United States Patent 7,250,496 (BIOINFORMATICALLY DETECTABLE GROUP OF NOVEL REGULATORY GENES AND USES THEREOF) - sequence listing, part 8

SEQ ID NO: 286186 - RNA, 22 nt, Human
aauguacagacucucaagcaac

SEQ ID NO: 286187 - RNA, 24 nt, Human
aauuauugaagucgacacuaagcc

SEQ ID NO: 286188 - RNA, 18 nt, Human
aauugccuaggaccucaa

SEQ ID NO: 286189 - RNA, 18 nt, Human
acacagagccacucagac

SEQ ID NO: 286190 - RNA, 25 nt, Human
acaccuggaacacugacaagucauc

SEQ ID NO: 286191 - RNA, 20 nt, Human
acagagccacucagacacca

SEQ ID NO: 286192 - RNA, 23 nt, Human
acagcaacaccuuuauuacuagc

SEQ ID NO: 286193 - RNA, 22 nt, Human
accucgggccccagaauccaac

SEQ ID NO: 286194 - RNA, 23 nt, Human
accuggaacacugacaagucauc

SEQ ID NO: 286195 - RNA, 26 nt, Human
acuuugcagaagcaggcugcauugug

SEQ ID NO: 286196 - RNA, 18 nt, Human
agcagguuaccaguaagg

SEQ ID NO: 286197 - RNA, 21 nt, Human
agccuuuuaaaaaacaaacag

SEQ ID NO: 286198 - RNA, 19 nt, Human
agcugacuuaaaauugccc

SEQ ID NO: 286199 - RNA, 18 nt, Human
aggaaauaaaaaauccaa

SEQ ID NO: 286200 - RNA, 21 nt, Human
aggaauucucucaauuaugaa

SEQ ID NO: 286201 - RNA, 24 nt, Human
aggcgacggcggcagcggcgggcu

SEQ ID NO: 286202 - RNA, 23 nt, Human
aggcugcauugugaacggggcag

SEQ ID NO: 286203 - RNA, 20 nt, Human
agggcucgccugugcuuccu

SEQ ID NO: 286204 - RNA, 22 nt, Human
agguuaccaguaaggugucagc

SEQ ID NO: 286205 - RNA, 18 nt, Human
auccugaaggauaacacc

SEQ ID NO: 286206 - RNA, 18 nt, Human
caacacagaggcgauggg

SEQ ID NO: 286207 - RNA, 26 nt, Human
caacauaaaauugaucuguccguucu

SEQ ID NO: 286208 - RNA, 19 nt, Human
caacugccucucacaggcu

SEQ ID NO: 286209 - RNA, 23 nt, Human
caauccugaaggauaacaccaga

SEQ ID NO: 286210 - RNA, 26 nt, Human
cacacagagccacucagacaccaccg

SEQ ID NO: 286211 - RNA, 19 nt, Human
cacagcaacaauucucuuu

SEQ ID NO: 286212 - RNA, 19 nt, Human
cagaauccaacaaggccga

SEQ ID NO: 286213 - RNA, 18 nt, Human
cagacucucaagcaacaa

SEQ ID NO: 286214 - RNA, 22 nt, Human
cagagaaacgaucaaaauuaga

SEQ ID NO: 286215 - RNA, 20 nt, Human
cagcaacaccuuuauuacua

SEQ ID NO: 286216 - RNA, 24 nt, Human
cagguugaaaaauggguuaaagua

SEQ ID NO: 286217 - RNA, 22 nt, Human
cagugacauuguggggugacac

SEQ ID NO: 286218 - RNA, 20 nt, Human
cauguuguucaucaucucag

SEQ ID NO: 286219 - RNA, 18 nt, Human
cauuccauggcaguggau

SEQ ID NO: 286220 - RNA, 20 nt, Human
cauugugaacggggcagggg

SEQ ID NO: 286221 - RNA, 20 nt, Human
ccaguggagacucuaacguc

SEQ ID NO: 286222 - RNA, 19 nt, Human
cccagaauccaacaaggcc

SEQ ID NO: 286223 - RNA, 19 nt, Human
ccugcagucaggcuguugg

SEQ ID NO: 286224 - RNA, 21 nt, Human
ccugcagucaggcuguugggc

SEQ ID NO: 286225 - RNA, 21 nt, Human
cgaccucgggccccagaaucc

SEQ ID NO: 286226 - RNA, 20 nt, Human
cggcggcagcggcgggcucg

SEQ ID NO: 286227 - RNA, 24 nt, Human
cucacaaccacuacuacuucuguu

SEQ ID NO: 286228 - RNA, 19 nt, Human
cucaguggcuccaccucug

SEQ ID NO: 286229 - RNA, 26 nt, Human
cucgaccucgggccccagaauccaac

SEQ ID NO: 286230 - RNA, 27 nt, Human
cucugcuucuaagaaaaaucacucauu

SEQ ID NO: 286231 - RNA, 20 nt, Human
cugaaucaucuucccagucu

SEQ ID NO: 286232 - RNA, 22 nt, Human
cuuacugccagcaccaacugcc

SEQ ID NO: 286233 - RNA, 18 nt, Human
cuucacacagagccacuc

SEQ ID NO: 286234 - RNA, 25 nt, Human
cuucacacagagccacucagacacc

SEQ ID NO: 286235 - RNA, 22 nt, Human
gaaaaaucacucauuccauggc

SEQ ID NO: 286236 - RNA, 23 nt, Human
gacuaaauguacagacucucaag

SEQ ID NO: 286237 - RNA, 19 nt, Human
gaucaugggacugggaagg

SEQ ID NO: 286238 - RNA, 21 nt, Human
gcgacggcggcagcggcgggc

SEQ ID NO: 286239 - RNA, 20 nt, Human
ggaaggaggggcgugggcgg

SEQ ID NO: 286240 - RNA, 24 nt, Human
ggacugggaaggaggggcgugggc

SEQ ID NO: 286241 - RNA, 18 nt, Human
ggcuggggugaucauggg

SEQ ID NO: 286242 - RNA, 19 nt, Human
gggaccagugagcacgugc

SEQ ID NO: 286243 - RNA, 27 nt, Human
gggcgggccucucuggcggcggcugcu

SEQ ID NO: 286244 - RNA, 20 nt, Human
ggggcgugggcgguagagcu

SEQ ID NO: 286245 - RNA, 22 nt, Human
uaaaaaacaaacagguugaaaa

SEQ ID NO: 286246 - RNA, 23 nt, Human
uaaaaaacaaacagguugaaaaa

SEQ ID NO: 286247 - RNA, 18 nt, Human
uaaaguaggcaaauacag

SEQ ID NO: 286248 - RNA, 20 nt, Human
uaaaguaggcaaauacagca

SEQ ID NO: 286249 - RNA, 20 nt, Human
uaagagauguaaaagcuuaa

SEQ ID NO: 286250 - RNA, 24 nt, Human
uaaggugucagccaauuuguucca

SEQ ID NO: 286251 - RNA, 20 nt, Human
uaaguagacgggagcaagug

SEQ ID NO: 286252 - RNA, 22 nt, Human
uacagcauaucugccuuuagag

SEQ ID NO: 286253 - RNA, 20 nt, Human
uacagcuuucuucguccucc

SEQ ID NO: 286254 - RNA, 19 nt, Human
uacauccucaucaccaccc

SEQ ID NO: 286255 - RNA, 18 nt, Human
uagcugacuuaaaauugc

SEQ ID NO: 286256 - RNA, 18 nt, Human
uaugaagaaaaggagacu

SEQ ID NO: 286257 - RNA, 24 nt, Human
uauuuuucuuucucaaaauccagg

SEQ ID NO: 286258 - RNA, 26 nt, Human
ucacacagagccacucagacaccaca

SEQ ID NO: 286259 - RNA, 22 nt, Human
ucauuugccauacugacagugc

SEQ ID NO: 286260 - RNA, 20 nt, Human
uccaacaaggccgacucgau

SEQ ID NO: 286261 - RNA, 21 nt, Human
uccagucacuuuugaauccau

SEQ ID NO: 286262 - RNA, 22 nt, Human
ucgcggccucuucucgcuuccc

SEQ ID NO: 286263 - RNA, 21 nt, Human
ucuacauccucaucaccaccc

SEQ ID NO: 286264 - RNA, 20 nt, Human
ucuucaucugaaucaucuuc

SEQ ID NO: 286265 - RNA, 21 nt, Human
ucuugugaaucaucaucugcu

SEQ ID NO: 286266 - RNA, 21 nt, Human
ucuuuuguuaaccuuggccau

SEQ ID NO: 286267 - RNA, 24 nt, Human
ugacagugcaaauacaaaucugga

SEQ ID NO: 286268 - RNA, 20 nt, Human
ugacuggccagauucuccuu

SEQ ID NO: 286269 - RNA, 23 nt, Human
ugcauugugaacggggcaggggg

SEQ ID NO: 286270 - RNA, 19 nt, Human
ugccuaggaccucaacagc

SEQ ID NO: 286271 - RNA, 21 nt, Human
ugcuggggagggcucgccugu

SEQ ID NO: 286272 - RNA, 21 nt, Human
uggaacacugacaagucauca

SEQ ID NO: 286273 - RNA, 22 nt, Human
uggaucaauacagugaaaaaga

SEQ ID NO: 286274 - RNA, 18 nt, Human
uggugggcgggccucucu

SEQ ID NO: 286275 - RNA, 21 nt, Human
ugucaugaacauaaauugagg

SEQ ID NO: 286276 - RNA, 20 nt, Human
ugugaacggggcagggggac

SEQ ID NO: 286277 - RNA, 21 nt, Human
ugugaacggggcagggggacg

SEQ ID NO: 286278 - RNA, 23 nt, Human
uuaacauccuuacugucuucaac

SEQ ID NO: 286279 - RNA, 21 nt, Human
uuaaccuuggccaugacuggc

SEQ ID NO: 286280 - RNA, 19 nt, Human
uuccaggaguuucuuauau

SEQ ID NO: 286281 - RNA, 21 nt, Human
uuccugcagucaggcuguugg

SEQ ID NO: 286282 - RNA, 19 nt, Human
uucuguuuucucucucuca

SEQ ID NO: 286283 - RNA, 23 nt, Human
uugcccgggagggugcgauaagg

SEQ ID NO: 286284 - RNA, 18 nt, Human
uuuuuuuuuuuuuuuuug

SEQ ID NO: 286285 - RNA, 22 nt, Human
uuuuuuuuuuuuuuuuugacgg

SEQ ID NO: 286286 - RNA, 19 nt, Human
aaacaacuucacuacaaga

SEQ ID NO: 286287 - RNA, 19 nt, Human
aagcuucuauaaacaguuc

SEQ ID NO: 286288 - RNA, 21 nt, Human
aauuagaauguauacaaagua

SEQ ID NO: 286289 - RNA, 22 nt, Human
acacaacuccaaguggcccgag

SEQ ID NO: 286290 - RNA, 19 nt, Human
acauuuaaaauacauagaa

SEQ ID NO: 286291 - RNA, 20 nt, Human
caaaaugcuucaaagauuaa

SEQ ID NO: 286292 - RNA, 21 nt, Human
caacuucacuacaagaaauac

SEQ ID NO: 286293 - RNA, 23 nt, Human
cauuuuuauuucuaaaugcugag

SEQ ID NO: 286294 - RNA, 22 nt, Human
ccacacugauagcaacaaugac

SEQ ID NO: 286295 - RNA, 18 nt, Human
ccuccgguggccacugcc

SEQ ID NO: 286296 - RNA, 19 nt, Human
ccuuagcuuuggaguacac

SEQ ID NO: 286297 - RNA, 21 nt, Human
cgccaugaggagggacugcuc

SEQ ID NO: 286298 - RNA, 23 nt, Human
cgccaugaggagggacugcucca

SEQ ID NO: 286299 - RNA, 23 nt, Human
cgguggccacugccaucuuccuc

SEQ ID NO: 286300 - RNA, 19 nt, Human
gaacuugauuuugcuagca

SEQ ID NO: 286301 - RNA, 19 nt, Human
gccaucuuccucaucacug

SEQ ID NO: 286302 - RNA, 22 nt, Human
uaagcccaaaaugcuucaaaga

SEQ ID NO: 286303 - RNA, 22 nt, Human
uacaaaguagauuacaaaacaa

SEQ ID NO: 286304 - RNA, 20 nt, Human
uacaugaucagaucauggaa

SEQ ID NO: 286305 - RNA, 24 nt, Human
uagacucuaucaaauuccacacug

SEQ ID NO: 286306 - RNA, 24 nt, Human
uauccaagcacaaaaauguggaag

SEQ ID NO: 286307 - RNA, 21 nt, Human
ucaucacuguccuuagcuuug

SEQ ID NO: 286308 - RNA, 23 nt, Human
ucuuccucaucacuguccuuagc

SEQ ID NO: 286309 - RNA, 18 nt, Human
ugagaaggcauggacuac

SEQ ID NO: 286310 - RNA, 19 nt, Human
ugagugagaaggcauggac

SEQ ID NO: 286311 - RNA, 23 nt, Human
ugauagcaacaaugacugcaucu

SEQ ID NO: 286312 - RNA, 22 nt, Human
ugccaucuuccucaucacuguc

SEQ ID NO: 286313 - RNA, 22 nt, Human
ugcuccaguccuccgguggcca

SEQ ID NO: 286314 - RNA, 21 nt, Human
uggaaggauagcuccacuccu

SEQ ID NO: 286315 - RNA, 26 nt, Human
uguccuuagcuuuggaguacacaacu

SEQ ID NO: 286316 - RNA, 18 nt, Human
ugugcugcuggcaaucuu

SEQ ID NO: 286317 - RNA, 18 nt, Human
uucaaagauuaaacagcc

SEQ ID NO: 286318 - RNA, 26 nt, Human
uuccacacugauagcaacaaugacug

SEQ ID NO: 286319 - RNA, 24 nt, Human
uucucaagcuucuauaaacaguuc

SEQ ID NO: 286320 - RNA, 18 nt, Human
aggaagccagaguaucaa

SEQ ID NO: 286321 - RNA, 23 nt, Human
aggaagccagaguaucaagagca

SEQ ID NO: 286322 - RNA, 19 nt, Human
aggcaggguccucuguggc

SEQ ID NO: 286323 - RNA, 19 nt, Human
cagaagggggcccaguggu

SEQ ID NO: 286324 - RNA, 20 nt, Human
cagaagggggcccaguggug

SEQ ID NO: 286325 - RNA, 18 nt, Human
ccccauuccuccaacccc

SEQ ID NO: 286326 - RNA, 19 nt, Human
ccucaggagagggaggucc

SEQ ID NO: 286327 - RNA, 19 nt, Human
ccucaggagagggaggucc

SEQ ID NO: 286328 - RNA, 22 nt, Human
gaauucgauuucccaugccccc

SEQ ID NO: 286329 - RNA, 24 nt, Human
ggacaggaagccagaguaucaaga

SEQ ID NO: 286330 - RNA, 22 nt, Human
ggacaggcuccccauuccucca

SEQ ID NO: 286331 - RNA, 23 nt, Human
gugguggccucaggagagggagg

SEQ ID NO: 286332 - RNA, 27 nt, Human
uaucaagagcagagaaucucacuagga

SEQ ID NO: 286333 - RNA, 18 nt, Human
ugaguguggggcccugga

SEQ ID NO: 286334 - RNA, 18 nt, Human
uguggggcccuggaaaga

SEQ ID NO: 286335 - RNA, 21 nt, Human
agaaauuucucuggggugaug

SEQ ID NO: 286336 - RNA, 19 nt, Human
auggggcuguggagagccc

SEQ ID NO: 286337 - RNA, 18 nt, Human
caaacagauccugcacac

SEQ ID NO: 286338 - RNA, 19 nt, Human
cagauccugcacacaacac

SEQ ID NO: 286339 - RNA, 21 nt, Human
cagauccugcacacaacacac

SEQ ID NO: 286340 - RNA, 20 nt, Human
caggagcugcuggggaaccc

SEQ ID NO: 286341 - RNA, 19 nt, Human
cccuccuccuccucucugu

SEQ ID NO: 286342 - RNA, 21 nt, Human
ccugcacacaacacacaggag

SEQ ID NO: 286343 - RNA, 18 nt, Human
cgagugggcaaacagauc

SEQ ID NO: 286344 - RNA, 23 nt, Human
cuccugggccgagugggcaaaca

SEQ ID NO: 286345 - RNA, 19 nt, Human
gagcugcuggggaacccug

SEQ ID NO: 286346 - RNA, 19 nt, Human
ggccgagugggcaaacaga

SEQ ID NO: 286347 - RNA, 22 nt, Human
ggcuguggagagcccaggugug

SEQ ID NO: 286348 - RNA, 18 nt, Human
guggagagcccaggugug

SEQ ID NO: 286349 - RNA, 19 nt, Human
ucucccuccuccuccucuc

SEQ ID NO: 286350 - RNA, 24 nt, Human
ucuguucuuugauggggcugugga

SEQ ID NO: 286351 - RNA, 18 nt, Human
ugcacacaacacacagga

SEQ ID NO: 286352 - RNA, 19 nt, Human
aaagcgcugggauuacaga

SEQ ID NO: 286353 - RNA, 24 nt, Human
aaagcgcugggauuacagacguga

SEQ ID NO: 286354 - RNA, 26 nt, Human
aagcgcugggauuacagacgugagcc

SEQ ID NO: 286355 - RNA, 21 nt, Human
acgugagccacggugccuggc

SEQ ID NO: 286356 - RNA, 24 nt, Human
agcgcugggauuacagacgugagc

SEQ ID NO: 286357 - RNA, 24 nt, Human
aggugaucugccugccucggccuc

SEQ ID NO: 286358 - RNA, 18 nt, Human
aguagcugggauugcagg

SEQ ID NO: 286359 - RNA, 24 nt, Human
agugauucuugugccucagccucc

SEQ ID NO: 286360 - RNA, 21 nt, Human
auugcaggugcaugccaccau

SEQ ID NO: 286361 - RNA, 22 nt, Human
auuuuuguauuuuuaguacaga

SEQ ID NO: 286362 - RNA, 24 nt, Human
caaagcgcugggauuacagacgug

SEQ ID NO: 286363 - RNA, 22 nt, Human
caagugauucuugugccucagc

SEQ ID NO: 286364 - RNA, 28 nt, Human
caagugauucuugugccucagccucccg

SEQ ID NO: 286365 - RNA, 24 nt, Human
caccaugucuggcugauuuuugua

SEQ ID NO: 286366 - RNA, 21 nt, Human
cacuacaaccucugccucccg

SEQ ID NO: 286367 - RNA, 23 nt, Human
cacuacaaccucugccucccggg

SEQ ID NO: 286368 - RNA, 21 nt, Human
cagagcucuacucuuccugac

SEQ ID NO: 286369 - RNA, 22 nt, Human
caggugaucugccugccucggc

SEQ ID NO: 286370 - RNA, 24 nt, Human
ccaaagcgcugggauuacagacgu

SEQ ID NO: 286371 - RNA, 21 nt, Human
cccgaccucaggugaucugcc

SEQ ID NO: 286372 - RNA, 23 nt, Human
cccgaccucaggugaucugccug

SEQ ID NO: 286373 - RNA, 23 nt, Human
cccgaguagcugggauugcaggu

SEQ ID NO: 286374 - RNA, 24 nt, Human
cccgaguagcugggauugcaggug

SEQ ID NO: 286375 - RNA, 19 nt, Human
ccucccaggcuggagagca

SEQ ID NO: 286376 - RNA, 22 nt, Human
ccugacagggccacagcaagcc

SEQ ID NO: 286377 - RNA, 23 nt, Human
ccugacagggccacagcaagccc

SEQ ID NO: 286378 - RNA, 21 nt, Human
ccugccucggccucccaaagc

SEQ ID NO: 286379 - RNA, 24 nt, Human
ccugccucggccucccaaagcgcu

SEQ ID NO: 286380 - RNA, 18 nt, Human
cgaccucaggugaucugc

SEQ ID NO: 286381 - RNA, 20 nt, Human
cgaccucaggugaucugccu

SEQ ID NO: 286382 - RNA, 24 nt, Human
cgccuuguuagccaggcgggucuc

SEQ ID NO: 286383 - RNA, 24 nt, Human
cgcugggauuacagacgugagcca

SEQ ID NO: 286384 - RNA, 23 nt, Human
cuacaaccucugccucccggguu

SEQ ID NO: 286385 - RNA, 24 nt, Human
cuacaaccucugccucccggguuc

SEQ ID NO: 286386 - RNA, 24 nt, Human
cucacuacaaccucugccucccgg

SEQ ID NO: 286387 - RNA, 24 nt, Human
cucagccucccgaguagcugggau

SEQ ID NO: 286388 - RNA, 26 nt, Human
cucccgaccucaggugaucugccugc

SEQ ID NO: 286389 - RNA, 20 nt, Human
cucccggguucaagugauuc

SEQ ID NO: 286390 - RNA, 23 nt, Human
cugccucccggguucaagugauu

SEQ ID NO: 286391 - RNA, 25 nt, Human
cuugugccucagccucccgaguagc

SEQ ID NO: 286392 - RNA, 18 nt, Human
gacaggauuucgccuugu

SEQ ID NO: 286393 - RNA, 23 nt, Human
gaccucaggugaucugccugccu

SEQ ID NO: 286394 - RNA, 24 nt, Human
gaccucaggugaucugccugccuc

SEQ ID NO: 286395 - RNA, 21 nt, Human
gagcaguggcacaaucugggc

SEQ ID NO: 286396 - RNA, 26 nt, Human
gaguagcugggauugcaggugcaugc

SEQ ID NO: 286397 - RNA, 18 nt, Human
gauuacagacgugagcca

SEQ ID NO: 286398 - RNA, 19 nt, Human
gauuacagacgugagccac

SEQ ID NO: 286399 - RNA, 19 nt, Human
gauuacagacgugagccac

SEQ ID NO: 286400 - RNA, 24 nt, Human
gauugcaggugcaugccaccaugu

SEQ ID NO: 286401 - RNA, 21 nt, Human
gcucacuacaaccucugccuc

SEQ ID NO: 286402 - RNA, 24 nt, Human
gugauucuugugccucagccuccc

SEQ ID NO: 286403 - RNA, 22 nt, Human
gugccucagccucccgaguagc

SEQ ID NO: 286404 - RNA, 22 nt, Human
uacagacaggauuucgccuugu

SEQ ID NO: 286405 - RNA, 24 nt, Human
uaguacagacaggauuucgccuug

SEQ ID NO: 286406 - RNA, 24 nt, Human
ucacuacaaccucugccucccggg

SEQ ID NO: 286407 - RNA, 25 nt, Human
ucacuacaaccucugccucccgggu

SEQ ID NO: 286408 - RNA, 20 nt, Human
ucagccucccgaguagcugg

SEQ ID NO: 286409 - RNA, 18 nt, Human
ucccaaagcgcugggauu

SEQ ID NO: 286410 - RNA, 23 nt, Human
ucccaggcuggagagcaguggca

SEQ ID NO: 286411 - RNA, 23 nt, Human
ucccgaguagcugggauugcagg

SEQ ID NO: 286412 - RNA, 24 nt, Human
ucccgaguagcugggauugcaggu

SEQ ID NO: 286413 - RNA, 20 nt, Human
ucccggguucaagugauucu

SEQ ID NO: 286414 - RNA, 20 nt, Human
ucccggguucaagugauucu

SEQ ID NO: 286415 - RNA, 23 nt, Human
ucgccuuguuagccaggcggguc

SEQ ID NO: 286416 - RNA, 20 nt, Human
ugauucuugugccucagccu

SEQ ID NO: 286417 - RNA, 24 nt, Human
ugccucagccucccgaguagcugg

SEQ ID NO: 286418 - RNA, 22 nt, Human
ugccucccggguucaagugauu

SEQ ID NO: 286419 - RNA, 21 nt, Human
ugccucggccucccaaagcgc

SEQ ID NO: 286420 - RNA, 24 nt, Human
ugccucggccucccaaagcgcugg

SEQ ID NO: 286421 - RNA, 23 nt, Human
uggagagcaguggcacaaucugg

SEQ ID NO: 286422 - RNA, 24 nt, Human
uggcacaaucugggcucacuacaa

SEQ ID NO: 286423 - RNA, 18 nt, Human
ugggauuacagacgugag

SEQ ID NO: 286424 - RNA, 19 nt, Human
ugggauuacagacgugagc

SEQ ID NO: 286425 - RNA, 21 nt, Human
ugggauuacagacgugagcca

SEQ ID NO: 286426 - RNA, 22 nt, Human
ugggauuacagacgugagccac

SEQ ID NO: 286427 - RNA, 23 nt, Human
ugggauuacagacgugagccacg

SEQ ID NO: 286428 - RNA, 27 nt, Human
ugggauuacagacgugagccacggugc

SEQ ID NO: 286429 - RNA, 21 nt, Human
ugggauugcaggugcaugcca

SEQ ID NO: 286430 - RNA, 22 nt, Human
ugggauugcaggugcaugccac

SEQ ID NO: 286431 - RNA, 24 nt, Human
ugggauugcaggugcaugccacca

SEQ ID NO: 286432 - RNA, 24 nt, Human
ugugccucagccucccgaguagcu

SEQ ID NO: 286433 - RNA, 23 nt, Human
uucaagugauucuugugccucag

SEQ ID NO: 286434 - RNA, 20 nt, Human
uuuuuguauuuuuaguacag

SEQ ID NO: 286435 - RNA, 23 nt, Human
uuuuuguauuuuuaguacagaca

SEQ ID NO: 286436 - RNA, 22 nt, Human
uuuuuuuuuuuuuuuuuuuggg

SEQ ID NO: 286437 - RNA, 22 nt, Human
aaaaugucuucugcccacccca

SEQ ID NO: 286438 - RNA, 20 nt, Human
aaacaauaaaggcuagauaa

SEQ ID NO: 286439 - RNA, 20 nt, Human
aaacccaaacaagcuaagug

SEQ ID NO: 286440 - RNA, 22 nt, Human
aaaguacuugauucuguuaagc

SEQ ID NO: 286441 - RNA, 24 nt, Human
aacagccccaguacucaugugcac

SEQ ID NO: 286442 - RNA, 18 nt, Human
aagacacugaaaaaaaca

SEQ ID NO: 286443 - RNA, 24 nt, Human
aagacacugaaaaaaacaccccgc

SEQ ID NO: 286444 - RNA, 20 nt, Human
aagcaaacccaaacaagcua

SEQ ID NO: 286445 - RNA, 21 nt, Human
aagcaaacccaaacaagcuaa

SEQ ID NO: 286446 - RNA, 20 nt, Human
aaguugcagggggcuaguuu

SEQ ID NO: 286447 - RNA, 18 nt, Human
acaaggaaaauacaugca

SEQ ID NO: 286448 - RNA, 22 nt, Human
acacacuuuaaacagaaaagcc

SEQ ID NO: 286449 - RNA, 18 nt, Human
agaaaagccugcacauuu

SEQ ID NO: 286450 - RNA, 23 nt, Human
agaaauaacuggaaaacaaucac

SEQ ID NO: 286451 - RNA, 27 nt, Human
agagacugugaaagcaaacccaaacaa

SEQ ID NO: 286452 - RNA, 23 nt, Human
agagagguguuuggagauucuug

SEQ ID NO: 286453 - RNA, 21 nt, Human
agagggcagcggcggccaggg

SEQ ID NO: 286454 - RNA, 18 nt, Human
agauaaaccacaaacuca

SEQ ID NO: 286455 - RNA, 19 nt, Human
agauaaaccacaaacucaa

SEQ ID NO: 286456 - RNA, 25 nt, Human
aggcaaaagagaaaguaaagggacc

SEQ ID NO: 286457 - RNA, 22 nt, Human
aggcuuuuaaauucauuagcuu

SEQ ID NO: 286458 - RNA, 22 nt, Human
aucaaaaacagccccaguacuc

SEQ ID NO: 286459 - RNA, 24 nt, Human
aucaaaaacagccccaguacucau

SEQ ID NO: 286460 - RNA, 19 nt, Human
caccccgcucagagaucca

SEQ ID NO: 286461 - RNA, 22 nt, Human
cacugaaaaaaacaccccgcuc

SEQ ID NO: 286462 - RNA, 20 nt, Human
cauugcacagcaguggggca

SEQ ID NO: 286463 - RNA, 23 nt, Human
ccaguacgauaauauaugcaggc

SEQ ID NO: 286464 - RNA, 18 nt, Human
cccaauauauaaugagac

SEQ ID NO: 286465 - RNA, 18 nt, Human
cggccaggggcgcagcaa

SEQ ID NO: 286466 - RNA, 25 nt, Human
cuaaaaugucuucugcccaccccag

SEQ ID NO: 286467 - RNA, 20 nt, Human
gaagagagacugugaaagca

SEQ ID NO: 286468 - RNA, 18 nt, Human
gagagggcagcggcggcc

SEQ ID NO: 286469 - RNA, 24 nt, Human
gcaucggaaaagccagcgagcgga

SEQ ID NO: 286470 - RNA, 19 nt, Human
gcuaaguguggaugugggc

SEQ ID NO: 286471 - RNA, 23 nt, Human
gcucagagauccauugaucugau

SEQ ID NO: 286472 - RNA, 24 nt, Human
uaacuagguaguauuguuuuauua

SEQ ID NO: 286473 - RNA, 21 nt, Human
uaagcauccuaccauauuaca

SEQ ID NO: 286474 - RNA, 21 nt, Human
uaauauaugcaggcuuucccc

SEQ ID NO: 286475 - RNA, 18 nt, Human
uacagaugugagugaaca

SEQ ID NO: 286476 - RNA, 24 nt, Human
uacuguggauuuuaaaaaaacaau

SEQ ID NO: 286477 - RNA, 27 nt, Human
ucaaacauuuagcacccaauauauaau

SEQ ID NO: 286478 - RNA, 25 nt, Human
ucauacauuugagaguauacuugga

SEQ ID NO: 286479 - RNA, 19 nt, Human
ucggaaaagccagcgagcg

SEQ ID NO: 286480 - RNA, 18 nt, Human
ucuaaaaugucuucugcc

SEQ ID NO: 286481 - RNA, 22 nt, Human
ucugcccaccccaguugcuuca

SEQ ID NO: 286482 - RNA, 24 nt, Human
ugaaaaaaacaccccgcucagaga

SEQ ID NO: 286483 - RNA, 24 nt, Human
ugaacugaugaguuuaguguuuug

SEQ ID NO: 286484 - RNA, 19 nt, Human
ugacugucaaccucuccuu

SEQ ID NO: 286485 - RNA, 19 nt, Human
ugagaguauacuuggaggc

SEQ ID NO: 286486 - RNA, 23 nt, Human
ugaucugaugccggaugaacuga

SEQ ID NO: 286487 - RNA, 23 nt, Human
ugcacauuuuaaaggcaaaagag

SEQ ID NO: 286488 - RNA, 24 nt, Human
uggaaaacaaucacuuuucaggcu

SEQ ID NO: 286489 - RNA, 18 nt, Human
uggaacacaaacaaaguc

SEQ ID NO: 286490 - RNA, 21 nt, Human
uggaacacaaacaaaguccua

SEQ ID NO: 286491 - RNA, 20 nt, Human
ugguggaagcaagagucuuc

SEQ ID NO: 286492 - RNA, 27 nt, Human
uguccaauauccuucaacuuacuaaca

SEQ ID NO: 286493 - RNA, 20 nt, Human
ugugggcauuucuacuucua

SEQ ID NO: 286494 - RNA, 23 nt, Human
uucugcccaccccaguugcuuca

SEQ ID NO: 286495 - RNA, 18 nt, Human
uuuaaaggcaaaagagaa

SEQ ID NO: 286496 - RNA, 24 nt, Human
uuugcaauucuuaaaauuguuuuu

SEQ ID NO: 286497 - RNA, 22 nt, Human
uuuucaggcuuuuaaauucauu

SEQ ID NO: 286498 - RNA, 24 nt, Human
cugcagaguggcaucugguauuuu

SEQ ID NO: 286499 - RNA, 22 nt, Human
cuggacaugagaaaguguucug

SEQ ID NO: 286500 - RNA, 18 nt, Human
gagaaaguguucuguucu

SEQ ID NO: 286501 - RNA, 18 nt, Human
uagaggauuuccugaguu

SEQ ID NO: 286502 - RNA, 24 nt, Human
uaguuuaguugccaaaccucuuug

SEQ ID NO: 286503 - RNA, 21 nt, Human
ugagaaaguguucuguucugc

SEQ ID NO: 286504 - RNA, 24 nt, Human
ugagugcucuuguaaucugacccu

SEQ ID NO: 286505 - RNA, 22 nt, Human
ugaguuuucgucaguaaagucu

SEQ ID NO: 286506 - RNA, 19 nt, Human
ugauucuggaggguuugaa

SEQ ID NO: 286507 - RNA, 20 nt, Human
uuagagucauuauuauuaac

SEQ ID NO: 286508 - RNA, 22 nt, Human
uuccugaguuuucgucaguaaa

SEQ ID NO: 286509 - RNA, 24 nt, Human
uucuguucugcagcuccugucuuc

SEQ ID NO: 286510 - RNA, 19 nt, Human
uuuuuuuuuuuuuguuucu

SEQ ID NO: 286511 - RNA, 22 nt, Human
uuuuuuuuuuuuuuuuuuguuu

SEQ ID NO: 286512 - RNA, 27 nt, Human
uuuuuuuuuuuuuuuuuuuuuuugggg

SEQ ID NO: 286513 - RNA, 22 nt, Human
aaacaggaaaaacaggucccca

SEQ ID NO: 286514 - RNA, 18 nt, Human
aaacagguccccaggccu

SEQ ID NO: 286515 - RNA, 23 nt, Human
acaggaaaaacagguccccaggc

SEQ ID NO: 286516 - RNA, 25 nt, Human
agcuaaguccaccguggcacccagu

SEQ ID NO: 286517 - RNA, 23 nt, Human
aggaugcucagcgccugcacggg

SEQ ID NO: 286518 - RNA, 18 nt, Human
caccccagguagcucagc

SEQ ID NO: 286519 - RNA, 18 nt, Human
cacgcccagccuccagca

SEQ ID NO: 286520 - RNA, 21 nt, Human
cacugcgcugcgcuucuccuc

SEQ ID NO: 286521 - RNA, 23 nt, Human
cauuccagaccacugugcaaacu

SEQ ID NO: 286522 - RNA, 21 nt, Human
ccacaaggggcuccucucgcc

SEQ ID NO: 286523 - RNA, 22 nt, Human
ccaccuuccucucugggccugu

SEQ ID NO: 286524 - RNA, 21 nt, Human
ccacugugcaaacucagcccu

SEQ ID NO: 286525 - RNA, 25 nt, Human
ccaggguuuucuggccaaccuguga

SEQ ID NO: 286526 - RNA, 18 nt, Human
ccccagguagcucagcuc

SEQ ID NO: 286527 - RNA, 24 nt, Human
cccccaacuuauacacacaaacga

SEQ ID NO: 286528 - RNA, 22 nt, Human
cccugaccagccccugcucucc

SEQ ID NO: 286529 - RNA, 27 nt, Human
ccuccagcauuuuucuggggggccgcc

SEQ ID NO: 286530 - RNA, 19 nt, Human
ccuggaccgggcugcaggg

SEQ ID NO: 286531 - RNA, 22 nt, Human
cugcacaggcugaaguguucug

SEQ ID NO: 286532 - RNA, 20 nt, Human
cugcgcugcgcuucuccucu

SEQ ID NO: 286533 - RNA, 20 nt, Human
cugggccuguuucuccauuu

SEQ ID NO: 286534 - RNA, 27 nt, Human
cuuggcccccaccccagguagcucagc

SEQ ID NO: 286535 - RNA, 22 nt, Human
gaaaaacagguccccaggccug

SEQ ID NO: 286536 - RNA, 19 nt, Human
gcccaugggagccuccagg

SEQ ID NO: 286537 - RNA, 22 nt, Human
gccuccagcauuuuucugggca

SEQ ID NO: 286538 - RNA, 24 nt, Human
ggaccuggaccgggcugcagggaa

SEQ ID NO: 286539 - RNA, 22 nt, Human
ggggucauccagcaugagucac

SEQ ID NO: 286540 - RNA, 24 nt, Human
ggggucauccagcaugagucacug

SEQ ID NO: 286541 - RNA, 19 nt, Human
ggggugucauugaccuuga

SEQ ID NO: 286542 - RNA, 18 nt, Human
uagcaggcaacacaaccu

SEQ ID NO: 286543 - RNA, 21 nt, Human
uagcucagcuccagacucugg

SEQ ID NO: 286544 - RNA, 21 nt, Human
ucacacugcuccuagcccaug

SEQ ID NO: 286545 - RNA, 21 nt, Human
ucacugaugguccauaucugg

SEQ ID NO: 286546 - RNA, 28 nt, Human
ucagcccucauuacuuaccaggguuuuc

SEQ ID NO: 286547 - RNA, 18 nt, Human
uccagcauuuuucugggc

SEQ ID NO: 286548 - RNA, 21 nt, Human
ucccaauauaaaccugcacag

SEQ ID NO: 286549 - RNA, 28 nt, Human
uccccaggccuggggccacgcccagccu

SEQ ID NO: 286550 - RNA, 20 nt, Human
ugaaugcacacgccuggacc

SEQ ID NO: 286551 - RNA, 19 nt, Human
ugacuuggcccccacccca

SEQ ID NO: 286552 - RNA, 26 nt, Human
ugacuuggcccccaccccagguagcu

SEQ ID NO: 286553 - RNA, 19 nt, Human
ugcacacgccuggaccugg

SEQ ID NO: 286554 - RNA, 21 nt, Human
ugcacggguuccucacucaug

SEQ ID NO: 286555 - RNA, 19 nt, Human
uuaccaggguuuucuggcc

SEQ ID NO: 286556 - RNA, 22 nt, Human
uucccaauauaaaccugcacag

SEQ ID NO: 286557 - RNA, 18 nt, Human
aaacagggucuuacugug

SEQ ID NO: 286558 - RNA, 22 nt, Human
aaagugcuccccacuucugcuu

SEQ ID NO: 286559 - RNA, 23 nt, Human
aaauaugaaggcugcccaggacc

SEQ ID NO: 286560 - RNA, 24 nt, Human
aaauugcugagauuacaggcauga

SEQ ID NO: 286561 - RNA, 22 nt, Human
aaccaacacaggccugagcaca

SEQ ID NO: 286562 - RNA, 21 nt, Human
aaggccauguguccucugcuc

SEQ ID NO: 286563 - RNA, 26 nt, Human
aaucaucccucaaaacccagcucaaa

SEQ ID NO: 286564 - RNA, 18 nt, Human
acccccuccccccagcca

SEQ ID NO: 286565 - RNA, 22 nt, Human
acccugauguugcugugccagu

SEQ ID NO: 286566 - RNA, 21 nt, Human
acuccaugcccagcugagcug

SEQ ID NO: 286567 - RNA, 18 nt, Human
acucguggagcagccccu

SEQ ID NO: 286568 - RNA, 21 nt, Human
acucuugcccuugacuggagg

SEQ ID NO: 286569 - RNA, 24 nt, Human
acugucuguguacccccucccccc

SEQ ID NO: 286570 - RNA, 24 nt, Human
acuguguugcccaggcuggucuaa

SEQ ID NO: 286571 - RNA, 22 nt, Human
agaaccaacacaggccugagca

SEQ ID NO: 286572 - RNA, 18 nt, Human
agaagcucucaccucccc

SEQ ID NO: 286573 - RNA, 18 nt, Human
agagcucuuuccugacuc

SEQ ID NO: 286574 - RNA, 22 nt, Human
agauuacaggcaugagccacug

SEQ ID NO: 286575 - RNA, 24 nt, Human
agauuacaggcaugagccacugca

SEQ ID NO: 286576 - RNA, 21 nt, Human
agcucaaaugccccuucccag

SEQ ID NO: 286577 - RNA, 18 nt, Human
aggcugcccaggaccugg

SEQ ID NO: 286578 - RNA, 21 nt, Human
auggagcauaccuggguugcc

SEQ ID NO: 286579 - RNA, 24 nt, Human
caaaugccccuucccagaagcucu

SEQ ID NO: 286580 - RNA, 24 nt, Human
caaauugcugagauuacaggcaug

SEQ ID NO: 286581 - RNA, 24 nt, Human
caaguucccacucagcccucaaca

SEQ ID NO: 286582 - RNA, 19 nt, Human
cacagcacagagcuggcaa

SEQ ID NO: 286583 - RNA, 18 nt, Human
cacaggccugagcacaag

SEQ ID NO: 286584 - RNA, 22 nt, Human
cacccgcuucauuggugacuca

SEQ ID NO: 286585 - RNA, 20 nt, Human
cacugcacuucgcccccugc

SEQ ID NO: 286586 - RNA, 19 nt, Human
cagaagcucucaccucccc

SEQ ID NO: 286587 - RNA, 21 nt, Human
cagagagcucuuuccugacuc

SEQ ID NO: 286588 - RNA, 19 nt, Human
cagagcuggcaagcagcag

SEQ ID NO: 286589 - RNA, 20 nt, Human
cagcuggauaugcauggagc

SEQ ID NO: 286590 - RNA, 21 nt, Human
cagggaggccaagaguuagca

SEQ ID NO: 286591 - RNA, 24 nt, Human
cagggucuuacuguguugcccagg

SEQ ID NO: 286592 - RNA, 22 nt, Human
cauuggcuucccacugccugga

SEQ ID NO: 286593 - RNA, 23 nt, Human
ccaaauugcugagauuacaggca

SEQ ID NO: 286594 - RNA, 24 nt, Human
ccaaauugcugagauuacaggcau

SEQ ID NO: 286595 - RNA, 23 nt, Human
ccacucguggagcagccccugcu

SEQ ID NO: 286596 - RNA, 20 nt, Human
ccacugcacuucgcccccug

SEQ ID NO: 286597 - RNA, 22 nt, Human
ccacugcacuucgcccccugcc

SEQ ID NO: 286598 - RNA, 20 nt, Human
cccacugccuggagcaucug

SEQ ID NO: 286599 - RNA, 24 nt, Human
cccccagccaugcuucccucuguc

SEQ ID NO: 286600 - RNA, 21 nt, Human
ccccggacacaauggcaaaua

SEQ ID NO: 286601 - RNA, 19 nt, Human
cccucaaaacccagcucaa

SEQ ID NO: 286602 - RNA, 21 nt, Human
cccuccauuggcuucccacug

SEQ ID NO: 286603 - RNA, 25 nt, Human
cccuccucagagagcucuuuccuga

SEQ ID NO: 286604 - RNA, 24 nt, Human
cccucugucacaacccugauguug

SEQ ID NO: 286605 - RNA, 25 nt, Human
cccuugacuggaggguagcugaagc

SEQ ID NO: 286606 - RNA, 23 nt, Human
ccuccauuggcuucccacugccu

SEQ ID NO: 286607 - RNA, 20 nt, Human
ccuccuuccuuggccuccca

SEQ ID NO: 286608 - RNA, 21 nt, Human
ccuugaugacaguacacguca

SEQ ID NO: 286609 - RNA, 25 nt, Human
cgcuuaaucccuccauuggcuuccc

SEQ ID NO: 286610 - RNA, 23 nt, Human
cucaaaugccccuucccagaagc

SEQ ID NO: 286611 - RNA, 21 nt, Human
cucccaaauugcugagauuac

SEQ ID NO: 286612 - RNA, 23 nt, Human
cucuugggcucaagcauuccucc

SEQ ID NO: 286613 - RNA, 19 nt, Human
cuggguccugugagggauc

SEQ ID NO: 286614 - RNA, 22 nt, Human
cugucacaacccugauguugcu

SEQ ID NO: 286615 - RNA, 21 nt, Human
cuucccagaagcucucaccuc

SEQ ID NO: 286616 - RNA, 22 nt, Human
cuuuacaccaaugcugacccuc

SEQ ID NO: 286617 - RNA, 18 nt, Human
gaagcucucaccuccccc

SEQ ID NO: 286618 - RNA, 21 nt, Human
gaaggcugcccaggaccugga

SEQ ID NO: 286619 - RNA, 20 nt, Human
gacacaauggcaaauaugaa

SEQ ID NO: 286620 - RNA, 23 nt, Human
gacacaauggcaaauaugaaggc

SEQ ID NO: 286621 - RNA, 18 nt, Human
gaccuggggagaggaagu

SEQ ID NO: 286622 - RNA, 22 nt, Human
gagaacccugaagcuccagucc

SEQ ID NO: 286623 - RNA, 21 nt, Human
gaggaaaccgagagaccuggg

SEQ ID NO: 286624 - RNA, 18 nt, Human
gauuacaggcaugagcca

SEQ ID NO: 286625 - RNA, 22 nt, Human
gauuacaggcaugagccacugc

SEQ ID NO: 286626 - RNA, 21 nt, Human
gcccagcacgaggcuggccca

SEQ ID NO: 286627 - RNA, 18 nt, Human
gcuaacucuugcccuuga

SEQ ID NO: 286628 - RNA, 20 nt, Human
gcucucaccucccccucuca

SEQ ID NO: 286629 - RNA, 18 nt, Human
gcucuggcccucugccug

SEQ ID NO: 286630 - RNA, 18 nt, Human
ggagaggcagcagaugag

SEQ ID NO: 286631 - RNA, 23 nt, Human
ggagcauaccuggguugcauuaa

SEQ ID NO: 286632 - RNA, 24 nt, Human
gggccaggacucgaaucccgagaa

SEQ ID NO: 286633 - RNA, 22 nt, Human
uaaauggaauaucacuccucuc

SEQ ID NO: 286634 - RNA, 21 nt, Human
uacaggcaugagccacugcac

SEQ ID NO: 286635 - RNA, 21 nt, Human
uacuguguugcccaggcuggu

SEQ ID NO: 286636 - RNA, 22 nt, Human
uacuguguugcccaggcugguc

SEQ ID NO: 286637 - RNA, 22 nt, Human
uagaaacagggucuuacugugu

SEQ ID NO: 286638 - RNA, 21 nt, Human
uagcugaagcacagcucccau

SEQ ID NO: 286639 - RNA, 20 nt, Human
ucaaaacccagcucaaaugc

SEQ ID NO: 286640 - RNA, 21 nt, Human
ucaacaucuggcucagaugcu

SEQ ID NO: 286641 - RNA, 20 nt, Human
ucagggaggccaagaguuag

SEQ ID NO: 286642 - RNA, 18 nt, Human
ucaugggcacugucugug

SEQ ID NO: 286643 - RNA, 21 nt, Human
uccagagagcucauaaucauc

SEQ ID NO: 286644 - RNA, 24 nt, Human
uccaugcccagcugagcugaacuc

SEQ ID NO: 286645 - RNA, 24 nt, Human
ucccaaauugcugagauuacaggc

SEQ ID NO: 286646 - RNA, 23 nt, Human
ucccgagaacccugaagcuccag

SEQ ID NO: 286647 - RNA, 19 nt, Human
ucccucaaaacccagcuca

SEQ ID NO: 286648 - RNA, 20 nt, Human
ucccucaaaacccagcucaa

SEQ ID NO: 286649 - RNA, 20 nt, Human
uccucugcucuggcccucug

SEQ ID NO: 286650 - RNA, 18 nt, Human
ucucaagagccaggccca

SEQ ID NO: 286651 - RNA, 22 nt, Human
ucuccagagagcucauaaucau

SEQ ID NO: 286652 - RNA, 23 nt, Human
ucuccagagagcucauaaucauc

SEQ ID NO: 286653 - RNA, 20 nt, Human
ucuccaugcccacagggucu

SEQ ID NO: 286654 - RNA, 19 nt, Human
ucuuacuguguugcccagg

SEQ ID NO: 286655 - RNA, 23 nt, Human
ucuuacuguguugcccaggcugg

SEQ ID NO: 286656 - RNA, 24 nt, Human
ucuuacuguguugcccaggcuggu

SEQ ID NO: 286657 - RNA, 24 nt, Human
ugaagcuccaguccuuuacaccaa

SEQ ID NO: 286658 - RNA, 21 nt, Human
ugacugggaccucucaagagc

SEQ ID NO: 286659 - RNA, 21 nt, Human
ugagauuacaggcaugagcca

SEQ ID NO: 286660 - RNA, 22 nt, Human
ugagauuacaggcaugagccac

SEQ ID NO: 286661 - RNA, 22 nt, Human
ugagauuacaggcaugagccac

SEQ ID NO: 286662 - RNA, 24 nt, Human
ugagauuacaggcaugagccacug

SEQ ID NO: 286663 - RNA, 24 nt, Human
ugagauuacaggcaugagccacug

SEQ ID NO: 286664 - RNA, 20 nt, Human
ugauguugcugugccagucu

SEQ ID NO: 286665 - RNA, 25 nt, Human
ugccacagcacagagcuggcaagca

SEQ ID NO: 286666 - RNA, 20 nt, Human
ugccagucuguacuuccagc

SEQ ID NO: 286667 - RNA, 24 nt, Human
ugcccaggcuggucuaaaacucuu

SEQ ID NO: 286668 - RNA, 20 nt, Human
ugcugagauuacaggcauga

SEQ ID NO: 286669 - RNA, 19 nt, Human
uggcccagcuggauaugca

SEQ ID NO: 286670 - RNA, 23 nt, Human
uggcccucugccugucugcccag

SEQ ID NO: 286671 - RNA, 23 nt, Human
uggcucagaugcucccuccucag

SEQ ID NO: 286672 - RNA, 24 nt, Human
uggggagaggaaguaacuugccac

SEQ ID NO: 286673 - RNA, 20 nt, Human
uggguugcauuaaagugcuu

SEQ ID NO: 286674 - RNA, 21 nt, Human
uguacccccuccccccagcca

SEQ ID NO: 286675 - RNA, 20 nt, Human
ugucacaacccugauguugc

SEQ ID NO: 286676 - RNA, 20 nt, Human
ugucuguguacccccucccc

SEQ ID NO: 286677 - RNA, 23 nt, Human
uguguugcccaggcuggucuaaa

SEQ ID NO: 286678 - RNA, 18 nt, Human
uguugcccaggcuggucu

SEQ ID NO: 286679 - RNA, 19 nt, Human
uguugcccaggcuggucua

SEQ ID NO: 286680 - RNA, 22 nt, Human
uucacacacgcaaggccaugug

SEQ ID NO: 286681 - RNA, 21 nt, Human
uucccacucguggagcagccc

SEQ ID NO: 286682 - RNA, 21 nt, Human
uuccgccgcuuaaucccucca

SEQ ID NO: 286683 - RNA, 23 nt, Human
uucuggguccugugagggaucuu

SEQ ID NO: 286684 - RNA, 19 nt, Human
uuguagaaacagggucuua

SEQ ID NO: 286685 - RNA, 27 nt, Human
uuuuuuuuuuuuguagaaacagggucu

SEQ ID NO: 286686 - RNA, 28 nt, Human
uuuuuuuuuuuuuuuuguagaaacaggg

SEQ ID NO: 286687 - RNA, 19 nt, Human
uuuuuuuuuuuuuuuuugu

SEQ ID NO: 286688 - RNA, 20 nt, Human
uuuuuuuuuuuuuuuuuugg

SEQ ID NO: 286689 - RNA, 23 nt, Human
aaaaaaucaguaaaaaaauaagc

SEQ ID NO: 286690 - RNA, 30 nt, Human
aacgcgcggcggcggcggcggcccuucccu

SEQ ID NO: 286691 - RNA, 19 nt, Human
acgcgcggcggcggcggcg

SEQ ID NO: 286692 - RNA, 23 nt, Human
agcgcccaccuaccuaacucagc

SEQ ID NO: 286693 - RNA, 21 nt, Human
augaaagcuugacccagaggc

SEQ ID NO: 286694 - RNA, 21 nt, Human
caguaaaaaaauaagccugga

SEQ ID NO: 286695 - RNA, 20 nt, Human
cauggccucuuuggcacuga

SEQ ID NO: 286696 - RNA, 21 nt, Human
ccucugcggcuuaggagaaca

SEQ ID NO: 286697 - RNA, 22 nt, Human
ccuuacgccauuccugggcccc

SEQ ID NO: 286698 - RNA, 23 nt, Human
cgaucgcggagcagggucggggc

SEQ ID NO: 286699 - RNA, 22 nt, Human
cggaggcucucaccugccacag

SEQ ID NO: 286700 - RNA, 20 nt, Human
cggcggcggcggcccuuccc

SEQ ID NO: 286701 - RNA, 21 nt, Human
cucuuuggcacugaaagcugg

SEQ ID NO: 286702 - RNA, 26 nt, Human
cugcagcgucugccuggcaggcaguc

SEQ ID NO: 286703 - RNA, 19 nt, Human
gcagggcugucccugggag

SEQ ID NO: 286704 - RNA, 20 nt, Human
gccauuccugggccccgcgg

SEQ ID NO: 286705 - RNA, 18 nt, Human
gccccgccaggccucgca

SEQ ID NO: 286706 - RNA, 20 nt, Human
ggcccuucccugccaggccc

SEQ ID NO: 286707 - RNA, 21 nt, Human
ggcccuucccugccaggcccg

SEQ ID NO: 286708 - RNA, 18 nt, Human
gggagggaggaaaggaag

SEQ ID NO: 286709 - RNA, 20 nt, Human
gggcuggggcugaugaaagc

SEQ ID NO: 286710 - RNA, 21 nt, Human
ggucggggccagaggccgccu

SEQ ID NO: 286711 - RNA, 25 nt, Human
uaacucagcauggccucuuuggcac

SEQ ID NO: 286712 - RNA, 21 nt, Human
uagcugcagcgucugccuggc

SEQ ID NO: 286713 - RNA, 18 nt, Human
ucccaguccugugcuguc

SEQ ID NO: 286714 - RNA, 23 nt, Human
ucccaguccugugcugucuuccu

SEQ ID NO: 286715 - RNA, 18 nt, Human
uccugggccccgcggccc

SEQ ID NO: 286716 - RNA, 21 nt, Human
uccugugcugucuuccuugau

SEQ ID NO: 286717 - RNA, 20 nt, Human
ucucggagucugggggggcc

SEQ ID NO: 286718 - RNA, 18 nt, Human
ucugcggcuuaggagaac

SEQ ID NO: 286719 - RNA, 19 nt, Human
ugagaacuuugguggagug

SEQ ID NO: 286720 - RNA, 19 nt, Human
ugagaaggguucaugggug

SEQ ID NO: 286721 - RNA, 21 nt, Human
ugggccccgcggccccgccag

SEQ ID NO: 286722 - RNA, 22 nt, Human
ugucccugggaguccggaaguu

SEQ ID NO: 286723 - RNA, 18 nt, Human
ugugggggcuggggcuga

SEQ ID NO: 286724 - RNA, 23 nt, Human
uuacgccauuccugggccccgcg

SEQ ID NO: 286725 - RNA, 19 nt, Human
uuccuugauggcagggcug

SEQ ID NO: 286726 - RNA, 20 nt, Human
uugauggcagggcugucccu

SEQ ID NO: 286727 - RNA, 25 nt, Human
aaaaaaaaaaaucgaaauauuuuaa

SEQ ID NO: 286728 - RNA, 22 nt, Human
aaaaaaacaggcuaagugggga

SEQ ID NO: 286729 - RNA, 23 nt, Human
aaaaaaaucaacuuagaagauca

SEQ ID NO: 286730 - RNA, 22 nt, Human
aaaaagacuugggaggaaaaaa

SEQ ID NO: 286731 - RNA, 22 nt, Human
aaaacagcaaaauuccugaaca

SEQ ID NO: 286732 - RNA, 26 nt, Human
aaaauuccucacuuuaaacucugccu

SEQ ID NO: 286733 - RNA, 20 nt, Human
aacaauaggagaaaaaggga

SEQ ID NO: 286734 - RNA, 22 nt, Human
aaccaaaaaguucuuuaaauau

SEQ ID NO: 286735 - RNA, 23 nt, Human
aagaaaaagacuuuuaaaaaaaa

SEQ ID NO: 286736 - RNA, 20 nt, Human
acaaaguaagcaauugucca

SEQ ID NO: 286737 - RNA, 22 nt, Human
acaaaguaagcaauuguccaca

SEQ ID NO: 286738 - RNA, 18 nt, Human
acuuccuacccucagccc

SEQ ID NO: 286739 - RNA, 18 nt, Human
acuuuuaaaagaacccac

SEQ ID NO: 286740 - RNA, 28 nt, Human
agaaaaacagcaaaauuccugaacaaaa

SEQ ID NO: 286741 - RNA, 23 nt, Human
agacacuagguaaacagaacacc

SEQ ID NO: 286742 - RNA, 23 nt, Human
agaggagcuaaaagaaaagagag

SEQ ID NO: 286743 - RNA, 23 nt, Human
aggaaaaaaaucaacuuagaaga

SEQ ID NO: 286744 - RNA, 22 nt, Human
aggucauuguugucacaacaca

SEQ ID NO: 286745 - RNA, 19 nt, Human
cacaccuggaaagugggac

SEQ ID NO: 286746 - RNA, 19 nt, Human
cacaguauuuaaucagaau

SEQ ID NO: 286747 - RNA, 21 nt, Human
caccuaggcacaucuguaagg

SEQ ID NO: 286748 - RNA, 21 nt, Human
cauucuagcuuaacacccacc

SEQ ID NO: 286749 - RNA, 21 nt, Human
cgaaauauuuuaacucaagua

SEQ ID NO: 286750 - RNA, 19 nt, Human
cuacuuccuacccucagcc

SEQ ID NO: 286751 - RNA, 18 nt, Human
cuuuuaaaagaacccaca

SEQ ID NO: 286752 - RNA, 19 nt, Human
gaaaaacagcaaaauuccu

SEQ ID NO: 286753 - RNA, 27 nt, Human
gaaaaacagcaaaauuccugaacaaaa

SEQ ID NO: 286754 - RNA, 18 nt, Human
gaaaguuaagacuaugga

SEQ ID NO: 286755 - RNA, 21 nt, Human
gggcggcgcgcucuucagccc

SEQ ID NO: 286756 - RNA, 22 nt, Human
uaaaagaaaagagaggggguug

SEQ ID NO: 286757 - RNA, 18 nt, Human
uaaacagaacaccuaggc

SEQ ID NO: 286758 - RNA, 21 nt, Human
uaaacagaacaccuaggcaca

SEQ ID NO: 286759 - RNA, 24 nt, Human
uaagaaaaacagcaaaauuccuga

SEQ ID NO: 286760 - RNA, 21 nt, Human
uaagacacuagguaaacagaa

SEQ ID NO: 286761 - RNA, 23 nt, Human
uaagacuauggaaauguguauau

SEQ ID NO: 286762 - RNA, 18 nt, Human
uagcaggaauaagaggca

SEQ ID NO: 286763 - RNA, 18 nt, Human
ucagauccagaaaacaga

SEQ ID NO: 286764 - RNA, 20 nt, Human
uccagaaaacagaguaagac

SEQ ID NO: 286765 - RNA, 22 nt, Human
uccauuaaaaaaaaaaaaaaaa

SEQ ID NO: 286766 - RNA, 26 nt, Human
uccauuaaaaaaaaaaaaaaaaucga

SEQ ID NO: 286767 - RNA, 18 nt, Human
ucuuaaaaaaacaaacau

SEQ ID NO: 286768 - RNA, 21 nt, Human
ugauaccaacagaacuuuaag

SEQ ID NO: 286769 - RNA, 22 nt, Human
uguagcaggaauaagaggcaag

SEQ ID NO: 286770 - RNA, 22 nt, Human
uguccacagaugaaacauggga

SEQ ID NO: 286771 - RNA, 21 nt, Human
uuaaacuuccagucuccuaag

SEQ ID NO: 286772 - RNA, 24 nt, Human
uuaguguccuaguuuauuacuagu

SEQ ID NO: 286773 - RNA, 24 nt, Human
uuuaaucagaaugccaauauuacc

SEQ ID NO: 286774 - RNA, 24 nt, Human
uuucagaaucuuaaaaaaacaaac

SEQ ID NO: 286775 - RNA, 21 nt, Human
aaaaaugcaagagccaugauc

SEQ ID NO: 286776 - RNA, 18 nt, Human
aaaaugcaagagccauga

SEQ ID NO: 286777 - RNA, 18 nt, Human
aaaugucuaaaaauccca

SEQ ID NO: 286778 - RNA, 23 nt, Human
aacaaauacccugaugucgaaaa

SEQ ID NO: 286779 - RNA, 25 nt, Human
aacacgguagcaagcacucuggaca

SEQ ID NO: 286780 - RNA, 19 nt, Human
accgaaaagcagaaggaag

SEQ ID NO: 286781 - RNA, 23 nt, Human
aggagaaaccucccgcgggaggg

SEQ ID NO: 286782 - RNA, 19 nt, Human
aggaggaggagcccuggcu

SEQ ID NO: 286783 - RNA, 21 nt, Human
aggaggaggagcccuggcuug

SEQ ID NO: 286784 - RNA, 19 nt, Human
aggcagcgagacuccgaac

SEQ ID NO: 286785 - RNA, 20 nt, Human
caagguggaacaaauacccu

SEQ ID NO: 286786 - RNA, 24 nt, Human
caagguggaacaaauacccugaug

SEQ ID NO: 286787 - RNA, 22 nt, Human
cacuucagagagguucccuggg

SEQ ID NO: 286788 - RNA, 20 nt, Human
cagaaggaagagacgggggu

SEQ ID NO: 286789 - RNA, 22 nt, Human
cagcgagacuccgaacacggua

SEQ ID NO: 286790 - RNA, 23 nt, Human
caggcaugggggacacccugaca

SEQ ID NO: 286791 - RNA, 21 nt, Human
ccacaggccgugcuguagaga

SEQ ID NO: 286792 - RNA, 22 nt, Human
ccaggccugugccgggccccag

SEQ ID NO: 286793 - RNA, 22 nt, Human
cccagggcuggcagccaccagc

SEQ ID NO: 286794 - RNA, 23 nt, Human
ccucccgcgggagggaggcagcg

SEQ ID NO: 286795 - RNA, 18 nt, Human
ccucuuccaggcaugggg

SEQ ID NO: 286796 - RNA, 24 nt, Human
ccugacaggauccggaagucucca

SEQ ID NO: 286797 - RNA, 18 nt, Human
ccuggcuugagggaaggg

SEQ ID NO: 286798 - RNA, 19 nt, Human
ccugugccgggccccaggg

SEQ ID NO: 286799 - RNA, 22 nt, Human
cgacacugcaggcgguacugag

SEQ ID NO: 286800 - RNA, 22 nt, Human
cgaggggucucggcagcgcccg

SEQ ID NO: 286801 - RNA, 21 nt, Human
cggaagucuccauuuacccaa

SEQ ID NO: 286802 - RNA, 22 nt, Human
cggaagucuccauuuacccaaa

SEQ ID NO: 286803 - RNA, 24 nt, Human
cuccgaggaggccuggccaaggug

SEQ ID NO: 286804 - RNA, 19 nt, Human
cuggcuugagggaagggga

SEQ ID NO: 286805 - RNA, 23 nt, Human
gaaaagcagaaggaagagacggg

SEQ ID NO: 286806 - RNA, 19 nt, Human
gaacaggccacaggccgug

SEQ ID NO: 286807 - RNA, 27 nt, Human
gcccacgacaggaggaggagcccuggc

SEQ ID NO: 286808 - RNA, 20 nt, Human
gccgggccccagggcuggca

SEQ ID NO: 286809 - RNA, 18 nt, Human
gccugugccgggccccag

SEQ ID NO: 286810 - RNA, 18 nt, Human
ggugucacuucagagagg

SEQ ID NO: 286811 - RNA, 23 nt, Human
gucgaaaaaugucuaaaaauccc

SEQ ID NO: 286812 - RNA, 18 nt, Human
gugcgcugcugcugggug

SEQ ID NO: 286813 - RNA, 18 nt, Human
uagagaggccagugguca

SEQ ID NO: 286814 - RNA, 19 nt, Human
uagagaggccaguggucac

SEQ ID NO: 286815 - RNA, 21 nt, Human
uagcaagcacucuggacagac

SEQ ID NO: 286816 - RNA, 18 nt, Human
ucaaaaagaggagaaacc

SEQ ID NO: 286817 - RNA, 18 nt, Human
ucaagggucgugguucug

SEQ ID NO: 286818 - RNA, 24 nt, Human
ucacaaugagcccacgacaggagg

SEQ ID NO: 286819 - RNA, 20 nt, Human
ucagcgucugauucagcucc

SEQ ID NO: 286820 - RNA, 23 nt, Human
ucagcuccagcauccuuggccac

SEQ ID NO: 286821 - RNA, 24 nt, Human
uccaaaaaccgaaaagcagaagga

SEQ ID NO: 286822 - RNA, 21 nt, Human
uccccacccgggagucaaggg

SEQ ID NO: 286823 - RNA, 25 nt, Human
ucgaaaaaugucuaaaaaucccaca

SEQ ID NO: 286824 - RNA, 24 nt, Human
ucuggacagacucauguaugaaag

SEQ ID NO: 286825 - RNA, 22 nt, Human
ugacaggauccggaagucucca

SEQ ID NO: 286826 - RNA, 22 nt, Human
ugaggugucacuucagagaggu

SEQ ID NO: 286827 - RNA, 23 nt, Human
uggccaagguggaacaaauaccc

SEQ ID NO: 286828 - RNA, 24 nt, Human
uggccaagguggaacaaauacccu

SEQ ID NO: 286829 - RNA, 20 nt, Human
ugugaaauagaaaugccuga

SEQ ID NO: 286830 - RNA, 21 nt, Human
aaaaccuuucugccuccuaga

SEQ ID NO: 286831 - RNA, 19 nt, Human
aaacucaaaaaacccuaug

SEQ ID NO: 286832 - RNA, 20 nt, Human
aaagaacagacauaaaccgg

SEQ ID NO: 286833 - RNA, 20 nt, Human
aaccuagccacccaacuggc

SEQ ID NO: 286834 - RNA, 20 nt, Human
aagcaggauccgggguggac

SEQ ID NO: 286835 - RNA, 18 nt, Human
aaggcacaucauuauucu

SEQ ID NO: 286836 - RNA, 22 nt, Human
aaugcauggccccugcauccuu

SEQ ID NO: 286837 - RNA, 22 nt, Human
acaauccauuguaaggcacauc

SEQ ID NO: 286838 - RNA, 20 nt, Human
acaccugggcccugcaccuc

SEQ ID NO: 286839 - RNA, 21 nt, Human
acagaccagggauaaaaacaa

SEQ ID NO: 286840 - RNA, 19 nt, Human
accacucuuaaguguaccg

SEQ ID NO: 286841 - RNA, 19 nt, Human
accagggauaaaaacaaca

SEQ ID NO: 286842 - RNA, 18 nt, Human
acccuaugucguuaccug

SEQ ID NO: 286843 - RNA, 19 nt, Human
agaaaaccuuucugccucc

SEQ ID NO: 286844 - RNA, 19 nt, Human
agacagcaaaucagcccaa

SEQ ID NO: 286845 - RNA, 25 nt, Human
agacagcaaaucagcccaaagaaca

SEQ ID NO: 286846 - RNA, 19 nt, Human
agacaggaaaaaaaaucuu

SEQ ID NO: 286847 - RNA, 20 nt, Human
agaccccgcagccuggcucc

SEQ ID NO: 286848 - RNA, 22 nt, Human
agagaauuuacucuuugcaaaa

SEQ ID NO: 286849 - RNA, 23 nt, Human
agccuggcuccaugcucucaaca

SEQ ID NO: 286850 - RNA, 23 nt, Human
agcugagcucaaaugcugacccc

SEQ ID NO: 286851 - RNA, 19 nt, Human
aggaggaggagggcuggcc

SEQ ID NO: 286852 - RNA, 18 nt, Human
aggaugcaaaaugaggca

SEQ ID NO: 286853 - RNA, 25 nt, Human
aggcuggagugcaguggcgugaucu

SEQ ID NO: 286854 - RNA, 19 nt, Human
agugcaguggcgugaucuc

SEQ ID NO: 286855 - RNA, 20 nt, Human
agugcaguggcgugaucucg

SEQ ID NO: 286856 - RNA, 23 nt, Human
agugcaguggcgugaucucggcu

SEQ ID NO: 286857 - RNA, 24 nt, Human
agugcaguggcgugaucucggcuc

SEQ ID NO: 286858 - RNA, 19 nt, Human
auccagacaguugcugagg

SEQ ID NO: 286859 - RNA, 20 nt, Human
auggaagacugcucauucca

SEQ ID NO: 286860 - RNA, 20 nt, Human
caaaacuaagggaucugaaa

SEQ ID NO: 286861 - RNA, 21 nt, Human
caaagaacagacauaaaccgg

SEQ ID NO: 286862 - RNA, 25 nt, Human
caaccuagccacccaacuggcccag

SEQ ID NO: 286863 - RNA, 21 nt, Human
caagauccagacgagacugac

SEQ ID NO: 286864 - RNA, 18 nt, Human
caaggggggaaaugaggu

SEQ ID NO: 286865 - RNA, 19 nt, Human
caaggggggaaaugaggug

SEQ ID NO: 286866 - RNA, 21 nt, Human
caccuacacugagacucaggc

SEQ ID NO: 286867 - RNA, 18 nt, Human
cagccaggcaccaccuuc

SEQ ID NO: 286868 - RNA, 19 nt, Human
cagccaggcaccaccuucc

SEQ ID NO: 286869 - RNA, 24 nt, Human
cagccuucccuccccaugcgcucc

SEQ ID NO: 286870 - RNA, 19 nt, Human
caggaggaacaaaaggcuc

SEQ ID NO: 286871 - RNA, 21 nt, Human
cauaaaccggcgcuuccuccc

SEQ ID NO: 286872 - RNA, 24 nt, Human
cauaaaccggcgcuuccucccucc

SEQ ID NO: 286873 - RNA, 21 nt, Human
caucuggacaaaagcaggauc

SEQ ID NO: 286874 - RNA, 23 nt, Human
cauuguaaggcacaucauuauuc

SEQ ID NO: 286875 - RNA, 20 nt, Human
ccaaagaacagacauaaacc

SEQ ID NO: 286876 - RNA, 24 nt, Human
ccaagacaggaaaaaaaaucuuua

SEQ ID NO: 286877 - RNA, 21 nt, Human
ccacacccaugaauucacuaa

SEQ ID NO: 286878 - RNA, 26 nt, Human
ccaguggccugucucuaagggcgacc

SEQ ID NO: 286879 - RNA, 21 nt, Human
cccaaagaacagacauaaacc

SEQ ID NO: 286880 - RNA, 21 nt, Human
cccaagacaggaaaaaaaauc

SEQ ID NO: 286881 - RNA, 23 nt, Human
cccacacagugaaucugugagau

SEQ ID NO: 286882 - RNA, 19 nt, Human
cccaugcgcuccacaugcg

SEQ ID NO: 286883 - RNA, 21 nt, Human
cccauguacacacagcuccua

SEQ ID NO: 286884 - RNA, 25 nt, Human
ccccagcacaccugggcccugcacc

SEQ ID NO: 286885 - RNA, 18 nt, Human
cccccuccucagagccca

SEQ ID NO: 286886 - RNA, 21 nt, Human
ccccgcagccuggcuccaugc

SEQ ID NO: 286887 - RNA, 19 nt, Human
ccccugcauccuuaccccc

SEQ ID NO: 286888 - RNA, 20 nt, Human
cccugcaccucagacgcugc

SEQ ID NO: 286889 - RNA, 18 nt, Human
ccggagcccugcacccca

SEQ ID NO: 286890 - RNA, 24 nt, Human
ccggagcccugcaccccagccuuc

SEQ ID NO: 286891 - RNA, 19 nt, Human
ccgugaacuugggcaccca

SEQ ID NO: 286892 - RNA, 18 nt, Human
ccuauuguccagcauccu

SEQ ID NO: 286893 - RNA, 21 nt, Human
ccucccaucaccacagcucgg

SEQ ID NO: 286894 - RNA, 18 nt, Human
ccucccucccaucaccac

SEQ ID NO: 286895 - RNA, 24 nt, Human
ccucuugggacuauugaucagggc

SEQ ID NO: 286896 - RNA, 21 nt, Human
ccugcacaucugugcugcugu

SEQ ID NO: 286897 - RNA, 21 nt, Human
ccuggcccaggccuggccugu

SEQ ID NO: 286898 - RNA, 20 nt, Human
ccugggcccugcaccucaga

SEQ ID NO: 286899 - RNA, 24 nt, Human
cgcccaggcuggagugcaguggcg

SEQ ID NO: 286900 - RNA, 19 nt, Human
cggcucacugcaaccucac

SEQ ID NO: 286901 - RNA, 26 nt, Human
cuaaaacacaauccauuguaaggcac

SEQ ID NO: 286902 - RNA, 19 nt, Human
cucagagcccacaagcuuc

SEQ ID NO: 286903 - RNA, 23 nt, Human
cuccagggagguguaggcgcucc

SEQ ID NO: 286904 - RNA, 22 nt, Human
cucggcucacugcaaccucaac

SEQ ID NO: 286905 - RNA, 24 nt, Human
cucucucugucgcccaggcuggag

SEQ ID NO: 286906 - RNA, 24 nt, Human
cucucugucgcccaggcuggagug

SEQ ID NO: 286907 - RNA, 18 nt, Human
cugcaccucagacgcugc

SEQ ID NO: 286908 - RNA, 18 nt, Human
cugcauccuuacccccuc

SEQ ID NO: 286909 - RNA, 24 nt, Human
cuggacaaaagcaggauccggggu

SEQ ID NO: 286910 - RNA, 20 nt, Human
cuggcuccuggcagacuccu

SEQ ID NO: 286911 - RNA, 19 nt, Human
cuuaaguguaccguuaccu

SEQ ID NO: 286912 - RNA, 21 nt, Human
cuuccggagccaugcgcugcc

SEQ ID NO: 286913 - RNA, 21 nt, Human
gaaaccaaacugggacaggag

SEQ ID NO: 286914 - RNA, 21 nt, Human
gaccuagaccaaggccucagu

SEQ ID NO: 286915 - RNA, 24 nt, Human
gagacagcaaaucagcccaaagaa

SEQ ID NO: 286916 - RNA, 18 nt, Human
gagcaggcccggagcccu

SEQ ID NO: 286917 - RNA, 24 nt, Human
gagcaggcgagcccgagcacggcc

SEQ ID NO: 286918 - RNA, 19 nt, Human
gagcucaaaugcugacccc

SEQ ID NO: 286919 - RNA, 21 nt, Human
gagcugagcaggcgagcccga

SEQ ID NO: 286920 - RNA, 23 nt, Human
gagguggccgcuagucccgaccc

SEQ ID NO: 286921 - RNA, 18 nt, Human
gaucauagcugagcucaa

SEQ ID NO: 286922 - RNA, 19 nt, Human
gauuccgaggaggaggagg

SEQ ID NO: 286923 - RNA, 20 nt, Human
gcacaccugggcccugcacc

SEQ ID NO: 286924 - RNA, 19 nt, Human
gccaggcaccaccuuccuu

SEQ ID NO: 286925 - RNA, 20 nt, Human
gcccaggcuggagugcagug

SEQ ID NO: 286926 - RNA, 24 nt, Human
gcccaggcuggagugcaguggcgu

SEQ ID NO: 286927 - RNA, 25 nt, Human
gcccugcaccccagccuucccuccc

SEQ ID NO: 286928 - RNA, 19 nt, Human
gcuccuggcagacuccugg

SEQ ID NO: 286929 - RNA, 19 nt, Human
gcuggagugcaguggcgug

SEQ ID NO: 286930 - RNA, 23 nt, Human
ggaaaggccuggagagaccuaga

SEQ ID NO: 286931 - RNA, 21 nt, Human
ggacaaaagcaggauccgggg

SEQ ID NO: 286932 - RNA, 19 nt, Human
ggacaggaggaacaaaagg

SEQ ID NO: 286933 - RNA, 20 nt, Human
ggaccaagauccagacgaga

SEQ ID NO: 286934 - RNA, 20 nt, Human
ggcaccaccuuccuuccaaa

SEQ ID NO: 286935 - RNA, 26 nt, Human
ggcccggagcccugcaccccagccuu

SEQ ID NO: 286936 - RNA, 22 nt, Human
ggcuggagugcaguggcgugau

SEQ ID NO: 286937 - RNA, 18 nt, Human
gggagguguaggcgcucc

SEQ ID NO: 286938 - RNA, 20 nt, Human
gguauucauggcauccaggg

SEQ ID NO: 286939 - RNA, 18 nt, Human
gugaacuugggcacccaa

SEQ ID NO: 286940 - RNA, 22 nt, Human
gugaacuugggcacccaaaacu

SEQ ID NO: 286941 - RNA, 21 nt, Human
gugcaggucugagcagaggcu

SEQ ID NO: 286942 - RNA, 30 nt, Human
uaaaauacauccacagcaguuuacaacucu

SEQ ID NO: 286943 - RNA, 22 nt, Human
uaaauaaaauacauccacagca

SEQ ID NO: 286944 - RNA, 21 nt, Human
uaagugacuggugcuccgagg

SEQ ID NO: 286945 - RNA, 24 nt, Human
uaauucuaucacggcccacaccca

SEQ ID NO: 286946 - RNA, 18 nt, Human
uacagacaccuacacuga

SEQ ID NO: 286947 - RNA, 22 nt, Human
uagaaacccaggauuccgagga

SEQ ID NO: 286948 - RNA, 21 nt, Human
uagcugagcucaaaugcugac

SEQ ID NO: 286949 - RNA, 18 nt, Human
uagcuuggcuguagugac

SEQ ID NO: 286950 - RNA, 19 nt, Human
ucaacggugcuuuuuucug

SEQ ID NO: 286951 - RNA, 19 nt, Human
ucaaggucaguggugcaaa

SEQ ID NO: 286952 - RNA, 20 nt, Human
ucacugcaaccucaacgggg

SEQ ID NO: 286953 - RNA, 23 nt, Human
ucacugcaaccucaacgggggcc

SEQ ID NO: 286954 - RNA, 23 nt, Human
ucacugcaaccucaacggggguc

SEQ ID NO: 286955 - RNA, 18 nt, Human
ucagccucuccauuuagc

SEQ ID NO: 286956 - RNA, 22 nt, Human
ucagccucuccauuuagcucuc

SEQ ID NO: 286957 - RNA, 23 nt, Human
ucagccucuccauuuagcucuca

SEQ ID NO: 286958 - RNA, 22 nt, Human
ucaggagagggucaaacucaaa

SEQ ID NO: 286959 - RNA, 18 nt, Human
ucaggauuugaacccaga

SEQ ID NO: 286960 - RNA, 18 nt, Human
uccaaaagccuuguuucu

SEQ ID NO: 286961 - RNA, 23 nt, Human
uccagcauccuauggcccauucc

SEQ ID NO: 286962 - RNA, 23 nt, Human
uccccuagguauucauggcaucc

SEQ ID NO: 286963 - RNA, 19 nt, Human
ucccuaagggacugccucc

SEQ ID NO: 286964 - RNA, 21 nt, Human
uccguggaaauggucuccucc

SEQ ID NO: 286965 - RNA, 18 nt, Human
uccuaggagucggagggu

SEQ ID NO: 286966 - RNA, 23 nt, Human
uccucagagcccacaagcuuccg

SEQ ID NO: 286967 - RNA, 24 nt, Human
ucgcccaggcuggagugcaguggc

SEQ ID NO: 286968 - RNA, 23 nt, Human
ucggggcuuugucaccccagcac

SEQ ID NO: 286969 - RNA, 19 nt, Human
ucucagaaaaccuuucugc

SEQ ID NO: 286970 - RNA, 18 nt, Human
ucucuaagcacuguggcu

SEQ ID NO: 286971 - RNA, 23 nt, Human
ucucucucugucgcccaggcugg

SEQ ID NO: 286972 - RNA, 24 nt, Human
ucucucucugucgcccaggcugga

SEQ ID NO: 286973 - RNA, 24 nt, Human
ucucucugucgcccaggcuggagu

SEQ ID NO: 286974 - RNA, 19 nt, Human
ucucugucgcccaggcugg

SEQ ID NO: 286975 - RNA, 25 nt, Human
ucucugucgcccaggcuggagugca

SEQ ID NO: 286976 - RNA, 24 nt, Human
ucugucgcccaggcuggagugcag

SEQ ID NO: 286977 - RNA, 22 nt, Human
ucugugcugcugugacugggug

SEQ ID NO: 286978 - RNA, 23 nt, Human
ucuguuuguuuguuuguuuuugu

SEQ ID NO: 286979 - RNA, 19 nt, Human
ugacagagcuucuauuccc

SEQ ID NO: 286980 - RNA, 21 nt, Human
ugacuggugcuccgaggccca

SEQ ID NO: 286981 - RNA, 22 nt, Human
ugagauggagucucucucuguc

SEQ ID NO: 286982 - RNA, 22 nt, Human
ugagcagaggcuuucggaguga

SEQ ID NO: 286983 - RNA, 21 nt, Human
ugagcaggcgagcccgagcac

SEQ ID NO: 286984 - RNA, 21 nt, Human
ugcagccaggcaccaccuucc

SEQ ID NO: 286985 - RNA, 22 nt, Human
ugcaguggcgugaucucggcuc

SEQ ID NO: 286986 - RNA, 19 nt, Human
ugccaugaugucauuuugu

SEQ ID NO: 286987 - RNA, 24 nt, Human
uggaauaaacaaaauaugcuaaug

SEQ ID NO: 286988 - RNA, 19 nt, Human
uggaauggaagacugcuca

SEQ ID NO: 286989 - RNA, 19 nt, Human
uggagugcaguggcgugau

SEQ ID NO: 286990 - RNA, 23 nt, Human
uggagugcaguggcgugaucucg

SEQ ID NO: 286991 - RNA, 24 nt, Human
uggagugcaguggcgugaucucgg

SEQ ID NO: 286992 - RNA, 19 nt, Human
uggaugcagccaggcacca

SEQ ID NO: 286993 - RNA, 18 nt, Human
uggcccaggccuggccug

SEQ ID NO: 286994 - RNA, 22 nt, Human
uggcccaggccuggccuguguc

SEQ ID NO: 286995 - RNA, 22 nt, Human
uggccccugcauccuuaccccc

SEQ ID NO: 286996 - RNA, 20 nt, Human
uggcgugaucucggcucacu

SEQ ID NO: 286997 - RNA, 18 nt, Human
uggggagagaaguguggg

SEQ ID NO: 286998 - RNA, 20 nt, Human
uggggagagaagugugggcc

SEQ ID NO: 286999 - RNA, 24 nt, Human
uggggagagaagugugggccucca

SEQ ID NO: 287000 - RNA, 20 nt, Human
uggucaaggggggaaaugag

SEQ ID NO: 287001 - RNA, 22 nt, Human
uuagcuuggcuguagugaccac

SEQ ID NO: 287002 - RNA, 24 nt, Human
uuauucuucucuggcagguuuucc

SEQ ID NO: 287003 - RNA, 19 nt, Human
uucacuaaguaauuaucac

SEQ ID NO: 287004 - RNA, 21 nt, Human
uuguccugcccauguacacac

SEQ ID NO: 287005 - RNA, 21 nt, Human
uuguuuguuuguuuuuguuuu

SEQ ID NO: 287006 - RNA, 19 nt, Human
uuuacagacaccuacacug

SEQ ID NO: 287007 - RNA, 21 nt, Human
uuuacccacacagugaaucug

SEQ ID NO: 287008 - RNA, 24 nt, Human
uuucucagaaaaccuuucugccuc

SEQ ID NO: 287009 - RNA, 19 nt, Human
uuugaacccagaccccgca

SEQ ID NO: 287010 - RNA, 18 nt, Human
aaaacgccuuuccaccuc

SEQ ID NO: 287011 - RNA, 24 nt, Human
aaagugcugggauuacaggcguga

SEQ ID NO: 287012 - RNA, 23 nt, Human
aagagcaacaggucacuccugaa

SEQ ID NO: 287013 - RNA, 19 nt, Human
aaguagcugggacuauagg

SEQ ID NO: 287014 - RNA, 20 nt, Human
aaguagcugggacuauaggc

SEQ ID NO: 287015 - RNA, 19 nt, Human
aagugcugggauuacaggc

SEQ ID NO: 287016 - RNA, 19 nt, Human
aagugcugggauuacaggc

SEQ ID NO: 287017 - RNA, 26 nt, Human
aagugcugggauuacaggcgugagcc

SEQ ID NO: 287018 - RNA, 24 nt, Human
aaguuuucauuuucaguccauacu

SEQ ID NO: 287019 - RNA, 20 nt, Human
acaggguuucgccauguugg

SEQ ID NO: 287020 - RNA, 21 nt, Human
acaggguuucgccauguuggu

SEQ ID NO: 287021 - RNA, 23 nt, Human
acaggguuucgccauguugguua

SEQ ID NO: 287022 - RNA, 24 nt, Human
acaggguuucgccauguugguuag

SEQ ID NO: 287023 - RNA, 19 nt, Human
acccaggcuggagugcagu

SEQ ID NO: 287024 - RNA, 25 nt, Human
acccgccucagccucccaaagugcu

SEQ ID NO: 287025 - RNA, 24 nt, Human
accuccaucucagacuuguagagg

SEQ ID NO: 287026 - RNA, 22 nt, Human
acuccaccacacccauccgagc

SEQ ID NO: 287027 - RNA, 18 nt, Human
agacaggguuucgccaug

SEQ ID NO: 287028 - RNA, 18 nt, Human
agacaggguuucgccaug

SEQ ID NO: 287029 - RNA, 21 nt, Human
agcgggcaggcaggcgagagc

SEQ ID NO: 287030 - RNA, 21 nt, Human
aggcacaaaccaccaggccug

SEQ ID NO: 287031 - RNA, 22 nt, Human
aggcaggcgagagcgagaagcu

SEQ ID NO: 287032 - RNA, 25 nt, Human
aggcuggagugcaguggcacaaucu

SEQ ID NO: 287033 - RNA, 24 nt, Human
aggugauccacccgccucagccuc

SEQ ID NO: 287034 - RNA, 21 nt, Human
agugcaguggcacaaucucag

SEQ ID NO: 287035 - RNA, 18 nt, Human
agugcugggauuacaggc

SEQ ID NO: 287036 - RNA, 25 nt, Human
auucugucacccaggcuggagugca

SEQ ID NO: 287037 - RNA, 23 nt, Human
auuuuuguaguuuuuaguagaga

SEQ ID NO: 287038 - RNA, 24 nt, Human
caaagugcugggauuacaggcgug

SEQ ID NO: 287039 - RNA, 24 nt, Human
caaccuccaccucccggguccaag

SEQ ID NO: 287040 - RNA, 22 nt, Human
caagcaacucuccugccucagc

SEQ ID NO: 287041 - RNA, 27 nt, Human
caagcaacucuccugccucagccuccc

SEQ ID NO: 287042 - RNA, 18 nt, Human
caccacacccauccgagc

SEQ ID NO: 287043 - RNA, 19 nt, Human
caccacacccauccgagcc

SEQ ID NO: 287044 - RNA, 24 nt, Human
caccaggccuggcucauuuuugua

SEQ ID NO: 287045 - RNA, 23 nt, Human
cacccgccucagccucccaaagu

SEQ ID NO: 287046 - RNA, 23 nt, Human
cacuccaccacacccauccgagc

SEQ ID NO: 287047 - RNA, 21 nt, Human
cacugcaaccuccaccucccg

SEQ ID NO: 287048 - RNA, 23 nt, Human
cacugcaaccuccaccucccggg

SEQ ID NO: 287049 - RNA, 19 nt, Human
cagaguccccucgauccuc

SEQ ID NO: 287050 - RNA, 24 nt, Human
caggguuucgccauguugguuagg

SEQ ID NO: 287051 - RNA, 24 nt, Human
cauucugucacccaggcuggagug

SEQ ID NO: 287052 - RNA, 20 nt, Human
ccaaagugcugggauuacag

SEQ ID NO: 287053 - RNA, 22 nt, Human
ccaaagugcugggauuacaggc

SEQ ID NO: 287054 - RNA, 22 nt, Human
ccaaagugcugggauuacaggc

SEQ ID NO: 287055 - RNA, 24 nt, Human
ccaaagugcugggauuacaggcgu

SEQ ID NO: 287056 - RNA, 26 nt, Human
ccacccgccucagccucccaaagugc

SEQ ID NO: 287057 - RNA, 21 nt, Human
ccaccucacugaagaaggcac

SEQ ID NO: 287058 - RNA, 26 nt, Human
ccaccucccggguccaagcaacucuu

SEQ ID NO: 287059 - RNA, 19 nt, Human
ccauguugguuaggcuggu

SEQ ID NO: 287060 - RNA, 19 nt, Human
ccauguugguuaggcuggu

SEQ ID NO: 287061 - RNA, 18 nt, Human
cccaaguagcugggacua

SEQ ID NO: 287062 - RNA, 24 nt, Human
cccaaguagcugggacuauaggca

SEQ ID NO: 287063 - RNA, 19 nt, Human
ccccugagccgccgccgcc

SEQ ID NO: 287064 - RNA, 19 nt, Human
ccccugagccgccgccgcc

SEQ ID NO: 287065 - RNA, 20 nt, Human
ccccugagccgccgccgccu

SEQ ID NO: 287066 - RNA, 23 nt, Human
ccccugagccgccgccgccucug

SEQ ID NO: 287067 - RNA, 23 nt, Human
cccggguccaagcaacucuccug

SEQ ID NO: 287068 - RNA, 19 nt, Human
cccugagccgccgccgccu

SEQ ID NO: 287069 - RNA, 24 nt, Human
ccgccucagccucccaaagugcug

SEQ ID NO: 287070 - RNA, 21 nt, Human
ccucuccugagcugacgagac

SEQ ID NO: 287071 - RNA, 22 nt, Human
ccucucggccgccagacucuag

SEQ ID NO: 287072 - RNA, 23 nt, Human
ccuuuagcucugcauccuggacc

SEQ ID NO: 287073 - RNA, 21 nt, Human
cgcagggcacgcugggacaac

SEQ ID NO: 287074 - RNA, 23 nt, Human
cgccauguugguuaggcugguuc

SEQ ID NO: 287075 - RNA, 24 nt, Human
cgccucagccucccaaagugcugg

SEQ ID NO: 287076 - RNA, 22 nt, Human
cgcgcgggcugaggcgcagggc

SEQ ID NO: 287077 - RNA, 21 nt, Human
cgcgggcugaggcgcagggca

SEQ ID NO: 287078 - RNA, 21 nt, Human
cgugaccucaggugauccacc

SEQ ID NO: 287079 - RNA, 24 nt, Human
cucacugcaaccuccaccucccgg

SEQ ID NO: 287080 - RNA, 24 nt, Human
cucagccucccaaguagcugggac

SEQ ID NO: 287081 - RNA, 24 nt, Human
cucauucugucacccaggcuggag

SEQ ID NO: 287082 - RNA, 21 nt, Human
cuccugaaaacauggaguaga

SEQ ID NO: 287083 - RNA, 27 nt, Human
cucuccugccucagccucccaaguagc

SEQ ID NO: 287084 - RNA, 23 nt, Human
cugagccgccgccgccucugucu

SEQ ID NO: 287085 - RNA, 23 nt, Human
cugcaaccuccaccucccggguc

SEQ ID NO: 287086 - RNA, 24 nt, Human
cugcagccucguuuccccugagcc

SEQ ID NO: 287087 - RNA, 23 nt, Human
cugccucagccucccaaguagcu

SEQ ID NO: 287088 - RNA, 20 nt, Human
cugggacaacuaguccucuc

SEQ ID NO: 287089 - RNA, 24 nt, Human
cuuccuacuaccaccacugcagcc

SEQ ID NO: 287090 - RNA, 24 nt, Human
gaccucaggugauccacccgccuc

SEQ ID NO: 287091 - RNA, 21 nt, Human
gagaaagggaauauuaagagc

SEQ ID NO: 287092 - RNA, 23 nt, Human
gagaacauccacagcauauacuu

SEQ ID NO: 287093 - RNA, 18 nt, Human
gagagcgagaagcugcga

SEQ ID NO: 287094 - RNA, 18 nt, Human
gauuacaggcgugagcca

SEQ ID NO: 287095 - RNA, 20 nt, Human
gauuacaggcgugagccacc

SEQ ID NO: 287096 - RNA, 22 nt, Human
gauuacaggcgugagccaccgc

SEQ ID NO: 287097 - RNA, 18 nt, Human
gcagggcacgcugggaca

SEQ ID NO: 287098 - RNA, 24 nt, Human
gccauguugguuaggcugguucug

SEQ ID NO: 287099 - RNA, 20 nt, Human
gccucagccucccaaguagc

SEQ ID NO: 287100 - RNA, 21 nt, Human
gccuuuagcucugcauccugg

SEQ ID NO: 287101 - RNA, 19 nt, Human
gcuggagugcaguggcaca

SEQ ID NO: 287102 - RNA, 24 nt, Human
ggcugguucugaacucgugaccuc

SEQ ID NO: 287103 - RNA, 25 nt, Human
gggaauauuaagagcaaccgguacc

SEQ ID NO: 287104 - RNA, 22 nt, Human
ggguuucgccauguugguuagg

SEQ ID NO: 287105 - RNA, 24 nt, Human
gugauccacccgccucagccuccc

SEQ ID NO: 287106 - RNA, 25 nt, Human
uaaacugggcaacaaauucaccccc

SEQ ID NO: 287107 - RNA, 19 nt, Human
uaaaguaaacggcauggca

SEQ ID NO: 287108 - RNA, 20 nt, Human
uaaauagugguucucugucc

SEQ ID NO: 287109 - RNA, 23 nt, Human
uacaggcgugagccaccgcgccc

SEQ ID NO: 287110 - RNA, 23 nt, Human
uaccucaaauucagcuuuuucau

SEQ ID NO: 287111 - RNA, 19 nt, Human
uagaaaaaaaccugaugac

SEQ ID NO: 287112 - RNA, 22 nt, Human
uagagacaggguuucgccaugu

SEQ ID NO: 287113 - RNA, 24 nt, Human
uaguagagacaggguuucgccaug

SEQ ID NO: 287114 - RNA, 22 nt, Human
ucacccaggcuggagugcagug

SEQ ID NO: 287115 - RNA, 23 nt, Human
ucacugcaaccuccaccucccgg

SEQ ID NO: 287116 - RNA, 24 nt, Human
ucacugcaaccuccaccucccggg

SEQ ID NO: 287117 - RNA, 25 nt, Human
ucacugcaaccuccaccucccgggu

SEQ ID NO: 287118 - RNA, 27 nt, Human
ucacugcaaccuccaccucccgggucc

SEQ ID NO: 287119 - RNA, 20 nt, Human
ucagccucccaaguagcugg

SEQ ID NO: 287120 - RNA, 24 nt, Human
ucauucugucacccaggcuggagu

SEQ ID NO: 287121 - RNA, 25 nt, Human
ucauuuuuguaguuuuuaguagaga

SEQ ID NO: 287122 - RNA, 24 nt, Human
uccaagcaacucuccugccucagc

SEQ ID NO: 287123 - RNA, 21 nt, Human
uccacccgccucagccuccca

SEQ ID NO: 287124 - RNA, 24 nt, Human
ucccaaagugcugggauuacaggc

SEQ ID NO: 287125 - RNA, 24 nt, Human
ucccaaguagcugggacuauaggc

SEQ ID NO: 287126 - RNA, 23 nt, Human
ucccagccacaggcuguggucag

SEQ ID NO: 287127 - RNA, 24 nt, Human
uccccucgauccucgaggagaggg

SEQ ID NO: 287128 - RNA, 19 nt, Human
ucccggguccaagcaacuc

SEQ ID NO: 287129 - RNA, 21 nt, Human
ucccggguccaagcaacucuc

SEQ ID NO: 287130 - RNA, 24 nt, Human
ucccggguccaagcaacucuccug

SEQ ID NO: 287131 - RNA, 18 nt, Human
ucgccauguugguuaggc

SEQ ID NO: 287132 - RNA, 22 nt, Human
ucgccauguugguuaggcuggu

SEQ ID NO: 287133 - RNA, 23 nt, Human
ucucauucugucacccaggcugg

SEQ ID NO: 287134 - RNA, 24 nt, Human
ucucauucugucacccaggcugga

SEQ ID NO: 287135 - RNA, 18 nt, Human
ucugucacccaggcugga

SEQ ID NO: 287136 - RNA, 24 nt, Human
ucugucacccaggcuggagugcag

SEQ ID NO: 287137 - RNA, 20 nt, Human
ucuguccugcauccuuggcc

SEQ ID NO: 287138 - RNA, 19 nt, Human
ucugucucccuucccagcc

SEQ ID NO: 287139 - RNA, 24 nt, Human
ucuuuuuuuucuuuuucuggguuu

SEQ ID NO: 287140 - RNA, 20 nt, Human
ugaccucaggugauccaccc

SEQ ID NO: 287141 - RNA, 21 nt, Human
ugaccucaggugauccacccg

SEQ ID NO: 287142 - RNA, 24 nt, Human
ugaccucaggugauccacccgccu

SEQ ID NO: 287143 - RNA, 20 nt, Human
ugcagcaguucauguuuggc

SEQ ID NO: 287144 - RNA, 22 nt, Human
ugcaguggcacaaucucagcuc

SEQ ID NO: 287145 - RNA, 24 nt, Human
ugccucagccucccaaguagcugg

SEQ ID NO: 287146 - RNA, 24 nt, Human
ugcugggauuacaggcgugagcca

SEQ ID NO: 287147 - RNA, 18 nt, Human
uggagugcaguggcacaa

SEQ ID NO: 287148 - RNA, 23 nt, Human
uggagugcaguggcacaaucuca

SEQ ID NO: 287149 - RNA, 24 nt, Human
uggagugcaguggcacaaucucag

SEQ ID NO: 287150 - RNA, 24 nt, Human
uggcacaaucucagcucacugcaa

SEQ ID NO: 287151 - RNA, 24 nt, Human
ugggacuauaggcacaaaccacca

SEQ ID NO: 287152 - RNA, 18 nt, Human
ugggauuacaggcgugag

SEQ ID NO: 287153 - RNA, 19 nt, Human
ugggauuacaggcgugagc

SEQ ID NO: 287154 - RNA, 21 nt, Human
ugggauuacaggcgugagcca

SEQ ID NO: 287155 - RNA, 22 nt, Human
ugggauuacaggcgugagccac

SEQ ID NO: 287156 - RNA, 23 nt, Human
ugggauuacaggcgugagccacc

SEQ ID NO: 287157 - RNA, 24 nt, Human
ugggauuacaggcgugagccaccg

SEQ ID NO: 287158 - RNA, 20 nt, Human
uggggccauugggcaugaga

SEQ ID NO: 287159 - RNA, 21 nt, Human
ugguuaggcugguucugaacu

SEQ ID NO: 287160 - RNA, 18 nt, Human
ugugguagaagguaauaa

SEQ ID NO: 287161 - RNA, 24 nt, Human
uuaguagagacaggguuucgccau

SEQ ID NO: 287162 - RNA, 22 nt, Human
uuccccugagccgccgccgccu

SEQ ID NO: 287163 - RNA, 20 nt, Human
uuucaugguccuucgacaca

SEQ ID NO: 287164 - RNA, 24 nt, Human
uuucgccauguugguuaggcuggu

SEQ ID NO: 287165 - RNA, 19 nt, Human
uuuuguaguuuuuaguaga

SEQ ID NO: 287166 - RNA, 22 nt, Human
uuuuuaguagagacaggguuuc

SEQ ID NO: 287167 - RNA, 23 nt, Human
uuuuuaguagagacaggguuucg

SEQ ID NO: 287168 - RNA, 23 nt, Human
uuuuucgacuugcagaacucugg

SEQ ID NO: 287169 - RNA, 21 nt, Human
uuuuuguaguuuuuaguagag

SEQ ID NO: 287170 - RNA, 24 nt, Human
uuuuuguaguuuuuaguagagaca

SEQ ID NO: 287171 - RNA, 24 nt, Human
uuuuuuuucuuuuucuggguuuuu

SEQ ID NO: 287172 - RNA, 27 nt, Human
aaaaaaaauaaaagucuccggcggggg

SEQ ID NO: 287173 - RNA, 24 nt, Human
aaauguguguuccgagcccggagc

SEQ ID NO: 287174 - RNA, 22 nt, Human
aagcaagaauuuuauaauccaa

SEQ ID NO: 287175 - RNA, 20 nt, Human
agaccuggcauuugcucggu

SEQ ID NO: 287176 - RNA, 22 nt, Human
agaggaagaaaaaaaauaaaag

SEQ ID NO: 287177 - RNA, 27 nt, Human
aggaagaaaaaaaauaaaagucuccgg

SEQ ID NO: 287178 - RNA, 22 nt, Human
cacaaguuucuuuucauggucc

SEQ ID NO: 287179 - RNA, 21 nt, Human
ccacaguaaagaauuacaaaa

SEQ ID NO: 287180 - RNA, 21 nt, Human
ccgagcccggagcacacacuc

SEQ ID NO: 287181 - RNA, 19 nt, Human
ccggggcugggggccggag

SEQ ID NO: 287182 - RNA, 22 nt, Human
cgcagagggacaaaaaucaacc

SEQ ID NO: 287183 - RNA, 18 nt, Human
cggggccgcgggcgggcg

SEQ ID NO: 287184 - RNA, 20 nt, Human
cggugucggguccgggcagc

SEQ ID NO: 287185 - RNA, 19 nt, Human
cuagaccuggcauuugcuc

SEQ ID NO: 287186 - RNA, 24 nt, Human
cuuaaaacagaacugacauucuga

SEQ ID NO: 287187 - RNA, 20 nt, Human
cuuggagcugcugcggggcc

SEQ ID NO: 287188 - RNA, 23 nt, Human
gaaaaaaaauaaaagucuccggc

SEQ ID NO: 287189 - RNA, 24 nt, Human
gaccuggcauuugcucgguacaua

SEQ ID NO: 287190 - RNA, 21 nt, Human
gacuagcauuauguuugcuag

SEQ ID NO: 287191 - RNA, 19 nt, Human
gcccggagcacacacuccg

SEQ ID NO: 287192 - RNA, 23 nt, Human
gccggggggaggggagcggggag

SEQ ID NO: 287193 - RNA, 21 nt, Human
gcggggagcgaggguggcggu

SEQ ID NO: 287194 - RNA, 19 nt, Human
gcugcggggccgcgggcgg

SEQ ID NO: 287195 - RNA, 20 nt, Human
gcugcugcggggccgcgggc

SEQ ID NO: 287196 - RNA, 20 nt, Human
ggagcacacacuccgcacuc

SEQ ID NO: 287197 - RNA, 24 nt, Human
ggagcacacacuccgcacucucag

SEQ ID NO: 287198 - RNA, 19 nt, Human
gggcagcgggaaggccucg

SEQ ID NO: 287199 - RNA, 18 nt, Human
ggggaggggagcggggag

SEQ ID NO: 287200 - RNA, 24 nt, Human
ggggccggagccggggggagggga

SEQ ID NO: 287201 - RNA, 20 nt, Human
gggucgauccacugccgcug

SEQ ID NO: 287202 - RNA, 18 nt, Human
uaaaacagaacugacauu

SEQ ID NO: 287203 - RNA, 21 nt, Human
uaaaacagaacugacauucug

SEQ ID NO: 287204 - RNA, 24 nt, Human
uaaaacagaacugacauucugagc

SEQ ID NO: 287205 - RNA, 18 nt, Human
uauguuugcuagaccugg

SEQ ID NO: 287206 - RNA, 20 nt, Human
uauguuugcuagaccuggcc

SEQ ID NO: 287207 - RNA, 19 nt, Human
ucaaaguuuccuuuccuuu

SEQ ID NO: 287208 - RNA, 24 nt, Human
uccaaauuacguuuccuugcucag

SEQ ID NO: 287209 - RNA, 30 nt, Human
uccacaguaaagaauuacaaaauuaaagaa

SEQ ID NO: 287210 - RNA, 23 nt, Human
ucggugaagcacaaguuucuuuu

SEQ ID NO: 287211 - RNA, 22 nt, Human
ugaaaacuacucaacggccgca

SEQ ID NO: 287212 - RNA, 23 nt, Human
uggcggugucggguccgggcagc

SEQ ID NO: 287213 - RNA, 21 nt, Human
uuacaaaauuaaagaaaggaa

SEQ ID NO: 287214 - RNA, 18 nt, Human
uucauggucccugaucaa

SEQ ID NO: 287215 - RNA, 24 nt, Human
uucccagggucuauaaaacauuaa

SEQ ID NO: 287216 - RNA, 19 nt, Human
uugguuccuucuuggagcu

SEQ ID NO: 287217 - RNA, 22 nt, Human
uugguuccuucuuggagcugcu

SEQ ID NO: 287218 - RNA, 20 nt, Human
uuguguuuuuuuguuuuuaa

SEQ ID NO: 287219 - RNA, 24 nt, Human
uuuauaauccaaauuacguuuccu

SEQ ID NO: 287220 - RNA, 20 nt, Human
uuuuguguuuuuuuguuuuu

SEQ ID NO: 287221 - RNA, 22 nt, Human
aagcaagaauuuuauaauccaa

SEQ ID NO: 287222 - RNA, 21 nt, Human
aauuuuauaauccaaaccaug

SEQ ID NO: 287223 - RNA, 21 nt, Human
acaaauuucuuuucguggucu

SEQ ID NO: 287224 - RNA, 24 nt, Human
gaccuugcauuugcucgguacaua

SEQ ID NO: 287225 - RNA, 21 nt, Human
gauuuugcaauuuuuuuuccc

SEQ ID NO: 287226 - RNA, 18 nt, Human
uagaccuugcauuugcuc

SEQ ID NO: 287227 - RNA, 21 nt, Human
uccacaguaaagaauuaaaaa

SEQ ID NO: 287228 - RNA, 24 nt, Human
uccccagggucuacaaaacauuaa

SEQ ID NO: 287229 - RNA, 23 nt, Human
ucggugaagcacaaauuucuuuu

SEQ ID NO: 287230 - RNA, 18 nt, Human
uucguggucucugaucaa

SEQ ID NO: 287231 - RNA, 24 nt, Human
uuuauaauccaaaccauguuuccu

SEQ ID NO: 287232 - RNA, 18 nt, Human
aaaccaaaucuuuguggg

SEQ ID NO: 287233 - RNA, 20 nt, Human
agggcacggcgggccgggcg

SEQ ID NO: 287234 - RNA, 29 nt, Human
agggguuauuuggcuuuugaaucgguuuu

SEQ ID NO: 287235 - RNA, 23 nt, Human
auccccuuccgaaggguaaaaau

SEQ ID NO: 287236 - RNA, 21 nt, Human
auuuuuuuuaucuuuuucucu

SEQ ID NO: 287237 - RNA, 21 nt, Human
caaaaggcucuccgcacaaua

SEQ ID NO: 287238 - RNA, 25 nt, Human
cacagcagaacccaaagaacauauu

SEQ ID NO: 287239 - RNA, 19 nt, Human
caccccgagccccgccaga

SEQ ID NO: 287240 - RNA, 22 nt, Human
caccccgagccccgccagagga

SEQ ID NO: 287241 - RNA, 22 nt, Human
cagaggacuucuuaucgggccc

SEQ ID NO: 287242 - RNA, 19 nt, Human
cagcaccgcagacaaaagg

SEQ ID NO: 287243 - RNA, 23 nt, Human
cagcaccgcagacaaaaggcucu

SEQ ID NO: 287244 - RNA, 18 nt, Human
caggccggggcgcggggc

SEQ ID NO: 287245 - RNA, 20 nt, Human
ccaaagaacauauucguaua

SEQ ID NO: 287246 - RNA, 22 nt, Human
ccaaauuucaaaaaaucaaagu

SEQ ID NO: 287247 - RNA, 22 nt, Human
ccacagcagaacccaaagaaca

SEQ ID NO: 287248 - RNA, 23 nt, Human
ccacagcagaacccaaagaacau

SEQ ID NO: 287249 - RNA, 21 nt, Human
cccaccaccccgagccccgcc

SEQ ID NO: 287250 - RNA, 23 nt, Human
cccacggccgcagcaccgcagac

SEQ ID NO: 287251 - RNA, 23 nt, Human
ccccaccaccccgagccccgcca

SEQ ID NO: 287252 - RNA, 20 nt, Human
cccccaccaccccgagcccc

SEQ ID NO: 287253 - RNA, 20 nt, Human
ccccccaccaccccgagccc

SEQ ID NO: 287254 - RNA, 26 nt, Human
ccccccaccaccccgagccccgccag

SEQ ID NO: 287255 - RNA, 23 nt, Human
cccccggaccgacggacggagac

SEQ ID NO: 287256 - RNA, 25 nt, Human
ccgcagacaaaaggcucuccgcaca

SEQ ID NO: 287257 - RNA, 19 nt, Human
ccgcaggacaaaggggcgc

SEQ ID NO: 287258 - RNA, 27 nt, Human
ccgccccccaccaccccgagccccgcc

SEQ ID NO: 287259 - RNA, 21 nt, Human
ccgcgguccuggugcgaaggc

SEQ ID NO: 287260 - RNA, 20 nt, Human
cgaccccgggcgggcggcga

SEQ ID NO: 287261 - RNA, 21 nt, Human
cgacucggcgaccccgggcgg

SEQ ID NO: 287262 - RNA, 22 nt, Human
cgccccccaccaccccgagccc

SEQ ID NO: 287263 - RNA, 20 nt, Human
cgcggcgaggacgagcugga

SEQ ID NO: 287264 - RNA, 25 nt, Human
cgcugcggcggcgggcgcggggcag

SEQ ID NO: 287265 - RNA, 22 nt, Human
cggaccgacggacggagaccga

SEQ ID NO: 287266 - RNA, 19 nt, Human
cggagaccgacggacgcca

SEQ ID NO: 287267 - RNA, 21 nt, Human
cggcgguuuaagauuacaacc

SEQ ID NO: 287268 - RNA, 21 nt, Human
cuccgcacaauacggcccucc

SEQ ID NO: 287269 - RNA, 18 nt, Human
cuuuuucucuuuuuuucc

SEQ ID NO: 287270 - RNA, 23 nt, Human
gagggcacggcgggccgggcggg

SEQ ID NO: 287271 - RNA, 21 nt, Human
gauucguuuuuucuuuuccuu

SEQ ID NO: 287272 - RNA, 19 nt, Human
gcagcaccgcagacaaaag

SEQ ID NO: 287273 - RNA, 22 nt, Human
gcgcggcgaggacgagcuggag

SEQ ID NO: 287274 - RNA, 23 nt, Human
gcggcgaagggcagcacggacac

SEQ ID NO: 287275 - RNA, 21 nt, Human
gcugcggcggcgggcgcgggg

SEQ ID NO: 287276 - RNA, 23 nt, Human
ggacgagcuggagucggcgggcu

SEQ ID NO: 287277 - RNA, 18 nt, Human
ggcucggggcccgagcgg

SEQ ID NO: 287278 - RNA, 18 nt, Human
gggaaacguaagacuugg

SEQ ID NO: 287279 - RNA, 23 nt, Human
ggggggagggcacggcgggccgg

SEQ ID NO: 287280 - RNA, 21 nt, Human
uacaucaaauaaaaccaauuu

SEQ ID NO: 287281 - RNA, 22 nt, Human
ucaaaguaggaaaaaaauuaaa

SEQ ID NO: 287282 - RNA, 18 nt, Human
ucuccgcacaauacggcc

SEQ ID NO: 287283 - RNA, 25 nt, Human
ucugggccacagcagaacccaaaga

SEQ ID NO: 287284 - RNA, 19 nt, Human
ucuuuuccuuuuuuuuuuc

SEQ ID NO: 287285 - RNA, 19 nt, Human
ugaguugaauuccauaagg

SEQ ID NO: 287286 - RNA, 23 nt, Human
ugcccacggcgggccucggggac

SEQ ID NO: 287287 - RNA, 19 nt, Human
ugcggcggcgggcgcgggg

SEQ ID NO: 287288 - RNA, 18 nt, Human
uggagauuuuuuuucuuu

SEQ ID NO: 287289 - RNA, 21 nt, Human
ugggccacagcagaacccaaa

SEQ ID NO: 287290 - RNA, 23 nt, Human
uuccccgcggguucuccgaggau

SEQ ID NO: 287291 - RNA, 21 nt, Human
uucggagccggagcccgggcc

SEQ ID NO: 287292 - RNA, 18 nt, Human
uuuguaauccuugguguu

SEQ ID NO: 287293 - RNA, 26 nt, Human
uuuuuucuuuuccuuuuuuuuuuuuc

SEQ ID NO: 287294 - RNA, 21 nt, Human
aaaaaaaaacaaaaaaacaaa

SEQ ID NO: 287295 - RNA, 22 nt, Human
aaaaaaaacaaaaaaacaaaag

SEQ ID NO: 287296 - RNA, 24 nt, Human
aaaaaaaacccuccuaccacccac

SEQ ID NO: 287297 - RNA, 19 nt, Human
aaaaaaaauucccaccccu

SEQ ID NO: 287298 - RNA, 22 nt, Human
aaaaaaaauucccaccccugga

SEQ ID NO: 287299 - RNA, 26 nt, Human
aaaaaaacccuccuaccacccacgcc

SEQ ID NO: 287300 - RNA, 27 nt, Human
aaaaaacaaaaaaacaaaacaacugaa

SEQ ID NO: 287301 - RNA, 23 nt, Human
aaaaaacaaaacaacugaaaaac

SEQ ID NO: 287302 - RNA, 21 nt, Human
aaaaaacccuccuaccaccca

SEQ ID NO: 287303 - RNA, 20 nt, Human
aaaaaaggcaaaggaaaaaa

SEQ ID NO: 287304 - RNA, 21 nt, Human
aaaaacaaaacaacugaaaaa

SEQ ID NO: 287305 - RNA, 20 nt, Human
aaaaacaccccuaaaccccc

SEQ ID NO: 287306 - RNA, 21 nt, Human
aaaaacaccccuaaacccccc

SEQ ID NO: 287307 - RNA, 26 nt, Human
aaaaagaaacacaaaaggaaacaaaa

SEQ ID NO: 287308 - RNA, 22 nt, Human
aaaacaaaaacaccccuaaacc

SEQ ID NO: 287309 - RNA, 23 nt, Human
aaaacaaaaacaccccuaaaccc

SEQ ID NO: 287310 - RNA, 24 nt, Human
aaaacaaaacaacugaaaaacaaa

SEQ ID NO: 287311 - RNA, 20 nt, Human
aaaacaccccuaaacccccc

SEQ ID NO: 287312 - RNA, 25 nt, Human
aaaacagaaaaagaaacacaaaagg

SEQ ID NO: 287313 - RNA, 23 nt, Human
aaacaaaaaaacaaaacaacuga

SEQ ID NO: 287314 - RNA, 27 nt, Human
aaacaaaaacaccccuaaaccccccaa

SEQ ID NO: 287315 - RNA, 23 nt, Human
aaacacaaaaggaaacaaaauag

SEQ ID NO: 287316 - RNA, 26 nt, Human
aaacaccccuaaaccccccaaaacaa

SEQ ID NO: 287317 - RNA, 19 nt, Human
aaacagaaaaagaaacaca

SEQ ID NO: 287318 - RNA, 22 nt, Human
aaacagaaaaagaaacacaaaa

SEQ ID NO: 287319 - RNA, 31 nt, Human
aaacagaaaaagaaacacaaaaggaaacaaa

SEQ ID NO: 287320 - RNA, 24 nt, Human
aaacagagcagcaguuucaggaaa

SEQ ID NO: 287321 - RNA, 22 nt, Human
aaaggaaacaaaauagaucacc

SEQ ID NO: 287322 - RNA, 24 nt, Human
aaauaaacaaaauccaccucccac

SEQ ID NO: 287323 - RNA, 21 nt, Human
aacaccccuaaaccccccaaa

SEQ ID NO: 287324 - RNA, 24 nt, Human
aacugaaaaacaaaaacaccccua

SEQ ID NO: 287325 - RNA, 23 nt, Human
aagaaacacaaaaggaaacaaaa

SEQ ID NO: 287326 - RNA, 25 nt, Human
aagaaacacaaaaggaaacaaaaua

SEQ ID NO: 287327 - RNA, 18 nt, Human
aagcagcccccugcccca

SEQ ID NO: 287328 - RNA, 19 nt, Human
aagcugccugcccgucacc

SEQ ID NO: 287329 - RNA, 23 nt, Human
aagggaaaaaaggcaaaggaaaa

SEQ ID NO: 287330 - RNA, 21 nt, Human
aaugaagcauuccaggaggga

SEQ ID NO: 287331 - RNA, 22 nt, Human
acaaaacaacugaaaaacaaaa

SEQ ID NO: 287332 - RNA, 24 nt, Human
acuagcucucccgcaccagaaagc

SEQ ID NO: 287333 - RNA, 18 nt, Human
acugaaaaacaaaaacac

SEQ ID NO: 287334 - RNA, 23 nt, Human
acugaaaaacaaaaacaccccua

SEQ ID NO: 287335 - RNA, 21 nt, Human
acugugaaaggcgaggagaag

SEQ ID NO: 287336 - RNA, 18 nt, Human
agaaaaagaaacacaaaa

SEQ ID NO: 287337 - RNA, 20 nt, Human
agaaaaagaaacacaaaagg

SEQ ID NO: 287338 - RNA, 21 nt, Human
agaaagacacucaaaacagaa

SEQ ID NO: 287339 - RNA, 20 nt, Human
agaaagaggggugggguggg

SEQ ID NO: 287340 - RNA, 20 nt, Human
agagcuacuagucacaaguc

SEQ ID NO: 287341 - RNA, 18 nt, Human
agcagcaguuucaggaaa

SEQ ID NO: 287342 - RNA, 21 nt, Human
agcccuggguaaaaaaaaccc

SEQ ID NO: 287343 - RNA, 22 nt, Human
aggaaaaaaaaaaaacaaaaaa

SEQ ID NO: 287344 - RNA, 23 nt, Human
aggaaaaaaaaaaaacaaaaaaa

SEQ ID NO: 287345 - RNA, 21 nt, Human
aggaggggacugugaaaggcg

SEQ ID NO: 287346 - RNA, 19 nt, Human
aggcaggaggggacuguga

SEQ ID NO: 287347 - RNA, 19 nt, Human
aggcauuuguauuggggcu

SEQ ID NO: 287348 - RNA, 21 nt, Human
aggcccaaaacagagcagcag

SEQ ID NO: 287349 - RNA, 23 nt, Human
caaaaaaacaaaacaacugaaaa

SEQ ID NO: 287350 - RNA, 26 nt, Human
caaaaaaacaaaacaacugaaaaaca

SEQ ID NO: 287351 - RNA, 18 nt, Human
caaaaacaccccuaaacc

SEQ ID NO: 287352 - RNA, 22 nt, Human
caaaaacaccccuaaacccccc

SEQ ID NO: 287353 - RNA, 22 nt, Human
caaaacaacugaaaaacaaaaa

SEQ ID NO: 287354 - RNA, 22 nt, Human
caaaauccaccucccaccuccc

SEQ ID NO: 287355 - RNA, 24 nt, Human
caaaggaaaaaaaaaaaacaaaaa

SEQ ID NO: 287356 - RNA, 19 nt, Human
caacacgcgucccaccucc

SEQ ID NO: 287357 - RNA, 18 nt, Human
caaugucaccccuccaau

SEQ ID NO: 287358 - RNA, 18 nt, Human
caccccuaaaccccccaa

SEQ ID NO: 287359 - RNA, 21 nt, Human
caccccuaaaccccccaaaac

SEQ ID NO: 287360 - RNA, 23 nt, Human
caccucccaccucccuguuccca

SEQ ID NO: 287361 - RNA, 19 nt, Human
cacggccuggcaauaugcu

SEQ ID NO: 287362 - RNA, 22 nt, Human
cacugcaaaccccagcuucccc

SEQ ID NO: 287363 - RNA, 18 nt, Human
cagacuggggcccgccgc

SEQ ID NO: 287364 - RNA, 22 nt, Human
ccacucccugggccuuccccua

SEQ ID NO: 287365 - RNA, 19 nt, Human
cccaagggggugaaggggg

SEQ ID NO: 287366 - RNA, 23 nt, Human
cccacuuccucccauucccucca

SEQ ID NO: 287367 - RNA, 25 nt, Human
cccacuuccucccauucccuccaaa

SEQ ID NO: 287368 - RNA, 20 nt, Human
ccccaaaacaagguagugca

SEQ ID NO: 287369 - RNA, 21 nt, Human
ccccaaagcaggucccuccuc

SEQ ID NO: 287370 - RNA, 22 nt, Human
ccccaaagcaggucccuccuca

SEQ ID NO: 287371 - RNA, 21 nt, Human
ccccagcuuccccucauuucc

SEQ ID NO: 287372 - RNA, 18 nt, Human
ccccccaaaacaagguag

SEQ ID NO: 287373 - RNA, 19 nt, Human
cccccgaaaggacugccgg

SEQ ID NO: 287374 - RNA, 23 nt, Human
cccccugccccacucccugggcc

SEQ ID NO: 287375 - RNA, 21 nt, Human
ccccuaaaccccccaaaacaa

SEQ ID NO: 287376 - RNA, 22 nt, Human
ccccuaaaccccccaaaacaag

SEQ ID NO: 287377 - RNA, 22 nt, Human
ccccugccccacucccugggcc

SEQ ID NO: 287378 - RNA, 23 nt, Human
cccggcauguggagagcugcgcc

SEQ ID NO: 287379 - RNA, 22 nt, Human
cccuggaaaugagcuaaaaaaa

SEQ ID NO: 287380 - RNA, 18 nt, Human
ccgaucgccucaccgcag

SEQ ID NO: 287381 - RNA, 18 nt, Human
ccgggugaggcccaaaac

SEQ ID NO: 287382 - RNA, 18 nt, Human
ccuauguccacggcgcgc

SEQ ID NO: 287383 - RNA, 23 nt, Human
ccucccuguucccacuuccuccc

SEQ ID NO: 287384 - RNA, 21 nt, Human
ccuucuuuccucuuuuuuucc

SEQ ID NO: 287385 - RNA, 21 nt, Human
ccuucuuuccucuuuuuuucc

SEQ ID NO: 287386 - RNA, 25 nt, Human
cgagguaaagucucaaaaccguaaa

SEQ ID NO: 287387 - RNA, 23 nt, Human
cgcccaccuacccuugagcaggc

SEQ ID NO: 287388 - RNA, 22 nt, Human
cgcucagacuggggcccgccgc

SEQ ID NO: 287389 - RNA, 20 nt, Human
cucaaaacagaaaaagaaac

SEQ ID NO: 287390 - RNA, 23 nt, Human
cucaaaacagaaaaagaaacaca

SEQ ID NO: 287391 - RNA, 30 nt, Human
cucaaaacagaaaaagaaacacaaaaggaa

SEQ ID NO: 287392 - RNA, 19 nt, Human
cucccaccucccuguuccc

SEQ ID NO: 287393 - RNA, 28 nt, Human
cugaaaaacaaaaacaccccuaaacccc

SEQ ID NO: 287394 - RNA, 20 nt, Human
cuuccaaugucaccccucca

SEQ ID NO: 287395 - RNA, 21 nt, Human
cuucucguuccuuugggugua

SEQ ID NO: 287396 - RNA, 23 nt, Human
cuugcguaggccuucugcucccc

SEQ ID NO: 287397 - RNA, 22 nt, Human
cuuuccucuuuuuuuccucucu

SEQ ID NO: 287398 - RNA, 20 nt, Human
gaaaaaaaaaaaacaaaaaa

SEQ ID NO: 287399 - RNA, 25 nt, Human
gaaaaacaaaaacaccccuaaaccc

SEQ ID NO: 287400 - RNA, 20 nt, Human
gaagcauuccaggagggagc

SEQ ID NO: 287401 - RNA, 22 nt, Human
gacacucaaaacagaaaaagaa

SEQ ID NO: 287402 - RNA, 19 nt, Human
gacgauauuccugcuucuc

SEQ ID NO: 287403 - RNA, 20 nt, Human
gagagucgaaggggugacac

SEQ ID NO: 287404 - RNA, 20 nt, Human
gcaaaggaaaaaaaaaaaac

SEQ ID NO: 287405 - RNA, 25 nt, Human
gcaaaggaaaaaaaaaaaacaaaaa

SEQ ID NO: 287406 - RNA, 21 nt, Human
gcagcccccugccccacuccc

SEQ ID NO: 287407 - RNA, 19 nt, Human
gcccuggguaaaaaaaacc

SEQ ID NO: 287408 - RNA, 23 nt, Human
gcgaauccccagagugaauaagc

SEQ ID NO: 287409 - RNA, 19 nt, Human
gcuaaaaaaauaaacaaaa

SEQ ID NO: 287410 - RNA, 19 nt, Human
ggaaacaugggcaagcagc

SEQ ID NO: 287411 - RNA, 23 nt, Human
ggaggacucauuagcucaagcug

SEQ ID NO: 287412 - RNA, 18 nt, Human
ggagguugugaaugaagc

SEQ ID NO: 287413 - RNA, 20 nt, Human
ggcagggagccggagaaaga

SEQ ID NO: 287414 - RNA, 22 nt, Human
ggcgaggagaagacgggaggga

SEQ ID NO: 287415 - RNA, 25 nt, Human
ggcuacagaaaccugcaaagaaaga

SEQ ID NO: 287416 - RNA, 24 nt, Human
ggcuucaaacuugggaaacccgag

SEQ ID NO: 287417 - RNA, 23 nt, Human
gggagccggagaaagaggggugg

SEQ ID NO: 287418 - RNA, 23 nt, Human
gggcagggaaacaugggcaagca

SEQ ID NO: 287419 - RNA, 21 nt, Human
gggcagggagccggagaaaga

SEQ ID NO: 287420 - RNA, 22 nt, Human
ggggugggugguagaccuggcu

SEQ ID NO: 287421 - RNA, 18 nt, Human
gguaaagucucaaaaccg

SEQ ID NO: 287422 - RNA, 24 nt, Human
guagugcauuuccccagggggaag

SEQ ID NO: 287423 - RNA, 19 nt, Human
guccauggcgaauccccag

SEQ ID NO: 287424 - RNA, 22 nt, Human
uaaaaaaaacccuccuaccacc

SEQ ID NO: 287425 - RNA, 23 nt, Human
uaaaaaaaacccuccuaccaccc

SEQ ID NO: 287426 - RNA, 21 nt, Human
uaaaccccccaaaacaaggua

SEQ ID NO: 287427 - RNA, 24 nt, Human
uaacagacuggccccccuuugcuu

SEQ ID NO: 287428 - RNA, 19 nt, Human
uaagcagcccccugcccca

SEQ ID NO: 287429 - RNA, 24 nt, Human
uaaggcgggcacugcgccaaauuc

SEQ ID NO: 287430 - RNA, 25 nt, Human
uaccgccacgcugugacgauauucc

SEQ ID NO: 287431 - RNA, 22 nt, Human
uaggccuucugcuccccaguuc

SEQ ID NO: 287432 - RNA, 19 nt, Human
uagugcauuuccccagggg

SEQ ID NO: 287433 - RNA, 18 nt, Human
uaugcuaccacauagaug

SEQ ID NO: 287434 - RNA, 22 nt, Human
ucaaaacagaaaaagaaacaca

SEQ ID NO: 287435 - RNA, 23 nt, Human
ucaaaaccguaaaucacggccuu

SEQ ID NO: 287436 - RNA, 25 nt, Human
ucacggccuggcaauaugcuaccac

SEQ ID NO: 287437 - RNA, 18 nt, Human
uccaaauaaaagggaaaa

SEQ ID NO: 287438 - RNA, 20 nt, Human
uccacuagcucucccgcacc

SEQ ID NO: 287439 - RNA, 23 nt, Human
ucccaccucccuguucccacuuc

SEQ ID NO: 287440 - RNA, 25 nt, Human
ucucacggccuggcaauaugcuacc

SEQ ID NO: 287441 - RNA, 23 nt, Human
ucucagaugccgauuggcuugcg

SEQ ID NO: 287442 - RNA, 20 nt, Human
ucuuuuuuuccucucucucc

SEQ ID NO: 287443 - RNA, 23 nt, Human
ugaaaggcgaggagaagacggga

SEQ ID NO: 287444 - RNA, 24 nt, Human
ugaaaggcgaggagaagacgggag

SEQ ID NO: 287445 - RNA, 19 nt, Human
ugaagggggcagggaaaca

SEQ ID NO: 287446 - RNA, 28 nt, Human
ugaauaagcagcccccugcuguaaugac

SEQ ID NO: 287447 - RNA, 18 nt, Human
ugaaugaagcauuccagg

SEQ ID NO: 287448 - RNA, 21 nt, Human
ugacaggugaaccuugccccc

SEQ ID NO: 287449 - RNA, 21 nt, Human
ugagcaggcccaaggggguga

SEQ ID NO: 287450 - RNA, 19 nt, Human
ugauuggcccuagcuaggc

SEQ ID NO: 287451 - RNA, 22 nt, Human
ugcacccagucugugccucuaa

SEQ ID NO: 287452 - RNA, 25 nt, Human
ugccccacucccugggccuuccccu

SEQ ID NO: 287453 - RNA, 18 nt, Human
ugccucuaacauguaguc

SEQ ID NO: 287454 - RNA, 23 nt, Human
uggcgagguaaagucucaaaacc

SEQ ID NO: 287455 - RNA, 23 nt, Human
uggggugggugguagaccuggcu

SEQ ID NO: 287456 - RNA, 23 nt, Human
uguaccugcacccagucugugcc

SEQ ID NO: 287457 - RNA, 20 nt, Human
ugucccgcccucuugcguag

SEQ ID NO: 287458 - RNA, 19 nt, Human
uguugcugaaaauggaggu

SEQ ID NO: 287459 - RNA, 21 nt, Human
uuauuggcaccaucauccacu

SEQ ID NO: 287460 - RNA, 26 nt, Human
uucccacuuccucccauucccuccaa

SEQ ID NO: 287461 - RNA, 21 nt, Human
uucccaggacaagugggccua

SEQ ID NO: 287462 - RNA, 23 nt, Human
uuccuucuuuccucuuuuuuucc

SEQ ID NO: 287463 - RNA, 19 nt, Human
uucgugacaggugaaccuu

SEQ ID NO: 287464 - RNA, 26 nt, Human
uucuuuuuuuuuuuuuuaauucuuuu

SEQ ID NO: 287465 - RNA, 21 nt, Human
uugguguccuuccagagcccu

SEQ ID NO: 287466 - RNA, 20 nt, Human
uuuccaucaaggucaucuuc

SEQ ID NO: 287467 - RNA, 22 nt, Human
uuucuuuuuuuuuuuuuuaauu

SEQ ID NO: 287468 - RNA, 20 nt, Human
uuuguggauguuguuuccuu

SEQ ID NO: 287469 - RNA, 24 nt, Human
uuuuuuuccuucuuuccucuuuuu

SEQ ID NO: 287470 - RNA, 24 nt, Human
uuuuuuuuuuuuuuuuuuuauuuu

SEQ ID NO: 287471 - RNA, 22 nt, Human
aaaaaucacugugcaccaaccc

SEQ ID NO: 287472 - RNA, 25 nt, Human
aaacacagaugucagccugccccuc

SEQ ID NO: 287473 - RNA, 21 nt, Human
aaacagccccugagaucccca

SEQ ID NO: 287474 - RNA, 21 nt, Human
aacagccccugagauccccac

SEQ ID NO: 287475 - RNA, 23 nt, Human
aagaaaaaaaucacugugcacca

SEQ ID NO: 287476 - RNA, 22 nt, Human
acaaaaccagccgggcuggcca

SEQ ID NO: 287477 - RNA, 21 nt, Human
accacccacccaggggcucca

SEQ ID NO: 287478 - RNA, 20 nt, Human
accccucuugccucccagcu

SEQ ID NO: 287479 - RNA, 20 nt, Human
accucagguggccagguggg

SEQ ID NO: 287480 - RNA, 19 nt, Human
accugccuugccuuggucc

SEQ ID NO: 287481 - RNA, 21 nt, Human
accugccuugccuuggucccu

SEQ ID NO: 287482 - RNA, 18 nt, Human
agaaaaggggacucccag

SEQ ID NO: 287483 - RNA, 18 nt, Human
agagcugggggacagggu

SEQ ID NO: 287484 - RNA, 19 nt, Human
agagguggccuccucccuc

SEQ ID NO: 287485 - RNA, 22 nt, Human
agauaucuccuaggccagcccc

SEQ ID NO: 287486 - RNA, 18 nt, Human
agccagggaggagcaggg

SEQ ID NO: 287487 - RNA, 20 nt, Human
agcugcggccugggucagga

SEQ ID NO: 287488 - RNA, 19 nt, Human
agggcagccagggaggagc

SEQ ID NO: 287489 - RNA, 24 nt, Human
agggcagggggaugggagaggagg

SEQ ID NO: 287490 - RNA, 23 nt, Human
agggcucgggagggugaagagug

SEQ ID NO: 287491 - RNA, 19 nt, Human
aggguagaaaagaaaaggg

SEQ ID NO: 287492 - RNA, 21 nt, Human
aggguucagccagagcuucgg

SEQ ID NO: 287493 - RNA, 23 nt, Human
aggucugugagugccaacagccc

SEQ ID NO: 287494 - RNA, 24 nt, Human
agugaaaauauauccucaaacagc

SEQ ID NO: 287495 - RNA, 24 nt, Human
auaaucacaaagugaaaauauauc

SEQ ID NO: 287496 - RNA, 20 nt, Human
auauauccucaaacagcccc

SEQ ID NO: 287497 - RNA, 22 nt, Human
caaaaggcacgucagaagagga

SEQ ID NO: 287498 - RNA, 21 nt, Human
caagcaagggcugccccucuu

SEQ ID NO: 287499 - RNA, 22 nt, Human
cacaggggaaagcagcaucggg

SEQ ID NO: 287500 - RNA, 22 nt, Human
cacaggguucagccagagcuuc

SEQ ID NO: 287501 - RNA, 19 nt, Human
caccagcacaggguucagc

SEQ ID NO: 287502 - RNA, 18 nt, Human
caccauccagcuccagag

SEQ ID NO: 287503 - RNA, 30 nt, Human
cacccaggggcuccaggucugugagugccc

SEQ ID NO: 287504 - RNA, 18 nt, Human
caccccucuugccuccca

SEQ ID NO: 287505 - RNA, 19 nt, Human
caccucagggccagggcag

SEQ ID NO: 287506 - RNA, 19 nt, Human
caccucuggcacuuggaga

SEQ ID NO: 287507 - RNA, 28 nt, Human
caccucuggcacuuggagagccagugac

SEQ ID NO: 287508 - RNA, 19 nt, Human
cacugugcaccaacccagc

SEQ ID NO: 287509 - RNA, 21 nt, Human
cagagcuucggccuuggcugc

SEQ ID NO: 287510 - RNA, 18 nt, Human
cagccccugagaucccca

SEQ ID NO: 287511 - RNA, 22 nt, Human
cagccgggcuggccacgagggc

SEQ ID NO: 287512 - RNA, 19 nt, Human
caucuaaagugaaauaauc

SEQ ID NO: 287513 - RNA, 24 nt, Human
cauggggccgagacgggcagggcu

SEQ ID NO: 287514 - RNA, 18 nt, Human
ccacaggggaaagcagca

SEQ ID NO: 287515 - RNA, 24 nt, Human
ccaccacccacccaggggcuccag

SEQ ID NO: 287516 - RNA, 22 nt, Human
ccaccaccugcccaccucuggc

SEQ ID NO: 287517 - RNA, 19 nt, Human
ccaggcagcccgggcucag

SEQ ID NO: 287518 - RNA, 20 nt, Human
ccagucccaagauaaaaaaa

SEQ ID NO: 287519 - RNA, 23 nt, Human
cccaaggaggggauuggcuugag

SEQ ID NO: 287520 - RNA, 23 nt, Human
cccacugggacccccuuuccuug

SEQ ID NO: 287521 - RNA, 22 nt, Human
cccagcugggguccaaacccag

SEQ ID NO: 287522 - RNA, 18 nt, Human
ccccaccacccacccagg

SEQ ID NO: 287523 - RNA, 25 nt, Human
ccccacgccccagcugguccugggc

SEQ ID NO: 287524 - RNA, 18 nt, Human
ccccagcugguccugggc

SEQ ID NO: 287525 - RNA, 20 nt, Human
ccccagcugguccugggccc

SEQ ID NO: 287526 - RNA, 22 nt, Human
ccccagcugguccugggcccac

SEQ ID NO: 287527 - RNA, 21 nt, Human
cccccauuaaaaauacaaaaa

SEQ ID NO: 287528 - RNA, 22 nt, Human
cccccggcauggcgagccccac

SEQ ID NO: 287529 - RNA, 18 nt, Human
ccccuccccaccacccac

SEQ ID NO: 287530 - RNA, 19 nt, Human
cccggggcugacugguggg

SEQ ID NO: 287531 - RNA, 21 nt, Human
ccgcaggaacucuggcugggg

SEQ ID NO: 287532 - RNA, 19 nt, Human
ccucaaacagccccugaga

SEQ ID NO: 287533 - RNA, 23 nt, Human
ccucagggccagggcagccaggg

SEQ ID NO: 287534 - RNA, 22 nt, Human
ccucagguggccaggugggccc

SEQ ID NO: 287535 - RNA, 24 nt, Human
ccucccagcugggguccaaaccca

SEQ ID NO: 287536 - RNA, 18 nt, Human
ccuccccaccacccaccc

SEQ ID NO: 287537 - RNA, 23 nt, Human
ccuccccacgccccagcuggucc

SEQ ID NO: 287538 - RNA, 25 nt, Human
ccuuucuccacauggaaggggugcu

SEQ ID NO: 287539 - RNA, 21 nt, Human
cgagccccacuugaaacacag

SEQ ID NO: 287540 - RNA, 23 nt, Human
cgggugcaagagaggggagggug

SEQ ID NO: 287541 - RNA, 25 nt, Human
cugcagcccccacaccucagggcca

SEQ ID NO: 287542 - RNA, 21 nt, Human
cugcucacugccuguggcccg

SEQ ID NO: 287543 - RNA, 20 nt, Human
cuggcuggggccggggccgg

SEQ ID NO: 287544 - RNA, 21 nt, Human
cuuggagagguggccuccucc

SEQ ID NO: 287545 - RNA, 25 nt, Human
cuuggccuggucacagggccucggc

SEQ ID NO: 287546 - RNA, 18 nt, Human
cuuggggcucaacuauuc

SEQ ID NO: 287547 - RNA, 18 nt, Human
gaaccagcaaugcugggc

SEQ ID NO: 287548 - RNA, 26 nt, Human
gagcugggggacaggguggagggugc

SEQ ID NO: 287549 - RNA, 26 nt, Human
gcacaggguucagccagagcuucggc

SEQ ID NO: 287550 - RNA, 19 nt, Human
gcaccugccuugccuuggu

SEQ ID NO: 287551 - RNA, 25 nt, Human
gccagcgccccuccccaccacccac

SEQ ID NO: 287552 - RNA, 22 nt, Human
gcccaaggaggggauuggcuug

SEQ ID NO: 287553 - RNA, 25 nt, Human
gccccucuucacuccgcaggaacuc

SEQ ID NO: 287554 - RNA, 20 nt, Human
gcgccccuccccaccaccca

SEQ ID NO: 287555 - RNA, 18 nt, Human
gcugcagcccccacaccu

SEQ ID NO: 287556 - RNA, 20 nt, Human
gcuggcccgccucuucagga

SEQ ID NO: 287557 - RNA, 22 nt, Human
ggaaagcagcaucgggugggag

SEQ ID NO: 287558 - RNA, 23 nt, Human
ggaggggauuggcuugagggggu

SEQ ID NO: 287559 - RNA, 26 nt, Human
ggaggggauuggcuugaggggguggg

SEQ ID NO: 287560 - RNA, 19 nt, Human
ggccacgagggcaggggga

SEQ ID NO: 287561 - RNA, 22 nt, Human
ggccagagaggccggcugggcc

SEQ ID NO: 287562 - RNA, 19 nt, Human
ggcccggggcugacuggug

SEQ ID NO: 287563 - RNA, 19 nt, Human
ggccggggccggggcaagc

SEQ ID NO: 287564 - RNA, 22 nt, Human
gggaggccagagaggccggcug

SEQ ID NO: 287565 - RNA, 25 nt, Human
gggauuggcuugagggggugggcag

SEQ ID NO: 287566 - RNA, 23 nt, Human
gggcagggggaugggagaggagg

SEQ ID NO: 287567 - RNA, 22 nt, Human
gggccagggcagccagggagga

SEQ ID NO: 287568 - RNA, 24 nt, Human
gggccagggcagccagggaggagc

SEQ ID NO: 287569 - RNA, 19 nt, Human
gggccgagacgggcagggc

SEQ ID NO: 287570 - RNA, 25 nt, Human
gggccgagacgggcagggcucggga

SEQ ID NO: 287571 - RNA, 21 nt, Human
gggcggacggugggugugaga

SEQ ID NO: 287572 - RNA, 20 nt, Human
gggggaugggagaggagggg

SEQ ID NO: 287573 - RNA, 19 nt, Human
gguaccaggaauggcuagg

SEQ ID NO: 287574 - RNA, 18 nt, Human
ggucccuuccuaugaugg

SEQ ID NO: 287575 - RNA, 21 nt, Human
guggugguggaggcacggagc

SEQ ID NO: 287576 - RNA, 25 nt, Human
uacaaaaccagccgggcuggccacg

SEQ ID NO: 287577 - RNA, 20 nt, Human
uaucuccuaggccagccccc

SEQ ID NO: 287578 - RNA, 20 nt, Human
ucacuccgcaggaacucugg

SEQ ID NO: 287579 - RNA, 25 nt, Human
ucagggccagggcagccagggagga

SEQ ID NO: 287580 - RNA, 23 nt, Human
uccaaacccagucccaagauaaa

SEQ ID NO: 287581 - RNA, 18 nt, Human
ucccaagauaaaaaaaua

SEQ ID NO: 287582 - RNA, 19 nt, Human
ucccacugggacccccuuu

SEQ ID NO: 287583 - RNA, 23 nt, Human
ucccaggugccugcucacugccu

SEQ ID NO: 287584 - RNA, 21 nt, Human
uccccaccacccacccagggg

SEQ ID NO: 287585 - RNA, 22 nt, Human
uccuaggccagcccccgacugc

SEQ ID NO: 287586 - RNA, 18 nt, Human
uccuaugauggcugcugc

SEQ ID NO: 287587 - RNA, 20 nt, Human
ucuccacauggaaggggugc

SEQ ID NO: 287588 - RNA, 19 nt, Human
ugaaacacagaugucagcc

SEQ ID NO: 287589 - RNA, 21 nt, Human
ugaaacacagaugucagccug

SEQ ID NO: 287590 - RNA, 23 nt, Human
ugaacccccggcauggcgagccc

SEQ ID NO: 287591 - RNA, 24 nt, Human
ugaacccccggcauggcgagcccc

SEQ ID NO: 287592 - RNA, 23 nt, Human
ugaauuaaaaagugcccaaggag

SEQ ID NO: 287593 - RNA, 19 nt, Human
ugagggggugggcaguggg

SEQ ID NO: 287594 - RNA, 21 nt, Human
ugcaagagaggggaggguggu

SEQ ID NO: 287595 - RNA, 22 nt, Human
ugccaccaccugcccaccucug

SEQ ID NO: 287596 - RNA, 22 nt, Human
ugcccuaaagguuucacuccuu

SEQ ID NO: 287597 - RNA, 19 nt, Human
ugcugccgccaagacucac

SEQ ID NO: 287598 - RNA, 20 nt, Human
uggaaggggugcugagggug

SEQ ID NO: 287599 - RNA, 18 nt, Human
uggaggcacggagcacag

SEQ ID NO: 287600 - RNA, 18 nt, Human
uggccaggugggcccgag

SEQ ID NO: 287601 - RNA, 20 nt, Human
uggccaggugggcccgaggg

SEQ ID NO: 287602 - RNA, 18 nt, Human
uggcccggggcugacugg

SEQ ID NO: 287603 - RNA, 19 nt, Human
uggcugcgccagccuggug

SEQ ID NO: 287604 - RNA, 24 nt, Human
ugggacccuggagcgcccgucucc

SEQ ID NO: 287605 - RNA, 21 nt, Human
ugggagaggagggggcacccc

SEQ ID NO: 287606 - RNA, 19 nt, Human
ugggaggccagagaggccg

SEQ ID NO: 287607 - RNA, 21 nt, Human
ugggaggccagagaggccggc

SEQ ID NO: 287608 - RNA, 24 nt, Human
ugggaggggacugauuguccuaau

SEQ ID NO: 287609 - RNA, 22 nt, Human
ugggguccaaacccagucccaa

SEQ ID NO: 287610 - RNA, 18 nt, Human
ugguuugcauagucugca

SEQ ID NO: 287611 - RNA, 22 nt, Human
uguccauuaaauagaaccagca

SEQ ID NO: 287612 - RNA, 21 nt, Human
uuggagagccagugaccuaug

SEQ ID NO: 287613 - RNA, 24 nt, Human
uuggagagguggccuccucccuca

SEQ ID NO: 287614 - RNA, 18 nt, Human
uugggcccugacgggaga

SEQ ID NO: 287615 - RNA, 20 nt, Human
aaaagcacggggagaagagu

SEQ ID NO: 287616 - RNA, 20 nt, Human
aaacaagguucaugcuugca

SEQ ID NO: 287617 - RNA, 20 nt, Human
aaaggaacuuaauaaagagc

SEQ ID NO: 287618 - RNA, 19 nt, Human
aaaggcagccaaaguucua

SEQ ID NO: 287619 - RNA, 18 nt, Human
aacauuguacuugcuuca

SEQ ID NO: 287620 - RNA, 25 nt, Human
aagagcaucuacaaaaaauauacag

SEQ ID NO: 287621 - RNA, 25 nt, Human
aagcaauccuccugccucaacuucc

SEQ ID NO: 287622 - RNA, 22 nt, Human
aagcacggggagaagagugaug

SEQ ID NO: 287623 - RNA, 19 nt, Human
aaggggaaagcauucaguc

SEQ ID NO: 287624 - RNA, 19 nt, Human
aagguggacggauggaugg

SEQ ID NO: 287625 - RNA, 19 nt, Human
aauugaucaagcagaucug

SEQ ID NO: 287626 - RNA, 18 nt, Human
acacagacacaggaguuu

SEQ ID NO: 287627 - RNA, 23 nt, Human
acacagccgcagaaaagcacggg

SEQ ID NO: 287628 - RNA, 18 nt, Human
accuccuuaagagccacc

SEQ ID NO: 287629 - RNA, 18 nt, Human
acucaaauuccugggcuc

SEQ ID NO: 287630 - RNA, 23 nt, Human
acucuuaucuuagaaaugaagau

SEQ ID NO: 287631 - RNA, 18 nt, Human
acucuugugaccugaggg

SEQ ID NO: 287632 - RNA, 24 nt, Human
acugcugcaguuucagaaguagcu

SEQ ID NO: 287633 - RNA, 21 nt, Human
agaaaggaacuuaauaaagag

SEQ ID NO: 287634 - RNA, 26 nt, Human
agaaaugaagauuagcucaaaagaga

SEQ ID NO: 287635 - RNA, 21 nt, Human
agacagaacacgguaacaagg

SEQ ID NO: 287636 - RNA, 18 nt, Human
agacucuggccgacaguc

SEQ ID NO: 287637 - RNA, 19 nt, Human
agaguuguagauucaauaa

SEQ ID NO: 287638 - RNA, 18 nt, Human
agaugucaauaaaacaca

SEQ ID NO: 287639 - RNA, 23 nt, Human
agcaauaaaaugagaacaguuau

SEQ ID NO: 287640 - RNA, 20 nt, Human
agcacaggauagauugagcc

SEQ ID NO: 287641 - RNA, 22 nt, Human
agccaacaagcagcauuugaga

SEQ ID NO: 287642 - RNA, 18 nt, Human
agccgcuccgcgccgggg

SEQ ID NO: 287643 - RNA, 19 nt, Human
agcugcgagugcgccgggg

SEQ ID NO: 287644 - RNA, 22 nt, Human
aggagaguuuuggggaaaggcg

SEQ ID NO: 287645 - RNA, 20 nt, Human
aggaggaggcggccgcggcg

SEQ ID NO: 287646 - RNA, 20 nt, Human
aggaggcggccgcggcgcgu

SEQ ID NO: 287647 - RNA, 22 nt, Human
aggcaaaugcacugucgucaaa

SEQ ID NO: 287648 - RNA, 18 nt, Human
agggcgccgcuccugaaa

SEQ ID NO: 287649 - RNA, 23 nt, Human
agugccugcccucugugggcagc

SEQ ID NO: 287650 - RNA, 19 nt, Human
auagaguauaggagacccc

SEQ ID NO: 287651 - RNA, 21 nt, Human
augcuuucuacuggagauaca

SEQ ID NO: 287652 - RNA, 22 nt, Human
auggucccagaagcugcuccaa

SEQ ID NO: 287653 - RNA, 18 nt, Human
auguagaaaaguguaaag

SEQ ID NO: 287654 - RNA, 21 nt, Human
auguccaaagugcugagccuc

SEQ ID NO: 287655 - RNA, 24 nt, Human
caaauuccugggcucaagcaaucc

SEQ ID NO: 287656 - RNA, 22 nt, Human
caacaagcagcauuugagagga

SEQ ID NO: 287657 - RNA, 23 nt, Human
caagcaauccuccugccucaacu

SEQ ID NO: 287658 - RNA, 23 nt, Human
caagcgccuuucuuuucugcuuu

SEQ ID NO: 287659 - RNA, 22 nt, Human
caaggcaaaugcacugucguca

SEQ ID NO: 287660 - RNA, 21 nt, Human
cacacgcauucaugcagucaa

SEQ ID NO: 287661 - RNA, 21 nt, Human
cacuucgcaccugucucuuca

SEQ ID NO: 287662 - RNA, 24 nt, Human
cagaaccgacuaaacaauacuggu

SEQ ID NO: 287663 - RNA, 23 nt, Human
cagaaugccuccuguugccucuc

SEQ ID NO: 287664 - RNA, 18 nt, Human
cagauugcaaaaucucaa

SEQ ID NO: 287665 - RNA, 18 nt, Human
caggguucgccagcuggg

SEQ ID NO: 287666 - RNA, 18 nt, Human
caggugcagggcgccgcu

SEQ ID NO: 287667 - RNA, 22 nt, Human
caucugucccucugcaguauuu

SEQ ID NO: 287668 - RNA, 21 nt, Human
cauuguacuugcuucauugau

SEQ ID NO: 287669 - RNA, 20 nt, Human
ccaaaguucuaaauguggug

SEQ ID NO: 287670 - RNA, 21 nt, Human
ccacccaccuggcuugggugc

SEQ ID NO: 287671 - RNA, 23 nt, Human
ccaccgccgccgccaacaccgcc

SEQ ID NO: 287672 - RNA, 21 nt, Human
cccccgggcccgcgcuccugc

SEQ ID NO: 287673 - RNA, 18 nt, Human
cccgaaacgccccccacc

SEQ ID NO: 287674 - RNA, 18 nt, Human
cccgagcugcgagugcgc

SEQ ID NO: 287675 - RNA, 21 nt, Human
cccucugugggcagcuaggcu

SEQ ID NO: 287676 - RNA, 22 nt, Human
ccgccaacaccgccgcgggcgg

SEQ ID NO: 287677 - RNA, 22 nt, Human
ccgcccccgggcccgcgcuccu

SEQ ID NO: 287678 - RNA, 21 nt, Human
ccgccgccaacaccgccgcgg

SEQ ID NO: 287679 - RNA, 19 nt, Human
ccgccgccaccgccgccgc

SEQ ID NO: 287680 - RNA, 22 nt, Human
ccgccgccaccgccgccgccaa

SEQ ID NO: 287681 - RNA, 18 nt, Human
ccgccgccgccaacaccg

SEQ ID NO: 287682 - RNA, 19 nt, Human
ccgccgccgccaacaccgc

SEQ ID NO: 287683 - RNA, 23 nt, Human
ccgccgccgccaccgccgccgcc

SEQ ID NO: 287684 - RNA, 25 nt, Human
ccgccgccgccaccgccgccgccaa

SEQ ID NO: 287685 - RNA, 18 nt, Human
ccgccgccgccgccaccg

SEQ ID NO: 287686 - RNA, 24 nt, Human
ccgccgccgccgccaccgccgccg

SEQ ID NO: 287687 - RNA, 19 nt, Human
ccgcgcuccugcgaccggg

SEQ ID NO: 287688 - RNA, 20 nt, Human
ccgcggcgcguucccgcccc

SEQ ID NO: 287689 - RNA, 25 nt, Human
ccuccugccucaacuucccuaguag

SEQ ID NO: 287690 - RNA, 21 nt, Human
ccuccuuaagagccaccaccc

SEQ ID NO: 287691 - RNA, 22 nt, Human
ccucuccucagaaggcucugca

SEQ ID NO: 287692 - RNA, 19 nt, Human
ccucugugggcagcuaggc

SEQ ID NO: 287693 - RNA, 21 nt, Human
ccugcgaccgggcuccggggc

SEQ ID NO: 287694 - RNA, 23 nt, Human
ccugggcucaagcaauccuccug

SEQ ID NO: 287695 - RNA, 22 nt, Human
cgaggagaguuuuggggaaagg

SEQ ID NO: 287696 - RNA, 20 nt, Human
cgcacacgcauucaugcagu

SEQ ID NO: 287697 - RNA, 19 nt, Human
cgcccgagcugcgagugcg

SEQ ID NO: 287698 - RNA, 23 nt, Human
cgccgccgccgccgccaccgccg

SEQ ID NO: 287699 - RNA, 19 nt, Human
cgcggcgcguucccgcccc

SEQ ID NO: 287700 - RNA, 19 nt, Human
cggcacagaaggcaugugc

SEQ ID NO: 287701 - RNA, 23 nt, Human
cuagauguaguacaguuuccuuu

SEQ ID NO: 287702 - RNA, 24 nt, Human
cucaagcaauccuccugccucaac

SEQ ID NO: 287703 - RNA, 23 nt, Human
cugaaaggaaaucaagaauucau

SEQ ID NO: 287704 - RNA, 18 nt, Human
cugcgggucacuucgcac

SEQ ID NO: 287705 - RNA, 18 nt, Human
cuguguuguccaggcuag

SEQ ID NO: 287706 - RNA, 20 nt, Human
cuuaagagccaccacccacc

SEQ ID NO: 287707 - RNA, 18 nt, Human
cuuagaaaugaagauuag

SEQ ID NO: 287708 - RNA, 20 nt, Human
cuucgcaccugucucuucac

SEQ ID NO: 287709 - RNA, 28 nt, Human
cuucuggucuggcuuuggaaggaaaacc

SEQ ID NO: 287710 - RNA, 18 nt, Human
cuuuaaaucugucuuccu

SEQ ID NO: 287711 - RNA, 21 nt, Human
cuuuaaaucugucuuccuuuc

SEQ ID NO: 287712 - RNA, 26 nt, Human
gaacaccuccuuaagagccaccaccc

SEQ ID NO: 287713 - RNA, 24 nt, Human
gaagguggacggauggauggaugg

SEQ ID NO: 287714 - RNA, 25 nt, Human
gacugcuggcccuuugucacaugug

SEQ ID NO: 287715 - RNA, 18 nt, Human
gagaaagacgaggucgaa

SEQ ID NO: 287716 - RNA, 21 nt, Human
gagaaagacgaggucgaaaag

SEQ ID NO: 287717 - RNA, 20 nt, Human
gagaagagugaugugugaug

SEQ ID NO: 287718 - RNA, 18 nt, Human
gagcaggacaauauggag

SEQ ID NO: 287719 - RNA, 19 nt, Human
gagccggggaggaggaggc

SEQ ID NO: 287720 - RNA, 19 nt, Human
gagccucugggggcgggag

SEQ ID NO: 287721 - RNA, 23 nt, Human
gaggaagguggacggauggaugg

SEQ ID NO: 287722 - RNA, 18 nt, Human
gaggagaguuuuggggaa

SEQ ID NO: 287723 - RNA, 21 nt, Human
gaggaggaggcggccgcggcg

SEQ ID NO: 287724 - RNA, 19 nt, Human
gaggguucuuccguaaugu

SEQ ID NO: 287725 - RNA, 21 nt, Human
gauggcuagcaauaaaaugag

SEQ ID NO: 287726 - RNA, 23 nt, Human
gauucauaaaugugcacagcagc

SEQ ID NO: 287727 - RNA, 20 nt, Human
gcccccgggcccgcgcuccu

SEQ ID NO: 287728 - RNA, 19 nt, Human
gcccgcgcuccugcgaccg

SEQ ID NO: 287729 - RNA, 18 nt, Human
gccgcagaaaagcacggg

SEQ ID NO: 287730 - RNA, 21 nt, Human
gccgccuuuuaaagccgcucc

SEQ ID NO: 287731 - RNA, 20 nt, Human
gcugagccucugggggcggg

SEQ ID NO: 287732 - RNA, 18 nt, Human
gcugcgagugcgccgggg

SEQ ID NO: 287733 - RNA, 18 nt, Human
gcugcgagugcgccgggg

SEQ ID NO: 287734 - RNA, 20 nt, Human
gcuggccacagaaugccucc

SEQ ID NO: 287735 - RNA, 21 nt, Human
ggagaagagugaugugugaug

SEQ ID NO: 287736 - RNA, 18 nt, Human
ggauguuaacucuuuuau

SEQ ID NO: 287737 - RNA, 21 nt, Human
ggccgacagucuggaggaagg

SEQ ID NO: 287738 - RNA, 24 nt, Human
ggccgcggcgcguucccgcccccg

SEQ ID NO: 287739 - RNA, 23 nt, Human
gggauacuuuucuuaaauagcug

SEQ ID NO: 287740 - RNA, 22 nt, Human
gggcucaagcaauccuccugcc

SEQ ID NO: 287741 - RNA, 18 nt, Human
ggggguggagugccgccu

SEQ ID NO: 287742 - RNA, 24 nt, Human
guagugggggaaguaauuuuuuuu

SEQ ID NO: 287743 - RNA, 19 nt, Human
gugagccauguccaaagug

SEQ ID NO: 287744 - RNA, 23 nt, Human
gugccgccuuuuaaagccgcucc

SEQ ID NO: 287745 - RNA, 24 nt, Human
gugccgccuuuuaaagccgcuccg

SEQ ID NO: 287746 - RNA, 20 nt, Human
uaaaaaaaacuccucggacc

SEQ ID NO: 287747 - RNA, 20 nt, Human
uaaaaugcauauauaucggg

SEQ ID NO: 287748 - RNA, 19 nt, Human
uaaacaacaucuggguucu

SEQ ID NO: 287749 - RNA, 20 nt, Human
uaaggggaaagcauucaguc

SEQ ID NO: 287750 - RNA, 31 nt, Human
uaauaaagagcaucuacaaaaaauauacagg

SEQ ID NO: 287751 - RNA, 19 nt, Human
uacacagccgcagaaaagc

SEQ ID NO: 287752 - RNA, 21 nt, Human
uacacagccgcagaaaagcac

SEQ ID NO: 287753 - RNA, 26 nt, Human
uacagcugaagacagaaccggggucc

SEQ ID NO: 287754 - RNA, 25 nt, Human
uaccaugguaguaaaaguccuagcc

SEQ ID NO: 287755 - RNA, 23 nt, Human
uacuacacagccgcagaaaagca

SEQ ID NO: 287756 - RNA, 19 nt, Human
uagcaauaaaaugagaaca

SEQ ID NO: 287757 - RNA, 22 nt, Human
uaguaaaaguccuagccaguac

SEQ ID NO: 287758 - RNA, 24 nt, Human
uaguagcugcgacuauaggcacac

SEQ ID NO: 287759 - RNA, 20 nt, Human
uauguacagcugaagacaga

SEQ ID NO: 287760 - RNA, 21 nt, Human
uauguacagcugaagacagaa

SEQ ID NO: 287761 - RNA, 21 nt, Human
uauucaagggaauugaucaag

SEQ ID NO: 287762 - RNA, 23 nt, Human
ucaagggaauugaucaagcagau

SEQ ID NO: 287763 - RNA, 22 nt, Human
ucaggucgagguggucguucag

SEQ ID NO: 287764 - RNA, 22 nt, Human
ucauugauuucucuuucagagu

SEQ ID NO: 287765 - RNA, 22 nt, Human
ucccagaagcugcuccaaagcc

SEQ ID NO: 287766 - RNA, 20 nt, Human
uccggggccgagagccgucc

SEQ ID NO: 287767 - RNA, 19 nt, Human
uccugcuguguuguccagg

SEQ ID NO: 287768 - RNA, 18 nt, Human
uccugggcucaagcaauc

SEQ ID NO: 287769 - RNA, 21 nt, Human
uccugggcucaagcaauccuc

SEQ ID NO: 287770 - RNA, 22 nt, Human
uccugggcucaagcaauccucc

SEQ ID NO: 287771 - RNA, 22 nt, Human
uccugggcucaagcaauccucc

SEQ ID NO: 287772 - RNA, 24 nt, Human
uccugggcucaagcaauccuccug

SEQ ID NO: 287773 - RNA, 22 nt, Human
ucuccccgagauaaguggggau

SEQ ID NO: 287774 - RNA, 19 nt, Human
ucugcuuuggucuugaaga

SEQ ID NO: 287775 - RNA, 20 nt, Human
ucuucugaagggcagaggcu

SEQ ID NO: 287776 - RNA, 22 nt, Human
ucuuuuuuucucaaacgaggag

SEQ ID NO: 287777 - RNA, 18 nt, Human
ugaaagagaaaaggaggu

SEQ ID NO: 287778 - RNA, 20 nt, Human
ugaaaggaaaucaagaauuc

SEQ ID NO: 287779 - RNA, 18 nt, Human
ugacaaacuugaaagccg

SEQ ID NO: 287780 - RNA, 20 nt, Human
ugacaacaguguguauggug

SEQ ID NO: 287781 - RNA, 19 nt, Human
ugaccaaaccguccccaga

SEQ ID NO: 287782 - RNA, 20 nt, Human
ugaccaaaccguccccagac

SEQ ID NO: 287783 - RNA, 21 nt, Human
ugaccaaaccguccccagacu

SEQ ID NO: 287784 - RNA, 18 nt, Human
ugaggugagacaaagguc

SEQ ID NO: 287785 - RNA, 19 nt, Human
ugaguuuagcaagguugca

SEQ ID NO: 287786 - RNA, 23 nt, Human
ugauauuuuuuuuucucaccagu

SEQ ID NO: 287787 - RNA, 18 nt, Human
ugaucaagcagaucugug

SEQ ID NO: 287788 - RNA, 20 nt, Human
ugauggaugauuaacaaugc

SEQ ID NO: 287789 - RNA, 23 nt, Human
ugauggaugauuaacaaugcaug

SEQ ID NO: 287790 - RNA, 22 nt, Human
ugcacgcacacgcauucaugca

SEQ ID NO: 287791 - RNA, 24 nt, Human
ugcagggcgccgcuccugaaacag

SEQ ID NO: 287792 - RNA, 21 nt, Human
ugccaagcgccuuucuuuucu

SEQ ID NO: 287793 - RNA, 20 nt, Human
ugccucaacuucccuaguag

SEQ ID NO: 287794 - RNA, 19 nt, Human
ugcgaccgggcuccggggc

SEQ ID NO: 287795 - RNA, 20 nt, Human
ugcgccgggggguggagugc

SEQ ID NO: 287796 - RNA, 24 nt, Human
ugcuguguuguccaggcuagacuc

SEQ ID NO: 287797 - RNA, 22 nt, Human
ugcuucauugauuucucuuuca

SEQ ID NO: 287798 - RNA, 26 nt, Human
ugcuugcacgcacacgcauucaugca

SEQ ID NO: 287799 - RNA, 21 nt, Human
uggaugauuaacaaugcaugg

SEQ ID NO: 287800 - RNA, 18 nt, Human
uggcuuuggaauuggacu

SEQ ID NO: 287801 - RNA, 19 nt, Human
uggcuuuggaauuggacuu

SEQ ID NO: 287802 - RNA, 18 nt, Human
ugggaaaaaagacauugu

SEQ ID NO: 287803 - RNA, 24 nt, Human
ugggcucaagcaauccuccugccu

SEQ ID NO: 287804 - RNA, 18 nt, Human
ugguauagguggugucuc

SEQ ID NO: 287805 - RNA, 22 nt, Human
ugucucuucacccuucguuuca

SEQ ID NO: 287806 - RNA, 19 nt, Human
ugugagcaccuugcuauuc

SEQ ID NO: 287807 - RNA, 24 nt, Human
ugugagcaccuugcuauucugcuu

SEQ ID NO: 287808 - RNA, 23 nt, Human
ugugcacagcagcaguugguugc

SEQ ID NO: 287809 - RNA, 23 nt, Human
uguguuguccaggcuagacucaa

SEQ ID NO: 287810 - RNA, 24 nt, Human
uguguuguccaggcuagacucaaa

SEQ ID NO: 287811 - RNA, 23 nt, Human
uuagaaaaaauacguaacuacau

SEQ ID NO: 287812 - RNA, 22 nt, Human
uucacuuccuguugcuggagcc

SEQ ID NO: 287813 - RNA, 22 nt, Human
uucagaguuguagauucaauaa

SEQ ID NO: 287814 - RNA, 21 nt, Human
uugaaguaaagggccugcggg

SEQ ID NO: 287815 - RNA, 19 nt, Human
uuggagaguccuuuuaagg

SEQ ID NO: 287816 - RNA, 19 nt, Human
uuggucaucugucccucug

SEQ ID NO: 287817 - RNA, 21 nt, Human
uuucugcuuuggucuugaaga

SEQ ID NO: 287818 - RNA, 21 nt, Human
uuuuaauaauuauggauuugu

SEQ ID NO: 287819 - RNA, 22 nt, Human
aagagccuugcagguacaaggc

SEQ ID NO: 287820 - RNA, 20 nt, Human
aagcagggcaggggaggaag

SEQ ID NO: 287821 - RNA, 18 nt, Human
aagcccccgcacccucuc

SEQ ID NO: 287822 - RNA, 22 nt, Human
aagcccggccgacuucccgggg

SEQ ID NO: 287823 - RNA, 19 nt, Human
aagcucggagaccagacag

SEQ ID NO: 287824 - RNA, 21 nt, Human
aaggaagggggugcugacggc

SEQ ID NO: 287825 - RNA, 23 nt, Human
aagggcugccagcagggagaaug

SEQ ID NO: 287826 - RNA, 19 nt, Human
acaaaacaggugcauugcu

SEQ ID NO: 287827 - RNA, 20 nt, Human
acacaaucauguacaaaaca

SEQ ID NO: 287828 - RNA, 20 nt, Human
accaucggcggcgacucggg

SEQ ID NO: 287829 - RNA, 19 nt, Human
accccaagccccagcaccc

SEQ ID NO: 287830 - RNA, 21 nt, Human
accccaagccccagcacccca

SEQ ID NO: 287831 - RNA, 23 nt, Human
agaccagacagugauaaggaagg

SEQ ID NO: 287832 - RNA, 21 nt, Human
agacgagagugggaggggagg

SEQ ID NO: 287833 - RNA, 18 nt, Human
agacggcgggcggugggg

SEQ ID NO: 287834 - RNA, 22 nt, Human
agcaggugggcccuuugcuccc

SEQ ID NO: 287835 - RNA, 19 nt, Human
aggaagaagagguuaggaa

SEQ ID NO: 287836 - RNA, 19 nt, Human
aggaagggaagcagggcag

SEQ ID NO: 287837 - RNA, 22 nt, Human
aggaggccuuugagagcagggu

SEQ ID NO: 287838 - RNA, 19 nt, Human
aggagggaggagggcaucu

SEQ ID NO: 287839 - RNA, 21 nt, Human
aggagggaggagggcaucugc

SEQ ID NO: 287840 - RNA, 18 nt, Human
aggcccaggaggccaggu

SEQ ID NO: 287841 - RNA, 19 nt, Human
aggcccaggaggccaggug

SEQ ID NO: 287842 - RNA, 23 nt, Human
aggcccccaaccccaacuccugc

SEQ ID NO: 287843 - RNA, 20 nt, Human
agggaagcagggcaggggag

SEQ ID NO: 287844 - RNA, 20 nt, Human
agggagaguggggggccagg

SEQ ID NO: 287845 - RNA, 25 nt, Human
agggggauggacaagugcggagcug

SEQ ID NO: 287846 - RNA, 22 nt, Human
auggcaaggggcguggccccca

SEQ ID NO: 287847 - RNA, 21 nt, Human
auggggcaggugccggcagcc

SEQ ID NO: 287848 - RNA, 18 nt, Human
auucacccuccuguaccc

SEQ ID NO: 287849 - RNA, 21 nt, Human
auucacccuccuguaccccag

SEQ ID NO: 287850 - RNA, 23 nt, Human
caagccccagcaccccagccucc

SEQ ID NO: 287851 - RNA, 23 nt, Human
caagguaagcgaugagggacaga

SEQ ID NO: 287852 - RNA, 19 nt, Human
caccaugacuuccuccagc

SEQ ID NO: 287853 - RNA, 18 nt, Human
caccccaagccccagcac

SEQ ID NO: 287854 - RNA, 21 nt, Human
cacccuaggccaggggacuuu

SEQ ID NO: 287855 - RNA, 18 nt, Human
caccucaggcugcagccg

SEQ ID NO: 287856 - RNA, 22 nt, Human
cacuggagcugggaggacugca

SEQ ID NO: 287857 - RNA, 23 nt, Human
cagagguccccaagagacuuuuc

SEQ ID NO: 287858 - RNA, 21 nt, Human
cagcaggagcaaaggaggacu

SEQ ID NO: 287859 - RNA, 20 nt, Human
cagcaucgugggugcaggca

SEQ ID NO: 287860 - RNA, 18 nt, Human
cagcucaggcccugccag

SEQ ID NO: 287861 - RNA, 23 nt, Human
caggagggaggagggcaucugcg

SEQ ID NO: 287862 - RNA, 25 nt, Human
caggccccaaggugcagauugccag

SEQ ID NO: 287863 - RNA, 19 nt, Human
caggcccugccagaguguc

SEQ ID NO: 287864 - RNA, 19 nt, Human
caggcugcuacuguugcug

SEQ ID NO: 287865 - RNA, 20 nt, Human
caggcuggaguccagcuggg

SEQ ID NO: 287866 - RNA, 20 nt, Human
ccaagccccagcaccccagc

SEQ ID NO: 287867 - RNA, 23 nt, Human
ccagguggcccugcaaaugcucu

SEQ ID NO: 287868 - RNA, 18 nt, Human
cccacaugaagaagguca

SEQ ID NO: 287869 - RNA, 22 nt, Human
cccacaugaagaaggucagagc

SEQ ID NO: 287870 - RNA, 19 nt, Human
cccaggugcugggaagccg

SEQ ID NO: 287871 - RNA, 21 nt, Human
ccccaaagguccuuucacucu

SEQ ID NO: 287872 - RNA, 19 nt, Human
ccccaagagacuuuucuuc

SEQ ID NO: 287873 - RNA, 18 nt, Human
ccccaagccccagcaccc

SEQ ID NO: 287874 - RNA, 18 nt, Human
ccccaagccccagcaccc

SEQ ID NO: 287875 - RNA, 19 nt, Human
ccccagcaccccagccucc

SEQ ID NO: 287876 - RNA, 21 nt, Human
cccccaaccccaacuccugcc

SEQ ID NO: 287877 - RNA, 23 nt, Human
cccccaaccccaacuccugccug

SEQ ID NO: 287878 - RNA, 18 nt, Human
cccggccucaagcccggc

SEQ ID NO: 287879 - RNA, 22 nt, Human
cccggccucaagcccggccgac

SEQ ID NO: 287880 - RNA, 23 nt, Human
cccgugcagcaucgugggugcag

SEQ ID NO: 287881 - RNA, 20 nt, Human
cccgugcggccuucacgggc

SEQ ID NO: 287882 - RNA, 22 nt, Human
cccuggggccaccccaagcccc

SEQ ID NO: 287883 - RNA, 23 nt, Human
cccuggucugcuucccaagcccc

SEQ ID NO: 287884 - RNA, 19 nt, Human
ccucagggcucaggagacu

SEQ ID NO: 287885 - RNA, 21 nt, Human
ccuccagcucaccccucuuuc

SEQ ID NO: 287886 - RNA, 25 nt, Human
ccuccagguggcccugcaaaugcuc

SEQ ID NO: 287887 - RNA, 19 nt, Human
ccuggcccugagggaggcc

SEQ ID NO: 287888 - RNA, 20 nt, Human
cgacucggggcgaagcggga

SEQ ID NO: 287889 - RNA, 18 nt, Human
cgcugccgccgccaccgc

SEQ ID NO: 287890 - RNA, 19 nt, Human
cggagggagugaggcgggg

SEQ ID NO: 287891 - RNA, 22 nt, Human
cguuccuccuccagucccaccg

SEQ ID NO: 287892 - RNA, 19 nt, Human
cuacaggaggaggccgugg

SEQ ID NO: 287893 - RNA, 23 nt, Human
cucaccccucuuucaugucuggg

SEQ ID NO: 287894 - RNA, 21 nt, Human
cuccuguaccccagugacacc

SEQ ID NO: 287895 - RNA, 19 nt, Human
cucucucucuuuaccugga

SEQ ID NO: 287896 - RNA, 19 nt, Human
cugcagccgaagcucggag

SEQ ID NO: 287897 - RNA, 18 nt, Human
cugcaggacuucucagcu

SEQ ID NO: 287898 - RNA, 19 nt, Human
cuggaggcccaggaggcca

SEQ ID NO: 287899 - RNA, 18 nt, Human
cugggcccuggagcucag

SEQ ID NO: 287900 - RNA, 23 nt, Human
cuggugcugcaggacuucucagc

SEQ ID NO: 287901 - RNA, 24 nt, Human
cuucauucacccuccuguacccca

SEQ ID NO: 287902 - RNA, 23 nt, Human
cuuugccguagguuugggggucc

SEQ ID NO: 287903 - RNA, 26 nt, Human
cuuuguuuuguucuguuuugacuuuu

SEQ ID NO: 287904 - RNA, 18 nt, Human
gaacccgaagagcagaug

SEQ ID NO: 287905 - RNA, 23 nt, Human
gaagggaagcagggcaggggagg

SEQ ID NO: 287906 - RNA, 19 nt, Human
gacgagagugggaggggag

SEQ ID NO: 287907 - RNA, 21 nt, Human
gacggagggagugaggcgggg

SEQ ID NO: 287908 - RNA, 23 nt, Human
gagaagcagcaggagcaaaggag

SEQ ID NO: 287909 - RNA, 19 nt, Human
gagcaaaggaggacugagg

SEQ ID NO: 287910 - RNA, 20 nt, Human
gagcccaggacacaccucag

SEQ ID NO: 287911 - RNA, 24 nt, Human
gaggagcccaggacacaccucagg

SEQ ID NO: 287912 - RNA, 22 nt, Human
gaggggaaacagggcugggcug

SEQ ID NO: 287913 - RNA, 19 nt, Human
gaggggcggcaguggggag

SEQ ID NO: 287914 - RNA, 20 nt, Human
gaggucugccuguccccggg

SEQ ID NO: 287915 - RNA, 19 nt, Human
gauguugggcuaaguccua

SEQ ID NO: 287916 - RNA, 19 nt, Human
gccagcuucccaccuuucc

SEQ ID NO: 287917 - RNA, 18 nt, Human
gccccagcaccccagccu

SEQ ID NO: 287918 - RNA, 21 nt, Human
gcccuggagcucagggggacu

SEQ ID NO: 287919 - RNA, 22 nt, Human
gcccuuugcucccacccacccc

SEQ ID NO: 287920 - RNA, 19 nt, Human
gccucauggaggcugaugu

SEQ ID NO: 287921 - RNA, 18 nt, Human
gccuggggcugggagggc

SEQ ID NO: 287922 - RNA, 19 nt, Human
gcgcugccgccgccaccgc

SEQ ID NO: 287923 - RNA, 21 nt, Human
gcggagcugcgguuagcaggc

SEQ ID NO: 287924 - RNA, 18 nt, Human
gcggcagacggcgggcgg

SEQ ID NO: 287925 - RNA, 21 nt, Human
gcucugggaucucgccggggc

SEQ ID NO: 287926 - RNA, 21 nt, Human
gcugcagccccucccaggugc

SEQ ID NO: 287927 - RNA, 22 nt, Human
gcuggcuuugccguagguuugg

SEQ ID NO: 287928 - RNA, 19 nt, Human
ggaacccagugauuuuaug

SEQ ID NO: 287929 - RNA, 22 nt, Human
ggaaggagacgagagugggagg

SEQ ID NO: 287930 - RNA, 22 nt, Human
ggaaugguuaggccaagagccu

SEQ ID NO: 287931 - RNA, 20 nt, Human
ggacugaggggaaacagggc

SEQ ID NO: 287932 - RNA, 24 nt, Human
ggagacauccaucccucagggcuc

SEQ ID NO: 287933 - RNA, 19 nt, Human
ggaggaagggaagcagggc

SEQ ID NO: 287934 - RNA, 22 nt, Human
ggaggagggggcuggcgcugcc

SEQ ID NO: 287935 - RNA, 23 nt, Human
ggagggagaguggggggccaggg

SEQ ID NO: 287936 - RNA, 18 nt, Human
ggagggagugaggcgggg

SEQ ID NO: 287937 - RNA, 18 nt, Human
ggaguauggagggagggg

SEQ ID NO: 287938 - RNA, 21 nt, Human
ggcaggggaggaagaagaggu

SEQ ID NO: 287939 - RNA, 18 nt, Human
ggcuggcacagcccgggc

SEQ ID NO: 287940 - RNA, 21 nt, Human
ggcuuccaaaagcuugcuuca

SEQ ID NO: 287941 - RNA, 24 nt, Human
gggaaggagacgagagugggaggg

SEQ ID NO: 287942 - RNA, 23 nt, Human
gggagggcuggcacagcccgggc

SEQ ID NO: 287943 - RNA, 22 nt, Human
gggaggggaggggcggcagugg

SEQ ID NO: 287944 - RNA, 23 nt, Human
gggcaggggaggaagaagagguu

SEQ ID NO: 287945 - RNA, 18 nt, Human
gggccguggggacaagga

SEQ ID NO: 287946 - RNA, 19 nt, Human
gggcgguggggcagcccug

SEQ ID NO: 287947 - RNA, 20 nt, Human
gggcgguggggcagcccugg

SEQ ID NO: 287948 - RNA, 18 nt, Human
gggcuggcgcugccgccg

SEQ ID NO: 287949 - RNA, 21 nt, Human
gggggagcccaggccccaagg

SEQ ID NO: 287950 - RNA, 19 nt, Human
gggggaggagggggcuggc

SEQ ID NO: 287951 - RNA, 24 nt, Human
gggugcugacggcaggaaggaggu

SEQ ID NO: 287952 - RNA, 21 nt, Human
ggugccaucgccccuggcccu

SEQ ID NO: 287953 - RNA, 24 nt, Human
gguggaggaagggaagcagggcag

SEQ ID NO: 287954 - RNA, 19 nt, Human
gugacgggaguauggaggg

SEQ ID NO: 287955 - RNA, 24 nt, Human
gugggaggggaggggcggcagugg

SEQ ID NO: 287956 - RNA, 25 nt, Human
uacacaaucauguacaaaacaggug

SEQ ID NO: 287957 - RNA, 19 nt, Human
uacaggaggaggccguggg

SEQ ID NO: 287958 - RNA, 27 nt, Human
uacccuggggccaccccaagccccagc

SEQ ID NO: 287959 - RNA, 18 nt, Human
uacuguugcuggcuuugc

SEQ ID NO: 287960 - RNA, 18 nt, Human
uagaagggugcuccccgg

SEQ ID NO: 287961 - RNA, 18 nt, Human
uagcuggaaagaagggcc

SEQ ID NO: 287962 - RNA, 20 nt, Human
ucacucugacccagguuugg

SEQ ID NO: 287963 - RNA, 18 nt, Human
ucaggcugcagccgaagc

SEQ ID NO: 287964 - RNA, 21 nt, Human
ucaugggguuuuguccaaccc

SEQ ID NO: 287965 - RNA, 23 nt, Human
uccaaaagcuugcuucaggcucu

SEQ ID NO: 287966 - RNA, 20 nt, Human
uccaggggucuggagaggag

SEQ ID NO: 287967 - RNA, 21 nt, Human
uccaggggucuggagaggagg

SEQ ID NO: 287968 - RNA, 22 nt, Human
uccccaagagacuuuucuucca

SEQ ID NO: 287969 - RNA, 20 nt, Human
uccuaacagugggcuguugg

SEQ ID NO: 287970 - RNA, 19 nt, Human
uccuccagcucaccccucu

SEQ ID NO: 287971 - RNA, 18 nt, Human
ucgccggggcugcgggaa

SEQ ID NO: 287972 - RNA, 22 nt, Human
ucggaacuaauggagucaggaa

SEQ ID NO: 287973 - RNA, 22 nt, Human
ucuauggcgaggggaaggagac

SEQ ID NO: 287974 - RNA, 21 nt, Human
ucucaggcuggaggcacccgu

SEQ ID NO: 287975 - RNA, 24 nt, Human
ucuccccugaugucucaggcugga

SEQ ID NO: 287976 - RNA, 18 nt, Human
ucugcacuggagcuggga

SEQ ID NO: 287977 - RNA, 21 nt, Human
ugacuuccuccagcucacccc

SEQ ID NO: 287978 - RNA, 18 nt, Human
ugagagcaggguggugga

SEQ ID NO: 287979 - RNA, 21 nt, Human
ugaggcgggguggaaggguca

SEQ ID NO: 287980 - RNA, 19 nt, Human
ugaggggaaacagggcugg

SEQ ID NO: 287981 - RNA, 24 nt, Human
ugaggggaaacagggcugggcugg

SEQ ID NO: 287982 - RNA, 23 nt, Human
ugcacuggagcugggaggacugc

SEQ ID NO: 287983 - RNA, 21 nt, Human
ugcagccgaagcucggagacc

SEQ ID NO: 287984 - RNA, 20 nt, Human
ugcaggcaggagcuacagga

SEQ ID NO: 287985 - RNA, 21 nt, Human
ugcaugcccuucauucacccu

SEQ ID NO: 287986 - RNA, 18 nt, Human
ugcccuggagugggcagc

SEQ ID NO: 287987 - RNA, 18 nt, Human
ugcccuggagugggcagc

SEQ ID NO: 287988 - RNA, 18 nt, Human
ugccggcagccuggagug

SEQ ID NO: 287989 - RNA, 20 nt, Human
ugccuguccccggggugcca

SEQ ID NO: 287990 - RNA, 20 nt, Human
ugcuacuguugcuggcuuuu

SEQ ID NO: 287991 - RNA, 18 nt, Human
ugcugagaccacagcacu

SEQ ID NO: 287992 - RNA, 24 nt, Human
ugcuucaggcucugaggagcccag

SEQ ID NO: 287993 - RNA, 23 nt, Human
uggaacccgaagagcagauguug

SEQ ID NO: 287994 - RNA, 21 nt, Human
uggacauggagggagaguggg

SEQ ID NO: 287995 - RNA, 19 nt, Human
uggagacauggaagggcug

SEQ ID NO: 287996 - RNA, 26 nt, Human
uggcaaggggcguggcccccacacuc

SEQ ID NO: 287997 - RNA, 19 nt, Human
uggcacagcccgggcugag

SEQ ID NO: 287998 - RNA, 22 nt, Human
uggcgaggggaaggagacgaga

SEQ ID NO: 287999 - RNA, 25 nt, Human
uggcucucucucuuuaccuggaggc

SEQ ID NO: 288000 - RNA, 22 nt, Human
ugggaagccgcuggcacagaga

SEQ ID NO: 288001 - RNA, 18 nt, Human
ugggagaagcagcaggag

SEQ ID NO: 288002 - RNA, 19 nt, Human
ugggaucucgccggggcug

SEQ ID NO: 288003 - RNA, 21 nt, Human
ugggccuggggcugggagggc

SEQ ID NO: 288004 - RNA, 24 nt, Human
ugggccuggggcugggagggcugg

SEQ ID NO: 288005 - RNA, 21 nt, Human
uggggacaaggaagaaaaaca

SEQ ID NO: 288006 - RNA, 22 nt, Human
uggggcugcagccccucccagg

SEQ ID NO: 288007 - RNA, 19 nt, Human
ugguggaggaagggaagca

SEQ ID NO: 288008 - RNA, 22 nt, Human
uguggaacccagugauuuuaug

SEQ ID NO: 288009 - RNA, 26 nt, Human
uuccaggggucuggagaggaggccuu

SEQ ID NO: 288010 - RNA, 18 nt, Human
uugcuggcuuugccguag

SEQ ID NO: 288011 - RNA, 22 nt, Human
aagcccaccccaggaaccccaa

SEQ ID NO: 288012 - RNA, 20 nt, Human
aagggacagaggagcagcca

SEQ ID NO: 288013 - RNA, 18 nt, Human
acaaaggccccuccccuc

SEQ ID NO: 288014 - RNA, 20 nt, Human
acacgcuagaacaagccaca

SEQ ID NO: 288015 - RNA, 24 nt, Human
acacgcuagaacaagccacaagag

SEQ ID NO: 288016 - RNA, 18 nt, Human
acacucaccccaagccca

SEQ ID NO: 288017 - RNA, 23 nt, Human
accccaagcccaccccaggaacc

SEQ ID NO: 288018 - RNA, 19 nt, Human
agagaucacuucaaggacc

SEQ ID NO: 288019 - RNA, 18 nt, Human
agaggucaggaacugagu

SEQ ID NO: 288020 - RNA, 23 nt, Human
agcgacgguucagggcccugagg

SEQ ID NO: 288021 - RNA, 23 nt, Human
aggaaccccaaagcagaggucag

SEQ ID NO: 288022 - RNA, 19 nt, Human
caaagcagaggucaggaac

SEQ ID NO: 288023 - RNA, 23 nt, Human
caagcccaccccaggaaccccaa

SEQ ID NO: 288024 - RNA, 18 nt, Human
cacagcuccuggggaggc

SEQ ID NO: 288025 - RNA, 23 nt, Human
caccccaagcccaccccaggaac

SEQ ID NO: 288026 - RNA, 22 nt, Human
cagcuccuggggaggcccaggc

SEQ ID NO: 288027 - RNA, 18 nt, Human
caggaaccccaaagcaga

SEQ ID NO: 288028 - RNA, 19 nt, Human
caggaaccccaaagcagag

SEQ ID NO: 288029 - RNA, 25 nt, Human
caggaaccccaaagcagaggucagg

SEQ ID NO: 288030 - RNA, 26 nt, Human
ccaaagcagaggucaggaacugaguc

SEQ ID NO: 288031 - RNA, 21 nt, Human
ccaagcccaccccaggaaccc

SEQ ID NO: 288032 - RNA, 29 nt, Human
cccaggaaccccaaagcagaggucaggaa

SEQ ID NO: 288033 - RNA, 18 nt, Human
cccaucuugcccucagcc

SEQ ID NO: 288034 - RNA, 24 nt, Human
ccccaagcccaccccaggaacccc

SEQ ID NO: 288035 - RNA, 26 nt, Human
ccccaagcccaccccaggaaccccaa

SEQ ID NO: 288036 - RNA, 22 nt, Human
ccccugaacgcuucugucaccu

SEQ ID NO: 288037 - RNA, 27 nt, Human
ccccugaacgcuucugucaccucugac

SEQ ID NO: 288038 - RNA, 22 nt, Human
cccugggucccaggacuuccuc

SEQ ID NO: 288039 - RNA, 26 nt, Human
ccucccaucuugcccucagccuagac

SEQ ID NO: 288040 - RNA, 22 nt, Human
ccuggggaggcccaggcacccc

SEQ ID NO: 288041 - RNA, 22 nt, Human
ccugggucccaggacuuccucc

SEQ ID NO: 288042 - RNA, 22 nt, Human
cgacgguucagggcccugaggg

SEQ ID NO: 288043 - RNA, 21 nt, Human
cuacacucaccccaagcccac

SEQ ID NO: 288044 - RNA, 19 nt, Human
cucaaugcugccaccguga

SEQ ID NO: 288045 - RNA, 21 nt, Human
cucagccuagacucgucccuu

SEQ ID NO: 288046 - RNA, 18 nt, Human
cugggcucugaaccaggg

SEQ ID NO: 288047 - RNA, 21 nt, Human
gaacaagccacaagagggugc

SEQ ID NO: 288048 - RNA, 20 nt, Human
gcggauuuggggcuggggcc

SEQ ID NO: 288049 - RNA, 19 nt, Human
ggccccucggcgggugggg

SEQ ID NO: 288050 - RNA, 21 nt, Human
gucccaggacuuccucccuca

SEQ ID NO: 288051 - RNA, 21 nt, Human
guccucccugggccccucggc

SEQ ID NO: 288052 - RNA, 19 nt, Human
ucagccuagacucgucccu

SEQ ID NO: 288053 - RNA, 22 nt, Human
ucaggaacugaguccacagcuc

SEQ ID NO: 288054 - RNA, 24 nt, Human
ucccuagacaaaggccccuccccu

SEQ ID NO: 288055 - RNA, 24 nt, Human
ucccugggucccaggacuuccucc

SEQ ID NO: 288056 - RNA, 25 nt, Human
ucccugggucccaggacuuccuccc

SEQ ID NO: 288057 - RNA, 21 nt, Human
ucccuucccuagacaaaggcu

SEQ ID NO: 288058 - RNA, 20 nt, Human
ugaccucccaucuugcccuc

SEQ ID NO: 288059 - RNA, 21 nt, Human
ugacucugccgcguccucccu

SEQ ID NO: 288060 - RNA, 22 nt, Human
ugcccucagccuagacucgucc

SEQ ID NO: 288061 - RNA, 22 nt, Human
ugguggcggauuuggggcuggg

SEQ ID NO: 288062 - RNA, 25 nt, Human
ugguggcggauuuggggcuggggcc

SEQ ID NO: 288063 - RNA, 19 nt, Human
ugugugggugugugucaag

SEQ ID NO: 288064 - RNA, 19 nt, Human
uucagggcccugagggucc

SEQ ID NO: 288065 - RNA, 23 nt, Human
uucccuaccagucccuucccuag

SEQ ID NO: 288066 - RNA, 18 nt, Human
uuugugugugggugugug

SEQ ID NO: 288067 - RNA, 21 nt, Human
uuuuugguuuugugugugggu

SEQ ID NO: 288068 - RNA, 18 nt, Human
uuuuuuuuuuuuuuuuug

SEQ ID NO: 288069 - RNA, 24 nt, Human
uuuuuuuuuuuuuuuuuugguuuu

SEQ ID NO: 288070 - RNA, 24 nt, Human
acagaccagggccacgcccagggu

SEQ ID NO: 288071 - RNA, 23 nt, Human
aggcacagcauggcugcggcugu

SEQ ID NO: 288072 - RNA, 25 nt, Human
cagcauggcugcggcuguggguggc

SEQ ID NO: 288073 - RNA, 19 nt, Human
caggaggaagucccacugc

SEQ ID NO: 288074 - RNA, 20 nt, Human
caggaggcacagcauggcug

SEQ ID NO: 288075 - RNA, 20 nt, Human
ccagagacucugcccccagg

SEQ ID NO: 288076 - RNA, 19 nt, Human
ccccagggagcagccuccc

SEQ ID NO: 288077 - RNA, 21 nt, Human
cgcccagggugagcaggaggc

SEQ ID NO: 288078 - RNA, 19 nt, Human
gacacagaugaccacguca

SEQ ID NO: 288079 - RNA, 18 nt, Human
gagcucuggagccagagg

SEQ ID NO: 288080 - RNA, 18 nt, Human
gcacagcauggcugcggc

SEQ ID NO: 288081 - RNA, 23 nt, Human
gcaggugugcagcaggaagggga

SEQ ID NO: 288082 - RNA, 22 nt, Human
gcugugguuauucuuugaaagg

SEQ ID NO: 288083 - RNA, 21 nt, Human
ggaagucccacugcucuggag

SEQ ID NO: 288084 - RNA, 18 nt, Human
ggagguguggaagggugg

SEQ ID NO: 288085 - RNA, 21 nt, Human
gugagcaggaggcacagcaug

SEQ ID NO: 288086 - RNA, 20 nt, Human
uaauaaccucugccagagac

SEQ ID NO: 288087 - RNA, 22 nt, Human
ucugccagagacucugccccca

SEQ ID NO: 288088 - RNA, 21 nt, Human
ucuggucuuccuggaggcgga

SEQ ID NO: 288089 - RNA, 21 nt, Human
ugccagagacucugcccccag

SEQ ID NO: 288090 - RNA, 22 nt, Human
uggaagggugggagucuggucu

SEQ ID NO: 288091 - RNA, 18 nt, Human
uggcgacacagaugacca

SEQ ID NO: 288092 - RNA, 19 nt, Human
uggcucugagcucuggagc

SEQ ID NO: 288093 - RNA, 20 nt, Human
uggcucugagcucuggagcc

SEQ ID NO: 288094 - RNA, 26 nt, Human
ugugcagcaggaaggggauggcgaca

SEQ ID NO: 288095 - RNA, 23 nt, Human
uguggguggcucugagcucugga

SEQ ID NO: 288096 - RNA, 19 nt, Human
aaaaaaauccaaaaccuuu

SEQ ID NO: 288097 - RNA, 18 nt, Human
aaaaacaaacaagcaaaa

SEQ ID NO: 288098 - RNA, 22 nt, Human
aaacaaacaaaaagacacaagc

SEQ ID NO: 288099 - RNA, 28 nt, Human
aaacaaacaagcaaacaaaccggacccc

SEQ ID NO: 288100 - RNA, 19 nt, Human
aaacagggcucauuacaug

SEQ ID NO: 288101 - RNA, 20 nt, Human
aaacuuucccuuccagagac

SEQ ID NO: 288102 - RNA, 20 nt, Human
aaaggggacauuuaaaaaau

SEQ ID NO: 288103 - RNA, 21 nt, Human
aacaaaaagacacaagcuaga

SEQ ID NO: 288104 - RNA, 20 nt, Human
aacaaacaagcaaacaaaca

SEQ ID NO: 288105 - RNA, 28 nt, Human
aacaaacaagcaaacaaacaaaaagaca

SEQ ID NO: 288106 - RNA, 22 nt, Human
aacaucuucagagugagcuuua

SEQ ID NO: 288107 - RNA, 19 nt, Human
aaccuguugguuagcuaag

SEQ ID NO: 288108 - RNA, 23 nt, Human
aagcagcagugaaccucuaaacc

SEQ ID NO: 288109 - RNA, 19 nt, Human
aaggaugaucgagccaccg

SEQ ID NO: 288110 - RNA, 19 nt, Human
aagggcaucaacaggacag

SEQ ID NO: 288111 - RNA, 18 nt, Human
acaaacaaaaagacacaa

SEQ ID NO: 288112 - RNA, 24 nt, Human
acaaagcagcagugaaccucuaaa

SEQ ID NO: 288113 - RNA, 18 nt, Human
acacagaaccuucucagu

SEQ ID NO: 288114 - RNA, 18 nt, Human
acacauuucaggaaaagc

SEQ ID NO: 288115 - RNA, 21 nt, Human
acagaaaauagcagcaaacaa

SEQ ID NO: 288116 - RNA, 21 nt, Human
acagggcucauuacaugugga

SEQ ID NO: 288117 - RNA, 22 nt, Human
acaggggaaaaugauucuuuca

SEQ ID NO: 288118 - RNA, 21 nt, Human
acaguacaagcaagcagcuac

SEQ ID NO: 288119 - RNA, 22 nt, Human
accacacacagacgaaccagga

SEQ ID NO: 288120 - RNA, 21 nt, Human
agaaagaggcgaacgggagag

SEQ ID NO: 288121 - RNA, 23 nt, Human
agaauaauuuacaugaaaggaca

SEQ ID NO: 288122 - RNA, 20 nt, Human
agacagcagacagagaaaac

SEQ ID NO: 288123 - RNA, 18 nt, Human
agaggaaaagagggagga

SEQ ID NO: 288124 - RNA, 21 nt, Human
agaggaaaagagggaggaggg

SEQ ID NO: 288125 - RNA, 24 nt, Human
agaggaaaagagggaggaggggcc

SEQ ID NO: 288126 - RNA, 19 nt, Human
agaggcgaacgggagagca

SEQ ID NO: 288127 - RNA, 23 nt, Human
agagggaggaggggccgaaggag

SEQ ID NO: 288128 - RNA, 24 nt, Human
agaggggagggaggaaggagggag

SEQ ID NO: 288129 - RNA, 24 nt, Human
agcaaacaaacaaaaagacacaag

SEQ ID NO: 288130 - RNA, 18 nt, Human
agcagugaaccucuaaac

SEQ ID NO: 288131 - RNA, 18 nt, Human
agcucggcgcucgcgguu

SEQ ID NO: 288132 - RNA, 22 nt, Human
agcucuuuauuucuuaaguggc

SEQ ID NO: 288133 - RNA, 24 nt, Human
aggaauuagcuuaagauguaauuu

SEQ ID NO: 288134 - RNA, 21 nt, Human
aggagggagggagggaaggag

SEQ ID NO: 288135 - RNA, 22 nt, Human
aggagggagggagggaaggagg

SEQ ID NO: 288136 - RNA, 22 nt, Human
aggagggagggagggaaggagg

SEQ ID NO: 288137 - RNA, 24 nt, Human
aggagggagggagggaaggagggg

SEQ ID NO: 288138 - RNA, 25 nt, Human
agggaggaaggagggagggagggaa

SEQ ID NO: 288139 - RNA, 20 nt, Human
agggaggaggggccgaagga

SEQ ID NO: 288140 - RNA, 18 nt, Human
agggagggagggaaggag

SEQ ID NO: 288141 - RNA, 23 nt, Human
aggggaggggagcgggcgggcuc

SEQ ID NO: 288142 - RNA, 26 nt, Human
agggggaggggaggggagcgggcggg

SEQ ID NO: 288143 - RNA, 20 nt, Human
agugucuuccacacagggga

SEQ ID NO: 288144 - RNA, 21 nt, Human
aucccuaaaaaacaccaaaaa

SEQ ID NO: 288145 - RNA, 23 nt, Human
auggcgcgcugggcccgggcccg

SEQ ID NO: 288146 - RNA, 24 nt, Human
auuaagaccaaaaugaaauaaaug

SEQ ID NO: 288147 - RNA, 24 nt, Human
caaaaaaaaccuguugguuagcua

SEQ ID NO: 288148 - RNA, 22 nt, Human
caaaaacccaggacuaaggaca

SEQ ID NO: 288149 - RNA, 21 nt, Human
caaaaagacacaagcuagaca

SEQ ID NO: 288150 - RNA, 26 nt, Human
caaacaagaacaaagauauuuuccau

SEQ ID NO: 288151 - RNA, 23 nt, Human
caaagcauuaagaccaaaaugaa

SEQ ID NO: 288152 - RNA, 24 nt, Human
caacucagcagcaggcuguggcaa

SEQ ID NO: 288153 - RNA, 23 nt, Human
caagcaaacaaacaaaaagacac

SEQ ID NO: 288154 - RNA, 21 nt, Human
caauuugauugagaaagugac

SEQ ID NO: 288155 - RNA, 22 nt, Human
cacagaaacagaaagaggcgaa

SEQ ID NO: 288156 - RNA, 18 nt, Human
cacauugcacaucccuaa

SEQ ID NO: 288157 - RNA, 21 nt, Human
caccacuuuuccccaaaugag

SEQ ID NO: 288158 - RNA, 22 nt, Human
caccgaugucaacaaaauaucc

SEQ ID NO: 288159 - RNA, 20 nt, Human
caccggagcgcugcaccgcc

SEQ ID NO: 288160 - RNA, 20 nt, Human
cacgcuugcuuccuccugca

SEQ ID NO: 288161 - RNA, 22 nt, Human
cacucccauccaccggcggggg

SEQ ID NO: 288162 - RNA, 21 nt, Human
cagcaaacaagaacaaagaua

SEQ ID NO: 288163 - RNA, 23 nt, Human
cagcuaggauuucuugggcacgg

SEQ ID NO: 288164 - RNA, 21 nt, Human
cagcuugcccuccccccaccc

SEQ ID NO: 288165 - RNA, 22 nt, Human
caggaaaagcccuaauaaccac

SEQ ID NO: 288166 - RNA, 23 nt, Human
caggaaaagcccuaauaaccacc

SEQ ID NO: 288167 - RNA, 21 nt, Human
caggacuaaggacauggaggu

SEQ ID NO: 288168 - RNA, 23 nt, Human
cagugaaccucuaaaccaauuaa

SEQ ID NO: 288169 - RNA, 24 nt, Human
cauauacuuacaaacauuuacaua

SEQ ID NO: 288170 - RNA, 27 nt, Human
cauuuaaaaaaucacauaguacacaaa

SEQ ID NO: 288171 - RNA, 20 nt, Human
ccaaaacaaauauauccuac

SEQ ID NO: 288172 - RNA, 20 nt, Human
ccaaagcuuccaaagacuac

SEQ ID NO: 288173 - RNA, 19 nt, Human
ccaccgaugucaacaaaau

SEQ ID NO: 288174 - RNA, 24 nt, Human
ccacuggaaaaaaaauccaaaacc

SEQ ID NO: 288175 - RNA, 21 nt, Human
ccagcccagguuuuuaaaccc

SEQ ID NO: 288176 - RNA, 23 nt, Human
ccccgccgcuccagcuccgucug

SEQ ID NO: 288177 - RNA, 18 nt, Human
ccccuccuucuccuucuc

SEQ ID NO: 288178 - RNA, 18 nt, Human
ccccuccuucuccuucuc

SEQ ID NO: 288179 - RNA, 21 nt, Human
cccggggagggggaggggagg

SEQ ID NO: 288180 - RNA, 18 nt, Human
cccgugucgcugcuccuc

SEQ ID NO: 288181 - RNA, 19 nt, Human
cccgugucgcugcuccucc

SEQ ID NO: 288182 - RNA, 18 nt, Human
ccgccgccgccccgccgc

SEQ ID NO: 288183 - RNA, 20 nt, Human
ccgccgccgccccgccgcuc

SEQ ID NO: 288184 - RNA, 21 nt, Human
ccgccgccgccccgccgcucc

SEQ ID NO: 288185 - RNA, 22 nt, Human
ccgccggacuccgccgccgccc

SEQ ID NO: 288186 - RNA, 28 nt, Human
ccgccuccgccgggccucuuccguccuu

SEQ ID NO: 288187 - RNA, 19 nt, Human
ccuccccccaccccacugg

SEQ ID NO: 288188 - RNA, 22 nt, Human
ccuccuucuccuucucgcuccc

SEQ ID NO: 288189 - RNA, 19 nt, Human
ccuucuccuucucgcuccc

SEQ ID NO: 288190 - RNA, 19 nt, Human
cggacugcucucccccacc

SEQ ID NO: 288191 - RNA, 22 nt, Human
cucacucgcucucccggccgcc

SEQ ID NO: 288192 - RNA, 20 nt, Human
cucgcgcccgagcgcucccc

SEQ ID NO: 288193 - RNA, 22 nt, Human
cucggcgcucgcgguuucucuc

SEQ ID NO: 288194 - RNA, 24 nt, Human
cugauauagugguaugucccuccu

SEQ ID NO: 288195 - RNA, 18 nt, Human
cugcaccgccgccuccgc

SEQ ID NO: 288196 - RNA, 18 nt, Human
cugcucucccccaccccu

SEQ ID NO: 288197 - RNA, 19 nt, Human
cuggggaacuguuuuccuc

SEQ ID NO: 288198 - RNA, 22 nt, Human
cuuauaauuuaaauaugccacu

SEQ ID NO: 288199 - RNA, 20 nt, Human
cuugcccuccccccaccccc

SEQ ID NO: 288200 - RNA, 24 nt, Human
gaaaaugauucuuucacaaaugaa

SEQ ID NO: 288201 - RNA, 21 nt, Human
gaagauauucaacaaguaaga

SEQ ID NO: 288202 - RNA, 20 nt, Human
gaaggagggagggagggaag

SEQ ID NO: 288203 - RNA, 21 nt, Human
gacaguacaagcaagcagcua

SEQ ID NO: 288204 - RNA, 19 nt, Human
gacuugcuaacacuaguga

SEQ ID NO: 288205 - RNA, 19 nt, Human
gaggaggggccgaaggaga

SEQ ID NO: 288206 - RNA, 18 nt, Human
gagggaaggaggggggag

SEQ ID NO: 288207 - RNA, 20 nt, Human
gagggaaggaggggggagga

SEQ ID NO: 288208 - RNA, 25 nt, Human
gagggaaggaggggggaggauggcg

SEQ ID NO: 288209 - RNA, 24 nt, Human
gcacaccauuggucacaccacaca

SEQ ID NO: 288210 - RNA, 21 nt, Human
gcacaucccuaaaaaacacca

SEQ ID NO: 288211 - RNA, 19 nt, Human
gcccauauacuuacaaaca

SEQ ID NO: 288212 - RNA, 18 nt, Human
gcccuccccccaccccac

SEQ ID NO: 288213 - RNA, 22 nt, Human
gccgccgccccgccgcuccagc

SEQ ID NO: 288214 - RNA, 27 nt, Human
gcgcuccccuccuucuccuucucgcuc

SEQ ID NO: 288215 - RNA, 20 nt, Human
gcuugcccuccccccacccc

SEQ ID NO: 288216 - RNA, 25 nt, Human
ggagaggggagggaggaaggaggga

SEQ ID NO: 288217 - RNA, 19 nt, Human
ggaggaaggagggagggag

SEQ ID NO: 288218 - RNA, 21 nt, Human
ggagggaaggaggggggagga

SEQ ID NO: 288219 - RNA, 24 nt, Human
ggagggaaggaggggggaggaugg

SEQ ID NO: 288220 - RNA, 24 nt, Human
ggagggggagggagaggggaggga

SEQ ID NO: 288221 - RNA, 24 nt, Human
ggaggggggaggauggcgcgcugg

SEQ ID NO: 288222 - RNA, 21 nt, Human
ggcacuggcagcggggaggcg

SEQ ID NO: 288223 - RNA, 19 nt, Human
ggcccggggagggggaggg

SEQ ID NO: 288224 - RNA, 19 nt, Human
gggcccgggcccggggagg

SEQ ID NO: 288225 - RNA, 20 nt, Human
ggggaggggaggggagcggg

SEQ ID NO: 288226 - RNA, 21 nt, Human
ggggaggggaggggagcgggc

SEQ ID NO: 288227 - RNA, 21 nt, Human
ggggaggggaggggagcgggc

SEQ ID NO: 288228 - RNA, 20 nt, Human
ggggagggggagggagaggg

SEQ ID NO: 288229 - RNA, 18 nt, Human
ggggagggggaggggagg

SEQ ID NO: 288230 - RNA, 22 nt, Human
gggggaggauggcgcgcugggc

SEQ ID NO: 288231 - RNA, 18 nt, Human
gggggagggagaggggag

SEQ ID NO: 288232 - RNA, 21 nt, Human
guaagugaaacacaguuuaaa

SEQ ID NO: 288233 - RNA, 23 nt, Human
gucacaccacacacagacgaacc

SEQ ID NO: 288234 - RNA, 24 nt, Human
gugaaccucuaaaccaauuaauaa

SEQ ID NO: 288235 - RNA, 26 nt, Human
uaaacaaaaggugaaaacaggggacc

SEQ ID NO: 288236 - RNA, 19 nt, Human
uaaccaccacuuuucccca

SEQ ID NO: 288237 - RNA, 24 nt, Human
uaaccucaucauuguccuuauccc

SEQ ID NO: 288238 - RNA, 19 nt, Human
uaacucaacucagcagcag

SEQ ID NO: 288239 - RNA, 19 nt, Human
uaaggaauuagcuuaagau

SEQ ID NO: 288240 - RNA, 24 nt, Human
uaauaauccaacauaaaaugacac

SEQ ID NO: 288241 - RNA, 19 nt, Human
uacaaacaaauguuaagau

SEQ ID NO: 288242 - RNA, 22 nt, Human
uacaaacaaauguuaagaugca

SEQ ID NO: 288243 - RNA, 22 nt, Human
uacaggacgcuaacucucaccc

SEQ ID NO: 288244 - RNA, 24 nt, Human
uacauguacaaacaaauguuaaga

SEQ ID NO: 288245 - RNA, 22 nt, Human
uacccacuuacagauaggccca

SEQ ID NO: 288246 - RNA, 18 nt, Human
uacggcgaacgcucccca

SEQ ID NO: 288247 - RNA, 21 nt, Human
uagacagcagacagagaaaac

SEQ ID NO: 288248 - RNA, 20 nt, Human
uagcagcaaacaagaacaaa

SEQ ID NO: 288249 - RNA, 21 nt, Human
uauaccacuagccucugcgug

SEQ ID NO: 288250 - RNA, 22 nt, Human
uauguaaauuuacaguauacaa

SEQ ID NO: 288251 - RNA, 21 nt, Human
ucacuguuaucucauuguucu

SEQ ID NO: 288252 - RNA, 19 nt, Human
ucagaagagcuaagggaaa

SEQ ID NO: 288253 - RNA, 18 nt, Human
ucagaagauucugaauug

SEQ ID NO: 288254 - RNA, 18 nt, Human
ucagaagauucugaauug

SEQ ID NO: 288255 - RNA, 23 nt, Human
ucagaauuuuaucuuuguuaaac

SEQ ID NO: 288256 - RNA, 20 nt, Human
ucagacagcagugcaggaaa

SEQ ID NO: 288257 - RNA, 19 nt, Human
ucaggcaccaacagauagc

SEQ ID NO: 288258 - RNA, 19 nt, Human
ucaguauuucugucauuau

SEQ ID NO: 288259 - RNA, 18 nt, Human
uccaccggcgggggaggg

SEQ ID NO: 288260 - RNA, 22 nt, Human
uccccagagucagaccuaguuu

SEQ ID NO: 288261 - RNA, 18 nt, Human
ucucauuguucuguuaac

SEQ ID NO: 288262 - RNA, 19 nt, Human
ucugccuucuuaggccugg

SEQ ID NO: 288263 - RNA, 23 nt, Human
ucugguaacucaacucagcagca

SEQ ID NO: 288264 - RNA, 21 nt, Human
ucuuacuguaaaacacgagag

SEQ ID NO: 288265 - RNA, 23 nt, Human
ugacacacucaauggggagauua

SEQ ID NO: 288266 - RNA, 30 nt, Human
ugaccuguaaauccagcuugcccuccccuu

SEQ ID NO: 288267 - RNA, 22 nt, Human
ugauguguaugauacacacaua

SEQ ID NO: 288268 - RNA, 20 nt, Human
ugauucuuucacaaaugaau

SEQ ID NO: 288269 - RNA, 21 nt, Human
ugcaagaugccgugacaacag

SEQ ID NO: 288270 - RNA, 22 nt, Human
ugcaggggaagacacgcuugcu

SEQ ID NO: 288271 - RNA, 20 nt, Human
ugcaucgguaccauucuccu

SEQ ID NO: 288272 - RNA, 19 nt, Human
ugcaugaauacuuugugug

SEQ ID NO: 288273 - RNA, 23 nt, Human
ugccaaaacaaauauauccuacu

SEQ ID NO: 288274 - RNA, 18 nt, Human
uggaaaaaaaauccaaaa

SEQ ID NO: 288275 - RNA, 19 nt, Human
uggaaaaaaaauccaaaac

SEQ ID NO: 288276 - RNA, 20 nt, Human
uggcaugcacucucaagagc

SEQ ID NO: 288277 - RNA, 22 nt, Human
uguagaaaaauccagucagaag

SEQ ID NO: 288278 - RNA, 18 nt, Human
ugucaacuauucaguuua

SEQ ID NO: 288279 - RNA, 25 nt, Human
uguggcaaucucccaaguaaggaua

SEQ ID NO: 288280 - RNA, 25 nt, Human
ugugugcugcaggggaagacacgcu

SEQ ID NO: 288281 - RNA, 22 nt, Human
uguuuuccucaauuaccacuua

SEQ ID NO: 288282 - RNA, 20 nt, Human
uuaaguggccaauuugauug

SEQ ID NO: 288283 - RNA, 26 nt, Human
uuacccuuaaacaauucaugcuaaaa

SEQ ID NO: 288284 - RNA, 19 nt, Human
uucaccaugcaugaauacu

SEQ ID NO: 288285 - RNA, 21 nt, Human
uucucaaaauaggacagaaaa

SEQ ID NO: 288286 - RNA, 21 nt, Human
uucuugggcacguuacagaua

SEQ ID NO: 288287 - RNA, 26 nt, Human
uuuacagaguaaucguuuccuccucc

SEQ ID NO: 288288 - RNA, 27 nt, Human
uuuucacacacacacacagucaauaau

SEQ ID NO: 288289 - RNA, 27 nt, Human
aaaaagccaaguagaauggugggcacc

SEQ ID NO: 288290 - RNA, 21 nt, Human
aaagagaaggauucuguagug

SEQ ID NO: 288291 - RNA, 23 nt, Human
aaugcaaagugccuuaagaaaga

SEQ ID NO: 288292 - RNA, 24 nt, Human
accaguuuaaaucccuccuccccu

SEQ ID NO: 288293 - RNA, 24 nt, Human
caaacaaaccuucuauguacagga

SEQ ID NO: 288294 - RNA, 23 nt, Human
ccacagaaaggccaagaaaagaa

SEQ ID NO: 288295 - RNA, 19 nt, Human
ccaguuuaaaucccuccuc

SEQ ID NO: 288296 - RNA, 20 nt, Human
ccuucuauguacaggaccag

SEQ ID NO: 288297 - RNA, 18 nt, Human
cggcugaggcgucggcgg

SEQ ID NO: 288298 - RNA, 20 nt, Human
cuccuccccuucaaacacua

SEQ ID NO: 288299 - RNA, 20 nt, Human
uagauaugaacauccaggaa

SEQ ID NO: 288300 - RNA, 22 nt, Human
ucaaacacuagauaugaacauc

SEQ ID NO: 288301 - RNA, 21 nt, Human
uccacagaaaggccaagaaaa

SEQ ID NO: 288302 - RNA, 19 nt, Human
ucccuccuccccuucaaac

SEQ ID NO: 288303 - RNA, 21 nt, Human
uccgugcgggccccaagcggc

SEQ ID NO: 288304 - RNA, 21 nt, Human
uccgugcgggccccaagcggc

SEQ ID NO: 288305 - RNA, 23 nt, Human
uccgugcgggccccaagcggcug

SEQ ID NO: 288306 - RNA, 22 nt, Human
ucuuccuuggcuaauuuuucuc

SEQ ID NO: 288307 - RNA, 21 nt, Human
ugauaauuauuauauaugaca

SEQ ID NO: 288308 - RNA, 22 nt, Human
uucaguauuuaggcuugauguu

SEQ ID NO: 288309 - RNA, 21 nt, Human
uuuaggcuugauguuguccca

SEQ ID NO: 288310 - RNA, 20 nt, Human
aaccuucgcuucccccacga

SEQ ID NO: 288311 - RNA, 21 nt, Human
agggcgccgccuccucuccag

SEQ ID NO: 288312 - RNA, 25 nt, Human
caaaggaccgucccaacgcuagcac

SEQ ID NO: 288313 - RNA, 25 nt, Human
cacuccuaccccucgcggcaacaaa

SEQ ID NO: 288314 - RNA, 19 nt, Human
caggaaccuucgcuucccc

SEQ ID NO: 288315 - RNA, 21 nt, Human
cagugggcucgcccggcgcuu

SEQ ID NO: 288316 - RNA, 24 nt, Human
cccacgacggccgcacagugggcu

SEQ ID NO: 288317 - RNA, 22 nt, Human
ccccucgcggcaacaaaggacu

SEQ ID NO: 288318 - RNA, 21 nt, Human
cgccacgcccacuccuacccc

SEQ ID NO: 288319 - RNA, 18 nt, Human
cgcggaggacgaaggccg

SEQ ID NO: 288320 - RNA, 18 nt, Human
cggcccgggaguguuccg

SEQ ID NO: 288321 - RNA, 21 nt, Human
gcuccgccacgcccacuccua

SEQ ID NO: 288322 - RNA, 22 nt, Human
ggaggacgaaggccgauacagg

SEQ ID NO: 288323 - RNA, 21 nt, Human
ggcuccgccacgcccacuccu

SEQ ID NO: 288324 - RNA, 20 nt, Human
ucccaacgcuagcacacccg

SEQ ID NO: 288325 - RNA, 18 nt, Human
uggcgccgcagcuccugc

SEQ ID NO: 288326 - RNA, 24 nt, Human
uuaggagguagguggaaucaggaa

SEQ ID NO: 288327 - RNA, 23 nt, Human
uuuuuuuuuuuuuuuuuucacug

SEQ ID NO: 288328 - RNA, 24 nt, Human
aaaaagucacagaugucacaaggg

SEQ ID NO: 288329 - RNA, 20 nt, Human
aaagagaugauuaaauucaa

SEQ ID NO: 288330 - RNA, 20 nt, Human
aaagaggaaaaacagcaaga

SEQ ID NO: 288331 - RNA, 19 nt, Human
aagaaggaacaaagacaga

SEQ ID NO: 288332 - RNA, 23 nt, Human
aagacacuucauccucccaauua

SEQ ID NO: 288333 - RNA, 19 nt, Human
aaguacuuuggggagaggc

SEQ ID NO: 288334 - RNA, 20 nt, Human
aauggaauuaugacacuuuu

SEQ ID NO: 288335 - RNA, 23 nt, Human
accacaggaaucuggacauuuca

SEQ ID NO: 288336 - RNA, 23 nt, Human
accuauauugagggcaaaggcca

SEQ ID NO: 288337 - RNA, 19 nt, Human
acuacagcauucacaaugc

SEQ ID NO: 288338 - RNA, 20 nt, Human
acucugcaaugucagacaug

SEQ ID NO: 288339 - RNA, 21 nt, Human
agaaggaacaaagacagaaga

SEQ ID NO: 288340 - RNA, 19 nt, Human
agacagaagagacuccagg

SEQ ID NO: 288341 - RNA, 22 nt, Human
agcaaagcagugcuuaugagag

SEQ ID NO: 288342 - RNA, 19 nt, Human
agcaagauuauuaaaucca

SEQ ID NO: 288343 - RNA, 22 nt, Human
agcagacagagaaaaggaaaga

SEQ ID NO: 288344 - RNA, 21 nt, Human
agcccacacucauaauagcac

SEQ ID NO: 288345 - RNA, 19 nt, Human
aggaacaaagacagaagag

SEQ ID NO: 288346 - RNA, 20 nt, Human
aggaagaagauuccaauagg

SEQ ID NO: 288347 - RNA, 22 nt, Human
aggcagagagcuguguccuugg

SEQ ID NO: 288348 - RNA, 20 nt, Human
aggcaggggcacacucaggu

SEQ ID NO: 288349 - RNA, 27 nt, Human
aggcaugaaaugaaacaaaagggaccc

SEQ ID NO: 288350 - RNA, 24 nt, Human
agucaguagcagacagagaaaagg

SEQ ID NO: 288351 - RNA, 23 nt, Human
aucauuguacauaaaaucaaaau

SEQ ID NO: 288352 - RNA, 22 nt, Human
auggaaaauacugaaaagauuc

SEQ ID NO: 288353 - RNA, 23 nt, Human
caaguaccauuuaaaaaggugag

SEQ ID NO: 288354 - RNA, 22 nt, Human
cacaggcuacccaggguugucu

SEQ ID NO: 288355 - RNA, 23 nt, Human
cacuacagcauucacaaugcuag

SEQ ID NO: 288356 - RNA, 25 nt, Human
cacuucaacuaggcuccuuugaaaa

SEQ ID NO: 288357 - RNA, 20 nt, Human
caggagcaggcacuggcacc

SEQ ID NO: 288358 - RNA, 25 nt, Human
caggagcaggcacuggcaccagccg

SEQ ID NO: 288359 - RNA, 24 nt, Human
caggcugagcucuuacucugagcu

SEQ ID NO: 288360 - RNA, 23 nt, Human
caucuaaaacugacuucaaguac

SEQ ID NO: 288361 - RNA, 19 nt, Human
caucuggcaggcaggggca

SEQ ID NO: 288362 - RNA, 24 nt, Human
caugaaaugaaacaaaaguuuuga

SEQ ID NO: 288363 - RNA, 24 nt, Human
ccaaaauaagaaggaacaaagaca

SEQ ID NO: 288364 - RNA, 21 nt, Human
ccacagaagaaacgucuccag

SEQ ID NO: 288365 - RNA, 23 nt, Human
ccagacacugaucacaggcuacu

SEQ ID NO: 288366 - RNA, 21 nt, Human
cccaauuauauucuuugucau

SEQ ID NO: 288367 - RNA, 21 nt, Human
ccucccaauuauauucuuugu

SEQ ID NO: 288368 - RNA, 22 nt, Human
cgcaggguccagauccccaggu

SEQ ID NO: 288369 - RNA, 23 nt, Human
cguccaaauauguggucuguguc

SEQ ID NO: 288370 - RNA, 23 nt, Human
cuaaaacaccuauauugagggca

SEQ ID NO: 288371 - RNA, 19 nt, Human
cuccagggacgucccuccc

SEQ ID NO: 288372 - RNA, 25 nt, Human
cugauugcaaaauaaugacaaccaa

SEQ ID NO: 288373 - RNA, 22 nt, Human
cugggcuuaaacaagucuagaa

SEQ ID NO: 288374 - RNA, 23 nt, Human
gaaaagcugucuuuccauagccc

SEQ ID NO: 288375 - RNA, 19 nt, Human
gcagaaagcagcagccaug

SEQ ID NO: 288376 - RNA, 22 nt, Human
gcagacagagaaaaggaaagag

SEQ ID NO: 288377 - RNA, 20 nt, Human
gcagcagggagaugugcuug

SEQ ID NO: 288378 - RNA, 20 nt, Human
ggaaauacacauucaugucc

SEQ ID NO: 288379 - RNA, 21 nt, Human
gggcagaaagcagcagccaug

SEQ ID NO: 288380 - RNA, 22 nt, Human
uaaaaaggugagucuuuaaaaa

SEQ ID NO: 288381 - RNA, 24 nt, Human
uaaaauaaagcaucuaaaacugac

SEQ ID NO: 288382 - RNA, 23 nt, Human
uaaacaagucuagaaguaccaca

SEQ ID NO: 288383 - RNA, 24 nt, Human
uaaagcaucuaaaacugacuucaa

SEQ ID NO: 288384 - RNA, 18 nt, Human
uaacacaaagcagugaaa

SEQ ID NO: 288385 - RNA, 19 nt, Human
uaagaaggaacaaagacag

SEQ ID NO: 288386 - RNA, 21 nt, Human
uaagaucuaaagagaugauua

SEQ ID NO: 288387 - RNA, 19 nt, Human
uaaggcaugaaaugaaaca

SEQ ID NO: 288388 - RNA, 19 nt, Human
uaaggcucucuguuuugaa

SEQ ID NO: 288389 - RNA, 22 nt, Human
uaccuuaggguagcaguuaacu

SEQ ID NO: 288390 - RNA, 21 nt, Human
uagaaguaccacaauacucau

SEQ ID NO: 288391 - RNA, 22 nt, Human
uagcccacacucauaauagcac

SEQ ID NO: 288392 - RNA, 23 nt, Human
uaugcacacgacaucuucauggu

SEQ ID NO: 288393 - RNA, 18 nt, Human
uauuccauuuauuucucu

SEQ ID NO: 288394 - RNA, 19 nt, Human
uauucuuugucauaaagag

SEQ ID NO: 288395 - RNA, 18 nt, Human
uauuuuguucuucuuucc

SEQ ID NO: 288396 - RNA, 21 nt, Human
ucaaagguggugacauggagg

SEQ ID NO: 288397 - RNA, 23 nt, Human
ucaaagguggugacauggaggca

SEQ ID NO: 288398 - RNA, 20 nt, Human
ucaaauauugcaauauugcc

SEQ ID NO: 288399 - RNA, 18 nt, Human
ucaugggagagaccaggc

SEQ ID NO: 288400 - RNA, 22 nt, Human
uccaaaaagucacagaugucac

SEQ ID NO: 288401 - RNA, 20 nt, Human
uccccaucccuucacccgca

SEQ ID NO: 288402 - RNA, 21 nt, Human
uccuugggaugaaccacagga

SEQ ID NO: 288403 - RNA, 25 nt, Human
ucgaaugccaaaauaagaaggaaca

SEQ ID NO: 288404 - RNA, 21 nt, Human
ucucugucucagaaacugaac

SEQ ID NO: 288405 - RNA, 21 nt, Human
ucugcugugaucuucuaauca

SEQ ID NO: 288406 - RNA, 18 nt, Human
ucuucucuuccacagaag

SEQ ID NO: 288407 - RNA, 21 nt, Human
ucuuuuguggguggugagggu

SEQ ID NO: 288408 - RNA, 23 nt, Human
ugaacaacugggagaacagucga

SEQ ID NO: 288409 - RNA, 24 nt, Human
ugacuaaagcagcauaugaaguau

SEQ ID NO: 288410 - RNA, 19 nt, Human
ugagaugccacacuguugg

SEQ ID NO: 288411 - RNA, 19 nt, Human
ugagaugccacacuguugg

SEQ ID NO: 288412 - RNA, 23 nt, Human
ugaugcgcaacucuuuggggagg

SEQ ID NO: 288413 - RNA, 21 nt, Human
uggaaaaacauuccagugagc

SEQ ID NO: 288414 - RNA, 21 nt, Human
uggcgagcugggcagaaagca

SEQ ID NO: 288415 - RNA, 21 nt, Human
ugucagacaugcaguguagag

SEQ ID NO: 288416 - RNA, 23 nt, Human
ugucucagaaacugaacaacugg

SEQ ID NO: 288417 - RNA, 24 nt, Human
uguggguggugagggugcagcagg

SEQ ID NO: 288418 - RNA, 18 nt, Human
uguggucugugucccaac

SEQ ID NO: 288419 - RNA, 18 nt, Human
ugugucacuucuucucuu

SEQ ID NO: 288420 - RNA, 24 nt, Human
uuaccauguacuaaagaaccccau

SEQ ID NO: 288421 - RNA, 19 nt, Human
uucaagggggaaaaagccu

SEQ ID NO: 288422 - RNA, 24 nt, Human
uugacuagaaaaauaaaauaaagc

SEQ ID NO: 288423 - RNA, 21 nt, Human
uugcaaaauaaugacaaccaa

SEQ ID NO: 288424 - RNA, 22 nt, Human
uuuaagacacuucauccuccca

SEQ ID NO: 288425 - RNA, 20 nt, Human
uuuuguggguggugaggguu

SEQ ID NO: 288426 - RNA, 20 nt, Human
aaacagacuugauaauuaau

SEQ ID NO: 288427 - RNA, 23 nt, Human
aaaucaaagaugaccccaaaaga

SEQ ID NO: 288428 - RNA, 22 nt, Human
aacauuuccugaauaucuacca

SEQ ID NO: 288429 - RNA, 19 nt, Human
aagaagccagggagcgacg

SEQ ID NO: 288430 - RNA, 19 nt, Human
aagcaggucccaaauuuua

SEQ ID NO: 288431 - RNA, 18 nt, Human
aauccgccccccuuaccc

SEQ ID NO: 288432 - RNA, 23 nt, Human
acgggccacccaagccccgucga

SEQ ID NO: 288433 - RNA, 20 nt, Human
agaagccagggagcgacggg

SEQ ID NO: 288434 - RNA, 18 nt, Human
agccugggaagcgaguuc

SEQ ID NO: 288435 - RNA, 26 nt, Human
aggaggccagggcagccugccggaug

SEQ ID NO: 288436 - RNA, 19 nt, Human
aggggaggggcugagggag

SEQ ID NO: 288437 - RNA, 21 nt, Human
augggauuaucaucucuaaau

SEQ ID NO: 288438 - RNA, 22 nt, Human
auuuguuguuucuccaucuugu

SEQ ID NO: 288439 - RNA, 22 nt, Human
caaacagcacguggggcugaag

SEQ ID NO: 288440 - RNA, 19 nt, Human
cagaagccugggaagcgag

SEQ ID NO: 288441 - RNA, 23 nt, Human
caggaggcaccacuucgcugccc

SEQ ID NO: 288442 - RNA, 22 nt, Human
cagugaacauuuccugaauauc

SEQ ID NO: 288443 - RNA, 23 nt, Human
caucucuaaaucaaagaugaccc

SEQ ID NO: 288444 - RNA, 23 nt, Human
ccacuucgcugcccgcccugggu

SEQ ID NO: 288445 - RNA, 21 nt, Human
ccagggagcgacgggccaccc

SEQ ID NO: 288446 - RNA, 18 nt, Human
ccaggucaccugcccagg

SEQ ID NO: 288447 - RNA, 22 nt, Human
ccucaaaguguuucccaaaaca

SEQ ID NO: 288448 - RNA, 19 nt, Human
cgccccccuuacccccagc

SEQ ID NO: 288449 - RNA, 21 nt, Human
cucagaagccugggaagcgag

SEQ ID NO: 288450 - RNA, 22 nt, Human
cuccccgggagugaggucucug

SEQ ID NO: 288451 - RNA, 23 nt, Human
cuccccgggagugaggucucugg

SEQ ID NO: 288452 - RNA, 21 nt, Human
cuccgcacaguaacgccccuc

SEQ ID NO: 288453 - RNA, 18 nt, Human
cugaauaucuaccaacca

SEQ ID NO: 288454 - RNA, 18 nt, Human
cugcccaggacgggccgg

SEQ ID NO: 288455 - RNA, 18 nt, Human
gcgacgggccacccaagc

SEQ ID NO: 288456 - RNA, 18 nt, Human
gcuccaggucaccugccc

SEQ ID NO: 288457 - RNA, 20 nt, Human
gcuggcuccccgggagugag

SEQ ID NO: 288458 - RNA, 19 nt, Human
ggaagcgaguucucugcaa

SEQ ID NO: 288459 - RNA, 18 nt, Human
gggaagcgaguucucugc

SEQ ID NO: 288460 - RNA, 21 nt, Human
gggaggggcugagggagggug

SEQ ID NO: 288461 - RNA, 21 nt, Human
gggcugagggagggugugggg

SEQ ID NO: 288462 - RNA, 22 nt, Human
ggggaggggcugagggagggug

SEQ ID NO: 288463 - RNA, 22 nt, Human
uaauacaaauaaaaauuucaca

SEQ ID NO: 288464 - RNA, 20 nt, Human
uacagcaguauuuaugauua

SEQ ID NO: 288465 - RNA, 21 nt, Human
uacauuuagccuuauaugcuc

SEQ ID NO: 288466 - RNA, 21 nt, Human
uacuaaagaaguucaaugcuu

SEQ ID NO: 288467 - RNA, 24 nt, Human
uacuaauacaaauaaaaauuucac

SEQ ID NO: 288468 - RNA, 23 nt, Human
uaguaauuggaaucauaguuaac

SEQ ID NO: 288469 - RNA, 23 nt, Human
uauaugaauaauccgccccccuu

SEQ ID NO: 288470 - RNA, 21 nt, Human
uaugaagcuugaaugaagcag

SEQ ID NO: 288471 - RNA, 24 nt, Human
uaugaagcuugaaugaagcagguc

SEQ ID NO: 288472 - RNA, 23 nt, Human
ucaacagauucacagcugacaga

SEQ ID NO: 288473 - RNA, 21 nt, Human
ucagaagccugggaagcgagu

SEQ ID NO: 288474 - RNA, 19 nt, Human
ucagugaacauuuccugaa

SEQ ID NO: 288475 - RNA, 21 nt, Human
uccaggucaccugcccaggac

SEQ ID NO: 288476 - RNA, 23 nt, Human
uccaucaacagauucacagcuga

SEQ ID NO: 288477 - RNA, 18 nt, Human
ucuccgcacaguaacgcc

SEQ ID NO: 288478 - RNA, 22 nt, Human
ucugcugcaucauaaauguccu

SEQ ID NO: 288479 - RNA, 23 nt, Human
ugaauaucuaccaaccaagccuu

SEQ ID NO: 288480 - RNA, 21 nt, Human
ugauacuggaaguuaugggga

SEQ ID NO: 288481 - RNA, 22 nt, Human
ugcuccaggucaccugcccagg

SEQ ID NO: 288482 - RNA, 25 nt, Human
ugggcuucugaccuaaagaaaauuu

SEQ ID NO: 288483 - RNA, 19 nt, Human
ugguauaacaauuauauga

SEQ ID NO: 288484 - RNA, 19 nt, Human
uguaaaggauuuaaggcug

SEQ ID NO: 288485 - RNA, 21 nt, Human
uuaacuaaaauagaaaauaaa

SEQ ID NO: 288486 - RNA, 19 nt, Human
uuaaucuugaugaaaugcg

SEQ ID NO: 288487 - RNA, 21 nt, Human
uugaguauguacucauauccu

SEQ ID NO: 288488 - RNA, 19 nt, Human
uuggaaaaugauacuggaa

SEQ ID NO: 288489 - RNA, 20 nt, Human
aaaaaaaaaaaaaaugcaag

SEQ ID NO: 288490 - RNA, 26 nt, Human
aaaaaaaaaaaaaaugcaagucugga

SEQ ID NO: 288491 - RNA, 24 nt, Human
aaaaaaaaugcaagucuggagaaa

SEQ ID NO: 288492 - RNA, 18 nt, Human
aaaaaugcaagucuggag

SEQ ID NO: 288493 - RNA, 25 nt, Human
aaccugggugacauagugagagcuc

SEQ ID NO: 288494 - RNA, 22 nt, Human
aagagaaaugagguuaaguccg

SEQ ID NO: 288495 - RNA, 18 nt, Human
aagagcuacaggcuugga

SEQ ID NO: 288496 - RNA, 26 nt, Human
aagcaauucucaugccucagccuccc

SEQ ID NO: 288497 - RNA, 23 nt, Human
aagugcugugaucguagguguga

SEQ ID NO: 288498 - RNA, 22 nt, Human
aagugggcugagggcugcgacc

SEQ ID NO: 288499 - RNA, 21 nt, Human
aaugauaaaggcuggcugaaa

SEQ ID NO: 288500 - RNA, 18 nt, Human
aauuuguaguuuuucccc

SEQ ID NO: 288501 - RNA, 21 nt, Human
acaaaaaauaaaauuagcucg

SEQ ID NO: 288502 - RNA, 19 nt, Human
acagaggaugagaagacgg

SEQ ID NO: 288503 - RNA, 18 nt, Human
acaggguuucaccauguu

SEQ ID NO: 288504 - RNA, 23 nt, Human
acaggguuucaccauguuggcca

SEQ ID NO: 288505 - RNA, 24 nt, Human
acaggguuucaccauguuggccag

SEQ ID NO: 288506 - RNA, 18 nt, Human
acagugagacccugucuc

SEQ ID NO: 288507 - RNA, 18 nt, Human
accauguuggccaggcug

SEQ ID NO: 288508 - RNA, 22 nt, Human
acgccacugcacuccagccugg

SEQ ID NO: 288509 - RNA, 24 nt, Human
acgccacugcacuccagccugggc

SEQ ID NO: 288510 - RNA, 19 nt, Human
acugcacuccagccugggc

SEQ ID NO: 288511 - RNA, 24 nt, Human
acugcacuccagccugggcgacag

SEQ ID NO: 288512 - RNA, 21 nt, Human
acuugaggcuuuuguacagag

SEQ ID NO: 288513 - RNA, 22 nt, Human
acuuuuuguauuuuuaguagag

SEQ ID NO: 288514 - RNA, 20 nt, Human
agacaggcacaguggcucau

SEQ ID NO: 288515 - RNA, 21 nt, Human
agauagcuaagcauagcacau

SEQ ID NO: 288516 - RNA, 22 nt, Human
agcaauuuuuuuuuuccccuuu

SEQ ID NO: 288517 - RNA, 19 nt, Human
agcacuuugggaggcugag

SEQ ID NO: 288518 - RNA, 23 nt, Human
agcacuuugggaggcugagauag

SEQ ID NO: 288519 - RNA, 24 nt, Human
aggaaaaaggauaaaguaagagga

SEQ ID NO: 288520 - RNA, 19 nt, Human
aggaaugauaaaggcuggc

SEQ ID NO: 288521 - RNA, 24 nt, Human
aggcacaguggcucaugucuguaa

SEQ ID NO: 288522 - RNA, 24 nt, Human
aggcugaggugggagaacugcuug

SEQ ID NO: 288523 - RNA, 21 nt, Human
aggugugagccacugugccca

SEQ ID NO: 288524 - RNA, 20 nt, Human
agguuggagugcaguggcau

SEQ ID NO: 288525 - RNA, 25 nt, Human
aguagcugggauuacaggugccugu

SEQ ID NO: 288526 - RNA, 19 nt, Human
agugaguauaccaagagcu

SEQ ID NO: 288527 - RNA, 24 nt, Human
agugaucugcuugcuucagccucc

SEQ ID NO: 288528 - RNA, 20 nt, Human
agugcaguggcaugauccag

SEQ ID NO: 288529 - RNA, 23 nt, Human
agugcaguggcaugauccaggcu

SEQ ID NO: 288530 - RNA, 24 nt, Human
agugcaguggcaugauccaggcuc

SEQ ID NO: 288531 - RNA, 21 nt, Human
aguggcucaugucuguaaccc

SEQ ID NO: 288532 - RNA, 24 nt, Human
aguggcucaugucuguaacccuag

SEQ ID NO: 288533 - RNA, 20 nt, Human
auaaagcucuacuagcuaac

SEQ ID NO: 288534 - RNA, 24 nt, Human
aucacgccacugcacuccagccug

SEQ ID NO: 288535 - RNA, 22 nt, Human
auccuaagugggcugagggcug

SEQ ID NO: 288536 - RNA, 22 nt, Human
augccucagccucccgaguagc

SEQ ID NO: 288537 - RNA, 19 nt, Human
augucuguaacccuagcac

SEQ ID NO: 288538 - RNA, 23 nt, Human
auuagcucggcauggugcugcaa

SEQ ID NO: 288539 - RNA, 20 nt, Human
caagcuucugacuugcaaca

SEQ ID NO: 288540 - RNA, 22 nt, Human
caagugaucugcuugcuucagc

SEQ ID NO: 288541 - RNA, 21 nt, Human
caauaguagugaccaccaaua

SEQ ID NO: 288542 - RNA, 21 nt, Human
caauguguggcaguccaaaau

SEQ ID NO: 288543 - RNA, 21 nt, Human
caccauguuggccaggcuggu

SEQ ID NO: 288544 - RNA, 24 nt, Human
caccauguuggccaggcuggucuc

SEQ ID NO: 288545 - RNA, 27 nt, Human
caccauguuggccaggcuggucucaaa

SEQ ID NO: 288546 - RNA, 21 nt, Human
cacugcaaccuccgccucccg

SEQ ID NO: 288547 - RNA, 23 nt, Human
cacugcaaccuccgccucccggg

SEQ ID NO: 288548 - RNA, 19 nt, Human
cacugcacuccagccuggg

SEQ ID NO: 288549 - RNA, 20 nt, Human
cacugcacuccagccugggc

SEQ ID NO: 288550 - RNA, 22 nt, Human
cacugcacuccagccugggcga

SEQ ID NO: 288551 - RNA, 23 nt, Human
cacugcacuccagccugggcgac

SEQ ID NO: 288552 - RNA, 24 nt, Human
cacugcacuccagccugggcgaca

SEQ ID NO: 288553 - RNA, 25 nt, Human
cacugcacuccagccugggcgacag

SEQ ID NO: 288554 - RNA, 22 nt, Human
cacuugaggcuuuuguacagag

SEQ ID NO: 288555 - RNA, 24 nt, Human
cagagucuugcucugcugcccagg

SEQ ID NO: 288556 - RNA, 24 nt, Human
caggguuucaccauguuggccagg

SEQ ID NO: 288557 - RNA, 20 nt, Human
caggugccugucaucacggc

SEQ ID NO: 288558 - RNA, 24 nt, Human
caugccucagccucccgaguagcu

SEQ ID NO: 288559 - RNA, 20 nt, Human
caugucuguaacccuagcac

SEQ ID NO: 288560 - RNA, 24 nt, Human
cauguuggccaggcuggucucaaa

SEQ ID NO: 288561 - RNA, 20 nt, Human
ccacugcacuccagccuggg

SEQ ID NO: 288562 - RNA, 20 nt, Human
ccacugcacuccagccuggg

SEQ ID NO: 288563 - RNA, 21 nt, Human
ccacugcacuccagccugggc

SEQ ID NO: 288564 - RNA, 21 nt, Human
ccacugcacuccagccugggc

SEQ ID NO: 288565 - RNA, 23 nt, Human
ccacugcacuccagccugggcga

SEQ ID NO: 288566 - RNA, 24 nt, Human
ccacugcacuccagccugggcgac

SEQ ID NO: 288567 - RNA, 20 nt, Human
cccaugggacagacagggag

SEQ ID NO: 288568 - RNA, 23 nt, Human
cccgaguagcugggauuacaggu

SEQ ID NO: 288569 - RNA, 24 nt, Human
cccgaguagcugggauuacaggug

SEQ ID NO: 288570 - RNA, 23 nt, Human
cccggguucaagcaauucucaug

SEQ ID NO: 288571 - RNA, 20 nt, Human
cccuaaaaaauucaauggca

SEQ ID NO: 288572 - RNA, 19 nt, Human
cccugucucaaaaaaaaaa

SEQ ID NO: 288573 - RNA, 24 nt, Human
ccgaagugcugugaucguaggugu

SEQ ID NO: 288574 - RNA, 21 nt, Human
ccgaguagcugggauuacagg

SEQ ID NO: 288575 - RNA, 27 nt, Human
ccgccucccggguucaagcaauucuuu

SEQ ID NO: 288576 - RNA, 19 nt, Human
ccgcgccgggaagcgaggc

SEQ ID NO: 288577 - RNA, 22 nt, Human
ccucccggguucaagcaauucu

SEQ ID NO: 288578 - RNA, 20 nt, Human
ccugaccucaagugaucugc

SEQ ID NO: 288579 - RNA, 23 nt, Human
ccugucucaaaaaaaaaaaaaaa

SEQ ID NO: 288580 - RNA, 25 nt, Human
ccugucucaaaaaaaaaaaaaaaaa

SEQ ID NO: 288581 - RNA, 18 nt, Human
cgacagugagacccuguc

SEQ ID NO: 288582 - RNA, 26 nt, Human
cgccacugcacuccagccugggcgac

SEQ ID NO: 288583 - RNA, 18 nt, Human
cucaaaaaaaaaaaaaaa

SEQ ID NO: 288584 - RNA, 23 nt, Human
cucaagugaucugcuugcuucag

SEQ ID NO: 288585 - RNA, 24 nt, Human
cucacugcaaccuccgccucccgg

SEQ ID NO: 288586 - RNA, 24 nt, Human
cucagccucccgaguagcugggau

SEQ ID NO: 288587 - RNA, 25 nt, Human
cucaugccucagccucccgaguagc

SEQ ID NO: 288588 - RNA, 24 nt, Human
cucaugucuguaacccuagcacuu

SEQ ID NO: 288589 - RNA, 21 nt, Human
cucccauuacgcuacuguugg

SEQ ID NO: 288590 - RNA, 26 nt, Human
cuccugaccucaagugaucugcuugc

SEQ ID NO: 288591 - RNA, 18 nt, Human
cucugaaagagaaaugag

SEQ ID NO: 288592 - RNA, 18 nt, Human
cucugcugcccagguugg

SEQ ID NO: 288593 - RNA, 23 nt, Human
cugcaaccuccgccucccggguu

SEQ ID NO: 288594 - RNA, 24 nt, Human
cugcaaccuccgccucccggguuc

SEQ ID NO: 288595 - RNA, 18 nt, Human
cugcccagguuggagugc

SEQ ID NO: 288596 - RNA, 24 nt, Human
cugcccagguuggagugcaguggc

SEQ ID NO: 288597 - RNA, 18 nt, Human
cugcuugagcccaggagg

SEQ ID NO: 288598 - RNA, 23 nt, Human
cugggggaagcaugcagggaagg

SEQ ID NO: 288599 - RNA, 19 nt, Human
cuguaacccuagcacuuug

SEQ ID NO: 288600 - RNA, 21 nt, Human
cuguaacccuagcacuuuggg

SEQ ID NO: 288601 - RNA, 21 nt, Human
cuugcucugcugcccagguug

SEQ ID NO: 288602 - RNA, 24 nt, Human
cuuuuuguauuuuuaguagagaca

SEQ ID NO: 288603 - RNA, 24 nt, Human
gaagugcugugaucguagguguga

SEQ ID NO: 288604 - RNA, 20 nt, Human
gacauagugagagcucaucu

SEQ ID NO: 288605 - RNA, 25 nt, Human
gaccaccaauacuuaaggaaaaagg

SEQ ID NO: 288606 - RNA, 23 nt, Human
gagaucacgccacugcacuccag

SEQ ID NO: 288607 - RNA, 23 nt, Human
gagcccaggagggaaagcagcag

SEQ ID NO: 288608 - RNA, 18 nt, Human
gaucguaggugugagcca

SEQ ID NO: 288609 - RNA, 19 nt, Human
gaucguaggugugagccac

SEQ ID NO: 288610 - RNA, 21 nt, Human
gaucguaggugugagccacug

SEQ ID NO: 288611 - RNA, 24 nt, Human
gaucguaggugugagccacugugc

SEQ ID NO: 288612 - RNA, 22 nt, Human
gccacugcacuccagccugggc

SEQ ID NO: 288613 - RNA, 24 nt, Human
gccacugcacuccagccugggcga

SEQ ID NO: 288614 - RNA, 21 nt, Human
gcgacagugagacccugucuc

SEQ ID NO: 288615 - RNA, 23 nt, Human
gcuggucucaaacuccugaccuc

SEQ ID NO: 288616 - RNA, 18 nt, Human
ggacagcgaacauaaagc

SEQ ID NO: 288617 - RNA, 23 nt, Human
ggauaauguugaauuugacccuc

SEQ ID NO: 288618 - RNA, 25 nt, Human
ggcacaguggcucaugucuguaacc

SEQ ID NO: 288619 - RNA, 19 nt, Human
ggcugagggcugcgaccgc

SEQ ID NO: 288620 - RNA, 24 nt, Human
ggcuggucucaaacuccugaccuc

SEQ ID NO: 288621 - RNA, 22 nt, Human
gggaagcgaggcagaacucaag

SEQ ID NO: 288622 - RNA, 22 nt, Human
ggguuucaccauguuggccagg

SEQ ID NO: 288623 - RNA, 18 nt, Human
guccuuuuaauuguucuu

SEQ ID NO: 288624 - RNA, 24 nt, Human
gugaucugcuugcuucagccuccc

SEQ ID NO: 288625 - RNA, 24 nt, Human
uacuuuuuguauuuuuaguagaga

SEQ ID NO: 288626 - RNA, 22 nt, Human
uagagacaggguuucaccaugu

SEQ ID NO: 288627 - RNA, 18 nt, Human
uagcacuuugggaggcug

SEQ ID NO: 288628 - RNA, 24 nt, Human
uaguagagacaggguuucaccaug

SEQ ID NO: 288629 - RNA, 25 nt, Human
uaguagagacaggguuucaccaugu

SEQ ID NO: 288630 - RNA, 23 nt, Human
ucacgccacugcacuccagccug

SEQ ID NO: 288631 - RNA, 23 nt, Human
ucacugcaaccuccgccucccgg

SEQ ID NO: 288632 - RNA, 24 nt, Human
ucacugcaaccuccgccucccggg

SEQ ID NO: 288633 - RNA, 25 nt, Human
ucacugcaaccuccgccucccgggu

SEQ ID NO: 288634 - RNA, 26 nt, Human
ucacugcaaccuccgccucccggguu

SEQ ID NO: 288635 - RNA, 24 nt, Human
ucacuugaggcuuuuguacagagg

SEQ ID NO: 288636 - RNA, 20 nt, Human
ucagccucccgaguagcugg

SEQ ID NO: 288637 - RNA, 22 nt, Human
uccagccugggcgacagugaga

SEQ ID NO: 288638 - RNA, 23 nt, Human
ucccgaagugcugugaucguagg

SEQ ID NO: 288639 - RNA, 23 nt, Human
ucccgaguagcugggauuacagg

SEQ ID NO: 288640 - RNA, 24 nt, Human
ucccgaguagcugggauuacaggu

SEQ ID NO: 288641 - RNA, 21 nt, Human
ucccggguucaagcaauucuc

SEQ ID NO: 288642 - RNA, 24 nt, Human
ucccggguucaagcaauucucaug

SEQ ID NO: 288643 - RNA, 24 nt, Human
uccgccucccggguucaagcaauu

SEQ ID NO: 288644 - RNA, 21 nt, Human
ucuacuagcuaacaaauaggg

SEQ ID NO: 288645 - RNA, 21 nt, Human
ucuagacaggcacaguggcuc

SEQ ID NO: 288646 - RNA, 25 nt, Human
ucuagacaggcacaguggcucaugg

SEQ ID NO: 288647 - RNA, 24 nt, Human
ucugcugcccagguuggagugcag

SEQ ID NO: 288648 - RNA, 23 nt, Human
ucuugcucugcugcccagguugg

SEQ ID NO: 288649 - RNA, 24 nt, Human
ucuugcucugcugcccagguugga

SEQ ID NO: 288650 - RNA, 21 nt, Human
ugaaauaucuuggugucuagc

SEQ ID NO: 288651 - RNA, 22 nt, Human
ugaccucaagugaucugcuugc

SEQ ID NO: 288652 - RNA, 23 nt, Human
ugaccucaagugaucugcuugcu

SEQ ID NO: 288653 - RNA, 24 nt, Human
ugaccucaagugaucugcuugcuu

SEQ ID NO: 288654 - RNA, 18 nt, Human
ugagaaaaacaucaauga

SEQ ID NO: 288655 - RNA, 23 nt, Human
ugagaaaaacaucaaugaugaaa

SEQ ID NO: 288656 - RNA, 26 nt, Human
ugagaaaaacaucaaugaugaaauca

SEQ ID NO: 288657 - RNA, 18 nt, Human
ugagacagagucuugcuc

SEQ ID NO: 288658 - RNA, 22 nt, Human
ugagacagagucuugcucugcu

SEQ ID NO: 288659 - RNA, 23 nt, Human
ugaggugggagaacugcuugagc

SEQ ID NO: 288660 - RNA, 24 nt, Human
ugaggugggagaacugcuugagcc

SEQ ID NO: 288661 - RNA, 22 nt, Human
ugagugcccaugggacagacag

SEQ ID NO: 288662 - RNA, 22 nt, Human
ugcaagucuggagaaauauagc

SEQ ID NO: 288663 - RNA, 18 nt, Human
ugcccagguuggagugca

SEQ ID NO: 288664 - RNA, 21 nt, Human
ugcccagguuggagugcagug

SEQ ID NO: 288665 - RNA, 22 nt, Human
ugcccagguuggagugcagugg

SEQ ID NO: 288666 - RNA, 24 nt, Human
ugccucagccucccgaguagcugg

SEQ ID NO: 288667 - RNA, 22 nt, Human
ugcuucagccucccgaagugcu

SEQ ID NO: 288668 - RNA, 25 nt, Human
ugcuucagccucccgaagugcugug

SEQ ID NO: 288669 - RNA, 23 nt, Human
uggaagaugaauaaaguugggag

SEQ ID NO: 288670 - RNA, 19 nt, Human
uggagugcaguggcaugau

SEQ ID NO: 288671 - RNA, 22 nt, Human
uggagugcaguggcaugaucca

SEQ ID NO: 288672 - RNA, 24 nt, Human
uggagugcaguggcaugauccagg

SEQ ID NO: 288673 - RNA, 24 nt, Human
uggccaggcuggucucaaacuccu

SEQ ID NO: 288674 - RNA, 19 nt, Human
uggcucaugucuguaaccc

SEQ ID NO: 288675 - RNA, 23 nt, Human
uggcucaugucuguaacccuagc

SEQ ID NO: 288676 - RNA, 24 nt, Human
uggcucaugucuguaacccuagca

SEQ ID NO: 288677 - RNA, 20 nt, Human
ugggaggcugagauaggaga

SEQ ID NO: 288678 - RNA, 22 nt, Human
ugggauuacaggugccugucau

SEQ ID NO: 288679 - RNA, 24 nt, Human
ugggauuacaggugccugucauca

SEQ ID NO: 288680 - RNA, 24 nt, Human
ugggggaagcaugcagggaagggc

SEQ ID NO: 288681 - RNA, 23 nt, Human
ugggucacaucagcaauuuuuuu

SEQ ID NO: 288682 - RNA, 24 nt, Human
ugugaucguaggugugagccacug

SEQ ID NO: 288683 - RNA, 23 nt, Human
uguuagucgagaggcugaggugg

SEQ ID NO: 288684 - RNA, 26 nt, Human
uuaaggaaaaaggauaaaguaagagg

SEQ ID NO: 288685 - RNA, 20 nt, Human
uuacaggugccugucaucac

SEQ ID NO: 288686 - RNA, 18 nt, Human
uuacuaggguucaggagu

SEQ ID NO: 288687 - RNA, 21 nt, Human
uuacuaggguucaggaguuug

SEQ ID NO: 288688 - RNA, 23 nt, Human
uuacuaggguucaggaguuugag

SEQ ID NO: 288689 - RNA, 20 nt, Human
uuagcucggcauggugcugc

SEQ ID NO: 288690 - RNA, 24 nt, Human
uuaguagagacaggguuucaccau

SEQ ID NO: 288691 - RNA, 18 nt, Human
uucccuucaugggucaca

SEQ ID NO: 288692 - RNA, 24 nt, Human
uugcuucagccucccgaagugcug

SEQ ID NO: 288693 - RNA, 23 nt, Human
uugggaggcugagauaggagaau

SEQ ID NO: 288694 - RNA, 24 nt, Human
uuucaccauguuggccaggcuggu

SEQ ID NO: 288695 - RNA, 24 nt, Human
uuuuuaguagagacaggguuucac

SEQ ID NO: 288696 - RNA, 21 nt, Human
uuuuuguauuuuuaguagaga

SEQ ID NO: 288697 - RNA, 20 nt, Human
aaaaaaagacaauuugguaa

SEQ ID NO: 288698 - RNA, 23 nt, Human
aacaaagcaaggaaaagcaccac

SEQ ID NO: 288699 - RNA, 23 nt, Human
aagacuaacaaaaacuuuggcaa

SEQ ID NO: 288700 - RNA, 24 nt, Human
acuaacaaaaacuuuggcaaugca

SEQ ID NO: 288701 - RNA, 23 nt, Human
agcuuuuuacuuaguaacagucu

SEQ ID NO: 288702 - RNA, 23 nt, Human
aguuggaacucaaauuaaaugua

SEQ ID NO: 288703 - RNA, 22 nt, Human
auagauuagccucaaaaaaaga

SEQ ID NO: 288704 - RNA, 19 nt, Human
caaagcaaggaaaagcacc

SEQ ID NO: 288705 - RNA, 21 nt, Human
caaagcaaggaaaagcaccac

SEQ ID NO: 288706 - RNA, 23 nt, Human
caaagcaaggaaaagcaccacuc

SEQ ID NO: 288707 - RNA, 28 nt, Human
caaagcaaggaaaagcaccacucaaauc

SEQ ID NO: 288708 - RNA, 20 nt, Human
ccgccucccuucuccagucc

SEQ ID NO: 288709 - RNA, 23 nt, Human
ccgcggaucuccacaggcagcgc

SEQ ID NO: 288710 - RNA, 20 nt, Human
ccucaaaaaaagacaauuug

SEQ ID NO: 288711 - RNA, 20 nt, Human
cggaaaaggcuggacuggca

SEQ ID NO: 288712 - RNA, 20 nt, Human
cuuuuaauuuggugcuuguu

SEQ ID NO: 288713 - RNA, 25 nt, Human
gcaagacuaacaaaaacuuuggcaa

SEQ ID NO: 288714 - RNA, 26 nt, Human
gcccgccgccucccuucuccaguccc

SEQ ID NO: 288715 - RNA, 18 nt, Human
gcucgacgugcgcuucgc

SEQ ID NO: 288716 - RNA, 19 nt, Human
gguauuggucauauguuag

SEQ ID NO: 288717 - RNA, 18 nt, Human
uaacaaagcaaggaaaaa

SEQ ID NO: 288718 - RNA, 19 nt, Human
uaacaguuggaacucaaau

SEQ ID NO: 288719 - RNA, 19 nt, Human
uaacccaaugcacagcagc

SEQ ID NO: 288720 - RNA, 21 nt, Human
uaacccaaugcacagcagcgg

SEQ ID NO: 288721 - RNA, 20 nt, Human
uagccucaaaaaaagacaau

SEQ ID NO: 288722 - RNA, 22 nt, Human
ucaguaaauguuugacagcuuu

SEQ ID NO: 288723 - RNA, 25 nt, Human
uccacaggcagcgccgcucccccgc

SEQ ID NO: 288724 - RNA, 18 nt, Human
uccaccaaaagagggccc

SEQ ID NO: 288725 - RNA, 18 nt, Human
ucgacgugcgcuucgccc

SEQ ID NO: 288726 - RNA, 23 nt, Human
ucucaaauuaacuaacagaccuu

SEQ ID NO: 288727 - RNA, 30 nt, Human
ucuccacaggcagcgccgcucccccgcucu

SEQ ID NO: 288728 - RNA, 23 nt, Human
ucugagaaauaugcuuaacaguu

SEQ ID NO: 288729 - RNA, 18 nt, Human
ucuuuuuuuuuuuuuuuu

SEQ ID NO: 288730 - RNA, 18 nt, Human
ugacaagagugcuuuuac

SEQ ID NO: 288731 - RNA, 20 nt, Human
ugacuggugcuucuuuccuu

SEQ ID NO: 288732 - RNA, 18 nt, Human
ugccuucacaguguggaa

SEQ ID NO: 288733 - RNA, 18 nt, Human
ugucuucacaucaagcca

SEQ ID NO: 288734 - RNA, 24 nt, Human
uguucagcuggauuauggguuggu

SEQ ID NO: 288735 - RNA, 19 nt, Human
uguugguugucguuuuuaa

SEQ ID NO: 288736 - RNA, 19 nt, Human
uuacuuaguaacagucuca

SEQ ID NO: 288737 - RNA, 21 nt, Human
uugugcuacauccaccaaaag

SEQ ID NO: 288738 - RNA, 21 nt, Human
uuucuaacaauaacauaccgg

SEQ ID NO: 288739 - RNA, 18 nt, Human
uuuucaacuuaaacacua

SEQ ID NO: 288740 - RNA, 22 nt, Human
uuuuuuuuuuuuuuuuuuucag

SEQ ID NO: 288741 - RNA, 25 nt, Human
uuuuuuuuuuuuuuuuuuucuuuuu

SEQ ID NO: 288742 - RNA, 21 nt, Human
aaagggaaugagaguccaagg

SEQ ID NO: 288743 - RNA, 21 nt, Human
accuucacuuucucccuccug

SEQ ID NO: 288744 - RNA, 19 nt, Human
aggcaaggagaagagggca

SEQ ID NO: 288745 - RNA, 18 nt, Human
aggcaggaggugguaacu

SEQ ID NO: 288746 - RNA, 20 nt, Human
aggcaggaggugguaacugg

SEQ ID NO: 288747 - RNA, 21 nt, Human
aggcaggaggugguaacugga

SEQ ID NO: 288748 - RNA, 21 nt, Human
aggcgucuguggccuucgugg

SEQ ID NO: 288749 - RNA, 19 nt, Human
agggaagggaugauggggg

SEQ ID NO: 288750 - RNA, 18 nt, Human
augaugggggggcgggag

SEQ ID NO: 288751 - RNA, 25 nt, Human
cacccucauauccaugaauugggag

SEQ ID NO: 288752 - RNA, 21 nt, Human
cagcagcagcuacuuccgcgc

SEQ ID NO: 288753 - RNA, 21 nt, Human
caggaaaugggagaagcaagg

SEQ ID NO: 288754 - RNA, 24 nt, Human
cccgcugucgcugccguggcgggg

SEQ ID NO: 288755 - RNA, 19 nt, Human
ccgcgggggggcaaggggg

SEQ ID NO: 288756 - RNA, 21 nt, Human
ccuccugcccgcugucgcugc

SEQ ID NO: 288757 - RNA, 21 nt, Human
ccugcccgcugucgcugccgu

SEQ ID NO: 288758 - RNA, 23 nt, Human
cggcuccuccucuccuccccccu

SEQ ID NO: 288759 - RNA, 21 nt, Human
cucaggacaggggaacugcga

SEQ ID NO: 288760 - RNA, 22 nt, Human
cugcucagcucucucggcuccu

SEQ ID NO: 288761 - RNA, 22 nt, Human
gaacugcgagggaagggaugau

SEQ ID NO: 288762 - RNA, 21 nt, Human
gaauugggaggaaauuccuua

SEQ ID NO: 288763 - RNA, 22 nt, Human
gaugaugggggggcgggaggga

SEQ ID NO: 288764 - RNA, 26 nt, Human
ggaaauuccuuauuuagaaauggcca

SEQ ID NO: 288765 - RNA, 21 nt, Human
ggcgucuguggccuucguggc

SEQ ID NO: 288766 - RNA, 19 nt, Human
ggcuccuccucuccucccc

SEQ ID NO: 288767 - RNA, 20 nt, Human
gggaaugagaguccaagggg

SEQ ID NO: 288768 - RNA, 20 nt, Human
gggcaaggggggacugaggg

SEQ ID NO: 288769 - RNA, 22 nt, Human
gggcaaggggggacugaggggc

SEQ ID NO: 288770 - RNA, 21 nt, Human
ggggcuccguggaaaagggaa

SEQ ID NO: 288771 - RNA, 25 nt, Human
uaaacccuuaaucauaaaccacccu

SEQ ID NO: 288772 - RNA, 18 nt, Human
ucaaugcuggacacacgg

SEQ ID NO: 288773 - RNA, 19 nt, Human
ucacuuucucccuccugcc

SEQ ID NO: 288774 - RNA, 24 nt, Human
ucagcucucucggcuccuccucuc

SEQ ID NO: 288775 - RNA, 26 nt, Human
ucaggacaggggaacugcgagggaag

SEQ ID NO: 288776 - RNA, 23 nt, Human
uccguggaaaagggaaugagagu

SEQ ID NO: 288777 - RNA, 18 nt, Human
uccuccucuccuccccgu

SEQ ID NO: 288778 - RNA, 23 nt, Human
ucucacagagcuuggcacaauga

SEQ ID NO: 288779 - RNA, 25 nt, Human
ucucacagagcuuggcacaaugagg

SEQ ID NO: 288780 - RNA, 19 nt, Human
ucucucggcuccuccucuc

SEQ ID NO: 288781 - RNA, 22 nt, Human
ugagaguccaagggggaaggcg

SEQ ID NO: 288782 - RNA, 18 nt, Human
ugccguggcggggcuccc

SEQ ID NO: 288783 - RNA, 20 nt, Human
ugccguggcggggcuccccu

SEQ ID NO: 288784 - RNA, 22 nt, Human
ugcgagggaagggaugaugggg

SEQ ID NO: 288785 - RNA, 24 nt, Human
uggaaaagggaaugagaguccaag

SEQ ID NO: 288786 - RNA, 20 nt, Human
uggaauuucugaaaugugca

SEQ ID NO: 288787 - RNA, 23 nt, Human
ugggagaagcaaggcaaggagaa

SEQ ID NO: 288788 - RNA, 27 nt, Human
ugggagaagcaaggcaaggagaagagg

SEQ ID NO: 288789 - RNA, 21 nt, Human
uucacuuucucccuccugccc

SEQ ID NO: 288790 - RNA, 24 nt, Human
uucucuucaaugcuggacacacgg

SEQ ID NO: 288791 - RNA, 22 nt, Human
aaccugguucuucaggcagugg

SEQ ID NO: 288792 - RNA, 19 nt, Human
aagaacaugggggagggcc

SEQ ID NO: 288793 - RNA, 21 nt, Human
aagucacgagaucaaaacugg

SEQ ID NO: 288794 - RNA, 29 nt, Human
acacaugcacacucacacgcgugcacaca

SEQ ID NO: 288795 - RNA, 20 nt, Human
agcaaggaggguggugccac

SEQ ID NO: 288796 - RNA, 20 nt, Human
aggaaccugguucuucaggc

SEQ ID NO: 288797 - RNA, 18 nt, Human
aggcaggggugggcgggc

SEQ ID NO: 288798 - RNA, 22 nt, Human
aggcaggggugggcgggcuggg

SEQ ID NO: 288799 - RNA, 23 nt, Human
aggcaggggugggcgggcugggg

SEQ ID NO: 288800 - RNA, 28 nt, Human
aggcuguccaggugcaguaggacccagu

SEQ ID NO: 288801 - RNA, 21 nt, Human
aggggcuggagaggguggggg

SEQ ID NO: 288802 - RNA, 20 nt, Human
agggggcgcagggcuacggg

SEQ ID NO: 288803 - RNA, 19 nt, Human
aggggugggcgggcugggg

SEQ ID NO: 288804 - RNA, 19 nt, Human
agugcccucaggcagguga

SEQ ID NO: 288805 - RNA, 24 nt, Human
augcacacucacacgcgugcacag

SEQ ID NO: 288806 - RNA, 23 nt, Human
augcacacucacacgcgugcagg

SEQ ID NO: 288807 - RNA, 31 nt, Human
cacacacacacacaugcacacucacacgcgg

SEQ ID NO: 288808 - RNA, 26 nt, Human
cacacgcgugcacacacucauacaug

SEQ ID NO: 288809 - RNA, 23 nt, Human
cacccccagcgacccccacugca

SEQ ID NO: 288810 - RNA, 19 nt, Human
caccccuugcgggcuggag

SEQ ID NO: 288811 - RNA, 18 nt, Human
caccgccaccaccgcgga

SEQ ID NO: 288812 - RNA, 23 nt, Human
caggaaccugguucuucaggcag

SEQ ID NO: 288813 - RNA, 19 nt, Human
caggacagggaccaucugu

SEQ ID NO: 288814 - RNA, 24 nt, Human
caggacagggaccaucuguccccc

SEQ ID NO: 288815 - RNA, 18 nt, Human
ccagccacagaaaggggg

SEQ ID NO: 288816 - RNA, 25 nt, Human
ccagcgacccccacugcagacuucc

SEQ ID NO: 288817 - RNA, 24 nt, Human
cccacaauggcucagggggagagg

SEQ ID NO: 288818 - RNA, 18 nt, Human
cccacugcagacuuccag

SEQ ID NO: 288819 - RNA, 18 nt, Human
ccccagcgacccccacug

SEQ ID NO: 288820 - RNA, 19 nt, Human
ccccagcgacccccacugc

SEQ ID NO: 288821 - RNA, 21 nt, Human
cccccacaauggcucaggggg

SEQ ID NO: 288822 - RNA, 19 nt, Human
cccccagcaaggagggugg

SEQ ID NO: 288823 - RNA, 19 nt, Human
cccccagcgacccccacug

SEQ ID NO: 288824 - RNA, 30 nt, Human
cccccuacuggccucaguggggcggggguu

SEQ ID NO: 288825 - RNA, 25 nt, Human
ccccuugcgggcuggaggacggggu

SEQ ID NO: 288826 - RNA, 21 nt, Human
cccuguguuuuucuaaaaguc

SEQ ID NO: 288827 - RNA, 23 nt, Human
ccucagcucucuugcaccgccac

SEQ ID NO: 288828 - RNA, 25 nt, Human
cgcgugcacacacucauacauguuc

SEQ ID NO: 288829 - RNA, 20 nt, Human
cgcucgcggccuaacugcuc

SEQ ID NO: 288830 - RNA, 22 nt, Human
cggacauucaugaucgaccccc

SEQ ID NO: 288831 - RNA, 19 nt, Human
cggccuggucugaugcugg

SEQ ID NO: 288832 - RNA, 21 nt, Human
cucgcgccucccucagcucuc

SEQ ID NO: 288833 - RNA, 19 nt, Human
cugcaggggcuggagaggg

SEQ ID NO: 288834 - RNA, 20 nt, Human
cuuugguugaggggaagggc

SEQ ID NO: 288835 - RNA, 25 nt, Human
gaacaugggggagggccugucccag

SEQ ID NO: 288836 - RNA, 24 nt, Human
gcagacuuccagugaugggagggc

SEQ ID NO: 288837 - RNA, 18 nt, Human
gcaggaaccugguucuuc

SEQ ID NO: 288838 - RNA, 23 nt, Human
gccaccaccgcggacgaauucca

SEQ ID NO: 288839 - RNA, 22 nt, Human
gcccucgcgccucccucagcuc

SEQ ID NO: 288840 - RNA, 23 nt, Human
gcggccuggucugaugcuggugg

SEQ ID NO: 288841 - RNA, 18 nt, Human
gcucagggggagaggggg

SEQ ID NO: 288842 - RNA, 19 nt, Human
gcucagggggagagggggc

SEQ ID NO: 288843 - RNA, 20 nt, Human
gcugaccgggcaggaaccug

SEQ ID NO: 288844 - RNA, 21 nt, Human
gcuugcucccacgagucccug

SEQ ID NO: 288845 - RNA, 21 nt, Human
ggagggccugucccagagggu

SEQ ID NO: 288846 - RNA, 24 nt, Human
ggagggccugucccagaggguggg

SEQ ID NO: 288847 - RNA, 21 nt, Human
ggcugggaggagugggaggcc

SEQ ID NO: 288848 - RNA, 23 nt, Human
gggcaggaaccugguucuucagg

SEQ ID NO: 288849 - RNA, 18 nt, Human
gggcgcagggcuacggga

SEQ ID NO: 288850 - RNA, 21 nt, Human
gggcuggagaggguggggggc

SEQ ID NO: 288851 - RNA, 21 nt, Human
ggggugggcgggcuggggcug

SEQ ID NO: 288852 - RNA, 24 nt, Human
gucauuugcugcaggggcuggaaa

SEQ ID NO: 288853 - RNA, 24 nt, Human
gucccccaauaagggcaggggcug

SEQ ID NO: 288854 - RNA, 25 nt, Human
guucaccucuuaguguucucuccac

SEQ ID NO: 288855 - RNA, 23 nt, Human
uaacucgaggcaggggugggcgg

SEQ ID NO: 288856 - RNA, 18 nt, Human
uaauuguaaaacuaacuc

SEQ ID NO: 288857 - RNA, 21 nt, Human
uacuggccucaguggggcggg

SEQ ID NO: 288858 - RNA, 21 nt, Human
ucaggcagugguucugccagg

SEQ ID NO: 288859 - RNA, 21 nt, Human
ucauuugcugcaggggcugga

SEQ ID NO: 288860 - RNA, 20 nt, Human
uccacccccagcgaccccca

SEQ ID NO: 288861 - RNA, 22 nt, Human
ucccagaggguggggguccugg

SEQ ID NO: 288862 - RNA, 20 nt, Human
ucgcuugcucccacgagucc

SEQ ID NO: 288863 - RNA, 19 nt, Human
ucuccacccccagcgaccc

SEQ ID NO: 288864 - RNA, 21 nt, Human
ucuuugguugaggggaagggc

SEQ ID NO: 288865 - RNA, 23 nt, Human
ucuuugguugaggggaagggcgc

SEQ ID NO: 288866 - RNA, 19 nt, Human
ugaggggaagggcgcuggg

SEQ ID NO: 288867 - RNA, 27 nt, Human
ugcacacacacacacaugcacacucac

SEQ ID NO: 288868 - RNA, 25 nt, Human
ugcacacacucauacauguucaccu

SEQ ID NO: 288869 - RNA, 23 nt, Human
ugcaccgccaccaccgcggacga

SEQ ID NO: 288870 - RNA, 20 nt, Human
ugccagggccaccccgcagg

SEQ ID NO: 288871 - RNA, 24 nt, Human
ugcggccuggucugaugcuggugg

SEQ ID NO: 288872 - RNA, 22 nt, Human
ugcuggugggacagaagugccc

SEQ ID NO: 288873 - RNA, 23 nt, Human
uggagacagaagaacauggggga

SEQ ID NO: 288874 - RNA, 21 nt, Human
ugggaggagugggaggccugg

SEQ ID NO: 288875 - RNA, 24 nt, Human
ugggaggccuggcccccuacuggc

SEQ ID NO: 288876 - RNA, 25 nt, Human
uggggcgggggugacccggggggcu

SEQ ID NO: 288877 - RNA, 22 nt, Human
uggggggcccugaccugucucc

SEQ ID NO: 288878 - RNA, 27 nt, Human
uguucucuccacccccagcgaccccca

SEQ ID NO: 288879 - RNA, 20 nt, Human
uuaguguucucuccaccccc

SEQ ID NO: 288880 - RNA, 18 nt, Human
uuccuggagacagaagaa

SEQ ID NO: 288881 - RNA, 19 nt, Human
uucucuccacccccagcga

SEQ ID NO: 288882 - RNA, 28 nt, Human
uugcacacacacacacaugcacacucac

SEQ ID NO: 288883 - RNA, 18 nt, Human
uugcaccgccaccaccgc

SEQ ID NO: 288884 - RNA, 22 nt, Human
uugcugcaggggcuggagaggg

SEQ ID NO: 288885 - RNA, 19 nt, Human
uuugguugaggggaagggc

SEQ ID NO: 288886 - RNA, 18 nt, Human
aaaaacacaccaacugaa

SEQ ID NO: 288887 - RNA, 19 nt, Human
aaacagaagccaacuuaac

SEQ ID NO: 288888 - RNA, 24 nt, Human
aaacagaagccaacuuaaccaaaa

SEQ ID NO: 288889 - RNA, 18 nt, Human
aaacgugcuaaagggaaa

SEQ ID NO: 288890 - RNA, 21 nt, Human
aaagaaagacacuggcaauga

SEQ ID NO: 288891 - RNA, 24 nt, Human
aagacacuggcaaugaaagugcua

SEQ ID NO: 288892 - RNA, 23 nt, Human
aagacaucccaaaaacacaccaa

SEQ ID NO: 288893 - RNA, 23 nt, Human
acacaccauccgccagcgagagc

SEQ ID NO: 288894 - RNA, 24 nt, Human
accaucuaaaaauaagacauccca

SEQ ID NO: 288895 - RNA, 19 nt, Human
acuagaaacagaagccaac

SEQ ID NO: 288896 - RNA, 21 nt, Human
acuagaaacagaagccaacuu

SEQ ID NO: 288897 - RNA, 19 nt, Human
agaggaccgggcagcgcag

SEQ ID NO: 288898 - RNA, 21 nt, Human
agaggaccgggcagcgcagcg

SEQ ID NO: 288899 - RNA, 19 nt, Human
aguguguacagucccacac

SEQ ID NO: 288900 - RNA, 19 nt, Human
auaaaguguguacaguccc

SEQ ID NO: 288901 - RNA, 25 nt, Human
caacuagaaacagaagccaacuuaa

SEQ ID NO: 288902 - RNA, 24 nt, Human
cacacaccauccgccagcgagagc

SEQ ID NO: 288903 - RNA, 23 nt, Human
caccaaagaaagacacuggcaau

SEQ ID NO: 288904 - RNA, 24 nt, Human
caccaaagaaagacacuggcaaug

SEQ ID NO: 288905 - RNA, 21 nt, Human
caucccaaaaacacaccaacu

SEQ ID NO: 288906 - RNA, 24 nt, Human
caucccaaaaacacaccaacugaa

SEQ ID NO: 288907 - RNA, 19 nt, Human
ccacgccgauacgaccccg

SEQ ID NO: 288908 - RNA, 18 nt, Human
ccgcaggcggaagcuuuc

SEQ ID NO: 288909 - RNA, 23 nt, Human
ccuccagcgccgcucgcgugccc

SEQ ID NO: 288910 - RNA, 19 nt, Human
ccugcggcggccacacacc

SEQ ID NO: 288911 - RNA, 19 nt, Human
cgagagcagcgagcuggcc

SEQ ID NO: 288912 - RNA, 24 nt, Human
cgcagcgcggggcuggggcuggcg

SEQ ID NO: 288913 - RNA, 25 nt, Human
cgccagcagccgcuacuucauggcc

SEQ ID NO: 288914 - RNA, 22 nt, Human
cgggagaggaccgggcagcgca

SEQ ID NO: 288915 - RNA, 19 nt, Human
cgugcuaaagggaaaggaa

SEQ ID NO: 288916 - RNA, 22 nt, Human
cuagaaacagaagccaacuuaa

SEQ ID NO: 288917 - RNA, 20 nt, Human
cucaacuagaaacagaagcc

SEQ ID NO: 288918 - RNA, 22 nt, Human
cuccagcgccgcucgcgugccc

SEQ ID NO: 288919 - RNA, 22 nt, Human
cuccucaacuagaaacagaagc

SEQ ID NO: 288920 - RNA, 24 nt, Human
cucgcgugcccuggcgcuggggcu

SEQ ID NO: 288921 - RNA, 23 nt, Human
cuuaaccaaaacgaaguaaauaa

SEQ ID NO: 288922 - RNA, 22 nt, Human
gacgguuucucuagucuauguu

SEQ ID NO: 288923 - RNA, 18 nt, Human
gagagcagcgagcuggcc

SEQ ID NO: 288924 - RNA, 18 nt, Human
gcgcagcgcggggcuggg

SEQ ID NO: 288925 - RNA, 21 nt, Human
ggaaacuccucaacuagaaac

SEQ ID NO: 288926 - RNA, 23 nt, Human
ggacgguuucucuagucuauguu

SEQ ID NO: 288927 - RNA, 20 nt, Human
ggcgguugggcagcggcgcc

SEQ ID NO: 288928 - RNA, 20 nt, Human
ggcuggcgguugggcagcgg

SEQ ID NO: 288929 - RNA, 20 nt, Human
gggagaggaccgggcagcgc

SEQ ID NO: 288930 - RNA, 21 nt, Human
gggcagcggcgccgccagcag

SEQ ID NO: 288931 - RNA, 25 nt, Human
gggcaggcgggacuuuuguccggcc

SEQ ID NO: 288932 - RNA, 22 nt, Human
gggcuggggcuggcgguugggc

SEQ ID NO: 288933 - RNA, 19 nt, Human
uagaaacagaagccaacuu

SEQ ID NO: 288934 - RNA, 21 nt, Human
ucaacuagaaacagaagccaa

SEQ ID NO: 288935 - RNA, 18 nt, Human
ucugaaaacacuuuauua

SEQ ID NO: 288936 - RNA, 20 nt, Human
ucugaaaacacuuuauuaca

SEQ ID NO: 288937 - RNA, 23 nt, Human
ucuggguaaaucuuacucaaucu

SEQ ID NO: 288938 - RNA, 20 nt, Human
ugacaggggcugugaggggu

SEQ ID NO: 288939 - RNA, 21 nt, Human
ugacaggggcugugaggggua

SEQ ID NO: 288940 - RNA, 21 nt, Human
ugacaggggcugugaggggua

SEQ ID NO: 288941 - RNA, 19 nt, Human
ugccacaggcuaagaaugc

SEQ ID NO: 288942 - RNA, 21 nt, Human
ugccacaggcuaagaaugcug

SEQ ID NO: 288943 - RNA, 21 nt, Human
uggcccgggcacggcgggcgu

SEQ ID NO: 288944 - RNA, 20 nt, Human
ugugagggguaucacccaaa

SEQ ID NO: 288945 - RNA, 21 nt, Human
ugugagggguaucacccaaac

SEQ ID NO: 288946 - RNA, 20 nt, Human
uuaaacgugcuaaagggaaa

SEQ ID NO: 288947 - RNA, 22 nt, Human
uuuuuuuuuuuuuuugcucuga

SEQ ID NO: 288948 - RNA, 22 nt, Human
aaacacaggcugcugacuuccc

SEQ ID NO: 288949 - RNA, 23 nt, Human
aaacacaggcugcugacuucccu

SEQ ID NO: 288950 - RNA, 23 nt, Human
aaacagaagaaagauaagaauga

SEQ ID NO: 288951 - RNA, 25 nt, Human
aaacagaagaaagauaagagggacc

SEQ ID NO: 288952 - RNA, 26 nt, Human
aaacagaagaaagauaagagggaccc

SEQ ID NO: 288953 - RNA, 19 nt, Human
acacagauaccccacugcc

SEQ ID NO: 288954 - RNA, 21 nt, Human
acucucccauccccgagcccu

SEQ ID NO: 288955 - RNA, 27 nt, Human
acucucccauccccgagcccucccagg

SEQ ID NO: 288956 - RNA, 30 nt, Human
acuggucucaugcccaugaugaguugcacc

SEQ ID NO: 288957 - RNA, 22 nt, Human
agaaacagaagaaagauaagaa

SEQ ID NO: 288958 - RNA, 19 nt, Human
agagacugaaaugacagcg

SEQ ID NO: 288959 - RNA, 20 nt, Human
agauaagaaugaggugguca

SEQ ID NO: 288960 - RNA, 20 nt, Human
aggaagaaacagaagaaaga

SEQ ID NO: 288961 - RNA, 22 nt, Human
aggaagaaacagaagaaagaua

SEQ ID NO: 288962 - RNA, 24 nt, Human
aggaagaaacagaagaaagauaag

SEQ ID NO: 288963 - RNA, 21 nt, Human
agguggucagguugggggaau

SEQ ID NO: 288964 - RNA, 31 nt, Human
cacuggucucaugcccaugaugaguugcacc

SEQ ID NO: 288965 - RNA, 27 nt, Human
cagcggggaggaagaaacagaagaaag

SEQ ID NO: 288966 - RNA, 23 nt, Human
caggacacccuugcugagucuca

SEQ ID NO: 288967 - RNA, 23 nt, Human
cggggaggaagaaacagaagaaa

SEQ ID NO: 288968 - RNA, 25 nt, Human
cuuccagggugaguccucacacugg

SEQ ID NO: 288969 - RNA, 20 nt, Human
gaaagauaagaaugaggugg

SEQ ID NO: 288970 - RNA, 20 nt, Human
gacaaaaugaagagacugaa

SEQ ID NO: 288971 - RNA, 19 nt, Human
gagguggucagguuggggg

SEQ ID NO: 288972 - RNA, 20 nt, Human
gagguggucagguuggggga

SEQ ID NO: 288973 - RNA, 18 nt, Human
gccguaugacaaaaugaa

SEQ ID NO: 288974 - RNA, 27 nt, Human
guggucagugggagaacacacagauac

SEQ ID NO: 288975 - RNA, 19 nt, Human
uaagcgaauauucucuucc

SEQ ID NO: 288976 - RNA, 23 nt, Human
uaugacaaaaugaagagacugaa

SEQ ID NO: 288977 - RNA, 22 nt, Human
ucacacuggucucaugcccaug

SEQ ID NO: 288978 - RNA, 28 nt, Human
ucucagaguuccugugcuccucauuuga

SEQ ID NO: 288979 - RNA, 22 nt, Human
ugaagagacugaaaugacagcg

SEQ ID NO: 288980 - RNA, 21 nt, Human
ugaaucuguguacucucccau

SEQ ID NO: 288981 - RNA, 19 nt, Human
ugacaaaaugaagagacug

SEQ ID NO: 288982 - RNA, 20 nt, Human
ugcccaugaugaguugcaca

SEQ ID NO: 288983 - RNA, 20 nt, Human
ugccucaugucauuuuccuu

SEQ ID NO: 288984 - RNA, 18 nt, Human
ugucugcgacuugaggag

SEQ ID NO: 288985 - RNA, 18 nt, Human
ugucugcgacuugaggag

SEQ ID NO: 288986 - RNA, 18 nt, Human
accgccgccgcugccgcc

SEQ ID NO: 288987 - RNA, 18 nt, Human
accgccgccgcugccgcc

SEQ ID NO: 288988 - RNA, 21 nt, Human
aggcgggagggaggggggggc

SEQ ID NO: 288989 - RNA, 19 nt, Human
caaccccucucccgcaccg

SEQ ID NO: 288990 - RNA, 23 nt, Human
caaccccucucccgcaccgcucc

SEQ ID NO: 288991 - RNA, 20 nt, Human
cagcccuggguccaaccccu

SEQ ID NO: 288992 - RNA, 23 nt, Human
cagucacuucccccccgcaaccg

SEQ ID NO: 288993 - RNA, 24 nt, Human
cccccgcaaccgccgccgcugccg

SEQ ID NO: 288994 - RNA, 25 nt, Human
cccccgcaaccgccgccgcugccgc

SEQ ID NO: 288995 - RNA, 19 nt, Human
cccucucccgcaccgcucc

SEQ ID NO: 288996 - RNA, 18 nt, Human
ccgccgccgcugccgccc

SEQ ID NO: 288997 - RNA, 22 nt, Human
ccgcucccgccgcuuuaagcgc

SEQ ID NO: 288998 - RNA, 23 nt, Human
ccggcgccggcaccgcccaguca

SEQ ID NO: 288999 - RNA, 24 nt, Human
cgccgcuuuaagcgcuucuccucc

SEQ ID NO: 289000 - RNA, 20 nt, Human
gaggcgggagggaggggggg

SEQ ID NO: 289001 - RNA, 20 nt, Human
ggagggaggggggggccugc

SEQ ID NO: 289002 - RNA, 21 nt, Human
ucuccggcgccggcaccgccc

SEQ ID NO: 289003 - RNA, 23 nt, Human
ugaggcgggagggaggggggggc

SEQ ID NO: 289004 - RNA, 24 nt, Human
ugaggcgggagggaggggggggcc

SEQ ID NO: 289005 - RNA, 21 nt, Human
aaaaaagcuccucuuaagacu

SEQ ID NO: 289006 - RNA, 22 nt, Human
aagcuccucuuaagacugaucc

SEQ ID NO: 289007 - RNA, 20 nt, Human
acguuccccccgcccccccc

SEQ ID NO: 289008 - RNA, 21 nt, Human
aucccugguguggagaggcca

SEQ ID NO: 289009 - RNA, 18 nt, Human
ccccccgccccccccuuc

SEQ ID NO: 289010 - RNA, 19 nt, Human
cccccgccccccccuucgc

SEQ ID NO: 289011 - RNA, 22 nt, Human
cccccgccccccccuucgcccc

SEQ ID NO: 289012 - RNA, 24 nt, Human
ccccuaacagcugguugccuuccu

SEQ ID NO: 289013 - RNA, 25 nt, Human
ccgccacccggagcugccagcuuug

SEQ ID NO: 289014 - RNA, 19 nt, Human
ccugcaccgccacccggag

SEQ ID NO: 289015 - RNA, 22 nt, Human
cuaacagcugguugccuuccuc

SEQ ID NO: 289016 - RNA, 21 nt, Human
cuccaaaaaaaagcuccucuu

SEQ ID NO: 289017 - RNA, 24 nt, Human
cuccccgcuccuuuaucugccuua

SEQ ID NO: 289018 - RNA, 23 nt, Human
cugguuggcaauuaauuucucuc

SEQ ID NO: 289019 - RNA, 24 nt, Human
ggaggcucugggacugcacacugu

SEQ ID NO: 289020 - RNA, 20 nt, Human
guggguccuggcguugggaa

SEQ ID NO: 289021 - RNA, 18 nt, Human
uaaaauuaaaggcagacc

SEQ ID NO: 289022 - RNA, 20 nt, Human
uaaaauuaaaggcagaccgg

SEQ ID NO: 289023 - RNA, 19 nt, Human
uaacagcugguugccuucc

SEQ ID NO: 289024 - RNA, 18 nt, Human
uaauuucucuccccgcuc

SEQ ID NO: 289025 - RNA, 19 nt, Human
uccgcugaauucccucccc

SEQ ID NO: 289026 - RNA, 20 nt, Human
ucgcuucuucacccuucuug

SEQ ID NO: 289027 - RNA, 24 nt, Human
ucugggacugcacacuguauaugc

SEQ ID NO: 289028 - RNA, 22 nt, Human
ugauccgcugaauucccucccc

SEQ ID NO: 289029 - RNA, 21 nt, Human
ugggaauucuuugacaacuuc

SEQ ID NO: 289030 - RNA, 22 nt, Human
ugggaugggaauccauuucauc

SEQ ID NO: 289031 - RNA, 18 nt, Human
uggguaaaauuaaaggca

SEQ ID NO: 289032 - RNA, 18 nt, Human
ugugcuccacucucccca

SEQ ID NO: 289033 - RNA, 24 nt, Human
uuccccccgccccccccuucgccc

SEQ ID NO: 289034 - RNA, 18 nt, Human
uugaaaaauacagcccaa

SEQ ID NO: 289035 - RNA, 22 nt, Human
uuuuuugcugugguugugugac

SEQ ID NO: 289036 - RNA, 22 nt, Human
aaagauacauuaaaaccaucag

SEQ ID NO: 289037 - RNA, 23 nt, Human
aagcauguccagacagacaccac

SEQ ID NO: 289038 - RNA, 19 nt, Human
acaaagaaaugccaacaga

SEQ ID NO: 289039 - RNA, 21 nt, Human
acaaagaaaugccaacagaga

SEQ ID NO: 289040 - RNA, 21 nt, Human
accacaaagaaaugccaacag

SEQ ID NO: 289041 - RNA, 25 nt, Human
agacagacaccacaaagaaaugcca

SEQ ID NO: 289042 - RNA, 18 nt, Human
aggaagcauguccagaca

SEQ ID NO: 289043 - RNA, 21 nt, Human
cacagaagcauaaauauaaua

SEQ ID NO: 289044 - RNA, 18 nt, Human
caccacaaagaaaugcca

SEQ ID NO: 289045 - RNA, 21 nt, Human
caccacaaagaaaugccaaca

SEQ ID NO: 289046 - RNA, 20 nt, Human
cagcuugaaaaaaucaugaa

SEQ ID NO: 289047 - RNA, 21 nt, Human
ccagacagacaccacaaagaa

SEQ ID NO: 289048 - RNA, 20 nt, Human
gaaaaaaucaugacacagaa

SEQ ID NO: 289049 - RNA, 24 nt, Human
gaccgcggagcgcgcugagcagcc

SEQ ID NO: 289050 - RNA, 20 nt, Human
gcggagcgcgcugagcagcc

SEQ ID NO: 289051 - RNA, 22 nt, Human
uaacuauaauaaguggaaaaga

SEQ ID NO: 289052 - RNA, 20 nt, Human
uauaauaaguggaaaagaua

SEQ ID NO: 289053 - RNA, 18 nt, Human
ucaaagguggagugacug

SEQ ID NO: 289054 - RNA, 20 nt, Human
uccagacagacaccacaaag

SEQ ID NO: 289055 - RNA, 21 nt, Human
uccagacagacaccacaaaga

SEQ ID NO: 289056 - RNA, 23 nt, Human
uccagacagacaccacaaagaaa

SEQ ID NO: 289057 - RNA, 24 nt, Human
ugaaaaaaucaugacacagaagca

SEQ ID NO: 289058 - RNA, 21 nt, Human
ugucaaagguggagugacugg

SEQ ID NO: 289059 - RNA, 23 nt, Human
uuaaugugaauacuacugguuac

SEQ ID NO: 289060 - RNA, 24 nt, Human
uucaaaacagaacucauaaggcag

SEQ ID NO: 289061 - RNA, 26 nt, Human
uuuaaggggaaaaaaagcaagauuua

SEQ ID NO: 289062 - RNA, 19 nt, Human
uuuuuuuuuuuuuaagggg

SEQ ID NO: 289063 - RNA, 22 nt, Human
aaaaagacagacaaaccauuac

SEQ ID NO: 289064 - RNA, 25 nt, Human
aaaaagacagacaaaccauuacaga

SEQ ID NO: 289065 - RNA, 22 nt, Human
aaaagaaauaaacaucaaagaa

SEQ ID NO: 289066 - RNA, 22 nt, Human
aaacaaaacauaucuaagucca

SEQ ID NO: 289067 - RNA, 22 nt, Human
aaagaaacuauuuuaaccuagg

SEQ ID NO: 289068 - RNA, 21 nt, Human
aagaaaaaaguaccaaggaaa

SEQ ID NO: 289069 - RNA, 22 nt, Human
aagaaaaaaguaccaaggaaac

SEQ ID NO: 289070 - RNA, 22 nt, Human
aagacagacaaaccauuacaga

SEQ ID NO: 289071 - RNA, 18 nt, Human
aaggaaacaaaaaaaauc

SEQ ID NO: 289072 - RNA, 23 nt, Human
aagugauuuauuaaugaaaauuc

SEQ ID NO: 289073 - RNA, 23 nt, Human
aauagaaacaaaacauaucuaag

SEQ ID NO: 289074 - RNA, 30 nt, Human
aauagaagaaaauagaaacaaaacauaucc

SEQ ID NO: 289075 - RNA, 22 nt, Human
aauuuaaaaacuuaaacaaugc

SEQ ID NO: 289076 - RNA, 18 nt, Human
acaccacaucaggaaaac

SEQ ID NO: 289077 - RNA, 26 nt, Human
accucaaaaguacaauuucuggaaau

SEQ ID NO: 289078 - RNA, 24 nt, Human
acgugagucaggauggagggaguu

SEQ ID NO: 289079 - RNA, 20 nt, Human
agaagaaaauagaaacaaaa

SEQ ID NO: 289080 - RNA, 26 nt, Human
agaagaaaauagaaacaaaagggacc

SEQ ID NO: 289081 - RNA, 21 nt, Human
agacagacaaaccauuacaga

SEQ ID NO: 289082 - RNA, 26 nt, Human
aggaaaaccuccuuuuauuccacauu

SEQ ID NO: 289083 - RNA, 20 nt, Human
aggaagaaagagacccgaca

SEQ ID NO: 289084 - RNA, 19 nt, Human
caaaagaaacauuaguccu

SEQ ID NO: 289085 - RNA, 18 nt, Human
cacauguguggaagagau

SEQ ID NO: 289086 - RNA, 19 nt, Human
cacuauauaaccuuugaau

SEQ ID NO: 289087 - RNA, 22 nt, Human
cacuauauaaccuuugaauacc

SEQ ID NO: 289088 - RNA, 21 nt, Human
cagaggaaaaaagacagacaa

SEQ ID NO: 289089 - RNA, 24 nt, Human
cagaggaaaaaagacagacaaacc

SEQ ID NO: 289090 - RNA, 22 nt, Human
cauauauuacaccugacagcuc

SEQ ID NO: 289091 - RNA, 19 nt, Human
ccccccaaagugcagagau

SEQ ID NO: 289092 - RNA, 19 nt, Human
ccucaagcaccacaaaaga

SEQ ID NO: 289093 - RNA, 25 nt, Human
ccucugccaggcagagacgcuccuc

SEQ ID NO: 289094 - RNA, 22 nt, Human
ccugccuuggccccccaaagug

SEQ ID NO: 289095 - RNA, 23 nt, Human
ccuuccaugggauuucacaagag

SEQ ID NO: 289096 - RNA, 18 nt, Human
cuggaaauuauucuaucu

SEQ ID NO: 289097 - RNA, 19 nt, Human
cugguauaaaaaaauacug

SEQ ID NO: 289098 - RNA, 19 nt, Human
gaaaaacugaaauagaaga

SEQ ID NO: 289099 - RNA, 18 nt, Human
gaagaaaauagaaacaaa

SEQ ID NO: 289100 - RNA, 21 nt, Human
gaggagaugcuauucgcucgg

SEQ ID NO: 289101 - RNA, 23 nt, Human
ggacaaaagaaauaaacaucaaa

SEQ ID NO: 289102 - RNA, 20 nt, Human
ggcaggaagaaagagacccg

SEQ ID NO: 289103 - RNA, 21 nt, Human
ggcaggaagaaagagacccga

SEQ ID NO: 289104 - RNA, 19 nt, Human
gggcaucugcgggcugcag

SEQ ID NO: 289105 - RNA, 21 nt, Human
uaaaaaaauacugaucagagg

SEQ ID NO: 289106 - RNA, 28 nt, Human
uaaccugagagagauggacugcgcgucc

SEQ ID NO: 289107 - RNA, 26 nt, Human
uacaccugacagcucaaacaggacgu

SEQ ID NO: 289108 - RNA, 21 nt, Human
uagcaaaaucaguuaaagaga

SEQ ID NO: 289109 - RNA, 23 nt, Human
uaugcaacacauaugaaaaaaac

SEQ ID NO: 289110 - RNA, 21 nt, Human
ucaguuaaagagauuccuggg

SEQ ID NO: 289111 - RNA, 22 nt, Human
ucaucucaggcagucuccaaaa

SEQ ID NO: 289112 - RNA, 21 nt, Human
uccacauuuccuuucaucuca

SEQ ID NO: 289113 - RNA, 19 nt, Human
ucgcugggcaucugcgggc

SEQ ID NO: 289114 - RNA, 19 nt, Human
ucuccaaaacugguauaaa

SEQ ID NO: 289115 - RNA, 23 nt, Human
ucuggugggaggugggaggagau

SEQ ID NO: 289116 - RNA, 22 nt, Human
ugaaaaacugaaauagaagaaa

SEQ ID NO: 289117 - RNA, 21 nt, Human
ugaaauagaagaaaauagaaa

SEQ ID NO: 289118 - RNA, 18 nt, Human
ugacaacugcacaugugu

SEQ ID NO: 289119 - RNA, 18 nt, Human
ugagagagauggacugcg

SEQ ID NO: 289120 - RNA, 23 nt, Human
ugcagccucugccaggcagagac

SEQ ID NO: 289121 - RNA, 18 nt, Human
ugccaggcagagacgcuc

SEQ ID NO: 289122 - RNA, 19 nt, Human
ugccaggcagagacgcucc

SEQ ID NO: 289123 - RNA, 28 nt, Human
ugccaggcagagacgcuccucacuuccc

SEQ ID NO: 289124 - RNA, 22 nt, Human
ugccuuggccccccaaagugca

SEQ ID NO: 289125 - RNA, 21 nt, Human
uggacaaaagaaauaaacauc

SEQ ID NO: 289126 - RNA, 22 nt, Human
ugggaggugggaggagaugcua

SEQ ID NO: 289127 - RNA, 18 nt, Human
ugggcaggaagaaagaga

SEQ ID NO: 289128 - RNA, 23 nt, Human
uggugggaggugggaggagaugc

SEQ ID NO: 289129 - RNA, 21 nt, Human
uuacaccacaucaggaaaacc

SEQ ID NO: 289130 - RNA, 22 nt, Human
uucaucucaggcagucuccaaa

SEQ ID NO: 289131 - RNA, 27 nt, Human
uuuaaaaagaaaaaaguaccaaggaaa

SEQ ID NO: 289132 - RNA, 23 nt, Human
uuuucagaauuuaaaaacuuaaa

SEQ ID NO: 289133 - RNA, 23 nt, Human
uuuuuuuuuuuuuuuuuucuggg

SEQ ID NO: 289134 - RNA, 20 nt, Human
aaaaaaaagcugaaaguuug

SEQ ID NO: 289135 - RNA, 24 nt, Human
aaaagcugaaaguuugauugaacu

SEQ ID NO: 289136 - RNA, 23 nt, Human
acugcaguucauuuuacagagaa

SEQ ID NO: 289137 - RNA, 19 nt, Human
agauagugguuguacuuuc

SEQ ID NO: 289138 - RNA, 21 nt, Human
aguucuggaaaggcuccucuu

SEQ ID NO: 289139 - RNA, 26 nt, Human
caaaaugaauacucagaaucaaacua

SEQ ID NO: 289140 - RNA, 19 nt, Human
cagauuggacagagagggu

SEQ ID NO: 289141 - RNA, 18 nt, Human
caggagcuucuucuguaa

SEQ ID NO: 289142 - RNA, 19 nt, Human
cauccggaggcugagaacg

SEQ ID NO: 289143 - RNA, 19 nt, Human
cauuuuacagagaaacacc

SEQ ID NO: 289144 - RNA, 25 nt, Human
ccagcggucuccuggguaauccucc

SEQ ID NO: 289145 - RNA, 22 nt, Human
ccaggaguuucuucugcaauuu

SEQ ID NO: 289146 - RNA, 25 nt, Human
cccaugcgcgcagcggcgccagccg

SEQ ID NO: 289147 - RNA, 27 nt, Human
cccaugcgcgcagcggcgccagccgcg

SEQ ID NO: 289148 - RNA, 21 nt, Human
cucuaaauccaaaagggccuc

SEQ ID NO: 289149 - RNA, 20 nt, Human
cugaaaaaaaagcugaaagu

SEQ ID NO: 289150 - RNA, 24 nt, Human
gacacuggguaugcucccccagga

SEQ ID NO: 289151 - RNA, 24 nt, Human
gacuugcagauuggacagagaggg

SEQ ID NO: 289152 - RNA, 18 nt, Human
gagaacucucucuccagc

SEQ ID NO: 289153 - RNA, 23 nt, Human
gcgcgcgcgcgugugugugugug

SEQ ID NO: 289154 - RNA, 24 nt, Human
gugaauggcugaaaaaaaagcuga

SEQ ID NO: 289155 - RNA, 19 nt, Human
guuguacuuucucuucugc

SEQ ID NO: 289156 - RNA, 22 nt, Human
uaacuugauuucuucccuguaa

SEQ ID NO: 289157 - RNA, 20 nt, Human
uaagagaaggucucuccugg

SEQ ID NO: 289158 - RNA, 22 nt, Human
ucagugcuacaucuaaaaagag

SEQ ID NO: 289159 - RNA, 21 nt, Human
ucccuguaauucaaacauuca

SEQ ID NO: 289160 - RNA, 23 nt, Human
ucuagugaguuuacuguccuaag

SEQ ID NO: 289161 - RNA, 22 nt, Human
ucuccaaguugcaaaaugaaua

SEQ ID NO: 289162 - RNA, 19 nt, Human
ucugcguaguguggguaag

SEQ ID NO: 289163 - RNA, 21 nt, Human
ucugcguaguguggguaagag

SEQ ID NO: 289164 - RNA, 22 nt, Human
ucuguaauuuuacucugcuguu

SEQ ID NO: 289165 - RNA, 19 nt, Human
ugaaaaaaacuugaagagu

SEQ ID NO: 289166 - RNA, 25 nt, Human
ugaaaagagaauuagaaaaugaagg

SEQ ID NO: 289167 - RNA, 21 nt, Human
ugaacugaaauccaauccaug

SEQ ID NO: 289168 - RNA, 23 nt, Human
ugaauggcugaaaaaaaagcuga

SEQ ID NO: 289169 - RNA, 24 nt, Human
ugcccucaguuauguucacgaucu

SEQ ID NO: 289170 - RNA, 18 nt, Human
ugcgcgcgcgcgcgugug

SEQ ID NO: 289171 - RNA, 22 nt, Human
ugcgcgcgcgcgcgugugugug

SEQ ID NO: 289172 - RNA, 20 nt, Human
uggaaaggcuccucuuuaaa

SEQ ID NO: 289173 - RNA, 20 nt, Human
uggagagagucgggcguguc

SEQ ID NO: 289174 - RNA, 22 nt, Human
uggcggcugcgggccaggaaca

SEQ ID NO: 289175 - RNA, 19 nt, Human
uggguagguggcggcugcg

SEQ ID NO: 289176 - RNA, 22 nt, Human
uggguagguggcggcugcgggc

SEQ ID NO: 289177 - RNA, 21 nt, Human
ugucgcagauggcucugcugu

SEQ ID NO: 289178 - RNA, 22 nt, Human
ugugaauggcugaaaaaaaagc

SEQ ID NO: 289179 - RNA, 18 nt, Human
ugugcgcgcgcgcgcgug

SEQ ID NO: 289180 - RNA, 24 nt, Human
ugugcgcgcgcgcgcgugugugug

SEQ ID NO: 289181 - RNA, 24 nt, Human
ugugugcgcgcgcgcgcgugugug

SEQ ID NO: 289182 - RNA, 24 nt, Human
ugugugugcgcgcgcgcgcgugau

SEQ ID NO: 289183 - RNA, 25 nt, Human
uucauaauuucucacuuugugacaa

SEQ ID NO: 289184 - RNA, 19 nt, Human
uucugauggagagagucgg

SEQ ID NO: 289185 - RNA, 21 nt, Human
uucuuugggaauagaugcuuu

SEQ ID NO: 289186 - RNA, 21 nt, Human
uuguacuuucucuucugcgua

SEQ ID NO: 289187 - RNA, 22 nt, Human
uuuacugaagguaaaaggcagg

SEQ ID NO: 289188 - RNA, 19 nt, Human
aaaaccuguuuucuccccc

SEQ ID NO: 289189 - RNA, 18 nt, Human
aaagcagcgccaugagcc

SEQ ID NO: 289190 - RNA, 18 nt, Human
aaaggccagggcauacgg

SEQ ID NO: 289191 - RNA, 19 nt, Human
aaccuguuuucuccccccc

SEQ ID NO: 289192 - RNA, 18 nt, Human
aaccuuuuuacucguaca

SEQ ID NO: 289193 - RNA, 18 nt, Human
aacuugguuuccaacccc

SEQ ID NO: 289194 - RNA, 22 nt, Human
aacuugguuuccaaccccuccc

SEQ ID NO: 289195 - RNA, 23 nt, Human
acacacacacacacacacacaca

SEQ ID NO: 289196 - RNA, 23 nt, Human
acacacacacacacacacacaca

SEQ ID NO: 289197 - RNA, 23 nt, Human
acacacacacacacacacacaca

SEQ ID NO: 289198 - RNA, 23 nt, Human
acacacacacacacacacacaca

SEQ ID NO: 289199 - RNA, 23 nt, Human
acacacacacacacacacacaca

SEQ ID NO: 289200 - RNA, 23 nt, Human
acacacacacacacacacacaca

SEQ ID NO: 289201 - RNA, 23 nt, Human
acacacacacacacacacacaca

SEQ ID NO: 289202 - RNA, 24 nt, Human
acacacacacacacacacacacag

SEQ ID NO: 289203 - RNA, 33 nt, Human
acacacacacacacacacacacagacacguagu

SEQ ID NO: 289204 - RNA, 31 nt, Human
acacacacacacacacacacagacacguacg

SEQ ID NO: 289205 - RNA, 29 nt, Human
acacacacacacacacagacacguacgca

SEQ ID NO: 289206 - RNA, 25 nt, Human
acacacacacacacagacacguacg

SEQ ID NO: 289207 - RNA, 25 nt, Human
acacugggucaugacaggaaaggcc

SEQ ID NO: 289208 - RNA, 20 nt, Human
acagccacaaaaauaaaacc

SEQ ID NO: 289209 - RNA, 26 nt, Human
acagccacaaaaauaaaaccuguuuu

SEQ ID NO: 289210 - RNA, 21 nt, Human
agaaaggaacucuacauaaaa

SEQ ID NO: 289211 - RNA, 22 nt, Human
agagacucuggaaagugaacac

SEQ ID NO: 289212 - RNA, 21 nt, Human
agcaacacggaauucacuggu

SEQ ID NO: 289213 - RNA, 25 nt, Human
agccacaaaaauaaaaccuguuuuc

SEQ ID NO: 289214 - RNA, 22 nt, Human
aggaacucuacauaaauaugcc

SEQ ID NO: 289215 - RNA, 19 nt, Human
aggaaggacaagcuugaga

SEQ ID NO: 289216 - RNA, 21 nt, Human
aggagaaaggaacucuacaua

SEQ ID NO: 289217 - RNA, 18 nt, Human
auaaauaugcccaaaggc

SEQ ID NO: 289218 - RNA, 20 nt, Human
auacaaaaaugugaaauauc

SEQ ID NO: 289219 - RNA, 27 nt, Human
caaaaauaaaaccuguuuucucccccc

SEQ ID NO: 289220 - RNA, 18 nt, Human
caaagcagcgccaugagc

SEQ ID NO: 289221 - RNA, 21 nt, Human
caagagcaacacggaauucac

SEQ ID NO: 289222 - RNA, 20 nt, Human
cacacacacacacacacaca

SEQ ID NO: 289223 - RNA, 20 nt, Human
cacacacacacacacacaca

SEQ ID NO: 289224 - RNA, 20 nt, Human
cacacacacacacacacaca

SEQ ID NO: 289225 - RNA, 20 nt, Human
cacacacacacacacacaca

SEQ ID NO: 289226 - RNA, 20 nt, Human
cacacacacacacacacaca

SEQ ID NO: 289227 - RNA, 20 nt, Human
cacacacacacacacacaca

SEQ ID NO: 289228 - RNA, 20 nt, Human
cacacacacacacacacaca

SEQ ID NO: 289229 - RNA, 20 nt, Human
cacacacacacacacacaca

SEQ ID NO: 289230 - RNA, 20 nt, Human
cacacacacacacacacaca

SEQ ID NO: 289231 - RNA, 20 nt, Human
cacacacacacacacacaca

SEQ ID NO: 289232 - RNA, 22 nt, Human
cacacacacacacacacacaca

SEQ ID NO: 289233 - RNA, 22 nt, Human
cacacacacacacacacacaca

SEQ ID NO: 289234 - RNA, 22 nt, Human
cacacacacacacacacacaca

SEQ ID NO: 289235 - RNA, 26 nt, Human
cacacacacacacacacacacacaca

SEQ ID NO: 289236 - RNA, 26 nt, Human
cacacacacacacacacacacacaca

SEQ ID NO: 289237 - RNA, 26 nt, Human
cacacacacacacacacacacacaca

SEQ ID NO: 289238 - RNA, 26 nt, Human
cacacacacacacacacacacacaca

SEQ ID NO: 289239 - RNA, 26 nt, Human
cacacacacacacacacacacacaca

SEQ ID NO: 289240 - RNA, 26 nt, Human
cacacacacacacacacacacacaca

SEQ ID NO: 289241 - RNA, 28 nt, Human
cacacacacacacacacacacacagaca

SEQ ID NO: 289242 - RNA, 18 nt, Human
cacacacgcugccguacc

SEQ ID NO: 289243 - RNA, 19 nt, Human
cacacacgcugccguaccc

SEQ ID NO: 289244 - RNA, 21 nt, Human
cacagcgccacgcauaagaac

SEQ ID NO: 289245 - RNA, 24 nt, Human
cacagcgccacgcauaagaacaga

SEQ ID NO: 289246 - RNA, 21 nt, Human
cacguacgcacacacgcugcc

SEQ ID NO: 289247 - RNA, 23 nt, Human
cagagacucuggaaagugaacac

SEQ ID NO: 289248 - RNA, 19 nt, Human
cagcagcuggaaugucagc

SEQ ID NO: 289249 - RNA, 31 nt, Human
cagcagcuggaaugucagcucuuuuugcagg

SEQ ID NO: 289250 - RNA, 23 nt, Human
caggaaaggccucacaagagcaa

SEQ ID NO: 289251 - RNA, 21 nt, Human
caggcaggacaguacaccccc

SEQ ID NO: 289252 - RNA, 20 nt, Human
caguuagauuaaaaagggga

SEQ ID NO: 289253 - RNA, 19 nt, Human
ccaaacaaacgaacagaga

SEQ ID NO: 289254 - RNA, 28 nt, Human
ccacaaaaauaaaaccuguuguccggac

SEQ ID NO: 289255 - RNA, 24 nt, Human
ccaucaggcagguucuuaagcaca

SEQ ID NO: 289256 - RNA, 19 nt, Human
ccccacccgggcccgcgcc

SEQ ID NO: 289257 - RNA, 23 nt, Human
ccccacccgggcccgcgcccgcc

SEQ ID NO: 289258 - RNA, 23 nt, Human
ccccacccgggcccgcgcccgcc

SEQ ID NO: 289259 - RNA, 22 nt, Human
cccccaggagacaacuugguuu

SEQ ID NO: 289260 - RNA, 25 nt, Human
cccccaggagacaacuugguuucca

SEQ ID NO: 289261 - RNA, 23 nt, Human
ccccgagaccgccauccaaacaa

SEQ ID NO: 289262 - RNA, 24 nt, Human
ccucaaaaucucagugcgagaaga

SEQ ID NO: 289263 - RNA, 24 nt, Human
cuaucugaagcggguggagcaaag

SEQ ID NO: 289264 - RNA, 21 nt, Human
cucccccccaggagacaacuu

SEQ ID NO: 289265 - RNA, 21 nt, Human
cucguacaucccccaugagaa

SEQ ID NO: 289266 - RNA, 23 nt, Human
cucuacauaaauaugcccaaagg

SEQ ID NO: 289267 - RNA, 19 nt, Human
cuggaaagugaacacagcg

SEQ ID NO: 289268 - RNA, 18 nt, Human
gagaccgccauccaaaca

SEQ ID NO: 289269 - RNA, 23 nt, Human
gaucuguuucaacggagaauggg

SEQ ID NO: 289270 - RNA, 21 nt, Human
gcccgcgcccgccucagcggu

SEQ ID NO: 289271 - RNA, 21 nt, Human
gcugccguaccccgagaccgc

SEQ ID NO: 289272 - RNA, 25 nt, Human
ggaaaaaaccacagccacaaaaaua

SEQ ID NO: 289273 - RNA, 18 nt, Human
ggaaggacaagcuugaga

SEQ ID NO: 289274 - RNA, 18 nt, Human
ggccagggcauacggcaa

SEQ ID NO: 289275 - RNA, 25 nt, Human
uaaaaccuguuuucucccccccagg

SEQ ID NO: 289276 - RNA, 18 nt, Human
uaagaacagaaguuaacc

SEQ ID NO: 289277 - RNA, 18 nt, Human
uacggcaagcccucucau

SEQ ID NO: 289278 - RNA, 20 nt, Human
uaucugaagcggguggagca

SEQ ID NO: 289279 - RNA, 21 nt, Human
ucacacacacacacacacaca

SEQ ID NO: 289280 - RNA, 23 nt, Human
ucagcucuuuuugcagauuucac

SEQ ID NO: 289281 - RNA, 22 nt, Human
ucaugacaggaaaggccucaca

SEQ ID NO: 289282 - RNA, 19 nt, Human
uccaaacaaacgaacagag

SEQ ID NO: 289283 - RNA, 21 nt, Human
uccaaacaaacgaacagagac

SEQ ID NO: 289284 - RNA, 22 nt, Human
ucucaugggugggcaugagugg

SEQ ID NO: 289285 - RNA, 24 nt, Human
ucugcagaguggccggaaccuugg

SEQ ID NO: 289286 - RNA, 19 nt, Human
ugagaaacucacgucuuag

SEQ ID NO: 289287 - RNA, 23 nt, Human
ugaguggacaucuuccugaagga

SEQ ID NO: 289288 - RNA, 19 nt, Human
ugguuuccaaccccuccca

SEQ ID NO: 289289 - RNA, 20 nt, Human
uucacacacacacacacaca

SEQ ID NO: 289290 - RNA, 21 nt, Human
uucacacacacacacacacac

SEQ ID NO: 289291 - RNA, 26 nt, Human
uucaugacagccuacaaccgugauga

SEQ ID NO: 289292 - RNA, 19 nt, Human
uuuccaaccccucccauac

SEQ ID NO: 289293 - RNA, 24 nt, Human
uuugucguugcugugaucuguuuc

SEQ ID NO: 289294 - RNA, 21 nt, Human
aaaagcugugaaagcuuccac

SEQ ID NO: 289295 - RNA, 27 nt, Human
aacaucacuuacuaacagaugagcagc

SEQ ID NO: 289296 - RNA, 22 nt, Human
aaccauaguugcucuaauaccu

SEQ ID NO: 289297 - RNA, 24 nt, Human
acaaaagcugugaaagcuuccacu

SEQ ID NO: 289298 - RNA, 19 nt, Human
aggcaaaagaagauaaugg

SEQ ID NO: 289299 - RNA, 25 nt, Human
aggcaaaagaagauaaugguacuag

SEQ ID NO: 289300 - RNA, 21 nt, Human
auaaguagauuaauguguaga

SEQ ID NO: 289301 - RNA, 22 nt, Human
augaaggaaauaugagcaagga

SEQ ID NO: 289302 - RNA, 18 nt, Human
augauuuuuaauuugaau

SEQ ID NO: 289303 - RNA, 20 nt, Human
caaggaagcugugauuuuuc

SEQ ID NO: 289304 - RNA, 22 nt, Human
cacagagaauguacaaaagcug

SEQ ID NO: 289305 - RNA, 27 nt, Human
cacaggcugaagaaaauaaauguaaac

SEQ ID NO: 289306 - RNA, 20 nt, Human
caccuggaauggaguuaaua

SEQ ID NO: 289307 - RNA, 18 nt, Human
cagcugagauugccaagc

SEQ ID NO: 289308 - RNA, 19 nt, Human
caggggacagucuguaacu

SEQ ID NO: 289309 - RNA, 22 nt, Human
cagugcagcccuuucagcuuuc

SEQ ID NO: 289310 - RNA, 22 nt, Human
caugucaccuggaauggaguua

SEQ ID NO: 289311 - RNA, 19 nt, Human
ccagaaccugcuaauacaa

SEQ ID NO: 289312 - RNA, 27 nt, Human
ccauugcuuuguuuugcacaggcugaa

SEQ ID NO: 289313 - RNA, 22 nt, Human
ccccagaaaaaugucgaguccc

SEQ ID NO: 289314 - RNA, 22 nt, Human
cccugcuaugugacagcuccaa

SEQ ID NO: 289315 - RNA, 25 nt, Human
ccuuugguuucugggacggcucggg

SEQ ID NO: 289316 - RNA, 22 nt, Human
cuccaaggacuaaagauuucaa

SEQ ID NO: 289317 - RNA, 23 nt, Human
cuccagguguagcugcguuuucc

SEQ ID NO: 289318 - RNA, 20 nt, Human
gaaggaaauaugagcaagga

SEQ ID NO: 289319 - RNA, 20 nt, Human
gaaggcagcagcacucaggc

SEQ ID NO: 289320 - RNA, 24 nt, Human
gaggcauuggcuccaacugucagc

SEQ ID NO: 289321 - RNA, 19 nt, Human
gcugugauuuuucucuggc

SEQ ID NO: 289322 - RNA, 20 nt, Human
gcuuguuuuccaucucagcc

SEQ ID NO: 289323 - RNA, 20 nt, Human
ggcuggcacugugaaaauaa

SEQ ID NO: 289324 - RNA, 18 nt, Human
uaaauguaaacagcauau

SEQ ID NO: 289325 - RNA, 20 nt, Human
uaagaugaaggaaauaugag

SEQ ID NO: 289326 - RNA, 22 nt, Human
uaauaaugggacaucacuuccu

SEQ ID NO: 289327 - RNA, 19 nt, Human
uacaaguccugaugaauug

SEQ ID NO: 289328 - RNA, 19 nt, Human
uacacuaugaggcauuggc

SEQ ID NO: 289329 - RNA, 18 nt, Human
uagccagaaccugcuaau

SEQ ID NO: 289330 - RNA, 19 nt, Human
uaggaggggaagagcagug

SEQ ID NO: 289331 - RNA, 23 nt, Human
uauccaugucaccuggaauggag

SEQ ID NO: 289332 - RNA, 20 nt, Human
uaugagcaaggacugcacuc

SEQ ID NO: 289333 - RNA, 24 nt, Human
uauuuuucuuucaguuuacacuau

SEQ ID NO: 289334 - RNA, 25 nt, Human
ucaccagaaaacauuaauugaucgu

SEQ ID NO: 289335 - RNA, 20 nt, Human
ucagaaaaagguucaguuuc

SEQ ID NO: 289336 - RNA, 21 nt, Human
ucagcaguucccuaccaggaa

SEQ ID NO: 289337 - RNA, 26 nt, Human
ucagcaguucccuaccaggaaacugg

SEQ ID NO: 289338 - RNA, 19 nt, Human
ucagggagccaggggacag

SEQ ID NO: 289339 - RNA, 20 nt, Human
uccagugcagcccuuucagc

SEQ ID NO: 289340 - RNA, 23 nt, Human
uccccagaaaaaugucgaguccc

SEQ ID NO: 289341 - RNA, 24 nt, Human
uccugagcaauuuuucuuuuauug

SEQ ID NO: 289342 - RNA, 20 nt, Human
ucggaguuguaggaggugaa

SEQ ID NO: 289343 - RNA, 21 nt, Human
ucuagccagaaccugcuaaua

SEQ ID NO: 289344 - RNA, 18 nt, Human
ugacaggagauagucucu

SEQ ID NO: 289345 - RNA, 19 nt, Human
ugacguggugcauuaguaa

SEQ ID NO: 289346 - RNA, 20 nt, Human
ugcagcccuuucagcuuucc

SEQ ID NO: 289347 - RNA, 23 nt, Human
ugcagcccuuucagcuuuccaga

SEQ ID NO: 289348 - RNA, 22 nt, Human
ugccccugcuaugugacagcuc

SEQ ID NO: 289349 - RNA, 24 nt, Human
uggacaaaaauacaaaugaaauga

SEQ ID NO: 289350 - RNA, 23 nt, Human
uggcucaggguggauaauaaugg

SEQ ID NO: 289351 - RNA, 20 nt, Human
ugguggcucaggguggauaa

SEQ ID NO: 289352 - RNA, 23 nt, Human
uuaguaauuuuaggcaaaagaag

SEQ ID NO: 289353 - RNA, 18 nt, Human
uugcuggugacggucuug

SEQ ID NO: 289354 - RNA, 22 nt, Human
uuuagaguauuguuggcuuugu

SEQ ID NO: 289355 - RNA, 24 nt, Human
uuuauuaaggagaugagaagcagg

SEQ ID NO: 289356 - RNA, 24 nt, Human
uuuauugggaucaucuuaauucuu

SEQ ID NO: 289357 - RNA, 24 nt, Human
uuugguuucugggacggcucgggu

SEQ ID NO: 289358 - RNA, 18 nt, Human
uuuguuaagaugaggcag

SEQ ID NO: 289359 - RNA, 24 nt, Human
aaacuacccuuuccuccuuuucug

SEQ ID NO: 289360 - RNA, 18 nt, Human
aaaucagccucuacccuu

SEQ ID NO: 289361 - RNA, 19 nt, Human
aacccccagccccaaacag

SEQ ID NO: 289362 - RNA, 23 nt, Human
aagaagacuugagccacuucuuu

SEQ ID NO: 289363 - RNA, 23 nt, Human
aagaaggauaacacagaaaggaa

SEQ ID NO: 289364 - RNA, 24 nt, Human
aagaaggauaacacagaaaggaaa

SEQ ID NO: 289365 - RNA, 24 nt, Human
aagaggaagggauucuuuuuugaa

SEQ ID NO: 289366 - RNA, 19 nt, Human
aaggguuuguagcaaccug

SEQ ID NO: 289367 - RNA, 19 nt, Human
agaaaggaaaaaaauuuga

SEQ ID NO: 289368 - RNA, 21 nt, Human
aggaaggaaagcagcagagga

SEQ ID NO: 289369 - RNA, 19 nt, Human
auccucuucuguagugugu

SEQ ID NO: 289370 - RNA, 21 nt, Human
augaacaaacuccaagaagac

SEQ ID NO: 289371 - RNA, 22 nt, Human
augcaguuuccuuucuaugucc

SEQ ID NO: 289372 - RNA, 18 nt, Human
auguugcuacuccccauc

SEQ ID NO: 289373 - RNA, 19 nt, Human
auguugcuacuccccaucc

SEQ ID NO: 289374 - RNA, 19 nt, Human
caacaaccucacccagaaa

SEQ ID NO: 289375 - RNA, 30 nt, Human
caacccccagccccaaacagaucugauucu

SEQ ID NO: 289376 - RNA, 22 nt, Human
cacaaggguuuguagcaaccug

SEQ ID NO: 289377 - RNA, 23 nt, Human
cacagaaggaaggaaagcagcag

SEQ ID NO: 289378 - RNA, 22 nt, Human
cagguacuauuucuagaauccc

SEQ ID NO: 289379 - RNA, 22 nt, Human
cauuucucagcuuccucuaugc

SEQ ID NO: 289380 - RNA, 22 nt, Human
ccagacucaaauggcuuccuca

SEQ ID NO: 289381 - RNA, 29 nt, Human
ccagccccaaacagaucugauucuagaaa

SEQ ID NO: 289382 - RNA, 21 nt, Human
cccagccccaaacagaucuga

SEQ ID NO: 289383 - RNA, 21 nt, Human
ccccaucccuucaggccacag

SEQ ID NO: 289384 - RNA, 19 nt, Human
cccuugugaacagguucgg

SEQ ID NO: 289385 - RNA, 23 nt, Human
ccucagaccccacauuucucagc

SEQ ID NO: 289386 - RNA, 25 nt, Human
cucaaauggcuuccucagaccccac

SEQ ID NO: 289387 - RNA, 26 nt, Human
cuccaacccccagccccaaacagauc

SEQ ID NO: 289388 - RNA, 21 nt, Human
cugcuuuuauucuccaacccc

SEQ ID NO: 289389 - RNA, 30 nt, Human
cuucuguagugugugugugugugugugugg

SEQ ID NO: 289390 - RNA, 21 nt, Human
cuuuuuauguugcuacucccc

SEQ ID NO: 289391 - RNA, 24 nt, Human
gaacaaacuccaagaagacuugag

SEQ ID NO: 289392 - RNA, 27 nt, Human
gaacaaacuccaagaagacuugagcca

SEQ ID NO: 289393 - RNA, 19 nt, Human
gagguaagggugggagagg

SEQ ID NO: 289394 - RNA, 25 nt, Human
gauaagaaggauaacacagaaagga

SEQ ID NO: 289395 - RNA, 22 nt, Human
gcaacaaccucacccagaaauu

SEQ ID NO: 289396 - RNA, 20 nt, Human
gcagaagauggagccaugug

SEQ ID NO: 289397 - RNA, 21 nt, Human
gcuacuccccaucccuucagg

SEQ ID NO: 289398 - RNA, 18 nt, Human
gcucaagugugugagaug

SEQ ID NO: 289399 - RNA, 23 nt, Human
ggauaagaaggauaacacagaaa

SEQ ID NO: 289400 - RNA, 23 nt, Human
gugacagagacuguagaaaagga

SEQ ID NO: 289401 - RNA, 21 nt, Human
gugugugugugugugauuuuu

SEQ ID NO: 289402 - RNA, 20 nt, Human
gugugugugugugugugugu

SEQ ID NO: 289403 - RNA, 19 nt, Human
uacagaguggcaagcucaa

SEQ ID NO: 289404 - RNA, 18 nt, Human
uagaaagucauugugaag

SEQ ID NO: 289405 - RNA, 21 nt, Human
uagaaggcagacaaucuuucu

SEQ ID NO: 289406 - RNA, 20 nt, Human
uagaaucccauagacuucuc

SEQ ID NO: 289407 - RNA, 21 nt, Human
uagaaucccauagacuucucc

SEQ ID NO: 289408 - RNA, 21 nt, Human
uauacagaguggcaagcucaa

SEQ ID NO: 289409 - RNA, 24 nt, Human
uauguugcuacuccccaucccuuc

SEQ ID NO: 289410 - RNA, 21 nt, Human
uauuuuaaggggcgugacaga

SEQ ID NO: 289411 - RNA, 20 nt, Human
ucaagugugugagauggagg

SEQ ID NO: 289412 - RNA, 21 nt, Human
ucacucuuuccaggcuucauu

SEQ ID NO: 289413 - RNA, 19 nt, Human
ucccauagacuucuccugc

SEQ ID NO: 289414 - RNA, 21 nt, Human
uccccaucccuucaggccaca

SEQ ID NO: 289415 - RNA, 22 nt, Human
ugacagagacuguagaaaagga

SEQ ID NO: 289416 - RNA, 23 nt, Human
ugaggcaacaaccucacccagaa

SEQ ID NO: 289417 - RNA, 22 nt, Human
ugaguuuggcagggaagcugga

SEQ ID NO: 289418 - RNA, 24 nt, Human
ugcagguacuauuucuagaauccc

SEQ ID NO: 289419 - RNA, 23 nt, Human
ugccacagaaggaaggaaagcag

SEQ ID NO: 289420 - RNA, 19 nt, Human
ugcugcugguggcucuguc

SEQ ID NO: 289421 - RNA, 25 nt, Human
ugggaucagcauucaugaacaaacu

SEQ ID NO: 289422 - RNA, 24 nt, Human
uguagaaaaggagagggacuuucc

SEQ ID NO: 289423 - RNA, 20 nt, Human
ugucuagagguugaugucuc

SEQ ID NO: 289424 - RNA, 18 nt, Human
ugugugugugugugugug

SEQ ID NO: 289425 - RNA, 19 nt, Human
ugugugugugugugugugu

SEQ ID NO: 289426 - RNA, 24 nt, Human
uguucuuucucucaagguuauuua

SEQ ID NO: 289427 - RNA, 21 nt, Human
uucuccaacccccagccccaa

SEQ ID NO: 289428 - RNA, 22 nt, Human
uugaucuuguucuuucucucaa

SEQ ID NO: 289429 - RNA, 19 nt, Human
uuugcugcugguggcucug

SEQ ID NO: 289430 - RNA, 22 nt, Human
uuuuauguugcuacuccccauc

SEQ ID NO: 289431 - RNA, 20 nt, Human
aaaaagaaguauuuugaaaa

SEQ ID NO: 289432 - RNA, 20 nt, Human
aaaaccaauaaugaaaaaga

SEQ ID NO: 289433 - RNA, 24 nt, Human
aaaauguacuaccaagauaaaaua

SEQ ID NO: 289434 - RNA, 22 nt, Human
aaacaucuguuugcuagaaaua

SEQ ID NO: 289435 - RNA, 20 nt, Human
aaguauuuugaaaacaaaca

SEQ ID NO: 289436 - RNA, 24 nt, Human
acacaaaaccaaaaaggcauuauc

SEQ ID NO: 289437 - RNA, 20 nt, Human
accacacaaaaccaaaaagg

SEQ ID NO: 289438 - RNA, 23 nt, Human
agauaaaaggauaaugcuuuuuu

SEQ ID NO: 289439 - RNA, 23 nt, Human
auguauuaguugaauaccacaca

SEQ ID NO: 289440 - RNA, 25 nt, Human
cacacaaaaccaaaaaggcauuauc

SEQ ID NO: 289441 - RNA, 22 nt, Human
cagccggcggggcuuggaggag

SEQ ID NO: 289442 - RNA, 27 nt, Human
caucccaaaaguauuggaagguccuuc

SEQ ID NO: 289443 - RNA, 21 nt, Human
cauguaaacaaagacuaugua

SEQ ID NO: 289444 - RNA, 21 nt, Human
gaauaccacacaaaaccaaaa

SEQ ID NO: 289445 - RNA, 19 nt, Human
gcugccuccucuuccuucc

SEQ ID NO: 289446 - RNA, 19 nt, Human
ggauccggcucccaagugu

SEQ ID NO: 289447 - RNA, 20 nt, Human
ggccccgaggaugccaggag

SEQ ID NO: 289448 - RNA, 18 nt, Human
ggcggggcuuggaggagc

SEQ ID NO: 289449 - RNA, 21 nt, Human
ggggacgaggcguagggcugg

SEQ ID NO: 289450 - RNA, 22 nt, Human
ggucgggcucucaccucaggcc

SEQ ID NO: 289451 - RNA, 21 nt, Human
uaaaaccaauaaugaaaaaga

SEQ ID NO: 289452 - RNA, 19 nt, Human
uaaaaggauaaugcuuuuu

SEQ ID NO: 289453 - RNA, 21 nt, Human
uagcauugaccauuaacauuu

SEQ ID NO: 289454 - RNA, 21 nt, Human
uauuuugaaaacaaacaucug

SEQ ID NO: 289455 - RNA, 19 nt, Human
ucaacacauaaaagguggc

SEQ ID NO: 289456 - RNA, 24 nt, Human
ucaucaacacauaaaagguggcac

SEQ ID NO: 289457 - RNA, 28 nt, Human
ucccaaaggggccggucgggcucucacc

SEQ ID NO: 289458 - RNA, 23 nt, Human
ugagucaucaacacauaaaaggu

SEQ ID NO: 289459 - RNA, 18 nt, Human
uucaaucaguaguuuaaa

SEQ ID NO: 289460 - RNA, 22 nt, Human
aaaaugccccccucccccagga

SEQ ID NO: 289461 - RNA, 22 nt, Human
aaaaugccccccucccccagga

SEQ ID NO: 289462 - RNA, 21 nt, Human
aaacauccggcgcgcaccagc

SEQ ID NO: 289463 - RNA, 21 nt, Human
aaacauccggcgcgcaccagc

SEQ ID NO: 289464 - RNA, 18 nt, Human
aaagagccaacaaacagg

SEQ ID NO: 289465 - RNA, 18 nt, Human
aaagagccaacaaacagg

SEQ ID NO: 289466 - RNA, 23 nt, Human
aaagggagggacggugggggagg

SEQ ID NO: 289467 - RNA, 19 nt, Human
aagcagcagccuggugggc

SEQ ID NO: 289468 - RNA, 19 nt, Human
aagcagcagccuggugggc

SEQ ID NO: 289469 - RNA, 19 nt, Human
aagcccguuccuagagccg

SEQ ID NO: 289470 - RNA, 19 nt, Human
aagcccguuccuagagccg

SEQ ID NO: 289471 - RNA, 21 nt, Human
aagcgaaaacacggaauuaca

SEQ ID NO: 289472 - RNA, 22 nt, Human
aagcgaaaacacggaauuacag

SEQ ID NO: 289473 - RNA, 24 nt, Human
aagucguuuucuucuuaaucuccu

SEQ ID NO: 289474 - RNA, 24 nt, Human
aagucguuuucuucuuaaucuccu

SEQ ID NO: 289475 - RNA, 22 nt, Human
acacaccgucuuuccacaaagc

SEQ ID NO: 289476 - RNA, 22 nt, Human
acacaccgucuuuccacaaagc

SEQ ID NO: 289477 - RNA, 20 nt, Human
acagaaacauccggcgcgca

SEQ ID NO: 289478 - RNA, 20 nt, Human
acagaaacauccggcgcgca

SEQ ID NO: 289479 - RNA, 22 nt, Human
acagacaagagcgacagagacg

SEQ ID NO: 289480 - RNA, 22 nt, Human
acagacaagagcgacagagacg

SEQ ID NO: 289481 - RNA, 20 nt, Human
acagagaaagagccaacaaa

SEQ ID NO: 289482 - RNA, 20 nt, Human
acagagaaagagccaacaaa

SEQ ID NO: 289483 - RNA, 18 nt, Human
acccggaaggcgagggca

SEQ ID NO: 289484 - RNA, 18 nt, Human
acccggaaggcgagggca

SEQ ID NO: 289485 - RNA, 23 nt, Human
acuucaggacuugaggagaaaag

SEQ ID NO: 289486 - RNA, 18 nt, Human
agagaagcggagaggaga

SEQ ID NO: 289487 - RNA, 18 nt, Human
agagaagcggagaggaga

SEQ ID NO: 289488 - RNA, 25 nt, Human
agagacagagacagagggggagaga

SEQ ID NO: 289489 - RNA, 25 nt, Human
agagacagagacagagggggagaga

SEQ ID NO: 289490 - RNA, 23 nt, Human
agagccggacccccacaccccca

SEQ ID NO: 289491 - RNA, 23 nt, Human
agagccggacccccacaccccca

SEQ ID NO: 289492 - RNA, 21 nt, Human
agaggagagaggggcagaggg

SEQ ID NO: 289493 - RNA, 21 nt, Human
agaggagagaggggcagaggg

SEQ ID NO: 289494 - RNA, 19 nt, Human
agaggcgguggucggagag

SEQ ID NO: 289495 - RNA, 23 nt, Human
agcaggaggugccgggcccuggg

SEQ ID NO: 289496 - RNA, 23 nt, Human
agcaggaggugccgggcccuggg

SEQ ID NO: 289497 - RNA, 21 nt, Human
agcgacagagacggagagaga

SEQ ID NO: 289498 - RNA, 21 nt, Human
agcgacagagacggagagaga

SEQ ID NO: 289499 - RNA, 23 nt, Human
agcgacagagacggagagagaca

SEQ ID NO: 289500 - RNA, 23 nt, Human
agcgacagagacggagagagaca

SEQ ID NO: 289501 - RNA, 19 nt, Human
aggaaaaagcgaaaacacg

SEQ ID NO: 289502 - RNA, 19 nt, Human
aggaaaaagcgaaaacacg

SEQ ID NO: 289503 - RNA, 21 nt, Human
aggaaaaagcgaaaacacgga

SEQ ID NO: 289504 - RNA, 21 nt, Human
aggaaaaagcgaaaacacgga

SEQ ID NO: 289505 - RNA, 18 nt, Human
aggcagggccggcgggcg

SEQ ID NO: 289506 - RNA, 18 nt, Human
aggcagggccggcgggcg

SEQ ID NO: 289507 - RNA, 21 nt, Human
aggcggggaggggcggcaggc

SEQ ID NO: 289508 - RNA, 24 nt, Human
aggcggggaggggcggcaggcggg

SEQ ID NO: 289509 - RNA, 18 nt, Human
agggagagaggggcaggg

SEQ ID NO: 289510 - RNA, 19 nt, Human
agggaggaggaugcagggc

SEQ ID NO: 289511 - RNA, 19 nt, Human
agggaggaggaugcagggc

SEQ ID NO: 289512 - RNA, 18 nt, Human
agggagggacgguggggg

SEQ ID NO: 289513 - RNA, 21 nt, Human
aggggcagagggagagagggg

SEQ ID NO: 289514 - RNA, 21 nt, Human
aggggcagagggagagagggg

SEQ ID NO: 289515 - RNA, 24 nt, Human
aggggcagagggagagaggggcag

SEQ ID NO: 289516 - RNA, 18 nt, Human
agguaggggcaaggcagg

SEQ ID NO: 289517 - RNA, 18 nt, Human
agguaggggcaaggcagg

SEQ ID NO: 289518 - RNA, 20 nt, Human
agguaggggcaaggcagggc

SEQ ID NO: 289519 - RNA, 20 nt, Human
agguaggggcaaggcagggc

SEQ ID NO: 289520 - RNA, 21 nt, Human
aguuccugccggaggaggagg

SEQ ID NO: 289521 - RNA, 21 nt, Human
aguuccugccggaggaggagg

SEQ ID NO: 289522 - RNA, 22 nt, Human
auaaaaaaugccccccuccccc

SEQ ID NO: 289523 - RNA, 21 nt, Human
caaacaggccagaggagucac

SEQ ID NO: 289524 - RNA, 21 nt, Human
caaacaggccagaggagucac

SEQ ID NO: 289525 - RNA, 21 nt, Human
caaagcagcagccuggugggc

SEQ ID NO: 289526 - RNA, 21 nt, Human
caaagcagcagccuggugggc

SEQ ID NO: 289527 - RNA, 24 nt, Human
caaccuuggaaagaccugacgccc

SEQ ID NO: 289528 - RNA, 24 nt, Human
caaccuuggaaagaccugacgccc

SEQ ID NO: 289529 - RNA, 23 nt, Human
cacacaccgucuuuccacaaagc

SEQ ID NO: 289530 - RNA, 23 nt, Human
cacacaccgucuuuccacaaagc

SEQ ID NO: 289531 - RNA, 19 nt, Human
cacccccauuccaucuucu

SEQ ID NO: 289532 - RNA, 19 nt, Human
cacccccauuccaucuucu

SEQ ID NO: 289533 - RNA, 19 nt, Human
caccgucuuuccacaaagc

SEQ ID NO: 289534 - RNA, 19 nt, Human
caccgucuuuccacaaagc

SEQ ID NO: 289535 - RNA, 24 nt, Human
cagacagacaagagcgacagagac

SEQ ID NO: 289536 - RNA, 24 nt, Human
cagacagacaagagcgacagagac

SEQ ID NO: 289537 - RNA, 20 nt, Human
cagagaaagagccaacaaac

SEQ ID NO: 289538 - RNA, 22 nt, Human
cagagacagacagacaagagcg

SEQ ID NO: 289539 - RNA, 22 nt, Human
cagagacagacagacaagagcg

SEQ ID NO: 289540 - RNA, 22 nt, Human
cagcagaauggccccggggcgg

SEQ ID NO: 289541 - RNA, 25 nt, Human
cagcagaauggccccggggcggugg

SEQ ID NO: 289542 - RNA, 20 nt, Human
cagcaggaggugccgggccc

SEQ ID NO: 289543 - RNA, 20 nt, Human
cagcaggaggugccgggccc

SEQ ID NO: 289544 - RNA, 19 nt, Human
cagccccccacuuccaccc

SEQ ID NO: 289545 - RNA, 19 nt, Human
cagccccccacuuccaccc

SEQ ID NO: 289546 - RNA, 22 nt, Human
cagccccccacuuccaccccgg

SEQ ID NO: 289547 - RNA, 22 nt, Human
cagccccccacuuccaccccgg

SEQ ID NO: 289548 - RNA, 21 nt, Human
caggcggggcugggggcggug

SEQ ID NO: 289549 - RNA, 21 nt, Human
caggcggggcugggggcggug

SEQ ID NO: 289550 - RNA, 25 nt, Human
cccacuuccaccccgcagcagcuca

SEQ ID NO: 289551 - RNA, 25 nt, Human
cccacuuccaccccgcagcagcuca

SEQ ID NO: 289552 - RNA, 18 nt, Human
cccccacacccccauucc

SEQ ID NO: 289553 - RNA, 19 nt, Human
cccccacacccccauucca

SEQ ID NO: 289554 - RNA, 19 nt, Human
cccccacacccccauucca

SEQ ID NO: 289555 - RNA, 21 nt, Human
cccccacacccccauuccauc

SEQ ID NO: 289556 - RNA, 21 nt, Human
cccccacacccccauuccauc

SEQ ID NO: 289557 - RNA, 19 nt, Human
ccccccacuuccaccccgc

SEQ ID NO: 289558 - RNA, 19 nt, Human
ccccccacuuccaccccgc

SEQ ID NO: 289559 - RNA, 19 nt, Human
cccccccuucccccccagc

SEQ ID NO: 289560 - RNA, 19 nt, Human
cccccccuucccccccagc

SEQ ID NO: 289561 - RNA, 23 nt, Human
cccgcagcagcucagacgccagc

SEQ ID NO: 289562 - RNA, 23 nt, Human
cccgcagcagcucagacgccagc

SEQ ID NO: 289563 - RNA, 22 nt, Human
cccgggagagcguccgaugggg

SEQ ID NO: 289564 - RNA, 23 nt, Human
ccgaagcugucggccugaagcuu

SEQ ID NO: 289565 - RNA, 19 nt, Human
ccgcggggcgggggcgguc

SEQ ID NO: 289566 - RNA, 22 nt, Human
ccggcagauugagagucugugu

SEQ ID NO: 289567 - RNA, 21 nt, Human
ccuccggguuggccggagcuu

SEQ ID NO: 289568 - RNA, 27 nt, Human
cgaaggacuggcaggaggggaaacugg

SEQ ID NO: 289569 - RNA, 27 nt, Human
cgaaggacuggcaggaggggaaacugg

SEQ ID NO: 289570 - RNA, 23 nt, Human
cgagcugggccgaaucccccuca

SEQ ID NO: 289571 - RNA, 23 nt, Human
cgagcugggccgaaucccccuca

SEQ ID NO: 289572 - RNA, 19 nt, Human
cgcgcugcagcugcagcca

SEQ ID NO: 289573 - RNA, 19 nt, Human
cgcugcagcugcagccagg

SEQ ID NO: 289574 - RNA, 22 nt, Human
cggcagauugagagucuguguc

SEQ ID NO: 289575 - RNA, 19 nt, Human
cgggagcagcgcggcgccg

SEQ ID NO: 289576 - RNA, 20 nt, Human
cgggaggggagcgcgcggcc

SEQ ID NO: 289577 - RNA, 24 nt, Human
cgggggagggggcaucaaguaacu

SEQ ID NO: 289578 - RNA, 24 nt, Human
cgggggagggggcaucaaguaacu

SEQ ID NO: 289579 - RNA, 22 nt, Human
cguccgaggcgggugcccgggg

SEQ ID NO: 289580 - RNA, 22 nt, Human
cguccgaggcgggugcccgggg

SEQ ID NO: 289581 - RNA, 18 nt, Human
cuagagccggacccccac

SEQ ID NO: 289582 - RNA, 18 nt, Human
cuagagccggacccccac

SEQ ID NO: 289583 - RNA, 22 nt, Human
cugaagcuugaugugguccccg

SEQ ID NO: 289584 - RNA, 19 nt, Human
cugcugggccccccgaucc

SEQ ID NO: 289585 - RNA, 19 nt, Human
cugcugggccccccgaucc

SEQ ID NO: 289586 - RNA, 22 nt, Human
cugggggcggugggcccgggcc

SEQ ID NO: 289587 - RNA, 22 nt, Human
cugggggcggugggcccgggcc

SEQ ID NO: 289588 - RNA, 19 nt, Human
cuuccaccccgcagcagcu

SEQ ID NO: 289589 - RNA, 19 nt, Human
cuuccaccccgcagcagcu

SEQ ID NO: 289590 - RNA, 18 nt, Human
cuugaggagaaaagggag

SEQ ID NO: 289591 - RNA, 21 nt, Human
cuuggaaagaccugacgcccc

SEQ ID NO: 289592 - RNA, 21 nt, Human
cuuggaaagaccugacgcccc

SEQ ID NO: 289593 - RNA, 23 nt, Human
cuuggaaagaccugacgccccca

SEQ ID NO: 289594 - RNA, 19 nt, Human
cuuggcccagccccuccag

SEQ ID NO: 289595 - RNA, 19 nt, Human
cuuggcccagccccuccag

SEQ ID NO: 289596 - RNA, 20 nt, Human
gaaaaagcgaaaacacggaa

SEQ ID NO: 289597 - RNA, 20 nt, Human
gaaaaagcgaaaacacggaa

SEQ ID NO: 289598 - RNA, 23 nt, Human
gaauggccccggggcggugggcc

SEQ ID NO: 289599 - RNA, 19 nt, Human
gacggagagagacagagac

SEQ ID NO: 289600 - RNA, 19 nt, Human
gacggagagagacagagac

SEQ ID NO: 289601 - RNA, 26 nt, Human
gacuugaggagaaaagggagggacgg

SEQ ID NO: 289602 - RNA, 19 nt, Human
gagagcgccgcggggcggg

SEQ ID NO: 289603 - RNA, 19 nt, Human
gagcuugcaacugcaguag

SEQ ID NO: 289604 - RNA, 22 nt, Human
gaggaggaggcugggaggggau

SEQ ID NO: 289605 - RNA, 22 nt, Human
gaggaggaggcugggaggggau

SEQ ID NO: 289606 - RNA, 25 nt, Human
gaggggcagagggagagaggggcag

SEQ ID NO: 289607 - RNA, 25 nt, Human
gaggggcagagggagagaggggcag

SEQ ID NO: 289608 - RNA, 21 nt, Human
gaguacggcaggguggcuggc

SEQ ID NO: 289609 - RNA, 21 nt, Human
gaguacggcaggguggcuggc

SEQ ID NO: 289610 - RNA, 19 nt, Human
gcagauugagagucugugu

SEQ ID NO: 289611 - RNA, 20 nt, Human
gcagccuggugggcuuuugu

SEQ ID NO: 289612 - RNA, 20 nt, Human
gcagccuggugggcuuuugu

SEQ ID NO: 289613 - RNA, 24 nt, Human
gcaguccaggcaggcggggagggg

SEQ ID NO: 289614 - RNA, 24 nt, Human
gcaguccaggcaggcggggagggg

SEQ ID NO: 289615 - RNA, 22 nt, Human
gcggcaggcggggcugggggcg

SEQ ID NO: 289616 - RNA, 21 nt, Human
gcgggcuucggggcuggcuug

SEQ ID NO: 289617 - RNA, 21 nt, Human
gcgggcuucggggcuggcuug

SEQ ID NO: 289618 - RNA, 25 nt, Human
gcugcagccagggcugaagcugggc

SEQ ID NO: 289619 - RNA, 21 nt, Human
ggaacuaggcaggccaggagg

SEQ ID NO: 289620 - RNA, 21 nt, Human
ggaacuaggcaggccaggagg

SEQ ID NO: 289621 - RNA, 24 nt, Human
ggaauuacagagaaagagccaaca

SEQ ID NO: 289622 - RNA, 24 nt, Human
ggaauuacagagaaagagccaaca

SEQ ID NO: 289623 - RNA, 20 nt, Human
ggagaggagagaggggcaga

SEQ ID NO: 289624 - RNA, 20 nt, Human
ggagaggagagaggggcaga

SEQ ID NO: 289625 - RNA, 25 nt, Human
ggagcagcgcggcgccgccgccgug

SEQ ID NO: 289626 - RNA, 19 nt, Human
ggaggaggaggcugggagg

SEQ ID NO: 289627 - RNA, 19 nt, Human
ggaggaggaggcugggagg

SEQ ID NO: 289628 - RNA, 25 nt, Human
ggaggaggaugcagggcgucaaggg

SEQ ID NO: 289629 - RNA, 25 nt, Human
ggaggaggaugcagggcgucaaggg

SEQ ID NO: 289630 - RNA, 21 nt, Human
ggcagauugagagucuguguc

SEQ ID NO: 289631 - RNA, 19 nt, Human
ggccccggggcggugggcc

SEQ ID NO: 289632 - RNA, 24 nt, Human
ggcggggaggggcggcaggcgggg

SEQ ID NO: 289633 - RNA, 24 nt, Human
ggcggggaggggcggcaggcgggg

SEQ ID NO: 289634 - RNA, 25 nt, Human
ggcugggggcggugggcccgggccu

SEQ ID NO: 289635 - RNA, 25 nt, Human
ggcugggggcggugggcccgggccu

SEQ ID NO: 289636 - RNA, 19 nt, Human
gggaaacugggaggccagc

SEQ ID NO: 289637 - RNA, 19 nt, Human
gggaaacugggaggccagc

SEQ ID NO: 289638 - RNA, 23 nt, Human
gggaggcagaggagcgggagcag

SEQ ID NO: 289639 - RNA, 25 nt, Human
gggcggcaggcggggcugggggcga

SEQ ID NO: 289640 - RNA, 22 nt, Human
gggcggggcggagggggagggg

SEQ ID NO: 289641 - RNA, 22 nt, Human
gggcggggcggagggggagggg

SEQ ID NO: 289642 - RNA, 18 nt, Human
gggcucggggcugggcgg

SEQ ID NO: 289643 - RNA, 21 nt, Human
gggcugaagcugggcggggga

SEQ ID NO: 289644 - RNA, 22 nt, Human
ggggagcgcgcggccaggcccc

SEQ ID NO: 289645 - RNA, 22 nt, Human
ggggcgcccgggggcggggggc

SEQ ID NO: 289646 - RNA, 18 nt, Human
ggggcggagggggagggg

SEQ ID NO: 289647 - RNA, 18 nt, Human
ggggcggagggggagggg

SEQ ID NO: 289648 - RNA, 19 nt, Human
gggggcgcauggcucgcgc

SEQ ID NO: 289649 - RNA, 20 nt, Human
gggggcggugggcccgggcc

SEQ ID NO: 289650 - RNA, 20 nt, Human
gggggcggugggcccgggcc

SEQ ID NO: 289651 - RNA, 20 nt, Human
ggucagcagaauggccccgg

SEQ ID NO: 289652 - RNA, 22 nt, Human
ggugaggcuggggcgguggccg

SEQ ID NO: 289653 - RNA, 22 nt, Human
ggugaggcuggggcgguggccg

SEQ ID NO: 289654 - RNA, 21 nt, Human
guaacauaaaaaaugcccccc

SEQ ID NO: 289655 - RNA, 21 nt, Human
guaacauaaaaaaugcccccc

SEQ ID NO: 289656 - RNA, 21 nt, Human
gucccgccccgcggcuccacc

SEQ ID NO: 289657 - RNA, 21 nt, Human
gucccgccccgcggcuccacc

SEQ ID NO: 289658 - RNA, 24 nt, Human
gucccgggagagcguccgaugggg

SEQ ID NO: 289659 - RNA, 21 nt, Human
uaaaaaaugccccccuccccc

SEQ ID NO: 289660 - RNA, 21 nt, Human
uaaaaaaugccccccuccccc

SEQ ID NO: 289661 - RNA, 22 nt, Human
uacagagaaagagccaacaaac

SEQ ID NO: 289662 - RNA, 22 nt, Human
ucaaguaacugcuggaggaaga

SEQ ID NO: 289663 - RNA, 22 nt, Human
ucaaguaacugcuggaggaaga

SEQ ID NO: 289664 - RNA, 20 nt, Human
ucagaaccgguucuuaccac

SEQ ID NO: 289665 - RNA, 20 nt, Human
ucagaaccgguucuuaccac

SEQ ID NO: 289666 - RNA, 19 nt, Human
ucaggacuugaggagaaaa

SEQ ID NO: 289667 - RNA, 20 nt, Human
ucaggacuugaggagaaaag

SEQ ID NO: 289668 - RNA, 23 nt, Human
uccaccccgcagcagcucagacg

SEQ ID NO: 289669 - RNA, 23 nt, Human
uccaccccgcagcagcucagacg

SEQ ID NO: 289670 - RNA, 19 nt, Human
uccaggcaggcggggaggg

SEQ ID NO: 289671 - RNA, 19 nt, Human
uccaggcaggcggggaggg

SEQ ID NO: 289672 - RNA, 20 nt, Human
uccaggcaggcggggagggg

SEQ ID NO: 289673 - RNA, 20 nt, Human
uccaggcaggcggggagggg

SEQ ID NO: 289674 - RNA, 18 nt, Human
ucccccccuuccccccca

SEQ ID NO: 289675 - RNA, 18 nt, Human
ucccccccuuccccccca

SEQ ID NO: 289676 - RNA, 21 nt, Human
uccgcagucuauggaaacugg

SEQ ID NO: 289677 - RNA, 21 nt, Human
uccgcagucuauggaaacugg

SEQ ID NO: 289678 - RNA, 24 nt, Human
ucugggacagggcacacccggaag

SEQ ID NO: 289679 - RNA, 24 nt, Human
ucugggacagggcacacccggaag

SEQ ID NO: 289680 - RNA, 19 nt, Human
ucugugucgggggaggggg

SEQ ID NO: 289681 - RNA, 19 nt, Human
ucugugucgggggaggggg

SEQ ID NO: 289682 - RNA, 18 nt, Human
ugcgggaggggagcgcgc

SEQ ID NO: 289683 - RNA, 20 nt, Human
ugcggggcgcccgggggcgg

SEQ ID NO: 289684 - RNA, 21 nt, Human
uggaaagaccugacgccccca

SEQ ID NO: 289685 - RNA, 19 nt, Human
uggaagagacgcugaggua

SEQ ID NO: 289686 - RNA, 19 nt, Human
uggaagagacgcugaggua

SEQ ID NO: 289687 - RNA, 21 nt, Human
uggaggccgggacgagcuggg

SEQ ID NO: 289688 - RNA, 21 nt, Human
uggaggccgggacgagcuggg

SEQ ID NO: 289689 - RNA, 22 nt, Human
uggcacugggggaaaagaauuu

SEQ ID NO: 289690 - RNA, 22 nt, Human
uggcacugggggaaaagaauuu

SEQ ID NO: 289691 - RNA, 18 nt, Human
uggcagagaaguagcaau

SEQ ID NO: 289692 - RNA, 23 nt, Human
uggcagagaaguagcaaucccgg

SEQ ID NO: 289693 - RNA, 28 nt, Human
uggcagagaaguagcaaucccggggaug

SEQ ID NO: 289694 - RNA, 20 nt, Human
uggcaggaggggaaacuggg

SEQ ID NO: 289695 - RNA, 20 nt, Human
uggcaggaggggaaacuggg

SEQ ID NO: 289696 - RNA, 26 nt, Human
uggcaggaggggaaacugggaggcca

SEQ ID NO: 289697 - RNA, 26 nt, Human
uggcaggaggggaaacugggaggcca

SEQ ID NO: 289698 - RNA, 21 nt, Human
uggcgggcuucggggcuggcu

SEQ ID NO: 289699 - RNA, 21 nt, Human
uggcgggcuucggggcuggcu

SEQ ID NO: 289700 - RNA, 18 nt, Human
uggcucgcgcugcagcug

SEQ ID NO: 289701 - RNA, 21 nt, Human
ugggaggggaugggaggagug

SEQ ID NO: 289702 - RNA, 21 nt, Human
ugggaggggaugggaggagug

SEQ ID NO: 289703 - RNA, 23 nt, Human
ugggauggggugaggcuggggcg

SEQ ID NO: 289704 - RNA, 23 nt, Human
ugggauggggugaggcuggggcg

SEQ ID NO: 289705 - RNA, 27 nt, Human
ugggccccccgauccuugggucccaag

SEQ ID NO: 289706 - RNA, 27 nt, Human
ugggccccccgauccuugggucccaag

SEQ ID NO: 289707 - RNA, 21 nt, Human
uggggcugcgagucagggagg

SEQ ID NO: 289708 - RNA, 21 nt, Human
uggggcugcgagucagggagg

SEQ ID NO: 289709 - RNA, 20 nt, Human
ugggggagggaggaugagug

SEQ ID NO: 289710 - RNA, 21 nt, Human
uggggucagacggggacgaug

SEQ ID NO: 289711 - RNA, 20 nt, Human
ugucccccccuuccccccca

SEQ ID NO: 289712 - RNA, 20 nt, Human
ugucccccccuuccccccca

SEQ ID NO: 289713 - RNA, 22 nt, Human
uguguuguuuuguuccuuuuug

SEQ ID NO: 289714 - RNA, 22 nt, Human
uguguuguuuuguuccuuuuug

SEQ ID NO: 289715 - RNA, 21 nt, Human
uuaaugggcguguagcugugu

SEQ ID NO: 289716 - RNA, 21 nt, Human
uuaaugggcguguagcugugu

SEQ ID NO: 289717 - RNA, 20 nt, Human
uuccuagagccggaccccca

SEQ ID NO: 289718 - RNA, 20 nt, Human
uuccuagagccggaccccca

SEQ ID NO: 289719 - RNA, 21 nt, Human
uugcgggggucgugggauggg

SEQ ID NO: 289720 - RNA, 21 nt, Human
uugcgggggucgugggauggg

SEQ ID NO: 289721 - RNA, 20 nt, Human
uuguuuuguuccuuuuugca

SEQ ID NO: 289722 - RNA, 20 nt, Human
uuguuuuguuccuuuuugca

SEQ ID NO: 289723 - RNA, 21 nt, Human
aaaacagaaaaacuaagcaga

SEQ ID NO: 289724 - RNA, 22 nt, Human
aaaacagaaaaacuaagcagaa

SEQ ID NO: 289725 - RNA, 27 nt, Human
aaagaaagauuuacaaaacagaaaaac

SEQ ID NO: 289726 - RNA, 24 nt, Human
acaaaacagaaaaacuaagcagaa

SEQ ID NO: 289727 - RNA, 21 nt, Human
acaacagagcacaauucacag

SEQ ID NO: 289728 - RNA, 23 nt, Human
acccucuaucccaggcccuacaa

SEQ ID NO: 289729 - RNA, 20 nt, Human
acggaaaggcgagugcggcg

SEQ ID NO: 289730 - RNA, 18 nt, Human
agagcuuccccugccccc

SEQ ID NO: 289731 - RNA, 18 nt, Human
agaguacucucucucucc

SEQ ID NO: 289732 - RNA, 18 nt, Human
aggcagccaauguggggg

SEQ ID NO: 289733 - RNA, 19 nt, Human
aggcagccaaugugggggc

SEQ ID NO: 289734 - RNA, 19 nt, Human
aguacccucuaucccaggc

SEQ ID NO: 289735 - RNA, 25 nt, Human
auauuuauaaggcagccaauguggg

SEQ ID NO: 289736 - RNA, 25 nt, Human
auauuuauaaggcagccaauguggg

SEQ ID NO: 289737 - RNA, 20 nt, Human
augucguuacucaggcgcag

SEQ ID NO: 289738 - RNA, 19 nt, Human
caaaacagaaaaacuaagc

SEQ ID NO: 289739 - RNA, 19 nt, Human
cacacagacauauuuauaa

SEQ ID NO: 289740 - RNA, 22 nt, Human
cacacagacauauuuauaaggc

SEQ ID NO: 289741 - RNA, 21 nt, Human
cacaguucuagaaucccaggg

SEQ ID NO: 289742 - RNA, 22 nt, Human
cacaguucuagaaucccagggg

SEQ ID NO: 289743 - RNA, 25 nt, Human
cagagcacaauucacaguucuagaa

SEQ ID NO: 289744 - RNA, 25 nt, Human
ccaaugugggggcaauuuuggaggg

SEQ ID NO: 289745 - RNA, 25 nt, Human
ccaaugugggggcaauuuuggaggg

SEQ ID NO: 289746 - RNA, 22 nt, Human
ccccaaaacggcuggagagaga

SEQ ID NO: 289747 - RNA, 21 nt, Human
ccccuccccaaaacggcugga

SEQ ID NO: 289748 - RNA, 23 nt, Human
gagcguggagagccccuccccaa

SEQ ID NO: 289749 - RNA, 19 nt, Human
gagugcggcgcggaugacc

SEQ ID NO: 289750 - RNA, 23 nt, Human
ggagcguggagagccccucccca

SEQ ID NO: 289751 - RNA, 25 nt, Human
guacucucucucuccuuuaaugcga

SEQ ID NO: 289752 - RNA, 24 nt, Human
uaauggcaacagagugagagcuuc

SEQ ID NO: 289753 - RNA, 22 nt, Human
uacaacagagcacaauucacag

SEQ ID NO: 289754 - RNA, 29 nt, Human
uacucucucucuccuuuaaugcgaggaaa

SEQ ID NO: 289755 - RNA, 19 nt, Human
uccggagcguggagagccc

SEQ ID NO: 289756 - RNA, 19 nt, Human
ugaagauucaaguacccuc

SEQ ID NO: 289757 - RNA, 23 nt, Human
ugguaagaaagaaagauuuacaa

SEQ ID NO: 289758 - RNA, 30 nt, Human
uuaauggcaacagagugagagcuuccccuu

SEQ ID NO: 289759 - RNA, 24 nt, Human
aaguuucuuguuuuuuggggaugc

SEQ ID NO: 289760 - RNA, 21 nt, Human
aaucacaggaaggaggaagga

SEQ ID NO: 289761 - RNA, 26 nt, Human
acacauacauacauaauacacauaua

SEQ ID NO: 289762 - RNA, 28 nt, Human
acgcaugcacacauacauacauaauaca

SEQ ID NO: 289763 - RNA, 23 nt, Human
agacugcauccuugcugccccca

SEQ ID NO: 289764 - RNA, 19 nt, Human
aggcaucgaggcagggcca

SEQ ID NO: 289765 - RNA, 27 nt, Human
auaucaauguguguguguguguguggu

SEQ ID NO: 289766 - RNA, 23 nt, Human
augcacacauacauacauaauac

SEQ ID NO: 289767 - RNA, 19 nt, Human
augugugugugugugugug

SEQ ID NO: 289768 - RNA, 22 nt, Human
caaaauacauaugcaaauacaa

SEQ ID NO: 289769 - RNA, 20 nt, Human
caaugugugugugugugugu

SEQ ID NO: 289770 - RNA, 20 nt, Human
cacaggagggagcaaucaca

SEQ ID NO: 289771 - RNA, 19 nt, Human
cacucuguuugcugcuaug

SEQ ID NO: 289772 - RNA, 21 nt, Human
cagccccuccaaucaggugau

SEQ ID NO: 289773 - RNA, 18 nt, Human
caggugaugcgccagaga

SEQ ID NO: 289774 - RNA, 19 nt, Human
cauacauaauacacauaua

SEQ ID NO: 289775 - RNA, 23 nt, Human
cauauagaugcauacauagagua

SEQ ID NO: 289776 - RNA, 20 nt, Human
cauaugacaaaauacauaug

SEQ ID NO: 289777 - RNA, 19 nt, Human
caucgaggcagggccaggc

SEQ ID NO: 289778 - RNA, 18 nt, Human
caucuccuucccacuccu

SEQ ID NO: 289779 - RNA, 21 nt, Human
caucuccuucccacuccugcc

SEQ ID NO: 289780 - RNA, 22 nt, Human
ccaccaccgagugcauccucuc

SEQ ID NO: 289781 - RNA, 18 nt, Human
ccaccucucccacugccc

SEQ ID NO: 289782 - RNA, 20 nt, Human
ccaccucucccacugcccug

SEQ ID NO: 289783 - RNA, 20 nt, Human
cccacugcccugcccgccug

SEQ ID NO: 289784 - RNA, 18 nt, Human
ccuccagccuggcuuccc

SEQ ID NO: 289785 - RNA, 23 nt, Human
ccucucccacugcccugcccgcc

SEQ ID NO: 289786 - RNA, 22 nt, Human
ccuggcuucccaccaccgagug

SEQ ID NO: 289787 - RNA, 22 nt, Human
cgaggcagggccaggcaacguc

SEQ ID NO: 289788 - RNA, 25 nt, Human
cgcacgcaugcacacauacauacau

SEQ ID NO: 289789 - RNA, 23 nt, Human
gaggcagggccaggcaacgucca

SEQ ID NO: 289790 - RNA, 22 nt, Human
gcaaauacaaaauacauaugac

SEQ ID NO: 289791 - RNA, 21 nt, Human
gcaaauacaaaauacauaugc

SEQ ID NO: 289792 - RNA, 22 nt, Human
gcaggacgguaaggacaauggg

SEQ ID NO: 289793 - RNA, 19 nt, Human
gccagagaggcaucgaggc

SEQ ID NO: 289794 - RNA, 24 nt, Human
ggagacugcauccuugcugccccc

SEQ ID NO: 289795 - RNA, 22 nt, Human
guagauacauagauguaaauaa

SEQ ID NO: 289796 - RNA, 23 nt, Human
gucacucaggccccuccagccug

SEQ ID NO: 289797 - RNA, 30 nt, Human
gugugugugugcgcgcacgcaugcacacag

SEQ ID NO: 289798 - RNA, 18 nt, Human
uaaaaugccaugauauaa

SEQ ID NO: 289799 - RNA, 25 nt, Human
uacauacauaauacacauauagaug

SEQ ID NO: 289800 - RNA, 22 nt, Human
uagggaaaacaugauggacaac

SEQ ID NO: 289801 - RNA, 24 nt, Human
uaugcaaauacaaaauacauaugg

SEQ ID NO: 289802 - RNA, 24 nt, Human
uaugcaaauacaaaauacauaugg

SEQ ID NO: 289803 - RNA, 22 nt, Human
uccagccuggcuucccaccacc

SEQ ID NO: 289804 - RNA, 22 nt, Human
ucccugggcgugagacagaggu

SEQ ID NO: 289805 - RNA, 26 nt, Human
ucgaggcagggccaggcaacguccac

SEQ ID NO: 289806 - RNA, 20 nt, Human
ugaaaaauggcauuucacuc

SEQ ID NO: 289807 - RNA, 27 nt, Human
ugauauaauaucaaugugugugugugu

SEQ ID NO: 289808 - RNA, 19 nt, Human
ugauggacaacagaacuac

SEQ ID NO: 289809 - RNA, 26 nt, Human
ugccuacauacaugcauagauuagau

SEQ ID NO: 289810 - RNA, 25 nt, Human
ugcgcgcacgcaugcacacauacau

SEQ ID NO: 289811 - RNA, 24 nt, Human
uggaagauuuaggaauaaaaugcc

SEQ ID NO: 289812 - RNA, 21 nt, Human
ugggagacugcauccuugcug

SEQ ID NO: 289813 - RNA, 20 nt, Human
ugugagaagugggugggugu

SEQ ID NO: 289814 - RNA, 30 nt, Human
ugugugugcgcgcacgcaugcacacauaca

SEQ ID NO: 289815 - RNA, 19 nt, Human
ugugugugugugcgcgcac

SEQ ID NO: 289816 - RNA, 23 nt, Human
uuacaguaaauuuucuuagaugu

SEQ ID NO: 289817 - RNA, 18 nt, Human
uuaccagccccuccaauc

SEQ ID NO: 289818 - RNA, 22 nt, Human
uuguuuagauacauguauugcc

SEQ ID NO: 289819 - RNA, 18 nt, Human
uuucuuguuuuuugggga

SEQ ID NO: 289820 - RNA, 18 nt, Human
uuuggggaugcaugcugg

SEQ ID NO: 289821 - RNA, 21 nt, Human
aaaaagcguccgaaggcaccg

SEQ ID NO: 289822 - RNA, 18 nt, Human
aaaccaggacaucucccc

SEQ ID NO: 289823 - RNA, 22 nt, Human
aagaggggagcuucaggcaagu

SEQ ID NO: 289824 - RNA, 22 nt, Human
acaagcauccagaaguccaacg

SEQ ID NO: 289825 - RNA, 25 nt, Human
acacagcagcuccucacugcucucc

SEQ ID NO: 289826 - RNA, 18 nt, Human
acccagggcagagaggau

SEQ ID NO: 289827 - RNA, 21 nt, Human
acccugcugcaccaaggcagg

SEQ ID NO: 289828 - RNA, 25 nt, Human
acgccgcgcccccagcgcgccgccc

SEQ ID NO: 289829 - RNA, 19 nt, Human
acuaaagagcuucucgcca

SEQ ID NO: 289830 - RNA, 22 nt, Human
agaaauagacaagcauccagaa

SEQ ID NO: 289831 - RNA, 21 nt, Human
agagacuaugcaaggaauuaa

SEQ ID NO: 289832 - RNA, 21 nt, Human
agagucccuggaggaagagag

SEQ ID NO: 289833 - RNA, 22 nt, Human
agaugcaucauggguggagcag

SEQ ID NO: 289834 - RNA, 22 nt, Human
agcaggaggcuggggcccaagg

SEQ ID NO: 289835 - RNA, 18 nt, Human
agcugaucacugagcuga

SEQ ID NO: 289836 - RNA, 21 nt, Human
aggcaagugggggaugcuggg

SEQ ID NO: 289837 - RNA, 19 nt, Human
aggcagccaaggcucaaag

SEQ ID NO: 289838 - RNA, 25 nt, Human
aggcagccaaggcucaaagagguga

SEQ ID NO: 289839 - RNA, 18 nt, Human
aggcaggcugggcugggg

SEQ ID NO: 289840 - RNA, 20 nt, Human
aggcaggcugggcuggggcu

SEQ ID NO: 289841 - RNA, 22 nt, Human
agggccccagagucccuggagg

SEQ ID NO: 289842 - RNA, 22 nt, Human
auggcagguguccgaagugacc

SEQ ID NO: 289843 - RNA, 23 nt, Human
caagccuuccgcucccccgccga

SEQ ID NO: 289844 - RNA, 20 nt, Human
cacacugccggcccggagcg

SEQ ID NO: 289845 - RNA, 22 nt, Human
cacagcaaagacauguggccag

SEQ ID NO: 289846 - RNA, 27 nt, Human
cacauucaaaguccacaauguaaucaa

SEQ ID NO: 289847 - RNA, 19 nt, Human
cacccagggcagagaggau

SEQ ID NO: 289848 - RNA, 19 nt, Human
cacccccaugucaaaauca

SEQ ID NO: 289849 - RNA, 19 nt, Human
caccggaacaggcuugccc

SEQ ID NO: 289850 - RNA, 19 nt, Human
cacugcucuccugccccuc

SEQ ID NO: 289851 - RNA, 21 nt, Human
cacuugcugggguccuggagg

SEQ ID NO: 289852 - RNA, 22 nt, Human
cacuugcugggguccuggaggg

SEQ ID NO: 289853 - RNA, 23 nt, Human
cacuugcugggguccuggagggu

SEQ ID NO: 289854 - RNA, 22 nt, Human
cagcagcuccucacugcucucc

SEQ ID NO: 289855 - RNA, 21 nt, Human
cagcauccuccaucuugagga

SEQ ID NO: 289856 - RNA, 24 nt, Human
cagccccagcaccuccaugcccag

SEQ ID NO: 289857 - RNA, 20 nt, Human
cagcugccugcuaagcucca

SEQ ID NO: 289858 - RNA, 24 nt, Human
caggaccaggacaagaccugccug

SEQ ID NO: 289859 - RNA, 20 nt, Human
cagggcagagaggaugcucu

SEQ ID NO: 289860 - RNA, 23 nt, Human
cauggcagguguccgaagugacc

SEQ ID NO: 289861 - RNA, 23 nt, Human
caugucaaaaucacucccagguc

SEQ ID NO: 289862 - RNA, 21 nt, Human
cauucaaaguccacaauguaa

SEQ ID NO: 289863 - RNA, 19 nt, Human
ccagacaguuuucuuugag

SEQ ID NO: 289864 - RNA, 18 nt, Human
ccagcccagugagacucc

SEQ ID NO: 289865 - RNA, 22 nt, Human
cccacagcaaagacauguggcc

SEQ ID NO: 289866 - RNA, 27 nt, Human
cccacagcaaagacauguggccaggac

SEQ ID NO: 289867 - RNA, 19 nt, Human
cccagacacgccgcgcccc

SEQ ID NO: 289868 - RNA, 19 nt, Human
cccagcgcgccgccccaca

SEQ ID NO: 289869 - RNA, 19 nt, Human
cccaucugcuugcuuggaa

SEQ ID NO: 289870 - RNA, 18 nt, Human
ccccaaagugugcuccuc

SEQ ID NO: 289871 - RNA, 19 nt, Human
ccccacacugccggcccgg

SEQ ID NO: 289872 - RNA, 20 nt, Human
ccccacacugccggcccgga

SEQ ID NO: 289873 - RNA, 19 nt, Human
ccccagcaccuccaugccc

SEQ ID NO: 289874 - RNA, 26 nt, Human
ccccagcaccuccaugcccagcugcc

SEQ ID NO: 289875 - RNA, 27 nt, Human
ccccagccccagcaccuccaugcccag

SEQ ID NO: 289876 - RNA, 27 nt, Human
cccccucucaucacugucauucagccc

SEQ ID NO: 289877 - RNA, 19 nt, Human
cccugcaugguccuggccu

SEQ ID NO: 289878 - RNA, 19 nt, Human
cccuggaggaagagaggaa

SEQ ID NO: 289879 - RNA, 18 nt, Human
cccuuggccguggcccug

SEQ ID NO: 289880 - RNA, 18 nt, Human
ccggugaugcaccaagag

SEQ ID NO: 289881 - RNA, 20 nt, Human
ccuacagaugacccugcugc

SEQ ID NO: 289882 - RNA, 22 nt, Human
ccucaggaggccuuccucuguc

SEQ ID NO: 289883 - RNA, 19 nt, Human
ccucaggccccuccuuggc

SEQ ID NO: 289884 - RNA, 23 nt, Human
ccugaccaucgcggccccuuaga

SEQ ID NO: 289885 - RNA, 21 nt, Human
ccugcagcacaaccagcccag

SEQ ID NO: 289886 - RNA, 23 nt, Human
ccugccccagaugauccucucac

SEQ ID NO: 289887 - RNA, 18 nt, Human
ccugccccucccucagga

SEQ ID NO: 289888 - RNA, 19 nt, Human
ccugcgucccauccagccc

SEQ ID NO: 289889 - RNA, 20 nt, Human
ccuuggccguggcccugacc

SEQ ID NO: 289890 - RNA, 25 nt, Human
ccuuuuuuuuucuuuuuuuuuuuuu

SEQ ID NO: 289891 - RNA, 22 nt, Human
cgaagugaccugaaccugggca

SEQ ID NO: 289892 - RNA, 22 nt, Human
cgccaacaucacaagauguccc

SEQ ID NO: 289893 - RNA, 22 nt, Human
cgccgccccacacugccggccc

SEQ ID NO: 289894 - RNA, 24 nt, Human
cgccgcgcccccagcgcgccgccc

SEQ ID NO: 289895 - RNA, 18 nt, Human
cgcgccgccccacacugc

SEQ ID NO: 289896 - RNA, 19 nt, Human
cgcggccgggccugcucag

SEQ ID NO: 289897 - RNA, 26 nt, Human
cggaacaggcuugcccagaauccacu

SEQ ID NO: 289898 - RNA, 21 nt, Human
cucacugcucuccugccccuc

SEQ ID NO: 289899 - RNA, 25 nt, Human
cucaggaggccuuccucuguccccc

SEQ ID NO: 289900 - RNA, 18 nt, Human
cucaggugcccaccccca

SEQ ID NO: 289901 - RNA, 18 nt, Human
cuccuucccaggcugggg

SEQ ID NO: 289902 - RNA, 23 nt, Human
cucuccuucccaggcuggggugg

SEQ ID NO: 289903 - RNA, 21 nt, Human
cugaccacccuagcccacagu

SEQ ID NO: 289904 - RNA, 19 nt, Human
cugcagcacaaccagccca

SEQ ID NO: 289905 - RNA, 28 nt, Human
cugccccagaugauccucucacagcccc

SEQ ID NO: 289906 - RNA, 18 nt, Human
cuggaggacaggcaggcu

SEQ ID NO: 289907 - RNA, 27 nt, Human
cuuggccguggcccugaccaucgcggc

SEQ ID NO: 289908 - RNA, 23 nt, Human
gaaauggaggcaggaaaccagga

SEQ ID NO: 289909 - RNA, 18 nt, Human
gacagggaaaaguuucca

SEQ ID NO: 289910 - RNA, 24 nt, Human
gaccugccuggccugcugauccca

SEQ ID NO: 289911 - RNA, 24 nt, Human
gagccugcagcacaaccagcccag

SEQ ID NO: 289912 - RNA, 19 nt, Human
gaggaugcucugccauagg

SEQ ID NO: 289913 - RNA, 21 nt, Human
gaguucuccaagcucccucuc

SEQ ID NO: 289914 - RNA, 24 nt, Human
gcacccccaugucaaaaucacucc

SEQ ID NO: 289915 - RNA, 19 nt, Human
gccaagcccccucucauca

SEQ ID NO: 289916 - RNA, 23 nt, Human
gcccccucucaucacugucauuc

SEQ ID NO: 289917 - RNA, 21 nt, Human
gcccuggcucucugccauccu

SEQ ID NO: 289918 - RNA, 20 nt, Human
gcccuuggccguggcccuga

SEQ ID NO: 289919 - RNA, 21 nt, Human
gccucagggggagccugcagc

SEQ ID NO: 289920 - RNA, 18 nt, Human
gccucaguuucccacaag

SEQ ID NO: 289921 - RNA, 19 nt, Human
gcgcgccgccccacacugc

SEQ ID NO: 289922 - RNA, 20 nt, Human
gcugaagcaacaaaagcaag

SEQ ID NO: 289923 - RNA, 18 nt, Human
gcuggggcccaagggcag

SEQ ID NO: 289924 - RNA, 22 nt, Human
ggagcuucaggcaaguggggga

SEQ ID NO: 289925 - RNA, 21 nt, Human
ggaggcuggggcccaagggcc

SEQ ID NO: 289926 - RNA, 21 nt, Human
ggcccggagcgaggaaagggu

SEQ ID NO: 289927 - RNA, 22 nt, Human
ggccucagggggagccugcagc

SEQ ID NO: 289928 - RNA, 19 nt, Human
ggcuggggcccaagggcag

SEQ ID NO: 289929 - RNA, 19 nt, Human
gggagggucugccccgaga

SEQ ID NO: 289930 - RNA, 20 nt, Human
gggaguagggagagccucag

SEQ ID NO: 289931 - RNA, 21 nt, Human
ggguggcccuacagaugaccc

SEQ ID NO: 289932 - RNA, 23 nt, Human
gggugugggggaaaguccucugu

SEQ ID NO: 289933 - RNA, 23 nt, Human
gguccuggagggugggugaagug

SEQ ID NO: 289934 - RNA, 23 nt, Human
gucccauccagcccucacauuca

SEQ ID NO: 289935 - RNA, 21 nt, Human
guccuggccuuccccaagcug

SEQ ID NO: 289936 - RNA, 20 nt, Human
gugccaggggccgcucacag

SEQ ID NO: 289937 - RNA, 21 nt, Human
uacaugggugcugcugaagca

SEQ ID NO: 289938 - RNA, 19 nt, Human
uaggcaucugccccagccc

SEQ ID NO: 289939 - RNA, 24 nt, Human
uaggugccaucaguguuuggugcc

SEQ ID NO: 289940 - RNA, 20 nt, Human
ucagaaaacaccguuccagg

SEQ ID NO: 289941 - RNA, 19 nt, Human
ucaggcccacagaaaagca

SEQ ID NO: 289942 - RNA, 21 nt, Human
uccacgaggacggggaggguc

SEQ ID NO: 289943 - RNA, 22 nt, Human
uccacuugcugggguccuggag

SEQ ID NO: 289944 - RNA, 23 nt, Human
ucccaaguccagucucucucugc

SEQ ID NO: 289945 - RNA, 21 nt, Human
ucccaggucacacagcagcuc

SEQ ID NO: 289946 - RNA, 22 nt, Human
uccccaagcugggccucaguuu

SEQ ID NO: 289947 - RNA, 21 nt, Human
uccccagacacgccgcgcccc

SEQ ID NO: 289948 - RNA, 23 nt, Human
uccccagacacgccgcgccccca

SEQ ID NO: 289949 - RNA, 27 nt, Human
ucccccagaucuucccugcuggcuucc

SEQ ID NO: 289950 - RNA, 19 nt, Human
ucccucaggaggccuuccu

SEQ ID NO: 289951 - RNA, 21 nt, Human
ucccucaggaggccuuccucu

SEQ ID NO: 289952 - RNA, 19 nt, Human
ucccugcaugguccuggcc

SEQ ID NO: 289953 - RNA, 19 nt, Human
ucccuggaggaagagagga

SEQ ID NO: 289954 - RNA, 20 nt, Human
ucgggagaagcucauagauu

SEQ ID NO: 289955 - RNA, 24 nt, Human
ucucagucggaccuucaggcccac

SEQ ID NO: 289956 - RNA, 23 nt, Human
ucuccaagcucccucuccaaguu

SEQ ID NO: 289957 - RNA, 19 nt, Human
ucuccugccccucccucag

SEQ ID NO: 289958 - RNA, 18 nt, Human
ucucucugcccuggcucu

SEQ ID NO: 289959 - RNA, 20 nt, Human
ucugaggucccacagcaaag

SEQ ID NO: 289960 - RNA, 19 nt, Human
ucugccccagccccagcac

SEQ ID NO: 289961 - RNA, 21 nt, Human
ucugccccagccccagcaccu

SEQ ID NO: 289962 - RNA, 18 nt, Human
ucuuuuuuuuuuuuuuuu

SEQ ID NO: 289963 - RNA, 18 nt, Human
ucuuuuuuuuuuuuuuuu

SEQ ID NO: 289964 - RNA, 21 nt, Human
ugaguucuuugaucuggaaaa

SEQ ID NO: 289965 - RNA, 20 nt, Human
ugaucuggaaaagagcugcu

SEQ ID NO: 289966 - RNA, 18 nt, Human
ugcaccaagagugcgaga

SEQ ID NO: 289967 - RNA, 20 nt, Human
ugcaggguuuugucugaggu

SEQ ID NO: 289968 - RNA, 23 nt, Human
ugcccuggcucucugccauccug

SEQ ID NO: 289969 - RNA, 18 nt, Human
ugccuggccugcugaucc

SEQ ID NO: 289970 - RNA, 21 nt, Human
ugcuccucuuggagaggggcc

SEQ ID NO: 289971 - RNA, 20 nt, Human
ugcucuccugccccucccuc

SEQ ID NO: 289972 - RNA, 21 nt, Human
uggaaaaaaagcguccgaagg

SEQ ID NO: 289973 - RNA, 23 nt, Human
uggacagggaaaaguuuccacuu

SEQ ID NO: 289974 - RNA, 21 nt, Human
uggagagaggaggggaaggaa

SEQ ID NO: 289975 - RNA, 20 nt, Human
uggaggaagagaggaagagg

SEQ ID NO: 289976 - RNA, 22 nt, Human
uggccugcugaucccaagucca

SEQ ID NO: 289977 - RNA, 18 nt, Human
uggcuuccucugaccacc

SEQ ID NO: 289978 - RNA, 27 nt, Human
ugggccucaggugcccacccccaucug

SEQ ID NO: 289979 - RNA, 18 nt, Human
uggguggagcagucuucu

SEQ ID NO: 289980 - RNA, 18 nt, Human
uguccuguucucgccaac

SEQ ID NO: 289981 - RNA, 21 nt, Human
uguggccaggaccaggacaag

SEQ ID NO: 289982 - RNA, 23 nt, Human
uuccucugucccccagaucuucc

SEQ ID NO: 289983 - RNA, 18 nt, Human
uugugaucuggguguggg

SEQ ID NO: 289984 - RNA, 24 nt, Human
uuuagaaauagacaagcauccaga

SEQ ID NO: 289985 - RNA, 23 nt, Human
uuuugugccuuuuuuuuucuuuu

SEQ ID NO: 289986 - RNA, 30 nt, Human
uuuuuuucuuuuuuuuuuuuuuuuuuuuuu

SEQ ID NO: 289987 - RNA, 31 nt, Human
uuuuuuuucuuuuuuuuuuuuuuuuuuuuuu

SEQ ID NO: 289988 - RNA, 26 nt, Human
uuuuuuuuuuuuuuuuggugccaggg

SEQ ID NO: 289989 - RNA, 18 nt, Human
uuuuuuuuuuuuuuuuug

SEQ ID NO: 289990 - RNA, 20 nt, Human
uuuuuuuuuuuuuuuuuggu

SEQ ID NO: 289991 - RNA, 23 nt, Human
aaugugugugugcggcgccggcc

SEQ ID NO: 289992 - RNA, 23 nt, Human
acucucacaauaaaaggccucac

SEQ ID NO: 289993 - RNA, 20 nt, Human
ccucgccuccaccgcuccuc

SEQ ID NO: 289994 - RNA, 20 nt, Human
cggaugucuguccacucucu

SEQ ID NO: 289995 - RNA, 20 nt, Human
cucacacaucugcgcgcccc

SEQ ID NO: 289996 - RNA, 22 nt, Human
cucacacaucugcgcgccccua

SEQ ID NO: 289997 - RNA, 22 nt, Human
cucucacaauaaaaggccucac

SEQ ID NO: 289998 - RNA, 19 nt, Human
gcucaaguguguuaaugug

SEQ ID NO: 289999 - RNA, 18 nt, Human
gugcugcuguuguugcuu

SEQ ID NO: 290000 - RNA, 20 nt, Human
ucaagaguuuuguuugguug

SEQ ID NO: 290001 - RNA, 18 nt, Human
ucacuggcccauuagcga

SEQ ID NO: 290002 - RNA, 20 nt, Human
uccacggggcucgaauaugg

SEQ ID NO: 290003 - RNA, 25 nt, Human
uccacucucacaauaaaaggccuca

SEQ ID NO: 290004 - RNA, 21 nt, Human
ugagaguuuucuccacggaug

SEQ ID NO: 290005 - RNA, 23 nt, Human
ugcgcgccccuaguuaaagucuu

SEQ ID NO: 290006 - RNA, 20 nt, Human
ugcuggguuggugugugaga

SEQ ID NO: 290007 - RNA, 20 nt, Human
ugcuggugagaguuuucucc

SEQ ID NO: 290008 - RNA, 24 nt, Human
ugggggccgcgggauuccacgggg

SEQ ID NO: 290009 - RNA, 24 nt, Human
ugucaagaguuuuguuugguuggg

SEQ ID NO: 290010 - RNA, 18 nt, Human
ugugcggcgccggccucg

SEQ ID NO: 290011 - RNA, 19 nt, Human
uguugcuugaagaccacaa

SEQ ID NO: 290012 - RNA, 21 nt, Human
uucucagauuccuaugcugau

SEQ ID NO: 290013 - RNA, 21 nt, Human
uugcuggugagaguuuucucc

SEQ ID NO: 290014 - RNA, 25 nt, Human
uugggguuuuuugugcugcuguugu

SEQ ID NO: 290015 - RNA, 23 nt, Human
uuguuugguugggguuuuuugug

SEQ ID NO: 290016 - RNA, 21 nt, Human
uuuuugugcugcuguuguugc

SEQ ID NO: 290017 - RNA, 19 nt, Human
uuuuuugugcugcuguugu

SEQ ID NO: 290018 - RNA, 19 nt, Human
aaacaaacaaacacuccaa

SEQ ID NO: 290019 - RNA, 19 nt, Human
aaacaaacacuccaacccc

SEQ ID NO: 290020 - RNA, 25 nt, Human
aaacaaacacuccaaccccaagucc

SEQ ID NO: 290021 - RNA, 20 nt, Human
aaccucuucucccuccccuc

SEQ ID NO: 290022 - RNA, 22 nt, Human
aaccucuucucccuccccucca

SEQ ID NO: 290023 - RNA, 23 nt, Human
aaccucuucucccuccccuccac

SEQ ID NO: 290024 - RNA, 18 nt, Human
aagcagaggcuuagccag

SEQ ID NO: 290025 - RNA, 19 nt, Human
aagcagaggcuuagccagg

SEQ ID NO: 290026 - RNA, 20 nt, Human
aagcagaggcuuagccagga

SEQ ID NO: 290027 - RNA, 25 nt, Human
acacacacucccuacccccaccccc

SEQ ID NO: 290028 - RNA, 22 nt, Human
acacucccuacccccacccccc

SEQ ID NO: 290029 - RNA, 19 nt, Human
acccccaccccccaccccu

SEQ ID NO: 290030 - RNA, 22 nt, Human
acccggagaccaggccccgcgg

SEQ ID NO: 290031 - RNA, 22 nt, Human
acucccuacccccaccccccac

SEQ ID NO: 290032 - RNA, 21 nt, Human
agaacccggagaccaggcccc

SEQ ID NO: 290033 - RNA, 19 nt, Human
agccaggagauguccuggg

SEQ ID NO: 290034 - RNA, 19 nt, Human
aggagauguccuggguuuu

SEQ ID NO: 290035 - RNA, 21 nt, Human
caaacaaacacuccaacccca

SEQ ID NO: 290036 - RNA, 25 nt, Human
cacacacucccuacccccacccccc

SEQ ID NO: 290037 - RNA, 20 nt, Human
cacacucccuacccccaccc

SEQ ID NO: 290038 - RNA, 23 nt, Human
cacacucccuacccccacccccc

SEQ ID NO: 290039 - RNA, 18 nt, Human
caccccccaccccuggcu

SEQ ID NO: 290040 - RNA, 20 nt, Human
cacucccuacccccaccccc

SEQ ID NO: 290041 - RNA, 20 nt, Human
cacucccuacccccaccccc

SEQ ID NO: 290042 - RNA, 24 nt, Human
cacucccuacccccaccccccacc

SEQ ID NO: 290043 - RNA, 26 nt, Human
cacucccuacccccaccccccacccc

SEQ ID NO: 290044 - RNA, 18 nt, Human
cacucgcuucucccucca

SEQ ID NO: 290045 - RNA, 27 nt, Human
ccaaccccaaguccgccucugccggcu

SEQ ID NO: 290046 - RNA, 18 nt, Human
ccacacacacucccuacc

SEQ ID NO: 290047 - RNA, 21 nt, Human
ccacacucgcuucucccucca

SEQ ID NO: 290048 - RNA, 23 nt, Human
ccaccccuggcugcagucaaacg

SEQ ID NO: 290049 - RNA, 19 nt, Human
ccaggagauguccuggguu

SEQ ID NO: 290050 - RNA, 24 nt, Human
cccaccccuggcugcagucaaacg

SEQ ID NO: 290051 - RNA, 24 nt, Human
cccccaccccccaccccuggcugc

SEQ ID NO: 290052 - RNA, 20 nt, Human
cccuccacacacacucccua

SEQ ID NO: 290053 - RNA, 18 nt, Human
cccucccucuucuccacg

SEQ ID NO: 290054 - RNA, 21 nt, Human
cccugcugcgaucucuuucuu

SEQ ID NO: 290055 - RNA, 22 nt, Human
ccgccucugccggcuggccucg

SEQ ID NO: 290056 - RNA, 18 nt, Human
ccucugccggcuggccuc

SEQ ID NO: 290057 - RNA, 20 nt, Human
ccucuucucccuccccucca

SEQ ID NO: 290058 - RNA, 28 nt, Human
ccuggcugcagucaaacgcguccagaag

SEQ ID NO: 290059 - RNA, 22 nt, Human
cgaggaaguucaaacaaacaaa

SEQ ID NO: 290060 - RNA, 19 nt, Human
cgcggacggaggggggccg

SEQ ID NO: 290061 - RNA, 22 nt, Human
cggcuggccucggccagaaguu

SEQ ID NO: 290062 - RNA, 20 nt, Human
cggggccaaaguuuccgagc

SEQ ID NO: 290063 - RNA, 21 nt, Human
cguccgcucccuucaccccug

SEQ ID NO: 290064 - RNA, 21 nt, Human
cuacccccaccccccaccccu

SEQ ID NO: 290065 - RNA, 20 nt, Human
cuccaaccccaaguccgccu

SEQ ID NO: 290066 - RNA, 21 nt, Human
cuccacacacacucccuaccc

SEQ ID NO: 290067 - RNA, 19 nt, Human
cucccuacccccacccccc

SEQ ID NO: 290068 - RNA, 20 nt, Human
cucccuccccuccacacaca

SEQ ID NO: 290069 - RNA, 18 nt, Human
cucccucccucuucucca

SEQ ID NO: 290070 - RNA, 21 nt, Human
cucccucccucuucuccacgc

SEQ ID NO: 290071 - RNA, 26 nt, Human
cugcgaucucuuucuuuccgucuucu

SEQ ID NO: 290072 - RNA, 23 nt, Human
cugcugcgaucucuuucuuuccg

SEQ ID NO: 290073 - RNA, 21 nt, Human
cuuuccgucuucuucgucuuc

SEQ ID NO: 290074 - RNA, 24 nt, Human
gcgaucucuuucuuuccgucuucu

SEQ ID NO: 290075 - RNA, 20 nt, Human
gcgcucuggcgcucggggcc

SEQ ID NO: 290076 - RNA, 19 nt, Human
gcucccucccucuucucca

SEQ ID NO: 290077 - RNA, 21 nt, Human
ggaaucgaggccgccagccuc

SEQ ID NO: 290078 - RNA, 21 nt, Human
gggggugaggugggguggagg

SEQ ID NO: 290079 - RNA, 18 nt, Human
gggguggagguugggggg

SEQ ID NO: 290080 - RNA, 22 nt, Human
ggguggagguuggggggaggga

SEQ ID NO: 290081 - RNA, 21 nt, Human
uaaccucuucucccuccccuc

SEQ ID NO: 290082 - RNA, 22 nt, Human
uacccccaccccccaccccugg

SEQ ID NO: 290083 - RNA, 22 nt, Human
ucaaacaaacaaacacuccaac

SEQ ID NO: 290084 - RNA, 23 nt, Human
uccacacacacucccuaccccca

SEQ ID NO: 290085 - RNA, 19 nt, Human
uccagaagcuggggagggg

SEQ ID NO: 290086 - RNA, 20 nt, Human
ucccguccgcucccuucacc

SEQ ID NO: 290087 - RNA, 19 nt, Human
ucccguccgcucccuuccc

SEQ ID NO: 290088 - RNA, 23 nt, Human
ucccuacccccaccccccacccc

SEQ ID NO: 290089 - RNA, 21 nt, Human
uccgucuucuucgucuucuuu

SEQ ID NO: 290090 - RNA, 21 nt, Human
ucuucuuuuuuuuaaccucuu

SEQ ID NO: 290091 - RNA, 19 nt, Human
ucuuucuuuccgucuucuc

SEQ ID NO: 290092 - RNA, 18 nt, Human
ugcuguguauuuuauuuc

SEQ ID NO: 290093 - RNA, 24 nt, Human
uucgucuucuuuuuuuuaaccucu

SEQ ID NO: 290094 - RNA, 24 nt, Human
acuacagauggucaaaggccgugg

SEQ ID NO: 290095 - RNA, 19 nt, Human
cagcccgccgagggcucgg

SEQ ID NO: 290096 - RNA, 20 nt, Human
cccguagguccgggccgcgc

SEQ ID NO: 290097 - RNA, 18 nt, Human
cccugggcccggugucuc

SEQ ID NO: 290098 - RNA, 22 nt, Human
ccgagggcucggggcuuccucc

SEQ ID NO: 290099 - RNA, 25 nt, Human
ccgccgagggcucggggcuuccucc

SEQ ID NO: 290100 - RNA, 21 nt, Human
ccugccgcugcccuggccggc

SEQ ID NO: 290101 - RNA, 21 nt, Human
cgagggcucggggcuuccucc

SEQ ID NO: 290102 - RNA, 28 nt, Human
cugggcccggugucucuccuccuucuga

SEQ ID NO: 290103 - RNA, 19 nt, Human
gcccggugucucuccuccu

SEQ ID NO: 290104 - RNA, 18 nt, Human
gccgcgccugccgcugcc

SEQ ID NO: 290105 - RNA, 19 nt, Human
gccgcgccugccgcugccc

SEQ ID NO: 290106 - RNA, 22 nt, Human
gccgcgccugccgcugcccugg

SEQ ID NO: 290107 - RNA, 18 nt, Human
gccuugauguggaacugu

SEQ ID NO: 290108 - RNA, 21 nt, Human
ggcaguggugggcggugcacu

SEQ ID NO: 290109 - RNA, 18 nt, Human
gggcggugcacucggccu

SEQ ID NO: 290110 - RNA, 23 nt, Human
guggcaguggugggcggugcacu

SEQ ID NO: 290111 - RNA, 21 nt, Human
ucccguagguccgggccgcgc

SEQ ID NO: 290112 - RNA, 18 nt, Human
ugccgcugcccuggccgg

SEQ ID NO: 290113 - RNA, 22 nt, Human
ugggcccggugucucuccuccu

SEQ ID NO: 290114 - RNA, 23 nt, Human
aaaaggggcggguccgagggcaa

SEQ ID NO: 290115 - RNA, 19 nt, Human
aaacuccuuccgcugucuc

SEQ ID NO: 290116 - RNA, 23 nt, Human
aaggaagaaguaaaaggagggac

SEQ ID NO: 290117 - RNA, 21 nt, Human
accaacccggccccaguuccg

SEQ ID NO: 290118 - RNA, 20 nt, Human
agacagaaacuuuccgcacc

SEQ ID NO: 290119 - RNA, 18 nt, Human
aggaaacuccuuccgcug

SEQ ID NO: 290120 - RNA, 23 nt, Human
aggaagaaguaaaaggaagucug

SEQ ID NO: 290121 - RNA, 22 nt, Human
aggaggaggcgagagggcaaaa

SEQ ID NO: 290122 - RNA, 24 nt, Human
caccaacccggccccaguuccgca

SEQ ID NO: 290123 - RNA, 24 nt, Human
cacucccagacagaaacuuuccgc

SEQ ID NO: 290124 - RNA, 22 nt, Human
caggaaacuccuuccgcugucu

SEQ ID NO: 290125 - RNA, 19 nt, Human
cagggcagggcggcuccgu

SEQ ID NO: 290126 - RNA, 18 nt, Human
caugucaguuuuucugca

SEQ ID NO: 290127 - RNA, 22 nt, Human
ccaacccggccccaguuccgca

SEQ ID NO: 290128 - RNA, 22 nt, Human
ccaggaaacuccuuccgcuguc

SEQ ID NO: 290129 - RNA, 22 nt, Human
ccaggaggaggaggcgagaggg

SEQ ID NO: 290130 - RNA, 18 nt, Human
ccaguuccgcacucccag

SEQ ID NO: 290131 - RNA, 21 nt, Human
cccggccgaccggccggcgcc

SEQ ID NO: 290132 - RNA, 18 nt, Human
cgggucggugagcgacag

SEQ ID NO: 290133 - RNA, 21 nt, Human
cuccgagcaguacaccaaccc

SEQ ID NO: 290134 - RNA, 23 nt, Human
gaccugggaauugggggaggagg

SEQ ID NO: 290135 - RNA, 18 nt, Human
gagggcaggagggguggg

SEQ ID NO: 290136 - RNA, 18 nt, Human
ggaaacuccuuccgcugu

SEQ ID NO: 290137 - RNA, 18 nt, Human
ggaggaggaggcgagagg

SEQ ID NO: 290138 - RNA, 22 nt, Human
ggcgagagggcaaaaggaagaa

SEQ ID NO: 290139 - RNA, 21 nt, Human
ggugaagcugcuggagacgga

SEQ ID NO: 290140 - RNA, 21 nt, Human
gugggcugggcugagcagggc

SEQ ID NO: 290141 - RNA, 22 nt, Human
uaaaaggggcggguccgagggc

SEQ ID NO: 290142 - RNA, 26 nt, Human
uaagugucauuagcacaaaggaugug

SEQ ID NO: 290143 - RNA, 21 nt, Human
uacagccagcuuucaaggcag

SEQ ID NO: 290144 - RNA, 18 nt, Human
ucggugagcgacagcgca

SEQ ID NO: 290145 - RNA, 22 nt, Human
ucugcaagagaaaaguuauggc

SEQ ID NO: 290146 - RNA, 18 nt, Human
aaaagucacccucaacua

SEQ ID NO: 290147 - RNA, 22 nt, Human
aaagccacccucccuccugcuu

SEQ ID NO: 290148 - RNA, 20 nt, Human
aacacagaucucagguuucc

SEQ ID NO: 290149 - RNA, 20 nt, Human
aacacugaacuggggaacau

SEQ ID NO: 290150 - RNA, 19 nt, Human
aacagcacaauuaaugcaa

SEQ ID NO: 290151 - RNA, 24 nt, Human
aagcaaacagcacaauuaaugcaa

SEQ ID NO: 290152 - RNA, 21 nt, Human
aagcagagcgugcagccggga

SEQ ID NO: 290153 - RNA, 25 nt, Human
aagggaccagagugacauacugaug

SEQ ID NO: 290154 - RNA, 25 nt, Human
acaagcaaacagcacaauuaaugca

SEQ ID NO: 290155 - RNA, 19 nt, Human
agcaaagccacccucccuc

SEQ ID NO: 290156 - RNA, 24 nt, Human
aggcagaggcaaccaaucuuuuuu

SEQ ID NO: 290157 - RNA, 20 nt, Human
agggaccagagugacauacu

SEQ ID NO: 290158 - RNA, 18 nt, Human
auaaaggccaggcagcag

SEQ ID NO: 290159 - RNA, 21 nt, Human
aucuauuauacaugcaacacu

SEQ ID NO: 290160 - RNA, 23 nt, Human
augaccccaucacaguaccaaaa

SEQ ID NO: 290161 - RNA, 23 nt, Human
auuaaugcaacauucagcaacuc

SEQ ID NO: 290162 - RNA, 20 nt, Human
caaaauaccccccaaaauga

SEQ ID NO: 290163 - RNA, 19 nt, Human
caacaacagcaaagccacc

SEQ ID NO: 290164 - RNA, 20 nt, Human
caacaacagcaaagccaccc

SEQ ID NO: 290165 - RNA, 24 nt, Human
caacaacagcaaagccacccuccc

SEQ ID NO: 290166 - RNA, 21 nt, Human
caacacugaacuggggaacau

SEQ ID NO: 290167 - RNA, 25 nt, Human
caagcaaacagcacaauuaaugcaa

SEQ ID NO: 290168 - RNA, 30 nt, Human
cacaguaccaaaauaccccccaaaaugaag

SEQ ID NO: 290169 - RNA, 26 nt, Human
cagaggcaaccaaucuuuuuuuuuuu

SEQ ID NO: 290170 - RNA, 19 nt, Human
cagagugacauacugaugc

SEQ ID NO: 290171 - RNA, 20 nt, Human
cagcaaagccacccucccuc

SEQ ID NO: 290172 - RNA, 23 nt, Human
cagcaaagccacccucccuccug

SEQ ID NO: 290173 - RNA, 19 nt, Human
caggaucacaaaggcagag

SEQ ID NO: 290174 - RNA, 22 nt, Human
caguaccaaaauaccccccaaa

SEQ ID NO: 290175 - RNA, 23 nt, Human
ccaaaauaccccccaaaaugaag

SEQ ID NO: 290176 - RNA, 20 nt, Human
ccaacaacagcaaagccacc

SEQ ID NO: 290177 - RNA, 21 nt, Human
cccaacaacagcaaagccacc

SEQ ID NO: 290178 - RNA, 27 nt, Human
cccccaguuuuuucuuuuugggccgcc

SEQ ID NO: 290179 - RNA, 18 nt, Human
ccccccaaaaugaaguuc

SEQ ID NO: 290180 - RNA, 24 nt, Human
cccucaacuaccaucugacugguc

SEQ ID NO: 290181 - RNA, 20 nt, Human
cccucccuccugcuucuucc

SEQ ID NO: 290182 - RNA, 18 nt, Human
cgcggagagcucagcaca

SEQ ID NO: 290183 - RNA, 18 nt, Human
cgggcgacagaggcgacg

SEQ ID NO: 290184 - RNA, 27 nt, Human
cuacaagcaaacagcacagcgcgaguc

SEQ ID NO: 290185 - RNA, 21 nt, Human
cucgggaagacgcagaccccc

SEQ ID NO: 290186 - RNA, 19 nt, Human
cuuggggccuccaggacag

SEQ ID NO: 290187 - RNA, 24 nt, Human
cuuuuuuuuuuuuuuuuuuuuuaa

SEQ ID NO: 290188 - RNA, 22 nt, Human
gaucaaaacauaaaucagagug

SEQ ID NO: 290189 - RNA, 20 nt, Human
gauugcucuuuaaagggacu

SEQ ID NO: 290190 - RNA, 22 nt, Human
gcaacacugaacuggggaacau

SEQ ID NO: 290191 - RNA, 24 nt, Human
gcaacuccagaccagcuuuucuua

SEQ ID NO: 290192 - RNA, 18 nt, Human
gccagccucugguugucu

SEQ ID NO: 290193 - RNA, 23 nt, Human
ggcaaccaaucuuuuuuuuuuuu

SEQ ID NO: 290194 - RNA, 18 nt, Human
ggcgacagaggcgacgcg

SEQ ID NO: 290195 - RNA, 22 nt, Human
ggcgacagaggcgacgcggaga

SEQ ID NO: 290196 - RNA, 18 nt, Human
ggcgaggccaagcagagc

SEQ ID NO: 290197 - RNA, 21 nt, Human
ggggaacauggcuuggggccu

SEQ ID NO: 290198 - RNA, 25 nt, Human
ggggcaggaagaggagaaaucuauu

SEQ ID NO: 290199 - RNA, 21 nt, Human
gucacccucaacuaccaucug

SEQ ID NO: 290200 - RNA, 20 nt, Human
uaggccaggcgcgggcgaca

SEQ ID NO: 290201 - RNA, 23 nt, Human
ucccaacaacagcaaagccaccc

SEQ ID NO: 290202 - RNA, 22 nt, Human
ucccaagcugucagcgaggcgc

SEQ ID NO: 290203 - RNA, 21 nt, Human
ucucagguuuccucccaagcu

SEQ ID NO: 290204 - RNA, 23 nt, Human
ugaagaacgaucaauuuaaaaaa

SEQ ID NO: 290205 - RNA, 25 nt, Human
ugagugaguaaaauuauaaaggcca

SEQ ID NO: 290206 - RNA, 18 nt, Human
ugccgcgguaggccaggc

SEQ ID NO: 290207 - RNA, 18 nt, Human
uggcucgggaagacgcag

SEQ ID NO: 290208 - RNA, 24 nt, Human
uuauaaaggccaggcagcaggaaa

SEQ ID NO: 290209 - RNA, 24 nt, Human
uucagauuaauaauuugaugaccc

SEQ ID NO: 290210 - RNA, 22 nt, Human
uucagguccccaagcuaacccc

SEQ ID NO: 290211 - RNA, 23 nt, Human
uucuuccaggauugcucuuuaaa

SEQ ID NO: 290212 - RNA, 20 nt, Human
uugaugcuuugcucuaucac

SEQ ID NO: 290213 - RNA, 22 nt, Human
uuuccccccaguuuuuucuuuu

SEQ ID NO: 290214 - RNA, 25 nt, Human
uuuuacauucuggguugcuauuuuc

SEQ ID NO: 290215 - RNA, 20 nt, Human
aacccucccuccugccccug

SEQ ID NO: 290216 - RNA, 19 nt, Human
aagaagagaagagaaggag

SEQ ID NO: 290217 - RNA, 18 nt, Human
agcuggaggcagggaagg

SEQ ID NO: 290218 - RNA, 21 nt, Human
aggcagggaaggguggcuucu

SEQ ID NO: 290219 - RNA, 18 nt, Human
cagaggcacaggggcagg

SEQ ID NO: 290220 - RNA, 25 nt, Human
cagaggcacaggggcagggaagaug

SEQ ID NO: 290221 - RNA, 21 nt, Human
ccaaagaagagaagagaagga

SEQ ID NO: 290222 - RNA, 19 nt, Human
ccagaaaaaaaagggaaga

SEQ ID NO: 290223 - RNA, 20 nt, Human
cccaaagaagagaagagaag

SEQ ID NO: 290224 - RNA, 19 nt, Human
ccccaacuggggcagaggg

SEQ ID NO: 290225 - RNA, 26 nt, Human
ccuccugccccugccccaacuggggc

SEQ ID NO: 290226 - RNA, 19 nt, Human
ccugccccugccccaacug

SEQ ID NO: 290227 - RNA, 24 nt, Human
cuacggcagcccccggcucuuccu

SEQ ID NO: 290228 - RNA, 23 nt, Human
cuccaaaggcuacggcagccccc

SEQ ID NO: 290229 - RNA, 23 nt, Human
cucccuccugccccugccccaac

SEQ ID NO: 290230 - RNA, 20 nt, Human
cuccucggcucggcuccugg

SEQ ID NO: 290231 - RNA, 23 nt, Human
cuugggagagaaacccucccucc

SEQ ID NO: 290232 - RNA, 25 nt, Human
gaaacccucccuccugccccugccc

SEQ ID NO: 290233 - RNA, 22 nt, Human
gagaaacccucccuccugcccc

SEQ ID NO: 290234 - RNA, 22 nt, Human
ggcagagggucagccgggaugc

SEQ ID NO: 290235 - RNA, 20 nt, Human
ucagugauaugagagagggc

SEQ ID NO: 290236 - RNA, 18 nt, Human
uccucggcucggcuccug

SEQ ID NO: 290237 - RNA, 20 nt, Human
ucuuauuguguuugcugauu

SEQ ID NO: 290238 - RNA, 26 nt, Human
ucuucaaauccuuuucaggauaaaca

SEQ ID NO: 290239 - RNA, 19 nt, Human
ugaaauagcaucccaaaga

SEQ ID NO: 290240 - RNA, 19 nt, Human
ugacagcuggaggcaggga

SEQ ID NO: 290241 - RNA, 20 nt, Human
ugccccugccccaacugggg

SEQ ID NO: 290242 - RNA, 26 nt, Human
aaaaaaaaaacagauggaucccaggg

SEQ ID NO: 290243 - RNA, 24 nt, Human
aaaaaaaaaaguucaaccccaaag

SEQ ID NO: 290244 - RNA, 18 nt, Human
aaaaaagacaagaaauca

SEQ ID NO: 290245 - RNA, 22 nt, Human
aaaacaagcuacuuccccaaac

SEQ ID NO: 290246 - RNA, 19 nt, Human
aaaacagauggaucccagg

SEQ ID NO: 290247 - RNA, 21 nt, Human
aaacaagcuacuuccccaaac

SEQ ID NO: 290248 - RNA, 22 nt, Human
aaacagauggaucccaggguuu

SEQ ID NO: 290249 - RNA, 21 nt, Human
aaagacagaggagaaaaaggg

SEQ ID NO: 290250 - RNA, 18 nt, Human
aaaugcggcagaaaccug

SEQ ID NO: 290251 - RNA, 21 nt, Human
aacaacaaaaacaacaacaac

SEQ ID NO: 290252 - RNA, 24 nt, Human
aacaacaaaaacaacaacaacaaa

SEQ ID NO: 290253 - RNA, 30 nt, Human
aacaacaaaaacaacaacaacaaaaaaaaa

SEQ ID NO: 290254 - RNA, 24 nt, Human
aacaacaacaaaaacaacaacaac

SEQ ID NO: 290255 - RNA, 20 nt, Human
aacaagcuacuuccccaaac

SEQ ID NO: 290256 - RNA, 19 nt, Human
aagggggaugagaggccag

SEQ ID NO: 290257 - RNA, 20 nt, Human
acaaaaacaacaacaacaaa

SEQ ID NO: 290258 - RNA, 21 nt, Human
acaaaaacaacaacaacaaaa

SEQ ID NO: 290259 - RNA, 23 nt, Human
acaacaaaaacaacaacaacaaa

SEQ ID NO: 290260 - RNA, 26 nt, Human
acaacaacaaaaaaaaaaacagaugg

SEQ ID NO: 290261 - RNA, 27 nt, Human
acaacaacaaaaaaaaaaacagaugga

SEQ ID NO: 290262 - RNA, 29 nt, Human
acaacaacaaaaacaacaacaacaaaaaa

SEQ ID NO: 290263 - RNA, 20 nt, Human
accaccaccaccaccaccaa

SEQ ID NO: 290264 - RNA, 21 nt, Human
accaccaccaccaccaccacc

SEQ ID NO: 290265 - RNA, 23 nt, Human
accaccaccaccaccaccaccaa

SEQ ID NO: 290266 - RNA, 20 nt, Human
accccaaagcccagucaaua

SEQ ID NO: 290267 - RNA, 22 nt, Human
accccugugacccugaggggca

SEQ ID NO: 290268 - RNA, 20 nt, Human
acuagccccccggcccaugc

SEQ ID NO: 290269 - RNA, 23 nt, Human
acugcauuuuguuuuuuuucugu

SEQ ID NO: 290270 - RNA, 22 nt, Human
agaaagcgagagaggaaaaaga

SEQ ID NO: 290271 - RNA, 24 nt, Human
agaaauaaaaaaaaaagacaagaa

SEQ ID NO: 290272 - RNA, 18 nt, Human
agagagaaagacagagga

SEQ ID NO: 290273 - RNA, 19 nt, Human
agagaggaaaaagauggaa

SEQ ID NO: 290274 - RNA, 23 nt, Human
agagagucucguuagggagggga

SEQ ID NO: 290275 - RNA, 22 nt, Human
agaggaaaaagauggaaaaaag

SEQ ID NO: 290276 - RNA, 20 nt, Human
agagggagagagaaagacag

SEQ ID NO: 290277 - RNA, 27 nt, Human
aggaaaaagauggaaaaaaggggaccc

SEQ ID NO: 290278 - RNA, 19 nt, Human
aggagaaaaaggggucuga

SEQ ID NO: 290279 - RNA, 18 nt, Human
aggccuggagccaggggg

SEQ ID NO: 290280 - RNA, 22 nt, Human
agggaaagugggggagcccagg

SEQ ID NO: 290281 - RNA, 21 nt, Human
aggggggccucuuuaccaguu

SEQ ID NO: 290282 - RNA, 25 nt, Human
aguaagaaauaaaaaaaaaagacaa

SEQ ID NO: 290283 - RNA, 21 nt, Human
aguccugcccggaucuuuaau

SEQ ID NO: 290284 - RNA, 23 nt, Human
auaguugcaagugggaguaugug

SEQ ID NO: 290285 - RNA, 20 nt, Human
aucccaggguuucuuuuucu

SEQ ID NO: 290286 - RNA, 21 nt, Human
augguagcuaguucagggcug

SEQ ID NO: 290287 - RNA, 20 nt, Human
caaaaaaaaaaacagaugga

SEQ ID NO: 290288 - RNA, 26 nt, Human
caaaaacaacaacaacaaaaaaaaaa

SEQ ID NO: 290289 - RNA, 25 nt, Human
caacaaaaaaaaaaacagauggauc

SEQ ID NO: 290290 - RNA, 20 nt, Human
caacaaaaacaacaacaaca

SEQ ID NO: 290291 - RNA, 32 nt, Human
caacaaaaacaacaacaacaaaaaaaaaaaag

SEQ ID NO: 290292 - RNA, 30 nt, Human
caacaacaacaaaaacaacaacaacaaaag

SEQ ID NO: 290293 - RNA, 21 nt, Human
caagcccuucacugccuccac

SEQ ID NO: 290294 - RNA, 19 nt, Human
cacacuuccaaccuguccc

SEQ ID NO: 290295 - RNA, 22 nt, Human
cacagauuccagagcauacaag

SEQ ID NO: 290296 - RNA, 24 nt, Human
caccaacaacaacaaaaacaacaa

SEQ ID NO: 290297 - RNA, 24 nt, Human
caccaccaccaacaacaacaaaaa

SEQ ID NO: 290298 - RNA, 18 nt, Human
caccaccaccaccaacaa

SEQ ID NO: 290299 - RNA, 27 nt, Human
caccaccaccaccaacaacaacaaaaa

SEQ ID NO: 290300 - RNA, 22 nt, Human
caccccaacccauauuuaacau

SEQ ID NO: 290301 - RNA, 19 nt, Human
cacccccccacccaucaca

SEQ ID NO: 290302 - RNA, 21 nt, Human
cauauacaagcaccccaaccc

SEQ ID NO: 290303 - RNA, 18 nt, Human
caucacacuuccaaccug

SEQ ID NO: 290304 - RNA, 23 nt, Human
caucacacuuccaaccuguccca

SEQ ID NO: 290305 - RNA, 19 nt, Human
cauuggcccuucucugucu

SEQ ID NO: 290306 - RNA, 23 nt, Human
ccaccaccaccaccaacaacaac

SEQ ID NO: 290307 - RNA, 25 nt, Human
ccaccaccaccaccaacaacaacaa

SEQ ID NO: 290308 - RNA, 25 nt, Human
ccaccaccaccaccaccaacaacaa

SEQ ID NO: 290309 - RNA, 25 nt, Human
ccaccaccaccaccaccaccaacaa

SEQ ID NO: 290310 - RNA, 18 nt, Human
ccacccccccacccauca

SEQ ID NO: 290311 - RNA, 22 nt, Human
ccacccccccacccaucacacu

SEQ ID NO: 290312 - RNA, 23 nt, Human
ccaccgagcgauucuauugguuu

SEQ ID NO: 290313 - RNA, 26 nt, Human
ccagcccugcccaaggguugugggaa

SEQ ID NO: 290314 - RNA, 23 nt, Human
cccaugccucccacccccccacc

SEQ ID NO: 290315 - RNA, 21 nt, Human
cccauguccucuguccagaag

SEQ ID NO: 290316 - RNA, 22 nt, Human
ccccaaagcccagucaauaauu

SEQ ID NO: 290317 - RNA, 25 nt, Human
ccccaacccauauuuaacauauuug

SEQ ID NO: 290318 - RNA, 23 nt, Human
ccccacaucuggcuuuuugcaac

SEQ ID NO: 290319 - RNA, 18 nt, Human
ccccauucuuccugccau

SEQ ID NO: 290320 - RNA, 23 nt, Human
ccccccacccaucacacuuccaa

SEQ ID NO: 290321 - RNA, 23 nt, Human
ccccggcccaugccucccacccc

SEQ ID NO: 290322 - RNA, 21 nt, Human
cccugcccaaggguugugggg

SEQ ID NO: 290323 - RNA, 22 nt, Human
ccggcccaugccucccaccccc

SEQ ID NO: 290324 - RNA, 22 nt, Human
ccuccacaucaaaugcggcaga

SEQ ID NO: 290325 - RNA, 22 nt, Human
ccucccacccccccacccauca

SEQ ID NO: 290326 - RNA, 23 nt, Human
ccucccacccccccacccaucac

SEQ ID NO: 290327 - RNA, 22 nt, Human
ccucccucucccuaccccuuga

SEQ ID NO: 290328 - RNA, 27 nt, Human
cggcccaugccucccacccccccaccc

SEQ ID NO: 290329 - RNA, 19 nt, Human
cuagccccccggcccaugc

SEQ ID NO: 290330 - RNA, 21 nt, Human
cuucccauucuucccccucca

SEQ ID NO: 290331 - RNA, 23 nt, Human
cuuggugcccuguaaaauuuacc

SEQ ID NO: 290332 - RNA, 21 nt, Human
cuuguaaaauccugagaaugu

SEQ ID NO: 290333 - RNA, 21 nt, Human
gaagaagggggaugagaggcc

SEQ ID NO: 290334 - RNA, 23 nt, Human
gaagauacauauacaagcacccc

SEQ ID NO: 290335 - RNA, 20 nt, Human
gagagcccccaccccuguga

SEQ ID NO: 290336 - RNA, 19 nt, Human
gagcccaggagagaaacag

SEQ ID NO: 290337 - RNA, 21 nt, Human
gaggccccauucuuccugcca

SEQ ID NO: 290338 - RNA, 23 nt, Human
gagggguuccccacucugacagu

SEQ ID NO: 290339 - RNA, 23 nt, Human
gcagaaaccugccugcaugaaca

SEQ ID NO: 290340 - RNA, 22 nt, Human
gcggggguggggaugcaugggg

SEQ ID NO: 290341 - RNA, 24 nt, Human
gcggggguggggaugcaugggggc

SEQ ID NO: 290342 - RNA, 23 nt, Human
ggagagacagaccccacacuccc

SEQ ID NO: 290343 - RNA, 19 nt, Human
gggaaagugggggagccca

SEQ ID NO: 290344 - RNA, 26 nt, Human
gggcggggguggggaugcaugggggc

SEQ ID NO: 290345 - RNA, 18 nt, Human
gggggaugagaggccagc

SEQ ID NO: 290346 - RNA, 18 nt, Human
gggguggggaagggaaag

SEQ ID NO: 290347 - RNA, 22 nt, Human
gggguggggaagggaaaguggg

SEQ ID NO: 290348 - RNA, 21 nt, Human
gggguggggaugcaugggggc

SEQ ID NO: 290349 - RNA, 20 nt, Human
ggguugugggaagaaggggg

SEQ ID NO: 290350 - RNA, 18 nt, Human
ggguuucuuuuucuuucu

SEQ ID NO: 290351 - RNA, 18 nt, Human
ggugugggagagggagag

SEQ ID NO: 290352 - RNA, 19 nt, Human
guccucuggaagccugcgu

SEQ ID NO: 290353 - RNA, 21 nt, Human
gugggaagaagggggaugaga

SEQ ID NO: 290354 - RNA, 26 nt, Human
uaaaaaaaaaaaaguucaaccccaaa

SEQ ID NO: 290355 - RNA, 21 nt, Human
uaaaaaaaaaagacaagaaau

SEQ ID NO: 290356 - RNA, 24 nt, Human
uaaaaaaaaaagacaagaaaucaa

SEQ ID NO: 290357 - RNA, 19 nt, Human
uaaaauuuaccuuccugau

SEQ ID NO: 290358 - RNA, 25 nt, Human
uaaaguagcagaaacucccuccgag

SEQ ID NO: 290359 - RNA, 22 nt, Human
uaacucccuucccauucuuccc

SEQ ID NO: 290360 - RNA, 24 nt, Human
uaacucccuucccauucuuccccc

SEQ ID NO: 290361 - RNA, 24 nt, Human
uaagaaauaaaaaaaaaagacaaa

SEQ ID NO: 290362 - RNA, 18 nt, Human
uaagaaccaccaccacca

SEQ ID NO: 290363 - RNA, 21 nt, Human
uaagaaccaccaccaccacca

SEQ ID NO: 290364 - RNA, 22 nt, Human
uaagaaccaccaccaccaccac

SEQ ID NO: 290365 - RNA, 21 nt, Human
uaagaugagcugcguaugagg

SEQ ID NO: 290366 - RNA, 19 nt, Human
uacaagcaccccaacccau

SEQ ID NO: 290367 - RNA, 23 nt, Human
uagccccccggcccaugccuccc

SEQ ID NO: 290368 - RNA, 22 nt, Human
ucaaaugcggcagaaaccugcc

SEQ ID NO: 290369 - RNA, 20 nt, Human
ucccacccccccacccauca

SEQ ID NO: 290370 - RNA, 21 nt, Human
ucccauucuucccccuccaau

SEQ ID NO: 290371 - RNA, 21 nt, Human
ucccauucuucccccuccaau

SEQ ID NO: 290372 - RNA, 20 nt, Human
uccccaaacuaaauuaaaaa

SEQ ID NO: 290373 - RNA, 22 nt, Human
uccucuguccagaagucauguc

SEQ ID NO: 290374 - RNA, 18 nt, Human
ucugaggggaucagaugg

SEQ ID NO: 290375 - RNA, 21 nt, Human
ucuguuugucccccuuucucu

SEQ ID NO: 290376 - RNA, 23 nt, Human
ucuuuaaaaaaaaaaaaguucaa

SEQ ID NO: 290377 - RNA, 23 nt, Human
ugacaaaaagauaccucauuuau

SEQ ID NO: 290378 - RNA, 21 nt, Human
ugagagcccccaccccuguga

SEQ ID NO: 290379 - RNA, 24 nt, Human
ugagagcccccaccccugugaccc

SEQ ID NO: 290380 - RNA, 19 nt, Human
ugaggaugggacaguguug

SEQ ID NO: 290381 - RNA, 20 nt, Human
ugaggugugggagagggaga

SEQ ID NO: 290382 - RNA, 23 nt, Human
ugagucagacacucucguccacc

SEQ ID NO: 290383 - RNA, 19 nt, Human
ugaguccagcccugcccaa

SEQ ID NO: 290384 - RNA, 18 nt, Human
ugcccggaucuuuaaugg

SEQ ID NO: 290385 - RNA, 20 nt, Human
ugccucccacccccccaccc

SEQ ID NO: 290386 - RNA, 24 nt, Human
uggaaaaaagggagagacagaccc

SEQ ID NO: 290387 - RNA, 28 nt, Human
ugggaaaguaagaaauaaaaaaaaaaga

SEQ ID NO: 290388 - RNA, 23 nt, Human
ugggaagaagggggaugagaggc

SEQ ID NO: 290389 - RNA, 24 nt, Human
ugggagagggagagagaaagacag

SEQ ID NO: 290390 - RNA, 21 nt, Human
ugggguggggaagggaaagug

SEQ ID NO: 290391 - RNA, 22 nt, Human
ugugugaggugugggagaggga

SEQ ID NO: 290392 - RNA, 18 nt, Human
ugugugugagguguggga

SEQ ID NO: 290393 - RNA, 23 nt, Human
uucccauucuucccccuccaauu

SEQ ID NO: 290394 - RNA, 19 nt, Human
uuccucaaaauuacugagu

SEQ ID NO: 290395 - RNA, 21 nt, Human
uugcaaccuccucccucuccc

SEQ ID NO: 290396 - RNA, 23 nt, Human
uuuauaaaaaaaaaaacaagcua

SEQ ID NO: 290397 - RNA, 22 nt, Human
uuucucgguauguguauguuuc

SEQ ID NO: 290398 - RNA, 24 nt, Human
uuuucuuucuuuaaaaaaaaaaaa

SEQ ID NO: 290399 - RNA, 21 nt, Human
aaacagauuuaccaaguucuc

SEQ ID NO: 290400 - RNA, 22 nt, Human
aaagagacaaacuacagcguga

SEQ ID NO: 290401 - RNA, 22 nt, Human
aaaucuuggccuaauuggauaa

SEQ ID NO: 290402 - RNA, 21 nt, Human
aauguuuccacacucgguuuu

SEQ ID NO: 290403 - RNA, 20 nt, Human
acaaacgugacgaggaagau

SEQ ID NO: 290404 - RNA, 19 nt, Human
acaacaguuuuaccgaucc

SEQ ID NO: 290405 - RNA, 21 nt, Human
agaaagagacaaacuacagcg

SEQ ID NO: 290406 - RNA, 20 nt, Human
agagagagaaacgaugcuac

SEQ ID NO: 290407 - RNA, 20 nt, Human
agagguaguaagugagcacu

SEQ ID NO: 290408 - RNA, 22 nt, Human
agauaagaaagagacaaacuac

SEQ ID NO: 290409 - RNA, 21 nt, Human
aguaauggaaauaugcaagaa

SEQ ID NO: 290410 - RNA, 22 nt, Human
agucaguaauggaaauaugcaa

SEQ ID NO: 290411 - RNA, 21 nt, Human
auauacaacacuccagagagc

SEQ ID NO: 290412 - RNA, 20 nt, Human
augaagggaaacaaagaguu

SEQ ID NO: 290413 - RNA, 20 nt, Human
caacacuccagagagcaggg

SEQ ID NO: 290414 - RNA, 24 nt, Human
caacuccauuagugauaugaaaga

SEQ ID NO: 290415 - RNA, 23 nt, Human
cacaccguaaaaccccagacgga

SEQ ID NO: 290416 - RNA, 18 nt, Human
cacuccagagagcagggc

SEQ ID NO: 290417 - RNA, 24 nt, Human
cagcagcaaguaucuucgucucuc

SEQ ID NO: 290418 - RNA, 19 nt, Human
cagcucuuuauuccaacuc

SEQ ID NO: 290419 - RNA, 23 nt, Human
caugagguaauaaagcuguguuu

SEQ ID NO: 290420 - RNA, 18 nt, Human
ccagugcacaccguaaaa

SEQ ID NO: 290421 - RNA, 21 nt, Human
ccagugcacaccguaaaaccc

SEQ ID NO: 290422 - RNA, 22 nt, Human
cguaaaaccccagacggaucaa

SEQ ID NO: 290423 - RNA, 22 nt, Human
gacccaauguuuccacacucgg

SEQ ID NO: 290424 - RNA, 19 nt, Human
gacucugggcacuggugcu

SEQ ID NO: 290425 - RNA, 18 nt, Human
gcaagaaguucaauuuag

SEQ ID NO: 290426 - RNA, 21 nt, Human
guugcaagugcaacccugauu

SEQ ID NO: 290427 - RNA, 22 nt, Human
uaaaucuuggccuaauuggaua

SEQ ID NO: 290428 - RNA, 20 nt, Human
uacaaaaacgcuuuccuuuu

SEQ ID NO: 290429 - RNA, 18 nt, Human
uacaagaugcaaaaagau

SEQ ID NO: 290430 - RNA, 22 nt, Human
uaccaaguucucgaauaagaca

SEQ ID NO: 290431 - RNA, 23 nt, Human
uagcucaggaaaaguguggccag

SEQ ID NO: 290432 - RNA, 20 nt, Human
uaugaaagaaagacaaucca

SEQ ID NO: 290433 - RNA, 24 nt, Human
ucucucagaacaaucuggauccau

SEQ ID NO: 290434 - RNA, 18 nt, Human
ucugaucuaauuauaaca

SEQ ID NO: 290435 - RNA, 21 nt, Human
ucugggcacuggugcuuucag

SEQ ID NO: 290436 - RNA, 23 nt, Human
ugacgaggaagauucuuaaacac

SEQ ID NO: 290437 - RNA, 19 nt, Human
ugagcacucuaagcuacag

SEQ ID NO: 290438 - RNA, 21 nt, Human
ugcaaaaagauaagaaagaga

SEQ ID NO: 290439 - RNA, 19 nt, Human
ugcccagaggacguagcaa

SEQ ID NO: 290440 - RNA, 20 nt, Human
uguguugaauuaagacccaa

SEQ ID NO: 290441 - RNA, 19 nt, Human
uuaaaagauuacaauguac

SEQ ID NO: 290442 - RNA, 22 nt, Human
uuaccgagcagacucugggcac

SEQ ID NO: 290443 - RNA, 20 nt, Human
uucaccucuaucagcagcaa

SEQ ID NO: 290444 - RNA, 24 nt, Human
uucucgaauaagacaagguuuuac

SEQ ID NO: 290445 - RNA, 20 nt, Human
uugaagaacauucaaaaugu

SEQ ID NO: 290446 - RNA, 19 nt, Human
uuuuugcaucugcuuuaac

SEQ ID NO: 290447 - RNA, 26 nt, Human
acaucuuagaucuccccuucccccag

SEQ ID NO: 290448 - RNA, 24 nt, Human
accccuaaaccuccccuggguccu

SEQ ID NO: 290449 - RNA, 22 nt, Human
accuccacggcccggccuuccu

SEQ ID NO: 290450 - RNA, 19 nt, Human
aguaaacuucccaggaccu

SEQ ID NO: 290451 - RNA, 22 nt, Human
aguaaacuucccaggaccuggg

SEQ ID NO: 290452 - RNA, 24 nt, Human
aucuuagaucuccccuucccccag

SEQ ID NO: 290453 - RNA, 23 nt, Human
augaagcaagcuuuucauucggu

SEQ ID NO: 290454 - RNA, 24 nt, Human
caccgcaggcggugucucuccugu

SEQ ID NO: 290455 - RNA, 20 nt, Human
cacggcccggccuuccuggc

SEQ ID NO: 290456 - RNA, 19 nt, Human
caggcggugucucuccugu

SEQ ID NO: 290457 - RNA, 23 nt, Human
caucuuagaucuccccuuccccc

SEQ ID NO: 290458 - RNA, 19 nt, Human
cccaagucugggccugagg

SEQ ID NO: 290459 - RNA, 20 nt, Human
cccccaggagauaggacccc

SEQ ID NO: 290460 - RNA, 19 nt, Human
ccccuaaaccuccccuggg

SEQ ID NO: 290461 - RNA, 21 nt, Human
ccccuggguccuaggaccacc

SEQ ID NO: 290462 - RNA, 24 nt, Human
cccuggguccuaggaccaccugac

SEQ ID NO: 290463 - RNA, 21 nt, Human
ccugccguggcagcacagcuu

SEQ ID NO: 290464 - RNA, 25 nt, Human
ccugccguggcagcacagcuucugu

SEQ ID NO: 290465 - RNA, 20 nt, Human
ccuggccucgggcacuggcc

SEQ ID NO: 290466 - RNA, 21 nt, Human
cggaggcaaauggaagaaagg

SEQ ID NO: 290467 - RNA, 18 nt, Human
cuguccagcuguggacag

SEQ ID NO: 290468 - RNA, 19 nt, Human
gcagaguuccagagaggcc

SEQ ID NO: 290469 - RNA, 18 nt, Human
gcuuggggauggccaggc

SEQ ID NO: 290470 - RNA, 19 nt, Human
ggaccccuaaaccuccccu

SEQ ID NO: 290471 - RNA, 24 nt, Human
ggcacuggcuggccugggccugcc

SEQ ID NO: 290472 - RNA, 18 nt, Human
ggccucgggcacuggcug

SEQ ID NO: 290473 - RNA, 26 nt, Human
ggccucgggcacuggcuggccugggc

SEQ ID NO: 290474 - RNA, 23 nt, Human
gguggaaucauauuagagagucu

SEQ ID NO: 290475 - RNA, 19 nt, Human
guuccuguaacacccaagu

SEQ ID NO: 290476 - RNA, 23 nt, Human
ucccccaggagauaggaccccua

SEQ ID NO: 290477 - RNA, 22 nt, Human
ucuccagugaggaggggacccu

SEQ ID NO: 290478 - RNA, 26 nt, Human
ucuugaacgccaagaugaagcaagcu

SEQ ID NO: 290479 - RNA, 21 nt, Human
ugaaaggaaugaaccaccgca

SEQ ID NO: 290480 - RNA, 22 nt, Human
ugauguucuagguuaauccccu

SEQ ID NO: 290481 - RNA, 20 nt, Human
uggacaggaccuccacggcc

SEQ ID NO: 290482 - RNA, 21 nt, Human
uggccaggcugccggucuggg

SEQ ID NO: 290483 - RNA, 23 nt, Human
uggccaggcugccggucuggggc

SEQ ID NO: 290484 - RNA, 25 nt, Human
ugguuuauucuuuuggccauuuccc

SEQ ID NO: 290485 - RNA, 22 nt, Human
uguggacaggaccuccacggcc

SEQ ID NO: 290486 - RNA, 21 nt, Human
uuggccauuucccaucuucca

SEQ ID NO: 290487 - RNA, 18 nt, Human
aaaggucuaaauuccugg

SEQ ID NO: 290488 - RNA, 19 nt, Human
aacagagcccccaggauga

SEQ ID NO: 290489 - RNA, 19 nt, Human
acacuggcacaucccacag

SEQ ID NO: 290490 - RNA, 23 nt, Human
agcccccaggaugaagagagugg

SEQ ID NO: 290491 - RNA, 23 nt, Human
aggguaagggcuccucagcuccc

SEQ ID NO: 290492 - RNA, 22 nt, Human
cacaucccacagcaaggacuca

SEQ ID NO: 290493 - RNA, 19 nt, Human
cagcaaggacucagcccuc

SEQ ID NO: 290494 - RNA, 19 nt, Human
cagcucccucccuggacuc

SEQ ID NO: 290495 - RNA, 22 nt, Human
cccacagcaaggacucagcccu

SEQ ID NO: 290496 - RNA, 23 nt, Human
cggaagaauucaaagaggaaggg

SEQ ID NO: 290497 - RNA, 19 nt, Human
cuccucagcucccucccug

SEQ ID NO: 290498 - RNA, 19 nt, Human
cugggaaguugcaaagaaa

SEQ ID NO: 290499 - RNA, 20 nt, Human
gacucagcccucaacggcgg

SEQ ID NO: 290500 - RNA, 23 nt, Human
gaggggaguggugggaggguaag

SEQ ID NO: 290501 - RNA, 18 nt, Human
gcccucaacggcggcggc

SEQ ID NO: 290502 - RNA, 20 nt, Human
ggggaguggugggaggguaa

SEQ ID NO: 290503 - RNA, 25 nt, Human
gucaccccuucccccggaagaauuc

SEQ ID NO: 290504 - RNA, 22 nt, Human
ucaacggcggcggcugggucuu

SEQ ID NO: 290505 - RNA, 21 nt, Human
ucaccccuucccccggaagaa

SEQ ID NO: 290506 - RNA, 24 nt, Human
uccucagcucccucccuggacucc

SEQ ID NO: 290507 - RNA, 24 nt, Human
uggacucccaguucagucaccccu

SEQ ID NO: 290508 - RNA, 22 nt, Human
ugggaggggaguggugggaggg

SEQ ID NO: 290509 - RNA, 21 nt, Human
ugggaggguaagggcuccuca

SEQ ID NO: 290510 - RNA, 26 nt, Human
uggugggaggguaagggcuccucagc

SEQ ID NO: 290511 - RNA, 24 nt, Human
uguaacagagcccccaggaugaag

SEQ ID NO: 290512 - RNA, 19 nt, Human
uuauuguugcugggaaguu

SEQ ID NO: 290513 - RNA, 27 nt, Human
aaaaaacccaaaacaaaacuaaaaaca

SEQ ID NO: 290514 - RNA, 24 nt, Human
aaaaacagggaaaagcuuauaaaa

SEQ ID NO: 290515 - RNA, 24 nt, Human
aaaaacccaaaacaaaacuaaaaa

SEQ ID NO: 290516 - RNA, 24 nt, Human
aaaacaaaacuaaaaacagggaaa

SEQ ID NO: 290517 - RNA, 21 nt, Human
aaaaccuggaaucacugacca

SEQ ID NO: 290518 - RNA, 25 nt, Human
aaacagaaauaaaauucaugagcca

SEQ ID NO: 290519 - RNA, 24 nt, Human
aaccaauccguuuuuuaauucuua

SEQ ID NO: 290520 - RNA, 24 nt, Human
aagggguuauugagggaaccuaca

SEQ ID NO: 290521 - RNA, 20 nt, Human
acuaaaaacagggaaaagcu

SEQ ID NO: 290522 - RNA, 19 nt, Human
agaaagggguuauugaggg

SEQ ID NO: 290523 - RNA, 24 nt, Human
agcggcgggcggcguuccucgcgg

SEQ ID NO: 290524 - RNA, 21 nt, Human
aggcccaaaacuaccggcgcg

SEQ ID NO: 290525 - RNA, 23 nt, Human
agggguuauugagggaaccuaca

SEQ ID NO: 290526 - RNA, 18 nt, Human
augagccaaaaaacccaa

SEQ ID NO: 290527 - RNA, 18 nt, Human
caaaaaacccaaaacaaa

SEQ ID NO: 290528 - RNA, 23 nt, Human
caaaaaacccaaaacaaaacuaa

SEQ ID NO: 290529 - RNA, 23 nt, Human
caaaaaacccaaaacaaaacuaa

SEQ ID NO: 290530 - RNA, 20 nt, Human
caaaacaaaacuaaaaacag

SEQ ID NO: 290531 - RNA, 25 nt, Human
caaaacuaaaaacagggaaaagcuu

SEQ ID NO: 290532 - RNA, 19 nt, Human
cagcagaaagggguuauug

SEQ ID NO: 290533 - RNA, 23 nt, Human
cagggaaaagcuuauaaaacuaa

SEQ ID NO: 290534 - RNA, 22 nt, Human
ccaaaaaacccaaaacaaaacu

SEQ ID NO: 290535 - RNA, 23 nt, Human
ccaaaaaacccaaaacaaaacua

SEQ ID NO: 290536 - RNA, 26 nt, Human
ccaaaacaaaacuaaaaacagggaaa

SEQ ID NO: 290537 - RNA, 27 nt, Human
cggcgcgaggcgagcgaggaccgcggg

SEQ ID NO: 290538 - RNA, 24 nt, Human
gaacacuuacaaauuauuuaaaac

SEQ ID NO: 290539 - RNA, 24 nt, Human
gagccaaaaaacccaaaacaaaac

SEQ ID NO: 290540 - RNA, 25 nt, Human
gagcgagcgggagcgggcgggaguc

SEQ ID NO: 290541 - RNA, 23 nt, Human
gcgggagcgggcgggaguccgca

SEQ ID NO: 290542 - RNA, 21 nt, Human
ggagguguaggcccaaaacua

SEQ ID NO: 290543 - RNA, 25 nt, Human
ggcggggggaggggagguguaggcc

SEQ ID NO: 290544 - RNA, 21 nt, Human
uaaauucuugacauuacagaa

SEQ ID NO: 290545 - RNA, 21 nt, Human
uagaaacugaacacuuacaaa

SEQ ID NO: 290546 - RNA, 22 nt, Human
ugagccaaaaaacccaaaacaa

SEQ ID NO: 290547 - RNA, 22 nt, Human
uuaaauucuugacauuacagaa

SEQ ID NO: 290548 - RNA, 24 nt, Human
uucaugagccaaaaaacccaaaac

SEQ ID NO: 290549 - RNA, 18 nt, Human
acugguugggggugaaag

SEQ ID NO: 290550 - RNA, 18 nt, Human
agaaagggauuauggaug

SEQ ID NO: 290551 - RNA, 18 nt, Human
cagcagaaagggauuaug

SEQ ID NO: 290552 - RNA, 20 nt, Human
ccuggaaucgcugacuguuc

SEQ ID NO: 290553 - RNA, 23 nt, Human
cgcugacuguucagaaacuacac

SEQ ID NO: 290554 - RNA, 19 nt, Human
guagaaacugaaaauuuac

SEQ ID NO: 290555 - RNA, 20 nt, Human
gucacugguugggggugaaa

SEQ ID NO: 290556 - RNA, 19 nt, Human
uacacagauggaucauggg

SEQ ID NO: 290557 - RNA, 24 nt, Human
uagaaacugaaaauuuacaaacua

SEQ ID NO: 290558 - RNA, 20 nt, Human
ucaugggugguggugaacag

SEQ ID NO: 290559 - RNA, 19 nt, Human
ugaaagccaaaaacugcag

SEQ ID NO: 290560 - RNA, 22 nt, Human
uugaguggucaagucuuugguc

SEQ ID NO: 290561 - RNA, 22 nt, Human
cgccguccggcagcgaccagcg

SEQ ID NO: 290562 - RNA, 25 nt, Human
gugaugacugaaagguuauaaaucc

SEQ ID NO: 290563 - RNA, 23 nt, Human
uggaauaaaugacgacguaaacg

SEQ ID NO: 290564 - RNA, 20 nt, Human
aaaacauucagaaugucccc

SEQ ID NO: 290565 - RNA, 21 nt, Human
aaaagcccuucagggagccac

SEQ ID NO: 290566 - RNA, 21 nt, Human
aacccaauaauucacaagcac

SEQ ID NO: 290567 - RNA, 19 nt, Human
aaggggaaggggccccugg

SEQ ID NO: 290568 - RNA, 18 nt, Human
aaggggccccugggcugg

SEQ ID NO: 290569 - RNA, 19 nt, Human
agaaguacgcugcccaccc

SEQ ID NO: 290570 - RNA, 20 nt, Human
agagaaugucgaauagagag

SEQ ID NO: 290571 - RNA, 20 nt, Human
agagcuggaagaguuaggug

SEQ ID NO: 290572 - RNA, 21 nt, Human
aggaggcagugagauuugguu

SEQ ID NO: 290573 - RNA, 22 nt, Human
agggagccacugguggucaaga

SEQ ID NO: 290574 - RNA, 18 nt, Human
agggggugcucccuggaa

SEQ ID NO: 290575 - RNA, 19 nt, Human
agugaggcccuggaauggg

SEQ ID NO: 290576 - RNA, 20 nt, Human
auucagaaugucccccaccc

SEQ ID NO: 290577 - RNA, 22 nt, Human
caagaguuuccucugggagcuc

SEQ ID NO: 290578 - RNA, 21 nt, Human
cacccccgucccuaccccacc

SEQ ID NO: 290579 - RNA, 21 nt, Human
caccccuuaaauuuaccuuuc

SEQ ID NO: 290580 - RNA, 21 nt, Human
cacgggaaaacaaggccuccg

SEQ ID NO: 290581 - RNA, 19 nt, Human
cagaaugucccccaccccu

SEQ ID NO: 290582 - RNA, 22 nt, Human
cagcaagucuccaaugcugcca

SEQ ID NO: 290583 - RNA, 24 nt, Human
caugauggaucuaucaucuaucaa

SEQ ID NO: 290584 - RNA, 23 nt, Human
ccaaugcugccagccugggagau

SEQ ID NO: 290585 - RNA, 19 nt, Human
cccacccuugacuccacca

SEQ ID NO: 290586 - RNA, 20 nt, Human
ccccugggcugggagaugga

SEQ ID NO: 290587 - RNA, 23 nt, Human
ccccugggcugggagauggaaau

SEQ ID NO: 290588 - RNA, 28 nt, Human
cccgucccuaccccaccuuugguaacaa

SEQ ID NO: 290589 - RNA, 21 nt, Human
cccucuugggcaucagcuggg

SEQ ID NO: 290590 - RNA, 19 nt, Human
cccugcaugggagaagggc

SEQ ID NO: 290591 - RNA, 23 nt, Human
cccugcuucagggcuaaaauugg

SEQ ID NO: 290592 - RNA, 18 nt, Human
ccugacugaagcauagga

SEQ ID NO: 290593 - RNA, 19 nt, Human
cgcccuggucggccaugag

SEQ ID NO: 290594 - RNA, 18 nt, Human
cuccaccaucugcccaaa

SEQ ID NO: 290595 - RNA, 19 nt, Human
cugcccacccuugacucca

SEQ ID NO: 290596 - RNA, 26 nt, Human
cugcccacccuugacuccaccaucug

SEQ ID NO: 290597 - RNA, 22 nt, Human
cugcccuuuacugacauugucc

SEQ ID NO: 290598 - RNA, 20 nt, Human
cuggccggcgcugggggagg

SEQ ID NO: 290599 - RNA, 21 nt, Human
cuuagagcaaaaccaaggaaa

SEQ ID NO: 290600 - RNA, 21 nt, Human
cuugggcccuggcaggaaguc

SEQ ID NO: 290601 - RNA, 18 nt, Human
gaaacagaugacaguuuc

SEQ ID NO: 290602 - RNA, 18 nt, Human
gagaggaccuggacccug

SEQ ID NO: 290603 - RNA, 19 nt, Human
gagauuagcagaaccacag

SEQ ID NO: 290604 - RNA, 20 nt, Human
gagcaaaaccaaggaaagga

SEQ ID NO: 290605 - RNA, 21 nt, Human
gcucccuggaagucaagggaa

SEQ ID NO: 290606 - RNA, 18 nt, Human
ggaagggugauuuuucaa

SEQ ID NO: 290607 - RNA, 19 nt, Human
ggagauggaaaugagggga

SEQ ID NO: 290608 - RNA, 19 nt, Human
ggccuccgcuccacuccca

SEQ ID NO: 290609 - RNA, 21 nt, Human
gggaaggggccccugggcugg

SEQ ID NO: 290610 - RNA, 21 nt, Human
gggagauggaaaugaggggag

SEQ ID NO: 290611 - RNA, 24 nt, Human
gggcuccccaguucagcccugcuu

SEQ ID NO: 290612 - RNA, 22 nt, Human
ggggaaggggccccugggcugg

SEQ ID NO: 290613 - RNA, 21 nt, Human
gggguggagagugaggcccug

SEQ ID NO: 290614 - RNA, 18 nt, Human
ggguggagagugaggccc

SEQ ID NO: 290615 - RNA, 22 nt, Human
gucaagggaaggagcccaguca

SEQ ID NO: 290616 - RNA, 24 nt, Human
uaaaaacauucagaauguccccca

SEQ ID NO: 290617 - RNA, 18 nt, Human
uaaaaagaacuaucagug

SEQ ID NO: 290618 - RNA, 26 nt, Human
uaaaaagaacuaucagugaucaaagg

SEQ ID NO: 290619 - RNA, 24 nt, Human
uaacccaauaauucacaagcacaa

SEQ ID NO: 290620 - RNA, 22 nt, Human
uagcaaaacaauccaaagagaa

SEQ ID NO: 290621 - RNA, 24 nt, Human
uaggacuuagagcaaaaccaagga

SEQ ID NO: 290622 - RNA, 18 nt, Human
ucagggagccacuggugg

SEQ ID NO: 290623 - RNA, 21 nt, Human
uccaccaucugcccaaaucga

SEQ ID NO: 290624 - RNA, 21 nt, Human
ucccacccccgucccuacccc

SEQ ID NO: 290625 - RNA, 23 nt, Human
uggaaaugaggggagaggaccug

SEQ ID NO: 290626 - RNA, 19 nt, Human
uggaaugggcauuugggag

SEQ ID NO: 290627 - RNA, 18 nt, Human
uggcggaaacagaugaca

SEQ ID NO: 290628 - RNA, 20 nt, Human
ugggagaagggccagcgugg

SEQ ID NO: 290629 - RNA, 20 nt, Human
ugggagcucccagggaaagg

SEQ ID NO: 290630 - RNA, 23 nt, Human
ugggagcuggccggcgcuggggg

SEQ ID NO: 290631 - RNA, 23 nt, Human
uguccuaaaaacauucagaaugu

SEQ ID NO: 290632 - RNA, 26 nt, Human
uucaagauauaaaaagaacuaucagu

SEQ ID NO: 290633 - RNA, 20 nt, Human
uucagaaugucccccacccc

SEQ ID NO: 290634 - RNA, 22 nt, Human
uucagggagccacuggugguca

SEQ ID NO: 290635 - RNA, 18 nt, Human
uugggagcuggccggcgc

SEQ ID NO: 290636 - RNA, 19 nt, Human
uugguaacaaaagcccuuc

SEQ ID NO: 290637 - RNA, 20 nt, Human
uuucaggugaaaagaguggg

SEQ ID NO: 290638 - RNA, 25 nt, Human
aaaaaaacugaaaacaacaaacaaa

SEQ ID NO: 290639 - RNA, 20 nt, Human
aaaaaacugaaaacaacaaa

SEQ ID NO: 290640 - RNA, 23 nt, Human
aaaaacaacaaaaaauacuguac

SEQ ID NO: 290641 - RNA, 24 nt, Human
aaaaacaacaaaaaauacuguaca

SEQ ID NO: 290642 - RNA, 19 nt, Human
aaaaaggcuuccgcccgcu

SEQ ID NO: 290643 - RNA, 22 nt, Human
aaaaaucccuuagucuuauaga

SEQ ID NO: 290644 - RNA, 19 nt, Human
aaaacacaagaaaaaaucu

SEQ ID NO: 290645 - RNA, 18 nt, Human
aaaaucccaaauauccaa

SEQ ID NO: 290646 - RNA, 28 nt, Human
aaacaaaaaucaaaaagaaagcccaaaa

SEQ ID NO: 290647 - RNA, 27 nt, Human
aaacaaaauccuuuuuaaaacagaacc

SEQ ID NO: 290648 - RNA, 23 nt, Human
aaagaaacaaacaaaaaaaacua

SEQ ID NO: 290649 - RNA, 24 nt, Human
aaagaaacaaacaaaaaaaacuaa

SEQ ID NO: 290650 - RNA, 19 nt, Human
aaagcccaaaaaaaggcua

SEQ ID NO: 290651 - RNA, 20 nt, Human
aaaggcuuccgcccgcucca

SEQ ID NO: 290652 - RNA, 24 nt, Human
aaagugcugggauuacaggcguga

SEQ ID NO: 290653 - RNA, 24 nt, Human
aaagugcugggauuacagguguga

SEQ ID NO: 290654 - RNA, 24 nt, Human
aaauuuuaucaacaauauaguauu

SEQ ID NO: 290655 - RNA, 25 nt, Human
aacaaaaaucccuuagucuuauaga

SEQ ID NO: 290656 - RNA, 24 nt, Human
aacaaaaguuuagguaaacuaaag

SEQ ID NO: 290657 - RNA, 18 nt, Human
aacaacaaaaaaacugaa

SEQ ID NO: 290658 - RNA, 23 nt, Human
aacaacaaaaaaacugaaaacaa

SEQ ID NO: 290659 - RNA, 18 nt, Human
aacauagauaguaaccau

SEQ ID NO: 290660 - RNA, 25 nt, Human
aacauuuuuuucuuuuuggggggcc

SEQ ID NO: 290661 - RNA, 19 nt, Human
aaccaagaagagggugccc

SEQ ID NO: 290662 - RNA, 25 nt, Human
aacccgcacaacacugaccaaaaga

SEQ ID NO: 290663 - RNA, 18 nt, Human
aaccgcccccauuaaaca

SEQ ID NO: 290664 - RNA, 21 nt, Human
aacuaucaugugaaaagggga

SEQ ID NO: 290665 - RNA, 20 nt, Human
aagaaagcccaaaaaaaggc

SEQ ID NO: 290666 - RNA, 18 nt, Human
aagaagaaagauaagaaa

SEQ ID NO: 290667 - RNA, 19 nt, Human
aagaagaaagauaagaaau

SEQ ID NO: 290668 - RNA, 20 nt, Human
aagaagaaauuauuaagaag

SEQ ID NO: 290669 - RNA, 18 nt, Human
aagaagcagucaugugcc

SEQ ID NO: 290670 - RNA, 20 nt, Human
aagaagcagucaugugccuu

SEQ ID NO: 290671 - RNA, 18 nt, Human
aagaagccaacccuaaac

SEQ ID NO: 290672 - RNA, 24 nt, Human
aagaggaagaagaaauuauuaaga

SEQ ID NO: 290673 - RNA, 29 nt, Human
aagaggaagaagaaauuauuaagaagcca

SEQ ID NO: 290674 - RNA, 23 nt, Human
aagccaacccuaaacaugcaugu

SEQ ID NO: 290675 - RNA, 22 nt, Human
aaggccugguagaguauggggg

SEQ ID NO: 290676 - RNA, 18 nt, Human
aagugcugggauuacagg

SEQ ID NO: 290677 - RNA, 19 nt, Human
aagugcugggauuacaggc

SEQ ID NO: 290678 - RNA, 19 nt, Human
aagugcugggauuacaggc

SEQ ID NO: 290679 - RNA, 26 nt, Human
aagugcugggauuacaggcgugagcc

SEQ ID NO: 290680 - RNA, 19 nt, Human
aagugcugggauuacaggu

SEQ ID NO: 290681 - RNA, 26 nt, Human
aagugcugggauuacaggugugagcc

SEQ ID NO: 290682 - RNA, 21 nt, Human
aaguguccaccauugauaaau

SEQ ID NO: 290683 - RNA, 19 nt, Human
aaguuccuuccugauauuc

SEQ ID NO: 290684 - RNA, 23 nt, Human
aauaacagacaacagaagaaaac

SEQ ID NO: 290685 - RNA, 20 nt, Human
aauacauacucacaagugug

SEQ ID NO: 290686 - RNA, 20 nt, Human
aaugaaauaagauaccuaca

SEQ ID NO: 290687 - RNA, 21 nt, Human
aaugugugugugugugcacgu

SEQ ID NO: 290688 - RNA, 23 nt, Human
acaaaaaaacugaaaacaacaaa

SEQ ID NO: 290689 - RNA, 18 nt, Human
acaacaaaaaauacugua

SEQ ID NO: 290690 - RNA, 30 nt, Human
acaacaaacaaaaaucaaaaagaaagcccu

SEQ ID NO: 290691 - RNA, 18 nt, Human
acaacacuugaaauaucu

SEQ ID NO: 290692 - RNA, 22 nt, Human
acaugcaccuggaaaaccagua

SEQ ID NO: 290693 - RNA, 19 nt, Human
acccaggcuggagugcagu

SEQ ID NO: 290694 - RNA, 25 nt, Human
acccgccucggccucccaaagugcu

SEQ ID NO: 290695 - RNA, 22 nt, Human
acgccaggcuaauuuuuuguau

SEQ ID NO: 290696 - RNA, 22 nt, Human
acgugugugugugugugugugu

SEQ ID NO: 290697 - RNA, 23 nt, Human
acguguguguguguguguguguu

SEQ ID NO: 290698 - RNA, 20 nt, Human
acucccccccccaccccaac

SEQ ID NO: 290699 - RNA, 18 nt, Human
acucugauaguuaaaagu

SEQ ID NO: 290700 - RNA, 25 nt, Human
acugaaaacaacaaacaaaaaucaa

SEQ ID NO: 290701 - RNA, 19 nt, Human
acugaaccagaguguuuug

SEQ ID NO: 290702 - RNA, 18 nt, Human
acugcaagcuccgccucc

SEQ ID NO: 290703 - RNA, 23 nt, Human
acuggucuugaacuccugaccuc

SEQ ID NO: 290704 - RNA, 21 nt, Human
acuguagauuugaugcaccaa

SEQ ID NO: 290705 - RNA, 20 nt, Human
acuguuucugcuguugucaa

SEQ ID NO: 290706 - RNA, 23 nt, Human
agaaaaacaagaauagcuauuaa

SEQ ID NO: 290707 - RNA, 27 nt, Human
agaaacagcaugagaguaccgguaccc

SEQ ID NO: 290708 - RNA, 23 nt, Human
agaagaggagagagagaagagga

SEQ ID NO: 290709 - RNA, 21 nt, Human
agaaggaaggcauaggggaga

SEQ ID NO: 290710 - RNA, 25 nt, Human
agaaugaagagguaaacgaaaggga

SEQ ID NO: 290711 - RNA, 20 nt, Human
agagcagcugaggcaaaacc

SEQ ID NO: 290712 - RNA, 24 nt, Human
agaggaagaagaaauuauuaagaa

SEQ ID NO: 290713 - RNA, 25 nt, Human
agauauugacucccccccccacccc

SEQ ID NO: 290714 - RNA, 18 nt, Human
agcagcugaggcaaaacc

SEQ ID NO: 290715 - RNA, 20 nt, Human
agccaccacacccagccaaa

SEQ ID NO: 290716 - RNA, 21 nt, Human
agccagugccgagccagcccu

SEQ ID NO: 290717 - RNA, 24 nt, Human
agcuccgccucccggguucacgcu

SEQ ID NO: 290718 - RNA, 21 nt, Human
aggaagaagaaauuauuaaga

SEQ ID NO: 290719 - RNA, 22 nt, Human
aggaagaagaaauuauuaagaa

SEQ ID NO: 290720 - RNA, 20 nt, Human
aggaaggcauaggggagaau

SEQ ID NO: 290721 - RNA, 20 nt, Human
aggaaucauuauaaaggagg

SEQ ID NO: 290722 - RNA, 21 nt, Human
aggaaucauuauaaaggaggg

SEQ ID NO: 290723 - RNA, 21 nt, Human
aggauuuaagaaccucccuag

SEQ ID NO: 290724 - RNA, 24 nt, Human
aggcaaaaccucuccgguaugugg

SEQ ID NO: 290725 - RNA, 25 nt, Human
aggcuggagugcaguggcgccaucu

SEQ ID NO: 290726 - RNA, 24 nt, Human
aggugauccacccaccucggccuc

SEQ ID NO: 290727 - RNA, 18 nt, Human
aguagcugggacuacagg

SEQ ID NO: 290728 - RNA, 22 nt, Human
agugaaaaaaaauugaucugga

SEQ ID NO: 290729 - RNA, 20 nt, Human
agugcaguggcgccaucucg

SEQ ID NO: 290730 - RNA, 24 nt, Human
agugcaguggcgccaucucggcuc

SEQ ID NO: 290731 - RNA, 18 nt, Human
agugcugggauuacaggc

SEQ ID NO: 290732 - RNA, 19 nt, Human
agugguuuucuucaguaag

SEQ ID NO: 290733 - RNA, 24 nt, Human
aguuuauguuacaaaauuuacaca

SEQ ID NO: 290734 - RNA, 23 nt, Human
auaaaguuugauuugaagaagag

SEQ ID NO: 290735 - RNA, 27 nt, Human
auaagaaaaacaagaauagcuauuaau

SEQ ID NO: 290736 - RNA, 24 nt, Human
auacaucacaauagccacuugugu

SEQ ID NO: 290737 - RNA, 18 nt, Human
auagaacaauuaauacaa

SEQ ID NO: 290738 - RNA, 22 nt, Human
auagauuuaguauaugguuuua

SEQ ID NO: 290739 - RNA, 20 nt, Human
auaucugaauuaaaacccac

SEQ ID NO: 290740 - RNA, 18 nt, Human
aucauggcuguugauuca

SEQ ID NO: 290741 - RNA, 23 nt, Human
augaaaaagaaacaaacaaaaaa

SEQ ID NO: 290742 - RNA, 18 nt, Human
augaaaagaaacuuucuc

SEQ ID NO: 290743 - RNA, 21 nt, Human
auggacacaaaauagaauaac

SEQ ID NO: 290744 - RNA, 20 nt, Human
augggguuucaccguguuag

SEQ ID NO: 290745 - RNA, 19 nt, Human
augguuuuuguucugugug

SEQ ID NO: 290746 - RNA, 22 nt, Human
augugugugugugugcacgugu

SEQ ID NO: 290747 - RNA, 24 nt, Human
auuuaaaucuuccugaguuucucu

SEQ ID NO: 290748 - RNA, 22 nt, Human
auuucauucucuggcuuaaaga

SEQ ID NO: 290749 - RNA, 25 nt, Human
auuucauucucuggcuuaaagauga

SEQ ID NO: 290750 - RNA, 19 nt, Human
caaaacacugaaccagagu

SEQ ID NO: 290751 - RNA, 19 nt, Human
caaaaccucuccgguaugu

SEQ ID NO: 290752 - RNA, 28 nt, Human
caaacucugauaguuaaaaguuaagaag

SEQ ID NO: 290753 - RNA, 24 nt, Human
caaagugcugggauuacaggcgug

SEQ ID NO: 290754 - RNA, 24 nt, Human
caaagugcugggauuacaggugug

SEQ ID NO: 290755 - RNA, 23 nt, Human
caacaaaaaaacugaaaacaaca

SEQ ID NO: 290756 - RNA, 25 nt, Human
caacaacaaaaaaacugaaaacaac

SEQ ID NO: 290757 - RNA, 22 nt, Human
caacacgaaggagaaaaaacau

SEQ ID NO: 290758 - RNA, 23 nt, Human
caacacugaccaaaagaagagga

SEQ ID NO: 290759 - RNA, 19 nt, Human
caaguaauugcauguuuca

SEQ ID NO: 290760 - RNA, 26 nt, Human
cacaacacugaccaaaagaagaggag

SEQ ID NO: 290761 - RNA, 22 nt, Human
cacccaccucggccucccaaag

SEQ ID NO: 290762 - RNA, 23 nt, Human
cacccaccucggccucccaaagu

SEQ ID NO: 290763 - RNA, 19 nt, Human
cacccagccaaaaauaacu

SEQ ID NO: 290764 - RNA, 24 nt, Human
cacccaggcuggagugcaguggcg

SEQ ID NO: 290765 - RNA, 22 nt, Human
caccccaaccgcccccauuaaa

SEQ ID NO: 290766 - RNA, 23 nt, Human
caccccaaccgcccccauuaaac

SEQ ID NO: 290767 - RNA, 23 nt, Human
cacccgccucggccucccaaagu

SEQ ID NO: 290768 - RNA, 18 nt, Human
caccguguuagccaggau

SEQ ID NO: 290769 - RNA, 24 nt, Human
caccguguuagccaggauggucuc

SEQ ID NO: 290770 - RNA, 24 nt, Human
caccucggccucccaaagugcugg

SEQ ID NO: 290771 - RNA, 22 nt, Human
cacgcuauucuccugccucagc

SEQ ID NO: 290772 - RNA, 18 nt, Human
cacggagacugcgacugc

SEQ ID NO: 290773 - RNA, 24 nt, Human
cacgugugugugugugugugugag

SEQ ID NO: 290774 - RNA, 23 nt, Human
cacgugugugugugugugugugu

SEQ ID NO: 290775 - RNA, 23 nt, Human
cacgugugugugugugugugugu

SEQ ID NO: 290776 - RNA, 19 nt, Human
cacuaacaacaacaaaaaa

SEQ ID NO: 290777 - RNA, 20 nt, Human
cacuaacaacaacaaaaaaa

SEQ ID NO: 290778 - RNA, 25 nt, Human
cacugaaccagaguguuuugguuuu

SEQ ID NO: 290779 - RNA, 26 nt, Human
cauacaucacaauagccacuugugug

SEQ ID NO: 290780 - RNA, 26 nt, Human
cauucaaaauaguuucuaauggucau

SEQ ID NO: 290781 - RNA, 21 nt, Human
ccaaagugcugggauuacagg

SEQ ID NO: 290782 - RNA, 21 nt, Human
ccaaagugcugggauuacagg

SEQ ID NO: 290783 - RNA, 22 nt, Human
ccaaagugcugggauuacaggc

SEQ ID NO: 290784 - RNA, 22 nt, Human
ccaaagugcugggauuacaggc

SEQ ID NO: 290785 - RNA, 24 nt, Human
ccaaagugcugggauuacaggcgu

SEQ ID NO: 290786 - RNA, 24 nt, Human
ccaaagugcugggauuacaggugu

SEQ ID NO: 290787 - RNA, 28 nt, Human
ccaacccuaaacaugcauguuaacaaaa

SEQ ID NO: 290788 - RNA, 25 nt, Human
ccaagacagccuuauauuacaucau

SEQ ID NO: 290789 - RNA, 22 nt, Human
ccaccgcgcccggcccacucaa

SEQ ID NO: 290790 - RNA, 19 nt, Human
ccccaccccaaccgccccc

SEQ ID NO: 290791 - RNA, 20 nt, Human
ccccccaccccaaccgcccc

SEQ ID NO: 290792 - RNA, 26 nt, Human
ccccccaccccaaccgcccccauuaa

SEQ ID NO: 290793 - RNA, 19 nt, Human
ccccccccaccccaaccgc

SEQ ID NO: 290794 - RNA, 20 nt, Human
cccccccccaccccaaccgc

SEQ ID NO: 290795 - RNA, 22 nt, Human
cccccccccaccccaaccgccc

SEQ ID NO: 290796 - RNA, 23 nt, Human
cccgaguagcugggacuacaggc

SEQ ID NO: 290797 - RNA, 24 nt, Human
cccgaguagcugggacuacaggcg

SEQ ID NO: 290798 - RNA, 22 nt, Human
cccgcacaacacugaccaaaag

SEQ ID NO: 290799 - RNA, 24 nt, Human
cccuuuguguugaaguuuuuuuca

SEQ ID NO: 290800 - RNA, 18 nt, Human
ccgggcugccugugcugc

SEQ ID NO: 290801 - RNA, 24 nt, Human
ccugaccucaggugauccacccac

SEQ ID NO: 290802 - RNA, 20 nt, Human
ccugaccucgugauccaccc

SEQ ID NO: 290803 - RNA, 23 nt, Human
ccugccucagccucccgaguagc

SEQ ID NO: 290804 - RNA, 21 nt, Human
ccuuauauuacaucauggcug

SEQ ID NO: 290805 - RNA, 20 nt, Human
ccuuggaacauuaacaacac

SEQ ID NO: 290806 - RNA, 18 nt, Human
cgaaagggagaaaaaagg

SEQ ID NO: 290807 - RNA, 18 nt, Human
cgacaguucgccgacugc

SEQ ID NO: 290808 - RNA, 18 nt, Human
cgcccgcuccacggagac

SEQ ID NO: 290809 - RNA, 19 nt, Human
cgccucccggguucacgcu

SEQ ID NO: 290810 - RNA, 21 nt, Human
cgcuccacggagacugcgacu

SEQ ID NO: 290811 - RNA, 20 nt, Human
cguucaguccucauagugcu

SEQ ID NO: 290812 - RNA, 25 nt, Human
cuacaggcgcccgccaccacgccag

SEQ ID NO: 290813 - RNA, 24 nt, Human
cucagccucccgaguagcugggac

SEQ ID NO: 290814 - RNA, 23 nt, Human
cucauagugcucugcaaucagcc

SEQ ID NO: 290815 - RNA, 23 nt, Human
cucaugcacacaaugguacugag

SEQ ID NO: 290816 - RNA, 24 nt, Human
cucccccccccaccccaaccgccc

SEQ ID NO: 290817 - RNA, 21 nt, Human
cucccggguucacgcuauucu

SEQ ID NO: 290818 - RNA, 24 nt, Human
cucccucugcauuuuuccuuaaaa

SEQ ID NO: 290819 - RNA, 24 nt, Human
cuccugaccucgugauccacccgc

SEQ ID NO: 290820 - RNA, 21 nt, Human
cucgcaguccgcagagcagcc

SEQ ID NO: 290821 - RNA, 26 nt, Human
cugaaaacaacaaacaaaaaucaaaa

SEQ ID NO: 290822 - RNA, 21 nt, Human
cugaaaagcuuuaaugugaug

SEQ ID NO: 290823 - RNA, 21 nt, Human
cugaagcccuagaaguaacag

SEQ ID NO: 290824 - RNA, 18 nt, Human
cugcacugucucuuccau

SEQ ID NO: 290825 - RNA, 23 nt, Human
cugccucagccucccgaguagcu

SEQ ID NO: 290826 - RNA, 21 nt, Human
cugugcugccugugucgccgc

SEQ ID NO: 290827 - RNA, 20 nt, Human
cuuaaaaaugucucuugccc

SEQ ID NO: 290828 - RNA, 18 nt, Human
cuucccacaauacaaaca

SEQ ID NO: 290829 - RNA, 24 nt, Human
cuugcucugucacccaggcuggag

SEQ ID NO: 290830 - RNA, 22 nt, Human
gaaagcacaagguucacuagga

SEQ ID NO: 290831 - RNA, 21 nt, Human
gaaauaacagacaacagaaga

SEQ ID NO: 290832 - RNA, 18 nt, Human
gaaucauuauaaaggagg

SEQ ID NO: 290833 - RNA, 24 nt, Human
gacacaauauuaguuaaaacacag

SEQ ID NO: 290834 - RNA, 24 nt, Human
gaccucaggugauccacccaccuc

SEQ ID NO: 290835 - RNA, 22 nt, Human
gaccucgugauccacccgccuc

SEQ ID NO: 290836 - RNA, 22 nt, Human
gaccucgugauccacccgccuc

SEQ ID NO: 290837 - RNA, 24 nt, Human
gaccucgugauccacccgccucgg

SEQ ID NO: 290838 - RNA, 24 nt, Human
gacuggucuugaacuccugaccuc

SEQ ID NO: 290839 - RNA, 24 nt, Human
gagacucacuaacaacaacaaaaa

SEQ ID NO: 290840 - RNA, 18 nt, Human
gagaugggguuucaccgu

SEQ ID NO: 290841 - RNA, 24 nt, Human
gagaugggguuucaccguguuagc

SEQ ID NO: 290842 - RNA, 20 nt, Human
gaguagcugggacuacaggc

SEQ ID NO: 290843 - RNA, 25 nt, Human
gaguagcugggacuacaggcgcccg

SEQ ID NO: 290844 - RNA, 18 nt, Human
gauuacaggcgugagcca

SEQ ID NO: 290845 - RNA, 22 nt, Human
gauuacaggcgugagccaccgc

SEQ ID NO: 290846 - RNA, 22 nt, Human
gauuacaggcgugagccaccgc

SEQ ID NO: 290847 - RNA, 18 nt, Human
gauuacaggugugagcca

SEQ ID NO: 290848 - RNA, 21 nt, Human
gauuacaggugugagccacca

SEQ ID NO: 290849 - RNA, 22 nt, Human
gauuacaggugugagccaccac

SEQ ID NO: 290850 - RNA, 22 nt, Human
gcaaacagagaaacagcaugag

SEQ ID NO: 290851 - RNA, 18 nt, Human
gcaccuggaaaaccagua

SEQ ID NO: 290852 - RNA, 26 nt, Human
gcacuaaccauuuauuauuauuuucu

SEQ ID NO: 290853 - RNA, 18 nt, Human
gccaggcuaauuuuuugu

SEQ ID NO: 290854 - RNA, 25 nt, Human
gccucccggguucacgcuauucucc

SEQ ID NO: 290855 - RNA, 23 nt, Human
gccucggccucccaaagugcugg

SEQ ID NO: 290856 - RNA, 18 nt, Human
gccugguagaguaugggg

SEQ ID NO: 290857 - RNA, 25 nt, Human
gcucugucacccaggcuggagugca

SEQ ID NO: 290858 - RNA, 18 nt, Human
gcugagguuguuucugag

SEQ ID NO: 290859 - RNA, 20 nt, Human
gcuggagugcaguggcgcca

SEQ ID NO: 290860 - RNA, 19 nt, Human
ggacuacaggcuuaaaaug

SEQ ID NO: 290861 - RNA, 20 nt, Human
ggagaggagagggguugaug

SEQ ID NO: 290862 - RNA, 19 nt, Human
ggagaugggguuucaccgu

SEQ ID NO: 290863 - RNA, 24 nt, Human
ggauggucucaaucuccugaccuc

SEQ ID NO: 290864 - RNA, 22 nt, Human
gggguuucaccguguuagccag

SEQ ID NO: 290865 - RNA, 24 nt, Human
ggguugaugugacuaaugccuaaa

SEQ ID NO: 290866 - RNA, 19 nt, Human
ggucuugaacuccugaccu

SEQ ID NO: 290867 - RNA, 18 nt, Human
gguucauuccuauaucau

SEQ ID NO: 290868 - RNA, 18 nt, Human
gguuuuguuuuuuguuug

SEQ ID NO: 290869 - RNA, 24 nt, Human
gugauccacccaccucggccuccc

SEQ ID NO: 290870 - RNA, 24 nt, Human
gugauccacccgccucggccuccc

SEQ ID NO: 290871 - RNA, 30 nt, Human
gugugcacgugugugugugugugugugugg

SEQ ID NO: 290872 - RNA, 18 nt, Human
guuaaauuccuuuucuuu

SEQ ID NO: 290873 - RNA, 21 nt, Human
guuauugugcugcacugucuc

SEQ ID NO: 290874 - RNA, 18 nt, Human
uaaaacacagguaaaguu

SEQ ID NO: 290875 - RNA, 21 nt, Human
uaaaacagaaccauuuuuuga

SEQ ID NO: 290876 - RNA, 19 nt, Human
uaaagaaagcacaagguuc

SEQ ID NO: 290877 - RNA, 25 nt, Human
uaaauacacauucugaauuaaacaa

SEQ ID NO: 290878 - RNA, 21 nt, Human
uaaaugugugugugugugcac

SEQ ID NO: 290879 - RNA, 20 nt, Human
uaacagacaacagaagaaaa

SEQ ID NO: 290880 - RNA, 24 nt, Human
uaacagacaacagaagaaaacuaa

SEQ ID NO: 290881 - RNA, 21 nt, Human
uaacagguuuccaaggccaga

SEQ ID NO: 290882 - RNA, 19 nt, Human
uaacauagauaguaaccau

SEQ ID NO: 290883 - RNA, 21 nt, Human
uaagaaaaacaagaauagcua

SEQ ID NO: 290884 - RNA, 18 nt, Human
uaagaauacacaaaauua

SEQ ID NO: 290885 - RNA, 20 nt, Human
uaagaauacacaaaauuacu

SEQ ID NO: 290886 - RNA, 19 nt, Human
uaagucugauuauaaaauc

SEQ ID NO: 290887 - RNA, 19 nt, Human
uaaguguauacaccaagac

SEQ ID NO: 290888 - RNA, 22 nt, Human
uaauaaacauucaaauaucauc

SEQ ID NO: 290889 - RNA, 20 nt, Human
uaaugugauguaucuagccc

SEQ ID NO: 290890 - RNA, 24 nt, Human
uaauuuuuuguauuuuuaguggag

SEQ ID NO: 290891 - RNA, 25 nt, Human
uaauuuuuuguauuuuuaguggaga

SEQ ID NO: 290892 - RNA, 23 nt, Human
uacaggcgugagccaccgcgccc

SEQ ID NO: 290893 - RNA, 24 nt, Human
uacaggugugagccaccacaccca

SEQ ID NO: 290894 - RNA, 23 nt, Human
uacaguaucaaaaaugacacaga

SEQ ID NO: 290895 - RNA, 23 nt, Human
uacaguuuguuguauuaacccgc

SEQ ID NO: 290896 - RNA, 23 nt, Human
uacaguuuguuguauuaacccgc

SEQ ID NO: 290897 - RNA, 18 nt, Human
uaccauagcuagaaaauu

SEQ ID NO: 290898 - RNA, 23 nt, Human
uaccaugaaaaagaaacaaacaa

SEQ ID NO: 290899 - RNA, 24 nt, Human
uaccaugaaaaagaaacaaacaaa

SEQ ID NO: 290900 - RNA, 20 nt, Human
uaccuaaacuaacuauaaau

SEQ ID NO: 290901 - RNA, 22 nt, Human
uagaauaacaaaaaucccuuag

SEQ ID NO: 290902 - RNA, 21 nt, Human
uaguggagaugggguuucacc

SEQ ID NO: 290903 - RNA, 24 nt, Human
uaguggagaugggguuucaccgug

SEQ ID NO: 290904 - RNA, 26 nt, Human
uaguggagaugggguuucaccguguu

SEQ ID NO: 290905 - RNA, 25 nt, Human
uauguuagugaauauuuucaaaaca

SEQ ID NO: 290906 - RNA, 21 nt, Human
uauuaagaagccaacccuaaa

SEQ ID NO: 290907 - RNA, 19 nt, Human
uauucuccugccucagccu

SEQ ID NO: 290908 - RNA, 24 nt, Human
uauucugcauccaauuuuccuaaa

SEQ ID NO: 290909 - RNA, 26 nt, Human
ucaaagugaaaaaaaauugaucugga

SEQ ID NO: 290910 - RNA, 21 nt, Human
ucaacaucaacaauagccaca

SEQ ID NO: 290911 - RNA, 22 nt, Human
ucaacaucaacaauagccacaa

SEQ ID NO: 290912 - RNA, 21 nt, Human
ucaaccuucuuacuuccaaag

SEQ ID NO: 290913 - RNA, 24 nt, Human
ucacccaggcuggagugcaguggc

SEQ ID NO: 290914 - RNA, 24 nt, Human
ucaccguguuagccaggauggucu

SEQ ID NO: 290915 - RNA, 18 nt, Human
ucacugcaagcuccgccu

SEQ ID NO: 290916 - RNA, 19 nt, Human
ucacugcaagcuccgccuc

SEQ ID NO: 290917 - RNA, 24 nt, Human
ucacugcaagcuccgccucccggg

SEQ ID NO: 290918 - RNA, 19 nt, Human
ucacuuacaaucacuaaac

SEQ ID NO: 290919 - RNA, 19 nt, Human
ucagagaguaguuuggcua

SEQ ID NO: 290920 - RNA, 23 nt, Human
ucagccucccgaguagcugggac

SEQ ID NO: 290921 - RNA, 20 nt, Human
ucaggugauccacccaccuc

SEQ ID NO: 290922 - RNA, 21 nt, Human
ucaguaauaccaugaaaaaga

SEQ ID NO: 290923 - RNA, 23 nt, Human
uccaacuuugaguccuauuugau

SEQ ID NO: 290924 - RNA, 23 nt, Human
ucccaaagugcugggauuacagg

SEQ ID NO: 290925 - RNA, 24 nt, Human
ucccaaagugcugggauuacaggc

SEQ ID NO: 290926 - RNA, 18 nt, Human
ucccagaaguaaagaccu

SEQ ID NO: 290927 - RNA, 27 nt, Human
uccccaaguuuaaaauuuucaaccagg

SEQ ID NO: 290928 - RNA, 28 nt, Human
uccccaaguuuaaaauuuucaaccaggc

SEQ ID NO: 290929 - RNA, 24 nt, Human
ucccgaguagcugggacuacaggc

SEQ ID NO: 290930 - RNA, 21 nt, Human
ucccggguucacgcuauucuc

SEQ ID NO: 290931 - RNA, 24 nt, Human
ucccggguucacgcuauucuccug

SEQ ID NO: 290932 - RNA, 21 nt, Human
uccuaaucugaaaacgacacu

SEQ ID NO: 290933 - RNA, 18 nt, Human
uccucaccaaugaaauua

SEQ ID NO: 290934 - RNA, 21 nt, Human
uccucaugcacacaaugguac

SEQ ID NO: 290935 - RNA, 23 nt, Human
ucgcaguccgcagagcagccgga

SEQ ID NO: 290936 - RNA, 18 nt, Human
ucggccucccaaagugcu

SEQ ID NO: 290937 - RNA, 24 nt, Human
ucuaccaaacuuaauugaauccau

SEQ ID NO: 290938 - RNA, 24 nt, Human
ucuccugccucagccucccgagua

SEQ ID NO: 290939 - RNA, 19 nt, Human
ucucuggcuuaaagaugag

SEQ ID NO: 290940 - RNA, 22 nt, Human
ucucuggcuuaaagaugagaau

SEQ ID NO: 290941 - RNA, 18 nt, Human
ucucuuggcaaugaauaa

SEQ ID NO: 290942 - RNA, 24 nt, Human
ucugucacccaggcuggagugcag

SEQ ID NO: 290943 - RNA, 23 nt, Human
ucuugaacuccugaccucaggug

SEQ ID NO: 290944 - RNA, 22 nt, Human
ucuugcucugucacccaggcug

SEQ ID NO: 290945 - RNA, 23 nt, Human
ucuugcucugucacccaggcugg

SEQ ID NO: 290946 - RNA, 24 nt, Human
ucuugcucugucacccaggcugga

SEQ ID NO: 290947 - RNA, 21 nt, Human
ugaaaacgcuacuuaaccugc

SEQ ID NO: 290948 - RNA, 22 nt, Human
ugaauacauacucacaagugug

SEQ ID NO: 290949 - RNA, 22 nt, Human
ugacagcagagagacacaaaca

SEQ ID NO: 290950 - RNA, 21 nt, Human
ugaccucaggugauccaccca

SEQ ID NO: 290951 - RNA, 24 nt, Human
ugaccucaggugauccacccaccu

SEQ ID NO: 290952 - RNA, 18 nt, Human
ugacucccccccccaccc

SEQ ID NO: 290953 - RNA, 19 nt, Human
ugacucccccccccacccc

SEQ ID NO: 290954 - RNA, 18 nt, Human
ugagacagagucuugcuc

SEQ ID NO: 290955 - RNA, 22 nt, Human
ugagacagagucuugcucuguc

SEQ ID NO: 290956 - RNA, 26 nt, Human
ugagcuagaauaacaaaaaucccuua

SEQ ID NO: 290957 - RNA, 19 nt, Human
ugaguacaaucaacauaaa

SEQ ID NO: 290958 - RNA, 22 nt, Human
ugauaaaaacaacaaaaaauac

SEQ ID NO: 290959 - RNA, 24 nt, Human
ugauccacccaccucggccuccca

SEQ ID NO: 290960 - RNA, 20 nt, Human
ugaucuguggaauccuucuu

SEQ ID NO: 290961 - RNA, 23 nt, Human
ugauucagagcaaacagagaaac

SEQ ID NO: 290962 - RNA, 20 nt, Human
ugauuuguuuagucuauuuu

SEQ ID NO: 290963 - RNA, 20 nt, Human
ugcaauacagaaccugaaau

SEQ ID NO: 290964 - RNA, 22 nt, Human
ugcacauacauuuuucugagca

SEQ ID NO: 290965 - RNA, 21 nt, Human
ugcacgugugugugugugugu

SEQ ID NO: 290966 - RNA, 18 nt, Human
ugcagagagaaaauguga

SEQ ID NO: 290967 - RNA, 19 nt, Human
ugccaucuacagacaaaau

SEQ ID NO: 290968 - RNA, 24 nt, Human
ugccucagccucccgaguagcugg

SEQ ID NO: 290969 - RNA, 18 nt, Human
ugcgacugcuguagcggg

SEQ ID NO: 290970 - RNA, 24 nt, Human
ugcucugucacccaggcuggagug

SEQ ID NO: 290971 - RNA, 24 nt, Human
ugcugggauuacaggcgugagcca

SEQ ID NO: 290972 - RNA, 24 nt, Human
ugcugggauuacaggugugagcca

SEQ ID NO: 290973 - RNA, 22 nt, Human
ugcuguugucaacuugaacugc

SEQ ID NO: 290974 - RNA, 20 nt, Human
uggaacagcaugaguacaau

SEQ ID NO: 290975 - RNA, 20 nt, Human
uggaagaaaauuaaguuggu

SEQ ID NO: 290976 - RNA, 18 nt, Human
uggacuacaggcuuaaaa

SEQ ID NO: 290977 - RNA, 28 nt, Human
uggagugcaguggcgccauccuagcacg

SEQ ID NO: 290978 - RNA, 23 nt, Human
uggagugcaguggcgccaucucg

SEQ ID NO: 290979 - RNA, 24 nt, Human
uggagugcaguggcgccaucucgg

SEQ ID NO: 290980 - RNA, 18 nt, Human
uggauaccuuucagagag

SEQ ID NO: 290981 - RNA, 24 nt, Human
uggccagacuggucuugaacuccu

SEQ ID NO: 290982 - RNA, 21 nt, Human
ugggacuacaggcgcccgcca

SEQ ID NO: 290983 - RNA, 22 nt, Human
ugggacuacaggcgcccgccac

SEQ ID NO: 290984 - RNA, 24 nt, Human
ugggacuacaggcgcccgccacca

SEQ ID NO: 290985 - RNA, 20 nt, Human
ugggagaggagagggguuga

SEQ ID NO: 290986 - RNA, 18 nt, Human
ugggauuacaggcgugag

SEQ ID NO: 290987 - RNA, 19 nt, Human
ugggauuacaggcgugagc

SEQ ID NO: 290988 - RNA, 21 nt, Human
ugggauuacaggcgugagcca

SEQ ID NO: 290989 - RNA, 22 nt, Human
ugggauuacaggcgugagccac

SEQ ID NO: 290990 - RNA, 23 nt, Human
ugggauuacaggcgugagccacc

SEQ ID NO: 290991 - RNA, 24 nt, Human
ugggauuacaggcgugagccaccg

SEQ ID NO: 290992 - RNA, 18 nt, Human
ugggauuacaggugugag

SEQ ID NO: 290993 - RNA, 19 nt, Human
ugggauuacaggugugagc

SEQ ID NO: 290994 - RNA, 22 nt, Human
ugggauuacaggugugagccac

SEQ ID NO: 290995 - RNA, 23 nt, Human
ugggauuacaggugugagccacc

SEQ ID NO: 290996 - RNA, 24 nt, Human
ugggauuacaggugugagccacca

SEQ ID NO: 290997 - RNA, 24 nt, Human
ugggguuucaccguguuagccagg

SEQ ID NO: 290998 - RNA, 19 nt, Human
ugguucauuccuauaucau

SEQ ID NO: 290999 - RNA, 19 nt, Human
uguaacugcuaccauuaca

SEQ ID NO: 291000 - RNA, 20 nt, Human
uguaggacuacauacaucau

SEQ ID NO: 291001 - RNA, 21 nt, Human
uguauuaacccgcacaacacu

SEQ ID NO: 291002 - RNA, 21 nt, Human
uguauuaacccgcacaacacu

SEQ ID NO: 291003 - RNA, 21 nt, Human
uguauuuuuaguggagauggg

SEQ ID NO: 291004 - RNA, 21 nt, Human
ugugcacgugugugugugugu

SEQ ID NO: 291005 - RNA, 21 nt, Human
ugugugcacgugugugugugu

SEQ ID NO: 291006 - RNA, 24 nt, Human
ugugugcacgugugugugugugug

SEQ ID NO: 291007 - RNA, 21 nt, Human
ugugugugcacgugugugugu

SEQ ID NO: 291008 - RNA, 21 nt, Human
ugugugugcacgugugugugu

SEQ ID NO: 291009 - RNA, 21 nt, Human
ugugugugcacgugugugugu

SEQ ID NO: 291010 - RNA, 21 nt, Human
ugugugugcacgugugugugu

SEQ ID NO: 291011 - RNA, 24 nt, Human
ugugugugcacgugugugugugug

SEQ ID NO: 291012 - RNA, 20 nt, Human
ugugugugugcacgugugug

SEQ ID NO: 291013 - RNA, 20 nt, Human
ugugugugugugugcacgug

SEQ ID NO: 291014 - RNA, 23 nt, Human
ugugugugugugugcacgugugu

SEQ ID NO: 291015 - RNA, 23 nt, Human
ugugugugugugugcacgugugu

SEQ ID NO: 291016 - RNA, 19 nt, Human
uguguguguguguguguag

SEQ ID NO: 291017 - RNA, 18 nt, Human
ugugugugugugugugug

SEQ ID NO: 291018 - RNA, 18 nt, Human
ugugugugugugugugug

SEQ ID NO: 291019 - RNA, 25 nt, Human
uuaacaaaaacuguuuuaaauuaaa

SEQ ID NO: 291020 - RNA, 24 nt, Human
uuaauugaauccauauaucuauug

SEQ ID NO: 291021 - RNA, 24 nt, Human
uuacacacaguuuaaucauaaauu

SEQ ID NO: 291022 - RNA, 18 nt, Human
uuacugaacacccuuugg

SEQ ID NO: 291023 - RNA, 19 nt, Human
uuacuguacaaggggaugc

SEQ ID NO: 291024 - RNA, 18 nt, Human
uuaguggagaugggguuu

SEQ ID NO: 291025 - RNA, 22 nt, Human
uuaguggagaugggguuucacc

SEQ ID NO: 291026 - RNA, 24 nt, Human
uuaguggagaugggguuucaccgu

SEQ ID NO: 291027 - RNA, 21 nt, Human
uucaaaacacugaaccagagu

SEQ ID NO: 291028 - RNA, 22 nt, Human
uucaauauauucucuagcaaga

SEQ ID NO: 291029 - RNA, 21 nt, Human
uucacgcuauucuccugccuc

SEQ ID NO: 291030 - RNA, 18 nt, Human
uucagagcaaacagagaa

SEQ ID NO: 291031 - RNA, 19 nt, Human
uuccauugccagauuacag

SEQ ID NO: 291032 - RNA, 21 nt, Human
uucccagaaguaaagacccaa

SEQ ID NO: 291033 - RNA, 21 nt, Human
uuccugaguuucucuacaaaa

SEQ ID NO: 291034 - RNA, 21 nt, Human
uucuuuguuauaauauggguu

SEQ ID NO: 291035 - RNA, 20 nt, Human
uugacucccccccccacccc

SEQ ID NO: 291036 - RNA, 24 nt, Human
uugcucugucacccaggcuggagu

SEQ ID NO: 291037 - RNA, 22 nt, Human
uuggaacauuaacaacacgaag

SEQ ID NO: 291038 - RNA, 24 nt, Human
uuggaacauuaacaacacgaagga

SEQ ID NO: 291039 - RNA, 23 nt, Human
uuguaaaguucuacaucaacuga

SEQ ID NO: 291040 - RNA, 23 nt, Human
uuguauuuuuaguggagaugggg

SEQ ID NO: 291041 - RNA, 23 nt, Human
uuuaaaacagaaccauuuuuuga

SEQ ID NO: 291042 - RNA, 24 nt, Human
uuuaauuucaaaucaaacaaaauc

SEQ ID NO: 291043 - RNA, 19 nt, Human
uuucaccguguuagccagg

SEQ ID NO: 291044 - RNA, 22 nt, Human
uuucaugacugauauauuaacc

SEQ ID NO: 291045 - RNA, 20 nt, Human
uuugcagagagaaaauguga

SEQ ID NO: 291046 - RNA, 26 nt, Human
uuugggagaggagagggguugaugug

SEQ ID NO: 291047 - RNA, 22 nt, Human
uuuguuuuuuguuuguuugggg

SEQ ID NO: 291048 - RNA, 20 nt, Human
uuuugcaguuguaggacuac

SEQ ID NO: 291049 - RNA, 19 nt, Human
uuuugguuuuguuuuuugu

SEQ ID NO: 291050 - RNA, 18 nt, Human
uuuuguuuguuugggguc

SEQ ID NO: 291051 - RNA, 24 nt, Human
uuuuuaguggagaugggguuucac

SEQ ID NO: 291052 - RNA, 20 nt, Human
uuuuucuuuuugagacagag

SEQ ID NO: 291053 - RNA, 21 nt, Human
uuuuuguauuuuuaguggaga

SEQ ID NO: 291054 - RNA, 20 nt, Human
uuuuuguuacuguuucugcu

SEQ ID NO: 291055 - RNA, 24 nt, Human
uuuuuucuuuuugagacagagucu

SEQ ID NO: 291056 - RNA, 24 nt, Human
uuuuuuguauuuuuaguggagaug

SEQ ID NO: 291057 - RNA, 24 nt, Human
aaaaacaacaaaaaauacuguaca

SEQ ID NO: 291058 - RNA, 19 nt, Human
aaaaaggcuuccgcccgcu

SEQ ID NO: 291059 - RNA, 22 nt, Human
aaaaaucccuuagucuuauaga

SEQ ID NO: 291060 - RNA, 19 nt, Human
aaaacacaagaaaaaaucu

SEQ ID NO: 291061 - RNA, 21 nt, Human
aaaaggcuuccgcccgcucca

SEQ ID NO: 291062 - RNA, 18 nt, Human
aaaaucccaaauauccaa

SEQ ID NO: 291063 - RNA, 30 nt, Human
aaacaaaaaucaaaaagaaagccccaaaag

SEQ ID NO: 291064 - RNA, 27 nt, Human
aaacaaaauccuuuuuaaaacagaacc

SEQ ID NO: 291065 - RNA, 24 nt, Human
aaaccacaaacaaaaaucaaaaag

SEQ ID NO: 291066 - RNA, 23 nt, Human
aaagaaacaaacaaaaaaaacua

SEQ ID NO: 291067 - RNA, 24 nt, Human
aaagaaacaaacaaaaaaaacuaa

SEQ ID NO: 291068 - RNA, 19 nt, Human
aaagugcuggaauuacagg

SEQ ID NO: 291069 - RNA, 24 nt, Human
aaagugcuggaauuacaggcguga

SEQ ID NO: 291070 - RNA, 24 nt, Human
aaagugcugggauuacagguauga

SEQ ID NO: 291071 - RNA, 24 nt, Human
aaauuuuaucaacaauauaguauu

SEQ ID NO: 291072 - RNA, 25 nt, Human
aacaaaaaaacugaaaaccacaaac

SEQ ID NO: 291073 - RNA, 23 nt, Human
aacaaaaacuguuuuaaauuaaa

SEQ ID NO: 291074 - RNA, 24 nt, Human
aacaaaaguuuagguaaacuaaag

SEQ ID NO: 291075 - RNA, 18 nt, Human
aacaacaaaaaaacugaa

SEQ ID NO: 291076 - RNA, 20 nt, Human
aacagauuuccaaggccaga

SEQ ID NO: 291077 - RNA, 18 nt, Human
aacauagauaguaaccau

SEQ ID NO: 291078 - RNA, 18 nt, Human
aacauuaucugaacaaaa

SEQ ID NO: 291079 - RNA, 25 nt, Human
aacauuuuuuucuuuuuggggggcc

SEQ ID NO: 291080 - RNA, 19 nt, Human
aaccaagaagagggugccc

SEQ ID NO: 291081 - RNA, 18 nt, Human
aaccgcccccauuaaaca

SEQ ID NO: 291082 - RNA, 21 nt, Human
aacuaucaugugaaaagggga

SEQ ID NO: 291083 - RNA, 21 nt, Human
aagaaagccccaaaaaaggcu

SEQ ID NO: 291084 - RNA, 18 nt, Human
aagaagcagucaugugcc

SEQ ID NO: 291085 - RNA, 20 nt, Human
aagaagcagucaugugccuu

SEQ ID NO: 291086 - RNA, 26 nt, Human
aagugcuggaauuacaggcgugagcc

SEQ ID NO: 291087 - RNA, 18 nt, Human
aagugcugggauuacagg

SEQ ID NO: 291088 - RNA, 19 nt, Human
aagugcugggauuacaggu

SEQ ID NO: 291089 - RNA, 26 nt, Human
aagugcugggauuacagguaugagcc

SEQ ID NO: 291090 - RNA, 21 nt, Human
aaguguccaccauugauaaau

SEQ ID NO: 291091 - RNA, 19 nt, Human
aaguuccuuccugauauuc

SEQ ID NO: 291092 - RNA, 23 nt, Human
aauaacagacaacaggagaaaac

SEQ ID NO: 291093 - RNA, 20 nt, Human
aauacauacucacaagugug

SEQ ID NO: 291094 - RNA, 20 nt, Human
aaugaaauaagauaccuaca

SEQ ID NO: 291095 - RNA, 23 nt, Human
aaugugugugugugcacgugugu

SEQ ID NO: 291096 - RNA, 18 nt, Human
aauuacaggcgugagcca

SEQ ID NO: 291097 - RNA, 22 nt, Human
aauuacaggcgugagccaccgc

SEQ ID NO: 291098 - RNA, 23 nt, Human
acaaaaaaacugaaaaccacaaa

SEQ ID NO: 291099 - RNA, 26 nt, Human
acaacaaaaaaacugaaaaccacaaa

SEQ ID NO: 291100 - RNA, 18 nt, Human
acaacaaaaaauacugua

SEQ ID NO: 291101 - RNA, 22 nt, Human
acaugcaccuggaaaaccagua

SEQ ID NO: 291102 - RNA, 19 nt, Human
acccaggcuggagugcagu

SEQ ID NO: 291103 - RNA, 25 nt, Human
acccgccucggccucccaaagugcu

SEQ ID NO: 291104 - RNA, 25 nt, Human
acccgccucggccucccaaagugcu

SEQ ID NO: 291105 - RNA, 23 nt, Human
acguguguguguguguguguguu

SEQ ID NO: 291106 - RNA, 19 nt, Human
acugaaccagaguguuuug

SEQ ID NO: 291107 - RNA, 18 nt, Human
acugcaagcuccgccucc

SEQ ID NO: 291108 - RNA, 23 nt, Human
acuggucuugaacuccugaccuc

SEQ ID NO: 291109 - RNA, 20 nt, Human
acuguuucugcuguugucaa

SEQ ID NO: 291110 - RNA, 23 nt, Human
agaaaaacaagaauagcuauuaa

SEQ ID NO: 291111 - RNA, 27 nt, Human
agaaacagcaugagaguaccgguaccc

SEQ ID NO: 291112 - RNA, 21 nt, Human
agaaagccccaaaaaaggcua

SEQ ID NO: 291113 - RNA, 25 nt, Human
agaaugaagagguaaacgaaaggga

SEQ ID NO: 291114 - RNA, 21 nt, Human
agccaccacacccagccaaaa

SEQ ID NO: 291115 - RNA, 21 nt, Human
agccagugccgagccagcccu

SEQ ID NO: 291116 - RNA, 20 nt, Human
aggaaucauuauaaaggagg

SEQ ID NO: 291117 - RNA, 21 nt, Human
aggaaucauuauaaaggaggg

SEQ ID NO: 291118 - RNA, 21 nt, Human
aggauuuaagaaccucccuag

SEQ ID NO: 291119 - RNA, 25 nt, Human
aggcuggagugcaguggcgccaucu

SEQ ID NO: 291120 - RNA, 24 nt, Human
aggugauccacccgccucggccuc

SEQ ID NO: 291121 - RNA, 18 nt, Human
aguagcugggacuacagg

SEQ ID NO: 291122 - RNA, 19 nt, Human
aguagcugggacuacaggc

SEQ ID NO: 291123 - RNA, 23 nt, Human
aguagcugggacuacaggcgccc

SEQ ID NO: 291124 - RNA, 22 nt, Human
agugaaaaaaaauugaucugga

SEQ ID NO: 291125 - RNA, 20 nt, Human
agugcaguggcgccaucucg

SEQ ID NO: 291126 - RNA, 24 nt, Human
agugcaguggcgccaucucggcuc

SEQ ID NO: 291127 - RNA, 19 nt, Human
agugguuuucuucaguaag

SEQ ID NO: 291128 - RNA, 23 nt, Human
auaaaguuugauuugaagaagag

SEQ ID NO: 291129 - RNA, 27 nt, Human
auaagaaaaacaagaauagcuauuaau

SEQ ID NO: 291130 - RNA, 24 nt, Human
auacaucacaauagccacuugugu

SEQ ID NO: 291131 - RNA, 18 nt, Human
auagaacaauuaauacaa

SEQ ID NO: 291132 - RNA, 22 nt, Human
auagauuuaguaugugguuuua

SEQ ID NO: 291133 - RNA, 18 nt, Human
aucauggcuguugauuca

SEQ ID NO: 291134 - RNA, 24 nt, Human
auccugaccucgugauccacccgc

SEQ ID NO: 291135 - RNA, 23 nt, Human
augaaaaagaaacaaacaaaaaa

SEQ ID NO: 291136 - RNA, 18 nt, Human
augaaaagaaacuuucuc

SEQ ID NO: 291137 - RNA, 21 nt, Human
auggacacaaaauagaauaac

SEQ ID NO: 291138 - RNA, 18 nt, Human
augggguuucaccauguu

SEQ ID NO: 291139 - RNA, 19 nt, Human
augggguuucaccauguua

SEQ ID NO: 291140 - RNA, 20 nt, Human
augggguuucaccauguuag

SEQ ID NO: 291141 - RNA, 24 nt, Human
augggguuucaccauguuagccag

SEQ ID NO: 291142 - RNA, 19 nt, Human
augguuuuuguucugugug

SEQ ID NO: 291143 - RNA, 22 nt, Human
augugugugugugcacgugugu

SEQ ID NO: 291144 - RNA, 21 nt, Human
auucuccugccucagccuccc

SEQ ID NO: 291145 - RNA, 24 nt, Human
auuuaaaucuuccugaguuucucu

SEQ ID NO: 291146 - RNA, 19 nt, Human
auuucuucuugacugcaag

SEQ ID NO: 291147 - RNA, 19 nt, Human
caaaaaaacugaaaaccac

SEQ ID NO: 291148 - RNA, 26 nt, Human
caaaaaaacugaaaaccacaaacaaa

SEQ ID NO: 291149 - RNA, 19 nt, Human
caaaacacugaaccagagu

SEQ ID NO: 291150 - RNA, 22 nt, Human
caaaacuucacaaguuuccaga

SEQ ID NO: 291151 - RNA, 27 nt, Human
caaacaaaaaucaaaaagaaagcccca

SEQ ID NO: 291152 - RNA, 28 nt, Human
caaacucugauaguuaauaguuaagaag

SEQ ID NO: 291153 - RNA, 24 nt, Human
caaagugcuggaauuacaggcgug

SEQ ID NO: 291154 - RNA, 24 nt, Human
caaagugcugggauuacagguaug

SEQ ID NO: 291155 - RNA, 23 nt, Human
caacaacaaaaaaacugaaaacc

SEQ ID NO: 291156 - RNA, 25 nt, Human
caacaacaaaaaaacugaaaaccac

SEQ ID NO: 291157 - RNA, 29 nt, Human
caacaacaaaaaaacugaaaaccacuauc

SEQ ID NO: 291158 - RNA, 19 nt, Human
caacaggagaaaacuaaug

SEQ ID NO: 291159 - RNA, 19 nt, Human
caaguaauugcauguuuca

SEQ ID NO: 291160 - RNA, 18 nt, Human
caccauguuagccaggau

SEQ ID NO: 291161 - RNA, 22 nt, Human
caccauguuagccaggaugguc

SEQ ID NO: 291162 - RNA, 24 nt, Human
caccauguuagccaggauggucuc

SEQ ID NO: 291163 - RNA, 19 nt, Human
cacccagccaaaaauaacu

SEQ ID NO: 291164 - RNA, 24 nt, Human
cacccaggcuggagugcaguggcg

SEQ ID NO: 291165 - RNA, 23 nt, Human
cacccgccucggccucccaaagu

SEQ ID NO: 291166 - RNA, 23 nt, Human
cacccgccucggccucccaaagu

SEQ ID NO: 291167 - RNA, 22 nt, Human
cacgccauucuccugccucagc

SEQ ID NO: 291168 - RNA, 18 nt, Human
cacggagacugcgacugc

SEQ ID NO: 291169 - RNA, 24 nt, Human
cacgugugugugugugugugugag

SEQ ID NO: 291170 - RNA, 25 nt, Human
cacguguguguguguguguguguaa

SEQ ID NO: 291171 - RNA, 20 nt, Human
cacuaacaacaacaaaaaaa

SEQ ID NO: 291172 - RNA, 25 nt, Human
cacugaaccagaguguuuugguuuu

SEQ ID NO: 291173 - RNA, 21 nt, Human
caggcgcccgccaccacgccc

SEQ ID NO: 291174 - RNA, 26 nt, Human
cauucaaaauaguuucuaauggucau

SEQ ID NO: 291175 - RNA, 20 nt, Human
ccaaagugcuggaauuacag

SEQ ID NO: 291176 - RNA, 22 nt, Human
ccaaagugcuggaauuacaggc

SEQ ID NO: 291177 - RNA, 24 nt, Human
ccaaagugcuggaauuacaggcgu

SEQ ID NO: 291178 - RNA, 20 nt, Human
ccaaagugcugggauuacag

SEQ ID NO: 291179 - RNA, 21 nt, Human
ccaaagugcugggauuacagg

SEQ ID NO: 291180 - RNA, 21 nt, Human
ccaaagugcugggauuacagg

SEQ ID NO: 291181 - RNA, 21 nt, Human
ccaaagugcugggauuacagg

SEQ ID NO: 291182 - RNA, 22 nt, Human
ccaaagugcugggauuacaggu

SEQ ID NO: 291183 - RNA, 24 nt, Human
ccaaagugcugggauuacagguau

SEQ ID NO: 291184 - RNA, 25 nt, Human
ccaagacagccuuauauuacaucau

SEQ ID NO: 291185 - RNA, 22 nt, Human
ccaccgcgcccggcccacucaa

SEQ ID NO: 291186 - RNA, 22 nt, Human
ccaguuaagaggauaaaagaag

SEQ ID NO: 291187 - RNA, 24 nt, Human
ccaguuaagaggauaaaagaagga

SEQ ID NO: 291188 - RNA, 27 nt, Human
cccaaccccaaccgcccccauuaaacu

SEQ ID NO: 291189 - RNA, 28 nt, Human
ccccaaccccaaccgcccccauuaaaca

SEQ ID NO: 291190 - RNA, 22 nt, Human
cccccaaccccaaccgccccca

SEQ ID NO: 291191 - RNA, 20 nt, Human
cccccccaaccccaaccgcc

SEQ ID NO: 291192 - RNA, 23 nt, Human
cccccccaaccccaaccgccccc

SEQ ID NO: 291193 - RNA, 23 nt, Human
cccccccaaccccaaccgccccc

SEQ ID NO: 291194 - RNA, 23 nt, Human
cccgaguagcugggacuacaggc

SEQ ID NO: 291195 - RNA, 24 nt, Human
cccgaguagcugggacuacaggcg

SEQ ID NO: 291196 - RNA, 21 nt, Human
cccgccaccacgcccagcuaa

SEQ ID NO: 291197 - RNA, 18 nt, Human
ccgggcugccugugcugc

SEQ ID NO: 291198 - RNA, 19 nt, Human
ccuagaaaguuacaucuca

SEQ ID NO: 291199 - RNA, 22 nt, Human
ccugaccucaggugauccaccc

SEQ ID NO: 291200 - RNA, 23 nt, Human
ccugaccucaggugauccacccg

SEQ ID NO: 291201 - RNA, 20 nt, Human
ccugaccucgugauccaccc

SEQ ID NO: 291202 - RNA, 23 nt, Human
ccugccucagccucccgaguagc

SEQ ID NO: 291203 - RNA, 24 nt, Human
ccugccucagccucccgaguagcu

SEQ ID NO: 291204 - RNA, 21 nt, Human
ccuuauauuacaucauggcug

SEQ ID NO: 291205 - RNA, 20 nt, Human
ccuuggaacauuaacaacac

SEQ ID NO: 291206 - RNA, 18 nt, Human
cgcccgcuccacggagac

SEQ ID NO: 291207 - RNA, 19 nt, Human
cgccucccggguucacgcc

SEQ ID NO: 291208 - RNA, 24 nt, Human
cgccucggccucccaaagugcugg

SEQ ID NO: 291209 - RNA, 21 nt, Human
cgcuccacggagacugcgacu

SEQ ID NO: 291210 - RNA, 22 nt, Human
cguagaaguaacagauuuccaa

SEQ ID NO: 291211 - RNA, 19 nt, Human
cuaacgccuaaacauggua

SEQ ID NO: 291212 - RNA, 24 nt, Human
cucagccucccgaguagcugggac

SEQ ID NO: 291213 - RNA, 18 nt, Human
cucauagugcacugcaau

SEQ ID NO: 291214 - RNA, 21 nt, Human
cucccggguucacgccauucu

SEQ ID NO: 291215 - RNA, 24 nt, Human
cucccucugcauuuuuccuuaaaa

SEQ ID NO: 291216 - RNA, 21 nt, Human
cucgcaguccgcagagcagcc

SEQ ID NO: 291217 - RNA, 23 nt, Human
cugaaaaccacaaacaaaaauca

SEQ ID NO: 291218 - RNA, 23 nt, Human
cugaggcaaaaccgcucugguau

SEQ ID NO: 291219 - RNA, 18 nt, Human
cugcacugucucuuccau

SEQ ID NO: 291220 - RNA, 23 nt, Human
cugccucagccucccgaguagcu

SEQ ID NO: 291221 - RNA, 18 nt, Human
cugucacccaggcuggag

SEQ ID NO: 291222 - RNA, 19 nt, Human
cugucacccaggcuggagu

SEQ ID NO: 291223 - RNA, 21 nt, Human
cugugcugccugugucgccgc

SEQ ID NO: 291224 - RNA, 20 nt, Human
cuuaaaaaugucucuugccc

SEQ ID NO: 291225 - RNA, 18 nt, Human
cuucccacaauacaaaca

SEQ ID NO: 291226 - RNA, 21 nt, Human
cuugcucugucacccaggcug

SEQ ID NO: 291227 - RNA, 18 nt, Human
gaaaaacaagaauagcua

SEQ ID NO: 291228 - RNA, 22 nt, Human
gaaagcacaagguucacuagga

SEQ ID NO: 291229 - RNA, 25 nt, Human
gaaagcacaagguucacuaggaaag

SEQ ID NO: 291230 - RNA, 24 nt, Human
gacacaauauuaguuaaaacacag

SEQ ID NO: 291231 - RNA, 24 nt, Human
gaccucaggugauccacccgccuc

SEQ ID NO: 291232 - RNA, 22 nt, Human
gaccucgugauccacccgccuc

SEQ ID NO: 291233 - RNA, 22 nt, Human
gaccucgugauccacccgccuc

SEQ ID NO: 291234 - RNA, 24 nt, Human
gaccucgugauccacccgccucgg

SEQ ID NO: 291235 - RNA, 24 nt, Human
gacuggucuugaacuccugaccuc

SEQ ID NO: 291236 - RNA, 18 nt, Human
gagaugggguuucaccau

SEQ ID NO: 291237 - RNA, 24 nt, Human
gagaugggguuucaccauguuagc

SEQ ID NO: 291238 - RNA, 20 nt, Human
gaguagcugggacuacaggc

SEQ ID NO: 291239 - RNA, 25 nt, Human
gaguagcugggacuacaggcgcccg

SEQ ID NO: 291240 - RNA, 18 nt, Human
gauuacagguaugagcca

SEQ ID NO: 291241 - RNA, 21 nt, Human
gauuacagguaugagccacca

SEQ ID NO: 291242 - RNA, 22 nt, Human
gauuacagguaugagccaccac

SEQ ID NO: 291243 - RNA, 22 nt, Human
gcaaacagagaaacagcaugag

SEQ ID NO: 291244 - RNA, 18 nt, Human
gcaccuggaaaaccagua

SEQ ID NO: 291245 - RNA, 26 nt, Human
gcacuaaccauuuauuauuauuuucu

SEQ ID NO: 291246 - RNA, 23 nt, Human
gcccagcuaauuuuuuguauuuu

SEQ ID NO: 291247 - RNA, 25 nt, Human
gccucccggguucacgccauucucc

SEQ ID NO: 291248 - RNA, 23 nt, Human
gccucggccucccaaagugcugg

SEQ ID NO: 291249 - RNA, 25 nt, Human
gcucugucacccaggcuggagugca

SEQ ID NO: 291250 - RNA, 18 nt, Human
gcugaggcaaaaccgcuc

SEQ ID NO: 291251 - RNA, 18 nt, Human
gcugagguuguuucugag

SEQ ID NO: 291252 - RNA, 20 nt, Human
gcuggagugcaguggcgcca

SEQ ID NO: 291253 - RNA, 19 nt, Human
ggacuacaggcuuaaaaug

SEQ ID NO: 291254 - RNA, 24 nt, Human
ggauggucucaauauccugaccuc

SEQ ID NO: 291255 - RNA, 19 nt, Human
ggauuacagguaugagcca

SEQ ID NO: 291256 - RNA, 22 nt, Human
gggguuucaccauguuagccag

SEQ ID NO: 291257 - RNA, 24 nt, Human
ggguugaugugacuaacgccuaaa

SEQ ID NO: 291258 - RNA, 22 nt, Human
ggguuucaccauguuagccagg

SEQ ID NO: 291259 - RNA, 19 nt, Human
ggucuugaacuccugaccu

SEQ ID NO: 291260 - RNA, 24 nt, Human
gguuucaccauguuagccaggaug

SEQ ID NO: 291261 - RNA, 18 nt, Human
gguuuuguuuuuuguuug

SEQ ID NO: 291262 - RNA, 24 nt, Human
gucuugcucugucacccaggcugg

SEQ ID NO: 291263 - RNA, 24 nt, Human
gugauccacccgccucggccuccc

SEQ ID NO: 291264 - RNA, 24 nt, Human
gugauccacccgccucggccuccc

SEQ ID NO: 291265 - RNA, 23 nt, Human
guggagaugggguuucaccaugu

SEQ ID NO: 291266 - RNA, 18 nt, Human
guuaaauuccuuuucuuu

SEQ ID NO: 291267 - RNA, 21 nt, Human
guuauugcgcugcacugucuc

SEQ ID NO: 291268 - RNA, 18 nt, Human
uaaaacacagguaaaguu

SEQ ID NO: 291269 - RNA, 21 nt, Human
uaaaacagaaccauuuuucga

SEQ ID NO: 291270 - RNA, 19 nt, Human
uaaagaaagcacaagguuc

SEQ ID NO: 291271 - RNA, 25 nt, Human
uaaauacacauucugaauuaaacaa

SEQ ID NO: 291272 - RNA, 24 nt, Human
uaacagacaacaggagaaaacuaa

SEQ ID NO: 291273 - RNA, 21 nt, Human
uaagaaaaacaagaauagcua

SEQ ID NO: 291274 - RNA, 20 nt, Human
uaagaauacacaaaauuacu

SEQ ID NO: 291275 - RNA, 19 nt, Human
uaaguguauacaccaagac

SEQ ID NO: 291276 - RNA, 22 nt, Human
uaauaaacauucaaauaucauc

SEQ ID NO: 291277 - RNA, 24 nt, Human
uaauuuuuuguauuuuuaguggag

SEQ ID NO: 291278 - RNA, 25 nt, Human
uaauuuuuuguauuuuuaguggaga

SEQ ID NO: 291279 - RNA, 24 nt, Human
uacaggcgcccgccaccacgccca

SEQ ID NO: 291280 - RNA, 23 nt, Human
uacaggcgugagccaccgcgccc

SEQ ID NO: 291281 - RNA, 24 nt, Human
uacagguaugagccaccacaccca

SEQ ID NO: 291282 - RNA, 23 nt, Human
uacaguaucaaaaaugacacaga

SEQ ID NO: 291283 - RNA, 18 nt, Human
uaccauagcuagaaaauu

SEQ ID NO: 291284 - RNA, 23 nt, Human
uaccaugaaaaagaaacaaacaa

SEQ ID NO: 291285 - RNA, 24 nt, Human
uaccaugaaaaagaaacaaacaaa

SEQ ID NO: 291286 - RNA, 20 nt, Human
uaccuaaacuaacuauaaau

SEQ ID NO: 291287 - RNA, 22 nt, Human
uagaauaacaaaaaucccuuag

SEQ ID NO: 291288 - RNA, 19 nt, Human
uagaaugaagagguaaacg

SEQ ID NO: 291289 - RNA, 27 nt, Human
uaggagauauugacucccccccaauuc

SEQ ID NO: 291290 - RNA, 24 nt, Human
uaguggagaugggguuucaccaug

SEQ ID NO: 291291 - RNA, 22 nt, Human
ucaaaaagaaagccccaaaaaa

SEQ ID NO: 291292 - RNA, 24 nt, Human
ucaaaggaaauccucaccaaugaa

SEQ ID NO: 291293 - RNA, 26 nt, Human
ucaaagugaaaaaaaauugaucugga

SEQ ID NO: 291294 - RNA, 21 nt, Human
ucaacaucaacaauagccaca

SEQ ID NO: 291295 - RNA, 22 nt, Human
ucaacaucaacaauagccacaa

SEQ ID NO: 291296 - RNA, 21 nt, Human
ucaaccuucuuacuuccaaag

SEQ ID NO: 291297 - RNA, 24 nt, Human
ucaccauguuagccaggauggucu

SEQ ID NO: 291298 - RNA, 22 nt, Human
ucacccaggcuggagugcagug

SEQ ID NO: 291299 - RNA, 24 nt, Human
ucacccaggcuggagugcaguggc

SEQ ID NO: 291300 - RNA, 18 nt, Human
ucacugcaagcuccgccu

SEQ ID NO: 291301 - RNA, 19 nt, Human
ucacugcaagcuccgccuc

SEQ ID NO: 291302 - RNA, 24 nt, Human
ucacugcaagcuccgccucccggg

SEQ ID NO: 291303 - RNA, 19 nt, Human
ucacuuacagucacuaaac

SEQ ID NO: 291304 - RNA, 19 nt, Human
ucagagaguaguuuggcua

SEQ ID NO: 291305 - RNA, 23 nt, Human
ucagccucccgaguagcugggac

SEQ ID NO: 291306 - RNA, 21 nt, Human
ucaguaauaccaugaaaaaga

SEQ ID NO: 291307 - RNA, 23 nt, Human
uccaacuuugaguccuauuugau

SEQ ID NO: 291308 - RNA, 24 nt, Human
ucccaaagugcuggaauuacaggc

SEQ ID NO: 291309 - RNA, 23 nt, Human
ucccaaagugcugggauuacagg

SEQ ID NO: 291310 - RNA, 18 nt, Human
ucccagaaguaaagaccu

SEQ ID NO: 291311 - RNA, 23 nt, Human
uccccaaguuuacaauuuucaac

SEQ ID NO: 291312 - RNA, 24 nt, Human
ucccgaguagcugggacuacaggc

SEQ ID NO: 291313 - RNA, 21 nt, Human
ucccggguucacgccauucuc

SEQ ID NO: 291314 - RNA, 24 nt, Human
ucccggguucacgccauucuccug

SEQ ID NO: 291315 - RNA, 18 nt, Human
uccucaccaaugaaauua

SEQ ID NO: 291316 - RNA, 23 nt, Human
ucgcaguccgcagagcagccgga

SEQ ID NO: 291317 - RNA, 18 nt, Human
ucggccucccaaagugcu

SEQ ID NO: 291318 - RNA, 18 nt, Human
ucggccucccaaagugcu

SEQ ID NO: 291319 - RNA, 24 nt, Human
ucuccugccucagccucccgagua

SEQ ID NO: 291320 - RNA, 18 nt, Human
ucucuuggcaaugaauaa

SEQ ID NO: 291321 - RNA, 24 nt, Human
ucugucacccaggcuggagugcag

SEQ ID NO: 291322 - RNA, 23 nt, Human
ucuugaacuccugaccucaggug

SEQ ID NO: 291323 - RNA, 23 nt, Human
ucuugcucugucacccaggcugg

SEQ ID NO: 291324 - RNA, 24 nt, Human
ucuugcucugucacccaggcugga

SEQ ID NO: 291325 - RNA, 22 nt, Human
ugaaaaccacaaacaaaaauca

SEQ ID NO: 291326 - RNA, 23 nt, Human
ugaaaaccacaaacaaaaaucaa

SEQ ID NO: 291327 - RNA, 21 nt, Human
ugaaaacgcuacuuaaccugc

SEQ ID NO: 291328 - RNA, 22 nt, Human
ugaauacauacucacaagugug

SEQ ID NO: 291329 - RNA, 22 nt, Human
ugacagcagagagacacaaaca

SEQ ID NO: 291330 - RNA, 21 nt, Human
ugaccucaggugauccacccg

SEQ ID NO: 291331 - RNA, 24 nt, Human
ugaccucaggugauccacccgccu

SEQ ID NO: 291332 - RNA, 18 nt, Human
ugacucccccccaacccc

SEQ ID NO: 291333 - RNA, 18 nt, Human
ugagacagagucuugcuc

SEQ ID NO: 291334 - RNA, 22 nt, Human
ugagacagagucuugcucuguc

SEQ ID NO: 291335 - RNA, 26 nt, Human
ugagcuagaauaacaaaaaucccuua

SEQ ID NO: 291336 - RNA, 19 nt, Human
ugaguacaaucaacauaaa

SEQ ID NO: 291337 - RNA, 22 nt, Human
ugauaaaaacaacaaaaaauac

SEQ ID NO: 291338 - RNA, 20 nt, Human
ugaucuguggaauccuucuu

SEQ ID NO: 291339 - RNA, 23 nt, Human
ugauucagagcaaacagagaaac

SEQ ID NO: 291340 - RNA, 20 nt, Human
ugauuuguuuagucuauuuu

SEQ ID NO: 291341 - RNA, 20 nt, Human
ugcaauacagaaccugaaau

SEQ ID NO: 291342 - RNA, 22 nt, Human
ugcacauacauuuuucugagca

SEQ ID NO: 291343 - RNA, 21 nt, Human
ugcacgugugugugugugugu

SEQ ID NO: 291344 - RNA, 22 nt, Human
ugcaguggcgccaucucggcuc

SEQ ID NO: 291345 - RNA, 24 nt, Human
ugccucagccucccgaguagcugg

SEQ ID NO: 291346 - RNA, 18 nt, Human
ugcgacugcuguagcggg

SEQ ID NO: 291347 - RNA, 24 nt, Human
ugcucugucacccaggcuggagug

SEQ ID NO: 291348 - RNA, 24 nt, Human
ugcuggaauuacaggcgugagcca

SEQ ID NO: 291349 - RNA, 24 nt, Human
ugcugggauuacagguaugagcca

SEQ ID NO: 291350 - RNA, 22 nt, Human
ugcuguugucaacuugaacugc

SEQ ID NO: 291351 - RNA, 21 nt, Human
ugcuucaguaagacguuuugc

SEQ ID NO: 291352 - RNA, 20 nt, Human
uggaacagcaugaguacaau

SEQ ID NO: 291353 - RNA, 20 nt, Human
uggaagaaaaucaaguuggu

SEQ ID NO: 291354 - RNA, 22 nt, Human
uggaagaaaaucaaguugguga

SEQ ID NO: 291355 - RNA, 18 nt, Human
uggaauuacaggcgugag

SEQ ID NO: 291356 - RNA, 19 nt, Human
uggaauuacaggcgugagc

SEQ ID NO: 291357 - RNA, 21 nt, Human
uggaauuacaggcgugagcca

SEQ ID NO: 291358 - RNA, 22 nt, Human
uggaauuacaggcgugagccac

SEQ ID NO: 291359 - RNA, 23 nt, Human
uggaauuacaggcgugagccacc

SEQ ID NO: 291360 - RNA, 24 nt, Human
uggaauuacaggcgugagccaccg

SEQ ID NO: 291361 - RNA, 24 nt, Human
uggaauuacaggcgugagccaccg

SEQ ID NO: 291362 - RNA, 18 nt, Human
uggacuacaggcuuaaaa

SEQ ID NO: 291363 - RNA, 28 nt, Human
uggagugcaguggcgccauccuagcacg

SEQ ID NO: 291364 - RNA, 23 nt, Human
uggagugcaguggcgccaucucg

SEQ ID NO: 291365 - RNA, 24 nt, Human
uggagugcaguggcgccaucucgg

SEQ ID NO: 291366 - RNA, 18 nt, Human
uggauaccuuucagagag

SEQ ID NO: 291367 - RNA, 24 nt, Human
uggccagacuggucuugaacuccu

SEQ ID NO: 291368 - RNA, 25 nt, Human
uggccaguuaagaggauaaaagaag

SEQ ID NO: 291369 - RNA, 21 nt, Human
ugggacuacaggcgcccgcca

SEQ ID NO: 291370 - RNA, 22 nt, Human
ugggacuacaggcgcccgccac

SEQ ID NO: 291371 - RNA, 24 nt, Human
ugggacuacaggcgcccgccacca

SEQ ID NO: 291372 - RNA, 20 nt, Human
ugggagaggagagggguuga

SEQ ID NO: 291373 - RNA, 18 nt, Human
ugggauuacagguaugag

SEQ ID NO: 291374 - RNA, 19 nt, Human
ugggauuacagguaugagc

SEQ ID NO: 291375 - RNA, 22 nt, Human
ugggauuacagguaugagccac

SEQ ID NO: 291376 - RNA, 23 nt, Human
ugggauuacagguaugagccacc

SEQ ID NO: 291377 - RNA, 24 nt, Human
ugggauuacagguaugagccacca

SEQ ID NO: 291378 - RNA, 24 nt, Human
ugggguuucaccauguuagccagg

SEQ ID NO: 291379 - RNA, 19 nt, Human
ugguaugugaucuguggaa

SEQ ID NO: 291380 - RNA, 20 nt, Human
ugguucauuccuauaucuau

SEQ ID NO: 291381 - RNA, 19 nt, Human
uguaacugcuaccauuaca

SEQ ID NO: 291382 - RNA, 21 nt, Human
uguauuuuuaguggagauggg

SEQ ID NO: 291383 - RNA, 21 nt, Human
ugugcacgugugugugugugu

SEQ ID NO: 291384 - RNA, 21 nt, Human
ugugugugcacgugugugugu

SEQ ID NO: 291385 - RNA, 21 nt, Human
ugugugugcacgugugugugu

SEQ ID NO: 291386 - RNA, 21 nt, Human
ugugugugcacgugugugugu

SEQ ID NO: 291387 - RNA, 24 nt, Human
ugugugugcacgugugugugugug

SEQ ID NO: 291388 - RNA, 21 nt, Human
uguguguguaugugugugugu

SEQ ID NO: 291389 - RNA, 22 nt, Human
uguguguguaugugugugugua

SEQ ID NO: 291390 - RNA, 20 nt, Human
ugugugugugcacgugugug

SEQ ID NO: 291391 - RNA, 30 nt, Human
ugugugugugcacgugugugugugugugug

SEQ ID NO: 291392 - RNA, 20 nt, Human
uguguguguguaugugugug

SEQ ID NO: 291393 - RNA, 21 nt, Human
uguguguguguaugugugugu

SEQ ID NO: 291394 - RNA, 18 nt, Human
ugugugugugugcacgug

SEQ ID NO: 291395 - RNA, 21 nt, Human
ugugugugugugcacgugugu

SEQ ID NO: 291396 - RNA, 21 nt, Human
uguguguguguguaugugugu

SEQ ID NO: 291397 - RNA, 21 nt, Human
uguguguguguguguaugugu

SEQ ID NO: 291398 - RNA, 23 nt, Human
uguguguguguguguaugugugu

SEQ ID NO: 291399 - RNA, 24 nt, Human
uguguguguguguguaugugugug

SEQ ID NO: 291400 - RNA, 21 nt, Human
uguguguguguguguguaugu

SEQ ID NO: 291401 - RNA, 21 nt, Human
uguguguguguguguguaugu

SEQ ID NO: 291402 - RNA, 18 nt, Human
ugugugugugugugugug

SEQ ID NO: 291403 - RNA, 18 nt, Human
uguuauugguauuucuuc

SEQ ID NO: 291404 - RNA, 25 nt, Human
uuaacaaaaacuguuuuaaauuaaa

SEQ ID NO: 291405 - RNA, 21 nt, Human
uuaacagagggggagaaaggg

SEQ ID NO: 291406 - RNA, 19 nt, Human
uuacaguuuaaucauaaau

SEQ ID NO: 291407 - RNA, 18 nt, Human
uuacugaacacccuuugg

SEQ ID NO: 291408 - RNA, 19 nt, Human
uuacuguacaaggggaugc

SEQ ID NO: 291409 - RNA, 18 nt, Human
uuaguggagaugggguuu

SEQ ID NO: 291410 - RNA, 22 nt, Human
uuaguggagaugggguuucacc

SEQ ID NO: 291411 - RNA, 24 nt, Human
uuaguggagaugggguuucaccau

SEQ ID NO: 291412 - RNA, 21 nt, Human
uucaaaacacugaaccagagu

SEQ ID NO: 291413 - RNA, 18 nt, Human
uucagagcaaacagagaa

SEQ ID NO: 291414 - RNA, 19 nt, Human
uuccauugccagauuacag

SEQ ID NO: 291415 - RNA, 21 nt, Human
uucccagaaguaaagacccaa

SEQ ID NO: 291416 - RNA, 24 nt, Human
uucccagccaauugagccaguugg

SEQ ID NO: 291417 - RNA, 21 nt, Human
uuccugaguuucucuacaaaa

SEQ ID NO: 291418 - RNA, 24 nt, Human
uugcucugucacccaggcuggagu

SEQ ID NO: 291419 - RNA, 22 nt, Human
uuggaacauuaacaacacgaag

SEQ ID NO: 291420 - RNA, 24 nt, Human
uuggaacauuaacaacacgaagga

SEQ ID NO: 291421 - RNA, 23 nt, Human
uuguauuuuuaguggagaugggg

SEQ ID NO: 291422 - RNA, 24 nt, Human
uuuaauuucaaaucaaacaaaauc

SEQ ID NO: 291423 - RNA, 23 nt, Human
uuuauguuacaaaauuacaguuu

SEQ ID NO: 291424 - RNA, 19 nt, Human
uuucaccauguuagccagg

SEQ ID NO: 291425 - RNA, 20 nt, Human
uuucaccauguuagccagga

SEQ ID NO: 291426 - RNA, 22 nt, Human
uuucaugacugauauauuaacc

SEQ ID NO: 291427 - RNA, 20 nt, Human
uuugcagagagaaaauguga

SEQ ID NO: 291428 - RNA, 26 nt, Human
uuugggagaggagagggguugaugug

SEQ ID NO: 291429 - RNA, 22 nt, Human
uuuguuuuuuguuuguuugggg

SEQ ID NO: 291430 - RNA, 19 nt, Human
uuuugguuuuguuuuuugu

SEQ ID NO: 291431 - RNA, 18 nt, Human
uuuuguuuguuugggguc

SEQ ID NO: 291432 - RNA, 24 nt, Human
uuuuuaguggagaugggguuucac

SEQ ID NO: 291433 - RNA, 21 nt, Human
uuuuuguauuuuuaguggaga

SEQ ID NO: 291434 - RNA, 20 nt, Human
uuuuuguuacuguuucugcu

SEQ ID NO: 291435 - RNA, 24 nt, Human
uuuuuucuuuuugagacagagucu

SEQ ID NO: 291436 - RNA, 24 nt, Human
uuuuuuguauuuuuaguggagaug

SEQ ID NO: 291437 - RNA, 26 nt, Human
aaaagacucagagcugcuuacaaggg

SEQ ID NO: 291438 - RNA, 19 nt, Human
aaacaagcaggaccccaag

SEQ ID NO: 291439 - RNA, 20 nt, Human
aaacaagcaggaccccaagg

SEQ ID NO: 291440 - RNA, 20 nt, Human
aaaugauggacaagagcugg

SEQ ID NO: 291441 - RNA, 18 nt, Human
acccuaaaguucucaggc

SEQ ID NO: 291442 - RNA, 20 nt, Human
agacucagagcugcuuacaa

SEQ ID NO: 291443 - RNA, 22 nt, Human
agagcuggucuaagagggaccu

SEQ ID NO: 291444 - RNA, 22 nt, Human
agcaaggcggcugcugagggaa

SEQ ID NO: 291445 - RNA, 22 nt, Human
agcccccugacuccugcuaccc

SEQ ID NO: 291446 - RNA, 24 nt, Human
agcccccugacuccugcuacccaa

SEQ ID NO: 291447 - RNA, 21 nt, Human
agcuggucuaagagggaccug

SEQ ID NO: 291448 - RNA, 23 nt, Human
aggccccugguucuuggauccag

SEQ ID NO: 291449 - RNA, 18 nt, Human
aggcuggggaaacagaga

SEQ ID NO: 291450 - RNA, 22 nt, Human
aggggcugcuuuggucagucag

SEQ ID NO: 291451 - RNA, 23 nt, Human
aucugcacaacuugucacacccu

SEQ ID NO: 291452 - RNA, 18 nt, Human
augaaacaagcaggaccc

SEQ ID NO: 291453 - RNA, 18 nt, Human
auggaaaccccaccuaca

SEQ ID NO: 291454 - RNA, 22 nt, Human
auucagaaaccacuagaguucu

SEQ ID NO: 291455 - RNA, 22 nt, Human
caaacgccgaucaagaauugcc

SEQ ID NO: 291456 - RNA, 19 nt, Human
caagugagcagaaaacuug

SEQ ID NO: 291457 - RNA, 21 nt, Human
cacaaaccgucccuguccucc

SEQ ID NO: 291458 - RNA, 26 nt, Human
cacagauccucaggccccugguucuu

SEQ ID NO: 291459 - RNA, 18 nt, Human
cacauauguuuugccagg

SEQ ID NO: 291460 - RNA, 20 nt, Human
cagagaagcagcuuuuuccu

SEQ ID NO: 291461 - RNA, 20 nt, Human
cagauccucaggccccuggu

SEQ ID NO: 291462 - RNA, 19 nt, Human
cagcggugucaucugggac

SEQ ID NO: 291463 - RNA, 23 nt, Human
caggaaacacuuaucucagccac

SEQ ID NO: 291464 - RNA, 23 nt, Human
caguugcuaggcuggggaaacag

SEQ ID NO: 291465 - RNA, 22 nt, Human
caucugggacaagucacuuaac

SEQ ID NO: 291466 - RNA, 21 nt, Human
ccaaggcaaggccaucuucau

SEQ ID NO: 291467 - RNA, 24 nt, Human
ccacgcagcaaggcggcugcugag

SEQ ID NO: 291468 - RNA, 19 nt, Human
cccaagaaggccacccuuu

SEQ ID NO: 291469 - RNA, 25 nt, Human
cccaagaaggccacccuuuccugcc

SEQ ID NO: 291470 - RNA, 23 nt, Human
cccagagcugccggcacaaccuu

SEQ ID NO: 291471 - RNA, 24 nt, Human
cccauaguuagaugauuaugaaac

SEQ ID NO: 291472 - RNA, 21 nt, Human
ccccaaggcaaggccaucuuc

SEQ ID NO: 291473 - RNA, 19 nt, Human
ccccauuguuccccucuca

SEQ ID NO: 291474 - RNA, 19 nt, Human
cccccugacuccugcuacc

SEQ ID NO: 291475 - RNA, 23 nt, Human
cccugacuccugcuacccaagaa

SEQ ID NO: 291476 - RNA, 18 nt, Human
ccugacuccugcuaccca

SEQ ID NO: 291477 - RNA, 21 nt, Human
ccugacuccugcuacccaaga

SEQ ID NO: 291478 - RNA, 22 nt, Human
ccugacuccugcuacccaagaa

SEQ ID NO: 291479 - RNA, 26 nt, Human
ccugggccuggccccgagucacaggc

SEQ ID NO: 291480 - RNA, 18 nt, Human
ccuggggcucuugccucc

SEQ ID NO: 291481 - RNA, 23 nt, Human
cucccgggcaagucauguuuccu

SEQ ID NO: 291482 - RNA, 23 nt, Human
cugggccuccauuaccucaucug

SEQ ID NO: 291483 - RNA, 19 nt, Human
cuguagaguggggauggga

SEQ ID NO: 291484 - RNA, 20 nt, Human
gaaacagagaagcagcuuuu

SEQ ID NO: 291485 - RNA, 24 nt, Human
gaaagcagcugugauuaacagagc

SEQ ID NO: 291486 - RNA, 22 nt, Human
gagcagccaucagagguaaacu

SEQ ID NO: 291487 - RNA, 19 nt, Human
gcaucagucacccuaaagu

SEQ ID NO: 291488 - RNA, 25 nt, Human
gcccuggggcagucccugcccacac

SEQ ID NO: 291489 - RNA, 23 nt, Human
gcggcugcugagggaaagggagc

SEQ ID NO: 291490 - RNA, 18 nt, Human
gcuccacauauguuuugc

SEQ ID NO: 291491 - RNA, 18 nt, Human
ggaaacagagaagcagcc

SEQ ID NO: 291492 - RNA, 21 nt, Human
ggcccuggggcagucccugcc

SEQ ID NO: 291493 - RNA, 20 nt, Human
ggcuggacaaguccuccagu

SEQ ID NO: 291494 - RNA, 23 nt, Human
uaacagagcagccaucagaggua

SEQ ID NO: 291495 - RNA, 20 nt, Human
uaagaauaguagcccuuucc

SEQ ID NO: 291496 - RNA, 25 nt, Human
uacaagauuuuagaaaccagcucuu

SEQ ID NO: 291497 - RNA, 21 nt, Human
uacagcccccugacuccugcu

SEQ ID NO: 291498 - RNA, 22 nt, Human
uagaaaccagcucuuguccaca

SEQ ID NO: 291499 - RNA, 21 nt, Human
uagcuagugaguuacaagauu

SEQ ID NO: 291500 - RNA, 18 nt, Human
uaguccuggggcucuugc

SEQ ID NO: 291501 - RNA, 19 nt, Human
ucagcaaaugauggacaag

SEQ ID NO: 291502 - RNA, 22 nt, Human
uccacagauccucaggccccug

SEQ ID NO: 291503 - RNA, 23 nt, Human
uccccaacucucuuuguuccuau

SEQ ID NO: 291504 - RNA, 22 nt, Human
uccuggauggcuugaucagccc

SEQ ID NO: 291505 - RNA, 19 nt, Human
uccugggccuccauuaccu

SEQ ID NO: 291506 - RNA, 24 nt, Human
uccuguuucucuccccuuccccaa

SEQ ID NO: 291507 - RNA, 18 nt, Human
ucuaagagggaccugacc

SEQ ID NO: 291508 - RNA, 18 nt, Human
ucucaggccgccgcuagc

SEQ ID NO: 291509 - RNA, 22 nt, Human
ucugcacaacuugucacacccu

SEQ ID NO: 291510 - RNA, 27 nt, Human
ugaaacaagcaggaccccaaggcaagg

SEQ ID NO: 291511 - RNA, 19 nt, Human
ugaccguguggcucuccuc

SEQ ID NO: 291512 - RNA, 19 nt, Human
ugagcagaaaacuugagcc

SEQ ID NO: 291513 - RNA, 22 nt, Human
ugagggaaagggagccucugca

SEQ ID NO: 291514 - RNA, 21 nt, Human
ugaugccccucccgggcaagu

SEQ ID NO: 291515 - RNA, 18 nt, Human
ugccagaggacugacccu

SEQ ID NO: 291516 - RNA, 24 nt, Human
ugccagaggacugacccuuugugc

SEQ ID NO: 291517 - RNA, 22 nt, Human
uggauccagaggcgucugaggu

SEQ ID NO: 291518 - RNA, 26 nt, Human
uggcacccccaggguacagcccccug

SEQ ID NO: 291519 - RNA, 18 nt, Human
uggcaucuguucugccag

SEQ ID NO: 291520 - RNA, 18 nt, Human
uggcccuggggcaguccc

SEQ ID NO: 291521 - RNA, 22 nt, Human
uggccugggccuggccccgagu

SEQ ID NO: 291522 - RNA, 18 nt, Human
uggcucuccucccgcuuc

SEQ ID NO: 291523 - RNA, 20 nt, Human
ugguccacuucagcaaauga

SEQ ID NO: 291524 - RNA, 19 nt, Human
uggucuugauuccagaagc

SEQ ID NO: 291525 - RNA, 24 nt, Human
uguaaucugcacaacuugucacac

SEQ ID NO: 291526 - RNA, 26 nt, Human
ugugauacuccguggcaucuguucug

SEQ ID NO: 291527 - RNA, 20 nt, Human
uuacaaggggcugcuuuggu

SEQ ID NO: 291528 - RNA, 19 nt, Human
uuaguccuggggcucuugc

SEQ ID NO: 291529 - RNA, 22 nt, Human
uucaaggcuggacaaguccucc

SEQ ID NO: 291530 - RNA, 23 nt, Human
uucccccagagcugccggcacaa

SEQ ID NO: 291531 - RNA, 18 nt, Human
uugaaucacugcuuuucc

SEQ ID NO: 291532 - RNA, 20 nt, Human
uuggauccagaggcgucuga

SEQ ID NO: 291533 - RNA, 22 nt, Human
uugguccacuucagcaaaugau

SEQ ID NO: 291534 - RNA, 21 nt, Human
uuuccuguuucucuccccuuc

SEQ ID NO: 291535 - RNA, 24 nt, Human
uuuccuguuucucuccccuucccc

SEQ ID NO: 291536 - RNA, 18 nt, Human
uuuuuuuuuuuuuuuuug

SEQ ID NO: 291537 - RNA, 22 nt, Human
aacucagaaagcauaccaucau

SEQ ID NO: 291538 - RNA, 21 nt, Human
aagaaaaaacagaaccuauca

SEQ ID NO: 291539 - RNA, 21 nt, Human
aagagaauaagacagcaacug

SEQ ID NO: 291540 - RNA, 18 nt, Human
acugcauuucauugaauu

SEQ ID NO: 291541 - RNA, 22 nt, Human
agcaggaaucugucugcccucu

SEQ ID NO: 291542 - RNA, 22 nt, Human
auagagucuucuuugacguuca

SEQ ID NO: 291543 - RNA, 21 nt, Human
auuuucaugcccacauauucc

SEQ ID NO: 291544 - RNA, 28 nt, Human
caagaaaauguuacuaggaaaauuuuua

SEQ ID NO: 291545 - RNA, 20 nt, Human
caagagguuugcccgacuaa

SEQ ID NO: 291546 - RNA, 21 nt, Human
cacaaugagaaauaaagagaa

SEQ ID NO: 291547 - RNA, 26 nt, Human
cagcaaguuuucuugccaaggcugcc

SEQ ID NO: 291548 - RNA, 22 nt, Human
caucaagaaaauguuacuagga

SEQ ID NO: 291549 - RNA, 18 nt, Human
ccacaugauagacaugcc

SEQ ID NO: 291550 - RNA, 19 nt, Human
cccgacuaaaauaagaaaa

SEQ ID NO: 291551 - RNA, 19 nt, Human
ccuacaaucuagguacauu

SEQ ID NO: 291552 - RNA, 22 nt, Human
cgacuaaaauaagaaaagcaaa

SEQ ID NO: 291553 - RNA, 19 nt, Human
cgguaguauuucuucuuac

SEQ ID NO: 291554 - RNA, 21 nt, Human
cuaagcugcuagcaggaaucu

SEQ ID NO: 291555 - RNA, 19 nt, Human
cuuauuuguaacagucugc

SEQ ID NO: 291556 - RNA, 19 nt, Human
cuucaagaaaaaacagaac

SEQ ID NO: 291557 - RNA, 22 nt, Human
cuucaagaaaaaacagaaccua

SEQ ID NO: 291558 - RNA, 26 nt, Human
cuugcacaucccuuuaaaaagaacca

SEQ ID NO: 291559 - RNA, 22 nt, Human
gagaaaaaaaacugcauuucau

SEQ ID NO: 291560 - RNA, 19 nt, Human
gauuaugcagcaaguuuuc

SEQ ID NO: 291561 - RNA, 18 nt, Human
ggaagggaaagcacaaug

SEQ ID NO: 291562 - RNA, 25 nt, Human
uaaaagcaagucagaguaaaagaug

SEQ ID NO: 291563 - RNA, 21 nt, Human
uaagacagcaacugaaaaagu

SEQ ID NO: 291564 - RNA, 21 nt, Human
uaagcauacuacuaagauaaa

SEQ ID NO: 291565 - RNA, 23 nt, Human
uaagcugcuagcaggaaucuguc

SEQ ID NO: 291566 - RNA, 23 nt, Human
uaccaaauacauaggcuucaaga

SEQ ID NO: 291567 - RNA, 23 nt, Human
uagaaaagcaaaacaguucaaca

SEQ ID NO: 291568 - RNA, 20 nt, Human
uaguagugaugagguuaaua

SEQ ID NO: 291569 - RNA, 27 nt, Human
uauaaagaagggaagggaaagcacaau

SEQ ID NO: 291570 - RNA, 21 nt, Human
uaugucugucaucuccuacaa

SEQ ID NO: 291571 - RNA, 21 nt, Human
ucacucaaagcugauuugcgg

SEQ ID NO: 291572 - RNA, 21 nt, Human
ucagaaaacagaugacuacau

SEQ ID NO: 291573 - RNA, 26 nt, Human
ugaaauaccuuaugucugucaucucc

SEQ ID NO: 291574 - RNA, 19 nt, Human
ugagaaauaaagagaauaa

SEQ ID NO: 291575 - RNA, 21 nt, Human
ugcauuucauugaauuugggg

SEQ ID NO: 291576 - RNA, 23 nt, Human
ugcccgacuaaaauaagaaaagc

SEQ ID NO: 291577 - RNA, 20 nt, Human
ugugaggcauugauauccac

SEQ ID NO: 291578 - RNA, 26 nt, Human
uguuacuaggaaaauuuuuagaaaag

SEQ ID NO: 291579 - RNA, 19 nt, Human
uucaaauuugauguucaac

SEQ ID NO: 291580 - RNA, 20 nt, Human
uugggguaaaauaauagagu

SEQ ID NO: 291581 - RNA, 24 nt, Human
uuuaaauuaaaaacgagaaaaaaa

SEQ ID NO: 291582 - RNA, 23 nt, Human
uuucaugcccacauauucccacu

SEQ ID NO: 291583 - RNA, 21 nt, Human
aaacagaaagaaugcaaaugg

SEQ ID NO: 291584 - RNA, 26 nt, Human
aaacgagaagacaaaacuuuacagaa

SEQ ID NO: 291585 - RNA, 19 nt, Human
aacuaaccaucuaaguaau

SEQ ID NO: 291586 - RNA, 19 nt, Human
aagaggcugaauuucccuu

SEQ ID NO: 291587 - RNA, 19 nt, Human
aagccagucucaacuccga

SEQ ID NO: 291588 - RNA, 21 nt, Human
aagcggcguggagaguuggcc

SEQ ID NO: 291589 - RNA, 20 nt, Human
aaugggugcuaaucgcccgc

SEQ ID NO: 291590 - RNA, 18 nt, Human
aauguaguaugaauuagg

SEQ ID NO: 291591 - RNA, 23 nt, Human
acagaagauaaucugucucagag

SEQ ID NO: 291592 - RNA, 21 nt, Human
acagcccccucggcgcccccc

SEQ ID NO: 291593 - RNA, 20 nt, Human
accacagcccccucggcgcc

SEQ ID NO: 291594 - RNA, 24 nt, Human
accaggcgcuggggccagcaacaa

SEQ ID NO: 291595 - RNA, 19 nt, Human
acgaagcagccgccugaaa

SEQ ID NO: 291596 - RNA, 21 nt, Human
acgaagcagccgccugaaacc

SEQ ID NO: 291597 - RNA, 23 nt, Human
acuccaaacccaggcucugcucc

SEQ ID NO: 291598 - RNA, 23 nt, Human
agaaaauaauuucaggugaaaac

SEQ ID NO: 291599 - RNA, 22 nt, Human
agaaagugaguguugggaauca

SEQ ID NO: 291600 - RNA, 22 nt, Human
agaauccccggcucuagucccc

SEQ ID NO: 291601 - RNA, 19 nt, Human
agagggaggggagggaggg

SEQ ID NO: 291602 - RNA, 22 nt, Human
agagggaggggagggagggggc

SEQ ID NO: 291603 - RNA, 19 nt, Human
agcagugcgcaccgugcgg

SEQ ID NO: 291604 - RNA, 18 nt, Human
agcccccucggcgccccc

SEQ ID NO: 291605 - RNA, 22 nt, Human
agcccgagccaucuucagagac

SEQ ID NO: 291606 - RNA, 21 nt, Human
aggcagaaguggcaggcaaag

SEQ ID NO: 291607 - RNA, 24 nt, Human
aggcgcuggggccagcaacaagcc

SEQ ID NO: 291608 - RNA, 20 nt, Human
agggaggggagggagggggc

SEQ ID NO: 291609 - RNA, 21 nt, Human
agggcaggcuccagcagguuu

SEQ ID NO: 291610 - RNA, 20 nt, Human
agguggggaaugagccugca

SEQ ID NO: 291611 - RNA, 18 nt, Human
agucgcaguacucacagu

SEQ ID NO: 291612 - RNA, 23 nt, Human
auauuuuuaaaccagcaguuuca

SEQ ID NO: 291613 - RNA, 23 nt, Human
caaacagaaagaaugcaaauggu

SEQ ID NO: 291614 - RNA, 23 nt, Human
caacaagccagucucaacuccga

SEQ ID NO: 291615 - RNA, 19 nt, Human
caacccagagucauccccu

SEQ ID NO: 291616 - RNA, 26 nt, Human
caacccagagucauccccucagcggg

SEQ ID NO: 291617 - RNA, 18 nt, Human
cacacauauuuauucugg

SEQ ID NO: 291618 - RNA, 22 nt, Human
cacagcccccucggcgcccccc

SEQ ID NO: 291619 - RNA, 22 nt, Human
caccccacggccaagggcaggc

SEQ ID NO: 291620 - RNA, 19 nt, Human
caccgugcggugcccaagu

SEQ ID NO: 291621 - RNA, 23 nt, Human
cagacaaacgugagucgcuuccu

SEQ ID NO: 291622 - RNA, 19 nt, Human
cagcccccucggcgccccc

SEQ ID NO: 291623 - RNA, 21 nt, Human
cagcccccucggcgccccccu

SEQ ID NO: 291624 - RNA, 20 nt, Human
cagccuuucgcccacggggg

SEQ ID NO: 291625 - RNA, 19 nt, Human
cagcgauagaugcuucuuu

SEQ ID NO: 291626 - RNA, 23 nt, Human
ccacagcccccucggcgcccccc

SEQ ID NO: 291627 - RNA, 19 nt, Human
ccacccagacaaacgugag

SEQ ID NO: 291628 - RNA, 21 nt, Human
cccaacccagagucauccccu

SEQ ID NO: 291629 - RNA, 25 nt, Human
cccacggccaagggcaggcuccagc

SEQ ID NO: 291630 - RNA, 23 nt, Human
ccccaacccagagucauccccuc

SEQ ID NO: 291631 - RNA, 19 nt, Human
cccccgccugccagcccgc

SEQ ID NO: 291632 - RNA, 22 nt, Human
cccccggcgcgccaaagagaag

SEQ ID NO: 291633 - RNA, 20 nt, Human
ccccgaguccucuccccucu

SEQ ID NO: 291634 - RNA, 25 nt, Human
ccccgcucugucggaaggggccaga

SEQ ID NO: 291635 - RNA, 21 nt, Human
cccggcacgucgcuucgggca

SEQ ID NO: 291636 - RNA, 24 nt, Human
cccggcgcgccaaagagaagcccg

SEQ ID NO: 291637 - RNA, 18 nt, Human
cccucggcgccccccucc

SEQ ID NO: 291638 - RNA, 21 nt, Human
ccgcagcagccuuucgcccac

SEQ ID NO: 291639 - RNA, 20 nt, Human
ccgcagcagccuuucgcccc

SEQ ID NO: 291640 - RNA, 18 nt, Human
ccugcaccaggcgcuggg

SEQ ID NO: 291641 - RNA, 24 nt, Human
ccuuucgcccacgggggcgaaggc

SEQ ID NO: 291642 - RNA, 19 nt, Human
cgaagcagccgccugaaac

SEQ ID NO: 291643 - RNA, 22 nt, Human
cgagagggaggggagggagggg

SEQ ID NO: 291644 - RNA, 18 nt, Human
cgaguccucuccccucuc

SEQ ID NO: 291645 - RNA, 21 nt, Human
cgcaaggucauuagucacgaa

SEQ ID NO: 291646 - RNA, 21 nt, Human
cgcagcagccuuucgcccacg

SEQ ID NO: 291647 - RNA, 27 nt, Human
cggaaggggccagaaccgcuccggcag

SEQ ID NO: 291648 - RNA, 18 nt, Human
cggcgcgccaaagagaag

SEQ ID NO: 291649 - RNA, 20 nt, Human
cgggaaugggggugggaggg

SEQ ID NO: 291650 - RNA, 24 nt, Human
cguuccaggcacucacuccaaacc

SEQ ID NO: 291651 - RNA, 26 nt, Human
cucccccaacccagagucaucccccc

SEQ ID NO: 291652 - RNA, 22 nt, Human
cuccccucucccggaaaggaag

SEQ ID NO: 291653 - RNA, 19 nt, Human
cugaauacuucuuucagua

SEQ ID NO: 291654 - RNA, 25 nt, Human
cuguuucauacauuuauuuuauuuu

SEQ ID NO: 291655 - RNA, 21 nt, Human
cuucuccugcugcugcugccg

SEQ ID NO: 291656 - RNA, 22 nt, Human
cuucuccugcugcugcugcuac

SEQ ID NO: 291657 - RNA, 23 nt, Human
gaagagaaagugaguguugggaa

SEQ ID NO: 291658 - RNA, 24 nt, Human
gaaggagcgagagggaggggaggg

SEQ ID NO: 291659 - RNA, 19 nt, Human
gacucugcucaugcagcgg

SEQ ID NO: 291660 - RNA, 23 nt, Human
gagaauccccggcucuagucccc

SEQ ID NO: 291661 - RNA, 21 nt, Human
gagcagugcgcaccgugcggu

SEQ ID NO: 291662 - RNA, 19 nt, Human
gaguagaaaggucaucaca

SEQ ID NO: 291663 - RNA, 26 nt, Human
gauagaugcuucuuuuuuuccuccug

SEQ ID NO: 291664 - RNA, 24 nt, Human
gcaaacuuuuaauaccaaacagaa

SEQ ID NO: 291665 - RNA, 19 nt, Human
gcacucacuccaaacccag

SEQ ID NO: 291666 - RNA, 21 nt, Human
gcccgagccaucuucagagac

SEQ ID NO: 291667 - RNA, 20 nt, Human
gcgccgcggguucggcgcuc

SEQ ID NO: 291668 - RNA, 20 nt, Human
gcuccuucuaaccacagccc

SEQ ID NO: 291669 - RNA, 22 nt, Human
gcugcuacugcuccuucuaacc

SEQ ID NO: 291670 - RNA, 27 nt, Human
ggaaaggaaggagcgagagggagggga

SEQ ID NO: 291671 - RNA, 25 nt, Human
ggaaggagcgagagggaggggaggg

SEQ ID NO: 291672 - RNA, 26 nt, Human
ggaaggggccagaaccgcuccggcag

SEQ ID NO: 291673 - RNA, 22 nt, Human
ggaaucagugaagggguuagac

SEQ ID NO: 291674 - RNA, 22 nt, Human
ggagagcgcggguuucucuuuu

SEQ ID NO: 291675 - RNA, 19 nt, Human
ggagcgagagggaggggag

SEQ ID NO: 291676 - RNA, 24 nt, Human
ggaggggagggagggggcaaaagc

SEQ ID NO: 291677 - RNA, 20 nt, Human
ggcugggaagagguggggaa

SEQ ID NO: 291678 - RNA, 21 nt, Human
ggggagccagucaacagaucg

SEQ ID NO: 291679 - RNA, 22 nt, Human
guacucacaguucacgggacac

SEQ ID NO: 291680 - RNA, 24 nt, Human
guagcacauuucugcauuaauacu

SEQ ID NO: 291681 - RNA, 22 nt, Human
gugcgcaccgugcggugcccaa

SEQ ID NO: 291682 - RNA, 23 nt, Human
guuccaggcacucacuccaaacc

SEQ ID NO: 291683 - RNA, 20 nt, Human
uaacaguaucacuaaaggcc

SEQ ID NO: 291684 - RNA, 21 nt, Human
uacaacaaguggaacaagcag

SEQ ID NO: 291685 - RNA, 23 nt, Human
uacagaagauaaucugucucaga

SEQ ID NO: 291686 - RNA, 21 nt, Human
uaccaaacagaaagaaugcaa

SEQ ID NO: 291687 - RNA, 18 nt, Human
uaccucuuguagauggcc

SEQ ID NO: 291688 - RNA, 21 nt, Human
uacucgaguugaguccaauuc

SEQ ID NO: 291689 - RNA, 20 nt, Human
uauaaaagauugaaagugga

SEQ ID NO: 291690 - RNA, 24 nt, Human
uauaaaagauugaaaguggaguuu

SEQ ID NO: 291691 - RNA, 18 nt, Human
uauuguuucauaauucau

SEQ ID NO: 291692 - RNA, 24 nt, Human
ucaaaaauaaaauguacaacaagu

SEQ ID NO: 291693 - RNA, 24 nt, Human
ucagacauccauuaguagcacauu

SEQ ID NO: 291694 - RNA, 21 nt, Human
uccugcugcugcugcuacugc

SEQ ID NO: 291695 - RNA, 24 nt, Human
uccugcugcugcugcuacugcucc

SEQ ID NO: 291696 - RNA, 26 nt, Human
uccugcugcugcugcuacugcuccuu

SEQ ID NO: 291697 - RNA, 23 nt, Human
uccugcuucuuccgaaaguuauu

SEQ ID NO: 291698 - RNA, 21 nt, Human
ucgaguugaguccaauucacg

SEQ ID NO: 291699 - RNA, 18 nt, Human
ucuccugcugcugcugcu

SEQ ID NO: 291700 - RNA, 23 nt, Human
ucuccugcugcugcugcuacugc

SEQ ID NO: 291701 - RNA, 19 nt, Human
ucucuuugguagcccccuc

SEQ ID NO: 291702 - RNA, 22 nt, Human
ucucuuuuuucuuaacaacucu

SEQ ID NO: 291703 - RNA, 22 nt, Human
ugaagggguuagacaugcaagu

SEQ ID NO: 291704 - RNA, 22 nt, Human
ugacucagacauccauuaguag

SEQ ID NO: 291705 - RNA, 21 nt, Human
ugagaaagaaaaagacucaaa

SEQ ID NO: 291706 - RNA, 22 nt, Human
ugcaaagagaacugccaaacac

SEQ ID NO: 291707 - RNA, 26 nt, Human
ugcaaguaacaaggaugguuucuaca

SEQ ID NO: 291708 - RNA, 19 nt, Human
ugcaccaggcgcuggggcc

SEQ ID NO: 291709 - RNA, 22 nt, Human
ugccacagaagaaaauaauuuc

SEQ ID NO: 291710 - RNA, 24 nt, Human
ugccacagaagaaaauaauuucag

SEQ ID NO: 291711 - RNA, 21 nt, Human
ugcggugcccaaguuuggguu

SEQ ID NO: 291712 - RNA, 18 nt, Human
ugcuaaccgccucuuuaa

SEQ ID NO: 291713 - RNA, 20 nt, Human
ugcuccggcuccggccaccc

SEQ ID NO: 291714 - RNA, 21 nt, Human
ugcuccuucuaaccacagccc

SEQ ID NO: 291715 - RNA, 21 nt, Human
uggaaacaaaaaaauguagua

SEQ ID NO: 291716 - RNA, 24 nt, Human
uggaauuucuggugacucagacau

SEQ ID NO: 291717 - RNA, 18 nt, Human
uggaggcagaaguggcag

SEQ ID NO: 291718 - RNA, 18 nt, Human
uggggaagagaaagugag

SEQ ID NO: 291719 - RNA, 21 nt, Human
ugucucuuugguagcccccuc

SEQ ID NO: 291720 - RNA, 20 nt, Human
uguugggaaucagugaaggg

SEQ ID NO: 291721 - RNA, 18 nt, Human
uguuuuuuuuuuuuugga

SEQ ID NO: 291722 - RNA, 23 nt, Human
uugucucuuugguagcccccucu

SEQ ID NO: 291723 - RNA, 26 nt, Human
uugucucuuugguagcccccucuuug

SEQ ID NO: 291724 - RNA, 25 nt, Human
uuucauaauucaugcaaugggugcu

SEQ ID NO: 291725 - RNA, 19 nt, Human
uuuuccuccugcuucuucc

SEQ ID NO: 291726 - RNA, 20 nt, Human
uuuuccuccugcuucuuccg

SEQ ID NO: 291727 - RNA, 26 nt, Human
uuuuguuuuuuuuuuuuuggagaggg

SEQ ID NO: 291728 - RNA, 23 nt, Human
uuuuuuggagagggguggggaag

SEQ ID NO: 291729 - RNA, 23 nt, Human
uuuuuuuuuuuggagaggggugg

SEQ ID NO: 291730 - RNA, 19 nt, Human
aaaaacacuaagaaaaugg

SEQ ID NO: 291731 - RNA, 23 nt, Human
aaauaccaaacaguaccaaugug

SEQ ID NO: 291732 - RNA, 21 nt, Human
aacuuccacuuuagcuuuuau

SEQ ID NO: 291733 - RNA, 19 nt, Human
aagaaaauggcaagccgca

SEQ ID NO: 291734 - RNA, 18 nt, Human
aggcucucggaaucacgc

SEQ ID NO: 291735 - RNA, 22 nt, Human
caagugcgauccgaaaggcuaa

SEQ ID NO: 291736 - RNA, 21 nt, Human
cauaaaaauuacauuaacuac

SEQ ID NO: 291737 - RNA, 19 nt, Human
cccucacucugcgccucuc

SEQ ID NO: 291738 - RNA, 19 nt, Human
ccucacucugcgccucucc

SEQ ID NO: 291739 - RNA, 22 nt, Human
cgggagaagucugcggguagca

SEQ ID NO: 291740 - RNA, 24 nt, Human
cuuggcaaggcaaaauuucucaaa

SEQ ID NO: 291741 - RNA, 23 nt, Human
gcaaauaccaaacaguaccaaug

SEQ ID NO: 291742 - RNA, 23 nt, Human
gccuccagccucaagugcgaucc

SEQ ID NO: 291743 - RNA, 27 nt, Human
uaaaaacacuaagaaaauggcaagccg

SEQ ID NO: 291744 - RNA, 18 nt, Human
uacacaauguacagguua

SEQ ID NO: 291745 - RNA, 19 nt, Human
uagcagcuccgagccucca

SEQ ID NO: 291746 - RNA, 19 nt, Human
uaggggcuucucggaguga

SEQ ID NO: 291747 - RNA, 24 nt, Human
uauauacaaacauuacauuacaca

SEQ ID NO: 291748 - RNA, 21 nt, Human
ucaauaacuuaggggcuucuc

SEQ ID NO: 291749 - RNA, 23 nt, Human
uccuuuggcaauaacuuccacuu

SEQ ID NO: 291750 - RNA, 22 nt, Human
ucuucaaacacaugacaaaucu

SEQ ID NO: 291751 - RNA, 22 nt, Human
ugaaaucuaccacagagucaag

SEQ ID NO: 291752 - RNA, 22 nt, Human
uggcaauaacuuccacuuuagc

SEQ ID NO: 291753 - RNA, 21 nt, Human
uguacagguuaaaaacacuaa

SEQ ID NO: 291754 - RNA, 20 nt, Human
ugucuuacagacaguuccuu

SEQ ID NO: 291755 - RNA, 18 nt, Human
uguuuuguuuuuugucuu

SEQ ID NO: 291756 - RNA, 21 nt, Human
uucaaacacaugacaaaucuu

SEQ ID NO: 291757 - RNA, 20 nt, Human
uugaaaucaaagucaauagc

SEQ ID NO: 291758 - RNA, 24 nt, Human
uuuguuuuuugucuuacagacagu

SEQ ID NO: 291759 - RNA, 20 nt, Human
aacacucauucuccucagca

SEQ ID NO: 291760 - RNA, 22 nt, Human
aagaucacaacaaugaccacca

SEQ ID NO: 291761 - RNA, 23 nt, Human
aagcgugugcaaagacuuagggu

SEQ ID NO: 291762 - RNA, 19 nt, Human
acacucauucuccucagca

SEQ ID NO: 291763 - RNA, 18 nt, Human
acaguacuauacuuuggc

SEQ ID NO: 291764 - RNA, 24 nt, Human
accaaaggggcauccccagcuuua

SEQ ID NO: 291765 - RNA, 23 nt, Human
accaccucaaguucaaagaaaca

SEQ ID NO: 291766 - RNA, 21 nt, Human
acucuggaggcugucaaaacu

SEQ ID NO: 291767 - RNA, 23 nt, Human
aggaauacaagcacaagcgugug

SEQ ID NO: 291768 - RNA, 18 nt, Human
aggaauggcugagagggg

SEQ ID NO: 291769 - RNA, 18 nt, Human
aggcacugaagugaucug

SEQ ID NO: 291770 - RNA, 22 nt, Human
aggcacugaagugaucugaacu

SEQ ID NO: 291771 - RNA, 22 nt, Human
agguaaaaaucccucaggucca

SEQ ID NO: 291772 - RNA, 24 nt, Human
agugucaacauccacugcaaaaac

SEQ ID NO: 291773 - RNA, 18 nt, Human
agugucugguuugagaug

SEQ ID NO: 291774 - RNA, 26 nt, Human
aucaccaccucaaguucaaagaaaca

SEQ ID NO: 291775 - RNA, 21 nt, Human
aucagaggcaacaauuuuaaa

SEQ ID NO: 291776 - RNA, 21 nt, Human
auccagaacaguaacaaucac

SEQ ID NO: 291777 - RNA, 24 nt, Human
auccaguccaaaaacacucugccc

SEQ ID NO: 291778 - RNA, 23 nt, Human
augaaaugggaccucucuuucaa

SEQ ID NO: 291779 - RNA, 23 nt, Human
caaaaacacucugcccauuuaac

SEQ ID NO: 291780 - RNA, 18 nt, Human
caaacgaugcaaucccac

SEQ ID NO: 291781 - RNA, 22 nt, Human
caaaugaaaugggaccucucuu

SEQ ID NO: 291782 - RNA, 23 nt, Human
caacaaagaagaggucucuaaca

SEQ ID NO: 291783 - RNA, 19 nt, Human
caacaaugaccaccauggc

SEQ ID NO: 291784 - RNA, 19 nt, Human
caacauccacugcaaaaac

SEQ ID NO: 291785 - RNA, 23 nt, Human
caagcugauaaacaaugucugca

SEQ ID NO: 291786 - RNA, 19 nt, Human
caaucagagcagccaacag

SEQ ID NO: 291787 - RNA, 22 nt, Human
cacaguacuauacuuuggcaga

SEQ ID NO: 291788 - RNA, 24 nt, Human
cacugcaaaaacuucugcuaccac

SEQ ID NO: 291789 - RNA, 18 nt, Human
cacugucuucaucugugg

SEQ ID NO: 291790 - RNA, 26 nt, Human
cagagcagccaacagguaaaaauccc

SEQ ID NO: 291791 - RNA, 20 nt, Human
cagauaaauacacggugcca

SEQ ID NO: 291792 - RNA, 22 nt, Human
cagcaucugcaucugucacugu

SEQ ID NO: 291793 - RNA, 21 nt, Human
caucacuuacugugaccugca

SEQ ID NO: 291794 - RNA, 22 nt, Human
cauccagaacaguaacaaucac

SEQ ID NO: 291795 - RNA, 23 nt, Human
ccagaacaguaacaaucacagcc

SEQ ID NO: 291796 - RNA, 21 nt, Human
ccaguccaaaaacacucugcc

SEQ ID NO: 291797 - RNA, 22 nt, Human
ccaguccaaaaacacucugccc

SEQ ID NO: 291798 - RNA, 22 nt, Human
cccaacaaagguguuguccaaa

SEQ ID NO: 291799 - RNA, 23 nt, Human
cccacaucaguaggugcugguuu

SEQ ID NO: 291800 - RNA, 18 nt, Human
ccggcgaugauggcaauc

SEQ ID NO: 291801 - RNA, 22 nt, Human
cgaagaucacaacaaugaccac

SEQ ID NO: 291802 - RNA, 20 nt, Human
cguuaacauaaaggaauaca

SEQ ID NO: 291803 - RNA, 22 nt, Human
cuccuugggaacugcacucuga

SEQ ID NO: 291804 - RNA, 19 nt, Human
cucugcccauuuaacaauu

SEQ ID NO: 291805 - RNA, 19 nt, Human
cugaaacuguaauuagggc

SEQ ID NO: 291806 - RNA, 21 nt, Human
cugaagaaaucauuggggagg

SEQ ID NO: 291807 - RNA, 23 nt, Human
cuugaagccuccuugggaacugc

SEQ ID NO: 291808 - RNA, 24 nt, Human
cuugagcuauugcggaauccagcc

SEQ ID NO: 291809 - RNA, 21 nt, Human
gacaggagauggaaacauggg

SEQ ID NO: 291810 - RNA, 18 nt, Human
gagcaggaguggagcugc

SEQ ID NO: 291811 - RNA, 22 nt, Human
gaugcacaaauugcaagaggaa

SEQ ID NO: 291812 - RNA, 18 nt, Human
gcacaaauugcaagagga

SEQ ID NO: 291813 - RNA, 21 nt, Human
gcugaauuacagagguaccua

SEQ ID NO: 291814 - RNA, 20 nt, Human
ggaauaugcaccuccacuug

SEQ ID NO: 291815 - RNA, 26 nt, Human
ggaauaugcaccuccacuugacccuc

SEQ ID NO: 291816 - RNA, 19 nt, Human
ggagauggaaacauggggg

SEQ ID NO: 291817 - RNA, 22 nt, Human
ggagugccuccauccucuacuu

SEQ ID NO: 291818 - RNA, 26 nt, Human
ggcaaucagagcagccaacagguaaa

SEQ ID NO: 291819 - RNA, 23 nt, Human
gggcgaccugggcaccaaaaaug

SEQ ID NO: 291820 - RNA, 20 nt, Human
guaaaaaucccucaggucca

SEQ ID NO: 291821 - RNA, 28 nt, Human
uaaaaaugaaucguucuuguucuucucu

SEQ ID NO: 291822 - RNA, 23 nt, Human
uaaacaggcaaucagagcagcca

SEQ ID NO: 291823 - RNA, 20 nt, Human
uaaaggaaguauuagacggu

SEQ ID NO: 291824 - RNA, 25 nt, Human
uaaggggcccuuugucuugaagccu

SEQ ID NO: 291825 - RNA, 20 nt, Human
uacaagcacaagcgugugca

SEQ ID NO: 291826 - RNA, 19 nt, Human
uacaggcugguugaaaauu

SEQ ID NO: 291827 - RNA, 19 nt, Human
uaccggauuucagcauuac

SEQ ID NO: 291828 - RNA, 20 nt, Human
uaccugaggucuauauuagg

SEQ ID NO: 291829 - RNA, 24 nt, Human
uacucuggaggcugucaaaacucc

SEQ ID NO: 291830 - RNA, 18 nt, Human
uacugccuauaucugcau

SEQ ID NO: 291831 - RNA, 23 nt, Human
uagaaagggugucacaaccccca

SEQ ID NO: 291832 - RNA, 20 nt, Human
uagacgguggagaaaugaca

SEQ ID NO: 291833 - RNA, 19 nt, Human
uaggaggguuaucauuuac

SEQ ID NO: 291834 - RNA, 18 nt, Human
uaggguaccccaggucac

SEQ ID NO: 291835 - RNA, 23 nt, Human
uauaacccacgucgguuguuuuc

SEQ ID NO: 291836 - RNA, 24 nt, Human
ucaaagaaacacucauucuccuca

SEQ ID NO: 291837 - RNA, 21 nt, Human
ucacaacaaugaccaccaugg

SEQ ID NO: 291838 - RNA, 23 nt, Human
ucacaacaaugaccaccauggca

SEQ ID NO: 291839 - RNA, 22 nt, Human
ucacugugauuacccccacagu

SEQ ID NO: 291840 - RNA, 20 nt, Human
ucagauccuuugguauguuu

SEQ ID NO: 291841 - RNA, 18 nt, Human
ucagcguucauuccagug

SEQ ID NO: 291842 - RNA, 22 nt, Human
ucaguaggugcugguuuuucuu

SEQ ID NO: 291843 - RNA, 22 nt, Human
uccacgauauccaguccaaaaa

SEQ ID NO: 291844 - RNA, 19 nt, Human
uccagaucaaagaaggagg

SEQ ID NO: 291845 - RNA, 22 nt, Human
uccuauacuuugcuccuccagu

SEQ ID NO: 291846 - RNA, 18 nt, Human
ucuacuuugauuuucauc

SEQ ID NO: 291847 - RNA, 19 nt, Human
ucucuaucuaaggaccucu

SEQ ID NO: 291848 - RNA, 22 nt, Human
ucugcauuuuucccacugucuu

SEQ ID NO: 291849 - RNA, 22 nt, Human
ucugcuaccacggagccaggaa

SEQ ID NO: 291850 - RNA, 20 nt, Human
ucuguggagugccuccaucc

SEQ ID NO: 291851 - RNA, 24 nt, Human
ugaaaagcaggcuguggagaagca

SEQ ID NO: 291852 - RNA, 22 nt, Human
ugaaaugggaccucucuuucaa

SEQ ID NO: 291853 - RNA, 26 nt, Human
ugacaggagauggaaacaugggggca

SEQ ID NO: 291854 - RNA, 25 nt, Human
ugacuccagaauagggauccaacac

SEQ ID NO: 291855 - RNA, 21 nt, Human
ugauaaacaaugucugcauuu

SEQ ID NO: 291856 - RNA, 19 nt, Human
ugauagguucaugaacugc

SEQ ID NO: 291857 - RNA, 22 nt, Human
ugaugcacaaauugcaagagga

SEQ ID NO: 291858 - RNA, 19 nt, Human
ugcaaaaacuucugcuacc

SEQ ID NO: 291859 - RNA, 22 nt, Human
ugcacaaauugcaagaggaagc

SEQ ID NO: 291860 - RNA, 21 nt, Human
ugcaggggcgaccugggcacc

SEQ ID NO: 291861 - RNA, 24 nt, Human
ugcaucugucacugugauuacccc

SEQ ID NO: 291862 - RNA, 23 nt, Human
uggaaagcggcuguugaucaaag

SEQ ID NO: 291863 - RNA, 21 nt, Human
uggagaagcagauuuguagug

SEQ ID NO: 291864 - RNA, 23 nt, Human
uggcauggagcugaauuacagag

SEQ ID NO: 291865 - RNA, 20 nt, Human
uggccguacuggauuucugu

SEQ ID NO: 291866 - RNA, 24 nt, Human
ugguuguccuccaucaguggcuuu

SEQ ID NO: 291867 - RNA, 21 nt, Human
ugguuugagaugaaaagcagg

SEQ ID NO: 291868 - RNA, 21 nt, Human
ugucauuuucauccucaagcu

SEQ ID NO: 291869 - RNA, 21 nt, Human
ugucugguuugagaugaaaag

SEQ ID NO: 291870 - RNA, 21 nt, Human
ugucuugaagccuccuuggga

SEQ ID NO: 291871 - RNA, 18 nt, Human
ugugaauggcugucuccu

SEQ ID NO: 291872 - RNA, 20 nt, Human
uucagaaacugacagcucaa

SEQ ID NO: 291873 - RNA, 21 nt, Human
uugaagccugugucaggaucu

SEQ ID NO: 291874 - RNA, 18 nt, Human
uugacccucuuuaaacac

SEQ ID NO: 291875 - RNA, 23 nt, Human
uugaucaaaguguuuucuggaau

SEQ ID NO: 291876 - RNA, 23 nt, Human
uuggaggggaggggucccauugu

SEQ ID NO: 291877 - RNA, 18 nt, Human
uuggcuuuggaggggagg

SEQ ID NO: 291878 - RNA, 24 nt, Human
uuguccaaagggaguuccugaauc

SEQ ID NO: 291879 - RNA, 21 nt, Human
uugucuugaagccuccuuggg

SEQ ID NO: 291880 - RNA, 23 nt, Human
uuucaucacauagguaucuuucu

SEQ ID NO: 291881 - RNA, 18 nt, Human
uuugauaggguuggcuac

SEQ ID NO: 291882 - RNA, 18 nt, Human
uuuguagugcuuggccag

SEQ ID NO: 291883 - RNA, 21 nt, Human
uuugugaauggcugucuccuc

SEQ ID NO: 291884 - RNA, 25 nt, Human
aaaaggaaaacuaaaccaaagagaa

SEQ ID NO: 291885 - RNA, 23 nt, Human
aaacucccaagcugcucaaucuc

SEQ ID NO: 291886 - RNA, 22 nt, Human
aacucccaagcugcucaaucuc

SEQ ID NO: 291887 - RNA, 22 nt, Human
aacuguuggcuugcagguauga

SEQ ID NO: 291888 - RNA, 26 nt, Human
aagcuaaaaguagacaagagggaccc

SEQ ID NO: 291889 - RNA, 23 nt, Human
aagcugcucaaucucaaaacuuu

SEQ ID NO: 291890 - RNA, 19 nt, Human
aauccugcagagcugaagu

SEQ ID NO: 291891 - RNA, 30 nt, Human
aaugcuuuuuuuaaauaacagacuccuacu

SEQ ID NO: 291892 - RNA, 24 nt, Human
acauguguugguaacaaguuuuac

SEQ ID NO: 291893 - RNA, 21 nt, Human
accaccauuuucauuuauuag

SEQ ID NO: 291894 - RNA, 22 nt, Human
accuugaagacauuuuuuaaag

SEQ ID NO: 291895 - RNA, 21 nt, Human
acuaaaccaaagagaaggugu

SEQ ID NO: 291896 - RNA, 19 nt, Human
agaaaggaaacuugggucu

SEQ ID NO: 291897 - RNA, 22 nt, Human
agacaggauccccggagcacag

SEQ ID NO: 291898 - RNA, 19 nt, Human
agagagagagagaaagaga

SEQ ID NO: 291899 - RNA, 19 nt, Human
agaggguggcugccaccuc

SEQ ID NO: 291900 - RNA, 21 nt, Human
agccaauaucuggcacucgca

SEQ ID NO: 291901 - RNA, 23 nt, Human
agccagaguggagagaaagaguu

SEQ ID NO: 291902 - RNA, 18 nt, Human
agcuuuuacgacaaaacc

SEQ ID NO: 291903 - RNA, 19 nt, Human
aggagaaaggaaacuuggg

SEQ ID NO: 291904 - RNA, 23 nt, Human
aguuacacacccuucaaaauaug

SEQ ID NO: 291905 - RNA, 21 nt, Human
auaaaucuaugaaacaacaaa

SEQ ID NO: 291906 - RNA, 21 nt, Human
auaccauuagaauuucaaagc

SEQ ID NO: 291907 - RNA, 21 nt, Human
augcaagaggcagccccagag

SEQ ID NO: 291908 - RNA, 24 nt, Human
auucaagacaaaacugccauuaau

SEQ ID NO: 291909 - RNA, 22 nt, Human
caacaauaaagcuuaaaguuca

SEQ ID NO: 291910 - RNA, 23 nt, Human
caacagacuuuagggucuccuaa

SEQ ID NO: 291911 - RNA, 21 nt, Human
cacagaauuaguagauugaaa

SEQ ID NO: 291912 - RNA, 20 nt, Human
cacauacacaagcacagagu

SEQ ID NO: 291913 - RNA, 18 nt, Human
cacuguaugagaaaacaa

SEQ ID NO: 291914 - RNA, 24 nt, Human
cagauaccauuagaauuucaaagc

SEQ ID NO: 291915 - RNA, 22 nt, Human
caggauccccggagcacagggc

SEQ ID NO: 291916 - RNA, 22 nt, Human
cauagcauacagcauacauaug

SEQ ID NO: 291917 - RNA, 18 nt, Human
caugcaagaggcagcccc

SEQ ID NO: 291918 - RNA, 21 nt, Human
cauucaagacaaaacugccau

SEQ ID NO: 291919 - RNA, 22 nt, Human
ccaguggccacaaacucccaag

SEQ ID NO: 291920 - RNA, 21 nt, Human
ccccaugcaauccugcagagc

SEQ ID NO: 291921 - RNA, 22 nt, Human
ccccaugcaauccugcagagcu

SEQ ID NO: 291922 - RNA, 23 nt, Human
cccgcgguagccacacauaccca

SEQ ID NO: 291923 - RNA, 19 nt, Human
cccuucaaaauaugggaga

SEQ ID NO: 291924 - RNA, 20 nt, Human
ccgcgguagccacacauacc

SEQ ID NO: 291925 - RNA, 19 nt, Human
cuaaaaguagacaagacag

SEQ ID NO: 291926 - RNA, 19 nt, Human
cuaaaccaaagagaaggug

SEQ ID NO: 291927 - RNA, 25 nt, Human
cuagcacaccaagacaagucacaga

SEQ ID NO: 291928 - RNA, 23 nt, Human
cuaugaaacaacaaacagcgaaa

SEQ ID NO: 291929 - RNA, 18 nt, Human
cucccaagcugcucaauc

SEQ ID NO: 291930 - RNA, 18 nt, Human
cugcagagcugaaguuac

SEQ ID NO: 291931 - RNA, 21 nt, Human
cuggaccauaaauaaaauucc

SEQ ID NO: 291932 - RNA, 18 nt, Human
cuuauuuaaggugacagc

SEQ ID NO: 291933 - RNA, 23 nt, Human
gaacuguuggcuugcagguauga

SEQ ID NO: 291934 - RNA, 20 nt, Human
gaccugaaagaguaaagcug

SEQ ID NO: 291935 - RNA, 20 nt, Human
gagagagagagagaaagaga

SEQ ID NO: 291936 - RNA, 20 nt, Human
gccacaaacucccaagcugc

SEQ ID NO: 291937 - RNA, 21 nt, Human
gcugcucaaucucaaaacuuu

SEQ ID NO: 291938 - RNA, 20 nt, Human
gcuucuguuucccagggugg

SEQ ID NO: 291939 - RNA, 19 nt, Human
gggcugggaagccucuccu

SEQ ID NO: 291940 - RNA, 21 nt, Human
gggcugggaagccucuccuuu

SEQ ID NO: 291941 - RNA, 18 nt, Human
uaacagacuccuaccucu

SEQ ID NO: 291942 - RNA, 20 nt, Human
uaacaucauagguguuagua

SEQ ID NO: 291943 - RNA, 24 nt, Human
uaauaaauuagcccgauucuccuc

SEQ ID NO: 291944 - RNA, 21 nt, Human
uaauggaauuacauucaacaa

SEQ ID NO: 291945 - RNA, 27 nt, Human
uaauuaucaucauuaauaaauuagccc

SEQ ID NO: 291946 - RNA, 19 nt, Human
uacacaaaagcugauuaac

SEQ ID NO: 291947 - RNA, 23 nt, Human
uaccaauagcaccaauucaaaau

SEQ ID NO: 291948 - RNA, 21 nt, Human
uaccauuagaauuucaaagca

SEQ ID NO: 291949 - RNA, 25 nt, Human
uaccccaugcaauccugcagagcug

SEQ ID NO: 291950 - RNA, 19 nt, Human
uacgacaaaaccuguuaaa

SEQ ID NO: 291951 - RNA, 18 nt, Human
uacugugucuuucauaca

SEQ ID NO: 291952 - RNA, 23 nt, Human
uagaauuucaaagcauucugcaa

SEQ ID NO: 291953 - RNA, 24 nt, Human
uagaauuucaaagcauucugcaac

SEQ ID NO: 291954 - RNA, 26 nt, Human
uagcacaccaagacaagucacagaau

SEQ ID NO: 291955 - RNA, 20 nt, Human
uaguagauugaaaaaucugc

SEQ ID NO: 291956 - RNA, 23 nt, Human
uauuugucuuuguuuucuugccu

SEQ ID NO: 291957 - RNA, 22 nt, Human
uccacuuuuucacagguguaca

SEQ ID NO: 291958 - RNA, 22 nt, Human
ugaaacaacaaacagcgaaagg

SEQ ID NO: 291959 - RNA, 22 nt, Human
ugaacaccuugaagacauuuuu

SEQ ID NO: 291960 - RNA, 19 nt, Human
ugauauuugaaaagaugau

SEQ ID NO: 291961 - RNA, 23 nt, Human
ugcaauccugcagagcugaaguu

SEQ ID NO: 291962 - RNA, 28 nt, Human
ugcuuuuuuuaaauaacagacuccuacu

SEQ ID NO: 291963 - RNA, 20 nt, Human
uggcuggaccauaaauaaaa

SEQ ID NO: 291964 - RNA, 22 nt, Human
uggcuggaccauaaauaaaauu

SEQ ID NO: 291965 - RNA, 20 nt, Human
uggcuugcagguaugaugca

SEQ ID NO: 291966 - RNA, 23 nt, Human
uguacagauacauuauaauuauc

SEQ ID NO: 291967 - RNA, 22 nt, Human
uuaaaaaaacacuacuccacuu

SEQ ID NO: 291968 - RNA, 19 nt, Human
uuaaaacacugaacuguug

SEQ ID NO: 291969 - RNA, 19 nt, Human
uuaacaaugguuaaaaaaa

SEQ ID NO: 291970 - RNA, 26 nt, Human
uuagugaacaccuugaagacauuuuu

SEQ ID NO: 291971 - RNA, 21 nt, Human
uucaaaaugaauccacaugac

SEQ ID NO: 291972 - RNA, 22 nt, Human
uucacauacacaagcacagagu

SEQ ID NO: 291973 - RNA, 21 nt, Human
uucgcaaauguaaaaagugcu

SEQ ID NO: 291974 - RNA, 18 nt, Human
uuguauucauauuucucu

SEQ ID NO: 291975 - RNA, 22 nt, Human
uuuauuuaguaauacaugcaag

SEQ ID NO: 291976 - RNA, 22 nt, Human
uuuucauaaacauugugugcaa

SEQ ID NO: 291977 - RNA, 25 nt, Human
aaaaggaaaacuaaaccaaagagaa

SEQ ID NO: 291978 - RNA, 23 nt, Human
aaacucccaagcugcucaaucuc

SEQ ID NO: 291979 - RNA, 21 nt, Human
aacaauaaagcuuaaaguuca

SEQ ID NO: 291980 - RNA, 22 nt, Human
aacucccaagcugcucaaucuc

SEQ ID NO: 291981 - RNA, 22 nt, Human
aacuguuggcuugcagguauga

SEQ ID NO: 291982 - RNA, 26 nt, Human
aagcuaaaaguagacaagagggaccc

SEQ ID NO: 291983 - RNA, 19 nt, Human
aauccugcagagcugaagu

SEQ ID NO: 291984 - RNA, 30 nt, Human; identical to SEQ ID NO: 291891

SEQ ID NO: 291985 - RNA, 24 nt, Human
acauguguugguaacaaguuuuac

SEQ ID NO: 291986 - RNA, 21 nt, Human
accaccauuuucauuuauuag

SEQ ID NO: 291987 - RNA, 24 nt, Human
acccgcgguagccacacauaccca

SEQ ID NO: 291988 - RNA, 21 nt, Human
acuaaaccaaagagaaggugu

SEQ ID NO: 291989 - RNA, 19 nt, Human
agaaaggaaacuugggucu

SEQ ID NO: 291990 - RNA, 21 nt, Human
agacaggauccccggagcaca

SEQ ID NO: 291991 - RNA, 22 nt, Human
agacaggauccccggagcacag

SEQ ID NO: 291992 - RNA, 19 nt, Human
agagagagagagaaagaga

SEQ ID NO: 291993 - RNA, 19 nt, Human
agaggguggcugccaccuc

SEQ ID NO: 291994 - RNA, 21 nt, Human
agccaauaucuggcacucgca

SEQ ID NO: 291995 - RNA, 23 nt, Human
agccagaguggagagaaagaguu

SEQ ID NO: 291996 - RNA, 18 nt, Human
aggagaaaggaaacuugg

SEQ ID NO: 291997 - RNA, 19 nt, Human
aggagaaaggaaacuuggg

SEQ ID NO: 291998 - RNA, 23 nt, Human
aguuacacacccuucaaaauaug

SEQ ID NO: 291999 - RNA, 21 nt, Human
auaaaucuaugaaacaacaaa

SEQ ID NO: 292000 - RNA, 21 nt, Human
auaccauuagaauuucaaagc

SEQ ID NO: 292001 - RNA, 21 nt, Human
augcaagaggcagccccagag

SEQ ID NO: 292002 - RNA, 20 nt, Human
caaaaggaaauauaauggaa

SEQ ID NO: 292003 - RNA, 22 nt, Human
caacaauaaagcuuaaaguuca

SEQ ID NO: 292004 - RNA, 23 nt, Human
caacagacuuuagggucuccuaa

SEQ ID NO: 292005 - RNA, 21 nt, Human
cacagaauuaguagauugaaa

SEQ ID NO: 292006 - RNA, 20 nt, Human
cacauacacaagcacagagu

SEQ ID NO: 292007 - RNA, 18 nt, Human
cacuguaugagaaaacaa

SEQ ID NO: 292008 - RNA, 24 nt, Human
cagauaccauuagaauuucaaagc

SEQ ID NO: 292009 - RNA, 22 nt, Human
caggauccccggagcacagggc

SEQ ID NO: 292010 - RNA, 18 nt, Human
caugcaagaggcagcccc

SEQ ID NO: 292011 - RNA, 22 nt, Human
ccaguggccacaaacucccaag

SEQ ID NO: 292012 - RNA, 23 nt, Human
cccaagcugcucaaucucaaaac

SEQ ID NO: 292013 - RNA, 21 nt, Human
ccccaugcaauccugcagagc

SEQ ID NO: 292014 - RNA, 22 nt, Human
ccccaugcaauccugcagagcu

SEQ ID NO: 292015 - RNA, 23 nt, Human
cccgcgguagccacacauaccca

SEQ ID NO: 292016 - RNA, 19 nt, Human
cccuucaaaauaugggaga

SEQ ID NO: 292017 - RNA, 20 nt, Human
ccgcgguagccacacauacc

SEQ ID NO: 292018 - RNA, 19 nt, Human
cuaaaaguagacaagacag

SEQ ID NO: 292019 - RNA, 25 nt, Human
cuagcacaccaagacaagucacaga

SEQ ID NO: 292020 - RNA, 23 nt, Human
cuaugaaacaacaaacagcgaaa

SEQ ID NO: 292021 - RNA, 18 nt, Human
cucccaagcugcucaauc

SEQ ID NO: 292022 - RNA, 18 nt, Human
cugcagagcugaaguuac

SEQ ID NO: 292023 - RNA, 21 nt, Human
cuggaccauaaauaaaauucc

SEQ ID NO: 292024 - RNA, 18 nt, Human
cuuauuuaaggugacagc

SEQ ID NO: 292025 - RNA, 23 nt, Human
gaacuguuggcuugcagguauga

SEQ ID NO: 292026 - RNA, 20 nt, Human
gaccugaaagaguaaagcug

SEQ ID NO: 292027 - RNA, 20 nt, Human
gagagagagagagaaagaga

SEQ ID NO: 292028 - RNA, 18 nt, Human
gcauacagcauacauaug

SEQ ID NO: 292029 - RNA, 20 nt, Human
gccacaaacucccaagcugc

SEQ ID NO: 292030 - RNA, 21 nt, Human
gcugcucaaucucaaaacuuu

SEQ ID NO: 292031 - RNA, 20 nt, Human
gcuucuguuucccagggugg

SEQ ID NO: 292032 - RNA, 21 nt, Human
gggcugggaagccucuccuuu

SEQ ID NO: 292033 - RNA, 18 nt, Human
uaacagacuccuaccucu

SEQ ID NO: 292034 - RNA, 18 nt, Human
uaacaucauagguguuag

SEQ ID NO: 292035 - RNA, 20 nt, Human
uaacaucauagguguuagua

SEQ ID NO: 292036 - RNA, 21 nt, Human
uaauaaauuagcccgauucuc

SEQ ID NO: 292037 - RNA, 21 nt, Human
uaauggaauuacauucaacaa

SEQ ID NO: 292038 - RNA, 27 nt, Human
uaauuaucaucauuaauaaauuagccc

SEQ ID NO: 292039 - RNA, 19 nt, Human
uacacaaaagcugauuaac

SEQ ID NO: 292040 - RNA, 23 nt, Human
uaccaauagcaccaauucaaaau

SEQ ID NO: 292041 - RNA, 21 nt, Human
uaccauuagaauuucaaagca

SEQ ID NO: 292042 - RNA, 25 nt, Human
uaccccaugcaauccugcagagcug

SEQ ID NO: 292043 - RNA, 19 nt, Human
uacgacaaaaccuguuaaa

SEQ ID NO: 292044 - RNA, 18 nt, Human
uacugugucuuucauaca

SEQ ID NO: 292045 - RNA, 23 nt, Human
uagaauuucaaagcauucugcaa

SEQ ID NO: 292046 - RNA, 24 nt, Human
uagaauuucaaagcauucugcaac

SEQ ID NO: 292047 - RNA, 26 nt, Human
uagcacaccaagacaagucacagaau

SEQ ID NO: 292048 - RNA, 20 nt, Human
uaguagauugaaaaaucugc

SEQ ID NO: 292049 - RNA, 23 nt, Human
uauuugucuuuguuuucuugccu

SEQ ID NO: 292050 - RNA, 22 nt, Human
uccacuuuuucacagguguaca

SEQ ID NO: 292051 - RNA, 22 nt, Human
ugaaacaacaaacagcgaaagg

SEQ ID NO: 292052 - RNA, 23 nt, Human
ugcaauccugcagagcugaaguu

SEQ ID NO: 292053 - RNA, 20 nt, Human
uggcuggaccauaaauaaaa

SEQ ID NO: 292054 - RNA, 22 nt, Human
uggcuggaccauaaauaaaauu

SEQ ID NO: 292055 - RNA, 20 nt, Human
uggcuugcagguaugaugca

SEQ ID NO: 292056 - RNA, 23 nt, Human
uguacagauacauuauaauuauc

SEQ ID NO: 292057 - RNA, 22 nt, Human
uuaaaaaaacacuacuccacuu

SEQ ID NO: 292058 - RNA, 19 nt, Human
uuaaaacacugaacuguug

SEQ ID NO: 292059 - RNA, 19 nt, Human
uuaacaaugguuaaaaaaa

SEQ ID NO: 292060 - RNA, 21 nt, Human
uucaaaaugaauccacaugac

SEQ ID NO: 292061 - RNA, 22 nt, Human
uucacauacacaagcacagagu

SEQ ID NO: 292062 - RNA, 21 nt, Human
uucgcaaauguaaaaagugcu

SEQ ID NO: 292063 - RNA, 18 nt, Human
uuguauucauauuucucu

SEQ ID NO: 292064 - RNA, 22 nt, Human
uuuucauaaacauugugugcaa

SEQ ID NO: 292065 - RNA, 23 nt, Human
aaaacaaauauauucauauucuc

SEQ ID NO: 292066 - RNA, 25 nt, Human
aaaaggaaaacuaaaccaaagagaa

SEQ ID NO: 292067 - RNA, 22 nt, Human
aaacaaauauauucauauucuc

SEQ ID NO: 292068 - RNA, 22 nt, Human
aacucccaagcugcucaaucuc

SEQ ID NO: 292069 - RNA, 22 nt, Human
aacuguuggcuugcagguauga

SEQ ID NO: 292070 - RNA, 26 nt, Human
aagcuaaaaguagacaagagggaccc

SEQ ID NO: 292071 - RNA, 23 nt, Human
aagcugcucaaucucaaaacuuu

SEQ ID NO: 292072 - RNA, 19 nt, Human
aauccugcagagcugaagu

SEQ ID NO: 292073 - RNA, 30 nt, Human; identical to SEQ ID NO: 291891

SEQ ID NO: 292074 - RNA, 20 nt, Human
acaguaccagauucuucagu

SEQ ID NO: 292075 - RNA, 24 nt, Human
acauguguugguaacaaguuuuac

SEQ ID NO: 292076 - RNA, 21 nt, Human
accaccauuuucauuuauuag

SEQ ID NO: 292077 - RNA, 24 nt, Human
acccgcgguagccacacauaccca

SEQ ID NO: 292078 - RNA, 21 nt, Human
acuaaaccaaagagaaggugu

SEQ ID NO: 292079 - RNA, 23 nt, Human
acugcauuuaccaccacagaauu

SEQ ID NO: 292080 - RNA, 19 nt, Human
agaaaggaaacuugggucu

SEQ ID NO: 292081 - RNA, 22 nt, Human
agacaggauccccggagcacag

SEQ ID NO: 292082 - RNA, 19 nt, Human
agagagagagagaaagaga

SEQ ID NO: 292083 - RNA, 19 nt, Human
agaggguggcugccaccuc

SEQ ID NO: 292084 - RNA, 21 nt, Human
agccaauaucuggcacucgca

SEQ ID NO: 292085 - RNA, 23 nt, Human
agccagaguggagagaaagaguu

SEQ ID NO: 292086 - RNA, 18 nt, Human
agcuuuuacgacaaaacc

SEQ ID NO: 292087 - RNA, 19 nt, Human
aggagaaaggaaacuuggg

SEQ ID NO: 292088 - RNA, 23 nt, Human
aguuacacacccuucaaaauaug

SEQ ID NO: 292089 - RNA, 21 nt, Human
auaaaucuaugaaacaacaaa

SEQ ID NO: 292090 - RNA, 21 nt, Human
auaccauuagaauuucaaagc

SEQ ID NO: 292091 - RNA, 22 nt, Human
augaaaaacaaauauauucaua

SEQ ID NO: 292092 - RNA, 20 nt, Human
caaaaggaaauauaauggaa

SEQ ID NO: 292093 - RNA, 22 nt, Human
caacaauaaagcuuaaaguuca

SEQ ID NO: 292094 - RNA, 23 nt, Human
caacagacuuuagggucuccuaa

SEQ ID NO: 292095 - RNA, 21 nt, Human
cacagaauuaguagauugaaa

SEQ ID NO: 292096 - RNA, 18 nt, Human
cacuguaugagaaaacaa

SEQ ID NO: 292097 - RNA, 21 nt, Human
cagagugagagagaaagagaa

SEQ ID NO: 292098 - RNA, 24 nt, Human
cagauaccauuagaauuucaaagc

SEQ ID NO: 292099 - RNA, 22 nt, Human
caggauccccggagcacagggc

SEQ ID NO: 292100 - RNA, 22 nt, Human
cauagcauacagcauacauaug

SEQ ID NO: 292101 - RNA, 18 nt, Human
caugcaagaggcagcccc

SEQ ID NO: 292102 - RNA, 19 nt, Human
ccacaaacucccaagcugc

SEQ ID NO: 292103 - RNA, 22 nt, Human
ccaguggccacaaacucccaag

SEQ ID NO: 292104 - RNA, 23 nt, Human
cccaagcugcucaaucucaaaac

SEQ ID NO: 292105 - RNA, 21 nt, Human
ccccaugcaauccugcagagc

SEQ ID NO: 292106 - RNA, 22 nt, Human
ccccaugcaauccugcagagcu

SEQ ID NO: 292107 - RNA, 19 nt, Human
cccuucaaaauaugggaga

SEQ ID NO: 292108 - RNA, 20 nt, Human
ccgcgguagccacacauacc

SEQ ID NO: 292109 - RNA, 18 nt, Human
cuaaaacugugaguacug

SEQ ID NO: 292110 - RNA, 19 nt, Human
cuaaaaguagacaagacag

SEQ ID NO: 292111 - RNA, 25 nt, Human
cuagcacaccaagacaagucacaga

SEQ ID NO: 292112 - RNA, 23 nt, Human
cuaugaaacaacaaacagcgaaa

SEQ ID NO: 292113 - RNA, 18 nt, Human
cucccaagcugcucaauc

SEQ ID NO: 292114 - RNA, 18 nt, Human
cugcagagcugaaguuac

SEQ ID NO: 292115 - RNA, 21 nt, Human
cuggaccauaaauaaaauucc

SEQ ID NO: 292116 - RNA, 18 nt, Human
cuuauuuaaggugacagc

SEQ ID NO: 292117 - RNA, 19 nt, Human
cuugcauuuucauaucuau

SEQ ID NO: 292118 - RNA, 23 nt, Human
gaacuguuggcuugcagguauga

SEQ ID NO: 292119 - RNA, 20 nt, Human
gaccugaaagaguaaagcug

SEQ ID NO: 292120 - RNA, 20 nt, Human
gagagagagagagaaagaga

SEQ ID NO: 292121 - RNA, 19 nt, Human
gagugagagagaaagagaa

SEQ ID NO: 292122 - RNA, 19 nt, Human
gcaagaggcagccccagag

SEQ ID NO: 292123 - RNA, 20 nt, Human
gcuucuguuucccagggugg

SEQ ID NO: 292124 - RNA, 21 nt, Human
gggcugggaagccucuccuuu

SEQ ID NO: 292125 - RNA, 21 nt, Human
uaaaaaagaauccacaaagga

SEQ ID NO: 292126 - RNA, 18 nt, Human
uaaauuauugugucuaug

SEQ ID NO: 292127 - RNA, 18 nt, Human
uaacagacuccuaccucu

SEQ ID NO: 292128 - RNA, 20 nt, Human
uaacaucauagguguuagua

SEQ ID NO: 292129 - RNA, 24 nt, Human
uaauaaauuagcccgauucuccuc

SEQ ID NO: 292130 - RNA, 21 nt, Human
uaauggaauuacauucaacaa

SEQ ID NO: 292131 - RNA, 27 nt, Human
uaauuaucaucauuaauaaauuagccc

SEQ ID NO: 292132 - RNA, 19 nt, Human
uacacaaaagcugauuaac

SEQ ID NO: 292133 - RNA, 23 nt, Human
uaccaauagcaccaauucaaaau

SEQ ID NO: 292134 - RNA, 21 nt, Human
uaccauuagaauuucaaagca

SEQ ID NO: 292135 - RNA, 25 nt, Human
uaccccaugcaauccugcagagcug

SEQ ID NO: 292136 - RNA, 19 nt, Human
uacgacaaaaccuguuaaa

SEQ ID NO: 292137 - RNA, 18 nt, Human
uacugugucuuucauaca

SEQ ID NO: 292138 - RNA, 23 nt, Human
uagaauuucaaagcauucugcaa

SEQ ID NO: 292139 - RNA, 24 nt, Human
uagaauuucaaagcauucugcaac

SEQ ID NO: 292140 - RNA, 26 nt, Human
uagcacaccaagacaagucacagaau

SEQ ID NO: 292141 - RNA, 20 nt, Human
uaguagauugaaaaaucugc

SEQ ID NO: 292142 - RNA, 25 nt, Human
uaugauggaguuccuuuguauggga

SEQ ID NO: 292143 - RNA, 23 nt, Human
uauucucaaacuugguaguuuua

SEQ ID NO: 292144 - RNA, 23 nt, Human
uauuugucuuuguuuucuugccu

SEQ ID NO: 292145 - RNA, 24 nt, Human
ucaaagaaaaaauugaaguuuuau

SEQ ID NO: 292146 - RNA, 22 nt, Human
uccacuuuuucacagguguaca

SEQ ID NO: 292147 - RNA, 22 nt, Human
ugaaacaacaaacagcgaaagg

SEQ ID NO: 292148 - RNA, 24 nt, Human
ugagagagaaagagaauucaguug

SEQ ID NO: 292149 - RNA, 23 nt, Human
ugcaauccugcagagcugaaguu

SEQ ID NO: 292150 - RNA, 22 nt, Human
ugcuuauuuauggaauauucag

SEQ ID NO: 292151 - RNA, 20 nt, Human
uggcuggaccauaaauaaaa

SEQ ID NO: 292152 - RNA, 20 nt, Human
uggcuugcagguaugaugca

SEQ ID NO: 292153 - RNA, 23 nt, Human
uguacagauacauuauaauuauc

SEQ ID NO: 292154 - RNA, 29 nt, Human
uguuuuggguuucuucccccaaauauuuu

SEQ ID NO: 292155 - RNA, 22 nt, Human
uuaaaaaaacacuacuccacuu

SEQ ID NO: 292156 - RNA, 19 nt, Human
uuaaaacacugaacuguug

SEQ ID NO: 292157 - RNA, 19 nt, Human
uuaacaaugguuaaaaaaa

SEQ ID NO: 292158 - RNA, 25 nt, Human
uuacacuuacaguaccagauucuuc

SEQ ID NO: 292159 - RNA, 22 nt, Human
uuacaguaccagauucuucagu

SEQ ID NO: 292160 - RNA, 24 nt, Human
uucaaaaugaauccacaugacgug

SEQ ID NO: 292161 - RNA, 22 nt, Human
uucacauacacaagcacagagu

SEQ ID NO: 292162 - RNA, 20 nt, Human
uuccuuuguaugggagugcc

SEQ ID NO: 292163 - RNA, 21 nt, Human
uucgcaaauguaaaaagugcu

SEQ ID NO: 292164 - RNA, 21 nt, Human
uugcagaacaauaugaaaaag

SEQ ID NO: 292165 - RNA, 22 nt, Human
uuuauuuaguaauacaugcaag

SEQ ID NO: 292166 - RNA, 22 nt, Human
uuuucauaaacauugugugcaa

SEQ ID NO: 292167 - RNA, 25 nt, Human
aaaaggaaaacuaaaccaaagagaa

SEQ ID NO: 292168 - RNA, 23 nt, Human
aaacucccaagcugcucaaucuc

SEQ ID NO: 292169 - RNA, 22 nt, Human
aacuguuggcuugcagguauga

SEQ ID NO: 292170 - RNA, 26 nt, Human
aagcuaaaaguagacaagagggaccc

SEQ ID NO: 292171 - RNA, 19 nt, Human
aauccugcagagcugaagu

SEQ ID NO: 292172 - RNA, 30 nt, Human; identical to SEQ ID NO: 291891

SEQ ID NO: 292173 - RNA, 24 nt, Human
acauguguugguaacaaguuuuac

SEQ ID NO: 292174 - RNA, 21 nt, Human
accaccauuuucauuuauuag

SEQ ID NO: 292175 - RNA, 24 nt, Human
acccgcgguagccacacauaccca

SEQ ID NO: 292176 - RNA, 19 nt, Human
agaaaggaaacuugggucu

SEQ ID NO: 292177 - RNA, 22 nt, Human
agacaggauccccggagcacag

SEQ ID NO: 292178 - RNA, 19 nt, Human
agagagagagagaaagaga

SEQ ID NO: 292179 - RNA, 19 nt, Human
agaggguggcugccaccuc

SEQ ID NO: 292180 - RNA, 18 nt, Human
agcagucacccuuuucug

SEQ ID NO: 292181 - RNA, 21 nt, Human
agccaauaucuggcacucgca

SEQ ID NO: 292182 - RNA, 23 nt, Human
agccagaguggagagaaagaguu

SEQ ID NO: 292183 - RNA, 19 nt, Human
aggagaaaggaaacuuggg

SEQ ID NO: 292184 - RNA, 19 nt, Human
agggccucugaguugggac

SEQ ID NO: 292185 - RNA, 23 nt, Human
aguuacacacccuucaaaauaug

SEQ ID NO: 292186 - RNA, 21 nt, Human
auaaaucuaugaaacaacaaa

SEQ ID NO: 292187 - RNA, 21 nt, Human
auaccauuagaauuucaaagc

SEQ ID NO: 292188 - RNA, 21 nt, Human
augcaagaggcagccccagag

SEQ ID NO: 292189 - RNA, 20 nt, Human
caaaaggaaauauaauggaa

SEQ ID NO: 292190 - RNA, 22 nt, Human
caacaauaaagcuuaaaguuca

SEQ ID NO: 292191 - RNA, 23 nt, Human
caacagacuuuagggucuccuaa

SEQ ID NO: 292192 - RNA, 21 nt, Human
cacagaauuaguagauugaaa

SEQ ID NO: 292193 - RNA, 18 nt, Human
cacuguaugagaaaacaa

SEQ ID NO: 292194 - RNA, 24 nt, Human
cagauaccauuagaauuucaaagc

SEQ ID NO: 292195 - RNA, 22 nt, Human
caggauccccggagcacagggc

SEQ ID NO: 292196 - RNA, 22 nt, Human
cauagcauacagcauacauaug

SEQ ID NO: 292197 - RNA, 18 nt, Human
caugcaagaggcagcccc

SEQ ID NO: 292198 - RNA, 22 nt, Human
ccaguggccacaaacucccaag

SEQ ID NO: 292199 - RNA, 23 nt, Human
cccaagcugcucaaucucaaaac

SEQ ID NO: 292200 - RNA, 21 nt, Human
ccccaugcaauccugcagagc

SEQ ID NO: 292201 - RNA, 21 nt, Human
ccccaugcaauccugcagagc

SEQ ID NO: 292202 - RNA, 19 nt, Human
cccuucaaaauaugggaga

SEQ ID NO: 292203 - RNA, 20 nt, Human
ccgcgguagccacacauacc

SEQ ID NO: 292204 - RNA, 24 nt, Human
ccucugaguugggacaaucaguuu

SEQ ID NO: 292205 - RNA, 19 nt, Human
cuaaaaguagacaagacag

SEQ ID NO: 292206 - RNA, 19 nt, Human
cuaaaccaaagagaaggug

SEQ ID NO: 292207 - RNA, 25 nt, Human
cuagcacaccaagacaagucacaga

SEQ ID NO: 292208 - RNA, 23 nt, Human
cuaugaaacaacaaacagcgaaa

SEQ ID NO: 292209 - RNA, 18 nt, Human
cucccaagcugcucaauc

SEQ ID NO: 292210 - RNA, 18 nt, Human
cugcagagcugaaguuac

SEQ ID NO: 292211 - RNA, 21 nt, Human
cuggaccauaaauaaaauucc

SEQ ID NO: 292212 - RNA, 18 nt, Human
cuuauuuaaggugacagc

SEQ ID NO: 292213 - RNA, 20 nt, Human
gaccugaaagaguaaagcug

SEQ ID NO: 292214 - RNA, 20 nt, Human
gagagagagagagaaagaga

SEQ ID NO: 292215 - RNA, 20 nt, Human
gccacaaacucccaagcugc

SEQ ID NO: 292216 - RNA, 21 nt, Human
gcugcucaaucucaaaacuuu

SEQ ID NO: 292217 - RNA, 20 nt, Human
gcuucuguuucccagggugg

SEQ ID NO: 292218 - RNA, 19 nt, Human
gggcugggaagccucuccu

SEQ ID NO: 292219 - RNA, 18 nt, Human
uaacagacuccuaccucu

SEQ ID NO: 292220 - RNA, 20 nt, Human
uaacaucauagguguuagua

SEQ ID NO: 292221 - RNA, 24 nt, Human
uaauaaauuagcccgauucuccuc

SEQ ID NO: 292222 - RNA, 21 nt, Human
uaauggaauuacauucaacaa

SEQ ID NO: 292223 - RNA, 27 nt, Human
uaauuaucaucauuaauaaauuagccc

SEQ ID NO: 292224 - RNA, 19 nt, Human
uacacaaaagcugauuaac

SEQ ID NO: 292225 - RNA, 23 nt, Human
uaccaauagcaccaauucaaaau

SEQ ID NO: 292226 - RNA, 21 nt, Human
uaccauuagaauuucaaagca

SEQ ID NO: 292227 - RNA, 25 nt, Human
uaccccaugcaauccugcagagcug

SEQ ID NO: 292228 - RNA, 19 nt, Human
uacgacaaaaccuguuaaa

SEQ ID NO: 292229 - RNA, 18 nt, Human
uacugugucuuucauaca

SEQ ID NO: 292230 - RNA, 23 nt, Human
uagaauuucaaagcauucugcaa

SEQ ID NO: 292231 - RNA, 24 nt, Human
uagaauuucaaagcauucugcaac

SEQ ID NO: 292232 - RNA, 26 nt, Human
uagcacaccaagacaagucacagaau

SEQ ID NO: 292233 - RNA, 20 nt, Human
uaguagauugaaaaaucugc

SEQ ID NO: 292234 - RNA, 23 nt, Human
uauuugucuuuguuuucuugccu

SEQ ID NO: 292235 - RNA, 22 nt, Human
uccacuuuuucacagguguaca

SEQ ID NO: 292236 - RNA, 22 nt, Human
ugaaacaacaaacagcgaaagg

SEQ ID NO: 292237 - RNA, 20 nt, Human
ugaguugggacaaucaguuu

SEQ ID NO: 292238 - RNA, 23 nt, Human
ugcaauccugcagagcugaaguu

SEQ ID NO: 292239 - RNA, 20 nt, Human
uggcuggaccauaaauaaaa

SEQ ID NO: 292240 - RNA, 20 nt, Human
uggcuugcagguaugaugca

SEQ ID NO: 292241 - RNA, 23 nt, Human
uguacagauacauuauaauuauc

SEQ ID NO: 292242 - RNA, 22 nt, Human
uuaaaaaaacacuacuccacuu

SEQ ID NO: 292243 - RNA, 19 nt, Human
uuaaaacacugaacuguug

SEQ ID NO: 292244 - RNA, 21 nt, Human
uucaaaaugaauccacaugac

SEQ ID NO: 292245 - RNA, 22 nt, Human
uucacauacacaagcacagagu

SEQ ID NO: 292246 - RNA, 21 nt, Human
uucgcaaauguaaaaagugcu

SEQ ID NO: 292247 - RNA, 18 nt, Human
uuguauucauauuucucu

SEQ ID NO: 292248 - RNA, 22 nt, Human
uuuauuuaguaauacaugcaag

SEQ ID NO: 292249 - RNA, 22 nt, Human
uuuucauaaacauugugugcaa

SEQ ID NO: 292250 - RNA, 25 nt, Human
aaaaggaaaacuaaaccaaagagaa

SEQ ID NO: 292251 - RNA, 23 nt, Human
aaacucccaagcugcucaaucuc

SEQ ID NO: 292252 - RNA, 22 nt, Human
aacuguuggcuugcagguauga

SEQ ID NO: 292253 - RNA, 26 nt, Human
aagcuaaaaguagacaagagggaccc

SEQ ID NO: 292254 - RNA, 23 nt, Human
aagcugcucaaucucaaaacuuu

SEQ ID NO: 292255 - RNA, 19 nt, Human
aauccugcagagcugaagu

SEQ ID NO: 292256 - RNA, 30 nt, Human; identical to SEQ ID NO: 291891

SEQ ID NO: 292257 - RNA, 24 nt, Human
acauguguugguaacaaguuuuac

SEQ ID NO: 292258 - RNA, 21 nt, Human
accaccauuuucauuuauuag

SEQ ID NO: 292259 - RNA, 24 nt, Human
acccgcgguagccacacauaccca

SEQ ID NO: 292260 - RNA, 21 nt, Human
acuaaaccaaagagaaggugu

SEQ ID NO: 292261 - RNA, 19 nt, Human
agaaaggaaacuugggucu

SEQ ID NO: 292262 - RNA, 22 nt, Human
agacaggauccccggagcacag

SEQ ID NO: 292263 - RNA, 19 nt, Human
agagagagagagaaagaga

SEQ ID NO: 292264 - RNA, 19 nt, Human
agaggguggcugccaccuc

SEQ ID NO: 292265 - RNA, 21 nt, Human
agccaauaucuggcacucgca

SEQ ID NO: 292266 - RNA, 23 nt, Human
agccagaguggagagaaagaguu

SEQ ID NO: 292267 - RNA, 18 nt, Human
aggagaaaggaaacuugg

SEQ ID NO: 292268 - RNA, 23 nt, Human
aguuacacacccuucaaaauaug

SEQ ID NO: 292269 - RNA, 21 nt, Human
auaaaucuaugaaacaacaaa

SEQ ID NO: 292270 - RNA, 21 nt, Human
auaccauuagaauuucaaagc

SEQ ID NO: 292271 - RNA, 21 nt, Human
augcaagaggcagccccagag

SEQ ID NO: 292272 - RNA, 20 nt, Human
caaaaggaaauauaauggaa

SEQ ID NO: 292273 - RNA, 22 nt, Human
caacaauaaagcuuaaaguuca

SEQ ID NO: 292274 - RNA, 23 nt, Human
caacagacuuuagggucuccuaa

SEQ ID NO: 292275 - RNA, 21 nt, Human
cacagaauuaguagauugaaa

SEQ ID NO: 292276 - RNA, 18 nt, Human
cacuguaugagaaaacaa

SEQ ID NO: 292277 - RNA, 24 nt, Human
cagauaccauuagaauuucaaagc

SEQ ID NO: 292278 - RNA, 22 nt, Human
caggauccccggagcacagggc

SEQ ID NO: 292279 - RNA, 22 nt, Human
cauagcauacagcauacauaug

SEQ ID NO: 292280 - RNA, 18 nt, Human
caugcaagaggcagcccc

SEQ ID NO: 292281 - RNA, 19 nt, Human
ccacaaacucccaagcugc

SEQ ID NO: 292282 - RNA, 22 nt, Human
ccaguggccacaaacucccaag

SEQ ID NO: 292283 - RNA, 23 nt, Human
cccaagcugcucaaucucaaaac

SEQ ID NO: 292284 - RNA, 21 nt, Human
ccccaugcaauccugcagagc

SEQ ID NO: 292285 - RNA, 22 nt, Human
ccccaugcaauccugcagagcu

SEQ ID NO: 292286 - RNA, 20 nt, Human
ccgcgguagccacacauacc

SEQ ID NO: 292287 - RNA, 19 nt, Human
cuaaaaguagacaagacag

SEQ ID NO: 292288 - RNA, 25 nt, Human
cuagcacaccaagacaagucacaga

SEQ ID NO: 292289 - RNA, 23 nt, Human
cuaugaaacaacaaacagcgaaa

SEQ ID NO: 292290 - RNA, 18 nt, Human
cucccaagcugcucaauc

SEQ ID NO: 292291 - RNA, 18 nt, Human
cugcagagcugaaguuac

SEQ ID NO: 292292 - RNA, 21 nt, Human
cuggaccauaaauaaaauucc

SEQ ID NO: 292293 - RNA, 18 nt, Human
cuuauuuaaggugacagc

SEQ ID NO: 292294 - RNA, 20 nt, Human
gaccugaaagaguaaagcug

SEQ ID NO: 292295 - RNA, 20 nt, Human
gagagagagagagaaagaga

SEQ ID NO: 292296 - RNA, 20 nt, Human
gcuucuguuucccagggugg

SEQ ID NO: 292297 - RNA, 21 nt, Human
gggcugggaagccucuccuuu

SEQ ID NO: 292298 - RNA, 18 nt, Human
uaacagacuccuaccucu

SEQ ID NO: 292299 - RNA, 20 nt, Human
uaacaucauagguguuagua

SEQ ID NO: 292300 - RNA, 24 nt, Human
uaauaaauuagcccgauucuccuc

SEQ ID NO: 292301 - RNA, 21 nt, Human
uaauggaauuacauucaacaa

SEQ ID NO: 292302 - RNA, 27 nt, Human
uaauuaucaucauuaauaaauuagccc

SEQ ID NO: 292303 - RNA, 19 nt, Human
uacacaaaagcugauuaac

SEQ ID NO: 292304 - RNA, 23 nt, Human
uaccaauagcaccaauucaaaau

SEQ ID NO: 292305 - RNA, 21 nt, Human
uaccauuagaauuucaaagca

SEQ ID NO: 292306 - RNA, 25 nt, Human
uaccccaugcaauccugcagagcug

SEQ ID NO: 292307 - RNA, 19 nt, Human
uacgacaaaaccuguuaaa

SEQ ID NO: 292308 - RNA, 18 nt, Human
uacugugucuuucauaca

SEQ ID NO: 292309 - RNA, 23 nt, Human
uagaauuucaaagcauucugcaa

SEQ ID NO: 292310 - RNA, 24 nt, Human
uagaauuucaaagcauucugcaac

SEQ ID NO: 292311 - RNA, 26 nt, Human
uagcacaccaagacaagucacagaau

SEQ ID NO: 292312 - RNA, 20 nt, Human
uaguagauugaaaaaucugc

SEQ ID NO: 292313 - RNA, 23 nt, Human
uauuugucuuuguuuucuugccu

SEQ ID NO: 292314 - RNA, 22 nt, Human
uccacuuuuucacagguguaca

SEQ ID NO: 292315 - RNA, 22 nt, Human
ugaaacaacaaacagcgaaagg

SEQ ID NO: 292316 - RNA, 23 nt, Human
ugcaauccugcagagcugaaguu

SEQ ID NO: 292317 - RNA, 20 nt, Human
uggcuggaccauaaauaaaa

SEQ ID NO: 292318 - RNA, 20 nt, Human
uggcuugcagguaugaugca

SEQ ID NO: 292319 - RNA, 23 nt, Human
uguacagauacauuauaauuauc

SEQ ID NO: 292320 - RNA, 22 nt, Human
uuaaaaaaacacuacuccacuu

SEQ ID NO: 292321 - RNA, 19 nt, Human
uuaaaacacugaacuguug

SEQ ID NO: 292322 - RNA, 19 nt, Human
uuaacaaugguuaaaaaaa

SEQ ID NO: 292323 - RNA, 21 nt, Human
uucaaaaugaauccacaugac

SEQ ID NO: 292324 - RNA, 22 nt, Human
uucacauacacaagcacagagu

SEQ ID NO: 292325 - RNA, 21 nt, Human
uucgcaaauguaaaaagugcu

SEQ ID NO: 292326 - RNA, 22 nt, Human
uuuauuuaguaauacaugcaag

SEQ ID NO: 292327 - RNA, 22 nt, Human
uuuucauaaacauugugugcaa

SEQ ID NO: 292328 - RNA, 19 nt, Human
aaaaaccaaaacaacaaca

SEQ ID NO: 292329 - RNA, 21 nt, Human
aaaaaccaaaacaacaacaaa

SEQ ID NO: 292330 - RNA, 25 nt, Human
aaaaaccaaaacaacaacaaaaaac

SEQ ID NO: 292331 - RNA, 25 nt, Human
aaaacaacaacaaaaaacccaccaa

SEQ ID NO: 292332 - RNA, 25 nt, Human
aaaaggaaaacuaaaccaaagagaa

SEQ ID NO: 292333 - RNA, 21 nt, Human
aaacacacacacacaaaaacc

SEQ ID NO: 292334 - RNA, 23 nt, Human
aaacucccaagcugcucaaucuc

SEQ ID NO: 292335 - RNA, 24 nt, Human
aaccaaaacaacaacaaaaaaccc

SEQ ID NO: 292336 - RNA, 22 nt, Human
aacuguuggcuugcagguauga

SEQ ID NO: 292337 - RNA, 18 nt, Human
aagcacauuggaaaaaag

SEQ ID NO: 292338 - RNA, 26 nt, Human
aagcuaaaaguagacaagagggaccc

SEQ ID NO: 292339 - RNA, 23 nt, Human
aagcugcucaaucucaaaacuuu

SEQ ID NO: 292340 - RNA, 19 nt, Human
aauccugcagagcugaagu

SEQ ID NO: 292341 - RNA, 30 nt, Human; identical to SEQ ID NO: 291891

SEQ ID NO: 292342 - RNA, 20 nt, Human
acaaaaaccaaaacaacaac

SEQ ID NO: 292343 - RNA, 29 nt, Human
acaacaaaaaacccaccaaauuucugaaa

SEQ ID NO: 292344 - RNA, 26 nt, Human
acacaaaaaccaaaacagcagggacu

SEQ ID NO: 292345 - RNA, 20 nt, Human
acacacaaaaaccaaaacaa

SEQ ID NO: 292346 - RNA, 25 nt, Human
acacacacacacaaaaaccaaaaca

SEQ ID NO: 292347 - RNA, 31 nt, Human
acacucacacaaacacacacacacaaaaacc

SEQ ID NO: 292348 - RNA, 24 nt, Human
acauguguugguaacaaguuuuac

SEQ ID NO: 292349 - RNA, 24 nt, Human
accaaauuucugaaucaaacagaa

SEQ ID NO: 292350 - RNA, 21 nt, Human
accaccauuuucauuuauuag

SEQ ID NO: 292351 - RNA, 24 nt, Human
acccgcgguagccacacauaccca

SEQ ID NO: 292352 - RNA, 21 nt, Human
acuaaaccaaagagaaggugu

SEQ ID NO: 292353 - RNA, 24 nt, Human
acucacacaaacacacacacacaa

SEQ ID NO: 292354 - RNA, 19 nt, Human
agaaaggaaacuugggucu

SEQ ID NO: 292355 - RNA, 22 nt, Human
agacaggauccccggagcacag

SEQ ID NO: 292356 - RNA, 19 nt, Human
agagagagagagaaagaga

SEQ ID NO: 292357 - RNA, 19 nt, Human
agaggguggcugccaccuc

SEQ ID NO: 292358 - RNA, 21 nt, Human
agccaauaucuggcacucgca

SEQ ID NO: 292359 - RNA, 23 nt, Human
agccagaguggagagaaagaguu

SEQ ID NO: 292360 - RNA, 18 nt, Human
agcuuuuacgacaaaacc

SEQ ID NO: 292361 - RNA, 18 nt, Human
aggagaaaggaaacuugg

SEQ ID NO: 292362 - RNA, 23 nt, Human
aguuacacacccuucaaaauaug

SEQ ID NO: 292363 - RNA, 21 nt, Human
auaaaucuaugaaacaacaaa

SEQ ID NO: 292364 - RNA, 21 nt, Human
auaccauuagaauuucaaagc

SEQ ID NO: 292365 - RNA, 21 nt, Human
augcaagaggcagccccagag

SEQ ID NO: 292366 - RNA, 23 nt, Human
caaaacaacaacaaaaaacccac

SEQ ID NO: 292367 - RNA, 24 nt, Human
caaacacacacacacaaaaaccaa

SEQ ID NO: 292368 - RNA, 28 nt, Human
caaacacacacacacaaaaaccaaaaca

SEQ ID NO: 292369 - RNA, 23 nt, Human
caacaacaaaaaacccaccaaau

SEQ ID NO: 292370 - RNA, 22 nt, Human
caacaauaaagcuuaaaguuca

SEQ ID NO: 292371 - RNA, 23 nt, Human
caacagacuuuagggucuccuaa

SEQ ID NO: 292372 - RNA, 26 nt, Human
cacaaaaaccaaaacaacaacaaaaa

SEQ ID NO: 292373 - RNA, 22 nt, Human
cacacaaaaaccaaaacaacaa

SEQ ID NO: 292374 - RNA, 23 nt, Human
cacacaaaaaccaaaacaacaac

SEQ ID NO: 292375 - RNA, 18 nt, Human
cacacaaacacacacaca

SEQ ID NO: 292376 - RNA, 20 nt, Human
cacacaaacacacacacaca

SEQ ID NO: 292377 - RNA, 23 nt, Human
cacacacacaaaaaccaaaacaa

SEQ ID NO: 292378 - RNA, 22 nt, Human
cacacacacacaaaaaccaaaa

SEQ ID NO: 292379 - RNA, 21 nt, Human
cacagaauuaguagauugaaa

SEQ ID NO: 292380 - RNA, 18 nt, Human
cacuguaugagaaaacaa

SEQ ID NO: 292381 - RNA, 24 nt, Human
cagauaccauuagaauuucaaagc

SEQ ID NO: 292382 - RNA, 22 nt, Human
caggauccccggagcacagggc

SEQ ID NO: 292383 - RNA, 18 nt, Human
caguacaucugugaagug

SEQ ID NO: 292384 - RNA, 22 nt, Human
cauagcauacagcauacauaug

SEQ ID NO: 292385 - RNA, 18 nt, Human
caugcaagaggcagcccc

SEQ ID NO: 292386 - RNA, 19 nt, Human
cauuuaccagguauuuuaa

SEQ ID NO: 292387 - RNA, 21 nt, Human
ccaccaaauuucugaaucaaa

SEQ ID NO: 292388 - RNA, 22 nt, Human
ccaguggccacaaacucccaag

SEQ ID NO: 292389 - RNA, 23 nt, Human
cccaagcugcucaaucucaaaac

SEQ ID NO: 292390 - RNA, 21 nt, Human
ccccaugcaauccugcagagc

SEQ ID NO: 292391 - RNA, 22 nt, Human
ccccaugcaauccugcagagcu

SEQ ID NO: 292392 - RNA, 20 nt, Human
ccgcgguagccacacauacc

SEQ ID NO: 292393 - RNA, 22 nt, Human
ccugcugcuucucuuauuccuc

SEQ ID NO: 292394 - RNA, 19 nt, Human
cuaaaaguagacaagacag

SEQ ID NO: 292395 - RNA, 25 nt, Human
cuagcacaccaagacaagucacaga

SEQ ID NO: 292396 - RNA, 28 nt, Human
cuagugaaaauagcuuuacgcucccucu

SEQ ID NO: 292397 - RNA, 23 nt, Human
cuaugaaacaacaaacagcgaaa

SEQ ID NO: 292398 - RNA, 21 nt, Human
cucacacaaacacacacacac

SEQ ID NO: 292399 - RNA, 18 nt, Human
cucccaagcugcucaauc

SEQ ID NO: 292400 - RNA, 18 nt, Human
cugcagagcugaaguuac

SEQ ID NO: 292401 - RNA, 21 nt, Human
cuggaccauaaauaaaauucc

SEQ ID NO: 292402 - RNA, 18 nt, Human
cuuauuuaaggugacagc

SEQ ID NO: 292403 - RNA, 23 nt, Human
gaacuguuggcuugcagguauga

SEQ ID NO: 292404 - RNA, 20 nt, Human
gaccugaaagaguaaagcug

SEQ ID NO: 292405 - RNA, 20 nt, Human
gagagagagagagaaagaga

SEQ ID NO: 292406 - RNA, 20 nt, Human
gccacaaacucccaagcugc

SEQ ID NO: 292407 - RNA, 20 nt, Human
gcuucuguuucccagggugg

SEQ ID NO: 292408 - RNA, 19 nt, Human
gggcugggaagccucuccu

SEQ ID NO: 292409 - RNA, 24 nt, Human
guccugcugcuucucuuauuccuc

SEQ ID NO: 292410 - RNA, 19 nt, Human
uaaaguccugcugcuucuc

SEQ ID NO: 292411 - RNA, 18 nt, Human
uaacagacuccuaccucu

SEQ ID NO: 292412 - RNA, 20 nt, Human
uaacaucauagguguuagua

SEQ ID NO: 292413 - RNA, 24 nt, Human
uaauaaauuagcccgauucuccuc

SEQ ID NO: 292414 - RNA, 20 nt, Human
uaauauuuucauuuaccagg

SEQ ID NO: 292415 - RNA, 21 nt, Human
uaauggaauuacauucaacaa

SEQ ID NO: 292416 - RNA, 27 nt, Human
uaauuaucaucauuaauaaauuagccc

SEQ ID NO: 292417 - RNA, 19 nt, Human
uacacaaaagcugauuaac

SEQ ID NO: 292418 - RNA, 23 nt, Human
uaccaauagcaccaauucaaaau

SEQ ID NO: 292419 - RNA, 21 nt, Human
uaccauuagaauuucaaagca

SEQ ID NO: 292420 - RNA, 25 nt, Human
uaccccaugcaauccugcagagcug

SEQ ID NO: 292421 - RNA, 19 nt, Human
uacgacaaaaccuguuaaa

SEQ ID NO: 292422 - RNA, 18 nt, Human
uacugugucuuucauaca

SEQ ID NO: 292423 - RNA, 23 nt, Human
uagaauuucaaagcauucugcaa

SEQ ID NO: 292424 - RNA, 24 nt, Human
uagaauuucaaagcauucugcaac

SEQ ID NO: 292425 - RNA, 26 nt, Human
uagcacaccaagacaagucacagaau

SEQ ID NO: 292426 - RNA, 20 nt, Human
uaguagauugaaaaaucugc

SEQ ID NO: 292427 - RNA, 23 nt, Human
uauuugucuuuguuuucuugccu

SEQ ID NO: 292428 - RNA, 23 nt, Human
ucacacaaacacacacacacaaa

SEQ ID NO: 292429 - RNA, 22 nt, Human
uccacuuuuucacagguguaca

SEQ ID NO: 292430 - RNA, 23 nt, Human
ucucuguuaaaguccugcugcuu

SEQ ID NO: 292431 - RNA, 20 nt, Human
ucugaaucaaacagaaacca

SEQ ID NO: 292432 - RNA, 21 nt, Human
ucuucaaaaugucuuugccaa

SEQ ID NO: 292433 - RNA, 22 nt, Human
ugaaaauagcuuuacgcucccu

SEQ ID NO: 292434 - RNA, 22 nt, Human
ugaaacaacaaacagcgaaagg

SEQ ID NO: 292435 - RNA, 23 nt, Human
ugcaauccugcagagcugaaguu

SEQ ID NO: 292436 - RNA, 22 nt, Human
uggcuggaccauaaauaaaauu

SEQ ID NO: 292437 - RNA, 20 nt, Human
uggcuugcagguaugaugca

SEQ ID NO: 292438 - RNA, 23 nt, Human
uguacagauacauuauaauuauc

SEQ ID NO: 292439 - RNA, 22 nt, Human
uuaaaaaaacacuacuccacuu

SEQ ID NO: 292440 - RNA, 19 nt, Human
uuaaaacacugaacuguug

SEQ ID NO: 292441 - RNA, 19 nt, Human
uuaacaaugguuaaaaaaa

SEQ ID NO: 292442 - RNA, 21 nt, Human
uuagaagagcauguuuugcaa

SEQ ID NO: 292443 - RNA, 21 nt, Human
uucaaaaugaauccacaugac

SEQ ID NO: 292444 - RNA, 22 nt, Human
uucacauacacaagcacagagu

SEQ ID NO: 292445 - RNA, 21 nt, Human
uucgcaaauguaaaaagugcu

SEQ ID NO: 292446 - RNA, 22 nt, Human
uugaagaacuacacucacacaa

SEQ ID NO: 292447 - RNA, 18 nt, Human
uuguauucauauuucucu

SEQ ID NO: 292448 - RNA, 23 nt, Human
uuuaaaaacuuuccuugccuccu

SEQ ID NO: 292449 - RNA, 22 nt, Human
uuuauuuaguaauacaugcaag

SEQ ID NO: 292450 - RNA, 22 nt, Human
uuuucauaaacauugugugcaa

SEQ ID NO: 292451 - RNA, 25 nt, Human
aaaaggaaaacuaaaccaaagagaa

SEQ ID NO: 292452 - RNA, 23 nt, Human
aaacucccaagcugcucaaucuc

SEQ ID NO: 292453 - RNA, 22 nt, Human
aacuguuggcuugcagguauga

SEQ ID NO: 292454 - RNA, 26 nt, Human
aagcuaaaaguagacaagagggaccc

SEQ ID NO: 292455 - RNA, 19 nt, Human
aauccugcagagcugaagu

SEQ ID NO: 292456 - RNA, 30 nt, Human; identical to SEQ ID NO: 291891

SEQ ID NO: 292457 - RNA, 18 nt, Human
acagaauuaguagauuga

SEQ ID NO: 292458 - RNA, 24 nt, Human
acauguguugguaacaaguuuuac

SEQ ID NO: 292459 - RNA, 21 nt, Human
accaccauuuucauuuauuag

SEQ ID NO: 292460 - RNA, 21 nt, Human
acuaaaccaaagagaaggugu

SEQ ID NO: 292461 - RNA, 19 nt, Human
agaaaggaaacuugggucu

SEQ ID NO: 292462 - RNA, 22 nt, Human
agacaggauccccggagcacag

SEQ ID NO: 292463 - RNA, 19 nt, Human
agagagagagagaaagaga

SEQ ID NO: 292464 - RNA, 19 nt, Human
agaggguggcugccaccuc

SEQ ID NO: 292465 - RNA, 21 nt, Human
agccaauaucuggcacucgca

SEQ ID NO: 292466 - RNA, 23 nt, Human
agccagaguggagagaaagaguu

SEQ ID NO: 292467 - RNA, 18 nt, Human
agcuuuuacgacaaaacc

SEQ ID NO: 292468 - RNA, 19 nt, Human
aggagaaaggaaacuuggg

SEQ ID NO: 292469 - RNA, 23 nt, Human
aguuacacacccuucaaaauaug

SEQ ID NO: 292470 - RNA, 21 nt, Human
auaaaucuaugaaacaacaaa

SEQ ID NO: 292471 - RNA, 21 nt, Human
auaccauuagaauuucaaagc

SEQ ID NO: 292472 - RNA, 20 nt, Human
caaaaggaaauauaauggaa

SEQ ID NO: 292473 - RNA, 22 nt, Human
caacaauaaagcuuaaaguuca

SEQ ID NO: 292474 - RNA, 23 nt, Human
caacagacuuuagggucuccuaa

SEQ ID NO: 292475 - RNA, 20 nt, Human
cacauacacaagcacagagu

SEQ ID NO: 292476 - RNA, 18 nt, Human
cacuguaugagaaaacaa

SEQ ID NO: 292477 - RNA, 24 nt, Human
cagauaccauuagaauuucaaagc

SEQ ID NO: 292478 - RNA, 22 nt, Human
caggauccccggagcacagggc

SEQ ID NO: 292479 - RNA, 22 nt, Human
cauagcauacagcauacauaug

SEQ ID NO: 292480 - RNA, 18 nt, Human
caugcaagaggcagcccc

SEQ ID NO: 292481 - RNA, 22 nt, Human
ccaguggccacaaacucccaag

SEQ ID NO: 292482 - RNA, 19 nt, Human
ccaugcaauccugcagagc

SEQ ID NO: 292483 - RNA, 23 nt, Human
cccaagcugcucaaucucaaaac

SEQ ID NO: 292484 - RNA, 21 nt, Human
ccccaugcaauccugcagagc

SEQ ID NO: 292485 - RNA, 23 nt, Human
cccgcgguagccacacauaccca

SEQ ID NO: 292486 - RNA, 19 nt, Human
cccuucaaaauaugggaga

SEQ ID NO: 292487 - RNA, 20 nt, Human
ccgcgguagccacacauacc

SEQ ID NO: 292488 - RNA, 19 nt, Human
cuaaaaguagacaagacag

SEQ ID NO: 292489 - RNA, 25 nt, Human
cuagcacaccaagacaagucacaga

SEQ ID NO: 292490 - RNA, 23 nt, Human
cuaugaaacaacaaacagcgaaa

SEQ ID NO: 292491 - RNA, 18 nt, Human
cucccaagcugcucaauc

SEQ ID NO: 292492 - RNA, 18 nt, Human
cugcagagcugaaguuac

SEQ ID NO: 292493 - RNA, 21 nt, Human
cuggaccauaaauaaaauucc

SEQ ID NO: 292494 - RNA, 18 nt, Human
cuuauuuaaggugacagc

SEQ ID NO: 292495 - RNA, 23 nt, Human
gaacuguuggcuugcagguauga

SEQ ID NO: 292496 - RNA, 20 nt, Human
gaccugaaagaguaaagcug

SEQ ID NO: 292497 - RNA, 20 nt, Human
gagagagagagagaaagaga

SEQ ID NO: 292498 - RNA, 19 nt, Human
gcaagaggcagccccagag

SEQ ID NO: 292499 - RNA, 20 nt, Human
gccacaaacucccaagcugc

SEQ ID NO: 292500 - RNA, 21 nt, Human
gcugcucaaucucaaaacuuu

SEQ ID NO: 292501 - RNA, 20 nt, Human
gcuucuguuucccagggugg

SEQ ID NO: 292502 - RNA, 21 nt, Human
gggcugggaagccucuccuuu

SEQ ID NO: 292503 - RNA, 18 nt, Human
uaacagacuccuaccucu

SEQ ID NO: 292504 - RNA, 18 nt, Human
uaacaucauagguguuag

SEQ ID NO: 292505 - RNA, 24 nt, Human
uaauaaauuagcccgauucuccuc

SEQ ID NO: 292506 - RNA, 21 nt, Human
uaauggaauuacauucaacaa

SEQ ID NO: 292507 - RNA, 27 nt, Human
uaauuaucaucauuaauaaauuagccc

SEQ ID NO: 292508 - RNA, 19 nt, Human
uacacaaaagcugauuaac

SEQ ID NO: 292509 - RNA, 23 nt, Human
uaccaauagcaccaauucaaaau

SEQ ID NO: 292510 - RNA, 21 nt, Human
uaccauuagaauuucaaagca

SEQ ID NO: 292511 - RNA, 25 nt, Human
uaccccaugcaauccugcagagcug

SEQ ID NO: 292512 - RNA, 19 nt, Human
uacgacaaaaccuguuaaa

SEQ ID NO: 292513 - RNA, 18 nt, Human
uacugugucuuucauaca

SEQ ID NO: 292514 - RNA, 23 nt, Human
uagaauuucaaagcauucugcaa

SEQ ID NO: 292515 - RNA, 24 nt, Human
uagaauuucaaagcauucugcaac

SEQ ID NO: 292516 - RNA, 26 nt, Human
uagcacaccaagacaagucacagaau

SEQ ID NO: 292517 - RNA, 20 nt, Human
uaguagauugaaaaaucugc

SEQ ID NO: 292518 - RNA, 23 nt, Human
uauuugucuuuguuuucuugccu

SEQ ID NO: 292519 - RNA, 22 nt, Human
uccacuuuuucacagguguaca

SEQ ID NO: 292520 - RNA, 22 nt, Human
ugaaacaacaaacagcgaaagg

SEQ ID NO: 292521 - RNA, 23 nt, Human
ugcaauccugcagagcugaaguu

SEQ ID NO: 292522 - RNA, 22 nt, Human
uggcuggaccauaaauaaaauu

SEQ ID NO: 292523 - RNA, 20 nt, Human
uggcuugcagguaugaugca

SEQ ID NO: 292524 - RNA, 23 nt, Human
uguacagauacauuauaauuauc

SEQ ID NO: 292525 - RNA, 22 nt, Human
uuaaaaaaacacuacuccacuu

SEQ ID NO: 292526 - RNA, 19 nt, Human
uuaaaacacugaacuguug

SEQ ID NO: 292527 - RNA, 19 nt, Human
uuaacaaugguuaaaaaaa

SEQ ID NO: 292528 - RNA, 21 nt, Human
uucaaaaugaauccacaugac

SEQ ID NO: 292529 - RNA, 21 nt, Human
uucgcaaauguaaaaagugcu

SEQ ID NO: 292530 - RNA, 18 nt, Human
uuguauucauauuucucu

SEQ ID NO: 292531 - RNA, 22 nt, Human
uuuauuuaguaauacaugcaag

SEQ ID NO: 292532 - RNA, 22 nt, Human
uuuucauaaacauugugugcaa

SEQ ID NO: 292533 - RNA, 25 nt, Human
aaaaggaaaacuaaaccaaagagaa

SEQ ID NO: 292534 - RNA, 23 nt, Human
aaacucccaagcugcucaaucuc

SEQ ID NO: 292535 - RNA, 22 nt, Human
aacuguuggcuugcagguauga

SEQ ID NO: 292536 - RNA, 26 nt, Human
aagcuaaaaguagacaagagggaccc

SEQ ID NO: 292537 - RNA, 23 nt, Human
aagcugcucaaucucaaaacuuu

SEQ ID NO: 292538 - RNA, 19 nt, Human
aauccugcagagcugaagu

SEQ ID NO: 292539 - RNA, 30 nt, Human; identical to SEQ ID NO: 291891

SEQ ID NO: 292540 - RNA, 24 nt, Human
acauguguugguaacaaguuuuac

SEQ ID NO: 292541 - RNA, 21 nt, Human
accaccauuuucauuuauuag

SEQ ID NO: 292542 - RNA, 24 nt, Human
acccgcgguagccacacauaccca

SEQ ID NO: 292543 - RNA, 21 nt, Human
acuaaaccaaagagaaggugu

SEQ ID NO: 292544 - RNA, 19 nt, Human
agaaaggaaacuugggucu

SEQ ID NO: 292545 - RNA, 22 nt, Human
agacaggauccccggagcacag

SEQ ID NO: 292546 - RNA, 19 nt, Human
agagagagagagaaagaga

SEQ ID NO: 292547 - RNA, 19 nt, Human
agaggguggcugccaccuc

SEQ ID NO: 292548 - RNA, 21 nt, Human
agccaauaucuggcacucgca

SEQ ID NO: 292549 - RNA, 23 nt, Human
agccagaguggagagaaagaguu

SEQ ID NO: 292550 - RNA, 18 nt, Human
aggagaaaggaaacuugg

SEQ ID NO: 292551 - RNA, 23 nt, Human
aguuacacacccuucaaaauaug

SEQ ID NO: 292552 - RNA, 21 nt, Human
auaaaucuaugaaacaacaaa

SEQ ID NO: 292553 - RNA, 21 nt, Human
auaccauuagaauuucaaagc

SEQ ID NO: 292554 - RNA, 20 nt, Human
auuaaauaucguuucucaaa

SEQ ID NO: 292555 - RNA, 20 nt, Human
caaaaggaaauauaauggaa

SEQ ID NO: 292556 - RNA, 22 nt, Human
caacaauaaagcuuaaaguuca

SEQ ID NO: 292557 - RNA, 23 nt, Human
caacagacuuuagggucuccuaa

SEQ ID NO: 292558 - RNA, 21 nt, Human
cacagaauuaguagauugaaa

SEQ ID NO: 292559 - RNA, 22 nt, Human
cacaguauuuuguucugauuaa

SEQ ID NO: 292560 - RNA, 18 nt, Human
cacuguaugagaaaacaa

SEQ ID NO: 292561 - RNA, 24 nt, Human
cagauaccauuagaauuucaaagc

SEQ ID NO: 292562 - RNA, 22 nt, Human
caggauccccggagcacagggc

SEQ ID NO: 292563 - RNA, 22 nt, Human
cauagcauacagcauacauaug

SEQ ID NO: 292564 - RNA, 18 nt, Human
caugcaagaggcagcccc

SEQ ID NO: 292565 - RNA, 19 nt, Human
ccacaaacucccaagcugc

SEQ ID NO: 292566 - RNA, 22 nt, Human
ccaguggccacaaacucccaag

SEQ ID NO: 292567 - RNA, 23 nt, Human
cccaagcugcucaaucucaaaac

SEQ ID NO: 292568 - RNA, 21 nt, Human
ccccaugcaauccugcagagc

SEQ ID NO: 292569 - RNA, 22 nt, Human
ccccaugcaauccugcagagcu

SEQ ID NO: 292570 - RNA, 19 nt, Human
cccuucaaaauaugggaga

SEQ ID NO: 292571 - RNA, 20 nt, Human
ccgcgguagccacacauacc

SEQ ID NO: 292572 - RNA, 19 nt, Human
cuaaaaguagacaagacag

SEQ ID NO: 292573 - RNA, 25 nt, Human
cuagcacaccaagacaagucacaga

SEQ ID NO: 292574 - RNA, 20 nt, Human
cucaaagucaagggaaaucc

SEQ ID NO: 292575 - RNA, 18 nt, Human
cucccaagcugcucaauc

SEQ ID NO: 292576 - RNA, 18 nt, Human
cugcagagcugaaguuac

SEQ ID NO: 292577 - RNA, 21 nt, Human
cuggaccauaaauaaaauucc

SEQ ID NO: 292578 - RNA, 18 nt, Human
cuuauuuaaggugacagc

SEQ ID NO: 292579 - RNA, 19 nt, Human
gaaacaacaaacagcgaaa

SEQ ID NO: 292580 - RNA, 20 nt, Human
gaccugaaagaguaaagcug

SEQ ID NO: 292581 - RNA, 20 nt, Human
gagagagagagagaaagaga

SEQ ID NO: 292582 - RNA, 19 nt, Human
gcaagaggcagccccagag

SEQ ID NO: 292583 - RNA, 20 nt, Human
gcuucuguuucccagggugg

SEQ ID NO: 292584 - RNA, 21 nt, Human
gggcugggaagccucuccuuu

SEQ ID NO: 292585 - RNA, 18 nt, Human
uaacagacuccuaccucu

SEQ ID NO: 292586 - RNA, 18 nt, Human
uaacaucauagguguuag

SEQ ID NO: 292587 - RNA, 24 nt, Human
uaauaaauuagcccgauucuccuc

SEQ ID NO: 292588 - RNA, 21 nt, Human
uaauggaauuacauucaacaa

SEQ ID NO: 292589 - RNA, 27 nt, Human
uaauuaucaucauuaauaaauuagccc

SEQ ID NO: 292590 - RNA, 19 nt, Human
uacacaaaagcugauuaac

SEQ ID NO: 292591 - RNA, 23 nt, Human
uaccaauagcaccaauucaaaau

SEQ ID NO: 292592 - RNA, 21 nt, Human
uaccauuagaauuucaaagca

SEQ ID NO: 292593 - RNA, 25 nt, Human
uaccccaugcaauccugcagagcug

SEQ ID NO: 292594 - RNA, 19 nt, Human
uacgacaaaaccuguuaaa

SEQ ID NO: 292595 - RNA, 18 nt, Human
uacugugucuuucauaca

SEQ ID NO: 292596 - RNA, 23 nt, Human
uagaauuucaaagcauucugcaa

SEQ ID NO: 292597 - RNA, 24 nt, Human
uagaauuucaaagcauucugcaac

SEQ ID NO: 292598 - RNA, 26 nt, Human
uagcacaccaagacaagucacagaau

SEQ ID NO: 292599 - RNA, 20 nt, Human
uaguagauugaaaaaucugc

SEQ ID NO: 292600 - RNA, 23 nt, Human
uauuugucuuuguuuucuugccu

SEQ ID NO: 292601 - RNA, 20 nt, Human
uauuuuguucugauuaaaua

SEQ ID NO: 292602 - RNA, 23 nt, Human
uauuuuguucugauuaaauaucg

SEQ ID NO: 292603 - RNA, 22 nt, Human
uccacuuuuucacagguguaca

SEQ ID NO: 292604 - RNA, 22 nt, Human
ugaaacaacaaacagcgaaagg

SEQ ID NO: 292605 - RNA, 22 nt, Human
ugauuaaauaucguuucucaaa

SEQ ID NO: 292606 - RNA, 23 nt, Human
ugcaauccugcagagcugaaguu

SEQ ID NO: 292607 - RNA, 24 nt, Human
ugcacaguauuuuguucugauuaa

SEQ ID NO: 292608 - RNA, 20 nt, Human
uggcuggaccauaaauaaaa

SEQ ID NO: 292609 - RNA, 20 nt, Human
uggcuugcagguaugaugca

SEQ ID NO: 292610 - RNA, 23 nt, Human
uguacagauacauuauaauuauc

SEQ ID NO: 292611 - RNA, 22 nt, Human
uuaaaaaaacacuacuccacuu

SEQ ID NO: 292612 - RNA, 19 nt, Human
uuaaaacacugaacuguug

SEQ ID NO: 292613 - RNA, 19 nt, Human
uuaacaaugguuaaaaaaa

SEQ ID NO: 292614 - RNA, 21 nt, Human
uucaaaaugaauccacaugac

SEQ ID NO: 292615 - RNA, 22 nt, Human
uucacauacacaagcacagagu

SEQ ID NO: 292616 - RNA, 21 nt, Human
uucgcaaauguaaaaagugcu

SEQ ID NO: 292617 - RNA, 22 nt, Human
uuuauuuaguaauacaugcaag

SEQ ID NO: 292618 - RNA, 22 nt, Human
uuuucauaaacauugugugcaa

SEQ ID NO: 292619 - RNA, 25 nt, Human
aaaaggaaaacuaaaccaaagagaa

SEQ ID NO: 292620 - RNA, 22 nt, Human
aacucccaagcugcucaaucuc

SEQ ID NO: 292621 - RNA, 22 nt, Human
aacuguuggcuugcagguauga

SEQ ID NO: 292622 - RNA, 26 nt, Human
aagcuaaaaguagacaagagggaccc

SEQ ID NO: 292623 - RNA, 19 nt, Human
aauccugcagagcugaagu

SEQ ID NO: 292624 - RNA, 30 nt, Human; identical to SEQ ID NO: 291891

SEQ ID NO: 292625 - RNA, 24 nt, Human
acauguguugguaacaaguuuuac

SEQ ID NO: 292626 - RNA, 21 nt, Human
accaccauuuucauuuauuag

SEQ ID NO: 292627 - RNA, 21 nt, Human
acuaaaccaaagagaaggugu

SEQ ID NO: 292628 - RNA, 19 nt, Human
agaaaggaaacuugggucu

SEQ ID NO: 292629 - RNA, 22 nt, Human
agacaggauccccggagcacag

SEQ ID NO: 292630 - RNA, 19 nt, Human
agagagagagagaaagaga

SEQ ID NO: 292631 - RNA, 19 nt, Human
agaggguggcugccaccuc

SEQ ID NO: 292632 - RNA, 21 nt, Human
agccaauaucuggcacucgca

SEQ ID NO: 292633 - RNA, 23 nt, Human
agccagaguggagagaaagaguu

SEQ ID NO: 292634 - RNA, 18 nt, Human
aggagaaaggaaacuugg

SEQ ID NO: 292635 - RNA, 23 nt, Human
aguuacacacccuucaaaauaug

SEQ ID NO: 292636 - RNA, 21 nt, Human
auaaaucuaugaaacaacaaa

SEQ ID NO: 292637 - RNA, 21 nt, Human
auaccauuagaauuucaaagc

SEQ ID NO: 292638 - RNA, 21 nt, Human
augcaagaggcagccccagag

SEQ ID NO: 292639 - RNA, 18 nt, Human
auggaauuacauucaaca

SEQ ID NO: 292640 - RNA, 22 nt, Human
caacaauaaagcuuaaaguuca

SEQ ID NO: 292641 - RNA, 23 nt, Human
caacagacuuuagggucuccuaa

SEQ ID NO: 292642 - RNA, 21 nt, Human
cacagaauuaguagauugaaa

SEQ ID NO: 292643 - RNA, 20 nt, Human
cacauacacaagcacagagu

SEQ ID NO: 292644 - RNA, 18 nt, Human
cacuguaugagaaaacaa

SEQ ID NO: 292645 - RNA, 24 nt, Human
cagauaccauuagaauuucaaagc

SEQ ID NO: 292646 - RNA, 22 nt, Human
caggauccccggagcacagggc

SEQ ID NO: 292647 - RNA, 22 nt, Human
cauagcauacagcauacauaug

SEQ ID NO: 292648 - RNA, 18 nt, Human
caugcaagaggcagcccc

SEQ ID NO: 292649 - RNA, 22 nt, Human
ccaguggccacaaacucccaag

SEQ ID NO: 292650 - RNA, 23 nt, Human
cccaagcugcucaaucucaaaac

SEQ ID NO: 292651 - RNA, 21 nt, Human
ccccaugcaauccugcagagc

SEQ ID NO: 292652 - RNA, 22 nt, Human
ccccaugcaauccugcagagcu

SEQ ID NO: 292653 - RNA, 23 nt, Human
cccgcgguagccacacauaccca

SEQ ID NO: 292654 - RNA, 19 nt, Human
cccuucaaaauaugggaga

SEQ ID NO: 292655 - RNA, 20 nt, Human
ccgcgguagccacacauacc

SEQ ID NO: 292656 - RNA, 19 nt, Human
cuaaaaguagacaagacag

SEQ ID NO: 292657 - RNA, 25 nt, Human
cuagcacaccaagacaagucacaga

SEQ ID NO: 292658 - RNA, 23 nt, Human
cuaugaaacaacaaacagcgaaa

SEQ ID NO: 292659 - RNA, 18 nt, Human
cucccaagcugcucaauc

SEQ ID NO: 292660 - RNA, 18 nt, Human
cugcagagcugaaguuac

SEQ ID NO: 292661 - RNA, 21 nt, Human
cuggaccauaaauaaaauucc

SEQ ID NO: 292662 - RNA, 18 nt, Human
cuuauuuaaggugacagc

SEQ ID NO: 292663 - RNA, 23 nt, Human
gaacuguuggcuugcagguauga

SEQ ID NO: 292664 - RNA, 20 nt, Human
gaccugaaagaguaaagcug

SEQ ID NO: 292665 - RNA, 20 nt, Human
gagagagagagagaaagaga

SEQ ID NO: 292666 - RNA, 20 nt, Human
gccacaaacucccaagcugc

SEQ ID NO: 292667 - RNA, 21 nt, Human
gcugcucaaucucaaaacuuu

SEQ ID NO: 292668 - RNA, 20 nt, Human
gcuucuguuucccagggugg

SEQ ID NO: 292669 - RNA, 19 nt, Human
gggcugggaagccucuccu

SEQ ID NO: 292670 - RNA, 18 nt, Human
uaacagacuccuaccucu

SEQ ID NO: 292671 - RNA, 20 nt, Human
uaacaucauagguguuagua

SEQ ID NO: 292672 - RNA, 24 nt, Human
uaauaaauuagcccgauucuccuc

SEQ ID NO: 292673 - RNA, 27 nt, Human
uaauuaucaucauuaauaaauuagccc

SEQ ID NO: 292674 - RNA, 19 nt, Human
uacacaaaagcugauuaac

SEQ ID NO: 292675 - RNA, 23 nt, Human
uaccaauagcaccaauucaaaau

SEQ ID NO: 292676 - RNA, 21 nt, Human
uaccauuagaauuucaaagca

SEQ ID NO: 292677 - RNA, 25 nt, Human
uaccccaugcaauccugcagagcug

SEQ ID NO: 292678 - RNA, 19 nt, Human
uacgacaaaaccuguuaaa

SEQ ID NO: 292679 - RNA, 18 nt, Human
uacugugucuuucauaca

SEQ ID NO: 292680 - RNA, 23 nt, Human
uagaauuucaaagcauucugcaa

SEQ ID NO: 292681 - RNA, 24 nt, Human
uagaauuucaaagcauucugcaac

SEQ ID NO: 292682 - RNA, 26 nt, Human
uagcacaccaagacaagucacagaau

SEQ ID NO: 292683 - RNA, 20 nt, Human
uaguagauugaaaaaucugc

SEQ ID NO: 292684 - RNA, 23 nt, Human
uauuugucuuuguuuucuugccu

SEQ ID NO: 292685 - RNA, 22 nt, Human
uccacuuuuucacagguguaca

SEQ ID NO: 292686 - RNA, 22 nt, Human
ugaaacaacaaacagcgaaagg

SEQ ID NO: 292687 - RNA, 23 nt, Human
ugcaauccugcagagcugaaguu

SEQ ID NO: 292688 - RNA, 22 nt, Human
uggcuggaccauaaauaaaauu

SEQ ID NO: 292689 - RNA, 20 nt, Human
uggcuugcagguaugaugca

SEQ ID NO: 292690 - RNA, 23 nt, Human
uguacagauacauuauaauuauc

SEQ ID NO: 292691 - RNA, 22 nt, Human
uuaaaaaaacacuacuccacuu

SEQ ID NO: 292692 - RNA, 19 nt, Human
uuaaaacacugaacuguug

SEQ ID NO: 292693 - RNA, 19 nt, Human
uuaacaaugguuaaaaaaa

SEQ ID NO: 292694 - RNA, 21 nt, Human
uucaaaaugaauccacaugac

SEQ ID NO: 292695 - RNA, 21 nt, Human
uucgcaaauguaaaaagugcu

SEQ ID NO: 292696 - RNA, 18 nt, Human
uuguauucauauuucucu

SEQ ID NO: 292697 - RNA, 22 nt, Human
uuuauuuaguaauacaugcaag

SEQ ID NO: 292698 - RNA, 22 nt, Human
uuuucauaaacauugugugcaa

SEQ ID NO: 292699 - RNA, 25 nt, Human
aaaaggaaaacuaaaccaaagagaa

SEQ ID NO: 292700 - RNA, 23 nt, Human
aaacucccaagcugcucaaucuc

SEQ ID NO: 292701 - RNA, 22 nt, Human
aaauaccucugguuuuauuucc

SEQ ID NO: 292702 - RNA, 21 nt, Human
aacaauaaagcuuaaaguuca

SEQ ID NO: 292703 - RNA, 22 nt, Human
aacuguuggcuugcagguauga

SEQ ID NO: 292704 - RNA, 26 nt, Human
aagcuaaaaguagacaagagggaccc

SEQ ID NO: 292705 - RNA, 23 nt, Human
aagcugcucaaucucaaaacuuu

SEQ ID NO: 292706 - RNA, 19 nt, Human
aauccugcagagcugaagu

SEQ ID NO: 292707 - RNA, 30 nt, Human; identical to SEQ ID NO: 291891

SEQ ID NO: 292708 - RNA, 18 nt, Human
acagaauuaguagauuga

SEQ ID NO: 292709 - RNA, 24 nt, Human
acauguguugguaacaaguuuuac

SEQ ID NO: 292710 - RNA, 21 nt, Human
accaccauuuucauuuauuag

SEQ ID NO: 292711 - RNA, 24 nt, Human
acccgcgguagccacacauaccca

SEQ ID NO: 292712 - RNA, 21 nt, Human
acuaaaccaaagagaaggugu

SEQ ID NO: 292713 - RNA, 19 nt, Human
agaaaggaaacuugggucu

SEQ ID NO: 292714 - RNA, 21 nt, Human
agacaggauccccggagcaca

SEQ ID NO: 292715 - RNA, 22 nt, Human
agacaggauccccggagcacag

SEQ ID NO: 292716 - RNA, 19 nt, Human
agagagagagagaaagaga

SEQ ID NO: 292717 - RNA, 19 nt, Human
agaggguggcugccaccuc

SEQ ID NO: 292718 - RNA, 21 nt, Human
agccaauaucuggcacucgca

SEQ ID NO: 292719 - RNA, 23 nt, Human
agccagaguggagagaaagaguu

SEQ ID NO: 292720 - RNA, 18 nt, Human
agcuuuuacgacaaaacc

SEQ ID NO: 292721 - RNA, 18 nt, Human
aggagaaaggaaacuugg

SEQ ID NO: 292722 - RNA, 19 nt, Human
aggagaaaggaaacuuggg

SEQ ID NO: 292723 - RNA, 23 nt, Human
aguuacacacccuucaaaauaug

SEQ ID NO: 292724 - RNA, 21 nt, Human
auaaaucuaugaaacaacaaa

SEQ ID NO: 292725 - RNA, 21 nt, Human
auaccauuagaauuucaaagc

SEQ ID NO: 292726 - RNA, 21 nt, Human
augcaagaggcagccccagag

SEQ ID NO: 292727 - RNA, 18 nt, Human
auggaauuacauucaaca

SEQ ID NO: 292728 - RNA, 23 nt, Human
caacagacuuuagggucuccuaa

SEQ ID NO: 292729 - RNA, 21 nt, Human
cacagaauuaguagauugaaa

SEQ ID NO: 292730 - RNA, 18 nt, Human
cacuguaugagaaaacaa

SEQ ID NO: 292731 - RNA, 24 nt, Human
cagauaccauuagaauuucaaagc

SEQ ID NO: 292732 - RNA, 22 nt, Human
caggauccccggagcacagggc

SEQ ID NO: 292733 - RNA, 18 nt, Human
caugcaagaggcagcccc

SEQ ID NO: 292734 - RNA, 19 nt, Human
ccacaaacucccaagcugc

SEQ ID NO: 292735 - RNA, 22 nt, Human
ccaguggccacaaacucccaag

SEQ ID NO: 292736 - RNA, 19 nt, Human
ccaugcaauccugcagagc

SEQ ID NO: 292737 - RNA, 23 nt, Human
cccaagcugcucaaucucaaaac

SEQ ID NO: 292738 - RNA, 21 nt, Human
ccccaugcaauccugcagagc

SEQ ID NO: 292739 - RNA, 21 nt, Human
ccccaugcaauccugcagagc

SEQ ID NO: 292740 - RNA, 23 nt, Human
cccgcgguagccacacauaccca

SEQ ID NO: 292741 - RNA, 19 nt, Human
cccuucaaaauaugggaga

SEQ ID NO: 292742 - RNA, 20 nt, Human
ccgcgguagccacacauacc

SEQ ID NO: 292743 - RNA, 19 nt, Human
cuaaaaguagacaagacag

SEQ ID NO: 292744 - RNA, 25 nt, Human
cuagcacaccaagacaagucacaga

SEQ ID NO: 292745 - RNA, 23 nt, Human
cuaugaaacaacaaacagcgaaa

SEQ ID NO: 292746 - RNA, 18 nt, Human
cucccaagcugcucaauc

SEQ ID NO: 292747 - RNA, 18 nt, Human
cugcagagcugaaguuac

SEQ ID NO: 292748 - RNA, 21 nt, Human
cuggaccauaaauaaaauucc

SEQ ID NO: 292749 - RNA, 18 nt, Human
cuuauuuaaggugacagc

SEQ ID NO: 292750 - RNA, 23 nt, Human
gaacuguuggcuugcagguauga

SEQ ID NO: 292751 - RNA, 20 nt, Human
gaccugaaagaguaaagcug

SEQ ID NO: 292752 - RNA, 20 nt, Human
gagagagagagagaaagaga

SEQ ID NO: 292753 - RNA, 18 nt, Human
gcauacagcauacauaug

SEQ ID NO: 292754 - RNA, 20 nt, Human
gccacaaacucccaagcugc

SEQ ID NO: 292755 - RNA, 20 nt, Human
gcuucuguuucccagggugg

SEQ ID NO: 292756 - RNA, 21 nt, Human
gggcugggaagccucuccuuu

SEQ ID NO: 292757 - RNA, 18 nt, Human
uaacagacuccuaccucu

SEQ ID NO: 292758 - RNA, 20 nt, Human
uaacaucauagguguuagua

SEQ ID NO: 292759 - RNA, 21 nt, Human
uaauaaauuagcccgauucuc

SEQ ID NO: 292760 - RNA, 24 nt, Human
uaauaaauuagcccgauucuccuc

SEQ ID NO: 292761 - RNA, 21 nt, Human
uaauggaauuacauucaacaa

SEQ ID NO: 292762 - RNA, 27 nt, Human
uaauuaucaucauuaauaaauuagccc

SEQ ID NO: 292763 - RNA, 19 nt, Human
uacacaaaagcugauuaac

SEQ ID NO: 292764 - RNA, 23 nt, Human
uaccaauagcaccaauucaaaau

SEQ ID NO: 292765 - RNA, 21 nt, Human
uaccauuagaauuucaaagca

SEQ ID NO: 292766 - RNA, 25 nt, Human
uaccccaugcaauccugcagagcug

SEQ ID NO: 292767 - RNA, 19 nt, Human
uacgacaaaaccuguuaaa

SEQ ID NO: 292768 - RNA, 18 nt, Human
uacugugucuuucauaca

SEQ ID NO: 292769 - RNA, 23 nt, Human
uagaauuucaaagcauucugcaa

SEQ ID NO: 292770 - RNA, 24 nt, Human
uagaauuucaaagcauucugcaac

SEQ ID NO: 292771 - RNA, 26 nt, Human
uagcacaccaagacaagucacagaau

SEQ ID NO: 292772 - RNA, 20 nt, Human
uaguagauugaaaaaucugc

SEQ ID NO: 292773 - RNA, 23 nt, Human
uauuugucuuuguuuucuugccu

SEQ ID NO: 292774 - RNA, 22 nt, Human
uccacuuuuucacagguguaca

SEQ ID NO: 292775 - RNA, 22 nt, Human
ugaaacaacaaacagcgaaagg

SEQ ID NO: 292776 - RNA, 23 nt, Human
ugcaauccugcagagcugaaguu

SEQ ID NO: 292777 - RNA, 28 nt, Human
ugcuuuuuuuaaauaacagacuccuacu

SEQ ID NO: 292778 - RNA, 22 nt, Human
uggcuggaccauaaauaaaauu

SEQ ID NO: 292779 - RNA, 20 nt, Human
uggcuugcagguaugaugca

SEQ ID NO: 292780 - RNA, 23 nt, Human
uguacagauacauuauaauuauc

SEQ ID NO: 292781 - RNA, 22 nt, Human
uuaaaaaaacacuacuccacuu

SEQ ID NO: 292782 - RNA, 19 nt, Human
uuaaaacacugaacuguug

SEQ ID NO: 292783 - RNA, 19 nt, Human
uuaacaaugguuaaaaaaa

SEQ ID NO: 292784 - RNA, 21 nt, Human
uucaaaaugaauccacaugac

SEQ ID NO: 292785 - RNA, 22 nt, Human
uucacauacacaagcacagagu

SEQ ID NO: 292786 - RNA, 21 nt, Human
uucgcaaauguaaaaagugcu

SEQ ID NO: 292787 - RNA, 18 nt, Human
uuguauucauauuucucu

SEQ ID NO: 292788 - RNA, 22 nt, Human
uuuauuuaguaauacaugcaag

SEQ ID NO: 292789 - RNA, 22 nt, Human
uuuucauaaacauugugugcaa

SEQ ID NO: 292790 - RNA, 25 nt, Human
aaaaggaaaacuaaaccaaagagaa

SEQ ID NO: 292791 - RNA, 23 nt, Human
aaacucccaagcugcucaaucuc

SEQ ID NO: 292792 - RNA, 22 nt, Human
aacuguuggcuugcagguauga

SEQ ID NO: 292793 - RNA, 26 nt, Human
aagcuaaaaguagacaagagggaccc

SEQ ID NO: 292794 - RNA, 19 nt, Human
aauccugcagagcugaagu

SEQ ID NO: 292795 - RNA, 24 nt, Human
acauguguugguaacaaguuuuac

SEQ ID NO: 292796 - RNA, 21 nt, Human
accaccauuuucauuuauuag

SEQ ID NO: 292797 - RNA, 21 nt, Human
acuaaaccaaagagaaggugu

SEQ ID NO: 292798 - RNA, 19 nt, Human
agaaaggaaacuugggucu

SEQ ID NO: 292799 - RNA, 21 nt, Human
agacaggauccccggagcaca

SEQ ID NO: 292800 - RNA, 19 nt, Human
agagagagagagaaagaga

SEQ ID NO: 292801 - RNA, 19 nt, Human
agaggguggcugccaccuc

SEQ ID NO: 292802 - RNA, 21 nt, Human
agccaauaucuggcacucgca

SEQ ID NO: 292803 - RNA, 23 nt, Human
agccagaguggagagaaagaguu

SEQ ID NO: 292804 - RNA, 19 nt, Human
aggagaaaggaaacuuggg

SEQ ID NO: 292805 - RNA, 23 nt, Human
aguuacacacccuucaaaauaug

SEQ ID NO: 292806 - RNA, 21 nt, Human
auaaaucuaugaaacaacaaa

SEQ ID NO: 292807 - RNA, 21 nt, Human
auaccauuagaauuucaaagc

SEQ ID NO: 292808 - RNA, 20 nt, Human
caaaaggaaauauaauggaa

SEQ ID NO: 292809 - RNA, 22 nt, Human
caacaauaaagcuuaaaguuca

SEQ ID NO: 292810 - RNA, 23 nt, Human
caacagacuuuagggucuccuaa

SEQ ID NO: 292811 - RNA, 21 nt, Human
cacagaauuaguagauugaaa

SEQ ID NO: 292812 - RNA, 18 nt, Human
cacuguaugagaaaacaa

SEQ ID NO: 292813 - RNA, 24 nt, Human
cagauaccauuagaauuucaaagc

SEQ ID NO: 292814 - RNA, 22 nt, Human
caggauccccggagcacagggc

SEQ ID NO: 292815 - RNA, 22 nt, Human
cauagcauacagcauacauaug

SEQ ID NO: 292816 - RNA, 18 nt, Human
caugcaagaggcagcccc

SEQ ID NO: 292817 - RNA, 22 nt, Human
ccaguggccacaaacucccaag

SEQ ID NO: 292818 - RNA, 19 nt, Human
ccaugcaauccugcagagc

SEQ ID NO: 292819 - RNA, 22 nt, Human
ccccaugcaauccugcagagcu

SEQ ID NO: 292820 - RNA, 23 nt, Human
cccgcgguagccacacauaccca

SEQ ID NO: 292821 - RNA, 19 nt, Human
cccuucaaaauaugggaga

SEQ ID NO: 292822 - RNA, 19 nt, Human
cgcgguagccacacauacc

SEQ ID NO: 292823 - RNA, 19 nt, Human
cuaaaaguagacaagacag

SEQ ID NO: 292824 - RNA, 25 nt, Human
cuagcacaccaagacaagucacaga

SEQ ID NO: 292825 - RNA, 23 nt, Human
cuaugaaacaacaaacagcgaaa

SEQ ID NO: 292826 - RNA, 18 nt, Human
cucccaagcugcucaauc

SEQ ID NO: 292827 - RNA, 18 nt, Human
cugcagagcugaaguuac

SEQ ID NO: 292828 - RNA, 21 nt, Human
cuggaccauaaauaaaauucc

SEQ ID NO: 292829 - RNA, 18 nt, Human
cuuauuuaaggugacagc

SEQ ID NO: 292830 - RNA, 20 nt, Human
gaccugaaagaguaaagcug

SEQ ID NO: 292831 - RNA, 20 nt, Human
gagagagagagagaaagaga

SEQ ID NO: 292832 - RNA, 19 nt, Human
gcaagaggcagccccagag

SEQ ID NO: 292833 - RNA, 20 nt, Human
gccacaaacucccaagcugc

SEQ ID NO: 292834 - RNA, 21 nt, Human
gcugcucaaucucaaaacuuu

SEQ ID NO: 292835 - RNA, 20 nt, Human
gcuucuguuucccagggugg

SEQ ID NO: 292836 - RNA, 21 nt, Human
gggcugggaagccucuccuuu

SEQ ID NO: 292837 - RNA, 18 nt, Human
uaacagacuccuaccucu

SEQ ID NO: 292838 - RNA, 18 nt, Human
uaacaucauagguguuag

SEQ ID NO: 292839 - RNA, 24 nt, Human
uaauaaauuagcccgauucuccuc

SEQ ID NO: 292840 - RNA, 21 nt, Human
uaauggaauuacauucaacaa

SEQ ID NO: 292841 - RNA, 27 nt, Human
uaauuaucaucauuaauaaauuagccc

SEQ ID NO: 292842 - RNA, 19 nt, Human
uacacaaaagcugauuaac

SEQ ID NO: 292843 - RNA, 23 nt, Human
uaccaauagcaccaauucaaaau

SEQ ID NO: 292844 - RNA, 21 nt, Human
uaccauuagaauuucaaagca

SEQ ID NO: 292845 - RNA, 25 nt, Human
uaccccaugcaauccugcagagcug

SEQ ID NO: 292846 - RNA, 19 nt, Human
uacgacaaaaccuguuaaa

SEQ ID NO: 292847 - RNA, 18 nt, Human
uacugugucuuucauaca

SEQ ID NO: 292848 - RNA, 23 nt, Human
uagaauuucaaagcauucugcaa

SEQ ID NO: 292849 - RNA, 24 nt, Human
uagaauuucaaagcauucugcaac

SEQ ID NO: 292850 - RNA, 26 nt, Human
uagcacaccaagacaagucacagaau

SEQ ID NO: 292851 - RNA, 20 nt, Human
uaguagauugaaaaaucugc

SEQ ID NO: 292852 - RNA, 23 nt, Human
uauuugucuuuguuuucuugccu

SEQ ID NO: 292853 - RNA, 22 nt, Human
ugaaacaacaaacagcgaaagg

SEQ ID NO: 292854 - RNA, 23 nt, Human
ugcaauccugcagagcugaaguu

SEQ ID NO: 292855 - RNA, 28 nt, Human
ugcuuuuuuuaaauaacagacuccuacu

SEQ ID NO: 292856 - RNA, 20 nt, Human
uggcuggaccauaaauaaaa

SEQ ID NO: 292857 - RNA, 20 nt, Human
uggcuugcagguaugaugca

SEQ ID NO: 292858 - RNA, 23 nt, Human
uguacagauacauuauaauuauc

SEQ ID NO: 292859 - RNA, 22 nt, Human
uuaaaaaaacacuacuccacuu

SEQ ID NO: 292860 - RNA, 19 nt, Human
uuaaaacacugaacuguug

SEQ ID NO: 292861 - RNA, 19 nt, Human
uuaacaaugguuaaaaaaa

SEQ ID NO: 292862 - RNA, 21 nt, Human
uucaaaaugaauccacaugac

SEQ ID NO: 292863 - RNA, 22 nt, Human
uucacauacacaagcacagagu

SEQ ID NO: 292864 - RNA, 21 nt, Human
uucgcaaauguaaaaagugcu

SEQ ID NO: 292865 - RNA, 18 nt, Human
uuguauucauauuucucu

SEQ ID NO: 292866 - RNA, 22 nt, Human
uuuauuuaguaauacaugcaag

SEQ ID NO: 292867 - RNA, 22 nt, Human
uuuucauaaacauugugugcaa

SEQ ID NO: 292868 - RNA, 25 nt, Human
aaaaggaaaacuaaaccaaagagaa

SEQ ID NO: 292869 - RNA, 22 nt, Human
aacucccaagcugcucaaucuc

SEQ ID NO: 292870 - RNA, 22 nt, Human
aacuguuggcuugcagguauga

SEQ ID NO: 292871 - RNA, 26 nt, Human
aagcuaaaaguagacaagagggaccc

SEQ ID NO: 292872 - RNA, 23 nt, Human
aagcugcucaaucucaaaacuuu

SEQ ID NO: 292873 - RNA, 19 nt, Human
aauccugcagagcugaagu

SEQ ID NO: 292874 - RNA, 30 nt, Human; identical to SEQ ID NO: 291891

SEQ ID NO: 292875 - RNA, 24 nt, Human
acauguguugguaacaaguuuuac

SEQ ID NO: 292876 - RNA, 21 nt, Human
accaccauuuucauuuauuag

SEQ ID NO: 292877 - RNA, 24 nt, Human
acccgcgguagccacacauaccca

SEQ ID NO: 292878 - RNA, 21 nt, Human
acuaaaccaaagagaaggugu

SEQ ID NO: 292879 - RNA, 19 nt, Human
agaaaggaaacuugggucu

SEQ ID NO: 292880 - RNA, 22 nt, Human
agacaggauccccggagcacag

SEQ ID NO: 292881 - RNA, 19 nt, Human
agagagagagagaaagaga

SEQ ID NO: 292882 - RNA, 19 nt, Human
agaggguggcugccaccuc

SEQ ID NO: 292883 - RNA, 21 nt, Human
agccaauaucuggcacucgca

SEQ ID NO: 292884 - RNA, 23 nt, Human
agccagaguggagagaaagaguu

SEQ ID NO: 292885 - RNA, 18 nt, Human
agcuuuuacgacaaaacc

SEQ ID NO: 292886 - RNA, 18 nt, Human
aggagaaaggaaacuugg

SEQ ID NO: 292887 - RNA, 23 nt, Human
aguuacacacccuucaaaauaug

SEQ ID NO: 292888 - RNA, 21 nt, Human
auaaaucuaugaaacaacaaa

SEQ ID NO: 292889 - RNA, 21 nt, Human
auaccauuagaauuucaaagc

SEQ ID NO: 292890 - RNA, 21 nt, Human
augcaagaggcagccccagag

SEQ ID NO: 292891 - RNA, 18 nt, Human
auggaauuacauucaaca

SEQ ID NO: 292892 - RNA, 20 nt, Human
caaaaggaaauauaauggaa

SEQ ID NO: 292893 - RNA, 22 nt, Human
caacaauaaagcuuaaaguuca

SEQ ID NO: 292894 - RNA, 23 nt, Human
caacagacuuuagggucuccuaa

SEQ ID NO: 292895 - RNA, 21 nt, Human
cacagaauuaguagauugaaa

SEQ ID NO: 292896 - RNA, 20 nt, Human
cacauacacaagcacagagu

SEQ ID NO: 292897 - RNA, 18 nt, Human
cacuguaugagaaaacaa

SEQ ID NO: 292898 - RNA, 24 nt, Human
cagauaccauuagaauuucaaagc

SEQ ID NO: 292899 - RNA, 22 nt, Human
caggauccccggagcacagggc

SEQ ID NO: 292900 - RNA, 18 nt, Human
caugcaagaggcagcccc

SEQ ID NO: 292901 - RNA, 19 nt, Human
ccacaaacucccaagcugc

SEQ ID NO: 292902 - RNA, 22 nt, Human
ccaguggccacaaacucccaag

SEQ ID NO: 292903 - RNA, 23 nt, Human
cccaagcugcucaaucucaaaac

SEQ ID NO: 292904 - RNA, 21 nt, Human
ccccaugcaauccugcagagc

SEQ ID NO: 292905 - RNA, 22 nt, Human
ccccaugcaauccugcagagcu

SEQ ID NO: 292906 - RNA, 19 nt, Human
cccuucaaaauaugggaga

SEQ ID NO: 292907 - RNA, 20 nt, Human
ccgcgguagccacacauacc

SEQ ID NO: 292908 - RNA, 19 nt, Human
cuaaaaguagacaagacag

SEQ ID NO: 292909 - RNA, 25 nt, Human
cuagcacaccaagacaagucacaga

SEQ ID NO: 292910 - RNA, 23 nt, Human
cuaugaaacaacaaacagcgaaa

SEQ ID NO: 292911 - RNA, 18 nt, Human
cucccaagcugcucaauc

SEQ ID NO: 292912 - RNA, 18 nt, Human
cugcagagcugaaguuac

SEQ ID NO: 292913 - RNA, 21 nt, Human
cuggaccauaaauaaaauucc

SEQ ID NO: 292914 - RNA, 18 nt, Human
cuuauuuaaggugacagc

SEQ ID NO: 292915 - RNA, 20 nt, Human
gaccugaaagaguaaagcug

SEQ ID NO: 292916 - RNA, 20 nt, Human
gagagagagagagaaagaga

SEQ ID NO: 292917 - RNA, 18 nt, Human
gcauacagcauacauaug

SEQ ID NO: 292918 - RNA, 20 nt, Human
gcuucuguuucccagggugg

SEQ ID NO: 292919 - RNA, 19 nt, Human
gggcugggaagccucuccu

SEQ ID NO: 292920 - RNA, 18 nt, Human
uaacagacuccuaccucu

SEQ ID NO: 292921 - RNA, 20 nt, Human
uaacaucauagguguuagua

SEQ ID NO: 292922 - RNA, 24 nt, Human
uaauaaauuagcccgauucuccuc

SEQ ID NO: 292923 - RNA, 27 nt, Human
uaauuaucaucauuaauaaauuagccc

SEQ ID NO: 292924 - RNA, 19 nt, Human
uacacaaaagcugauuaac

SEQ ID NO: 292925 - RNA, 23 nt, Human
uaccaauagcaccaauucaaaau

SEQ ID NO: 292926 - RNA, 21 nt, Human
uaccauuagaauuucaaagca

SEQ ID NO: 292927 - RNA, 25 nt, Human
uaccccaugcaauccugcagagcug

SEQ ID NO: 292928 - RNA, 19 nt, Human
uacgacaaaaccuguuaaa

SEQ ID NO: 292929 - RNA, 18 nt, Human
uacugugucuuucauaca

SEQ ID NO: 292930 - RNA, 23 nt, Human
uagaauuucaaagcauucugcaa

SEQ ID NO: 292931 - RNA, 24 nt, Human
uagaauuucaaagcauucugcaac

SEQ ID NO: 292932 - RNA, 26 nt, Human
uagcacaccaagacaagucacagaau

SEQ ID NO: 292933 - RNA, 20 nt, Human
uaguagauugaaaaaucugc

SEQ ID NO: 292934 - RNA, 23 nt, Human
uauuugucuuuguuuucuugccu

SEQ ID NO: 292935 - RNA, 22 nt, Human
uccacuuuuucacagguguaca

SEQ ID NO: 292936 - RNA, 22 nt, Human
ugaaacaacaaacagcgaaagg

SEQ ID NO: 292937 - RNA, 23 nt, Human
ugcaauccugcagagcugaaguu

SEQ ID NO: 292938 - RNA, 20 nt, Human
uggcuggaccauaaauaaaa

SEQ ID NO: 292939 - RNA, 20 nt, Human
uggcuugcagguaugaugca

SEQ ID NO: 292940 - RNA, 23 nt, Human
uguacagauacauuauaauuauc

SEQ ID NO: 292941 - RNA, 22 nt, Human
uuaaaaaaacacuacuccacuu

SEQ ID NO: 292942 - RNA, 19 nt, Human
uuaaaacacugaacuguug

SEQ ID NO: 292943 - RNA, 19 nt, Human
uuaacaaugguuaaaaaaa

SEQ ID NO: 292944 - RNA, 21 nt, Human
uucaaaaugaauccacaugac

SEQ ID NO: 292945 - RNA, 21 nt, Human
uucgcaaauguaaaaagugcu

SEQ ID NO: 292946 - RNA, 18 nt, Human
uuguauucauauuucucu

SEQ ID NO: 292947 - RNA, 22 nt, Human
uuuauuuaguaauacaugcaag

SEQ ID NO: 292948 - RNA, 22 nt, Human
uuuucauaaacauugugugcaa

SEQ ID NO: 292949 - RNA, 21 nt, Human
aaaaaauaaaaaagccuuggc

SEQ ID NO: 292950 - RNA, 25 nt, Human
aaaaggaaaacuaaaccaaagagaa

SEQ ID NO: 292951 - RNA, 20 nt, Human
aaaauaauagauacugaagg

SEQ ID NO: 292952 - RNA, 23 nt, Human
aaacucccaagcugcucaaucuc

SEQ ID NO: 292953 - RNA, 22 nt, Human
aacaauacaaguagacuaaaau

SEQ ID NO: 292954 - RNA, 24 nt, Human
aacaaucagauguucacagucucc

SEQ ID NO: 292955 - RNA, 19 nt, Human
aacacggugaaaccccauc

SEQ ID NO: 292956 - RNA, 20 nt, Human
aacacggugaaaccccaucu

SEQ ID NO: 292957 - RNA, 21 nt, Human
aacacggugaaaccccaucuc

SEQ ID NO: 292958 - RNA, 21 nt, Human
aacacggugaaaccccaucuc

SEQ ID NO: 292959 - RNA, 19 nt, Human
aacaugaugaaaccccauc

SEQ ID NO: 292960 - RNA, 20 nt, Human
aacaugaugaaaccccaucu

SEQ ID NO: 292961 - RNA, 21 nt, Human
aacaugaugaaaccccaucuc

SEQ ID NO: 292962 - RNA, 21 nt, Human
aacaugaugaaaccccaucuc

SEQ ID NO: 292963 - RNA, 21 nt, Human
aaccacauaacaaaaacucaa

SEQ ID NO: 292964 - RNA, 22 nt, Human
aacuguuggcuugcagguauga

SEQ ID NO: 292965 - RNA, 24 nt, Human
aagaacacauuuuaggccaggcgc

SEQ ID NO: 292966 - RNA, 22 nt, Human
aagacaaagucggcuccaaugu

SEQ ID NO: 292967 - RNA, 24 nt, Human
aagagaaauccaggaguugcaauc

SEQ ID NO: 292968 - RNA, 26 nt, Human
aagcuaaaaguagacaagagggaccc

SEQ ID NO: 292969 - RNA, 21 nt, Human
aauaaucagauaccugggucc

SEQ ID NO: 292970 - RNA, 24 nt, Human
aauauaggagcccagaaaucuacu

SEQ ID NO: 292971 - RNA, 22 nt, Human
aaucaucucaggugugcuuuaa

SEQ ID NO: 292972 - RNA, 19 nt, Human
aauccugcagagcugaagu

SEQ ID NO: 292973 - RNA, 22 nt, Human
aaugacaaaaaaaaaaaauaaa

SEQ ID NO: 292974 - RNA, 30 nt, Human; identical to SEQ ID NO: 291891

SEQ ID NO: 292975 - RNA, 20 nt, Human
aauugcuugaacccaggagg

SEQ ID NO: 292976 - RNA, 24 nt, Human
aauugcuugaacccaggaggcaga

SEQ ID NO: 292977 - RNA, 19 nt, Human
acaaaaaguagcaaccaac

SEQ ID NO: 292978 - RNA, 24 nt, Human
acagagcgagacucugacucaaaa

SEQ ID NO: 292979 - RNA, 18 nt, Human
acaguucacugcagccuc

SEQ ID NO: 292980 - RNA, 24 nt, Human
acauguguugguaacaaguuuuac

SEQ ID NO: 292981 - RNA, 22 nt, Human
accacauaacaaaaacucaaua

SEQ ID NO: 292982 - RNA, 21 nt, Human
accaccauuuucauuuauuag

SEQ ID NO: 292983 - RNA, 22 nt, Human
accacugcacuccagccugggc

SEQ ID NO: 292984 - RNA, 24 nt, Human
accccaucucuacuaaaaauacaa

SEQ ID NO: 292985 - RNA, 24 nt, Human
accccaucucuacuaaaaauacaa

SEQ ID NO: 292986 - RNA, 24 nt, Human
acccgcgguagccacacauaccca

SEQ ID NO: 292987 - RNA, 21 nt, Human
acuaaaccaaagagaaggugu

SEQ ID NO: 292988 - RNA, 24 nt, Human
acugcacuccagccugggcaacag

SEQ ID NO: 292989 - RNA, 24 nt, Human
acugcacuccagccugggcaacag

SEQ ID NO: 292990 - RNA, 24 nt, Human
acuguacuccagccuggguggcag

SEQ ID NO: 292991 - RNA, 22 nt, Human
acuugaaaagagacauaggagg

SEQ ID NO: 292992 - RNA, 22 nt, Human
agaaaaauaaaaagacaaaaaa

SEQ ID NO: 292993 - RNA, 19 nt, Human
agaaaggaaacacuuguuu

SEQ ID NO: 292994 - RNA, 24 nt, Human
agaaaggaaacacuuguuuaaaaa

SEQ ID NO: 292995 - RNA, 19 nt, Human
agaaaggaaacuugggucu

SEQ ID NO: 292996 - RNA, 19 nt, Human
agaaucucccauauggcuc

SEQ ID NO: 292997 - RNA, 22 nt, Human
agacaggauccccggagcacag

SEQ ID NO: 292998 - RNA, 20 nt, Human
agacguugcagugagccaag

SEQ ID NO: 292999 - RNA, 22 nt, Human
agagagaacaucgcggcaaaga

SEQ ID NO: 293000 - RNA, 19 nt, Human
agagagagagagaaagaga

SEQ ID NO: 293001 - RNA, 20 nt, Human
agagauuaauaugaaggacu

SEQ ID NO: 293002 - RNA, 19 nt, Human
agaggguggcugccaccuc

SEQ ID NO: 293003 - RNA, 24 nt, Human
agcacuuugggaggccgagguggg

SEQ ID NO: 293004 - RNA, 21 nt, Human
agcauuuugggaggcugaggc

SEQ ID NO: 293005 - RNA, 24 nt, Human
agcauuuugggaggcugaggcggg

SEQ ID NO: 293006 - RNA, 21 nt, Human
agccaauaucuggcacucgca

SEQ ID NO: 293007 - RNA, 23 nt, Human
agccagaguggagagaaagaguu

SEQ ID NO: 293008 - RNA, 24 nt, Human
agccugggcaacagagcgagacuc

SEQ ID NO: 293009 - RNA, 24 nt, Human
agccuggguggcagaaaacgacuc

SEQ ID NO: 293010 - RNA, 24 nt, Human
agcgauucucucgccucagccucc

SEQ ID NO: 293011 - RNA, 23 nt, Human
agcugggcgcgguggcaugugcc

SEQ ID NO: 293012 - RNA, 18 nt, Human
agcuuuuacgacaaaacc

SEQ ID NO: 293013 - RNA, 28 nt, Human
aggaaucaacaaaaaguagccgguaccc

SEQ ID NO: 293014 - RNA, 19 nt, Human
aggagaaaggaaacuuggg

SEQ ID NO: 293015 - RNA, 24 nt, Human
aggcagacguugcagugagccaag

SEQ ID NO: 293016 - RNA, 23 nt, Human
aggcaggagaauugcuugaaccc

SEQ ID NO: 293017 - RNA, 24 nt, Human
aggcgcgguggcucacgccuguaa

SEQ ID NO: 293018 - RNA, 18 nt, Human
aggcgggaggaucaugag

SEQ ID NO: 293019 - RNA, 20 nt, Human
aggcgggaggaucaugaggu

SEQ ID NO: 293020 - RNA, 24 nt, Human
aggcgggaggaucaugaggucagg

SEQ ID NO: 293021 - RNA, 19 nt, Human
aggcugaggcaggagaaug

SEQ ID NO: 293022 - RNA, 21 nt, Human
aggcugaggcaggagaauugc

SEQ ID NO: 293023 - RNA, 24 nt, Human
aggcugaggcaggagaauugcuug

SEQ ID NO: 293024 - RNA, 20 nt, Human
aggcugaggcgggaggauca

SEQ ID NO: 293025 - RNA, 22 nt, Human
aggcugaggcgggaggaucaug

SEQ ID NO: 293026 - RNA, 24 nt, Human
agggggagcuuggagugagccaag

SEQ ID NO: 293027 - RNA, 24 nt, Human
aggugggagcaucacaaggucagg

SEQ ID NO: 293028 - RNA, 24 nt, Human
aguggcucacagcuuuaaucccag

SEQ ID NO: 293029 - RNA, 23 nt, Human
aguuacacacccuucaaaauaug

SEQ ID NO: 293030 - RNA, 21 nt, Human
auaaaucuaugaaacaacaaa

SEQ ID NO: 293031 - RNA, 21 nt, Human
auaccauuagaauuucaaagc

SEQ ID NO: 293032 - RNA, 19 nt, Human
auagcugaaagagaaagaa

SEQ ID NO: 293033 - RNA, 24 nt, Human
auauuucaugaauaaaaauuucac

SEQ ID NO: 293034 - RNA, 23 nt, Human
aucagaaauucaaugucacuuua

SEQ ID NO: 293035 - RNA, 24 nt, Human
aucaugccacuguacuccagccug

SEQ ID NO: 293036 - RNA, 19 nt, Human
augaaugacuaacaacuaa

SEQ ID NO: 293037 - RNA, 25 nt, Human
augacaaaaaaaaaaaauaaaaaag

SEQ ID NO: 293038 - RNA, 20 nt, Human
augacaucuguagcaucccu

SEQ ID NO: 293039 - RNA, 22 nt, Human
augccacuguacuccagccugg

SEQ ID NO: 293040 - RNA, 24 nt, Human
auggcaccacugcacuccagccug

SEQ ID NO: 293041 - RNA, 20 nt, Human
auuaccaaucccaucaauac

SEQ ID NO: 293042 - RNA, 23 nt, Human
auucuaacuugaauugaggaaug

SEQ ID NO: 293043 - RNA, 22 nt, Human
caaaauguugggauugcaggug

SEQ ID NO: 293044 - RNA, 26 nt, Human
caaagauacuugaaaguauaagacua

SEQ ID NO: 293045 - RNA, 19 nt, Human
caacaaaaaguagcaacca

SEQ ID NO: 293046 - RNA, 22 nt, Human
caacaauaaagcuuaaaguuca

SEQ ID NO: 293047 - RNA, 23 nt, Human
caacagacuuuagggucuccuaa

SEQ ID NO: 293048 - RNA, 21 nt, Human
cacagaauuaguagauugaaa

SEQ ID NO: 293049 - RNA, 23 nt, Human
cacagcccuucugagaauuugca

SEQ ID NO: 293050 - RNA, 24 nt, Human
cacagcuuuaaucccagcacuuug

SEQ ID NO: 293051 - RNA, 20 nt, Human
cacaguuauucugcaaaacu

SEQ ID NO: 293052 - RNA, 20 nt, Human
cacauacuacaauucaggaa

SEQ ID NO: 293053 - RNA, 24 nt, Human
caccacugcacuccagccugggca

SEQ ID NO: 293054 - RNA, 20 nt, Human
cacccccuuugcucucaaag

SEQ ID NO: 293055 - RNA, 24 nt, Human
cacgccuguaaucccagcauuuug

SEQ ID NO: 293056 - RNA, 23 nt, Human
cacuccagccugggcaacagagc

SEQ ID NO: 293057 - RNA, 24 nt, Human
cacuccagccugggcaacagagcg

SEQ ID NO: 293058 - RNA, 18 nt, Human
cacugcacuccagccugg

SEQ ID NO: 293059 - RNA, 19 nt, Human
cacugcacuccagccuggg

SEQ ID NO: 293060 - RNA, 21 nt, Human
cacugcacuccagccugggca

SEQ ID NO: 293061 - RNA, 23 nt, Human
cacugcacuccagccugggcaac

SEQ ID NO: 293062 - RNA, 24 nt, Human
cacugcacuccagccugggcaaca

SEQ ID NO: 293063 - RNA, 19 nt, Human
cacuguacuccagccuggg

SEQ ID NO: 293064 - RNA, 19 nt, Human
cacuguacuccagccuggg

SEQ ID NO: 293065 - RNA, 19 nt, Human
cacuguacuccagccuggg

SEQ ID NO: 293066 - RNA, 21 nt, Human
cacuguacuccagccugggug

SEQ ID NO: 293067 - RNA, 24 nt, Human
cacuguacuccagccuggguggca

SEQ ID NO: 293068 - RNA, 25 nt, Human
cacuguacuccagccuggguggcag

SEQ ID NO: 293069 - RNA, 18 nt, Human
cacuguaugagaaaacaa

SEQ ID NO: 293070 - RNA, 19 nt, Human
cagaacaagugaauucuca

SEQ ID NO: 293071 - RNA, 22 nt, Human
cagaaucuugcugucucccggg

SEQ ID NO: 293072 - RNA, 23 nt, Human
cagagagaacaucgcggcaaaga

SEQ ID NO: 293073 - RNA, 24 nt, Human
cagauaccauuagaauuucaaagc

SEQ ID NO: 293074 - RNA, 21 nt, Human
cagcacuuugggaggccgagg

SEQ ID NO: 293075 - RNA, 24 nt, Human
cagcacuuugggaggccgaggugg

SEQ ID NO: 293076 - RNA, 24 nt, Human
cagcauuuugggaggcugaggcgg

SEQ ID NO: 293077 - RNA, 24 nt, Human
cagccucaaugucccaggcucaag

SEQ ID NO: 293078 - RNA, 20 nt, Human
cagccuccugaguaauuggg

SEQ ID NO: 293079 - RNA, 24 nt, Human
cagcuacucaggaggcugaggcag

SEQ ID NO: 293080 - RNA, 24 nt, Human
cagcuacucgggaggcugaggcag

SEQ ID NO: 293081 - RNA, 23 nt, Human
caggagcucagagaccacucaag

SEQ ID NO: 293082 - RNA, 22 nt, Human
caggauccccggagcacagggc

SEQ ID NO: 293083 - RNA, 25 nt, Human
cauaacaaaaacucaauaagcgaag

SEQ ID NO: 293084 - RNA, 19 nt, Human
cauaaggguaauguuuuaa

SEQ ID NO: 293085 - RNA, 23 nt, Human
cauaaggguaauguuuuaaguua

SEQ ID NO: 293086 - RNA, 20 nt, Human
caucacaaggucaggaguuc

SEQ ID NO: 293087 - RNA, 22 nt, Human
caucacaaggucaggaguucga

SEQ ID NO: 293088 - RNA, 24 nt, Human
caucacaaggucaggaguucgaga

SEQ ID NO: 293089 - RNA, 18 nt, Human
caugcaagaggcagcccc

SEQ ID NO: 293090 - RNA, 22 nt, Human
caugguggcaggcgccuguagu

SEQ ID NO: 293091 - RNA, 21 nt, Human
ccaaaauguugggauugcagg

SEQ ID NO: 293092 - RNA, 24 nt, Human
ccaaaauguugggauugcaggugu

SEQ ID NO: 293093 - RNA, 20 nt, Human
ccacugcacuccagccuggg

SEQ ID NO: 293094 - RNA, 20 nt, Human
ccacugcacuccagccuggg

SEQ ID NO: 293095 - RNA, 21 nt, Human
ccacugcacuccagccugggc

SEQ ID NO: 293096 - RNA, 23 nt, Human
ccacugcacuccagccugggcaa

SEQ ID NO: 293097 - RNA, 24 nt, Human
ccacugcacuccagccugggcaac

SEQ ID NO: 293098 - RNA, 20 nt, Human
ccacuguacuccagccuggg

SEQ ID NO: 293099 - RNA, 20 nt, Human
ccacuguacuccagccuggg

SEQ ID NO: 293100 - RNA, 20 nt, Human
ccacuguacuccagccuggg

SEQ ID NO: 293101 - RNA, 21 nt, Human
ccacuguacuccagccugggu

SEQ ID NO: 293102 - RNA, 21 nt, Human
ccacuguacuccagccugggu

SEQ ID NO: 293103 - RNA, 22 nt, Human
ccacuguacuccagccugggug

SEQ ID NO: 293104 - RNA, 23 nt, Human
ccacuguacuccagccugggugg

SEQ ID NO: 293105 - RNA, 24 nt, Human
ccacuguacuccagccuggguggc

SEQ ID NO: 293106 - RNA, 22 nt, Human
ccaguggccacaaacucccaag

SEQ ID NO: 293107 - RNA, 23 nt, Human
cccaagcugcucaaucucaaaac

SEQ ID NO: 293108 - RNA, 20 nt, Human
cccaggcucaagcgauucuc

SEQ ID NO: 293109 - RNA, 21 nt, Human
ccccaugcaauccugcagagc

SEQ ID NO: 293110 - RNA, 22 nt, Human
ccccaugcaauccugcagagcu

SEQ ID NO: 293111 - RNA, 24 nt, Human
cccucccaccuuggccucccaaaa

SEQ ID NO: 293112 - RNA, 20 nt, Human
ccgcgguagccacacauacc

SEQ ID NO: 293113 - RNA, 21 nt, Human
ccuauaaucccagcuacucag

SEQ ID NO: 293114 - RNA, 22 nt, Human
ccuauaaucccagcuacucagg

SEQ ID NO: 293115 - RNA, 19 nt, Human
ccucccaccuuggccuccc

SEQ ID NO: 293116 - RNA, 24 nt, Human
ccugacuaacacggugaaacccca

SEQ ID NO: 293117 - RNA, 24 nt, Human
ccuggccaacaugaugaaacccca

SEQ ID NO: 293118 - RNA, 22 nt, Human
ccugggcaacagagcgagacuc

SEQ ID NO: 293119 - RNA, 22 nt, Human
ccuggguggcagaaaacgacuc

SEQ ID NO: 293120 - RNA, 21 nt, Human
ccuguagucccagcuacucgg

SEQ ID NO: 293121 - RNA, 18 nt, Human
ccuugaaccagaacauuc

SEQ ID NO: 293122 - RNA, 21 nt, Human
cgagaccaaccuggccaacau

SEQ ID NO: 293123 - RNA, 24 nt, Human
cgagaccauccugacuaacacggu

SEQ ID NO: 293124 - RNA, 23 nt, Human
cgagacucugacucaaaaaaaaa

SEQ ID NO: 293125 - RNA, 24 nt, Human
cgaggugggagcaucacaagguca

SEQ ID NO: 293126 - RNA, 24 nt, Human
cgccuguaaucccagcauuuuggg

SEQ ID NO: 293127 - RNA, 23 nt, Human
cgccuguagucccagcuacucgg

SEQ ID NO: 293128 - RNA, 24 nt, Human
cgccuguagucccagcuacucggg

SEQ ID NO: 293129 - RNA, 19 nt, Human
cuaaaaguagacaagacag

SEQ ID NO: 293130 - RNA, 21 nt, Human
cuaaaaguuuuguaugaccuu

SEQ ID NO: 293131 - RNA, 19 nt, Human
cuaaauugguuuucaagug

SEQ ID NO: 293132 - RNA, 25 nt, Human
cuagcacaccaagacaagucacaga

SEQ ID NO: 293133 - RNA, 23 nt, Human
cuaugaaacaacaaacagcgaaa

SEQ ID NO: 293134 - RNA, 22 nt, Human
cuaugcaucauuuagcaauaaa

SEQ ID NO: 293135 - RNA, 23 nt, Human
cucaaggaagggacccucccacc

SEQ ID NO: 293136 - RNA, 24 nt, Human
cucacagcuuuaaucccagcacuu

SEQ ID NO: 293137 - RNA, 21 nt, Human
cucacgccuguaaucccagca

SEQ ID NO: 293138 - RNA, 21 nt, Human
cucacgccuguaaucccagca

SEQ ID NO: 293139 - RNA, 19 nt, Human
cucauauccagauuucugc

SEQ ID NO: 293140 - RNA, 18 nt, Human
cucccaagcugcucaauc

SEQ ID NO: 293141 - RNA, 25 nt, Human
cucccgggcugaaaugcaguugugc

SEQ ID NO: 293142 - RNA, 21 nt, Human
cucugaauuucaaaagaacuc

SEQ ID NO: 293143 - RNA, 23 nt, Human
cucugacucaaaaaaaaaaauac

SEQ ID NO: 293144 - RNA, 24 nt, Human
cucuuucccaugggaaaagggcug

SEQ ID NO: 293145 - RNA, 23 nt, Human
cugacuaacacggugaaacccca

SEQ ID NO: 293146 - RNA, 18 nt, Human
cugcagagcugaaguuac

SEQ ID NO: 293147 - RNA, 23 nt, Human
cugcagccucaaugucccaggcu

SEQ ID NO: 293148 - RNA, 21 nt, Human
cuggaccauaaauaaaauucc

SEQ ID NO: 293149 - RNA, 18 nt, Human
cuuauuuaaggugacagc

SEQ ID NO: 293150 - RNA, 18 nt, Human
gaaaaacgugcaaagaca

SEQ ID NO: 293151 - RNA, 20 nt, Human
gaaaacucuccacuuaaguu

SEQ ID NO: 293152 - RNA, 23 nt, Human
gaacuguuggcuugcagguauga

SEQ ID NO: 293153 - RNA, 19 nt, Human
gaccauaggccccaauuug

SEQ ID NO: 293154 - RNA, 20 nt, Human
gaccugaaagaguaaagcug

SEQ ID NO: 293155 - RNA, 24 nt, Human
gagaaaaagauauuuuuaaaaaaa

SEQ ID NO: 293156 - RNA, 23 nt, Human
gagaauugcuugaacccaggagg

SEQ ID NO: 293157 - RNA, 20 nt, Human
gagagagagagagaaagaga

SEQ ID NO: 293158 - RNA, 23 nt, Human
gagcaucacaaggucaggaguuc

SEQ ID NO: 293159 - RNA, 20 nt, Human
gagugaaaaagaauugagcc

SEQ ID NO: 293160 - RNA, 24 nt, Human
gauauuuuuaaaaaaacagauuuc

SEQ ID NO: 293161 - RNA, 23 nt, Human
gaucccguuucucuugcuggagc

SEQ ID NO: 293162 - RNA, 25 nt, Human
gauucuaguguaagagaaauccagg

SEQ ID NO: 293163 - RNA, 19 nt, Human
gcaagaggcagccccagag

SEQ ID NO: 293164 - RNA, 27 nt, Human
gcacuaaagguagaguguggaaaacca

SEQ ID NO: 293165 - RNA, 24 nt, Human
gcacuccagccugggcaacagagc

SEQ ID NO: 293166 - RNA, 21 nt, Human
gcagaaaacgacuccgucuca

SEQ ID NO: 293167 - RNA, 22 nt, Human
gcaggagaauugcuugaaccca

SEQ ID NO: 293168 - RNA, 18 nt, Human
gcauacagcauacauaug

SEQ ID NO: 293169 - RNA, 22 nt, Human
gcaugugccuauaaucccagcu

SEQ ID NO: 293170 - RNA, 24 nt, Human
gccaacaugaugaaaccccaucuc

SEQ ID NO: 293171 - RNA, 20 nt, Human
gccacaaacucccaagcugc

SEQ ID NO: 293172 - RNA, 19 nt, Human
gccacuguacuccagccug

SEQ ID NO: 293173 - RNA, 24 nt, Human
gccacuguacuccagccugggugg

SEQ ID NO: 293174 - RNA, 25 nt, Human
gccucagccuccugaguaauuggga

SEQ ID NO: 293175 - RNA, 21 nt, Human
gccuuggcacaguggcucaca

SEQ ID NO: 293176 - RNA, 24 nt, Human
gcgauucucucgccucagccuccu

SEQ ID NO: 293177 - RNA, 21 nt, Human
gcgggcaugguggcaggcgcc

SEQ ID NO: 293178 - RNA, 22 nt, Human
gcugaggcaggagaauggcgug

SEQ ID NO: 293179 - RNA, 21 nt, Human
gcugcucaaucucaaaacuuu

SEQ ID NO: 293180 - RNA, 20 nt, Human
gcuucuguuucccagggugg

SEQ ID NO: 293181 - RNA, 21 nt, Human
ggaaaagggcuguauuugucu

SEQ ID NO: 293182 - RNA, 20 nt, Human
ggacuuaggugcugcuaaug

SEQ ID NO: 293183 - RNA, 23 nt, Human
ggagcaucacaaggucaggaguu

SEQ ID NO: 293184 - RNA, 21 nt, Human
ggaguucgagaccaaccuggc

SEQ ID NO: 293185 - RNA, 19 nt, Human
ggauugcaggugucaggcc

SEQ ID NO: 293186 - RNA, 18 nt, Human
ggcacaugaaacuugaaa

SEQ ID NO: 293187 - RNA, 24 nt, Human
ggcagaaaacgacuccgucucaga

SEQ ID NO: 293188 - RNA, 22 nt, Human
ggcaugguggcaggcgccugua

SEQ ID NO: 293189 - RNA, 23 nt, Human
ggcgggaggaucaugaggucagg

SEQ ID NO: 293190 - RNA, 21 nt, Human
ggcucacgccuguaaucccag

SEQ ID NO: 293191 - RNA, 20 nt, Human
gggagacaaaugacaucugu

SEQ ID NO: 293192 - RNA, 24 nt, Human
gggcgcgguggcaugugccuauaa

SEQ ID NO: 293193 - RNA, 19 nt, Human
gggcugggaagccucuccu

SEQ ID NO: 293194 - RNA, 24 nt, Human
gguggcaggcgccuguagucccag

SEQ ID NO: 293195 - RNA, 24 nt, Human
gguggcaugugccuauaaucccag

SEQ ID NO: 293196 - RNA, 23 nt, Human
gguggcucacgccuguaauccca

SEQ ID NO: 293197 - RNA, 24 nt, Human
gguggcucacgccuguaaucccag

SEQ ID NO: 293198 - RNA, 19 nt, Human
guacuccagccuggguggc

SEQ ID NO: 293199 - RNA, 25 nt, Human
gucccaggcucaagcgauucucucg

SEQ ID NO: 293200 - RNA, 19 nt, Human
uaaaaagcauuuucuccaa

SEQ ID NO: 293201 - RNA, 23 nt, Human
uaaaaguuuuguaugaccuugau

SEQ ID NO: 293202 - RNA, 21 nt, Human
uaaaauagcugaaagagaaag

SEQ ID NO: 293203 - RNA, 22 nt, Human
uaacacggugaaaccccaucuc

SEQ ID NO: 293204 - RNA, 24 nt, Human
uaacacggugaaaccccaucucua

SEQ ID NO: 293205 - RNA, 18 nt, Human
uaacagacuccuaccucu

SEQ ID NO: 293206 - RNA, 20 nt, Human
uaacaucauagguguuagua

SEQ ID NO: 293207 - RNA, 24 nt, Human
uaauaaauuagcccgauucuccuc

SEQ ID NO: 293208 - RNA, 18 nt, Human
uaaugaaugacuaacaac

SEQ ID NO: 293209 - RNA, 21 nt, Human
uaauggaauuacauucaacaa

SEQ ID NO: 293210 - RNA, 27 nt, Human
uaauuaucaucauuaauaaauuagccc

SEQ ID NO: 293211 - RNA, 18 nt, Human
uaauuugauuccuaaagu

SEQ ID NO: 293212 - RNA, 19 nt, Human
uacacaaaagcugauuaac

SEQ ID NO: 293213 - RNA, 23 nt, Human
uaccaauagcaccaauucaaaau

SEQ ID NO: 293214 - RNA, 21 nt, Human
uaccauuagaauuucaaagca

SEQ ID NO: 293215 - RNA, 25 nt, Human
uaccccaugcaauccugcagagcug

SEQ ID NO: 293216 - RNA, 19 nt, Human
uacgacaaaaccuguuaaa

SEQ ID NO: 293217 - RNA, 18 nt, Human
uacuccagccuggguggc

SEQ ID NO: 293218 - RNA, 20 nt, Human
uacuccagccuggguggcag

SEQ ID NO: 293219 - RNA, 18 nt, Human
uacugugucuuucauaca

SEQ ID NO: 293220 - RNA, 22 nt, Human
uagaaaacaaacaaauagcuug

SEQ ID NO: 293221 - RNA, 24 nt, Human
uagaagucaagacaaagucggcuc

SEQ ID NO: 293222 - RNA, 23 nt, Human
uagaauuucaaagcauucugcaa

SEQ ID NO: 293223 - RNA, 24 nt, Human
uagaauuucaaagcauucugcaac

SEQ ID NO: 293224 - RNA, 20 nt, Human
uagagaacuacaaacuuaac

SEQ ID NO: 293225 - RNA, 23 nt, Human
uagagaacuacaaacuuaacaag

SEQ ID NO: 293226 - RNA, 26 nt, Human
uagcacaccaagacaagucacagaau

SEQ ID NO: 293227 - RNA, 22 nt, Human
uagcugggcgcgguggcaugug

SEQ ID NO: 293228 - RNA, 20 nt, Human
uaggauucuaguguaagaga

SEQ ID NO: 293229 - RNA, 25 nt, Human
uaggcaaaauaggaaagugucucuu

SEQ ID NO: 293230 - RNA, 23 nt, Human
uagggcuauggaucuaaaauuuc

SEQ ID NO: 293231 - RNA, 20 nt, Human
uaguagauugaaaaaucugc

SEQ ID NO: 293232 - RNA, 24 nt, Human
uaucaaauagggcuauggaucuaa

SEQ ID NO: 293233 - RNA, 21 nt, Human
uauuaggcaaaauaggaaagu

SEQ ID NO: 293234 - RNA, 23 nt, Human
uauuugucuuuguuuucuugccu

SEQ ID NO: 293235 - RNA, 23 nt, Human
ucaaaagaacucgaaguuucgaa

SEQ ID NO: 293236 - RNA, 19 nt, Human
ucaacaaaaaguagcaacc

SEQ ID NO: 293237 - RNA, 24 nt, Human
ucaaugucacuuuaaucacaaauu

SEQ ID NO: 293238 - RNA, 18 nt, Human
ucacaaggucaggaguuc

SEQ ID NO: 293239 - RNA, 24 nt, Human
ucacaaggucaggaguucgagacc

SEQ ID NO: 293240 - RNA, 21 nt, Human
ucacgccuguaaucccagcau

SEQ ID NO: 293241 - RNA, 24 nt, Human
ucacugcagccucaaugucccagg

SEQ ID NO: 293242 - RNA, 18 nt, Human
ucaugaggucaggagauc

SEQ ID NO: 293243 - RNA, 24 nt, Human
ucaugaggucaggagaucgagacc

SEQ ID NO: 293244 - RNA, 23 nt, Human
ucaugccacuguacuccagccug

SEQ ID NO: 293245 - RNA, 22 nt, Human
ucauuuagcaauaaauaaauga

SEQ ID NO: 293246 - RNA, 22 nt, Human
uccacuuuuucacagguguaca

SEQ ID NO: 293247 - RNA, 23 nt, Human
uccagccugggcaacagagcgag

SEQ ID NO: 293248 - RNA, 24 nt, Human
uccagccugggcaacagagcgaga

SEQ ID NO: 293249 - RNA, 18 nt, Human
uccagccuggguggcaga

SEQ ID NO: 293250 - RNA, 23 nt, Human
ucccaaaauguugggauugcagg

SEQ ID NO: 293251 - RNA, 21 nt, Human
ucccaggcucaagcgauucuc

SEQ ID NO: 293252 - RNA, 21 nt, Human
ucccaggcucaagcgauucuc

SEQ ID NO: 293253 - RNA, 20 nt, Human
ucccaugggaaaagggcugu

SEQ ID NO: 293254 - RNA, 22 nt, Human
ucccauucugcuguguucgcca

SEQ ID NO: 293255 - RNA, 24 nt, Human
ucccucuauucacaucaaauaauc

SEQ ID NO: 293256 - RNA, 18 nt, Human
ucccugagaaaacucucc

SEQ ID NO: 293257 - RNA, 19 nt, Human
ucccugagaaaacucucca

SEQ ID NO: 293258 - RNA, 23 nt, Human
ucuccaauuucuguaaacugaau

SEQ ID NO: 293259 - RNA, 21 nt, Human
ucucuacuaaaaauacaaaaa

SEQ ID NO: 293260 - RNA, 22 nt, Human
ucucuacuaaaaauacaaaaaa

SEQ ID NO: 293261 - RNA, 19 nt, Human
ucucuagugaauauaggag

SEQ ID NO: 293262 - RNA, 19 nt, Human
ucuugcugucucccgggcu

SEQ ID NO: 293263 - RNA, 24 nt, Human
ugaaaaagaauugagccucuuucc

SEQ ID NO: 293264 - RNA, 22 nt, Human
ugaaacaacaaacagcgaaagg

SEQ ID NO: 293265 - RNA, 19 nt, Human
ugaaacagaagaucccguu

SEQ ID NO: 293266 - RNA, 21 nt, Human
ugaaacagaagaucccguuuc

SEQ ID NO: 293267 - RNA, 19 nt, Human
ugaaaccccaucucuacua

SEQ ID NO: 293268 - RNA, 19 nt, Human
ugaaaccccaucucuacua

SEQ ID NO: 293269 - RNA, 19 nt, Human
ugaaagaaaaugacaaaaa

SEQ ID NO: 293270 - RNA, 21 nt, Human
ugaaagagaaagaaaaauaua

SEQ ID NO: 293271 - RNA, 18 nt, Human
ugaaagucacauacuaca

SEQ ID NO: 293272 - RNA, 19 nt, Human
ugacacaauauuaaauaaa

SEQ ID NO: 293273 - RNA, 19 nt, Human
ugacugccucuaaaaguuu

SEQ ID NO: 293274 - RNA, 23 nt, Human
ugaggcaggagaauggcgugaac

SEQ ID NO: 293275 - RNA, 24 nt, Human
ugaggcaggagaauugcuugaacc

SEQ ID NO: 293276 - RNA, 25 nt, Human
ugaggcaggagaauugcuugaaccc

SEQ ID NO: 293277 - RNA, 21 nt, Human
ugaggcgggaggaucaugagg

SEQ ID NO: 293278 - RNA, 24 nt, Human
ugaggcgggaggaucaugagguca

SEQ ID NO: 293279 - RNA, 23 nt, Human
ugcaauccugcagagcugaaguu

SEQ ID NO: 293280 - RNA, 24 nt, Human
ugccuauaaucccagcuacucagg

SEQ ID NO: 293281 - RNA, 21 nt, Human
uggaaaaccaccauuuugaaa

SEQ ID NO: 293282 - RNA, 24 nt, Human
uggaaaaccaccauuuugaaaguc

SEQ ID NO: 293283 - RNA, 20 nt, Human
uggcaccacugcacuccagc

SEQ ID NO: 293284 - RNA, 18 nt, Human
uggcagcauagcaucaga

SEQ ID NO: 293285 - RNA, 22 nt, Human
uggcaugugccuauaaucccag

SEQ ID NO: 293286 - RNA, 18 nt, Human
uggcgugaacacgggagg

SEQ ID NO: 293287 - RNA, 24 nt, Human
uggcucacagcuuuaaucccagca

SEQ ID NO: 293288 - RNA, 24 nt, Human
uggcucacgccuguaaucccagca

SEQ ID NO: 293289 - RNA, 20 nt, Human
uggcuggaccauaaauaaaa

SEQ ID NO: 293290 - RNA, 20 nt, Human
uggcuugcagguaugaugca

SEQ ID NO: 293291 - RNA, 24 nt, Human
ugggacuagagaugugugccacca

SEQ ID NO: 293292 - RNA, 19 nt, Human
ugggaggccgaggugggag

SEQ ID NO: 293293 - RNA, 21 nt, Human
ugggaggccgaggugggagca

SEQ ID NO: 293294 - RNA, 19 nt, Human
ugggaggcugaggcgggag

SEQ ID NO: 293295 - RNA, 24 nt, Human
ugggaggcugaggcgggaggauca

SEQ ID NO: 293296 - RNA, 22 nt, Human
ugggauugcaggugucaggcca

SEQ ID NO: 293297 - RNA, 23 nt, Human
ugggugacaacuuaguuuuuccu

SEQ ID NO: 293298 - RNA, 24 nt, Human
ugguggcaggcgccuguaguccca

SEQ ID NO: 293299 - RNA, 23 nt, Human
uguacagauacauuauaauuauc

SEQ ID NO: 293300 - RNA, 24 nt, Human
ugucccaggcucaagcgauucucu

SEQ ID NO: 293301 - RNA, 27 nt, Human
ugucccaggcucaagcgauucucucgg

SEQ ID NO: 293302 - RNA, 18 nt, Human
uguucuaaguguagacaa

SEQ ID NO: 293303 - RNA, 22 nt, Human
uuaaaaaaacacuacuccacuu

SEQ ID NO: 293304 - RNA, 19 nt, Human
uuaaaacacugaacuguug

SEQ ID NO: 293305 - RNA, 19 nt, Human
uuaacaaugguuaaaaaaa

SEQ ID NO: 293306 - RNA, 20 nt, Human
uuacagcacccccuuugcuc

SEQ ID NO: 293307 - RNA, 19 nt, Human
uuagcugggcgcgguggca

SEQ ID NO: 293308 - RNA, 24 nt, Human
uuagcugggcgcgguggcaugugc

SEQ ID NO: 293309 - RNA, 24 nt, Human
uuaggccaggcgcgguggcucacg

SEQ ID NO: 293310 - RNA, 18 nt, Human
uuaggggaaguuucuuuc

SEQ ID NO: 293311 - RNA, 21 nt, Human
uucaaaaugaauccacaugac

SEQ ID NO: 293312 - RNA, 22 nt, Human
uucacauacacaagcacagagu

SEQ ID NO: 293313 - RNA, 24 nt, Human
uucagcacccaaaaaauaucuauu

SEQ ID NO: 293314 - RNA, 21 nt, Human
uucgcaaauguaaaaagugcu

SEQ ID NO: 293315 - RNA, 18 nt, Human
uugaaaagguauaaaauu

SEQ ID NO: 293316 - RNA, 19 nt, Human
uugaaccagaacauucaau

SEQ ID NO: 293317 - RNA, 18 nt, Human
uugcagugagccaagauc

SEQ ID NO: 293318 - RNA, 18 nt, Human
uugcuugaacccaggagg

SEQ ID NO: 293319 - RNA, 23 nt, Human
uuggcacaguggcucacagcuuu

SEQ ID NO: 293320 - RNA, 21 nt, Human
uugggaggccgaggugggagc

SEQ ID NO: 293321 - RNA, 25 nt, Human
uugggaggcugaggcgggaggauca

SEQ ID NO: 293322 - RNA, 24 nt, Human
uugugccaucacaguucacugcag

SEQ ID NO: 293323 - RNA, 22 nt, Human
uuuauuuaguaauacaugcaag

SEQ ID NO: 293324 - RNA, 21 nt, Human
uuucuccaauuucuguaaacu

SEQ ID NO: 293325 - RNA, 18 nt, Human
uuucucuugcuggagccu

SEQ ID NO: 293326 - RNA, 18 nt, Human
uuugcucuuacuacccau

SEQ ID NO: 293327 - RNA, 22 nt, Human
uuuucauaaacauugugugcaa

SEQ ID NO: 293328 - RNA, 23 nt, Human
uuuuuggcagagaugagucucac

SEQ ID NO: 293329 - RNA, 25 nt, Human
aaaaggaaaacuaaaccaaagagaa

SEQ ID NO: 293330 - RNA, 23 nt, Human
aaacucccaagcugcucaaucuc

SEQ ID NO: 293331 - RNA, 20 nt, Human
aacacgcuacaccaacggug

SEQ ID NO: 293332 - RNA, 22 nt, Human
aacuguuggcuugcagguauga

SEQ ID NO: 293333 - RNA, 26 nt, Human
aagcuaaaaguagacaagagggaccc

SEQ ID NO: 293334 - RNA, 22 nt, Human
aaguaaauguuucaccuuccau

SEQ ID NO: 293335 - RNA, 19 nt, Human
aauccugcagagcugaagu

SEQ ID NO: 293336 - RNA, 30 nt, Human; identical to SEQ ID NO: 291891

SEQ ID NO: 293337 - RNA, 24 nt, Human
acauguguugguaacaaguuuuac

SEQ ID NO: 293338 - RNA, 21 nt, Human
accaccauuuucauuuauuag

SEQ ID NO: 293339 - RNA, 24 nt, Human
acccgcgguagccacacauaccca

SEQ ID NO: 293340 - RNA, 21 nt, Human
acuaaaccaaagagaaggugu

SEQ ID NO: 293341 - RNA, 19 nt, Human
agaaaggaaacuugggucu

SEQ ID NO: 293342 - RNA, 22 nt, Human
agacaggauccccggagcacag

SEQ ID NO: 293343 - RNA, 19 nt, Human
agagagagagagaaagaga

SEQ ID NO: 293344 - RNA, 19 nt, Human
agaggguggcugccaccuc

SEQ ID NO: 293345 - RNA, 21 nt, Human
agccaauaucuggcacucgca

SEQ ID NO: 293346 - RNA, 23 nt, Human
agccagaguggagagaaagaguu

SEQ ID NO: 293347 - RNA, 18 nt, Human
agcuuuuacgacaaaacc

SEQ ID NO: 293348 - RNA, 19 nt, Human
aggaagugcuaagaaggag

SEQ ID NO: 293349 - RNA, 18 nt, Human
aggagaaaggaaacuugg

SEQ ID NO: 293350 - RNA, 19 nt, Human
aguaaauguuucaccuucc

SEQ ID NO: 293351 - RNA, 23 nt, Human
aguuacacacccuucaaaauaug

SEQ ID NO: 293352 - RNA, 21 nt, Human
auaaaucuaugaaacaacaaa

SEQ ID NO: 293353 - RNA, 21 nt, Human
auaccauuagaauuucaaagc

SEQ ID NO: 293354 - RNA, 19 nt, Human
auaguuuaaguaaauguuu

SEQ ID NO: 293355 - RNA, 22 nt, Human
caacaauaaagcuuaaaguuca

SEQ ID NO: 293356 - RNA, 23 nt, Human
caacagacuuuagggucuccuaa

SEQ ID NO: 293357 - RNA, 21 nt, Human
cacagaauuaguagauugaaa

SEQ ID NO: 293358 - RNA, 25 nt, Human
cacaggaagugcuaagaaggagugu

SEQ ID NO: 293359 - RNA, 20 nt, Human
caccaacggugacccaggac

SEQ ID NO: 293360 - RNA, 22 nt, Human
caccaacggugacccaggacca

SEQ ID NO: 293361 - RNA, 18 nt, Human
cacuguaugagaaaacaa

SEQ ID NO: 293362 - RNA, 24 nt, Human
cagauaccauuagaauuucaaagc

SEQ ID NO: 293363 - RNA, 19 nt, Human
cagccaucuccgggccaaa

SEQ ID NO: 293364 - RNA, 22 nt, Human
caggauccccggagcacagggc

SEQ ID NO: 293365 - RNA, 18 nt, Human
caugcaagaggcagcccc

SEQ ID NO: 293366 - RNA, 24 nt, Human
cauucuucacuuuaaauauuagag

SEQ ID NO: 293367 - RNA, 19 nt, Human
ccacaaacucccaagcugc

SEQ ID NO: 293368 - RNA, 22 nt, Human
ccaguggccacaaacucccaag

SEQ ID NO: 293369 - RNA, 23 nt, Human
cccaagcugcucaaucucaaaac

SEQ ID NO: 293370 - RNA, 21 nt, Human
ccccaugcaauccugcagagc

SEQ ID NO: 293371 - RNA, 22 nt, Human
ccccaugcaauccugcagagcu

SEQ ID NO: 293372 - RNA, 19 nt, Human
cccuucaaaauaugggaga

SEQ ID NO: 293373 - RNA, 20 nt, Human
ccgcgguagccacacauacc

SEQ ID NO: 293374 - RNA, 19 nt, Human
cuaaaaguagacaagacag

SEQ ID NO: 293375 - RNA, 20 nt, Human
cuaauacuucuauacuucca

SEQ ID NO: 293376 - RNA, 25 nt, Human
cuagcacaccaagacaagucacaga

SEQ ID NO: 293377 - RNA, 23 nt, Human
cuaugaaacaacaaacagcgaaa

SEQ ID NO: 293378 - RNA, 18 nt, Human
cucccaagcugcucaauc

SEQ ID NO: 293379 - RNA, 18 nt, Human
cugcagagcugaaguuac

SEQ ID NO: 293380 - RNA, 20 nt, Human
cugccggccgucacugcugc

SEQ ID NO: 293381 - RNA, 21 nt, Human
cuggaccauaaauaaaauucc

SEQ ID NO: 293382 - RNA, 18 nt, Human
cuuauuuaaggugacagc

SEQ ID NO: 293383 - RNA, 20 nt, Human
gaccugaaagaguaaagcug

SEQ ID NO: 293384 - RNA, 20 nt, Human
gagagagagagagaaagaga

SEQ ID NO: 293385 - RNA, 19 nt, Human
gcaagaggcagccccagag

SEQ ID NO: 293386 - RNA, 18 nt, Human
gcauacagcauacauaug

SEQ ID NO: 293387 - RNA, 21 nt, Human
gcugcucaaucucaaaacuuu

SEQ ID NO: 293388 - RNA, 20 nt, Human
gcuucuguuucccagggugg

SEQ ID NO: 293389 - RNA, 20 nt, Human
ggaagugcuaagaaggagug

SEQ ID NO: 293390 - RNA, 23 nt, Human
ggcacaggaagugcuaagaagga

SEQ ID NO: 293391 - RNA, 21 nt, Human
gggcugggaagccucuccuuu

SEQ ID NO: 293392 - RNA, 23 nt, Human
gugguuaucgucaucuuuuaaua

SEQ ID NO: 293393 - RNA, 18 nt, Human
uaacagacuccuaccucu

SEQ ID NO: 293394 - RNA, 20 nt, Human
uaacaucauagguguuagua

SEQ ID NO: 293395 - RNA, 24 nt, Human
uaauaaauuagcccgauucuccuc

SEQ ID NO: 293396 - RNA, 21 nt, Human
uaauggaauuacauucaacaa

SEQ ID NO: 293397 - RNA, 27 nt, Human
uaauuaucaucauuaauaaauuagccc

SEQ ID NO: 293398 - RNA, 23 nt, Human
uaauuuauuuuuacaucuuuugu

SEQ ID NO: 293399 - RNA, 19 nt, Human
uacacaaaagcugauuaac

SEQ ID NO: 293400 - RNA, 23 nt, Human
uaccaauagcaccaauucaaaau

SEQ ID NO: 293401 - RNA, 21 nt, Human
uaccauuagaauuucaaagca

SEQ ID NO: 293402 - RNA, 25 nt, Human
uaccccaugcaauccugcagagcug

SEQ ID NO: 293403 - RNA, 19 nt, Human
uacgacaaaaccuguuaaa

SEQ ID NO: 293404 - RNA, 19 nt, Human
uacucagcgaccgccgacc

SEQ ID NO: 293405 - RNA, 18 nt, Human
uacugugucuuucauaca

SEQ ID NO: 293406 - RNA, 23 nt, Human
uagaauuucaaagcauucugcaa

SEQ ID NO: 293407 - RNA, 24 nt, Human
uagaauuucaaagcauucugcaac

SEQ ID NO: 293408 - RNA, 26 nt, Human
uagcacaccaagacaagucacagaau

SEQ ID NO: 293409 - RNA, 20 nt, Human
uaguagauugaaaaaucugc

SEQ ID NO: 293410 - RNA, 23 nt, Human
uauuugucuuuguuuucuugccu

SEQ ID NO: 293411 - RNA, 22 nt, Human
uccacuuuuucacagguguaca

SEQ ID NO: 293412 - RNA, 28 nt, Human
ucuuuugugguuaucgucaucuuuuaau

SEQ ID NO: 293413 - RNA, 22 nt, Human
ugaaacaacaaacagcgaaagg

SEQ ID NO: 293414 - RNA, 21 nt, Human
ugacccaggaccaugcuccgg

SEQ ID NO: 293415 - RNA, 23 nt, Human
ugcaauccugcagagcugaaguu

SEQ ID NO: 293416 - RNA, 22 nt, Human
ugcauugcaauaguuuaaguaa

SEQ ID NO: 293417 - RNA, 22 nt, Human
ugcuuauaaaauauuuugguau

SEQ ID NO: 293418 - RNA, 21 nt, Human
uggcacaggaagugcuaagaa

SEQ ID NO: 293419 - RNA, 22 nt, Human
uggcuggaccauaaauaaaauu

SEQ ID NO: 293420 - RNA, 20 nt, Human
uggcuugcagguaugaugca

SEQ ID NO: 293421 - RNA, 23 nt, Human
uguacagauacauuauaauuauc

SEQ ID NO: 293422 - RNA, 22 nt, Human
uuaaaaaaacacuacuccacuu

SEQ ID NO: 293423 - RNA, 19 nt, Human
uuaaaacacugaacuguug

SEQ ID NO: 293424 - RNA, 19 nt, Human
uuaacaaugguuaaaaaaa

SEQ ID NO: 293425 - RNA, 21 nt, Human
uucaaaaugaauccacaugac

SEQ ID NO: 293426 - RNA, 19 nt, Human
uucaauugaugaaauguug

SEQ ID NO: 293427 - RNA, 22 nt, Human
uucacauacacaagcacagagu

SEQ ID NO: 293428 - RNA, 21 nt, Human
uucgcaaauguaaaaagugcu

SEQ ID NO: 293429 - RNA, 22 nt, Human
uuuauuuaguaauacaugcaag

SEQ ID NO: 293430 - RNA, 20 nt, Human
uuuuagaccuuuaugucaua

SEQ ID NO: 293431 - RNA, 22 nt, Human
uuuucauaaacauugugugcaa

SEQ ID NO: 293432 - RNA, 25 nt, Human
aaaaggaaaacuaaaccaaagagaa

SEQ ID NO: 293433 - RNA, 23 nt, Human
aaacucccaagcugcucaaucuc

SEQ ID NO: 293434 - RNA, 22 nt, Human
aacuguuggcuugcagguauga

SEQ ID NO: 293435 - RNA, 26 nt, Human
aagcuaaaaguagacaagagggaccc

SEQ ID NO: 293436 - RNA, 23 nt, Human
aagcugcucaaucucaaaacuuu

SEQ ID NO: 293437 - RNA, 19 nt, Human
aauccugcagagcugaagu

SEQ ID NO: 293438 - RNA, 30 nt, Human; identical to SEQ ID NO: 291891

SEQ ID NO: 293439 - RNA, 24 nt, Human
acauguguugguaacaaguuuuac

SEQ ID NO: 293440 - RNA, 21 nt, Human
accaccauuuucauuuauuag

SEQ ID NO: 293441 - RNA, 24 nt, Human
acccgcgguagccacacauaccca

SEQ ID NO: 293442 - RNA, 21 nt, Human
acuaaaccaaagagaaggugu

SEQ ID NO: 293443 - RNA, 19 nt, Human
agaaaggaaacuugggucu

SEQ ID NO: 293444 - RNA, 22 nt, Human
agacaggauccccggagcacag

SEQ ID NO: 293445 - RNA, 19 nt, Human
agagagagagagaaagaga

SEQ ID NO: 293446 - RNA, 19 nt, Human
agaggguggcugccaccuc

SEQ ID NO: 293447 - RNA, 21 nt, Human
agccaauaucuggcacucgca

SEQ ID NO: 293448 - RNA, 23 nt, Human
agccagaguggagagaaagaguu

SEQ ID NO: 293449 - RNA, 18 nt, Human
agcuuuuacgacaaaacc

SEQ ID NO: 293450 - RNA, 19 nt, Human
aggagaaaggaaacuuggg

SEQ ID NO: 293451 - RNA, 23 nt, Human
aguuacacacccuucaaaauaug

SEQ ID NO: 293452 - RNA, 21 nt, Human
auaaaucuaugaaacaacaaa

SEQ ID NO: 293453 - RNA, 21 nt, Human
auaccauuagaauuucaaagc

SEQ ID NO: 293454 - RNA, 21 nt, Human
augcaagaggcagccccagag

SEQ ID NO: 293455 - RNA, 20 nt, Human
caaaaggaaauauaauggaa

SEQ ID NO: 293456 - RNA, 22 nt, Human
caacaauaaagcuuaaaguuca

SEQ ID NO: 293457 - RNA, 23 nt, Human
caacagacuuuagggucuccuaa

SEQ ID NO: 293458 - RNA, 21 nt, Human
cacagaauuaguagauugaaa

SEQ ID NO: 293459 - RNA, 18 nt, Human
cacuguaugagaaaacaa

SEQ ID NO: 293460 - RNA, 24 nt, Human
cagauaccauuagaauuucaaagc

SEQ ID NO: 293461 - RNA, 22 nt, Human
caggauccccggagcacagggc

SEQ ID NO: 293462 - RNA, 22 nt, Human
cauagcauacagcauacauaug

SEQ ID NO: 293463 - RNA, 18 nt, Human
caugcaagaggcagcccc

SEQ ID NO: 293464 - RNA, 22 nt, Human
ccaguggccacaaacucccaag

SEQ ID NO: 293465 - RNA, 23 nt, Human
cccaagcugcucaaucucaaaac

SEQ ID NO: 293466 - RNA, 21 nt, Human
ccccaugcaauccugcagagc

SEQ ID NO: 293467 - RNA, 21 nt, Human
ccccaugcaauccugcagagc

SEQ ID NO: 293468 - RNA, 19 nt, Human
cccuucaaaauaugggaga

SEQ ID NO: 293469 - RNA, 20 nt, Human
ccgcgguagccacacauacc

SEQ ID NO: 293470 - RNA, 19 nt, Human
cuaaaaguagacaagacag

SEQ ID NO: 293471 - RNA, 25 nt, Human
cuagcacaccaagacaagucacaga

SEQ ID NO: 293472 - RNA, 23 nt, Human
cuaugaaacaacaaacagcgaaa

SEQ ID NO: 293473 - RNA, 18 nt, Human
cucccaagcugcucaauc

SEQ ID NO: 293474 - RNA, 18 nt, Human
cugcagagcugaaguuac

SEQ ID NO: 293475 - RNA, 21 nt, Human
cuggaccauaaauaaaauucc

SEQ ID NO: 293476 - RNA, 18 nt, Human
cuuauuuaaggugacagc

SEQ ID NO: 293477 - RNA, 20 nt, Human
gaccugaaagaguaaagcug

SEQ ID NO: 293478 - RNA, 20 nt, Human
gagagagagagagaaagaga

SEQ ID NO: 293479 - RNA, 20 nt, Human
gccacaaacucccaagcugc

SEQ ID NO: 293480 - RNA, 20 nt, Human
gcuucuguuucccagggugg

SEQ ID NO: 293481 - RNA, 21 nt, Human
gggcugggaagccucuccuuu

SEQ ID NO: 293482 - RNA, 18 nt, Human
uaacagacuccuaccucu

SEQ ID NO: 293483 - RNA, 20 nt, Human
uaacaucauagguguuagua

SEQ ID NO: 293484 - RNA, 21 nt, Human
uaauaaauuagcccgauucuc

SEQ ID NO: 293485 - RNA, 21 nt, Human
uaauggaauuacauucaacaa

SEQ ID NO: 293486 - RNA, 27 nt, Human
uaauuaucaucauuaauaaauuagccc

SEQ ID NO: 293487 - RNA, 19 nt, Human
uacacaaaagcugauuaac

SEQ ID NO: 293488 - RNA, 23 nt, Human
uaccaauagcaccaauucaaaau

SEQ ID NO: 293489 - RNA, 21 nt, Human
uaccauuagaauuucaaagca

SEQ ID NO: 293490 - RNA, 25 nt, Human
uaccccaugcaauccugcagagcug

SEQ ID NO: 293491 - RNA, 19 nt, Human
uacgacaaaaccuguuaaa

SEQ ID NO: 293492 - RNA, 18 nt, Human
uacugugucuuucauaca

SEQ ID NO: 293493 - RNA, 23 nt, Human
uagaauuucaaagcauucugcaa

SEQ ID NO: 293494 - RNA, 24 nt, Human
uagaauuucaaagcauucugcaac

SEQ ID NO: 293495 - RNA, 26 nt, Human
uagcacaccaagacaagucacagaau

SEQ ID NO: 293496 - RNA, 20 nt, Human
uaguagauugaaaaaucugc

SEQ ID NO: 293497 - RNA, 23 nt, Human
uauuugucuuuguuuucuugccu

SEQ ID NO: 293498 - RNA, 22 nt, Human
uccacuuuuucacagguguaca

SEQ ID NO: 293499 - RNA, 22 nt, Human
ugaaacaacaaacagcgaaagg

SEQ ID NO: 293500 - RNA, 23 nt, Human
ugcaauccugcagagcugaaguu

SEQ ID NO: 293501 - RNA, 22 nt, Human
uggcuggaccauaaauaaaauu

SEQ ID NO: 293502 - RNA, 20 nt, Human
uggcuugcagguaugaugca

SEQ ID NO: 293503 - RNA, 23 nt, Human
uguacagauacauuauaauuauc

SEQ ID NO: 293504 - RNA, 22 nt, Human
uuaaaaaaacacuacuccacuu

SEQ ID NO: 293505 - RNA, 19 nt, Human
uuaaaacacugaacuguug

SEQ ID NO: 293506 - RNA, 19 nt, Human
uuaacaaugguuaaaaaaa

SEQ ID NO: 293507 - RNA, 21 nt, Human
uucaaaaugaauccacaugac

SEQ ID NO: 293508 - RNA, 22 nt, Human
uucacauacacaagcacagagu

SEQ ID NO: 293509 - RNA, 21 nt, Human
uucgcaaauguaaaaagugcu

SEQ ID NO: 293510 - RNA, 18 nt, Human
uuguauucauauuucucu

SEQ ID NO: 293511 - RNA, 22 nt, Human
uuuauuuaguaauacaugcaag

SEQ ID NO: 293512 - RNA, 22 nt, Human
uuuucauaaacauugugugcaa

SEQ ID NO: 293513 - RNA, 23 nt, Human
ucagagccaacuguugcggauau

SEQ ID NO: 293514 - RNA, 22 nt, Human
ucugcaaucagagccaacuguu

SEQ ID NO: 293515 - RNA, 24 nt, Human
ucugcaaucagagccaacuguugc

SEQ ID NO: 293516 - RNA, 24 nt, Human
aaaaaaaaaaaaaauuuagccgag

SEQ ID NO: 293517 - RNA, 21 nt, Human
aaaaaaaagaaaagaaaagaa

SEQ ID NO: 293518 - RNA, 20 nt, Human
aaaaaaggccgggcgcagug

SEQ ID NO: 293519 - RNA, 18 nt, Human
aaaagaaaaaaaaaaggc

SEQ ID NO: 293520 - RNA, 24 nt, Human
aaaggccgggcgcaguggcucaca

SEQ ID NO: 293521 - RNA, 24 nt, Human
aaauauggugacgauccgucucua

SEQ ID NO: 293522 - RNA, 20 nt, Human
aacguggugaaaccccgucu

SEQ ID NO: 293523 - RNA, 21 nt, Human
aacguggugaaaccccgucuc

SEQ ID NO: 293524 - RNA, 18 nt, Human
aagaaauauggugacgau

SEQ ID NO: 293525 - RNA, 20 nt, Human
aagacuaaauaauauugaua

SEQ ID NO: 293526 - RNA, 18 nt, Human
aauugcuugaacccgaga

SEQ ID NO: 293527 - RNA, 24 nt, Human
aauugcuugaacccgagaggcgga

SEQ ID NO: 293528 - RNA, 24 nt, Human
acagaaugagacucggucucaaaa

SEQ ID NO: 293529 - RNA, 19 nt, Human
agaaaagaaaaaaaaaagg

SEQ ID NO: 293530 - RNA, 19 nt, Human
agaaguuaaaggccagccu

SEQ ID NO: 293531 - RNA, 18 nt, Human
agagguugcagugagcug

SEQ ID NO: 293532 - RNA, 22 nt, Human
agagguugcagugagcugagau

SEQ ID NO: 293533 - RNA, 23 nt, Human
agagguugcagugagcugagauc

SEQ ID NO: 293534 - RNA, 20 nt, Human
agagguugcagugagcuggc

SEQ ID NO: 293535 - RNA, 22 nt, Human
agcacuuugggaggcugagggg

SEQ ID NO: 293536 - RNA, 24 nt, Human
agccagggcgacagaaugagacuc

SEQ ID NO: 293537 - RNA, 23 nt, Human
agccgagcgugguggugggcgcc

SEQ ID NO: 293538 - RNA, 23 nt, Human
agccgggcaugguggcgcacgcc

SEQ ID NO: 293539 - RNA, 23 nt, Human
agcgugguggugggcgccuguaa

SEQ ID NO: 293540 - RNA, 23 nt, Human
agcuacuuggaggcggagguggg

SEQ ID NO: 293541 - RNA, 20 nt, Human
aggcagagguugcagugagc

SEQ ID NO: 293542 - RNA, 24 nt, Human
aggcagagguugcagugagcugag

SEQ ID NO: 293543 - RNA, 24 nt, Human
aggccuggccgccuguaaucccag

SEQ ID NO: 293544 - RNA, 20 nt, Human
aggcggagggugcagugagc

SEQ ID NO: 293545 - RNA, 24 nt, Human
aggcggagggugcagugagcugag

SEQ ID NO: 293546 - RNA, 18 nt, Human
aggcugaggggagugcau

SEQ ID NO: 293547 - RNA, 23 nt, Human
aggcugaggggagugcaucucuu

SEQ ID NO: 293548 - RNA, 24 nt, Human
aggcugaugcaggagaauugcuug

SEQ ID NO: 293549 - RNA, 20 nt, Human
agucugggugacuaagacuc

SEQ ID NO: 293550 - RNA, 21 nt, Human
agugcaucucuugagcucaga

SEQ ID NO: 293551 - RNA, 24 nt, Human
aguggcucacaccgguaaucacag

SEQ ID NO: 293552 - RNA, 20 nt, Human
aucacaccauugcacuccag

SEQ ID NO: 293553 - RNA, 18 nt, Human
augcaggagaauugcuug

SEQ ID NO: 293554 - RNA, 24 nt, Human
augcaggagaauugcuugaacccg

SEQ ID NO: 293555 - RNA, 24 nt, Human
auugcacuccagccagggcgacag

SEQ ID NO: 293556 - RNA, 24 nt, Human
caacguggugaaaccccgucucua

SEQ ID NO: 293557 - RNA, 24 nt, Human
cacaccgguaaucacagcacuuug

SEQ ID NO: 293558 - RNA, 26 nt, Human
caccauugcacuccagccagggcgac

SEQ ID NO: 293559 - RNA, 23 nt, Human
cacgccuguagucccagcuacuu

SEQ ID NO: 293560 - RNA, 22 nt, Human
cagcacuuugggaggccguggc

SEQ ID NO: 293561 - RNA, 24 nt, Human
cagcacuuugggaggccguggcgg

SEQ ID NO: 293562 - RNA, 22 nt, Human
cagcacuuugggaggcugaggg

SEQ ID NO: 293563 - RNA, 20 nt, Human
cagugagcugagauccugcc

SEQ ID NO: 293564 - RNA, 18 nt, Human
cauugcacuccagccagg

SEQ ID NO: 293565 - RNA, 19 nt, Human
cauugcacuccagccaggg

SEQ ID NO: 293566 - RNA, 21 nt, Human
cauugcacuccagccagggcg

SEQ ID NO: 293567 - RNA, 24 nt, Human
cauugcacuccagccagggcgaca

SEQ ID NO: 293568 - RNA, 24 nt, Human
ccacugaccucuagucugggugac

SEQ ID NO: 293569 - RNA, 19 nt, Human
ccauugcacuccagccagg

SEQ ID NO: 293570 - RNA, 20 nt, Human
ccauugcacuccagccaggg

SEQ ID NO: 293571 - RNA, 21 nt, Human
ccauugcacuccagccagggc

SEQ ID NO: 293572 - RNA, 23 nt, Human
ccauugcacuccagccagggcga

SEQ ID NO: 293573 - RNA, 24 nt, Human
ccauugcacuccagccagggcgac

SEQ ID NO: 293574 - RNA, 25 nt, Human
ccauugcacuccagccagggcgaca

SEQ ID NO: 293575 - RNA, 23 nt, Human
cccggccaacguggugaaacccc

SEQ ID NO: 293576 - RNA, 24 nt, Human
cccggccaacguggugaaaccccg

SEQ ID NO: 293577 - RNA, 24 nt, Human
ccgguaaucacagcacuuugggag

SEQ ID NO: 293578 - RNA, 24 nt, Human
ccgucucuacuaaagauaaaaaaa

SEQ ID NO: 293579 - RNA, 20 nt, Human
ccuguaaucccagcacuuug

SEQ ID NO: 293580 - RNA, 22 nt, Human
ccuguaaucccagcacuuuggg

SEQ ID NO: 293581 - RNA, 22 nt, Human
ccuguaaugccagcuacucggg

SEQ ID NO: 293582 - RNA, 21 nt, Human
ccuguagucccagcuacuugg

SEQ ID NO: 293583 - RNA, 20 nt, Human
cgccuguaaucccagcacuu

SEQ ID NO: 293584 - RNA, 23 nt, Human
cgccuguaaugccagcuacucgg

SEQ ID NO: 293585 - RNA, 23 nt, Human
cgccuguagucccagcuacuugg

SEQ ID NO: 293586 - RNA, 19 nt, Human
cggaggugggcuggucucu

SEQ ID NO: 293587 - RNA, 24 nt, Human
cggccaacguggugaaaccccguc

SEQ ID NO: 293588 - RNA, 22 nt, Human
cggguggaacaugaggucaaga

SEQ ID NO: 293589 - RNA, 20 nt, Human
cggucucaaaaaaaaaaaaa

SEQ ID NO: 293590 - RNA, 22 nt, Human
cuaaagauaaaaaaaaaaaaaa

SEQ ID NO: 293591 - RNA, 18 nt, Human
cucaaaaaaaaaaaaaaa

SEQ ID NO: 293592 - RNA, 24 nt, Human
cucggucucaaaaaaaaaaaaaaa

SEQ ID NO: 293593 - RNA, 20 nt, Human
cucuacaaaaaauacaagaa

SEQ ID NO: 293594 - RNA, 21 nt, Human
cugaccucuagucugggugac

SEQ ID NO: 293595 - RNA, 21 nt, Human
gaacccgagaggcggagggug

SEQ ID NO: 293596 - RNA, 24 nt, Human
gagaaaagaaaaaauuaaaaauac

SEQ ID NO: 293597 - RNA, 23 nt, Human
gagaucacaccauugcacuccag

SEQ ID NO: 293598 - RNA, 22 nt, Human
gagggugcagugagcugagauc

SEQ ID NO: 293599 - RNA, 18 nt, Human
gauaugcaauacuugaaa

SEQ ID NO: 293600 - RNA, 24 nt, Human
gaugcaggagaauugcuugaaccc

SEQ ID NO: 293601 - RNA, 22 nt, Human
gcaggagaauugcuugaacccg

SEQ ID NO: 293602 - RNA, 24 nt, Human
gccaacguggugaaaccccgucuc

SEQ ID NO: 293603 - RNA, 24 nt, Human
gcccaggaggcagagguugcagug

SEQ ID NO: 293604 - RNA, 23 nt, Human
gcccggccaacguggugaaaccc

SEQ ID NO: 293605 - RNA, 23 nt, Human
gccuguaaugccagcuacucggg

SEQ ID NO: 293606 - RNA, 19 nt, Human
gccuguagucccagcuacu

SEQ ID NO: 293607 - RNA, 22 nt, Human
ggaggcagagguugcagugagc

SEQ ID NO: 293608 - RNA, 18 nt, Human
ggagggugcagugagcug

SEQ ID NO: 293609 - RNA, 23 nt, Human
ggagggugcagugagcugagauc

SEQ ID NO: 293610 - RNA, 24 nt, Human
ggagggugcagugagcugagauca

SEQ ID NO: 293611 - RNA, 18 nt, Human
ggcgcaguggcucacacc

SEQ ID NO: 293612 - RNA, 21 nt, Human
ggcggguggaacaugagguca

SEQ ID NO: 293613 - RNA, 24 nt, Human
gggcaugguggcgcacgccuguag

SEQ ID NO: 293614 - RNA, 23 nt, Human
ggggagaaaagaaaaaauuaaaa

SEQ ID NO: 293615 - RNA, 23 nt, Human
gguggaacaugaggucaagaguu

SEQ ID NO: 293616 - RNA, 24 nt, Human
gguggcgcacgccuguagucccag

SEQ ID NO: 293617 - RNA, 20 nt, Human
gugcagugagcugagaucac

SEQ ID NO: 293618 - RNA, 24 nt, Human
guugcagugagcugagauccugcc

SEQ ID NO: 293619 - RNA, 22 nt, Human
uaaaaaaguacaugcaaaugua

SEQ ID NO: 293620 - RNA, 24 nt, Human
uaauauaaaaaggauuuacaaugu

SEQ ID NO: 293621 - RNA, 19 nt, Human
uacaaaaaauacaagaagu

SEQ ID NO: 293622 - RNA, 21 nt, Human
uacauaaaacuaaaaaaguac

SEQ ID NO: 293623 - RNA, 18 nt, Human
uacuuggaggcggaggug

SEQ ID NO: 293624 - RNA, 18 nt, Human
uaucaaaaaaaagaaaag

SEQ ID NO: 293625 - RNA, 20 nt, Human
uaucaaaaaaaagaaaagaa

SEQ ID NO: 293626 - RNA, 23 nt, Human
ucgggaggcugaugcaggagaau

SEQ ID NO: 293627 - RNA, 21 nt, Human
ucggucucaaaaaaaaaaaaa

SEQ ID NO: 293628 - RNA, 24 nt, Human
ucggucucaaaaaaaaaaaaaaaa

SEQ ID NO: 293629 - RNA, 22 nt, Human
ucugggugacuaagacucugua

SEQ ID NO: 293630 - RNA, 23 nt, Human
ugagcucagaaguuaaaggccag

SEQ ID NO: 293631 - RNA, 25 nt, Human
ugaggucaagaguuuaaaaccugcc

SEQ ID NO: 293632 - RNA, 24 nt, Human
ugaugcaggagaauugcuugaacc

SEQ ID NO: 293633 - RNA, 19 nt, Human
ugcaauacuugaaaauuga

SEQ ID NO: 293634 - RNA, 22 nt, Human
ugcacuccagccagggcgacag

SEQ ID NO: 293635 - RNA, 18 nt, Human
ugcagugagcugagauca

SEQ ID NO: 293636 - RNA, 22 nt, Human
uggaacaugaggucaagaguuu

SEQ ID NO: 293637 - RNA, 21 nt, Human
uggccgccuguaaucccagca

SEQ ID NO: 293638 - RNA, 21 nt, Human
uggcgcacgccuguaguccca

SEQ ID NO: 293639 - RNA, 19 nt, Human
ugggaggcugaggggagug

SEQ ID NO: 293640 - RNA, 24 nt, Human
ugguggcgcacgccuguaguccca

SEQ ID NO: 293641 - RNA, 21 nt, Human
uguuacuuaauauaaaaagga

SEQ ID NO: 293642 - RNA, 24 nt, Human
uuagccgagcgugguggugggcgc

SEQ ID NO: 293643 - RNA, 19 nt, Human
uugcagugagcugagaucc

SEQ ID NO: 293644 - RNA, 21 nt, Human
uugcagugagcugagauccug

SEQ ID NO: 293645 - RNA, 22 nt, Human
uugcagugagcugagauccugc

SEQ ID NO: 293646 - RNA, 24 nt, Human
uugcuugaacccgagaggcggagg

SEQ ID NO: 293647 - RNA, 26 nt, Human
uugggggagaaaagaaaaaauuaaaa

SEQ ID NO: 293648 - RNA, 25 nt, Human
aaaaacaguauggaaugggagccgg

SEQ ID NO: 293649 - RNA, 22 nt, Human
aaauaaagauugaacaguagua

SEQ ID NO: 293650 - RNA, 21 nt, Human
aaugacaaaaacaguauggaa

SEQ ID NO: 293651 - RNA, 18 nt, Human
acaggcaccucacgauaa

SEQ ID NO: 293652 - RNA, 24 nt, Human
acuugaagaguauguauuugaagu

SEQ ID NO: 293653 - RNA, 18 nt, Human
auaauagcugaaaauuua

SEQ ID NO: 293654 - RNA, 23 nt, Human
caaaaauacuacuuuacaggcac

SEQ ID NO: 293655 - RNA, 24 nt, Human
caccucacgauaaguuccuaauua

SEQ ID NO: 293656 - RNA, 22 nt, Human
caggcaccucacgauaaguucc

SEQ ID NO: 293657 - RNA, 25 nt, Human
cuacuuuacaggcaccucacgauaa

SEQ ID NO: 293658 - RNA, 22 nt, Human
gaacagcauucuaaucaacuca

SEQ ID NO: 293659 - RNA, 22 nt, Human
uaaaaagguacacuacaaucua

SEQ ID NO: 293660 - RNA, 20 nt, Human
uaaaauaucucaaacaagag

SEQ ID NO: 293661 - RNA, 21 nt, Human
uaaauguauucauaaacacag

SEQ ID NO: 293662 - RNA, 22 nt, Human
uaguguaugauucauaaaacaa

SEQ ID NO: 293663 - RNA, 24 nt, Human
uccaaugacaaaaacaggguaccc

SEQ ID NO: 293664 - RNA, 23 nt, Human
ucucuuuaguuaggcagaaacug

SEQ ID NO: 293665 - RNA, 22 nt, Human
ugaacaguaguaugaauacgau

SEQ ID NO: 293666 - RNA, 21 nt, Human
ugaacuuacugaaucucuaag

SEQ ID NO: 293667 - RNA, 20 nt, Human
ugaagaguauguauuugaag

SEQ ID NO: 293668 - RNA, 20 nt, Human
uguaaagaaauuuauuucuu

SEQ ID NO: 293669 - RNA, 19 nt, Human
ugucacauauguuucuucu

SEQ ID NO: 293670 - RNA, 19 nt, Human
uuaguggaccuuagugaac

SEQ ID NO: 293671 - RNA, 24 nt, Human
uuuacccagaaaagcaagauuacu

SEQ ID NO: 293672 - RNA, 23 nt, Human
aaaaagagaaucaaaugaagaaa

SEQ ID NO: 293673 - RNA, 18 nt, Human
aaagaaugaauugucacc

SEQ ID NO: 293674 - RNA, 26 nt, Human
aaaugcuggaaaauuggaaucacuuc

SEQ ID NO: 293675 - RNA, 22 nt, Human
aagacuaaaaaaagagaaucaa

SEQ ID NO: 293676 - RNA, 18 nt, Human
aagauaggggcaugaaaa

SEQ ID NO: 293677 - RNA, 24 nt, Human
aagauaggggcaugaaaaaaaugu

SEQ ID NO: 293678 - RNA, 29 nt, Human
aagcaaaaagcauauuuaaaggggacccc

SEQ ID NO: 293679 - RNA, 19 nt, Human
aagcuccccguggacuucc

SEQ ID NO: 293680 - RNA, 23 nt, Human
acuuuaaaacaaagggagaaaga

SEQ ID NO: 293681 - RNA, 18 nt, Human
caccuuuuaagaaccagg

SEQ ID NO: 293682 - RNA, 19 nt, Human
cacuuuaaaacaaagggag

SEQ ID NO: 293683 - RNA, 21 nt, Human
cagcuaaagauaggggcaugg

SEQ ID NO: 293684 - RNA, 23 nt, Human
caugaaaaaaaugugauuuggua

SEQ ID NO: 293685 - RNA, 19 nt, Human
ccaagcuccccguggaccg

SEQ ID NO: 293686 - RNA, 26 nt, Human
cccagccguccucccuuuggcaucca

SEQ ID NO: 293687 - RNA, 21 nt, Human
ccucagaaauaugccagugag

SEQ ID NO: 293688 - RNA, 18 nt, Human
ccugcacaauccucucca

SEQ ID NO: 293689 - RNA, 21 nt, Human
ccugggaggacgguucugugg

SEQ ID NO: 293690 - RNA, 20 nt, Human
cuaaaaaaagagaaucaaau

SEQ ID NO: 293691 - RNA, 22 nt, Human
cucuccagaggacccagccguc

SEQ ID NO: 293692 - RNA, 22 nt, Human
gaaucacuuccaaauugcucua

SEQ ID NO: 293693 - RNA, 22 nt, Human
gcacaauccucuccaggaugaa

SEQ ID NO: 293694 - RNA, 18 nt, Human
gccagugaguaguccucu

SEQ ID NO: 293695 - RNA, 19 nt, Human
gccagugaguaguccucuc

SEQ ID NO: 293696 - RNA, 19 nt, Human
gggcaugaaaaaaauguga

SEQ ID NO: 293697 - RNA, 23 nt, Human
gggcaugaaaaaaaugugauuug

SEQ ID NO: 293698 - RNA, 18 nt, Human
gugaaguucagcuaaaga

SEQ ID NO: 293699 - RNA, 23 nt, Human
guugcaguaaaaaaaguuugaaa

SEQ ID NO: 293700 - RNA, 21 nt, Human
uaaaacaaagggagaaagaac

SEQ ID NO: 293701 - RNA, 23 nt, Human
uaaacauuggcauggaaaugcca

SEQ ID NO: 293702 - RNA, 24 nt, Human
uaacacacaacuccaauuuaugcu

SEQ ID NO: 293703 - RNA, 19 nt, Human
uaagacuaaaaaaagagaa

SEQ ID NO: 293704 - RNA, 22 nt, Human
uacaauauuacauacacacaaa

SEQ ID NO: 293705 - RNA, 23 nt, Human
uacaggcaaaaauuuuuacacau

SEQ ID NO: 293706 - RNA, 21 nt, Human
ucaccuuuuaagaaccaggaa

SEQ ID NO: 293707 - RNA, 22 nt, Human
uccaggaugaaugaggaaagga

SEQ ID NO: 293708 - RNA, 25 nt, Human
uccguacaauauuacauacacacag

SEQ ID NO: 293709 - RNA, 27 nt, Human
ucuacagauaccucagaaauaugccag

SEQ ID NO: 293710 - RNA, 21 nt, Human
ucuugcuggauucagcuuccu

SEQ ID NO: 293711 - RNA, 25 nt, Human
ugaguaguccucuccagaggaccca

SEQ ID NO: 293712 - RNA, 23 nt, Human
ugcaguaaaaaaaguuugaaaaa

SEQ ID NO: 293713 - RNA, 21 nt, Human
ugggcacaggcaucugcauuc

SEQ ID NO: 293714 - RNA, 19 nt, Human
ugguauugcucuuuaggga

SEQ ID NO: 293715 - RNA, 20 nt, Human
uuaaagaaugaauugucacc

SEQ ID NO: 293716 - RNA, 22 nt, Human
uucaacuagauugcacuagagc

SEQ ID NO: 293717 - RNA, 21 nt, Human
uucagcuaaagauaggggcau

SEQ ID NO: 293718 - RNA, 23 nt, Human
uuccugggaggacgguucugugg

SEQ ID NO: 293719 - RNA, 22 nt, Human
uugcaguaaaaaaaguuugaaa

SEQ ID NO: 293720 - RNA, 18 nt, Human
uugcuggauucagcuucc

SEQ ID NO: 293721 - RNA, 21 nt, Human
uugcuggauucagcuuccugg

SEQ ID NO: 293722 - RNA, 23 nt, Human
uuugggcacaggcaucugcauuc

SEQ ID NO: 293723 - RNA, 23 nt, Human
aaaaaccagaaaacacagauuac

SEQ ID NO: 293724 - RNA, 24 nt, Human
aaaagauuaugcaaaaaguaccau

SEQ ID NO: 293725 - RNA, 24 nt, Human
aaaaguaccaucagcuugccaaga

SEQ ID NO: 293726 - RNA, 21 nt, Human
agaaaaacaagagcuauaauc

SEQ ID NO: 293727 - RNA, 24 nt, Human
agaaacugugagaaaaacaagagc

SEQ ID NO: 293728 - RNA, 20 nt, Human
aguacaaccaagaauccaca

SEQ ID NO: 293729 - RNA, 21 nt, Human
aguacaaccaagaauccacaa

SEQ ID NO: 293730 - RNA, 24 nt, Human
augcaacuacaguacaaccaagaa

SEQ ID NO: 293731 - RNA, 24 nt, Human
caaaagauuaugcaaaaaguacca

SEQ ID NO: 293732 - RNA, 22 nt, Human
caagaauaaccaaaaauuagac

SEQ ID NO: 293733 - RNA, 21 nt, Human
caauaacuccauuaauauaac

SEQ ID NO: 293734 - RNA, 20 nt, Human
caugcaacuacaguacaacc

SEQ ID NO: 293735 - RNA, 22 nt, Human
ccaaauaaaugaaaaaccagaa

SEQ ID NO: 293736 - RNA, 21 nt, Human
cuacaguacaaccaagaaucc

SEQ ID NO: 293737 - RNA, 22 nt, Human
ucacagcaaaaauagcaauaac

SEQ ID NO: 293738 - RNA, 22 nt, Human
uccacaaaagauuaugcaaaaa

SEQ ID NO: 293739 - RNA, 24 nt, Human
ugaaaaaccagaaaacacagauua

SEQ ID NO: 293740 - RNA, 20 nt, Human
ugccaagaauaaccaaaaau

SEQ ID NO: 293741 - RNA, 23 nt, Human
uggccaaauaaaugaaaaaccag

SEQ ID NO: 293742 - RNA, 20 nt, Human
auuaauuuauucagaaauau

SEQ ID NO: 293743 - RNA, 22 nt, Human
cggaaagcuacagauaccuaca

SEQ ID NO: 293744 - RNA, 21 nt, Human
gacaaaggaaaugaguaacau

SEQ ID NO: 293745 - RNA, 21 nt, Human
gacggucggaaagcuacagau

SEQ ID NO: 293746 - RNA, 20 nt, Human
gucggaaagcuacagauacc

SEQ ID NO: 293747 - RNA, 22 nt, Human
uaaaaaaaacuaaggugaaaag

SEQ ID NO: 293748 - RNA, 23 nt, Human
uaaaaaaaaguagaauucaagau

SEQ ID NO: 293749 - RNA, 21 nt, Human
uaaagacaacaguagaaauuu

SEQ ID NO: 293750 - RNA, 24 nt, Human
aaaaaaagaaagaaaagaaaagaa

SEQ ID NO: 293751 - RNA, 20 nt, Human
aaaagaaauguaacauagga

SEQ ID NO: 293752 - RNA, 20 nt, Human
aaaagacugaagaaagagaa

SEQ ID NO: 293753 - RNA, 26 nt, Human
aaaauaaauaaauaaaacuuuggaug

SEQ ID NO: 293754 - RNA, 21 nt, Human
aaaaugaauaggaaguaaaua

SEQ ID NO: 293755 - RNA, 23 nt, Human
aaacaagcaaaucucaagguugg

SEQ ID NO: 293756 - RNA, 22 nt, Human
aaagaaagaaacuuuaagaaaa

SEQ ID NO: 293757 - RNA, 22 nt, Human
aaagacugaagaaagagaauaa

SEQ ID NO: 293758 - RNA, 23 nt, Human
aaaguacaggacuauaaaucagg

SEQ ID NO: 293759 - RNA, 18 nt, Human
aaaguucauuuguaguau

SEQ ID NO: 293760 - RNA, 19 nt, Human
aacaagacaaucauaagaa

SEQ ID NO: 293761 - RNA, 26 nt, Human
aacauaugugugugugugugugugug

SEQ ID NO: 293762 - RNA, 21 nt, Human
aagaaagaaacuuuaagaaaa

SEQ ID NO: 293763 - RNA, 24 nt, Human
aagcuacuugggaggcugaggugg

SEQ ID NO: 293764 - RNA, 22 nt, Human
aaggguggaauuuuaaucuauu

SEQ ID NO: 293765 - RNA, 21 nt, Human
acaaaagaaauguaacauagg

SEQ ID NO: 293766 - RNA, 26 nt, Human
acccugagaagugugaguugaggggu

SEQ ID NO: 293767 - RNA, 20 nt, Human
acuauguaauacaaaacacu

SEQ ID NO: 293768 - RNA, 18 nt, Human
acugcacuccagccuggg

SEQ ID NO: 293769 - RNA, 24 nt, Human
acugcacuccagccugggugacaa

SEQ ID NO: 293770 - RNA, 25 nt, Human
acugcacuccagccugggugacaag

SEQ ID NO: 293771 - RNA, 19 nt, Human
agaaaagaaaagaaagaaa

SEQ ID NO: 293772 - RNA, 20 nt, Human
agacacugcaaaauugcaau

SEQ ID NO: 293773 - RNA, 23 nt, Human
agagaaaguacaggacuauaaau

SEQ ID NO: 293774 - RNA, 22 nt, Human
agagguugcagugagccaagau

SEQ ID NO: 293775 - RNA, 24 nt, Human
agagguugcagugagccaagauug

SEQ ID NO: 293776 - RNA, 22 nt, Human
agaguaagacccugucucaaaa

SEQ ID NO: 293777 - RNA, 21 nt, Human
agccaagauugugccacugca

SEQ ID NO: 293778 - RNA, 19 nt, Human
agccauuaaaaauauaaca

SEQ ID NO: 293779 - RNA, 20 nt, Human
aggaaaaaaaaaaaaagaaa

SEQ ID NO: 293780 - RNA, 19 nt, Human
aggaaaagggaaacuggaa

SEQ ID NO: 293781 - RNA, 18 nt, Human
aggaaaauagacaaaaga

SEQ ID NO: 293782 - RNA, 23 nt, Human
aggaaaauagacaaaagaaaugu

SEQ ID NO: 293783 - RNA, 22 nt, Human
aggcaaaauacuucuaaaugua

SEQ ID NO: 293784 - RNA, 24 nt, Human
aggcagagguugcagugagccaag

SEQ ID NO: 293785 - RNA, 24 nt, Human
aggcugaggagggaggauggcuug

SEQ ID NO: 293786 - RNA, 24 nt, Human
aggcugagguggaaggauccguug

SEQ ID NO: 293787 - RNA, 18 nt, Human
aggcuuugggaaacgguu

SEQ ID NO: 293788 - RNA, 23 nt, Human
agggaggauggcuugagcccagg

SEQ ID NO: 293789 - RNA, 24 nt, Human
auagaauuuuauucaaaggccuaa

SEQ ID NO: 293790 - RNA, 23 nt, Human
auaucacuuacaauaggaauauu

SEQ ID NO: 293791 - RNA, 22 nt, Human
auggagcucugugauguuguac

SEQ ID NO: 293792 - RNA, 22 nt, Human
augugugugugugugugugugu

SEQ ID NO: 293793 - RNA, 23 nt, Human
auguguguguguguguguguguu

SEQ ID NO: 293794 - RNA, 24 nt, Human
auuggcuuaugccuguaaucccag

SEQ ID NO: 293795 - RNA, 24 nt, Human
auugugccacugcacuccagccug

SEQ ID NO: 293796 - RNA, 23 nt, Human
caaaaucucaucgcugcaaaaga

SEQ ID NO: 293797 - RNA, 22 nt, Human
caagagaaaccuuaccucuuuu

SEQ ID NO: 293798 - RNA, 24 nt, Human
caagauugugccacugcacuccag

SEQ ID NO: 293799 - RNA, 24 nt, Human
caccuauaguccaagcuacuuggg

SEQ ID NO: 293800 - RNA, 20 nt, Human
cacuccagccugggugacaa

SEQ ID NO: 293801 - RNA, 21 nt, Human
cacuccagccugggugacaag

SEQ ID NO: 293802 - RNA, 24 nt, Human
cacuccagccugggugacaagagu

SEQ ID NO: 293803 - RNA, 19 nt, Human
cacugcacuccagccuggg

SEQ ID NO: 293804 - RNA, 19 nt, Human
cacugcacuccagccuggg

SEQ ID NO: 293805 - RNA, 21 nt, Human
cacugcacuccagccugggug

SEQ ID NO: 293806 - RNA, 22 nt, Human
cacugcacuccagccuggguga

SEQ ID NO: 293807 - RNA, 24 nt, Human
cacugcacuccagccugggugaca

SEQ ID NO: 293808 - RNA, 25 nt, Human
cacugcacuccagccugggugacaa

SEQ ID NO: 293809 - RNA, 21 nt, Human
cacuuuuggauuccccccacc

SEQ ID NO: 293810 - RNA, 18 nt, Human
cagaaccaagcagcccaa

SEQ ID NO: 293811 - RNA, 20 nt, Human
cagaagcuucauguaucccc

SEQ ID NO: 293812 - RNA, 20 nt, Human
cagaauuuugggaggcugag

SEQ ID NO: 293813 - RNA, 19 nt, Human
cauaugugugugugugugu

SEQ ID NO: 293814 - RNA, 23 nt, Human
cauaugugugugugugugugugu

SEQ ID NO: 293815 - RNA, 22 nt, Human
cauucccaaacaagcaaaucuc

SEQ ID NO: 293816 - RNA, 20 nt, Human
cauuuucaucucaagagaaa

SEQ ID NO: 293817 - RNA, 20 nt, Human
ccacugcacuccagccuggg

SEQ ID NO: 293818 - RNA, 20 nt, Human
ccacugcacuccagccuggg

SEQ ID NO: 293819 - RNA, 20 nt, Human
ccacugcacuccagccuggg

SEQ ID NO: 293820 - RNA, 21 nt, Human
ccacugcacuccagccugggu

SEQ ID NO: 293821 - RNA, 23 nt, Human
ccacugcacuccagccuggguga

SEQ ID NO: 293822 - RNA, 24 nt, Human
ccacugcacuccagccugggugac

SEQ ID NO: 293823 - RNA, 22 nt, Human
ccaggaggcagagguugcagug

SEQ ID NO: 293824 - RNA, 24 nt, Human
cccaucccacuuauaaacauaugu

SEQ ID NO: 293825 - RNA, 27 nt, Human
cguacccguucucccaucccacuuaua

SEQ ID NO: 293826 - RNA, 22 nt, Human
cuagauaccgccaauguauacu

SEQ ID NO: 293827 - RNA, 26 nt, Human
cucaaaaaggaaaaaaaaaaaaagaa

SEQ ID NO: 293828 - RNA, 23 nt, Human
cugggcaacuuggcaaaaucuca

SEQ ID NO: 293829 - RNA, 19 nt, Human
cuuaaccugcagcgccacc

SEQ ID NO: 293830 - RNA, 21 nt, Human
cuuucugacaccuaacccuga

SEQ ID NO: 293831 - RNA, 21 nt, Human
cuuuugcuuccaggcuuuggg

SEQ ID NO: 293832 - RNA, 18 nt, Human
gaaaggaaaauagacaaa

SEQ ID NO: 293833 - RNA, 26 nt, Human
gagcaaaaaaugaauaggagggaccc

SEQ ID NO: 293834 - RNA, 21 nt, Human
gaggcagagguugcagugagc

SEQ ID NO: 293835 - RNA, 19 nt, Human
gccacugcacuccagccug

SEQ ID NO: 293836 - RNA, 24 nt, Human
gccacugcacuccagccuggguga

SEQ ID NO: 293837 - RNA, 22 nt, Human
gcccaggaguucaagaucagcc

SEQ ID NO: 293838 - RNA, 23 nt, Human
ggcacauuggcuuaugccuguaa

SEQ ID NO: 293839 - RNA, 22 nt, Human
gggaaaauagaacuuuuuuuuu

SEQ ID NO: 293840 - RNA, 20 nt, Human
gggaggcugagguggaagga

SEQ ID NO: 293841 - RNA, 23 nt, Human
guuaaagauuucucauaucacuu

SEQ ID NO: 293842 - RNA, 21 nt, Human
uaaaacuuuggaugggcacau

SEQ ID NO: 293843 - RNA, 22 nt, Human
uaaaguucauuuguaguaucug

SEQ ID NO: 293844 - RNA, 19 nt, Human
uaaauguacugaauagacu

SEQ ID NO: 293845 - RNA, 21 nt, Human
uaaaugucucuuugauaaguu

SEQ ID NO: 293846 - RNA, 23 nt, Human
uaaaugucucuuugauaaguuuu

SEQ ID NO: 293847 - RNA, 22 nt, Human
uaacagggaccucugauuuuuu

SEQ ID NO: 293848 - RNA, 20 nt, Human
uaauucaguaauagaaagaa

SEQ ID NO: 293849 - RNA, 19 nt, Human
uacacacuuagaagcaaaa

SEQ ID NO: 293850 - RNA, 20 nt, Human
uacacacuuagaagcaaaau

SEQ ID NO: 293851 - RNA, 24 nt, Human
uacauauaauaagcaagaaauaca

SEQ ID NO: 293852 - RNA, 22 nt, Human
uagacacugcaaaauugcaauc

SEQ ID NO: 293853 - RNA, 19 nt, Human
uaugccuguaaucccagaa

SEQ ID NO: 293854 - RNA, 24 nt, Human
uaugccuguaaucccagaauuuug

SEQ ID NO: 293855 - RNA, 26 nt, Human
uauggcacguagagaaaguacaggac

SEQ ID NO: 293856 - RNA, 18 nt, Human
uaugugugugugugugug

SEQ ID NO: 293857 - RNA, 23 nt, Human
uaugugugugugugugugugugu

SEQ ID NO: 293858 - RNA, 24 nt, Human
uaugugugugugugugugugugug

SEQ ID NO: 293859 - RNA, 19 nt, Human
uccagccugggugacaaga

SEQ ID NO: 293860 - RNA, 18 nt, Human
uccaggcuuugggaaacg

SEQ ID NO: 293861 - RNA, 19 nt, Human
uccaucucaaaaaaauaaa

SEQ ID NO: 293862 - RNA, 23 nt, Human
uccccccacccuuuuuucauuuc

SEQ ID NO: 293863 - RNA, 19 nt, Human
ucuacuuccuacuuagacu

SEQ ID NO: 293864 - RNA, 23 nt, Human
ugaaaaagacugaagaaagagaa

SEQ ID NO: 293865 - RNA, 22 nt, Human
ugaauagacuauguaauacaaa

SEQ ID NO: 293866 - RNA, 21 nt, Human
ugaaugucuuacaauggcuuc

SEQ ID NO: 293867 - RNA, 30 nt, Human
ugagaaguaacaugaaaaauggagcaaaac

SEQ ID NO: 293868 - RNA, 22 nt, Human
ugagccaagauugugccacugc

SEQ ID NO: 293869 - RNA, 23 nt, Human
ugagcccaggaguucaagaucag

SEQ ID NO: 293870 - RNA, 18 nt, Human
ugaggagggaggauggcu

SEQ ID NO: 293871 - RNA, 21 nt, Human
ugaggagggaggauggcuuga

SEQ ID NO: 293872 - RNA, 24 nt, Human
ugaggagggaggauggcuugagcc

SEQ ID NO: 293873 - RNA, 24 nt, Human
ugagguggaaggauccguugagcc

SEQ ID NO: 293874 - RNA, 24 nt, Human
ugccuguaaucccagaauuuuggg

SEQ ID NO: 293875 - RNA, 25 nt, Human
uggcaaaaucucaucgcugcaaaag

SEQ ID NO: 293876 - RNA, 21 nt, Human
uggcuuaugccuguaauccca

SEQ ID NO: 293877 - RNA, 22 nt, Human
uggcuuaugccuguaaucccag

SEQ ID NO: 293878 - RNA, 23 nt, Human
uggcuugagcccaggaguucaag

SEQ ID NO: 293879 - RNA, 18 nt, Human
ugggaggcugaggaggga

SEQ ID NO: 293880 - RNA, 19 nt, Human
ugggcacauuggcuuaugc

SEQ ID NO: 293881 - RNA, 19 nt, Human
uguguguguguguguaggu

SEQ ID NO: 293882 - RNA, 19 nt, Human
uguguguguguguguguag

SEQ ID NO: 293883 - RNA, 21 nt, Human
uguguguguguguguguaggu

SEQ ID NO: 293884 - RNA, 18 nt, Human
ugugugugugugugugug

SEQ ID NO: 293885 - RNA, 18 nt, Human
ugugugugugugugugug

SEQ ID NO: 293886 - RNA, 18 nt, Human
ugugugugugugugugug

SEQ ID NO: 293887 - RNA, 18 nt, Human
ugugugugugugugugug

SEQ ID NO: 293888 - RNA, 18 nt, Human
ugugugugugugugugug

SEQ ID NO: 293889 - RNA, 18 nt, Human
ugugugugugugugugug

SEQ ID NO: 293890 - RNA, 18 nt, Human
ugugugugugugugugug

SEQ ID NO: 293891 - RNA, 18 nt, Human
ugugugugugugugugug

SEQ ID NO: 293892 - RNA, 18 nt, Human
ugugugugugugugugug

SEQ ID NO: 293893 - RNA, 18 nt, Human
ugugugugugugugugug

SEQ ID NO: 293894 - RNA, 21 nt, Human
ugugugugugugugugugugu

SEQ ID NO: 293895 - RNA, 21 nt, Human
ugugugugugugugugugugu

SEQ ID NO: 293896 - RNA, 21 nt, Human
ugugugugugugugugugugu

SEQ ID NO: 293897 - RNA, 21 nt, Human
ugugugugugugugugugugu

SEQ ID NO: 293898 - RNA, 21 nt, Human
ugugugugugugugugugugu

SEQ ID NO: 293899 - RNA, 21 nt, Human
ugugugugugugugugugugu

SEQ ID NO: 293900 - RNA, 21 nt, Human
ugugugugugugugugugugu

SEQ ID NO: 293901 - RNA, 21 nt, Human
ugugugugugugugugugugu

SEQ ID NO: 293902 - RNA, 21 nt, Human
ugugugugugugugugugugu

SEQ ID NO: 293903 - RNA, 21 nt, Human
ugugugugugugugugugugu

SEQ ID NO: 293904 - RNA, 21 nt, Human
ugugugugugugugugugugu

SEQ ID NO: 293905 - RNA, 21 nt, Human
ugugugugugugugugugugu

SEQ ID NO: 293906 - RNA, 21 nt, Human
ugugugugugugugugugugu

SEQ ID NO: 293907 - RNA, 21 nt, Human
ugugugugugugugugugugu

SEQ ID NO: 293908 - RNA, 22 nt, Human
ugugugugugugugugugugua

SEQ ID NO: 293909 - RNA, 22 nt, Human
ugugugugugugugugugugug

SEQ ID NO: 293910 - RNA, 22 nt, Human
ugugugugugugugugugugug

SEQ ID NO: 293911 - RNA, 22 nt, Human
ugugugugugugugugugugug

SEQ ID NO: 293912 - RNA, 22 nt, Human
ugugugugugugugugugugug

SEQ ID NO: 293913 - RNA, 22 nt, Human
ugugugugugugugugugugug

SEQ ID NO: 293914 - RNA, 22 nt, Human
ugugugugugugugugugugug

SEQ ID NO: 293915 - RNA, 22 nt, Human
ugugugugugugugugugugug

SEQ ID NO: 293916 - RNA, 20 nt, Human
uuaaucaacaagacaaucau

SEQ ID NO: 293917 - RNA, 19 nt, Human
uuaaugcuguugagauuaa

SEQ ID NO: 293918 - RNA, 21 nt, Human
uuaugccuguaaucccagaau

SEQ ID NO: 293919 - RNA, 24 nt, Human
uucacagaagcuucauguaucccc

SEQ ID NO: 293920 - RNA, 23 nt, Human
uuccaggcuuugggaaacgguuu

SEQ ID NO: 293921 - RNA, 22 nt, Human
uugagcccaacaaaaauaccaa

SEQ ID NO: 293922 - RNA, 21 nt, Human
uugagcccaggaguucaagau

SEQ ID NO: 293923 - RNA, 22 nt, Human
uugcagugagccaagauugugc

SEQ ID NO: 293924 - RNA, 22 nt, Human
uugcuggauccuggagcugcgu

SEQ ID NO: 293925 - RNA, 21 nt, Human
uugcuuuauuaaagaauaaau

SEQ ID NO: 293926 - RNA, 23 nt, Human
uugugccacugcacuccagccug

SEQ ID NO: 293927 - RNA, 26 nt, Human
uuuaaggagauaccaauacagggaaa

SEQ ID NO: 293928 - RNA, 18 nt, Human
uuuggauuccccccaccc

SEQ ID NO: 293929 - RNA, 19 nt, Human
uuuguaguaucugucccag

SEQ ID NO: 293930 - RNA, 21 nt, Human
uuuucugaaguaacaugagaa

SEQ ID NO: 293931 - RNA, 26 nt, Human
aacaugcauagaauuggaauaagaug

SEQ ID NO: 293932 - RNA, 19 nt, Human
caaagcaguaaaaaaggac

SEQ ID NO: 293933 - RNA, 22 nt, Human
caguaaaaaaggacuuuccaca

SEQ ID NO: 293934 - RNA, 19 nt, Human
ccuccaaugggcaaagcag

SEQ ID NO: 293935 - RNA, 19 nt, Human
cucucaccaaacgugcucc

SEQ ID NO: 293936 - RNA, 19 nt, Human
ggacaauccuagggcccgg

SEQ ID NO: 293937 - RNA, 25 nt, Human
gguuacuuucuaauaaaaggagaca

SEQ ID NO: 293938 - RNA, 20 nt, Human
uagaauacaaagaaaauuua

SEQ ID NO: 293939 - RNA, 18 nt, Human
ucacguugucgcuaacuc

SEQ ID NO: 293940 - RNA, 20 nt, Human
ugaguggacaauccuagggc

SEQ ID NO: 293941 - RNA, 22 nt, Human
ugaguggacaauccuagggccc

SEQ ID NO: 293942 - RNA, 20 nt, Human
aaaaaaaaggcggaauuaag

SEQ ID NO: 293943 - RNA, 29 nt, Human
aaaaaaaaggcggaauuaagagggacccc

SEQ ID NO: 293944 - RNA, 18 nt, Human
aaaaaaaggcggaauuaa

SEQ ID NO: 293945 - RNA, 20 nt, Human
aaaaaaaggcggaauuaaga

SEQ ID NO: 293946 - RNA, 22 nt, Human
aaaaaagaccucuccaauggac

SEQ ID NO: 293947 - RNA, 23 nt, Human
aaaaaaggacuuuccacagauua

SEQ ID NO: 293948 - RNA, 19 nt, Human
aaaagacagugaauuucuu

SEQ ID NO: 293949 - RNA, 24 nt, Human
aauggacaaagcaguaaaaaagga

SEQ ID NO: 293950 - RNA, 25 nt, Human
agaaaaaaaaaaggcggaauuaaga

SEQ ID NO: 293951 - RNA, 21 nt, Human
agaccaaaaaagaccucucca

SEQ ID NO: 293952 - RNA, 25 nt, Human
auucucgauugaaauacaaaacauu

SEQ ID NO: 293953 - RNA, 19 nt, Human
caaagcaguaaaaaaggac

SEQ ID NO: 293954 - RNA, 18 nt, Human
caaaugucaacacagaaa

SEQ ID NO: 293955 - RNA, 18 nt, Human
cacuuuagauaaaccaaa

SEQ ID NO: 293956 - RNA, 22 nt, Human
cagagccacacaacuacuuucc

SEQ ID NO: 293957 - RNA, 22 nt, Human
caguaaaaaaggacuuuccaca

SEQ ID NO: 293958 - RNA, 20 nt, Human
cagugaauuucuuuuugcuc

SEQ ID NO: 293959 - RNA, 24 nt, Human
cauucagagccacacaacuacuuu

SEQ ID NO: 293960 - RNA, 22 nt, Human
ccagaccaaaaaagaccucucc

SEQ ID NO: 293961 - RNA, 18 nt, Human
cuaagccaucccuggauu

SEQ ID NO: 293962 - RNA, 19 nt, Human
cuuuagauaaaccaaaggg

SEQ ID NO: 293963 - RNA, 21 nt, Human
cuuuuugcuccccauuagaaa

SEQ ID NO: 293964 - RNA, 19 nt, Human
gaacacacuuuagauaaac

SEQ ID NO: 293965 - RNA, 21 nt, Human
ggcauauuauagaacacauua

SEQ ID NO: 293966 - RNA, 21 nt, Human
uaacuaagacgaggcucagua

SEQ ID NO: 293967 - RNA, 19 nt, Human
uacccauauuagucuauau

SEQ ID NO: 293968 - RNA, 22 nt, Human
uaugaauauauucaacaaggga

SEQ ID NO: 293969 - RNA, 22 nt, Human
ucaauauauaaacaaaauguuc

SEQ ID NO: 293970 - RNA, 21 nt, Human
uccaauggacaaagcaguaaa

SEQ ID NO: 293971 - RNA, 19 nt, Human
ucuccaauggacaaagcag

SEQ ID NO: 293972 - RNA, 20 nt, Human
ucuccaauggacaaagcagu

SEQ ID NO: 293973 - RNA, 18 nt, Human
ugaaaccuaagccauccc

SEQ ID NO: 293974 - RNA, 21 nt, Human
ugaguacuauaucccuaaaaa

SEQ ID NO: 293975 - RNA, 23 nt, Human
uggcaagccaggaugaaaggaga

SEQ ID NO: 293976 - RNA, 22 nt, Human
aaaagggacaaauuuagcuuua

SEQ ID NO: 293977 - RNA, 19 nt, Human
aaacaaaauaaucacuaga

SEQ ID NO: 293978 - RNA, 20 nt, Human
aagauggggagaagcuguag

SEQ ID NO: 293979 - RNA, 22 nt, Human
agaauagccaaggugcagaaga

SEQ ID NO: 293980 - RNA, 21 nt, Human
agcaaccaaauaaacaaaaua

SEQ ID NO: 293981 - RNA, 18 nt, Human
aggcauugcagugggaag

SEQ ID NO: 293982 - RNA, 21 nt, Human
aguauagucaaccagaaagga

SEQ ID NO: 293983 - RNA, 23 nt, Human
agucuugauuuuggggagaaauu

SEQ ID NO: 293984 - RNA, 19 nt, Human
aguuaaauacaaaacuuuc

SEQ ID NO: 293985 - RNA, 24 nt, Human
auauagagaaaauccauacucaau

SEQ ID NO: 293986 - RNA, 21 nt, Human
auuucagauucugagauuuuu

SEQ ID NO: 293987 - RNA, 18 nt, Human
caaaauaaucacuagaca

SEQ ID NO: 293988 - RNA, 23 nt, Human
cacauauuaaaguauacuuggau

SEQ ID NO: 293989 - RNA, 24 nt, Human
cagaaaggacaagguaauuauaaa

SEQ ID NO: 293990 - RNA, 18 nt, Human
cagaauagccaaggugca

SEQ ID NO: 293991 - RNA, 21 nt, Human
cuugcaaacauuaaguuacau

SEQ ID NO: 293992 - RNA, 21 nt, Human
gaaaaaccugagaucaacuga

SEQ ID NO: 293993 - RNA, 22 nt, Human
gaaaggacaagguaauuauaaa

SEQ ID NO: 293994 - RNA, 23 nt, Human
ggugcagaagaaauuucgugauu

SEQ ID NO: 293995 - RNA, 24 nt, Human
ggugcagaagaaauuucgugauuc

SEQ ID NO: 293996 - RNA, 22 nt, Human
gugaaaaaccugagaucaacug

SEQ ID NO: 293997 - RNA, 22 nt, Human
gugcagaagaaauuucgugauu

SEQ ID NO: 293998 - RNA, 23 nt, Human
gugcagaagaaauuucgugauuc

SEQ ID NO: 293999 - RNA, 19 nt, Human
guggucacaagaggaaaag

SEQ ID NO: 294000 - RNA, 24 nt, Human
uaacgggcgguucacugaacuaaa

SEQ ID NO: 294001 - RNA, 20 nt, Human
uaagagggcuuagccuagua

SEQ ID NO: 294002 - RNA, 21 nt, Human
uaaguagcaaccaaauaaaca

SEQ ID NO: 294003 - RNA, 24 nt, Human
uaaguagcaaccaaauaaacaaaa

SEQ ID NO: 294004 - RNA, 18 nt, Human
uaagugcaauuaauaaca

SEQ ID NO: 294005 - RNA, 23 nt, Human
uaagugcaauuaauaacaauaaa

SEQ ID NO: 294006 - RNA, 24 nt, Human
uacaugguaaagacaggcacaaca

SEQ ID NO: 294007 - RNA, 18 nt, Human
uacuuggauuucuauuua

SEQ ID NO: 294008 - RNA, 25 nt, Human
uagcaaccaaauaaacaaaauaauc

SEQ ID NO: 294009 - RNA, 26 nt, Human
uauagggaguaaaagguagcacaaaa

SEQ ID NO: 294010 - RNA, 19 nt, Human
uaucagggacaugaguagg

SEQ ID NO: 294011 - RNA, 24 nt, Human
ucagauuuaaacagaauagccaag

SEQ ID NO: 294012 - RNA, 20 nt, Human
uccagucuauacaaggacaa

SEQ ID NO: 294013 - RNA, 21 nt, Human
ugaaaaaccugagaucaacug

SEQ ID NO: 294014 - RNA, 22 nt, Human
ugaaagguuaugacaaauuaua

SEQ ID NO: 294015 - RNA, 18 nt, Human
ugagaucaacugauuauc

SEQ ID NO: 294016 - RNA, 24 nt, Human
ugcagaagaaauuucgugauucuu

SEQ ID NO: 294017 - RNA, 22 nt, Human
uggggagaaauuuagggcuuuc

SEQ ID NO: 294018 - RNA, 18 nt, Human
ugugguggucacaagagg

SEQ ID NO: 294019 - RNA, 23 nt, Human
uuaaucaccaauagaucaaauau

SEQ ID NO: 294020 - RNA, 26 nt, Human
uuacaaugugcuagguaaguagcaac

SEQ ID NO: 294021 - RNA, 23 nt, Human
uugaaauugugguaugaauauuu

SEQ ID NO: 294022 - RNA, 22 nt, Human
aaauaaccgcgaauccgaucuu

SEQ ID NO: 294023 - RNA, 19 nt, Human
aaaugcaaugaaauaaaau

SEQ ID NO: 294024 - RNA, 18 nt, Human
aauccgaucuuucuugac

SEQ ID NO: 294025 - RNA, 25 nt, Human
agaagagaaaaaaaucucaggaaaa

SEQ ID NO: 294026 - RNA, 27 nt, Human
agacaaauccauuaaaaagggaaauaa

SEQ ID NO: 294027 - RNA, 22 nt, Human
caaauccauuaaaaagggaaau

SEQ ID NO: 294028 - RNA, 24 nt, Human
caacaaauaccaacaagaagagaa

SEQ ID NO: 294029 - RNA, 19 nt, Human
caacaagaagagaaaaaaa

SEQ ID NO: 294030 - RNA, 19 nt, Human
caacacuuggacagcauga

SEQ ID NO: 294031 - RNA, 19 nt, Human
cacaacaaauaccaacaag

SEQ ID NO: 294032 - RNA, 22 nt, Human
cacaacaaauaccaacaagaag

SEQ ID NO: 294033 - RNA, 21 nt, Human
cagaaaacaacgcgucaucac

SEQ ID NO: 294034 - RNA, 21 nt, Human
ccacccugaagaucuagccac

SEQ ID NO: 294035 - RNA, 20 nt, Human
gacccgguccagaaggcgca

SEQ ID NO: 294036 - RNA, 22 nt, Human
guucagacccgguccagaaggc

SEQ ID NO: 294037 - RNA, 24 nt, Human
uaaauggcagaaaacaacgcguca

SEQ ID NO: 294038 - RNA, 26 nt, Human
uaacuccguacacaauccacccagau

SEQ ID NO: 294039 - RNA, 21 nt, Human
uacacaauccacccagaugau

SEQ ID NO: 294040 - RNA, 20 nt, Human
ucaaggugaaauuuuugucc

SEQ ID NO: 294041 - RNA, 20 nt, Human
uccacaagaacgaagcccac

SEQ ID NO: 294042 - RNA, 26 nt, Human
uccacaagaacgaagcccacccugaa

SEQ ID NO: 294043 - RNA, 20 nt, Human
uuuaaaauuaauacuugauu

SEQ ID NO: 294044 - RNA, 19 nt, Human
aaacaagaaacagaccaug

SEQ ID NO: 294045 - RNA, 24 nt, Human
agagguaaaauaaacaagaaacag

SEQ ID NO: 294046 - RNA, 23 nt, Human
aguaaagucuauagucacaaaaa

SEQ ID NO: 294047 - RNA, 24 nt, Human
caauagcuagaaauacaauuuuac

SEQ ID NO: 294048 - RNA, 19 nt, Human
cauagcaauagugaaacaa

SEQ ID NO: 294049 - RNA, 25 nt, Human
cauucagcaaauauuuauuaagcac

SEQ ID NO: 294050 - RNA, 21 nt, Human
ccuacauagcaauagugaaac

SEQ ID NO: 294051 - RNA, 21 nt, Human
uaaaagagaucuccaaacaua

SEQ ID NO: 294052 - RNA, 20 nt, Human
uaaggauuuacaauacuuuu

SEQ ID NO: 294053 - RNA, 20 nt, Human
uaaguuaaaagagaucucca

SEQ ID NO: 294054 - RNA, 21 nt, Human
uacuuuuuuuuggggggggga

SEQ ID NO: 294055 - RNA, 23 nt, Human
uguuacacacuguaggaguuacu

SEQ ID NO: 294056 - RNA, 22 nt, Human
aaaacaaacuuucaaaucagga

SEQ ID NO: 294057 - RNA, 22 nt, Human
aaaggagaaggcacagguugcc

SEQ ID NO: 294058 - RNA, 19 nt, Human
aaagucauauguucugaag

SEQ ID NO: 294059 - RNA, 22 nt, Human
aaugacagaaaacaguauggaa

SEQ ID NO: 294060 - RNA, 22 nt, Human
aauggcagcagcggaauccuuu

SEQ ID NO: 294061 - RNA, 21 nt, Human
agaaaaucuacaauaugaaga

SEQ ID NO: 294062 - RNA, 19 nt, Human
agagucagacagaucuggg

SEQ ID NO: 294063 - RNA, 23 nt, Human
auaaaaccauagauaaauaugua

SEQ ID NO: 294064 - RNA, 27 nt, Human
auuccuauuaccacuguuuccuuuccu

SEQ ID NO: 294065 - RNA, 27 nt, Human
caauaugaagaaaauaauuaacuaaug

SEQ ID NO: 294066 - RNA, 21 nt, Human
cagaaaacaguauggaaucgg

SEQ ID NO: 294067 - RNA, 19 nt, Human
cagcaguauaaauaugaua

SEQ ID NO: 294068 - RNA, 20 nt, Human
ccagaaaagcaggacuuuug

SEQ ID NO: 294069 - RNA, 26 nt, Human
ccccaauuccuauuaccacuguuucc

SEQ ID NO: 294070 - RNA, 23 nt, Human
cuaaauauagaaaagauuggaca

SEQ ID NO: 294071 - RNA, 21 nt, Human
cucauuuuaccccaauuccua

SEQ ID NO: 294072 - RNA, 19 nt, Human
cucgcaauaaguuccuaau

SEQ ID NO: 294073 - RNA, 21 nt, Human
cuuacugaaucucuaagacca

SEQ ID NO: 294074 - RNA, 22 nt, Human
gcagcggaauccuuugaaauga

SEQ ID NO: 294075 - RNA, 22 nt, Human
ggaaucggagcagggucacuga

SEQ ID NO: 294076 - RNA, 22 nt, Human
uaaaagcauuuuuuaaaaaugc

SEQ ID NO: 294077 - RNA, 20 nt, Human
uaaaauaucucaaacaagag

SEQ ID NO: 294078 - RNA, 21 nt, Human
uaaauaugauaaaagacuucu

SEQ ID NO: 294079 - RNA, 23 nt, Human
uaagaaaauaaaaccauagauaa

SEQ ID NO: 294080 - RNA, 18 nt, Human
uagacuguauauuaagca

SEQ ID NO: 294081 - RNA, 18 nt, Human
uaucuaaugacagaaaac

SEQ ID NO: 294082 - RNA, 27 nt, Human
ucaagaguacauauuugaaaugaugua

SEQ ID NO: 294083 - RNA, 22 nt, Human
ucagccuccagcggcucucaca

SEQ ID NO: 294084 - RNA, 21 nt, Human
ucaugcuuugugaaggguucu

SEQ ID NO: 294085 - RNA, 20 nt, Human
uccuaaaauaccaugccuca

SEQ ID NO: 294086 - RNA, 23 nt, Human
ucuacagucuaugcuucugagac

SEQ ID NO: 294087 - RNA, 22 nt, Human
ugaaaugagcugaauaauagca

SEQ ID NO: 294088 - RNA, 21 nt, Human
ugaacuuacugaaucucuaag

SEQ ID NO: 294089 - RNA, 18 nt, Human
ugacccagagucagacag

SEQ ID NO: 294090 - RNA, 19 nt, Human
ugacugcagaaaaucuaca

SEQ ID NO: 294091 - RNA, 24 nt, Human
ugauaucuaaugacagaaaacagu

SEQ ID NO: 294092 - RNA, 23 nt, Human
uggacagcaguauaaauaugaua

SEQ ID NO: 294093 - RNA, 18 nt, Human
uggcagcagcggaauccu

SEQ ID NO: 294094 - RNA, 23 nt, Human
uuaaugaucaucuaugauucucu

SEQ ID NO: 294095 - RNA, 19 nt, Human
uugguguauaagaaaauaa

SEQ ID NO: 294096 - RNA, 19 nt, Human
uuuguucauuccuaaaaua

SEQ ID NO: 294097 - RNA, 19 nt, Human
aagcuccccguggacuucc

SEQ ID NO: 294098 - RNA, 18 nt, Human
caguaucugaggcugugg

SEQ ID NO: 294099 - RNA, 19 nt, Human
ccaagcuccccguggaccg

SEQ ID NO: 294100 - RNA, 26 nt, Human
cccagccguccucccuuuggcaucca

SEQ ID NO: 294101 - RNA, 21 nt, Human
ccucagaaauaugccagugag

SEQ ID NO: 294102 - RNA, 21 nt, Human
ccugggaggacgguucugugg

SEQ ID NO: 294103 - RNA, 22 nt, Human
cucuccagaggacccagccguc

SEQ ID NO: 294104 - RNA, 18 nt, Human
gccagugaguaguccucu

SEQ ID NO: 294105 - RNA, 19 nt, Human
gccagugaguaguccucuc

SEQ ID NO: 294106 - RNA, 27 nt, Human
ucuacagauaccucagaaauaugccag

SEQ ID NO: 294107 - RNA, 25 nt, Human
ugaguaguccucuccagaggaccca

SEQ ID NO: 294108 - RNA, 23 nt, Human
uuccugggaggacgguucugugg

SEQ ID NO: 294109 - RNA, 18 nt, Human
uugcugaauucagcuucc

SEQ ID NO: 294110 - RNA, 27 nt, Human
aaaaaaaaaaaaaacaaacaaaccaaa

SEQ ID NO: 294111 - RNA, 20 nt, Human
aaaaaaaacaaacaaaccaa

SEQ ID NO: 294112 - RNA, 22 nt, Human
aaaaaaaacaaacaaaccaaaa

SEQ ID NO: 294113 - RNA, 25 nt, Human
aaaaaaacaaacaaaccaaaaaaca

SEQ ID NO: 294114 - RNA, 20 nt, Human
aaaaaacaaacaaaccaaaa

SEQ ID NO: 294115 - RNA, 21 nt, Human
aaaaauagaagaaauaucaaa

SEQ ID NO: 294116 - RNA, 20 nt, Human
aaaacaaacaaaccaaaaaa

SEQ ID NO: 294117 - RNA, 22 nt, Human
aaaauaagaaaaaguuaacuug

SEQ ID NO: 294118 - RNA, 24 nt, Human
aaacaaacaaacaaacaaaaaaca

SEQ ID NO: 294119 - RNA, 21 nt, Human
aaacaaacaaaccaaaaaaca

SEQ ID NO: 294120 - RNA, 25 nt, Human
aaacaaacaaaccaaaaaacaaaca

SEQ ID NO: 294121 - RNA, 25 nt, Human
aaacaaacaaaccaaaaaacaaaca

SEQ ID NO: 294122 - RNA, 21 nt, Human
aaacaaaccaaaaaacaaaca

SEQ ID NO: 294123 - RNA, 24 nt, Human
aaacaaaccaaaaaacaaacaaac

SEQ ID NO: 294124 - RNA, 22 nt, Human
aaacaguuguaaugaacaagga

SEQ ID NO: 294125 - RNA, 19 nt, Human
aaagaacagaccacacuaa

SEQ ID NO: 294126 - RNA, 20 nt, Human
aaagcacauauuacaugcag

SEQ ID NO: 294127 - RNA, 19 nt, Human
aaagugcugggauuacagg

SEQ ID NO: 294128 - RNA, 24 nt, Human
aaagugcugggauuacaggaauga

SEQ ID NO: 294129 - RNA, 26 nt, Human
aaaugucuuuauuaaguggguucccc

SEQ ID NO: 294130 - RNA, 23 nt, Human
aacaaacaaacaaacaaaaaaca

SEQ ID NO: 294131 - RNA, 25 nt, Human
aacaaacaaaccaaaaaacaaacaa

SEQ ID NO: 294132 - RNA, 27 nt, Human
aacaaaccaaaaaacaaacaaacaaac

SEQ ID NO: 294133 - RNA, 21 nt, Human
aacaagaauauauuaaagaag

SEQ ID NO: 294134 - RNA, 22 nt, Human
aaccaaaaaacaaacaaacaaa

SEQ ID NO: 294135 - RNA, 24 nt, Human
aagaaaaauagaagaaauaucaaa

SEQ ID NO: 294136 - RNA, 18 nt, Human
aagugcugggauuacagg

SEQ ID NO: 294137 - RNA, 26 nt, Human
aagugcugggauuacaggaaugagcc

SEQ ID NO: 294138 - RNA, 18 nt, Human
aaucgcuugaaccuggga

SEQ ID NO: 294139 - RNA, 24 nt, Human
aaucgcuugaaccugggaggcgga

SEQ ID NO: 294140 - RNA, 24 nt, Human
aauuuuguauuuuuaguaaagacg

SEQ ID NO: 294141 - RNA, 24 nt, Human
acagagcgagacuccgucucaaaa

SEQ ID NO: 294142 - RNA, 20 nt, Human
accaaaaaacaaacaaacaa

SEQ ID NO: 294143 - RNA, 26 nt, Human
accuaaggugaucugcccgccuuggc

SEQ ID NO: 294144 - RNA, 24 nt, Human
acgggguuacuuaacguuggucag

SEQ ID NO: 294145 - RNA, 23 nt, Human
acuaaagcccauuuacacacgcu

SEQ ID NO: 294146 - RNA, 18 nt, Human
acucuggaggcugaggca

SEQ ID NO: 294147 - RNA, 24 nt, Human
acugcacuccagccugggcgacag

SEQ ID NO: 294148 - RNA, 26 nt, Human
acugcacuccagccugggcgacagag

SEQ ID NO: 294149 - RNA, 23 nt, Human
agcaauuugggaggcugaguggg

SEQ ID NO: 294150 - RNA, 19 nt, Human
agccauuaaaaauuuaaca

SEQ ID NO: 294151 - RNA, 24 nt, Human
agccugggcgacagagcgagacuc

SEQ ID NO: 294152 - RNA, 24 nt, Human
agcgauucuccugccucagccucc

SEQ ID NO: 294153 - RNA, 24 nt, Human
agcugggauuacaagcaugugcca

SEQ ID NO: 294154 - RNA, 23 nt, Human
aggaaugagccacugagcccugc

SEQ ID NO: 294155 - RNA, 22 nt, Human
aggcaggagaaucgcuugaacc

SEQ ID NO: 294156 - RNA, 24 nt, Human
aggcaggagaaucgcuugaaccug

SEQ ID NO: 294157 - RNA, 20 nt, Human
aggcggagguugcagugagc

SEQ ID NO: 294158 - RNA, 24 nt, Human
aggcggagguugcagugagcugag

SEQ ID NO: 294159 - RNA, 20 nt, Human
aggcugaggcaggagaaucg

SEQ ID NO: 294160 - RNA, 24 nt, Human
aggcugaggcaggagaaucgcuug

SEQ ID NO: 294161 - RNA, 21 nt, Human
agggguuuauuuaucauauca

SEQ ID NO: 294162 - RNA, 24 nt, Human
aggugaucugcccgccuuggccuc

SEQ ID NO: 294163 - RNA, 23 nt, Human
aguagcugggauuacaagcaugu

SEQ ID NO: 294164 - RNA, 24 nt, Human
agugcugggauuacaggaaugagc

SEQ ID NO: 294165 - RNA, 24 nt, Human
agugggguggaucacgaggucaag

SEQ ID NO: 294166 - RNA, 18 nt, Human
auagaauuuuauucaaag

SEQ ID NO: 294167 - RNA, 24 nt, Human
aucgcgccacugcacuccagccug

SEQ ID NO: 294168 - RNA, 19 nt, Human
auuuuuuuuuuuuuuuugg

SEQ ID NO: 294169 - RNA, 25 nt, Human
caaaaaaaaaaaaaacaaacaaacc

SEQ ID NO: 294170 - RNA, 24 nt, Human
caaaaaacaaacaaacaaacaaaa

SEQ ID NO: 294171 - RNA, 22 nt, Human
caaaaaacaguuguaaugaaca

SEQ ID NO: 294172 - RNA, 20 nt, Human
caaacaaacaaacaaaaaac

SEQ ID NO: 294173 - RNA, 21 nt, Human
caaacaaaccaaaaaacaaac

SEQ ID NO: 294174 - RNA, 22 nt, Human
caaacaaaccaaaaaacaaaca

SEQ ID NO: 294175 - RNA, 24 nt, Human
caaaccaauaagaacaccgguuuc

SEQ ID NO: 294176 - RNA, 24 nt, Human
caaagugcugggauuacaggaaug

SEQ ID NO: 294177 - RNA, 21 nt, Human
caaauagggaacuaucaaugc

SEQ ID NO: 294178 - RNA, 25 nt, Human
caaauuaaauauuuucacaugaucc

SEQ ID NO: 294179 - RNA, 23 nt, Human
caacuuccaccuccuggguucaa

SEQ ID NO: 294180 - RNA, 20 nt, Human
caagcgauucuccugccuca

SEQ ID NO: 294181 - RNA, 22 nt, Human
caagcgauucuccugccucagc

SEQ ID NO: 294182 - RNA, 24 nt, Human
caaugccgggaaacuagaacuuua

SEQ ID NO: 294183 - RNA, 24 nt, Human
cacuccagccugggcgacagagcg

SEQ ID NO: 294184 - RNA, 22 nt, Human
cacugagcccugccucaaagac

SEQ ID NO: 294185 - RNA, 19 nt, Human
cacugcacuccagccuggg

SEQ ID NO: 294186 - RNA, 20 nt, Human
cacugcacuccagccugggc

SEQ ID NO: 294187 - RNA, 22 nt, Human
cacugcacuccagccugggcga

SEQ ID NO: 294188 - RNA, 23 nt, Human
cacugcacuccagccugggcgac

SEQ ID NO: 294189 - RNA, 24 nt, Human
cacugcacuccagccugggcgaca

SEQ ID NO: 294190 - RNA, 23 nt, Human
cagcaauuugggaggcugagugg

SEQ ID NO: 294191 - RNA, 21 nt, Human
ccaaaaaacaaacaaacaaac

SEQ ID NO: 294192 - RNA, 19 nt, Human
ccaaagugcugggauuaca

SEQ ID NO: 294193 - RNA, 21 nt, Human
ccaaagugcugggauuacagg

SEQ ID NO: 294194 - RNA, 24 nt, Human
ccaaagugcugggauuacaggaau

SEQ ID NO: 294195 - RNA, 24 nt, Human
ccaccuccuggguucaagcgauuc

SEQ ID NO: 294196 - RNA, 20 nt, Human
ccacugcacuccagccuggg

SEQ ID NO: 294197 - RNA, 21 nt, Human
ccacugcacuccagccugggc

SEQ ID NO: 294198 - RNA, 21 nt, Human
ccacugcacuccagccugggc

SEQ ID NO: 294199 - RNA, 23 nt, Human
ccacugcacuccagccugggcga

SEQ ID NO: 294200 - RNA, 24 nt, Human
ccacugcacuccagccugggcgac

SEQ ID NO: 294201 - RNA, 18 nt, Human
cccaggcuggaguacaau

SEQ ID NO: 294202 - RNA, 19 nt, Human
cccaggcuggaguacaaug

SEQ ID NO: 294203 - RNA, 19 nt, Human
cccgaguagcugggauuac

SEQ ID NO: 294204 - RNA, 22 nt, Human
cccgccuuggccucccaaagug

SEQ ID NO: 294205 - RNA, 22 nt, Human
cccgucucuacugaaaauacaa

SEQ ID NO: 294206 - RNA, 21 nt, Human
ccuaucuuaacacuauuaaaa

SEQ ID NO: 294207 - RNA, 24 nt, Human
ccuccuggguucaagcgauucucc

SEQ ID NO: 294208 - RNA, 23 nt, Human
ccugccucagccucccgaguagc

SEQ ID NO: 294209 - RNA, 24 nt, Human
ccugccucagccucccgaguagcu

SEQ ID NO: 294210 - RNA, 19 nt, Human
ccugggaggcggagguugc

SEQ ID NO: 294211 - RNA, 22 nt, Human
ccugggcgacagagcgagacuc

SEQ ID NO: 294212 - RNA, 23 nt, Human
ccuggguucaagcgauucuccug

SEQ ID NO: 294213 - RNA, 21 nt, Human
cuaacaccuaucuuaacacua

SEQ ID NO: 294214 - RNA, 21 nt, Human
cuagacacuaccaauaacacu

SEQ ID NO: 294215 - RNA, 19 nt, Human
cucaaaaaaaaaaaaaaca

SEQ ID NO: 294216 - RNA, 20 nt, Human
cucaaaaaaaaaaaaaacaa

SEQ ID NO: 294217 - RNA, 30 nt, Human
cucaaaaaaaaaaaaaacaaacaaaccaaa

SEQ ID NO: 294218 - RNA, 24 nt, Human
cucagccucccgaguagcugggau

SEQ ID NO: 294219 - RNA, 26 nt, Human
cucaugccuguaaaucccagcaauuu

SEQ ID NO: 294220 - RNA, 24 nt, Human
cuccgucucaaaaaaaaaaaaaac

SEQ ID NO: 294221 - RNA, 21 nt, Human
cuccuggguucaagcgauucu

SEQ ID NO: 294222 - RNA, 21 nt, Human
cucggcucaaagcaacuucca

SEQ ID NO: 294223 - RNA, 26 nt, Human
cucgugaccuaaggugaucugcccgc

SEQ ID NO: 294224 - RNA, 24 nt, Human
cuuaacguuggucaggcuggucuc

SEQ ID NO: 294225 - RNA, 19 nt, Human
cuugaaccugggaggcgga

SEQ ID NO: 294226 - RNA, 21 nt, Human
gacagagcgagacuccgucuc

SEQ ID NO: 294227 - RNA, 24 nt, Human
gacagagcgagacuccgucucaaa

SEQ ID NO: 294228 - RNA, 23 nt, Human
gaccuaaggugaucugcccgccu

SEQ ID NO: 294229 - RNA, 23 nt, Human
gagaaucgcuugaaccugggagg

SEQ ID NO: 294230 - RNA, 23 nt, Human
gagaucgcgccacugcacuccag

SEQ ID NO: 294231 - RNA, 23 nt, Human
gagguugcagugagcugagaucg

SEQ ID NO: 294232 - RNA, 25 nt, Human
gaguagcugggauuacaagcaugug

SEQ ID NO: 294233 - RNA, 23 nt, Human
gauacaaaauaagaaaaaguuaa

SEQ ID NO: 294234 - RNA, 24 nt, Human
gauuacaagcaugugccaccaugc

SEQ ID NO: 294235 - RNA, 18 nt, Human
gauuacaggaaugagcca

SEQ ID NO: 294236 - RNA, 22 nt, Human
gcaacuuccaccuccuggguuc

SEQ ID NO: 294237 - RNA, 24 nt, Human
gcacuccagccugggcgacagagc

SEQ ID NO: 294238 - RNA, 22 nt, Human
gccacugcacuccagccugggc

SEQ ID NO: 294239 - RNA, 24 nt, Human
gccacugcacuccagccugggcga

SEQ ID NO: 294240 - RNA, 20 nt, Human
gcccaaauggauuaagucaa

SEQ ID NO: 294241 - RNA, 22 nt, Human
gccuuggccucccaaagugcug

SEQ ID NO: 294242 - RNA, 24 nt, Human
gcgauucuccugccucagccuccc

SEQ ID NO: 294243 - RNA, 24 nt, Human
gcuagacacuaccaauaacacucu

SEQ ID NO: 294244 - RNA, 20 nt, Human
gcucuuauugcccaggcugg

SEQ ID NO: 294245 - RNA, 21 nt, Human
gcucuuauugcccaggcugga

SEQ ID NO: 294246 - RNA, 20 nt, Human
gcugagaucgcgccacugca

SEQ ID NO: 294247 - RNA, 30 nt, Human
gcuggaguacaauggugcaaucucggcucc

SEQ ID NO: 294248 - RNA, 21 nt, Human
ggaggcugagugggguggauc

SEQ ID NO: 294249 - RNA, 22 nt, Human
ggagguugcagugagcugagau

SEQ ID NO: 294250 - RNA, 24 nt, Human
ggagguugcagugagcugagaucg

SEQ ID NO: 294251 - RNA, 19 nt, Human
ggccaccaugaugaaaccc

SEQ ID NO: 294252 - RNA, 23 nt, Human
ggcugggugcgguggcucaugcc

SEQ ID NO: 294253 - RNA, 24 nt, Human
gggugcgguggcucaugccuguaa

SEQ ID NO: 294254 - RNA, 18 nt, Human
gguggaucacgaggucaa

SEQ ID NO: 294255 - RNA, 24 nt, Human
gguggcucaugccuguaaauccca

SEQ ID NO: 294256 - RNA, 25 nt, Human
gguggcucaugccuguaaaucccag

SEQ ID NO: 294257 - RNA, 18 nt, Human
guagcugggauuacaagc

SEQ ID NO: 294258 - RNA, 22 nt, Human
guaggcugggugcgguggcuca

SEQ ID NO: 294259 - RNA, 19 nt, Human
guugcagugagcugagauc

SEQ ID NO: 294260 - RNA, 21 nt, Human
guugcagugagcugagaucgc

SEQ ID NO: 294261 - RNA, 22 nt, Human
uaacaaguaaaaaguuuuagga

SEQ ID NO: 294262 - RNA, 25 nt, Human
uaacaaguaaaaaguuuuaggaaaa

SEQ ID NO: 294263 - RNA, 27 nt, Human
uaagaaaaaguuaacuugugaaguuaa

SEQ ID NO: 294264 - RNA, 24 nt, Human
uaagaacaccgguuucaaaagaaa

SEQ ID NO: 294265 - RNA, 18 nt, Human
uaaggugaucugcccgcc

SEQ ID NO: 294266 - RNA, 23 nt, Human
uaauuuuguauuuuuaguaaaga

SEQ ID NO: 294267 - RNA, 20 nt, Human
uacaagcaugugccaccaug

SEQ ID NO: 294268 - RNA, 22 nt, Human
uacaagcaugugccaccaugcc

SEQ ID NO: 294269 - RNA, 19 nt, Human
uacuuugugauugcuguug

SEQ ID NO: 294270 - RNA, 20 nt, Human
uagaccauccuggccaccau

SEQ ID NO: 294271 - RNA, 23 nt, Human
uaggcugggugcgguggcucaug

SEQ ID NO: 294272 - RNA, 18 nt, Human
uaguaaagacgggguuac

SEQ ID NO: 294273 - RNA, 24 nt, Human
uaguaaagacgggguuacuuaacg

SEQ ID NO: 294274 - RNA, 24 nt, Human
uauuuuauuuuauuuugauggagu

SEQ ID NO: 294275 - RNA, 25 nt, Human
ucaaaaaaaaaaaaaacaaacaaac

SEQ ID NO: 294276 - RNA, 24 nt, Human
ucaaagcaacuuccaccuccuggg

SEQ ID NO: 294277 - RNA, 19 nt, Human
ucaagcgauucuccugccu

SEQ ID NO: 294278 - RNA, 22 nt, Human
ucacgaggucaagagauagacc

SEQ ID NO: 294279 - RNA, 20 nt, Human
ucagccucccgaguagcugg

SEQ ID NO: 294280 - RNA, 24 nt, Human
ucauagaauuuuauucaaaguucu

SEQ ID NO: 294281 - RNA, 23 nt, Human
uccagccugggcgacagagcgag

SEQ ID NO: 294282 - RNA, 24 nt, Human
uccagccugggcgacagagcgaga

SEQ ID NO: 294283 - RNA, 18 nt, Human
ucccaaagugcugggauu

SEQ ID NO: 294284 - RNA, 23 nt, Human
ucccaaagugcugggauuacagg

SEQ ID NO: 294285 - RNA, 18 nt, Human
ucccgaguagcugggauu

SEQ ID NO: 294286 - RNA, 22 nt, Human
uccgucucaaaaaaaaaaaaaa

SEQ ID NO: 294287 - RNA, 21 nt, Human
uccuggguucaagcgauucuc

SEQ ID NO: 294288 - RNA, 24 nt, Human
uccuggguucaagcgauucuccug

SEQ ID NO: 294289 - RNA, 23 nt, Human
ucgcgccacugcacuccagccug

SEQ ID NO: 294290 - RNA, 24 nt, Human
ucgcuugaaccugggaggcggagg

SEQ ID NO: 294291 - RNA, 18 nt, Human
ucucaaaaaaaaaaaaaa

SEQ ID NO: 294292 - RNA, 23 nt, Human
ucucaaaaaaaaaaaaaacaaac

SEQ ID NO: 294293 - RNA, 24 nt, Human
ucuccugccucagccucccgagua

SEQ ID NO: 294294 - RNA, 21 nt, Human
ucucuacugaaaauacaaaaa

SEQ ID NO: 294295 - RNA, 24 nt, Human
ugaaccugggaggcggagguugca

SEQ ID NO: 294296 - RNA, 24 nt, Human
ugaccuaaggugaucugcccgccu

SEQ ID NO: 294297 - RNA, 24 nt, Human
ugacuaaauuuuuuuuuuuuuuuu

SEQ ID NO: 294298 - RNA, 22 nt, Human
ugagcugagaucgcgccacugc

SEQ ID NO: 294299 - RNA, 20 nt, Human
ugaggcaggagaaucgcuug

SEQ ID NO: 294300 - RNA, 24 nt, Human
ugaggcaggagaaucgcuugaacc

SEQ ID NO: 294301 - RNA, 25 nt, Human
ugaggcaggagaaucgcuugaaccu

SEQ ID NO: 294302 - RNA, 19 nt, Human
ugagugggguggaucacga

SEQ ID NO: 294303 - RNA, 21 nt, Human
ugcccaggcuggaguacaaug

SEQ ID NO: 294304 - RNA, 24 nt, Human
ugcccaggcuggaguacaauggug

SEQ ID NO: 294305 - RNA, 24 nt, Human
ugccucagccucccgaguagcugg

SEQ ID NO: 294306 - RNA, 24 nt, Human
ugcucuuauugcccaggcuggagu

SEQ ID NO: 294307 - RNA, 23 nt, Human
uggcucaugccuguaaaucccag

SEQ ID NO: 294308 - RNA, 25 nt, Human
uggcucaugccuguaaaucccagca

SEQ ID NO: 294309 - RNA, 29 nt, Human
ugggaggcggagguugcagugacaacggu

SEQ ID NO: 294310 - RNA, 24 nt, Human
ugggaggcggagguugcagugagc

SEQ ID NO: 294311 - RNA, 19 nt, Human
ugggaggcugaguggggug

SEQ ID NO: 294312 - RNA, 24 nt, Human
ugggaggcugagugggguggauca

SEQ ID NO: 294313 - RNA, 21 nt, Human
ugggauuacaagcaugugcca

SEQ ID NO: 294314 - RNA, 22 nt, Human
ugggauuacaagcaugugccac

SEQ ID NO: 294315 - RNA, 24 nt, Human
ugggauuacaagcaugugccacca

SEQ ID NO: 294316 - RNA, 22 nt, Human
ugggauuacaggaaugagccac

SEQ ID NO: 294317 - RNA, 22 nt, Human
ugggauuacaggaaugagccac

SEQ ID NO: 294318 - RNA, 23 nt, Human
ugggauuacaggaaugagccacu

SEQ ID NO: 294319 - RNA, 24 nt, Human
ugggauuacaggaaugagccacug

SEQ ID NO: 294320 - RNA, 23 nt, Human
uggguucaagcgauucuccugcc

SEQ ID NO: 294321 - RNA, 21 nt, Human
uggucaggcuggucucaaacu

SEQ ID NO: 294322 - RNA, 21 nt, Human
uguauuuuuaguaaagacggg

SEQ ID NO: 294323 - RNA, 20 nt, Human
uuaguaaagacgggguuacu

SEQ ID NO: 294324 - RNA, 24 nt, Human
uuauuguaggcugggugcgguggc

SEQ ID NO: 294325 - RNA, 22 nt, Human
uucaaaagaaaaauagaagaaa

SEQ ID NO: 294326 - RNA, 21 nt, Human
uucaagcgauucuccugccuc

SEQ ID NO: 294327 - RNA, 23 nt, Human
uucaagcgauucuccugccucag

SEQ ID NO: 294328 - RNA, 24 nt, Human
uucaagcgauucuccugccucagc

SEQ ID NO: 294329 - RNA, 24 nt, Human
uugaaccugggaggcggagguugc

SEQ ID NO: 294330 - RNA, 19 nt, Human
uugcagugagcugagaucg

SEQ ID NO: 294331 - RNA, 22 nt, Human
uugcagugagcugagaucgcgc

SEQ ID NO: 294332 - RNA, 23 nt, Human
uugcucuuauugcccaggcugga

SEQ ID NO: 294333 - RNA, 25 nt, Human
uugggaggcugagugggguggauca

SEQ ID NO: 294334 - RNA, 23 nt, Human
uuguauuuuuaguaaagacgggg

SEQ ID NO: 294335 - RNA, 23 nt, Human
uuuaaaacgaccaaaaauuuuua

SEQ ID NO: 294336 - RNA, 24 nt, Human
uuugcucuuauugcccaggcugga

SEQ ID NO: 294337 - RNA, 23 nt, Human
uuuugcucuuauugcccaggcug

SEQ ID NO: 294338 - RNA, 24 nt, Human
uuuugcucuuauugcccaggcugg

SEQ ID NO: 294339 - RNA, 20 nt, Human
uuuuguauuuuuaguaaaga

SEQ ID NO: 294340 - RNA, 21 nt, Human
aaaacacaacacgggccgccg

SEQ ID NO: 294341 - RNA, 24 nt, Human
aaaacagaagacugguccccaggg

SEQ ID NO: 294342 - RNA, 19 nt, Human
aaaagcacaccgcacuaca

SEQ ID NO: 294343 - RNA, 24 nt, Human
aaacaaaacagaagacuggucccc

SEQ ID NO: 294344 - RNA, 25 nt, Human
aaacaaaacagaagacuggucccca

SEQ ID NO: 294345 - RNA, 20 nt, Human
aaaugcccucccuaaauccc

SEQ ID NO: 294346 - RNA, 19 nt, Human
aacagaagacugguccccc

SEQ ID NO: 294347 - RNA, 19 nt, Human
aagaggucaugaugcccuu

SEQ ID NO: 294348 - RNA, 23 nt, Human
aagcuggcugccugggcugagcc

SEQ ID NO: 294349 - RNA, 25 nt, Human
acaaaacacaacacgggccgccgcg

SEQ ID NO: 294350 - RNA, 22 nt, Human
acaaaacagaagacuggucccc

SEQ ID NO: 294351 - RNA, 27 nt, Human
acagagccuccuccaaggccuugauaa

SEQ ID NO: 294352 - RNA, 22 nt, Human
acagcacaaaacacaacacggg

SEQ ID NO: 294353 - RNA, 21 nt, Human
accaugcuuugggggaagauu

SEQ ID NO: 294354 - RNA, 20 nt, Human
accccauacugucuuggaac

SEQ ID NO: 294355 - RNA, 19 nt, Human
acucgggaaagaggaacug

SEQ ID NO: 294356 - RNA, 22 nt, Human
acugaaaugccaguuuaaucca

SEQ ID NO: 294357 - RNA, 20 nt, Human
agaaggucuaugcacaagga

SEQ ID NO: 294358 - RNA, 19 nt, Human
agaggaacuguuggagugg

SEQ ID NO: 294359 - RNA, 24 nt, Human
agcucagcccaaagcuggcugccu

SEQ ID NO: 294360 - RNA, 21 nt, Human
aggacauacagagccuccucc

SEQ ID NO: 294361 - RNA, 22 nt, Human
aggaggcuuguagguuacuugg

SEQ ID NO: 294362 - RNA, 20 nt, Human
aggagggaggcaugggaugg

SEQ ID NO: 294363 - RNA, 18 nt, Human
aggagggcaggggcccug

SEQ ID NO: 294364 - RNA, 19 nt, Human
aggaggugggggaagucaa

SEQ ID NO: 294365 - RNA, 18 nt, Human
agggggcgcacuggggac

SEQ ID NO: 294366 - RNA, 25 nt, Human
auacagagccuccuccaaccggagg

SEQ ID NO: 294367 - RNA, 21 nt, Human
caaaacagaagacuggucccc

SEQ ID NO: 294368 - RNA, 23 nt, Human
caaacaaugaaaaacaaaacaga

SEQ ID NO: 294369 - RNA, 22 nt, Human
caacaccccaaccaccuuacuc

SEQ ID NO: 294370 - RNA, 21 nt, Human
cacacuucccuuccuuaucuu

SEQ ID NO: 294371 - RNA, 20 nt, Human
caccgcacuacacuacuggc

SEQ ID NO: 294372 - RNA, 18 nt, Human
cacuggggaccugggcag

SEQ ID NO: 294373 - RNA, 25 nt, Human
cagagccuccuccaaggccuugaua

SEQ ID NO: 294374 - RNA, 20 nt, Human
cagcccaaagcuggcugccu

SEQ ID NO: 294375 - RNA, 22 nt, Human
caggagggcaggggcccuguug

SEQ ID NO: 294376 - RNA, 22 nt, Human
caggggcagaagggggugggag

SEQ ID NO: 294377 - RNA, 22 nt, Human
caguauucuggggguuagcccu

SEQ ID NO: 294378 - RNA, 20 nt, Human
ccacagaggccccucugacc

SEQ ID NO: 294379 - RNA, 23 nt, Human
ccauacugucuuggaacaugcag

SEQ ID NO: 294380 - RNA, 26 nt, Human
ccauacugucuuggaacaugcagugg

SEQ ID NO: 294381 - RNA, 21 nt, Human
cccaccauccacauccacaca

SEQ ID NO: 294382 - RNA, 30 nt, Human
cccacccgccaucacguaaaagcacaccgg

SEQ ID NO: 294383 - RNA, 18 nt, Human
ccccacuacccccauggg

SEQ ID NO: 294384 - RNA, 20 nt, Human
ccccacuacccccaugggua

SEQ ID NO: 294385 - RNA, 21 nt, Human
ccccacuacccccauggguac

SEQ ID NO: 294386 - RNA, 27 nt, Human
cccccaccauccacauccacacacuuc

SEQ ID NO: 294387 - RNA, 25 nt, Human
cccccugggggggaagggguaggug

SEQ ID NO: 294388 - RNA, 21 nt, Human
ccccugaggacauacagagcc

SEQ ID NO: 294389 - RNA, 21 nt, Human
ccgccgcccgcugcccacccg

SEQ ID NO: 294390 - RNA, 22 nt, Human
ccucucaaggggaccugguccu

SEQ ID NO: 294391 - RNA, 22 nt, Human
ccuggcuggcccacccuuccug

SEQ ID NO: 294392 - RNA, 19 nt, Human
ccugggcugagacuuucug

SEQ ID NO: 294393 - RNA, 21 nt, Human
ccugggcugagcccuauuaug

SEQ ID NO: 294394 - RNA, 21 nt, Human
ccuguuagcucagcccaaagc

SEQ ID NO: 294395 - RNA, 24 nt, Human
cgcccgcugcccacccgccaucac

SEQ ID NO: 294396 - RNA, 19 nt, Human
cgcccuguggcucuuggcc

SEQ ID NO: 294397 - RNA, 22 nt, Human
cgcguggacacagcacaaaaca

SEQ ID NO: 294398 - RNA, 22 nt, Human
cggcaccuggcaaggugaagga

SEQ ID NO: 294399 - RNA, 23 nt, Human
cggcugcgcggagcccgccgccc

SEQ ID NO: 294400 - RNA, 22 nt, Human
cuauucuacaccagccgaaaga

SEQ ID NO: 294401 - RNA, 23 nt, Human
cugaggccugggugcagguaagg

SEQ ID NO: 294402 - RNA, 18 nt, Human
cugccugggcugagcccu

SEQ ID NO: 294403 - RNA, 18 nt, Human
cuggcaaggugaaggacu

SEQ ID NO: 294404 - RNA, 18 nt, Human
gaaaaacaaaacagaaga

SEQ ID NO: 294405 - RNA, 18 nt, Human
gaagauggaggaguucag

SEQ ID NO: 294406 - RNA, 21 nt, Human
gacccaggggcagaagggggu

SEQ ID NO: 294407 - RNA, 21 nt, Human
gagcauggccuuggccccuac

SEQ ID NO: 294408 - RNA, 18 nt, Human
gaggagggaggcauggga

SEQ ID NO: 294409 - RNA, 20 nt, Human
gagugggguggggaggaggg

SEQ ID NO: 294410 - RNA, 21 nt, Human
gcccccaccauccacauccac

SEQ ID NO: 294411 - RNA, 18 nt, Human
gcccuguggcucuuggcc

SEQ ID NO: 294412 - RNA, 20 nt, Human
gccuggcuggcccacccuuc

SEQ ID NO: 294413 - RNA, 18 nt, Human
gcggagcccgccgcccgc

SEQ ID NO: 294414 - RNA, 19 nt, Human
gcguggacacagcacaaaa

SEQ ID NO: 294415 - RNA, 20 nt, Human
gcugcgcggagcccgccgcc

SEQ ID NO: 294416 - RNA, 20 nt, Human
ggacccaggggcagaagggg

SEQ ID NO: 294417 - RNA, 22 nt, Human
ggagaagucaguacgggggagg

SEQ ID NO: 294418 - RNA, 19 nt, Human
ggaggcaugggauggaugg

SEQ ID NO: 294419 - RNA, 20 nt, Human
ggagggggcgcuacacuacu

SEQ ID NO: 294420 - RNA, 21 nt, Human
ggagugggguggggaggaggg

SEQ ID NO: 294421 - RNA, 22 nt, Human
ggagugggguggggaggaggga

SEQ ID NO: 294422 - RNA, 21 nt, Human
ggcaggucugggguucucugg

SEQ ID NO: 294423 - RNA, 19 nt, Human
ggcguugggaagaggcuug

SEQ ID NO: 294424 - RNA, 19 nt, Human
gggaccugguccuaaaccu

SEQ ID NO: 294425 - RNA, 19 nt, Human
gggaggagggaggcauggg

SEQ ID NO: 294426 - RNA, 21 nt, Human
gggcagaagggggugggagaa

SEQ ID NO: 294427 - RNA, 19 nt, Human
gggcguugggaagaggcuu

SEQ ID NO: 294428 - RNA, 18 nt, Human
ggggaagggguaggugcu

SEQ ID NO: 294429 - RNA, 30 nt, Human
ggggaggagggaggcaugggauggaugggg

SEQ ID NO: 294430 - RNA, 24 nt, Human
ggggagggggucgccuuagcgcgu

SEQ ID NO: 294431 - RNA, 27 nt, Human
ggggcagaagggggugggagaagaagg

SEQ ID NO: 294432 - RNA, 19 nt, Human
gggguggggaggagggagg

SEQ ID NO: 294433 - RNA, 20 nt, Human
gggguggggaggagggaggc

SEQ ID NO: 294434 - RNA, 21 nt, Human
guccaugcccccaccauccac

SEQ ID NO: 294435 - RNA, 23 nt, Human
gugaaggacugaggcuucaggag

SEQ ID NO: 294436 - RNA, 19 nt, Human
uacagagccuccuccaagg

SEQ ID NO: 294437 - RNA, 20 nt, Human
uacagagccuccuccaaggg

SEQ ID NO: 294438 - RNA, 21 nt, Human
uaccaguauucuggggguuag

SEQ ID NO: 294439 - RNA, 18 nt, Human
uacucgggaaagaggaac

SEQ ID NO: 294440 - RNA, 19 nt, Human
uagcccugaaacucugagg

SEQ ID NO: 294441 - RNA, 23 nt, Human
uagcccugaaacucugaggccug

SEQ ID NO: 294442 - RNA, 24 nt, Human
uaggagaagucaguacgggggagg

SEQ ID NO: 294443 - RNA, 25 nt, Human
uaucuuaccaccccauacugucuug

SEQ ID NO: 294444 - RNA, 19 nt, Human
uauguagugggaagggucc

SEQ ID NO: 294445 - RNA, 20 nt, Human
ucagcccaaagcuggcugcc

SEQ ID NO: 294446 - RNA, 18 nt, Human
ucaguccccugaggacau

SEQ ID NO: 294447 - RNA, 24 nt, Human
uccaaaacuugagcauugaucuug

SEQ ID NO: 294448 - RNA, 26 nt, Human
uccacacacuucccuuccuuaucuua

SEQ ID NO: 294449 - RNA, 19 nt, Human
uccacauccacacacuucc

SEQ ID NO: 294450 - RNA, 22 nt, Human
uccaccaguggcaccucuggag

SEQ ID NO: 294451 - RNA, 19 nt, Human
ugaaaaacaaaacagaaga

SEQ ID NO: 294452 - RNA, 21 nt, Human
ugaaaaacaaaacagaagacu

SEQ ID NO: 294453 - RNA, 18 nt, Human
ugacccuuccaccagugg

SEQ ID NO: 294454 - RNA, 22 nt, Human
ugacccuuccaccaguggcacc

SEQ ID NO: 294455 - RNA, 24 nt, Human
ugcccuagcucccugccuccccaa

SEQ ID NO: 294456 - RNA, 19 nt, Human
ugccugggcugagcccuau

SEQ ID NO: 294457 - RNA, 23 nt, Human
ugccugggcugagcccuauuaug

SEQ ID NO: 294458 - RNA, 22 nt, Human
ugcuggggcuccgcuccggggg

SEQ ID NO: 294459 - RNA, 21 nt, Human
uggaaacgucaaacaaugaaa

SEQ ID NO: 294460 - RNA, 25 nt, Human
uggaaacgucaaacaaugaaaaaca

SEQ ID NO: 294461 - RNA, 18 nt, Human
uggaaggaggugaagggg

SEQ ID NO: 294462 - RNA, 21 nt, Human
uggaaggaggugaaggggcug

SEQ ID NO: 294463 - RNA, 22 nt, Human
uggaaggaggugaaggggcugg

SEQ ID NO: 294464 - RNA, 18 nt, Human
uggaaucuggaggauguu

SEQ ID NO: 294465 - RNA, 22 nt, Human
uggaaucuggaggauguuguca

SEQ ID NO: 294466 - RNA, 21 nt, Human
uggacacagcacaaaacacaa

SEQ ID NO: 294467 - RNA, 19 nt, Human
uggaggauguugucagucc

SEQ ID NO: 294468 - RNA, 21 nt, Human
uggagugggguggggaggagg

SEQ ID NO: 294469 - RNA, 23 nt, Human
uggauggccggggacccaggggc

SEQ ID NO: 294470 - RNA, 29 nt, Human
uggcaaaugguucuuggugucuacaguaa

SEQ ID NO: 294471 - RNA, 19 nt, Human
uggcaaggugaaggacuga

SEQ ID NO: 294472 - RNA, 21 nt, Human
uggcaaggugaaggacugagg

SEQ ID NO: 294473 - RNA, 23 nt, Human
uggcaccucuggaguacccagca

SEQ ID NO: 294474 - RNA, 24 nt, Human
uggcaccucuggaguacccagcac

SEQ ID NO: 294475 - RNA, 18 nt, Human
uggcugccugggcugagc

SEQ ID NO: 294476 - RNA, 21 nt, Human
uggcugccugggcugagcccu

SEQ ID NO: 294477 - RNA, 19 nt, Human
ugggaaggguccagccuag

SEQ ID NO: 294478 - RNA, 20 nt, Human
ugggaaggguccagccuagu

SEQ ID NO: 294479 - RNA, 20 nt, Human
ugggaaggguccagccuagu

SEQ ID NO: 294480 - RNA, 19 nt, Human
ugggauggaugggccugau

SEQ ID NO: 294481 - RNA, 20 nt, Human
ugggcugguuggggagaggc

SEQ ID NO: 294482 - RNA, 22 nt, Human
uggggaccugggcaguggccuu

SEQ ID NO: 294483 - RNA, 20 nt, Human
uggggaggagggaggcaugg

SEQ ID NO: 294484 - RNA, 21 nt, Human
uggggaggagggaggcauggg

SEQ ID NO: 294485 - RNA, 18 nt, Human
ugggugcagguaaggaga

SEQ ID NO: 294486 - RNA, 26 nt, Human
ugguagcaaaaugcccucccuaaauc

SEQ ID NO: 294487 - RNA, 21 nt, Human
ugguccccagggcguugggaa

SEQ ID NO: 294488 - RNA, 20 nt, Human
uggucccugcccuagcuccc

SEQ ID NO: 294489 - RNA, 23 nt, Human
ugguuuauggcuggaaucuggag

SEQ ID NO: 294490 - RNA, 18 nt, Human
uguaagggcaggucuggg

SEQ ID NO: 294491 - RNA, 23 nt, Human
ugucuacaguaaccccacuaccc

SEQ ID NO: 294492 - RNA, 19 nt, Human
uguggcaaaugguucuugg

SEQ ID NO: 294493 - RNA, 23 nt, Human
uguggcaaaugguucuugguguc

SEQ ID NO: 294494 - RNA, 20 nt, Human
uugauuuggaagauggagga

SEQ ID NO: 294495 - RNA, 19 nt, Human
uuggaagauggaggaguuc

SEQ ID NO: 294496 - RNA, 21 nt, Human
uuguuucuguuucccaagggg

SEQ ID NO: 294497 - RNA, 21 nt, Human
uuguuugaggaggaggugggg

SEQ ID NO: 294498 - RNA, 21 nt, Human
uuuaaccaggcuauggccacu

SEQ ID NO: 294499 - RNA, 18 nt, Human
uuuucagaacuaggaggc

SEQ ID NO: 294500 - RNA, 21 nt, Human
aaaacacaacacgggccgccg

SEQ ID NO: 294501 - RNA, 24 nt, Human
aaaacagaagacugguccccaggg

SEQ ID NO: 294502 - RNA, 19 nt, Human
aaaagcacaccgcacuaca

SEQ ID NO: 294503 - RNA, 25 nt, Human
aaacaaaacagaagacuggucccca

SEQ ID NO: 294504 - RNA, 25 nt, Human
aaacaaaacagaagacuggucccca

SEQ ID NO: 294505 - RNA, 22 nt, Human
aaacaaugaaaaacaaaacaga

SEQ ID NO: 294506 - RNA, 20 nt, Human
aaaugcccucccuaaauccc

SEQ ID NO: 294507 - RNA, 19 nt, Human
aacagaagacugguccccc

SEQ ID NO: 294508 - RNA, 23 nt, Human
aagcuggcugccugggcugagcc

SEQ ID NO: 294509 - RNA, 25 nt, Human
acaaaacacaacacgggccgccgcg

SEQ ID NO: 294510 - RNA, 22 nt, Human
acaaaacagaagacuggucccc

SEQ ID NO: 294511 - RNA, 27 nt, Human
acagagccuccuccaaggccuugauaa

SEQ ID NO: 294512 - RNA, 22 nt, Human
acagcacaaaacacaacacggg

SEQ ID NO: 294513 - RNA, 21 nt, Human
accaugcuuugggggaagauu

SEQ ID NO: 294514 - RNA, 19 nt, Human
acucgggaaagaggaacug

SEQ ID NO: 294515 - RNA, 22 nt, Human
acugaaaugccaguuuaaucca

SEQ ID NO: 294516 - RNA, 20 nt, Human
agaaggucuaugcacaagga

SEQ ID NO: 294517 - RNA, 19 nt, Human
agaggaacuguuggagugg

SEQ ID NO: 294518 - RNA, 24 nt, Human
agcucagcccaaagcuggcugccu

SEQ ID NO: 294519 - RNA, 21 nt, Human
aggacauacagagccuccucc

SEQ ID NO: 294520 - RNA, 23 nt, Human
aggagaagucaguacgggggagg

SEQ ID NO: 294521 - RNA, 22 nt, Human
aggaggcuuguagguuacuugg

SEQ ID NO: 294522 - RNA, 20 nt, Human
aggagggaggcaugggaugg

SEQ ID NO: 294523 - RNA, 18 nt, Human
aggagggcaggggcccug

SEQ ID NO: 294524 - RNA, 19 nt, Human
aggaggugggggaagucaa

SEQ ID NO: 294525 - RNA, 23 nt, Human
agggaggcaugggauggaugggg

SEQ ID NO: 294526 - RNA, 21 nt, Human
aggggcagaagggggugggag

SEQ ID NO: 294527 - RNA, 18 nt, Human
agggggcgcacuggggac

SEQ ID NO: 294528 - RNA, 25 nt, Human
auacagagccuccuccaaccggagg

SEQ ID NO: 294529 - RNA, 20 nt, Human
auucuacaccagccgaaaga

SEQ ID NO: 294530 - RNA, 21 nt, Human
caaaacagaagacuggucccc

SEQ ID NO: 294531 - RNA, 22 nt, Human
caacaccccaaccaccuuacuc

SEQ ID NO: 294532 - RNA, 20 nt, Human
caagaggucaugaugcccuu

SEQ ID NO: 294533 - RNA, 21 nt, Human
cacacuucccuuccuuaucuu

SEQ ID NO: 294534 - RNA, 21 nt, Human
caccccauacugucuuggaac

SEQ ID NO: 294535 - RNA, 20 nt, Human
caccgcacuacacuacuggc

SEQ ID NO: 294536 - RNA, 18 nt, Human
cacuggggaccugggcag

SEQ ID NO: 294537 - RNA, 25 nt, Human
cagagccuccuccaaggccuugaua

SEQ ID NO: 294538 - RNA, 20 nt, Human
cagcccaaagcuggcugccu

SEQ ID NO: 294539 - RNA, 22 nt, Human
caggagggcaggggcccuguug

SEQ ID NO: 294540 - RNA, 22 nt, Human
caguauucuggggguuagcccu

SEQ ID NO: 294541 - RNA, 21 nt, Human
cauacagagccuccuccaagg

SEQ ID NO: 294542 - RNA, 29 nt, Human
ccacccgccaucacguaaaagcacaccgg

SEQ ID NO: 294543 - RNA, 23 nt, Human
ccauacugucuuggaacaugcag

SEQ ID NO: 294544 - RNA, 26 nt, Human
ccauacugucuuggaacaugcagugg

SEQ ID NO: 294545 - RNA, 21 nt, Human
cccacagaggccccucugacc

SEQ ID NO: 294546 - RNA, 21 nt, Human
cccaccauccacauccacaca

SEQ ID NO: 294547 - RNA, 19 nt, Human
cccaggggcagaagggggu

SEQ ID NO: 294548 - RNA, 18 nt, Human
ccccacuacccccauggg

SEQ ID NO: 294549 - RNA, 20 nt, Human
ccccacuacccccaugggua

SEQ ID NO: 294550 - RNA, 21 nt, Human
ccccacuacccccauggguac

SEQ ID NO: 294551 - RNA, 27 nt, Human
cccccaccauccacauccacacacuuc

SEQ ID NO: 294552 - RNA, 25 nt, Human
cccccugggggggaagggguaggug

SEQ ID NO: 294553 - RNA, 21 nt, Human
ccccugaggacauacagagcc

SEQ ID NO: 294554 - RNA, 21 nt, Human
ccgccgcccgcugcccacccg

SEQ ID NO: 294555 - RNA, 22 nt, Human
ccucucaaggggaccugguccu

SEQ ID NO: 294556 - RNA, 22 nt, Human
ccuggcuggcccacccuuccug

SEQ ID NO: 294557 - RNA, 19 nt, Human
ccugggcugagacuuucug

SEQ ID NO: 294558 - RNA, 21 nt, Human
ccugggcugagcccuauuaug

SEQ ID NO: 294559 - RNA, 21 nt, Human
ccuguuagcucagcccaaagc

SEQ ID NO: 294560 - RNA, 24 nt, Human
cgcccgcugcccacccgccaucac

SEQ ID NO: 294561 - RNA, 22 nt, Human
cgcguggacacagcacaaaaca

SEQ ID NO: 294562 - RNA, 22 nt, Human
cggcaccuggcaaggugaagga

SEQ ID NO: 294563 - RNA, 23 nt, Human
cggcugcgcggagcccgccgccc

SEQ ID NO: 294564 - RNA, 23 nt, Human
cugaggccugggugcagguaagg

SEQ ID NO: 294565 - RNA, 18 nt, Human
cugccugggcugagcccu

SEQ ID NO: 294566 - RNA, 18 nt, Human
cuggcaaggugaaggacu

SEQ ID NO: 294567 - RNA, 22 nt, Human
cuuguuugaggaggaggugggg

SEQ ID NO: 294568 - RNA, 22 nt, Human
cuuuaaccaggcuauggccacu

SEQ ID NO: 294569 - RNA, 18 nt, Human
gaaaaacaaaacagaaga

SEQ ID NO: 294570 - RNA, 18 nt, Human
gaagauggaggaguucag

SEQ ID NO: 294571 - RNA, 21 nt, Human
gacccaggggcagaagggggu

SEQ ID NO: 294572 - RNA, 21 nt, Human
gagcauggccuuggccccuac

SEQ ID NO: 294573 - RNA, 20 nt, Human
gagugggguggggaggaggg

SEQ ID NO: 294574 - RNA, 21 nt, Human
gcccccaccauccacauccac

SEQ ID NO: 294575 - RNA, 18 nt, Human
gcccuguggcucuuggcc

SEQ ID NO: 294576 - RNA, 20 nt, Human
gccuggcuggcccacccuuc

SEQ ID NO: 294577 - RNA, 18 nt, Human
gcggagcccgccgcccgc

SEQ ID NO: 294578 - RNA, 19 nt, Human
gcguggacacagcacaaaa

SEQ ID NO: 294579 - RNA, 19 nt, Human
gcugccugggcugagcccu

SEQ ID NO: 294580 - RNA, 20 nt, Human
gcugcgcggagcccgccgcc

SEQ ID NO: 294581 - RNA, 20 nt, Human
ggacccaggggcagaagggg

SEQ ID NO: 294582 - RNA, 22 nt, Human
ggagaagucaguacgggggagg

SEQ ID NO: 294583 - RNA, 19 nt, Human
ggaggagggaggcauggga

SEQ ID NO: 294584 - RNA, 20 nt, Human
ggagggggcgcuacacuacu

SEQ ID NO: 294585 - RNA, 21 nt, Human
ggagugggguggggaggaggg

SEQ ID NO: 294586 - RNA, 22 nt, Human
ggagugggguggggaggaggga

SEQ ID NO: 294587 - RNA, 21 nt, Human
ggcaggucugggguucucugg

SEQ ID NO: 294588 - RNA, 19 nt, Human
ggcguugggaagaggcuug

SEQ ID NO: 294589 - RNA, 19 nt, Human
gggaccugguccuaaaccu

SEQ ID NO: 294590 - RNA, 19 nt, Human
gggaggagggaggcauggg

SEQ ID NO: 294591 - RNA, 20 nt, Human
gggaggcaugggauggaugg

SEQ ID NO: 294592 - RNA, 21 nt, Human
gggcagaagggggugggagaa

SEQ ID NO: 294593 - RNA, 19 nt, Human
gggcguugggaagaggcuu

SEQ ID NO: 294594 - RNA, 18 nt, Human
ggggaagggguaggugcu

SEQ ID NO: 294595 - RNA, 24 nt, Human
ggggagggggucgccuuagcgcgu

SEQ ID NO: 294596 - RNA, 27 nt, Human
ggggcagaagggggugggagaagaagg

SEQ ID NO: 294597 - RNA, 19 nt, Human
gggguggggaggagggagg

SEQ ID NO: 294598 - RNA, 20 nt, Human
gggguggggaggagggaggc

SEQ ID NO: 294599 - RNA, 21 nt, Human
guccaugcccccaccauccac

SEQ ID NO: 294600 - RNA, 23 nt, Human
gugaaggacugaggcuucaggag

SEQ ID NO: 294601 - RNA, 20 nt, Human
uacagagccuccuccaaggg

SEQ ID NO: 294602 - RNA, 21 nt, Human
uaccaguauucuggggguuag

SEQ ID NO: 294603 - RNA, 18 nt, Human
uacucgggaaagaggaac

SEQ ID NO: 294604 - RNA, 19 nt, Human
uagcccugaaacucugagg

SEQ ID NO: 294605 - RNA, 23 nt, Human
uagcccugaaacucugaggccug

SEQ ID NO: 294606 - RNA, 25 nt, Human
uaucuuaccaccccauacugucuug

SEQ ID NO: 294607 - RNA, 20 nt, Human
ucagcccaaagcuggcugcc

SEQ ID NO: 294608 - RNA, 18 nt, Human
ucaguccccugaggacau

SEQ ID NO: 294609 - RNA, 24 nt, Human
uccaaaacuugagcauugaucuug

SEQ ID NO: 294610 - RNA, 26 nt, Human
uccacacacuucccuuccuuaucuua

SEQ ID NO: 294611 - RNA, 19 nt, Human
uccacauccacacacuucc

SEQ ID NO: 294612 - RNA, 22 nt, Human
uccaccaguggcaccucuggag

SEQ ID NO: 294613 - RNA, 21 nt, Human
ugaaaaacaaaacagaagacu

SEQ ID NO: 294614 - RNA, 18 nt, Human
ugacccuuccaccagugg

SEQ ID NO: 294615 - RNA, 22 nt, Human
ugacccuuccaccaguggcacc

SEQ ID NO: 294616 - RNA, 24 nt, Human
ugcccuagcucccugccuccccaa

SEQ ID NO: 294617 - RNA, 23 nt, Human
ugccugggcugagcccuauuaug

SEQ ID NO: 294618 - RNA, 22 nt, Human
ugcuggggcuccgcuccggggg

SEQ ID NO: 294619 - RNA, 21 nt, Human
uggaaacgucaaacaaugaaa

SEQ ID NO: 294620 - RNA, 25 nt, Human
uggaaacgucaaacaaugaaaaaca

SEQ ID NO: 294621 - RNA, 18 nt, Human
uggaaggaggugaagggg

SEQ ID NO: 294622 - RNA, 21 nt, Human
uggaaggaggugaaggggcug

SEQ ID NO: 294623 - RNA, 22 nt, Human
uggaaggaggugaaggggcugg

SEQ ID NO: 294624 - RNA, 18 nt, Human
uggaaucuggaggauguu

SEQ ID NO: 294625 - RNA, 22 nt, Human
uggaaucuggaggauguuguca

SEQ ID NO: 294626 - RNA, 21 nt, Human
uggacacagcacaaaacacaa

SEQ ID NO: 294627 - RNA, 19 nt, Human
uggaggauguugucagucc

SEQ ID NO: 294628 - RNA, 21 nt, Human
uggagugggguggggaggagg

SEQ ID NO: 294629 - RNA, 23 nt, Human
uggauggccggggacccaggggc

SEQ ID NO: 294630 - RNA, 29 nt, Human
uggcaaaugguucuuggugucuacaguaa

SEQ ID NO: 294631 - RNA, 19 nt, Human
uggcaaggugaaggacuga

SEQ ID NO: 294632 - RNA, 21 nt, Human
uggcaaggugaaggacugagg

SEQ ID NO: 294633 - RNA, 23 nt, Human
uggcaccucuggaguacccagca

SEQ ID NO: 294634 - RNA, 24 nt, Human
uggcaccucuggaguacccagcac

SEQ ID NO: 294635 - RNA, 18 nt, Human
uggcugccugggcugagc

SEQ ID NO: 294636 - RNA, 19 nt, Human
ugggaaggguccagccuag

SEQ ID NO: 294637 - RNA, 20 nt, Human
ugggaaggguccagccuagu

SEQ ID NO: 294638 - RNA, 20 nt, Human
ugggaaggguccagccuagu

SEQ ID NO: 294639 - RNA, 19 nt, Human
ugggauggaugggccugau

SEQ ID NO: 294640 - RNA, 20 nt, Human
ugggcugguuggggagaggc

SEQ ID NO: 294641 - RNA, 22 nt, Human
uggggaccugggcaguggccuu

SEQ ID NO: 294642 - RNA, 20 nt, Human
uggggaggagggaggcaugg

SEQ ID NO: 294643 - RNA, 21 nt, Human
uggggaggagggaggcauggg

SEQ ID NO: 294644 - RNA, 18 nt, Human
ugggugcagguaaggaga

SEQ ID NO: 294645 - RNA, 26 nt, Human
ugguagcaaaaugcccucccuaaauc

SEQ ID NO: 294646 - RNA, 21 nt, Human
ugguccccagggcguugggaa

SEQ ID NO: 294647 - RNA, 20 nt, Human
uggucccugcccuagcuccc

SEQ ID NO: 294648 - RNA, 23 nt, Human
ugguuuauggcuggaaucuggag

SEQ ID NO: 294649 - RNA, 18 nt, Human
uguaagggcaggucuggg

SEQ ID NO: 294650 - RNA, 23 nt, Human
ugucuacaguaaccccacuaccc

SEQ ID NO: 294651 - RNA, 19 nt, Human
uguggcaaaugguucuugg

SEQ ID NO: 294652 - RNA, 23 nt, Human
uguggcaaaugguucuugguguc

SEQ ID NO: 294653 - RNA, 20 nt, Human
uuauguagugggaagggucc

SEQ ID NO: 294654 - RNA, 20 nt, Human
uugauuuggaagauggagga

SEQ ID NO: 294655 - RNA, 21 nt, Human
uuguuucuguuucccaagggg

SEQ ID NO: 294656 - RNA, 18 nt, Human
uuuucagaacuaggaggc

SEQ ID NO: 294657 - RNA, 21 nt, Human
aaaacacaacacgggccgccg

SEQ ID NO: 294658 - RNA, 24 nt, Human
aaaacagaagacugguccccaggg

SEQ ID NO: 294659 - RNA, 19 nt, Human
aaaagcacaccgcacuaca

SEQ ID NO: 294660 - RNA, 24 nt, Human
aaacaaaacagaagacuggucccc

SEQ ID NO: 294661 - RNA, 25 nt, Human
aaacaaaacagaagacuggucccca

SEQ ID NO: 294662 - RNA, 25 nt, Human
aaacaaaacagaagacuggucccca

SEQ ID NO: 294663 - RNA, 23 nt, Human
aaacagaagacugguccccaggg

SEQ ID NO: 294664 - RNA, 20 nt, Human
aaagaggaacuguuggagug

SEQ ID NO: 294665 - RNA, 20 nt, Human
aaaugcccucccuaaauccc

SEQ ID NO: 294666 - RNA, 19 nt, Human
aacagaagacugguccccc

SEQ ID NO: 294667 - RNA, 19 nt, Human
aagaggucaugaugcccuu

SEQ ID NO: 294668 - RNA, 23 nt, Human
aagcuggcugccugggcugagcc

SEQ ID NO: 294669 - RNA, 25 nt, Human
acaaaacacaacacgggccgccgcg

SEQ ID NO: 294670 - RNA, 22 nt, Human
acaaaacagaagacuggucccc

SEQ ID NO: 294671 - RNA, 18 nt, Human
acagagccuccuccaagg

SEQ ID NO: 294672 - RNA, 27 nt, Human
acagagccuccuccaaggccuugauaa

SEQ ID NO: 294673 - RNA, 22 nt, Human
acagcacaaaacacaacacggg

SEQ ID NO: 294674 - RNA, 21 nt, Human
accaugcuuugggggaagauu

SEQ ID NO: 294675 - RNA, 19 nt, Human
acucgggaaagaggaacug

SEQ ID NO: 294676 - RNA, 22 nt, Human
acugaaaugccaguuuaaucca

SEQ ID NO: 294677 - RNA, 20 nt, Human
agaaggucuaugcacaagga

SEQ ID NO: 294678 - RNA, 19 nt, Human
agaggaacuguuggagugg

SEQ ID NO: 294679 - RNA, 24 nt, Human
agcucagcccaaagcuggcugccu

SEQ ID NO: 294680 - RNA, 21 nt, Human
aggacauacagagccuccucc

SEQ ID NO: 294681 - RNA, 22 nt, Human
aggaggcuuguagguuacuugg

SEQ ID NO: 294682 - RNA, 20 nt, Human
aggagggaggcaugggaugg

SEQ ID NO: 294683 - RNA, 18 nt, Human
aggagggcaggggcccug

SEQ ID NO: 294684 - RNA, 19 nt, Human
aggaggugggggaagucaa

SEQ ID NO: 294685 - RNA, 24 nt, Human
aggcaaaguaaaacucacauguag

SEQ ID NO: 294686 - RNA, 19 nt, Human
agggagggacucaauggcg

SEQ ID NO: 294687 - RNA, 18 nt, Human
agggggcgcacuggggac

SEQ ID NO: 294688 - RNA, 25 nt, Human
auacagagccuccuccaaccggagg

SEQ ID NO: 294689 - RNA, 24 nt, Human
auggccccuuugaaaucaaaagaa

SEQ ID NO: 294690 - RNA, 20 nt, Human
auucuacaccagccgaaaga

SEQ ID NO: 294691 - RNA, 21 nt, Human
caaaacagaagacuggucccc

SEQ ID NO: 294692 - RNA, 23 nt, Human
caaacaaugaaaaacaaaacaga

SEQ ID NO: 294693 - RNA, 22 nt, Human
caacaccccaaccaccuuacuc

SEQ ID NO: 294694 - RNA, 20 nt, Human
caagaggucaugaugcccuu

SEQ ID NO: 294695 - RNA, 21 nt, Human
cacacuucccuuccuuaucuu

SEQ ID NO: 294696 - RNA, 21 nt, Human
caccccauacugucuuggaac

SEQ ID NO: 294697 - RNA, 20 nt, Human
caccgcacuacacuacuggc

SEQ ID NO: 294698 - RNA, 18 nt, Human
cacuggggaccugggcag

SEQ ID NO: 294699 - RNA, 25 nt, Human
cagagccuccuccaaggccuugaua

SEQ ID NO: 294700 - RNA, 20 nt, Human
cagcccaaagcuggcugccu

SEQ ID NO: 294701 - RNA, 22 nt, Human
caggagggcaggggcccuguug

SEQ ID NO: 294702 - RNA, 22 nt, Human
caggggcagaagggggugggag

SEQ ID NO: 294703 - RNA, 22 nt, Human
caguauucuggggguuagcccu

SEQ ID NO: 294704 - RNA, 21 nt, Human
cauacagagccuccuccaagg

SEQ ID NO: 294705 - RNA, 25 nt, Human
cauccaaaauauaucagaaagcgaa

SEQ ID NO: 294706 - RNA, 23 nt, Human
ccacacacuucccuuccuuaucu

SEQ ID NO: 294707 - RNA, 20 nt, Human
ccacagaggccccucugacc

SEQ ID NO: 294708 - RNA, 23 nt, Human
ccauacugucuuggaacaugcag

SEQ ID NO: 294709 - RNA, 26 nt, Human
ccauacugucuuggaacaugcagugg

SEQ ID NO: 294710 - RNA, 21 nt, Human
cccacagaggccccucugacc

SEQ ID NO: 294711 - RNA, 21 nt, Human
cccaccauccacauccacaca

SEQ ID NO: 294712 - RNA, 30 nt, Human; identical to SEQ ID NO: 294382

SEQ ID NO: 294713 - RNA, 19 nt, Human
cccaggggcagaagggggu

SEQ ID NO: 294714 - RNA, 19 nt, Human
ccccacuacccccaugggu

SEQ ID NO: 294715 - RNA, 19 nt, Human
ccccacuacccccaugggu

SEQ ID NO: 294716 - RNA, 20 nt, Human
ccccacuacccccaugggua

SEQ ID NO: 294717 - RNA, 21 nt, Human
ccccacuacccccauggguac

SEQ ID NO: 294718 - RNA, 27 nt, Human
cccccaccauccacauccacacacuuc

SEQ ID NO: 294719 - RNA, 18 nt, Human
cccccccccaaacaguuu

SEQ ID NO: 294720 - RNA, 25 nt, Human
cccccugggggggaagggguaggug

SEQ ID NO: 294721 - RNA, 21 nt, Human
ccccugaggacauacagagcc

SEQ ID NO: 294722 - RNA, 18 nt, Human
ccccugggggggaagggg

SEQ ID NO: 294723 - RNA, 21 nt, Human
ccgccccaccccccccccaaa

SEQ ID NO: 294724 - RNA, 22 nt, Human
ccgccccaccccccccccaaac

SEQ ID NO: 294725 - RNA, 21 nt, Human
ccgccgcccgcugcccacccg

SEQ ID NO: 294726 - RNA, 22 nt, Human
ccucucaaggggaccugguccu

SEQ ID NO: 294727 - RNA, 22 nt, Human
ccuggcuggcccacccuuccug

SEQ ID NO: 294728 - RNA, 19 nt, Human
ccugggcugagacuuucug

SEQ ID NO: 294729 - RNA, 21 nt, Human
ccugggcugagcccuauuaug

SEQ ID NO: 294730 - RNA, 21 nt, Human
ccuguuagcucagcccaaagc

SEQ ID NO: 294731 - RNA, 19 nt, Human
cgccccaccccccccccaa

SEQ ID NO: 294732 - RNA, 24 nt, Human
cgcccgcugcccacccgccaucac

SEQ ID NO: 294733 - RNA, 19 nt, Human
cgcccuguggcucuuggcc

SEQ ID NO: 294734 - RNA, 18 nt, Human
cgccgcccgcugcccacc

SEQ ID NO: 294735 - RNA, 22 nt, Human
cgcguggacacagcacaaaaca

SEQ ID NO: 294736 - RNA, 22 nt, Human
cggcaccuggcaaggugaagga

SEQ ID NO: 294737 - RNA, 23 nt, Human
cggcugcgcggagcccgccgccc

SEQ ID NO: 294738 - RNA, 22 nt, Human
cuauucuacaccagccgaaaga

SEQ ID NO: 294739 - RNA, 22 nt, Human
cucagcccaaagcuggcugccu

SEQ ID NO: 294740 - RNA, 21 nt, Human
cucucaaggggaccugguccu

SEQ ID NO: 294741 - RNA, 23 nt, Human
cugaggccugggugcagguaagg

SEQ ID NO: 294742 - RNA, 18 nt, Human
cugccugggcugagcccu

SEQ ID NO: 294743 - RNA, 18 nt, Human
cuggcaaggugaaggacu

SEQ ID NO: 294744 - RNA, 22 nt, Human
cuuguuugaggaggaggugggg

SEQ ID NO: 294745 - RNA, 22 nt, Human
cuuuaaccaggcuauggccacu

SEQ ID NO: 294746 - RNA, 18 nt, Human
gaaaaacaaaacagaaga

SEQ ID NO: 294747 - RNA, 21 nt, Human
gaaagauuaucguaaucucau

SEQ ID NO: 294748 - RNA, 18 nt, Human
gaagauggaggaguucag

SEQ ID NO: 294749 - RNA, 21 nt, Human
gacccaggggcagaagggggu

SEQ ID NO: 294750 - RNA, 22 nt, Human
gagcagcggcgccuagagccca

SEQ ID NO: 294751 - RNA, 21 nt, Human
gagcauggccuuggccccuac

SEQ ID NO: 294752 - RNA, 18 nt, Human
gaggagggaggcauggga

SEQ ID NO: 294753 - RNA, 20 nt, Human
gagugggguggggaggaggg

SEQ ID NO: 294754 - RNA, 21 nt, Human
gcccccaccauccacauccac

SEQ ID NO: 294755 - RNA, 18 nt, Human
gcccuguggcucuuggcc

SEQ ID NO: 294756 - RNA, 20 nt, Human
gccuggcuggcccacccuuc

SEQ ID NO: 294757 - RNA, 18 nt, Human
gcggagcccgccgcccgc

SEQ ID NO: 294758 - RNA, 19 nt, Human
gcguggacacagcacaaaa

SEQ ID NO: 294759 - RNA, 21 nt, Human
gcguggacacagcacaaaaca

SEQ ID NO: 294760 - RNA, 20 nt, Human
gcugcgcggagcccgccgcc

SEQ ID NO: 294761 - RNA, 20 nt, Human
ggacccaggggcagaagggg

SEQ ID NO: 294762 - RNA, 22 nt, Human
ggagaagucaguacgggggagg

SEQ ID NO: 294763 - RNA, 19 nt, Human
ggaggagggaggcauggga

SEQ ID NO: 294764 - RNA, 19 nt, Human
ggaggcaugggauggaugg

SEQ ID NO: 294765 - RNA, 20 nt, Human
ggagggggcgcuacacuacu

SEQ ID NO: 294766 - RNA, 21 nt, Human
ggagugggguggggaggaggg

SEQ ID NO: 294767 - RNA, 22 nt, Human
ggagugggguggggaggaggga

SEQ ID NO: 294768 - RNA, 21 nt, Human
ggcaggucugggguucucugg

SEQ ID NO: 294769 - RNA, 19 nt, Human
ggcguugggaagaggcuug

SEQ ID NO: 294770 - RNA, 19 nt, Human
gggaccugguccuaaaccu

SEQ ID NO: 294771 - RNA, 19 nt, Human
gggaggagggaggcauggg

SEQ ID NO: 294772 - RNA, 20 nt, Human
gggaggcaugggauggaugg

SEQ ID NO: 294773 - RNA, 21 nt, Human
gggcagaagggggugggagaa

SEQ ID NO: 294774 - RNA, 19 nt, Human
gggcguugggaagaggcuu

SEQ ID NO: 294775 - RNA, 18 nt, Human
ggggaagggguaggugcu

SEQ ID NO: 294776 - RNA, 19 nt, Human
ggggagaggccgcccugug

SEQ ID NO: 294777 - RNA, 30 nt, Human; identical to SEQ ID NO: 294429

SEQ ID NO: 294778 - RNA, 24 nt, Human
ggggagggggucgccuuagcgcgu

SEQ ID NO: 294779 - RNA, 27 nt, Human
ggggcagaagggggugggagaagaagg

SEQ ID NO: 294780 - RNA, 19 nt, Human
gggguggggaggagggagg

SEQ ID NO: 294781 - RNA, 20 nt, Human
gggguggggaggagggaggc

SEQ ID NO: 294782 - RNA, 21 nt, Human
guccaugcccccaccauccac

SEQ ID NO: 294783 - RNA, 23 nt, Human
gugaaggacugaggcuucaggag

SEQ ID NO: 294784 - RNA, 19 nt, Human
uacagagccuccuccaagg

SEQ ID NO: 294785 - RNA, 20 nt, Human
uacagagccuccuccaaggg

SEQ ID NO: 294786 - RNA, 21 nt, Human
uaccaguauucuggggguuag

SEQ ID NO: 294787 - RNA, 18 nt, Human
uacucgggaaagaggaac

SEQ ID NO: 294788 - RNA, 19 nt, Human
uagcccugaaacucugagg

SEQ ID NO: 294789 - RNA, 23 nt, Human
uagcccugaaacucugaggccug

SEQ ID NO: 294790 - RNA, 24 nt, Human
uaggagaagucaguacgggggagg

SEQ ID NO: 294791 - RNA, 25 nt, Human
uaucuuaccaccccauacugucuug

SEQ ID NO: 294792 - RNA, 23 nt, Human
uaugccgccccacccccccccca

SEQ ID NO: 294793 - RNA, 19 nt, Human
uauguagugggaagggucc

SEQ ID NO: 294794 - RNA, 20 nt, Human
ucaauggcgcgcagcuuccc

SEQ ID NO: 294795 - RNA, 20 nt, Human
ucagcccaaagcuggcugcc

SEQ ID NO: 294796 - RNA, 18 nt, Human
ucaguccccugaggacau

SEQ ID NO: 294797 - RNA, 24 nt, Human
uccaaaacuugagcauugaucuug

SEQ ID NO: 294798 - RNA, 23 nt, Human
uccaaaauauaucagaaagcgaa

SEQ ID NO: 294799 - RNA, 26 nt, Human
uccacacacuucccuuccuuaucuua

SEQ ID NO: 294800 - RNA, 19 nt, Human
uccacauccacacacuucc

SEQ ID NO: 294801 - RNA, 22 nt, Human
uccaccaguggcaccucuggag

SEQ ID NO: 294802 - RNA, 21 nt, Human
ugaaaaacaaaacagaagacu

SEQ ID NO: 294803 - RNA, 21 nt, Human
ugaaaucaaaagaaaauaugc

SEQ ID NO: 294804 - RNA, 25 nt, Human
ugaaaucaaaagaaaauaugccaag

SEQ ID NO: 294805 - RNA, 24 nt, Human
ugaauggccccuuugaaaucaaaa

SEQ ID NO: 294806 - RNA, 18 nt, Human
ugacccuuccaccagugg

SEQ ID NO: 294807 - RNA, 22 nt, Human
ugacccuuccaccaguggcacc

SEQ ID NO: 294808 - RNA, 20 nt, Human
ugauaauagaaaaauaauac

SEQ ID NO: 294809 - RNA, 20 nt, Human
ugccaagauugaaaaaugac

SEQ ID NO: 294810 - RNA, 24 nt, Human
ugcccuagcucccugccuccccaa

SEQ ID NO: 294811 - RNA, 21 nt, Human
ugccgccccacccccccccca

SEQ ID NO: 294812 - RNA, 24 nt, Human
ugccgccccaccccccccccaaac

SEQ ID NO: 294813 - RNA, 19 nt, Human
ugccugggcugagcccuau

SEQ ID NO: 294814 - RNA, 23 nt, Human
ugccugggcugagcccuauuaug

SEQ ID NO: 294815 - RNA, 21 nt, Human
ugcuggggcuccgcuccgggg

SEQ ID NO: 294816 - RNA, 22 nt, Human
ugcuggggcuccgcuccggggg

SEQ ID NO: 294817 - RNA, 21 nt, Human
uggaaacgucaaacaaugaaa

SEQ ID NO: 294818 - RNA, 25 nt, Human
uggaaacgucaaacaaugaaaaaca

SEQ ID NO: 294819 - RNA, 18 nt, Human
uggaaggaggugaagggg

SEQ ID NO: 294820 - RNA, 21 nt, Human
uggaaggaggugaaggggcug

SEQ ID NO: 294821 - RNA, 22 nt, Human
uggaaggaggugaaggggcugg

SEQ ID NO: 294822 - RNA, 18 nt, Human
uggaaucuggaggauguu

SEQ ID NO: 294823 - RNA, 22 nt, Human
uggaaucuggaggauguuguca

SEQ ID NO: 294824 - RNA, 21 nt, Human
uggacacagcacaaaacacaa

SEQ ID NO: 294825 - RNA, 19 nt, Human
uggaggauguugucagucc

SEQ ID NO: 294826 - RNA, 21 nt, Human
uggagugggguggggaggagg

SEQ ID NO: 294827 - RNA, 23 nt, Human
uggauggccggggacccaggggc

SEQ ID NO: 294828 - RNA, 25 nt, Human
uggcaaaugguucuuggugucuaca

SEQ ID NO: 294829 - RNA, 29 nt, Human
uggcaaaugguucuuggugucuacaguaa

SEQ ID NO: 294830 - RNA, 19 nt, Human
uggcaaggugaaggacuga

SEQ ID NO: 294831 - RNA, 21 nt, Human
uggcaaggugaaggacugagg

SEQ ID NO: 294832 - RNA, 23 nt, Human
uggcaccucuggaguacccagca

SEQ ID NO: 294833 - RNA, 24 nt, Human
uggcaccucuggaguacccagcac

SEQ ID NO: 294834 - RNA, 21 nt, Human
uggccccuuugaaaucaaaag

SEQ ID NO: 294835 - RNA, 18 nt, Human
uggcugccugggcugagc

SEQ ID NO: 294836 - RNA, 21 nt, Human
uggcugccugggcugagcccu

SEQ ID NO: 294837 - RNA, 20 nt, Human
ugggaagaggcuugguagca

SEQ ID NO: 294838 - RNA, 19 nt, Human
ugggaaggguccagccuag

SEQ ID NO: 294839 - RNA, 20 nt, Human
ugggaaggguccagccuagu

SEQ ID NO: 294840 - RNA, 20 nt, Human
ugggaaggguccagccuagu

SEQ ID NO: 294841 - RNA, 19 nt, Human
ugggauggaugggccugau

SEQ ID NO: 294842 - RNA, 20 nt, Human
ugggcugguuggggagaggc

SEQ ID NO: 294843 - RNA, 22 nt, Human
uggggaccugggcaguggccuu

SEQ ID NO: 294844 - RNA, 20 nt, Human
uggggaggagggaggcaugg

SEQ ID NO: 294845 - RNA, 21 nt, Human
uggggaggagggaggcauggg

SEQ ID NO: 294846 - RNA, 18 nt, Human
ugggugcagguaaggaga

SEQ ID NO: 294847 - RNA, 26 nt, Human
ugguagcaaaaugcccucccuaaauc

SEQ ID NO: 294848 - RNA, 21 nt, Human
ugguccccagggcguugggaa

SEQ ID NO: 294849 - RNA, 20 nt, Human
uggucccugcccuagcuccc

SEQ ID NO: 294850 - RNA, 23 nt, Human
ugguuuauggcuggaaucuggag

SEQ ID NO: 294851 - RNA, 18 nt, Human
uguaagggcaggucuggg

SEQ ID NO: 294852 - RNA, 23 nt, Human
ugucuacaguaaccccacuaccc

SEQ ID NO: 294853 - RNA, 19 nt, Human
uguggcaaaugguucuugg

SEQ ID NO: 294854 - RNA, 23 nt, Human
uguggcaaaugguucuugguguc

SEQ ID NO: 294855 - RNA, 20 nt, Human
uuauguagugggaagggucc

SEQ ID NO: 294856 - RNA, 23 nt, Human
uugaauggccccuuugaaaucaa

SEQ ID NO: 294857 - RNA, 20 nt, Human
uugauuuggaagauggagga

SEQ ID NO: 294858 - RNA, 19 nt, Human
uuggaagauggaggaguuc

SEQ ID NO: 294859 - RNA, 21 nt, Human
uuguuucuguuucccaagggg

SEQ ID NO: 294860 - RNA, 21 nt, Human
uuguuugaggaggaggugggg

SEQ ID NO: 294861 - RNA, 18 nt, Human
uuuucagaacuaggaggc

SEQ ID NO: 294862 - RNA, 21 nt, Human
aaaacacaacacgggccgccg

SEQ ID NO: 294863 - RNA, 19 nt, Human
aaaagcacaccgcacuaca

SEQ ID NO: 294864 - RNA, 24 nt, Human
aaacaaaacagaagacuggucccc

SEQ ID NO: 294865 - RNA, 25 nt, Human
aaacaaaacagaagacuggucccca

SEQ ID NO: 294866 - RNA, 23 nt, Human
aaacagaagacugguccccaggg

SEQ ID NO: 294867 - RNA, 18 nt, Human
aaaugcccucccuaaauc

SEQ ID NO: 294868 - RNA, 19 nt, Human
aacagaagacugguccccc

SEQ ID NO: 294869 - RNA, 21 nt, Human
aaccacugaagucaggagcag

SEQ ID NO: 294870 - RNA, 19 nt, Human
aagaggaacuguuggagug

SEQ ID NO: 294871 - RNA, 23 nt, Human
aagcuggcugccugggcugagcc

SEQ ID NO: 294872 - RNA, 25 nt, Human
acaaaacacaacacgggccgccgcg

SEQ ID NO: 294873 - RNA, 22 nt, Human
acaaaacagaagacuggucccc

SEQ ID NO: 294874 - RNA, 18 nt, Human
acagagccuccuccaagg

SEQ ID NO: 294875 - RNA, 27 nt, Human
acagagccuccuccaaggccuugauaa

SEQ ID NO: 294876 - RNA, 22 nt, Human
acagcacaaaacacaacacggg

SEQ ID NO: 294877 - RNA, 21 nt, Human
accaugcuuugggggaagauu

SEQ ID NO: 294878 - RNA, 20 nt, Human
acccuuccaccaguggcacc

SEQ ID NO: 294879 - RNA, 19 nt, Human
acucgggaaagaggaacug

SEQ ID NO: 294880 - RNA, 22 nt, Human
acugaaaugccaguuuaaucca

SEQ ID NO: 294881 - RNA, 20 nt, Human
agaaggucuaugcacaagga

SEQ ID NO: 294882 - RNA, 19 nt, Human
agaggaacuguuggagugg

SEQ ID NO: 294883 - RNA, 24 nt, Human
agcucagcccaaagcuggcugccu

SEQ ID NO: 294884 - RNA, 21 nt, Human
aggacauacagagccuccucc

SEQ ID NO: 294885 - RNA, 22 nt, Human
aggaggcuuguagguuacuugg

SEQ ID NO: 294886 - RNA, 20 nt, Human
aggagggaggcaugggaugg

SEQ ID NO: 294887 - RNA, 18 nt, Human
aggagggcaggggcccug

SEQ ID NO: 294888 - RNA, 19 nt, Human
aggaggugggggaagucaa

SEQ ID NO: 294889 - RNA, 18 nt, Human
agggggcgcacuggggac

SEQ ID NO: 294890 - RNA, 25 nt, Human
auacagagccuccuccaaccggagg

SEQ ID NO: 294891 - RNA, 21 nt, Human
caaaacagaagacuggucccc

SEQ ID NO: 294892 - RNA, 23 nt, Human
caaacaaugaaaaacaaaacaga

SEQ ID NO: 294893 - RNA, 22 nt, Human
caacaccccaaccaccuuacuc

SEQ ID NO: 294894 - RNA, 20 nt, Human
caagaggucaugaugcccuu

SEQ ID NO: 294895 - RNA, 21 nt, Human
cacacuucccuuccuuaucuu

SEQ ID NO: 294896 - RNA, 21 nt, Human
caccccauacugucuuggaac

SEQ ID NO: 294897 - RNA, 20 nt, Human
caccgcacuacacuacuggc

SEQ ID NO: 294898 - RNA, 18 nt, Human
cacuggggaccugggcag

SEQ ID NO: 294899 - RNA, 25 nt, Human
cagagccuccuccaaggccuugaua

SEQ ID NO: 294900 - RNA, 21 nt, Human
cagagcuccuccguuguuucc

SEQ ID NO: 294901 - RNA, 20 nt, Human
cagcccaaagcuggcugccu

SEQ ID NO: 294902 - RNA, 22 nt, Human
caggagggcaggggcccuguug

SEQ ID NO: 294903 - RNA, 22 nt, Human
caggggcagaagggggugggag

SEQ ID NO: 294904 - RNA, 22 nt, Human
caguauucuggggguuagcccu

SEQ ID NO: 294905 - RNA, 20 nt, Human
ccacagaggccccucugacc

SEQ ID NO: 294906 - RNA, 29 nt, Human
ccacccgccaucacguaaaagcacaccgg

SEQ ID NO: 294907 - RNA, 22 nt, Human
ccagggaugguucauuccuagc

SEQ ID NO: 294908 - RNA, 23 nt, Human
ccauacugucuuggaacaugcag

SEQ ID NO: 294909 - RNA, 26 nt, Human
ccauacugucuuggaacaugcagugg

SEQ ID NO: 294910 - RNA, 21 nt, Human
cccaccauccacauccacaca

SEQ ID NO: 294911 - RNA, 19 nt, Human
cccaggggcagaagggggu

SEQ ID NO: 294912 - RNA, 18 nt, Human
cccauagaaugggacagu

SEQ ID NO: 294913 - RNA, 18 nt, Human
ccccacuacccccauggg

SEQ ID NO: 294914 - RNA, 20 nt, Human
ccccacuacccccaugggua

SEQ ID NO: 294915 - RNA, 21 nt, Human
ccccacuacccccauggguac

SEQ ID NO: 294916 - RNA, 27 nt, Human
cccccaccauccacauccacacacuuc

SEQ ID NO: 294917 - RNA, 25 nt, Human
cccccugggggggaagggguaggug

SEQ ID NO: 294918 - RNA, 21 nt, Human
ccccugaggacauacagagcc

SEQ ID NO: 294919 - RNA, 18 nt, Human
ccccugggggggaagggg

SEQ ID NO: 294920 - RNA, 21 nt, Human
ccgccgcccgcugcccacccg

SEQ ID NO: 294921 - RNA, 22 nt, Human
ccucucaaggggaccugguccu

SEQ ID NO: 294922 - RNA, 19 nt, Human
ccuggcuggcccacccuuc

SEQ ID NO: 294923 - RNA, 22 nt, Human
ccuggcuggcccacccuuccug

SEQ ID NO: 294924 - RNA, 19 nt, Human
ccugggcugagacuuucug

SEQ ID NO: 294925 - RNA, 21 nt, Human
ccuguuagcucagcccaaagc

SEQ ID NO: 294926 - RNA, 24 nt, Human
cgcccgcugcccacccgccaucac

SEQ ID NO: 294927 - RNA, 22 nt, Human
cgcguggacacagcacaaaaca

SEQ ID NO: 294928 - RNA, 22 nt, Human
cggcaccuggcaaggugaagga

SEQ ID NO: 294929 - RNA, 22 nt, Human
cuauucuacaccagccgaaaga

SEQ ID NO: 294930 - RNA, 18 nt, Human
cugccugggcugagcccu

SEQ ID NO: 294931 - RNA, 18 nt, Human
cuggcaaggugaaggacu

SEQ ID NO: 294932 - RNA, 22 nt, Human
cuuuaaccaggcuauggccacu

SEQ ID NO: 294933 - RNA, 18 nt, Human
gaaaaacaaaacagaaga

SEQ ID NO: 294934 - RNA, 18 nt, Human
gaagauggaggaguucag

SEQ ID NO: 294935 - RNA, 18 nt, Human
gaagucagagcuccuccg

SEQ ID NO: 294936 - RNA, 21 nt, Human
gacccaggggcagaagggggu

SEQ ID NO: 294937 - RNA, 21 nt, Human
gagcauggccuuggccccuac

SEQ ID NO: 294938 - RNA, 21 nt, Human
gaggccugggugcagguaagg

SEQ ID NO: 294939 - RNA, 20 nt, Human
gagugggguggggaggaggg

SEQ ID NO: 294940 - RNA, 21 nt, Human
gcccccaccauccacauccac

SEQ ID NO: 294941 - RNA, 18 nt, Human
gcccuguggcucuuggcc

SEQ ID NO: 294942 - RNA, 18 nt, Human
gcggagcccgccgcccgc

SEQ ID NO: 294943 - RNA, 19 nt, Human
gcguggacacagcacaaaa

SEQ ID NO: 294944 - RNA, 19 nt, Human
gcugccugggcugagcccu

SEQ ID NO: 294945 - RNA, 20 nt, Human
gcugcgcggagcccgccgcc

SEQ ID NO: 294946 - RNA, 18 nt, Human
ggaagucagagcuccucc

SEQ ID NO: 294947 - RNA, 20 nt, Human
ggacccaggggcagaagggg

SEQ ID NO: 294948 - RNA, 22 nt, Human
ggagaagucaguacgggggagg

SEQ ID NO: 294949 - RNA, 19 nt, Human
ggaggagggaggcauggga

SEQ ID NO: 294950 - RNA, 19 nt, Human
ggaggcaugggauggaugg

SEQ ID NO: 294951 - RNA, 20 nt, Human
ggagggggcgcuacacuacu

SEQ ID NO: 294952 - RNA, 21 nt, Human
ggagugggguggggaggaggg

SEQ ID NO: 294953 - RNA, 22 nt, Human
ggagugggguggggaggaggga

SEQ ID NO: 294954 - RNA, 21 nt, Human
ggcaggucugggguucucugg

SEQ ID NO: 294955 - RNA, 19 nt, Human
ggcguugggaagaggcuug

SEQ ID NO: 294956 - RNA, 19 nt, Human
gggaccugguccuaaaccu

SEQ ID NO: 294957 - RNA, 19 nt, Human
gggaggagggaggcauggg

SEQ ID NO: 294958 - RNA, 21 nt, Human
gggcagaagggggugggagaa

SEQ ID NO: 294959 - RNA, 18 nt, Human
ggggaagggguaggugcu

SEQ ID NO: 294960 - RNA, 19 nt, Human
ggggagaggccgcccugug

SEQ ID NO: 294961 - RNA, 30 nt, Human; identical to SEQ ID NO: 294429

SEQ ID NO: 294962 - RNA, 24 nt, Human
ggggagggggucgccuuagcgcgu

SEQ ID NO: 294963 - RNA, 27 nt, Human
ggggcagaagggggugggagaagaagg

SEQ ID NO: 294964 - RNA, 19 nt, Human
gggguggggaggagggagg

SEQ ID NO: 294965 - RNA, 20 nt, Human
gggguggggaggagggaggc

SEQ ID NO: 294966 - RNA, 23 nt, Human
gugaaggacugaggcuucaggag

SEQ ID NO: 294967 - RNA, 19 nt, Human
uacagagccuccuccaagg

SEQ ID NO: 294968 - RNA, 20 nt, Human
uacagagccuccuccaaggg

SEQ ID NO: 294969 - RNA, 21 nt, Human
uaccaguauucuggggguuag

SEQ ID NO: 294970 - RNA, 19 nt, Human
uagcccugaaacucugagg

SEQ ID NO: 294971 - RNA, 23 nt, Human
uagcccugaaacucugaggccug

SEQ ID NO: 294972 - RNA, 24 nt, Human
uaggagaagucaguacgggggagg

SEQ ID NO: 294973 - RNA, 25 nt, Human
uaucuuaccaccccauacugucuug

SEQ ID NO: 294974 - RNA, 20 nt, Human
ucagcccaaagcuggcugcc

SEQ ID NO: 294975 - RNA, 18 nt, Human
ucaguccccugaggacau

SEQ ID NO: 294976 - RNA, 24 nt, Human
uccaaaacuugagcauugaucuug

SEQ ID NO: 294977 - RNA, 26 nt, Human
uccacacacuucccuuccuuaucuua

SEQ ID NO: 294978 - RNA, 19 nt, Human
uccacauccacacacuucc

SEQ ID NO: 294979 - RNA, 22 nt, Human
uccaccaguggcaccucuggag

SEQ ID NO: 294980 - RNA, 20 nt, Human
uccaugcccccaccauccac

SEQ ID NO: 294981 - RNA, 24 nt, Human
uccuccguuguuuccacauacucc

SEQ ID NO: 294982 - RNA, 21 nt, Human
ugaaaaacaaaacagaagacu

SEQ ID NO: 294983 - RNA, 18 nt, Human
ugacccuuccaccagugg

SEQ ID NO: 294984 - RNA, 24 nt, Human
ugcccuagcucccugccuccccaa

SEQ ID NO: 294985 - RNA, 18 nt, Human
ugcccuuaaccacugaag

SEQ ID NO: 294986 - RNA, 20 nt, Human
ugcccuuaaccacugaaguc

SEQ ID NO: 294987 - RNA, 19 nt, Human
ugccugggcugagcccuau

SEQ ID NO: 294988 - RNA, 23 nt, Human
ugccugggcugagcccuauuaug

SEQ ID NO: 294989 - RNA, 22 nt, Human
ugcuggggcuccgcuccggggg

SEQ ID NO: 294990 - RNA, 21 nt, Human
uggaaacgucaaacaaugaaa

SEQ ID NO: 294991 - RNA, 25 nt, Human
uggaaacgucaaacaaugaaaaaca

SEQ ID NO: 294992 - RNA, 18 nt, Human
uggaaggaggugaagggg

SEQ ID NO: 294993 - RNA, 21 nt, Human
uggaaggaggugaaggggcug

SEQ ID NO: 294994 - RNA, 22 nt, Human
uggaaggaggugaaggggcugg

SEQ ID NO: 294995 - RNA, 18 nt, Human
uggaaucuggaggauguu

SEQ ID NO: 294996 - RNA, 22 nt, Human
uggaaucuggaggauguuguca

SEQ ID NO: 294997 - RNA, 21 nt, Human
uggacacagcacaaaacacaa

SEQ ID NO: 294998 - RNA, 19 nt, Human
uggaggauguugucagucc

SEQ ID NO: 294999 - RNA, 21 nt, Human
uggagugggguggggaggagg

SEQ ID NO: 295000 - RNA, 23 nt, Human
uggauggccggggacccaggggc

SEQ ID NO: 295001 - RNA, 25 nt, Human
uggcaaaugguucuuggugucuaca

SEQ ID NO: 295002 - RNA, 19 nt, Human
uggcaaggugaaggacuga

SEQ ID NO: 295003 - RNA, 21 nt, Human
uggcaaggugaaggacugagg

SEQ ID NO: 295004 - RNA, 23 nt, Human
uggcaccucuggaguacccagca

SEQ ID NO: 295005 - RNA, 24 nt, Human
uggcaccucuggaguacccagcac

SEQ ID NO: 295006 - RNA, 18 nt, Human
uggcugccugggcugagc

SEQ ID NO: 295007 - RNA, 20 nt, Human
ugggaagaggcuugguagca

SEQ ID NO: 295008 - RNA, 19 nt, Human
ugggaaggguccagccuag

SEQ ID NO: 295009 - RNA, 20 nt, Human
ugggaaggguccagccuagu

SEQ ID NO: 295010 - RNA, 19 nt, Human
ugggauggaugggccugau

SEQ ID NO: 295011 - RNA, 20 nt, Human
ugggcugguuggggagaggc

SEQ ID NO: 295012 - RNA, 22 nt, Human
uggggaccugggcaguggccuu

SEQ ID NO: 295013 - RNA, 20 nt, Human
uggggaggagggaggcaugg

SEQ ID NO: 295014 - RNA, 21 nt, Human
uggggaggagggaggcauggg

SEQ ID NO: 295015 - RNA, 18 nt, Human
ugggugcagguaaggaga

SEQ ID NO: 295016 - RNA, 26 nt, Human
ugguagcaaaaugcccucccuaaauc

SEQ ID NO: 295017 - RNA, 21 nt, Human
ugguccccagggcguugggaa

SEQ ID NO: 295018 - RNA, 20 nt, Human
uggucccugcccuagcuccc

SEQ ID NO: 295019 - RNA, 23 nt, Human
ugguuuauggcuggaaucuggag

SEQ ID NO: 295020 - RNA, 18 nt, Human
uguaagggcaggucuggg

SEQ ID NO: 295021 - RNA, 23 nt, Human
ugucuacaguaaccccacuaccc

SEQ ID NO: 295022 - RNA, 19 nt, Human
uguggcaaaugguucuugg

SEQ ID NO: 295023 - RNA, 23 nt, Human
uguggcaaaugguucuugguguc

SEQ ID NO: 295024 - RNA, 20 nt, Human
uuauguagugggaagggucc

SEQ ID NO: 295025 - RNA, 22 nt, Human
uuccuagcuaucugcuuugugc

SEQ ID NO: 295026 - RNA, 22 nt, Human
uuccuagcuaucugcuuugugc

SEQ ID NO: 295027 - RNA, 23 nt, Human
uuccuagcuaucugcuuugugcu

SEQ ID NO: 295028 - RNA, 24 nt, Human
uuccuagcuaucugcuuugugcuu

SEQ ID NO: 295029 - RNA, 20 nt, Human
uugauuuggaagauggagga

SEQ ID NO: 295030 - RNA, 21 nt, Human
uuguuucuguuucccaagggg

SEQ ID NO: 295031 - RNA, 21 nt, Human
uuguuugaggaggaggugggg

SEQ ID NO: 295032 - RNA, 18 nt, Human
uuuucagaacuaggaggc

SEQ ID NO: 295033 - RNA, 21 nt, Human
aaaacacaacacgggccgccg

SEQ ID NO: 295034 - RNA, 19 nt, Human
aaaagcacaccgcacuaca

SEQ ID NO: 295035 - RNA, 25 nt, Human
aaacaaaacagaagacuggucccca

SEQ ID NO: 295036 - RNA, 25 nt, Human
aaacaaaacagaagacuggucccca

SEQ ID NO: 295037 - RNA, 23 nt, Human
aaacagaagacugguccccaggg

SEQ ID NO: 295038 - RNA, 18 nt, Human
aaaugcccucccuaaauc

SEQ ID NO: 295039 - RNA, 19 nt, Human
aacagaagacugguccccc

SEQ ID NO: 295040 - RNA, 23 nt, Human
aagcuggcugccugggcugagcc

SEQ ID NO: 295041 - RNA, 21 nt, Human
aaugaaaaacaaaacagaaga

SEQ ID NO: 295042 - RNA, 25 nt, Human
acaaaacacaacacgggccgccgcg

SEQ ID NO: 295043 - RNA, 22 nt, Human
acaaaacagaagacuggucccc

SEQ ID NO: 295044 - RNA, 27 nt, Human
acagagccuccuccaaggccuugauaa

SEQ ID NO: 295045 - RNA, 22 nt, Human
acagcacaaaacacaacacggg

SEQ ID NO: 295046 - RNA, 21 nt, Human
accaugcuuugggggaagauu

SEQ ID NO: 295047 - RNA, 19 nt, Human
acucgggaaagaggaacug

SEQ ID NO: 295048 - RNA, 22 nt, Human
acugaaaugccaguuuaaucca

SEQ ID NO: 295049 - RNA, 20 nt, Human
agaaggucuaugcacaagga

SEQ ID NO: 295050 - RNA, 19 nt, Human
agaggaacuguuggagugg

SEQ ID NO: 295051 - RNA, 24 nt, Human
agcucagcccaaagcuggcugccu

SEQ ID NO: 295052 - RNA, 21 nt, Human
aggacauacagagccuccucc

SEQ ID NO: 295053 - RNA, 22 nt, Human
aggaggcuuguagguuacuugg

SEQ ID NO: 295054 - RNA, 20 nt, Human
aggagggaggcaugggaugg

SEQ ID NO: 295055 - RNA, 18 nt, Human
aggagggcaggggcccug

SEQ ID NO: 295056 - RNA, 19 nt, Human
aggaggugggggaagucaa

SEQ ID NO: 295057 - RNA, 23 nt, Human
agggaggcaugggauggaugggg

SEQ ID NO: 295058 - RNA, 18 nt, Human
agggggcgcacuggggac

SEQ ID NO: 295059 - RNA, 25 nt, Human
auacagagccuccuccaaccggagg

SEQ ID NO: 295060 - RNA, 21 nt, Human
caaaacagaagacuggucccc

SEQ ID NO: 295061 - RNA, 23 nt, Human
caaacaaugaaaaacaaaacaga

SEQ ID NO: 295062 - RNA, 22 nt, Human
caacaccccaaccaccuuacuc

SEQ ID NO: 295063 - RNA, 20 nt, Human
caagaggucaugaugcccuu

SEQ ID NO: 295064 - RNA, 21 nt, Human
cacacuucccuuccuuaucuu

SEQ ID NO: 295065 - RNA, 21 nt, Human
caccccauacugucuuggaac

SEQ ID NO: 295066 - RNA, 20 nt, Human
caccgcacuacacuacuggc

SEQ ID NO: 295067 - RNA, 18 nt, Human
cacuggggaccugggcag

SEQ ID NO: 295068 - RNA, 25 nt, Human
cagagccuccuccaaggccuugaua

SEQ ID NO: 295069 - RNA, 26 nt, Human
cagcauccagugcggauuccaaucuu

SEQ ID NO: 295070 - RNA, 22 nt, Human
caggagggcaggggcccuguug

SEQ ID NO: 295071 - RNA, 22 nt, Human
caggggcagaagggggugggag

SEQ ID NO: 295072 - RNA, 22 nt, Human
caguauucuggggguuagcccu

SEQ ID NO: 295073 - RNA, 20 nt, Human
ccacagaggccccucugacc

SEQ ID NO: 295074 - RNA, 23 nt, Human
ccauacugucuuggaacaugcag

SEQ ID NO: 295075 - RNA, 26 nt, Human
ccauacugucuuggaacaugcagugg

SEQ ID NO: 295076 - RNA, 21 nt, Human
cccaccauccacauccacaca

SEQ ID NO: 295077 - RNA, 30 nt, Human; identical to SEQ ID NO: 294382

SEQ ID NO: 295078 - RNA, 19 nt, Human
ccccacuacccccaugggu

SEQ ID NO: 295079 - RNA, 19 nt, Human
ccccacuacccccaugggu

SEQ ID NO: 295080 - RNA, 21 nt, Human
ccccacuacccccauggguac

SEQ ID NO: 295081 - RNA, 27 nt, Human
cccccaccauccacauccacacacuuc

SEQ ID NO: 295082 - RNA, 25 nt, Human
cccccugggggggaagggguaggug

SEQ ID NO: 295083 - RNA, 21 nt, Human
ccccugaggacauacagagcc

SEQ ID NO: 295084 - RNA, 22 nt, Human
cccuccugucgcaauuuucucc

SEQ ID NO: 295085 - RNA, 26 nt, Human
ccuccugucgcaauuuucuccgaguc

SEQ ID NO: 295086 - RNA, 19 nt, Human
ccuggcuggcccacccuuc

SEQ ID NO: 295087 - RNA, 22 nt, Human
ccuggcuggcccacccuuccug

SEQ ID NO: 295088 - RNA, 19 nt, Human
ccugggcugagacuuucug

SEQ ID NO: 295089 - RNA, 21 nt, Human
ccuguuagcucagcccaaagc

SEQ ID NO: 295090 - RNA, 24 nt, Human
cgcccgcugcccacccgccaucac

SEQ ID NO: 295091 - RNA, 18 nt, Human
cgccgcccgcugcccacc

SEQ ID NO: 295092 - RNA, 22 nt, Human
cgcguggacacagcacaaaaca

SEQ ID NO: 295093 - RNA, 22 nt, Human
cggcaccuggcaaggugaagga

SEQ ID NO: 295094 - RNA, 23 nt, Human
cggcugcgcggagcccgccgccc

SEQ ID NO: 295095 - RNA, 22 nt, Human
cuauucuacaccagccgaaaga

SEQ ID NO: 295096 - RNA, 22 nt, Human
cucagcccaaagcuggcugccu

SEQ ID NO: 295097 - RNA, 21 nt, Human
cucucaaggggaccugguccu

SEQ ID NO: 295098 - RNA, 23 nt, Human
cugaggccugggugcagguaagg

SEQ ID NO: 295099 - RNA, 18 nt, Human
cugccugggcugagcccu

SEQ ID NO: 295100 - RNA, 18 nt, Human
cuggcaaggugaaggacu

SEQ ID NO: 295101 - RNA, 18 nt, Human
gaagauggaggaguucag

SEQ ID NO: 295102 - RNA, 21 nt, Human
gacccaggggcagaagggggu

SEQ ID NO: 295103 - RNA, 21 nt, Human
gagcauggccuuggccccuac

SEQ ID NO: 295104 - RNA, 18 nt, Human
gaggagggaggcauggga

SEQ ID NO: 295105 - RNA, 20 nt, Human
gagugggguggggaggaggg

SEQ ID NO: 295106 - RNA, 21 nt, Human
gcccccaccauccacauccac

SEQ ID NO: 295107 - RNA, 18 nt, Human
gcccuguggcucuuggcc

SEQ ID NO: 295108 - RNA, 18 nt, Human
gcggagcccgccgcccgc

SEQ ID NO: 295109 - RNA, 19 nt, Human
gcguggacacagcacaaaa

SEQ ID NO: 295110 - RNA, 20 nt, Human
gcugcgcggagcccgccgcc

SEQ ID NO: 295111 - RNA, 20 nt, Human
ggacccaggggcagaagggg

SEQ ID NO: 295112 - RNA, 22 nt, Human
ggagaagucaguacgggggagg

SEQ ID NO: 295113 - RNA, 20 nt, Human
ggagggggcgcuacacuacu

SEQ ID NO: 295114 - RNA, 21 nt, Human
ggagugggguggggaggaggg

SEQ ID NO: 295115 - RNA, 22 nt, Human
ggagugggguggggaggaggga

SEQ ID NO: 295116 - RNA, 21 nt, Human
ggcaggucugggguucucugg

SEQ ID NO: 295117 - RNA, 19 nt, Human
ggcguugggaagaggcuug

SEQ ID NO: 295118 - RNA, 19 nt, Human
gggaccugguccuaaaccu

SEQ ID NO: 295119 - RNA, 19 nt, Human
gggaggagggaggcauggg

SEQ ID NO: 295120 - RNA, 20 nt, Human
gggaggcaugggauggaugg

SEQ ID NO: 295121 - RNA, 21 nt, Human
gggcagaagggggugggagaa

SEQ ID NO: 295122 - RNA, 19 nt, Human
gggccaaaccuccaccccc

SEQ ID NO: 295123 - RNA, 19 nt, Human
gggcguugggaagaggcuu

SEQ ID NO: 295124 - RNA, 18 nt, Human
ggggaagggguaggugcu

SEQ ID NO: 295125 - RNA, 24 nt, Human
ggggagggggucgccuuagcgcgu

SEQ ID NO: 295126 - RNA, 19 nt, Human
gggguggggaggagggagg

SEQ ID NO: 295127 - RNA, 20 nt, Human
gggguggggaggagggaggc

SEQ ID NO: 295128 - RNA, 21 nt, Human
guccaugcccccaccauccac

SEQ ID NO: 295129 - RNA, 23 nt, Human
gugaaggacugaggcuucaggag

SEQ ID NO: 295130 - RNA, 21 nt, Human
guuuauggcuggaaucuggag

SEQ ID NO: 295131 - RNA, 19 nt, Human
uacagagccuccuccaagg

SEQ ID NO: 295132 - RNA, 20 nt, Human
uacagagccuccuccaaggg

SEQ ID NO: 295133 - RNA, 21 nt, Human
uaccaguauucuggggguuag

SEQ ID NO: 295134 - RNA, 19 nt, Human
uagcccugaaacucugagg

SEQ ID NO: 295135 - RNA, 23 nt, Human
uagcccugaaacucugaggccug

SEQ ID NO: 295136 - RNA, 24 nt, Human
uaggagaagucaguacgggggagg

SEQ ID NO: 295137 - RNA, 25 nt, Human
uaucuuaccaccccauacugucuug

SEQ ID NO: 295138 - RNA, 22 nt, Human
uauggagagaacuggugggcug

SEQ ID NO: 295139 - RNA, 19 nt, Human
uauguagugggaagggucc

SEQ ID NO: 295140 - RNA, 20 nt, Human
ucagcccaaagcuggcugcc

SEQ ID NO: 295141 - RNA, 18 nt, Human
ucaguccccugaggacau

SEQ ID NO: 295142 - RNA, 24 nt, Human
uccaaaacuugagcauugaucuug

SEQ ID NO: 295143 - RNA, 26 nt, Human
uccacacacuucccuuccuuaucuua

SEQ ID NO: 295144 - RNA, 19 nt, Human
uccacauccacacacuucc

SEQ ID NO: 295145 - RNA, 22 nt, Human
uccaccaguggcaccucuggag

SEQ ID NO: 295146 - RNA, 19 nt, Human
ugaaaaacaaaacagaaga

SEQ ID NO: 295147 - RNA, 21 nt, Human
ugaaaaacaaaacagaagacu

SEQ ID NO: 295148 - RNA, 18 nt, Human
ugacccuuccaccagugg

SEQ ID NO: 295149 - RNA, 22 nt, Human
ugacccuuccaccaguggcacc

SEQ ID NO: 295150 - RNA, 26 nt, Human
ugagauaaccagcauucacgggaccc

SEQ ID NO: 295151 - RNA, 24 nt, Human
ugcccuagcucccugccuccccaa

SEQ ID NO: 295152 - RNA, 19 nt, Human
ugccugggcugagcccuau

SEQ ID NO: 295153 - RNA, 23 nt, Human
ugccugggcugagcccuauuaug

SEQ ID NO: 295154 - RNA, 22 nt, Human
ugcuggggcuccgcuccggggg

SEQ ID NO: 295155 - RNA, 21 nt, Human
uggaaacgucaaacaaugaaa

SEQ ID NO: 295156 - RNA, 25 nt, Human
uggaaacgucaaacaaugaaaaaca

SEQ ID NO: 295157 - RNA, 18 nt, Human
uggaaggaggugaagggg

SEQ ID NO: 295158 - RNA, 21 nt, Human
uggaaggaggugaaggggcug

SEQ ID NO: 295159 - RNA, 22 nt, Human
uggaaggaggugaaggggcugg

SEQ ID NO: 295160 - RNA, 18 nt, Human
uggaaucuggaggauguu

SEQ ID NO: 295161 - RNA, 22 nt, Human
uggaaucuggaggauguuguca

SEQ ID NO: 295162 - RNA, 21 nt, Human
uggacacagcacaaaacacaa

SEQ ID NO: 295163 - RNA, 19 nt, Human
uggaggauguugucagucc

SEQ ID NO: 295164 - RNA, 21 nt, Human
uggagugggguggggaggagg

SEQ ID NO: 295165 - RNA, 23 nt, Human
uggauggccggggacccaggggc

SEQ ID NO: 295166 - RNA, 29 nt, Human
uggcaaaugguucuuggugucuacaguaa

SEQ ID NO: 295167 - RNA, 19 nt, Human
uggcaaggugaaggacuga

SEQ ID NO: 295168 - RNA, 21 nt, Human
uggcaaggugaaggacugagg

SEQ ID NO: 295169 - RNA, 23 nt, Human
uggcaccucuggaguacccagca

SEQ ID NO: 295170 - RNA, 24 nt, Human
uggcaccucuggaguacccagcac

SEQ ID NO: 295171 - RNA, 18 nt, Human
uggcugccugggcugagc

SEQ ID NO: 295172 - RNA, 21 nt, Human
uggcugccugggcugagcccu

SEQ ID NO: 295173 - RNA, 19 nt, Human
ugggaaggguccagccuag

SEQ ID NO: 295174 - RNA, 20 nt, Human
ugggaaggguccagccuagu

SEQ ID NO: 295175 - RNA, 20 nt, Human
ugggaaggguccagccuagu

SEQ ID NO: 295176 - RNA, 19 nt, Human
ugggauggaugggccugau

SEQ ID NO: 295177 - RNA, 20 nt, Human
ugggcugguuggggagaggc

SEQ ID NO: 295178 - RNA, 22 nt, Human
uggggaccugggcaguggccuu

SEQ ID NO: 295179 - RNA, 20 nt, Human
uggggaggagggaggcaugg

SEQ ID NO: 295180 - RNA, 21 nt, Human
uggggaggagggaggcauggg

SEQ ID NO: 295181 - RNA, 18 nt, Human
ugggugcagguaaggaga

SEQ ID NO: 295182 - RNA, 26 nt, Human
ugguagcaaaaugcccucccuaaauc

SEQ ID NO: 295183 - RNA, 21 nt, Human
ugguccccagggcguugggaa

SEQ ID NO: 295184 - RNA, 20 nt, Human
uggucccugcccuagcuccc

SEQ ID NO: 295185 - RNA, 18 nt, Human
uguaagggcaggucuggg

SEQ ID NO: 295186 - RNA, 23 nt, Human
ugucuacaguaaccccacuaccc

SEQ ID NO: 295187 - RNA, 19 nt, Human
uguggcaaaugguucuugg

SEQ ID NO: 295188 - RNA, 23 nt, Human
uguggcaaaugguucuugguguc

SEQ ID NO: 295189 - RNA, 20 nt, Human
uugauuuggaagauggagga

SEQ ID NO: 295190 - RNA, 19 nt, Human
uuggaagauggaggaguuc

SEQ ID NO: 295191 - RNA, 21 nt, Human
uuguuucuguuucccaagggg

SEQ ID NO: 295192 - RNA, 21 nt, Human
uuguuugaggaggaggugggg

SEQ ID NO: 295193 - RNA, 21 nt, Human
uuuaaccaggcuauggccacu

SEQ ID NO: 295194 - RNA, 22 nt, Human
uuuagggccaaaccuccacccc

SEQ ID NO: 295195 - RNA, 18 nt, Human
uuuucagaacuaggaggc

SEQ ID NO: 295196 - RNA, 21 nt, Human
aaaacacaacacgggccgccg

SEQ ID NO: 295197 - RNA, 24 nt, Human
aaaacagaagacugguccccaggg

SEQ ID NO: 295198 - RNA, 19 nt, Human
aaaagcacaccgcacuaca

SEQ ID NO: 295199 - RNA, 25 nt, Human
aaacaaaacagaagacuggucccca

SEQ ID NO: 295200 - RNA, 25 nt, Human
aaacaaaacagaagacuggucccca

SEQ ID NO: 295201 - RNA, 20 nt, Human
aaaugcccucccuaaauccc

SEQ ID NO: 295202 - RNA, 19 nt, Human
aacagaagacugguccccc

SEQ ID NO: 295203 - RNA, 23 nt, Human
aagcuggcugccugggcugagcc

SEQ ID NO: 295204 - RNA, 25 nt, Human
acaaaacacaacacgggccgccgcg

SEQ ID NO: 295205 - RNA, 22 nt, Human
acaaaacagaagacuggucccc

SEQ ID NO: 295206 - RNA, 18 nt, Human
acagagccuccuccaagg

SEQ ID NO: 295207 - RNA, 27 nt, Human
acagagccuccuccaaggccuugauaa

SEQ ID NO: 295208 - RNA, 22 nt, Human
acagcacaaaacacaacacggg

SEQ ID NO: 295209 - RNA, 21 nt, Human
accaugcuuugggggaagauu

SEQ ID NO: 295210 - RNA, 19 nt, Human
acucgggaaagaggaacug

SEQ ID NO: 295211 - RNA, 22 nt, Human
acugaaaugccaguuuaaucca

SEQ ID NO: 295212 - RNA, 20 nt, Human
agaaggucuaugcacaagga

SEQ ID NO: 295213 - RNA, 19 nt, Human
agaggaacuguuggagugg

SEQ ID NO: 295214 - RNA, 24 nt, Human
agcucagcccaaagcuggcugccu

SEQ ID NO: 295215 - RNA, 21 nt, Human
aggacauacagagccuccucc

SEQ ID NO: 295216 - RNA, 23 nt, Human
aggagaagucaguacgggggagg

SEQ ID NO: 295217 - RNA, 22 nt, Human
aggaggcuuguagguuacuugg

SEQ ID NO: 295218 - RNA, 20 nt, Human
aggagggaggcaugggaugg

SEQ ID NO: 295219 - RNA, 18 nt, Human
aggagggcaggggcccug

SEQ ID NO: 295220 - RNA, 19 nt, Human
aggaggugggggaagucaa

SEQ ID NO: 295221 - RNA, 23 nt, Human
agggaggcaugggauggaugggg

SEQ ID NO: 295222 - RNA, 18 nt, Human
agggggcgcacuggggac

SEQ ID NO: 295223 - RNA, 25 nt, Human
auacagagccuccuccaaccggagg

SEQ ID NO: 295224 - RNA, 21 nt, Human
caaaacagaagacuggucccc

SEQ ID NO: 295225 - RNA, 23 nt, Human
caaacaaugaaaaacaaaacaga

SEQ ID NO: 295226 - RNA, 22 nt, Human
caacaccccaaccaccuuacuc

SEQ ID NO: 295227 - RNA, 20 nt, Human
caagaggucaugaugcccuu

SEQ ID NO: 295228 - RNA, 21 nt, Human
cacacuucccuuccuuaucuu

SEQ ID NO: 295229 - RNA, 21 nt, Human
caccccauacugucuuggaac

SEQ ID NO: 295230 - RNA, 20 nt, Human
caccgcacuacacuacuggc

SEQ ID NO: 295231 - RNA, 18 nt, Human
cacuggggaccugggcag

SEQ ID NO: 295232 - RNA, 25 nt, Human
cagagccuccuccaaggccuugaua

SEQ ID NO: 295233 - RNA, 20 nt, Human
cagcccaaagcuggcugccu

SEQ ID NO: 295234 - RNA, 22 nt, Human
caggagggcaggggcccuguug

SEQ ID NO: 295235 - RNA, 22 nt, Human
caggggcagaagggggugggag

SEQ ID NO: 295236 - RNA, 22 nt, Human
caguauucuggggguuagcccu

SEQ ID NO: 295237 - RNA, 23 nt, Human
ccacacacuucccuuccuuaucu

SEQ ID NO: 295238 - RNA, 23 nt, Human
ccauacugucuuggaacaugcag

SEQ ID NO: 295239 - RNA, 26 nt, Human
ccauacugucuuggaacaugcagugg

SEQ ID NO: 295240 - RNA, 21 nt, Human
cccacagaggccccucugacc

SEQ ID NO: 295241 - RNA, 21 nt, Human
cccaccauccacauccacaca

SEQ ID NO: 295242 - RNA, 30 nt, Human; identical to SEQ ID NO: 294382

SEQ ID NO: 295243 - RNA, 19 nt, Human
cccaggggcagaagggggu

SEQ ID NO: 295244 - RNA, 19 nt, Human
ccccacuacccccaugggu

SEQ ID NO: 295245 - RNA, 20 nt, Human
ccccacuacccccaugggua

SEQ ID NO: 295246 - RNA, 21 nt, Human
ccccacuacccccauggguac

SEQ ID NO: 295247 - RNA, 27 nt, Human
cccccaccauccacauccacacacuuc

SEQ ID NO: 295248 - RNA, 25 nt, Human
cccccugggggggaagggguaggug

SEQ ID NO: 295249 - RNA, 21 nt, Human
ccccugaggacauacagagcc

SEQ ID NO: 295250 - RNA, 21 nt, Human
ccgccgcccgcugcccacccg

SEQ ID NO: 295251 - RNA, 22 nt, Human
ccuggcuggcccacccuuccug

SEQ ID NO: 295252 - RNA, 19 nt, Human
ccugggcugagacuuucug

SEQ ID NO: 295253 - RNA, 21 nt, Human
ccugggcugagcccuauuaug

SEQ ID NO: 295254 - RNA, 21 nt, Human
ccuguuagcucagcccaaagc

SEQ ID NO: 295255 - RNA, 24 nt, Human
cgcccgcugcccacccgccaucac

SEQ ID NO: 295256 - RNA, 19 nt, Human
cgcccuguggcucuuggcc

SEQ ID NO: 295257 - RNA, 22 nt, Human
cgcguggacacagcacaaaaca

SEQ ID NO: 295258 - RNA, 22 nt, Human
cggcaccuggcaaggugaagga

SEQ ID NO: 295259 - RNA, 22 nt, Human
cuauucuacaccagccgaaaga

SEQ ID NO: 295260 - RNA, 21 nt, Human
cucucaaggggaccugguccu

SEQ ID NO: 295261 - RNA, 23 nt, Human
cugaggccugggugcagguaagg

SEQ ID NO: 295262 - RNA, 18 nt, Human
cugccugggcugagcccu

SEQ ID NO: 295263 - RNA, 18 nt, Human
cuggcaaggugaaggacu

SEQ ID NO: 295264 - RNA, 22 nt, Human
cuuguuugaggaggaggugggg

SEQ ID NO: 295265 - RNA, 22 nt, Human
cuuuaaccaggcuauggccacu

SEQ ID NO: 295266 - RNA, 18 nt, Human
gaaaaacaaaacagaaga

SEQ ID NO: 295267 - RNA, 18 nt, Human
gaagauggaggaguucag

SEQ ID NO: 295268 - RNA, 21 nt, Human
gacccaggggcagaagggggu

SEQ ID NO: 295269 - RNA, 21 nt, Human
gagcauggccuuggccccuac

SEQ ID NO: 295270 - RNA, 20 nt, Human
gagugggguggggaggaggg

SEQ ID NO: 295271 - RNA, 21 nt, Human
gcccccaccauccacauccac

SEQ ID NO: 295272 - RNA, 18 nt, Human
gcccuguggcucuuggcc

SEQ ID NO: 295273 - RNA, 20 nt, Human
gccuggcuggcccacccuuc

SEQ ID NO: 295274 - RNA, 18 nt, Human
gcggagcccgccgcccgc

SEQ ID NO: 295275 - RNA, 19 nt, Human
gcguggacacagcacaaaa

SEQ ID NO: 295276 - RNA, 20 nt, Human
gcugcgcggagcccgccgcc

SEQ ID NO: 295277 - RNA, 20 nt, Human
ggacccaggggcagaagggg

SEQ ID NO: 295278 - RNA, 22 nt, Human
ggagaagucaguacgggggagg

SEQ ID NO: 295279 - RNA, 19 nt, Human
ggaggagggaggcauggga

SEQ ID NO: 295280 - RNA, 19 nt, Human
ggaggcaugggauggaugg

SEQ ID NO: 295281 - RNA, 20 nt, Human
ggagggggcgcuacacuacu

SEQ ID NO: 295282 - RNA, 21 nt, Human
ggagugggguggggaggaggg

SEQ ID NO: 295283 - RNA, 22 nt, Human
ggagugggguggggaggaggga

SEQ ID NO: 295284 - RNA, 21 nt, Human
ggcaggucugggguucucugg

SEQ ID NO: 295285 - RNA, 19 nt, Human
ggcguugggaagaggcuug

SEQ ID NO: 295286 - RNA, 19 nt, Human
gggaccugguccuaaaccu

SEQ ID NO: 295287 - RNA, 19 nt, Human
gggaggagggaggcauggg

SEQ ID NO: 295288 - RNA, 21 nt, Human
gggcagaagggggugggagaa

SEQ ID NO: 295289 - RNA, 19 nt, Human
gggcguugggaagaggcuu

SEQ ID NO: 295290 - RNA, 18 nt, Human
ggggaagggguaggugcu

SEQ ID NO: 295291 - RNA, 24 nt, Human
ggggagggggucgccuuagcgcgu

SEQ ID NO: 295292 - RNA, 27 nt, Human
ggggcagaagggggugggagaagaagg

SEQ ID NO: 295293 - RNA, 19 nt, Human
gggguggggaggagggagg

SEQ ID NO: 295294 - RNA, 20 nt, Human
gggguggggaggagggaggc

SEQ ID NO: 295295 - RNA, 23 nt, Human
gugaaggacugaggcuucaggag

SEQ ID NO: 295296 - RNA, 19 nt, Human
uacagagccuccuccaagg

SEQ ID NO: 295297 - RNA, 20 nt, Human
uacagagccuccuccaaggg

SEQ ID NO: 295298 - RNA, 21 nt, Human
uaccaguauucuggggguuag

SEQ ID NO: 295299 - RNA, 19 nt, Human
uagcccugaaacucugagg

SEQ ID NO: 295300 - RNA, 23 nt, Human
uagcccugaaacucugaggccug

SEQ ID NO: 295301 - RNA, 25 nt, Human
uaucuuaccaccccauacugucuug

SEQ ID NO: 295302 - RNA, 20 nt, Human
ucagcccaaagcuggcugcc

SEQ ID NO: 295303 - RNA, 18 nt, Human
ucaguccccugaggacau

SEQ ID NO: 295304 - RNA, 24 nt, Human
uccaaaacuugagcauugaucuug

SEQ ID NO: 295305 - RNA, 19 nt, Human
uccacauccacacacuucc

SEQ ID NO: 295306 - RNA, 22 nt, Human
uccaccaguggcaccucuggag

SEQ ID NO: 295307 - RNA, 20 nt, Human
uccaugcccccaccauccac

SEQ ID NO: 295308 - RNA, 19 nt, Human
ugaaaaacaaaacagaaga

SEQ ID NO: 295309 - RNA, 21 nt, Human
ugaaaaacaaaacagaagacu

SEQ ID NO: 295310 - RNA, 18 nt, Human
ugacccuuccaccagugg

SEQ ID NO: 295311 - RNA, 22 nt, Human
ugacccuuccaccaguggcacc

SEQ ID NO: 295312 - RNA, 24 nt, Human
ugcccuagcucccugccuccccaa

SEQ ID NO: 295313 - RNA, 23 nt, Human
ugccugggcugagcccuauuaug

SEQ ID NO: 295314 - RNA, 22 nt, Human
ugcuggggcuccgcuccggggg

SEQ ID NO: 295315 - RNA, 21 nt, Human
uggaaacgucaaacaaugaaa

SEQ ID NO: 295316 - RNA, 25 nt, Human
uggaaacgucaaacaaugaaaaaca

SEQ ID NO: 295317 - RNA, 18 nt, Human
uggaaggaggugaagggg

SEQ ID NO: 295318 - RNA, 21 nt, Human
uggaaggaggugaaggggcug

SEQ ID NO: 295319 - RNA, 22 nt, Human
uggaaggaggugaaggggcugg

SEQ ID NO: 295320 - RNA, 18 nt, Human
uggaaucuggaggauguu

SEQ ID NO: 295321 - RNA, 22 nt, Human
uggaaucuggaggauguuguca

SEQ ID NO: 295322 - RNA, 21 nt, Human
uggacacagcacaaaacacaa

SEQ ID NO: 295323 - RNA, 19 nt, Human
uggaggauguugucagucc

SEQ ID NO: 295324 - RNA, 21 nt, Human
uggagugggguggggaggagg

SEQ ID NO: 295325 - RNA, 23 nt, Human
uggauggccggggacccaggggc

SEQ ID NO: 295326 - RNA, 29 nt, Human
uggcaaaugguucuuggugucuacaguaa

SEQ ID NO: 295327 - RNA, 19 nt, Human
uggcaaggugaaggacuga

SEQ ID NO: 295328 - RNA, 21 nt, Human
uggcaaggugaaggacugagg

SEQ ID NO: 295329 - RNA, 23 nt, Human
uggcaccucuggaguacccagca

SEQ ID NO: 295330 - RNA, 24 nt, Human
uggcaccucuggaguacccagcac

SEQ ID NO: 295331 - RNA, 18 nt, Human
uggcugccugggcugagc

SEQ ID NO: 295332 - RNA, 21 nt, Human
uggcugccugggcugagcccu

SEQ ID NO: 295333 - RNA, 19 nt, Human
ugggaaggguccagccuag

SEQ ID NO: 295334 - RNA, 20 nt, Human
ugggaaggguccagccuagu

SEQ ID NO: 295335 - RNA, 19 nt, Human
ugggauggaugggccugau

SEQ ID NO: 295336 - RNA, 20 nt, Human
ugggcugguuggggagaggc

SEQ ID NO: 295337 - RNA, 22 nt, Human
uggggaccugggcaguggccuu

SEQ ID NO: 295338 - RNA, 20 nt, Human
uggggaggagggaggcaugg

SEQ ID NO: 295339 - RNA, 21 nt, Human
uggggaggagggaggcauggg

SEQ ID NO: 295340 - RNA, 18 nt, Human
ugggugcagguaaggaga

SEQ ID NO: 295341 - RNA, 26 nt, Human
ugguagcaaaaugcccucccuaaauc

SEQ ID NO: 295342 - RNA, 21 nt, Human
ugguccccagggcguugggaa

SEQ ID NO: 295343 - RNA, 20 nt, Human
uggucccugcccuagcuccc

SEQ ID NO: 295344 - RNA, 23 nt, Human
ugguuuauggcuggaaucuggag

SEQ ID NO: 295345 - RNA, 18 nt, Human
uguaagggcaggucuggg

SEQ ID NO: 295346 - RNA, 23 nt, Human
ugucuacaguaaccccacuaccc

SEQ ID NO: 295347 - RNA, 19 nt, Human
uguggcaaaugguucuugg

SEQ ID NO: 295348 - RNA, 23 nt, Human
uguggcaaaugguucuugguguc

SEQ ID NO: 295349 - RNA, 20 nt, Human
uuauguagugggaagggucc

SEQ ID NO: 295350 - RNA, 20 nt, Human
uugauuuggaagauggagga

SEQ ID NO: 295351 - RNA, 21 nt, Human
uuguuucuguuucccaagggg

SEQ ID NO: 295352 - RNA, 18 nt, Human
uuuucagaacuaggaggc

SEQ ID NO: 295353 - RNA, 21 nt, Human
aaaacacaacacgggccgccg

SEQ ID NO: 295354 - RNA, 19 nt, Human
aaaagcacaccgcacuaca

SEQ ID NO: 295355 - RNA, 25 nt, Human
aaacaaaacagaagacuggucccca

SEQ ID NO: 295356 - RNA, 25 nt, Human
aaacaaaacagaagacuggucccca

SEQ ID NO: 295357 - RNA, 22 nt, Human
aaacaaugaaaaacaaaacaga

SEQ ID NO: 295358 - RNA, 23 nt, Human
aaacagaagacugguccccaggg

SEQ ID NO: 295359 - RNA, 20 nt, Human
aaaugcccucccuaaauccc

SEQ ID NO: 295360 - RNA, 19 nt, Human
aacagaagacugguccccc

SEQ ID NO: 295361 - RNA, 19 nt, Human
aagaggucaugaugcccuu

SEQ ID NO: 295362 - RNA, 23 nt, Human
aagcuggcugccugggcugagcc

SEQ ID NO: 295363 - RNA, 25 nt, Human
acaaaacacaacacgggccgccgcg

SEQ ID NO: 295364 - RNA, 22 nt, Human
acaaaacagaagacuggucccc

SEQ ID NO: 295365 - RNA, 18 nt, Human
acagagccuccuccaagg

SEQ ID NO: 295366 - RNA, 27 nt, Human
acagagccuccuccaaggccuugauaa

SEQ ID NO: 295367 - RNA, 22 nt, Human
acagcacaaaacacaacacggg

SEQ ID NO: 295368 - RNA, 21 nt, Human
accaugcuuugggggaagauu

SEQ ID NO: 295369 - RNA, 19 nt, Human
acucgggaaagaggaacug

SEQ ID NO: 295370 - RNA, 22 nt, Human
acugaaaugccaguuuaaucca

SEQ ID NO: 295371 - RNA, 20 nt, Human
agaaggucuaugcacaagga

SEQ ID NO: 295372 - RNA, 19 nt, Human
agaggaacuguuggagugg

SEQ ID NO: 295373 - RNA, 24 nt, Human
agcucagcccaaagcuggcugccu

SEQ ID NO: 295374 - RNA, 21 nt, Human
aggacauacagagccuccucc

SEQ ID NO: 295375 - RNA, 22 nt, Human
aggaggcuuguagguuacuugg

SEQ ID NO: 295376 - RNA, 20 nt, Human
aggagggaggcaugggaugg

SEQ ID NO: 295377 - RNA, 18 nt, Human
aggagggcaggggcccug

SEQ ID NO: 295378 - RNA, 19 nt, Human
aggaggugggggaagucaa

SEQ ID NO: 295379 - RNA, 18 nt, Human
agggggcgcacuggggac

SEQ ID NO: 295380 - RNA, 25 nt, Human
auacagagccuccuccaaccggagg

SEQ ID NO: 295381 - RNA, 21 nt, Human
caaaacagaagacuggucccc

SEQ ID NO: 295382 - RNA, 22 nt, Human
caacaccccaaccaccuuacuc

SEQ ID NO: 295383 - RNA, 21 nt, Human
cacacuucccuuccuuaucuu

SEQ ID NO: 295384 - RNA, 21 nt, Human
caccccauacugucuuggaac

SEQ ID NO: 295385 - RNA, 20 nt, Human
caccgcacuacacuacuggc

SEQ ID NO: 295386 - RNA, 18 nt, Human
cacuggggaccugggcag

SEQ ID NO: 295387 - RNA, 25 nt, Human
cagagccuccuccaaggccuugaua

SEQ ID NO: 295388 - RNA, 20 nt, Human
cagcccaaagcuggcugccu

SEQ ID NO: 295389 - RNA, 22 nt, Human
caggagggcaggggcccuguug

SEQ ID NO: 295390 - RNA, 22 nt, Human
caggggcagaagggggugggag

SEQ ID NO: 295391 - RNA, 22 nt, Human
caguauucuggggguuagcccu

SEQ ID NO: 295392 - RNA, 21 nt, Human
cauacagagccuccuccaagg

SEQ ID NO: 295393 - RNA, 23 nt, Human
ccauacugucuuggaacaugcag

SEQ ID NO: 295394 - RNA, 26 nt, Human
ccauacugucuuggaacaugcagugg

SEQ ID NO: 295395 - RNA, 21 nt, Human
cccacagaggccccucugacc

SEQ ID NO: 295396 - RNA, 21 nt, Human
cccaccauccacauccacaca

SEQ ID NO: 295397 - RNA, 30 nt, Human; identical to SEQ ID NO: 294382

SEQ ID NO: 295398 - RNA, 19 nt, Human
ccccacuacccccaugggu

SEQ ID NO: 295399 - RNA, 19 nt, Human
ccccacuacccccaugggu

SEQ ID NO: 295400 - RNA, 21 nt, Human
ccccacuacccccauggguac

SEQ ID NO: 295401 - RNA, 27 nt, Human
cccccaccauccacauccacacacuuc

SEQ ID NO: 295402 - RNA, 25 nt, Human
cccccugggggggaagggguaggug

SEQ ID NO: 295403 - RNA, 21 nt, Human
ccccugaggacauacagagcc

SEQ ID NO: 295404 - RNA, 18 nt, Human
ccccugggggggaagggg

SEQ ID NO: 295405 - RNA, 20 nt, Human
cccugaaacucugaggccug

SEQ ID NO: 295406 - RNA, 22 nt, Human
ccucucaaggggaccugguccu

SEQ ID NO: 295407 - RNA, 19 nt, Human
ccuggcuggcccacccuuc

SEQ ID NO: 295408 - RNA, 22 nt, Human
ccuggcuggcccacccuuccug

SEQ ID NO: 295409 - RNA, 19 nt, Human
ccugggcugagacuuucug

SEQ ID NO: 295410 - RNA, 21 nt, Human
ccuguuagcucagcccaaagc

SEQ ID NO: 295411 - RNA, 24 nt, Human
cgcccgcugcccacccgccaucac

SEQ ID NO: 295412 - RNA, 18 nt, Human
cgccgcccgcugcccacc

SEQ ID NO: 295413 - RNA, 22 nt, Human
cgcguggacacagcacaaaaca

SEQ ID NO: 295414 - RNA, 23 nt, Human
cggcugcgcggagcccgccgccc

SEQ ID NO: 295415 - RNA, 22 nt, Human
cuauucuacaccagccgaaaga

SEQ ID NO: 295416 - RNA, 23 nt, Human
cugaggccugggugcagguaagg

SEQ ID NO: 295417 - RNA, 18 nt, Human
cugccugggcugagcccu

SEQ ID NO: 295418 - RNA, 18 nt, Human
cuggcaaggugaaggacu

SEQ ID NO: 295419 - RNA, 22 nt, Human
cuuguuugaggaggaggugggg

SEQ ID NO: 295420 - RNA, 22 nt, Human
cuuuaaccaggcuauggccacu

SEQ ID NO: 295421 - RNA, 18 nt, Human
gaaaaacaaaacagaaga

SEQ ID NO: 295422 - RNA, 18 nt, Human
gaagauggaggaguucag

SEQ ID NO: 295423 - RNA, 21 nt, Human
gacccaggggcagaagggggu

SEQ ID NO: 295424 - RNA, 21 nt, Human
gagcauggccuuggccccuac

SEQ ID NO: 295425 - RNA, 18 nt, Human
gaggagggaggcauggga

SEQ ID NO: 295426 - RNA, 20 nt, Human
gagugggguggggaggaggg

SEQ ID NO: 295427 - RNA, 20 nt, Human
gcaccuggcaaggugaagga

SEQ ID NO: 295428 - RNA, 21 nt, Human
gcccccaccauccacauccac

SEQ ID NO: 295429 - RNA, 18 nt, Human
gcccuguggcucuuggcc

SEQ ID NO: 295430 - RNA, 18 nt, Human
gcggagcccgccgcccgc

SEQ ID NO: 295431 - RNA, 19 nt, Human
gcguggacacagcacaaaa

SEQ ID NO: 295432 - RNA, 20 nt, Human
gcugcgcggagcccgccgcc

SEQ ID NO: 295433 - RNA, 20 nt, Human
ggacccaggggcagaagggg

SEQ ID NO: 295434 - RNA, 22 nt, Human
ggagaagucaguacgggggagg

SEQ ID NO: 295435 - RNA, 20 nt, Human
ggagggggcgcuacacuacu

SEQ ID NO: 295436 - RNA, 21 nt, Human
ggagugggguggggaggaggg

SEQ ID NO: 295437 - RNA, 22 nt, Human
ggagugggguggggaggaggga

SEQ ID NO: 295438 - RNA, 21 nt, Human
ggcaggucugggguucucugg

SEQ ID NO: 295439 - RNA, 19 nt, Human
ggcguugggaagaggcuug

SEQ ID NO: 295440 - RNA, 19 nt, Human
gggaccugguccuaaaccu

SEQ ID NO: 295441 - RNA, 19 nt, Human
gggaggagggaggcauggg

SEQ ID NO: 295442 - RNA, 20 nt, Human
gggaggcaugggauggaugg

SEQ ID NO: 295443 - RNA, 18 nt, Human
ggggaagggguaggugcu

SEQ ID NO: 295444 - RNA, 30 nt, Human; identical to SEQ ID NO: 294429

SEQ ID NO: 295445 - RNA, 24 nt, Human
ggggagggggucgccuuagcgcgu

SEQ ID NO: 295446 - RNA, 27 nt, Human
ggggcagaagggggugggagaagaagg

SEQ ID NO: 295447 - RNA, 19 nt, Human
gggguggggaggagggagg

SEQ ID NO: 295448 - RNA, 20 nt, Human
gggguggggaggagggaggc

SEQ ID NO: 295449 - RNA, 21 nt, Human
guccaugcccccaccauccac

SEQ ID NO: 295450 - RNA, 23 nt, Human
gugaaggacugaggcuucaggag

SEQ ID NO: 295451 - RNA, 21 nt, Human
guuuauggcuggaaucuggag

SEQ ID NO: 295452 - RNA, 20 nt, Human
uacagagccuccuccaaggg

SEQ ID NO: 295453 - RNA, 21 nt, Human
uaccaguauucuggggguuag

SEQ ID NO: 295454 - RNA, 19 nt, Human
uagcccugaaacucugagg

SEQ ID NO: 295455 - RNA, 24 nt, Human
uaggagaagucaguacgggggagg

SEQ ID NO: 295456 - RNA, 25 nt, Human
uaucuuaccaccccauacugucuug

SEQ ID NO: 295457 - RNA, 19 nt, Human
uauguagugggaagggucc

SEQ ID NO: 295458 - RNA, 20 nt, Human
ucagcccaaagcuggcugcc

SEQ ID NO: 295459 - RNA, 18 nt, Human
ucaguccccugaggacau

SEQ ID NO: 295460 - RNA, 24 nt, Human
uccaaaacuugagcauugaucuug

SEQ ID NO: 295461 - RNA, 26 nt, Human
uccacacacuucccuuccuuaucuua

SEQ ID NO: 295462 - RNA, 19 nt, Human
uccacauccacacacuucc

SEQ ID NO: 295463 - RNA, 22 nt, Human
uccaccaguggcaccucuggag

SEQ ID NO: 295464 - RNA, 21 nt, Human
ugaaaaacaaaacagaagacu

SEQ ID NO: 295465 - RNA, 18 nt, Human
ugacccuuccaccagugg

SEQ ID NO: 295466 - RNA, 22 nt, Human
ugacccuuccaccaguggcacc

SEQ ID NO: 295467 - RNA, 19 nt, Human
ugauuuggaagauggagga

SEQ ID NO: 295468 - RNA, 24 nt, Human
ugcccuagcucccugccuccccaa

SEQ ID NO: 295469 - RNA, 19 nt, Human
ugccugggcugagcccuau

SEQ ID NO: 295470 - RNA, 23 nt, Human
ugccugggcugagcccuauuaug

SEQ ID NO: 295471 - RNA, 22 nt, Human
ugcuggggcuccgcuccggggg

SEQ ID NO: 295472 - RNA, 21 nt, Human
uggaaacgucaaacaaugaaa

SEQ ID NO: 295473 - RNA, 25 nt, Human
uggaaacgucaaacaaugaaaaaca

SEQ ID NO: 295474 - RNA, 18 nt, Human
uggaaggaggugaagggg

SEQ ID NO: 295475 - RNA, 21 nt, Human
uggaaggaggugaaggggcug

SEQ ID NO: 295476 - RNA, 22 nt, Human
uggaaggaggugaaggggcugg

SEQ ID NO: 295477 - RNA, 18 nt, Human
uggaaucuggaggauguu

SEQ ID NO: 295478 - RNA, 22 nt, Human
uggaaucuggaggauguuguca

SEQ ID NO: 295479 - RNA, 21 nt, Human
uggacacagcacaaaacacaa

SEQ ID NO: 295480 - RNA, 19 nt, Human
uggaggauguugucagucc

SEQ ID NO: 295481 - RNA, 21 nt, Human
uggagugggguggggaggagg

SEQ ID NO: 295482 - RNA, 23 nt, Human
uggauggccggggacccaggggc

SEQ ID NO: 295483 - RNA, 25 nt, Human
uggcaaaugguucuuggugucuaca

SEQ ID NO: 295484 - RNA, 19 nt, Human
uggcaaggugaaggacuga

SEQ ID NO: 295485 - RNA, 21 nt, Human
uggcaaggugaaggacugagg

SEQ ID NO: 295486 - RNA, 23 nt, Human
uggcaccucuggaguacccagca

SEQ ID NO: 295487 - RNA, 24 nt, Human
uggcaccucuggaguacccagcac

SEQ ID NO: 295488 - RNA, 18 nt, Human
uggcugccugggcugagc

SEQ ID NO: 295489 - RNA, 21 nt, Human
uggcugccugggcugagcccu

SEQ ID NO: 295490 - RNA, 19 nt, Human
ugggaaggguccagccuag

SEQ ID NO: 295491 - RNA, 20 nt, Human
ugggaaggguccagccuagu

SEQ ID NO: 295492 - RNA, 20 nt, Human
ugggaaggguccagccuagu

SEQ ID NO: 295493 - RNA, 19 nt, Human
ugggauggaugggccugau

SEQ ID NO: 295494 - RNA, 20 nt, Human
ugggcugguuggggagaggc

SEQ ID NO: 295495 - RNA, 22 nt, Human
uggggaccugggcaguggccuu

SEQ ID NO: 295496 - RNA, 20 nt, Human
uggggaggagggaggcaugg

SEQ ID NO: 295497 - RNA, 21 nt, Human
uggggaggagggaggcauggg

SEQ ID NO: 295498 - RNA, 18 nt, Human
ugggugcagguaaggaga

SEQ ID NO: 295499 - RNA, 26 nt, Human
ugguagcaaaaugcccucccuaaauc

SEQ ID NO: 295500 - RNA, 21 nt, Human
ugguccccagggcguugggaa

SEQ ID NO: 295501 - RNA, 20 nt, Human
uggucccugcccuagcuccc

SEQ ID NO: 295502 - RNA, 18 nt, Human
uguaagggcaggucuggg

SEQ ID NO: 295503 - RNA, 23 nt, Human
ugucuacaguaaccccacuaccc

SEQ ID NO: 295504 - RNA, 19 nt, Human
uguggcaaaugguucuugg

SEQ ID NO: 295505 - RNA, 23 nt, Human
uguggcaaaugguucuugguguc

SEQ ID NO: 295506 - RNA, 21 nt, Human
uuguuucuguuucccaagggg

SEQ ID NO: 295507 - RNA, 18 nt, Human
uuuucagaacuaggaggc

SEQ ID NO: 295508 - RNA, 21 nt, Human
aaaacacaacacgggccgccg

SEQ ID NO: 295509 - RNA, 19 nt, Human
aaaagcacaccgcacuaca

SEQ ID NO: 295510 - RNA, 25 nt, Human
aaacaaaacagaagacuggucccca

SEQ ID NO: 295511 - RNA, 25 nt, Human
aaacaaaacagaagacuggucccca

SEQ ID NO: 295512 - RNA, 23 nt, Human
aaacagaagacugguccccaggg

SEQ ID NO: 295513 - RNA, 20 nt, Human
aaaugcccucccuaaauccc

SEQ ID NO: 295514 - RNA, 19 nt, Human
aacagaagacugguccccc

SEQ ID NO: 295515 - RNA, 19 nt, Human
aagaggucaugaugcccuu

SEQ ID NO: 295516 - RNA, 25 nt, Human
acaaaacacaacacgggccgccgcg

SEQ ID NO: 295517 - RNA, 22 nt, Human
acaaaacagaagacuggucccc

SEQ ID NO: 295518 - RNA, 27 nt, Human
acagagccuccuccaaggccuugauaa

SEQ ID NO: 295519 - RNA, 22 nt, Human
acagcacaaaacacaacacggg

SEQ ID NO: 295520 - RNA, 21 nt, Human
accaugcuuugggggaagauu

SEQ ID NO: 295521 - RNA, 19 nt, Human
acucgggaaagaggaacug

SEQ ID NO: 295522 - RNA, 22 nt, Human
acugaaaugccaguuuaaucca

SEQ ID NO: 295523 - RNA, 20 nt, Human
agaaggucuaugcacaagga

SEQ ID NO: 295524 - RNA, 19 nt, Human
agaggaacuguuggagugg

SEQ ID NO: 295525 - RNA, 24 nt, Human
agcucagcccaaagcuggcugccu

SEQ ID NO: 295526 - RNA, 21 nt, Human
aggacauacagagccuccucc

SEQ ID NO: 295527 - RNA, 22 nt, Human
aggaggcuuguagguuacuugg

SEQ ID NO: 295528 - RNA, 20 nt, Human
aggagggaggcaugggaugg

SEQ ID NO: 295529 - RNA, 18 nt, Human
aggagggcaggggcccug

SEQ ID NO: 295530 - RNA, 19 nt, Human
aggaggugggggaagucaa

SEQ ID NO: 295531 - RNA, 23 nt, Human
agggaggcaugggauggaugggg

SEQ ID NO: 295532 - RNA, 18 nt, Human
agggggcgcacuggggac

SEQ ID NO: 295533 - RNA, 25 nt, Human
auacagagccuccuccaaccggagg

SEQ ID NO: 295534 - RNA, 20 nt, Human
auucuacaccagccgaaaga

SEQ ID NO: 295535 - RNA, 21 nt, Human
caaaacagaagacuggucccc

SEQ ID NO: 295536 - RNA, 23 nt, Human
caaacaaugaaaaacaaaacaga

SEQ ID NO: 295537 - RNA, 22 nt, Human
caacaccccaaccaccuuacuc

SEQ ID NO: 295538 - RNA, 21 nt, Human
cacacuucccuuccuuaucuu

SEQ ID NO: 295539 - RNA, 21 nt, Human
caccccauacugucuuggaac

SEQ ID NO: 295540 - RNA, 20 nt, Human
caccgcacuacacuacuggc

SEQ ID NO: 295541 - RNA, 18 nt, Human
cacuggggaccugggcag

SEQ ID NO: 295542 - RNA, 25 nt, Human
cagagccuccuccaaggccuugaua

SEQ ID NO: 295543 - RNA, 22 nt, Human
caggagggcaggggcccuguug

SEQ ID NO: 295544 - RNA, 22 nt, Human
caggggcagaagggggugggag

SEQ ID NO: 295545 - RNA, 22 nt, Human
caguauucuggggguuagcccu

SEQ ID NO: 295546 - RNA, 23 nt, Human
ccacacacuucccuuccuuaucu

SEQ ID NO: 295547 - RNA, 20 nt, Human
ccacagaggccccucugacc

SEQ ID NO: 295548 - RNA, 29 nt, Human
ccacccgccaucacguaaaagcacaccgg

SEQ ID NO: 295549 - RNA, 23 nt, Human
ccauacugucuuggaacaugcag

SEQ ID NO: 295550 - RNA, 26 nt, Human
ccauacugucuuggaacaugcagugg

SEQ ID NO: 295551 - RNA, 21 nt, Human
cccaccauccacauccacaca

SEQ ID NO: 295552 - RNA, 18 nt, Human
ccccacuacccccauggg

SEQ ID NO: 295553 - RNA, 20 nt, Human
ccccacuacccccaugggua

SEQ ID NO: 295554 - RNA, 21 nt, Human
ccccacuacccccauggguac

SEQ ID NO: 295555 - RNA, 27 nt, Human
cccccaccauccacauccacacacuuc

SEQ ID NO: 295556 - RNA, 25 nt, Human
cccccugggggggaagggguaggug

SEQ ID NO: 295557 - RNA, 21 nt, Human
ccccugaggacauacagagcc

SEQ ID NO: 295558 - RNA, 18 nt, Human
ccccugggggggaagggg

SEQ ID NO: 295559 - RNA, 20 nt, Human
cccugaaacucugaggccug

SEQ ID NO: 295560 - RNA, 22 nt, Human
ccucucaaggggaccugguccu

SEQ ID NO: 295561 - RNA, 19 nt, Human
ccuggcuggcccacccuuc

SEQ ID NO: 295562 - RNA, 22 nt, Human
ccuggcuggcccacccuuccug

SEQ ID NO: 295563 - RNA, 19 nt, Human
ccugggcugagacuuucug

SEQ ID NO: 295564 - RNA, 21 nt, Human
ccugggcugagcccuauuaug

SEQ ID NO: 295565 - RNA, 21 nt, Human
ccuguuagcucagcccaaagc

SEQ ID NO: 295566 - RNA, 24 nt, Human
cgcccgcugcccacccgccaucac

SEQ ID NO: 295567 - RNA, 18 nt, Human
cgccgcccgcugcccacc

SEQ ID NO: 295568 - RNA, 22 nt, Human
cgcguggacacagcacaaaaca

SEQ ID NO: 295569 - RNA, 22 nt, Human
cggcaccuggcaaggugaagga

SEQ ID NO: 295570 - RNA, 22 nt, Human
cucagcccaaagcuggcugccu

SEQ ID NO: 295571 - RNA, 23 nt, Human
cugaggccugggugcagguaagg

SEQ ID NO: 295572 - RNA, 18 nt, Human
cugccugggcugagcccu

SEQ ID NO: 295573 - RNA, 18 nt, Human
cuggcaaggugaaggacu

SEQ ID NO: 295574 - RNA, 18 nt, Human
gaaaaacaaaacagaaga

SEQ ID NO: 295575 - RNA, 18 nt, Human
gaagauggaggaguucag

SEQ ID NO: 295576 - RNA, 21 nt, Human
gacccaggggcagaagggggu

SEQ ID NO: 295577 - RNA, 21 nt, Human
gagcauggccuuggccccuac

SEQ ID NO: 295578 - RNA, 18 nt, Human
gaggagggaggcauggga

SEQ ID NO: 295579 - RNA, 20 nt, Human
gagugggguggggaggaggg

SEQ ID NO: 295580 - RNA, 21 nt, Human
gcccccaccauccacauccac

SEQ ID NO: 295581 - RNA, 18 nt, Human
gcccuguggcucuuggcc

SEQ ID NO: 295582 - RNA, 18 nt, Human
gcggagcccgccgcccgc

SEQ ID NO: 295583 - RNA, 19 nt, Human
gcguggacacagcacaaaa

SEQ ID NO: 295584 - RNA, 20 nt, Human
gcugcgcggagcccgccgcc

SEQ ID NO: 295585 - RNA, 20 nt, Human
ggacccaggggcagaagggg

SEQ ID NO: 295586 - RNA, 22 nt, Human
ggagaagucaguacgggggagg

SEQ ID NO: 295587 - RNA, 20 nt, Human
ggagggggcgcuacacuacu

SEQ ID NO: 295588 - RNA, 21 nt, Human
ggagugggguggggaggaggg

SEQ ID NO: 295589 - RNA, 22 nt, Human
ggagugggguggggaggaggga

SEQ ID NO: 295590 - RNA, 21 nt, Human
ggcaggucugggguucucugg

SEQ ID NO: 295591 - RNA, 19 nt, Human
ggcguugggaagaggcuug

SEQ ID NO: 295592 - RNA, 19 nt, Human
gggaccugguccuaaaccu

SEQ ID NO: 295593 - RNA, 19 nt, Human
gggaggagggaggcauggg

SEQ ID NO: 295594 - RNA, 20 nt, Human
gggaggcaugggauggaugg

SEQ ID NO: 295595 - RNA, 19 nt, Human
gggcguugggaagaggcuu

SEQ ID NO: 295596 - RNA, 18 nt, Human
ggggaagggguaggugcu

SEQ ID NO: 295597 - RNA, 24 nt, Human
ggggagggggucgccuuagcgcgu

SEQ ID NO: 295598 - RNA, 27 nt, Human
ggggcagaagggggugggagaagaagg

SEQ ID NO: 295599 - RNA, 19 nt, Human
gggguggggaggagggagg

SEQ ID NO: 295600 - RNA, 20 nt, Human
gggguggggaggagggaggc

SEQ ID NO: 295601 - RNA, 23 nt, Human
gugaaggacugaggcuucaggag

SEQ ID NO: 295602 - RNA, 19 nt, Human
uacagagccuccuccaagg

SEQ ID NO: 295603 - RNA, 20 nt, Human
uacagagccuccuccaaggg

SEQ ID NO: 295604 - RNA, 21 nt, Human
uaccaguauucuggggguuag

SEQ ID NO: 295605 - RNA, 19 nt, Human
uagcccugaaacucugagg

SEQ ID NO: 295606 - RNA, 24 nt, Human
uaggagaagucaguacgggggagg

SEQ ID NO: 295607 - RNA, 25 nt, Human
uaucuuaccaccccauacugucuug

SEQ ID NO: 295608 - RNA, 20 nt, Human
ucagcccaaagcuggcugcc

SEQ ID NO: 295609 - RNA, 18 nt, Human
ucaguccccugaggacau

SEQ ID NO: 295610 - RNA, 24 nt, Human
uccaaaacuugagcauugaucuug

SEQ ID NO: 295611 - RNA, 19 nt, Human
uccacauccacacacuucc

SEQ ID NO: 295612 - RNA, 22 nt, Human
uccaccaguggcaccucuggag

SEQ ID NO: 295613 - RNA, 20 nt, Human
uccaugcccccaccauccac

SEQ ID NO: 295614 - RNA, 21 nt, Human
ugaaaaacaaaacagaagacu

SEQ ID NO: 295615 - RNA, 18 nt, Human
ugacccuuccaccagugg

SEQ ID NO: 295616 - RNA, 22 nt, Human
ugacccuuccaccaguggcacc

SEQ ID NO: 295617 - RNA, 24 nt, Human
ugcccuagcucccugccuccccaa

SEQ ID NO: 295618 - RNA, 19 nt, Human
ugccugggcugagcccuau

SEQ ID NO: 295619 - RNA, 23 nt, Human
ugccugggcugagcccuauuaug

SEQ ID NO: 295620 - RNA, 22 nt, Human
ugcuggggcuccgcuccggggg

SEQ ID NO: 295621 - RNA, 21 nt, Human
uggaaacgucaaacaaugaaa

SEQ ID NO: 295622 - RNA, 25 nt, Human
uggaaacgucaaacaaugaaaaaca

SEQ ID NO: 295623 - RNA, 18 nt, Human
uggaaggaggugaagggg

SEQ ID NO: 295624 - RNA, 21 nt, Human
uggaaggaggugaaggggcug

SEQ ID NO: 295625 - RNA, 22 nt, Human
uggaaggaggugaaggggcugg

SEQ ID NO: 295626 - RNA, 18 nt, Human
uggaaucuggaggauguu

SEQ ID NO: 295627 - RNA, 22 nt, Human
uggaaucuggaggauguuguca

SEQ ID NO: 295628 - RNA, 21 nt, Human
uggacacagcacaaaacacaa

SEQ ID NO: 295629 - RNA, 19 nt, Human
uggaggauguugucagucc

SEQ ID NO: 295630 - RNA, 21 nt, Human
uggagugggguggggaggagg

SEQ ID NO: 295631 - RNA, 23 nt, Human
uggauggccggggacccaggggc

SEQ ID NO: 295632 - RNA, 29 nt, Human
uggcaaaugguucuuggugucuacaguaa

SEQ ID NO: 295633 - RNA, 19 nt, Human
uggcaaggugaaggacuga

SEQ ID NO: 295634 - RNA, 21 nt, Human
uggcaaggugaaggacugagg

SEQ ID NO: 295635 - RNA, 23 nt, Human
uggcaccucuggaguacccagca

SEQ ID NO: 295636 - RNA, 24 nt, Human
uggcaccucuggaguacccagcac

SEQ ID NO: 295637 - RNA, 18 nt, Human
uggcugccugggcugagc

SEQ ID NO: 295638 - RNA, 21 nt, Human
uggcugccugggcugagcccu

SEQ ID NO: 295639 - RNA, 19 nt, Human
ugggaaggguccagccuag

SEQ ID NO: 295640 - RNA, 20 nt, Human
ugggaaggguccagccuagu

SEQ ID NO: 295641 - RNA, 19 nt, Human
ugggauggaugggccugau

SEQ ID NO: 295642 - RNA, 20 nt, Human
ugggcugguuggggagaggc

SEQ ID NO: 295643 - RNA, 22 nt, Human
uggggaccugggcaguggccuu

SEQ ID NO: 295644 - RNA, 20 nt, Human
uggggaggagggaggcaugg

SEQ ID NO: 295645 - RNA, 21 nt, Human
uggggaggagggaggcauggg

SEQ ID NO: 295646 - RNA, 18 nt, Human
ugggugcagguaaggaga

SEQ ID NO: 295647 - RNA, 26 nt, Human
ugguagcaaaaugcccucccuaaauc

SEQ ID NO: 295648 - RNA, 21 nt, Human
ugguccccagggcguugggaa

SEQ ID NO: 295649 - RNA, 20 nt, Human
uggucccugcccuagcuccc

SEQ ID NO: 295650 - RNA, 23 nt, Human
ugguuuauggcuggaaucuggag

SEQ ID NO: 295651 - RNA, 18 nt, Human
uguaagggcaggucuggg

SEQ ID NO: 295652 - RNA, 23 nt, Human
ugucuacaguaaccccacuaccc

SEQ ID NO: 295653 - RNA, 19 nt, Human
uguggcaaaugguucuugg

SEQ ID NO: 295654 - RNA, 23 nt, Human
uguggcaaaugguucuugguguc

SEQ ID NO: 295655 - RNA, 20 nt, Human
uuauguagugggaagggucc

SEQ ID NO: 295656 - RNA, 20 nt, Human
uugauuuggaagauggagga

SEQ ID NO: 295657 - RNA, 21 nt, Human
uuguuucuguuucccaagggg

SEQ ID NO: 295658 - RNA, 21 nt, Human
uuguuugaggaggaggugggg

SEQ ID NO: 295659 - RNA, 21 nt, Human
uuuaaccaggcuauggccacu

SEQ ID NO: 295660 - RNA, 18 nt, Human
uuuucagaacuaggaggc

SEQ ID NO: 295661 - RNA, 21 nt, Human
aaaacacaacacgggccgccg

SEQ ID NO: 295662 - RNA, 24 nt, Human
aaaacagaagacugguccccaggg

SEQ ID NO: 295663 - RNA, 19 nt, Human
aaaagcacaccgcacuaca

SEQ ID NO: 295664 - RNA, 25 nt, Human
aaacaaaacagaagacuggucccca

SEQ ID NO: 295665 - RNA, 25 nt, Human
aaacaaaacagaagacuggucccca

SEQ ID NO: 295666 - RNA, 18 nt, Human
aaaugcccucccuaaauc

SEQ ID NO: 295667 - RNA, 19 nt, Human
aacagaagacugguccccc

SEQ ID NO: 295668 - RNA, 19 nt, Human
aagaggucaugaugcccuu

SEQ ID NO: 295669 - RNA, 25 nt, Human
acaaaacacaacacgggccgccgcg

SEQ ID NO: 295670 - RNA, 22 nt, Human
acaaaacagaagacuggucccc

SEQ ID NO: 295671 - RNA, 18 nt, Human
acagagccuccuccaagg

SEQ ID NO: 295672 - RNA, 27 nt, Human
acagagccuccuccaaggccuugauaa

SEQ ID NO: 295673 - RNA, 22 nt, Human
acagcacaaaacacaacacggg

SEQ ID NO: 295674 - RNA, 21 nt, Human
accaugcuuugggggaagauu

SEQ ID NO: 295675 - RNA, 20 nt, Human
accccauacugucuuggaac

SEQ ID NO: 295676 - RNA, 19 nt, Human
acucgggaaagaggaacug

SEQ ID NO: 295677 - RNA, 22 nt, Human
acugaaaugccaguuuaaucca

SEQ ID NO: 295678 - RNA, 20 nt, Human
agaaggucuaugcacaagga

SEQ ID NO: 295679 - RNA, 19 nt, Human
agaggaacuguuggagugg

SEQ ID NO: 295680 - RNA, 24 nt, Human
agcucagcccaaagcuggcugccu

SEQ ID NO: 295681 - RNA, 21 nt, Human
aggacauacagagccuccucc

SEQ ID NO: 295682 - RNA, 22 nt, Human
aggaggcuuguagguuacuugg

SEQ ID NO: 295683 - RNA, 20 nt, Human
aggagggaggcaugggaugg

SEQ ID NO: 295684 - RNA, 18 nt, Human
aggagggcaggggcccug

SEQ ID NO: 295685 - RNA, 19 nt, Human
aggaggugggggaagucaa

SEQ ID NO: 295686 - RNA, 21 nt, Human
aggggcagaagggggugggag

SEQ ID NO: 295687 - RNA, 18 nt, Human
agggggcgcacuggggac

SEQ ID NO: 295688 - RNA, 25 nt, Human
auacagagccuccuccaaccggagg

SEQ ID NO: 295689 - RNA, 20 nt, Human
auucuacaccagccgaaaga

SEQ ID NO: 295690 - RNA, 21 nt, Human
caaaacagaagacuggucccc

SEQ ID NO: 295691 - RNA, 23 nt, Human
caaacaaugaaaaacaaaacaga

SEQ ID NO: 295692 - RNA, 22 nt, Human
caacaccccaaccaccuuacuc

SEQ ID NO: 295693 - RNA, 21 nt, Human
cacacuucccuuccuuaucuu

SEQ ID NO: 295694 - RNA, 20 nt, Human
caccgcacuacacuacuggc

SEQ ID NO: 295695 - RNA, 18 nt, Human
cacuggggaccugggcag

SEQ ID NO: 295696 - RNA, 25 nt, Human
cagagccuccuccaaggccuugaua

SEQ ID NO: 295697 - RNA, 22 nt, Human
caggagggcaggggcccuguug

SEQ ID NO: 295698 - RNA, 22 nt, Human
caguauucuggggguuagcccu

SEQ ID NO: 295699 - RNA, 21 nt, Human
cauacagagccuccuccaagg

SEQ ID NO: 295700 - RNA, 29 nt, Human
ccacccgccaucacguaaaagcacaccgg

SEQ ID NO: 295701 - RNA, 23 nt, Human
ccauacugucuuggaacaugcag

SEQ ID NO: 295702 - RNA, 26 nt, Human
ccauacugucuuggaacaugcagugg

SEQ ID NO: 295703 - RNA, 21 nt, Human
cccacagaggccccucugacc

SEQ ID NO: 295704 - RNA, 21 nt, Human
cccaccauccacauccacaca

SEQ ID NO: 295705 - RNA, 19 nt, Human
cccaggggcagaagggggu

SEQ ID NO: 295706 - RNA, 26 nt, Human
ccccaccauccacauccacacacuuc

SEQ ID NO: 295707 - RNA, 19 nt, Human
ccccacuacccccaugggu

SEQ ID NO: 295708 - RNA, 20 nt, Human
ccccacuacccccaugggua

SEQ ID NO: 295709 - RNA, 21 nt, Human
ccccacuacccccauggguac

SEQ ID NO: 295710 - RNA, 25 nt, Human
cccccugggggggaagggguaggug

SEQ ID NO: 295711 - RNA, 21 nt, Human
ccccugaggacauacagagcc

SEQ ID NO: 295712 - RNA, 18 nt, Human
ccccugggggggaagggg

SEQ ID NO: 295713 - RNA, 20 nt, Human
cccugaaacucugaggccug

SEQ ID NO: 295714 - RNA, 21 nt, Human
ccgccgcccgcugcccacccg

SEQ ID NO: 295715 - RNA, 19 nt, Human
ccuggcuggcccacccuuc

SEQ ID NO: 295716 - RNA, 22 nt, Human
ccuggcuggcccacccuuccug

SEQ ID NO: 295717 - RNA, 19 nt, Human
ccugggcugagacuuucug

SEQ ID NO: 295718 - RNA, 21 nt, Human
ccugggcugagcccuauuaug

SEQ ID NO: 295719 - RNA, 21 nt, Human
ccuguuagcucagcccaaagc

SEQ ID NO: 295720 - RNA, 24 nt, Human
cgcccgcugcccacccgccaucac

SEQ ID NO: 295721 - RNA, 19 nt, Human
cgcccuguggcucuuggcc

SEQ ID NO: 295722 - RNA, 22 nt, Human
cgcguggacacagcacaaaaca

SEQ ID NO: 295723 - RNA, 23 nt, Human
cggcugcgcggagcccgccgccc

SEQ ID NO: 295724 - RNA, 22 nt, Human
cucagcccaaagcuggcugccu

SEQ ID NO: 295725 - RNA, 21 nt, Human
cucucaaggggaccugguccu

SEQ ID NO: 295726 - RNA, 18 nt, Human
cugccugggcugagcccu

SEQ ID NO: 295727 - RNA, 18 nt, Human
cuggcaaggugaaggacu

SEQ ID NO: 295728 - RNA, 22 nt, Human
cuuguuugaggaggaggugggg

SEQ ID NO: 295729 - RNA, 22 nt, Human
cuuuaaccaggcuauggccacu

SEQ ID NO: 295730 - RNA, 18 nt, Human
gaaaaacaaaacagaaga

SEQ ID NO: 295731 - RNA, 18 nt, Human
gaagauggaggaguucag

SEQ ID NO: 295732 - RNA, 21 nt, Human
gacccaggggcagaagggggu

SEQ ID NO: 295733 - RNA, 21 nt, Human
gagcauggccuuggccccuac

SEQ ID NO: 295734 - RNA, 18 nt, Human
gaggagggaggcauggga

SEQ ID NO: 295735 - RNA, 21 nt, Human
gaggccugggugcagguaagg

SEQ ID NO: 295736 - RNA, 20 nt, Human
gagugggguggggaggaggg

SEQ ID NO: 295737 - RNA, 20 nt, Human
gcaccuggcaaggugaagga

SEQ ID NO: 295738 - RNA, 21 nt, Human
gcccccaccauccacauccac

SEQ ID NO: 295739 - RNA, 18 nt, Human
gcccuguggcucuuggcc

SEQ ID NO: 295740 - RNA, 18 nt, Human
gcggagcccgccgcccgc

SEQ ID NO: 295741 - RNA, 19 nt, Human
gcguggacacagcacaaaa

SEQ ID NO: 295742 - RNA, 20 nt, Human
gcugcgcggagcccgccgcc

SEQ ID NO: 295743 - RNA, 20 nt, Human
ggacccaggggcagaagggg

SEQ ID NO: 295744 - RNA, 22 nt, Human
ggagaagucaguacgggggagg

SEQ ID NO: 295745 - RNA, 20 nt, Human
ggagggggcgcuacacuacu

SEQ ID NO: 295746 - RNA, 21 nt, Human
ggagugggguggggaggaggg

SEQ ID NO: 295747 - RNA, 22 nt, Human
ggagugggguggggaggaggga

SEQ ID NO: 295748 - RNA, 21 nt, Human
ggcaggucugggguucucugg

SEQ ID NO: 295749 - RNA, 19 nt, Human
ggcguugggaagaggcuug

SEQ ID NO: 295750 - RNA, 19 nt, Human
gggaccugguccuaaaccu

SEQ ID NO: 295751 - RNA, 19 nt, Human
gggaggagggaggcauggg

SEQ ID NO: 295752 - RNA, 20 nt, Human
gggaggcaugggauggaugg

SEQ ID NO: 295753 - RNA, 21 nt, Human
gggcagaagggggugggagaa

SEQ ID NO: 295754 - RNA, 19 nt, Human
gggcguugggaagaggcuu

SEQ ID NO: 295755 - RNA, 18 nt, Human
ggggaagggguaggugcu

SEQ ID NO: 295756 - RNA, 30 nt, Human; identical to SEQ ID NO: 294429

SEQ ID NO: 295757 - RNA, 24 nt, Human
ggggagggggucgccuuagcgcgu

SEQ ID NO: 295758 - RNA, 27 nt, Human
ggggcagaagggggugggagaagaagg

SEQ ID NO: 295759 - RNA, 20 nt, Human
gggguggggaggagggaggc

SEQ ID NO: 295760 - RNA, 23 nt, Human
gugaaggacugaggcuucaggag

SEQ ID NO: 295761 - RNA, 20 nt, Human
uacagagccuccuccaaggg

SEQ ID NO: 295762 - RNA, 21 nt, Human
uaccaguauucuggggguuag

SEQ ID NO: 295763 - RNA, 19 nt, Human
uagcccugaaacucugagg

SEQ ID NO: 295764 - RNA, 24 nt, Human
uaggagaagucaguacgggggagg

SEQ ID NO: 295765 - RNA, 25 nt, Human
uaucuuaccaccccauacugucuug

SEQ ID NO: 295766 - RNA, 20 nt, Human
ucagcccaaagcuggcugcc

SEQ ID NO: 295767 - RNA, 18 nt, Human
ucaguccccugaggacau

SEQ ID NO: 295768 - RNA, 24 nt, Human
uccaaaacuugagcauugaucuug

SEQ ID NO: 295769 - RNA, 26 nt, Human
uccacacacuucccuuccuuaucuua

SEQ ID NO: 295770 - RNA, 19 nt, Human
uccacauccacacacuucc

SEQ ID NO: 295771 - RNA, 22 nt, Human
uccaccaguggcaccucuggag

SEQ ID NO: 295772 - RNA, 20 nt, Human
uccaugcccccaccauccac

SEQ ID NO: 295773 - RNA, 21 nt, Human
ugaaaaacaaaacagaagacu

SEQ ID NO: 295774 - RNA, 18 nt, Human
ugacccuuccaccagugg

SEQ ID NO: 295775 - RNA, 22 nt, Human
ugacccuuccaccaguggcacc

SEQ ID NO: 295776 - RNA, 24 nt, Human
ugcccuagcucccugccuccccaa

SEQ ID NO: 295777 - RNA, 23 nt, Human
ugccugggcugagcccuauuaug

SEQ ID NO: 295778 - RNA, 21 nt, Human
ugcuggggcuccgcuccgggg

SEQ ID NO: 295779 - RNA, 21 nt, Human
uggaaacgucaaacaaugaaa

SEQ ID NO: 295780 - RNA, 25 nt, Human
uggaaacgucaaacaaugaaaaaca

SEQ ID NO: 295781 - RNA, 18 nt, Human
uggaaggaggugaagggg

SEQ ID NO: 295782 - RNA, 21 nt, Human
uggaaggaggugaaggggcug

SEQ ID NO: 295783 - RNA, 22 nt, Human
uggaaggaggugaaggggcugg

SEQ ID NO: 295784 - RNA, 18 nt, Human
uggaaucuggaggauguu

SEQ ID NO: 295785 - RNA, 22 nt, Human
uggaaucuggaggauguuguca

SEQ ID NO: 295786 - RNA, 21 nt, Human
uggacacagcacaaaacacaa

SEQ ID NO: 295787 - RNA, 19 nt, Human
uggaggauguugucagucc

SEQ ID NO: 295788 - RNA, 21 nt, Human
uggagugggguggggaggagg

SEQ ID NO: 295789 - RNA, 23 nt, Human
uggauggccggggacccaggggc

SEQ ID NO: 295790 - RNA, 25 nt, Human
uggcaaaugguucuuggugucuaca

SEQ ID NO: 295791 - RNA, 19 nt, Human
uggcaaggugaaggacuga

SEQ ID NO: 295792 - RNA, 21 nt, Human
uggcaaggugaaggacugagg

SEQ ID NO: 295793 - RNA, 23 nt, Human
uggcaccucuggaguacccagca

SEQ ID NO: 295794 - RNA, 24 nt, Human
uggcaccucuggaguacccagcac

SEQ ID NO: 295795 - RNA, 18 nt, Human
uggcugccugggcugagc

SEQ ID NO: 295796 - RNA, 21 nt, Human
uggcugccugggcugagcccu

SEQ ID NO: 295797 - RNA, 19 nt, Human
ugggaaggguccagccuag

SEQ ID NO: 295798 - RNA, 20 nt, Human
ugggaaggguccagccuagu

SEQ ID NO: 295799 - RNA, 19 nt, Human
ugggauggaugggccugau

SEQ ID NO: 295800 - RNA, 20 nt, Human
ugggcugguuggggagaggc

SEQ ID NO: 295801 - RNA, 22 nt, Human
uggggaccugggcaguggccuu

SEQ ID NO: 295802 - RNA, 20 nt, Human
uggggaggagggaggcaugg

SEQ ID NO: 295803 - RNA, 21 nt, Human
uggggaggagggaggcauggg

SEQ ID NO: 295804 - RNA, 18 nt, Human
ugggugcagguaaggaga

SEQ ID NO: 295805 - RNA, 26 nt, Human
ugguagcaaaaugcccucccuaaauc

SEQ ID NO: 295806 - RNA, 21 nt, Human
ugguccccagggcguugggaa

SEQ ID NO: 295807 - RNA, 20 nt, Human
uggucccugcccuagcuccc

SEQ ID NO: 295808 - RNA, 23 nt, Human
ugguuuauggcuggaaucuggag

SEQ ID NO: 295809 - RNA, 18 nt, Human
uguaagggcaggucuggg

SEQ ID NO: 295810 - RNA, 23 nt, Human
ugucuacaguaaccccacuaccc

SEQ ID NO: 295811 - RNA, 19 nt, Human
uguggcaaaugguucuugg

SEQ ID NO: 295812 - RNA, 23 nt, Human
uguggcaaaugguucuugguguc

SEQ ID NO: 295813 - RNA, 20 nt, Human
uuauguagugggaagggucc

SEQ ID NO: 295814 - RNA, 20 nt, Human
uugauuuggaagauggagga

SEQ ID NO: 295815 - RNA, 21 nt, Human
uuguuucuguuucccaagggg

SEQ ID NO: 295816 - RNA, 18 nt, Human
uuuucagaacuaggaggc

SEQ ID NO: 295817 - RNA, 21 nt, Human
aaaacacaacacgggccgccg

SEQ ID NO: 295818 - RNA, 19 nt, Human
aaaagcacaccgcacuaca

SEQ ID NO: 295819 - RNA, 25 nt, Human
aaacaaaacagaagacuggucccca

SEQ ID NO: 295820 - RNA, 25 nt, Human
aaacaaaacagaagacuggucccca

SEQ ID NO: 295821 - RNA, 23 nt, Human
aaacagaagacugguccccaggg

SEQ ID NO: 295822 - RNA, 18 nt, Human
aaaugcccucccuaaauc

SEQ ID NO: 295823 - RNA, 19 nt, Human
aacagaagacugguccccc

SEQ ID NO: 295824 - RNA, 19 nt, Human
aagaggucaugaugcccuu

SEQ ID NO: 295825 - RNA, 23 nt, Human
aagcuggcugccugggcugagcc

SEQ ID NO: 295826 - RNA, 25 nt, Human
acaaaacacaacacgggccgccgcg

SEQ ID NO: 295827 - RNA, 22 nt, Human
acaaaacagaagacuggucccc

SEQ ID NO: 295828 - RNA, 27 nt, Human
acagagccuccuccaaggccuugauaa

SEQ ID NO: 295829 - RNA, 22 nt, Human
acagcacaaaacacaacacggg

SEQ ID NO: 295830 - RNA, 21 nt, Human
accaugcuuugggggaagauu

SEQ ID NO: 295831 - RNA, 19 nt, Human
acucgggaaagaggaacug

SEQ ID NO: 295832 - RNA, 22 nt, Human
acugaaaugccaguuuaaucca

SEQ ID NO: 295833 - RNA, 20 nt, Human
agaaggucuaugcacaagga

SEQ ID NO: 295834 - RNA, 19 nt, Human
agaggaacuguuggagugg

SEQ ID NO: 295835 - RNA, 24 nt, Human
agcucagcccaaagcuggcugccu

SEQ ID NO: 295836 - RNA, 21 nt, Human
aggacauacagagccuccucc

SEQ ID NO: 295837 - RNA, 22 nt, Human
aggaggcuuguagguuacuugg

SEQ ID NO: 295838 - RNA, 20 nt, Human
aggagggaggcaugggaugg

SEQ ID NO: 295839 - RNA, 18 nt, Human
aggagggcaggggcccug

SEQ ID NO: 295840 - RNA, 19 nt, Human
aggaggugggggaagucaa

SEQ ID NO: 295841 - RNA, 23 nt, Human
agggaggcaugggauggaugggg

SEQ ID NO: 295842 - RNA, 21 nt, Human
aggggcagaagggggugggag

SEQ ID NO: 295843 - RNA, 18 nt, Human
agggggcgcacuggggac

SEQ ID NO: 295844 - RNA, 25 nt, Human
auacagagccuccuccaaccggagg

SEQ ID NO: 295845 - RNA, 20 nt, Human
auucuacaccagccgaaaga

SEQ ID NO: 295846 - RNA, 21 nt, Human
caaaacagaagacuggucccc

SEQ ID NO: 295847 - RNA, 24 nt, Human
caaaauaauagagaaauaucaugc

SEQ ID NO: 295848 - RNA, 23 nt, Human
caaacaaugaaaaacaaaacaga

SEQ ID NO: 295849 - RNA, 22 nt, Human
caacaccccaaccaccuuacuc

SEQ ID NO: 295850 - RNA, 21 nt, Human
cacacuucccuuccuuaucuu

SEQ ID NO: 295851 - RNA, 21 nt, Human
caccccauacugucuuggaac

SEQ ID NO: 295852 - RNA, 20 nt, Human
caccgcacuacacuacuggc

SEQ ID NO: 295853 - RNA, 18 nt, Human
cacuggggaccugggcag

SEQ ID NO: 295854 - RNA, 25 nt, Human
cagagccuccuccaaggccuugaua

SEQ ID NO: 295855 - RNA, 22 nt, Human
caggagggcaggggcccuguug

SEQ ID NO: 295856 - RNA, 22 nt, Human
caguauucuggggguuagcccu

SEQ ID NO: 295857 - RNA, 23 nt, Human
ccacacacuucccuuccuuaucu

SEQ ID NO: 295858 - RNA, 23 nt, Human
ccauacugucuuggaacaugcag

SEQ ID NO: 295859 - RNA, 26 nt, Human
ccauacugucuuggaacaugcagugg

SEQ ID NO: 295860 - RNA, 21 nt, Human
cccacagaggccccucugacc

SEQ ID NO: 295861 - RNA, 21 nt, Human
cccaccauccacauccacaca

SEQ ID NO: 295862 - RNA, 30 nt, Human; identical to SEQ ID NO: 294382

SEQ ID NO: 295863 - RNA, 19 nt, Human
ccccacuacccccaugggu

SEQ ID NO: 295864 - RNA, 20 nt, Human
ccccacuacccccaugggua

SEQ ID NO: 295865 - RNA, 21 nt, Human
ccccacuacccccauggguac

SEQ ID NO: 295866 - RNA, 27 nt, Human
cccccaccauccacauccacacacuuc

SEQ ID NO: 295867 - RNA, 25 nt, Human
cccccugggggggaagggguaggug

SEQ ID NO: 295868 - RNA, 21 nt, Human
ccccugaggacauacagagcc

SEQ ID NO: 295869 - RNA, 21 nt, Human
ccgccgcccgcugcccacccg

SEQ ID NO: 295870 - RNA, 22 nt, Human
ccucucaaggggaccugguccu

SEQ ID NO: 295871 - RNA, 22 nt, Human
ccuggcuggcccacccuuccug

SEQ ID NO: 295872 - RNA, 19 nt, Human
ccugggcugagacuuucug

SEQ ID NO: 295873 - RNA, 21 nt, Human
ccuguuagcucagcccaaagc

SEQ ID NO: 295874 - RNA, 24 nt, Human
cgcccgcugcccacccgccaucac

SEQ ID NO: 295875 - RNA, 22 nt, Human
cgcguggacacagcacaaaaca

SEQ ID NO: 295876 - RNA, 23 nt, Human
cggcugcgcggagcccgccgccc

SEQ ID NO: 295877 - RNA, 22 nt, Human
cucagcccaaagcuggcugccu

SEQ ID NO: 295878 - RNA, 23 nt, Human
cugaaggaaacugguaaacucau

SEQ ID NO: 295879 - RNA, 23 nt, Human
cugaggccugggugcagguaagg

SEQ ID NO: 295880 - RNA, 18 nt, Human
cugccugggcugagcccu

SEQ ID NO: 295881 - RNA, 18 nt, Human
cuggcaaggugaaggacu

SEQ ID NO: 295882 - RNA, 22 nt, Human
cuuguuugaggaggaggugggg

SEQ ID NO: 295883 - RNA, 18 nt, Human
gaaaaacaaaacagaaga

SEQ ID NO: 295884 - RNA, 18 nt, Human
gaagauggaggaguucag

SEQ ID NO: 295885 - RNA, 21 nt, Human
gacccaggggcagaagggggu

SEQ ID NO: 295886 - RNA, 21 nt, Human
gagcauggccuuggccccuac

SEQ ID NO: 295887 - RNA, 20 nt, Human
gagugggguggggaggaggg

SEQ ID NO: 295888 - RNA, 20 nt, Human
gcaccuggcaaggugaagga

SEQ ID NO: 295889 - RNA, 21 nt, Human
gcccccaccauccacauccac

SEQ ID NO: 295890 - RNA, 18 nt, Human
gcccuguggcucuuggcc

SEQ ID NO: 295891 - RNA, 20 nt, Human
gccuggcuggcccacccuuc

SEQ ID NO: 295892 - RNA, 18 nt, Human
gcggagcccgccgcccgc

SEQ ID NO: 295893 - RNA, 19 nt, Human
gcguggacacagcacaaaa

SEQ ID NO: 295894 - RNA, 19 nt, Human
gcugccugggcugagcccu

SEQ ID NO: 295895 - RNA, 20 nt, Human
gcugcgcggagcccgccgcc

SEQ ID NO: 295896 - RNA, 20 nt, Human
ggacccaggggcagaagggg

SEQ ID NO: 295897 - RNA, 22 nt, Human
ggagaagucaguacgggggagg

SEQ ID NO: 295898 - RNA, 19 nt, Human
ggaggagggaggcauggga

SEQ ID NO: 295899 - RNA, 19 nt, Human
ggaggcaugggauggaugg

SEQ ID NO: 295900 - RNA, 20 nt, Human
ggagggggcgcuacacuacu

SEQ ID NO: 295901 - RNA, 21 nt, Human
ggagugggguggggaggaggg

SEQ ID NO: 295902 - RNA, 22 nt, Human
ggagugggguggggaggaggga

SEQ ID NO: 295903 - RNA, 21 nt, Human
ggcaggucugggguucucugg

SEQ ID NO: 295904 - RNA, 19 nt, Human
ggcguugggaagaggcuug

SEQ ID NO: 295905 - RNA, 19 nt, Human
gggaccugguccuaaaccu

SEQ ID NO: 295906 - RNA, 19 nt, Human
gggaggagggaggcauggg

SEQ ID NO: 295907 - RNA, 19 nt, Human
gggcguugggaagaggcuu

SEQ ID NO: 295908 - RNA, 18 nt, Human
ggggaagggguaggugcu

SEQ ID NO: 295909 - RNA, 24 nt, Human
ggggagggggucgccuuagcgcgu

SEQ ID NO: 295910 - RNA, 27 nt, Human
ggggcagaagggggugggagaagaagg

SEQ ID NO: 295911 - RNA, 19 nt, Human
gggguggggaggagggagg

SEQ ID NO: 295912 - RNA, 20 nt, Human
gggguggggaggagggaggc

SEQ ID NO: 295913 - RNA, 23 nt, Human
gugaaggacugaggcuucaggag

SEQ ID NO: 295914 - RNA, 19 nt, Human
uaaagugucaccacugaag

SEQ ID NO: 295915 - RNA, 23 nt, Human
uaaaucccuauuuucaaaacauu

SEQ ID NO: 295916 - RNA, 19 nt, Human
uacagagccuccuccaagg

SEQ ID NO: 295917 - RNA, 20 nt, Human
uacagagccuccuccaaggg

SEQ ID NO: 295918 - RNA, 21 nt, Human
uaccaguauucuggggguuag

SEQ ID NO: 295919 - RNA, 18 nt, Human
uacucgggaaagaggaac

SEQ ID NO: 295920 - RNA, 19 nt, Human
uagcccugaaacucugagg

SEQ ID NO: 295921 - RNA, 23 nt, Human
uagcccugaaacucugaggccug

SEQ ID NO: 295922 - RNA, 24 nt, Human
uaggagaagucaguacgggggagg

SEQ ID NO: 295923 - RNA, 25 nt, Human
uaucuuaccaccccauacugucuug

SEQ ID NO: 295924 - RNA, 20 nt, Human
ucacuaaagaaauacuauau

SEQ ID NO: 295925 - RNA, 20 nt, Human
ucagcccaaagcuggcugcc

SEQ ID NO: 295926 - RNA, 18 nt, Human
ucaguccccugaggacau

SEQ ID NO: 295927 - RNA, 24 nt, Human
uccaaaacuugagcauugaucuug

SEQ ID NO: 295928 - RNA, 19 nt, Human
uccacauccacacacuucc

SEQ ID NO: 295929 - RNA, 22 nt, Human
uccaccaguggcaccucuggag

SEQ ID NO: 295930 - RNA, 20 nt, Human
uccaugcccccaccauccac

SEQ ID NO: 295931 - RNA, 21 nt, Human
ugaaaaacaaaacagaagacu

SEQ ID NO: 295932 - RNA, 18 nt, Human
ugacccuuccaccagugg

SEQ ID NO: 295933 - RNA, 22 nt, Human
ugacccuuccaccaguggcacc

SEQ ID NO: 295934 - RNA, 24 nt, Human
ugcccuagcucccugccuccccaa

SEQ ID NO: 295935 - RNA, 23 nt, Human
ugccugggcugagcccuauuaug

SEQ ID NO: 295936 - RNA, 22 nt, Human
ugcuggggcuccgcuccggggg

SEQ ID NO: 295937 - RNA, 21 nt, Human
uggaaacgucaaacaaugaaa

SEQ ID NO: 295938 - RNA, 25 nt, Human
uggaaacgucaaacaaugaaaaaca

SEQ ID NO: 295939 - RNA, 21 nt, Human
uggaaauuauaaaaugugaua

SEQ ID NO: 295940 - RNA, 18 nt, Human
uggaaggaggugaagggg

SEQ ID NO: 295941 - RNA, 21 nt, Human
uggaaggaggugaaggggcug

SEQ ID NO: 295942 - RNA, 22 nt, Human
uggaaggaggugaaggggcugg

SEQ ID NO: 295943 - RNA, 18 nt, Human
uggaaucuggaggauguu

SEQ ID NO: 295944 - RNA, 22 nt, Human
uggaaucuggaggauguuguca

SEQ ID NO: 295945 - RNA, 21 nt, Human
uggacacagcacaaaacacaa

SEQ ID NO: 295946 - RNA, 19 nt, Human
uggaggauguugucagucc

SEQ ID NO: 295947 - RNA, 21 nt, Human
uggagugggguggggaggagg

SEQ ID NO: 295948 - RNA, 23 nt, Human
uggauggccggggacccaggggc

SEQ ID NO: 295949 - RNA, 25 nt, Human
uggcaaaugguucuuggugucuaca

SEQ ID NO: 295950 - RNA, 19 nt, Human
uggcaaggugaaggacuga

SEQ ID NO: 295951 - RNA, 21 nt, Human
uggcaaggugaaggacugagg

SEQ ID NO: 295952 - RNA, 23 nt, Human
uggcaccucuggaguacccagca

SEQ ID NO: 295953 - RNA, 24 nt, Human
uggcaccucuggaguacccagcac

SEQ ID NO: 295954 - RNA, 18 nt, Human
uggcugccugggcugagc

SEQ ID NO: 295955 - RNA, 19 nt, Human
ugggaaggguccagccuag

SEQ ID NO: 295956 - RNA, 20 nt, Human
ugggaaggguccagccuagu

SEQ ID NO: 295957 - RNA, 20 nt, Human
ugggaaggguccagccuagu

SEQ ID NO: 295958 - RNA, 19 nt, Human
ugggauggaugggccugau

SEQ ID NO: 295959 - RNA, 20 nt, Human
ugggcugguuggggagaggc

SEQ ID NO: 295960 - RNA, 22 nt, Human
uggggaccugggcaguggccuu

SEQ ID NO: 295961 - RNA, 20 nt, Human
uggggaggagggaggcaugg

SEQ ID NO: 295962 - RNA, 21 nt, Human
uggggaggagggaggcauggg

SEQ ID NO: 295963 - RNA, 18 nt, Human
ugggugcagguaaggaga

SEQ ID NO: 295964 - RNA, 26 nt, Human
ugguaaacucauuuuuaccucuauca

SEQ ID NO: 295965 - RNA, 26 nt, Human
ugguagcaaaaugcccucccuaaauc

SEQ ID NO: 295966 - RNA, 21 nt, Human
ugguccccagggcguugggaa

SEQ ID NO: 295967 - RNA, 20 nt, Human
uggucccugcccuagcuccc

SEQ ID NO: 295968 - RNA, 23 nt, Human
ugguuuauggcuggaaucuggag

SEQ ID NO: 295969 - RNA, 18 nt, Human
uguaagggcaggucuggg

SEQ ID NO: 295970 - RNA, 23 nt, Human
ugucuacaguaaccccacuaccc

SEQ ID NO: 295971 - RNA, 19 nt, Human
uguggcaaaugguucuugg

SEQ ID NO: 295972 - RNA, 23 nt, Human
uguggcaaaugguucuugguguc

SEQ ID NO: 295973 - RNA, 20 nt, Human
uuauguagugggaagggucc

SEQ ID NO: 295974 - RNA, 20 nt, Human
uugauuuggaagauggagga

SEQ ID NO: 295975 - RNA, 21 nt, Human
uuguuucuguuucccaagggg

SEQ ID NO: 295976 - RNA, 21 nt, Human
uuuaaccaggcuauggccacu

SEQ ID NO: 295977 - RNA, 18 nt, Human
uuuucagaacuaggaggc

SEQ ID NO: 295978 - RNA, 21 nt, Human
aaaacacaacacgggccgccg

SEQ ID NO: 295979 - RNA, 18 nt, Human
aaaagaaacagccaaaga

SEQ ID NO: 295980 - RNA, 19 nt, Human
aaaagcacaccgcacuaca

SEQ ID NO: 295981 - RNA, 25 nt, Human
aaacaaaacagaagacuggucccca

SEQ ID NO: 295982 - RNA, 25 nt, Human
aaacaaaacagaagacuggucccca

SEQ ID NO: 295983 - RNA, 22 nt, Human
aaacaaugaaaaacaaaacaga

SEQ ID NO: 295984 - RNA, 23 nt, Human
aaacagaagacugguccccaggg

SEQ ID NO: 295985 - RNA, 20 nt, Human
aaaugcccucccuaaauccc

SEQ ID NO: 295986 - RNA, 19 nt, Human
aacagaagacugguccccc

SEQ ID NO: 295987 - RNA, 19 nt, Human
aagaggucaugaugcccuu

SEQ ID NO: 295988 - RNA, 23 nt, Human
aagcuggcugccugggcugagcc

SEQ ID NO: 295989 - RNA, 21 nt, Human
aaugaaaaacaaaacagaaga

SEQ ID NO: 295990 - RNA, 25 nt, Human
acaaaacacaacacgggccgccgcg

SEQ ID NO: 295991 - RNA, 22 nt, Human
acaaaacagaagacuggucccc

SEQ ID NO: 295992 - RNA, 18 nt, Human
acagagccuccuccaagg

SEQ ID NO: 295993 - RNA, 27 nt, Human
acagagccuccuccaaggccuugauaa

SEQ ID NO: 295994 - RNA, 22 nt, Human
acagcacaaaacacaacacggg

SEQ ID NO: 295995 - RNA, 21 nt, Human
accaugcuuugggggaagauu

SEQ ID NO: 295996 - RNA, 19 nt, Human
acucgggaaagaggaacug

SEQ ID NO: 295997 - RNA, 22 nt, Human
acugaaaugccaguuuaaucca

SEQ ID NO: 295998 - RNA, 20 nt, Human
agaaggucuaugcacaagga

SEQ ID NO: 295999 - RNA, 19 nt, Human
agaggaacuguuggagugg

SEQ ID NO: 296000 - RNA, 24 nt, Human
agcucagcccaaagcuggcugccu

SEQ ID NO: 296001 - RNA, 21 nt, Human
aggacauacagagccuccucc

SEQ ID NO: 296002 - RNA, 22 nt, Human
aggaggcuuguagguuacuugg

SEQ ID NO: 296003 - RNA, 20 nt, Human
aggagggaggcaugggaugg

SEQ ID NO: 296004 - RNA, 18 nt, Human
aggagggcaggggcccug

SEQ ID NO: 296005 - RNA, 19 nt, Human
aggaggugggggaagucaa

SEQ ID NO: 296006 - RNA, 18 nt, Human
agggggcgcacuggggac

SEQ ID NO: 296007 - RNA, 22 nt, Human
aguccuaaauaguuacugcacu

SEQ ID NO: 296008 - RNA, 25 nt, Human
auacagagccuccuccaaccggagg

SEQ ID NO: 296009 - RNA, 18 nt, Human
aucauuuuacaagcuuuc

SEQ ID NO: 296010 - RNA, 21 nt, Human
caaaacagaagacuggucccc

SEQ ID NO: 296011 - RNA, 24 nt, Human
caaaacauaauuuaugccaaauaa

SEQ ID NO: 296012 - RNA, 22 nt, Human
caacaccccaaccaccuuacuc

SEQ ID NO: 296013 - RNA, 21 nt, Human
cacacuucccuuccuuaucuu

SEQ ID NO: 296014 - RNA, 21 nt, Human
caccccauacugucuuggaac

SEQ ID NO: 296015 - RNA, 20 nt, Human
caccgcacuacacuacuggc

SEQ ID NO: 296016 - RNA, 18 nt, Human
cacuggggaccugggcag

SEQ ID NO: 296017 - RNA, 21 nt, Human
cagaauccucucagaaucuuc

SEQ ID NO: 296018 - RNA, 25 nt, Human
cagagccuccuccaaggccuugaua

SEQ ID NO: 296019 - RNA, 22 nt, Human
caggagggcaggggcccuguug

SEQ ID NO: 296020 - RNA, 22 nt, Human
caggggcagaagggggugggag

SEQ ID NO: 296021 - RNA, 22 nt, Human
caguauucuggggguuagcccu

SEQ ID NO: 296022 - RNA, 21 nt, Human
cauacagagccuccuccaagg

SEQ ID NO: 296023 - RNA, 23 nt, Human
ccaaaauaaacccaaaacucugu

SEQ ID NO: 296024 - RNA, 23 nt, Human
ccacacacuucccuuccuuaucu

SEQ ID NO: 296025 - RNA, 20 nt, Human
ccacagaggccccucugacc

SEQ ID NO: 296026 - RNA, 23 nt, Human
ccauacugucuuggaacaugcag

SEQ ID NO: 296027 - RNA, 26 nt, Human
ccauacugucuuggaacaugcagugg

SEQ ID NO: 296028 - RNA, 21 nt, Human
cccaccauccacauccacaca

SEQ ID NO: 296029 - RNA, 30 nt, Human; identical to SEQ ID NO: 294382

SEQ ID NO: 296030 - RNA, 19 nt, Human
cccauugugcucuaagcuu

SEQ ID NO: 296031 - RNA, 26 nt, Human
ccccaccauccacauccacacacuuc

SEQ ID NO: 296032 - RNA, 18 nt, Human
ccccacuacccccauggg

SEQ ID NO: 296033 - RNA, 20 nt, Human
ccccacuacccccaugggua

SEQ ID NO: 296034 - RNA, 21 nt, Human
ccccacuacccccauggguac

SEQ ID NO: 296035 - RNA, 25 nt, Human
cccccugggggggaagggguaggug

SEQ ID NO: 296036 - RNA, 21 nt, Human
ccccugaggacauacagagcc

SEQ ID NO: 296037 - RNA, 21 nt, Human
ccgccgcccgcugcccacccg

SEQ ID NO: 296038 - RNA, 22 nt, Human
ccuggcuggcccacccuuccug

SEQ ID NO: 296039 - RNA, 19 nt, Human
ccugggcugagacuuucug

SEQ ID NO: 296040 - RNA, 21 nt, Human
ccuguuagcucagcccaaagc

SEQ ID NO: 296041 - RNA, 24 nt, Human
cgcccgcugcccacccgccaucac

SEQ ID NO: 296042 - RNA, 23 nt, Human
cggcugcgcggagcccgccgccc

SEQ ID NO: 296043 - RNA, 24 nt, Human
cuagauuacugagaaaaaaaaauc

SEQ ID NO: 296044 - RNA, 22 nt, Human
cuauucuacaccagccgaaaga

SEQ ID NO: 296045 - RNA, 22 nt, Human
cucagcccaaagcuggcugccu

SEQ ID NO: 296046 - RNA, 25 nt, Human
cucuacuagauuacugagaaaaaaa

SEQ ID NO: 296047 - RNA, 21 nt, Human
cucucaaggggaccugguccu

SEQ ID NO: 296048 - RNA, 20 nt, Human
cugagaaaaaaaaaucauuu

SEQ ID NO: 296049 - RNA, 23 nt, Human
cugaggccugggugcagguaagg

SEQ ID NO: 296050 - RNA, 18 nt, Human
cugccugggcugagcccu

SEQ ID NO: 296051 - RNA, 18 nt, Human
cuggcaaggugaaggacu

SEQ ID NO: 296052 - RNA, 22 nt, Human
cuuuaaccaggcuauggccacu

SEQ ID NO: 296053 - RNA, 22 nt, Human
cuuuauuguaaaugucuccaau

SEQ ID NO: 296054 - RNA, 24 nt, Human
gaacuucaguugucaccagaaaug

SEQ ID NO: 296055 - RNA, 18 nt, Human
gaagauggaggaguucag

SEQ ID NO: 296056 - RNA, 21 nt, Human
gacccaggggcagaagggggu

SEQ ID NO: 296057 - RNA, 21 nt, Human
gagcauggccuuggccccuac

SEQ ID NO: 296058 - RNA, 20 nt, Human
gagugggguggggaggaggg

SEQ ID NO: 296059 - RNA, 26 nt, Human
gauuacuucuaaauguaauacucuac

SEQ ID NO: 296060 - RNA, 20 nt, Human
gcaccuggcaaggugaagga

SEQ ID NO: 296061 - RNA, 19 nt, Human
gcagaauccucucagaauc

SEQ ID NO: 296062 - RNA, 21 nt, Human
gcccccaccauccacauccac

SEQ ID NO: 296063 - RNA, 18 nt, Human
gcccuguggcucuuggcc

SEQ ID NO: 296064 - RNA, 20 nt, Human
gccuggcuggcccacccuuc

SEQ ID NO: 296065 - RNA, 18 nt, Human
gcggagcccgccgcccgc

SEQ ID NO: 296066 - RNA, 19 nt, Human
gcguggacacagcacaaaa

SEQ ID NO: 296067 - RNA, 21 nt, Human
gcguggacacagcacaaaaca

SEQ ID NO: 296068 - RNA, 19 nt, Human
gcugccugggcugagcccu

SEQ ID NO: 296069 - RNA, 20 nt, Human
gcugcgcggagcccgccgcc

SEQ ID NO: 296070 - RNA, 20 nt, Human
ggacccaggggcagaagggg

SEQ ID NO: 296071 - RNA, 22 nt, Human
ggagaagucaguacgggggagg

SEQ ID NO: 296072 - RNA, 19 nt, Human
ggaggagggaggcauggga

SEQ ID NO: 296073 - RNA, 20 nt, Human
ggagggggcgcuacacuacu

SEQ ID NO: 296074 - RNA, 21 nt, Human
ggagugggguggggaggaggg

SEQ ID NO: 296075 - RNA, 22 nt, Human
ggagugggguggggaggaggga

SEQ ID NO: 296076 - RNA, 21 nt, Human
ggcaggucugggguucucugg

SEQ ID NO: 296077 - RNA, 19 nt, Human
ggcguugggaagaggcuug

SEQ ID NO: 296078 - RNA, 19 nt, Human
gggaccugguccuaaaccu

SEQ ID NO: 296079 - RNA, 19 nt, Human
gggaggagggaggcauggg

SEQ ID NO: 296080 - RNA, 20 nt, Human
gggaggcaugggauggaugg

SEQ ID NO: 296081 - RNA, 21 nt, Human
gggcagaagggggugggagaa

SEQ ID NO: 296082 - RNA, 19 nt, Human
gggcguugggaagaggcuu

SEQ ID NO: 296083 - RNA, 18 nt, Human
ggggaagggguaggugcu

SEQ ID NO: 296084 - RNA, 30 nt, Human; identical to SEQ ID NO: 294429

SEQ ID NO: 296085 - RNA, 24 nt, Human
ggggagggggucgccuuagcgcgu

SEQ ID NO: 296086 - RNA, 27 nt, Human
ggggcagaagggggugggagaagaagg

SEQ ID NO: 296087 - RNA, 19 nt, Human
gggguggggaggagggagg

SEQ ID NO: 296088 - RNA, 20 nt, Human
gggguggggaggagggaggc

SEQ ID NO: 296089 - RNA, 23 nt, Human
gugaaggacugaggcuucaggag

SEQ ID NO: 296090 - RNA, 18 nt, Human
guuguuuugcugcagaau

SEQ ID NO: 296091 - RNA, 21 nt, Human
guuuauggcuggaaucuggag

SEQ ID NO: 296092 - RNA, 24 nt, Human
uaaaagaaacagccaaagaaugug

SEQ ID NO: 296093 - RNA, 23 nt, Human
uaaaugaucagauuagaucagaa

SEQ ID NO: 296094 - RNA, 22 nt, Human
uaacaaauaacuaagaacuuca

SEQ ID NO: 296095 - RNA, 23 nt, Human
uacaagcuuucuauagaguuguu

SEQ ID NO: 296096 - RNA, 20 nt, Human
uacagagccuccuccaaggg

SEQ ID NO: 296097 - RNA, 21 nt, Human
uaccaguauucuggggguuag

SEQ ID NO: 296098 - RNA, 18 nt, Human
uacucgggaaagaggaac

SEQ ID NO: 296099 - RNA, 19 nt, Human
uagaccuacuggagaugac

SEQ ID NO: 296100 - RNA, 19 nt, Human
uagcccugaaacucugagg

SEQ ID NO: 296101 - RNA, 23 nt, Human
uagcccugaaacucugaggccug

SEQ ID NO: 296102 - RNA, 24 nt, Human
uaggagaagucaguacgggggagg

SEQ ID NO: 296103 - RNA, 22 nt, Human
uaguaacaccaccaaaauaaac

SEQ ID NO: 296104 - RNA, 25 nt, Human
uaucuuaccaccccauacugucuug

SEQ ID NO: 296105 - RNA, 19 nt, Human
uauguagugggaagggucc

SEQ ID NO: 296106 - RNA, 22 nt, Human
ucaauuuuauaguaacaccacc

SEQ ID NO: 296107 - RNA, 20 nt, Human
ucacugugcauaaauggguc

SEQ ID NO: 296108 - RNA, 20 nt, Human
ucagcccaaagcuggcugcc

SEQ ID NO: 296109 - RNA, 18 nt, Human
ucaguccccugaggacau

SEQ ID NO: 296110 - RNA, 24 nt, Human
uccaaaacuugagcauugaucuug

SEQ ID NO: 296111 - RNA, 19 nt, Human
uccacauccacacacuucc

SEQ ID NO: 296112 - RNA, 22 nt, Human
uccaccaguggcaccucuggag

SEQ ID NO: 296113 - RNA, 20 nt, Human
uccaugcccccaccauccac

SEQ ID NO: 296114 - RNA, 21 nt, Human
ugaaaaacaaaacagaagacu

SEQ ID NO: 296115 - RNA, 18 nt, Human
ugacccuuccaccagugg

SEQ ID NO: 296116 - RNA, 22 nt, Human
ugacccuuccaccaguggcacc

SEQ ID NO: 296117 - RNA, 24 nt, Human
ugcccuagcucccugccuccccaa

SEQ ID NO: 296118 - RNA, 23 nt, Human
ugccugggcugagcccuauuaug

SEQ ID NO: 296119 - RNA, 22 nt, Human
ugcuggggcuccgcuccggggg

SEQ ID NO: 296120 - RNA, 21 nt, Human
uggaaacgucaaacaaugaaa

SEQ ID NO: 296121 - RNA, 25 nt, Human
uggaaacgucaaacaaugaaaaaca

SEQ ID NO: 296122 - RNA, 18 nt, Human
uggaaggaggugaagggg

SEQ ID NO: 296123 - RNA, 21 nt, Human
uggaaggaggugaaggggcug

SEQ ID NO: 296124 - RNA, 22 nt, Human
uggaaggaggugaaggggcugg

SEQ ID NO: 296125 - RNA, 18 nt, Human
uggaaucuggaggauguu

SEQ ID NO: 296126 - RNA, 22 nt, Human
uggaaucuggaggauguuguca

SEQ ID NO: 296127 - RNA, 21 nt, Human
uggacacagcacaaaacacaa

SEQ ID NO: 296128 - RNA, 19 nt, Human
uggaggauguugucagucc

SEQ ID NO: 296129 - RNA, 21 nt, Human
uggagugggguggggaggagg

SEQ ID NO: 296130 - RNA, 23 nt, Human
uggauggccggggacccaggggc

SEQ ID NO: 296131 - RNA, 25 nt, Human
uggcaaaugguucuuggugucuaca

SEQ ID NO: 296132 - RNA, 19 nt, Human
uggcaaggugaaggacuga

SEQ ID NO: 296133 - RNA, 21 nt, Human
uggcaaggugaaggacugagg

SEQ ID NO: 296134 - RNA, 23 nt, Human
uggcaccucuggaguacccagca

SEQ ID NO: 296135 - RNA, 24 nt, Human
uggcaccucuggaguacccagcac

SEQ ID NO: 296136 - RNA, 22 nt, Human
uggcaucugcgggucuucguga

SEQ ID NO: 296137 - RNA, 23 nt, Human
uggcaucugcgggucuucgugag

SEQ ID NO: 296138 - RNA, 18 nt, Human
uggcugccugggcugagc

SEQ ID NO: 296139 - RNA, 19 nt, Human
ugggaaggguccagccuag

SEQ ID NO: 296140 - RNA, 20 nt, Human
ugggaaggguccagccuagu

SEQ ID NO: 296141 - RNA, 20 nt, Human
ugggaaggguccagccuagu

SEQ ID NO: 296142 - RNA, 19 nt, Human
ugggauggaugggccugau

SEQ ID NO: 296143 - RNA, 20 nt, Human
ugggcugguuggggagaggc

SEQ ID NO: 296144 - RNA, 22 nt, Human
uggggaccugggcaguggccuu

SEQ ID NO: 296145 - RNA, 20 nt, Human
uggggaggagggaggcaugg

SEQ ID NO: 296146 - RNA, 21 nt, Human
uggggaggagggaggcauggg

SEQ ID NO: 296147 - RNA, 18 nt, Human
ugggugcagguaaggaga

SEQ ID NO: 296148 - RNA, 26 nt, Human
ugguagcaaaaugcccucccuaaauc

SEQ ID NO: 296149 - RNA, 21 nt, Human
ugguccccagggcguugggaa

SEQ ID NO: 296150 - RNA, 20 nt, Human
uggucccugcccuagcuccc

SEQ ID NO: 296151 - RNA, 20 nt, Human
ugguuuaaacuacuuaauca

SEQ ID NO: 296152 - RNA, 18 nt, Human
uguaagggcaggucuggg

SEQ ID NO: 296153 - RNA, 23 nt, Human
ugucuacaguaaccccacuaccc

SEQ ID NO: 296154 - RNA, 19 nt, Human
uguggcaaaugguucuugg

SEQ ID NO: 296155 - RNA, 23 nt, Human
uguggcaaaugguucuugguguc

SEQ ID NO: 296156 - RNA, 19 nt, Human
uguuguuuugcugcagaau

SEQ ID NO: 296157 - RNA, 23 nt, Human
uguuuugcugcagaauccucuca

SEQ ID NO: 296158 - RNA, 26 nt, Human
uuauccguaaacccauauuuuaaaag

SEQ ID NO: 296159 - RNA, 24 nt, Human
uucccauugugcucuaagcuuuau

SEQ ID NO: 296160 - RNA, 21 nt, Human
uugagacuaaaauagaccuac

SEQ ID NO: 296161 - RNA, 20 nt, Human
uugauuuggaagauggagga

SEQ ID NO: 296162 - RNA, 19 nt, Human
uuggaagauggaggaguuc

SEQ ID NO: 296163 - RNA, 21 nt, Human
uuguuucuguuucccaagggg

SEQ ID NO: 296164 - RNA, 21 nt, Human
uuguuugaggaggaggugggg

SEQ ID NO: 296165 - RNA, 24 nt, Human
uuucuauagaguuguugcuuuuaa

SEQ ID NO: 296166 - RNA, 26 nt, Human
uuucuugccgcagcuauggagaugac

SEQ ID NO: 296167 - RNA, 18 nt, Human
uuuucagaacuaggaggc

SEQ ID NO: 296168 - RNA, 21 nt, Human
aaaacacaacacgggccgccg

SEQ ID NO: 296169 - RNA, 24 nt, Human
aaaacagaagacugguccccaggg

SEQ ID NO: 296170 - RNA, 19 nt, Human
aaaagcacaccgcacuaca

SEQ ID NO: 296171 - RNA, 25 nt, Human
aaacaaaacagaagacuggucccca

SEQ ID NO: 296172 - RNA, 25 nt, Human
aaacaaaacagaagacuggucccca

SEQ ID NO: 296173 - RNA, 22 nt, Human
aaacaaugaaaaacaaaacaga

SEQ ID NO: 296174 - RNA, 18 nt, Human
aaaugcccucccuaaauc

SEQ ID NO: 296175 - RNA, 19 nt, Human
aacagaagacugguccccc

SEQ ID NO: 296176 - RNA, 23 nt, Human
aagcuggcugccugggcugagcc

SEQ ID NO: 296177 - RNA, 21 nt, Human
aaugaaaaacaaaacagaaga

SEQ ID NO: 296178 - RNA, 25 nt, Human
acaaaacacaacacgggccgccgcg

SEQ ID NO: 296179 - RNA, 22 nt, Human
acaaaacagaagacuggucccc

SEQ ID NO: 296180 - RNA, 27 nt, Human
acagagccuccuccaaggccuugauaa

SEQ ID NO: 296181 - RNA, 22 nt, Human
acagcacaaaacacaacacggg

SEQ ID NO: 296182 - RNA, 21 nt, Human
accaugcuuugggggaagauu

SEQ ID NO: 296183 - RNA, 19 nt, Human
acucgggaaagaggaacug

SEQ ID NO: 296184 - RNA, 22 nt, Human
acugaaaugccaguuuaaucca

SEQ ID NO: 296185 - RNA, 20 nt, Human
agaaggucuaugcacaagga

SEQ ID NO: 296186 - RNA, 19 nt, Human
agaggaacuguuggagugg

SEQ ID NO: 296187 - RNA, 24 nt, Human
agcucagcccaaagcuggcugccu

SEQ ID NO: 296188 - RNA, 21 nt, Human
aggacauacagagccuccucc

SEQ ID NO: 296189 - RNA, 23 nt, Human
aggagaagucaguacgggggagg

SEQ ID NO: 296190 - RNA, 22 nt, Human
aggaggcuuguagguuacuugg

SEQ ID NO: 296191 - RNA, 18 nt, Human
aggagggcaggggcccug

SEQ ID NO: 296192 - RNA, 19 nt, Human
aggaggugggggaagucaa

SEQ ID NO: 296193 - RNA, 18 nt, Human
agggggcgcacuggggac

SEQ ID NO: 296194 - RNA, 25 nt, Human
auacagagccuccuccaaccggagg

SEQ ID NO: 296195 - RNA, 21 nt, Human
caaaacagaagacuggucccc

SEQ ID NO: 296196 - RNA, 22 nt, Human
caacaccccaaccaccuuacuc

SEQ ID NO: 296197 - RNA, 20 nt, Human
caagaggucaugaugcccuu

SEQ ID NO: 296198 - RNA, 21 nt, Human
cacacuucccuuccuuaucuu

SEQ ID NO: 296199 - RNA, 21 nt, Human
caccccauacugucuuggaac

SEQ ID NO: 296200 - RNA, 20 nt, Human
caccgcacuacacuacuggc

SEQ ID NO: 296201 - RNA, 18 nt, Human
cacuggggaccugggcag

SEQ ID NO: 296202 - RNA, 25 nt, Human
cagagccuccuccaaggccuugaua

SEQ ID NO: 296203 - RNA, 22 nt, Human
caggagggcaggggcccuguug

SEQ ID NO: 296204 - RNA, 22 nt, Human
caggggcagaagggggugggag

SEQ ID NO: 296205 - RNA, 22 nt, Human
caguauucuggggguuagcccu

SEQ ID NO: 296206 - RNA, 21 nt, Human
cauacagagccuccuccaagg

SEQ ID NO: 296207 - RNA, 23 nt, Human
ccacacacuucccuuccuuaucu

SEQ ID NO: 296208 - RNA, 23 nt, Human
ccauacugucuuggaacaugcag

SEQ ID NO: 296209 - RNA, 26 nt, Human
ccauacugucuuggaacaugcagugg

SEQ ID NO: 296210 - RNA, 21 nt, Human
cccacagaggccccucugacc

SEQ ID NO: 296211 - RNA, 21 nt, Human
cccaccauccacauccacaca

SEQ ID NO: 296212 - RNA, 30 nt, Human; identical to SEQ ID NO: 294382

SEQ ID NO: 296213 - RNA, 18 nt, Human
ccccacuacccccauggg

SEQ ID NO: 296214 - RNA, 20 nt, Human
ccccacuacccccaugggua

SEQ ID NO: 296215 - RNA, 21 nt, Human
ccccacuacccccauggguac

SEQ ID NO: 296216 - RNA, 27 nt, Human
cccccaccauccacauccacacacuuc

SEQ ID NO: 296217 - RNA, 25 nt, Human
cccccugggggggaagggguaggug

SEQ ID NO: 296218 - RNA, 21 nt, Human
ccccugaggacauacagagcc

SEQ ID NO: 296219 - RNA, 20 nt, Human
cccugaaacucugaggccug

SEQ ID NO: 296220 - RNA, 21 nt, Human
ccgccgcccgcugcccacccg

SEQ ID NO: 296221 - RNA, 22 nt, Human
ccuggcuggcccacccuuccug

SEQ ID NO: 296222 - RNA, 19 nt, Human
ccugggcugagacuuucug

SEQ ID NO: 296223 - RNA, 21 nt, Human
ccugggcugagcccuauuaug

SEQ ID NO: 296224 - RNA, 21 nt, Human
ccuguuagcucagcccaaagc

SEQ ID NO: 296225 - RNA, 24 nt, Human
cgcccgcugcccacccgccaucac

SEQ ID NO: 296226 - RNA, 19 nt, Human
cgcccuguggcucuuggcc

SEQ ID NO: 296227 - RNA, 22 nt, Human
cgcguggacacagcacaaaaca

SEQ ID NO: 296228 - RNA, 23 nt, Human
cggcugcgcggagcccgccgccc

SEQ ID NO: 296229 - RNA, 22 nt, Human
cuauucuacaccagccgaaaga

SEQ ID NO: 296230 - RNA, 22 nt, Human
cucagcccaaagcuggcugccu

SEQ ID NO: 296231 - RNA, 21 nt, Human
cucucaaggggaccugguccu

SEQ ID NO: 296232 - RNA, 23 nt, Human
cugaggccugggugcagguaagg

SEQ ID NO: 296233 - RNA, 18 nt, Human
cugccugggcugagcccu

SEQ ID NO: 296234 - RNA, 18 nt, Human
cuggcaaggugaaggacu

SEQ ID NO: 296235 - RNA, 22 nt, Human
cuuguuugaggaggaggugggg

SEQ ID NO: 296236 - RNA, 22 nt, Human
cuuuaaccaggcuauggccacu

SEQ ID NO: 296237 - RNA, 18 nt, Human
gaagauggaggaguucag

SEQ ID NO: 296238 - RNA, 21 nt, Human
gacccaggggcagaagggggu

SEQ ID NO: 296239 - RNA, 21 nt, Human
gagcauggccuuggccccuac

SEQ ID NO: 296240 - RNA, 18 nt, Human
gaggagggaggcauggga

SEQ ID NO: 296241 - RNA, 21 nt, Human
gaggagggaggcaugggaugg

SEQ ID NO: 296242 - RNA, 20 nt, Human
gagugggguggggaggaggg

SEQ ID NO: 296243 - RNA, 20 nt, Human
gcaccuggcaaggugaagga

SEQ ID NO: 296244 - RNA, 21 nt, Human
gcccccaccauccacauccac

SEQ ID NO: 296245 - RNA, 18 nt, Human
gcccuguggcucuuggcc

SEQ ID NO: 296246 - RNA, 20 nt, Human
gccuggcuggcccacccuuc

SEQ ID NO: 296247 - RNA, 18 nt, Human
gcggagcccgccgcccgc

SEQ ID NO: 296248 - RNA, 19 nt, Human
gcguggacacagcacaaaa

SEQ ID NO: 296249 - RNA, 20 nt, Human
gcugcgcggagcccgccgcc

SEQ ID NO: 296250 - RNA, 20 nt, Human
ggacccaggggcagaagggg

SEQ ID NO: 296251 - RNA, 22 nt, Human
ggagaagucaguacgggggagg

SEQ ID NO: 296252 - RNA, 20 nt, Human
ggagggggcgcuacacuacu

SEQ ID NO: 296253 - RNA, 21 nt, Human
ggagugggguggggaggaggg

SEQ ID NO: 296254 - RNA, 22 nt, Human
ggagugggguggggaggaggga

SEQ ID NO: 296255 - RNA, 21 nt, Human
ggcaggucugggguucucugg

SEQ ID NO: 296256 - RNA, 19 nt, Human
ggcguugggaagaggcuug

SEQ ID NO: 296257 - RNA, 19 nt, Human
gggaccugguccuaaaccu

SEQ ID NO: 296258 - RNA, 19 nt, Human
gggaggagggaggcauggg

SEQ ID NO: 296259 - RNA, 20 nt, Human
gggaggcaugggauggaugg

SEQ ID NO: 296260 - RNA, 21 nt, Human
gggcagaagggggugggagaa

SEQ ID NO: 296261 - RNA, 18 nt, Human
ggggaagggguaggugcu

SEQ ID NO: 296262 - RNA, 30 nt, Human; identical to SEQ ID NO: 294429

SEQ ID NO: 296263 - RNA, 24 nt, Human
ggggagggggucgccuuagcgcgu

SEQ ID NO: 296264 - RNA, 27 nt, Human
ggggcagaagggggugggagaagaagg

SEQ ID NO: 296265 - RNA, 19 nt, Human
gggguggggaggagggagg

SEQ ID NO: 296266 - RNA, 20 nt, Human
gggguggggaggagggaggc

SEQ ID NO: 296267 - RNA, 21 nt, Human
guccaugcccccaccauccac

SEQ ID NO: 296268 - RNA, 23 nt, Human
gugaaggacugaggcuucaggag

SEQ ID NO: 296269 - RNA, 20 nt, Human
uacagagccuccuccaaggg

SEQ ID NO: 296270 - RNA, 21 nt, Human
uaccaguauucuggggguuag

SEQ ID NO: 296271 - RNA, 18 nt, Human
uacucgggaaagaggaac

SEQ ID NO: 296272 - RNA, 19 nt, Human
uagcccugaaacucugagg

SEQ ID NO: 296273 - RNA, 25 nt, Human
uaucuuaccaccccauacugucuug

SEQ ID NO: 296274 - RNA, 20 nt, Human
ucagcccaaagcuggcugcc

SEQ ID NO: 296275 - RNA, 18 nt, Human
ucaguccccugaggacau

SEQ ID NO: 296276 - RNA, 24 nt, Human
uccaaaacuugagcauugaucuug

SEQ ID NO: 296277 - RNA, 19 nt, Human
uccacauccacacacuucc

SEQ ID NO: 296278 - RNA, 22 nt, Human
uccaccaguggcaccucuggag

SEQ ID NO: 296279 - RNA, 19 nt, Human
ugaaaaacaaaacagaaga

SEQ ID NO: 296280 - RNA, 21 nt, Human
ugaaaaacaaaacagaagacu

SEQ ID NO: 296281 - RNA, 18 nt, Human
ugacccuuccaccagugg

SEQ ID NO: 296282 - RNA, 22 nt, Human
ugacccuuccaccaguggcacc

SEQ ID NO: 296283 - RNA, 24 nt, Human
ugcccuagcucccugccuccccaa

SEQ ID NO: 296284 - RNA, 19 nt, Human
ugccugggcugagcccuau

SEQ ID NO: 296285 - RNA, 23 nt, Human
ugccugggcugagcccuauuaug

SEQ ID NO: 296286 - RNA, 22 nt, Human
ugcuggggcuccgcuccggggg

SEQ ID NO: 296287 - RNA, 21 nt, Human
uggaaacgucaaacaaugaaa

SEQ ID NO: 296288 - RNA, 25 nt, Human
uggaaacgucaaacaaugaaaaaca

SEQ ID NO: 296289 - RNA, 18 nt, Human
uggaaggaggugaagggg

SEQ ID NO: 296290 - RNA, 21 nt, Human
uggaaggaggugaaggggcug

SEQ ID NO: 296291 - RNA, 22 nt, Human
uggaaggaggugaaggggcugg

SEQ ID NO: 296292 - RNA, 18 nt, Human
uggaaucuggaggauguu

SEQ ID NO: 296293 - RNA, 22 nt, Human
uggaaucuggaggauguuguca

SEQ ID NO: 296294 - RNA, 21 nt, Human
uggacacagcacaaaacacaa

SEQ ID NO: 296295 - RNA, 19 nt, Human
uggaggauguugucagucc

SEQ ID NO: 296296 - RNA, 21 nt, Human
uggagugggguggggaggagg

SEQ ID NO: 296297 - RNA, 23 nt, Human
uggauggccggggacccaggggc

SEQ ID NO: 296298 - RNA, 29 nt, Human
uggcaaaugguucuuggugucuacaguaa

SEQ ID NO: 296299 - RNA, 19 nt, Human
uggcaaggugaaggacuga

SEQ ID NO: 296300 - RNA, 21 nt, Human
uggcaaggugaaggacugagg

SEQ ID NO: 296301 - RNA, 23 nt, Human
uggcaccucuggaguacccagca

SEQ ID NO: 296302 - RNA, 24 nt, Human
uggcaccucuggaguacccagcac

SEQ ID NO: 296303 - RNA, 18 nt, Human
uggcugccugggcugagc

SEQ ID NO: 296304 - RNA, 21 nt, Human
uggcugccugggcugagcccu

SEQ ID NO: 296305 - RNA, 19 nt, Human
ugggaaggguccagccuag

SEQ ID NO: 296306 - RNA, 20 nt, Human
ugggaaggguccagccuagu

SEQ ID NO: 296307 - RNA, 19 nt, Human
ugggauggaugggccugau

SEQ ID NO: 296308 - RNA, 20 nt, Human
ugggcugguuggggagaggc

SEQ ID NO: 296309 - RNA, 22 nt, Human
uggggaccugggcaguggccuu

SEQ ID NO: 296310 - RNA, 20 nt, Human
uggggaggagggaggcaugg

SEQ ID NO: 296311 - RNA, 21 nt, Human
uggggaggagggaggcauggg

SEQ ID NO: 296312 - RNA, 18 nt, Human
ugggugcagguaaggaga

SEQ ID NO: 296313 - RNA, 26 nt, Human
ugguagcaaaaugcccucccuaaauc

SEQ ID NO: 296314 - RNA, 21 nt, Human
ugguccccagggcguugggaa

SEQ ID NO: 296315 - RNA, 20 nt, Human
uggucccugcccuagcuccc

SEQ ID NO: 296316 - RNA, 23 nt, Human
ugguuuauggcuggaaucuggag

SEQ ID NO: 296317 - RNA, 18 nt, Human
uguaagggcaggucuggg

SEQ ID NO: 296318 - RNA, 23 nt, Human
ugucuacaguaaccccacuaccc

SEQ ID NO: 296319 - RNA, 19 nt, Human
uguggcaaaugguucuugg

SEQ ID NO: 296320 - RNA, 23 nt, Human
uguggcaaaugguucuugguguc

SEQ ID NO: 296321 - RNA, 20 nt, Human
uuauguagugggaagggucc

SEQ ID NO: 296322 - RNA, 20 nt, Human
uugauuuggaagauggagga

SEQ ID NO: 296323 - RNA, 19 nt, Human
uuggaagauggaggaguuc

SEQ ID NO: 296324 - RNA, 21 nt, Human
uuguuucuguuucccaagggg

SEQ ID NO: 296325 - RNA, 18 nt, Human
uuuucagaacuaggaggc

SEQ ID NO: 296326 - RNA, 21 nt, Human
aaaacacaacacgggccgccg

SEQ ID NO: 296327 - RNA, 24 nt, Human
aaaacagaagacugguccccaggg

SEQ ID NO: 296328 - RNA, 19 nt, Human
aaaagcacaccgcacuaca

SEQ ID NO: 296329 - RNA, 24 nt, Human
aaacaaaacagaagacuggucccc

SEQ ID NO: 296330 - RNA, 25 nt, Human
aaacaaaacagaagacuggucccca

SEQ ID NO: 296331 - RNA, 20 nt, Human
aaaugcccucccuaaauccc

SEQ ID NO: 296332 - RNA, 19 nt, Human
aacagaagacugguccccc

SEQ ID NO: 296333 - RNA, 23 nt, Human
aagcuggcugccugggcugagcc

SEQ ID NO: 296334 - RNA, 25 nt, Human
acaaaacacaacacgggccgccgcg

SEQ ID NO: 296335 - RNA, 22 nt, Human
acaaaacagaagacuggucccc

SEQ ID NO: 296336 - RNA, 18 nt, Human
acagagccuccuccaagg

SEQ ID NO: 296337 - RNA, 27 nt, Human
acagagccuccuccaaggccuugauaa

SEQ ID NO: 296338 - RNA, 22 nt, Human
acagcacaaaacacaacacggg

SEQ ID NO: 296339 - RNA, 21 nt, Human
accaugcuuugggggaagauu

SEQ ID NO: 296340 - RNA, 19 nt, Human
acucgggaaagaggaacug

SEQ ID NO: 296341 - RNA, 22 nt, Human
acugaaaugccaguuuaaucca

SEQ ID NO: 296342 - RNA, 20 nt, Human
agaaggucuaugcacaagga

SEQ ID NO: 296343 - RNA, 19 nt, Human
agaggaacuguuggagugg

SEQ ID NO: 296344 - RNA, 24 nt, Human
agcucagcccaaagcuggcugccu

SEQ ID NO: 296345 - RNA, 21 nt, Human
aggacauacagagccuccucc

SEQ ID NO: 296346 - RNA, 23 nt, Human
aggagaagucaguacgggggagg

SEQ ID NO: 296347 - RNA, 22 nt, Human
aggaggcuuguagguuacuugg

SEQ ID NO: 296348 - RNA, 20 nt, Human
aggagggaggcaugggaugg

SEQ ID NO: 296349 - RNA, 18 nt, Human
aggagggcaggggcccug

SEQ ID NO: 296350 - RNA, 19 nt, Human
aggaggugggggaagucaa

SEQ ID NO: 296351 - RNA, 23 nt, Human
agggaggcaugggauggaugggg

SEQ ID NO: 296352 - RNA, 21 nt, Human
aggggcagaagggggugggag

SEQ ID NO: 296353 - RNA, 18 nt, Human
agggggcgcacuggggac

SEQ ID NO: 296354 - RNA, 25 nt, Human
auacagagccuccuccaaccggagg

SEQ ID NO: 296355 - RNA, 20 nt, Human
auucuacaccagccgaaaga

SEQ ID NO: 296356 - RNA, 21 nt, Human
caaaacagaagacuggucccc

SEQ ID NO: 296357 - RNA, 23 nt, Human
caaacaaugaaaaacaaaacaga

SEQ ID NO: 296358 - RNA, 22 nt, Human
caacaccccaaccaccuuacuc

SEQ ID NO: 296359 - RNA, 20 nt, Human
caagaggucaugaugcccuu

SEQ ID NO: 296360 - RNA, 21 nt, Human
cacacuucccuuccuuaucuu

SEQ ID NO: 296361 - RNA, 21 nt, Human
caccccauacugucuuggaac

SEQ ID NO: 296362 - RNA, 20 nt, Human
caccgcacuacacuacuggc

SEQ ID NO: 296363 - RNA, 18 nt, Human
cacuggggaccugggcag

SEQ ID NO: 296364 - RNA, 25 nt, Human
cagagccuccuccaaggccuugaua

SEQ ID NO: 296365 - RNA, 22 nt, Human
caggagggcaggggcccuguug

SEQ ID NO: 296366 - RNA, 22 nt, Human
caguauucuggggguuagcccu

SEQ ID NO: 296367 - RNA, 21 nt, Human
cauacagagccuccuccaagg

SEQ ID NO: 296368 - RNA, 23 nt, Human
ccacacacuucccuuccuuaucu

SEQ ID NO: 296369 - RNA, 29 nt, Human
ccacccgccaucacguaaaagcacaccgg

SEQ ID NO: 296370 - RNA, 23 nt, Human
ccauacugucuuggaacaugcag

SEQ ID NO: 296371 - RNA, 26 nt, Human
ccauacugucuuggaacaugcagugg

SEQ ID NO: 296372 - RNA, 21 nt, Human
cccacagaggccccucugacc

SEQ ID NO: 296373 - RNA, 21 nt, Human
cccaccauccacauccacaca

SEQ ID NO: 296374 - RNA, 26 nt, Human
ccccaccauccacauccacacacuuc

SEQ ID NO: 296375 - RNA, 19 nt, Human
ccccacuacccccaugggu

SEQ ID NO: 296376 - RNA, 20 nt, Human
ccccacuacccccaugggua

SEQ ID NO: 296377 - RNA, 21 nt, Human
ccccacuacccccauggguac

SEQ ID NO: 296378 - RNA, 25 nt, Human
cccccugggggggaagggguaggug

SEQ ID NO: 296379 - RNA, 21 nt, Human
ccccugaggacauacagagcc

SEQ ID NO: 296380 - RNA, 20 nt, Human
cccugaaacucugaggccug

SEQ ID NO: 296381 - RNA, 21 nt, Human
ccgccgcccgcugcccacccg

SEQ ID NO: 296382 - RNA, 22 nt, Human
ccucucaaggggaccugguccu

SEQ ID NO: 296383 - RNA, 22 nt, Human
ccuggcuggcccacccuuccug

SEQ ID NO: 296384 - RNA, 19 nt, Human
ccugggcugagacuuucug

SEQ ID NO: 296385 - RNA, 21 nt, Human
ccuguuagcucagcccaaagc

SEQ ID NO: 296386 - RNA, 24 nt, Human
cgcccgcugcccacccgccaucac

SEQ ID NO: 296387 - RNA, 22 nt, Human
cgcguggacacagcacaaaaca

SEQ ID NO: 296388 - RNA, 22 nt, Human
cucagcccaaagcuggcugccu

SEQ ID NO: 296389 - RNA, 23 nt, Human
cugaggccugggugcagguaagg

SEQ ID NO: 296390 - RNA, 18 nt, Human
cugccugggcugagcccu

SEQ ID NO: 296391 - RNA, 18 nt, Human
cuggcaaggugaaggacu

SEQ ID NO: 296392 - RNA, 22 nt, Human
cuuguuugaggaggaggugggg

SEQ ID NO: 296393 - RNA, 18 nt, Human
gaaaaacaaaacagaaga

SEQ ID NO: 296394 - RNA, 18 nt, Human
gaagauggaggaguucag

SEQ ID NO: 296395 - RNA, 21 nt, Human
gacccaggggcagaagggggu

SEQ ID NO: 296396 - RNA, 21 nt, Human
gagcauggccuuggccccuac

SEQ ID NO: 296397 - RNA, 18 nt, Human
gaggagggaggcauggga

SEQ ID NO: 296398 - RNA, 20 nt, Human
gagugggguggggaggaggg

SEQ ID NO: 296399 - RNA, 20 nt, Human
gcaccuggcaaggugaagga

SEQ ID NO: 296400 - RNA, 21 nt, Human
gcccccaccauccacauccac

SEQ ID NO: 296401 - RNA, 18 nt, Human
gcccuguggcucuuggcc

SEQ ID NO: 296402 - RNA, 20 nt, Human
gccuggcuggcccacccuuc

SEQ ID NO: 296403 - RNA, 18 nt, Human
gcggagcccgccgcccgc

SEQ ID NO: 296404 - RNA, 19 nt, Human
gcguggacacagcacaaaa

SEQ ID NO: 296405 - RNA, 20 nt, Human
gcugcgcggagcccgccgcc

SEQ ID NO: 296406 - RNA, 20 nt, Human
ggacccaggggcagaagggg

SEQ ID NO: 296407 - RNA, 22 nt, Human
ggagaagucaguacgggggagg

SEQ ID NO: 296408 - RNA, 20 nt, Human
ggagggggcgcuacacuacu

SEQ ID NO: 296409 - RNA, 21 nt, Human
ggagugggguggggaggaggg

SEQ ID NO: 296410 - RNA, 22 nt, Human
ggagugggguggggaggaggga

SEQ ID NO: 296411 - RNA, 21 nt, Human
ggcaggucugggguucucugg

SEQ ID NO: 296412 - RNA, 19 nt, Human
ggcguugggaagaggcuug

SEQ ID NO: 296413 - RNA, 19 nt, Human
gggaccugguccuaaaccu

SEQ ID NO: 296414 - RNA, 19 nt, Human
gggaggagggaggcauggg

SEQ ID NO: 296415 - RNA, 20 nt, Human
gggaggcaugggauggaugg

SEQ ID NO: 296416 - RNA, 21 nt, Human
gggcagaagggggugggagaa

SEQ ID NO: 296417 - RNA, 19 nt, Human
gggcguugggaagaggcuu

SEQ ID NO: 296418 - RNA, 18 nt, Human
ggggaagggguaggugcu

SEQ ID NO: 296419 - RNA, 24 nt, Human
ggggagggggucgccuuagcgcgu

SEQ ID NO: 296420 - RNA, 27 nt, Human
ggggcagaagggggugggagaagaagg

SEQ ID NO: 296421 - RNA, 19 nt, Human
gggguggggaggagggagg

SEQ ID NO: 296422 - RNA, 20 nt, Human
gggguggggaggagggaggc

SEQ ID NO: 296423 - RNA, 21 nt, Human
guccaugcccccaccauccac

SEQ ID NO: 296424 - RNA, 23 nt, Human
gugaaggacugaggcuucaggag

SEQ ID NO: 296425 - RNA, 20 nt, Human
uacagagccuccuccaaggg

SEQ ID NO: 296426 - RNA, 21 nt, Human
uaccaguauucuggggguuag

SEQ ID NO: 296427 - RNA, 18 nt, Human
uacucgggaaagaggaac

SEQ ID NO: 296428 - RNA, 19 nt, Human
uagcccugaaacucugagg

SEQ ID NO: 296429 - RNA, 25 nt, Human
uaucuuaccaccccauacugucuug

SEQ ID NO: 296430 - RNA, 19 nt, Human
uauguagugggaagggucc

SEQ ID NO: 296431 - RNA, 20 nt, Human
ucagcccaaagcuggcugcc

SEQ ID NO: 296432 - RNA, 18 nt, Human
ucaguccccugaggacau

SEQ ID NO: 296433 - RNA, 24 nt, Human
uccaaaacuugagcauugaucuug

SEQ ID NO: 296434 - RNA, 19 nt, Human
uccacauccacacacuucc

SEQ ID NO: 296435 - RNA, 22 nt, Human
uccaccaguggcaccucuggag

SEQ ID NO: 296436 - RNA, 19 nt, Human
ugaaaaacaaaacagaaga

SEQ ID NO: 296437 - RNA, 21 nt, Human
ugaaaaacaaaacagaagacu

SEQ ID NO: 296438 - RNA, 18 nt, Human
ugacccuuccaccagugg

SEQ ID NO: 296439 - RNA, 22 nt, Human
ugacccuuccaccaguggcacc

SEQ ID NO: 296440 - RNA, 24 nt, Human
ugcccuagcucccugccuccccaa

SEQ ID NO: 296441 - RNA, 19 nt, Human
ugccugggcugagcccuau

SEQ ID NO: 296442 - RNA, 23 nt, Human
ugccugggcugagcccuauuaug

SEQ ID NO: 296443 - RNA, 22 nt, Human
ugcuggggcuccgcuccggggg

SEQ ID NO: 296444 - RNA, 21 nt, Human
uggaaacgucaaacaaugaaa

SEQ ID NO: 296445 - RNA, 25 nt, Human
uggaaacgucaaacaaugaaaaaca

SEQ ID NO: 296446 - RNA, 18 nt, Human
uggaaggaggugaagggg

SEQ ID NO: 296447 - RNA, 21 nt, Human
uggaaggaggugaaggggcug

SEQ ID NO: 296448 - RNA, 22 nt, Human
uggaaggaggugaaggggcugg

SEQ ID NO: 296449 - RNA, 18 nt, Human
uggaaucuggaggauguu

SEQ ID NO: 296450 - RNA, 22 nt, Human
uggaaucuggaggauguuguca

SEQ ID NO: 296451 - RNA, 21 nt, Human
uggacacagcacaaaacacaa

SEQ ID NO: 296452 - RNA, 19 nt, Human
uggaggauguugucagucc

SEQ ID NO: 296453 - RNA, 21 nt, Human
uggagugggguggggaggagg

SEQ ID NO: 296454 - RNA, 23 nt, Human
uggauggccggggacccaggggc

SEQ ID NO: 296455 - RNA, 29 nt, Human
uggcaaaugguucuuggugucuacaguaa

SEQ ID NO: 296456 - RNA, 19 nt, Human
uggcaaggugaaggacuga

SEQ ID NO: 296457 - RNA, 21 nt, Human
uggcaaggugaaggacugagg

SEQ ID NO: 296458 - RNA, 23 nt, Human
uggcaccucuggaguacccagca

SEQ ID NO: 296459 - RNA, 24 nt, Human
uggcaccucuggaguacccagcac

SEQ ID NO: 296460 - RNA, 18 nt, Human
uggcugccugggcugagc

SEQ ID NO: 296461 - RNA, 21 nt, Human
uggcugccugggcugagcccu

SEQ ID NO: 296462 - RNA, 19 nt, Human
ugggaaggguccagccuag

SEQ ID NO: 296463 - RNA, 20 nt, Human
ugggaaggguccagccuagu

SEQ ID NO: 296464 - RNA, 20 nt, Human
ugggaaggguccagccuagu

SEQ ID NO: 296465 - RNA, 19 nt, Human
ugggauggaugggccugau

SEQ ID NO: 296466 - RNA, 20 nt, Human
ugggcugguuggggagaggc

SEQ ID NO: 296467 - RNA, 22 nt, Human
uggggaccugggcaguggccuu

SEQ ID NO: 296468 - RNA, 20 nt, Human
uggggaggagggaggcaugg

SEQ ID NO: 296469 - RNA, 21 nt, Human
uggggaggagggaggcauggg

SEQ ID NO: 296470 - RNA, 18 nt, Human
ugggugcagguaaggaga

SEQ ID NO: 296471 - RNA, 26 nt, Human
ugguagcaaaaugcccucccuaaauc

SEQ ID NO: 296472 - RNA, 21 nt, Human
ugguccccagggcguugggaa

SEQ ID NO: 296473 - RNA, 20 nt, Human
uggucccugcccuagcuccc

SEQ ID NO: 296474 - RNA, 23 nt, Human
ugguuuauggcuggaaucuggag

SEQ ID NO: 296475 - RNA, 18 nt, Human
uguaagggcaggucuggg

SEQ ID NO: 296476 - RNA, 23 nt, Human
ugucuacaguaaccccacuaccc

SEQ ID NO: 296477 - RNA, 19 nt, Human
uguggcaaaugguucuugg

SEQ ID NO: 296478 - RNA, 23 nt, Human
uguggcaaaugguucuugguguc

SEQ ID NO: 296479 - RNA, 20 nt, Human
uugauuuggaagauggagga

SEQ ID NO: 296480 - RNA, 21 nt, Human
uuguuucuguuucccaagggg

SEQ ID NO: 296481 - RNA, 21 nt, Human
uuuaaccaggcuauggccacu

SEQ ID NO: 296482 - RNA, 18 nt, Human
uuuucagaacuaggaggc

SEQ ID NO: 296483 - RNA, 21 nt, Human
aaaacacaacacgggccgccg

SEQ ID NO: 296484 - RNA, 24 nt, Human
aaaacagaagacugguccccaggg

SEQ ID NO: 296485 - RNA, 19 nt, Human
aaaagcacaccgcacuaca

SEQ ID NO: 296486 - RNA, 25 nt, Human
aaacaaaacagaagacuggucccca

SEQ ID NO: 296487 - RNA, 25 nt, Human
aaacaaaacagaagacuggucccca

SEQ ID NO: 296488 - RNA, 22 nt, Human
aaacaaugaaaaacaaaacaga

SEQ ID NO: 296489 - RNA, 20 nt, Human
aaaugcccucccuaaauccc

SEQ ID NO: 296490 - RNA, 19 nt, Human
aacagaagacugguccccc

SEQ ID NO: 296491 - RNA, 23 nt, Human
aagcuggcugccugggcugagcc

SEQ ID NO: 296492 - RNA, 21 nt, Human
aaugaaaaacaaaacagaaga

SEQ ID NO: 296493 - RNA, 25 nt, Human
acaaaacacaacacgggccgccgcg

SEQ ID NO: 296494 - RNA, 22 nt, Human
acaaaacagaagacuggucccc

SEQ ID NO: 296495 - RNA, 22 nt, Human
acagcacaaaacacaacacggg

SEQ ID NO: 296496 - RNA, 21 nt, Human
accaugcuuugggggaagauu

SEQ ID NO: 296497 - RNA, 20 nt, Human
accccauacugucuuggaac

SEQ ID NO: 296498 - RNA, 19 nt, Human
acucgggaaagaggaacug

SEQ ID NO: 296499 - RNA, 22 nt, Human
acugaaaugccaguuuaaucca

SEQ ID NO: 296500 - RNA, 20 nt, Human
agaaggucuaugcacaagga

SEQ ID NO: 296501 - RNA, 19 nt, Human
agaggaacuguuggagugg

SEQ ID NO: 296502 - RNA, 24 nt, Human
agcucagcccaaagcuggcugccu

SEQ ID NO: 296503 - RNA, 21 nt, Human
aggacauacagagccuccucc

SEQ ID NO: 296504 - RNA, 22 nt, Human
aggaggcuuguagguuacuugg

SEQ ID NO: 296505 - RNA, 20 nt, Human
aggagggaggcaugggaugg

SEQ ID NO: 296506 - RNA, 18 nt, Human
aggagggcaggggcccug

SEQ ID NO: 296507 - RNA, 19 nt, Human
aggaggugggggaagucaa

SEQ ID NO: 296508 - RNA, 23 nt, Human
agggaggcaugggauggaugggg

SEQ ID NO: 296509 - RNA, 18 nt, Human
agggggcgcacuggggac

SEQ ID NO: 296510 - RNA, 25 nt, Human
auacagagccuccuccaaccggagg

SEQ ID NO: 296511 - RNA, 20 nt, Human
auucuacaccagccgaaaga

SEQ ID NO: 296512 - RNA, 21 nt, Human
caaaacagaagacuggucccc

SEQ ID NO: 296513 - RNA, 22 nt, Human
caacaccccaaccaccuuacuc

SEQ ID NO: 296514 - RNA, 20 nt, Human
caagaggucaugaugcccuu

SEQ ID NO: 296515 - RNA, 21 nt, Human
cacacuucccuuccuuaucuu

SEQ ID NO: 296516 - RNA, 20 nt, Human
caccgcacuacacuacuggc

SEQ ID NO: 296517 - RNA, 18 nt, Human
cacuggggaccugggcag

SEQ ID NO: 296518 - RNA, 25 nt, Human
cagagccuccuccaaggccuugaua

SEQ ID NO: 296519 - RNA, 22 nt, Human
caggagggcaggggcccuguug

SEQ ID NO: 296520 - RNA, 22 nt, Human
caggggcagaagggggugggag

SEQ ID NO: 296521 - RNA, 22 nt, Human
caguauucuggggguuagcccu

SEQ ID NO: 296522 - RNA, 21 nt, Human
cauacagagccuccuccaagg

SEQ ID NO: 296523 - RNA, 23 nt, Human
ccacacacuucccuuccuuaucu

SEQ ID NO: 296524 - RNA, 23 nt, Human
ccauacugucuuggaacaugcag

SEQ ID NO: 296525 - RNA, 26 nt, Human
ccauacugucuuggaacaugcagugg

SEQ ID NO: 296526 - RNA, 21 nt, Human
cccacagaggccccucugacc

SEQ ID NO: 296527 - RNA, 21 nt, Human
cccaccauccacauccacaca

SEQ ID NO: 296528 - RNA, 30 nt, Human; identical to SEQ ID NO: 294382

SEQ ID NO: 296529 - RNA, 26 nt, Human
ccccaccauccacauccacacacuuc

SEQ ID NO: 296530 - RNA, 19 nt, Human
ccccacuacccccaugggu

SEQ ID NO: 296531 - RNA, 20 nt, Human
ccccacuacccccaugggua

SEQ ID NO: 296532 - RNA, 21 nt, Human
ccccacuacccccauggguac

SEQ ID NO: 296533 - RNA, 25 nt, Human
cccccugggggggaagggguaggug

SEQ ID NO: 296534 - RNA, 21 nt, Human
ccccugaggacauacagagcc

SEQ ID NO: 296535 - RNA, 21 nt, Human
ccgccgcccgcugcccacccg

SEQ ID NO: 296536 - RNA, 19 nt, Human
ccuggcuggcccacccuuc

SEQ ID NO: 296537 - RNA, 22 nt, Human
ccuggcuggcccacccuuccug

SEQ ID NO: 296538 - RNA, 19 nt, Human
ccugggcugagacuuucug

SEQ ID NO: 296539 - RNA, 21 nt, Human
ccugggcugagcccuauuaug

SEQ ID NO: 296540 - RNA, 21 nt, Human
ccuguuagcucagcccaaagc

SEQ ID NO: 296541 - RNA, 24 nt, Human
cgcccgcugcccacccgccaucac

SEQ ID NO: 296542 - RNA, 19 nt, Human
cgcccuguggcucuuggcc

SEQ ID NO: 296543 - RNA, 22 nt, Human
cgcguggacacagcacaaaaca

SEQ ID NO: 296544 - RNA, 22 nt, Human
cggcaccuggcaaggugaagga

SEQ ID NO: 296545 - RNA, 23 nt, Human
cggcugcgcggagcccgccgccc

SEQ ID NO: 296546 - RNA, 22 nt, Human
cucagcccaaagcuggcugccu

SEQ ID NO: 296547 - RNA, 21 nt, Human
cucucaaggggaccugguccu

SEQ ID NO: 296548 - RNA, 23 nt, Human
cugaggccugggugcagguaagg

SEQ ID NO: 296549 - RNA, 18 nt, Human
cugccugggcugagcccu

SEQ ID NO: 296550 - RNA, 18 nt, Human
cuggcaaggugaaggacu

SEQ ID NO: 296551 - RNA, 22 nt, Human
cuuguuugaggaggaggugggg

SEQ ID NO: 296552 - RNA, 22 nt, Human
cuuuaaccaggcuauggccacu

SEQ ID NO: 296553 - RNA, 18 nt, Human
gaagauggaggaguucag

SEQ ID NO: 296554 - RNA, 21 nt, Human
gacccaggggcagaagggggu

SEQ ID NO: 296555 - RNA, 21 nt, Human
gagcauggccuuggccccuac

SEQ ID NO: 296556 - RNA, 20 nt, Human
gagugggguggggaggaggg

SEQ ID NO: 296557 - RNA, 21 nt, Human
gcccccaccauccacauccac

SEQ ID NO: 296558 - RNA, 18 nt, Human
gcccuguggcucuuggcc

SEQ ID NO: 296559 - RNA, 18 nt, Human
gcggagcccgccgcccgc

SEQ ID NO: 296560 - RNA, 19 nt, Human
gcguggacacagcacaaaa

SEQ ID NO: 296561 - RNA, 20 nt, Human
gcugcgcggagcccgccgcc

SEQ ID NO: 296562 - RNA, 20 nt, Human
ggacccaggggcagaagggg

SEQ ID NO: 296563 - RNA, 22 nt, Human
ggagaagucaguacgggggagg

SEQ ID NO: 296564 - RNA, 19 nt, Human
ggaggagggaggcauggga

SEQ ID NO: 296565 - RNA, 20 nt, Human
ggagggggcgcuacacuacu

SEQ ID NO: 296566 - RNA, 21 nt, Human
ggagugggguggggaggaggg

SEQ ID NO: 296567 - RNA, 22 nt, Human
ggagugggguggggaggaggga

SEQ ID NO: 296568 - RNA, 21 nt, Human
ggcaggucugggguucucugg

SEQ ID NO: 296569 - RNA, 19 nt, Human
ggcguugggaagaggcuug

SEQ ID NO: 296570 - RNA, 19 nt, Human
gggaccugguccuaaaccu

SEQ ID NO: 296571 - RNA, 19 nt, Human
gggaggagggaggcauggg

SEQ ID NO: 296572 - RNA, 20 nt, Human
gggaggcaugggauggaugg

SEQ ID NO: 296573 - RNA, 21 nt, Human
gggcagaagggggugggagaa

SEQ ID NO: 296574 - RNA, 19 nt, Human
gggcguugggaagaggcuu

SEQ ID NO: 296575 - RNA, 18 nt, Human
ggggaagggguaggugcu

SEQ ID NO: 296576 - RNA, 24 nt, Human
ggggagggggucgccuuagcgcgu

SEQ ID NO: 296577 - RNA, 19 nt, Human
gggguggggaggagggagg

SEQ ID NO: 296578 - RNA, 20 nt, Human
gggguggggaggagggaggc

SEQ ID NO: 296579 - RNA, 24 nt, Human
guagcaaaaugcccucccuaaauc

SEQ ID NO: 296580 - RNA, 21 nt, Human
guccaugcccccaccauccac

SEQ ID NO: 296581 - RNA, 23 nt, Human
gugaaggacugaggcuucaggag

SEQ ID NO: 296582 - RNA, 20 nt, Human
uacagagccuccuccaaggg

SEQ ID NO: 296583 - RNA, 21 nt, Human
uaccaguauucuggggguuag

SEQ ID NO: 296584 - RNA, 18 nt, Human
uacucgggaaagaggaac

SEQ ID NO: 296585 - RNA, 19 nt, Human
uagcccugaaacucugagg

SEQ ID NO: 296586 - RNA, 23 nt, Human
uagcccugaaacucugaggccug

SEQ ID NO: 296587 - RNA, 24 nt, Human
uaggagaagucaguacgggggagg

SEQ ID NO: 296588 - RNA, 25 nt, Human
uaucuuaccaccccauacugucuug

SEQ ID NO: 296589 - RNA, 19 nt, Human
uauguagugggaagggucc

SEQ ID NO: 296590 - RNA, 20 nt, Human
ucagcccaaagcuggcugcc

SEQ ID NO: 296591 - RNA, 18 nt, Human
ucaguccccugaggacau

SEQ ID NO: 296592 - RNA, 24 nt, Human
uccaaaacuugagcauugaucuug

SEQ ID NO: 296593 - RNA, 19 nt, Human
uccacauccacacacuucc

SEQ ID NO: 296594 - RNA, 22 nt, Human
uccaccaguggcaccucuggag

SEQ ID NO: 296595 - RNA, 21 nt, Human
ugaaaaacaaaacagaagacu

SEQ ID NO: 296596 - RNA, 18 nt, Human
ugacccuuccaccagugg

SEQ ID NO: 296597 - RNA, 22 nt, Human
ugacccuuccaccaguggcacc

SEQ ID NO: 296598 - RNA, 24 nt, Human
ugcccuagcucccugccuccccaa

SEQ ID NO: 296599 - RNA, 19 nt, Human
ugccugggcugagcccuau

SEQ ID NO: 296600 - RNA, 23 nt, Human
ugccugggcugagcccuauuaug

SEQ ID NO: 296601 - RNA, 22 nt, Human
ugcuggggcuccgcuccggggg

SEQ ID NO: 296602 - RNA, 21 nt, Human
uggaaacgucaaacaaugaaa

SEQ ID NO: 296603 - RNA, 25 nt, Human
uggaaacgucaaacaaugaaaaaca

SEQ ID NO: 296604 - RNA, 18 nt, Human
uggaaggaggugaagggg

SEQ ID NO: 296605 - RNA, 21 nt, Human
uggaaggaggugaaggggcug

SEQ ID NO: 296606 - RNA, 22 nt, Human
uggaaggaggugaaggggcugg

SEQ ID NO: 296607 - RNA, 18 nt, Human
uggaaucuggaggauguu

SEQ ID NO: 296608 - RNA, 22 nt, Human
uggaaucuggaggauguuguca

SEQ ID NO: 296609 - RNA, 21 nt, Human
uggacacagcacaaaacacaa

SEQ ID NO: 296610 - RNA, 19 nt, Human
uggaggauguugucagucc

SEQ ID NO: 296611 - RNA, 21 nt, Human
uggagugggguggggaggagg

SEQ ID NO: 296612 - RNA, 23 nt, Human
uggauggccggggacccaggggc

SEQ ID NO: 296613 - RNA, 25 nt, Human
uggcaaaugguucuuggugucuaca

SEQ ID NO: 296614 - RNA, 19 nt, Human
uggcaaggugaaggacuga

SEQ ID NO: 296615 - RNA, 21 nt, Human
uggcaaggugaaggacugagg

SEQ ID NO: 296616 - RNA, 23 nt, Human
uggcaccucuggaguacccagca

SEQ ID NO: 296617 - RNA, 24 nt, Human
uggcaccucuggaguacccagcac

SEQ ID NO: 296618 - RNA, 18 nt, Human
uggcugccugggcugagc

SEQ ID NO: 296619 - RNA, 21 nt, Human
uggcugccugggcugagcccu

SEQ ID NO: 296620 - RNA, 19 nt, Human
ugggaaggguccagccuag

SEQ ID NO: 296621 - RNA, 20 nt, Human
ugggaaggguccagccuagu

SEQ ID NO: 296622 - RNA, 20 nt, Human
ugggaaggguccagccuagu

SEQ ID NO: 296623 - RNA, 19 nt, Human
ugggauggaugggccugau

SEQ ID NO: 296624 - RNA, 20 nt, Human
ugggcugguuggggagaggc

SEQ ID NO: 296625 - RNA, 22 nt, Human
uggggaccugggcaguggccuu

SEQ ID NO: 296626 - RNA, 20 nt, Human
uggggaggagggaggcaugg

SEQ ID NO: 296627 - RNA, 21 nt, Human
uggggaggagggaggcauggg

SEQ ID NO: 296628 - RNA, 18 nt, Human
ugggugcagguaaggaga

SEQ ID NO: 296629 - RNA, 21 nt, Human
ugguccccagggcguugggaa

SEQ ID NO: 296630 - RNA, 20 nt, Human
uggucccugcccuagcuccc

SEQ ID NO: 296631 - RNA, 23 nt, Human
ugguuuauggcuggaaucuggag

SEQ ID NO: 296632 - RNA, 18 nt, Human
uguaagggcaggucuggg

SEQ ID NO: 296633 - RNA, 23 nt, Human
ugucuacaguaaccccacuaccc

SEQ ID NO: 296634 - RNA, 19 nt, Human
uguggcaaaugguucuugg

SEQ ID NO: 296635 - RNA, 23 nt, Human
uguggcaaaugguucuugguguc

SEQ ID NO: 296636 - RNA, 20 nt, Human
uugauuuggaagauggagga

SEQ ID NO: 296637 - RNA, 19 nt, Human
uuggaagauggaggaguuc

SEQ ID NO: 296638 - RNA, 21 nt, Human
uuguuucuguuucccaagggg

SEQ ID NO: 296639 - RNA, 18 nt, Human
uuuucagaacuaggaggc

SEQ ID NO: 296640 - RNA, 21 nt, Human
aaaacacaacacgggccgccg

SEQ ID NO: 296641 - RNA, 19 nt, Human
aaaagcacaccgcacuaca

SEQ ID NO: 296642 - RNA, 25 nt, Human
aaacaaaacagaagacuggucccca

SEQ ID NO: 296643 - RNA, 25 nt, Human
aaacaaaacagaagacuggucccca

SEQ ID NO: 296644 - RNA, 22 nt, Human
aaacaaugaaaaacaaaacaga

SEQ ID NO: 296645 - RNA, 23 nt, Human
aaacagaagacugguccccaggg

SEQ ID NO: 296646 - RNA, 20 nt, Human
aaaugcccucccuaaauccc

SEQ ID NO: 296647 - RNA, 19 nt, Human
aacagaagacugguccccc

SEQ ID NO: 296648 - RNA, 19 nt, Human
aagaggucaugaugcccuu

SEQ ID NO: 296649 - RNA, 23 nt, Human
aagcuggcugccugggcugagcc

SEQ ID NO: 296650 - RNA, 25 nt, Human
acaaaacacaacacgggccgccgcg

SEQ ID NO: 296651 - RNA, 22 nt, Human
acaaaacagaagacuggucccc

SEQ ID NO: 296652 - RNA, 18 nt, Human
acagagccuccuccaagg

SEQ ID NO: 296653 - RNA, 27 nt, Human
acagagccuccuccaaggccuugauaa

SEQ ID NO: 296654 - RNA, 22 nt, Human
acagcacaaaacacaacacggg

SEQ ID NO: 296655 - RNA, 21 nt, Human
accaugcuuugggggaagauu

SEQ ID NO: 296656 - RNA, 20 nt, Human
acccuuccaccaguggcacc

SEQ ID NO: 296657 - RNA, 19 nt, Human
acucgggaaagaggaacug

SEQ ID NO: 296658 - RNA, 22 nt, Human
acugaaaugccaguuuaaucca

SEQ ID NO: 296659 - RNA, 20 nt, Human
agaaggucuaugcacaagga

SEQ ID NO: 296660 - RNA, 19 nt, Human
agaggaacuguuggagugg

SEQ ID NO: 296661 - RNA, 24 nt, Human
agcucagcccaaagcuggcugccu

SEQ ID NO: 296662 - RNA, 21 nt, Human
aggacauacagagccuccucc

SEQ ID NO: 296663 - RNA, 22 nt, Human
aggaggcuuguagguuacuugg

SEQ ID NO: 296664 - RNA, 20 nt, Human
aggagggaggcaugggaugg

SEQ ID NO: 296665 - RNA, 18 nt, Human
aggagggcaggggcccug

SEQ ID NO: 296666 - RNA, 19 nt, Human
aggaggugggggaagucaa

SEQ ID NO: 296667 - RNA, 23 nt, Human
agggaggcaugggauggaugggg

SEQ ID NO: 296668 - RNA, 18 nt, Human
agggggcgcacuggggac

SEQ ID NO: 296669 - RNA, 25 nt, Human
auacagagccuccuccaaccggagg

SEQ ID NO: 296670 - RNA, 20 nt, Human
auggccggggacccaggggc

SEQ ID NO: 296671 - RNA, 21 nt, Human
caaaacagaagacuggucccc

SEQ ID NO: 296672 - RNA, 22 nt, Human
caacaccccaaccaccuuacuc

SEQ ID NO: 296673 - RNA, 21 nt, Human
cacacuucccuuccuuaucuu

SEQ ID NO: 296674 - RNA, 21 nt, Human
caccccauacugucuuggaac

SEQ ID NO: 296675 - RNA, 20 nt, Human
caccgcacuacacuacuggc

SEQ ID NO: 296676 - RNA, 18 nt, Human
cacuggggaccugggcag

SEQ ID NO: 296677 - RNA, 25 nt, Human
cagagccuccuccaaggccuugaua

SEQ ID NO: 296678 - RNA, 20 nt, Human
cagcccaaagcuggcugccu

SEQ ID NO: 296679 - RNA, 22 nt, Human
caggagggcaggggcccuguug

SEQ ID NO: 296680 - RNA, 22 nt, Human
caggggcagaagggggugggag

SEQ ID NO: 296681 - RNA, 22 nt, Human
caguauucuggggguuagcccu

SEQ ID NO: 296682 - RNA, 23 nt, Human
ccacacacuucccuuccuuaucu

SEQ ID NO: 296683 - RNA, 23 nt, Human
ccauacugucuuggaacaugcag

SEQ ID NO: 296684 - RNA, 26 nt, Human
ccauacugucuuggaacaugcagugg

SEQ ID NO: 296685 - RNA, 21 nt, Human
cccacagaggccccucugacc

SEQ ID NO: 296686 - RNA, 21 nt, Human
cccaccauccacauccacaca

SEQ ID NO: 296687 - RNA, 30 nt, Human; identical to SEQ ID NO: 294382

SEQ ID NO: 296688 - RNA, 19 nt, Human
ccccacuacccccaugggu

SEQ ID NO: 296689 - RNA, 20 nt, Human
ccccacuacccccaugggua

SEQ ID NO: 296690 - RNA, 21 nt, Human
ccccacuacccccauggguac

SEQ ID NO: 296691 - RNA, 27 nt, Human
cccccaccauccacauccacacacuuc

SEQ ID NO: 296692 - RNA, 23 nt, Human
cccccugggggggaagggguagg

SEQ ID NO: 296693 - RNA, 21 nt, Human
ccccugaggacauacagagcc

SEQ ID NO: 296694 - RNA, 20 nt, Human
cccugaaacucugaggccug

SEQ ID NO: 296695 - RNA, 19 nt, Human
ccuggcuggcccacccuuc

SEQ ID NO: 296696 - RNA, 22 nt, Human
ccuggcuggcccacccuuccug

SEQ ID NO: 296697 - RNA, 19 nt, Human
ccugggcugagacuuucug

SEQ ID NO: 296698 - RNA, 21 nt, Human
ccugggcugagcccuauuaug

SEQ ID NO: 296699 - RNA, 21 nt, Human
ccuguuagcucagcccaaagc

SEQ ID NO: 296700 - RNA, 24 nt, Human
cgcccgcugcccacccgccaucac

SEQ ID NO: 296701 - RNA, 18 nt, Human
cgccgcccgcugcccacc

SEQ ID NO: 296702 - RNA, 22 nt, Human
cgcguggacacagcacaaaaca

SEQ ID NO: 296703 - RNA, 23 nt, Human
cggcugcgcggagcccgccgccc

SEQ ID NO: 296704 - RNA, 22 nt, Human
cuauucuacaccagccgaaaga

SEQ ID NO: 296705 - RNA, 21 nt, Human
cucucaaggggaccugguccu

SEQ ID NO: 296706 - RNA, 18 nt, Human
cugccugggcugagcccu

SEQ ID NO: 296707 - RNA, 18 nt, Human
cuggcaaggugaaggacu

SEQ ID NO: 296708 - RNA, 18 nt, Human
gaaaaacaaaacagaaga

SEQ ID NO: 296709 - RNA, 18 nt, Human
gaagauggaggaguucag

SEQ ID NO: 296710 - RNA, 21 nt, Human
gacccaggggcagaagggggu

SEQ ID NO: 296711 - RNA, 21 nt, Human
gagcauggccuuggccccuac

SEQ ID NO: 296712 - RNA, 21 nt, Human
gaggccugggugcagguaagg

SEQ ID NO: 296713 - RNA, 20 nt, Human
gagugggguggggaggaggg

SEQ ID NO: 296714 - RNA, 20 nt, Human
gcaccuggcaaggugaagga

SEQ ID NO: 296715 - RNA, 21 nt, Human
gcccccaccauccacauccac

SEQ ID NO: 296716 - RNA, 18 nt, Human
gcccuguggcucuuggcc

SEQ ID NO: 296717 - RNA, 18 nt, Human
gcggagcccgccgcccgc

SEQ ID NO: 296718 - RNA, 19 nt, Human
gcguggacacagcacaaaa

SEQ ID NO: 296719 - RNA, 19 nt, Human
gcugccugggcugagcccu

SEQ ID NO: 296720 - RNA, 20 nt, Human
gcugcgcggagcccgccgcc

SEQ ID NO: 296721 - RNA, 20 nt, Human
ggacccaggggcagaagggg

SEQ ID NO: 296722 - RNA, 22 nt, Human
ggagaagucaguacgggggagg

SEQ ID NO: 296723 - RNA, 19 nt, Human
ggaggagggaggcauggga

SEQ ID NO: 296724 - RNA, 19 nt, Human
ggaggcaugggauggaugg

SEQ ID NO: 296725 - RNA, 20 nt, Human
ggagggggcgcuacacuacu

SEQ ID NO: 296726 - RNA, 21 nt, Human
ggagugggguggggaggaggg

SEQ ID NO: 296727 - RNA, 22 nt, Human
ggagugggguggggaggaggga

SEQ ID NO: 296728 - RNA, 21 nt, Human
ggcaggucugggguucucugg

SEQ ID NO: 296729 - RNA, 19 nt, Human
ggcguugggaagaggcuug

SEQ ID NO: 296730 - RNA, 19 nt, Human
gggaccugguccuaaaccu

SEQ ID NO: 296731 - RNA, 19 nt, Human
gggaggagggaggcauggg

SEQ ID NO: 296732 - RNA, 19 nt, Human
gggcguugggaagaggcuu

SEQ ID NO: 296733 - RNA, 18 nt, Human
ggggaagggguaggugcu

SEQ ID NO: 296734 - RNA, 24 nt, Human
ggggagggggucgccuuagcgcgu

SEQ ID NO: 296735 - RNA, 27 nt, Human
ggggcagaagggggugggagaagaagg

SEQ ID NO: 296736 - RNA, 19 nt, Human
gggguggggaggagggagg

SEQ ID NO: 296737 - RNA, 20 nt, Human
gggguggggaggagggaggc

SEQ ID NO: 296738 - RNA, 21 nt, Human
guccaugcccccaccauccac

SEQ ID NO: 296739 - RNA, 23 nt, Human
gugaaggacugaggcuucaggag

SEQ ID NO: 296740 - RNA, 19 nt, Human
uacagagccuccuccaagg

SEQ ID NO: 296741 - RNA, 20 nt, Human
uacagagccuccuccaaggg

SEQ ID NO: 296742 - RNA, 21 nt, Human
uaccaguauucuggggguuag

SEQ ID NO: 296743 - RNA, 18 nt, Human
uacucgggaaagaggaac

SEQ ID NO: 296744 - RNA, 19 nt, Human
uagcccugaaacucugagg

SEQ ID NO: 296745 - RNA, 24 nt, Human
uaggagaagucaguacgggggagg

SEQ ID NO: 296746 - RNA, 25 nt, Human
uaucuuaccaccccauacugucuug

SEQ ID NO: 296747 - RNA, 20 nt, Human
ucagcccaaagcuggcugcc

SEQ ID NO: 296748 - RNA, 18 nt, Human
ucaguccccugaggacau

SEQ ID NO: 296749 - RNA, 24 nt, Human
uccaaaacuugagcauugaucuug

SEQ ID NO: 296750 - RNA, 19 nt, Human
uccacauccacacacuucc

SEQ ID NO: 296751 - RNA, 22 nt, Human
uccaccaguggcaccucuggag

SEQ ID NO: 296752 - RNA, 19 nt, Human
ugaaaaacaaaacagaaga

SEQ ID NO: 296753 - RNA, 21 nt, Human
ugaaaaacaaaacagaagacu

SEQ ID NO: 296754 - RNA, 18 nt, Human
ugacccuuccaccagugg

SEQ ID NO: 296755 - RNA, 24 nt, Human
ugcccuagcucccugccuccccaa

SEQ ID NO: 296756 - RNA, 19 nt, Human
ugccugggcugagcccuau

SEQ ID NO: 296757 - RNA, 23 nt, Human
ugccugggcugagcccuauuaug

SEQ ID NO: 296758 - RNA, 22 nt, Human
ugcuggggcuccgcuccggggg

SEQ ID NO: 296759 - RNA, 21 nt, Human
uggaaacgucaaacaaugaaa

SEQ ID NO: 296760 - RNA, 25 nt, Human
uggaaacgucaaacaaugaaaaaca

SEQ ID NO: 296761 - RNA, 18 nt, Human
uggaaggaggugaagggg

SEQ ID NO: 296762 - RNA, 21 nt, Human
uggaaggaggugaaggggcug

SEQ ID NO: 296763 - RNA, 22 nt, Human
uggaaggaggugaaggggcugg

SEQ ID NO: 296764 - RNA, 18 nt, Human
uggaaucuggaggauguu

SEQ ID NO: 296765 - RNA, 22 nt, Human
uggaaucuggaggauguuguca

SEQ ID NO: 296766 - RNA, 21 nt, Human
uggacacagcacaaaacacaa

SEQ ID NO: 296767 - RNA, 19 nt, Human
uggaggauguugucagucc

SEQ ID NO: 296768 - RNA, 21 nt, Human
uggagugggguggggaggagg

SEQ ID NO: 296769 - RNA, 29 nt, Human
uggcaaaugguucuuggugucuacaguaa

SEQ ID NO: 296770 - RNA, 19 nt, Human
uggcaaggugaaggacuga

SEQ ID NO: 296771 - RNA, 21 nt, Human
uggcaaggugaaggacugagg

SEQ ID NO: 296772 - RNA, 23 nt, Human
uggcaccucuggaguacccagca

SEQ ID NO: 296773 - RNA, 24 nt, Human
uggcaccucuggaguacccagcac

SEQ ID NO: 296774 - RNA, 18 nt, Human
uggcugccugggcugagc

SEQ ID NO: 296775 - RNA, 19 nt, Human
ugggaaggguccagccuag

SEQ ID NO: 296776 - RNA, 20 nt, Human
ugggaaggguccagccuagu

SEQ ID NO: 296777 - RNA, 20 nt, Human
ugggaaggguccagccuagu

SEQ ID NO: 296778 - RNA, 19 nt, Human
ugggauggaugggccugau

SEQ ID NO: 296779 - RNA, 20 nt, Human
ugggcugguuggggagaggc

SEQ ID NO: 296780 - RNA, 22 nt, Human
uggggaccugggcaguggccuu

SEQ ID NO: 296781 - RNA, 20 nt, Human
uggggaggagggaggcaugg

SEQ ID NO: 296782 - RNA, 21 nt, Human
uggggaggagggaggcauggg

SEQ ID NO: 296783 - RNA, 18 nt, Human
ugggugcagguaaggaga

SEQ ID NO: 296784 - RNA, 26 nt, Human
ugguagcaaaaugcccucccuaaauc

SEQ ID NO: 296785 - RNA, 21 nt, Human
ugguccccagggcguugggaa

SEQ ID NO: 296786 - RNA, 20 nt, Human
uggucccugcccuagcuccc

SEQ ID NO: 296787 - RNA, 23 nt, Human
ugguuuauggcuggaaucuggag

SEQ ID NO: 296788 - RNA, 18 nt, Human
uguaagggcaggucuggg

SEQ ID NO: 296789 - RNA, 23 nt, Human
ugucuacaguaaccccacuaccc

SEQ ID NO: 296790 - RNA, 19 nt, Human
uguggcaaaugguucuugg

SEQ ID NO: 296791 - RNA, 23 nt, Human
uguggcaaaugguucuugguguc

SEQ ID NO: 296792 - RNA, 20 nt, Human
uuauguagugggaagggucc

SEQ ID NO: 296793 - RNA, 20 nt, Human
uugauuuggaagauggagga

SEQ ID NO: 296794 - RNA, 21 nt, Human
uuguuucuguuucccaagggg

SEQ ID NO: 296795 - RNA, 21 nt, Human
uuguuugaggaggaggugggg

SEQ ID NO: 296796 - RNA, 21 nt, Human
uuuaaccaggcuauggccacu

SEQ ID NO: 296797 - RNA, 18 nt, Human
uuuucagaacuaggaggc

SEQ ID NO: 296798 - RNA, 21 nt, Human
aaaacacaacacgggccgccg

SEQ ID NO: 296799 - RNA, 24 nt, Human
aaaacagaagacugguccccaggg

SEQ ID NO: 296800 - RNA, 19 nt, Human
aaaagcacaccgcacuaca

SEQ ID NO: 296801 - RNA, 25 nt, Human
aaacaaaacagaagacuggucccca

SEQ ID NO: 296802 - RNA, 25 nt, Human
aaacaaaacagaagacuggucccca

SEQ ID NO: 296803 - RNA, 22 nt, Human
aaacaaugaaaaacaaaacaga

SEQ ID NO: 296804 - RNA, 18 nt, Human
aaaugcccucccuaaauc

SEQ ID NO: 296805 - RNA, 19 nt, Human
aacagaagacugguccccc

SEQ ID NO: 296806 - RNA, 19 nt, Human
aagaggaacuguuggagug

SEQ ID NO: 296807 - RNA, 23 nt, Human
aagcuggcugccugggcugagcc

SEQ ID NO: 296808 - RNA, 25 nt, Human
acaaaacacaacacgggccgccgcg

SEQ ID NO: 296809 - RNA, 22 nt, Human
acaaaacagaagacuggucccc

SEQ ID NO: 296810 - RNA, 18 nt, Human
acagagccuccuccaagg

SEQ ID NO: 296811 - RNA, 27 nt, Human
acagagccuccuccaaggccuugauaa

SEQ ID NO: 296812 - RNA, 22 nt, Human
acagcacaaaacacaacacggg

SEQ ID NO: 296813 - RNA, 21 nt, Human
accaugcuuugggggaagauu

SEQ ID NO: 296814 - RNA, 19 nt, Human
acucgggaaagaggaacug

SEQ ID NO: 296815 - RNA, 22 nt, Human
acugaaaugccaguuuaaucca

SEQ ID NO: 296816 - RNA, 20 nt, Human
agaaggucuaugcacaagga

SEQ ID NO: 296817 - RNA, 19 nt, Human
agaggaacuguuggagugg

SEQ ID NO: 296818 - RNA, 24 nt, Human
agcucagcccaaagcuggcugccu

SEQ ID NO: 296819 - RNA, 21 nt, Human
aggacauacagagccuccucc

SEQ ID NO: 296820 - RNA, 22 nt, Human
aggaggcuuguagguuacuugg

SEQ ID NO: 296821 - RNA, 20 nt, Human
aggagggaggcaugggaugg

SEQ ID NO: 296822 - RNA, 18 nt, Human
aggagggcaggggcccug

SEQ ID NO: 296823 - RNA, 19 nt, Human
aggaggugggggaagucaa

SEQ ID NO: 296824 - RNA, 18 nt, Human
agggggcgcacuggggac

SEQ ID NO: 296825 - RNA, 25 nt, Human
auacagagccuccuccaaccggagg

SEQ ID NO: 296826 - RNA, 21 nt, Human
caaaacagaagacuggucccc

SEQ ID NO: 296827 - RNA, 22 nt, Human
caacaccccaaccaccuuacuc

SEQ ID NO: 296828 - RNA, 20 nt, Human
caagaggucaugaugcccuu

SEQ ID NO: 296829 - RNA, 21 nt, Human
cacacuucccuuccuuaucuu

SEQ ID NO: 296830 - RNA, 21 nt, Human
caccccauacugucuuggaac

SEQ ID NO: 296831 - RNA, 20 nt, Human
caccgcacuacacuacuggc

SEQ ID NO: 296832 - RNA, 18 nt, Human
cacuggggaccugggcag

SEQ ID NO: 296833 - RNA, 25 nt, Human
cagagccuccuccaaggccuugaua

SEQ ID NO: 296834 - RNA, 22 nt, Human
caggagggcaggggcccuguug

SEQ ID NO: 296835 - RNA, 22 nt, Human
caggggcagaagggggugggag

SEQ ID NO: 296836 - RNA, 22 nt, Human
caguauucuggggguuagcccu

SEQ ID NO: 296837 - RNA, 21 nt, Human
cauacagagccuccuccaagg

SEQ ID NO: 296838 - RNA, 23 nt, Human
ccacacacuucccuuccuuaucu

SEQ ID NO: 296839 - RNA, 29 nt, Human
ccacccgccaucacguaaaagcacaccgg

SEQ ID NO: 296840 - RNA, 23 nt, Human
ccauacugucuuggaacaugcag

SEQ ID NO: 296841 - RNA, 26 nt, Human
ccauacugucuuggaacaugcagugg

SEQ ID NO: 296842 - RNA, 21 nt, Human
cccacagaggccccucugacc

SEQ ID NO: 296843 - RNA, 21 nt, Human
cccaccauccacauccacaca

SEQ ID NO: 296844 - RNA, 19 nt, Human
cccaggggcagaagggggu

SEQ ID NO: 296845 - RNA, 26 nt, Human
ccccaccauccacauccacacacuuc

SEQ ID NO: 296846 - RNA, 19 nt, Human
ccccacuacccccaugggu

SEQ ID NO: 296847 - RNA, 20 nt, Human
ccccacuacccccaugggua

SEQ ID NO: 296848 - RNA, 21 nt, Human
ccccacuacccccauggguac

SEQ ID NO: 296849 - RNA, 25 nt, Human
cccccugggggggaagggguaggug

SEQ ID NO: 296850 - RNA, 21 nt, Human
ccccugaggacauacagagcc

SEQ ID NO: 296851 - RNA, 18 nt, Human
ccccugggggggaagggg

SEQ ID NO: 296852 - RNA, 20 nt, Human
cccugaaacucugaggccug

SEQ ID NO: 296853 - RNA, 21 nt, Human
ccgccgcccgcugcccacccg

SEQ ID NO: 296854 - RNA, 19 nt, Human
ccuggcuggcccacccuuc

SEQ ID NO: 296855 - RNA, 22 nt, Human
ccuggcuggcccacccuuccug

SEQ ID NO: 296856 - RNA, 19 nt, Human
ccugggcugagacuuucug

SEQ ID NO: 296857 - RNA, 21 nt, Human
ccugggcugagcccuauuaug

SEQ ID NO: 296858 - RNA, 21 nt, Human
ccuguuagcucagcccaaagc

SEQ ID NO: 296859 - RNA, 24 nt, Human
cgcccgcugcccacccgccaucac

SEQ ID NO: 296860 - RNA, 22 nt, Human
cgcguggacacagcacaaaaca

SEQ ID NO: 296861 - RNA, 23 nt, Human
cggcugcgcggagcccgccgccc

SEQ ID NO: 296862 - RNA, 22 nt, Human
cuauucuacaccagccgaaaga

SEQ ID NO: 296863 - RNA, 22 nt, Human
cucagcccaaagcuggcugccu

SEQ ID NO: 296864 - RNA, 21 nt, Human
cucucaaggggaccugguccu

SEQ ID NO: 296865 - RNA, 23 nt, Human
cugaggccugggugcagguaagg

SEQ ID NO: 296866 - RNA, 18 nt, Human
cugccugggcugagcccu

SEQ ID NO: 296867 - RNA, 18 nt, Human
cuggcaaggugaaggacu

SEQ ID NO: 296868 - RNA, 22 nt, Human
cuuuaaccaggcuauggccacu

SEQ ID NO: 296869 - RNA, 18 nt, Human
gaaaaacaaaacagaaga

SEQ ID NO: 296870 - RNA, 18 nt, Human
gaagauggaggaguucag

SEQ ID NO: 296871 - RNA, 21 nt, Human
gacccaggggcagaagggggu

SEQ ID NO: 296872 - RNA, 21 nt, Human
gagcauggccuuggccccuac

SEQ ID NO: 296873 - RNA, 18 nt, Human
gaggagggaggcauggga

SEQ ID NO: 296874 - RNA, 20 nt, Human
gagugggguggggaggaggg

SEQ ID NO: 296875 - RNA, 20 nt, Human
gcaccuggcaaggugaagga

SEQ ID NO: 296876 - RNA, 21 nt, Human
gcccccaccauccacauccac

SEQ ID NO: 296877 - RNA, 18 nt, Human
gcccuguggcucuuggcc

SEQ ID NO: 296878 - RNA, 18 nt, Human
gcggagcccgccgcccgc

SEQ ID NO: 296879 - RNA, 19 nt, Human
gcguggacacagcacaaaa

SEQ ID NO: 296880 - RNA, 20 nt, Human
gcugcgcggagcccgccgcc

SEQ ID NO: 296881 - RNA, 20 nt, Human
ggacccaggggcagaagggg

SEQ ID NO: 296882 - RNA, 22 nt, Human
ggagaagucaguacgggggagg

SEQ ID NO: 296883 - RNA, 20 nt, Human
ggagggggcgcuacacuacu

SEQ ID NO: 296884 - RNA, 21 nt, Human
ggagugggguggggaggaggg

SEQ ID NO: 296885 - RNA, 22 nt, Human
ggagugggguggggaggaggga

SEQ ID NO: 296886 - RNA, 21 nt, Human
ggcaggucugggguucucugg

SEQ ID NO: 296887 - RNA, 19 nt, Human
ggcguugggaagaggcuug

SEQ ID NO: 296888 - RNA, 18 nt, Human
gggaaggguccagccuag

SEQ ID NO: 296889 - RNA, 19 nt, Human
gggaccugguccuaaaccu

SEQ ID NO: 296890 - RNA, 19 nt, Human
gggaggagggaggcauggg

SEQ ID NO: 296891 - RNA, 20 nt, Human
gggaggcaugggauggaugg

SEQ ID NO: 296892 - RNA, 21 nt, Human
gggcagaagggggugggagaa

SEQ ID NO: 296893 - RNA, 18 nt, Human
ggggaagggguaggugcu

SEQ ID NO: 296894 - RNA, 19 nt, Human
ggggagaggccgcccugug

SEQ ID NO: 296895 - RNA, 30 nt, Human; identical to SEQ ID NO: 294429

SEQ ID NO: 296896 - RNA, 24 nt, Human
ggggagggggucgccuuagcgcgu

SEQ ID NO: 296897 - RNA, 19 nt, Human
gggguggggaggagggagg

SEQ ID NO: 296898 - RNA, 20 nt, Human
gggguggggaggagggaggc

SEQ ID NO: 296899 - RNA, 21 nt, Human
guccaugcccccaccauccac

SEQ ID NO: 296900 - RNA, 23 nt, Human
gugaaggacugaggcuucaggag

SEQ ID NO: 296901 - RNA, 20 nt, Human
uacagagccuccuccaaggg

SEQ ID NO: 296902 - RNA, 21 nt, Human
uaccaguauucuggggguuag

SEQ ID NO: 296903 - RNA, 19 nt, Human
uagcccugaaacucugagg

SEQ ID NO: 296904 - RNA, 24 nt, Human
uaggagaagucaguacgggggagg

SEQ ID NO: 296905 - RNA, 25 nt, Human
uaucuuaccaccccauacugucuug

SEQ ID NO: 296906 - RNA, 19 nt, Human
uauguagugggaagggucc

SEQ ID NO: 296907 - RNA, 20 nt, Human
ucagcccaaagcuggcugcc

SEQ ID NO: 296908 - RNA, 18 nt, Human
ucaguccccugaggacau

SEQ ID NO: 296909 - RNA, 24 nt, Human
uccaaaacuugagcauugaucuug

SEQ ID NO: 296910 - RNA, 19 nt, Human
uccacauccacacacuucc

SEQ ID NO: 296911 - RNA, 22 nt, Human
uccaccaguggcaccucuggag

SEQ ID NO: 296912 - RNA, 19 nt, Human
ugaaaaacaaaacagaaga

SEQ ID NO: 296913 - RNA, 21 nt, Human
ugaaaaacaaaacagaagacu

SEQ ID NO: 296914 - RNA, 18 nt, Human
ugacccuuccaccagugg

SEQ ID NO: 296915 - RNA, 22 nt, Human
ugacccuuccaccaguggcacc

SEQ ID NO: 296916 - RNA, 24 nt, Human
ugcccuagcucccugccuccccaa

SEQ ID NO: 296917 - RNA, 19 nt, Human
ugccugggcugagcccuau

SEQ ID NO: 296918 - RNA, 23 nt, Human
ugccugggcugagcccuauuaug

SEQ ID NO: 296919 - RNA, 21 nt, Human
ugcuggggcuccgcuccgggg

SEQ ID NO: 296920 - RNA, 21 nt, Human
uggaaacgucaaacaaugaaa

SEQ ID NO: 296921 - RNA, 25 nt, Human
uggaaacgucaaacaaugaaaaaca

SEQ ID NO: 296922 - RNA, 18 nt, Human
uggaaggaggugaagggg

SEQ ID NO: 296923 - RNA, 21 nt, Human
uggaaggaggugaaggggcug

SEQ ID NO: 296924 - RNA, 22 nt, Human
uggaaggaggugaaggggcugg

SEQ ID NO: 296925 - RNA, 18 nt, Human
uggaaucuggaggauguu

SEQ ID NO: 296926 - RNA, 22 nt, Human
uggaaucuggaggauguuguca

SEQ ID NO: 296927 - RNA, 21 nt, Human
uggacacagcacaaaacacaa

SEQ ID NO: 296928 - RNA, 19 nt, Human
uggaggauguugucagucc

SEQ ID NO: 296929 - RNA, 21 nt, Human
uggagugggguggggaggagg

SEQ ID NO: 296930 - RNA, 23 nt, Human
uggauggccggggacccaggggc

SEQ ID NO: 296931 - RNA, 29 nt, Human
uggcaaaugguucuuggugucuacaguaa

SEQ ID NO: 296932 - RNA, 19 nt, Human
uggcaaggugaaggacuga

SEQ ID NO: 296933 - RNA, 21 nt, Human
uggcaaggugaaggacugagg

SEQ ID NO: 296934 - RNA, 23 nt, Human
uggcaccucuggaguacccagca

SEQ ID NO: 296935 - RNA, 24 nt, Human
uggcaccucuggaguacccagcac

SEQ ID NO: 296936 - RNA, 18 nt, Human
uggcugccugggcugagc

SEQ ID NO: 296937 - RNA, 21 nt, Human
uggcugccugggcugagcccu

SEQ ID NO: 296938 - RNA, 20 nt, Human
ugggaagaggcuugguagca

SEQ ID NO: 296939 - RNA, 19 nt, Human
ugggaaggguccagccuag

SEQ ID NO: 296940 - RNA, 19 nt, Human
ugggauggaugggccugau

SEQ ID NO: 296941 - RNA, 20 nt, Human
ugggcugguuggggagaggc

SEQ ID NO: 296942 - RNA, 22 nt, Human
uggggaccugggcaguggccuu

SEQ ID NO: 296943 - RNA, 20 nt, Human
uggggaggagggaggcaugg

SEQ ID NO: 296944 - RNA, 21 nt, Human
uggggaggagggaggcauggg

SEQ ID NO: 296945 - RNA, 18 nt, Human
ugggugcagguaaggaga

SEQ ID NO: 296946 - RNA, 26 nt, Human
ugguagcaaaaugcccucccuaaauc

SEQ ID NO: 296947 - RNA, 21 nt, Human
ugguccccagggcguugggaa

SEQ ID NO: 296948 - RNA, 20 nt, Human
uggucccugcccuagcuccc

SEQ ID NO: 296949 - RNA, 23 nt, Human
ugguuuauggcuggaaucuggag

SEQ ID NO: 296950 - RNA, 18 nt, Human
uguaagggcaggucuggg

SEQ ID NO: 296951 - RNA, 23 nt, Human
ugucuacaguaaccccacuaccc

SEQ ID NO: 296952 - RNA, 19 nt, Human
uguggcaaaugguucuugg

SEQ ID NO: 296953 - RNA, 23 nt, Human
uguggcaaaugguucuugguguc

SEQ ID NO: 296954 - RNA, 20 nt, Human
uugauuuggaagauggagga

SEQ ID NO: 296955 - RNA, 19 nt, Human
uuggaagauggaggaguuc

SEQ ID NO: 296956 - RNA, 21 nt, Human
uuguuucuguuucccaagggg

SEQ ID NO: 296957 - RNA, 21 nt, Human
uuguuugaggaggaggugggg

SEQ ID NO: 296958 - RNA, 18 nt, Human
uuuucagaacuaggaggc

SEQ ID NO: 296959 - RNA, 21 nt, Human
aaaacacaacacgggccgccg

SEQ ID NO: 296960 - RNA, 24 nt, Human
aaaacagaagacugguccccaggg

SEQ ID NO: 296961 - RNA, 19 nt, Human
aaaagcacaccgcacuaca

SEQ ID NO: 296962 - RNA, 25 nt, Human
aaacaaaacagaagacuggucccca

SEQ ID NO: 296963 - RNA, 25 nt, Human
aaacaaaacagaagacuggucccca

SEQ ID NO: 296964 - RNA, 20 nt, Human
aaaugcccucccuaaauccc

SEQ ID NO: 296965 - RNA, 19 nt, Human
aacagaagacugguccccc

SEQ ID NO: 296966 - RNA, 23 nt, Human
aagcuggcugccugggcugagcc

SEQ ID NO: 296967 - RNA, 25 nt, Human
acaaaacacaacacgggccgccgcg

SEQ ID NO: 296968 - RNA, 22 nt, Human
acaaaacagaagacuggucccc

SEQ ID NO: 296969 - RNA, 18 nt, Human
acagagccuccuccaagg

SEQ ID NO: 296970 - RNA, 27 nt, Human
acagagccuccuccaaggccuugauaa

SEQ ID NO: 296971 - RNA, 22 nt, Human
acagcacaaaacacaacacggg

SEQ ID NO: 296972 - RNA, 21 nt, Human
accaugcuuugggggaagauu

SEQ ID NO: 296973 - RNA, 20 nt, Human
accccauacugucuuggaac

SEQ ID NO: 296974 - RNA, 19 nt, Human
acucgggaaagaggaacug

SEQ ID NO: 296975 - RNA, 22 nt, Human
acugaaaugccaguuuaaucca

SEQ ID NO: 296976 - RNA, 20 nt, Human
agaaggucuaugcacaagga

SEQ ID NO: 296977 - RNA, 19 nt, Human
agaggaacuguuggagugg

SEQ ID NO: 296978 - RNA, 24 nt, Human
agcucagcccaaagcuggcugccu

SEQ ID NO: 296979 - RNA, 21 nt, Human
aggacauacagagccuccucc

SEQ ID NO: 296980 - RNA, 22 nt, Human
aggaggcuuguagguuacuugg

SEQ ID NO: 296981 - RNA, 20 nt, Human
aggagggaggcaugggaugg

SEQ ID NO: 296982 - RNA, 18 nt, Human
aggagggcaggggcccug

SEQ ID NO: 296983 - RNA, 19 nt, Human
aggaggugggggaagucaa

SEQ ID NO: 296984 - RNA, 18 nt, Human
agggggcgcacuggggac

SEQ ID NO: 296985 - RNA, 25 nt, Human
auacagagccuccuccaaccggagg

SEQ ID NO: 296986 - RNA, 21 nt, Human
caaaacagaagacuggucccc

SEQ ID NO: 296987 - RNA, 23 nt, Human
caaacaaugaaaaacaaaacaga

SEQ ID NO: 296988 - RNA, 22 nt, Human
caacaccccaaccaccuuacuc

SEQ ID NO: 296989 - RNA, 20 nt, Human
caagaggucaugaugcccuu

SEQ ID NO: 296990 - RNA, 21 nt, Human
cacacuucccuuccuuaucuu

SEQ ID NO: 296991 - RNA, 20 nt, Human
caccgcacuacacuacuggc

SEQ ID NO: 296992 - RNA, 18 nt, Human
cacuggggaccugggcag

SEQ ID NO: 296993 - RNA, 25 nt, Human
cagagccuccuccaaggccuugaua

SEQ ID NO: 296994 - RNA, 20 nt, Human
cagcccaaagcuggcugccu

SEQ ID NO: 296995 - RNA, 22 nt, Human
caggagggcaggggcccuguug

SEQ ID NO: 296996 - RNA, 22 nt, Human
caggggcagaagggggugggag

SEQ ID NO: 296997 - RNA, 22 nt, Human
caguauucuggggguuagcccu

SEQ ID NO: 296998 - RNA, 21 nt, Human
cauacagagccuccuccaagg

SEQ ID NO: 296999 - RNA, 23 nt, Human
ccacacacuucccuuccuuaucu

SEQ ID NO: 297000 - RNA, 29 nt, Human
ccacccgccaucacguaaaagcacaccgg

SEQ ID NO: 297001 - RNA, 23 nt, Human
ccauacugucuuggaacaugcag

SEQ ID NO: 297002 - RNA, 26 nt, Human
ccauacugucuuggaacaugcagugg

SEQ ID NO: 297003 - RNA, 21 nt, Human
cccacagaggccccucugacc

SEQ ID NO: 297004 - RNA, 21 nt, Human
cccaccauccacauccacaca

SEQ ID NO: 297005 - RNA, 18 nt, Human
ccccacuacccccauggg

SEQ ID NO: 297006 - RNA, 20 nt, Human
ccccacuacccccaugggua

SEQ ID NO: 297007 - RNA, 21 nt, Human
ccccacuacccccauggguac

SEQ ID NO: 297008 - RNA, 27 nt, Human
cccccaccauccacauccacacacuuc

SEQ ID NO: 297009 - RNA, 25 nt, Human
cccccugggggggaagggguaggug

SEQ ID NO: 297010 - RNA, 21 nt, Human
ccccugaggacauacagagcc

SEQ ID NO: 297011 - RNA, 21 nt, Human
ccgccgcccgcugcccacccg

SEQ ID NO: 297012 - RNA, 19 nt, Human
ccuggcuggcccacccuuc

SEQ ID NO: 297013 - RNA, 22 nt, Human
ccuggcuggcccacccuuccug

SEQ ID NO: 297014 - RNA, 19 nt, Human
ccugggcugagacuuucug

SEQ ID NO: 297015 - RNA, 21 nt, Human
ccuguuagcucagcccaaagc

SEQ ID NO: 297016 - RNA, 24 nt, Human
cgcccgcugcccacccgccaucac

SEQ ID NO: 297017 - RNA, 19 nt, Human
cgcccuguggcucuuggcc

SEQ ID NO: 297018 - RNA, 22 nt, Human
cgcguggacacagcacaaaaca

SEQ ID NO: 297019 - RNA, 22 nt, Human
cggcaccuggcaaggugaagga

SEQ ID NO: 297020 - RNA, 23 nt, Human
cggcugcgcggagcccgccgccc

SEQ ID NO: 297021 - RNA, 22 nt, Human
cuauucuacaccagccgaaaga

SEQ ID NO: 297022 - RNA, 21 nt, Human
cucucaaggggaccugguccu

SEQ ID NO: 297023 - RNA, 18 nt, Human
cugccugggcugagcccu

SEQ ID NO: 297024 - RNA, 18 nt, Human
cuggcaaggugaaggacu

SEQ ID NO: 297025 - RNA, 22 nt, Human
cuuuaaccaggcuauggccacu

SEQ ID NO: 297026 - RNA, 18 nt, Human
gaaaaacaaaacagaaga

SEQ ID NO: 297027 - RNA, 18 nt, Human
gaagauggaggaguucag

SEQ ID NO: 297028 - RNA, 21 nt, Human
gacccaggggcagaagggggu

SEQ ID NO: 297029 - RNA, 21 nt, Human
gagcauggccuuggccccuac

SEQ ID NO: 297030 - RNA, 18 nt, Human
gaggagggaggcauggga

SEQ ID NO: 297031 - RNA, 21 nt, Human
gaggccugggugcagguaagg

SEQ ID NO: 297032 - RNA, 20 nt, Human
gagugggguggggaggaggg

SEQ ID NO: 297033 - RNA, 21 nt, Human
gcccccaccauccacauccac

SEQ ID NO: 297034 - RNA, 18 nt, Human
gcccuguggcucuuggcc

SEQ ID NO: 297035 - RNA, 18 nt, Human
gcggagcccgccgcccgc

SEQ ID NO: 297036 - RNA, 19 nt, Human
gcguggacacagcacaaaa

SEQ ID NO: 297037 - RNA, 20 nt, Human
gcugcgcggagcccgccgcc

SEQ ID NO: 297038 - RNA, 20 nt, Human
ggacccaggggcagaagggg

SEQ ID NO: 297039 - RNA, 22 nt, Human
ggagaagucaguacgggggagg

SEQ ID NO: 297040 - RNA, 20 nt, Human
ggagggggcgcuacacuacu

SEQ ID NO: 297041 - RNA, 21 nt, Human
ggagugggguggggaggaggg

SEQ ID NO: 297042 - RNA, 22 nt, Human
ggagugggguggggaggaggga

SEQ ID NO: 297043 - RNA, 21 nt, Human
ggcaggucugggguucucugg

SEQ ID NO: 297044 - RNA, 19 nt, Human
ggcguugggaagaggcuug

SEQ ID NO: 297045 - RNA, 19 nt, Human
gggaccugguccuaaaccu

SEQ ID NO: 297046 - RNA, 19 nt, Human
gggaggagggaggcauggg

SEQ ID NO: 297047 - RNA, 20 nt, Human
gggaggcaugggauggaugg

SEQ ID NO: 297048 - RNA, 21 nt, Human
gggcagaagggggugggagaa

SEQ ID NO: 297049 - RNA, 18 nt, Human
ggggaagggguaggugcu

SEQ ID NO: 297050 - RNA, 30 nt, Human; identical to SEQ ID NO: 294429

SEQ ID NO: 297051 - RNA, 24 nt, Human
ggggagggggucgccuuagcgcgu

SEQ ID NO: 297052 - RNA, 27 nt, Human
ggggcagaagggggugggagaagaagg

SEQ ID NO: 297053 - RNA, 19 nt, Human
gggguggggaggagggagg

SEQ ID NO: 297054 - RNA, 20 nt, Human
gggguggggaggagggaggc

SEQ ID NO: 297055 - RNA, 23 nt, Human
gugaaggacugaggcuucaggag

SEQ ID NO: 297056 - RNA, 20 nt, Human
uacagagccuccuccaaggg

SEQ ID NO: 297057 - RNA, 21 nt, Human
uaccaguauucuggggguuag

SEQ ID NO: 297058 - RNA, 18 nt, Human
uacucgggaaagaggaac

SEQ ID NO: 297059 - RNA, 19 nt, Human
uagcccugaaacucugagg

SEQ ID NO: 297060 - RNA, 23 nt, Human
uagcccugaaacucugaggccug

SEQ ID NO: 297061 - RNA, 24 nt, Human
uaggagaagucaguacgggggagg

SEQ ID NO: 297062 - RNA, 25 nt, Human
uaucuuaccaccccauacugucuug

SEQ ID NO: 297063 - RNA, 20 nt, Human
ucagcccaaagcuggcugcc

SEQ ID NO: 297064 - RNA, 18 nt, Human
ucaguccccugaggacau

SEQ ID NO: 297065 - RNA, 24 nt, Human
uccaaaacuugagcauugaucuug

SEQ ID NO: 297066 - RNA, 19 nt, Human
uccacauccacacacuucc

SEQ ID NO: 297067 - RNA, 22 nt, Human
uccaccaguggcaccucuggag

SEQ ID NO: 297068 - RNA, 20 nt, Human
uccaugcccccaccauccac

SEQ ID NO: 297069 - RNA, 21 nt, Human
ugaaaaacaaaacagaagacu

SEQ ID NO: 297070 - RNA, 18 nt, Human
ugacccuuccaccagugg

SEQ ID NO: 297071 - RNA, 22 nt, Human
ugacccuuccaccaguggcacc

SEQ ID NO: 297072 - RNA, 24 nt, Human
ugcccuagcucccugccuccccaa

SEQ ID NO: 297073 - RNA, 23 nt, Human
ugccugggcugagcccuauuaug

SEQ ID NO: 297074 - RNA, 22 nt, Human
ugcuggggcuccgcuccggggg

SEQ ID NO: 297075 - RNA, 21 nt, Human
uggaaacgucaaacaaugaaa

SEQ ID NO: 297076 - RNA, 25 nt, Human
uggaaacgucaaacaaugaaaaaca

SEQ ID NO: 297077 - RNA, 18 nt, Human
uggaaggaggugaagggg

SEQ ID NO: 297078 - RNA, 21 nt, Human
uggaaggaggugaaggggcug

SEQ ID NO: 297079 - RNA, 22 nt, Human
uggaaggaggugaaggggcugg

SEQ ID NO: 297080 - RNA, 18 nt, Human
uggaaucuggaggauguu

SEQ ID NO: 297081 - RNA, 22 nt, Human
uggaaucuggaggauguuguca

SEQ ID NO: 297082 - RNA, 21 nt, Human
uggacacagcacaaaacacaa

SEQ ID NO: 297083 - RNA, 19 nt, Human
uggaggauguugucagucc

SEQ ID NO: 297084 - RNA, 21 nt, Human
uggagugggguggggaggagg

SEQ ID NO: 297085 - RNA, 23 nt, Human
uggauggccggggacccaggggc

SEQ ID NO: 297086 - RNA, 29 nt, Human
uggcaaaugguucuuggugucuacaguaa

SEQ ID NO: 297087 - RNA, 19 nt, Human
uggcaaggugaaggacuga

SEQ ID NO: 297088 - RNA, 21 nt, Human
uggcaaggugaaggacugagg

SEQ ID NO: 297089 - RNA, 23 nt, Human
uggcaccucuggaguacccagca

SEQ ID NO: 297090 - RNA, 24 nt, Human
uggcaccucuggaguacccagcac

SEQ ID NO: 297091 - RNA, 18 nt, Human
uggcugccugggcugagc

SEQ ID NO: 297092 - RNA, 21 nt, Human
uggcugccugggcugagcccu

SEQ ID NO: 297093 - RNA, 19 nt, Human
ugggaaggguccagccuag

SEQ ID NO: 297094 - RNA, 20 nt, Human
ugggaaggguccagccuagu

SEQ ID NO: 297095 - RNA, 19 nt, Human
ugggauggaugggccugau

SEQ ID NO: 297096 - RNA, 20 nt, Human
ugggcugguuggggagaggc

SEQ ID NO: 297097 - RNA, 22 nt, Human
uggggaccugggcaguggccuu

SEQ ID NO: 297098 - RNA, 20 nt, Human
uggggaggagggaggcaugg

SEQ ID NO: 297099 - RNA, 21 nt, Human
uggggaggagggaggcauggg

SEQ ID NO: 297100 - RNA, 18 nt, Human
ugggugcagguaaggaga

SEQ ID NO: 297101 - RNA, 26 nt, Human
ugguagcaaaaugcccucccuaaauc

SEQ ID NO: 297102 - RNA, 21 nt, Human
ugguccccagggcguugggaa

SEQ ID NO: 297103 - RNA, 20 nt, Human
uggucccugcccuagcuccc

SEQ ID NO: 297104 - RNA, 23 nt, Human
ugguuuauggcuggaaucuggag

SEQ ID NO: 297105 - RNA, 18 nt, Human
uguaagggcaggucuggg

SEQ ID NO: 297106 - RNA, 23 nt, Human
ugucuacaguaaccccacuaccc

SEQ ID NO: 297107 - RNA, 19 nt, Human
uguggcaaaugguucuugg

SEQ ID NO: 297108 - RNA, 23 nt, Human
uguggcaaaugguucuugguguc

SEQ ID NO: 297109 - RNA, 20 nt, Human
uuauguagugggaagggucc

SEQ ID NO: 297110 - RNA, 20 nt, Human
uugauuuggaagauggagga

SEQ ID NO: 297111 - RNA, 19 nt, Human
uuggaagauggaggaguuc

SEQ ID NO: 297112 - RNA, 21 nt, Human
uuguuucuguuucccaagggg

SEQ ID NO: 297113 - RNA, 21 nt, Human
uuguuugaggaggaggugggg

SEQ ID NO: 297114 - RNA, 18 nt, Human
uuuucagaacuaggaggc

SEQ ID NO: 297115 - RNA, 21 nt, Human
aaaacacaacacgggccgccg

SEQ ID NO: 297116 - RNA, 19 nt, Human
aaaagcacaccgcacuaca

SEQ ID NO: 297117 - RNA, 25 nt, Human
aaacaaaacagaagacuggucccca

SEQ ID NO: 297118 - RNA, 25 nt, Human
aaacaaaacagaagacuggucccca

SEQ ID NO: 297119 - RNA, 23 nt, Human
aaacagaagacugguccccaggg

SEQ ID NO: 297120 - RNA, 20 nt, Human
aaaugcccucccuaaauccc

SEQ ID NO: 297121 - RNA, 19 nt, Human
aacagaagacugguccccc

SEQ ID NO: 297122 - RNA, 19 nt, Human
aagaggucaugaugcccuu

SEQ ID NO: 297123 - RNA, 25 nt, Human
acaaaacacaacacgggccgccgcg

SEQ ID NO: 297124 - RNA, 22 nt, Human
acaaaacagaagacuggucccc

SEQ ID NO: 297125 - RNA, 18 nt, Human
acagagccuccuccaagg

SEQ ID NO: 297126 - RNA, 27 nt, Human
acagagccuccuccaaggccuugauaa

SEQ ID NO: 297127 - RNA, 22 nt, Human
acagcacaaaacacaacacggg

SEQ ID NO: 297128 - RNA, 21 nt, Human
accaugcuuugggggaagauu

SEQ ID NO: 297129 - RNA, 20 nt, Human
accccauacugucuuggaac

SEQ ID NO: 297130 - RNA, 19 nt, Human
acucgggaaagaggaacug

SEQ ID NO: 297131 - RNA, 22 nt, Human
acugaaaugccaguuuaaucca

SEQ ID NO: 297132 - RNA, 20 nt, Human
agaaggucuaugcacaagga

SEQ ID NO: 297133 - RNA, 19 nt, Human
agaggaacuguuggagugg

SEQ ID NO: 297134 - RNA, 24 nt, Human
agcucagcccaaagcuggcugccu

SEQ ID NO: 297135 - RNA, 21 nt, Human
aggacauacagagccuccucc

SEQ ID NO: 297136 - RNA, 22 nt, Human
aggaggcuuguagguuacuugg

SEQ ID NO: 297137 - RNA, 20 nt, Human
aggagggaggcaugggaugg

SEQ ID NO: 297138 - RNA, 18 nt, Human
aggagggcaggggcccug

SEQ ID NO: 297139 - RNA, 19 nt, Human
aggaggugggggaagucaa

SEQ ID NO: 297140 - RNA, 18 nt, Human
agggggcgcacuggggac

SEQ ID NO: 297141 - RNA, 25 nt, Human
auacagagccuccuccaaccggagg

SEQ ID NO: 297142 - RNA, 20 nt, Human
auucuacaccagccgaaaga

SEQ ID NO: 297143 - RNA, 21 nt, Human
caaaacagaagacuggucccc

SEQ ID NO: 297144 - RNA, 23 nt, Human
caaacaaugaaaaacaaaacaga

SEQ ID NO: 297145 - RNA, 22 nt, Human
caacaccccaaccaccuuacuc

SEQ ID NO: 297146 - RNA, 21 nt, Human
cacacuucccuuccuuaucuu

SEQ ID NO: 297147 - RNA, 20 nt, Human
caccgcacuacacuacuggc

SEQ ID NO: 297148 - RNA, 18 nt, Human
cacuggggaccugggcag

SEQ ID NO: 297149 - RNA, 25 nt, Human
cagagccuccuccaaggccuugaua

SEQ ID NO: 297150 - RNA, 22 nt, Human
caggagggcaggggcccuguug

SEQ ID NO: 297151 - RNA, 22 nt, Human
caggggcagaagggggugggag

SEQ ID NO: 297152 - RNA, 22 nt, Human
caguauucuggggguuagcccu

SEQ ID NO: 297153 - RNA, 21 nt, Human
cauacagagccuccuccaagg

SEQ ID NO: 297154 - RNA, 29 nt, Human
ccacccgccaucacguaaaagcacaccgg

SEQ ID NO: 297155 - RNA, 23 nt, Human
ccauacugucuuggaacaugcag

SEQ ID NO: 297156 - RNA, 26 nt, Human
ccauacugucuuggaacaugcagugg

SEQ ID NO: 297157 - RNA, 21 nt, Human
cccacagaggccccucugacc

SEQ ID NO: 297158 - RNA, 21 nt, Human
cccaccauccacauccacaca

SEQ ID NO: 297159 - RNA, 19 nt, Human
ccccacuacccccaugggu

SEQ ID NO: 297160 - RNA, 20 nt, Human
ccccacuacccccaugggua

SEQ ID NO: 297161 - RNA, 21 nt, Human
ccccacuacccccauggguac

SEQ ID NO: 297162 - RNA, 27 nt, Human
cccccaccauccacauccacacacuuc

SEQ ID NO: 297163 - RNA, 25 nt, Human
cccccugggggggaagggguaggug

SEQ ID NO: 297164 - RNA, 21 nt, Human
ccccugaggacauacagagcc

SEQ ID NO: 297165 - RNA, 20 nt, Human
cccugaaacucugaggccug

SEQ ID NO: 297166 - RNA, 21 nt, Human
ccgccgcccgcugcccacccg

SEQ ID NO: 297167 - RNA, 22 nt, Human
ccucucaaggggaccugguccu

SEQ ID NO: 297168 - RNA, 19 nt, Human
ccuggcuggcccacccuuc

SEQ ID NO: 297169 - RNA, 22 nt, Human
ccuggcuggcccacccuuccug

SEQ ID NO: 297170 - RNA, 19 nt, Human
ccugggcugagacuuucug

SEQ ID NO: 297171 - RNA, 21 nt, Human
ccuguuagcucagcccaaagc

SEQ ID NO: 297172 - RNA, 24 nt, Human
cgcccgcugcccacccgccaucac

SEQ ID NO: 297173 - RNA, 22 nt, Human
cgcguggacacagcacaaaaca

SEQ ID NO: 297174 - RNA, 22 nt, Human
cggcaccuggcaaggugaagga

SEQ ID NO: 297175 - RNA, 23 nt, Human
cggcugcgcggagcccgccgccc

SEQ ID NO: 297176 - RNA, 22 nt, Human
cucagcccaaagcuggcugccu

SEQ ID NO: 297177 - RNA, 23 nt, Human
cugaggccugggugcagguaagg

SEQ ID NO: 297178 - RNA, 18 nt, Human
cugccugggcugagcccu

SEQ ID NO: 297179 - RNA, 18 nt, Human
cuggcaaggugaaggacu

SEQ ID NO: 297180 - RNA, 22 nt, Human
cuuguuugaggaggaggugggg

SEQ ID NO: 297181 - RNA, 22 nt, Human
cuuuaaccaggcuauggccacu

SEQ ID NO: 297182 - RNA, 18 nt, Human
gaaaaacaaaacagaaga

SEQ ID NO: 297183 - RNA, 18 nt, Human
gaagauggaggaguucag

SEQ ID NO: 297184 - RNA, 21 nt, Human
gacccaggggcagaagggggu

SEQ ID NO: 297185 - RNA, 21 nt, Human
gagcauggccuuggccccuac

SEQ ID NO: 297186 - RNA, 20 nt, Human
gagugggguggggaggaggg

SEQ ID NO: 297187 - RNA, 21 nt, Human
gcccccaccauccacauccac

SEQ ID NO: 297188 - RNA, 18 nt, Human
gcccuguggcucuuggcc

SEQ ID NO: 297189 - RNA, 18 nt, Human
gcggagcccgccgcccgc

SEQ ID NO: 297190 - RNA, 19 nt, Human
gcguggacacagcacaaaa

SEQ ID NO: 297191 - RNA, 19 nt, Human
gcugccugggcugagcccu

SEQ ID NO: 297192 - RNA, 20 nt, Human
gcugcgcggagcccgccgcc

SEQ ID NO: 297193 - RNA, 20 nt, Human
ggacccaggggcagaagggg

SEQ ID NO: 297194 - RNA, 22 nt, Human
ggagaagucaguacgggggagg

SEQ ID NO: 297195 - RNA, 19 nt, Human
ggaggagggaggcauggga

SEQ ID NO: 297196 - RNA, 20 nt, Human
ggagggggcgcuacacuacu

SEQ ID NO: 297197 - RNA, 21 nt, Human
ggagugggguggggaggaggg

SEQ ID NO: 297198 - RNA, 22 nt, Human
ggagugggguggggaggaggga

SEQ ID NO: 297199 - RNA, 21 nt, Human
ggcaggucugggguucucugg

SEQ ID NO: 297200 - RNA, 19 nt, Human
ggcguugggaagaggcuug

SEQ ID NO: 297201 - RNA, 19 nt, Human
gggaccugguccuaaaccu

SEQ ID NO: 297202 - RNA, 19 nt, Human
gggaggagggaggcauggg

SEQ ID NO: 297203 - RNA, 20 nt, Human
gggaggcaugggauggaugg

SEQ ID NO: 297204 - RNA, 21 nt, Human
gggcagaagggggugggagaa

SEQ ID NO: 297205 - RNA, 19 nt, Human
gggcguugggaagaggcuu

SEQ ID NO: 297206 - RNA, 18 nt, Human
ggggaagggguaggugcu

SEQ ID NO: 297207 - RNA, 30 nt, Human; identical to SEQ ID NO: 294429

SEQ ID NO: 297208 - RNA, 24 nt, Human
ggggagggggucgccuuagcgcgu

SEQ ID NO: 297209 - RNA, 27 nt, Human
ggggcagaagggggugggagaagaagg

SEQ ID NO: 297210 - RNA, 19 nt, Human
gggguggggaggagggagg

SEQ ID NO: 297211 - RNA, 20 nt, Human
gggguggggaggagggaggc

SEQ ID NO: 297212 - RNA, 21 nt, Human
guccaugcccccaccauccac

SEQ ID NO: 297213 - RNA, 23 nt, Human
gugaaggacugaggcuucaggag

SEQ ID NO: 297214 - RNA, 21 nt, Human
guuuauggcuggaaucuggag

SEQ ID NO: 297215 - RNA, 20 nt, Human
uacagagccuccuccaaggg

SEQ ID NO: 297216 - RNA, 21 nt, Human
uaccaguauucuggggguuag

SEQ ID NO: 297217 - RNA, 18 nt, Human
uacucgggaaagaggaac

SEQ ID NO: 297218 - RNA, 19 nt, Human
uagcccugaaacucugagg

SEQ ID NO: 297219 - RNA, 24 nt, Human
uaggagaagucaguacgggggagg

SEQ ID NO: 297220 - RNA, 25 nt, Human
uaucuuaccaccccauacugucuug

SEQ ID NO: 297221 - RNA, 20 nt, Human
ucagcccaaagcuggcugcc

SEQ ID NO: 297222 - RNA, 18 nt, Human
ucaguccccugaggacau

SEQ ID NO: 297223 - RNA, 24 nt, Human
uccaaaacuugagcauugaucuug

SEQ ID NO: 297224 - RNA, 26 nt, Human
uccacacacuucccuuccuuaucuua

SEQ ID NO: 297225 - RNA, 19 nt, Human
uccacauccacacacuucc

SEQ ID NO: 297226 - RNA, 22 nt, Human
uccaccaguggcaccucuggag

SEQ ID NO: 297227 - RNA, 21 nt, Human
ugaaaaacaaaacagaagacu

SEQ ID NO: 297228 - RNA, 18 nt, Human
ugacccuuccaccagugg

SEQ ID NO: 297229 - RNA, 22 nt, Human
ugacccuuccaccaguggcacc

SEQ ID NO: 297230 - RNA, 24 nt, Human
ugcccuagcucccugccuccccaa

SEQ ID NO: 297231 - RNA, 19 nt, Human
ugccugggcugagcccuau

SEQ ID NO: 297232 - RNA, 23 nt, Human
ugccugggcugagcccuauuaug

SEQ ID NO: 297233 - RNA, 21 nt, Human
ugcuggggcuccgcuccgggg

SEQ ID NO: 297234 - RNA, 21 nt, Human
uggaaacgucaaacaaugaaa

SEQ ID NO: 297235 - RNA, 25 nt, Human
uggaaacgucaaacaaugaaaaaca

SEQ ID NO: 297236 - RNA, 18 nt, Human
uggaaggaggugaagggg

SEQ ID NO: 297237 - RNA, 21 nt, Human
uggaaggaggugaaggggcug

SEQ ID NO: 297238 - RNA, 22 nt, Human
uggaaggaggugaaggggcugg

SEQ ID NO: 297239 - RNA, 18 nt, Human
uggaaucuggaggauguu

SEQ ID NO: 297240 - RNA, 22 nt, Human
uggaaucuggaggauguuguca

SEQ ID NO: 297241 - RNA, 21 nt, Human
uggacacagcacaaaacacaa

SEQ ID NO: 297242 - RNA, 19 nt, Human
uggaggauguugucagucc

SEQ ID NO: 297243 - RNA, 21 nt, Human
uggagugggguggggaggagg

SEQ ID NO: 297244 - RNA, 23 nt, Human
uggauggccggggacccaggggc

SEQ ID NO: 297245 - RNA, 29 nt, Human
uggcaaaugguucuuggugucuacaguaa

SEQ ID NO: 297246 - RNA, 19 nt, Human
uggcaaggugaaggacuga

SEQ ID NO: 297247 - RNA, 21 nt, Human
uggcaaggugaaggacugagg

SEQ ID NO: 297248 - RNA, 23 nt, Human
uggcaccucuggaguacccagca

SEQ ID NO: 297249 - RNA, 24 nt, Human
uggcaccucuggaguacccagcac

SEQ ID NO: 297250 - RNA, 18 nt, Human
uggcugccugggcugagc

SEQ ID NO: 297251 - RNA, 19 nt, Human
ugggaaggguccagccuag

SEQ ID NO: 297252 - RNA, 20 nt, Human
ugggaaggguccagccuagu

SEQ ID NO: 297253 - RNA, 20 nt, Human
ugggaaggguccagccuagu

SEQ ID NO: 297254 - RNA, 19 nt, Human
ugggauggaugggccugau

SEQ ID NO: 297255 - RNA, 20 nt, Human
ugggcugguuggggagaggc

SEQ ID NO: 297256 - RNA, 22 nt, Human
uggggaccugggcaguggccuu

SEQ ID NO: 297257 - RNA, 20 nt, Human
uggggaggagggaggcaugg

SEQ ID NO: 297258 - RNA, 21 nt, Human
uggggaggagggaggcauggg

SEQ ID NO: 297259 - RNA, 18 nt, Human
ugggugcagguaaggaga

SEQ ID NO: 297260 - RNA, 26 nt, Human
ugguagcaaaaugcccucccuaaauc

SEQ ID NO: 297261 - RNA, 21 nt, Human
ugguccccagggcguugggaa

SEQ ID NO: 297262 - RNA, 20 nt, Human
uggucccugcccuagcuccc

SEQ ID NO: 297263 - RNA, 18 nt, Human
uguaagggcaggucuggg

SEQ ID NO: 297264 - RNA, 23 nt, Human
ugucuacaguaaccccacuaccc

SEQ ID NO: 297265 - RNA, 19 nt, Human
uguggcaaaugguucuugg

SEQ ID NO: 297266 - RNA, 23 nt, Human
uguggcaaaugguucuugguguc

SEQ ID NO: 297267 - RNA, 20 nt, Human
uuauguagugggaagggucc

SEQ ID NO: 297268 - RNA, 20 nt, Human
uugauuuggaagauggagga

SEQ ID NO: 297269 - RNA, 21 nt, Human
uuguuucuguuucccaagggg

SEQ ID NO: 297270 - RNA, 18 nt, Human
uuuucagaacuaggaggc

SEQ ID NO: 297271 - RNA, 21 nt, Human
aaaacacaacacgggccgccg

SEQ ID NO: 297272 - RNA, 24 nt, Human
aaaacagaagacugguccccaggg

SEQ ID NO: 297273 - RNA, 19 nt, Human
aaaagcacaccgcacuaca

SEQ ID NO: 297274 - RNA, 24 nt, Human
aaacaaaacagaagacuggucccc

SEQ ID NO: 297275 - RNA, 25 nt, Human
aaacaaaacagaagacuggucccca

SEQ ID NO: 297276 - RNA, 21 nt, Human
aaagagcauucggcccaggac

SEQ ID NO: 297277 - RNA, 20 nt, Human
aaaugcccucccuaaauccc

SEQ ID NO: 297278 - RNA, 19 nt, Human
aacagaagacugguccccc

SEQ ID NO: 297279 - RNA, 19 nt, Human
aagaggucaugaugcccuu

SEQ ID NO: 297280 - RNA, 23 nt, Human
aagcuggcugccugggcugagcc

SEQ ID NO: 297281 - RNA, 25 nt, Human
acaaaacacaacacgggccgccgcg

SEQ ID NO: 297282 - RNA, 22 nt, Human
acaaaacagaagacuggucccc

SEQ ID NO: 297283 - RNA, 18 nt, Human
acagagccuccuccaagg

SEQ ID NO: 297284 - RNA, 27 nt, Human
acagagccuccuccaaggccuugauaa

SEQ ID NO: 297285 - RNA, 22 nt, Human
acagcacaaaacacaacacggg

SEQ ID NO: 297286 - RNA, 21 nt, Human
accaugcuuugggggaagauu

SEQ ID NO: 297287 - RNA, 19 nt, Human
acucgggaaagaggaacug

SEQ ID NO: 297288 - RNA, 22 nt, Human
acugaaaugccaguuuaaucca

SEQ ID NO: 297289 - RNA, 20 nt, Human
agaaggucuaugcacaagga

SEQ ID NO: 297290 - RNA, 19 nt, Human
agaggaacuguuggagugg

SEQ ID NO: 297291 - RNA, 24 nt, Human
agcucagcccaaagcuggcugccu

SEQ ID NO: 297292 - RNA, 21 nt, Human
aggacauacagagccuccucc

SEQ ID NO: 297293 - RNA, 22 nt, Human
aggaggcuuguagguuacuugg

SEQ ID NO: 297294 - RNA, 20 nt, Human
aggagggaggcaugggaugg

SEQ ID NO: 297295 - RNA, 18 nt, Human
aggagggcaggggcccug

SEQ ID NO: 297296 - RNA, 19 nt, Human
aggaggugggggaagucaa

SEQ ID NO: 297297 - RNA, 18 nt, Human
agggggcgcacuggggac

SEQ ID NO: 297298 - RNA, 25 nt, Human
auacagagccuccuccaaccggagg

SEQ ID NO: 297299 - RNA, 21 nt, Human
caaaacagaagacuggucccc

SEQ ID NO: 297300 - RNA, 23 nt, Human
caaacaaugaaaaacaaaacaga

SEQ ID NO: 297301 - RNA, 22 nt, Human
caacaccccaaccaccuuacuc

SEQ ID NO: 297302 - RNA, 21 nt, Human
cacacuucccuuccuuaucuu

SEQ ID NO: 297303 - RNA, 21 nt, Human
caccccauacugucuuggaac

SEQ ID NO: 297304 - RNA, 20 nt, Human
caccgcacuacacuacuggc

SEQ ID NO: 297305 - RNA, 18 nt, Human
cacuggggaccugggcag

SEQ ID NO: 297306 - RNA, 25 nt, Human
cagagccuccuccaaggccuugaua

SEQ ID NO: 297307 - RNA, 20 nt, Human
cagcccaaagcuggcugccu

SEQ ID NO: 297308 - RNA, 22 nt, Human
caggagggcaggggcccuguug

SEQ ID NO: 297309 - RNA, 22 nt, Human
caggggcagaagggggugggag

SEQ ID NO: 297310 - RNA, 22 nt, Human
caguauucuggggguuagcccu

SEQ ID NO: 297311 - RNA, 21 nt, Human
cauacagagccuccuccaagg

SEQ ID NO: 297312 - RNA, 23 nt, Human
ccacacacuucccuuccuuaucu

SEQ ID NO: 297313 - RNA, 23 nt, Human
ccauacugucuuggaacaugcag

SEQ ID NO: 297314 - RNA, 26 nt, Human
ccauacugucuuggaacaugcagugg

SEQ ID NO: 297315 - RNA, 21 nt, Human
cccacagaggccccucugacc

SEQ ID NO: 297316 - RNA, 21 nt, Human
cccaccauccacauccacaca

SEQ ID NO: 297317 - RNA, 30 nt, Human; identical to SEQ ID NO: 294382

SEQ ID NO: 297318 - RNA, 26 nt, Human
ccccaccauccacauccacacacuuc

SEQ ID NO: 297319 - RNA, 18 nt, Human
ccccacuacccccauggg

SEQ ID NO: 297320 - RNA, 20 nt, Human
ccccacuacccccaugggua

SEQ ID NO: 297321 - RNA, 21 nt, Human
ccccacuacccccauggguac

SEQ ID NO: 297322 - RNA, 23 nt, Human
cccccugggggggaagggguagg

SEQ ID NO: 297323 - RNA, 21 nt, Human
ccccugaggacauacagagcc

SEQ ID NO: 297324 - RNA, 18 nt, Human
ccccugggggggaagggg

SEQ ID NO: 297325 - RNA, 20 nt, Human
cccugaaacucugaggccug

SEQ ID NO: 297326 - RNA, 22 nt, Human
ccuggcuggcccacccuuccug

SEQ ID NO: 297327 - RNA, 19 nt, Human
ccugggcugagacuuucug

SEQ ID NO: 297328 - RNA, 21 nt, Human
ccuguuagcucagcccaaagc

SEQ ID NO: 297329 - RNA, 24 nt, Human
cgcccgcugcccacccgccaucac

SEQ ID NO: 297330 - RNA, 19 nt, Human
cgcccuguggcucuuggcc

SEQ ID NO: 297331 - RNA, 18 nt, Human
cgccgcccgcugcccacc

SEQ ID NO: 297332 - RNA, 22 nt, Human
cggcaccuggcaaggugaagga

SEQ ID NO: 297333 - RNA, 23 nt, Human
cggcugcgcggagcccgccgccc

SEQ ID NO: 297334 - RNA, 22 nt, Human
cuauucuacaccagccgaaaga

SEQ ID NO: 297335 - RNA, 23 nt, Human
cucgcuggguccccgcuuuucca

SEQ ID NO: 297336 - RNA, 20 nt, Human
cucggguucucgcugggucc

SEQ ID NO: 297337 - RNA, 21 nt, Human
cucucaaggggaccugguccu

SEQ ID NO: 297338 - RNA, 23 nt, Human
cugaggccugggugcagguaagg

SEQ ID NO: 297339 - RNA, 18 nt, Human
cugccugggcugagcccu

SEQ ID NO: 297340 - RNA, 18 nt, Human
cuggcaaggugaaggacu

SEQ ID NO: 297341 - RNA, 22 nt, Human
cuuguuugaggaggaggugggg

SEQ ID NO: 297342 - RNA, 22 nt, Human
cuuuaaccaggcuauggccacu

SEQ ID NO: 297343 - RNA, 18 nt, Human
gaaaaacaaaacagaaga

SEQ ID NO: 297344 - RNA, 18 nt, Human
gaagauggaggaguucag

SEQ ID NO: 297345 - RNA, 21 nt, Human
gacccaggggcagaagggggu

SEQ ID NO: 297346 - RNA, 21 nt, Human
gagcauggccuuggccccuac

SEQ ID NO: 297347 - RNA, 20 nt, Human
gagugggguggggaggaggg

SEQ ID NO: 297348 - RNA, 21 nt, Human
gcccccaccauccacauccac

SEQ ID NO: 297349 - RNA, 18 nt, Human
gcccuguggcucuuggcc

SEQ ID NO: 297350 - RNA, 20 nt, Human
gccuggcuggcccacccuuc

SEQ ID NO: 297351 - RNA, 18 nt, Human
gcggagcccgccgcccgc

SEQ ID NO: 297352 - RNA, 19 nt, Human
gcguggacacagcacaaaa

SEQ ID NO: 297353 - RNA, 21 nt, Human
gcguggacacagcacaaaaca

SEQ ID NO: 297354 - RNA, 20 nt, Human
gcugcgcggagcccgccgcc

SEQ ID NO: 297355 - RNA, 20 nt, Human
ggacccaggggcagaagggg

SEQ ID NO: 297356 - RNA, 22 nt, Human
ggagaagucaguacgggggagg

SEQ ID NO: 297357 - RNA, 19 nt, Human
ggaggagggaggcauggga

SEQ ID NO: 297358 - RNA, 20 nt, Human
ggagggggcgcuacacuacu

SEQ ID NO: 297359 - RNA, 21 nt, Human
ggagugggguggggaggaggg

SEQ ID NO: 297360 - RNA, 22 nt, Human
ggagugggguggggaggaggga

SEQ ID NO: 297361 - RNA, 21 nt, Human
ggcaggucugggguucucugg

SEQ ID NO: 297362 - RNA, 19 nt, Human
ggcguugggaagaggcuug

SEQ ID NO: 297363 - RNA, 19 nt, Human
gggaccugguccuaaaccu

SEQ ID NO: 297364 - RNA, 19 nt, Human
gggaggagggaggcauggg

SEQ ID NO: 297365 - RNA, 20 nt, Human
gggaggcaugggauggaugg

SEQ ID NO: 297366 - RNA, 18 nt, Human
ggggaagggguaggugcu

SEQ ID NO: 297367 - RNA, 30 nt, Human; identical to SEQ ID NO: 294429

SEQ ID NO: 297368 - RNA, 24 nt, Human
ggggagggggucgccuuagcgcgu

SEQ ID NO: 297369 - RNA, 27 nt, Human
ggggcagaagggggugggagaagaagg

SEQ ID NO: 297370 - RNA, 19 nt, Human
gggguggggaggagggagg

SEQ ID NO: 297371 - RNA, 20 nt, Human
gggguggggaggagggaggc

SEQ ID NO: 297372 - RNA, 21 nt, Human
gggucucggagcuggcaaucu

SEQ ID NO: 297373 - RNA, 21 nt, Human
guccaugcccccaccauccac

SEQ ID NO: 297374 - RNA, 23 nt, Human
gugaaggacugaggcuucaggag

SEQ ID NO: 297375 - RNA, 21 nt, Human
guuuauggcuggaaucuggag

SEQ ID NO: 297376 - RNA, 23 nt, Human
uaaccauaaauuugaccuauauu

SEQ ID NO: 297377 - RNA, 20 nt, Human
uacagagccuccuccaaggg

SEQ ID NO: 297378 - RNA, 21 nt, Human
uaccaguauucuggggguuag

SEQ ID NO: 297379 - RNA, 18 nt, Human
uacucgggaaagaggaac

SEQ ID NO: 297380 - RNA, 22 nt, Human
uagaaucuuaaaauaauaccac

SEQ ID NO: 297381 - RNA, 19 nt, Human
uagcccugaaacucugagg

SEQ ID NO: 297382 - RNA, 24 nt, Human
uaggagaagucaguacgggggagg

SEQ ID NO: 297383 - RNA, 25 nt, Human
uaucuuaccaccccauacugucuug

SEQ ID NO: 297384 - RNA, 19 nt, Human
uauguagugggaagggucc

SEQ ID NO: 297385 - RNA, 20 nt, Human
ucagcccaaagcuggcugcc

SEQ ID NO: 297386 - RNA, 18 nt, Human
ucaguccccugaggacau

SEQ ID NO: 297387 - RNA, 24 nt, Human
uccaaaacuugagcauugaucuug

SEQ ID NO: 297388 - RNA, 19 nt, Human
uccacauccacacacuucc

SEQ ID NO: 297389 - RNA, 22 nt, Human
uccaccaguggcaccucuggag

SEQ ID NO: 297390 - RNA, 21 nt, Human
ucgcuggguccccgcuuuucc

SEQ ID NO: 297391 - RNA, 19 nt, Human
ugaaaaacaaaacagaaga

SEQ ID NO: 297392 - RNA, 21 nt, Human
ugaaaaacaaaacagaagacu

SEQ ID NO: 297393 - RNA, 18 nt, Human
ugacccuuccaccagugg

SEQ ID NO: 297394 - RNA, 22 nt, Human
ugacccuuccaccaguggcacc

SEQ ID NO: 297395 - RNA, 24 nt, Human
ugcccuagcucccugccuccccaa

SEQ ID NO: 297396 - RNA, 19 nt, Human
ugccugggcugagcccuau

SEQ ID NO: 297397 - RNA, 23 nt, Human
ugccugggcugagcccuauuaug

SEQ ID NO: 297398 - RNA, 21 nt, Human
ugcuggggcuccgcuccgggg

SEQ ID NO: 297399 - RNA, 21 nt, Human
uggaaacgucaaacaaugaaa

SEQ ID NO: 297400 - RNA, 25 nt, Human
uggaaacgucaaacaaugaaaaaca

SEQ ID NO: 297401 - RNA, 18 nt, Human
uggaaggaggugaagggg

SEQ ID NO: 297402 - RNA, 21 nt, Human
uggaaggaggugaaggggcug

SEQ ID NO: 297403 - RNA, 22 nt, Human
uggaaggaggugaaggggcugg

SEQ ID NO: 297404 - RNA, 18 nt, Human
uggaaucuggaggauguu

SEQ ID NO: 297405 - RNA, 22 nt, Human
uggaaucuggaggauguuguca

SEQ ID NO: 297406 - RNA, 21 nt, Human
uggacacagcacaaaacacaa

SEQ ID NO: 297407 - RNA, 19 nt, Human
uggaggauguugucagucc

SEQ ID NO: 297408 - RNA, 21 nt, Human
uggagugggguggggaggagg

SEQ ID NO: 297409 - RNA, 23 nt, Human
uggauggccggggacccaggggc

SEQ ID NO: 297410 - RNA, 25 nt, Human
uggcaaaugguucuuggugucuaca

SEQ ID NO: 297411 - RNA, 19 nt, Human
uggcaaggugaaggacuga

SEQ ID NO: 297412 - RNA, 21 nt, Human
uggcaaggugaaggacugagg

SEQ ID NO: 297413 - RNA, 23 nt, Human
uggcaccucuggaguacccagca

SEQ ID NO: 297414 - RNA, 24 nt, Human
uggcaccucuggaguacccagcac

SEQ ID NO: 297415 - RNA, 18 nt, Human
uggcugccugggcugagc

SEQ ID NO: 297416 - RNA, 21 nt, Human
uggcugccugggcugagcccu

SEQ ID NO: 297417 - RNA, 19 nt, Human
ugggaaggguccagccuag

SEQ ID NO: 297418 - RNA, 20 nt, Human
ugggaaggguccagccuagu

SEQ ID NO: 297419 - RNA, 19 nt, Human
ugggauggaugggccugau

SEQ ID NO: 297420 - RNA, 20 nt, Human
ugggcugguuggggagaggc

SEQ ID NO: 297421 - RNA, 22 nt, Human
uggggaccugggcaguggccuu

SEQ ID NO: 297422 - RNA, 20 nt, Human
uggggaggagggaggcaugg

SEQ ID NO: 297423 - RNA, 21 nt, Human
uggggaggagggaggcauggg

SEQ ID NO: 297424 - RNA, 18 nt, Human
ugggugcagguaaggaga

SEQ ID NO: 297425 - RNA, 26 nt, Human
ugguagcaaaaugcccucccuaaauc

SEQ ID NO: 297426 - RNA, 21 nt, Human
ugguccccagggcguugggaa

SEQ ID NO: 297427 - RNA, 20 nt, Human
uggucccugcccuagcuccc

SEQ ID NO: 297428 - RNA, 18 nt, Human
uguaagggcaggucuggg

SEQ ID NO: 297429 - RNA, 24 nt, Human
uguaauauaaaaaggauuaaauac

SEQ ID NO: 297430 - RNA, 23 nt, Human
ugucuacaguaaccccacuaccc

SEQ ID NO: 297431 - RNA, 19 nt, Human
uguggcaaaugguucuugg

SEQ ID NO: 297432 - RNA, 23 nt, Human
uguggcaaaugguucuugguguc

SEQ ID NO: 297433 - RNA, 20 nt, Human
uugauuuggaagauggagga

SEQ ID NO: 297434 - RNA, 19 nt, Human
uuggaagauggaggaguuc

SEQ ID NO: 297435 - RNA, 21 nt, Human
uuguuucuguuucccaagggg

SEQ ID NO: 297436 - RNA, 18 nt, Human
uuuucagaacuaggaggc

SEQ ID NO: 297437 - RNA, 21 nt, Human
aaaacacaacacgggccgccg

SEQ ID NO: 297438 - RNA, 24 nt, Human
aaaacagaagacugguccccaggg

SEQ ID NO: 297439 - RNA, 19 nt, Human
aaaagcacaccgcacuaca

SEQ ID NO: 297440 - RNA, 18 nt, Human
aaaagcaguuccucucag

SEQ ID NO: 297441 - RNA, 24 nt, Human
aaacaaaacagaagacuggucccc

SEQ ID NO: 297442 - RNA, 25 nt, Human
aaacaaaacagaagacuggucccca

SEQ ID NO: 297443 - RNA, 25 nt, Human
aaacaaaacagaagacuggucccca

SEQ ID NO: 297444 - RNA, 22 nt, Human
aaacaaugaaaaacaaaacaga

SEQ ID NO: 297445 - RNA, 20 nt, Human
aaagaggaacuguuggagug

SEQ ID NO: 297446 - RNA, 18 nt, Human
aaaugcccucccuaaauc

SEQ ID NO: 297447 - RNA, 20 nt, Human
aaaugcccucccuaaauccc

SEQ ID NO: 297448 - RNA, 19 nt, Human
aacagaagacugguccccc

SEQ ID NO: 297449 - RNA, 19 nt, Human
aagaggucaugaugcccuu

SEQ ID NO: 297450 - RNA, 23 nt, Human
aagcuggcugccugggcugagcc

SEQ ID NO: 297451 - RNA, 21 nt, Human
aaugaaaaacaaaacagaaga

SEQ ID NO: 297452 - RNA, 25 nt, Human
acaaaacacaacacgggccgccgcg

SEQ ID NO: 297453 - RNA, 22 nt, Human
acaaaacagaagacuggucccc

SEQ ID NO: 297454 - RNA, 18 nt, Human
acagagccuccuccaagg

SEQ ID NO: 297455 - RNA, 27 nt, Human
acagagccuccuccaaggccuugauaa

SEQ ID NO: 297456 - RNA, 22 nt, Human
acagcacaaaacacaacacggg

SEQ ID NO: 297457 - RNA, 21 nt, Human
accaugcuuugggggaagauu

SEQ ID NO: 297458 - RNA, 19 nt, Human
acucgggaaagaggaacug

SEQ ID NO: 297459 - RNA, 22 nt, Human
acugaaaugccaguuuaaucca

SEQ ID NO: 297460 - RNA, 20 nt, Human
agaaggucuaugcacaagga

SEQ ID NO: 297461 - RNA, 19 nt, Human
agaggaacuguuggagugg

SEQ ID NO: 297462 - RNA, 24 nt, Human
agcucagcccaaagcuggcugccu

SEQ ID NO: 297463 - RNA, 21 nt, Human
aggacauacagagccuccucc

SEQ ID NO: 297464 - RNA, 22 nt, Human
aggaggcuuguagguuacuugg

SEQ ID NO: 297465 - RNA, 20 nt, Human
aggagggaggcaugggaugg

SEQ ID NO: 297466 - RNA, 18 nt, Human
aggagggcaggggcccug

SEQ ID NO: 297467 - RNA, 19 nt, Human
aggaggugggggaagucaa

SEQ ID NO: 297468 - RNA, 18 nt, Human
agggggcgcacuggggac

SEQ ID NO: 297469 - RNA, 25 nt, Human
auacagagccuccuccaaccggagg

SEQ ID NO: 297470 - RNA, 21 nt, Human
caaaacagaagacuggucccc

SEQ ID NO: 297471 - RNA, 23 nt, Human
caaacaaugaaaaacaaaacaga

SEQ ID NO: 297472 - RNA, 22 nt, Human
caacaccccaaccaccuuacuc

SEQ ID NO: 297473 - RNA, 21 nt, Human
cacaaaccacacucuggcagg

SEQ ID NO: 297474 - RNA, 21 nt, Human
cacacuucccuuccuuaucuu

SEQ ID NO: 297475 - RNA, 21 nt, Human
caccccauacugucuuggaac

SEQ ID NO: 297476 - RNA, 20 nt, Human
caccgcacuacacuacuggc

SEQ ID NO: 297477 - RNA, 18 nt, Human
cacuggggaccugggcag

SEQ ID NO: 297478 - RNA, 25 nt, Human
cagagccuccuccaaggccuugaua

SEQ ID NO: 297479 - RNA, 20 nt, Human
cagcccaaagcuggcugccu

SEQ ID NO: 297480 - RNA, 22 nt, Human
caggagggcaggggcccuguug

SEQ ID NO: 297481 - RNA, 22 nt, Human
caggggcagaagggggugggag

SEQ ID NO: 297482 - RNA, 22 nt, Human
caguauucuggggguuagcccu

SEQ ID NO: 297483 - RNA, 21 nt, Human
cauacagagccuccuccaagg

SEQ ID NO: 297484 - RNA, 23 nt, Human
ccauacugucuuggaacaugcag

SEQ ID NO: 297485 - RNA, 26 nt, Human
ccauacugucuuggaacaugcagugg

SEQ ID NO: 297486 - RNA, 21 nt, Human
cccacagaggccccucugacc

SEQ ID NO: 297487 - RNA, 21 nt, Human
cccaccauccacauccacaca

SEQ ID NO: 297488 - RNA, 30 nt, Human; identical to SEQ ID NO: 294382

SEQ ID NO: 297489 - RNA, 26 nt, Human
ccccaccauccacauccacacacuuc

SEQ ID NO: 297490 - RNA, 19 nt, Human
ccccacuacccccaugggu

SEQ ID NO: 297491 - RNA, 19 nt, Human
ccccacuacccccaugggu

SEQ ID NO: 297492 - RNA, 20 nt, Human
ccccacuacccccaugggua

SEQ ID NO: 297493 - RNA, 21 nt, Human
ccccacuacccccauggguac

SEQ ID NO: 297494 - RNA, 27 nt, Human
cccccaccauccacauccacacacuuc

SEQ ID NO: 297495 - RNA, 23 nt, Human
cccccugggggggaagggguagg

SEQ ID NO: 297496 - RNA, 25 nt, Human
cccccugggggggaagggguaggug

SEQ ID NO: 297497 - RNA, 21 nt, Human
ccccugaggacauacagagcc

SEQ ID NO: 297498 - RNA, 18 nt, Human
ccccugggggggaagggg

SEQ ID NO: 297499 - RNA, 20 nt, Human
cccugaaacucugaggccug

SEQ ID NO: 297500 - RNA, 21 nt, Human
cccugagauuucgcugagaaa

SEQ ID NO: 297501 - RNA, 21 nt, Human
ccgccgcccgcugcccacccg

SEQ ID NO: 297502 - RNA, 19 nt, Human
ccugaaaugggaccacaaa

SEQ ID NO: 297503 - RNA, 19 nt, Human
ccuggcuggcccacccuuc

SEQ ID NO: 297504 - RNA, 22 nt, Human
ccuggcuggcccacccuuccug

SEQ ID NO: 297505 - RNA, 19 nt, Human
ccugggcugagacuuucug

SEQ ID NO: 297506 - RNA, 21 nt, Human
ccuguuagcucagcccaaagc

SEQ ID NO: 297507 - RNA, 24 nt, Human
cgcccgcugcccacccgccaucac

SEQ ID NO: 297508 - RNA, 19 nt, Human
cgcccuguggcucuuggcc

SEQ ID NO: 297509 - RNA, 22 nt, Human
cgcguggacacagcacaaaaca

SEQ ID NO: 297510 - RNA, 23 nt, Human
cggcugcgcggagcccgccgccc

SEQ ID NO: 297511 - RNA, 22 nt, Human
cuauucuacaccagccgaaaga

SEQ ID NO: 297512 - RNA, 22 nt, Human
cucagcccaaagcuggcugccu

SEQ ID NO: 297513 - RNA, 21 nt, Human
cucucaaggggaccugguccu

SEQ ID NO: 297514 - RNA, 23 nt, Human
cugaggccugggugcagguaagg

SEQ ID NO: 297515 - RNA, 18 nt, Human
cugccugggcugagcccu

SEQ ID NO: 297516 - RNA, 18 nt, Human
cuggcaaggugaaggacu

SEQ ID NO: 297517 - RNA, 22 nt, Human
cuuguuugaggaggaggugggg

SEQ ID NO: 297518 - RNA, 22 nt, Human
cuuuaaccaggcuauggccacu

SEQ ID NO: 297519 - RNA, 18 nt, Human
gaaaaacaaaacagaaga

SEQ ID NO: 297520 - RNA, 18 nt, Human
gaagauggaggaguucag

SEQ ID NO: 297521 - RNA, 21 nt, Human
gacccaggggcagaagggggu

SEQ ID NO: 297522 - RNA, 21 nt, Human
gagcauggccuuggccccuac

SEQ ID NO: 297523 - RNA, 18 nt, Human
gaggagggaggcauggga

SEQ ID NO: 297524 - RNA, 21 nt, Human
gaggccugggugcagguaagg

SEQ ID NO: 297525 - RNA, 20 nt, Human
gagucaaguaucuucccccu

SEQ ID NO: 297526 - RNA, 20 nt, Human
gagugggguggggaggaggg

SEQ ID NO: 297527 - RNA, 20 nt, Human
gcaccuggcaaggugaagga

SEQ ID NO: 297528 - RNA, 21 nt, Human
gcccccaccauccacauccac

SEQ ID NO: 297529 - RNA, 18 nt, Human
gcccuguggcucuuggcc

SEQ ID NO: 297530 - RNA, 20 nt, Human
gccuggcuggcccacccuuc

SEQ ID NO: 297531 - RNA, 18 nt, Human
gcggagcccgccgcccgc

SEQ ID NO: 297532 - RNA, 19 nt, Human
gcguggacacagcacaaaa

SEQ ID NO: 297533 - RNA, 19 nt, Human
gcugccugggcugagcccu

SEQ ID NO: 297534 - RNA, 20 nt, Human
gcugcgcggagcccgccgcc

SEQ ID NO: 297535 - RNA, 20 nt, Human
ggacccaggggcagaagggg

SEQ ID NO: 297536 - RNA, 22 nt, Human
ggagaagucaguacgggggagg

SEQ ID NO: 297537 - RNA, 20 nt, Human
ggagggggcgcuacacuacu

SEQ ID NO: 297538 - RNA, 21 nt, Human
ggagugggguggggaggaggg

SEQ ID NO: 297539 - RNA, 22 nt, Human
ggagugggguggggaggaggga

SEQ ID NO: 297540 - RNA, 21 nt, Human
ggcaggucugggguucucugg

SEQ ID NO: 297541 - RNA, 19 nt, Human
ggcguugggaagaggcuug

SEQ ID NO: 297542 - RNA, 19 nt, Human
gggaccugguccuaaaccu

SEQ ID NO: 297543 - RNA, 18 nt, Human
gggagaggccgcccugug

SEQ ID NO: 297544 - RNA, 19 nt, Human
gggaggagggaggcauggg

SEQ ID NO: 297545 - RNA, 20 nt, Human
gggaggcaugggauggaugg

SEQ ID NO: 297546 - RNA, 21 nt, Human
gggcagaagggggugggagaa

SEQ ID NO: 297547 - RNA, 19 nt, Human
gggcguugggaagaggcuu

SEQ ID NO: 297548 - RNA, 18 nt, Human
ggggaagggguaggugcu

SEQ ID NO: 297549 - RNA, 19 nt, Human
ggggagaggccgcccugug

SEQ ID NO: 297550 - RNA, 30 nt, Human; identical to SEQ ID NO: 294429

SEQ ID NO: 297551 - RNA, 24 nt, Human
ggggagggggucgccuuagcgcgu

SEQ ID NO: 297552 - RNA, 27 nt, Human
ggggcagaagggggugggagaagaagg

SEQ ID NO: 297553 - RNA, 19 nt, Human
gggguggggaggagggagg

SEQ ID NO: 297554 - RNA, 20 nt, Human
gggguggggaggagggaggc

SEQ ID NO: 297555 - RNA, 21 nt, Human
guccaugcccccaccauccac

SEQ ID NO: 297556 - RNA, 23 nt, Human
gugaaggacugaggcuucaggag

SEQ ID NO: 297557 - RNA, 21 nt, Human
guuuauggcuggaaucuggag

SEQ ID NO: 297558 - RNA, 20 nt, Human
uacagagccuccuccaaggg

SEQ ID NO: 297559 - RNA, 21 nt, Human
uaccaguauucuggggguuag

SEQ ID NO: 297560 - RNA, 19 nt, Human
uagcccugaaacucugagg

SEQ ID NO: 297561 - RNA, 23 nt, Human
uagcccugaaacucugaggccug

SEQ ID NO: 297562 - RNA, 24 nt, Human
uaggagaagucaguacgggggagg

SEQ ID NO: 297563 - RNA, 25 nt, Human
uaucuuaccaccccauacugucuug

SEQ ID NO: 297564 - RNA, 19 nt, Human
uauguagugggaagggucc

SEQ ID NO: 297565 - RNA, 22 nt, Human
ucaaaagcaguuccucucagcg

SEQ ID NO: 297566 - RNA, 20 nt, Human
ucagcccaaagcuggcugcc

SEQ ID NO: 297567 - RNA, 18 nt, Human
ucaguccccugaggacau

SEQ ID NO: 297568 - RNA, 24 nt, Human
uccaaaacuugagcauugaucuug

SEQ ID NO: 297569 - RNA, 26 nt, Human
uccacacacuucccuuccuuaucuua

SEQ ID NO: 297570 - RNA, 19 nt, Human
uccacauccacacacuucc

SEQ ID NO: 297571 - RNA, 22 nt, Human
uccaccaguggcaccucuggag

SEQ ID NO: 297572 - RNA, 19 nt, Human
ugaaaaacaaaacagaaga

SEQ ID NO: 297573 - RNA, 21 nt, Human
ugaaaaacaaaacagaagacu

SEQ ID NO: 297574 - RNA, 23 nt, Human
ugaaaugggaccacaaaccacac

SEQ ID NO: 297575 - RNA, 18 nt, Human
ugacccuuccaccagugg

SEQ ID NO: 297576 - RNA, 22 nt, Human
ugacccuuccaccaguggcacc

SEQ ID NO: 297577 - RNA, 24 nt, Human
ugcccuagcucccugccuccccaa

SEQ ID NO: 297578 - RNA, 23 nt, Human
ugccugggcugagcccuauuaug

SEQ ID NO: 297579 - RNA, 21 nt, Human
ugcuggggcuccgcuccgggg

SEQ ID NO: 297580 - RNA, 22 nt, Human
ugcuggggcuccgcuccggggg

SEQ ID NO: 297581 - RNA, 21 nt, Human
uggaaacgucaaacaaugaaa

SEQ ID NO: 297582 - RNA, 25 nt, Human
uggaaacgucaaacaaugaaaaaca

SEQ ID NO: 297583 - RNA, 18 nt, Human
uggaaggaggugaagggg

SEQ ID NO: 297584 - RNA, 21 nt, Human
uggaaggaggugaaggggcug

SEQ ID NO: 297585 - RNA, 22 nt, Human
uggaaggaggugaaggggcugg

SEQ ID NO: 297586 - RNA, 18 nt, Human
uggaaucuggaggauguu

SEQ ID NO: 297587 - RNA, 22 nt, Human
uggaaucuggaggauguuguca

SEQ ID NO: 297588 - RNA, 21 nt, Human
uggacacagcacaaaacacaa

SEQ ID NO: 297589 - RNA, 19 nt, Human
uggaggauguugucagucc

SEQ ID NO: 297590 - RNA, 21 nt, Human
uggagugggguggggaggagg

SEQ ID NO: 297591 - RNA, 23 nt, Human
uggauggccggggacccaggggc

SEQ ID NO: 297592 - RNA, 25 nt, Human
uggcaaaugguucuuggugucuaca

SEQ ID NO: 297593 - RNA, 29 nt, Human
uggcaaaugguucuuggugucuacaguaa

SEQ ID NO: 297594 - RNA, 19 nt, Human
uggcaaggugaaggacuga

SEQ ID NO: 297595 - RNA, 21 nt, Human
uggcaaggugaaggacugagg

SEQ ID NO: 297596 - RNA, 23 nt, Human
uggcaccucuggaguacccagca

SEQ ID NO: 297597 - RNA, 24 nt, Human
uggcaccucuggaguacccagcac

SEQ ID NO: 297598 - RNA, 18 nt, Human
uggcugccugggcugagc

SEQ ID NO: 297599 - RNA, 21 nt, Human
uggcugccugggcugagcccu

SEQ ID NO: 297600 - RNA, 20 nt, Human
ugggaagaggcuugguagca

SEQ ID NO: 297601 - RNA, 19 nt, Human
ugggaaggguccagccuag

SEQ ID NO: 297602 - RNA, 20 nt, Human
ugggaaggguccagccuagu

SEQ ID NO: 297603 - RNA, 20 nt, Human
ugggaaggguccagccuagu

SEQ ID NO: 297604 - RNA, 19 nt, Human
ugggauggaugggccugau

SEQ ID NO: 297605 - RNA, 20 nt, Human
ugggcugguuggggagaggc

SEQ ID NO: 297606 - RNA, 22 nt, Human
uggggaccugggcaguggccuu

SEQ ID NO: 297607 - RNA, 20 nt, Human
uggggaggagggaggcaugg

SEQ ID NO: 297608 - RNA, 21 nt, Human
uggggaggagggaggcauggg

SEQ ID NO: 297609 - RNA, 18 nt, Human
ugggugcagguaaggaga

SEQ ID NO: 297610 - RNA, 26 nt, Human
ugguagcaaaaugcccucccuaaauc

SEQ ID NO: 297611 - RNA, 21 nt, Human
ugguccccagggcguugggaa

SEQ ID NO: 297612 - RNA, 20 nt, Human
uggucccugcccuagcuccc

SEQ ID NO: 297613 - RNA, 23 nt, Human
ugguuuauggcuggaaucuggag

SEQ ID NO: 297614 - RNA, 18 nt, Human
uguaagggcaggucuggg

SEQ ID NO: 297615 - RNA, 23 nt, Human
ugucuacaguaaccccacuaccc

SEQ ID NO: 297616 - RNA, 19 nt, Human
uguggcaaaugguucuugg

SEQ ID NO: 297617 - RNA, 23 nt, Human
uguggcaaaugguucuugguguc

SEQ ID NO: 297618 - RNA, 20 nt, Human
uuauguagugggaagggucc

SEQ ID NO: 297619 - RNA, 20 nt, Human
uugauuuggaagauggagga

SEQ ID NO: 297620 - RNA, 19 nt, Human
uuggaagauggaggaguuc

SEQ ID NO: 297621 - RNA, 21 nt, Human
uuguuucuguuucccaagggg

SEQ ID NO: 297622 - RNA, 18 nt, Human
uuuucagaacuaggaggc

SEQ ID NO: 297623 - RNA, 21 nt, Human
aaaacacaacacgggccgccg

SEQ ID NO: 297624 - RNA, 24 nt, Human
aaaacagaagacugguccccaggg

SEQ ID NO: 297625 - RNA, 19 nt, Human
aaaagcacaccgcacuaca

SEQ ID NO: 297626 - RNA, 24 nt, Human
aaacaaaacagaagacuggucccc

SEQ ID NO: 297627 - RNA, 25 nt, Human
aaacaaaacagaagacuggucccca

SEQ ID NO: 297628 - RNA, 20 nt, Human
aaaugcccucccuaaauccc

SEQ ID NO: 297629 - RNA, 19 nt, Human
aacagaagacugguccccc

SEQ ID NO: 297630 - RNA, 23 nt, Human
aagcuggcugccugggcugagcc

SEQ ID NO: 297631 - RNA, 25 nt, Human
acaaaacacaacacgggccgccgcg

SEQ ID NO: 297632 - RNA, 22 nt, Human
acaaaacagaagacuggucccc

SEQ ID NO: 297633 - RNA, 18 nt, Human
acagagccuccuccaagg

SEQ ID NO: 297634 - RNA, 27 nt, Human
acagagccuccuccaaggccuugauaa

SEQ ID NO: 297635 - RNA, 22 nt, Human
acagcacaaaacacaacacggg

SEQ ID NO: 297636 - RNA, 21 nt, Human
accaugcuuugggggaagauu

SEQ ID NO: 297637 - RNA, 20 nt, Human
accccauacugucuuggaac

SEQ ID NO: 297638 - RNA, 19 nt, Human
acucgggaaagaggaacug

SEQ ID NO: 297639 - RNA, 22 nt, Human
acugaaaugccaguuuaaucca

SEQ ID NO: 297640 - RNA, 20 nt, Human
agaaggucuaugcacaagga

SEQ ID NO: 297641 - RNA, 19 nt, Human
agaggaacuguuggagugg

SEQ ID NO: 297642 - RNA, 24 nt, Human
agcucagcccaaagcuggcugccu

SEQ ID NO: 297643 - RNA, 21 nt, Human
aggacauacagagccuccucc

SEQ ID NO: 297644 - RNA, 22 nt, Human
aggaggcuuguagguuacuugg

SEQ ID NO: 297645 - RNA, 20 nt, Human
aggagggaggcaugggaugg

SEQ ID NO: 297646 - RNA, 18 nt, Human
aggagggcaggggcccug

SEQ ID NO: 297647 - RNA, 19 nt, Human
aggaggugggggaagucaa

SEQ ID NO: 297648 - RNA, 18 nt, Human
agggggcgcacuggggac

SEQ ID NO: 297649 - RNA, 25 nt, Human
auacagagccuccuccaaccggagg

SEQ ID NO: 297650 - RNA, 20 nt, Human
auucuacaccagccgaaaga

SEQ ID NO: 297651 - RNA, 21 nt, Human
caaaacagaagacuggucccc

SEQ ID NO: 297652 - RNA, 23 nt, Human
caaacaaugaaaaacaaaacaga

SEQ ID NO: 297653 - RNA, 22 nt, Human
caacaccccaaccaccuuacuc

SEQ ID NO: 297654 - RNA, 20 nt, Human
caagaggucaugaugcccuu

SEQ ID NO: 297655 - RNA, 21 nt, Human
cacacuucccuuccuuaucuu

SEQ ID NO: 297656 - RNA, 20 nt, Human
caccgcacuacacuacuggc

SEQ ID NO: 297657 - RNA, 18 nt, Human
cacuggggaccugggcag

SEQ ID NO: 297658 - RNA, 25 nt, Human
cagagccuccuccaaggccuugaua

SEQ ID NO: 297659 - RNA, 22 nt, Human
caggagggcaggggcccuguug

SEQ ID NO: 297660 - RNA, 22 nt, Human
caggggcagaagggggugggag

SEQ ID NO: 297661 - RNA, 22 nt, Human
caguauucuggggguuagcccu

SEQ ID NO: 297662 - RNA, 21 nt, Human
cauacagagccuccuccaagg

SEQ ID NO: 297663 - RNA, 20 nt, Human
ccacagaggccccucugacc

SEQ ID NO: 297664 - RNA, 23 nt, Human
ccauacugucuuggaacaugcag

SEQ ID NO: 297665 - RNA, 26 nt, Human
ccauacugucuuggaacaugcagugg

SEQ ID NO: 297666 - RNA, 21 nt, Human
cccaccauccacauccacaca

SEQ ID NO: 297667 - RNA, 30 nt, Human; identical to SEQ ID NO: 294382

SEQ ID NO: 297668 - RNA, 19 nt, Human
ccccacuacccccaugggu

SEQ ID NO: 297669 - RNA, 19 nt, Human
ccccacuacccccaugggu

SEQ ID NO: 297670 - RNA, 21 nt, Human
ccccacuacccccauggguac

SEQ ID NO: 297671 - RNA, 27 nt, Human
cccccaccauccacauccacacacuuc

SEQ ID NO: 297672 - RNA, 25 nt, Human
cccccugggggggaagggguaggug

SEQ ID NO: 297673 - RNA, 21 nt, Human
ccccugaggacauacagagcc

SEQ ID NO: 297674 - RNA, 21 nt, Human
ccgccgcccgcugcccacccg

SEQ ID NO: 297675 - RNA, 22 nt, Human
ccucucaaggggaccugguccu

SEQ ID NO: 297676 - RNA, 22 nt, Human
ccuggcuggcccacccuuccug

SEQ ID NO: 297677 - RNA, 19 nt, Human
ccugggcugagacuuucug

SEQ ID NO: 297678 - RNA, 21 nt, Human
ccuguuagcucagcccaaagc

SEQ ID NO: 297679 - RNA, 24 nt, Human
cgcccgcugcccacccgccaucac

SEQ ID NO: 297680 - RNA, 22 nt, Human
cgcguggacacagcacaaaaca

SEQ ID NO: 297681 - RNA, 22 nt, Human
cggcaccuggcaaggugaagga

SEQ ID NO: 297682 - RNA, 23 nt, Human
cggcugcgcggagcccgccgccc

SEQ ID NO: 297683 - RNA, 22 nt, Human
cucagcccaaagcuggcugccu

SEQ ID NO: 297684 - RNA, 23 nt, Human
cugaggccugggugcagguaagg

SEQ ID NO: 297685 - RNA, 18 nt, Human
cugccugggcugagcccu

SEQ ID NO: 297686 - RNA, 18 nt, Human
cuggcaaggugaaggacu

SEQ ID NO: 297687 - RNA, 22 nt, Human
cuuuaaccaggcuauggccacu

SEQ ID NO: 297688 - RNA, 18 nt, Human
gaaaaacaaaacagaaga

SEQ ID NO: 297689 - RNA, 18 nt, Human
gaagauggaggaguucag

SEQ ID NO: 297690 - RNA, 21 nt, Human
gacccaggggcagaagggggu

SEQ ID NO: 297691 - RNA, 21 nt, Human
gagcauggccuuggccccuac

SEQ ID NO: 297692 - RNA, 20 nt, Human
gagugggguggggaggaggg

SEQ ID NO: 297693 - RNA, 21 nt, Human
gcccccaccauccacauccac

SEQ ID NO: 297694 - RNA, 18 nt, Human
gcccuguggcucuuggcc

SEQ ID NO: 297695 - RNA, 20 nt, Human
gccuggcuggcccacccuuc

SEQ ID NO: 297696 - RNA, 18 nt, Human
gcggagcccgccgcccgc

SEQ ID NO: 297697 - RNA, 19 nt, Human
gcguggacacagcacaaaa

SEQ ID NO: 297698 - RNA, 20 nt, Human
gcugcgcggagcccgccgcc

SEQ ID NO: 297699 - RNA, 20 nt, Human
ggacccaggggcagaagggg

SEQ ID NO: 297700 - RNA, 22 nt, Human
ggagaagucaguacgggggagg

SEQ ID NO: 297701 - RNA, 19 nt, Human
ggaggagggaggcauggga

SEQ ID NO: 297702 - RNA, 20 nt, Human
ggagggggcgcuacacuacu

SEQ ID NO: 297703 - RNA, 21 nt, Human
ggagugggguggggaggaggg

SEQ ID NO: 297704 - RNA, 22 nt, Human
ggagugggguggggaggaggga

SEQ ID NO: 297705 - RNA, 21 nt, Human
ggcaggucugggguucucugg

SEQ ID NO: 297706 - RNA, 19 nt, Human
ggcguugggaagaggcuug

SEQ ID NO: 297707 - RNA, 19 nt, Human
gggaccugguccuaaaccu

SEQ ID NO: 297708 - RNA, 19 nt, Human
gggaggagggaggcauggg

SEQ ID NO: 297709 - RNA, 20 nt, Human
gggaggcaugggauggaugg

SEQ ID NO: 297710 - RNA, 19 nt, Human
gggcguugggaagaggcuu

SEQ ID NO: 297711 - RNA, 18 nt, Human
ggggaagggguaggugcu

SEQ ID NO: 297712 - RNA, 30 nt, Human; identical to SEQ ID NO: 294429

SEQ ID NO: 297713 - RNA, 24 nt, Human
ggggagggggucgccuuagcgcgu

SEQ ID NO: 297714 - RNA, 27 nt, Human
ggggcagaagggggugggagaagaagg

SEQ ID NO: 297715 - RNA, 19 nt, Human
gggguggggaggagggagg

SEQ ID NO: 297716 - RNA, 20 nt, Human
gggguggggaggagggaggc

SEQ ID NO: 297717 - RNA, 23 nt, Human
gugaaggacugaggcuucaggag

SEQ ID NO: 297718 - RNA, 20 nt, Human
uacagagccuccuccaaggg

SEQ ID NO: 297719 - RNA, 21 nt, Human
uaccaguauucuggggguuag

SEQ ID NO: 297720 - RNA, 18 nt, Human
uacucgggaaagaggaac

SEQ ID NO: 297721 - RNA, 19 nt, Human
uagcccugaaacucugagg

SEQ ID NO: 297722 - RNA, 23 nt, Human
uagcccugaaacucugaggccug

SEQ ID NO: 297723 - RNA, 24 nt, Human
uaggagaagucaguacgggggagg

SEQ ID NO: 297724 - RNA, 25 nt, Human
uaucuuaccaccccauacugucuug

SEQ ID NO: 297725 - RNA, 19 nt, Human
uauguagugggaagggucc

SEQ ID NO: 297726 - RNA, 20 nt, Human
ucagcccaaagcuggcugcc

SEQ ID NO: 297727 - RNA, 18 nt, Human
ucaguccccugaggacau

SEQ ID NO: 297728 - RNA, 24 nt, Human
uccaaaacuugagcauugaucuug

SEQ ID NO: 297729 - RNA, 26 nt, Human
uccacacacuucccuuccuuaucuua

SEQ ID NO: 297730 - RNA, 19 nt, Human
uccacauccacacacuucc

SEQ ID NO: 297731 - RNA, 22 nt, Human
uccaccaguggcaccucuggag

SEQ ID NO: 297732 - RNA, 20 nt, Human
uccaugcccccaccauccac

SEQ ID NO: 297733 - RNA, 21 nt, Human
ugaaaaacaaaacagaagacu

SEQ ID NO: 297734 - RNA, 18 nt, Human
ugacccuuccaccagugg

SEQ ID NO: 297735 - RNA, 22 nt, Human
ugacccuuccaccaguggcacc

SEQ ID NO: 297736 - RNA, 24 nt, Human
ugcccuagcucccugccuccccaa

SEQ ID NO: 297737 - RNA, 19 nt, Human
ugccugggcugagcccuau

SEQ ID NO: 297738 - RNA, 23 nt, Human
ugccugggcugagcccuauuaug

SEQ ID NO: 297739 - RNA, 21 nt, Human
ugcuggggcuccgcuccgggg

SEQ ID NO: 297740 - RNA, 21 nt, Human
uggaaacgucaaacaaugaaa

SEQ ID NO: 297741 - RNA, 25 nt, Human
uggaaacgucaaacaaugaaaaaca

SEQ ID NO: 297742 - RNA, 18 nt, Human
uggaaggaggugaagggg

SEQ ID NO: 297743 - RNA, 21 nt, Human
uggaaggaggugaaggggcug

SEQ ID NO: 297744 - RNA, 22 nt, Human
uggaaggaggugaaggggcugg

SEQ ID NO: 297745 - RNA, 18 nt, Human
uggaaucuggaggauguu

SEQ ID NO: 297746 - RNA, 22 nt, Human
uggaaucuggaggauguuguca

SEQ ID NO: 297747 - RNA, 21 nt, Human
uggacacagcacaaaacacaa

SEQ ID NO: 297748 - RNA, 19 nt, Human
uggaggauguugucagucc

SEQ ID NO: 297749 - RNA, 21 nt, Human
uggagugggguggggaggagg

SEQ ID NO: 297750 - RNA, 23 nt, Human
uggauggccggggacccaggggc

SEQ ID NO: 297751 - RNA, 29 nt, Human
uggcaaaugguucuuggugucuacaguaa

SEQ ID NO: 297752 - RNA, 19 nt, Human
uggcaaggugaaggacuga

SEQ ID NO: 297753 - RNA, 21 nt, Human
uggcaaggugaaggacugagg

SEQ ID NO: 297754 - RNA, 23 nt, Human
uggcaccucuggaguacccagca

SEQ ID NO: 297755 - RNA, 24 nt, Human
uggcaccucuggaguacccagcac

SEQ ID NO: 297756 - RNA, 18 nt, Human
uggcugccugggcugagc

SEQ ID NO: 297757 - RNA, 21 nt, Human
uggcugccugggcugagcccu

SEQ ID NO: 297758 - RNA, 19 nt, Human
ugggaaggguccagccuag

SEQ ID NO: 297759 - RNA, 20 nt, Human
ugggaaggguccagccuagu

SEQ ID NO: 297760 - RNA, 20 nt, Human
ugggaaggguccagccuagu

SEQ ID NO: 297761 - RNA, 19 nt, Human
ugggauggaugggccugau

SEQ ID NO: 297762 - RNA, 20 nt, Human
ugggcugguuggggagaggc

SEQ ID NO: 297763 - RNA, 22 nt, Human
uggggaccugggcaguggccuu

SEQ ID NO: 297764 - RNA, 20 nt, Human
uggggaggagggaggcaugg

SEQ ID NO: 297765 - RNA, 21 nt, Human
uggggaggagggaggcauggg

SEQ ID NO: 297766 - RNA, 18 nt, Human
ugggugcagguaaggaga

SEQ ID NO: 297767 - RNA, 26 nt, Human
ugguagcaaaaugcccucccuaaauc

SEQ ID NO: 297768 - RNA, 21 nt, Human
ugguccccagggcguugggaa

SEQ ID NO: 297769 - RNA, 20 nt, Human
uggucccugcccuagcuccc

SEQ ID NO: 297770 - RNA, 23 nt, Human
ugguuuauggcuggaaucuggag

SEQ ID NO: 297771 - RNA, 18 nt, Human
uguaagggcaggucuggg

SEQ ID NO: 297772 - RNA, 23 nt, Human
ugucuacaguaaccccacuaccc

SEQ ID NO: 297773 - RNA, 19 nt, Human
uguggcaaaugguucuugg

SEQ ID NO: 297774 - RNA, 23 nt, Human
uguggcaaaugguucuugguguc

SEQ ID NO: 297775 - RNA, 20 nt, Human
uugauuuggaagauggagga

SEQ ID NO: 297776 - RNA, 21 nt, Human
uuguuucuguuucccaagggg

SEQ ID NO: 297777 - RNA, 21 nt, Human
uuguuugaggaggaggugggg

SEQ ID NO: 297778 - RNA, 18 nt, Human
uuuucagaacuaggaggc

SEQ ID NO: 297779 - RNA, 21 nt, Human
aaaacacaacacgggccgccg

SEQ ID NO: 297780 - RNA, 24 nt, Human
aaaacagaagacugguccccaggg

SEQ ID NO: 297781 - RNA, 19 nt, Human
aaaagcacaccgcacuaca

SEQ ID NO: 297782 - RNA, 25 nt, Human
aaacaaaacagaagacuggucccca

SEQ ID NO: 297783 - RNA, 25 nt, Human
aaacaaaacagaagacuggucccca

SEQ ID NO: 297784 - RNA, 20 nt, Human
aaaugcccucccuaaauccc

SEQ ID NO: 297785 - RNA, 19 nt, Human
aacagaagacugguccccc

SEQ ID NO: 297786 - RNA, 23 nt, Human
aagcuggcugccugggcugagcc

SEQ ID NO: 297787 - RNA, 21 nt, Human
aaugaaaaacaaaacagaaga

SEQ ID NO: 297788 - RNA, 25 nt, Human
acaaaacacaacacgggccgccgcg

SEQ ID NO: 297789 - RNA, 22 nt, Human
acaaaacagaagacuggucccc

SEQ ID NO: 297790 - RNA, 18 nt, Human
acagagccuccuccaagg

SEQ ID NO: 297791 - RNA, 27 nt, Human
acagagccuccuccaaggccuugauaa

SEQ ID NO: 297792 - RNA, 22 nt, Human
acagcacaaaacacaacacggg

SEQ ID NO: 297793 - RNA, 21 nt, Human
accaugcuuugggggaagauu

SEQ ID NO: 297794 - RNA, 19 nt, Human
acucgggaaagaggaacug

SEQ ID NO: 297795 - RNA, 22 nt, Human
acugaaaugccaguuuaaucca

SEQ ID NO: 297796 - RNA, 20 nt, Human
agaaggucuaugcacaagga

SEQ ID NO: 297797 - RNA, 19 nt, Human
agaggaacuguuggagugg

SEQ ID NO: 297798 - RNA, 24 nt, Human
agcucagcccaaagcuggcugccu

SEQ ID NO: 297799 - RNA, 21 nt, Human
aggacauacagagccuccucc

SEQ ID NO: 297800 - RNA, 22 nt, Human
aggaggcuuguagguuacuugg

SEQ ID NO: 297801 - RNA, 20 nt, Human
aggagggaggcaugggaugg

SEQ ID NO: 297802 - RNA, 18 nt, Human
aggagggcaggggcccug

SEQ ID NO: 297803 - RNA, 19 nt, Human
aggaggugggggaagucaa

SEQ ID NO: 297804 - RNA, 23 nt, Human
agggaggcaugggauggaugggg

SEQ ID NO: 297805 - RNA, 21 nt, Human
aggggcagaagggggugggag

SEQ ID NO: 297806 - RNA, 18 nt, Human
agggggcgcacuggggac

SEQ ID NO: 297807 - RNA, 25 nt, Human
auacagagccuccuccaaccggagg

SEQ ID NO: 297808 - RNA, 21 nt, Human
caaaacagaagacuggucccc

SEQ ID NO: 297809 - RNA, 23 nt, Human
caaacaaugaaaaacaaaacaga

SEQ ID NO: 297810 - RNA, 22 nt, Human
caacaccccaaccaccuuacuc

SEQ ID NO: 297811 - RNA, 20 nt, Human
caagaggucaugaugcccuu

SEQ ID NO: 297812 - RNA, 21 nt, Human
cacacuucccuuccuuaucuu

SEQ ID NO: 297813 - RNA, 21 nt, Human
caccccauacugucuuggaac

SEQ ID NO: 297814 - RNA, 20 nt, Human
caccgcacuacacuacuggc

SEQ ID NO: 297815 - RNA, 18 nt, Human
cacuggggaccugggcag

SEQ ID NO: 297816 - RNA, 25 nt, Human
cagagccuccuccaaggccuugaua

SEQ ID NO: 297817 - RNA, 20 nt, Human
cagcccaaagcuggcugccu

SEQ ID NO: 297818 - RNA, 22 nt, Human
caggagggcaggggcccuguug

SEQ ID NO: 297819 - RNA, 22 nt, Human
caguauucuggggguuagcccu

SEQ ID NO: 297820 - RNA, 21 nt, Human
cauacagagccuccuccaagg

SEQ ID NO: 297821 - RNA, 23 nt, Human
ccacacacuucccuuccuuaucu

SEQ ID NO: 297822 - RNA, 23 nt, Human
ccauacugucuuggaacaugcag

SEQ ID NO: 297823 - RNA, 26 nt, Human
ccauacugucuuggaacaugcagugg

SEQ ID NO: 297824 - RNA, 21 nt, Human
cccacagaggccccucugacc

SEQ ID NO: 297825 - RNA, 21 nt, Human
cccaccauccacauccacaca

SEQ ID NO: 297826 - RNA, 30 nt, Human; identical to SEQ ID NO: 294382

SEQ ID NO: 297827 - RNA, 19 nt, Human
ccccacuacccccaugggu

SEQ ID NO: 297828 - RNA, 19 nt, Human
ccccacuacccccaugggu

SEQ ID NO: 297829 - RNA, 21 nt, Human
ccccacuacccccauggguac

SEQ ID NO: 297830 - RNA, 27 nt, Human
cccccaccauccacauccacacacuuc

SEQ ID NO: 297831 - RNA, 25 nt, Human
cccccugggggggaagggguaggug

SEQ ID NO: 297832 - RNA, 21 nt, Human
ccccugaggacauacagagcc

SEQ ID NO: 297833 - RNA, 19 nt, Human
ccuggcuggcccacccuuc

SEQ ID NO: 297834 - RNA, 22 nt, Human
ccuggcuggcccacccuuccug

SEQ ID NO: 297835 - RNA, 19 nt, Human
ccugggcugagacuuucug

SEQ ID NO: 297836 - RNA, 21 nt, Human
ccuguuagcucagcccaaagc

SEQ ID NO: 297837 - RNA, 24 nt, Human
cgcccgcugcccacccgccaucac

SEQ ID NO: 297838 - RNA, 18 nt, Human
cgccgcccgcugcccacc

SEQ ID NO: 297839 - RNA, 22 nt, Human
cgcguggacacagcacaaaaca

SEQ ID NO: 297840 - RNA, 22 nt, Human
cggcaccuggcaaggugaagga

SEQ ID NO: 297841 - RNA, 23 nt, Human
cggcugcgcggagcccgccgccc

SEQ ID NO: 297842 - RNA, 22 nt, Human
cuauucuacaccagccgaaaga

SEQ ID NO: 297843 - RNA, 21 nt, Human
cucucaaggggaccugguccu

SEQ ID NO: 297844 - RNA, 23 nt, Human
cugaggccugggugcagguaagg

SEQ ID NO: 297845 - RNA, 18 nt, Human
cugccugggcugagcccu

SEQ ID NO: 297846 - RNA, 18 nt, Human
cuggcaaggugaaggacu

SEQ ID NO: 297847 - RNA, 22 nt, Human
cuuuaaccaggcuauggccacu

SEQ ID NO: 297848 - RNA, 18 nt, Human
gaagauggaggaguucag

SEQ ID NO: 297849 - RNA, 21 nt, Human
gacccaggggcagaagggggu

SEQ ID NO: 297850 - RNA, 21 nt, Human
gagcauggccuuggccccuac

SEQ ID NO: 297851 - RNA, 20 nt, Human
gagugggguggggaggaggg

SEQ ID NO: 297852 - RNA, 21 nt, Human
gcccccaccauccacauccac

SEQ ID NO: 297853 - RNA, 18 nt, Human
gcccuguggcucuuggcc

SEQ ID NO: 297854 - RNA, 18 nt, Human
gcggagcccgccgcccgc

SEQ ID NO: 297855 - RNA, 19 nt, Human
gcguggacacagcacaaaa

SEQ ID NO: 297856 - RNA, 20 nt, Human
gcugcgcggagcccgccgcc

SEQ ID NO: 297857 - RNA, 20 nt, Human
ggacccaggggcagaagggg

SEQ ID NO: 297858 - RNA, 22 nt, Human
ggagaagucaguacgggggagg

SEQ ID NO: 297859 - RNA, 19 nt, Human
ggaggagggaggcauggga

SEQ ID NO: 297860 - RNA, 20 nt, Human
ggagggggcgcuacacuacu

SEQ ID NO: 297861 - RNA, 21 nt, Human
ggagugggguggggaggaggg

SEQ ID NO: 297862 - RNA, 22 nt, Human
ggagugggguggggaggaggga

SEQ ID NO: 297863 - RNA, 21 nt, Human
ggcaggucugggguucucugg

SEQ ID NO: 297864 - RNA, 19 nt, Human
ggcguugggaagaggcuug

SEQ ID NO: 297865 - RNA, 19 nt, Human
gggaccugguccuaaaccu

SEQ ID NO: 297866 - RNA, 19 nt, Human
gggaggagggaggcauggg

SEQ ID NO: 297867 - RNA, 20 nt, Human
gggaggcaugggauggaugg

SEQ ID NO: 297868 - RNA, 21 nt, Human
gggcagaagggggugggagaa

SEQ ID NO: 297869 - RNA, 19 nt, Human
gggcguugggaagaggcuu

SEQ ID NO: 297870 - RNA, 18 nt, Human
ggggaagggguaggugcu

SEQ ID NO: 297871 - RNA, 24 nt, Human
ggggagggggucgccuuagcgcgu

SEQ ID NO: 297872 - RNA, 27 nt, Human
ggggcagaagggggugggagaagaagg

SEQ ID NO: 297873 - RNA, 19 nt, Human
gggguggggaggagggagg

SEQ ID NO: 297874 - RNA, 20 nt, Human
gggguggggaggagggaggc

SEQ ID NO: 297875 - RNA, 23 nt, Human
gugaaggacugaggcuucaggag

SEQ ID NO: 297876 - RNA, 20 nt, Human
uacagagccuccuccaaggg

SEQ ID NO: 297877 - RNA, 21 nt, Human
uaccaguauucuggggguuag

SEQ ID NO: 297878 - RNA, 18 nt, Human
uacucgggaaagaggaac

SEQ ID NO: 297879 - RNA, 19 nt, Human
uagcccugaaacucugagg

SEQ ID NO: 297880 - RNA, 23 nt, Human
uagcccugaaacucugaggccug

SEQ ID NO: 297881 - RNA, 24 nt, Human
uaggagaagucaguacgggggagg

SEQ ID NO: 297882 - RNA, 25 nt, Human
uaucuuaccaccccauacugucuug

SEQ ID NO: 297883 - RNA, 19 nt, Human
uauguagugggaagggucc

SEQ ID NO: 297884 - RNA, 20 nt, Human
ucagcccaaagcuggcugcc

SEQ ID NO: 297885 - RNA, 18 nt, Human
ucaguccccugaggacau

SEQ ID NO: 297886 - RNA, 24 nt, Human
uccaaaacuugagcauugaucuug

SEQ ID NO: 297887 - RNA, 19 nt, Human
uccacauccacacacuucc

SEQ ID NO: 297888 - RNA, 22 nt, Human
uccaccaguggcaccucuggag

SEQ ID NO: 297889 - RNA, 20 nt, Human
uccaugcccccaccauccac

SEQ ID NO: 297890 - RNA, 21 nt, Human
ugaaaaacaaaacagaagacu

SEQ ID NO: 297891 - RNA, 18 nt, Human
ugacccuuccaccagugg

SEQ ID NO: 297892 - RNA, 22 nt, Human
ugacccuuccaccaguggcacc

SEQ ID NO: 297893 - RNA, 24 nt, Human
ugcccuagcucccugccuccccaa

SEQ ID NO: 297894 - RNA, 23 nt, Human
ugccugggcugagcccuauuaug

SEQ ID NO: 297895 - RNA, 22 nt, Human
ugcuggggcuccgcuccggggg

SEQ ID NO: 297896 - RNA, 21 nt, Human
uggaaacgucaaacaaugaaa

SEQ ID NO: 297897 - RNA, 25 nt, Human
uggaaacgucaaacaaugaaaaaca

SEQ ID NO: 297898 - RNA, 18 nt, Human
uggaaggaggugaagggg

SEQ ID NO: 297899 - RNA, 21 nt, Human
uggaaggaggugaaggggcug

SEQ ID NO: 297900 - RNA, 22 nt, Human
uggaaggaggugaaggggcugg

SEQ ID NO: 297901 - RNA, 18 nt, Human
uggaaucuggaggauguu

SEQ ID NO: 297902 - RNA, 22 nt, Human
uggaaucuggaggauguuguca

SEQ ID NO: 297903 - RNA, 21 nt, Human
uggacacagcacaaaacacaa

SEQ ID NO: 297904 - RNA, 19 nt, Human
uggaggauguugucagucc

SEQ ID NO: 297905 - RNA, 21 nt, Human
uggagugggguggggaggagg

SEQ ID NO: 297906 - RNA, 23 nt, Human
uggauggccggggacccaggggc

SEQ ID NO: 297907 - RNA, 25 nt, Human
uggcaaaugguucuuggugucuaca

SEQ ID NO: 297908 - RNA, 19 nt, Human
uggcaaggugaaggacuga

SEQ ID NO: 297909 - RNA, 21 nt, Human
uggcaaggugaaggacugagg

SEQ ID NO: 297910 - RNA, 23 nt, Human
uggcaccucuggaguacccagca

SEQ ID NO: 297911 - RNA, 24 nt, Human
uggcaccucuggaguacccagcac

SEQ ID NO: 297912 - RNA, 18 nt, Human
uggcugccugggcugagc

SEQ ID NO: 297913 - RNA, 21 nt, Human
uggcugccugggcugagcccu

SEQ ID NO: 297914 - RNA, 19 nt, Human
ugggaaggguccagccuag

SEQ ID NO: 297915 - RNA, 20 nt, Human
ugggaaggguccagccuagu

SEQ ID NO: 297916 - RNA, 20 nt, Human
ugggaaggguccagccuagu

SEQ ID NO: 297917 - RNA, 19 nt, Human
ugggauggaugggccugau

SEQ ID NO: 297918 - RNA, 20 nt, Human
ugggcugguuggggagaggc

SEQ ID NO: 297919 - RNA, 22 nt, Human
uggggaccugggcaguggccuu

SEQ ID NO: 297920 - RNA, 20 nt, Human
uggggaggagggaggcaugg

SEQ ID NO: 297921 - RNA, 21 nt, Human
uggggaggagggaggcauggg

SEQ ID NO: 297922 - RNA, 18 nt, Human
ugggugcagguaaggaga

SEQ ID NO: 297923 - RNA, 26 nt, Human
ugguagcaaaaugcccucccuaaauc

SEQ ID NO: 297924 - RNA, 21 nt, Human
ugguccccagggcguugggaa

SEQ ID NO: 297925 - RNA, 20 nt, Human
uggucccugcccuagcuccc

SEQ ID NO: 297926 - RNA, 23 nt, Human
ugguuuauggcuggaaucuggag

SEQ ID NO: 297927 - RNA, 18 nt, Human
uguaagggcaggucuggg

SEQ ID NO: 297928 - RNA, 23 nt, Human
ugucuacaguaaccccacuaccc

SEQ ID NO: 297929 - RNA, 19 nt, Human
uguggcaaaugguucuugg

SEQ ID NO: 297930 - RNA, 23 nt, Human
uguggcaaaugguucuugguguc

SEQ ID NO: 297931 - RNA, 20 nt, Human
uugauuuggaagauggagga

SEQ ID NO: 297932 - RNA, 19 nt, Human
uuggaagauggaggaguuc

SEQ ID NO: 297933 - RNA, 21 nt, Human
uuguuucuguuucccaagggg

SEQ ID NO: 297934 - RNA, 21 nt, Human
uuguuugaggaggaggugggg

SEQ ID NO: 297935 - RNA, 18 nt, Human
uuuucagaacuaggaggc

SEQ ID NO: 297936 - RNA, 21 nt, Human
aaagugaaaaaacacugaaaa

SEQ ID NO: 297937 - RNA, 21 nt, Human
aauuugggaacacuugcccuc

SEQ ID NO: 297938 - RNA, 23 nt, Human
acacacacacacacacacacaca

SEQ ID NO: 297939 - RNA, 23 nt, Human
acacacacacacacacacacaca

SEQ ID NO: 297940 - RNA, 23 nt, Human
acacacacacacacacacacaca

SEQ ID NO: 297941 - RNA, 23 nt, Human
acacacacacacacacacacaca

SEQ ID NO: 297942 - RNA, 23 nt, Human
acacacacacacacacacacaua

SEQ ID NO: 297943 - RNA, 23 nt, Human
acacacacacacacacacauaua

SEQ ID NO: 297944 - RNA, 21 nt, Human
acacacacacacauauauaua

SEQ ID NO: 297945 - RNA, 24 nt, Human
acacauacacaaauauaccacaca

SEQ ID NO: 297946 - RNA, 19 nt, Human
accacacagacacaugugc

SEQ ID NO: 297947 - RNA, 21 nt, Human
accuuauggaugggaaaggga

SEQ ID NO: 297948 - RNA, 22 nt, Human
acuugcccucucuugcuccuac

SEQ ID NO: 297949 - RNA, 19 nt, Human
auacacauacacaaauaua

SEQ ID NO: 297950 - RNA, 22 nt, Human
auacacauacacaaauauacca

SEQ ID NO: 297951 - RNA, 20 nt, Human
cacacacacacacacacaca

SEQ ID NO: 297952 - RNA, 20 nt, Human
cacacacacacacacacaca

SEQ ID NO: 297953 - RNA, 20 nt, Human
cacacacacacacacacaca

SEQ ID NO: 297954 - RNA, 20 nt, Human
cacacacacacacacacaca

SEQ ID NO: 297955 - RNA, 20 nt, Human
cacacacacacacacacaca

SEQ ID NO: 297956 - RNA, 20 nt, Human
cacacacacacacacacaca

SEQ ID NO: 297957 - RNA, 20 nt, Human
cacacacacacacacacaca

SEQ ID NO: 297958 - RNA, 20 nt, Human
cacacacacacacacacaca

SEQ ID NO: 297959 - RNA, 20 nt, Human
cacacacacacacacacaca

SEQ ID NO: 297960 - RNA, 22 nt, Human
cacacacacacacacacacaca

SEQ ID NO: 297961 - RNA, 22 nt, Human
cacacacacacacacacacaca

SEQ ID NO: 297962 - RNA, 22 nt, Human
cacacacacacacacacacaca

SEQ ID NO: 297963 - RNA, 22 nt, Human
cacacacacacacacacacaca

SEQ ID NO: 297964 - RNA, 26 nt, Human
cacacacacacacacacacacacaca

SEQ ID NO: 297965 - RNA, 26 nt, Human
cacacacacacacacacacacacaca

SEQ ID NO: 297966 - RNA, 26 nt, Human
cacacacacacacacacacacacaca

SEQ ID NO: 297967 - RNA, 26 nt, Human
cacacacacacacacacacacacaca

SEQ ID NO: 297968 - RNA, 26 nt, Human
cacacacacacacacacacacacaua

SEQ ID NO: 297969 - RNA, 26 nt, Human
cacacacacacacacacacacauaua

SEQ ID NO: 297970 - RNA, 26 nt, Human
cacacacacacacacacacauauaua

SEQ ID NO: 297971 - RNA, 20 nt, Human
cacacacacacacacacaua

SEQ ID NO: 297972 - RNA, 26 nt, Human
cacacacacacacacacauauauaua

SEQ ID NO: 297973 - RNA, 19 nt, Human
cacacacacacacacauau

SEQ ID NO: 297974 - RNA, 25 nt, Human
cacacacacacacacauauauauau

SEQ ID NO: 297975 - RNA, 25 nt, Human
caguacauacaaauacacauacaca

SEQ ID NO: 297976 - RNA, 21 nt, Human
cauacaaauacacauacacaa

SEQ ID NO: 297977 - RNA, 25 nt, Human
caugcacacacacacacacacacac

SEQ ID NO: 297978 - RNA, 23 nt, Human
caugcuaagauuucccuucucaa

SEQ ID NO: 297979 - RNA, 22 nt, Human
uaaagugaaaaaacacugaaaa

SEQ ID NO: 297980 - RNA, 27 nt, Human
uaaagugaaaaaacacugaaaagauca

SEQ ID NO: 297981 - RNA, 22 nt, Human
uaagcacaauauuaauaacaaa

SEQ ID NO: 297982 - RNA, 21 nt, Human
uacacaaauauaccacacaga

SEQ ID NO: 297983 - RNA, 23 nt, Human
uacagcucaaguauuuuuuuggu

SEQ ID NO: 297984 - RNA, 24 nt, Human
uacaugcacacacacacacacaca

SEQ ID NO: 297985 - RNA, 26 nt, Human
uacaugcacacacacacacacacaca

SEQ ID NO: 297986 - RNA, 25 nt, Human
uaguaggucaucuugcccaagauuu

SEQ ID NO: 297987 - RNA, 24 nt, Human
uauaccacacagacacaugugcac

SEQ ID NO: 297988 - RNA, 23 nt, Human
uccacauagcuaaagugaaaaaa

SEQ ID NO: 297989 - RNA, 24 nt, Human
ucccagugggaaggccgugcuugg

SEQ ID NO: 297990 - RNA, 23 nt, Human
ucucuugcuccuacugcaccuua

SEQ ID NO: 297991 - RNA, 20 nt, Human
ugcacacacacacacacaca

SEQ ID NO: 297992 - RNA, 25 nt, Human
ugcacacacacacacacacacacac

SEQ ID NO: 297993 - RNA, 24 nt, Human
ugcuaaggggcacgaaugugaggu

SEQ ID NO: 297994 - RNA, 18 nt, Human
uggcagaaccucccagcu

SEQ ID NO: 297995 - RNA, 21 nt, Human
ugggaacacuugcccucucuu

SEQ ID NO: 297996 - RNA, 20 nt, Human
ugggaaggccgugcuuggug

SEQ ID NO: 297997 - RNA, 22 nt, Human
ugggaaggccgugcuugguggc

SEQ ID NO: 297998 - RNA, 26 nt, Human
ugugcacauacaugcacacacacaca

SEQ ID NO: 297999 - RNA, 25 nt, Human
ugugcacauacaugcacacacacag

SEQ ID NO: 298000 - RNA, 22 nt, Human
uucaaggaaaacuaguagguca

SEQ ID NO: 298001 - RNA, 20 nt, Human
uucaauaacaguacauacaa

SEQ ID NO: 298002 - RNA, 21 nt, Human
uugcccucucuugcuccuacc

SEQ ID NO: 298003 - RNA, 24 nt, Human
uuuaagcacaauauuaauaacaaa

SEQ ID NO: 298004 - RNA, 20 nt, Human
uuuuuuggugugcauucuag

SEQ ID NO: 298005 - RNA, 20 nt, Human
aaaauacagcaguuaagaua

SEQ ID NO: 298006 - RNA, 23 nt, Human
aaaaugacaccacaugcacagca

SEQ ID NO: 298007 - RNA, 20 nt, Human
aaacaaaaaggacacacaac

SEQ ID NO: 298008 - RNA, 18 nt, Human
aaacaggaaaggacagca

SEQ ID NO: 298009 - RNA, 18 nt, Human
aaacaggaaaggacagca

SEQ ID NO: 298010 - RNA, 21 nt, Human
aaacaggaaaggacagcagga

SEQ ID NO: 298011 - RNA, 23 nt, Human
aaacaggaaaggacagcaggaaa

SEQ ID NO: 298012 - RNA, 22 nt, Human
aaagagcauauuaauguauuua

SEQ ID NO: 298013 - RNA, 25 nt, Human
aaugguuagaaaaaauaucuguaaa

SEQ ID NO: 298014 - RNA, 21 nt, Human
acacuuaacaacuauggaaac

SEQ ID NO: 298015 - RNA, 22 nt, Human
acacuuaacaacuauggaaaca

SEQ ID NO: 298016 - RNA, 22 nt, Human
acagacaaagggacagagaaca

SEQ ID NO: 298017 - RNA, 20 nt, Human
accgcuuuuaugugcugcug

SEQ ID NO: 298018 - RNA, 21 nt, Human
acuguaucaaaugcuaugagc

SEQ ID NO: 298019 - RNA, 27 nt, Human
agaguauguauccucagauggaaccag

SEQ ID NO: 298020 - RNA, 18 nt, Human
aggcaaaaaacacugauc

SEQ ID NO: 298021 - RNA, 19 nt, Human
aggcaaaaaacacugaucc

SEQ ID NO: 298022 - RNA, 22 nt, Human
aggcagauuaucagacugaguu

SEQ ID NO: 298023 - RNA, 21 nt, Human
aguauguauccucagauggaa

SEQ ID NO: 298024 - RNA, 18 nt, Human
agucaaaagaugcccagu

SEQ ID NO: 298025 - RNA, 20 nt, Human
auacaaaucacuguagucaa

SEQ ID NO: 298026 - RNA, 21 nt, Human
caagagagaacuuucaccaug

SEQ ID NO: 298027 - RNA, 22 nt, Human
caccacaugcacagcacuaaag

SEQ ID NO: 298028 - RNA, 24 nt, Human
caccuccuucuggcuugacugguc

SEQ ID NO: 298029 - RNA, 26 nt, Human
cacugauccacauuccaacugguagg

SEQ ID NO: 298030 - RNA, 21 nt, Human
cagaauggacccaauugugcu

SEQ ID NO: 298031 - RNA, 20 nt, Human
cagcaggaaagaaaggcaac

SEQ ID NO: 298032 - RNA, 23 nt, Human
cagcaggaaagaaaggcaacaga

SEQ ID NO: 298033 - RNA, 24 nt, Human
ccaacagaauggacccaauugugc

SEQ ID NO: 298034 - RNA, 20 nt, Human
ccaucagacaucaccuuccu

SEQ ID NO: 298035 - RNA, 22 nt, Human
ccuggcuaaugccuuuuagaag

SEQ ID NO: 298036 - RNA, 18 nt, Human
ccuuucugcucaccuccu

SEQ ID NO: 298037 - RNA, 19 nt, Human
cgcaaacaaaaaggacaca

SEQ ID NO: 298038 - RNA, 22 nt, Human
cuccucaggagguggauuuggc

SEQ ID NO: 298039 - RNA, 21 nt, Human
cugucaucacauacaaagugu

SEQ ID NO: 298040 - RNA, 22 nt, Human
cuuccuggcaugauuagacuga

SEQ ID NO: 298041 - RNA, 22 nt, Human
cuucuggcuugacugguccauc

SEQ ID NO: 298042 - RNA, 22 nt, Human
gaugacuagggagauggagaga

SEQ ID NO: 298043 - RNA, 22 nt, Human
gaugguggaaacaaaggagaaa

SEQ ID NO: 298044 - RNA, 20 nt, Human
gcaaaaaacacugauccaca

SEQ ID NO: 298045 - RNA, 22 nt, Human
gcccagugcauagaaaaauaca

SEQ ID NO: 298046 - RNA, 19 nt, Human
ggaaacaaaggagaaacag

SEQ ID NO: 298047 - RNA, 20 nt, Human
ggccuuucugcucaccuccu

SEQ ID NO: 298048 - RNA, 28 nt, Human
uaaaaaaaaucuaaauaagaaagagcau

SEQ ID NO: 298049 - RNA, 21 nt, Human
uaaacauauuuuaucagacaa

SEQ ID NO: 298050 - RNA, 18 nt, Human
uaccauauuucagaagca

SEQ ID NO: 298051 - RNA, 23 nt, Human
uagacugaccgcuuuuaugugcu

SEQ ID NO: 298052 - RNA, 22 nt, Human
uauuacacaggcacuuggagau

SEQ ID NO: 298053 - RNA, 20 nt, Human
ucaaaugccaaaaugacacc

SEQ ID NO: 298054 - RNA, 26 nt, Human
ucaaaugccaaaaugacaccacaugc

SEQ ID NO: 298055 - RNA, 21 nt, Human
uccaagguucuagaaguugac

SEQ ID NO: 298056 - RNA, 20 nt, Human
uccauucugcaauaugaagg

SEQ ID NO: 298057 - RNA, 20 nt, Human
ucuaaauaagaaagagcaua

SEQ ID NO: 298058 - RNA, 23 nt, Human
ucuaaauaagaaagagcauauua

SEQ ID NO: 298059 - RNA, 19 nt, Human
ucugcaauaugaauauugu

SEQ ID NO: 298060 - RNA, 22 nt, Human
ugaaagcaaacaggaaaggaca

SEQ ID NO: 298061 - RNA, 21 nt, Human
ugaaauaauaggcaaaaaaca

SEQ ID NO: 298062 - RNA, 20 nt, Human
ugaaauggaaacccagagua

SEQ ID NO: 298063 - RNA, 23 nt, Human
ugaauguggauugaguuccugug

SEQ ID NO: 298064 - RNA, 18 nt, Human
ugacaccacaugcacagc

SEQ ID NO: 298065 - RNA, 19 nt, Human
ugacaccacaugcacagca

SEQ ID NO: 298066 - RNA, 21 nt, Human
ugagaauguaagaaauaagau

SEQ ID NO: 298067 - RNA, 20 nt, Human
ugcauuaucuucugccuaga

SEQ ID NO: 298068 - RNA, 21 nt, Human
ugccaaaaugacaccacaugc

SEQ ID NO: 298069 - RNA, 18 nt, Human
ugccaugcccacaaaagc

SEQ ID NO: 298070 - RNA, 20 nt, Human
ugccuagacuuuuugagugu

SEQ ID NO: 298071 - RNA, 21 nt, Human
uggaaaacuggcagccacuug

SEQ ID NO: 298072 - RNA, 23 nt, Human
uggaaacaaaggagaaacagcca

SEQ ID NO: 298073 - RNA, 21 nt, Human
uggagagaacaaugaucuauc

SEQ ID NO: 298074 - RNA, 24 nt, Human
uggaugguggaaacaaaggagaaa

SEQ ID NO: 298075 - RNA, 24 nt, Human
uguuuucaaaugccaaaaugacac

SEQ ID NO: 298076 - RNA, 23 nt, Human
uugacuuauagcuaccagacaua

SEQ ID NO: 298077 - RNA, 20 nt, Human
uugaguuccuguggaaaucu

SEQ ID NO: 298078 - RNA, 18 nt, Human
uugcauugccuuaucaca

SEQ ID NO: 298079 - RNA, 22 nt, Human
uuugcacauggaaagcuaccau

SEQ ID NO: 298080 - RNA, 27 nt, Human
uuuucagaagacuacaauuuuuugcac

SEQ ID NO: 298081 - RNA, 20 nt, Human
uuuuuugguauaaguccugg

SEQ ID NO: 298082 - RNA, 22 nt, Human
uuuuuuuugguauaaguccugg

SEQ ID NO: 298083 - RNA, 18 nt, Human
aagcagccucuccuguca

SEQ ID NO: 298084 - RNA, 23 nt, Human
aagcagccucuccugucaaaggc

SEQ ID NO: 298085 - RNA, 19 nt, Human
cacgcgcagcacgcacuua

SEQ ID NO: 298086 - RNA, 23 nt, Human
cacguacgcacgcgcagcacgca

SEQ ID NO: 298087 - RNA, 19 nt, Human
cagaggggcaagcgcggcg

SEQ ID NO: 298088 - RNA, 21 nt, Human
cccgcacgacccgcgccggca

SEQ ID NO: 298089 - RNA, 23 nt, Human
ccgcgccggcagcggucggcccu

SEQ ID NO: 298090 - RNA, 19 nt, Human
ccggcagcggucggcccuc

SEQ ID NO: 298091 - RNA, 18 nt, Human
gagaacucgccggcggga

SEQ ID NO: 298092 - RNA, 20 nt, Human
gcagcagagaggcccacacg

SEQ ID NO: 298093 - RNA, 21 nt, Human
gugguggagaagagggcgggg

SEQ ID NO: 298094 - RNA, 20 nt, Human
uccucgcaacggcgcgcggg

SEQ ID NO: 298095 - RNA, 25 nt, Human
ugugguggagaagagggcgggguac

SEQ ID NO: 298096 - RNA, 23 nt, Human
uuuagaaacuaguuuuugcagcu

SEQ ID NO: 298097 - RNA, 19 nt, Human
uuugcagcucagaaacugc

SEQ ID NO: 298098 - RNA, 20 nt, Human
uuuugcagcucagaaacugc

SEQ ID NO: 298099 - RNA, 20 nt, Human
aaaaaccacuccucaaaauc

SEQ ID NO: 298100 - RNA, 18 nt, Human
aaaaagcuuugaggacug

SEQ ID NO: 298101 - RNA, 20 nt, Human
aaacagaaaaccacacuaaa

SEQ ID NO: 298102 - RNA, 30 nt, Human
aaauuagaaacagaaaaccacacuaaacuu

SEQ ID NO: 298103 - RNA, 21 nt, Human
aaugccuaguuuuaagguaac

SEQ ID NO: 298104 - RNA, 24 nt, Human
acagaaccaccuucagcgcgacga

SEQ ID NO: 298105 - RNA, 20 nt, Human
acauuuucaugcugaaaaua

SEQ ID NO: 298106 - RNA, 21 nt, Human
agaaaaccacacuaaacuaca

SEQ ID NO: 298107 - RNA, 19 nt, Human
agcagcugauuguaucuac

SEQ ID NO: 298108 - RNA, 23 nt, Human
caaaaagcuuugaggacugagau

SEQ ID NO: 298109 - RNA, 20 nt, Human
caaagcagcacugcauaaac

SEQ ID NO: 298110 - RNA, 26 nt, Human
caaauuagaaacagaaaaccacacua

SEQ ID NO: 298111 - RNA, 18 nt, Human
cacucggagcagguacag

SEQ ID NO: 298112 - RNA, 21 nt, Human
cagaaaaccacacuaaacuac

SEQ ID NO: 298113 - RNA, 20 nt, Human
cagaaacccuaaaaaaacac

SEQ ID NO: 298114 - RNA, 22 nt, Human
cagaaacccuaaaaaaacacac

SEQ ID NO: 298115 - RNA, 21 nt, Human
caguguaacaaaguccaaaac

SEQ ID NO: 298116 - RNA, 21 nt, Human
ccucaaaaucaauucacaaac

SEQ ID NO: 298117 - RNA, 21 nt, Human
cuccucaaaaucaauucacaa

SEQ ID NO: 298118 - RNA, 19 nt, Human
cucugugccucuuugaaga

SEQ ID NO: 298119 - RNA, 21 nt, Human
cugaaaauaacaguguaacaa

SEQ ID NO: 298120 - RNA, 28 nt, Human
gagcagguacagaaccaccuucagcgcg

SEQ ID NO: 298121 - RNA, 19 nt, Human
gcucugugccucuuugaag

SEQ ID NO: 298122 - RNA, 21 nt, Human
guguccaagaaaagaaaaacc

SEQ ID NO: 298123 - RNA, 30 nt, Human
uaaaaaaacacacauuuucaugcugaaaag

SEQ ID NO: 298124 - RNA, 22 nt, Human
uaaaaagaaagcucaucucuau

SEQ ID NO: 298125 - RNA, 24 nt, Human
uacacagcauguuaaguucauaua

SEQ ID NO: 298126 - RNA, 22 nt, Human
uaugacaccacaucaaaagcuu

SEQ ID NO: 298127 - RNA, 20 nt, Human
uccaaauaccaagaaucuua

SEQ ID NO: 298128 - RNA, 21 nt, Human
uccaagaaaagaaaaaccacu

SEQ ID NO: 298129 - RNA, 22 nt, Human
uccaagaaaagaaaaaccacuc

SEQ ID NO: 298130 - RNA, 20 nt, Human
uccaaugcacaaaagcaauc

SEQ ID NO: 298131 - RNA, 23 nt, Human
ucuaacagauauccaaauaccaa

SEQ ID NO: 298132 - RNA, 21 nt, Human
ucuuuuaauauuuccaaguaa

SEQ ID NO: 298133 - RNA, 23 nt, Human
ugaacagcugaguguuuacagga

SEQ ID NO: 298134 - RNA, 19 nt, Human
ugacaccacaucaaaagcu

SEQ ID NO: 298135 - RNA, 21 nt, Human
ugacaccacaucaaaagcuuu

SEQ ID NO: 298136 - RNA, 19 nt, Human
ugagaugagcaauccacug

SEQ ID NO: 298137 - RNA, 19 nt, Human
ugcauaaacuguucaagaa

SEQ ID NO: 298138 - RNA, 23 nt, Human
uggaagaagaaagagcagaagau

SEQ ID NO: 298139 - RNA, 23 nt, Human
uguaacaaaguccaaaacaagcu

SEQ ID NO: 298140 - RNA, 25 nt, Human
uguccaagaaaagaaaaaccacucc

SEQ ID NO: 298141 - RNA, 25 nt, Human
uuaauaucagaacagaauuaagugu

SEQ ID NO: 298142 - RNA, 18 nt, Human
uugcauccuuccucuacc

SEQ ID NO: 298143 - RNA, 21 nt, Human
uuugaagaaucagaaacccua

SEQ ID NO: 298144 - RNA, 19 nt, Human
uuugagagagagagaaggg

SEQ ID NO: 298145 - RNA, 18 nt, Human
aaacaauaucuacauaug

SEQ ID NO: 298146 - RNA, 22 nt, Human
aagacuucaguauaugcuggca

SEQ ID NO: 298147 - RNA, 21 nt, Human
agacuucaguauaugcuggca

SEQ ID NO: 298148 - RNA, 22 nt, Human
aggcaggcgggaaggaggaaag

SEQ ID NO: 298149 - RNA, 23 nt, Human
aggcgggaaggaggaaagucuag

SEQ ID NO: 298150 - RNA, 24 nt, Human
cacaaguauuucuaagagacaaaa

SEQ ID NO: 298151 - RNA, 23 nt, Human
cagaucagacuuuggacuuuauu

SEQ ID NO: 298152 - RNA, 18 nt, Human
cuaagagacaaaaauacu

SEQ ID NO: 298153 - RNA, 21 nt, Human
gacuucaguauaugcuggcau

SEQ ID NO: 298154 - RNA, 19 nt, Human
ggcuucaggagccucagag

SEQ ID NO: 298155 - RNA, 20 nt, Human
uaaauucaaaaacacuucuu

SEQ ID NO: 298156 - RNA, 22 nt, Human
uacaaauuuggugacagaaaag

SEQ ID NO: 298157 - RNA, 19 nt, Human
uagaagcaguucucaaaga

SEQ ID NO: 298158 - RNA, 29 nt, Human
ucagacuuuggacuuuauucucccugggg

SEQ ID NO: 298159 - RNA, 23 nt, Human
ucggcuucaggagccucagagcg

SEQ ID NO: 298160 - RNA, 18 nt, Human
ucuagguuaacuagacca

SEQ ID NO: 298161 - RNA, 22 nt, Human
uucggcuucaggagccucagag

SEQ ID NO: 298162 - RNA, 19 nt, Human
uuggagagaauagagaaaa

SEQ ID NO: 298163 - RNA, 19 nt, Human
agaaacauuuauuuggaua

SEQ ID NO: 298164 - RNA, 20 nt, Human
aggccugagggcuaggggcc

SEQ ID NO: 298165 - RNA, 19 nt, Human
agggcuaggggccggggcu

SEQ ID NO: 298166 - RNA, 18 nt, Human
cagcagcgguggcggcag

SEQ ID NO: 298167 - RNA, 24 nt, Human
cucaagacagaggcagcagcugaa

SEQ ID NO: 298168 - RNA, 20 nt, Human
gagcagcagcagcgguggcg

SEQ ID NO: 298169 - RNA, 19 nt, Human
gcagcagcagcgguggcgg

SEQ ID NO: 298170 - RNA, 19 nt, Human
gcagcagcugaauuuugca

SEQ ID NO: 298171 - RNA, 19 nt, Human
gccccgggggaaaggcgcu

SEQ ID NO: 298172 - RNA, 23 nt, Human
gccccgggggaaaggcgcugggg

SEQ ID NO: 298173 - RNA, 21 nt, Human
gggccggggcuggccugcguc

SEQ ID NO: 298174 - RNA, 20 nt, Human
aacacuauaaauauugcacu

SEQ ID NO: 298175 - RNA, 25 nt, Human
aaguauuuuuuuuucuacugagaga

SEQ ID NO: 298176 - RNA, 21 nt, Human
acccaccgcgcucacaccgcc

SEQ ID NO: 298177 - RNA, 22 nt, Human
accgccgcggggcggcccaggu

SEQ ID NO: 298178 - RNA, 24 nt, Human
acgcaagacaagauuguaacaccu

SEQ ID NO: 298179 - RNA, 23 nt, Human
caagacaagauuguaacaccuca

SEQ ID NO: 298180 - RNA, 19 nt, Human
cacccaccgcgcucacacc

SEQ ID NO: 298181 - RNA, 20 nt, Human
cacgccccuccgcacccacc

SEQ ID NO: 298182 - RNA, 20 nt, Human
cacuaagucggcagguuucc

SEQ ID NO: 298183 - RNA, 19 nt, Human
cagcguagacgcucggggu

SEQ ID NO: 298184 - RNA, 21 nt, Human
caugugaagagucaaccaguc

SEQ ID NO: 298185 - RNA, 21 nt, Human
ccaccgcgcucacaccgccgc

SEQ ID NO: 298186 - RNA, 23 nt, Human
ccaccgcgcucacaccgccgcuc

SEQ ID NO: 298187 - RNA, 23 nt, Human
ccgcacccaccgcgcucacaccg

SEQ ID NO: 298188 - RNA, 27 nt, Human
ccgcacuaagucggcagguuuccaauc

SEQ ID NO: 298189 - RNA, 23 nt, Human
ccuccgcacccaccgcgcucaca

SEQ ID NO: 298190 - RNA, 25 nt, Human
cgccccuccgcacccaccgcgcuca

SEQ ID NO: 298191 - RNA, 21 nt, Human
cgcgcgcgccggcacacacgg

SEQ ID NO: 298192 - RNA, 25 nt, Human
cucacacuggcagcagcgcuggcuc

SEQ ID NO: 298193 - RNA, 24 nt, Human
cuccgcacccaccgcgcucacacc

SEQ ID NO: 298194 - RNA, 26 nt, Human
cugacagcaggcaaagaacuucccuc

SEQ ID NO: 298195 - RNA, 19 nt, Human
cugcccgcgcgcucccucu

SEQ ID NO: 298196 - RNA, 22 nt, Human
gcagcagcgcuggcucacaccg

SEQ ID NO: 298197 - RNA, 23 nt, Human
gcgcgcucccucucacgcgcgca

SEQ ID NO: 298198 - RNA, 26 nt, Human
gcucacacuggcagcagcgcuggcuc

SEQ ID NO: 298199 - RNA, 19 nt, Human
uaacacuauaaauauugca

SEQ ID NO: 298200 - RNA, 27 nt, Human
uagaaaacgcaagacaagauuguaaca

SEQ ID NO: 298201 - RNA, 19 nt, Human
uagcuuccuaucaccgcac

SEQ ID NO: 298202 - RNA, 23 nt, Human
ucaaaggcaauggcagaauacag

SEQ ID NO: 298203 - RNA, 24 nt, Human
ucacgcgcgcaccgccgcggggcg

SEQ ID NO: 298204 - RNA, 19 nt, Human
ucccucagcuaucucggag

SEQ ID NO: 298205 - RNA, 24 nt, Human
uccgcacccaccgcgcucacaccg

SEQ ID NO: 298206 - RNA, 18 nt, Human
ucggaggccucauaccuc

SEQ ID NO: 298207 - RNA, 19 nt, Human
ugacagcaggcaaagaacu

SEQ ID NO: 298208 - RNA, 23 nt, Human
uggcagcagcgcuggcucacacc

SEQ ID NO: 298209 - RNA, 18 nt, Human
uggcucacaccggcgcuc

SEQ ID NO: 298210 - RNA, 20 nt, Human
ugugaagagucaaccagucc

SEQ ID NO: 298211 - RNA, 29 nt, Human
uucacacaacucaauucuaaaauauccuu

SEQ ID NO: 298212 - RNA, 21 nt, Human
uuuuuuguaauccuuuaaaaa

SEQ ID NO: 298213 - RNA, 18 nt, Human
uuuuuuuuuuuuuuuuug

SEQ ID NO: 298214 - RNA, 19 nt, Human
uuuuuuuuuuuuuuuuugu

SEQ ID NO: 298215 - RNA, 22 nt, Human
aaaaacaaaaacaaaaccugga

SEQ ID NO: 298216 - RNA, 20 nt, Human
aaacaaaaacaaaaccugga

SEQ ID NO: 298217 - RNA, 27 nt, Human
aaacaaaaacaaaaccuggaagccuca

SEQ ID NO: 298218 - RNA, 25 nt, Human
aaagacagcaggcugugcccaaagc

SEQ ID NO: 298219 - RNA, 20 nt, Human
aacaaaaacaaaaccuggaa

SEQ ID NO: 298220 - RNA, 21 nt, Human
aagguccuccgggagaaccag

SEQ ID NO: 298221 - RNA, 21 nt, Human
aauggaaaagacagcaggcug

SEQ ID NO: 298222 - RNA, 23 nt, Human
acaaaaccuggaagccucaagac

SEQ ID NO: 298223 - RNA, 25 nt, Human
acaccacugcagccucagcaugggc

SEQ ID NO: 298224 - RNA, 28 nt, Human
acaccaggacacagacccaccgcccaac

SEQ ID NO: 298225 - RNA, 23 nt, Human
acagcacauguggccaaaggcac

SEQ ID NO: 298226 - RNA, 22 nt, Human
acaggacugaggcagccccacc

SEQ ID NO: 298227 - RNA, 22 nt, Human
acaggcagcaucgucaugaagc

SEQ ID NO: 298228 - RNA, 21 nt, Human
acauagaccuguggugccucc

SEQ ID NO: 298229 - RNA, 24 nt, Human
acccaccgcccaaccuaaaagaac

SEQ ID NO: 298230 - RNA, 21 nt, Human
acccacgacaccacugcagcc

SEQ ID NO: 298231 - RNA, 19 nt, Human
acccacgauggacagaagg

SEQ ID NO: 298232 - RNA, 21 nt, Human
accgcccaaccuaaaagaaca

SEQ ID NO: 298233 - RNA, 22 nt, Human
acugaagaggggcggggacccg

SEQ ID NO: 298234 - RNA, 26 nt, Human
agaaacucaacaccaggacacagacc

SEQ ID NO: 298235 - RNA, 25 nt, Human
agacaaacagcacagcacauguggc

SEQ ID NO: 298236 - RNA, 22 nt, Human
agacagcaggcugugcccaaag

SEQ ID NO: 298237 - RNA, 23 nt, Human
agacagcaggcugugcccaaagc

SEQ ID NO: 298238 - RNA, 18 nt, Human
agcagccccaaccccagc

SEQ ID NO: 298239 - RNA, 18 nt, Human
agccucucucagccuccc

SEQ ID NO: 298240 - RNA, 23 nt, Human
agcugcagacgcacccgcuggga

SEQ ID NO: 298241 - RNA, 23 nt, Human
agcugcuggugacucuccagggc

SEQ ID NO: 298242 - RNA, 18 nt, Human
aggcauuggggugugguc

SEQ ID NO: 298243 - RNA, 20 nt, Human
agggaagugagggagcgcag

SEQ ID NO: 298244 - RNA, 21 nt, Human
agggaagugagggagcgcagg

SEQ ID NO: 298245 - RNA, 20 nt, Human
agggggcucagccagcuggg

SEQ ID NO: 298246 - RNA, 21 nt, Human
agguuuuccucacagcagccc

SEQ ID NO: 298247 - RNA, 23 nt, Human
auggaggaggaggaugucauugu

SEQ ID NO: 298248 - RNA, 24 nt, Human
caaaaacaaaaccuggaagccuca

SEQ ID NO: 298249 - RNA, 19 nt, Human
caaaggcaccuccagaggc

SEQ ID NO: 298250 - RNA, 19 nt, Human
caacaccaggacacagacc

SEQ ID NO: 298251 - RNA, 20 nt, Human
caacaccaggacacagaccc

SEQ ID NO: 298252 - RNA, 25 nt, Human
caacagcauucuaggagaaagguga

SEQ ID NO: 298253 - RNA, 24 nt, Human
caacagggcagcccugacccccuc

SEQ ID NO: 298254 - RNA, 27 nt, Human
caaccccagcccagcugaagacggcuc

SEQ ID NO: 298255 - RNA, 24 nt, Human
cacagcagccccaaccccagccca

SEQ ID NO: 298256 - RNA, 23 nt, Human
caccaggacacagacccaccgcc

SEQ ID NO: 298257 - RNA, 27 nt, Human
cacccccagaaauuugcagaaacucaa

SEQ ID NO: 298258 - RNA, 20 nt, Human
cagaaauuugcagaaacuca

SEQ ID NO: 298259 - RNA, 18 nt, Human
cagagcucugcacccucc

SEQ ID NO: 298260 - RNA, 21 nt, Human
cagcacagcacauguggccaa

SEQ ID NO: 298261 - RNA, 18 nt, Human
cagcauucuaggagaaag

SEQ ID NO: 298262 - RNA, 26 nt, Human
cagccccaaccccagcccagcugaag

SEQ ID NO: 298263 - RNA, 19 nt, Human
cagccgcccaccaccugcc

SEQ ID NO: 298264 - RNA, 22 nt, Human
cagggccccaaggaaaggggag

SEQ ID NO: 298265 - RNA, 21 nt, Human
cauagaccuguggugccuccu

SEQ ID NO: 298266 - RNA, 19 nt, Human
ccaaaggcaccuccagagg

SEQ ID NO: 298267 - RNA, 20 nt, Human
ccaacacuagccccucccug

SEQ ID NO: 298268 - RNA, 21 nt, Human
ccacugcagccucagcauggg

SEQ ID NO: 298269 - RNA, 24 nt, Human
ccaggacacagacccaccgcccaa

SEQ ID NO: 298270 - RNA, 19 nt, Human
ccagggggcucagccagcu

SEQ ID NO: 298271 - RNA, 27 nt, Human
cccaaccccagcccagcugaagacggc

SEQ ID NO: 298272 - RNA, 18 nt, Human
cccaaccuaaaagaacag

SEQ ID NO: 298273 - RNA, 21 nt, Human
cccaagagcugcuggugacuc

SEQ ID NO: 298274 - RNA, 24 nt, Human
cccaagagcugcuggugacucucc

SEQ ID NO: 298275 - RNA, 26 nt, Human
cccaccgcccaaccuaaaagguuuuc

SEQ ID NO: 298276 - RNA, 20 nt, Human
cccacgacaccacugcagcc

SEQ ID NO: 298277 - RNA, 21 nt, Human
cccacgacaccacugcagccu

SEQ ID NO: 298278 - RNA, 22 nt, Human
cccacgacaccacugcagccuc

SEQ ID NO: 298279 - RNA, 24 nt, Human
cccacgacaccacugcagccucag

SEQ ID NO: 298280 - RNA, 25 nt, Human
cccacgacaccacugcagccucagc

SEQ ID NO: 298281 - RNA, 19 nt, Human
ccccaaccccagcccagcu

SEQ ID NO: 298282 - RNA, 19 nt, Human
ccccagagucugaaggccu

SEQ ID NO: 298283 - RNA, 25 nt, Human
ccccauggacugggcagcuuuggga

SEQ ID NO: 298284 - RNA, 19 nt, Human
ccccucuggcugaugggaa

SEQ ID NO: 298285 - RNA, 21 nt, Human
ccccucuuggccuccccgcug

SEQ ID NO: 298286 - RNA, 18 nt, Human
cccugccagccgcccacc

SEQ ID NO: 298287 - RNA, 19 nt, Human
ccucacagcagccccaacc

SEQ ID NO: 298288 - RNA, 24 nt, Human
ccucacagcagccccaaccccagc

SEQ ID NO: 298289 - RNA, 19 nt, Human
ccucccagcaaguccuucc

SEQ ID NO: 298290 - RNA, 19 nt, Human
ccuccgggagaaccagccu

SEQ ID NO: 298291 - RNA, 19 nt, Human
ccuggcccauggcucugca

SEQ ID NO: 298292 - RNA, 24 nt, Human
cgcccaaccuaaaagaacaggaac

SEQ ID NO: 298293 - RNA, 22 nt, Human
cgccguggccgaggaccuuuug

SEQ ID NO: 298294 - RNA, 20 nt, Human
cgucuaggaccuaccaacac

SEQ ID NO: 298295 - RNA, 25 nt, Human
cgucuaggaccuaccaacacuagcc

SEQ ID NO: 298296 - RNA, 22 nt, Human
cucacagcagccccaaccccag

SEQ ID NO: 298297 - RNA, 24 nt, Human
cucacagcagccccaaccccagcc

SEQ ID NO: 298298 - RNA, 24 nt, Human
cucccagcaaguccuucccaagag

SEQ ID NO: 298299 - RNA, 24 nt, Human
cucccugccagccgcccaccaccu

SEQ ID NO: 298300 - RNA, 23 nt, Human
cucccuucaucagcugccuuggc

SEQ ID NO: 298301 - RNA, 19 nt, Human
cugcagccucagcaugggc

SEQ ID NO: 298302 - RNA, 21 nt, Human
cugccagccgcccaccaccug

SEQ ID NO: 298303 - RNA, 19 nt, Human
cuguccacauggugggacc

SEQ ID NO: 298304 - RNA, 22 nt, Human
cugugcccaaagccucucucag

SEQ ID NO: 298305 - RNA, 19 nt, Human
cuucaucagcugccuuggc

SEQ ID NO: 298306 - RNA, 18 nt, Human
gaccuguggugccuccuu

SEQ ID NO: 298307 - RNA, 22 nt, Human
gaguuguuuggcaacagggcag

SEQ ID NO: 298308 - RNA, 23 nt, Human
gaguuguuuggcaacagggcagc

SEQ ID NO: 298309 - RNA, 24 nt, Human
gcaaaaacaaaaacaaaaccugga

SEQ ID NO: 298310 - RNA, 22 nt, Human
gcacggggugggcaggacugag

SEQ ID NO: 298311 - RNA, 24 nt, Human
gcagcuuugggaacugagggaagu

SEQ ID NO: 298312 - RNA, 23 nt, Human
gcccagagucacagaaaucaccc

SEQ ID NO: 298313 - RNA, 22 nt, Human
gccccaaccccagcccagcuga

SEQ ID NO: 298314 - RNA, 24 nt, Human
gcccccacagugcugggugaaagu

SEQ ID NO: 298315 - RNA, 22 nt, Human
gcugcagacgcacccgcuggga

SEQ ID NO: 298316 - RNA, 27 nt, Human
ggaaaagacagcaggcugugcccaaag

SEQ ID NO: 298317 - RNA, 18 nt, Human
ggacugaggaggggaggg

SEQ ID NO: 298318 - RNA, 18 nt, Human
ggagaaccagccugccca

SEQ ID NO: 298319 - RNA, 20 nt, Human
ggagcgcaggaggccagggg

SEQ ID NO: 298320 - RNA, 22 nt, Human
ggaggagcugcagacgcacccg

SEQ ID NO: 298321 - RNA, 25 nt, Human
ggaggaggaugucauuggucucagg

SEQ ID NO: 298322 - RNA, 20 nt, Human
ggagggcaggacugaagagg

SEQ ID NO: 298323 - RNA, 18 nt, Human
ggagugauggaggaggag

SEQ ID NO: 298324 - RNA, 24 nt, Human
ggaguuguuuggcaacagggcagg

SEQ ID NO: 298325 - RNA, 23 nt, Human
ggcaaaaacaaaaacaaaaccug

SEQ ID NO: 298326 - RNA, 19 nt, Human
ggcaacagggcagcccuga

SEQ ID NO: 298327 - RNA, 23 nt, Human
ggggagggcaggacugaagaggg

SEQ ID NO: 298328 - RNA, 22 nt, Human
ggggcucagccagcugguaggg

SEQ ID NO: 298329 - RNA, 24 nt, Human
ggggugggcaggacugaggagggg

SEQ ID NO: 298330 - RNA, 20 nt, Human
gugccuccuugggcuauguc

SEQ ID NO: 298331 - RNA, 26 nt, Human
uacuuuggcaaaaacaaaaacaaagc

SEQ ID NO: 298332 - RNA, 18 nt, Human
uaggaccuaccaacacua

SEQ ID NO: 298333 - RNA, 19 nt, Human
ucacagaaaucacccccag

SEQ ID NO: 298334 - RNA, 22 nt, Human
ucagggucuccacguuccugca

SEQ ID NO: 298335 - RNA, 19 nt, Human
ucagugcccaaggggacag

SEQ ID NO: 298336 - RNA, 18 nt, Human
uccacagggccccucuug

SEQ ID NO: 298337 - RNA, 25 nt, Human
ucccccagcacacauagaccugugg

SEQ ID NO: 298338 - RNA, 20 nt, Human
uccuccgggagaaccagccu

SEQ ID NO: 298339 - RNA, 23 nt, Human
ucucucagccucccagcaagucc

SEQ ID NO: 298340 - RNA, 23 nt, Human
ucugcacccuccccaaggcuguu

SEQ ID NO: 298341 - RNA, 19 nt, Human
ucuguccacauggugggac

SEQ ID NO: 298342 - RNA, 23 nt, Human
ugaaaagaaaaccaaaugcagug

SEQ ID NO: 298343 - RNA, 19 nt, Human
ugaaaguccacagggcccc

SEQ ID NO: 298344 - RNA, 25 nt, Human
ugaagcagggccccaaggaaagguc

SEQ ID NO: 298345 - RNA, 24 nt, Human
ugagcucccuucaucagcugccuu

SEQ ID NO: 298346 - RNA, 21 nt, Human
ugauggaggaggaggauguca

SEQ ID NO: 298347 - RNA, 18 nt, Human
ugcagggugggcacacuu

SEQ ID NO: 298348 - RNA, 18 nt, Human
ugcccaaggggacaggac

SEQ ID NO: 298349 - RNA, 18 nt, Human
uggacaggcucccugucg

SEQ ID NO: 298350 - RNA, 21 nt, Human
uggaggaggaggaugucauug

SEQ ID NO: 298351 - RNA, 18 nt, Human
uggagugauggaggagga

SEQ ID NO: 298352 - RNA, 18 nt, Human
uggcaaaaacaaaaacaa

SEQ ID NO: 298353 - RNA, 20 nt, Human
uggcaaaaacaaaaacaaaa

SEQ ID NO: 298354 - RNA, 22 nt, Human
uggcaaaaacaaaaacaaaacc

SEQ ID NO: 298355 - RNA, 21 nt, Human
ugggaaggcauuggggugugg

SEQ ID NO: 298356 - RNA, 24 nt, Human
ugggccccucuccucagugcccaa

SEQ ID NO: 298357 - RNA, 21 nt, Human
ugggcugcacggggugggcag

SEQ ID NO: 298358 - RNA, 19 nt, Human
ugguaggggcggccgagac

SEQ ID NO: 298359 - RNA, 19 nt, Human
ugucauuguaaauaccacc

SEQ ID NO: 298360 - RNA, 19 nt, Human
ugucugcugccccagaguc

SEQ ID NO: 298361 - RNA, 19 nt, Human
ugucuguccacaugguggg

SEQ ID NO: 298362 - RNA, 23 nt, Human
uguuacccacgauggacagaagg

SEQ ID NO: 298363 - RNA, 25 nt, Human
uuccucacagcagccccaaccccag

SEQ ID NO: 298364 - RNA, 22 nt, Human
uuuacagaugguagagggugac

SEQ ID NO: 298365 - RNA, 21 nt, Human
cagcacagcgaccccucggaa

SEQ ID NO: 298366 - RNA, 19 nt, Human
caggaggaaugaaaaugga

SEQ ID NO: 298367 - RNA, 20 nt, Human
ggaaugaaaauggagagaaa

SEQ ID NO: 298368 - RNA, 20 nt, Human
uaugcguguguggauugugu

SEQ ID NO: 298369 - RNA, 23 nt, Human
uaugcguguguggauugugugug

SEQ ID NO: 298370 - RNA, 24 nt, Human
ucagguggacuaggaggggguucu

SEQ ID NO: 298371 - RNA, 19 nt, Human
ucuguacaugcauuggagg

SEQ ID NO: 298372 - RNA, 21 nt, Human
ugcguguguggauugugugug

SEQ ID NO: 298373 - RNA, 19 nt, Human
uggcucuaacucaacagcu

SEQ ID NO: 298374 - RNA, 18 nt, Human
uguguguggaugacuucu

SEQ ID NO: 298375 - RNA, 19 nt, Human
uugcaggaggaaugaaaau

SEQ ID NO: 298376 - RNA, 22 nt, Human
uuguguguggaugacuucucuc

SEQ ID NO: 298377 - RNA, 24 nt, Human
aaaaagaaaaggugccacaaagga

SEQ ID NO: 298378 - RNA, 18 nt, Human
aaaaagaagcaagauagg

SEQ ID NO: 298379 - RNA, 22 nt, Human
aaaaagaagcaagauaggagaa

SEQ ID NO: 298380 - RNA, 19 nt, Human
aaaacauucugcauaccaa

SEQ ID NO: 298381 - RNA, 24 nt, Human
aaacaaaaucuaccugagggacaa

SEQ ID NO: 298382 - RNA, 18 nt, Human
aaacagaggaaagaccag

SEQ ID NO: 298383 - RNA, 22 nt, Human
aaacauucugcauaccaaacaa

SEQ ID NO: 298384 - RNA, 25 nt, Human
aaacucagugggagaaagccagcag

SEQ ID NO: 298385 - RNA, 21 nt, Human
aaagaucuagggaaugagucu

SEQ ID NO: 298386 - RNA, 23 nt, Human
aacaagcuacagaaacaguuucu

SEQ ID NO: 298387 - RNA, 22 nt, Human
aagaauucaugacaaaacaacc

SEQ ID NO: 298388 - RNA, 19 nt, Human
aagaggaaaaagaagcaag

SEQ ID NO: 298389 - RNA, 23 nt, Human
aagcaagauaggagaaaagccag

SEQ ID NO: 298390 - RNA, 24 nt, Human
aagcaagauaggagaaaagccaga

SEQ ID NO: 298391 - RNA, 20 nt, Human
acacacucgcuugaacaaga

SEQ ID NO: 298392 - RNA, 23 nt, Human
accacauggacaagacagggaac

SEQ ID NO: 298393 - RNA, 19 nt, Human
acucccccuucccacccuc

SEQ ID NO: 298394 - RNA, 20 nt, Human
acuggagacuuuguaagcau

SEQ ID NO: 298395 - RNA, 25 nt, Human
agaaagauuuauacaucuagcacua

SEQ ID NO: 298396 - RNA, 23 nt, Human
agaaaggagacagguauagaaaa

SEQ ID NO: 298397 - RNA, 18 nt, Human
agaacacgcuguucuaau

SEQ ID NO: 298398 - RNA, 22 nt, Human
agacaaaugucacuuuuaauau

SEQ ID NO: 298399 - RNA, 20 nt, Human
agacagguauagaaaacuuu

SEQ ID NO: 298400 - RNA, 19 nt, Human
agaggaaaaagaagcaaga

SEQ ID NO: 298401 - RNA, 21 nt, Human
agaggaaaaagaagcaagaua

SEQ ID NO: 298402 - RNA, 18 nt, Human
agccaaagcaaaugacag

SEQ ID NO: 298403 - RNA, 23 nt, Human
agugaacuccuucauuaggccua

SEQ ID NO: 298404 - RNA, 18 nt, Human
agugauaggauuggagaa

SEQ ID NO: 298405 - RNA, 21 nt, Human
agugauaggauuggagaagaa

SEQ ID NO: 298406 - RNA, 22 nt, Human
auacuccagguuggaaacauuc

SEQ ID NO: 298407 - RNA, 21 nt, Human
auaucacaacacauacaugua

SEQ ID NO: 298408 - RNA, 22 nt, Human
auaugcuccaauauuggaaauu

SEQ ID NO: 298409 - RNA, 19 nt, Human
auggagcagggugccaugg

SEQ ID NO: 298410 - RNA, 21 nt, Human
auuucaagaucuguuucuaga

SEQ ID NO: 298411 - RNA, 30 nt, Human
caaaaacaaaacuucucuugguuucucccc

SEQ ID NO: 298412 - RNA, 19 nt, Human
caaagcaaaugacagacuc

SEQ ID NO: 298413 - RNA, 19 nt, Human
caacugugacuccagaaag

SEQ ID NO: 298414 - RNA, 24 nt, Human
caacugugacuccagaaagaacaa

SEQ ID NO: 298415 - RNA, 18 nt, Human
caagagugggaagggaag

SEQ ID NO: 298416 - RNA, 23 nt, Human
caagcuacagaaacaguuucuga

SEQ ID NO: 298417 - RNA, 20 nt, Human
caauacaucaaauguauaau

SEQ ID NO: 298418 - RNA, 21 nt, Human
caccacagacacagugcaccg

SEQ ID NO: 298419 - RNA, 23 nt, Human
cacccucgggcucuagaccacuc

SEQ ID NO: 298420 - RNA, 22 nt, Human
cagaaggagaaacagaggaaag

SEQ ID NO: 298421 - RNA, 21 nt, Human
caggcacuaagaaagacugac

SEQ ID NO: 298422 - RNA, 22 nt, Human
cagugauaggauuggagaagaa

SEQ ID NO: 298423 - RNA, 20 nt, Human
cauuguaggugacuggagac

SEQ ID NO: 298424 - RNA, 18 nt, Human
ccacuucagacacaggca

SEQ ID NO: 298425 - RNA, 25 nt, Human
ccagacagacucccccuucccaccc

SEQ ID NO: 298426 - RNA, 21 nt, Human
ccuaaugcauuuacacuuugu

SEQ ID NO: 298427 - RNA, 26 nt, Human
ccuuaugaaguucaaacuucauggaa

SEQ ID NO: 298428 - RNA, 22 nt, Human
cgagaggagaggcugggcggcg

SEQ ID NO: 298429 - RNA, 24 nt, Human
cgggcauugcucugcaaacacccu

SEQ ID NO: 298430 - RNA, 19 nt, Human
cucccccuucccacccucg

SEQ ID NO: 298431 - RNA, 22 nt, Human
cuugagagugaaccuuuggcua

SEQ ID NO: 298432 - RNA, 23 nt, Human
gaaaaagaaaaggugccacaaag

SEQ ID NO: 298433 - RNA, 20 nt, Human
gaaaggagacagguauagaa

SEQ ID NO: 298434 - RNA, 24 nt, Human
gaagcaagauaggagaaaagccag

SEQ ID NO: 298435 - RNA, 22 nt, Human
gacuccagaaagaacaaaacaa

SEQ ID NO: 298436 - RNA, 22 nt, Human
gagcuuuuugucaacugugacu

SEQ ID NO: 298437 - RNA, 22 nt, Human
gauuuuauuuaaauauuaaagc

SEQ ID NO: 298438 - RNA, 21 nt, Human
gccuuuucuuuugagaauuga

SEQ ID NO: 298439 - RNA, 24 nt, Human
gcucuagguaacauggagcagggu

SEQ ID NO: 298440 - RNA, 19 nt, Human
ggacaagacagggaacaag

SEQ ID NO: 298441 - RNA, 21 nt, Human
ggagaaacagaggaaagacca

SEQ ID NO: 298442 - RNA, 21 nt, Human
ggcggcgagcgcuccucgcgg

SEQ ID NO: 298443 - RNA, 20 nt, Human
gggaauggaaaaguaaugag

SEQ ID NO: 298444 - RNA, 18 nt, Human
ggguaaggaagaagcaug

SEQ ID NO: 298445 - RNA, 23 nt, Human
gguauagaaaacuuucagaagga

SEQ ID NO: 298446 - RNA, 21 nt, Human
uaagaaagacugacaaaacug

SEQ ID NO: 298447 - RNA, 21 nt, Human
uaagaauaccaagaccacaca

SEQ ID NO: 298448 - RNA, 31 nt, Human
uaagcaaacucauaauuauuauuguacagaa

SEQ ID NO: 298449 - RNA, 22 nt, Human
uaauugauaucccagguuuugc

SEQ ID NO: 298450 - RNA, 21 nt, Human
uaccaaacaaaaucuaccuga

SEQ ID NO: 298451 - RNA, 20 nt, Human
uaccaagaccacacauguua

SEQ ID NO: 298452 - RNA, 24 nt, Human
uaggagaaaagccagacagacucc

SEQ ID NO: 298453 - RNA, 24 nt, Human
uauaugaaacuuccaaggacagag

SEQ ID NO: 298454 - RNA, 22 nt, Human
uaucccagguuuugccuuuucu

SEQ ID NO: 298455 - RNA, 22 nt, Human
uauuauacuccagguuggaaac

SEQ ID NO: 298456 - RNA, 18 nt, Human
ucagcuccagcuaacugu

SEQ ID NO: 298457 - RNA, 26 nt, Human
uccaauauuggaaauucuaucuaaca

SEQ ID NO: 298458 - RNA, 23 nt, Human
uccacggacgccucuggcaccac

SEQ ID NO: 298459 - RNA, 19 nt, Human
uccagaaagaacaaaacac

SEQ ID NO: 298460 - RNA, 24 nt, Human
uccagaaagaacaaaacacuucac

SEQ ID NO: 298461 - RNA, 20 nt, Human
ucccagguuuugccuuuucu

SEQ ID NO: 298462 - RNA, 24 nt, Human
ucccagguuuugccuuuucuuuug

SEQ ID NO: 298463 - RNA, 22 nt, Human
ucgaaaauugcucaaaccagag

SEQ ID NO: 298464 - RNA, 24 nt, Human
ucuaagaauucucugguccuuuuu

SEQ ID NO: 298465 - RNA, 21 nt, Human
ucuaaucaggcagcugcuacu

SEQ ID NO: 298466 - RNA, 19 nt, Human
ucuaguguucuuuucauga

SEQ ID NO: 298467 - RNA, 21 nt, Human
ucugaauauuauacuccaggu

SEQ ID NO: 298468 - RNA, 23 nt, Human
ucugcaaacacccucuacacaaa

SEQ ID NO: 298469 - RNA, 24 nt, Human
ucugcauaccaaacaaaaucuacc

SEQ ID NO: 298470 - RNA, 20 nt, Human
ucuugagagugaaccuuugg

SEQ ID NO: 298471 - RNA, 23 nt, Human
ugaaacuuccaaggacagaguga

SEQ ID NO: 298472 - RNA, 22 nt, Human
ugaaauaccuaugaucaauucu

SEQ ID NO: 298473 - RNA, 18 nt, Human
ugaacacaguuggaaaaa

SEQ ID NO: 298474 - RNA, 24 nt, Human
ugacaaaacaaccacuucagacac

SEQ ID NO: 298475 - RNA, 24 nt, Human
ugaccaacaugaccagauuuugac

SEQ ID NO: 298476 - RNA, 22 nt, Human
ugagaauuuggacacuaucagu

SEQ ID NO: 298477 - RNA, 18 nt, Human
ugagagaaggaagccaga

SEQ ID NO: 298478 - RNA, 20 nt, Human
ugagagucaucuaaucaggc

SEQ ID NO: 298479 - RNA, 19 nt, Human
ugauaugcuccaauauugg

SEQ ID NO: 298480 - RNA, 26 nt, Human
ugauaugcuccaauauuggaaauucu

SEQ ID NO: 298481 - RNA, 21 nt, Human
ugcagacaggaaagauguguu

SEQ ID NO: 298482 - RNA, 20 nt, Human
ugcaguguucuaauguagug

SEQ ID NO: 298483 - RNA, 22 nt, Human
ugccacaaaggauauuauaagc

SEQ ID NO: 298484 - RNA, 19 nt, Human
ugccuaacagaagaugcgg

SEQ ID NO: 298485 - RNA, 19 nt, Human
ugcgaagagcuaggaggcg

SEQ ID NO: 298486 - RNA, 23 nt, Human
ugcuugagcucauccccuucaca

SEQ ID NO: 298487 - RNA, 20 nt, Human
uggaauagaaagaucuaggg

SEQ ID NO: 298488 - RNA, 22 nt, Human
uggaauagaaagaucuagggaa

SEQ ID NO: 298489 - RNA, 24 nt, Human
uggcaccacagacacagugcacca

SEQ ID NO: 298490 - RNA, 23 nt, Human
uggcugagaaaggagacagguau

SEQ ID NO: 298491 - RNA, 18 nt, Human
ugggagaaagccagcauu

SEQ ID NO: 298492 - RNA, 19 nt, Human
uguggcugagaaaggagac

SEQ ID NO: 298493 - RNA, 28 nt, Human
uguuaccaaccauacuucaagccaaagc

SEQ ID NO: 298494 - RNA, 27 nt, Human
uuaagaauaccaagaccacacauguua

SEQ ID NO: 298495 - RNA, 21 nt, Human
uuaagaauaccaagaccacag

SEQ ID NO: 298496 - RNA, 22 nt, Human
uucaagaucuguuucuagaucu

SEQ ID NO: 298497 - RNA, 20 nt, Human
uucacaaaaauccacacagg

SEQ ID NO: 298498 - RNA, 25 nt, Human
uucagacacaggcaaaaucgcaggg

SEQ ID NO: 298499 - RNA, 21 nt, Human
uugaagaaccacauggacaag

SEQ ID NO: 298500 - RNA, 21 nt, Human
uuucuuggcaucaaaauuuga

SEQ ID NO: 298501 - RNA, 22 nt, Human
uuugauaugcuccaauauugga

SEQ ID NO: 298502 - RNA, 19 nt, Human
ggggguagggauccucggg

SEQ ID NO: 298503 - RNA, 23 nt, Human
guggggccaggggguagggaucc

SEQ ID NO: 298504 - RNA, 19 nt, Human
ucuggacgugcuggcgggg

SEQ ID NO: 298505 - RNA, 21 nt, Human
uggacgugcuggcggggagca

SEQ ID NO: 298506 - RNA, 24 nt, Human
ugggucccagggugcacgggaucc

SEQ ID NO: 298507 - RNA, 23 nt, Human
uuuuuuuuuuuuuuuugcuucag

SEQ ID NO: 298508 - RNA, 21 nt, Human
uuuuuuuuuuuuuuuuugcuu

SEQ ID NO: 298509 - RNA, 20 nt, Human
uuuuuuuuuuuuuuuuuugg

SEQ ID NO: 298510 - RNA, 22 nt, Human
aaaaaauacuccugucgccucu

SEQ ID NO: 298511 - RNA, 22 nt, Human
aaaauacuccugucgccucuca

SEQ ID NO: 298512 - RNA, 22 nt, Human
aaacugguuuaaaaagaccuuu

SEQ ID NO: 298513 - RNA, 21 nt, Human
aaauucaaaacaucgcucccc

SEQ ID NO: 298514 - RNA, 22 nt, Human
aacacauuaaugacaucaaacu

SEQ ID NO: 298515 - RNA, 22 nt, Human
aacgugccccuuucaccuccca

SEQ ID NO: 298516 - RNA, 21 nt, Human
aaguagcugauaaguugcuuu

SEQ ID NO: 298517 - RNA, 30 nt, Human
aauacacauacacacauuauagguauaugg

SEQ ID NO: 298518 - RNA, 18 nt, Human
aaucugcauuuucagcuc

SEQ ID NO: 298519 - RNA, 18 nt, Human
aaugacaucaaacugugg

SEQ ID NO: 298520 - RNA, 18 nt, Human
acacauauauacacacau

SEQ ID NO: 298521 - RNA, 24 nt, Human
acacccuguccucagcuuugauuu

SEQ ID NO: 298522 - RNA, 24 nt, Human
acagagagcugaaaaauuacagag

SEQ ID NO: 298523 - RNA, 24 nt, Human
acagccccuuguuugagaccaugg

SEQ ID NO: 298524 - RNA, 23 nt, Human
agaaagagacugaacagggucuu

SEQ ID NO: 298525 - RNA, 22 nt, Human
agaaagagcgaguguaggucug

SEQ ID NO: 298526 - RNA, 18 nt, Human
agaggcggagcuggggag

SEQ ID NO: 298527 - RNA, 22 nt, Human
agccccuuguuugagaccaugg

SEQ ID NO: 298528 - RNA, 20 nt, Human
agcuaugugaggagccccag

SEQ ID NO: 298529 - RNA, 21 nt, Human
agcuggggagggagggcggug

SEQ ID NO: 298530 - RNA, 19 nt, Human
aggauaucacccauuugaa

SEQ ID NO: 298531 - RNA, 24 nt, Human
aggugccugccugaaacguggagc

SEQ ID NO: 298532 - RNA, 22 nt, Human
aguguauguauauauacacaua

SEQ ID NO: 298533 - RNA, 20 nt, Human
auagagaccaaauauuuaua

SEQ ID NO: 298534 - RNA, 20 nt, Human
auguauauauacacauauau

SEQ ID NO: 298535 - RNA, 23 nt, Human
caacaaguaauaaauuucuuuua

SEQ ID NO: 298536 - RNA, 24 nt, Human
caacuggagaacuaugugaagaua

SEQ ID NO: 298537 - RNA, 27 nt, Human
cacauguauauagucuacauauguaua

SEQ ID NO: 298538 - RNA, 19 nt, Human
caccucccaugacucuucc

SEQ ID NO: 298539 - RNA, 21 nt, Human
cagauuucucucuuaaagugg

SEQ ID NO: 298540 - RNA, 22 nt, Human
cauauauacacacauguauaua

SEQ ID NO: 298541 - RNA, 20 nt, Human
caucaaacugugggggagua

SEQ ID NO: 298542 - RNA, 18 nt, Human
cauuucuugggaauggau

SEQ ID NO: 298543 - RNA, 21 nt, Human
ccgggacagaggccuuuuucc

SEQ ID NO: 298544 - RNA, 24 nt, Human
cgaggacagaggcggagcugggga

SEQ ID NO: 298545 - RNA, 20 nt, Human
cggagcaggggacucggagg

SEQ ID NO: 298546 - RNA, 26 nt, Human
cggauuuuaacauaacucagagcaga

SEQ ID NO: 298547 - RNA, 19 nt, Human
cggcccggcgcgcgggcag

SEQ ID NO: 298548 - RNA, 19 nt, Human
cucacacccuguccucagc

SEQ ID NO: 298549 - RNA, 19 nt, Human
cucagaaacaaaaaaaaaa

SEQ ID NO: 298550 - RNA, 20 nt, Human
cucagaaacaaaaaaaaaaa

SEQ ID NO: 298551 - RNA, 19 nt, Human
cugaaaaauuacagaggug

SEQ ID NO: 298552 - RNA, 19 nt, Human
cuggaggggaagccgugca

SEQ ID NO: 298553 - RNA, 30 nt, Human
cugugugcacuuauacacacaugcacacag

SEQ ID NO: 298554 - RNA, 25 nt, Human
cuuauacacacaugcacacauaaug

SEQ ID NO: 298555 - RNA, 21 nt, Human
cuucucucaccuccuucaggc

SEQ ID NO: 298556 - RNA, 27 nt, Human
gacugugugcuuuccucacagaggucu

SEQ ID NO: 298557 - RNA, 26 nt, Human
gagcagcagcuggugagaagggcgcc

SEQ ID NO: 298558 - RNA, 21 nt, Human
gagcagcagcuggugagagca

SEQ ID NO: 298559 - RNA, 18 nt, Human
gaucagauugagacaccu

SEQ ID NO: 298560 - RNA, 24 nt, Human
gcaaaaaaugaaauagaggggacc

SEQ ID NO: 298561 - RNA, 19 nt, Human
gccucucacucagaucaga

SEQ ID NO: 298562 - RNA, 20 nt, Human
gcucuguguugcuggcuuga

SEQ ID NO: 298563 - RNA, 25 nt, Human
gcugaagacaaagcauuucuuggga

SEQ ID NO: 298564 - RNA, 23 nt, Human
ggacagaggcggagcuggggagg

SEQ ID NO: 298565 - RNA, 18 nt, Human
ggacucggagggagggug

SEQ ID NO: 298566 - RNA, 19 nt, Human
ggacucggagggagggugc

SEQ ID NO: 298567 - RNA, 19 nt, Human
ggagccccagaaaauuggg

SEQ ID NO: 298568 - RNA, 24 nt, Human
ggagggcggugggaaaggcggaug

SEQ ID NO: 298569 - RNA, 21 nt, Human
ggcaggggugcgaaugugggg

SEQ ID NO: 298570 - RNA, 19 nt, Human
ggggagggagggcgguggg

SEQ ID NO: 298571 - RNA, 19 nt, Human
gguauauguguauauacau

SEQ ID NO: 298572 - RNA, 19 nt, Human
gguugcauguuaaaugguc

SEQ ID NO: 298573 - RNA, 23 nt, Human
guaggucacuuugguaaugucua

SEQ ID NO: 298574 - RNA, 18 nt, Human
guauagagaaagagacug

SEQ ID NO: 298575 - RNA, 19 nt, Human
guguauguauauauacaca

SEQ ID NO: 298576 - RNA, 19 nt, Human
guguauguauauauacaca

SEQ ID NO: 298577 - RNA, 24 nt, Human
guuugagaccauggacaauuguuc

SEQ ID NO: 298578 - RNA, 23 nt, Human
uaaauacacauacacacauuaua

SEQ ID NO: 298579 - RNA, 19 nt, Human
uaaaugacuauaaauaacu

SEQ ID NO: 298580 - RNA, 18 nt, Human
uaaauuacaccacaccug

SEQ ID NO: 298581 - RNA, 18 nt, Human
uaagcucucugcucccac

SEQ ID NO: 298582 - RNA, 24 nt, Human
uaaucuacaucccugguaaaucuc

SEQ ID NO: 298583 - RNA, 25 nt, Human
uacacacaugcacacauaauguccu

SEQ ID NO: 298584 - RNA, 19 nt, Human
uacacacauguauauaguc

SEQ ID NO: 298585 - RNA, 25 nt, Human
uacacacauguauauagucuacaua

SEQ ID NO: 298586 - RNA, 21 nt, Human
uacacauauauacacacaugu

SEQ ID NO: 298587 - RNA, 22 nt, Human
uacguucuuuucucagaaacaa

SEQ ID NO: 298588 - RNA, 24 nt, Human
uacguucuuuucucagaaacaaaa

SEQ ID NO: 298589 - RNA, 21 nt, Human
uauacaaguguauguauauau

SEQ ID NO: 298590 - RNA, 24 nt, Human
uauacaaguguauguauauauaca

SEQ ID NO: 298591 - RNA, 19 nt, Human
uauacacacauguauauag

SEQ ID NO: 298592 - RNA, 25 nt, Human
uauacacauauauacacacauguag

SEQ ID NO: 298593 - RNA, 20 nt, Human
uauagguauauguguauaua

SEQ ID NO: 298594 - RNA, 25 nt, Human
uauauacacacauguauauagucua

SEQ ID NO: 298595 - RNA, 32 nt, Human
uauauacacauauauacacacauguauauagu

SEQ ID NO: 298596 - RNA, 27 nt, Human
uauauagucuacauauguauauauuac

SEQ ID NO: 298597 - RNA, 22 nt, Human
uauauauacacauauauacaca

SEQ ID NO: 298598 - RNA, 25 nt, Human
uauauauacacauauauacacacau

SEQ ID NO: 298599 - RNA, 24 nt, Human
uauauguguauauacauuuauaca

SEQ ID NO: 298600 - RNA, 22 nt, Human
uauguauauauacacauauaua

SEQ ID NO: 298601 - RNA, 24 nt, Human
uauguauauauacacauauauaca

SEQ ID NO: 298602 - RNA, 22 nt, Human
uauguauauauauuucugugug

SEQ ID NO: 298603 - RNA, 18 nt, Human
uauuuggggcauagagua

SEQ ID NO: 298604 - RNA, 19 nt, Human
ucuacauauguauauauau

SEQ ID NO: 298605 - RNA, 23 nt, Human
ucucacuaaauucaaaacaucgc

SEQ ID NO: 298606 - RNA, 23 nt, Human
ucucuggguaggucacuuuggua

SEQ ID NO: 298607 - RNA, 21 nt, Human
ucuggagcauaauguuuuauu

SEQ ID NO: 298608 - RNA, 18 nt, Human
ugacugugugcuuuccuc

SEQ ID NO: 298609 - RNA, 18 nt, Human
ugagacaccucaaaguga

SEQ ID NO: 298610 - RNA, 18 nt, Human
ugagaccauggacaauug

SEQ ID NO: 298611 - RNA, 24 nt, Human
ugcuuauaaaauuuugucacaggg

SEQ ID NO: 298612 - RNA, 20 nt, Human
uggccaccuucagggaauug

SEQ ID NO: 298613 - RNA, 18 nt, Human
uggcggagcaggggacuc

SEQ ID NO: 298614 - RNA, 20 nt, Human
uggcuggaggggaagccgug

SEQ ID NO: 298615 - RNA, 20 nt, Human
ugggaauggaugugcauugg

SEQ ID NO: 298616 - RNA, 19 nt, Human
uggggagggagggcggugg

SEQ ID NO: 298617 - RNA, 19 nt, Human
uggggagggagggcggugg

SEQ ID NO: 298618 - RNA, 23 nt, Human
ugguaaaucucacuaaauucaaa

SEQ ID NO: 298619 - RNA, 20 nt, Human
uguaaaaaaaaaaaaauacu

SEQ ID NO: 298620 - RNA, 18 nt, Human
uguauauagucuacauau

SEQ ID NO: 298621 - RNA, 24 nt, Human
uguauguauauauacacauauaua

SEQ ID NO: 298622 - RNA, 21 nt, Human
ugugaaaugaauuuucgauga

SEQ ID NO: 298623 - RNA, 20 nt, Human
uguguguucuccagcaucug

SEQ ID NO: 298624 - RNA, 26 nt, Human
uucaauaaauacacauacacacauua

SEQ ID NO: 298625 - RNA, 21 nt, Human
uucagauuucucucuuaaagu

SEQ ID NO: 298626 - RNA, 24 nt, Human
uugagaccauggacaauuguucuu

SEQ ID NO: 298627 - RNA, 24 nt, Human
uugaugaacauuuucaccugaauu

SEQ ID NO: 298628 - RNA, 25 nt, Human
uugaugcuaaaucugcauuuucagc

SEQ ID NO: 298629 - RNA, 21 nt, Human
uuggagucacucuauguggcu

SEQ ID NO: 298630 - RNA, 23 nt, Human
uuuaaaauacguucuuuucucag

SEQ ID NO: 298631 - RNA, 19 nt, Human
uuuucagcuccuccucagc

SEQ ID NO: 298632 - RNA, 23 nt, Human
uuuuuuuuuuuuuuuuuuucagg

SEQ ID NO: 298633 - RNA, 20 nt, Human
acuaacuucuccggccugcg

SEQ ID NO: 298634 - RNA, 22 nt, Human
agaugaccagcgggagcgguac

SEQ ID NO: 298635 - RNA, 24 nt, Human
aggaacaaagaaaucuaagauggc

SEQ ID NO: 298636 - RNA, 21 nt, Human
aggaggaggcugaguggggcg

SEQ ID NO: 298637 - RNA, 21 nt, Human
caaagaaaucuaagauggcug

SEQ ID NO: 298638 - RNA, 19 nt, Human
cagccccgggccgccgcag

SEQ ID NO: 298639 - RNA, 21 nt, Human
cagcgagccuuacgccggcuc

SEQ ID NO: 298640 - RNA, 25 nt, Human
caggcagcgaccgggcgcccccucu

SEQ ID NO: 298641 - RNA, 19 nt, Human
ccagcgggagcgguacagg

SEQ ID NO: 298642 - RNA, 18 nt, Human
ccccgagcgcggcggaga

SEQ ID NO: 298643 - RNA, 19 nt, Human
ccccgggccgccgcagcuc

SEQ ID NO: 298644 - RNA, 18 nt, Human
ccccgggcgaucggcagg

SEQ ID NO: 298645 - RNA, 19 nt, Human
cccggcgccucgcugcucc

SEQ ID NO: 298646 - RNA, 22 nt, Human
ccgccgcagcucgcagccccgg

SEQ ID NO: 298647 - RNA, 20 nt, Human
ccggcagggagcagagcagc

SEQ ID NO: 298648 - RNA, 28 nt, Human
ccggcccguggggcgcucggccaccugg

SEQ ID NO: 298649 - RNA, 22 nt, Human
ccggggcccccgagcgcggcgg

SEQ ID NO: 298650 - RNA, 21 nt, Human
ccuagaccaucccuggggcug

SEQ ID NO: 298651 - RNA, 23 nt, Human
ccugcgccgcccggcgagcagcc

SEQ ID NO: 298652 - RNA, 19 nt, Human
ccugugcucccagcucucc

SEQ ID NO: 298653 - RNA, 21 nt, Human
ccugugcucccagcucuccgg

SEQ ID NO: 298654 - RNA, 18 nt, Human
cggcaggaggcggcuagc

SEQ ID NO: 298655 - RNA, 18 nt, Human
cggcuccuagaccauccc

SEQ ID NO: 298656 - RNA, 18 nt, Human
cgggcgcccccucugcug

SEQ ID NO: 298657 - RNA, 21 nt, Human
cgggcguccuccgcaguuggg

SEQ ID NO: 298658 - RNA, 21 nt, Human
cuagccccggcagggagcaga

SEQ ID NO: 298659 - RNA, 19 nt, Human
gagcgcggcggagaugacc

SEQ ID NO: 298660 - RNA, 18 nt, Human
gcagccccgggcgaucgg

SEQ ID NO: 298661 - RNA, 19 nt, Human
gcagccccgggcgaucggc

SEQ ID NO: 298662 - RNA, 24 nt, Human
gccccggcagggagcagagcagcg

SEQ ID NO: 298663 - RNA, 23 nt, Human
gccccgggccgccgcagcucgca

SEQ ID NO: 298664 - RNA, 24 nt, Human
gcgccgcccggcgagcagccccgg

SEQ ID NO: 298665 - RNA, 21 nt, Human
gcucgcuugcucgcucccagc

SEQ ID NO: 298666 - RNA, 22 nt, Human
gcugccgggaccugugcuccca

SEQ ID NO: 298667 - RNA, 18 nt, Human
ggagaugaccagcgggag

SEQ ID NO: 298668 - RNA, 24 nt, Human
ggaggcugaguggggcgggcgucc

SEQ ID NO: 298669 - RNA, 19 nt, Human
ggccgccgcagcucgcagc

SEQ ID NO: 298670 - RNA, 20 nt, Human
gggaccugugcucccagcuc

SEQ ID NO: 298671 - RNA, 23 nt, Human
guggggcgggcguccuccgcagu

SEQ ID NO: 298672 - RNA, 19 nt, Human
ucccuggggcugccgggac

SEQ ID NO: 298673 - RNA, 23 nt, Human
uccuagaccaucccuggggcugc

SEQ ID NO: 298674 - RNA, 19 nt, Human
ucggcaggaggcggcuagc

SEQ ID NO: 298675 - RNA, 21 nt, Human
ucggcaggaggcggcuagccc

SEQ ID NO: 298676 - RNA, 19 nt, Human
ucuccggccugcgccgccc

SEQ ID NO: 298677 - RNA, 22 nt, Human
ugcuggcccgggcuccaaacgc

SEQ ID NO: 298678 - RNA, 23 nt, Human
aaaaaaaaaaaacaaugaaugaa

SEQ ID NO: 298679 - RNA, 20 nt, Human
aaaaaaaacaaaaaucucau

SEQ ID NO: 298680 - RNA, 21 nt, Human
aaacaaaaaaaggcccacaca

SEQ ID NO: 298681 - RNA, 20 nt, Human
aaacaaacaaaaaaaggccc

SEQ ID NO: 298682 - RNA, 20 nt, Human
aaacaaacaaaaaaaggccc

SEQ ID NO: 298683 - RNA, 23 nt, Human
aacccaaccccccaaacccacua

SEQ ID NO: 298684 - RNA, 22 nt, Human
aacugcccccuccccucgugcc

SEQ ID NO: 298685 - RNA, 19 nt, Human
aagaguggggccccccacc

SEQ ID NO: 298686 - RNA, 23 nt, Human
aagaguuauuggccuuuaccacc

SEQ ID NO: 298687 - RNA, 19 nt, Human
aagcaggcagaggaugccu

SEQ ID NO: 298688 - RNA, 20 nt, Human
aagcaggcagaggaugccuc

SEQ ID NO: 298689 - RNA, 20 nt, Human
aagcaggcagaggaugccuc

SEQ ID NO: 298690 - RNA, 21 nt, Human
aagccggagacggcaccaggg

SEQ ID NO: 298691 - RNA, 23 nt, Human
aagccggagacggcaccagggag

SEQ ID NO: 298692 - RNA, 22 nt, Human
aaguuugcuagcgccuagguga

SEQ ID NO: 298693 - RNA, 24 nt, Human
acaaaaaaaggcccacacaauaug

SEQ ID NO: 298694 - RNA, 21 nt, Human
acaaacaaaaaaaggcccaca

SEQ ID NO: 298695 - RNA, 21 nt, Human
acaccccccucccccaacccu

SEQ ID NO: 298696 - RNA, 19 nt, Human
acagagacagacagaccaa

SEQ ID NO: 298697 - RNA, 23 nt, Human
acaggccaauggguggguugaca

SEQ ID NO: 298698 - RNA, 21 nt, Human
acccaaccccccaaacccacu

SEQ ID NO: 298699 - RNA, 22 nt, Human
accccucacaccccccuccccc

SEQ ID NO: 298700 - RNA, 19 nt, Human
accccugcccucccacccc

SEQ ID NO: 298701 - RNA, 24 nt, Human
accuggcgcgucaaucaccacucg

SEQ ID NO: 298702 - RNA, 19 nt, Human
acugcccccuccccucgug

SEQ ID NO: 298703 - RNA, 22 nt, Human
agacagacagaccaagugaagg

SEQ ID NO: 298704 - RNA, 25 nt, Human
agacaggccaauggguggguugaca

SEQ ID NO: 298705 - RNA, 18 nt, Human
agccgcugccugcugggg

SEQ ID NO: 298706 - RNA, 22 nt, Human
agcuacgggacugcaggagaga

SEQ ID NO: 298707 - RNA, 20 nt, Human
aggaaaaaagacaaaugaag

SEQ ID NO: 298708 - RNA, 22 nt, Human
aggaacccaaccccccaaaccc

SEQ ID NO: 298709 - RNA, 24 nt, Human
aggaacccaaccccccaaacccac

SEQ ID NO: 298710 - RNA, 24 nt, Human
aggaggaggcggcggcggcggcgg

SEQ ID NO: 298711 - RNA, 21 nt, Human
aggcagagaguaagcagggaa

SEQ ID NO: 298712 - RNA, 20 nt, Human
aggcaggaaagcaggcagag

SEQ ID NO: 298713 - RNA, 22 nt, Human
aggcaggaaagcaggcagagga

SEQ ID NO: 298714 - RNA, 27 nt, Human
aggcaggaaagcaggcagaggggaccc

SEQ ID NO: 298715 - RNA, 20 nt, Human
aggcagguggggcaggcagg

SEQ ID NO: 298716 - RNA, 23 nt, Human
aggcggcggcggcggcgguggcu

SEQ ID NO: 298717 - RNA, 18 nt, Human
aggcuggcacggccaugc

SEQ ID NO: 298718 - RNA, 24 nt, Human
agggucuggugaugaucaggguuc

SEQ ID NO: 298719 - RNA, 22 nt, Human
aggugaacauggcucaggcagg

SEQ ID NO: 298720 - RNA, 22 nt, Human
aguggcggcggaucccagggcc

SEQ ID NO: 298721 - RNA, 23 nt, Human
augaaacaaacaaaaaaaggccc

SEQ ID NO: 298722 - RNA, 21 nt, Human
caaaaaaaggcccacacaaua

SEQ ID NO: 298723 - RNA, 22 nt, Human
caaacaaaaaaaggcccacaca

SEQ ID NO: 298724 - RNA, 25 nt, Human
caaaugaagcacucaguucuagucc

SEQ ID NO: 298725 - RNA, 20 nt, Human
caacaccugggcacaacccc

SEQ ID NO: 298726 - RNA, 22 nt, Human
caacaccugggcacaaccccuc

SEQ ID NO: 298727 - RNA, 25 nt, Human
caacaccugggcacaaccccucaca

SEQ ID NO: 298728 - RNA, 19 nt, Human
caaccccucacaccccccu

SEQ ID NO: 298729 - RNA, 19 nt, Human
caaggggacugggcugggg

SEQ ID NO: 298730 - RNA, 20 nt, Human
cacaaccccucacacccccc

SEQ ID NO: 298731 - RNA, 22 nt, Human
cacaccccccucccccaacccu

SEQ ID NO: 298732 - RNA, 18 nt, Human
caccccccucccccaacc

SEQ ID NO: 298733 - RNA, 20 nt, Human
caccccccucccccaacccu

SEQ ID NO: 298734 - RNA, 21 nt, Human
caccccccucccccaacccug

SEQ ID NO: 298735 - RNA, 23 nt, Human
caccccccucccccaacccugcu

SEQ ID NO: 298736 - RNA, 18 nt, Human
caccccugcccucccacc

SEQ ID NO: 298737 - RNA, 21 nt, Human
caccccugcccucccacccca

SEQ ID NO: 298738 - RNA, 25 nt, Human
caccccugcccucccaccccauuuc

SEQ ID NO: 298739 - RNA, 22 nt, Human
caccuuguccauuucccagagu

SEQ ID NO: 298740 - RNA, 21 nt, Human
cagagacagacagaccaagug

SEQ ID NO: 298741 - RNA, 23 nt, Human
caggcgcccgucccaguagucuu

SEQ ID NO: 298742 - RNA, 18 nt, Human
cagggccccagggcuuag

SEQ ID NO: 298743 - RNA, 19 nt, Human
cauugucaccaucuugucu

SEQ ID NO: 298744 - RNA, 24 nt, Human
ccaaccccccaaacccacuaggag

SEQ ID NO: 298745 - RNA, 24 nt, Human
ccaacccugcuugugcacauaugc

SEQ ID NO: 298746 - RNA, 20 nt, Human
ccaagccggagacggcacca

SEQ ID NO: 298747 - RNA, 21 nt, Human
ccacacaauaugaggcaggug

SEQ ID NO: 298748 - RNA, 20 nt, Human
ccacacgcaggggguggggc

SEQ ID NO: 298749 - RNA, 19 nt, Human
ccaccccugcccucccacc

SEQ ID NO: 298750 - RNA, 22 nt, Human
ccagccgcugccugcuggggcc

SEQ ID NO: 298751 - RNA, 24 nt, Human
cccaaccccccaaacccacuagga

SEQ ID NO: 298752 - RNA, 21 nt, Human
cccaacugcccccuccccucg

SEQ ID NO: 298753 - RNA, 18 nt, Human
cccaccccauuucagggc

SEQ ID NO: 298754 - RNA, 18 nt, Human
cccacuaggagggcuccc

SEQ ID NO: 298755 - RNA, 23 nt, Human
ccccaaacccacuaggagggcuc

SEQ ID NO: 298756 - RNA, 19 nt, Human
ccccagaucccccugcaac

SEQ ID NO: 298757 - RNA, 19 nt, Human
cccccucccccaacccugc

SEQ ID NO: 298758 - RNA, 18 nt, Human
ccccgcccaacugccccc

SEQ ID NO: 298759 - RNA, 24 nt, Human
ccccgcccaacugcccccuccccu

SEQ ID NO: 298760 - RNA, 18 nt, Human
ccccugcccucccacccc

SEQ ID NO: 298761 - RNA, 20 nt, Human
cccgcucagccggccaugag

SEQ ID NO: 298762 - RNA, 19 nt, Human
cccguccgcagcgggaggg

SEQ ID NO: 298763 - RNA, 18 nt, Human
cccucccaccccauuuca

SEQ ID NO: 298764 - RNA, 21 nt, Human
cccugcccugccucacccucc

SEQ ID NO: 298765 - RNA, 23 nt, Human
cccugcccugccucacccucccc

SEQ ID NO: 298766 - RNA, 24 nt, Human
cccugcccugccucacccucccca

SEQ ID NO: 298767 - RNA, 19 nt, Human
cccugccucacccucccca

SEQ ID NO: 298768 - RNA, 18 nt, Human
cccuugaggugcuugggg

SEQ ID NO: 298769 - RNA, 18 nt, Human
ccgcagcgggaggggacg

SEQ ID NO: 298770 - RNA, 19 nt, Human
ccgcgcgcgccgcgcuccg

SEQ ID NO: 298771 - RNA, 27 nt, Human
ccgggaugaggccgcgcgaccuccuuc

SEQ ID NO: 298772 - RNA, 23 nt, Human
ccgucccaguagucuucagccau

SEQ ID NO: 298773 - RNA, 21 nt, Human
ccucacaccccccucccccaa

SEQ ID NO: 298774 - RNA, 24 nt, Human
ccucacaccccccucccccaaccc

SEQ ID NO: 298775 - RNA, 22 nt, Human
ccuccagccgcugccugcuggg

SEQ ID NO: 298776 - RNA, 22 nt, Human
ccucccaccccauuucagggcc

SEQ ID NO: 298777 - RNA, 22 nt, Human
ccugcaacuggggauggcgggc

SEQ ID NO: 298778 - RNA, 27 nt, Human
ccugcccugccucacccuccccaggag

SEQ ID NO: 298779 - RNA, 18 nt, Human
ccugccucacccucccca

SEQ ID NO: 298780 - RNA, 19 nt, Human
ccugggcuagcucuggacc

SEQ ID NO: 298781 - RNA, 19 nt, Human
ccuggggcggcggcccggg

SEQ ID NO: 298782 - RNA, 22 nt, Human
cgcagcgggaggggacgcggcc

SEQ ID NO: 298783 - RNA, 18 nt, Human
cggcgcggcggcgccugg

SEQ ID NO: 298784 - RNA, 19 nt, Human
cggcggcgccuggggcggc

SEQ ID NO: 298785 - RNA, 25 nt, Human
cggcggcgccuggggcggcggcccg

SEQ ID NO: 298786 - RNA, 23 nt, Human
cggcuugaauccgagugcucacg

SEQ ID NO: 298787 - RNA, 22 nt, Human
cgggcggggguaggaaggcgag

SEQ ID NO: 298788 - RNA, 22 nt, Human
cucacaccccccucccccaacc

SEQ ID NO: 298789 - RNA, 23 nt, Human
cucacaccccccucccccaaccc

SEQ ID NO: 298790 - RNA, 25 nt, Human
cuggaccccuggcuggccguggggu

SEQ ID NO: 298791 - RNA, 18 nt, Human
cugggcccgggccgccgc

SEQ ID NO: 298792 - RNA, 18 nt, Human
cugguaguccccagaucc

SEQ ID NO: 298793 - RNA, 24 nt, Human
gaacccaaccccccaaacccacca

SEQ ID NO: 298794 - RNA, 22 nt, Human
gaagauguaguugggggcugcc

SEQ ID NO: 298795 - RNA, 18 nt, Human
gacaggccaauggugggg

SEQ ID NO: 298796 - RNA, 19 nt, Human
gagacagacagaccaagug

SEQ ID NO: 298797 - RNA, 18 nt, Human
gaggaggaggaggcggcg

SEQ ID NO: 298798 - RNA, 29 nt, Human
gaggaggaggcggcggcggcggcggugac

SEQ ID NO: 298799 - RNA, 18 nt, Human
gaggcuguuuaguacuca

SEQ ID NO: 298800 - RNA, 23 nt, Human
gagucgagauccccagccugggc

SEQ ID NO: 298801 - RNA, 26 nt, Human
gcaacaccugggcacaaccccucaca

SEQ ID NO: 298802 - RNA, 24 nt, Human
gcacaaccccucacaccccccucc

SEQ ID NO: 298803 - RNA, 18 nt, Human
gcagcaggggacaagugg

SEQ ID NO: 298804 - RNA, 25 nt, Human
gcaggcagcaggggacaagugggca

SEQ ID NO: 298805 - RNA, 20 nt, Human
gcauugucaccaucuugucu

SEQ ID NO: 298806 - RNA, 21 nt, Human
gccacacgcaggggguggggc

SEQ ID NO: 298807 - RNA, 22 nt, Human
gccgcgcgaccuccuucuccuc

SEQ ID NO: 298808 - RNA, 20 nt, Human
gccugggcuagcucuggacc

SEQ ID NO: 298809 - RNA, 22 nt, Human
gccugggcuagcucuggacccc

SEQ ID NO: 298810 - RNA, 20 nt, Human
gcggcggcggcggcgguggc

SEQ ID NO: 298811 - RNA, 23 nt, Human
gcggcggcggcggcgguggcuuu

SEQ ID NO: 298812 - RNA, 23 nt, Human
gcggcggcggcgguggcugaggc

SEQ ID NO: 298813 - RNA, 24 nt, Human
gcggcggcggcgguggcugaggcg

SEQ ID NO: 298814 - RNA, 22 nt, Human
gcggcggcgguggcugaggcgg

SEQ ID NO: 298815 - RNA, 19 nt, Human
gcuagcucuggaccccugg

SEQ ID NO: 298816 - RNA, 23 nt, Human
ggaaagcaggcagaggaugccuc

SEQ ID NO: 298817 - RNA, 21 nt, Human
ggaaggcgaguggcuguggca

SEQ ID NO: 298818 - RNA, 23 nt, Human
ggacgcggccaucgcgagcccag

SEQ ID NO: 298819 - RNA, 21 nt, Human
ggcauugucaccaucuugucu

SEQ ID NO: 298820 - RNA, 24 nt, Human
ggcggcggcggcggcgguggcugg

SEQ ID NO: 298821 - RNA, 18 nt, Human
gggaugggagcaagggga

SEQ ID NO: 298822 - RNA, 30 nt, Human
gggcaggcagcaggggacaagugggcaacg

SEQ ID NO: 298823 - RNA, 18 nt, Human
ggggacugggcuggggag

SEQ ID NO: 298824 - RNA, 18 nt, Human
ggggauggcgggcggggg

SEQ ID NO: 298825 - RNA, 20 nt, Human
gggguguuugggcaggcagc

SEQ ID NO: 298826 - RNA, 23 nt, Human
gggguguuugggcaggcagcagg

SEQ ID NO: 298827 - RNA, 24 nt, Human
ggguguuugggcaggcagcagggg

SEQ ID NO: 298828 - RNA, 27 nt, Human
guggggcaggcaggaaagcaggcagag

SEQ ID NO: 298829 - RNA, 19 nt, Human
uaaccacccauccagggac

SEQ ID NO: 298830 - RNA, 22 nt, Human
uaaccacccauccagggacuga

SEQ ID NO: 298831 - RNA, 24 nt, Human
uaauuaaaaaaaaaaaaaacaaug

SEQ ID NO: 298832 - RNA, 18 nt, Human
uacugugggagggccaca

SEQ ID NO: 298833 - RNA, 19 nt, Human
uaggaaggcgaguggcugu

SEQ ID NO: 298834 - RNA, 23 nt, Human
uaggaaggcgaguggcuguggca

SEQ ID NO: 298835 - RNA, 22 nt, Human
uaggguggaggaaggggaggua

SEQ ID NO: 298836 - RNA, 22 nt, Human
uaguacucaguuccgaucuugg

SEQ ID NO: 298837 - RNA, 22 nt, Human
ucaaucaccacucguucccccu

SEQ ID NO: 298838 - RNA, 23 nt, Human
uccaaauaggggcugugucccug

SEQ ID NO: 298839 - RNA, 18 nt, Human
uccauuucccagagucuc

SEQ ID NO: 298840 - RNA, 23 nt, Human
ucccaccccugcccucccacccc

SEQ ID NO: 298841 - RNA, 25 nt, Human
ucccagagucucugguaguccccag

SEQ ID NO: 298842 - RNA, 19 nt, Human
ucccauagccaaucccagg

SEQ ID NO: 298843 - RNA, 20 nt, Human
uccccagaucccccugcaac

SEQ ID NO: 298844 - RNA, 21 nt, Human
uccccgcccaacugcccccuc

SEQ ID NO: 298845 - RNA, 22 nt, Human
ucccugucucugaaaggcuggg

SEQ ID NO: 298846 - RNA, 22 nt, Human
ucccuugaggugcuuggggagg

SEQ ID NO: 298847 - RNA, 22 nt, Human
ucgcugagcuggucaguuccug

SEQ ID NO: 298848 - RNA, 22 nt, Human
ucucugaaaggcugggagcagg

SEQ ID NO: 298849 - RNA, 21 nt, Human
ucucugguaguccccagaucc

SEQ ID NO: 298850 - RNA, 21 nt, Human
ucugagucgagauccccagcc

SEQ ID NO: 298851 - RNA, 19 nt, Human
ugaaacaaacaaaaaaagg

SEQ ID NO: 298852 - RNA, 22 nt, Human
ugaaacaaacaaaaaaaggccc

SEQ ID NO: 298853 - RNA, 22 nt, Human
ugaaacaaacaaaaaaaggccc

SEQ ID NO: 298854 - RNA, 24 nt, Human
ugaaugaaacaaacaaaaaaaggc

SEQ ID NO: 298855 - RNA, 20 nt, Human
ugagcuggucaguuccuggc

SEQ ID NO: 298856 - RNA, 23 nt, Human
ugagcuggucaguuccuggcagg

SEQ ID NO: 298857 - RNA, 21 nt, Human
ugaggccgcgcgaccuccuuc

SEQ ID NO: 298858 - RNA, 19 nt, Human
ugaugggggguagaccugg

SEQ ID NO: 298859 - RNA, 20 nt, Human
ugcccugccucacccucccc

SEQ ID NO: 298860 - RNA, 20 nt, Human
ugcccugugagggguguggc

SEQ ID NO: 298861 - RNA, 21 nt, Human
uggaggaaggggagguaacca

SEQ ID NO: 298862 - RNA, 21 nt, Human
uggaggcuguuuaguacucag

SEQ ID NO: 298863 - RNA, 18 nt, Human
uggcacggccaugcuguc

SEQ ID NO: 298864 - RNA, 24 nt, Human
uggcacggccaugcuguccaccgg

SEQ ID NO: 298865 - RNA, 21 nt, Human
uggcagaaguuugcuagcgcc

SEQ ID NO: 298866 - RNA, 25 nt, Human
uggcagggccccuacccaacagcac

SEQ ID NO: 298867 - RNA, 20 nt, Human
uggcucaggcagguaggcag

SEQ ID NO: 298868 - RNA, 21 nt, Human
uggcuccucgcugagcugguc

SEQ ID NO: 298869 - RNA, 24 nt, Human
uggcuguggcaugcuuucccauag

SEQ ID NO: 298870 - RNA, 18 nt, Human
ugggagcaaggggacugg

SEQ ID NO: 298871 - RNA, 20 nt, Human
ugggagcaaggggacuggaa

SEQ ID NO: 298872 - RNA, 21 nt, Human
ugggagcaaggggacugggcu

SEQ ID NO: 298873 - RNA, 24 nt, Human
ugggagcaaggggacugggcuggg

SEQ ID NO: 298874 - RNA, 19 nt, Human
ugggaugggagcaagggga

SEQ ID NO: 298875 - RNA, 19 nt, Human
uggggauggcgggcggggg

SEQ ID NO: 298876 - RNA, 22 nt, Human
uggggccccccaccuuguccau

SEQ ID NO: 298877 - RNA, 20 nt, Human
ugggguagugguccuggggg

SEQ ID NO: 298878 - RNA, 21 nt, Human
ugggguagugguccugggggc

SEQ ID NO: 298879 - RNA, 24 nt, Human
ugggguguuugggcaggcagcagg

SEQ ID NO: 298880 - RNA, 20 nt, Human
uggguugacaggccaauggu

SEQ ID NO: 298881 - RNA, 23 nt, Human
uggguugacaggccaaugguggg

SEQ ID NO: 298882 - RNA, 23 nt, Human
uggugggguguuugggcaggcag

SEQ ID NO: 298883 - RNA, 27 nt, Human
uggugggguguuugggcaggggagugc

SEQ ID NO: 298884 - RNA, 20 nt, Human
uguccauuucccagagucuc

SEQ ID NO: 298885 - RNA, 21 nt, Human
ugugggagggccacacgcagg

SEQ ID NO: 298886 - RNA, 23 nt, Human
ugugucccugucucugaaaggcu

SEQ ID NO: 298887 - RNA, 22 nt, Human
uuaaaaaaaacaaaaaucucau

SEQ ID NO: 298888 - RNA, 24 nt, Human
uuaccaccuuagcuaggacggccu

SEQ ID NO: 298889 - RNA, 19 nt, Human
uuaggguggaggaagggga

SEQ ID NO: 298890 - RNA, 23 nt, Human
uuaggguggaggaaggggaggua

SEQ ID NO: 298891 - RNA, 27 nt, Human
uuauggugcauucaggaacccaacccc

SEQ ID NO: 298892 - RNA, 22 nt, Human
uucaggaacccaaccccccaaa

SEQ ID NO: 298893 - RNA, 21 nt, Human
uuucagggccccagggcuuag

SEQ ID NO: 298894 - RNA, 24 nt, Human
uuuuaauauuucauacagcgauua

SEQ ID NO: 298895 - RNA, 19 nt, Human
uuuuuuuuuuuuucacuuu

SEQ ID NO: 298896 - RNA, 21 nt, Human
uuuuuuuuuuuuucacuuuag

SEQ ID NO: 298897 - RNA, 23 nt, Human
uuuuuuuuuuuuuuuuucacuuu

SEQ ID NO: 298898 - RNA, 26 nt, Human
uuuuuuuuuuuuuuuuucacuuuaau

SEQ ID NO: 298899 - RNA, 26 nt, Human
uuuuuuuuuuuuuuuuuucacuuuag

SEQ ID NO: 298900 - RNA, 27 nt, Human
aaagaagaaacagccguggccagaagg

SEQ ID NO: 298901 - RNA, 24 nt, Human
aagaagaaacagccguggccagaa

SEQ ID NO: 298902 - RNA, 21 nt, Human
aagaggagguagaagggaggg

SEQ ID NO: 298903 - RNA, 23 nt, Human
aaggggccagaaagggggacuac

SEQ ID NO: 298904 - RNA, 22 nt, Human
acaaagaagaaacagccguggc

SEQ ID NO: 298905 - RNA, 18 nt, Human
acaguaccguggggagga

SEQ ID NO: 298906 - RNA, 21 nt, Human
agaaaggcgaggcuggccucc

SEQ ID NO: 298907 - RNA, 25 nt, Human
agaagggaggggaagggagggagug

SEQ ID NO: 298908 - RNA, 21 nt, Human
agagaagcugcaaccugagcu

SEQ ID NO: 298909 - RNA, 21 nt, Human
agccacaagggcugggaagga

SEQ ID NO: 298910 - RNA, 19 nt, Human
aggcaggagccggucacag

SEQ ID NO: 298911 - RNA, 19 nt, Human
agggaggggaagggaggga

SEQ ID NO: 298912 - RNA, 21 nt, Human
aggggcugggggaagcuggua

SEQ ID NO: 298913 - RNA, 22 nt, Human
agggggccuggguagaaaggcg

SEQ ID NO: 298914 - RNA, 23 nt, Human
agggguugguaugcaggugaggg

SEQ ID NO: 298915 - RNA, 21 nt, Human
aggugggcagggcagggggcc

SEQ ID NO: 298916 - RNA, 18 nt, Human
caacuccauucagacuga

SEQ ID NO: 298917 - RNA, 22 nt, Human
cacacauguggguaccuaggau

SEQ ID NO: 298918 - RNA, 23 nt, Human
cacagcugggcauccaagcaugc

SEQ ID NO: 298919 - RNA, 24 nt, Human
cacagcugggcauccaagcaugcc

SEQ ID NO: 298920 - RNA, 24 nt, Human
cacaguaccguggggaggagugga

SEQ ID NO: 298921 - RNA, 26 nt, Human
cacccaggcuuccagcccccggaggc

SEQ ID NO: 298922 - RNA, 18 nt, Human
caccugccagguggggua

SEQ ID NO: 298923 - RNA, 18 nt, Human
cagagugcccauccuggc

SEQ ID NO: 298924 - RNA, 22 nt, Human
cagagugcccauccuggcgccu

SEQ ID NO: 298925 - RNA, 19 nt, Human
cagccaugguucaagccag

SEQ ID NO: 298926 - RNA, 19 nt, Human
cagccggguccuuugcucc

SEQ ID NO: 298927 - RNA, 23 nt, Human
cagcuuaugccagccccaacgug

SEQ ID NO: 298928 - RNA, 25 nt, Human
cagggaagcagcuuaugccagcccc

SEQ ID NO: 298929 - RNA, 21 nt, Human
cagggcagggggccuggguag

SEQ ID NO: 298930 - RNA, 23 nt, Human
caugugaucucuugucccuuggc

SEQ ID NO: 298931 - RNA, 21 nt, Human
ccaagcaugccagcaaagcgu

SEQ ID NO: 298932 - RNA, 21 nt, Human
ccacgcaggugcccaaacacc

SEQ ID NO: 298933 - RNA, 23 nt, Human
ccacgcaggugcccaaacaccag

SEQ ID NO: 298934 - RNA, 20 nt, Human
cccaggcgcaccgcccgcgg

SEQ ID NO: 298935 - RNA, 20 nt, Human
ccccugcuccggaaagguga

SEQ ID NO: 298936 - RNA, 18 nt, Human
cccgcuccuccgaccucc

SEQ ID NO: 298937 - RNA, 24 nt, Human
cccgcuccuccgaccucccccuuc

SEQ ID NO: 298938 - RNA, 18 nt, Human
cccggcgccgcggugccc

SEQ ID NO: 298939 - RNA, 25 nt, Human
cccggcgccgcggugcccgcuccuc

SEQ ID NO: 298940 - RNA, 22 nt, Human
cccugaccaggccuggcuaauc

SEQ ID NO: 298941 - RNA, 19 nt, Human
ccgcggugcgcccgcuccc

SEQ ID NO: 298942 - RNA, 23 nt, Human
ccgggcacggggcagcuuccccu

SEQ ID NO: 298943 - RNA, 21 nt, Human
ccuaggauuccagggucccag

SEQ ID NO: 298944 - RNA, 20 nt, Human
ccuccccuuggccugugcca

SEQ ID NO: 298945 - RNA, 27 nt, Human
ccuccgaccucccccuuccucccaggc

SEQ ID NO: 298946 - RNA, 22 nt, Human
ccuccgagggccacacaggcuc

SEQ ID NO: 298947 - RNA, 20 nt, Human
ccugagcuggcgaagaggag

SEQ ID NO: 298948 - RNA, 18 nt, Human
ccuggcuaaucagagccc

SEQ ID NO: 298949 - RNA, 20 nt, Human
ccuguauccagggcagagug

SEQ ID NO: 298950 - RNA, 24 nt, Human
ccugucguggccgcccucuggggu

SEQ ID NO: 298951 - RNA, 22 nt, Human
cgagccuucgggagcugagguc

SEQ ID NO: 298952 - RNA, 19 nt, Human
cggaaaggugagcaguucc

SEQ ID NO: 298953 - RNA, 22 nt, Human
cggaggcaagccucucagcauc

SEQ ID NO: 298954 - RNA, 20 nt, Human
cuacccgaauuugugcucca

SEQ ID NO: 298955 - RNA, 20 nt, Human
cuacuggggaggcacacggg

SEQ ID NO: 298956 - RNA, 22 nt, Human
cucagaggggaaaaagaugaaa

SEQ ID NO: 298957 - RNA, 22 nt, Human
cucccugucguggccgcccucu

SEQ ID NO: 298958 - RNA, 19 nt, Human
cucugcauaucugggugcc

SEQ ID NO: 298959 - RNA, 26 nt, Human
cuggcaccagugucagggugacucug

SEQ ID NO: 298960 - RNA, 23 nt, Human
cuggccuccccuuggccugugcc

SEQ ID NO: 298961 - RNA, 24 nt, Human
cugggggauacagaggggagccuu

SEQ ID NO: 298962 - RNA, 18 nt, Human
cugggguggcaggggcug

SEQ ID NO: 298963 - RNA, 18 nt, Human
cuguauccagggcagagu

SEQ ID NO: 298964 - RNA, 21 nt, Human
cuuccagcccccggaggcaag

SEQ ID NO: 298965 - RNA, 19 nt, Human
gaaggaaggauggggaggc

SEQ ID NO: 298966 - RNA, 23 nt, Human
gagggugggggccugaggugggc

SEQ ID NO: 298967 - RNA, 25 nt, Human
gagggugggggccugaggugggcag

SEQ ID NO: 298968 - RNA, 19 nt, Human
gaucagguggacagagcca

SEQ ID NO: 298969 - RNA, 21 nt, Human
gccagaaagggggacuaccaa

SEQ ID NO: 298970 - RNA, 25 nt, Human
gcccccggaggcaagccucucagca

SEQ ID NO: 298971 - RNA, 19 nt, Human
gccuggcuaaucagagccc

SEQ ID NO: 298972 - RNA, 24 nt, Human
gcggucuuccaggcuggcugucag

SEQ ID NO: 298973 - RNA, 20 nt, Human
gcggugcgcccgcucccucc

SEQ ID NO: 298974 - RNA, 19 nt, Human
ggacugggcagccgggucc

SEQ ID NO: 298975 - RNA, 23 nt, Human
ggccccggccacccaggcuuccc

SEQ ID NO: 298976 - RNA, 22 nt, Human
ggcgaagaggagguagaaggga

SEQ ID NO: 298977 - RNA, 23 nt, Human
ggcgaggcuggccuccccuuggc

SEQ ID NO: 298978 - RNA, 24 nt, Human
gggaagcugguauugggaucaggu

SEQ ID NO: 298979 - RNA, 21 nt, Human
gggcagggcagggggccuggg

SEQ ID NO: 298980 - RNA, 22 nt, Human
gggcagggcagggggccugggu

SEQ ID NO: 298981 - RNA, 22 nt, Human
gggcuggcugagguggcaggcg

SEQ ID NO: 298982 - RNA, 25 nt, Human
ggggaagcugguauugggaucaggu

SEQ ID NO: 298983 - RNA, 19 nt, Human
ggggaagggagggagugga

SEQ ID NO: 298984 - RNA, 27 nt, Human
gggggccugaggugggcagggcagggg

SEQ ID NO: 298985 - RNA, 24 nt, Human
gggguggacaggcaggagccgguc

SEQ ID NO: 298986 - RNA, 24 nt, Human
gggugggggccugaggugggcagg

SEQ ID NO: 298987 - RNA, 22 nt, Human
guggacagagccacaagggcug

SEQ ID NO: 298988 - RNA, 18 nt, Human
gugugggcuccaaggggc

SEQ ID NO: 298989 - RNA, 18 nt, Human
uacccggcgccgcggugc

SEQ ID NO: 298990 - RNA, 19 nt, Human
uaccguggggaggagugga

SEQ ID NO: 298991 - RNA, 19 nt, Human
uagaagggaggggaaggga

SEQ ID NO: 298992 - RNA, 22 nt, Human
uauuccuucuguugcuguggga

SEQ ID NO: 298993 - RNA, 18 nt, Human
ucagcccaguguugagga

SEQ ID NO: 298994 - RNA, 21 nt, Human
ucaguccuccgagggccacac

SEQ ID NO: 298995 - RNA, 20 nt, Human
uccaaggggccagaaagggg

SEQ ID NO: 298996 - RNA, 19 nt, Human
ucccacgcaggugcccaaa

SEQ ID NO: 298997 - RNA, 21 nt, Human
ucccagagaacaugccauguc

SEQ ID NO: 298998 - RNA, 22 nt, Human
ucccagagaacaugccaugucu

SEQ ID NO: 298999 - RNA, 27 nt, Human
uccccaggacccugaccaggccuggcu

SEQ ID NO: 299000 - RNA, 23 nt, Human
uccuguuccacguuccucucccu

SEQ ID NO: 299001 - RNA, 21 nt, Human
ucuacaccucucccugucgug

SEQ ID NO: 299002 - RNA, 18 nt, Human
ucugggguggcaggggcu

SEQ ID NO: 299003 - RNA, 19 nt, Human
ugagcuggcgaagaggagg

SEQ ID NO: 299004 - RNA, 22 nt, Human
ugagcuggcgaagaggagguag

SEQ ID NO: 299005 - RNA, 24 nt, Human
ugaggguaggguagggcugaugga

SEQ ID NO: 299006 - RNA, 22 nt, Human
ugaggugggcagggcagggggc

SEQ ID NO: 299007 - RNA, 23 nt, Human
ugaggugggcagggcagggggcc

SEQ ID NO: 299008 - RNA, 20 nt, Human
ugaucucuugucccuuggcc

SEQ ID NO: 299009 - RNA, 24 nt, Human
ugcaaccugagcuggcgaagagga

SEQ ID NO: 299010 - RNA, 21 nt, Human
ugcuccuguuccacguuccuc

SEQ ID NO: 299011 - RNA, 24 nt, Human
uggaaagaguggggacuacuauuc

SEQ ID NO: 299012 - RNA, 26 nt, Human
uggaaagaguggggacuacuauuccu

SEQ ID NO: 299013 - RNA, 22 nt, Human
uggagggugggggccugaggug

SEQ ID NO: 299014 - RNA, 24 nt, Human
uggagggugggggccugaggugga

SEQ ID NO: 299015 - RNA, 20 nt, Human
uggcacuaggcagguccugg

SEQ ID NO: 299016 - RNA, 21 nt, Human
uggcaggggcugggggaagcu

SEQ ID NO: 299017 - RNA, 18 nt, Human
uggcuaaucagagcccug

SEQ ID NO: 299018 - RNA, 22 nt, Human
ugggcagggcagggggccuggg

SEQ ID NO: 299019 - RNA, 21 nt, Human
ugggcgggggcuggcugaggu

SEQ ID NO: 299020 - RNA, 20 nt, Human
ugggggaggaggguagagcc

SEQ ID NO: 299021 - RNA, 20 nt, Human
ugggggccugaggugggcag

SEQ ID NO: 299022 - RNA, 18 nt, Human
uguccugggggccgcggu

SEQ ID NO: 299023 - RNA, 21 nt, Human
uucacaguaccguggggagga

SEQ ID NO: 299024 - RNA, 21 nt, Human
uuccaggcuggcugucagccc

SEQ ID NO: 299025 - RNA, 23 nt, Human
uuccagggucccagagaacaugc

SEQ ID NO: 299026 - RNA, 20 nt, Human
aaagagccagcccgcccaaa

SEQ ID NO: 299027 - RNA, 18 nt, Human
aacagcuacugauccucc

SEQ ID NO: 299028 - RNA, 21 nt, Human
aacagcuacugauccuccaca

SEQ ID NO: 299029 - RNA, 22 nt, Human
aacccauggaugcaauguuccc

SEQ ID NO: 299030 - RNA, 21 nt, Human
aagcagacgagugagcuggau

SEQ ID NO: 299031 - RNA, 20 nt, Human
acaaggcuaugcacaaagca

SEQ ID NO: 299032 - RNA, 19 nt, Human
acuuccagcagccccuccc

SEQ ID NO: 299033 - RNA, 21 nt, Human
agaaaaggcagacaacuuagg

SEQ ID NO: 299034 - RNA, 19 nt, Human
agaaacagcaggggaaggc

SEQ ID NO: 299035 - RNA, 21 nt, Human
agaagaaggcagcccagccca

SEQ ID NO: 299036 - RNA, 24 nt, Human
agaagaaggcagcccagcccagga

SEQ ID NO: 299037 - RNA, 19 nt, Human
agacagaaacagcagggga

SEQ ID NO: 299038 - RNA, 21 nt, Human
agcauagaaaacuaaaagucu

SEQ ID NO: 299039 - RNA, 20 nt, Human
aggaagcagacgagugagcu

SEQ ID NO: 299040 - RNA, 23 nt, Human
aggauggggggagcgagaaagga

SEQ ID NO: 299041 - RNA, 21 nt, Human
aggccucugauacuucuccaa

SEQ ID NO: 299042 - RNA, 25 nt, Human
agguggcacuuccagguggcacuuc

SEQ ID NO: 299043 - RNA, 22 nt, Human
aucaccucaaaucccagccuaa

SEQ ID NO: 299044 - RNA, 20 nt, Human
aucagcuccacaaagcauaa

SEQ ID NO: 299045 - RNA, 26 nt, Human
caaaucccagccuaaucagcuccaca

SEQ ID NO: 299046 - RNA, 23 nt, Human
cagcccaggauggggggagcgag

SEQ ID NO: 299047 - RNA, 21 nt, Human
caguggugggugcucuuccag

SEQ ID NO: 299048 - RNA, 24 nt, Human
ccagaaagaaaacaaacagucuga

SEQ ID NO: 299049 - RNA, 20 nt, Human
ccagcagccccucccaagcu

SEQ ID NO: 299050 - RNA, 21 nt, Human
ccagugacauauggaaaagag

SEQ ID NO: 299051 - RNA, 22 nt, Human
cccagaaagaaaacaaacaguc

SEQ ID NO: 299052 - RNA, 24 nt, Human
cccuacugaagacuuccccuccua

SEQ ID NO: 299053 - RNA, 19 nt, Human
ccuccgcccacccaucccc

SEQ ID NO: 299054 - RNA, 22 nt, Human
cuaugcacaaagcaucuuugcu

SEQ ID NO: 299055 - RNA, 22 nt, Human
cucccaagcuggaagaaaucac

SEQ ID NO: 299056 - RNA, 22 nt, Human
gaagaaggcagcccagcccagg

SEQ ID NO: 299057 - RNA, 20 nt, Human
gagaaaucauccauuuccuc

SEQ ID NO: 299058 - RNA, 24 nt, Human
gcugcaaaagagccagcccgccca

SEQ ID NO: 299059 - RNA, 21 nt, Human
ggaaaagagaaaucauccauu

SEQ ID NO: 299060 - RNA, 21 nt, Human
ggugggugcucuuccagagac

SEQ ID NO: 299061 - RNA, 18 nt, Human
uaacagcuacugauccuc

SEQ ID NO: 299062 - RNA, 20 nt, Human
uaaggcaaauggacauuggc

SEQ ID NO: 299063 - RNA, 21 nt, Human
uacccuaccaaaauucaggag

SEQ ID NO: 299064 - RNA, 20 nt, Human
uacugaagacuuccccuccu

SEQ ID NO: 299065 - RNA, 24 nt, Human
uagaaaaggcagacaacuuaggca

SEQ ID NO: 299066 - RNA, 22 nt, Human
uaguaagcaagcaaagguuucc

SEQ ID NO: 299067 - RNA, 22 nt, Human
ucaggagaaagcauagaaaacu

SEQ ID NO: 299068 - RNA, 18 nt, Human
uccacaaagcauaaggca

SEQ ID NO: 299069 - RNA, 22 nt, Human
uccacaaguaggaacgaggaaa

SEQ ID NO: 299070 - RNA, 21 nt, Human
uccagcagccccucccaagcu

SEQ ID NO: 299071 - RNA, 18 nt, Human
ucccaagcuggaagaaau

SEQ ID NO: 299072 - RNA, 19 nt, Human
ucccagccuaaucagcucc

SEQ ID NO: 299073 - RNA, 23 nt, Human
ucccagccuaaucagcuccacaa

SEQ ID NO: 299074 - RNA, 26 nt, Human
ucuuccagagacacuuccagguggca

SEQ ID NO: 299075 - RNA, 18 nt, Human
ucuugacgccucaguuuc

SEQ ID NO: 299076 - RNA, 18 nt, Human
ugagaaaaaggugcagag

SEQ ID NO: 299077 - RNA, 18 nt, Human
ugagaaaaaggugcagag

SEQ ID NO: 299078 - RNA, 21 nt, Human
ugagagguacaggcagccuuu

SEQ ID NO: 299079 - RNA, 18 nt, Human
ugagcuggaugucaggca

SEQ ID NO: 299080 - RNA, 18 nt, Human
ugagguaucccacauuaa

SEQ ID NO: 299081 - RNA, 22 nt, Human
ugcaaaagagccagcccgccca

SEQ ID NO: 299082 - RNA, 18 nt, Human
ugcacaauggaaugaucg

SEQ ID NO: 299083 - RNA, 21 nt, Human
ugcagagucauuaagccacca

SEQ ID NO: 299084 - RNA, 24 nt, Human
ugcauagaaagauacuuuuucaca

SEQ ID NO: 299085 - RNA, 21 nt, Human
uggaagaaaucacaagcugca

SEQ ID NO: 299086 - RNA, 21 nt, Human
uucaggagaaagcauagaaaa

SEQ ID NO: 299087 - RNA, 23 nt, Human
uuccagagacaucaacccaugga

SEQ ID NO: 299088 - RNA, 21 nt, Human
uuccagagacauugggugguu

SEQ ID NO: 299089 - RNA, 22 nt, Human
uuccagcagccccucccaagcu

SEQ ID NO: 299090 - RNA, 20 nt, Human
uuuuggugguagaaaaggca

SEQ ID NO: 299091 - RNA, 22 nt, Human
aacugcaacucacgcucccccg

SEQ ID NO: 299092 - RNA, 23 nt, Human
agaaagggaggacaggaaaggag

SEQ ID NO: 299093 - RNA, 19 nt, Human
agggaggacaggaaaggag

SEQ ID NO: 299094 - RNA, 22 nt, Human
ccuuagguuuaguguugggguc

SEQ ID NO: 299095 - RNA, 18 nt, Human
gaggacaggaaaggaggg

SEQ ID NO: 299096 - RNA, 24 nt, Human
uaacugcaacucacgcucccccga

SEQ ID NO: 299097 - RNA, 26 nt, Human
ugaagguaaugggacagaaagggagg

SEQ ID NO: 299098 - RNA, 24 nt, Human
uugucuuuccuuuguagcuguccu

SEQ ID NO: 299099 - RNA, 22 nt, Human
aaaaacagcaaaaacauucaaa

SEQ ID NO: 299100 - RNA, 21 nt, Human
aaaacagcaaaaacauucaaa

SEQ ID NO: 299101 - RNA, 19 nt, Human
aaagauagcagcuaccccu

SEQ ID NO: 299102 - RNA, 23 nt, Human
accccaucucccaggcacccccc

SEQ ID NO: 299103 - RNA, 25 nt, Human
accccaucucccaggcaccccccag

SEQ ID NO: 299104 - RNA, 24 nt, Human
accccucccccagucccccccccc

SEQ ID NO: 299105 - RNA, 18 nt, Human
accugucagcagcugccu

SEQ ID NO: 299106 - RNA, 21 nt, Human
agacacagcagagguccuggc

SEQ ID NO: 299107 - RNA, 22 nt, Human
agccaugacccucgaggaccca

SEQ ID NO: 299108 - RNA, 19 nt, Human
agcgcggcccagguccccg

SEQ ID NO: 299109 - RNA, 24 nt, Human
agcuaccccucccccagucccccc

SEQ ID NO: 299110 - RNA, 24 nt, Human
aggaggccccaggccauggggggc

SEQ ID NO: 299111 - RNA, 19 nt, Human
aggcaacacaguccggggc

SEQ ID NO: 299112 - RNA, 18 nt, Human
aggcaccccccagcaagg

SEQ ID NO: 299113 - RNA, 18 nt, Human
aggcucccagaugauagc

SEQ ID NO: 299114 - RNA, 20 nt, Human
aguccccccccccauccccc

SEQ ID NO: 299115 - RNA, 20 nt, Human
auggggggcuccuggccaug

SEQ ID NO: 299116 - RNA, 22 nt, Human
caaaugaaagcucuucuuaccc

SEQ ID NO: 299117 - RNA, 19 nt, Human
caacacaguccggggcugu

SEQ ID NO: 299118 - RNA, 20 nt, Human
caccggaaccggaaauagcu

SEQ ID NO: 299119 - RNA, 21 nt, Human
caccggaaccggaaauagcuu

SEQ ID NO: 299120 - RNA, 23 nt, Human
cagacaaaugaaagcucuucuua

SEQ ID NO: 299121 - RNA, 19 nt, Human
cagcgcggcccaggucccc

SEQ ID NO: 299122 - RNA, 18 nt, Human
cagggcacagggugggcg

SEQ ID NO: 299123 - RNA, 21 nt, Human
caggggcacaggcucccagau

SEQ ID NO: 299124 - RNA, 19 nt, Human
ccaguccccccccccaucc

SEQ ID NO: 299125 - RNA, 25 nt, Human
ccaucccccaaacaauuucugugcc

SEQ ID NO: 299126 - RNA, 20 nt, Human
cccaggcaccccccagcaag

SEQ ID NO: 299127 - RNA, 28 nt, Human
cccaguccccccccccaucccccaaaca

SEQ ID NO: 299128 - RNA, 20 nt, Human
ccccaaacaauuucugugcc

SEQ ID NO: 299129 - RNA, 19 nt, Human
ccccccaucccccaaacaa

SEQ ID NO: 299130 - RNA, 21 nt, Human
ccccccccccaucccccaaac

SEQ ID NO: 299131 - RNA, 19 nt, Human
cggcggcggcggcggcgcc

SEQ ID NO: 299132 - RNA, 20 nt, Human
cggcggcggcggcggcgccu

SEQ ID NO: 299133 - RNA, 21 nt, Human
cucccccagucccccccccca

SEQ ID NO: 299134 - RNA, 18 nt, Human
cugaaugagcacccaggc

SEQ ID NO: 299135 - RNA, 23 nt, Human
cugaaugagcacccaggcaacac

SEQ ID NO: 299136 - RNA, 23 nt, Human
cugacaccggaaccggaaauagc

SEQ ID NO: 299137 - RNA, 24 nt, Human
cugcggcggcggcggcggcgccuc

SEQ ID NO: 299138 - RNA, 22 nt, Human
cuuacaugcuaucuaucuacca

SEQ ID NO: 299139 - RNA, 20 nt, Human
gaaaugcuguccugcaucuu

SEQ ID NO: 299140 - RNA, 21 nt, Human
gcagggaagggcagagaggug

SEQ ID NO: 299141 - RNA, 23 nt, Human
gcggcugcggcggcggcggcggc

SEQ ID NO: 299142 - RNA, 21 nt, Human
ggcagggaagggcagagaggu

SEQ ID NO: 299143 - RNA, 23 nt, Human
ggcggcugcggcggcggcggcgg

SEQ ID NO: 299144 - RNA, 24 nt, Human
gggcagagaggugaggcccugagg

SEQ ID NO: 299145 - RNA, 22 nt, Human
ggggcuccuggccaugaggggc

SEQ ID NO: 299146 - RNA, 23 nt, Human
gggggcuccuggccaugaggggc

SEQ ID NO: 299147 - RNA, 18 nt, Human
ggggggcuccuggccaug

SEQ ID NO: 299148 - RNA, 19 nt, Human
ggguagggcugaaaauggg

SEQ ID NO: 299149 - RNA, 21 nt, Human
guggagcauguuuugccuggg

SEQ ID NO: 299150 - RNA, 21 nt, Human
ucagcagcugccuccugggac

SEQ ID NO: 299151 - RNA, 18 nt, Human
ucagucagacaggacuga

SEQ ID NO: 299152 - RNA, 27 nt, Human
ucccaggcaccccccagcaagggcucc

SEQ ID NO: 299153 - RNA, 18 nt, Human
uccugcaucuuucugucu

SEQ ID NO: 299154 - RNA, 20 nt, Human
ucuaaaaacagcaaaaacau

SEQ ID NO: 299155 - RNA, 21 nt, Human
ucucccaggcaccccccagca

SEQ ID NO: 299156 - RNA, 19 nt, Human
ucugugccaagaugaagag

SEQ ID NO: 299157 - RNA, 23 nt, Human
ugccaagaugaagaggaggcccc

SEQ ID NO: 299158 - RNA, 23 nt, Human
ugccuccugggacaaccaccccc

SEQ ID NO: 299159 - RNA, 18 nt, Human
ugccugggugccacacag

SEQ ID NO: 299160 - RNA, 20 nt, Human
uggagcauguuuugccuggu

SEQ ID NO: 299161 - RNA, 20 nt, Human
ugggacaaccacccccuuaa

SEQ ID NO: 299162 - RNA, 18 nt, Human
uggguagggcugaaaaug

SEQ ID NO: 299163 - RNA, 23 nt, Human
uggguagggcugaaaaugggcac

SEQ ID NO: 299164 - RNA, 22 nt, Human
uguccugcaucuuucugucuca

SEQ ID NO: 299165 - RNA, 28 nt, Human
aaaaaagacaaaacauaacuugaaaggg

SEQ ID NO: 299166 - RNA, 24 nt, Human
aaaaagacaaaacauaacuugaaa

SEQ ID NO: 299167 - RNA, 24 nt, Human
aagcaauauagauacuaccaaaac

SEQ ID NO: 299168 - RNA, 20 nt, Human
aagccaacugcggagaaggc

SEQ ID NO: 299169 - RNA, 22 nt, Human
aauaauguaauuugaaaagucc

SEQ ID NO: 299170 - RNA, 21 nt, Human
aaucauuuauuacuccuuugg

SEQ ID NO: 299171 - RNA, 20 nt, Human
acuaccaaaaccaucaucca

SEQ ID NO: 299172 - RNA, 19 nt, Human
agacaaaacauaacuugaa

SEQ ID NO: 299173 - RNA, 20 nt, Human
agacaaaacauaacuugaaa

SEQ ID NO: 299174 - RNA, 22 nt, Human
agggaaaauggaguaaaaaaga

SEQ ID NO: 299175 - RNA, 20 nt, Human
auggaguaaaaaagacaaaa

SEQ ID NO: 299176 - RNA, 21 nt, Human
caagcauuguaucaauuugag

SEQ ID NO: 299177 - RNA, 24 nt, Human
ccaaaaccaucauccaauaccuaa

SEQ ID NO: 299178 - RNA, 19 nt, Human
ccaauaccuaaaggauaaa

SEQ ID NO: 299179 - RNA, 21 nt, Human
ccugagaaucuccuucuugcu

SEQ ID NO: 299180 - RNA, 24 nt, Human
cuaauaauguugcugaagacagcu

SEQ ID NO: 299181 - RNA, 19 nt, Human
cuuuuuguuguuguuuuug

SEQ ID NO: 299182 - RNA, 27 nt, Human
cuuuuuguuguuguuuuuguuuuuguc

SEQ ID NO: 299183 - RNA, 23 nt, Human
gaagguauuccucacauugcuau

SEQ ID NO: 299184 - RNA, 23 nt, Human
gauacuaccaaaaccaucaucca

SEQ ID NO: 299185 - RNA, 22 nt, Human
ggaagccaacugcggagaaggc

SEQ ID NO: 299186 - RNA, 19 nt, Human
ggaagcuaccgaggaagcc

SEQ ID NO: 299187 - RNA, 24 nt, Human
ggaguaaaaaagacaaaacauaac

SEQ ID NO: 299188 - RNA, 28 nt, Human
uaaagcaauauagauacuaccaaaacca

SEQ ID NO: 299189 - RNA, 19 nt, Human
uaagaaaugcuaauaacuc

SEQ ID NO: 299190 - RNA, 20 nt, Human
uaagaaaugcuaauaacucg

SEQ ID NO: 299191 - RNA, 21 nt, Human
uaauuaggaagguauuccuca

SEQ ID NO: 299192 - RNA, 21 nt, Human
uagauacuaccaaaaccauca

SEQ ID NO: 299193 - RNA, 23 nt, Human
ucauccaauaccuaaaggauaaa

SEQ ID NO: 299194 - RNA, 19 nt, Human
ucucaugagauuucauuuu

SEQ ID NO: 299195 - RNA, 19 nt, Human
uguuguuguuuuuguuuuu

SEQ ID NO: 299196 - RNA, 24 nt, Human
uucauuuuuauuacacaaagaaaa

SEQ ID NO: 299197 - RNA, 25 nt, Human
uugaaaaaugucauaauauuaucca

SEQ ID NO: 299198 - RNA, 23 nt, Human
uugucaaguuagcauagccgugc

SEQ ID NO: 299199 - RNA, 20 nt, Human
uuguuguuguuuuuguuuuu

SEQ ID NO: 299200 - RNA, 21 nt, Human
uuuuuuuuuuuuuuuuuauuu

SEQ ID NO: 299201 - RNA, 24 nt, Human
uuuuuuuuuuuuuuuuuuuauuuu

SEQ ID NO: 299202 - RNA, 24 nt, Human
aaucugucaacaucucugcaccuc

SEQ ID NO: 299203 - RNA, 21 nt, Human
cccacagcugggucggaaggc

SEQ ID NO: 299204 - RNA, 19 nt, Human
cggaaaucgggcgccgggc

SEQ ID NO: 299205 - RNA, 23 nt, Human
gcggggcgcgggcuggcgugggg

SEQ ID NO: 299206 - RNA, 20 nt, Human
gggcgcagcccacagcuggg

SEQ ID NO: 299207 - RNA, 26 nt, Human
uaggauaaaaucccagaaauggaauu

SEQ ID NO: 299208 - RNA, 28 nt, Human
uccuuaggauaaaaucccagaaauggag

SEQ ID NO: 299209 - RNA, 19 nt, Human
ugguauaaguauuuccuua

SEQ ID NO: 299210 - RNA, 20 nt, Human
accuccuccuucccuuuccu

SEQ ID NO: 299211 - RNA, 21 nt, Human
cggcgaccgcuauucgggacc

SEQ ID NO: 299212 - RNA, 23 nt, Human
aaaaaaaaaaaaaaugcacccug

SEQ ID NO: 299213 - RNA, 24 nt, Human
aaaaaaaaucuagguuaaacaaaa

SEQ ID NO: 299214 - RNA, 24 nt, Human
aaaaagagacaaagacaagcaggg

SEQ ID NO: 299215 - RNA, 23 nt, Human
aaaacaaaaagagacaaagacaa

SEQ ID NO: 299216 - RNA, 22 nt, Human
aaaacaccuuggcaggaaacag

SEQ ID NO: 299217 - RNA, 26 nt, Human
aaaagagacaaagacaagcaggggca

SEQ ID NO: 299218 - RNA, 20 nt, Human
aaacaaaaagagacaaagac

SEQ ID NO: 299219 - RNA, 22 nt, Human
aaacaccuuggcaggaaacaga

SEQ ID NO: 299220 - RNA, 24 nt, Human
aaagaacagcugaaaagccagaag

SEQ ID NO: 299221 - RNA, 19 nt, Human
aaagacugaaaggaaauaa

SEQ ID NO: 299222 - RNA, 20 nt, Human
aaagagacaaagacaagcag

SEQ ID NO: 299223 - RNA, 18 nt, Human
aaagccagaagacaaagg

SEQ ID NO: 299224 - RNA, 21 nt, Human
aaaggaaaaaaacgcaaauga

SEQ ID NO: 299225 - RNA, 25 nt, Human
aaccaaaaaguuuuaaaaaaaaucu

SEQ ID NO: 299226 - RNA, 21 nt, Human
aacccaaacaaugagaaaucu

SEQ ID NO: 299227 - RNA, 24 nt, Human
aacugcuugaacccaggaggugga

SEQ ID NO: 299228 - RNA, 20 nt, Human
aaggaaaaaaacgcaaauga

SEQ ID NO: 299229 - RNA, 20 nt, Human
aaguagcugggacuagaggu

SEQ ID NO: 299230 - RNA, 21 nt, Human
aauaaaagggacuacaaagaa

SEQ ID NO: 299231 - RNA, 19 nt, Human
aaucaugguucacugcagc

SEQ ID NO: 299232 - RNA, 21 nt, Human
acaauaacagagaugucacac

SEQ ID NO: 299233 - RNA, 24 nt, Human
acagagcgagacuccaucucaaag

SEQ ID NO: 299234 - RNA, 24 nt, Human
acagcugaaaagccagaagacaaa

SEQ ID NO: 299235 - RNA, 25 nt, Human
acaugaaauccagcagcagaggcca

SEQ ID NO: 299236 - RNA, 24 nt, Human
acccaggagguggagguugcagug

SEQ ID NO: 299237 - RNA, 22 nt, Human
acuccagccugggugacagagc

SEQ ID NO: 299238 - RNA, 22 nt, Human
agacugaaaggaaauaagcuag

SEQ ID NO: 299239 - RNA, 21 nt, Human
agagauccuccugacuaagcc

SEQ ID NO: 299240 - RNA, 19 nt, Human
agagauuauuuuaauuuuc

SEQ ID NO: 299241 - RNA, 23 nt, Human
agagauuauuuuaauuuucuuau

SEQ ID NO: 299242 - RNA, 18 nt, Human
agcccgacagcgcggacc

SEQ ID NO: 299243 - RNA, 24 nt, Human
agccugggugacagagcgagacuc

SEQ ID NO: 299244 - RNA, 20 nt, Human
agcugaaaagccagaagaca

SEQ ID NO: 299245 - RNA, 18 nt, Human
aggcgggagaacugcuug

SEQ ID NO: 299246 - RNA, 21 nt, Human
aggcugaggcgggagaacugc

SEQ ID NO: 299247 - RNA, 24 nt, Human
aggcugaggcgggagaacugcuug

SEQ ID NO: 299248 - RNA, 24 nt, Human
agggucucugucgcccagguugga

SEQ ID NO: 299249 - RNA, 24 nt, Human
agguggagguugcagugagccgag

SEQ ID NO: 299250 - RNA, 20 nt, Human
agucaauuccugaaaagccg

SEQ ID NO: 299251 - RNA, 22 nt, Human
auaacagagaugucacaccaca

SEQ ID NO: 299252 - RNA, 24 nt, Human
aucacgcuauuguacuccagccug

SEQ ID NO: 299253 - RNA, 19 nt, Human
auuguacuccagccugggu

SEQ ID NO: 299254 - RNA, 21 nt, Human
auuguacuccagccuggguga

SEQ ID NO: 299255 - RNA, 23 nt, Human
auuguacuccagccugggugaca

SEQ ID NO: 299256 - RNA, 24 nt, Human
auuguacuccagccugggugacag

SEQ ID NO: 299257 - RNA, 19 nt, Human
caaaaagagacaaagacaa

SEQ ID NO: 299258 - RNA, 20 nt, Human
caagagauccuccugacuaa

SEQ ID NO: 299259 - RNA, 21 nt, Human
caauuccugaaaagccaggaa

SEQ ID NO: 299260 - RNA, 22 nt, Human
cacugcagccuugaccucccag

SEQ ID NO: 299261 - RNA, 22 nt, Human
cagcagaggccaccccucagga

SEQ ID NO: 299262 - RNA, 23 nt, Human
cagcagcagaggccaccccucag

SEQ ID NO: 299263 - RNA, 23 nt, Human
cagccuugaccucccaggcucaa

SEQ ID NO: 299264 - RNA, 24 nt, Human
cagccuugaccucccaggcucaag

SEQ ID NO: 299265 - RNA, 24 nt, Human
cagcuacucaggaggcugaggcgg

SEQ ID NO: 299266 - RNA, 29 nt, Human
caggagguggagguugcagugacaacggu

SEQ ID NO: 299267 - RNA, 19 nt, Human
cagggucucugucgcccag

SEQ ID NO: 299268 - RNA, 24 nt, Human
caucaagcaaauuauaucacaucu

SEQ ID NO: 299269 - RNA, 18 nt, Human
ccaggaaaaucaaaauug

SEQ ID NO: 299270 - RNA, 19 nt, Human
cccaaguagcugggacuag

SEQ ID NO: 299271 - RNA, 21 nt, Human
cccaggagguggagguugcag

SEQ ID NO: 299272 - RNA, 18 nt, Human
cccaggcucaagagaucc

SEQ ID NO: 299273 - RNA, 21 nt, Human
cccaggcucaagagauccucc

SEQ ID NO: 299274 - RNA, 26 nt, Human
ccgucuaaagcuauggaacugauuac

SEQ ID NO: 299275 - RNA, 24 nt, Human
ccugaaaagccaggaaaaucaaaa

SEQ ID NO: 299276 - RNA, 22 nt, Human
ccugcuguuccagacuuaguca

SEQ ID NO: 299277 - RNA, 22 nt, Human
ccugggugacagagcgagacuc

SEQ ID NO: 299278 - RNA, 22 nt, Human
cgagacuccaucucaaagaaaa

SEQ ID NO: 299279 - RNA, 26 nt, Human
cgcuccggauccuuugggccagcagc

SEQ ID NO: 299280 - RNA, 19 nt, Human
cggaaggaauggagcacuu

SEQ ID NO: 299281 - RNA, 24 nt, Human
cuaagccucccaaguagcugggac

SEQ ID NO: 299282 - RNA, 21 nt, Human
cuauuguacuccagccugggu

SEQ ID NO: 299283 - RNA, 24 nt, Human
cuauuguacuccagccugggugac

SEQ ID NO: 299284 - RNA, 22 nt, Human
cucaaagaaaacaaacaaaaua

SEQ ID NO: 299285 - RNA, 18 nt, Human
cucaggaggcugaggcgg

SEQ ID NO: 299286 - RNA, 18 nt, Human
cucugucgcccagguugg

SEQ ID NO: 299287 - RNA, 19 nt, Human
cucugucgcccagguugga

SEQ ID NO: 299288 - RNA, 22 nt, Human
cugcagccuugaccucccaggc

SEQ ID NO: 299289 - RNA, 23 nt, Human
cugcagccuugaccucccaggcu

SEQ ID NO: 299290 - RNA, 24 nt, Human
cugcuugaacccaggagguggagg

SEQ ID NO: 299291 - RNA, 19 nt, Human
gacugggugcgguggcuca

SEQ ID NO: 299292 - RNA, 23 nt, Human
gagaucacgcuauuguacuccag

SEQ ID NO: 299293 - RNA, 21 nt, Human
gagguggagguugcagugagc

SEQ ID NO: 299294 - RNA, 22 nt, Human
gagguugcagugagccgagauc

SEQ ID NO: 299295 - RNA, 23 nt, Human
gaucaucugaagacaauuuccaa

SEQ ID NO: 299296 - RNA, 21 nt, Human
gcgguggcucaccccuuuaaa

SEQ ID NO: 299297 - RNA, 19 nt, Human
gcuauuguacuccagccug

SEQ ID NO: 299298 - RNA, 24 nt, Human
gcuauuguacuccagccuggguga

SEQ ID NO: 299299 - RNA, 22 nt, Human
ggagaacugcuugaacccagga

SEQ ID NO: 299300 - RNA, 18 nt, Human
ggagguugcagugagccg

SEQ ID NO: 299301 - RNA, 20 nt, Human
ggagguugcagugagccgag

SEQ ID NO: 299302 - RNA, 22 nt, Human
ggagguugcagugagccgagau

SEQ ID NO: 299303 - RNA, 23 nt, Human
ggagguugcagugagccgagauc

SEQ ID NO: 299304 - RNA, 24 nt, Human
ggagguugcagugagccgagauca

SEQ ID NO: 299305 - RNA, 20 nt, Human
ggcgccggaaggaauggagc

SEQ ID NO: 299306 - RNA, 21 nt, Human
ggcucaagagauccuccugac

SEQ ID NO: 299307 - RNA, 22 nt, Human
gggaaaaaaaaaaucuaaccac

SEQ ID NO: 299308 - RNA, 24 nt, Human
guacuccagccugggugacagagc

SEQ ID NO: 299309 - RNA, 24 nt, Human
gucucugucgcccagguuggagug

SEQ ID NO: 299310 - RNA, 19 nt, Human
guugcagugagccgagauc

SEQ ID NO: 299311 - RNA, 23 nt, Human
uaaaaaaaggaaaaaaacgcaaa

SEQ ID NO: 299312 - RNA, 22 nt, Human
uaaaaauauugaaaaaagacug

SEQ ID NO: 299313 - RNA, 19 nt, Human
uaaaagggacuacaaagaa

SEQ ID NO: 299314 - RNA, 23 nt, Human
uaaaagggacuacaaagaacagc

SEQ ID NO: 299315 - RNA, 24 nt, Human
uaaagagacugguuaaauaaauua

SEQ ID NO: 299316 - RNA, 23 nt, Human
uaaaguuaaaaaaaggaaaaaaa

SEQ ID NO: 299317 - RNA, 24 nt, Human
uaaaguuaaaaaaaggaaaaaaac

SEQ ID NO: 299318 - RNA, 24 nt, Human
uaaauauaauuuacaaucauuuga

SEQ ID NO: 299319 - RNA, 23 nt, Human
uaacaauacuucccugcuucuaa

SEQ ID NO: 299320 - RNA, 21 nt, Human
uaacagagaugucacaccaca

SEQ ID NO: 299321 - RNA, 26 nt, Human
uaagcuagacuaacaauacuucccug

SEQ ID NO: 299322 - RNA, 21 nt, Human
uacaaagaacagcugaaaagc

SEQ ID NO: 299323 - RNA, 21 nt, Human
uacaaagauuuccagccccac

SEQ ID NO: 299324 - RNA, 21 nt, Human
uacagaauuacacucucagac

SEQ ID NO: 299325 - RNA, 20 nt, Human
uacauagaaaaaaaggcuau

SEQ ID NO: 299326 - RNA, 22 nt, Human
uacuccagccugggugacagag

SEQ ID NO: 299327 - RNA, 24 nt, Human
uacuccagccugggugacagagcg

SEQ ID NO: 299328 - RNA, 18 nt, Human
uacugaauaugaauuacu

SEQ ID NO: 299329 - RNA, 24 nt, Human
uauagaacaguauguucagaauga

SEQ ID NO: 299330 - RNA, 21 nt, Human
uauucagcauucugauuuaau

SEQ ID NO: 299331 - RNA, 21 nt, Human
ucaaaagccuggcuuccuguc

SEQ ID NO: 299332 - RNA, 19 nt, Human
ucacugcagccuugaccuc

SEQ ID NO: 299333 - RNA, 20 nt, Human
ucacugcagccuugaccucc

SEQ ID NO: 299334 - RNA, 24 nt, Human
ucacugcagccuugaccucccagg

SEQ ID NO: 299335 - RNA, 24 nt, Human
ucaguuuuccucuacugaauauga

SEQ ID NO: 299336 - RNA, 28 nt, Human
ucaucugaagacaauuuccaagacccug

SEQ ID NO: 299337 - RNA, 23 nt, Human
uccagccugggugacagagcgag

SEQ ID NO: 299338 - RNA, 24 nt, Human
uccagccugggugacagagcgaga

SEQ ID NO: 299339 - RNA, 23 nt, Human
ucccaaguagcugggacuagagg

SEQ ID NO: 299340 - RNA, 18 nt, Human
ucccaggcucaagagauc

SEQ ID NO: 299341 - RNA, 22 nt, Human
uccugaaaagccaggaaaauca

SEQ ID NO: 299342 - RNA, 20 nt, Human
uccuuugggccagcagcucc

SEQ ID NO: 299343 - RNA, 22 nt, Human
ucgcccagguuggagugcaauc

SEQ ID NO: 299344 - RNA, 20 nt, Human
ucgcuccggauccuuugggc

SEQ ID NO: 299345 - RNA, 20 nt, Human
ucuaagaucaucugaagaca

SEQ ID NO: 299346 - RNA, 19 nt, Human
ucucugucgcccagguugg

SEQ ID NO: 299347 - RNA, 19 nt, Human
ucucugucgcccagguugg

SEQ ID NO: 299348 - RNA, 24 nt, Human
ucugucgcccagguuggagugcaa

SEQ ID NO: 299349 - RNA, 19 nt, Human
ucuuucuuuuuaagaagac

SEQ ID NO: 299350 - RNA, 21 nt, Human
ugaaaagccagaagacaaagg

SEQ ID NO: 299351 - RNA, 24 nt, Human
ugaaaagccagaagacaaaggaac

SEQ ID NO: 299352 - RNA, 19 nt, Human
ugaaaagccaggaaaauca

SEQ ID NO: 299353 - RNA, 23 nt, Human
ugaauuacuuuuccaauaugaaa

SEQ ID NO: 299354 - RNA, 25 nt, Human
ugaccucccaggcucaagagauccu

SEQ ID NO: 299355 - RNA, 22 nt, Human
ugacuaagccucccaaguagcu

SEQ ID NO: 299356 - RNA, 22 nt, Human
ugagccgagaucacgcuauugu

SEQ ID NO: 299357 - RNA, 24 nt, Human
ugaggcgggagaacugcuugaacc

SEQ ID NO: 299358 - RNA, 28 nt, Human
ugauauauuauuagcugaccauacuaua

SEQ ID NO: 299359 - RNA, 23 nt, Human
ugauuaagaaaaugcucuauuua

SEQ ID NO: 299360 - RNA, 23 nt, Human
uggagugcaaucaugguucacug

SEQ ID NO: 299361 - RNA, 18 nt, Human
uggcaggaaacagaccaa

SEQ ID NO: 299362 - RNA, 19 nt, Human
uggcaggaaacagaccaaa

SEQ ID NO: 299363 - RNA, 19 nt, Human
ugggccagcagcuccgggc

SEQ ID NO: 299364 - RNA, 24 nt, Human
ugguucacugcagccuugaccucc

SEQ ID NO: 299365 - RNA, 20 nt, Human
uguacuccagccugggugac

SEQ ID NO: 299366 - RNA, 22 nt, Human
uguacuccagccugggugacag

SEQ ID NO: 299367 - RNA, 24 nt, Human
uguacuccagccugggugacagag

SEQ ID NO: 299368 - RNA, 24 nt, Human
uuagucaaaaaaaaaaaaaaugca

SEQ ID NO: 299369 - RNA, 24 nt, Human
uucacugcagccuugaccucccag

SEQ ID NO: 299370 - RNA, 19 nt, Human
uuccagccccacuccagcu

SEQ ID NO: 299371 - RNA, 20 nt, Human
uuccugaaaagccaggaaaa

SEQ ID NO: 299372 - RNA, 24 nt, Human
uugaacccaggagguggagguugc

SEQ ID NO: 299373 - RNA, 19 nt, Human
uugagacagggucucuguc

SEQ ID NO: 299374 - RNA, 18 nt, Human
uugcagugagccgagauc

SEQ ID NO: 299375 - RNA, 20 nt, Human
uugcagugagccgagaucac

SEQ ID NO: 299376 - RNA, 21 nt, Human
uugcagugagccgagaucacg

SEQ ID NO: 299377 - RNA, 19 nt, Human
uuuauacaacuguaaguca

SEQ ID NO: 299378 - RNA, 21 nt, Human
uuuccagccccacuccagcuc

SEQ ID NO: 299379 - RNA, 23 nt, Human
uuuuaugcauaauaaaagggacu

SEQ ID NO: 299380 - RNA, 21 nt, Human
aaaaauggcagaagcacuggc

SEQ ID NO: 299381 - RNA, 25 nt, Human
aauacaguuacagucaguuucagca

SEQ ID NO: 299382 - RNA, 21 nt, Human
acucugacagauuugcuauug

SEQ ID NO: 299383 - RNA, 18 nt, Human
agaguuacuagcucaaaa

SEQ ID NO: 299384 - RNA, 21 nt, Human
agcuagaacaagcauuccuca

SEQ ID NO: 299385 - RNA, 22 nt, Human
aggagucaauuaaaauggccca

SEQ ID NO: 299386 - RNA, 18 nt, Human
agucaguuucagcagcua

SEQ ID NO: 299387 - RNA, 21 nt, Human
caaagcaagaaaaauuaaaaa

SEQ ID NO: 299388 - RNA, 23 nt, Human
cagcuagaacaagcauuccucag

SEQ ID NO: 299389 - RNA, 23 nt, Human
cauauauccacugcucaccaccc

SEQ ID NO: 299390 - RNA, 18 nt, Human
ccaaauuguggagggaaa

SEQ ID NO: 299391 - RNA, 22 nt, Human
ggagggaaaaaaauggcagaag

SEQ ID NO: 299392 - RNA, 21 nt, Human
uaagacaauacaguuacaguc

SEQ ID NO: 299393 - RNA, 18 nt, Human
uacaaagcugagggaaga

SEQ ID NO: 299394 - RNA, 21 nt, Human
uauugcacagucauuacgaca

SEQ ID NO: 299395 - RNA, 24 nt, Human
ucaaagcaagaaaaauuaaaaacu

SEQ ID NO: 299396 - RNA, 25 nt, Human
ucagcagcuagaacaagccgggguc

SEQ ID NO: 299397 - RNA, 23 nt, Human
ucugcacauguauugcacaguca

SEQ ID NO: 299398 - RNA, 21 nt, Human
ugacaggcauauauccacugc

SEQ ID NO: 299399 - RNA, 19 nt, Human
ugcuauugacuuugacagg

SEQ ID NO: 299400 - RNA, 20 nt, Human
uggagggaaaaaaauggcag

SEQ ID NO: 299401 - RNA, 24 nt, Human
uggccaaaaacucugauaaaaacu

SEQ ID NO: 299402 - RNA, 23 nt, Human
uucaaagcaagaaaaauuaaaaa

SEQ ID NO: 299403 - RNA, 18 nt, Human
uuuguuuuugcuuccuuu

SEQ ID NO: 299404 - RNA, 22 nt, Human
uuuuuuuuuuuuuuuuguuuuu

SEQ ID NO: 299405 - RNA, 20 nt, Human
aacacuuuggacucaaugaa

SEQ ID NO: 299406 - RNA, 19 nt, Human
aaccccaaaucucuggcau

SEQ ID NO: 299407 - RNA, 20 nt, Human
aaggaauccacuccccuccc

SEQ ID NO: 299408 - RNA, 20 nt, Human
accccauucccagauccuag

SEQ ID NO: 299409 - RNA, 26 nt, Human
acccccaaaauguauugcuuagaaac

SEQ ID NO: 299410 - RNA, 21 nt, Human
agaggcugagggaugggcaca

SEQ ID NO: 299411 - RNA, 21 nt, Human
agccugaaguuccccagucuu

SEQ ID NO: 299412 - RNA, 21 nt, Human
aggaugggggaggucccaggg

SEQ ID NO: 299413 - RNA, 19 nt, Human
agggaugggcacagugacc

SEQ ID NO: 299414 - RNA, 19 nt, Human
agggcucugaaaaccccca

SEQ ID NO: 299415 - RNA, 19 nt, Human
auccuagaaagguaccaug

SEQ ID NO: 299416 - RNA, 18 nt, Human
aucucugacccuucccca

SEQ ID NO: 299417 - RNA, 19 nt, Human
caccccauucccagauccu

SEQ ID NO: 299418 - RNA, 18 nt, Human
cacuccccuccccacaca

SEQ ID NO: 299419 - RNA, 21 nt, Human
cagaggcugagggaugggcac

SEQ ID NO: 299420 - RNA, 19 nt, Human
caggaagcuccccgcuccc

SEQ ID NO: 299421 - RNA, 28 nt, Human
cagugggugucagguggggaggggcccu

SEQ ID NO: 299422 - RNA, 25 nt, Human
caucucugacccuuccccaaggccc

SEQ ID NO: 299423 - RNA, 22 nt, Human
cccaaccccaaaucucuggcau

SEQ ID NO: 299424 - RNA, 21 nt, Human
cccagaccugccagcuaagau

SEQ ID NO: 299425 - RNA, 19 nt, Human
cccaggggaggaaaagggg

SEQ ID NO: 299426 - RNA, 19 nt, Human
ccuauuccagcccuuccca

SEQ ID NO: 299427 - RNA, 26 nt, Human
ccugggaagccuccaggaagcucccc

SEQ ID NO: 299428 - RNA, 18 nt, Human
ccugggccagccccaggg

SEQ ID NO: 299429 - RNA, 19 nt, Human
cuccaccccauucccagau

SEQ ID NO: 299430 - RNA, 19 nt, Human
cucccuggcagccaccugg

SEQ ID NO: 299431 - RNA, 21 nt, Human
cuggcaucucugacccuuccc

SEQ ID NO: 299432 - RNA, 19 nt, Human
cuggccaugaagagaaucc

SEQ ID NO: 299433 - RNA, 19 nt, Human
cuuuccccaaccccaaauc

SEQ ID NO: 299434 - RNA, 19 nt, Human
gacccuuccccaaggcccu

SEQ ID NO: 299435 - RNA, 20 nt, Human
gaccugggccagccccaggg

SEQ ID NO: 299436 - RNA, 18 nt, Human
gccaugaagagaauccag

SEQ ID NO: 299437 - RNA, 23 nt, Human
ggaaaaggggcacccagaccugc

SEQ ID NO: 299438 - RNA, 20 nt, Human
ggaacauuaaagugcacccc

SEQ ID NO: 299439 - RNA, 20 nt, Human
ggaagcuccccgcucccugg

SEQ ID NO: 299440 - RNA, 20 nt, Human
ggagccugaaguuccccagu

SEQ ID NO: 299441 - RNA, 18 nt, Human
ggcaucucugacccuucc

SEQ ID NO: 299442 - RNA, 18 nt, Human
ggcccuuuccccaacccc

SEQ ID NO: 299443 - RNA, 19 nt, Human
gggguggggggcugaggga

SEQ ID NO: 299444 - RNA, 20 nt, Human
uagaaagguaccaugcccug

SEQ ID NO: 299445 - RNA, 18 nt, Human
uauuccagcccuucccag

SEQ ID NO: 299446 - RNA, 19 nt, Human
uccaccccauucccagauc

SEQ ID NO: 299447 - RNA, 20 nt, Human
uccccaaccccaaaucucug

SEQ ID NO: 299448 - RNA, 23 nt, Human
ucccuuggagcagaugggggagc

SEQ ID NO: 299449 - RNA, 20 nt, Human
uccucuccaccccauuccca

SEQ ID NO: 299450 - RNA, 23 nt, Human
ucucugacccuuccccaaggccc

SEQ ID NO: 299451 - RNA, 19 nt, Human
ugaagagaauccagaggcu

SEQ ID NO: 299452 - RNA, 20 nt, Human
ugaagagaauccagaggcug

SEQ ID NO: 299453 - RNA, 24 nt, Human
ugaaggaauccacuccccucccca

SEQ ID NO: 299454 - RNA, 18 nt, Human
ugacaucaaacacuuugg

SEQ ID NO: 299455 - RNA, 22 nt, Human
uggaggcaaaaaggauggggga

SEQ ID NO: 299456 - RNA, 23 nt, Human
uggcaucucugacccuuccccaa

SEQ ID NO: 299457 - RNA, 21 nt, Human
uggguuguuucuuccacgacc

SEQ ID NO: 299458 - RNA, 21 nt, Human
uguccucuccaccccauuccc

SEQ ID NO: 299459 - RNA, 25 nt, Human
aaaaaaagguaaagaaugaacaaaa

SEQ ID NO: 299460 - RNA, 27 nt, Human
aaaaagguaaagaaugaacaaaaagaa

SEQ ID NO: 299461 - RNA, 23 nt, Human
aaaagcccagaaggaggccccac

SEQ ID NO: 299462 - RNA, 19 nt, Human
aaacaacagcggugagucc

SEQ ID NO: 299463 - RNA, 22 nt, Human
aaacaagaggagaagcagcuag

SEQ ID NO: 299464 - RNA, 20 nt, Human
aaagaaaaaaagguaaagaa

SEQ ID NO: 299465 - RNA, 20 nt, Human
aaagaaaacagaaaaaaacc

SEQ ID NO: 299466 - RNA, 21 nt, Human
aaagaaaacagaaaaaaaccc

SEQ ID NO: 299467 - RNA, 18 nt, Human
aacagcggugaguccacc

SEQ ID NO: 299468 - RNA, 22 nt, Human
aagaaaacagaaaaaaacccca

SEQ ID NO: 299469 - RNA, 19 nt, Human
aagaaaaggcccacuccga

SEQ ID NO: 299470 - RNA, 20 nt, Human
aagaaagaaaaggcccacuc

SEQ ID NO: 299471 - RNA, 23 nt, Human
aagagucuuugaggcagaggagg

SEQ ID NO: 299472 - RNA, 23 nt, Human
aagcagcuuacagagguccugug

SEQ ID NO: 299473 - RNA, 19 nt, Human
aaggaggccccacaccugc

SEQ ID NO: 299474 - RNA, 20 nt, Human
aaggggaaaaaaagaaaaca

SEQ ID NO: 299475 - RNA, 19 nt, Human
aaggugcaggcggccacug

SEQ ID NO: 299476 - RNA, 19 nt, Human
aagugaacccaaaguggaa

SEQ ID NO: 299477 - RNA, 20 nt, Human
acaaaaaagaaagaaagaaa

SEQ ID NO: 299478 - RNA, 18 nt, Human
acaaccacuggggagggg

SEQ ID NO: 299479 - RNA, 20 nt, Human
acacgacuucccauaaaaca

SEQ ID NO: 299480 - RNA, 22 nt, Human
accucagccccucauuccccag

SEQ ID NO: 299481 - RNA, 21 nt, Human
acgcucccuuccauaccaccc

SEQ ID NO: 299482 - RNA, 23 nt, Human
agaaaagaaaaaaagguaaagaa

SEQ ID NO: 299483 - RNA, 18 nt, Human
agaaguggggcggggggc

SEQ ID NO: 299484 - RNA, 21 nt, Human
agcggugaguccacccuuuuc

SEQ ID NO: 299485 - RNA, 22 nt, Human
agcuagaaguggggcggggggc

SEQ ID NO: 299486 - RNA, 23 nt, Human
aggagaaauuauuuuggugccag

SEQ ID NO: 299487 - RNA, 18 nt, Human
aggaggccccacaccugc

SEQ ID NO: 299488 - RNA, 23 nt, Human
aggcagaaacaagaggagaagca

SEQ ID NO: 299489 - RNA, 19 nt, Human
aggcagaggaggagguggu

SEQ ID NO: 299490 - RNA, 23 nt, Human
agggauggaaggcuagggaggaa

SEQ ID NO: 299491 - RNA, 21 nt, Human
aggggaacagggacagagguc

SEQ ID NO: 299492 - RNA, 23 nt, Human
aggggaggagggagagagggggc

SEQ ID NO: 299493 - RNA, 21 nt, Human
agguagagacuccccaggcgg

SEQ ID NO: 299494 - RNA, 22 nt, Human
agguagagacuccccaggcggc

SEQ ID NO: 299495 - RNA, 23 nt, Human
agguccugugcucacccugggga

SEQ ID NO: 299496 - RNA, 18 nt, Human
aggugggguccggaggac

SEQ ID NO: 299497 - RNA, 21 nt, Human
aguauguacaaaaaagaaaga

SEQ ID NO: 299498 - RNA, 20 nt, Human
agugggggaaggugaggggg

SEQ ID NO: 299499 - RNA, 24 nt, Human
auggagaguggaggaggucuaggg

SEQ ID NO: 299500 - RNA, 20 nt, Human
caaaaaaaggccccgugggu

SEQ ID NO: 299501 - RNA, 18 nt, Human
caaaccagaggggggcug

SEQ ID NO: 299502 - RNA, 23 nt, Human
caaaguggacaauacacaagcag

SEQ ID NO: 299503 - RNA, 20 nt, Human
caagagucuuugaggcagag

SEQ ID NO: 299504 - RNA, 21 nt, Human
caccuccaaaaaaaggccccg

SEQ ID NO: 299505 - RNA, 20 nt, Human
cacugcaacccccuugccug

SEQ ID NO: 299506 - RNA, 23 nt, Human
cacugccccaaaaaacggagaaa

SEQ ID NO: 299507 - RNA, 19 nt, Human
cacuggggagggggugccg

SEQ ID NO: 299508 - RNA, 23 nt, Human
cacuggggagggggugccgggca

SEQ ID NO: 299509 - RNA, 23 nt, Human
cagaaaaaaaccccacuuuucgu

SEQ ID NO: 299510 - RNA, 21 nt, Human
cagcagcccugguuacauggc

SEQ ID NO: 299511 - RNA, 23 nt, Human
cagcagcccugguuacauggccc

SEQ ID NO: 299512 - RNA, 22 nt, Human
cagcaggaacagagacucuccc

SEQ ID NO: 299513 - RNA, 18 nt, Human
cagcagggcugggggcuc

SEQ ID NO: 299514 - RNA, 22 nt, Human
cagcagggcugggggcucccuu

SEQ ID NO: 299515 - RNA, 23 nt, Human
cagcccccaccuccaaaaaaagg

SEQ ID NO: 299516 - RNA, 25 nt, Human
cagcccugggccccaacgggccccc

SEQ ID NO: 299517 - RNA, 19 nt, Human
caggaacagagacucuccc

SEQ ID NO: 299518 - RNA, 19 nt, Human
caggauggggguucugggc

SEQ ID NO: 299519 - RNA, 20 nt, Human
caggauggggguucugggcg

SEQ ID NO: 299520 - RNA, 18 nt, Human
cagucccccauggcuugg

SEQ ID NO: 299521 - RNA, 22 nt, Human
cauaccacccccguauccuaaa

SEQ ID NO: 299522 - RNA, 19 nt, Human
ccacagugacugccccccc

SEQ ID NO: 299523 - RNA, 21 nt, Human
ccacuggggagggggugccgg

SEQ ID NO: 299524 - RNA, 18 nt, Human
ccagaaggaggccccaca

SEQ ID NO: 299525 - RNA, 22 nt, Human
ccagcagggcugggggcucccu

SEQ ID NO: 299526 - RNA, 24 nt, Human
ccagcagggcugggggcucccuuc

SEQ ID NO: 299527 - RNA, 21 nt, Human
ccagcugcagaaccaggccga

SEQ ID NO: 299528 - RNA, 22 nt, Human
cccaaccccuaggaugacacga

SEQ ID NO: 299529 - RNA, 22 nt, Human
cccacagugacugccccccacc

SEQ ID NO: 299530 - RNA, 27 nt, Human
cccagcagcagcccugguuacauggcc

SEQ ID NO: 299531 - RNA, 23 nt, Human
ccccacccuggccccagccccgc

SEQ ID NO: 299532 - RNA, 21 nt, Human
ccccagcccccaccuccaaaa

SEQ ID NO: 299533 - RNA, 19 nt, Human
ccccagccccgccuagaau

SEQ ID NO: 299534 - RNA, 24 nt, Human
ccccccgcggcaguggguggaggc

SEQ ID NO: 299535 - RNA, 20 nt, Human
ccccuaggaugacacgacuu

SEQ ID NO: 299536 - RNA, 22 nt, Human
ccccuggcuccuggagaagggg

SEQ ID NO: 299537 - RNA, 20 nt, Human
cccucauuccccagccccca

SEQ ID NO: 299538 - RNA, 20 nt, Human
cccugggccccaacgggccc

SEQ ID NO: 299539 - RNA, 27 nt, Human
ccgccuagaauggcuauuccugaccac

SEQ ID NO: 299540 - RNA, 21 nt, Human
ccgcgcucccagcagcagccc

SEQ ID NO: 299541 - RNA, 21 nt, Human
ccuccaaaaaaaggccccgug

SEQ ID NO: 299542 - RNA, 19 nt, Human
ccuccuucccuaccuuccc

SEQ ID NO: 299543 - RNA, 27 nt, Human
ccuggccccagccccgccuagaauggc

SEQ ID NO: 299544 - RNA, 26 nt, Human
ccuguggccgugggaauuauuaaggc

SEQ ID NO: 299545 - RNA, 19 nt, Human
cgccuggcccugccucauc

SEQ ID NO: 299546 - RNA, 20 nt, Human
cgcgcucccagcagcagccc

SEQ ID NO: 299547 - RNA, 19 nt, Human
cgcggaggggccugggccg

SEQ ID NO: 299548 - RNA, 20 nt, Human
cuagaaguggggcggggggc

SEQ ID NO: 299549 - RNA, 21 nt, Human
cuagggcccuccucaaauccc

SEQ ID NO: 299550 - RNA, 20 nt, Human
cucagaauuggguagggggc

SEQ ID NO: 299551 - RNA, 24 nt, Human
cugcccaggaaugagaaugagggu

SEQ ID NO: 299552 - RNA, 22 nt, Human
cuggccccagccccgccuagaa

SEQ ID NO: 299553 - RNA, 24 nt, Human
cuguggccgugggaauuauuaagg

SEQ ID NO: 299554 - RNA, 24 nt, Human
cuuagcccgccuggggcugcugca

SEQ ID NO: 299555 - RNA, 20 nt, Human
cuuugaggcagaggaggagg

SEQ ID NO: 299556 - RNA, 21 nt, Human
gaaaacagaaaaaaaccccac

SEQ ID NO: 299557 - RNA, 25 nt, Human
gaacagagacucucccaacgggaga

SEQ ID NO: 299558 - RNA, 23 nt, Human
gaaccaggccgagggcgagggga

SEQ ID NO: 299559 - RNA, 21 nt, Human
gaaggaggccccacaccugcu

SEQ ID NO: 299560 - RNA, 24 nt, Human
gaggccccacaccugcuugggccc

SEQ ID NO: 299561 - RNA, 18 nt, Human
gagggauggaaggcuagg

SEQ ID NO: 299562 - RNA, 18 nt, Human
gagggauuuggaagugga

SEQ ID NO: 299563 - RNA, 19 nt, Human
gaggggaggagggagagag

SEQ ID NO: 299564 - RNA, 18 nt, Human
gaguggaggaggucuagg

SEQ ID NO: 299565 - RNA, 19 nt, Human
gcccagaaggaggccccac

SEQ ID NO: 299566 - RNA, 25 nt, Human
gcccagccccaaccccuaggaugac

SEQ ID NO: 299567 - RNA, 22 nt, Human
gcccugggccccaacgggcccc

SEQ ID NO: 299568 - RNA, 23 nt, Human
gccuagaauggcuauuccugacc

SEQ ID NO: 299569 - RNA, 19 nt, Human
gccuggggcugcugcacac

SEQ ID NO: 299570 - RNA, 21 nt, Human
gcuagggaggaacugggggcu

SEQ ID NO: 299571 - RNA, 21 nt, Human
ggaaaaaaagaaaacagaaaa

SEQ ID NO: 299572 - RNA, 23 nt, Human
ggaaaaaaagaaaacagaaaaaa

SEQ ID NO: 299573 - RNA, 18 nt, Human
ggaacagagacucuccca

SEQ ID NO: 299574 - RNA, 22 nt, Human
ggaaccaggaacaggagcaucu

SEQ ID NO: 299575 - RNA, 19 nt, Human
ggaaggaagggcugcccag

SEQ ID NO: 299576 - RNA, 18 nt, Human
ggacaggcucugcccagc

SEQ ID NO: 299577 - RNA, 22 nt, Human
ggagaaggggggaggggacagg

SEQ ID NO: 299578 - RNA, 19 nt, Human
ggagaccuccuucccuacc

SEQ ID NO: 299579 - RNA, 22 nt, Human
ggagaggaggcagcaaaccaga

SEQ ID NO: 299580 - RNA, 22 nt, Human
ggaggagggagagagggggcuu

SEQ ID NO: 299581 - RNA, 25 nt, Human
ggaggccccacaccugcuugggccc

SEQ ID NO: 299582 - RNA, 25 nt, Human
ggaucagagccacugccccaaaaaa

SEQ ID NO: 299583 - RNA, 18 nt, Human
ggcaaaagguaggggggc

SEQ ID NO: 299584 - RNA, 19 nt, Human
ggcagaggaggaggugguc

SEQ ID NO: 299585 - RNA, 20 nt, Human
ggcagggcaagggucccagg

SEQ ID NO: 299586 - RNA, 18 nt, Human
ggcagugggggaagguga

SEQ ID NO: 299587 - RNA, 21 nt, Human
ggcgaggggaggagggagaga

SEQ ID NO: 299588 - RNA, 25 nt, Human
ggcuagggaggaacugggggcuaca

SEQ ID NO: 299589 - RNA, 18 nt, Human
gggagagggagaggcuag

SEQ ID NO: 299590 - RNA, 20 nt, Human
gggagagggagaggcuaggc

SEQ ID NO: 299591 - RNA, 24 nt, Human
gggaggggacaggcucugcccagc

SEQ ID NO: 299592 - RNA, 22 nt, Human
gggauggaaggcuagggaggaa

SEQ ID NO: 299593 - RNA, 26 nt, Human
gggcaaaagguaggggggcugugauc

SEQ ID NO: 299594 - RNA, 20 nt, Human
gggcuggagcugggaccucc

SEQ ID NO: 299595 - RNA, 18 nt, Human
gggcugggggcucccuuc

SEQ ID NO: 299596 - RNA, 22 nt, Human
ggggagagggagaggcuaggca

SEQ ID NO: 299597 - RNA, 21 nt, Human
ggggagggggugccgggcagg

SEQ ID NO: 299598 - RNA, 18 nt, Human
ggggcggggggcgggggg

SEQ ID NO: 299599 - RNA, 19 nt, Human
ggggcggggggcggggggg

SEQ ID NO: 299600 - RNA, 25 nt, Human
ggggggugcggccaggauggggguu

SEQ ID NO: 299601 - RNA, 20 nt, Human
ggggguccgugcccauggga

SEQ ID NO: 299602 - RNA, 19 nt, Human
gggguccgugcccauggga

SEQ ID NO: 299603 - RNA, 18 nt, Human
ggugccaggguggaagga

SEQ ID NO: 299604 - RNA, 24 nt, Human
guagagacuccccaggcggcugga

SEQ ID NO: 299605 - RNA, 21 nt, Human
guauguacaaaaaagaaagaa

SEQ ID NO: 299606 - RNA, 19 nt, Human
gugugagugcgggguuacc

SEQ ID NO: 299607 - RNA, 20 nt, Human
guucugggcgccuggcccug

SEQ ID NO: 299608 - RNA, 21 nt, Human
uaaaacaacagcggugagucc

SEQ ID NO: 299609 - RNA, 20 nt, Human
uaaaauccuuccgggaccuc

SEQ ID NO: 299610 - RNA, 26 nt, Human
uaaagugaacagcucccccagcuccc

SEQ ID NO: 299611 - RNA, 24 nt, Human
uacaaaauaugaacccuguacaga

SEQ ID NO: 299612 - RNA, 22 nt, Human
uacaguaccgugugcucagaau

SEQ ID NO: 299613 - RNA, 19 nt, Human
uagaaguggggcggggggc

SEQ ID NO: 299614 - RNA, 19 nt, Human
uagaggggagaggaggcag

SEQ ID NO: 299615 - RNA, 25 nt, Human
uagucaguaucgccaggaguaucgc

SEQ ID NO: 299616 - RNA, 19 nt, Human
uauugcucaggggacuagc

SEQ ID NO: 299617 - RNA, 20 nt, Human
uauugcucaggggacuagcu

SEQ ID NO: 299618 - RNA, 20 nt, Human
ucauccaaggugcaggcggc

SEQ ID NO: 299619 - RNA, 26 nt, Human
ucauuccccagcccccaccuccaaaa

SEQ ID NO: 299620 - RNA, 18 nt, Human
uccacccuuuucccagga

SEQ ID NO: 299621 - RNA, 21 nt, Human
uccacccuuuucccaggacua

SEQ ID NO: 299622 - RNA, 20 nt, Human
uccccagcccccaccuccaa

SEQ ID NO: 299623 - RNA, 25 nt, Human
uccccagcccccaccuccaaaaaaa

SEQ ID NO: 299624 - RNA, 24 nt, Human
ucccccagcucccugacuuucuag

SEQ ID NO: 299625 - RNA, 21 nt, Human
ucccuuuuugccuccguagaa

SEQ ID NO: 299626 - RNA, 22 nt, Human
uccuagggcaaaagguaggggg

SEQ ID NO: 299627 - RNA, 21 nt, Human
uccuggagaaggggggagggg

SEQ ID NO: 299628 - RNA, 20 nt, Human
ucgccggcugggacaaaaac

SEQ ID NO: 299629 - RNA, 21 nt, Human
ucuccagucacccccuggcuc

SEQ ID NO: 299630 - RNA, 24 nt, Human
ucucccaacgggagaccuccuucc

SEQ ID NO: 299631 - RNA, 26 nt, Human
ugacugaucgucaaaguggacaauac

SEQ ID NO: 299632 - RNA, 20 nt, Human
ugagccuggaacuugggggg

SEQ ID NO: 299633 - RNA, 18 nt, Human
ugaggcagaggaggaggu

SEQ ID NO: 299634 - RNA, 20 nt, Human
ugaggcagaggaggaggugg

SEQ ID NO: 299635 - RNA, 21 nt, Human
ugaggcagaggaggagguggu

SEQ ID NO: 299636 - RNA, 19 nt, Human
ugcccaggaaugagaauga

SEQ ID NO: 299637 - RNA, 21 nt, Human
ugccccaaaaaacggagaaaa

SEQ ID NO: 299638 - RNA, 25 nt, Human
ugccccaaaaaacggagaaaauuca

SEQ ID NO: 299639 - RNA, 24 nt, Human
ugcggccaggauggggguucuggg

SEQ ID NO: 299640 - RNA, 22 nt, Human
uggaaaggggggugcggccagg

SEQ ID NO: 299641 - RNA, 26 nt, Human
uggaaaggggggugcggccaggaugg

SEQ ID NO: 299642 - RNA, 19 nt, Human
uggaagacugagccuggaa

SEQ ID NO: 299643 - RNA, 25 nt, Human
uggaagacugagccuggaacuuggg

SEQ ID NO: 299644 - RNA, 20 nt, Human
uggaaggaagggcugcccag

SEQ ID NO: 299645 - RNA, 20 nt, Human
uggaaggugggguccggagg

SEQ ID NO: 299646 - RNA, 20 nt, Human
uggacagagggauggaaggc

SEQ ID NO: 299647 - RNA, 24 nt, Human
uggagaguggaggaggucuagggc

SEQ ID NO: 299648 - RNA, 27 nt, Human
ugggaggggggcagggcaagggucccc

SEQ ID NO: 299649 - RNA, 24 nt, Human
ugggcgccuggcccugccucaucc

SEQ ID NO: 299650 - RNA, 22 nt, Human
ugggcuuggggagucccggggu

SEQ ID NO: 299651 - RNA, 21 nt, Human
uggggagaggagcccugcuug

SEQ ID NO: 299652 - RNA, 24 nt, Human
uggggagaggagcccugcuugggg

SEQ ID NO: 299653 - RNA, 20 nt, Human
ugggggaaggugaggggagg

SEQ ID NO: 299654 - RNA, 21 nt, Human
ugggggcagggggaaagggga

SEQ ID NO: 299655 - RNA, 20 nt, Human
ugggguggacagagggaugg

SEQ ID NO: 299656 - RNA, 19 nt, Human
uggguaguggaagggggag

SEQ ID NO: 299657 - RNA, 20 nt, Human
uggguggaggcggugggggg

SEQ ID NO: 299658 - RNA, 23 nt, Human
ugggugggggcagggggaaaggg

SEQ ID NO: 299659 - RNA, 24 nt, Human
uguacagacagcaucaagggagug

SEQ ID NO: 299660 - RNA, 20 nt, Human
uuccaaacagucccccaugg

SEQ ID NO: 299661 - RNA, 19 nt, Human
uucuuucuuuuuuuuuucu

SEQ ID NO: 299662 - RNA, 21 nt, Human
uugaggcagaggaggaggugg

SEQ ID NO: 299663 - RNA, 21 nt, Human
uugaggcagaggaggaggugg

SEQ ID NO: 299664 - RNA, 22 nt, Human
uuggagacaagaucgaaggauu

SEQ ID NO: 299665 - RNA, 25 nt, Human
uuggagacuuagcccgccuggggcu

SEQ ID NO: 299666 - RNA, 22 nt, Human
uuggugccaggguggaaggaag

SEQ ID NO: 299667 - RNA, 22 nt, Human
uuuuuuucuuuuuuuguucuuu

SEQ ID NO: 299668 - RNA, 20 nt, Human
uuuuuuuuuucuuuuuuugg

SEQ ID NO: 299669 - RNA, 22 nt, Human
aaaaacuacaucccauugcccc

SEQ ID NO: 299670 - RNA, 19 nt, Human
aaaacuaaaggcagaagca

SEQ ID NO: 299671 - RNA, 19 nt, Human
aaaauucgggugaaaacug

SEQ ID NO: 299672 - RNA, 21 nt, Human
aaacaggaauggagguguuag

SEQ ID NO: 299673 - RNA, 24 nt, Human
aaacuaaaggcagaagcaccaaag

SEQ ID NO: 299674 - RNA, 26 nt, Human
aaacuacaucccauugccccugcccc

SEQ ID NO: 299675 - RNA, 23 nt, Human
aaacuccagguauucaacaggca

SEQ ID NO: 299676 - RNA, 21 nt, Human
aaagggcagacccuuugaaca

SEQ ID NO: 299677 - RNA, 21 nt, Human
aaagggcagacccuuugaaca

SEQ ID NO: 299678 - RNA, 25 nt, Human
aagcucaucugcauaaauguguccu

SEQ ID NO: 299679 - RNA, 23 nt, Human
aaguuuccccccaaccccccgcc

SEQ ID NO: 299680 - RNA, 19 nt, Human
acacaaauuuaacaccacc

SEQ ID NO: 299681 - RNA, 19 nt, Human
acacaaauuuaacaccacc

SEQ ID NO: 299682 - RNA, 21 nt, Human
acacaaauuuaacaccaccau

SEQ ID NO: 299683 - RNA, 21 nt, Human
acacaaauuuaacaccaccau

SEQ ID NO: 299684 - RNA, 18 nt, Human
acaguggugcucugccug

SEQ ID NO: 299685 - RNA, 21 nt, Human
acccccuaauuuguucaauuu

SEQ ID NO: 299686 - RNA, 19 nt, Human
acuaaaggcagaagcacca

SEQ ID NO: 299687 - RNA, 22 nt, Human
acuauuuucuuucccuuuucca

SEQ ID NO: 299688 - RNA, 28 nt, Human
acuccaaacucaaguaacugaaaggcca

SEQ ID NO: 299689 - RNA, 18 nt, Human
agaaggcagugcaagaga

SEQ ID NO: 299690 - RNA, 20 nt, Human
agaggaggaugggaagcagg

SEQ ID NO: 299691 - RNA, 23 nt, Human
agaggaggaugggaagcagggcc

SEQ ID NO: 299692 - RNA, 19 nt, Human
agcuucagcccucuccacc

SEQ ID NO: 299693 - RNA, 20 nt, Human
aggaggaugggaagcagggc

SEQ ID NO: 299694 - RNA, 19 nt, Human
aggcaagucaaccguggga

SEQ ID NO: 299695 - RNA, 24 nt, Human
aggcagaagcaccaaagaguuuuc

SEQ ID NO: 299696 - RNA, 21 nt, Human
aggcaggcaaacagagagaag

SEQ ID NO: 299697 - RNA, 18 nt, Human
aggcagggaaagggcaga

SEQ ID NO: 299698 - RNA, 18 nt, Human
aggcagggaaagggcaga

SEQ ID NO: 299699 - RNA, 24 nt, Human
aggcagugcaagagaaggacggca

SEQ ID NO: 299700 - RNA, 24 nt, Human
aggcagugcaagagaaggacggca

SEQ ID NO: 299701 - RNA, 19 nt, Human
aggcggagggaacggucuc

SEQ ID NO: 299702 - RNA, 26 nt, Human
auaaguucccgaaacuuagugcagaa

SEQ ID NO: 299703 - RNA, 28 nt, Human
auacacgguuauaaacaggaauggaggu

SEQ ID NO: 299704 - RNA, 18 nt, Human
aucaaggcaagucaaccg

SEQ ID NO: 299705 - RNA, 18 nt, Human
augucucuacuaagugac

SEQ ID NO: 299706 - RNA, 18 nt, Human
augucucuacuaagugac

SEQ ID NO: 299707 - RNA, 24 nt, Human
augugguuagaaguguauccuuuc

SEQ ID NO: 299708 - RNA, 20 nt, Human
auuguuuucuuuuguaauga

SEQ ID NO: 299709 - RNA, 20 nt, Human
cacaaauuuaacaccaccau

SEQ ID NO: 299710 - RNA, 20 nt, Human
cacaaauuuaacaccaccau

SEQ ID NO: 299711 - RNA, 22 nt, Human
cacaauacaaaacauuacaaga

SEQ ID NO: 299712 - RNA, 22 nt, Human
cacaauacaaaacauuacaaga

SEQ ID NO: 299713 - RNA, 21 nt, Human
caccaggagaacaaaucacag

SEQ ID NO: 299714 - RNA, 18 nt, Human
caccccuguccucucugc

SEQ ID NO: 299715 - RNA, 18 nt, Human
caccccuguccucucugc

SEQ ID NO: 299716 - RNA, 24 nt, Human
caccccuguccucucugccaaggg

SEQ ID NO: 299717 - RNA, 24 nt, Human
caccccuguccucucugccaaggg

SEQ ID NO: 299718 - RNA, 21 nt, Human
cacugcuccuuucuacccccu

SEQ ID NO: 299719 - RNA, 19 nt, Human
cagaaggcagugcaagaga

SEQ ID NO: 299720 - RNA, 18 nt, Human
cagaaguagcaacucagg

SEQ ID NO: 299721 - RNA, 22 nt, Human
cagacccuuugaacaaaagccc

SEQ ID NO: 299722 - RNA, 22 nt, Human
cagacccuuugaacaaaagccc

SEQ ID NO: 299723 - RNA, 20 nt, Human
cagcaaaaaguuaaaaguac

SEQ ID NO: 299724 - RNA, 19 nt, Human
cagggaaagggcagacccu

SEQ ID NO: 299725 - RNA, 19 nt, Human
cagggaaagggcagacccu

SEQ ID NO: 299726 - RNA, 19 nt, Human
cauuuugcuuuucuucuaa

SEQ ID NO: 299727 - RNA, 19 nt, Human
ccagaaagagucaaaaaag

SEQ ID NO: 299728 - RNA, 18 nt, Human
ccccaaccccccgccugg

SEQ ID NO: 299729 - RNA, 20 nt, Human
ccucugaggaagaaggcgga

SEQ ID NO: 299730 - RNA, 19 nt, Human
ccuuccagcucucuccacc

SEQ ID NO: 299731 - RNA, 24 nt, Human
cgggagcauucagaagaaucagaa

SEQ ID NO: 299732 - RNA, 19 nt, Human
cggggugaagagaggagga

SEQ ID NO: 299733 - RNA, 25 nt, Human
cuacuaagugacguuuggguuauau

SEQ ID NO: 299734 - RNA, 25 nt, Human
cuacuaagugacguuuggguuauau

SEQ ID NO: 299735 - RNA, 19 nt, Human
cucaaggagaaaugaggaa

SEQ ID NO: 299736 - RNA, 23 nt, Human
cucaaggagaaaugaggaaagcu

SEQ ID NO: 299737 - RNA, 18 nt, Human
cucagacucucucugccu

SEQ ID NO: 299738 - RNA, 26 nt, Human
cuggugccaaguuuccccccaacccc

SEQ ID NO: 299739 - RNA, 18 nt, Human
gaaaacugguucauaaag

SEQ ID NO: 299740 - RNA, 21 nt, Human
gaauuccuuuuuuuuuuuuuu

SEQ ID NO: 299741 - RNA, 19 nt, Human
gacaaagggacaagugaga

SEQ ID NO: 299742 - RNA, 24 nt, Human
gagaauauuguuuccaaaacuggu

SEQ ID NO: 299743 - RNA, 21 nt, Human
gcagaaggcagugcaagagaa

SEQ ID NO: 299744 - RNA, 21 nt, Human
gcccccagcaacagcuucagc

SEQ ID NO: 299745 - RNA, 26 nt, Human
gccugggauggcuggugccaaguuuc

SEQ ID NO: 299746 - RNA, 23 nt, Human
ggaaagcuuuuucucauuuugcu

SEQ ID NO: 299747 - RNA, 18 nt, Human
ggcaggguccaagacaca

SEQ ID NO: 299748 - RNA, 21 nt, Human
gguucauaaagggguugugca

SEQ ID NO: 299749 - RNA, 21 nt, Human
gguucauaaagggguugugca

SEQ ID NO: 299750 - RNA, 24 nt, Human
guaguguuuccuuuugaaccaaag

SEQ ID NO: 299751 - RNA, 22 nt, Human
gugaagagaggaggaugggaag

SEQ ID NO: 299752 - RNA, 18 nt, Human
guuugcaaaaguaacugu

SEQ ID NO: 299753 - RNA, 21 nt, Human
uaaaacuaaaggcagaagcac

SEQ ID NO: 299754 - RNA, 22 nt, Human
uaaaacuaaaggcagaagcacc

SEQ ID NO: 299755 - RNA, 21 nt, Human
uaaaagacucaguauaaacca

SEQ ID NO: 299756 - RNA, 21 nt, Human
uaacggggugaagagaggagg

SEQ ID NO: 299757 - RNA, 21 nt, Human
uaacggggugaagagaggagg

SEQ ID NO: 299758 - RNA, 19 nt, Human
uacaaaacauuacaagaaa

SEQ ID NO: 299759 - RNA, 19 nt, Human
uacaaaacauuacaagaaa

SEQ ID NO: 299760 - RNA, 19 nt, Human
uacaagaaaaagucguaac

SEQ ID NO: 299761 - RNA, 19 nt, Human
uacaagaaaaagucguaac

SEQ ID NO: 299762 - RNA, 20 nt, Human
uacacaaauuuaacaccacc

SEQ ID NO: 299763 - RNA, 20 nt, Human
uacacaaauuuaacaccacc

SEQ ID NO: 299764 - RNA, 22 nt, Human
uagaaccuggguaaaaacuaca

SEQ ID NO: 299765 - RNA, 20 nt, Human
uagcaacuccuguggggggc

SEQ ID NO: 299766 - RNA, 18 nt, Human
uaggauccaguuauaacc

SEQ ID NO: 299767 - RNA, 23 nt, Human
uauaauacacaauacaaaacauu

SEQ ID NO: 299768 - RNA, 23 nt, Human
uauaauacacaauacaaaacauu

SEQ ID NO: 299769 - RNA, 20 nt, Human
uauacaaaaguaaaagacuc

SEQ ID NO: 299770 - RNA, 24 nt, Human
uccaaacucaaguaacugaaaggc

SEQ ID NO: 299771 - RNA, 19 nt, Human
uccaccaggagaacaaauc

SEQ ID NO: 299772 - RNA, 20 nt, Human
ucuacccccuaauuuguuca

SEQ ID NO: 299773 - RNA, 21 nt, Human
ugaaaacugguucauaaaggg

SEQ ID NO: 299774 - RNA, 22 nt, Human
ugaaacagucaaaauucgggug

SEQ ID NO: 299775 - RNA, 21 nt, Human
ugaacaaaagcccaccccugu

SEQ ID NO: 299776 - RNA, 21 nt, Human
ugaacaaaagcccaccccugu

SEQ ID NO: 299777 - RNA, 22 nt, Human
ugaacuggaacaugacauuccu

SEQ ID NO: 299778 - RNA, 19 nt, Human
ugaagagaggaggauggga

SEQ ID NO: 299779 - RNA, 18 nt, Human
ugaaggauauugcccaag

SEQ ID NO: 299780 - RNA, 21 nt, Human
ugagaauauuguuuccaaaac

SEQ ID NO: 299781 - RNA, 23 nt, Human
ugagaauauuguuuccaaaacug

SEQ ID NO: 299782 - RNA, 21 nt, Human
ugagcaaauguaguguuuccu

SEQ ID NO: 299783 - RNA, 21 nt, Human
ugaugucauuucugagugcuu

SEQ ID NO: 299784 - RNA, 23 nt, Human
ugaugucauuucugagugcuuug

SEQ ID NO: 299785 - RNA, 24 nt, Human
ugccaaguuuccccccaacccccc

SEQ ID NO: 299786 - RNA, 18 nt, Human
ugggauggcuggugccaa

SEQ ID NO: 299787 - RNA, 19 nt, Human
uggguaaaaacuacauccc

SEQ ID NO: 299788 - RNA, 18 nt, Human
ugugagaauauuguuucc

SEQ ID NO: 299789 - RNA, 25 nt, Human
ugugagaauauuguuuccaaaacug

SEQ ID NO: 299790 - RNA, 23 nt, Human
uguggaguuggacuggacaacag

SEQ ID NO: 299791 - RNA, 20 nt, Human
uuauaaacaggaauggaggu

SEQ ID NO: 299792 - RNA, 22 nt, Human
uucaaagucaguaguucgggag

SEQ ID NO: 299793 - RNA, 22 nt, Human
uucagcccucuccaccaagcuu

SEQ ID NO: 299794 - RNA, 23 nt, Human
uuccccccaaccccccgccugga

SEQ ID NO: 299795 - RNA, 21 nt, Human
uuccccccaaccccccgccuu

SEQ ID NO: 299796 - RNA, 26 nt, Human
uugauacuaaacuccagguauucaac

SEQ ID NO: 299797 - RNA, 22 nt, Human
uugcuuccuggucuugcuuucu

SEQ ID NO: 299798 - RNA, 20 nt, Human
uuggcagacaaagggacaag

SEQ ID NO: 299799 - RNA, 23 nt, Human
uuuauuguuuucuuuuguaauga

SEQ ID NO: 299800 - RNA, 23 nt, Human
uuucucagacucucucugccuua

SEQ ID NO: 299801 - RNA, 20 nt, Human
aaaauuuuccccacucacau

SEQ ID NO: 299802 - RNA, 23 nt, Human
aaacuccugagcuuaagcagucc

SEQ ID NO: 299803 - RNA, 23 nt, Human
aaagugcugggauuauaggcaug

SEQ ID NO: 299804 - RNA, 24 nt, Human
aaagugcugggauuauaggcaugg

SEQ ID NO: 299805 - RNA, 25 nt, Human
aaagugcugggauuauaggcauggg

SEQ ID NO: 299806 - RNA, 24 nt, Human
aaccucaggugauccaccugccuc

SEQ ID NO: 299807 - RNA, 25 nt, Human
aagcaguccucccaccucagccucc

SEQ ID NO: 299808 - RNA, 18 nt, Human
aagcccaggagaaagaca

SEQ ID NO: 299809 - RNA, 26 nt, Human
aaguaccgggauuacaggcauaagcc

SEQ ID NO: 299810 - RNA, 21 nt, Human
aagucugccugccaagagcca

SEQ ID NO: 299811 - RNA, 19 nt, Human
aagugcugggauuauaggc

SEQ ID NO: 299812 - RNA, 21 nt, Human
aagugcugggauuauaggcau

SEQ ID NO: 299813 - RNA, 21 nt, Human
acaggcacccgccaccaugcc

SEQ ID NO: 299814 - RNA, 21 nt, Human
accagggcaucguaagaggcu

SEQ ID NO: 299815 - RNA, 24 nt, Human
accauguuggccaggcuggucucg

SEQ ID NO: 299816 - RNA, 18 nt, Human
agacaggaucuugcugug

SEQ ID NO: 299817 - RNA, 19 nt, Human
agacaggaucuugcugugu

SEQ ID NO: 299818 - RNA, 19 nt, Human
agagauggugggggucuug

SEQ ID NO: 299819 - RNA, 20 nt, Human
agccaccuauaacuaagagc

SEQ ID NO: 299820 - RNA, 22 nt, Human
agccaggugccuccaauuagac

SEQ ID NO: 299821 - RNA, 19 nt, Human
aggcuggagugcaguggca

SEQ ID NO: 299822 - RNA, 24 nt, Human
aggugauccaccugccucagccuc

SEQ ID NO: 299823 - RNA, 18 nt, Human
aguagcugggauuacagg

SEQ ID NO: 299824 - RNA, 19 nt, Human
aguagcugggauucucagg

SEQ ID NO: 299825 - RNA, 21 nt, Human
agugcagugaugcagucauag

SEQ ID NO: 299826 - RNA, 23 nt, Human
agugcagugaugcagucauagcu

SEQ ID NO: 299827 - RNA, 23 nt, Human
agugcaguggcaugaugucggcu

SEQ ID NO: 299828 - RNA, 24 nt, Human
agugcaguggcaugaugucggcuc

SEQ ID NO: 299829 - RNA, 25 nt, Human
auagaagcccaggagaaagacacca

SEQ ID NO: 299830 - RNA, 22 nt, Human
augggguuucaccauguuggcc

SEQ ID NO: 299831 - RNA, 24 nt, Human
augggguuucaccauguuggccag

SEQ ID NO: 299832 - RNA, 18 nt, Human
auucuccugccucagccu

SEQ ID NO: 299833 - RNA, 24 nt, Human
auuuuuguauuuuuaguagagaug

SEQ ID NO: 299834 - RNA, 24 nt, Human
caaaguaccgggauuacaggcaua

SEQ ID NO: 299835 - RNA, 24 nt, Human
caaagugcugggauuauaggcaug

SEQ ID NO: 299836 - RNA, 23 nt, Human
caaccuccaccuccugaauucaa

SEQ ID NO: 299837 - RNA, 27 nt, Human
caacuccugggcucaagcgauccccuu

SEQ ID NO: 299838 - RNA, 20 nt, Human
caagugauucuccugccuca

SEQ ID NO: 299839 - RNA, 22 nt, Human
caagugauucuccugccucagc

SEQ ID NO: 299840 - RNA, 24 nt, Human
caauuuuuguauuuuuaguagaga

SEQ ID NO: 299841 - RNA, 24 nt, Human
cacaccaccaugccuggcuaauuu

SEQ ID NO: 299842 - RNA, 21 nt, Human
caccauguuggccaggcuggu

SEQ ID NO: 299843 - RNA, 24 nt, Human
caccauguuggccaggcuggucuc

SEQ ID NO: 299844 - RNA, 27 nt, Human
caccauguuggccaggcuggucucgaa

SEQ ID NO: 299845 - RNA, 24 nt, Human
caccucagccucccaaaguaccgg

SEQ ID NO: 299846 - RNA, 23 nt, Human
caccugccucagccucccaaagu

SEQ ID NO: 299847 - RNA, 20 nt, Human
cacuaugccuugcccagccc

SEQ ID NO: 299848 - RNA, 21 nt, Human
cacugcaaccuccaccuccug

SEQ ID NO: 299849 - RNA, 19 nt, Human
cagagccccgucucuuucc

SEQ ID NO: 299850 - RNA, 24 nt, Human
cagaguggaccccagccaggugcc

SEQ ID NO: 299851 - RNA, 21 nt, Human
cagccuccaacuccugggcuc

SEQ ID NO: 299852 - RNA, 23 nt, Human
cagccuccaacuccugggcucaa

SEQ ID NO: 299853 - RNA, 24 nt, Human
caggaucuugcuguguugcccagg

SEQ ID NO: 299854 - RNA, 22 nt, Human
cagggauagaagcccaggagaa

SEQ ID NO: 299855 - RNA, 22 nt, Human
caggugauccaccugccucagc

SEQ ID NO: 299856 - RNA, 25 nt, Human
caguagcugggauuacaggcacccg

SEQ ID NO: 299857 - RNA, 20 nt, Human
cauggagccucuuccuggaa

SEQ ID NO: 299858 - RNA, 24 nt, Human
cauguuggccaggcuggucucgaa

SEQ ID NO: 299859 - RNA, 24 nt, Human
ccaaaguaccgggauuacaggcau

SEQ ID NO: 299860 - RNA, 24 nt, Human
ccaaagugcugggauuauaggcau

SEQ ID NO: 299861 - RNA, 25 nt, Human
ccaacuccugggcucaagcgauccc

SEQ ID NO: 299862 - RNA, 24 nt, Human
ccaccuccugaauucaagugauuc

SEQ ID NO: 299863 - RNA, 26 nt, Human
ccaccugccucagccucccaaagugc

SEQ ID NO: 299864 - RNA, 26 nt, Human
ccagcagacagcaccucuccucacag

SEQ ID NO: 299865 - RNA, 18 nt, Human
ccagggcaucguaagagg

SEQ ID NO: 299866 - RNA, 22 nt, Human
ccaguagcugggauuacaggca

SEQ ID NO: 299867 - RNA, 24 nt, Human
cccaaaguaccgggauuacaggca

SEQ ID NO: 299868 - RNA, 20 nt, Human
cccaggcuggagugcaguga

SEQ ID NO: 299869 - RNA, 23 nt, Human
cccaguagcugggauuacaggca

SEQ ID NO: 299870 - RNA, 24 nt, Human
ccccaggcuggagugcaguggcau

SEQ ID NO: 299871 - RNA, 23 nt, Human
ccccaguagcugggauuacaggc

SEQ ID NO: 299872 - RNA, 21 nt, Human
ccuaaccucaggugauccacc

SEQ ID NO: 299873 - RNA, 23 nt, Human
ccuaaccucaggugauccaccug

SEQ ID NO: 299874 - RNA, 23 nt, Human
ccuaaccucaggugauccaccug

SEQ ID NO: 299875 - RNA, 24 nt, Human
ccuauaacuaagagcuugauuguc

SEQ ID NO: 299876 - RNA, 23 nt, Human
ccucuccucacagggauagaagc

SEQ ID NO: 299877 - RNA, 23 nt, Human
ccugaauucaagugauucuccug

SEQ ID NO: 299878 - RNA, 20 nt, Human
ccugggcucaagcgaucccc

SEQ ID NO: 299879 - RNA, 21 nt, Human
ccugggcucaagcgauccccu

SEQ ID NO: 299880 - RNA, 21 nt, Human
cgggauuacaggcauaagcca

SEQ ID NO: 299881 - RNA, 22 nt, Human
cgggauuacaggcauaagccac

SEQ ID NO: 299882 - RNA, 24 nt, Human
cgggauuacaggcauaagccacua

SEQ ID NO: 299883 - RNA, 18 nt, Human
cguaagaggcugccccuu

SEQ ID NO: 299884 - RNA, 26 nt, Human
cucacugcaaccuccaccuccugaau

SEQ ID NO: 299885 - RNA, 24 nt, Human
cucagccuccccaguagcugggau

SEQ ID NO: 299886 - RNA, 23 nt, Human
cucaggugauccaccugccucag

SEQ ID NO: 299887 - RNA, 22 nt, Human
cuccagcagacagcaccucucc

SEQ ID NO: 299888 - RNA, 22 nt, Human
cuccucuuccugcccccuaccg

SEQ ID NO: 299889 - RNA, 19 nt, Human
cuccugaauucaagugauu

SEQ ID NO: 299890 - RNA, 23 nt, Human
cuccugccucagccuccccagua

SEQ ID NO: 299891 - RNA, 21 nt, Human
cucucuucagccuccaacucc

SEQ ID NO: 299892 - RNA, 23 nt, Human
cugcaaccuccaccuccugaauu

SEQ ID NO: 299893 - RNA, 23 nt, Human
cugccucagccucccaaagugcu

SEQ ID NO: 299894 - RNA, 24 nt, Human
cugccucagccucccaaagugcug

SEQ ID NO: 299895 - RNA, 23 nt, Human
cugccucagccuccccaguagcu

SEQ ID NO: 299896 - RNA, 23 nt, Human
cuucagccuccaacuccugggcu

SEQ ID NO: 299897 - RNA, 18 nt, Human
cuuccugcccccuaccgu

SEQ ID NO: 299898 - RNA, 25 nt, Human
cuuccugcccccuaccguaguuuca

SEQ ID NO: 299899 - RNA, 24 nt, Human
cuugcucugucagccccaggcugg

SEQ ID NO: 299900 - RNA, 22 nt, Human
cuugcuguguugcccaggcugg

SEQ ID NO: 299901 - RNA, 19 nt, Human
cuuuccuucucuuuucuuu

SEQ ID NO: 299902 - RNA, 19 nt, Human
cuuuccuuuccuucucuuu

SEQ ID NO: 299903 - RNA, 21 nt, Human
gaaagucugccugccaagagc

SEQ ID NO: 299904 - RNA, 18 nt, Human
gagaugggguuucaccau

SEQ ID NO: 299905 - RNA, 24 nt, Human
gagaugggguuucaccauguuggc

SEQ ID NO: 299906 - RNA, 21 nt, Human
gauccaccugccucagccucc

SEQ ID NO: 299907 - RNA, 22 nt, Human
gauuacaggcacccgccaccau

SEQ ID NO: 299908 - RNA, 18 nt, Human
gauuacaggcauaagcca

SEQ ID NO: 299909 - RNA, 21 nt, Human
gauuacaggcauaagccacua

SEQ ID NO: 299910 - RNA, 24 nt, Human
gauuacaggcauaagccacuaugc

SEQ ID NO: 299911 - RNA, 21 nt, Human
gauucuccugccucagccucc

SEQ ID NO: 299912 - RNA, 22 nt, Human
gcaaccuccaccuccugaauuc

SEQ ID NO: 299913 - RNA, 20 nt, Human
gccacugugcucggccucag

SEQ ID NO: 299914 - RNA, 22 nt, Human
gcccagccaauuuuuguauuuu

SEQ ID NO: 299915 - RNA, 19 nt, Human
gcccaggcuggagugcagu

SEQ ID NO: 299916 - RNA, 21 nt, Human
gcccuucuuuucugcuccucu

SEQ ID NO: 299917 - RNA, 19 nt, Human
gcuggagugcaguggcaug

SEQ ID NO: 299918 - RNA, 23 nt, Human
gcuggucucgaacuccuaaccuc

SEQ ID NO: 299919 - RNA, 20 nt, Human
ggagaggguggacuagaggc

SEQ ID NO: 299920 - RNA, 24 nt, Human
ggauuacaggcauaagccacuaug

SEQ ID NO: 299921 - RNA, 20 nt, Human
gggauagaagcccaggagaa

SEQ ID NO: 299922 - RNA, 21 nt, Human
gggauuacaggcauaagccac

SEQ ID NO: 299923 - RNA, 22 nt, Human
gggauuacaggcauaagccacu

SEQ ID NO: 299924 - RNA, 23 nt, Human
gggauuacaggcauaagccacua

SEQ ID NO: 299925 - RNA, 24 nt, Human
gggggucuugcuauguugcccagg

SEQ ID NO: 299926 - RNA, 22 nt, Human
gggguuucaccauguuggccag

SEQ ID NO: 299927 - RNA, 23 nt, Human
gggguuucaccauguuggccagg

SEQ ID NO: 299928 - RNA, 18 nt, Human
ggguuucaccauguuggc

SEQ ID NO: 299929 - RNA, 23 nt, Human
guagagaugggguuucaccaugu

SEQ ID NO: 299930 - RNA, 18 nt, Human
guagcugggauuacaggc

SEQ ID NO: 299931 - RNA, 18 nt, Human
gugauccaccugccucag

SEQ ID NO: 299932 - RNA, 24 nt, Human
gugauccaccugccucagccuccc

SEQ ID NO: 299933 - RNA, 24 nt, Human
gugauucuccugccucagccuccc

SEQ ID NO: 299934 - RNA, 24 nt, Human
uaaccucaggugauccaccugccu

SEQ ID NO: 299935 - RNA, 24 nt, Human
uaacuaagagcuugauugucuccc

SEQ ID NO: 299936 - RNA, 27 nt, Human
uaagcaguccucccaccucagccuccc

SEQ ID NO: 299937 - RNA, 27 nt, Human
uaagcaguccucccaccucagccuccc

SEQ ID NO: 299938 - RNA, 24 nt, Human
uacaggcacccgccaccaugccca

SEQ ID NO: 299939 - RNA, 24 nt, Human
uaccgggauuacaggcauaagcca

SEQ ID NO: 299940 - RNA, 18 nt, Human
uaccguaguuucagaaac

SEQ ID NO: 299941 - RNA, 19 nt, Human
uaccguaguuucagaaaca

SEQ ID NO: 299942 - RNA, 22 nt, Human
uagagaugggguuucaccaugu

SEQ ID NO: 299943 - RNA, 24 nt, Human
uagcucucuucagccuccaacucc

SEQ ID NO: 299944 - RNA, 24 nt, Human
uaguagagaugggguuucaccaug

SEQ ID NO: 299945 - RNA, 26 nt, Human
uaguagagaugggguuucaccauguu

SEQ ID NO: 299946 - RNA, 22 nt, Human
uaguuucagaaacaaaacuggg

SEQ ID NO: 299947 - RNA, 23 nt, Human
uauguugcccaggcuggucucaa

SEQ ID NO: 299948 - RNA, 24 nt, Human
uauguugcccaggcuggucucaaa

SEQ ID NO: 299949 - RNA, 20 nt, Human
ucaaccuucugaguagcugg

SEQ ID NO: 299950 - RNA, 19 nt, Human
ucacugcaaccuccaccuc

SEQ ID NO: 299951 - RNA, 20 nt, Human
ucacugcaaccuccaccucc

SEQ ID NO: 299952 - RNA, 22 nt, Human
ucacugcaaccuccaccuccug

SEQ ID NO: 299953 - RNA, 23 nt, Human
ucacugcaaccuccaccuccuga

SEQ ID NO: 299954 - RNA, 27 nt, Human
ucacugcaaccuccaccuccugaauuc

SEQ ID NO: 299955 - RNA, 18 nt, Human
ucagccucccaaaguacc

SEQ ID NO: 299956 - RNA, 20 nt, Human
ucagccucccaaaguaccgg

SEQ ID NO: 299957 - RNA, 20 nt, Human
ucagccuccccaguagcugg

SEQ ID NO: 299958 - RNA, 22 nt, Human
ucaggugauccaccugccucag

SEQ ID NO: 299959 - RNA, 24 nt, Human
ucccaaaguaccgggauuacaggc

SEQ ID NO: 299960 - RNA, 24 nt, Human
ucccaaagugcugggauuauaggc

SEQ ID NO: 299961 - RNA, 24 nt, Human
uccccaguagcugggauuacaggc

SEQ ID NO: 299962 - RNA, 27 nt, Human
uccucccaccucagccucccaaaguac

SEQ ID NO: 299963 - RNA, 21 nt, Human
uccugaauucaagugauucuc

SEQ ID NO: 299964 - RNA, 24 nt, Human
uccugaauucaagugauucuccug

SEQ ID NO: 299965 - RNA, 18 nt, Human
uccugggcucaagcgauc

SEQ ID NO: 299966 - RNA, 24 nt, Human
uccugggcucaagcgauccccuuu

SEQ ID NO: 299967 - RNA, 24 nt, Human
ucucaaacuccugagcuuaagcag

SEQ ID NO: 299968 - RNA, 19 nt, Human
ucuccugacuccccacccu

SEQ ID NO: 299969 - RNA, 20 nt, Human
ucucuucagccuccaacucc

SEQ ID NO: 299970 - RNA, 23 nt, Human
ucucuuuccuuuccuucucuuuu

SEQ ID NO: 299971 - RNA, 23 nt, Human
ucugaguagcugggauucucagg

SEQ ID NO: 299972 - RNA, 25 nt, Human
ucugaguagcugggauucucaggug

SEQ ID NO: 299973 - RNA, 18 nt, Human
ucugucagccccaggcug

SEQ ID NO: 299974 - RNA, 22 nt, Human
ucugucagccccaggcuggagu

SEQ ID NO: 299975 - RNA, 18 nt, Human
ucuugcuauguugcccag

SEQ ID NO: 299976 - RNA, 19 nt, Human
ucuugcuauguugcccagg

SEQ ID NO: 299977 - RNA, 23 nt, Human
ucuugcuauguugcccaggcugg

SEQ ID NO: 299978 - RNA, 24 nt, Human
ucuugcuauguugcccaggcuggu

SEQ ID NO: 299979 - RNA, 21 nt, Human
ucuugcucugucagccccagg

SEQ ID NO: 299980 - RNA, 24 nt, Human
ucuugcucugucagccccaggcug

SEQ ID NO: 299981 - RNA, 25 nt, Human
ucuugcucugucagccccaggcugg

SEQ ID NO: 299982 - RNA, 26 nt, Human
ucuugcucugucagccccaggcugga

SEQ ID NO: 299983 - RNA, 23 nt, Human
ucuugcuguguugcccaggcugg

SEQ ID NO: 299984 - RNA, 24 nt, Human
ucuugcuguguugcccaggcugga

SEQ ID NO: 299985 - RNA, 18 nt, Human
ugaauucaagugauucuc

SEQ ID NO: 299986 - RNA, 23 nt, Human
ugaauucaagugauucuccugcc

SEQ ID NO: 299987 - RNA, 24 nt, Human
ugaauucaagugauucuccugccu

SEQ ID NO: 299988 - RNA, 20 nt, Human
ugacagaugugacucaagag

SEQ ID NO: 299989 - RNA, 22 nt, Human
ugagacagugucuugcucuguc

SEQ ID NO: 299990 - RNA, 20 nt, Human
ugcaguggcaugaugucggc

SEQ ID NO: 299991 - RNA, 22 nt, Human
ugccaagagccaaagggcuuua

SEQ ID NO: 299992 - RNA, 18 nt, Human
ugcccaggcuggagugca

SEQ ID NO: 299993 - RNA, 22 nt, Human
ugcccaggcuggagugcaguga

SEQ ID NO: 299994 - RNA, 24 nt, Human
ugcccaggcuggagugcagugaug

SEQ ID NO: 299995 - RNA, 24 nt, Human
ugcccaggcuggucucaaacuccu

SEQ ID NO: 299996 - RNA, 28 nt, Human
ugcccaggcuggucucaaacuccugagc

SEQ ID NO: 299997 - RNA, 24 nt, Human
ugccucagccucccaaagugcugg

SEQ ID NO: 299998 - RNA, 21 nt, Human
ugccucagccuccccaguagc

SEQ ID NO: 299999 - RNA, 24 nt, Human
ugccucagccuccccaguagcugg

SEQ ID NO: 300000 - RNA, 19 nt, Human
ugccuugcccagcccuucu

SEQ ID NO: 300001 - RNA, 24 nt, Human
ugcuauguugcccaggcuggucuc

SEQ ID NO: 300002 - RNA, 27 nt, Human
ugcuauguugcccaggcuggucucaaa

SEQ ID NO: 300003 - RNA, 19 nt, Human
ugcucugucagccccaggc

SEQ ID NO: 300004 - RNA, 26 nt, Human
ugcucugucagccccaggcuggagug

SEQ ID NO: 300005 - RNA, 21 nt, Human
ugcugaaaauuuuccccacuc

SEQ ID NO: 300006 - RNA, 24 nt, Human
ugcuguguugcccaggcuggagug

SEQ ID NO: 300007 - RNA, 28 nt, Human
uggagugcagugaugcaguccuagcacg

SEQ ID NO: 300008 - RNA, 23 nt, Human
uggagugcaguggcaugaugucg

SEQ ID NO: 300009 - RNA, 24 nt, Human
uggagugcaguggcaugaugucgg

SEQ ID NO: 300010 - RNA, 20 nt, Human
uggcaugaugucggcucacu

SEQ ID NO: 300011 - RNA, 24 nt, Human
uggccaggcuggucucgaacuccu

SEQ ID NO: 300012 - RNA, 21 nt, Human
ugggaaagugaagcaggagcc

SEQ ID NO: 300013 - RNA, 21 nt, Human
ugggauuacaggcacccgcca

SEQ ID NO: 300014 - RNA, 22 nt, Human
ugggauuacaggcacccgccac

SEQ ID NO: 300015 - RNA, 24 nt, Human
ugggauuacaggcacccgccacca

SEQ ID NO: 300016 - RNA, 25 nt, Human
ugggauuacaggcacccgccaccau

SEQ ID NO: 300017 - RNA, 18 nt, Human
ugggauuauaggcauggg

SEQ ID NO: 300018 - RNA, 21 nt, Human
ugggauuauaggcaugggcca

SEQ ID NO: 300019 - RNA, 22 nt, Human
ugggauuauaggcaugggccac

SEQ ID NO: 300020 - RNA, 22 nt, Human
ugggauuauaggcaugggccac

SEQ ID NO: 300021 - RNA, 22 nt, Human
ugggauuauaggcaugggccac

SEQ ID NO: 300022 - RNA, 24 nt, Human
ugggauuauaggcaugggccacug

SEQ ID NO: 300023 - RNA, 25 nt, Human
ugggcucaagcgauccccuuugucu

SEQ ID NO: 300024 - RNA, 24 nt, Human
ugggguuucaccauguuggccagg

SEQ ID NO: 300025 - RNA, 23 nt, Human
uggguaugagugaagcuuuggug

SEQ ID NO: 300026 - RNA, 18 nt, Human
ugguagaggaagacaggg

SEQ ID NO: 300027 - RNA, 23 nt, Human
ugucagccccaggcuggagugca

SEQ ID NO: 300028 - RNA, 20 nt, Human
ugucucaaccuucugaguaa

SEQ ID NO: 300029 - RNA, 22 nt, Human
ugucucaaccuucugaguagcu

SEQ ID NO: 300030 - RNA, 18 nt, Human
uguguugcccaggcugga

SEQ ID NO: 300031 - RNA, 22 nt, Human
uguguugcccaggcuggagugc

SEQ ID NO: 300032 - RNA, 21 nt, Human
uguugcccaggcuggagugca

SEQ ID NO: 300033 - RNA, 18 nt, Human
uuaguagagaugggguuu

SEQ ID NO: 300034 - RNA, 22 nt, Human
uuaguagagaugggguuucacc

SEQ ID NO: 300035 - RNA, 24 nt, Human
uuaguagagaugggguuucaccau

SEQ ID NO: 300036 - RNA, 21 nt, Human
uucaagugauucuccugccuc

SEQ ID NO: 300037 - RNA, 23 nt, Human
uucaagugauucuccugccucag

SEQ ID NO: 300038 - RNA, 24 nt, Human
uucaagugauucuccugccucagc

SEQ ID NO: 300039 - RNA, 24 nt, Human
uugcccaggcuggagugcagugau

SEQ ID NO: 300040 - RNA, 24 nt, Human
uugcuguguugcccaggcuggagu

SEQ ID NO: 300041 - RNA, 23 nt, Human
uuguauuuuuaguagagaugggg

SEQ ID NO: 300042 - RNA, 24 nt, Human
uuucaccauguuggccaggcuggu

SEQ ID NO: 300043 - RNA, 24 nt, Human
uuuuuaguagagaugggguuucac

SEQ ID NO: 300044 - RNA, 22 nt, Human
uuuuucuuuuuugagacagugu

SEQ ID NO: 300045 - RNA, 20 nt, Human
uuuuuguauuuuuaguagag

SEQ ID NO: 300046 - RNA, 18 nt, Human
uuuuuuuuuucuuuuuug

SEQ ID NO: 300047 - RNA, 25 nt, Human
uuuuuuuuuuuuuuuuuuucuuuuu

SEQ ID NO: 300048 - RNA, 25 nt, Human
aaaaaaaaaaaaggaaauaaucaaa

SEQ ID NO: 300049 - RNA, 19 nt, Human
aaaaaaaaaggcaugaaag

SEQ ID NO: 300050 - RNA, 20 nt, Human
aaaauccauuucauucaagu

SEQ ID NO: 300051 - RNA, 20 nt, Human
aaacaaccaucacacaugca

SEQ ID NO: 300052 - RNA, 20 nt, Human
aaacaagcucuaaggugaca

SEQ ID NO: 300053 - RNA, 20 nt, Human
aaacuugcaaguuacuccuu

SEQ ID NO: 300054 - RNA, 18 nt, Human
aaagaggaauaaacucua

SEQ ID NO: 300055 - RNA, 23 nt, Human
aaagcaguauauauuucugaagc

SEQ ID NO: 300056 - RNA, 22 nt, Human
aaaugcccagcccuagcuccac

SEQ ID NO: 300057 - RNA, 23 nt, Human
aaaugcccagcccuagcuccacu

SEQ ID NO: 300058 - RNA, 19 nt, Human
aacagauggcaaacaacca

SEQ ID NO: 300059 - RNA, 23 nt, Human
aacuacuuggucaaacauacguc

SEQ ID NO: 300060 - RNA, 19 nt, Human
aagaagacuuuauuaaggc

SEQ ID NO: 300061 - RNA, 18 nt, Human
aagagcuucugucucaaa

SEQ ID NO: 300062 - RNA, 19 nt, Human
aagagcuucugucucaaaa

SEQ ID NO: 300063 - RNA, 18 nt, Human
aagcuagucaugauauac

SEQ ID NO: 300064 - RNA, 18 nt, Human
aaguuuuuucuuuccuug

SEQ ID NO: 300065 - RNA, 21 nt, Human
acaagaccucaucuagcaaac

SEQ ID NO: 300066 - RNA, 22 nt, Human
acgcuaaauuauaaagcagcac

SEQ ID NO: 300067 - RNA, 25 nt, Human
agaaaaaaaaugcauggcacaaaaa

SEQ ID NO: 300068 - RNA, 22 nt, Human
agaaaaacacuggugaagagca

SEQ ID NO: 300069 - RNA, 19 nt, Human
agaacagauaauuuacaau

SEQ ID NO: 300070 - RNA, 23 nt, Human
agacaacacgaacugaugacuga

SEQ ID NO: 300071 - RNA, 20 nt, Human
agauuuuuauccaguguagc

SEQ ID NO: 300072 - RNA, 20 nt, Human
agcacagauuuguacugaaa

SEQ ID NO: 300073 - RNA, 23 nt, Human
agcuagucaugauauacaaccuc

SEQ ID NO: 300074 - RNA, 18 nt, Human
agcuggugcggggcucug

SEQ ID NO: 300075 - RNA, 19 nt, Human
aggaaaacaucuaaaaaag

SEQ ID NO: 300076 - RNA, 22 nt, Human
aguaaauaauaaagacuuacaa

SEQ ID NO: 300077 - RNA, 23 nt, Human
agugcagcucacugaaccacacu

SEQ ID NO: 300078 - RNA, 24 nt, Human
auaaaacaaaauuaaaacagcauu

SEQ ID NO: 300079 - RNA, 24 nt, Human
auaaacaagcucuaaggugacaag

SEQ ID NO: 300080 - RNA, 19 nt, Human
auaaagcagcacaagggga

SEQ ID NO: 300081 - RNA, 26 nt, Human
auauucuugugaaacuacuuggucag

SEQ ID NO: 300082 - RNA, 22 nt, Human
auguccaccuugcucggaugac

SEQ ID NO: 300083 - RNA, 18 nt, Human
auuuuaucugcuuuguca

SEQ ID NO: 300084 - RNA, 23 nt, Human
caaaaaauaaauaaugcauucaa

SEQ ID NO: 300085 - RNA, 22 nt, Human
caaaaugcaaaguaaauaauag

SEQ ID NO: 300086 - RNA, 22 nt, Human
caaaguaaauaauaaagacuua

SEQ ID NO: 300087 - RNA, 21 nt, Human
caacagauggcaaacaaccau

SEQ ID NO: 300088 - RNA, 19 nt, Human
caccguggcucccagagga

SEQ ID NO: 300089 - RNA, 23 nt, Human
cacgcuaaauuauaaagcagcac

SEQ ID NO: 300090 - RNA, 19 nt, Human
cacugaaccacacuauuca

SEQ ID NO: 300091 - RNA, 18 nt, Human
cagaggaucccaaacaaa

SEQ ID NO: 300092 - RNA, 18 nt, Human
cagaguauguauacacac

SEQ ID NO: 300093 - RNA, 23 nt, Human
cagcuagaucucaggggacugaa

SEQ ID NO: 300094 - RNA, 19 nt, Human
cagcucacugaaccacacu

SEQ ID NO: 300095 - RNA, 18 nt, Human
cagcucuaccaagcugaa

SEQ ID NO: 300096 - RNA, 19 nt, Human
cauauaaaugcuuuucaga

SEQ ID NO: 300097 - RNA, 20 nt, Human
cauauaaaugcuuuucagag

SEQ ID NO: 300098 - RNA, 24 nt, Human
cccaaacaaaagccauuuuuaagg

SEQ ID NO: 300099 - RNA, 18 nt, Human
ccccauacaguacccaga

SEQ ID NO: 300100 - RNA, 22 nt, Human
ccgaguuaaaaaaaaaaaaaaa

SEQ ID NO: 300101 - RNA, 26 nt, Human
ccgaguuaaaaaaaaaaaaaaaggaa

SEQ ID NO: 300102 - RNA, 19 nt, Human
ccucugcaagauaugcuua

SEQ ID NO: 300103 - RNA, 18 nt, Human
ccugcaacauaaaguugu

SEQ ID NO: 300104 - RNA, 20 nt, Human
cuaagcaucagcuagaucuu

SEQ ID NO: 300105 - RNA, 18 nt, Human
cucaggggacugaaaugg

SEQ ID NO: 300106 - RNA, 19 nt, Human
cuccacuguuaccuuucaa

SEQ ID NO: 300107 - RNA, 20 nt, Human
cuuucaaaugcagcaaaaca

SEQ ID NO: 300108 - RNA, 21 nt, Human
gaaaaacacuggugaagagca

SEQ ID NO: 300109 - RNA, 20 nt, Human
gaaaacaucuaaaaaagacu

SEQ ID NO: 300110 - RNA, 19 nt, Human
gaaaugaacaucuagugac

SEQ ID NO: 300111 - RNA, 22 nt, Human
gaagaaaaacacuggugaagag

SEQ ID NO: 300112 - RNA, 18 nt, Human
gaccgugguuguggcaug

SEQ ID NO: 300113 - RNA, 21 nt, Human
gaccgugguuguggcauguga

SEQ ID NO: 300114 - RNA, 21 nt, Human
gagcuggugcggggcucuggg

SEQ ID NO: 300115 - RNA, 18 nt, Human
gccuggauguaaaaugcc

SEQ ID NO: 300116 - RNA, 22 nt, Human
ggggcucuggggcccugaggcc

SEQ ID NO: 300117 - RNA, 21 nt, Human
ggugaagagcaacucugcuua

SEQ ID NO: 300118 - RNA, 26 nt, Human
ggugagaaaaaaaaugcauggcacaa

SEQ ID NO: 300119 - RNA, 19 nt, Human
gugcggggcucuggggccc

SEQ ID NO: 300120 - RNA, 24 nt, Human
guuaaaaaaaaaaaaaaaggaaau

SEQ ID NO: 300121 - RNA, 22 nt, Human
guuugcaugaagcuuaagacac

SEQ ID NO: 300122 - RNA, 19 nt, Human
uaaaaaccaacaaacugga

SEQ ID NO: 300123 - RNA, 18 nt, Human
uaaaaugcccagcccuag

SEQ ID NO: 300124 - RNA, 21 nt, Human
uaaaccaagaguaaaagcuag

SEQ ID NO: 300125 - RNA, 19 nt, Human
uaaagcagcacaaggggaa

SEQ ID NO: 300126 - RNA, 25 nt, Human
uaaauacaugguuguaaacagacaa

SEQ ID NO: 300127 - RNA, 18 nt, Human
uaaauuauaaagcagcac

SEQ ID NO: 300128 - RNA, 25 nt, Human
uaacacacauaaaaguauuauagaa

SEQ ID NO: 300129 - RNA, 26 nt, Human
uaacacacauaaaaguauuauagaac

SEQ ID NO: 300130 - RNA, 19 nt, Human
uaacauuacaguauguaca

SEQ ID NO: 300131 - RNA, 20 nt, Human
uaagaacagauaauuuacaa

SEQ ID NO: 300132 - RNA, 23 nt, Human
uaagugauaaaggacuuccuaca

SEQ ID NO: 300133 - RNA, 21 nt, Human
uaauacaguuccuggugcuga

SEQ ID NO: 300134 - RNA, 21 nt, Human
uacacuuaaaaccguuucuca

SEQ ID NO: 300135 - RNA, 19 nt, Human
uacagaguauguauacaca

SEQ ID NO: 300136 - RNA, 19 nt, Human
uacagguaaggucauuugg

SEQ ID NO: 300137 - RNA, 23 nt, Human
uacuauaacuggcuguaaaaaca

SEQ ID NO: 300138 - RNA, 24 nt, Human
uagaacaaauagucacuuugcaca

SEQ ID NO: 300139 - RNA, 28 nt, Human
uagcacagauuuguacugaaaacuugca

SEQ ID NO: 300140 - RNA, 19 nt, Human
uaggaaaacaucuaaaaaa

SEQ ID NO: 300141 - RNA, 18 nt, Human
uaggaaauguaaagccac

SEQ ID NO: 300142 - RNA, 25 nt, Human
uaggagauacuaaguaggaaaacau

SEQ ID NO: 300143 - RNA, 25 nt, Human
uaggcacucugugggggaaauacua

SEQ ID NO: 300144 - RNA, 20 nt, Human
uauaucucccacuugcuuca

SEQ ID NO: 300145 - RNA, 24 nt, Human
uauguacauugcaauaaauacaug

SEQ ID NO: 300146 - RNA, 22 nt, Human
ucaacagauggcaaacaaccau

SEQ ID NO: 300147 - RNA, 21 nt, Human
ucaggaagacuugaaauuaga

SEQ ID NO: 300148 - RNA, 19 nt, Human
ucaguuaauugcuaugaac

SEQ ID NO: 300149 - RNA, 26 nt, Human
uccacauauaaaugcuuuucagaguu

SEQ ID NO: 300150 - RNA, 22 nt, Human
uccacaucaaaaccuguaggac

SEQ ID NO: 300151 - RNA, 19 nt, Human
uccccauacaguacccaga

SEQ ID NO: 300152 - RNA, 21 nt, Human
uccuggcagaugacagugagg

SEQ ID NO: 300153 - RNA, 24 nt, Human
ucuaaaacuguaauacaguuccug

SEQ ID NO: 300154 - RNA, 19 nt, Human
ucuacuuaaaaaaaaaaaa

SEQ ID NO: 300155 - RNA, 18 nt, Human
ucuuacuauaacuggcug

SEQ ID NO: 300156 - RNA, 21 nt, Human
ucuuccauaaacaagcucuaa

SEQ ID NO: 300157 - RNA, 20 nt, Human
ugaaauggggacucucuuca

SEQ ID NO: 300158 - RNA, 20 nt, Human
ugaagaaaaacacuggugaa

SEQ ID NO: 300159 - RNA, 23 nt, Human
ugaagagcaacucugcuuaucug

SEQ ID NO: 300160 - RNA, 20 nt, Human
ugaagauguccaccuugcuc

SEQ ID NO: 300161 - RNA, 21 nt, Human
ugacauggaggugaaaaaacu

SEQ ID NO: 300162 - RNA, 22 nt, Human
ugaccgugguuguggcauguga

SEQ ID NO: 300163 - RNA, 22 nt, Human
ugacguggggauaaagucagaa

SEQ ID NO: 300164 - RNA, 19 nt, Human
ugacuuacuuuccaguccc

SEQ ID NO: 300165 - RNA, 20 nt, Human
ugagaaaaaaaaugcauggc

SEQ ID NO: 300166 - RNA, 21 nt, Human
ugagaaaaaaaaugcauggca

SEQ ID NO: 300167 - RNA, 24 nt, Human
ugaggccccgcacggagcaggagg

SEQ ID NO: 300168 - RNA, 22 nt, Human
ugauaaaggacuuccuacacgu

SEQ ID NO: 300169 - RNA, 24 nt, Human
ugaucaacagauggcaaacaacca

SEQ ID NO: 300170 - RNA, 22 nt, Human
ugcagcaaaacagaagaaaaua

SEQ ID NO: 300171 - RNA, 23 nt, Human
uggcaagaaguacuuaagagcuu

SEQ ID NO: 300172 - RNA, 22 nt, Human
uggcacaaaaaauaaauaaugc

SEQ ID NO: 300173 - RNA, 23 nt, Human
uggcagaugaaguucugaacaua

SEQ ID NO: 300174 - RNA, 20 nt, Human
uggcucccagaggaucccuc

SEQ ID NO: 300175 - RNA, 24 nt, Human
uggcuguccauuaaggaagaguag

SEQ ID NO: 300176 - RNA, 23 nt, Human
uggugaagagcaacucugcuuau

SEQ ID NO: 300177 - RNA, 25 nt, Human
uuaaaaccaaauaggauuaguugua

SEQ ID NO: 300178 - RNA, 23 nt, Human
uuagagcaugaaauguguggauu

SEQ ID NO: 300179 - RNA, 24 nt, Human
uucauagagaagguaaagaagacu

SEQ ID NO: 300180 - RNA, 20 nt, Human
uuccgaguuaaaaaaaaaaa

SEQ ID NO: 300181 - RNA, 18 nt, Human
uucucuguaaaccaagag

SEQ ID NO: 300182 - RNA, 22 nt, Human
uugcacaugaagaaaaacacug

SEQ ID NO: 300183 - RNA, 23 nt, Human
uuggaguagauuuuaucugcuuu

SEQ ID NO: 300184 - RNA, 23 nt, Human
uuuccaaauauaucaacaccauc

SEQ ID NO: 300185 - RNA, 23 nt, Human
uuuggaguagauuuuaucugcuu

SEQ ID NO: 300186 - RNA, 22 nt, Human
uuuuucuuacuauaacuggcug

SEQ ID NO: 300187 - RNA, 19 nt, Human
aaacaaauauacaaaaaau

SEQ ID NO: 300188 - RNA, 22 nt, Human
aagaauacugcauacacuuugc

SEQ ID NO: 300189 - RNA, 19 nt, Human
accccagcuuccccgccca

SEQ ID NO: 300190 - RNA, 24 nt, Human
acucggccucgagacccucccccu

SEQ ID NO: 300191 - RNA, 21 nt, Human
agacacuauacagacagugug

SEQ ID NO: 300192 - RNA, 20 nt, Human
agacaguguguaagaaacua

SEQ ID NO: 300193 - RNA, 23 nt, Human
agcaaaaaaaccucagugcaaga

SEQ ID NO: 300194 - RNA, 24 nt, Human
agcaaaaaaaccucagugcaagaa

SEQ ID NO: 300195 - RNA, 23 nt, Human
aguacacgaaauaucacaaacaa

SEQ ID NO: 300196 - RNA, 21 nt, Human
aguggcaaaguauauaccaaa

SEQ ID NO: 300197 - RNA, 18 nt, Human
caaagcggccggagcgcg

SEQ ID NO: 300198 - RNA, 23 nt, Human
caagaauacugcauacacuuugc

SEQ ID NO: 300199 - RNA, 25 nt, Human
caccccagcuuccccgcccagccag

SEQ ID NO: 300200 - RNA, 19 nt, Human
caccgcgcgccucggaggc

SEQ ID NO: 300201 - RNA, 25 nt, Human
cagaacacaccaucucuguaaacuu

SEQ ID NO: 300202 - RNA, 21 nt, Human
cagacaguguguaagaaacua

SEQ ID NO: 300203 - RNA, 18 nt, Human
cagcugggguccgucccu

SEQ ID NO: 300204 - RNA, 19 nt, Human
cagcugggguccgucccuc

SEQ ID NO: 300205 - RNA, 23 nt, Human
caguguguaagaaacuaggcaua

SEQ ID NO: 300206 - RNA, 22 nt, Human
ccccuucguccugcuccagucg

SEQ ID NO: 300207 - RNA, 24 nt, Human
ccggcuuucgacaaagcggccgga

SEQ ID NO: 300208 - RNA, 23 nt, Human
cgaaauaucacaaacaaugcuuu

SEQ ID NO: 300209 - RNA, 22 nt, Human
gaaauaucacaaacaaugcuuu

SEQ ID NO: 300210 - RNA, 25 nt, Human
gcaguggcaaaguauauaccaaaag

SEQ ID NO: 300211 - RNA, 20 nt, Human
uaaaacaaauauacaaaaaa

SEQ ID NO: 300212 - RNA, 22 nt, Human
uaaaacaaauauacaaaaaaua

SEQ ID NO: 300213 - RNA, 23 nt, Human
uacagcaguggcaaaguauauac

SEQ ID NO: 300214 - RNA, 25 nt, Human
uacugcauacacuuugcaguacacg

SEQ ID NO: 300215 - RNA, 18 nt, Human
uacugcuuuuccacccca

SEQ ID NO: 300216 - RNA, 19 nt, Human
uagcauaaaacaaauauac

SEQ ID NO: 300217 - RNA, 20 nt, Human
uagcauaaaacaaauauaca

SEQ ID NO: 300218 - RNA, 25 nt, Human
uagcauaaaacaaauauacaaaaaa

SEQ ID NO: 300219 - RNA, 19 nt, Human
uccaccccagcuggggucc

SEQ ID NO: 300220 - RNA, 23 nt, Human
uccucuaaaaacauucaugcuau

SEQ ID NO: 300221 - RNA, 20 nt, Human
ucuguaaacuucaacucugc

SEQ ID NO: 300222 - RNA, 22 nt, Human
ugcauacacuuugcaguacacg

SEQ ID NO: 300223 - RNA, 22 nt, Human
uggcaagguuccgucauguugc

SEQ ID NO: 300224 - RNA, 18 nt, Human
uguaagaaacuaggcaua

SEQ ID NO: 300225 - RNA, 21 nt, Human
ugucccguggacucgucccuc

SEQ ID NO: 300226 - RNA, 21 nt, Human
uguguaagaaacuaggcauau

SEQ ID NO: 300227 - RNA, 23 nt, Human
aggguggugccguccagccagca

SEQ ID NO: 300228 - RNA, 18 nt, Human
cugggucuugucugcaaa

SEQ ID NO: 300229 - RNA, 18 nt, Human
gaacaguccuggaagcua

SEQ ID NO: 300230 - RNA, 27 nt, Human
gacucuucuacuucucaaggugugugg

SEQ ID NO: 300231 - RNA, 20 nt, Human
gaggccuuccaauggcaguu

SEQ ID NO: 300232 - RNA, 22 nt, Human
ggacugggacggaggccuucca

SEQ ID NO: 300233 - RNA, 23 nt, Human
ggaggccuuccaauggcaguuuu

SEQ ID NO: 300234 - RNA, 18 nt, Human
ggcugggagucccacugg

SEQ ID NO: 300235 - RNA, 23 nt, Human
uaacagcuuucaaauccuaugac

SEQ ID NO: 300236 - RNA, 19 nt, Human
ucaaauccuaugacucuuc

SEQ ID NO: 300237 - RNA, 21 nt, Human
uccacuggcuugagucaucuc

SEQ ID NO: 300238 - RNA, 20 nt, Human
ucucuucccaggaaagggug

SEQ ID NO: 300239 - RNA, 25 nt, Human
uucaacagcuaucauuaguguuacu

SEQ ID NO: 300240 - RNA, 22 nt, Human
uuuugcagucugcaacaagucc

SEQ ID NO: 300241 - RNA, 24 nt, Human
aaacaggcugggcgugguggcuca

SEQ ID NO: 300242 - RNA, 20 nt, Human
aauauggugaaaccccaucu

SEQ ID NO: 300243 - RNA, 24 nt, Human
aaucgcuugaaccugggaggugga

SEQ ID NO: 300244 - RNA, 18 nt, Human
acacauauguacaugugu

SEQ ID NO: 300245 - RNA, 24 nt, Human
acagagcaagacuccaucucaaaa

SEQ ID NO: 300246 - RNA, 24 nt, Human
acaggcugggcgugguggcucaug

SEQ ID NO: 300247 - RNA, 24 nt, Human
accugaggucaggaguucgagacc

SEQ ID NO: 300248 - RNA, 24 nt, Human
acggcacuccagccugggugacag

SEQ ID NO: 300249 - RNA, 26 nt, Human
acggcacuccagccugggugacagag

SEQ ID NO: 300250 - RNA, 20 nt, Human
agccacaggcagaacccaaa

SEQ ID NO: 300251 - RNA, 24 nt, Human
agccugcccaauauggugaaaccc

SEQ ID NO: 300252 - RNA, 24 nt, Human
agccugggugacagagcaagacuc

SEQ ID NO: 300253 - RNA, 22 nt, Human
aggcacgagaaucgcuugaacc

SEQ ID NO: 300254 - RNA, 24 nt, Human
aggcacgagaaucgcuugaaccug

SEQ ID NO: 300255 - RNA, 18 nt, Human
aggcagaacccaaauccu

SEQ ID NO: 300256 - RNA, 20 nt, Human
aggcggugaucaccugaggu

SEQ ID NO: 300257 - RNA, 24 nt, Human
aggcugaggcacgagaaucgcuug

SEQ ID NO: 300258 - RNA, 20 nt, Human
agguggagguugcagugagc

SEQ ID NO: 300259 - RNA, 24 nt, Human
agguggagguugcagugagcugag

SEQ ID NO: 300260 - RNA, 24 nt, Human
aucaccugaggucaggaguucgag

SEQ ID NO: 300261 - RNA, 24 nt, Human
aucgugccacggcacuccagccug

SEQ ID NO: 300262 - RNA, 19 nt, Human
augccuguaaucccagcac

SEQ ID NO: 300263 - RNA, 21 nt, Human
caagacuccaucucaaaaaaa

SEQ ID NO: 300264 - RNA, 22 nt, Human
caauauggugaaaccccaucug

SEQ ID NO: 300265 - RNA, 23 nt, Human
caccugaggucaggaguucgaga

SEQ ID NO: 300266 - RNA, 19 nt, Human
cacggcacuccagccuggg

SEQ ID NO: 300267 - RNA, 24 nt, Human
cacggcacuccagccugggugaca

SEQ ID NO: 300268 - RNA, 22 nt, Human
cacuccagccugggugacagag

SEQ ID NO: 300269 - RNA, 23 nt, Human
cacuccagccugggugacagagc

SEQ ID NO: 300270 - RNA, 24 nt, Human
caggaggcugaggcacgagaaucg

SEQ ID NO: 300271 - RNA, 23 nt, Human
caugccuguaaucccagcacuuc

SEQ ID NO: 300272 - RNA, 21 nt, Human
ccaauauggugaaaccccauc

SEQ ID NO: 300273 - RNA, 20 nt, Human
ccacggcacuccagccuggg

SEQ ID NO: 300274 - RNA, 21 nt, Human
ccacggcacuccagccugggu

SEQ ID NO: 300275 - RNA, 21 nt, Human
ccacggcacuccagccugggu

SEQ ID NO: 300276 - RNA, 23 nt, Human
ccacggcacuccagccuggguga

SEQ ID NO: 300277 - RNA, 24 nt, Human
ccacggcacuccagccugggugac

SEQ ID NO: 300278 - RNA, 25 nt, Human
ccaucucaaaaaaaaaaaaaaaaaa

SEQ ID NO: 300279 - RNA, 18 nt, Human
ccucuuguagcaaauagc

SEQ ID NO: 300280 - RNA, 22 nt, Human
ccugaggucaggaguucgagac

SEQ ID NO: 300281 - RNA, 24 nt, Human
ccugcccaauauggugaaacccca

SEQ ID NO: 300282 - RNA, 21 nt, Human
ccugggagguggagguugcag

SEQ ID NO: 300283 - RNA, 22 nt, Human
ccugggugacagagcaagacuc

SEQ ID NO: 300284 - RNA, 21 nt, Human
ccuguagucccagcuacucag

SEQ ID NO: 300285 - RNA, 22 nt, Human
ccuguagucccagcuacucagg

SEQ ID NO: 300286 - RNA, 24 nt, Human
cgagaccagccugcccaauauggu

SEQ ID NO: 300287 - RNA, 24 nt, Human
cgccuguagucccagcuacucagg

SEQ ID NO: 300288 - RNA, 21 nt, Human
cgcuugaaccugggaggugga

SEQ ID NO: 300289 - RNA, 18 nt, Human
cucaaaaaaaaaaaaaaa

SEQ ID NO: 300290 - RNA, 23 nt, Human
cucaugccuguaaucccagcacu

SEQ ID NO: 300291 - RNA, 24 nt, Human
cucaugccuguaaucccagcacuu

SEQ ID NO: 300292 - RNA, 19 nt, Human
cuccaucucaaaaaaaaaa

SEQ ID NO: 300293 - RNA, 19 nt, Human
cugaggcggugaucaccug

SEQ ID NO: 300294 - RNA, 21 nt, Human
cuguguacacauauguacaug

SEQ ID NO: 300295 - RNA, 23 nt, Human
gagaucgugccacggcacuccag

SEQ ID NO: 300296 - RNA, 23 nt, Human
gagguugcagugagcugagaucg

SEQ ID NO: 300297 - RNA, 22 nt, Human
gaucaccugaggucaggaguuc

SEQ ID NO: 300298 - RNA, 24 nt, Human
gaucaccugaggucaggaguucga

SEQ ID NO: 300299 - RNA, 24 nt, Human
gcacuccagccugggugacagagc

SEQ ID NO: 300300 - RNA, 19 nt, Human
gccacggcacuccagccug

SEQ ID NO: 300301 - RNA, 22 nt, Human
ggagguugcagugagcugagau

SEQ ID NO: 300302 - RNA, 24 nt, Human
ggagguugcagugagcugagaucg

SEQ ID NO: 300303 - RNA, 24 nt, Human
ggcggugaucaccugaggucagga

SEQ ID NO: 300304 - RNA, 23 nt, Human
ggcgugguggcucaugccuguaa

SEQ ID NO: 300305 - RNA, 23 nt, Human
ggcugggcgugguggcucaugcc

SEQ ID NO: 300306 - RNA, 24 nt, Human
ggugaucaccugaggucaggaguu

SEQ ID NO: 300307 - RNA, 19 nt, Human
gguggagguugcagugagc

SEQ ID NO: 300308 - RNA, 24 nt, Human
gguggcucaugccuguaaucccag

SEQ ID NO: 300309 - RNA, 24 nt, Human
gugaucaccugaggucaggaguuc

SEQ ID NO: 300310 - RNA, 20 nt, Human
guggagguugcagugagcug

SEQ ID NO: 300311 - RNA, 23 nt, Human
guggugggcgccuguagucccag

SEQ ID NO: 300312 - RNA, 19 nt, Human
guucgagaccagccugccc

SEQ ID NO: 300313 - RNA, 24 nt, Human
guugcagugagcugagaucgugcc

SEQ ID NO: 300314 - RNA, 22 nt, Human
uaggcuacaguuuauucacagu

SEQ ID NO: 300315 - RNA, 26 nt, Human
uauguacauguguggcugcaaauguu

SEQ ID NO: 300316 - RNA, 22 nt, Human
ucaaaaaaaaaaaaaaaaaaaa

SEQ ID NO: 300317 - RNA, 23 nt, Human
ucaaaaaaaaaaaaaaaaaaaaa

SEQ ID NO: 300318 - RNA, 25 nt, Human
ucaaaaaaaaaaaaaaaaaaaaaau

SEQ ID NO: 300319 - RNA, 23 nt, Human
ucauggacccuuuucaaaggucu

SEQ ID NO: 300320 - RNA, 24 nt, Human
uccagccugggugacagagcaaga

SEQ ID NO: 300321 - RNA, 23 nt, Human
uccaucucaaaaaaaaaaaaaaa

SEQ ID NO: 300322 - RNA, 24 nt, Human
ucgagaccagccugcccaauaugg

SEQ ID NO: 300323 - RNA, 24 nt, Human
ucgcuugaaccugggagguggagg

SEQ ID NO: 300324 - RNA, 23 nt, Human
ucgugccacggcacuccagccug

SEQ ID NO: 300325 - RNA, 26 nt, Human
ucugucuaccuguguacacauaugua

SEQ ID NO: 300326 - RNA, 19 nt, Human
ugaaaccccaucuguacug

SEQ ID NO: 300327 - RNA, 24 nt, Human
ugaaccugggagguggagguugca

SEQ ID NO: 300328 - RNA, 24 nt, Human
ugaggcacgagaaucgcuugaacc

SEQ ID NO: 300329 - RNA, 20 nt, Human
ugagggagccauaggguccc

SEQ ID NO: 300330 - RNA, 23 nt, Human
ugaucaccugaggucaggaguuc

SEQ ID NO: 300331 - RNA, 24 nt, Human
ugccuguaaucccagcacuucagg

SEQ ID NO: 300332 - RNA, 24 nt, Human
uggcucaugccuguaaucccagca

SEQ ID NO: 300333 - RNA, 18 nt, Human
ugggagguggagguugca

SEQ ID NO: 300334 - RNA, 29 nt, Human
ugggagguggagguugcagugacaacggu

SEQ ID NO: 300335 - RNA, 24 nt, Human
ugggagguggagguugcagugagc

SEQ ID NO: 300336 - RNA, 24 nt, Human
ugguggcucaugccuguaauccca

SEQ ID NO: 300337 - RNA, 24 nt, Human
ugguggugggcgccuguaguccca

SEQ ID NO: 300338 - RNA, 23 nt, Human
uguacacauauguacaugugugg

SEQ ID NO: 300339 - RNA, 19 nt, Human
ugucuaccuguguacacau

SEQ ID NO: 300340 - RNA, 25 nt, Human
ugucuaccuguguacacauauguac

SEQ ID NO: 300341 - RNA, 19 nt, Human
uguguacacauauguacau

SEQ ID NO: 300342 - RNA, 19 nt, Human
uguguacacauauguacau

SEQ ID NO: 300343 - RNA, 24 nt, Human
uguguacacauauguacaugugug

SEQ ID NO: 300344 - RNA, 24 nt, Human
uguguccaucugucuaccugugua

SEQ ID NO: 300345 - RNA, 21 nt, Human
uuagcaugugugguggugggc

SEQ ID NO: 300346 - RNA, 24 nt, Human
uugaaccugggagguggagguugc

SEQ ID NO: 300347 - RNA, 18 nt, Human
uugcagugagcugagauc

SEQ ID NO: 300348 - RNA, 21 nt, Human
uugcagugagcugagaucgug

SEQ ID NO: 300349 - RNA, 22 nt, Human
uugcagugagcugagaucgugc

SEQ ID NO: 300350 - RNA, 19 nt, Human
gcacuaccugaggcagagu

SEQ ID NO: 300351 - RNA, 22 nt, Human
gcuagcaauauauauuuucuuc

SEQ ID NO: 300352 - RNA, 20 nt, Human
guugaacuuuauuuugcccc

SEQ ID NO: 300353 - RNA, 18 nt, Human
uaccugaggcagagugau

SEQ ID NO: 300354 - RNA, 19 nt, Human
uauuuuugucauauuuugc

SEQ ID NO: 300355 - RNA, 20 nt, Human
ucagagcacuaccugaggca

SEQ ID NO: 300356 - RNA, 19 nt, Human
ugagaaggaaauucauccu

SEQ ID NO: 300357 - RNA, 23 nt, Human
ugagaaggaaauucauccuggug

SEQ ID NO: 300358 - RNA, 21 nt, Human
ugaggaaaccguaaauggucc

SEQ ID NO: 300359 - RNA, 22 nt, Human
ugaggaaaccguaaaugguccc

SEQ ID NO: 300360 - RNA, 22 nt, Human
uggcaccaaaaauguaccuauu

SEQ ID NO: 300361 - RNA, 21 nt, Human
uggcuugcuuugcugcguuug

SEQ ID NO: 300362 - RNA, 22 nt, Human
uucagaaaggacgaccuucaga

SEQ ID NO: 300363 - RNA, 19 nt, Human
uuggcaccaaaaauguacc

SEQ ID NO: 300364 - RNA, 27 nt, Human
uuuugcacuuuuguugaacuuuauuuu

SEQ ID NO: 300365 - RNA, 20 nt, Human
aaacguguggaggaaaaaag

SEQ ID NO: 300366 - RNA, 19 nt, Human
aaggaggagacaaggaggg

SEQ ID NO: 300367 - RNA, 27 nt, Human
agaaaugguaggaaaaaaccgguaccc

SEQ ID NO: 300368 - RNA, 22 nt, Human
agccgaggauggagccgcagcc

SEQ ID NO: 300369 - RNA, 20 nt, Human
aggaacacggaauuuuucca

SEQ ID NO: 300370 - RNA, 22 nt, Human
agguucugcuguugagggaauu

SEQ ID NO: 300371 - RNA, 26 nt, Human
aguaaacaguuuccuccucccuccaa

SEQ ID NO: 300372 - RNA, 23 nt, Human
augguaggaaaaaacuaaacaug

SEQ ID NO: 300373 - RNA, 25 nt, Human
caaaaaucaaacguguggaggaaaa

SEQ ID NO: 300374 - RNA, 26 nt, Human
caaauucuugaaauguacacacauuc

SEQ ID NO: 300375 - RNA, 19 nt, Human
cacucuggucggcggagcc

SEQ ID NO: 300376 - RNA, 19 nt, Human
cagacggugcccaggagcc

SEQ ID NO: 300377 - RNA, 24 nt, Human
cagcccggcuuggagaccucgggc

SEQ ID NO: 300378 - RNA, 18 nt, Human
caggagccgaggauggag

SEQ ID NO: 300379 - RNA, 21 nt, Human
cccaaggaggagacaaggagg

SEQ ID NO: 300380 - RNA, 22 nt, Human
ccuccucccuccaaaaaaccca

SEQ ID NO: 300381 - RNA, 24 nt, Human
ccugcccuggucugggguugggag

SEQ ID NO: 300382 - RNA, 21 nt, Human
ccuguccccugcccuggucug

SEQ ID NO: 300383 - RNA, 20 nt, Human
cuagcagccgcagcggccag

SEQ ID NO: 300384 - RNA, 20 nt, Human
cucccuccaaaaaacccaaa

SEQ ID NO: 300385 - RNA, 21 nt, Human
cuuggagaccucgggcuagca

SEQ ID NO: 300386 - RNA, 23 nt, Human
gaaaaaacuaaacaugggucagg

SEQ ID NO: 300387 - RNA, 21 nt, Human
gaaaugguaggaaaaaacuaa

SEQ ID NO: 300388 - RNA, 20 nt, Human
gcccaaggaggagacaagga

SEQ ID NO: 300389 - RNA, 21 nt, Human
gcuuucucacucuggucggcg

SEQ ID NO: 300390 - RNA, 21 nt, Human
ggaauuuuuccaaaaccaggg

SEQ ID NO: 300391 - RNA, 24 nt, Human
ggaauuuuuccaaaaccaggggcc

SEQ ID NO: 300392 - RNA, 19 nt, Human
gggcccaaggaggagacaa

SEQ ID NO: 300393 - RNA, 22 nt, Human
uaaacaguuuccuccucccucc

SEQ ID NO: 300394 - RNA, 24 nt, Human
uaggaaaaaacuaaacauggguca

SEQ ID NO: 300395 - RNA, 24 nt, Human
uauguguuuguuucccugugugua

SEQ ID NO: 300396 - RNA, 24 nt, Human
uccaaaaaacccaaauucuugaaa

SEQ ID NO: 300397 - RNA, 20 nt, Human
uccuccucccuccaaaaaac

SEQ ID NO: 300398 - RNA, 22 nt, Human
uggaagauggcggcuugggaaa

SEQ ID NO: 300399 - RNA, 22 nt, Human
uggaggaaaaaaguaaacaguu

SEQ ID NO: 300400 - RNA, 20 nt, Human
ugggaaaaagagccaucugg

SEQ ID NO: 300401 - RNA, 20 nt, Human
ugggaaggacuugagaccug

SEQ ID NO: 300402 - RNA, 22 nt, Human
uggucagcuggaagauggcggc

SEQ ID NO: 300403 - RNA, 20 nt, Human
ugguccccugguggcugcag

SEQ ID NO: 300404 - RNA, 19 nt, Human
uguguguaugcugggaagg

SEQ ID NO: 300405 - RNA, 19 nt, Human
uuuuuuuuuuuugacugua

SEQ ID NO: 300406 - RNA, 22 nt, Human
aaaauagauuuaaaggacuuac

SEQ ID NO: 300407 - RNA, 20 nt, Human
aaaggacuuacagauaaaca

SEQ ID NO: 300408 - RNA, 22 nt, Human
aagaaaccacuuccaaucagcu

SEQ ID NO: 300409 - RNA, 19 nt, Human
aagcaaccaaaauuacagc

SEQ ID NO: 300410 - RNA, 24 nt, Human
aagcaaccaaaauuacagcagaug

SEQ ID NO: 300411 - RNA, 24 nt, Human
aauguagagaaauauugaugacuu

SEQ ID NO: 300412 - RNA, 21 nt, Human
acagggcaaaagcaaccaaaa

SEQ ID NO: 300413 - RNA, 19 nt, Human
accuugaaagucaaagaaa

SEQ ID NO: 300414 - RNA, 21 nt, Human
aggagguggggagugacauaa

SEQ ID NO: 300415 - RNA, 21 nt, Human
caacagggcaaaagcaaccaa

SEQ ID NO: 300416 - RNA, 23 nt, Human
caacagggcaaaagcaaccaaaa

SEQ ID NO: 300417 - RNA, 19 nt, Human
cagggcaaaagcaaccaaa

SEQ ID NO: 300418 - RNA, 19 nt, Human
cauugagaguggcagaacc

SEQ ID NO: 300419 - RNA, 21 nt, Human
gcugauguuucccuuucagcc

SEQ ID NO: 300420 - RNA, 20 nt, Human
uaagagaacucuuaguagua

SEQ ID NO: 300421 - RNA, 23 nt, Human
uagcaaaaauagauuuaaaggac

SEQ ID NO: 300422 - RNA, 18 nt, Human
uaggaaaagguggucaag

SEQ ID NO: 300423 - RNA, 21 nt, Human
ucagcugcccagcugccuucu

SEQ ID NO: 300424 - RNA, 18 nt, Human
uccuaucagcugcccagc

SEQ ID NO: 300425 - RNA, 27 nt, Human
uccuaucagcugcccagcugccuucuu

SEQ ID NO: 300426 - RNA, 25 nt, Human
ucugacaguaagagaacucuuagua

SEQ ID NO: 300427 - RNA, 21 nt, Human
ugcaagagagauucugacagu

SEQ ID NO: 300428 - RNA, 23 nt, Human
uuccuaucagcugcccagcugcc

SEQ ID NO: 300429 - RNA, 24 nt, Human
aaacaagaaguuuggucacuuagc

SEQ ID NO: 300430 - RNA, 24 nt, Human
aaagaagaaaaaggcaaaccaggg

SEQ ID NO: 300431 - RNA, 22 nt, Human
aaaguuaacagcaacaggcaca

SEQ ID NO: 300432 - RNA, 27 nt, Human
aacaggcacauauuaaaaaggguuucc

SEQ ID NO: 300433 - RNA, 22 nt, Human
aacuuaguggaagguacaagau

SEQ ID NO: 300434 - RNA, 19 nt, Human
aagaaaaaggcaaaccagg

SEQ ID NO: 300435 - RNA, 19 nt, Human
aagaagaaaaaggcaaacc

SEQ ID NO: 300436 - RNA, 19 nt, Human
aagaagaaaaaggcaaacc

SEQ ID NO: 300437 - RNA, 20 nt, Human
aaggcaauuuagaaccaaua

SEQ ID NO: 300438 - RNA, 24 nt, Human
aauuacaaaaguggaauguuugaa

SEQ ID NO: 300439 - RNA, 19 nt, Human
aauugcuaaaaaaaauugc

SEQ ID NO: 300440 - RNA, 25 nt, Human
acaagaaaacaaugcacuuuuuuca

SEQ ID NO: 300441 - RNA, 21 nt, Human
acacauccguacauucacaca

SEQ ID NO: 300442 - RNA, 23 nt, Human
acacaugcacaaacaugcacgca

SEQ ID NO: 300443 - RNA, 27 nt, Human
acaguagugaaaacaacaugcaauguc

SEQ ID NO: 300444 - RNA, 23 nt, Human
accuaccaaccuuccccuccccc

SEQ ID NO: 300445 - RNA, 19 nt, Human
agaaaaaggcaaaccaggg

SEQ ID NO: 300446 - RNA, 22 nt, Human
agaaccaaggccagacaccaga

SEQ ID NO: 300447 - RNA, 19 nt, Human
agaagaaaaaggcaaacca

SEQ ID NO: 300448 - RNA, 18 nt, Human
agagauuguugcugaaca

SEQ ID NO: 300449 - RNA, 18 nt, Human
aggcaaaagagaggggac

SEQ ID NO: 300450 - RNA, 23 nt, Human
aggcaaaagagaggggacacuga

SEQ ID NO: 300451 - RNA, 21 nt, Human
aggcagcagaggcugggcacu

SEQ ID NO: 300452 - RNA, 22 nt, Human
aguuuguccuagaaaacaucug

SEQ ID NO: 300453 - RNA, 22 nt, Human
auaaaagcuuacauuucaaauc

SEQ ID NO: 300454 - RNA, 18 nt, Human
augaaauaaaacuauagc

SEQ ID NO: 300455 - RNA, 20 nt, Human
augaacuaaaagaaagcacc

SEQ ID NO: 300456 - RNA, 21 nt, Human
augaacuaaaagaaagcaccg

SEQ ID NO: 300457 - RNA, 24 nt, Human
augcacgcaaacacacauccguac

SEQ ID NO: 300458 - RNA, 25 nt, Human
augcuggcuggcaucacucacuugg

SEQ ID NO: 300459 - RNA, 19 nt, Human
auuaugucacauucuaaaa

SEQ ID NO: 300460 - RNA, 23 nt, Human
caaaaguuaacagcaacaggcac

SEQ ID NO: 300461 - RNA, 21 nt, Human
caaauuaaaaacuaauugcua

SEQ ID NO: 300462 - RNA, 20 nt, Human
cacauuucuaaaaaccucca

SEQ ID NO: 300463 - RNA, 23 nt, Human
cacucaagcuuucucccaagaaa

SEQ ID NO: 300464 - RNA, 24 nt, Human
cacuugauaagaaccaaggccaga

SEQ ID NO: 300465 - RNA, 22 nt, Human
cacuuuuauuucagauuggcaa

SEQ ID NO: 300466 - RNA, 28 nt, Human
cauaacaugcacagucacacaugcacag

SEQ ID NO: 300467 - RNA, 26 nt, Human
caugcacaaacaugcacgcaaacaca

SEQ ID NO: 300468 - RNA, 19 nt, Human
cauuccaccuuuuucucgc

SEQ ID NO: 300469 - RNA, 19 nt, Human
ccaaacggcacuggaguga

SEQ ID NO: 300470 - RNA, 18 nt, Human
ccaaggcaauuuagaacc

SEQ ID NO: 300471 - RNA, 22 nt, Human
ccagacaccagaucaauguaau

SEQ ID NO: 300472 - RNA, 20 nt, Human
ccagaggcagcagaggcugg

SEQ ID NO: 300473 - RNA, 23 nt, Human
cccacuuuuauuucagauuggca

SEQ ID NO: 300474 - RNA, 23 nt, Human
ccccucccaccccaaauuaaaaa

SEQ ID NO: 300475 - RNA, 22 nt, Human
cccgcugcauaaucucucucuu

SEQ ID NO: 300476 - RNA, 21 nt, Human
cccucccaccccaaauuaaaa

SEQ ID NO: 300477 - RNA, 24 nt, Human
cucaagcuuucucccaagaaaaug

SEQ ID NO: 300478 - RNA, 19 nt, Human
cucucccaucccacuuuua

SEQ ID NO: 300479 - RNA, 23 nt, Human
cuggcaucacucacuuggaaacc

SEQ ID NO: 300480 - RNA, 21 nt, Human
cuuggaaaccuuggcagucaa

SEQ ID NO: 300481 - RNA, 21 nt, Human
cuuuacacucaagcuuucucc

SEQ ID NO: 300482 - RNA, 26 nt, Human
cuuuacacucaagcuuucucccaaga

SEQ ID NO: 300483 - RNA, 25 nt, Human
gaaccaaggccagacaccagaucaa

SEQ ID NO: 300484 - RNA, 20 nt, Human
gauuaugguguuuuaaacau

SEQ ID NO: 300485 - RNA, 23 nt, Human
gcacagucacacaugcacaaaca

SEQ ID NO: 300486 - RNA, 22 nt, Human
ggacaagaaaacaaugcacuuu

SEQ ID NO: 300487 - RNA, 22 nt, Human
ggagcaaggaaaacuucuuagg

SEQ ID NO: 300488 - RNA, 23 nt, Human
gggagcaaggaaaacuucuuagg

SEQ ID NO: 300489 - RNA, 21 nt, Human
gguguucuuccccucccaccc

SEQ ID NO: 300490 - RNA, 20 nt, Human
gguuccuucacaaucaugcu

SEQ ID NO: 300491 - RNA, 23 nt, Human
guucgggucuugcaauuaacaag

SEQ ID NO: 300492 - RNA, 20 nt, Human
uaaaacuauagcaaauggga

SEQ ID NO: 300493 - RNA, 23 nt, Human
uaacaugcacagucacacaugca

SEQ ID NO: 300494 - RNA, 23 nt, Human
uaaguucucucaccucaagaccc

SEQ ID NO: 300495 - RNA, 22 nt, Human
uacagcuuaccuaccaaccuuc

SEQ ID NO: 300496 - RNA, 24 nt, Human
uacccuugaucugaaggacacacu

SEQ ID NO: 300497 - RNA, 27 nt, Human
uauaguuuguccuagaaaacaucuguu

SEQ ID NO: 300498 - RNA, 22 nt, Human
ucaaaaguuaacagcaacaggc

SEQ ID NO: 300499 - RNA, 24 nt, Human
ucaaaaguuaacagcaacaggcac

SEQ ID NO: 300500 - RNA, 21 nt, Human
ucaaagggagggacaagaaaa

SEQ ID NO: 300501 - RNA, 21 nt, Human
ucauuaugucacauucuaaaa

SEQ ID NO: 300502 - RNA, 21 nt, Human
uccaaagaagaaaaaggcaaa

SEQ ID NO: 300503 - RNA, 22 nt, Human
uccaaagaagaaaaaggcaaac

SEQ ID NO: 300504 - RNA, 22 nt, Human
uccaaagaagaaaaaggcaaac

SEQ ID NO: 300505 - RNA, 20 nt, Human
uccaagagauuguugcugaa

SEQ ID NO: 300506 - RNA, 23 nt, Human
uccguacauucacacacaacaua

SEQ ID NO: 300507 - RNA, 19 nt, Human
uccuagaaaacaucuguuc

SEQ ID NO: 300508 - RNA, 21 nt, Human
uccuagaaaacaucuguucac

SEQ ID NO: 300509 - RNA, 21 nt, Human
ucuacgauaaaugcucaguuu

SEQ ID NO: 300510 - RNA, 26 nt, Human
ugaaaagauagguuuuuauucaucaa

SEQ ID NO: 300511 - RNA, 19 nt, Human
ugaacuaaaagaaagcacc

SEQ ID NO: 300512 - RNA, 21 nt, Human
ugaacuaaaagaaagcaccgg

SEQ ID NO: 300513 - RNA, 19 nt, Human
ugaaggacacacucuccca

SEQ ID NO: 300514 - RNA, 21 nt, Human
ugagugguuccuucacaauca

SEQ ID NO: 300515 - RNA, 24 nt, Human
ugauaagaaccaaggccagacacc

SEQ ID NO: 300516 - RNA, 20 nt, Human
ugauuuguaaacauugucuu

SEQ ID NO: 300517 - RNA, 22 nt, Human
ugcacagucacacaugcacaaa

SEQ ID NO: 300518 - RNA, 18 nt, Human
ugcacgcaaacacacauc

SEQ ID NO: 300519 - RNA, 24 nt, Human
ugcacgcaaacacacauccguaca

SEQ ID NO: 300520 - RNA, 19 nt, Human
ugcaggucaaguguacagu

SEQ ID NO: 300521 - RNA, 22 nt, Human
ugcauauucaagguuucacaug

SEQ ID NO: 300522 - RNA, 20 nt, Human
ugccuuggaccucaagcagc

SEQ ID NO: 300523 - RNA, 19 nt, Human
uggagaaacauaacaugca

SEQ ID NO: 300524 - RNA, 20 nt, Human
uggcagucaagaguuaaguu

SEQ ID NO: 300525 - RNA, 19 nt, Human
uguacaguagugaaaacaa

SEQ ID NO: 300526 - RNA, 20 nt, Human
ugucuugccagaggcagcag

SEQ ID NO: 300527 - RNA, 22 nt, Human
ugugcaggucaaguguacagua

SEQ ID NO: 300528 - RNA, 20 nt, Human
uuaaauuuguuugagugguu

SEQ ID NO: 300529 - RNA, 24 nt, Human
uuacuccuuucggauucucuccug

SEQ ID NO: 300530 - RNA, 20 nt, Human
uucaaaugauccaacagagg

SEQ ID NO: 300531 - RNA, 23 nt, Human
uugcugaacaauucaaguuucac

SEQ ID NO: 300532 - RNA, 18 nt, Human
uuggcaaauacccugagc

SEQ ID NO: 300533 - RNA, 19 nt, Human
uuggcagucaagaguuaag

SEQ ID NO: 300534 - RNA, 22 nt, Human
uuguuugagugguuccuucaca

SEQ ID NO: 300535 - RNA, 20 nt, Human
uuuacaguaacaagggaaau

SEQ ID NO: 300536 - RNA, 21 nt, Human
uuuauucaucaaaaguuaaca

SEQ ID NO: 300537 - RNA, 22 nt, Human
uuucuaaaaaccuccaggaggc

SEQ ID NO: 300538 - RNA, 21 nt, Human
uuuguccuagaaaacaucugu

SEQ ID NO: 300539 - RNA, 26 nt, Human
uuuucagaguugauuuguaaacauug

SEQ ID NO: 300540 - RNA, 19 nt, Human
agaacugcagccacgcccc

SEQ ID NO: 300541 - RNA, 19 nt, Human
augguucuuagaaaacaug

SEQ ID NO: 300542 - RNA, 18 nt, Human
caaaaugguucuuagaaa

SEQ ID NO: 300543 - RNA, 19 nt, Human
cagcccguccagaacugca

SEQ ID NO: 300544 - RNA, 24 nt, Human
caggugcccagggcagcucuuccc

SEQ ID NO: 300545 - RNA, 18 nt, Human
cagugaacaaaaugguuc

SEQ ID NO: 300546 - RNA, 18 nt, Human
cauggucuuguggugcca

SEQ ID NO: 300547 - RNA, 23 nt, Human
ccagaacugcagccacgcccccc

SEQ ID NO: 300548 - RNA, 20 nt, Human
cccguccagaacugcagcca

SEQ ID NO: 300549 - RNA, 22 nt, Human
cccguccagaacugcagccacg

SEQ ID NO: 300550 - RNA, 19 nt, Human
cgcagcucggccagcccgu

SEQ ID NO: 300551 - RNA, 18 nt, Human
cguccagaacugcagcca

SEQ ID NO: 300552 - RNA, 24 nt, Human
cugcagccacgccccccgcuuucc

SEQ ID NO: 300553 - RNA, 20 nt, Human
gcucggccagcccguccaga

SEQ ID NO: 300554 - RNA, 22 nt, Human
ggugccaggugcccagggcagc

SEQ ID NO: 300555 - RNA, 20 nt, Human
ucagugaacaaaaugguucu

SEQ ID NO: 300556 - RNA, 23 nt, Human
ugccaggugcccagggcagcucu

SEQ ID NO: 300557 - RNA, 19 nt, Human
uuucccgacgccagccgcc

SEQ ID NO: 300558 - RNA, 22 nt, Human
uuuuuuuuuuuuuuuguaucag

SEQ ID NO: 300559 - RNA, 20 nt, Human
aaaaauaaaaggaaagcccc

SEQ ID NO: 300560 - RNA, 18 nt, Human
aaaaggaaagcccccaaa

SEQ ID NO: 300561 - RNA, 28 nt, Human
aaaauaaaaggaaagcccccaaaaauau

SEQ ID NO: 300562 - RNA, 19 nt, Human
aaaaugcaggguggaggua

SEQ ID NO: 300563 - RNA, 18 nt, Human
aaagugcaguagguggga

SEQ ID NO: 300564 - RNA, 28 nt, Human
aacccguuucccccaaagagcgacccca

SEQ ID NO: 300565 - RNA, 26 nt, Human
aagagccccuugguggagcagacuga

SEQ ID NO: 300566 - RNA, 18 nt, Human
aaggcccccaaaaucgga

SEQ ID NO: 300567 - RNA, 21 nt, Human
aagggccaggacaagaggaaa

SEQ ID NO: 300568 - RNA, 20 nt, Human
aaggguggacggacacgugg

SEQ ID NO: 300569 - RNA, 18 nt, Human
aauaaaaggaaagccccc

SEQ ID NO: 300570 - RNA, 23 nt, Human
accugggcgcaggaccugggucc

SEQ ID NO: 300571 - RNA, 19 nt, Human
acgaaaacgaaaagaagcc

SEQ ID NO: 300572 - RNA, 22 nt, Human
agaccggaggccgcugggagga

SEQ ID NO: 300573 - RNA, 21 nt, Human
agaggaaaaugcaggguggag

SEQ ID NO: 300574 - RNA, 21 nt, Human
agaggaagaggugaaucagag

SEQ ID NO: 300575 - RNA, 22 nt, Human
agccauggaguccgaggcagcc

SEQ ID NO: 300576 - RNA, 22 nt, Human
agcgcucagguguggcccaggc

SEQ ID NO: 300577 - RNA, 22 nt, Human
aggaaaaugcaggguggaggua

SEQ ID NO: 300578 - RNA, 18 nt, Human
aggaagaggugaaucaga

SEQ ID NO: 300579 - RNA, 19 nt, Human
aggcaggggauacccaggu

SEQ ID NO: 300580 - RNA, 23 nt, Human
aggcgggaagggggaaagugcag

SEQ ID NO: 300581 - RNA, 22 nt, Human
agggaggcaggcaggccgcucc

SEQ ID NO: 300582 - RNA, 20 nt, Human
agggguggcaggaggcaggg

SEQ ID NO: 300583 - RNA, 22 nt, Human
agggguucaagagccccuuggu

SEQ ID NO: 300584 - RNA, 23 nt, Human
aggguggggggcuggggaggggg

SEQ ID NO: 300585 - RNA, 18 nt, Human
caacagcaaacuccaucu

SEQ ID NO: 300586 - RNA, 19 nt, Human
caacagcaaacuccaucuc

SEQ ID NO: 300587 - RNA, 18 nt, Human
caagaccggaggccgcug

SEQ ID NO: 300588 - RNA, 19 nt, Human
caagaccggaggccgcugg

SEQ ID NO: 300589 - RNA, 21 nt, Human
caagaccggaggccgcuggga

SEQ ID NO: 300590 - RNA, 22 nt, Human
caagaggaaaaggaacacggca

SEQ ID NO: 300591 - RNA, 21 nt, Human
cacacucuccugccgaugccc

SEQ ID NO: 300592 - RNA, 22 nt, Human
caccaccucaacagcaaacucc

SEQ ID NO: 300593 - RNA, 25 nt, Human
cagacugaagggccaggacaagagg

SEQ ID NO: 300594 - RNA, 21 nt, Human
cagagguggagcucagaagga

SEQ ID NO: 300595 - RNA, 24 nt, Human
cagcaaauaccauauuaaauaacc

SEQ ID NO: 300596 - RNA, 24 nt, Human
caggugcaggggaaggaacccguu

SEQ ID NO: 300597 - RNA, 22 nt, Human
caguacacacccugcacaaccu

SEQ ID NO: 300598 - RNA, 18 nt, Human
ccacagcgcucaggugug

SEQ ID NO: 300599 - RNA, 22 nt, Human
ccacaggcugcaucaggggcac

SEQ ID NO: 300600 - RNA, 26 nt, Human
ccacaggcugcaucaggggcacagcc

SEQ ID NO: 300601 - RNA, 23 nt, Human
ccagccgaggcgucuagccgugu

SEQ ID NO: 300602 - RNA, 18 nt, Human
ccaggccaggugcagggg

SEQ ID NO: 300603 - RNA, 20 nt, Human
ccagggagacgaggugacug

SEQ ID NO: 300604 - RNA, 21 nt, Human
ccagggagacgaggugacugg

SEQ ID NO: 300605 - RNA, 24 nt, Human
ccaggguggggggcuggggagggg

SEQ ID NO: 300606 - RNA, 21 nt, Human
ccaggucaccaucuacaccac

SEQ ID NO: 300607 - RNA, 21 nt, Human
ccaggugucccacacccaccu

SEQ ID NO: 300608 - RNA, 22 nt, Human
ccaguccacaaggagucuuugu

SEQ ID NO: 300609 - RNA, 23 nt, Human
cccaaaaucggaaagcgcggagc

SEQ ID NO: 300610 - RNA, 20 nt, Human
cccccaaaaaacuuuuucca

SEQ ID NO: 300611 - RNA, 22 nt, Human
cccccaaaaauauaaucaccga

SEQ ID NO: 300612 - RNA, 23 nt, Human
cccccauucccagcccacgagcu

SEQ ID NO: 300613 - RNA, 21 nt, Human
cccgcggccaggguggggggc

SEQ ID NO: 300614 - RNA, 27 nt, Human
cccggccccggcuccgucgccgguucc

SEQ ID NO: 300615 - RNA, 22 nt, Human
cccuaccacagucucccuccua

SEQ ID NO: 300616 - RNA, 20 nt, Human
cccuagggaggcagcggggg

SEQ ID NO: 300617 - RNA, 18 nt, Human
cccugcccacacacucuc

SEQ ID NO: 300618 - RNA, 19 nt, Human
cccugcccacacacucucc

SEQ ID NO: 300619 - RNA, 20 nt, Human
cccugcccacacacucuccu

SEQ ID NO: 300620 - RNA, 19 nt, Human
cccuugcugcccuggccuc

SEQ ID NO: 300621 - RNA, 18 nt, Human
ccgcccccgcggccaggg

SEQ ID NO: 300622 - RNA, 21 nt, Human
ccgucugcccgccugcucgcc

SEQ ID NO: 300623 - RNA, 19 nt, Human
ccucagagcuggccagggg

SEQ ID NO: 300624 - RNA, 22 nt, Human
ccucagggcuccucaggacagu

SEQ ID NO: 300625 - RNA, 22 nt, Human
ccucccugccccuaccacaguc

SEQ ID NO: 300626 - RNA, 24 nt, Human
ccucccugccccuaccacagucuc

SEQ ID NO: 300627 - RNA, 21 nt, Human
ccuccuauuuggccacuccag

SEQ ID NO: 300628 - RNA, 21 nt, Human
ccucugcagccgcggcucacc

SEQ ID NO: 300629 - RNA, 21 nt, Human
ccucugcccgccggcuuagcu

SEQ ID NO: 300630 - RNA, 24 nt, Human
ccuuggagaccuucucccaggugu

SEQ ID NO: 300631 - RNA, 25 nt, Human
cgaaaacgaaaagaagccacugugc

SEQ ID NO: 300632 - RNA, 18 nt, Human
cgacagguggacgcggcg

SEQ ID NO: 300633 - RNA, 19 nt, Human
cgacuccgggcccggcccc

SEQ ID NO: 300634 - RNA, 19 nt, Human
cgaggccggcuaccugggc

SEQ ID NO: 300635 - RNA, 21 nt, Human
cgcaggaccuggguccgaggc

SEQ ID NO: 300636 - RNA, 22 nt, Human
cgcccgggccggguaggggggc

SEQ ID NO: 300637 - RNA, 22 nt, Human
cgcggccaggguggggggcugg

SEQ ID NO: 300638 - RNA, 25 nt, Human
cgcuggggggcaggggaggaccuga

SEQ ID NO: 300639 - RNA, 23 nt, Human
cggacgcguagaucgagcgcgcc

SEQ ID NO: 300640 - RNA, 19 nt, Human
cggcucagguccgcggcga

SEQ ID NO: 300641 - RNA, 19 nt, Human
cguauguaugugugugcgc

SEQ ID NO: 300642 - RNA, 21 nt, Human
cgugggagggguuuucuccag

SEQ ID NO: 300643 - RNA, 18 nt, Human
cucacacucuuaucccaa

SEQ ID NO: 300644 - RNA, 23 nt, Human
cucccccaaaaaacuuuuuccaa

SEQ ID NO: 300645 - RNA, 18 nt, Human
cucccuuggagaccuucu

SEQ ID NO: 300646 - RNA, 20 nt, Human
cucgccgcucugggcguccu

SEQ ID NO: 300647 - RNA, 19 nt, Human
cugcagccgcggcucaccc

SEQ ID NO: 300648 - RNA, 21 nt, Human
cugcuccgguuuucucuuugc

SEQ ID NO: 300649 - RNA, 22 nt, Human
cugggcgcaggaccuggguccg

SEQ ID NO: 300650 - RNA, 22 nt, Human
cuucaaaacgaaaacgaaaaga

SEQ ID NO: 300651 - RNA, 19 nt, Human
cuuggagaccuucucccag

SEQ ID NO: 300652 - RNA, 19 nt, Human
cuuugcagcgaggcuggag

SEQ ID NO: 300653 - RNA, 24 nt, Human
cuuuuuuuuuuuuuuuuccuuuuu

SEQ ID NO: 300654 - RNA, 19 nt, Human
gaaaggcccccaaaaucgg

SEQ ID NO: 300655 - RNA, 22 nt, Human
gaagcaccauuggccguccgaa

SEQ ID NO: 300656 - RNA, 19 nt, Human
gaaggaacccguuuccccc

SEQ ID NO: 300657 - RNA, 19 nt, Human
gaaggaagcagguuuugga

SEQ ID NO: 300658 - RNA, 20 nt, Human
gaaggaagcagguuuuggaa

SEQ ID NO: 300659 - RNA, 20 nt, Human
gaaggaucaaagauggggaa

SEQ ID NO: 300660 - RNA, 21 nt, Human
gaagugugcaagcagggaggg

SEQ ID NO: 300661 - RNA, 21 nt, Human
gaggagccaccagagguggag

SEQ ID NO: 300662 - RNA, 23 nt, Human
gaggcgucuagccgugugggggc

SEQ ID NO: 300663 - RNA, 19 nt, Human
gagugcagcauccacggcc

SEQ ID NO: 300664 - RNA, 19 nt, Human
gcacagaggcaccagggag

SEQ ID NO: 300665 - RNA, 19 nt, Human
gcacagccaguccacaagg

SEQ ID NO: 300666 - RNA, 21 nt, Human
gcagcauccacggccgggggg

SEQ ID NO: 300667 - RNA, 22 nt, Human
gccaggacaagaggaaaaugca

SEQ ID NO: 300668 - RNA, 24 nt, Human
gccaggugcaggggaaggaacccg

SEQ ID NO: 300669 - RNA, 20 nt, Human
gcccccgcggccaggguggg

SEQ ID NO: 300670 - RNA, 20 nt, Human
gcccuggccucuagucuucu

SEQ ID NO: 300671 - RNA, 21 nt, Human
gcccuggccucuagucuucug

SEQ ID NO: 300672 - RNA, 21 nt, Human
gccgacuccgggcccggcccc

SEQ ID NO: 300673 - RNA, 20 nt, Human
gcuccgguuuucucuuugca

SEQ ID NO: 300674 - RNA, 24 nt, Human
gcugcacccucccuuggagaccuu

SEQ ID NO: 300675 - RNA, 21 nt, Human
gcuggggaggggggugggcuc

SEQ ID NO: 300676 - RNA, 23 nt, Human
gcuggguuggaauaugaugagca

SEQ ID NO: 300677 - RNA, 23 nt, Human
gcuuuuuuuuuuuuuuuuccuuu

SEQ ID NO: 300678 - RNA, 28 nt, Human
ggaaagcccccaaaaauauaaucaccga

SEQ ID NO: 300679 - RNA, 24 nt, Human
ggaacccguuucccccaaagagcg

SEQ ID NO: 300680 - RNA, 19 nt, Human
ggacaagaggaaaaugcag

SEQ ID NO: 300681 - RNA, 22 nt, Human
ggaggugggagcucagauccca

SEQ ID NO: 300682 - RNA, 21 nt, Human
ggcagcgggggaggcugcggg

SEQ ID NO: 300683 - RNA, 19 nt, Human
ggcaggggaggaccugggc

SEQ ID NO: 300684 - RNA, 21 nt, Human
ggccagggguucagggaucag

SEQ ID NO: 300685 - RNA, 19 nt, Human
ggcccgggcggcgggcacg

SEQ ID NO: 300686 - RNA, 20 nt, Human
ggcggcgggcacggcugcuc

SEQ ID NO: 300687 - RNA, 19 nt, Human
ggcuggggagggggguggg

SEQ ID NO: 300688 - RNA, 19 nt, Human
gggaagaagauggcgaugg

SEQ ID NO: 300689 - RNA, 19 nt, Human
gggauacccaggucaccau

SEQ ID NO: 300690 - RNA, 20 nt, Human
gggcaggggaggaccugggc

SEQ ID NO: 300691 - RNA, 24 nt, Human
gggcaguugcuggagcagaggacu

SEQ ID NO: 300692 - RNA, 19 nt, Human
gggccaggacaagaggaaa

SEQ ID NO: 300693 - RNA, 23 nt, Human
gggccggguaggggggcgggagc

SEQ ID NO: 300694 - RNA, 21 nt, Human
gggcggaucccgagcccgagu

SEQ ID NO: 300695 - RNA, 21 nt, Human
gggcuuuuuuuuuuuuuuuuc

SEQ ID NO: 300696 - RNA, 19 nt, Human
ggggaggcugcgggugcgc

SEQ ID NO: 300697 - RNA, 20 nt, Human
ggggcuggggaggggggugg

SEQ ID NO: 300698 - RNA, 22 nt, Human
ggggggcaggggaggaccuggg

SEQ ID NO: 300699 - RNA, 20 nt, Human
ggguggggggcuggggaggg

SEQ ID NO: 300700 - RNA, 21 nt, Human
ggugcaggggaaggaacccgu

SEQ ID NO: 300701 - RNA, 24 nt, Human
ggugggaagggaggugggagcuca

SEQ ID NO: 300702 - RNA, 29 nt, Human
ggugggcuuuuuuuuuuuuuuuuccuuuu

SEQ ID NO: 300703 - RNA, 24 nt, Human
gguggggggcuggggaggggggug

SEQ ID NO: 300704 - RNA, 23 nt, Human
gguuuccuaggaggagccaccag

SEQ ID NO: 300705 - RNA, 19 nt, Human
guccgaaucaggcaucgag

SEQ ID NO: 300706 - RNA, 22 nt, Human
gucugugugcccgucugugguc

SEQ ID NO: 300707 - RNA, 21 nt, Human
gugccuccccucagagcuggc

SEQ ID NO: 300708 - RNA, 18 nt, Human
gugugcccgucugugguc

SEQ ID NO: 300709 - RNA, 23 nt, Human
gugugcccgucuguggucuuagc

SEQ ID NO: 300710 - RNA, 20 nt, Human
guucaguccuucuuuuucuu

SEQ ID NO: 300711 - RNA, 18 nt, Human
uaaaaggaaagcccccaa

SEQ ID NO: 300712 - RNA, 18 nt, Human
uacauggcagucguggcu

SEQ ID NO: 300713 - RNA, 24 nt, Human
uacccaggucaccaucuacaccac

SEQ ID NO: 300714 - RNA, 18 nt, Human
uaggaggagccaccagag

SEQ ID NO: 300715 - RNA, 20 nt, Human
uaggaggagccaccagaggu

SEQ ID NO: 300716 - RNA, 21 nt, Human
uaggaggagccaccagaggug

SEQ ID NO: 300717 - RNA, 21 nt, Human
uaugcugagagguccucaggg

SEQ ID NO: 300718 - RNA, 25 nt, Human
ucaaaacgaaaacgaaaagaagcca

SEQ ID NO: 300719 - RNA, 18 nt, Human
ucaagagccccuuggugg

SEQ ID NO: 300720 - RNA, 20 nt, Human
uccaaccuccaagaggaaaa

SEQ ID NO: 300721 - RNA, 19 nt, Human
uccaaggaccccauggggg

SEQ ID NO: 300722 - RNA, 19 nt, Human
uccgcgcgcgcggcgugcc

SEQ ID NO: 300723 - RNA, 24 nt, Human
uccgucgcuggggggcaggggagg

SEQ ID NO: 300724 - RNA, 22 nt, Human
ucugcccgccugcucgccgcuc

SEQ ID NO: 300725 - RNA, 21 nt, Human
ucuggaaaggcccccaaaauc

SEQ ID NO: 300726 - RNA, 24 nt, Human
ugaaggaagcagguuuuggaaggc

SEQ ID NO: 300727 - RNA, 19 nt, Human
ugagcaggucccuugcugc

SEQ ID NO: 300728 - RNA, 18 nt, Human
ugaugugaacagugcucc

SEQ ID NO: 300729 - RNA, 24 nt, Human
ugcaacauuuucuggaaaggcccc

SEQ ID NO: 300730 - RNA, 24 nt, Human
uggcaggaggcaggggauacccag

SEQ ID NO: 300731 - RNA, 19 nt, Human
uggcccaggccaggugcag

SEQ ID NO: 300732 - RNA, 21 nt, Human
uggccucuagucuucugcccu

SEQ ID NO: 300733 - RNA, 21 nt, Human
ugggaaauggaggucaugugg

SEQ ID NO: 300734 - RNA, 20 nt, Human
ugggaagggaggugggagcc

SEQ ID NO: 300735 - RNA, 20 nt, Human
ugggaggagacccgcugaug

SEQ ID NO: 300736 - RNA, 19 nt, Human
ugggcaagaccggaggccg

SEQ ID NO: 300737 - RNA, 22 nt, Human
ugggcuuuuuuuuuuuuuuuuu

SEQ ID NO: 300738 - RNA, 18 nt, Human
uggggaggggggugggcu

SEQ ID NO: 300739 - RNA, 21 nt, Human
uggggaggggggugggcucgg

SEQ ID NO: 300740 - RNA, 22 nt, Human
uggggggcaggggaggaccugg

SEQ ID NO: 300741 - RNA, 20 nt, Human
uggggggcuggggagggggg

SEQ ID NO: 300742 - RNA, 23 nt, Human
uggggggcuggggaggggggugg

SEQ ID NO: 300743 - RNA, 24 nt, Human
uggggggcuggggagggggguggg

SEQ ID NO: 300744 - RNA, 29 nt, Human
uggguuggaauaugaugagcaggucccuu

SEQ ID NO: 300745 - RNA, 19 nt, Human
uuaaauaacccugcccaca

SEQ ID NO: 300746 - RNA, 21 nt, Human
uuaagggaagaagauggcgau

SEQ ID NO: 300747 - RNA, 21 nt, Human
uucaaaacgaaaacgaaaaga

SEQ ID NO: 300748 - RNA, 25 nt, Human
uucaaaacgaaaacgaaaagaagcc

SEQ ID NO: 300749 - RNA, 26 nt, Human
uuccuuuuugcgcgcguauguaugug

SEQ ID NO: 300750 - RNA, 23 nt, Human
uucucuuugcagcgaggcuggag

SEQ ID NO: 300751 - RNA, 18 nt, Human
uuuaaaaaauaaaaggaa

SEQ ID NO: 300752 - RNA, 23 nt, Human
uuuaaaaaauaaaaggaaagccc

SEQ ID NO: 300753 - RNA, 24 nt, Human
uuuacauuuaaaaaauaaaaggaa

SEQ ID NO: 300754 - RNA, 20 nt, Human
uuuggaaggcgggaaggggg

SEQ ID NO: 300755 - RNA, 21 nt, Human
uuugggcaccgugggaggggu

SEQ ID NO: 300756 - RNA, 21 nt, Human
aaaaaaauauaaacgaaggca

SEQ ID NO: 300757 - RNA, 19 nt, Human
aaaaacaugaacaggggca

SEQ ID NO: 300758 - RNA, 19 nt, Human
aaaaaguucaacagcagcu

SEQ ID NO: 300759 - RNA, 26 nt, Human
aaaaggaaacaaaucuggaauuugcu

SEQ ID NO: 300760 - RNA, 18 nt, Human
aaaaugcuauaguaccag

SEQ ID NO: 300761 - RNA, 23 nt, Human
aaacaaaaacaugaacaggggca

SEQ ID NO: 300762 - RNA, 23 nt, Human
aaaccaaacuuuagcuuucucag

SEQ ID NO: 300763 - RNA, 19 nt, Human
aaacgaaggcagugauaca

SEQ ID NO: 300764 - RNA, 22 nt, Human
aaacucccugcgcuccgaaucu

SEQ ID NO: 300765 - RNA, 20 nt, Human
aaaguuucucucaaacuccu

SEQ ID NO: 300766 - RNA, 24 nt, Human
aaauacauauauugggguugccaa

SEQ ID NO: 300767 - RNA, 22 nt, Human
aaaugucaaaaacugucaaacu

SEQ ID NO: 300768 - RNA, 20 nt, Human
aaaugucacuaaccugaagc

SEQ ID NO: 300769 - RNA, 24 nt, Human
aacccacaccaaccuguuugacag

SEQ ID NO: 300770 - RNA, 24 nt, Human
aagaagauaguuaauacaaucuaa

SEQ ID NO: 300771 - RNA, 24 nt, Human
aaggacaucacuaaucguuuaaaa

SEQ ID NO: 300772 - RNA, 18 nt, Human
aaugggcucaaaaaccgc

SEQ ID NO: 300773 - RNA, 24 nt, Human
acaauucauccucccaucuaaccu

SEQ ID NO: 300774 - RNA, 21 nt, Human
acacacacacccacaaaugca

SEQ ID NO: 300775 - RNA, 21 nt, Human
acacacccacaaaugcaguca

SEQ ID NO: 300776 - RNA, 24 nt, Human
acccacaaaugcagucauauacaa

SEQ ID NO: 300777 - RNA, 24 nt, Human
acggggaaaguucaaucuccccca

SEQ ID NO: 300778 - RNA, 26 nt, Human
agaaaaaaaaaaaaaacuucugcaaa

SEQ ID NO: 300779 - RNA, 18 nt, Human
agaacuuuuaggacuuaa

SEQ ID NO: 300780 - RNA, 19 nt, Human
agcccccccucaaccuugg

SEQ ID NO: 300781 - RNA, 21 nt, Human
aggacuggaaacugcuggacu

SEQ ID NO: 300782 - RNA, 20 nt, Human
aggcaugaagaaaaaaaaaa

SEQ ID NO: 300783 - RNA, 23 nt, Human
aggccaaaaggaaacaaaucugg

SEQ ID NO: 300784 - RNA, 18 nt, Human
agggaaguacauggaugg

SEQ ID NO: 300785 - RNA, 21 nt, Human
auaguccauccuucuaaaacu

SEQ ID NO: 300786 - RNA, 23 nt, Human
auaucaaaaugcaaagcaccaac

SEQ ID NO: 300787 - RNA, 21 nt, Human
aucauuuuaucuuaugucccu

SEQ ID NO: 300788 - RNA, 22 nt, Human
aucuaucuccaaacuucacaca

SEQ ID NO: 300789 - RNA, 18 nt, Human
auugugcuuucucuggag

SEQ ID NO: 300790 - RNA, 20 nt, Human
caaaaugcaaagcaccaaca

SEQ ID NO: 300791 - RNA, 22 nt, Human
caaagcaccaacaaaauaaggc

SEQ ID NO: 300792 - RNA, 21 nt, Human
caacccccagacuucgacaac

SEQ ID NO: 300793 - RNA, 22 nt, Human
cacacacacacccacaaaugca

SEQ ID NO: 300794 - RNA, 24 nt, Human
caggaaauaagcccccccucaacc

SEQ ID NO: 300795 - RNA, 24 nt, Human
ccaaaugaucucuugcagucuccu

SEQ ID NO: 300796 - RNA, 21 nt, Human
ccacacauggaguaaagagcg

SEQ ID NO: 300797 - RNA, 23 nt, Human
ccauucauucauauuuagaacgc

SEQ ID NO: 300798 - RNA, 19 nt, Human
cccacacauggaguaaaga

SEQ ID NO: 300799 - RNA, 25 nt, Human
cccacggccuucccaaaugaucucu

SEQ ID NO: 300800 - RNA, 19 nt, Human
cccagacuucgacaacaac

SEQ ID NO: 300801 - RNA, 18 nt, Human
cccauggcaacuuccuga

SEQ ID NO: 300802 - RNA, 21 nt, Human
cccauggcaacuuccugaaac

SEQ ID NO: 300803 - RNA, 24 nt, Human
cccauggcaacuuccugaaaccua

SEQ ID NO: 300804 - RNA, 20 nt, Human
ccccagaaguggaaggaacc

SEQ ID NO: 300805 - RNA, 22 nt, Human
ccccagaaguggaaggaaccuc

SEQ ID NO: 300806 - RNA, 26 nt, Human
cccccucaaccuuggucucuucaaaa

SEQ ID NO: 300807 - RNA, 20 nt, Human
cccuuauccaucuaucucca

SEQ ID NO: 300808 - RNA, 19 nt, Human
ccuccgauguuauuccgca

SEQ ID NO: 300809 - RNA, 20 nt, Human
ccuccuguuucucucccugu

SEQ ID NO: 300810 - RNA, 18 nt, Human
ccuuauccaucuaucucc

SEQ ID NO: 300811 - RNA, 20 nt, Human
cgaggcccuuggcugggaac

SEQ ID NO: 300812 - RNA, 25 nt, Human
cugaaaacacacacacacccaauuu

SEQ ID NO: 300813 - RNA, 23 nt, Human
cugcgugguugaauuccaacccu

SEQ ID NO: 300814 - RNA, 19 nt, Human
cuggccgaucagaacagcu

SEQ ID NO: 300815 - RNA, 18 nt, Human
cugucaaaaccaaacuuu

SEQ ID NO: 300816 - RNA, 24 nt, Human
cuugcagucuccuccuguuucucu

SEQ ID NO: 300817 - RNA, 22 nt, Human
gaacccacaccaaccuguuuga

SEQ ID NO: 300818 - RNA, 21 nt, Human
gaggauccaggcuaaugcaca

SEQ ID NO: 300819 - RNA, 22 nt, Human
gaggauccaggcuaaugcacau

SEQ ID NO: 300820 - RNA, 22 nt, Human
gaggcaacacugacaaaguuca

SEQ ID NO: 300821 - RNA, 19 nt, Human
gcaaggcucacagcaauau

SEQ ID NO: 300822 - RNA, 21 nt, Human
gcaauaaagugguuuucugaa

SEQ ID NO: 300823 - RNA, 21 nt, Human
gggagcauuuguuaggacugg

SEQ ID NO: 300824 - RNA, 21 nt, Human
gggguaaggggugaaagaagg

SEQ ID NO: 300825 - RNA, 22 nt, Human
gucaguguuuccgaaaacuggc

SEQ ID NO: 300826 - RNA, 24 nt, Human
gucucuucaaaauaaaaguuucuc

SEQ ID NO: 300827 - RNA, 27 nt, Human
uaaaacaaaaacaugaacaggggcauu

SEQ ID NO: 300828 - RNA, 24 nt, Human
uaaacaucaaccaaguccuccucu

SEQ ID NO: 300829 - RNA, 23 nt, Human
uaacaguaguaguauuauaaaca

SEQ ID NO: 300830 - RNA, 19 nt, Human
uaaguaaauagcugucagg

SEQ ID NO: 300831 - RNA, 25 nt, Human
uaaguaucuuucuuuuuauuauuuc

SEQ ID NO: 300832 - RNA, 22 nt, Human
uacauauauacauauugaugua

SEQ ID NO: 300833 - RNA, 18 nt, Human
uaccauacuuuauagaga

SEQ ID NO: 300834 - RNA, 22 nt, Human
uaccauacuuuauagagaaaca

SEQ ID NO: 300835 - RNA, 23 nt, Human
uacgauggauuggggaaccuauu

SEQ ID NO: 300836 - RNA, 21 nt, Human
uacuuuauuauugcuucugca

SEQ ID NO: 300837 - RNA, 21 nt, Human
uagaaacacaaacguauuuca

SEQ ID NO: 300838 - RNA, 23 nt, Human
uagaaaguaggaaagauuggcaa

SEQ ID NO: 300839 - RNA, 24 nt, Human
uagcaaaaugcuauaguaccagua

SEQ ID NO: 300840 - RNA, 19 nt, Human
uaguguuucucaggccggc

SEQ ID NO: 300841 - RNA, 23 nt, Human
uauaaauuuuggacauucaaaag

SEQ ID NO: 300842 - RNA, 24 nt, Human
uauacaaauucaggugggagcauu

SEQ ID NO: 300843 - RNA, 22 nt, Human
uauauagaaauacauauauaca

SEQ ID NO: 300844 - RNA, 22 nt, Human
uauauagaaauacauauauaca

SEQ ID NO: 300845 - RNA, 18 nt, Human
ucaaaaccaaacuuuagc

SEQ ID NO: 300846 - RNA, 18 nt, Human
ucacaaaaauaggaccau

SEQ ID NO: 300847 - RNA, 24 nt, Human
ucaggaaauaagcccccccucaau

SEQ ID NO: 300848 - RNA, 26 nt, Human
ucaucaggcaugaagaaaaaaaaaaa

SEQ ID NO: 300849 - RNA, 23 nt, Human
ucauuucaaaauaucccauucau

SEQ ID NO: 300850 - RNA, 25 nt, Human
uccaaacuucacacaccacugagau

SEQ ID NO: 300851 - RNA, 25 nt, Human
uccaaagcaucaucugccgauagca

SEQ ID NO: 300852 - RNA, 23 nt, Human
ucccuuauccaucuaucuccaaa

SEQ ID NO: 300853 - RNA, 19 nt, Human
uccucccaucuaaccucaa

SEQ ID NO: 300854 - RNA, 24 nt, Human
uccuccgauguuauuccgcaauga

SEQ ID NO: 300855 - RNA, 20 nt, Human
uccuccucucaaccuccgca

SEQ ID NO: 300856 - RNA, 24 nt, Human
ucgacaacaacuggggggcgggga

SEQ ID NO: 300857 - RNA, 20 nt, Human
ucucacacauucaccacacc

SEQ ID NO: 300858 - RNA, 22 nt, Human
ucucucaaacucccugcgcucc

SEQ ID NO: 300859 - RNA, 23 nt, Human
ucuuaugucccucuucacaaaaa

SEQ ID NO: 300860 - RNA, 23 nt, Human
ucuuccaaagcaucaucugccga

SEQ ID NO: 300861 - RNA, 20 nt, Human
ugaaaacacacacacaccca

SEQ ID NO: 300862 - RNA, 21 nt, Human
ugaaaacacacacacacccac

SEQ ID NO: 300863 - RNA, 23 nt, Human
ugaaaacacacacacacccacaa

SEQ ID NO: 300864 - RNA, 21 nt, Human
ugaacaggggcauucguaaua

SEQ ID NO: 300865 - RNA, 18 nt, Human
ugacaucagguuucaaga

SEQ ID NO: 300866 - RNA, 18 nt, Human
ugagauuacaccaguagg

SEQ ID NO: 300867 - RNA, 21 nt, Human
ugagcugguuacacagagacu

SEQ ID NO: 300868 - RNA, 22 nt, Human
ugaguggucucuucagaagucc

SEQ ID NO: 300869 - RNA, 19 nt, Human
ugccaaagcuuucaucagg

SEQ ID NO: 300870 - RNA, 24 nt, Human
uggaaggaaccccucgaauccgcc

SEQ ID NO: 300871 - RNA, 21 nt, Human
uggaauuugcugaaaacacac

SEQ ID NO: 300872 - RNA, 23 nt, Human
uggcgggguauggagugggaggc

SEQ ID NO: 300873 - RNA, 18 nt, Human
uggcucagucuucgcacu

SEQ ID NO: 300874 - RNA, 23 nt, Human
ugggaggcagaagacgggagacg

SEQ ID NO: 300875 - RNA, 18 nt, Human
ugggcauccuucugaccc

SEQ ID NO: 300876 - RNA, 23 nt, Human
uggucucuucagaaguccaaaga

SEQ ID NO: 300877 - RNA, 18 nt, Human
ugucaggcuucuaaauga

SEQ ID NO: 300878 - RNA, 19 nt, Human
ugucaugcaaggcucacag

SEQ ID NO: 300879 - RNA, 22 nt, Human
uguuucucucccuguagcucca

SEQ ID NO: 300880 - RNA, 18 nt, Human
uguuuguuucuaauccca

SEQ ID NO: 300881 - RNA, 23 nt, Human
uuauugcuucugcaucuuccaaa

SEQ ID NO: 300882 - RNA, 22 nt, Human
uucauucauauuuagaacgcuc

SEQ ID NO: 300883 - RNA, 24 nt, Human
uuuacauaauuacaaugcugaagu

SEQ ID NO: 300884 - RNA, 18 nt, Human
uuuuccaccaaaacacug

SEQ ID NO: 300885 - RNA, 24 nt, Human
uuuuugcucuuacgcaaucagggg

SEQ ID NO: 300886 - RNA, 24 nt, Human
aaaaaaaaguacacagauagaaaa

SEQ ID NO: 300887 - RNA, 18 nt, Human
aaaccauacccccaugga

SEQ ID NO: 300888 - RNA, 18 nt, Human
aaaccuccaaagcgccca

SEQ ID NO: 300889 - RNA, 20 nt, Human
aaagaggucccguggucuuc

SEQ ID NO: 300890 - RNA, 20 nt, Human
aacccugacuccccuggcac

SEQ ID NO: 300891 - RNA, 22 nt, Human
aaccuccaaagcgcccaccucc

SEQ ID NO: 300892 - RNA, 24 nt, Human
aagcccggucaggccaggccagga

SEQ ID NO: 300893 - RNA, 21 nt, Human
aagcgcccaccucucacaucc

SEQ ID NO: 300894 - RNA, 19 nt, Human
aagggcagccuggcugaca

SEQ ID NO: 300895 - RNA, 18 nt, Human
aagggcugcaggcugggg

SEQ ID NO: 300896 - RNA, 22 nt, Human
acagcauacaaaauagcauuuc

SEQ ID NO: 300897 - RNA, 20 nt, Human
acguggccacuccacacugg

SEQ ID NO: 300898 - RNA, 26 nt, Human
agaaggacaggcaggacuggugcagg

SEQ ID NO: 300899 - RNA, 18 nt, Human
agagaauccuagauucug

SEQ ID NO: 300900 - RNA, 18 nt, Human
agagggauggaggaaggg

SEQ ID NO: 300901 - RNA, 21 nt, Human
agagggauggaggaagggggc

SEQ ID NO: 300902 - RNA, 21 nt, Human
agagggauggaggaagggggc

SEQ ID NO: 300903 - RNA, 20 nt, Human
agagggcuggucacggcccc

SEQ ID NO: 300904 - RNA, 19 nt, Human
agcagccagggaggcuagg

SEQ ID NO: 300905 - RNA, 21 nt, Human
agccuggcugacaggaagccc

SEQ ID NO: 300906 - RNA, 20 nt, Human
agcgcugccucagggauggg

SEQ ID NO: 300907 - RNA, 19 nt, Human
aggcaggacuggugcaggc

SEQ ID NO: 300908 - RNA, 20 nt, Human
aggcagggcaggguaggggc

SEQ ID NO: 300909 - RNA, 21 nt, Human
aggccaggagaugcugggugc

SEQ ID NO: 300910 - RNA, 25 nt, Human
agggaggagacuggcuuucuucugg

SEQ ID NO: 300911 - RNA, 21 nt, Human
agggggggagcuucaggcagg

SEQ ID NO: 300912 - RNA, 22 nt, Human
agggguugagcuuccugcaccc

SEQ ID NO: 300913 - RNA, 22 nt, Human
auacucuagaauguuagugcug

SEQ ID NO: 300914 - RNA, 21 nt, Human
augcggggcccgucuggccuu

SEQ ID NO: 300915 - RNA, 21 nt, Human
augguuccugaguccccagag

SEQ ID NO: 300916 - RNA, 23 nt, Human
caaagcgcccaccucucacaucc

SEQ ID NO: 300917 - RNA, 19 nt, Human
cacauuuacauucucauca

SEQ ID NO: 300918 - RNA, 28 nt, Human
cacccccuccaggaaguccuccuuacug

SEQ ID NO: 300919 - RNA, 24 nt, Human
cacggccccugcaguuuucuugcc

SEQ ID NO: 300920 - RNA, 21 nt, Human
cagaaagcuuccagaagggga

SEQ ID NO: 300921 - RNA, 24 nt, Human
cagcagccagggaggcuagggucu

SEQ ID NO: 300922 - RNA, 24 nt, Human
cagcugacccccaggauggaaguu

SEQ ID NO: 300923 - RNA, 22 nt, Human
caggaaguccuccuuacugccc

SEQ ID NO: 300924 - RNA, 19 nt, Human
caggagcagaaagcuucca

SEQ ID NO: 300925 - RNA, 21 nt, Human
cagguccaaugcagagccagg

SEQ ID NO: 300926 - RNA, 25 nt, Human
caguaacuccaagaaucuucccagg

SEQ ID NO: 300927 - RNA, 23 nt, Human
cagugacaaaaccauacccccau

SEQ ID NO: 300928 - RNA, 23 nt, Human
ccaccuggaauacucuagaaugu

SEQ ID NO: 300929 - RNA, 19 nt, Human
ccagggaaguaaggugcca

SEQ ID NO: 300930 - RNA, 21 nt, Human
ccauauacuggcacacacacg

SEQ ID NO: 300931 - RNA, 23 nt, Human
ccauauacuggcacacacacgug

SEQ ID NO: 300932 - RNA, 19 nt, Human
cccaggagcccagcugacc

SEQ ID NO: 300933 - RNA, 19 nt, Human
cccauuuuacauaugggaa

SEQ ID NO: 300934 - RNA, 22 nt, Human
cccccggaggucaucgugggua

SEQ ID NO: 300935 - RNA, 24 nt, Human
cccccuucccaacccuccccgugc

SEQ ID NO: 300936 - RNA, 22 nt, Human
cccguggucuucccaugucccu

SEQ ID NO: 300937 - RNA, 21 nt, Human
cccucuuugucccuuuugccc

SEQ ID NO: 300938 - RNA, 22 nt, Human
cccuggggcagcugcugggggc

SEQ ID NO: 300939 - RNA, 22 nt, Human
ccguauugagaacccacucucc

SEQ ID NO: 300940 - RNA, 20 nt, Human
ccucaguaacuccaagaauc

SEQ ID NO: 300941 - RNA, 19 nt, Human
ccuccuaagccagccccag

SEQ ID NO: 300942 - RNA, 23 nt, Human
ccuccuaagccagccccaggguu

SEQ ID NO: 300943 - RNA, 20 nt, Human
ccuccuuggaccaacucugg

SEQ ID NO: 300944 - RNA, 18 nt, Human
ccucucacauccuucuug

SEQ ID NO: 300945 - RNA, 28 nt, Human
ccugcaaugcaggguuggugcccagagg

SEQ ID NO: 300946 - RNA, 18 nt, Human
ccugcaguuuucuugccu

SEQ ID NO: 300947 - RNA, 23 nt, Human
ccugcaguuuucuugccuccuaa

SEQ ID NO: 300948 - RNA, 18 nt, Human
cgccucacuccccaagca

SEQ ID NO: 300949 - RNA, 24 nt, Human
cgggaggagcagagccgccagagg

SEQ ID NO: 300950 - RNA, 23 nt, Human
cuagggucucuucccuagcuccu

SEQ ID NO: 300951 - RNA, 18 nt, Human
cuccuuacugcccucucc

SEQ ID NO: 300952 - RNA, 18 nt, Human
cugccucagggauggggc

SEQ ID NO: 300953 - RNA, 22 nt, Human
cugcgugugcuccaagugcccu

SEQ ID NO: 300954 - RNA, 21 nt, Human
cuggaaucucccaggagccca

SEQ ID NO: 300955 - RNA, 23 nt, Human
cuggcaccuccaaugcccacugg

SEQ ID NO: 300956 - RNA, 23 nt, Human
cugggggcuuuccaggacaccgg

SEQ ID NO: 300957 - RNA, 21 nt, Human
cuguguucuugagacuugcug

SEQ ID NO: 300958 - RNA, 18 nt, Human
cuuggcuacaacccugac

SEQ ID NO: 300959 - RNA, 23 nt, Human
cuuucccauuuuacauaugggaa

SEQ ID NO: 300960 - RNA, 19 nt, Human
gagcuuccugcacccccuu

SEQ ID NO: 300961 - RNA, 24 nt, Human
gauagaaaaacucaacagcauaca

SEQ ID NO: 300962 - RNA, 19 nt, Human
gcccucuuugucccuuuug

SEQ ID NO: 300963 - RNA, 28 nt, Human
gcgcugccucagggauggggggaacgcc

SEQ ID NO: 300964 - RNA, 20 nt, Human
gcguugggcagggcgagcac

SEQ ID NO: 300965 - RNA, 21 nt, Human
gcugggugcuggcaggggggg

SEQ ID NO: 300966 - RNA, 18 nt, Human
gcuggucacggccccugc

SEQ ID NO: 300967 - RNA, 24 nt, Human
gcuucuggugugggcacaguucca

SEQ ID NO: 300968 - RNA, 18 nt, Human
ggaugaggcaacacugcu

SEQ ID NO: 300969 - RNA, 22 nt, Human
ggccccugcaguuuucuugccu

SEQ ID NO: 300970 - RNA, 20 nt, Human
ggcucuggacagucaccccc

SEQ ID NO: 300971 - RNA, 22 nt, Human
gggcaaaccuccaaagcgccca

SEQ ID NO: 300972 - RNA, 18 nt, Human
ggggaaacugaggcccag

SEQ ID NO: 300973 - RNA, 20 nt, Human
ggggcagcuggugggugagg

SEQ ID NO: 300974 - RNA, 22 nt, Human
ggggccuggggaaggggcaugg

SEQ ID NO: 300975 - RNA, 24 nt, Human
gggggagcuucaggcagggcaggg

SEQ ID NO: 300976 - RNA, 24 nt, Human
ggugauaaagaaaaagccccagga

SEQ ID NO: 300977 - RNA, 24 nt, Human
gguggauaaaagugcgaggagaga

SEQ ID NO: 300978 - RNA, 19 nt, Human
guacacagauagaaaaacu

SEQ ID NO: 300979 - RNA, 21 nt, Human
gugggcacaguuccaggcucu

SEQ ID NO: 300980 - RNA, 18 nt, Human
gugggugaggggcaaacc

SEQ ID NO: 300981 - RNA, 27 nt, Human
uaaaaaaaaguacacagauagaaaaac

SEQ ID NO: 300982 - RNA, 24 nt, Human
uacacagauagaaaaacucaacag

SEQ ID NO: 300983 - RNA, 22 nt, Human
uagaaaaacucaacagcauaca

SEQ ID NO: 300984 - RNA, 23 nt, Human
uagaaggacaggcaggacuggug

SEQ ID NO: 300985 - RNA, 22 nt, Human
uagauucugggucaucaagccu

SEQ ID NO: 300986 - RNA, 21 nt, Human
uaggggagaggagcggcccag

SEQ ID NO: 300987 - RNA, 22 nt, Human
uauacuggcacacacacguggc

SEQ ID NO: 300988 - RNA, 21 nt, Human
uaucagaaagacugcuggucc

SEQ ID NO: 300989 - RNA, 21 nt, Human
uaucagaaagacugcuggucc

SEQ ID NO: 300990 - RNA, 26 nt, Human
ucaacagcauacaaaauagcauuucu

SEQ ID NO: 300991 - RNA, 21 nt, Human
ucacggccccugcaguuuucu

SEQ ID NO: 300992 - RNA, 19 nt, Human
ucacugcuaggucugggca

SEQ ID NO: 300993 - RNA, 20 nt, Human
ucaggccaggccaggagaug

SEQ ID NO: 300994 - RNA, 18 nt, Human
ucagggauggggcagcug

SEQ ID NO: 300995 - RNA, 20 nt, Human
ucaguuggccucccuggagg

SEQ ID NO: 300996 - RNA, 21 nt, Human
uccaaagcgcccaccucucac

SEQ ID NO: 300997 - RNA, 22 nt, Human
uccaaagcgcccaccucucaca

SEQ ID NO: 300998 - RNA, 20 nt, Human
ucccagaguggguaacagcu

SEQ ID NO: 300999 - RNA, 19 nt, Human
uccccuggcaccuccaaug

SEQ ID NO: 301000 - RNA, 18 nt, Human
ucccuggggcagcugcug

SEQ ID NO: 301001 - RNA, 26 nt, Human
ucccuggggcagcugcugggggcuuu

SEQ ID NO: 301002 - RNA, 21 nt, Human
ucccugggggaacccuggcuc

SEQ ID NO: 301003 - RNA, 25 nt, Human
uccuaagccagccccaggguuuggg

SEQ ID NO: 301004 - RNA, 19 nt, Human
uccuucgggaggagcagag

SEQ ID NO: 301005 - RNA, 19 nt, Human
ucgggccagggaacgcagg

SEQ ID NO: 301006 - RNA, 19 nt, Human
ucuagaauguuagugcugg

SEQ ID NO: 301007 - RNA, 23 nt, Human
ucuggccuucuagacucuggugg

SEQ ID NO: 301008 - RNA, 19 nt, Human
ucugucuucgacgcagacc

SEQ ID NO: 301009 - RNA, 18 nt, Human
ucuuggcuacaacccuga

SEQ ID NO: 301010 - RNA, 18 nt, Human
ugacuccccuggcaccuc

SEQ ID NO: 301011 - RNA, 23 nt, Human
ugagacuugcugggggccugggg

SEQ ID NO: 301012 - RNA, 19 nt, Human
ugauaagggcagccuggcu

SEQ ID NO: 301013 - RNA, 22 nt, Human
ugcacccccuucccaacccucc

SEQ ID NO: 301014 - RNA, 20 nt, Human
ugccucagggauggggcagc

SEQ ID NO: 301015 - RNA, 20 nt, Human
ugccucagggauggggcagc

SEQ ID NO: 301016 - RNA, 19 nt, Human
ugccuccuaagccagcccc

SEQ ID NO: 301017 - RNA, 19 nt, Human
ugcugggggccuggggaag

SEQ ID NO: 301018 - RNA, 21 nt, Human
uggaggaagggggcugcugua

SEQ ID NO: 301019 - RNA, 21 nt, Human
uggcacacacacguggccacu

SEQ ID NO: 301020 - RNA, 18 nt, Human
uggcucagagucaguugg

SEQ ID NO: 301021 - RNA, 23 nt, Human
uggcuucuggugugggcacaguu

SEQ ID NO: 301022 - RNA, 21 nt, Human
ugggaaaacugaguucccugg

SEQ ID NO: 301023 - RNA, 21 nt, Human
ugggcacaguuccaggcucug

SEQ ID NO: 301024 - RNA, 22 nt, Human
ugggcugcaggaggugaucuca

SEQ ID NO: 301025 - RNA, 20 nt, Human
uggggaaggggcaugguucc

SEQ ID NO: 301026 - RNA, 18 nt, Human
ugggucuggcugucugcg

SEQ ID NO: 301027 - RNA, 21 nt, Human
uguguucuugagacuugcugg

SEQ ID NO: 301028 - RNA, 22 nt, Human
uuccaggcucuggacagucacc

SEQ ID NO: 301029 - RNA, 19 nt, Human
uucccaugucccuggggca

SEQ ID NO: 301030 - RNA, 19 nt, Human
uucccugggggaacccugg

SEQ ID NO: 301031 - RNA, 19 nt, Human
uuccuugagggguagcugg

SEQ ID NO: 301032 - RNA, 21 nt, Human
uucuagacucugguggaugga

SEQ ID NO: 301033 - RNA, 24 nt, Human
aagcacuaauaaaaggaaccccaa

SEQ ID NO: 301034 - RNA, 20 nt, Human
aaugggcuuuccauaaguuc

SEQ ID NO: 301035 - RNA, 23 nt, Human
acauguauaaaaacuaggaacac

SEQ ID NO: 301036 - RNA, 19 nt, Human
cugugaauagacuggauga

SEQ ID NO: 301037 - RNA, 20 nt, Human
cuugacaucagccucuggcc

SEQ ID NO: 301038 - RNA, 25 nt, Human
gcaaagcacuaauaaaaggaacccc

SEQ ID NO: 301039 - RNA, 22 nt, Human
gcaggagcgcggcggcugcgcg

SEQ ID NO: 301040 - RNA, 19 nt, Human
gcgcggggcggggacgcag

SEQ ID NO: 301041 - RNA, 22 nt, Human
gcggcugcgcggggcggggacg

SEQ ID NO: 301042 - RNA, 19 nt, Human
uaaaaggaaccccaaagcu

SEQ ID NO: 301043 - RNA, 24 nt, Human
uaauaaaaggaaccccaaagcuga

SEQ ID NO: 301044 - RNA, 19 nt, Human
uauaaaauuguuuacacau

SEQ ID NO: 301045 - RNA, 23 nt, Human
uggcaaagcacuaauaaaaggaa

SEQ ID NO: 301046 - RNA, 18 nt, Human
ugggcuuuccauaaguuc

SEQ ID NO: 301047 - RNA, 22 nt, Human
uguagguaagcaaucaaaauca

SEQ ID NO: 301048 - RNA, 18 nt, Human
acccaggaggcacgacgc

SEQ ID NO: 301049 - RNA, 23 nt, Human
acccaggaggcacgacgcgggug

SEQ ID NO: 301050 - RNA, 22 nt, Human
cagcggcgacuccucacaaccc

SEQ ID NO: 301051 - RNA, 29 nt, Human
caggcaguggcggcagcggcgacuccucu

SEQ ID NO: 301052 - RNA, 26 nt, Human
ggcggcagcggcgacuccucacaacc

SEQ ID NO: 301053 - RNA, 24 nt, Human
gugcccccaagucuccuucaggug

SEQ ID NO: 301054 - RNA, 18 nt, Human
ugacuggguuuucuuccu

SEQ ID NO: 301055 - RNA, 19 nt, Human
ugacuggguuuucuuccuc

SEQ ID NO: 301056 - RNA, 22 nt, Human
uggcggcagcggcgacuccuca

SEQ ID NO: 301057 - RNA, 25 nt, Human
uggcggcagcggcgacuccucacaa

SEQ ID NO: 301058 - RNA, 27 nt, Human
uuacuaccugcucaaucuacacacuua

SEQ ID NO: 301059 - RNA, 25 nt, Human
aaagaacauggcaaccguaacagac

SEQ ID NO: 301060 - RNA, 24 nt, Human
aaauccaggugcagugccagcaag

SEQ ID NO: 301061 - RNA, 24 nt, Human
aagcauggcaucuaggggaggaag

SEQ ID NO: 301062 - RNA, 21 nt, Human
acaaauccaggugcagugcca

SEQ ID NO: 301063 - RNA, 24 nt, Human
acaucuuucaugaggacucugcca

SEQ ID NO: 301064 - RNA, 25 nt, Human
agacaaaaggaagcauggcaucuag

SEQ ID NO: 301065 - RNA, 18 nt, Human
caaccguaacagacaaaa

SEQ ID NO: 301066 - RNA, 23 nt, Human
caaccguaacagacaaaaggaag

SEQ ID NO: 301067 - RNA, 22 nt, Human
cacaaacacauuuaaacuuccc

SEQ ID NO: 301068 - RNA, 19 nt, Human
cauggcaaccguaacagac

SEQ ID NO: 301069 - RNA, 22 nt, Human
cuugcaguacaaauccaggugc

SEQ ID NO: 301070 - RNA, 18 nt, Human
gcaguacaaauccaggug

SEQ ID NO: 301071 - RNA, 20 nt, Human
gggaggagaguggagaguuu

SEQ ID NO: 301072 - RNA, 23 nt, Human
ggggaggagaguggagaguuuuc

SEQ ID NO: 301073 - RNA, 20 nt, Human
uaaaauguuauauaauuugu

SEQ ID NO: 301074 - RNA, 18 nt, Human
uauucaaagaacauggca

SEQ ID NO: 301075 - RNA, 21 nt, Human
uauucaaagaacauggcaacc

SEQ ID NO: 301076 - RNA, 22 nt, Human
ucaaagaacauggcaaccguaa

SEQ ID NO: 301077 - RNA, 24 nt, Human
ugaauagucaggucuugcaguaca

SEQ ID NO: 301078 - RNA, 21 nt, Human
ugccagcaaguauuucaaaua

SEQ ID NO: 301079 - RNA, 21 nt, Human
uuccauacacaaacacauuua

SEQ ID NO: 301080 - RNA, 19 nt, Human
uuuguccuuguggugagag

SEQ ID NO: 301081 - RNA, 18 nt, Human
agagaagccacagccagu

SEQ ID NO: 301082 - RNA, 18 nt, Human
agccagguaaagugggga

SEQ ID NO: 301083 - RNA, 23 nt, Human
cagccaguacgccagguuucccg

SEQ ID NO: 301084 - RNA, 21 nt, Human
cagguuucccgcgccaauguu

SEQ ID NO: 301085 - RNA, 21 nt, Human
cuagagaagccacagccagua

SEQ ID NO: 301086 - RNA, 21 nt, Human
gagaagccacagccaguacgc

SEQ ID NO: 301087 - RNA, 19 nt, Human
gcuagagaagccacagcca

SEQ ID NO: 301088 - RNA, 24 nt, Human
guucugaacaccauaccuuccaaa

SEQ ID NO: 301089 - RNA, 20 nt, Human
ucccgcuagagaagccacag

SEQ ID NO: 301090 - RNA, 20 nt, Human
ucugaacaccauaccuucca

SEQ ID NO: 301091 - RNA, 25 nt, Human
aaaaaauuaucacauuucucuguac

SEQ ID NO: 301092 - RNA, 23 nt, Human
aaaaacagauggaaaacugaggc

SEQ ID NO: 301093 - RNA, 23 nt, Human
aaaacugaaauccacaaaaaaau

SEQ ID NO: 301094 - RNA, 24 nt, Human
aaaaugccugccuucugcuucccu

SEQ ID NO: 301095 - RNA, 23 nt, Human
aaacaaggguucacacacaaaca

SEQ ID NO: 301096 - RNA, 18 nt, Human
aaacugcuaaccaccauc

SEQ ID NO: 301097 - RNA, 24 nt, Human
aaagcucuuccccagauuucacaa

SEQ ID NO: 301098 - RNA, 20 nt, Human
aacuggucugccaaccuuca

SEQ ID NO: 301099 - RNA, 19 nt, Human
aagaauccauacugcuuuc

SEQ ID NO: 301100 - RNA, 19 nt, Human
aagacaaaaacacaaugua

SEQ ID NO: 301101 - RNA, 21 nt, Human
aagcagcacugguguagaccc

SEQ ID NO: 301102 - RNA, 21 nt, Human
aaggaguuuucguugcugucg

SEQ ID NO: 301103 - RNA, 21 nt, Human
acaaggguucacacacaaaca

SEQ ID NO: 301104 - RNA, 20 nt, Human
acacuaggccaccaugaaau

SEQ ID NO: 301105 - RNA, 23 nt, Human
acuagaauccuaaagcucuuccc

SEQ ID NO: 301106 - RNA, 26 nt, Human
acuagaauccuaaagcucuuccccag

SEQ ID NO: 301107 - RNA, 20 nt, Human
acucccuuucuuauucuuau

SEQ ID NO: 301108 - RNA, 22 nt, Human
acugaaaugacaaauaaccuag

SEQ ID NO: 301109 - RNA, 18 nt, Human
agacaaaaacacaaugua

SEQ ID NO: 301110 - RNA, 18 nt, Human
agugaagagucugggcag

SEQ ID NO: 301111 - RNA, 20 nt, Human
aucaguguucugauuaagga

SEQ ID NO: 301112 - RNA, 20 nt, Human
caaaaacagauggaaaacug

SEQ ID NO: 301113 - RNA, 19 nt, Human
caaauaaccuacugcaaac

SEQ ID NO: 301114 - RNA, 19 nt, Human
caacacuaggccaccauga

SEQ ID NO: 301115 - RNA, 19 nt, Human
caacuggucugccaaccuu

SEQ ID NO: 301116 - RNA, 23 nt, Human
cacacacaaacauucaggaagca

SEQ ID NO: 301117 - RNA, 21 nt, Human
cacaguauuugaguuaauuaa

SEQ ID NO: 301118 - RNA, 18 nt, Human
caccaugaaauuacacac

SEQ ID NO: 301119 - RNA, 22 nt, Human
cacccggccuggcggggacugu

SEQ ID NO: 301120 - RNA, 24 nt, Human
cacccggccuggcggggacugugg

SEQ ID NO: 301121 - RNA, 24 nt, Human
cacuaggccaccaugaaauuacac

SEQ ID NO: 301122 - RNA, 18 nt, Human
cacucacucccuuucuua

SEQ ID NO: 301123 - RNA, 22 nt, Human
ccccggccugggcugggguuug

SEQ ID NO: 301124 - RNA, 20 nt, Human
ccgagggggcgcggcgcguc

SEQ ID NO: 301125 - RNA, 18 nt, Human
ccuacugcaaacuguuuu

SEQ ID NO: 301126 - RNA, 22 nt, Human
ccuggcggggacuguggcuggc

SEQ ID NO: 301127 - RNA, 22 nt, Human
cgcguccgggcgaggacugcag

SEQ ID NO: 301128 - RNA, 24 nt, Human
cuccaauccccaacaucccgaguu

SEQ ID NO: 301129 - RNA, 24 nt, Human
cugccuucugcuucccucucuucc

SEQ ID NO: 301130 - RNA, 27 nt, Human
cuggacucccaccauuaagaaauguca

SEQ ID NO: 301131 - RNA, 20 nt, Human
cugucuaggacuucugauga

SEQ ID NO: 301132 - RNA, 18 nt, Human
gaaaagcccuuccuacug

SEQ ID NO: 301133 - RNA, 25 nt, Human
gaagcaccacaacacuaggccacca

SEQ ID NO: 301134 - RNA, 22 nt, Human
gagcagagccugguuccgaggg

SEQ ID NO: 301135 - RNA, 22 nt, Human
gcggggacuguggcuggcuuga

SEQ ID NO: 301136 - RNA, 23 nt, Human
gcuggcuugaggggcgaaggcug

SEQ ID NO: 301137 - RNA, 22 nt, Human
ggccuggcggggacuguggcug

SEQ ID NO: 301138 - RNA, 23 nt, Human
ggccugggcugggguuugagggu

SEQ ID NO: 301139 - RNA, 24 nt, Human
ggccugggcugggguuugagggug

SEQ ID NO: 301140 - RNA, 22 nt, Human
ggcugggguuugagggugccgc

SEQ ID NO: 301141 - RNA, 18 nt, Human
ggcuugugcgccccggcc

SEQ ID NO: 301142 - RNA, 25 nt, Human
gggaaaauagaaaaaugccgguacc

SEQ ID NO: 301143 - RNA, 18 nt, Human
ggucacagaaacaagcuc

SEQ ID NO: 301144 - RNA, 20 nt, Human
guaaaguguccugagugucc

SEQ ID NO: 301145 - RNA, 19 nt, Human
uaaaaaacugaaaugacaa

SEQ ID NO: 301146 - RNA, 19 nt, Human
uaaaagguacuuaaauucu

SEQ ID NO: 301147 - RNA, 23 nt, Human
uaaaguguccugagugucccuuc

SEQ ID NO: 301148 - RNA, 22 nt, Human
uaagaaaugucacugucuagga

SEQ ID NO: 301149 - RNA, 23 nt, Human
uacacacaaaugucaaauucaac

SEQ ID NO: 301150 - RNA, 22 nt, Human
uaccagaagcaccacaacacua

SEQ ID NO: 301151 - RNA, 24 nt, Human
uaccauuaccagaagcaccacaac

SEQ ID NO: 301152 - RNA, 24 nt, Human
uaccuuaacucucccaaaaauacc

SEQ ID NO: 301153 - RNA, 18 nt, Human
uagaaaauggaugccuuu

SEQ ID NO: 301154 - RNA, 22 nt, Human
uagaauccuaaagcucuucccc

SEQ ID NO: 301155 - RNA, 27 nt, Human
uaucccagaaaauacagaagguccuuc

SEQ ID NO: 301156 - RNA, 21 nt, Human
ucaaaaacagauggaaaacug

SEQ ID NO: 301157 - RNA, 20 nt, Human
ucaaaguucauuugcacagu

SEQ ID NO: 301158 - RNA, 18 nt, Human
ucaggauuugauauaaac

SEQ ID NO: 301159 - RNA, 22 nt, Human
ucagugcacaucuaacaauuca

SEQ ID NO: 301160 - RNA, 23 nt, Human
ucagugcacaucuaacaauucac

SEQ ID NO: 301161 - RNA, 23 nt, Human
ucccaccauuaagaaaugucacu

SEQ ID NO: 301162 - RNA, 22 nt, Human
uccccaacaucccgaguucagu

SEQ ID NO: 301163 - RNA, 18 nt, Human
uccuaaagcucuucccca

SEQ ID NO: 301164 - RNA, 23 nt, Human
uccugggucacagaaacaagcuc

SEQ ID NO: 301165 - RNA, 19 nt, Human
ucuccugggucacagaaac

SEQ ID NO: 301166 - RNA, 28 nt, Human
ucucuguacauagcauaaagacaaaaac

SEQ ID NO: 301167 - RNA, 23 nt, Human
ucuguuaacuccuguagucuugc

SEQ ID NO: 301168 - RNA, 23 nt, Human
ugaaaugacaaauaaccuacugc

SEQ ID NO: 301169 - RNA, 26 nt, Human
ugaaaugacaaauaaccuacugcaaa

SEQ ID NO: 301170 - RNA, 21 nt, Human
ugaacaagaggccuaaaauau

SEQ ID NO: 301171 - RNA, 18 nt, Human
ugacaaauaaccuacugc

SEQ ID NO: 301172 - RNA, 27 nt, Human
ugauaaaaacugaaauccacaaaaaaa

SEQ ID NO: 301173 - RNA, 19 nt, Human
uguggcuggcuugaggggc

SEQ ID NO: 301174 - RNA, 22 nt, Human
uuaaacagacauauuaaugcug

SEQ ID NO: 301175 - RNA, 19 nt, Human
uuauucuuaucaaaaacag

SEQ ID NO: 301176 - RNA, 21 nt, Human
uucaggguagagaaaagcccu

SEQ ID NO: 301177 - RNA, 24 nt, Human
uucagugcacaucuaacaauucac

SEQ ID NO: 301178 - RNA, 23 nt, Human
uuucaggguagagaaaagcccuu

SEQ ID NO: 301179 - RNA, 18 nt, Human
uuuggaggaaacaagggu

SEQ ID NO: 301180 - RNA, 21 nt, Human
uuuggcaauucucucucucca

SEQ ID NO: 301181 - RNA, 18 nt, Human
uuuucguugcugucguuu

SEQ ID NO: 301182 - RNA, 20 nt, Human
aaaaggaaaaacaaaacaau

SEQ ID NO: 301183 - RNA, 18 nt, Human
aaaaguaaacaacaaaaa

SEQ ID NO: 301184 - RNA, 22 nt, Human
aaaguuguucauucagcuuaag

SEQ ID NO: 301185 - RNA, 24 nt, Human
aaaguuguucauucagcuuaaggu

SEQ ID NO: 301186 - RNA, 21 nt, Human
aacagccaaaaggaaaaacaa

SEQ ID NO: 301187 - RNA, 24 nt, Human
acaaaacaaucaacaugcaguagc

SEQ ID NO: 301188 - RNA, 24 nt, Human
accaaaaugaacagccaaaaggaa

SEQ ID NO: 301189 - RNA, 23 nt, Human
agccaaaaggaaaaacaaaacaa

SEQ ID NO: 301190 - RNA, 20 nt, Human
aggaaaaacaaaacaaucaa

SEQ ID NO: 301191 - RNA, 20 nt, Human
aguaaacaacaaaaaacagu

SEQ ID NO: 301192 - RNA, 24 nt, Human
auuuccuuauaguagccaccaaaa

SEQ ID NO: 301193 - RNA, 26 nt, Human
caaaacaaucaacaugcaguagcucc

SEQ ID NO: 301194 - RNA, 25 nt, Human
caaaaugaacagccaaaaggaaaaa

SEQ ID NO: 301195 - RNA, 18 nt, Human
caaucaacaugcaguagc

SEQ ID NO: 301196 - RNA, 22 nt, Human
ccaaaaugaacagccaaaagga

SEQ ID NO: 301197 - RNA, 21 nt, Human
ccacaaguaaagaugcaaaag

SEQ ID NO: 301198 - RNA, 22 nt, Human
gcaaaaguaaacaacaaaaaac

SEQ ID NO: 301199 - RNA, 19 nt, Human
ggaaaaacaaaacaaucaa

SEQ ID NO: 301200 - RNA, 22 nt, Human
ggcaagcucugcaggccaccga

SEQ ID NO: 301201 - RNA, 22 nt, Human
uagccaccaaaaugaacagcca

SEQ ID NO: 301202 - RNA, 20 nt, Human
uauaguagccaccaaaauga

SEQ ID NO: 301203 - RNA, 18 nt, Human
uaugaggacuugccacag

SEQ ID NO: 301204 - RNA, 19 nt, Human
uccacaaguaaagaugcaa

SEQ ID NO: 301205 - RNA, 22 nt, Human
uccacaaguaaagaugcaaaag

SEQ ID NO: 301206 - RNA, 23 nt, Human
ucugcaggccaccgaauucuugu

SEQ ID NO: 301207 - RNA, 18 nt, Human
uguucagaguccagaagc

SEQ ID NO: 301208 - RNA, 21 nt, Human
uucaagagaagaaaaguuguu

SEQ ID NO: 301209 - RNA, 22 nt, Human
uucaagagaagaaaaguuguuc

SEQ ID NO: 301210 - RNA, 18 nt, Human
aacagcuugcagggcacc

SEQ ID NO: 301211 - RNA, 22 nt, Human
aacuuucaagagaggagagggc

SEQ ID NO: 301212 - RNA, 19 nt, Human
aagcagagggaaaaccaaa

SEQ ID NO: 301213 - RNA, 18 nt, Human
agagaagaacgguggggc

SEQ ID NO: 301214 - RNA, 21 nt, Human
aggcagggaggggacucaaug

SEQ ID NO: 301215 - RNA, 18 nt, Human
agggacacaguguugcug

SEQ ID NO: 301216 - RNA, 20 nt, Human
aguuuuccuuuaauuguaaa

SEQ ID NO: 301217 - RNA, 22 nt, Human
caaggugacacugaacaaaaca

SEQ ID NO: 301218 - RNA, 20 nt, Human
cacaguguugcugacaaggu

SEQ ID NO: 301219 - RNA, 18 nt, Human
cagcagagaagaacggug

SEQ ID NO: 301220 - RNA, 24 nt, Human
ccagaacacugagagaaaaagcug

SEQ ID NO: 301221 - RNA, 20 nt, Human
ccuuuaauuguaaaagcggg

SEQ ID NO: 301222 - RNA, 23 nt, Human
gaagggacacaguguugcugaca

SEQ ID NO: 301223 - RNA, 22 nt, Human
gacacguuauauuugauugggu

SEQ ID NO: 301224 - RNA, 25 nt, Human
gcggaacagcuugcagggcaccccc

SEQ ID NO: 301225 - RNA, 19 nt, Human
gcugacaaggugacacuga

SEQ ID NO: 301226 - RNA, 20 nt, Human
ggagaaagagcggcgcggcg

SEQ ID NO: 301227 - RNA, 20 nt, Human
gucagacacguuauauuuga

SEQ ID NO: 301228 - RNA, 19 nt, Human
uaaaaacaaaaucaguguc

SEQ ID NO: 301229 - RNA, 21 nt, Human
ugacaaggugacacugaacaa

SEQ ID NO: 301230 - RNA, 20 nt, Human
ugagagaaaaagcugcagca

SEQ ID NO: 301231 - RNA, 18 nt, Human
uggcgggcgacgacccgc

SEQ ID NO: 301232 - RNA, 18 nt, Human
uggggcgaagggacacag

SEQ ID NO: 301233 - RNA, 19 nt, Human
uuuacaagcagagggaaaa

SEQ ID NO: 301234 - RNA, 19 nt, Human
cggcgccuccucagcgucc

SEQ ID NO: 301235 - RNA, 23 nt, Human
cggcgcgggcgccucccccgcag

SEQ ID NO: 301236 - RNA, 20 nt, Human
cuccucagcguccuccuccc

SEQ ID NO: 301237 - RNA, 21 nt, Human
gcgaagggcagcccggccgca

SEQ ID NO: 301238 - RNA, 21 nt, Human
ggcagcgaagggcagcccggc

SEQ ID NO: 301239 - RNA, 20 nt, Human
ggcggccaagccgcgcuggg

SEQ ID NO: 301240 - RNA, 23 nt, Human
uaaaaaugcugcaagguuuccgc

SEQ ID NO: 301241 - RNA, 20 nt, Human
ucggcgcgggcgccuccccc

SEQ ID NO: 301242 - RNA, 22 nt, Human
uggcagcgaagggcagcccggc

SEQ ID NO: 301243 - RNA, 23 nt, Human
uggcagguggucuggaagcgucc

SEQ ID NO: 301244 - RNA, 19 nt, Human
aaaaacaagacagauagaa

SEQ ID NO: 301245 - RNA, 18 nt, Human
aaaaugcucaaaugagcc

SEQ ID NO: 301246 - RNA, 23 nt, Human
aacaagacagauagaaaccaccc

SEQ ID NO: 301247 - RNA, 18 nt, Human
acaguguuauauaaguga

SEQ ID NO: 301248 - RNA, 20 nt, Human
acugaaucaacuaagcugaa

SEQ ID NO: 301249 - RNA, 21 nt, Human
agaaagguuuacauauuuuag

SEQ ID NO: 301250 - RNA, 22 nt, Human
agacagauagaaaccacccuaa

SEQ ID NO: 301251 - RNA, 20 nt, Human
agcagugcuuguaaaaguga

SEQ ID NO: 301252 - RNA, 23 nt, Human
agugaaaaacaagacagauagaa

SEQ ID NO: 301253 - RNA, 22 nt, Human
auauaagugaaaaacaagacag

SEQ ID NO: 301254 - RNA, 20 nt, Human
caaaaugcucaaaugagcca

SEQ ID NO: 301255 - RNA, 24 nt, Human
caaacauauacuuugauuuacauc

SEQ ID NO: 301256 - RNA, 19 nt, Human
caaauugaagaugaagaca

SEQ ID NO: 301257 - RNA, 19 nt, Human
caacuaagcugaacaccaa

SEQ ID NO: 301258 - RNA, 27 nt, Human
caagacagauagaaaccacccuaaacc

SEQ ID NO: 301259 - RNA, 23 nt, Human
cacuucauacuuaaauaccaagu

SEQ ID NO: 301260 - RNA, 23 nt, Human
cagcaccagagguuaaaaaugga

SEQ ID NO: 301261 - RNA, 18 nt, Human
cagugcuuguaaaaguga

SEQ ID NO: 301262 - RNA, 22 nt, Human
cuuuauacagcaccagagguua

SEQ ID NO: 301263 - RNA, 18 nt, Human
gacucaagaugaaggcaa

SEQ ID NO: 301264 - RNA, 24 nt, Human
gguuuaccuagaaagguuuacaua

SEQ ID NO: 301265 - RNA, 21 nt, Human
uaaaagugaggucccacugcu

SEQ ID NO: 301266 - RNA, 19 nt, Human
uaagcugaacaccaacuuc

SEQ ID NO: 301267 - RNA, 22 nt, Human
uaagcugaacaccaacuucuua

SEQ ID NO: 301268 - RNA, 25 nt, Human
uacagcaccagagguuaaaaaugga

SEQ ID NO: 301269 - RNA, 19 nt, Human
uacauucucaaauauucca

SEQ ID NO: 301270 - RNA, 24 nt, Human
uauguacauaaaaaauucaauaau

SEQ ID NO: 301271 - RNA, 19 nt, Human
ucaagaugaaggcaagcgg

SEQ ID NO: 301272 - RNA, 18 nt, Human
ucuuuucauucaugcuuc

SEQ ID NO: 301273 - RNA, 20 nt, Human
ugaaaaacaagacagauaga

SEQ ID NO: 301274 - RNA, 25 nt, Human
ugaaaaacaagacagauagaaacca

SEQ ID NO: 301275 - RNA, 18 nt, Human
ugccauaaccccuaauac

SEQ ID NO: 301276 - RNA, 24 nt, Human
ugcuaaguuaauggccaucucuuu

SEQ ID NO: 301277 - RNA, 24 nt, Human
uuuacaucuaguuuaauauucccu

SEQ ID NO: 301278 - RNA, 20 nt, Human
uuuauuauccagaauaaacu

SEQ ID NO: 301279 - RNA, 20 nt, Human
uuugaagaucacuucuaccu

SEQ ID NO: 301280 - RNA, 18 nt, Human
uuuuuuuuuuuuuuuuug

SEQ ID NO: 301281 - RNA, 23 nt, Human
uuuuuuuuuuuuuuuuuggcaag

SEQ ID NO: 301282 - RNA, 22 nt, Human
uuuuuuuuuuuuuuuuuuuggc

SEQ ID NO: 301283 - RNA, 18 nt, Human
aaacacggagacaccaac

SEQ ID NO: 301284 - RNA, 18 nt, Human
accagcagaugccggaca

SEQ ID NO: 301285 - RNA, 23 nt, Human
agcgcagacgccuccuucugacc

SEQ ID NO: 301286 - RNA, 22 nt, Human
cacagggacaaacacggagaca

SEQ ID NO: 301287 - RNA, 22 nt, Human
cacuuuguuauuuuucacaaag

SEQ ID NO: 301288 - RNA, 19 nt, Human
ccagcagaugccggacacu

SEQ ID NO: 301289 - RNA, 19 nt, Human
cccucggcugcgacucugg

SEQ ID NO: 301290 - RNA, 22 nt, Human
ccgaggcgggggcacggucucc

SEQ ID NO: 301291 - RNA, 22 nt, Human
ccgccgcucgcucgggcuccgg

SEQ ID NO: 301292 - RNA, 21 nt, Human
ccggccccggcuccccucggc

SEQ ID NO: 301293 - RNA, 21 nt, Human
ccuggccgcggcggcgcgggg

SEQ ID NO: 301294 - RNA, 19 nt, Human
cgcucgggcuccggcucgg

SEQ ID NO: 301295 - RNA, 23 nt, Human
cggacacucaugaaagaaaaaaa

SEQ ID NO: 301296 - RNA, 19 nt, Human
cggcucgggcucgggcucc

SEQ ID NO: 301297 - RNA, 24 nt, Human
cuaaggcagacguuacauguuuuc

SEQ ID NO: 301298 - RNA, 20 nt, Human
cucgggcuccggccccggcc

SEQ ID NO: 301299 - RNA, 19 nt, Human
ggccgaggcgggggcacgg

SEQ ID NO: 301300 - RNA, 18 nt, Human
gggccgaggcgggggcac

SEQ ID NO: 301301 - RNA, 24 nt, Human
gggccgaggcgggggcacggucuc

SEQ ID NO: 301302 - RNA, 18 nt, Human
gggccuggccgcggcggc

SEQ ID NO: 301303 - RNA, 20 nt, Human
gugucacgggcaagcggcgg

SEQ ID NO: 301304 - RNA, 25 nt, Human
ugaagaccagcagaugccggacacu

SEQ ID NO: 301305 - RNA, 19 nt, Human
uggccgcggcggcgcgggg

SEQ ID NO: 301306 - RNA, 22 nt, Human
uuuuuuuuuuuuuuugugacca

SEQ ID NO: 301307 - RNA, 19 nt, Human
uuuuuuuuuuuuuuuuugu

SEQ ID NO: 301308 - RNA, 20 nt, Human
uuuuuuuuuuuuuuuuuugg

SEQ ID NO: 301309 - RNA, 23 nt, Human
aaacaaucuauccauuucagaac

SEQ ID NO: 301310 - RNA, 21 nt, Human
aaccaagacaucaggaggucu

SEQ ID NO: 301311 - RNA, 21 nt, Human
aagaggaaagaagcauuaugg

SEQ ID NO: 301312 - RNA, 19 nt, Human
aagcauuauggggauugaa

SEQ ID NO: 301313 - RNA, 20 nt, Human
acaaaauaacucuaaaacaa

SEQ ID NO: 301314 - RNA, 19 nt, Human
acauccacccuuccccauc

SEQ ID NO: 301315 - RNA, 21 nt, Human
acccaaugcccagugcguaug

SEQ ID NO: 301316 - RNA, 18 nt, Human
acuccaaccugaaaaggu

SEQ ID NO: 301317 - RNA, 20 nt, Human
agacagggagggcuuugaug

SEQ ID NO: 301318 - RNA, 20 nt, Human
agacauuaagaggaaagaag

SEQ ID NO: 301319 - RNA, 19 nt, Human
agagauaggcugggcuugg

SEQ ID NO: 301320 - RNA, 23 nt, Human
agaggaaagaagcauuaugggga

SEQ ID NO: 301321 - RNA, 21 nt, Human
agccuauuaaaggcuaagcaa

SEQ ID NO: 301322 - RNA, 21 nt, Human
agccucaucuccuggacccac

SEQ ID NO: 301323 - RNA, 19 nt, Human
aggcacuguccaggguacc

SEQ ID NO: 301324 - RNA, 22 nt, Human
agggcuuugauggaaaccaaga

SEQ ID NO: 301325 - RNA, 20 nt, Human
agggguuucuccugacucua

SEQ ID NO: 301326 - RNA, 18 nt, Human
aggguaccaacaugacug

SEQ ID NO: 301327 - RNA, 22 nt, Human
agucaggugcacaggagaucuu

SEQ ID NO: 301328 - RNA, 18 nt, Human
auaacauacucccacgca

SEQ ID NO: 301329 - RNA, 28 nt, Human
aucacaaacugcugcugcugcugcugcc

SEQ ID NO: 301330 - RNA, 20 nt, Human
aucuuucuuuuauuuauugu

SEQ ID NO: 301331 - RNA, 26 nt, Human
caaacugcugcugcugcugcugcugc

SEQ ID NO: 301332 - RNA, 21 nt, Human
caaagaggcagcugugaacac

SEQ ID NO: 301333 - RNA, 18 nt, Human
caagccuauuaaaggcua

SEQ ID NO: 301334 - RNA, 19 nt, Human
cacaaaauaacucuaaaac

SEQ ID NO: 301335 - RNA, 20 nt, Human
cacaaaccaaaagagagugc

SEQ ID NO: 301336 - RNA, 22 nt, Human
caccauggaguagaagcaugau

SEQ ID NO: 301337 - RNA, 23 nt, Human
caccauggaguagaagcaugaua

SEQ ID NO: 301338 - RNA, 21 nt, Human
cacucugcuuugucccugggc

SEQ ID NO: 301339 - RNA, 19 nt, Human
cagcaauuccugcggcuug

SEQ ID NO: 301340 - RNA, 23 nt, Human
cagccucaucuccuggacccaca

SEQ ID NO: 301341 - RNA, 19 nt, Human
caggugcacaggagaucuu

SEQ ID NO: 301342 - RNA, 25 nt, Human
cauuuuauuccucuuucugguuuua

SEQ ID NO: 301343 - RNA, 23 nt, Human
ccacccuuccccaucacagaccc

SEQ ID NO: 301344 - RNA, 19 nt, Human
cccacaaaccaaaagagag

SEQ ID NO: 301345 - RNA, 24 nt, Human
cccacaaaccaaaagagagugccu

SEQ ID NO: 301346 - RNA, 24 nt, Human
cccagagaaauaacauacucccac

SEQ ID NO: 301347 - RNA, 19 nt, Human
cccagugcguauguugggc

SEQ ID NO: 301348 - RNA, 21 nt, Human
ccucaucuccuggacccacaa

SEQ ID NO: 301349 - RNA, 20 nt, Human
gaaugcacuccaaccugaaa

SEQ ID NO: 301350 - RNA, 20 nt, Human
gcaaaagagagacagacaga

SEQ ID NO: 301351 - RNA, 24 nt, Human
gcauucaagaggcugcucucaauc

SEQ ID NO: 301352 - RNA, 19 nt, Human
gcucaggggccuccuugac

SEQ ID NO: 301353 - RNA, 22 nt, Human
ggcugcugcaacagcucccccc

SEQ ID NO: 301354 - RNA, 20 nt, Human
ggcuugggcugcugcaacag

SEQ ID NO: 301355 - RNA, 18 nt, Human
gggccagauggcuuggac

SEQ ID NO: 301356 - RNA, 19 nt, Human
uaaacccacuagaagacug

SEQ ID NO: 301357 - RNA, 28 nt, Human
uaagcaaauuccaaguaaauugcauaaa

SEQ ID NO: 301358 - RNA, 21 nt, Human
uaaguuuggacaucauagacc

SEQ ID NO: 301359 - RNA, 24 nt, Human
uacaaauuauccagacucaagccu

SEQ ID NO: 301360 - RNA, 23 nt, Human
uacacaagccuauuaaaggcuaa

SEQ ID NO: 301361 - RNA, 23 nt, Human
uagaccuacagguacaaagaaca

SEQ ID NO: 301362 - RNA, 19 nt, Human
uaggauuucuguguaugaa

SEQ ID NO: 301363 - RNA, 23 nt, Human
uauccagccucaucuccuggacc

SEQ ID NO: 301364 - RNA, 22 nt, Human
uauuaaaggcuaagcaaauucc

SEQ ID NO: 301365 - RNA, 22 nt, Human
uauuuuguacacaaugcugagc

SEQ ID NO: 301366 - RNA, 26 nt, Human
ucacaaacugcugcugcugcugcugc

SEQ ID NO: 301367 - RNA, 21 nt, Human
ucagggguuucuccugacucu

SEQ ID NO: 301368 - RNA, 21 nt, Human
ucaggugcacaggagaucuuu

SEQ ID NO: 301369 - RNA, 22 nt, Human
ucauuuggccucaagcacuuaa

SEQ ID NO: 301370 - RNA, 19 nt, Human
uccacccuuccccaucaca

SEQ ID NO: 301371 - RNA, 19 nt, Human
ucccacgcagaagagagau

SEQ ID NO: 301372 - RNA, 18 nt, Human
uccccaucacagacccca

SEQ ID NO: 301373 - RNA, 21 nt, Human
uccugcggcuugggcugcugc

SEQ ID NO: 301374 - RNA, 23 nt, Human
ucggagguggcaguggcuggucc

SEQ ID NO: 301375 - RNA, 23 nt, Human
ucuauccauuucagaacaucauc

SEQ ID NO: 301376 - RNA, 24 nt, Human
ucuccugacucuacuccaugaaaa

SEQ ID NO: 301377 - RNA, 25 nt, Human
ucugguuuuauuuugagacauuaag

SEQ ID NO: 301378 - RNA, 19 nt, Human
ugaaugcacuccaaccuga

SEQ ID NO: 301379 - RNA, 18 nt, Human
ugacuaaacauuaaaccc

SEQ ID NO: 301380 - RNA, 19 nt, Human
ugauguguauacuaucugc

SEQ ID NO: 301381 - RNA, 20 nt, Human
ugauguguauacuaucugca

SEQ ID NO: 301382 - RNA, 21 nt, Human
ugcaacagcuccccccacgca

SEQ ID NO: 301383 - RNA, 18 nt, Human
ugccucugauucaggguu

SEQ ID NO: 301384 - RNA, 19 nt, Human
ugccugggaaugagagagc

SEQ ID NO: 301385 - RNA, 18 nt, Human
ugcucagcagcaucuuau

SEQ ID NO: 301386 - RNA, 19 nt, Human
ugcugagcugagcaugggg

SEQ ID NO: 301387 - RNA, 23 nt, Human
ugcugccgcugcugauaguuuua

SEQ ID NO: 301388 - RNA, 18 nt, Human
ugcugcugcugccgcugc

SEQ ID NO: 301389 - RNA, 21 nt, Human
ugcugcugcugcugcugcugc

SEQ ID NO: 301390 - RNA, 24 nt, Human
uggacccacaaaccaaaagagagu

SEQ ID NO: 301391 - RNA, 24 nt, Human
uggcugguccaaggcucaggggcc

SEQ ID NO: 301392 - RNA, 19 nt, Human
ugggccagauggcuuggac

SEQ ID NO: 301393 - RNA, 21 nt, Human
uugagauuugggaauauaaug

SEQ ID NO: 301394 - RNA, 21 nt, Human
uuuaaaggacacaaaauaacu

SEQ ID NO: 301395 - RNA, 18 nt, Human
uuucacucccuucuguaa

SEQ ID NO: 301396 - RNA, 19 nt, Human
uuuucacucccuucuguaa

SEQ ID NO: 301397 - RNA, 23 nt, Human
uuuucugaacaaugaggacucag

SEQ ID NO: 301398 - RNA, 22 nt, Human
aaacaggucacaacucauuccu

SEQ ID NO: 301399 - RNA, 24 nt, Human
acagaaugagacccuggagaugga

SEQ ID NO: 301400 - RNA, 22 nt, Human
accacugcacuccagccugggc

SEQ ID NO: 301401 - RNA, 24 nt, Human
acugcacuccagccugggcaacag

SEQ ID NO: 301402 - RNA, 27 nt, Human
agaaaggauuccuauuaaauacccaga

SEQ ID NO: 301403 - RNA, 24 nt, Human
agagguugcugugagccgagaucg

SEQ ID NO: 301404 - RNA, 20 nt, Human
aguaaacaggucacaacuca

SEQ ID NO: 301405 - RNA, 24 nt, Human
aucgcaccacugcacuccagccug

SEQ ID NO: 301406 - RNA, 28 nt, Human
aucgcaccacugcacuccagccugggca

SEQ ID NO: 301407 - RNA, 18 nt, Human
augauaacagaagacaau

SEQ ID NO: 301408 - RNA, 23 nt, Human
cacaacauuguuacaaaagcaca

SEQ ID NO: 301409 - RNA, 22 nt, Human
cacaauuuuaauaggcuuaucu

SEQ ID NO: 301410 - RNA, 19 nt, Human
cacugcacuccagccuggg

SEQ ID NO: 301411 - RNA, 21 nt, Human
cacugcacuccagccugggca

SEQ ID NO: 301412 - RNA, 22 nt, Human
cacugcacuccagccugggcaa

SEQ ID NO: 301413 - RNA, 23 nt, Human
cacugcacuccagccugggcaac

SEQ ID NO: 301414 - RNA, 24 nt, Human
cacugcacuccagccugggcaaca

SEQ ID NO: 301415 - RNA, 21 nt, Human
cagcuaucaaauaaacagcca

SEQ ID NO: 301416 - RNA, 20 nt, Human
ccacugcacuccagccuggg

SEQ ID NO: 301417 - RNA, 20 nt, Human
ccacugcacuccagccuggg

SEQ ID NO: 301418 - RNA, 21 nt, Human
ccacugcacuccagccugggc

SEQ ID NO: 301419 - RNA, 23 nt, Human
ccacugcacuccagccugggcaa

SEQ ID NO: 301420 - RNA, 24 nt, Human
ccacugcacuccagccugggcaac

SEQ ID NO: 301421 - RNA, 23 nt, Human
cucaaggaaccuguagaaguaag

SEQ ID NO: 301422 - RNA, 22 nt, Human
gagacaucaucauacagagaaa

SEQ ID NO: 301423 - RNA, 23 nt, Human
gagaucgcaccacugcacuccag

SEQ ID NO: 301424 - RNA, 20 nt, Human
gcaccacugcacuccagccu

SEQ ID NO: 301425 - RNA, 20 nt, Human
gccgagaucgcaccacugca

SEQ ID NO: 301426 - RNA, 24 nt, Human
gccgccuguaagacaaaugauaac

SEQ ID NO: 301427 - RNA, 22 nt, Human
ggaaaagaucacaugaaaaaaa

SEQ ID NO: 301428 - RNA, 19 nt, Human
ggaggcagagagguugcug

SEQ ID NO: 301429 - RNA, 23 nt, Human
gggcaacagaaugagacccugga

SEQ ID NO: 301430 - RNA, 20 nt, Human
ggugcucaaggaaccuguag

SEQ ID NO: 301431 - RNA, 21 nt, Human
guaagacaaaugauaacagaa

SEQ ID NO: 301432 - RNA, 23 nt, Human
uaagcagcugucaccuauacaga

SEQ ID NO: 301433 - RNA, 23 nt, Human
uaagcauaaauuagccgucugca

SEQ ID NO: 301434 - RNA, 20 nt, Human
uccuugagaaaggauuccua

SEQ ID NO: 301435 - RNA, 23 nt, Human
ucgcaccacugcacuccagccug

SEQ ID NO: 301436 - RNA, 31 nt, Human
ucgcaccacugcacuccagccugggcaacaa

SEQ ID NO: 301437 - RNA, 25 nt, Human
ugaaaaaaaucuagcucuugccuua

SEQ ID NO: 301438 - RNA, 22 nt, Human
ugagccgagaucgcaccacugc

SEQ ID NO: 301439 - RNA, 18 nt, Human
uggaagaggagcugcucc

SEQ ID NO: 301440 - RNA, 22 nt, Human
uugcugugagccgagaucgcac

SEQ ID NO: 301441 - RNA, 21 nt, Human
uuggugcucaaggaaccugua

SEQ ID NO: 301442 - RNA, 22 nt, Human
uuugcauuuguuaaugguauuu

SEQ ID NO: 301443 - RNA, 24 nt, Human
uuuuuuuuuuuuuuuuuugcauuu

SEQ ID NO: 301444 - RNA, 27 nt, Human
uuuuuuuuuuuuuuuuuuuuuuugggg

SEQ ID NO: 301445 - RNA, 19 nt, Human
aaaagggcagacauggcag

SEQ ID NO: 301446 - RNA, 26 nt, Human
aaacaguccagcacaggaguacaaac

SEQ ID NO: 301447 - RNA, 18 nt, Human
aacccugucucucuucuc

SEQ ID NO: 301448 - RNA, 20 nt, Human
aaccuccuccucggcucccg

SEQ ID NO: 301449 - RNA, 24 nt, Human
aacucagcccccuccccuagcccc

SEQ ID NO: 301450 - RNA, 26 nt, Human
aacucagcccccuccccuagccccug

SEQ ID NO: 301451 - RNA, 21 nt, Human
aaggagagagggaagguugcc

SEQ ID NO: 301452 - RNA, 23 nt, Human
aagggucucauucuucaaccucc

SEQ ID NO: 301453 - RNA, 23 nt, Human
aauaaccaaguugggacccuaua

SEQ ID NO: 301454 - RNA, 21 nt, Human
acaccacaaaaaagggcagac

SEQ ID NO: 301455 - RNA, 23 nt, Human
accaggaaaggaucccuggcuca

SEQ ID NO: 301456 - RNA, 20 nt, Human
acccugucucucuucuccca

SEQ ID NO: 301457 - RNA, 20 nt, Human
acccugucucucuucuccca

SEQ ID NO: 301458 - RNA, 23 nt, Human
acucccacauccuaaaagcuccu

SEQ ID NO: 301459 - RNA, 19 nt, Human
acugcagacagaagagcac

SEQ ID NO: 301460 - RNA, 23 nt, Human
acuguaguuaacuucuuucuggc

SEQ ID NO: 301461 - RNA, 19 nt, Human
agaaauagcccccaccucc

SEQ ID NO: 301462 - RNA, 21 nt, Human
agacaaaaagggaccugcugg

SEQ ID NO: 301463 - RNA, 19 nt, Human
agagggaagguugccuaca

SEQ ID NO: 301464 - RNA, 24 nt, Human
aggaaagggaaguaggaggaaugu

SEQ ID NO: 301465 - RNA, 21 nt, Human
agggaaagggagacuugggaa

SEQ ID NO: 301466 - RNA, 21 nt, Human
agggagaagccagacagggaa

SEQ ID NO: 301467 - RNA, 18 nt, Human
agguguucacaagcccag

SEQ ID NO: 301468 - RNA, 20 nt, Human
agguguucacaagcccaggg

SEQ ID NO: 301469 - RNA, 21 nt, Human
aguggguagaugguggguugc

SEQ ID NO: 301470 - RNA, 19 nt, Human
agugggugggcagguuagu

SEQ ID NO: 301471 - RNA, 23 nt, Human
auggggggaguggaggaaaggga

SEQ ID NO: 301472 - RNA, 23 nt, Human
auguuuuuugaaaaagccuucuu

SEQ ID NO: 301473 - RNA, 18 nt, Human
auuccccucccacccccg

SEQ ID NO: 301474 - RNA, 21 nt, Human
caaaaaagggcagacauggca

SEQ ID NO: 301475 - RNA, 20 nt, Human
caaaaagggaccugcuggua

SEQ ID NO: 301476 - RNA, 18 nt, Human
caaucucacagcaauaua

SEQ ID NO: 301477 - RNA, 24 nt, Human
cacaaaaaagggcagacauggcag

SEQ ID NO: 301478 - RNA, 20 nt, Human
cacacaguuagcacggucag

SEQ ID NO: 301479 - RNA, 21 nt, Human
cacacugcagacagaagagca

SEQ ID NO: 301480 - RNA, 22 nt, Human
cacgcacacacacgcgcacagu

SEQ ID NO: 301481 - RNA, 22 nt, Human
cacuccugaguccccgguuccu

SEQ ID NO: 301482 - RNA, 21 nt, Human
cacugcagacagaagagcaca

SEQ ID NO: 301483 - RNA, 23 nt, Human
cagaagagcacaagauaggggca

SEQ ID NO: 301484 - RNA, 25 nt, Human
cagagcgugcgcacacgcacacaca

SEQ ID NO: 301485 - RNA, 23 nt, Human
cagcacaggaguacaaacaugga

SEQ ID NO: 301486 - RNA, 19 nt, Human
cagcccccuccccuagccc

SEQ ID NO: 301487 - RNA, 20 nt, Human
cagcccccuccccuagcccc

SEQ ID NO: 301488 - RNA, 22 nt, Human
caguccagcacaggaguacaaa

SEQ ID NO: 301489 - RNA, 24 nt, Human
caguucaugcucauuccccccacc

SEQ ID NO: 301490 - RNA, 21 nt, Human
caugagagacaaaaagggacc

SEQ ID NO: 301491 - RNA, 22 nt, Human
caugcucauuccccccacccaa

SEQ ID NO: 301492 - RNA, 18 nt, Human
ccaaggagagagggaagg

SEQ ID NO: 301493 - RNA, 24 nt, Human
ccacauccuaaaagcuccuaacuu

SEQ ID NO: 301494 - RNA, 20 nt, Human
ccagacagggaaagggagac

SEQ ID NO: 301495 - RNA, 21 nt, Human
cccccuccccuagccccugac

SEQ ID NO: 301496 - RNA, 23 nt, Human
cccccuccccuagccccugaccc

SEQ ID NO: 301497 - RNA, 25 nt, Human
cccgccgccgccgccgccgccgcuu

SEQ ID NO: 301498 - RNA, 22 nt, Human
ccgagcccagcgccgcucacuc

SEQ ID NO: 301499 - RNA, 22 nt, Human
ccgccgccgccgccgccgccgc

SEQ ID NO: 301500 - RNA, 24 nt, Human
ccgccgccgccgccgccgccgcuu

SEQ ID NO: 301501 - RNA, 31 nt, Human
ccgccgccgccgccgcuucugccgccgccgg

SEQ ID NO: 301502 - RNA, 18 nt, Human
ccgccgccgccgcuucug

SEQ ID NO: 301503 - RNA, 20 nt, Human
ccgccgccgccucuuccgcc

SEQ ID NO: 301504 - RNA, 21 nt, Human
ccgccgccgccucuuccgccc

SEQ ID NO: 301505 - RNA, 24 nt, Human
ccgccgccgccucuuccgcccggu

SEQ ID NO: 301506 - RNA, 20 nt, Human
ccgccgccgcuucugccgcc

SEQ ID NO: 301507 - RNA, 23 nt, Human
ccgccgccgcuucugccgccgcc

SEQ ID NO: 301508 - RNA, 24 nt, Human
ccgccgcuucugccgccgccgccg

SEQ ID NO: 301509 - RNA, 26 nt, Human
ccgccgcuucugccgccgccgccgcc

SEQ ID NO: 301510 - RNA, 27 nt, Human
ccgccgcuucugccgccgccgccgccu

SEQ ID NO: 301511 - RNA, 18 nt, Human
ccgcucacuccacccggc

SEQ ID NO: 301512 - RNA, 26 nt, Human
ccgcuucugccgccgccgccgccucu

SEQ ID NO: 301513 - RNA, 20 nt, Human
ccggaaccuccuccucggcu

SEQ ID NO: 301514 - RNA, 18 nt, Human
ccguccccacugcuuuuc

SEQ ID NO: 301515 - RNA, 18 nt, Human
ccgugcacacugcagaca

SEQ ID NO: 301516 - RNA, 21 nt, Human
ccuaaaagcuccuaacuugaa

SEQ ID NO: 301517 - RNA, 22 nt, Human
ccuaugcuaggcccaugagaga

SEQ ID NO: 301518 - RNA, 26 nt, Human
ccucccacccccgcucuggccuagac

SEQ ID NO: 301519 - RNA, 19 nt, Human
ccuggauccaccuaccucu

SEQ ID NO: 301520 - RNA, 18 nt, Human
cgccgccgccgccgccgc

SEQ ID NO: 301521 - RNA, 21 nt, Human
cgcgggcacuccugagucccc

SEQ ID NO: 301522 - RNA, 21 nt, Human
cgcuucugccgccgccgccgc

SEQ ID NO: 301523 - RNA, 21 nt, Human
cggagcccgagcccagcgccg

SEQ ID NO: 301524 - RNA, 20 nt, Human
cggagccggagcccgagccc

SEQ ID NO: 301525 - RNA, 23 nt, Human
cuaaaagcuccuaacuugaacuu

SEQ ID NO: 301526 - RNA, 22 nt, Human
cuaacgcuggcugcuccauggg

SEQ ID NO: 301527 - RNA, 19 nt, Human
cuagacaccacaaaaaagg

SEQ ID NO: 301528 - RNA, 20 nt, Human
cuaggcccaugagagacaag

SEQ ID NO: 301529 - RNA, 18 nt, Human
cucauuccccccacccaa

SEQ ID NO: 301530 - RNA, 18 nt, Human
cucccauaccuuaccccu

SEQ ID NO: 301531 - RNA, 20 nt, Human
cucucccauaccuuaccccu

SEQ ID NO: 301532 - RNA, 18 nt, Human
cugaguaggaacaacuga

SEQ ID NO: 301533 - RNA, 21 nt, Human
cugcagcaguggccagagggg

SEQ ID NO: 301534 - RNA, 19 nt, Human
cuugcccccucuccuggag

SEQ ID NO: 301535 - RNA, 20 nt, Human
cuugcccccucuccuggagg

SEQ ID NO: 301536 - RNA, 20 nt, Human
gaaacaguccagcacaggag

SEQ ID NO: 301537 - RNA, 22 nt, Human
gacaaaaagggaccugcuggua

SEQ ID NO: 301538 - RNA, 23 nt, Human
gagaaacuacuagacucugcuga

SEQ ID NO: 301539 - RNA, 19 nt, Human
gagcgcucagggcgcgggc

SEQ ID NO: 301540 - RNA, 18 nt, Human
gaggcuggggucacucac

SEQ ID NO: 301541 - RNA, 19 nt, Human
gaggggcaucuugggguag

SEQ ID NO: 301542 - RNA, 19 nt, Human
gcaaucucacagcaauaua

SEQ ID NO: 301543 - RNA, 22 nt, Human
gcacacgcacacacacgcgcac

SEQ ID NO: 301544 - RNA, 22 nt, Human
gcacacugcagacagaagagca

SEQ ID NO: 301545 - RNA, 23 nt, Human
gcaucuugggguaggcaggaggc

SEQ ID NO: 301546 - RNA, 18 nt, Human
gcccucauccccaucuca

SEQ ID NO: 301547 - RNA, 22 nt, Human
gccgccgccgccgccucuuccg

SEQ ID NO: 301548 - RNA, 20 nt, Human
gcucccgccgccgccgccgc

SEQ ID NO: 301549 - RNA, 21 nt, Human
ggagccggagcccgagcccag

SEQ ID NO: 301550 - RNA, 18 nt, Human
ggaggaaugugcugauuu

SEQ ID NO: 301551 - RNA, 24 nt, Human
ggcauuccccucccacccccgcuc

SEQ ID NO: 301552 - RNA, 20 nt, Human
gggaguggaggaaagggaag

SEQ ID NO: 301553 - RNA, 20 nt, Human
gggcuccccucucucugccc

SEQ ID NO: 301554 - RNA, 19 nt, Human
ggggaguggaggaaaggga

SEQ ID NO: 301555 - RNA, 19 nt, Human
ggggaucggugcaaaggaa

SEQ ID NO: 301556 - RNA, 20 nt, Human
guuagucuuuuuagauuauu

SEQ ID NO: 301557 - RNA, 21 nt, Human
uaaccaaguugggacccuaua

SEQ ID NO: 301558 - RNA, 25 nt, Human
uaaugcuagacaccacaaaaaaggg

SEQ ID NO: 301559 - RNA, 19 nt, Human
uaccuuaccccuaugucag

SEQ ID NO: 301560 - RNA, 22 nt, Human
uagccccugacccccauccccu

SEQ ID NO: 301561 - RNA, 23 nt, Human
uauauguacacacaguuagcacg

SEQ ID NO: 301562 - RNA, 22 nt, Human
uauggggggaguggaggaaagg

SEQ ID NO: 301563 - RNA, 21 nt, Human
uauguacacacaguuagcacg

SEQ ID NO: 301564 - RNA, 23 nt, Human
uauguagaauauauauguacaca

SEQ ID NO: 301565 - RNA, 22 nt, Human
ucaggguggggaggggcaucuu

SEQ ID NO: 301566 - RNA, 22 nt, Human
uccaaccuuccuccucuuccuc

SEQ ID NO: 301567 - RNA, 19 nt, Human
ucccacauccuaaaagcuc

SEQ ID NO: 301568 - RNA, 23 nt, Human
ucccacauccuaaaagcuccuaa

SEQ ID NO: 301569 - RNA, 21 nt, Human
ucccgccgccgccgccgccgc

SEQ ID NO: 301570 - RNA, 24 nt, Human
ucccgccgccgccgccgccgccgg

SEQ ID NO: 301571 - RNA, 23 nt, Human
uccuaagcagcguccggaaccuc

SEQ ID NO: 301572 - RNA, 25 nt, Human
ucggcucccgccgccgccgccgccg

SEQ ID NO: 301573 - RNA, 22 nt, Human
ucucucuucucccauuucuucc

SEQ ID NO: 301574 - RNA, 19 nt, Human
ucugccacucccuucacug

SEQ ID NO: 301575 - RNA, 27 nt, Human
ugaaaagaacccugucucucuucuccc

SEQ ID NO: 301576 - RNA, 18 nt, Human
ugcacacugcagacagaa

SEQ ID NO: 301577 - RNA, 24 nt, Human
ugcaguuuuaauauacauauaugu

SEQ ID NO: 301578 - RNA, 24 nt, Human
ugcccucauccccaucucaggcuc

SEQ ID NO: 301579 - RNA, 19 nt, Human
ugcccuugcccccucuccu

SEQ ID NO: 301580 - RNA, 25 nt, Human
ugcgcacacgcacacacacgcgcac

SEQ ID NO: 301581 - RNA, 25 nt, Human
ugcgcacacgcacacacacgcgcag

SEQ ID NO: 301582 - RNA, 18 nt, Human
uggaaggacaguucaugc

SEQ ID NO: 301583 - RNA, 19 nt, Human
uggaaggacaguucaugcu

SEQ ID NO: 301584 - RNA, 19 nt, Human
uggaggaaagggaaguagg

SEQ ID NO: 301585 - RNA, 26 nt, Human
uggaggaaagggaaguaggaggaaaa

SEQ ID NO: 301586 - RNA, 21 nt, Human
uggcauuccccucccaccccc

SEQ ID NO: 301587 - RNA, 18 nt, Human
uggcuaggagguguucac

SEQ ID NO: 301588 - RNA, 25 nt, Human
uggggaaacucagcccccuccccua

SEQ ID NO: 301589 - RNA, 20 nt, Human
uggggaggggcaucuugggg

SEQ ID NO: 301590 - RNA, 20 nt, Human
ugggggaagggaguggucug

SEQ ID NO: 301591 - RNA, 19 nt, Human
uucacaagcccagggggcc

SEQ ID NO: 301592 - RNA, 24 nt, Human
uucccagcacagucucuccagagu

SEQ ID NO: 301593 - RNA, 23 nt, Human
uucucccauuucuuccauaagaa

SEQ ID NO: 301594 - RNA, 23 nt, Human
uucugccgccgccgccgccucuu

SEQ ID NO: 301595 - RNA, 26 nt, Human
uugcauagaaauagcccccaccuccu

SEQ ID NO: 301596 - RNA, 24 nt, Human
uuuaauguuuuuugaaaaagccuu

SEQ ID NO: 301597 - RNA, 20 nt, Human
uuuuuuuuuuuuuuuugcaa

SEQ ID NO: 301598 - RNA, 24 nt, Human
aaacacgcuugcuucgacucaugc

SEQ ID NO: 301599 - RNA, 26 nt, Human
acaguuuaggaaacacaagauugucu

SEQ ID NO: 301600 - RNA, 21 nt, Human
agccaaagacauaagaaaucc

SEQ ID NO: 301601 - RNA, 23 nt, Human
aggcucggggaacacugcagcga

SEQ ID NO: 301602 - RNA, 23 nt, Human
cacaaaauaucuaguguagccaa

SEQ ID NO: 301603 - RNA, 20 nt, Human
cagcacuuccucuauccuuu

SEQ ID NO: 301604 - RNA, 21 nt, Human
caggccaggaagggggcgggg

SEQ ID NO: 301605 - RNA, 22 nt, Human
ccaaagacauaagaaaucccug

SEQ ID NO: 301606 - RNA, 22 nt, Human
cccuucuugcagcuuucuguca

SEQ ID NO: 301607 - RNA, 21 nt, Human
cucaugcagccuagggcagca

SEQ ID NO: 301608 - RNA, 24 nt, Human
cuuccucuauccuuuccucucuca

SEQ ID NO: 301609 - RNA, 23 nt, Human
gaaaucccuguaugaaucaaaaa

SEQ ID NO: 301610 - RNA, 19 nt, Human
gaaucaaaaagugcccuuc

SEQ ID NO: 301611 - RNA, 21 nt, Human
gccaggaagggggcggggccc

SEQ ID NO: 301612 - RNA, 23 nt, Human
ggaaccaaagagguccucaccuc

SEQ ID NO: 301613 - RNA, 22 nt, Human
gggagaggggaugggaaugcag

SEQ ID NO: 301614 - RNA, 22 nt, Human
uaagaaaucccuguaugaauca

SEQ ID NO: 301615 - RNA, 18 nt, Human
uagggcagcacuuccucu

SEQ ID NO: 301616 - RNA, 19 nt, Human
uauccuuuccucucucagu

SEQ ID NO: 301617 - RNA, 21 nt, Human
ucacaaaauaucuaguguagc

SEQ ID NO: 301618 - RNA, 20 nt, Human
ugcuucgacucaugcagccu

SEQ ID NO: 301619 - RNA, 23 nt, Human
uggcgggaaggaaacacgcuugc

SEQ ID NO: 301620 - RNA, 21 nt, Human
uuuuuuuuuuuuuuuuuauuu

SEQ ID NO: 301621 - RNA, 25 nt, Human
aaagaacagcauuauuuucaaucau

SEQ ID NO: 301622 - RNA, 19 nt, Human
aaagagguugcaaggccag

SEQ ID NO: 301623 - RNA, 21 nt, Human
aaaggugggagccugcaaaag

SEQ ID NO: 301624 - RNA, 23 nt, Human
aaaguaucagaaaugcuucuuuc

SEQ ID NO: 301625 - RNA, 19 nt, Human
aaaugcuucuuuccuggga

SEQ ID NO: 301626 - RNA, 24 nt, Human
aaucauuuuaagucgcucauuuaa

SEQ ID NO: 301627 - RNA, 19 nt, Human
aggccaggcccccaggugc

SEQ ID NO: 301628 - RNA, 24 nt, Human
aggugcgcugggauuucuggcugg

SEQ ID NO: 301629 - RNA, 20 nt, Human
aucaaaugccgaagcuggga

SEQ ID NO: 301630 - RNA, 19 nt, Human
caaaugccauucugcauau

SEQ ID NO: 301631 - RNA, 22 nt, Human
caggcccccaggugcgcuggga

SEQ ID NO: 301632 - RNA, 21 nt, Human
ccaggcccccaggugcgcugg

SEQ ID NO: 301633 - RNA, 23 nt, Human
ccccaggugcgcugggauuucug

SEQ ID NO: 301634 - RNA, 23 nt, Human
cuaaagaacagcauuauuuucaa

SEQ ID NO: 301635 - RNA, 20 nt, Human
cuacuaaagaacagcauuau

SEQ ID NO: 301636 - RNA, 20 nt, Human
cugaucaaaugccgaagcug

SEQ ID NO: 301637 - RNA, 24 nt, Human
gagguugcaaggccaggcccccag

SEQ ID NO: 301638 - RNA, 18 nt, Human
gauucugggugccgucuc

SEQ ID NO: 301639 - RNA, 19 nt, Human
ugacagaaaguaucagaaa

SEQ ID NO: 301640 - RNA, 19 nt, Human
ugacagcaagacacauuuu

SEQ ID NO: 301641 - RNA, 22 nt, Human
ugcuucuuuccugggaaaagga

SEQ ID NO: 301642 - RNA, 18 nt, Human
uggagugcugaccagcag

SEQ ID NO: 301643 - RNA, 18 nt, Human
ugggaaaaggaauauaaa

SEQ ID NO: 301644 - RNA, 19 nt, Human
ugggagccugcaaaagggu

SEQ ID NO: 301645 - RNA, 19 nt, Human
aaaaaaaaaaaaaaaaaga

SEQ ID NO: 301646 - RNA, 22 nt, Human
aaaaaaacacucuaccuugacu

SEQ ID NO: 301647 - RNA, 24 nt, Human
aaaagacacaagcagucaaacaaa

SEQ ID NO: 301648 - RNA, 21 nt, Human
aaacagccaugaagaucuuuc

SEQ ID NO: 301649 - RNA, 21 nt, Human
aaacaugacuugaugcuuggc

SEQ ID NO: 301650 - RNA, 19 nt, Human
aaagugcuggggacacugg

SEQ ID NO: 301651 - RNA, 20 nt, Human
aacauggugaaacccugucu

SEQ ID NO: 301652 - RNA, 21 nt, Human
aacauggugaaacccugucuc

SEQ ID NO: 301653 - RNA, 18 nt, Human
aagaaugagggcugugca

SEQ ID NO: 301654 - RNA, 19 nt, Human
aagaaugagggcugugcac

SEQ ID NO: 301655 - RNA, 18 nt, Human
aagcaacaugagcauaug

SEQ ID NO: 301656 - RNA, 23 nt, Human
aagcacacacacuaaagaaaaca

SEQ ID NO: 301657 - RNA, 18 nt, Human
aaucgcuugaaccuggga

SEQ ID NO: 301658 - RNA, 24 nt, Human
aaucgcuugaaccugggaggcaga

SEQ ID NO: 301659 - RNA, 21 nt, Human
acacaaacaaaccacuugucc

SEQ ID NO: 301660 - RNA, 24 nt, Human
accaauuuucuaaaaggcaaacag

SEQ ID NO: 301661 - RNA, 23 nt, Human
accauaaagagaugacugaugac

SEQ ID NO: 301662 - RNA, 18 nt, Human
acccugggaaagcucugg

SEQ ID NO: 301663 - RNA, 24 nt, Human
acccugucucuacuaaaaauacaa

SEQ ID NO: 301664 - RNA, 21 nt, Human
accgcaguucaaacgagcgca

SEQ ID NO: 301665 - RNA, 24 nt, Human
accugguguaccucgcuggcugcc

SEQ ID NO: 301666 - RNA, 22 nt, Human
acuaaaaucucuuccccauccc

SEQ ID NO: 301667 - RNA, 27 nt, Human
acuccaucuaaaaaaaaaaaaaaaaaa

SEQ ID NO: 301668 - RNA, 18 nt, Human
acugcacuccagccuggg

SEQ ID NO: 301669 - RNA, 24 nt, Human
acugcacuccagccugggcaaaaa

SEQ ID NO: 301670 - RNA, 25 nt, Human
acugcacuccagccugggcaaaaag

SEQ ID NO: 301671 - RNA, 26 nt, Human
agacaagaauaaugcagaagggaccc

SEQ ID NO: 301672 - RNA, 19 nt, Human
agacacaagcagucaaaca

SEQ ID NO: 301673 - RNA, 18 nt, Human
agagguugcagugagcca

SEQ ID NO: 301674 - RNA, 20 nt, Human
agagguugcagugagccaag

SEQ ID NO: 301675 - RNA, 22 nt, Human
agagguugcagugagccaagau

SEQ ID NO: 301676 - RNA, 24 nt, Human
agagguugcagugagccaagaugg

SEQ ID NO: 301677 - RNA, 22 nt, Human
agauaaaaagcaguccccaaga

SEQ ID NO: 301678 - RNA, 24 nt, Human
agaucuuucaucucuuccaagcac

SEQ ID NO: 301679 - RNA, 22 nt, Human
agauggcgccacugcacuccag

SEQ ID NO: 301680 - RNA, 20 nt, Human
agcacacacacuaaagaaaa

SEQ ID NO: 301681 - RNA, 24 nt, Human
agcacuuugggaggccgagguggg

SEQ ID NO: 301682 - RNA, 22 nt, Human
agccuggccaacauggugaaac

SEQ ID NO: 301683 - RNA, 24 nt, Human
agccuggccaacauggugaaaccc

SEQ ID NO: 301684 - RNA, 19 nt, Human
agcugggugugguggcagu

SEQ ID NO: 301685 - RNA, 24 nt, Human
aggcagagguugcagugagccaag

SEQ ID NO: 301686 - RNA, 22 nt, Human
aggcaggagaaucgcuugaacc

SEQ ID NO: 301687 - RNA, 24 nt, Human
aggcaggagaaucgcuugaaccug

SEQ ID NO: 301688 - RNA, 20 nt, Human
aggccgagguggguggaucg

SEQ ID NO: 301689 - RNA, 24 nt, Human
aggccgagguggguggaucgcuug

SEQ ID NO: 301690 - RNA, 20 nt, Human
aggcugaggcaggagaaucg

SEQ ID NO: 301691 - RNA, 24 nt, Human
aggcugaggcaggagaaucgcuug

SEQ ID NO: 301692 - RNA, 21 nt, Human
agguggguggaucgcuugagg

SEQ ID NO: 301693 - RNA, 18 nt, Human
agugauaacuuugaauuu

SEQ ID NO: 301694 - RNA, 21 nt, Human
aguggauuacaaagagauuuc

SEQ ID NO: 301695 - RNA, 23 nt, Human
auauauaaaaacauauuucuuuc

SEQ ID NO: 301696 - RNA, 26 nt, Human
aucaaaaaacagaaaacccugguccc

SEQ ID NO: 301697 - RNA, 24 nt, Human
auggcgccacugcacuccagccug

SEQ ID NO: 301698 - RNA, 25 nt, Human
caaacaaaaccuaugucagacugaa

SEQ ID NO: 301699 - RNA, 24 nt, Human
caacauggugaaacccugucucua

SEQ ID NO: 301700 - RNA, 23 nt, Human
caacccagggugcagugggagag

SEQ ID NO: 301701 - RNA, 23 nt, Human
caacuuuguucacuacaaacaaa

SEQ ID NO: 301702 - RNA, 18 nt, Human
caaguguccaaaugaccu

SEQ ID NO: 301703 - RNA, 23 nt, Human
cacaaacaaaccacuuguccagc

SEQ ID NO: 301704 - RNA, 18 nt, Human
cacacaaaccacuaggcu

SEQ ID NO: 301705 - RNA, 18 nt, Human
cacaggacuucugggagc

SEQ ID NO: 301706 - RNA, 22 nt, Human
caccauaaagagaugacugaug

SEQ ID NO: 301707 - RNA, 19 nt, Human
cacccugggaaagcucugg

SEQ ID NO: 301708 - RNA, 21 nt, Human
caccuaucccuucaugaucug

SEQ ID NO: 301709 - RNA, 24 nt, Human
cacgccuguaaucccagcacuuug

SEQ ID NO: 301710 - RNA, 19 nt, Human
cacugcacuccagccuggg

SEQ ID NO: 301711 - RNA, 21 nt, Human
cacugcacuccagccugggca

SEQ ID NO: 301712 - RNA, 22 nt, Human
cacugcacuccagccugggcaa

SEQ ID NO: 301713 - RNA, 23 nt, Human
cacugcacuccagccugggcaaa

SEQ ID NO: 301714 - RNA, 24 nt, Human
cagcacuuugggaggccgaggugg

SEQ ID NO: 301715 - RNA, 18 nt, Human
cagcagaguaagauuuug

SEQ ID NO: 301716 - RNA, 22 nt, Human
cagcagaguaagauuuuggcag

SEQ ID NO: 301717 - RNA, 22 nt, Human
cagccugguuugcaaagggaag

SEQ ID NO: 301718 - RNA, 24 nt, Human
cagcuacucaggaggcugaggcag

SEQ ID NO: 301719 - RNA, 18 nt, Human
cagcugauguuacuuugu

SEQ ID NO: 301720 - RNA, 18 nt, Human
cauaacagcagaguaaga

SEQ ID NO: 301721 - RNA, 22 nt, Human
cauaggcauaggcagcugaugu

SEQ ID NO: 301722 - RNA, 25 nt, Human
caucaaaaaacagaaaacccugguc

SEQ ID NO: 301723 - RNA, 20 nt, Human
ccacugcacuccagccuggg

SEQ ID NO: 301724 - RNA, 20 nt, Human
ccacugcacuccagccuggg

SEQ ID NO: 301725 - RNA, 21 nt, Human
ccacugcacuccagccugggc

SEQ ID NO: 301726 - RNA, 23 nt, Human
ccacugcacuccagccugggcaa

SEQ ID NO: 301727 - RNA, 23 nt, Human
ccaguugggcgugguggcucacg

SEQ ID NO: 301728 - RNA, 22 nt, Human
ccauuugguauguauaaaaaaa

SEQ ID NO: 301729 - RNA, 20 nt, Human
ccccugaaaauacagaugca

SEQ ID NO: 301730 - RNA, 25 nt, Human
ccccugaaaauacagaugcagucgc

SEQ ID NO: 301731 - RNA, 24 nt, Human
ccucacuuuuccccaaguguccaa

SEQ ID NO: 301732 - RNA, 18 nt, Human
ccugagcugcgaagcggg

SEQ ID NO: 301733 - RNA, 22 nt, Human
ccuggccaacauggugaaaccc

SEQ ID NO: 301734 - RNA, 24 nt, Human
ccuggccaacauggugaaacccug

SEQ ID NO: 301735 - RNA, 25 nt, Human
ccugggaggcagagguugcagugag

SEQ ID NO: 301736 - RNA, 22 nt, Human
ccuguaaucccagcacuuuggg

SEQ ID NO: 301737 - RNA, 19 nt, Human
ccuguggucccagcuacuc

SEQ ID NO: 301738 - RNA, 21 nt, Human
ccuguggucccagcuacucag

SEQ ID NO: 301739 - RNA, 24 nt, Human
cgagaccagccuggccaacauggu

SEQ ID NO: 301740 - RNA, 24 nt, Human
cgagguggguggaucgcuugaggu

SEQ ID NO: 301741 - RNA, 26 nt, Human
cgagguggguggaucgcuugagguca

SEQ ID NO: 301742 - RNA, 24 nt, Human
cgccacugcacuccagccugggca

SEQ ID NO: 301743 - RNA, 24 nt, Human
cgccuguggucccagcuacucagg

SEQ ID NO: 301744 - RNA, 22 nt, Human
cggaagaaaaccaaacaggacu

SEQ ID NO: 301745 - RNA, 23 nt, Human
cuaguggauuacaaagagauuuc

SEQ ID NO: 301746 - RNA, 22 nt, Human
cucacgccuguaaucccagcac

SEQ ID NO: 301747 - RNA, 24 nt, Human
cucacgccuguaaucccagcacuu

SEQ ID NO: 301748 - RNA, 22 nt, Human
cucaugaaaagaaugagggcuu

SEQ ID NO: 301749 - RNA, 20 nt, Human
cucuuccccaucccacaaaa

SEQ ID NO: 301750 - RNA, 21 nt, Human
cugaagcuacaguuaacaauc

SEQ ID NO: 301751 - RNA, 22 nt, Human
cugacacuaagaggcgcuuagu

SEQ ID NO: 301752 - RNA, 18 nt, Human
cugcgugugcauucaucc

SEQ ID NO: 301753 - RNA, 24 nt, Human
cuggccaacauggugaaacccugu

SEQ ID NO: 301754 - RNA, 18 nt, Human
cuggucccuuuuaagccu

SEQ ID NO: 301755 - RNA, 24 nt, Human
cuggucccuuuuaagccucauagu

SEQ ID NO: 301756 - RNA, 18 nt, Human
gaacucuccccacucucc

SEQ ID NO: 301757 - RNA, 22 nt, Human
gaacucuccccacucuccacag

SEQ ID NO: 301758 - RNA, 18 nt, Human
gagaaaaacuguuuaaca

SEQ ID NO: 301759 - RNA, 23 nt, Human
gagaaucgcuugaaccugggagg

SEQ ID NO: 301760 - RNA, 21 nt, Human
gagcacugaggcaacuucccu

SEQ ID NO: 301761 - RNA, 23 nt, Human
gagguggguggaucgcuugaggu

SEQ ID NO: 301762 - RNA, 24 nt, Human
gagguggguggaucgcuugagguc

SEQ ID NO: 301763 - RNA, 18 nt, Human
gagguugcagugagccaa

SEQ ID NO: 301764 - RNA, 24 nt, Human
gaucgcuugaggucaggaguucga

SEQ ID NO: 301765 - RNA, 21 nt, Human
gcaaaaagaaacuccaucuaa

SEQ ID NO: 301766 - RNA, 22 nt, Human
gcaaaaagaaacuccaucuaaa

SEQ ID NO: 301767 - RNA, 25 nt, Human
gcacuccagccugggcaaaaagaaa

SEQ ID NO: 301768 - RNA, 24 nt, Human
gcaguucaaacgagcgcacccugc

SEQ ID NO: 301769 - RNA, 24 nt, Human
gccaacauggugaaacccugucuc

SEQ ID NO: 301770 - RNA, 22 nt, Human
gccacugcacuccagccugggc

SEQ ID NO: 301771 - RNA, 24 nt, Human
gccacugcacuccagccugggcaa

SEQ ID NO: 301772 - RNA, 23 nt, Human
gccuguggucccagcuacucagg

SEQ ID NO: 301773 - RNA, 22 nt, Human
gcuggcugccgggcugaggugg

SEQ ID NO: 301774 - RNA, 24 nt, Human
gcuggggacacuggcagaggccug

SEQ ID NO: 301775 - RNA, 24 nt, Human
gcuugaggucaggaguucgagacc

SEQ ID NO: 301776 - RNA, 19 nt, Human
ggagacaagaauaaugcag

SEQ ID NO: 301777 - RNA, 22 nt, Human
ggcaaaaagaaacuccaucuaa

SEQ ID NO: 301778 - RNA, 23 nt, Human
ggcgugguggcucacgccuguaa

SEQ ID NO: 301779 - RNA, 22 nt, Human
ggggguucgaguccccaacccu

SEQ ID NO: 301780 - RNA, 19 nt, Human
gguggaagcagaugucugg

SEQ ID NO: 301781 - RNA, 24 nt, Human
gguggcucacgccuguaaucccag

SEQ ID NO: 301782 - RNA, 24 nt, Human
gguugcagugagccaagauggcgc

SEQ ID NO: 301783 - RNA, 24 nt, Human
gucccaguugggcgugguggcuca

SEQ ID NO: 301784 - RNA, 21 nt, Human
gugaaacccugucucuacuaa

SEQ ID NO: 301785 - RNA, 23 nt, Human
guggcucacgccuguaaucccag

SEQ ID NO: 301786 - RNA, 23 nt, Human
guguccauuucaguggaaacagc

SEQ ID NO: 301787 - RNA, 19 nt, Human
uaaaaagacacaagcaguc

SEQ ID NO: 301788 - RNA, 26 nt, Human
uaaaaagcaguccccaagagaggaca

SEQ ID NO: 301789 - RNA, 27 nt, Human
uaaauaacaacuaaaaucucuucccca

SEQ ID NO: 301790 - RNA, 23 nt, Human
uaaauuaacgaaaaauuaaagug

SEQ ID NO: 301791 - RNA, 19 nt, Human
uaacaccuguguaagcaca

SEQ ID NO: 301792 - RNA, 22 nt, Human
uaacuguaaccuuagaugaaca

SEQ ID NO: 301793 - RNA, 23 nt, Human
uaagccucauagucuugguccaa

SEQ ID NO: 301794 - RNA, 25 nt, Human
uacaaacaaaaccuaugucagacug

SEQ ID NO: 301795 - RNA, 21 nt, Human
uacaaagagauuucaccucca

SEQ ID NO: 301796 - RNA, 18 nt, Human
uauacaaugcaacaugag

SEQ ID NO: 301797 - RNA, 21 nt, Human
uauacaaugcaacaugagguu

SEQ ID NO: 301798 - RNA, 26 nt, Human
uaucauaggcauaggcagcugauguu

SEQ ID NO: 301799 - RNA, 24 nt, Human
uauguauaaaaaaacacucuaccu

SEQ ID NO: 301800 - RNA, 23 nt, Human
uauugcacuggguaaagaaaguu

SEQ ID NO: 301801 - RNA, 19 nt, Human
ucacuacaaacaaaaccua

SEQ ID NO: 301802 - RNA, 19 nt, Human
ucaguggaaacagccauga

SEQ ID NO: 301803 - RNA, 18 nt, Human
uccaagcaccaccuggug

SEQ ID NO: 301804 - RNA, 24 nt, Human
uccaagcaccaccugguguaccuc

SEQ ID NO: 301805 - RNA, 22 nt, Human
uccacauauauauuuuauauau

SEQ ID NO: 301806 - RNA, 21 nt, Human
uccauauuggccaucaugguc

SEQ ID NO: 301807 - RNA, 22 nt, Human
uccaucuaaaaaaaaaaaaaaa

SEQ ID NO: 301808 - RNA, 21 nt, Human
ucccacaaaacuccacauaua

SEQ ID NO: 301809 - RNA, 21 nt, Human
ucccacaaaacuccacauaua

SEQ ID NO: 301810 - RNA, 22 nt, Human
uccccaaguguccaaaugaccu

SEQ ID NO: 301811 - RNA, 23 nt, Human
uccccaucccacaaaacuccaca

SEQ ID NO: 301812 - RNA, 24 nt, Human
uccgagagaggucgggcucaugaa

SEQ ID NO: 301813 - RNA, 19 nt, Human
uccgauggaguuggccaca

SEQ ID NO: 301814 - RNA, 18 nt, Human
ucgcuugaaccugggagg

SEQ ID NO: 301815 - RNA, 20 nt, Human
ucgcuugaggucaggaguuc

SEQ ID NO: 301816 - RNA, 21 nt, Human
ucgggcucaugaaaagaauga

SEQ ID NO: 301817 - RNA, 21 nt, Human
ucuaaaaaaaaaaaaaaaaaa

SEQ ID NO: 301818 - RNA, 24 nt, Human
ucucuacuaaaaauacaaaaaauu

SEQ ID NO: 301819 - RNA, 24 nt, Human
ugaaccugggaggcagagguugca

SEQ ID NO: 301820 - RNA, 20 nt, Human
ugaagaucuuucaucucuuc

SEQ ID NO: 301821 - RNA, 21 nt, Human
ugacuuuagaggcaaggaguu

SEQ ID NO: 301822 - RNA, 21 nt, Human
ugagcacauauuaaaugauaa

SEQ ID NO: 301823 - RNA, 20 nt, Human
ugaggcaggagaaucgcuug

SEQ ID NO: 301824 - RNA, 24 nt, Human
ugaggcaggagaaucgcuugaacc

SEQ ID NO: 301825 - RNA, 24 nt, Human
ugaggcaggagaaucgcuugaacc

SEQ ID NO: 301826 - RNA, 22 nt, Human
ugagggcugugcacccaaccca

SEQ ID NO: 301827 - RNA, 18 nt, Human
ugaugugggcuuggcugg

SEQ ID NO: 301828 - RNA, 19 nt, Human
ugaugugggcuuggcuggg

SEQ ID NO: 301829 - RNA, 18 nt, Human
ugcuggggacacuggcag

SEQ ID NO: 301830 - RNA, 24 nt, Human
uggaguuggccacacaaaccacua

SEQ ID NO: 301831 - RNA, 24 nt, Human
uggaucgcuugaggucaggaguuc

SEQ ID NO: 301832 - RNA, 24 nt, Human
uggcagucgccuguggucccagcu

SEQ ID NO: 301833 - RNA, 24 nt, Human
uggcaucacguaaacaaauucaca

SEQ ID NO: 301834 - RNA, 24 nt, Human
uggccaacauggugaaacccuguc

SEQ ID NO: 301835 - RNA, 22 nt, Human
uggcucacgccuguaaucccag

SEQ ID NO: 301836 - RNA, 24 nt, Human
uggcucacgccuguaaucccagca

SEQ ID NO: 301837 - RNA, 22 nt, Human
uggcugccgggcugaggugggg

SEQ ID NO: 301838 - RNA, 21 nt, Human
uggcuggguggaagcagaugu

SEQ ID NO: 301839 - RNA, 19 nt, Human
ugggaaagcucuggaagcc

SEQ ID NO: 301840 - RNA, 24 nt, Human
ugggaggcagagguugcagugagc

SEQ ID NO: 301841 - RNA, 23 nt, Human
ugggaggccgagguggguggauc

SEQ ID NO: 301842 - RNA, 24 nt, Human
ugggaggccgagguggguggaucg

SEQ ID NO: 301843 - RNA, 19 nt, Human
ugggcucuggaacgaagcu

SEQ ID NO: 301844 - RNA, 24 nt, Human
ugggcucuggaacgaagcuuucgg

SEQ ID NO: 301845 - RNA, 24 nt, Human
uggguggaucgcuugaggucagga

SEQ ID NO: 301846 - RNA, 22 nt, Human
uggucacagccugguuuccuug

SEQ ID NO: 301847 - RNA, 24 nt, Human
ugguggcagucgccugugguccca

SEQ ID NO: 301848 - RNA, 24 nt, Human
ugguggcucacgccuguaauccca

SEQ ID NO: 301849 - RNA, 24 nt, Human
uguaaauuaacgaaaaauuaaagu

SEQ ID NO: 301850 - RNA, 20 nt, Human
uguccaaaugaccuaaaagu

SEQ ID NO: 301851 - RNA, 23 nt, Human
ugugguggcagucgccugugguc

SEQ ID NO: 301852 - RNA, 18 nt, Human
uuacaaagagauuucacc

SEQ ID NO: 301853 - RNA, 19 nt, Human
uuacaaagagauuucaccu

SEQ ID NO: 301854 - RNA, 18 nt, Human
uuagcugggugugguggc

SEQ ID NO: 301855 - RNA, 20 nt, Human
uucaccuccaucaaaaaaca

SEQ ID NO: 301856 - RNA, 24 nt, Human
uugaaccugggaggcagagguugc

SEQ ID NO: 301857 - RNA, 22 nt, Human
uugcagugagccaagauggcgc

SEQ ID NO: 301858 - RNA, 18 nt, Human
uuuaagccucauagucuu

SEQ ID NO: 301859 - RNA, 20 nt, Human
uuuacauaucucuucgggaa

SEQ ID NO: 301860 - RNA, 18 nt, Human
uuuaugaagaauagguuu

SEQ ID NO: 301861 - RNA, 21 nt, Human
uuugcaaagggaagucaccau

SEQ ID NO: 301862 - RNA, 23 nt, Human
aacugugugggagggggcugugg

SEQ ID NO: 301863 - RNA, 18 nt, Human
aagggaagcgagggcugc

SEQ ID NO: 301864 - RNA, 24 nt, Human
aauaacaaaugcucccccuacccu

SEQ ID NO: 301865 - RNA, 18 nt, Human
accaggcaccagcagggc

SEQ ID NO: 301866 - RNA, 21 nt, Human
accaggcaccagcagggcagc

SEQ ID NO: 301867 - RNA, 21 nt, Human
acccugagaaucacgggucca

SEQ ID NO: 301868 - RNA, 24 nt, Human
agcagggcagcuccauccaaggga

SEQ ID NO: 301869 - RNA, 18 nt, Human
agccagagagcaugaggg

SEQ ID NO: 301870 - RNA, 21 nt, Human
aggagaagugacucuggucca

SEQ ID NO: 301871 - RNA, 19 nt, Human
aggaggagaagugacucug

SEQ ID NO: 301872 - RNA, 18 nt, Human
aggggcuggccucagccc

SEQ ID NO: 301873 - RNA, 24 nt, Human
agguccucuggccugccucugcca

SEQ ID NO: 301874 - RNA, 20 nt, Human
aucacagcacccugagaauc

SEQ ID NO: 301875 - RNA, 25 nt, Human
cacacuuagguccucuggccugccu

SEQ ID NO: 301876 - RNA, 22 nt, Human
caccagcagggcagcuccaucc

SEQ ID NO: 301877 - RNA, 18 nt, Human
caccccaucacagcaccc

SEQ ID NO: 301878 - RNA, 26 nt, Human
caccccaucacagcacccugagaauc

SEQ ID NO: 301879 - RNA, 23 nt, Human
cagagaaucaggcugggcacaga

SEQ ID NO: 301880 - RNA, 20 nt, Human
cagaggccucuucucugacc

SEQ ID NO: 301881 - RNA, 19 nt, Human
cagcagggcagcuccaucc

SEQ ID NO: 301882 - RNA, 22 nt, Human
caguagguagggggcugggugg

SEQ ID NO: 301883 - RNA, 21 nt, Human
caucacacuuagguccucugg

SEQ ID NO: 301884 - RNA, 21 nt, Human
ccaggcaccagcagggcagcu

SEQ ID NO: 301885 - RNA, 19 nt, Human
ccaucacagcacccugaga

SEQ ID NO: 301886 - RNA, 20 nt, Human
cccaucacagcacccugaga

SEQ ID NO: 301887 - RNA, 25 nt, Human
cccccuacccucaccccaucacagc

SEQ ID NO: 301888 - RNA, 21 nt, Human
ccucaccccaucacagcaccc

SEQ ID NO: 301889 - RNA, 18 nt, Human
cucaccccaucacagcac

SEQ ID NO: 301890 - RNA, 20 nt, Human
cucccccuacccucacccca

SEQ ID NO: 301891 - RNA, 24 nt, Human
gcuggccucagcccugugaggggc

SEQ ID NO: 301892 - RNA, 25 nt, Human
gcugggcacagaggccucuucucug

SEQ ID NO: 301893 - RNA, 21 nt, Human
ggaggaggagaagugacucug

SEQ ID NO: 301894 - RNA, 18 nt, Human
ggcaguagguagggggcu

SEQ ID NO: 301895 - RNA, 18 nt, Human
ggugggccucugcaccuc

SEQ ID NO: 301896 - RNA, 19 nt, Human
uaacaaaugcucccccuac

SEQ ID NO: 301897 - RNA, 19 nt, Human
uacaggcagcuccacuucc

SEQ ID NO: 301898 - RNA, 22 nt, Human
uacccucaccccaucacagcac

SEQ ID NO: 301899 - RNA, 20 nt, Human
uagguagggggcuggguggg

SEQ ID NO: 301900 - RNA, 22 nt, Human
uagguagggggcugggugggcc

SEQ ID NO: 301901 - RNA, 21 nt, Human
ucagggcuggcuggagaaagg

SEQ ID NO: 301902 - RNA, 18 nt, Human
ucccccuacccucacccc

SEQ ID NO: 301903 - RNA, 24 nt, Human
ucucugaccaggcaccagcagggc

SEQ ID NO: 301904 - RNA, 19 nt, Human
ugaggagccgacuagggcc

SEQ ID NO: 301905 - RNA, 24 nt, Human
ugcuaggggcuggccucagcccug

SEQ ID NO: 301906 - RNA, 21 nt, Human
ugcucccccuacccucacccc

SEQ ID NO: 301907 - RNA, 27 nt, Human
ugggcacagaggccucuucucugaccc

SEQ ID NO: 301908 - RNA, 19 nt, Human
ugggugggccucugcaccu

SEQ ID NO: 301909 - RNA, 25 nt, Human
uguggaaagccaggaugaauggggg

SEQ ID NO: 301910 - RNA, 21 nt, Human
uuaauaacaaaugcucccccu

SEQ ID NO: 301911 - RNA, 19 nt, Human
aggcgggguggcugcuggu

SEQ ID NO: 301912 - RNA, 22 nt, Human
cacuguuuguuguugucccuug

SEQ ID NO: 301913 - RNA, 23 nt, Human
cagccucaccggacccuccugau

SEQ ID NO: 301914 - RNA, 22 nt, Human
caggcgggguggcugcuggucg

SEQ ID NO: 301915 - RNA, 19 nt, Human
cccuugggcaaggggaucc

SEQ ID NO: 301916 - RNA, 25 nt, Human
cugcugcagccucaccggacccucc

SEQ ID NO: 301917 - RNA, 23 nt, Human
gcaggcgggguggcugcuggucg

SEQ ID NO: 301918 - RNA, 21 nt, Human
gcugcagccucaccggacccu

SEQ ID NO: 301919 - RNA, 21 nt, Human
gggcaaggggaucccaaacau

SEQ ID NO: 301920 - RNA, 24 nt, Human
uagagggugagaacacuggugaca

SEQ ID NO: 301921 - RNA, 27 nt, Human
ugagaacacuggugacauuaacgccau

SEQ ID NO: 301922 - RNA, 20 nt, Human
uucacaggauccuguuccca

SEQ ID NO: 301923 - RNA, 23 nt, Human
uuuuuuuuuuuuuuuuuuaacag

SEQ ID NO: 301924 - RNA, 19 nt, Human
aagaaauucauagacacca

SEQ ID NO: 301925 - RNA, 24 nt, Human
aagaagaaauucauagacaccauu

SEQ ID NO: 301926 - RNA, 21 nt, Human
agccaucaaaaaacuuaacag

SEQ ID NO: 301927 - RNA, 23 nt, Human
auuccaagaaauuuaaauuuaau

SEQ ID NO: 301928 - RNA, 25 nt, Human
caaaacagugaagaagcugcuaagc

SEQ ID NO: 301929 - RNA, 26 nt, Human
caaaacagugaagaagcugcuaagca

SEQ ID NO: 301930 - RNA, 22 nt, Human
cacccuagcgccgcaaaggacc

SEQ ID NO: 301931 - RNA, 22 nt, Human
cagugaagaagcugcuaagcau

SEQ ID NO: 301932 - RNA, 21 nt, Human
cccuagcgccgcaaaggaccc

SEQ ID NO: 301933 - RNA, 18 nt, Human
ccggagcgucccucuggg

SEQ ID NO: 301934 - RNA, 26 nt, Human
gagcgucccucuggguucgcccaccc

SEQ ID NO: 301935 - RNA, 23 nt, Human
ggaaauaaaauauggaaucuguu

SEQ ID NO: 301936 - RNA, 23 nt, Human
gucccggagcgucccucuggguu

SEQ ID NO: 301937 - RNA, 23 nt, Human
uaacagaaccaaaucaaaaagaa

SEQ ID NO: 301938 - RNA, 22 nt, Human
uaagaagaaauucauagacacc

SEQ ID NO: 301939 - RNA, 22 nt, Human
uacaacugggaauuccaagaaa

SEQ ID NO: 301940 - RNA, 21 nt, Human
ucccucuggguucgcccaccc

SEQ ID NO: 301941 - RNA, 22 nt, Human
ucccucuggguucgcccacccu

SEQ ID NO: 301942 - RNA, 24 nt, Human
ucucaauccugaucauuacauaau

SEQ ID NO: 301943 - RNA, 23 nt, Human
uggaaucuguuauaaugucccaa

SEQ ID NO: 301944 - RNA, 22 nt, Human
uucgcccacccuagcgccgcaa

SEQ ID NO: 301945 - RNA, 26 nt, Human
aagcgaccuugacguguauugaaggu

SEQ ID NO: 301946 - RNA, 21 nt, Human
acccgccagccuccgugcccc

SEQ ID NO: 301947 - RNA, 25 nt, Human
accuggcucgugagugcgucugggu

SEQ ID NO: 301948 - RNA, 19 nt, Human
acucauucaguccauugcc

SEQ ID NO: 301949 - RNA, 18 nt, Human
acucccguagaggucauc

SEQ ID NO: 301950 - RNA, 22 nt, Human
agccuccgugccccaccccacc

SEQ ID NO: 301951 - RNA, 19 nt, Human
aggccccccaggagagggc

SEQ ID NO: 301952 - RNA, 18 nt, Human
aggugcuggccuugguug

SEQ ID NO: 301953 - RNA, 24 nt, Human
augcaguuuugaaaaccuggaaac

SEQ ID NO: 301954 - RNA, 18 nt, Human
augguuuggggaagggag

SEQ ID NO: 301955 - RNA, 26 nt, Human
caacccgccagccuccgugccccacc

SEQ ID NO: 301956 - RNA, 19 nt, Human
caaguccugggggaugugc

SEQ ID NO: 301957 - RNA, 27 nt, Human
cacccagcacgcacucauucaguccau

SEQ ID NO: 301958 - RNA, 21 nt, Human
cagccuccgugccccacccca

SEQ ID NO: 301959 - RNA, 23 nt, Human
cagccuccgugccccaccccacc

SEQ ID NO: 301960 - RNA, 18 nt, Human
cagcgccgccucccaugg

SEQ ID NO: 301961 - RNA, 22 nt, Human
caggcgccccucccagggcuga

SEQ ID NO: 301962 - RNA, 19 nt, Human
caugacaaaaaacugagag

SEQ ID NO: 301963 - RNA, 19 nt, Human
ccagccuccgugccccacc

SEQ ID NO: 301964 - RNA, 23 nt, Human
cccagggcugagaaagcgcagcc

SEQ ID NO: 301965 - RNA, 22 nt, Human
cccauggggccguggggcugcu

SEQ ID NO: 301966 - RNA, 22 nt, Human
ccccaccccacccagcacgcac

SEQ ID NO: 301967 - RNA, 21 nt, Human
cccccauacccccaggaccug

SEQ ID NO: 301968 - RNA, 22 nt, Human
cccgagcagccacgccggccac

SEQ ID NO: 301969 - RNA, 20 nt, Human
ccuaccagguugggguuagg

SEQ ID NO: 301970 - RNA, 20 nt, Human
ccuggcagcccccauacccc

SEQ ID NO: 301971 - RNA, 19 nt, Human
cgccccuggcagcccccau

SEQ ID NO: 301972 - RNA, 18 nt, Human
cuaaaaucccguccaaau

SEQ ID NO: 301973 - RNA, 23 nt, Human
cuacuucugaauuacuucucaac

SEQ ID NO: 301974 - RNA, 24 nt, Human
cucacugcacuggcugaagcaacc

SEQ ID NO: 301975 - RNA, 18 nt, Human
cucgugagugcgucuggg

SEQ ID NO: 301976 - RNA, 18 nt, Human
cucugcccagccgcccuc

SEQ ID NO: 301977 - RNA, 25 nt, Human
cugaauuacuucucaacuguauggu

SEQ ID NO: 301978 - RNA, 23 nt, Human
cugagaaagcgcagccagggaca

SEQ ID NO: 301979 - RNA, 22 nt, Human
cuggggccgagcugaggggcug

SEQ ID NO: 301980 - RNA, 18 nt, Human
gaaagcgcagccagggac

SEQ ID NO: 301981 - RNA, 20 nt, Human
gaaggugugugugccaaaug

SEQ ID NO: 301982 - RNA, 21 nt, Human
gagagcagcgccgccucccau

SEQ ID NO: 301983 - RNA, 20 nt, Human
gaggcgggaaauaggcuggg

SEQ ID NO: 301984 - RNA, 25 nt, Human
gauuucuguuuucuaaaacuggaag

SEQ ID NO: 301985 - RNA, 21 nt, Human
gcccagacgggcgagaacuga

SEQ ID NO: 301986 - RNA, 27 nt, Human
gccgagcugaggggcugaacacagcag

SEQ ID NO: 301987 - RNA, 18 nt, Human
ggaugugcucugcccagc

SEQ ID NO: 301988 - RNA, 23 nt, Human
ggcuggggccgagcugaggggcu

SEQ ID NO: 301989 - RNA, 23 nt, Human
ucaaauggaggcgggaaauaggc

SEQ ID NO: 301990 - RNA, 26 nt, Human
ucaguccauugccuuaacacaagccu

SEQ ID NO: 301991 - RNA, 23 nt, Human
ucccauggggccguggggcugcu

SEQ ID NO: 301992 - RNA, 22 nt, Human
ucgccugcccagcaggcccccc

SEQ ID NO: 301993 - RNA, 20 nt, Human
ucuaaaacuggaagcgaccu

SEQ ID NO: 301994 - RNA, 19 nt, Human
ucuucuggccuacuucuga

SEQ ID NO: 301995 - RNA, 20 nt, Human
ugaagcaacccgccagccuc

SEQ ID NO: 301996 - RNA, 19 nt, Human
ugagaugcagauuucuguu

SEQ ID NO: 301997 - RNA, 20 nt, Human
ugagaugcagauuucuguuu

SEQ ID NO: 301998 - RNA, 21 nt, Human
ugaggggcugaacacagcagu

SEQ ID NO: 301999 - RNA, 27 nt, Human
ugccccaccccacccagcacgcacuca

SEQ ID NO: 302000 - RNA, 19 nt, Human
uggcagcccccauaccccc

SEQ ID NO: 302001 - RNA, 18 nt, Human
uggcugaguccuaccagg

SEQ ID NO: 302002 - RNA, 19 nt, Human
uucaguccauugccuuaac

SEQ ID NO: 302003 - RNA, 19 nt, Human
uugaaaaccuggaaacauc

SEQ ID NO: 302004 - RNA, 24 nt, Human
uugguuucucucugccccgugugg

SEQ ID NO: 302005 - RNA, 20 nt, Human
uuuuuuuuuuuuuuugcugg

SEQ ID NO: 302006 - RNA, 19 nt, Human
aaaacaccugaaauagcca

SEQ ID NO: 302007 - RNA, 22 nt, Human
aacugcaggcaaacaugaaaga

SEQ ID NO: 302008 - RNA, 20 nt, Human
caaaacaccugaaauagcca

SEQ ID NO: 302009 - RNA, 22 nt, Human
cagcaaaacaccugaaauagcc

SEQ ID NO: 302010 - RNA, 18 nt, Human
ccucucggcucccgcucc

SEQ ID NO: 302011 - RNA, 20 nt, Human
cuccucucggcucccgcucc

SEQ ID NO: 302012 - RNA, 19 nt, Human
uagccaauaacaaauguuu

SEQ ID NO: 302013 - RNA, 23 nt, Human
uauuguucaacugcaggcaaaca

SEQ ID NO: 302014 - RNA, 21 nt, Human
ugcaggcaaacaugaaagaua

SEQ ID NO: 302015 - RNA, 22 nt, Human
uguguaacuuuaauaauuucua

SEQ ID NO: 302016 - RNA, 19 nt, Human
aagcugcccucccagggcc

SEQ ID NO: 302017 - RNA, 22 nt, Human
aagugugacuccccacacugcc

SEQ ID NO: 302018 - RNA, 22 nt, Human
agaggaggccagguggacagaa

SEQ ID NO: 302019 - RNA, 21 nt, Human
agagggaggcaggguauggcc

SEQ ID NO: 302020 - RNA, 25 nt, Human
agcucugcccccuaccugggcucca

SEQ ID NO: 302021 - RNA, 23 nt, Human
agcucuggccaugcgugguguca

SEQ ID NO: 302022 - RNA, 20 nt, Human
aggcagcugggccuggggcu

SEQ ID NO: 302023 - RNA, 23 nt, Human
aggcagcugggccuggggcuggg

SEQ ID NO: 302024 - RNA, 22 nt, Human
aggcgagaggaggccaggugga

SEQ ID NO: 302025 - RNA, 21 nt, Human
aggcuucgcugccuucagccu

SEQ ID NO: 302026 - RNA, 20 nt, Human
agggggcuggggaggggcuu

SEQ ID NO: 302027 - RNA, 27 nt, Human
auuugucugggaggacgacggggcaug

SEQ ID NO: 302028 - RNA, 24 nt, Human
cagcugaggacagcucugcccccu

SEQ ID NO: 302029 - RNA, 19 nt, Human
caggccgcagugcagcuga

SEQ ID NO: 302030 - RNA, 18 nt, Human
ccacacugccaccaggcc

SEQ ID NO: 302031 - RNA, 26 nt, Human
ccaggccgcagugcagcugaggacag

SEQ ID NO: 302032 - RNA, 23 nt, Human
ccagggagggagggggauggcag

SEQ ID NO: 302033 - RNA, 21 nt, Human
ccagggccgggcccagggagg

SEQ ID NO: 302034 - RNA, 21 nt, Human
cccagggccagagagggaggc

SEQ ID NO: 302035 - RNA, 19 nt, Human
ccccgaggcuucgcugccu

SEQ ID NO: 302036 - RNA, 19 nt, Human
ccgcugggcgagguuucuc

SEQ ID NO: 302037 - RNA, 26 nt, Human
ccuggggcuggggcuggggcuggggc

SEQ ID NO: 302038 - RNA, 22 nt, Human
cgggagagggggcuggggaggg

SEQ ID NO: 302039 - RNA, 18 nt, Human
cggguccagggccgggcc

SEQ ID NO: 302040 - RNA, 26 nt, Human
cgguagucaagacacucagcaaacac

SEQ ID NO: 302041 - RNA, 28 nt, Human
cgguagucaagacacucagcaaacacac

SEQ ID NO: 302042 - RNA, 19 nt, Human
cuccuccggagugagcccc

SEQ ID NO: 302043 - RNA, 22 nt, Human
cugacuugagaucaaagccaaa

SEQ ID NO: 302044 - RNA, 21 nt, Human
cugccuucagccugacuugag

SEQ ID NO: 302045 - RNA, 20 nt, Human
cugggccuggggcuggggcu

SEQ ID NO: 302046 - RNA, 22 nt, Human
gaggggcuugggccccgaggcu

SEQ ID NO: 302047 - RNA, 28 nt, Human
gagugggguuggggcugggugcuggagc

SEQ ID NO: 302048 - RNA, 21 nt, Human
gcagcugaggacagcucugcc

SEQ ID NO: 302049 - RNA, 22 nt, Human
gcaguagggacgcuagcucugg

SEQ ID NO: 302050 - RNA, 19 nt, Human
gcugaaccauuacacggca

SEQ ID NO: 302051 - RNA, 20 nt, Human
gcugcccucccagggccaga

SEQ ID NO: 302052 - RNA, 20 nt, Human
ggagagggggcuggggaggg

SEQ ID NO: 302053 - RNA, 18 nt, Human
ggagugagcccccaucuc

SEQ ID NO: 302054 - RNA, 19 nt, Human
ggauggcagacaccagagg

SEQ ID NO: 302055 - RNA, 24 nt, Human
ggccaggcgagaggaggccagguu

SEQ ID NO: 302056 - RNA, 23 nt, Human
ggccuggggcuggggcuggggcu

SEQ ID NO: 302057 - RNA, 20 nt, Human
ggcuggggaggggcuugggc

SEQ ID NO: 302058 - RNA, 19 nt, Human
ggcuggggcuggggcuggc

SEQ ID NO: 302059 - RNA, 20 nt, Human
gggccuggggcuggggcugg

SEQ ID NO: 302060 - RNA, 25 nt, Human
gggcuggggacaggcaccugacggg

SEQ ID NO: 302061 - RNA, 22 nt, Human
gggcuggggcuggggcuggggc

SEQ ID NO: 302062 - RNA, 23 nt, Human
gggcuggggcuggggcuggggcu

SEQ ID NO: 302063 - RNA, 21 nt, Human
gggcuugggccccgaggcuuc

SEQ ID NO: 302064 - RNA, 26 nt, Human
gguccagggccgggcccagggaggga

SEQ ID NO: 302065 - RNA, 19 nt, Human
uaccugggcuccaagcugc

SEQ ID NO: 302066 - RNA, 20 nt, Human
uaccugggcuccaagcugcc

SEQ ID NO: 302067 - RNA, 19 nt, Human
uagucaagacacucagcaa

SEQ ID NO: 302068 - RNA, 19 nt, Human
ucacgguagucaagacacu

SEQ ID NO: 302069 - RNA, 22 nt, Human
uccccacacugccaccaggccg

SEQ ID NO: 302070 - RNA, 20 nt, Human
uccuccggagugagccccca

SEQ ID NO: 302071 - RNA, 19 nt, Human
ucgcugccuucagccugac

SEQ ID NO: 302072 - RNA, 22 nt, Human
ucgcugccuucagccugacuug

SEQ ID NO: 302073 - RNA, 24 nt, Human
ugacuccccacacugccaccucac

SEQ ID NO: 302074 - RNA, 21 nt, Human
ugggcuccaagcugcccuccc

SEQ ID NO: 302075 - RNA, 24 nt, Human
uggggcuggggacaggcaccugac

SEQ ID NO: 302076 - RNA, 20 nt, Human
ugucacgguagucaagacac

SEQ ID NO: 302077 - RNA, 23 nt, Human
uugagaucaaagccaaaggcagc

SEQ ID NO: 302078 - RNA, 22 nt, Human
acagauuuuuccucaguauuaa

SEQ ID NO: 302079 - RNA, 23 nt, Human
accuuaaaaaauauagugaagaa

SEQ ID NO: 302080 - RNA, 24 nt, Human
auuuacccaguguauuuuaaaaag

SEQ ID NO: 302081 - RNA, 23 nt, Human
caauauguaacuuucuaaggcuu

SEQ ID NO: 302082 - RNA, 19 nt, Human
cacauccuagaccuauguc

SEQ ID NO: 302083 - RNA, 20 nt, Human
caccauuuccauaagaauaa

SEQ ID NO: 302084 - RNA, 26 nt, Human
cacuucuguuuacagcagucuaggga

SEQ ID NO: 302085 - RNA, 21 nt, Human
cagauuuuuccucaguauuaa

SEQ ID NO: 302086 - RNA, 22 nt, Human
cguguauauauauaugcccaca

SEQ ID NO: 302087 - RNA, 19 nt, Human
gcauuuugauaacaaacug

SEQ ID NO: 302088 - RNA, 22 nt, Human
ggugugggcugacuagggguga

SEQ ID NO: 302089 - RNA, 19 nt, Human
guauauauauaugcccaca

SEQ ID NO: 302090 - RNA, 20 nt, Human
guuguuggaauucaccauuu

SEQ ID NO: 302091 - RNA, 21 nt, Human
uaaaaaaguccuccaucaagg

SEQ ID NO: 302092 - RNA, 26 nt, Human
uaaaaaauauagugaagaaauagcaa

SEQ ID NO: 302093 - RNA, 31 nt, Human
uaaaaaauauagugaagaaauagcaaagaag

SEQ ID NO: 302094 - RNA, 20 nt, Human
uagccucuaaaccaauaugu

SEQ ID NO: 302095 - RNA, 18 nt, Human
uaggggugugggcugacu

SEQ ID NO: 302096 - RNA, 20 nt, Human
uaugaaaugaagacuuuuau

SEQ ID NO: 302097 - RNA, 18 nt, Human
uccaaacuucacacaucc

SEQ ID NO: 302098 - RNA, 23 nt, Human
uccaaacuucacacauccuagac

SEQ ID NO: 302099 - RNA, 23 nt, Human
ugaagaaauagcaaagaacauag

SEQ ID NO: 302100 - RNA, 19 nt, Human
ugcacguguauauauauau

SEQ ID NO: 302101 - RNA, 24 nt, Human
ugguaaaguacacugaauuuugua

SEQ ID NO: 302102 - RNA, 19 nt, Human
uguauuuauauauauauau

SEQ ID NO: 302103 - RNA, 24 nt, Human
uguauuuauauauauauauaugua

SEQ ID NO: 302104 - RNA, 23 nt, Human
uuuaaaaaguaaaugaaucccac

SEQ ID NO: 302105 - RNA, 22 nt, Human
uuuacagcagucuagggaacau

SEQ ID NO: 302106 - RNA, 19 nt, Human
uuuauauauauauauaugu

SEQ ID NO: 302107 - RNA, 22 nt, Human
uuuccauaagaauaaaaaaguc

SEQ ID NO: 302108 - RNA, 23 nt, Human
uuugaaagguagcuggagaaaag

SEQ ID NO: 302109 - RNA, 21 nt, Human
uuuuuuuuuuuuuuuuacuaa

SEQ ID NO: 302110 - RNA, 20 nt, Human
aacuagcccucucagggccc

SEQ ID NO: 302111 - RNA, 21 nt, Human
agcggggucccagacccuggg

SEQ ID NO: 302112 - RNA, 20 nt, Human
cagaacccaaggcccuggcc

SEQ ID NO: 302113 - RNA, 20 nt, Human
cagaucucucugugggcuau

SEQ ID NO: 302114 - RNA, 19 nt, Human
cagcagccugaggaggagc

SEQ ID NO: 302115 - RNA, 19 nt, Human
cagcagccugaggaggagc

SEQ ID NO: 302116 - RNA, 22 nt, Human
ccacagaacuagcccucucagg

SEQ ID NO: 302117 - RNA, 24 nt, Human
ccccagaacccaaggcccuggccc

SEQ ID NO: 302118 - RNA, 24 nt, Human
ccugcagccaugcugagcgggguc

SEQ ID NO: 302119 - RNA, 25 nt, Human
ccuggcccucuuccugguccccugg

SEQ ID NO: 302120 - RNA, 19 nt, Human
cugagcggggucccagacc

SEQ ID NO: 302121 - RNA, 23 nt, Human
gcggggucccagacccugggggg

SEQ ID NO: 302122 - RNA, 23 nt, Human
gcugcugucucaaugccacuuug

SEQ ID NO: 302123 - RNA, 21 nt, Human
ggagggagguggccuccaggu

SEQ ID NO: 302124 - RNA, 20 nt, Human
ggagguggccuccagguggg

SEQ ID NO: 302125 - RNA, 21 nt, Human
gggagguggccuccagguggg

SEQ ID NO: 302126 - RNA, 20 nt, Human
gggccuuucucuuagagccg

SEQ ID NO: 302127 - RNA, 20 nt, Human
ucccagacccuggggggcuc

SEQ ID NO: 302128 - RNA, 24 nt, Human
uccuggagggagguggccuccagg

SEQ ID NO: 302129 - RNA, 23 nt, Human
ucucaaugccacuuugcacccug

SEQ ID NO: 302130 - RNA, 19 nt, Human
ucucugugggcuaucaagg

SEQ ID NO: 302131 - RNA, 20 nt, Human
uggaaggaggggcaaguagg

SEQ ID NO: 302132 - RNA, 19 nt, Human
uggagggagguggccucca

SEQ ID NO: 302133 - RNA, 19 nt, Human
uucccagaucucucugugg

SEQ ID NO: 302134 - RNA, 19 nt, Human
uuccugaguagaugggccu

SEQ ID NO: 302135 - RNA, 18 nt, Human
uuuuuuuuuuagggggcg

SEQ ID NO: 302136 - RNA, 19 nt, Human
uuuuuuuuuuuuagggggc

SEQ ID NO: 302137 - RNA, 22 nt, Human
uuuuuuuuuuuuuuuuuuaggg

SEQ ID NO: 302138 - RNA, 23 nt, Human
aagccguuccgagucggaggcac

SEQ ID NO: 302139 - RNA, 24 nt, Human
agcauauaaaagcauaaugucuau

SEQ ID NO: 302140 - RNA, 23 nt, Human
auagcauauaaaagcauaauguc

SEQ ID NO: 302141 - RNA, 21 nt, Human
caacauccucuguuucugacc

SEQ ID NO: 302142 - RNA, 21 nt, Human
ccaggguaaauuggaaagauu

SEQ ID NO: 302143 - RNA, 20 nt, Human
cccccggcccucgcugcccc

SEQ ID NO: 302144 - RNA, 20 nt, Human
cccgccgcccccggcccucg

SEQ ID NO: 302145 - RNA, 21 nt, Human
cccggcccucgcugccccggc

SEQ ID NO: 302146 - RNA, 20 nt, Human
ccgcccgccgcccccggccc

SEQ ID NO: 302147 - RNA, 25 nt, Human
ccgccgcccccggcccucgcugccc

SEQ ID NO: 302148 - RNA, 23 nt, Human
gacuacauuuuaauagauacuac

SEQ ID NO: 302149 - RNA, 24 nt, Human
ucagcucccucaaaacugauucca

SEQ ID NO: 302150 - RNA, 27 nt, Human
ucagcucccucaaaacugauuccaggg

SEQ ID NO: 302151 - RNA, 22 nt, Human
aacacaaauaucagaaguuucu

SEQ ID NO: 302152 - RNA, 22 nt, Human
auaacacaaauaucagaaguuu

SEQ ID NO: 302153 - RNA, 20 nt, Human
caaaugcacacacguaggca

SEQ ID NO: 302154 - RNA, 23 nt, Human
cauaaggauaacacaaauaucag

SEQ ID NO: 302155 - RNA, 25 nt, Human
cuauauagcaaaugcacacacguag

SEQ ID NO: 302156 - RNA, 18 nt, Human
uaaggauaacacaaauau

SEQ ID NO: 302157 - RNA, 21 nt, Human
aaaucagucuuuauuaaacca

SEQ ID NO: 302158 - RNA, 19 nt, Human
aaaugaacaaauauguauc

SEQ ID NO: 302159 - RNA, 24 nt, Human
aacaaaaucagucuuuauuaaacc

SEQ ID NO: 302160 - RNA, 27 nt, Human
aagaaggauaauacaaacaucagaaga

SEQ ID NO: 302161 - RNA, 25 nt, Human
cagugcgcagggaaagucgggcugg

SEQ ID NO: 302162 - RNA, 24 nt, Human
cauaaaugaacaaauauguaucag

SEQ ID NO: 302163 - RNA, 20 nt, Human
cuuuuugcuuaaaauucugg

SEQ ID NO: 302164 - RNA, 24 nt, Human
gaacaaauauguaucagcuaacau

SEQ ID NO: 302165 - RNA, 20 nt, Human
gaaggauaauacaaacauca

SEQ ID NO: 302166 - RNA, 24 nt, Human
uaagaaauagauugacuauaccac

SEQ ID NO: 302167 - RNA, 24 nt, Human
uuaagagcuacuaauauuuauugg

SEQ ID NO: 302168 - RNA, 20 nt, Human
acugcccccugcaccucuac

SEQ ID NO: 302169 - RNA, 20 nt, Human
aggagcgugcagcaacuucc

SEQ ID NO: 302170 - RNA, 19 nt, Human
agggggcucagaguggagg

SEQ ID NO: 302171 - RNA, 22 nt, Human
caccccugagccucaguuuccc

SEQ ID NO: 302172 - RNA, 23 nt, Human
caccucuaccagagaggaggucc

SEQ ID NO: 302173 - RNA, 19 nt, Human
ccagagaggaggucccgcu

SEQ ID NO: 302174 - RNA, 18 nt, Human
cccccugcaccucuacca

SEQ ID NO: 302175 - RNA, 24 nt, Human
cccugcaccucuaccagagaggag

SEQ ID NO: 302176 - RNA, 25 nt, Human
cuaacauaaugacggggucaaccuc

SEQ ID NO: 302177 - RNA, 20 nt, Human
gaaaaugcauaaucucuaac

SEQ ID NO: 302178 - RNA, 19 nt, Human
gagccucaguuucccuaug

SEQ ID NO: 302179 - RNA, 19 nt, Human
gccgugugaccuuggguga

SEQ ID NO: 302180 - RNA, 19 nt, Human
ggguugauaggcucccaga

SEQ ID NO: 302181 - RNA, 22 nt, Human
guacugcccccugcaccucuac

SEQ ID NO: 302182 - RNA, 22 nt, Human
gugaagugagugugcggugcuc

SEQ ID NO: 302183 - RNA, 24 nt, Human
uaacauaaugacggggucaaccuc

SEQ ID NO: 302184 - RNA, 21 nt, Human
uaggagcgugcagcaacuucc

SEQ ID NO: 302185 - RNA, 18 nt, Human
ucccagaggaaauggagc

SEQ ID NO: 302186 - RNA, 25 nt, Human
ucuaccagagaggaggucgucccgg

SEQ ID NO: 302187 - RNA, 24 nt, Human
ugaaccagggugaagugagugugc

SEQ ID NO: 302188 - RNA, 22 nt, Human
ugaguacugcccccugcaccuc

SEQ ID NO: 302189 - RNA, 20 nt, Human
uggaaaaugcauaaucucua

SEQ ID NO: 302190 - RNA, 18 nt, Human
aaaguuuccuccagagcu

SEQ ID NO: 302191 - RNA, 20 nt, Human
aagguggaaggcgaugagga

SEQ ID NO: 302192 - RNA, 22 nt, Human
agaaaguuuccuccagagcuag

SEQ ID NO: 302193 - RNA, 21 nt, Human
aggccaaggcagaguaggaga

SEQ ID NO: 302194 - RNA, 24 nt, Human
augaggacacaggcaguuugacuu

SEQ ID NO: 302195 - RNA, 22 nt, Human
cagaguaggagaagagcaaaga

SEQ ID NO: 302196 - RNA, 19 nt, Human
caguaagucuuuauucguc

SEQ ID NO: 302197 - RNA, 19 nt, Human
cagugaggccaaggcagag

SEQ ID NO: 302198 - RNA, 25 nt, Human
ccucuuguaggcaguaagucuuuau

SEQ ID NO: 302199 - RNA, 23 nt, Human
gaugaggacacaggcaguuugac

SEQ ID NO: 302200 - RNA, 20 nt, Human
ggaggacuucuucacuggaa

SEQ ID NO: 302201 - RNA, 24 nt, Human
ggcagaguaggagaagagcaaaga

SEQ ID NO: 302202 - RNA, 20 nt, Human
uaagaaagaaaguuuccucc

SEQ ID NO: 302203 - RNA, 24 nt, Human
ucacuuccuaucuuacuaccuguc

SEQ ID NO: 302204 - RNA, 19 nt, Human
ugcggccagcaagcgaggc

SEQ ID NO: 302205 - RNA, 24 nt, Human
uggaaguggggugccucagugagg

SEQ ID NO: 302206 - RNA, 20 nt, Human
uugcggccagcaagcgaggc

SEQ ID NO: 302207 - RNA, 19 nt, Human
aacaugaggacauuaguga

SEQ ID NO: 302208 - RNA, 19 nt, Human
aauuugcacacauaaccuc

SEQ ID NO: 302209 - RNA, 26 nt, Human
agacaaaagugaaggaaaagggaccc

SEQ ID NO: 302210 - RNA, 23 nt, Human
agacaccagggaacagagagaag

SEQ ID NO: 302211 - RNA, 18 nt, Human
aggccagggcuggaggga

SEQ ID NO: 302212 - RNA, 21 nt, Human
agggcaggaggccagggcugg

SEQ ID NO: 302213 - RNA, 21 nt, Human
aggggacaugaaaguggggga

SEQ ID NO: 302214 - RNA, 26 nt, Human
caccacaaugccaugcauuacacugg

SEQ ID NO: 302215 - RNA, 23 nt, Human
ccacaaugccaugcauuacacug

SEQ ID NO: 302216 - RNA, 18 nt, Human
ccccaacacuucaccaac

SEQ ID NO: 302217 - RNA, 20 nt, Human
ccccaagggcguguaucuuu

SEQ ID NO: 302218 - RNA, 23 nt, Human
cccgcccuccaucccccaacacc

SEQ ID NO: 302219 - RNA, 21 nt, Human
ccuccuccuccagaucauccc

SEQ ID NO: 302220 - RNA, 21 nt, Human
cuacgaucucuccuaagaucc

SEQ ID NO: 302221 - RNA, 25 nt, Human
cuuggccccggcgccugcccuguaa

SEQ ID NO: 302222 - RNA, 21 nt, Human
gacugcucacccgcccuccau

SEQ ID NO: 302223 - RNA, 21 nt, Human
gggcaggaggccagggcugga

SEQ ID NO: 302224 - RNA, 23 nt, Human
uaacugggccagacuugucucuu

SEQ ID NO: 302225 - RNA, 22 nt, Human
uaaggagugugaggaaaacaca

SEQ ID NO: 302226 - RNA, 18 nt, Human
uacaccaccggaaugcug

SEQ ID NO: 302227 - RNA, 20 nt, Human
uagacagacaccacaaugcc

SEQ ID NO: 302228 - RNA, 25 nt, Human
uagacagacaccacaaugccaugca

SEQ ID NO: 302229 - RNA, 22 nt, Human
ucccucccugccuuggccccgg

SEQ ID NO: 302230 - RNA, 21 nt, Human
uccuaagaucccucccugccu

SEQ ID NO: 302231 - RNA, 24 nt, Human
uccuaagaucccucccugccuugg

SEQ ID NO: 302232 - RNA, 24 nt, Human
ugaagacaccagggaacuggagac

SEQ ID NO: 302233 - RNA, 18 nt, Human
ugaaggaaaaauagacuu

SEQ ID NO: 302234 - RNA, 26 nt, Human
ugcucacccgcccuccaucccccaac

SEQ ID NO: 302235 - RNA, 23 nt, Human
uguaucuuuuuccuccuccucca

SEQ ID NO: 302236 - RNA, 21 nt, Human
uuacacuggacaauccagagg

SEQ ID NO: 302237 - RNA, 22 nt, Human
uuccuuccuagacagacaccac

SEQ ID NO: 302238 - RNA, 25 nt, Human
uuuuccuccuccuccagaucauccc

SEQ ID NO: 302239 - RNA, 20 nt, Human
aaaaagugcaaaagccagca

SEQ ID NO: 302240 - RNA, 20 nt, Human
aaaacagcacagugucccca

SEQ ID NO: 302241 - RNA, 22 nt, Human
aaacaaaacagcacaguguccc

SEQ ID NO: 302242 - RNA, 20 nt, Human
aacccaacaccuguccaagu

SEQ ID NO: 302243 - RNA, 24 nt, Human
aagaggccucaacccaacaccugu

SEQ ID NO: 302244 - RNA, 18 nt, Human
aagccccccagggcaaga

SEQ ID NO: 302245 - RNA, 24 nt, Human
aagcugcagaaauggaaauggaau

SEQ ID NO: 302246 - RNA, 23 nt, Human
aaggcagggcgccagggacccac

SEQ ID NO: 302247 - RNA, 21 nt, Human
acaaaacagcacagugucccc

SEQ ID NO: 302248 - RNA, 24 nt, Human
accaguguggucuucccagcucca

SEQ ID NO: 302249 - RNA, 27 nt, Human
aggcagggcgccagggacccacguggu

SEQ ID NO: 302250 - RNA, 27 nt, Human
aggcgucuucccaggucaagaugcacc

SEQ ID NO: 302251 - RNA, 21 nt, Human
aggcucccccgcugcuccacc

SEQ ID NO: 302252 - RNA, 22 nt, Human
aggcucccccgcugcuccaccc

SEQ ID NO: 302253 - RNA, 19 nt, Human
agggacuuccugcagaaga

SEQ ID NO: 302254 - RNA, 22 nt, Human
aggguagcgaggcuggggaugc

SEQ ID NO: 302255 - RNA, 21 nt, Human
auggaauggaaccgacacguc

SEQ ID NO: 302256 - RNA, 21 nt, Human
caaaauacuucccucuccccg

SEQ ID NO: 302257 - RNA, 22 nt, Human
caagaugcaccaaacagucacg

SEQ ID NO: 302258 - RNA, 19 nt, Human
caagcuaagcugcagaaau

SEQ ID NO: 302259 - RNA, 25 nt, Human
cacagaaacgaaacaaaacagcaca

SEQ ID NO: 302260 - RNA, 24 nt, Human
caccaggcccugcugcucgccucc

SEQ ID NO: 302261 - RNA, 23 nt, Human
cacccagccaacuugcgucucag

SEQ ID NO: 302262 - RNA, 22 nt, Human
caccuguccaaguucguuccca

SEQ ID NO: 302263 - RNA, 18 nt, Human
cacucaucacccucccaa

SEQ ID NO: 302264 - RNA, 18 nt, Human
cagaaauggaaauggaau

SEQ ID NO: 302265 - RNA, 18 nt, Human
cagaagaggccucaaccc

SEQ ID NO: 302266 - RNA, 19 nt, Human
cagagguuccaagcccccc

SEQ ID NO: 302267 - RNA, 22 nt, Human
caggacacaagcuaagcugcag

SEQ ID NO: 302268 - RNA, 25 nt, Human
cagggacuuccugcagaagaggccu

SEQ ID NO: 302269 - RNA, 19 nt, Human
cagggcaagacaccccaac

SEQ ID NO: 302270 - RNA, 20 nt, Human
caucaaaaaagugcaaaagc

SEQ ID NO: 302271 - RNA, 20 nt, Human
caucaaaaaagugcaaaagc

SEQ ID NO: 302272 - RNA, 20 nt, Human
cauuccuaggaaacccagag

SEQ ID NO: 302273 - RNA, 25 nt, Human
ccaacaccuguccaaguucguuccc

SEQ ID NO: 302274 - RNA, 21 nt, Human
ccaccccacccucuccggaag

SEQ ID NO: 302275 - RNA, 24 nt, Human
ccagcggccuccugucaggaccag

SEQ ID NO: 302276 - RNA, 21 nt, Human
ccccccagggcaagacacccc

SEQ ID NO: 302277 - RNA, 23 nt, Human
ccccccagggcaagacaccccaa

SEQ ID NO: 302278 - RNA, 22 nt, Human
cccugcugcucgccuccucucc

SEQ ID NO: 302279 - RNA, 23 nt, Human
cccuggagcucccugggagcagg

SEQ ID NO: 302280 - RNA, 19 nt, Human
ccgcgcucucgccaccagg

SEQ ID NO: 302281 - RNA, 18 nt, Human
ccggaagaaguccucagg

SEQ ID NO: 302282 - RNA, 22 nt, Human
ccucccaaggcuuugugaaggu

SEQ ID NO: 302283 - RNA, 23 nt, Human
cgaaacaaaacagcacagugucc

SEQ ID NO: 302284 - RNA, 25 nt, Human
cgaaacaaaacagcacagugucccc

SEQ ID NO: 302285 - RNA, 19 nt, Human
cgaggcuggggaugcccgg

SEQ ID NO: 302286 - RNA, 26 nt, Human
cgcggccgggcguuuccugcgcugcc

SEQ ID NO: 302287 - RNA, 22 nt, Human
cgcugcuccaccccacccucuc

SEQ ID NO: 302288 - RNA, 20 nt, Human
cggaacaaaggaggagaggg

SEQ ID NO: 302289 - RNA, 19 nt, Human
cggaccacccagccaacuu

SEQ ID NO: 302290 - RNA, 24 nt, Human
cgguaaugcaagugcuggggaagg

SEQ ID NO: 302291 - RNA, 22 nt, Human
cuaaaggcagggcgccagggac

SEQ ID NO: 302292 - RNA, 22 nt, Human
cucccccgcugcuccaccccac

SEQ ID NO: 302293 - RNA, 20 nt, Human
cuccggaagaaguccucagg

SEQ ID NO: 302294 - RNA, 18 nt, Human
cuggggaaggaugccagg

SEQ ID NO: 302295 - RNA, 23 nt, Human
cuuugggcuaaguuccggacccu

SEQ ID NO: 302296 - RNA, 20 nt, Human
gaacaaaggaggagaggggg

SEQ ID NO: 302297 - RNA, 22 nt, Human
gacacaagcuaagcugcagaaa

SEQ ID NO: 302298 - RNA, 19 nt, Human
gacgcuggcaggagagcgg

SEQ ID NO: 302299 - RNA, 20 nt, Human
gacucucaggucacacuucu

SEQ ID NO: 302300 - RNA, 18 nt, Human
gagcucccugggagcagg

SEQ ID NO: 302301 - RNA, 24 nt, Human
gccgcgcucucgccaccaggcccu

SEQ ID NO: 302302 - RNA, 18 nt, Human
gcguuuccugcgcugcca

SEQ ID NO: 302303 - RNA, 21 nt, Human
ggacauuccuaggaaacccag

SEQ ID NO: 302304 - RNA, 19 nt, Human
ggagagccagggugcggac

SEQ ID NO: 302305 - RNA, 19 nt, Human
ggaggagaggggggcgugc

SEQ ID NO: 302306 - RNA, 18 nt, Human
ggaugcucgggcgcagug

SEQ ID NO: 302307 - RNA, 18 nt, Human
ggccgaggggacacagac

SEQ ID NO: 302308 - RNA, 19 nt, Human
gggcaagacaccccaacau

SEQ ID NO: 302309 - RNA, 21 nt, Human
gggcguuuccugcgcugccag

SEQ ID NO: 302310 - RNA, 24 nt, Human
gguaaugcaagugcuggggaagga

SEQ ID NO: 302311 - RNA, 21 nt, Human
gugggaggagagaggggcccu

SEQ ID NO: 302312 - RNA, 18 nt, Human
ucagggacuuccugcaga

SEQ ID NO: 302313 - RNA, 24 nt, Human
uccccaccugggaagagcagggac

SEQ ID NO: 302314 - RNA, 21 nt, Human
uccccgugcagccagccugcc

SEQ ID NO: 302315 - RNA, 22 nt, Human
ucggcaaaauacuucccucucc

SEQ ID NO: 302316 - RNA, 21 nt, Human
ucgggcgcagugacagccgcg

SEQ ID NO: 302317 - RNA, 21 nt, Human
ugccaccaguguggucuuccc

SEQ ID NO: 302318 - RNA, 22 nt, Human
uggaauggaaccgacacgucug

SEQ ID NO: 302319 - RNA, 24 nt, Human
uggaauggaaccgacacgucugcc

SEQ ID NO: 302320 - RNA, 18 nt, Human
uggaggugggggccccac

SEQ ID NO: 302321 - RNA, 20 nt, Human
ugggaagagcagggacggua

SEQ ID NO: 302322 - RNA, 21 nt, Human
ugggaagagcagggacgguaa

SEQ ID NO: 302323 - RNA, 19 nt, Human
ugggagcaggaggccccag

SEQ ID NO: 302324 - RNA, 24 nt, Human
ugggaggagagaggggcccuggag

SEQ ID NO: 302325 - RNA, 20 nt, Human
ugugaaggucuccgaggcug

SEQ ID NO: 302326 - RNA, 19 nt, Human
uguuccgcuccccaccuuc

SEQ ID NO: 302327 - RNA, 19 nt, Human
uucagcaacuaggagccug

SEQ ID NO: 302328 - RNA, 23 nt, Human
uucccagcuccaaacgugccggg

SEQ ID NO: 302329 - RNA, 19 nt, Human
uuccuuaacuuucagcaac

SEQ ID NO: 302330 - RNA, 21 nt, Human
uucucaguuccccccaagucc

SEQ ID NO: 302331 - RNA, 19 nt, Human
uuuccugcgcugccagggg

SEQ ID NO: 302332 - RNA, 20 nt, Human
aaaauacacagaagcaaagg

SEQ ID NO: 302333 - RNA, 28 nt, Human
aaaauccucccuugcccagggacugccu

SEQ ID NO: 302334 - RNA, 18 nt, Human
aaagagccaggugggcug

SEQ ID NO: 302335 - RNA, 22 nt, Human
aaagaugugcuacccuccaggc

SEQ ID NO: 302336 - RNA, 20 nt, Human
aagcaaaggcugcaguccua

SEQ ID NO: 302337 - RNA, 22 nt, Human
aagcacuuuccuuucacauugu

SEQ ID NO: 302338 - RNA, 19 nt, Human
acacgggcagcaacagggg

SEQ ID NO: 302339 - RNA, 23 nt, Human
acacuuucugacccagccccaca

SEQ ID NO: 302340 - RNA, 20 nt, Human
accaagggaacccacuaugg

SEQ ID NO: 302341 - RNA, 18 nt, Human
acuccaaaauacacagaa

SEQ ID NO: 302342 - RNA, 20 nt, Human
acugccccccugcccucacc

SEQ ID NO: 302343 - RNA, 23 nt, Human
agaagcucagggccccaugaaga

SEQ ID NO: 302344 - RNA, 18 nt, Human
agaggccgggggguugcc

SEQ ID NO: 302345 - RNA, 19 nt, Human
agaguccaccuguggacag

SEQ ID NO: 302346 - RNA, 18 nt, Human
aggcagaagucaacaaac

SEQ ID NO: 302347 - RNA, 21 nt, Human
aggcagaagucaacaaacacc

SEQ ID NO: 302348 - RNA, 20 nt, Human
aggcagaagucaacaaaccg

SEQ ID NO: 302349 - RNA, 21 nt, Human
aggcugcaaagcccugggagg

SEQ ID NO: 302350 - RNA, 21 nt, Human
agggacugccuauggguucug

SEQ ID NO: 302351 - RNA, 18 nt, Human
agggcagaggccgggggg

SEQ ID NO: 302352 - RNA, 23 nt, Human
aggugacaaaagucaccaaaacu

SEQ ID NO: 302353 - RNA, 22 nt, Human
auggcuaacaaaugaguguguc

SEQ ID NO: 302354 - RNA, 21 nt, Human
caaaagucaccaaaacuccag

SEQ ID NO: 302355 - RNA, 25 nt, Human
caaaauacacagaagcaaaggcugc

SEQ ID NO: 302356 - RNA, 18 nt, Human
caaaggacuugggaucca

SEQ ID NO: 302357 - RNA, 23 nt, Human
caacaggggagaggccgccuccc

SEQ ID NO: 302358 - RNA, 21 nt, Human
caaugugcugaagcaagcgca

SEQ ID NO: 302359 - RNA, 22 nt, Human
cacaaggaugagagaccaccgg

SEQ ID NO: 302360 - RNA, 23 nt, Human
cacagcaagcacuuuccuuucac

SEQ ID NO: 302361 - RNA, 23 nt, Human
caccaaaacuccaaaauacacag

SEQ ID NO: 302362 - RNA, 25 nt, Human
caccaaaacuccaaaauacacagaa

SEQ ID NO: 302363 - RNA, 18 nt, Human
caccucagcccaugcgga

SEQ ID NO: 302364 - RNA, 24 nt, Human
caccucagcccaugcggagaccau

SEQ ID NO: 302365 - RNA, 19 nt, Human
caccuguggacagcagggc

SEQ ID NO: 302366 - RNA, 24 nt, Human
cagcccaugcggagaccaugccag

SEQ ID NO: 302367 - RNA, 21 nt, Human
cagcugggccacaguaggaac

SEQ ID NO: 302368 - RNA, 18 nt, Human
caggagccacgcacaacc

SEQ ID NO: 302369 - RNA, 23 nt, Human
caggggccuggcuuccccagagu

SEQ ID NO: 302370 - RNA, 24 nt, Human
caguaggaacaucacagcaagcac

SEQ ID NO: 302371 - RNA, 25 nt, Human
caguggcugcccaggaagcaucugc

SEQ ID NO: 302372 - RNA, 19 nt, Human
caugaaugcccacaacuaa

SEQ ID NO: 302373 - RNA, 22 nt, Human
cauugcuuucaugaaugcccac

SEQ ID NO: 302374 - RNA, 23 nt, Human
ccaagggaacccacuauggcuaa

SEQ ID NO: 302375 - RNA, 22 nt, Human
ccagcaacuccuaacuccccuc

SEQ ID NO: 302376 - RNA, 19 nt, Human
ccagggaaggggagagggg

SEQ ID NO: 302377 - RNA, 25 nt, Human
ccauguguggcuucaagaauauccc

SEQ ID NO: 302378 - RNA, 21 nt, Human
cccacaggcagaagucaacaa

SEQ ID NO: 302379 - RNA, 22 nt, Human
ccccauuggcugccagugucca

SEQ ID NO: 302380 - RNA, 22 nt, Human
ccccccugcccucacguuucug

SEQ ID NO: 302381 - RNA, 21 nt, Human
ccggaagaaacuggggcuggg

SEQ ID NO: 302382 - RNA, 23 nt, Human
ccuggccaguggcugcccaggaa

SEQ ID NO: 302383 - RNA, 26 nt, Human
ccuugggcucugggucuaaagggcuu

SEQ ID NO: 302384 - RNA, 19 nt, Human
cgaccacaacugccccccu

SEQ ID NO: 302385 - RNA, 22 nt, Human
cgcauugcuuucaugaaugccc

SEQ ID NO: 302386 - RNA, 24 nt, Human
cgcgcagcccaugcagaugcaguc

SEQ ID NO: 302387 - RNA, 19 nt, Human
cuaacuccccucuguacac

SEQ ID NO: 302388 - RNA, 20 nt, Human
cuaacuccccucuguacacu

SEQ ID NO: 302389 - RNA, 21 nt, Human
cucagacccacaggcagaagu

SEQ ID NO: 302390 - RNA, 23 nt, Human
cucgagcacuucggugugugcac

SEQ ID NO: 302391 - RNA, 26 nt, Human
cucguaaugcauccaguccagcaacu

SEQ ID NO: 302392 - RNA, 22 nt, Human
cucuggguuccgccagccaugu

SEQ ID NO: 302393 - RNA, 20 nt, Human
cugcgccggaagaaacuggg

SEQ ID NO: 302394 - RNA, 24 nt, Human
cuggccucuggcucaggaaguggc

SEQ ID NO: 302395 - RNA, 23 nt, Human
cuggggugggggcucuggguucc

SEQ ID NO: 302396 - RNA, 19 nt, Human
gaaaauaucugcaacaugg

SEQ ID NO: 302397 - RNA, 19 nt, Human
gaacucaggggcaugacag

SEQ ID NO: 302398 - RNA, 25 nt, Human
gagaccaccggccagggccagggac

SEQ ID NO: 302399 - RNA, 20 nt, Human
gagagaccaccggccagggc

SEQ ID NO: 302400 - RNA, 21 nt, Human
gagcagugccugccuaguggu

SEQ ID NO: 302401 - RNA, 19 nt, Human
gaggaugguagaggcccug

SEQ ID NO: 302402 - RNA, 21 nt, Human
gcauugcuuucaugaaugccc

SEQ ID NO: 302403 - RNA, 19 nt, Human
gccagcuguaaacagacug

SEQ ID NO: 302404 - RNA, 21 nt, Human
gcuuccccagaguccaccugu

SEQ ID NO: 302405 - RNA, 22 nt, Human
ggacacgggcagcaacagggga

SEQ ID NO: 302406 - RNA, 18 nt, Human
ggagagggggcggcagcc

SEQ ID NO: 302407 - RNA, 19 nt, Human
ggccagggccagggacgcu

SEQ ID NO: 302408 - RNA, 21 nt, Human
ggcuggggugggggcucuggg

SEQ ID NO: 302409 - RNA, 18 nt, Human
gggacugccuauggguuc

SEQ ID NO: 302410 - RNA, 22 nt, Human
gggcagaggccgggggguugcc

SEQ ID NO: 302411 - RNA, 23 nt, Human
gggcuggggugggggcucugggu

SEQ ID NO: 302412 - RNA, 23 nt, Human
ggggagagggggcggcagccucu

SEQ ID NO: 302413 - RNA, 25 nt, Human
ggucucaccucagaugacauccaga

SEQ ID NO: 302414 - RNA, 19 nt, Human
guccagacacuuucugacc

SEQ ID NO: 302415 - RNA, 21 nt, Human
guccaggugacaaaagucacc

SEQ ID NO: 302416 - RNA, 19 nt, Human
gugggggcucuggguuccg

SEQ ID NO: 302417 - RNA, 24 nt, Human
uacacagaagcaaaggcugcaguc

SEQ ID NO: 302418 - RNA, 20 nt, Human
uaggaacaucacagcaagca

SEQ ID NO: 302419 - RNA, 26 nt, Human
ucaauaccauccauucuggggaacuc

SEQ ID NO: 302420 - RNA, 18 nt, Human
ucacaaagccaacugagc

SEQ ID NO: 302421 - RNA, 25 nt, Human
ucaccaaaacuccaaaauacacaga

SEQ ID NO: 302422 - RNA, 19 nt, Human
ucagcccaugcggagaccc

SEQ ID NO: 302423 - RNA, 18 nt, Human
uccaaaauacacagaagc

SEQ ID NO: 302424 - RNA, 18 nt, Human
uccaggggccuggcuucc

SEQ ID NO: 302425 - RNA, 20 nt, Human
uccaggugacaaaagucacc

SEQ ID NO: 302426 - RNA, 21 nt, Human
ucccaaaggcaugguccuugg

SEQ ID NO: 302427 - RNA, 18 nt, Human
ucccucuacccugucccc

SEQ ID NO: 302428 - RNA, 24 nt, Human
ucccugcauggcauggugacuaac

SEQ ID NO: 302429 - RNA, 19 nt, Human
ucccuugcccagggacugc

SEQ ID NO: 302430 - RNA, 19 nt, Human
uccgcgcagcccaugcaga

SEQ ID NO: 302431 - RNA, 21 nt, Human
ucucugggaccaaaagaacuc

SEQ ID NO: 302432 - RNA, 19 nt, Human
ucugccuucucccuuccuc

SEQ ID NO: 302433 - RNA, 22 nt, Human
ugaagugguuucacugugagag

SEQ ID NO: 302434 - RNA, 19 nt, Human
ugacaaaagucaccaaaac

SEQ ID NO: 302435 - RNA, 21 nt, Human
ugacagaugagucuggaagga

SEQ ID NO: 302436 - RNA, 24 nt, Human
ugacccagccccacaacuugccag

SEQ ID NO: 302437 - RNA, 18 nt, Human
ugcccaggaagcaucugc

SEQ ID NO: 302438 - RNA, 25 nt, Human
ugcccugucuugaagugguuucacu

SEQ ID NO: 302439 - RNA, 22 nt, Human
ugccucucugggaccaaaagaa

SEQ ID NO: 302440 - RNA, 24 nt, Human
ugcuggacacaguguugcaugugg

SEQ ID NO: 302441 - RNA, 19 nt, Human
ugcuuucaugaaugcccac

SEQ ID NO: 302442 - RNA, 21 nt, Human
uggagggccuggaaugacccc

SEQ ID NO: 302443 - RNA, 23 nt, Human
uggaugucccucuacccuguccc

SEQ ID NO: 302444 - RNA, 25 nt, Human
uggcaucugcaggcugcaaagcccu

SEQ ID NO: 302445 - RNA, 19 nt, Human
uggcucaggaaguggccac

SEQ ID NO: 302446 - RNA, 20 nt, Human
ugggauccaggggccuggcu

SEQ ID NO: 302447 - RNA, 19 nt, Human
ugggcagcugggccacagu

SEQ ID NO: 302448 - RNA, 20 nt, Human
uggggcucugacagaugagu

SEQ ID NO: 302449 - RNA, 20 nt, Human
ugucccucuacccugucccc

SEQ ID NO: 302450 - RNA, 18 nt, Human
ugucgccgacugucaaca

SEQ ID NO: 302451 - RNA, 24 nt, Human
uucaauaccauccauucuggggaa

SEQ ID NO: 302452 - RNA, 22 nt, Human
uuuuuauuuuuuaaaaaguauu

SEQ ID NO: 302453 - RNA, 20 nt, Human
acccaggccaccguccaacu

SEQ ID NO: 302454 - RNA, 21 nt, Human
aggaagguggaugccccaggg

SEQ ID NO: 302455 - RNA, 23 nt, Human
aggcaggggaugggcugagcagg

SEQ ID NO: 302456 - RNA, 24 nt, Human
aggcaggggaugggcugagcaggg

SEQ ID NO: 302457 - RNA, 21 nt, Human
aggcuccagacacaacagccc

SEQ ID NO: 302458 - RNA, 19 nt, Human
agguggccagggauagagg

SEQ ID NO: 302459 - RNA, 22 nt, Human
caacacaaccuaggcgccagca

SEQ ID NO: 302460 - RNA, 19 nt, Human
caaccuaggcgccagcagc

SEQ ID NO: 302461 - RNA, 23 nt, Human
cacaaccuaggcgccagcagccu

SEQ ID NO: 302462 - RNA, 23 nt, Human
cacccaggccaccguccaaccac

SEQ ID NO: 302463 - RNA, 23 nt, Human
cagacacaacagcccaggcccca

SEQ ID NO: 302464 - RNA, 23 nt, Human
cagcagcagggagcaggugugag

SEQ ID NO: 302465 - RNA, 19 nt, Human
cagccggagggaggccugg

SEQ ID NO: 302466 - RNA, 19 nt, Human
cagcgccacguccccuggg

SEQ ID NO: 302467 - RNA, 20 nt, Human
cagcuucuccagguccaccg

SEQ ID NO: 302468 - RNA, 19 nt, Human
caggagcagcgcacccagg

SEQ ID NO: 302469 - RNA, 18 nt, Human
cagggcacucuguccucc

SEQ ID NO: 302470 - RNA, 24 nt, Human
ccaaagccagggggcagcagccuc

SEQ ID NO: 302471 - RNA, 22 nt, Human
ccacgccucuggcaggcagcag

SEQ ID NO: 302472 - RNA, 19 nt, Human
ccagcagccuaccggccag

SEQ ID NO: 302473 - RNA, 23 nt, Human
ccaggccccaucugagcccuggc

SEQ ID NO: 302474 - RNA, 20 nt, Human
ccccugggcaggaaggugga

SEQ ID NO: 302475 - RNA, 20 nt, Human
cccgcagcuucuccaggucc

SEQ ID NO: 302476 - RNA, 22 nt, Human
cccgcagcuucuccagguccac

SEQ ID NO: 302477 - RNA, 19 nt, Human
cccgcgcccgacgcccgca

SEQ ID NO: 302478 - RNA, 22 nt, Human
ccgcuggucaggacgccgaugg

SEQ ID NO: 302479 - RNA, 20 nt, Human
ccuggcagguggccagggau

SEQ ID NO: 302480 - RNA, 23 nt, Human
cgacagcgccacguccccugggc

SEQ ID NO: 302481 - RNA, 22 nt, Human
cgcagcuucuccagguccaccg

SEQ ID NO: 302482 - RNA, 20 nt, Human
cuaggcgccagcagccuacc

SEQ ID NO: 302483 - RNA, 20 nt, Human
cucuguccuccugcuggagg

SEQ ID NO: 302484 - RNA, 22 nt, Human
cugagcccuggcgcugcgcugg

SEQ ID NO: 302485 - RNA, 20 nt, Human
cuggcaggcagcagcugagg

SEQ ID NO: 302486 - RNA, 20 nt, Human
cuggcgcugcgcuggcaugg

SEQ ID NO: 302487 - RNA, 21 nt, Human
gacgcccgcagcuucuccagg

SEQ ID NO: 302488 - RNA, 25 nt, Human
gagcaggugugaggugaggugccac

SEQ ID NO: 302489 - RNA, 24 nt, Human
gcagggccaggggcaucccccucu

SEQ ID NO: 302490 - RNA, 20 nt, Human
gcagguggccagggauagag

SEQ ID NO: 302491 - RNA, 22 nt, Human
gcaucccccucucaacacaacc

SEQ ID NO: 302492 - RNA, 19 nt, Human
gcccaggccccaucugagc

SEQ ID NO: 302493 - RNA, 21 nt, Human
gcccaggccccaucugagccc

SEQ ID NO: 302494 - RNA, 24 nt, Human
ggcaggaagguggaugccccaggg

SEQ ID NO: 302495 - RNA, 21 nt, Human
ggcagggcaaggagagggcag

SEQ ID NO: 302496 - RNA, 18 nt, Human
ggccuggcaggcuggucu

SEQ ID NO: 302497 - RNA, 19 nt, Human
gggcacucuguccuccugc

SEQ ID NO: 302498 - RNA, 20 nt, Human
ggggcuggggaggggcgugg

SEQ ID NO: 302499 - RNA, 19 nt, Human
gggugggggcuggggaggg

SEQ ID NO: 302500 - RNA, 20 nt, Human
gucacagugaggcagggcca

SEQ ID NO: 302501 - RNA, 18 nt, Human
uagaaaaggugacaggug

SEQ ID NO: 302502 - RNA, 21 nt, Human
ucagcagggggccuggugggc

SEQ ID NO: 302503 - RNA, 21 nt, Human
uccagguccaccgcggccaug

SEQ ID NO: 302504 - RNA, 22 nt, Human
ucucuggucuccccagcuccag

SEQ ID NO: 302505 - RNA, 23 nt, Human
ucucuggucuccccagcuccagg

SEQ ID NO: 302506 - RNA, 18 nt, Human
ucuguccuccugcuggag

SEQ ID NO: 302507 - RNA, 20 nt, Human
ucuguccuccugcuggaggg

SEQ ID NO: 302508 - RNA, 18 nt, Human
ugacaggugcugcacgug

SEQ ID NO: 302509 - RNA, 28 nt, Human
ugaggugaggugccacgccucuggcagg

SEQ ID NO: 302510 - RNA, 19 nt, Human
ugccccagggcacucuguc

SEQ ID NO: 302511 - RNA, 18 nt, Human
ugcuggagggccuggcag

SEQ ID NO: 302512 - RNA, 19 nt, Human
ugggggcuggggaggggcg

SEQ ID NO: 302513 - RNA, 23 nt, Human
ugggggcuggggaggggcguggg

SEQ ID NO: 302514 - RNA, 18 nt, Human
ugugaggugaggugccac

SEQ ID NO: 302515 - RNA, 20 nt, Human
uucuccagguccaccgcggc

SEQ ID NO: 302516 - RNA, 22 nt, Human
uuucuagaaaaggugacaggug

SEQ ID NO: 302517 - RNA, 25 nt, Human
uuuuuuuuuuuuuuuuuuuuuccgg

SEQ ID NO: 302518 - RNA, 18 nt, Human
aaaacaagcagagacuug

SEQ ID NO: 302519 - RNA, 18 nt, Human
agagggagggggaaggag

SEQ ID NO: 302520 - RNA, 27 nt, Human
agagggagggggaaggaggagaggcuu

SEQ ID NO: 302521 - RNA, 18 nt, Human
aggaagaaaacaagcaga

SEQ ID NO: 302522 - RNA, 21 nt, Human
aggaagaaaacaagcagagac

SEQ ID NO: 302523 - RNA, 23 nt, Human
aggagccagguggaggcaaagag

SEQ ID NO: 302524 - RNA, 27 nt, Human
aggcgcacagccugguuaccccuugug

SEQ ID NO: 302525 - RNA, 28 nt, Human
aggggcaggcgcacagccucccaagggg

SEQ ID NO: 302526 - RNA, 19 nt, Human
agggggaaggaggagaggc

SEQ ID NO: 302527 - RNA, 20 nt, Human
aggggugauggacgaacaug

SEQ ID NO: 302528 - RNA, 21 nt, Human
caaaagugccaucacugcuuc

SEQ ID NO: 302529 - RNA, 22 nt, Human
cacccauccugcugcccagaau

SEQ ID NO: 302530 - RNA, 22 nt, Human
caccuggacacauuccaugagg

SEQ ID NO: 302531 - RNA, 24 nt, Human
ccagacgcuuaaccaccagcugaa

SEQ ID NO: 302532 - RNA, 18 nt, Human
ccagguggaggcaaagag

SEQ ID NO: 302533 - RNA, 24 nt, Human
ccagguggaggcaaagagggaggg

SEQ ID NO: 302534 - RNA, 20 nt, Human
cccagacgcuuaaccaccag

SEQ ID NO: 302535 - RNA, 18 nt, Human
ccuccaaaagugccauca

SEQ ID NO: 302536 - RNA, 18 nt, Human
cgaacauggggaggagcc

SEQ ID NO: 302537 - RNA, 26 nt, Human
cgucccaccccucugcacaugcccca

SEQ ID NO: 302538 - RNA, 29 nt, Human
cucuccuccgccgcugcuuucuugcagau

SEQ ID NO: 302539 - RNA, 21 nt, Human
cugauggcgucccaccccucu

SEQ ID NO: 302540 - RNA, 23 nt, Human
cugggguaucugggguccccucc

SEQ ID NO: 302541 - RNA, 23 nt, Human
cugggguccccuccaaaagugcc

SEQ ID NO: 302542 - RNA, 18 nt, Human
gaagaaaacaagcagaga

SEQ ID NO: 302543 - RNA, 24 nt, Human
gaagaaaacaagcagagacuuggg

SEQ ID NO: 302544 - RNA, 20 nt, Human
gacagcucagccucuugucu

SEQ ID NO: 302545 - RNA, 20 nt, Human
gagacuuggguaaaccaugg

SEQ ID NO: 302546 - RNA, 19 nt, Human
gaggagccagguggaggca

SEQ ID NO: 302547 - RNA, 21 nt, Human
gcaaagagggagggggaagga

SEQ ID NO: 302548 - RNA, 21 nt, Human
gcucacuacacaggcuggggu

SEQ ID NO: 302549 - RNA, 22 nt, Human
ggcaaagagggagggggaagga

SEQ ID NO: 302550 - RNA, 19 nt, Human
gucauaucccagacgcuua

SEQ ID NO: 302551 - RNA, 23 nt, Human
uaaccaccagcugaagggaccaa

SEQ ID NO: 302552 - RNA, 20 nt, Human
ucacuacacaggcuggggua

SEQ ID NO: 302553 - RNA, 23 nt, Human
ucagccucuugucuuguaauggu

SEQ ID NO: 302554 - RNA, 24 nt, Human
uccaaaagugccaucacugcuucc

SEQ ID NO: 302555 - RNA, 21 nt, Human
uccacacccauccugcugccc

SEQ ID NO: 302556 - RNA, 22 nt, Human
uccacacccauccugcugccca

SEQ ID NO: 302557 - RNA, 19 nt, Human
uccuugggaaaggggggag

SEQ ID NO: 302558 - RNA, 22 nt, Human
uccuugggaaaggggggagggg

SEQ ID NO: 302559 - RNA, 18 nt, Human
ugaagggaccaacagagg

SEQ ID NO: 302560 - RNA, 22 nt, Human
ugcccagaauucugucaaaggc

SEQ ID NO: 302561 - RNA, 19 nt, Human
ugggaaaggggggaggggu

SEQ ID NO: 302562 - RNA, 19 nt, Human
ugggguaucuggggucccc

SEQ ID NO: 302563 - RNA, 25 nt, Human
uuagcucuccuccgccgcugcuuuc

SEQ ID NO: 302564 - RNA, 22 nt, Human
uugucuuguaaugguucuuugu

SEQ ID NO: 302565 - RNA, 20 nt, Human
aaacagacaguccacggugg

SEQ ID NO: 302566 - RNA, 21 nt, Human
acagacagcacgcacuggagc

SEQ ID NO: 302567 - RNA, 21 nt, Human
acagacaguccacgguggccg

SEQ ID NO: 302568 - RNA, 23 nt, Human
agacacacuccacagacagcacg

SEQ ID NO: 302569 - RNA, 19 nt, Human
agacagcacgcacuggagc

SEQ ID NO: 302570 - RNA, 19 nt, Human
auaaagugcugauaaaaua

SEQ ID NO: 302571 - RNA, 18 nt, Human
uccacagacagcacgcac

SEQ ID NO: 302572 - RNA, 20 nt, Human
uccacagacagcacgcacuu

SEQ ID NO: 302573 - RNA, 24 nt, Human
uccacgguggcugcaggcacaugc

SEQ ID NO: 302574 - RNA, 24 nt, Human
ugcauaaagugcugauaaaauaac

SEQ ID NO: 302575 - RNA, 22 nt, Human
uuaauucugcucauaugcacau

SEQ ID NO: 302576 - RNA, 20 nt, Human
aaaaaaccccaaaaaacaaa

SEQ ID NO: 302577 - RNA, 19 nt, Human
agaaaaaaaaaaccccaaa

SEQ ID NO: 302578 - RNA, 22 nt, Human
agaaaaaaaaaaccccaaaaaa

SEQ ID NO: 302579 - RNA, 18 nt, Human
ccucggcuggcgggcggg

SEQ ID NO: 302580 - RNA, 22 nt, Human
cgcugcugcuggggccgcggac

SEQ ID NO: 302581 - RNA, 25 nt, Human
cgcugcugcuggggccgcggacugg

SEQ ID NO: 302582 - RNA, 23 nt, Human
cugcuacuggggcugcucucggc

SEQ ID NO: 302583 - RNA, 23 nt, Human
gaaaaaaaaaaccccaaaaaaca

SEQ ID NO: 302584 - RNA, 19 nt, Human
gcgcugccguccggaccgc

SEQ ID NO: 302585 - RNA, 21 nt, Human
gcuacuggggcugcucucggc

SEQ ID NO: 302586 - RNA, 19 nt, Human
ggaaaggggugcaaagcug

SEQ ID NO: 302587 - RNA, 23 nt, Human
uaguagaaucuuuuuuauucaga

SEQ ID NO: 302588 - RNA, 21 nt, Human
uauucagaaaaaaaaaacccc

SEQ ID NO: 302589 - RNA, 26 nt, Human
uggcagcaauaagggguaugggguaa

SEQ ID NO: 302590 - RNA, 22 nt, Human
uggcccccagcccaugugguuu

SEQ ID NO: 302591 - RNA, 18 nt, Human
ugggguaauggcccaaaa

SEQ ID NO: 302592 - RNA, 21 nt, Human
ugggguaauggcccaaaaaau

SEQ ID NO: 302593 - RNA, 24 nt, Human
ugugguuuuggcagcaauaagggg

SEQ ID NO: 302594 - RNA, 24 nt, Human
uucagaaaaaaaaaaccccaaaaa

SEQ ID NO: 302595 - RNA, 25 nt, Human
uucagaaaaaaaaaaccccaaaaaa

SEQ ID NO: 302596 - RNA, 18 nt, Human
uuuuuuuuuuuuuuuuug

SEQ ID NO: 302597 - RNA, 24 nt, Human
uuuuuuuuuuuuuuuuuuguuagu

SEQ ID NO: 302598 - RNA, 25 nt, Human
aaaaaaaaacaggcacugcauaaaa

SEQ ID NO: 302599 - RNA, 25 nt, Human
aaaaaaaaacaggcacugcauaaaa

SEQ ID NO: 302600 - RNA, 18 nt, Human
aaaaaaacaggcacugca

SEQ ID NO: 302601 - RNA, 19 nt, Human
aaaaaaacaggcacugcau

SEQ ID NO: 302602 - RNA, 18 nt, Human
aaaacaaaagugaacaga

SEQ ID NO: 302603 - RNA, 19 nt, Human
aaacaauagaagcaaauac

SEQ ID NO: 302604 - RNA, 19 nt, Human
aaacaauagaagcaaauac

SEQ ID NO: 302605 - RNA, 19 nt, Human
aacaaaacaaaagugaaca

SEQ ID NO: 302606 - RNA, 19 nt, Human
aaccaaugcuggaguacac

SEQ ID NO: 302607 - RNA, 23 nt, Human
aagaaaaaggaagaaaaaucuga

SEQ ID NO: 302608 - RNA, 23 nt, Human
aagaaaaaggaagaaaaaucuga

SEQ ID NO: 302609 - RNA, 19 nt, Human
aagacaccuuuccccacca

SEQ ID NO: 302610 - RNA, 18 nt, Human
aagaguagagcuggugug

SEQ ID NO: 302611 - RNA, 18 nt, Human
aagaguagagcuggugug

SEQ ID NO: 302612 - RNA, 21 nt, Human
aaggaaacaaaacaaaaguga

SEQ ID NO: 302613 - RNA, 21 nt, Human
acaaaacaaaagugaacagaa

SEQ ID NO: 302614 - RNA, 24 nt, Human
acaauacuaaaagcaaacuacugc

SEQ ID NO: 302615 - RNA, 24 nt, Human
acaauacuaaaagcaaacuacugc

SEQ ID NO: 302616 - RNA, 21 nt, Human
acaauagaagcaaauacuaga

SEQ ID NO: 302617 - RNA, 21 nt, Human
acaauagaagcaaauacuaga

SEQ ID NO: 302618 - RNA, 23 nt, Human
acugcagcucucaauagcucauc

SEQ ID NO: 302619 - RNA, 23 nt, Human
acugcagcucucaauagcucauc

SEQ ID NO: 302620 - RNA, 18 nt, Human
agaaaauagguaaagaaa

SEQ ID NO: 302621 - RNA, 20 nt, Human
agaaauggacaaaucagcaa

SEQ ID NO: 302622 - RNA, 22 nt, Human
agagaagagugaaggaaugaug

SEQ ID NO: 302623 - RNA, 19 nt, Human
aggaagacuaaaugagcca

SEQ ID NO: 302624 - RNA, 19 nt, Human
agggaggggggggcgggaa

SEQ ID NO: 302625 - RNA, 19 nt, Human
agggaggggggggcgggaa

SEQ ID NO: 302626 - RNA, 19 nt, Human
aggguuguugaugaagaca

SEQ ID NO: 302627 - RNA, 19 nt, Human
aggguuguugaugaagaca

SEQ ID NO: 302628 - RNA, 20 nt, Human
aggguuguugaugaagacag

SEQ ID NO: 302629 - RNA, 20 nt, Human
aggguuguugaugaagacag

SEQ ID NO: 302630 - RNA, 18 nt, Human
agugcaacaacaauacua

SEQ ID NO: 302631 - RNA, 18 nt, Human
agugcaacaacaauacua

SEQ ID NO: 302632 - RNA, 21 nt, Human
augaagaacaaacuggacaca

SEQ ID NO: 302633 - RNA, 21 nt, Human
augaagaacaaacuggacaca

SEQ ID NO: 302634 - RNA, 21 nt, Human
augaagacaguugcuagguag

SEQ ID NO: 302635 - RNA, 21 nt, Human
augaagacaguugcuagguag

SEQ ID NO: 302636 - RNA, 23 nt, Human
augcccccuccccccaauuucaa

SEQ ID NO: 302637 - RNA, 23 nt, Human
auguaacaaagugcagggaaaga

SEQ ID NO: 302638 - RNA, 23 nt, Human
auguaacaaagugcagggaaaga

SEQ ID NO: 302639 - RNA, 19 nt, Human
auguugccagauaaggguu

SEQ ID NO: 302640 - RNA, 19 nt, Human
auguugccagauaaggguu

SEQ ID NO: 302641 - RNA, 19 nt, Human
auucaaucaguaugguuac

SEQ ID NO: 302642 - RNA, 19 nt, Human
auucaaucaguaugguuac

SEQ ID NO: 302643 - RNA, 19 nt, Human
caacaacaauacuaaaagc

SEQ ID NO: 302644 - RNA, 19 nt, Human
caacaacaauacuaaaagc

SEQ ID NO: 302645 - RNA, 22 nt, Human
caacaauacuaaaagcaaacua

SEQ ID NO: 302646 - RNA, 22 nt, Human
caacaauacuaaaagcaaacua

SEQ ID NO: 302647 - RNA, 22 nt, Human
caagugcaacaacaauacuaaa

SEQ ID NO: 302648 - RNA, 22 nt, Human
caagugcaacaacaauacuaaa

SEQ ID NO: 302649 - RNA, 22 nt, Human
cacagguucauaccccaucacc

SEQ ID NO: 302650 - RNA, 22 nt, Human
cacugcauaaaaaaagauggaa

SEQ ID NO: 302651 - RNA, 22 nt, Human
cacugcauaaaaaaagauggaa

SEQ ID NO: 302652 - RNA, 23 nt, Human
cacugcauaaaaaaagauggaag

SEQ ID NO: 302653 - RNA, 25 nt, Human
cagaaagaaagacaccuuuccccac

SEQ ID NO: 302654 - RNA, 21 nt, Human
cagccaaguccacaauaaugc

SEQ ID NO: 302655 - RNA, 21 nt, Human
cagccaaguccacaauaaugc

SEQ ID NO: 302656 - RNA, 21 nt, Human
cagggaaagaaauggacaaau

SEQ ID NO: 302657 - RNA, 23 nt, Human
cauaaaaaaagauggaagcaaac

SEQ ID NO: 302658 - RNA, 23 nt, Human
cauaaaaaaagauggaagcaaac

SEQ ID NO: 302659 - RNA, 23 nt, Human
cauauaaaaacucaagcugcaaa

SEQ ID NO: 302660 - RNA, 23 nt, Human
cauauaaaaacucaagcugcaaa

SEQ ID NO: 302661 - RNA, 23 nt, Human
caugacuauaaccaaugcuggag

SEQ ID NO: 302662 - RNA, 22 nt, Human
caugcccccuccccccaauuuc

SEQ ID NO: 302663 - RNA, 22 nt, Human
caugcccccuccccccaauuuc

SEQ ID NO: 302664 - RNA, 24 nt, Human
caugcccccuccccccaauuucaa

SEQ ID NO: 302665 - RNA, 23 nt, Human
cauuauccacaaggcccaaacaa

SEQ ID NO: 302666 - RNA, 23 nt, Human
cauuauccacaaggcccaaacaa

SEQ ID NO: 302667 - RNA, 25 nt, Human
cccaucacccugcauugcuaauaaa

SEQ ID NO: 302668 - RNA, 21 nt, Human
ccccaucacccugcauugcua

SEQ ID NO: 302669 - RNA, 21 nt, Human
cccccuccccccaauuucaag

SEQ ID NO: 302670 - RNA, 22 nt, Human
ccccuaauacuuaacagucugc

SEQ ID NO: 302671 - RNA, 20 nt, Human
ccccuccccccaauuucaag

SEQ ID NO: 302672 - RNA, 21 nt, Human
cucacaauagcaacaguucau

SEQ ID NO: 302673 - RNA, 21 nt, Human
cucacaauagcaacaguucau

SEQ ID NO: 302674 - RNA, 23 nt, Human
cuuacacaucagaccuccucagg

SEQ ID NO: 302675 - RNA, 20 nt, Human
gaaaaaaauucaucacaaga

SEQ ID NO: 302676 - RNA, 20 nt, Human
gaaaaaaauucaucacaaga

SEQ ID NO: 302677 - RNA, 24 nt, Human
gaaaauagguaaagaaaaauuagc

SEQ ID NO: 302678 - RNA, 24 nt, Human
gaaaauagguaaagaaaaauuagc

SEQ ID NO: 302679 - RNA, 23 nt, Human
gaaacaaaacaaaagugaacaga

SEQ ID NO: 302680 - RNA, 18 nt, Human
gaaauggacaaaucagca

SEQ ID NO: 302681 - RNA, 21 nt, Human
gagaagagugaaggaaugaug

SEQ ID NO: 302682 - RNA, 23 nt, Human
gcacuuuuuccucccaaccaugc

SEQ ID NO: 302683 - RNA, 23 nt, Human
gcacuuuuuccucccaaccaugc

SEQ ID NO: 302684 - RNA, 22 nt, Human
gcuacaaaaggaagacuaaaug

SEQ ID NO: 302685 - RNA, 22 nt, Human
gcuacaaaaggaagacuaaaug

SEQ ID NO: 302686 - RNA, 21 nt, Human
gcugcaauuauguugccagau

SEQ ID NO: 302687 - RNA, 21 nt, Human
gcugcaauuauguugccagau

SEQ ID NO: 302688 - RNA, 18 nt, Human
ggaaacaaaacaaaagug

SEQ ID NO: 302689 - RNA, 19 nt, Human
ggcccaaacaauagaagca

SEQ ID NO: 302690 - RNA, 19 nt, Human
ggcccaaacaauagaagca

SEQ ID NO: 302691 - RNA, 19 nt, Human
ggcgggaaaaagagaagag

SEQ ID NO: 302692 - RNA, 19 nt, Human
ggcgggaaaaagagaagag

SEQ ID NO: 302693 - RNA, 18 nt, Human
guacauuauccacaaggc

SEQ ID NO: 302694 - RNA, 18 nt, Human
guacauuauccacaaggc

SEQ ID NO: 302695 - RNA, 20 nt, Human
guagauggggagaggcugcu

SEQ ID NO: 302696 - RNA, 21 nt, Human
uaaaauuuccagaauuaagac

SEQ ID NO: 302697 - RNA, 23 nt, Human
uaaaucagaugaguuagacugua

SEQ ID NO: 302698 - RNA, 23 nt, Human
uaaaucagaugaguuagacugua

SEQ ID NO: 302699 - RNA, 20 nt, Human
uaaaugcauauuaaaucaga

SEQ ID NO: 302700 - RNA, 20 nt, Human
uaaaugcauauuaaaucaga

SEQ ID NO: 302701 - RNA, 24 nt, Human
uaagacaaagugaugcccaacuug

SEQ ID NO: 302702 - RNA, 24 nt, Human
uaagacaaagugaugcccaacuug

SEQ ID NO: 302703 - RNA, 23 nt, Human
uaauaguuauggcauuuuuuuaa

SEQ ID NO: 302704 - RNA, 23 nt, Human
uaauaguuauggcauuuuuuuaa

SEQ ID NO: 302705 - RNA, 19 nt, Human
uacugcagcucucaauagc

SEQ ID NO: 302706 - RNA, 19 nt, Human
uacugcagcucucaauagc

SEQ ID NO: 302707 - RNA, 19 nt, Human
uagaaaauagguaaagaaa

SEQ ID NO: 302708 - RNA, 19 nt, Human
uagaaaauagguaaagaaa

SEQ ID NO: 302709 - RNA, 20 nt, Human
uagcucaucaacaaaaggga

SEQ ID NO: 302710 - RNA, 20 nt, Human
uagcucaucaacaaaaggga

SEQ ID NO: 302711 - RNA, 19 nt, Human
uaggucaguuaaaauccau

SEQ ID NO: 302712 - RNA, 19 nt, Human
uaggucaguuaaaauccau

SEQ ID NO: 302713 - RNA, 22 nt, Human
uauaaccaaugcuggaguacac

SEQ ID NO: 302714 - RNA, 23 nt, Human
uauagcuaggaaaguuuaagagg

SEQ ID NO: 302715 - RNA, 20 nt, Human
uauggcacagaauacauaug

SEQ ID NO: 302716 - RNA, 20 nt, Human
uauggcacagaauacauaug

SEQ ID NO: 302717 - RNA, 18 nt, Human
uauguugccagauaaggg

SEQ ID NO: 302718 - RNA, 18 nt, Human
uauguugccagauaaggg

SEQ ID NO: 302719 - RNA, 26 nt, Human
ucaaagugcugaaaagacacugauca

SEQ ID NO: 302720 - RNA, 26 nt, Human
ucaaagugcugaaaagacacugauca

SEQ ID NO: 302721 - RNA, 24 nt, Human
ucaauagcucaucaacaaaaggga

SEQ ID NO: 302722 - RNA, 24 nt, Human
ucaauagcucaucaacaaaaggga

SEQ ID NO: 302723 - RNA, 24 nt, Human
ucacccugcauugcuaauaaaauu

SEQ ID NO: 302724 - RNA, 19 nt, Human
ucagaccuccucagguaua

SEQ ID NO: 302725 - RNA, 18 nt, Human
ucagagauuguacaaccg

SEQ ID NO: 302726 - RNA, 18 nt, Human
ucagagauuguacaaccg

SEQ ID NO: 302727 - RNA, 18 nt, Human
uccacaaggcccaaacaa

SEQ ID NO: 302728 - RNA, 25 nt, Human
uccacaauaaugcaacuucauauaa

SEQ ID NO: 302729 - RNA, 25 nt, Human
uccacaauaaugcaacuucauauaa

SEQ ID NO: 302730 - RNA, 21 nt, Human
uccauugggcaaacaggaauc

SEQ ID NO: 302731 - RNA, 21 nt, Human
uccauugggcaaacaggaauc

SEQ ID NO: 302732 - RNA, 18 nt, Human
uccguggacaccuuccuu

SEQ ID NO: 302733 - RNA, 22 nt, Human
uccguggacaccuuccuuuccc

SEQ ID NO: 302734 - RNA, 21 nt, Human
ugaugcaugcacuuuuuccuc

SEQ ID NO: 302735 - RNA, 21 nt, Human
ugaugcaugcacuuuuuccuc

SEQ ID NO: 302736 - RNA, 23 nt, Human
ugcagggaaagaaauggacaaau

SEQ ID NO: 302737 - RNA, 23 nt, Human
ugccuaugugcgaagggaggggg

SEQ ID NO: 302738 - RNA, 23 nt, Human
ugccuaugugcgaagggaggggg

SEQ ID NO: 302739 - RNA, 20 nt, Human
ugcuagguagauggggagag

SEQ ID NO: 302740 - RNA, 20 nt, Human
ugcuagguagauggggagag

SEQ ID NO: 302741 - RNA, 20 nt, Human
ugcugaaaagacacugauca

SEQ ID NO: 302742 - RNA, 20 nt, Human
ugcugaaaagacacugauca

SEQ ID NO: 302743 - RNA, 23 nt, Human
uggaagcaaaccaaaugccuaug

SEQ ID NO: 302744 - RNA, 23 nt, Human
uggaagcaaaccaaaugccuaug

SEQ ID NO: 302745 - RNA, 24 nt, Human
uggaauaaauuuauuucaucuguc

SEQ ID NO: 302746 - RNA, 24 nt, Human
uggaauaaauuuauuucaucuguc

SEQ ID NO: 302747 - RNA, 23 nt, Human
uggcaugcccccuccccccaauu

SEQ ID NO: 302748 - RNA, 23 nt, Human
uggcaugcccccuccccccaauu

SEQ ID NO: 302749 - RNA, 20 nt, Human
ugggaggaagugcuuuuugc

SEQ ID NO: 302750 - RNA, 20 nt, Human
ugggaggaagugcuuuuugc

SEQ ID NO: 302751 - RNA, 23 nt, Human
uggggggggagggcagaaagaaa

SEQ ID NO: 302752 - RNA, 27 nt, Human
uguccuguagacacuaugaauaaaggu

SEQ ID NO: 302753 - RNA, 27 nt, Human
uguccuguagacacuaugaauaaaggu

SEQ ID NO: 302754 - RNA, 23 nt, Human
ugugcgaagggaggggggggcgg

SEQ ID NO: 302755 - RNA, 23 nt, Human
ugugcgaagggaggggggggcgg

SEQ ID NO: 302756 - RNA, 25 nt, Human
uuaaaaaaaaacaggcacugcauaa

SEQ ID NO: 302757 - RNA, 25 nt, Human
uuaaaaaaaaacaggcacugcauaa

SEQ ID NO: 302758 - RNA, 18 nt, Human
uuagcuaccaucuacagu

SEQ ID NO: 302759 - RNA, 18 nt, Human
uuagcuaccaucuacagu

SEQ ID NO: 302760 - RNA, 23 nt, Human
uugguccuaugaagaacaaacug

SEQ ID NO: 302761 - RNA, 23 nt, Human
uugguccuaugaagaacaaacug

SEQ ID NO: 302762 - RNA, 23 nt, Human
uugguuggaauaaauuuauuuca

SEQ ID NO: 302763 - RNA, 25 nt, Human
uuguuuugccauugcacucuucaua

SEQ ID NO: 302764 - RNA, 25 nt, Human
uuguuuugccauugcacucuucaua

SEQ ID NO: 302765 - RNA, 19 nt, Human
uuuuggggggggagggcag

SEQ ID NO: 302766 - RNA, 22 nt, Human
uuuuuccucccaaccaugcgcu

SEQ ID NO: 302767 - RNA, 22 nt, Human
uuuuuccucccaaccaugcgcu

SEQ ID NO: 302768 - RNA, 21 nt, Human
uuuuuuuuuuuuuugguugga

SEQ ID NO: 302769 - RNA, 21 nt, Human
uuuuuuuuuuuuuuuuugguu

SEQ ID NO: 302770 - RNA, 23 nt, Human
uuuuuuuuuuuuuuuuugguugg

SEQ ID NO: 302771 - RNA, 20 nt, Human
uuuuuuuuuuuuuuuuuugg

SEQ ID NO: 302772 - RNA, 18 nt, Human
aaccugugcucuagaacu

SEQ ID NO: 302773 - RNA, 24 nt, Human
aagcaacuagaacaugauucagaa

SEQ ID NO: 302774 - RNA, 20 nt, Human
acaaagcacucgcaaaaacc

SEQ ID NO: 302775 - RNA, 18 nt, Human
acaagaaaccccagaagg

SEQ ID NO: 302776 - RNA, 20 nt, Human
acuccgcucauggggacaga

SEQ ID NO: 302777 - RNA, 24 nt, Human
agaaccugugcucuagaacugcua

SEQ ID NO: 302778 - RNA, 19 nt, Human
aggcaggaagggauucuaa

SEQ ID NO: 302779 - RNA, 21 nt, Human
aguaggcagugaccugacugc

SEQ ID NO: 302780 - RNA, 19 nt, Human
augaagggagugggugcag

SEQ ID NO: 302781 - RNA, 22 nt, Human
caaccgccacaagaaaccccag

SEQ ID NO: 302782 - RNA, 26 nt, Human
cacuccugccccucagaggucaagga

SEQ ID NO: 302783 - RNA, 24 nt, Human
cacugccaugaaacaaggcaggaa

SEQ ID NO: 302784 - RNA, 27 nt, Human
cacugccaugaaacaaggcaggaaggg

SEQ ID NO: 302785 - RNA, 23 nt, Human
cagguuacauucgucuuccacug

SEQ ID NO: 302786 - RNA, 20 nt, Human
cauuucacugccaugaaaca

SEQ ID NO: 302787 - RNA, 24 nt, Human
ccacaagaaaccccagaaggguua

SEQ ID NO: 302788 - RNA, 23 nt, Human
cgccacaagaaaccccagaaggg

SEQ ID NO: 302789 - RNA, 20 nt, Human
cuaauacacacaccaggaag

SEQ ID NO: 302790 - RNA, 24 nt, Human
cucaagaugucuacagaugugguc

SEQ ID NO: 302791 - RNA, 21 nt, Human
cuccccaaaguccuuaguaaa

SEQ ID NO: 302792 - RNA, 23 nt, Human
cucgcaaaaacccaagucacuac

SEQ ID NO: 302793 - RNA, 21 nt, Human
cuuagacugagaaccugugcu

SEQ ID NO: 302794 - RNA, 20 nt, Human
cuuggacaggaccaagaggc

SEQ ID NO: 302795 - RNA, 25 nt, Human
gaagcacuccugccccucagagguc

SEQ ID NO: 302796 - RNA, 19 nt, Human
gagcagaggacagacuccg

SEQ ID NO: 302797 - RNA, 21 nt, Human
gcagaggacagacuccgcuca

SEQ ID NO: 302798 - RNA, 24 nt, Human
gcagguuacauucgucuuccacug

SEQ ID NO: 302799 - RNA, 22 nt, Human
ggagcuuuuccauagcuuagac

SEQ ID NO: 302800 - RNA, 19 nt, Human
gggacagacaggcucuguu

SEQ ID NO: 302801 - RNA, 21 nt, Human
gucagugugacaugugcaggu

SEQ ID NO: 302802 - RNA, 21 nt, Human
guuauuguuuuguauuauaua

SEQ ID NO: 302803 - RNA, 24 nt, Human
uaaacaaagcacucgcaaaaaccc

SEQ ID NO: 302804 - RNA, 24 nt, Human
uaaauuaacacauaacgaaauuca

SEQ ID NO: 302805 - RNA, 23 nt, Human
uacaguuaugcucagaugaacac

SEQ ID NO: 302806 - RNA, 24 nt, Human
uagaacaugauucagaaaucagug

SEQ ID NO: 302807 - RNA, 24 nt, Human
uagcaugguuccuccccaaagucc

SEQ ID NO: 302808 - RNA, 24 nt, Human
uauuauacugauauggaaaaagga

SEQ ID NO: 302809 - RNA, 20 nt, Human
ucacugccaugaaacaaggc

SEQ ID NO: 302810 - RNA, 20 nt, Human
ucagaugaacacuggaccca

SEQ ID NO: 302811 - RNA, 18 nt, Human
ucauggggacagacaggc

SEQ ID NO: 302812 - RNA, 19 nt, Human
uccauagcuuagacugaga

SEQ ID NO: 302813 - RNA, 19 nt, Human
ucccaaccuagagccagau

SEQ ID NO: 302814 - RNA, 21 nt, Human
uccccaaaguccuuaguaaac

SEQ ID NO: 302815 - RNA, 23 nt, Human
uccccaaaguccuuaguaaacaa

SEQ ID NO: 302816 - RNA, 24 nt, Human
uggaaugacuagagcccccaggca

SEQ ID NO: 302817 - RNA, 24 nt, Human
uggcuuagcaugguuccuccccaa

SEQ ID NO: 302818 - RNA, 21 nt, Human
uggggucagggaggaaacagu

SEQ ID NO: 302819 - RNA, 18 nt, Human
uguggucagugugacaug

SEQ ID NO: 302820 - RNA, 19 nt, Human
uggcagcagggaccacaga

SEQ ID NO: 302821 - RNA, 18 nt, Human
aaaaagaaggcugaaucc

SEQ ID NO: 302822 - RNA, 26 nt, Human
aaaagaaggcugaauccagaguggaa

SEQ ID NO: 302823 - RNA, 19 nt, Human
agaggaagagcagcucuga

SEQ ID NO: 302824 - RNA, 19 nt, Human
agaguggaaagacagauac

SEQ ID NO: 302825 - RNA, 18 nt, Human
cagaguccagaaaaagaa

SEQ ID NO: 302826 - RNA, 18 nt, Human
cagggucaagaggaagag

SEQ ID NO: 302827 - RNA, 19 nt, Human
cagggucaagaggaagagg

SEQ ID NO: 302828 - RNA, 20 nt, Human
gaagagcagcucugaguucu

SEQ ID NO: 302829 - RNA, 19 nt, Human
gcccuaggagggugcaggg

SEQ ID NO: 302830 - RNA, 25 nt, Human
ggaaagacagauacaaugcccuagg

SEQ ID NO: 302831 - RNA, 18 nt, Human
ggugcagggucaagagga

SEQ ID NO: 302832 - RNA, 18 nt, Human
ggugcagggucaagagga

SEQ ID NO: 302833 - RNA, 25 nt, Human
ggugcagggucaagaggaagagggg

SEQ ID NO: 302834 - RNA, 23 nt, Human
gucaagaggaagaggggagccca

SEQ ID NO: 302835 - RNA, 20 nt, Human
guggaaagacagauacaaug

SEQ ID NO: 302836 - RNA, 18 nt, Human
uagagaaaguccagaguc

SEQ ID NO: 302837 - RNA, 28 nt, Human
uccagaguccagaaaaagaaggcugaau

SEQ ID NO: 302838 - RNA, 19 nt, Human
uccagaguggaaagacaga

SEQ ID NO: 302839 - RNA, 23 nt, Human
ugcagggucaagaggaagagggg

SEQ ID NO: 302840 - RNA, 18 nt, Human
ugcccuaggagggugcag

SEQ ID NO: 302841 - RNA, 19 nt, Human
uggaaagacagauacaaug

SEQ ID NO: 302842 - RNA, 26 nt, Human
aaaaaaaaaaaaaaagacgaaagaag

SEQ ID NO: 302843 - RNA, 25 nt, Human
aaaaaaaaaaaaagacgaaagaaaa

SEQ ID NO: 302844 - RNA, 20 nt, Human
aaagccccugguguguccuc

SEQ ID NO: 302845 - RNA, 25 nt, Human
aacagaaaauagggcaaaggggacc

SEQ ID NO: 302846 - RNA, 19 nt, Human
acccgcagcggcucccucc

SEQ ID NO: 302847 - RNA, 24 nt, Human
acguccauguacccauugcccaau

SEQ ID NO: 302848 - RNA, 23 nt, Human
agagggcaugguggcucucacag

SEQ ID NO: 302849 - RNA, 23 nt, Human
aggaaaaagggaauucagccgca

SEQ ID NO: 302850 - RNA, 18 nt, Human
agggaaagacccgcagcg

SEQ ID NO: 302851 - RNA, 20 nt, Human
auaaagaaugucacgcacag

SEQ ID NO: 302852 - RNA, 22 nt, Human
caaaaaaaaaaaaaaaaaaaaa

SEQ ID NO: 302853 - RNA, 21 nt, Human
cagagugcgcaaacacccuuc

SEQ ID NO: 302854 - RNA, 20 nt, Human
cauguacccauugcccaauu

SEQ ID NO: 302855 - RNA, 20 nt, Human
ccaggagcaaaaaaaaaaaa

SEQ ID NO: 302856 - RNA, 26 nt, Human
ccaggagcaaaaaaaaaaaaaaaaaa

SEQ ID NO: 302857 - RNA, 19 nt, Human
cccgcagcggcucccucca

SEQ ID NO: 302858 - RNA, 21 nt, Human
cgaggugagacuaagaaucug

SEQ ID NO: 302859 - RNA, 21 nt, Human
cggacagagcagaaccgaaga

SEQ ID NO: 302860 - RNA, 22 nt, Human
cuugccaggagcaaaaaaaaaa

SEQ ID NO: 302861 - RNA, 18 nt, Human
gaaguauuugacauacaa

SEQ ID NO: 302862 - RNA, 19 nt, Human
gacccgcagcggcucccuc

SEQ ID NO: 302863 - RNA, 21 nt, Human
ggaaaaagggaauucagccgc

SEQ ID NO: 302864 - RNA, 20 nt, Human
ggaagccacugccgcaagga

SEQ ID NO: 302865 - RNA, 19 nt, Human
ggugacaggagcagcauga

SEQ ID NO: 302866 - RNA, 21 nt, Human
guaaaggaaaaagggaauuca

SEQ ID NO: 302867 - RNA, 19 nt, Human
uaaacugugugucuuccuc

SEQ ID NO: 302868 - RNA, 21 nt, Human
uacagugaacguccauguacc

SEQ ID NO: 302869 - RNA, 19 nt, Human
uagggcaaagggccaggug

SEQ ID NO: 302870 - RNA, 23 nt, Human
ucaggagucucuuacaacacuuu

SEQ ID NO: 302871 - RNA, 20 nt, Human
uccauguacccauugcccaa

SEQ ID NO: 302872 - RNA, 19 nt, Human
ucuguggaaucguggaggg

SEQ ID NO: 302873 - RNA, 20 nt, Human
ugacauacaaaaagccauaa

SEQ ID NO: 302874 - RNA, 21 nt, Human
ugacauacaaaaagccauaaa

SEQ ID NO: 302875 - RNA, 24 nt, Human
ugacauacaaaaagccauaaagaa

SEQ ID NO: 302876 - RNA, 18 nt, Human
ugagacuaagaaucugga

SEQ ID NO: 302877 - RNA, 21 nt, Human
ugagcagcuccuggucagucc

SEQ ID NO: 302878 - RNA, 23 nt, Human
ugagcagcuccuggucaguccca

SEQ ID NO: 302879 - RNA, 18 nt, Human
ugaguaaaggaaaaaggg

SEQ ID NO: 302880 - RNA, 19 nt, Human
ugaguaaaggaaaaaggga

SEQ ID NO: 302881 - RNA, 22 nt, Human
ugccaggagcaaaaaaaaaaaa

SEQ ID NO: 302882 - RNA, 18 nt, Human
ugccaugaggcacaugga

SEQ ID NO: 302883 - RNA, 19 nt, Human
ugccugccuccucugagug

SEQ ID NO: 302884 - RNA, 19 nt, Human
ugcgugaugggaaccgcac

SEQ ID NO: 302885 - RNA, 22 nt, Human
uuaaagccccugguguguccuc

SEQ ID NO: 302886 - RNA, 18 nt, Human
aagcaaauggcaaagugu

SEQ ID NO: 302887 - RNA, 19 nt, Human
aagcccccaggcaaccacu

SEQ ID NO: 302888 - RNA, 23 nt, Human
aagccuugcggagucaggagccc

SEQ ID NO: 302889 - RNA, 20 nt, Human
agcggaagcucccagggguc

SEQ ID NO: 302890 - RNA, 21 nt, Human
agcuugugggggugccagggc

SEQ ID NO: 302891 - RNA, 21 nt, Human
aggcaaccacuguucuccaga

SEQ ID NO: 302892 - RNA, 23 nt, Human
aggcaaccacuguucuccagagc

SEQ ID NO: 302893 - RNA, 18 nt, Human
aggcagcucuuucuccag

SEQ ID NO: 302894 - RNA, 19 nt, Human
aggcauucagcagggaaac

SEQ ID NO: 302895 - RNA, 23 nt, Human
auccaggcagcucuuucuccagc

SEQ ID NO: 302896 - RNA, 19 nt, Human
caaaagcccccaggcaacc

SEQ ID NO: 302897 - RNA, 23 nt, Human
caaagcggaagcucccagggguc

SEQ ID NO: 302898 - RNA, 20 nt, Human
caagagaaucuggcuuggca

SEQ ID NO: 302899 - RNA, 22 nt, Human
caccuuggccggaaagaacaau

SEQ ID NO: 302900 - RNA, 21 nt, Human
cagagccugaggcccaagaac

SEQ ID NO: 302901 - RNA, 24 nt, Human
caggagcccguagguaaggcugug

SEQ ID NO: 302902 - RNA, 19 nt, Human
caggagucacugaagagug

SEQ ID NO: 302903 - RNA, 20 nt, Human
cagggccucuggggccuagc

SEQ ID NO: 302904 - RNA, 23 nt, Human
cagguccucccguagcugggccg

SEQ ID NO: 302905 - RNA, 20 nt, Human
caguacaagcaaauggcaaa

SEQ ID NO: 302906 - RNA, 21 nt, Human
ccagggcccuuggggaaccug

SEQ ID NO: 302907 - RNA, 21 nt, Human
ccagggccucuggggccuagc

SEQ ID NO: 302908 - RNA, 20 nt, Human
ccagggggcuccgagggaaa

SEQ ID NO: 302909 - RNA, 22 nt, Human
ccccaggcaaccacuguucucc

SEQ ID NO: 302910 - RNA, 24 nt, Human
cccccaggcaaccacuguucucca

SEQ ID NO: 302911 - RNA, 18 nt, Human
cccccggggagccccugg

SEQ ID NO: 302912 - RNA, 21 nt, Human
ccccgaggccccggccggugg

SEQ ID NO: 302913 - RNA, 18 nt, Human
ccccuggagaccuccagg

SEQ ID NO: 302914 - RNA, 21 nt, Human
ccccuggagaccuccagggcc

SEQ ID NO: 302915 - RNA, 25 nt, Human
ccccuggagaccuccagggccucug

SEQ ID NO: 302916 - RNA, 22 nt, Human
cccguagcugggcggccguccg

SEQ ID NO: 302917 - RNA, 23 nt, Human
cccuggugaccucauccccacug

SEQ ID NO: 302918 - RNA, 23 nt, Human
cccuucuuuccuucugcaggccc

SEQ ID NO: 302919 - RNA, 19 nt, Human
ccgcugccggccuucccac

SEQ ID NO: 302920 - RNA, 27 nt, Human
ccggccggugguucgagcaucuucugg

SEQ ID NO: 302921 - RNA, 19 nt, Human
ccuccagggccucuggggc

SEQ ID NO: 302922 - RNA, 23 nt, Human
ccuccagggccucuggggccuag

SEQ ID NO: 302923 - RNA, 22 nt, Human
ccucccucacugcugccccgag

SEQ ID NO: 302924 - RNA, 19 nt, Human
ccuccgcagacagcagccu

SEQ ID NO: 302925 - RNA, 21 nt, Human
ccucuggggccuagcuugccc

SEQ ID NO: 302926 - RNA, 22 nt, Human
ccuucagcugggacgcacaggc

SEQ ID NO: 302927 - RNA, 24 nt, Human
ccuuggccggaaagaaccgggguc

SEQ ID NO: 302928 - RNA, 18 nt, Human
cgacggggagcggcccgg

SEQ ID NO: 302929 - RNA, 21 nt, Human
cgagcaucuucuggaagccuu

SEQ ID NO: 302930 - RNA, 20 nt, Human
cuccgagggaaaaccaccau

SEQ ID NO: 302931 - RNA, 19 nt, Human
cucuggggccuagcuugcc

SEQ ID NO: 302932 - RNA, 20 nt, Human
cugcuccccugccacugccu

SEQ ID NO: 302933 - RNA, 21 nt, Human
cugcuccccugccacugccuu

SEQ ID NO: 302934 - RNA, 19 nt, Human
cuucugcaggccccuggag

SEQ ID NO: 302935 - RNA, 21 nt, Human
cuugccccucacgaggccacg

SEQ ID NO: 302936 - RNA, 19 nt, Human
gaaccugcuccccugccac

SEQ ID NO: 302937 - RNA, 23 nt, Human
gaaccugcuccccugccacugcc

SEQ ID NO: 302938 - RNA, 20 nt, Human
gaagaagagggggaaguggc

SEQ ID NO: 302939 - RNA, 21 nt, Human
gaagccuugcggagucaggag

SEQ ID NO: 302940 - RNA, 18 nt, Human
gaccucauccccacuggc

SEQ ID NO: 302941 - RNA, 22 nt, Human
gcagguaccagcaggagucacu

SEQ ID NO: 302942 - RNA, 18 nt, Human
gccagggcccuuggggaa

SEQ ID NO: 302943 - RNA, 23 nt, Human
gcccugcagggacagcuuguggg

SEQ ID NO: 302944 - RNA, 18 nt, Human
gcccuuggggaaccugcu

SEQ ID NO: 302945 - RNA, 22 nt, Human
gcccuuggggaaccugcucccc

SEQ ID NO: 302946 - RNA, 19 nt, Human
ggagaccuccagggccucu

SEQ ID NO: 302947 - RNA, 23 nt, Human
ggagcgaggcauucagcagggaa

SEQ ID NO: 302948 - RNA, 24 nt, Human
ggcccuuggggaaccugcuccccu

SEQ ID NO: 302949 - RNA, 26 nt, Human
ggccggugguucgagcaucuucugga

SEQ ID NO: 302950 - RNA, 18 nt, Human
gggaacccgacggggagc

SEQ ID NO: 302951 - RNA, 22 nt, Human
gggcgcccagugccacuccagg

SEQ ID NO: 302952 - RNA, 20 nt, Human
ggggucuguggcuggcuucg

SEQ ID NO: 302953 - RNA, 18 nt, Human
ggucucucuccuccaagg

SEQ ID NO: 302954 - RNA, 21 nt, Human
uaauaaauagagggcagguac

SEQ ID NO: 302955 - RNA, 20 nt, Human
uacaagcaaauggcaaagug

SEQ ID NO: 302956 - RNA, 27 nt, Human
uccacacuagaauacuuuauucaagag

SEQ ID NO: 302957 - RNA, 19 nt, Human
ucccaggggucuguggcug

SEQ ID NO: 302958 - RNA, 23 nt, Human
uccccugccacugccuucagcug

SEQ ID NO: 302959 - RNA, 23 nt, Human
ucccuacuuuuggacaggagcug

SEQ ID NO: 302960 - RNA, 21 nt, Human
ucccugccccucgucuugaag

SEQ ID NO: 302961 - RNA, 20 nt, Human
uccgcagacagcagccucgu

SEQ ID NO: 302962 - RNA, 21 nt, Human
ucucagacgucccgagccagg

SEQ ID NO: 302963 - RNA, 18 nt, Human
ucucuuagggggggcagg

SEQ ID NO: 302964 - RNA, 18 nt, Human
ugccccgaggccccggcc

SEQ ID NO: 302965 - RNA, 23 nt, Human
ugcuccccugccacugccuucag

SEQ ID NO: 302966 - RNA, 22 nt, Human
uggagaccuccagggccucugg

SEQ ID NO: 302967 - RNA, 23 nt, Human
uggcacaggaggagaagagcuga

SEQ ID NO: 302968 - RNA, 23 nt, Human
uggcuaauaaauagagggcaggu

SEQ ID NO: 302969 - RNA, 19 nt, Human
uggcuggauccccuccgcc

SEQ ID NO: 302970 - RNA, 20 nt, Human
uggcuggggaacccgacggg

SEQ ID NO: 302971 - RNA, 25 nt, Human
uggugaccucauccccacuggcuga

SEQ ID NO: 302972 - RNA, 19 nt, Human
ugugaggggagaucacggg

SEQ ID NO: 302973 - RNA, 21 nt, Human
uuggggaaccugcuccccugc

SEQ ID NO: 302974 - RNA, 20 nt, Human
uuuuuuuuuuuuuuuuccac

SEQ ID NO: 302975 - RNA, 19 nt, Human
aaagagaacuaagcuaaca

SEQ ID NO: 302976 - RNA, 23 nt, Human
aaauauaugcacucuagaaugca

SEQ ID NO: 302977 - RNA, 18 nt, Human
aagcuaaucauaauaacc

SEQ ID NO: 302978 - RNA, 21 nt, Human
agaaaaugcuaaguugacuua

SEQ ID NO: 302979 - RNA, 22 nt, Human
aggguuccuggcacugcaucuc

SEQ ID NO: 302980 - RNA, 24 nt, Human
aggguuccuggcacugcaucucuu

SEQ ID NO: 302981 - RNA, 26 nt, Human
augcuaaguugacuuaggggcugugc

SEQ ID NO: 302982 - RNA, 23 nt, Human
caauggacacuuuuauuguuuac

SEQ ID NO: 302983 - RNA, 19 nt, Human
cagaaaaugcuaaguugac

SEQ ID NO: 302984 - RNA, 23 nt, Human
cuaacacugcucacuuucuuuuu

SEQ ID NO: 302985 - RNA, 20 nt, Human
gcacaggaacuaaaaggcag

SEQ ID NO: 302986 - RNA, 21 nt, Human
uaugcaaauccagggugcagu

SEQ ID NO: 302987 - RNA, 22 nt, Human
ucaaaagagaacuaagcuaaca

SEQ ID NO: 302988 - RNA, 20 nt, Human
ugaaacagugacaaagcuaa

SEQ ID NO: 302989 - RNA, 20 nt, Human
ugacauggaagguuuuagcu

SEQ ID NO: 302990 - RNA, 22 nt, Human
ugccgacgugcgcuccggaggc

SEQ ID NO: 302991 - RNA, 19 nt, Human
uucaaaugggaucuugaag

SEQ ID NO: 302992 - RNA, 24 nt, Human
uucaucuuguuuccaugcugagua

SEQ ID NO: 302993 - RNA, 21 nt, Human
uuggccacuagcugaaucuug

SEQ ID NO: 302994 - RNA, 25 nt, Human
agccacagccuguguguugagcccc

SEQ ID NO: 302995 - RNA, 21 nt, Human
aggggcccagccccaugggcc

SEQ ID NO: 302996 - RNA, 22 nt, Human
aguggcggccagcaggggccca

SEQ ID NO: 302997 - RNA, 19 nt, Human
cagcagcacgacguggcuu

SEQ ID NO: 302998 - RNA, 21 nt, Human
cagcagcagcacgacguggcu

SEQ ID NO: 302999 - RNA, 26 nt, Human
ccagcagcagcacgacguggcuuuuu

SEQ ID NO: 303000 - RNA, 19 nt, Human
ccccaugggccgcgugccu

SEQ ID NO: 303001 - RNA, 24 nt, Human
ccccaugggccgcgugccuggucc

SEQ ID NO: 303002 - RNA, 18 nt, Human
cuguuggcuuccagcagc

SEQ ID NO: 303003 - RNA, 20 nt, Human
gagaguggcggccagcaggg

SEQ ID NO: 303004 - RNA, 18 nt, Human
gagcccggagaguggcgg

SEQ ID NO: 303005 - RNA, 21 nt, Human
ggcugcuggccggaggcuguu

SEQ ID NO: 303006 - RNA, 27 nt, Human
guguguugagccccggguagggcugcu

SEQ ID NO: 303007 - RNA, 21 nt, Human
ugagccccggguagggcugcu

SEQ ID NO: 303008 - RNA, 19 nt, Human
ugccuggucccagcugcgg

SEQ ID NO: 303009 - RNA, 25 nt, Human
uggucccagcugcggcgucccucug

SEQ ID NO: 303010 - RNA, 25 nt, Human
uguccagagccacagccuguguguu

SEQ ID NO: 303011 - RNA, 25 nt, Human
uguguugagccccggguagggcugc

SEQ ID NO: 303012 - RNA, 19 nt, Human
aaaggaacuugcaccauca

SEQ ID NO: 303013 - RNA, 19 nt, Human
accugauggcuaaggagac

SEQ ID NO: 303014 - RNA, 23 nt, Human
acgcagcagcaaugcaggagggc

SEQ ID NO: 303015 - RNA, 22 nt, Human
agacaaauacccacgcagcagc

SEQ ID NO: 303016 - RNA, 26 nt, Human
agcaaugcaggagggcaugaaaagga

SEQ ID NO: 303017 - RNA, 20 nt, Human
aggaaagaacugauuggaca

SEQ ID NO: 303018 - RNA, 23 nt, Human
aggaaagaacugauuggacagaa

SEQ ID NO: 303019 - RNA, 19 nt, Human
aggcacuagaaauugcauu

SEQ ID NO: 303020 - RNA, 21 nt, Human
aggcagaaaucuguagccaag

SEQ ID NO: 303021 - RNA, 20 nt, Human
cacauccuaaggaugaagaa

SEQ ID NO: 303022 - RNA, 25 nt, Human
caccaucauuucauugccacauccu

SEQ ID NO: 303023 - RNA, 21 nt, Human
caggggacagggcccucccuc

SEQ ID NO: 303024 - RNA, 21 nt, Human
cauuuuguuucugucaugcuc

SEQ ID NO: 303025 - RNA, 27 nt, Human
ccgcagguccucuuucccucacagcuc

SEQ ID NO: 303026 - RNA, 18 nt, Human
ccggcguuuggcccuccu

SEQ ID NO: 303027 - RNA, 22 nt, Human
ccucuuucccucacagcuccca

SEQ ID NO: 303028 - RNA, 23 nt, Human
cuaagcccgcagguccucuuucc

SEQ ID NO: 303029 - RNA, 23 nt, Human
cucagaggaaagaacugauugga

SEQ ID NO: 303030 - RNA, 20 nt, Human
cuccgcgccagcccaccucc

SEQ ID NO: 303031 - RNA, 20 nt, Human
gaaagauucacaaaagagaa

SEQ ID NO: 303032 - RNA, 19 nt, Human
gcagaaaucuguagccaag

SEQ ID NO: 303033 - RNA, 18 nt, Human
gcccgcagguccucuuuc

SEQ ID NO: 303034 - RNA, 20 nt, Human
gcccucccuccgcgccagcc

SEQ ID NO: 303035 - RNA, 20 nt, Human
gccgggggucagagcggcgg

SEQ ID NO: 303036 - RNA, 26 nt, Human
gcuuauuuuccuuuauuaucccaaaa

SEQ ID NO: 303037 - RNA, 21 nt, Human
ggacuuggcuggcggaggggc

SEQ ID NO: 303038 - RNA, 23 nt, Human
gugaaugggacaaugucgcaaaa

SEQ ID NO: 303039 - RNA, 21 nt, Human
ucagagcggcggacuuggcug

SEQ ID NO: 303040 - RNA, 23 nt, Human
ucccucacagcucccaagggcug

SEQ ID NO: 303041 - RNA, 27 nt, Human
ucuggggugagggcacggcgggugggg

SEQ ID NO: 303042 - RNA, 18 nt, Human
ugagggcacggcgggugg

SEQ ID NO: 303043 - RNA, 22 nt, Human
ugagggcacggcgggugggggc

SEQ ID NO: 303044 - RNA, 23 nt, Human
uggauggguccggggguggaggg

SEQ ID NO: 303045 - RNA, 21 nt, Human
uggcuaaggagacaaauaccc

SEQ ID NO: 303046 - RNA, 18 nt, Human
uguagccaaguacgucuc

SEQ ID NO: 303047 - RNA, 21 nt, Human
uguaguguaaacuguaccuga

SEQ ID NO: 303048 - RNA, 20 nt, Human
uguuggguuacauguaaaca

SEQ ID NO: 303049 - RNA, 23 nt, Human
uucccucacagcucccaagggca

SEQ ID NO: 303050 - RNA, 23 nt, Human
uuuggcccuccuccuuaaaggga

SEQ ID NO: 303051 - RNA, 18 nt, Human
uuuuuuuuuuuuuuuuug

SEQ ID NO: 303052 - RNA, 19 nt, Human
uuuuuuuuuuuuuuuuugu

SEQ ID NO: 303053 - RNA, 23 nt, Human
aauauaggggcagagggaggaga

SEQ ID NO: 303054 - RNA, 21 nt, Human
acuccccuuuucuccuccccc

SEQ ID NO: 303055 - RNA, 18 nt, Human
aggaggaggggguuucgg

SEQ ID NO: 303056 - RNA, 24 nt, Human
agggaggagggaaaagggaaggag

SEQ ID NO: 303057 - RNA, 24 nt, Human
aggggguuucgggaauauaggggc

SEQ ID NO: 303058 - RNA, 18 nt, Human
ccccuuuucuccuccccc

SEQ ID NO: 303059 - RNA, 23 nt, Human
ccccuuuucuccucccccgucuc

SEQ ID NO: 303060 - RNA, 28 nt, Human
ccccuuuucuccucccccgucuccaggg

SEQ ID NO: 303061 - RNA, 20 nt, Human
ccuccugggucgggggcggg

SEQ ID NO: 303062 - RNA, 21 nt, Human
cggagggaucuccaccuccug

SEQ ID NO: 303063 - RNA, 20 nt, Human
cgggaauauaggggcagagg

SEQ ID NO: 303064 - RNA, 29 nt, Human
cuccccuuuucuccucccccgucuccccu

SEQ ID NO: 303065 - RNA, 22 nt, Human
cuggacuccccuuuucuccucc

SEQ ID NO: 303066 - RNA, 24 nt, Human
gaucuccaccuccugggucggggg

SEQ ID NO: 303067 - RNA, 29 nt, Human
ggaggagggaaaagggaaggaggaggggg

SEQ ID NO: 303068 - RNA, 21 nt, Human
ggggcagagggaggagaaagu

SEQ ID NO: 303069 - RNA, 25 nt, Human
uaauucuuuaaaagaaaaagaugac

SEQ ID NO: 303070 - RNA, 20 nt, Human
uccaccuccugggucggggg

SEQ ID NO: 303071 - RNA, 24 nt, Human
uccagggaggagggaaaagggaag

SEQ ID NO: 303072 - RNA, 18 nt, Human
uggcuggaccggagggau

SEQ ID NO: 303073 - RNA, 22 nt, Human
ugggucgggggcgggggagggc

SEQ ID NO: 303074 - RNA, 21 nt, Human
aagucuucaacaggacucaca

SEQ ID NO: 303075 - RNA, 26 nt, Human
acacaccuguuuccgcuggucacaca

SEQ ID NO: 303076 - RNA, 19 nt, Human
acagcaguuuauacacauu

SEQ ID NO: 303077 - RNA, 24 nt, Human
accugcuuccacucugaccuccac

SEQ ID NO: 303078 - RNA, 18 nt, Human
aggaaggcuguguuaaga

SEQ ID NO: 303079 - RNA, 22 nt, Human
aggaaggcuguguuaagaauca

SEQ ID NO: 303080 - RNA, 21 nt, Human
aggcagacaccugugcucccc

SEQ ID NO: 303081 - RNA, 25 nt, Human
auagagcccgugagaagggcagucu

SEQ ID NO: 303082 - RNA, 24 nt, Human
caacaggacucacaucucggucca

SEQ ID NO: 303083 - RNA, 22 nt, Human
cacagugauuucugggguggga

SEQ ID NO: 303084 - RNA, 22 nt, Human
cacauacugccccgccugcgug

SEQ ID NO: 303085 - RNA, 18 nt, Human
cagcagcaucugcacagg

SEQ ID NO: 303086 - RNA, 22 nt, Human
cagcagcaucugcacaggaacc

SEQ ID NO: 303087 - RNA, 19 nt, Human
cagcaucugcacaggaacc

SEQ ID NO: 303088 - RNA, 21 nt, Human
cagcaucugcacaggaaccgc

SEQ ID NO: 303089 - RNA, 22 nt, Human
cagcccgcggaggugcaggcag

SEQ ID NO: 303090 - RNA, 23 nt, Human
cagcccgcggagguggcgguccg

SEQ ID NO: 303091 - RNA, 20 nt, Human
caucggggcuguggcccagu

SEQ ID NO: 303092 - RNA, 20 nt, Human
ccaguccaucacauacugcc

SEQ ID NO: 303093 - RNA, 23 nt, Human
cccagugcaggcauagagcccgu

SEQ ID NO: 303094 - RNA, 22 nt, Human
ccugcgugcugccaaaugcugg

SEQ ID NO: 303095 - RNA, 19 nt, Human
ccuucugcuggacccucuc

SEQ ID NO: 303096 - RNA, 21 nt, Human
cgcugggaagacggaggccug

SEQ ID NO: 303097 - RNA, 23 nt, Human
cuaaagcugguuugcauaggcac

SEQ ID NO: 303098 - RNA, 19 nt, Human
cuaggcagacaccugugcu

SEQ ID NO: 303099 - RNA, 22 nt, Human
cugcacaggaaccgcugggaag

SEQ ID NO: 303100 - RNA, 20 nt, Human
cugccccgccugcgugcugc

SEQ ID NO: 303101 - RNA, 19 nt, Human
cuggacccucucacaccug

SEQ ID NO: 303102 - RNA, 22 nt, Human
cuggucacacaguuaaagagaa

SEQ ID NO: 303103 - RNA, 18 nt, Human
cugugcuccccaguccau

SEQ ID NO: 303104 - RNA, 18 nt, Human
gaagggcagucucugaac

SEQ ID NO: 303105 - RNA, 20 nt, Human
gagcagaaggaaggcugugu

SEQ ID NO: 303106 - RNA, 21 nt, Human
gcagauucuucaaucugugcc

SEQ ID NO: 303107 - RNA, 19 nt, Human
gccacacguggaucuaggc

SEQ ID NO: 303108 - RNA, 18 nt, Human
gccccgccugcgugcugc

SEQ ID NO: 303109 - RNA, 18 nt, Human
gcccgugagaagggcagu

SEQ ID NO: 303110 - RNA, 20 nt, Human
gcuuccacucugaccuccac

SEQ ID NO: 303111 - RNA, 26 nt, Human
ggacccucucacaccugcuuccacuc

SEQ ID NO: 303112 - RNA, 19 nt, Human
guccaggccuccucucuca

SEQ ID NO: 303113 - RNA, 19 nt, Human
uaacagacagaccacuucc

SEQ ID NO: 303114 - RNA, 24 nt, Human
uaacagacagaccacuuccucucu

SEQ ID NO: 303115 - RNA, 18 nt, Human
uagauggaugugagaaga

SEQ ID NO: 303116 - RNA, 18 nt, Human
uaugguaacagacagacc

SEQ ID NO: 303117 - RNA, 19 nt, Human
uaugguaacagacagacca

SEQ ID NO: 303118 - RNA, 23 nt, Human
ucagugacaggacggaggccaca

SEQ ID NO: 303119 - RNA, 21 nt, Human
ucugaagugauuuuaccuuua

SEQ ID NO: 303120 - RNA, 19 nt, Human
ucugcuggacccucucaca

SEQ ID NO: 303121 - RNA, 20 nt, Human
ugaaauuucacagugauuuc

SEQ ID NO: 303122 - RNA, 19 nt, Human
ugaauuccccaaccacaca

SEQ ID NO: 303123 - RNA, 21 nt, Human
ugaauuccccaaccacacaua

SEQ ID NO: 303124 - RNA, 24 nt, Human
ugacaggacggaggccacacgugg

SEQ ID NO: 303125 - RNA, 22 nt, Human
ugaccuccacaugaauucccuc

SEQ ID NO: 303126 - RNA, 20 nt, Human
ugaccuccacaugaauuccu

SEQ ID NO: 303127 - RNA, 21 nt, Human
ugcccaggccggaacuccagc

SEQ ID NO: 303128 - RNA, 22 nt, Human
uggacccucucacaccugcuuc

SEQ ID NO: 303129 - RNA, 18 nt, Human
ugggagcagaaggaaggc

SEQ ID NO: 303130 - RNA, 23 nt, Human
uggggugggagcagaaggaaggc

SEQ ID NO: 303131 - RNA, 24 nt, Human
uggggugggagcagaaggaaggcu

SEQ ID NO: 303132 - RNA, 22 nt, Human
ugguaacagacagaccacuucc

SEQ ID NO: 303133 - RNA, 22 nt, Human
uggugcccaggccggaacucca

SEQ ID NO: 303134 - RNA, 21 nt, Human
uguuaagaaucaucggggcug

SEQ ID NO: 303135 - RNA, 23 nt, Human
acaggaaggagcugaagagcaag

SEQ ID NO: 303136 - RNA, 22 nt, Human
acccugggagcaucucaagagg

SEQ ID NO: 303137 - RNA, 19 nt, Human
acugcugcaggagcaggga

SEQ ID NO: 303138 - RNA, 18 nt, Human
agaccccgcucagggcac

SEQ ID NO: 303139 - RNA, 22 nt, Human
agcauccucuuggaccaauagc

SEQ ID NO: 303140 - RNA, 22 nt, Human
aggcaguccucucucgccgccu

SEQ ID NO: 303141 - RNA, 24 nt, Human
aggcaguccucucucgccgccucc

SEQ ID NO: 303142 - RNA, 19 nt, Human
aggcgaccugcuggugugu

SEQ ID NO: 303143 - RNA, 20 nt, Human
aggcggacaccgugagggcc

SEQ ID NO: 303144 - RNA, 22 nt, Human
agggaccacaggaccagggaca

SEQ ID NO: 303145 - RNA, 22 nt, Human
agggaccacaggaccagggaca

SEQ ID NO: 303146 - RNA, 19 nt, Human
agggcacccacugagccca

SEQ ID NO: 303147 - RNA, 19 nt, Human
agggcacccacugagccca

SEQ ID NO: 303148 - RNA, 20 nt, Human
aggguuggggcucucuccag

SEQ ID NO: 303149 - RNA, 19 nt, Human
agugcagcccaccaaggcc

SEQ ID NO: 303150 - RNA, 19 nt, Human
agugcagcccaccaaggcc

SEQ ID NO: 303151 - RNA, 20 nt, Human
agugcagcccaccaaggccu

SEQ ID NO: 303152 - RNA, 20 nt, Human
agugcagcccaccaaggccu

SEQ ID NO: 303153 - RNA, 26 nt, Human
agugcagcccaccaaggccugacguc

SEQ ID NO: 303154 - RNA, 26 nt, Human
agugcagcccaccaaggccugacguc

SEQ ID NO: 303155 - RNA, 21 nt, Human
caaaccacaggaaggagcuga

SEQ ID NO: 303156 - RNA, 22 nt, Human
caaggcggacaccgugagggcc

SEQ ID NO: 303157 - RNA, 21 nt, Human
cagccaccgaagacuacccga

SEQ ID NO: 303158 - RNA, 22 nt, Human
cagccugaaugguccuggaggc

SEQ ID NO: 303159 - RNA, 22 nt, Human
cagccugaaugguccuggaggc

SEQ ID NO: 303160 - RNA, 22 nt, Human
cagccugaaugguccuggaggc

SEQ ID NO: 303161 - RNA, 21 nt, Human
caguccucucucgccgccucc

SEQ ID NO: 303162 - RNA, 22 nt, Human
ccagcagcuguggauagggcag

SEQ ID NO: 303163 - RNA, 22 nt, Human
cccacugagcccaccgcgacuu

SEQ ID NO: 303164 - RNA, 22 nt, Human
cccacugagcccaccgcgacuu

SEQ ID NO: 303165 - RNA, 19 nt, Human
ccccggagccuccagguga

SEQ ID NO: 303166 - RNA, 19 nt, Human
ccccggagccuccagguga

SEQ ID NO: 303167 - RNA, 19 nt, Human
ccccggagccuccagguga

SEQ ID NO: 303168 - RNA, 18 nt, Human
ccccucccuuccccuccc

SEQ ID NO: 303169 - RNA, 23 nt, Human
cgcucagggcacccacugagccc

SEQ ID NO: 303170 - RNA, 23 nt, Human
cgcucagggcacccacugagccc

SEQ ID NO: 303171 - RNA, 23 nt, Human
cuccaggugagagugcagcccac

SEQ ID NO: 303172 - RNA, 23 nt, Human
cuccaggugagagugcagcccac

SEQ ID NO: 303173 - RNA, 23 nt, Human
cuccaggugagagugcagcccac

SEQ ID NO: 303174 - RNA, 22 nt, Human
cucccuuccccucccugugguu

SEQ ID NO: 303175 - RNA, 23 nt, Human
cuccuggggcuggcggccacaug

SEQ ID NO: 303176 - RNA, 20 nt, Human
cucgccgccuccucucccug

SEQ ID NO: 303177 - RNA, 20 nt, Human
cugcagccaccgaagacuac

SEQ ID NO: 303178 - RNA, 23 nt, Human
cuggucaggcuggaggcgaccug

SEQ ID NO: 303179 - RNA, 18 nt, Human
cugguuugaagguggagg

SEQ ID NO: 303180 - RNA, 20 nt, Human
cuuggaccaauagcaacugc

SEQ ID NO: 303181 - RNA, 21 nt, Human
gaccccgcucagggcacccac

SEQ ID NO: 303182 - RNA, 21 nt, Human
gaccccgcucagggcacccac

SEQ ID NO: 303183 - RNA, 19 nt, Human
gaccugcugguguguccuc

SEQ ID NO: 303184 - RNA, 19 nt, Human
gagagacaggcucagcugc

SEQ ID NO: 303185 - RNA, 21 nt, Human
gagaggggcagaggcgcagca

SEQ ID NO: 303186 - RNA, 20 nt, Human
gagcaucucaagaggcuggg

SEQ ID NO: 303187 - RNA, 19 nt, Human
gagcugaagagcaaggcgg

SEQ ID NO: 303188 - RNA, 23 nt, Human
gaggcagaugcuuccccggagcc

SEQ ID NO: 303189 - RNA, 21 nt, Human
gauggcaaaccacaggaagga

SEQ ID NO: 303190 - RNA, 18 nt, Human
gcugggcuccuggggcug

SEQ ID NO: 303191 - RNA, 20 nt, Human
gcugguuugaagguggaggg

SEQ ID NO: 303192 - RNA, 20 nt, Human
gcugguuugaagguggaggg

SEQ ID NO: 303193 - RNA, 20 nt, Human
ggaccacaggaccagggaca

SEQ ID NO: 303194 - RNA, 23 nt, Human
ggaccagggacaaggacuuggga

SEQ ID NO: 303195 - RNA, 23 nt, Human
ggaccagggacaaggacuuggga

SEQ ID NO: 303196 - RNA, 23 nt, Human
ggaccagggacaaggacuuggga

SEQ ID NO: 303197 - RNA, 22 nt, Human
ggagaggggcagaggcgcagca

SEQ ID NO: 303198 - RNA, 25 nt, Human
ggaggcagaugcuuccccggagccu

SEQ ID NO: 303199 - RNA, 25 nt, Human
ggaggcagaugcuuccccggagccu

SEQ ID NO: 303200 - RNA, 20 nt, Human
ggaugcccugaaggcagucc

SEQ ID NO: 303201 - RNA, 20 nt, Human
ggcacgggacugcugcagga

SEQ ID NO: 303202 - RNA, 24 nt, Human
ggcagccagguggcaggagagggg

SEQ ID NO: 303203 - RNA, 20 nt, Human
ggcaugggacugcugcagga

SEQ ID NO: 303204 - RNA, 24 nt, Human
ggcugggcuccuggggcuggcggc

SEQ ID NO: 303205 - RNA, 20 nt, Human
gggcagaggcgcagcaucgc

SEQ ID NO: 303206 - RNA, 21 nt, Human
uagggcagacucagagugugg

SEQ ID NO: 303207 - RNA, 23 nt, Human
ucaggguguauuugcccuugcgg

SEQ ID NO: 303208 - RNA, 20 nt, Human
ucuccugcagccaccgaaga

SEQ ID NO: 303209 - RNA, 18 nt, Human
ucucucgccgccuccucu

SEQ ID NO: 303210 - RNA, 25 nt, Human
ucucucgccgccuccucucccugac

SEQ ID NO: 303211 - RNA, 19 nt, Human
ugaagagcaaggcggacac

SEQ ID NO: 303212 - RNA, 20 nt, Human
ugagagacaggcucagcugc

SEQ ID NO: 303213 - RNA, 21 nt, Human
ugcagccaccgaagacuaccc

SEQ ID NO: 303214 - RNA, 28 nt, Human
uggagagcucugugggcagccagguggc

SEQ ID NO: 303215 - RNA, 28 nt, Human
uggagagcucugugggcagccagguggc

SEQ ID NO: 303216 - RNA, 24 nt, Human
uggcaaaccacaggaaggagcuga

SEQ ID NO: 303217 - RNA, 18 nt, Human
uggcaggagaggggcaga

SEQ ID NO: 303218 - RNA, 18 nt, Human
uggcaggagaggggcaga

SEQ ID NO: 303219 - RNA, 24 nt, Human
uggcaggagaggggcagaggcgca

SEQ ID NO: 303220 - RNA, 24 nt, Human
uggcaggagaggggcagaggcgca

SEQ ID NO: 303221 - RNA, 19 nt, Human
ugggcagccagguggcagg

SEQ ID NO: 303222 - RNA, 19 nt, Human
ugggcagccagguggcagg

SEQ ID NO: 303223 - RNA, 21 nt, Human
uguguggguccacccugggag

SEQ ID NO: 303224 - RNA, 22 nt, Human
uugcugguuugaagguggaggg

SEQ ID NO: 303225 - RNA, 22 nt, Human
uugcugguuugaagguggaggg

SEQ ID NO: 303226 - RNA, 22 nt, Human
uugcugguuugaagguggaggg

SEQ ID NO: 303227 - RNA, 20 nt, Human
aaagaaacauacuuaguuca

SEQ ID NO: 303228 - RNA, 21 nt, Human
aaagcaaugggcgaugaaggc

SEQ ID NO: 303229 - RNA, 23 nt, Human
aaagcaaugggcgaugaaggcuc

SEQ ID NO: 303230 - RNA, 20 nt, Human
aaaguagccuagggauuuau

SEQ ID NO: 303231 - RNA, 18 nt, Human
aaagucacuuuucguggu

SEQ ID NO: 303232 - RNA, 19 nt, Human
aagcaggucaccuacccaa

SEQ ID NO: 303233 - RNA, 24 nt, Human
acagaugcugucuagauccaagca

SEQ ID NO: 303234 - RNA, 23 nt, Human
acuuugaacagaugcugucuaga

SEQ ID NO: 303235 - RNA, 22 nt, Human
augaaagucuccaggccuaaag

SEQ ID NO: 303236 - RNA, 22 nt, Human
cacugugcaacugucucaggau

SEQ ID NO: 303237 - RNA, 20 nt, Human
gaaagucuccaggccuaaag

SEQ ID NO: 303238 - RNA, 21 nt, Human
uaaagaaacauacuuaguuca

SEQ ID NO: 303239 - RNA, 21 nt, Human
uaguucauucuuauauuccac

SEQ ID NO: 303240 - RNA, 18 nt, Human
ucagugcagccuccgcug

SEQ ID NO: 303241 - RNA, 22 nt, Human
ucuaaagaaacauacuuaguuc

SEQ ID NO: 303242 - RNA, 20 nt, Human
ucucaggaugccauaaacca

SEQ ID NO: 303243 - RNA, 20 nt, Human
uuaguucauucuuauauucc

SEQ ID NO: 303244 - RNA, 22 nt, Human
uuccacuuuauaagcccuacga

SEQ ID NO: 303245 - RNA, 23 nt, Human
aaccccaccucggacuccucccc

SEQ ID NO: 303246 - RNA, 25 nt, Human
aagaugcccccuccuccccacucaa

SEQ ID NO: 303247 - RNA, 20 nt, Human
aagcagcggcagcggcagga

SEQ ID NO: 303248 - RNA, 22 nt, Human
aagcuguaacaaaauaacauca

SEQ ID NO: 303249 - RNA, 22 nt, Human
aagcuguaacaaaauaacauca

SEQ ID NO: 303250 - RNA, 22 nt, Human
acaaaauaacaucaaaggaaaa

SEQ ID NO: 303251 - RNA, 22 nt, Human
acaaaauaacaucaaaggaaaa

SEQ ID NO: 303252 - RNA, 27 nt, Human
accaaccccaccucggacuccuccccc

SEQ ID NO: 303253 - RNA, 25 nt, Human
accccaccucggacuccucccccag

SEQ ID NO: 303254 - RNA, 24 nt, Human
accucggacuccucccccaguccc

SEQ ID NO: 303255 - RNA, 22 nt, Human
agaugcccccuccuccccacuc

SEQ ID NO: 303256 - RNA, 21 nt, Human
agccaaagcagcggcagcggc

SEQ ID NO: 303257 - RNA, 19 nt, Human
aggaaaugggaaggauggg

SEQ ID NO: 303258 - RNA, 19 nt, Human
aggaaaugggaaggauggg

SEQ ID NO: 303259 - RNA, 20 nt, Human
aggcaggcuguucagaagau

SEQ ID NO: 303260 - RNA, 18 nt, Human
caaagcagcggcagcggc

SEQ ID NO: 303261 - RNA, 24 nt, Human
caccucggacuccucccccagucc

SEQ ID NO: 303262 - RNA, 23 nt, Human
cacucaaccagguacugcacaga

SEQ ID NO: 303263 - RNA, 18 nt, Human
cagcggcagcggcaggag

SEQ ID NO: 303264 - RNA, 21 nt, Human
cagcggcagcggcaggaggag

SEQ ID NO: 303265 - RNA, 18 nt, Human
caggcggaggccgggggg

SEQ ID NO: 303266 - RNA, 24 nt, Human
ccaaccccaccucggacuccuccc

SEQ ID NO: 303267 - RNA, 25 nt, Human
ccaggcccagccccuccgucccggc

SEQ ID NO: 303268 - RNA, 19 nt, Human
ccccacuccccacucuugg

SEQ ID NO: 303269 - RNA, 19 nt, Human
ccccacuccccacucuugg

SEQ ID NO: 303270 - RNA, 22 nt, Human
ccccaggcccagccccuccguc

SEQ ID NO: 303271 - RNA, 18 nt, Human
cccccagucccaggagac

SEQ ID NO: 303272 - RNA, 19 nt, Human
cccccuccuccccacucaa

SEQ ID NO: 303273 - RNA, 22 nt, Human
cccccuccuccccacucaacca

SEQ ID NO: 303274 - RNA, 20 nt, Human
ccccuccuccccacucaacc

SEQ ID NO: 303275 - RNA, 21 nt, Human
cccuccuccccacucaaccag

SEQ ID NO: 303276 - RNA, 27 nt, Human
ccgccgggagccgggcaggggcagacg

SEQ ID NO: 303277 - RNA, 22 nt, Human
ccucgggacagguaaccaaccc

SEQ ID NO: 303278 - RNA, 19 nt, Human
cggacuccucccccagucc

SEQ ID NO: 303279 - RNA, 23 nt, Human
cucagucucugcccccagggguu

SEQ ID NO: 303280 - RNA, 23 nt, Human
cucagucucugcccccagggguu

SEQ ID NO: 303281 - RNA, 20 nt, Human
cucuccgagcaaggacccgg

SEQ ID NO: 303282 - RNA, 24 nt, Human
cugcccccagggguuaaauaauuu

SEQ ID NO: 303283 - RNA, 24 nt, Human
cugcccccagggguuaaauaauuu

SEQ ID NO: 303284 - RNA, 22 nt, Human
gagucccccgcgcggagagggc

SEQ ID NO: 303285 - RNA, 18 nt, Human
gcacguccgggcgugggg

SEQ ID NO: 303286 - RNA, 18 nt, Human
gcagcggcagcggcagga

SEQ ID NO: 303287 - RNA, 21 nt, Human
ggaggguagagaagagggccu

SEQ ID NO: 303288 - RNA, 21 nt, Human
ggaggguagagaagagggccu

SEQ ID NO: 303289 - RNA, 24 nt, Human
gggccgccgggagccgggcagggg

SEQ ID NO: 303290 - RNA, 24 nt, Human
gggccgccgggagccgggcagggg

SEQ ID NO: 303291 - RNA, 19 nt, Human
gggccucuuccccacuccc

SEQ ID NO: 303292 - RNA, 19 nt, Human
gggccucuuccccacuccc

SEQ ID NO: 303293 - RNA, 21 nt, Human
gggcguaugacgcagcagcca

SEQ ID NO: 303294 - RNA, 19 nt, Human
ggggagaagggggugcuga

SEQ ID NO: 303295 - RNA, 18 nt, Human
ggggagcugggcagaggc

SEQ ID NO: 303296 - RNA, 18 nt, Human
ggggagcugggcagaggc

SEQ ID NO: 303297 - RNA, 19 nt, Human
gggggugcugagcgucuag

SEQ ID NO: 303298 - RNA, 21 nt, Human
guccgggaucccuuaucaucc

SEQ ID NO: 303299 - RNA, 21 nt, Human
guccgggaucccuuaucaucc

SEQ ID NO: 303300 - RNA, 24 nt, Human
gugacagcuggggccgccgggagc

SEQ ID NO: 303301 - RNA, 23 nt, Human
gugcaggcggaggccgggggguc

SEQ ID NO: 303302 - RNA, 24 nt, Human
ucagaagaugcccccuccucccca

SEQ ID NO: 303303 - RNA, 25 nt, Human
uccccacuccccacucuuggauucc

SEQ ID NO: 303304 - RNA, 25 nt, Human
uccccacuccccacucuuggauucc

SEQ ID NO: 303305 - RNA, 22 nt, Human
ucuccagguacaucccagcugu

SEQ ID NO: 303306 - RNA, 22 nt, Human
ucuccagguacaucccagcugu

SEQ ID NO: 303307 - RNA, 18 nt, Human
ucuuccccacuccccacu

SEQ ID NO: 303308 - RNA, 18 nt, Human
ucuuccccacuccccacu

SEQ ID NO: 303309 - RNA, 24 nt, Human
ucuuggauuccagccugggcagua

SEQ ID NO: 303310 - RNA, 23 nt, Human
ugacagcuggggccgccgggagc

SEQ ID NO: 303311 - RNA, 19 nt, Human
uggauuccagccugggcag

SEQ ID NO: 303312 - RNA, 21 nt, Human
ugggaaggaugggagggguca

SEQ ID NO: 303313 - RNA, 21 nt, Human
ugggaaggaugggagggguca

SEQ ID NO: 303314 - RNA, 21 nt, Human
ugggaggggucaggaaucaug

SEQ ID NO: 303315 - RNA, 21 nt, Human
ugggaggggucaggaaucaug

SEQ ID NO: 303316 - RNA, 28 nt, Human
uucagaagaugcccccuccuccccacuc

SEQ ID NO: 303317 - RNA, 18 nt, Human
uuuuuuuuuuuuuuuuug

SEQ ID NO: 303318 - RNA, 22 nt, Human
uuuuuuuuuuuuuuuuuuguuu

SEQ ID NO: 303319 - RNA, 24 nt, Human
aaagccccagaggcagggaccagg

SEQ ID NO: 303320 - RNA, 20 nt, Human
aacugggcaguauucuccag

SEQ ID NO: 303321 - RNA, 23 nt, Human
aagaagcugcgguucggccuggc

SEQ ID NO: 303322 - RNA, 19 nt, Human
agaaaagccccagaggcag

SEQ ID NO: 303323 - RNA, 23 nt, Human
aucuccuccuccuccuccucuua

SEQ ID NO: 303324 - RNA, 25 nt, Human
cagcucccgcuccccagucaucucc

SEQ ID NO: 303325 - RNA, 25 nt, Human
caguauucuccagcucccgcucccc

SEQ ID NO: 303326 - RNA, 21 nt, Human
ccagucaucuccuccuccucc

SEQ ID NO: 303327 - RNA, 20 nt, Human
cuccuccuccuccuccucuu

SEQ ID NO: 303328 - RNA, 18 nt, Human
gggguaggcucuuuauua

SEQ ID NO: 303329 - RNA, 25 nt, Human
uaccuaagccaagaagccggggguc

SEQ ID NO: 303330 - RNA, 20 nt, Human
ucagaaaagccccagaggca

SEQ ID NO: 303331 - RNA, 23 nt, Human
ucccgcuccccagucaucuccuc

SEQ ID NO: 303332 - RNA, 22 nt, Human
uggguuucuucagaaaagcccc

SEQ ID NO: 303333 - RNA, 20 nt, Human
ugucagaggcccgcguucag

SEQ ID NO: 303334 - RNA, 18 nt, Human
uguggauuuucucucccu

SEQ ID NO: 303335 - RNA, 22 nt, Human
aaguauccaacgcugcuccacc

SEQ ID NO: 303336 - RNA, 21 nt, Human
acagaaaggggcaggguugga

SEQ ID NO: 303337 - RNA, 20 nt, Human
agaagccaggaaccaaagcc

SEQ ID NO: 303338 - RNA, 24 nt, Human
agagcccucccaccgcucaggccu

SEQ ID NO: 303339 - RNA, 23 nt, Human
caaaaggcucccagaagccagga

SEQ ID NO: 303340 - RNA, 19 nt, Human
caccggagcuucggucccu

SEQ ID NO: 303341 - RNA, 19 nt, Human
cagagcccucccaccgcuc

SEQ ID NO: 303342 - RNA, 19 nt, Human
caggccccgcagagcccuc

SEQ ID NO: 303343 - RNA, 18 nt, Human
ccaggccccgcagagccc

SEQ ID NO: 303344 - RNA, 18 nt, Human
ccccgcagagcccucccc

SEQ ID NO: 303345 - RNA, 19 nt, Human
cgaggcagggaccagcugu

SEQ ID NO: 303346 - RNA, 23 nt, Human
cgccugaacaccaggccccgcag

SEQ ID NO: 303347 - RNA, 22 nt, Human
cguggugggacgccugaacacc

SEQ ID NO: 303348 - RNA, 19 nt, Human
cuugggaaggaugggacag

SEQ ID NO: 303349 - RNA, 19 nt, Human
gcacaaucaaccgaggcag

SEQ ID NO: 303350 - RNA, 18 nt, Human
gcugcuccacccucgugg

SEQ ID NO: 303351 - RNA, 24 nt, Human
ggaguuagaaaacuauauugguag

SEQ ID NO: 303352 - RNA, 22 nt, Human
gggcaggguuggagugauuagg

SEQ ID NO: 303353 - RNA, 18 nt, Human
uagcccgggugccaccgg

SEQ ID NO: 303354 - RNA, 19 nt, Human
uccaacgcugcuccacccu

SEQ ID NO: 303355 - RNA, 18 nt, Human
ucccagaagccaggaacc

SEQ ID NO: 303356 - RNA, 24 nt, Human
ucccagaagccaggaaccaaagcc

SEQ ID NO: 303357 - RNA, 22 nt, Human
uccccaaacaggaguuagaaaa

SEQ ID NO: 303358 - RNA, 21 nt, Human
ucggucccuaaggaacaagua

SEQ ID NO: 303359 - RNA, 20 nt, Human
ucuagagaauaaaaacacau

SEQ ID NO: 303360 - RNA, 26 nt, Human
ucuagagaauaaaaacacaugcaaac

SEQ ID NO: 303361 - RNA, 22 nt, Human
ugaaagaaauaaagccaaucau

SEQ ID NO: 303362 - RNA, 19 nt, Human
ugaugaaagaaauaaagcc

SEQ ID NO: 303363 - RNA, 19 nt, Human
ugcacaaucaaccgaggca

SEQ ID NO: 303364 - RNA, 18 nt, Human
ugggaaggaugggacaga

SEQ ID NO: 303365 - RNA, 24 nt, Human
ugggaaggaugggacagaaagggg

SEQ ID NO: 303366 - RNA, 22 nt, Human
ugggacgccugaacaccaggcc

SEQ ID NO: 303367 - RNA, 23 nt, Human
ugggacgccugaacaccaggccc

SEQ ID NO: 303368 - RNA, 24 nt, Human
uugguaacagaucuagagaauaaa

SEQ ID NO: 303369 - RNA, 22 nt, Human
aaacccuggaagaccaugagcc

SEQ ID NO: 303370 - RNA, 25 nt, Human
aagcaaggcacaagaaaacccccca

SEQ ID NO: 303371 - RNA, 26 nt, Human
aagcaaggcacaagaaaaccccccau

SEQ ID NO: 303372 - RNA, 18 nt, Human
agaaaaccccccauucca

SEQ ID NO: 303373 - RNA, 18 nt, Human
agacagccaggauaaaaa

SEQ ID NO: 303374 - RNA, 21 nt, Human
agagaccaauuuccaauuccu

SEQ ID NO: 303375 - RNA, 21 nt, Human
aggaugugucacuagcucauc

SEQ ID NO: 303376 - RNA, 18 nt, Human
aggcaggagaaaacccua

SEQ ID NO: 303377 - RNA, 21 nt, Human
auuauguuacaucaaggcagc

SEQ ID NO: 303378 - RNA, 21 nt, Human
caagaaaaccccccauuccac

SEQ ID NO: 303379 - RNA, 22 nt, Human
caagcaaggcacaagaaaaccc

SEQ ID NO: 303380 - RNA, 21 nt, Human
caaggcacaagaaaacccccc

SEQ ID NO: 303381 - RNA, 23 nt, Human
cagagagacacaaguguucuauu

SEQ ID NO: 303382 - RNA, 19 nt, Human
cagccaggauaaaaacccu

SEQ ID NO: 303383 - RNA, 19 nt, Human
caggagaaaacccuaguuc

SEQ ID NO: 303384 - RNA, 21 nt, Human
cauccugugaagagguggccc

SEQ ID NO: 303385 - RNA, 22 nt, Human
ccaggauaaaaacccuggaaga

SEQ ID NO: 303386 - RNA, 21 nt, Human
ccucagaguccgugagaccag

SEQ ID NO: 303387 - RNA, 19 nt, Human
ccuccaagcgggucugguu

SEQ ID NO: 303388 - RNA, 23 nt, Human
ccuccaagcgggucugguucccg

SEQ ID NO: 303389 - RNA, 25 nt, Human
cggggcuguggccuccaagcggguc

SEQ ID NO: 303390 - RNA, 22 nt, Human
cgggggaacacaggacuccuca

SEQ ID NO: 303391 - RNA, 22 nt, Human
gaagaccaugagccaaggugaa

SEQ ID NO: 303392 - RNA, 23 nt, Human
gaagaggaauuuucuaaaucuug

SEQ ID NO: 303393 - RNA, 24 nt, Human
gaccaauuuccaauuccuccucag

SEQ ID NO: 303394 - RNA, 25 nt, Human
gaccagaugcuacagcaaauguucc

SEQ ID NO: 303395 - RNA, 19 nt, Human
gauaaaaacccuggaagac

SEQ ID NO: 303396 - RNA, 22 nt, Human
gcaaggcacaagaaaacccccc

SEQ ID NO: 303397 - RNA, 22 nt, Human
gcacaggggaucuugggggaca

SEQ ID NO: 303398 - RNA, 22 nt, Human
gcgugggcgcgggacgucgggg

SEQ ID NO: 303399 - RNA, 23 nt, Human
gggggaacacaggacuccucagc

SEQ ID NO: 303400 - RNA, 23 nt, Human
uaaaauggaaggcuaugaaagca

SEQ ID NO: 303401 - RNA, 19 nt, Human
uacagcaaauguuccagag

SEQ ID NO: 303402 - RNA, 22 nt, Human
uacagcaaauguuccagagaaa

SEQ ID NO: 303403 - RNA, 19 nt, Human
uaugaaagcaagcaaggca

SEQ ID NO: 303404 - RNA, 20 nt, Human
ucaguuucagggugagugcu

SEQ ID NO: 303405 - RNA, 23 nt, Human
ucccaggccgcagcgcccgaucu

SEQ ID NO: 303406 - RNA, 19 nt, Human
ucccggacacucacagccu

SEQ ID NO: 303407 - RNA, 21 nt, Human
ucugcacucaaaagagaccaa

SEQ ID NO: 303408 - RNA, 21 nt, Human
ucuguggcuuuaacauacauc

SEQ ID NO: 303409 - RNA, 20 nt, Human
ugaaagcaagcaaggcacaa

SEQ ID NO: 303410 - RNA, 18 nt, Human
ugauagcacaggggaucu

SEQ ID NO: 303411 - RNA, 20 nt, Human
ugcacagacagacugcaucc

SEQ ID NO: 303412 - RNA, 23 nt, Human
ugcuaccauugccccccgagagu

SEQ ID NO: 303413 - RNA, 19 nt, Human
ugucacuagcucaucgaaa

SEQ ID NO: 303414 - RNA, 24 nt, Human
ugugaucauguuuccaggugagac

SEQ ID NO: 303415 - RNA, 21 nt, Human
uuacaucaaggcagccaugcc

SEQ ID NO: 303416 - RNA, 22 nt, Human
uuccuaaggcaggagaaaaccc

SEQ ID NO: 303417 - RNA, 21 nt, Human
uuuccuaaggcaggagaaaac

SEQ ID NO: 303418 - RNA, 22 nt, Human
aaaagcauuuaccauuaccguu

SEQ ID NO: 303419 - RNA, 24 nt, Human
aaccucaagugauccaccugccuc

SEQ ID NO: 303420 - RNA, 19 nt, Human
aaccuccgucuccugguuc

SEQ ID NO: 303421 - RNA, 26 nt, Human
aagcaauucucaugccucagccuccu

SEQ ID NO: 303422 - RNA, 18 nt, Human
aagcauuuaccauuaccg

SEQ ID NO: 303423 - RNA, 24 nt, Human
aagugauccaccugccucagccuc

SEQ ID NO: 303424 - RNA, 22 nt, Human
aagugcuaagauuucaggugug

SEQ ID NO: 303425 - RNA, 23 nt, Human
aagugcuaagauuucagguguga

SEQ ID NO: 303426 - RNA, 24 nt, Human
acagagcuuccuacaccuucccca

SEQ ID NO: 303427 - RNA, 25 nt, Human
acaggguuuucaccauguuggcugg

SEQ ID NO: 303428 - RNA, 24 nt, Human
accauguuggcugggcuggucuug

SEQ ID NO: 303429 - RNA, 19 nt, Human
accuccccagcaugcucag

SEQ ID NO: 303430 - RNA, 18 nt, Human
acuauuauaguuggcaua

SEQ ID NO: 303431 - RNA, 19 nt, Human
aggagcucaaagaaaaugu

SEQ ID NO: 303432 - RNA, 22 nt, Human
aguagagacaggguuuucacca

SEQ ID NO: 303433 - RNA, 24 nt, Human
agugauccaccugccucagccucc

SEQ ID NO: 303434 - RNA, 21 nt, Human
aguuggcauaaucaugagaac

SEQ ID NO: 303435 - RNA, 19 nt, Human
augcaagagguccauaacc

SEQ ID NO: 303436 - RNA, 23 nt, Human
augccucagccuccucaguagcu

SEQ ID NO: 303437 - RNA, 24 nt, Human
auuuuuguauuuuuaguagagaca

SEQ ID NO: 303438 - RNA, 19 nt, Human
caaaauaucagcuggcuga

SEQ ID NO: 303439 - RNA, 25 nt, Human
caacacacuucagaacaugugucuc

SEQ ID NO: 303440 - RNA, 24 nt, Human
caacaugcagcggcaaauuuucaa

SEQ ID NO: 303441 - RNA, 22 nt, Human
caagugauccaccugccucagc

SEQ ID NO: 303442 - RNA, 25 nt, Human
caauucucaugccucagccuccuca

SEQ ID NO: 303443 - RNA, 21 nt, Human
caccauguuggcugggcuggu

SEQ ID NO: 303444 - RNA, 23 nt, Human
caccauguuggcugggcuggucu

SEQ ID NO: 303445 - RNA, 24 nt, Human
caccauguuggcugggcuggucuu

SEQ ID NO: 303446 - RNA, 20 nt, Human
cagagcuuccuacaccuucc

SEQ ID NO: 303447 - RNA, 25 nt, Human
caggguuuucaccauguuggcuggg

SEQ ID NO: 303448 - RNA, 25 nt, Human
caguagcuggguuuaaaaggcaugc

SEQ ID NO: 303449 - RNA, 21 nt, Human
caugccuggcuaauuuuugua

SEQ ID NO: 303450 - RNA, 24 nt, Human
cauguuggcugggcuggucuugaa

SEQ ID NO: 303451 - RNA, 25 nt, Human
ccaccugccucagccucccgaagug

SEQ ID NO: 303452 - RNA, 23 nt, Human
ccuaaccucaagugauccaccug

SEQ ID NO: 303453 - RNA, 23 nt, Human
ccuaaccucaagugauccaccug

SEQ ID NO: 303454 - RNA, 19 nt, Human
ccugguucaagcaauucuc

SEQ ID NO: 303455 - RNA, 22 nt, Human
ccugguucaagcaauucucaug

SEQ ID NO: 303456 - RNA, 22 nt, Human
cgcucugucacccaggcuggug

SEQ ID NO: 303457 - RNA, 23 nt, Human
cucaagugauccaccugccucag

SEQ ID NO: 303458 - RNA, 24 nt, Human
cucacugcaaccuccgucuccugg

SEQ ID NO: 303459 - RNA, 23 nt, Human
cugcaaccuccgucuccugguuc

SEQ ID NO: 303460 - RNA, 23 nt, Human
cugccucagccucccgaagugcu

SEQ ID NO: 303461 - RNA, 24 nt, Human
cugccucagccucccgaagugcua

SEQ ID NO: 303462 - RNA, 18 nt, Human
gaagugcuaagauuucag

SEQ ID NO: 303463 - RNA, 20 nt, Human
gcaccaucaugccuggcuaa

SEQ ID NO: 303464 - RNA, 25 nt, Human
gcucugucacccaggcuggugugca

SEQ ID NO: 303465 - RNA, 23 nt, Human
gcuggucuugaacuccuaaccuc

SEQ ID NO: 303466 - RNA, 24 nt, Human
gcuggugugcaguggcaggauuuc

SEQ ID NO: 303467 - RNA, 24 nt, Human
ggcuggucuugaacuccuaaccuc

SEQ ID NO: 303468 - RNA, 19 nt, Human
ggguuuucaccauguuggc

SEQ ID NO: 303469 - RNA, 23 nt, Human
ggguuuucaccauguuggcuggg

SEQ ID NO: 303470 - RNA, 18 nt, Human
gugauccaccugccucag

SEQ ID NO: 303471 - RNA, 24 nt, Human
gugauccaccugccucagccuccc

SEQ ID NO: 303472 - RNA, 23 nt, Human
gugcaguggcaggauuucagcuc

SEQ ID NO: 303473 - RNA, 22 nt, Human
uaagcuugaacaugaaacacaa

SEQ ID NO: 303474 - RNA, 24 nt, Human
uaauuuuuguauuuuuaguagaga

SEQ ID NO: 303475 - RNA, 21 nt, Human
uagaauagcucuguauacuaa

SEQ ID NO: 303476 - RNA, 23 nt, Human
uagagacaggguuuucaccaugu

SEQ ID NO: 303477 - RNA, 25 nt, Human
uaguagagacaggguuuucaccaug

SEQ ID NO: 303478 - RNA, 23 nt, Human
uauuauuaauaaugcaguuuuug

SEQ ID NO: 303479 - RNA, 22 nt, Human
ucaagugauccaccugccucag

SEQ ID NO: 303480 - RNA, 21 nt, Human
ucaccuccccagcaugcucag

SEQ ID NO: 303481 - RNA, 19 nt, Human
ucacugcaaccuccgucuc

SEQ ID NO: 303482 - RNA, 23 nt, Human
ucacugcaaccuccgucuccugg

SEQ ID NO: 303483 - RNA, 23 nt, Human
ucacugcaaccuccgucuccugg

SEQ ID NO: 303484 - RNA, 27 nt, Human
ucacugcaaccuccgucuccugguuca

SEQ ID NO: 303485 - RNA, 20 nt, Human
ucaguaucuuuugauuucca

SEQ ID NO: 303486 - RNA, 19 nt, Human
uccaaagagcaaagauuca

SEQ ID NO: 303487 - RNA, 19 nt, Human
ucccgaagugcuaagauuu

SEQ ID NO: 303488 - RNA, 23 nt, Human
uccgucuccugguucaagcaauu

SEQ ID NO: 303489 - RNA, 18 nt, Human
uccugguucaagcaauuc

SEQ ID NO: 303490 - RNA, 20 nt, Human
ucucaugccucagccuccuc

SEQ ID NO: 303491 - RNA, 19 nt, Human
ucucgcucugucacccagg

SEQ ID NO: 303492 - RNA, 23 nt, Human
ucucgcucugucacccaggcugg

SEQ ID NO: 303493 - RNA, 24 nt, Human
ucucgcucugucacccaggcuggu

SEQ ID NO: 303494 - RNA, 26 nt, Human
ucucgcucugucacccaggcuggugu

SEQ ID NO: 303495 - RNA, 27 nt, Human
ucucgcucugucacccaggcuggugug

SEQ ID NO: 303496 - RNA, 24 nt, Human
ucugucacccaggcuggugugcag

SEQ ID NO: 303497 - RNA, 22 nt, Human
ugaaacacaacacacuucagaa

SEQ ID NO: 303498 - RNA, 25 nt, Human
ugacaauaccacuaagagaaguuca

SEQ ID NO: 303499 - RNA, 19 nt, Human
ugacaugcaagagguccau

SEQ ID NO: 303500 - RNA, 19 nt, Human
ugagaacuuuuuccugcuu

SEQ ID NO: 303501 - RNA, 24 nt, Human
ugccucagccucccgaagugcuaa

SEQ ID NO: 303502 - RNA, 21 nt, Human
ugccucagccuccucaguagc

SEQ ID NO: 303503 - RNA, 24 nt, Human
ugccucagccuccucaguagcugg

SEQ ID NO: 303504 - RNA, 22 nt, Human
ugcucaguucguauauuaaugg

SEQ ID NO: 303505 - RNA, 20 nt, Human
uggcaggauuucagcucacu

SEQ ID NO: 303506 - RNA, 24 nt, Human
uggcaggauuucagcucacugcaa

SEQ ID NO: 303507 - RNA, 24 nt, Human
uggcugacuuugcuuuuaugaugu

SEQ ID NO: 303508 - RNA, 24 nt, Human
uggcugggcuggucuugaacuccu

SEQ ID NO: 303509 - RNA, 22 nt, Human
ugugcaguggcaggauuucagc

SEQ ID NO: 303510 - RNA, 23 nt, Human
ugugcaguggcaggauuucagcu

SEQ ID NO: 303511 - RNA, 25 nt, Human
uuaguagagacaggguuuucaccau

SEQ ID NO: 303512 - RNA, 22 nt, Human
uugaacaugaaacacaacacac

SEQ ID NO: 303513 - RNA, 21 nt, Human
uuuagcaggagcucaaagaaa

SEQ ID NO: 303514 - RNA, 24 nt, Human
uuucaccauguuggcugggcuggu

SEQ ID NO: 303515 - RNA, 24 nt, Human
uuugagaaccaaaauaucagcugg

SEQ ID NO: 303516 - RNA, 20 nt, Human
uuuuuguauuuuuaguagag

SEQ ID NO: 303517 - RNA, 21 nt, Human
aagccccccggggagagggga

SEQ ID NO: 303518 - RNA, 26 nt, Human
ccccaccugcccccuagcccucccug

SEQ ID NO: 303519 - RNA, 25 nt, Human
ccccuagcccucccugacuggccaa

SEQ ID NO: 303520 - RNA, 21 nt, Human
gacuuguauuuccauggcuuc

SEQ ID NO: 303521 - RNA, 19 nt, Human
ggaccacagagggcugaag

SEQ ID NO: 303522 - RNA, 18 nt, Human
uccccaccugcccccuag

SEQ ID NO: 303523 - RNA, 21 nt, Human
uccccaccugcccccuagccc

SEQ ID NO: 303524 - RNA, 22 nt, Human
uccccaccugcccccuagcccu

SEQ ID NO: 303525 - RNA, 24 nt, Human
uccccaccugcccccuagcccucc

SEQ ID NO: 303526 - RNA, 25 nt, Human
uggcuuccccuccccaccugccccc

SEQ ID NO: 303527 - RNA, 19 nt, Human
uugacaagaaucccaaagc

SEQ ID NO: 303528 - RNA, 19 nt, Human
uuuuuuuuuuuuuuacccc

SEQ ID NO: 303529 - RNA, 27 nt, Human
uuuuuuuuuuuuuuuuuaccccuuuga

SEQ ID NO: 303530 - RNA, 26 nt, Human
uuuuuuuuuuuuuuuuuuuaccccuu

SEQ ID NO: 303531 - RNA, 27 nt, Human
agagcccagaggagcugggaccaaagu

SEQ ID NO: 303532 - RNA, 20 nt, Human
aggcagaggagccagggucg

SEQ ID NO: 303533 - RNA, 20 nt, Human
agugggccugaggccagagc

SEQ ID NO: 303534 - RNA, 25 nt, Human
caccccagcucugaucucagagucc

SEQ ID NO: 303535 - RNA, 18 nt, Human
caggaucauuagugggcc

SEQ ID NO: 303536 - RNA, 20 nt, Human
cauaugcagugcaugcagca

SEQ ID NO: 303537 - RNA, 21 nt, Human
cccagcucugaucucagaguc

SEQ ID NO: 303538 - RNA, 23 nt, Human
cccuggcguguagcagauuuuau

SEQ ID NO: 303539 - RNA, 24 nt, Human
ccgggccaggcguggcguucagaa

SEQ ID NO: 303540 - RNA, 24 nt, Human
ccugaggccagagcccagaggagc

SEQ ID NO: 303541 - RNA, 23 nt, Human
cguucagaauggcucccuuccac

SEQ ID NO: 303542 - RNA, 18 nt, Human
gagagagguaccgggcug

SEQ ID NO: 303543 - RNA, 18 nt, Human
ggcaggcagaggagccag

SEQ ID NO: 303544 - RNA, 18 nt, Human
ggggagagagguaccggg

SEQ ID NO: 303545 - RNA, 24 nt, Human
guggcguucagaauggcucccuuc

SEQ ID NO: 303546 - RNA, 21 nt, Human
ucuggagaguucugcuuccug

SEQ ID NO: 303547 - RNA, 18 nt, Human
ugagggggcaggcagagg

SEQ ID NO: 303548 - RNA, 20 nt, Human
ugaucucagaguccuggcca

SEQ ID NO: 303549 - RNA, 21 nt, Human
uggggagagagguaccgggcu

SEQ ID NO: 303550 - RNA, 23 nt, Human
uucagaauggcucccuuccaccc

SEQ ID NO: 303551 - RNA, 22 nt, Human
aagcccgcugcguccacgcccu

SEQ ID NO: 303552 - RNA, 23 nt, Human
acgcccuccagcgucucuugcuc

SEQ ID NO: 303553 - RNA, 18 nt, Human
ccacgcccuccagcgucu

SEQ ID NO: 303554 - RNA, 21 nt, Human
cccacuuccucaaguccucaa

SEQ ID NO: 303555 - RNA, 18 nt, Human
ccccggaaacuccucucc

SEQ ID NO: 303556 - RNA, 24 nt, Human
cccggaaacuccucuccucuaccc

SEQ ID NO: 303557 - RNA, 21 nt, Human
cccggacccgagccccggaaa

SEQ ID NO: 303558 - RNA, 23 nt, Human
cccuccagcgucucuugcuccgc

SEQ ID NO: 303559 - RNA, 23 nt, Human
cucaaaaccuugucuugcccggg

SEQ ID NO: 303560 - RNA, 18 nt, Human
cuccagcgucucuugcuc

SEQ ID NO: 303561 - RNA, 21 nt, Human
cuuccgcgcucguuccccugg

SEQ ID NO: 303562 - RNA, 24 nt, Human
gacccggacccgagccccggaaac

SEQ ID NO: 303563 - RNA, 21 nt, Human
gccccggaaacuccucuccuu

SEQ ID NO: 303564 - RNA, 21 nt, Human
gcugcguccacgcccuccagc

SEQ ID NO: 303565 - RNA, 20 nt, Human
uacccaggcgaucgcccaag

SEQ ID NO: 303566 - RNA, 21 nt, Human
ugcuccgccucucgccgccca

SEQ ID NO: 303567 - RNA, 19 nt, Human
uugcuuccgcgcucguucc

SEQ ID NO: 303568 - RNA, 24 nt, Human
aaacccccccucacccccaccacc

SEQ ID NO: 303569 - RNA, 24 nt, Human
acaccgcggcccucagcacccggc

SEQ ID NO: 303570 - RNA, 21 nt, Human
acccccccucacccccaccac

SEQ ID NO: 303571 - RNA, 19 nt, Human
accuaagcagcaggagacc

SEQ ID NO: 303572 - RNA, 18 nt, Human
agagucugggaccaucca

SEQ ID NO: 303573 - RNA, 20 nt, Human
agagucugggaccauccagg

SEQ ID NO: 303574 - RNA, 21 nt, Human
agcagggagggggcuccuaug

SEQ ID NO: 303575 - RNA, 19 nt, Human
agcuccagcgccuccucca

SEQ ID NO: 303576 - RNA, 19 nt, Human
agcugggcauguccugaga

SEQ ID NO: 303577 - RNA, 19 nt, Human
aggaccuaagcagcaggag

SEQ ID NO: 303578 - RNA, 20 nt, Human
auggagcacagccgugcccc

SEQ ID NO: 303579 - RNA, 24 nt, Human
auggccaaacccccccucaccccc

SEQ ID NO: 303580 - RNA, 19 nt, Human
caaacccccccucaccccc

SEQ ID NO: 303581 - RNA, 22 nt, Human
caaacccccccucacccccacc

SEQ ID NO: 303582 - RNA, 24 nt, Human
caaacccccccucacccccaccac

SEQ ID NO: 303583 - RNA, 21 nt, Human
caacgaagcugccuugaccuc

SEQ ID NO: 303584 - RNA, 20 nt, Human
caagccagagggaacaacga

SEQ ID NO: 303585 - RNA, 18 nt, Human
cacaagccagagggaaca

SEQ ID NO: 303586 - RNA, 23 nt, Human
caccaccuuaggccgaacaccgc

SEQ ID NO: 303587 - RNA, 19 nt, Human
cacccgcuccuccgcucua

SEQ ID NO: 303588 - RNA, 19 nt, Human
cagaugccuccgcgccucc

SEQ ID NO: 303589 - RNA, 18 nt, Human
cagcaggagacccccagg

SEQ ID NO: 303590 - RNA, 18 nt, Human
cagccgugcccccacaag

SEQ ID NO: 303591 - RNA, 23 nt, Human
cagccgugcccccacaagccaga

SEQ ID NO: 303592 - RNA, 25 nt, Human
cagcucccccuuucaaggugagucc

SEQ ID NO: 303593 - RNA, 19 nt, Human
caggacagagggcaggacc

SEQ ID NO: 303594 - RNA, 22 nt, Human
cauccucagcccugcguagccu

SEQ ID NO: 303595 - RNA, 21 nt, Human
cauguccugagagucugggaa

SEQ ID NO: 303596 - RNA, 18 nt, Human
ccaaaaggaccuaagcaa

SEQ ID NO: 303597 - RNA, 23 nt, Human
ccaaacccccccucacccccacc

SEQ ID NO: 303598 - RNA, 21 nt, Human
ccagcgcgcuccgcgcccacc

SEQ ID NO: 303599 - RNA, 24 nt, Human
ccaggccuggcacaaagccagggg

SEQ ID NO: 303600 - RNA, 24 nt, Human
cccacaagccagagggaacaacga

SEQ ID NO: 303601 - RNA, 20 nt, Human
cccacaccgcggcccucagc

SEQ ID NO: 303602 - RNA, 22 nt, Human
ccccaccaccuuaggccgaaca

SEQ ID NO: 303603 - RNA, 19 nt, Human
ccccagcgcgcuccgcgcc

SEQ ID NO: 303604 - RNA, 22 nt, Human
ccccaugggggacugcccucuc

SEQ ID NO: 303605 - RNA, 23 nt, Human
ccccaugggggacugcccucucc

SEQ ID NO: 303606 - RNA, 21 nt, Human
cccccacaagccagagggaac

SEQ ID NO: 303607 - RNA, 23 nt, Human
cccccagcgcgcuccgcgcccac

SEQ ID NO: 303608 - RNA, 26 nt, Human
cccccaggagugggcuuuaggcccag

SEQ ID NO: 303609 - RNA, 18 nt, Human
cccccccucacccccacc

SEQ ID NO: 303610 - RNA, 22 nt, Human
ccccgagguucgcggaaagcuc

SEQ ID NO: 303611 - RNA, 21 nt, Human
ccccucacccccaccaccuua

SEQ ID NO: 303612 - RNA, 21 nt, Human
cccucuccaggccuggcacaa

SEQ ID NO: 303613 - RNA, 19 nt, Human
ccgacccgccucugccaga

SEQ ID NO: 303614 - RNA, 21 nt, Human
ccgcagcgcaggauucuggcg

SEQ ID NO: 303615 - RNA, 18 nt, Human
ccgccucugccagaugcc

SEQ ID NO: 303616 - RNA, 18 nt, Human
ccgccucugccagaugcc

SEQ ID NO: 303617 - RNA, 21 nt, Human
ccgcgcccaccgccccgcuuc

SEQ ID NO: 303618 - RNA, 22 nt, Human
ccgcuucagccggcacccgcuc

SEQ ID NO: 303619 - RNA, 18 nt, Human
ccgugagccccaccgccc

SEQ ID NO: 303620 - RNA, 22 nt, Human
ccgugcgcgcugcccaccugcg

SEQ ID NO: 303621 - RNA, 26 nt, Human
ccucacccccaccaccuuaggccgaa

SEQ ID NO: 303622 - RNA, 19 nt, Human
ccucaugccauaugaggcc

SEQ ID NO: 303623 - RNA, 22 nt, Human
ccugcguagccuucugcccucc

SEQ ID NO: 303624 - RNA, 22 nt, Human
cgcagcgcaggauucuggcgcc

SEQ ID NO: 303625 - RNA, 22 nt, Human
cgcgcacccacaccgcggcccu

SEQ ID NO: 303626 - RNA, 19 nt, Human
cgcggaaagcuccaggcug

SEQ ID NO: 303627 - RNA, 22 nt, Human
cgugcccccacaagccagaggg

SEQ ID NO: 303628 - RNA, 22 nt, Human
cucacccccaccaccuuaggcc

SEQ ID NO: 303629 - RNA, 19 nt, Human
cucgaagccccugagcugg

SEQ ID NO: 303630 - RNA, 23 nt, Human
cucguccauuccuucagcuccag

SEQ ID NO: 303631 - RNA, 27 nt, Human
cugacugcuccgcgcacccacaccgcg

SEQ ID NO: 303632 - RNA, 26 nt, Human
cuggaugggugggggucccaaaagga

SEQ ID NO: 303633 - RNA, 22 nt, Human
cuucagccggcacccgcuccuc

SEQ ID NO: 303634 - RNA, 23 nt, Human
gaagccccugagcugggcauguc

SEQ ID NO: 303635 - RNA, 25 nt, Human
gaccauccaggggcugcaucuucau

SEQ ID NO: 303636 - RNA, 20 nt, Human
gagcagucugcaggacagag

SEQ ID NO: 303637 - RNA, 21 nt, Human
gcagcgcaggauucuggcgcc

SEQ ID NO: 303638 - RNA, 23 nt, Human
gcaggacagagggcaggaccaca

SEQ ID NO: 303639 - RNA, 21 nt, Human
gccccgagguucgcggaaagc

SEQ ID NO: 303640 - RNA, 19 nt, Human
gccccgggcuggcaggccc

SEQ ID NO: 303641 - RNA, 23 nt, Human
gccgugcgcgcugcccaccugcg

SEQ ID NO: 303642 - RNA, 18 nt, Human
gcuucagccggcacccgc

SEQ ID NO: 303643 - RNA, 24 nt, Human
ggagugggcuuuaggcccagcagc

SEQ ID NO: 303644 - RNA, 19 nt, Human
ggcgcggcgccccucucgg

SEQ ID NO: 303645 - RNA, 21 nt, Human
ggcugcaucuucauccucagc

SEQ ID NO: 303646 - RNA, 22 nt, Human
ggguacuccuuuugguaccagg

SEQ ID NO: 303647 - RNA, 19 nt, Human
gugcaaaaaagggccugga

SEQ ID NO: 303648 - RNA, 19 nt, Human
ucagcacccggcugccggu

SEQ ID NO: 303649 - RNA, 23 nt, Human
uccaugccuuccaccuugccaca

SEQ ID NO: 303650 - RNA, 20 nt, Human
ucccagggcucguccauucc

SEQ ID NO: 303651 - RNA, 21 nt, Human
ucccagggcucguccauuccu

SEQ ID NO: 303652 - RNA, 22 nt, Human
ucccagggcucguccauuccuu

SEQ ID NO: 303653 - RNA, 18 nt, Human
uccgcgcacccacaccgc

SEQ ID NO: 303654 - RNA, 23 nt, Human
uccgcucuaccccagcuggccca

SEQ ID NO: 303655 - RNA, 18 nt, Human
uccuucagcuccagcgcc

SEQ ID NO: 303656 - RNA, 18 nt, Human
ugcaaaaaagggccugga

SEQ ID NO: 303657 - RNA, 22 nt, Human
ugccagcucccccucaugccau

SEQ ID NO: 303658 - RNA, 27 nt, Human
ugcccaccugcgcccugacugcuccgc

SEQ ID NO: 303659 - RNA, 19 nt, Human
ugccuccgcgccucccuag

SEQ ID NO: 303660 - RNA, 20 nt, Human
uggagcacagccgugccccc

SEQ ID NO: 303661 - RNA, 19 nt, Human
uggagugggccuggguacc

SEQ ID NO: 303662 - RNA, 22 nt, Human
ugggcuuuaggcccagcagcuc

SEQ ID NO: 303663 - RNA, 23 nt, Human
uggggaaagacaugaaaugcuaa

SEQ ID NO: 303664 - RNA, 21 nt, Human
ugugcaaaaaagggccuggau

SEQ ID NO: 303665 - RNA, 19 nt, Human
uucgcggaaagcuccaggc

SEQ ID NO: 303666 - RNA, 23 nt, Human
uucugcccuccucccagggcucg

SEQ ID NO: 303667 - RNA, 24 nt, Human
aaaaagacuauguccaguaaacau

SEQ ID NO: 303668 - RNA, 18 nt, Human
aacaagcagguggguauc

SEQ ID NO: 303669 - RNA, 22 nt, Human
aauaguucgcuugaucucucuu

SEQ ID NO: 303670 - RNA, 19 nt, Human
agagaaaugaaaucuccag

SEQ ID NO: 303671 - RNA, 18 nt, Human
agguuuuuagcaugcaca

SEQ ID NO: 303672 - RNA, 22 nt, Human
aguucgcuugaucucucuuuga

SEQ ID NO: 303673 - RNA, 23 nt, Human
ccaaaaagacuauguccaguaaa

SEQ ID NO: 303674 - RNA, 20 nt, Human
ccaguaaacauaacugucac

SEQ ID NO: 303675 - RNA, 21 nt, Human
ccuaaauaguucgcuugaucu

SEQ ID NO: 303676 - RNA, 21 nt, Human
ccuccggaaacaccauucauu

SEQ ID NO: 303677 - RNA, 21 nt, Human
cgcuuugcagagcugagagca

SEQ ID NO: 303678 - RNA, 20 nt, Human
gaaaaggacuugcuccuccg

SEQ ID NO: 303679 - RNA, 21 nt, Human
guuuuuagcaugcacacccag

SEQ ID NO: 303680 - RNA, 21 nt, Human
uaaaauagcuuugcuucaugc

SEQ ID NO: 303681 - RNA, 19 nt, Human
uagagaaaugaaaucucca

SEQ ID NO: 303682 - RNA, 23 nt, Human
uagguaaguuuugauaccagcca

SEQ ID NO: 303683 - RNA, 22 nt, Human
uccagccagagaaugggauuuc

SEQ ID NO: 303684 - RNA, 21 nt, Human
uccuccggaaacaccauucau

SEQ ID NO: 303685 - RNA, 19 nt, Human
ucugcagucaucacuuucc

SEQ ID NO: 303686 - RNA, 20 nt, Human
ugagagcaccugugcauguc

SEQ ID NO: 303687 - RNA, 22 nt, Human
uggaaaaggacuugcuccuccg

SEQ ID NO: 303688 - RNA, 21 nt, Human
uucauucgcuuugcagagcug

SEQ ID NO: 303689 - RNA, 21 nt, Human
aaaacaguaauauuucacuuu

SEQ ID NO: 303690 - RNA, 19 nt, Human
accaccuuuauuggcugcc

SEQ ID NO: 303691 - RNA, 20 nt, Human
auuaagaaaacauuuuccuu

SEQ ID NO: 303692 - RNA, 20 nt, Human
cauacccuaagcuccaaauc

SEQ ID NO: 303693 - RNA, 23 nt, Human
cccuaagcuccaaaucauucacu

SEQ ID NO: 303694 - RNA, 20 nt, Human
ccuaagcuccaaaucauuca

SEQ ID NO: 303695 - RNA, 22 nt, Human
gcgcggggaacccccaccccuc

SEQ ID NO: 303696 - RNA, 18 nt, Human
gcggcgcggggaaccccc

SEQ ID NO: 303697 - RNA, 25 nt, Human
ggaaaaaaaucucuuaugacauaaa

SEQ ID NO: 303698 - RNA, 20 nt, Human
ggcgcggggaacccccaccc

SEQ ID NO: 303699 - RNA, 25 nt, Human
uaaagcaacaccauugugcugcaaa

SEQ ID NO: 303700 - RNA, 26 nt, Human
uaucagaaaggggauacaaaacauac

SEQ ID NO: 303701 - RNA, 23 nt, Human
ucuguugaaagaguuauagcaga

SEQ ID NO: 303702 - RNA, 24 nt, Human
uguucuagauuugggggaaaaaaa

SEQ ID NO: 303703 - RNA, 26 nt, Human
uuagacaccaaccaccuuuauuggcu

SEQ ID NO: 303704 - RNA, 22 nt, Human
aaguggaugagagaggcagcuc

SEQ ID NO: 303705 - RNA, 26 nt, Human
aggaccagauggggccuguagcucug

SEQ ID NO: 303706 - RNA, 24 nt, Human
aggcagcuccagccgugggcaucc

SEQ ID NO: 303707 - RNA, 18 nt, Human
cucuggggacggcacagg

SEQ ID NO: 303708 - RNA, 25 nt, Human
ggggaagggcagcagggacuuagga

SEQ ID NO: 303709 - RNA, 18 nt, Human
guggaugagagaggcagc

SEQ ID NO: 303710 - RNA, 19 nt, Human
uaagagcuaaggccauacc

SEQ ID NO: 303711 - RNA, 20 nt, Human
uggccuggcuccagggcggg

SEQ ID NO: 303712 - RNA, 19 nt, Human
uggcuaagagcuaaggcca

SEQ ID NO: 303713 - RNA, 23 nt, Human
uggcuaagagcuaaggccauacc

SEQ ID NO: 303714 - RNA, 20 nt, Human
ugggaaggggaagggcagca

SEQ ID NO: 303715 - RNA, 18 nt, Human
ugggaggaagaauggaca

SEQ ID NO: 303716 - RNA, 21 nt, Human
ugggaggaagaauggacagug

SEQ ID NO: 303717 - RNA, 18 nt, Human
ugugggaaggggaagggc

SEQ ID NO: 303718 - RNA, 23 nt, Human
ugugggaaggggaagggcagcag

SEQ ID NO: 303719 - RNA, 20 nt, Human
uguuuggcuaagagcuaagg

SEQ ID NO: 303720 - RNA, 20 nt, Human
aaacagagcacaaaguucuc

SEQ ID NO: 303721 - RNA, 20 nt, Human
agguaaaacagagcacaaag

SEQ ID NO: 303722 - RNA, 23 nt, Human
ccaaguucauucgaucuggggug

SEQ ID NO: 303723 - RNA, 21 nt, Human
ccgccgcuagacccgccccuc

SEQ ID NO: 303724 - RNA, 22 nt, Human
ccggccuggccccgccccggcc

SEQ ID NO: 303725 - RNA, 20 nt, Human
ccuggccccgccccggcccg

SEQ ID NO: 303726 - RNA, 23 nt, Human
cgaucugggguggggaugggagc

SEQ ID NO: 303727 - RNA, 21 nt, Human
cggccuggccccgccccggcc

SEQ ID NO: 303728 - RNA, 21 nt, Human
cgggggccgccgcuagacccg

SEQ ID NO: 303729 - RNA, 18 nt, Human
cuaaaaaaaggaaaaaaa

SEQ ID NO: 303730 - RNA, 20 nt, Human
gccgcuagacccgccccucu

SEQ ID NO: 303731 - RNA, 21 nt, Human
uaaaacagagcacaaaguucu

SEQ ID NO: 303732 - RNA, 21 nt, Human
uaagguaaaacagagcacaaa

SEQ ID NO: 303733 - RNA, 21 nt, Human
ucccuaaaaaaaggaaaaaaa

SEQ ID NO: 303734 - RNA, 19 nt, Human
ucuaaacagaguaagguaa

SEQ ID NO: 303735 - RNA, 21 nt, Human
ucugggguggggaugggagca

SEQ ID NO: 303736 - RNA, 18 nt, Human
ucuuuuaauuuuuucccu

SEQ ID NO: 303737 - RNA, 22 nt, Human
uggggaugggagcagcagggcc

SEQ ID NO: 303738 - RNA, 18 nt, Human
ugggguggggaugggagc

SEQ ID NO: 303739 - RNA, 24 nt, Human
uguuuuaucacacaggcagucuua

SEQ ID NO: 303740 - RNA, 18 nt, Human
uuuuuuuuuuaaacaagu

SEQ ID NO: 303741 - RNA, 20 nt, Human
uuuuuuuuuuuuaaacaagu

SEQ ID NO: 303742 - RNA, 19 nt, Human
aaaaagaagauugggaagg

SEQ ID NO: 303743 - RNA, 21 nt, Human
aaaaguaggcaucugugaagg

SEQ ID NO: 303744 - RNA, 23 nt, Human
aaagaacauuuccagaaacagac

SEQ ID NO: 303745 - RNA, 20 nt, Human
aagaagaaauagagccaugg

SEQ ID NO: 303746 - RNA, 24 nt, Human
aagagaggugccccuuccccaaga

SEQ ID NO: 303747 - RNA, 18 nt, Human
aagcaauaggccgggccu

SEQ ID NO: 303748 - RNA, 22 nt, Human
aaggagggcacaggguccuucc

SEQ ID NO: 303749 - RNA, 23 nt, Human
accccaguguccuuaaaaagagg

SEQ ID NO: 303750 - RNA, 25 nt, Human
accccaguguccuuaaaaagagguu

SEQ ID NO: 303751 - RNA, 19 nt, Human
acccuuugggugcuggccu

SEQ ID NO: 303752 - RNA, 18 nt, Human
agacauagucaaggcuga

SEQ ID NO: 303753 - RNA, 20 nt, Human
agagagagacccaagcaaua

SEQ ID NO: 303754 - RNA, 24 nt, Human
agauugggaaggagggcacagggu

SEQ ID NO: 303755 - RNA, 27 nt, Human
aggcagagaugaggccaaaagggaccc

SEQ ID NO: 303756 - RNA, 18 nt, Human
agggaucagaguagcugg

SEQ ID NO: 303757 - RNA, 23 nt, Human
agggcacaggguccuuccaccuc

SEQ ID NO: 303758 - RNA, 22 nt, Human
caauaggccgggccugacuccc

SEQ ID NO: 303759 - RNA, 21 nt, Human
cacaggguccuuccaccuccc

SEQ ID NO: 303760 - RNA, 22 nt, Human
caccaucuaaagaacauuucca

SEQ ID NO: 303761 - RNA, 22 nt, Human
cagaaacagaccccaguguccu

SEQ ID NO: 303762 - RNA, 21 nt, Human
cauacccaaaggaaugugcca

SEQ ID NO: 303763 - RNA, 22 nt, Human
cauacuugcucaguguuggggg

SEQ ID NO: 303764 - RNA, 20 nt, Human
caucccauuugccucccacu

SEQ ID NO: 303765 - RNA, 25 nt, Human
ccaucuaaagaacauuuccagaaac

SEQ ID NO: 303766 - RNA, 29 nt, Human
ccaucuaaagaacauuuccagaaacagag

SEQ ID NO: 303767 - RNA, 19 nt, Human
ccaugagccucuagaagcu

SEQ ID NO: 303768 - RNA, 21 nt, Human
cccaguguccuuaaaaagagg

SEQ ID NO: 303769 - RNA, 18 nt, Human
ccuaggccuuggcgagcc

SEQ ID NO: 303770 - RNA, 18 nt, Human
ccuccucugucauacugg

SEQ ID NO: 303771 - RNA, 23 nt, Human
ccugacucccagaccccugcaga

SEQ ID NO: 303772 - RNA, 20 nt, Human
gaaggagggcacaggguccu

SEQ ID NO: 303773 - RNA, 19 nt, Human
gaaguuuccauaauccagg

SEQ ID NO: 303774 - RNA, 21 nt, Human
gacaauggaugugaagaagaa

SEQ ID NO: 303775 - RNA, 18 nt, Human
gaguauuuugguuuuucu

SEQ ID NO: 303776 - RNA, 19 nt, Human
gucaucuuuggaguauuuu

SEQ ID NO: 303777 - RNA, 24 nt, Human
uaaauagagagagacccaagcaau

SEQ ID NO: 303778 - RNA, 19 nt, Human
uaacauacccaaaggaaug

SEQ ID NO: 303779 - RNA, 21 nt, Human
uaaggccuuacauccuccucu

SEQ ID NO: 303780 - RNA, 18 nt, Human
uagacauagucaaggcug

SEQ ID NO: 303781 - RNA, 23 nt, Human
uagcugggguugggacuccacag

SEQ ID NO: 303782 - RNA, 20 nt, Human
uauuuugguuuuucuuauuu

SEQ ID NO: 303783 - RNA, 23 nt, Human
ucagaguagcugggguugggacu

SEQ ID NO: 303784 - RNA, 19 nt, Human
ucagcccuucuccuagcuc

SEQ ID NO: 303785 - RNA, 19 nt, Human
ucaggcagagaugaggcca

SEQ ID NO: 303786 - RNA, 19 nt, Human
ucaguuuuuccaccugucu

SEQ ID NO: 303787 - RNA, 20 nt, Human
uccacaauccaaaauaaagu

SEQ ID NO: 303788 - RNA, 21 nt, Human
uccacaauccaaaauaaaguu

SEQ ID NO: 303789 - RNA, 20 nt, Human
uccacagcauacuugcucag

SEQ ID NO: 303790 - RNA, 19 nt, Human
ucccuggaaaggugcagaa

SEQ ID NO: 303791 - RNA, 21 nt, Human
ucuguccaucucugaaacugc

SEQ ID NO: 303792 - RNA, 19 nt, Human
ugaaaaagaagauugggaa

SEQ ID NO: 303793 - RNA, 21 nt, Human
ugaaaaagaagauugggaagg

SEQ ID NO: 303794 - RNA, 18 nt, Human
ugaaacugccugucucag

SEQ ID NO: 303795 - RNA, 21 nt, Human
ugcagaaugagccaggccuaa

SEQ ID NO: 303796 - RNA, 21 nt, Human
ugggaaggagggcacaggguc

SEQ ID NO: 303797 - RNA, 22 nt, Human
ugggaaggagggcacagggucc

SEQ ID NO: 303798 - RNA, 19 nt, Human
ugggguugggacuccacag

SEQ ID NO: 303799 - RNA, 23 nt, Human
uggguuuggguaauaagaagaga

SEQ ID NO: 303800 - RNA, 20 nt, Human
uguccaucucugaaacugcc

SEQ ID NO: 303801 - RNA, 20 nt, Human
ugugaagaagaaauagagcc

SEQ ID NO: 303802 - RNA, 19 nt, Human
uucuccuagcucacauacc

SEQ ID NO: 303803 - RNA, 21 nt, Human
uuugggguucaagagaggugc

SEQ ID NO: 303804 - RNA, 22 nt, Human
agcaggacaacgccgaagagga

SEQ ID NO: 303805 - RNA, 20 nt, Human
agcccgagccccagagcccc

SEQ ID NO: 303806 - RNA, 23 nt, Human
agcuccugccugggaaguccucg

SEQ ID NO: 303807 - RNA, 20 nt, Human
aggcaaaucacacucccucu

SEQ ID NO: 303808 - RNA, 21 nt, Human
aucagcuuuaaacggcucugg

SEQ ID NO: 303809 - RNA, 23 nt, Human
caaagcccgagccccagagcccc

SEQ ID NO: 303810 - RNA, 22 nt, Human
cacccggaacacagaugggaac

SEQ ID NO: 303811 - RNA, 19 nt, Human
cacucccucugaguuggaa

SEQ ID NO: 303812 - RNA, 20 nt, Human
caguucacucuuuauuuccu

SEQ ID NO: 303813 - RNA, 22 nt, Human
caguucacucuuuauuuccuca

SEQ ID NO: 303814 - RNA, 20 nt, Human
caguuccaggacgaucuugc

SEQ ID NO: 303815 - RNA, 18 nt, Human
ccagguuugcucuggaaa

SEQ ID NO: 303816 - RNA, 21 nt, Human
cccagagccccaggacugccu

SEQ ID NO: 303817 - RNA, 22 nt, Human
cccaugcaccagcggcgccgag

SEQ ID NO: 303818 - RNA, 23 nt, Human
ccccagagccccaggacugccuc

SEQ ID NO: 303819 - RNA, 22 nt, Human
ccccaggacugccucugccucc

SEQ ID NO: 303820 - RNA, 23 nt, Human
cccccagccgacccggguccccg

SEQ ID NO: 303821 - RNA, 18 nt, Human
ccccugccggccagcgcc

SEQ ID NO: 303822 - RNA, 22 nt, Human
cccgagccccagagccccagga

SEQ ID NO: 303823 - RNA, 21 nt, Human
cccggcuccccucccaugcac

SEQ ID NO: 303824 - RNA, 22 nt, Human
cccucugaguuggaagccccca

SEQ ID NO: 303825 - RNA, 20 nt, Human
ccuccgccccgagcuccugc

SEQ ID NO: 303826 - RNA, 21 nt, Human
ccucugccuccaccggaaugg

SEQ ID NO: 303827 - RNA, 24 nt, Human
ccugccugggaaguccucggccgc

SEQ ID NO: 303828 - RNA, 18 nt, Human
cgccccgagcuccugccu

SEQ ID NO: 303829 - RNA, 24 nt, Human
cugccggccagcgccucgcugccc

SEQ ID NO: 303830 - RNA, 24 nt, Human
cugcgggucccggugacaaagccc

SEQ ID NO: 303831 - RNA, 19 nt, Human
gacaggacagggcagggca

SEQ ID NO: 303832 - RNA, 22 nt, Human
gacaggacagggcagggcagga

SEQ ID NO: 303833 - RNA, 22 nt, Human
gaccgaucccacccggaacaca

SEQ ID NO: 303834 - RNA, 19 nt, Human
gaggaagcaccggguuucu

SEQ ID NO: 303835 - RNA, 21 nt, Human
gaggaagcaccggguuucuug

SEQ ID NO: 303836 - RNA, 22 nt, Human
gaggaagcaccggguuucuugg

SEQ ID NO: 303837 - RNA, 24 nt, Human
gccagccucaggcuggcaccgcag

SEQ ID NO: 303838 - RNA, 21 nt, Human
gccagcgccucgcugcccugg

SEQ ID NO: 303839 - RNA, 24 nt, Human
gccccagagccccaggacugccuc

SEQ ID NO: 303840 - RNA, 22 nt, Human
gccggccagcgccucgcugccc

SEQ ID NO: 303841 - RNA, 23 nt, Human
gccggccagcgccucgcugcccu

SEQ ID NO: 303842 - RNA, 25 nt, Human
ggaagcccccagccgacccgggucc

SEQ ID NO: 303843 - RNA, 18 nt, Human
ggagcagccagccucagg

SEQ ID NO: 303844 - RNA, 22 nt, Human
ggaucaggcaaaucacacuccc

SEQ ID NO: 303845 - RNA, 24 nt, Human
gggaacggcgggaagugggauggc

SEQ ID NO: 303846 - RNA, 23 nt, Human
uccagaccgaucccacccggaac

SEQ ID NO: 303847 - RNA, 22 nt, Human
ucccaugcaccagcggcgccga

SEQ ID NO: 303848 - RNA, 21 nt, Human
ucccucugaguuggaagcccc

SEQ ID NO: 303849 - RNA, 20 nt, Human
ucuggaggaagcaccggguu

SEQ ID NO: 303850 - RNA, 23 nt, Human
ugacaaagcccgagccccagagc

SEQ ID NO: 303851 - RNA, 20 nt, Human
ugccucugccuccaccggaa

SEQ ID NO: 303852 - RNA, 19 nt, Human
ugccugggaaguccucggc

SEQ ID NO: 303853 - RNA, 21 nt, Human
uggaagcccccagccgacccg

SEQ ID NO: 303854 - RNA, 18 nt, Human
uggcaccgcagcgccccc

SEQ ID NO: 303855 - RNA, 21 nt, Human
ugggauggcgguacagggcug

SEQ ID NO: 303856 - RNA, 21 nt, Human
uguccugcccccauccuccuu

SEQ ID NO: 303857 - RNA, 23 nt, Human
uguccugcccccauccuccuuca

SEQ ID NO: 303858 - RNA, 18 nt, Human
uuccucauaucagcuuua

SEQ ID NO: 303859 - RNA, 23 nt, Human
uuggaagcccccagccgacccgg

SEQ ID NO: 303860 - RNA, 21 nt, Human
aaaaacaacaaaauuaacaaa

SEQ ID NO: 303861 - RNA, 23 nt, Human
aaaaaugacaggaaaacaaccua

SEQ ID NO: 303862 - RNA, 25 nt, Human
aaacccagcagaucugggcugugaa

SEQ ID NO: 303863 - RNA, 19 nt, Human
aaauagcugcagaaaaacc

SEQ ID NO: 303864 - RNA, 24 nt, Human
aaugcuagaaaauagcugcagaaa

SEQ ID NO: 303865 - RNA, 20 nt, Human
aauuucugcccgcuggccuc

SEQ ID NO: 303866 - RNA, 26 nt, Human
acaaaauacaacagcuagaauuacaa

SEQ ID NO: 303867 - RNA, 21 nt, Human
acuccuuuaccucccauaucc

SEQ ID NO: 303868 - RNA, 27 nt, Human
agagagaagggaauacgcagaggggcc

SEQ ID NO: 303869 - RNA, 24 nt, Human
agagagaccaaaaccuaaccugag

SEQ ID NO: 303870 - RNA, 22 nt, Human
agcacccaauauuccuuugaaa

SEQ ID NO: 303871 - RNA, 21 nt, Human
agcagaucugggcugugaagg

SEQ ID NO: 303872 - RNA, 18 nt, Human
aggcaggauggaaaggug

SEQ ID NO: 303873 - RNA, 23 nt, Human
aggcaggauggaaagguggaagg

SEQ ID NO: 303874 - RNA, 21 nt, Human
aggcgggaggugaacagggaa

SEQ ID NO: 303875 - RNA, 21 nt, Human
agugaccaggagcaacuggga

SEQ ID NO: 303876 - RNA, 20 nt, Human
aguggccaacaguaaauuuc

SEQ ID NO: 303877 - RNA, 18 nt, Human
aguuacaagaaacaagac

SEQ ID NO: 303878 - RNA, 18 nt, Human
caaaauccauucauccaa

SEQ ID NO: 303879 - RNA, 23 nt, Human
caaauucacaaaauacaacagcu

SEQ ID NO: 303880 - RNA, 26 nt, Human
caacagcuagaauuacaaaauccauu

SEQ ID NO: 303881 - RNA, 21 nt, Human
caagacaguaauggcuauaaa

SEQ ID NO: 303882 - RNA, 19 nt, Human
cacagcuccgccgccgcgg

SEQ ID NO: 303883 - RNA, 19 nt, Human
caggaaaacaaccuaaucu

SEQ ID NO: 303884 - RNA, 24 nt, Human
caguaaauuucugcccgcuggccu

SEQ ID NO: 303885 - RNA, 26 nt, Human
ccacagcuccgccgccgcggcuccgg

SEQ ID NO: 303886 - RNA, 21 nt, Human
cccacaauuuuagucucucaa

SEQ ID NO: 303887 - RNA, 20 nt, Human
cccaugcccaccgcgggcca

SEQ ID NO: 303888 - RNA, 24 nt, Human
cccuuggcagagcggguccugccu

SEQ ID NO: 303889 - RNA, 18 nt, Human
ccgccgcggcuccggccc

SEQ ID NO: 303890 - RNA, 23 nt, Human
ccgccgcggcuccggcccugccc

SEQ ID NO: 303891 - RNA, 23 nt, Human
ccuccuaucucaucucuucaggc

SEQ ID NO: 303892 - RNA, 21 nt, Human
ccuuugaaauauggaaauaga

SEQ ID NO: 303893 - RNA, 18 nt, Human
cggaguugaaaaaguuca

SEQ ID NO: 303894 - RNA, 24 nt, Human
cuauaugcagcacccaauauuccu

SEQ ID NO: 303895 - RNA, 21 nt, Human
cuccuuuaccucccauaucca

SEQ ID NO: 303896 - RNA, 19 nt, Human
cuuuccuccuaucucaucu

SEQ ID NO: 303897 - RNA, 23 nt, Human
gaaaaacaacaaaauuaacaaau

SEQ ID NO: 303898 - RNA, 20 nt, Human
gacuuuaaauguaccaauug

SEQ ID NO: 303899 - RNA, 19 nt, Human
gagaccaaaaccuaaccug

SEQ ID NO: 303900 - RNA, 19 nt, Human
gcaggcgggaggugaacag

SEQ ID NO: 303901 - RNA, 21 nt, Human
gcaguggagcaagagagacca

SEQ ID NO: 303902 - RNA, 25 nt, Human
gcaguggagcaagagagaccaaaag

SEQ ID NO: 303903 - RNA, 21 nt, Human
gccacagcuucuuccaauccc

SEQ ID NO: 303904 - RNA, 19 nt, Human
gcuagaauuacaaaaucca

SEQ ID NO: 303905 - RNA, 19 nt, Human
gcugcagaaaaaccugugg

SEQ ID NO: 303906 - RNA, 21 nt, Human
gcuuuuuccccuucaagggaa

SEQ ID NO: 303907 - RNA, 19 nt, Human
ggaaaacaaccuaaucaca

SEQ ID NO: 303908 - RNA, 21 nt, Human
ggcuuuuuuuuuuuuuuuuuu

SEQ ID NO: 303909 - RNA, 20 nt, Human
gggaauacgcagaggggccc

SEQ ID NO: 303910 - RNA, 21 nt, Human
guggagcaagagagaccaaaa

SEQ ID NO: 303911 - RNA, 26 nt, Human
uaccagguauuuugaacaucugcccc

SEQ ID NO: 303912 - RNA, 22 nt, Human
uagaaaauagcugcagaaaaac

SEQ ID NO: 303913 - RNA, 24 nt, Human
uagcuuuuuccccuucaagggaaa

SEQ ID NO: 303914 - RNA, 24 nt, Human
ucacagaaaaacaacaaaauuaac

SEQ ID NO: 303915 - RNA, 24 nt, Human
ucaguccaggcacagggacuggca

SEQ ID NO: 303916 - RNA, 23 nt, Human
uccacacacuggugucagggaac

SEQ ID NO: 303917 - RNA, 18 nt, Human
ucccuggcaggcgggagg

SEQ ID NO: 303918 - RNA, 21 nt, Human
uccucaaaacccagcagaucu

SEQ ID NO: 303919 - RNA, 23 nt, Human
ucugcccgcuggccucccaccac

SEQ ID NO: 303920 - RNA, 22 nt, Human
ugaccaggagcaacugggacac

SEQ ID NO: 303921 - RNA, 23 nt, Human
ugaccauuuuuuaaaaacuugua

SEQ ID NO: 303922 - RNA, 21 nt, Human
ugcagaaaaaccuguggccuu

SEQ ID NO: 303923 - RNA, 23 nt, Human
ugcaguggagcaagagagaccaa

SEQ ID NO: 303924 - RNA, 20 nt, Human
uggaaauagaccuggcagug

SEQ ID NO: 303925 - RNA, 23 nt, Human
uggcaaaugcuagaaaauagcug

SEQ ID NO: 303926 - RNA, 18 nt, Human
uggccucccaccaccaac

SEQ ID NO: 303927 - RNA, 21 nt, Human
uugcaguggagcaagagagac

SEQ ID NO: 303928 - RNA, 21 nt, Human
uuucacagaaaaacaacaaaa

SEQ ID NO: 303929 - RNA, 22 nt, Human
uuuuuuuuuuuuuugcagugga

SEQ ID NO: 303930 - RNA, 19 nt, Human
uuuuuuuuuuuuuuuuugc

SEQ ID NO: 303931 - RNA, 25 nt, Human
uuuuuuuuuuuuuuuuuugcagugg

SEQ ID NO: 303932 - RNA, 27 nt, Human
uuuuuuuuuuuuuuuuuuuuuuugggg

SEQ ID NO: 303933 - RNA, 18 nt, Human
aaaaaaacaaaaaccccc

SEQ ID NO: 303934 - RNA, 21 nt, Human
aaaaaaacaaaaaccccccaa

SEQ ID NO: 303935 - RNA, 22 nt, Human
aaaaaaacaaaaaccccccaaa

SEQ ID NO: 303936 - RNA, 22 nt, Human
aaaaaaacaaaaaccccccaaa

SEQ ID NO: 303937 - RNA, 22 nt, Human
aaaaaaacaaaaaccccccaaa

SEQ ID NO: 303938 - RNA, 20 nt, Human
aaaaaacaaaaaccccccaa

SEQ ID NO: 303939 - RNA, 20 nt, Human
aaaaaacaaaaaccccccaa

SEQ ID NO: 303940 - RNA, 23 nt, Human
aaaaaggaaaauaauaauuugca

SEQ ID NO: 303941 - RNA, 24 nt, Human
aaaaaggaaaauaauaauuugcaa

SEQ ID NO: 303942 - RNA, 24 nt, Human
aaaaaggaaaauaauaauuugcaa

SEQ ID NO: 303943 - RNA, 24 nt, Human
aaaaaggaaaauaauaauuugcaa

SEQ ID NO: 303944 - RNA, 19 nt, Human
aaaacaaaaaccccccaaa

SEQ ID NO: 303945 - RNA, 19 nt, Human
aaaacaaaaaccccccaaa

SEQ ID NO: 303946 - RNA, 22 nt, Human
aaaacaaaaaccccccaaaagc

SEQ ID NO: 303947 - RNA, 22 nt, Human
aaaacaaaaaccccccaaaagc

SEQ ID NO: 303948 - RNA, 22 nt, Human
aaaacaaaaaccccccaaaagc

SEQ ID NO: 303949 - RNA, 24 nt, Human
aaaacaaaaaccccccaaaagcaa

SEQ ID NO: 303950 - RNA, 18 nt, Human
aaaaggacaggguagcag

SEQ ID NO: 303951 - RNA, 18 nt, Human
aaaaggacaggguagcag

SEQ ID NO: 303952 - RNA, 21 nt, Human
aaaaggacaggguagcagcug

SEQ ID NO: 303953 - RNA, 21 nt, Human
aaaaggacaggguagcagcug

SEQ ID NO: 303954 - RNA, 21 nt, Human
aaaaggacaggguagcagcug

SEQ ID NO: 303955 - RNA, 23 nt, Human
aaaauaccuucacaaacacaacu

SEQ ID NO: 303956 - RNA, 23 nt, Human
aaaauaccuucacaaacacaacu

SEQ ID NO: 303957 - RNA, 23 nt, Human
aaaauaccuucacaaacacaacu

SEQ ID NO: 303958 - RNA, 18 nt, Human
aaacaaaaaccccccaaa

SEQ ID NO: 303959 - RNA, 23 nt, Human
aaacaaaaaccccccaaaagcaa

SEQ ID NO: 303960 - RNA, 23 nt, Human
aaacaaaaaccccccaaaagcaa

SEQ ID NO: 303961 - RNA, 24 nt, Human
aaaccuuaagaguucaaagaauuc

SEQ ID NO: 303962 - RNA, 24 nt, Human
aaaccuuaagaguucaaagaauuc

SEQ ID NO: 303963 - RNA, 24 nt, Human
aaaccuuaagaguucaaagaauuc

SEQ ID NO: 303964 - RNA, 18 nt, Human
aaacugccaacaaagcaa

SEQ ID NO: 303965 - RNA, 18 nt, Human
aaacugccaacaaagcaa

SEQ ID NO: 303966 - RNA, 18 nt, Human
aaagcaaaaaauaccuuc

SEQ ID NO: 303967 - RNA, 18 nt, Human
aaagcaaaaaauaccuuc

SEQ ID NO: 303968 - RNA, 18 nt, Human
aaagcaaaaaauaccuuc

SEQ ID NO: 303969 - RNA, 23 nt, Human
aaagcaaaaaauaccuucacaaa

SEQ ID NO: 303970 - RNA, 23 nt, Human
aaagcaaaaaauaccuucacaaa

SEQ ID NO: 303971 - RNA, 23 nt, Human
aaagcaaaaaauaccuucacaaa

SEQ ID NO: 303972 - RNA, 22 nt, Human
aaauucacuuuaaaaucaacua

SEQ ID NO: 303973 - RNA, 23 nt, Human
aaauucacuuuaaaaucaacuaa

SEQ ID NO: 303974 - RNA, 23 nt, Human
aaauucacuuuaaaaucaacuaa

SEQ ID NO: 303975 - RNA, 22 nt, Human
aacaaaaaccccccaaaagcaa

SEQ ID NO: 303976 - RNA, 21 nt, Human
aacacagcuuccacugauacc

SEQ ID NO: 303977 - RNA, 21 nt, Human
aacacagcuuccacugauacc

SEQ ID NO: 303978 - RNA, 22 nt, Human
aacacagcuuccacugauaccc

SEQ ID NO: 303979 - RNA, 22 nt, Human
aacacagcuuccacugauaccc

SEQ ID NO: 303980 - RNA, 19 nt, Human
aacagugauaucggucccc

SEQ ID NO: 303981 - RNA, 19 nt, Human
aacagugauaucggucccc

SEQ ID NO: 303982 - RNA, 19 nt, Human
aacagugauaucggucccc

SEQ ID NO: 303983 - RNA, 24 nt, Human
aaccacaauuaugaugaaguaagc

SEQ ID NO: 303984 - RNA, 24 nt, Human
aaccacaauuaugaugaaguaagc

SEQ ID NO: 303985 - RNA, 24 nt, Human
aaccacaauuaugaugaaguaagc

SEQ ID NO: 303986 - RNA, 27 nt, Human
aacucuaaaaaaacaaaaaccccccaa

SEQ ID NO: 303987 - RNA, 27 nt, Human
aacucuaaaaaaacaaaaaccccccaa

SEQ ID NO: 303988 - RNA, 27 nt, Human
aacucuaaaaaaacaaaaaccccccaa

SEQ ID NO: 303989 - RNA, 22 nt, Human
aacuuacuaaauuaacucuaaa

SEQ ID NO: 303990 - RNA, 18 nt, Human
aagaaaaugaggaagagg

SEQ ID NO: 303991 - RNA, 18 nt, Human
aagaaaaugaggaagagg

SEQ ID NO: 303992 - RNA, 22 nt, Human
aauaccuucacaaacacaacug

SEQ ID NO: 303993 - RNA, 22 nt, Human
aauaccuucacaaacacaacug

SEQ ID NO: 303994 - RNA, 23 nt, Human
aaugugcugguaacugauggacu

SEQ ID NO: 303995 - RNA, 23 nt, Human
aaugugcugguaacugauggacu

SEQ ID NO: 303996 - RNA, 23 nt, Human
aaugugcugguaacugauggacu

SEQ ID NO: 303997 - RNA, 21 nt, Human
acaaaaaccccccaaaagcaa

SEQ ID NO: 303998 - RNA, 21 nt, Human
acaaaaaccccccaaaagcaa

SEQ ID NO: 303999 - RNA, 24 nt, Human
acaaaacacaaauauauuucuuuu

SEQ ID NO: 304000 - RNA, 24 nt, Human
acaaaacacaaauauauuucuuuu

SEQ ID NO: 304001 - RNA, 24 nt, Human
acaaaacacaaauauauuucuuuu

SEQ ID NO: 304002 - RNA, 18 nt, Human
acaaagcaaagauguagc

SEQ ID NO: 304003 - RNA, 18 nt, Human
acaaagcaaagauguagc

SEQ ID NO: 304004 - RNA, 20 nt, Human
acaaagcaaagauguagccu

SEQ ID NO: 304005 - RNA, 20 nt, Human
acaaagcaaagauguagccu

SEQ ID NO: 304006 - RNA, 27 nt, Human
accacaauuaugaugaaguaagccauu

SEQ ID NO: 304007 - RNA, 27 nt, Human
accacaauuaugaugaaguaagccauu

SEQ ID NO: 304008 - RNA, 27 nt, Human
accacaauuaugaugaaguaagccauu

SEQ ID NO: 304009 - RNA, 19 nt, Human
accuuaagaguucaaagaa

SEQ ID NO: 304010 - RNA, 19 nt, Human
accuuaagaguucaaagaa

SEQ ID NO: 304011 - RNA, 19 nt, Human
accuuaagaguucaaagaa

SEQ ID NO: 304012 - RNA, 18 nt, Human
acgugaaacaaauuuacu

SEQ ID NO: 304013 - RNA, 18 nt, Human
agagcaacccaguuaaga

SEQ ID NO: 304014 - RNA, 25 nt, Human
agauuuuaaaaauugcacucuugcu

SEQ ID NO: 304015 - RNA, 25 nt, Human
agauuuuaaaaauugcacucuugcu

SEQ ID NO: 304016 - RNA, 25 nt, Human
agauuuuaaaaauugcacucuugcu

SEQ ID NO: 304017 - RNA, 20 nt, Human
agccuguuacugggccgcag

SEQ ID NO: 304018 - RNA, 22 nt, Human
agcgaggccacagugaagggga

SEQ ID NO: 304019 - RNA, 22 nt, Human
agcgaggccacagugaagggga

SEQ ID NO: 304020 - RNA, 22 nt, Human
agcgaggccacagugaagggga

SEQ ID NO: 304021 - RNA, 19 nt, Human
aggaagaggaaguugaaaa

SEQ ID NO: 304022 - RNA, 18 nt, Human
agggauuucaguagucug

SEQ ID NO: 304023 - RNA, 18 nt, Human
agggauuucaguagucug

SEQ ID NO: 304024 - RNA, 18 nt, Human
agggauuucaguagucug

SEQ ID NO: 304025 - RNA, 21 nt, Human
aguccaggcaccccguggccc

SEQ ID NO: 304026 - RNA, 21 nt, Human
aguccaggcaccccguggccc

SEQ ID NO: 304027 - RNA, 19 nt, Human
auaaaaaucccaguaagac

SEQ ID NO: 304028 - RNA, 22 nt, Human
auaaauuuugugaauguuguca

SEQ ID NO: 304029 - RNA, 22 nt, Human
auaaauuuugugaauguuguca

SEQ ID NO: 304030 - RNA, 22 nt, Human
auaaauuuugugaauguuguca

SEQ ID NO: 304031 - RNA, 22 nt, Human
auaauacacaccauguggauaa

SEQ ID NO: 304032 - RNA, 22 nt, Human
auaauacacaccauguggauaa

SEQ ID NO: 304033 - RNA, 22 nt, Human
auaauacacaccauguggauaa

SEQ ID NO: 304034 - RNA, 21 nt, Human
auaccuucacaaacacaacug

SEQ ID NO: 304035 - RNA, 22 nt, Human
augaaguaagccauuugaaugg

SEQ ID NO: 304036 - RNA, 22 nt, Human
augaaguaagccauuugaaugg

SEQ ID NO: 304037 - RNA, 22 nt, Human
augaaguaagccauuugaaugg

SEQ ID NO: 304038 - RNA, 25 nt, Human
augguaaacaaagagugaaugcacc

SEQ ID NO: 304039 - RNA, 25 nt, Human
augguaaacaaagagugaaugcacc

SEQ ID NO: 304040 - RNA, 25 nt, Human
augguaaacaaagagugaaugcacc

SEQ ID NO: 304041 - RNA, 20 nt, Human
auucuggucuuuauuuuugg

SEQ ID NO: 304042 - RNA, 20 nt, Human
auucuggucuuuauuuuugg

SEQ ID NO: 304043 - RNA, 20 nt, Human
auucuggucuuuauuuuugg

SEQ ID NO: 304044 - RNA, 21 nt, Human
auugaucucauaucaaccaca

SEQ ID NO: 304045 - RNA, 21 nt, Human
auugaucucauaucaaccaca

SEQ ID NO: 304046 - RNA, 21 nt, Human
auugaucucauaucaaccaca

SEQ ID NO: 304047 - RNA, 19 nt, Human
auugcacucuugcuuuugc

SEQ ID NO: 304048 - RNA, 19 nt, Human
auugcacucuugcuuuugc

SEQ ID NO: 304049 - RNA, 19 nt, Human
auugcacucuugcuuuugc

SEQ ID NO: 304050 - RNA, 22 nt, Human
caaaaaauaccuucacaaacac

SEQ ID NO: 304051 - RNA, 22 nt, Human
caaaaaauaccuucacaaacac

SEQ ID NO: 304052 - RNA, 22 nt, Human
caaaaaauaccuucacaaacac

SEQ ID NO: 304053 - RNA, 20 nt, Human
caaaaccccuaacuucuaga

SEQ ID NO: 304054 - RNA, 20 nt, Human
caaaaccccuaacuucuaga

SEQ ID NO: 304055 - RNA, 20 nt, Human
caaaaccccuaacuucuaga

SEQ ID NO: 304056 - RNA, 24 nt, Human
caaagcucucaaaauauaauguua

SEQ ID NO: 304057 - RNA, 24 nt, Human
caaagcucucaaaauauaauguua

SEQ ID NO: 304058 - RNA, 24 nt, Human
caaagcucucaaaauauaauguua

SEQ ID NO: 304059 - RNA, 24 nt, Human
caacaaaaccccuaacuucuagau

SEQ ID NO: 304060 - RNA, 25 nt, Human
caauauauuuuucacaaauuucuca

SEQ ID NO: 304061 - RNA, 25 nt, Human
caauauauuuuucacaaauuucuca

SEQ ID NO: 304062 - RNA, 25 nt, Human
caauauauuuuucacaaauuucuca

SEQ ID NO: 304063 - RNA, 19 nt, Human
cacaaacacaacugaagau

SEQ ID NO: 304064 - RNA, 19 nt, Human
cacaaacacaacugaagau

SEQ ID NO: 304065 - RNA, 19 nt, Human
cacaaacacaacugaagau

SEQ ID NO: 304066 - RNA, 24 nt, Human
cacaacacugucagaaucuaugua

SEQ ID NO: 304067 - RNA, 24 nt, Human
cacaacacugucagaaucuaugua

SEQ ID NO: 304068 - RNA, 24 nt, Human
cacaacacugucagaaucuaugua

SEQ ID NO: 304069 - RNA, 18 nt, Human
cacauaaaauaauaaggu

SEQ ID NO: 304070 - RNA, 22 nt, Human
caccccguggcccaguggcauc

SEQ ID NO: 304071 - RNA, 22 nt, Human
caccccguggcccaguggcauc

SEQ ID NO: 304072 - RNA, 25 nt, Human
cacccugucaugcagcugguaucuu

SEQ ID NO: 304073 - RNA, 25 nt, Human
cacccugucaugcagcugguaucuu

SEQ ID NO: 304074 - RNA, 19 nt, Human
cagauaucucauuauucuc

SEQ ID NO: 304075 - RNA, 19 nt, Human
cagauaucucauuauucuc

SEQ ID NO: 304076 - RNA, 24 nt, Human
cagcacccaaagcucucaaaauau

SEQ ID NO: 304077 - RNA, 24 nt, Human
cagcacccaaagcucucaaaauau

SEQ ID NO: 304078 - RNA, 24 nt, Human
cagcacccaaagcucucaaaauau

SEQ ID NO: 304079 - RNA, 18 nt, Human
cagcugguuuugggaugg

SEQ ID NO: 304080 - RNA, 18 nt, Human
cagcugguuuugggaugg

SEQ ID NO: 304081 - RNA, 23 nt, Human
caguagucugaaaaauugcauac

SEQ ID NO: 304082 - RNA, 23 nt, Human
caguagucugaaaaauugcauac

SEQ ID NO: 304083 - RNA, 23 nt, Human
caguagucugaaaaauugcauac

SEQ ID NO: 304084 - RNA, 22 nt, Human
cauaaaaaucccaguaagacug

SEQ ID NO: 304085 - RNA, 22 nt, Human
cauaaaaaucccaguaagacug

SEQ ID NO: 304086 - RNA, 25 nt, Human
cauaacuuacuaaauuaacucuaaa

SEQ ID NO: 304087 - RNA, 25 nt, Human
cauaacuuacuaaauuaacucuaaa

SEQ ID NO: 304088 - RNA, 22 nt, Human
cauguuggauauugaucucaua

SEQ ID NO: 304089 - RNA, 21 nt, Human
ccaaaaaaugcccagaaaacg

SEQ ID NO: 304090 - RNA, 21 nt, Human
ccaaaaaaugcccagaaaacg

SEQ ID NO: 304091 - RNA, 21 nt, Human
ccaaaaaaugcccagaaaacg

SEQ ID NO: 304092 - RNA, 24 nt, Human
cccgaacuucuuccaaaaugauuu

SEQ ID NO: 304093 - RNA, 24 nt, Human
cccgaacuucuuccaaaaugauuu

SEQ ID NO: 304094 - RNA, 18 nt, Human
cggugauuuuuuuccugg

SEQ ID NO: 304095 - RNA, 18 nt, Human
cggugauuuuuuuccugg

SEQ ID NO: 304096 - RNA, 18 nt, Human
cggugauuuuuuuccugg

SEQ ID NO: 304097 - RNA, 20 nt, Human
cuaaaaaaacaaaaaccccc

SEQ ID NO: 304098 - RNA, 20 nt, Human
cuaaaaaaacaaaaaccccc

SEQ ID NO: 304099 - RNA, 22 nt, Human
cucacaaaaaccuuaagaguuc

SEQ ID NO: 304100 - RNA, 22 nt, Human
cucacaaaaaccuuaagaguuc

SEQ ID NO: 304101 - RNA, 22 nt, Human
cucacaaaaaccuuaagaguuc

SEQ ID NO: 304102 - RNA, 20 nt, Human
cucacauaaaauaauaaggu

SEQ ID NO: 304103 - RNA, 22 nt, Human
cucuaaaaaaacaaaaaccccc

SEQ ID NO: 304104 - RNA, 25 nt, Human
cucuaaaaaaacaaaaaccccccaa

SEQ ID NO: 304105 - RNA, 25 nt, Human
cucuaaaaaaacaaaaaccccccaa

SEQ ID NO: 304106 - RNA, 25 nt, Human
cucuaaaaaaacaaaaaccccccaa

SEQ ID NO: 304107 - RNA, 20 nt, Human
cugaagauggaggcucuacc

SEQ ID NO: 304108 - RNA, 20 nt, Human
cugaagauggaggcucuacc

SEQ ID NO: 304109 - RNA, 20 nt, Human
cugaagauggaggcucuacc

SEQ ID NO: 304110 - RNA, 21 nt, Human
cuggagcuggcaaugucccug

SEQ ID NO: 304111 - RNA, 21 nt, Human
cuggagcuggcaaugucccug

SEQ ID NO: 304112 - RNA, 21 nt, Human
cuuacauuaaaaggacagggu

SEQ ID NO: 304113 - RNA, 21 nt, Human
cuuacauuaaaaggacagggu

SEQ ID NO: 304114 - RNA, 21 nt, Human
cuuacauuaaaaggacagggu

SEQ ID NO: 304115 - RNA, 23 nt, Human
cuugaacuaagacauuucuaaca

SEQ ID NO: 304116 - RNA, 23 nt, Human
cuugaacuaagacauuucuaaca

SEQ ID NO: 304117 - RNA, 24 nt, Human
cuuucccgaacuucuuccaaaaug

SEQ ID NO: 304118 - RNA, 24 nt, Human
cuuucccgaacuucuuccaaaaug

SEQ ID NO: 304119 - RNA, 24 nt, Human
gaaauacaauauauuuuucacaaa

SEQ ID NO: 304120 - RNA, 24 nt, Human
gaaauacaauauauuuuucacaaa

SEQ ID NO: 304121 - RNA, 24 nt, Human
gaaauacaauauauuuuucacaaa

SEQ ID NO: 304122 - RNA, 22 nt, Human
gaagaggaaguugaaaacugcc

SEQ ID NO: 304123 - RNA, 22 nt, Human
gaagaggaaguugaaaacugcc

SEQ ID NO: 304124 - RNA, 20 nt, Human
gaaggcauuuauagaaaacu

SEQ ID NO: 304125 - RNA, 20 nt, Human
gaaggcauuuauagaaaacu

SEQ ID NO: 304126 - RNA, 20 nt, Human
gaaggcauuuauagaaaacu

SEQ ID NO: 304127 - RNA, 19 nt, Human
gaggccacagugaagggga

SEQ ID NO: 304128 - RNA, 19 nt, Human
gaggccacagugaagggga

SEQ ID NO: 304129 - RNA, 19 nt, Human
gaggccacagugaagggga

SEQ ID NO: 304130 - RNA, 18 nt, Human
gagucauccaucucaaga

SEQ ID NO: 304131 - RNA, 18 nt, Human
gagucauccaucucaaga

SEQ ID NO: 304132 - RNA, 23 nt, Human
gccaacaaagcaaagauguagcc

SEQ ID NO: 304133 - RNA, 22 nt, Human
ggaggcucuaccuaggagaaug

SEQ ID NO: 304134 - RNA, 22 nt, Human
ggaggcucuaccuaggagaaug

SEQ ID NO: 304135 - RNA, 22 nt, Human
ggaggcucuaccuaggagaaug

SEQ ID NO: 304136 - RNA, 22 nt, Human
ggcaaccuuuugaaacaucaaa

SEQ ID NO: 304137 - RNA, 22 nt, Human
ggcaaccuuuugaaacaucaaa

SEQ ID NO: 304138 - RNA, 22 nt, Human
ggcaaccuuuugaaacaucaaa

SEQ ID NO: 304139 - RNA, 23 nt, Human
ggcaaccuuuugaaacaucaaaa

SEQ ID NO: 304140 - RNA, 23 nt, Human
ggcaaccuuuugaaacaucaaaa

SEQ ID NO: 304141 - RNA, 23 nt, Human
ggcaaccuuuugaaacaucaaaa

SEQ ID NO: 304142 - RNA, 23 nt, Human
ggucccucuccuccaauuaugaa

SEQ ID NO: 304143 - RNA, 18 nt, Human
ggugauuuuuuuccuggc

SEQ ID NO: 304144 - RNA, 18 nt, Human
ggugauuuuuuuccuggc

SEQ ID NO: 304145 - RNA, 18 nt, Human
ggugauuuuuuuccuggc

SEQ ID NO: 304146 - RNA, 19 nt, Human
gguggcaugccucuaaaac

SEQ ID NO: 304147 - RNA, 18 nt, Human
guuacaauuaagguaucc

SEQ ID NO: 304148 - RNA, 23 nt, Human
guuacaauuaagguauccagaaa

SEQ ID NO: 304149 - RNA, 23 nt, Human
guuacaauuaagguauccagaaa

SEQ ID NO: 304150 - RNA, 23 nt, Human
guuacaauuaagguauccagaaa

SEQ ID NO: 304151 - RNA, 25 nt, Human
uaaaaaaacaaaaaccccccaaaag

SEQ ID NO: 304152 - RNA, 25 nt, Human
uaaaaaaacaaaaaccccccaaaag

SEQ ID NO: 304153 - RNA, 25 nt, Human
uaaaaaaacaaaaaccccccaaaag

SEQ ID NO: 304154 - RNA, 23 nt, Human
uaaaacaguucauauaauuguug

SEQ ID NO: 304155 - RNA, 23 nt, Human
uaaaacaguucauauaauuguug

SEQ ID NO: 304156 - RNA, 23 nt, Human
uaaaacaguucauauaauuguug

SEQ ID NO: 304157 - RNA, 18 nt, Human
uaaacaaagagugaaugc

SEQ ID NO: 304158 - RNA, 18 nt, Human
uaaacaaagagugaaugc

SEQ ID NO: 304159 - RNA, 18 nt, Human
uaaacaaagagugaaugc

SEQ ID NO: 304160 - RNA, 23 nt, Human
uaaauaaaccauucugaaguaaa

SEQ ID NO: 304161 - RNA, 23 nt, Human
uaaauaaaccauucugaaguaaa

SEQ ID NO: 304162 - RNA, 23 nt, Human
uaaauaaaccauucugaaguaaa

SEQ ID NO: 304163 - RNA, 20 nt, Human
uaacauccacccacaaagac

SEQ ID NO: 304164 - RNA, 20 nt, Human
uaacauccacccacaaagac

SEQ ID NO: 304165 - RNA, 20 nt, Human
uaacauccacccacaaagac

SEQ ID NO: 304166 - RNA, 22 nt, Human
uagccuguuacugggccgcagu

SEQ ID NO: 304167 - RNA, 22 nt, Human
uaguagugugucggugauuuuu

SEQ ID NO: 304168 - RNA, 22 nt, Human
uaguagugugucggugauuuuu

SEQ ID NO: 304169 - RNA, 22 nt, Human
uaguagugugucggugauuuuu

SEQ ID NO: 304170 - RNA, 21 nt, Human
uauagaaaacucaauuaugca

SEQ ID NO: 304171 - RNA, 21 nt, Human
uauagaaaacucaauuaugca

SEQ ID NO: 304172 - RNA, 21 nt, Human
uauagaaaacucaauuaugca

SEQ ID NO: 304173 - RNA, 23 nt, Human
uauuacaaauguuuaaaaucuua

SEQ ID NO: 304174 - RNA, 23 nt, Human
uauuacaaauguuuaaaaucuua

SEQ ID NO: 304175 - RNA, 23 nt, Human
uauuacaaauguuuaaaaucuua

SEQ ID NO: 304176 - RNA, 18 nt, Human
ucacaaaaaccuuaagag

SEQ ID NO: 304177 - RNA, 19 nt, Human
ucacaaaaaccuuaagagu

SEQ ID NO: 304178 - RNA, 19 nt, Human
ucacaaaaaccuuaagagu

SEQ ID NO: 304179 - RNA, 22 nt, Human
ucagauaucucauuauucucac

SEQ ID NO: 304180 - RNA, 21 nt, Human
ucagcacccaaagcucucaaa

SEQ ID NO: 304181 - RNA, 21 nt, Human
ucagcacccaaagcucucaaa

SEQ ID NO: 304182 - RNA, 21 nt, Human
ucagcacccaaagcucucaaa

SEQ ID NO: 304183 - RNA, 27 nt, Human
ucaguccauuuuucuccaacaaaaccc

SEQ ID NO: 304184 - RNA, 27 nt, Human
ucaguccauuuuucuccaacaaaaccc

SEQ ID NO: 304185 - RNA, 27 nt, Human
ucaguccauuuuucuccaacaaaaccc

SEQ ID NO: 304186 - RNA, 22 nt, Human
ucccaguaagacugaauaguuu

SEQ ID NO: 304187 - RNA, 22 nt, Human
ucccaguaagacugaauaguuu

SEQ ID NO: 304188 - RNA, 22 nt, Human
ucccaguaagacugaauaguuu

SEQ ID NO: 304189 - RNA, 18 nt, Human
ucgguccccaguauuuaa

SEQ ID NO: 304190 - RNA, 18 nt, Human
ucgguccccaguauuuaa

SEQ ID NO: 304191 - RNA, 18 nt, Human
ucgguccccaguauuuaa

SEQ ID NO: 304192 - RNA, 21 nt, Human
ucuaaaaaaacaaaaaccccc

SEQ ID NO: 304193 - RNA, 21 nt, Human
ucuaaaaaaacaaaaaccccc

SEQ ID NO: 304194 - RNA, 21 nt, Human
ucuaaagcucccaaaagacgc

SEQ ID NO: 304195 - RNA, 21 nt, Human
ucuaaagcucccaaaagacgc

SEQ ID NO: 304196 - RNA, 23 nt, Human
ucuccaacaaaaccccuaacuuc

SEQ ID NO: 304197 - RNA, 24 nt, Human
ucuccaacaaaaccccuaacuucu

SEQ ID NO: 304198 - RNA, 24 nt, Human
ucuccaacaaaaccccuaacuucu

SEQ ID NO: 304199 - RNA, 18 nt, Human
ucuuucccgaacuucuuc

SEQ ID NO: 304200 - RNA, 18 nt, Human
ucuuucccgaacuucuuc

SEQ ID NO: 304201 - RNA, 19 nt, Human
ugaaugauauagagguagc

SEQ ID NO: 304202 - RNA, 19 nt, Human
ugaaugauauagagguagc

SEQ ID NO: 304203 - RNA, 19 nt, Human
ugaaugauauagagguagc

SEQ ID NO: 304204 - RNA, 22 nt, Human
ugaaugguaaacaaagagugaa

SEQ ID NO: 304205 - RNA, 22 nt, Human
ugaaugguaaacaaagagugaa

SEQ ID NO: 304206 - RNA, 22 nt, Human
ugaaugguaaacaaagagugaa

SEQ ID NO: 304207 - RNA, 24 nt, Human
ugacaauacuuaucagacaucagc

SEQ ID NO: 304208 - RNA, 24 nt, Human
ugacaauacuuaucagacaucagc

SEQ ID NO: 304209 - RNA, 24 nt, Human
ugacaauacuuaucagacaucagc

SEQ ID NO: 304210 - RNA, 20 nt, Human
ugagugaaccuaauaaaugu

SEQ ID NO: 304211 - RNA, 20 nt, Human
ugagugaaccuaauaaaugu

SEQ ID NO: 304212 - RNA, 20 nt, Human
ugagugaaccuaauaaaugu

SEQ ID NO: 304213 - RNA, 23 nt, Human
ugcacacugacaauacuuaucag

SEQ ID NO: 304214 - RNA, 23 nt, Human
ugcacacugacaauacuuaucag

SEQ ID NO: 304215 - RNA, 23 nt, Human
ugcacacugacaauacuuaucag

SEQ ID NO: 304216 - RNA, 19 nt, Human
ugcacugaaaaauguggag

SEQ ID NO: 304217 - RNA, 20 nt, Human
ugcauaaaaaucccaguaag

SEQ ID NO: 304218 - RNA, 20 nt, Human
ugcauaaaaaucccaguaag

SEQ ID NO: 304219 - RNA, 20 nt, Human
ugcauaaaaaucccaguaag

SEQ ID NO: 304220 - RNA, 21 nt, Human
ugcauacaacaggaacaaagu

SEQ ID NO: 304221 - RNA, 21 nt, Human
ugcauacaacaggaacaaagu

SEQ ID NO: 304222 - RNA, 21 nt, Human
ugcauacaacaggaacaaagu

SEQ ID NO: 304223 - RNA, 24 nt, Human
ugccaacaaagcaaagauguagcc

SEQ ID NO: 304224 - RNA, 19 nt, Human
ugccuuauuguuuugaauu

SEQ ID NO: 304225 - RNA, 19 nt, Human
ugccuuauuguuuugaauu

SEQ ID NO: 304226 - RNA, 18 nt, Human
uggaggguuucucugcac

SEQ ID NO: 304227 - RNA, 18 nt, Human
uggaggguuucucugcac

SEQ ID NO: 304228 - RNA, 18 nt, Human
uggaggguuucucugcac

SEQ ID NO: 304229 - RNA, 22 nt, Human
uggcaaugucccugacuucagu

SEQ ID NO: 304230 - RNA, 22 nt, Human
uggcaaugucccugacuucagu

SEQ ID NO: 304231 - RNA, 23 nt, Human
uggcccaguggcaucuauugcaa

SEQ ID NO: 304232 - RNA, 23 nt, Human
uggcccaguggcaucuauugcaa

SEQ ID NO: 304233 - RNA, 19 nt, Human
uggcucugggcaacaacaa

SEQ ID NO: 304234 - RNA, 19 nt, Human
uggcucugggcaacaacaa

SEQ ID NO: 304235 - RNA, 19 nt, Human
uggcucugggcaacaacaa

SEQ ID NO: 304236 - RNA, 24 nt, Human
uggucccucuccuccaauuaugaa

SEQ ID NO: 304237 - RNA, 24 nt, Human
ugucaugcagcugguaucuuuccc

SEQ ID NO: 304238 - RNA, 24 nt, Human
ugucaugcagcugguaucuuuccc

SEQ ID NO: 304239 - RNA, 22 nt, Human
uguuaauuacauguaacaccua

SEQ ID NO: 304240 - RNA, 22 nt, Human
uguuaauuacauguaacaccua

SEQ ID NO: 304241 - RNA, 22 nt, Human
uguuaauuacauguaacaccua

SEQ ID NO: 304242 - RNA, 21 nt, Human
uuaaaaagcaaaaaauaccuu

SEQ ID NO: 304243 - RNA, 21 nt, Human
uuaaaaagcaaaaaauaccuu

SEQ ID NO: 304244 - RNA, 21 nt, Human
uuaaaaagcaaaaaauaccuu

SEQ ID NO: 304245 - RNA, 24 nt, Human
uuaacucuaaaaaaacaaaaaccc

SEQ ID NO: 304246 - RNA, 24 nt, Human
uuaacucuaaaaaaacaaaaaccc

SEQ ID NO: 304247 - RNA, 24 nt, Human
uuaacucuaaaaaaacaaaaaccc

SEQ ID NO: 304248 - RNA, 21 nt, Human
uuaauaacauccacccacaaa

SEQ ID NO: 304249 - RNA, 21 nt, Human
uuaauaacauccacccacaaa

SEQ ID NO: 304250 - RNA, 21 nt, Human
uuaauaacauccacccacaaa

SEQ ID NO: 304251 - RNA, 22 nt, Human
uuacaauuaagguauccagaaa

SEQ ID NO: 304252 - RNA, 22 nt, Human
uuacaauuaagguauccagaaa

SEQ ID NO: 304253 - RNA, 22 nt, Human
uuacaauuaagguauccagaaa

SEQ ID NO: 304254 - RNA, 21 nt, Human
uuacgugaaacaaauuuacuu

SEQ ID NO: 304255 - RNA, 21 nt, Human
uuacgugaaacaaauuuacuu

SEQ ID NO: 304256 - RNA, 24 nt, Human
uuacuaaauuaacucuaaaaaaac

SEQ ID NO: 304257 - RNA, 24 nt, Human
uuacuaaauuaacucuaaaaaaac

SEQ ID NO: 304258 - RNA, 24 nt, Human
uuacuaaauuaacucuaaaaaaac

SEQ ID NO: 304259 - RNA, 20 nt, Human
uuaguacaaacaaaacacaa

SEQ ID NO: 304260 - RNA, 21 nt, Human
uuaguacaaacaaaacacaaa

SEQ ID NO: 304261 - RNA, 21 nt, Human
uuaguacaaacaaaacacaaa

SEQ ID NO: 304262 - RNA, 21 nt, Human
uucagauaucucauuauucuc

SEQ ID NO: 304263 - RNA, 21 nt, Human
uucagauaucucauuauucuc

SEQ ID NO: 304264 - RNA, 24 nt, Human
uucauguuuauaugugaguuucua

SEQ ID NO: 304265 - RNA, 24 nt, Human
uucauguuuauaugugaguuucua

SEQ ID NO: 304266 - RNA, 25 nt, Human
uucauguuuauaugugaguuucuau

SEQ ID NO: 304267 - RNA, 23 nt, Human
uucucuuuggucccucuccucca

SEQ ID NO: 304268 - RNA, 23 nt, Human
uucucuuuggucccucuccucca

SEQ ID NO: 304269 - RNA, 19 nt, Human
uucuggucuuuauuuuugg

SEQ ID NO: 304270 - RNA, 19 nt, Human
uucuggucuuuauuuuugg

SEQ ID NO: 304271 - RNA, 19 nt, Human
uucuggucuuuauuuuugg

SEQ ID NO: 304272 - RNA, 21 nt, Human
uugaaugauauagagguagca

SEQ ID NO: 304273 - RNA, 21 nt, Human
uugaaugauauagagguagca

SEQ ID NO: 304274 - RNA, 21 nt, Human
uugaaugauauagagguagca

SEQ ID NO: 304275 - RNA, 18 nt, Human
uuuccuggcauuaacugg

SEQ ID NO: 304276 - RNA, 18 nt, Human
uuuccuggcauuaacugg

SEQ ID NO: 304277 - RNA, 18 nt, Human
uuuccuggcauuaacugg

SEQ ID NO: 304278 - RNA, 19 nt, Human
uuuuacugaaggcucacau

SEQ ID NO: 304279 - RNA, 19 nt, Human
uuuuacugaaggcucacau

SEQ ID NO: 304280 - RNA, 23 nt, Human
aaaacuaaaggucuuuauuuaaa

SEQ ID NO: 304281 - RNA, 19 nt, Human
aagcccggaaguaaccggg

SEQ ID NO: 304282 - RNA, 20 nt, Human
auguuaauuuaucuaggaaa

SEQ ID NO: 304283 - RNA, 18 nt, Human
caagcccggaaguaaccg

SEQ ID NO: 304284 - RNA, 18 nt, Human
caugaaucuuacccagug

SEQ ID NO: 304285 - RNA, 21 nt, Human
cggaagaaagcugcaguagcg

SEQ ID NO: 304286 - RNA, 25 nt, Human
uacccaguguuuaccgaaguauuua

SEQ ID NO: 304287 - RNA, 18 nt, Human
uccgaaaacugcuggaag

SEQ ID NO: 304288 - RNA, 26 nt, Human
ugagagcagucgucgcucgcaagccc

SEQ ID NO: 304289 - RNA, 24 nt, Human
uggccuuugagagcagucgucgcu

SEQ ID NO: 304290 - RNA, 18 nt, Human
ugguauuuuauacauuuc

SEQ ID NO: 304291 - RNA, 18 nt, Human
ugguggccuccuugcggu

SEQ ID NO: 304292 - RNA, 30 nt, Human
uugguaaagcaguucauacagcuuuuuucu

SEQ ID NO: 304293 - RNA, 21 nt, Human
uuuaaaaucuggcauuguauu

SEQ ID NO: 304294 - RNA, 23 nt, Human
uuuccucaguagugauauuuggu

SEQ ID NO: 304295 - RNA, 19 nt, Human
uuuuuuuuuuuuuugagga

SEQ ID NO: 304296 - RNA, 22 nt, Human
uuuuuuuuuuuuuuuuuugagg

SEQ ID NO: 304297 - RNA, 21 nt, Human
aauaacagaaaggauaagcac

SEQ ID NO: 304298 - RNA, 20 nt, Human
agaaaaagagagacugugaa

SEQ ID NO: 304299 - RNA, 21 nt, Human
agaauggaacucugucuuuaa

SEQ ID NO: 304300 - RNA, 22 nt, Human
auaagcacccucaccacccaag

SEQ ID NO: 304301 - RNA, 20 nt, Human
auucaagagguccccagaaa

SEQ ID NO: 304302 - RNA, 23 nt, Human
auuuuuuuaauagaaaccacauc

SEQ ID NO: 304303 - RNA, 24 nt, Human
cacaaugacaugcugcuuccagaa

SEQ ID NO: 304304 - RNA, 22 nt, Human
cacagccaaguuccuagaaaaa

SEQ ID NO: 304305 - RNA, 25 nt, Human
cacagccaaguuccuagaaaaagag

SEQ ID NO: 304306 - RNA, 19 nt, Human
caguuuaaucaucgcccuc

SEQ ID NO: 304307 - RNA, 19 nt, Human
cuacaaaauaacagaaagg

SEQ ID NO: 304308 - RNA, 20 nt, Human
cucaccacccaagccuuugg

SEQ ID NO: 304309 - RNA, 23 nt, Human
cuuuaugaaguuuugaaaugaga

SEQ ID NO: 304310 - RNA, 24 nt, Human
gaugaauuugucucugaggcagga

SEQ ID NO: 304311 - RNA, 20 nt, Human
uaagcacccucaccacccaa

SEQ ID NO: 304312 - RNA, 25 nt, Human
uaagcacccucaccacccaagccuu

SEQ ID NO: 304313 - RNA, 18 nt, Human
uccuagaaaaagagagac

SEQ ID NO: 304314 - RNA, 22 nt, Human
ucuacaaaauaacagaaaggau

SEQ ID NO: 304315 - RNA, 24 nt, Human
ucuauucucuuaccacaaugacau

SEQ ID NO: 304316 - RNA, 23 nt, Human
ucuuaccacaaugacaugcugcu

SEQ ID NO: 304317 - RNA, 18 nt, Human
ugaggcaggacaacacag

SEQ ID NO: 304318 - RNA, 20 nt, Human
ugaggcaggacaacacagcc

SEQ ID NO: 304319 - RNA, 23 nt, Human
uggaaauuccaugcuguguugau

SEQ ID NO: 304320 - RNA, 27 nt, Human
uguucuaccaaccuuuccuuguuuuca

SEQ ID NO: 304321 - RNA, 23 nt, Human
uucaaacucaggccaguuuaauc

SEQ ID NO: 304322 - RNA, 24 nt, Human
uuccuuguuuucaaaggcaggggc

SEQ ID NO: 304323 - RNA, 20 nt, Human
aacuacguaaaaaacagagc

SEQ ID NO: 304324 - RNA, 19 nt, Human
acaaagaaauaucucccuu

SEQ ID NO: 304325 - RNA, 19 nt, Human
acaaagaaauaucucccuu

SEQ ID NO: 304326 - RNA, 24 nt, Human
caacuagaagguacaaucucucag

SEQ ID NO: 304327 - RNA, 26 nt, Human
ccucccgcggaagggaagcggggaac

SEQ ID NO: 304328 - RNA, 19 nt, Human
cuacaaucacaucauguug

SEQ ID NO: 304329 - RNA, 18 nt, Human
cugcuuggcuuugaccau

SEQ ID NO: 304330 - RNA, 23 nt, Human
cuuugaccauacacauuucugcc

SEQ ID NO: 304331 - RNA, 24 nt, Human
uacagaaucugcacaaagggacau

SEQ ID NO: 304332 - RNA, 20 nt, Human
uacguaaaaaacagagcugu

SEQ ID NO: 304333 - RNA, 21 nt, Human
uguaacuacguaaaaaacaga

SEQ ID NO: 304334 - RNA, 23 nt, Human
uuggauggcuagcuaacucuccc

SEQ ID NO: 304335 - RNA, 26 nt, Human
aaaaaaaaaugcugaguaacagaaaa

SEQ ID NO: 304336 - RNA, 20 nt, Human
aaaagcagcuaucugugaac

SEQ ID NO: 304337 - RNA, 20 nt, Human
aaaccugaacaugcuuagca

SEQ ID NO: 304338 - RNA, 21 nt, Human
aaguaaaccugaacaugcuua

SEQ ID NO: 304339 - RNA, 20 nt, Human
agacaaugcuggccuucuga

SEQ ID NO: 304340 - RNA, 19 nt, Human
aggcaaaaccuuacaagga

SEQ ID NO: 304341 - RNA, 19 nt, Human
auaaaaagcagcuaucugu

SEQ ID NO: 304342 - RNA, 19 nt, Human
caacaaaguaaaccugaac

SEQ ID NO: 304343 - RNA, 18 nt, Human
caagacaucugaugucag

SEQ ID NO: 304344 - RNA, 19 nt, Human
caccugaugguuuggagua

SEQ ID NO: 304345 - RNA, 22 nt, Human
cccccacucggccgcccgcacc

SEQ ID NO: 304346 - RNA, 19 nt, Human
ccgcaccgcgcggcgcugc

SEQ ID NO: 304347 - RNA, 22 nt, Human
cugauauaaaaaaaaaugcuga

SEQ ID NO: 304348 - RNA, 22 nt, Human
cugaugucaguuucccauuguu

SEQ ID NO: 304349 - RNA, 22 nt, Human
gcccccacucggccgcccgcac

SEQ ID NO: 304350 - RNA, 19 nt, Human
gccccuauggcuuaagagu

SEQ ID NO: 304351 - RNA, 23 nt, Human
ggaaaaccagccccuauggcuua

SEQ ID NO: 304352 - RNA, 25 nt, Human
ggaaaaccagccccuauggcuuaag

SEQ ID NO: 304353 - RNA, 20 nt, Human
gugaaccagguaacugugug

SEQ ID NO: 304354 - RNA, 19 nt, Human
uaaaaagcagcuaucugug

SEQ ID NO: 304355 - RNA, 22 nt, Human
uaaauaagcccuguacagaaca

SEQ ID NO: 304356 - RNA, 21 nt, Human
uaagcccuguacagaacacag

SEQ ID NO: 304357 - RNA, 19 nt, Human
uccauaaugguuccuagga

SEQ ID NO: 304358 - RNA, 21 nt, Human
ugaaaaccaaaguccaauuuc

SEQ ID NO: 304359 - RNA, 20 nt, Human
ugaaauacuaugaucuuguu

SEQ ID NO: 304360 - RNA, 23 nt, Human
uggaagaucuguuuauuaacagu

SEQ ID NO: 304361 - RNA, 19 nt, Human
uguacagaacacaggcacu

SEQ ID NO: 304362 - RNA, 21 nt, Human
ugucucauccuucuuggcaaa

SEQ ID NO: 304363 - RNA, 25 nt, Human
ugucucauccuucuuggcaaaagua

SEQ ID NO: 304364 - RNA, 19 nt, Human
ugucugaaaaccaaagucc

SEQ ID NO: 304365 - RNA, 18 nt, Human
ugugucaaaauucuuaag

SEQ ID NO: 304366 - RNA, 26 nt, Human
uucacaaacaucaacaaaguaaaccu

SEQ ID NO: 304367 - RNA, 24 nt, Human
uucuuugcugacauuacuuuugac

SEQ ID NO: 304368 - RNA, 20 nt, Human
uugucucauccuucuuggca

SEQ ID NO: 304369 - RNA, 24 nt, Human
uuucccauuguuuugcuucacaaa

SEQ ID NO: 304370 - RNA, 23 nt, Human
uuuuucguaacuuuacacaaggg

SEQ ID NO: 304371 - RNA, 21 nt, Human
aaagauugggaggauauacaa

SEQ ID NO: 304372 - RNA, 24 nt, Human
acauuaaagaauaaaccaaaggaa

SEQ ID NO: 304373 - RNA, 20 nt, Human
agaauaaaccaaaggaaaac

SEQ ID NO: 304374 - RNA, 21 nt, Human
augaaaaaagacauuacaaaa

SEQ ID NO: 304375 - RNA, 21 nt, Human
caucuuugcuuuuaauuaaag

SEQ ID NO: 304376 - RNA, 20 nt, Human
cauuguaaaaugaaaaaaga

SEQ ID NO: 304377 - RNA, 21 nt, Human
uacacaaaauacaaaacugga

SEQ ID NO: 304378 - RNA, 23 nt, Human
uauaaaauuaauaguugauucaa

SEQ ID NO: 304379 - RNA, 25 nt, Human
uauuuuucuuuaaguuauaaaauua

SEQ ID NO: 304380 - RNA, 19 nt, Human
uccaugcauucuucauuca

SEQ ID NO: 304381 - RNA, 19 nt, Human
aaaaaaaaaaagugaagga

SEQ ID NO: 304382 - RNA, 28 nt, Human
aaaaaaagugaaggauagaccgguaccc

SEQ ID NO: 304383 - RNA, 19 nt, Human
aaacaauauacgaaaaagc

SEQ ID NO: 304384 - RNA, 19 nt, Human
aaaccagugcugaaagcug

SEQ ID NO: 304385 - RNA, 23 nt, Human
aaaccagugcugaaagcugauag

SEQ ID NO: 304386 - RNA, 19 nt, Human
aaaggaaaaaaaugaaaaa

SEQ ID NO: 304387 - RNA, 20 nt, Human
aaauaccugcaaacacuuuu

SEQ ID NO: 304388 - RNA, 19 nt, Human
aaggaaaaaaaugaaaaag

SEQ ID NO: 304389 - RNA, 24 nt, Human
aauaauagaugacaguaaaaagaa

SEQ ID NO: 304390 - RNA, 21 nt, Human
aauucaaagggaaagaaacaa

SEQ ID NO: 304391 - RNA, 22 nt, Human
acaaccagaaagaauaacaccu

SEQ ID NO: 304392 - RNA, 18 nt, Human
accaagcacuuucuacuu

SEQ ID NO: 304393 - RNA, 25 nt, Human
acccucccggcucucgugccgaauu

SEQ ID NO: 304394 - RNA, 21 nt, Human
acugcccccacaggcauaugc

SEQ ID NO: 304395 - RNA, 23 nt, Human
agacagaaauaccaagcacuuuc

SEQ ID NO: 304396 - RNA, 23 nt, Human
agcugccagccaaaggaaaaaaa

SEQ ID NO: 304397 - RNA, 24 nt, Human
aggaaaauccagaaaugaaaaaaa

SEQ ID NO: 304398 - RNA, 25 nt, Human
aggcauaugcucuccucuggguaug

SEQ ID NO: 304399 - RNA, 22 nt, Human
aguaaaaagaaauucaaaggga

SEQ ID NO: 304400 - RNA, 18 nt, Human
aguuauuuuaacuccugu

SEQ ID NO: 304401 - RNA, 19 nt, Human
augccugcaaaaccuagaa

SEQ ID NO: 304402 - RNA, 19 nt, Human
caacaucacugggaagagc

SEQ ID NO: 304403 - RNA, 21 nt, Human
cacaaccagaaagaauaacac

SEQ ID NO: 304404 - RNA, 21 nt, Human
cacagcaaugacuuuggaugc

SEQ ID NO: 304405 - RNA, 18 nt, Human
cagaaaugaaaaaaaaaa

SEQ ID NO: 304406 - RNA, 23 nt, Human
caggaaagcuuagcaucagccaa

SEQ ID NO: 304407 - RNA, 21 nt, Human
cagugguccccucuacccucc

SEQ ID NO: 304408 - RNA, 18 nt, Human
caucagcacugcccccac

SEQ ID NO: 304409 - RNA, 19 nt, Human
cccaggaaaauccagaaau

SEQ ID NO: 304410 - RNA, 22 nt, Human
cuccaaaggcuacagcucaucu

SEQ ID NO: 304411 - RNA, 24 nt, Human
cugcaaaaccuagaaaaaaaaaga

SEQ ID NO: 304412 - RNA, 24 nt, Human
cugggaagagcugccagccaaagg

SEQ ID NO: 304413 - RNA, 23 nt, Human
cuuccagguuuaucaucaucugu

SEQ ID NO: 304414 - RNA, 20 nt, Human
gaaaucccaggaaaauccag

SEQ ID NO: 304415 - RNA, 21 nt, Human
gaaauucaaagggaaagaaac

SEQ ID NO: 304416 - RNA, 22 nt, Human
gaaggcaggacccagcuccauu

SEQ ID NO: 304417 - RNA, 21 nt, Human
gacccagcuccauuaaagcuc

SEQ ID NO: 304418 - RNA, 19 nt, Human
gcaaaaggccaacucugca

SEQ ID NO: 304419 - RNA, 23 nt, Human
gcagugguccccucuacccuccc

SEQ ID NO: 304420 - RNA, 21 nt, Human
gccaaaggaaaaaaaugaaaa

SEQ ID NO: 304421 - RNA, 20 nt, Human
ggaaaauccagaaaugaaaa

SEQ ID NO: 304422 - RNA, 19 nt, Human
gguugacugagaaaaccug

SEQ ID NO: 304423 - RNA, 20 nt, Human
guagaauauacuauauaucc

SEQ ID NO: 304424 - RNA, 19 nt, Human
gugcuagaaucucacaacc

SEQ ID NO: 304425 - RNA, 23 nt, Human
uaacaaaaccagugcugaaagcu

SEQ ID NO: 304426 - RNA, 25 nt, Human
uaacaaaaccagugcugaaagcuga

SEQ ID NO: 304427 - RNA, 19 nt, Human
uaacuuaauucaaaagcaa

SEQ ID NO: 304428 - RNA, 22 nt, Human
uaagacagaaauaccaagcacu

SEQ ID NO: 304429 - RNA, 18 nt, Human
uaaggaacaucuauguuc

SEQ ID NO: 304430 - RNA, 18 nt, Human
uacagaggguuuccuagu

SEQ ID NO: 304431 - RNA, 22 nt, Human
uaccaagcacuuucuacuuuug

SEQ ID NO: 304432 - RNA, 21 nt, Human
uacgaaaaagcuaugggguaa

SEQ ID NO: 304433 - RNA, 18 nt, Human
uacuauauauccauaucc

SEQ ID NO: 304434 - RNA, 19 nt, Human
uacuauauauccauaucca

SEQ ID NO: 304435 - RNA, 21 nt, Human
uagaauauacuauauauccau

SEQ ID NO: 304436 - RNA, 19 nt, Human
uagggcgcauaccaggaaa

SEQ ID NO: 304437 - RNA, 23 nt, Human
uaggucuccaaaggcuacagcuc

SEQ ID NO: 304438 - RNA, 23 nt, Human
uaugugggaaguugugcgacugg

SEQ ID NO: 304439 - RNA, 20 nt, Human
uccaaauaccauuuuccuua

SEQ ID NO: 304440 - RNA, 20 nt, Human
uccagauaaccugucaauuc

SEQ ID NO: 304441 - RNA, 19 nt, Human
ucugcagggauauguaaag

SEQ ID NO: 304442 - RNA, 20 nt, Human
ugaaaaaaaaaaagugaagg

SEQ ID NO: 304443 - RNA, 22 nt, Human
ugagaaaaccugagaaauagca

SEQ ID NO: 304444 - RNA, 18 nt, Human
ugagauuuuagcuuaaaa

SEQ ID NO: 304445 - RNA, 22 nt, Human
ugauaaauauugacgguggcac

SEQ ID NO: 304446 - RNA, 26 nt, Human
ugcaaaaccuagaaaaaaaaagaagc

SEQ ID NO: 304447 - RNA, 21 nt, Human
uguaaagggucauuuuaugga

SEQ ID NO: 304448 - RNA, 26 nt, Human
uguaacuaauuagucuucaagaacag

SEQ ID NO: 304449 - RNA, 21 nt, Human
ugugcuagaaucucacaacca

SEQ ID NO: 304450 - RNA, 19 nt, Human
uuaggccuuugugcuagaa

SEQ ID NO: 304451 - RNA, 26 nt, Human
uucaaagggaaagaaacaauauacga

SEQ ID NO: 304452 - RNA, 24 nt, Human
uuccagcucagccacagcaaugac

SEQ ID NO: 304453 - RNA, 22 nt, Human
uuccagguuuaucaucaucugu

SEQ ID NO: 304454 - RNA, 22 nt, Human
uuuuccacagauauaaucacua

SEQ ID NO: 304455 - RNA, 22 nt, Human
aaaaaaaaaaaaaauuagccag

SEQ ID NO: 304456 - RNA, 23 nt, Human
aaaaaaagaggccggacgcggug

SEQ ID NO: 304457 - RNA, 18 nt, Human
aaaagaaaaagaaaaacg

SEQ ID NO: 304458 - RNA, 18 nt, Human
aaagaagaagaggggaag

SEQ ID NO: 304459 - RNA, 19 nt, Human
aacacggugaaacccuguc

SEQ ID NO: 304460 - RNA, 20 nt, Human
aacacggugaaacccugucu

SEQ ID NO: 304461 - RNA, 21 nt, Human
aacacggugaaacccugucuc

SEQ ID NO: 304462 - RNA, 20 nt, Human
aacauggcgaaacccugucu

SEQ ID NO: 304463 - RNA, 21 nt, Human
aacauggcgaaacccugucuc

SEQ ID NO: 304464 - RNA, 21 nt, Human
aagaagaagaggggaaggacg

SEQ ID NO: 304465 - RNA, 19 nt, Human
aauggugucaaccugggag

SEQ ID NO: 304466 - RNA, 19 nt, Human
acacagugagacuuugucu

SEQ ID NO: 304467 - RNA, 20 nt, Human
acacagugagacuuugucuc

SEQ ID NO: 304468 - RNA, 24 nt, Human
acacagugagacuuugucucaaaa

SEQ ID NO: 304469 - RNA, 20 nt, Human
acagugagagacuccgucuc

SEQ ID NO: 304470 - RNA, 18 nt, Human
accagcacgccucugagg

SEQ ID NO: 304471 - RNA, 24 nt, Human
acccugucucuacuaaaaauacaa

SEQ ID NO: 304472 - RNA, 28 nt, Human
acuccgucucaaaaaaaaaaaagaaaaa

SEQ ID NO: 304473 - RNA, 19 nt, Human
acugcacuccagccugggc

SEQ ID NO: 304474 - RNA, 24 nt, Human
acugcacuccagccugggcgacag

SEQ ID NO: 304475 - RNA, 25 nt, Human
agaagaagaggggaaggacgggagg

SEQ ID NO: 304476 - RNA, 18 nt, Human
agaagaggggaaggacgg

SEQ ID NO: 304477 - RNA, 30 nt, Human
agaagaggggaaggacgggagggagggauu

SEQ ID NO: 304478 - RNA, 24 nt, Human
agacaugguggcccacaucuguag

SEQ ID NO: 304479 - RNA, 22 nt, Human
agagagaucccuggcccaggac

SEQ ID NO: 304480 - RNA, 25 nt, Human
agagcagggagugggguccccagga

SEQ ID NO: 304481 - RNA, 22 nt, Human
agagguuucagugagccgagau

SEQ ID NO: 304482 - RNA, 24 nt, Human
agagguuucagugagccgagauug

SEQ ID NO: 304483 - RNA, 24 nt, Human
agcacuuugggaggcagaggcagg

SEQ ID NO: 304484 - RNA, 24 nt, Human
agccugggcgacagugagagacuc

SEQ ID NO: 304485 - RNA, 24 nt, Human
aggaaagaagaagaggggaaggaa

SEQ ID NO: 304486 - RNA, 23 nt, Human
aggaacaauuaggccaggcuuug

SEQ ID NO: 304487 - RNA, 23 nt, Human
aggacucgagacauuuuaugacc

SEQ ID NO: 304488 - RNA, 21 nt, Human
aggcagagguuucagugagcc

SEQ ID NO: 304489 - RNA, 24 nt, Human
aggcagagguuucagugagccgag

SEQ ID NO: 304490 - RNA, 22 nt, Human
aggcaggagaauggugucaacc

SEQ ID NO: 304491 - RNA, 24 nt, Human
aggcaggagaauggugucaaccug

SEQ ID NO: 304492 - RNA, 25 nt, Human
aggcaggagaauggugucaaccugg

SEQ ID NO: 304493 - RNA, 20 nt, Human
aggcaggcggaucacgaggu

SEQ ID NO: 304494 - RNA, 24 nt, Human
aggcaggcggaucacgaggucagg

SEQ ID NO: 304495 - RNA, 26 nt, Human
aggcaggcggaucacgaggucaggag

SEQ ID NO: 304496 - RNA, 22 nt, Human
aggcaugagaauagcuugaacc

SEQ ID NO: 304497 - RNA, 24 nt, Human
aggcaugagaauagcuugaaccug

SEQ ID NO: 304498 - RNA, 22 nt, Human
aggccggacgcgguggcucacg

SEQ ID NO: 304499 - RNA, 25 nt, Human
aggcggagguugcagugacaacggu

SEQ ID NO: 304500 - RNA, 21 nt, Human
aggcggagguugcagugagcc

SEQ ID NO: 304501 - RNA, 24 nt, Human
aggcggagguugcagugagccgag

SEQ ID NO: 304502 - RNA, 24 nt, Human
aggcggaucacgaggucaggagau

SEQ ID NO: 304503 - RNA, 20 nt, Human
aggcggcagaucacuugagg

SEQ ID NO: 304504 - RNA, 25 nt, Human
aggcggcagaucacuugaggccagg

SEQ ID NO: 304505 - RNA, 24 nt, Human
aggcgugcuggcaggcgccuguag

SEQ ID NO: 304506 - RNA, 21 nt, Human
aggcucaguggcucaugccua

SEQ ID NO: 304507 - RNA, 24 nt, Human
aggcugaggcaugagaauagcuug

SEQ ID NO: 304508 - RNA, 20 nt, Human
agggagcaggcggcgacacc

SEQ ID NO: 304509 - RNA, 20 nt, Human
agggagggauggaguggagg

SEQ ID NO: 304510 - RNA, 22 nt, Human
agggagugggguccccaggagc

SEQ ID NO: 304511 - RNA, 18 nt, Human
agggccuuugagaaaaac

SEQ ID NO: 304512 - RNA, 24 nt, Human
aggggcagaggugagcaccccugg

SEQ ID NO: 304513 - RNA, 18 nt, Human
aguacagaacucagagga

SEQ ID NO: 304514 - RNA, 24 nt, Human
agucucgucaacauggcgaaaccc

SEQ ID NO: 304515 - RNA, 24 nt, Human
agucugggugacacagugagacuu

SEQ ID NO: 304516 - RNA, 26 nt, Human
aguggcucaugccuauauaaucccag

SEQ ID NO: 304517 - RNA, 26 nt, Human
aucagcucucccacccuggucccucu

SEQ ID NO: 304518 - RNA, 21 nt, Human
augugagugacagaaauggug

SEQ ID NO: 304519 - RNA, 24 nt, Human
auuagccagacaugguggcccaca

SEQ ID NO: 304520 - RNA, 24 nt, Human
auugcgccacugcacuccagccug

SEQ ID NO: 304521 - RNA, 21 nt, Human
auuuucucuucucccuccucc

SEQ ID NO: 304522 - RNA, 23 nt, Human
caaagcaccugaauucuaguaug

SEQ ID NO: 304523 - RNA, 22 nt, Human
caacauggcgaaacccugucuc

SEQ ID NO: 304524 - RNA, 24 nt, Human
caacauggcgaaacccugucucua

SEQ ID NO: 304525 - RNA, 24 nt, Human
cacgccuguaaucccagcacuuug

SEQ ID NO: 304526 - RNA, 19 nt, Human
cacugcacuccagccuggg

SEQ ID NO: 304527 - RNA, 21 nt, Human
cacugcacuccagccugggcg

SEQ ID NO: 304528 - RNA, 22 nt, Human
cacugcacuccagccugggcga

SEQ ID NO: 304529 - RNA, 23 nt, Human
cacugcacuccagccugggcgac

SEQ ID NO: 304530 - RNA, 24 nt, Human
cacugcacuccagccugggcgaca

SEQ ID NO: 304531 - RNA, 26 nt, Human
cacugcacuccagccugggcgacagu

SEQ ID NO: 304532 - RNA, 22 nt, Human
cacugcauuccagucuggguga

SEQ ID NO: 304533 - RNA, 23 nt, Human
cacugcauuccagucugggugac

SEQ ID NO: 304534 - RNA, 24 nt, Human
cacugcauuccagucugggugaca

SEQ ID NO: 304535 - RNA, 21 nt, Human
cacugguguccucagaaaggc

SEQ ID NO: 304536 - RNA, 21 nt, Human
cacuuccuucucucccguuga

SEQ ID NO: 304537 - RNA, 25 nt, Human
cagaggcaggcggaucacgagguca

SEQ ID NO: 304538 - RNA, 27 nt, Human
cagaucacuugaggccaggaguucgag

SEQ ID NO: 304539 - RNA, 24 nt, Human
cagcacuuugggaggcagaggcag

SEQ ID NO: 304540 - RNA, 26 nt, Human
cagcacuuugggaggcagaggcaggc

SEQ ID NO: 304541 - RNA, 24 nt, Human
caguacuuugagaagcugaggcgg

SEQ ID NO: 304542 - RNA, 20 nt, Human
caucuagcaaagcaccugaa

SEQ ID NO: 304543 - RNA, 23 nt, Human
caucuguagucccagcuacuuga

SEQ ID NO: 304544 - RNA, 20 nt, Human
caucuuuugauggaaggaaa

SEQ ID NO: 304545 - RNA, 24 nt, Human
cauuccagucugggugacacagug

SEQ ID NO: 304546 - RNA, 20 nt, Human
ccacugcacuccagccuggg

SEQ ID NO: 304547 - RNA, 20 nt, Human
ccacugcacuccagccuggg

SEQ ID NO: 304548 - RNA, 21 nt, Human
ccacugcacuccagccugggc

SEQ ID NO: 304549 - RNA, 21 nt, Human
ccacugcacuccagccugggc

SEQ ID NO: 304550 - RNA, 23 nt, Human
ccacugcacuccagccugggcga

SEQ ID NO: 304551 - RNA, 24 nt, Human
ccacugcacuccagccugggcgac

SEQ ID NO: 304552 - RNA, 19 nt, Human
ccaggacaggagaugccaa

SEQ ID NO: 304553 - RNA, 26 nt, Human
ccaggaguucgagaccagucgaguuc

SEQ ID NO: 304554 - RNA, 24 nt, Human
cccacaucuguagucccagcuacu

SEQ ID NO: 304555 - RNA, 21 nt, Human
cccaugauaagggugcagagg

SEQ ID NO: 304556 - RNA, 24 nt, Human
cccaugauaagggugcagaggggc

SEQ ID NO: 304557 - RNA, 18 nt, Human
cccuccuccuccuuauuc

SEQ ID NO: 304558 - RNA, 22 nt, Human
cccuccuuuacauuuucucuuc

SEQ ID NO: 304559 - RNA, 19 nt, Human
ccuauauaaucccaguacu

SEQ ID NO: 304560 - RNA, 22 nt, Human
ccuggcuaacacggugaaaccc

SEQ ID NO: 304561 - RNA, 24 nt, Human
ccuggcuaacacggugaaacccug

SEQ ID NO: 304562 - RNA, 19 nt, Human
ccugggaggcggagguugc

SEQ ID NO: 304563 - RNA, 22 nt, Human
ccuguaaucccagcacuuuggg

SEQ ID NO: 304564 - RNA, 18 nt, Human
ccuguagucccagcuacu

SEQ ID NO: 304565 - RNA, 21 nt, Human
ccuguagucccagcuacuugg

SEQ ID NO: 304566 - RNA, 23 nt, Human
ccuuucugcaaucagcucuccca

SEQ ID NO: 304567 - RNA, 24 nt, Human
cgagaccauccuggcuaacacggu

SEQ ID NO: 304568 - RNA, 24 nt, Human
cgagauugcgccacugcacuccag

SEQ ID NO: 304569 - RNA, 22 nt, Human
cgccaagaagagcuguggcuuc

SEQ ID NO: 304570 - RNA, 24 nt, Human
cgccuguagucccagcuacuuggg

SEQ ID NO: 304571 - RNA, 23 nt, Human
cggcagaucacuugaggccagga

SEQ ID NO: 304572 - RNA, 20 nt, Human
cggccugggaaagaucuccc

SEQ ID NO: 304573 - RNA, 21 nt, Human
cuaaaacugugccuccaacag

SEQ ID NO: 304574 - RNA, 24 nt, Human
cucaaaaaaaaaaaagaaaaagaa

SEQ ID NO: 304575 - RNA, 22 nt, Human
cucacgccuguaaucccagcac

SEQ ID NO: 304576 - RNA, 24 nt, Human
cucacgccuguaaucccagcacuu

SEQ ID NO: 304577 - RNA, 22 nt, Human
cucaggccgacuucuccugugc

SEQ ID NO: 304578 - RNA, 21 nt, Human
cucaugccacccucaucccca

SEQ ID NO: 304579 - RNA, 25 nt, Human
cucccuccuccuccuuauucuaaaa

SEQ ID NO: 304580 - RNA, 25 nt, Human
cucccuccuuuacauuuucucuucu

SEQ ID NO: 304581 - RNA, 19 nt, Human
cuccgucucaaaaaaaaaa

SEQ ID NO: 304582 - RNA, 19 nt, Human
cucuucucccuccuccucc

SEQ ID NO: 304583 - RNA, 18 nt, Human
cuggcuaacacggugaaa

SEQ ID NO: 304584 - RNA, 24 nt, Human
cuggcuaacacggugaaacccugu

SEQ ID NO: 304585 - RNA, 19 nt, Human
cugggugacacagugagac

SEQ ID NO: 304586 - RNA, 20 nt, Human
cugggugacacagugagacu

SEQ ID NO: 304587 - RNA, 21 nt, Human
cuggucccucuuccuucaagg

SEQ ID NO: 304588 - RNA, 19 nt, Human
cuguagucccagcuacuug

SEQ ID NO: 304589 - RNA, 19 nt, Human
gaaacccugucucuacuaa

SEQ ID NO: 304590 - RNA, 18 nt, Human
gaaagaagaagaggggaa

SEQ ID NO: 304591 - RNA, 22 nt, Human
gaaccuggaaggcagagguuuc

SEQ ID NO: 304592 - RNA, 18 nt, Human
gaaggaaagaagaagagg

SEQ ID NO: 304593 - RNA, 24 nt, Human
gaaggacgggagggagggauggag

SEQ ID NO: 304594 - RNA, 18 nt, Human
gaaguacagaacucagag

SEQ ID NO: 304595 - RNA, 21 nt, Human
gacacagugagacuuugucuc

SEQ ID NO: 304596 - RNA, 24 nt, Human
gacacagugagacuuugucucaaa

SEQ ID NO: 304597 - RNA, 20 nt, Human
gacaggagaugccaaaucua

SEQ ID NO: 304598 - RNA, 24 nt, Human
gacagugagagacuccgucucaaa

SEQ ID NO: 304599 - RNA, 24 nt, Human
gaccccuaaggccuuaggacucga

SEQ ID NO: 304600 - RNA, 22 nt, Human
gagaccagucucgucaacaugg

SEQ ID NO: 304601 - RNA, 19 nt, Human
gagcaccccuggugaaaag

SEQ ID NO: 304602 - RNA, 25 nt, Human
gaggacaguaggaaaaaccgguacc

SEQ ID NO: 304603 - RNA, 21 nt, Human
gaggggaaggacgggagggag

SEQ ID NO: 304604 - RNA, 21 nt, Human
gagguugcagugagccgagau

SEQ ID NO: 304605 - RNA, 23 nt, Human
gagguugcagugagccgagauug

SEQ ID NO: 304606 - RNA, 18 nt, Human
gaucacuugaggccagga

SEQ ID NO: 304607 - RNA, 24 nt, Human
gaucacuugaggccaggaguucga

SEQ ID NO: 304608 - RNA, 22 nt, Human
gccacugcacuccagccugggc

SEQ ID NO: 304609 - RNA, 24 nt, Human
gccacugcacuccagccugggcga

SEQ ID NO: 304610 - RNA, 19 nt, Human
gccaggcucaguggcucau

SEQ ID NO: 304611 - RNA, 23 nt, Human
gccuccaacagaggggcaggggc

SEQ ID NO: 304612 - RNA, 23 nt, Human
gccuguagucccagcuacuuggg

SEQ ID NO: 304613 - RNA, 24 nt, Human
gcuaacacggugaaacccugucuc

SEQ ID NO: 304614 - RNA, 24 nt, Human
gcuggcaggcgccuguagucccag

SEQ ID NO: 304615 - RNA, 23 nt, Human
ggaaggacgggagggagggaugg

SEQ ID NO: 304616 - RNA, 24 nt, Human
ggacgcgguggcucacgccuguaa

SEQ ID NO: 304617 - RNA, 24 nt, Human
ggacucgagacauuuuaugaccuc

SEQ ID NO: 304618 - RNA, 22 nt, Human
ggagguugcagugagccgagau

SEQ ID NO: 304619 - RNA, 24 nt, Human
ggagguugcagugagccgagauug

SEQ ID NO: 304620 - RNA, 21 nt, Human
ggcucacgccuguaaucccag

SEQ ID NO: 304621 - RNA, 20 nt, Human
ggcugguugaaguacagaac

SEQ ID NO: 304622 - RNA, 24 nt, Human
gguggcccacaucuguagucccag

SEQ ID NO: 304623 - RNA, 23 nt, Human
gguggcucacgccuguaauccca

SEQ ID NO: 304624 - RNA, 24 nt, Human
gguggcucacgccuguaaucccag

SEQ ID NO: 304625 - RNA, 24 nt, Human
gucaaccugggaggcggagguugc

SEQ ID NO: 304626 - RNA, 24 nt, Human
guggcccacaucuguagucccagc

SEQ ID NO: 304627 - RNA, 18 nt, Human
guugaaguacagaacuca

SEQ ID NO: 304628 - RNA, 19 nt, Human
guugcagugagccgagauu

SEQ ID NO: 304629 - RNA, 21 nt, Human
guugcagugagccgagauugc

SEQ ID NO: 304630 - RNA, 22 nt, Human
uaacacggugaaacccugucuc

SEQ ID NO: 304631 - RNA, 24 nt, Human
uaacacggugaaacccugucucua

SEQ ID NO: 304632 - RNA, 24 nt, Human
uacaaaaaaaaaaaaaaaaaaaaa

SEQ ID NO: 304633 - RNA, 22 nt, Human
uacagaacucagaggaaaaaag

SEQ ID NO: 304634 - RNA, 24 nt, Human
uagccagacaugguggcccacauc

SEQ ID NO: 304635 - RNA, 22 nt, Human
uaggagcuacuggcagggcacu

SEQ ID NO: 304636 - RNA, 25 nt, Human
uaggggcagaggugagcaccccugg

SEQ ID NO: 304637 - RNA, 18 nt, Human
ucacgaggucaggagauc

SEQ ID NO: 304638 - RNA, 24 nt, Human
ucacgaggucaggagaucgagacc

SEQ ID NO: 304639 - RNA, 19 nt, Human
ucacugaggaggggaccag

SEQ ID NO: 304640 - RNA, 20 nt, Human
ucacugaggaggggaccagc

SEQ ID NO: 304641 - RNA, 20 nt, Human
ucacugcauuccagucuggg

SEQ ID NO: 304642 - RNA, 24 nt, Human
ucacugcauuccagucugggugac

SEQ ID NO: 304643 - RNA, 23 nt, Human
ucacuugaggccaggaguucgag

SEQ ID NO: 304644 - RNA, 22 nt, Human
uccagccugggcgacagugaga

SEQ ID NO: 304645 - RNA, 20 nt, Human
ucccgagcgccgcaccacuc

SEQ ID NO: 304646 - RNA, 20 nt, Human
ucccuccuccuccuuauucu

SEQ ID NO: 304647 - RNA, 20 nt, Human
uccgucucaaaaaaaaaaaa

SEQ ID NO: 304648 - RNA, 23 nt, Human
uccgucucaaaaaaaaaaaagaa

SEQ ID NO: 304649 - RNA, 18 nt, Human
ucuaaaacugugccucca

SEQ ID NO: 304650 - RNA, 27 nt, Human
ucucaaaaaaaaaaaagaaaaagaaaa

SEQ ID NO: 304651 - RNA, 22 nt, Human
ucucccuccuccuccuuauucu

SEQ ID NO: 304652 - RNA, 24 nt, Human
ucucccuccuuuacauuuucucuu

SEQ ID NO: 304653 - RNA, 24 nt, Human
ucucgucaacauggcgaaacccug

SEQ ID NO: 304654 - RNA, 22 nt, Human
ucucuacaaaaaaaaaaaaaaa

SEQ ID NO: 304655 - RNA, 22 nt, Human
ucucuacuaaaaauacaaaaaa

SEQ ID NO: 304656 - RNA, 22 nt, Human
ucuguagucccagcuacuugag

SEQ ID NO: 304657 - RNA, 19 nt, Human
ugaaaugguaagaaugugg

SEQ ID NO: 304658 - RNA, 21 nt, Human
ugacacagugagacuuugucu

SEQ ID NO: 304659 - RNA, 22 nt, Human
ugacacagugagacuuugucuc

SEQ ID NO: 304660 - RNA, 20 nt, Human
ugaccccuaaggccuuagga

SEQ ID NO: 304661 - RNA, 19 nt, Human
ugacuucagggacacagcc

SEQ ID NO: 304662 - RNA, 22 nt, Human
ugagccgagauugcgccacugc

SEQ ID NO: 304663 - RNA, 22 nt, Human
ugagccgagauugugucacugc

SEQ ID NO: 304664 - RNA, 20 nt, Human
ugaggcaggagaaugguguc

SEQ ID NO: 304665 - RNA, 21 nt, Human
ugaggcaggagaaugguguca

SEQ ID NO: 304666 - RNA, 24 nt, Human
ugaggcaugagaauagcuugaacc

SEQ ID NO: 304667 - RNA, 25 nt, Human
ugaggcggcagaucacuugaggcca

SEQ ID NO: 304668 - RNA, 21 nt, Human
ugauggaaggaaagaagaaga

SEQ ID NO: 304669 - RNA, 24 nt, Human
ugccuauauaaucccaguacuuug

SEQ ID NO: 304670 - RNA, 24 nt, Human
ugcuggcaggcgccuguaguccca

SEQ ID NO: 304671 - RNA, 18 nt, Human
uggaaggaaagaagaaga

SEQ ID NO: 304672 - RNA, 21 nt, Human
uggaaggaaagaagaagaggg

SEQ ID NO: 304673 - RNA, 24 nt, Human
uggaaggaaagaagaagaggggaa

SEQ ID NO: 304674 - RNA, 20 nt, Human
uggcaccaucaaacacuucu

SEQ ID NO: 304675 - RNA, 21 nt, Human
uggccaguugguaaccccugc

SEQ ID NO: 304676 - RNA, 23 nt, Human
uggcccaggacaggagaugccaa

SEQ ID NO: 304677 - RNA, 22 nt, Human
uggcucacgccuguaaucccag

SEQ ID NO: 304678 - RNA, 24 nt, Human
uggcucacgccuguaaucccagca

SEQ ID NO: 304679 - RNA, 19 nt, Human
ugggaggcagaggcaggcg

SEQ ID NO: 304680 - RNA, 24 nt, Human
ugggaggcagaggcaggcggauca

SEQ ID NO: 304681 - RNA, 24 nt, Human
ugggaggcggagguugcagugagc

SEQ ID NO: 304682 - RNA, 24 nt, Human
ugguggcccacaucuguaguccca

SEQ ID NO: 304683 - RNA, 18 nt, Human
uggugggucccgagcgcc

SEQ ID NO: 304684 - RNA, 21 nt, Human
uggugucaaccugggaggcgg

SEQ ID NO: 304685 - RNA, 24 nt, Human
uggugucaaccugggaggcggagg

SEQ ID NO: 304686 - RNA, 19 nt, Human
ugucaaccugggaggcgga

SEQ ID NO: 304687 - RNA, 21 nt, Human
ugugaaaugguaagaaugugg

SEQ ID NO: 304688 - RNA, 24 nt, Human
ugugaaaugguaagaauguggguu

SEQ ID NO: 304689 - RNA, 23 nt, Human
uguguguaugcucaucauacaug

SEQ ID NO: 304690 - RNA, 20 nt, Human
uuagccaggcgugcuggcag

SEQ ID NO: 304691 - RNA, 22 nt, Human
uucuguugacaucccaugauaa

SEQ ID NO: 304692 - RNA, 22 nt, Human
uugaggccaggaguucgagacc

SEQ ID NO: 304693 - RNA, 18 nt, Human
uugcagugagccgagauu

SEQ ID NO: 304694 - RNA, 19 nt, Human
uugcagugagccgagauug

SEQ ID NO: 304695 - RNA, 22 nt, Human
uugcagugagccgagauugcgc

SEQ ID NO: 304696 - RNA, 23 nt, Human
uugcgccacugcacuccagccug

SEQ ID NO: 304697 - RNA, 19 nt, Human
uuggaacucuucaaacauc

SEQ ID NO: 304698 - RNA, 21 nt, Human
uugggaggcagaggcaggcgg

SEQ ID NO: 304699 - RNA, 23 nt, Human
uugucaugggugcagggagcagg

SEQ ID NO: 304700 - RNA, 23 nt, Human
uuucagugagccgagauuguguc

SEQ ID NO: 304701 - RNA, 19 nt, Human
aaaaaaaaaaaaccuaggg

SEQ ID NO: 304702 - RNA, 23 nt, Human
aaaaaaaaccuagggaaaagucc

SEQ ID NO: 304703 - RNA, 23 nt, Human
aaaacuuugcugcaaccucacag

SEQ ID NO: 304704 - RNA, 19 nt, Human
aaacaguacacagaucucu

SEQ ID NO: 304705 - RNA, 24 nt, Human
aaagaaaaaucauggggcaaaaaa

SEQ ID NO: 304706 - RNA, 22 nt, Human
aaaggagauacaagggauucug

SEQ ID NO: 304707 - RNA, 21 nt, Human
aaaguccaauaagaaccuuaa

SEQ ID NO: 304708 - RNA, 19 nt, Human
aacauggugaaaccccguc

SEQ ID NO: 304709 - RNA, 20 nt, Human
aacauggugaaaccccgucu

SEQ ID NO: 304710 - RNA, 21 nt, Human
aacauggugaaaccccgucuc

SEQ ID NO: 304711 - RNA, 19 nt, Human
aagccucaguccagcacag

SEQ ID NO: 304712 - RNA, 19 nt, Human
aaggauaacaguuuccaaa

SEQ ID NO: 304713 - RNA, 20 nt, Human
aaggcaggcagaucacgagg

SEQ ID NO: 304714 - RNA, 24 nt, Human
aaucgcuugaacccgggaggcaga

SEQ ID NO: 304715 - RNA, 24 nt, Human
aauuagcuuggcgugguggcacau

SEQ ID NO: 304716 - RNA, 21 nt, Human
acaacaacaauaacaaaaaaa

SEQ ID NO: 304717 - RNA, 19 nt, Human
acaauaacaaaaaaaaaaa

SEQ ID NO: 304718 - RNA, 20 nt, Human
acaauaacaaaaaaaaaaaa

SEQ ID NO: 304719 - RNA, 21 nt, Human
acagaaauggaguuugggagg

SEQ ID NO: 304720 - RNA, 23 nt, Human
acaggcacaaagccaguaacaca

SEQ ID NO: 304721 - RNA, 25 nt, Human
acagggcgagacuccgucuccaaaa

SEQ ID NO: 304722 - RNA, 21 nt, Human
acccacugggccccuccccag

SEQ ID NO: 304723 - RNA, 24 nt, Human
accccgucucuacuaaaaauacaa

SEQ ID NO: 304724 - RNA, 23 nt, Human
accuggaccgagcuggaggccug

SEQ ID NO: 304725 - RNA, 26 nt, Human
acgaaacaacaacaacaauaacaaaa

SEQ ID NO: 304726 - RNA, 22 nt, Human
acuacacuccagccuggcgaca

SEQ ID NO: 304727 - RNA, 23 nt, Human
acuacacuccagccuggcgacag

SEQ ID NO: 304728 - RNA, 19 nt, Human
acucucccugccuccuacc

SEQ ID NO: 304729 - RNA, 21 nt, Human
agaaaacgaaacaacaacaac

SEQ ID NO: 304730 - RNA, 19 nt, Human
agaaaggagauacaaggga

SEQ ID NO: 304731 - RNA, 25 nt, Human
agaaaggagauacaagggauucugg

SEQ ID NO: 304732 - RNA, 21 nt, Human
agaaauggaguuugggaggga

SEQ ID NO: 304733 - RNA, 19 nt, Human
agaaucaccuggaccgagc

SEQ ID NO: 304734 - RNA, 18 nt, Human
agacaagaggaaaagucc

SEQ ID NO: 304735 - RNA, 26 nt, Human
agacaagaggaaaaguccccccaaaa

SEQ ID NO: 304736 - RNA, 21 nt, Human
agagagggcucuggccgagga

SEQ ID NO: 304737 - RNA, 22 nt, Human
agagagggcucuggccgaggac

SEQ ID NO: 304738 - RNA, 22 nt, Human
agccaguaacacauuuaugguc

SEQ ID NO: 304739 - RNA, 21 nt, Human
agccuggcgacagggcgagac

SEQ ID NO: 304740 - RNA, 23 nt, Human
agccuggcgacagggcgagacuc

SEQ ID NO: 304741 - RNA, 24 nt, Human
agccugggaugcugggugguggcu

SEQ ID NO: 304742 - RNA, 19 nt, Human
agcgcucuccuuuggaggc

SEQ ID NO: 304743 - RNA, 23 nt, Human
agcuuggcgugguggcacaugcc

SEQ ID NO: 304744 - RNA, 18 nt, Human
aggaagagacagcagagc

SEQ ID NO: 304745 - RNA, 21 nt, Human
aggaagaggaaggagugaauu

SEQ ID NO: 304746 - RNA, 21 nt, Human
aggcaaaaucagaaaggccca

SEQ ID NO: 304747 - RNA, 18 nt, Human
aggcagaucacgagguca

SEQ ID NO: 304748 - RNA, 19 nt, Human
aggcagaucacgaggucaa

SEQ ID NO: 304749 - RNA, 19 nt, Human
aggcagauuuugcagugag

SEQ ID NO: 304750 - RNA, 24 nt, Human
aggcagauuuugcagugagucgag

SEQ ID NO: 304751 - RNA, 22 nt, Human
aggcagcccuccccaacccucc

SEQ ID NO: 304752 - RNA, 18 nt, Human
aggcaggcagaucacgag

SEQ ID NO: 304753 - RNA, 24 nt, Human
aggcaggcagaucacgaggucaag

SEQ ID NO: 304754 - RNA, 23 nt, Human
aggccaaggcaggcagaucacga

SEQ ID NO: 304755 - RNA, 24 nt, Human
aggcugagguaggagaaucgcuug

SEQ ID NO: 304756 - RNA, 24 nt, Human
agguaggagaaucgcuugaacccg

SEQ ID NO: 304757 - RNA, 19 nt, Human
aguuucugauccuuggaau

SEQ ID NO: 304758 - RNA, 21 nt, Human
auacagcccaccccacacacu

SEQ ID NO: 304759 - RNA, 24 nt, Human
aucaugccacuacacuccagccug

SEQ ID NO: 304760 - RNA, 22 nt, Human
aucccagcacuuugggaggcca

SEQ ID NO: 304761 - RNA, 21 nt, Human
auccuggccaacauggugaaa

SEQ ID NO: 304762 - RNA, 21 nt, Human
augagucagcaaaacggggag

SEQ ID NO: 304763 - RNA, 22 nt, Human
augccacuacacuccagccugg

SEQ ID NO: 304764 - RNA, 21 nt, Human
augcugcccuguggcuucggu

SEQ ID NO: 304765 - RNA, 19 nt, Human
augcuuuccagaggcuacc

SEQ ID NO: 304766 - RNA, 24 nt, Human
auggauggggaaugcuuuccagag

SEQ ID NO: 304767 - RNA, 22 nt, Human
augggggacacaggcaacaaag

SEQ ID NO: 304768 - RNA, 26 nt, Human
caaauagucuuccucucuugccuucu

SEQ ID NO: 304769 - RNA, 22 nt, Human
caacaacaauaacaaaaaaaaa

SEQ ID NO: 304770 - RNA, 24 nt, Human
caacauggugaaaccccgucucua

SEQ ID NO: 304771 - RNA, 24 nt, Human
caaggcaggcagaucacgagguca

SEQ ID NO: 304772 - RNA, 23 nt, Human
cacaaggaggagucucacagggg

SEQ ID NO: 304773 - RNA, 20 nt, Human
cacacacuccccaaaccaag

SEQ ID NO: 304774 - RNA, 19 nt, Human
cacagaucucuuuaaauca

SEQ ID NO: 304775 - RNA, 19 nt, Human
caccccacacacuccccaa

SEQ ID NO: 304776 - RNA, 26 nt, Human
caccccacacacuccccaaaccaagc

SEQ ID NO: 304777 - RNA, 28 nt, Human
caccccacacacuccccaaaccaagcau

SEQ ID NO: 304778 - RNA, 19 nt, Human
caccuggaccgagcuggag

SEQ ID NO: 304779 - RNA, 24 nt, Human
cacgccuguaaucccagcacuuug

SEQ ID NO: 304780 - RNA, 22 nt, Human
cacuccagccuggcgacagggc

SEQ ID NO: 304781 - RNA, 23 nt, Human
cacuccagccuggcgacagggcg

SEQ ID NO: 304782 - RNA, 20 nt, Human
cacuccucuucccccuccug

SEQ ID NO: 304783 - RNA, 20 nt, Human
cagagacaaaugaagggaga

SEQ ID NO: 304784 - RNA, 26 nt, Human
cagagacaaaugaagggagagaccua

SEQ ID NO: 304785 - RNA, 19 nt, Human
cagaucacgaggucaagag

SEQ ID NO: 304786 - RNA, 21 nt, Human
cagaucucuuuaaaucaggag

SEQ ID NO: 304787 - RNA, 19 nt, Human
cagcacaggcagcccuccc

SEQ ID NO: 304788 - RNA, 28 nt, Human
cagcacaggcagcccuccccaacccucc

SEQ ID NO: 304789 - RNA, 24 nt, Human
cagcacuuugggaggccaaggcag

SEQ ID NO: 304790 - RNA, 25 nt, Human
cagcacuuugggaggccaaggcagg

SEQ ID NO: 304791 - RNA, 20 nt, Human
cagcagaaagaaguggggag

SEQ ID NO: 304792 - RNA, 26 nt, Human
cagcagaaagaaguggggagugaugg

SEQ ID NO: 304793 - RNA, 19 nt, Human
cagcccuccccaacccucc

SEQ ID NO: 304794 - RNA, 21 nt, Human
cagcuacucgggaggcugagg

SEQ ID NO: 304795 - RNA, 18 nt, Human
caggacuacagugaaccu

SEQ ID NO: 304796 - RNA, 22 nt, Human
caggcagaucacgaggucaaga

SEQ ID NO: 304797 - RNA, 20 nt, Human
caguccagcacaggcagccc

SEQ ID NO: 304798 - RNA, 18 nt, Human
caguggcacaagccucag

SEQ ID NO: 304799 - RNA, 18 nt, Human
caugggaaauauccagcc

SEQ ID NO: 304800 - RNA, 23 nt, Human
ccaaaagagcaugggucccugaa

SEQ ID NO: 304801 - RNA, 22 nt, Human
ccacacacuccccaaaccaagc

SEQ ID NO: 304802 - RNA, 22 nt, Human
ccaccccacacacuccccaaac

SEQ ID NO: 304803 - RNA, 19 nt, Human
ccacuacacuccagccugg

SEQ ID NO: 304804 - RNA, 20 nt, Human
ccacuacacuccagccuggc

SEQ ID NO: 304805 - RNA, 23 nt, Human
ccacuacacuccagccuggcgac

SEQ ID NO: 304806 - RNA, 21 nt, Human
ccacuccucuucccccuccug

SEQ ID NO: 304807 - RNA, 20 nt, Human
cccacacacuccccaaacca

SEQ ID NO: 304808 - RNA, 18 nt, Human
cccacugggccccucccc

SEQ ID NO: 304809 - RNA, 19 nt, Human
cccacugggccccucccca

SEQ ID NO: 304810 - RNA, 23 nt, Human
ccccaaaagagcaugggucccuu

SEQ ID NO: 304811 - RNA, 18 nt, Human
ccccaacccuccccaacc

SEQ ID NO: 304812 - RNA, 24 nt, Human
ccccaacccuccccaaccuguccu

SEQ ID NO: 304813 - RNA, 19 nt, Human
ccccacacacuccccaaac

SEQ ID NO: 304814 - RNA, 23 nt, Human
ccccacacacuccccaaaccaag

SEQ ID NO: 304815 - RNA, 24 nt, Human
ccccacacacuccccaaaccaagc

SEQ ID NO: 304816 - RNA, 25 nt, Human
ccccacacacuccccaaaccaagca

SEQ ID NO: 304817 - RNA, 23 nt, Human
ccccacuccucuucccccuccug

SEQ ID NO: 304818 - RNA, 24 nt, Human
cccccaaaagagcaugggucccug

SEQ ID NO: 304819 - RNA, 19 nt, Human
cccccaaaaugcuacuuca

SEQ ID NO: 304820 - RNA, 22 nt, Human
cccccaccccaugccccuuucc

SEQ ID NO: 304821 - RNA, 21 nt, Human
cccuccccaacccuccccaac

SEQ ID NO: 304822 - RNA, 21 nt, Human
cccugagggccucugcucccc

SEQ ID NO: 304823 - RNA, 19 nt, Human
ccgcccacuccccacuccu

SEQ ID NO: 304824 - RNA, 26 nt, Human
ccgucuccaaaaaaaaaaaaaaaaau

SEQ ID NO: 304825 - RNA, 19 nt, Human
ccuagcaagcagucaguag

SEQ ID NO: 304826 - RNA, 19 nt, Human
ccuagggaccucuucccag

SEQ ID NO: 304827 - RNA, 21 nt, Human
ccuauagcuagaaaacgaaac

SEQ ID NO: 304828 - RNA, 24 nt, Human
ccuccuaccacagaggccagaauc

SEQ ID NO: 304829 - RNA, 24 nt, Human
ccuccuacugaccaaagaaaaauc

SEQ ID NO: 304830 - RNA, 22 nt, Human
ccuggccaacauggugaaaccc

SEQ ID NO: 304831 - RNA, 23 nt, Human
ccuggccaacauggugaaacccc

SEQ ID NO: 304832 - RNA, 24 nt, Human
ccuggccaacauggugaaaccccg

SEQ ID NO: 304833 - RNA, 21 nt, Human
ccuggcgacagggcgagacuc

SEQ ID NO: 304834 - RNA, 22 nt, Human
ccuguaaucccagcacuuuggg

SEQ ID NO: 304835 - RNA, 19 nt, Human
ccuguaaucccagcuacuc

SEQ ID NO: 304836 - RNA, 21 nt, Human
ccuguaaucccagcuacucgg

SEQ ID NO: 304837 - RNA, 22 nt, Human
ccuguaaucccagcuacucggg

SEQ ID NO: 304838 - RNA, 23 nt, Human
ccuucucgcaaggcuuccugucc

SEQ ID NO: 304839 - RNA, 25 nt, Human
cgaaacaacaacaacaauaacaaaa

SEQ ID NO: 304840 - RNA, 24 nt, Human
cgagaccauccuggccaacauggu

SEQ ID NO: 304841 - RNA, 24 nt, Human
cgagaucaugccacuacacuccag

SEQ ID NO: 304842 - RNA, 21 nt, Human
cgaggacccacugggccccuc

SEQ ID NO: 304843 - RNA, 23 nt, Human
cgccuguaaucccagcacuuugg

SEQ ID NO: 304844 - RNA, 24 nt, Human
cucaaaauggaauccuuuuggccc

SEQ ID NO: 304845 - RNA, 20 nt, Human
cucacagccuccaaggggcu

SEQ ID NO: 304846 - RNA, 22 nt, Human
cucacgccuguaaucccagcac

SEQ ID NO: 304847 - RNA, 24 nt, Human
cucacgccuguaaucccagcacuu

SEQ ID NO: 304848 - RNA, 27 nt, Human
cuccccacuccucuucccccuccugga

SEQ ID NO: 304849 - RNA, 22 nt, Human
cucuucuuccuucucuauaccc

SEQ ID NO: 304850 - RNA, 22 nt, Human
cugacccccagaagggccagga

SEQ ID NO: 304851 - RNA, 21 nt, Human
cuggaggguugugacauggug

SEQ ID NO: 304852 - RNA, 20 nt, Human
cugggugguggcucugcugg

SEQ ID NO: 304853 - RNA, 21 nt, Human
cugggugguggcucugcuggg

SEQ ID NO: 304854 - RNA, 25 nt, Human
cuucaggacuacagugaaccucucu

SEQ ID NO: 304855 - RNA, 21 nt, Human
cuuccaugcugcccuguggcu

SEQ ID NO: 304856 - RNA, 20 nt, Human
cuucuuccuucucuauaccc

SEQ ID NO: 304857 - RNA, 20 nt, Human
cuuuuggcccucuacucuuc

SEQ ID NO: 304858 - RNA, 23 nt, Human
gaaaacgaaacaacaacaacaau

SEQ ID NO: 304859 - RNA, 19 nt, Human
gaaaaguccccccaaaaga

SEQ ID NO: 304860 - RNA, 26 nt, Human
gaaacaacaacaacaauaacaaaaaa

SEQ ID NO: 304861 - RNA, 21 nt, Human
gacagggcgagacuccgucuc

SEQ ID NO: 304862 - RNA, 21 nt, Human
gacccacugggccccucccca

SEQ ID NO: 304863 - RNA, 18 nt, Human
gacgccaucucuauggug

SEQ ID NO: 304864 - RNA, 23 nt, Human
gagaaucgcuugaacccgggagg

SEQ ID NO: 304865 - RNA, 18 nt, Human
gaggacccacugggcccc

SEQ ID NO: 304866 - RNA, 18 nt, Human
gagugaauugcuaaggcu

SEQ ID NO: 304867 - RNA, 18 nt, Human
gaugcugggugguggcuc

SEQ ID NO: 304868 - RNA, 20 nt, Human
gcaaaacggggaguuucuga

SEQ ID NO: 304869 - RNA, 18 nt, Human
gcaaaaucagaaaggccc

SEQ ID NO: 304870 - RNA, 21 nt, Human
gcaacaaagucucuacuuccu

SEQ ID NO: 304871 - RNA, 19 nt, Human
gcaaggcuuccugucccag

SEQ ID NO: 304872 - RNA, 18 nt, Human
gcacaagccucaguccag

SEQ ID NO: 304873 - RNA, 19 nt, Human
gcagcacagcagaaagaag

SEQ ID NO: 304874 - RNA, 24 nt, Human
gccaacauggugaaaccccgucuc

SEQ ID NO: 304875 - RNA, 18 nt, Human
gccaccagccugggaugc

SEQ ID NO: 304876 - RNA, 25 nt, Human
gcccacuccccacuccucuuccccc

SEQ ID NO: 304877 - RNA, 18 nt, Human
gcccuguggcuucgguca

SEQ ID NO: 304878 - RNA, 24 nt, Human
gccgaggacccacugggccccucc

SEQ ID NO: 304879 - RNA, 19 nt, Human
gcggggcaugguggcucac

SEQ ID NO: 304880 - RNA, 19 nt, Human
gcuaaggcuuccuucagcc

SEQ ID NO: 304881 - RNA, 18 nt, Human
gcugcaaccucacagccu

SEQ ID NO: 304882 - RNA, 20 nt, Human
ggaaaaguccccccaaaaga

SEQ ID NO: 304883 - RNA, 21 nt, Human
ggaaaaguccccccaaaagag

SEQ ID NO: 304884 - RNA, 22 nt, Human
ggaaguaaacaguacacagauc

SEQ ID NO: 304885 - RNA, 22 nt, Human
ggagagaccuauggggaagcac

SEQ ID NO: 304886 - RNA, 22 nt, Human
ggaggcaaaaucagaaaggccc

SEQ ID NO: 304887 - RNA, 22 nt, Human
ggaugcugggugguggcucugc

SEQ ID NO: 304888 - RNA, 23 nt, Human
ggcgaggaagacaacccuuugga

SEQ ID NO: 304889 - RNA, 23 nt, Human
ggcgugguggcacaugccuguaa

SEQ ID NO: 304890 - RNA, 22 nt, Human
gggaagcagcacagcagaaaga

SEQ ID NO: 304891 - RNA, 22 nt, Human
gggaauaaagaauaugaagaga

SEQ ID NO: 304892 - RNA, 19 nt, Human
gggagagaccuauggggaa

SEQ ID NO: 304893 - RNA, 24 nt, Human
gggcaugguggcucacgccuguaa

SEQ ID NO: 304894 - RNA, 22 nt, Human
ggguugugacauggugucuggg

SEQ ID NO: 304895 - RNA, 24 nt, Human
gguggcacaugccuguaaucccag

SEQ ID NO: 304896 - RNA, 24 nt, Human
gguggcucacgccuguaaucccag

SEQ ID NO: 304897 - RNA, 18 nt, Human
guccuuagagagggcucu

SEQ ID NO: 304898 - RNA, 21 nt, Human
guccuuagagagggcucuggc

SEQ ID NO: 304899 - RNA, 19 nt, Human
guccuuggcagaaccccaa

SEQ ID NO: 304900 - RNA, 23 nt, Human
gucuuacucucccugccuccuac

SEQ ID NO: 304901 - RNA, 19 nt, Human
gugaggaugggggacacag

SEQ ID NO: 304902 - RNA, 26 nt, Human
uaaaaugagcuacaggcacaaagcca

SEQ ID NO: 304903 - RNA, 20 nt, Human
uaagaaccuuaaucauacaa

SEQ ID NO: 304904 - RNA, 22 nt, Human
uacagcccaccccacacacucc

SEQ ID NO: 304905 - RNA, 18 nt, Human
uacccugagggccucugc

SEQ ID NO: 304906 - RNA, 21 nt, Human
uacuucauacagcccacccca

SEQ ID NO: 304907 - RNA, 22 nt, Human
uagcuuggcgugguggcacaug

SEQ ID NO: 304908 - RNA, 21 nt, Human
uauagcuagaaaacgaaacaa

SEQ ID NO: 304909 - RNA, 23 nt, Human
uaucacagcgcucuccuuuggag

SEQ ID NO: 304910 - RNA, 23 nt, Human
uauccacccacccacccccaaaa

SEQ ID NO: 304911 - RNA, 19 nt, Human
uaugguccguucaucugga

SEQ ID NO: 304912 - RNA, 18 nt, Human
ucaccacuccaauccagc

SEQ ID NO: 304913 - RNA, 24 nt, Human
ucacgaggucaagagaucgagacc

SEQ ID NO: 304914 - RNA, 21 nt, Human
ucacuauuucauuuuuuaaaa

SEQ ID NO: 304915 - RNA, 27 nt, Human
ucaguccagcacaggcagcccucccca

SEQ ID NO: 304916 - RNA, 23 nt, Human
uccaaauagucuuccucucuugc

SEQ ID NO: 304917 - RNA, 22 nt, Human
uccaauccagccuccuacugac

SEQ ID NO: 304918 - RNA, 19 nt, Human
uccacccacccacccccaa

SEQ ID NO: 304919 - RNA, 21 nt, Human
uccacccacccacccccaaaa

SEQ ID NO: 304920 - RNA, 22 nt, Human
uccagccuggcgacagggcgag

SEQ ID NO: 304921 - RNA, 23 nt, Human
uccagccuggcgacagggcgaga

SEQ ID NO: 304922 - RNA, 21 nt, Human
ucccaguuaggacaacaucac

SEQ ID NO: 304923 - RNA, 21 nt, Human
uccccaaaccaagcauugcuc

SEQ ID NO: 304924 - RNA, 22 nt, Human
uccccaacccuccccaaccugu

SEQ ID NO: 304925 - RNA, 22 nt, Human
ucccccaccccaugccccuuuc

SEQ ID NO: 304926 - RNA, 22 nt, Human
ucccugccuccuaccacagagg

SEQ ID NO: 304927 - RNA, 24 nt, Human
uccgucuccaaaaaaaaaaaaaaa

SEQ ID NO: 304928 - RNA, 21 nt, Human
uccugccaccagccugggaug

SEQ ID NO: 304929 - RNA, 18 nt, Human
ucgcuugaacccgggagg

SEQ ID NO: 304930 - RNA, 24 nt, Human
ucgggaggcugagguaggagaauc

SEQ ID NO: 304931 - RNA, 18 nt, Human
ucuaugguggaacagugg

SEQ ID NO: 304932 - RNA, 20 nt, Human
ucuccaaaaaaaaaaaaaaa

SEQ ID NO: 304933 - RNA, 27 nt, Human
ucuccaaaaaaaaaaaaaaaaauccau

SEQ ID NO: 304934 - RNA, 21 nt, Human
ucucuacuaaaaauacaaaaa

SEQ ID NO: 304935 - RNA, 21 nt, Human
ucuuccucucuugccuucugg

SEQ ID NO: 304936 - RNA, 20 nt, Human
ucuugggugaaacuacaucu

SEQ ID NO: 304937 - RNA, 23 nt, Human
ugacagaaauggaguuugggagg

SEQ ID NO: 304938 - RNA, 21 nt, Human
ugaccaaagaaaaaucauggg

SEQ ID NO: 304939 - RNA, 21 nt, Human
ugagcuacaggcacaaagcca

SEQ ID NO: 304940 - RNA, 27 nt, Human
ugaggaaaagucuuauaaaaaggguga

SEQ ID NO: 304941 - RNA, 21 nt, Human
ugaggaugggggacacaggca

SEQ ID NO: 304942 - RNA, 24 nt, Human
ugagguaggagaaucgcuugaacc

SEQ ID NO: 304943 - RNA, 19 nt, Human
ugagucgagaucaugccac

SEQ ID NO: 304944 - RNA, 24 nt, Human
ugccuguaaucccagcuacucggg

SEQ ID NO: 304945 - RNA, 18 nt, Human
ugcucaucacaaccaacc

SEQ ID NO: 304946 - RNA, 21 nt, Human
uggaaggauaacaguuuccaa

SEQ ID NO: 304947 - RNA, 21 nt, Human
uggaaucccccaccccaugcc

SEQ ID NO: 304948 - RNA, 23 nt, Human
uggaaucccccaccccaugcccc

SEQ ID NO: 304949 - RNA, 24 nt, Human
uggaauccuuuuggcccucuacuc

SEQ ID NO: 304950 - RNA, 20 nt, Human
uggaggcaaaaucagaaagg

SEQ ID NO: 304951 - RNA, 21 nt, Human
uggcacaugccuguaauccca

SEQ ID NO: 304952 - RNA, 22 nt, Human
uggcacaugccuguaaucccag

SEQ ID NO: 304953 - RNA, 24 nt, Human
uggccaacauggugaaaccccguc

SEQ ID NO: 304954 - RNA, 22 nt, Human
uggcucacgccuguaaucccag

SEQ ID NO: 304955 - RNA, 24 nt, Human
uggcucacgccuguaaucccagca

SEQ ID NO: 304956 - RNA, 24 nt, Human
ugggaggccaaggcaggcagauca

SEQ ID NO: 304957 - RNA, 19 nt, Human
ugggaugcugggugguggc

SEQ ID NO: 304958 - RNA, 24 nt, Human
ugguggcacaugccuguaauccca

SEQ ID NO: 304959 - RNA, 24 nt, Human
ugguggcucacgccuguaauccca

SEQ ID NO: 304960 - RNA, 18 nt, Human
ugugaagccucugcuagg

SEQ ID NO: 304961 - RNA, 18 nt, Human
uuacgguuugcugcaaag

SEQ ID NO: 304962 - RNA, 18 nt, Human
uuagcuuggcgugguggc

SEQ ID NO: 304963 - RNA, 24 nt, Human
uuagcuuggcgugguggcacaugc

SEQ ID NO: 304964 - RNA, 22 nt, Human
uucaaagucccucccuccuuuu

SEQ ID NO: 304965 - RNA, 23 nt, Human
uucauagagaccagcugaccccc

SEQ ID NO: 304966 - RNA, 22 nt, Human
uuccaaagaggcaaacaaucuu

SEQ ID NO: 304967 - RNA, 22 nt, Human
uucucaggaagaggaaggagug

SEQ ID NO: 304968 - RNA, 18 nt, Human
uugcagugagucgagauc

SEQ ID NO: 304969 - RNA, 21 nt, Human
uugcagugagucgagaucaug

SEQ ID NO: 304970 - RNA, 23 nt, Human
uuggcgaggaagacaacccuuug

SEQ ID NO: 304971 - RNA, 28 nt, Human
uuucaccgcccacuccccacuccucuuc

SEQ ID NO: 304972 - RNA, 18 nt, Human
uuucugauccuuggaauu

SEQ ID NO: 304973 - RNA, 19 nt, Human
uuucugcuucaggacuaca

SEQ ID NO: 304974 - RNA, 22 nt, Human
uuugauggaaucccccacccca

SEQ ID NO: 304975 - RNA, 19 nt, Human
uuugcagugagucgagauc

SEQ ID NO: 304976 - RNA, 24 nt, Human
uuugcagugagucgagaucaugcc

SEQ ID NO: 304977 - RNA, 18 nt, Human
aguauuuuauuucuguuc

SEQ ID NO: 304978 - RNA, 20 nt, Human
cggucuuugccugcugagag

SEQ ID NO: 304979 - RNA, 19 nt, Human
uauuuuauuucuguucuug

SEQ ID NO: 304980 - RNA, 18 nt, Human
ucaaacccuguuugcguu

SEQ ID NO: 304981 - RNA, 21 nt, Human
ugaaaugaacuaguuuaagug

SEQ ID NO: 304982 - RNA, 22 nt, Human
aaagaccagcaaagcccccucc

SEQ ID NO: 304983 - RNA, 18 nt, Human
aacaaaaucacuuuacag

SEQ ID NO: 304984 - RNA, 19 nt, Human
aacagaggaagaccccauc

SEQ ID NO: 304985 - RNA, 20 nt, Human
aacagaggaagaccccaucu

SEQ ID NO: 304986 - RNA, 20 nt, Human
aacauggugaaacccccguc

SEQ ID NO: 304987 - RNA, 21 nt, Human
aacauggugaaacccccgucu

SEQ ID NO: 304988 - RNA, 22 nt, Human
aacauggugaaacccccgucuc

SEQ ID NO: 304989 - RNA, 18 nt, Human
aacuaacuugccuucccc

SEQ ID NO: 304990 - RNA, 23 nt, Human
aagaaucacuugaaccugggagg

SEQ ID NO: 304991 - RNA, 24 nt, Human
aagacuguacacccaaaaccagaa

SEQ ID NO: 304992 - RNA, 20 nt, Human
aauaguccaagaaagaccag

SEQ ID NO: 304993 - RNA, 24 nt, Human
aaucacuugaaccugggaggcgga

SEQ ID NO: 304994 - RNA, 19 nt, Human
acaaaaggcagccaugucg

SEQ ID NO: 304995 - RNA, 20 nt, Human
acagaggaagaccccaucuc

SEQ ID NO: 304996 - RNA, 24 nt, Human
acagaggaagaccccaucucaaaa

SEQ ID NO: 304997 - RNA, 22 nt, Human
acagcagguucccaaaggugau

SEQ ID NO: 304998 - RNA, 22 nt, Human
accacugcacuccagccugggc

SEQ ID NO: 304999 - RNA, 18 nt, Human
accccaucucaaaaaaaa

SEQ ID NO: 305000 - RNA, 19 nt, Human
acccgcagccgccuccucu

SEQ ID NO: 305001 - RNA, 24 nt, Human
accugaggucaggaguucgagacc

SEQ ID NO: 305002 - RNA, 24 nt, Human
acuaaaauacaaaaauuagcuggu

SEQ ID NO: 305003 - RNA, 24 nt, Human
acugcacuccagccugggcaacag

SEQ ID NO: 305004 - RNA, 24 nt, Human
acugcacuccagccugggcaacag

SEQ ID NO: 305005 - RNA, 22 nt, Human
agaaagaucccagcacgccccc

SEQ ID NO: 305006 - RNA, 20 nt, Human
agaacagagcuggcaccuga

SEQ ID NO: 305007 - RNA, 18 nt, Human
agacuguacacccaaaac

SEQ ID NO: 305008 - RNA, 20 nt, Human
agcacuuugggaggcucagg

SEQ ID NO: 305009 - RNA, 24 nt, Human
agcccagccaacauggugaaaccc

SEQ ID NO: 305010 - RNA, 23 nt, Human
agcgggcggcuacuucuggcucu

SEQ ID NO: 305011 - RNA, 24 nt, Human
aggaggcugaggcaagaagaauca

SEQ ID NO: 305012 - RNA, 23 nt, Human
aggcaagaagaaucacuugaacc

SEQ ID NO: 305013 - RNA, 25 nt, Human
aggcaagaagaaucacuugaaccug

SEQ ID NO: 305014 - RNA, 20 nt, Human
aggcagccaugucgguucuu

SEQ ID NO: 305015 - RNA, 19 nt, Human
aggcggagguuacagugag

SEQ ID NO: 305016 - RNA, 24 nt, Human
aggcggagguuacagugagccaag

SEQ ID NO: 305017 - RNA, 22 nt, Human
aggcggguggaucaccugaggu

SEQ ID NO: 305018 - RNA, 26 nt, Human
aggcggguggaucaccugaggucagg

SEQ ID NO: 305019 - RNA, 20 nt, Human
aguaggcaccaggugaccgc

SEQ ID NO: 305020 - RNA, 20 nt, Human
agugucaucccgcccuggcc

SEQ ID NO: 305021 - RNA, 25 nt, Human
auaaauaaauaaccaguguaaacaa

SEQ ID NO: 305022 - RNA, 19 nt, Human
aucaccgggcagguccuga

SEQ ID NO: 305023 - RNA, 21 nt, Human
aucacuuuacaguagagaaag

SEQ ID NO: 305024 - RNA, 19 nt, Human
auccaggccuuuggaggcu

SEQ ID NO: 305025 - RNA, 19 nt, Human
augccuguaaucccagcac

SEQ ID NO: 305026 - RNA, 24 nt, Human
auugcaccacugcacuccagccug

SEQ ID NO: 305027 - RNA, 28 nt, Human
auugcaccacugcacuccagccugggca

SEQ ID NO: 305028 - RNA, 25 nt, Human
caacauggugaaacccccgucucua

SEQ ID NO: 305029 - RNA, 22 nt, Human
caagacuguacacccaaaacca

SEQ ID NO: 305030 - RNA, 21 nt, Human
cacaagacuguacacccaaaa

SEQ ID NO: 305031 - RNA, 23 nt, Human
cacaagacuguacacccaaaacc

SEQ ID NO: 305032 - RNA, 19 nt, Human
cacacaggcgcacuuaaau

SEQ ID NO: 305033 - RNA, 19 nt, Human
cacaccuguaaucccagcu

SEQ ID NO: 305034 - RNA, 23 nt, Human
caccugaggucaggaguucgaga

SEQ ID NO: 305035 - RNA, 24 nt, Human
caccuguaaucccagcuacucagg

SEQ ID NO: 305036 - RNA, 18 nt, Human
cacugcacuccagccugg

SEQ ID NO: 305037 - RNA, 19 nt, Human
cacugcacuccagccuggg

SEQ ID NO: 305038 - RNA, 21 nt, Human
cacugcacuccagccugggca

SEQ ID NO: 305039 - RNA, 23 nt, Human
cacugcacuccagccugggcaac

SEQ ID NO: 305040 - RNA, 24 nt, Human
cacugcacuccagccugggcaaca

SEQ ID NO: 305041 - RNA, 25 nt, Human
cacugcacuccagccugggcaacaa

SEQ ID NO: 305042 - RNA, 27 nt, Human
cacugcacuccagccugggcaacagag

SEQ ID NO: 305043 - RNA, 21 nt, Human
cacuugaaccugggaggcgga

SEQ ID NO: 305044 - RNA, 18 nt, Human
cagaacucagucuaggga

SEQ ID NO: 305045 - RNA, 20 nt, Human
cagagugcuggucucaaccc

SEQ ID NO: 305046 - RNA, 19 nt, Human
cagcaccgccgcugaauga

SEQ ID NO: 305047 - RNA, 22 nt, Human
cagcacuuugggaggcucaggc

SEQ ID NO: 305048 - RNA, 24 nt, Human
cagcacuuugggaggcucaggcgg

SEQ ID NO: 305049 - RNA, 18 nt, Human
cagccugggcaacagagg

SEQ ID NO: 305050 - RNA, 22 nt, Human
cagccugggcaacagaggaaga

SEQ ID NO: 305051 - RNA, 19 nt, Human
cagcuggaagacuuggggu

SEQ ID NO: 305052 - RNA, 24 nt, Human
cagcuggaagacuuggggugacag

SEQ ID NO: 305053 - RNA, 20 nt, Human
caggcacacaagacuguaca

SEQ ID NO: 305054 - RNA, 21 nt, Human
caggcacacaagacuguacac

SEQ ID NO: 305055 - RNA, 21 nt, Human
cagguccugaguccauggccu

SEQ ID NO: 305056 - RNA, 20 nt, Human
cagguucccaaaggugaugg

SEQ ID NO: 305057 - RNA, 26 nt, Human
caguucaggcucuucagccccuuuag

SEQ ID NO: 305058 - RNA, 24 nt, Human
caugccuguaaucccagcacuuug

SEQ ID NO: 305059 - RNA, 23 nt, Human
ccaagaaagaccagcaaagcccc

SEQ ID NO: 305060 - RNA, 21 nt, Human
ccacacccgcgcacacaggcg

SEQ ID NO: 305061 - RNA, 20 nt, Human
ccacugcacuccagccuggg

SEQ ID NO: 305062 - RNA, 20 nt, Human
ccacugcacuccagccuggg

SEQ ID NO: 305063 - RNA, 21 nt, Human
ccacugcacuccagccugggc

SEQ ID NO: 305064 - RNA, 23 nt, Human
ccacugcacuccagccugggcaa

SEQ ID NO: 305065 - RNA, 24 nt, Human
ccacugcacuccagccugggcaac

SEQ ID NO: 305066 - RNA, 20 nt, Human
ccagacagaaacaugaaaug

SEQ ID NO: 305067 - RNA, 22 nt, Human
ccagacagaaacaugaaaugac

SEQ ID NO: 305068 - RNA, 22 nt, Human
ccagaugacaguuguccucucu

SEQ ID NO: 305069 - RNA, 19 nt, Human
ccaggacccaggcagucug

SEQ ID NO: 305070 - RNA, 24 nt, Human
ccaucucaaaaaaaaaaaaaaaaa

SEQ ID NO: 305071 - RNA, 22 nt, Human
cccaaaggugaugguucuggaa

SEQ ID NO: 305072 - RNA, 20 nt, Human
cccacgacccgcagccgccu

SEQ ID NO: 305073 - RNA, 24 nt, Human
cccacgacccgcagccgccuccuc

SEQ ID NO: 305074 - RNA, 19 nt, Human
ccccaucucaaaaaaaaaa

SEQ ID NO: 305075 - RNA, 22 nt, Human
ccccgucucuacuaaaauacaa

SEQ ID NO: 305076 - RNA, 21 nt, Human
ccucagccgagagccaggugc

SEQ ID NO: 305077 - RNA, 22 nt, Human
ccucggggggcccagcaccgcc

SEQ ID NO: 305078 - RNA, 22 nt, Human
ccugaggucaggaguucgagac

SEQ ID NO: 305079 - RNA, 18 nt, Human
ccugggaagaagguuccc

SEQ ID NO: 305080 - RNA, 19 nt, Human
ccugggaggcggagguuac

SEQ ID NO: 305081 - RNA, 21 nt, Human
ccuguaaucccagcuacucag

SEQ ID NO: 305082 - RNA, 18 nt, Human
ccuuuggaggcuuaagac

SEQ ID NO: 305083 - RNA, 24 nt, Human
cgagaccagcccagccaacauggu

SEQ ID NO: 305084 - RNA, 19 nt, Human
cggcgcagcugacagggcu

SEQ ID NO: 305085 - RNA, 24 nt, Human
cggguggaucaccugaggucagga

SEQ ID NO: 305086 - RNA, 18 nt, Human
cucaaaaaaaaaaaaaaa

SEQ ID NO: 305087 - RNA, 18 nt, Human
cucaaaaaaaaaaaaaaa

SEQ ID NO: 305088 - RNA, 24 nt, Human
cucaugccuguaaucccagcacuu

SEQ ID NO: 305089 - RNA, 23 nt, Human
cuggccucauccuuuuguuaaaa

SEQ ID NO: 305090 - RNA, 23 nt, Human
cuggugaaucagaacagagcugg

SEQ ID NO: 305091 - RNA, 21 nt, Human
cuguaaucccagcuacucagg

SEQ ID NO: 305092 - RNA, 19 nt, Human
gaagaccccaucucaaaaa

SEQ ID NO: 305093 - RNA, 21 nt, Human
gacccgcagccgccuccucuu

SEQ ID NO: 305094 - RNA, 18 nt, Human
gagguuacagugagccaa

SEQ ID NO: 305095 - RNA, 23 nt, Human
gagguuacagugagccaagauug

SEQ ID NO: 305096 - RNA, 24 nt, Human
gagugggccgggcgugguggcuca

SEQ ID NO: 305097 - RNA, 24 nt, Human
gaucaccugaggucaggaguucga

SEQ ID NO: 305098 - RNA, 25 nt, Human
gccaacauggugaaacccccgucuc

SEQ ID NO: 305099 - RNA, 20 nt, Human
gcccagggcugggaggagcc

SEQ ID NO: 305100 - RNA, 19 nt, Human
gccuuuggaggcuuaagac

SEQ ID NO: 305101 - RNA, 22 nt, Human
ggaagacuuggggugacaaucc

SEQ ID NO: 305102 - RNA, 21 nt, Human
ggaggcggagguuacagugag

SEQ ID NO: 305103 - RNA, 22 nt, Human
ggagguuacagugagccaagau

SEQ ID NO: 305104 - RNA, 24 nt, Human
ggagguuacagugagccaagauug

SEQ ID NO: 305105 - RNA, 22 nt, Human
ggaucaccugaggucaggaguu

SEQ ID NO: 305106 - RNA, 21 nt, Human
ggccgggcgugguggcucaug

SEQ ID NO: 305107 - RNA, 23 nt, Human
ggccgggcgugguggcucaugcc

SEQ ID NO: 305108 - RNA, 23 nt, Human
ggcgugguggcucaugccuguaa

SEQ ID NO: 305109 - RNA, 22 nt, Human
gggaauucucguacccaagacc

SEQ ID NO: 305110 - RNA, 21 nt, Human
ggugcacaccuguaaucccag

SEQ ID NO: 305111 - RNA, 21 nt, Human
gguggaucaccugaggucagg

SEQ ID NO: 305112 - RNA, 24 nt, Human
gguggcucaugccuguaaucccag

SEQ ID NO: 305113 - RNA, 23 nt, Human
gguggugcacaccuguaauccca

SEQ ID NO: 305114 - RNA, 24 nt, Human
gguggugcacaccuguaaucccag

SEQ ID NO: 305115 - RNA, 23 nt, Human
gugcucccacacccgcgcacaca

SEQ ID NO: 305116 - RNA, 23 nt, Human
uaaaagcccacaguccuagcccc

SEQ ID NO: 305117 - RNA, 25 nt, Human
uaaauaaauaaccaguguuguaaua

SEQ ID NO: 305118 - RNA, 20 nt, Human
uaaauaaauaacgcgcacgc

SEQ ID NO: 305119 - RNA, 21 nt, Human
uaacuaacuugccuuccccag

SEQ ID NO: 305120 - RNA, 19 nt, Human
uacacccaaaaccagaaac

SEQ ID NO: 305121 - RNA, 22 nt, Human
uacuucuggcucuguugaguuu

SEQ ID NO: 305122 - RNA, 20 nt, Human
ucaccugaggucaggaguuc

SEQ ID NO: 305123 - RNA, 24 nt, Human
ucacuugaaccugggaggcggagg

SEQ ID NO: 305124 - RNA, 25 nt, Human
ucacuugaaccugggaggcggaggu

SEQ ID NO: 305125 - RNA, 24 nt, Human
ucaggcggguggaucaccugaggu

SEQ ID NO: 305126 - RNA, 26 nt, Human
ucaggcggguggaucaccugagguca

SEQ ID NO: 305127 - RNA, 22 nt, Human
ucaugccuguaaucccagcacu

SEQ ID NO: 305128 - RNA, 27 nt, Human
ucccacacccgcgcacacaggcgcacu

SEQ ID NO: 305129 - RNA, 19 nt, Human
uccccacgacccgcagccg

SEQ ID NO: 305130 - RNA, 19 nt, Human
uccuuuuguuaaaaccugc

SEQ ID NO: 305131 - RNA, 22 nt, Human
ucgcuucugaccugcuuuugcc

SEQ ID NO: 305132 - RNA, 18 nt, Human
ucucaaaaaaaaaaaaaa

SEQ ID NO: 305133 - RNA, 20 nt, Human
ucucuacuaaaauacaaaaa

SEQ ID NO: 305134 - RNA, 23 nt, Human
ucugaaggcugggagaagcccua

SEQ ID NO: 305135 - RNA, 22 nt, Human
ucuggcucuguugaguuuugga

SEQ ID NO: 305136 - RNA, 20 nt, Human
ugaaaaguggagagcaagca

SEQ ID NO: 305137 - RNA, 22 nt, Human
ugaaaaguggagagcaagcauc

SEQ ID NO: 305138 - RNA, 24 nt, Human
ugaaaugacuuaaaaaaauagaaa

SEQ ID NO: 305139 - RNA, 23 nt, Human
ugaaucagaacagagcuggcacc

SEQ ID NO: 305140 - RNA, 22 nt, Human
ugaaucuagaggguaccccggc

SEQ ID NO: 305141 - RNA, 19 nt, Human
ugaggcaagaagaaucacu

SEQ ID NO: 305142 - RNA, 21 nt, Human
ugaggcaagaagaaucacuug

SEQ ID NO: 305143 - RNA, 25 nt, Human
ugaggcaagaagaaucacuugaacc

SEQ ID NO: 305144 - RNA, 26 nt, Human
ugaggcaagaagaaucacuugaaccu

SEQ ID NO: 305145 - RNA, 23 nt, Human
ugagggaauucucguacccaaga

SEQ ID NO: 305146 - RNA, 21 nt, Human
ugcaccacugcacuccagccu

SEQ ID NO: 305147 - RNA, 23 nt, Human
ugccuguaaucccagcacuuugg

SEQ ID NO: 305148 - RNA, 24 nt, Human
ugccuguaaucccagcacuuuggg

SEQ ID NO: 305149 - RNA, 18 nt, Human
ugcgugaccggggugagc

SEQ ID NO: 305150 - RNA, 20 nt, Human
ugcguuguuacuucccagau

SEQ ID NO: 305151 - RNA, 22 nt, Human
ugcugggcccagauccaccagc

SEQ ID NO: 305152 - RNA, 24 nt, Human
uggaucaccugaggucaggaguuc

SEQ ID NO: 305153 - RNA, 27 nt, Human
uggaucaccugaggucaggaguucgag

SEQ ID NO: 305154 - RNA, 24 nt, Human
uggcagagugggccgggcguggug

SEQ ID NO: 305155 - RNA, 22 nt, Human
uggcucaugccuguaaucccag

SEQ ID NO: 305156 - RNA, 24 nt, Human
uggcucaugccuguaaucccagca

SEQ ID NO: 305157 - RNA, 29 nt, Human
ugggaggcggagguuacagugacaacggu

SEQ ID NO: 305158 - RNA, 24 nt, Human
ugggaggcggagguuacagugagc

SEQ ID NO: 305159 - RNA, 24 nt, Human
ugggaggcucaggcggguggauca

SEQ ID NO: 305160 - RNA, 22 nt, Human
ugggaggcucaggcggguggga

SEQ ID NO: 305161 - RNA, 18 nt, Human
uggggugacaauccucag

SEQ ID NO: 305162 - RNA, 22 nt, Human
uggugcacaccuguaaucccag

SEQ ID NO: 305163 - RNA, 24 nt, Human
ugguggcucaugccuguaauccca

SEQ ID NO: 305164 - RNA, 23 nt, Human
uguacacccaaaaccagaaacgc

SEQ ID NO: 305165 - RNA, 18 nt, Human
ugucaucccgcccuggcc

SEQ ID NO: 305166 - RNA, 20 nt, Human
uguuaaaaccugcuuucaga

SEQ ID NO: 305167 - RNA, 22 nt, Human
uuacagugagccaagauugcac

SEQ ID NO: 305168 - RNA, 21 nt, Human
uuagcuggguacggguggugc

SEQ ID NO: 305169 - RNA, 24 nt, Human
uucccagaugacaguuguccucuc

SEQ ID NO: 305170 - RNA, 19 nt, Human
uucucacacuucugguacc

SEQ ID NO: 305171 - RNA, 19 nt, Human
uucucauuucaagguuuca

SEQ ID NO: 305172 - RNA, 21 nt, Human
uugaaccugggaggcggaggu

SEQ ID NO: 305173 - RNA, 23 nt, Human
uugcaccacugcacuccagccug

SEQ ID NO: 305174 - RNA, 19 nt, Human
uuugcugggcccagaucca

SEQ ID NO: 305175 - RNA, 19 nt, Human
uuuguuaaaaccugcuuuc

SEQ ID NO: 305176 - RNA, 18 nt, Human
aaaaaaaaaagaaaaggg

SEQ ID NO: 305177 - RNA, 18 nt, Human
aaaaaaccaaaccugcaa

SEQ ID NO: 305178 - RNA, 25 nt, Human
aaaaagaaaaggucuggacuaccuc

SEQ ID NO: 305179 - RNA, 20 nt, Human
aaacaaaaacaaaaauguga

SEQ ID NO: 305180 - RNA, 28 nt, Human
aaacaaaaacaaaaaugugaugcaccug

SEQ ID NO: 305181 - RNA, 19 nt, Human
aaacagguaucuauuuuua

SEQ ID NO: 305182 - RNA, 24 nt, Human
aaaccaaaccugcaaauaauccua

SEQ ID NO: 305183 - RNA, 20 nt, Human
aaaccugcaaauaauccuag

SEQ ID NO: 305184 - RNA, 27 nt, Human
aaagggaggcagggaaaaaggaaggga

SEQ ID NO: 305185 - RNA, 20 nt, Human
aaccauagaacacuaacuug

SEQ ID NO: 305186 - RNA, 25 nt, Human
aagaccagcagaggaaggucaaggc

SEQ ID NO: 305187 - RNA, 20 nt, Human
aagagauggagucucacugu

SEQ ID NO: 305188 - RNA, 23 nt, Human
aagcacucaauaguaagauaguc

SEQ ID NO: 305189 - RNA, 22 nt, Human
aaggaagggaagaaaugucagg

SEQ ID NO: 305190 - RNA, 21 nt, Human
aauaucagggacaauaaggaa

SEQ ID NO: 305191 - RNA, 20 nt, Human
acaaaaacaaaaaugugaug

SEQ ID NO: 305192 - RNA, 20 nt, Human
acaacgauuacaucuuuuuc

SEQ ID NO: 305193 - RNA, 20 nt, Human
acaugaucaugacucucugc

SEQ ID NO: 305194 - RNA, 19 nt, Human
acccuggaacaagaccagc

SEQ ID NO: 305195 - RNA, 22 nt, Human
acuguguugcccaggcugauaa

SEQ ID NO: 305196 - RNA, 21 nt, Human
agaaaaaaccaaaccugcaaa

SEQ ID NO: 305197 - RNA, 22 nt, Human
agaaaaagaaaaaacuguucag

SEQ ID NO: 305198 - RNA, 22 nt, Human
agaccagcagaggaaggucaag

SEQ ID NO: 305199 - RNA, 19 nt, Human
agagauggagucucacugu

SEQ ID NO: 305200 - RNA, 23 nt, Human
agcaaugccaacaucuuuucucc

SEQ ID NO: 305201 - RNA, 20 nt, Human
aggaagggaagaaaugucag

SEQ ID NO: 305202 - RNA, 18 nt, Human
aggcaauccuccugccuc

SEQ ID NO: 305203 - RNA, 20 nt, Human
aggcacauaccacuauaccc

SEQ ID NO: 305204 - RNA, 19 nt, Human
aggcauaaaagaggcccug

SEQ ID NO: 305205 - RNA, 26 nt, Human
agguaggaaaagagcuauacuucuga

SEQ ID NO: 305206 - RNA, 23 nt, Human
auauucauaacccuggaacaaga

SEQ ID NO: 305207 - RNA, 24 nt, Human
auccaggcuggaguguaaggacau

SEQ ID NO: 305208 - RNA, 20 nt, Human
auccuccugccucagccucc

SEQ ID NO: 305209 - RNA, 23 nt, Human
augcaccugcaaaacuauugccc

SEQ ID NO: 305210 - RNA, 21 nt, Human
augccacagacaaaugagaaa

SEQ ID NO: 305211 - RNA, 19 nt, Human
augguugaggcuaugaagc

SEQ ID NO: 305212 - RNA, 19 nt, Human
caaaagacacugaaaagac

SEQ ID NO: 305213 - RNA, 18 nt, Human
caaagaauuuccagaagc

SEQ ID NO: 305214 - RNA, 19 nt, Human
caaagaauuuccagaagca

SEQ ID NO: 305215 - RNA, 23 nt, Human
caacgguuuagauuucuccugcu

SEQ ID NO: 305216 - RNA, 22 nt, Human
caagaccagcagaggaagguca

SEQ ID NO: 305217 - RNA, 24 nt, Human
cacaaagauaaccaaaauugagac

SEQ ID NO: 305218 - RNA, 28 nt, Human
cacacauuaaaaaaaaaaaaaaaaagaa

SEQ ID NO: 305219 - RNA, 21 nt, Human
cacaccacuaacaccugcaga

SEQ ID NO: 305220 - RNA, 24 nt, Human
caccuccugggcucaggcaauccu

SEQ ID NO: 305221 - RNA, 18 nt, Human
cacuguguugcccaggcu

SEQ ID NO: 305222 - RNA, 19 nt, Human
cacuguguugcccaggcug

SEQ ID NO: 305223 - RNA, 24 nt, Human
cagacaaaugagaaaaaaccaaac

SEQ ID NO: 305224 - RNA, 20 nt, Human
cagccuccugaguaccuggg

SEQ ID NO: 305225 - RNA, 23 nt, Human
cagcuaauuuuuuuuuuaagaga

SEQ ID NO: 305226 - RNA, 22 nt, Human
caggcaauccuccugccucagc

SEQ ID NO: 305227 - RNA, 26 nt, Human
cauaacccuggaacaagaccagcaga

SEQ ID NO: 305228 - RNA, 24 nt, Human
cauaccacuauacccagcuaauuu

SEQ ID NO: 305229 - RNA, 25 nt, Human
cauauucauaacccuggaacaagac

SEQ ID NO: 305230 - RNA, 21 nt, Human
cauuaagaaaaagaaaaaacu

SEQ ID NO: 305231 - RNA, 23 nt, Human
ccaaacaaucagcaaugccaaca

SEQ ID NO: 305232 - RNA, 23 nt, Human
ccacagacaaaugagaaaaaacc

SEQ ID NO: 305233 - RNA, 18 nt, Human
cccucccuuuuccuccca

SEQ ID NO: 305234 - RNA, 22 nt, Human
ccgugcccucccuuuuccuccc

SEQ ID NO: 305235 - RNA, 24 nt, Human
ccugaguaccugggacuacaggca

SEQ ID NO: 305236 - RNA, 24 nt, Human
ccugccucagccuccugaguaccu

SEQ ID NO: 305237 - RNA, 26 nt, Human
cuaugaagcuuuccccuuuuaugaga

SEQ ID NO: 305238 - RNA, 21 nt, Human
cuccaauaaauaacgagauau

SEQ ID NO: 305239 - RNA, 21 nt, Human
cucccaaaacaaaaacaaaaa

SEQ ID NO: 305240 - RNA, 24 nt, Human
cucgcucuguuauccaggcuggag

SEQ ID NO: 305241 - RNA, 21 nt, Human
cugcaguuuccaccuccuggg

SEQ ID NO: 305242 - RNA, 24 nt, Human
cugcaguuuccaccuccugggcuc

SEQ ID NO: 305243 - RNA, 24 nt, Human
cugccaugcuggagaaagcuauac

SEQ ID NO: 305244 - RNA, 19 nt, Human
gaaaaaaccaaaccugcaa

SEQ ID NO: 305245 - RNA, 18 nt, Human
gaaaugucaggcauaaaa

SEQ ID NO: 305246 - RNA, 24 nt, Human
gaagauuucacaagucuguaaaga

SEQ ID NO: 305247 - RNA, 19 nt, Human
gaagggaagaaaugucagg

SEQ ID NO: 305248 - RNA, 24 nt, Human
gacuacaggcacauaccacuauac

SEQ ID NO: 305249 - RNA, 20 nt, Human
gauaaucuagccgagaagga

SEQ ID NO: 305250 - RNA, 18 nt, Human
gaugaaaaagggaggcag

SEQ ID NO: 305251 - RNA, 24 nt, Human
gauuucuccugcuguguuugugug

SEQ ID NO: 305252 - RNA, 23 nt, Human
gcaauccuccugccucagccucc

SEQ ID NO: 305253 - RNA, 19 nt, Human
gcagccaggcuuaggaacc

SEQ ID NO: 305254 - RNA, 19 nt, Human
gcuggaguguaaggacaug

SEQ ID NO: 305255 - RNA, 20 nt, Human
ggaaauggauaaggcaagua

SEQ ID NO: 305256 - RNA, 22 nt, Human
ggagucucacuguguugcccag

SEQ ID NO: 305257 - RNA, 23 nt, Human
ggagucucacuguguugcccagg

SEQ ID NO: 305258 - RNA, 19 nt, Human
ggauaaggcaaguaguguu

SEQ ID NO: 305259 - RNA, 22 nt, Human
gggaggcagggaaaaaggaagg

SEQ ID NO: 305260 - RNA, 22 nt, Human
gggcucaggcaauccuccugcc

SEQ ID NO: 305261 - RNA, 24 nt, Human
guaggaaaagagcuauacuucuga

SEQ ID NO: 305262 - RNA, 22 nt, Human
uaaauaucuucuuccauuaaga

SEQ ID NO: 305263 - RNA, 21 nt, Human
uaacccuggaacaagaccagc

SEQ ID NO: 305264 - RNA, 21 nt, Human
uaacccuggaacaagaccagg

SEQ ID NO: 305265 - RNA, 23 nt, Human
uaagaaaaagaaaaaacuguuca

SEQ ID NO: 305266 - RNA, 20 nt, Human
uaaggagauguuuggaagca

SEQ ID NO: 305267 - RNA, 23 nt, Human
uaaggagauguuuggaagcauca

SEQ ID NO: 305268 - RNA, 21 nt, Human
uaaggcaaguaguguucuucc

SEQ ID NO: 305269 - RNA, 20 nt, Human
uacuagauaacucacucuug

SEQ ID NO: 305270 - RNA, 23 nt, Human
uagcuacagguaauuacaaaaua

SEQ ID NO: 305271 - RNA, 22 nt, Human
uauacaugacaaaagaauugaa

SEQ ID NO: 305272 - RNA, 25 nt, Human
uaugaagccuggcugccgugcccuc

SEQ ID NO: 305273 - RNA, 26 nt, Human
uauuuuauuuuuuugagacagggucu

SEQ ID NO: 305274 - RNA, 18 nt, Human
ucaauaguaagauaguca

SEQ ID NO: 305275 - RNA, 20 nt, Human
uccaaagaauuuccagaagc

SEQ ID NO: 305276 - RNA, 18 nt, Human
uccaaugccacagacaaa

SEQ ID NO: 305277 - RNA, 22 nt, Human
uccacaauacagguuggacuag

SEQ ID NO: 305278 - RNA, 21 nt, Human
uccaggcuggaguguaaggac

SEQ ID NO: 305279 - RNA, 18 nt, Human
ucccuuuuccucccaaaa

SEQ ID NO: 305280 - RNA, 19 nt, Human
ucccuuuuccucccaaaac

SEQ ID NO: 305281 - RNA, 22 nt, Human
ucccuuuuccucccaaaacaaa

SEQ ID NO: 305282 - RNA, 25 nt, Human
uccuccugccucagccuccugagua

SEQ ID NO: 305283 - RNA, 24 nt, Human
uccugaguaccugggacuacaggc

SEQ ID NO: 305284 - RNA, 18 nt, Human
uccugggcucaggcaauc

SEQ ID NO: 305285 - RNA, 22 nt, Human
uccugggcucaggcaauccucc

SEQ ID NO: 305286 - RNA, 24 nt, Human
uccugggcucaggcaauccuccug

SEQ ID NO: 305287 - RNA, 24 nt, Human
ucgcucuguuauccaggcuggagu

SEQ ID NO: 305288 - RNA, 19 nt, Human
ucggugguaguaucaucuc

SEQ ID NO: 305289 - RNA, 22 nt, Human
ucuauugcauuugaaauccaag

SEQ ID NO: 305290 - RNA, 19 nt, Human
ucucacuguguugcccagg

SEQ ID NO: 305291 - RNA, 19 nt, Human
ucucacuguguugcccagg

SEQ ID NO: 305292 - RNA, 25 nt, Human
ucucacuguguugcccaggcugaua

SEQ ID NO: 305293 - RNA, 26 nt, Human
ucucacuguguugcccaggcugauaa

SEQ ID NO: 305294 - RNA, 20 nt, Human
ucuccugcuguguuugugug

SEQ ID NO: 305295 - RNA, 19 nt, Human
ucucgcucuguuauccagg

SEQ ID NO: 305296 - RNA, 23 nt, Human
ucucgcucuguuauccaggcugg

SEQ ID NO: 305297 - RNA, 24 nt, Human
ucucgcucuguuauccaggcugga

SEQ ID NO: 305298 - RNA, 24 nt, Human
ucucugcaguuuccaccuccuggg

SEQ ID NO: 305299 - RNA, 21 nt, Human
ucugcaguuuccaccuccugg

SEQ ID NO: 305300 - RNA, 24 nt, Human
ucuguuauccaggcuggaguguaa

SEQ ID NO: 305301 - RNA, 21 nt, Human
ugaagauuucacaagucugua

SEQ ID NO: 305302 - RNA, 22 nt, Human
ugagacagggucucgcucuguu

SEQ ID NO: 305303 - RNA, 21 nt, Human
ugaggaacacaaagauaacca

SEQ ID NO: 305304 - RNA, 27 nt, Human
ugcacacauuaaaaaaaaaaaaaaaaa

SEQ ID NO: 305305 - RNA, 24 nt, Human
ugccucagccuccugaguaccugg

SEQ ID NO: 305306 - RNA, 18 nt, Human
ugccuccuuuaauaagau

SEQ ID NO: 305307 - RNA, 19 nt, Human
uggaagcaucauuuaagga

SEQ ID NO: 305308 - RNA, 21 nt, Human
uggaagcaucauuuaaggaau

SEQ ID NO: 305309 - RNA, 22 nt, Human
uggacuagacaaugaaacacag

SEQ ID NO: 305310 - RNA, 24 nt, Human
uggagucucacuguguugcccagg

SEQ ID NO: 305311 - RNA, 21 nt, Human
ugggacuacaggcacauacca

SEQ ID NO: 305312 - RNA, 22 nt, Human
ugggacuacaggcacauaccac

SEQ ID NO: 305313 - RNA, 22 nt, Human
ugggacuacaggcacauaccac

SEQ ID NO: 305314 - RNA, 24 nt, Human
ugggacuacaggcacauaccacua

SEQ ID NO: 305315 - RNA, 26 nt, Human
ugggacuacaggcacauaccacuaua

SEQ ID NO: 305316 - RNA, 24 nt, Human
ugggcucaggcaauccuccugccu

SEQ ID NO: 305317 - RNA, 21 nt, Human
uguguugcccaggcugauaag

SEQ ID NO: 305318 - RNA, 23 nt, Human
uuaaaaaaaaaaaaaaaaagaaa

SEQ ID NO: 305319 - RNA, 24 nt, Human
uuaauggucucucuaagguuaaac

SEQ ID NO: 305320 - RNA, 25 nt, Human
uuagcacaccacuaacaccugcaga

SEQ ID NO: 305321 - RNA, 18 nt, Human
uucagguaggaaaagagc

SEQ ID NO: 305322 - RNA, 22 nt, Human
uucauauuuucuagaaugccuc

SEQ ID NO: 305323 - RNA, 22 nt, Human
uugagacagggucucgcucugu

SEQ ID NO: 305324 - RNA, 23 nt, Human
uugcccaggcugauaagaguguu

SEQ ID NO: 305325 - RNA, 19 nt, Human
uugccggaacguuguagau

SEQ ID NO: 305326 - RNA, 23 nt, Human
uuuaagagauggagucucacugu

SEQ ID NO: 305327 - RNA, 26 nt, Human
uuuccucccaaaacaaaaacaaaaau

SEQ ID NO: 305328 - RNA, 28 nt, Human
uuuuauuuuauuuuuuugagacaggguc

SEQ ID NO: 305329 - RNA, 21 nt, Human
uuuuauuuuuuugagacaggg

SEQ ID NO: 305330 - RNA, 19 nt, Human
uuuuuuugagacagggucu

SEQ ID NO: 305331 - RNA, 18 nt, Human
aaaacaguccaaaaaaaa

SEQ ID NO: 305332 - RNA, 24 nt, Human
aaagaaaaaaagaaaaagaaggga

SEQ ID NO: 305333 - RNA, 19 nt, Human
aacaaaaauccgggacaac

SEQ ID NO: 305334 - RNA, 21 nt, Human
aacaaaacaguccaaaaaaaa

SEQ ID NO: 305335 - RNA, 24 nt, Human
aacaaaacaguccaaaaaaaaucu

SEQ ID NO: 305336 - RNA, 20 nt, Human
aagaaaaaaagaaaaagaag

SEQ ID NO: 305337 - RNA, 24 nt, Human
aagaaaaaaagaaaaagaagggau

SEQ ID NO: 305338 - RNA, 26 nt, Human
aaugucauuuuaaguccuguuuucca

SEQ ID NO: 305339 - RNA, 22 nt, Human
aauuaaaccaaagaaaaaaaga

SEQ ID NO: 305340 - RNA, 26 nt, Human
acaaaacaguccaaaaaaaaucuguu

SEQ ID NO: 305341 - RNA, 25 nt, Human
acugacauucucccaaagcgucccu

SEQ ID NO: 305342 - RNA, 19 nt, Human
agaaaaaaagaaaaagaag

SEQ ID NO: 305343 - RNA, 19 nt, Human
agaaagcucuagucccauc

SEQ ID NO: 305344 - RNA, 18 nt, Human
agaggccucaggguggcu

SEQ ID NO: 305345 - RNA, 19 nt, Human
agcccuuugcuuuccagag

SEQ ID NO: 305346 - RNA, 23 nt, Human
agcugguaaagcuucagaaagca

SEQ ID NO: 305347 - RNA, 20 nt, Human
agucauccaauauuauguac

SEQ ID NO: 305348 - RNA, 23 nt, Human
agucccauccaaagaaagauggc

SEQ ID NO: 305349 - RNA, 21 nt, Human
auugaauaaagcagcuuugaa

SEQ ID NO: 305350 - RNA, 23 nt, Human
caaaacaaaacagaagcuauuug

SEQ ID NO: 305351 - RNA, 19 nt, Human
caaagaaaaaaagaaaaag

SEQ ID NO: 305352 - RNA, 26 nt, Human
caagcaacaaaaacugggguggggaa

SEQ ID NO: 305353 - RNA, 20 nt, Human
cacagcaacauccaggcuaa

SEQ ID NO: 305354 - RNA, 24 nt, Human
cagcucaauucacagaucagacug

SEQ ID NO: 305355 - RNA, 20 nt, Human
cagcuuaggaacgugugguc

SEQ ID NO: 305356 - RNA, 19 nt, Human
caggguucuucugccucuc

SEQ ID NO: 305357 - RNA, 22 nt, Human
caucauacagccuuaggcugca

SEQ ID NO: 305358 - RNA, 22 nt, Human
ccaaagaaaaaaagaaaaagaa

SEQ ID NO: 305359 - RNA, 22 nt, Human
ccgcucuccagagucccaacuu

SEQ ID NO: 305360 - RNA, 30 nt, Human
cgggacaacaauauuuucaagcaacaaaag

SEQ ID NO: 305361 - RNA, 18 nt, Human
cucuuuguguuguaugug

SEQ ID NO: 305362 - RNA, 19 nt, Human
cuggguuuuuguuuuuuga

SEQ ID NO: 305363 - RNA, 24 nt, Human
cuuuaaauuaaaccaaagaaaaaa

SEQ ID NO: 305364 - RNA, 20 nt, Human
gaaagaaagcucuaguccca

SEQ ID NO: 305365 - RNA, 21 nt, Human
gcuggaccaaaccuucucagg

SEQ ID NO: 305366 - RNA, 19 nt, Human
gucauuuuaaguccuguuu

SEQ ID NO: 305367 - RNA, 19 nt, Human
guccaaaaaaaaucuguua

SEQ ID NO: 305368 - RNA, 22 nt, Human
gugaaagaaagcucuaguccca

SEQ ID NO: 305369 - RNA, 21 nt, Human
guuucugcagcucaauucaca

SEQ ID NO: 305370 - RNA, 21 nt, Human
uauugaauaaagcagcuuuga

SEQ ID NO: 305371 - RNA, 21 nt, Human
ucagaaagcauuaacaagcac

SEQ ID NO: 305372 - RNA, 21 nt, Human
ucagcaaaacaaaacagaagc

SEQ ID NO: 305373 - RNA, 18 nt, Human
ucaggccaggguucuucu

SEQ ID NO: 305374 - RNA, 22 nt, Human
uccacagugcgaugugucuggg

SEQ ID NO: 305375 - RNA, 18 nt, Human
uccagagucccaacuuuc

SEQ ID NO: 305376 - RNA, 21 nt, Human
ucccauccaaagaaagauggc

SEQ ID NO: 305377 - RNA, 24 nt, Human
ucccugcacgcagagauuuuugca

SEQ ID NO: 305378 - RNA, 21 nt, Human
uccgggacaacaauauuuuca

SEQ ID NO: 305379 - RNA, 22 nt, Human
uccuccgcucuccagaguccca

SEQ ID NO: 305380 - RNA, 25 nt, Human
ucugccucucucuccuccgcucucc

SEQ ID NO: 305381 - RNA, 20 nt, Human
ucuguugcuggguuuuuguu

SEQ ID NO: 305382 - RNA, 21 nt, Human
ucuuccccuacuucuuuuuuu

SEQ ID NO: 305383 - RNA, 22 nt, Human
ugaaagaaagcucuagucccau

SEQ ID NO: 305384 - RNA, 22 nt, Human
ugacagaauuucuucugaacau

SEQ ID NO: 305385 - RNA, 24 nt, Human
uguuaugaacuuuuuaaccuuggg

SEQ ID NO: 305386 - RNA, 21 nt, Human
uuacuuuuaaaaaaggauaac

SEQ ID NO: 305387 - RNA, 21 nt, Human
uuagccuucagcaaaacaaaa

SEQ ID NO: 305388 - RNA, 18 nt, Human
uucaggagaaggaucaag

SEQ ID NO: 305389 - RNA, 24 nt, Human
uucuucugaacauacaugaacugg

SEQ ID NO: 305390 - RNA, 23 nt, Human
uuuauugaauaaagcagcuuuga

SEQ ID NO: 305391 - RNA, 21 nt, Human
uuuucaagcaacaaaaacugg

SEQ ID NO: 305392 - RNA, 23 nt, Human
uuuucuguugcuggguuuuuguu

SEQ ID NO: 305393 - RNA, 19 nt, Human
uuuuuuuuuuuuacuggca

SEQ ID NO: 305394 - RNA, 24 nt, Human
aaagauccgcccgucuuggccucc

SEQ ID NO: 305395 - RNA, 24 nt, Human
aaagugcugggauuacaggcauga

SEQ ID NO: 305396 - RNA, 21 nt, Human
aacaagagccagagccggaga

SEQ ID NO: 305397 - RNA, 19 nt, Human
aagaaagacagagaaaagg

SEQ ID NO: 305398 - RNA, 21 nt, Human
aagagaaagagggugagagaa

SEQ ID NO: 305399 - RNA, 19 nt, Human
aagugcugggauuacaggc

SEQ ID NO: 305400 - RNA, 21 nt, Human
aagugcugggauuacaggcau

SEQ ID NO: 305401 - RNA, 26 nt, Human
aagugcugggauuacaggcaugagcc

SEQ ID NO: 305402 - RNA, 23 nt, Human
aaguuggagucuguggggcgggu

SEQ ID NO: 305403 - RNA, 18 nt, Human
acaggcgaccacaggggc

SEQ ID NO: 305404 - RNA, 21 nt, Human
acccccaacauggagagagac

SEQ ID NO: 305405 - RNA, 21 nt, Human
accucuaucuccagcagucac

SEQ ID NO: 305406 - RNA, 22 nt, Human
acgggcccaggggcggcucugc

SEQ ID NO: 305407 - RNA, 26 nt, Human
agacaggggccaagaaagacagagaa

SEQ ID NO: 305408 - RNA, 23 nt, Human
agagaaccccaaacaagagccag

SEQ ID NO: 305409 - RNA, 18 nt, Human
agagggagaucuggagaa

SEQ ID NO: 305410 - RNA, 20 nt, Human
aggcaugagccaccgugccu

SEQ ID NO: 305411 - RNA, 23 nt, Human
aggcaugagccaccgugccuggc

SEQ ID NO: 305412 - RNA, 19 nt, Human
auccgcccgucuuggccuc

SEQ ID NO: 305413 - RNA, 24 nt, Human
auuuuaguagaugcgggguuuugc

SEQ ID NO: 305414 - RNA, 24 nt, Human
caaagugcugggauuacaggcaug

SEQ ID NO: 305415 - RNA, 18 nt, Human
caagagccagagccggag

SEQ ID NO: 305416 - RNA, 22 nt, Human
cagagugaaguuccuuccugcc

SEQ ID NO: 305417 - RNA, 23 nt, Human
cagcagagugaaguuccuuccug

SEQ ID NO: 305418 - RNA, 19 nt, Human
caggggccaagaaagacag

SEQ ID NO: 305419 - RNA, 26 nt, Human
caggggccaagaaagacagagaaaag

SEQ ID NO: 305420 - RNA, 21 nt, Human
cauggagagagacaggggcca

SEQ ID NO: 305421 - RNA, 23 nt, Human
ccaaagugcugggauuacaggca

SEQ ID NO: 305422 - RNA, 24 nt, Human
ccaaagugcugggauuacaggcau

SEQ ID NO: 305423 - RNA, 20 nt, Human
ccaagaaagacagagaaaaa

SEQ ID NO: 305424 - RNA, 23 nt, Human
ccacuggccccauugguugaagc

SEQ ID NO: 305425 - RNA, 20 nt, Human
ccaggcuggccuccaacucc

SEQ ID NO: 305426 - RNA, 22 nt, Human
ccauuuuggccaggcuggccuc

SEQ ID NO: 305427 - RNA, 24 nt, Human
cccaaagugcugggauuacaggca

SEQ ID NO: 305428 - RNA, 20 nt, Human
cccccuugugggguaacccg

SEQ ID NO: 305429 - RNA, 26 nt, Human
ccccuggauguggcuggucuuggucc

SEQ ID NO: 305430 - RNA, 22 nt, Human
cccgucuuggccucccaaagug

SEQ ID NO: 305431 - RNA, 22 nt, Human
ccgcuggguuggcuuggggugc

SEQ ID NO: 305432 - RNA, 18 nt, Human
ccggagaaaugaggaccc

SEQ ID NO: 305433 - RNA, 25 nt, Human
ccugcccugaccccaggucuauggc

SEQ ID NO: 305434 - RNA, 19 nt, Human
cgcagcccaggggcccucu

SEQ ID NO: 305435 - RNA, 19 nt, Human
cggccgagguucucggaag

SEQ ID NO: 305436 - RNA, 23 nt, Human
cgggguuuugccauuuuggccag

SEQ ID NO: 305437 - RNA, 24 nt, Human
cgggguuuugccauuuuggccagg

SEQ ID NO: 305438 - RNA, 23 nt, Human
cgugagugggguggggucuggau

SEQ ID NO: 305439 - RNA, 26 nt, Human
cucccgaccucaaaagauccgcccgu

SEQ ID NO: 305440 - RNA, 18 nt, Human
cuccggcgcagacgggcc

SEQ ID NO: 305441 - RNA, 19 nt, Human
cucgcagcggcccccuugu

SEQ ID NO: 305442 - RNA, 22 nt, Human
cuucucgcagcggcccccuugu

SEQ ID NO: 305443 - RNA, 23 nt, Human
gaaguuccuuccugcccugaccc

SEQ ID NO: 305444 - RNA, 18 nt, Human
gaaugggggagggaagga

SEQ ID NO: 305445 - RNA, 23 nt, Human
gaccucaaaagauccgcccgucu

SEQ ID NO: 305446 - RNA, 22 nt, Human
gagaaccccaaacaagagccag

SEQ ID NO: 305447 - RNA, 19 nt, Human
gagaaugggggagggaagg

SEQ ID NO: 305448 - RNA, 18 nt, Human
gagagaaccccaaacaag

SEQ ID NO: 305449 - RNA, 23 nt, Human
gagagagacaggggccaagaaag

SEQ ID NO: 305450 - RNA, 24 nt, Human
gagccagagccggagaaaugagga

SEQ ID NO: 305451 - RNA, 18 nt, Human
gauuacaggcaugagcca

SEQ ID NO: 305452 - RNA, 21 nt, Human
gauuacaggcaugagccaccg

SEQ ID NO: 305453 - RNA, 24 nt, Human
gauuacaggcaugagccaccgugc

SEQ ID NO: 305454 - RNA, 23 nt, Human
gcccaggggcccucuguaaacau

SEQ ID NO: 305455 - RNA, 21 nt, Human
gcccaggggcggcucugcuug

SEQ ID NO: 305456 - RNA, 22 nt, Human
gcgcagcccaggggcccucugu

SEQ ID NO: 305457 - RNA, 24 nt, Human
gcgcagcccaggggcccucuguaa

SEQ ID NO: 305458 - RNA, 20 nt, Human
gcgggguuuugccauuuugg

SEQ ID NO: 305459 - RNA, 24 nt, Human
gcgggguuuugccauuuuggccag

SEQ ID NO: 305460 - RNA, 23 nt, Human
gcuggccuccaacucccgaccuc

SEQ ID NO: 305461 - RNA, 20 nt, Human
gcuuggagccccacuggccc

SEQ ID NO: 305462 - RNA, 20 nt, Human
gcuuggggcggguccucggu

SEQ ID NO: 305463 - RNA, 19 nt, Human
ggaaggaaagagaaagagg

SEQ ID NO: 305464 - RNA, 26 nt, Human
ggagacagagggagaucuggagaaug

SEQ ID NO: 305465 - RNA, 20 nt, Human
ggaggacacguagauauggg

SEQ ID NO: 305466 - RNA, 24 nt, Human
ggauuacaggcaugagccaccgug

SEQ ID NO: 305467 - RNA, 20 nt, Human
ggcagggcagagggucaggg

SEQ ID NO: 305468 - RNA, 19 nt, Human
ggcaggugcagccagaagg

SEQ ID NO: 305469 - RNA, 22 nt, Human
ggccgcgcagcccaggggcccu

SEQ ID NO: 305470 - RNA, 20 nt, Human
ggcugggaggguccgcuggg

SEQ ID NO: 305471 - RNA, 18 nt, Human
gggaaggaaagagaaaga

SEQ ID NO: 305472 - RNA, 21 nt, Human
gggaggguccgcuggguuggc

SEQ ID NO: 305473 - RNA, 23 nt, Human
gggcugggaggguccgcuggguu

SEQ ID NO: 305474 - RNA, 20 nt, Human
ggggcccucuguaaacaugg

SEQ ID NO: 305475 - RNA, 21 nt, Human
gggggaccugcggugggcagg

SEQ ID NO: 305476 - RNA, 23 nt, Human
gggguuuugccauuuuggccagg

SEQ ID NO: 305477 - RNA, 21 nt, Human
gguugaagcagggcugggagg

SEQ ID NO: 305478 - RNA, 21 nt, Human
guuaggacccccaacauggag

SEQ ID NO: 305479 - RNA, 21 nt, Human
uaauuuuuguauuuuaguaga

SEQ ID NO: 305480 - RNA, 22 nt, Human
uacaggcaugagccaccgugcc

SEQ ID NO: 305481 - RNA, 20 nt, Human
uaggacccccaacauggaga

SEQ ID NO: 305482 - RNA, 23 nt, Human
uaguagaugcgggguuuugccau

SEQ ID NO: 305483 - RNA, 28 nt, Human
ucacuggguccaccauucgucagcuggu

SEQ ID NO: 305484 - RNA, 24 nt, Human
ucccaaagugcugggauuacaggc

SEQ ID NO: 305485 - RNA, 19 nt, Human
uccgggaccccgggggacc

SEQ ID NO: 305486 - RNA, 24 nt, Human
ucuguaaacauggcaggugcagcc

SEQ ID NO: 305487 - RNA, 20 nt, Human
ucuuggccucccaaagugcu

SEQ ID NO: 305488 - RNA, 19 nt, Human
ugagugggguggggucugg

SEQ ID NO: 305489 - RNA, 24 nt, Human
ugccauuuuggccaggcuggccuc

SEQ ID NO: 305490 - RNA, 23 nt, Human
ugcccaggcuggggccgcgcagc

SEQ ID NO: 305491 - RNA, 23 nt, Human
ugcccugaccccaggucuauggc

SEQ ID NO: 305492 - RNA, 25 nt, Human
ugcccugaccccaggucuauggcuu

SEQ ID NO: 305493 - RNA, 22 nt, Human
ugcggugggcagggcagagggu

SEQ ID NO: 305494 - RNA, 20 nt, Human
uggccaggcuggccuccaac

SEQ ID NO: 305495 - RNA, 21 nt, Human
uggccaggcuggccuccaacu

SEQ ID NO: 305496 - RNA, 19 nt, Human
uggccuccaacucccgacc

SEQ ID NO: 305497 - RNA, 20 nt, Human
uggccuccaacucccgaccu

SEQ ID NO: 305498 - RNA, 18 nt, Human
uggccucccaaagugcug

SEQ ID NO: 305499 - RNA, 20 nt, Human
ugggaggguccgcuggguug

SEQ ID NO: 305500 - RNA, 21 nt, Human
ugggaggguccgcuggguugg

SEQ ID NO: 305501 - RNA, 22 nt, Human
ugggaggguccgcuggguuggc

SEQ ID NO: 305502 - RNA, 18 nt, Human
ugggauuacaggcaugag

SEQ ID NO: 305503 - RNA, 21 nt, Human
ugggauuacaggcaugagcca

SEQ ID NO: 305504 - RNA, 22 nt, Human
ugggauuacaggcaugagccac

SEQ ID NO: 305505 - RNA, 23 nt, Human
ugggauuacaggcaugagccacc

SEQ ID NO: 305506 - RNA, 23 nt, Human
ugggauuacaggcaugagccacc

SEQ ID NO: 305507 - RNA, 24 nt, Human
ugggauuacaggcaugagccaccg

SEQ ID NO: 305508 - RNA, 22 nt, Human
uggggugggggaguuaggaccc

SEQ ID NO: 305509 - RNA, 18 nt, Human
uuagguuggcugcuugga

SEQ ID NO: 305510 - RNA, 24 nt, Human
uuaguagaugcgggguuuugccau

SEQ ID NO: 305511 - RNA, 19 nt, Human
uuccaugacccuuacaagg

SEQ ID NO: 305512 - RNA, 21 nt, Human
uuccugcccugaccccagguc

SEQ ID NO: 305513 - RNA, 18 nt, Human
uugaagcagggcugggag

SEQ ID NO: 305514 - RNA, 19 nt, Human
uugaagcagggcugggagg

SEQ ID NO: 305515 - RNA, 20 nt, Human
uuuuuguauuuuaguagaug

SEQ ID NO: 305516 - RNA, 21 nt, Human
aaaaaaaugccagagaaccac

SEQ ID NO: 305517 - RNA, 21 nt, Human
aaaaaccccaaugaaacagac

SEQ ID NO: 305518 - RNA, 21 nt, Human
aaaaagaaugcuauuccucau

SEQ ID NO: 305519 - RNA, 21 nt, Human
aaaaagcagcccuucuccaca

SEQ ID NO: 305520 - RNA, 25 nt, Human
aaaaagccaaagagaagcaguggga

SEQ ID NO: 305521 - RNA, 23 nt, Human
aaaagacacucagaacacacuga

SEQ ID NO: 305522 - RNA, 23 nt, Human
aaaagcuuccagauggcuucuac

SEQ ID NO: 305523 - RNA, 26 nt, Human
aaaauccuuucuacacagucgcucuu

SEQ ID NO: 305524 - RNA, 18 nt, Human
aaagaccaauaaguaucu

SEQ ID NO: 305525 - RNA, 23 nt, Human
aaagcucaccauccccacaaaaa

SEQ ID NO: 305526 - RNA, 18 nt, Human
aaauacaaccccacccgc

SEQ ID NO: 305527 - RNA, 20 nt, Human
aaauacaaccccacccgcua

SEQ ID NO: 305528 - RNA, 18 nt, Human
aacaaaaugcccccgaac

SEQ ID NO: 305529 - RNA, 21 nt, Human
aacaaugaauucaagaaugaa

SEQ ID NO: 305530 - RNA, 18 nt, Human
aacaggguccucccccuc

SEQ ID NO: 305531 - RNA, 19 nt, Human
aaccaacccgaccgcacca

SEQ ID NO: 305532 - RNA, 23 nt, Human
aaccaacccgaccgcaccaacug

SEQ ID NO: 305533 - RNA, 18 nt, Human
aaccgaagcugccgcagc

SEQ ID NO: 305534 - RNA, 20 nt, Human
aacugcccucaagcucugcc

SEQ ID NO: 305535 - RNA, 24 nt, Human
aagaggaaaaaaaagaacacguug

SEQ ID NO: 305536 - RNA, 18 nt, Human
aagaugcagguacuggcu

SEQ ID NO: 305537 - RNA, 21 nt, Human
aaggagcagacacauuacuga

SEQ ID NO: 305538 - RNA, 20 nt, Human
aaucauggcgugccaucuag

SEQ ID NO: 305539 - RNA, 20 nt, Human
acaaaaaccccaaugaaaca

SEQ ID NO: 305540 - RNA, 18 nt, Human
acaacaaaaugcccccga

SEQ ID NO: 305541 - RNA, 24 nt, Human
acaacagaauagauuuuucacaag

SEQ ID NO: 305542 - RNA, 23 nt, Human
acaacucccagcagagccaugcc

SEQ ID NO: 305543 - RNA, 21 nt, Human
acaccaggcccaguggguagu

SEQ ID NO: 305544 - RNA, 23 nt, Human
acagaacacaacaaaaugccccc

SEQ ID NO: 305545 - RNA, 24 nt, Human
acagaacacaacaaaaugcccccg

SEQ ID NO: 305546 - RNA, 21 nt, Human
agaaaagcucccaccgccucc

SEQ ID NO: 305547 - RNA, 21 nt, Human
agacuggucccuaugccauuu

SEQ ID NO: 305548 - RNA, 19 nt, Human
agcauccaccugcuucagc

SEQ ID NO: 305549 - RNA, 18 nt, Human
agccagggugccugacug

SEQ ID NO: 305550 - RNA, 24 nt, Human
agccucacagaggccuacucuggg

SEQ ID NO: 305551 - RNA, 22 nt, Human
aggaaaaaaaagaacacguugg

SEQ ID NO: 305552 - RNA, 20 nt, Human
aggaaacaccauacaagcac

SEQ ID NO: 305553 - RNA, 22 nt, Human
aggaaacaccauacaagcacca

SEQ ID NO: 305554 - RNA, 18 nt, Human
aggcaaaaaagggggcug

SEQ ID NO: 305555 - RNA, 18 nt, Human
aggcaaagagaaaagcuu

SEQ ID NO: 305556 - RNA, 22 nt, Human
aggcaggaaggacagaagggac

SEQ ID NO: 305557 - RNA, 18 nt, Human
aggccucuaaugccccca

SEQ ID NO: 305558 - RNA, 21 nt, Human
aggcuuccaaauacaaccccu

SEQ ID NO: 305559 - RNA, 23 nt, Human
agggagaaugaagaggaaaaaaa

SEQ ID NO: 305560 - RNA, 23 nt, Human
aguaccaguccggccaaacuacc

SEQ ID NO: 305561 - RNA, 24 nt, Human
aguaccaguccggccaaacuaccc

SEQ ID NO: 305562 - RNA, 22 nt, Human
agugacaaaggaaggcaaaaaa

SEQ ID NO: 305563 - RNA, 24 nt, Human
auaaaaacuguagaaaaaaaugcc

SEQ ID NO: 305564 - RNA, 23 nt, Human
auaaagaugguacuuggucucuc

SEQ ID NO: 305565 - RNA, 22 nt, Human
aucugacuccccuccuuagcaa

SEQ ID NO: 305566 - RNA, 19 nt, Human
auuuuaugauucaaagcuc

SEQ ID NO: 305567 - RNA, 27 nt, Human
caaaaaagagacccguggaagacacau

SEQ ID NO: 305568 - RNA, 20 nt, Human
caaaaaccccaaugaaacag

SEQ ID NO: 305569 - RNA, 21 nt, Human
caaaaaccccaaugaaacaga

SEQ ID NO: 305570 - RNA, 21 nt, Human
caaaaagaaugcuauuccuca

SEQ ID NO: 305571 - RNA, 23 nt, Human
caaaacaaaaaccccaaugaaac

SEQ ID NO: 305572 - RNA, 22 nt, Human
caaaaugcccccgaacuuucaa

SEQ ID NO: 305573 - RNA, 20 nt, Human
caaagcaaaacacaacuccc

SEQ ID NO: 305574 - RNA, 26 nt, Human
caaagcucaccauccccacaaaaaga

SEQ ID NO: 305575 - RNA, 20 nt, Human
caaauacaaccccacccgcu

SEQ ID NO: 305576 - RNA, 22 nt, Human
caacuacauuaugaacuguccc

SEQ ID NO: 305577 - RNA, 20 nt, Human
caacugcccucaagcucugc

SEQ ID NO: 305578 - RNA, 22 nt, Human
caagacagucccaggguccaga

SEQ ID NO: 305579 - RNA, 22 nt, Human
caagccuaauauucuguugagg

SEQ ID NO: 305580 - RNA, 23 nt, Human
caaguggcuggagcuaaagcagg

SEQ ID NO: 305581 - RNA, 20 nt, Human
caaucugacuccccuccuua

SEQ ID NO: 305582 - RNA, 18 nt, Human
cacaaaaaaaggcaaaga

SEQ ID NO: 305583 - RNA, 26 nt, Human
cacaaaaucacuucuugugcaaaaca

SEQ ID NO: 305584 - RNA, 27 nt, Human
caccuuagaaaacaggaauugcccagg

SEQ ID NO: 305585 - RNA, 20 nt, Human
caccuugcuacccucucccc

SEQ ID NO: 305586 - RNA, 20 nt, Human
cacguugggagaaacccggg

SEQ ID NO: 305587 - RNA, 18 nt, Human
cacugaaauuuuaguacc

SEQ ID NO: 305588 - RNA, 21 nt, Human
cacuuuuguguccuucgaagg

SEQ ID NO: 305589 - RNA, 22 nt, Human
cagaacacaacaaaaugccccc

SEQ ID NO: 305590 - RNA, 23 nt, Human
cagaacacaacaaaaugcccccg

SEQ ID NO: 305591 - RNA, 24 nt, Human
cagaagauuccuggccuaaaauca

SEQ ID NO: 305592 - RNA, 19 nt, Human
cagcuggacucuauuuguc

SEQ ID NO: 305593 - RNA, 21 nt, Human
caggagauauauagaaggcau

SEQ ID NO: 305594 - RNA, 26 nt, Human
caguuuaagagaacacauggggcuga

SEQ ID NO: 305595 - RNA, 18 nt, Human
caugaugggggcaggaau

SEQ ID NO: 305596 - RNA, 23 nt, Human
cauugaaacugcaguuaagaugc

SEQ ID NO: 305597 - RNA, 19 nt, Human
cauugcaccuuuucuuuac

SEQ ID NO: 305598 - RNA, 20 nt, Human
cauuggucuggcaacaaacu

SEQ ID NO: 305599 - RNA, 23 nt, Human
cauuuuccuuugguugucuuuuu

SEQ ID NO: 305600 - RNA, 19 nt, Human
ccaaaaccccauccagcaa

SEQ ID NO: 305601 - RNA, 19 nt, Human
ccaauccugaaacugcagu

SEQ ID NO: 305602 - RNA, 20 nt, Human
ccaggguccagaucauggga

SEQ ID NO: 305603 - RNA, 19 nt, Human
ccaguaccaguccggccaa

SEQ ID NO: 305604 - RNA, 19 nt, Human
ccaguccggccaaacuacc

SEQ ID NO: 305605 - RNA, 23 nt, Human
ccauccccacaaaaagaaugcua

SEQ ID NO: 305606 - RNA, 21 nt, Human
ccaucccggccggcugcugcu

SEQ ID NO: 305607 - RNA, 21 nt, Human
cccaaaaccccauccagcaaa

SEQ ID NO: 305608 - RNA, 21 nt, Human
cccaggguccagaucauggga

SEQ ID NO: 305609 - RNA, 21 nt, Human
cccaggugcaauucucaguuu

SEQ ID NO: 305610 - RNA, 24 nt, Human
cccauucuaucacaaaaccuaaac

SEQ ID NO: 305611 - RNA, 23 nt, Human
ccccagaggccgggacucgggcu

SEQ ID NO: 305612 - RNA, 24 nt, Human
cccccagaacuagagcuuuccuag

SEQ ID NO: 305613 - RNA, 18 nt, Human
cccccuacccuccccaac

SEQ ID NO: 305614 - RNA, 22 nt, Human
ccccucuacacaccaggcccag

SEQ ID NO: 305615 - RNA, 19 nt, Human
cccgaccgcaccaacugcc

SEQ ID NO: 305616 - RNA, 25 nt, Human
cccuacccuccccaacaauugcaca

SEQ ID NO: 305617 - RNA, 20 nt, Human
cccuaucuggacccucuggu

SEQ ID NO: 305618 - RNA, 26 nt, Human
cccucaagcucugcccggacuccagc

SEQ ID NO: 305619 - RNA, 18 nt, Human
cccucugguuucugaggc

SEQ ID NO: 305620 - RNA, 18 nt, Human
cccuggaccacagggccc

SEQ ID NO: 305621 - RNA, 18 nt, Human
cccuggaccacagggccc

SEQ ID NO: 305622 - RNA, 22 nt, Human
cccuggaccacagggccccugg

SEQ ID NO: 305623 - RNA, 20 nt, Human
ccgaacaggguccucccccu

SEQ ID NO: 305624 - RNA, 23 nt, Human
ccgaacaggguccucccccucuc

SEQ ID NO: 305625 - RNA, 18 nt, Human
ccggccggagaaguccag

SEQ ID NO: 305626 - RNA, 21 nt, Human
ccgggacucgggcuccucucc

SEQ ID NO: 305627 - RNA, 23 nt, Human
ccuaaaaucaaggccacuggagc

SEQ ID NO: 305628 - RNA, 21 nt, Human
ccuauagcucccaaaacccca

SEQ ID NO: 305629 - RNA, 19 nt, Human
ccucaggccucuaaugccc

SEQ ID NO: 305630 - RNA, 19 nt, Human
ccucucgccuuucccccua

SEQ ID NO: 305631 - RNA, 21 nt, Human
ccugcaaaagcuucagaaacc

SEQ ID NO: 305632 - RNA, 21 nt, Human
ccuggccuaaaaucaaggcca

SEQ ID NO: 305633 - RNA, 19 nt, Human
ccuuucccccuacccuccc

SEQ ID NO: 305634 - RNA, 19 nt, Human
ccuuugguugucuuuuuca

SEQ ID NO: 305635 - RNA, 20 nt, Human
cgcagccucgggaauggggc

SEQ ID NO: 305636 - RNA, 22 nt, Human
cggcaccaaagucacaugcugg

SEQ ID NO: 305637 - RNA, 20 nt, Human
cgggcaagugacaaaggaag

SEQ ID NO: 305638 - RNA, 21 nt, Human
cgggcaagugacaaaggaagg

SEQ ID NO: 305639 - RNA, 22 nt, Human
cuaaaaauauauaucugcaaaa

SEQ ID NO: 305640 - RNA, 22 nt, Human
cuaaaaucaaggccacuggagc

SEQ ID NO: 305641 - RNA, 22 nt, Human
cuacccucucccccucuacaca

SEQ ID NO: 305642 - RNA, 18 nt, Human
cuaugggcuuuucuccuc

SEQ ID NO: 305643 - RNA, 21 nt, Human
cucaccauccccacaaaaaga

SEQ ID NO: 305644 - RNA, 21 nt, Human
cucacccaauccugaaacugc

SEQ ID NO: 305645 - RNA, 25 nt, Human
cucaggccucuaaugcccccauccc

SEQ ID NO: 305646 - RNA, 23 nt, Human
cucaugaaggaggccaagaccug

SEQ ID NO: 305647 - RNA, 19 nt, Human
cucauugaaacugcaguua

SEQ ID NO: 305648 - RNA, 20 nt, Human
cucccaaaaccccauccagc

SEQ ID NO: 305649 - RNA, 23 nt, Human
cucccaaaaccccauccagcaaa

SEQ ID NO: 305650 - RNA, 21 nt, Human
cucucccugcaaaagcuucag

SEQ ID NO: 305651 - RNA, 21 nt, Human
cugcaguuaagaugccaagac

SEQ ID NO: 305652 - RNA, 20 nt, Human
cugcccccacuccauuugcc

SEQ ID NO: 305653 - RNA, 21 nt, Human
cugcccccacuccauuugccu

SEQ ID NO: 305654 - RNA, 22 nt, Human
cugcucccaagucaugggcgua

SEQ ID NO: 305655 - RNA, 25 nt, Human
cuggcuaaacaaaacaaaaacccca

SEQ ID NO: 305656 - RNA, 21 nt, Human
cugggcgcucccgccggggug

SEQ ID NO: 305657 - RNA, 20 nt, Human
cuucuccacaagccagccca

SEQ ID NO: 305658 - RNA, 22 nt, Human
cuugagcauccaccugcuucag

SEQ ID NO: 305659 - RNA, 24 nt, Human
cuugagcauccaccugcuucagca

SEQ ID NO: 305660 - RNA, 21 nt, Human
gaagaggaaaaaaaagaacac

SEQ ID NO: 305661 - RNA, 19 nt, Human
gaagauuccuggccuaaaa

SEQ ID NO: 305662 - RNA, 18 nt, Human
gacugaaaaaaagcagcc

SEQ ID NO: 305663 - RNA, 21 nt, Human
gacugccaaagcaaaacacaa

SEQ ID NO: 305664 - RNA, 20 nt, Human
gagcaggagggcagacugca

SEQ ID NO: 305665 - RNA, 22 nt, Human
gcaccaacugcccucaagcucu

SEQ ID NO: 305666 - RNA, 26 nt, Human
gcacuagacucucaugaaggaggcca

SEQ ID NO: 305667 - RNA, 22 nt, Human
gcagaagauuccuggccuaaaa

SEQ ID NO: 305668 - RNA, 18 nt, Human
gcagacugcacauagccu

SEQ ID NO: 305669 - RNA, 18 nt, Human
gccacaaguggcuggagc

SEQ ID NO: 305670 - RNA, 19 nt, Human
gccaucuaaaagcacugca

SEQ ID NO: 305671 - RNA, 20 nt, Human
gccaucuaaggccaggugga

SEQ ID NO: 305672 - RNA, 24 nt, Human
gcccucugccucauugaaacugca

SEQ ID NO: 305673 - RNA, 20 nt, Human
gcucccaaaaccccauccag

SEQ ID NO: 305674 - RNA, 18 nt, Human
ggagagggagugaaagug

SEQ ID NO: 305675 - RNA, 21 nt, Human
ggagcuaaagcagguuugagc

SEQ ID NO: 305676 - RNA, 19 nt, Human
ggagggggaaaugaaggga

SEQ ID NO: 305677 - RNA, 24 nt, Human
ggccagacuguccccucuugggga

SEQ ID NO: 305678 - RNA, 18 nt, Human
ggcuuggagagggaguga

SEQ ID NO: 305679 - RNA, 24 nt, Human
gggaagguauuaaacaaaaagacc

SEQ ID NO: 305680 - RNA, 20 nt, Human
ggugugacucucacccugga

SEQ ID NO: 305681 - RNA, 22 nt, Human
guggguaguagacuggucccua

SEQ ID NO: 305682 - RNA, 20 nt, Human
guguggggcaugaugggggc

SEQ ID NO: 305683 - RNA, 18 nt, Human
uaaaaagacauggucucu

SEQ ID NO: 305684 - RNA, 18 nt, Human
uaaagaugguacuugguc

SEQ ID NO: 305685 - RNA, 22 nt, Human
uaaaugaaaucccaagccuccc

SEQ ID NO: 305686 - RNA, 26 nt, Human
uaaccaagaaaaagccaaagagaagc

SEQ ID NO: 305687 - RNA, 23 nt, Human
uacacgaauuuucuuggacacug

SEQ ID NO: 305688 - RNA, 22 nt, Human
uacagaacacaacaaaaugccc

SEQ ID NO: 305689 - RNA, 26 nt, Human
uacagaacacaacaaaaugcccccga

SEQ ID NO: 305690 - RNA, 24 nt, Human
uacuaacagucuaaacacuaagcc

SEQ ID NO: 305691 - RNA, 19 nt, Human
uagaaaacaggaauugccc

SEQ ID NO: 305692 - RNA, 18 nt, Human
uagaaagaaugcccucau

SEQ ID NO: 305693 - RNA, 26 nt, Human
uagcaaccuauagcucccaaaacccc

SEQ ID NO: 305694 - RNA, 20 nt, Human
uagcucccaaaaccccaucc

SEQ ID NO: 305695 - RNA, 20 nt, Human
uaggcuaaggaaacaccaua

SEQ ID NO: 305696 - RNA, 21 nt, Human
uaguuacagugaucaauuuua

SEQ ID NO: 305697 - RNA, 23 nt, Human
uaucacaaaaccuaaacagccuu

SEQ ID NO: 305698 - RNA, 19 nt, Human
uaucuguauuuccauuuug

SEQ ID NO: 305699 - RNA, 19 nt, Human
uauggaagcacauguguaa

SEQ ID NO: 305700 - RNA, 20 nt, Human
uaugggcuuuucuccucaga

SEQ ID NO: 305701 - RNA, 26 nt, Human
uauugcaaugucuuuauugcauuacu

SEQ ID NO: 305702 - RNA, 28 nt, Human
ucaaaaaaaacaucugcuuccagcuuag

SEQ ID NO: 305703 - RNA, 25 nt, Human
ucaaacagcugacucacucugagcc

SEQ ID NO: 305704 - RNA, 23 nt, Human
ucacaaguaacggcaccaaaguc

SEQ ID NO: 305705 - RNA, 18 nt, Human
ucacagaggccuacucug

SEQ ID NO: 305706 - RNA, 18 nt, Human
ucacccccagaacuagag

SEQ ID NO: 305707 - RNA, 22 nt, Human
ucagcagguucaacaccaggug

SEQ ID NO: 305708 - RNA, 19 nt, Human
ucagugcagcggcauggcu

SEQ ID NO: 305709 - RNA, 20 nt, Human
ucagugcagcggcauggcug

SEQ ID NO: 305710 - RNA, 22 nt, Human
ucauggcgugccaucuaaggcc

SEQ ID NO: 305711 - RNA, 18 nt, Human
ucccaucaaacauugguc

SEQ ID NO: 305712 - RNA, 24 nt, Human
ucccccagaggccgggacucgggc

SEQ ID NO: 305713 - RNA, 21 nt, Human
ucccccucuacacaccaggcc

SEQ ID NO: 305714 - RNA, 19 nt, Human
ucccugcaaaagcuucaga

SEQ ID NO: 305715 - RNA, 22 nt, Human
ucccugcaaaagcuucagaaac

SEQ ID NO: 305716 - RNA, 20 nt, Human
ucccuuucuauccucgucac

SEQ ID NO: 305717 - RNA, 19 nt, Human
ucugaggccacugaagccu

SEQ ID NO: 305718 - RNA, 22 nt, Human
ucugcagagagcgaauccccca

SEQ ID NO: 305719 - RNA, 22 nt, Human
ucugcagggccuuuaaacuugg

SEQ ID NO: 305720 - RNA, 22 nt, Human
ucugccucauugaaacugcagu

SEQ ID NO: 305721 - RNA, 24 nt, Human
ucuucagagggaggggcuggugag

SEQ ID NO: 305722 - RNA, 18 nt, Human
ugaaaaaaaaaaugaagg

SEQ ID NO: 305723 - RNA, 24 nt, Human
ugaaaaaaaaaaugaaggaaugua

SEQ ID NO: 305724 - RNA, 19 nt, Human
ugaaaucccaagccucccc

SEQ ID NO: 305725 - RNA, 20 nt, Human
ugacaagaacaauuuguaaa

SEQ ID NO: 305726 - RNA, 18 nt, Human
ugacaguuuggggaaggg

SEQ ID NO: 305727 - RNA, 22 nt, Human
ugaccccugggucuuagauccc

SEQ ID NO: 305728 - RNA, 20 nt, Human
ugacuccccuccuuagcaag

SEQ ID NO: 305729 - RNA, 19 nt, Human
ugaggcaccugaccacaau

SEQ ID NO: 305730 - RNA, 20 nt, Human
ugaggccacugaagccucag

SEQ ID NO: 305731 - RNA, 21 nt, Human
ugcaauucucaguuuaagaga

SEQ ID NO: 305732 - RNA, 19 nt, Human
ugccaaagcaaaacacaac

SEQ ID NO: 305733 - RNA, 20 nt, Human
ugcccccaucccggccggcu

SEQ ID NO: 305734 - RNA, 23 nt, Human
ugcccucaagcucugcccggacu

SEQ ID NO: 305735 - RNA, 18 nt, Human
ugccuagcuucacucagc

SEQ ID NO: 305736 - RNA, 21 nt, Human
ugcucggccucuccacuucac

SEQ ID NO: 305737 - RNA, 24 nt, Human
uggaauuuguaaggaaacgagguu

SEQ ID NO: 305738 - RNA, 20 nt, Human
uggaggucccaucaaggcuu

SEQ ID NO: 305739 - RNA, 21 nt, Human
uggcagcagagggcccaagca

SEQ ID NO: 305740 - RNA, 25 nt, Human
uggccagacuguccccucuugggga

SEQ ID NO: 305741 - RNA, 25 nt, Human
uggcuaaacaaaacaaaaaccccaa

SEQ ID NO: 305742 - RNA, 19 nt, Human
uggcugaguccuagagaac

SEQ ID NO: 305743 - RNA, 20 nt, Human
uggcuggagcuaaagcaggu

SEQ ID NO: 305744 - RNA, 20 nt, Human
uggggggaagagagacugcc

SEQ ID NO: 305745 - RNA, 21 nt, Human
uggguaguagacuggucccua

SEQ ID NO: 305746 - RNA, 24 nt, Human
ugguaagaaacaaaauaccuucag

SEQ ID NO: 305747 - RNA, 27 nt, Human
uggucagaaaagauacugucaaaccuc

SEQ ID NO: 305748 - RNA, 23 nt, Human
ugguugucuuuuucaucaaaucc

SEQ ID NO: 305749 - RNA, 21 nt, Human
uguaaggaaacgagguuguuu

SEQ ID NO: 305750 - RNA, 21 nt, Human
uguagaaaaaaaugccagaga

SEQ ID NO: 305751 - RNA, 20 nt, Human
uguagcaaaaaagagacccg

SEQ ID NO: 305752 - RNA, 21 nt, Human
ugucugggcgcucccgccggg

SEQ ID NO: 305753 - RNA, 22 nt, Human
uuagaaaacaggaauugcccag

SEQ ID NO: 305754 - RNA, 21 nt, Human
uucaaagcacaugaggccuaa

SEQ ID NO: 305755 - RNA, 19 nt, Human
uucaagcuaugggcuuuuc

SEQ ID NO: 305756 - RNA, 21 nt, Human
uucacccccagaacuagagcu

SEQ ID NO: 305757 - RNA, 22 nt, Human
uucagagggaggggcuggugag

SEQ ID NO: 305758 - RNA, 22 nt, Human
uuccacaggcucagggucaagc

SEQ ID NO: 305759 - RNA, 21 nt, Human
uucuuggacacaucaaagaca

SEQ ID NO: 305760 - RNA, 24 nt, Human
uugacaguuuggggaagggaugug

SEQ ID NO: 305761 - RNA, 24 nt, Human
uuguguccuucgaaggagggagaa

SEQ ID NO: 305762 - RNA, 18 nt, Human
uuucccaucaaacauugg

SEQ ID NO: 305763 - RNA, 24 nt, Human
uuucuugugagucagauauuuuua

SEQ ID NO: 305764 - RNA, 22 nt, Human
uuugagcaguuggcagcagagg

SEQ ID NO: 305765 - RNA, 20 nt, Human
aaaaauaaaaaauugagagc

SEQ ID NO: 305766 - RNA, 25 nt, Human
aagccccaacaagucuggaccccac

SEQ ID NO: 305767 - RNA, 22 nt, Human
acagcuggcucucccaccccuc

SEQ ID NO: 305768 - RNA, 24 nt, Human
acccaucucccccugcacuccccc

SEQ ID NO: 305769 - RNA, 26 nt, Human
acccaucucccccugcacucccccag

SEQ ID NO: 305770 - RNA, 19 nt, Human
accccccaccacuccuggg

SEQ ID NO: 305771 - RNA, 19 nt, Human
acugacacagaccaggagg

SEQ ID NO: 305772 - RNA, 25 nt, Human
agagcucuuuucccuggguuugggg

SEQ ID NO: 305773 - RNA, 18 nt, Human
aggcagggaaaaagcaaa

SEQ ID NO: 305774 - RNA, 25 nt, Human
agggaagaggugguagugaccaaga

SEQ ID NO: 305775 - RNA, 18 nt, Human
agugaccaagacaggcag

SEQ ID NO: 305776 - RNA, 21 nt, Human
caagacaggcagggaaaaagc

SEQ ID NO: 305777 - RNA, 25 nt, Human
cacagaccaggaggggcagggaagc

SEQ ID NO: 305778 - RNA, 22 nt, Human
cacccaucucccccugcacucc

SEQ ID NO: 305779 - RNA, 26 nt, Human
cacccaucucccccugcacuccccca

SEQ ID NO: 305780 - RNA, 19 nt, Human
caccucuguuuucuggagg

SEQ ID NO: 305781 - RNA, 19 nt, Human
cagaacggaauaagaggau

SEQ ID NO: 305782 - RNA, 21 nt, Human
cagcuggcucucccaccccuc

SEQ ID NO: 305783 - RNA, 23 nt, Human
caggaucaaguccuaaguaccga

SEQ ID NO: 305784 - RNA, 19 nt, Human
cagggaaaaagcaaacuuc

SEQ ID NO: 305785 - RNA, 22 nt, Human
caggggucggucccugggaggg

SEQ ID NO: 305786 - RNA, 19 nt, Human
cauggaaggcccgcccuuc

SEQ ID NO: 305787 - RNA, 23 nt, Human
ccaagacaggcagggaaaaagca

SEQ ID NO: 305788 - RNA, 20 nt, Human
ccaguggccaaccacaggau

SEQ ID NO: 305789 - RNA, 22 nt, Human
ccagugucccucacauuuguca

SEQ ID NO: 305790 - RNA, 26 nt, Human
ccaucucccccugcacucccccagaa

SEQ ID NO: 305791 - RNA, 24 nt, Human
ccccaacaagucuggaccccacag

SEQ ID NO: 305792 - RNA, 26 nt, Human
ccccacagcuggcucucccaccccuc

SEQ ID NO: 305793 - RNA, 20 nt, Human
ccccacuuccugggccccag

SEQ ID NO: 305794 - RNA, 18 nt, Human
cccccaccacuccugggc

SEQ ID NO: 305795 - RNA, 22 nt, Human
ccccccaccacuccugggcuga

SEQ ID NO: 305796 - RNA, 20 nt, Human
cccucacauuugucaccucu

SEQ ID NO: 305797 - RNA, 18 nt, Human
cccuggguuuggggaagg

SEQ ID NO: 305798 - RNA, 22 nt, Human
cccuggguuuggggaaggaguc

SEQ ID NO: 305799 - RNA, 20 nt, Human
cccuuggguggaugguuggg

SEQ ID NO: 305800 - RNA, 19 nt, Human
ccggaccccccaccacucc

SEQ ID NO: 305801 - RNA, 19 nt, Human
ccucaucacccaucucccc

SEQ ID NO: 305802 - RNA, 21 nt, Human
ccucaucacccaucucccccu

SEQ ID NO: 305803 - RNA, 19 nt, Human
cggaccccccaccacuccu

SEQ ID NO: 305804 - RNA, 18 nt, Human
cggucccugggaggggua

SEQ ID NO: 305805 - RNA, 21 nt, Human
cucccaccccucagcaagcuc

SEQ ID NO: 305806 - RNA, 19 nt, Human
cugacacagaccaggaggg

SEQ ID NO: 305807 - RNA, 23 nt, Human
cuggaccccacagcuggcucucc

SEQ ID NO: 305808 - RNA, 19 nt, Human
cugguuugggguuucucag

SEQ ID NO: 305809 - RNA, 19 nt, Human
gaaccucugagagaccccu

SEQ ID NO: 305810 - RNA, 19 nt, Human
gaccaagacaggcagggaa

SEQ ID NO: 305811 - RNA, 18 nt, Human
gagggcagugaguccugg

SEQ ID NO: 305812 - RNA, 19 nt, Human
gcagcagcauggccagugg

SEQ ID NO: 305813 - RNA, 21 nt, Human
gcccaugauggggaaccucag

SEQ ID NO: 305814 - RNA, 22 nt, Human
gcccaugauggggaaccucagc

SEQ ID NO: 305815 - RNA, 21 nt, Human
gccccggaccccccaccacuc

SEQ ID NO: 305816 - RNA, 20 nt, Human
ggccaggggucggucccugg

SEQ ID NO: 305817 - RNA, 21 nt, Human
ggccaguggccaaccacagga

SEQ ID NO: 305818 - RNA, 21 nt, Human
ggcugugggaauucccuuccu

SEQ ID NO: 305819 - RNA, 19 nt, Human
gggaagccccaacaagucu

SEQ ID NO: 305820 - RNA, 18 nt, Human
gggaauucccuuccuugc

SEQ ID NO: 305821 - RNA, 21 nt, Human
gggcagcagcauggccagugg

SEQ ID NO: 305822 - RNA, 24 nt, Human
gggcugugggaauucccuuccuug

SEQ ID NO: 305823 - RNA, 21 nt, Human
gggugccccggaccccccacc

SEQ ID NO: 305824 - RNA, 20 nt, Human
ggguuuggggaaggagucag

SEQ ID NO: 305825 - RNA, 20 nt, Human
guaggucccugggaggggua

SEQ ID NO: 305826 - RNA, 25 nt, Human
uaacuaaggacuuuauuucaaacaa

SEQ ID NO: 305827 - RNA, 19 nt, Human
uacaaggagaagaaaggcc

SEQ ID NO: 305828 - RNA, 19 nt, Human
uagagcugggcagcagcau

SEQ ID NO: 305829 - RNA, 18 nt, Human
ucaaccaaguguaaucug

SEQ ID NO: 305830 - RNA, 21 nt, Human
ucccccugcacucccccagaa

SEQ ID NO: 305831 - RNA, 21 nt, Human
ucccucacauuugucaccucu

SEQ ID NO: 305832 - RNA, 23 nt, Human
ucccugggagggguaggucccug

SEQ ID NO: 305833 - RNA, 23 nt, Human
uccuaaguaccgagaaccuacuc

SEQ ID NO: 305834 - RNA, 20 nt, Human
uccugggccccagaacggaa

SEQ ID NO: 305835 - RNA, 21 nt, Human
ucuggaccccacagcuggcuc

SEQ ID NO: 305836 - RNA, 18 nt, Human
ucuuaguggcugcuccgg

SEQ ID NO: 305837 - RNA, 20 nt, Human
ugccccggaccccccaccac

SEQ ID NO: 305838 - RNA, 23 nt, Human
ugccccggaccccccaccacucc

SEQ ID NO: 305839 - RNA, 19 nt, Human
uggaaagaaccucugagag

SEQ ID NO: 305840 - RNA, 19 nt, Human
uggccuguggaaagaaccu

SEQ ID NO: 305841 - RNA, 19 nt, Human
uggcugcuccggaguaguc

SEQ ID NO: 305842 - RNA, 18 nt, Human
ugggagggguagagcugg

SEQ ID NO: 305843 - RNA, 19 nt, Human
ugggagggguagagcuggg

SEQ ID NO: 305844 - RNA, 20 nt, Human
ugggagggguagagcugggc

SEQ ID NO: 305845 - RNA, 20 nt, Human
ugggagggguaggucccugg

SEQ ID NO: 305846 - RNA, 21 nt, Human
ugggagggguaggucccugga

SEQ ID NO: 305847 - RNA, 22 nt, Human
ugggcagcagcauggccagugg

SEQ ID NO: 305848 - RNA, 21 nt, Human
uucauaccucaucacccaucu

SEQ ID NO: 305849 - RNA, 23 nt, Human
uuuguaucuuggacacugaggca

SEQ ID NO: 305850 - RNA, 22 nt, Human
aaaaaccaaaaaggaagaccag

SEQ ID NO: 305851 - RNA, 21 nt, Human
aaacaagaaacaaaaacaggu

SEQ ID NO: 305852 - RNA, 21 nt, Human
aaacaagaaacaaaaacaggu

SEQ ID NO: 305853 - RNA, 23 nt, Human
aaacaagaaacaaaaacagguaa

SEQ ID NO: 305854 - RNA, 27 nt, Human
aaacagagcaagcgucgcagcccuccc

SEQ ID NO: 305855 - RNA, 23 nt, Human
aaagaaaacuagggcagcagcua

SEQ ID NO: 305856 - RNA, 21 nt, Human
aaauacauaacauugaccucc

SEQ ID NO: 305857 - RNA, 25 nt, Human
aaccaaaaaggaagaccaguucacu

SEQ ID NO: 305858 - RNA, 24 nt, Human
aacugcuuuucauaauuauccuau

SEQ ID NO: 305859 - RNA, 25 nt, Human
aagaaacaaaaacagguaaaauaac

SEQ ID NO: 305860 - RNA, 20 nt, Human
aagcagcagguaaaagaggc

SEQ ID NO: 305861 - RNA, 23 nt, Human
aagcagcagguaaaagaggggac

SEQ ID NO: 305862 - RNA, 19 nt, Human
aaggaggcagaaaaaaggg

SEQ ID NO: 305863 - RNA, 22 nt, Human
aaggcacucagaaagagucgga

SEQ ID NO: 305864 - RNA, 18 nt, Human
aagguccccaagucagag

SEQ ID NO: 305865 - RNA, 25 nt, Human
acacagccccagagaggagggaacc

SEQ ID NO: 305866 - RNA, 25 nt, Human
acacagucagcaaugccccucccca

SEQ ID NO: 305867 - RNA, 23 nt, Human
acccacccccaccccccaccccc

SEQ ID NO: 305868 - RNA, 24 nt, Human
acccccaccccccacccccgggau

SEQ ID NO: 305869 - RNA, 18 nt, Human
agcaagcgucgcagcccu

SEQ ID NO: 305870 - RNA, 22 nt, Human
aggaggaaaggaggaaagaaaa

SEQ ID NO: 305871 - RNA, 20 nt, Human
aggagggggugagggaggac

SEQ ID NO: 305872 - RNA, 28 nt, Human
aggcaaaauuucuuaaaaauuagaucca

SEQ ID NO: 305873 - RNA, 18 nt, Human
aggcagaaaaaagggcag

SEQ ID NO: 305874 - RNA, 22 nt, Human
aggccgagggcgagucggagga

SEQ ID NO: 305875 - RNA, 18 nt, Human
auuucagaguccagcaau

SEQ ID NO: 305876 - RNA, 19 nt, Human
caaaacaagaaacaaaaac

SEQ ID NO: 305877 - RNA, 18 nt, Human
caaaacacagccccagag

SEQ ID NO: 305878 - RNA, 22 nt, Human
caaaacacagccccagagagga

SEQ ID NO: 305879 - RNA, 21 nt, Human
cacaaacagagcaagcgucgc

SEQ ID NO: 305880 - RNA, 20 nt, Human
cacagucagcaaugccccuc

SEQ ID NO: 305881 - RNA, 22 nt, Human
cacccccaccccccacccccgg

SEQ ID NO: 305882 - RNA, 24 nt, Human
caccuggguaaguaggugaggggc

SEQ ID NO: 305883 - RNA, 19 nt, Human
cacucagaaagagucggaa

SEQ ID NO: 305884 - RNA, 22 nt, Human
cacucuuccccacuguugggag

SEQ ID NO: 305885 - RNA, 18 nt, Human
cagaggaggaaaggagga

SEQ ID NO: 305886 - RNA, 20 nt, Human
cagcacagccggagucccca

SEQ ID NO: 305887 - RNA, 18 nt, Human
cagcggggucgggcagcg

SEQ ID NO: 305888 - RNA, 29 nt, Human
cauccagaacugcuuuucauaauuauccc

SEQ ID NO: 305889 - RNA, 22 nt, Human
caucccaaccuguuuccccccu

SEQ ID NO: 305890 - RNA, 24 nt, Human
caugccaacuguacacacauuuac

SEQ ID NO: 305891 - RNA, 23 nt, Human
ccacaaacagagcaagcgucgca

SEQ ID NO: 305892 - RNA, 23 nt, Human
cccacagaagccagggagcugca

SEQ ID NO: 305893 - RNA, 19 nt, Human
cccacagagccgggaccca

SEQ ID NO: 305894 - RNA, 21 nt, Human
cccacagagccgggacccacc

SEQ ID NO: 305895 - RNA, 25 nt, Human
cccagcacagccggaguccccacag

SEQ ID NO: 305896 - RNA, 21 nt, Human
ccccacagaagccagggagcu

SEQ ID NO: 305897 - RNA, 19 nt, Human
ccccaccccccacccccgg

SEQ ID NO: 305898 - RNA, 21 nt, Human
ccccuccccaucacccacaga

SEQ ID NO: 305899 - RNA, 21 nt, Human
ccccuguacaguauuucacuc

SEQ ID NO: 305900 - RNA, 20 nt, Human
cccuggagagucacucuucc

SEQ ID NO: 305901 - RNA, 18 nt, Human
ccgccgccgcugccaccg

SEQ ID NO: 305902 - RNA, 25 nt, Human
ccgccgcugccaccgacuccucucg

SEQ ID NO: 305903 - RNA, 20 nt, Human
ccuaggaccccuggagaguc

SEQ ID NO: 305904 - RNA, 19 nt, Human
ccuccaggggccugggauc

SEQ ID NO: 305905 - RNA, 20 nt, Human
ccuggggcuguggcuguggc

SEQ ID NO: 305906 - RNA, 18 nt, Human
cggcgcagggacggugcc

SEQ ID NO: 305907 - RNA, 19 nt, Human
cgucaccccacaaacagag

SEQ ID NO: 305908 - RNA, 19 nt, Human
cgugcggcagcgccgcggg

SEQ ID NO: 305909 - RNA, 23 nt, Human
cuccccaucacccacagagccgg

SEQ ID NO: 305910 - RNA, 19 nt, Human
cuggaaggcacaccaucca

SEQ ID NO: 305911 - RNA, 22 nt, Human
cuggggcuguggcuguggcugu

SEQ ID NO: 305912 - RNA, 23 nt, Human
cuggggcuguggcuguggcugug

SEQ ID NO: 305913 - RNA, 18 nt, Human
gaaggcacaccauccaga

SEQ ID NO: 305914 - RNA, 19 nt, Human
gaaggcacaccauccagaa

SEQ ID NO: 305915 - RNA, 20 nt, Human
gacaagagaggggaggaccu

SEQ ID NO: 305916 - RNA, 22 nt, Human
gagaaaaauagggaacaaaacc

SEQ ID NO: 305917 - RNA, 25 nt, Human
gagccgggacccaccuggguaaguu

SEQ ID NO: 305918 - RNA, 20 nt, Human
gaggugacagggacuuaaaa

SEQ ID NO: 305919 - RNA, 22 nt, Human
gcagauuuuuggagaagcagca

SEQ ID NO: 305920 - RNA, 20 nt, Human
gcagcagcuauggaagcuug

SEQ ID NO: 305921 - RNA, 27 nt, Human
gcccuguagccucuuccauggcaccuu

SEQ ID NO: 305922 - RNA, 20 nt, Human
gccggucccgccgccgccgc

SEQ ID NO: 305923 - RNA, 22 nt, Human
gcggggcaggaggcuagugguu

SEQ ID NO: 305924 - RNA, 22 nt, Human
gcugcggcuggcgcggaaggcc

SEQ ID NO: 305925 - RNA, 20 nt, Human
ggaggacaacugagggcgcu

SEQ ID NO: 305926 - RNA, 18 nt, Human
ggaggaguugaggccuag

SEQ ID NO: 305927 - RNA, 18 nt, Human
ggcagaaaaaagggcagg

SEQ ID NO: 305928 - RNA, 20 nt, Human
ggcuaugccuggggcugugg

SEQ ID NO: 305929 - RNA, 18 nt, Human
ggcucguggggcucgugc

SEQ ID NO: 305930 - RNA, 21 nt, Human
ggcuguggcuguggcuguggc

SEQ ID NO: 305931 - RNA, 18 nt, Human
gggauauuucagagucca

SEQ ID NO: 305932 - RNA, 23 nt, Human
gggcagcgcugagaacggcgggg

SEQ ID NO: 305933 - RNA, 22 nt, Human
gggcuguggcuguggcuguggc

SEQ ID NO: 305934 - RNA, 18 nt, Human
ggggugagcggcucgugg

SEQ ID NO: 305935 - RNA, 21 nt, Human
ggugagggaggacaggagaga

SEQ ID NO: 305936 - RNA, 18 nt, Human
gucaccccacaaacagag

SEQ ID NO: 305937 - RNA, 18 nt, Human
guccagcaaugcuggaca

SEQ ID NO: 305938 - RNA, 25 nt, Human
guccugcuuggcgagacgugucacu

SEQ ID NO: 305939 - RNA, 21 nt, Human
gugguugcugcugcugcugcu

SEQ ID NO: 305940 - RNA, 23 nt, Human
gugguugcugcugcugcugcugc

SEQ ID NO: 305941 - RNA, 23 nt, Human
guuuggcccuguagccucuucca

SEQ ID NO: 305942 - RNA, 22 nt, Human
uaaaaccagcaggcuaccugcu

SEQ ID NO: 305943 - RNA, 23 nt, Human
uaaaauggugcuaguccuauccc

SEQ ID NO: 305944 - RNA, 18 nt, Human
uacacagucagcaaugcc

SEQ ID NO: 305945 - RNA, 24 nt, Human
uacacagucagcaaugccccuccc

SEQ ID NO: 305946 - RNA, 24 nt, Human
uauuucacucagauaaaaccagca

SEQ ID NO: 305947 - RNA, 18 nt, Human
ucaaaacaagaaacaaaa

SEQ ID NO: 305948 - RNA, 22 nt, Human
ucaaaacaagaaacaaaaacaa

SEQ ID NO: 305949 - RNA, 25 nt, Human
ucaaaacacagccccagagaggauc

SEQ ID NO: 305950 - RNA, 20 nt, Human
ucaccccacaaacagagcaa

SEQ ID NO: 305951 - RNA, 24 nt, Human
ucacugguacucgggaagcuggag

SEQ ID NO: 305952 - RNA, 19 nt, Human
ucagaggaggaaaggagga

SEQ ID NO: 305953 - RNA, 21 nt, Human
ucagauaaaaccagcaggcua

SEQ ID NO: 305954 - RNA, 21 nt, Human
ucccaaccuguuuccccccua

SEQ ID NO: 305955 - RNA, 25 nt, Human
uccccacagaaggcacucagaaaga

SEQ ID NO: 305956 - RNA, 23 nt, Human
ucccgccgccgccgcugccaccg

SEQ ID NO: 305957 - RNA, 25 nt, Human
ucccgccgccgccgcugccaccgac

SEQ ID NO: 305958 - RNA, 18 nt, Human
uccuauauacacagucag

SEQ ID NO: 305959 - RNA, 18 nt, Human
ucgcagcccucccccaaa

SEQ ID NO: 305960 - RNA, 20 nt, Human
ucggaagaggugacagggac

SEQ ID NO: 305961 - RNA, 22 nt, Human
ucucccagcacagccggagucc

SEQ ID NO: 305962 - RNA, 27 nt, Human
ucuuuuauuccccuguacaguauuuca

SEQ ID NO: 305963 - RNA, 19 nt, Human
ugaaggaaacaguuccaug

SEQ ID NO: 305964 - RNA, 18 nt, Human
ugacaagagaggggagga

SEQ ID NO: 305965 - RNA, 21 nt, Human
ugacagggacuuaaaauggug

SEQ ID NO: 305966 - RNA, 18 nt, Human
ugacccacccccaccccc

SEQ ID NO: 305967 - RNA, 19 nt, Human
ugacccacccccacccccc

SEQ ID NO: 305968 - RNA, 24 nt, Human
ugacccacccccaccccccacccc

SEQ ID NO: 305969 - RNA, 25 nt, Human
ugacccacccccaccccccaccccc

SEQ ID NO: 305970 - RNA, 19 nt, Human
ugaggccuaggaccccugg

SEQ ID NO: 305971 - RNA, 21 nt, Human
ugaggccuaggaccccuggag

SEQ ID NO: 305972 - RNA, 21 nt, Human
ugauugcauuguuugugcauu

SEQ ID NO: 305973 - RNA, 19 nt, Human
ugcagcacugucccgccug

SEQ ID NO: 305974 - RNA, 23 nt, Human
ugccaccgacuccucucgggccu

SEQ ID NO: 305975 - RNA, 18 nt, Human
ugccuggggcuguggcug

SEQ ID NO: 305976 - RNA, 19 nt, Human
ugccuggggcuguggcugu

SEQ ID NO: 305977 - RNA, 18 nt, Human
ugcuaguccuaucccauc

SEQ ID NO: 305978 - RNA, 21 nt, Human
ugcugcugcugcugcugcugc

SEQ ID NO: 305979 - RNA, 21 nt, Human
ugcugcugcugcugcugcugc

SEQ ID NO: 305980 - RNA, 21 nt, Human
ugcugcugcugcugcugcugc

SEQ ID NO: 305981 - RNA, 21 nt, Human
ugcugcugcugcugcugcugc

SEQ ID NO: 305982 - RNA, 20 nt, Human
uggaaugaguuguaaauguu

SEQ ID NO: 305983 - RNA, 21 nt, Human
uggacaccuaugagaagaaga

SEQ ID NO: 305984 - RNA, 23 nt, Human
uggcuguggcugcggguggcguu

SEQ ID NO: 305985 - RNA, 18 nt, Human
uggcuguggcuguggcug

SEQ ID NO: 305986 - RNA, 21 nt, Human
uggggcuguggcuguggcugu

SEQ ID NO: 305987 - RNA, 20 nt, Human
uguugggaggcagccuccag

SEQ ID NO: 305988 - RNA, 21 nt, Human
uuacagcuuuucuguugauug

SEQ ID NO: 305989 - RNA, 21 nt, Human
uucaaguauuucucccagcac

SEQ ID NO: 305990 - RNA, 23 nt, Human
uuugugcauuuuuugugugugug

SEQ ID NO: 305991 - RNA, 26 nt, Human
uuuuacuaaaggaggcagaaaaaagg

SEQ ID NO: 305992 - RNA, 20 nt, Human
aaaaaaccauccaucccauc

SEQ ID NO: 305993 - RNA, 27 nt, Human
aaaaaaccauccaucccauccuagugu

SEQ ID NO: 305994 - RNA, 18 nt, Human
aaaagaagccuuggggua

SEQ ID NO: 305995 - RNA, 24 nt, Human
aaacagcaagccuuauuuccccua

SEQ ID NO: 305996 - RNA, 21 nt, Human
aacagcaagccuuauuucccc

SEQ ID NO: 305997 - RNA, 22 nt, Human
aacuccccuccccacaauacgu

SEQ ID NO: 305998 - RNA, 21 nt, Human
aagcacccuugcccaaguaag

SEQ ID NO: 305999 - RNA, 25 nt, Human
aagcagcuugacccaauaugggacc

SEQ ID NO: 306000 - RNA, 27 nt, Human
aauguccaucuaucccugugacauggc

SEQ ID NO: 306001 - RNA, 19 nt, Human
acccaaaaaaaaaaaaaaa

SEQ ID NO: 306002 - RNA, 24 nt, Human
agaauaagagucccggggcucaga

SEQ ID NO: 306003 - RNA, 25 nt, Human
agaaugggaacaacuucaccaaaaa

SEQ ID NO: 306004 - RNA, 22 nt, Human
agaggagggcacacuuggaacu

SEQ ID NO: 306005 - RNA, 19 nt, Human
agcccaucccccaaaaaac

SEQ ID NO: 306006 - RNA, 21 nt, Human
aggcaggagaagagaggaggg

SEQ ID NO: 306007 - RNA, 23 nt, Human
aggcaggagaagagaggagggac

SEQ ID NO: 306008 - RNA, 23 nt, Human
aggcuaggggaaagggucccuuu

SEQ ID NO: 306009 - RNA, 24 nt, Human
agggaacugggcagacuugguuua

SEQ ID NO: 306010 - RNA, 20 nt, Human
augggacccuaggcuagggg

SEQ ID NO: 306011 - RNA, 19 nt, Human
caaaaaaccauccauccca

SEQ ID NO: 306012 - RNA, 18 nt, Human
caacagggcauuaccucc

SEQ ID NO: 306013 - RNA, 19 nt, Human
caacagggcauuaccuccc

SEQ ID NO: 306014 - RNA, 21 nt, Human
caacagggcauuaccuccccc

SEQ ID NO: 306015 - RNA, 20 nt, Human
cacccuugcccaaguaagag

SEQ ID NO: 306016 - RNA, 19 nt, Human
cacugaacccgcuaagccc

SEQ ID NO: 306017 - RNA, 18 nt, Human
cacuugggauaacagagu

SEQ ID NO: 306018 - RNA, 22 nt, Human
cagaauaagagucccggggcuc

SEQ ID NO: 306019 - RNA, 25 nt, Human
cagcaagccuuauuuccccuagccc

SEQ ID NO: 306020 - RNA, 24 nt, Human
cagcuggggagccagggcuggggg

SEQ ID NO: 306021 - RNA, 19 nt, Human
cagguaagcagcuugaccc

SEQ ID NO: 306022 - RNA, 22 nt, Human
ccaaaaaaaaaaaaaaaaaaaa

SEQ ID NO: 306023 - RNA, 25 nt, Human
ccaaaaaaaaaaaaaaaaaaaagaa

SEQ ID NO: 306024 - RNA, 25 nt, Human
ccaaaauaaacuuccuuagcaaaau

SEQ ID NO: 306025 - RNA, 20 nt, Human
ccaaauuauggaaguaaggu

SEQ ID NO: 306026 - RNA, 20 nt, Human
ccaggcaggagaagagagga

SEQ ID NO: 306027 - RNA, 20 nt, Human
ccaggguggaaagcagagaa

SEQ ID NO: 306028 - RNA, 20 nt, Human
cccaggagaacaaacagcaa

SEQ ID NO: 306029 - RNA, 19 nt, Human
ccccaaaaaaccauccauc

SEQ ID NO: 306030 - RNA, 18 nt, Human
ccccagaauaaagaaucc

SEQ ID NO: 306031 - RNA, 21 nt, Human
cccccuccagaaucagggacu

SEQ ID NO: 306032 - RNA, 25 nt, Human
ccccucacccaaaaaaaaaaaaaaa

SEQ ID NO: 306033 - RNA, 24 nt, Human
cccggggcagcgcagcuggggagc

SEQ ID NO: 306034 - RNA, 24 nt, Human
cccucacccaaaaaaaaaaaaaaa

SEQ ID NO: 306035 - RNA, 19 nt, Human
cccuugcccaaguaagagc

SEQ ID NO: 306036 - RNA, 21 nt, Human
ccugggcugaggcagguaagc

SEQ ID NO: 306037 - RNA, 25 nt, Human
cgcagcuggggagccagggcugggg

SEQ ID NO: 306038 - RNA, 21 nt, Human
cggcucaggaggagguugcaa

SEQ ID NO: 306039 - RNA, 22 nt, Human
cuagcccaucccccaaaaaacc

SEQ ID NO: 306040 - RNA, 23 nt, Human
cuagcccaucccccaaaaaacca

SEQ ID NO: 306041 - RNA, 19 nt, Human
cuuggaacuccccucccca

SEQ ID NO: 306042 - RNA, 19 nt, Human
gaaggcuccuuuguaggau

SEQ ID NO: 306043 - RNA, 19 nt, Human
gcuccuuuguaggauuggg

SEQ ID NO: 306044 - RNA, 21 nt, Human
gcuccuuuguaggauugggaa

SEQ ID NO: 306045 - RNA, 20 nt, Human
ggaaagcagagaaacuggug

SEQ ID NO: 306046 - RNA, 26 nt, Human
ggaaagggucccuuuacuaaaauaaa

SEQ ID NO: 306047 - RNA, 21 nt, Human
ggauugggaagggaacugggc

SEQ ID NO: 306048 - RNA, 23 nt, Human
ggcugaggcagguaagcagcuug

SEQ ID NO: 306049 - RNA, 21 nt, Human
gggagccagggcuggggggcc

SEQ ID NO: 306050 - RNA, 19 nt, Human
gggcucagaaugggaacaa

SEQ ID NO: 306051 - RNA, 20 nt, Human
ggggagccagggcugggggg

SEQ ID NO: 306052 - RNA, 21 nt, Human
guaggguccccucacccaaaa

SEQ ID NO: 306053 - RNA, 23 nt, Human
guguccaucuuccauuccuuccc

SEQ ID NO: 306054 - RNA, 24 nt, Human
uaaaaccaagucaacaaaugucca

SEQ ID NO: 306055 - RNA, 23 nt, Human
uaaagaauccugggcugaggcag

SEQ ID NO: 306056 - RNA, 24 nt, Human
uaaagaauccugggcugaggcagg

SEQ ID NO: 306057 - RNA, 21 nt, Human
uaacagaguaggguccccuca

SEQ ID NO: 306058 - RNA, 21 nt, Human
uaaccccugauccucaauccc

SEQ ID NO: 306059 - RNA, 18 nt, Human
uagcaaaaugagaagcaa

SEQ ID NO: 306060 - RNA, 20 nt, Human
uagcaaaaugagaagcaaga

SEQ ID NO: 306061 - RNA, 20 nt, Human
uaggguccccucacccaaaa

SEQ ID NO: 306062 - RNA, 23 nt, Human
uaguggguuuccacacauggcuu

SEQ ID NO: 306063 - RNA, 22 nt, Human
ucacccaaaaaaaaaaaaaaaa

SEQ ID NO: 306064 - RNA, 25 nt, Human
ucacccaaaaaaaaaaaaaaaaaaa

SEQ ID NO: 306065 - RNA, 23 nt, Human
ucccccaaaaaaccauccauccc

SEQ ID NO: 306066 - RNA, 23 nt, Human
ucccccagaauaaagaauccugg

SEQ ID NO: 306067 - RNA, 22 nt, Human
uccccuagcccaucccccaaaa

SEQ ID NO: 306068 - RNA, 18 nt, Human
ucccggggcucagaaugg

SEQ ID NO: 306069 - RNA, 22 nt, Human
uccugggcugaggcagguaagc

SEQ ID NO: 306070 - RNA, 19 nt, Human
ucuaaccccugauccucaa

SEQ ID NO: 306071 - RNA, 24 nt, Human
ucuauuacuuuuauuaaauagugg

SEQ ID NO: 306072 - RNA, 19 nt, Human
ugacacaucaucagaauaa

SEQ ID NO: 306073 - RNA, 24 nt, Human
ugagaagcaagaaguucccccucc

SEQ ID NO: 306074 - RNA, 19 nt, Human
ugaggcagguaagcagcuu

SEQ ID NO: 306075 - RNA, 26 nt, Human
uggaaagcagagaaacugguggcccg

SEQ ID NO: 306076 - RNA, 24 nt, Human
uggcccggaagcgcccgcagacgg

SEQ ID NO: 306077 - RNA, 19 nt, Human
ugggaacaacuucaccaaa

SEQ ID NO: 306078 - RNA, 21 nt, Human
ugggcagacuugguuuauguc

SEQ ID NO: 306079 - RNA, 18 nt, Human
uggggggcgccagggugg

SEQ ID NO: 306080 - RNA, 18 nt, Human
uggguuuccacacauggc

SEQ ID NO: 306081 - RNA, 21 nt, Human
uguaaaaccaagucaacaaau

SEQ ID NO: 306082 - RNA, 24 nt, Human
uguccaucuuccauuccuucccaa

SEQ ID NO: 306083 - RNA, 19 nt, Human
ugucuggugguguccggug

SEQ ID NO: 306084 - RNA, 18 nt, Human
uguggugguaguaggagg

SEQ ID NO: 306085 - RNA, 18 nt, Human
uguggugguaguaggagg

SEQ ID NO: 306086 - RNA, 22 nt, Human
uugagcccacugaacccgcuaa

SEQ ID NO: 306087 - RNA, 23 nt, Human
aacgugggcagaaguauggaaua

SEQ ID NO: 306088 - RNA, 24 nt, Human
aacgugggcagaaguauggaauag

SEQ ID NO: 306089 - RNA, 23 nt, Human
accacgacaaacuaguacagaga

SEQ ID NO: 306090 - RNA, 19 nt, Human
acugcaacggucuccuggg

SEQ ID NO: 306091 - RNA, 21 nt, Human
aggcugcaguccuuguuucug

SEQ ID NO: 306092 - RNA, 20 nt, Human
auggaauagaaaauaaauac

SEQ ID NO: 306093 - RNA, 19 nt, Human
caaagguucaaacaucgag

SEQ ID NO: 306094 - RNA, 18 nt, Human
cacagcucaggcccggcu

SEQ ID NO: 306095 - RNA, 24 nt, Human
cagagaaugcccuguacaaaacac

SEQ ID NO: 306096 - RNA, 24 nt, Human
ccugggggaggugcuagcacagcu

SEQ ID NO: 306097 - RNA, 24 nt, Human
ggaauagaaaauaaauacaaaugu

SEQ ID NO: 306098 - RNA, 21 nt, Human
ggcccggcuagagcuaccguc

SEQ ID NO: 306099 - RNA, 18 nt, Human
uaaaggaauggauuuuga

SEQ ID NO: 306100 - RNA, 22 nt, Human
uacaaaacacaacaaagguuca

SEQ ID NO: 306101 - RNA, 25 nt, Human
uacaaaacacaacaaagguucaaac

SEQ ID NO: 306102 - RNA, 20 nt, Human
ucaggcccggcuagagcuac

SEQ ID NO: 306103 - RNA, 18 nt, Human
ugagagaaaacaacgugg

SEQ ID NO: 306104 - RNA, 23 nt, Human
ugagagaaaacaacgugggcaga

SEQ ID NO: 306105 - RNA, 18 nt, Human
uggaauagaaaauaaaua

SEQ ID NO: 306106 - RNA, 24 nt, Human
uggaauagaaaauaaauacaaaug

SEQ ID NO: 306107 - RNA, 18 nt, Human
uguggcacaguccaugcu

SEQ ID NO: 306108 - RNA, 18 nt, Human
uuuuuaaaggaauggauu

SEQ ID NO: 306109 - RNA, 21 nt, Human
accccucccaccacacugccc

SEQ ID NO: 306110 - RNA, 20 nt, Human
acuggcuggcgggcaagggg

SEQ ID NO: 306111 - RNA, 19 nt, Human
agccgcccugcccugcccc

SEQ ID NO: 306112 - RNA, 24 nt, Human
caccccucccaccacacugcccug

SEQ ID NO: 306113 - RNA, 20 nt, Human
cagccccaacuggggaugga

SEQ ID NO: 306114 - RNA, 29 nt, Human
cccagggcccccaaucuggaagggccccu

SEQ ID NO: 306115 - RNA, 20 nt, Human
ccccagggcccccaaucugg

SEQ ID NO: 306116 - RNA, 19 nt, Human
ccccgaggccaggccuggg

SEQ ID NO: 306117 - RNA, 18 nt, Human
cccucgagucugccucca

SEQ ID NO: 306118 - RNA, 22 nt, Human
cccugcugaagucaauuccuua

SEQ ID NO: 306119 - RNA, 23 nt, Human
cuggcggucgcagccccaacugg

SEQ ID NO: 306120 - RNA, 24 nt, Human
cugggagccucccaccccugcuga

SEQ ID NO: 306121 - RNA, 23 nt, Human
gacagggaguggggaccccaggg

SEQ ID NO: 306122 - RNA, 21 nt, Human
ggaacaccccucccaccacac

SEQ ID NO: 306123 - RNA, 24 nt, Human
ggacagggaguggggaccccaggg

SEQ ID NO: 306124 - RNA, 21 nt, Human
ggcagggagugggggguucgg

SEQ ID NO: 306125 - RNA, 24 nt, Human
gggagaaucuggcggucgcagccc

SEQ ID NO: 306126 - RNA, 23 nt, Human
ggggggacacggggcggcucugc

SEQ ID NO: 306127 - RNA, 24 nt, Human
gggggguucggccacuggcuggcg

SEQ ID NO: 306128 - RNA, 20 nt, Human
ucccaccacacugcccuggg

SEQ ID NO: 306129 - RNA, 19 nt, Human
ugacgguggcagggagugg

SEQ ID NO: 306130 - RNA, 20 nt, Human
uggccggccuagccgcccug

SEQ ID NO: 306131 - RNA, 22 nt, Human
uggcugccgcaugaguguucac

SEQ ID NO: 306132 - RNA, 19 nt, Human
uggggaccccagggccccc

SEQ ID NO: 306133 - RNA, 25 nt, Human
ugugacgguggcagggagugggggg

SEQ ID NO: 306134 - RNA, 19 nt, Human
aagggcccccucccagcca

SEQ ID NO: 306135 - RNA, 19 nt, Human
aauccgugaacacuguccc

SEQ ID NO: 306136 - RNA, 19 nt, Human
acugugugacaguggcagg

SEQ ID NO: 306137 - RNA, 19 nt, Human
agagaagcguggccuaacu

SEQ ID NO: 306138 - RNA, 19 nt, Human
agcaggcagcgggggaacc

SEQ ID NO: 306139 - RNA, 20 nt, Human
agggaguggggaaccccagg

SEQ ID NO: 306140 - RNA, 21 nt, Human
agggaguggggaaccccaggg

SEQ ID NO: 306141 - RNA, 20 nt, Human
aguguuugcuuuugcuacug

SEQ ID NO: 306142 - RNA, 21 nt, Human
cagccccaacuggggacugac

SEQ ID NO: 306143 - RNA, 19 nt, Human
caguggcagggaguggggg

SEQ ID NO: 306144 - RNA, 19 nt, Human
caguggcagggaguggggg

SEQ ID NO: 306145 - RNA, 23 nt, Human
ccaauccucacuccgugcggaca

SEQ ID NO: 306146 - RNA, 24 nt, Human
ccaggaccuggugggacauggggc

SEQ ID NO: 306147 - RNA, 29 nt, Human
cccagggcccccagucuggaagggccccu

SEQ ID NO: 306148 - RNA, 20 nt, Human
ccccagggcccccagucugg

SEQ ID NO: 306149 - RNA, 18 nt, Human
cccccaauccucacuccg

SEQ ID NO: 306150 - RNA, 20 nt, Human
cccccagucuggaagggccc

SEQ ID NO: 306151 - RNA, 19 nt, Human
ccccgaggccaggccuggg

SEQ ID NO: 306152 - RNA, 23 nt, Human
ccucacuccgugcggacaaugac

SEQ ID NO: 306153 - RNA, 18 nt, Human
ccuccaggaccugguggg

SEQ ID NO: 306154 - RNA, 24 nt, Human
ccuuugcugaaggcacccaggucu

SEQ ID NO: 306155 - RNA, 19 nt, Human
cgcucaucucccccguccg

SEQ ID NO: 306156 - RNA, 19 nt, Human
cgugcggacaaugacgugg

SEQ ID NO: 306157 - RNA, 19 nt, Human
cuccucccaccacauugcc

SEQ ID NO: 306158 - RNA, 21 nt, Human
cucgcaucugccuccaggacc

SEQ ID NO: 306159 - RNA, 22 nt, Human
cugcgagccucccucccaugcu

SEQ ID NO: 306160 - RNA, 23 nt, Human
cuggaggucgcagccccaacugg

SEQ ID NO: 306161 - RNA, 22 nt, Human
gacaaugacguggaugccggaa

SEQ ID NO: 306162 - RNA, 19 nt, Human
gcccugggucugcgagccc

SEQ ID NO: 306163 - RNA, 20 nt, Human
gcucagagggcccacagcug

SEQ ID NO: 306164 - RNA, 21 nt, Human
ggaacacuccucccaccacau

SEQ ID NO: 306165 - RNA, 21 nt, Human
ggcagggagugggggguucgg

SEQ ID NO: 306166 - RNA, 19 nt, Human
ggggugaaagggugcugca

SEQ ID NO: 306167 - RNA, 18 nt, Human
gggucuucaaauggcuuc

SEQ ID NO: 306168 - RNA, 18 nt, Human
guggcagggagugggggg

SEQ ID NO: 306169 - RNA, 20 nt, Human
ucccaccacauugcccuggg

SEQ ID NO: 306170 - RNA, 18 nt, Human
ucgcagccccaacugggg

SEQ ID NO: 306171 - RNA, 23 nt, Human
ucugggcccucgcaucugccucc

SEQ ID NO: 306172 - RNA, 22 nt, Human
ugaacacugucccgcucaucuc

SEQ ID NO: 306173 - RNA, 19 nt, Human
ugcucagagggcccacagc

SEQ ID NO: 306174 - RNA, 20 nt, Human
ugcucagagggcccacagcu

SEQ ID NO: 306175 - RNA, 19 nt, Human
uggcuucugcaucugaccu

SEQ ID NO: 306176 - RNA, 22 nt, Human
ugggcccccaauccucacuccg

SEQ ID NO: 306177 - RNA, 18 nt, Human
uggggcggcucugcugac

SEQ ID NO: 306178 - RNA, 21 nt, Human
ugggggugaaagggugcugca

SEQ ID NO: 306179 - RNA, 22 nt, Human
ugggggugaaagggugcugcaa

SEQ ID NO: 306180 - RNA, 22 nt, Human
uggugggacauggggcggcucu

SEQ ID NO: 306181 - RNA, 19 nt, Human
ugucccgcucaucuccccc

SEQ ID NO: 306182 - RNA, 26 nt, Human
ugucccgcucaucucccccguccgcc

SEQ ID NO: 306183 - RNA, 25 nt, Human
ugugacaguggcagggagugggggg

SEQ ID NO: 306184 - RNA, 23 nt, Human
aaaaagaaaggaguuaacacuga

SEQ ID NO: 306185 - RNA, 24 nt, Human
acacuaaucuauuugaugcccaau

SEQ ID NO: 306186 - RNA, 21 nt, Human
acagaauacaaggagcaucca

SEQ ID NO: 306187 - RNA, 21 nt, Human
acuauguuaagacaguggagc

SEQ ID NO: 306188 - RNA, 21 nt, Human
acugacugaauaccuacuaca

SEQ ID NO: 306189 - RNA, 22 nt, Human
aggaaagagaauacagguuaaa

SEQ ID NO: 306190 - RNA, 21 nt, Human
cacccucucuuacaccuacaa

SEQ ID NO: 306191 - RNA, 24 nt, Human
cacccucucuuacaccuacaaacc

SEQ ID NO: 306192 - RNA, 21 nt, Human
caguugugugaauagugugag

SEQ ID NO: 306193 - RNA, 21 nt, Human
ccccacccucucuuacaccua

SEQ ID NO: 306194 - RNA, 18 nt, Human
ccccugaagaugguuucu

SEQ ID NO: 306195 - RNA, 23 nt, Human
ccuacaaacccauacuuagagcu

SEQ ID NO: 306196 - RNA, 22 nt, Human
ccuggaagaucagaguugacua

SEQ ID NO: 306197 - RNA, 21 nt, Human
gaaacaaaauguauaaaacuu

SEQ ID NO: 306198 - RNA, 18 nt, Human
gagcuaauaccaccuguc

SEQ ID NO: 306199 - RNA, 23 nt, Human
uaaaacaaauguugucuaggaac

SEQ ID NO: 306200 - RNA, 27 nt, Human
uaaaacaaauguugucuaggaacuuau

SEQ ID NO: 306201 - RNA, 20 nt, Human
uaacacugaaaggcauaacg

SEQ ID NO: 306202 - RNA, 24 nt, Human
uacuacaguugacauucacuuagc

SEQ ID NO: 306203 - RNA, 27 nt, Human
uacuuagagcuuucacagaauacaagg

SEQ ID NO: 306204 - RNA, 27 nt, Human
ucuuacaccuacaaacccauacuuaga

SEQ ID NO: 306205 - RNA, 23 nt, Human
ugacugaauaccuacuacaguug

SEQ ID NO: 306206 - RNA, 20 nt, Human
ugagaaagacugacugaaua

SEQ ID NO: 306207 - RNA, 24 nt, Human
ugagaaagacugacugaauaccua

SEQ ID NO: 306208 - RNA, 21 nt, Human
uguaaaacaaauguugucuag

SEQ ID NO: 306209 - RNA, 22 nt, Human
uguccuggaagaucagaguuga

SEQ ID NO: 306210 - RNA, 25 nt, Human
uguuuuuuuccuccaauaaacauuu

SEQ ID NO: 306211 - RNA, 21 nt, Human
uucacagaauacaaggagcau

SEQ ID NO: 306212 - RNA, 24 nt, Human
uugaugcccaauauuuucaguugu

SEQ ID NO: 306213 - RNA, 22 nt, Human
uuuccuugcagcuccagcucaa

SEQ ID NO: 306214 - RNA, 18 nt, Human
uuuuuuuuuuuuuguuuu

SEQ ID NO: 306215 - RNA, 24 nt, Human
uuuuuuuuuuuuuguuuuuuuccu

SEQ ID NO: 306216 - RNA, 18 nt, Human
ccacugggcgggcuggag

SEQ ID NO: 306217 - RNA, 24 nt, Human
ccacugggcgggcuggagacucca

SEQ ID NO: 306218 - RNA, 25 nt, Human
cccaugggcaugccacaagaugcgc

SEQ ID NO: 306219 - RNA, 27 nt, Human
cccgcagugcccugacagcugaguggu

SEQ ID NO: 306220 - RNA, 21 nt, Human
ccgccgccucuggaccugggu

SEQ ID NO: 306221 - RNA, 24 nt, Human
cuggagacuccaggagaaucagga

SEQ ID NO: 306222 - RNA, 18 nt, Human
gacuucaggccagaggug

SEQ ID NO: 306223 - RNA, 19 nt, Human
gggaaauguggcgagaggg

SEQ ID NO: 306224 - RNA, 20 nt, Human
ugagaacauuaaaaaggucc

SEQ ID NO: 306225 - RNA, 22 nt, Human
ugagagccacgauugagaacau

SEQ ID NO: 306226 - RNA, 21 nt, Human
uggaccugggugacugcggcc

SEQ ID NO: 306227 - RNA, 25 nt, Human
aaacagaaggcaaugugucccagag

SEQ ID NO: 306228 - RNA, 24 nt, Human
cagaaggcaaugugucccagagaa

SEQ ID NO: 306229 - RNA, 20 nt, Human
gaaaucaccuggguguggca

SEQ ID NO: 306230 - RNA, 22 nt, Human
gaccacagcagaaauuccagcc

SEQ ID NO: 306231 - RNA, 20 nt, Human
gagaaaacagaaggcaaugu

SEQ ID NO: 306232 - RNA, 26 nt, Human
uagaccacagcagaaauuccagccaa

SEQ ID NO: 306233 - RNA, 21 nt, Human
uggcaaacagacagggcuucc

SEQ ID NO: 306234 - RNA, 21 nt, Human
uuaagaaguuuauuuuauaga

SEQ ID NO: 306235 - RNA, 19 nt, Human
uucuuuagaggaaaucacc

SEQ ID NO: 306236 - RNA, 20 nt, Human
aaaaaaaaacgaggcaugaa

SEQ ID NO: 306237 - RNA, 20 nt, Human
aaaaaaacgaggcaugaaaa

SEQ ID NO: 306238 - RNA, 18 nt, Human
aaaaaauagcaagaauuc

SEQ ID NO: 306239 - RNA, 24 nt, Human
aaaaagaagaagaaagcugggagg

SEQ ID NO: 306240 - RNA, 22 nt, Human
aaaagaagaagaaagcugggag

SEQ ID NO: 306241 - RNA, 22 nt, Human
aaacacccuuaucccccaaaaa

SEQ ID NO: 306242 - RNA, 19 nt, Human
aaacagacagaaguguccc

SEQ ID NO: 306243 - RNA, 26 nt, Human
aaacauggcagcaaagacaggcagcc

SEQ ID NO: 306244 - RNA, 21 nt, Human
aaacgaggcaugaaaaguccc

SEQ ID NO: 306245 - RNA, 18 nt, Human
aacacccuuaucccccaa

SEQ ID NO: 306246 - RNA, 22 nt, Human
aaccgcuuuccacaggggauac

SEQ ID NO: 306247 - RNA, 19 nt, Human
aacucacgucccgcacccc

SEQ ID NO: 306248 - RNA, 24 nt, Human
aacucacgucccgcacccccucca

SEQ ID NO: 306249 - RNA, 24 nt, Human
aagagaggaggaguuuaaagagga

SEQ ID NO: 306250 - RNA, 24 nt, Human
aagcugccaaguccagcaauccca

SEQ ID NO: 306251 - RNA, 24 nt, Human
accaagccacaucugaaaaaaaaa

SEQ ID NO: 306252 - RNA, 22 nt, Human
accuugcgcccagaccaagcca

SEQ ID NO: 306253 - RNA, 18 nt, Human
acucacgucccgcacccc

SEQ ID NO: 306254 - RNA, 20 nt, Human
agaaaaaaaaaagaagaaga

SEQ ID NO: 306255 - RNA, 22 nt, Human
agacagggggguaggacauaug

SEQ ID NO: 306256 - RNA, 19 nt, Human
agaccaagccacaucugaa

SEQ ID NO: 306257 - RNA, 23 nt, Human
agagaggaggaguuuaaagagga

SEQ ID NO: 306258 - RNA, 21 nt, Human
agagcaaaaaaaaucuccucu

SEQ ID NO: 306259 - RNA, 25 nt, Human
agagcaaaaaaaaucuccucuggag

SEQ ID NO: 306260 - RNA, 26 nt, Human
agcaagaauucuuuccuucuuguaaa

SEQ ID NO: 306261 - RNA, 24 nt, Human
aggcagccagaaacuggcuggggg

SEQ ID NO: 306262 - RNA, 25 nt, Human
aggcagccagaaacuggcugggggu

SEQ ID NO: 306263 - RNA, 23 nt, Human
aggcagggugggauagagaaggg

SEQ ID NO: 306264 - RNA, 19 nt, Human
agggugggauagagaaggg

SEQ ID NO: 306265 - RNA, 25 nt, Human
auaguggaggcaaaggguuggccag

SEQ ID NO: 306266 - RNA, 20 nt, Human
aucaagagaggaggaguuua

SEQ ID NO: 306267 - RNA, 18 nt, Human
augaagacagggggguag

SEQ ID NO: 306268 - RNA, 21 nt, Human
auggaggagcagcuccccuca

SEQ ID NO: 306269 - RNA, 21 nt, Human
caaagacaggcagccagaaac

SEQ ID NO: 306270 - RNA, 24 nt, Human
caaggcaagaaucugcugucuccc

SEQ ID NO: 306271 - RNA, 24 nt, Human
caaucccauuuccagcaugaagaa

SEQ ID NO: 306272 - RNA, 21 nt, Human
cagaaaaaaaaaagaagaaga

SEQ ID NO: 306273 - RNA, 20 nt, Human
cagaccaagccacaucugaa

SEQ ID NO: 306274 - RNA, 23 nt, Human
cagagagaaagaacuaagguagg

SEQ ID NO: 306275 - RNA, 26 nt, Human
cagauggaaaaccacaacucuuguag

SEQ ID NO: 306276 - RNA, 21 nt, Human
cagcaaugaccucaccaaggc

SEQ ID NO: 306277 - RNA, 19 nt, Human
cagcccauggcugccuccu

SEQ ID NO: 306278 - RNA, 25 nt, Human
cagcggccuggcucucuucccccug

SEQ ID NO: 306279 - RNA, 19 nt, Human
caggagaacacuguuggaa

SEQ ID NO: 306280 - RNA, 18 nt, Human
cagggugggauagagaag

SEQ ID NO: 306281 - RNA, 25 nt, Human
caucuugucaacacuucuggaguuc

SEQ ID NO: 306282 - RNA, 20 nt, Human
cauuuagaaaaacaaccaga

SEQ ID NO: 306283 - RNA, 22 nt, Human
ccaaguccagcaaucccauuuc

SEQ ID NO: 306284 - RNA, 19 nt, Human
ccagaccaagccacaucug

SEQ ID NO: 306285 - RNA, 25 nt, Human
ccccauuccuuucccuaagacccag

SEQ ID NO: 306286 - RNA, 19 nt, Human
cccccauuuccaacuuccc

SEQ ID NO: 306287 - RNA, 24 nt, Human
cccccuccgggccucccucagaca

SEQ ID NO: 306288 - RNA, 21 nt, Human
cccccuucuuccccugacaag

SEQ ID NO: 306289 - RNA, 25 nt, Human
ccccgcccccuccgggccucccuca

SEQ ID NO: 306290 - RNA, 23 nt, Human
cccgcacccccuccacaaguuua

SEQ ID NO: 306291 - RNA, 20 nt, Human
cccgcccccuccgggccucc

SEQ ID NO: 306292 - RNA, 25 nt, Human
cccucagcggccuggcucucuuuca

SEQ ID NO: 306293 - RNA, 22 nt, Human
ccgcacccccuccacaaguuua

SEQ ID NO: 306294 - RNA, 21 nt, Human
ccgguucuuccucuucucgga

SEQ ID NO: 306295 - RNA, 22 nt, Human
ccuaagacccagcccucccuca

SEQ ID NO: 306296 - RNA, 18 nt, Human
ccuccgggccucccucag

SEQ ID NO: 306297 - RNA, 27 nt, Human
ccuccgggccucccucagacacguccc

SEQ ID NO: 306298 - RNA, 23 nt, Human
ccugagauaccaggcccccuucu

SEQ ID NO: 306299 - RNA, 18 nt, Human
ccuggaccagcucaaggc

SEQ ID NO: 306300 - RNA, 20 nt, Human
ccuugcgcccagaccaagcc

SEQ ID NO: 306301 - RNA, 25 nt, Human
cgcacccccuccacaaguuuaaccg

SEQ ID NO: 306302 - RNA, 20 nt, Human
cgucccgcacccccuccaca

SEQ ID NO: 306303 - RNA, 18 nt, Human
cucaaauauucccuccca

SEQ ID NO: 306304 - RNA, 24 nt, Human
cucacgucccgcacccccuccaca

SEQ ID NO: 306305 - RNA, 21 nt, Human
cucagcggccuggcucucuuu

SEQ ID NO: 306306 - RNA, 21 nt, Human
cucccaccccuaacagaacuc

SEQ ID NO: 306307 - RNA, 23 nt, Human
cucccagcccauggcugccuccu

SEQ ID NO: 306308 - RNA, 23 nt, Human
cuccccgcccccuccgggccucc

SEQ ID NO: 306309 - RNA, 21 nt, Human
cuccuggaccagcucaaggcc

SEQ ID NO: 306310 - RNA, 18 nt, Human
cucugaggcacuaaggcc

SEQ ID NO: 306311 - RNA, 22 nt, Human
cucuucauuccuucagccuuaa

SEQ ID NO: 306312 - RNA, 23 nt, Human
cugacaagaguggaaggaucaga

SEQ ID NO: 306313 - RNA, 23 nt, Human
gaaaauucagcauugcuggggca

SEQ ID NO: 306314 - RNA, 19 nt, Human
gaaugggggucugaaaaaa

SEQ ID NO: 306315 - RNA, 19 nt, Human
gagcgaacgccccuucucc

SEQ ID NO: 306316 - RNA, 19 nt, Human
gauacuuuccccuuucaca

SEQ ID NO: 306317 - RNA, 22 nt, Human
gcaugaagaaugggggucugaa

SEQ ID NO: 306318 - RNA, 19 nt, Human
gccaccuccccgcccccuc

SEQ ID NO: 306319 - RNA, 23 nt, Human
gcccccucccccucagcggccug

SEQ ID NO: 306320 - RNA, 21 nt, Human
gccuggcauggggaagaacuc

SEQ ID NO: 306321 - RNA, 21 nt, Human
gcugcugggaccuugcgccca

SEQ ID NO: 306322 - RNA, 21 nt, Human
guagcccccauuuccaacuuc

SEQ ID NO: 306323 - RNA, 19 nt, Human
guccugaggaaauuaagag

SEQ ID NO: 306324 - RNA, 18 nt, Human
gucucuuuacagaacccg

SEQ ID NO: 306325 - RNA, 21 nt, Human
uaaaaaacauggcagcaaaga

SEQ ID NO: 306326 - RNA, 21 nt, Human
uaaacagacagaagugucccc

SEQ ID NO: 306327 - RNA, 22 nt, Human
uaaagaggagcugcuucuggca

SEQ ID NO: 306328 - RNA, 20 nt, Human
uaaauuaugaaaaaaaaaua

SEQ ID NO: 306329 - RNA, 19 nt, Human
uaagaguccgguuccuagu

SEQ ID NO: 306330 - RNA, 23 nt, Human
uaccaggcccccuucuuccccug

SEQ ID NO: 306331 - RNA, 21 nt, Human
uagcagcccccucccccucag

SEQ ID NO: 306332 - RNA, 27 nt, Human
uagcagcccccucccccucagcggccu

SEQ ID NO: 306333 - RNA, 19 nt, Human
uaggaagggcuaugaucuc

SEQ ID NO: 306334 - RNA, 20 nt, Human
uagggauaaugugccagcua

SEQ ID NO: 306335 - RNA, 20 nt, Human
uaucaaggcagggugggaua

SEQ ID NO: 306336 - RNA, 21 nt, Human
uaucaaggcagggugggauag

SEQ ID NO: 306337 - RNA, 25 nt, Human
uaugaaaaaaaaauagcaagaauuc

SEQ ID NO: 306338 - RNA, 23 nt, Human
ucacagaagaguaagcuuaagcu

SEQ ID NO: 306339 - RNA, 22 nt, Human
ucacauuuagaaaaacaaccag

SEQ ID NO: 306340 - RNA, 23 nt, Human
ucagaaaaaaaaaagaagaagaa

SEQ ID NO: 306341 - RNA, 25 nt, Human
ucagaaaaaaaaaagaagaagaaag

SEQ ID NO: 306342 - RNA, 20 nt, Human
ucauaaacaccauggcucuu

SEQ ID NO: 306343 - RNA, 21 nt, Human
ucccaaaggagcgaacgcccc

SEQ ID NO: 306344 - RNA, 25 nt, Human
uccccaugaguuuaagaaaauauuu

SEQ ID NO: 306345 - RNA, 26 nt, Human
uccccaugaguuuaagaaaauauuug

SEQ ID NO: 306346 - RNA, 22 nt, Human
uccccgcccccuccgggccucc

SEQ ID NO: 306347 - RNA, 23 nt, Human
ucccuaagacccagcccucccuc

SEQ ID NO: 306348 - RNA, 21 nt, Human
uccuagucaaagacgagggga

SEQ ID NO: 306349 - RNA, 24 nt, Human
ucucccagcccauggcugccuccu

SEQ ID NO: 306350 - RNA, 19 nt, Human
ucuccccaugaguuuaaga

SEQ ID NO: 306351 - RNA, 21 nt, Human
ucuccguccuuccuaaccacg

SEQ ID NO: 306352 - RNA, 24 nt, Human
ucucugaggcacuaaggcccauuc

SEQ ID NO: 306353 - RNA, 23 nt, Human
ucugaaaaaaauucaauaguggg

SEQ ID NO: 306354 - RNA, 22 nt, Human
ugaaaaaaaaacgaggcaugaa

SEQ ID NO: 306355 - RNA, 23 nt, Human
ugaaaaaaaaacgaggcaugaaa

SEQ ID NO: 306356 - RNA, 21 nt, Human
ugaaaaaaauucaauagugga

SEQ ID NO: 306357 - RNA, 23 nt, Human
ugaaaauccguaccacccaacuc

SEQ ID NO: 306358 - RNA, 23 nt, Human
ugaagacagggggguaggacaua

SEQ ID NO: 306359 - RNA, 23 nt, Human
ugaccucaccaaggcaagaaucu

SEQ ID NO: 306360 - RNA, 24 nt, Human
ugagauaccaggcccccuucuucc

SEQ ID NO: 306361 - RNA, 23 nt, Human
ugaggaagaggaaggagagaagg

SEQ ID NO: 306362 - RNA, 24 nt, Human
ugaggaagaggaaggagagaaggu

SEQ ID NO: 306363 - RNA, 21 nt, Human
ugaggcacuaaggcccauuca

SEQ ID NO: 306364 - RNA, 18 nt, Human
uggaggagcagcuccccu

SEQ ID NO: 306365 - RNA, 20 nt, Human
uggaguggaggggaugcugc

SEQ ID NO: 306366 - RNA, 19 nt, Human
uggccaguugaaaauccgu

SEQ ID NO: 306367 - RNA, 20 nt, Human
ugggaggugguuaaacaccc

SEQ ID NO: 306368 - RNA, 18 nt, Human
ugggaucacagagauggc

SEQ ID NO: 306369 - RNA, 21 nt, Human
uggggaagaacucacgucccg

SEQ ID NO: 306370 - RNA, 23 nt, Human
uguaaaaaacauggcagcaaaga

SEQ ID NO: 306371 - RNA, 24 nt, Human
ugucccacucucuucauuccuuca

SEQ ID NO: 306372 - RNA, 22 nt, Human
uuaccuuagcuccacaaacagg

SEQ ID NO: 306373 - RNA, 24 nt, Human
uuagcagcccccucccccucagcg

SEQ ID NO: 306374 - RNA, 25 nt, Human
uucagaaaaaaaaaagaagaagaaa

SEQ ID NO: 306375 - RNA, 18 nt, Human
uucaggaagaagauggag

SEQ ID NO: 306376 - RNA, 21 nt, Human
uuccacaggggauacuuuccc

SEQ ID NO: 306377 - RNA, 18 nt, Human
uuccaggucuucugaggc

SEQ ID NO: 306378 - RNA, 27 nt, Human
uucccaacgucucuuuacagaacccgc

SEQ ID NO: 306379 - RNA, 22 nt, Human
uuccuucagccuuaagaaauuc

SEQ ID NO: 306380 - RNA, 22 nt, Human
uuccuuucccuaagacccagcc

SEQ ID NO: 306381 - RNA, 19 nt, Human
uucucuucauaaacaccau

SEQ ID NO: 306382 - RNA, 22 nt, Human
uucuucuucaggaagaagaugg

SEQ ID NO: 306383 - RNA, 21 nt, Human
uugcgcccagaccaagccaca

SEQ ID NO: 306384 - RNA, 19 nt, Human
uuggccaguugaaaauccg

SEQ ID NO: 306385 - RNA, 23 nt, Human
uugucaacacuucuggaguucug

SEQ ID NO: 306386 - RNA, 23 nt, Human
uuuaagaaaauauuugcuggccu

SEQ ID NO: 306387 - RNA, 21 nt, Human
uuugguaagucuucacauuua

SEQ ID NO: 306388 - RNA, 26 nt, Human
aaaauagcacuuccaacuccaaaaag

SEQ ID NO: 306389 - RNA, 22 nt, Human
aaacaacagagcugacuuuaca

SEQ ID NO: 306390 - RNA, 18 nt, Human
aacagagcuagucuuccc

SEQ ID NO: 306391 - RNA, 20 nt, Human
aagugaaggcagaccuagua

SEQ ID NO: 306392 - RNA, 20 nt, Human
acaaauauuucaaagacaau

SEQ ID NO: 306393 - RNA, 23 nt, Human
acccgggcagcauucgggugccu

SEQ ID NO: 306394 - RNA, 22 nt, Human
acuuccaacuccaaaaagguga

SEQ ID NO: 306395 - RNA, 18 nt, Human
agaaaaggcccucaaaug

SEQ ID NO: 306396 - RNA, 19 nt, Human
agacaauguauguacacga

SEQ ID NO: 306397 - RNA, 22 nt, Human
agagcugacuuuacaaaaguaa

SEQ ID NO: 306398 - RNA, 24 nt, Human
agcucugcugggccuuggcuuccc

SEQ ID NO: 306399 - RNA, 19 nt, Human
aguaaacagugaaaaaauc

SEQ ID NO: 306400 - RNA, 18 nt, Human
augcaguucuucacaguu

SEQ ID NO: 306401 - RNA, 22 nt, Human
caacugcuugcuguuuacagug

SEQ ID NO: 306402 - RNA, 21 nt, Human
cacaaugaaauaaugcaaaag

SEQ ID NO: 306403 - RNA, 18 nt, Human
caccagagaaaggucaca

SEQ ID NO: 306404 - RNA, 24 nt, Human
cagcaaaugauagaauagggagua

SEQ ID NO: 306405 - RNA, 25 nt, Human
cagcaagcaacagcaaaugauagaa

SEQ ID NO: 306406 - RNA, 22 nt, Human
cauugucgagaccguuuucuuu

SEQ ID NO: 306407 - RNA, 23 nt, Human
cauugucgagaccguuuucuuug

SEQ ID NO: 306408 - RNA, 21 nt, Human
cgcuaccaagaccaguugcgc

SEQ ID NO: 306409 - RNA, 18 nt, Human
cucauugucgagaccguu

SEQ ID NO: 306410 - RNA, 24 nt, Human
cugcagucacaucucagcucugcu

SEQ ID NO: 306411 - RNA, 18 nt, Human
cugggccuuggcuuccuc

SEQ ID NO: 306412 - RNA, 18 nt, Human
cuuugccagguuucuuuc

SEQ ID NO: 306413 - RNA, 18 nt, Human
gaagcaggaagagaaaag

SEQ ID NO: 306414 - RNA, 20 nt, Human
gaauagggaguauuuuucac

SEQ ID NO: 306415 - RNA, 19 nt, Human
gcuaccaagaccaguugcg

SEQ ID NO: 306416 - RNA, 21 nt, Human
gcuuccucaucucacccgggc

SEQ ID NO: 306417 - RNA, 22 nt, Human
ggaagagaaaaggcccucaaau

SEQ ID NO: 306418 - RNA, 24 nt, Human
ggacugggguuggacggcucugca

SEQ ID NO: 306419 - RNA, 22 nt, Human
gggcagcauucgggugccuccg

SEQ ID NO: 306420 - RNA, 19 nt, Human
ggguuggacggcucugcag

SEQ ID NO: 306421 - RNA, 19 nt, Human
uaaaacaacagagcugagg

SEQ ID NO: 306422 - RNA, 24 nt, Human
uaaugaaccaauuuaacuuucaau

SEQ ID NO: 306423 - RNA, 20 nt, Human
ucaacugcuugcuguuuaca

SEQ ID NO: 306424 - RNA, 21 nt, Human
ucacaggacugggguuggacg

SEQ ID NO: 306425 - RNA, 23 nt, Human
uccauaggaaaauagcacuucca

SEQ ID NO: 306426 - RNA, 23 nt, Human
ucccaucugcugaucagccuuaa

SEQ ID NO: 306427 - RNA, 24 nt, Human
ugaaaaaaucuuuauagaagcuag

SEQ ID NO: 306428 - RNA, 18 nt, Human
ugaaauaaugcaaaaguc

SEQ ID NO: 306429 - RNA, 22 nt, Human
ugaacuauaauuuugcaaaaga

SEQ ID NO: 306430 - RNA, 21 nt, Human
ugaaggcagaccuaguauauu

SEQ ID NO: 306431 - RNA, 26 nt, Human
ugagaacaaaauauuuuauuucucuc

SEQ ID NO: 306432 - RNA, 20 nt, Human
ugcagucacaucucagcucu

SEQ ID NO: 306433 - RNA, 19 nt, Human
ugcaugcacaaugaaauaa

SEQ ID NO: 306434 - RNA, 22 nt, Human
ugccauaacugugcucacgucu

SEQ ID NO: 306435 - RNA, 23 nt, Human
ugggccuuggcuuccucaucuca

SEQ ID NO: 306436 - RNA, 18 nt, Human
uggguggccuacucauug

SEQ ID NO: 306437 - RNA, 19 nt, Human
uguauguaguggggcucag

SEQ ID NO: 306438 - RNA, 23 nt, Human
ugugcucacgucucauccaugug

SEQ ID NO: 306439 - RNA, 26 nt, Human
uuaguagcaacagagcuagucuuccc

SEQ ID NO: 306440 - RNA, 24 nt, Human
uuaguagugauggguggccuacuc

SEQ ID NO: 306441 - RNA, 22 nt, Human
uucacaguucagcaagcaacag

SEQ ID NO: 306442 - RNA, 18 nt, Human
uuuguaaaugaaauggca

SEQ ID NO: 306443 - RNA, 19 nt, Human
uuuucuuugccagguuucu

SEQ ID NO: 306444 - RNA, 24 nt, Human
aaacacaaaucaaauauaaacacc

SEQ ID NO: 306445 - RNA, 25 nt, Human
aaauauaaacacaaaucaaauauaa

SEQ ID NO: 306446 - RNA, 23 nt, Human
aacuacuuucuaaagaacuuaac

SEQ ID NO: 306447 - RNA, 24 nt, Human
aagaaaaagggcauuucaaaauau

SEQ ID NO: 306448 - RNA, 20 nt, Human
acauaugccauaaaacugca

SEQ ID NO: 306449 - RNA, 21 nt, Human
agacaaaugcucacuuuaauc

SEQ ID NO: 306450 - RNA, 22 nt, Human
agagaacauaaucauaaaaugg

SEQ ID NO: 306451 - RNA, 24 nt, Human
aggugcuauaaacuagacaaagcu

SEQ ID NO: 306452 - RNA, 20 nt, Human
caaccaaacauuccuccugu

SEQ ID NO: 306453 - RNA, 23 nt, Human
caaccaaacauuccuccuguacc

SEQ ID NO: 306454 - RNA, 22 nt, Human
cauaugccauaaaacugcaacc

SEQ ID NO: 306455 - RNA, 26 nt, Human
ccagauaaaacugaacaacgggggcg

SEQ ID NO: 306456 - RNA, 25 nt, Human
cccaaccaaacauuccuccuguacc

SEQ ID NO: 306457 - RNA, 19 nt, Human
cucauugaagucuugaaga

SEQ ID NO: 306458 - RNA, 19 nt, Human
cugaaagaaauaagaaugu

SEQ ID NO: 306459 - RNA, 19 nt, Human
gcuaaaauacaaaacaucu

SEQ ID NO: 306460 - RNA, 21 nt, Human
uaaaacugacaacguagcuua

SEQ ID NO: 306461 - RNA, 18 nt, Human
uaaaauggcuagaggucc

SEQ ID NO: 306462 - RNA, 22 nt, Human
uaaacacaaaucaaauauaaac

SEQ ID NO: 306463 - RNA, 26 nt, Human
uaaacacaaaucaaauauaaacaccc

SEQ ID NO: 306464 - RNA, 19 nt, Human
uaacaaaaagugacuacuu

SEQ ID NO: 306465 - RNA, 24 nt, Human
uaacaaaaagugacuacuugaaga

SEQ ID NO: 306466 - RNA, 18 nt, Human
uaaggugcuauaaacuag

SEQ ID NO: 306467 - RNA, 19 nt, Human
uacaauaccugccucaaau

SEQ ID NO: 306468 - RNA, 22 nt, Human
uagaaaaacagaauacgcucuu

SEQ ID NO: 306469 - RNA, 22 nt, Human
uagaaaagaacagcaugugaug

SEQ ID NO: 306470 - RNA, 28 nt, Human
uauaaacacaaaucaaauauaaacaccc

SEQ ID NO: 306471 - RNA, 21 nt, Human
uaucaagaaaaagggcauuuc

SEQ ID NO: 306472 - RNA, 25 nt, Human
uaucauaauagggaugacuaaguac

SEQ ID NO: 306473 - RNA, 24 nt, Human
ucaaaguaaauucagaucuaagcu

SEQ ID NO: 306474 - RNA, 23 nt, Human
uccacuuuuauuaaagguuuuga

SEQ ID NO: 306475 - RNA, 20 nt, Human
ucucauaucauaauagggau

SEQ ID NO: 306476 - RNA, 22 nt, Human
ucucccaaccaaacauuccucc

SEQ ID NO: 306477 - RNA, 21 nt, Human
ucuucugaaagaaauaagaau

SEQ ID NO: 306478 - RNA, 20 nt, Human
ugaaagaaauaagaauguuu

SEQ ID NO: 306479 - RNA, 19 nt, Human
ugccauaaaacugcaacca

SEQ ID NO: 306480 - RNA, 19 nt, Human
ugcuauaaacuagacaaag

SEQ ID NO: 306481 - RNA, 20 nt, Human
ugguaucaagaaaaagggca

SEQ ID NO: 306482 - RNA, 23 nt, Human
uucucccaaccaaacauuccuuc

SEQ ID NO: 306483 - RNA, 21 nt, Human
uuuacagagaacauaaucaua

SEQ ID NO: 306484 - RNA, 21 nt, Human
uuuugacaaugaagauuucau

SEQ ID NO: 306485 - RNA, 18 nt, Human
uuuuuuuuuuuuuuuuug

SEQ ID NO: 306486 - RNA, 22 nt, Human
uuuuuuuuuuuuuuuuugauag

SEQ ID NO: 306487 - RNA, 24 nt, Human
ccgucaagggccucucccgacugc

SEQ ID NO: 306488 - RNA, 23 nt, Human
cgucaagggccucucccgacugc

SEQ ID NO: 306489 - RNA, 26 nt, Human
acgccacguaucucggaggagcaggc

SEQ ID NO: 306490 - RNA, 22 nt, Human
aggcuccugcacacgcgggcuc

SEQ ID NO: 306491 - RNA, 21 nt, Human
caauacugaagggcaucuaga

SEQ ID NO: 306492 - RNA, 25 nt, Human
ccccgccgcccucgccgcggucgcc

SEQ ID NO: 306493 - RNA, 23 nt, Human
ccccguggcccggcccggcccgg

SEQ ID NO: 306494 - RNA, 22 nt, Human
cccgcccggccucccgcccgcu

SEQ ID NO: 306495 - RNA, 20 nt, Human
ccgacgccgcccggagcugc

SEQ ID NO: 306496 - RNA, 25 nt, Human
ccgcccggccucccgcccgcugccc

SEQ ID NO: 306497 - RNA, 26 nt, Human
ccgcugcccgccggccgcucuccccg

SEQ ID NO: 306498 - RNA, 18 nt, Human
ccguccccgccgcccucg

SEQ ID NO: 306499 - RNA, 19 nt, Human
ccguccccgccgcccucgg

SEQ ID NO: 306500 - RNA, 25 nt, Human
ccucgucgccucucgcgccgcugcc

SEQ ID NO: 306501 - RNA, 20 nt, Human
ccucucgcgccgcugccgac

SEQ ID NO: 306502 - RNA, 25 nt, Human
cgaaaguugccugaagaaugggcac

SEQ ID NO: 306503 - RNA, 23 nt, Human
cgccgcgccggcuccugccgccc

SEQ ID NO: 306504 - RNA, 20 nt, Human
cgcggcccgcccggccuccc

SEQ ID NO: 306505 - RNA, 21 nt, Human
cggcucgguggcugcccgcgg

SEQ ID NO: 306506 - RNA, 18 nt, Human
cuauuuguucacaauacu

SEQ ID NO: 306507 - RNA, 23 nt, Human
cuuccuguugaccacugucuugc

SEQ ID NO: 306508 - RNA, 22 nt, Human
gaaauaaagguugggggaacac

SEQ ID NO: 306509 - RNA, 27 nt, Human
gaacacaauggagagagaccgguaccc

SEQ ID NO: 306510 - RNA, 18 nt, Human
ggaggagcaggcuccugc

SEQ ID NO: 306511 - RNA, 19 nt, Human
gggcaucuagaauuagcua

SEQ ID NO: 306512 - RNA, 19 nt, Human
guggcugcccgcggcccgc

SEQ ID NO: 306513 - RNA, 22 nt, Human
uccccguggcccggcccggccc

SEQ ID NO: 306514 - RNA, 24 nt, Human
ucgccgcgccggcuccugccgccc

SEQ ID NO: 306515 - RNA, 20 nt, Human
ucgccgcggucgccgcgccg

SEQ ID NO: 306516 - RNA, 20 nt, Human
ugcagaggggaaaggcggcu

SEQ ID NO: 306517 - RNA, 21 nt, Human
ugcccgccggccgcucucccc

SEQ ID NO: 306518 - RNA, 22 nt, Human
ugccugaagaaugggcacagaa

SEQ ID NO: 306519 - RNA, 19 nt, Human
uggcccggcccggcccggc

SEQ ID NO: 306520 - RNA, 19 nt, Human
ugggucuuccuguugacca

SEQ ID NO: 306521 - RNA, 24 nt, Human
ugucacuuggaaauaaagguuggg

SEQ ID NO: 306522 - RNA, 19 nt, Human
uugcaaaaagugcagaggg

SEQ ID NO: 306523 - RNA, 22 nt, Human
uugggggaacacacagaaaugg

SEQ ID NO: 306524 - RNA, 24 nt, Human
aaaagaagagaaaaauaauaaaag

SEQ ID NO: 306525 - RNA, 21 nt, Human
aaacaaguaaaaacuggccug

SEQ ID NO: 306526 - RNA, 23 nt, Human
aaacuguuccuaucucaaaguca

SEQ ID NO: 306527 - RNA, 24 nt, Human
aaagaagagaaaaauaauaaaagg

SEQ ID NO: 306528 - RNA, 18 nt, Human
aaauccaauaaaaaccag

SEQ ID NO: 306529 - RNA, 24 nt, Human
aaauccaauaaaaaccagaaauuu

SEQ ID NO: 306530 - RNA, 19 nt, Human
aacuggccuguaacuuugc

SEQ ID NO: 306531 - RNA, 23 nt, Human
acauacauauauacacacguggu

SEQ ID NO: 306532 - RNA, 24 nt, Human
acaugugggaaaacgaggagcagg

SEQ ID NO: 306533 - RNA, 23 nt, Human
accaaacacuuugcagacaauga

SEQ ID NO: 306534 - RNA, 25 nt, Human
acuaaaaaaaaauuuauaacagacu

SEQ ID NO: 306535 - RNA, 20 nt, Human
agaaaccgucaucuccauuu

SEQ ID NO: 306536 - RNA, 19 nt, Human
agaaagcugauaaaaaucu

SEQ ID NO: 306537 - RNA, 18 nt, Human
agacagagaaagcugaua

SEQ ID NO: 306538 - RNA, 23 nt, Human
auacaaaaauccaauaaaaacca

SEQ ID NO: 306539 - RNA, 21 nt, Human
auaugcacacauacauauagu

SEQ ID NO: 306540 - RNA, 22 nt, Human
augcacacauacauauauacac

SEQ ID NO: 306541 - RNA, 21 nt, Human
auugcagucaauuuguccauu

SEQ ID NO: 306542 - RNA, 23 nt, Human
caaaacaagacuccaugaagugc

SEQ ID NO: 306543 - RNA, 22 nt, Human
caacacugcaagauacugguca

SEQ ID NO: 306544 - RNA, 20 nt, Human
caacagugcccagagaguaa

SEQ ID NO: 306545 - RNA, 20 nt, Human
caagacuccaugaagugcua

SEQ ID NO: 306546 - RNA, 18 nt, Human
cacaagcacacaucuggg

SEQ ID NO: 306547 - RNA, 23 nt, Human
cacaagcacacaucugggaaacg

SEQ ID NO: 306548 - RNA, 19 nt, Human
caccgcacgcaggccagac

SEQ ID NO: 306549 - RNA, 21 nt, Human
caccgcacgcaggccagacuc

SEQ ID NO: 306550 - RNA, 18 nt, Human
cacuaacuauauccuauc

SEQ ID NO: 306551 - RNA, 18 nt, Human
cacucaucacuggcugcg

SEQ ID NO: 306552 - RNA, 18 nt, Human
cagauguccaccagucuc

SEQ ID NO: 306553 - RNA, 25 nt, Human
cauaugcacacauacauauauacac

SEQ ID NO: 306554 - RNA, 19 nt, Human
ccagacucacacugcaucu

SEQ ID NO: 306555 - RNA, 24 nt, Human
ccagcuaguauuacauugcaguca

SEQ ID NO: 306556 - RNA, 22 nt, Human
ccauccagaaauaaauaguuau

SEQ ID NO: 306557 - RNA, 25 nt, Human
ccucacagcugccgccgauaccacc

SEQ ID NO: 306558 - RNA, 21 nt, Human
ccucaccgcacgcaggccaga

SEQ ID NO: 306559 - RNA, 22 nt, Human
ccucgcaccaaacacuuugcag

SEQ ID NO: 306560 - RNA, 20 nt, Human
cuacuugagagcacauccca

SEQ ID NO: 306561 - RNA, 18 nt, Human
cuucaaaacaagacucca

SEQ ID NO: 306562 - RNA, 19 nt, Human
cuuccaggacugacagagg

SEQ ID NO: 306563 - RNA, 20 nt, Human
cuucccggaacccccucaca

SEQ ID NO: 306564 - RNA, 23 nt, Human
gcaccaaacacuuugcagacaau

SEQ ID NO: 306565 - RNA, 20 nt, Human
gcguguuuuaggagggacag

SEQ ID NO: 306566 - RNA, 18 nt, Human
gcuguaguuacagaaaac

SEQ ID NO: 306567 - RNA, 20 nt, Human
ggaacccccucacagcugcc

SEQ ID NO: 306568 - RNA, 21 nt, Human
ggggagggaugcaggacaugu

SEQ ID NO: 306569 - RNA, 24 nt, Human
gguuuuguugcugaggauaacagg

SEQ ID NO: 306570 - RNA, 25 nt, Human
gugauccuacacauccuuccuuguc

SEQ ID NO: 306571 - RNA, 21 nt, Human
uaaaaggcuauauauguuggu

SEQ ID NO: 306572 - RNA, 24 nt, Human
uaaaauacaaaaauccaauaaaaa

SEQ ID NO: 306573 - RNA, 21 nt, Human
uaaaucagaaaccgucaucuc

SEQ ID NO: 306574 - RNA, 24 nt, Human
uacaaaaauccaauaaaaaccaga

SEQ ID NO: 306575 - RNA, 18 nt, Human
uacaacagugcccagaga

SEQ ID NO: 306576 - RNA, 30 nt, Human
uacagacauaugcacacauacauauauaca

SEQ ID NO: 306577 - RNA, 21 nt, Human
uaguauuacauugcagucaau

SEQ ID NO: 306578 - RNA, 22 nt, Human
uauacagcuacagacauaugca

SEQ ID NO: 306579 - RNA, 20 nt, Human
uauauacacaagugugugua

SEQ ID NO: 306580 - RNA, 31 nt, Human
uauauacacacgugguugagaaccugugcag

SEQ ID NO: 306581 - RNA, 26 nt, Human
uauauacagcuacagacauaugcaca

SEQ ID NO: 306582 - RNA, 23 nt, Human
uauauuuccaacuuuucuacaca

SEQ ID NO: 306583 - RNA, 28 nt, Human
uauguacauauauacacaagugugugua

SEQ ID NO: 306584 - RNA, 18 nt, Human
uaugucuguauguacaua

SEQ ID NO: 306585 - RNA, 24 nt, Human
uaugucuguauguacauauauaca

SEQ ID NO: 306586 - RNA, 19 nt, Human
uauucagaaucuguccuga

SEQ ID NO: 306587 - RNA, 24 nt, Human
ucacuggcugcgcuuguuccccuc

SEQ ID NO: 306588 - RNA, 25 nt, Human
uccaacuuuucuacacagccuacaa

SEQ ID NO: 306589 - RNA, 24 nt, Human
uccacagcuugacauuuaugaaac

SEQ ID NO: 306590 - RNA, 23 nt, Human
uccaugcgccgggcucucauuuc

SEQ ID NO: 306591 - RNA, 23 nt, Human
ucuuacaacagugcccagagagu

SEQ ID NO: 306592 - RNA, 22 nt, Human
ugaaacauaccagcuaguauua

SEQ ID NO: 306593 - RNA, 20 nt, Human
ugaagaaauuuucuguggga

SEQ ID NO: 306594 - RNA, 19 nt, Human
ugacugcagggguuggcgu

SEQ ID NO: 306595 - RNA, 20 nt, Human
ugacuuaaaagaagagaaaa

SEQ ID NO: 306596 - RNA, 20 nt, Human
ugagagcacaucccacaguc

SEQ ID NO: 306597 - RNA, 21 nt, Human
ugauccuacacauccuuccuu

SEQ ID NO: 306598 - RNA, 24 nt, Human
ugcaguagugauccuacacauccu

SEQ ID NO: 306599 - RNA, 20 nt, Human
ugcauguguguguaucauca

SEQ ID NO: 306600 - RNA, 24 nt, Human
uggaacaccaaaaaauuuugaaga

SEQ ID NO: 306601 - RNA, 24 nt, Human
uggaacaccaaaaaauuuugaaga

SEQ ID NO: 306602 - RNA, 23 nt, Human
uggcguguuuuaggagggacagg

SEQ ID NO: 306603 - RNA, 24 nt, Human
ugggacuaaaaaaaaauuuauaac

SEQ ID NO: 306604 - RNA, 18 nt, Human
uguaucaucacaagcaca

SEQ ID NO: 306605 - RNA, 23 nt, Human
uguaucaucacaagcacacaucu

SEQ ID NO: 306606 - RNA, 23 nt, Human
ugugggagucuacugcuuauggg

SEQ ID NO: 306607 - RNA, 23 nt, Human
uguguguaucuggaucuguagcu

SEQ ID NO: 306608 - RNA, 18 nt, Human
uguguguguaucaucaca

SEQ ID NO: 306609 - RNA, 20 nt, Human
uucacaaaauuagcaauaau

SEQ ID NO: 306610 - RNA, 23 nt, Human
uuccaugugcgccuaagcucccu

SEQ ID NO: 306611 - RNA, 18 nt, Human
uuccucgcaccaaacacu

SEQ ID NO: 306612 - RNA, 23 nt, Human
uugaccuugauuacguaaacagu

SEQ ID NO: 306613 - RNA, 23 nt, Human
uuuuacuguaauuuacacaagag

SEQ ID NO: 306614 - RNA, 22 nt, Human
aaagcaaacacaaaaccaaccc

SEQ ID NO: 306615 - RNA, 21 nt, Human
aacccaacgcccgccccaaca

SEQ ID NO: 306616 - RNA, 21 nt, Human
aagcaaacacaaaaccaaccc

SEQ ID NO: 306617 - RNA, 24 nt, Human
aagcaaacacaaaaccaacgaguc

SEQ ID NO: 306618 - RNA, 24 nt, Human
aagcucaaggcugggguguucuga

SEQ ID NO: 306619 - RNA, 22 nt, Human
aaggcgcucucggccgggccua

SEQ ID NO: 306620 - RNA, 18 nt, Human
accacccgcgccaucccg

SEQ ID NO: 306621 - RNA, 28 nt, Human
accucccgccaggcccgcacugcccgcu

SEQ ID NO: 306622 - RNA, 23 nt, Human
agcaaacacaaaaccaacccgga

SEQ ID NO: 306623 - RNA, 22 nt, Human
agcgcacgcuaagcggcugccc

SEQ ID NO: 306624 - RNA, 19 nt, Human
aggcccgcacugcccgcug

SEQ ID NO: 306625 - RNA, 22 nt, Human
caaguccaggccccgcacaucc

SEQ ID NO: 306626 - RNA, 19 nt, Human
cacacacaccacccgcgcc

SEQ ID NO: 306627 - RNA, 20 nt, Human
cacacacaccacccgcgcca

SEQ ID NO: 306628 - RNA, 24 nt, Human
cacacacaccacccgcgccauccc

SEQ ID NO: 306629 - RNA, 19 nt, Human
caccguccccccaaaccca

SEQ ID NO: 306630 - RNA, 22 nt, Human
caccuccuagcccgggagcaga

SEQ ID NO: 306631 - RNA, 21 nt, Human
cagagugggguccggaaaagc

SEQ ID NO: 306632 - RNA, 23 nt, Human
ccaaacccaacgcccgccccaac

SEQ ID NO: 306633 - RNA, 20 nt, Human
ccaacgcccgccccaacacg

SEQ ID NO: 306634 - RNA, 22 nt, Human
ccacugagugcccgauccuggg

SEQ ID NO: 306635 - RNA, 21 nt, Human
ccagcgcggcgggggcgcggg

SEQ ID NO: 306636 - RNA, 18 nt, Human
cccaaacccaacgcccgc

SEQ ID NO: 306637 - RNA, 25 nt, Human
cccaacgcccgccccaacacggauc

SEQ ID NO: 306638 - RNA, 19 nt, Human
cccaccucccgccaggccc

SEQ ID NO: 306639 - RNA, 21 nt, Human
cccaccucccgccaggcccgc

SEQ ID NO: 306640 - RNA, 20 nt, Human
ccccaaacccaacgcccgcc

SEQ ID NO: 306641 - RNA, 26 nt, Human
ccccaaacccaacgcccgccccaaca

SEQ ID NO: 306642 - RNA, 19 nt, Human
ccccccaaacccaacgccc

SEQ ID NO: 306643 - RNA, 24 nt, Human
ccccccaaacccaacgcccgcccc

SEQ ID NO: 306644 - RNA, 21 nt, Human
cccggccgcugggccucggcc

SEQ ID NO: 306645 - RNA, 22 nt, Human
cccuccgcggagugggccuccg

SEQ ID NO: 306646 - RNA, 21 nt, Human
ccggagugggaagugggagga

SEQ ID NO: 306647 - RNA, 25 nt, Human
ccggggcugggcgcgcccgccgccu

SEQ ID NO: 306648 - RNA, 19 nt, Human
ccucccccggccgcugggc

SEQ ID NO: 306649 - RNA, 23 nt, Human
ccucccgccaggcccgcacugcc

SEQ ID NO: 306650 - RNA, 20 nt, Human
ccuccgcgcccgcgcccuuc

SEQ ID NO: 306651 - RNA, 19 nt, Human
ccugcagcuaagcucaagg

SEQ ID NO: 306652 - RNA, 19 nt, Human
cgcccgcgcccuuccccgc

SEQ ID NO: 306653 - RNA, 19 nt, Human
cgcgcccgcgcccuucccc

SEQ ID NO: 306654 - RNA, 18 nt, Human
cgcggcgcggugagcugg

SEQ ID NO: 306655 - RNA, 20 nt, Human
cgcgugcguccuccgcgccc

SEQ ID NO: 306656 - RNA, 21 nt, Human
cggcgcggugagcuggggcuu

SEQ ID NO: 306657 - RNA, 19 nt, Human
cggcgggcgcuccaggggc

SEQ ID NO: 306658 - RNA, 19 nt, Human
cgggcggugaggagggggc

SEQ ID NO: 306659 - RNA, 23 nt, Human
cugcccgcugucgcuccguggcc

SEQ ID NO: 306660 - RNA, 19 nt, Human
cugccggcucgacucuugc

SEQ ID NO: 306661 - RNA, 24 nt, Human
gaaaagcaaacacaaaaccaaccc

SEQ ID NO: 306662 - RNA, 25 nt, Human
gaaaagcaaacacaaaaccaacccg

SEQ ID NO: 306663 - RNA, 22 nt, Human
gagcagagcagagggccugggc

SEQ ID NO: 306664 - RNA, 19 nt, Human
gaggagggggcugcgcagg

SEQ ID NO: 306665 - RNA, 21 nt, Human
gauggaccucccccaccuccc

SEQ ID NO: 306666 - RNA, 18 nt, Human
gcgcggcgggggcgcggg

SEQ ID NO: 306667 - RNA, 18 nt, Human
gcgcgggccggagagcgg

SEQ ID NO: 306668 - RNA, 19 nt, Human
gcgcgggccggagagcggg

SEQ ID NO: 306669 - RNA, 20 nt, Human
gcggcgggggcgcgggauac

SEQ ID NO: 306670 - RNA, 18 nt, Human
gcgggcggugaggagggg

SEQ ID NO: 306671 - RNA, 24 nt, Human
ggaccucccccaccucccgccagg

SEQ ID NO: 306672 - RNA, 25 nt, Human
ggagagcgggugugcaaagugggcg

SEQ ID NO: 306673 - RNA, 23 nt, Human
ggagugggaagugggaggagggg

SEQ ID NO: 306674 - RNA, 23 nt, Human
ggagugggaagugggaggagggg

SEQ ID NO: 306675 - RNA, 22 nt, Human
ggcaccguccccccaaacccaa

SEQ ID NO: 306676 - RNA, 21 nt, Human
ggcugcgcaggugugaggucc

SEQ ID NO: 306677 - RNA, 20 nt, Human
gggaagugggaggagggggc

SEQ ID NO: 306678 - RNA, 21 nt, Human
ggggaccgcggcgggcgcucc

SEQ ID NO: 306679 - RNA, 20 nt, Human
ggggccgcgccccuugcucu

SEQ ID NO: 306680 - RNA, 23 nt, Human
gugggguccggaaaagcaaacac

SEQ ID NO: 306681 - RNA, 19 nt, Human
uaccaggcgcgccgggccg

SEQ ID NO: 306682 - RNA, 20 nt, Human
uaccgcgccgcgugcccucc

SEQ ID NO: 306683 - RNA, 19 nt, Human
uacgagguuguccuccccc

SEQ ID NO: 306684 - RNA, 22 nt, Human
uagacagauuuauuacagucag

SEQ ID NO: 306685 - RNA, 19 nt, Human
uagcccgggagcagagcag

SEQ ID NO: 306686 - RNA, 19 nt, Human
uccaguccgcaggcccggc

SEQ ID NO: 306687 - RNA, 23 nt, Human
uccccccaaacccaacgcccgcc

SEQ ID NO: 306688 - RNA, 24 nt, Human
uccgcaggcccggccgcucagucc

SEQ ID NO: 306689 - RNA, 21 nt, Human
uccggaaaagcaaacacaaaa

SEQ ID NO: 306690 - RNA, 18 nt, Human
uccggggcccgugggaac

SEQ ID NO: 306691 - RNA, 21 nt, Human
uccuaggcaaguccaggcccc

SEQ ID NO: 306692 - RNA, 23 nt, Human
uccuaggcaaguccaggccccgc

SEQ ID NO: 306693 - RNA, 23 nt, Human
ucugagauggaccucccccaccu

SEQ ID NO: 306694 - RNA, 18 nt, Human
ucuugcacggcgggcggu

SEQ ID NO: 306695 - RNA, 24 nt, Human
ucuuuuuggagggcagaguggggu

SEQ ID NO: 306696 - RNA, 20 nt, Human
ugagauggaccucccccacc

SEQ ID NO: 306697 - RNA, 25 nt, Human
ugcaaagugggcgcagggcccuggg

SEQ ID NO: 306698 - RNA, 18 nt, Human
uggaccucccccaccucc

SEQ ID NO: 306699 - RNA, 19 nt, Human
uggaccucccccaccuccc

SEQ ID NO: 306700 - RNA, 19 nt, Human
ugggaacacacacacacca

SEQ ID NO: 306701 - RNA, 18 nt, Human
ugggaggagggggcugcg

SEQ ID NO: 306702 - RNA, 21 nt, Human
ugggggcaccguccccccaau

SEQ ID NO: 306703 - RNA, 20 nt, Human
ugugcaaagugggcgcaggg

SEQ ID NO: 306704 - RNA, 21 nt, Human
uuuuuuuuuuuuuugucuuuu

SEQ ID NO: 306705 - RNA, 18 nt, Human
uuuuuuuuuuuuuuuuug

SEQ ID NO: 306706 - RNA, 25 nt, Human
uuuuuuuuuuuuuuuuuugucuuuu

SEQ ID NO: 306707 - RNA, 25 nt, Human
aaacaagagugggcaaagacccccu

SEQ ID NO: 306708 - RNA, 23 nt, Human
aaagcgaaacaagagugggcaaa

SEQ ID NO: 306709 - RNA, 21 nt, Human
aagcgaaacaagagugggcaa

SEQ ID NO: 306710 - RNA, 26 nt, Human
acacaggguagguuguacauagcagu

SEQ ID NO: 306711 - RNA, 31 nt, Human
acccccuucuucucucccucccucccccaag

SEQ ID NO: 306712 - RNA, 18 nt, Human
acccuccgcaacgcgcac

SEQ ID NO: 306713 - RNA, 24 nt, Human
accgcgcucugcccgccccccccc

SEQ ID NO: 306714 - RNA, 21 nt, Human
accuucuagcauaauucccag

SEQ ID NO: 306715 - RNA, 18 nt, Human
acucagagcgucuuuagg

SEQ ID NO: 306716 - RNA, 23 nt, Human
agacccccuucuucucucccucc

SEQ ID NO: 306717 - RNA, 21 nt, Human
agugacagggacagguaggug

SEQ ID NO: 306718 - RNA, 21 nt, Human
auugcauccaccagagaaacu

SEQ ID NO: 306719 - RNA, 21 nt, Human
caaacgaagacaugggaugug

SEQ ID NO: 306720 - RNA, 21 nt, Human
caacgcgcacacgcacacccc

SEQ ID NO: 306721 - RNA, 26 nt, Human
cacauuuguuucauauuugcugaaaa

SEQ ID NO: 306722 - RNA, 20 nt, Human
cagcagccgcugcagccacg

SEQ ID NO: 306723 - RNA, 22 nt, Human
caggcacccaggcgagcgacgg

SEQ ID NO: 306724 - RNA, 26 nt, Human
cagugguuuccuuuucucuauauagc

SEQ ID NO: 306725 - RNA, 21 nt, Human
ccagaucugcggcuccgcgcu

SEQ ID NO: 306726 - RNA, 23 nt, Human
cccccaagaaccccuccaauaag

SEQ ID NO: 306727 - RNA, 20 nt, Human
ccccccccacgcggcagccc

SEQ ID NO: 306728 - RNA, 20 nt, Human
cccccccccacgcggcagcc

SEQ ID NO: 306729 - RNA, 21 nt, Human
cccccguagccgccgcugccc

SEQ ID NO: 306730 - RNA, 21 nt, Human
cccccuucuucucucccuccc

SEQ ID NO: 306731 - RNA, 24 nt, Human
ccccucgggcggucgaacaggagc

SEQ ID NO: 306732 - RNA, 20 nt, Human
cccgccgaguucucaagcca

SEQ ID NO: 306733 - RNA, 22 nt, Human
cccgcuccgggucgcgcucucc

SEQ ID NO: 306734 - RNA, 19 nt, Human
ccgccgagcccccguagcc

SEQ ID NO: 306735 - RNA, 20 nt, Human
ccgcgcucugcccgcccccc

SEQ ID NO: 306736 - RNA, 21 nt, Human
ccgcgcucugcccgccccccc

SEQ ID NO: 306737 - RNA, 21 nt, Human
cgaccgcgcucugcccgcccc

SEQ ID NO: 306738 - RNA, 21 nt, Human
cgcccccccccacgcggcagc

SEQ ID NO: 306739 - RNA, 21 nt, Human
cgccgaccgcgcucugcccgc

SEQ ID NO: 306740 - RNA, 20 nt, Human
cgccgaguucucaagccaag

SEQ ID NO: 306741 - RNA, 22 nt, Human
cggcaagguccuaggaucccgg

SEQ ID NO: 306742 - RNA, 20 nt, Human
cggcagcccugacagagaag

SEQ ID NO: 306743 - RNA, 23 nt, Human
cuccuccggaaggcucaagcgaa

SEQ ID NO: 306744 - RNA, 18 nt, Human
cucugcccgccccccccc

SEQ ID NO: 306745 - RNA, 19 nt, Human
cucugcccgccccccccca

SEQ ID NO: 306746 - RNA, 24 nt, Human
gacacugaggacaucccuuugaaa

SEQ ID NO: 306747 - RNA, 25 nt, Human
gaccuucuagcauaauucccagucu

SEQ ID NO: 306748 - RNA, 20 nt, Human
gagcaggcuuccaagcucca

SEQ ID NO: 306749 - RNA, 24 nt, Human
gcgaaacaagagugggcaaagacc

SEQ ID NO: 306750 - RNA, 20 nt, Human
gcgcucugcccgcccccccc

SEQ ID NO: 306751 - RNA, 23 nt, Human
gcuaacgccgaccgcgcucugcc

SEQ ID NO: 306752 - RNA, 19 nt, Human
gcucugcccgccccccccc

SEQ ID NO: 306753 - RNA, 24 nt, Human
gcucugcccgcccccccccacgcg

SEQ ID NO: 306754 - RNA, 24 nt, Human
ggacgcaacccccgccgaguucuc

SEQ ID NO: 306755 - RNA, 25 nt, Human
ggacgcaacccccgccgaguucuca

SEQ ID NO: 306756 - RNA, 22 nt, Human
ggcggcagcagccgcugcagcc

SEQ ID NO: 306757 - RNA, 23 nt, Human
gggagagccaggggacgcaaccc

SEQ ID NO: 306758 - RNA, 22 nt, Human
uaauauguuagaaacauacagu

SEQ ID NO: 306759 - RNA, 22 nt, Human
uacacaggguagguuguacaua

SEQ ID NO: 306760 - RNA, 20 nt, Human
uagguuguacauagcaguuu

SEQ ID NO: 306761 - RNA, 21 nt, Human
uauaguaauguuaaaauguca

SEQ ID NO: 306762 - RNA, 25 nt, Human
uauguuagaaacauacaguguggca

SEQ ID NO: 306763 - RNA, 20 nt, Human
uauuuuacucccaugaaaua

SEQ ID NO: 306764 - RNA, 19 nt, Human
ucccccaagaaccccucca

SEQ ID NO: 306765 - RNA, 23 nt, Human
ucccucccucccccaagaacccc

SEQ ID NO: 306766 - RNA, 20 nt, Human
ucucuuucucucccuuucuu

SEQ ID NO: 306767 - RNA, 19 nt, Human
ucugagcgcacccuccgca

SEQ ID NO: 306768 - RNA, 22 nt, Human
ucuucucucccucccuccccca

SEQ ID NO: 306769 - RNA, 21 nt, Human
ugaaaaguaaaacaauaauau

SEQ ID NO: 306770 - RNA, 18 nt, Human
ugagcgcacccuccgcaa

SEQ ID NO: 306771 - RNA, 27 nt, Human
ugggaugugggcagaagggcaccacuc

SEQ ID NO: 306772 - RNA, 24 nt, Human
uguacauagcaguuucagaaacau

SEQ ID NO: 306773 - RNA, 18 nt, Human
ugucaagagugacaggga

SEQ ID NO: 306774 - RNA, 22 nt, Human
ugucagacacugaggacauccc

SEQ ID NO: 306775 - RNA, 25 nt, Human
uuaaaaaauaacaagcuuauaguaa

SEQ ID NO: 306776 - RNA, 27 nt, Human
uuaaagccuaaccuuuaaaaacacugu

SEQ ID NO: 306777 - RNA, 18 nt, Human
uucaagggcggaguugcc

SEQ ID NO: 306778 - RNA, 26 nt, Human
uucuucucucccucccucccccaaga

SEQ ID NO: 306779 - RNA, 22 nt, Human
uuguguauguguccuugcaacu

SEQ ID NO: 306780 - RNA, 19 nt, Human
uuucaagggcggaguugcc

SEQ ID NO: 306781 - RNA, 19 nt, Human
uuuuuuuuuuuuuuuuugu

SEQ ID NO: 306782 - RNA, 27 nt, Human
uuuuuuuuuuuuuuuuuuuuuuugggg

SEQ ID NO: 306783 - RNA, 22 nt, Human
agcuggucccugucgugacaca

SEQ ID NO: 306784 - RNA, 18 nt, Human
agggaggggaagccugga

SEQ ID NO: 306785 - RNA, 25 nt, Human
caaaaugaccccaguccgcggaggc

SEQ ID NO: 306786 - RNA, 18 nt, Human
caacaggcagacucccag

SEQ ID NO: 306787 - RNA, 23 nt, Human
cagcugcccaaacaccccuuuca

SEQ ID NO: 306788 - RNA, 19 nt, Human
caguagcggcggcugcggc

SEQ ID NO: 306789 - RNA, 21 nt, Human
caguagcggcggcugcggcgg

SEQ ID NO: 306790 - RNA, 22 nt, Human
ccaguagcggcggcugcggcuu

SEQ ID NO: 306791 - RNA, 19 nt, Human
ccagucaaaaugaccccag

SEQ ID NO: 306792 - RNA, 21 nt, Human
ccccccagcugcccaaacacc

SEQ ID NO: 306793 - RNA, 23 nt, Human
ccccccagcugcccaaacacccc

SEQ ID NO: 306794 - RNA, 18 nt, Human
ccccccugcucccgggcc

SEQ ID NO: 306795 - RNA, 21 nt, Human
ccccccugcucccgggccgcc

SEQ ID NO: 306796 - RNA, 19 nt, Human
cccccggggagcugguccc

SEQ ID NO: 306797 - RNA, 21 nt, Human
cccccggggagcuggucccug

SEQ ID NO: 306798 - RNA, 18 nt, Human
ccccggggagcugguccc

SEQ ID NO: 306799 - RNA, 19 nt, Human
ccggagugggggccgcccc

SEQ ID NO: 306800 - RNA, 24 nt, Human
cggagugggggccgccccccugcu

SEQ ID NO: 306801 - RNA, 22 nt, Human
cucccaguagcggcggcugcgg

SEQ ID NO: 306802 - RNA, 20 nt, Human
cucccgggccgccucuccgc

SEQ ID NO: 306803 - RNA, 22 nt, Human
gagaaggcgggaugggccaagg

SEQ ID NO: 306804 - RNA, 21 nt, Human
gagggcaggcaggggccaggg

SEQ ID NO: 306805 - RNA, 19 nt, Human
gcaacaggcagacucccag

SEQ ID NO: 306806 - RNA, 23 nt, Human
ggaggggaagccuggagaaggcg

SEQ ID NO: 306807 - RNA, 20 nt, Human
ggugaguuggcccccgggga

SEQ ID NO: 306808 - RNA, 20 nt, Human
ggugccccccagcugcccaa

SEQ ID NO: 306809 - RNA, 21 nt, Human
guagcggcggcugcggcggcg

SEQ ID NO: 306810 - RNA, 19 nt, Human
gucaaaaugaccccagucc

SEQ ID NO: 306811 - RNA, 21 nt, Human
ucagacccuggggcgggagca

SEQ ID NO: 306812 - RNA, 21 nt, Human
ucccgggccgccucuccgcuc

SEQ ID NO: 306813 - RNA, 24 nt, Human
ucccuguuccuggcuuuaguccca

SEQ ID NO: 306814 - RNA, 22 nt, Human
ugcccaaacaccccuuucagac

SEQ ID NO: 306815 - RNA, 23 nt, Human
ugcccaaacaccccuuucagacc

SEQ ID NO: 306816 - RNA, 24 nt, Human
ugcccccgcccucggggaugaucu

SEQ ID NO: 306817 - RNA, 23 nt, Human
ugggaggggaaggcccucuccug

SEQ ID NO: 306818 - RNA, 23 nt, Human
uuccuggcuuuagucccaggggc

SEQ ID NO: 306819 - RNA, 18 nt, Human
uuuuuuuuuuuuuuuuug

SEQ ID NO: 306820 - RNA, 22 nt, Human
uuuuuuuuuuuuuuuuugacag

SEQ ID NO: 306821 - RNA, 21 nt, Human
aaaaaaaugcucacaaaauau

SEQ ID NO: 306822 - RNA, 22 nt, Human
aaaaaaguaaauaaaagcuuaa

SEQ ID NO: 306823 - RNA, 20 nt, Human
aaaaaugcucacaaaauauc

SEQ ID NO: 306824 - RNA, 26 nt, Human
aaaauaaacaaaaaaaugcucacaaa

SEQ ID NO: 306825 - RNA, 24 nt, Human
aaaaucccaaagucauuucaaaaa

SEQ ID NO: 306826 - RNA, 20 nt, Human
aaauucaaaacagguaucuc

SEQ ID NO: 306827 - RNA, 18 nt, Human
acuugcucacuccugaaa

SEQ ID NO: 306828 - RNA, 23 nt, Human
agaaagauaacaguuaaaaaaaa

SEQ ID NO: 306829 - RNA, 22 nt, Human
aguaccuuuuaucuuuaagaua

SEQ ID NO: 306830 - RNA, 21 nt, Human
auaaacaaaaaaaugcucaca

SEQ ID NO: 306831 - RNA, 23 nt, Human
auaguaauguuaauauagagauu

SEQ ID NO: 306832 - RNA, 19 nt, Human
augagcugaaaccccaccu

SEQ ID NO: 306833 - RNA, 18 nt, Human
auuucuuggaccgcugcc

SEQ ID NO: 306834 - RNA, 21 nt, Human
caaaaaaaugcucacaaaaua

SEQ ID NO: 306835 - RNA, 21 nt, Human
ccccccugccaaauaaaaauc

SEQ ID NO: 306836 - RNA, 24 nt, Human
cccuucccaaguuucauccagaaa

SEQ ID NO: 306837 - RNA, 18 nt, Human
ccgcugcccucgcccuag

SEQ ID NO: 306838 - RNA, 22 nt, Human
ccggugaauagcaaugcuagaa

SEQ ID NO: 306839 - RNA, 24 nt, Human
ccucuuaucuccuuuaaauucaaa

SEQ ID NO: 306840 - RNA, 21 nt, Human
ccugguccuugcaccucagcc

SEQ ID NO: 306841 - RNA, 21 nt, Human
ccugguccuugcaccucagcc

SEQ ID NO: 306842 - RNA, 22 nt, Human
cggugaauagcaaugcuagaaa

SEQ ID NO: 306843 - RNA, 23 nt, Human
cucacaaaauaucuaugagaaac

SEQ ID NO: 306844 - RNA, 24 nt, Human
cuugcaccucagcccgaggccaac

SEQ ID NO: 306845 - RNA, 21 nt, Human
gcaaugcuagaaauaaaaugc

SEQ ID NO: 306846 - RNA, 18 nt, Human
uaaaaaaaucccaaaguc

SEQ ID NO: 306847 - RNA, 24 nt, Human
uaaaaaaaucccaaagucauuuca

SEQ ID NO: 306848 - RNA, 23 nt, Human
uaaauaaaagcuuaaaaaaaucc

SEQ ID NO: 306849 - RNA, 20 nt, Human
uacaaccuagccccccugcc

SEQ ID NO: 306850 - RNA, 25 nt, Human
uaccaaguaucuuauccacauuucu

SEQ ID NO: 306851 - RNA, 24 nt, Human
ucaugucccaguuccaaaacaaaa

SEQ ID NO: 306852 - RNA, 21 nt, Human
uccagaaagauaacaguuaaa

SEQ ID NO: 306853 - RNA, 21 nt, Human
ucccauacaaccuagcccccc

SEQ ID NO: 306854 - RNA, 28 nt, Human
ucuucaaaauaaacaaaaaaaugcucac

SEQ ID NO: 306855 - RNA, 18 nt, Human
ugagcugaaaccccaccu

SEQ ID NO: 306856 - RNA, 18 nt, Human
ugcaccucagcccgaggc

SEQ ID NO: 306857 - RNA, 23 nt, Human
ugcccucgcccuaguccuggucc

SEQ ID NO: 306858 - RNA, 19 nt, Human
uucuuuggacaauuuaaaa

SEQ ID NO: 306859 - RNA, 22 nt, Human
aaaaaaacagaaugcauagagg

SEQ ID NO: 306860 - RNA, 19 nt, Human
aaaaacagaaaagggagga

SEQ ID NO: 306861 - RNA, 27 nt, Human
aaacagaaaagggaggaaaagggaccc

SEQ ID NO: 306862 - RNA, 21 nt, Human
aaacauccaacacaccaguaa

SEQ ID NO: 306863 - RNA, 27 nt, Human
aaacauccaacacaccaguaaccucac

SEQ ID NO: 306864 - RNA, 26 nt, Human
aaaggacacaacgagcagcagcugcg

SEQ ID NO: 306865 - RNA, 25 nt, Human
aaccacucccuuccucucccuucca

SEQ ID NO: 306866 - RNA, 20 nt, Human
aacucgugcaacguaauccu

SEQ ID NO: 306867 - RNA, 25 nt, Human
aagaaaaacagaaaagggaggaaaa

SEQ ID NO: 306868 - RNA, 20 nt, Human
aagaagaaaaacagaaaaga

SEQ ID NO: 306869 - RNA, 20 nt, Human
aagaagaaaaacagaaaagg

SEQ ID NO: 306870 - RNA, 20 nt, Human
aagggagggggcgagguccc

SEQ ID NO: 306871 - RNA, 21 nt, Human
aaugcauagaagggggaggga

SEQ ID NO: 306872 - RNA, 18 nt, Human
aauuaaacauccaacaca

SEQ ID NO: 306873 - RNA, 19 nt, Human
agaaaagggaggaaaaaaa

SEQ ID NO: 306874 - RNA, 19 nt, Human
agaagaaaaacagaaaagg

SEQ ID NO: 306875 - RNA, 24 nt, Human
agaagaaaaacagaaaagggaggg

SEQ ID NO: 306876 - RNA, 24 nt, Human
aggaaaaaaacagaaugcauagaa

SEQ ID NO: 306877 - RNA, 18 nt, Human
agggagggggcgaggucc

SEQ ID NO: 306878 - RNA, 22 nt, Human
agggagggggcgaggucccuga

SEQ ID NO: 306879 - RNA, 23 nt, Human
aguaaccucacuuaacugaaggc

SEQ ID NO: 306880 - RNA, 23 nt, Human
caaaggacacaacgagcagcagc

SEQ ID NO: 306881 - RNA, 23 nt, Human
caaauccucccaaccaccacuug

SEQ ID NO: 306882 - RNA, 26 nt, Human
caacacaccaguaaccucacuuaacu

SEQ ID NO: 306883 - RNA, 21 nt, Human
caaccaccacuuggauaaugc

SEQ ID NO: 306884 - RNA, 22 nt, Human
cacucccuuccucucccuucca

SEQ ID NO: 306885 - RNA, 20 nt, Human
cacuuguuauucaaacaacu

SEQ ID NO: 306886 - RNA, 18 nt, Human
cagcggcaauuucuccag

SEQ ID NO: 306887 - RNA, 21 nt, Human
cagcggcaauuucuccagcgg

SEQ ID NO: 306888 - RNA, 19 nt, Human
caguaaccucacuuaacug

SEQ ID NO: 306889 - RNA, 19 nt, Human
cccacuccaugucgguggu

SEQ ID NO: 306890 - RNA, 18 nt, Human
cccccgccuucccucucc

SEQ ID NO: 306891 - RNA, 23 nt, Human
cccccuucuucacaccccugggc

SEQ ID NO: 306892 - RNA, 20 nt, Human
ccccgccuucccucuccucu

SEQ ID NO: 306893 - RNA, 21 nt, Human
ccccgccuucccucuccucuc

SEQ ID NO: 306894 - RNA, 21 nt, Human
cccgacaccgcaccgcggccg

SEQ ID NO: 306895 - RNA, 20 nt, Human
cccugggcucagcgaggcuc

SEQ ID NO: 306896 - RNA, 24 nt, Human
cccugggcucagcgaggcuccucc

SEQ ID NO: 306897 - RNA, 22 nt, Human
cccuuccucucccuuccagccc

SEQ ID NO: 306898 - RNA, 25 nt, Human
ccgcggccgccgcccggaggcuccc

SEQ ID NO: 306899 - RNA, 18 nt, Human
ccgggaagaagaaaaaca

SEQ ID NO: 306900 - RNA, 20 nt, Human
ccucggcucggagcacgcca

SEQ ID NO: 306901 - RNA, 21 nt, Human
ccucucgccgucgcgcccugg

SEQ ID NO: 306902 - RNA, 19 nt, Human
ccugaagcagccccucggc

SEQ ID NO: 306903 - RNA, 21 nt, Human
ccuuccagcccucccccgccu

SEQ ID NO: 306904 - RNA, 20 nt, Human
ccuucccucuccucucgccg

SEQ ID NO: 306905 - RNA, 23 nt, Human
cgcccgagcccacuccaugucgg

SEQ ID NO: 306906 - RNA, 19 nt, Human
cgccgcgcgggcagagagc

SEQ ID NO: 306907 - RNA, 18 nt, Human
cgcggccggggguggaag

SEQ ID NO: 306908 - RNA, 20 nt, Human
cggaggcucccgacgcccca

SEQ ID NO: 306909 - RNA, 21 nt, Human
cggccggggguggaaggcggg

SEQ ID NO: 306910 - RNA, 22 nt, Human
cggccggggguggaaggcgggc

SEQ ID NO: 306911 - RNA, 21 nt, Human
cggcggcgcgggcggcucugg

SEQ ID NO: 306912 - RNA, 18 nt, Human
cggcucccaaccacuccc

SEQ ID NO: 306913 - RNA, 22 nt, Human
cgggcugcgggcggcacuggca

SEQ ID NO: 306914 - RNA, 23 nt, Human
cuccaugucgguggucgcucgug

SEQ ID NO: 306915 - RNA, 20 nt, Human
cucccccgccuucccucucc

SEQ ID NO: 306916 - RNA, 18 nt, Human
cucccggcuucacccuag

SEQ ID NO: 306917 - RNA, 20 nt, Human
cucccuuccucucccuucca

SEQ ID NO: 306918 - RNA, 20 nt, Human
cuggugcugaauuaaacauc

SEQ ID NO: 306919 - RNA, 27 nt, Human
cuggugcugaauuaaacauccaacuga

SEQ ID NO: 306920 - RNA, 25 nt, Human
gaagaaaaacagaaaagggaggaaa

SEQ ID NO: 306921 - RNA, 20 nt, Human
gaagaagaaaaacagaaaag

SEQ ID NO: 306922 - RNA, 19 nt, Human
gaggcggcuuuucguuucu

SEQ ID NO: 306923 - RNA, 21 nt, Human
gaggcggcuuuucguuucucc

SEQ ID NO: 306924 - RNA, 20 nt, Human
gauuucugcugguuuuccuu

SEQ ID NO: 306925 - RNA, 21 nt, Human
gcccacuccaugucggugguc

SEQ ID NO: 306926 - RNA, 19 nt, Human
gcccucccccgccuucccu

SEQ ID NO: 306927 - RNA, 21 nt, Human
ggaagaagaaaaacagaaaag

SEQ ID NO: 306928 - RNA, 23 nt, Human
ggaagaagaaaaacagaaaaggg

SEQ ID NO: 306929 - RNA, 18 nt, Human
ggacacaacgagcagcag

SEQ ID NO: 306930 - RNA, 25 nt, Human
ggcggcggcgcgggcggcucuggca

SEQ ID NO: 306931 - RNA, 20 nt, Human
ggcucggagcacgccaaguc

SEQ ID NO: 306932 - RNA, 23 nt, Human
gggaagaagaaaaacagaaaagg

SEQ ID NO: 306933 - RNA, 21 nt, Human
gggagggggcgaggucccuga

SEQ ID NO: 306934 - RNA, 23 nt, Human
gucccgcgcacagaggcggaggc

SEQ ID NO: 306935 - RNA, 19 nt, Human
guccuucuuucuuuaaggc

SEQ ID NO: 306936 - RNA, 19 nt, Human
gucgcgcccugggcucagc

SEQ ID NO: 306937 - RNA, 24 nt, Human
uaaaaaaaaaaaaaaacucuucuc

SEQ ID NO: 306938 - RNA, 21 nt, Human
uaaacauccaacacaccagua

SEQ ID NO: 306939 - RNA, 23 nt, Human
uaacugaaggcgucuucaauuuc

SEQ ID NO: 306940 - RNA, 19 nt, Human
ucaaaggacacaacgagca

SEQ ID NO: 306941 - RNA, 23 nt, Human
ucacuucccgggaagaagaaaaa

SEQ ID NO: 306942 - RNA, 21 nt, Human
ucaugcaaugcuggugcugaa

SEQ ID NO: 306943 - RNA, 18 nt, Human
ucauucaaaauucaacuc

SEQ ID NO: 306944 - RNA, 19 nt, Human
uccacagcgaggagggagg

SEQ ID NO: 306945 - RNA, 18 nt, Human
ucccaaccacucccuucc

SEQ ID NO: 306946 - RNA, 19 nt, Human
ucccccgccuucccucucc

SEQ ID NO: 306947 - RNA, 23 nt, Human
ucccccuucuucacaccccuggg

SEQ ID NO: 306948 - RNA, 18 nt, Human
ucccgagguccuucuuuc

SEQ ID NO: 306949 - RNA, 22 nt, Human
ucccggcuucacccuagggccu

SEQ ID NO: 306950 - RNA, 23 nt, Human
ucccugaagcagccccucggcuc

SEQ ID NO: 306951 - RNA, 23 nt, Human
ucccuuccucucccuuccagccc

SEQ ID NO: 306952 - RNA, 24 nt, Human
uccgcggcugaggagacuagaggc

SEQ ID NO: 306953 - RNA, 20 nt, Human
uccuucuuucuuuaaggcuu

SEQ ID NO: 306954 - RNA, 21 nt, Human
ucugaaccuaaauuuuaaaag

SEQ ID NO: 306955 - RNA, 24 nt, Human
ucuucaauuucacccauauacaua

SEQ ID NO: 306956 - RNA, 20 nt, Human
ucuuuaaaaaaaaaaaaaaa

SEQ ID NO: 306957 - RNA, 22 nt, Human
ugaauuaaacauccaacacacc

SEQ ID NO: 306958 - RNA, 21 nt, Human
ugcaaauccucccaaccacca

SEQ ID NO: 306959 - RNA, 24 nt, Human
ugcaaauccucccaaccaccacuu

SEQ ID NO: 306960 - RNA, 18 nt, Human
uuaaugcauuuuuaaaag

SEQ ID NO: 306961 - RNA, 21 nt, Human
uucaaacaacugucaugcaau

SEQ ID NO: 306962 - RNA, 23 nt, Human
uuccagcccucccccgccuuccc

SEQ ID NO: 306963 - RNA, 21 nt, Human
uucccgggaagaagaaaaaca

SEQ ID NO: 306964 - RNA, 19 nt, Human
uugcugcaaauccucccaa

SEQ ID NO: 306965 - RNA, 22 nt, Human
acagacagacagaugccccugc

SEQ ID NO: 306966 - RNA, 21 nt, Human
acgccaccacaccuaccaagc

SEQ ID NO: 306967 - RNA, 24 nt, Human
agacagaugccccugccugcucuc

SEQ ID NO: 306968 - RNA, 25 nt, Human
agaccugaugccagcaggccugggc

SEQ ID NO: 306969 - RNA, 24 nt, Human
aggggacccuggguccugguuggc

SEQ ID NO: 306970 - RNA, 19 nt, Human
aggggcaggguggcggcgg

SEQ ID NO: 306971 - RNA, 22 nt, Human
caagcucgcauccaagcagcag

SEQ ID NO: 306972 - RNA, 18 nt, Human
cagcagccuuagcagugg

SEQ ID NO: 306973 - RNA, 18 nt, Human
cagcccccaggaggaguc

SEQ ID NO: 306974 - RNA, 22 nt, Human
cagcccuagugaaaauagugac

SEQ ID NO: 306975 - RNA, 21 nt, Human
cagcucugggcgcaggccccu

SEQ ID NO: 306976 - RNA, 21 nt, Human
cagucaccuuccuccacccug

SEQ ID NO: 306977 - RNA, 23 nt, Human
cccacagaagugguacacagaag

SEQ ID NO: 306978 - RNA, 21 nt, Human
cccacagacagacagaugccc

SEQ ID NO: 306979 - RNA, 22 nt, Human
cccacagacagacagaugcccc

SEQ ID NO: 306980 - RNA, 23 nt, Human
cccacccccgccaggaaggagga

SEQ ID NO: 306981 - RNA, 19 nt, Human
ccccaggaggagucuuuuc

SEQ ID NO: 306982 - RNA, 24 nt, Human
ccccgccguccccaggcccgcccg

SEQ ID NO: 306983 - RNA, 21 nt, Human
ccccucagcccuagugaaaau

SEQ ID NO: 306984 - RNA, 18 nt, Human
cccugaagccagcagccu

SEQ ID NO: 306985 - RNA, 20 nt, Human
ccgcagcucaggcggggccc

SEQ ID NO: 306986 - RNA, 21 nt, Human
ccgccguccccaggcccgccc

SEQ ID NO: 306987 - RNA, 25 nt, Human
ccuggcccucggccuugacagcggc

SEQ ID NO: 306988 - RNA, 20 nt, Human
cgacuccacggcccaccccc

SEQ ID NO: 306989 - RNA, 23 nt, Human
cgagggccuugaggcugccuggg

SEQ ID NO: 306990 - RNA, 20 nt, Human
cgcacacacacacacacaca

SEQ ID NO: 306991 - RNA, 20 nt, Human
cgugcagccauucugccugg

SEQ ID NO: 306992 - RNA, 21 nt, Human
cuccacccugggagccagccc

SEQ ID NO: 306993 - RNA, 22 nt, Human
cugcuuggugcggggguugggg

SEQ ID NO: 306994 - RNA, 22 nt, Human
gagacggugcagggaguacggu

SEQ ID NO: 306995 - RNA, 23 nt, Human
gagcgacgcccgcucggggcucg

SEQ ID NO: 306996 - RNA, 21 nt, Human
gcagcgcgcgcauggccccgc

SEQ ID NO: 306997 - RNA, 18 nt, Human
gcaggcuaacccucccug

SEQ ID NO: 306998 - RNA, 19 nt, Human
gcccccagcaccggcccaa

SEQ ID NO: 306999 - RNA, 21 nt, Human
gcccccaggaggagucuuuuc

SEQ ID NO: 307000 - RNA, 19 nt, Human
gccuggcccucggccuuga

SEQ ID NO: 307001 - RNA, 24 nt, Human
gcgcgcacacacacacacacacag

SEQ ID NO: 307002 - RNA, 19 nt, Human
gcgggcgcggggcuggaug

SEQ ID NO: 307003 - RNA, 19 nt, Human
gcggggguugggggggugu

SEQ ID NO: 307004 - RNA, 31 nt, Human
gcgucgcgcgcgcacacacacacacacacag

SEQ ID NO: 307005 - RNA, 19 nt, Human
gcucggggccaggccgcuc

SEQ ID NO: 307006 - RNA, 18 nt, Human
ggaggggacccugggucc

SEQ ID NO: 307007 - RNA, 18 nt, Human
ggcauggcgggcgcgggg

SEQ ID NO: 307008 - RNA, 18 nt, Human
ggcccaaggccaagcucg

SEQ ID NO: 307009 - RNA, 26 nt, Human
ggggaggggacccuggguccugguug

SEQ ID NO: 307010 - RNA, 20 nt, Human
ggggcaggguggcggcggug

SEQ ID NO: 307011 - RNA, 20 nt, Human
gggggaggccagcucugggc

SEQ ID NO: 307012 - RNA, 19 nt, Human
guccugcuacuugcccaga

SEQ ID NO: 307013 - RNA, 22 nt, Human
guccugcuacuugcccagaccu

SEQ ID NO: 307014 - RNA, 20 nt, Human
uaacuuaggggcaggguggc

SEQ ID NO: 307015 - RNA, 23 nt, Human
uacacagaagcaggcacagccag

SEQ ID NO: 307016 - RNA, 21 nt, Human
uccacccugggagccagcccc

SEQ ID NO: 307017 - RNA, 21 nt, Human
uccacuccgacuccacggccc

SEQ ID NO: 307018 - RNA, 18 nt, Human
ucgcauccaagcagcagc

SEQ ID NO: 307019 - RNA, 20 nt, Human
ucggggcucggggccaggcc

SEQ ID NO: 307020 - RNA, 19 nt, Human
ucucagaggcuagaaaccu

SEQ ID NO: 307021 - RNA, 23 nt, Human
ucucuugcuaccuggccuggggc

SEQ ID NO: 307022 - RNA, 18 nt, Human
ugcagccauucugccugg

SEQ ID NO: 307023 - RNA, 23 nt, Human
ugcccccagcaccggcccaaggc

SEQ ID NO: 307024 - RNA, 25 nt, Human
ugcggggguugggggggugucgagg

SEQ ID NO: 307025 - RNA, 18 nt, Human
uggauggggcugcgcggc

SEQ ID NO: 307026 - RNA, 19 nt, Human
uggcagacagcugugcccc

SEQ ID NO: 307027 - RNA, 20 nt, Human
uggguccugguuggccacac

SEQ ID NO: 307028 - RNA, 21 nt, Human
uggugcggggguugggggggu

SEQ ID NO: 307029 - RNA, 18 nt, Human
ugucugcuuggugcgggg

SEQ ID NO: 307030 - RNA, 18 nt, Human
uguguccuucccaaggga

SEQ ID NO: 307031 - RNA, 26 nt, Human
aaaaacaguacaauaaaaaguaucau

SEQ ID NO: 307032 - RNA, 18 nt, Human
aaaauaaauuaaagugca

SEQ ID NO: 307033 - RNA, 20 nt, Human
aaacuuacagaaacccagua

SEQ ID NO: 307034 - RNA, 22 nt, Human
aaagagacuuucuagugaccau

SEQ ID NO: 307035 - RNA, 24 nt, Human
aaagugcugggauuacaggcguga

SEQ ID NO: 307036 - RNA, 19 nt, Human
aaaugaacauaauuguugg

SEQ ID NO: 307037 - RNA, 25 nt, Human
aaguaaagauagagaugaagccaug

SEQ ID NO: 307038 - RNA, 19 nt, Human
aagugcugggauuacaggc

SEQ ID NO: 307039 - RNA, 19 nt, Human
aagugcugggauuacaggc

SEQ ID NO: 307040 - RNA, 26 nt, Human
aagugcugggauuacaggcgugagcc

SEQ ID NO: 307041 - RNA, 19 nt, Human
aaugucaccuuacucaaca

SEQ ID NO: 307042 - RNA, 18 nt, Human
accaaaugcuuuaugaau

SEQ ID NO: 307043 - RNA, 19 nt, Human
acugaucuuuggugguuuu

SEQ ID NO: 307044 - RNA, 21 nt, Human
acuugaguacuauauuuuuua

SEQ ID NO: 307045 - RNA, 22 nt, Human
agaaaacaguguugcuaacuca

SEQ ID NO: 307046 - RNA, 18 nt, Human
agaaaggaggaauucugc

SEQ ID NO: 307047 - RNA, 20 nt, Human
aggccauggggccagagaug

SEQ ID NO: 307048 - RNA, 22 nt, Human
agggaggggccuuggaaauagc

SEQ ID NO: 307049 - RNA, 24 nt, Human
agggaggggccuuggaaauagcuc

SEQ ID NO: 307050 - RNA, 18 nt, Human
agugcugggauuacaggc

SEQ ID NO: 307051 - RNA, 22 nt, Human
aguuagucccacagacaucaga

SEQ ID NO: 307052 - RNA, 18 nt, Human
auaaagaacuuuguguag

SEQ ID NO: 307053 - RNA, 19 nt, Human
auaauagggaagagaugag

SEQ ID NO: 307054 - RNA, 23 nt, Human
auagcuccccccaccccacuccc

SEQ ID NO: 307055 - RNA, 18 nt, Human
aucaaggccauggggcca

SEQ ID NO: 307056 - RNA, 20 nt, Human
augaacuuuuaauaccaaaa

SEQ ID NO: 307057 - RNA, 21 nt, Human
augcaaacuuuaguauguagu

SEQ ID NO: 307058 - RNA, 19 nt, Human
auuagacugagcuccauuu

SEQ ID NO: 307059 - RNA, 24 nt, Human
caaagugcugggauuacaggcgug

SEQ ID NO: 307060 - RNA, 19 nt, Human
caagaauacuugaguacua

SEQ ID NO: 307061 - RNA, 22 nt, Human
caagugauucgccuguuucggc

SEQ ID NO: 307062 - RNA, 19 nt, Human
cacacagauucuaucauag

SEQ ID NO: 307063 - RNA, 22 nt, Human
cacacauacugaaacacacaua

SEQ ID NO: 307064 - RNA, 24 nt, Human
caccccacuccccacgugucccau

SEQ ID NO: 307065 - RNA, 26 nt, Human
cacuccccacgugucccauccaguuu

SEQ ID NO: 307066 - RNA, 23 nt, Human
cagcuuauucaaauuagagccaa

SEQ ID NO: 307067 - RNA, 24 nt, Human
cagcuuauucaaauuagagccaaa

SEQ ID NO: 307068 - RNA, 23 nt, Human
cauggucgauacacauggauacc

SEQ ID NO: 307069 - RNA, 25 nt, Human
cauguaacaacaugguacauauaca

SEQ ID NO: 307070 - RNA, 20 nt, Human
ccaaagugcugggauuacag

SEQ ID NO: 307071 - RNA, 22 nt, Human
ccaaagugcugggauuacaggc

SEQ ID NO: 307072 - RNA, 22 nt, Human
ccaaagugcugggauuacaggc

SEQ ID NO: 307073 - RNA, 24 nt, Human
ccaaagugcugggauuacaggcgu

SEQ ID NO: 307074 - RNA, 19 nt, Human
ccagaguggaaaggaaugc

SEQ ID NO: 307075 - RNA, 24 nt, Human
ccauguuggucuugaacuccuggg

SEQ ID NO: 307076 - RNA, 19 nt, Human
cccacgugucccauccagu

SEQ ID NO: 307077 - RNA, 18 nt, Human
ccccacgugucccaucca

SEQ ID NO: 307078 - RNA, 19 nt, Human
ccccccaccccacucccca

SEQ ID NO: 307079 - RNA, 20 nt, Human
ccccccaccccacuccccac

SEQ ID NO: 307080 - RNA, 21 nt, Human
ccugggcucaagugauucgcc

SEQ ID NO: 307081 - RNA, 22 nt, Human
ccugggcucaagugauucgccu

SEQ ID NO: 307082 - RNA, 23 nt, Human
ccugggcucaagugauucgccug

SEQ ID NO: 307083 - RNA, 22 nt, Human
ccuguuucggccucccaaagug

SEQ ID NO: 307084 - RNA, 22 nt, Human
cgccacauugcccauguugguc

SEQ ID NO: 307085 - RNA, 21 nt, Human
cucaaaaugucaccuuacuca

SEQ ID NO: 307086 - RNA, 24 nt, Human
cucaaaaugucaccuuacucaaca

SEQ ID NO: 307087 - RNA, 19 nt, Human
cucaagugauucgccuguu

SEQ ID NO: 307088 - RNA, 22 nt, Human
cucaauauuuacaccuagauuu

SEQ ID NO: 307089 - RNA, 20 nt, Human
cuccugggcucaagugauuc

SEQ ID NO: 307090 - RNA, 23 nt, Human
cuguuucggccucccaaagugcu

SEQ ID NO: 307091 - RNA, 21 nt, Human
gaaaaacaguacaauaaaaag

SEQ ID NO: 307092 - RNA, 18 nt, Human
gaaacagggaggggccuu

SEQ ID NO: 307093 - RNA, 19 nt, Human
gaaaggaggaauucugcaa

SEQ ID NO: 307094 - RNA, 19 nt, Human
gacaacuuagggcuccuuc

SEQ ID NO: 307095 - RNA, 19 nt, Human
gacaggauucucuugguuc

SEQ ID NO: 307096 - RNA, 21 nt, Human
gacuagcauccuaugguggaa

SEQ ID NO: 307097 - RNA, 22 nt, Human
gagaugccauuuuauccuauaa

SEQ ID NO: 307098 - RNA, 20 nt, Human
gauaauagggaagagaugag

SEQ ID NO: 307099 - RNA, 24 nt, Human
gauuacaggcgugagccgucauac

SEQ ID NO: 307100 - RNA, 20 nt, Human
gcagcagcuggacgagggca

SEQ ID NO: 307101 - RNA, 25 nt, Human
gccagaguggaaaggaaugccccag

SEQ ID NO: 307102 - RNA, 22 nt, Human
gcuccccccaccccacucccca

SEQ ID NO: 307103 - RNA, 19 nt, Human
gcuggacgagggcacagga

SEQ ID NO: 307104 - RNA, 24 nt, Human
ggaaacagggaggggccuuggaaa

SEQ ID NO: 307105 - RNA, 24 nt, Human
gggaguucuccaugacuaaagaag

SEQ ID NO: 307106 - RNA, 21 nt, Human
gggcagcagcuggacgagggc

SEQ ID NO: 307107 - RNA, 19 nt, Human
gggcucaagugauucgccu

SEQ ID NO: 307108 - RNA, 22 nt, Human
guaccgcucaauacacaucaug

SEQ ID NO: 307109 - RNA, 24 nt, Human
uaaaaugaacauaauuguuggaua

SEQ ID NO: 307110 - RNA, 18 nt, Human
uaagugauacaguuaguc

SEQ ID NO: 307111 - RNA, 18 nt, Human
uacaauaaaaaguaucau

SEQ ID NO: 307112 - RNA, 18 nt, Human
uacaccuagauuucuuau

SEQ ID NO: 307113 - RNA, 21 nt, Human
uacagucaauaucccuggaau

SEQ ID NO: 307114 - RNA, 21 nt, Human
uagcuccccccaccccacucc

SEQ ID NO: 307115 - RNA, 21 nt, Human
uagggaagagaugaggggggg

SEQ ID NO: 307116 - RNA, 21 nt, Human
uaguugaaaaaaaaggcuccu

SEQ ID NO: 307117 - RNA, 25 nt, Human
uauaucaaguuuuuauuaagaagua

SEQ ID NO: 307118 - RNA, 23 nt, Human
uaugagaaaaagaaaaaaaaauc

SEQ ID NO: 307119 - RNA, 24 nt, Human
ucagaagcccuuugacaguuuucu

SEQ ID NO: 307120 - RNA, 22 nt, Human
ucaucuuaaccauucacacaga

SEQ ID NO: 307121 - RNA, 24 nt, Human
ucccaaagugcugggauuacaggc

SEQ ID NO: 307122 - RNA, 19 nt, Human
uccugggcucaagugauuc

SEQ ID NO: 307123 - RNA, 24 nt, Human
uccugggcucaagugauucgccug

SEQ ID NO: 307124 - RNA, 22 nt, Human
ucuugaacuccugggcucaagu

SEQ ID NO: 307125 - RNA, 23 nt, Human
ucuugaacuccugggcucaagug

SEQ ID NO: 307126 - RNA, 20 nt, Human
ucuuggaaaaaaauaacaau

SEQ ID NO: 307127 - RNA, 20 nt, Human
ugaaaaaaaaggcuccuuuc

SEQ ID NO: 307128 - RNA, 23 nt, Human
ugauacaguuagucccacagaca

SEQ ID NO: 307129 - RNA, 24 nt, Human
ugccagaguggaaaggaaugcccc

SEQ ID NO: 307130 - RNA, 24 nt, Human
ugcccauguuggucuugaacuccu

SEQ ID NO: 307131 - RNA, 23 nt, Human
ugccccauuuuccuucacacucu

SEQ ID NO: 307132 - RNA, 20 nt, Human
ugcugggauuacaggcguga

SEQ ID NO: 307133 - RNA, 22 nt, Human
uggaaauagcuccccccacccc

SEQ ID NO: 307134 - RNA, 19 nt, Human
uggagggcagcagcuggac

SEQ ID NO: 307135 - RNA, 19 nt, Human
uggcguccggcgcgcgggu

SEQ ID NO: 307136 - RNA, 18 nt, Human
ugggauuacaggcgugag

SEQ ID NO: 307137 - RNA, 19 nt, Human
ugggauuacaggcgugagc

SEQ ID NO: 307138 - RNA, 20 nt, Human
ugggauuacaggcgugagcc

SEQ ID NO: 307139 - RNA, 21 nt, Human
ugggauuacaggcgugagccg

SEQ ID NO: 307140 - RNA, 22 nt, Human
ugggauuacaggcgugagccgu

SEQ ID NO: 307141 - RNA, 23 nt, Human
ugggauuacaggcgugagccguc

SEQ ID NO: 307142 - RNA, 23 nt, Human
ugggauuacaggcgugagccguc

SEQ ID NO: 307143 - RNA, 24 nt, Human
ugggauuacaggcgugagccguca

SEQ ID NO: 307144 - RNA, 24 nt, Human
ugggcucaagugauucgccuguuu

SEQ ID NO: 307145 - RNA, 24 nt, Human
ugucuaauguaugaacuuuuaaua

SEQ ID NO: 307146 - RNA, 22 nt, Human
uuaaccauucacacagauucua

SEQ ID NO: 307147 - RNA, 27 nt, Human
uuagaaaaguuuaccccaggaagcuag

SEQ ID NO: 307148 - RNA, 20 nt, Human
uuagucccacagacaucaga

SEQ ID NO: 307149 - RNA, 18 nt, Human
uucaggacagccacuucc

SEQ ID NO: 307150 - RNA, 21 nt, Human
uucauugucaacugagaagac

SEQ ID NO: 307151 - RNA, 26 nt, Human
uucuccaagugaggguuauucaacag

SEQ ID NO: 307152 - RNA, 21 nt, Human
uugagaucaaggccauggggc

SEQ ID NO: 307153 - RNA, 24 nt, Human
uuguagagauggaguuucgccaca

SEQ ID NO: 307154 - RNA, 20 nt, Human
uuucggccucccaaagugcu

SEQ ID NO: 307155 - RNA, 22 nt, Human
uuuuuuguagagauggaguuuc

SEQ ID NO: 307156 - RNA, 23 nt, Human
uuuuuuguagagauggaguuucg

SEQ ID NO: 307157 - RNA, 24 nt, Human
uuuuuuuuuuuugagaucaaggcc

SEQ ID NO: 307158 - RNA, 18 nt, Human
uuuuuuuuuuuuuuuuug

SEQ ID NO: 307159 - RNA, 19 nt, Human
aacuggaagguggggguuu

SEQ ID NO: 307160 - RNA, 22 nt, Human
aagaauaaugucagaacccacc

SEQ ID NO: 307161 - RNA, 19 nt, Human
acgggaggaaaaggcgaug

SEQ ID NO: 307162 - RNA, 19 nt, Human
agaggaagagggagcagag

SEQ ID NO: 307163 - RNA, 21 nt, Human
agaggggagaauaggaggagg

SEQ ID NO: 307164 - RNA, 19 nt, Human
agaggggagaggggagaau

SEQ ID NO: 307165 - RNA, 21 nt, Human
agccugggcuccugccuuuug

SEQ ID NO: 307166 - RNA, 18 nt, Human
aggaguuuuauugauagc

SEQ ID NO: 307167 - RNA, 19 nt, Human
augaggugggggggcccgg

SEQ ID NO: 307168 - RNA, 25 nt, Human
caagccccaggggaccagccgaaag

SEQ ID NO: 307169 - RNA, 20 nt, Human
cagaacccaccacauauuag

SEQ ID NO: 307170 - RNA, 18 nt, Human
cagccgaaaggggaggug

SEQ ID NO: 307171 - RNA, 23 nt, Human
cagccucuugcagaagauccuuc

SEQ ID NO: 307172 - RNA, 19 nt, Human
caggagcucucucucccuc

SEQ ID NO: 307173 - RNA, 24 nt, Human
caggagcucucucucccucuugcu

SEQ ID NO: 307174 - RNA, 19 nt, Human
ccacacagccugggcuccu

SEQ ID NO: 307175 - RNA, 24 nt, Human
ccagccuagccagcagagagcaaa

SEQ ID NO: 307176 - RNA, 18 nt, Human
ccaggugcccacucucag

SEQ ID NO: 307177 - RNA, 18 nt, Human
ccugaguucauuuccuug

SEQ ID NO: 307178 - RNA, 18 nt, Human
cucagcuagaggaagagg

SEQ ID NO: 307179 - RNA, 21 nt, Human
cuguuuccacacagccugggc

SEQ ID NO: 307180 - RNA, 27 nt, Human
gaacuggaagguggggguugagccucu

SEQ ID NO: 307181 - RNA, 24 nt, Human
gaagauccuucauagacuuugcuc

SEQ ID NO: 307182 - RNA, 19 nt, Human
gaaugaggugggggggccc

SEQ ID NO: 307183 - RNA, 20 nt, Human
gagaggggagaauaggagga

SEQ ID NO: 307184 - RNA, 18 nt, Human
gagcggaugagaggacag

SEQ ID NO: 307185 - RNA, 19 nt, Human
gagcggaugagaggacagg

SEQ ID NO: 307186 - RNA, 25 nt, Human
gaugagaggacaggguggggaagga

SEQ ID NO: 307187 - RNA, 24 nt, Human
ggagaauaggaggaggauguggag

SEQ ID NO: 307188 - RNA, 18 nt, Human
ggagcugggaguggaagg

SEQ ID NO: 307189 - RNA, 22 nt, Human
ggaggugagggaacuggaaggu

SEQ ID NO: 307190 - RNA, 21 nt, Human
gggaccagccgaaaggggagg

SEQ ID NO: 307191 - RNA, 18 nt, Human
gggagaggggagaauagg

SEQ ID NO: 307192 - RNA, 27 nt, Human
gugagggaacuggaagguggggguuug

SEQ ID NO: 307193 - RNA, 24 nt, Human
uaccccaggugcccacucucagcc

SEQ ID NO: 307194 - RNA, 20 nt, Human
uagaggaagagggagcagag

SEQ ID NO: 307195 - RNA, 21 nt, Human
uagccaccauggaaacccaca

SEQ ID NO: 307196 - RNA, 21 nt, Human
ucaaagaucucugaauccuga

SEQ ID NO: 307197 - RNA, 20 nt, Human
ucaggagcucucucucccuc

SEQ ID NO: 307198 - RNA, 22 nt, Human
ucccucuugcugcaagccccag

SEQ ID NO: 307199 - RNA, 21 nt, Human
ucucugaauccugaguucauu

SEQ ID NO: 307200 - RNA, 21 nt, Human
ugaauccugaguucauuuccu

SEQ ID NO: 307201 - RNA, 18 nt, Human
ugaggugggggggcccgg

SEQ ID NO: 307202 - RNA, 21 nt, Human
uggaaggagaaacgggaggaa

SEQ ID NO: 307203 - RNA, 23 nt, Human
uggaagguggggguuugaagagg

SEQ ID NO: 307204 - RNA, 24 nt, Human
ugggaguggaaggagaaacgggag

SEQ ID NO: 307205 - RNA, 21 nt, Human
uggggagggagcggaugagag

SEQ ID NO: 307206 - RNA, 24 nt, Human
ugucugugccugcuggggagggag

SEQ ID NO: 307207 - RNA, 21 nt, Human
ugugccugcuggggagggagc

SEQ ID NO: 307208 - RNA, 23 nt, Human
ugugccugcuggggagggagccu

SEQ ID NO: 307209 - RNA, 18 nt, Human
aagcaaacaagauucuuc

SEQ ID NO: 307210 - RNA, 24 nt, Human
aagcuuaggcuucuugaaguucuu

SEQ ID NO: 307211 - RNA, 23 nt, Human
cucauauuaagacaacuuuugga

SEQ ID NO: 307212 - RNA, 26 nt, Human
cuucuugaaguucuuauaagcaaaca

SEQ ID NO: 307213 - RNA, 23 nt, Human
gaguacaagaaaauuaaagccaa

SEQ ID NO: 307214 - RNA, 18 nt, Human
uaaagccaagcuuaggcu

SEQ ID NO: 307215 - RNA, 22 nt, Human
uacaagaaaauuaaagccaagc

SEQ ID NO: 307216 - RNA, 18 nt, Human
ucuuauaagcaaacaaga

SEQ ID NO: 307217 - RNA, 24 nt, Human
ugcccagaaagaggaucguguucc

SEQ ID NO: 307218 - RNA, 19 nt, Human
uguuccagugcuugaggag

SEQ ID NO: 307219 - RNA, 19 nt, Human
uuccuugaagcuaucaucg

SEQ ID NO: 307220 - RNA, 19 nt, Human
uuugaacuuauguuuagua

SEQ ID NO: 307221 - RNA, 22 nt, Human
uuugaacuuauguuuaguaaca

SEQ ID NO: 307222 - RNA, 21 nt, Human
uuuuuuuuuuuuuuuuuucag

SEQ ID NO: 307223 - RNA, 21 nt, Human
aaaugaacaugcuucugagug

SEQ ID NO: 307224 - RNA, 23 nt, Human
aagaaacaggguugcccuuguac

SEQ ID NO: 307225 - RNA, 23 nt, Human
aaucccacacugugauccugcug

SEQ ID NO: 307226 - RNA, 20 nt, Human
accacauuuuccuuauuccu

SEQ ID NO: 307227 - RNA, 18 nt, Human
acgaggcccuaagcccag

SEQ ID NO: 307228 - RNA, 18 nt, Human
agcgcagaaacacccaga

SEQ ID NO: 307229 - RNA, 21 nt, Human
aggaguuuggggcucugucag

SEQ ID NO: 307230 - RNA, 23 nt, Human
auaaaccacauuuuccuuauucc

SEQ ID NO: 307231 - RNA, 21 nt, Human
aucuuagaugcauauguugcu

SEQ ID NO: 307232 - RNA, 18 nt, Human
cacccuggccaggucccu

SEQ ID NO: 307233 - RNA, 21 nt, Human
cacuacacucccaacuuuuac

SEQ ID NO: 307234 - RNA, 26 nt, Human
cacuacacucccaacuuuuacacucc

SEQ ID NO: 307235 - RNA, 24 nt, Human
cagacaaugcuccacccuggccag

SEQ ID NO: 307236 - RNA, 23 nt, Human
ccagcacgcuauuaauaaccaaa

SEQ ID NO: 307237 - RNA, 21 nt, Human
cccagggggaacaagaggagg

SEQ ID NO: 307238 - RNA, 20 nt, Human
ccccagaugcuacacuacac

SEQ ID NO: 307239 - RNA, 20 nt, Human
cccuggucuacaaaggggcc

SEQ ID NO: 307240 - RNA, 21 nt, Human
cucaaaaccaguggcucugcc

SEQ ID NO: 307241 - RNA, 21 nt, Human
cuggccaggucccucucucaa

SEQ ID NO: 307242 - RNA, 19 nt, Human
cugugauccugcugucucc

SEQ ID NO: 307243 - RNA, 19 nt, Human
cuuggucagaaaauguuac

SEQ ID NO: 307244 - RNA, 24 nt, Human
gagcaacaggccauuagcuuccag

SEQ ID NO: 307245 - RNA, 25 nt, Human
gcagaaacacccagacaaugcucca

SEQ ID NO: 307246 - RNA, 22 nt, Human
gccacugacacucccuaauccc

SEQ ID NO: 307247 - RNA, 21 nt, Human
gucacauaacuccccucuaaa

SEQ ID NO: 307248 - RNA, 19 nt, Human
uaagaauaaaugagaagca

SEQ ID NO: 307249 - RNA, 19 nt, Human
uauuucaaugugaacccau

SEQ ID NO: 307250 - RNA, 25 nt, Human
ucaaaaccaguggcucugccuucuc

SEQ ID NO: 307251 - RNA, 22 nt, Human
uccagcacgcuauuaauaacca

SEQ ID NO: 307252 - RNA, 21 nt, Human
ucccaacuuuuacacucccaa

SEQ ID NO: 307253 - RNA, 21 nt, Human
uccccuuaaucccacagacuc

SEQ ID NO: 307254 - RNA, 19 nt, Human
uccuuauuccugaauaguc

SEQ ID NO: 307255 - RNA, 23 nt, Human
ucucuuggucagaaaauguuacu

SEQ ID NO: 307256 - RNA, 24 nt, Human
ucuuaagugauaaaccacauuuuc

SEQ ID NO: 307257 - RNA, 20 nt, Human
ugauaaaccacauuuuccuu

SEQ ID NO: 307258 - RNA, 26 nt, Human
ugcaggcaccaaagaaacaggguugc

SEQ ID NO: 307259 - RNA, 26 nt, Human
ugcaggcaccaaagaaacuggagacc

SEQ ID NO: 307260 - RNA, 23 nt, Human
uggcaucuacauaaaugaacaug

SEQ ID NO: 307261 - RNA, 21 nt, Human
ugggucaagcgcagaaacacc

SEQ ID NO: 307262 - RNA, 25 nt, Human
uuaacaaaacaugucucuuggucag

SEQ ID NO: 307263 - RNA, 24 nt, Human
uuacuuuaacuaccaguagcuuua

SEQ ID NO: 307264 - RNA, 18 nt, Human
aaaaaacuuaaaaagugg

SEQ ID NO: 307265 - RNA, 19 nt, Human
aaaaaacuuaaaaaguggu

SEQ ID NO: 307266 - RNA, 19 nt, Human
aaaaaaugucccccucccc

SEQ ID NO: 307267 - RNA, 23 nt, Human
aaaaacugguaaauaauuaacaa

SEQ ID NO: 307268 - RNA, 27 nt, Human
aaaaagccaggaaguugccguuaugaa

SEQ ID NO: 307269 - RNA, 18 nt, Human
aaaaauuggaagaagggu

SEQ ID NO: 307270 - RNA, 24 nt, Human
aaaauacaucaucuacaaagagga

SEQ ID NO: 307271 - RNA, 18 nt, Human
aaacauuucugccaauuc

SEQ ID NO: 307272 - RNA, 24 nt, Human
aaagcaugugcagguaaacugagg

SEQ ID NO: 307273 - RNA, 18 nt, Human
aacagggacuaauuaaac

SEQ ID NO: 307274 - RNA, 18 nt, Human
aacaguguggaauuaaac

SEQ ID NO: 307275 - RNA, 21 nt, Human
aagaagcucaaagcauugugg

SEQ ID NO: 307276 - RNA, 26 nt, Human
aagaagcucaaagcauuguggguggu

SEQ ID NO: 307277 - RNA, 22 nt, Human
aagaaggggcagaaauaacaga

SEQ ID NO: 307278 - RNA, 21 nt, Human
aagugcaaauuugauacgcuc

SEQ ID NO: 307279 - RNA, 23 nt, Human
aaguugccuugugguuggaaggu

SEQ ID NO: 307280 - RNA, 21 nt, Human
aauaagaagauaauaaaaauu

SEQ ID NO: 307281 - RNA, 21 nt, Human
aauacugggaacauucugccu

SEQ ID NO: 307282 - RNA, 24 nt, Human
acguuagacuauaacucaccuaac

SEQ ID NO: 307283 - RNA, 22 nt, Human
acucguuugugucccagccaaa

SEQ ID NO: 307284 - RNA, 20 nt, Human
agaaaugcuuuucuguaaca

SEQ ID NO: 307285 - RNA, 22 nt, Human
agaaggggcagaaauaacagag

SEQ ID NO: 307286 - RNA, 18 nt, Human
agaaucacugaaaaauag

SEQ ID NO: 307287 - RNA, 20 nt, Human
agaguaaacgucuauaaacc

SEQ ID NO: 307288 - RNA, 22 nt, Human
aucaggcuuaaguuaaaaacug

SEQ ID NO: 307289 - RNA, 19 nt, Human
augaauuuuaaaugacaga

SEQ ID NO: 307290 - RNA, 21 nt, Human
caaacaaaaagcauggagaaa

SEQ ID NO: 307291 - RNA, 18 nt, Human
caacacagugaccacaga

SEQ ID NO: 307292 - RNA, 21 nt, Human
caagaccgagaaucuacaaaa

SEQ ID NO: 307293 - RNA, 21 nt, Human
caauacucaccagaugccuaa

SEQ ID NO: 307294 - RNA, 19 nt, Human
caaucucuuuuuggaagcu

SEQ ID NO: 307295 - RNA, 19 nt, Human
cacaggaaaaaagcacauc

SEQ ID NO: 307296 - RNA, 21 nt, Human
cacaggaaaaaagcacaucuc

SEQ ID NO: 307297 - RNA, 18 nt, Human
cacugaaaaauagaacag

SEQ ID NO: 307298 - RNA, 21 nt, Human
cacuuguaaaaagccaggaag

SEQ ID NO: 307299 - RNA, 23 nt, Human
cagcaggacaguccucacuuccc

SEQ ID NO: 307300 - RNA, 24 nt, Human
cagcaggacaguccucacuucccc

SEQ ID NO: 307301 - RNA, 19 nt, Human
caggaaaaauaccugugga

SEQ ID NO: 307302 - RNA, 23 nt, Human
ccagaaagacuggucuugugaca

SEQ ID NO: 307303 - RNA, 18 nt, Human
cccaugagaauaucaauu

SEQ ID NO: 307304 - RNA, 21 nt, Human
ccccaaaaaaugucccccucc

SEQ ID NO: 307305 - RNA, 21 nt, Human
cccccaaaaaaugucccccuc

SEQ ID NO: 307306 - RNA, 20 nt, Human
ccccccaaaaaauguccccc

SEQ ID NO: 307307 - RNA, 23 nt, Human
ccccccaaaaaaugucccccucc

SEQ ID NO: 307308 - RNA, 28 nt, Human
ccccccaaaaaaugucccccuccccaaa

SEQ ID NO: 307309 - RNA, 22 nt, Human
ccuucuggauccagagccaagg

SEQ ID NO: 307310 - RNA, 18 nt, Human
ccuugaucagauaagcug

SEQ ID NO: 307311 - RNA, 20 nt, Human
cuaaacucucagcaaagccc

SEQ ID NO: 307312 - RNA, 22 nt, Human
cuacuggauauucucacuaggc

SEQ ID NO: 307313 - RNA, 18 nt, Human
cucaagggagaaaugauc

SEQ ID NO: 307314 - RNA, 19 nt, Human
cucaagggagaaaugaucc

SEQ ID NO: 307315 - RNA, 22 nt, Human
cucucagcaaagcccaugagaa

SEQ ID NO: 307316 - RNA, 20 nt, Human
cugccccccaaaaaaugucc

SEQ ID NO: 307317 - RNA, 21 nt, Human
cugccccccaaaaaauguccc

SEQ ID NO: 307318 - RNA, 18 nt, Human
cugggcaguaacaagggc

SEQ ID NO: 307319 - RNA, 18 nt, Human
cuucaagaccgagaaucu

SEQ ID NO: 307320 - RNA, 22 nt, Human
gaaaaaaacacaaggagaagua

SEQ ID NO: 307321 - RNA, 20 nt, Human
gaacacagucccugcccccc

SEQ ID NO: 307322 - RNA, 18 nt, Human
gaagcucuccacauuccu

SEQ ID NO: 307323 - RNA, 18 nt, Human
gaaggcccugagagagcu

SEQ ID NO: 307324 - RNA, 22 nt, Human
gaagggagucauucaacuaaau

SEQ ID NO: 307325 - RNA, 19 nt, Human
gaaguugccuugugguugg

SEQ ID NO: 307326 - RNA, 22 nt, Human
gaauaaauuuagaguuggccua

SEQ ID NO: 307327 - RNA, 20 nt, Human
gagaaggcuaccuaccuccu

SEQ ID NO: 307328 - RNA, 20 nt, Human
gaguguguuuccuuucucuc

SEQ ID NO: 307329 - RNA, 19 nt, Human
gaguuggaaaaaaacacaa

SEQ ID NO: 307330 - RNA, 20 nt, Human
gccaguacuucucauagaac

SEQ ID NO: 307331 - RNA, 28 nt, Human
ggagaaguagguuuuugggcuguguuaa

SEQ ID NO: 307332 - RNA, 21 nt, Human
ggcaguaacaagggcaagucu

SEQ ID NO: 307333 - RNA, 21 nt, Human
ggccuucuggauccagagcca

SEQ ID NO: 307334 - RNA, 23 nt, Human
gggaaauauuugcuggguuaccc

SEQ ID NO: 307335 - RNA, 18 nt, Human
gggaaggcccugagagac

SEQ ID NO: 307336 - RNA, 18 nt, Human
guauagagcucaggaaaa

SEQ ID NO: 307337 - RNA, 21 nt, Human
gucuccuugugacucaaggga

SEQ ID NO: 307338 - RNA, 24 nt, Human
guugaaaaagggauucagagucca

SEQ ID NO: 307339 - RNA, 24 nt, Human
guuuuucguuuuuaauucuguugg

SEQ ID NO: 307340 - RNA, 18 nt, Human
uaaaaaguggugaaagaa

SEQ ID NO: 307341 - RNA, 21 nt, Human
uaaaacaugccucccagaaag

SEQ ID NO: 307342 - RNA, 18 nt, Human
uaaacuagggaaggcaug

SEQ ID NO: 307343 - RNA, 21 nt, Human
uaaaguagagauugcaaaggc

SEQ ID NO: 307344 - RNA, 20 nt, Human
uaaaucaauacucuuaagau

SEQ ID NO: 307345 - RNA, 23 nt, Human
uaacaaccuuaccaaauguauca

SEQ ID NO: 307346 - RNA, 22 nt, Human
uaacuaaacucucagcaaagcc

SEQ ID NO: 307347 - RNA, 23 nt, Human
uaacuaaacucucagcaaagccc

SEQ ID NO: 307348 - RNA, 19 nt, Human
uaacucacucacguuagac

SEQ ID NO: 307349 - RNA, 21 nt, Human
uaagaagauaauaaaaauugg

SEQ ID NO: 307350 - RNA, 24 nt, Human
uacaaaauuuccuuucccaaauuu

SEQ ID NO: 307351 - RNA, 25 nt, Human
uacaaaauuuccuuucccaaauuug

SEQ ID NO: 307352 - RNA, 20 nt, Human
uacaguggugcucaaauugg

SEQ ID NO: 307353 - RNA, 22 nt, Human
uacaguggugcucaaauuggcu

SEQ ID NO: 307354 - RNA, 18 nt, Human
uacauuugauuuccucau

SEQ ID NO: 307355 - RNA, 21 nt, Human
uaccuccuuuuagggacagcc

SEQ ID NO: 307356 - RNA, 21 nt, Human
uaccuguggaaaaaaaacuua

SEQ ID NO: 307357 - RNA, 24 nt, Human
uacuuauauuuucuuccaaaucca

SEQ ID NO: 307358 - RNA, 21 nt, Human
uagaacaguggucauacaaaa

SEQ ID NO: 307359 - RNA, 21 nt, Human
uagauugucacugcugggaaa

SEQ ID NO: 307360 - RNA, 24 nt, Human
uagcugcaaaauauguaugagaca

SEQ ID NO: 307361 - RNA, 19 nt, Human
uaggauaaaacaugccucc

SEQ ID NO: 307362 - RNA, 24 nt, Human
uagggugagacacaccugccccuu

SEQ ID NO: 307363 - RNA, 19 nt, Human
uauaaaccaacuucuugca

SEQ ID NO: 307364 - RNA, 22 nt, Human
uauaguguauguugaaaucaac

SEQ ID NO: 307365 - RNA, 24 nt, Human
uaucugguuagagcucagccugca

SEQ ID NO: 307366 - RNA, 22 nt, Human
uaugagacauuuuucagucugu

SEQ ID NO: 307367 - RNA, 20 nt, Human
uauuuauuuagauaaagggu

SEQ ID NO: 307368 - RNA, 21 nt, Human
ucaaacacuuuugaacucucu

SEQ ID NO: 307369 - RNA, 23 nt, Human
ucaacaguucuauacucaauagu

SEQ ID NO: 307370 - RNA, 21 nt, Human
ucaagaauccguggacauguu

SEQ ID NO: 307371 - RNA, 23 nt, Human
ucaagggagaaaugauccuuucu

SEQ ID NO: 307372 - RNA, 20 nt, Human
ucaguuugaaaagaaauggg

SEQ ID NO: 307373 - RNA, 18 nt, Human
ucaguuuugauuggagca

SEQ ID NO: 307374 - RNA, 19 nt, Human
uccaaaaagcuuacggcuc

SEQ ID NO: 307375 - RNA, 23 nt, Human
uccacuuguaaaaagccaggaag

SEQ ID NO: 307376 - RNA, 19 nt, Human
uccaugccacaugcuagag

SEQ ID NO: 307377 - RNA, 24 nt, Human
ucccuaauucucucauuuuuuuuu

SEQ ID NO: 307378 - RNA, 25 nt, Human
ucccuucuauaaaagaagcucaaag

SEQ ID NO: 307379 - RNA, 24 nt, Human
ucucugaucucccaauguaguucu

SEQ ID NO: 307380 - RNA, 18 nt, Human
ucugguuagagcucagcc

SEQ ID NO: 307381 - RNA, 20 nt, Human
ucuuuuccaguuguaaaugu

SEQ ID NO: 307382 - RNA, 18 nt, Human
ugaaaaagggauucagag

SEQ ID NO: 307383 - RNA, 26 nt, Human
ugaaaaauagaacaguggucauacaa

SEQ ID NO: 307384 - RNA, 20 nt, Human
ugaaagaaagcaugugcagg

SEQ ID NO: 307385 - RNA, 23 nt, Human
ugaaagaaagcaugugcagguaa

SEQ ID NO: 307386 - RNA, 21 nt, Human
ugaaagcaaaauauggaaugc

SEQ ID NO: 307387 - RNA, 24 nt, Human
ugaaauaaaauccacuuguaaaaa

SEQ ID NO: 307388 - RNA, 21 nt, Human
ugaacacagucccugcccccc

SEQ ID NO: 307389 - RNA, 18 nt, Human
ugaagauguuuauagcug

SEQ ID NO: 307390 - RNA, 22 nt, Human
ugaauaaauuuagaguuggccu

SEQ ID NO: 307391 - RNA, 19 nt, Human
ugaccagaccuuuucauga

SEQ ID NO: 307392 - RNA, 19 nt, Human
ugaccagaccuuuucauga

SEQ ID NO: 307393 - RNA, 21 nt, Human
ugaccagaccuuuucaugauc

SEQ ID NO: 307394 - RNA, 22 nt, Human
ugagagcaaucucuuuuuggaa

SEQ ID NO: 307395 - RNA, 23 nt, Human
ugagagcaaucucuuuuuggaag

SEQ ID NO: 307396 - RNA, 19 nt, Human
ugauccuuucuuucuaagu

SEQ ID NO: 307397 - RNA, 22 nt, Human
ugcaggcauuucaauguauagu

SEQ ID NO: 307398 - RNA, 19 nt, Human
ugcaucaucuucuccaaaa

SEQ ID NO: 307399 - RNA, 21 nt, Human
uggaaaaaaacacaaggagaa

SEQ ID NO: 307400 - RNA, 22 nt, Human
uggaagaaggguaaagaagggg

SEQ ID NO: 307401 - RNA, 22 nt, Human
uggaauggaucaguugaacuaa

SEQ ID NO: 307402 - RNA, 21 nt, Human
uggaauuaaacuguagcugac

SEQ ID NO: 307403 - RNA, 21 nt, Human
uggaucaguugaacuaauuaa

SEQ ID NO: 307404 - RNA, 20 nt, Human
uggcaaguuacugaagaugu

SEQ ID NO: 307405 - RNA, 21 nt, Human
ugguaaauaauuaacaagugc

SEQ ID NO: 307406 - RNA, 18 nt, Human
uggucaaaacaaccgugg

SEQ ID NO: 307407 - RNA, 22 nt, Human
uggugcccaagcaaaauacauc

SEQ ID NO: 307408 - RNA, 24 nt, Human
uguauauauuuaucauguacaacu

SEQ ID NO: 307409 - RNA, 22 nt, Human
ugugaagggcgaaauagaauga

SEQ ID NO: 307410 - RNA, 19 nt, Human
ugugacucaagggagaaau

SEQ ID NO: 307411 - RNA, 23 nt, Human
ugugacucaagggagaaaugauc

SEQ ID NO: 307412 - RNA, 20 nt, Human
uguggaauuaaacuguagcu

SEQ ID NO: 307413 - RNA, 20 nt, Human
uguuggugcccaagcaaaau

SEQ ID NO: 307414 - RNA, 24 nt, Human
uuaaaguauucuucaguuugaaaa

SEQ ID NO: 307415 - RNA, 25 nt, Human
uuagagcucagccugcagccaccac

SEQ ID NO: 307416 - RNA, 22 nt, Human
uuagcuagaugccaaaauucca

SEQ ID NO: 307417 - RNA, 21 nt, Human
uucauugaguuggaaaaaaac

SEQ ID NO: 307418 - RNA, 18 nt, Human
uugcuggguuacccaugu

SEQ ID NO: 307419 - RNA, 24 nt, Human
uuucucucugucaagaauccgugg

SEQ ID NO: 307420 - RNA, 23 nt, Human
uuucuggucugagugcagugaug

SEQ ID NO: 307421 - RNA, 19 nt, Human
aaaaaagacaugaaaacac

SEQ ID NO: 307422 - RNA, 20 nt, Human
aaaaugaaaagacagcccuu

SEQ ID NO: 307423 - RNA, 24 nt, Human
aacaguguaaauaacacagcagua

SEQ ID NO: 307424 - RNA, 19 nt, Human
aagcaaucagagagggggc

SEQ ID NO: 307425 - RNA, 21 nt, Human
aaggagauuacuuucuccacc

SEQ ID NO: 307426 - RNA, 21 nt, Human
aaggauccauacaaaaaugac

SEQ ID NO: 307427 - RNA, 24 nt, Human
aagucacuucuuuggggaaaccag

SEQ ID NO: 307428 - RNA, 24 nt, Human
aaugaaaagacagcccuuuuaaaa

SEQ ID NO: 307429 - RNA, 18 nt, Human
aaugacagagguagggaa

SEQ ID NO: 307430 - RNA, 23 nt, Human
acacacagauacguaaugcuaaa

SEQ ID NO: 307431 - RNA, 22 nt, Human
acaccaccacaguauggaaaac

SEQ ID NO: 307432 - RNA, 23 nt, Human
acaucauuuuguuuucauaagca

SEQ ID NO: 307433 - RNA, 19 nt, Human
accugauucagcuuaguga

SEQ ID NO: 307434 - RNA, 21 nt, Human
acuaaaaugaaaagacagccc

SEQ ID NO: 307435 - RNA, 25 nt, Human
agaauaaaacaaauuugacagauug

SEQ ID NO: 307436 - RNA, 21 nt, Human
agagagaagagccaggggggc

SEQ ID NO: 307437 - RNA, 25 nt, Human
agagagaagagccaggggggcuuuc

SEQ ID NO: 307438 - RNA, 23 nt, Human
agagggggcagugcugagcauau

SEQ ID NO: 307439 - RNA, 20 nt, Human
agcagguuccugcaaugcag

SEQ ID NO: 307440 - RNA, 24 nt, Human
agccauuuucuuuuuccucuuuuc

SEQ ID NO: 307441 - RNA, 20 nt, Human
agcccuuuuaaaaaugagug

SEQ ID NO: 307442 - RNA, 18 nt, Human
agcggggccgcucccgac

SEQ ID NO: 307443 - RNA, 25 nt, Human
agcucgcgccggcccgcgccccacc

SEQ ID NO: 307444 - RNA, 21 nt, Human
agggaaaagucugccugcagc

SEQ ID NO: 307445 - RNA, 24 nt, Human
agucaggaaacuuccccggaccua

SEQ ID NO: 307446 - RNA, 19 nt, Human
auauauauauauauauaua

SEQ ID NO: 307447 - RNA, 19 nt, Human
auauauauauauauauaua

SEQ ID NO: 307448 - RNA, 21 nt, Human
auggagucuugaugaaucugu

SEQ ID NO: 307449 - RNA, 24 nt, Human
auuaaaauauauauauauauauau

SEQ ID NO: 307450 - RNA, 20 nt, Human
caaggagauuacuuucucca

SEQ ID NO: 307451 - RNA, 21 nt, Human
cacacagauacguaaugcuaa

SEQ ID NO: 307452 - RNA, 23 nt, Human
cacacagauacguaaugcuaaaa

SEQ ID NO: 307453 - RNA, 24 nt, Human
cacacagauacguaaugcuaaaaa

SEQ ID NO: 307454 - RNA, 24 nt, Human
cacaguauggaaaacuaaaaugaa

SEQ ID NO: 307455 - RNA, 19 nt, Human
cacaugauugcaaggagau

SEQ ID NO: 307456 - RNA, 24 nt, Human
cagcagaggccaucaaacacagua

SEQ ID NO: 307457 - RNA, 24 nt, Human
cagcuuagugaagauaaguugucc

SEQ ID NO: 307458 - RNA, 21 nt, Human
caugauugcaaggagauuacu

SEQ ID NO: 307459 - RNA, 19 nt, Human
cauuuuguuuucauaagca

SEQ ID NO: 307460 - RNA, 20 nt, Human
ccaaacacaagccacaugau

SEQ ID NO: 307461 - RNA, 23 nt, Human
ccauagaacaaaauauuuccagu

SEQ ID NO: 307462 - RNA, 20 nt, Human
ccauuuucuuuuuccucuuu

SEQ ID NO: 307463 - RNA, 27 nt, Human
cccgaccccagggaaggcagccuggaa

SEQ ID NO: 307464 - RNA, 23 nt, Human
cccgcgcacgccgccacgggccg

SEQ ID NO: 307465 - RNA, 25 nt, Human
cccgcgcacgccgccacgggccgca

SEQ ID NO: 307466 - RNA, 18 nt, Human
cccuuuuaaaaaugagug

SEQ ID NO: 307467 - RNA, 20 nt, Human
ccgccgcgcccgccgagugc

SEQ ID NO: 307468 - RNA, 22 nt, Human
ccgccgcgcccgccgagugcuc

SEQ ID NO: 307469 - RNA, 22 nt, Human
ccugcagccacagccucugccc

SEQ ID NO: 307470 - RNA, 26 nt, Human
cgccgcggagcuccggcugcaugaag

SEQ ID NO: 307471 - RNA, 20 nt, Human
cucuuuuuucuuggagauga

SEQ ID NO: 307472 - RNA, 19 nt, Human
cugccccgcgagguugugg

SEQ ID NO: 307473 - RNA, 20 nt, Human
cugccccgcgagguugugga

SEQ ID NO: 307474 - RNA, 24 nt, Human
gaauuccuuuuuuuuuuuuuuuuu

SEQ ID NO: 307475 - RNA, 18 nt, Human
gaccccagggaaggcagc

SEQ ID NO: 307476 - RNA, 22 nt, Human
gagaugaccuucagauuucuau

SEQ ID NO: 307477 - RNA, 23 nt, Human
gaucucuuuuuucuuggagauga

SEQ ID NO: 307478 - RNA, 23 nt, Human
gccggcccgcgccccaccugcca

SEQ ID NO: 307479 - RNA, 19 nt, Human
gggaaaccagggcuucuca

SEQ ID NO: 307480 - RNA, 22 nt, Human
ggugaacacuugagccagagau

SEQ ID NO: 307481 - RNA, 18 nt, Human
guccuuaguaugaucuug

SEQ ID NO: 307482 - RNA, 18 nt, Human
uaaaacacagcagaggcc

SEQ ID NO: 307483 - RNA, 22 nt, Human
uaaaacacagcagaggccauca

SEQ ID NO: 307484 - RNA, 20 nt, Human
uaaauaacacagcaguaacc

SEQ ID NO: 307485 - RNA, 19 nt, Human
uacaaaaaugacgcccaaa

SEQ ID NO: 307486 - RNA, 18 nt, Human
uacaccaccacaguaugg

SEQ ID NO: 307487 - RNA, 22 nt, Human
uaccuuuccaauuguccaaaau

SEQ ID NO: 307488 - RNA, 23 nt, Human
uaguaaaaguuuacaaacauuaa

SEQ ID NO: 307489 - RNA, 19 nt, Human
uauauauauauauauauau

SEQ ID NO: 307490 - RNA, 18 nt, Human
uauuguacaauacaaaac

SEQ ID NO: 307491 - RNA, 20 nt, Human
ucaaacacaguauuaaugag

SEQ ID NO: 307492 - RNA, 19 nt, Human
uccuuaguaugaucuuggc

SEQ ID NO: 307493 - RNA, 18 nt, Human
uccuuuuuuuuuuuuuuu

SEQ ID NO: 307494 - RNA, 18 nt, Human
uccuuuuuuuuuuuuuuu

SEQ ID NO: 307495 - RNA, 18 nt, Human
ucgcgccagccacggggg

SEQ ID NO: 307496 - RNA, 18 nt, Human
ucucugcaaagcgcggaa

SEQ ID NO: 307497 - RNA, 22 nt, Human
ucuuucuuuuacugggugaaca

SEQ ID NO: 307498 - RNA, 19 nt, Human
ugaaaaaagacaugaaaac

SEQ ID NO: 307499 - RNA, 21 nt, Human
ugaaaaaagacaugaaaacac

SEQ ID NO: 307500 - RNA, 22 nt, Human
ugaccuucagauuucuaucaga

SEQ ID NO: 307501 - RNA, 23 nt, Human
ugagcaaggggaaagacuguguu

SEQ ID NO: 307502 - RNA, 20 nt, Human
ugauaaugagcagguuccug

SEQ ID NO: 307503 - RNA, 22 nt, Human
ugcuaccaaauauccacauagc

SEQ ID NO: 307504 - RNA, 20 nt, Human
ugggguucaaucaacccuuc

SEQ ID NO: 307505 - RNA, 23 nt, Human
ugggugaacacuugagccagaga

SEQ ID NO: 307506 - RNA, 20 nt, Human
uguccaaaauucucauaaau

SEQ ID NO: 307507 - RNA, 21 nt, Human
ugugauugguguccacaugau

SEQ ID NO: 307508 - RNA, 23 nt, Human
uguggucgagggucaaagugggg

SEQ ID NO: 307509 - RNA, 21 nt, Human
uguguacaccaccacaguaug

SEQ ID NO: 307510 - RNA, 25 nt, Human
uucacaguaauguacaucauuuugu

SEQ ID NO: 307511 - RNA, 22 nt, Human
uucuaccuuuccaauuguccaa

SEQ ID NO: 307512 - RNA, 18 nt, Human
uuggaaaccuucuugucu

SEQ ID NO: 307513 - RNA, 21 nt, Human
uuuuuuuuuuuuuuuuacugg

SEQ ID NO: 307514 - RNA, 23 nt, Human
uuuuuuuuuuuuuuuuuuacugg

SEQ ID NO: 307515 - RNA, 19 nt, Human
aaagugaguagcaucacaa

SEQ ID NO: 307516 - RNA, 19 nt, Human
acaaauuuugcauuuucca

SEQ ID NO: 307517 - RNA, 19 nt, Human
acagguuuaaaaaauucug

SEQ ID NO: 307518 - RNA, 27 nt, Human
accaccagacuaaaugucucaagaaaa

SEQ ID NO: 307519 - RNA, 24 nt, Human
agaagcaaaauacgucagacaaaa

SEQ ID NO: 307520 - RNA, 19 nt, Human
agcaugacuccagccgcgc

SEQ ID NO: 307521 - RNA, 19 nt, Human
caaacacacucuauccaug

SEQ ID NO: 307522 - RNA, 19 nt, Human
caagcucugcggcccggaa

SEQ ID NO: 307523 - RNA, 19 nt, Human
cacaggguuuucugcuucu

SEQ ID NO: 307524 - RNA, 19 nt, Human
cacauacuagaagcaaaau

SEQ ID NO: 307525 - RNA, 24 nt, Human
cacauacuagaagcaaaauacguc

SEQ ID NO: 307526 - RNA, 20 nt, Human
caguauagcaugacuccagc

SEQ ID NO: 307527 - RNA, 19 nt, Human
cagugaauuuuguuggguu

SEQ ID NO: 307528 - RNA, 22 nt, Human
ccaaaaauguccauaauuuucu

SEQ ID NO: 307529 - RNA, 21 nt, Human
ccaagcucugcggcccggagc

SEQ ID NO: 307530 - RNA, 21 nt, Human
cgacucgggcucuagccuccg

SEQ ID NO: 307531 - RNA, 22 nt, Human
cuaaagauguuucuguuaucaa

SEQ ID NO: 307532 - RNA, 19 nt, Human
cuccuaucuuuccuguccc

SEQ ID NO: 307533 - RNA, 22 nt, Human
cugccugccggugcccugggcu

SEQ ID NO: 307534 - RNA, 23 nt, Human
cuuucaacaugcagauauucagc

SEQ ID NO: 307535 - RNA, 19 nt, Human
cuuucuuucuccuaucuuu

SEQ ID NO: 307536 - RNA, 21 nt, Human
gagcugcgacucgggcucuag

SEQ ID NO: 307537 - RNA, 22 nt, Human
gcccggagcugcgacucgggcu

SEQ ID NO: 307538 - RNA, 21 nt, Human
gccugccugccggugcccugg

SEQ ID NO: 307539 - RNA, 25 nt, Human
gcgcagcugccugccugccggugcc

SEQ ID NO: 307540 - RNA, 22 nt, Human
uaaacuuucuuucuccuaucuu

SEQ ID NO: 307541 - RNA, 25 nt, Human
uaagucuuucaacaugcagauauuc

SEQ ID NO: 307542 - RNA, 24 nt, Human
uaauagcuuaccuuggacaucauc

SEQ ID NO: 307543 - RNA, 22 nt, Human
uaccacaguuaccaccagacua

SEQ ID NO: 307544 - RNA, 22 nt, Human
uagaagcaaaauacgucagaca

SEQ ID NO: 307545 - RNA, 20 nt, Human
uagcaugacuccagccgcgc

SEQ ID NO: 307546 - RNA, 20 nt, Human
uaggcauguuccauauaacc

SEQ ID NO: 307547 - RNA, 27 nt, Human
ucaaacuuuuacaauuuuuccaagacg

SEQ ID NO: 307548 - RNA, 19 nt, Human
uccaagacguuuuugaggu

SEQ ID NO: 307549 - RNA, 23 nt, Human
uccuaaagauguuucuguuauca

SEQ ID NO: 307550 - RNA, 18 nt, Human
ugcaauguuaccacaguu

SEQ ID NO: 307551 - RNA, 22 nt, Human
ugcagauauucagcacucuuga

SEQ ID NO: 307552 - RNA, 22 nt, Human
ugcgacucgggcucuagccucc

SEQ ID NO: 307553 - RNA, 22 nt, Human
uggcaaaaaacaaacacacucu

SEQ ID NO: 307554 - RNA, 19 nt, Human
uggcacaggguuuucugcu

SEQ ID NO: 307555 - RNA, 23 nt, Human
uuaucuaauauacacaugcugcu

SEQ ID NO: 307556 - RNA, 20 nt, Human
uuccugucccuggcacaggg

SEQ ID NO: 307557 - RNA, 23 nt, Human
uuccugucccuggcacaggguuu

SEQ ID NO: 307558 - RNA, 18 nt, Human
uucuccuaucuuuccugu

SEQ ID NO: 307559 - RNA, 24 nt, Human
uuuccugucccuggcacaggguuu

SEQ ID NO: 307560 - RNA, 18 nt, Human
uuuggcaaaaaacaaaca

SEQ ID NO: 307561 - RNA, 24 nt, Human
uuuuuuuuuuuuuuuuuuuuaggg

SEQ ID NO: 307562 - RNA, 22 nt, Human
aaaaguguuuucuaaaaaaggg

SEQ ID NO: 307563 - RNA, 18 nt, Human
aaguguaccugggcacgg

SEQ ID NO: 307564 - RNA, 19 nt, Human
aaguguaccugggcacggu

SEQ ID NO: 307565 - RNA, 21 nt, Human
acaaugacaguuuagcuaaaa

SEQ ID NO: 307566 - RNA, 21 nt, Human
agaggagguguugguguuggg

SEQ ID NO: 307567 - RNA, 19 nt, Human
agguggugggaaugugaag

SEQ ID NO: 307568 - RNA, 21 nt, Human
agguggugggaaugugaagcc

SEQ ID NO: 307569 - RNA, 23 nt, Human
aucguuuugagccaaaaucccuu

SEQ ID NO: 307570 - RNA, 21 nt, Human
aucucuucagauuuuccacug

SEQ ID NO: 307571 - RNA, 21 nt, Human
auggagcucagagaagaggcu

SEQ ID NO: 307572 - RNA, 22 nt, Human
cagaaggucucucguccagccu

SEQ ID NO: 307573 - RNA, 23 nt, Human
ccucuggggagccuucucagucu

SEQ ID NO: 307574 - RNA, 18 nt, Human
ccugugggugugggcaga

SEQ ID NO: 307575 - RNA, 20 nt, Human
ccugugggugugggcagagg

SEQ ID NO: 307576 - RNA, 20 nt, Human
cgagaggagcguuccugugu

SEQ ID NO: 307577 - RNA, 23 nt, Human
cgcccaagucccggcgccagcuc

SEQ ID NO: 307578 - RNA, 22 nt, Human
cuccauaucugcugaaaaaagg

SEQ ID NO: 307579 - RNA, 18 nt, Human
cuccgugccugggccgcc

SEQ ID NO: 307580 - RNA, 23 nt, Human
cuggacccagaagauugggcugg

SEQ ID NO: 307581 - RNA, 22 nt, Human
cugguuuaauuucuuuuuccug

SEQ ID NO: 307582 - RNA, 25 nt, Human
cugugggugugggcagagggcuuuc

SEQ ID NO: 307583 - RNA, 20 nt, Human
gagaagaggcugcugggcca

SEQ ID NO: 307584 - RNA, 23 nt, Human
gaggagcguuccugugugggcug

SEQ ID NO: 307585 - RNA, 20 nt, Human
gaucuguggagcuccaugag

SEQ ID NO: 307586 - RNA, 18 nt, Human
gcagagggcuuucccgga

SEQ ID NO: 307587 - RNA, 18 nt, Human
gccaaaaucccuucccua

SEQ ID NO: 307588 - RNA, 20 nt, Human
gcccaagucccggcgccagc

SEQ ID NO: 307589 - RNA, 24 nt, Human
gccccgcccaagucccggcgccag

SEQ ID NO: 307590 - RNA, 25 nt, Human
gccugggccgccggcacgaggccuc

SEQ ID NO: 307591 - RNA, 18 nt, Human
gcuuaaaaaaugugaauu

SEQ ID NO: 307592 - RNA, 20 nt, Human
gggcacggugcgaagguggu

SEQ ID NO: 307593 - RNA, 23 nt, Human
gggcaggccccgcccaagucccg

SEQ ID NO: 307594 - RNA, 21 nt, Human
ggggagccuucucagucuggc

SEQ ID NO: 307595 - RNA, 20 nt, Human
gguggugggaaugugaagcc

SEQ ID NO: 307596 - RNA, 21 nt, Human
gucucgccgccucuccgugcc

SEQ ID NO: 307597 - RNA, 25 nt, Human
uacagugucuugaaaguguaccugg

SEQ ID NO: 307598 - RNA, 20 nt, Human
uaccugggcacggugcgaag

SEQ ID NO: 307599 - RNA, 23 nt, Human
uagggcaggccccgcccaagucc

SEQ ID NO: 307600 - RNA, 20 nt, Human
ucagauuuuccacuguugac

SEQ ID NO: 307601 - RNA, 20 nt, Human
ucagcucucuccauaucugc

SEQ ID NO: 307602 - RNA, 19 nt, Human
ucccuucccuaaaaaugga

SEQ ID NO: 307603 - RNA, 18 nt, Human
uccucaggccugguuuaa

SEQ ID NO: 307604 - RNA, 20 nt, Human
ucuguggagcuccaugaggg

SEQ ID NO: 307605 - RNA, 18 nt, Human
ugaauugauugucagcuc

SEQ ID NO: 307606 - RNA, 23 nt, Human
uggacagggcagagguggucaga

SEQ ID NO: 307607 - RNA, 22 nt, Human
uggaggccacagaggccucugg

SEQ ID NO: 307608 - RNA, 19 nt, Human
ugggccgccggcacgaggc

SEQ ID NO: 307609 - RNA, 22 nt, Human
ugugaagccugugggugugggc

SEQ ID NO: 307610 - RNA, 18 nt, Human
ugugugggcugcucacug

SEQ ID NO: 307611 - RNA, 19 nt, Human
uguugguguugggacaggg

SEQ ID NO: 307612 - RNA, 24 nt, Human
uuacacaaaucaucggcauuuauu

SEQ ID NO: 307613 - RNA, 20 nt, Human
uucugcggucucgccgccuc

SEQ ID NO: 307614 - RNA, 18 nt, Human
uugggcuggagaggaggu

SEQ ID NO: 307615 - RNA, 19 nt, Human
aagguggggcuuuggaggg

SEQ ID NO: 307616 - RNA, 20 nt, Human
accucgaaggggcuagauga

SEQ ID NO: 307617 - RNA, 20 nt, Human
accugugugaaauggagaug

SEQ ID NO: 307618 - RNA, 19 nt, Human
agauggggaaggggcaacc

SEQ ID NO: 307619 - RNA, 28 nt, Human
aggaauagagaagagaggaccgguaccc

SEQ ID NO: 307620 - RNA, 21 nt, Human
ccugugugaaauggagauggg

SEQ ID NO: 307621 - RNA, 20 nt, Human
cugcugagcagauuggaugc

SEQ ID NO: 307622 - RNA, 22 nt, Human
cugggccagaggggggaggggc

SEQ ID NO: 307623 - RNA, 21 nt, Human
gaccugugugaaauggagaug

SEQ ID NO: 307624 - RNA, 18 nt, Human
gcugggccagagggggga

SEQ ID NO: 307625 - RNA, 21 nt, Human
gggcuuuggaggggugugggc

SEQ ID NO: 307626 - RNA, 19 nt, Human
ggugcuguuggguggccag

SEQ ID NO: 307627 - RNA, 22 nt, Human
ugaaauggagauggggaagggg

SEQ ID NO: 307628 - RNA, 19 nt, Human
uggagauggggaaggggca

SEQ ID NO: 307629 - RNA, 18 nt, Human
uggggaggaagggauggg

SEQ ID NO: 307630 - RNA, 19 nt, Human
uggggcuuuggaggggugu

SEQ ID NO: 307631 - RNA, 19 nt, Human
uuaaagguggggcuuugga

SEQ ID NO: 307632 - RNA, 23 nt, Human
uuggugcuguuggguggccagug

SEQ ID NO: 307633 - RNA, 19 nt, Human
uuucagugugggccugggg

SEQ ID NO: 307634 - RNA, 18 nt, Human
uuuuuuuuuuuuuuuuug

SEQ ID NO: 307635 - RNA, 24 nt, Human
uuuuuuuuuuuuuuuuuuuuuggg

SEQ ID NO: 307636 - RNA, 26 nt, Human
acacagccauguuucagugaggcguu

SEQ ID NO: 307637 - RNA, 20 nt, Human
agacgaagaagauccggagc

SEQ ID NO: 307638 - RNA, 22 nt, Human
agcugaguggaggguggggaca

SEQ ID NO: 307639 - RNA, 20 nt, Human
aggcucugggcugucccacu

SEQ ID NO: 307640 - RNA, 19 nt, Human
agugggggaaaauggaagg

SEQ ID NO: 307641 - RNA, 20 nt, Human
augggcugggggaagggggu

SEQ ID NO: 307642 - RNA, 24 nt, Human
caacagcccagugcccuaaggccc

SEQ ID NO: 307643 - RNA, 20 nt, Human
caaccuaccagugccacguu

SEQ ID NO: 307644 - RNA, 20 nt, Human
caaggagccacugccucagc

SEQ ID NO: 307645 - RNA, 24 nt, Human
cacacaggaaaggaagcugucacc

SEQ ID NO: 307646 - RNA, 22 nt, Human
cagcccagagugaguucuacaa

SEQ ID NO: 307647 - RNA, 18 nt, Human
caggcucugggcuguccc

SEQ ID NO: 307648 - RNA, 18 nt, Human
caggggccuccaguccag

SEQ ID NO: 307649 - RNA, 19 nt, Human
caugauggggcagccaggc

SEQ ID NO: 307650 - RNA, 22 nt, Human
cgcugaccgacucgggcuacgc

SEQ ID NO: 307651 - RNA, 25 nt, Human
cggcaacaggccuggaggugcugca

SEQ ID NO: 307652 - RNA, 20 nt, Human
cggcuucaauggaacaacag

SEQ ID NO: 307653 - RNA, 19 nt, Human
cuccaggggccuccagucc

SEQ ID NO: 307654 - RNA, 20 nt, Human
cuccaggggccuccagucca

SEQ ID NO: 307655 - RNA, 18 nt, Human
cuggcuccaggggccucc

SEQ ID NO: 307656 - RNA, 25 nt, Human
gaagcaaguaagggccagggccaga

SEQ ID NO: 307657 - RNA, 19 nt, Human
gaagguggaggguggagug

SEQ ID NO: 307658 - RNA, 19 nt, Human
gacucgggcuacgcugcaa

SEQ ID NO: 307659 - RNA, 18 nt, Human
ggacagaguacacacagg

SEQ ID NO: 307660 - RNA, 24 nt, Human
ggacaggggcuggaggaggggcuc

SEQ ID NO: 307661 - RNA, 21 nt, Human
ggcuggaggaggggcucuggg

SEQ ID NO: 307662 - RNA, 22 nt, Human
ggcuggaggaggggcucugggg

SEQ ID NO: 307663 - RNA, 20 nt, Human
ggcugggggaaggggguggg

SEQ ID NO: 307664 - RNA, 19 nt, Human
gggaagggggugggacagg

SEQ ID NO: 307665 - RNA, 25 nt, Human
gggaagggggugggacaggggcugg

SEQ ID NO: 307666 - RNA, 23 nt, Human
ggguggaguguuugcugcaggaa

SEQ ID NO: 307667 - RNA, 19 nt, Human
ggugcaaacuggagaggcc

SEQ ID NO: 307668 - RNA, 24 nt, Human
uaaggccccuaacucuugcuggcu

SEQ ID NO: 307669 - RNA, 19 nt, Human
uaccagugccacguuacag

SEQ ID NO: 307670 - RNA, 23 nt, Human
ucagugaggcguugaucuucuuc

SEQ ID NO: 307671 - RNA, 18 nt, Human
ucccuggugucccaaccu

SEQ ID NO: 307672 - RNA, 23 nt, Human
ucuaaaggaacuggacagaguac

SEQ ID NO: 307673 - RNA, 20 nt, Human
ucuggcuccaggggccucca

SEQ ID NO: 307674 - RNA, 23 nt, Human
ucuggcuccaggggccuccaguc

SEQ ID NO: 307675 - RNA, 24 nt, Human
ugauuggguggggccacaugaugg

SEQ ID NO: 307676 - RNA, 23 nt, Human
ugcaguagugggggaaaauggaa

SEQ ID NO: 307677 - RNA, 24 nt, Human
ugcugcaguagugggggaaaaugg

SEQ ID NO: 307678 - RNA, 19 nt, Human
uggaagguggaggguggag

SEQ ID NO: 307679 - RNA, 24 nt, Human
uggacagaguacacacaggaaagg

SEQ ID NO: 307680 - RNA, 18 nt, Human
uggaggguggaguguuug

SEQ ID NO: 307681 - RNA, 23 nt, Human
uggaggguggaguguuugcugca

SEQ ID NO: 307682 - RNA, 19 nt, Human
uggaggguggggacaggug

SEQ ID NO: 307683 - RNA, 20 nt, Human
uggccuaauggaugggcugg

SEQ ID NO: 307684 - RNA, 20 nt, Human
uggcuccaggggccuccagu

SEQ ID NO: 307685 - RNA, 19 nt, Human
ugggcugggggaagggggu

SEQ ID NO: 307686 - RNA, 20 nt, Human
ugggggaagggggugggaca

SEQ ID NO: 307687 - RNA, 20 nt, Human
ugggggaagggggugggaca

SEQ ID NO: 307688 - RNA, 19 nt, Human
uggguggggccacaugaug

SEQ ID NO: 307689 - RNA, 22 nt, Human
uggguggggccacaugaugggg

SEQ ID NO: 307690 - RNA, 22 nt, Human
ugucccaaccuaccagugccac

SEQ ID NO: 307691 - RNA, 23 nt, Human
uuggguggggccacaugaugggg

SEQ ID NO: 307692 - RNA, 20 nt, Human
aaaaaaaaccaugagaugug

SEQ ID NO: 307693 - RNA, 23 nt, Human
aaaaaaaaccaugagaugugcau

SEQ ID NO: 307694 - RNA, 27 nt, Human
aaaaacucuucacuagcuuaaaauguc

SEQ ID NO: 307695 - RNA, 22 nt, Human
aaaaagcagcaaaaaaaaccau

SEQ ID NO: 307696 - RNA, 20 nt, Human
aaaaaugucauucucucccc

SEQ ID NO: 307697 - RNA, 31 nt, Human
aaaauccacacacacgcacacacgcgcacag

SEQ ID NO: 307698 - RNA, 25 nt, Human
aaacaaaucgaaaccaaagaaaaca

SEQ ID NO: 307699 - RNA, 21 nt, Human
aacacugacaccaggagacca

SEQ ID NO: 307700 - RNA, 19 nt, Human
aagaaaacagaacccaggg

SEQ ID NO: 307701 - RNA, 23 nt, Human
aagagcaaaacucugucucaaaa

SEQ ID NO: 307702 - RNA, 18 nt, Human
aagaucaaccagcccacu

SEQ ID NO: 307703 - RNA, 23 nt, Human
aagcaacaacguacaagagaaca

SEQ ID NO: 307704 - RNA, 22 nt, Human
aagcagcaaaaaaaaccaugag

SEQ ID NO: 307705 - RNA, 20 nt, Human
aagcgaccaugcaacugugg

SEQ ID NO: 307706 - RNA, 27 nt, Human
aaguaaacaaugaaaacaaaucgaaac

SEQ ID NO: 307707 - RNA, 18 nt, Human
acacaagaucaaccagcc

SEQ ID NO: 307708 - RNA, 18 nt, Human
acacacacacacacacac

SEQ ID NO: 307709 - RNA, 21 nt, Human
acacacacacacuugaaagaa

SEQ ID NO: 307710 - RNA, 27 nt, Human
acacacacgcacacacgcgcacacaca

SEQ ID NO: 307711 - RNA, 23 nt, Human
acacgcacacacgcgcacacaca

SEQ ID NO: 307712 - RNA, 26 nt, Human
acacgcacacacgcgcacacacacac

SEQ ID NO: 307713 - RNA, 22 nt, Human
acagaacuaagugacaaccgca

SEQ ID NO: 307714 - RNA, 19 nt, Human
accacuccuaaguaaacaa

SEQ ID NO: 307715 - RNA, 27 nt, Human
accucacuuaccugaaguccgacuucg

SEQ ID NO: 307716 - RNA, 25 nt, Human
accucacuuaccugaaguccuguuu

SEQ ID NO: 307717 - RNA, 23 nt, Human
acgcacacacgcgcacacacaca

SEQ ID NO: 307718 - RNA, 19 nt, Human
acucagucuaggcgugugc

SEQ ID NO: 307719 - RNA, 18 nt, Human
acugaagacauucccgac

SEQ ID NO: 307720 - RNA, 23 nt, Human
agaaaaaacucuucacuagcuua

SEQ ID NO: 307721 - RNA, 20 nt, Human
agaaaacagaacccagccca

SEQ ID NO: 307722 - RNA, 27 nt, Human
agaaaacagaacccagcccacucucuc

SEQ ID NO: 307723 - RNA, 18 nt, Human
agagcaaaacucugucuc

SEQ ID NO: 307724 - RNA, 24 nt, Human
aggaaacagaaguccuacaguuau

SEQ ID NO: 307725 - RNA, 18 nt, Human
agggauucaaggugggga

SEQ ID NO: 307726 - RNA, 19 nt, Human
aggguggggagcgggggca

SEQ ID NO: 307727 - RNA, 19 nt, Human
aggugcccucgccagacca

SEQ ID NO: 307728 - RNA, 24 nt, Human
aguaaacaaugaaaacaaaucgaa

SEQ ID NO: 307729 - RNA, 22 nt, Human
aucacgguuuagaaaauggcag

SEQ ID NO: 307730 - RNA, 18 nt, Human
auugcccuccagccuggg

SEQ ID NO: 307731 - RNA, 22 nt, Human
caaacgcaaacguaggagccaa

SEQ ID NO: 307732 - RNA, 22 nt, Human
caaagaaaacagaacccagccc

SEQ ID NO: 307733 - RNA, 21 nt, Human
caacaacguacaagagaacac

SEQ ID NO: 307734 - RNA, 19 nt, Human
cacacaagaucaaccagcc

SEQ ID NO: 307735 - RNA, 20 nt, Human
cacacacacacacacacaca

SEQ ID NO: 307736 - RNA, 28 nt, Human
cacacacacgcacacacgcgcacacaca

SEQ ID NO: 307737 - RNA, 24 nt, Human
caccauugcccuccagccugggca

SEQ ID NO: 307738 - RNA, 18 nt, Human
caccguggccuguuuucu

SEQ ID NO: 307739 - RNA, 26 nt, Human
cacgcgcacacacacacacacacaca

SEQ ID NO: 307740 - RNA, 20 nt, Human
cacgguuuagaaaauggcag

SEQ ID NO: 307741 - RNA, 21 nt, Human
cacuagcuuaaaaugucccuu

SEQ ID NO: 307742 - RNA, 19 nt, Human
cagaacccagcccacucuc

SEQ ID NO: 307743 - RNA, 24 nt, Human
cagccauaccauuucagaugauau

SEQ ID NO: 307744 - RNA, 24 nt, Human
cagcccacugagaucugcuggaac

SEQ ID NO: 307745 - RNA, 23 nt, Human
caggagaccagccacaaacgcaa

SEQ ID NO: 307746 - RNA, 25 nt, Human
caggagaccagccacaaacgcaaga

SEQ ID NO: 307747 - RNA, 26 nt, Human
caggcucacugaacaugaggggacuu

SEQ ID NO: 307748 - RNA, 19 nt, Human
cauugcccuccagccuggg

SEQ ID NO: 307749 - RNA, 22 nt, Human
cauugcccuccagccugggcaa

SEQ ID NO: 307750 - RNA, 23 nt, Human
cauugcccuccagccugggcaac

SEQ ID NO: 307751 - RNA, 24 nt, Human
cauugcccuccagccugggcaaca

SEQ ID NO: 307752 - RNA, 25 nt, Human
ccagaccaacucgcugcugggacuc

SEQ ID NO: 307753 - RNA, 23 nt, Human
ccagcaagguaaaaauaggaguu

SEQ ID NO: 307754 - RNA, 25 nt, Human
ccauccacucacgacgaaaccacac

SEQ ID NO: 307755 - RNA, 21 nt, Human
ccauugcccuccagccugggc

SEQ ID NO: 307756 - RNA, 23 nt, Human
ccauugcccuccagccugggcaa

SEQ ID NO: 307757 - RNA, 24 nt, Human
ccauugcccuccagccugggcaac

SEQ ID NO: 307758 - RNA, 23 nt, Human
cccacugagaucugcuggaacca

SEQ ID NO: 307759 - RNA, 24 nt, Human
ccccaaaagacuugauaaccaagu

SEQ ID NO: 307760 - RNA, 24 nt, Human
cccuccagccugggcaacaagagc

SEQ ID NO: 307761 - RNA, 18 nt, Human
cccucgccagaccaacuc

SEQ ID NO: 307762 - RNA, 23 nt, Human
cccuuggcuuacaaccaaucauu

SEQ ID NO: 307763 - RNA, 19 nt, Human
ccuguuuucugagaaaaag

SEQ ID NO: 307764 - RNA, 22 nt, Human
cgaaaccaaagaaaacagaacc

SEQ ID NO: 307765 - RNA, 22 nt, Human
cgaaagcaacaacguacaagag

SEQ ID NO: 307766 - RNA, 20 nt, Human
cgcacacacacacacacaca

SEQ ID NO: 307767 - RNA, 22 nt, Human
cgcacacacgcgcacacacaca

SEQ ID NO: 307768 - RNA, 23 nt, Human
cgcacacacgcgcacacacacac

SEQ ID NO: 307769 - RNA, 26 nt, Human
cgcgcacacacacacacacacacacu

SEQ ID NO: 307770 - RNA, 18 nt, Human
cggaauggguacaaggga

SEQ ID NO: 307771 - RNA, 21 nt, Human
cucgccagaccaacucgcugc

SEQ ID NO: 307772 - RNA, 27 nt, Human
cucugucucaaaaaaaaaaugucauuc

SEQ ID NO: 307773 - RNA, 23 nt, Human
cuuaaaaugucccuuggcuuaca

SEQ ID NO: 307774 - RNA, 21 nt, Human
gaaaaaaaaagcagcaaaaaa

SEQ ID NO: 307775 - RNA, 23 nt, Human
gaaaaaaaaagcagcaaaaaaaa

SEQ ID NO: 307776 - RNA, 21 nt, Human
gaaaacaaaucgaaaccaaag

SEQ ID NO: 307777 - RNA, 18 nt, Human
gacucucaagaaacugaa

SEQ ID NO: 307778 - RNA, 19 nt, Human
gaggugcccucgccagacc

SEQ ID NO: 307779 - RNA, 19 nt, Human
ggcugccgaggugcccucg

SEQ ID NO: 307780 - RNA, 24 nt, Human
gggcugccgaggugcccucgccag

SEQ ID NO: 307781 - RNA, 18 nt, Human
ggguggggagcgggggca

SEQ ID NO: 307782 - RNA, 23 nt, Human
guuucgggugcagcagcuucuuu

SEQ ID NO: 307783 - RNA, 22 nt, Human
uaaaaauccacacacacgcaca

SEQ ID NO: 307784 - RNA, 18 nt, Human
uaccaggaaacagaaguc

SEQ ID NO: 307785 - RNA, 25 nt, Human
uauccucaauauagucaucauccaa

SEQ ID NO: 307786 - RNA, 21 nt, Human
ucaaggguggggagcgggggc

SEQ ID NO: 307787 - RNA, 24 nt, Human
ucagaacauuccaaauugaaauau

SEQ ID NO: 307788 - RNA, 20 nt, Human
ucauucucuccccaaaagac

SEQ ID NO: 307789 - RNA, 20 nt, Human
uccacacacacgcacacacg

SEQ ID NO: 307790 - RNA, 24 nt, Human
ucgaaaccaaagaaaacagaaccc

SEQ ID NO: 307791 - RNA, 20 nt, Human
ucgaaagcaacaacguacaa

SEQ ID NO: 307792 - RNA, 19 nt, Human
ucuuucaguuaaagcuccu

SEQ ID NO: 307793 - RNA, 24 nt, Human
ucuuuugggaaaaaucaauuccag

SEQ ID NO: 307794 - RNA, 24 nt, Human
ugaaaaaaaaagcagcaaaaaaaa

SEQ ID NO: 307795 - RNA, 24 nt, Human
ugaaacaggugaauuuuauagaau

SEQ ID NO: 307796 - RNA, 22 nt, Human
ugaaguuaaaacuuuuaaaaca

SEQ ID NO: 307797 - RNA, 19 nt, Human
ugcagauaucaaaauuuca

SEQ ID NO: 307798 - RNA, 23 nt, Human
ugcccuagcucugagccaauggg

SEQ ID NO: 307799 - RNA, 19 nt, Human
ugcccuccagccugggcaa

SEQ ID NO: 307800 - RNA, 26 nt, Human
ugcuggaaccacagaacuaagugaca

SEQ ID NO: 307801 - RNA, 22 nt, Human
ugggaaaaaucaauuccagaaa

SEQ ID NO: 307802 - RNA, 22 nt, Human
uggucaagugagcaggagggcu

SEQ ID NO: 307803 - RNA, 26 nt, Human
uguggucagauuuaaauuagacugga

SEQ ID NO: 307804 - RNA, 19 nt, Human
uguuaccaggaaacagaag

SEQ ID NO: 307805 - RNA, 19 nt, Human
uuagaaaauggcagcgcua

SEQ ID NO: 307806 - RNA, 20 nt, Human
uuagaucaaguguaaaaugc

SEQ ID NO: 307807 - RNA, 18 nt, Human
uucagaugauaugaagac

SEQ ID NO: 307808 - RNA, 21 nt, Human
uugcugugcaaacuccaaaaa

SEQ ID NO: 307809 - RNA, 24 nt, Human
uugcugugcaaacuccaaaaaguc

SEQ ID NO: 307810 - RNA, 31 nt, Human
uuuaaaaauccacacacacgcacacacgcgg

SEQ ID NO: 307811 - RNA, 25 nt, Human
uuuaaaauaaauuucuguguguuuc

SEQ ID NO: 307812 - RNA, 18 nt, Human
uuugcugugcaaacucca

SEQ ID NO: 307813 - RNA, 26 nt, Human
uuuuauaguaguaaauguucaucacu

SEQ ID NO: 307814 - RNA, 23 nt, Human
aaaaaucuuuccacuauccacag

SEQ ID NO: 307815 - RNA, 22 nt, Human
aaagccccccccgccccaaccu

SEQ ID NO: 307816 - RNA, 20 nt, Human
aagaaagccccccccgcccc

SEQ ID NO: 307817 - RNA, 20 nt, Human
aagccccccccgccccaacc

SEQ ID NO: 307818 - RNA, 22 nt, Human
aagccccccccgccccaaccuc

SEQ ID NO: 307819 - RNA, 21 nt, Human
accccugcccugcaccacccc

SEQ ID NO: 307820 - RNA, 23 nt, Human
agaaaaccccauccagcgaggcc

SEQ ID NO: 307821 - RNA, 21 nt, Human
aggaaaaaaaaaaucuaaaaa

SEQ ID NO: 307822 - RNA, 26 nt, Human
aggaaaaaaaaaaucuaaaaaucuuu

SEQ ID NO: 307823 - RNA, 19 nt, Human
auggacagaaaaccccauc

SEQ ID NO: 307824 - RNA, 22 nt, Human
caagaaagccccccccgcccca

SEQ ID NO: 307825 - RNA, 22 nt, Human
caagaaagccccccccgcccca

SEQ ID NO: 307826 - RNA, 21 nt, Human
cacuggcgaggcccgcccucc

SEQ ID NO: 307827 - RNA, 22 nt, Human
caggauauaccaccccugcccu

SEQ ID NO: 307828 - RNA, 24 nt, Human
ccaaccucccuaacccccauugcc

SEQ ID NO: 307829 - RNA, 18 nt, Human
ccaaggaaaaaaaaaauc

SEQ ID NO: 307830 - RNA, 23 nt, Human
ccaaggaaaaaaaaaaucuaaaa

SEQ ID NO: 307831 - RNA, 19 nt, Human
ccauccagcgaggccugag

SEQ ID NO: 307832 - RNA, 19 nt, Human
cccaaggaaaaaaaaaauc

SEQ ID NO: 307833 - RNA, 25 nt, Human
ccccaaccucccuaacccccauugc

SEQ ID NO: 307834 - RNA, 22 nt, Human
ccccccccgccccaaccucccu

SEQ ID NO: 307835 - RNA, 24 nt, Human
cccccccgccccaaccucccuaac

SEQ ID NO: 307836 - RNA, 18 nt, Human
ccccccgccccaaccucc

SEQ ID NO: 307837 - RNA, 24 nt, Human
cccccgccccaaccucccuaaccc

SEQ ID NO: 307838 - RNA, 18 nt, Human
ccccgccccaaccucccu

SEQ ID NO: 307839 - RNA, 21 nt, Human
ccccgccccaaccucccuaac

SEQ ID NO: 307840 - RNA, 25 nt, Human
cccugcagcugcuccuggcgcuucc

SEQ ID NO: 307841 - RNA, 18 nt, Human
ccucccuaacccccauug

SEQ ID NO: 307842 - RNA, 21 nt, Human
ccucccuaacccccauugccu

SEQ ID NO: 307843 - RNA, 18 nt, Human
ccugcaagccuaacuugc

SEQ ID NO: 307844 - RNA, 18 nt, Human
ccugcagcugcuccuggc

SEQ ID NO: 307845 - RNA, 21 nt, Human
cgccccaaccucccuaacccc

SEQ ID NO: 307846 - RNA, 22 nt, Human
cgcggccggggccuaggagagc

SEQ ID NO: 307847 - RNA, 24 nt, Human
cugcuccuggcgcuuccacccugg

SEQ ID NO: 307848 - RNA, 20 nt, Human
gacagaaaaccccauccagc

SEQ ID NO: 307849 - RNA, 18 nt, Human
gagcgugcucuucucgcu

SEQ ID NO: 307850 - RNA, 23 nt, Human
gccccaaccucccuaacccccau

SEQ ID NO: 307851 - RNA, 19 nt, Human
gcgcgcggccggggccuag

SEQ ID NO: 307852 - RNA, 24 nt, Human
gcuccuggcgcuuccacccugguu

SEQ ID NO: 307853 - RNA, 18 nt, Human
ggcacuggcgaggcccgc

SEQ ID NO: 307854 - RNA, 19 nt, Human
gggcucccugcagcugcuc

SEQ ID NO: 307855 - RNA, 21 nt, Human
uaacucaagaaagcccccccc

SEQ ID NO: 307856 - RNA, 24 nt, Human
uauaccaccccugcccugcaccac

SEQ ID NO: 307857 - RNA, 25 nt, Human
uccccaaggaaaaaaaaaaucuaaa

SEQ ID NO: 307858 - RNA, 19 nt, Human
ucccugcagcugcuccugg

SEQ ID NO: 307859 - RNA, 23 nt, Human
ucuaaaaaucuuuccacuauccu

SEQ ID NO: 307860 - RNA, 21 nt, Human
ucucuggcacuggcgaggccc

SEQ ID NO: 307861 - RNA, 23 nt, Human
ugaacuuucccaaauacugcacu

SEQ ID NO: 307862 - RNA, 18 nt, Human
ugagggcuucucagcugg

SEQ ID NO: 307863 - RNA, 19 nt, Human
uucgucccucucuggcacu

SEQ ID NO: 307864 - RNA, 23 nt, Human
uugccugccaguuuccccaagga

SEQ ID NO: 307865 - RNA, 19 nt, Human
aaaaaaaaaaauaacagaa

SEQ ID NO: 307866 - RNA, 21 nt, Human
aaaacaugggaaccagaaaag

SEQ ID NO: 307867 - RNA, 24 nt, Human
aaacaaccaaggggauaaaaacaa

SEQ ID NO: 307868 - RNA, 19 nt, Human
aaacaugggaaccagaaaa

SEQ ID NO: 307869 - RNA, 23 nt, Human
aaauucucuccaguauuuuaaaa

SEQ ID NO: 307870 - RNA, 20 nt, Human
aaccaaggggauaaaaacaa

SEQ ID NO: 307871 - RNA, 25 nt, Human
aaccagaaaaggaauauaaauguaa

SEQ ID NO: 307872 - RNA, 26 nt, Human
aagcacaaaguaaagaaaggggaccc

SEQ ID NO: 307873 - RNA, 22 nt, Human
acaaccaaggggauaaaaacaa

SEQ ID NO: 307874 - RNA, 20 nt, Human
acacugcagaacaauacacc

SEQ ID NO: 307875 - RNA, 19 nt, Human
acuuaggacaaauguuguc

SEQ ID NO: 307876 - RNA, 18 nt, Human
agagaaaaacaaccaagg

SEQ ID NO: 307877 - RNA, 20 nt, Human
agcccuaauaacaaagaccc

SEQ ID NO: 307878 - RNA, 24 nt, Human
agccuguggccgguaucuacuggu

SEQ ID NO: 307879 - RNA, 25 nt, Human
auaaauucucuccaguauuuuaaaa

SEQ ID NO: 307880 - RNA, 22 nt, Human
aucacaguugccuuucucugug

SEQ ID NO: 307881 - RNA, 27 nt, Human
auuuaaaaaucagagaaaaacaaccaa

SEQ ID NO: 307882 - RNA, 18 nt, Human
auuuguuuucuggauuca

SEQ ID NO: 307883 - RNA, 19 nt, Human
cacaaaguaaagaaagaaa

SEQ ID NO: 307884 - RNA, 20 nt, Human
cagauaaagauagaguccag

SEQ ID NO: 307885 - RNA, 20 nt, Human
caggaaaggcauuacauagg

SEQ ID NO: 307886 - RNA, 22 nt, Human
caggcaguggccaaaaaagucc

SEQ ID NO: 307887 - RNA, 23 nt, Human
cagucugauagaaggccuuaguu

SEQ ID NO: 307888 - RNA, 21 nt, Human
caugcuuuugagguuucuugg

SEQ ID NO: 307889 - RNA, 22 nt, Human
ccaaggggauaaaaacaagcac

SEQ ID NO: 307890 - RNA, 23 nt, Human
ccaucguuuagaagagauuugga

SEQ ID NO: 307891 - RNA, 25 nt, Human
ccucuugcagauaaagauagagucc

SEQ ID NO: 307892 - RNA, 19 nt, Human
cuuacagucaugcauacuu

SEQ ID NO: 307893 - RNA, 21 nt, Human
cuuuucuucucuagaguuuuc

SEQ ID NO: 307894 - RNA, 21 nt, Human
gacaaaacaugggaaccagaa

SEQ ID NO: 307895 - RNA, 23 nt, Human
gcacaaaguaaagaaagaaacca

SEQ ID NO: 307896 - RNA, 27 nt, Human
ggaaaagacuucuuuaauuugcuauga

SEQ ID NO: 307897 - RNA, 18 nt, Human
ggguaguagaaaaauagg

SEQ ID NO: 307898 - RNA, 19 nt, Human
ggugggcaaggcugggcug

SEQ ID NO: 307899 - RNA, 24 nt, Human
guaaagacuaacucuauaugaaug

SEQ ID NO: 307900 - RNA, 23 nt, Human
guguuuuccuuuggggauuuuug

SEQ ID NO: 307901 - RNA, 23 nt, Human
uaaaaacaagcacaaaguaaaga

SEQ ID NO: 307902 - RNA, 25 nt, Human
uaaaaucccaguaaugcaacagcuu

SEQ ID NO: 307903 - RNA, 22 nt, Human
uaaagauagaguccauucuuuc

SEQ ID NO: 307904 - RNA, 19 nt, Human
uaaguugucuucauucagc

SEQ ID NO: 307905 - RNA, 22 nt, Human
uagaaacaaggcaugcuuuuga

SEQ ID NO: 307906 - RNA, 24 nt, Human
uaucaucagaacucuggaaaaaga

SEQ ID NO: 307907 - RNA, 22 nt, Human
uaugagaucuaguggcucugug

SEQ ID NO: 307908 - RNA, 22 nt, Human
uauuucucauaucauuucugga

SEQ ID NO: 307909 - RNA, 26 nt, Human
ucagauuaaaaaaaaaaauaacagaa

SEQ ID NO: 307910 - RNA, 22 nt, Human
ucagugccccaggcuggccagg

SEQ ID NO: 307911 - RNA, 22 nt, Human
ucauaugagaucuaguggcucu

SEQ ID NO: 307912 - RNA, 19 nt, Human
ucauugacucaguguuggg

SEQ ID NO: 307913 - RNA, 23 nt, Human
ucauugacucaguguugggggag

SEQ ID NO: 307914 - RNA, 22 nt, Human
uccaggcaguggccaaaaaagu

SEQ ID NO: 307915 - RNA, 19 nt, Human
ucccaguaaugcaacaggg

SEQ ID NO: 307916 - RNA, 20 nt, Human
uccucucaauuucuuuuucu

SEQ ID NO: 307917 - RNA, 24 nt, Human
ucuaccauaagcccuaauaacaaa

SEQ ID NO: 307918 - RNA, 26 nt, Human
ucuuacagucaugcauacucuguaau

SEQ ID NO: 307919 - RNA, 26 nt, Human
ucuucacuuuucuucucuagaguuuu

SEQ ID NO: 307920 - RNA, 22 nt, Human
ugaaaaaaaauugcuucaaaua

SEQ ID NO: 307921 - RNA, 27 nt, Human
ugacaaaacaugggaaccagaaaagga

SEQ ID NO: 307922 - RNA, 22 nt, Human
ugagaaaaaucucauugacuca

SEQ ID NO: 307923 - RNA, 22 nt, Human
ugagugacaaaacaugggaacc

SEQ ID NO: 307924 - RNA, 24 nt, Human
uggaugaugucaaccauuuaaaau

SEQ ID NO: 307925 - RNA, 21 nt, Human
uggcaaacuugcaaaggucuu

SEQ ID NO: 307926 - RNA, 21 nt, Human
uggugggcaaggcugggcugg

SEQ ID NO: 307927 - RNA, 21 nt, Human
ugugauauuucuuaaauggug

SEQ ID NO: 307928 - RNA, 25 nt, Human
ugugcacaugagugacaaaacaugg

SEQ ID NO: 307929 - RNA, 25 nt, Human
uguggccgguaucuacugguggcaa

SEQ ID NO: 307930 - RNA, 22 nt, Human
uguucuauuuguuuucuggauu

SEQ ID NO: 307931 - RNA, 23 nt, Human
uuaaaaaucagagaaaaacaacc

SEQ ID NO: 307932 - RNA, 24 nt, Human
uucucauaucauuucuggaugguc

SEQ ID NO: 307933 - RNA, 22 nt, Human
uucucuguggaaaagauuuuau

SEQ ID NO: 307934 - RNA, 21 nt, Human
uuuguuuucuggauucagggg

SEQ ID NO: 307935 - RNA, 24 nt, Human
ccucaaaaaggaaaaaaaaacaca

SEQ ID NO: 307936 - RNA, 24 nt, Human
cggcacccgaaaaaauuaaaaaag

SEQ ID NO: 307937 - RNA, 25 nt, Human
cuucauucauuccuuccacuucacu

SEQ ID NO: 307938 - RNA, 22 nt, Human
gaaaaaauuaaaaaagugccgc

SEQ ID NO: 307939 - RNA, 19 nt, Human
gcgcggcugcccgccccuc

SEQ ID NO: 307940 - RNA, 20 nt, Human
gcggcggcgcggcugcccgc

SEQ ID NO: 307941 - RNA, 22 nt, Human
gcugcccgccccucaaaaacaa

SEQ ID NO: 307942 - RNA, 21 nt, Human
uaaaaaagugccgcggcggcg

SEQ ID NO: 307943 - RNA, 22 nt, Human
ucaaaaaggaaaaaaaaacaca

SEQ ID NO: 307944 - RNA, 22 nt, Human
ucauucauuccuuccacuucac

SEQ ID NO: 307945 - RNA, 18 nt, Human
acagaagacuuggaggag

SEQ ID NO: 307946 - RNA, 23 nt, Human
accaagcccggcggacacacacc

SEQ ID NO: 307947 - RNA, 19 nt, Human
accgggagucaggcccagg

SEQ ID NO: 307948 - RNA, 24 nt, Human
accucaccuucccucgcggcccaa

SEQ ID NO: 307949 - RNA, 20 nt, Human
accuggggcggcgcaaaggc

SEQ ID NO: 307950 - RNA, 20 nt, Human
acucccccagccccuccccc

SEQ ID NO: 307951 - RNA, 18 nt, Human
agacuuggaggaggggua

SEQ ID NO: 307952 - RNA, 22 nt, Human
agaggugggacggugcugcagg

SEQ ID NO: 307953 - RNA, 22 nt, Human
agcuaggggcgggcaccugggg

SEQ ID NO: 307954 - RNA, 21 nt, Human
aggcaccaagcccggcggaca

SEQ ID NO: 307955 - RNA, 24 nt, Human
auuacucccccagccccucccccg

SEQ ID NO: 307956 - RNA, 25 nt, Human
caagcccggcggacacacaccccgg

SEQ ID NO: 307957 - RNA, 24 nt, Human
cacacaccccggcugucacgcccc

SEQ ID NO: 307958 - RNA, 21 nt, Human
caccuggggcggcgcaaaggc

SEQ ID NO: 307959 - RNA, 18 nt, Human
cacgccccggcuccgccc

SEQ ID NO: 307960 - RNA, 25 nt, Human
cacgccccggcuccgcccccgaccu

SEQ ID NO: 307961 - RNA, 24 nt, Human
cacgccuguaaucccagcacuuug

SEQ ID NO: 307962 - RNA, 22 nt, Human
ccagccccucccccgcucaccu

SEQ ID NO: 307963 - RNA, 23 nt, Human
ccggcggacacacaccccggcug

SEQ ID NO: 307964 - RNA, 18 nt, Human
ccugaauuugcuuuaaca

SEQ ID NO: 307965 - RNA, 19 nt, Human
cgcccccgaccucaccuuc

SEQ ID NO: 307966 - RNA, 22 nt, Human
cucacgccuguaaucccagcac

SEQ ID NO: 307967 - RNA, 24 nt, Human
cucacgccuguaaucccagcacuu

SEQ ID NO: 307968 - RNA, 22 nt, Human
cugucacgccccggcuccgccc

SEQ ID NO: 307969 - RNA, 21 nt, Human
gacucacgccuguaaucccag

SEQ ID NO: 307970 - RNA, 23 nt, Human
ggcgcggugacucacgccuguaa

SEQ ID NO: 307971 - RNA, 22 nt, Human
ggcgcuggggacaggaccggga

SEQ ID NO: 307972 - RNA, 24 nt, Human
ggugacucacgccuguaaucccag

SEQ ID NO: 307973 - RNA, 19 nt, Human
gucacgccccggcuccgcc

SEQ ID NO: 307974 - RNA, 20 nt, Human
gugcugcagggccaccggag

SEQ ID NO: 307975 - RNA, 18 nt, Human
ucuuggucacugaagggg

SEQ ID NO: 307976 - RNA, 22 nt, Human
ucuuuugauguuauuacucccc

SEQ ID NO: 307977 - RNA, 21 nt, Human
ugacucacgccuguaauccca

SEQ ID NO: 307978 - RNA, 22 nt, Human
ugacucacgccuguaaucccag

SEQ ID NO: 307979 - RNA, 24 nt, Human
ugacucacgccuguaaucccagca

SEQ ID NO: 307980 - RNA, 18 nt, Human
ugcugcagggccaccgga

SEQ ID NO: 307981 - RNA, 22 nt, Human
ugcugcagggccaccggaggca

SEQ ID NO: 307982 - RNA, 20 nt, Human
ugggacggugcugcagggcc

SEQ ID NO: 307983 - RNA, 21 nt, Human
ugugcaaaagagcauuucaag

SEQ ID NO: 307984 - RNA, 24 nt, Human
uuuggccgggcgcggugacucacg

SEQ ID NO: 307985 - RNA, 21 nt, Human
uuuuuuuuuuuuuuuuucauu

SEQ ID NO: 307986 - RNA, 21 nt, Human
ggagaguacagugugagauga

SEQ ID NO: 307987 - RNA, 18 nt, Human
ugagaugaggcagauaga

SEQ ID NO: 307988 - RNA, 20 nt, Human
uggagaguacagugugagau

SEQ ID NO: 307989 - RNA, 25 nt, Human
aacuucugccccggccgucgcuccc

SEQ ID NO: 307990 - RNA, 18 nt, Human
aaggcuguuuggagacag

SEQ ID NO: 307991 - RNA, 23 nt, Human
agacagggcaggugaaugcuccc

SEQ ID NO: 307992 - RNA, 23 nt, Human
agagagggaaauucagcacuggg

SEQ ID NO: 307993 - RNA, 23 nt, Human
agggagggaggguaugagagagg

SEQ ID NO: 307994 - RNA, 20 nt, Human
auggacuggccuagcuccuc

SEQ ID NO: 307995 - RNA, 19 nt, Human
cacuggguggaagguuucc

SEQ ID NO: 307996 - RNA, 21 nt, Human
cagaagagaccccccggagua

SEQ ID NO: 307997 - RNA, 18 nt, Human
cccccggaguacagcuuc

SEQ ID NO: 307998 - RNA, 20 nt, Human
ccgucgcuccccugcuccuc

SEQ ID NO: 307999 - RNA, 20 nt, Human
ccuagcuccucugcugggug

SEQ ID NO: 308000 - RNA, 22 nt, Human
ccucugggagguuggggguagg

SEQ ID NO: 308001 - RNA, 21 nt, Human
cuguuuggagacagggcaggu

SEQ ID NO: 308002 - RNA, 22 nt, Human
gagagggaaauucagcacuggg

SEQ ID NO: 308003 - RNA, 22 nt, Human
gggcaggugaaugcucccuucu

SEQ ID NO: 308004 - RNA, 24 nt, Human
ggggguaggugaggcacaaggcug

SEQ ID NO: 308005 - RNA, 20 nt, Human
uagaagggcuccugccuggc

SEQ ID NO: 308006 - RNA, 25 nt, Human
uagggagggaggguaugagagaggg

SEQ ID NO: 308007 - RNA, 19 nt, Human
ucaacuucugccccggccg

SEQ ID NO: 308008 - RNA, 25 nt, Human
ucagaagagaccccccggaguacag

SEQ ID NO: 308009 - RNA, 21 nt, Human
ucccucugggagguugggggu

SEQ ID NO: 308010 - RNA, 19 nt, Human
ucccuggaucuguugcucu

SEQ ID NO: 308011 - RNA, 25 nt, Human
ucccuggaucuguugcucuuuuucc

SEQ ID NO: 308012 - RNA, 18 nt, Human
ugagagagggaaauucag

SEQ ID NO: 308013 - RNA, 23 nt, Human
uggccuagcuccucugcugggug

SEQ ID NO: 308014 - RNA, 24 nt, Human
ugggugacaaaugcagauggacug

SEQ ID NO: 308015 - RNA, 18 nt, Human
uguucugcacuccugcuc

SEQ ID NO: 308016 - RNA, 19 nt, Human
uucagaagagaccccccgg

SEQ ID NO: 308017 - RNA, 19 nt, Human
uucugcacuccugcucccc

SEQ ID NO: 308018 - RNA, 24 nt, Human
uugguuaagcacggaguugaggug

SEQ ID NO: 308019 - RNA, 22 nt, Human
uuuuuuuuuuuuuuuugcuaau

SEQ ID NO: 308020 - RNA, 18 nt, Human
uuuuuuuuuuuuuuuuug

SEQ ID NO: 308021 - RNA, 20 nt, Human
uuuuuuuuuuuuuuuuugcu

SEQ ID NO: 308022 - RNA, 23 nt, Human
uuuuuuuuuuuuuuuuuugcuaa

SEQ ID NO: 308023 - RNA, 18 nt, Human
aacccagacaauccugca

SEQ ID NO: 308024 - RNA, 23 nt, Human
aaggauucuugugcaaaugcuuu

SEQ ID NO: 308025 - RNA, 21 nt, Human
aaguguugggauuacaggcau

SEQ ID NO: 308026 - RNA, 23 nt, Human
aaguguugggauuacaggcauga

SEQ ID NO: 308027 - RNA, 26 nt, Human
aaguguugggauuacaggcaugagcc

SEQ ID NO: 308028 - RNA, 18 nt, Human
aauagcugggauuacagg

SEQ ID NO: 308029 - RNA, 23 nt, Human
aauagcugggauuacaggcaccc

SEQ ID NO: 308030 - RNA, 19 nt, Human
acacaggcacagcugcccc

SEQ ID NO: 308031 - RNA, 22 nt, Human
acagagugucacucuguugccc

SEQ ID NO: 308032 - RNA, 24 nt, Human
acaggggaaacagagauggcacag

SEQ ID NO: 308033 - RNA, 19 nt, Human
acccaagaaggauuuaugg

SEQ ID NO: 308034 - RNA, 20 nt, Human
accuggccucacucagggag

SEQ ID NO: 308035 - RNA, 18 nt, Human
acgagguuuugccauguu

SEQ ID NO: 308036 - RNA, 20 nt, Human
acgagguuuugccauguugg

SEQ ID NO: 308037 - RNA, 24 nt, Human
acucuguugcccaggcuggagugc

SEQ ID NO: 308038 - RNA, 22 nt, Human
agaaggcauugguagaggguuc

SEQ ID NO: 308039 - RNA, 23 nt, Human
agaccagggcaguauuuagggga

SEQ ID NO: 308040 - RNA, 21 nt, Human
agagaggugguuccaggagag

SEQ ID NO: 308041 - RNA, 24 nt, Human
agagguggggcagggggaaggcag

SEQ ID NO: 308042 - RNA, 18 nt, Human
agccuccugaauagcugg

SEQ ID NO: 308043 - RNA, 25 nt, Human
aggcuggagugcagugucgcgaucu

SEQ ID NO: 308044 - RNA, 22 nt, Human
aggcuucacccaagaaggauuu

SEQ ID NO: 308045 - RNA, 19 nt, Human
agggagaggggccuugggc

SEQ ID NO: 308046 - RNA, 20 nt, Human
agggggugaggaaggacaag

SEQ ID NO: 308047 - RNA, 20 nt, Human
aggggucagaccaagcagag

SEQ ID NO: 308048 - RNA, 28 nt, Human
aggggucagaccaagcagagaggugguu

SEQ ID NO: 308049 - RNA, 22 nt, Human
agguccaagugauucuccugcc

SEQ ID NO: 308050 - RNA, 23 nt, Human
agguccaagugauucuccugccu

SEQ ID NO: 308051 - RNA, 20 nt, Human
agguggggaugccagagcuc

SEQ ID NO: 308052 - RNA, 22 nt, Human
aguagagacgagguuuugccau

SEQ ID NO: 308053 - RNA, 24 nt, Human
agugauucuccugccucagccucc

SEQ ID NO: 308054 - RNA, 19 nt, Human
agugcagugucgcgaucug

SEQ ID NO: 308055 - RNA, 18 nt, Human
auagcugggauuacaggc

SEQ ID NO: 308056 - RNA, 24 nt, Human
auuuuuguauuuuuaguagagacg

SEQ ID NO: 308057 - RNA, 22 nt, Human
caagugauucuccugccucagc

SEQ ID NO: 308058 - RNA, 23 nt, Human
cacaccaucugcugcaaccucug

SEQ ID NO: 308059 - RNA, 21 nt, Human
cacagcaaaauugagaaggua

SEQ ID NO: 308060 - RNA, 19 nt, Human
cacaucucagaacugcuca

SEQ ID NO: 308061 - RNA, 21 nt, Human
cacaugagucaccacaucuca

SEQ ID NO: 308062 - RNA, 18 nt, Human
cacccaccacgaugccug

SEQ ID NO: 308063 - RNA, 24 nt, Human
cacccugagccaaugccuggaggc

SEQ ID NO: 308064 - RNA, 18 nt, Human
caccuggccucacucagg

SEQ ID NO: 308065 - RNA, 24 nt, Human
cacgaugccuggcuaauuuuugua

SEQ ID NO: 308066 - RNA, 22 nt, Human
cacucuguugcccaggcuggag

SEQ ID NO: 308067 - RNA, 21 nt, Human
cagaccccucccccaccccga

SEQ ID NO: 308068 - RNA, 23 nt, Human
cagcaggugggggacagcggcag

SEQ ID NO: 308069 - RNA, 20 nt, Human
cagcggcagaccccuccccc

SEQ ID NO: 308070 - RNA, 22 nt, Human
cagcggcagaccccucccccac

SEQ ID NO: 308071 - RNA, 24 nt, Human
cagcugaggcacagauggugccaa

SEQ ID NO: 308072 - RNA, 24 nt, Human
caggcacccaccacgaugccuggc

SEQ ID NO: 308073 - RNA, 22 nt, Human
cagggcaguauuuaggggaagg

SEQ ID NO: 308074 - RNA, 24 nt, Human
cauguugggcaggcuggucuugaa

SEQ ID NO: 308075 - RNA, 19 nt, Human
ccaagugauucuccugccu

SEQ ID NO: 308076 - RNA, 20 nt, Human
ccaccaugccuggccuagac

SEQ ID NO: 308077 - RNA, 22 nt, Human
ccacccucagaggacacagcua

SEQ ID NO: 308078 - RNA, 18 nt, Human
ccagacaauccugcacag

SEQ ID NO: 308079 - RNA, 18 nt, Human
ccagagugugggugacug

SEQ ID NO: 308080 - RNA, 19 nt, Human
ccaggagaggccuggccuc

SEQ ID NO: 308081 - RNA, 22 nt, Human
ccaggugaucugccugccucag

SEQ ID NO: 308082 - RNA, 18 nt, Human
ccauccacccucagagga

SEQ ID NO: 308083 - RNA, 19 nt, Human
ccauguugggcaggcuggu

SEQ ID NO: 308084 - RNA, 21 nt, Human
ccauguugggcaggcuggucu

SEQ ID NO: 308085 - RNA, 24 nt, Human
cccaagaaggauuuauggagcucc

SEQ ID NO: 308086 - RNA, 27 nt, Human
cccagcgcccacaguccuucauuccua

SEQ ID NO: 308087 - RNA, 23 nt, Human
cccccacacaggcacagcugccc

SEQ ID NO: 308088 - RNA, 23 nt, Human
cccuaaguguugggauuacaggc

SEQ ID NO: 308089 - RNA, 24 nt, Human
cccuaaguguugggauuacaggca

SEQ ID NO: 308090 - RNA, 23 nt, Human
cccuuguaauucacccugagcca

SEQ ID NO: 308091 - RNA, 20 nt, Human
cccuuugacccugaggaggu

SEQ ID NO: 308092 - RNA, 22 nt, Human
ccgaugcuuugguccaaacacc

SEQ ID NO: 308093 - RNA, 19 nt, Human
ccuaaguguugggauuaca

SEQ ID NO: 308094 - RNA, 22 nt, Human
ccuaaguguugggauuacaggc

SEQ ID NO: 308095 - RNA, 24 nt, Human
ccuaaguguugggauuacaggcau

SEQ ID NO: 308096 - RNA, 22 nt, Human
ccucagccacccuaaguguugg

SEQ ID NO: 308097 - RNA, 24 nt, Human
ccucccagguccaagugauucucc

SEQ ID NO: 308098 - RNA, 23 nt, Human
ccugaauagcugggauuacaggc

SEQ ID NO: 308099 - RNA, 24 nt, Human
ccugaauagcugggauuacaggca

SEQ ID NO: 308100 - RNA, 21 nt, Human
ccugaccccaggugaucugcc

SEQ ID NO: 308101 - RNA, 23 nt, Human
ccugaccccaggugaucugccug

SEQ ID NO: 308102 - RNA, 23 nt, Human
ccuggccucagcccgauccgguu

SEQ ID NO: 308103 - RNA, 19 nt, Human
ccuugcuugggcuucuccc

SEQ ID NO: 308104 - RNA, 20 nt, Human
cgagguuuugccauguuggg

SEQ ID NO: 308105 - RNA, 22 nt, Human
cuaaguguugggauuacaggca

SEQ ID NO: 308106 - RNA, 25 nt, Human
cucacgccauucacaggcaugaauu

SEQ ID NO: 308107 - RNA, 22 nt, Human
cucacugaaaccucugccuccc

SEQ ID NO: 308108 - RNA, 23 nt, Human
cucacugaaaccucugccuccca

SEQ ID NO: 308109 - RNA, 24 nt, Human
cucacugaaaccucugccucccag

SEQ ID NO: 308110 - RNA, 19 nt, Human
cucccagguccaagugauu

SEQ ID NO: 308111 - RNA, 24 nt, Human
cuccugaauagcugggauuacagg

SEQ ID NO: 308112 - RNA, 26 nt, Human
cuccugaccccaggugaucugccugc

SEQ ID NO: 308113 - RNA, 19 nt, Human
cucuuggugggagaggugg

SEQ ID NO: 308114 - RNA, 20 nt, Human
cucuuggugggagagguggg

SEQ ID NO: 308115 - RNA, 18 nt, Human
cugaaaccucugccuccc

SEQ ID NO: 308116 - RNA, 23 nt, Human
cugaaaccucugccucccagguc

SEQ ID NO: 308117 - RNA, 19 nt, Human
cugagggaguacuuucugg

SEQ ID NO: 308118 - RNA, 20 nt, Human
cugcaaccucuguguaucca

SEQ ID NO: 308119 - RNA, 23 nt, Human
cugccucagccuccugaauagcu

SEQ ID NO: 308120 - RNA, 21 nt, Human
cuucuugguucugguguugcu

SEQ ID NO: 308121 - RNA, 21 nt, Human
cuugggcuucucccaagauuc

SEQ ID NO: 308122 - RNA, 24 nt, Human
gaccccaggugaucugccugccuc

SEQ ID NO: 308123 - RNA, 24 nt, Human
gacugugcaggguccccagugccu

SEQ ID NO: 308124 - RNA, 19 nt, Human
gagaggccuggccucagcc

SEQ ID NO: 308125 - RNA, 22 nt, Human
gagcaccuaguaugugggaaaa

SEQ ID NO: 308126 - RNA, 24 nt, Human
gagccaaugccuggaggcaggaga

SEQ ID NO: 308127 - RNA, 23 nt, Human
gagcuggcaauuguacccuccau

SEQ ID NO: 308128 - RNA, 18 nt, Human
gauuacaggcaugagcca

SEQ ID NO: 308129 - RNA, 21 nt, Human
gauuacaggcaugagccacca

SEQ ID NO: 308130 - RNA, 24 nt, Human
gauuacaggcaugagccaccaugc

SEQ ID NO: 308131 - RNA, 20 nt, Human
gccauguugggcaggcuggu

SEQ ID NO: 308132 - RNA, 24 nt, Human
gccauguugggcaggcuggucuug

SEQ ID NO: 308133 - RNA, 21 nt, Human
gcccaggcuggagugcagugu

SEQ ID NO: 308134 - RNA, 21 nt, Human
gcucacugaaaccucugccuc

SEQ ID NO: 308135 - RNA, 23 nt, Human
gcuggucuugaacuccugacccc

SEQ ID NO: 308136 - RNA, 23 nt, Human
ggaacaggguagagggugugggc

SEQ ID NO: 308137 - RNA, 19 nt, Human
ggaaccaggaaaacuggau

SEQ ID NO: 308138 - RNA, 20 nt, Human
ggaaggaggcagauuggagc

SEQ ID NO: 308139 - RNA, 24 nt, Human
ggacagcggcagaccccuccccca

SEQ ID NO: 308140 - RNA, 19 nt, Human
ggaggagggagugagcccu

SEQ ID NO: 308141 - RNA, 24 nt, Human
ggauuacaggcaugagccaccaug

SEQ ID NO: 308142 - RNA, 22 nt, Human
ggcucacgccauucacaggcau

SEQ ID NO: 308143 - RNA, 18 nt, Human
ggcuggucuugaacuccu

SEQ ID NO: 308144 - RNA, 18 nt, Human
gggaaaacaggggaaaca

SEQ ID NO: 308145 - RNA, 23 nt, Human
gggagacuuccagaaaguagccc

SEQ ID NO: 308146 - RNA, 23 nt, Human
gguaucccuaccuggaguggugc

SEQ ID NO: 308147 - RNA, 23 nt, Human
guagagacgagguuuugccaugu

SEQ ID NO: 308148 - RNA, 19 nt, Human
gucuaggcuucacccaaga

SEQ ID NO: 308149 - RNA, 24 nt, Human
gugacagguggccucuugguggga

SEQ ID NO: 308150 - RNA, 24 nt, Human
gugaucugccugccucagccaccc

SEQ ID NO: 308151 - RNA, 24 nt, Human
gugauucuccugccucagccuccu

SEQ ID NO: 308152 - RNA, 23 nt, Human
guuuuagguucacagcaaaauug

SEQ ID NO: 308153 - RNA, 21 nt, Human
uaaaagauagagccacaugga

SEQ ID NO: 308154 - RNA, 22 nt, Human
uaagcggcagagccaugaagca

SEQ ID NO: 308155 - RNA, 24 nt, Human
uaauuuuuguauuuuuaguagaga

SEQ ID NO: 308156 - RNA, 22 nt, Human
uacaggcaugagccaccaugcc

SEQ ID NO: 308157 - RNA, 22 nt, Human
uagagacgagguuuugccaugu

SEQ ID NO: 308158 - RNA, 24 nt, Human
uaguagagacgagguuuugccaug

SEQ ID NO: 308159 - RNA, 18 nt, Human
uauggagcuccuucuugg

SEQ ID NO: 308160 - RNA, 19 nt, Human
ucacaugagucaccacauc

SEQ ID NO: 308161 - RNA, 22 nt, Human
ucacucuguugcccaggcugga

SEQ ID NO: 308162 - RNA, 24 nt, Human
ucacucuguugcccaggcuggagu

SEQ ID NO: 308163 - RNA, 24 nt, Human
ucacugaaaccucugccucccagg

SEQ ID NO: 308164 - RNA, 25 nt, Human
ucacugaaaccucugccucccaggu

SEQ ID NO: 308165 - RNA, 21 nt, Human
ucagaacugcucagucagcug

SEQ ID NO: 308166 - RNA, 22 nt, Human
ucagcccccuggcuggaaacag

SEQ ID NO: 308167 - RNA, 19 nt, Human
ucagggagaggggccuugg

SEQ ID NO: 308168 - RNA, 25 nt, Human
ucaguagccccuuguaauucacccu

SEQ ID NO: 308169 - RNA, 20 nt, Human
uccaaacaccaccucugagg

SEQ ID NO: 308170 - RNA, 23 nt, Human
uccaagugauucuccugccucag

SEQ ID NO: 308171 - RNA, 24 nt, Human
uccaagugauucuccugccucagc

SEQ ID NO: 308172 - RNA, 22 nt, Human
uccaggagaggccuggccucag

SEQ ID NO: 308173 - RNA, 21 nt, Human
ucccagguccaagugauucuc

SEQ ID NO: 308174 - RNA, 24 nt, Human
ucccagguccaagugauucuccug

SEQ ID NO: 308175 - RNA, 25 nt, Human
uccccagugccuaugagaggcuuua

SEQ ID NO: 308176 - RNA, 24 nt, Human
uccugaauagcugggauuacaggc

SEQ ID NO: 308177 - RNA, 20 nt, Human
ucuaggcuucacccaagaag

SEQ ID NO: 308178 - RNA, 21 nt, Human
ucucccaagauucccauccac

SEQ ID NO: 308179 - RNA, 24 nt, Human
ucuccugccucagccuccugaaua

SEQ ID NO: 308180 - RNA, 18 nt, Human
ucuguugcccaggcugga

SEQ ID NO: 308181 - RNA, 24 nt, Human
ucuguugcccaggcuggagugcag

SEQ ID NO: 308182 - RNA, 19 nt, Human
ugaaaccucugccucccag

SEQ ID NO: 308183 - RNA, 18 nt, Human
ugaccccaggugaucugc

SEQ ID NO: 308184 - RNA, 19 nt, Human
ugaccccaggugaucugcc

SEQ ID NO: 308185 - RNA, 20 nt, Human
ugacugcaggugccucagcc

SEQ ID NO: 308186 - RNA, 18 nt, Human
ugagcaccuaguaugugg

SEQ ID NO: 308187 - RNA, 23 nt, Human
ugagccaaugccuggaggcagga

SEQ ID NO: 308188 - RNA, 27 nt, Human
ugaggagguggggaucagucgugauga

SEQ ID NO: 308189 - RNA, 21 nt, Human
ugagggaaccaggaaaacugg

SEQ ID NO: 308190 - RNA, 21 nt, Human
ugagggcucccuugcuugggc

SEQ ID NO: 308191 - RNA, 21 nt, Human
ugagguggggaugccagagcu

SEQ ID NO: 308192 - RNA, 20 nt, Human
ugauucuccugccucagccu

SEQ ID NO: 308193 - RNA, 24 nt, Human
ugccauguugggcaggcuggucuu

SEQ ID NO: 308194 - RNA, 18 nt, Human
ugcccaggcuggagugca

SEQ ID NO: 308195 - RNA, 21 nt, Human
ugcccaggcuggagugcagug

SEQ ID NO: 308196 - RNA, 21 nt, Human
ugcccaggcuggagugcagug

SEQ ID NO: 308197 - RNA, 23 nt, Human
ugccucagccacccuaaguguug

SEQ ID NO: 308198 - RNA, 24 nt, Human
ugccucagccacccuaaguguugg

SEQ ID NO: 308199 - RNA, 19 nt, Human
ugccucagcccccuggcug

SEQ ID NO: 308200 - RNA, 24 nt, Human
ugccucagcccccuggcuggaaac

SEQ ID NO: 308201 - RNA, 31 nt, Human
ugccucagcccccuggcuggaaacagcuagg

SEQ ID NO: 308202 - RNA, 27 nt, Human
ugccucagccuccugaauagcugggau

SEQ ID NO: 308203 - RNA, 18 nt, Human
ugccuggagccacaagac

SEQ ID NO: 308204 - RNA, 21 nt, Human
ugccuggagccacaagaccug

SEQ ID NO: 308205 - RNA, 26 nt, Human
ugccuggaggcaggagaaaguaccau

SEQ ID NO: 308206 - RNA, 24 nt, Human
uggacagaaagaucaauauugccc

SEQ ID NO: 308207 - RNA, 19 nt, Human
uggagugcagugucgcgau

SEQ ID NO: 308208 - RNA, 23 nt, Human
uggagugcagugucgcgaucugg

SEQ ID NO: 308209 - RNA, 20 nt, Human
uggccaugagugacaggugg

SEQ ID NO: 308210 - RNA, 20 nt, Human
uggcuggaaacagcuagcca

SEQ ID NO: 308211 - RNA, 20 nt, Human
uggcuggaaacagcuagcca

SEQ ID NO: 308212 - RNA, 25 nt, Human
ugggaaaacaggggaaacagagaug

SEQ ID NO: 308213 - RNA, 19 nt, Human
ugggagcuuggaggaggga

SEQ ID NO: 308214 - RNA, 19 nt, Human
ugggauuacaggcacccac

SEQ ID NO: 308215 - RNA, 21 nt, Human
ugggauuacaggcacccacca

SEQ ID NO: 308216 - RNA, 18 nt, Human
ugggauuacaggcaugag

SEQ ID NO: 308217 - RNA, 22 nt, Human
ugggauuacaggcaugagccac

SEQ ID NO: 308218 - RNA, 23 nt, Human
ugggauuacaggcaugagccacc

SEQ ID NO: 308219 - RNA, 24 nt, Human
ugggauuacaggcaugagccacca

SEQ ID NO: 308220 - RNA, 25 nt, Human
ugggauuacaggcaugagccaccau

SEQ ID NO: 308221 - RNA, 24 nt, Human
ugggcaggcuggucuugaacuccu

SEQ ID NO: 308222 - RNA, 24 nt, Human
uggggcagggggaaggcagcuccc

SEQ ID NO: 308223 - RNA, 18 nt, Human
ugggggacagcggcagac

SEQ ID NO: 308224 - RNA, 24 nt, Human
uggugggagagguggggcaggggg

SEQ ID NO: 308225 - RNA, 23 nt, Human
ugguuccaggagaggccuggccu

SEQ ID NO: 308226 - RNA, 24 nt, Human
ugucacucuguugcccaggcugga

SEQ ID NO: 308227 - RNA, 18 nt, Human
ugugcaggguccccagug

SEQ ID NO: 308228 - RNA, 23 nt, Human
ugugggaaaacaggggaaacaga

SEQ ID NO: 308229 - RNA, 24 nt, Human
uuaguagagacgagguuuugccau

SEQ ID NO: 308230 - RNA, 24 nt, Human
uucagguuagauacugaggugggg

SEQ ID NO: 308231 - RNA, 19 nt, Human
uucccccacacaggcacag

SEQ ID NO: 308232 - RNA, 19 nt, Human
uucuugugcaaaugcuuua

SEQ ID NO: 308233 - RNA, 24 nt, Human
uugcccaggcuggagugcaguguc

SEQ ID NO: 308234 - RNA, 23 nt, Human
uuuugccauguugggcaggcugg

SEQ ID NO: 308235 - RNA, 21 nt, Human
uuuuuaguagagacgagguuu

SEQ ID NO: 308236 - RNA, 20 nt, Human
uuuuuguauuuuuaguagag

SEQ ID NO: 308237 - RNA, 19 nt, Human
aaaaagaacacacauaaga

SEQ ID NO: 308238 - RNA, 20 nt, Human
aaaagaacacacauaagaaa

SEQ ID NO: 308239 - RNA, 25 nt, Human
aaagaaaaaaaauuuuuaaaaagaa

SEQ ID NO: 308240 - RNA, 23 nt, Human
agaaaaaaaauuuuuaaaaagaa

SEQ ID NO: 308241 - RNA, 19 nt, Human
auguauguauauauaugca

SEQ ID NO: 308242 - RNA, 19 nt, Human
auguauguauauauaugca

SEQ ID NO: 308243 - RNA, 21 nt, Human
caggaaguucauacugacuga

SEQ ID NO: 308244 - RNA, 19 nt, Human
cugaaaauguagcuaagua

SEQ ID NO: 308245 - RNA, 25 nt, Human
gaaaaaaaauuuuuaaaaagaacac

SEQ ID NO: 308246 - RNA, 22 nt, Human
uaaaaagaacacacauaagaaa

SEQ ID NO: 308247 - RNA, 18 nt, Human
uauguauauauaugcaua

SEQ ID NO: 308248 - RNA, 20 nt, Human
uauguauauauaugcauaua

SEQ ID NO: 308249 - RNA, 22 nt, Human
uauguauauauaugcauauaua

SEQ ID NO: 308250 - RNA, 22 nt, Human
uauuucauguauguauauauau

SEQ ID NO: 308251 - RNA, 20 nt, Human
ucaguacgacuaucuguacu

SEQ ID NO: 308252 - RNA, 23 nt, Human
ugacugaaaauguagcuaaguau

SEQ ID NO: 308253 - RNA, 18 nt, Human
uguauauauaugcauaua

SEQ ID NO: 308254 - RNA, 20 nt, Human
uguauauauaugcauauaua

SEQ ID NO: 308255 - RNA, 19 nt, Human
uguauguauauauaugcau

SEQ ID NO: 308256 - RNA, 23 nt, Human
uguauguauauauaugcauauau

SEQ ID NO: 308257 - RNA, 20 nt, Human
uucaauuacaggaaauguuu

SEQ ID NO: 308258 - RNA, 24 nt, Human
accccacugcaaacugcugaggcg

SEQ ID NO: 308259 - RNA, 18 nt, Human
caacuacucaagguagcg

SEQ ID NO: 308260 - RNA, 21 nt, Human
cacaaaugggcuuggccuccu

SEQ ID NO: 308261 - RNA, 24 nt, Human
caccugagcccgaggcucugaagc

SEQ ID NO: 308262 - RNA, 19 nt, Human
cacugcaaacugcugaggc

SEQ ID NO: 308263 - RNA, 21 nt, Human
cagcagccagggaaugaauga

SEQ ID NO: 308264 - RNA, 21 nt, Human
cgaggcucugaagcacugcgu

SEQ ID NO: 308265 - RNA, 19 nt, Human
cugcgugaugacaguuccc

SEQ ID NO: 308266 - RNA, 20 nt, Human
gcagaagggaaaacaggcac

SEQ ID NO: 308267 - RNA, 22 nt, Human
gccuccuuaccccacugcaaac

SEQ ID NO: 308268 - RNA, 23 nt, Human
gcugaggcgcaagggagcuccca

SEQ ID NO: 308269 - RNA, 19 nt, Human
ggaaaacaggcacaggccg

SEQ ID NO: 308270 - RNA, 20 nt, Human
uagggguggcaggggccccg

SEQ ID NO: 308271 - RNA, 24 nt, Human
uaucaagugcuccaacuacucaag

SEQ ID NO: 308272 - RNA, 21 nt, Human
ugagaguuagggguggcaggg

SEQ ID NO: 308273 - RNA, 19 nt, Human
ugcaacucagcagccaggg

SEQ ID NO: 308274 - RNA, 18 nt, Human
uggcaggggccccggcca

SEQ ID NO: 308275 - RNA, 24 nt, Human
uucccaccugcaacucagcagcca

SEQ ID NO: 308276 - RNA, 23 nt, Human
uuuugggugauuacacaaauggg

SEQ ID NO: 308277 - RNA, 19 nt, Human
uuuuuuuuuuuuuuuuugu

SEQ ID NO: 308278 - RNA, 20 nt, Human
uuuuuuuuuuuuuuuuuugg

SEQ ID NO: 308279 - RNA, 22 nt, Human
acgccuucuucugaaugacgcu

SEQ ID NO: 308280 - RNA, 19 nt, Human
agaaaauucucaguccucc

SEQ ID NO: 308281 - RNA, 21 nt, Human
aucagucaaucagcaagcauu

SEQ ID NO: 308282 - RNA, 19 nt, Human
auucucaguccuccugagc

SEQ ID NO: 308283 - RNA, 19 nt, Human
caaaaucacagucuagcug

SEQ ID NO: 308284 - RNA, 20 nt, Human
cagaaaauucucaguccucc

SEQ ID NO: 308285 - RNA, 24 nt, Human
ccaaagcuucugugguccuccugc

SEQ ID NO: 308286 - RNA, 19 nt, Human
cccacagugcccuggaagc

SEQ ID NO: 308287 - RNA, 24 nt, Human
cccacagugcccuggaagcugagg

SEQ ID NO: 308288 - RNA, 25 nt, Human
cccccugugggaggaggucgcgggc

SEQ ID NO: 308289 - RNA, 20 nt, Human
ccuccugguccugagcaggg

SEQ ID NO: 308290 - RNA, 18 nt, Human
ccugagcagggccaaccu

SEQ ID NO: 308291 - RNA, 19 nt, Human
ccugagccugggucugggg

SEQ ID NO: 308292 - RNA, 20 nt, Human
cgcgggugaagacugcgggg

SEQ ID NO: 308293 - RNA, 20 nt, Human
cucagagcuccacuuggcug

SEQ ID NO: 308294 - RNA, 18 nt, Human
cuccugagccugggucug

SEQ ID NO: 308295 - RNA, 21 nt, Human
cuggggcgugugcgcaugcgc

SEQ ID NO: 308296 - RNA, 20 nt, Human
cugguccugagcagggccaa

SEQ ID NO: 308297 - RNA, 20 nt, Human
gaaggcauuggucugaacua

SEQ ID NO: 308298 - RNA, 21 nt, Human
gaccaacaggcccacagugcc

SEQ ID NO: 308299 - RNA, 19 nt, Human
gagcaguggaaggcauugg

SEQ ID NO: 308300 - RNA, 23 nt, Human
gauagcccaugauuuaagcccaa

SEQ ID NO: 308301 - RNA, 23 nt, Human
gcaguggaaggcauuggucugaa

SEQ ID NO: 308302 - RNA, 25 nt, Human
ggaggcuugggcuccggaauccggu

SEQ ID NO: 308303 - RNA, 18 nt, Human
ggcgugugcgcaugcgcg

SEQ ID NO: 308304 - RNA, 19 nt, Human
uaucacauucauucuggcc

SEQ ID NO: 308305 - RNA, 23 nt, Human
uauugagcacuuguuguauucuc

SEQ ID NO: 308306 - RNA, 25 nt, Human
ucaaggccaugaagcguguggcuga

SEQ ID NO: 308307 - RNA, 22 nt, Human
uccaggaucucccgagggaccu

SEQ ID NO: 308308 - RNA, 22 nt, Human
ucucagagcuccacuuggcugu

SEQ ID NO: 308309 - RNA, 18 nt, Human
ucucccgagggaccugca

SEQ ID NO: 308310 - RNA, 18 nt, Human
ugaagcguguggcugaag

SEQ ID NO: 308311 - RNA, 23 nt, Human
ugcuccagcuccaggaucucccg

SEQ ID NO: 308312 - RNA, 22 nt, Human
ugcuccggaauccggugcggag

SEQ ID NO: 308313 - RNA, 19 nt, Human
uggagcuugugcuccggaa

SEQ ID NO: 308314 - RNA, 20 nt, Human
ugggaggaggucgcgggcug

SEQ ID NO: 308315 - RNA, 21 nt, Human
ugggaggaggucgcgggcugg

SEQ ID NO: 308316 - RNA, 18 nt, Human
ugucagacacucaugcuc

SEQ ID NO: 308317 - RNA, 19 nt, Human
ugugcgcaugcgcggugga

SEQ ID NO: 308318 - RNA, 22 nt, Human
uucucaguccuccugagccugg

SEQ ID NO: 308319 - RNA, 21 nt, Human
aaaaacagaacaaaagucuug

SEQ ID NO: 308320 - RNA, 25 nt, Human
aaacagaacaaaagucuuggucugg

SEQ ID NO: 308321 - RNA, 22 nt, Human
aacagaacaaaagucuuggucu

SEQ ID NO: 308322 - RNA, 20 nt, Human
aagaaaagagacacagccaa

SEQ ID NO: 308323 - RNA, 19 nt, Human
acaguguggcccugggggu

SEQ ID NO: 308324 - RNA, 21 nt, Human
accagagucacucuccuggga

SEQ ID NO: 308325 - RNA, 19 nt, Human
acccuggagacccgggucu

SEQ ID NO: 308326 - RNA, 19 nt, Human
agaaaagagacacagccaa

SEQ ID NO: 308327 - RNA, 24 nt, Human
agaaaagagacacagccaacccug

SEQ ID NO: 308328 - RNA, 25 nt, Human
agaaaagagacacagccaacccuga

SEQ ID NO: 308329 - RNA, 20 nt, Human
agaacaaaagucuuggucug

SEQ ID NO: 308330 - RNA, 28 nt, Human
agaagaaaagagacacagccaacccuga

SEQ ID NO: 308331 - RNA, 20 nt, Human
cagagaagaaaagagacaca

SEQ ID NO: 308332 - RNA, 21 nt, Human
cccucagaaguggaggccuag

SEQ ID NO: 308333 - RNA, 21 nt, Human
cccugaguuggaggagagcuc

SEQ ID NO: 308334 - RNA, 25 nt, Human
ccuagggacccugggacccuaccaa

SEQ ID NO: 308335 - RNA, 28 nt, Human
ccuaugaccagagucacucuccugggac

SEQ ID NO: 308336 - RNA, 21 nt, Human
cgagaaagacugaggucugug

SEQ ID NO: 308337 - RNA, 18 nt, Human
cucgcgggcuccccgucu

SEQ ID NO: 308338 - RNA, 18 nt, Human
cuuaggagccucucucag

SEQ ID NO: 308339 - RNA, 20 nt, Human
cuucgagaaagacugagguc

SEQ ID NO: 308340 - RNA, 24 nt, Human
gaggguacaguguggcccuggggg

SEQ ID NO: 308341 - RNA, 19 nt, Human
gagucacucuccugggacu

SEQ ID NO: 308342 - RNA, 24 nt, Human
ggaggguacaguguggcccugggg

SEQ ID NO: 308343 - RNA, 21 nt, Human
ggguacaguguggcccugggg

SEQ ID NO: 308344 - RNA, 18 nt, Human
guacaguguggcccuggg

SEQ ID NO: 308345 - RNA, 19 nt, Human
guggcccuggggguccgcc

SEQ ID NO: 308346 - RNA, 23 nt, Human
gugguggugaugauaaucugauc

SEQ ID NO: 308347 - RNA, 18 nt, Human
uaagugcaucucaggaaa

SEQ ID NO: 308348 - RNA, 18 nt, Human
uacccauacaccagauuu

SEQ ID NO: 308349 - RNA, 24 nt, Human
uagaaaaacagaacaaaagucuug

SEQ ID NO: 308350 - RNA, 26 nt, Human
uagaaaaacagaacaaaagucuuggu

SEQ ID NO: 308351 - RNA, 24 nt, Human
uccugggacucgcuggaggguaca

SEQ ID NO: 308352 - RNA, 18 nt, Human
uccuugggcagacccugg

SEQ ID NO: 308353 - RNA, 20 nt, Human
ucucgcgggcuccccgucuc

SEQ ID NO: 308354 - RNA, 19 nt, Human
ugaguuggaggagagcucu

SEQ ID NO: 308355 - RNA, 21 nt, Human
ugaguuggaggagagcucuug

SEQ ID NO: 308356 - RNA, 25 nt, Human
uggagacccgggucucgcgggcucc

SEQ ID NO: 308357 - RNA, 20 nt, Human
uggagggugguggugaugau

SEQ ID NO: 308358 - RNA, 20 nt, Human
uugcguaaaauucucuggag

SEQ ID NO: 308359 - RNA, 19 nt, Human
caccgcgcaccaacgcgac

SEQ ID NO: 308360 - RNA, 24 nt, Human
ccgcgcaccaacgcgacccaagcg

SEQ ID NO: 308361 - RNA, 25 nt, Human
cgcgacccaagcgcuccaaacccga

SEQ ID NO: 308362 - RNA, 23 nt, Human
cggagcugcucgcgggaacuggg

SEQ ID NO: 308363 - RNA, 23 nt, Human
gcgcuccaaacccgacugcuucu

SEQ ID NO: 308364 - RNA, 18 nt, Human
ggaacuggggucccuggg

SEQ ID NO: 308365 - RNA, 21 nt, Human
aaacaacuaagaauccucuca

SEQ ID NO: 308366 - RNA, 18 nt, Human
aacuaagaauccucucag

SEQ ID NO: 308367 - RNA, 18 nt, Human
aagcacccggccccgccg

SEQ ID NO: 308368 - RNA, 18 nt, Human
aagcccuuuccuuuuccc

SEQ ID NO: 308369 - RNA, 22 nt, Human
aaggccacauuuuaacuauaug

SEQ ID NO: 308370 - RNA, 19 nt, Human
acccggccccgccgcgcgg

SEQ ID NO: 308371 - RNA, 21 nt, Human
agaauccucucagaagcccuu

SEQ ID NO: 308372 - RNA, 18 nt, Human
agcccagagcccuggaga

SEQ ID NO: 308373 - RNA, 22 nt, Human
agcucuacuccuuuaaauccaa

SEQ ID NO: 308374 - RNA, 20 nt, Human
aucaaaacccaucugauuug

SEQ ID NO: 308375 - RNA, 20 nt, Human
aucaguugagagcccagaac

SEQ ID NO: 308376 - RNA, 21 nt, Human
auuuagaaucccagaaagucc

SEQ ID NO: 308377 - RNA, 27 nt, Human
caaugcauaauuuaccccuuuuaagaa

SEQ ID NO: 308378 - RNA, 18 nt, Human
cacugggcucuccgggag

SEQ ID NO: 308379 - RNA, 19 nt, Human
cagagcccuggagacccac

SEQ ID NO: 308380 - RNA, 25 nt, Human
ccaccgcugucuccacagugaaccg

SEQ ID NO: 308381 - RNA, 29 nt, Human
ccacuccgccaccgcugucuccacaguga

SEQ ID NO: 308382 - RNA, 23 nt, Human
cccaauucacauucuaauggcau

SEQ ID NO: 308383 - RNA, 24 nt, Human
cccagagcccuggagacccacucc

SEQ ID NO: 308384 - RNA, 20 nt, Human
ccccucauauacaagauuaa

SEQ ID NO: 308385 - RNA, 19 nt, Human
cccgccgcgcggaagcgga

SEQ ID NO: 308386 - RNA, 19 nt, Human
ccuccgcgccccaccccuc

SEQ ID NO: 308387 - RNA, 22 nt, Human
ccuccgggggccuugccagccc

SEQ ID NO: 308388 - RNA, 21 nt, Human
cggaagcggaucuguagccuc

SEQ ID NO: 308389 - RNA, 22 nt, Human
cugaaaaauaaccaaugcauaa

SEQ ID NO: 308390 - RNA, 22 nt, Human
cuucucaacaacaucugucugg

SEQ ID NO: 308391 - RNA, 20 nt, Human
gagacccacuccgccaccgc

SEQ ID NO: 308392 - RNA, 22 nt, Human
gcccagagcccuggagacccac

SEQ ID NO: 308393 - RNA, 25 nt, Human
ggaaaugaauaaaucaaaacccauc

SEQ ID NO: 308394 - RNA, 23 nt, Human
gggagccccuuaucccgggagcc

SEQ ID NO: 308395 - RNA, 18 nt, Human
gucuccacagugaaccga

SEQ ID NO: 308396 - RNA, 21 nt, Human
uaaauagaacaccuaaacuca

SEQ ID NO: 308397 - RNA, 21 nt, Human
uaagaauccucucagaagccc

SEQ ID NO: 308398 - RNA, 20 nt, Human
uacccuggugucuguggcau

SEQ ID NO: 308399 - RNA, 24 nt, Human
uagccuccuccgcgccccaccccu

SEQ ID NO: 308400 - RNA, 23 nt, Human
uagggaguuucuuuuaauaguuc

SEQ ID NO: 308401 - RNA, 18 nt, Human
uaguacuucucaacaaca

SEQ ID NO: 308402 - RNA, 20 nt, Human
uauaauacagaucuuuagcu

SEQ ID NO: 308403 - RNA, 25 nt, Human
uauaauauauuuagaaucccagaaa

SEQ ID NO: 308404 - RNA, 25 nt, Human
ucaaaaccaguaaucacuucaagaa

SEQ ID NO: 308405 - RNA, 23 nt, Human
ucaaaacccaucugauuugguua

SEQ ID NO: 308406 - RNA, 21 nt, Human
ucagaagcccuuuccuuuucc

SEQ ID NO: 308407 - RNA, 22 nt, Human
uccacagugaaccgacacucgg

SEQ ID NO: 308408 - RNA, 22 nt, Human
ucccccaaauuuuaguagagau

SEQ ID NO: 308409 - RNA, 18 nt, Human
ucccgggagcccagagcc

SEQ ID NO: 308410 - RNA, 22 nt, Human
ucuguagccuccuccgcgcccc

SEQ ID NO: 308411 - RNA, 23 nt, Human
ugacccaauucacauucuaaugg

SEQ ID NO: 308412 - RNA, 23 nt, Human
ugagacuauaauacagaucuuua

SEQ ID NO: 308413 - RNA, 20 nt, Human
uguaacauauuauauaauau

SEQ ID NO: 308414 - RNA, 21 nt, Human
uuaaaguuucaauauauuacu

SEQ ID NO: 308415 - RNA, 21 nt, Human
uucaaaagaaacaacuaagaa

SEQ ID NO: 308416 - RNA, 21 nt, Human
aacaacaucuguaacaucagc

SEQ ID NO: 308417 - RNA, 21 nt, Human
accacagcugggcggggucug

SEQ ID NO: 308418 - RNA, 21 nt, Human
agaguaaacacuccaaugacc

SEQ ID NO: 308419 - RNA, 20 nt, Human
aggaaccccagaagguucuc

SEQ ID NO: 308420 - RNA, 20 nt, Human
aucagaccagcccccgaguc

SEQ ID NO: 308421 - RNA, 21 nt, Human
cacagcugggcggggucuggg

SEQ ID NO: 308422 - RNA, 23 nt, Human
cagaccagcccccgaguccccaa

SEQ ID NO: 308423 - RNA, 19 nt, Human
cagcuccuccuggcucucc

SEQ ID NO: 308424 - RNA, 18 nt, Human
cagggcaggacaacugag

SEQ ID NO: 308425 - RNA, 18 nt, Human
ccagcuccuccuggcucu

SEQ ID NO: 308426 - RNA, 18 nt, Human
ccccaagaaggucacccc

SEQ ID NO: 308427 - RNA, 20 nt, Human
cccccgaguccccaagaagg

SEQ ID NO: 308428 - RNA, 25 nt, Human
ccccgaguccccaagaaggucaccc

SEQ ID NO: 308429 - RNA, 21 nt, Human
ccucagggugcccccaacaac

SEQ ID NO: 308430 - RNA, 20 nt, Human
ccugcagaguaaacacuccc

SEQ ID NO: 308431 - RNA, 20 nt, Human
ccugcucagucccgcccucc

SEQ ID NO: 308432 - RNA, 23 nt, Human
ccugggaccuggagucauccgga

SEQ ID NO: 308433 - RNA, 24 nt, Human
cuccgccugcucagucccgcccuc

SEQ ID NO: 308434 - RNA, 25 nt, Human
cuccgccugcucagucccgcccucc

SEQ ID NO: 308435 - RNA, 18 nt, Human
cugaagguccugguggcg

SEQ ID NO: 308436 - RNA, 22 nt, Human
gaccacagcugggcggggucug

SEQ ID NO: 308437 - RNA, 23 nt, Human
gcaggacaacugaggucgcgucc

SEQ ID NO: 308438 - RNA, 18 nt, Human
gcggcucugagcugggac

SEQ ID NO: 308439 - RNA, 18 nt, Human
ggcccagcuccuccuggc

SEQ ID NO: 308440 - RNA, 21 nt, Human
ggguccuggccugggcauggc

SEQ ID NO: 308441 - RNA, 23 nt, Human
gggucuggggguguauuuagggg

SEQ ID NO: 308442 - RNA, 20 nt, Human
ggugcucugaagguccuggu

SEQ ID NO: 308443 - RNA, 19 nt, Human
uaaacacuccaaugaccac

SEQ ID NO: 308444 - RNA, 25 nt, Human
uaaauaaauacacaguuccaucaga

SEQ ID NO: 308445 - RNA, 19 nt, Human
uaauaauaaauaacagacu

SEQ ID NO: 308446 - RNA, 21 nt, Human
uacacaguuccaucagaccag

SEQ ID NO: 308447 - RNA, 27 nt, Human
ucagacagcuuuauuuuuaucaccaga

SEQ ID NO: 308448 - RNA, 22 nt, Human
ucagggugcccccucagggugc

SEQ ID NO: 308449 - RNA, 22 nt, Human
uccuccuggcucuccuugucua

SEQ ID NO: 308450 - RNA, 18 nt, Human
uccuggcucuccuugucu

SEQ ID NO: 308451 - RNA, 21 nt, Human
ucucaggaaccuugagcccau

SEQ ID NO: 308452 - RNA, 20 nt, Human
ucuggggguguauuuagggg

SEQ ID NO: 308453 - RNA, 20 nt, Human
ugagguuggggcccagcucc

SEQ ID NO: 308454 - RNA, 24 nt, Human
ugcccccaacaacaucuguaacau

SEQ ID NO: 308455 - RNA, 19 nt, Human
ugcccccucagggugcccc

SEQ ID NO: 308456 - RNA, 18 nt, Human
uggccugggcauggcugu

SEQ ID NO: 308457 - RNA, 20 nt, Human
ugggagucugugcuuuugga

SEQ ID NO: 308458 - RNA, 24 nt, Human
uggggcccagcuccuccuggcucu

SEQ ID NO: 308459 - RNA, 21 nt, Human
uggggguguauuuagggggag

SEQ ID NO: 308460 - RNA, 21 nt, Human
uguaacaucagcagcaucuga

SEQ ID NO: 308461 - RNA, 19 nt, Human
uguccgaggguccuaggaa

SEQ ID NO: 308462 - RNA, 20 nt, Human
uuaauaauaaauaacagacu

SEQ ID NO: 308463 - RNA, 26 nt, Human
uuagggggaggaucuuuagguggggg

SEQ ID NO: 308464 - RNA, 18 nt, Human
uuggggcccagcuccucc

SEQ ID NO: 308465 - RNA, 19 nt, Human
aaaaauauagaaaaaggcu

SEQ ID NO: 308466 - RNA, 19 nt, Human
aaggaacuugcugugucug

SEQ ID NO: 308467 - RNA, 18 nt, Human
acuggugaaggcagcugc

SEQ ID NO: 308468 - RNA, 19 nt, Human
agcacuuauuugucagaca

SEQ ID NO: 308469 - RNA, 20 nt, Human
agcaucuucaggagacccca

SEQ ID NO: 308470 - RNA, 18 nt, Human
aggcagcugccaaauuuc

SEQ ID NO: 308471 - RNA, 21 nt, Human
aucucagucaccggaacugaa

SEQ ID NO: 308472 - RNA, 22 nt, Human
caggagaccccaaaccugagga

SEQ ID NO: 308473 - RNA, 19 nt, Human
cuauagguuucucuuucuu

SEQ ID NO: 308474 - RNA, 26 nt, Human
cuggggauaauuugucaguuuccuuu

SEQ ID NO: 308475 - RNA, 20 nt, Human
uagaaaaaggcuuaauucau

SEQ ID NO: 308476 - RNA, 21 nt, Human
uauuuuuuguuuacacaugaa

SEQ ID NO: 308477 - RNA, 19 nt, Human
ucagacauuuguacacuau

SEQ ID NO: 308478 - RNA, 20 nt, Human
ucaggagaccccaaaccuga

SEQ ID NO: 308479 - RNA, 21 nt, Human
ugugucuguauuugcccccag

SEQ ID NO: 308480 - RNA, 21 nt, Human
uuaauucaugaaguugcuaua

SEQ ID NO: 308481 - RNA, 18 nt, Human
uuuuauuuuauuuuuugu

SEQ ID NO: 308482 - RNA, 21 nt, Human
aacauaucaaauucagcaaga

SEQ ID NO: 308483 - RNA, 24 nt, Human
aagaggcaaccgcggggcuuuaac

SEQ ID NO: 308484 - RNA, 24 nt, Human
aagcaaaaagggacugauuacuga

SEQ ID NO: 308485 - RNA, 21 nt, Human
aagcacaagcaacaaauaggc

SEQ ID NO: 308486 - RNA, 20 nt, Human
aagcauuauauaucaaaggc

SEQ ID NO: 308487 - RNA, 18 nt, Human
aaggcauaaccuauaaga

SEQ ID NO: 308488 - RNA, 23 nt, Human
aauauucuccuaaucaaaagcua

SEQ ID NO: 308489 - RNA, 26 nt, Human
acacauuuaccagaacuaacagcccc

SEQ ID NO: 308490 - RNA, 19 nt, Human
acaggcaaagagguguaca

SEQ ID NO: 308491 - RNA, 23 nt, Human
acagugccaagauccuuccacac

SEQ ID NO: 308492 - RNA, 24 nt, Human
acauaacacuguaggccacaagaa

SEQ ID NO: 308493 - RNA, 24 nt, Human
accacacacacacauacacauaca

SEQ ID NO: 308494 - RNA, 20 nt, Human
acuaaaugaaauaaaaaagu

SEQ ID NO: 308495 - RNA, 24 nt, Human
acuggcuuaaugaaaauuuguauu

SEQ ID NO: 308496 - RNA, 20 nt, Human
agaaugaagcauucugggug

SEQ ID NO: 308497 - RNA, 21 nt, Human
agaucuccuccaaugucacau

SEQ ID NO: 308498 - RNA, 24 nt, Human
agcagcaugauccaauauaauauu

SEQ ID NO: 308499 - RNA, 20 nt, Human
agcuaaggcacuaccagaaa

SEQ ID NO: 308500 - RNA, 22 nt, Human
aggaagcaguaaugaagcagag

SEQ ID NO: 308501 - RNA, 23 nt, Human
aggcccuaagugcaaucugagug

SEQ ID NO: 308502 - RNA, 21 nt, Human
aguucugugucauuucuaggc

SEQ ID NO: 308503 - RNA, 25 nt, Human
auaacuauaaagguacuuguauaca

SEQ ID NO: 308504 - RNA, 21 nt, Human
auaucacuauauuccacaaau

SEQ ID NO: 308505 - RNA, 19 nt, Human
aucaucuaauggcacuuga

SEQ ID NO: 308506 - RNA, 21 nt, Human
auccguuuccuaauggauucc

SEQ ID NO: 308507 - RNA, 21 nt, Human
auguauguguguguguauaua

SEQ ID NO: 308508 - RNA, 21 nt, Human
auuuuggccaaucugaggccc

SEQ ID NO: 308509 - RNA, 23 nt, Human
caaaaagggacugauuacugaug

SEQ ID NO: 308510 - RNA, 20 nt, Human
caaaagacacugccuuccau

SEQ ID NO: 308511 - RNA, 23 nt, Human
caaacauaacacuguaggccaca

SEQ ID NO: 308512 - RNA, 19 nt, Human
caaagcucaguuuaaaagc

SEQ ID NO: 308513 - RNA, 18 nt, Human
caaaggccuacauauaua

SEQ ID NO: 308514 - RNA, 23 nt, Human
caaaggccuacauauauaucauc

SEQ ID NO: 308515 - RNA, 20 nt, Human
caacaaugaaaauaaauugc

SEQ ID NO: 308516 - RNA, 22 nt, Human
caagaaaugauauaagcgcuau

SEQ ID NO: 308517 - RNA, 18 nt, Human
caagaggcaaccgcgggg

SEQ ID NO: 308518 - RNA, 24 nt, Human
caagcaacaaauaggcaaaaauac

SEQ ID NO: 308519 - RNA, 18 nt, Human
caagcuaaggcacuacca

SEQ ID NO: 308520 - RNA, 23 nt, Human
caauacuccuaucauuucccaga

SEQ ID NO: 308521 - RNA, 19 nt, Human
cacacaccacacacacaca

SEQ ID NO: 308522 - RNA, 20 nt, Human
cacacauacacauacauaca

SEQ ID NO: 308523 - RNA, 18 nt, Human
cacgaaaugccaugucac

SEQ ID NO: 308524 - RNA, 21 nt, Human
cacuaccagaaauuucaagga

SEQ ID NO: 308525 - RNA, 19 nt, Human
cauagaaacuaaaggaagc

SEQ ID NO: 308526 - RNA, 20 nt, Human
cauauauuuuguggaauuca

SEQ ID NO: 308527 - RNA, 18 nt, Human
caugauaagccacuugau

SEQ ID NO: 308528 - RNA, 22 nt, Human
ccauuguaguguaugcgcugcc

SEQ ID NO: 308529 - RNA, 22 nt, Human
cccacccuugcccccaucccca

SEQ ID NO: 308530 - RNA, 24 nt, Human
cccagguaaacuuaacugaacaca

SEQ ID NO: 308531 - RNA, 19 nt, Human
cccauuuccaaaaugcuuu

SEQ ID NO: 308532 - RNA, 22 nt, Human
cccguccgccgccucuacaccg

SEQ ID NO: 308533 - RNA, 20 nt, Human
ccguccgccgccucuacacc

SEQ ID NO: 308534 - RNA, 23 nt, Human
ccucauggcugcaguuccacaau

SEQ ID NO: 308535 - RNA, 22 nt, Human
cgacaaaauauccuguguacua

SEQ ID NO: 308536 - RNA, 18 nt, Human
cggccaaggcagcaccaa

SEQ ID NO: 308537 - RNA, 23 nt, Human
cgguaugugugcaugugugugug

SEQ ID NO: 308538 - RNA, 22 nt, Human
cuaaaaaccucccacccuugcc

SEQ ID NO: 308539 - RNA, 23 nt, Human
cucccuauggguuuuuagcacaa

SEQ ID NO: 308540 - RNA, 21 nt, Human
cugaagaccccaaugccauac

SEQ ID NO: 308541 - RNA, 21 nt, Human
cugguucaucuguaccacuga

SEQ ID NO: 308542 - RNA, 18 nt, Human
cuguaggccacaagaagc

SEQ ID NO: 308543 - RNA, 23 nt, Human
cuuacgccucuuuccagcagcca

SEQ ID NO: 308544 - RNA, 20 nt, Human
cuucuaaaaaccucccaccc

SEQ ID NO: 308545 - RNA, 20 nt, Human
cuucucaaguuucauguggu

SEQ ID NO: 308546 - RNA, 24 nt, Human
gaaaaaauauucuccuaaucaaaa

SEQ ID NO: 308547 - RNA, 21 nt, Human
gaaaagccuauaauuauucag

SEQ ID NO: 308548 - RNA, 18 nt, Human
gaaaauuaagacuccaaa

SEQ ID NO: 308549 - RNA, 22 nt, Human
gacaaaaaugaaaauuuuaaga

SEQ ID NO: 308550 - RNA, 26 nt, Human
gagaguggaauccaauccuucccauu

SEQ ID NO: 308551 - RNA, 23 nt, Human
gaggcccugcuccaaacucuagc

SEQ ID NO: 308552 - RNA, 21 nt, Human
gaugcuuuguguuuaggguuu

SEQ ID NO: 308553 - RNA, 18 nt, Human
gcaagaaaugauauaagc

SEQ ID NO: 308554 - RNA, 23 nt, Human
gccaaauacggccaaggcagcac

SEQ ID NO: 308555 - RNA, 23 nt, Human
gccaugucaccuaacagagucuc

SEQ ID NO: 308556 - RNA, 20 nt, Human
gcggggcuuuaacauccucc

SEQ ID NO: 308557 - RNA, 23 nt, Human
gcggggcuuuaacauccucccuc

SEQ ID NO: 308558 - RNA, 25 nt, Human
ggaaagaaaaacauaucaaauucag

SEQ ID NO: 308559 - RNA, 19 nt, Human
ggaagacagugugcuuuga

SEQ ID NO: 308560 - RNA, 21 nt, Human
ggagcaguuugaaaaauuuaa

SEQ ID NO: 308561 - RNA, 19 nt, Human
gguaugugugcaugugugu

SEQ ID NO: 308562 - RNA, 21 nt, Human
gguaugugugcaugugugugu

SEQ ID NO: 308563 - RNA, 22 nt, Human
ggugaacugguauuuuuuaacu

SEQ ID NO: 308564 - RNA, 19 nt, Human
gucacagaaugaagcauuc

SEQ ID NO: 308565 - RNA, 24 nt, Human
guguauauauacacacaccacaca

SEQ ID NO: 308566 - RNA, 24 nt, Human
guguguguguauuauauauauaua

SEQ ID NO: 308567 - RNA, 23 nt, Human
guuaaauucaaagggcuguuagu

SEQ ID NO: 308568 - RNA, 24 nt, Human
uaaaaaccucccacccuugccccc

SEQ ID NO: 308569 - RNA, 23 nt, Human
uaaaaauauacaaaauucggccu

SEQ ID NO: 308570 - RNA, 27 nt, Human
uaaaaauguaccuguuuaaaauaccau

SEQ ID NO: 308571 - RNA, 22 nt, Human
uaaaauaccaucuaccauuuuu

SEQ ID NO: 308572 - RNA, 22 nt, Human
uaacauacagcauguucuucac

SEQ ID NO: 308573 - RNA, 20 nt, Human
uaacccuggcuacaggggcc

SEQ ID NO: 308574 - RNA, 23 nt, Human
uaacugaacacaaaugguuccaa

SEQ ID NO: 308575 - RNA, 21 nt, Human
uaagaaaauuuaaacccuuga

SEQ ID NO: 308576 - RNA, 21 nt, Human
uaagaaaguuucuguaaaggu

SEQ ID NO: 308577 - RNA, 19 nt, Human
uaagugacacgaaaugcca

SEQ ID NO: 308578 - RNA, 21 nt, Human
uaauuuagggccaacuauuaa

SEQ ID NO: 308579 - RNA, 21 nt, Human
uacacagcuugaaagaaacac

SEQ ID NO: 308580 - RNA, 22 nt, Human
uacacauacauacauauauggc

SEQ ID NO: 308581 - RNA, 23 nt, Human
uacagagcuuauacacacacaaa

SEQ ID NO: 308582 - RNA, 22 nt, Human
uacagcauguucuucacuccac

SEQ ID NO: 308583 - RNA, 21 nt, Human
uagcagcaugauccaauauaa

SEQ ID NO: 308584 - RNA, 18 nt, Human
uagcauguuaagaaggau

SEQ ID NO: 308585 - RNA, 24 nt, Human
uaggcacacauuuaccagaacuaa

SEQ ID NO: 308586 - RNA, 22 nt, Human
uauaauauugaaggaguguuuc

SEQ ID NO: 308587 - RNA, 21 nt, Human
uaugugugcaugugugugugu

SEQ ID NO: 308588 - RNA, 18 nt, Human
uauuaaaugaaaagauag

SEQ ID NO: 308589 - RNA, 22 nt, Human
uauucucaauuguuauuuucau

SEQ ID NO: 308590 - RNA, 22 nt, Human
ucaaaaaggguuuagugaccac

SEQ ID NO: 308591 - RNA, 27 nt, Human
ucaaaagacacugccuuccauccucag

SEQ ID NO: 308592 - RNA, 19 nt, Human
ucacugcagcuucauaaug

SEQ ID NO: 308593 - RNA, 18 nt, Human
ucaggagccaaagcuccu

SEQ ID NO: 308594 - RNA, 23 nt, Human
uccacacccuauuauaaagccca

SEQ ID NO: 308595 - RNA, 18 nt, Human
uccacacuugcuauuugu

SEQ ID NO: 308596 - RNA, 21 nt, Human
ucccacccuugcccccauccc

SEQ ID NO: 308597 - RNA, 23 nt, Human
ucccuccggcccguccgccgccu

SEQ ID NO: 308598 - RNA, 21 nt, Human
ucgggcuggacgcggcgggcc

SEQ ID NO: 308599 - RNA, 19 nt, Human
ucuaugaucccaaaggagc

SEQ ID NO: 308600 - RNA, 22 nt, Human
ucugaggcccaaauucuaaacu

SEQ ID NO: 308601 - RNA, 18 nt, Human
ucugaggcccugcuccaa

SEQ ID NO: 308602 - RNA, 18 nt, Human
ucuuacagcaaacauaac

SEQ ID NO: 308603 - RNA, 23 nt, Human
ugacccaccccuugguccccugg

SEQ ID NO: 308604 - RNA, 21 nt, Human
ugacuaagaaaaauaaagcac

SEQ ID NO: 308605 - RNA, 21 nt, Human
ugaugcuuuguguuuaggguu

SEQ ID NO: 308606 - RNA, 18 nt, Human
ugcaaggaaagauggauu

SEQ ID NO: 308607 - RNA, 24 nt, Human
ugcagcuucauaaugugauugcua

SEQ ID NO: 308608 - RNA, 23 nt, Human
ugcccaacuccacuaaaugauau

SEQ ID NO: 308609 - RNA, 21 nt, Human
uggauaaaaaaauacgacuga

SEQ ID NO: 308610 - RNA, 18 nt, Human
uguaaaaaaauaaaccau

SEQ ID NO: 308611 - RNA, 21 nt, Human
ugugaaagguggaaaagacua

SEQ ID NO: 308612 - RNA, 23 nt, Human
uguggaagugaaacugaaugagg

SEQ ID NO: 308613 - RNA, 19 nt, Human
uguguauuauauauauaua

SEQ ID NO: 308614 - RNA, 20 nt, Human
uguguauuauauauauauau

SEQ ID NO: 308615 - RNA, 19 nt, Human
ugugugcaugugugugugu

SEQ ID NO: 308616 - RNA, 22 nt, Human
ugugugcaugugugugugugug

SEQ ID NO: 308617 - RNA, 24 nt, Human
uguguguguauuauauauauauaa

SEQ ID NO: 308618 - RNA, 24 nt, Human
uguguguguguauuauauauauau

SEQ ID NO: 308619 - RNA, 21 nt, Human
uguuaacaagugcuuaauaga

SEQ ID NO: 308620 - RNA, 22 nt, Human
uuaaaaaacugaacuugguaau

SEQ ID NO: 308621 - RNA, 24 nt, Human
uuaaaucugguauauggacaauaa

SEQ ID NO: 308622 - RNA, 19 nt, Human
uuaacccuggcuacagggg

SEQ ID NO: 308623 - RNA, 18 nt, Human
uuaagaagauuauguugg

SEQ ID NO: 308624 - RNA, 21 nt, Human
uuacagaauagcaauuuuaaa

SEQ ID NO: 308625 - RNA, 19 nt, Human
uuagcagcaugauccaaua

SEQ ID NO: 308626 - RNA, 22 nt, Human
uuauauaucaaaggccuacaua

SEQ ID NO: 308627 - RNA, 25 nt, Human
uucccagagaugcaugaaaguggga

SEQ ID NO: 308628 - RNA, 22 nt, Human
uucuaaaaaguccaguuuuuaa

SEQ ID NO: 308629 - RNA, 20 nt, Human
uucugggugccaaauacggc

SEQ ID NO: 308630 - RNA, 18 nt, Human
uuucuguaaugaauccau

SEQ ID NO: 308631 - RNA, 26 nt, Human
uuuuacagagcuuauacacacacaaa

SEQ ID NO: 308632 - RNA, 21 nt, Human
aaaacaucuuccagaauacgg

SEQ ID NO: 308633 - RNA, 21 nt, Human
aaaacuacagguuggcuaugg

SEQ ID NO: 308634 - RNA, 23 nt, Human
aaaaugccuuugacugacgcccu

SEQ ID NO: 308635 - RNA, 22 nt, Human
aagguagaaaaaucccugaaaa

SEQ ID NO: 308636 - RNA, 21 nt, Human
acauccaacccugaagguaga

SEQ ID NO: 308637 - RNA, 22 nt, Human
acggaaaagccucuaaaaacau

SEQ ID NO: 308638 - RNA, 18 nt, Human
agacaagauuaacuccuc

SEQ ID NO: 308639 - RNA, 26 nt, Human
agacagaggcaaaggaaaagggaccc

SEQ ID NO: 308640 - RNA, 21 nt, Human
agauuuggagaaauccaaacc

SEQ ID NO: 308641 - RNA, 24 nt, Human
agguagaaaaaucccugaaaagaa

SEQ ID NO: 308642 - RNA, 18 nt, Human
caaaaugccuuugacuga

SEQ ID NO: 308643 - RNA, 19 nt, Human
cagcaaaaugccuuugacu

SEQ ID NO: 308644 - RNA, 20 nt, Human
caucucaagccagucaucac

SEQ ID NO: 308645 - RNA, 23 nt, Human
ccauagucccagucucguuuucc

SEQ ID NO: 308646 - RNA, 19 nt, Human
cugaagauucaaaccugug

SEQ ID NO: 308647 - RNA, 21 nt, Human
gaagauucaaaccugugagaa

SEQ ID NO: 308648 - RNA, 22 nt, Human
gacagauuggcacaauacaugc

SEQ ID NO: 308649 - RNA, 21 nt, Human
gagaauucucuuaucaucuca

SEQ ID NO: 308650 - RNA, 22 nt, Human
gauuaacuccucugauuccuau

SEQ ID NO: 308651 - RNA, 20 nt, Human
ggaaaaauacacuuuaaaaa

SEQ ID NO: 308652 - RNA, 23 nt, Human
ggagagacacacaaaguuaucuu

SEQ ID NO: 308653 - RNA, 21 nt, Human
gucagcaaaaugccuuugacu

SEQ ID NO: 308654 - RNA, 21 nt, Human
uaaaaugcuucuuaaaacauc

SEQ ID NO: 308655 - RNA, 24 nt, Human
uaaaaugcuucuuaaaacaucuuc

SEQ ID NO: 308656 - RNA, 19 nt, Human
uaaccugguuacacaguga

SEQ ID NO: 308657 - RNA, 24 nt, Human
uaacuaaacuacauccaacccuga

SEQ ID NO: 308658 - RNA, 25 nt, Human
uaagcuagacagaggcaaaggaaaa

SEQ ID NO: 308659 - RNA, 21 nt, Human
uaauaagauaccaaauucaag

SEQ ID NO: 308660 - RNA, 23 nt, Human
uaauaguaacuaaacuacaucca

SEQ ID NO: 308661 - RNA, 25 nt, Human
uacaaagcaugaacacucaggacag

SEQ ID NO: 308662 - RNA, 21 nt, Human
uaccacuuaaccugguuacac

SEQ ID NO: 308663 - RNA, 22 nt, Human
uauagcagccgucauuuuggau

SEQ ID NO: 308664 - RNA, 21 nt, Human
uauauguuuacggaaaagccu

SEQ ID NO: 308665 - RNA, 18 nt, Human
uccagaauacggaaaaau

SEQ ID NO: 308666 - RNA, 26 nt, Human
uccagaauacggaaaaauacacuuua

SEQ ID NO: 308667 - RNA, 23 nt, Human
uccauaguucccuuacuaggcag

SEQ ID NO: 308668 - RNA, 19 nt, Human
ucccagucucguuuuccaa

SEQ ID NO: 308669 - RNA, 20 nt, Human
ucugaagauucaaaccugug

SEQ ID NO: 308670 - RNA, 20 nt, Human
ucugcugcgaggcagggacu

SEQ ID NO: 308671 - RNA, 18 nt, Human
ucugucagauguaacuga

SEQ ID NO: 308672 - RNA, 18 nt, Human
ucuuccagaauacggaaa

SEQ ID NO: 308673 - RNA, 26 nt, Human
uucaagagauuauaguuacauuguaa

SEQ ID NO: 308674 - RNA, 23 nt, Human
uucccauauggacaaacacuuau

SEQ ID NO: 308675 - RNA, 18 nt, Human
uucuuaaaacaucuucca

SEQ ID NO: 308676 - RNA, 18 nt, Human
uuggauuacagaacacgc

SEQ ID NO: 308677 - RNA, 25 nt, Human
uuuaagauaaaugaagugauaacuc

SEQ ID NO: 308678 - RNA, 21 nt, Human
uuuaagcuagacagaggcaaa

SEQ ID NO: 308679 - RNA, 25 nt, Human
aacagaaaguaaaaacuaacaugga

SEQ ID NO: 308680 - RNA, 23 nt, Human
aagaagaagaggcgggaucucau

SEQ ID NO: 308681 - RNA, 23 nt, Human
aauucacggcuugcuccuucccu

SEQ ID NO: 308682 - RNA, 20 nt, Human
accuucugagagccagggag

SEQ ID NO: 308683 - RNA, 21 nt, Human
acgucaagggugcuuuugagg

SEQ ID NO: 308684 - RNA, 23 nt, Human
acucuaaaguuuauaaagaaaaa

SEQ ID NO: 308685 - RNA, 18 nt, Human
agacaugcuuucauuuuu

SEQ ID NO: 308686 - RNA, 20 nt, Human
agccagggaguggggaaagg

SEQ ID NO: 308687 - RNA, 19 nt, Human
aggcaggggguggggucgg

SEQ ID NO: 308688 - RNA, 19 nt, Human
aggcaggggguggggucgg

SEQ ID NO: 308689 - RNA, 20 nt, Human
aggcaggggguggggucggu

SEQ ID NO: 308690 - RNA, 21 nt, Human
aggcaggggguggggucggug

SEQ ID NO: 308691 - RNA, 22 nt, Human
agggaguggggaaaggggaagg

SEQ ID NO: 308692 - RNA, 24 nt, Human
aggggguggggucgguggccccgg

SEQ ID NO: 308693 - RNA, 20 nt, Human
augcucaguggacagggcca

SEQ ID NO: 308694 - RNA, 22 nt, Human
caacagaaaguaaaaacuaaca

SEQ ID NO: 308695 - RNA, 22 nt, Human
cacagcuccggccuccuuaagu

SEQ ID NO: 308696 - RNA, 20 nt, Human
cacuguacacaaaaggaaua

SEQ ID NO: 308697 - RNA, 26 nt, Human
cacuuuacacacuguacacaaaagga

SEQ ID NO: 308698 - RNA, 22 nt, Human
cagcuccggccuccuuaaguuu

SEQ ID NO: 308699 - RNA, 22 nt, Human
caggcaggggguggggucggug

SEQ ID NO: 308700 - RNA, 21 nt, Human
ccccacagcuccggccuccuu

SEQ ID NO: 308701 - RNA, 20 nt, Human
ccuucccuuuccucgcagag

SEQ ID NO: 308702 - RNA, 23 nt, Human
ccuucugagagccagggaguggg

SEQ ID NO: 308703 - RNA, 19 nt, Human
cucauuugcuuuugaggag

SEQ ID NO: 308704 - RNA, 19 nt, Human
cuccuuaaguuuccaggca

SEQ ID NO: 308705 - RNA, 21 nt, Human
cucgcagagguuuucucucca

SEQ ID NO: 308706 - RNA, 23 nt, Human
cucgucccgcuucugcggugugg

SEQ ID NO: 308707 - RNA, 22 nt, Human
cuucccaucugacagaguaucc

SEQ ID NO: 308708 - RNA, 22 nt, Human
cuucugaagaagaagaggcggg

SEQ ID NO: 308709 - RNA, 20 nt, Human
cuuuagcugaaaacagggug

SEQ ID NO: 308710 - RNA, 23 nt, Human
cuuuccucgcagagguuuucucu

SEQ ID NO: 308711 - RNA, 27 nt, Human
gcaacagaaaguaaaaacuaacaugga

SEQ ID NO: 308712 - RNA, 22 nt, Human
gccccggcugggcggguuucug

SEQ ID NO: 308713 - RNA, 24 nt, Human
gcccuggacuccuguaggauccca

SEQ ID NO: 308714 - RNA, 18 nt, Human
ggaaguaucugggaaaau

SEQ ID NO: 308715 - RNA, 18 nt, Human
gugaaaaauauaucugaa

SEQ ID NO: 308716 - RNA, 23 nt, Human
gugcuuuugaggaacaugacggg

SEQ ID NO: 308717 - RNA, 20 nt, Human
guggccccggcugggcgggu

SEQ ID NO: 308718 - RNA, 22 nt, Human
uacacacuguacacaaaaggaa

SEQ ID NO: 308719 - RNA, 21 nt, Human
uaccuucugagagccagggag

SEQ ID NO: 308720 - RNA, 23 nt, Human
uagagaagcacugcgccuuugca

SEQ ID NO: 308721 - RNA, 21 nt, Human
uagcugaaaacaggguggcau

SEQ ID NO: 308722 - RNA, 23 nt, Human
uauaaagaaaaaggauuuacacu

SEQ ID NO: 308723 - RNA, 23 nt, Human
uauccugaaaucagaccaagucc

SEQ ID NO: 308724 - RNA, 22 nt, Human
uauuaaguacaguauaaaacag

SEQ ID NO: 308725 - RNA, 21 nt, Human
uccaggcaggggguggggucg

SEQ ID NO: 308726 - RNA, 18 nt, Human
uccccacagcuccggccu

SEQ ID NO: 308727 - RNA, 25 nt, Human
ucucauuugcuuuugaggagucggg

SEQ ID NO: 308728 - RNA, 20 nt, Human
ucucuccagcccuggacucc

SEQ ID NO: 308729 - RNA, 20 nt, Human
ucugaagaagaagaggcggg

SEQ ID NO: 308730 - RNA, 23 nt, Human
ugacaggucaggagguugggcuu

SEQ ID NO: 308731 - RNA, 21 nt, Human
ugaggcccugcugggcucuug

SEQ ID NO: 308732 - RNA, 22 nt, Human
ugccccaacuuugaggcccugc

SEQ ID NO: 308733 - RNA, 21 nt, Human
ugcgguguggugggucuggag

SEQ ID NO: 308734 - RNA, 21 nt, Human
uggaaaaacugugaaaaauau

SEQ ID NO: 308735 - RNA, 22 nt, Human
uggcauggccacuuucugccca

SEQ ID NO: 308736 - RNA, 23 nt, Human
uggcauggccacuuucugcccag

SEQ ID NO: 308737 - RNA, 19 nt, Human
uggccccggcugggcgggu

SEQ ID NO: 308738 - RNA, 20 nt, Human
ugggaaguaucugggaaaau

SEQ ID NO: 308739 - RNA, 20 nt, Human
uguagagaagcacugcgccu

SEQ ID NO: 308740 - RNA, 18 nt, Human
uugaggcccugcugggcu

SEQ ID NO: 308741 - RNA, 18 nt, Human
uuuuuuuuuuuuuuuuug

SEQ ID NO: 308742 - RNA, 20 nt, Human
aaccaugggccucacaaaug

SEQ ID NO: 308743 - RNA, 19 nt, Human
aagaaagcggguggugccc

SEQ ID NO: 308744 - RNA, 19 nt, Human
aagaaagggacaucuaugu

SEQ ID NO: 308745 - RNA, 21 nt, Human
acacucacagcccacacacaa

SEQ ID NO: 308746 - RNA, 20 nt, Human
accccacccagugaggauug

SEQ ID NO: 308747 - RNA, 22 nt, Human
accccacccagugaggauugga

SEQ ID NO: 308748 - RNA, 19 nt, Human
acucuacugcaaaaaugac

SEQ ID NO: 308749 - RNA, 20 nt, Human
acuuacacucacagcccaca

SEQ ID NO: 308750 - RNA, 23 nt, Human
agaaaaagacaaguugcugguca

SEQ ID NO: 308751 - RNA, 20 nt, Human
agaaagcggguggugcccgu

SEQ ID NO: 308752 - RNA, 21 nt, Human
agaauaauacauucccaggca

SEQ ID NO: 308753 - RNA, 24 nt, Human
agagccuaucuucccagucucuuc

SEQ ID NO: 308754 - RNA, 19 nt, Human
auggagaugacucuacugc

SEQ ID NO: 308755 - RNA, 24 nt, Human
caaccaugggccucacaaaugccc

SEQ ID NO: 308756 - RNA, 22 nt, Human
cacaggagaugcccugcccuuu

SEQ ID NO: 308757 - RNA, 20 nt, Human
cauacacacacauauauauu

SEQ ID NO: 308758 - RNA, 24 nt, Human
ccagaaagaccacucuguguggca

SEQ ID NO: 308759 - RNA, 23 nt, Human
ccagcacccaggccuaugccuga

SEQ ID NO: 308760 - RNA, 20 nt, Human
ccaugcacaggagaugcccu

SEQ ID NO: 308761 - RNA, 19 nt, Human
ccuaugccugaggguaaag

SEQ ID NO: 308762 - RNA, 20 nt, Human
ccucuccagaaagaccacuu

SEQ ID NO: 308763 - RNA, 23 nt, Human
cgugggggacccaagaggcccca

SEQ ID NO: 308764 - RNA, 27 nt, Human
cuaucuucccagucucuucuuacagcu

SEQ ID NO: 308765 - RNA, 21 nt, Human
cuccccaaaccgcugcuccca

SEQ ID NO: 308766 - RNA, 21 nt, Human
cuuacacucacagcccacaca

SEQ ID NO: 308767 - RNA, 19 nt, Human
gagaugacucuacugcaaa

SEQ ID NO: 308768 - RNA, 21 nt, Human
gagugguccucaccccaccca

SEQ ID NO: 308769 - RNA, 19 nt, Human
gcaaauccaucugugcaga

SEQ ID NO: 308770 - RNA, 19 nt, Human
gcuaaaaggaagggauaac

SEQ ID NO: 308771 - RNA, 22 nt, Human
gggaaauuauucauuucucaac

SEQ ID NO: 308772 - RNA, 18 nt, Human
gggacccaagaggcccca

SEQ ID NO: 308773 - RNA, 18 nt, Human
gugguccucaccccaccc

SEQ ID NO: 308774 - RNA, 20 nt, Human
ucacgugggggacccaagag

SEQ ID NO: 308775 - RNA, 24 nt, Human
ucaguccagaaaaagacaaguugc

SEQ ID NO: 308776 - RNA, 21 nt, Human
ucccagucucuucuuacagcu

SEQ ID NO: 308777 - RNA, 20 nt, Human
uccccaaaccgcugcuccca

SEQ ID NO: 308778 - RNA, 21 nt, Human
ucucaaccaugggccucacaa

SEQ ID NO: 308779 - RNA, 19 nt, Human
ucuccagaaagaccacucu

SEQ ID NO: 308780 - RNA, 22 nt, Human
ucuucuuacagcugauggagau

SEQ ID NO: 308781 - RNA, 20 nt, Human
ugaaacugagacagugcugg

SEQ ID NO: 308782 - RNA, 20 nt, Human
ugagacagugcuggucacag

SEQ ID NO: 308783 - RNA, 18 nt, Human
uggagaugacucuacugc

SEQ ID NO: 308784 - RNA, 19 nt, Human
uggccagaggggucugggc

SEQ ID NO: 308785 - RNA, 18 nt, Human
uggucacaggucaugcug

SEQ ID NO: 308786 - RNA, 19 nt, Human
ugguccucaccccacccag

SEQ ID NO: 308787 - RNA, 19 nt, Human
ugugaaagugaaacugaga

SEQ ID NO: 308788 - RNA, 27 nt, Human
ugugcaaacauacacacacauauauag

SEQ ID NO: 308789 - RNA, 22 nt, Human
uuagacuuaacaaucagacacc

SEQ ID NO: 308790 - RNA, 19 nt, Human
uucccaggcacugucacgu

SEQ ID NO: 308791 - RNA, 20 nt, Human
uuuagacuuaacaaucagac

SEQ ID NO: 308792 - RNA, 23 nt, Human
aacaacacaacagcggcaacaau

SEQ ID NO: 308793 - RNA, 23 nt, Human
aagagcucucccauugcccacgg

SEQ ID NO: 308794 - RNA, 20 nt, Human
acaaacuuccuucccggggc

SEQ ID NO: 308795 - RNA, 24 nt, Human
acaacaacacaacagcggcaacaa

SEQ ID NO: 308796 - RNA, 20 nt, Human
acccggggcaaucgcucucc

SEQ ID NO: 308797 - RNA, 25 nt, Human
agagcucucccauugcccacggccu

SEQ ID NO: 308798 - RNA, 22 nt, Human
aggaaggaggcaguuuuguggc

SEQ ID NO: 308799 - RNA, 18 nt, Human
agggcaaagggguccccc

SEQ ID NO: 308800 - RNA, 20 nt, Human
auagcugggaaaacugaggc

SEQ ID NO: 308801 - RNA, 23 nt, Human
auuuuuguuaguuuugucaggag

SEQ ID NO: 308802 - RNA, 22 nt, Human
caaaucccaguucucucucuuc

SEQ ID NO: 308803 - RNA, 24 nt, Human
cacacuggccugaggucacacagc

SEQ ID NO: 308804 - RNA, 22 nt, Human
cagggacuccucccagacguuu

SEQ ID NO: 308805 - RNA, 21 nt, Human
caguuuuguggccccagggac

SEQ ID NO: 308806 - RNA, 25 nt, Human
cccacggccuuccuccagcuuuucu

SEQ ID NO: 308807 - RNA, 24 nt, Human
ccccagaugcgugggcgccucccc

SEQ ID NO: 308808 - RNA, 19 nt, Human
ccccggauccagccagggc

SEQ ID NO: 308809 - RNA, 19 nt, Human
cccggggcaaucgcucucc

SEQ ID NO: 308810 - RNA, 21 nt, Human
cccugcacgucuucucuccuu

SEQ ID NO: 308811 - RNA, 23 nt, Human
ccuccgccacaaacuuccuuccc

SEQ ID NO: 308812 - RNA, 24 nt, Human
ccuccgccacaaacuuccuucccg

SEQ ID NO: 308813 - RNA, 22 nt, Human
ccugaggucacacagcaagucu

SEQ ID NO: 308814 - RNA, 21 nt, Human
ccugggugcaaaucccaguuc

SEQ ID NO: 308815 - RNA, 22 nt, Human
ccuucuggccucaggaaggagg

SEQ ID NO: 308816 - RNA, 21 nt, Human
cgaaccuccuccgccacaaac

SEQ ID NO: 308817 - RNA, 23 nt, Human
cgccacaaacuuccuucccgggg

SEQ ID NO: 308818 - RNA, 23 nt, Human
cggccuuccuccagcuuuucucu

SEQ ID NO: 308819 - RNA, 21 nt, Human
cuggccucaggaaggaggcag

SEQ ID NO: 308820 - RNA, 21 nt, Human
gagucagccccagaugcgugg

SEQ ID NO: 308821 - RNA, 20 nt, Human
gcugguggugaaggggcugg

SEQ ID NO: 308822 - RNA, 21 nt, Human
ggcagagagggggauuucagg

SEQ ID NO: 308823 - RNA, 22 nt, Human
ggcagagagggggauuucaggu

SEQ ID NO: 308824 - RNA, 19 nt, Human
gggcuggcucggcccugac

SEQ ID NO: 308825 - RNA, 21 nt, Human
ggggcgcggccggcugguggu

SEQ ID NO: 308826 - RNA, 18 nt, Human
gucgcgagggcagcuccu

SEQ ID NO: 308827 - RNA, 22 nt, Human
guggccccagggacuccuccca

SEQ ID NO: 308828 - RNA, 26 nt, Human
uaaaauaaauaauaugaauauuaauu

SEQ ID NO: 308829 - RNA, 24 nt, Human
uaacaacaacacaacagcggcaac

SEQ ID NO: 308830 - RNA, 23 nt, Human
uaauaacaacaacacaacagcgg

SEQ ID NO: 308831 - RNA, 23 nt, Human
ucaggaaggaggcaguuuugugg

SEQ ID NO: 308832 - RNA, 22 nt, Human
ucccccggauccagccagggca

SEQ ID NO: 308833 - RNA, 24 nt, Human
uccgccacaaacuuccuucccggg

SEQ ID NO: 308834 - RNA, 23 nt, Human
uccuccgccacaaacuuccuucc

SEQ ID NO: 308835 - RNA, 18 nt, Human
uccugugcgcgggguccc

SEQ ID NO: 308836 - RNA, 24 nt, Human
ucuccacugcuguaaaaugaggau

SEQ ID NO: 308837 - RNA, 21 nt, Human
ucuguccccagauugccuggg

SEQ ID NO: 308838 - RNA, 22 nt, Human
ugacgguaaauaugaauguggc

SEQ ID NO: 308839 - RNA, 19 nt, Human
ugaggcccagagaggucgg

SEQ ID NO: 308840 - RNA, 24 nt, Human
ugggacccggggcaaucgcucucc

SEQ ID NO: 308841 - RNA, 18 nt, Human
uggugaaggggcuggcuc

SEQ ID NO: 308842 - RNA, 23 nt, Human
ugguggugaaggggcuggcucgg

SEQ ID NO: 308843 - RNA, 25 nt, Human
uguaaaaugaggauaaaaacuuuga

SEQ ID NO: 308844 - RNA, 25 nt, Human
ugugagauagcuguuuucauagcug

SEQ ID NO: 308845 - RNA, 23 nt, Human
uuaauaauaacaagagcucuccc

SEQ ID NO: 308846 - RNA, 25 nt, Human
uuaauaauaacaagagcucucccau

SEQ ID NO: 308847 - RNA, 19 nt, Human
uucccggggcgcggccggc

SEQ ID NO: 308848 - RNA, 18 nt, Human
aacagcacccaagagccc

SEQ ID NO: 308849 - RNA, 27 nt, Human
agacuucuaggccccagagaggcccuu

SEQ ID NO: 308850 - RNA, 22 nt, Human
agaguggggccaggaucccacu

SEQ ID NO: 308851 - RNA, 18 nt, Human
agccaagcugggcucaaa

SEQ ID NO: 308852 - RNA, 21 nt, Human
agccuggggcaggaggguucg

SEQ ID NO: 308853 - RNA, 18 nt, Human
aggaagaggggugagcca

SEQ ID NO: 308854 - RNA, 22 nt, Human
aggaaggaggccagccaggagg

SEQ ID NO: 308855 - RNA, 22 nt, Human
agggugccuggguccugucuca

SEQ ID NO: 308856 - RNA, 21 nt, Human
aucccacuuucugccuuccag

SEQ ID NO: 308857 - RNA, 20 nt, Human
auggggccuggaagccuggg

SEQ ID NO: 308858 - RNA, 19 nt, Human
cagaagggcaggaaggagg

SEQ ID NO: 308859 - RNA, 19 nt, Human
cagaguggggccaggaucc

SEQ ID NO: 308860 - RNA, 24 nt, Human
cagccaggagggggagccaagcug

SEQ ID NO: 308861 - RNA, 21 nt, Human
ccaggaucccacuuucugccu

SEQ ID NO: 308862 - RNA, 20 nt, Human
ccaguccauagucuuuugcc

SEQ ID NO: 308863 - RNA, 19 nt, Human
cccaagagcccacugcccc

SEQ ID NO: 308864 - RNA, 18 nt, Human
cccacuuucugccuucca

SEQ ID NO: 308865 - RNA, 18 nt, Human
cccugccgugagggugcc

SEQ ID NO: 308866 - RNA, 22 nt, Human
cccugccgugagggugccuggg

SEQ ID NO: 308867 - RNA, 20 nt, Human
ccuaggaagaggggugagcc

SEQ ID NO: 308868 - RNA, 20 nt, Human
ccucaacaaauauaugacac

SEQ ID NO: 308869 - RNA, 18 nt, Human
ccuggggcaggaggguuc

SEQ ID NO: 308870 - RNA, 20 nt, Human
cuagagauggagggggaggu

SEQ ID NO: 308871 - RNA, 24 nt, Human
cuaggccccagagaggcccugccg

SEQ ID NO: 308872 - RNA, 19 nt, Human
cugagagggguacauggua

SEQ ID NO: 308873 - RNA, 19 nt, Human
cugcagcguccaaggcagc

SEQ ID NO: 308874 - RNA, 23 nt, Human
gacacaggcaggcagaagggcag

SEQ ID NO: 308875 - RNA, 20 nt, Human
gagaggcccugccgugaggg

SEQ ID NO: 308876 - RNA, 21 nt, Human
gagcaaaugaugcugaccuug

SEQ ID NO: 308877 - RNA, 20 nt, Human
gagccagggucaggguggaa

SEQ ID NO: 308878 - RNA, 18 nt, Human
gaggagggggcugcagcg

SEQ ID NO: 308879 - RNA, 19 nt, Human
gaggagggggcugcagcgu

SEQ ID NO: 308880 - RNA, 19 nt, Human
gagggugccuggguccugu

SEQ ID NO: 308881 - RNA, 19 nt, Human
gcagaagggcaggaaggag

SEQ ID NO: 308882 - RNA, 27 nt, Human
gcccucaacaaauauaugaccgguuuc

SEQ ID NO: 308883 - RNA, 21 nt, Human
gccuggccguugaggaggggg

SEQ ID NO: 308884 - RNA, 22 nt, Human
gccuggguccugucucagacuc

SEQ ID NO: 308885 - RNA, 24 nt, Human
ggaagucagcuugagaagacuucu

SEQ ID NO: 308886 - RNA, 21 nt, Human
ggcaggaaggaggccagccag

SEQ ID NO: 308887 - RNA, 21 nt, Human
ggccccagagaggcccugccg

SEQ ID NO: 308888 - RNA, 20 nt, Human
ggccuggaagccuggggcag

SEQ ID NO: 308889 - RNA, 19 nt, Human
gggcaggaaggaggccagc

SEQ ID NO: 308890 - RNA, 19 nt, Human
gggcaggaggguucggggc

SEQ ID NO: 308891 - RNA, 20 nt, Human
guggggccaggaucccacuu

SEQ ID NO: 308892 - RNA, 19 nt, Human
uagaaccacaucccagaga

SEQ ID NO: 308893 - RNA, 20 nt, Human
uagagauggagggggaggua

SEQ ID NO: 308894 - RNA, 19 nt, Human
uagccccugggguggcccu

SEQ ID NO: 308895 - RNA, 22 nt, Human
uaggaagaggggugagccaggg

SEQ ID NO: 308896 - RNA, 19 nt, Human
ucagaaggcuggggcuccu

SEQ ID NO: 308897 - RNA, 19 nt, Human
uccauagucuuuugcccuc

SEQ ID NO: 308898 - RNA, 18 nt, Human
ucccagagaaggggcuga

SEQ ID NO: 308899 - RNA, 21 nt, Human
ucucagacucuggccuggccg

SEQ ID NO: 308900 - RNA, 20 nt, Human
ugaggaaacugagcccagag

SEQ ID NO: 308901 - RNA, 22 nt, Human
ugaggagggggcugcagcgucc

SEQ ID NO: 308902 - RNA, 21 nt, Human
ugagggugccuggguccuguc

SEQ ID NO: 308903 - RNA, 24 nt, Human
uggaacagcacccaagagcccacu

SEQ ID NO: 308904 - RNA, 19 nt, Human
uggaagccuggggcaggag

SEQ ID NO: 308905 - RNA, 21 nt, Human
uggaagccuggggcaggaggg

SEQ ID NO: 308906 - RNA, 19 nt, Human
uggaggugaguggguccaa

SEQ ID NO: 308907 - RNA, 25 nt, Human
uggggccaggaucccacuuucugcc

SEQ ID NO: 308908 - RNA, 19 nt, Human
ugucucagacucuggccug

SEQ ID NO: 308909 - RNA, 21 nt, Human
uucuaggccccagagaggccc

SEQ ID NO: 308910 - RNA, 18 nt, Human
uuugcagaaucucagcag

SEQ ID NO: 308911 - RNA, 21 nt, Human
aaaaggaagaggagaauaaaa

SEQ ID NO: 308912 - RNA, 21 nt, Human
aagaguuguucacaccaagcu

SEQ ID NO: 308913 - RNA, 25 nt, Human
acauaaaggaaacaaaauaaacagc

SEQ ID NO: 308914 - RNA, 20 nt, Human
agcggcacuggagggacaca

SEQ ID NO: 308915 - RNA, 19 nt, Human
auuuuuguuuggccaagga

SEQ ID NO: 308916 - RNA, 21 nt, Human
caaaauaaacagcuuucaucc

SEQ ID NO: 308917 - RNA, 19 nt, Human
caggggucccccuggugcu

SEQ ID NO: 308918 - RNA, 26 nt, Human
ccugcaguuacaacauguccuaaggc

SEQ ID NO: 308919 - RNA, 26 nt, Human
cucugaugcaaagauccagguccuac

SEQ ID NO: 308920 - RNA, 19 nt, Human
cugaugcaaagauccaggu

SEQ ID NO: 308921 - RNA, 19 nt, Human
cuggugcuugggagaacaa

SEQ ID NO: 308922 - RNA, 21 nt, Human
cuugggagaacaaggggcaag

SEQ ID NO: 308923 - RNA, 21 nt, Human
gacucugccuuacuggaauag

SEQ ID NO: 308924 - RNA, 19 nt, Human
gagaauaaaauuaccucuc

SEQ ID NO: 308925 - RNA, 22 nt, Human
gagucuuuugaugcuuuguggg

SEQ ID NO: 308926 - RNA, 19 nt, Human
gugagacuaggguaaaagg

SEQ ID NO: 308927 - RNA, 22 nt, Human
uaaaauuaccucucauugcaga

SEQ ID NO: 308928 - RNA, 21 nt, Human
uacacauaaaggaaacaaaau

SEQ ID NO: 308929 - RNA, 21 nt, Human
ucccagagcuguuagucuagu

SEQ ID NO: 308930 - RNA, 21 nt, Human
ucucugguuucagauaucauc

SEQ ID NO: 308931 - RNA, 23 nt, Human
ugagugagucuuuugaugcuuug

SEQ ID NO: 308932 - RNA, 19 nt, Human
ugcaaagauccagguccua

SEQ ID NO: 308933 - RNA, 26 nt, Human
ugcuuuguggguuugcugccguguac

SEQ ID NO: 308934 - RNA, 22 nt, Human
uggaauaguaaauuuuugugga

SEQ ID NO: 308935 - RNA, 22 nt, Human
uggguuugcugcuucaguuugc

SEQ ID NO: 308936 - RNA, 24 nt, Human
uggugcuugggagaacaaggggca

SEQ ID NO: 308937 - RNA, 28 nt, Human
uggugcuugggagaacaaggggcaagcg

SEQ ID NO: 308938 - RNA, 21 nt, Human
uucccaaacuaguccucagug

SEQ ID NO: 308939 - RNA, 20 nt, Human
uuguggauuuguagcuauuu

SEQ ID NO: 308940 - RNA, 19 nt, Human
accccacuggguuccucca

SEQ ID NO: 308941 - RNA, 21 nt, Human
caagaggcugggagcaggcac

SEQ ID NO: 308942 - RNA, 21 nt, Human
cacuauguuagggcugaaggc

SEQ ID NO: 308943 - RNA, 21 nt, Human
cagcccacucaggggggaccc

SEQ ID NO: 308944 - RNA, 20 nt, Human
cccacauguggacagagggc

SEQ ID NO: 308945 - RNA, 23 nt, Human
cgacagcaccggcggccuggggu

SEQ ID NO: 308946 - RNA, 18 nt, Human
gcugaaggcaauuugggg

SEQ ID NO: 308947 - RNA, 19 nt, Human
gcugcauuguuauuccuaa

SEQ ID NO: 308948 - RNA, 19 nt, Human
gguccgagcggagugcgac

SEQ ID NO: 308949 - RNA, 19 nt, Human
uccgagcggagugcgacca

SEQ ID NO: 308950 - RNA, 27 nt, Human
uguuagggcugaaggcaauuugggggc

SEQ ID NO: 308951 - RNA, 19 nt, Human
aaacacaguacaguuuuug

SEQ ID NO: 308952 - RNA, 21 nt, Human
aagcuacaggacaauguaaac

SEQ ID NO: 308953 - RNA, 24 nt, Human
aaggcuccuccuccuccuccacuc

SEQ ID NO: 308954 - RNA, 19 nt, Human
acagcaccugcugcucucc

SEQ ID NO: 308955 - RNA, 19 nt, Human
acucuuaggaaugucagag

SEQ ID NO: 308956 - RNA, 21 nt, Human
aggaaugucaguagcuccuug

SEQ ID NO: 308957 - RNA, 21 nt, Human
auccagagcuggggcauggag

SEQ ID NO: 308958 - RNA, 19 nt, Human
caaagaacccaguucgcgg

SEQ ID NO: 308959 - RNA, 21 nt, Human
caacggcggcggcggcacccc

SEQ ID NO: 308960 - RNA, 23 nt, Human
caagauggaaggauccaucucca

SEQ ID NO: 308961 - RNA, 22 nt, Human
cacucuuaggaaugucaguagc

SEQ ID NO: 308962 - RNA, 18 nt, Human
cacugcuggaauccaggc

SEQ ID NO: 308963 - RNA, 27 nt, Human
cagcaaggcuccuccuccuccuccacu

SEQ ID NO: 308964 - RNA, 24 nt, Human
ccacuggcugaggcagccucucuc

SEQ ID NO: 308965 - RNA, 24 nt, Human
ccaucuccagaagucagggccaga

SEQ ID NO: 308966 - RNA, 22 nt, Human
cccacaagauggaaggauccau

SEQ ID NO: 308967 - RNA, 19 nt, Human
cccagcaaggcuccuccuc

SEQ ID NO: 308968 - RNA, 23 nt, Human
ccgcccgggagcaagcgcaacgg

SEQ ID NO: 308969 - RNA, 20 nt, Human
ccuccuccuccuccacucuu

SEQ ID NO: 308970 - RNA, 21 nt, Human
ccugcugcucuccaacgaggc

SEQ ID NO: 308971 - RNA, 25 nt, Human
cuccuccuccuccuccacucuuccc

SEQ ID NO: 308972 - RNA, 24 nt, Human
cugggggcggcggcggcacaggcc

SEQ ID NO: 308973 - RNA, 21 nt, Human
gaggcagccucucucuccaag

SEQ ID NO: 308974 - RNA, 19 nt, Human
gcgcacagcaccugcugcu

SEQ ID NO: 308975 - RNA, 20 nt, Human
ggaaggccgccacagggggc

SEQ ID NO: 308976 - RNA, 22 nt, Human
ggccaugguccuggccccacaa

SEQ ID NO: 308977 - RNA, 19 nt, Human
gggggcggcggcggcacag

SEQ ID NO: 308978 - RNA, 23 nt, Human
gucaguagcuccuuggagucucc

SEQ ID NO: 308979 - RNA, 22 nt, Human
gugugcuuaaugcgaaacacag

SEQ ID NO: 308980 - RNA, 19 nt, Human
uagcuccuuggagucuccu

SEQ ID NO: 308981 - RNA, 23 nt, Human
ucaguagcuccuuggagucuccu

SEQ ID NO: 308982 - RNA, 23 nt, Human
uccaaagaacccaguucgcggca

SEQ ID NO: 308983 - RNA, 25 nt, Human
uccaaagaacccaguucgcggcauu

SEQ ID NO: 308984 - RNA, 30 nt, Human
uccagagcuggggcauggaggcccaaaacc

SEQ ID NO: 308985 - RNA, 18 nt, Human
ucuccaacgaggcugggg

SEQ ID NO: 308986 - RNA, 21 nt, Human
ugccacuggcugaggcagccu

SEQ ID NO: 308987 - RNA, 22 nt, Human
uggccccacaagauggaaggau

SEQ ID NO: 308988 - RNA, 20 nt, Human
uggggcauggaggcccaaaa

SEQ ID NO: 308989 - RNA, 21 nt, Human
ugggggcggcggcggcacagg

SEQ ID NO: 308990 - RNA, 22 nt, Human
ugggggcggcggcggcacaggc

SEQ ID NO: 308991 - RNA, 21 nt, Human
uguuucccuggcccagcaagg

SEQ ID NO: 308992 - RNA, 20 nt, Human
uucccuggcccagcaaggcu

SEQ ID NO: 308993 - RNA, 23 nt, Human
uucccuggcccagcaaggcuccc

SEQ ID NO: 308994 - RNA, 18 nt, Human
uuggagucuccugugcca

SEQ ID NO: 308995 - RNA, 22 nt, Human
uuggagucuccugugccacugg

SEQ ID NO: 308996 - RNA, 26 nt, Human
aacacacaugcgcacacacacagugu

SEQ ID NO: 308997 - RNA, 21 nt, Human
acacacaugcgcacacacaca

SEQ ID NO: 308998 - RNA, 21 nt, Human
agaaggaaggaaucgggagaa

SEQ ID NO: 308999 - RNA, 22 nt, Human
cacaugcgcacacacacaauag

SEQ ID NO: 309000 - RNA, 21 nt, Human
cagcugcccgccugccccggg

SEQ ID NO: 309001 - RNA, 28 nt, Human
caugcgcacacacacaauacccuuacac

SEQ ID NO: 309002 - RNA, 19 nt, Human
cccgcgcgcgcagcccgcg

SEQ ID NO: 309003 - RNA, 20 nt, Human
cccgcgcgcgcagcccgcgg

SEQ ID NO: 309004 - RNA, 24 nt, Human
cccgcgcgcgcagcccgcgucccg

SEQ ID NO: 309005 - RNA, 23 nt, Human
cgcacacacacaauacccuuaca

SEQ ID NO: 309006 - RNA, 32 nt, Human
cgcacacacacaauacccuuacacacauagug

SEQ ID NO: 309007 - RNA, 28 nt, Human
cgcagcccgcgucccgacucgggucacc

SEQ ID NO: 309008 - RNA, 21 nt, Human
cgcgcgcgcagcccgcguccc

SEQ ID NO: 309009 - RNA, 18 nt, Human
cugcccgccugccccggg

SEQ ID NO: 309010 - RNA, 19 nt, Human
cuggccgugccgcccgggc

SEQ ID NO: 309011 - RNA, 25 nt, Human
gaaaauaauaggaaauuaccccaac

SEQ ID NO: 309012 - RNA, 20 nt, Human
gggagaaaucaggaagcugg

SEQ ID NO: 309013 - RNA, 21 nt, Human
gggagaaaucaggaagcuggc

SEQ ID NO: 309014 - RNA, 22 nt, Human
ggggucccgcgcgcgcagcccg

SEQ ID NO: 309015 - RNA, 21 nt, Human
gugccgcccgggcacagcugc

SEQ ID NO: 309016 - RNA, 26 nt, Human
uacaugcaaacacacaugcgcacaca

SEQ ID NO: 309017 - RNA, 21 nt, Human
uccaagaugaaaauaauagga

SEQ ID NO: 309018 - RNA, 23 nt, Human
uccaagaugaaaauaauaggaaa

SEQ ID NO: 309019 - RNA, 23 nt, Human
ugaagaaaagaugucacagauua

SEQ ID NO: 309020 - RNA, 23 nt, Human
ugagaggccaaaaaugaggagca

SEQ ID NO: 309021 - RNA, 21 nt, Human
uugaagaaaagaugucacaga

SEQ ID NO: 309022 - RNA, 23 nt, Human
aacagaguacaugcuaccaacaa

SEQ ID NO: 309023 - RNA, 20 nt, Human
aaggggccgcuagcaccugc

SEQ ID NO: 309024 - RNA, 21 nt, Human
aaggggcugcagggcgaaggg

SEQ ID NO: 309025 - RNA, 21 nt, Human
cccuccccagucauuccaaaa

SEQ ID NO: 309026 - RNA, 20 nt, Human
ggauacgagaaugcgucagg

SEQ ID NO: 309027 - RNA, 19 nt, Human
gggcgaaggggccgcuagc

SEQ ID NO: 309028 - RNA, 22 nt, Human
uaggcagaaggaauuauaaagu

SEQ ID NO: 309029 - RNA, 23 nt, Human
ucaaugugacugcagcccucccc

SEQ ID NO: 309030 - RNA, 19 nt, Human
uccccaggaagucacugug

SEQ ID NO: 309031 - RNA, 20 nt, Human
ucucagggcuccucgugccu

SEQ ID NO: 309032 - RNA, 21 nt, Human
ucuuugagcugccaaugaaua

SEQ ID NO: 309033 - RNA, 19 nt, Human
ugacugcagcccuccccag

SEQ ID NO: 309034 - RNA, 24 nt, Human
ugcagcccuccccagucauuccaa

SEQ ID NO: 309035 - RNA, 24 nt, Human
uggacagaguaaaagcaaaggggc

SEQ ID NO: 309036 - RNA, 19 nt, Human
aagaggaagggaacaaugg

SEQ ID NO: 309037 - RNA, 25 nt, Human
aaugccugccuccccagaucucaaa

SEQ ID NO: 309038 - RNA, 23 nt, Human
agccggagcccacgccccggccg

SEQ ID NO: 309039 - RNA, 26 nt, Human
agggagccagacgugguggggcacag

SEQ ID NO: 309040 - RNA, 22 nt, Human
agggaggggguucaagggcagg

SEQ ID NO: 309041 - RNA, 20 nt, Human
agggcacugcccucaguccu

SEQ ID NO: 309042 - RNA, 20 nt, Human
auugaacggauacaaaguua

SEQ ID NO: 309043 - RNA, 18 nt, Human
cacugggcagcagggggg

SEQ ID NO: 309044 - RNA, 19 nt, Human
cagggagccagacguggug

SEQ ID NO: 309045 - RNA, 18 nt, Human
ccccagaucucaaagggc

SEQ ID NO: 309046 - RNA, 19 nt, Human
ccggagcccacgccccggc

SEQ ID NO: 309047 - RNA, 22 nt, Human
ccggagcugcagccggagccca

SEQ ID NO: 309048 - RNA, 23 nt, Human
ccuggggcagagcccccuucucc

SEQ ID NO: 309049 - RNA, 21 nt, Human
cucuguaacaccucuaguucc

SEQ ID NO: 309050 - RNA, 22 nt, Human
cuucaggaaugccugccucccc

SEQ ID NO: 309051 - RNA, 19 nt, Human
gacagggaggggguucaag

SEQ ID NO: 309052 - RNA, 22 nt, Human
gacagggaggggguucaagggc

SEQ ID NO: 309053 - RNA, 21 nt, Human
gcaggaagaggaagggaacaa

SEQ ID NO: 309054 - RNA, 22 nt, Human
gcuugacccugcucacccuggc

SEQ ID NO: 309055 - RNA, 18 nt, Human
gcuuuauccuucccucca

SEQ ID NO: 309056 - RNA, 18 nt, Human
ggagccagacgugguggg

SEQ ID NO: 309057 - RNA, 22 nt, Human
ggagcugugcuucuccuuugca

SEQ ID NO: 309058 - RNA, 18 nt, Human
ggccuggggcagagcccc

SEQ ID NO: 309059 - RNA, 24 nt, Human
gggaacaauggguaguagggccgg

SEQ ID NO: 309060 - RNA, 26 nt, Human
gggcaggaagaggaagggaacaaugg

SEQ ID NO: 309061 - RNA, 20 nt, Human
ggggguucaagggcaggaag

SEQ ID NO: 309062 - RNA, 24 nt, Human
guggggcacagcagcuggugaccu

SEQ ID NO: 309063 - RNA, 23 nt, Human
uaagaggcuugacccugcucacc

SEQ ID NO: 309064 - RNA, 20 nt, Human
uaaugugcccuccuuccuuc

SEQ ID NO: 309065 - RNA, 20 nt, Human
ucagcaggcugguggaggga

SEQ ID NO: 309066 - RNA, 19 nt, Human
uccuuccccuggugggggc

SEQ ID NO: 309067 - RNA, 20 nt, Human
uccuuccuuccccugguggg

SEQ ID NO: 309068 - RNA, 25 nt, Human
ugcagcauggagaagugguuugcac

SEQ ID NO: 309069 - RNA, 22 nt, Human
uggaauaagaggcuugacccug

SEQ ID NO: 309070 - RNA, 19 nt, Human
uggcagcaaugggcuggga

SEQ ID NO: 309071 - RNA, 23 nt, Human
ugggagggcccugggacagggag

SEQ ID NO: 309072 - RNA, 21 nt, Human
uggugggggcugaagccagaa

SEQ ID NO: 309073 - RNA, 24 nt, Human
uucaagggcaggaagaggaaggga

SEQ ID NO: 309074 - RNA, 21 nt, Human
aagcaaacguguggcucguca

SEQ ID NO: 309075 - RNA, 24 nt, Human
acagaagagauugucgcacccgga

SEQ ID NO: 309076 - RNA, 22 nt, Human
acagggaagaagcaaacgugug

SEQ ID NO: 309077 - RNA, 18 nt, Human
cacccggaagugacgggg

SEQ ID NO: 309078 - RNA, 18 nt, Human
ccuaacgacuccagcggc

SEQ ID NO: 309079 - RNA, 19 nt, Human
ggcaccuaacgacuccagc

SEQ ID NO: 309080 - RNA, 19 nt, Human
gggaacacagggaagaagc

SEQ ID NO: 309081 - RNA, 27 nt, Human
gggaacacagggaagaagccgguaccc

SEQ ID NO: 309082 - RNA, 21 nt, Human
guguggcucgucagaagcaag

SEQ ID NO: 309083 - RNA, 25 nt, Human
ugggaacacagggaagaagcaaacg

SEQ ID NO: 309084 - RNA, 21 nt, Human
aaacagaaucucacagaugug

SEQ ID NO: 309085 - RNA, 25 nt, Human
aaacccucaaaaccaccacugcucu

SEQ ID NO: 309086 - RNA, 20 nt, Human
aaagacaguucuuuaccucu

SEQ ID NO: 309087 - RNA, 22 nt, Human
aaaugaaacagaaucucacaga

SEQ ID NO: 309088 - RNA, 20 nt, Human
aacaaagggagacccucuca

SEQ ID NO: 309089 - RNA, 27 nt, Human
aacguuagagaaaugcuccagaaagga

SEQ ID NO: 309090 - RNA, 18 nt, Human
aagcugaggcacgaacgc

SEQ ID NO: 309091 - RNA, 18 nt, Human
aaggacccucagcuacuc

SEQ ID NO: 309092 - RNA, 23 nt, Human
aaguagaagaugucuaaagagaa

SEQ ID NO: 309093 - RNA, 21 nt, Human
aaugaggaaaaauguucuacu

SEQ ID NO: 309094 - RNA, 18 nt, Human
accccugggcuguuuccc

SEQ ID NO: 309095 - RNA, 19 nt, Human
acuguacuacagaucagca

SEQ ID NO: 309096 - RNA, 23 nt, Human
acuguacuacagaucagcaacag

SEQ ID NO: 309097 - RNA, 23 nt, Human
agagaacaaaagagguuucuucc

SEQ ID NO: 309098 - RNA, 21 nt, Human
agaugcugcgcaaugcuaaca

SEQ ID NO: 309099 - RNA, 19 nt, Human
agauuuuuuuuuuuuuaag

SEQ ID NO: 309100 - RNA, 22 nt, Human
agcagaacaacuagauacacua

SEQ ID NO: 309101 - RNA, 22 nt, Human
agcuggccaguaguucagcccc

SEQ ID NO: 309102 - RNA, 20 nt, Human
aggaacaaagggagacccuc

SEQ ID NO: 309103 - RNA, 23 nt, Human
aggaggggaggaggaaugcagga

SEQ ID NO: 309104 - RNA, 18 nt, Human
aggauuugauaaaaugag

SEQ ID NO: 309105 - RNA, 21 nt, Human
aggccaagagcaaguagaaga

SEQ ID NO: 309106 - RNA, 21 nt, Human
agggggaccucaggaaucuac

SEQ ID NO: 309107 - RNA, 21 nt, Human
aguggaauagggcuccucugg

SEQ ID NO: 309108 - RNA, 23 nt, Human
agugggaacagcuucaggaaugu

SEQ ID NO: 309109 - RNA, 24 nt, Human
augcaaaggucacucucaggcaac

SEQ ID NO: 309110 - RNA, 21 nt, Human
auugcaaauaaguucccaauu

SEQ ID NO: 309111 - RNA, 23 nt, Human
auuuuuuuuuuuuuaagcuaggg

SEQ ID NO: 309112 - RNA, 19 nt, Human
caaaacccucaaaaccacc

SEQ ID NO: 309113 - RNA, 20 nt, Human
caaaacccucaaaaccacca

SEQ ID NO: 309114 - RNA, 21 nt, Human
caaaaguaauagaagucaaaa

SEQ ID NO: 309115 - RNA, 23 nt, Human
caauacaaugcaggggaaccuug

SEQ ID NO: 309116 - RNA, 22 nt, Human
caccaggcaguugcccaggccu

SEQ ID NO: 309117 - RNA, 23 nt, Human
caccaggcaguugcccaggccuc

SEQ ID NO: 309118 - RNA, 21 nt, Human
cagaagacacaacuuuccagg

SEQ ID NO: 309119 - RNA, 25 nt, Human
cagaaucucacagaugugggguccc

SEQ ID NO: 309120 - RNA, 19 nt, Human
cagaguggaauagggcucc

SEQ ID NO: 309121 - RNA, 23 nt, Human
cagcugccgcaagacacauucac

SEQ ID NO: 309122 - RNA, 19 nt, Human
cagcuucaggaauguuaca

SEQ ID NO: 309123 - RNA, 19 nt, Human
cagguccuggacugagcuu

SEQ ID NO: 309124 - RNA, 24 nt, Human
ccaaaaguaauagaagucaaaacc

SEQ ID NO: 309125 - RNA, 22 nt, Human
ccaggccucucacccauggggg

SEQ ID NO: 309126 - RNA, 25 nt, Human
ccccccugcaaaugaaaacuuccca

SEQ ID NO: 309127 - RNA, 21 nt, Human
cccgggucucuuucccagaag

SEQ ID NO: 309128 - RNA, 21 nt, Human
cccucaaaaccaccacugcuc

SEQ ID NO: 309129 - RNA, 21 nt, Human
ccucaaaaccaccacugcucu

SEQ ID NO: 309130 - RNA, 21 nt, Human
ccuccccgggucucuuuccca

SEQ ID NO: 309131 - RNA, 24 nt, Human
ccucucagaaguucuguguggcuc

SEQ ID NO: 309132 - RNA, 19 nt, Human
cuacucuccuuucuuuccu

SEQ ID NO: 309133 - RNA, 19 nt, Human
cucaggaggggaggaggaa

SEQ ID NO: 309134 - RNA, 25 nt, Human
cucuccuuucuuuccuggagccuuu

SEQ ID NO: 309135 - RNA, 21 nt, Human
cugucuuucucaauuuuggag

SEQ ID NO: 309136 - RNA, 22 nt, Human
gaaacagaaucucacagaugug

SEQ ID NO: 309137 - RNA, 25 nt, Human
gaacagcuucaggaauguuacaggg

SEQ ID NO: 309138 - RNA, 26 nt, Human
gaaggacaccagcagaacuggagacc

SEQ ID NO: 309139 - RNA, 20 nt, Human
gaaguucuguguggcucuga

SEQ ID NO: 309140 - RNA, 19 nt, Human
gaaguuuuugaguaggaug

SEQ ID NO: 309141 - RNA, 18 nt, Human
gaggaaaaauguucuacu

SEQ ID NO: 309142 - RNA, 22 nt, Human
gaggggaggaggaaugcaggag

SEQ ID NO: 309143 - RNA, 19 nt, Human
gaugaggaagaaagaagag

SEQ ID NO: 309144 - RNA, 18 nt, Human
gcaauaucauuuacugga

SEQ ID NO: 309145 - RNA, 19 nt, Human
gcuccagaaaggaacaaag

SEQ ID NO: 309146 - RNA, 22 nt, Human
gcugcgcaaugcuaacagcccc

SEQ ID NO: 309147 - RNA, 19 nt, Human
gcuuaaagcugaggcacga

SEQ ID NO: 309148 - RNA, 18 nt, Human
ggaaccuugcacaccaca

SEQ ID NO: 309149 - RNA, 23 nt, Human
ggggcagaggggcugcagugagc

SEQ ID NO: 309150 - RNA, 24 nt, Human
gggucauggauaggggcagagggg

SEQ ID NO: 309151 - RNA, 22 nt, Human
gucaaaacccucaaaaccaccc

SEQ ID NO: 309152 - RNA, 22 nt, Human
uacuccuggccuccccgggucu

SEQ ID NO: 309153 - RNA, 23 nt, Human
uacuuuaacacugaguguagaaa

SEQ ID NO: 309154 - RNA, 19 nt, Human
uaggggcagaggggcugca

SEQ ID NO: 309155 - RNA, 22 nt, Human
ucagaacucaagcaggagcugc

SEQ ID NO: 309156 - RNA, 24 nt, Human
ucagaacucaagcaggagcugcug

SEQ ID NO: 309157 - RNA, 23 nt, Human
ucagaaguucuguguggcucuga

SEQ ID NO: 309158 - RNA, 18 nt, Human
uccagaagaggcccugag

SEQ ID NO: 309159 - RNA, 24 nt, Human
uccccgggucucuuucccagaagg

SEQ ID NO: 309160 - RNA, 18 nt, Human
ucccucaggaggggagga

SEQ ID NO: 309161 - RNA, 18 nt, Human
ucucacagaugugggguc

SEQ ID NO: 309162 - RNA, 19 nt, Human
ucucacagauguggggucc

SEQ ID NO: 309163 - RNA, 19 nt, Human
ucucagaucagccuaaaac

SEQ ID NO: 309164 - RNA, 21 nt, Human
ucuguaaaccucaaaugaaac

SEQ ID NO: 309165 - RNA, 21 nt, Human
ucuguguggcucugaguccuu

SEQ ID NO: 309166 - RNA, 20 nt, Human
ugaaaacuucccaccccugg

SEQ ID NO: 309167 - RNA, 23 nt, Human
ugaaaacuucccaccccugggcu

SEQ ID NO: 309168 - RNA, 18 nt, Human
ugaaacagaaucucacag

SEQ ID NO: 309169 - RNA, 21 nt, Human
ugaagauaacugaaggccagu

SEQ ID NO: 309170 - RNA, 21 nt, Human
ugccaaaaguaauagaaguca

SEQ ID NO: 309171 - RNA, 19 nt, Human
ugcgcaaugcuaacagccc

SEQ ID NO: 309172 - RNA, 22 nt, Human
uggacaggcagaugcaaagguc

SEQ ID NO: 309173 - RNA, 23 nt, Human
uggacaggcagaugcaaagguca

SEQ ID NO: 309174 - RNA, 25 nt, Human
uggacugagcuuguccaugggccgg

SEQ ID NO: 309175 - RNA, 23 nt, Human
uggcuggacaggcagaugcaaag

SEQ ID NO: 309176 - RNA, 19 nt, Human
ugggagugggaacagcuuc

SEQ ID NO: 309177 - RNA, 21 nt, Human
ugggagugggaacagcuucag

SEQ ID NO: 309178 - RNA, 22 nt, Human
uggggcagauuuuuuuuuuuuu

SEQ ID NO: 309179 - RNA, 21 nt, Human
uggggggaacacaucuggccg

SEQ ID NO: 309180 - RNA, 18 nt, Human
uggugaguuacauucaga

SEQ ID NO: 309181 - RNA, 18 nt, Human
uguccaugggcuucccuc

SEQ ID NO: 309182 - RNA, 21 nt, Human
ugucuaaagagaacaaaagag

SEQ ID NO: 309183 - RNA, 22 nt, Human
uguuacaggggaauugagggag

SEQ ID NO: 309184 - RNA, 20 nt, Human
uuaaagcugaggcacgaacc

SEQ ID NO: 309185 - RNA, 21 nt, Human
uuacuggagaacugaagaugc

SEQ ID NO: 309186 - RNA, 22 nt, Human
uuacuggagaacugaagaugcu

SEQ ID NO: 309187 - RNA, 24 nt, Human
uucaccaggcaguugcccaggccu

SEQ ID NO: 309188 - RNA, 22 nt, Human
uucucaauuuuggagaagaauc

SEQ ID NO: 309189 - RNA, 18 nt, Human
uuuucuguaaaccucaaa

SEQ ID NO: 309190 - RNA, 21 nt, Human
uuuuuuuuuuaagcuaggggg

SEQ ID NO: 309191 - RNA, 21 nt, Human
aaaaccaaaauuuacucaaau

SEQ ID NO: 309192 - RNA, 21 nt, Human
aaaaugccgagguuuggcgua

SEQ ID NO: 309193 - RNA, 22 nt, Human
aaccaaaauuuacucaaaucaa

SEQ ID NO: 309194 - RNA, 18 nt, Human
aaucccuacccacguccc

SEQ ID NO: 309195 - RNA, 21 nt, Human
agaaaauaacacaaaaaaugc

SEQ ID NO: 309196 - RNA, 20 nt, Human
agaauccagcagucagaaaa

SEQ ID NO: 309197 - RNA, 23 nt, Human
agcugguagcuggggacaguguc

SEQ ID NO: 309198 - RNA, 23 nt, Human
cuacccacgucccagccucuagg

SEQ ID NO: 309199 - RNA, 19 nt, Human
gagucagugcgucacucug

SEQ ID NO: 309200 - RNA, 20 nt, Human
gcagucagaaaauaacacaa

SEQ ID NO: 309201 - RNA, 24 nt, Human
gcccagaaagugggucccaauccc

SEQ ID NO: 309202 - RNA, 22 nt, Human
gcuaaaucccuacccacguccc

SEQ ID NO: 309203 - RNA, 19 nt, Human
uacagaauccagcagucag

SEQ ID NO: 309204 - RNA, 22 nt, Human
uacuacagaauccagcagucag

SEQ ID NO: 309205 - RNA, 23 nt, Human
ucaaaguuaaguacagaguuuau

SEQ ID NO: 309206 - RNA, 19 nt, Human
ucccagccucuaggugagu

SEQ ID NO: 309207 - RNA, 24 nt, Human
ugcuaaaucccuacccacguccca

SEQ ID NO: 309208 - RNA, 23 nt, Human
ugucauagcuaugucaccuuacu

SEQ ID NO: 309209 - RNA, 21 nt, Human
uuacugccaguuauuuccagc

SEQ ID NO: 309210 - RNA, 20 nt, Human
aaaaaauagaaagcaaccau

SEQ ID NO: 309211 - RNA, 24 nt, Human
aaaaaauagaaagcaaccauguuc

SEQ ID NO: 309212 - RNA, 20 nt, Human
aacaauacaguauaacaacu

SEQ ID NO: 309213 - RNA, 21 nt, Human
aagaaaccuccauacccaaga

SEQ ID NO: 309214 - RNA, 22 nt, Human
acaauacaguauaacaacgauu

SEQ ID NO: 309215 - RNA, 23 nt, Human
acaauuugagucaaacaugugau

SEQ ID NO: 309216 - RNA, 19 nt, Human
acuucagucccaaacauag

SEQ ID NO: 309217 - RNA, 21 nt, Human
acuugaaaaagaugagagaaa

SEQ ID NO: 309218 - RNA, 27 nt, Human
agaaaaaauagaaagcaaccgguaccc

SEQ ID NO: 309219 - RNA, 18 nt, Human
agccacagggguccugga

SEQ ID NO: 309220 - RNA, 23 nt, Human
aggaaaagucugaccuaggucug

SEQ ID NO: 309221 - RNA, 24 nt, Human
aguggaacuccauuuuugacaggu

SEQ ID NO: 309222 - RNA, 21 nt, Human
auagaaagcaaccauguucua

SEQ ID NO: 309223 - RNA, 23 nt, Human
caagaaaaaauagaaagcaacca

SEQ ID NO: 309224 - RNA, 26 nt, Human
caagaaaccuccauacccaagaaaaa

SEQ ID NO: 309225 - RNA, 19 nt, Human
cacaaauucaaccaacugu

SEQ ID NO: 309226 - RNA, 18 nt, Human
cacauccacaaauucaac

SEQ ID NO: 309227 - RNA, 25 nt, Human
cagcagugcccagaaaguguguccc

SEQ ID NO: 309228 - RNA, 21 nt, Human
cauccacaaauucaaccaacu

SEQ ID NO: 309229 - RNA, 19 nt, Human
cauuuuacauaagggacuu

SEQ ID NO: 309230 - RNA, 22 nt, Human
ccacaaauucaaccaacugugg

SEQ ID NO: 309231 - RNA, 23 nt, Human
ccacaaauucaaccaacugugga

SEQ ID NO: 309232 - RNA, 23 nt, Human
cccucacagacacagacggacac

SEQ ID NO: 309233 - RNA, 23 nt, Human
cccucuguauccauggguuccac

SEQ ID NO: 309234 - RNA, 19 nt, Human
gaaccaaucccucacagac

SEQ ID NO: 309235 - RNA, 24 nt, Human
gcccagaaagugugucccaauccc

SEQ ID NO: 309236 - RNA, 18 nt, Human
gucaucuuuggucuuuuc

SEQ ID NO: 309237 - RNA, 20 nt, Human
gugccaaaaauaguugaaca

SEQ ID NO: 309238 - RNA, 20 nt, Human
guuggcccucuguauccaug

SEQ ID NO: 309239 - RNA, 25 nt, Human
uaaaacauaauacaaauaaaaacaa

SEQ ID NO: 309240 - RNA, 26 nt, Human
uacaguagaugaacacaaagaugaaa

SEQ ID NO: 309241 - RNA, 24 nt, Human
uacauagcauuuacauuauauuag

SEQ ID NO: 309242 - RNA, 24 nt, Human
uacccaagaaaaaauagaaagcaa

SEQ ID NO: 309243 - RNA, 19 nt, Human
uagggauugcacaagagaa

SEQ ID NO: 309244 - RNA, 20 nt, Human
ucacagacacagacggacac

SEQ ID NO: 309245 - RNA, 19 nt, Human
ucagucccaaacauaguca

SEQ ID NO: 309246 - RNA, 23 nt, Human
uccacaaauucaaccaacugugg

SEQ ID NO: 309247 - RNA, 24 nt, Human
ucccucacagacacagacggacac

SEQ ID NO: 309248 - RNA, 24 nt, Human
ucccucuguaguucuuuccauucc

SEQ ID NO: 309249 - RNA, 18 nt, Human
ucuuuccauucccagucu

SEQ ID NO: 309250 - RNA, 19 nt, Human
ugaaaggaaaagucugacu

SEQ ID NO: 309251 - RNA, 19 nt, Human
ugagagaaaauaacaauau

SEQ ID NO: 309252 - RNA, 23 nt, Human
ugagagaaaauaacaauaugaca

SEQ ID NO: 309253 - RNA, 24 nt, Human
ugaugccauuuuuuguuuuggaca

SEQ ID NO: 309254 - RNA, 22 nt, Human
ugcggggagaaguggaacucca

SEQ ID NO: 309255 - RNA, 22 nt, Human
uggaaaagacuugaaaaagaug

SEQ ID NO: 309256 - RNA, 23 nt, Human
uucaaccaacuguggauggaaaa

SEQ ID NO: 309257 - RNA, 22 nt, Human
uucaagaaaccuccauacccaa

SEQ ID NO: 309258 - RNA, 21 nt, Human
uucauugauuuuuuuuuuuaa

SEQ ID NO: 309259 - RNA, 20 nt, Human
uuccacauccacaaauucaa

SEQ ID NO: 309260 - RNA, 24 nt, Human
uucuucuauguucuaggucuucaa

SEQ ID NO: 309261 - RNA, 25 nt, Human
aaaaaaaaaggaaacaacuuaaaag

SEQ ID NO: 309262 - RNA, 18 nt, Human
aaaaaagaaaaaaaaagg

SEQ ID NO: 309263 - RNA, 27 nt, Human
aaaaaaggaaacaacuuaaaaguccau

SEQ ID NO: 309264 - RNA, 20 nt, Human
aaaaaggaaacaacuuaaaa

SEQ ID NO: 309265 - RNA, 26 nt, Human
aaacacccaagagcuuuugcaucuga

SEQ ID NO: 309266 - RNA, 20 nt, Human
aaagacacacauccuuuugc

SEQ ID NO: 309267 - RNA, 18 nt, Human
aaauaaacacccaagagc

SEQ ID NO: 309268 - RNA, 24 nt, Human
aacacucacuccggcugaccgcca

SEQ ID NO: 309269 - RNA, 22 nt, Human
aacggucaaauaucuuuuggcc

SEQ ID NO: 309270 - RNA, 24 nt, Human
aacuggcucugagagugaagcccc

SEQ ID NO: 309271 - RNA, 20 nt, Human
aagaaaaaaaaaggaaacaa

SEQ ID NO: 309272 - RNA, 21 nt, Human
aagcacacaggccuggacuca

SEQ ID NO: 309273 - RNA, 24 nt, Human
aagcaggcaugcguaacaccccac

SEQ ID NO: 309274 - RNA, 23 nt, Human
aagcuucaacuucuucccuuuaa

SEQ ID NO: 309275 - RNA, 18 nt, Human
aaggcaggugccccagga

SEQ ID NO: 309276 - RNA, 21 nt, Human
aaggcaggugccccaggaccc

SEQ ID NO: 309277 - RNA, 18 nt, Human
acaaaaaucucuccaagc

SEQ ID NO: 309278 - RNA, 20 nt, Human
acaaaaaucucuccaagcug

SEQ ID NO: 309279 - RNA, 20 nt, Human
accccaacacucacuccggc

SEQ ID NO: 309280 - RNA, 18 nt, Human
agaaaaaaaaaggaaaca

SEQ ID NO: 309281 - RNA, 24 nt, Human
agaaaaaaaaaggaaacaacuuaa

SEQ ID NO: 309282 - RNA, 21 nt, Human
agagaaacccgccggcccggg

SEQ ID NO: 309283 - RNA, 23 nt, Human
agagaaacccgccggcccggggc

SEQ ID NO: 309284 - RNA, 19 nt, Human
agagauggcaccguggugg

SEQ ID NO: 309285 - RNA, 19 nt, Human
agagcgagugggauuuaua

SEQ ID NO: 309286 - RNA, 18 nt, Human
agccugcugggagccuug

SEQ ID NO: 309287 - RNA, 19 nt, Human
aggaccccaacacucacuc

SEQ ID NO: 309288 - RNA, 18 nt, Human
aggugccccaggacccca

SEQ ID NO: 309289 - RNA, 25 nt, Human
auaaaauaaaaauaaaaagugcgcc

SEQ ID NO: 309290 - RNA, 21 nt, Human
aucaccauuuugguuccccag

SEQ ID NO: 309291 - RNA, 21 nt, Human
aucaggaugaggcugagcucc

SEQ ID NO: 309292 - RNA, 22 nt, Human
aucucuccaagcuguauuauua

SEQ ID NO: 309293 - RNA, 19 nt, Human
caaaaaagaaaaaaaaagg

SEQ ID NO: 309294 - RNA, 18 nt, Human
caaaaaucucuccaagcu

SEQ ID NO: 309295 - RNA, 20 nt, Human
caaaguagccugcugggagc

SEQ ID NO: 309296 - RNA, 22 nt, Human
caguagcaaaaaagaaaaaaaa

SEQ ID NO: 309297 - RNA, 23 nt, Human
caucagaggauguucaucagagg

SEQ ID NO: 309298 - RNA, 25 nt, Human
ccaacacucacuccggcugaccgcc

SEQ ID NO: 309299 - RNA, 19 nt, Human
ccaggaccccaacacucac

SEQ ID NO: 309300 - RNA, 31 nt, Human
ccucgcuccucaagcuucaacuucuucccuu

SEQ ID NO: 309301 - RNA, 23 nt, Human
cgagugggauuuauaaugugaua

SEQ ID NO: 309302 - RNA, 23 nt, Human
cguaacaccccacagcuugugua

SEQ ID NO: 309303 - RNA, 18 nt, Human
cguggcaaauauuuaucc

SEQ ID NO: 309304 - RNA, 22 nt, Human
gaucauccuagaucacagagga

SEQ ID NO: 309305 - RNA, 21 nt, Human
gccuggacucagccugugaag

SEQ ID NO: 309306 - RNA, 22 nt, Human
gccugggcagugcggguucugu

SEQ ID NO: 309307 - RNA, 26 nt, Human
gcucgccugggcagugcggguucugu

SEQ ID NO: 309308 - RNA, 19 nt, Human
ggcccggggcgcggcggcu

SEQ ID NO: 309309 - RNA, 20 nt, Human
gggaacaggggagcucgggg

SEQ ID NO: 309310 - RNA, 24 nt, Human
gggaacaggggagcucggggagaa

SEQ ID NO: 309311 - RNA, 21 nt, Human
guaacaccccacagcuugugu

SEQ ID NO: 309312 - RNA, 23 nt, Human
gugaagccccaaaaggaugcuaa

SEQ ID NO: 309313 - RNA, 21 nt, Human
gugcauagcccugcauacaca

SEQ ID NO: 309314 - RNA, 24 nt, Human
guuaaagagaugaaaaaucaaguu

SEQ ID NO: 309315 - RNA, 19 nt, Human
guuggggaugaacuguggc

SEQ ID NO: 309316 - RNA, 20 nt, Human
uaaacacaagcggggagugc

SEQ ID NO: 309317 - RNA, 23 nt, Human
uaaauaaacacccaagagcuuuu

SEQ ID NO: 309318 - RNA, 20 nt, Human
uaaugugauacaaaaaucuc

SEQ ID NO: 309319 - RNA, 23 nt, Human
uagcaaaaaagaaaaaaaaagga

SEQ ID NO: 309320 - RNA, 21 nt, Human
uaggguuggggaugaacugug

SEQ ID NO: 309321 - RNA, 22 nt, Human
ucaaaaccuucugucuggaccu

SEQ ID NO: 309322 - RNA, 23 nt, Human
ucaccauuuugguuccccagcau

SEQ ID NO: 309323 - RNA, 23 nt, Human
ucagugcuaagaaugugucaaaa

SEQ ID NO: 309324 - RNA, 20 nt, Human
uccauauuaugcaguaguua

SEQ ID NO: 309325 - RNA, 28 nt, Human
ucggggagaaagacacacauccuuuugc

SEQ ID NO: 309326 - RNA, 25 nt, Human
ugaagccccaaaaggaugcuaaaaa

SEQ ID NO: 309327 - RNA, 23 nt, Human
ugacaggaguuacucauucgugg

SEQ ID NO: 309328 - RNA, 18 nt, Human
ugaggcugagcuccccag

SEQ ID NO: 309329 - RNA, 25 nt, Human
ugcauacacaagagauggcaccgug

SEQ ID NO: 309330 - RNA, 22 nt, Human
ugcauacacacgugccugcagg

SEQ ID NO: 309331 - RNA, 18 nt, Human
ugcugggagccuugauca

SEQ ID NO: 309332 - RNA, 21 nt, Human
uggcucugagagugaagcccc

SEQ ID NO: 309333 - RNA, 20 nt, Human
uggcugugagcaagcagcug

SEQ ID NO: 309334 - RNA, 24 nt, Human
ugggagccuugaucaucagaggau

SEQ ID NO: 309335 - RNA, 20 nt, Human
uggugguuuucaaugaaggg

SEQ ID NO: 309336 - RNA, 23 nt, Human
uguaaggcaggugccccaggacc

SEQ ID NO: 309337 - RNA, 22 nt, Human
ugucccuuaaaaacuggcucug

SEQ ID NO: 309338 - RNA, 19 nt, Human
uguguaaacacaagcgggg

SEQ ID NO: 309339 - RNA, 21 nt, Human
uuaaagagaugaaaaaucaag

SEQ ID NO: 309340 - RNA, 28 nt, Human
uuaaauaaacacccaagagcuuuugcau

SEQ ID NO: 309341 - RNA, 24 nt, Human
uuauaguaacaaccaagccauaga

SEQ ID NO: 309342 - RNA, 22 nt, Human
uucaacuucuucccuuuaaugu

SEQ ID NO: 309343 - RNA, 20 nt, Human
uugguuccccagcaucaaaa

SEQ ID NO: 309344 - RNA, 22 nt, Human
uuguuagagaaacccgccggcc

SEQ ID NO: 309345 - RNA, 23 nt, Human
uuucaaugaaggggaacagggga

SEQ ID NO: 309346 - RNA, 19 nt, Human
uuuguuagagaaacccgcc

SEQ ID NO: 309347 - RNA, 22 nt, Human
uuuugcaauauuugaauucugu

SEQ ID NO: 309348 - RNA, 18 nt, Human
aaagauaaaaagcuggca

SEQ ID NO: 309349 - RNA, 24 nt, Human
aagcugauguggcaagcugcagau

SEQ ID NO: 309350 - RNA, 26 nt, Human
aagcugcagaucuagagguuguagca

SEQ ID NO: 309351 - RNA, 26 nt, Human
aaguggucgagagaaagauaaaaagc

SEQ ID NO: 309352 - RNA, 27 nt, Human
agaaacucuucuacucaggaagugguc

SEQ ID NO: 309353 - RNA, 21 nt, Human
agaccugaaaaauacuuagua

SEQ ID NO: 309354 - RNA, 21 nt, Human
agagaaagauaaaaagcuggc

SEQ ID NO: 309355 - RNA, 24 nt, Human
agaucuagagguuguagcagaacu

SEQ ID NO: 309356 - RNA, 21 nt, Human
aggaaguggucuguuauacaa

SEQ ID NO: 309357 - RNA, 21 nt, Human
auauaacacgcaaaauaugug

SEQ ID NO: 309358 - RNA, 19 nt, Human
auauuuggagagagaauuc

SEQ ID NO: 309359 - RNA, 19 nt, Human
auguacuagaauucuguga

SEQ ID NO: 309360 - RNA, 21 nt, Human
caaccugcaaaaucauucuga

SEQ ID NO: 309361 - RNA, 20 nt, Human
caagauccaacagaugaaua

SEQ ID NO: 309362 - RNA, 21 nt, Human
caguucucaucuguugaucau

SEQ ID NO: 309363 - RNA, 22 nt, Human
cauuuuauacacuuauuuugaa

SEQ ID NO: 309364 - RNA, 24 nt, Human
cgaauugucagcuccccuaacccc

SEQ ID NO: 309365 - RNA, 18 nt, Human
cuacagugccuuaaauga

SEQ ID NO: 309366 - RNA, 23 nt, Human
cucacugucacauauuaaccacc

SEQ ID NO: 309367 - RNA, 22 nt, Human
cuuacuuuuccauacuugauuc

SEQ ID NO: 309368 - RNA, 18 nt, Human
gaaagauaaaaagcuggc

SEQ ID NO: 309369 - RNA, 21 nt, Human
gcuggaauggaagacaaccug

SEQ ID NO: 309370 - RNA, 22 nt, Human
ggaauggaagacaaccugcaaa

SEQ ID NO: 309371 - RNA, 19 nt, Human
gucagcuccccuaaccccc

SEQ ID NO: 309372 - RNA, 20 nt, Human
gucuucuuuuagguagccuu

SEQ ID NO: 309373 - RNA, 20 nt, Human
uaaaagauguuaauguggca

SEQ ID NO: 309374 - RNA, 20 nt, Human
uaaaugaagauuagauucug

SEQ ID NO: 309375 - RNA, 23 nt, Human
uacauguacuagaauucugugau

SEQ ID NO: 309376 - RNA, 24 nt, Human
uagaaaaaauacaauuucuguuuu

SEQ ID NO: 309377 - RNA, 24 nt, Human
uagauguaauagaugggccaacaa

SEQ ID NO: 309378 - RNA, 20 nt, Human
uagauucugauaguuacuac

SEQ ID NO: 309379 - RNA, 20 nt, Human
uagguaacucuagcucagau

SEQ ID NO: 309380 - RNA, 18 nt, Human
ugaggagucaguggacua

SEQ ID NO: 309381 - RNA, 25 nt, Human
ugcggacccacgaauugucagcucc

SEQ ID NO: 309382 - RNA, 22 nt, Human
uggaagacaaccugcaaaauca

SEQ ID NO: 309383 - RNA, 25 nt, Human
uggaauggaagacaaccugcaaaau

SEQ ID NO: 309384 - RNA, 22 nt, Human
ugguaagcuagguaacucuagc

SEQ ID NO: 309385 - RNA, 20 nt, Human
uguucaagggucagcuguag

SEQ ID NO: 309386 - RNA, 18 nt, Human
uuaagauuuugcggaccc

SEQ ID NO: 309387 - RNA, 23 nt, Human
uugauacuuggugaagaccugaa

SEQ ID NO: 309388 - RNA, 22 nt, Human
uuggcagcugugaucaucacag

SEQ ID NO: 309389 - RNA, 22 nt, Human
uuucuaaauaacauuuucucua

SEQ ID NO: 309390 - RNA, 21 nt, Human
aaaacuugaagcagaaguccc

SEQ ID NO: 309391 - RNA, 22 nt, Human
aaagaagaaagguccaagaggg

SEQ ID NO: 309392 - RNA, 23 nt, Human
aacuugaagcagaagucccuggu

SEQ ID NO: 309393 - RNA, 23 nt, Human
aagagcaaugggaagucaacagc

SEQ ID NO: 309394 - RNA, 22 nt, Human
aagucccuggugcaacaccugu

SEQ ID NO: 309395 - RNA, 24 nt, Human
accacggagagccccagccauaaa

SEQ ID NO: 309396 - RNA, 22 nt, Human
agaacaccacggagagccccag

SEQ ID NO: 309397 - RNA, 19 nt, Human
aggcauccaggacagggug

SEQ ID NO: 309398 - RNA, 21 nt, Human
agggggccuugguuuuucagg

SEQ ID NO: 309399 - RNA, 23 nt, Human
aggugggggaagggggccuuggu

SEQ ID NO: 309400 - RNA, 21 nt, Human
aguggcugucuccaggggacu

SEQ ID NO: 309401 - RNA, 20 nt, Human
caaaacuugaagcagaaguc

SEQ ID NO: 309402 - RNA, 21 nt, Human
caaaacuugaagcagaagucc

SEQ ID NO: 309403 - RNA, 23 nt, Human
cacagaugccucuucugucuccc

SEQ ID NO: 309404 - RNA, 18 nt, Human
cacuccccuccccacagg

SEQ ID NO: 309405 - RNA, 21 nt, Human
ccacggagagccccagccaua

SEQ ID NO: 309406 - RNA, 25 nt, Human
ccaggguaaagcgacccauugaaaa

SEQ ID NO: 309407 - RNA, 18 nt, Human
cccacaggcaaguagaag

SEQ ID NO: 309408 - RNA, 18 nt, Human
cccuggugcaacaccugu

SEQ ID NO: 309409 - RNA, 22 nt, Human
ccugggaccccgaggucccaga

SEQ ID NO: 309410 - RNA, 18 nt, Human
ccugugccugggagaagc

SEQ ID NO: 309411 - RNA, 22 nt, Human
cgacccauugaaaacaggaucc

SEQ ID NO: 309412 - RNA, 21 nt, Human
cuacaaagcaguaaaagugaa

SEQ ID NO: 309413 - RNA, 18 nt, Human
cucccaagagguucucug

SEQ ID NO: 309414 - RNA, 24 nt, Human
cucccugucagucccaggguaaag

SEQ ID NO: 309415 - RNA, 19 nt, Human
cucucaugaccagccaugg

SEQ ID NO: 309416 - RNA, 20 nt, Human
cucucuucagaggcauccag

SEQ ID NO: 309417 - RNA, 20 nt, Human
cuggugcaacaccugugccu

SEQ ID NO: 309418 - RNA, 18 nt, Human
gccugggagaagcucugg

SEQ ID NO: 309419 - RNA, 21 nt, Human
ggagagccccagccauaaagg

SEQ ID NO: 309420 - RNA, 22 nt, Human
ggggacuacgguuugcucucau

SEQ ID NO: 309421 - RNA, 19 nt, Human
ggggccuugguuuuucagg

SEQ ID NO: 309422 - RNA, 22 nt, Human
guaaagcgacccauugaaaaca

SEQ ID NO: 309423 - RNA, 23 nt, Human
uaaagcgacccauugaaaacagg

SEQ ID NO: 309424 - RNA, 20 nt, Human
uaccccaaaacuugaagcag

SEQ ID NO: 309425 - RNA, 24 nt, Human
uaccccaaaacuugaagcagaagu

SEQ ID NO: 309426 - RNA, 23 nt, Human
ucacccagacagucuuucugggc

SEQ ID NO: 309427 - RNA, 22 nt, Human
ucagggcagcccuuggagucug

SEQ ID NO: 309428 - RNA, 22 nt, Human
uccagaacaccacggagagccc

SEQ ID NO: 309429 - RNA, 24 nt, Human
uccaggugucuuuaccccaaaacu

SEQ ID NO: 309430 - RNA, 18 nt, Human
ucccagaggcugcugggc

SEQ ID NO: 309431 - RNA, 18 nt, Human
ucccaggguaaagcgacc

SEQ ID NO: 309432 - RNA, 22 nt, Human
uccccacaggcaaguagaagau

SEQ ID NO: 309433 - RNA, 23 nt, Human
ucccugggaccccgaggucccag

SEQ ID NO: 309434 - RNA, 27 nt, Human
ucccugggaccccgaggucccagaggc

SEQ ID NO: 309435 - RNA, 21 nt, Human
ucccuggugcaacaccugugc

SEQ ID NO: 309436 - RNA, 19 nt, Human
ucuccaggggacuacgguu

SEQ ID NO: 309437 - RNA, 18 nt, Human
ucugacggucugucccuc

SEQ ID NO: 309438 - RNA, 20 nt, Human
ucugucccucucuucagagg

SEQ ID NO: 309439 - RNA, 20 nt, Human
ugaaaacaggauccucauuc

SEQ ID NO: 309440 - RNA, 18 nt, Human
uggaagaggugggggaag

SEQ ID NO: 309441 - RNA, 21 nt, Human
uggagagcacgagucacuaca

SEQ ID NO: 309442 - RNA, 22 nt, Human
ugggaagucaacagccaggagg

SEQ ID NO: 309443 - RNA, 18 nt, Human
ugggggacgaucggccgc

SEQ ID NO: 309444 - RNA, 19 nt, Human
uggugucuccaggggcugg

SEQ ID NO: 309445 - RNA, 19 nt, Human
ugguguguggaccugucac

SEQ ID NO: 309446 - RNA, 19 nt, Human
ugguugucggcaaagaaga

SEQ ID NO: 309447 - RNA, 19 nt, Human
ugucacuccccuccccaca

SEQ ID NO: 309448 - RNA, 18 nt, Human
ugugccugggagaagcuc

SEQ ID NO: 309449 - RNA, 23 nt, Human
uucccugggaccccgagguccca

SEQ ID NO: 309450 - RNA, 19 nt, Human
aaaaaaaaaccuauuugac

SEQ ID NO: 309451 - RNA, 22 nt, Human
aaaaaaaccuauuugacuuaag

SEQ ID NO: 309452 - RNA, 22 nt, Human
aaaauaaucugccuuccaauca

SEQ ID NO: 309453 - RNA, 23 nt, Human
aaacauaggguuugauuuuuaau

SEQ ID NO: 309454 - RNA, 24 nt, Human
aaacggaagaagcaaggcucaaca

SEQ ID NO: 309455 - RNA, 20 nt, Human
aaagcaaauaacccuccccc

SEQ ID NO: 309456 - RNA, 21 nt, Human
aaagggcaaaacggaagaagc

SEQ ID NO: 309457 - RNA, 22 nt, Human
aaauaacccuccccccaaaaaa

SEQ ID NO: 309458 - RNA, 22 nt, Human
aaccaccaacaaaaaaaaaccu

SEQ ID NO: 309459 - RNA, 24 nt, Human
aagcaaauaacccuccccccaaaa

SEQ ID NO: 309460 - RNA, 21 nt, Human
aagcaagcacaaccaccaaca

SEQ ID NO: 309461 - RNA, 23 nt, Human
aagcaagcacaaccaccaacaaa

SEQ ID NO: 309462 - RNA, 24 nt, Human
aaggaaagcaagcacaaccaccaa

SEQ ID NO: 309463 - RNA, 19 nt, Human
aauggaaagguuuucuaaa

SEQ ID NO: 309464 - RNA, 21 nt, Human
acaucaagucaacaaguauuu

SEQ ID NO: 309465 - RNA, 28 nt, Human
accaccaacaaaaaaaaaccuauuugac

SEQ ID NO: 309466 - RNA, 23 nt, Human
acgcuccucgguuguguuuugua

SEQ ID NO: 309467 - RNA, 22 nt, Human
agacacucagaagaauaaaaug

SEQ ID NO: 309468 - RNA, 25 nt, Human
agcaaauaacccuccccccaaaaaa

SEQ ID NO: 309469 - RNA, 23 nt, Human
agcacaaccaccaacaaaaaaaa

SEQ ID NO: 309470 - RNA, 22 nt, Human
aggagcgagacaaagggcaaaa

SEQ ID NO: 309471 - RNA, 22 nt, Human
agggcaaaacggaagaagcaag

SEQ ID NO: 309472 - RNA, 22 nt, Human
aucaauuugaaacacaaauuca

SEQ ID NO: 309473 - RNA, 19 nt, Human
aucugaaagaaacauaggg

SEQ ID NO: 309474 - RNA, 20 nt, Human
auuuugucuacauuuccucu

SEQ ID NO: 309475 - RNA, 23 nt, Human
caagcacaaccaccaacaaaaaa

SEQ ID NO: 309476 - RNA, 18 nt, Human
caucugaaagaaacauag

SEQ ID NO: 309477 - RNA, 18 nt, Human
caugccagucauucaccc

SEQ ID NO: 309478 - RNA, 21 nt, Human
ccaccaacaaaaaaaaaccua

SEQ ID NO: 309479 - RNA, 19 nt, Human
ccccccaaaaaagaauaag

SEQ ID NO: 309480 - RNA, 26 nt, Human
ccucucaucuucucagccacaacuuc

SEQ ID NO: 309481 - RNA, 21 nt, Human
cucagaagaauaaaauggaaa

SEQ ID NO: 309482 - RNA, 22 nt, Human
cuccucgguuguguuuuguacc

SEQ ID NO: 309483 - RNA, 22 nt, Human
cucucaucuucucagccacaac

SEQ ID NO: 309484 - RNA, 23 nt, Human
cuuuacauuaaaaacaguagcua

SEQ ID NO: 309485 - RNA, 24 nt, Human
gaccugcauagguguucagaaaua

SEQ ID NO: 309486 - RNA, 19 nt, Human
gcaaaacggaagaagcaag

SEQ ID NO: 309487 - RNA, 19 nt, Human
gcaaauaacccucccccca

SEQ ID NO: 309488 - RNA, 22 nt, Human
gcaagcacaaccaccaacaaaa

SEQ ID NO: 309489 - RNA, 25 nt, Human
gcacaaccaccaacaaaaaaaaacc

SEQ ID NO: 309490 - RNA, 28 nt, Human
gcacaaccaccaacaaaaagggaacgcc

SEQ ID NO: 309491 - RNA, 23 nt, Human
gcgagacaaagggcaaaacggaa

SEQ ID NO: 309492 - RNA, 23 nt, Human
gcuacaauaaggauauuucaacc

SEQ ID NO: 309493 - RNA, 23 nt, Human
ggaaagcaagcacaaccaccaac

SEQ ID NO: 309494 - RNA, 20 nt, Human
ggagcgagacaaagggcaaa

SEQ ID NO: 309495 - RNA, 19 nt, Human
uaaaauggaaauuaugcca

SEQ ID NO: 309496 - RNA, 23 nt, Human
uaacacuguaaauaagaccugca

SEQ ID NO: 309497 - RNA, 23 nt, Human
uaagaaauaucaaacaauuuuuu

SEQ ID NO: 309498 - RNA, 23 nt, Human
uacauuaaaaacaguagcuacaa

SEQ ID NO: 309499 - RNA, 24 nt, Human
uacauuaaaaacaguagcuacaau

SEQ ID NO: 309500 - RNA, 21 nt, Human
uaugccaggaagauaaaaaag

SEQ ID NO: 309501 - RNA, 23 nt, Human
uaugccaggaagauaaaaaagca

SEQ ID NO: 309502 - RNA, 18 nt, Human
uauuccucucaucuucuc

SEQ ID NO: 309503 - RNA, 23 nt, Human
ucauucacccaaaauaaauuuca

SEQ ID NO: 309504 - RNA, 25 nt, Human
ucgguuguguuuuguaccauuuucu

SEQ ID NO: 309505 - RNA, 18 nt, Human
ucguuuuccuauuuucua

SEQ ID NO: 309506 - RNA, 20 nt, Human
ucuguguuuuaaggcucaga

SEQ ID NO: 309507 - RNA, 19 nt, Human
ucuucuucaaucuguguuu

SEQ ID NO: 309508 - RNA, 21 nt, Human
ucuuucuuuucuucuucaauc

SEQ ID NO: 309509 - RNA, 26 nt, Human
ugaggaaaacguuguguaauucuuug

SEQ ID NO: 309510 - RNA, 20 nt, Human
ugauaaaacaucaagucaac

SEQ ID NO: 309511 - RNA, 19 nt, Human
uucaagguuuuacaacaug

SEQ ID NO: 309512 - RNA, 25 nt, Human
uuguguguucccuuaguaacacugu

SEQ ID NO: 309513 - RNA, 23 nt, Human
uuuaaauauuccucucaucuucu

SEQ ID NO: 309514 - RNA, 21 nt, Human
uuuggaagauucaucugaaag

SEQ ID NO: 309515 - RNA, 30 nt, Human
aaaaaaaggcguauccggaggcuacagaaa

SEQ ID NO: 309516 - RNA, 20 nt, Human
aaggugacauauucaguuca

SEQ ID NO: 309517 - RNA, 19 nt, Human
acagaaagcuccagaugcc

SEQ ID NO: 309518 - RNA, 20 nt, Human
agacccaucccccaacuccc

SEQ ID NO: 309519 - RNA, 20 nt, Human
agagacccaucccccaacuc

SEQ ID NO: 309520 - RNA, 18 nt, Human
aggcggggacuccgggag

SEQ ID NO: 309521 - RNA, 20 nt, Human
auggcagggcagguuuggca

SEQ ID NO: 309522 - RNA, 22 nt, Human
cacgcggggaguccccagaagc

SEQ ID NO: 309523 - RNA, 23 nt, Human
cagcacccaggauccugggaucu

SEQ ID NO: 309524 - RNA, 18 nt, Human
caggacgggggccaggcc

SEQ ID NO: 309525 - RNA, 21 nt, Human
caggcccccuaaaaaggcaca

SEQ ID NO: 309526 - RNA, 20 nt, Human
cauguggaagcccucgugcc

SEQ ID NO: 309527 - RNA, 23 nt, Human
ccaacucccaggacgggggccag

SEQ ID NO: 309528 - RNA, 21 nt, Human
ccagaagcccugugcccacga

SEQ ID NO: 309529 - RNA, 19 nt, Human
ccccagaagcccugugccc

SEQ ID NO: 309530 - RNA, 24 nt, Human
ccccagaagcccugugcccacgaa

SEQ ID NO: 309531 - RNA, 23 nt, Human
cccccuaaaaaggcacaauggca

SEQ ID NO: 309532 - RNA, 18 nt, Human
cccugugcccacgaaccc

SEQ ID NO: 309533 - RNA, 18 nt, Human
cccugugcccacgaaccc

SEQ ID NO: 309534 - RNA, 20 nt, Human
ccggaaagggggcgcucggg

SEQ ID NO: 309535 - RNA, 20 nt, Human
ccggcgccacagacaaggcg

SEQ ID NO: 309536 - RNA, 26 nt, Human
cgcccugaaaaaaaggcguauccgga

SEQ ID NO: 309537 - RNA, 19 nt, Human
cuacgcccugaaaaaaagg

SEQ ID NO: 309538 - RNA, 18 nt, Human
cucugggcugagccagcc

SEQ ID NO: 309539 - RNA, 19 nt, Human
cuggaucccagcuccggag

SEQ ID NO: 309540 - RNA, 21 nt, Human
gacagagagacccauccccca

SEQ ID NO: 309541 - RNA, 18 nt, Human
gaggcgggggaggggcgg

SEQ ID NO: 309542 - RNA, 18 nt, Human
gaggggcggcggcucggg

SEQ ID NO: 309543 - RNA, 22 nt, Human
gcccugugcccacgaaccccug

SEQ ID NO: 309544 - RNA, 20 nt, Human
ggaggagagaggcggggacu

SEQ ID NO: 309545 - RNA, 20 nt, Human
ggcggaggagagaggcgggg

SEQ ID NO: 309546 - RNA, 19 nt, Human
gggccggcgggcgggagac

SEQ ID NO: 309547 - RNA, 18 nt, Human
gggcugagccagccgcuu

SEQ ID NO: 309548 - RNA, 21 nt, Human
gguggggagcgggcccagaca

SEQ ID NO: 309549 - RNA, 23 nt, Human
uaaaaaggcacaauggcagggca

SEQ ID NO: 309550 - RNA, 24 nt, Human
uaucacgcggggaguccccagaag

SEQ ID NO: 309551 - RNA, 19 nt, Human
uauucaguucaggcacgcg

SEQ ID NO: 309552 - RNA, 20 nt, Human
uccccagaagcccugugccc

SEQ ID NO: 309553 - RNA, 24 nt, Human
ucccccaacucccaggacgggggc

SEQ ID NO: 309554 - RNA, 21 nt, Human
uccggaggcuacagaaagcuc

SEQ ID NO: 309555 - RNA, 21 nt, Human
ugcccacgaaccccugugggc

SEQ ID NO: 309556 - RNA, 18 nt, Human
ugcggaacauuaauaauu

SEQ ID NO: 309557 - RNA, 18 nt, Human
ugucccgggcgcacggga

SEQ ID NO: 309558 - RNA, 19 nt, Human
uuuggcagagugguugagu

SEQ ID NO: 309559 - RNA, 24 nt, Human
aaaucuaacuccccacuucccuca

SEQ ID NO: 309560 - RNA, 23 nt, Human
aaccaccacccacaccgaggaga

SEQ ID NO: 309561 - RNA, 22 nt, Human
acacacauaugguggccacacc

SEQ ID NO: 309562 - RNA, 21 nt, Human
agggggugggaguuggucugc

SEQ ID NO: 309563 - RNA, 22 nt, Human
auguuguuguugggguggggag

SEQ ID NO: 309564 - RNA, 19 nt, Human
caaccuagggccuggacuc

SEQ ID NO: 309565 - RNA, 24 nt, Human
cacuuuuaccucaaagagggggug

SEQ ID NO: 309566 - RNA, 19 nt, Human
cccucuauagaaccaccac

SEQ ID NO: 309567 - RNA, 20 nt, Human
ccucuauagaaccaccaccc

SEQ ID NO: 309568 - RNA, 24 nt, Human
cuaggcacacacauaugguggcca

SEQ ID NO: 309569 - RNA, 20 nt, Human
cuugcucgugguuucgagga

SEQ ID NO: 309570 - RNA, 27 nt, Human
ggagugggucccaaccuagggccugga

SEQ ID NO: 309571 - RNA, 19 nt, Human
uaacaauguuuauuauuca

SEQ ID NO: 309572 - RNA, 19 nt, Human
uaacuccccacuucccuca

SEQ ID NO: 309573 - RNA, 22 nt, Human
uaccucaaagagggggugggag

SEQ ID NO: 309574 - RNA, 23 nt, Human
uaggcacacacauaugguggcca

SEQ ID NO: 309575 - RNA, 24 nt, Human
uaugguggccacacccaggagggu

SEQ ID NO: 309576 - RNA, 21 nt, Human
ucccaaccuagggccuggacu

SEQ ID NO: 309577 - RNA, 22 nt, Human
ucccaauaaaggcacuuuuacc

SEQ ID NO: 309578 - RNA, 23 nt, Human
ucugaaaucuaacuccccacuuc

SEQ ID NO: 309579 - RNA, 22 nt, Human
uggacucugaaaucuaacuccc

SEQ ID NO: 309580 - RNA, 21 nt, Human
uggagugggucccaaccuagg

SEQ ID NO: 309581 - RNA, 18 nt, Human
ugguggccacacccagga

SEQ ID NO: 309582 - RNA, 23 nt, Human
ugguggccacacccaggaggguu

SEQ ID NO: 309583 - RNA, 19 nt, Human
uugcagagagaaaugaggg

SEQ ID NO: 309584 - RNA, 19 nt, Human
aaaauaguccaagcuguag

SEQ ID NO: 309585 - RNA, 24 nt, Human
aagcaaauaaaaggauuaaacugg

SEQ ID NO: 309586 - RNA, 25 nt, Human
aauacaauggugaaaaaaaaucaga

SEQ ID NO: 309587 - RNA, 22 nt, Human
acaguauagaaacuuacagaaa

SEQ ID NO: 309588 - RNA, 22 nt, Human
acauaucucucuaauaacaucc

SEQ ID NO: 309589 - RNA, 19 nt, Human
agaauccuguaaacuguga

SEQ ID NO: 309590 - RNA, 19 nt, Human
augaagcuaacaggacagu

SEQ ID NO: 309591 - RNA, 22 nt, Human
cacaccaaaaaaaucaaaccac

SEQ ID NO: 309592 - RNA, 20 nt, Human
cacagcagaaccugcaaaaa

SEQ ID NO: 309593 - RNA, 19 nt, Human
cacauuucacagcagaacc

SEQ ID NO: 309594 - RNA, 26 nt, Human
caccaaaaaaaucaaaccacauuuca

SEQ ID NO: 309595 - RNA, 20 nt, Human
cagaaaaacaauucagaaga

SEQ ID NO: 309596 - RNA, 24 nt, Human
cagcauaucuugggauguucuagc

SEQ ID NO: 309597 - RNA, 19 nt, Human
cauaccacuuaugaaaagc

SEQ ID NO: 309598 - RNA, 20 nt, Human
cuaaauuauauagggcuucu

SEQ ID NO: 309599 - RNA, 21 nt, Human
cuauuaucuguaucaguuggu

SEQ ID NO: 309600 - RNA, 18 nt, Human
gaaaauacucuacauuga

SEQ ID NO: 309601 - RNA, 18 nt, Human
gaaguccagaaaaacaau

SEQ ID NO: 309602 - RNA, 19 nt, Human
gacuauaugcacauucaaa

SEQ ID NO: 309603 - RNA, 24 nt, Human
gagaaaaagaacacccuaaagugc

SEQ ID NO: 309604 - RNA, 24 nt, Human
gcagaaauggacuaaugcuaaaaa

SEQ ID NO: 309605 - RNA, 22 nt, Human
ggaaagaaaucucuuuuguaga

SEQ ID NO: 309606 - RNA, 18 nt, Human
ggggaaaauacugauggu

SEQ ID NO: 309607 - RNA, 21 nt, Human
ggugaaaaaaaaucagaggga

SEQ ID NO: 309608 - RNA, 21 nt, Human
guccagaaaaacaauucagaa

SEQ ID NO: 309609 - RNA, 22 nt, Human
guggaagauggagaaaguagau

SEQ ID NO: 309610 - RNA, 23 nt, Human
uaaaaaagaaugauuuagucuug

SEQ ID NO: 309611 - RNA, 23 nt, Human
uaaaagagcaagaacauaucuua

SEQ ID NO: 309612 - RNA, 20 nt, Human
uaaaaggauuaaacuggauu

SEQ ID NO: 309613 - RNA, 22 nt, Human
uaaaguaucaauguaguuaaaa

SEQ ID NO: 309614 - RNA, 25 nt, Human
uaacuguguuacccaaaaaggcuga

SEQ ID NO: 309615 - RNA, 20 nt, Human
uaacuuaguaaauacaaugg

SEQ ID NO: 309616 - RNA, 24 nt, Human
uaauaaacaauucuggucaccaua

SEQ ID NO: 309617 - RNA, 22 nt, Human
uaauacgacuuuuaagcaacaa

SEQ ID NO: 309618 - RNA, 23 nt, Human
uacaauauguuuaauguggcaga

SEQ ID NO: 309619 - RNA, 19 nt, Human
uacacagcauuuuuauuaa

SEQ ID NO: 309620 - RNA, 21 nt, Human
uacgacuuuuaagcaacaaaa

SEQ ID NO: 309621 - RNA, 19 nt, Human
uagacuacucauucacacu

SEQ ID NO: 309622 - RNA, 22 nt, Human
uagcagcagaaauggacuaaug

SEQ ID NO: 309623 - RNA, 19 nt, Human
uagcuuuauguuacuuucu

SEQ ID NO: 309624 - RNA, 19 nt, Human
uauaaaaagaaaucuuaau

SEQ ID NO: 309625 - RNA, 18 nt, Human
uauauaugcacacauauc

SEQ ID NO: 309626 - RNA, 19 nt, Human
uaucaguugguaaauuaac

SEQ ID NO: 309627 - RNA, 21 nt, Human
ucuaauaacauccuaccaaca

SEQ ID NO: 309628 - RNA, 21 nt, Human
ugaaaaacauaugaaaauacu

SEQ ID NO: 309629 - RNA, 23 nt, Human
ugaaaauacucuacauugaauac

SEQ ID NO: 309630 - RNA, 20 nt, Human
ugaagcuaacaggacagugu

SEQ ID NO: 309631 - RNA, 23 nt, Human
ugacauuuuuguugcacaacagu

SEQ ID NO: 309632 - RNA, 23 nt, Human
ugagaaaaagaacacccuaaagu

SEQ ID NO: 309633 - RNA, 19 nt, Human
ugagauuuggaaguccaga

SEQ ID NO: 309634 - RNA, 21 nt, Human
ugcuaaaaauuuagaaaaaaa

SEQ ID NO: 309635 - RNA, 22 nt, Human
uggaaggggucaaaugacuaua

SEQ ID NO: 309636 - RNA, 23 nt, Human
uggaaguccagaaaaacaauuca

SEQ ID NO: 309637 - RNA, 19 nt, Human
uggagaaaguagauuucug

SEQ ID NO: 309638 - RNA, 23 nt, Human
uggcugaaugaccaauuaaacau

SEQ ID NO: 309639 - RNA, 20 nt, Human
uggugaaaaaaaaucagagg

SEQ ID NO: 309640 - RNA, 18 nt, Human
ugguuggcugaaugacca

SEQ ID NO: 309641 - RNA, 21 nt, Human
uguggcagaaaaucauaugaa

SEQ ID NO: 309642 - RNA, 22 nt, Human
uguuuggcuacaaguauuugga

SEQ ID NO: 309643 - RNA, 18 nt, Human
uuaacuguguuacccaaa

SEQ ID NO: 309644 - RNA, 20 nt, Human
uuaaucuuaagaaaacaauc

SEQ ID NO: 309645 - RNA, 28 nt, Human
uuaaucuuaagaaaacaaucaucaaaaa

SEQ ID NO: 309646 - RNA, 21 nt, Human
uucaaaaugaauacuuauaaa

SEQ ID NO: 309647 - RNA, 21 nt, Human
uugaaccauaaaaaagaauga

SEQ ID NO: 309648 - RNA, 22 nt, Human
aaaaugaaaaguccuuugaaug

SEQ ID NO: 309649 - RNA, 24 nt, Human
aaacagcuugacaaagcaagagua

SEQ ID NO: 309650 - RNA, 25 nt, Human
aaagaauacuguaaaaagauacugu

SEQ ID NO: 309651 - RNA, 20 nt, Human
aacccuuuccccugaggcuc

SEQ ID NO: 309652 - RNA, 23 nt, Human
aagaacuagcauacuggauggaa

SEQ ID NO: 309653 - RNA, 23 nt, Human
aagcaagucccaagagagggaca

SEQ ID NO: 309654 - RNA, 21 nt, Human
aagcacuucaccugggaaaua

SEQ ID NO: 309655 - RNA, 19 nt, Human
aauaccuuggaaacuauag

SEQ ID NO: 309656 - RNA, 24 nt, Human
aaugucaagggcagcauucuagga

SEQ ID NO: 309657 - RNA, 25 nt, Human
acaaagcaagaguacauuaauuccu

SEQ ID NO: 309658 - RNA, 21 nt, Human
acuguacuuaagaauaaaaga

SEQ ID NO: 309659 - RNA, 21 nt, Human
acuugaagaccccuuaaaaaa

SEQ ID NO: 309660 - RNA, 21 nt, Human
agaaagaauacuguaaaaaga

SEQ ID NO: 309661 - RNA, 20 nt, Human
agagagagaguuugaugaua

SEQ ID NO: 309662 - RNA, 21 nt, Human
agucgcagaguccugggucug

SEQ ID NO: 309663 - RNA, 24 nt, Human
caguacuacaaagauaagcaaagg

SEQ ID NO: 309664 - RNA, 21 nt, Human
cauucugcacagccaguuacu

SEQ ID NO: 309665 - RNA, 22 nt, Human
ccccugaggcucucaugauaag

SEQ ID NO: 309666 - RNA, 18 nt, Human
ccuuaagccauaagcacu

SEQ ID NO: 309667 - RNA, 21 nt, Human
ccuuugaauggccaagaguuc

SEQ ID NO: 309668 - RNA, 24 nt, Human
cuagcauacuggauggaaagcaaa

SEQ ID NO: 309669 - RNA, 21 nt, Human
cugaccugcgaaucaugcacc

SEQ ID NO: 309670 - RNA, 22 nt, Human
cugccgccgaccaacccacuca

SEQ ID NO: 309671 - RNA, 19 nt, Human
gcaaaagauaacagagcaa

SEQ ID NO: 309672 - RNA, 21 nt, Human
guccugggucuggcccgacug

SEQ ID NO: 309673 - RNA, 19 nt, Human
uacaaagauaagcaaagga

SEQ ID NO: 309674 - RNA, 21 nt, Human
uagcugaccugcgaaucaugc

SEQ ID NO: 309675 - RNA, 19 nt, Human
uauccaaauacgcucugac

SEQ ID NO: 309676 - RNA, 22 nt, Human
ucaaaaugaaaaguccuuugaa

SEQ ID NO: 309677 - RNA, 23 nt, Human
ucagcagucuuguuuaauauaau

SEQ ID NO: 309678 - RNA, 24 nt, Human
ucuccucaaaaguaucauauucaa

SEQ ID NO: 309679 - RNA, 18 nt, Human
ucuucuagcuacgaugua

SEQ ID NO: 309680 - RNA, 21 nt, Human
ugaccugcgaaucaugcaccu

SEQ ID NO: 309681 - RNA, 19 nt, Human
ugccugacaaauucaacuc

SEQ ID NO: 309682 - RNA, 19 nt, Human
uggcuaugagcacauuuca

SEQ ID NO: 309683 - RNA, 21 nt, Human
ugggaaauagcugaccugcga

SEQ ID NO: 309684 - RNA, 25 nt, Human
ugggaaauagcugaccugcgaauca

SEQ ID NO: 309685 - RNA, 22 nt, Human
uucuucuagcuacgauguaugu

SEQ ID NO: 309686 - RNA, 23 nt, Human
aaaaauuaauaaggccuuaguua

SEQ ID NO: 309687 - RNA, 18 nt, Human
aaaaguauacaaccagag

SEQ ID NO: 309688 - RNA, 19 nt, Human
aaagcaaaaguauacaacc

SEQ ID NO: 309689 - RNA, 24 nt, Human
aaccagagcuacaggccuuacagc

SEQ ID NO: 309690 - RNA, 22 nt, Human
aagcaaaaguauacaaccagag

SEQ ID NO: 309691 - RNA, 23 nt, Human
aaugaguauuaaaaaauguacaa

SEQ ID NO: 309692 - RNA, 18 nt, Human
acagcuuaauucauacag

SEQ ID NO: 309693 - RNA, 23 nt, Human
accagagcuacaggccuuacagc

SEQ ID NO: 309694 - RNA, 19 nt, Human
agauuuccugaggagacuu

SEQ ID NO: 309695 - RNA, 24 nt, Human
augauuucuugaagauuaaaaaaa

SEQ ID NO: 309696 - RNA, 19 nt, Human
caagguccagagagccggg

SEQ ID NO: 309697 - RNA, 19 nt, Human
ccagaguuuuagagugaag

SEQ ID NO: 309698 - RNA, 21 nt, Human
cggcuccugguuucguuuccu

SEQ ID NO: 309699 - RNA, 24 nt, Human
cggggccaggcgauggcuuccucu

SEQ ID NO: 309700 - RNA, 18 nt, Human
cugccgggcacagcugug

SEQ ID NO: 309701 - RNA, 19 nt, Human
cugcgccucuagacugccg

SEQ ID NO: 309702 - RNA, 24 nt, Human
cuuugcgccaacacccgcggcucc

SEQ ID NO: 309703 - RNA, 21 nt, Human
gagccggggccaggcgauggc

SEQ ID NO: 309704 - RNA, 20 nt, Human
gcaugaaauaaauuguaacu

SEQ ID NO: 309705 - RNA, 22 nt, Human
gcgagacaagguccagagagcc

SEQ ID NO: 309706 - RNA, 22 nt, Human
uaaaauggacaaugaaucaacu

SEQ ID NO: 309707 - RNA, 20 nt, Human
uaauaguaaagaaaauuauc

SEQ ID NO: 309708 - RNA, 21 nt, Human
uaggagaaguuaaguguagca

SEQ ID NO: 309709 - RNA, 20 nt, Human
uaguaaagaaaauuaucuuu

SEQ ID NO: 309710 - RNA, 21 nt, Human
ucuaauagaucauuauuuagg

SEQ ID NO: 309711 - RNA, 23 nt, Human
ucuaggaaggauagaguguaaga

SEQ ID NO: 309712 - RNA, 23 nt, Human
ucucuggcugccgcuguuuccgc

SEQ ID NO: 309713 - RNA, 20 nt, Human
ucuuugagcuuuuuugaaua

SEQ ID NO: 309714 - RNA, 19 nt, Human
ugaaaagcaaaaguauaca

SEQ ID NO: 309715 - RNA, 22 nt, Human
ugaaucagagaucauaauucaa

SEQ ID NO: 309716 - RNA, 27 nt, Human
uggcauuugcaaaauaacauuagcucu

SEQ ID NO: 309717 - RNA, 24 nt, Human
ugugaauauauauaugauauugua

SEQ ID NO: 309718 - RNA, 24 nt, Human
uuaaaaaauguacaaaaaccuuua

SEQ ID NO: 309719 - RNA, 22 nt, Human
uugaagauuaaaaaaacauuua

SEQ ID NO: 309720 - RNA, 23 nt, Human
uuuagguuuauacucugugaaua

SEQ ID NO: 309721 - RNA, 21 nt, Human
agaggggcugagagggguugg

SEQ ID NO: 309722 - RNA, 20 nt, Human
auccgggcgacggcggccac

SEQ ID NO: 309723 - RNA, 19 nt, Human
augugggaaaagaggggcu

SEQ ID NO: 309724 - RNA, 24 nt, Human
cagcucaggggauccgggcgacgg

SEQ ID NO: 309725 - RNA, 22 nt, Human
ccugaaugacagcugccagcuu

SEQ ID NO: 309726 - RNA, 22 nt, Human
cuaugaaugugggaaaagaggg

SEQ ID NO: 309727 - RNA, 22 nt, Human
gagagggguugggguccugaau

SEQ ID NO: 309728 - RNA, 21 nt, Human
gggggcggcgcggucacgugg

SEQ ID NO: 309729 - RNA, 19 nt, Human
uccugaaugacagcugcca

SEQ ID NO: 309730 - RNA, 18 nt, Human
ucucuguggcacuggggg

SEQ ID NO: 309731 - RNA, 24 nt, Human
ugaaugugggaaaagaggggcuga

SEQ ID NO: 309732 - RNA, 24 nt, Human
ugggaaaagaggggcugagagggg

SEQ ID NO: 309733 - RNA, 18 nt, Human
ugggauggcgggcagcuc

SEQ ID NO: 309734 - RNA, 18 nt, Human
ugugggaaaagaggggcu

SEQ ID NO: 309735 - RNA, 21 nt, Human
aaacaguccccagauguccca

SEQ ID NO: 309736 - RNA, 25 nt, Human
aagagccgggacccgaccgggugag

SEQ ID NO: 309737 - RNA, 22 nt, Human
aagccacccaggagucugagca

SEQ ID NO: 309738 - RNA, 23 nt, Human
acacaggaagagccgggacccga

SEQ ID NO: 309739 - RNA, 23 nt, Human
acagcccaagcuggcuaccccuc

SEQ ID NO: 309740 - RNA, 25 nt, Human
acagcccugaggacggagaggggcu

SEQ ID NO: 309741 - RNA, 20 nt, Human
agcugugugcgcagcugugg

SEQ ID NO: 309742 - RNA, 18 nt, Human
agcuuggaaagcugggaa

SEQ ID NO: 309743 - RNA, 20 nt, Human
agcuuggaaagcugggaaug

SEQ ID NO: 309744 - RNA, 19 nt, Human
aggauggcagcggugcagc

SEQ ID NO: 309745 - RNA, 22 nt, Human
aggauggcagcggugcagcggg

SEQ ID NO: 309746 - RNA, 24 nt, Human
agggacagagagaguggagagaga

SEQ ID NO: 309747 - RNA, 21 nt, Human
aggggcugcccgguccgucug

SEQ ID NO: 309748 - RNA, 21 nt, Human
aguuaacuguacaguacccca

SEQ ID NO: 309749 - RNA, 18 nt, Human
caaaacagcggcccgcag

SEQ ID NO: 309750 - RNA, 18 nt, Human
cacaaaaacaguccccag

SEQ ID NO: 309751 - RNA, 19 nt, Human
cacagcccugaggacggag

SEQ ID NO: 309752 - RNA, 26 nt, Human
cacauauauauauaugcauauauaua

SEQ ID NO: 309753 - RNA, 20 nt, Human
caccaccggacacuccacac

SEQ ID NO: 309754 - RNA, 18 nt, Human
caccccagaggcucucag

SEQ ID NO: 309755 - RNA, 18 nt, Human
cacccccagccucuuguc

SEQ ID NO: 309756 - RNA, 25 nt, Human
cacccccagccucuuguccuggucu

SEQ ID NO: 309757 - RNA, 19 nt, Human
cacuccacacgcaugcggu

SEQ ID NO: 309758 - RNA, 18 nt, Human
cagcggugcagcgggcau

SEQ ID NO: 309759 - RNA, 21 nt, Human
cagcugccaaccgggccccgg

SEQ ID NO: 309760 - RNA, 24 nt, Human
cagcugccagggcagccuguguag

SEQ ID NO: 309761 - RNA, 19 nt, Human
caggaagagccgggacccg

SEQ ID NO: 309762 - RNA, 22 nt, Human
cauauauauauaugcauauaua

SEQ ID NO: 309763 - RNA, 18 nt, Human
caugcggugagggcuguc

SEQ ID NO: 309764 - RNA, 24 nt, Human
ccacuccagggaggcuccggccac

SEQ ID NO: 309765 - RNA, 19 nt, Human
ccacuggggcuggagccug

SEQ ID NO: 309766 - RNA, 18 nt, Human
ccaggacacugcugagau

SEQ ID NO: 309767 - RNA, 23 nt, Human
ccaggacacugcugagaugccac

SEQ ID NO: 309768 - RNA, 24 nt, Human
cccagccucuuguccuggucucaa

SEQ ID NO: 309769 - RNA, 20 nt, Human
cccaguggcucccagaggca

SEQ ID NO: 309770 - RNA, 24 nt, Human
ccccagaugucccacugcucugga

SEQ ID NO: 309771 - RNA, 21 nt, Human
cccccagccucuuguccuggu

SEQ ID NO: 309772 - RNA, 19 nt, Human
ccccgggacccucagacuc

SEQ ID NO: 309773 - RNA, 23 nt, Human
ccccgggacccucagacucugcc

SEQ ID NO: 309774 - RNA, 25 nt, Human
ccccuaaacacaaaaacagucccca

SEQ ID NO: 309775 - RNA, 21 nt, Human
ccccugagcaagcagcugugu

SEQ ID NO: 309776 - RNA, 19 nt, Human
ccccuggagggcccuggcc

SEQ ID NO: 309777 - RNA, 24 nt, Human
ccccuggagggcccuggccucacc

SEQ ID NO: 309778 - RNA, 20 nt, Human
cccucagacucugccgccug

SEQ ID NO: 309779 - RNA, 25 nt, Human
cccugagcaagcagcugugugcgca

SEQ ID NO: 309780 - RNA, 18 nt, Human
ccggacacuccacacgca

SEQ ID NO: 309781 - RNA, 21 nt, Human
ccucuggucacugcccgucac

SEQ ID NO: 309782 - RNA, 22 nt, Human
ccucuuguccuggucucaaggg

SEQ ID NO: 309783 - RNA, 19 nt, Human
ccuggcccaguggcuccca

SEQ ID NO: 309784 - RNA, 20 nt, Human
ccuggcccaguggcucccaa

SEQ ID NO: 309785 - RNA, 18 nt, Human
cgacccggggccccuggc

SEQ ID NO: 309786 - RNA, 22 nt, Human
cggcaccccagaggcucucagg

SEQ ID NO: 309787 - RNA, 18 nt, Human
cggcccgagcaccaccgg

SEQ ID NO: 309788 - RNA, 21 nt, Human
cggggccccuggcccaguggc

SEQ ID NO: 309789 - RNA, 18 nt, Human
cgggugaggcaggggagg

SEQ ID NO: 309790 - RNA, 21 nt, Human
cucaccccucagccccucaga

SEQ ID NO: 309791 - RNA, 23 nt, Human
cucaggggccgcccucaggggcu

SEQ ID NO: 309792 - RNA, 23 nt, Human
cuccacaaccauuuggcauugcu

SEQ ID NO: 309793 - RNA, 25 nt, Human
cucccagaggcacagcccugaggac

SEQ ID NO: 309794 - RNA, 22 nt, Human
cugagaugccacacuggaagcc

SEQ ID NO: 309795 - RNA, 21 nt, Human
cugagcagccuggcccacagc

SEQ ID NO: 309796 - RNA, 24 nt, Human
cuggaagccacccaggagucugag

SEQ ID NO: 309797 - RNA, 18 nt, Human
cuggagggcccuggccuc

SEQ ID NO: 309798 - RNA, 18 nt, Human
cuggcccacagccccucc

SEQ ID NO: 309799 - RNA, 20 nt, Human
cuucagggcugcuccacucc

SEQ ID NO: 309800 - RNA, 23 nt, Human
cuuucuccagcugccaaccgggc

SEQ ID NO: 309801 - RNA, 20 nt, Human
gaaugcugacacccccagcc

SEQ ID NO: 309802 - RNA, 21 nt, Human
gacagcccaagcuggcuaccc

SEQ ID NO: 309803 - RNA, 20 nt, Human
gacccggggccccuggccca

SEQ ID NO: 309804 - RNA, 18 nt, Human
gaggcaggggagggaggg

SEQ ID NO: 309805 - RNA, 19 nt, Human
gagggcaaggguggacacc

SEQ ID NO: 309806 - RNA, 27 nt, Human
gccccguggugccgcggcaccccagag

SEQ ID NO: 309807 - RNA, 20 nt, Human
gcccgagcaccaccggacac

SEQ ID NO: 309808 - RNA, 22 nt, Human
gcggcggcccgagcaccaccgg

SEQ ID NO: 309809 - RNA, 21 nt, Human
gcugacacccccagccucuug

SEQ ID NO: 309810 - RNA, 21 nt, Human
gcugcacugcggcggcccgag

SEQ ID NO: 309811 - RNA, 20 nt, Human
gcuggaugaucacagcuggg

SEQ ID NO: 309812 - RNA, 24 nt, Human
ggaaagcugggaaugcugacaccc

SEQ ID NO: 309813 - RNA, 18 nt, Human
ggacaccgcuggccucca

SEQ ID NO: 309814 - RNA, 20 nt, Human
ggagaggggcugcccggucc

SEQ ID NO: 309815 - RNA, 20 nt, Human
ggagcccugccacagaccuu

SEQ ID NO: 309816 - RNA, 22 nt, Human
ggagugcucaggggccgcccuc

SEQ ID NO: 309817 - RNA, 21 nt, Human
ggcaugggugcuggagguggg

SEQ ID NO: 309818 - RNA, 24 nt, Human
ggccacuuucuccacaaccauuug

SEQ ID NO: 309819 - RNA, 22 nt, Human
ggccccuggcccaguggcuccc

SEQ ID NO: 309820 - RNA, 21 nt, Human
ggcuaccccucccccuggagg

SEQ ID NO: 309821 - RNA, 20 nt, Human
ggcucccagaggcacagccc

SEQ ID NO: 309822 - RNA, 24 nt, Human
ggcuuuuugccucuuucuccagcu

SEQ ID NO: 309823 - RNA, 23 nt, Human
gggaggcuccggccacuuucucc

SEQ ID NO: 309824 - RNA, 21 nt, Human
gggcacaggcuucagggcugc

SEQ ID NO: 309825 - RNA, 24 nt, Human
ggugcuggaggugggagucggugg

SEQ ID NO: 309826 - RNA, 19 nt, Human
gucuggaagccacccagga

SEQ ID NO: 309827 - RNA, 20 nt, Human
gugcuggaggugggagucgg

SEQ ID NO: 309828 - RNA, 21 nt, Human
uaaaaagaucaacucagacua

SEQ ID NO: 309829 - RNA, 24 nt, Human
uauauauauaugcauauauauaca

SEQ ID NO: 309830 - RNA, 22 nt, Human
uauauauaugcauauauauaca

SEQ ID NO: 309831 - RNA, 22 nt, Human
uauauauaugcauauauauaca

SEQ ID NO: 309832 - RNA, 23 nt, Human
uauauauaugcauauauauacau

SEQ ID NO: 309833 - RNA, 24 nt, Human
uauauauaugcauauauauacaug

SEQ ID NO: 309834 - RNA, 24 nt, Human
uauaugcauauauauacauguaca

SEQ ID NO: 309835 - RNA, 22 nt, Human
ucaaaccaaaacagcggcccgc

SEQ ID NO: 309836 - RNA, 25 nt, Human
ucaaaccaaaacagcggcccgcagg

SEQ ID NO: 309837 - RNA, 21 nt, Human
ucagaggucagcccuucuccc

SEQ ID NO: 309838 - RNA, 22 nt, Human
uccacacaggaagagccgggac

SEQ ID NO: 309839 - RNA, 19 nt, Human
ucccacugccuucauuuuc

SEQ ID NO: 309840 - RNA, 21 nt, Human
uccccagaugucccacugcuc

SEQ ID NO: 309841 - RNA, 25 nt, Human
ucccucuggucacugcccgucacuc

SEQ ID NO: 309842 - RNA, 22 nt, Human
ucggggggcacaggcuucaggg

SEQ ID NO: 309843 - RNA, 18 nt, Human
ucgguggcaacgggccca

SEQ ID NO: 309844 - RNA, 19 nt, Human
ucucagggucagcaggaag

SEQ ID NO: 309845 - RNA, 25 nt, Human
ucuccacaaccauuuggcauugcuu

SEQ ID NO: 309846 - RNA, 23 nt, Human
ucuccagcugccaaccgggcccc

SEQ ID NO: 309847 - RNA, 26 nt, Human
ucucucuugcugagggcaaggguugg

SEQ ID NO: 309848 - RNA, 21 nt, Human
ucuucaguuaacuguacagua

SEQ ID NO: 309849 - RNA, 21 nt, Human
ugaagacagcugccagggcag

SEQ ID NO: 309850 - RNA, 21 nt, Human
ugaaggccacugggcagcucu

SEQ ID NO: 309851 - RNA, 18 nt, Human
ugagaugccacacuggaa

SEQ ID NO: 309852 - RNA, 22 nt, Human
ugaggacggagaggggcugccc

SEQ ID NO: 309853 - RNA, 22 nt, Human
ugagggcaaggguggacaccgg

SEQ ID NO: 309854 - RNA, 23 nt, Human
ugccacagaccucaaggcccaag

SEQ ID NO: 309855 - RNA, 18 nt, Human
ugccccguggugccgcgg

SEQ ID NO: 309856 - RNA, 21 nt, Human
uggauguggugcuccggccuc

SEQ ID NO: 309857 - RNA, 19 nt, Human
uggcagcggugcagcgggc

SEQ ID NO: 309858 - RNA, 23 nt, Human
uggggcagggacagagagagugg

SEQ ID NO: 309859 - RNA, 21 nt, Human
uggggcgagguggauguggug

SEQ ID NO: 309860 - RNA, 20 nt, Human
ugggggcagcuuggaaagcu

SEQ ID NO: 309861 - RNA, 19 nt, Human
uguacagcuuucuuuuaag

SEQ ID NO: 309862 - RNA, 18 nt, Human
uguggcagguaccaucac

SEQ ID NO: 309863 - RNA, 24 nt, Human
uuccccuaaacacaaaaacagucc

SEQ ID NO: 309864 - RNA, 21 nt, Human
aaaaaacaguagcaaaaagca

SEQ ID NO: 309865 - RNA, 21 nt, Human
aaaaacaguagcaaaaagccg

SEQ ID NO: 309866 - RNA, 24 nt, Human
aaaacaaaaaacaguagcaaaaag

SEQ ID NO: 309867 - RNA, 24 nt, Human
aaacaaaacaaaaaacaguagcaa

SEQ ID NO: 309868 - RNA, 23 nt, Human
aacaaaacaaaaaacaguagcaa

SEQ ID NO: 309869 - RNA, 26 nt, Human
aacaaaacaaaaaacaguagcaaaaa

SEQ ID NO: 309870 - RNA, 19 nt, Human
aaccaccuucucccggccc

SEQ ID NO: 309871 - RNA, 20 nt, Human
aagggagacagaaaucagaa

SEQ ID NO: 309872 - RNA, 25 nt, Human
acaaaacaaaaaacaguagcaaaaa

SEQ ID NO: 309873 - RNA, 23 nt, Human
acaguagcaaaaagcauugguac

SEQ ID NO: 309874 - RNA, 19 nt, Human
accugaaggggcaaaggag

SEQ ID NO: 309875 - RNA, 18 nt, Human
acuggccucuguuuuugc

SEQ ID NO: 309876 - RNA, 21 nt, Human
agacagaaaucagaauuaaac

SEQ ID NO: 309877 - RNA, 21 nt, Human
agacucccagugugacagcuu

SEQ ID NO: 309878 - RNA, 21 nt, Human
aggauggacgacgcccacugu

SEQ ID NO: 309879 - RNA, 22 nt, Human
aguguuuggugcauacuugugc

SEQ ID NO: 309880 - RNA, 19 nt, Human
aguuccauacuccucuggc

SEQ ID NO: 309881 - RNA, 23 nt, Human
aucuccucucaaaagaugagaau

SEQ ID NO: 309882 - RNA, 19 nt, Human
augcaaagcagcagucaca

SEQ ID NO: 309883 - RNA, 20 nt, Human
augggagaaaagaaggaagg

SEQ ID NO: 309884 - RNA, 24 nt, Human
auuucuguuuuuuucccuuuuucu

SEQ ID NO: 309885 - RNA, 21 nt, Human
caaaacaaaaaacaguagcaa

SEQ ID NO: 309886 - RNA, 21 nt, Human
caaagcagcagucacagaggc

SEQ ID NO: 309887 - RNA, 19 nt, Human
cagccagggugagcucuug

SEQ ID NO: 309888 - RNA, 18 nt, Human
caggucccucuucccagg

SEQ ID NO: 309889 - RNA, 20 nt, Human
caucaaaggucaaauugucc

SEQ ID NO: 309890 - RNA, 21 nt, Human
caucauucuucuucuccucuu

SEQ ID NO: 309891 - RNA, 23 nt, Human
caucuccucucaaaagaugagaa

SEQ ID NO: 309892 - RNA, 21 nt, Human
ccagccagccagggugagcug

SEQ ID NO: 309893 - RNA, 20 nt, Human
ccaggccguuuccccaggga

SEQ ID NO: 309894 - RNA, 21 nt, Human
ccagguuuuacuggccucugu

SEQ ID NO: 309895 - RNA, 19 nt, Human
cccacacaccuccaggccg

SEQ ID NO: 309896 - RNA, 22 nt, Human
cccacugauauucuuccccauc

SEQ ID NO: 309897 - RNA, 22 nt, Human
cucauuauuuccccaauauaca

SEQ ID NO: 309898 - RNA, 21 nt, Human
cucccggccccggguucucug

SEQ ID NO: 309899 - RNA, 24 nt, Human
cuccucuggcugccgggauaauuc

SEQ ID NO: 309900 - RNA, 18 nt, Human
cucguggaggccuggccc

SEQ ID NO: 309901 - RNA, 22 nt, Human
cucucagcaucucugcuuucuc

SEQ ID NO: 309902 - RNA, 20 nt, Human
cucuggggccugauccccau

SEQ ID NO: 309903 - RNA, 25 nt, Human
cugccgggauaauuccagguuuuac

SEQ ID NO: 309904 - RNA, 23 nt, Human
cuggaaguuccauacuccucugg

SEQ ID NO: 309905 - RNA, 22 nt, Human
cuucucauaguaacuuuaggga

SEQ ID NO: 309906 - RNA, 19 nt, Human
cuucuucuccucuuucucu

SEQ ID NO: 309907 - RNA, 22 nt, Human
cuucuucuccucuuucucucuu

SEQ ID NO: 309908 - RNA, 19 nt, Human
cuugaagaaccaccuucuc

SEQ ID NO: 309909 - RNA, 20 nt, Human
gaaaggaaacauaucaaaga

SEQ ID NO: 309910 - RNA, 19 nt, Human
gaggaguccuccccucucc

SEQ ID NO: 309911 - RNA, 23 nt, Human
gaggaguccuccccucuccccag

SEQ ID NO: 309912 - RNA, 21 nt, Human
gaggcagaacuguccccaacu

SEQ ID NO: 309913 - RNA, 19 nt, Human
gcaaagcagcagucacaga

SEQ ID NO: 309914 - RNA, 20 nt, Human
gcuggcguagggagaggagu

SEQ ID NO: 309915 - RNA, 18 nt, Human
ggaaaaggagacagucau

SEQ ID NO: 309916 - RNA, 20 nt, Human
ggaaugggagaaaagaagga

SEQ ID NO: 309917 - RNA, 19 nt, Human
gugccucucggcuugaaga

SEQ ID NO: 309918 - RNA, 18 nt, Human
uagcaaaaagcauuggua

SEQ ID NO: 309919 - RNA, 24 nt, Human
uaggauuaaauaaaacaaaacaaa

SEQ ID NO: 309920 - RNA, 20 nt, Human
uaugucuccaaaucaacuuu

SEQ ID NO: 309921 - RNA, 18 nt, Human
ucaaaggucaaauugucc

SEQ ID NO: 309922 - RNA, 22 nt, Human
uccaccugaaggggcaaaggag

SEQ ID NO: 309923 - RNA, 18 nt, Human
uccccagggugccugguu

SEQ ID NO: 309924 - RNA, 18 nt, Human
ucccggccccggguucuc

SEQ ID NO: 309925 - RNA, 18 nt, Human
ucucaggggacagcaagc

SEQ ID NO: 309926 - RNA, 21 nt, Human
ucucugguguucucacugagg

SEQ ID NO: 309927 - RNA, 24 nt, Human
ucuucuccucuuucucucuuuuuu

SEQ ID NO: 309928 - RNA, 18 nt, Human
ucuuuuuuuuuuuuuuuu

SEQ ID NO: 309929 - RNA, 21 nt, Human
ugaaaggaaacauaucaaaga

SEQ ID NO: 309930 - RNA, 19 nt, Human
ugagaauauacaggugugu

SEQ ID NO: 309931 - RNA, 23 nt, Human
ugaggcagggcugccaggugucu

SEQ ID NO: 309932 - RNA, 21 nt, Human
ugauaugaggcagggcugcca

SEQ ID NO: 309933 - RNA, 25 nt, Human
ugcaaagcagcagucacagaggcag

SEQ ID NO: 309934 - RNA, 22 nt, Human
ugccagggaccacuggaugauu

SEQ ID NO: 309935 - RNA, 19 nt, Human
ugccgggauaauuccaggu

SEQ ID NO: 309936 - RNA, 19 nt, Human
uggagugaacuccaaaguc

SEQ ID NO: 309937 - RNA, 25 nt, Human
uggagugaacuccaaagucaaacac

SEQ ID NO: 309938 - RNA, 22 nt, Human
uggcccacacaccuccaggccg

SEQ ID NO: 309939 - RNA, 23 nt, Human
ugggagaaaagaaggaagggaga

SEQ ID NO: 309940 - RNA, 23 nt, Human
ugggagaaaagaaggaagggaga

SEQ ID NO: 309941 - RNA, 25 nt, Human
ugggagaggcccaccucaccccacu

SEQ ID NO: 309942 - RNA, 23 nt, Human
uuccccaauauacaucaaaugag

SEQ ID NO: 309943 - RNA, 21 nt, Human
uuuagggaaauugaaaggaaa

SEQ ID NO: 309944 - RNA, 20 nt, Human
uuucucucuuuuuuuuuuuu

SEQ ID NO: 309945 - RNA, 19 nt, Human
uuuguuuuauuucuguuuu

SEQ ID NO: 309946 - RNA, 20 nt, Human
aaaaagacgcuguauuugau

SEQ ID NO: 309947 - RNA, 19 nt, Human
aacugcucccagucccccc

SEQ ID NO: 309948 - RNA, 18 nt, Human
aagauuuacaaaaagggg

SEQ ID NO: 309949 - RNA, 24 nt, Human
aagauuuacaaaaagggguggggu

SEQ ID NO: 309950 - RNA, 24 nt, Human
acagacagacauaggaucugggaa

SEQ ID NO: 309951 - RNA, 21 nt, Human
accccaggaugucugggcccc

SEQ ID NO: 309952 - RNA, 24 nt, Human
acgcugggcggguuccggcugcac

SEQ ID NO: 309953 - RNA, 20 nt, Human
acguggggcccagcagccgu

SEQ ID NO: 309954 - RNA, 23 nt, Human
acugcucccaguccccccggacu

SEQ ID NO: 309955 - RNA, 22 nt, Human
agcuggggcuggggcuggugcu

SEQ ID NO: 309956 - RNA, 22 nt, Human
agggagcuggggcuggggcugg

SEQ ID NO: 309957 - RNA, 22 nt, Human
agggcauggaggcggcugcugg

SEQ ID NO: 309958 - RNA, 19 nt, Human
caaaucacucgagacucuu

SEQ ID NO: 309959 - RNA, 18 nt, Human
ccacccagagugccggca

SEQ ID NO: 309960 - RNA, 18 nt, Human
ccagcugcccccagcgug

SEQ ID NO: 309961 - RNA, 20 nt, Human
cccucagaucccccaggggc

SEQ ID NO: 309962 - RNA, 22 nt, Human
cccugggggccacaggcccuca

SEQ ID NO: 309963 - RNA, 21 nt, Human
ccucagaucccccaggggccc

SEQ ID NO: 309964 - RNA, 18 nt, Human
ccucagccacagccacuc

SEQ ID NO: 309965 - RNA, 23 nt, Human
cggcacccuuggggaggccggug

SEQ ID NO: 309966 - RNA, 19 nt, Human
cucagccacagccacucgg

SEQ ID NO: 309967 - RNA, 21 nt, Human
cuccggcuuggggcgcguucc

SEQ ID NO: 309968 - RNA, 20 nt, Human
cugcggccggagggagcugg

SEQ ID NO: 309969 - RNA, 18 nt, Human
cuggugcgugggcggagg

SEQ ID NO: 309970 - RNA, 20 nt, Human
cuuuuucuccuccucccauc

SEQ ID NO: 309971 - RNA, 21 nt, Human
gaccaggaccccaggaugucu

SEQ ID NO: 309972 - RNA, 23 nt, Human
gaguccacccagagugccggcac

SEQ ID NO: 309973 - RNA, 24 nt, Human
gccggagggagcuggggcuggggc

SEQ ID NO: 309974 - RNA, 21 nt, Human
gcgcguuccaggggagggugg

SEQ ID NO: 309975 - RNA, 18 nt, Human
ggacagacagacauagga

SEQ ID NO: 309976 - RNA, 18 nt, Human
ggcgcguuccaggggagg

SEQ ID NO: 309977 - RNA, 23 nt, Human
ggcugcacccacuccggcuuggg

SEQ ID NO: 309978 - RNA, 24 nt, Human
gggagggugggggccucagccaca

SEQ ID NO: 309979 - RNA, 20 nt, Human
gggcggaggcggaggccagc

SEQ ID NO: 309980 - RNA, 19 nt, Human
gggcuggggcuggugcugg

SEQ ID NO: 309981 - RNA, 23 nt, Human
ggguggggcucuagggcagccug

SEQ ID NO: 309982 - RNA, 26 nt, Human
uaccgcuuuuucuccuccucccaucu

SEQ ID NO: 309983 - RNA, 24 nt, Human
uaugucccaaggcagcacuggaga

SEQ ID NO: 309984 - RNA, 18 nt, Human
ucacucgagacucgacag

SEQ ID NO: 309985 - RNA, 25 nt, Human
ucacuugaccuuugacguggggccc

SEQ ID NO: 309986 - RNA, 22 nt, Human
uccacccagagugccggcaccc

SEQ ID NO: 309987 - RNA, 18 nt, Human
uccaggggaggguggggg

SEQ ID NO: 309988 - RNA, 21 nt, Human
ucucacuugaccuuugacgug

SEQ ID NO: 309989 - RNA, 24 nt, Human
ucugcggccggagggagcuggggc

SEQ ID NO: 309990 - RNA, 19 nt, Human
ugcccugggggccacaggc

SEQ ID NO: 309991 - RNA, 21 nt, Human
ugcuggugcggugcccggcgg

SEQ ID NO: 309992 - RNA, 22 nt, Human
ugcuggugcgugggcggaggcg

SEQ ID NO: 309993 - RNA, 19 nt, Human
uggacagacagacauagga

SEQ ID NO: 309994 - RNA, 21 nt, Human
ugggcggaggcggaggccagc

SEQ ID NO: 309995 - RNA, 21 nt, Human
uuuuucuccuccucccaucuc

SEQ ID NO: 309996 - RNA, 24 nt, Human
uuuuuuuuuuuugaaaaagacgcu

SEQ ID NO: 309997 - RNA, 20 nt, Human
uuuuuuuuuuuuuuuuuugg

SEQ ID NO: 309998 - RNA, 20 nt, Human
agagggggaaggagggggau

SEQ ID NO: 309999 - RNA, 22 nt, Human
agagggggaaggagggggaucc

SEQ ID NO: 310000 - RNA, 24 nt, Human
aggcaaauaaauacaauggggaga

SEQ ID NO: 310001 - RNA, 18 nt, Human
agggggaaggagggggau

SEQ ID NO: 310002 - RNA, 24 nt, Human
auacaauggggagagggggaagga

SEQ ID NO: 310003 - RNA, 19 nt, Human
cagggcaguggcgaugggc

SEQ ID NO: 310004 - RNA, 23 nt, Human
ccccucaguggcuggcucgguuc

SEQ ID NO: 310005 - RNA, 19 nt, Human
ccuggcuuugcacccugug

SEQ ID NO: 310006 - RNA, 18 nt, Human
gaaggugggugggcuggc

SEQ ID NO: 310007 - RNA, 19 nt, Human
gagagggggaaggaggggg

SEQ ID NO: 310008 - RNA, 20 nt, Human
gcaggggagguggcaggcag

SEQ ID NO: 310009 - RNA, 18 nt, Human
gcccccaggcucugccag

SEQ ID NO: 310010 - RNA, 23 nt, Human
gcccccaggcucugccagcuccc

SEQ ID NO: 310011 - RNA, 22 nt, Human
gcgcugcgguguugguggaucc

SEQ ID NO: 310012 - RNA, 23 nt, Human
gggauccuuauaaauuagaaaca

SEQ ID NO: 310013 - RNA, 18 nt, Human
ggggagagggggaaggag

SEQ ID NO: 310014 - RNA, 19 nt, Human
uaaauuagaaacaaucuca

SEQ ID NO: 310015 - RNA, 23 nt, Human
uccuuauaaauuagaaacaaucu

SEQ ID NO: 310016 - RNA, 18 nt, Human
ucuccugggcggcguggc

SEQ ID NO: 310017 - RNA, 19 nt, Human
ugccccagggcaguggcga

SEQ ID NO: 310018 - RNA, 22 nt, Human
ugcccccaggcucugccagcuc

SEQ ID NO: 310019 - RNA, 18 nt, Human
uggcaggggagguggcag

SEQ ID NO: 310020 - RNA, 18 nt, Human
ugggcuggcaggggaggu

SEQ ID NO: 310021 - RNA, 19 nt, Human
uggggagagggggaaggag

SEQ ID NO: 310022 - RNA, 22 nt, Human
uggggagagggggaaggagggg

SEQ ID NO: 310023 - RNA, 18 nt, Human
uggggggaaggugggugg

SEQ ID NO: 310024 - RNA, 18 nt, Human
uggggggaaggugggugg

SEQ ID NO: 310025 - RNA, 20 nt, Human
aaaaccauucaccaaagaca

SEQ ID NO: 310026 - RNA, 21 nt, Human
aaaaggacugacuuucagaga

SEQ ID NO: 310027 - RNA, 20 nt, Human
aaauugcuugaacccgggaa

SEQ ID NO: 310028 - RNA, 20 nt, Human
aacagagugagacuccaucu

SEQ ID NO: 310029 - RNA, 24 nt, Human
aacagagugagacuccaucucaaa

SEQ ID NO: 310030 - RNA, 24 nt, Human
aacagguccauaucaaaaaaagaa

SEQ ID NO: 310031 - RNA, 22 nt, Human
aaugauggagguaaaccaagga

SEQ ID NO: 310032 - RNA, 24 nt, Human
aauugcuugaacccgggaggcaga

SEQ ID NO: 310033 - RNA, 22 nt, Human
acagaacacaggcuccaaacau

SEQ ID NO: 310034 - RNA, 24 nt, Human
acagagugagacuccaucucaaaa

SEQ ID NO: 310035 - RNA, 24 nt, Human
accuugccucuacuaaaaauacaa

SEQ ID NO: 310036 - RNA, 24 nt, Human
acuccagccugggcaacagaguga

SEQ ID NO: 310037 - RNA, 28 nt, Human
acuccaucucaaaaaaaaaaaaaaaaaa

SEQ ID NO: 310038 - RNA, 24 nt, Human
acugguaaaaauauacagauguua

SEQ ID NO: 310039 - RNA, 21 nt, Human
agagcagaacauuuuugaacu

SEQ ID NO: 310040 - RNA, 24 nt, Human
agagguuucagugagccgagaucg

SEQ ID NO: 310041 - RNA, 20 nt, Human
agccaggcaugguggugggc

SEQ ID NO: 310042 - RNA, 24 nt, Human
agccugggcaacagagugagacuc

SEQ ID NO: 310043 - RNA, 21 nt, Human
aggcagagguuucagugagcc

SEQ ID NO: 310044 - RNA, 24 nt, Human
aggcagagguuucagugagccgag

SEQ ID NO: 310045 - RNA, 23 nt, Human
aggcaggaaauugcuugaacccg

SEQ ID NO: 310046 - RNA, 24 nt, Human
aggcagguggaucacgaggucagg

SEQ ID NO: 310047 - RNA, 24 nt, Human
aggcaugguggugggcaccuguaa

SEQ ID NO: 310048 - RNA, 20 nt, Human
aggcugaggcaggaaauugc

SEQ ID NO: 310049 - RNA, 23 nt, Human
aggcugaggcaggaaauugcuug

SEQ ID NO: 310050 - RNA, 24 nt, Human
agguggaucacgaggucaggaguu

SEQ ID NO: 310051 - RNA, 24 nt, Human
aguggugcacgccuguaaucccag

SEQ ID NO: 310052 - RNA, 26 nt, Human
auaaaaccauucaccaaagacaugcu

SEQ ID NO: 310053 - RNA, 24 nt, Human
aucgugccauugcacuccagccug

SEQ ID NO: 310054 - RNA, 23 nt, Human
auugcacuccagccugggcaaca

SEQ ID NO: 310055 - RNA, 24 nt, Human
auugcacuccagccugggcaacag

SEQ ID NO: 310056 - RNA, 20 nt, Human
caacagguccauaucaaaaa

SEQ ID NO: 310057 - RNA, 19 nt, Human
caccuguaaucccagcuau

SEQ ID NO: 310058 - RNA, 25 nt, Human
caccuguaaucccagcuauucauga

SEQ ID NO: 310059 - RNA, 22 nt, Human
cacgccuguaaucccagcacuu

SEQ ID NO: 310060 - RNA, 24 nt, Human
cacgccuguaaucccagcacuuug

SEQ ID NO: 310061 - RNA, 22 nt, Human
cacuccagccugggcaacagag

SEQ ID NO: 310062 - RNA, 22 nt, Human
cacuccagccugggcaacagag

SEQ ID NO: 310063 - RNA, 24 nt, Human
cacuccagccugggcaacagagug

SEQ ID NO: 310064 - RNA, 18 nt, Human
cagaacacaggcuccaaa

SEQ ID NO: 310065 - RNA, 19 nt, Human
cagaacacaggcuccaaac

SEQ ID NO: 310066 - RNA, 18 nt, Human
cagaacauuuuugaacug

SEQ ID NO: 310067 - RNA, 24 nt, Human
cagcacuuugggaagccgaggcag

SEQ ID NO: 310068 - RNA, 26 nt, Human
cagcacuuugggaagccgaggcaggu

SEQ ID NO: 310069 - RNA, 19 nt, Human
cagcaguggcuucaugaga

SEQ ID NO: 310070 - RNA, 22 nt, Human
cauagaccaacagguccauauc

SEQ ID NO: 310071 - RNA, 22 nt, Human
cauucaccaaagacaugcuuaa

SEQ ID NO: 310072 - RNA, 18 nt, Human
cauugcacuccagccugg

SEQ ID NO: 310073 - RNA, 19 nt, Human
cauugcacuccagccuggg

SEQ ID NO: 310074 - RNA, 21 nt, Human
cauugcacuccagccugggca

SEQ ID NO: 310075 - RNA, 23 nt, Human
cauugcacuccagccugggcaac

SEQ ID NO: 310076 - RNA, 24 nt, Human
cauugcacuccagccugggcaaca

SEQ ID NO: 310077 - RNA, 23 nt, Human
ccaaagacaugcuuaauuuuuga

SEQ ID NO: 310078 - RNA, 20 nt, Human
ccauugcacuccagccuggg

SEQ ID NO: 310079 - RNA, 21 nt, Human
ccauugcacuccagccugggc

SEQ ID NO: 310080 - RNA, 22 nt, Human
ccauugcacuccagccugggca

SEQ ID NO: 310081 - RNA, 23 nt, Human
ccauugcacuccagccugggcaa

SEQ ID NO: 310082 - RNA, 24 nt, Human
ccauugcacuccagccugggcaac

SEQ ID NO: 310083 - RNA, 21 nt, Human
cccagcaguggcuucaugaga

SEQ ID NO: 310084 - RNA, 22 nt, Human
ccugggcaacagagugagacuc

SEQ ID NO: 310085 - RNA, 22 nt, Human
ccuguaaucccagcacuuuggg

SEQ ID NO: 310086 - RNA, 18 nt, Human
cgagaacggaacugcacu

SEQ ID NO: 310087 - RNA, 24 nt, Human
cgaggcagguggaucacgagguca

SEQ ID NO: 310088 - RNA, 18 nt, Human
cuacuauaaauuugaauc

SEQ ID NO: 310089 - RNA, 18 nt, Human
cucaaaaaaaaaaaaaaa

SEQ ID NO: 310090 - RNA, 21 nt, Human
cucaacaagugaagguggucu

SEQ ID NO: 310091 - RNA, 19 nt, Human
cuccaucucaaaaaaaaaa

SEQ ID NO: 310092 - RNA, 20 nt, Human
cucuacuaaaaauacaaaaa

SEQ ID NO: 310093 - RNA, 24 nt, Human
cugaggcaggaaauugcuugaacc

SEQ ID NO: 310094 - RNA, 24 nt, Human
cuugaccaagauggugaaaccuug

SEQ ID NO: 310095 - RNA, 23 nt, Human
gaaaaagccuaugauuuugguua

SEQ ID NO: 310096 - RNA, 23 nt, Human
gaccaagauggugaaaccuugcc

SEQ ID NO: 310097 - RNA, 23 nt, Human
gagaucgugccauugcacuccag

SEQ ID NO: 310098 - RNA, 19 nt, Human
gaucacaaucacagauuua

SEQ ID NO: 310099 - RNA, 24 nt, Human
gaucacgaggucaggaguuccaga

SEQ ID NO: 310100 - RNA, 18 nt, Human
gcaauuaaaugcuuuucu

SEQ ID NO: 310101 - RNA, 24 nt, Human
gcacuccagccugggcaacagagu

SEQ ID NO: 310102 - RNA, 20 nt, Human
gcagaacauuuuugaacuga

SEQ ID NO: 310103 - RNA, 22 nt, Human
gccauugcacuccagccugggc

SEQ ID NO: 310104 - RNA, 24 nt, Human
gccauugcacuccagccugggcaa

SEQ ID NO: 310105 - RNA, 21 nt, Human
gcuggacucaguggugcacgc

SEQ ID NO: 310106 - RNA, 21 nt, Human
ggagguaaaccaaggagggua

SEQ ID NO: 310107 - RNA, 23 nt, Human
ggagguaaaccaaggaggguagg

SEQ ID NO: 310108 - RNA, 24 nt, Human
gguggugggcaccuguaaucccag

SEQ ID NO: 310109 - RNA, 19 nt, Human
gucuagaguguauguaagg

SEQ ID NO: 310110 - RNA, 21 nt, Human
gugaaaccuugccucuacuaa

SEQ ID NO: 310111 - RNA, 23 nt, Human
guggaucacgaggucaggaguuc

SEQ ID NO: 310112 - RNA, 22 nt, Human
guggugcacgccuguaauccca

SEQ ID NO: 310113 - RNA, 23 nt, Human
guggugggcaccuguaaucccag

SEQ ID NO: 310114 - RNA, 24 nt, Human
guuuugguagaaguggucugagaa

SEQ ID NO: 310115 - RNA, 21 nt, Human
uaaaaauacaaaaacuagcca

SEQ ID NO: 310116 - RNA, 20 nt, Human
uaaaagacaaaucaaccuuc

SEQ ID NO: 310117 - RNA, 25 nt, Human
uaaaccagacauuuaacauaauacc

SEQ ID NO: 310118 - RNA, 21 nt, Human
uaacauuaugggcuucuccuc

SEQ ID NO: 310119 - RNA, 20 nt, Human
uaagucauaauuauacagaa

SEQ ID NO: 310120 - RNA, 24 nt, Human
uaaguggcaguaugacuugucauu

SEQ ID NO: 310121 - RNA, 18 nt, Human
uacugaucuaucuuaacg

SEQ ID NO: 310122 - RNA, 20 nt, Human
uauacagaauuuucacaaag

SEQ ID NO: 310123 - RNA, 25 nt, Human
uauaugcaaacagucacaauaugca

SEQ ID NO: 310124 - RNA, 18 nt, Human
uauuucuuacaugccaag

SEQ ID NO: 310125 - RNA, 24 nt, Human
ucaaaaaaaaaaaaaaaaaaagaa

SEQ ID NO: 310126 - RNA, 25 nt, Human
ucaaaaaaaaaaaaaaaaaaagaau

SEQ ID NO: 310127 - RNA, 20 nt, Human
ucaacaagugaagguggucu

SEQ ID NO: 310128 - RNA, 22 nt, Human
ucacaaaguucaaugcacagaa

SEQ ID NO: 310129 - RNA, 22 nt, Human
ucaccaaagacaugcuuaauuu

SEQ ID NO: 310130 - RNA, 24 nt, Human
ucacgaggucaggaguuccagacc

SEQ ID NO: 310131 - RNA, 23 nt, Human
ucauuguuguuuuuuaaugaugg

SEQ ID NO: 310132 - RNA, 23 nt, Human
uccagccugggcaacagagugag

SEQ ID NO: 310133 - RNA, 24 nt, Human
uccagccugggcaacagagugaga

SEQ ID NO: 310134 - RNA, 23 nt, Human
uccaucucaaaaaaaaaaaaaaa

SEQ ID NO: 310135 - RNA, 23 nt, Human
ucgugccauugcacuccagccug

SEQ ID NO: 310136 - RNA, 26 nt, Human
ucugcaauuuacugguugacugcacu

SEQ ID NO: 310137 - RNA, 22 nt, Human
ugaaaagaugacauagaccaac

SEQ ID NO: 310138 - RNA, 19 nt, Human
ugaaagauuuuuuuuucuu

SEQ ID NO: 310139 - RNA, 22 nt, Human
ugaacugauaaacaagaauaua

SEQ ID NO: 310140 - RNA, 19 nt, Human
ugaccaagauggugaaacc

SEQ ID NO: 310141 - RNA, 22 nt, Human
ugagaccaagugucuacuuugc

SEQ ID NO: 310142 - RNA, 22 nt, Human
ugagccgagaucgugccauugc

SEQ ID NO: 310143 - RNA, 23 nt, Human
ugaggcaggaaauugcuugaacc

SEQ ID NO: 310144 - RNA, 23 nt, Human
ugaggcaggaaauugcuugaacc

SEQ ID NO: 310145 - RNA, 24 nt, Human
ugaggcaggaaauugcuugaaccc

SEQ ID NO: 310146 - RNA, 21 nt, Human
ugcacgccuguaaucccagca

SEQ ID NO: 310147 - RNA, 22 nt, Human
ugcacuccagccugggcaacag

SEQ ID NO: 310148 - RNA, 22 nt, Human
ugcacuccagccugggcaacag

SEQ ID NO: 310149 - RNA, 22 nt, Human
ugccaaguaguuccuccauucu

SEQ ID NO: 310150 - RNA, 22 nt, Human
uggaucacgaggucaggaguuc

SEQ ID NO: 310151 - RNA, 24 nt, Human
ugggaagccgaggcagguggauca

SEQ ID NO: 310152 - RNA, 21 nt, Human
uggugcacgccuguaauccca

SEQ ID NO: 310153 - RNA, 24 nt, Human
uggugcacgccuguaaucccagca

SEQ ID NO: 310154 - RNA, 24 nt, Human
ugguggugggcaccuguaauccca

SEQ ID NO: 310155 - RNA, 18 nt, Human
ugucuuauaugcuuuagg

SEQ ID NO: 310156 - RNA, 19 nt, Human
uguuuugguagaagugguc

SEQ ID NO: 310157 - RNA, 22 nt, Human
uucaaaaguugacauuaucaga

SEQ ID NO: 310158 - RNA, 27 nt, Human
uugaccaagauggugaaaccuugccuc

SEQ ID NO: 310159 - RNA, 18 nt, Human
uugcuugaacccgggagg

SEQ ID NO: 310160 - RNA, 24 nt, Human
uugcuugaacccgggaggcagagg

SEQ ID NO: 310161 - RNA, 22 nt, Human
uuucagugagccgagaucgugc

SEQ ID NO: 310162 - RNA, 23 nt, Human
uuucagugagccgagaucgugcc

SEQ ID NO: 310163 - RNA, 24 nt, Human
aaaagagacagggcucuggacaca

SEQ ID NO: 310164 - RNA, 21 nt, Human
aaacacagacugcugggcccc

SEQ ID NO: 310165 - RNA, 20 nt, Human
aaacagcacacauggugggg

SEQ ID NO: 310166 - RNA, 23 nt, Human
aagaagcucccaggggaugcuga

SEQ ID NO: 310167 - RNA, 22 nt, Human
aagagaagcugaaggggaggcg

SEQ ID NO: 310168 - RNA, 26 nt, Human
aagcagaggugucugugcagccagga

SEQ ID NO: 310169 - RNA, 26 nt, Human
aagcagaggugucugugcagccagga

SEQ ID NO: 310170 - RNA, 24 nt, Human
aagccagcaaaugacacgccagga

SEQ ID NO: 310171 - RNA, 24 nt, Human
aagccagcaaaugacacgccagga

SEQ ID NO: 310172 - RNA, 28 nt, Human
aagccagcaaaugacacgccaggagccc

SEQ ID NO: 310173 - RNA, 19 nt, Human
aagcuccagacaaaggucu

SEQ ID NO: 310174 - RNA, 18 nt, Human
aagcugaaggggaggcgu

SEQ ID NO: 310175 - RNA, 21 nt, Human
aauaaaccucuagggacagaa

SEQ ID NO: 310176 - RNA, 21 nt, Human
aaugaguagggaugggaagga

SEQ ID NO: 310177 - RNA, 24 nt, Human
acaccccuucacuggcccccacug

SEQ ID NO: 310178 - RNA, 21 nt, Human
acagaaccucagacugagggc

SEQ ID NO: 310179 - RNA, 21 nt, Human
acagaaccucagacugagggc

SEQ ID NO: 310180 - RNA, 25 nt, Human
acaugguggggcuggaaaucagugg

SEQ ID NO: 310181 - RNA, 19 nt, Human
accacggaagacaugucaa

SEQ ID NO: 310182 - RNA, 19 nt, Human
accacggaagacaugucaa

SEQ ID NO: 310183 - RNA, 18 nt, Human
acccugagggugcugggg

SEQ ID NO: 310184 - RNA, 21 nt, Human
acccugagggugcuggggccu

SEQ ID NO: 310185 - RNA, 21 nt, Human
agacagggcucuggacacaug

SEQ ID NO: 310186 - RNA, 19 nt, Human
agaccagggccaccuagag

SEQ ID NO: 310187 - RNA, 24 nt, Human
agagaagacccaggucucccugcc

SEQ ID NO: 310188 - RNA, 27 nt, Human
agagcaaagcuguggccaagcagaggu

SEQ ID NO: 310189 - RNA, 23 nt, Human
agaggccugggcugcuugggaag

SEQ ID NO: 310190 - RNA, 27 nt, Human
agccagcaaaugacacgccaggagccc

SEQ ID NO: 310191 - RNA, 27 nt, Human
agccagcaaaugacacgccaggagccc

SEQ ID NO: 310192 - RNA, 18 nt, Human
agccucuaguaauaaacc

SEQ ID NO: 310193 - RNA, 21 nt, Human
agcggacaacccugaccugcc

SEQ ID NO: 310194 - RNA, 18 nt, Human
agcucaggggccgggcag

SEQ ID NO: 310195 - RNA, 21 nt, Human
agcucaggggccgggcagggg

SEQ ID NO: 310196 - RNA, 21 nt, Human
agcucaggggccgggcagggg

SEQ ID NO: 310197 - RNA, 21 nt, Human
agcucaggggccgggcagggg

SEQ ID NO: 310198 - RNA, 18 nt, Human
agcucuccugggccuggc

SEQ ID NO: 310199 - RNA, 18 nt, Human
agcucuccugggccuggc

SEQ ID NO: 310200 - RNA, 22 nt, Human
agcugucauuuggagacugucc

SEQ ID NO: 310201 - RNA, 22 nt, Human
aggaaggaagcaagcuuuggaa

SEQ ID NO: 310202 - RNA, 22 nt, Human
aggaaggaagcaagcuuuggaa

SEQ ID NO: 310203 - RNA, 19 nt, Human
aggagaaggggagggcaaa

SEQ ID NO: 310204 - RNA, 19 nt, Human
aggagaaggggagggcaaa

SEQ ID NO: 310205 - RNA, 18 nt, Human
aggagccccggagggagc

SEQ ID NO: 310206 - RNA, 18 nt, Human
aggagccccggagggagc

SEQ ID NO: 310207 - RNA, 23 nt, Human
aggaggaaggaagcaagcuuugg

SEQ ID NO: 310208 - RNA, 18 nt, Human
aggcuugggguggggguc

SEQ ID NO: 310209 - RNA, 18 nt, Human
aggcuugggguggggguc

SEQ ID NO: 310210 - RNA, 18 nt, Human
aggcuugggguggggguc

SEQ ID NO: 310211 - RNA, 18 nt, Human
aggcuugggguggggguc

SEQ ID NO: 310212 - RNA, 18 nt, Human
agggacagaagggucacu

SEQ ID NO: 310213 - RNA, 18 nt, Human
agggaggaggaggaaggg

SEQ ID NO: 310214 - RNA, 19 nt, Human
agggaggaggaggaagggg

SEQ ID NO: 310215 - RNA, 20 nt, Human
agggaggaggaggaaggggc

SEQ ID NO: 310216 - RNA, 22 nt, Human
agggcuggguaccaggaccugg

SEQ ID NO: 310217 - RNA, 25 nt, Human
agggugcuggggccuuccagcugga

SEQ ID NO: 310218 - RNA, 20 nt, Human
auaaaccucuagggacagaa

SEQ ID NO: 310219 - RNA, 20 nt, Human
aucaaucuguuuccaucggu

SEQ ID NO: 310220 - RNA, 20 nt, Human
caaagaaaaccagaggucug

SEQ ID NO: 310221 - RNA, 20 nt, Human
caaagaggccuggaauggug

SEQ ID NO: 310222 - RNA, 20 nt, Human
caaagaggccuggaauggug

SEQ ID NO: 310223 - RNA, 20 nt, Human
caaagaggccuggaauggug

SEQ ID NO: 310224 - RNA, 20 nt, Human
caaagaggccuggaauggug

SEQ ID NO: 310225 - RNA, 21 nt, Human
caaaugacacgccaggagccc

SEQ ID NO: 310226 - RNA, 21 nt, Human
caaaugacacgccaggagccc

SEQ ID NO: 310227 - RNA, 25 nt, Human
caaguguuuauugagcagccacauc

SEQ ID NO: 310228 - RNA, 25 nt, Human
caaguguuuauugagcagccacauc

SEQ ID NO: 310229 - RNA, 25 nt, Human
caaguguuuauugagcagccacauc

SEQ ID NO: 310230 - RNA, 25 nt, Human
caaguguuuauugagcagccacauc

SEQ ID NO: 310231 - RNA, 23 nt, Human
caauacagaaccucagacugagg

SEQ ID NO: 310232 - RNA, 18 nt, Human
cacagacuucaccagugu

SEQ ID NO: 310233 - RNA, 24 nt, Human
cacagccagauggccgcucugacc

SEQ ID NO: 310234 - RNA, 20 nt, Human
caccagagacuccaagcugg

SEQ ID NO: 310235 - RNA, 18 nt, Human
cacccaagguaguggcag

SEQ ID NO: 310236 - RNA, 18 nt, Human
cacgguggacggcagggc

SEQ ID NO: 310237 - RNA, 18 nt, Human
cacgguggacggcagggc

SEQ ID NO: 310238 - RNA, 24 nt, Human
cacugcacagucagagauagggac

SEQ ID NO: 310239 - RNA, 23 nt, Human
cacuuucauugucaaucuugagg

SEQ ID NO: 310240 - RNA, 19 nt, Human
cagaacaccccucaaucac

SEQ ID NO: 310241 - RNA, 23 nt, Human
cagaaccucagacugagggcugg

SEQ ID NO: 310242 - RNA, 19 nt, Human
cagacuucaccagugugaa

SEQ ID NO: 310243 - RNA, 25 nt, Human
cagagaagacccaggucucccugcc

SEQ ID NO: 310244 - RNA, 25 nt, Human
cagagaagacccaggucucccugcc

SEQ ID NO: 310245 - RNA, 25 nt, Human
cagagaagacccaggucucccugcc

SEQ ID NO: 310246 - RNA, 18 nt, Human
cagaggccugugguagag

SEQ ID NO: 310247 - RNA, 20 nt, Human
cagcagagacuggacuggcg

SEQ ID NO: 310248 - RNA, 20 nt, Human
cagcagagacuggacuggcg

SEQ ID NO: 310249 - RNA, 21 nt, Human
cagccucuaguaauaaaccuc

SEQ ID NO: 310250 - RNA, 19 nt, Human
cagcucaggggccgggcag

SEQ ID NO: 310251 - RNA, 19 nt, Human
cagcucaggggccgggcag

SEQ ID NO: 310252 - RNA, 19 nt, Human
cagcucaggggccgggcag

SEQ ID NO: 310253 - RNA, 20 nt, Human
cagcugucauuuggagacug

SEQ ID NO: 310254 - RNA, 22 nt, Human
caggaagagccaagggccaugc

SEQ ID NO: 310255 - RNA, 20 nt, Human
caggagcccaggugagccgg

SEQ ID NO: 310256 - RNA, 20 nt, Human
caggagcccaggugagccgg

SEQ ID NO: 310257 - RNA, 21 nt, Human
caggcuggaggcuccuugugc

SEQ ID NO: 310258 - RNA, 21 nt, Human
caggcuggaggcuccuugugc

SEQ ID NO: 310259 - RNA, 20 nt, Human
cagugggcccagucucccuu

SEQ ID NO: 310260 - RNA, 18 nt, Human
caucaaaauucacuguga

SEQ ID NO: 310261 - RNA, 21 nt, Human
caucggggguggcagccugcu

SEQ ID NO: 310262 - RNA, 21 nt, Human
caucggggguggcagccugcu

SEQ ID NO: 310263 - RNA, 23 nt, Human
caucugccaggucuugggauagc

SEQ ID NO: 310264 - RNA, 23 nt, Human
caucugccaggucuugggauagc

SEQ ID NO: 310265 - RNA, 23 nt, Human
caucugccaggucuugggauagc

SEQ ID NO: 310266 - RNA, 20 nt, Human
caucuuuauucaagccagca

SEQ ID NO: 310267 - RNA, 20 nt, Human
caucuuuauucaagccagca

SEQ ID NO: 310268 - RNA, 18 nt, Human
caugucaagcugggaagc

SEQ ID NO: 310269 - RNA, 19 nt, Human
ccaagcuggucacccccuc

SEQ ID NO: 310270 - RNA, 18 nt, Human
ccacaggucugcauuucu

SEQ ID NO: 310271 - RNA, 25 nt, Human
ccaccagagacuccaagcuggucac

SEQ ID NO: 310272 - RNA, 22 nt, Human
ccacugggauaaaugggaggag

SEQ ID NO: 310273 - RNA, 22 nt, Human
ccacugggauaaaugggaggag

SEQ ID NO: 310274 - RNA, 18 nt, Human
ccaggacccugagggugc

SEQ ID NO: 310275 - RNA, 19 nt, Human
cccacgguggacggcaggg

SEQ ID NO: 310276 - RNA, 19 nt, Human
cccacgguggacggcaggg

SEQ ID NO: 310277 - RNA, 20 nt, Human
ccccuuggaggagcagucua

SEQ ID NO: 310278 - RNA, 20 nt, Human
cccggagggagcggcugcgg

SEQ ID NO: 310279 - RNA, 20 nt, Human
cccggagggagcggcugcgg

SEQ ID NO: 310280 - RNA, 19 nt, Human
ccucaggggccacccaguc

SEQ ID NO: 310281 - RNA, 19 nt, Human
ccucccugguucuagcucc

SEQ ID NO: 310282 - RNA, 23 nt, Human
ccucugggcagguggaggguggg

SEQ ID NO: 310283 - RNA, 22 nt, Human
ccugcacuucuuuuugggacuc

SEQ ID NO: 310284 - RNA, 22 nt, Human
ccugcacuucuuuuugggacuc

SEQ ID NO: 310285 - RNA, 22 nt, Human
ccugcccccaccacggaagaca

SEQ ID NO: 310286 - RNA, 22 nt, Human
ccugcccccaccacggaagaca

SEQ ID NO: 310287 - RNA, 19 nt, Human
ccugccucuguucugcugu

SEQ ID NO: 310288 - RNA, 18 nt, Human
cgaaggcggauggcucuc

SEQ ID NO: 310289 - RNA, 23 nt, Human
cgggaggacgaguuuucggcauc

SEQ ID NO: 310290 - RNA, 25 nt, Human
cgggaucgcacagccccucguaucc

SEQ ID NO: 310291 - RNA, 20 nt, Human
cguggaggccaaucagccca

SEQ ID NO: 310292 - RNA, 24 nt, Human
cuaugagagcagcgguucucaaac

SEQ ID NO: 310293 - RNA, 23 nt, Human
cucagaggccugcuuuccauucc

SEQ ID NO: 310294 - RNA, 18 nt, Human
cucagccagagaagaccc

SEQ ID NO: 310295 - RNA, 19 nt, Human
cucagggaccccaucccuc

SEQ ID NO: 310296 - RNA, 22 nt, Human
cuccauggagccucugacagag

SEQ ID NO: 310297 - RNA, 22 nt, Human
cuccauggagccucugacagag

SEQ ID NO: 310298 - RNA, 23 nt, Human
cuccuggcccugguguaguggga

SEQ ID NO: 310299 - RNA, 25 nt, Human
cuccuggcccugguguagugggagg

SEQ ID NO: 310300 - RNA, 24 nt, Human
cucguccaggacccugagggugcu

SEQ ID NO: 310301 - RNA, 19 nt, Human
cucuagggacagaaggguc

SEQ ID NO: 310302 - RNA, 28 nt, Human
cucuaguaauaaaccucuaggguacccc

SEQ ID NO: 310303 - RNA, 21 nt, Human
cucugcccaccagagacucca

SEQ ID NO: 310304 - RNA, 20 nt, Human
cucugggcagguggagggug

SEQ ID NO: 310305 - RNA, 23 nt, Human
cucugugcagggccuguaagagc

SEQ ID NO: 310306 - RNA, 23 nt, Human
cucugugcagggccuguaagagc

SEQ ID NO: 310307 - RNA, 20 nt, Human
cugaaccaaaugacaacuga

SEQ ID NO: 310308 - RNA, 20 nt, Human
cugccaggucuugggauagc

SEQ ID NO: 310309 - RNA, 22 nt, Human
cugcccaccagagacuccaagc

SEQ ID NO: 310310 - RNA, 25 nt, Human
cuggaggaggcagcucaggggccgg

SEQ ID NO: 310311 - RNA, 25 nt, Human
cuggaggaggcagcucaggggccgg

SEQ ID NO: 310312 - RNA, 25 nt, Human
cuggaggaggcagcucaggggccgg

SEQ ID NO: 310313 - RNA, 19 nt, Human
cuggcagauggcucugccu

SEQ ID NO: 310314 - RNA, 19 nt, Human
cuggcagauggcucugccu

SEQ ID NO: 310315 - RNA, 21 nt, Human
cuggggugguccaggcaugca

SEQ ID NO: 310316 - RNA, 22 nt, Human
cuguuuuaacagucuggcauca

SEQ ID NO: 310317 - RNA, 22 nt, Human
cuugagaggccuccauggagcc

SEQ ID NO: 310318 - RNA, 22 nt, Human
cuugagaggccuccauggagcc

SEQ ID NO: 310319 - RNA, 23 nt, Human
gaagagaagcugaaggggaggcg

SEQ ID NO: 310320 - RNA, 23 nt, Human
gaaggcacuuugaguugccaugg

SEQ ID NO: 310321 - RNA, 24 nt, Human
gaaggggagggcaaaaaaguuguu

SEQ ID NO: 310322 - RNA, 24 nt, Human
gaaggggagggcaaaaaaguuguu

SEQ ID NO: 310323 - RNA, 18 nt, Human
gacaccccuucacuggcc

SEQ ID NO: 310324 - RNA, 22 nt, Human
gacacuagagcuuaggaaggga

SEQ ID NO: 310325 - RNA, 21 nt, Human
gacaguggaggcagggcagaa

SEQ ID NO: 310326 - RNA, 26 nt, Human
gaccaaagagcaaagcuguggccaag

SEQ ID NO: 310327 - RNA, 22 nt, Human
gaccccaucccucucugcccac

SEQ ID NO: 310328 - RNA, 22 nt, Human
gacggcugagggugagggcagu

SEQ ID NO: 310329 - RNA, 24 nt, Human
gagcaugcaccagcaucaccggga

SEQ ID NO: 310330 - RNA, 18 nt, Human
gagcaugggcuggaggag

SEQ ID NO: 310331 - RNA, 18 nt, Human
gagcaugggcuggaggag

SEQ ID NO: 310332 - RNA, 18 nt, Human
gagcaugggcuggaggag

SEQ ID NO: 310333 - RNA, 19 nt, Human
gagcaugggcuggaggagg

SEQ ID NO: 310334 - RNA, 19 nt, Human
gagcaugggcuggaggagg

SEQ ID NO: 310335 - RNA, 19 nt, Human
gagcaugggcuggaggagg

SEQ ID NO: 310336 - RNA, 24 nt, Human
gagcggcugcgggaucgcacagcc

SEQ ID NO: 310337 - RNA, 24 nt, Human
gagcggcugcgggaucgcacagcc

SEQ ID NO: 310338 - RNA, 22 nt, Human
gagcuaaugaguagggauggga

SEQ ID NO: 310339 - RNA, 19 nt, Human
gaggagccccggagggagc

SEQ ID NO: 310340 - RNA, 19 nt, Human
gaggagccccggagggagc

SEQ ID NO: 310341 - RNA, 19 nt, Human
gaggaggaggaaggggcug

SEQ ID NO: 310342 - RNA, 21 nt, Human
gagggcaaaaaaguuguugag

SEQ ID NO: 310343 - RNA, 23 nt, Human
gaggggcccugugauggcaggag

SEQ ID NO: 310344 - RNA, 23 nt, Human
gaggggcccugugauggcaggag

SEQ ID NO: 310345 - RNA, 19 nt, Human
gaggucaaagaaaaccaga

SEQ ID NO: 310346 - RNA, 21 nt, Human
gaggugccggcucagggcccg

SEQ ID NO: 310347 - RNA, 21 nt, Human
gagugcgugaagagaagcuga

SEQ ID NO: 310348 - RNA, 21 nt, Human
gaguuuucggcaucugagucu

SEQ ID NO: 310349 - RNA, 18 nt, Human
gaugaggccccucuggga

SEQ ID NO: 310350 - RNA, 18 nt, Human
gcacagccagauggccgc

SEQ ID NO: 310351 - RNA, 19 nt, Human
gcagaacaccccucaauca

SEQ ID NO: 310352 - RNA, 21 nt, Human
gccagagcucagagcucuccu

SEQ ID NO: 310353 - RNA, 22 nt, Human
gccagagcucagagcucuccug

SEQ ID NO: 310354 - RNA, 22 nt, Human
gccagagcucagagcucuccug

SEQ ID NO: 310355 - RNA, 18 nt, Human
gccccggagggagcggcu

SEQ ID NO: 310356 - RNA, 18 nt, Human
gccccggagggagcggcu

SEQ ID NO: 310357 - RNA, 23 nt, Human
gcccugugauggcaggagugcug

SEQ ID NO: 310358 - RNA, 23 nt, Human
gcccugugauggcaggagugcug

SEQ ID NO: 310359 - RNA, 18 nt, Human
gccugcucagcgggcugg

SEQ ID NO: 310360 - RNA, 18 nt, Human
gccugcucagcgggcugg

SEQ ID NO: 310361 - RNA, 20 nt, Human
gcggacaacccugaccugcc

SEQ ID NO: 310362 - RNA, 20 nt, Human
gcugcaguuguuggccagag

SEQ ID NO: 310363 - RNA, 20 nt, Human
gcugcaguuguuggccagag

SEQ ID NO: 310364 - RNA, 23 nt, Human
gcugugauggguggggccuggcu

SEQ ID NO: 310365 - RNA, 23 nt, Human
gcuuagauccuggcagaggccua

SEQ ID NO: 310366 - RNA, 23 nt, Human
gcuuagauccuggcagaggccua

SEQ ID NO: 310367 - RNA, 18 nt, Human
ggaaggagggaggaggag

SEQ ID NO: 310368 - RNA, 20 nt, Human
ggaccacauggggagaccaa

SEQ ID NO: 310369 - RNA, 20 nt, Human
ggaccacauggggagaccaa

SEQ ID NO: 310370 - RNA, 19 nt, Human
ggacuggcgaggagugggc

SEQ ID NO: 310371 - RNA, 19 nt, Human
ggacuggcgaggagugggc

SEQ ID NO: 310372 - RNA, 21 nt, Human
ggacuggcgaggagugggcug

SEQ ID NO: 310373 - RNA, 21 nt, Human
ggacuggcgaggagugggcug

SEQ ID NO: 310374 - RNA, 18 nt, Human
ggaggccaagcugggggg

SEQ ID NO: 310375 - RNA, 18 nt, Human
ggaggccaagcugggggg

SEQ ID NO: 310376 - RNA, 20 nt, Human
ggagggagcggcugcgggau

SEQ ID NO: 310377 - RNA, 20 nt, Human
ggagggagcggcugcgggau

SEQ ID NO: 310378 - RNA, 22 nt, Human
ggagggcaaaaaaguuguugag

SEQ ID NO: 310379 - RNA, 22 nt, Human
ggagggcaaaaaaguuguugag

SEQ ID NO: 310380 - RNA, 19 nt, Human
ggagugcucugcccagccu

SEQ ID NO: 310381 - RNA, 19 nt, Human
ggagugcucugcccagccu

SEQ ID NO: 310382 - RNA, 24 nt, Human
ggagugcuggcuuggaccacaugg

SEQ ID NO: 310383 - RNA, 24 nt, Human
ggagugcuggcuuggaccacaugg

SEQ ID NO: 310384 - RNA, 21 nt, Human
ggcagggcagaacaccccuca

SEQ ID NO: 310385 - RNA, 23 nt, Human
ggcaggggcuggggucagggcag

SEQ ID NO: 310386 - RNA, 22 nt, Human
ggccagagcucagagcucuccu

SEQ ID NO: 310387 - RNA, 19 nt, Human
ggccccacccugaagauuc

SEQ ID NO: 310388 - RNA, 21 nt, Human
ggccuggcagauggcucugcc

SEQ ID NO: 310389 - RNA, 21 nt, Human
ggccuggcagauggcucugcc

SEQ ID NO: 310390 - RNA, 21 nt, Human
ggcuggggucagggcagagcu

SEQ ID NO: 310391 - RNA, 24 nt, Human
ggcuuagauccuggcagaggccua

SEQ ID NO: 310392 - RNA, 24 nt, Human
ggcuuagauccuggcagaggccua

SEQ ID NO: 310393 - RNA, 19 nt, Human
ggcuuggggugggggucgg

SEQ ID NO: 310394 - RNA, 19 nt, Human
ggcuuggggugggggucgg

SEQ ID NO: 310395 - RNA, 19 nt, Human
ggcuuggggugggggucgg

SEQ ID NO: 310396 - RNA, 19 nt, Human
ggcuuggggugggggucgg

SEQ ID NO: 310397 - RNA, 23 nt, Human
gggaacaagacccuacggaauuc

SEQ ID NO: 310398 - RNA, 20 nt, Human
gggacacuagagcuuaggaa

SEQ ID NO: 310399 - RNA, 22 nt, Human
gggagcuaaugaguagggaugg

SEQ ID NO: 310400 - RNA, 22 nt, Human
gggagggcuggggugguccagg

SEQ ID NO: 310401 - RNA, 24 nt, Human
gggaucgcacagccccucguaucc

SEQ ID NO: 310402 - RNA, 18 nt, Human
gggaugaaaggagaaggg

SEQ ID NO: 310403 - RNA, 21 nt, Human
gggcaggggcuggggucaggg

SEQ ID NO: 310404 - RNA, 26 nt, Human
gggcagggguguuggcugcaaggucg

SEQ ID NO: 310405 - RNA, 26 nt, Human
gggcagggguguuggcugcaaggucg

SEQ ID NO: 310406 - RNA, 26 nt, Human
gggcagggguguuggcugcaaggucg

SEQ ID NO: 310407 - RNA, 20 nt, Human
gggcuggggucagggcagag

SEQ ID NO: 310408 - RNA, 21 nt, Human
gggcuggggucagggcagagc

SEQ ID NO: 310409 - RNA, 18 nt, Human
gggcuggggugguccagg

SEQ ID NO: 310410 - RNA, 20 nt, Human
ggggaggccaagcugggggg

SEQ ID NO: 310411 - RNA, 20 nt, Human
ggggaggccaagcugggggg

SEQ ID NO: 310412 - RNA, 22 nt, Human
ggggagggcaaaaaaguuguug

SEQ ID NO: 310413 - RNA, 22 nt, Human
ggggagggcaaaaaaguuguug

SEQ ID NO: 310414 - RNA, 21 nt, Human
gggguagccccaggagaaccc

SEQ ID NO: 310415 - RNA, 19 nt, Human
ggguacacagacuucacca

SEQ ID NO: 310416 - RNA, 23 nt, Human
ggugucugugcagccaggaggaa

SEQ ID NO: 310417 - RNA, 21 nt, Human
gucacuacccacgaggccacc

SEQ ID NO: 310418 - RNA, 19 nt, Human
gucagcagguguccagggg

SEQ ID NO: 310419 - RNA, 21 nt, Human
guccaggggcaggggcugggg

SEQ ID NO: 310420 - RNA, 22 nt, Human
gucucccuuccuccuuccaucu

SEQ ID NO: 310421 - RNA, 21 nt, Human
gugcucagcuuuggaaccuuc

SEQ ID NO: 310422 - RNA, 24 nt, Human
gugcugggcacuccuugggacggc

SEQ ID NO: 310423 - RNA, 25 nt, Human
gugcuggggccuuccagcuggaggu

SEQ ID NO: 310424 - RNA, 18 nt, Human
gugggggacccuaaccuc

SEQ ID NO: 310425 - RNA, 24 nt, Human
guguagugggagggcugggguggu

SEQ ID NO: 310426 - RNA, 25 nt, Human
uaagaagcucccaggggaugcugaa

SEQ ID NO: 310427 - RNA, 24 nt, Human
uaaugaguagggaugggaaggagg

SEQ ID NO: 310428 - RNA, 20 nt, Human
uacagaaccucagacugagg

SEQ ID NO: 310429 - RNA, 24 nt, Human
uagaggacagaaaaugcauaagga

SEQ ID NO: 310430 - RNA, 22 nt, Human
uagccagcaucaccucagacug

SEQ ID NO: 310431 - RNA, 20 nt, Human
uauucagauccccuuuuccc

SEQ ID NO: 310432 - RNA, 20 nt, Human
ucaccagugugaaagcugag

SEQ ID NO: 310433 - RNA, 19 nt, Human
ucacucaggaccucccugg

SEQ ID NO: 310434 - RNA, 21 nt, Human
ucagaacacaggagagugcaa

SEQ ID NO: 310435 - RNA, 21 nt, Human
ucagaacacaggagagugcaa

SEQ ID NO: 310436 - RNA, 21 nt, Human
ucagaauacaggagagugcaa

SEQ ID NO: 310437 - RNA, 21 nt, Human
ucagaauacaggagagugcaa

SEQ ID NO: 310438 - RNA, 21 nt, Human
ucagagcucuccugggccugg

SEQ ID NO: 310439 - RNA, 21 nt, Human
ucagagcucuccugggccugg

SEQ ID NO: 310440 - RNA, 23 nt, Human
ucagccaugccuuagccuucccc

SEQ ID NO: 310441 - RNA, 23 nt, Human
ucagccaugccuuagccuucccc

SEQ ID NO: 310442 - RNA, 20 nt, Human
ucagcgggcugguggggagg

SEQ ID NO: 310443 - RNA, 20 nt, Human
ucagcgggcugguggggagg

SEQ ID NO: 310444 - RNA, 19 nt, Human
ucaggcuuuggaagcagga

SEQ ID NO: 310445 - RNA, 20 nt, Human
ucaggggccgggcaggggug

SEQ ID NO: 310446 - RNA, 20 nt, Human
ucaggggccgggcaggggug

SEQ ID NO: 310447 - RNA, 20 nt, Human
ucaggggccgggcaggggug

SEQ ID NO: 310448 - RNA, 21 nt, Human
uccaagagucugggcucugcu

SEQ ID NO: 310449 - RNA, 21 nt, Human
uccacugccucagaggccugc

SEQ ID NO: 310450 - RNA, 22 nt, Human
uccacugccucagaggccugcu

SEQ ID NO: 310451 - RNA, 20 nt, Human
uccccagggggaacaccugc

SEQ ID NO: 310452 - RNA, 21 nt, Human
uccccugcccccaccacggaa

SEQ ID NO: 310453 - RNA, 19 nt, Human
ucccucucugcccaccaga

SEQ ID NO: 310454 - RNA, 21 nt, Human
uccggucgugggaacaagacc

SEQ ID NO: 310455 - RNA, 22 nt, Human
uccugggccuggcagauggcuc

SEQ ID NO: 310456 - RNA, 22 nt, Human
uccugggccuggcagauggcuc

SEQ ID NO: 310457 - RNA, 21 nt, Human
uccuugggacggcugagggug

SEQ ID NO: 310458 - RNA, 21 nt, Human
ucgggaggacgaguuuucggc

SEQ ID NO: 310459 - RNA, 20 nt, Human
ucuagggacagaagggucac

SEQ ID NO: 310460 - RNA, 21 nt, Human
ucuagggacagaagggucacu

SEQ ID NO: 310461 - RNA, 21 nt, Human
ucuaguaauaaaccucuaggg

SEQ ID NO: 310462 - RNA, 19 nt, Human
ucucagccagagaagaccc

SEQ ID NO: 310463 - RNA, 19 nt, Human
ucucagccagagaagaccc

SEQ ID NO: 310464 - RNA, 19 nt, Human
ucucagccagagaagaccc

SEQ ID NO: 310465 - RNA, 21 nt, Human
ucuccugggccuggcagaugg

SEQ ID NO: 310466 - RNA, 21 nt, Human
ucuccugggccuggcagaugg

SEQ ID NO: 310467 - RNA, 20 nt, Human
ugaagagaagcugaagggga

SEQ ID NO: 310468 - RNA, 21 nt, Human
ugacagaaguuucuuucuugg

SEQ ID NO: 310469 - RNA, 21 nt, Human
ugacagaaguuucuuucuugg

SEQ ID NO: 310470 - RNA, 21 nt, Human
ugacagaaguuucuuucuugg

SEQ ID NO: 310471 - RNA, 21 nt, Human
ugacagaaguuucuuucuugg

SEQ ID NO: 310472 - RNA, 23 nt, Human
ugaggcucagcaucggggguggc

SEQ ID NO: 310473 - RNA, 23 nt, Human
ugaggcucagcaucggggguggc

SEQ ID NO: 310474 - RNA, 25 nt, Human
ugagggcuggaagagaccucagggg

SEQ ID NO: 310475 - RNA, 21 nt, Human
ugaggggucugguggccugag

SEQ ID NO: 310476 - RNA, 18 nt, Human
ugaggucaucagccaugg

SEQ ID NO: 310477 - RNA, 24 nt, Human
ugaguugccaugggcugccagggc

SEQ ID NO: 310478 - RNA, 19 nt, Human
ugauggguggggccuggcu

SEQ ID NO: 310479 - RNA, 22 nt, Human
ugccaggucuugggauagccag

SEQ ID NO: 310480 - RNA, 22 nt, Human
ugccaggucuugggauagccag

SEQ ID NO: 310481 - RNA, 22 nt, Human
ugccaggucuugggauagccag

SEQ ID NO: 310482 - RNA, 22 nt, Human
ugccaggucuugggauagccag

SEQ ID NO: 310483 - RNA, 22 nt, Human
ugccucagaggccugcuuucca

SEQ ID NO: 310484 - RNA, 21 nt, Human
ugccuuagccuuccccucuca

SEQ ID NO: 310485 - RNA, 21 nt, Human
ugccuuagccuuccccucuca

SEQ ID NO: 310486 - RNA, 21 nt, Human
ugccuuagccuuccccucuca

SEQ ID NO: 310487 - RNA, 21 nt, Human
ugccuuagccuuccccucuca

SEQ ID NO: 310488 - RNA, 21 nt, Human
ugcgugaagagaagcugaagg

SEQ ID NO: 310489 - RNA, 22 nt, Human
ugcugugauggguggggccugg

SEQ ID NO: 310490 - RNA, 20 nt, Human
ugcuugggggucagcaaggu

SEQ ID NO: 310491 - RNA, 21 nt, Human
uggaaggaggggcuaauagga

SEQ ID NO: 310492 - RNA, 20 nt, Human
uggaaugguggcuugaaucu

SEQ ID NO: 310493 - RNA, 20 nt, Human
uggaaugguggcuugaaucu

SEQ ID NO: 310494 - RNA, 20 nt, Human
uggaaugguggcuugaaucu

SEQ ID NO: 310495 - RNA, 20 nt, Human
uggaaugguggcuugaaucu

SEQ ID NO: 310496 - RNA, 18 nt, Human
uggaggagaaggggaggg

SEQ ID NO: 310497 - RNA, 18 nt, Human
uggaggagaaggggaggg

SEQ ID NO: 310498 - RNA, 19 nt, Human
uggaggagaaggggagggc

SEQ ID NO: 310499 - RNA, 19 nt, Human
uggaggagaaggggagggc

SEQ ID NO: 310500 - RNA, 21 nt, Human
uggaggagcagucuaugagag

SEQ ID NO: 310501 - RNA, 23 nt, Human
uggagugcgugaagagaagcuga

SEQ ID NO: 310502 - RNA, 20 nt, Human
uggauggagucaaaccucac

SEQ ID NO: 310503 - RNA, 20 nt, Human
uggcagauggcucugccugc

SEQ ID NO: 310504 - RNA, 20 nt, Human
uggcagauggcucugccugc

SEQ ID NO: 310505 - RNA, 22 nt, Human
uggcagccugcucagcgggcuu

SEQ ID NO: 310506 - RNA, 22 nt, Human
uggcagccugcucagcgggcuu

SEQ ID NO: 310507 - RNA, 19 nt, Human
uggcaggagugcuggcuug

SEQ ID NO: 310508 - RNA, 19 nt, Human
uggcaggagugcuggcuug

SEQ ID NO: 310509 - RNA, 22 nt, Human
uggccagagcucagagcucucc

SEQ ID NO: 310510 - RNA, 22 nt, Human
uggccagagcucagagcucucc

SEQ ID NO: 310511 - RNA, 21 nt, Human
uggccccuauauagcugcccu

SEQ ID NO: 310512 - RNA, 22 nt, Human
uggccccuauauagcugcccuu

SEQ ID NO: 310513 - RNA, 18 nt, Human
uggccugaggaccaaaga

SEQ ID NO: 310514 - RNA, 22 nt, Human
uggcugcaguuguuggccagag

SEQ ID NO: 310515 - RNA, 22 nt, Human
uggcugcaguuguuggccagag

SEQ ID NO: 310516 - RNA, 20 nt, Human
ugggaagccauggaggagaa

SEQ ID NO: 310517 - RNA, 20 nt, Human
ugggaagccauggaggagaa

SEQ ID NO: 310518 - RNA, 23 nt, Human
ugggaaggagggaggaggaggaa

SEQ ID NO: 310519 - RNA, 22 nt, Human
ugggacugggcugauggggggc

SEQ ID NO: 310520 - RNA, 22 nt, Human
ugggacugggcugauggggggc

SEQ ID NO: 310521 - RNA, 22 nt, Human
ugggauggauggggcaagacca

SEQ ID NO: 310522 - RNA, 18 nt, Human
ugggcuggaggaggcagc

SEQ ID NO: 310523 - RNA, 18 nt, Human
ugggcuggaggaggcagc

SEQ ID NO: 310524 - RNA, 18 nt, Human
ugggcuggaggaggcagc

SEQ ID NO: 310525 - RNA, 22 nt, Human
ugggcuggaggaggcagcucag

SEQ ID NO: 310526 - RNA, 22 nt, Human
ugggcuggaggaggcagcucag

SEQ ID NO: 310527 - RNA, 22 nt, Human
ugggcuggaggaggcagcucag

SEQ ID NO: 310528 - RNA, 25 nt, Human
ugggcuggcgaggacuguggcucgg

SEQ ID NO: 310529 - RNA, 18 nt, Human
ugggcuggcgaggagugg

SEQ ID NO: 310530 - RNA, 18 nt, Human
ugggcuggcgaggagugg

SEQ ID NO: 310531 - RNA, 21 nt, Human
uggggaggccaagcugggggg

SEQ ID NO: 310532 - RNA, 21 nt, Human
uggggaggccaagcugggggg

SEQ ID NO: 310533 - RNA, 19 nt, Human
uggggugggggucggggca

SEQ ID NO: 310534 - RNA, 19 nt, Human
uggggugggggucggggca

SEQ ID NO: 310535 - RNA, 19 nt, Human
uggggugggggucggggca

SEQ ID NO: 310536 - RNA, 19 nt, Human
uggggugggggucggggca

SEQ ID NO: 310537 - RNA, 20 nt, Human
uggggugggggucggggcau

SEQ ID NO: 310538 - RNA, 20 nt, Human
uggggugggggucggggcau

SEQ ID NO: 310539 - RNA, 20 nt, Human
uggggugggggucggggcau

SEQ ID NO: 310540 - RNA, 20 nt, Human
uggggugggggucggggcau

SEQ ID NO: 310541 - RNA, 28 nt, Human
uggggugggggucggggcauggaaggcu

SEQ ID NO: 310542 - RNA, 28 nt, Human
uggggugggggucggggcauggaaggcu

SEQ ID NO: 310543 - RNA, 28 nt, Human
uggggugggggucggggcauggaaggcu

SEQ ID NO: 310544 - RNA, 28 nt, Human
uggggugggggucggggcauggaaggcu

SEQ ID NO: 310545 - RNA, 20 nt, Human
uggguacacagacuucacca

SEQ ID NO: 310546 - RNA, 21 nt, Human
ugguagagcccacaggucugc

SEQ ID NO: 310547 - RNA, 21 nt, Human
uggucccagagaaagggaacu

SEQ ID NO: 310548 - RNA, 21 nt, Human
ugguguagugggagggcuggg

SEQ ID NO: 310549 - RNA, 22 nt, Human
ugucagcagguguccaggggca

SEQ ID NO: 310550 - RNA, 18 nt, Human
ugugauggcaggagugcu

SEQ ID NO: 310551 - RNA, 18 nt, Human
ugugauggcaggagugcu

SEQ ID NO: 310552 - RNA, 19 nt, Human
uuagaaaggggugggggua

SEQ ID NO: 310553 - RNA, 22 nt, Human
uucaagccagcaaaugacacgc

SEQ ID NO: 310554 - RNA, 22 nt, Human
uucaagccagcaaaugacacgc

SEQ ID NO: 310555 - RNA, 21 nt, Human
uuccagaaaagagacagggcu

SEQ ID NO: 310556 - RNA, 21 nt, Human
uucucuguaggauguuuagag

SEQ ID NO: 310557 - RNA, 21 nt, Human
uucuugggcaaagaggccugg

SEQ ID NO: 310558 - RNA, 21 nt, Human
uucuugggcaaagaggccugg

SEQ ID NO: 310559 - RNA, 21 nt, Human
uucuugggcaaagaggccugg

SEQ ID NO: 310560 - RNA, 21 nt, Human
uucuugggcaaagaggccugg

SEQ ID NO: 310561 - RNA, 23 nt, Human
uuggaccacauggggagaccaag

SEQ ID NO: 310562 - RNA, 23 nt, Human
uuggaccacauggggagaccaag

SEQ ID NO: 310563 - RNA, 22 nt, Human
uuuaaggcggacaucuuuauuc

SEQ ID NO: 310564 - RNA, 22 nt, Human
uuuaaggcggacaucuuuauuc

SEQ ID NO: 310565 - RNA, 26 nt, Human
uuugaguugccaugggcugccagggc

SEQ ID NO: 310566 - RNA, 22 nt, Human
uuuuuuuuuuuuuuaaggcgga

SEQ ID NO: 310567 - RNA, 20 nt, Human
uuuuuuuuuuuuuuugaugg

SEQ ID NO: 310568 - RNA, 20 nt, Human
uuuuuuuuuuuuuuugaugg

SEQ ID NO: 310569 - RNA, 20 nt, Human
uuuuuuuuuuuuuuugaugg

SEQ ID NO: 310570 - RNA, 18 nt, Human
uuuuuuuuuuuuuuuuug

SEQ ID NO: 310571 - RNA, 22 nt, Human
uuuuuuuuuuuuuuuuugaugg

SEQ ID NO: 310572 - RNA, 24 nt, Human
uuuuuuuuuuuuuuuuuuuucaag

SEQ ID NO: 310573 - RNA, 25 nt, Human
uuuuuuuuuuuuuuuuuuuuuaagg

SEQ ID NO: 310574 - RNA, 23 nt, Human
aagaaaccucuucuguaccgaaa

SEQ ID NO: 310575 - RNA, 19 nt, Human
accucaucgcccagggcag

SEQ ID NO: 310576 - RNA, 23 nt, Human
accuuccccaccguaccucaucg

SEQ ID NO: 310577 - RNA, 23 nt, Human
agaaagaaaccucuucuguaccg

SEQ ID NO: 310578 - RNA, 20 nt, Human
agccagugccacuaggagca

SEQ ID NO: 310579 - RNA, 20 nt, Human
agcuguggccuggggcacca

SEQ ID NO: 310580 - RNA, 23 nt, Human
aggcaggcagggcaggcuagauc

SEQ ID NO: 310581 - RNA, 24 nt, Human
aggccuaggccaaacucuucagaa

SEQ ID NO: 310582 - RNA, 28 nt, Human
caaaguucucuaaaauaggcaccuuccc

SEQ ID NO: 310583 - RNA, 18 nt, Human
caagcagcagcuguggcc

SEQ ID NO: 310584 - RNA, 22 nt, Human
ccaacaccaggaccucucuuua

SEQ ID NO: 310585 - RNA, 19 nt, Human
ccccaccguaccucaucgc

SEQ ID NO: 310586 - RNA, 23 nt, Human
ccucucuuuaggccuaggccaaa

SEQ ID NO: 310587 - RNA, 18 nt, Human
cgaaauacaagcagcagc

SEQ ID NO: 310588 - RNA, 23 nt, Human
cuguaccgaaauacaagcagcag

SEQ ID NO: 310589 - RNA, 26 nt, Human
gaaauacaagcagcagcuguggccug

SEQ ID NO: 310590 - RNA, 25 nt, Human
gaggggcccuggcaucuauccaaca

SEQ ID NO: 310591 - RNA, 19 nt, Human
gcagcaggcguccugggcc

SEQ ID NO: 310592 - RNA, 19 nt, Human
ggagcauggggaacacucu

SEQ ID NO: 310593 - RNA, 20 nt, Human
ggcaggcaggcagggcaggc

SEQ ID NO: 310594 - RNA, 21 nt, Human
ggccagaggaggggcccuggc

SEQ ID NO: 310595 - RNA, 21 nt, Human
ggcccuggcaucuauccaaca

SEQ ID NO: 310596 - RNA, 20 nt, Human
gggcccuggcaucuauccaa

SEQ ID NO: 310597 - RNA, 27 nt, Human
gugacaaaguucucuaaaauaggcacc

SEQ ID NO: 310598 - RNA, 19 nt, Human
uaaaauaggcaccuucccc

SEQ ID NO: 310599 - RNA, 19 nt, Human
uaccgaaauacaagcagca

SEQ ID NO: 310600 - RNA, 18 nt, Human
uccacacagacucuggcc

SEQ ID NO: 310601 - RNA, 19 nt, Human
uccacacagacucuggccc

SEQ ID NO: 310602 - RNA, 22 nt, Human
uccccaccguaccucaucgccc

SEQ ID NO: 310603 - RNA, 24 nt, Human
uccuggugcagaaagaaaccucuu

SEQ ID NO: 310604 - RNA, 18 nt, Human
ucuguaccgaaauacaag

SEQ ID NO: 310605 - RNA, 25 nt, Human
aaacuagaggcgaacgccuccagga

SEQ ID NO: 310606 - RNA, 23 nt, Human
aagcaccuggcugugggcuggga

SEQ ID NO: 310607 - RNA, 21 nt, Human
acacugccccacucacagccc

SEQ ID NO: 310608 - RNA, 21 nt, Human
accccgccccucccgcuccca

SEQ ID NO: 310609 - RNA, 19 nt, Human
acucuccagcccagcuguu

SEQ ID NO: 310610 - RNA, 19 nt, Human
agacuagggggcugggggu

SEQ ID NO: 310611 - RNA, 19 nt, Human
agcaggccucagccccaaa

SEQ ID NO: 310612 - RNA, 22 nt, Human
aggaaagaugccgcuggauggc

SEQ ID NO: 310613 - RNA, 18 nt, Human
aggcaggagugcagggca

SEQ ID NO: 310614 - RNA, 20 nt, Human
aggcaggagugcagggcagc

SEQ ID NO: 310615 - RNA, 21 nt, Human
aggcaggagugcagggcagcc

SEQ ID NO: 310616 - RNA, 23 nt, Human
aggcaggagugcagggcagccug

SEQ ID NO: 310617 - RNA, 25 nt, Human
aggcaggagugcagggcagccuggg

SEQ ID NO: 310618 - RNA, 20 nt, Human
agggaaccagguuuagcugu

SEQ ID NO: 310619 - RNA, 18 nt, Human
agggaggguccaggcaca

SEQ ID NO: 310620 - RNA, 21 nt, Human
caaacccccauguuugguauu

SEQ ID NO: 310621 - RNA, 22 nt, Human
cacacugccccacucacagccc

SEQ ID NO: 310622 - RNA, 18 nt, Human
caccuggcugugggcugg

SEQ ID NO: 310623 - RNA, 18 nt, Human
cagagccugccuaggcug

SEQ ID NO: 310624 - RNA, 23 nt, Human
cagcaggccucagccccaaacac

SEQ ID NO: 310625 - RNA, 23 nt, Human
ccaagagggaggguccaggcaca

SEQ ID NO: 310626 - RNA, 23 nt, Human
ccacacaaccccagcaccaagca

SEQ ID NO: 310627 - RNA, 21 nt, Human
ccagcaccaacucuccagccc

SEQ ID NO: 310628 - RNA, 24 nt, Human
ccagcaggccucagccccaaacac

SEQ ID NO: 310629 - RNA, 21 nt, Human
ccaggaagccagccaggggca

SEQ ID NO: 310630 - RNA, 22 nt, Human
cccauguuugguauugaugcag

SEQ ID NO: 310631 - RNA, 18 nt, Human
ccccgccccucccgcucc

SEQ ID NO: 310632 - RNA, 18 nt, Human
cccgccccucccgcuccc

SEQ ID NO: 310633 - RNA, 22 nt, Human
cccugagaaacuagaggcgaac

SEQ ID NO: 310634 - RNA, 20 nt, Human
ccgcuggauggcuguguccu

SEQ ID NO: 310635 - RNA, 23 nt, Human
ccuggccccagacucaggucggc

SEQ ID NO: 310636 - RNA, 21 nt, Human
ccuggcugugggcugggaggc

SEQ ID NO: 310637 - RNA, 20 nt, Human
ccugggcugggucacugcag

SEQ ID NO: 310638 - RNA, 19 nt, Human
ccuuccuucuggaaguuuc

SEQ ID NO: 310639 - RNA, 18 nt, Human
cggggcucagacaguuac

SEQ ID NO: 310640 - RNA, 23 nt, Human
cucacagcccccaucaaggugac

SEQ ID NO: 310641 - RNA, 22 nt, Human
cucagccccaaacacgggaaaa

SEQ ID NO: 310642 - RNA, 19 nt, Human
cuggaaguuucuggcacug

SEQ ID NO: 310643 - RNA, 21 nt, Human
cuguugguucccacuaccucc

SEQ ID NO: 310644 - RNA, 23 nt, Human
gaccccgccccucccgcucccac

SEQ ID NO: 310645 - RNA, 20 nt, Human
gagcacgugugggaggaccc

SEQ ID NO: 310646 - RNA, 21 nt, Human
gcaggagugcagggcagccug

SEQ ID NO: 310647 - RNA, 22 nt, Human
gccacacaaccccagcaccaag

SEQ ID NO: 310648 - RNA, 20 nt, Human
gccaucuguccagcaggccu

SEQ ID NO: 310649 - RNA, 22 nt, Human
gcggaccuagcuguagcugcac

SEQ ID NO: 310650 - RNA, 23 nt, Human
gcugcuuucaccccaccggaucc

SEQ ID NO: 310651 - RNA, 18 nt, Human
ggcaaggacuguuuugcc

SEQ ID NO: 310652 - RNA, 18 nt, Human
ggcugcgggugggugagc

SEQ ID NO: 310653 - RNA, 24 nt, Human
ggcugggaggcaggagugcagggc

SEQ ID NO: 310654 - RNA, 24 nt, Human
ggcuggggguggguggggaagacc

SEQ ID NO: 310655 - RNA, 19 nt, Human
gggcugggggugggugggg

SEQ ID NO: 310656 - RNA, 21 nt, Human
gggugggugagcacguguggg

SEQ ID NO: 310657 - RNA, 20 nt, Human
gguaagaaccggccccaggg

SEQ ID NO: 310658 - RNA, 18 nt, Human
gucagccgggaccccgcc

SEQ ID NO: 310659 - RNA, 23 nt, Human
gucagccgggaccccgccccucc

SEQ ID NO: 310660 - RNA, 22 nt, Human
gugaaggccugggugagugcag

SEQ ID NO: 310661 - RNA, 19 nt, Human
uaccuccggucucggagac

SEQ ID NO: 310662 - RNA, 26 nt, Human
uaccuccggucucggagacagagaag

SEQ ID NO: 310663 - RNA, 27 nt, Human
uagccgcaccuuacaagacacguuggc

SEQ ID NO: 310664 - RNA, 20 nt, Human
uagggggcugggggugggug

SEQ ID NO: 310665 - RNA, 24 nt, Human
uaucacacugccccacucacagcc

SEQ ID NO: 310666 - RNA, 21 nt, Human
ucagccccaaacacgggaaaa

SEQ ID NO: 310667 - RNA, 21 nt, Human
ucagccgggaccccgccccuc

SEQ ID NO: 310668 - RNA, 21 nt, Human
uccacagacccaccaagaggg

SEQ ID NO: 310669 - RNA, 19 nt, Human
uccaccguguucuagcuga

SEQ ID NO: 310670 - RNA, 18 nt, Human
ucccuagggucugcuccc

SEQ ID NO: 310671 - RNA, 26 nt, Human
ucucgcuccaucccugagaaacuaga

SEQ ID NO: 310672 - RNA, 24 nt, Human
ucuggcacuggagguggaagucca

SEQ ID NO: 310673 - RNA, 25 nt, Human
ucuggcacuggagguggaaguccag

SEQ ID NO: 310674 - RNA, 20 nt, Human
ucuuacuguucucuggcugg

SEQ ID NO: 310675 - RNA, 19 nt, Human
ugacaugcaggcgggagcu

SEQ ID NO: 310676 - RNA, 24 nt, Human
ugagacccgggauccuuccagaac

SEQ ID NO: 310677 - RNA, 19 nt, Human
ugagugcagauaggagagc

SEQ ID NO: 310678 - RNA, 18 nt, Human
ugaguguagugaacacag

SEQ ID NO: 310679 - RNA, 22 nt, Human
ugcagagccugccuaggcugcg

SEQ ID NO: 310680 - RNA, 21 nt, Human
ugccuaggcugcgggugggug

SEQ ID NO: 310681 - RNA, 19 nt, Human
ugccuggcauagcaugcag

SEQ ID NO: 310682 - RNA, 21 nt, Human
ugcuggcuugucagccgggac

SEQ ID NO: 310683 - RNA, 19 nt, Human
uggaccuggguaagaaccg

SEQ ID NO: 310684 - RNA, 19 nt, Human
uggcugggcucucgcucca

SEQ ID NO: 310685 - RNA, 20 nt, Human
ugggaggcaggagugcaggg

SEQ ID NO: 310686 - RNA, 19 nt, Human
ugggagguuuggagggaac

SEQ ID NO: 310687 - RNA, 19 nt, Human
uggguaagaaccggcccca

SEQ ID NO: 310688 - RNA, 19 nt, Human
ugggugagcacguguggga

SEQ ID NO: 310689 - RNA, 20 nt, Human
uguucucuggcugggcucuc

SEQ ID NO: 310690 - RNA, 19 nt, Human
uguuugguauugaugcagg

SEQ ID NO: 310691 - RNA, 21 nt, Human
uucucauuaccaaacccccau

SEQ ID NO: 310692 - RNA, 18 nt, Human
uucugaguguagugaaca

SEQ ID NO: 310693 - RNA, 21 nt, Human
uuugccagcaccaacucucca

SEQ ID NO: 310694 - RNA, 18 nt, Human
aaaaagaaacaaacuaca

SEQ ID NO: 310695 - RNA, 20 nt, Human
aaaaagaaacaaacuacagc

SEQ ID NO: 310696 - RNA, 21 nt, Human
aaaaaggcaaacagaaaagaa

SEQ ID NO: 310697 - RNA, 27 nt, Human
aaacagaaaagaaugcaugauguacaa

SEQ ID NO: 310698 - RNA, 24 nt, Human
aaagaaacaaacuacagcugcaug

SEQ ID NO: 310699 - RNA, 22 nt, Human
aagacaaaagcaaaaacaaaua

SEQ ID NO: 310700 - RNA, 20 nt, Human
aagcaaaaacaaauauuugc

SEQ ID NO: 310701 - RNA, 22 nt, Human
aaucuauaugauagaaaccaaa

SEQ ID NO: 310702 - RNA, 25 nt, Human
acacugacuuuuagauuaauucuca

SEQ ID NO: 310703 - RNA, 24 nt, Human
acgaagaucugagugcuagguaua

SEQ ID NO: 310704 - RNA, 19 nt, Human
acuucaaugaagaaaugau

SEQ ID NO: 310705 - RNA, 23 nt, Human
agaaauuauauccuuuuuauuau

SEQ ID NO: 310706 - RNA, 25 nt, Human
agacaaaagcaaaaacaaagggacc

SEQ ID NO: 310707 - RNA, 24 nt, Human
auagcccauucuccuagcuugccu

SEQ ID NO: 310708 - RNA, 19 nt, Human
aucaacaucaacauguuuu

SEQ ID NO: 310709 - RNA, 21 nt, Human
augcauguguauuaucacaca

SEQ ID NO: 310710 - RNA, 21 nt, Human
cacacauauaugcauggaggc

SEQ ID NO: 310711 - RNA, 28 nt, Human
cacauauaugcauggaggcauguguaug

SEQ ID NO: 310712 - RNA, 27 nt, Human
cacgcacauaaaugcauguguauuauc

SEQ ID NO: 310713 - RNA, 22 nt, Human
cacuucaaugaagaaaugauuu

SEQ ID NO: 310714 - RNA, 22 nt, Human
cauggaggcauguguaugcaau

SEQ ID NO: 310715 - RNA, 24 nt, Human
ccaauucuauuccauuuccacauu

SEQ ID NO: 310716 - RNA, 18 nt, Human
ccccuucaagcuggcucu

SEQ ID NO: 310717 - RNA, 24 nt, Human
cucaguuuaggccuuugcauaucu

SEQ ID NO: 310718 - RNA, 19 nt, Human
gaagggacagaaaaaaaug

SEQ ID NO: 310719 - RNA, 18 nt, Human
gcaauggucccccguucc

SEQ ID NO: 310720 - RNA, 21 nt, Human
gcauggaggcauguguaugca

SEQ ID NO: 310721 - RNA, 18 nt, Human
gcuccuuccccauaucuc

SEQ ID NO: 310722 - RNA, 20 nt, Human
gcuggaguagaggcuacccc

SEQ ID NO: 310723 - RNA, 18 nt, Human
gcuuuggaaucauccauu

SEQ ID NO: 310724 - RNA, 21 nt, Human
ggagccccuucaagcuggcuc

SEQ ID NO: 310725 - RNA, 22 nt, Human
gggaagggacagaaaaaaaugu

SEQ ID NO: 310726 - RNA, 23 nt, Human
gggugagagcucaacacaguucu

SEQ ID NO: 310727 - RNA, 21 nt, Human
guaaauauaugcauguguaua

SEQ ID NO: 310728 - RNA, 20 nt, Human
uaaaaaaggcaaacagaaaa

SEQ ID NO: 310729 - RNA, 19 nt, Human
uaaaaagaaacaaacuaca

SEQ ID NO: 310730 - RNA, 25 nt, Human
uaaauuauccauuuuuacuuaacug

SEQ ID NO: 310731 - RNA, 18 nt, Human
uaagacaaaagcaaaaac

SEQ ID NO: 310732 - RNA, 20 nt, Human
uaagacaaaagcaaaaacaa

SEQ ID NO: 310733 - RNA, 24 nt, Human
uacacacacgcacauaaaugcaug

SEQ ID NO: 310734 - RNA, 24 nt, Human
uaccuugcccuugcuuuggaauca

SEQ ID NO: 310735 - RNA, 23 nt, Human
uacuugguaauaaaaagaaacaa

SEQ ID NO: 310736 - RNA, 21 nt, Human
uagaauggauaaacugugaua

SEQ ID NO: 310737 - RNA, 24 nt, Human
uagcagcuuuauucauagcagccg

SEQ ID NO: 310738 - RNA, 22 nt, Human
uagcccauucuccuagcuugcc

SEQ ID NO: 310739 - RNA, 22 nt, Human
uagggguggaacagaaaaggac

SEQ ID NO: 310740 - RNA, 28 nt, Human
uauaauacauauaaacguacauauacau

SEQ ID NO: 310741 - RNA, 24 nt, Human
uauaugcauggaggcauguguagg

SEQ ID NO: 310742 - RNA, 23 nt, Human
uaucacaaaaacaugaugcugaa

SEQ ID NO: 310743 - RNA, 21 nt, Human
uauuuaacucacauuuaccug

SEQ ID NO: 310744 - RNA, 23 nt, Human
uccauagugaacauccugacucc

SEQ ID NO: 310745 - RNA, 18 nt, Human
ugagguguuuuugugucu

SEQ ID NO: 310746 - RNA, 24 nt, Human
ugaguuauauuuaacucacauuua

SEQ ID NO: 310747 - RNA, 19 nt, Human
ugauagaaaccaaaccacu

SEQ ID NO: 310748 - RNA, 24 nt, Human
ugcauguguauacacacacgcaca

SEQ ID NO: 310749 - RNA, 25 nt, Human
ugcauguguauuaucacacacauaa

SEQ ID NO: 310750 - RNA, 22 nt, Human
ugcccuugcuuuggaaucaucc

SEQ ID NO: 310751 - RNA, 23 nt, Human
uggcucaaguuuggccaguggaa

SEQ ID NO: 310752 - RNA, 19 nt, Human
ugggugagagcucaacaca

SEQ ID NO: 310753 - RNA, 22 nt, Human
ugguaauaaaaagaaacaaacu

SEQ ID NO: 310754 - RNA, 24 nt, Human
uguauacacacacgcacauaaaug

SEQ ID NO: 310755 - RNA, 32 nt, Human
uguauacacacacgcacauaaaugcauguggu

SEQ ID NO: 310756 - RNA, 25 nt, Human
uguaugcaauuauaauacauauagu

SEQ ID NO: 310757 - RNA, 25 nt, Human
ugugauauauucauacaaugaaaua

SEQ ID NO: 310758 - RNA, 19 nt, Human
uguguauuaucacacacau

SEQ ID NO: 310759 - RNA, 27 nt, Human
uguguauuaucacacacauauaugcag

SEQ ID NO: 310760 - RNA, 18 nt, Human
uuccuaccuugcccuugc

SEQ ID NO: 310761 - RNA, 20 nt, Human
uugcccuugcuuuggaauca

SEQ ID NO: 310762 - RNA, 22 nt, Human
uuucuugccuucccucauuuca

SEQ ID NO: 310763 - RNA, 20 nt, Human
uuuuggcaauauaccucuau

SEQ ID NO: 310764 - RNA, 21 nt, Human
uuuuuuaacauuacuuucugg

SEQ ID NO: 310765 - RNA, 22 nt, Human
aaaacaaaaauacugagcugga

SEQ ID NO: 310766 - RNA, 19 nt, Human
aaaacaaacaaacaaaaaa

SEQ ID NO: 310767 - RNA, 23 nt, Human
aaaaguguuauaaauagguuuua

SEQ ID NO: 310768 - RNA, 21 nt, Human
aaacaaaaaacaaaacaaaaa

SEQ ID NO: 310769 - RNA, 20 nt, Human
aaacaaaaauacugagcugg

SEQ ID NO: 310770 - RNA, 25 nt, Human
aaacaaaacaaaaauacugagcugg

SEQ ID NO: 310771 - RNA, 24 nt, Human
aaacaaaaggucuggagucuuagc

SEQ ID NO: 310772 - RNA, 25 nt, Human
aaacaaaaggucuggagucuuagca

SEQ ID NO: 310773 - RNA, 23 nt, Human
aaagcaaaaacaaaaggucugga

SEQ ID NO: 310774 - RNA, 27 nt, Human
aacaaaaaacaaaacaaaaauacugag

SEQ ID NO: 310775 - RNA, 25 nt, Human
aacagccuagacccagccaagcucu

SEQ ID NO: 310776 - RNA, 20 nt, Human
aagcaaaaacaaaaggucug

SEQ ID NO: 310777 - RNA, 24 nt, Human
aagcaaaaacaaaaggucuggagu

SEQ ID NO: 310778 - RNA, 19 nt, Human
aagggcuuuuggacauuug

SEQ ID NO: 310779 - RNA, 19 nt, Human
aaugcaaagcaaaaacaaa

SEQ ID NO: 310780 - RNA, 20 nt, Human
acaaaacaaacaaacaaaaa

SEQ ID NO: 310781 - RNA, 24 nt, Human
acaaacaaacaaaaaacaaaacaa

SEQ ID NO: 310782 - RNA, 18 nt, Human
acagaacagccuagaccc

SEQ ID NO: 310783 - RNA, 22 nt, Human
acgcucagagccucagacagac

SEQ ID NO: 310784 - RNA, 19 nt, Human
acugggucacccaccagaa

SEQ ID NO: 310785 - RNA, 20 nt, Human
agacccagccaagcucuagg

SEQ ID NO: 310786 - RNA, 22 nt, Human
agacccgcagccgacagacuaa

SEQ ID NO: 310787 - RNA, 19 nt, Human
aggaaugguaaauccauag

SEQ ID NO: 310788 - RNA, 23 nt, Human
aggcacagaacagccuagaccca

SEQ ID NO: 310789 - RNA, 23 nt, Human
agggagguaucuucuuucagaug

SEQ ID NO: 310790 - RNA, 21 nt, Human
agggcagucagagacccgcag

SEQ ID NO: 310791 - RNA, 19 nt, Human
aguccuuggaggcacagaa

SEQ ID NO: 310792 - RNA, 19 nt, Human
augcaucuuaguccacaca

SEQ ID NO: 310793 - RNA, 19 nt, Human
caaaacaaaaauacugagc

SEQ ID NO: 310794 - RNA, 26 nt, Human
caaaacaaacaaacaaaaaacaaaac

SEQ ID NO: 310795 - RNA, 21 nt, Human
caacagcaacccccaccucca

SEQ ID NO: 310796 - RNA, 18 nt, Human
caacauaaaaagcaaaca

SEQ ID NO: 310797 - RNA, 22 nt, Human
caauacuauguacauauaugua

SEQ ID NO: 310798 - RNA, 22 nt, Human
cagaaaaugcaaagcaaaaaca

SEQ ID NO: 310799 - RNA, 21 nt, Human
caggcuccccgagauguuccc

SEQ ID NO: 310800 - RNA, 20 nt, Human
ccacagggcagucagagacc

SEQ ID NO: 310801 - RNA, 24 nt, Human
cccacagggcagucagagacccgc

SEQ ID NO: 310802 - RNA, 19 nt, Human
cgcucagagccucagacag

SEQ ID NO: 310803 - RNA, 20 nt, Human
cggccaaacagcguaacccc

SEQ ID NO: 310804 - RNA, 21 nt, Human
cugcuuucugguuucccuucc

SEQ ID NO: 310805 - RNA, 20 nt, Human
cuguuucuguuggaugcacu

SEQ ID NO: 310806 - RNA, 21 nt, Human
cuuccaagcagauuucuuugc

SEQ ID NO: 310807 - RNA, 22 nt, Human
gaagauacuccaccuguaaggg

SEQ ID NO: 310808 - RNA, 20 nt, Human
gcaaagcaaaaacaaaaggu

SEQ ID NO: 310809 - RNA, 21 nt, Human
gcaagggcuccaguuugggca

SEQ ID NO: 310810 - RNA, 20 nt, Human
gccuagacccagccaagcuc

SEQ ID NO: 310811 - RNA, 20 nt, Human
gcuagguacaaaagcaguua

SEQ ID NO: 310812 - RNA, 19 nt, Human
gcucagagccucagacaga

SEQ ID NO: 310813 - RNA, 24 nt, Human
ggcuguuucuguuggaugcacugg

SEQ ID NO: 310814 - RNA, 22 nt, Human
gguuugaguuugggauuuuggg

SEQ ID NO: 310815 - RNA, 22 nt, Human
uaaggcaagacccuccccacag

SEQ ID NO: 310816 - RNA, 23 nt, Human
uacaucuucaaucaacagcaacc

SEQ ID NO: 310817 - RNA, 25 nt, Human
uaugccaaugccacaagccguguuu

SEQ ID NO: 310818 - RNA, 23 nt, Human
ucagaaaaugcaaagcaaaaaca

SEQ ID NO: 310819 - RNA, 19 nt, Human
ucagacagaccgucugggc

SEQ ID NO: 310820 - RNA, 24 nt, Human
ucagagccucagacagaccgucug

SEQ ID NO: 310821 - RNA, 18 nt, Human
ucuacaguugguggccaa

SEQ ID NO: 310822 - RNA, 19 nt, Human
ugcaagggauguuaaggca

SEQ ID NO: 310823 - RNA, 24 nt, Human
ugccaaugccacaagccguguuuu

SEQ ID NO: 310824 - RNA, 22 nt, Human
ugccacaagccguguuuuugca

SEQ ID NO: 310825 - RNA, 21 nt, Human
ugccagacaguccuuggaggc

SEQ ID NO: 310826 - RNA, 19 nt, Human
ugcucagcggaguuucugc

SEQ ID NO: 310827 - RNA, 20 nt, Human
uggccaauacaagucauugc

SEQ ID NO: 310828 - RNA, 18 nt, Human
ugggagggagguaucuuc

SEQ ID NO: 310829 - RNA, 20 nt, Human
ugggcuagcucuuuuuucuu

SEQ ID NO: 310830 - RNA, 18 nt, Human
ugggguuucuacccacac

SEQ ID NO: 310831 - RNA, 21 nt, Human
ugggguuucuacccacacuuu

SEQ ID NO: 310832 - RNA, 21 nt, Human
uguacauauauguaaaaagug

SEQ ID NO: 310833 - RNA, 28 nt, Human
uucaaucaacagcaacccccaccuccac

SEQ ID NO: 310834 - RNA, 26 nt, Human
uucccuauguacgcucagagccucag

SEQ ID NO: 310835 - RNA, 20 nt, Human
uuuccagugaguuguuuaga

SEQ ID NO: 310836 - RNA, 21 nt, Human
uuucuuugcagccaaaugcaa

SEQ ID NO: 310837 - RNA, 22 nt, Human
uuugggguuucuacccacacuu

SEQ ID NO: 310838 - RNA, 21 nt, Human
aaauaaccaugugacacauaa

SEQ ID NO: 310839 - RNA, 23 nt, Human
gaaccaauuucaaugguaacuaa

SEQ ID NO: 310840 - RNA, 21 nt, Human
gauaauuuaaaaccagacuca

SEQ ID NO: 310841 - RNA, 21 nt, Human
uaaaaaauaaccaugugacac

SEQ ID NO: 310842 - RNA, 22 nt, Human
uaaaaacaagucagugaauccu

SEQ ID NO: 310843 - RNA, 19 nt, Human
uaacagagcagcuugcugc

SEQ ID NO: 310844 - RNA, 19 nt, Human
ugaaaaaaugggcgaccau

SEQ ID NO: 310845 - RNA, 19 nt, Human
uggaagauagguuaaauga

SEQ ID NO: 310846 - RNA, 26 nt, Human
uuaaaaaauaaccaugugacacauaa

SEQ ID NO: 310847 - RNA, 21 nt, Human
uuaaaaccagacucaugcugu

SEQ ID NO: 310848 - RNA, 22 nt, Human
uucaaugguaacuaaucuucuu

SEQ ID NO: 310849 - RNA, 18 nt, Human
aaagguuagugaagacuc

SEQ ID NO: 310850 - RNA, 19 nt, Human
ugaaaagguucucaagauc

SEQ ID NO: 310851 - RNA, 19 nt, Human
uuuuaaguagcagguuuca

SEQ ID NO: 310852 - RNA, 19 nt, Human
aggaaaccuguccaagaac

SEQ ID NO: 310853 - RNA, 21 nt, Human
auggacaacugcugcggugac

SEQ ID NO: 310854 - RNA, 18 nt, Human
cagcauggacaacugcug

SEQ ID NO: 310855 - RNA, 19 nt, Human
ccauacaggaaaguggaaa

SEQ ID NO: 310856 - RNA, 19 nt, Human
cccgcccauacaggaaagu

SEQ ID NO: 310857 - RNA, 24 nt, Human
ccgcccauacaggaaaguggaaac

SEQ ID NO: 310858 - RNA, 19 nt, Human
ccuauaaucauagguuugu

SEQ ID NO: 310859 - RNA, 28 nt, Human
ccuugaaaagaaccugucgaaaaaaaag

SEQ ID NO: 310860 - RNA, 18 nt, Human
cuggcccugggcuaagca

SEQ ID NO: 310861 - RNA, 24 nt, Human
cuggcccugggcuaagcacuuggg

SEQ ID NO: 310862 - RNA, 22 nt, Human
gaauccuaaccagcccgcccau

SEQ ID NO: 310863 - RNA, 23 nt, Human
ggugacuggagccuugaaaagaa

SEQ ID NO: 310864 - RNA, 22 nt, Human
guggaaacuacagcauggacaa

SEQ ID NO: 310865 - RNA, 24 nt, Human
uccuucaacaaguauuucuuaagc

SEQ ID NO: 310866 - RNA, 26 nt, Human
ucuggcccugggcuaagcacuugggg

SEQ ID NO: 310867 - RNA, 21 nt, Human
ucuuguuuuuccaaguuccac

SEQ ID NO: 310868 - RNA, 20 nt, Human
ugagggauggggugaacgug

SEQ ID NO: 310869 - RNA, 21 nt, Human
uggaauccuaaccagcccgcc

SEQ ID NO: 310870 - RNA, 20 nt, Human
uggacaacugcugcggugac

SEQ ID NO: 310871 - RNA, 19 nt, Human
uucaagguuaaaaaaagaa

SEQ ID NO: 310872 - RNA, 23 nt, Human
caccagcauuuggugcuuccggu

SEQ ID NO: 310873 - RNA, 19 nt, Human
uucagccugcacggcucgu

SEQ ID NO: 310874 - RNA, 23 nt, Human
uuuuuuuuuuuuuuuucuucagg

SEQ ID NO: 310875 - RNA, 23 nt, Human
uuuuuuuuuuuuuuuuuucuuca

SEQ ID NO: 310876 - RNA, 24 nt, Human
uuuuuuuuuuuuuuuuuuuuucuu

SEQ ID NO: 310877 - RNA, 26 nt, Human
aaacaagugguggugguaucccagag

SEQ ID NO: 310878 - RNA, 26 nt, Human
aaacaagugguggugguaucccagag

SEQ ID NO: 310879 - RNA, 20 nt, Human
aaacagaagaagagagaagg

SEQ ID NO: 310880 - RNA, 23 nt, Human
aaacagaagaagagagaagggac

SEQ ID NO: 310881 - RNA, 21 nt, Human
aaacuauauuccuuggccuuc

SEQ ID NO: 310882 - RNA, 18 nt, Human
aaagaaaaagaaauggaa

SEQ ID NO: 310883 - RNA, 19 nt, Human
aaagaaaaagaaauggaag

SEQ ID NO: 310884 - RNA, 19 nt, Human
aaagaaaaagaaauggaag

SEQ ID NO: 310885 - RNA, 21 nt, Human
aaagaaaaagaaauggaagau

SEQ ID NO: 310886 - RNA, 22 nt, Human
aaagagaugugggcaugccuuu

SEQ ID NO: 310887 - RNA, 22 nt, Human
aaagagaugugggcaugccuuu

SEQ ID NO: 310888 - RNA, 25 nt, Human
aaagauggagacaaugagaaaggga

SEQ ID NO: 310889 - RNA, 25 nt, Human
aaagauggagacaaugagaaaggga

SEQ ID NO: 310890 - RNA, 23 nt, Human
aaauguuggaauuuagaaaaacc

SEQ ID NO: 310891 - RNA, 23 nt, Human
aaauguuggaauuuagaaaaacc

SEQ ID NO: 310892 - RNA, 22 nt, Human
aacaaaauaaacacacacagaa

SEQ ID NO: 310893 - RNA, 22 nt, Human
aacaaaauaaacacacacagaa

SEQ ID NO: 310894 - RNA, 20 nt, Human
aacguguuccccccucucug

SEQ ID NO: 310895 - RNA, 28 nt, Human
aagaaaaacaaaauaaacacacacagaa

SEQ ID NO: 310896 - RNA, 29 nt, Human
aagaaaaacaaaauaaacacacacagaaa

SEQ ID NO: 310897 - RNA, 19 nt, Human
aagaagagagaagaagggg

SEQ ID NO: 310898 - RNA, 20 nt, Human
aagaagagagaagaagggga

SEQ ID NO: 310899 - RNA, 23 nt, Human
aagagagaagaaggggugggaga

SEQ ID NO: 310900 - RNA, 26 nt, Human
aagaggacaggguaaggcagugggca

SEQ ID NO: 310901 - RNA, 26 nt, Human
aagaggacaggguaaggcagugggca

SEQ ID NO: 310902 - RNA, 18 nt, Human
aagccuuugugcugugcc

SEQ ID NO: 310903 - RNA, 25 nt, Human
aagcggaggccagcagggcggggga

SEQ ID NO: 310904 - RNA, 22 nt, Human
aauaacaagggggagagaggaa

SEQ ID NO: 310905 - RNA, 18 nt, Human
aaucauucaaagacaaca

SEQ ID NO: 310906 - RNA, 18 nt, Human
aaucauucaaagacaaca

SEQ ID NO: 310907 - RNA, 21 nt, Human
acaaagaaaaagaaauggaag

SEQ ID NO: 310908 - RNA, 21 nt, Human
acaaagaaaaagaaauggaag

SEQ ID NO: 310909 - RNA, 23 nt, Human
acaaagaaaaagaaauggaagaa

SEQ ID NO: 310910 - RNA, 23 nt, Human
acaguagaggcaaucauucugga

SEQ ID NO: 310911 - RNA, 23 nt, Human
acaguagaggcaaucauucugga

SEQ ID NO: 310912 - RNA, 18 nt, Human
accgaucccacccacccc

SEQ ID NO: 310913 - RNA, 21 nt, Human
accgaucccacccaccccccu

SEQ ID NO: 310914 - RNA, 20 nt, Human
acgcagccaauuacauugga

SEQ ID NO: 310915 - RNA, 20 nt, Human
acgcagccaauuacauugga

SEQ ID NO: 310916 - RNA, 24 nt, Human
acuccuguggauucucaggaguug

SEQ ID NO: 310917 - RNA, 21 nt, Human
acuucaaaaggcacaaacugg

SEQ ID NO: 310918 - RNA, 20 nt, Human
acuuuuuccccccagcagau

SEQ ID NO: 310919 - RNA, 20 nt, Human
acuuuuuccccccagcagau

SEQ ID NO: 310920 - RNA, 22 nt, Human
agaacggauagaugacuaaaug

SEQ ID NO: 310921 - RNA, 22 nt, Human
agaacggauagaugacuaaaug

SEQ ID NO: 310922 - RNA, 19 nt, Human
agaagaagagagaagaagg

SEQ ID NO: 310923 - RNA, 21 nt, Human
agaagaagagagaagaagggg

SEQ ID NO: 310924 - RNA, 26 nt, Human
agaagagagaagaaggggugggagag

SEQ ID NO: 310925 - RNA, 21 nt, Human
agagagaagaaggggugggag

SEQ ID NO: 310926 - RNA, 23 nt, Human
agagagaagaaggggugggagag

SEQ ID NO: 310927 - RNA, 21 nt, Human
agagaggaaagcggaggccag

SEQ ID NO: 310928 - RNA, 24 nt, Human
agagagggaggaagagggagggaa

SEQ ID NO: 310929 - RNA, 21 nt, Human
agaggcugauggaaaaaccuu

SEQ ID NO: 310930 - RNA, 21 nt, Human
agaggcugauggaaaaaccuu

SEQ ID NO: 310931 - RNA, 18 nt, Human
agagggagggaaggagag

SEQ ID NO: 310932 - RNA, 19 nt, Human
agccauggcgcuuuucagu

SEQ ID NO: 310933 - RNA, 20 nt, Human
agcuucuauaaagagaacug

SEQ ID NO: 310934 - RNA, 20 nt, Human
agcuucuauaaagagaacug

SEQ ID NO: 310935 - RNA, 22 nt, Human
aggaaggccaaaaaaaaaaaau

SEQ ID NO: 310936 - RNA, 22 nt, Human
aggcaagaguucaagcaccaac

SEQ ID NO: 310937 - RNA, 18 nt, Human
aggcacgaaagagaugug

SEQ ID NO: 310938 - RNA, 19 nt, Human
aggcacgaaagagaugugg

SEQ ID NO: 310939 - RNA, 24 nt, Human
agggaggaagagggagggaaggag

SEQ ID NO: 310940 - RNA, 18 nt, Human
agggagggaaggagagga

SEQ ID NO: 310941 - RNA, 22 nt, Human
agggggagagaggaaagcggag

SEQ ID NO: 310942 - RNA, 25 nt, Human
agggggagagaggaaagcggaggcc

SEQ ID NO: 310943 - RNA, 19 nt, Human
auauauauauauauauaua

SEQ ID NO: 310944 - RNA, 19 nt, Human
auauauauauauauauaua

SEQ ID NO: 310945 - RNA, 19 nt, Human
auauauauauauauauaua

SEQ ID NO: 310946 - RNA, 19 nt, Human
auauauauauauauauaua

SEQ ID NO: 310947 - RNA, 19 nt, Human
auauauauauauauauaua

SEQ ID NO: 310948 - RNA, 19 nt, Human
auauauauauauauauaua

SEQ ID NO: 310949 - RNA, 19 nt, Human
auauauauauauauauaua

SEQ ID NO: 310950 - RNA, 19 nt, Human
auauauauauauauauaua

SEQ ID NO: 310951 - RNA, 19 nt, Human
auauauauauauauauaua

SEQ ID NO: 310952 - RNA, 19 nt, Human
auauauauauauauauaua

SEQ ID NO: 310953 - RNA, 19 nt, Human
aucccacccaccccccucu

SEQ ID NO: 310954 - RNA, 20 nt, Human
aucccacccaccccccucuu

SEQ ID NO: 310955 - RNA, 23 nt, Human
aucccacccaccccccucuuccc

SEQ ID NO: 310956 - RNA, 18 nt, Human
aucccuuccaacucucca

SEQ ID NO: 310957 - RNA, 18 nt, Human
aucuguagcuucaagcuu

SEQ ID NO: 310958 - RNA, 21 nt, Human
augaaugaaagaaaaacaaaa

SEQ ID NO: 310959 - RNA, 21 nt, Human
augaaugaaagaaaaacaaaa

SEQ ID NO: 310960 - RNA, 19 nt, Human
auugcaaacuuaagcuugc

SEQ ID NO: 310961 - RNA, 18 nt, Human
auuuacuuuuucccccca

SEQ ID NO: 310962 - RNA, 22 nt, Human
caaaaaaaaaaaauuggaaaag

SEQ ID NO: 310963 - RNA, 22 nt, Human
caaaauaaacacacacagaaac

SEQ ID NO: 310964 - RNA, 22 nt, Human
caaaauaaacacacacagaaac

SEQ ID NO: 310965 - RNA, 23 nt, Human
caacagaagaaggcuuguuccag

SEQ ID NO: 310966 - RNA, 21 nt, Human
caagaaaacguguuccccccu

SEQ ID NO: 310967 - RNA, 24 nt, Human
caagaaaacguguuccccccucuc

SEQ ID NO: 310968 - RNA, 18 nt, Human
caauauuaaaaagucacc

SEQ ID NO: 310969 - RNA, 21 nt, Human
caauauuaaaaagucacccua

SEQ ID NO: 310970 - RNA, 22 nt, Human
caauucccaugauagaucagau

SEQ ID NO: 310971 - RNA, 22 nt, Human
caauucccaugauagaucagau

SEQ ID NO: 310972 - RNA, 19 nt, Human
cacaaucuccuucuuccuc

SEQ ID NO: 310973 - RNA, 22 nt, Human
cacccuauguucaagucaggag

SEQ ID NO: 310974 - RNA, 19 nt, Human
caccgaucccacccacccc

SEQ ID NO: 310975 - RNA, 21 nt, Human
caccgaucccacccacccccc

SEQ ID NO: 310976 - RNA, 23 nt, Human
caccgaucccacccaccccccuc

SEQ ID NO: 310977 - RNA, 24 nt, Human
cagcauugguugauuuccugaggc

SEQ ID NO: 310978 - RNA, 22 nt, Human
caggcuccaaacucaaggacau

SEQ ID NO: 310979 - RNA, 22 nt, Human
caggcuccaaacucaaggacau

SEQ ID NO: 310980 - RNA, 20 nt, Human
caucacaaucuccuucuucc

SEQ ID NO: 310981 - RNA, 24 nt, Human
ccaacaaagauggagacaaugaga

SEQ ID NO: 310982 - RNA, 24 nt, Human
ccaacaaagauggagacaaugaga

SEQ ID NO: 310983 - RNA, 20 nt, Human
ccacacgcacagacuaaaaa

SEQ ID NO: 310984 - RNA, 18 nt, Human
ccaccccccucuucccgc

SEQ ID NO: 310985 - RNA, 18 nt, Human
ccaggcaagaguucaagc

SEQ ID NO: 310986 - RNA, 18 nt, Human
cccacaauugccuuuuaa

SEQ ID NO: 310987 - RNA, 18 nt, Human
cccacaauugccuuuuaa

SEQ ID NO: 310988 - RNA, 20 nt, Human
cccaccgaucccacccaccc

SEQ ID NO: 310989 - RNA, 24 nt, Human
cccaccgaucccacccaccccccu

SEQ ID NO: 310990 - RNA, 23 nt, Human
cccagcagaugaagaaauaacag

SEQ ID NO: 310991 - RNA, 24 nt, Human
ccccaccgaucccacccacccccc

SEQ ID NO: 310992 - RNA, 25 nt, Human
ccccaccgaucccacccaccccccu

SEQ ID NO: 310993 - RNA, 21 nt, Human
cccccaccgaucccacccacc

SEQ ID NO: 310994 - RNA, 18 nt, Human
ccccccagcagaugaaga

SEQ ID NO: 310995 - RNA, 18 nt, Human
ccccccagcagaugaaga

SEQ ID NO: 310996 - RNA, 18 nt, Human
ccccccuuuccccuucuc

SEQ ID NO: 310997 - RNA, 18 nt, Human
cccccuuuccccuucucu

SEQ ID NO: 310998 - RNA, 19 nt, Human
cccccuuuccccuucucuc

SEQ ID NO: 310999 - RNA, 25 nt, Human
ccccugggagggcagaucucgacuu

SEQ ID NO: 311000 - RNA, 19 nt, Human
ccccuucucucucuccccc

SEQ ID NO: 311001 - RNA, 20 nt, Human
cccuaaugugaaaaugggac

SEQ ID NO: 311002 - RNA, 20 nt, Human
cccuaaugugaaaaugggac

SEQ ID NO: 311003 - RNA, 26 nt, Human
ccgccuuccgcagcauugguugauuu

SEQ ID NO: 311004 - RNA, 18 nt, Human
ccuggcucccagcccuag

SEQ ID NO: 311005 - RNA, 18 nt, Human
ccuggcucccagcccuag

SEQ ID NO: 311006 - RNA, 22 nt, Human
cgaggggggagaggagccgagu

SEQ ID NO: 311007 - RNA, 19 nt, Human
cuaauucauuuaaagcccu

SEQ ID NO: 311008 - RNA, 19 nt, Human
cuaauucauuuaaagcccu

SEQ ID NO: 311009 - RNA, 23 nt, Human
cucagguuggcaaugcuguuggc

SEQ ID NO: 311010 - RNA, 19 nt, Human
cucucccccucuucuugcu

SEQ ID NO: 311011 - RNA, 21 nt, Human
cuggcucccagcccuagacac

SEQ ID NO: 311012 - RNA, 19 nt, Human
cuuccaacucuccaaaagu

SEQ ID NO: 311013 - RNA, 18 nt, Human
cuuugugcugugccugac

SEQ ID NO: 311014 - RNA, 23 nt, Human
cuuugugcugugccugacguuuc

SEQ ID NO: 311015 - RNA, 22 nt, Human
cuuuuuguaaagaguaaaaaaa

SEQ ID NO: 311016 - RNA, 21 nt, Human
gaaaaaccuuaccaugaccaa

SEQ ID NO: 311017 - RNA, 21 nt, Human
gaaaaaccuuaccaugaccaa

SEQ ID NO: 311018 - RNA, 21 nt, Human
gaaaacguguuccccccucuc

SEQ ID NO: 311019 - RNA, 19 nt, Human
gaaucaacaccaaacgcug

SEQ ID NO: 311020 - RNA, 22 nt, Human
gacacuaaacuuuauuucaaaa

SEQ ID NO: 311021 - RNA, 23 nt, Human
gagagggaggaagagggagggaa

SEQ ID NO: 311022 - RNA, 21 nt, Human
gaggaagagggagggaaggag

SEQ ID NO: 311023 - RNA, 19 nt, Human
gagggaaggagaggaaggc

SEQ ID NO: 311024 - RNA, 22 nt, Human
gauaggugucuuaugguuuuug

SEQ ID NO: 311025 - RNA, 22 nt, Human
gauaggugucuuaugguuuuug

SEQ ID NO: 311026 - RNA, 19 nt, Human
gauucuucagaaagacuuu

SEQ ID NO: 311027 - RNA, 19 nt, Human
gauucuucagaaagacuuu

SEQ ID NO: 311028 - RNA, 20 nt, Human
gcaaacagaagaagagagaa

SEQ ID NO: 311029 - RNA, 19 nt, Human
gcagaugaagaaauaacag

SEQ ID NO: 311030 - RNA, 20 nt, Human
gcggaggccagcagggcggg

SEQ ID NO: 311031 - RNA, 26 nt, Human
gcggaggccagcagggcgggggaguu

SEQ ID NO: 311032 - RNA, 19 nt, Human
gcuccaaacucaaggacau

SEQ ID NO: 311033 - RNA, 24 nt, Human
gcugauggaaaaaccuuaccauga

SEQ ID NO: 311034 - RNA, 24 nt, Human
gcugauggaaaaaccuuaccauga

SEQ ID NO: 311035 - RNA, 24 nt, Human
ggaccuguucucaaacagcugccc

SEQ ID NO: 311036 - RNA, 27 nt, Human
gggaauacaagaaaauuggagaccggu

SEQ ID NO: 311037 - RNA, 19 nt, Human
gggagggaaggagaggaag

SEQ ID NO: 311038 - RNA, 24 nt, Human
gggggugggugggcugaaccuauc

SEQ ID NO: 311039 - RNA, 24 nt, Human
gggggugggugggcugaaccuauc

SEQ ID NO: 311040 - RNA, 21 nt, Human
ggugggagagaagaaucaaag

SEQ ID NO: 311041 - RNA, 18 nt, Human
ggugguggugauagugau

SEQ ID NO: 311042 - RNA, 18 nt, Human
ggugguggugauagugau

SEQ ID NO: 311043 - RNA, 30 nt, Human
guaaaaaaaaaaauuaagaauuaaaaaaag

SEQ ID NO: 311044 - RNA, 20 nt, Human
guguuacuagagaaauuucu

SEQ ID NO: 311045 - RNA, 18 nt, Human
guucucaaacagcugccc

SEQ ID NO: 311046 - RNA, 20 nt, Human
uaaaacaucuucaagaaaac

SEQ ID NO: 311047 - RNA, 18 nt, Human
uaaacacacacagaaaca

SEQ ID NO: 311048 - RNA, 20 nt, Human
uaaacacacacagaaacaaa

SEQ ID NO: 311049 - RNA, 21 nt, Human
uaaacacacacagaaacaagu

SEQ ID NO: 311050 - RNA, 21 nt, Human
uaaaucuauagcuuagaugua

SEQ ID NO: 311051 - RNA, 21 nt, Human
uaaaucuauagcuuagaugua

SEQ ID NO: 311052 - RNA, 22 nt, Human
uaagaacaguggugagggugug

SEQ ID NO: 311053 - RNA, 22 nt, Human
uaagaacaguggugagggugug

SEQ ID NO: 311054 - RNA, 20 nt, Human
uaagaugauugauugauuga

SEQ ID NO: 311055 - RNA, 20 nt, Human
uaagaugauugauugauuga

SEQ ID NO: 311056 - RNA, 22 nt, Human
uaaggcacuaagguucaaacaa

SEQ ID NO: 311057 - RNA, 22 nt, Human
uaaggcacuaagguucaaacaa

SEQ ID NO: 311058 - RNA, 20 nt, Human
uacaauauuaaaaagucacc

SEQ ID NO: 311059 - RNA, 18 nt, Human
uaccaaauagucugugac

SEQ ID NO: 311060 - RNA, 18 nt, Human
uagagagcaggauucuca

SEQ ID NO: 311061 - RNA, 18 nt, Human
uagggugagggguggugg

SEQ ID NO: 311062 - RNA, 18 nt, Human
uagggugagggguggugg

SEQ ID NO: 311063 - RNA, 21 nt, Human
uauaaagagaacugggaagag

SEQ ID NO: 311064 - RNA, 21 nt, Human
uauaaagagaacugggaagag

SEQ ID NO: 311065 - RNA, 18 nt, Human
uauaguuucuuuggcugc

SEQ ID NO: 311066 - RNA, 18 nt, Human
uauaguuucuuuggcugc

SEQ ID NO: 311067 - RNA, 25 nt, Human
uauauaaauauauacaguauauaua

SEQ ID NO: 311068 - RNA, 25 nt, Human
uauauaaauauauacaguauauaua

SEQ ID NO: 311069 - RNA, 24 nt, Human
uauauacaguauauauauaagugu

SEQ ID NO: 311070 - RNA, 24 nt, Human
uauauacaguauauauauaagugu

SEQ ID NO: 311071 - RNA, 19 nt, Human
uauauauauauauauauau

SEQ ID NO: 311072 - RNA, 19 nt, Human
uauauauauauauauauau

SEQ ID NO: 311073 - RNA, 19 nt, Human
uauauauauauauauauau

SEQ ID NO: 311074 - RNA, 19 nt, Human
uauauauauauauauauau

SEQ ID NO: 311075 - RNA, 19 nt, Human
uauauauauauauauauau

SEQ ID NO: 311076 - RNA, 19 nt, Human
uauauauauauauauauau

SEQ ID NO: 311077 - RNA, 21 nt, Human
uauauaugaaauauauauaua

SEQ ID NO: 311078 - RNA, 21 nt, Human
uauauaugaaauauauauaua

SEQ ID NO: 311079 - RNA, 20 nt, Human
ucaaaaggcacaaacuggca

SEQ ID NO: 311080 - RNA, 24 nt, Human
ucaaagacaacaaauaucuuuaac

SEQ ID NO: 311081 - RNA, 24 nt, Human
ucaaagacaacaaauaucuuuaac

SEQ ID NO: 311082 - RNA, 24 nt, Human
ucaacaccaaacgcugugggcgcg

SEQ ID NO: 311083 - RNA, 23 nt, Human
ucaagcaccaacagaagaaggcu

SEQ ID NO: 311084 - RNA, 23 nt, Human
ucacaacaccccugugagguagg

SEQ ID NO: 311085 - RNA, 23 nt, Human
ucacaacaccccugugagguagg

SEQ ID NO: 311086 - RNA, 20 nt, Human
ucacagacccccuuucucca

SEQ ID NO: 311087 - RNA, 23 nt, Human
ucauauuccugcuaagugaagaa

SEQ ID NO: 311088 - RNA, 23 nt, Human
ucauauuccugcuaagugaagaa

SEQ ID NO: 311089 - RNA, 18 nt, Human
ucaugggggugggugggc

SEQ ID NO: 311090 - RNA, 18 nt, Human
ucaugggggugggugggc

SEQ ID NO: 311091 - RNA, 25 nt, Human
ucauucuggauauauauauauauau

SEQ ID NO: 311092 - RNA, 25 nt, Human
ucauucuggauauauauauauauau

SEQ ID NO: 311093 - RNA, 28 nt, Human
uccaaagagauaauccacaguaaaauac

SEQ ID NO: 311094 - RNA, 22 nt, Human
uccacacgcacagacuaaaaau

SEQ ID NO: 311095 - RNA, 18 nt, Human
uccacaguaaaauacaau

SEQ ID NO: 311096 - RNA, 23 nt, Human
uccaucacaaucuccuucuuccu

SEQ ID NO: 311097 - RNA, 21 nt, Human
ucccagagggaggaggaacau

SEQ ID NO: 311098 - RNA, 21 nt, Human
ucccagagggaggaggaacau

SEQ ID NO: 311099 - RNA, 22 nt, Human
ucccagcccuagacacuaaacu

SEQ ID NO: 311100 - RNA, 22 nt, Human
ucccagcccuagacacuaaacu

SEQ ID NO: 311101 - RNA, 20 nt, Human
uccccccuuuccccuucucc

SEQ ID NO: 311102 - RNA, 21 nt, Human
ucccgcucgaaucaacaccaa

SEQ ID NO: 311103 - RNA, 23 nt, Human
ucucaaacagcugcccuaucaau

SEQ ID NO: 311104 - RNA, 23 nt, Human
ucucaaacagcugcccuaucaau

SEQ ID NO: 311105 - RNA, 25 nt, Human
ucucaaacagcugcccuaucaauua

SEQ ID NO: 311106 - RNA, 25 nt, Human
ucucaaacagcugcccuaucaauua

SEQ ID NO: 311107 - RNA, 18 nt, Human
ucucaggagugacuaaag

SEQ ID NO: 311108 - RNA, 18 nt, Human
ucucagguuggcaaugcu

SEQ ID NO: 311109 - RNA, 18 nt, Human
ucucccccucuucuugcu

SEQ ID NO: 311110 - RNA, 22 nt, Human
ucuccugcuuuucucugccaug

SEQ ID NO: 311111 - RNA, 22 nt, Human
ucuccugcuuuucucugccaug

SEQ ID NO: 311112 - RNA, 22 nt, Human
ucuucaagaaaacguguucccc

SEQ ID NO: 311113 - RNA, 21 nt, Human
ugaaaaugggaccuguucuca

SEQ ID NO: 311114 - RNA, 22 nt, Human
ugaaaaugggaccuguucucaa

SEQ ID NO: 311115 - RNA, 23 nt, Human
ugaaagaaaaacaaaauaaacac

SEQ ID NO: 311116 - RNA, 23 nt, Human
ugaaagaaaaacaaaauaaacac

SEQ ID NO: 311117 - RNA, 19 nt, Human
ugacagcaaaucauucaaa

SEQ ID NO: 311118 - RNA, 19 nt, Human
ugacagcaaaucauucaaa

SEQ ID NO: 311119 - RNA, 21 nt, Human
ugcaauauuauauauauauau

SEQ ID NO: 311120 - RNA, 19 nt, Human
ugcagaggaggcuuuguag

SEQ ID NO: 311121 - RNA, 21 nt, Human
ugcagggcuauuguuggcaca

SEQ ID NO: 311122 - RNA, 20 nt, Human
ugcccugugcagggcuauug

SEQ ID NO: 311123 - RNA, 22 nt, Human
uggaaaaaccuuaccaugacca

SEQ ID NO: 311124 - RNA, 22 nt, Human
uggaaaaaccuuaccaugacca

SEQ ID NO: 311125 - RNA, 19 nt, Human
uggagaccccugggagggc

SEQ ID NO: 311126 - RNA, 19 nt, Human
uggauauauauauauauau

SEQ ID NO: 311127 - RNA, 19 nt, Human
uggauauauauauauauau

SEQ ID NO: 311128 - RNA, 20 nt, Human
uggauauauauauauauaua

SEQ ID NO: 311129 - RNA, 20 nt, Human
uggauauauauauauauaua

SEQ ID NO: 311130 - RNA, 20 nt, Human
uggcaaagccuuugugcugu

SEQ ID NO: 311131 - RNA, 24 nt, Human
uggcaaguuacaaaagcauggcug

SEQ ID NO: 311132 - RNA, 24 nt, Human
uggcaaguuacaaaagcauggcug

SEQ ID NO: 311133 - RNA, 22 nt, Human
uggccauguugaugcccugugc

SEQ ID NO: 311134 - RNA, 20 nt, Human
uggcucccagcccuagacac

SEQ ID NO: 311135 - RNA, 22 nt, Human
uggcugggaacaaagaaaaaga

SEQ ID NO: 311136 - RNA, 22 nt, Human
uggcugggaacaaagaaaaaga

SEQ ID NO: 311137 - RNA, 20 nt, Human
ugggaagaggacaggguaag

SEQ ID NO: 311138 - RNA, 20 nt, Human
ugggaagaggacaggguaag

SEQ ID NO: 311139 - RNA, 22 nt, Human
ugggaagaggacaggguaaggc

SEQ ID NO: 311140 - RNA, 22 nt, Human
ugggaagaggacaggguaaggc

SEQ ID NO: 311141 - RNA, 19 nt, Human
ugggagagaagaaucaaag

SEQ ID NO: 311142 - RNA, 24 nt, Human
ugguggugguaucccagagggagg

SEQ ID NO: 311143 - RNA, 24 nt, Human
ugguggugguaucccagagggagg

SEQ ID NO: 311144 - RNA, 26 nt, Human
uguagaaaaagaaaagcagcaagauc

SEQ ID NO: 311145 - RNA, 26 nt, Human
uguagaaaaagaaaagcagcaagauc

SEQ ID NO: 311146 - RNA, 22 nt, Human
uguuccccccucucugcacucc

SEQ ID NO: 311147 - RNA, 21 nt, Human
uguuggcacauguggcagaau

SEQ ID NO: 311148 - RNA, 20 nt, Human
uguuugggaaauugcaaacu

SEQ ID NO: 311149 - RNA, 20 nt, Human
uguuugggaaauugcaaacu

SEQ ID NO: 311150 - RNA, 24 nt, Human
uuaaaaaauaaaaauagcccacaa

SEQ ID NO: 311151 - RNA, 24 nt, Human
uuaaaaaauaaaaauagcccacaa

SEQ ID NO: 311152 - RNA, 18 nt, Human
uuaaacaugugccuuucu

SEQ ID NO: 311153 - RNA, 18 nt, Human
uuaaacaugugccuuucu

SEQ ID NO: 311154 - RNA, 19 nt, Human
uuagagagcaggauucuca

SEQ ID NO: 311155 - RNA, 25 nt, Human
uucaaagacaacaaauaucuuuaac

SEQ ID NO: 311156 - RNA, 25 nt, Human
uucaaagacaacaaauaucuuuaac

SEQ ID NO: 311157 - RNA, 22 nt, Human
uucaagucaggagaaaaaaauc

SEQ ID NO: 311158 - RNA, 27 nt, Human
uucacagacccccuuucuccaucacaa

SEQ ID NO: 311159 - RNA, 20 nt, Human
uuccucaguugacuguuggc

SEQ ID NO: 311160 - RNA, 18 nt, Human
uucgaaagcuccuagagc

SEQ ID NO: 311161 - RNA, 18 nt, Human
uucgaaagcuccuagagc

SEQ ID NO: 311162 - RNA, 24 nt, Human
uucuggauauauauauauauauau

SEQ ID NO: 311163 - RNA, 24 nt, Human
uucuggauauauauauauauauau

SEQ ID NO: 311164 - RNA, 18 nt, Human
uugcaaacuuaagcuugc

SEQ ID NO: 311165 - RNA, 22 nt, Human
uugcaauauuauauauauauau

SEQ ID NO: 311166 - RNA, 19 nt, Human
uuggccauguugaugcccu

SEQ ID NO: 311167 - RNA, 22 nt, Human
uuuacuuuuuguaaagaguaaa

SEQ ID NO: 311168 - RNA, 19 nt, Human
uuuccccuucucucucucc

SEQ ID NO: 311169 - RNA, 18 nt, Human
uuugauuucuucuuaggc

SEQ ID NO: 311170 - RNA, 18 nt, Human
uuugauuucuucuuaggc

SEQ ID NO: 311171 - RNA, 19 nt, Human
uuugcuuuuuguauuguuu

SEQ ID NO: 311172 - RNA, 19 nt, Human
uuugcuuuuuguauuguuu

SEQ ID NO: 311173 - RNA, 23 nt, Human
uuuguguuacuagagaaauuucu

SEQ ID NO: 311174 - RNA, 24 nt, Human
uuuguuuguuuguaauuuacuuuu

SEQ ID NO: 311175 - RNA, 24 nt, Human
uuuguuuguuuguaauuuacuuuu

SEQ ID NO: 311176 - RNA, 21 nt, Human
uuuuuuuaaaacuucauacaa

SEQ ID NO: 311177 - RNA, 21 nt, Human
uuuuuuuaaaacuucauacaa

SEQ ID NO: 311178 - RNA, 22 nt, Human
agggaauccagguggguggggg

SEQ ID NO: 311179 - RNA, 19 nt, Human
aggugggugggggccacag

SEQ ID NO: 311180 - RNA, 20 nt, Human
aggugggugggggccacagg

SEQ ID NO: 311181 - RNA, 22 nt, Human
ccacagggcaccagguacagcc

SEQ ID NO: 311182 - RNA, 24 nt, Human
ggccacagggcaccagguacagcc

SEQ ID NO: 311183 - RNA, 22 nt, Human
uccaggugggugggggccacag

SEQ ID NO: 311184 - RNA, 19 nt, Human
aacgaggacaucccaaaaa

SEQ ID NO: 311185 - RNA, 19 nt, Human
aagugucaacgaggacauc

SEQ ID NO: 311186 - RNA, 21 nt, Human
aauaacaagggagaauagaaa

SEQ ID NO: 311187 - RNA, 22 nt, Human
acaaauuuguaaaacaacaaag

SEQ ID NO: 311188 - RNA, 27 nt, Human
acacaaacucaaaaaccaaguuugaaa

SEQ ID NO: 311189 - RNA, 19 nt, Human
acuguccaaggcaaauaaa

SEQ ID NO: 311190 - RNA, 18 nt, Human
agaaaauagcaaaugauu

SEQ ID NO: 311191 - RNA, 18 nt, Human
agaaaucuucugcugcaa

SEQ ID NO: 311192 - RNA, 21 nt, Human
agaagggaacagacuuaaaga

SEQ ID NO: 311193 - RNA, 21 nt, Human
agaagggaacagacuuaaaga

SEQ ID NO: 311194 - RNA, 19 nt, Human
agacaagacacaaacucaa

SEQ ID NO: 311195 - RNA, 29 nt, Human
agacaagacacaaacucaaaagggacccc

SEQ ID NO: 311196 - RNA, 21 nt, Human
agacacaaacucaaaaaccaa

SEQ ID NO: 311197 - RNA, 18 nt, Human
aggaaaccuucaaaaaca

SEQ ID NO: 311198 - RNA, 22 nt, Human
aucuaguguuaaaagcugaaaa

SEQ ID NO: 311199 - RNA, 25 nt, Human
caaaaaguacaagaaugucugguaa

SEQ ID NO: 311200 - RNA, 24 nt, Human
caacacaaaguuaagacaagacac

SEQ ID NO: 311201 - RNA, 21 nt, Human
caacuaaaaacuguccaaggc

SEQ ID NO: 311202 - RNA, 21 nt, Human
caagaaugucugguaaacaaa

SEQ ID NO: 311203 - RNA, 20 nt, Human
cacaaaguuaagacaagaca

SEQ ID NO: 311204 - RNA, 22 nt, Human
cagucacacaagucuaagccac

SEQ ID NO: 311205 - RNA, 22 nt, Human
caucaggaagaaaaugccaacc

SEQ ID NO: 311206 - RNA, 22 nt, Human
ccaacacaaaguuaagacaaga

SEQ ID NO: 311207 - RNA, 21 nt, Human
ccaaggcaaauaaaaacgagg

SEQ ID NO: 311208 - RNA, 18 nt, Human
ccugcggcaggcuugaga

SEQ ID NO: 311209 - RNA, 18 nt, Human
cggcaggcuugagacugc

SEQ ID NO: 311210 - RNA, 20 nt, Human
cucccugcggcaggcuugag

SEQ ID NO: 311211 - RNA, 19 nt, Human
cuuagauuaaaauaacaag

SEQ ID NO: 311212 - RNA, 22 nt, Human
ggggaaaaugcuuagauuaaaa

SEQ ID NO: 311213 - RNA, 23 nt, Human
gggggaaaaugcuuagauuaaaa

SEQ ID NO: 311214 - RNA, 20 nt, Human
guauaguaauggccaacaga

SEQ ID NO: 311215 - RNA, 20 nt, Human
uaaaaacgaggaaaccuuca

SEQ ID NO: 311216 - RNA, 21 nt, Human
uaaaaacgaggaaaccuucaa

SEQ ID NO: 311217 - RNA, 26 nt, Human
uaaaaacgaggaaaccuucaaaaaca

SEQ ID NO: 311218 - RNA, 20 nt, Human
uaaaaacuguccaaggcaaa

SEQ ID NO: 311219 - RNA, 25 nt, Human
uaaagagaacuguucccccucaauu

SEQ ID NO: 311220 - RNA, 19 nt, Human
uaaauaacucuuacaaaau

SEQ ID NO: 311221 - RNA, 20 nt, Human
uaagacaagacacaaacuca

SEQ ID NO: 311222 - RNA, 25 nt, Human
uaagacaagacacaaacucaaaaac

SEQ ID NO: 311223 - RNA, 22 nt, Human
uacagaauuagaagggaacaga

SEQ ID NO: 311224 - RNA, 22 nt, Human
uauaguaauggccaacagauac

SEQ ID NO: 311225 - RNA, 26 nt, Human
uauaguaauggccaacagauacucca

SEQ ID NO: 311226 - RNA, 27 nt, Human
uaucagcauguuuaaguuagagccaac

SEQ ID NO: 311227 - RNA, 23 nt, Human
uccaaggcaaauaaaaacgagga

SEQ ID NO: 311228 - RNA, 24 nt, Human
ucccugcggcaggcuugagacugc

SEQ ID NO: 311229 - RNA, 26 nt, Human
ucccugcggcaggcuugagacugcuu

SEQ ID NO: 311230 - RNA, 22 nt, Human
ucuuaaggcagcauccucuuua

SEQ ID NO: 311231 - RNA, 23 nt, Human
ugguaaacaaacagucuguauuu

SEQ ID NO: 311232 - RNA, 21 nt, Human
uuaaacaaaauucuugaaaac

SEQ ID NO: 311233 - RNA, 23 nt, Human
uuaaagauuugccuauuaaaaua

SEQ ID NO: 311234 - RNA, 20 nt, Human
uuagagccaacacaaaguua

SEQ ID NO: 311235 - RNA, 20 nt, Human
aaacaaguuauggcaguggc

SEQ ID NO: 311236 - RNA, 21 nt, Human
aaacaaucagucaaaaagaac

SEQ ID NO: 311237 - RNA, 22 nt, Human
aaacaaucagucaaaaagaaca

SEQ ID NO: 311238 - RNA, 20 nt, Human
aaaccccagguucaauuucc

SEQ ID NO: 311239 - RNA, 19 nt, Human
aaagaacagcucuuuuaca

SEQ ID NO: 311240 - RNA, 24 nt, Human
aacagcucuuuuacaaacaaguua

SEQ ID NO: 311241 - RNA, 23 nt, Human
aaccaaacagcagaaccugcaag

SEQ ID NO: 311242 - RNA, 22 nt, Human
acagcccuccccuucccugccc

SEQ ID NO: 311243 - RNA, 23 nt, Human
accaaacagcagaaccugcaagc

SEQ ID NO: 311244 - RNA, 24 nt, Human
agcccuccccuucccugcccaccu

SEQ ID NO: 311245 - RNA, 26 nt, Human
aggaacaaucagacgggaagguucug

SEQ ID NO: 311246 - RNA, 19 nt, Human
augacacauacacacacug

SEQ ID NO: 311247 - RNA, 25 nt, Human
caaaaauacacucugauguagcaac

SEQ ID NO: 311248 - RNA, 22 nt, Human
cacacugacccccuucagcaac

SEQ ID NO: 311249 - RNA, 28 nt, Human
caccuccaugacacauacacacagugug

SEQ ID NO: 311250 - RNA, 23 nt, Human
cagcauauauauccucaucuccc

SEQ ID NO: 311251 - RNA, 21 nt, Human
cagcugggaggagcgccccuu

SEQ ID NO: 311252 - RNA, 25 nt, Human
caggagagauggggcuauugaaaug

SEQ ID NO: 311253 - RNA, 19 nt, Human
cauacacacacugaccccc

SEQ ID NO: 311254 - RNA, 18 nt, Human
cccuucagcaaccaaaca

SEQ ID NO: 311255 - RNA, 18 nt, Human
ccuccgauggaugcgagg

SEQ ID NO: 311256 - RNA, 20 nt, Human
gacccccuucagcaaccaaa

SEQ ID NO: 311257 - RNA, 22 nt, Human
gcccaccuccaugacacauaca

SEQ ID NO: 311258 - RNA, 24 nt, Human
gcgcucagugccuuggggaagaag

SEQ ID NO: 311259 - RNA, 19 nt, Human
ggagcaggaagcaggugcu

SEQ ID NO: 311260 - RNA, 22 nt, Human
ggcaagaggcgggugagcagga

SEQ ID NO: 311261 - RNA, 23 nt, Human
ggggaucaccuggacgcucaugg

SEQ ID NO: 311262 - RNA, 21 nt, Human
gggugagcaggagagaugggg

SEQ ID NO: 311263 - RNA, 23 nt, Human
gggugagcaggagagauggggcu

SEQ ID NO: 311264 - RNA, 21 nt, Human
guugcaguggccgguacagcu

SEQ ID NO: 311265 - RNA, 23 nt, Human
guuguggugaaacaugccagggg

SEQ ID NO: 311266 - RNA, 23 nt, Human
ucaaaaagaacagcucuuuuaca

SEQ ID NO: 311267 - RNA, 18 nt, Human
ucagcaaccaaacagcag

SEQ ID NO: 311268 - RNA, 19 nt, Human
ucagcaaccaaacagcaga

SEQ ID NO: 311269 - RNA, 22 nt, Human
ucuuuuacaaacaaguuauggc

SEQ ID NO: 311270 - RNA, 18 nt, Human
ugcccaccuccaugacac

SEQ ID NO: 311271 - RNA, 19 nt, Human
ugccuuggggaagaaggaa

SEQ ID NO: 311272 - RNA, 19 nt, Human
aaacagacacaaugaccug

SEQ ID NO: 311273 - RNA, 20 nt, Human
aaacagacacaaugaccugg

SEQ ID NO: 311274 - RNA, 19 nt, Human
aagcggcggaggccgaggc

SEQ ID NO: 311275 - RNA, 20 nt, Human
aagggaggcggaucucugaa

SEQ ID NO: 311276 - RNA, 22 nt, Human
accaacauuguucuccugucac

SEQ ID NO: 311277 - RNA, 22 nt, Human
accccgcuccuugcagccucug

SEQ ID NO: 311278 - RNA, 23 nt, Human
acgugcggggcgggcucgcgggc

SEQ ID NO: 311279 - RNA, 20 nt, Human
acguucaccaacauuguucu

SEQ ID NO: 311280 - RNA, 23 nt, Human
aggccgaggccgggcugcggggu

SEQ ID NO: 311281 - RNA, 19 nt, Human
agugccccgggggcccucc

SEQ ID NO: 311282 - RNA, 23 nt, Human
ccaggagguggcucaccgcccag

SEQ ID NO: 311283 - RNA, 22 nt, Human
cccccaaggucagagagggcca

SEQ ID NO: 311284 - RNA, 18 nt, Human
ccccgggggcccuccagg

SEQ ID NO: 311285 - RNA, 21 nt, Human
ccccucggaaacagacacaau

SEQ ID NO: 311286 - RNA, 21 nt, Human
cccucggaaacagacacaaug

SEQ ID NO: 311287 - RNA, 19 nt, Human
ccgcccagugccccggggg

SEQ ID NO: 311288 - RNA, 22 nt, Human
ccgcuaggcgucuggggauaag

SEQ ID NO: 311289 - RNA, 18 nt, Human
ccgggggcgggggaaggg

SEQ ID NO: 311290 - RNA, 21 nt, Human
ccuccaggucgggccgggcug

SEQ ID NO: 311291 - RNA, 18 nt, Human
ccugggaggggguggugc

SEQ ID NO: 311292 - RNA, 27 nt, Human
ccugucaccaggacaggaccggggucc

SEQ ID NO: 311293 - RNA, 19 nt, Human
cgcgacaacaagcggcgga

SEQ ID NO: 311294 - RNA, 19 nt, Human
cgggagcaggcaaaggagg

SEQ ID NO: 311295 - RNA, 23 nt, Human
cggggcgggcucgcgggcggggc

SEQ ID NO: 311296 - RNA, 25 nt, Human
cucaccgcccagugccccgggggcc

SEQ ID NO: 311297 - RNA, 20 nt, Human
cugucaccaggacaggacgc

SEQ ID NO: 311298 - RNA, 19 nt, Human
gacggcaccgagaguugcc

SEQ ID NO: 311299 - RNA, 21 nt, Human
gaucucugaagucccgcccaa

SEQ ID NO: 311300 - RNA, 22 nt, Human
gcagggccugcgguuugggugc

SEQ ID NO: 311301 - RNA, 21 nt, Human
gcccagugccccgggggcccu

SEQ ID NO: 311302 - RNA, 18 nt, Human
gccucuggccuccuuaug

SEQ ID NO: 311303 - RNA, 21 nt, Human
gcgcgacaacaagcggcggag

SEQ ID NO: 311304 - RNA, 19 nt, Human
gcgggugggaacaucggga

SEQ ID NO: 311305 - RNA, 21 nt, Human
gcuggggagaagaggccucga

SEQ ID NO: 311306 - RNA, 21 nt, Human
ggaaacagacacaaugaccug

SEQ ID NO: 311307 - RNA, 24 nt, Human
ggacgcggcauucacaacggaaga

SEQ ID NO: 311308 - RNA, 18 nt, Human
ggagguggcucaccgccc

SEQ ID NO: 311309 - RNA, 18 nt, Human
ggccgggcuguggagaag

SEQ ID NO: 311310 - RNA, 22 nt, Human
ggccuccuuaugucuggagggc

SEQ ID NO: 311311 - RNA, 20 nt, Human
ggcgcgacaacaagcggcgg

SEQ ID NO: 311312 - RNA, 19 nt, Human
ggcuacgguccaggccccu

SEQ ID NO: 311313 - RNA, 24 nt, Human
ggggcgcgacaacaagcggcggag

SEQ ID NO: 311314 - RNA, 21 nt, Human
gggggaagggcaagggaggcg

SEQ ID NO: 311315 - RNA, 25 nt, Human
gggggcuguggccccgcgucuccgg

SEQ ID NO: 311316 - RNA, 20 nt, Human
ggguguaagcggucacgacc

SEQ ID NO: 311317 - RNA, 26 nt, Human
ggucagagagggccagcugggcgggg

SEQ ID NO: 311318 - RNA, 18 nt, Human
gguggugcugagaauaaa

SEQ ID NO: 311319 - RNA, 22 nt, Human
guccaggggugcgagggcgucc

SEQ ID NO: 311320 - RNA, 18 nt, Human
uaagggaagacucggccc

SEQ ID NO: 311321 - RNA, 26 nt, Human
uccguucugcagcacuggggcaggga

SEQ ID NO: 311322 - RNA, 21 nt, Human
ucucugaagucccgcccaacu

SEQ ID NO: 311323 - RNA, 22 nt, Human
ucucugaagucccgcccaacuu

SEQ ID NO: 311324 - RNA, 20 nt, Human
ucugaagucccgcccaacuu

SEQ ID NO: 311325 - RNA, 21 nt, Human
ucuggggauaagggaagacuc

SEQ ID NO: 311326 - RNA, 18 nt, Human
ugaccugggagggggugg

SEQ ID NO: 311327 - RNA, 19 nt, Human
ugaccugggaggggguggu

SEQ ID NO: 311328 - RNA, 23 nt, Human
ugagaauaaauuagggucagcug

SEQ ID NO: 311329 - RNA, 24 nt, Human
ugcuggggagaagaggccucgagc

SEQ ID NO: 311330 - RNA, 19 nt, Human
uggcgggaagggaucaugc

SEQ ID NO: 311331 - RNA, 19 nt, Human
ugggaggggguggugcuga

SEQ ID NO: 311332 - RNA, 24 nt, Human
uggggucucagcacucgcugggug

SEQ ID NO: 311333 - RNA, 21 nt, Human
ugggugacccgcgggagcagg

SEQ ID NO: 311334 - RNA, 18 nt, Human
uugcagccucuggccucc

SEQ ID NO: 311335 - RNA, 25 nt, Human
uuugggugcugugaccguccggggg

SEQ ID NO: 311336 - RNA, 18 nt, Human
aaaaugcucaaucuccuc

SEQ ID NO: 311337 - RNA, 21 nt, Human
aacucgccgcccucuggccuc

SEQ ID NO: 311338 - RNA, 21 nt, Human
aacucgccgcccucuggccuc

SEQ ID NO: 311339 - RNA, 23 nt, Human
aacucgccgcccucuggccucua

SEQ ID NO: 311340 - RNA, 23 nt, Human
aacucgccgcccucuggccucua

SEQ ID NO: 311341 - RNA, 18 nt, Human
aagaggaggagauuuaaa

SEQ ID NO: 311342 - RNA, 18 nt, Human
aagaggaggagauuuaaa

SEQ ID NO: 311343 - RNA, 20 nt, Human
aagaggaggagauuuaaaua

SEQ ID NO: 311344 - RNA, 21 nt, Human
aaucuucucucccuuucaggc

SEQ ID NO: 311345 - RNA, 21 nt, Human
acagaucagugaggaagaggc

SEQ ID NO: 311346 - RNA, 18 nt, Human
agaagaacaaaaguaggg

SEQ ID NO: 311347 - RNA, 18 nt, Human
agaagaacaaaaguaggg

SEQ ID NO: 311348 - RNA, 22 nt, Human
agcagugcacccuguugucuug

SEQ ID NO: 311349 - RNA, 21 nt, Human
agccuggggaacaggaaccug

SEQ ID NO: 311350 - RNA, 20 nt, Human
agcgccaaucuucucucccu

SEQ ID NO: 311351 - RNA, 21 nt, Human
agcuggugcugggaggggccg

SEQ ID NO: 311352 - RNA, 21 nt, Human
agcuggugcugggaggggccg

SEQ ID NO: 311353 - RNA, 21 nt, Human
agcuggugcugggaggggccg

SEQ ID NO: 311354 - RNA, 19 nt, Human
aggcaaaguuccucacaca

SEQ ID NO: 311355 - RNA, 19 nt, Human
agugaggaagaggcuauug

SEQ ID NO: 311356 - RNA, 23 nt, Human
aucuucucucccuuucaggccuu

SEQ ID NO: 311357 - RNA, 19 nt, Human
caaaaugcucaaucuccuc

SEQ ID NO: 311358 - RNA, 18 nt, Human
caaacugcugaucaaugu

SEQ ID NO: 311359 - RNA, 21 nt, Human
caaguguggauuugcccaggc

SEQ ID NO: 311360 - RNA, 19 nt, Human
caguuucuggaucuguccc

SEQ ID NO: 311361 - RNA, 19 nt, Human
caguuucuggaucuguccc

SEQ ID NO: 311362 - RNA, 25 nt, Human
ccaauggccggagcccauggccgaa

SEQ ID NO: 311363 - RNA, 20 nt, Human
ccaauggccggagccugggg

SEQ ID NO: 311364 - RNA, 21 nt, Human
ccacgaugccccagggguaga

SEQ ID NO: 311365 - RNA, 18 nt, Human
cccacauacuccuuguca

SEQ ID NO: 311366 - RNA, 20 nt, Human
ccccagggguagagucgacc

SEQ ID NO: 311367 - RNA, 20 nt, Human
ccccagggguagagucgacc

SEQ ID NO: 311368 - RNA, 19 nt, Human
cccccugccagcuuugucc

SEQ ID NO: 311369 - RNA, 19 nt, Human
cccccugccagcuuugucc

SEQ ID NO: 311370 - RNA, 18 nt, Human
ccccggcacccagcgcca

SEQ ID NO: 311371 - RNA, 21 nt, Human
ccgggcggggccggcuccgcc

SEQ ID NO: 311372 - RNA, 28 nt, Human
ccucugagucucugggcagucagcaggg

SEQ ID NO: 311373 - RNA, 28 nt, Human
ccucugagucucugggcagucagcaggg

SEQ ID NO: 311374 - RNA, 21 nt, Human
ccugcaauuugaaguccucau

SEQ ID NO: 311375 - RNA, 23 nt, Human
ccuuucaggccuuugccccagcc

SEQ ID NO: 311376 - RNA, 23 nt, Human
cgaggaggaccccagcacccgcu

SEQ ID NO: 311377 - RNA, 23 nt, Human
cgaggaggaccccagcacccgcu

SEQ ID NO: 311378 - RNA, 21 nt, Human
cgcccgagcgacccgcggcgg

SEQ ID NO: 311379 - RNA, 21 nt, Human
cgguacagaucagugaggaag

SEQ ID NO: 311380 - RNA, 27 nt, Human
cucuccugccaccaugaggguaaaguc

SEQ ID NO: 311381 - RNA, 25 nt, Human
cucuucagcaccaagaaguuuccgg

SEQ ID NO: 311382 - RNA, 26 nt, Human
cucuucuauguccacugcaugcuuag

SEQ ID NO: 311383 - RNA, 19 nt, Human
cugcaaaugggaugcuuuc

SEQ ID NO: 311384 - RNA, 26 nt, Human
cuucuggucauacuugcgauuccguu

SEQ ID NO: 311385 - RNA, 26 nt, Human
cuucuggucauacuugcgauuccguu

SEQ ID NO: 311386 - RNA, 20 nt, Human
cuuucgguggacuugguugg

SEQ ID NO: 311387 - RNA, 18 nt, Human
gagcugcgcgccgaccuc

SEQ ID NO: 311388 - RNA, 18 nt, Human
gcagagcuggugcuggga

SEQ ID NO: 311389 - RNA, 18 nt, Human
gcagagcuggugcuggga

SEQ ID NO: 311390 - RNA, 18 nt, Human
gcagagcuggugcuggga

SEQ ID NO: 311391 - RNA, 20 nt, Human
gcauuguccucagcuucaca

SEQ ID NO: 311392 - RNA, 20 nt, Human
gcauuguccucagcuucaca

SEQ ID NO: 311393 - RNA, 19 nt, Human
gcccacauacuccuuguca

SEQ ID NO: 311394 - RNA, 24 nt, Human
gccccggcacccagcgccaaucuu

SEQ ID NO: 311395 - RNA, 21 nt, Human
gcccgagcgacccgcggcgga

SEQ ID NO: 311396 - RNA, 19 nt, Human
gccgaccucgcagcaccgc

SEQ ID NO: 311397 - RNA, 24 nt, Human
gccgcagccucacacccuucucuu

SEQ ID NO: 311398 - RNA, 18 nt, Human
gccuggacagcgcccgag

SEQ ID NO: 311399 - RNA, 18 nt, Human
gcuucuggucauacuugc

SEQ ID NO: 311400 - RNA, 18 nt, Human
gcuucuggucauacuugc

SEQ ID NO: 311401 - RNA, 19 nt, Human
gcuuuguccuggcuucugg

SEQ ID NO: 311402 - RNA, 19 nt, Human
gcuuuguccuggcuucugg

SEQ ID NO: 311403 - RNA, 19 nt, Human
ggacaggaagaagaggagg

SEQ ID NO: 311404 - RNA, 19 nt, Human
ggacaggaagaagaggagg

SEQ ID NO: 311405 - RNA, 19 nt, Human
ggacaggaagaagaggagg

SEQ ID NO: 311406 - RNA, 18 nt, Human
gggaagucgguaccacuu

SEQ ID NO: 311407 - RNA, 18 nt, Human
gggaagucgguaccacuu

SEQ ID NO: 311408 - RNA, 18 nt, Human
gggaggugucaguguguc

SEQ ID NO: 311409 - RNA, 18 nt, Human
gggaggugucaguguguc

SEQ ID NO: 311410 - RNA, 19 nt, Human
gggcggggccggcuccgcc

SEQ ID NO: 311411 - RNA, 23 nt, Human
gguuggggaggguugcaaagccc

SEQ ID NO: 311412 - RNA, 20 nt, Human
guaccagcauuguccucagc

SEQ ID NO: 311413 - RNA, 20 nt, Human
guaccagcauuguccucagc

SEQ ID NO: 311414 - RNA, 23 nt, Human
guccacaauggugagccgcagcc

SEQ ID NO: 311415 - RNA, 19 nt, Human
gugcacccuguugucuugg

SEQ ID NO: 311416 - RNA, 22 nt, Human
gugggacagcagggauggggaa

SEQ ID NO: 311417 - RNA, 22 nt, Human
gugggacagcagggauggggaa

SEQ ID NO: 311418 - RNA, 23 nt, Human
guuuugaugcuguuguugucugg

SEQ ID NO: 311419 - RNA, 18 nt, Human
uacaguguugcugccaau

SEQ ID NO: 311420 - RNA, 18 nt, Human
uacaguguugcugccaau

SEQ ID NO: 311421 - RNA, 21 nt, Human
uaggcacgauguugacccgcu

SEQ ID NO: 311422 - RNA, 21 nt, Human
uaggcacgauguugacccgcu

SEQ ID NO: 311423 - RNA, 18 nt, Human
ucacagucugggaauuga

SEQ ID NO: 311424 - RNA, 18 nt, Human
ucacagucugggaauuga

SEQ ID NO: 311425 - RNA, 18 nt, Human
ucagcagggauguaaggc

SEQ ID NO: 311426 - RNA, 18 nt, Human
ucagcagggauguaaggc

SEQ ID NO: 311427 - RNA, 18 nt, Human
ucagcagggauguaaggc

SEQ ID NO: 311428 - RNA, 18 nt, Human
ucauaaugugucucccgu

SEQ ID NO: 311429 - RNA, 18 nt, Human
ucauaaugugucucccgu

SEQ ID NO: 311430 - RNA, 19 nt, Human
uccacaguuugcaugaucc

SEQ ID NO: 311431 - RNA, 19 nt, Human
uccacuuccacgaugcccc

SEQ ID NO: 311432 - RNA, 19 nt, Human
uccacuuccacgaugcccc

SEQ ID NO: 311433 - RNA, 20 nt, Human
ucccccugccagcuuugucc

SEQ ID NO: 311434 - RNA, 20 nt, Human
ucccccugccagcuuugucc

SEQ ID NO: 311435 - RNA, 22 nt, Human
ucccuggugggacagcagggau

SEQ ID NO: 311436 - RNA, 22 nt, Human
ucccuggugggacagcagggau

SEQ ID NO: 311437 - RNA, 25 nt, Human
ucccugucagaaagcucuaggucua

SEQ ID NO: 311438 - RNA, 22 nt, Human
uccucugagucucugggcaguc

SEQ ID NO: 311439 - RNA, 22 nt, Human
uccucugagucucugggcaguc

SEQ ID NO: 311440 - RNA, 22 nt, Human
uccucugagucucugggcaguc

SEQ ID NO: 311441 - RNA, 22 nt, Human
ucucacccaaggcuaggcuugg

SEQ ID NO: 311442 - RNA, 22 nt, Human
ucucacccaaggcuaggcuugg

SEQ ID NO: 311443 - RNA, 19 nt, Human
ucuccugccaccaugaggg

SEQ ID NO: 311444 - RNA, 24 nt, Human
ucucucggauaagcuucucaguuu

SEQ ID NO: 311445 - RNA, 24 nt, Human
ucucucggauaagcuucucaguuu

SEQ ID NO: 311446 - RNA, 19 nt, Human
ucucugggcagucagcagg

SEQ ID NO: 311447 - RNA, 19 nt, Human
ucucugggcagucagcagg

SEQ ID NO: 311448 - RNA, 19 nt, Human
ucucugggcagucagcagg

SEQ ID NO: 311449 - RNA, 19 nt, Human
ucuggaucugucccuggug

SEQ ID NO: 311450 - RNA, 19 nt, Human
ucuggaucugucccuggug

SEQ ID NO: 311451 - RNA, 19 nt, Human
ugagcagagcuggugcugg

SEQ ID NO: 311452 - RNA, 19 nt, Human
ugagcagagcuggugcugg

SEQ ID NO: 311453 - RNA, 18 nt, Human
ugagcccagggccuauag

SEQ ID NO: 311454 - RNA, 21 nt, Human
ugccacaggcuuccagcacuc

SEQ ID NO: 311455 - RNA, 26 nt, Human
ugccaccaugaggguaaagucaaagc

SEQ ID NO: 311456 - RNA, 23 nt, Human
ugcccuggguuuuccacuuccac

SEQ ID NO: 311457 - RNA, 23 nt, Human
ugcccuggguuuuccacuuccac

SEQ ID NO: 311458 - RNA, 20 nt, Human
uggcuuccuggcuugcuccu

SEQ ID NO: 311459 - RNA, 21 nt, Human
uggcuuccuggcuugcuccuu

SEQ ID NO: 311460 - RNA, 18 nt, Human
ugggaggggccggcaugg

SEQ ID NO: 311461 - RNA, 18 nt, Human
ugggaggggccggcaugg

SEQ ID NO: 311462 - RNA, 18 nt, Human
ugggaggggccggcaugg

SEQ ID NO: 311463 - RNA, 20 nt, Human
ugggaggggccggcauggac

SEQ ID NO: 311464 - RNA, 20 nt, Human
ugggaggggccggcauggac

SEQ ID NO: 311465 - RNA, 20 nt, Human
ugggaggggccggcauggac

SEQ ID NO: 311466 - RNA, 19 nt, Human
ugggaugcuuuccuuuagg

SEQ ID NO: 311467 - RNA, 19 nt, Human
ugggaugcuuuccuuuagg

SEQ ID NO: 311468 - RNA, 18 nt, Human
uggugcugggaggggccg

SEQ ID NO: 311469 - RNA, 18 nt, Human
uggugcugggaggggccg

SEQ ID NO: 311470 - RNA, 19 nt, Human
ugucagaaagcucuagguc

SEQ ID NO: 311471 - RNA, 22 nt, Human
ugucagaaagcucuaggucuaa

SEQ ID NO: 311472 - RNA, 24 nt, Human
uguggauuugcccaggccagacuc

SEQ ID NO: 311473 - RNA, 19 nt, Human
uuccucacacacagaaaca

SEQ ID NO: 311474 - RNA, 22 nt, Human
uugcaugauccucucuucagca

SEQ ID NO: 311475 - RNA, 19 nt, Human
uugguuggggaggguugca

SEQ ID NO: 311476 - RNA, 22 nt, Human
uuguguagcaucuccugcaucc

SEQ ID NO: 311477 - RNA, 22 nt, Human
uuguguagcaucuccugcaucc

SEQ ID NO: 311478 - RNA, 21 nt, Human
uuugcuaaagggagaaaaggg

SEQ ID NO: 311479 - RNA, 21 nt, Human
uuugcuaaagggagaaaaggg

SEQ ID NO: 311480 - RNA, 23 nt, Human
uuugcuaaagggagaaaaggguu

SEQ ID NO: 311481 - RNA, 23 nt, Human
uuugcuaaagggagaaaaggguu

SEQ ID NO: 311482 - RNA, 22 nt, Human
aaaacaccugaucuacaagaca

SEQ ID NO: 311483 - RNA, 18 nt, Human
aaaagcucauccaaaacu

SEQ ID NO: 311484 - RNA, 28 nt, Human
aaacaaaacaaaacaccugaucuacaag

SEQ ID NO: 311485 - RNA, 21 nt, Human
aaacaacuauaacaaaacucu

SEQ ID NO: 311486 - RNA, 23 nt, Human
aaagaguugaugauaaacugucu

SEQ ID NO: 311487 - RNA, 18 nt, Human
aaagugugagaagaccag

SEQ ID NO: 311488 - RNA, 24 nt, Human
aaccgcagcagccccacuaggcuc

SEQ ID NO: 311489 - RNA, 19 nt, Human
aaccucugaaucagcccag

SEQ ID NO: 311490 - RNA, 22 nt, Human
aagaaggaagcaaacaccucac

SEQ ID NO: 311491 - RNA, 22 nt, Human
aagcaaacaccucacucaagcc

SEQ ID NO: 311492 - RNA, 23 nt, Human
aagcagaccugguucacgcacgg

SEQ ID NO: 311493 - RNA, 20 nt, Human
aagcccuggcuggugaagug

SEQ ID NO: 311494 - RNA, 23 nt, Human
aagccuagacuaacacaguuugg

SEQ ID NO: 311495 - RNA, 19 nt, Human
acaacagaaaaccuacugg

SEQ ID NO: 311496 - RNA, 19 nt, Human
acacugaguguagggaggg

SEQ ID NO: 311497 - RNA, 18 nt, Human
acagagaagaggaacagc

SEQ ID NO: 311498 - RNA, 21 nt, Human
acagucugucccccaggcugc

SEQ ID NO: 311499 - RNA, 18 nt, Human
acccuggagguguggcgu

SEQ ID NO: 311500 - RNA, 21 nt, Human
accucugaaucagcccagagc

SEQ ID NO: 311501 - RNA, 20 nt, Human
acgcccagaacgauggagac

SEQ ID NO: 311502 - RNA, 18 nt, Human
acuaguucaucuauaaag

SEQ ID NO: 311503 - RNA, 22 nt, Human
acuccaaccuuuacugaaaugg

SEQ ID NO: 311504 - RNA, 20 nt, Human
acucuuugcccucucuugcc

SEQ ID NO: 311505 - RNA, 20 nt, Human
agaaacugcaagagaaccgc

SEQ ID NO: 311506 - RNA, 20 nt, Human
agaccaacaccaaagaguca

SEQ ID NO: 311507 - RNA, 22 nt, Human
agaccugagggaucagcuagug

SEQ ID NO: 311508 - RNA, 18 nt, Human
agagcauauugacuccaa

SEQ ID NO: 311509 - RNA, 26 nt, Human
agaggaacagcaaggccuagcuccag

SEQ ID NO: 311510 - RNA, 21 nt, Human
agaugccaccagaaacugcaa

SEQ ID NO: 311511 - RNA, 18 nt, Human
agcaaggcaaggugucag

SEQ ID NO: 311512 - RNA, 23 nt, Human
agcaguguggcauggugcaaaug

SEQ ID NO: 311513 - RNA, 18 nt, Human
agcggcggcggcggcggc

SEQ ID NO: 311514 - RNA, 24 nt, Human
agcuuuuggccuuuggcaguggag

SEQ ID NO: 311515 - RNA, 21 nt, Human
aggaaggaauuaggcagaugg

SEQ ID NO: 311516 - RNA, 19 nt, Human
aggaagucacuucaucuuu

SEQ ID NO: 311517 - RNA, 20 nt, Human
aggagcggcggcggcggcgg

SEQ ID NO: 311518 - RNA, 21 nt, Human
aggaucagcaaaggaggaaua

SEQ ID NO: 311519 - RNA, 22 nt, Human
aggccaggcuguggcccggggc

SEQ ID NO: 311520 - RNA, 22 nt, Human
aggccccaggacagaguaagug

SEQ ID NO: 311521 - RNA, 23 nt, Human
aggguagguuaacauggucacug

SEQ ID NO: 311522 - RNA, 22 nt, Human
aggguugccugccaaccagagc

SEQ ID NO: 311523 - RNA, 22 nt, Human
agguggcugcggugccggcgga

SEQ ID NO: 311524 - RNA, 22 nt, Human
auaguuuuuacaaacaaguuuc

SEQ ID NO: 311525 - RNA, 19 nt, Human
auauguguauauguaucag

SEQ ID NO: 311526 - RNA, 24 nt, Human
auccugcccaccuccaaacacuag

SEQ ID NO: 311527 - RNA, 21 nt, Human
caaaaacuugucauuuccagu

SEQ ID NO: 311528 - RNA, 27 nt, Human
caaaacaaaacaccugaucuacaagac

SEQ ID NO: 311529 - RNA, 23 nt, Human
caaaaggaacacgcugcucucac

SEQ ID NO: 311530 - RNA, 24 nt, Human
caaagaauauucuguaccuccuuc

SEQ ID NO: 311531 - RNA, 22 nt, Human
caagagaaccgcagcagcccca

SEQ ID NO: 311532 - RNA, 18 nt, Human
cacaacagucuguccccc

SEQ ID NO: 311533 - RNA, 18 nt, Human
cacugcagacaaaaagac

SEQ ID NO: 311534 - RNA, 21 nt, Human
cacugcagacaaaaagaccaa

SEQ ID NO: 311535 - RNA, 23 nt, Human
cacugcagacaaaaagaccaaca

SEQ ID NO: 311536 - RNA, 19 nt, Human
cacugcgcuuuccaggccc

SEQ ID NO: 311537 - RNA, 22 nt, Human
cagaaugaagggauuccacuag

SEQ ID NO: 311538 - RNA, 21 nt, Human
cagagccgggcuggggcgcag

SEQ ID NO: 311539 - RNA, 21 nt, Human
cagaucuuccccagccccucc

SEQ ID NO: 311540 - RNA, 22 nt, Human
cagccacugcucuuucauacug

SEQ ID NO: 311541 - RNA, 19 nt, Human
caggccaggacagugggac

SEQ ID NO: 311542 - RNA, 20 nt, Human
caucagagcuacuacagccg

SEQ ID NO: 311543 - RNA, 23 nt, Human
cauccugcccaccuccaaacacu

SEQ ID NO: 311544 - RNA, 20 nt, Human
caucuuaaaccuaaaugauu

SEQ ID NO: 311545 - RNA, 18 nt, Human
caugcccacugcuuagga

SEQ ID NO: 311546 - RNA, 19 nt, Human
ccacacaggauucccccuu

SEQ ID NO: 311547 - RNA, 20 nt, Human
ccagaacaagggguucaagg

SEQ ID NO: 311548 - RNA, 30 nt, Human
ccaggccaggacagugggacguucccacag

SEQ ID NO: 311549 - RNA, 21 nt, Human
cccagccccucccccuacccu

SEQ ID NO: 311550 - RNA, 23 nt, Human
cccagccccucccccuacccuuu

SEQ ID NO: 311551 - RNA, 20 nt, Human
ccccuaagcagaccugguuc

SEQ ID NO: 311552 - RNA, 20 nt, Human
ccccucggaguucacucucc

SEQ ID NO: 311553 - RNA, 19 nt, Human
ccccuggccuuccuuuucc

SEQ ID NO: 311554 - RNA, 22 nt, Human
cccugcccuccuuuccagccca

SEQ ID NO: 311555 - RNA, 20 nt, Human
cccugccgcugcagcagagc

SEQ ID NO: 311556 - RNA, 22 nt, Human
ccuaagcaguucugcccauuuu

SEQ ID NO: 311557 - RNA, 22 nt, Human
ccuagacuaacacaguuuggac

SEQ ID NO: 311558 - RNA, 22 nt, Human
ccucugaaucagcccagagccu

SEQ ID NO: 311559 - RNA, 18 nt, Human
ccugcagccacugcucuu

SEQ ID NO: 311560 - RNA, 22 nt, Human
ccuggggggauugggaggggac

SEQ ID NO: 311561 - RNA, 18 nt, Human
ccuguccagagaaaaaac

SEQ ID NO: 311562 - RNA, 18 nt, Human
ccugugcuaaucccagag

SEQ ID NO: 311563 - RNA, 24 nt, Human
ccuucgaguagcaauucuuaauuu

SEQ ID NO: 311564 - RNA, 22 nt, Human
cgaaaguucaacauuccacaca

SEQ ID NO: 311565 - RNA, 21 nt, Human
cgccucugggccgggagcagg

SEQ ID NO: 311566 - RNA, 26 nt, Human
cgggaccacaacagaaaaccuacugg

SEQ ID NO: 311567 - RNA, 20 nt, Human
cgggaccacaacagaaaacu

SEQ ID NO: 311568 - RNA, 22 nt, Human
cucccugccgcugcagcagagc

SEQ ID NO: 311569 - RNA, 21 nt, Human
cuccuuuccagcccagccacc

SEQ ID NO: 311570 - RNA, 18 nt, Human
cugaagacacaucgcuga

SEQ ID NO: 311571 - RNA, 20 nt, Human
cugcaagagaaccgcagcag

SEQ ID NO: 311572 - RNA, 19 nt, Human
cugccgagcccauaaaagu

SEQ ID NO: 311573 - RNA, 19 nt, Human
cugcggcggcucuuccucc

SEQ ID NO: 311574 - RNA, 18 nt, Human
cugcucucuaguccuugc

SEQ ID NO: 311575 - RNA, 25 nt, Human
cuggagcucuguggugcugcuggag

SEQ ID NO: 311576 - RNA, 19 nt, Human
cuguggugcugcuggaggc

SEQ ID NO: 311577 - RNA, 20 nt, Human
cuuugcugccugucucccca

SEQ ID NO: 311578 - RNA, 20 nt, Human
gaaaccacaguuuaccacug

SEQ ID NO: 311579 - RNA, 24 nt, Human
gaaccaugugauuuugaggaaguc

SEQ ID NO: 311580 - RNA, 18 nt, Human
gaccgugacaaaagcuau

SEQ ID NO: 311581 - RNA, 18 nt, Human
gaccugguucacgcacgg

SEQ ID NO: 311582 - RNA, 20 nt, Human
gagccuucuacauggcagcu

SEQ ID NO: 311583 - RNA, 21 nt, Human
gcccucucuugccucccccau

SEQ ID NO: 311584 - RNA, 19 nt, Human
gcgcugcggcggcucuucc

SEQ ID NO: 311585 - RNA, 22 nt, Human
gcgcuuuccaggcccucuuuuc

SEQ ID NO: 311586 - RNA, 20 nt, Human
gcggcggcggcggcggcugc

SEQ ID NO: 311587 - RNA, 25 nt, Human
gcggcggcggcggcggcugcguccu

SEQ ID NO: 311588 - RNA, 23 nt, Human
gcucucacuagcuacagcagauu

SEQ ID NO: 311589 - RNA, 19 nt, Human
gcugccugucuccccacuc

SEQ ID NO: 311590 - RNA, 18 nt, Human
gcuggggcgcagagccag

SEQ ID NO: 311591 - RNA, 23 nt, Human
ggaacaaacacugaguguaggga

SEQ ID NO: 311592 - RNA, 20 nt, Human
ggaagauggguacacgaggc

SEQ ID NO: 311593 - RNA, 23 nt, Human
ggaauuuacgcccagaacgaugg

SEQ ID NO: 311594 - RNA, 19 nt, Human
ggagugccaggggcaaugg

SEQ ID NO: 311595 - RNA, 24 nt, Human
ggcccggggcucccgagucgcgcu

SEQ ID NO: 311596 - RNA, 20 nt, Human
ggccgggagcagguggcugc

SEQ ID NO: 311597 - RNA, 23 nt, Human
gggaaaccacaguuuaccacuga

SEQ ID NO: 311598 - RNA, 20 nt, Human
gggagcagguggcugcggug

SEQ ID NO: 311599 - RNA, 22 nt, Human
gggcaagaaggaagcaaacacc

SEQ ID NO: 311600 - RNA, 24 nt, Human
gggcaaugggccagugucgggccc

SEQ ID NO: 311601 - RNA, 24 nt, Human
gggcgcagagccaguggcagagga

SEQ ID NO: 311602 - RNA, 23 nt, Human
ggguagguuaacauggucacugu

SEQ ID NO: 311603 - RNA, 19 nt, Human
gguggcuccggaggccagg

SEQ ID NO: 311604 - RNA, 19 nt, Human
guaaauuccaguguacuuc

SEQ ID NO: 311605 - RNA, 23 nt, Human
gucgcgcugcggcggcucuuccu

SEQ ID NO: 311606 - RNA, 25 nt, Human
guggcagaggagcggcggcggcggc

SEQ ID NO: 311607 - RNA, 21 nt, Human
guggcccggggcucccgaguc

SEQ ID NO: 311608 - RNA, 23 nt, Human
guggguggcuccggaggccaggc

SEQ ID NO: 311609 - RNA, 28 nt, Human
guguggcguuucacccgaaaaauggccg

SEQ ID NO: 311610 - RNA, 23 nt, Human
uaaaaaaacaaaacaaaacaccu

SEQ ID NO: 311611 - RNA, 18 nt, Human
uaaccucugaaucagccc

SEQ ID NO: 311612 - RNA, 25 nt, Human
uaagcagaccugguucacgcacgga

SEQ ID NO: 311613 - RNA, 19 nt, Human
uaagccuagacuaacacag

SEQ ID NO: 311614 - RNA, 19 nt, Human
uacaaacaaguuucucagu

SEQ ID NO: 311615 - RNA, 19 nt, Human
uacuggguggagagaaccc

SEQ ID NO: 311616 - RNA, 22 nt, Human
uagaaaacaacuauaacaaaac

SEQ ID NO: 311617 - RNA, 23 nt, Human
uagaaaacaacuauaacaaaacu

SEQ ID NO: 311618 - RNA, 20 nt, Human
uagaucuugaaauaccuuuc

SEQ ID NO: 311619 - RNA, 26 nt, Human
uagcuuuuguguuccccugagaugau

SEQ ID NO: 311620 - RNA, 20 nt, Human
uaggagaaggaaaacuuggg

SEQ ID NO: 311621 - RNA, 21 nt, Human
uauaaaagcucauccaaaacu

SEQ ID NO: 311622 - RNA, 24 nt, Human
uaucagagagcauuuagaacccag

SEQ ID NO: 311623 - RNA, 23 nt, Human
uauuccuucugaggcgcacaguc

SEQ ID NO: 311624 - RNA, 21 nt, Human
ucaccugcacgcagguccccu

SEQ ID NO: 311625 - RNA, 25 nt, Human
ucagagcuacuacagccggagccug

SEQ ID NO: 311626 - RNA, 20 nt, Human
ucaggucgucagaucccacc

SEQ ID NO: 311627 - RNA, 20 nt, Human
uccauccugcccaccuccaa

SEQ ID NO: 311628 - RNA, 20 nt, Human
ucccacgggaccacaacaga

SEQ ID NO: 311629 - RNA, 25 nt, Human
ucccagacccaaugcucucugaauu

SEQ ID NO: 311630 - RNA, 19 nt, Human
ucccagaggccccaggaca

SEQ ID NO: 311631 - RNA, 18 nt, Human
uccccagccccucccccu

SEQ ID NO: 311632 - RNA, 22 nt, Human
uccccagccccucccccuaccc

SEQ ID NO: 311633 - RNA, 22 nt, Human
uccccuucucuccucaccugca

SEQ ID NO: 311634 - RNA, 23 nt, Human
uccugcccaccuccaaacacuag

SEQ ID NO: 311635 - RNA, 18 nt, Human
uccuuggacagagcgaug

SEQ ID NO: 311636 - RNA, 19 nt, Human
ucgcuggggcccuauguga

SEQ ID NO: 311637 - RNA, 24 nt, Human
ucuccaagaggccauaggguugca

SEQ ID NO: 311638 - RNA, 20 nt, Human
ucuguccuuugugucauucu

SEQ ID NO: 311639 - RNA, 18 nt, Human
ucuuauguuuguguucau

SEQ ID NO: 311640 - RNA, 20 nt, Human
ugaaauaccuuucuccauga

SEQ ID NO: 311641 - RNA, 18 nt, Human
ugaacaacaaaaggaaca

SEQ ID NO: 311642 - RNA, 22 nt, Human
ugacaguauacaauuuuccaaa

SEQ ID NO: 311643 - RNA, 20 nt, Human
ugacauagguguccuggugg

SEQ ID NO: 311644 - RNA, 19 nt, Human
ugacuuugcuggggagggg

SEQ ID NO: 311645 - RNA, 21 nt, Human
ugagaugccaccagaaacugc

SEQ ID NO: 311646 - RNA, 23 nt, Human
ugagaugccaccagaaacugcaa

SEQ ID NO: 311647 - RNA, 19 nt, Human
ugagcucaggcacuagugg

SEQ ID NO: 311648 - RNA, 20 nt, Human
ugagugagaugagcuaacug

SEQ ID NO: 311649 - RNA, 23 nt, Human
ugcgcuuuccaggcccucuuuuc

SEQ ID NO: 311650 - RNA, 19 nt, Human
ugcuggaggccaccggcag

SEQ ID NO: 311651 - RNA, 20 nt, Human
uggcaguggagggcuggguu

SEQ ID NO: 311652 - RNA, 18 nt, Human
uggcugcggugccggcgg

SEQ ID NO: 311653 - RNA, 22 nt, Human
ugggaagauggguacacgaggc

SEQ ID NO: 311654 - RNA, 21 nt, Human
ugggaggggacaccccucgga

SEQ ID NO: 311655 - RNA, 23 nt, Human
ugggccgggagcagguggcugcg

SEQ ID NO: 311656 - RNA, 20 nt, Human
uggggugguuggucuggagc

SEQ ID NO: 311657 - RNA, 20 nt, Human
uguagggagggguaagaaca

SEQ ID NO: 311658 - RNA, 23 nt, Human
ugugcagcuuggggaaaccacaa

SEQ ID NO: 311659 - RNA, 22 nt, Human
uguucuccauccugcccaccuc

SEQ ID NO: 311660 - RNA, 24 nt, Human
uuaacuauaguuuuuacaaacaag

SEQ ID NO: 311661 - RNA, 21 nt, Human
uucaaaguuucuccaguauau

SEQ ID NO: 311662 - RNA, 22 nt, Human
uucacgcacggagaccugugug

SEQ ID NO: 311663 - RNA, 18 nt, Human
uuccagcccagccaccug

SEQ ID NO: 311664 - RNA, 22 nt, Human
uuccccagccccucccccuacc

SEQ ID NO: 311665 - RNA, 19 nt, Human
uucccuuccccauccaaac

SEQ ID NO: 311666 - RNA, 19 nt, Human
uuccuuuucccccuaggau

SEQ ID NO: 311667 - RNA, 21 nt, Human
uugaaaagggaaaaauuaagg

SEQ ID NO: 311668 - RNA, 22 nt, Human
uugaggaagucacuucaucuuu

SEQ ID NO: 311669 - RNA, 19 nt, Human
uuuggccuguugacauagg

SEQ ID NO: 311670 - RNA, 18 nt, Human
uuuguucagguugaaaag

SEQ ID NO: 311671 - RNA, 19 nt, Human
uuuguucucauccuggcuc

SEQ ID NO: 311672 - RNA, 20 nt, Human
aguauauuuuauuuuuucuc

SEQ ID NO: 311673 - RNA, 25 nt, Human
caaaugucuucuuaaagaaagcucu

SEQ ID NO: 311674 - RNA, 19 nt, Human
caauuuguugaguuugaca

SEQ ID NO: 311675 - RNA, 21 nt, Human
ccggaugccgcgauauggacc

SEQ ID NO: 311676 - RNA, 22 nt, Human
gggcgggagccggaugccgcga

SEQ ID NO: 311677 - RNA, 24 nt, Human
uauuuuuucuuucucuccugaaga

SEQ ID NO: 311678 - RNA, 24 nt, Human
ucucuccugaagacgggcgggagc

SEQ ID NO: 311679 - RNA, 21 nt, Human
uggcagguacaacuucccucu

SEQ ID NO: 311680 - RNA, 19 nt, Human
uuguugaguuugacaaaug

SEQ ID NO: 311681 - RNA, 26 nt, Human
aaaaauagcaagcgagggccaauuaa

SEQ ID NO: 311682 - RNA, 21 nt, Human
aaaaauagcaagcgagggccg

SEQ ID NO: 311683 - RNA, 19 nt, Human
aaaggcccugagcaaagcc

SEQ ID NO: 311684 - RNA, 26 nt, Human
aaauagcaagcgagggccaauuaagc

SEQ ID NO: 311685 - RNA, 23 nt, Human
aacacaugauccucaccguaacc

SEQ ID NO: 311686 - RNA, 19 nt, Human
aagacaagacugaaaagga

SEQ ID NO: 311687 - RNA, 21 nt, Human
aauaauguaagagaggaaaga

SEQ ID NO: 311688 - RNA, 28 nt, Human
acacagucccaagggagaagggaacgcc

SEQ ID NO: 311689 - RNA, 18 nt, Human
accccuacacauguuaau

SEQ ID NO: 311690 - RNA, 22 nt, Human
acucaacauuuuugcagccccc

SEQ ID NO: 311691 - RNA, 22 nt, Human
agaaaaaaauagcaagcgaggg

SEQ ID NO: 311692 - RNA, 23 nt, Human
agaagaaggcacaacauacuuuu

SEQ ID NO: 311693 - RNA, 23 nt, Human
aggggcaaaaagggaaugugagu

SEQ ID NO: 311694 - RNA, 20 nt, Human
caagcgagggccaauuaagc

SEQ ID NO: 311695 - RNA, 23 nt, Human
cacagucccaagggagaaacaga

SEQ ID NO: 311696 - RNA, 24 nt, Human
cagcccccuuuccuggucuacauu

SEQ ID NO: 311697 - RNA, 18 nt, Human
cagucaggcucugagaag

SEQ ID NO: 311698 - RNA, 19 nt, Human
cagucaggcucugagaagc

SEQ ID NO: 311699 - RNA, 23 nt, Human
cauuuuguuaguauaaucuuacc

SEQ ID NO: 311700 - RNA, 18 nt, Human
ccucccucagaaaccggg

SEQ ID NO: 311701 - RNA, 21 nt, Human
cucagugugugucuguuggac

SEQ ID NO: 311702 - RNA, 19 nt, Human
gaggcacagaggaagcugg

SEQ ID NO: 311703 - RNA, 18 nt, Human
gcaaaaagggaaugugag

SEQ ID NO: 311704 - RNA, 20 nt, Human
gcuuggggaggggcucugga

SEQ ID NO: 311705 - RNA, 20 nt, Human
ggaggggagcuuggggaggg

SEQ ID NO: 311706 - RNA, 18 nt, Human
ggcaaaaagggaauguga

SEQ ID NO: 311707 - RNA, 19 nt, Human
ggcuucuaaaucuuccccc

SEQ ID NO: 311708 - RNA, 22 nt, Human
gggaggggagcuuggggagggg

SEQ ID NO: 311709 - RNA, 22 nt, Human
gggcaaaaagggaaugugagga

SEQ ID NO: 311710 - RNA, 22 nt, Human
uaaaggcccugagcaaagccug

SEQ ID NO: 311711 - RNA, 22 nt, Human
uaagcaucccucuccccguuuu

SEQ ID NO: 311712 - RNA, 19 nt, Human
uagggccagaguggaggca

SEQ ID NO: 311713 - RNA, 24 nt, Human
uauugugaagaaaugagaaaaaaa

SEQ ID NO: 311714 - RNA, 18 nt, Human
ucccucagaaaccggguc

SEQ ID NO: 311715 - RNA, 18 nt, Human
ugaagaaaugagaaaaaa

SEQ ID NO: 311716 - RNA, 19 nt, Human
ugcagcccccuuuccuggu

SEQ ID NO: 311717 - RNA, 20 nt, Human
uggaggcacagaggaagcug

SEQ ID NO: 311718 - RNA, 22 nt, Human
uggaggcacagaggaagcuggg

SEQ ID NO: 311719 - RNA, 21 nt, Human
uggggaggggagcuuggggag

SEQ ID NO: 311720 - RNA, 23 nt, Human
uggggaggggagcuuggggaggg

SEQ ID NO: 311721 - RNA, 18 nt, Human
ugugucuguuggacuuug

SEQ ID NO: 311722 - RNA, 22 nt, Human
uguuagaguaucaaauuauuuu

SEQ ID NO: 311723 - RNA, 22 nt, Human
uguuaguauaaucuuaccaaua

SEQ ID NO: 311724 - RNA, 23 nt, Human
uuacauuccagcuacucucaauc

SEQ ID NO: 311725 - RNA, 23 nt, Human
uuagggccagaguggaggcacag

SEQ ID NO: 311726 - RNA, 24 nt, Human
uucaacuacccccuccuugguuac

SEQ ID NO: 311727 - RNA, 25 nt, Human
uucaacuacccccuccuugguuacu

SEQ ID NO: 311728 - RNA, 18 nt, Human
uucuaaaucuucccccuc

SEQ ID NO: 311729 - RNA, 26 nt, Human
aaaaacaccaaagacccuuacauagc

SEQ ID NO: 311730 - RNA, 21 nt, Human
aagaagaaacaaucauuuaaa

SEQ ID NO: 311731 - RNA, 33 nt, Human
aagaagaaacaaucauuuaaaaacaccaaagga

SEQ ID NO: 311732 - RNA, 19 nt, Human
aagcaaaagcaugaagaag

SEQ ID NO: 311733 - RNA, 25 nt, Human
aagcaaaagcaugaagaagaaacaa

SEQ ID NO: 311734 - RNA, 27 nt, Human
aagcaaaagcaugaagaagagggaccc

SEQ ID NO: 311735 - RNA, 23 nt, Human
aagcaugaagaagaaacaaucau

SEQ ID NO: 311736 - RNA, 18 nt, Human
accccagaguguucagaa

SEQ ID NO: 311737 - RNA, 19 nt, Human
caagcaaaagcaugaagaa

SEQ ID NO: 311738 - RNA, 23 nt, Human
cacccgagaaccccagaguguuc

SEQ ID NO: 311739 - RNA, 23 nt, Human
cagggacuagagcccucucccag

SEQ ID NO: 311740 - RNA, 27 nt, Human
cauagcaaagguuaagaaauaaauuaa

SEQ ID NO: 311741 - RNA, 21 nt, Human
ccccagaguguucagaaccag

SEQ ID NO: 311742 - RNA, 18 nt, Human
cccuuacauagcaaaggu

SEQ ID NO: 311743 - RNA, 23 nt, Human
ccgagaaccccagaguguucaga

SEQ ID NO: 311744 - RNA, 26 nt, Human
gagaaccccagaguguucagaaccag

SEQ ID NO: 311745 - RNA, 28 nt, Human
ggacuagagcccucucccaaccggaggg

SEQ ID NO: 311746 - RNA, 26 nt, Human
uaaaaacaccaaagacccuuacauag

SEQ ID NO: 311747 - RNA, 23 nt, Human
uaagaaauaaauuaagacuccua

SEQ ID NO: 311748 - RNA, 21 nt, Human
uauuggguugugucugccagg

SEQ ID NO: 311749 - RNA, 20 nt, Human
uggguugugucugccaggga

SEQ ID NO: 311750 - RNA, 19 nt, Human
uugacuacauugcaagcaa

SEQ ID NO: 311751 - RNA, 18 nt, Human
acgccgccgugaccccug

SEQ ID NO: 311752 - RNA, 18 nt, Human
cccgcccccgccccaugg

SEQ ID NO: 311753 - RNA, 28 nt, Human
caaugccgacacugcagggaaugaacag

SEQ ID NO: 311754 - RNA, 21 nt, Human
cagcuucgcccaggccaagga

SEQ ID NO: 311755 - RNA, 18 nt, Human
cagggaaugaacagccuc

SEQ ID NO: 311756 - RNA, 19 nt, Human
ccacacagcuucgcccagg

SEQ ID NO: 311757 - RNA, 19 nt, Human
ccaggccaaggagguucaa

SEQ ID NO: 311758 - RNA, 18 nt, Human
gaacagccuccaucuggg

SEQ ID NO: 311759 - RNA, 22 nt, Human
gccgacacugcagggaaugaac

SEQ ID NO: 311760 - RNA, 20 nt, Human
ggucaaaaccacuuuuuuga

SEQ ID NO: 311761 - RNA, 22 nt, Human
ugcagggaaugaacagccucca

SEQ ID NO: 311762 - RNA, 21 nt, Human
uugcuugguccacacagcuuc

SEQ ID NO: 311763 - RNA, 18 nt, Human
aagcgaagacgaagcaag

SEQ ID NO: 311764 - RNA, 19 nt, Human
agaaaagcgaagacgaagg

SEQ ID NO: 311765 - RNA, 21 nt, Human
agacggagaggcaaacaaagc

SEQ ID NO: 311766 - RNA, 20 nt, Human
aggaaagaagggggcccuga

SEQ ID NO: 311767 - RNA, 21 nt, Human
agggggcccugagggaaaaca

SEQ ID NO: 311768 - RNA, 22 nt, Human
gaaaacagacggagaggcaaac

SEQ ID NO: 311769 - RNA, 18 nt, Human
gaaaagcgaagacgaagc

SEQ ID NO: 311770 - RNA, 20 nt, Human
gaaagacacagauaagaaua

SEQ ID NO: 311771 - RNA, 18 nt, Human
gaggcaaacaaagcgaaa

SEQ ID NO: 311772 - RNA, 22 nt, Human
ggucgaggaaagaagggggccc

SEQ ID NO: 311773 - RNA, 18 nt, Human
uaagcagaaaacugauga

SEQ ID NO: 311774 - RNA, 19 nt, Human
uaagcagaaaacugaugaa

SEQ ID NO: 311775 - RNA, 23 nt, Human
uuugaaaaggucgaggaaagaag

SEQ ID NO: 311776 - RNA, 22 nt, Human
aaaaagcacagcugaaagccug

SEQ ID NO: 311777 - RNA, 18 nt, Human
aagaagaaaaggaaaaaa

SEQ ID NO: 311778 - RNA, 19 nt, Human
aagaagaaaaggaaaaaau

SEQ ID NO: 311779 - RNA, 20 nt, Human
accuggcuuugggcuccagc

SEQ ID NO: 311780 - RNA, 25 nt, Human
agaacaaagaaccagccaagaagaa

SEQ ID NO: 311781 - RNA, 26 nt, Human
aucuucuuggcagguccugcuacuga

SEQ ID NO: 311782 - RNA, 20 nt, Human
aucuugguucugaacccacu

SEQ ID NO: 311783 - RNA, 28 nt, Human
caaaaagcacagcugaaagccggggccc

SEQ ID NO: 311784 - RNA, 22 nt, Human
caaagaaccagccaagaagaaa

SEQ ID NO: 311785 - RNA, 23 nt, Human
caaagaaccagccaagaagaaaa

SEQ ID NO: 311786 - RNA, 22 nt, Human
caagcaacaaugccccuugucc

SEQ ID NO: 311787 - RNA, 19 nt, Human
caccaccccgaugaagcuc

SEQ ID NO: 311788 - RNA, 24 nt, Human
caccaccccgaugaagcuccacgg

SEQ ID NO: 311789 - RNA, 18 nt, Human
cagaacaaagaaccagcc

SEQ ID NO: 311790 - RNA, 18 nt, Human
ccaagaagaaaaggaaaa

SEQ ID NO: 311791 - RNA, 20 nt, Human
cccaaauccucgguccucac

SEQ ID NO: 311792 - RNA, 21 nt, Human
cccacugaauucaacugcacc

SEQ ID NO: 311793 - RNA, 21 nt, Human
cccgaccccaggcccacggcc

SEQ ID NO: 311794 - RNA, 19 nt, Human
ccuguaguccacaccgaug

SEQ ID NO: 311795 - RNA, 22 nt, Human
ccuucuuuuuauuuccacugcc

SEQ ID NO: 311796 - RNA, 22 nt, Human
ccuuguccuguaguccacaccg

SEQ ID NO: 311797 - RNA, 20 nt, Human
cgcagccucgggguagcgug

SEQ ID NO: 311798 - RNA, 19 nt, Human
cucccccgaccccaggccc

SEQ ID NO: 311799 - RNA, 18 nt, Human
cuuggcagguccugcuac

SEQ ID NO: 311800 - RNA, 25 nt, Human
cuuuuuauuuccacugccuuggagc

SEQ ID NO: 311801 - RNA, 18 nt, Human
gagcauuaauucuuuccc

SEQ ID NO: 311802 - RNA, 19 nt, Human
gccucgggguagcgugugg

SEQ ID NO: 311803 - RNA, 23 nt, Human
ggccuuaggcaagcccuuuugca

SEQ ID NO: 311804 - RNA, 20 nt, Human
guccugucucugcucuccug

SEQ ID NO: 311805 - RNA, 20 nt, Human
uagaaggaaucuucuuggca

SEQ ID NO: 311806 - RNA, 20 nt, Human
ucccccgaccccaggcccac

SEQ ID NO: 311807 - RNA, 19 nt, Human
uccuguaguccacaccgau

SEQ ID NO: 311808 - RNA, 21 nt, Human
ugcaaaaagcacagcugaaag

SEQ ID NO: 311809 - RNA, 26 nt, Human
ugccuuccaccccaaauccucggucc

SEQ ID NO: 311810 - RNA, 21 nt, Human
ugcugcucccccgaccccagg

SEQ ID NO: 311811 - RNA, 18 nt, Human
uggcuuugggcuccagcu

SEQ ID NO: 311812 - RNA, 23 nt, Human
uggcuuugggcuccagcuuggcu

SEQ ID NO: 311813 - RNA, 24 nt, Human
uggcuuugggcuccagcuuggcuu

SEQ ID NO: 311814 - RNA, 20 nt, Human
ugucucugcucuccugucaa

SEQ ID NO: 311815 - RNA, 18 nt, Human
uuacccaacaagcaacaa

SEQ ID NO: 311816 - RNA, 19 nt, Human
uugcaaaaagcacagcuga

SEQ ID NO: 311817 - RNA, 24 nt, Human
uuggagcagguuuaucacguuaga

SEQ ID NO: 311818 - RNA, 26 nt, Human
uuggagcagguuuaucacguuagaga

SEQ ID NO: 311819 - RNA, 26 nt, Human
uuuuuuuucuuuuuuuuccuucuuuu

SEQ ID NO: 311820 - RNA, 25 nt, Human
uuuuuuuuuuuuuuuuuuucuuuuu

SEQ ID NO: 311821 - RNA, 21 nt, Human
aaagauaaagaccuguaaaga

SEQ ID NO: 311822 - RNA, 19 nt, Human
aaagugcuggcauuacagg

SEQ ID NO: 311823 - RNA, 24 nt, Human
aaagugcuggcauuacagguauga

SEQ ID NO: 311824 - RNA, 24 nt, Human
aaaguguuaggauuacaggcguga

SEQ ID NO: 311825 - RNA, 24 nt, Human
aaauccuacaggcaagccugaggg

SEQ ID NO: 311826 - RNA, 21 nt, Human
aaaugcuaaagauuaaaaacu

SEQ ID NO: 311827 - RNA, 21 nt, Human
aacaaacaccuggcaaaacug

SEQ ID NO: 311828 - RNA, 21 nt, Human
aagcaauucuucugccucagc

SEQ ID NO: 311829 - RNA, 20 nt, Human
aagguaacaaacaccugggg

SEQ ID NO: 311830 - RNA, 22 nt, Human
aaguagcugggaucacaggugc

SEQ ID NO: 311831 - RNA, 26 nt, Human
aaguguuaggauuacaggcgugagcc

SEQ ID NO: 311832 - RNA, 18 nt, Human
aauggaagggcuccugaa

SEQ ID NO: 311833 - RNA, 24 nt, Human
accucgugaucugcccgccuuggc

SEQ ID NO: 311834 - RNA, 24 nt, Human
agaugguuuugccauguuggccag

SEQ ID NO: 311835 - RNA, 18 nt, Human
agccucccgaguagcugg

SEQ ID NO: 311836 - RNA, 23 nt, Human
agguaugagccacugugccuggc

SEQ ID NO: 311837 - RNA, 24 nt, Human
aggugaucugucugccucggccuc

SEQ ID NO: 311838 - RNA, 20 nt, Human
aguagagaugguuuugccau

SEQ ID NO: 311839 - RNA, 19 nt, Human
aguagcugggaucacaggc

SEQ ID NO: 311840 - RNA, 21 nt, Human
agugcgguggcgcaaucucag

SEQ ID NO: 311841 - RNA, 24 nt, Human
agugcgguggcgcaaucucagcuc

SEQ ID NO: 311842 - RNA, 19 nt, Human
aucugcccgccuuggccuc

SEQ ID NO: 311843 - RNA, 19 nt, Human
augacacugccucccuaaa

SEQ ID NO: 311844 - RNA, 23 nt, Human
augcaaccuccgccuccaagguu

SEQ ID NO: 311845 - RNA, 20 nt, Human
augggguuucaccauauugg

SEQ ID NO: 311846 - RNA, 21 nt, Human
augggguuucaccauauuggu

SEQ ID NO: 311847 - RNA, 25 nt, Human
auuaaaaauuucauaauucccuuuc

SEQ ID NO: 311848 - RNA, 20 nt, Human
auuacagguaugagccacug

SEQ ID NO: 311849 - RNA, 18 nt, Human
auucuccugccuuagccu

SEQ ID NO: 311850 - RNA, 24 nt, Human
auuuuaguagagaugggguuucac

SEQ ID NO: 311851 - RNA, 24 nt, Human
caaagugcuggcauuacagguaug

SEQ ID NO: 311852 - RNA, 24 nt, Human
caaaguguuaggauuacaggcgug

SEQ ID NO: 311853 - RNA, 20 nt, Human
caagugauucuccugccuua

SEQ ID NO: 311854 - RNA, 22 nt, Human
caagugauucuccugccuuagc

SEQ ID NO: 311855 - RNA, 23 nt, Human
caaucucagcucaccccaaccuc

SEQ ID NO: 311856 - RNA, 22 nt, Human
caccauauuggucugaaacucc

SEQ ID NO: 311857 - RNA, 23 nt, Human
caccccaaccucugccuccuggg

SEQ ID NO: 311858 - RNA, 19 nt, Human
caccuggcaaaacugccag

SEQ ID NO: 311859 - RNA, 22 nt, Human
cagagcuaaguuugcaaccacg

SEQ ID NO: 311860 - RNA, 18 nt, Human
cagcagcgguugccgaaa

SEQ ID NO: 311861 - RNA, 22 nt, Human
cagcagcgguugccgaaaaugc

SEQ ID NO: 311862 - RNA, 24 nt, Human
cagcagugggauuagaauccaugc

SEQ ID NO: 311863 - RNA, 22 nt, Human
cagugaguuucgagcgagauuu

SEQ ID NO: 311864 - RNA, 24 nt, Human
cauguuggccaggcuggucucaaa

SEQ ID NO: 311865 - RNA, 24 nt, Human
cauuacagguaugagccacugugc

SEQ ID NO: 311866 - RNA, 21 nt, Human
ccaaagugcuggcauuacagg

SEQ ID NO: 311867 - RNA, 21 nt, Human
ccaaagugcuggcauuacagg

SEQ ID NO: 311868 - RNA, 24 nt, Human
ccaaagugcuggcauuacagguau

SEQ ID NO: 311869 - RNA, 22 nt, Human
ccaaaguguuaggauuacaggc

SEQ ID NO: 311870 - RNA, 24 nt, Human
ccaaaguguuaggauuacaggcgu

SEQ ID NO: 311871 - RNA, 19 nt, Human
ccauguuggccaggcuggu

SEQ ID NO: 311872 - RNA, 23 nt, Human
ccccaaccucugccuccuggguu

SEQ ID NO: 311873 - RNA, 19 nt, Human
cccgaguagcugggaucac

SEQ ID NO: 311874 - RNA, 22 nt, Human
cccgccuuggccucccaaagug

SEQ ID NO: 311875 - RNA, 21 nt, Human
ccuccuggguucaagugauuc

SEQ ID NO: 311876 - RNA, 24 nt, Human
ccuccuggguucaagugauucucc

SEQ ID NO: 311877 - RNA, 22 nt, Human
ccucugccuccuggguucaagu

SEQ ID NO: 311878 - RNA, 23 nt, Human
ccugaccucaggugaucugucug

SEQ ID NO: 311879 - RNA, 24 nt, Human
ccugaccucgugaucugcccgccu

SEQ ID NO: 311880 - RNA, 26 nt, Human
ccugaccucgugaucugcccgccuug

SEQ ID NO: 311881 - RNA, 24 nt, Human
ccugccuuagccucccgaguagcu

SEQ ID NO: 311882 - RNA, 23 nt, Human
ccuggguucaagugauucuccuc

SEQ ID NO: 311883 - RNA, 23 nt, Human
ccuggguucaagugauucuccug

SEQ ID NO: 311884 - RNA, 24 nt, Human
cgcucuguugcccaggcuggagcg

SEQ ID NO: 311885 - RNA, 24 nt, Human
cucaccccaaccucugccuccugg

SEQ ID NO: 311886 - RNA, 22 nt, Human
cucagccuccaaguagcuggga

SEQ ID NO: 311887 - RNA, 26 nt, Human
cuccugaccucaggugaucugucugc

SEQ ID NO: 311888 - RNA, 24 nt, Human
cuccugaccucgugaucugcccgc

SEQ ID NO: 311889 - RNA, 21 nt, Human
cuccuggguucaagugauucu

SEQ ID NO: 311890 - RNA, 24 nt, Human
cucgcucuguugcccaggcuggag

SEQ ID NO: 311891 - RNA, 24 nt, Human
cucgcucuguugcccaggcuggag

SEQ ID NO: 311892 - RNA, 20 nt, Human
cucuguugcccaggcuggag

SEQ ID NO: 311893 - RNA, 18 nt, Human
cugccucggccucccaaa

SEQ ID NO: 311894 - RNA, 23 nt, Human
cuuagccucccgaguagcuggga

SEQ ID NO: 311895 - RNA, 24 nt, Human
gaccucaggugaucugucugccuc

SEQ ID NO: 311896 - RNA, 21 nt, Human
gaccucgugaucugcccgccu

SEQ ID NO: 311897 - RNA, 24 nt, Human
gaccucgugaucugcccgccuugg

SEQ ID NO: 311898 - RNA, 19 nt, Human
gagaaugugaagaaaauga

SEQ ID NO: 311899 - RNA, 24 nt, Human
gagaugggguuucaccauauuggu

SEQ ID NO: 311900 - RNA, 24 nt, Human
gaguagcugggaucacaggcgugc

SEQ ID NO: 311901 - RNA, 24 nt, Human
gaugguuuugccauguuggccagg

SEQ ID NO: 311902 - RNA, 18 nt, Human
gauuacaggcgugagcca

SEQ ID NO: 311903 - RNA, 21 nt, Human
gauuacaggcgugagccauug

SEQ ID NO: 311904 - RNA, 24 nt, Human
gauuacaggcgugagccauuguac

SEQ ID NO: 311905 - RNA, 18 nt, Human
gccauguuggccaggcug

SEQ ID NO: 311906 - RNA, 20 nt, Human
gccauguuggccaggcuggu

SEQ ID NO: 311907 - RNA, 20 nt, Human
gccuuagccucccgaguagc

SEQ ID NO: 311908 - RNA, 22 nt, Human
gccuuggccucccaaagugcug

SEQ ID NO: 311909 - RNA, 27 nt, Human
gcucuguugcccaggcuggagcgcacu

SEQ ID NO: 311910 - RNA, 25 nt, Human
gcucuguugcccaggcuggagugcg

SEQ ID NO: 311911 - RNA, 23 nt, Human
gcuggucucaaacuccugaccuc

SEQ ID NO: 311912 - RNA, 23 nt, Human
ggagucucgcucuguugcccagg

SEQ ID NO: 311913 - RNA, 24 nt, Human
ggauuacaggcgugagccauugua

SEQ ID NO: 311914 - RNA, 18 nt, Human
ggcaaaacugccagcagc

SEQ ID NO: 311915 - RNA, 21 nt, Human
ggcauuacagguaugagccac

SEQ ID NO: 311916 - RNA, 24 nt, Human
ggcuggucucaaacuccugaccuc

SEQ ID NO: 311917 - RNA, 18 nt, Human
gggguuucaccauauugg

SEQ ID NO: 311918 - RNA, 20 nt, Human
gguuuugccauguuggccag

SEQ ID NO: 311919 - RNA, 21 nt, Human
gguuuugccauguuggccagg

SEQ ID NO: 311920 - RNA, 21 nt, Human
guagagaugguuuugccaugu

SEQ ID NO: 311921 - RNA, 24 nt, Human
gugauucuccugccuuagccuccc

SEQ ID NO: 311922 - RNA, 22 nt, Human
uaacaaacaccuggcaaaacug

SEQ ID NO: 311923 - RNA, 23 nt, Human
uaauuuuucuauuuuuaguagag

SEQ ID NO: 311924 - RNA, 24 nt, Human
uaauuuuucuauuuuuaguagaga

SEQ ID NO: 311925 - RNA, 27 nt, Human
uaauuuuuuuuguaauuuuaguagaga

SEQ ID NO: 311926 - RNA, 19 nt, Human
uacaggcgugagccauugu

SEQ ID NO: 311927 - RNA, 22 nt, Human
uacagguaugagccacugugcc

SEQ ID NO: 311928 - RNA, 23 nt, Human
uacauuuaaaacccuuuuuuaaa

SEQ ID NO: 311929 - RNA, 18 nt, Human
uagcaugaucucagcuca

SEQ ID NO: 311930 - RNA, 19 nt, Human
uaggauuacaggcgugagc

SEQ ID NO: 311931 - RNA, 21 nt, Human
uaggauuacaggcgugagcca

SEQ ID NO: 311932 - RNA, 21 nt, Human
uaggauuacaggcgugagcca

SEQ ID NO: 311933 - RNA, 22 nt, Human
uaggauuacaggcgugagccau

SEQ ID NO: 311934 - RNA, 24 nt, Human
uaggauuacaggcgugagccauug

SEQ ID NO: 311935 - RNA, 31 nt, Human
uaggauuacaggcgugagccauuguacccgg

SEQ ID NO: 311936 - RNA, 19 nt, Human
uaguagagaugggguuuca

SEQ ID NO: 311937 - RNA, 23 nt, Human
uaguagagaugggguuucaccau

SEQ ID NO: 311938 - RNA, 26 nt, Human
uaguagagaugggguuucaccauauu

SEQ ID NO: 311939 - RNA, 22 nt, Human
uaguagagaugguuuugccaug

SEQ ID NO: 311940 - RNA, 23 nt, Human
uaucuccauuuuacagaugagaa

SEQ ID NO: 311941 - RNA, 26 nt, Human
ucaagguaacaaacaccuggcaaaac

SEQ ID NO: 311942 - RNA, 19 nt, Human
ucaagugauucuccugccu

SEQ ID NO: 311943 - RNA, 18 nt, Human
ucaaugcaaccuccgccu

SEQ ID NO: 311944 - RNA, 19 nt, Human
ucaaugcaaccuccgccuc

SEQ ID NO: 311945 - RNA, 24 nt, Human
ucaaugcaaccuccgccuccaagg

SEQ ID NO: 311946 - RNA, 27 nt, Human
ucaaugcaaccuccgccuccaagguua

SEQ ID NO: 311947 - RNA, 24 nt, Human
ucaccccaaccucugccuccuggg

SEQ ID NO: 311948 - RNA, 20 nt, Human
ucagggaaaucuguaaagau

SEQ ID NO: 311949 - RNA, 24 nt, Human
uccaagguuaaagcaauucuucug

SEQ ID NO: 311950 - RNA, 19 nt, Human
uccaaguagcugggaucac

SEQ ID NO: 311951 - RNA, 22 nt, Human
uccaaguagcugggaucacagg

SEQ ID NO: 311952 - RNA, 23 nt, Human
uccaaguagcugggaucacaggu

SEQ ID NO: 311953 - RNA, 23 nt, Human
ucccaaagugcuggcauuacagg

SEQ ID NO: 311954 - RNA, 24 nt, Human
ucccaaaguguuaggauuacaggc

SEQ ID NO: 311955 - RNA, 24 nt, Human
ucccgaguagcugggaucacaggc

SEQ ID NO: 311956 - RNA, 20 nt, Human
ucccuaaaugcuaaagauua

SEQ ID NO: 311957 - RNA, 24 nt, Human
uccgccuccaagguuaaagcaauu

SEQ ID NO: 311958 - RNA, 21 nt, Human
uccuggguucaagugauucuc

SEQ ID NO: 311959 - RNA, 22 nt, Human
uccuggguucaagugauucucc

SEQ ID NO: 311960 - RNA, 24 nt, Human
uccuggguucaagugauucuccug

SEQ ID NO: 311961 - RNA, 24 nt, Human
ucgcucuguugcccaggcuggagu

SEQ ID NO: 311962 - RNA, 22 nt, Human
ucuccauuuuacagaugagaau

SEQ ID NO: 311963 - RNA, 24 nt, Human
ucuccugccuuagccucccgagua

SEQ ID NO: 311964 - RNA, 19 nt, Human
ucucgcucuguugcccagg

SEQ ID NO: 311965 - RNA, 19 nt, Human
ucucgcucuguugcccagg

SEQ ID NO: 311966 - RNA, 23 nt, Human
ucucgcucuguugcccaggcugg

SEQ ID NO: 311967 - RNA, 23 nt, Human
ucucgcucuguugcccaggcugg

SEQ ID NO: 311968 - RNA, 24 nt, Human
ucucgcucuguugcccaggcugga

SEQ ID NO: 311969 - RNA, 24 nt, Human
ucucgcucuguugcccaggcugga

SEQ ID NO: 311970 - RNA, 26 nt, Human
ucucgcucuguugcccaggcuggagc

SEQ ID NO: 311971 - RNA, 23 nt, Human
ucugccucagccuccaaguagcu

SEQ ID NO: 311972 - RNA, 23 nt, Human
ucuguaagguauuaucuccauuu

SEQ ID NO: 311973 - RNA, 18 nt, Human
ucuguugcccaggcugga

SEQ ID NO: 311974 - RNA, 18 nt, Human
ucuguugcccaggcugga

SEQ ID NO: 311975 - RNA, 24 nt, Human
ucuguugcccaggcuggagugcgg

SEQ ID NO: 311976 - RNA, 18 nt, Human
ugaagucucgcucuguug

SEQ ID NO: 311977 - RNA, 19 nt, Human
ugaccucaggugaucuguc

SEQ ID NO: 311978 - RNA, 24 nt, Human
ugaccucaggugaucugucugccu

SEQ ID NO: 311979 - RNA, 25 nt, Human
ugacgacggagaaaccgagaaggga

SEQ ID NO: 311980 - RNA, 25 nt, Human
ugagaaugugaagaaaaugacuugu

SEQ ID NO: 311981 - RNA, 22 nt, Human
ugagaugaagucucgcucuguu

SEQ ID NO: 311982 - RNA, 22 nt, Human
ugagauggagucucgcucuguu

SEQ ID NO: 311983 - RNA, 24 nt, Human
ugccauguuggccaggcuggucuc

SEQ ID NO: 311984 - RNA, 27 nt, Human
ugccauguuggccaggcuggucucaaa

SEQ ID NO: 311985 - RNA, 19 nt, Human
ugcccaggcuggagugcgg

SEQ ID NO: 311986 - RNA, 21 nt, Human
ugcccaggcuggagugcggug

SEQ ID NO: 311987 - RNA, 21 nt, Human
ugcccaggcuggagugcggug

SEQ ID NO: 311988 - RNA, 24 nt, Human
ugcccaggcuggagugcgguggcg

SEQ ID NO: 311989 - RNA, 20 nt, Human
ugcccgggcaaccgucccca

SEQ ID NO: 311990 - RNA, 24 nt, Human
ugccgaaaaugcuggguucggugc

SEQ ID NO: 311991 - RNA, 23 nt, Human
ugccucagccuccaaguagcugg

SEQ ID NO: 311992 - RNA, 22 nt, Human
ugccuccuggguucaagugauu

SEQ ID NO: 311993 - RNA, 22 nt, Human
ugccucggccucccaaaguguu

SEQ ID NO: 311994 - RNA, 24 nt, Human
ugccuggcuaauuuuucuauuuuu

SEQ ID NO: 311995 - RNA, 21 nt, Human
ugccugugaagagaugggacc

SEQ ID NO: 311996 - RNA, 23 nt, Human
ugccugugaagagaugggaccgu

SEQ ID NO: 311997 - RNA, 24 nt, Human
ugccuuagccucccgaguagcugg

SEQ ID NO: 311998 - RNA, 23 nt, Human
ugcgguggcgcaaucucagcuca

SEQ ID NO: 311999 - RNA, 23 nt, Human
uggagcgcacuagcaugaucuca

SEQ ID NO: 312000 - RNA, 24 nt, Human
uggagucucgcucuguugcccagg

SEQ ID NO: 312001 - RNA, 18 nt, Human
uggagugcgguggcgcaa

SEQ ID NO: 312002 - RNA, 23 nt, Human
uggagugcgguggcgcaaucuca

SEQ ID NO: 312003 - RNA, 24 nt, Human
uggagugcgguggcgcaaucucag

SEQ ID NO: 312004 - RNA, 21 nt, Human
uggcauuacagguaugagcca

SEQ ID NO: 312005 - RNA, 22 nt, Human
uggcauuacagguaugagccac

SEQ ID NO: 312006 - RNA, 24 nt, Human
uggcauuacagguaugagccacug

SEQ ID NO: 312007 - RNA, 24 nt, Human
uggccaggcuggucucaaacuccu

SEQ ID NO: 312008 - RNA, 24 nt, Human
uggcgcaaucucagcucaccccaa

SEQ ID NO: 312009 - RNA, 21 nt, Human
ugggaucacaggcgugcacca

SEQ ID NO: 312010 - RNA, 24 nt, Human
ugggaucacaggcgugcaccacca

SEQ ID NO: 312011 - RNA, 19 nt, Human
ugggguuucaccauauugg

SEQ ID NO: 312012 - RNA, 23 nt, Human
uggguucaagugauucuccugcc

SEQ ID NO: 312013 - RNA, 24 nt, Human
uggguucaagugauucuccugccu

SEQ ID NO: 312014 - RNA, 21 nt, Human
uggucugaaacuccugaccuc

SEQ ID NO: 312015 - RNA, 22 nt, Human
ugugacgacggagaaaccgaga

SEQ ID NO: 312016 - RNA, 18 nt, Human
uuaguagagaugggguuu

SEQ ID NO: 312017 - RNA, 22 nt, Human
uuaguagagaugggguuucacc

SEQ ID NO: 312018 - RNA, 24 nt, Human
uuaguagagaugggguuucaccau

SEQ ID NO: 312019 - RNA, 22 nt, Human
uuaguagagaugguuuugccau

SEQ ID NO: 312020 - RNA, 20 nt, Human
uucaagugauucuccugccu

SEQ ID NO: 312021 - RNA, 24 nt, Human
uucaagugauucuccugccuuagc

SEQ ID NO: 312022 - RNA, 24 nt, Human
uugccauguuggccaggcuggucu

SEQ ID NO: 312023 - RNA, 18 nt, Human
uugcccaggcuggagcgc

SEQ ID NO: 312024 - RNA, 24 nt, Human
uugcccaggcuggagugcgguggc

SEQ ID NO: 312025 - RNA, 18 nt, Human
uuggccucccaaagugcu

SEQ ID NO: 312026 - RNA, 20 nt, Human
uuuucuauuuuuaguagaga

SEQ ID NO: 312027 - RNA, 23 nt, Human
uuuugccauguuggccaggcugg

SEQ ID NO: 312028 - RNA, 20 nt, Human
uuuuuaguagagaugguuuu

SEQ ID NO: 312029 - RNA, 21 nt, Human
uuuuuguaauuuuaguagaga

SEQ ID NO: 312030 - RNA, 18 nt, Human
uuuuuuguaauuuuagua

SEQ ID NO: 312031 - RNA, 21 nt, Human
uuuuuuguaauuuuaguagag

SEQ ID NO: 312032 - RNA, 22 nt, Human
uuuuuuguaauuuuaguagaga

SEQ ID NO: 312033 - RNA, 24 nt, Human
uuuuuuguaauuuuaguagagaug

SEQ ID NO: 312034 - RNA, 20 nt, Human
aaaccgcuaauccgaaaaua

SEQ ID NO: 312035 - RNA, 19 nt, Human
ccucgucgucgccgccgcc

SEQ ID NO: 312036 - RNA, 19 nt, Human
ccucgucgucgccgccgcc

SEQ ID NO: 312037 - RNA, 21 nt, Human
ccuugcuuuucagaccuuuuu

SEQ ID NO: 312038 - RNA, 20 nt, Human
cgccgccuuccuccuccggc

SEQ ID NO: 312039 - RNA, 26 nt, Human
cgccuuccuccuccggcuccaccccc

SEQ ID NO: 312040 - RNA, 22 nt, Human
cucgucgucgccgccgccuucc

SEQ ID NO: 312041 - RNA, 21 nt, Human
cuuccucgucgucgccgccgc

SEQ ID NO: 312042 - RNA, 20 nt, Human
ucgccgccgccuuccuccuc

SEQ ID NO: 312043 - RNA, 25 nt, Human
ucuggaacaguuuacuccguuauug

SEQ ID NO: 312044 - RNA, 19 nt, Human
ucuguuauauuuuuacgcu

SEQ ID NO: 312045 - RNA, 21 nt, Human
ucuuccucgucgucgccgccg

SEQ ID NO: 312046 - RNA, 21 nt, Human
ucuuccucgucgucgccgcua

SEQ ID NO: 312047 - RNA, 24 nt, Human
uuaauaaaccgcuaauccgaaaau

SEQ ID NO: 312048 - RNA, 26 nt, Human
uuaauaaaccgcuaauccgaaaauaa

SEQ ID NO: 312049 - RNA, 22 nt, Human
uuacauuauuucuucuguuaua

SEQ ID NO: 312050 - RNA, 23 nt, Human
uuccucgucgucgccgccgccuu

SEQ ID NO: 312051 - RNA, 24 nt, Human
uuuuacauuauuucuucuguuaua

SEQ ID NO: 312052 - RNA, 18 nt, Human
uuuuuuuuuuuuuuuuug

SEQ ID NO: 312053 - RNA, 18 nt, Human
aaacuuaaaaucagaaag

SEQ ID NO: 312054 - RNA, 24 nt, Human
aaagggcuggcauuacagguguga

SEQ ID NO: 312055 - RNA, 24 nt, Human
aacaaaguaguuaagugcugaaaa

SEQ ID NO: 312056 - RNA, 23 nt, Human
aaguaguucuccugccucagcca

SEQ ID NO: 312057 - RNA, 26 nt, Human
aauuuuaauuaugaaugcucaugaag

SEQ ID NO: 312058 - RNA, 22 nt, Human
acauaauugacaagaaaugaaa

SEQ ID NO: 312059 - RNA, 23 nt, Human
agacacuaggaucaaugccaaca

SEQ ID NO: 312060 - RNA, 24 nt, Human
aggcgugugccaccaagccuggcu

SEQ ID NO: 312061 - RNA, 18 nt, Human
aggcugcgcgagcgacgg

SEQ ID NO: 312062 - RNA, 18 nt, Human
agggcuggcauuacaggu

SEQ ID NO: 312063 - RNA, 24 nt, Human
aguacaguggcaagaucuuggcug

SEQ ID NO: 312064 - RNA, 19 nt, Human
aguagcugggauuacaggc

SEQ ID NO: 312065 - RNA, 23 nt, Human
aguagcugggauuacaggcgugu

SEQ ID NO: 312066 - RNA, 24 nt, Human
auagcacaaaaguacuuggagaaa

SEQ ID NO: 312067 - RNA, 21 nt, Human
auccuucuuuauagauuugug

SEQ ID NO: 312068 - RNA, 20 nt, Human
auuacaggugugagccauug

SEQ ID NO: 312069 - RNA, 22 nt, Human
caaaaguacuuggagaaacuac

SEQ ID NO: 312070 - RNA, 22 nt, Human
caaguaguucuccugccucagc

SEQ ID NO: 312071 - RNA, 19 nt, Human
caccaagccuggcuaauuu

SEQ ID NO: 312072 - RNA, 24 nt, Human
caccauguuggcgaggcuggucuc

SEQ ID NO: 312073 - RNA, 21 nt, Human
cagcuuugaccucccagguuc

SEQ ID NO: 312074 - RNA, 23 nt, Human
cagcuuugaccucccagguucaa

SEQ ID NO: 312075 - RNA, 20 nt, Human
caggcuggaguacaguggca

SEQ ID NO: 312076 - RNA, 24 nt, Human
cagggucucaccauguuggcgagg

SEQ ID NO: 312077 - RNA, 24 nt, Human
cauuacaggugugagccauugugc

SEQ ID NO: 312078 - RNA, 24 nt, Human
ccaaagggcuggcauuacaggugu

SEQ ID NO: 312079 - RNA, 23 nt, Human
ccaacgcccuucccagaaugcag

SEQ ID NO: 312080 - RNA, 23 nt, Human
cccagguucaaguaguucuccug

SEQ ID NO: 312081 - RNA, 19 nt, Human
ccccgcccucuccuuucuc

SEQ ID NO: 312082 - RNA, 24 nt, Human
ccucccagguucaaguaguucucc

SEQ ID NO: 312083 - RNA, 24 nt, Human
ccuccugcuuuucuacccgucguc

SEQ ID NO: 312084 - RNA, 24 nt, Human
ccucuccuuucuccgcuccuccug

SEQ ID NO: 312085 - RNA, 23 nt, Human
ccugaccucaagugaucugccca

SEQ ID NO: 312086 - RNA, 24 nt, Human
ccugccucagccaucugaguagcu

SEQ ID NO: 312087 - RNA, 22 nt, Human
cuaaauaaaucugcaaacuuaa

SEQ ID NO: 312088 - RNA, 22 nt, Human
cuacuauuaagcugucuucuuu

SEQ ID NO: 312089 - RNA, 23 nt, Human
cucaagugaucugcccauucggc

SEQ ID NO: 312090 - RNA, 19 nt, Human
cucaugaaguauuuaaaga

SEQ ID NO: 312091 - RNA, 19 nt, Human
cuccuuucuccgcuccucc

SEQ ID NO: 312092 - RNA, 23 nt, Human
cucuucaggcuggaguacagugg

SEQ ID NO: 312093 - RNA, 22 nt, Human
cugaguagcugggauuacaggc

SEQ ID NO: 312094 - RNA, 24 nt, Human
cugaguagcugggauuacaggcgu

SEQ ID NO: 312095 - RNA, 24 nt, Human
cugcagcuuugaccucccagguuc

SEQ ID NO: 312096 - RNA, 22 nt, Human
cuggcauuacaggugugagcca

SEQ ID NO: 312097 - RNA, 26 nt, Human
gaacaaauucauugauuauaaaauaa

SEQ ID NO: 312098 - RNA, 23 nt, Human
gaaucaucuuagacuaaauauuu

SEQ ID NO: 312099 - RNA, 19 nt, Human
gacagagucucgcucuuca

SEQ ID NO: 312100 - RNA, 23 nt, Human
gaccucaagugaucugcccauuc

SEQ ID NO: 312101 - RNA, 20 nt, Human
gaguagcugggauuacaggc

SEQ ID NO: 312102 - RNA, 25 nt, Human
gaguagcugggauuacaggcgugug

SEQ ID NO: 312103 - RNA, 18 nt, Human
gauuacaggcgugugcca

SEQ ID NO: 312104 - RNA, 20 nt, Human
gcaugugugaaucuuugaga

SEQ ID NO: 312105 - RNA, 23 nt, Human
gcuggucucaaacuccugaccuc

SEQ ID NO: 312106 - RNA, 24 nt, Human
ggcuggucucaaacuccugaccuc

SEQ ID NO: 312107 - RNA, 18 nt, Human
guagcugggauuacaggc

SEQ ID NO: 312108 - RNA, 18 nt, Human
guagcugggauuacaggc

SEQ ID NO: 312109 - RNA, 19 nt, Human
gucucgcucuucaggcugg

SEQ ID NO: 312110 - RNA, 22 nt, Human
gucucgcucuucaggcuggagu

SEQ ID NO: 312111 - RNA, 23 nt, Human
uaaaaauaauaaaaaaaucaccu

SEQ ID NO: 312112 - RNA, 21 nt, Human
uaaaucugcaaacuuaaaauc

SEQ ID NO: 312113 - RNA, 19 nt, Human
uaacaggauugauuuccaa

SEQ ID NO: 312114 - RNA, 20 nt, Human
uacaggcgugugccaccaag

SEQ ID NO: 312115 - RNA, 23 nt, Human
uacaggugugagccauugugccu

SEQ ID NO: 312116 - RNA, 19 nt, Human
uacaguggcaagaucuugg

SEQ ID NO: 312117 - RNA, 22 nt, Human
uagagacagggucucaccaugu

SEQ ID NO: 312118 - RNA, 24 nt, Human
uaguagagacagggucucaccaug

SEQ ID NO: 312119 - RNA, 26 nt, Human
uaguagagacagggucucaccauguu

SEQ ID NO: 312120 - RNA, 22 nt, Human
uauagauuuguggaaaguacca

SEQ ID NO: 312121 - RNA, 23 nt, Human
ucaaugccaacaaaguaguuaag

SEQ ID NO: 312122 - RNA, 19 nt, Human
uccaacuucauguugcaau

SEQ ID NO: 312123 - RNA, 23 nt, Human
ucccaaagggcuggcauuacagg

SEQ ID NO: 312124 - RNA, 26 nt, Human
ucccaaagggcuggcauuacaggugu

SEQ ID NO: 312125 - RNA, 21 nt, Human
ucccagguucaaguaguucuc

SEQ ID NO: 312126 - RNA, 24 nt, Human
ucccagguucaaguaguucuccug

SEQ ID NO: 312127 - RNA, 22 nt, Human
ucccauuccuaauuucccuuuu

SEQ ID NO: 312128 - RNA, 18 nt, Human
ucccuaccccgcccucuc

SEQ ID NO: 312129 - RNA, 25 nt, Human
ucccuaccccgcccucuccuuucuc

SEQ ID NO: 312130 - RNA, 19 nt, Human
uccuuucuccgcuccuccu

SEQ ID NO: 312131 - RNA, 18 nt, Human
ucucgcucuucaggcugg

SEQ ID NO: 312132 - RNA, 23 nt, Human
ucugaguagcugggauuacaggc

SEQ ID NO: 312133 - RNA, 24 nt, Human
ucugaguagcugggauuacaggcg

SEQ ID NO: 312134 - RNA, 23 nt, Human
ucugcaaacuuaaaaucagaaag

SEQ ID NO: 312135 - RNA, 23 nt, Human
ugacaagaaaugaaauacugcca

SEQ ID NO: 312136 - RNA, 18 nt, Human
ugaccucaagugaucugc

SEQ ID NO: 312137 - RNA, 23 nt, Human
ugacugcagcuuugaccucccag

SEQ ID NO: 312138 - RNA, 24 nt, Human
ugacugcagcuuugaccucccagg

SEQ ID NO: 312139 - RNA, 22 nt, Human
ugagaagaacucauugauagca

SEQ ID NO: 312140 - RNA, 23 nt, Human
ugagaagaacucauugauagcac

SEQ ID NO: 312141 - RNA, 21 nt, Human
ugagacagagucucgcucuuc

SEQ ID NO: 312142 - RNA, 18 nt, Human
ugagagcccuuacaaaug

SEQ ID NO: 312143 - RNA, 18 nt, Human
ugccauuuaaaaguccug

SEQ ID NO: 312144 - RNA, 24 nt, Human
ugccucagccaucugaguagcugg

SEQ ID NO: 312145 - RNA, 22 nt, Human
uggaaaguaccaacauaauuga

SEQ ID NO: 312146 - RNA, 24 nt, Human
uggaguacaguggcaagaucuugg

SEQ ID NO: 312147 - RNA, 21 nt, Human
uggcauuacaggugugagcca

SEQ ID NO: 312148 - RNA, 22 nt, Human
uggcauuacaggugugagccau

SEQ ID NO: 312149 - RNA, 24 nt, Human
uggcauuacaggugugagccauug

SEQ ID NO: 312150 - RNA, 27 nt, Human
uggcauuacaggugugagccauugugc

SEQ ID NO: 312151 - RNA, 24 nt, Human
uggcgaggcuggucucaaacuccu

SEQ ID NO: 312152 - RNA, 23 nt, Human
uggcuaauuuuuuuuuuuuuuuu

SEQ ID NO: 312153 - RNA, 24 nt, Human
uggcugacugcagcuuugaccucc

SEQ ID NO: 312154 - RNA, 18 nt, Human
ugggauuacaggcgugug

SEQ ID NO: 312155 - RNA, 19 nt, Human
ugggauuacaggcgugugc

SEQ ID NO: 312156 - RNA, 21 nt, Human
ugggauuacaggcgugugcca

SEQ ID NO: 312157 - RNA, 22 nt, Human
ugggauuacaggcgugugccac

SEQ ID NO: 312158 - RNA, 24 nt, Human
ugggauuacaggcgugugccacca

SEQ ID NO: 312159 - RNA, 18 nt, Human
uguguuuuaauacacauu

SEQ ID NO: 312160 - RNA, 24 nt, Human
uuaguagagacagggucucaccau

SEQ ID NO: 312161 - RNA, 21 nt, Human
uucaaguaguucuccugccuc

SEQ ID NO: 312162 - RNA, 23 nt, Human
uucaaguaguucuccugccucag

SEQ ID NO: 312163 - RNA, 24 nt, Human
uucuccgcuccuccugcuuuucua

SEQ ID NO: 312164 - RNA, 21 nt, Human
uugaaucaucuuagacuaaau

SEQ ID NO: 312165 - RNA, 24 nt, Human
uuuuuuaucguuuuaguagagaca

SEQ ID NO: 312166 - RNA, 23 nt, Human
uuuuuuuuuuuuuuuaucguuuu

SEQ ID NO: 312167 - RNA, 18 nt, Human
aagagucucuccaacccc

SEQ ID NO: 312168 - RNA, 21 nt, Human
acauguggaauggcuguucuc

SEQ ID NO: 312169 - RNA, 21 nt, Human
accccagagggugccggauga

SEQ ID NO: 312170 - RNA, 21 nt, Human
accuggggcuucaaaccagcc

SEQ ID NO: 312171 - RNA, 18 nt, Human
acuggguggccaggaggg

SEQ ID NO: 312172 - RNA, 18 nt, Human
agagucucuccaaccccu

SEQ ID NO: 312173 - RNA, 21 nt, Human
agcagggaagggggauaccug

SEQ ID NO: 312174 - RNA, 20 nt, Human
agcagguguggggagcccuc

SEQ ID NO: 312175 - RNA, 23 nt, Human
agccucucgacaugggggugcuc

SEQ ID NO: 312176 - RNA, 20 nt, Human
aggcccagagcccugggccc

SEQ ID NO: 312177 - RNA, 19 nt, Human
aggggcaguggugagguag

SEQ ID NO: 312178 - RNA, 20 nt, Human
auagcagggaagggggauac

SEQ ID NO: 312179 - RNA, 19 nt, Human
caaaccagccaccugcucc

SEQ ID NO: 312180 - RNA, 21 nt, Human
caggcccagagcccugggccc

SEQ ID NO: 312181 - RNA, 22 nt, Human
caguccaacucggcucuccuca

SEQ ID NO: 312182 - RNA, 21 nt, Human
ccaagagucucuccaaccccc

SEQ ID NO: 312183 - RNA, 19 nt, Human
ccagagucgguccccgggu

SEQ ID NO: 312184 - RNA, 24 nt, Human
ccagcaccaccagcugcccaggaa

SEQ ID NO: 312185 - RNA, 21 nt, Human
cccagcagcuuggccuuuccc

SEQ ID NO: 312186 - RNA, 22 nt, Human
cccagcagcuuggccuuuccca

SEQ ID NO: 312187 - RNA, 19 nt, Human
ccccggccccaagagucuc

SEQ ID NO: 312188 - RNA, 23 nt, Human
ccccugcagcuucuguccccacc

SEQ ID NO: 312189 - RNA, 18 nt, Human
cccgaccccggccccaag

SEQ ID NO: 312190 - RNA, 20 nt, Human
ccucuccccugcagcuucug

SEQ ID NO: 312191 - RNA, 22 nt, Human
ccugcagcuucuguccccaccc

SEQ ID NO: 312192 - RNA, 19 nt, Human
ccuggucucagccucucga

SEQ ID NO: 312193 - RNA, 23 nt, Human
cgggcagacacugggagccgggc

SEQ ID NO: 312194 - RNA, 21 nt, Human
cucccaacacuguccucacca

SEQ ID NO: 312195 - RNA, 18 nt, Human
cuccucagcacccccagc

SEQ ID NO: 312196 - RNA, 22 nt, Human
cuccugucugggagagggcugg

SEQ ID NO: 312197 - RNA, 20 nt, Human
cugcuguccuggucucagcc

SEQ ID NO: 312198 - RNA, 18 nt, Human
cugggccccugggccucc

SEQ ID NO: 312199 - RNA, 18 nt, Human
cuguccccacccagcagc

SEQ ID NO: 312200 - RNA, 21 nt, Human
cuuaaaauggggcaaggggcc

SEQ ID NO: 312201 - RNA, 24 nt, Human
gacacugggagccgggcagacacu

SEQ ID NO: 312202 - RNA, 21 nt, Human
gaggagucucgcagcugcggg

SEQ ID NO: 312203 - RNA, 23 nt, Human
gcagcugcggggagauggggcac

SEQ ID NO: 312204 - RNA, 18 nt, Human
gcccagagcccugggccc

SEQ ID NO: 312205 - RNA, 23 nt, Human
gccccaagagucucuccaacccc

SEQ ID NO: 312206 - RNA, 19 nt, Human
gcccgaccccggccccaag

SEQ ID NO: 312207 - RNA, 18 nt, Human
gccgcagcaggugugggg

SEQ ID NO: 312208 - RNA, 25 nt, Human
gcgcaggccagggaaucccagcucg

SEQ ID NO: 312209 - RNA, 22 nt, Human
ggaguacuggguggccaggagg

SEQ ID NO: 312210 - RNA, 21 nt, Human
ggcagacacugggagccgggc

SEQ ID NO: 312211 - RNA, 22 nt, Human
ggcaggugcgguguacucgccg

SEQ ID NO: 312212 - RNA, 20 nt, Human
ggcaguggugagguagaagg

SEQ ID NO: 312213 - RNA, 21 nt, Human
gggaagggggauaccuggggc

SEQ ID NO: 312214 - RNA, 21 nt, Human
gggaguacuggguggccagga

SEQ ID NO: 312215 - RNA, 19 nt, Human
ggugcucagcgccgcagcu

SEQ ID NO: 312216 - RNA, 25 nt, Human
guggaauggcuguucuccuaccccc

SEQ ID NO: 312217 - RNA, 18 nt, Human
uagaagaaagcuggagug

SEQ ID NO: 312218 - RNA, 22 nt, Human
uagaagaaagcuggagugcccg

SEQ ID NO: 312219 - RNA, 19 nt, Human
uccucaccaaggcuggggc

SEQ ID NO: 312220 - RNA, 18 nt, Human
ucgcugaggaagcuggug

SEQ ID NO: 312221 - RNA, 19 nt, Human
ucgguccccgggugggguc

SEQ ID NO: 312222 - RNA, 22 nt, Human
ucuccucagcacccccagccau

SEQ ID NO: 312223 - RNA, 18 nt, Human
uggaauggcuguucuccu

SEQ ID NO: 312224 - RNA, 21 nt, Human
ugggagagggcugggcagaca

SEQ ID NO: 312225 - RNA, 22 nt, Human
ugggagccgggcagacacuggg

SEQ ID NO: 312226 - RNA, 23 nt, Human
ugggagccgggcuggcucuugcu

SEQ ID NO: 312227 - RNA, 20 nt, Human
ugggccccugggccucccaa

SEQ ID NO: 312228 - RNA, 18 nt, Human
uguggggagcccuccggg

SEQ ID NO: 312229 - RNA, 22 nt, Human
uucccagcaccaccagcugccc

SEQ ID NO: 312230 - RNA, 18 nt, Human
uucccucuccccugcagc

SEQ ID NO: 312231 - RNA, 23 nt, Human
uugacagcacggcugcuucccuc

SEQ ID NO: 312232 - RNA, 24 nt, Human
uuuacugggccccugggccuccca

SEQ ID NO: 312233 - RNA, 24 nt, Human
uuugcaaaauucuucgaggggcag

SEQ ID NO: 312234 - RNA, 21 nt, Human
aaaauacuauuuccguacugu

SEQ ID NO: 312235 - RNA, 19 nt, Human
aaacagaaagaggcacuaa

SEQ ID NO: 312236 - RNA, 22 nt, Human
acaaacagaaagaggcacuaag

SEQ ID NO: 312237 - RNA, 25 nt, Human
acacuccaaccauaccaagucuuac

SEQ ID NO: 312238 - RNA, 19 nt, Human
acagauguggaaccaaagu

SEQ ID NO: 312239 - RNA, 22 nt, Human
agacagauguggaaccaaagug

SEQ ID NO: 312240 - RNA, 18 nt, Human
agggaaggaaaagcaaua

SEQ ID NO: 312241 - RNA, 22 nt, Human
aggggguauuuucugucucugg

SEQ ID NO: 312242 - RNA, 19 nt, Human
agucuaucaagacuugaaa

SEQ ID NO: 312243 - RNA, 18 nt, Human
caaagugcuaagugcaua

SEQ ID NO: 312244 - RNA, 21 nt, Human
caaauacauucauuguaugaa

SEQ ID NO: 312245 - RNA, 24 nt, Human
caacagcaaaaagauuagcuccau

SEQ ID NO: 312246 - RNA, 23 nt, Human
cacacgaugccuaccaccaccag

SEQ ID NO: 312247 - RNA, 21 nt, Human
cacaguaaguuacaaaaggca

SEQ ID NO: 312248 - RNA, 20 nt, Human
cacaguaaguuacaaaaggg

SEQ ID NO: 312249 - RNA, 23 nt, Human
cagaacaggauaccucuugaaga

SEQ ID NO: 312250 - RNA, 21 nt, Human
cagacagauguggaaccaaag

SEQ ID NO: 312251 - RNA, 27 nt, Human
cagggugaaaccaaaucuuuaucugcc

SEQ ID NO: 312252 - RNA, 22 nt, Human
cauucauuguaugaauuaggga

SEQ ID NO: 312253 - RNA, 27 nt, Human
cauuccuacacuccaaccauaccaagu

SEQ ID NO: 312254 - RNA, 18 nt, Human
ccacaaacagaaagaggc

SEQ ID NO: 312255 - RNA, 23 nt, Human
cccagacagauguggaaccaaag

SEQ ID NO: 312256 - RNA, 19 nt, Human
ccuacacuccaaccauacc

SEQ ID NO: 312257 - RNA, 19 nt, Human
cgaugccuaccaccaccag

SEQ ID NO: 312258 - RNA, 23 nt, Human
cuaccaccaccagggugaaacca

SEQ ID NO: 312259 - RNA, 20 nt, Human
gccacaguaaguuacaaaag

SEQ ID NO: 312260 - RNA, 20 nt, Human
guucuuuccaggugacugca

SEQ ID NO: 312261 - RNA, 18 nt, Human
uaaguuacaaaaggcaaa

SEQ ID NO: 312262 - RNA, 18 nt, Human
uagaauucauaauuuauu

SEQ ID NO: 312263 - RNA, 21 nt, Human
uaggcuaagucuaucaagacu

SEQ ID NO: 312264 - RNA, 23 nt, Human
uauucuacuucccccacgccccc

SEQ ID NO: 312265 - RNA, 27 nt, Human
ucccccacgcccccagaaguuuuugau

SEQ ID NO: 312266 - RNA, 18 nt, Human
ucuacuucccccacgccc

SEQ ID NO: 312267 - RNA, 23 nt, Human
ucuguucuuuccaggugacugca

SEQ ID NO: 312268 - RNA, 22 nt, Human
ugaauauucauuccuacacucc

SEQ ID NO: 312269 - RNA, 19 nt, Human
ugaauuagggaaggaaaag

SEQ ID NO: 312270 - RNA, 26 nt, Human
ugaccugcaauaaaaacaucugaucu

SEQ ID NO: 312271 - RNA, 23 nt, Human
ugagguaggugaaaggguaaucu

SEQ ID NO: 312272 - RNA, 21 nt, Human
ugcauauuucaagcaucuguu

SEQ ID NO: 312273 - RNA, 21 nt, Human
uuaaaauacuauuuccguacu

SEQ ID NO: 312274 - RNA, 22 nt, Human
uuacaaaaggcaaauucauaga

SEQ ID NO: 312275 - RNA, 24 nt, Human
uuacuaggcuaagucuaucaagac

SEQ ID NO: 312276 - RNA, 18 nt, Human
uucauaauuuauuagcca

SEQ ID NO: 312277 - RNA, 19 nt, Human
uucccccacgcccccagaa

SEQ ID NO: 312278 - RNA, 18 nt, Human
uucccugggaggacuuca

SEQ ID NO: 312279 - RNA, 20 nt, Human
uuuuuuuuuuuuuuucucau

SEQ ID NO: 312280 - RNA, 20 nt, Human
aaaaaaaaagaagggaaaag

SEQ ID NO: 312281 - RNA, 20 nt, Human
aaaaagccugcgccgccucc

SEQ ID NO: 312282 - RNA, 22 nt, Human
aaaauacccuuuacccgccccg

SEQ ID NO: 312283 - RNA, 21 nt, Human
aaaggaaaaaaaaagaaggga

SEQ ID NO: 312284 - RNA, 20 nt, Human
aagaagaaaaaggguaacga

SEQ ID NO: 312285 - RNA, 19 nt, Human
aagccggaggaggggaagg

SEQ ID NO: 312286 - RNA, 19 nt, Human
aaggaccuccccgaguugg

SEQ ID NO: 312287 - RNA, 24 nt, Human
aaggaucuucaauuuggggacagg

SEQ ID NO: 312288 - RNA, 20 nt, Human
acaaaaagccugcuguccga

SEQ ID NO: 312289 - RNA, 20 nt, Human
acaaaaggcagcuuuagcuu

SEQ ID NO: 312290 - RNA, 19 nt, Human
agacaaaaggcagcuuuag

SEQ ID NO: 312291 - RNA, 23 nt, Human
agacaagaaucugcaucagaaac

SEQ ID NO: 312292 - RNA, 21 nt, Human
aggaaaaaaaaagaagggaaa

SEQ ID NO: 312293 - RNA, 25 nt, Human
aggaaaaaaaaagaagggaaaagga

SEQ ID NO: 312294 - RNA, 24 nt, Human
aggaaaaagccggaggaggggaag

SEQ ID NO: 312295 - RNA, 21 nt, Human
aggcaagaacugcacggcagc

SEQ ID NO: 312296 - RNA, 21 nt, Human
aggcagcuuuagcuuuguucu

SEQ ID NO: 312297 - RNA, 18 nt, Human
aggcaggggguggguggg

SEQ ID NO: 312298 - RNA, 19 nt, Human
aggcagggggugggugggg

SEQ ID NO: 312299 - RNA, 20 nt, Human
aggcaggggguggguggggu

SEQ ID NO: 312300 - RNA, 18 nt, Human
agggggugggugggguag

SEQ ID NO: 312301 - RNA, 20 nt, Human
agggggugggugggguagga

SEQ ID NO: 312302 - RNA, 22 nt, Human
agggggugggugggguaggagg

SEQ ID NO: 312303 - RNA, 22 nt, Human
aguaaccggguuccugaacggc

SEQ ID NO: 312304 - RNA, 19 nt, Human
cacucacagcaggaacuac

SEQ ID NO: 312305 - RNA, 21 nt, Human
cagaaguucaccgggagcucu

SEQ ID NO: 312306 - RNA, 24 nt, Human
cagcacgggcaagcugcccugggc

SEQ ID NO: 312307 - RNA, 20 nt, Human
ccaaaaaggaaaaaaaaaga

SEQ ID NO: 312308 - RNA, 21 nt, Human
ccccgcaucaagccacaggca

SEQ ID NO: 312309 - RNA, 21 nt, Human
cccgaguugggaggaaaaagc

SEQ ID NO: 312310 - RNA, 18 nt, Human
cccuagcccgcugccgca

SEQ ID NO: 312311 - RNA, 18 nt, Human
cccuucuuucccuuaccg

SEQ ID NO: 312312 - RNA, 19 nt, Human
ccgcugccgcaccccacgu

SEQ ID NO: 312313 - RNA, 20 nt, Human
ccgggaaggaccuccccgag

SEQ ID NO: 312314 - RNA, 22 nt, Human
cgaguugggaggaaaaagccgg

SEQ ID NO: 312315 - RNA, 22 nt, Human
cgcaaaccucacuacaaaaagc

SEQ ID NO: 312316 - RNA, 23 nt, Human
cgccccgugagggaggcaagaac

SEQ ID NO: 312317 - RNA, 24 nt, Human
cggaggaggggaagguggcggagg

SEQ ID NO: 312318 - RNA, 18 nt, Human
cggccaccgggaaggacc

SEQ ID NO: 312319 - RNA, 20 nt, Human
cggcgaaauaaggagcgaaa

SEQ ID NO: 312320 - RNA, 18 nt, Human
cgggcaagcugcccuggg

SEQ ID NO: 312321 - RNA, 19 nt, Human
cucccaaaaaggaaaaaaa

SEQ ID NO: 312322 - RNA, 20 nt, Human
cugccgcaccccacgugccc

SEQ ID NO: 312323 - RNA, 22 nt, Human
gaaaaaaaaagaagggaaaagg

SEQ ID NO: 312324 - RNA, 23 nt, Human
gaaauaaggagcgaaaggagccc

SEQ ID NO: 312325 - RNA, 23 nt, Human
gacaagaaucugcaucagaaacg

SEQ ID NO: 312326 - RNA, 18 nt, Human
gaggaggggaagguggcg

SEQ ID NO: 312327 - RNA, 25 nt, Human
gaggggaagguggcggagggaagga

SEQ ID NO: 312328 - RNA, 22 nt, Human
gcuguaaccacucacagcagga

SEQ ID NO: 312329 - RNA, 19 nt, Human
ggaaaaaaaaagaagggaa

SEQ ID NO: 312330 - RNA, 25 nt, Human
ggaaggaucuucaauuuggggaaag

SEQ ID NO: 312331 - RNA, 21 nt, Human
ggacaggcagggggugggugg

SEQ ID NO: 312332 - RNA, 20 nt, Human
ggaggaaaaagccggaggag

SEQ ID NO: 312333 - RNA, 18 nt, Human
ggcgcaaaccucacuaca

SEQ ID NO: 312334 - RNA, 18 nt, Human
ggcggccaccgggaagga

SEQ ID NO: 312335 - RNA, 18 nt, Human
gggaagguggcggaggga

SEQ ID NO: 312336 - RNA, 20 nt, Human
ggggugggugggguaggagg

SEQ ID NO: 312337 - RNA, 20 nt, Human
uaaaauaacagacaaaaggc

SEQ ID NO: 312338 - RNA, 20 nt, Human
uaaaauaacagacaaaaggc

SEQ ID NO: 312339 - RNA, 22 nt, Human
uaaaauacccuuuacccgcccc

SEQ ID NO: 312340 - RNA, 21 nt, Human
uaacagcacaaguggagaaca

SEQ ID NO: 312341 - RNA, 24 nt, Human
uacaaaaagccugcgccgccuccg

SEQ ID NO: 312342 - RNA, 27 nt, Human
uaccggaaauuuuucagcucccaaaaa

SEQ ID NO: 312343 - RNA, 22 nt, Human
uagaacaccacugggccaguga

SEQ ID NO: 312344 - RNA, 26 nt, Human
ucacaagguauuuauguacaacggag

SEQ ID NO: 312345 - RNA, 23 nt, Human
ucccuuaccggaaauuuuucagc

SEQ ID NO: 312346 - RNA, 19 nt, Human
ucugcaucagaaacgggau

SEQ ID NO: 312347 - RNA, 26 nt, Human
ugggggaggaagaagaaaaaggggag

SEQ ID NO: 312348 - RNA, 24 nt, Human
ugggguaggagguagaacaccacu

SEQ ID NO: 312349 - RNA, 19 nt, Human
ugucucucccccuuccggg

SEQ ID NO: 312350 - RNA, 21 nt, Human
uucagcucccaaaaaggaaaa

SEQ ID NO: 312351 - RNA, 23 nt, Human
uucuccaaccgucccggccgcgc

SEQ ID NO: 312352 - RNA, 23 nt, Human
aaacaccacugcaucccugguaa

SEQ ID NO: 312353 - RNA, 21 nt, Human
aacgagaagagucugaagaga

SEQ ID NO: 312354 - RNA, 23 nt, Human
aacugcuuugugcauguuccuau

SEQ ID NO: 312355 - RNA, 23 nt, Human
aagaagcucaaccaacaguagac

SEQ ID NO: 312356 - RNA, 24 nt, Human
aagaagcucaaccaacaguagacc

SEQ ID NO: 312357 - RNA, 18 nt, Human
aagcgcuagcaggccagc

SEQ ID NO: 312358 - RNA, 22 nt, Human
aagcgcuagcaggccagcccug

SEQ ID NO: 312359 - RNA, 21 nt, Human
accagacaucuaagguacaac

SEQ ID NO: 312360 - RNA, 26 nt, Human
agacaucuaagguacaacugaaaaug

SEQ ID NO: 312361 - RNA, 23 nt, Human
auaaacacuuuuaaaaagacaac

SEQ ID NO: 312362 - RNA, 24 nt, Human
auugcaaaaauaaacacuuuuaaa

SEQ ID NO: 312363 - RNA, 21 nt, Human
caagaagcucaaccaacagua

SEQ ID NO: 312364 - RNA, 19 nt, Human
cacugcugccaauuauuaa

SEQ ID NO: 312365 - RNA, 25 nt, Human
caggccagcccuggggcaagaacug

SEQ ID NO: 312366 - RNA, 21 nt, Human
caguaaagaccuauccugccu

SEQ ID NO: 312367 - RNA, 24 nt, Human
cagugcugagggguuagggccaga

SEQ ID NO: 312368 - RNA, 19 nt, Human
ccaagaagcucaaccaaca

SEQ ID NO: 312369 - RNA, 19 nt, Human
ccagcccuggggcaagaac

SEQ ID NO: 312370 - RNA, 20 nt, Human
cccauauccagcugcuggcc

SEQ ID NO: 312371 - RNA, 23 nt, Human
cccccugaauaaaggcuauggca

SEQ ID NO: 312372 - RNA, 22 nt, Human
ccuaaacaccacugcaucccug

SEQ ID NO: 312373 - RNA, 18 nt, Human
ccugccuaaacaccacug

SEQ ID NO: 312374 - RNA, 21 nt, Human
ccugcuauuccaaaagguuac

SEQ ID NO: 312375 - RNA, 18 nt, Human
cugaauaaaggcuauggc

SEQ ID NO: 312376 - RNA, 23 nt, Human
cugccuaauuaacugcuuugugc

SEQ ID NO: 312377 - RNA, 21 nt, Human
cuggaucucugguuuucucca

SEQ ID NO: 312378 - RNA, 18 nt, Human
cuguguaugugggagggg

SEQ ID NO: 312379 - RNA, 23 nt, Human
gagaaaugaaauacuccuccugu

SEQ ID NO: 312380 - RNA, 21 nt, Human
gauccucaacaccagacaucu

SEQ ID NO: 312381 - RNA, 23 nt, Human
gauccucaacaccagacaucuaa

SEQ ID NO: 312382 - RNA, 23 nt, Human
gggacaccugggaauuugaagcg

SEQ ID NO: 312383 - RNA, 24 nt, Human
gugcacuggaaacacuccagcagg

SEQ ID NO: 312384 - RNA, 25 nt, Human
uaggcccccugaauaaaggcuaugg

SEQ ID NO: 312385 - RNA, 21 nt, Human
uaucuggagacagugcugagg

SEQ ID NO: 312386 - RNA, 21 nt, Human
ucauuuuggacagaaaggguu

SEQ ID NO: 312387 - RNA, 21 nt, Human
uccaaaagguuacuucucaaa

SEQ ID NO: 312388 - RNA, 22 nt, Human
ucugguuuucuccaggcugccu

SEQ ID NO: 312389 - RNA, 22 nt, Human
ucuguacuggaucucugguuuu

SEQ ID NO: 312390 - RNA, 28 nt, Human
ugccaagaagcucaaccaacaguagacu

SEQ ID NO: 312391 - RNA, 18 nt, Human
ugccuaaacaccacugca

SEQ ID NO: 312392 - RNA, 21 nt, Human
ugcucuuuauugcaaaaauaa

SEQ ID NO: 312393 - RNA, 23 nt, Human
ugcuuugugcauguuccuaucug

SEQ ID NO: 312394 - RNA, 24 nt, Human
uguacuggaucucugguuuucucc

SEQ ID NO: 312395 - RNA, 20 nt, Human
uguuaaucaauaaauauccu

SEQ ID NO: 312396 - RNA, 22 nt, Human
aaaccauucugggagccgugga

SEQ ID NO: 312397 - RNA, 23 nt, Human
aaccaguccaacaacgugcugca

SEQ ID NO: 312398 - RNA, 22 nt, Human
aagaaggggccagggaggggac

SEQ ID NO: 312399 - RNA, 21 nt, Human
aagcuuagaagaaggggccag

SEQ ID NO: 312400 - RNA, 21 nt, Human
acagcccgggaggacggggac

SEQ ID NO: 312401 - RNA, 21 nt, Human
agaggcuuccaggagcacgag

SEQ ID NO: 312402 - RNA, 23 nt, Human
agcacuggaaacguggcccaugc

SEQ ID NO: 312403 - RNA, 19 nt, Human
agcgccaagggcagcccga

SEQ ID NO: 312404 - RNA, 18 nt, Human
agcuuaggugcgccgucc

SEQ ID NO: 312405 - RNA, 18 nt, Human
aggagcagcuggaggcca

SEQ ID NO: 312406 - RNA, 22 nt, Human
aggcagccggaauucgugugag

SEQ ID NO: 312407 - RNA, 21 nt, Human
aggccuccgagcugcuguccu

SEQ ID NO: 312408 - RNA, 22 nt, Human
agguggcuucuggcagccacag

SEQ ID NO: 312409 - RNA, 21 nt, Human
caacaacgugcugcaggcccc

SEQ ID NO: 312410 - RNA, 22 nt, Human
caagcuuagaagaaggggccag

SEQ ID NO: 312411 - RNA, 19 nt, Human
cacaggucuguugcaggga

SEQ ID NO: 312412 - RNA, 23 nt, Human
cacauggccaccaagcacuggaa

SEQ ID NO: 312413 - RNA, 23 nt, Human
caccaagcacuggaaacguggcc

SEQ ID NO: 312414 - RNA, 24 nt, Human
caccaagcacuggaaacguggccc

SEQ ID NO: 312415 - RNA, 21 nt, Human
caccucagcuuccuggagcag

SEQ ID NO: 312416 - RNA, 18 nt, Human
cagaacaccagguguggc

SEQ ID NO: 312417 - RNA, 19 nt, Human
cagagagagccccguggcg

SEQ ID NO: 312418 - RNA, 21 nt, Human
cagcagagcgaggccagccua

SEQ ID NO: 312419 - RNA, 19 nt, Human
cagcagcagagcgaggcca

SEQ ID NO: 312420 - RNA, 22 nt, Human
cagccacagcggcagugaggag

SEQ ID NO: 312421 - RNA, 27 nt, Human
cagcccgagccuuacgagagcggcagg

SEQ ID NO: 312422 - RNA, 19 nt, Human
cagcccgggaggacgggga

SEQ ID NO: 312423 - RNA, 25 nt, Human
cagcggcagugaggagcagcuggag

SEQ ID NO: 312424 - RNA, 27 nt, Human
caggaggcaggcccugcccugcccucu

SEQ ID NO: 312425 - RNA, 19 nt, Human
caggccccacugcccccca

SEQ ID NO: 312426 - RNA, 18 nt, Human
cauggccaccaagcacug

SEQ ID NO: 312427 - RNA, 22 nt, Human
ccaacaacgugcugcaggcccc

SEQ ID NO: 312428 - RNA, 21 nt, Human
ccacagggcuguguggaugga

SEQ ID NO: 312429 - RNA, 22 nt, Human
ccauucugggagccguggaugg

SEQ ID NO: 312430 - RNA, 21 nt, Human
ccccacauggccaccaagcac

SEQ ID NO: 312431 - RNA, 25 nt, Human
ccccacugccccccaugaggcuccg

SEQ ID NO: 312432 - RNA, 21 nt, Human
ccccccgccacggggccccgc

SEQ ID NO: 312433 - RNA, 21 nt, Human
cccccuccgccuaaccccgcc

SEQ ID NO: 312434 - RNA, 21 nt, Human
ccccgccacggggccccgcga

SEQ ID NO: 312435 - RNA, 18 nt, Human
ccccuugucucuccucca

SEQ ID NO: 312436 - RNA, 24 nt, Human
cccgcgcggacugcgccugcgccg

SEQ ID NO: 312437 - RNA, 19 nt, Human
cccugcccugcccucuccu

SEQ ID NO: 312438 - RNA, 21 nt, Human
ccgaaucaggcccccuccgcc

SEQ ID NO: 312439 - RNA, 23 nt, Human
ccuaaccccgccccgcgccgguu

SEQ ID NO: 312440 - RNA, 23 nt, Human
ccugcaccacggcauagcuuagg

SEQ ID NO: 312441 - RNA, 27 nt, Human
ccugcagcccagggcaguccaggaaaa

SEQ ID NO: 312442 - RNA, 22 nt, Human
ccugggccucccccuaggggag

SEQ ID NO: 312443 - RNA, 21 nt, Human
ccuugcggcacaggacugugc

SEQ ID NO: 312444 - RNA, 18 nt, Human
cgggcggaugacacuggg

SEQ ID NO: 312445 - RNA, 21 nt, Human
cuccagcacguccccugcacc

SEQ ID NO: 312446 - RNA, 21 nt, Human
cuccccaucucuccugucugu

SEQ ID NO: 312447 - RNA, 23 nt, Human
cuccgccgccgccgccgcucgca

SEQ ID NO: 312448 - RNA, 19 nt, Human
cuccucccagaggcuucca

SEQ ID NO: 312449 - RNA, 21 nt, Human
cucgcaccccuucuccgcgcg

SEQ ID NO: 312450 - RNA, 24 nt, Human
cucggaucggcagcgccaagggca

SEQ ID NO: 312451 - RNA, 19 nt, Human
cucucaggauucaacacca

SEQ ID NO: 312452 - RNA, 20 nt, Human
cugcccugcccucuccucac

SEQ ID NO: 312453 - RNA, 26 nt, Human
cugggagccguggaugggggcggagg

SEQ ID NO: 312454 - RNA, 22 nt, Human
cuguggcagcugcaagcuuaga

SEQ ID NO: 312455 - RNA, 22 nt, Human
cuguggcagcugcaagcuuaga

SEQ ID NO: 312456 - RNA, 18 nt, Human
cuucaccacaggcugugc

SEQ ID NO: 312457 - RNA, 21 nt, Human
gagcagcagcagagcgaggcc

SEQ ID NO: 312458 - RNA, 20 nt, Human
gagcggcaguuggcugagcg

SEQ ID NO: 312459 - RNA, 19 nt, Human
gagcugggguggggcuggg

SEQ ID NO: 312460 - RNA, 24 nt, Human
gagcugggguuuggugcaguuucc

SEQ ID NO: 312461 - RNA, 24 nt, Human
gcagcagagcgaggccagccuaga

SEQ ID NO: 312462 - RNA, 25 nt, Human
gcagcgccaagggcagcccgagccu

SEQ ID NO: 312463 - RNA, 18 nt, Human
gcagggaaaggcagccgg

SEQ ID NO: 312464 - RNA, 20 nt, Human
gccccgcgcuggucugucgu

SEQ ID NO: 312465 - RNA, 20 nt, Human
gcccugggccucccccuagg

SEQ ID NO: 312466 - RNA, 20 nt, Human
gccuccgccgccgccgccgc

SEQ ID NO: 312467 - RNA, 23 nt, Human
gcugggaccacagguggcuucuc

SEQ ID NO: 312468 - RNA, 22 nt, Human
ggacgcaggaggcaggcccugc

SEQ ID NO: 312469 - RNA, 21 nt, Human
ggccaccaagcacuggaaacg

SEQ ID NO: 312470 - RNA, 23 nt, Human
ggcgaaugccugaaugcagcaac

SEQ ID NO: 312471 - RNA, 20 nt, Human
gggagccguggaugggggcg

SEQ ID NO: 312472 - RNA, 18 nt, Human
ggggcggagcugggguuu

SEQ ID NO: 312473 - RNA, 22 nt, Human
ggggcucagguacacagugggg

SEQ ID NO: 312474 - RNA, 21 nt, Human
gggguuuggugcaguuuccag

SEQ ID NO: 312475 - RNA, 23 nt, Human
gugaggagcagcuggaggccaca

SEQ ID NO: 312476 - RNA, 25 nt, Human
uaagguuucgcacgucagccccaca

SEQ ID NO: 312477 - RNA, 26 nt, Human
ucagccccacauggccaccaagcacu

SEQ ID NO: 312478 - RNA, 21 nt, Human
uccagaacaccagguguggcc

SEQ ID NO: 312479 - RNA, 22 nt, Human
ucccaccagcgggcgccuccuc

SEQ ID NO: 312480 - RNA, 22 nt, Human
uccccccgccaucugucucccu

SEQ ID NO: 312481 - RNA, 25 nt, Human
uccccugcaccacggcauagcuuag

SEQ ID NO: 312482 - RNA, 21 nt, Human
uccucacaggucuguugcagg

SEQ ID NO: 312483 - RNA, 21 nt, Human
uccuccaucucuccugucugu

SEQ ID NO: 312484 - RNA, 19 nt, Human
uccugucugucccuccccu

SEQ ID NO: 312485 - RNA, 21 nt, Human
ucggaccuagaggaggccucc

SEQ ID NO: 312486 - RNA, 22 nt, Human
ucucucggaagccaccgugugg

SEQ ID NO: 312487 - RNA, 23 nt, Human
ucugucccuccccuugucucucc

SEQ ID NO: 312488 - RNA, 26 nt, Human
ugaaauaaaaaguuuuuaaucgggug

SEQ ID NO: 312489 - RNA, 19 nt, Human
ugcccugggccaccucagc

SEQ ID NO: 312490 - RNA, 22 nt, Human
ugcccugggccaccucagcuuc

SEQ ID NO: 312491 - RNA, 20 nt, Human
ugcuccugucccuccagcaa

SEQ ID NO: 312492 - RNA, 18 nt, Human
uggcccugggccuccccc

SEQ ID NO: 312493 - RNA, 18 nt, Human
uggccgcacagccucucg

SEQ ID NO: 312494 - RNA, 19 nt, Human
ugggagcccggguggucuu

SEQ ID NO: 312495 - RNA, 23 nt, Human
ugggagcccggguggucuucacc

SEQ ID NO: 312496 - RNA, 21 nt, Human
ugggagccguggaugggggcg

SEQ ID NO: 312497 - RNA, 22 nt, Human
ugggguggggcugggaccacag

SEQ ID NO: 312498 - RNA, 25 nt, Human
ugggguggggcugggaccacagguu

SEQ ID NO: 312499 - RNA, 25 nt, Human
ugucccuccccuugucucuccucca

SEQ ID NO: 312500 - RNA, 21 nt, Human
ugucccugcccagugcauccc

SEQ ID NO: 312501 - RNA, 19 nt, Human
ugugcuguccccugcaccc

SEQ ID NO: 312502 - RNA, 19 nt, Human
uguggaacugucaggcggu

SEQ ID NO: 312503 - RNA, 24 nt, Human
uuaggugcgccguccuggggucgc

SEQ ID NO: 312504 - RNA, 21 nt, Human
uucaacaccaaccaguccaac

SEQ ID NO: 312505 - RNA, 24 nt, Human
uucaacaccaaccaguccaacaac

SEQ ID NO: 312506 - RNA, 21 nt, Human
uuccagaacaccagguguggc

SEQ ID NO: 312507 - RNA, 22 nt, Human
uuggugcaguuuccagggugca

SEQ ID NO: 312508 - RNA, 24 nt, Human
uuggugcaguuuccagggugcagu

SEQ ID NO: 312509 - RNA, 24 nt, Human
uuucacaggcacguuuauuuugcu

SEQ ID NO: 312510 - RNA, 23 nt, Human
uuuccagaacaccagguguggcc

SEQ ID NO: 312511 - RNA, 24 nt, Human
aaacagcgacacuacgacucgcgc

SEQ ID NO: 312512 - RNA, 19 nt, Human
agcgaccccgcugcgcccc

SEQ ID NO: 312513 - RNA, 19 nt, Human
ccccgcugcgccccggucc

SEQ ID NO: 312514 - RNA, 20 nt, Human
cccgcaaacagcgacacuac

SEQ ID NO: 312515 - RNA, 22 nt, Human
cccgcugcgccccggucccgcc

SEQ ID NO: 312516 - RNA, 22 nt, Human
cgcggagacccgcaaacagcga

SEQ ID NO: 312517 - RNA, 21 nt, Human
gcggagacccgcaaacagcga

SEQ ID NO: 312518 - RNA, 19 nt, Human
uauaaagugagaaugaaaa

SEQ ID NO: 312519 - RNA, 21 nt, Human
ucagcgaccccgcugcgcccc

SEQ ID NO: 312520 - RNA, 19 nt, Human
aacacauacugaaaaauga

SEQ ID NO: 312521 - RNA, 19 nt, Human
aagcaccagaugccuucug

SEQ ID NO: 312522 - RNA, 23 nt, Human
acacuuagacgccgcaaccccag

SEQ ID NO: 312523 - RNA, 19 nt, Human
caacaugauaagugugaca

SEQ ID NO: 312524 - RNA, 20 nt, Human
caccagaugccuucugggau

SEQ ID NO: 312525 - RNA, 24 nt, Human
cacuuccuagaguaggaccaaggg

SEQ ID NO: 312526 - RNA, 22 nt, Human
cagcagccagacuggaccucug

SEQ ID NO: 312527 - RNA, 23 nt, Human
cagcagccagacuggaccucugg

SEQ ID NO: 312528 - RNA, 19 nt, Human
cagguaggcaggcagaguc

SEQ ID NO: 312529 - RNA, 24 nt, Human
caguaguuaagcuacaagaagcac

SEQ ID NO: 312530 - RNA, 24 nt, Human
ccaccggaaacacuuagacgccgc

SEQ ID NO: 312531 - RNA, 19 nt, Human
ccagaccagguaggcaggc

SEQ ID NO: 312532 - RNA, 24 nt, Human
ccuccacaacagcagccagacugg

SEQ ID NO: 312533 - RNA, 25 nt, Human
ccuccgacagucccugggaauccac

SEQ ID NO: 312534 - RNA, 18 nt, Human
ccucuggacaacaugaua

SEQ ID NO: 312535 - RNA, 21 nt, Human
ccuugccuccacaacagcagc

SEQ ID NO: 312536 - RNA, 19 nt, Human
cggaaacacuuagacgccg

SEQ ID NO: 312537 - RNA, 21 nt, Human
cugggaugaguugccuuccuu

SEQ ID NO: 312538 - RNA, 22 nt, Human
cuugccuccacaacagcagcca

SEQ ID NO: 312539 - RNA, 20 nt, Human
gacagucccugggaauccac

SEQ ID NO: 312540 - RNA, 23 nt, Human
gcaccagaugccuucugggauga

SEQ ID NO: 312541 - RNA, 19 nt, Human
ggcagaguccacaccuccg

SEQ ID NO: 312542 - RNA, 21 nt, Human
uaagcuacaagaagcaccaga

SEQ ID NO: 312543 - RNA, 20 nt, Human
uacaagaagcaccagaugcc

SEQ ID NO: 312544 - RNA, 24 nt, Human
uaguuaagcuacaagaagcaccag

SEQ ID NO: 312545 - RNA, 26 nt, Human
ugauaagugugacaaucacacuuccu

SEQ ID NO: 312546 - RNA, 21 nt, Human
aaugcccaugaccugagugac

SEQ ID NO: 312547 - RNA, 18 nt, Human
agagaggcuggcuucagg

SEQ ID NO: 312548 - RNA, 19 nt, Human
agccagcccuuccucaaca

SEQ ID NO: 312549 - RNA, 19 nt, Human
cacaggcgagucaguuucc

SEQ ID NO: 312550 - RNA, 23 nt, Human
cacgguggacagugagccagccc

SEQ ID NO: 312551 - RNA, 21 nt, Human
cagcucucccacugugucuuu

SEQ ID NO: 312552 - RNA, 18 nt, Human
cauuuucagcucucccac

SEQ ID NO: 312553 - RNA, 23 nt, Human
gagagcagcagaaggggugagag

SEQ ID NO: 312554 - RNA, 24 nt, Human
gagagcagcagaaggggugagagc

SEQ ID NO: 312555 - RNA, 19 nt, Human
gagcagcagaaggggugag

SEQ ID NO: 312556 - RNA, 23 nt, Human
gagcagcagaaggggugagagcg

SEQ ID NO: 312557 - RNA, 24 nt, Human
gagcgcgaccacaguugggaguac

SEQ ID NO: 312558 - RNA, 19 nt, Human
gcacccccuagcguggaca

SEQ ID NO: 312559 - RNA, 24 nt, Human
ggacagugagccagcccuuccuca

SEQ ID NO: 312560 - RNA, 18 nt, Human
ugaacaaugcccaugacc

SEQ ID NO: 312561 - RNA, 23 nt, Human
ugaccugagugacuuggcagaga

SEQ ID NO: 312562 - RNA, 24 nt, Human
ugagugacuuggcagagaggcugg

SEQ ID NO: 312563 - RNA, 18 nt, Human
ugccgccacgguggacag

SEQ ID NO: 312564 - RNA, 23 nt, Human
uggacagugagccagcccuuccu

SEQ ID NO: 312565 - RNA, 24 nt, Human
agcccgcgcagcccucccagccuu

SEQ ID NO: 312566 - RNA, 22 nt, Human
uauuacacucgggggagagagg

SEQ ID NO: 312567 - RNA, 22 nt, Human
uuuauuacacucgggggagaga

SEQ ID NO: 312568 - RNA, 21 nt, Human
accuggagcggagggucaggc

SEQ ID NO: 312569 - RNA, 18 nt, Human
agagcccccucuggcccu

SEQ ID NO: 312570 - RNA, 21 nt, Human
ccccaaggguccgccgccgcc

SEQ ID NO: 312571 - RNA, 21 nt, Human
cucccgccgccguugcgucca

SEQ ID NO: 312572 - RNA, 19 nt, Human
gcagagcccccucuggccc

SEQ ID NO: 312573 - RNA, 24 nt, Human
uaccuggagcggagggucaggcca

SEQ ID NO: 312574 - RNA, 19 nt, Human
uccagaccccaaggguccg

SEQ ID NO: 312575 - RNA, 22 nt, Human
ucccgccgccguugcguccaga

SEQ ID NO: 312576 - RNA, 23 nt, Human
ucccgccgccguugcguccagaa

SEQ ID NO: 312577 - RNA, 23 nt, Human
ugcguccagaccccaaggguccg

SEQ ID NO: 312578 - RNA, 26 nt, Human
uuaggaauauaaaaccuaaucuaugu

SEQ ID NO: 312579 - RNA, 24 nt, Human
aaaaacucacuccgcguuuccaaa

SEQ ID NO: 312580 - RNA, 22 nt, Human
aaacucacuccgcguuuccaaa

SEQ ID NO: 312581 - RNA, 22 nt, Human
aacaaucagaaaugggaagaga

SEQ ID NO: 312582 - RNA, 18 nt, Human
agguuucaggaguucacu

SEQ ID NO: 312583 - RNA, 21 nt, Human
auauauggaaaaaacagugua

SEQ ID NO: 312584 - RNA, 18 nt, Human
cagcacggaaaaacucac

SEQ ID NO: 312585 - RNA, 20 nt, Human
ccccuacacagcacggaaaa

SEQ ID NO: 312586 - RNA, 21 nt, Human
cccuacacagcacggaaaaac

SEQ ID NO: 312587 - RNA, 19 nt, Human
gaguucacugggggccuug

SEQ ID NO: 312588 - RNA, 25 nt, Human
uacaacaaucagaaaugggaagaga

SEQ ID NO: 312589 - RNA, 20 nt, Human
uacacagcacggaaaaacuc

SEQ ID NO: 312590 - RNA, 19 nt, Human
ucucuugcuaugcuuaauu

SEQ ID NO: 312591 - RNA, 22 nt, Human
uggaaaaaacaguguauaaagg

SEQ ID NO: 312592 - RNA, 20 nt, Human
uugagguuucaggaguucac

SEQ ID NO: 312593 - RNA, 26 nt, Human
cgccgcuccaggcgccgccgccgccg

SEQ ID NO: 312594 - RNA, 20 nt, Human
cuccaggcgccgccgccgcc

SEQ ID NO: 312595 - RNA, 19 nt, Human
uuuuuuuuuuuuggggggu

SEQ ID NO: 312596 - RNA, 20 nt, Human
uuuuuuuuuuuuggggggug

SEQ ID NO: 312597 - RNA, 19 nt, Human
uuuuuuuuuuuuuuggggg

SEQ ID NO: 312598 - RNA, 20 nt, Human
uuuuuuuuuuuuuuuggggg

SEQ ID NO: 312599 - RNA, 22 nt, Human
uuuuuuuuuuuuuuuuuggggg

SEQ ID NO: 312600 - RNA, 21 nt, Human
aaaauagcaaaccgcgaagga

SEQ ID NO: 312601 - RNA, 22 nt, Human
aaaaugcacaccccacgggaca

SEQ ID NO: 312602 - RNA, 24 nt, Human
aaagacaucaaaauaaaaccccaa

SEQ ID NO: 312603 - RNA, 22 nt, Human
aacaggaaaugaaaauagcaaa

SEQ ID NO: 312604 - RNA, 24 nt, Human
aaggaacagacacggcuaccucaa

SEQ ID NO: 312605 - RNA, 20 nt, Human
aauaauagucaccagaccca

SEQ ID NO: 312606 - RNA, 21 nt, Human
acacgauccguuaaaacacuc

SEQ ID NO: 312607 - RNA, 20 nt, Human
acagaugagcacaacgagcu

SEQ ID NO: 312608 - RNA, 19 nt, Human
accaccacacgaagaaaca

SEQ ID NO: 312609 - RNA, 20 nt, Human
agauggccuacaagaugaac

SEQ ID NO: 312610 - RNA, 22 nt, Human
agccgacacgaugacccaacuu

SEQ ID NO: 312611 - RNA, 18 nt, Human
agugugcuacucuauucu

SEQ ID NO: 312612 - RNA, 19 nt, Human
auagaaaaacaguucugaa

SEQ ID NO: 312613 - RNA, 23 nt, Human
aucaaaauaaaaccccaaacccc

SEQ ID NO: 312614 - RNA, 18 nt, Human
aucaaagaauagaaaaac

SEQ ID NO: 312615 - RNA, 21 nt, Human
caaaaaaaucgaaacaugaua

SEQ ID NO: 312616 - RNA, 23 nt, Human
caaaagaaaagacaucaaaauaa

SEQ ID NO: 312617 - RNA, 21 nt, Human
caaaagggcagaccgcagaca

SEQ ID NO: 312618 - RNA, 24 nt, Human
caaaauaaaaccccaaaccccuca

SEQ ID NO: 312619 - RNA, 24 nt, Human
caaccagccgacacgaugacccaa

SEQ ID NO: 312620 - RNA, 18 nt, Human
caacgcugggcugugcuc

SEQ ID NO: 312621 - RNA, 18 nt, Human
caacgcugggcugugcuc

SEQ ID NO: 312622 - RNA, 20 nt, Human
caacuuagaaaaugcagcuc

SEQ ID NO: 312623 - RNA, 22 nt, Human
cagaccgcagacauuuuaaagc

SEQ ID NO: 312624 - RNA, 18 nt, Human
cagagcaggacaacggcc

SEQ ID NO: 312625 - RNA, 19 nt, Human
cagagugagccaguccugc

SEQ ID NO: 312626 - RNA, 21 nt, Human
cagucaauauugcuaaugcgu

SEQ ID NO: 312627 - RNA, 19 nt, Human
caguuccugagcccaaccu

SEQ ID NO: 312628 - RNA, 24 nt, Human
cauaguauaccuguaugcuuccga

SEQ ID NO: 312629 - RNA, 21 nt, Human
ccacagugguagccaggccaa

SEQ ID NO: 312630 - RNA, 24 nt, Human
ccaccacacgaagaaacaugcaga

SEQ ID NO: 312631 - RNA, 21 nt, Human
ccacgggcagucugccaggug

SEQ ID NO: 312632 - RNA, 23 nt, Human
cccaacgcugggcugugcucucc

SEQ ID NO: 312633 - RNA, 21 nt, Human
cccacggcgcacugggcagcu

SEQ ID NO: 312634 - RNA, 21 nt, Human
ccccacgggacacgcacugcc

SEQ ID NO: 312635 - RNA, 25 nt, Human
ccccacugcugcacaugcaucagau

SEQ ID NO: 312636 - RNA, 25 nt, Human
cccgacagcagggccacgggcaguc

SEQ ID NO: 312637 - RNA, 20 nt, Human
cccggccccaacgcugggcc

SEQ ID NO: 312638 - RNA, 25 nt, Human
ccgcaauaauagucaccagacccau

SEQ ID NO: 312639 - RNA, 18 nt, Human
ccgcgaaggaacagacac

SEQ ID NO: 312640 - RNA, 22 nt, Human
ccgguggccgaggccgcggggc

SEQ ID NO: 312641 - RNA, 22 nt, Human
ccugagcccaaccugccucagc

SEQ ID NO: 312642 - RNA, 23 nt, Human
ccugcaguuccugagcccaaccu

SEQ ID NO: 312643 - RNA, 28 nt, Human
ccugcaguuccugagcccaaccugccuc

SEQ ID NO: 312644 - RNA, 22 nt, Human
ccuggggcccgacagcagggcc

SEQ ID NO: 312645 - RNA, 22 nt, Human
ccuguaugcuuccgacgucggg

SEQ ID NO: 312646 - RNA, 18 nt, Human
ccuuuggaaaaccuucag

SEQ ID NO: 312647 - RNA, 22 nt, Human
cgacacgaugacccaacuuaga

SEQ ID NO: 312648 - RNA, 22 nt, Human
cgccagcggucccggccccaac

SEQ ID NO: 312649 - RNA, 22 nt, Human
cgcgaaggaacagacacggcua

SEQ ID NO: 312650 - RNA, 24 nt, Human
cgcugggcugugcucuccugcgac

SEQ ID NO: 312651 - RNA, 21 nt, Human
cggccuggggcccgacagcag

SEQ ID NO: 312652 - RNA, 18 nt, Human
cgggacacgcacugccag

SEQ ID NO: 312653 - RNA, 21 nt, Human
cgguccgcaauaauagucacc

SEQ ID NO: 312654 - RNA, 22 nt, Human
cuagaacuccccacugcugcac

SEQ ID NO: 312655 - RNA, 22 nt, Human
cucaucaugguguuuguaacga

SEQ ID NO: 312656 - RNA, 19 nt, Human
cuggauuuguuguccaguu

SEQ ID NO: 312657 - RNA, 23 nt, Human
gaacagacacggcuaccucaaac

SEQ ID NO: 312658 - RNA, 22 nt, Human
gaagaaacaugcagagugauca

SEQ ID NO: 312659 - RNA, 18 nt, Human
gaagauggacgcgaccac

SEQ ID NO: 312660 - RNA, 24 nt, Human
gaaggaacagacacggcuaccuca

SEQ ID NO: 312661 - RNA, 18 nt, Human
gacaacggccuggggccc

SEQ ID NO: 312662 - RNA, 19 nt, Human
gacacgaugacccaacuua

SEQ ID NO: 312663 - RNA, 21 nt, Human
gacacgaugacccaacuuaga

SEQ ID NO: 312664 - RNA, 20 nt, Human
gaccaaaagaaaagacauca

SEQ ID NO: 312665 - RNA, 22 nt, Human
gaccaaaagaaaagacaucaaa

SEQ ID NO: 312666 - RNA, 19 nt, Human
gacccguagugguuuccuu

SEQ ID NO: 312667 - RNA, 20 nt, Human
gagccaagcccuuuggaaaa

SEQ ID NO: 312668 - RNA, 20 nt, Human
gauccguuaaaacacucccc

SEQ ID NO: 312669 - RNA, 20 nt, Human
gcaauaauagucaccagacc

SEQ ID NO: 312670 - RNA, 20 nt, Human
gcagaaaacaacguccacgu

SEQ ID NO: 312671 - RNA, 22 nt, Human
gccaauucauuugcuucaccau

SEQ ID NO: 312672 - RNA, 25 nt, Human
gccccaacgcugggcugugcucucc

SEQ ID NO: 312673 - RNA, 19 nt, Human
gcccggcugacgugcgggg

SEQ ID NO: 312674 - RNA, 21 nt, Human
gcgacacgauccguuaaaaca

SEQ ID NO: 312675 - RNA, 19 nt, Human
gcgggcgugccgcgagccc

SEQ ID NO: 312676 - RNA, 18 nt, Human
gcuccuucacucacuucc

SEQ ID NO: 312677 - RNA, 20 nt, Human
ggcucuggagccaagcccuu

SEQ ID NO: 312678 - RNA, 21 nt, Human
gggggaggcugacgcagccag

SEQ ID NO: 312679 - RNA, 22 nt, Human
guagugguuuccuuaauguggg

SEQ ID NO: 312680 - RNA, 20 nt, Human
gucagacaaccagccgacac

SEQ ID NO: 312681 - RNA, 20 nt, Human
guggcucuggagccaagccc

SEQ ID NO: 312682 - RNA, 21 nt, Human
guuuaaaaaaaauucccuccu

SEQ ID NO: 312683 - RNA, 20 nt, Human
uaaaaaaaauucccuccucc

SEQ ID NO: 312684 - RNA, 21 nt, Human
uaaaacaaugaccucccaagc

SEQ ID NO: 312685 - RNA, 27 nt, Human
uaaaacaaugaccucccaagcuuaucc

SEQ ID NO: 312686 - RNA, 18 nt, Human
uaaaaccccaaaccccuc

SEQ ID NO: 312687 - RNA, 19 nt, Human
uaaaaugcacaccccacgg

SEQ ID NO: 312688 - RNA, 22 nt, Human
uaaaaugcacaccccacgggac

SEQ ID NO: 312689 - RNA, 21 nt, Human
uaacaaagacagugguuguug

SEQ ID NO: 312690 - RNA, 26 nt, Human
uacagaucaguuuuuauaaauauucu

SEQ ID NO: 312691 - RNA, 23 nt, Human
uagaacuccccacugcugcacau

SEQ ID NO: 312692 - RNA, 22 nt, Human
ucaaaaaaagguaacaaagaca

SEQ ID NO: 312693 - RNA, 24 nt, Human
ucaaaauaaaaccccaaaccccuc

SEQ ID NO: 312694 - RNA, 22 nt, Human
uccaaaaacucaggguuaggca

SEQ ID NO: 312695 - RNA, 24 nt, Human
uccacacacaaaaaaaucgaaaca

SEQ ID NO: 312696 - RNA, 22 nt, Human
ucccaaugacagagugagccag

SEQ ID NO: 312697 - RNA, 21 nt, Human
ucccggccccaacgcugggcu

SEQ ID NO: 312698 - RNA, 24 nt, Human
uccgcaauaauagucaccagaccc

SEQ ID NO: 312699 - RNA, 19 nt, Human
uccugagcccaaccugccu

SEQ ID NO: 312700 - RNA, 24 nt, Human
ucgcagcugacagcucccaaugac

SEQ ID NO: 312701 - RNA, 19 nt, Human
ucuauucuggaaugccucc

SEQ ID NO: 312702 - RNA, 27 nt, Human
ucuguggucagagcaggaccggggucc

SEQ ID NO: 312703 - RNA, 19 nt, Human
ugacauucuccacuagugg

SEQ ID NO: 312704 - RNA, 23 nt, Human
ugagggcaguaaaacaaugaccu

SEQ ID NO: 312705 - RNA, 21 nt, Human
uggaaugccuccuagagaacc

SEQ ID NO: 312706 - RNA, 18 nt, Human
uggccgaggccgcggggc

SEQ ID NO: 312707 - RNA, 20 nt, Human
uggucagagcaggacaacgg

SEQ ID NO: 312708 - RNA, 23 nt, Human
ugugagggcaguaaaacaaugac

SEQ ID NO: 312709 - RNA, 20 nt, Human
uguggcagaauacacuugca

SEQ ID NO: 312710 - RNA, 20 nt, Human
uucacagaugagcacaacga

SEQ ID NO: 312711 - RNA, 24 nt, Human
uucacauuuuccuaaagauuuuau

SEQ ID NO: 312712 - RNA, 20 nt, Human
uuccugagcccaaccugccu

SEQ ID NO: 312713 - RNA, 24 nt, Human
uuucaaacaaaaugugagggcagu

SEQ ID NO: 312714 - RNA, 23 nt, Human
uuuggaaaaccuucagggcgacc

SEQ ID NO: 312715 - RNA, 18 nt, Human
uuuuauaaugugacaacc

SEQ ID NO: 312716 - RNA, 18 nt, Human
uuuuuuuuuuuuuuuuug

SEQ ID NO: 312717 - RNA, 23 nt, Human
aggcaggcugaggcucugucucg

SEQ ID NO: 312718 - RNA, 21 nt, Human
aggcggcagcagggcagggga

SEQ ID NO: 312719 - RNA, 21 nt, Human
aggcugcucucugagggcggg

SEQ ID NO: 312720 - RNA, 27 nt, Human
cagcagggcaggggagagcaaggggcu

SEQ ID NO: 312721 - RNA, 20 nt, Human
ccccaggcugggaggcggca

SEQ ID NO: 312722 - RNA, 21 nt, Human
cccuccuucgccgccgcuuag

SEQ ID NO: 312723 - RNA, 19 nt, Human
ccuggggcccgcugugccc

SEQ ID NO: 312724 - RNA, 20 nt, Human
cggcagcagggcaggggagg

SEQ ID NO: 312725 - RNA, 19 nt, Human
cugccacgaccccccaggc

SEQ ID NO: 312726 - RNA, 18 nt, Human
gaggcggcagcagggcag

SEQ ID NO: 312727 - RNA, 24 nt, Human
gcaggcugaggcucugucucggga

SEQ ID NO: 312728 - RNA, 19 nt, Human
gcucucugagggcggggac

SEQ ID NO: 312729 - RNA, 19 nt, Human
gcugcucucugagggcggg

SEQ ID NO: 312730 - RNA, 24 nt, Human
ggcaggggagagcaaggggcuuug

SEQ ID NO: 312731 - RNA, 21 nt, Human
gggaggcggcagcagggcagg

SEQ ID NO: 312732 - RNA, 26 nt, Human
ggggaggguagcccuggggcccgcug

SEQ ID NO: 312733 - RNA, 23 nt, Human
guagcccuggggcccgcugugcc

SEQ ID NO: 312734 - RNA, 18 nt, Human
uaagaggcugauuaucug

SEQ ID NO: 312735 - RNA, 21 nt, Human
uccugggggaggguagcccug

SEQ ID NO: 312736 - RNA, 21 nt, Human
ucugccacgaccccccaggcu

SEQ ID NO: 312737 - RNA, 21 nt, Human
ucuucuuccccuccuucgccg

SEQ ID NO: 312738 - RNA, 19 nt, Human
ugggaggcggcagcagggc

SEQ ID NO: 312739 - RNA, 21 nt, Human
ugggaggcggcagcagggcag

SEQ ID NO: 312740 - RNA, 24 nt, Human
aaagucccacgaucccguggggaa

SEQ ID NO: 312741 - RNA, 18 nt, Human
aaggcaaagcccacugcu

SEQ ID NO: 312742 - RNA, 21 nt, Human
acugaggugucagaaggcaaa

SEQ ID NO: 312743 - RNA, 23 nt, Human
agcagcaccacugaggugucaga

SEQ ID NO: 312744 - RNA, 21 nt, Human
agccaggccagcgcagccgca

SEQ ID NO: 312745 - RNA, 21 nt, Human
aggcagugcgacaccuccugg

SEQ ID NO: 312746 - RNA, 18 nt, Human
aggccgagaagcgccgcc

SEQ ID NO: 312747 - RNA, 28 nt, Human
agguacaguaggaggccgaccgguaccc

SEQ ID NO: 312748 - RNA, 26 nt, Human
auaacagcagucagagucagggacac

SEQ ID NO: 312749 - RNA, 21 nt, Human
caccacagccaggccuacgcc

SEQ ID NO: 312750 - RNA, 22 nt, Human
cagcagucagagucagggacac

SEQ ID NO: 312751 - RNA, 24 nt, Human
cagccaggccuacgcccagcagca

SEQ ID NO: 312752 - RNA, 23 nt, Human
cagcgcagccgcagcaaccccug

SEQ ID NO: 312753 - RNA, 21 nt, Human
ccacagccaggccuacgccca

SEQ ID NO: 312754 - RNA, 22 nt, Human
ccaggccgcgguaguccccacg

SEQ ID NO: 312755 - RNA, 19 nt, Human
cccacggccagccaggccu

SEQ ID NO: 312756 - RNA, 24 nt, Human
ccccaccaggccgcgguagucccc

SEQ ID NO: 312757 - RNA, 21 nt, Human
ccccacggccagccaggccag

SEQ ID NO: 312758 - RNA, 20 nt, Human
cccuccggagcgggggcggg

SEQ ID NO: 312759 - RNA, 21 nt, Human
ccgagaagcgccgccccggcc

SEQ ID NO: 312760 - RNA, 18 nt, Human
ccgccgccgcucgccugc

SEQ ID NO: 312761 - RNA, 18 nt, Human
ccgccgccgcucgccugc

SEQ ID NO: 312762 - RNA, 19 nt, Human
ccgccgccgcucgccugcu

SEQ ID NO: 312763 - RNA, 21 nt, Human
ccgcgguaguccccacggcca

SEQ ID NO: 312764 - RNA, 19 nt, Human
ccggacaggaauacugggc

SEQ ID NO: 312765 - RNA, 23 nt, Human
ccucggggcucgcggcucagucc

SEQ ID NO: 312766 - RNA, 22 nt, Human
ccugcuccagccgccgcagccg

SEQ ID NO: 312767 - RNA, 21 nt, Human
cgaagcgaacaguguucgccc

SEQ ID NO: 312768 - RNA, 18 nt, Human
cgagaagcgccgccccgg

SEQ ID NO: 312769 - RNA, 21 nt, Human
cgcggcucuaggagguuuccg

SEQ ID NO: 312770 - RNA, 20 nt, Human
cggccgccgccgcucgccug

SEQ ID NO: 312771 - RNA, 26 nt, Human
cuacgcccagcagcaccacugaggug

SEQ ID NO: 312772 - RNA, 23 nt, Human
cuaucggccgccgccgcucgccu

SEQ ID NO: 312773 - RNA, 20 nt, Human
gaagcagacacaggguggga

SEQ ID NO: 312774 - RNA, 22 nt, Human
gacuuggccggaggcgaagcga

SEQ ID NO: 312775 - RNA, 27 nt, Human
gagcgcggcgccgggcgggcgggcggc

SEQ ID NO: 312776 - RNA, 18 nt, Human
gccgcagcaggcacgagg

SEQ ID NO: 312777 - RNA, 21 nt, Human
gcgccuucugaacgaaggagg

SEQ ID NO: 312778 - RNA, 27 nt, Human
ggagaagaggaguggggagagaggggu

SEQ ID NO: 312779 - RNA, 21 nt, Human
ggagcgcggcgccgggcgggc

SEQ ID NO: 312780 - RNA, 18 nt, Human
ggagggcgguguggagcg

SEQ ID NO: 312781 - RNA, 18 nt, Human
ggaguggggagagagggg

SEQ ID NO: 312782 - RNA, 19 nt, Human
gggcgggcugcggcggccc

SEQ ID NO: 312783 - RNA, 21 nt, Human
gggucggcggggagggcggug

SEQ ID NO: 312784 - RNA, 21 nt, Human
guaaaaguggugaacgcgaug

SEQ ID NO: 312785 - RNA, 25 nt, Human
uauucggaagcagacacaggguggg

SEQ ID NO: 312786 - RNA, 21 nt, Human
ucagaaggcaaagcccacugc

SEQ ID NO: 312787 - RNA, 21 nt, Human
ucaguccccaccaggccgcgg

SEQ ID NO: 312788 - RNA, 19 nt, Human
uccagcacacugugggaag

SEQ ID NO: 312789 - RNA, 20 nt, Human
ugcccaugaggagcaguucg

SEQ ID NO: 312790 - RNA, 18 nt, Human
uggagcgcggcgccgggc

SEQ ID NO: 312791 - RNA, 18 nt, Human
uggccggaggcgaagcga

SEQ ID NO: 312792 - RNA, 20 nt, Human
ugggaaguacccccggacag

SEQ ID NO: 312793 - RNA, 24 nt, Human
ugggaggcagugcgacaccuccug

SEQ ID NO: 312794 - RNA, 18 nt, Human
uggugagaaccaggauaa

SEQ ID NO: 312795 - RNA, 20 nt, Human
uguggagcgcggcgccgggc

SEQ ID NO: 312796 - RNA, 21 nt, Human
uguggagcgcggcgccgggcg

SEQ ID NO: 312797 - RNA, 18 nt, Human
aaaaaaaagcccuacaca

SEQ ID NO: 312798 - RNA, 18 nt, Human
aaaaacaaaacaaaagca

SEQ ID NO: 312799 - RNA, 20 nt, Human
aaaacccaccagcacuacca

SEQ ID NO: 312800 - RNA, 23 nt, Human
aaacaaaaacccaccagcacuac

SEQ ID NO: 312801 - RNA, 20 nt, Human
aaacaaaagcaagaaaaaaa

SEQ ID NO: 312802 - RNA, 18 nt, Human
aaagucauauaucgaagg

SEQ ID NO: 312803 - RNA, 19 nt, Human
aaauauuaaacaaaaaccc

SEQ ID NO: 312804 - RNA, 24 nt, Human
aacaaaacaaaagcaagaaaaaaa

SEQ ID NO: 312805 - RNA, 24 nt, Human
aacagagugagauucggucucaaa

SEQ ID NO: 312806 - RNA, 24 nt, Human
aacccugcuccccugugucuucug

SEQ ID NO: 312807 - RNA, 24 nt, Human
aagcaagaaaaaaauuuguuucua

SEQ ID NO: 312808 - RNA, 25 nt, Human
aagcaagaaaaaaauuuguuucuaa

SEQ ID NO: 312809 - RNA, 25 nt, Human
aaggcagcgauacacacaugugcuu

SEQ ID NO: 312810 - RNA, 23 nt, Human
acaaaacaaaagcaagaaaaaaa

SEQ ID NO: 312811 - RNA, 24 nt, Human
acagagugagauucggucucaaaa

SEQ ID NO: 312812 - RNA, 24 nt, Human
acaguguagucuuuggggacacuu

SEQ ID NO: 312813 - RNA, 22 nt, Human
accacugcacuccagccugggc

SEQ ID NO: 312814 - RNA, 24 nt, Human
acuccagccugggcaacagaguga

SEQ ID NO: 312815 - RNA, 24 nt, Human
acugcacuccagccugggcaacag

SEQ ID NO: 312816 - RNA, 24 nt, Human
acugcacuccagccugggcaacag

SEQ ID NO: 312817 - RNA, 20 nt, Human
agaaguugcagugagccaag

SEQ ID NO: 312818 - RNA, 23 nt, Human
agcacuaccaccaccucaacaac

SEQ ID NO: 312819 - RNA, 24 nt, Human
agccugggcaacagagugagauuc

SEQ ID NO: 312820 - RNA, 19 nt, Human
aggcagcgauacacacaug

SEQ ID NO: 312821 - RNA, 22 nt, Human
aggggaguuggaauaguucagg

SEQ ID NO: 312822 - RNA, 24 nt, Human
agguagaaguugcagugagccaag

SEQ ID NO: 312823 - RNA, 22 nt, Human
aucauaucacucccaguuaaac

SEQ ID NO: 312824 - RNA, 24 nt, Human
aucgcaccacugcacuccagccug

SEQ ID NO: 312825 - RNA, 20 nt, Human
caaaaaaaagcccuacacau

SEQ ID NO: 312826 - RNA, 19 nt, Human
caaaacaaaagcaagaaaa

SEQ ID NO: 312827 - RNA, 23 nt, Human
caacacucccaagaauuuuaaga

SEQ ID NO: 312828 - RNA, 25 nt, Human
caacagagugagauucggucucagu

SEQ ID NO: 312829 - RNA, 18 nt, Human
caagaucauagagacuca

SEQ ID NO: 312830 - RNA, 22 nt, Human
cacacuguuauuuaauaucuga

SEQ ID NO: 312831 - RNA, 21 nt, Human
cacgugagcuaacccugcucc

SEQ ID NO: 312832 - RNA, 22 nt, Human
cacuccagccugggcaacagag

SEQ ID NO: 312833 - RNA, 22 nt, Human
cacuccagccugggcaacagag

SEQ ID NO: 312834 - RNA, 24 nt, Human
cacuccagccugggcaacagagug

SEQ ID NO: 312835 - RNA, 19 nt, Human
cacugcacuccagccuggg

SEQ ID NO: 312836 - RNA, 21 nt, Human
cacugcacuccagccugggca

SEQ ID NO: 312837 - RNA, 22 nt, Human
cacugcacuccagccugggcaa

SEQ ID NO: 312838 - RNA, 23 nt, Human
cacugcacuccagccugggcaac

SEQ ID NO: 312839 - RNA, 24 nt, Human
cacugcacuccagccugggcaaca

SEQ ID NO: 312840 - RNA, 25 nt, Human
cacugcacuccagccugggcaacaa

SEQ ID NO: 312841 - RNA, 18 nt, Human
cagcgauacacacaugug

SEQ ID NO: 312842 - RNA, 18 nt, Human
caguguagucuuugggga

SEQ ID NO: 312843 - RNA, 20 nt, Human
ccacugcacuccagccuggg

SEQ ID NO: 312844 - RNA, 20 nt, Human
ccacugcacuccagccuggg

SEQ ID NO: 312845 - RNA, 21 nt, Human
ccacugcacuccagccugggc

SEQ ID NO: 312846 - RNA, 22 nt, Human
ccacugcacuccagccugggca

SEQ ID NO: 312847 - RNA, 23 nt, Human
ccacugcacuccagccugggcaa

SEQ ID NO: 312848 - RNA, 24 nt, Human
ccacugcacuccagccugggcaac

SEQ ID NO: 312849 - RNA, 20 nt, Human
ccagucaucgaagugaacaa

SEQ ID NO: 312850 - RNA, 22 nt, Human
ccuacacaucauaucacuccca

SEQ ID NO: 312851 - RNA, 22 nt, Human
ccugggcaacagagugagauuc

SEQ ID NO: 312852 - RNA, 21 nt, Human
ccuucaaaucagaaaaacaaa

SEQ ID NO: 312853 - RNA, 21 nt, Human
cgaagugaacaaacuuccuuu

SEQ ID NO: 312854 - RNA, 21 nt, Human
cgcaccacugcacuccagccu

SEQ ID NO: 312855 - RNA, 23 nt, Human
cggagguagaaguugcagugagc

SEQ ID NO: 312856 - RNA, 27 nt, Human
cgggaggcugaggcacaagaaucucuu

SEQ ID NO: 312857 - RNA, 18 nt, Human
cuaacccugcuccccugu

SEQ ID NO: 312858 - RNA, 23 nt, Human
cucaaaaacaaaacaaaagcaag

SEQ ID NO: 312859 - RNA, 20 nt, Human
cucggagguagaaguugcag

SEQ ID NO: 312860 - RNA, 20 nt, Human
cuucauaaugcauauguuuu

SEQ ID NO: 312861 - RNA, 18 nt, Human
gaagggaaaaugggagua

SEQ ID NO: 312862 - RNA, 18 nt, Human
gaaguugcagugagccaa

SEQ ID NO: 312863 - RNA, 22 nt, Human
gagucccugggugaguacugga

SEQ ID NO: 312864 - RNA, 22 nt, Human
gcacaagaaucucuugaaccuc

SEQ ID NO: 312865 - RNA, 20 nt, Human
gcaccacugcacuccagccu

SEQ ID NO: 312866 - RNA, 23 nt, Human
gcacuccagccugggcaacagag

SEQ ID NO: 312867 - RNA, 20 nt, Human
gccaagaucgcaccacugca

SEQ ID NO: 312868 - RNA, 20 nt, Human
gggaguuggaauaguucagg

SEQ ID NO: 312869 - RNA, 23 nt, Human
gugaguacuggaguucuaaagac

SEQ ID NO: 312870 - RNA, 19 nt, Human
guucagcuaagaacacugg

SEQ ID NO: 312871 - RNA, 23 nt, Human
uaaacaaaaacccaccaaccccg

SEQ ID NO: 312872 - RNA, 20 nt, Human
uaacacccugaagaaguaau

SEQ ID NO: 312873 - RNA, 19 nt, Human
uauuccaagacugauuuga

SEQ ID NO: 312874 - RNA, 20 nt, Human
ucaaaaacaaaacaaaagca

SEQ ID NO: 312875 - RNA, 18 nt, Human
ucauuguucagcuaagaa

SEQ ID NO: 312876 - RNA, 23 nt, Human
uccagccugggcaacagagugag

SEQ ID NO: 312877 - RNA, 24 nt, Human
uccagccugggcaacagagugaga

SEQ ID NO: 312878 - RNA, 23 nt, Human
ucgcaccacugcacuccagccug

SEQ ID NO: 312879 - RNA, 23 nt, Human
ucggucucaaaaacaaaacaaaa

SEQ ID NO: 312880 - RNA, 21 nt, Human
ugacaacacucccaagaauuu

SEQ ID NO: 312881 - RNA, 20 nt, Human
ugagaaggauuuuuauggua

SEQ ID NO: 312882 - RNA, 24 nt, Human
ugaggcacaagaaucucuugaacc

SEQ ID NO: 312883 - RNA, 21 nt, Human
uggagucccugggugaguacu

SEQ ID NO: 312884 - RNA, 22 nt, Human
uggccugugaacuggagucccu

SEQ ID NO: 312885 - RNA, 22 nt, Human
ugucagacaccugacgggcucc

SEQ ID NO: 312886 - RNA, 23 nt, Human
ugucauugcaacaggagaauuga

SEQ ID NO: 312887 - RNA, 23 nt, Human
uuaaacaaaaacccaccagcacu

SEQ ID NO: 312888 - RNA, 18 nt, Human
uuaaacagugcuuugaug

SEQ ID NO: 312889 - RNA, 22 nt, Human
uucagccuccacaacaagaagu

SEQ ID NO: 312890 - RNA, 21 nt, Human
uucucaaaaaaaagcccuaca

SEQ ID NO: 312891 - RNA, 22 nt, Human
uugcagugagccaagaucgcac

SEQ ID NO: 312892 - RNA, 19 nt, Human
uuuauccauuuuagugaga

SEQ ID NO: 312893 - RNA, 18 nt, Human
aaccuguucauuuuccuu

SEQ ID NO: 312894 - RNA, 19 nt, Human
aagaaccuguucauuuucc

SEQ ID NO: 312895 - RNA, 23 nt, Human
aagcagcuuucuuuucugucccu

SEQ ID NO: 312896 - RNA, 21 nt, Human
acucuauuucaguggaaucca

SEQ ID NO: 312897 - RNA, 20 nt, Human
cacagugccagaagugaggu

SEQ ID NO: 312898 - RNA, 20 nt, Human
cgaaagcagcuuucuuuucu

SEQ ID NO: 312899 - RNA, 18 nt, Human
cuggcaguuggaaggcaa

SEQ ID NO: 312900 - RNA, 18 nt, Human
ggugaggcuuacuuugug

SEQ ID NO: 312901 - RNA, 23 nt, Human
uaauauaacuccaacuuuuuaau

SEQ ID NO: 312902 - RNA, 23 nt, Human
ucagaauuagcaauuucauagaa

SEQ ID NO: 312903 - RNA, 23 nt, Human
uccaacuuuuuaaugguaaacaa

SEQ ID NO: 312904 - RNA, 18 nt, Human
ugcucuaagaacuaaaag

SEQ ID NO: 312905 - RNA, 18 nt, Human
uuggaaggcaaaggugag

SEQ ID NO: 312906 - RNA, 19 nt, Human
uugggauuuuaguuagucu

SEQ ID NO: 312907 - RNA, 20 nt, Human
uugggauuuuaguuagucuu

SEQ ID NO: 312908 - RNA, 18 nt, Human
uuuuuuuuuuuuuuuuug

SEQ ID NO: 312909 - RNA, 24 nt, Human
uuuuuuuuuuuuuuuuuuuuuggg

SEQ ID NO: 312910 - RNA, 18 nt, Human
agacuuuuuuuuuuuuuu

SEQ ID NO: 312911 - RNA, 27 nt, Human
auauguagacuuuuuuuuuuuuuuuuu

SEQ ID NO: 312912 - RNA, 20 nt, Human
ccacuuaucauacaauuauc

SEQ ID NO: 312913 - RNA, 23 nt, Human
uguagacuuuuuuuuuuuuuuuu

SEQ ID NO: 312914 - RNA, 20 nt, Human
aacaacccugugaggugggu

SEQ ID NO: 312915 - RNA, 19 nt, Human
accgacuccaccuuuccua

SEQ ID NO: 312916 - RNA, 24 nt, Human
agccuuccagugggugggaaaaga

SEQ ID NO: 312917 - RNA, 23 nt, Human
agguggguuucauaacccccacu

SEQ ID NO: 312918 - RNA, 22 nt, Human
cacaacaacccugugagguggg

SEQ ID NO: 312919 - RNA, 23 nt, Human
caggggucuucucaccuccggcu

SEQ ID NO: 312920 - RNA, 21 nt, Human
cccacuguuuaccgaugaggc

SEQ ID NO: 312921 - RNA, 23 nt, Human
ccuagaagccuucgugccgaauu

SEQ ID NO: 312922 - RNA, 20 nt, Human
ccugaaggaagguuugugag

SEQ ID NO: 312923 - RNA, 23 nt, Human
ccuugccugugagccuuccagug

SEQ ID NO: 312924 - RNA, 24 nt, Human
cggcuucucacuaccgacuccacc

SEQ ID NO: 312925 - RNA, 23 nt, Human
cuaaaucaacucauuggauccuc

SEQ ID NO: 312926 - RNA, 25 nt, Human
cucacuaccgacuccaccuuuccua

SEQ ID NO: 312927 - RNA, 26 nt, Human
cucacuaccgacuccaccuuuccuag

SEQ ID NO: 312928 - RNA, 21 nt, Human
cugguaaaggacggaaucugu

SEQ ID NO: 312929 - RNA, 26 nt, Human
cuguagcgacaguguuggcaccuucu

SEQ ID NO: 312930 - RNA, 18 nt, Human
cuugccugugagccuucc

SEQ ID NO: 312931 - RNA, 19 nt, Human
gaaggaagguuugugaggg

SEQ ID NO: 312932 - RNA, 22 nt, Human
gagggugaauuucucaaaguca

SEQ ID NO: 312933 - RNA, 18 nt, Human
gagguggguuucauaacc

SEQ ID NO: 312934 - RNA, 18 nt, Human
ucauaacccccacuguuu

SEQ ID NO: 312935 - RNA, 23 nt, Human
ucauuggauccucacaacaaccc

SEQ ID NO: 312936 - RNA, 18 nt, Human
ucucucaccuugccugug

SEQ ID NO: 312937 - RNA, 21 nt, Human
ucugugccucugcacuaccaa

SEQ ID NO: 312938 - RNA, 23 nt, Human
ugagguggguuucauaaccccca

SEQ ID NO: 312939 - RNA, 18 nt, Human
ugccugugagccuuccag

SEQ ID NO: 312940 - RNA, 24 nt, Human
uggcaccuucuguguccucucuca

SEQ ID NO: 312941 - RNA, 21 nt, Human
uggggccucucaaagccucac

SEQ ID NO: 312942 - RNA, 23 nt, Human
ugggugggaaaagaggcaugccu

SEQ ID NO: 312943 - RNA, 19 nt, Human
ugugaacacagaagagagc

SEQ ID NO: 312944 - RNA, 23 nt, Human
ugugccucugcacuaccaaugcc

SEQ ID NO: 312945 - RNA, 20 nt, Human
uuccuagaagccuucgugcc

SEQ ID NO: 312946 - RNA, 18 nt, Human
uuuggggccucucaaagc

SEQ ID NO: 312947 - RNA, 19 nt, Human
uuuuuuuuuuuuuuuuuaa

SEQ ID NO: 312948 - RNA, 18 nt, Human
aacucggagcgucacugg

SEQ ID NO: 312949 - RNA, 22 nt, Human
aagucaaccaguguuaaccccg

SEQ ID NO: 312950 - RNA, 24 nt, Human
caacauccucaacucggagcguca

SEQ ID NO: 312951 - RNA, 23 nt, Human
cagcaauaccuccuuuauuugau

SEQ ID NO: 312952 - RNA, 25 nt, Human
cauaaacaacugccuuagacggcaa

SEQ ID NO: 312953 - RNA, 19 nt, Human
cggagcgucacuggcugga

SEQ ID NO: 312954 - RNA, 25 nt, Human
uagagcacucagaaaacauggaaaa

SEQ ID NO: 312955 - RNA, 28 nt, Human
uaucauagagcacucagaaaacauggaa

SEQ ID NO: 312956 - RNA, 22 nt, Human
ucacacaaaaugaaaaucuccu

SEQ ID NO: 312957 - RNA, 19 nt, Human
ucauagagcacucagaaaa

SEQ ID NO: 312958 - RNA, 25 nt, Human
uccuagaaagagaaauuccucuguc

SEQ ID NO: 312959 - RNA, 20 nt, Human
uuccucuguccucugacuuc

SEQ ID NO: 312960 - RNA, 18 nt, Human
uuuuuuuuuuuuuuuuug

SEQ ID NO: 312961 - RNA, 21 nt, Human
uuuuuuuuuuuuuuuuugcag

SEQ ID NO: 312962 - RNA, 21 nt, Human
acccaggagacuacgggaggg

SEQ ID NO: 312963 - RNA, 23 nt, Human
agccaaacacacccaggagacua

SEQ ID NO: 312964 - RNA, 26 nt, Human
aggccaagccaaacacacccaggaga

SEQ ID NO: 312965 - RNA, 19 nt, Human
agucugugggguggguggg

SEQ ID NO: 312966 - RNA, 19 nt, Human
augccaaggccaagccaaa

SEQ ID NO: 312967 - RNA, 19 nt, Human
caaggccaagccaaacaca

SEQ ID NO: 312968 - RNA, 20 nt, Human
caccccaggcccagaggagu

SEQ ID NO: 312969 - RNA, 19 nt, Human
cagcagagagaaagagccc

SEQ ID NO: 312970 - RNA, 18 nt, Human
ccaagccaaacacaccca

SEQ ID NO: 312971 - RNA, 19 nt, Human
ccccaggcccagaggaguc

SEQ ID NO: 312972 - RNA, 23 nt, Human
cccugggcugugcugccaggggc

SEQ ID NO: 312973 - RNA, 23 nt, Human
gccaagccaaacacacccaggag

SEQ ID NO: 312974 - RNA, 18 nt, Human
gccucggacacgguggag

SEQ ID NO: 312975 - RNA, 22 nt, Human
ggaggaugcaccccaggcccag

SEQ ID NO: 312976 - RNA, 20 nt, Human
ggccagaggccuccagaggc

SEQ ID NO: 312977 - RNA, 19 nt, Human
gguggaccucaccuggccu

SEQ ID NO: 312978 - RNA, 20 nt, Human
gguggguggggcaggcaggc

SEQ ID NO: 312979 - RNA, 22 nt, Human
uacgggagggagccaggagagc

SEQ ID NO: 312980 - RNA, 18 nt, Human
ucagcagagagaaagagc

SEQ ID NO: 312981 - RNA, 23 nt, Human
ugccaaggccaagccaaacacac

SEQ ID NO: 312982 - RNA, 22 nt, Human
uggagcugguguccacguggga

SEQ ID NO: 312983 - RNA, 18 nt, Human
ugggguggguggggcagg

SEQ ID NO: 312984 - RNA, 22 nt, Human
aaaaaaaguggaaaaguaaagc

SEQ ID NO: 312985 - RNA, 18 nt, Human
aauauauuuggcuuaaaa

SEQ ID NO: 312986 - RNA, 24 nt, Human
agaaaaauaaggagaaccgguacc

SEQ ID NO: 312987 - RNA, 21 nt, Human
aggagaaccgcugcuccccaa

SEQ ID NO: 312988 - RNA, 20 nt, Human
auuucuguuuuuguugagga

SEQ ID NO: 312989 - RNA, 28 nt, Human
cccacaagagaguagaaaaauaaggaga

SEQ ID NO: 312990 - RNA, 23 nt, Human
gagaaaaaggcuauuauacaaua

SEQ ID NO: 312991 - RNA, 19 nt, Human
uaaguaaauaacaucaaua

SEQ ID NO: 312992 - RNA, 19 nt, Human
uauuacuguuaauauauuu

SEQ ID NO: 312993 - RNA, 20 nt, Human
ucagaguuuuauuauauuac

SEQ ID NO: 312994 - RNA, 19 nt, Human
uccccaaaucagaguuuua

SEQ ID NO: 312995 - RNA, 20 nt, Human
uggcuuaaaauagauaaugu

SEQ ID NO: 312996 - RNA, 22 nt, Human
ugucucaaagggccgauucaau

SEQ ID NO: 312997 - RNA, 24 nt, Human
uuucuuuuuuuuaaaaaaaagugg

SEQ ID NO: 312998 - RNA, 19 nt, Human
uuuguugaggaagagaaag

SEQ ID NO: 312999 - RNA, 20 nt, Human
aaaaaaaaccaaaaaaaaga

SEQ ID NO: 313000 - RNA, 21 nt, Human
aaaacccacaugguagcacua

SEQ ID NO: 313001 - RNA, 19 nt, Human
aaaccaaaaaaaagaaagg

SEQ ID NO: 313002 - RNA, 24 nt, Human
aaagcuccucuggaaaacguugau

SEQ ID NO: 313003 - RNA, 18 nt, Human
aaaggaagaagggaggga

SEQ ID NO: 313004 - RNA, 19 nt, Human
aacauggugaaaccccguc

SEQ ID NO: 313005 - RNA, 20 nt, Human
aacauggugaaaccccgucu

SEQ ID NO: 313006 - RNA, 21 nt, Human
aacauggugaaaccccgucuc

SEQ ID NO: 313007 - RNA, 18 nt, Human
aagaaagaaagagagagg

SEQ ID NO: 313008 - RNA, 20 nt, Human
aagaagcgagggagggaggg

SEQ ID NO: 313009 - RNA, 22 nt, Human
aagagcuaagcacaccugcuaa

SEQ ID NO: 313010 - RNA, 21 nt, Human
aagcacaccugcuaacaacuc

SEQ ID NO: 313011 - RNA, 18 nt, Human
aagcccuccccaggccag

SEQ ID NO: 313012 - RNA, 21 nt, Human
aaggcugggugcgguggcuca

SEQ ID NO: 313013 - RNA, 21 nt, Human
aauaaccaaguaaucuggagc

SEQ ID NO: 313014 - RNA, 24 nt, Human
aaucacuugaacuugggagacaga

SEQ ID NO: 313015 - RNA, 24 nt, Human
aauggagugagacuccgucccaaa

SEQ ID NO: 313016 - RNA, 22 nt, Human
aauuaccucccaaaauggaacu

SEQ ID NO: 313017 - RNA, 18 nt, Human
aauuagccaggcauggug

SEQ ID NO: 313018 - RNA, 24 nt, Human
acaggucuacaauucuagcugugc

SEQ ID NO: 313019 - RNA, 19 nt, Human
accaaaaaaaagaaagaaa

SEQ ID NO: 313020 - RNA, 22 nt, Human
accauuguacuccagccugggc

SEQ ID NO: 313021 - RNA, 24 nt, Human
accauuguacuccagccugggcaa

SEQ ID NO: 313022 - RNA, 22 nt, Human
accccacugugcgcgccccagc

SEQ ID NO: 313023 - RNA, 24 nt, Human
accccgucucuacuaaaaauacaa

SEQ ID NO: 313024 - RNA, 21 nt, Human
acuccagccugggcaauggag

SEQ ID NO: 313025 - RNA, 24 nt, Human
acuccagccugggcaauggaguga

SEQ ID NO: 313026 - RNA, 20 nt, Human
acuggccuguccccacccac

SEQ ID NO: 313027 - RNA, 20 nt, Human
acuucuggcugaggcuccag

SEQ ID NO: 313028 - RNA, 19 nt, Human
agaagcgagggagggaggg

SEQ ID NO: 313029 - RNA, 21 nt, Human
agaagcgagggagggagggag

SEQ ID NO: 313030 - RNA, 26 nt, Human
agaagggaaggagggaaggaagggag

SEQ ID NO: 313031 - RNA, 18 nt, Human
agaagggagggaggggaa

SEQ ID NO: 313032 - RNA, 23 nt, Human
agacagaggugcagugagccaag

SEQ ID NO: 313033 - RNA, 24 nt, Human
agaccgggguguguuuuccuccag

SEQ ID NO: 313034 - RNA, 19 nt, Human
agagagaagaagcgaggga

SEQ ID NO: 313035 - RNA, 19 nt, Human
agaggugcagugagccaag

SEQ ID NO: 313036 - RNA, 26 nt, Human
agcaaaacaaauuaaaauuaaaccua

SEQ ID NO: 313037 - RNA, 21 nt, Human
agcaggugggugagccaguuc

SEQ ID NO: 313038 - RNA, 22 nt, Human
agccagccgggacagagcaaca

SEQ ID NO: 313039 - RNA, 25 nt, Human
agcccaacuucccuugcacguaucc

SEQ ID NO: 313040 - RNA, 19 nt, Human
agccgggacagagcaacag

SEQ ID NO: 313041 - RNA, 22 nt, Human
agccuggccaacauggugaaac

SEQ ID NO: 313042 - RNA, 24 nt, Human
agccuggccaacauggugaaaccc

SEQ ID NO: 313043 - RNA, 22 nt, Human
agccugggcaauggagugagac

SEQ ID NO: 313044 - RNA, 24 nt, Human
agccugggcaauggagugagacuc

SEQ ID NO: 313045 - RNA, 23 nt, Human
agccuguucccaucccuccucug

SEQ ID NO: 313046 - RNA, 24 nt, Human
agcgcagcgcgggcagccacagcc

SEQ ID NO: 313047 - RNA, 18 nt, Human
aggaagaagggagggagg

SEQ ID NO: 313048 - RNA, 22 nt, Human
aggaaggaaagaaggaaggaag

SEQ ID NO: 313049 - RNA, 21 nt, Human
aggaaggaaggaaagaaggaa

SEQ ID NO: 313050 - RNA, 21 nt, Human
aggaaggaaggaaggaaggaa

SEQ ID NO: 313051 - RNA, 21 nt, Human
aggaaggaaggaaggaaggaa

SEQ ID NO: 313052 - RNA, 21 nt, Human
aggaaggaaggaaggaaggaa

SEQ ID NO: 313053 - RNA, 21 nt, Human
aggaaggaaggaaggaaggaa

SEQ ID NO: 313054 - RNA, 21 nt, Human
aggaaggaaggaaggaaggaa

SEQ ID NO: 313055 - RNA, 21 nt, Human
aggaaggaaggaaggaaggaa

SEQ ID NO: 313056 - RNA, 21 nt, Human
aggaaggaaggaaggaaggaa

SEQ ID NO: 313057 - RNA, 21 nt, Human
aggaaggaaggaaggaaggaa

SEQ ID NO: 313058 - RNA, 21 nt, Human
aggaaggaaggaaggaaggaa

SEQ ID NO: 313059 - RNA, 21 nt, Human
aggaaggaaggaaggaaggaa

SEQ ID NO: 313060 - RNA, 21 nt, Human
aggaaggaaggaaggaaggaa

SEQ ID NO: 313061 - RNA, 21 nt, Human
aggaaggaaggaaggaaggaa

SEQ ID NO: 313062 - RNA, 21 nt, Human
aggaaggaaggaaggaaggaa

SEQ ID NO: 313063 - RNA, 21 nt, Human
aggaaggaaggaaggaaggaa

SEQ ID NO: 313064 - RNA, 21 nt, Human
aggaaggaaggaaggaaggaa

SEQ ID NO: 313065 - RNA, 24 nt, Human
aggaaggaagggguuggaaaggaa

SEQ ID NO: 313066 - RNA, 24 nt, Human
aggaaggaagggguuggaaaggga

SEQ ID NO: 313067 - RNA, 23 nt, Human
aggaagguuuacaggucuacaau

SEQ ID NO: 313068 - RNA, 20 nt, Human
aggaagugagggagggaggg

SEQ ID NO: 313069 - RNA, 21 nt, Human
aggagggaaggaagggaggga

SEQ ID NO: 313070 - RNA, 21 nt, Human
aggagggaaggaagggaggga

SEQ ID NO: 313071 - RNA, 21 nt, Human
aggaugggggagagggaggaa

SEQ ID NO: 313072 - RNA, 21 nt, Human
aggcaggagaaucacuugaac

SEQ ID NO: 313073 - RNA, 24 nt, Human
aggcaggagaaucacuugaacuug

SEQ ID NO: 313074 - RNA, 24 nt, Human
aggcaugguggcaugcaccuguaa

SEQ ID NO: 313075 - RNA, 24 nt, Human
aggcgcgcggaucacaaggucagg

SEQ ID NO: 313076 - RNA, 24 nt, Human
aggcucaggcaggagaaucacuug

SEQ ID NO: 313077 - RNA, 22 nt, Human
agggaaggaagguuuacagguc

SEQ ID NO: 313078 - RNA, 23 nt, Human
agggaaggaagguuuacaggucu

SEQ ID NO: 313079 - RNA, 19 nt, Human
agggagggaggggaagaau

SEQ ID NO: 313080 - RNA, 22 nt, Human
agggagggaggggaagaaugga

SEQ ID NO: 313081 - RNA, 20 nt, Human
agggguuggaaagggagaag

SEQ ID NO: 313082 - RNA, 23 nt, Human
aggugggugagccaguucccaag

SEQ ID NO: 313083 - RNA, 18 nt, Human
aguaagaaagagagaaga

SEQ ID NO: 313084 - RNA, 22 nt, Human
agugagggagggaggggaagga

SEQ ID NO: 313085 - RNA, 22 nt, Human
agugaugagcccaaaagcuccu

SEQ ID NO: 313086 - RNA, 19 nt, Human
aucacaaggucaggaguuc

SEQ ID NO: 313087 - RNA, 24 nt, Human
aucgcaccauuguacuccagccug

SEQ ID NO: 313088 - RNA, 19 nt, Human
aucuggagccaagucauuc

SEQ ID NO: 313089 - RNA, 26 nt, Human
augguggcuuauggacgcuuuuaaga

SEQ ID NO: 313090 - RNA, 19 nt, Human
auguucuuuucucccugcc

SEQ ID NO: 313091 - RNA, 27 nt, Human
caaaaaaaaccaaaaaaaagaaagaaa

SEQ ID NO: 313092 - RNA, 21 nt, Human
caaaacccacaugguagcacu

SEQ ID NO: 313093 - RNA, 22 nt, Human
caaaacccacaugguagcacua

SEQ ID NO: 313094 - RNA, 24 nt, Human
caacauggugaaaccccgucucua

SEQ ID NO: 313095 - RNA, 19 nt, Human
caacucagucuccuacaaa

SEQ ID NO: 313096 - RNA, 31 nt, Human
cacagaaugguggcuuauggacgcuuuuaaa

SEQ ID NO: 313097 - RNA, 24 nt, Human
cacagcaccagcagagggccuaga

SEQ ID NO: 313098 - RNA, 21 nt, Human
cacagccuguucccaucccuc

SEQ ID NO: 313099 - RNA, 24 nt, Human
cacagccuguucccaucccuccuc

SEQ ID NO: 313100 - RNA, 24 nt, Human
caccauuguacuccagccugggca

SEQ ID NO: 313101 - RNA, 20 nt, Human
caccccucucuccaacuaag

SEQ ID NO: 313102 - RNA, 20 nt, Human
caccccuuacuacucugagc

SEQ ID NO: 313103 - RNA, 23 nt, Human
caccuguaaucccagcuacucgg

SEQ ID NO: 313104 - RNA, 24 nt, Human
caccuguaaucccagcuacucggg

SEQ ID NO: 313105 - RNA, 24 nt, Human
cacgccugugaucccagcacucug

SEQ ID NO: 313106 - RNA, 18 nt, Human
cacugugcgcgccccagc

SEQ ID NO: 313107 - RNA, 21 nt, Human
cagcacucugagaggcugagg

SEQ ID NO: 313108 - RNA, 19 nt, Human
cagcgcagcgcgggcagcc

SEQ ID NO: 313109 - RNA, 22 nt, Human
caggacucaggugggagccacg

SEQ ID NO: 313110 - RNA, 19 nt, Human
caucacauccucccaccuc

SEQ ID NO: 313111 - RNA, 18 nt, Human
cauuguacuccagccugg

SEQ ID NO: 313112 - RNA, 19 nt, Human
cauuguacuccagccuggg

SEQ ID NO: 313113 - RNA, 21 nt, Human
cauuguacuccagccugggca

SEQ ID NO: 313114 - RNA, 24 nt, Human
cauuguacuccagccugggcaaug

SEQ ID NO: 313115 - RNA, 25 nt, Human
cauuguacuccagccugggcaaugg

SEQ ID NO: 313116 - RNA, 21 nt, Human
ccacccacuucccaccccuua

SEQ ID NO: 313117 - RNA, 20 nt, Human
ccagccagccgggacagagc

SEQ ID NO: 313118 - RNA, 21 nt, Human
ccagcggccccggcccagagc

SEQ ID NO: 313119 - RNA, 20 nt, Human
ccauuguacuccagccuggg

SEQ ID NO: 313120 - RNA, 21 nt, Human
ccauuguacuccagccugggc

SEQ ID NO: 313121 - RNA, 22 nt, Human
ccauuguacuccagccugggca

SEQ ID NO: 313122 - RNA, 23 nt, Human
ccauuguacuccagccugggcaa

SEQ ID NO: 313123 - RNA, 24 nt, Human
ccauuguacuccagccugggcaau

SEQ ID NO: 313124 - RNA, 25 nt, Human
ccauuguacuccagccugggcaaug

SEQ ID NO: 313125 - RNA, 22 nt, Human
cccacaugguaaaaggcugggu

SEQ ID NO: 313126 - RNA, 20 nt, Human
cccacaugguagcacuaagc

SEQ ID NO: 313127 - RNA, 26 nt, Human
cccaccccuuacuacucugagcccca

SEQ ID NO: 313128 - RNA, 23 nt, Human
cccagaaaagucauuucccagaa

SEQ ID NO: 313129 - RNA, 21 nt, Human
cccaugcaggcuuccaggcca

SEQ ID NO: 313130 - RNA, 18 nt, Human
ccccacacucggagccag

SEQ ID NO: 313131 - RNA, 21 nt, Human
ccccgugucaagcccucccca

SEQ ID NO: 313132 - RNA, 24 nt, Human
ccccgugucaagcccuccccaggc

SEQ ID NO: 313133 - RNA, 19 nt, Human
cccgcggggaccugcugug

SEQ ID NO: 313134 - RNA, 24 nt, Human
cccggcccagagcgccccacacuc

SEQ ID NO: 313135 - RNA, 22 nt, Human
cccgugucaagcccuccccagg

SEQ ID NO: 313136 - RNA, 20 nt, Human
cccugccacccacuucccac

SEQ ID NO: 313137 - RNA, 23 nt, Human
ccgaccaaacacacccuucaccc

SEQ ID NO: 313138 - RNA, 19 nt, Human
ccgccggccaccacauaca

SEQ ID NO: 313139 - RNA, 18 nt, Human
ccgggacagagcaacagc

SEQ ID NO: 313140 - RNA, 21 nt, Human
ccuccaguggagccaccgcuu

SEQ ID NO: 313141 - RNA, 26 nt, Human
ccucccacaccccucucuccaacuaa

SEQ ID NO: 313142 - RNA, 19 nt, Human
ccucuggaaaacguugauc

SEQ ID NO: 313143 - RNA, 21 nt, Human
ccugccacccacuucccaccc

SEQ ID NO: 313144 - RNA, 23 nt, Human
ccuggccaacauggugaaacccc

SEQ ID NO: 313145 - RNA, 24 nt, Human
ccuggccaacauggugaaaccccg

SEQ ID NO: 313146 - RNA, 22 nt, Human
ccugggcaauggagugagacuc

SEQ ID NO: 313147 - RNA, 21 nt, Human
ccuguaaucccagcuacucgg

SEQ ID NO: 313148 - RNA, 21 nt, Human
ccugugaucccagcacucuga

SEQ ID NO: 313149 - RNA, 18 nt, Human
ccuuuucucuuugaagcc

SEQ ID NO: 313150 - RNA, 24 nt, Human
cgagaccagccuggccaacauggu

SEQ ID NO: 313151 - RNA, 22 nt, Human
cgagggagggagggagguaaag

SEQ ID NO: 313152 - RNA, 21 nt, Human
cgcaccauuguacuccagccu

SEQ ID NO: 313153 - RNA, 22 nt, Human
cggaucacaaggucaggaguuc

SEQ ID NO: 313154 - RNA, 24 nt, Human
cgggaggcucaggcaggagaauca

SEQ ID NO: 313155 - RNA, 21 nt, Human
cgggcagccacagccugcacc

SEQ ID NO: 313156 - RNA, 18 nt, Human
cggggcuggucuucccgc

SEQ ID NO: 313157 - RNA, 25 nt, Human
cguucacuaucaagagcuaagcaca

SEQ ID NO: 313158 - RNA, 21 nt, Human
cuagaggugagagagaaaugg

SEQ ID NO: 313159 - RNA, 23 nt, Human
cucacgccugugaucccagcacu

SEQ ID NO: 313160 - RNA, 24 nt, Human
cucacgccugugaucccagcacuc

SEQ ID NO: 313161 - RNA, 20 nt, Human
cuccaacuaagaugcacagc

SEQ ID NO: 313162 - RNA, 25 nt, Human
cucccugccacccacuucccacccc

SEQ ID NO: 313163 - RNA, 21 nt, Human
cuccucugucccucucuucgu

SEQ ID NO: 313164 - RNA, 20 nt, Human
cugaggcuguuuccugggcu

SEQ ID NO: 313165 - RNA, 21 nt, Human
cuguaaucccagcuacucggg

SEQ ID NO: 313166 - RNA, 21 nt, Human
gaacugacagcucaaggacuc

SEQ ID NO: 313167 - RNA, 20 nt, Human
gaacuugggagacagaggug

SEQ ID NO: 313168 - RNA, 19 nt, Human
gaaggaugggggagaggga

SEQ ID NO: 313169 - RNA, 24 nt, Human
gaagggaaggagggaaggaaggga

SEQ ID NO: 313170 - RNA, 18 nt, Human
gaagggagggaggaaaag

SEQ ID NO: 313171 - RNA, 18 nt, Human
gaagggagggaggaaaag

SEQ ID NO: 313172 - RNA, 29 nt, Human
gaagggagggaggaaaaggaaggaagggg

SEQ ID NO: 313173 - RNA, 18 nt, Human
gaagugagggagggaggg

SEQ ID NO: 313174 - RNA, 23 nt, Human
gagaaucacuugaacuugggaga

SEQ ID NO: 313175 - RNA, 18 nt, Human
gagagaagaagcgaggga

SEQ ID NO: 313176 - RNA, 22 nt, Human
gagcaacagcgcagcgcgggca

SEQ ID NO: 313177 - RNA, 24 nt, Human
gagcaacagcgcagcgcgggcagc

SEQ ID NO: 313178 - RNA, 18 nt, Human
gagggaaggaagggaggg

SEQ ID NO: 313179 - RNA, 18 nt, Human
gagggaaggaagggaggg

SEQ ID NO: 313180 - RNA, 23 nt, Human
gagggaggaaaaggaaggaaggg

SEQ ID NO: 313181 - RNA, 23 nt, Human
gagggaggaaaaggaaggaaggg

SEQ ID NO: 313182 - RNA, 24 nt, Human
gaggugcugucggggcuggucuuc

SEQ ID NO: 313183 - RNA, 21 nt, Human
gagugagacuccgucccaaaa

SEQ ID NO: 313184 - RNA, 22 nt, Human
gaucacaaggucaggaguucga

SEQ ID NO: 313185 - RNA, 24 nt, Human
gaucacaaggucaggaguucgaga

SEQ ID NO: 313186 - RNA, 20 nt, Human
gcaccauuguacuccagccu

SEQ ID NO: 313187 - RNA, 24 nt, Human
gcagcgcgggcagccacagccugc

SEQ ID NO: 313188 - RNA, 23 nt, Human
gcaggagaaucacuugaacuugg

SEQ ID NO: 313189 - RNA, 24 nt, Human
gccaacauggugaaaccccgucuc

SEQ ID NO: 313190 - RNA, 18 nt, Human
gccaccacauacaucuua

SEQ ID NO: 313191 - RNA, 22 nt, Human
gccaccacauacaucuuaaaau

SEQ ID NO: 313192 - RNA, 20 nt, Human
gcccaacuucccuugcacgu

SEQ ID NO: 313193 - RNA, 18 nt, Human
gcccagagcgccccacac

SEQ ID NO: 313194 - RNA, 18 nt, Human
gcgagggagggagggagg

SEQ ID NO: 313195 - RNA, 24 nt, Human
gcgcggaucacaaggucaggaguu

SEQ ID NO: 313196 - RNA, 21 nt, Human
gcucaaggacucuggcaucag

SEQ ID NO: 313197 - RNA, 19 nt, Human
gcugggugcgguggcucac

SEQ ID NO: 313198 - RNA, 20 nt, Human
ggaaagggagaagggaagga

SEQ ID NO: 313199 - RNA, 28 nt, Human
ggaaagggagaagggaaggagggaagga

SEQ ID NO: 313200 - RNA, 22 nt, Human
ggaagggagggaggaaaaggaa

SEQ ID NO: 313201 - RNA, 22 nt, Human
ggaagggagggaggaaaaggaa

SEQ ID NO: 313202 - RNA, 20 nt, Human
ggaccugcugugugugggug

SEQ ID NO: 313203 - RNA, 22 nt, Human
ggagagggaggaagugagggag

SEQ ID NO: 313204 - RNA, 25 nt, Human
ggagagggaggaagugagggaggga

SEQ ID NO: 313205 - RNA, 18 nt, Human
ggaggaagugagggaggg

SEQ ID NO: 313206 - RNA, 18 nt, Human
ggagggaaggaagggagg

SEQ ID NO: 313207 - RNA, 24 nt, Human
ggagggaggaaaaggaaggaaggg

SEQ ID NO: 313208 - RNA, 25 nt, Human
ggaggggaaggaagaagggaaggaa

SEQ ID NO: 313209 - RNA, 18 nt, Human
ggcaggacucagcccgcc

SEQ ID NO: 313210 - RNA, 20 nt, Human
ggccccgcggggaccugcug

SEQ ID NO: 313211 - RNA, 29 nt, Human
gggaagaauggaaggaugggggagagggg

SEQ ID NO: 313212 - RNA, 24 nt, Human
gggaaggaagaagggaaggaaggg

SEQ ID NO: 313213 - RNA, 20 nt, Human
gggagagggaggaagugagg

SEQ ID NO: 313214 - RNA, 23 nt, Human
gggagggaggggaaggaagaagg

SEQ ID NO: 313215 - RNA, 18 nt, Human
gggccuagaggugagaga

SEQ ID NO: 313216 - RNA, 22 nt, Human
ggggagagggaggaagugaggg

SEQ ID NO: 313217 - RNA, 24 nt, Human
gggugcgguggcucacgccuguga

SEQ ID NO: 313218 - RNA, 24 nt, Human
gguggcaugcaccuguaaucccag

SEQ ID NO: 313219 - RNA, 23 nt, Human
gguggcucacgccugugauccca

SEQ ID NO: 313220 - RNA, 24 nt, Human
gguggcucacgccugugaucccag

SEQ ID NO: 313221 - RNA, 22 nt, Human
ggugguguggggcaagcugugg

SEQ ID NO: 313222 - RNA, 21 nt, Human
ggugugaaggugguguggggc

SEQ ID NO: 313223 - RNA, 23 nt, Human
guacuccagccugggcaauggag

SEQ ID NO: 313224 - RNA, 21 nt, Human
gucaagcccuccccaggccag

SEQ ID NO: 313225 - RNA, 22 nt, Human
gugcagugagccaagaucgcac

SEQ ID NO: 313226 - RNA, 22 nt, Human
gugguguggggcaagcuguggg

SEQ ID NO: 313227 - RNA, 23 nt, Human
guugccuuuucucuuugaagccg

SEQ ID NO: 313228 - RNA, 23 nt, Human
guuuuccuccaguggagccaccg

SEQ ID NO: 313229 - RNA, 21 nt, Human
uaaaaauacaaaaauuagcca

SEQ ID NO: 313230 - RNA, 22 nt, Human
uacuccagccugggcaauggag

SEQ ID NO: 313231 - RNA, 24 nt, Human
uacuccagccugggcaauggagug

SEQ ID NO: 313232 - RNA, 24 nt, Human
uacuucuggcugaggcuccagagg

SEQ ID NO: 313233 - RNA, 22 nt, Human
uagaggugagagagaaauggcc

SEQ ID NO: 313234 - RNA, 18 nt, Human
ucacaaggucaggaguuc

SEQ ID NO: 313235 - RNA, 24 nt, Human
ucacaaggucaggaguucgagacc

SEQ ID NO: 313236 - RNA, 22 nt, Human
ucacgccugugaucccagcacu

SEQ ID NO: 313237 - RNA, 23 nt, Human
ucacuggccuguccccacccacc

SEQ ID NO: 313238 - RNA, 18 nt, Human
ucacuugaacuugggaga

SEQ ID NO: 313239 - RNA, 25 nt, Human
ucacuugaacuugggagacagaggu

SEQ ID NO: 313240 - RNA, 23 nt, Human
ucagcccgccaugggcgccugcc

SEQ ID NO: 313241 - RNA, 20 nt, Human
ucaggcaggagaaucacuug

SEQ ID NO: 313242 - RNA, 23 nt, Human
ucaggcaggagaaucacuugaac

SEQ ID NO: 313243 - RNA, 22 nt, Human
ucagggaacaggacucaggugg

SEQ ID NO: 313244 - RNA, 20 nt, Human
uccaagaaaugaaaugugac

SEQ ID NO: 313245 - RNA, 23 nt, Human
uccagccugggcaauggagugag

SEQ ID NO: 313246 - RNA, 24 nt, Human
uccagccugggcaauggagugaga

SEQ ID NO: 313247 - RNA, 18 nt, Human
ucccacaccccucucucc

SEQ ID NO: 313248 - RNA, 19 nt, Human
ucccacaccccucucucca

SEQ ID NO: 313249 - RNA, 20 nt, Human
ucccacaccccucucuccaa

SEQ ID NO: 313250 - RNA, 18 nt, Human
ucccaccccuuacuacuc

SEQ ID NO: 313251 - RNA, 20 nt, Human
ucccagaaaagucauuuccc

SEQ ID NO: 313252 - RNA, 18 nt, Human
uccccaggagggagggug

SEQ ID NO: 313253 - RNA, 22 nt, Human
ucccuauaauuaccucccaaaa

SEQ ID NO: 313254 - RNA, 20 nt, Human
uccucagccuuccuccuccc

SEQ ID NO: 313255 - RNA, 23 nt, Human
uccucccacaccccucucuccaa

SEQ ID NO: 313256 - RNA, 23 nt, Human
ucgcaccauuguacuccagccug

SEQ ID NO: 313257 - RNA, 21 nt, Human
ucucuacuaaaaauacaaaaa

SEQ ID NO: 313258 - RNA, 25 nt, Human
ucugcagccaggccgccugucaccc

SEQ ID NO: 313259 - RNA, 19 nt, Human
ucuggcugaggcuccagag

SEQ ID NO: 313260 - RNA, 21 nt, Human
ucuuuucucccugccacccac

SEQ ID NO: 313261 - RNA, 20 nt, Human
ugacagaaaugaaagcccau

SEQ ID NO: 313262 - RNA, 21 nt, Human
ugacagcucaaggacucuggc

SEQ ID NO: 313263 - RNA, 22 nt, Human
ugacuacuccaaacaagcauga

SEQ ID NO: 313264 - RNA, 24 nt, Human
ugagaggcugaggcgcgcggauca

SEQ ID NO: 313265 - RNA, 24 nt, Human
ugaggcgcgcggaucacaagguca

SEQ ID NO: 313266 - RNA, 18 nt, Human
ugagggagggaggggaag

SEQ ID NO: 313267 - RNA, 19 nt, Human
ugcaccuguaaucccagcu

SEQ ID NO: 313268 - RNA, 22 nt, Human
ugcagccaggccgccugucacc

SEQ ID NO: 313269 - RNA, 27 nt, Human
ugccuggacuguaaaucuggccgaggc

SEQ ID NO: 313270 - RNA, 26 nt, Human
uggaaaggaagaagggagggagggga

SEQ ID NO: 313271 - RNA, 21 nt, Human
uggaaagggagaagggaagga

SEQ ID NO: 313272 - RNA, 23 nt, Human
uggaccacagacuuggcaacauu

SEQ ID NO: 313273 - RNA, 19 nt, Human
uggagccaagucauuccuc

SEQ ID NO: 313274 - RNA, 23 nt, Human
uggagccaccgcuugagcugagg

SEQ ID NO: 313275 - RNA, 19 nt, Human
uggagggggccuugguucc

SEQ ID NO: 313276 - RNA, 22 nt, Human
uggcaugcaccuguaaucccag

SEQ ID NO: 313277 - RNA, 24 nt, Human
uggccaacauggugaaaccccguc

SEQ ID NO: 313278 - RNA, 22 nt, Human
uggcucacgccugugaucccag

SEQ ID NO: 313279 - RNA, 24 nt, Human
uggcucacgccugugaucccagca

SEQ ID NO: 313280 - RNA, 18 nt, Human
uggcuuauggacgcuuuu

SEQ ID NO: 313281 - RNA, 24 nt, Human
ugguggcaugcaccuguaauccca

SEQ ID NO: 313282 - RNA, 24 nt, Human
ugguguggggcaagcugugggaac

SEQ ID NO: 313283 - RNA, 19 nt, Human
uguacuccagccugggcaa

SEQ ID NO: 313284 - RNA, 24 nt, Human
uguacuccagccugggcaauggag

SEQ ID NO: 313285 - RNA, 24 nt, Human
ugugugugggugugaagguggugu

SEQ ID NO: 313286 - RNA, 23 nt, Human
uuccucagccuuccuccucccug

SEQ ID NO: 313287 - RNA, 19 nt, Human
uuccugggcuuuuuaaagg

SEQ ID NO: 313288 - RNA, 25 nt, Human
uugaagccgacaguuuggcuucuuu

SEQ ID NO: 313289 - RNA, 23 nt, Human
uugagcugaggcuguuuccuggg

SEQ ID NO: 313290 - RNA, 20 nt, Human
uugcacggcgcccaugcagg

SEQ ID NO: 313291 - RNA, 18 nt, Human
uuucagggaacaggacuc

SEQ ID NO: 313292 - RNA, 21 nt, Human
uuugaagccgacaguuuggcu

SEQ ID NO: 313293 - RNA, 21 nt, Human
agaggaugaggaggagaggcc

SEQ ID NO: 313294 - RNA, 22 nt, Human
aggaggaugaggaugaagagga

SEQ ID NO: 313295 - RNA, 18 nt, Human
aggcagggaccagaggaa

SEQ ID NO: 313296 - RNA, 21 nt, Human
aucugccccaggcccaacuca

SEQ ID NO: 313297 - RNA, 22 nt, Human
caagggaccaaggcagggacca

SEQ ID NO: 313298 - RNA, 22 nt, Human
caccacuggccuccugccccuc

SEQ ID NO: 313299 - RNA, 20 nt, Human
ccaaggcagggaccagagga

SEQ ID NO: 313300 - RNA, 20 nt, Human
ccacagccgcagccgcugcu

SEQ ID NO: 313301 - RNA, 21 nt, Human
ccacuggccuccugccccucu

SEQ ID NO: 313302 - RNA, 22 nt, Human
ccacuggccuccugccccucuu

SEQ ID NO: 313303 - RNA, 24 nt, Human
ccaggcccacaccaggcggggugc

SEQ ID NO: 313304 - RNA, 24 nt, Human
ccccaccacuggccuccugccccu

SEQ ID NO: 313305 - RNA, 25 nt, Human
ccccccuggaccuccaggggucugu

SEQ ID NO: 313306 - RNA, 18 nt, Human
ccccucuucccaggcaag

SEQ ID NO: 313307 - RNA, 21 nt, Human
ccggggcugcaccggcugccc

SEQ ID NO: 313308 - RNA, 24 nt, Human
ccuccugccccucuucccaggcaa

SEQ ID NO: 313309 - RNA, 21 nt, Human
ccucgggccccccuggaccuc

SEQ ID NO: 313310 - RNA, 28 nt, Human
ccugccccucuucccaggcaagggacca

SEQ ID NO: 313311 - RNA, 19 nt, Human
ccugccucgggccccccug

SEQ ID NO: 313312 - RNA, 22 nt, Human
ccugccucgggccccccuggac

SEQ ID NO: 313313 - RNA, 19 nt, Human
cugccccaggcccaacuca

SEQ ID NO: 313314 - RNA, 21 nt, Human
cugccucgggccccccuggac

SEQ ID NO: 313315 - RNA, 27 nt, Human
cuuuccuuuuuuuuuuuuuuuuuuggu

SEQ ID NO: 313316 - RNA, 21 nt, Human
cuuuuuuuuuuuuuuuuuugg

SEQ ID NO: 313317 - RNA, 20 nt, Human
gaugaagaggaugaggagga

SEQ ID NO: 313318 - RNA, 21 nt, Human
gcccccagcaccagauucccg

SEQ ID NO: 313319 - RNA, 23 nt, Human
gccuccugccccucuucccaggc

SEQ ID NO: 313320 - RNA, 19 nt, Human
gcugcugagaccaggccca

SEQ ID NO: 313321 - RNA, 24 nt, Human
ggaaugggaggggaggcauggcug

SEQ ID NO: 313322 - RNA, 23 nt, Human
ggaccaaggcagggaccagagga

SEQ ID NO: 313323 - RNA, 18 nt, Human
ggaggcauggcuggcccu

SEQ ID NO: 313324 - RNA, 25 nt, Human
guagagguuuuuuuuuuuuuuuggu

SEQ ID NO: 313325 - RNA, 23 nt, Human
uagagguuuuuuuuuuuuuuugg

SEQ ID NO: 313326 - RNA, 27 nt, Human
uaguuucuuuccuuuuuuuuuuuuuuu

SEQ ID NO: 313327 - RNA, 18 nt, Human
ucagguuuggacccugcc

SEQ ID NO: 313328 - RNA, 18 nt, Human
uccccggggcugcaccgg

SEQ ID NO: 313329 - RNA, 24 nt, Human
ucccuugucacuccugcucugagg

SEQ ID NO: 313330 - RNA, 18 nt, Human
uccuuuuuuuuuuuuuuu

SEQ ID NO: 313331 - RNA, 18 nt, Human
uccuuuuuuuuuuuuuuu

SEQ ID NO: 313332 - RNA, 22 nt, Human
ucuguugugauuauuuuugguu

SEQ ID NO: 313333 - RNA, 18 nt, Human
ugaagaggaugaggagga

SEQ ID NO: 313334 - RNA, 20 nt, Human
ugauucaagaagagcggcga

SEQ ID NO: 313335 - RNA, 22 nt, Human
ugcaccggcugcccccagcacc

SEQ ID NO: 313336 - RNA, 18 nt, Human
ugccgucucgcugcaagu

SEQ ID NO: 313337 - RNA, 21 nt, Human
ugccucgggccccccuggacc

SEQ ID NO: 313338 - RNA, 19 nt, Human
ugcuggagauggaggcugc

SEQ ID NO: 313339 - RNA, 21 nt, Human
ugcuggagauggaggcugcca

SEQ ID NO: 313340 - RNA, 25 nt, Human
uggaggaggaggaggaugaggauga

SEQ ID NO: 313341 - RNA, 22 nt, Human
uggcuggcccucacucagguuu

SEQ ID NO: 313342 - RNA, 19 nt, Human
ugggaggggaggcauggcu

SEQ ID NO: 313343 - RNA, 20 nt, Human
ugggaggggaggcauggcug

SEQ ID NO: 313344 - RNA, 21 nt, Human
ugggaggggaggcauggcugg

SEQ ID NO: 313345 - RNA, 23 nt, Human
ugguuuguuuuugguuuuuuuug

SEQ ID NO: 313346 - RNA, 25 nt, Human
uuaguuucuuuccuuuuuuuuuuuu

SEQ ID NO: 313347 - RNA, 24 nt, Human
uugguuguuuuuuuggucuuuccu

SEQ ID NO: 313348 - RNA, 26 nt, Human
uuguuuguuuuucaccucugguuccu

SEQ ID NO: 313349 - RNA, 18 nt, Human
uuuuucaccucugguucc

SEQ ID NO: 313350 - RNA, 19 nt, Human
uuuuuugguugguuguuuu

SEQ ID NO: 313351 - RNA, 21 nt, Human
uuuuuuuuugguugguuguuu

SEQ ID NO: 313352 - RNA, 26 nt, Human
uuuuuuuuuuuuuuugguuuguuuuu

SEQ ID NO: 313353 - RNA, 18 nt, Human
uuuuuuuuuuuuuuuuug

SEQ ID NO: 313354 - RNA, 21 nt, Human
uuuuuuuuuuuuuuuuugguu

SEQ ID NO: 313355 - RNA, 23 nt, Human
uuuuuuuuuuuuuuuuugguugg

SEQ ID NO: 313356 - RNA, 20 nt, Human
aaaaaaccaagcccggagaa

SEQ ID NO: 313357 - RNA, 25 nt, Human
aaaaaccaagcccggagaaagggga

SEQ ID NO: 313358 - RNA, 24 nt, Human
aaaauccaaagcaaccgaacaaaa

SEQ ID NO: 313359 - RNA, 23 nt, Human
aaaccaagcccggagaaagggga

SEQ ID NO: 313360 - RNA, 24 nt, Human
agaaaggggaaagcgggguggggc

SEQ ID NO: 313361 - RNA, 19 nt, Human
agcgcgccggcgggggccc

SEQ ID NO: 313362 - RNA, 21 nt, Human
aggcggcgggcaggaugcccg

SEQ ID NO: 313363 - RNA, 24 nt, Human
aggcggcgggcaggaugcccgggg

SEQ ID NO: 313364 - RNA, 24 nt, Human
auaaaaaccguaaaaaaccaagcc

SEQ ID NO: 313365 - RNA, 19 nt, Human
cagcgcgccggcgggggcc

SEQ ID NO: 313366 - RNA, 20 nt, Human
caggagccgagaggcuccac

SEQ ID NO: 313367 - RNA, 20 nt, Human
ccacccuggacccgcaggcu

SEQ ID NO: 313368 - RNA, 25 nt, Human
ccccgcacugcguuaccugucgcuu

SEQ ID NO: 313369 - RNA, 22 nt, Human
cccgcacugcguuaccugucgg

SEQ ID NO: 313370 - RNA, 21 nt, Human
cccgcaggcucaggaguccac

SEQ ID NO: 313371 - RNA, 18 nt, Human
cccuggacccgcaggcuc

SEQ ID NO: 313372 - RNA, 23 nt, Human
ccgcgcccugcagcgcgccggcg

SEQ ID NO: 313373 - RNA, 19 nt, Human
ccggaucuucgcuccucuc

SEQ ID NO: 313374 - RNA, 22 nt, Human
ccggccccgaacagcccggggg

SEQ ID NO: 313375 - RNA, 21 nt, Human
ccuccggggccccgauaaaua

SEQ ID NO: 313376 - RNA, 22 nt, Human
cgaguuccggaucuucgcuccu

SEQ ID NO: 313377 - RNA, 25 nt, Human
cgcccugcagcgcgccggcgggggc

SEQ ID NO: 313378 - RNA, 25 nt, Human
cgcgaccuccccuccggggccccga

SEQ ID NO: 313379 - RNA, 19 nt, Human
cgcgccggcgggggcccgg

SEQ ID NO: 313380 - RNA, 23 nt, Human
cgcugccgggauccggccccgaa

SEQ ID NO: 313381 - RNA, 18 nt, Human
cggccccgaacagcccgg

SEQ ID NO: 313382 - RNA, 24 nt, Human
cguaaaaaaccaagcccggagaaa

SEQ ID NO: 313383 - RNA, 25 nt, Human
cguccucucucccggggaaucccua

SEQ ID NO: 313384 - RNA, 24 nt, Human
cucgcuucguccucucucccgggg

SEQ ID NO: 313385 - RNA, 20 nt, Human
gaccuccccuccggggcccc

SEQ ID NO: 313386 - RNA, 22 nt, Human
gagaaaggggaaagcggggugg

SEQ ID NO: 313387 - RNA, 21 nt, Human
gagaacucuccucgcuucguc

SEQ ID NO: 313388 - RNA, 22 nt, Human
gcagcgcgccggcgggggcccg

SEQ ID NO: 313389 - RNA, 21 nt, Human
gcccgggggggcaggggcggg

SEQ ID NO: 313390 - RNA, 24 nt, Human
gcccgggggggcaggggcgggggu

SEQ ID NO: 313391 - RNA, 21 nt, Human
gcuucguccucucucccgggg

SEQ ID NO: 313392 - RNA, 21 nt, Human
ggagagaagaggcguguagcg

SEQ ID NO: 313393 - RNA, 21 nt, Human
ggaggccgcugccgggauccg

SEQ ID NO: 313394 - RNA, 19 nt, Human
ggcagagagcaggcggcgg

SEQ ID NO: 313395 - RNA, 24 nt, Human
ggcaggggcgggggucgucgaggg

SEQ ID NO: 313396 - RNA, 29 nt, Human
ggcaggggcgggggucgucgaggggaugg

SEQ ID NO: 313397 - RNA, 21 nt, Human
ggcuuuuuuuuuuuuuuguaa

SEQ ID NO: 313398 - RNA, 21 nt, Human
gggcgacgcagccuaccgggc

SEQ ID NO: 313399 - RNA, 22 nt, Human
gggcggaguuagaaggacccca

SEQ ID NO: 313400 - RNA, 18 nt, Human
ggggaugggggcagagag

SEQ ID NO: 313401 - RNA, 24 nt, Human
gggggggcaggggcgggggucguc

SEQ ID NO: 313402 - RNA, 24 nt, Human
gggucgucgaggggaugggggcag

SEQ ID NO: 313403 - RNA, 21 nt, Human
guaaaaaaccaagcccggagg

SEQ ID NO: 313404 - RNA, 19 nt, Human
uaaaauccaaagcaaccga

SEQ ID NO: 313405 - RNA, 20 nt, Human
uaaagugacagccccccacc

SEQ ID NO: 313406 - RNA, 21 nt, Human
uaaagugacagccccccaccc

SEQ ID NO: 313407 - RNA, 22 nt, Human
uaaauaaaaaccguaaaaaacc

SEQ ID NO: 313408 - RNA, 19 nt, Human
uaccugucgcuuuggggag

SEQ ID NO: 313409 - RNA, 22 nt, Human
uccacgaauaaauaaaaaccgu

SEQ ID NO: 313410 - RNA, 24 nt, Human
ucccuaaccccgcacugcguuacc

SEQ ID NO: 313411 - RNA, 22 nt, Human
uccugcuuuuauacacagacgc

SEQ ID NO: 313412 - RNA, 22 nt, Human
ucgcuucguccucucucccggg

SEQ ID NO: 313413 - RNA, 20 nt, Human
ugcuuuuuuuuggggggagg

SEQ ID NO: 313414 - RNA, 20 nt, Human
uggggcgcauccuuauagga

SEQ ID NO: 313415 - RNA, 19 nt, Human
uggggggaggguaggguag

SEQ ID NO: 313416 - RNA, 26 nt, Human
uguaaaauccaaagcaaccgaacaaa

SEQ ID NO: 313417 - RNA, 22 nt, Human
uguuugguuuuguucgaaaguu

SEQ ID NO: 313418 - RNA, 24 nt, Human
uuaaagcuuuggcuauuuccugcu

SEQ ID NO: 313419 - RNA, 20 nt, Human
uuccggaucuucgcuccucu

SEQ ID NO: 313420 - RNA, 19 nt, Human
uugcuuuuuuuugggggga

SEQ ID NO: 313421 - RNA, 22 nt, Human
uuuggggggaggguaggguagg

SEQ ID NO: 313422 - RNA, 22 nt, Human
uuuuggggggaggguaggguag

SEQ ID NO: 313423 - RNA, 22 nt, Human
aaacacagcagcaugugccaac

SEQ ID NO: 313424 - RNA, 23 nt, Human
aacaagagggccgggaaagggcc

SEQ ID NO: 313425 - RNA, 23 nt, Human
aacaaucagaaguuagagaggga

SEQ ID NO: 313426 - RNA, 20 nt, Human
aagcaucaggaagcugcauu

SEQ ID NO: 313427 - RNA, 19 nt, Human
acaccugcuaccuuuaaag

SEQ ID NO: 313428 - RNA, 18 nt, Human
acuccacuccauugccug

SEQ ID NO: 313429 - RNA, 19 nt, Human
acuccacuccauugccugg

SEQ ID NO: 313430 - RNA, 25 nt, Human
cacucuccucacucucuccaggaga

SEQ ID NO: 313431 - RNA, 23 nt, Human
cagcaugugccaacucuaagcau

SEQ ID NO: 313432 - RNA, 20 nt, Human
caggagacacuccacuccau

SEQ ID NO: 313433 - RNA, 21 nt, Human
ccagugucuuaguugcuuucc

SEQ ID NO: 313434 - RNA, 19 nt, Human
ccggacugagcgcuccggu

SEQ ID NO: 313435 - RNA, 19 nt, Human
ccgggaaagggccaaggac

SEQ ID NO: 313436 - RNA, 28 nt, Human
ccucgcucgcucuuucugucuccucucu

SEQ ID NO: 313437 - RNA, 19 nt, Human
cgccugcaaaggucaaaac

SEQ ID NO: 313438 - RNA, 20 nt, Human
cgcucugccccucccccagc

SEQ ID NO: 313439 - RNA, 23 nt, Human
cuagcuaucacacacucuccuca

SEQ ID NO: 313440 - RNA, 21 nt, Human
cuccaggagacacuccacucc

SEQ ID NO: 313441 - RNA, 18 nt, Human
cucgcucgcucuuucugu

SEQ ID NO: 313442 - RNA, 19 nt, Human
gacgcccgcuccgacgccu

SEQ ID NO: 313443 - RNA, 19 nt, Human
gagccggacugagcgcucc

SEQ ID NO: 313444 - RNA, 19 nt, Human
gccccgcgcucugccccuc

SEQ ID NO: 313445 - RNA, 22 nt, Human
gccucgggcucccucuccucgc

SEQ ID NO: 313446 - RNA, 18 nt, Human
ggagccccgcgcucugcc

SEQ ID NO: 313447 - RNA, 19 nt, Human
ggagggggagccccgcgcu

SEQ ID NO: 313448 - RNA, 19 nt, Human
ggggagccccgcgcucugc

SEQ ID NO: 313449 - RNA, 21 nt, Human
gguuugguggauuuuuuuucc

SEQ ID NO: 313450 - RNA, 21 nt, Human
uaaaggagccgcgcauuugac

SEQ ID NO: 313451 - RNA, 19 nt, Human
uaaauaaacacagcagcag

SEQ ID NO: 313452 - RNA, 19 nt, Human
uaaauaaacacagcagcau

SEQ ID NO: 313453 - RNA, 23 nt, Human
uacucgccugcaaaggucaaaac

SEQ ID NO: 313454 - RNA, 22 nt, Human
ucacacacucuccucacucucu

SEQ ID NO: 313455 - RNA, 26 nt, Human
uccacaauaaauaaacacagcagcau

SEQ ID NO: 313456 - RNA, 25 nt, Human
uccacuccauugccugguuacucgc

SEQ ID NO: 313457 - RNA, 21 nt, Human
ucgcucgcucuuucugucucc

SEQ ID NO: 313458 - RNA, 19 nt, Human
ucugucuccucucucuccc

SEQ ID NO: 313459 - RNA, 18 nt, Human
ucugucucucucucuuuc

SEQ ID NO: 313460 - RNA, 20 nt, Human
ugguggauuuuuuuuccuuu

SEQ ID NO: 313461 - RNA, 22 nt, Human
uuaaaggagccgcgcauuugac

SEQ ID NO: 313462 - RNA, 19 nt, Human
uuaguuuugccagguauuu

SEQ ID NO: 313463 - RNA, 21 nt, Human
uucugucuccucucucuccca

SEQ ID NO: 313464 - RNA, 24 nt, Human
uuucugucuccucucucucccaca

SEQ ID NO: 313465 - RNA, 20 nt, Human
aaaagaaaagaaagggaaag

SEQ ID NO: 313466 - RNA, 19 nt, Human
aaaaggaaaggaaagcaaa

SEQ ID NO: 313467 - RNA, 21 nt, Human
aaaaugaaaggaaaggaaagg

SEQ ID NO: 313468 - RNA, 23 nt, Human
aaagaaaaaggggaaagggaaag

SEQ ID NO: 313469 - RNA, 21 nt, Human
aaagaagggaaagaaaaaggg

SEQ ID NO: 313470 - RNA, 27 nt, Human
aaaggaaagcaaaagaaaagaaaggga

SEQ ID NO: 313471 - RNA, 23 nt, Human
aaaggaaaggaaagcaaaagaaa

SEQ ID NO: 313472 - RNA, 18 nt, Human
aacgagagagagagaaaa

SEQ ID NO: 313473 - RNA, 20 nt, Human
aagaagggaaagaaaaagga

SEQ ID NO: 313474 - RNA, 22 nt, Human
aaggaaagaaaagggaaaaaaa

SEQ ID NO: 313475 - RNA, 18 nt, Human
aagggaagggaagggaag

SEQ ID NO: 313476 - RNA, 24 nt, Human
aaggggaaagggaaagaaaaagga

SEQ ID NO: 313477 - RNA, 21 nt, Human
aaugaaaggaaaggaaaggga

SEQ ID NO: 313478 - RNA, 22 nt, Human
agaaaagaaagggaaaggaaag

SEQ ID NO: 313479 - RNA, 19 nt, Human
agaaagggaaaggaaagga

SEQ ID NO: 313480 - RNA, 21 nt, Human
agcgaacgagagagagagaaa

SEQ ID NO: 313481 - RNA, 21 nt, Human
aggaaagaaaagggaaaaaaa

SEQ ID NO: 313482 - RNA, 19 nt, Human
aggaaagcaaaagaaaaga

SEQ ID NO: 313483 - RNA, 22 nt, Human
aggaaaggaaagcaaaagaaaa

SEQ ID NO: 313484 - RNA, 21 nt, Human
aggaaaggaaagggaaaaaga

SEQ ID NO: 313485 - RNA, 19 nt, Human
aggaaagggaaaaagaagg

SEQ ID NO: 313486 - RNA, 23 nt, Human
agggaaaaagaagggaaagaaaa

SEQ ID NO: 313487 - RNA, 21 nt, Human
agggaagggaagggaagggga

SEQ ID NO: 313488 - RNA, 18 nt, Human
augaaaggaaaggaaagg

SEQ ID NO: 313489 - RNA, 24 nt, Human
cccagugcggccggccgccuccuc

SEQ ID NO: 313490 - RNA, 24 nt, Human
cggccggccgccuccucgcuuccu

SEQ ID NO: 313491 - RNA, 18 nt, Human
gaaaaagaagggaaagaa

SEQ ID NO: 313492 - RNA, 20 nt, Human
gaaagaaaaaggggaaaggg

SEQ ID NO: 313493 - RNA, 20 nt, Human
gaagggaagggaagggaagg

SEQ ID NO: 313494 - RNA, 24 nt, Human
gaagggaagggaaggggaaaggaa

SEQ ID NO: 313495 - RNA, 20 nt, Human
gcggccggccgccuccucgc

SEQ ID NO: 313496 - RNA, 20 nt, Human
ggaaaaagaagggaaagaaa

SEQ ID NO: 313497 - RNA, 21 nt, Human
ggaaaaagaagggaaagaaaa

SEQ ID NO: 313498 - RNA, 23 nt, Human
ggaaaggaagagauggaagggaa

SEQ ID NO: 313499 - RNA, 19 nt, Human
ggaagggaagggaagggga

SEQ ID NO: 313500 - RNA, 26 nt, Human
gggaaaaaaaggaaaggaaagcaaaa

SEQ ID NO: 313501 - RNA, 18 nt, Human
gggaaagaaaaaggggaa

SEQ ID NO: 313502 - RNA, 27 nt, Human
ucaacagaaguuagaaccucuuaugaa

SEQ ID NO: 313503 - RNA, 18 nt, Human
ugaaaaggaaagaaaagg

SEQ ID NO: 313504 - RNA, 18 nt, Human
ugaaaggaaaggaaaggg

SEQ ID NO: 313505 - RNA, 20 nt, Human
ugagagagaaaggaaauccc

SEQ ID NO: 313506 - RNA, 21 nt, Human
ugagagagaaaggaaaucccg

SEQ ID NO: 313507 - RNA, 22 nt, Human
ugagagagaaaggaaaucccgg

SEQ ID NO: 313508 - RNA, 22 nt, Human
aaaaaagauaaaacugaaaggg

SEQ ID NO: 313509 - RNA, 22 nt, Human
aaacaggagagaguaucucucc

SEQ ID NO: 313510 - RNA, 21 nt, Human
aaagacccccaccccaacagg

SEQ ID NO: 313511 - RNA, 24 nt, Human
aaagacccccaccccaacaggacc

SEQ ID NO: 313512 - RNA, 27 nt, Human
aaagagaaaaaacauaaccaaggagaa

SEQ ID NO: 313513 - RNA, 18 nt, Human
aaagcaggcauuuuaccu

SEQ ID NO: 313514 - RNA, 24 nt, Human
aaagccccccaaaaaugccuccuc

SEQ ID NO: 313515 - RNA, 24 nt, Human
aaaugacucuugaauaauaagaac

SEQ ID NO: 313516 - RNA, 23 nt, Human
aacacgcagacagaacaaggaaa

SEQ ID NO: 313517 - RNA, 19 nt, Human
aagagaggaagaaacggga

SEQ ID NO: 313518 - RNA, 21 nt, Human
aagcagaggaaagccccccaa

SEQ ID NO: 313519 - RNA, 20 nt, Human
aagcuccggaauucugcuuu

SEQ ID NO: 313520 - RNA, 19 nt, Human
aauaacuuuuuuccuguuu

SEQ ID NO: 313521 - RNA, 24 nt, Human
aauaauaagaacaaguaaaaggaa

SEQ ID NO: 313522 - RNA, 21 nt, Human
aaucaacaggaaaaaucagua

SEQ ID NO: 313523 - RNA, 21 nt, Human
aauccccacacccagcacccc

SEQ ID NO: 313524 - RNA, 19 nt, Human
acaaaaacgcacccaaauc

SEQ ID NO: 313525 - RNA, 20 nt, Human
acccagcaccccaguccuca

SEQ ID NO: 313526 - RNA, 21 nt, Human
acccagcaccccaguccucaa

SEQ ID NO: 313527 - RNA, 22 nt, Human
accccagaaccauccugcuccu

SEQ ID NO: 313528 - RNA, 18 nt, Human
accccaguccucaaggcu

SEQ ID NO: 313529 - RNA, 20 nt, Human
acccccaccccaacaggacc

SEQ ID NO: 313530 - RNA, 24 nt, Human
acccccaccccaacaggaccaggc

SEQ ID NO: 313531 - RNA, 22 nt, Human
acccuauacuccaauccccaca

SEQ ID NO: 313532 - RNA, 20 nt, Human
acccuucccgcgucuccccc

SEQ ID NO: 313533 - RNA, 21 nt, Human
acccuucccgcgucucccccc

SEQ ID NO: 313534 - RNA, 20 nt, Human
accuagaagagcaagaugag

SEQ ID NO: 313535 - RNA, 19 nt, Human
accucuuugaaacaaaugg

SEQ ID NO: 313536 - RNA, 23 nt, Human
acgccggcucacccggccucccu

SEQ ID NO: 313537 - RNA, 18 nt, Human
acuaugcccuucucucca

SEQ ID NO: 313538 - RNA, 23 nt, Human
acucccccgaaugcucccccccu

SEQ ID NO: 313539 - RNA, 24 nt, Human
agacagguagaucaauccgugaga

SEQ ID NO: 313540 - RNA, 22 nt, Human
agagaaaaaacauaaccaagga

SEQ ID NO: 313541 - RNA, 23 nt, Human
agagaggaagaaacgggaccuag

SEQ ID NO: 313542 - RNA, 18 nt, Human
agccauaggccucucauu

SEQ ID NO: 313543 - RNA, 21 nt, Human
aggaaagccccccaaaaaugc

SEQ ID NO: 313544 - RNA, 26 nt, Human
aggaagaaacgggaccuagaagagca

SEQ ID NO: 313545 - RNA, 22 nt, Human
aggcagggccacgggaaaaguu

SEQ ID NO: 313546 - RNA, 23 nt, Human
auccacaaacacuccgaaagucc

SEQ ID NO: 313547 - RNA, 24 nt, Human
augaacacuggcagucuguuacca

SEQ ID NO: 313548 - RNA, 20 nt, Human
augcagaccucuuugaaaca

SEQ ID NO: 313549 - RNA, 21 nt, Human
caaaaaugccuccucagcucc

SEQ ID NO: 313550 - RNA, 21 nt, Human
caacaggaccaggccaccaga

SEQ ID NO: 313551 - RNA, 22 nt, Human
caagaugagucucguucagugg

SEQ ID NO: 313552 - RNA, 19 nt, Human
cacaaacacuccgaaaguc

SEQ ID NO: 313553 - RNA, 19 nt, Human
cacacccagcaccccaguc

SEQ ID NO: 313554 - RNA, 19 nt, Human
cacagccaaguccuaccgc

SEQ ID NO: 313555 - RNA, 20 nt, Human
caccagaguauaggcagggc

SEQ ID NO: 313556 - RNA, 23 nt, Human
cacccagcaccccaguccucaag

SEQ ID NO: 313557 - RNA, 23 nt, Human
caccccauuagucuauuugaauc

SEQ ID NO: 313558 - RNA, 22 nt, Human
cacccggccucccuucggaggc

SEQ ID NO: 313559 - RNA, 21 nt, Human
cagcaaaggcaggaaaaucag

SEQ ID NO: 313560 - RNA, 20 nt, Human
cauguauauccacaaacacu

SEQ ID NO: 313561 - RNA, 19 nt, Human
cauuucaggaugaacacug

SEQ ID NO: 313562 - RNA, 21 nt, Human
cauuuuccuuugcuuuuguuc

SEQ ID NO: 313563 - RNA, 19 nt, Human
ccaacaggaccaggccacc

SEQ ID NO: 313564 - RNA, 21 nt, Human
ccaagagaggaagaaacggga

SEQ ID NO: 313565 - RNA, 18 nt, Human
ccacaaacacuccgaaag

SEQ ID NO: 313566 - RNA, 19 nt, Human
ccacccaaaccccagaacc

SEQ ID NO: 313567 - RNA, 22 nt, Human
ccaccuucaacuaucuuaauuu

SEQ ID NO: 313568 - RNA, 20 nt, Human
cccaacaggaccaggccacc

SEQ ID NO: 313569 - RNA, 21 nt, Human
cccagcaccccaguccucaag

SEQ ID NO: 313570 - RNA, 18 nt, Human
ccccaaaaaugccuccuc

SEQ ID NO: 313571 - RNA, 18 nt, Human
ccccacacccagcacccc

SEQ ID NO: 313572 - RNA, 21 nt, Human
ccccacacccagcaccccagu

SEQ ID NO: 313573 - RNA, 21 nt, Human
ccccacccaaaccccagaacc

SEQ ID NO: 313574 - RNA, 22 nt, Human
ccccacuccccacucccccgaa

SEQ ID NO: 313575 - RNA, 24 nt, Human
cccccaccccaacaggaccaggcc

SEQ ID NO: 313576 - RNA, 20 nt, Human
cccccacuccccacuccccc

SEQ ID NO: 313577 - RNA, 19 nt, Human
ccccccaaaaaugccuccu

SEQ ID NO: 313578 - RNA, 21 nt, Human
ccccccaaaaaugccuccuca

SEQ ID NO: 313579 - RNA, 22 nt, Human
ccccccacccaaaccccagaac

SEQ ID NO: 313580 - RNA, 20 nt, Human
ccccccacuccccacucccc

SEQ ID NO: 313581 - RNA, 23 nt, Human
ccccccacuccccacucccccga

SEQ ID NO: 313582 - RNA, 18 nt, Human
ccccccuucuccccuacc

SEQ ID NO: 313583 - RNA, 18 nt, Human
cccgacaccucccagccc

SEQ ID NO: 313584 - RNA, 20 nt, Human
ccgcgggcugcugcugcugc

SEQ ID NO: 313585 - RNA, 20 nt, Human
ccuaagcaagcagccagccu

SEQ ID NO: 313586 - RNA, 19 nt, Human
ccuauacuccaauccccac

SEQ ID NO: 313587 - RNA, 24 nt, Human
ccuccucagcuccccauucugucc

SEQ ID NO: 313588 - RNA, 20 nt, Human
ccucgcggucccgcuucucc

SEQ ID NO: 313589 - RNA, 25 nt, Human
cgaaugcucccccccuucuccccua

SEQ ID NO: 313590 - RNA, 22 nt, Human
cgggcugcugcugcugcuccug

SEQ ID NO: 313591 - RNA, 26 nt, Human
cuaccagaaagcuagcccaguuuagu

SEQ ID NO: 313592 - RNA, 20 nt, Human
cuaccaggaccuggcccagg

SEQ ID NO: 313593 - RNA, 19 nt, Human
cuccaaagacccccacccc

SEQ ID NO: 313594 - RNA, 20 nt, Human
cucccccugacccucucuuu

SEQ ID NO: 313595 - RNA, 22 nt, Human
cuccccggaguuaaaauuucua

SEQ ID NO: 313596 - RNA, 19 nt, Human
cuccccuacccuauacucc

SEQ ID NO: 313597 - RNA, 21 nt, Human
cucccuucggaggcugcagcc

SEQ ID NO: 313598 - RNA, 20 nt, Human
cugcuccugcugcugccagg

SEQ ID NO: 313599 - RNA, 23 nt, Human
cugcugcugcuccugcugcugcc

SEQ ID NO: 313600 - RNA, 18 nt, Human
cuuaaaaccccugcucgg

SEQ ID NO: 313601 - RNA, 21 nt, Human
cuuaaaaccccugcucggguc

SEQ ID NO: 313602 - RNA, 19 nt, Human
cuuuaaaucugucuuccuc

SEQ ID NO: 313603 - RNA, 22 nt, Human
gaagaaacgggaccuagaagag

SEQ ID NO: 313604 - RNA, 20 nt, Human
gacauaagaggaaaaaaaac

SEQ ID NO: 313605 - RNA, 26 nt, Human
gaccucuuugaaacaaaugggggugg

SEQ ID NO: 313606 - RNA, 20 nt, Human
gcagaggaaagccccccaaa

SEQ ID NO: 313607 - RNA, 22 nt, Human
gcucacccggccucccuucgga

SEQ ID NO: 313608 - RNA, 23 nt, Human
gcucccccccuucuccccuaccc

SEQ ID NO: 313609 - RNA, 21 nt, Human
gcugcugcuccugcugcugcc

SEQ ID NO: 313610 - RNA, 21 nt, Human
gcugcugcuccugcugcugcc

SEQ ID NO: 313611 - RNA, 20 nt, Human
ggaccuagaagagcaagaug

SEQ ID NO: 313612 - RNA, 22 nt, Human
ggaggcaagcagaggaaagccc

SEQ ID NO: 313613 - RNA, 22 nt, Human
gggugggggcacuuuaaaucug

SEQ ID NO: 313614 - RNA, 24 nt, Human
ggucccgcuucuccgacagcucua

SEQ ID NO: 313615 - RNA, 20 nt, Human
ggugcucuuuuuucucuucu

SEQ ID NO: 313616 - RNA, 20 nt, Human
gguugguagguuuguuuuug

SEQ ID NO: 313617 - RNA, 21 nt, Human
guacugggacacaucccccug

SEQ ID NO: 313618 - RNA, 20 nt, Human
gucgcggcggcuggcggcga

SEQ ID NO: 313619 - RNA, 24 nt, Human
gucuuuauuugucuaguuuuuggu

SEQ ID NO: 313620 - RNA, 20 nt, Human
guggaggugagagagggaaa

SEQ ID NO: 313621 - RNA, 25 nt, Human
uaaaccucucucuaaaaaaaagaua

SEQ ID NO: 313622 - RNA, 22 nt, Human
uaaccaaggagaaagcucagca

SEQ ID NO: 313623 - RNA, 27 nt, Human
uaaccaaggagaaagcucagcagacau

SEQ ID NO: 313624 - RNA, 19 nt, Human
uaagaacaaguaaaaggaa

SEQ ID NO: 313625 - RNA, 23 nt, Human
uaagaacaaguaaaaggaaacac

SEQ ID NO: 313626 - RNA, 23 nt, Human
uaagcaagcagccagccuccccc

SEQ ID NO: 313627 - RNA, 22 nt, Human
uaccagaaagcuagcccaguuu

SEQ ID NO: 313628 - RNA, 25 nt, Human
uaccagaaagcuagcccaguuuagg

SEQ ID NO: 313629 - RNA, 21 nt, Human
uacuccaauccccacacccag

SEQ ID NO: 313630 - RNA, 26 nt, Human
uacuccaauccccacacccagcaccc

SEQ ID NO: 313631 - RNA, 19 nt, Human
uaggggacagcaaaggcag

SEQ ID NO: 313632 - RNA, 24 nt, Human
uauaaacacaaaaacgcacccaaa

SEQ ID NO: 313633 - RNA, 19 nt, Human
uaugacaaaaauguuuuca

SEQ ID NO: 313634 - RNA, 20 nt, Human
uaugcccuucucuccaaaga

SEQ ID NO: 313635 - RNA, 20 nt, Human
ucaacauuucuauaauuuca

SEQ ID NO: 313636 - RNA, 19 nt, Human
ucagcagacauacauagac

SEQ ID NO: 313637 - RNA, 18 nt, Human
uccaaagacccccacccc

SEQ ID NO: 313638 - RNA, 18 nt, Human
uccaaagaguaucuugua

SEQ ID NO: 313639 - RNA, 22 nt, Human
uccacaaacacuccgaaagucc

SEQ ID NO: 313640 - RNA, 24 nt, Human
uccacaaacacuccgaaaguccgc

SEQ ID NO: 313641 - RNA, 18 nt, Human
uccaccagcagcuuguaa

SEQ ID NO: 313642 - RNA, 22 nt, Human
uccccacucccccgaaugcucc

SEQ ID NO: 313643 - RNA, 18 nt, Human
uccccccacccaaacccc

SEQ ID NO: 313644 - RNA, 20 nt, Human
uccccccacccaaaccccag

SEQ ID NO: 313645 - RNA, 19 nt, Human
ucuaccaggaccuggccca

SEQ ID NO: 313646 - RNA, 21 nt, Human
ucuccgcuuuccuucccccca

SEQ ID NO: 313647 - RNA, 20 nt, Human
ucucuaaaaaaaagauaaaa

SEQ ID NO: 313648 - RNA, 19 nt, Human
ucuguuuuguuuuaguuug

SEQ ID NO: 313649 - RNA, 20 nt, Human
ugaaaucgcacuagccacaa

SEQ ID NO: 313650 - RNA, 24 nt, Human
ugcaggcaggauaacggacacucc

SEQ ID NO: 313651 - RNA, 23 nt, Human
ugccaggcgcucccucugaccgc

SEQ ID NO: 313652 - RNA, 18 nt, Human
ugcccugcaaacaaugau

SEQ ID NO: 313653 - RNA, 23 nt, Human
ugcccuucucuccaaagaccccc

SEQ ID NO: 313654 - RNA, 19 nt, Human
ugcuccuuaaaaccccugc

SEQ ID NO: 313655 - RNA, 21 nt, Human
ugcugcugcuccugcugcugc

SEQ ID NO: 313656 - RNA, 21 nt, Human
ugcugcugcugcuccugcugc

SEQ ID NO: 313657 - RNA, 21 nt, Human
uggaacggaggaaauaaagag

SEQ ID NO: 313658 - RNA, 20 nt, Human
uggaggaaagagagcgagaa

SEQ ID NO: 313659 - RNA, 24 nt, Human
uggcauguauauccacaaacacuc

SEQ ID NO: 313660 - RNA, 21 nt, Human
ugggaaaagcuuauuuugaaa

SEQ ID NO: 313661 - RNA, 23 nt, Human
ugggggaaaaugaaguugcagau

SEQ ID NO: 313662 - RNA, 18 nt, Human
ugggguggaggugagaga

SEQ ID NO: 313663 - RNA, 22 nt, Human
ugggguggaggugagagaggga

SEQ ID NO: 313664 - RNA, 27 nt, Human
uggguggaggaaagagagcgagaaggg

SEQ ID NO: 313665 - RNA, 22 nt, Human
uggucagaaacaguccauuuuc

SEQ ID NO: 313666 - RNA, 20 nt, Human
ugucccgcccgacaccuccc

SEQ ID NO: 313667 - RNA, 25 nt, Human
uguugaaagguucuaccaggaccug

SEQ ID NO: 313668 - RNA, 24 nt, Human
uguuuuguuuuaguuugucuuuau

SEQ ID NO: 313669 - RNA, 23 nt, Human
uguuuuuguacauaguuccuugg

SEQ ID NO: 313670 - RNA, 20 nt, Human
uuaaaauuucuaaagcauuu

SEQ ID NO: 313671 - RNA, 20 nt, Human
uuccccccacuccccacucc

SEQ ID NO: 313672 - RNA, 23 nt, Human
uuccuagaauaagauaucucgaa

SEQ ID NO: 313673 - RNA, 25 nt, Human
uugaaacaaaugggggugggggcaa

SEQ ID NO: 313674 - RNA, 22 nt, Human
uuggcgcauagaauugguucug

SEQ ID NO: 313675 - RNA, 22 nt, Human
uuguacauaguuccuugguccc

SEQ ID NO: 313676 - RNA, 18 nt, Human
uuguucuguuuucgccca

SEQ ID NO: 313677 - RNA, 22 nt, Human
uuucagcugugcucccacucac

SEQ ID NO: 313678 - RNA, 22 nt, Human
uuucaggaugaacacuggcagu

SEQ ID NO: 313679 - RNA, 24 nt, Human
uuuucagcugugcucccacucacu

SEQ ID NO: 313680 - RNA, 18 nt, Human
aaaaacccuggcacaaac

SEQ ID NO: 313681 - RNA, 18 nt, Human
aaaaacccuggcacaaac

SEQ ID NO: 313682 - RNA, 19 nt, Human
aaagcccugccacaaacuc

SEQ ID NO: 313683 - RNA, 19 nt, Human
aaccaguugccccaaacuc

SEQ ID NO: 313684 - RNA, 19 nt, Human
aaccaguugccccaaacuc

SEQ ID NO: 313685 - RNA, 19 nt, Human
aaccaguugccccaaacuc

SEQ ID NO: 313686 - RNA, 24 nt, Human
aaccaguugccccaaacuccccug

SEQ ID NO: 313687 - RNA, 24 nt, Human
aaccaguugccccaaacuccccug

SEQ ID NO: 313688 - RNA, 24 nt, Human
aaccaguugccccaaacuccccug

SEQ ID NO: 313689 - RNA, 19 nt, Human
aacuccccugcccccaccc

SEQ ID NO: 313690 - RNA, 19 nt, Human
aacuccccugcccccaccc

SEQ ID NO: 313691 - RNA, 19 nt, Human
aacuccccugcccccaccc

SEQ ID NO: 313692 - RNA, 25 nt, Human
aagaacuuaauccaaaaacccuggc

SEQ ID NO: 313693 - RNA, 21 nt, Human
aaggcgccccaagccgggggc

SEQ ID NO: 313694 - RNA, 23 nt, Human
accaguugccccaaacuccccug

SEQ ID NO: 313695 - RNA, 23 nt, Human
accaguugccccaaacuccccug

SEQ ID NO: 313696 - RNA, 23 nt, Human
accaguugccccaaacuccccug

SEQ ID NO: 313697 - RNA, 24 nt, Human
ccaaaagcccugccacaaacucca

SEQ ID NO: 313698 - RNA, 18 nt, Human
ccacaaaugucauucacc

SEQ ID NO: 313699 - RNA, 22 nt, Human
ccacccuuaguguucccaauuc

SEQ ID NO: 313700 - RNA, 22 nt, Human
ccacccuuuguguucccaauuc

SEQ ID NO: 313701 - RNA, 22 nt, Human
ccacccuuuguguucccaauuc

SEQ ID NO: 313702 - RNA, 24 nt, Human
ccaccuaacuucuagaaauaaccu

SEQ ID NO: 313703 - RNA, 24 nt, Human
cccaaaaacccuggcacaaacucc

SEQ ID NO: 313704 - RNA, 24 nt, Human
cccaaaagcccugccacaaacucc

SEQ ID NO: 313705 - RNA, 21 nt, Human
cccacaaaugucauucaccca

SEQ ID NO: 313706 - RNA, 22 nt, Human
ccccacccuuaguguucccaau

SEQ ID NO: 313707 - RNA, 22 nt, Human
ccccacccuuuguguucccaau

SEQ ID NO: 313708 - RNA, 22 nt, Human
ccccacccuuuguguucccaau

SEQ ID NO: 313709 - RNA, 25 nt, Human
ccccugcccccacccuuaguguucc

SEQ ID NO: 313710 - RNA, 25 nt, Human
ccccugcccccacccuuuguguucc

SEQ ID NO: 313711 - RNA, 25 nt, Human
ccccugcccccacccuuuguguucc

SEQ ID NO: 313712 - RNA, 18 nt, Human
ccccuguuccccauuccc

SEQ ID NO: 313713 - RNA, 27 nt, Human
cccuuaguguucccaauuuugacgggc

SEQ ID NO: 313714 - RNA, 21 nt, Human
ccugucccccauuccuagaag

SEQ ID NO: 313715 - RNA, 21 nt, Human
ccugucccccauuccuagaag

SEQ ID NO: 313716 - RNA, 21 nt, Human
cuuaaucccaaaaacccuggc

SEQ ID NO: 313717 - RNA, 19 nt, Human
cuuccgagcugcccaccua

SEQ ID NO: 313718 - RNA, 24 nt, Human
gccccaaacuccccugcccccacc

SEQ ID NO: 313719 - RNA, 24 nt, Human
gccccaaacuccccugcccccacc

SEQ ID NO: 313720 - RNA, 24 nt, Human
gccccaaacuccccugcccccacc

SEQ ID NO: 313721 - RNA, 25 nt, Human
gccuuccgagcugcccaccuaacuu

SEQ ID NO: 313722 - RNA, 23 nt, Human
gcgccccaagccgggggccuggu

SEQ ID NO: 313723 - RNA, 26 nt, Human
uaaaaucaagagcaucauugaacuuc

SEQ ID NO: 313724 - RNA, 26 nt, Human
uaaaaucaagagcaucauugaacuuc

SEQ ID NO: 313725 - RNA, 26 nt, Human
uaaaaucaagagcaucauugaacuuc

SEQ ID NO: 313726 - RNA, 23 nt, Human
uaagaaaaaagugauacaugaug

SEQ ID NO: 313727 - RNA, 23 nt, Human
uaagaaaaaagugauacaugaug

SEQ ID NO: 313728 - RNA, 23 nt, Human
uaagaaaaaagugauacaugaug

SEQ ID NO: 313729 - RNA, 26 nt, Human
uagcuccuccccucccccuguccccc

SEQ ID NO: 313730 - RNA, 26 nt, Human
uagcuccuccccucccccuguccccc

SEQ ID NO: 313731 - RNA, 25 nt, Human
uagcuccuccccuccccuguucccc

SEQ ID NO: 313732 - RNA, 24 nt, Human
uccaaaaacccuggcacaaacucc

SEQ ID NO: 313733 - RNA, 27 nt, Human
ucccaaaaacccuggcacaaacuccag

SEQ ID NO: 313734 - RNA, 21 nt, Human
ucccccugucccccauuccuc

SEQ ID NO: 313735 - RNA, 21 nt, Human
ucccccugucccccauuccuc

SEQ ID NO: 313736 - RNA, 22 nt, Human
ucccuagcuccuccccuccccc

SEQ ID NO: 313737 - RNA, 22 nt, Human
ucccuagcuccuccccuccccc

SEQ ID NO: 313738 - RNA, 22 nt, Human
ucccuagcuccuccccuccccu

SEQ ID NO: 313739 - RNA, 21 nt, Human
uccgagcugcccaccuaacuu

SEQ ID NO: 313740 - RNA, 18 nt, Human
ucuagaaauaaccuaccc

SEQ ID NO: 313741 - RNA, 21 nt, Human
ucuuucccuagcuccuccccu

SEQ ID NO: 313742 - RNA, 21 nt, Human
ucuuucccuagcuccuccccu

SEQ ID NO: 313743 - RNA, 22 nt, Human
ugaugugggauuaaaaucaaga

SEQ ID NO: 313744 - RNA, 22 nt, Human
ugaugugggauuaaaaucaaga

SEQ ID NO: 313745 - RNA, 22 nt, Human
ugaugugggauuaaaaucaaga

SEQ ID NO: 313746 - RNA, 24 nt, Human
ugggauuaaaaucaagagcaucau

SEQ ID NO: 313747 - RNA, 24 nt, Human
ugggauuaaaaucaagagcaucau

SEQ ID NO: 313748 - RNA, 24 nt, Human
ugggauuaaaaucaagagcaucau

SEQ ID NO: 313749 - RNA, 23 nt, Human
uuaaucccaaaaacccuggcaca

SEQ ID NO: 313750 - RNA, 19 nt, Human
uuauuuaagaaaaaaguga

SEQ ID NO: 313751 - RNA, 21 nt, Human
uugaacuucaccuucccucca

SEQ ID NO: 313752 - RNA, 21 nt, Human
uugaacuucaccuucccucca

SEQ ID NO: 313753 - RNA, 21 nt, Human
uugaacuucaccuucccucca

SEQ ID NO: 313754 - RNA, 21 nt, Human
aacccaaggaggaagaaagcu

SEQ ID NO: 313755 - RNA, 25 nt, Human
aacccgcuugccccccuccagcccc

SEQ ID NO: 313756 - RNA, 20 nt, Human
aaccugccuuccuggcccug

SEQ ID NO: 313757 - RNA, 23 nt, Human
aagaggcacccuggucuccucca

SEQ ID NO: 313758 - RNA, 23 nt, Human
aaggagauaagaggcacccuggu

SEQ ID NO: 313759 - RNA, 22 nt, Human
acauacacagacacauugcaug

SEQ ID NO: 313760 - RNA, 22 nt, Human
acauucacacauacacagacac

SEQ ID NO: 313761 - RNA, 23 nt, Human
accccuaacccaggacacagcug

SEQ ID NO: 313762 - RNA, 19 nt, Human
acccgcuugccccccucca

SEQ ID NO: 313763 - RNA, 24 nt, Human
acccgcuugccccccuccagcccc

SEQ ID NO: 313764 - RNA, 21 nt, Human
agcuccgcagggcucggggca

SEQ ID NO: 313765 - RNA, 22 nt, Human
aggaggcagaccgcuagaagga

SEQ ID NO: 313766 - RNA, 20 nt, Human
caaaaauagaacuucucuug

SEQ ID NO: 313767 - RNA, 23 nt, Human
cacauacacagacacauugcaug

SEQ ID NO: 313768 - RNA, 26 nt, Human
cagcagcaccagagagggaaccugcc

SEQ ID NO: 313769 - RNA, 20 nt, Human
cauggcacaugggaccucag

SEQ ID NO: 313770 - RNA, 20 nt, Human
cauguugugcacacucaugg

SEQ ID NO: 313771 - RNA, 21 nt, Human
ccaaggaggaagaaagcucaa

SEQ ID NO: 313772 - RNA, 21 nt, Human
ccaggucccuuggucugagaa

SEQ ID NO: 313773 - RNA, 20 nt, Human
ccccaagagguaccaggagg

SEQ ID NO: 313774 - RNA, 20 nt, Human
ccccgagcuccgcagggcuc

SEQ ID NO: 313775 - RNA, 18 nt, Human
ccccuaacccaggacaca

SEQ ID NO: 313776 - RNA, 25 nt, Human
ccgacccccaaccccuaacccagga

SEQ ID NO: 313777 - RNA, 21 nt, Human
ccgcagggcucggggcaccag

SEQ ID NO: 313778 - RNA, 23 nt, Human
ccucggaacccgcuugccccccu

SEQ ID NO: 313779 - RNA, 21 nt, Human
ccuggaaggggccgaccccca

SEQ ID NO: 313780 - RNA, 19 nt, Human
cgcuugccccccuccagcc

SEQ ID NO: 313781 - RNA, 19 nt, Human
cggaacccgcuugcccccc

SEQ ID NO: 313782 - RNA, 19 nt, Human
cuccgcagggcucggggca

SEQ ID NO: 313783 - RNA, 19 nt, Human
gaaagcucaaccccucuag

SEQ ID NO: 313784 - RNA, 18 nt, Human
gaacccgcuugccccccu

SEQ ID NO: 313785 - RNA, 21 nt, Human
gacccccaaccccuaacccag

SEQ ID NO: 313786 - RNA, 19 nt, Human
gcuggccccgagcuccgca

SEQ ID NO: 313787 - RNA, 19 nt, Human
uaacccaggacacagcugg

SEQ ID NO: 313788 - RNA, 23 nt, Human
uacagguagaaaagccauauggg

SEQ ID NO: 313789 - RNA, 20 nt, Human
uagaaaagccauauggggca

SEQ ID NO: 313790 - RNA, 18 nt, Human
uagaaggagauaagaggc

SEQ ID NO: 313791 - RNA, 19 nt, Human
uagaaggagauaagaggca

SEQ ID NO: 313792 - RNA, 22 nt, Human
uccaacccaaggaggaagaaag

SEQ ID NO: 313793 - RNA, 22 nt, Human
ucggaacccgcuugccccccuc

SEQ ID NO: 313794 - RNA, 18 nt, Human
ucucacauucacacauac

SEQ ID NO: 313795 - RNA, 21 nt, Human
ucuccuccaacccaaggagga

SEQ ID NO: 313796 - RNA, 25 nt, Human
ucuugguauuuauaaaucuacggcc

SEQ ID NO: 313797 - RNA, 27 nt, Human
ugaaaggagggcuguguuuuucucacu

SEQ ID NO: 313798 - RNA, 21 nt, Human
ugaagguuuuuuuuccuccuu

SEQ ID NO: 313799 - RNA, 19 nt, Human
ugcaagcagcagcaccaga

SEQ ID NO: 313800 - RNA, 27 nt, Human
uggagcguugacuuagggggcguuuuu

SEQ ID NO: 313801 - RNA, 21 nt, Human
ugugcacacucauggcacaug

SEQ ID NO: 313802 - RNA, 24 nt, Human
uucucacauucacacauacacaga

SEQ ID NO: 313803 - RNA, 20 nt, Human
uuuccuccuuuuugcagucu

SEQ ID NO: 313804 - RNA, 28 nt, Human
uuuuucucacuucccuuuuuauuuccuc

SEQ ID NO: 313805 - RNA, 18 nt, Human
agaugaacacgauguagc

SEQ ID NO: 313806 - RNA, 18 nt, Human
auauacauccaauaugug

SEQ ID NO: 313807 - RNA, 22 nt, Human
cagagccaccagcccgcacgcg

SEQ ID NO: 313808 - RNA, 23 nt, Human
cccgcacgcggcgccgacugaca

SEQ ID NO: 313809 - RNA, 18 nt, Human
ccugccgccgccgcugcc

SEQ ID NO: 313810 - RNA, 23 nt, Human
cuucuaauacauccagaugaaca

SEQ ID NO: 313811 - RNA, 20 nt, Human
gcagaauuuacuuuaguuag

SEQ ID NO: 313812 - RNA, 22 nt, Human
gccggaguccugccgccgccgc

SEQ ID NO: 313813 - RNA, 23 nt, Human
gcugccacagagccaccagcccg

SEQ ID NO: 313814 - RNA, 18 nt, Human
uaacauauacauccaaua

SEQ ID NO: 313815 - RNA, 22 nt, Human
uagauggauaacauucugagua

SEQ ID NO: 313816 - RNA, 22 nt, Human
uagcaauaucagcuuguauucc

SEQ ID NO: 313817 - RNA, 21 nt, Human
ugacuuccaaaugacaacugc

SEQ ID NO: 313818 - RNA, 24 nt, Human
ugaguucuacaaauuuaaagcuuu

SEQ ID NO: 313819 - RNA, 22 nt, Human
ugccacagagccaccagcccgc

SEQ ID NO: 313820 - RNA, 24 nt, Human
ugccacagagccaccagcccgcac

SEQ ID NO: 313821 - RNA, 19 nt, Human
ugccggaguccugccgccg

SEQ ID NO: 313822 - RNA, 21 nt, Human
uuuuuuuuuuuuuuuuuucag

SEQ ID NO: 313823 - RNA, 21 nt, Human
aacuguggugacagcuucuca

SEQ ID NO: 313824 - RNA, 22 nt, Human
augaagcaggaagcacguccuc

SEQ ID NO: 313825 - RNA, 18 nt, Human
cgccgagcuccaagcucu

SEQ ID NO: 313826 - RNA, 18 nt, Human
cugagcuucagccugggc

SEQ ID NO: 313827 - RNA, 21 nt, Human
gcccugagcuucagccugggc

SEQ ID NO: 313828 - RNA, 22 nt, Human
ggugcugguugugcgccgagcu

SEQ ID NO: 313829 - RNA, 27 nt, Human
ucuugccacaaacuguugaguccacag

SEQ ID NO: 313830 - RNA, 18 nt, Human
ugacacugaaucugcugg

SEQ ID NO: 313831 - RNA, 21 nt, Human
ugcugcucccccgucuccuuu

SEQ ID NO: 313832 - RNA, 24 nt, Human
ugcugucagcuucagaacuccugg

SEQ ID NO: 313833 - RNA, 22 nt, Human
ugucuugccacaaacuguugag

SEQ ID NO: 313834 - RNA, 20 nt, Human
ugugcaaaaucgugcugcuc

SEQ ID NO: 313835 - RNA, 25 nt, Human
uuaaaacaaagauauggaauaauau

SEQ ID NO: 313836 - RNA, 20 nt, Human
aaaaauggaaaaagggagaa

SEQ ID NO: 313837 - RNA, 22 nt, Human
aaacagacaccaaacauuacuu

SEQ ID NO: 313838 - RNA, 24 nt, Human
aaacauggccuaaaaauggaaaaa

SEQ ID NO: 313839 - RNA, 19 nt, Human
aaaguccuucauuugcccu

SEQ ID NO: 313840 - RNA, 24 nt, Human
aaaguugaacaaccuucaugcaaa

SEQ ID NO: 313841 - RNA, 21 nt, Human
aaccaaaucagaccugucuga

SEQ ID NO: 313842 - RNA, 23 nt, Human
aagaaacagacaccaaacauuac

SEQ ID NO: 313843 - RNA, 23 nt, Human
aagcccuuccccaccacuaacgg

SEQ ID NO: 313844 - RNA, 21 nt, Human
aaucuucccucccccagucac

SEQ ID NO: 313845 - RNA, 20 nt, Human
accaaaguccuucauuugcc

SEQ ID NO: 313846 - RNA, 21 nt, Human
accccucccaccccccucccu

SEQ ID NO: 313847 - RNA, 25 nt, Human
acccuauuuaaacccuccuaaaaua

SEQ ID NO: 313848 - RNA, 21 nt, Human
acgaaacacuguauaaaaaca

SEQ ID NO: 313849 - RNA, 23 nt, Human
agaagaggagggugcucgaggcc

SEQ ID NO: 313850 - RNA, 22 nt, Human
agccuugcucuucggccuucca

SEQ ID NO: 313851 - RNA, 19 nt, Human
agucacuccuaagaaacag

SEQ ID NO: 313852 - RNA, 19 nt, Human
aguguccaaaaugaccaaa

SEQ ID NO: 313853 - RNA, 21 nt, Human
auaagcucccuaccaccauau

SEQ ID NO: 313854 - RNA, 21 nt, Human
auaugccuuucuaauucaccc

SEQ ID NO: 313855 - RNA, 23 nt, Human
caaaaggauaagcccuuccccac

SEQ ID NO: 313856 - RNA, 23 nt, Human
caaacaaaguugaacaaccuuca

SEQ ID NO: 313857 - RNA, 24 nt, Human
caauaguuuuuuuuccucuggccc

SEQ ID NO: 313858 - RNA, 21 nt, Human
caccccucccaccccccuccc

SEQ ID NO: 313859 - RNA, 18 nt, Human
caccccuuauggugguuu

SEQ ID NO: 313860 - RNA, 23 nt, Human
cagacaccaaacauuacuuaagu

SEQ ID NO: 313861 - RNA, 24 nt, Human
cauggccuaaaaauggaaaaaggg

SEQ ID NO: 313862 - RNA, 21 nt, Human
ccagcagucccuacucuuccc

SEQ ID NO: 313863 - RNA, 24 nt, Human
ccccugagcuuucauccugaaggc

SEQ ID NO: 313864 - RNA, 28 nt, Human
ccccugagcuuucauccugaaggcgagg

SEQ ID NO: 313865 - RNA, 22 nt, Human
cccuacaccccucccacccccc

SEQ ID NO: 313866 - RNA, 24 nt, Human
cccuaccaccauauaagccuugcu

SEQ ID NO: 313867 - RNA, 24 nt, Human
ccuacaccccucccaccccccucc

SEQ ID NO: 313868 - RNA, 23 nt, Human
ccucccaccccccucccuuucuu

SEQ ID NO: 313869 - RNA, 25 nt, Human
ccucccaccccccucccuuucuuaa

SEQ ID NO: 313870 - RNA, 18 nt, Human
ccuucauauacaugcacu

SEQ ID NO: 313871 - RNA, 21 nt, Human
cgaggagaagcuagauccgcc

SEQ ID NO: 313872 - RNA, 20 nt, Human
cggcggcaagaagaggaggg

SEQ ID NO: 313873 - RNA, 22 nt, Human
cuaaaauaaucuucccuccccc

SEQ ID NO: 313874 - RNA, 21 nt, Human
cucccuaccaccauauaagcc

SEQ ID NO: 313875 - RNA, 24 nt, Human
cugaacccuauuuaaacccuccua

SEQ ID NO: 313876 - RNA, 21 nt, Human
cuggcacaggaacaaagaaga

SEQ ID NO: 313877 - RNA, 22 nt, Human
gaagacuuccugguaaccagaa

SEQ ID NO: 313878 - RNA, 19 nt, Human
gaaucaaacccugugguuu

SEQ ID NO: 313879 - RNA, 19 nt, Human
gaccugucugacucacccc

SEQ ID NO: 313880 - RNA, 22 nt, Human
gagaagaaaauauauaugaaua

SEQ ID NO: 313881 - RNA, 18 nt, Human
gcggcaagaagaggaggg

SEQ ID NO: 313882 - RNA, 19 nt, Human
gcuauaagcucccuaccac

SEQ ID NO: 313883 - RNA, 22 nt, Human
ggaaaaagggagaagaaaauau

SEQ ID NO: 313884 - RNA, 18 nt, Human
ggacaacuaccucaaaca

SEQ ID NO: 313885 - RNA, 25 nt, Human
gggagaagaaaauauauaugaauau

SEQ ID NO: 313886 - RNA, 24 nt, Human
uaacuccuaauauuccuaugaucu

SEQ ID NO: 313887 - RNA, 21 nt, Human
uagcuaaaauaaucuucccuc

SEQ ID NO: 313888 - RNA, 23 nt, Human
ucaaacggacaacuaccucaaac

SEQ ID NO: 313889 - RNA, 24 nt, Human
ucaaacggacaacuaccucaaaca

SEQ ID NO: 313890 - RNA, 24 nt, Human
ucaaacggacaacuaccucaaaca

SEQ ID NO: 313891 - RNA, 19 nt, Human
ucauuugcccaugacucaa

SEQ ID NO: 313892 - RNA, 23 nt, Human
ucccaccccccucccuuucuuaa

SEQ ID NO: 313893 - RNA, 23 nt, Human
ucccuacaccccucccacccccc

SEQ ID NO: 313894 - RNA, 18 nt, Human
uccucgguuuccccccug

SEQ ID NO: 313895 - RNA, 19 nt, Human
ugaaggcgaggagaagcua

SEQ ID NO: 313896 - RNA, 19 nt, Human
ugacuccucgguuuccccc

SEQ ID NO: 313897 - RNA, 21 nt, Human
ugcuugggcuugaugcuacag

SEQ ID NO: 313898 - RNA, 27 nt, Human
uuaaacccuccuaaaauaaaaauauca

SEQ ID NO: 313899 - RNA, 22 nt, Human
uuacucagcuuuucugacuccu

SEQ ID NO: 313900 - RNA, 21 nt, Human
uucauccugaaggcgaggaga

SEQ ID NO: 313901 - RNA, 18 nt, Human
uuucuuuaauagggucug

SEQ ID NO: 313902 - RNA, 22 nt, Human
aagcagaaugcagaaaugcagg

SEQ ID NO: 313903 - RNA, 21 nt, Human
aauagaucauauucuaaaacc

SEQ ID NO: 313904 - RNA, 24 nt, Human
agaaaaagacuugaaguaacagaa

SEQ ID NO: 313905 - RNA, 24 nt, Human
aggaaagggaauuaagcagaaugc

SEQ ID NO: 313906 - RNA, 19 nt, Human
aggccgacccaagcgcccc

SEQ ID NO: 313907 - RNA, 25 nt, Human
aggcggcggcugcggcuccucgcgg

SEQ ID NO: 313908 - RNA, 19 nt, Human
aggcggcggcugcggcucg

SEQ ID NO: 313909 - RNA, 20 nt, Human
aggcggcggcugcggcucga

SEQ ID NO: 313910 - RNA, 22 nt, Human
aggcggcggcugcggcucgggc

SEQ ID NO: 313911 - RNA, 21 nt, Human
aucauauucuaaauccuuuuc

SEQ ID NO: 313912 - RNA, 24 nt, Human
auccuuuucuuuuuaaaacgcuuu

SEQ ID NO: 313913 - RNA, 24 nt, Human
ccacggcggcguggcgccccucuc

SEQ ID NO: 313914 - RNA, 19 nt, Human
ccccaggcggcggcugcgg

SEQ ID NO: 313915 - RNA, 22 nt, Human
ccccaggcggcggcugcggcuc

SEQ ID NO: 313916 - RNA, 19 nt, Human
cuaaggaaagggaauuaag

SEQ ID NO: 313917 - RNA, 20 nt, Human
gaaaaagacuugaaguaaca

SEQ ID NO: 313918 - RNA, 22 nt, Human
gaauacacccaugagucaagac

SEQ ID NO: 313919 - RNA, 23 nt, Human
gacccaagcgccccaggcggcgg

SEQ ID NO: 313920 - RNA, 24 nt, Human
gcggccacggcggcguggcgcccc

SEQ ID NO: 313921 - RNA, 22 nt, Human
ggccacggcggcguggcgcccc

SEQ ID NO: 313922 - RNA, 24 nt, Human
uaaacaauaugcauaaaauagauc

SEQ ID NO: 313923 - RNA, 19 nt, Human
uaggugucagauuuucccu

SEQ ID NO: 313924 - RNA, 19 nt, Human
uccucgaggccgacccaag

SEQ ID NO: 313925 - RNA, 24 nt, Human
ugaaguaacagaauuugugaauac

SEQ ID NO: 313926 - RNA, 22 nt, Human
ugaauacacccaugagucaaga

SEQ ID NO: 313927 - RNA, 23 nt, Human
ugcggccacggcggcguggcgcc

SEQ ID NO: 313928 - RNA, 25 nt, Human
ugcggccacggcggcguggcgcccc

SEQ ID NO: 313929 - RNA, 20 nt, Human
uguuggcaguggcucaggac

SEQ ID NO: 313930 - RNA, 24 nt, Human
uuuuuuuuuuuuuucauaauaugg

SEQ ID NO: 313931 - RNA, 18 nt, Human
aaaaaaacagaguacaaa

SEQ ID NO: 313932 - RNA, 23 nt, Human
aaacaucauaccccaauagugca

SEQ ID NO: 313933 - RNA, 18 nt, Human
aaagaaaaacaagcgaca

SEQ ID NO: 313934 - RNA, 21 nt, Human
aaaguucccucucugcugcuu

SEQ ID NO: 313935 - RNA, 24 nt, Human
aacaguggauucacucagaacaca

SEQ ID NO: 313936 - RNA, 22 nt, Human
aacccgguguccgcuccucaga

SEQ ID NO: 313937 - RNA, 21 nt, Human
aacuacagaaacuucaaaaug

SEQ ID NO: 313938 - RNA, 23 nt, Human
aacugacccaaacaucauacccc

SEQ ID NO: 313939 - RNA, 22 nt, Human
aagaaaaacaagcgacaagaaa

SEQ ID NO: 313940 - RNA, 22 nt, Human
aagaaaaauuuagcaguuuuga

SEQ ID NO: 313941 - RNA, 21 nt, Human
aagaagccaaaaaaucaagca

SEQ ID NO: 313942 - RNA, 24 nt, Human
aagaagccaaaaaaucaagcaagc

SEQ ID NO: 313943 - RNA, 18 nt, Human
aagaaggcugcauuuaca

SEQ ID NO: 313944 - RNA, 22 nt, Human
aagcaagcauccgacaggacaa

SEQ ID NO: 313945 - RNA, 23 nt, Human
aagccaaaaaaucaagcaagcau

SEQ ID NO: 313946 - RNA, 23 nt, Human
aaucaagcaagcauccgacagga

SEQ ID NO: 313947 - RNA, 23 nt, Human
acaaaacagcauuuuaaaaagau

SEQ ID NO: 313948 - RNA, 24 nt, Human
acaacagaagauacucaaaauuca

SEQ ID NO: 313949 - RNA, 20 nt, Human
acacgcacacuccaucacca

SEQ ID NO: 313950 - RNA, 23 nt, Human
acacucaugcaggcaaccagccc

SEQ ID NO: 313951 - RNA, 18 nt, Human
acacuccaaauguuacug

SEQ ID NO: 313952 - RNA, 20 nt, Human
acagaagauacucaaaauuc

SEQ ID NO: 313953 - RNA, 19 nt, Human
acauaaaauaaaaauacuc

SEQ ID NO: 313954 - RNA, 18 nt, Human
accaaguauuccacucau

SEQ ID NO: 313955 - RNA, 19 nt, Human
acccaacucucauuaguaa

SEQ ID NO: 313956 - RNA, 19 nt, Human
acccacagugucugcagaa

SEQ ID NO: 313957 - RNA, 24 nt, Human
acuaaagcaccaguucgguuacca

SEQ ID NO: 313958 - RNA, 24 nt, Human
acuccaggaaaagcaaagcugaca

SEQ ID NO: 313959 - RNA, 18 nt, Human
agaaaaacaagcgacaag

SEQ ID NO: 313960 - RNA, 21 nt, Human
agaagcaaugucaucaagaac

SEQ ID NO: 313961 - RNA, 22 nt, Human
agaagcaaugucaucaagaaca

SEQ ID NO: 313962 - RNA, 24 nt, Human
agagagagagagagagagagagac

SEQ ID NO: 313963 - RNA, 21 nt, Human
agcacacacaccacacacaua

SEQ ID NO: 313964 - RNA, 22 nt, Human
agcacacacucaugcaggcaac

SEQ ID NO: 313965 - RNA, 21 nt, Human
agcggcugucauuuuagggug

SEQ ID NO: 313966 - RNA, 21 nt, Human
agcucagugaggcugaugugu

SEQ ID NO: 313967 - RNA, 24 nt, Human
aggcaaaauagagaacacaugugg

SEQ ID NO: 313968 - RNA, 22 nt, Human
agggaaagaaauacuggcuuca

SEQ ID NO: 313969 - RNA, 18 nt, Human
agggcaaaaaggagaaug

SEQ ID NO: 313970 - RNA, 24 nt, Human
auaaaacuucaaagaaaaacaagc

SEQ ID NO: 313971 - RNA, 19 nt, Human
auauauauauauauauaua

SEQ ID NO: 313972 - RNA, 19 nt, Human
auauauauauauauauaua

SEQ ID NO: 313973 - RNA, 19 nt, Human
auauauauauauauauaua

SEQ ID NO: 313974 - RNA, 21 nt, Human
auccucucccacccagauucc

SEQ ID NO: 313975 - RNA, 22 nt, Human
aucuaugcugaaauuugccucc

SEQ ID NO: 313976 - RNA, 18 nt, Human
augucucuuuaguaaaca

SEQ ID NO: 313977 - RNA, 23 nt, Human
auugaggaaaacuaucuucaugg

SEQ ID NO: 313978 - RNA, 22 nt, Human
auuguagaugugguacuuacca

SEQ ID NO: 313979 - RNA, 19 nt, Human
caaaauuagcugcauuggc

SEQ ID NO: 313980 - RNA, 24 nt, Human
caaagcugacacccaugaauaaac

SEQ ID NO: 313981 - RNA, 25 nt, Human
caacaauacauguagaaaggguuuc

SEQ ID NO: 313982 - RNA, 23 nt, Human
caaccaacaguauuacacuuuca

SEQ ID NO: 313983 - RNA, 20 nt, Human
caagaacaacaccaugguca

SEQ ID NO: 313984 - RNA, 21 nt, Human
cacacacaccacacacauaca

SEQ ID NO: 313985 - RNA, 20 nt, Human
cacacauacauacacacaca

SEQ ID NO: 313986 - RNA, 24 nt, Human
cacacucaugcaggcaaccagccc

SEQ ID NO: 313987 - RNA, 23 nt, Human
cacaguuaaaauaccugcauuua

SEQ ID NO: 313988 - RNA, 25 nt, Human
caccacacacauacauacacacaca

SEQ ID NO: 313989 - RNA, 22 nt, Human
cacuccaucaccaagagacucu

SEQ ID NO: 313990 - RNA, 21 nt, Human
cagaacaacaagaauuaggcg

SEQ ID NO: 313991 - RNA, 23 nt, Human
cagaacacaauaugcuggugaua

SEQ ID NO: 313992 - RNA, 25 nt, Human
cagccaaacaguaaucgaaucucaa

SEQ ID NO: 313993 - RNA, 22 nt, Human
caguggaagaucaacauuuugg

SEQ ID NO: 313994 - RNA, 21 nt, Human
cauaacuguaaaaaauacaga

SEQ ID NO: 313995 - RNA, 22 nt, Human
caucaagaacaacaccaugguc

SEQ ID NO: 313996 - RNA, 23 nt, Human
caucaagaacaacaccaugguca

SEQ ID NO: 313997 - RNA, 19 nt, Human
caugcaggcaaccagcccc

SEQ ID NO: 313998 - RNA, 24 nt, Human
cauguacccacacauacuuccccu

SEQ ID NO: 313999 - RNA, 23 nt, Human
cauuccagggacuccacacucag

SEQ ID NO: 314000 - RNA, 23 nt, Human
cauuuugaugggcuacccacagu

SEQ ID NO: 314001 - RNA, 18 nt, Human
ccaagagacuccaggaaa

SEQ ID NO: 314002 - RNA, 25 nt, Human
ccacacacauacauacacacacaca

SEQ ID NO: 314003 - RNA, 24 nt, Human
cccaaaaaaauaaaaauaaaaaug

SEQ ID NO: 314004 - RNA, 22 nt, Human
ccccaguccucacauguaccca

SEQ ID NO: 314005 - RNA, 21 nt, Human
ccccuaaaccaagcacacaca

SEQ ID NO: 314006 - RNA, 18 nt, Human
ccccuuacugagagugaa

SEQ ID NO: 314007 - RNA, 23 nt, Human
cccuaaaccaagcacacacacca

SEQ ID NO: 314008 - RNA, 20 nt, Human
ccucucccacccagauucca

SEQ ID NO: 314009 - RNA, 21 nt, Human
cggaaagcaucauuuugcucu

SEQ ID NO: 314010 - RNA, 20 nt, Human
cucacuuucccucuucagca

SEQ ID NO: 314011 - RNA, 24 nt, Human
cucagaacacaauaugcuggugau

SEQ ID NO: 314012 - RNA, 21 nt, Human
cucccaaaaaaauaaaaauaa

SEQ ID NO: 314013 - RNA, 22 nt, Human
cuccucagaaagaaccgcugaa

SEQ ID NO: 314014 - RNA, 20 nt, Human
cuccucagaaagaaccgcuu

SEQ ID NO: 314015 - RNA, 19 nt, Human
cugaaauuugccuccagug

SEQ ID NO: 314016 - RNA, 21 nt, Human
cugacccaaacaucauacccc

SEQ ID NO: 314017 - RNA, 18 nt, Human
cugaugcccagacaucag

SEQ ID NO: 314018 - RNA, 20 nt, Human
cuuagauugaagcucaccua

SEQ ID NO: 314019 - RNA, 21 nt, Human
cuucaaagaaaaacaagcgac

SEQ ID NO: 314020 - RNA, 19 nt, Human
cuuuugauaaguaagaaaa

SEQ ID NO: 314021 - RNA, 20 nt, Human
gaaaaagaaaaaaaaaagag

SEQ ID NO: 314022 - RNA, 24 nt, Human
gaagauacucaaaauucagaaaga

SEQ ID NO: 314023 - RNA, 18 nt, Human
gaucguguugggcgagag

SEQ ID NO: 314024 - RNA, 21 nt, Human
gauuucuuaaaauaauuuauu

SEQ ID NO: 314025 - RNA, 18 nt, Human
gcaaugucaucaagaaca

SEQ ID NO: 314026 - RNA, 21 nt, Human
gcuaucugcaacugauaaaua

SEQ ID NO: 314027 - RNA, 18 nt, Human
gguugguugguugguugg

SEQ ID NO: 314028 - RNA, 19 nt, Human
guaaauacuuaacuacauc

SEQ ID NO: 314029 - RNA, 18 nt, Human
guagugcugucuuuugau

SEQ ID NO: 314030 - RNA, 24 nt, Human
gugacacagagcacacacucaugc

SEQ ID NO: 314031 - RNA, 18 nt, Human
guuguaacgcagaaccug

SEQ ID NO: 314032 - RNA, 18 nt, Human
uaaaacaaaacagcauuu

SEQ ID NO: 314033 - RNA, 19 nt, Human
uaaaaccacaacaauacau

SEQ ID NO: 314034 - RNA, 27 nt, Human
uaaaauaaaaauacuccauuuaacauc

SEQ ID NO: 314035 - RNA, 21 nt, Human
uaagaagccaaaaaaucaagc

SEQ ID NO: 314036 - RNA, 27 nt, Human
uaaguaagaaaagaaaccaaguauucc

SEQ ID NO: 314037 - RNA, 21 nt, Human
uacaaauuuagaaucaucaca

SEQ ID NO: 314038 - RNA, 24 nt, Human
uacaacagaagauacucaaaauuc

SEQ ID NO: 314039 - RNA, 20 nt, Human
uacaaugaauaaaaccacaa

SEQ ID NO: 314040 - RNA, 20 nt, Human
uacauguagaauuggcaggu

SEQ ID NO: 314041 - RNA, 18 nt, Human
uaccccaauagugcaaag

SEQ ID NO: 314042 - RNA, 18 nt, Human
uagaaaauuuccacuggc

SEQ ID NO: 314043 - RNA, 21 nt, Human
uagaaaauuuccacuggcuuu

SEQ ID NO: 314044 - RNA, 19 nt, Human
uagcauucuggugcccgca

SEQ ID NO: 314045 - RNA, 19 nt, Human
uagcuguaacaaaaaagaa

SEQ ID NO: 314046 - RNA, 20 nt, Human
uaggauauuucuugacaaga

SEQ ID NO: 314047 - RNA, 19 nt, Human
uauauauauauauauauau

SEQ ID NO: 314048 - RNA, 19 nt, Human
uauauauauauauauauau

SEQ ID NO: 314049 - RNA, 19 nt, Human
uauauauauauauauauau

SEQ ID NO: 314050 - RNA, 19 nt, Human
uauauauauauauauauau

SEQ ID NO: 314051 - RNA, 21 nt, Human
uaucaacugacccaaacauca

SEQ ID NO: 314052 - RNA, 24 nt, Human
uaucaugucuuccagaaaagucau

SEQ ID NO: 314053 - RNA, 24 nt, Human
uauucuugauuaagaaaaauuuag

SEQ ID NO: 314054 - RNA, 19 nt, Human
ucaaagauagucuucagac

SEQ ID NO: 314055 - RNA, 22 nt, Human
ucaacagacacacacacugucu

SEQ ID NO: 314056 - RNA, 20 nt, Human
ucagaaagaaccgcugaaca

SEQ ID NO: 314057 - RNA, 20 nt, Human
ucaggauugucauauaauca

SEQ ID NO: 314058 - RNA, 19 nt, Human
ucaucaagaacaacaccau

SEQ ID NO: 314059 - RNA, 23 nt, Human
ucccaaaaaaauaaaaauaaaaa

SEQ ID NO: 314060 - RNA, 26 nt, Human
ucgcucacuuucccucuuuccucggg

SEQ ID NO: 314061 - RNA, 18 nt, Human
ucuaaaggcaugaaaagg

SEQ ID NO: 314062 - RNA, 24 nt, Human
ucuaugcugaaauuugccuccagu

SEQ ID NO: 314063 - RNA, 19 nt, Human
ucucagagaguucuaccca

SEQ ID NO: 314064 - RNA, 19 nt, Human
ucuuaaaaaaacagaguac

SEQ ID NO: 314065 - RNA, 24 nt, Human
ugaaaaugucugucacauagguac

SEQ ID NO: 314066 - RNA, 24 nt, Human
ugaacacauaauaggauuuacuaa

SEQ ID NO: 314067 - RNA, 26 nt, Human
ugaacacauaauaggauuuacuaaaa

SEQ ID NO: 314068 - RNA, 28 nt, Human
ugaauaaaaccacaacaauacauguaga

SEQ ID NO: 314069 - RNA, 22 nt, Human
ugacccaaacaucauaccccaa

SEQ ID NO: 314070 - RNA, 20 nt, Human
ugaguaguagguguaucauu

SEQ ID NO: 314071 - RNA, 24 nt, Human
ugcagaagauacaaaagcuccacu

SEQ ID NO: 314072 - RNA, 18 nt, Human
ugcugaaauuugccucca

SEQ ID NO: 314073 - RNA, 20 nt, Human
ugcuuacuggauaucauucu

SEQ ID NO: 314074 - RNA, 19 nt, Human
ugcuucaaguugauucugc

SEQ ID NO: 314075 - RNA, 19 nt, Human
ugcuuugaauguugacagc

SEQ ID NO: 314076 - RNA, 20 nt, Human
uguaacccgguguccgcucc

SEQ ID NO: 314077 - RNA, 25 nt, Human
uguacccacacauacuuccccuaaa

SEQ ID NO: 314078 - RNA, 23 nt, Human
uguaucaugucuuccagaaaagu

SEQ ID NO: 314079 - RNA, 21 nt, Human
ugugguugguugguugguugg

SEQ ID NO: 314080 - RNA, 23 nt, Human
uguuguuguucuuguuguauugu

SEQ ID NO: 314081 - RNA, 23 nt, Human
uguuuuguuuuuguacagagagu

SEQ ID NO: 314082 - RNA, 19 nt, Human
uuacaugggugucaggauu

SEQ ID NO: 314083 - RNA, 20 nt, Human
uuaguucuauggaaccugug

SEQ ID NO: 314084 - RNA, 22 nt, Human
uucaacuccaauccacagugac

SEQ ID NO: 314085 - RNA, 31 nt, Human
uuccuuuuuaauuuauauauauauauauauu

SEQ ID NO: 314086 - RNA, 23 nt, Human
uucuggucaggugcccccagucc

SEQ ID NO: 314087 - RNA, 20 nt, Human
uugaaacauucguuucccuu

SEQ ID NO: 314088 - RNA, 19 nt, Human
uugaugggcuacccacagu

SEQ ID NO: 314089 - RNA, 20 nt, Human
uuguuuuguuuuuguacaga

SEQ ID NO: 314090 - RNA, 19 nt, Human
uuuauauauauauauauau

SEQ ID NO: 314091 - RNA, 19 nt, Human
uuuauauauauauauauau

SEQ ID NO: 314092 - RNA, 20 nt, Human
uuuauauauauauauauauu

SEQ ID NO: 314093 - RNA, 19 nt, Human
uuucuugacaagaugcuua

SEQ ID NO: 314094 - RNA, 24 nt, Human
uuuucaacuccaauccacagugac

SEQ ID NO: 314095 - RNA, 18 nt, Human
uuuugcucuuguugcacu

SEQ ID NO: 314096 - RNA, 18 nt, Human
aaaaggccaugauggaga

SEQ ID NO: 314097 - RNA, 23 nt, Human
aaacaaaaacuacagaaaacgca

SEQ ID NO: 314098 - RNA, 18 nt, Human
aacaaaaacuacagaaaa

SEQ ID NO: 314099 - RNA, 21 nt, Human
aacaaaaacuacagaaaacgc

SEQ ID NO: 314100 - RNA, 24 nt, Human
aacauacuuauuacacauauuuau

SEQ ID NO: 314101 - RNA, 21 nt, Human
aagaaaaaacuucaaaaaaga

SEQ ID NO: 314102 - RNA, 22 nt, Human
aagcaucucaguaaaacaaaaa

SEQ ID NO: 314103 - RNA, 21 nt, Human
acaagaaaaaacuucaaaaaa

SEQ ID NO: 314104 - RNA, 20 nt, Human
acacacauccaacccuacca

SEQ ID NO: 314105 - RNA, 18 nt, Human
acuacagccagaacugua

SEQ ID NO: 314106 - RNA, 21 nt, Human
acuucagaaaauugugaagua

SEQ ID NO: 314107 - RNA, 23 nt, Human
agaaaaaaaaaaaaaucucaaaa

SEQ ID NO: 314108 - RNA, 18 nt, Human
agagauggcaaagaucug

SEQ ID NO: 314109 - RNA, 22 nt, Human
agccaaggucauaacuacagcc

SEQ ID NO: 314110 - RNA, 21 nt, Human
agguggucccagggcuuuauu

SEQ ID NO: 314111 - RNA, 23 nt, Human
auaaacaaagguuuggggucaag

SEQ ID NO: 314112 - RNA, 22 nt, Human
aucaagcacuucauuaaaaaaa

SEQ ID NO: 314113 - RNA, 19 nt, Human
aucgcacuuugguauccuu

SEQ ID NO: 314114 - RNA, 18 nt, Human
aucucagauguuacaaga

SEQ ID NO: 314115 - RNA, 21 nt, Human
auguguacauguauauguaca

SEQ ID NO: 314116 - RNA, 21 nt, Human
caaaaaagaaaucaaauucau

SEQ ID NO: 314117 - RNA, 26 nt, Human
caaauaagucacaaaaaguaggcugu

SEQ ID NO: 314118 - RNA, 22 nt, Human
cacaaauaagucacaaaaagua

SEQ ID NO: 314119 - RNA, 20 nt, Human
cacauauuuaucaacaaggc

SEQ ID NO: 314120 - RNA, 19 nt, Human
cagaaaacgcaaaguaaaa

SEQ ID NO: 314121 - RNA, 18 nt, Human
cauuuuacauuguaccaa

SEQ ID NO: 314122 - RNA, 18 nt, Human
ccccaaagugguugucuc

SEQ ID NO: 314123 - RNA, 21 nt, Human
ccccaaagugguugucucuuu

SEQ ID NO: 314124 - RNA, 22 nt, Human
ccgaaagcacgaggaaggaccu

SEQ ID NO: 314125 - RNA, 24 nt, Human
cugcugcaugugggcuuaaagagc

SEQ ID NO: 314126 - RNA, 21 nt, Human
cuucuugcaaacccuuuaaag

SEQ ID NO: 314127 - RNA, 24 nt, Human
gaaaacgcaaaguaaaaucagaga

SEQ ID NO: 314128 - RNA, 19 nt, Human
gaagccaaggucauaacua

SEQ ID NO: 314129 - RNA, 23 nt, Human
gaggcaccagauuuuuuuuuuuu

SEQ ID NO: 314130 - RNA, 22 nt, Human
gagguggucccagggcuuuauu

SEQ ID NO: 314131 - RNA, 24 nt, Human
gccaauuaugucuccuuccaucau

SEQ ID NO: 314132 - RNA, 24 nt, Human
gccaccgaaagcacgaggaaggac

SEQ ID NO: 314133 - RNA, 18 nt, Human
ggaaaugucagugaccac

SEQ ID NO: 314134 - RNA, 20 nt, Human
ggacuugggaaaugucagug

SEQ ID NO: 314135 - RNA, 24 nt, Human
guauguguacauguauauguacau

SEQ ID NO: 314136 - RNA, 19 nt, Human
guggggaaacugaggcacc

SEQ ID NO: 314137 - RNA, 18 nt, Human
guugucucuuugauccuu

SEQ ID NO: 314138 - RNA, 19 nt, Human
uaaaaaucaaaguaaggcc

SEQ ID NO: 314139 - RNA, 22 nt, Human
uaaaacaaaaacuacagaaaac

SEQ ID NO: 314140 - RNA, 24 nt, Human
uaaaacaaaaacuacagaaaacgc

SEQ ID NO: 314141 - RNA, 19 nt, Human
uaacauaacagaaacaaac

SEQ ID NO: 314142 - RNA, 20 nt, Human
uaacauaacagaaacaaaca

SEQ ID NO: 314143 - RNA, 19 nt, Human
uaacuucuugaccaacuuu

SEQ ID NO: 314144 - RNA, 20 nt, Human
uaagaugauacuuggacuug

SEQ ID NO: 314145 - RNA, 24 nt, Human
uacagaaaacgcaaaguaaaauca

SEQ ID NO: 314146 - RNA, 18 nt, Human
uaccaaaggaagacaaac

SEQ ID NO: 314147 - RNA, 24 nt, Human
uaccaaaggaagacaaacaguuuc

SEQ ID NO: 314148 - RNA, 25 nt, Human
uaccaaaggaagacaaacaguuuca

SEQ ID NO: 314149 - RNA, 22 nt, Human
uauauguacaucuacauguaua

SEQ ID NO: 314150 - RNA, 20 nt, Human
uauauuuaacucaccugucu

SEQ ID NO: 314151 - RNA, 24 nt, Human
uaucuugaaacuacacacauccaa

SEQ ID NO: 314152 - RNA, 19 nt, Human
uaugauaauuaauuaaauu

SEQ ID NO: 314153 - RNA, 19 nt, Human
uauguacaucuacauguau

SEQ ID NO: 314154 - RNA, 22 nt, Human
uauguacaucuacauguauaua

SEQ ID NO: 314155 - RNA, 22 nt, Human
uauguguauguguacauguaua

SEQ ID NO: 314156 - RNA, 23 nt, Human
uauguguauguguacauguauau

SEQ ID NO: 314157 - RNA, 24 nt, Human
uauguguauguguacauguauaug

SEQ ID NO: 314158 - RNA, 21 nt, Human
uauuucaaauguaccagguua

SEQ ID NO: 314159 - RNA, 26 nt, Human
uauuucaaauguaccagguuacuugc

SEQ ID NO: 314160 - RNA, 25 nt, Human
ucaccugucuuguuggcaucaccuc

SEQ ID NO: 314161 - RNA, 23 nt, Human
uccuuaaacaaaacuggccccua

SEQ ID NO: 314162 - RNA, 21 nt, Human
ucuacaguuagacagggaagc

SEQ ID NO: 314163 - RNA, 23 nt, Human
ucugccaauuaugucuccuucca

SEQ ID NO: 314164 - RNA, 18 nt, Human
ugaaacuacacacaucca

SEQ ID NO: 314165 - RNA, 19 nt, Human
ugaaaugauggcucaaauc

SEQ ID NO: 314166 - RNA, 21 nt, Human
ugaauuuaaagcaguuaaaca

SEQ ID NO: 314167 - RNA, 20 nt, Human
ugacccacaggucuugccuc

SEQ ID NO: 314168 - RNA, 21 nt, Human
ugaguugucuuaaaaucagaa

SEQ ID NO: 314169 - RNA, 18 nt, Human
ugcaauaauauuuaugug

SEQ ID NO: 314170 - RNA, 24 nt, Human
ugccauggggaguacauuuaagac

SEQ ID NO: 314171 - RNA, 25 nt, Human
uggccccuauugugucuguacuuga

SEQ ID NO: 314172 - RNA, 21 nt, Human
ugguaaaaaaaaaaaauugua

SEQ ID NO: 314173 - RNA, 23 nt, Human
ugguauauuuaacucaccugucu

SEQ ID NO: 314174 - RNA, 21 nt, Human
uguaaaaaaaagaacaccaca

SEQ ID NO: 314175 - RNA, 21 nt, Human
uguacaucuacauguauauau

SEQ ID NO: 314176 - RNA, 19 nt, Human
uguacauguauauguacau

SEQ ID NO: 314177 - RNA, 21 nt, Human
uguagaauuacuaaacuguca

SEQ ID NO: 314178 - RNA, 21 nt, Human
ugucaaaauuuuaucuuggcc

SEQ ID NO: 314179 - RNA, 20 nt, Human
uguguaaaaaaaagaacacc

SEQ ID NO: 314180 - RNA, 18 nt, Human
uguguacauguauaugua

SEQ ID NO: 314181 - RNA, 23 nt, Human
uguguauguguacauguauaugu

SEQ ID NO: 314182 - RNA, 24 nt, Human
uguguauguguacauguauaugua

SEQ ID NO: 314183 - RNA, 28 nt, Human
uguuacaagaaaaaacuucaaaaaagaa

SEQ ID NO: 314184 - RNA, 22 nt, Human
uuauaaacauaagcauggcauu

SEQ ID NO: 314185 - RNA, 22 nt, Human
uucaaaaaguuaacaaucauua

SEQ ID NO: 314186 - RNA, 25 nt, Human
uucuuacauaaacaaagguuugggg

SEQ ID NO: 314187 - RNA, 20 nt, Human
uuucaaaaaguuaacaauca

SEQ ID NO: 314188 - RNA, 22 nt, Human
uuuuuuuuuuuuuaaagauuug

SEQ ID NO: 314189 - RNA, 19 nt, Human
uuuuuuuuuuuuuuuuuaa

SEQ ID NO: 314190 - RNA, 21 nt, Human
aaacacauauccaaauuuuaa

SEQ ID NO: 314191 - RNA, 24 nt, Human
aaaugugauuuuugagacagaaug

SEQ ID NO: 314192 - RNA, 22 nt, Human
agaaggcugagcuagaguuguu

SEQ ID NO: 314193 - RNA, 19 nt, Human
agacagaaugaaacacaua

SEQ ID NO: 314194 - RNA, 23 nt, Human
agacagaaugaaacacauaucca

SEQ ID NO: 314195 - RNA, 24 nt, Human
agacagaaugaaacacauauccaa

SEQ ID NO: 314196 - RNA, 21 nt, Human
auccugaauaaaugagaacuc

SEQ ID NO: 314197 - RNA, 21 nt, Human
gaaccagaagaccucugagug

SEQ ID NO: 314198 - RNA, 26 nt, Human
ugaaacacauauccaaauuuuaauac

SEQ ID NO: 314199 - RNA, 19 nt, Human
ugagaacucuagaaaauca

SEQ ID NO: 314200 - RNA, 20 nt, Human
aaaauucaagcuucagccuc

SEQ ID NO: 314201 - RNA, 20 nt, Human
aaaugcucucuggcuuuccu

SEQ ID NO: 314202 - RNA, 23 nt, Human
aaccugguauuccuccugucucc

SEQ ID NO: 314203 - RNA, 20 nt, Human
aaugcugaaaccaaauccua

SEQ ID NO: 314204 - RNA, 23 nt, Human
agguguuucaaaggaaaugaaga

SEQ ID NO: 314205 - RNA, 18 nt, Human
augaagacgagaaaaaaa

SEQ ID NO: 314206 - RNA, 21 nt, Human
caauaacagcuugcuagggac

SEQ ID NO: 314207 - RNA, 20 nt, Human
cagacuccuagaucuucacu

SEQ ID NO: 314208 - RNA, 22 nt, Human
cagagugugaaaagugccuccc

SEQ ID NO: 314209 - RNA, 21 nt, Human
cagcuugcuagggacuuccaa

SEQ ID NO: 314210 - RNA, 21 nt, Human
ccacuagguccaacccaguuu

SEQ ID NO: 314211 - RNA, 23 nt, Human
ccugacugcgggcucaggacaca

SEQ ID NO: 314212 - RNA, 18 nt, Human
cuaaugcugaaaccaaau

SEQ ID NO: 314213 - RNA, 19 nt, Human
cucacgacaacaccacuag

SEQ ID NO: 314214 - RNA, 22 nt, Human
cuccugguuagguggcacuccu

SEQ ID NO: 314215 - RNA, 22 nt, Human
cucuggggaaaugcagagggcu

SEQ ID NO: 314216 - RNA, 22 nt, Human
cuggccuccugguuagguggca

SEQ ID NO: 314217 - RNA, 20 nt, Human
cuuccaaaacccauacuaug

SEQ ID NO: 314218 - RNA, 18 nt, Human
gacaacaccacuaggucc

SEQ ID NO: 314219 - RNA, 19 nt, Human
gacaacaccacuaggucca

SEQ ID NO: 314220 - RNA, 18 nt, Human
ggagccugagggaagcuc

SEQ ID NO: 314221 - RNA, 22 nt, Human
gucaagcuuaguaguuuucucu

SEQ ID NO: 314222 - RNA, 23 nt, Human
uaaccuaaucuuaccaauaacag

SEQ ID NO: 314223 - RNA, 19 nt, Human
uaagcugcgaggaaccacu

SEQ ID NO: 314224 - RNA, 20 nt, Human
uaaugcugaaaccaaauccu

SEQ ID NO: 314225 - RNA, 19 nt, Human
uagagguuuuuccucaccc

SEQ ID NO: 314226 - RNA, 27 nt, Human
uagccgauccucuucagucauagauuc

SEQ ID NO: 314227 - RNA, 23 nt, Human
uaugaguuccuuucaggauguuu

SEQ ID NO: 314228 - RNA, 24 nt, Human
uaugaguuccuuucaggauguuuu

SEQ ID NO: 314229 - RNA, 19 nt, Human
uauuccuccugucucccuc

SEQ ID NO: 314230 - RNA, 23 nt, Human
ucaaaugcucucuggcuuuccua

SEQ ID NO: 314231 - RNA, 24 nt, Human
ucagucauagauucuguuucuucu

SEQ ID NO: 314232 - RNA, 18 nt, Human
uccacacagguucgggga

SEQ ID NO: 314233 - RNA, 24 nt, Human
ucccucagucacucacagauguca

SEQ ID NO: 314234 - RNA, 21 nt, Human
ucucucuggggaaaugcagag

SEQ ID NO: 314235 - RNA, 18 nt, Human
ucucuggggaaaugcaga

SEQ ID NO: 314236 - RNA, 18 nt, Human
ucuuaccaauaacagcuu

SEQ ID NO: 314237 - RNA, 21 nt, Human
ucuugugcuguaugaguuccu

SEQ ID NO: 314238 - RNA, 24 nt, Human
ugaccagggauguguucucccagc

SEQ ID NO: 314239 - RNA, 21 nt, Human
ugcuuggccaauguagagguu

SEQ ID NO: 314240 - RNA, 20 nt, Human
uggaaaggacuguacuugug

SEQ ID NO: 314241 - RNA, 21 nt, Human
ugggaugaauugggaucugcu

SEQ ID NO: 314242 - RNA, 22 nt, Human
uggggaaaugcagagggcuugu

SEQ ID NO: 314243 - RNA, 25 nt, Human
uucaaaggaaaugaagacgagaaaa

SEQ ID NO: 314244 - RNA, 24 nt, Human
uuggccaauguagagguuuuuccu

SEQ ID NO: 314245 - RNA, 25 nt, Human
aagaaaaaguaaauaaugaagaaaa

SEQ ID NO: 314246 - RNA, 18 nt, Human
aaugaaaacaaugagaga

SEQ ID NO: 314247 - RNA, 22 nt, Human
acacaacaccccaacccacccc

SEQ ID NO: 314248 - RNA, 23 nt, Human
acacaacaccccaacccaccccu

SEQ ID NO: 314249 - RNA, 24 nt, Human
acacaacaccccaacccaccccuc

SEQ ID NO: 314250 - RNA, 24 nt, Human
acccugugucuacuaaaaauacaa

SEQ ID NO: 314251 - RNA, 24 nt, Human
accugagguugggaguucaagacc

SEQ ID NO: 314252 - RNA, 24 nt, Human
acuaaaaauacaaaauuauccugg

SEQ ID NO: 314253 - RNA, 23 nt, Human
acugaaauacacaggugauucug

SEQ ID NO: 314254 - RNA, 18 nt, Human
agaaacuccaucucaaaa

SEQ ID NO: 314255 - RNA, 24 nt, Human
agauagucuagugagaagcugagc

SEQ ID NO: 314256 - RNA, 24 nt, Human
agcacuuugggaggcugaggaggg

SEQ ID NO: 314257 - RNA, 21 nt, Human
agccauaaagaaggugcagcc

SEQ ID NO: 314258 - RNA, 23 nt, Human
agccauaaagaaggugcagcccu

SEQ ID NO: 314259 - RNA, 22 nt, Human
aggaggguggaucaccugaggu

SEQ ID NO: 314260 - RNA, 25 nt, Human
aggcagaaaucucuuuaacaugcag

SEQ ID NO: 314261 - RNA, 18 nt, Human
aggcaggagaaucgccug

SEQ ID NO: 314262 - RNA, 24 nt, Human
aggcggacuuugcggugagccgag

SEQ ID NO: 314263 - RNA, 20 nt, Human
aggcugaggcaggagaaucg

SEQ ID NO: 314264 - RNA, 20 nt, Human
aggcugaggcaggagaaucg

SEQ ID NO: 314265 - RNA, 20 nt, Human
aggcugggugcgguggcuca

SEQ ID NO: 314266 - RNA, 26 nt, Human
aggugcagcccuagucugccaugucu

SEQ ID NO: 314267 - RNA, 18 nt, Human
auaaagaaggugcagccc

SEQ ID NO: 314268 - RNA, 21 nt, Human
auacacaacaccccaacccac

SEQ ID NO: 314269 - RNA, 23 nt, Human
auacauacacaacaccccaaccc

SEQ ID NO: 314270 - RNA, 23 nt, Human
aucaccugagguugggaguucaa

SEQ ID NO: 314271 - RNA, 24 nt, Human
aucgcgccaaugcacuccagccug

SEQ ID NO: 314272 - RNA, 19 nt, Human
augccuguaaucccagcac

SEQ ID NO: 314273 - RNA, 22 nt, Human
caacccaccccuccacacugaa

SEQ ID NO: 314274 - RNA, 19 nt, Human
caaugcacuccagccuggg

SEQ ID NO: 314275 - RNA, 22 nt, Human
caaugcacuccagccugggcaa

SEQ ID NO: 314276 - RNA, 23 nt, Human
caaugcacuccagccugggcaac

SEQ ID NO: 314277 - RNA, 24 nt, Human
caaugcacuccagccugggcaaca

SEQ ID NO: 314278 - RNA, 21 nt, Human
caccccaacccaccccuccac

SEQ ID NO: 314279 - RNA, 26 nt, Human
caccccaacccaccccuccacacuga

SEQ ID NO: 314280 - RNA, 23 nt, Human
caccugagguugggaguucaaga

SEQ ID NO: 314281 - RNA, 23 nt, Human
cacuuugggugaugaagaccagg

SEQ ID NO: 314282 - RNA, 23 nt, Human
cagcacuuugggaggcugaggag

SEQ ID NO: 314283 - RNA, 26 nt, Human
cagcacuuugggaggcugaggagggu

SEQ ID NO: 314284 - RNA, 21 nt, Human
cagcauaaaguuucacaugga

SEQ ID NO: 314285 - RNA, 24 nt, Human
cagccugaccaacauggagaaacc

SEQ ID NO: 314286 - RNA, 18 nt, Human
cagccugggcaacaagag

SEQ ID NO: 314287 - RNA, 24 nt, Human
cagcuacucaggaggcugaggcag

SEQ ID NO: 314288 - RNA, 22 nt, Human
caggacgcagcagauccagagg

SEQ ID NO: 314289 - RNA, 19 nt, Human
caggcuucuugccucgaag

SEQ ID NO: 314290 - RNA, 20 nt, Human
caugccuguaaucccagcac

SEQ ID NO: 314291 - RNA, 24 nt, Human
caugccuguaaucccagcacuuug

SEQ ID NO: 314292 - RNA, 18 nt, Human
cauggagaauaagggaga

SEQ ID NO: 314293 - RNA, 19 nt, Human
ccaacccaccccuccacac

SEQ ID NO: 314294 - RNA, 21 nt, Human
ccaacccaccccuccacacug

SEQ ID NO: 314295 - RNA, 21 nt, Human
ccaaugcacuccagccugggc

SEQ ID NO: 314296 - RNA, 22 nt, Human
ccaaugcacuccagccugggca

SEQ ID NO: 314297 - RNA, 23 nt, Human
ccaaugcacuccagccugggcaa

SEQ ID NO: 314298 - RNA, 24 nt, Human
ccaaugcacuccagccugggcaac

SEQ ID NO: 314299 - RNA, 24 nt, Human
cccaccccuccacacugaaauaca

SEQ ID NO: 314300 - RNA, 22 nt, Human
ccugaccaacauggagaaaccc

SEQ ID NO: 314301 - RNA, 24 nt, Human
ccugaccaacauggagaaacccug

SEQ ID NO: 314302 - RNA, 21 nt, Human
ccugcaggacgcagcagaucc

SEQ ID NO: 314303 - RNA, 22 nt, Human
ccuguaaucccagcacuuuggg

SEQ ID NO: 314304 - RNA, 21 nt, Human
ccuguaaucccagcuacucag

SEQ ID NO: 314305 - RNA, 24 nt, Human
cgagaucgcgccaaugcacuccag

SEQ ID NO: 314306 - RNA, 26 nt, Human
cgccaaugcacuccagccugggcaac

SEQ ID NO: 314307 - RNA, 26 nt, Human
cgcgccaaugcacuccagccugggca

SEQ ID NO: 314308 - RNA, 19 nt, Human
cuaaaaauacaaaauuauc

SEQ ID NO: 314309 - RNA, 24 nt, Human
cucaugccuguaaucccagcacuu

SEQ ID NO: 314310 - RNA, 19 nt, Human
cuggugugguggugcaugc

SEQ ID NO: 314311 - RNA, 21 nt, Human
gagaaacccugugucuacuaa

SEQ ID NO: 314312 - RNA, 23 nt, Human
gaggaggguggaucaccugaggu

SEQ ID NO: 314313 - RNA, 23 nt, Human
gaucaccugagguugggaguuca

SEQ ID NO: 314314 - RNA, 24 nt, Human
gaucaccugagguugggaguucaa

SEQ ID NO: 314315 - RNA, 21 nt, Human
gauugugaggugggguugggg

SEQ ID NO: 314316 - RNA, 22 nt, Human
gcagcccuagucugccaugucu

SEQ ID NO: 314317 - RNA, 22 nt, Human
gccaaugcacuccagccugggc

SEQ ID NO: 314318 - RNA, 26 nt, Human
gccaaugcacuccagccugggcaaca

SEQ ID NO: 314319 - RNA, 22 nt, Human
ggacagugagcuguuugcuucu

SEQ ID NO: 314320 - RNA, 24 nt, Human
ggacuuugcggugagccgagaucg

SEQ ID NO: 314321 - RNA, 24 nt, Human
ggaggguggaucaccugagguugg

SEQ ID NO: 314322 - RNA, 21 nt, Human
ggcucaugccuguaaucccag

SEQ ID NO: 314323 - RNA, 23 nt, Human
ggcugggugcgguggcucaugcc

SEQ ID NO: 314324 - RNA, 24 nt, Human
gggugcgguggcucaugccuguaa

SEQ ID NO: 314325 - RNA, 21 nt, Human
ggugcaugccuguaaucccag

SEQ ID NO: 314326 - RNA, 23 nt, Human
gguggcucaugccuguaauccca

SEQ ID NO: 314327 - RNA, 24 nt, Human
gguggcucaugccuguaaucccag

SEQ ID NO: 314328 - RNA, 24 nt, Human
gguggugcaugccuguaaucccag

SEQ ID NO: 314329 - RNA, 23 nt, Human
ggugugguggugcaugccuguaa

SEQ ID NO: 314330 - RNA, 23 nt, Human
gugacaggaaggaaaguucaggc

SEQ ID NO: 314331 - RNA, 23 nt, Human
guggugcaugccuguaaucccag

SEQ ID NO: 314332 - RNA, 21 nt, Human
uaaaacacauacauacacaac

SEQ ID NO: 314333 - RNA, 28 nt, Human
uaaaauaggcugggugcgguggcucaug

SEQ ID NO: 314334 - RNA, 18 nt, Human
uaaauuuucagcauaaag

SEQ ID NO: 314335 - RNA, 25 nt, Human
uaaauuuucagcauaaaguuucaca

SEQ ID NO: 314336 - RNA, 21 nt, Human
uaacaugcaggcgugauccca

SEQ ID NO: 314337 - RNA, 19 nt, Human
uaaguucuacuuugugaag

SEQ ID NO: 314338 - RNA, 23 nt, Human
uacaguaacaaguaagaaaaagu

SEQ ID NO: 314339 - RNA, 18 nt, Human
ucaccugagguugggagu

SEQ ID NO: 314340 - RNA, 23 nt, Human
ucaccugagguugggaguucaag

SEQ ID NO: 314341 - RNA, 22 nt, Human
ucaugccuguaaucccagcacu

SEQ ID NO: 314342 - RNA, 20 nt, Human
ucccaggcugaucugauucu

SEQ ID NO: 314343 - RNA, 18 nt, Human
ucuacuaaaaauacaaaa

SEQ ID NO: 314344 - RNA, 22 nt, Human
ugaaaacacuauaccuaaguuc

SEQ ID NO: 314345 - RNA, 25 nt, Human
ugacaggaaggaaaguucaggcuuc

SEQ ID NO: 314346 - RNA, 22 nt, Human
ugagccgagaucgcgccaaugc

SEQ ID NO: 314347 - RNA, 20 nt, Human
ugaggaggguggaucaccug

SEQ ID NO: 314348 - RNA, 21 nt, Human
ugaggaggguggaucaccuga

SEQ ID NO: 314349 - RNA, 24 nt, Human
ugaggaggguggaucaccugaggu

SEQ ID NO: 314350 - RNA, 20 nt, Human
ugaggcaggagaaucgccug

SEQ ID NO: 314351 - RNA, 25 nt, Human
ugaggcaggagaaucgccugggagg

SEQ ID NO: 314352 - RNA, 20 nt, Human
ugaggugggguuggggcacu

SEQ ID NO: 314353 - RNA, 19 nt, Human
ugcacuccagccugggcaa

SEQ ID NO: 314354 - RNA, 18 nt, Human
ugccucgaaggaguaggc

SEQ ID NO: 314355 - RNA, 23 nt, Human
ugccuguaaucccagcacuuugg

SEQ ID NO: 314356 - RNA, 24 nt, Human
ugccuguaaucccagcuacucagg

SEQ ID NO: 314357 - RNA, 24 nt, Human
uggaucaccugagguugggaguuc

SEQ ID NO: 314358 - RNA, 22 nt, Human
uggcucaugccuguaaucccag

SEQ ID NO: 314359 - RNA, 24 nt, Human
uggcucaugccuguaaucccagca

SEQ ID NO: 314360 - RNA, 21 nt, Human
ugggaggcggacuuugcggug

SEQ ID NO: 314361 - RNA, 24 nt, Human
ugggaggcggacuuugcggugagc

SEQ ID NO: 314362 - RNA, 23 nt, Human
ugggaggcugaggaggguggauc

SEQ ID NO: 314363 - RNA, 24 nt, Human
ugggaggcugaggaggguggauca

SEQ ID NO: 314364 - RNA, 22 nt, Human
uggggcacucauauacuuaaaa

SEQ ID NO: 314365 - RNA, 21 nt, Human
uggugcaugccuguaauccca

SEQ ID NO: 314366 - RNA, 24 nt, Human
ugguggugcaugccuguaauccca

SEQ ID NO: 314367 - RNA, 23 nt, Human
ugucagugguucuuaacugaagu

SEQ ID NO: 314368 - RNA, 19 nt, Human
uugcggugagccgagaucg

SEQ ID NO: 314369 - RNA, 22 nt, Human
uugcggugagccgagaucgcgc

SEQ ID NO: 314370 - RNA, 25 nt, Human
uugggaggcugaggaggguggauca

SEQ ID NO: 314371 - RNA, 22 nt, Human
uugggugaugaagaccaggcug

SEQ ID NO: 314372 - RNA, 24 nt, Human
uuuagaauuugaaaacacuauacc

SEQ ID NO: 314373 - RNA, 19 nt, Human
uuugcggugagccgagauc

SEQ ID NO: 314374 - RNA, 21 nt, Human
uuugcggugagccgagaucgc

SEQ ID NO: 314375 - RNA, 26 nt, Human
uuuuuuuuuuuuuuuuuuacaauuag

SEQ ID NO: 314376 - RNA, 22 nt, Human
aaagaggauucucccaugcaaa

SEQ ID NO: 314377 - RNA, 22 nt, Human
aaaggacacccgucucccaaca

SEQ ID NO: 314378 - RNA, 21 nt, Human
aagcggacguuuggggcggga

SEQ ID NO: 314379 - RNA, 23 nt, Human
accccggagccagaggagaaggg

SEQ ID NO: 314380 - RNA, 21 nt, Human
accgucccccugcccccacgc

SEQ ID NO: 314381 - RNA, 21 nt, Human
caccugcaugacgccgggcag

SEQ ID NO: 314382 - RNA, 20 nt, Human
cacgguccucaccuggaggc

SEQ ID NO: 314383 - RNA, 20 nt, Human
cagcgaguccccccuccccu

SEQ ID NO: 314384 - RNA, 18 nt, Human
cauucugcgcccccuacc

SEQ ID NO: 314385 - RNA, 22 nt, Human
ccaccgugccgccccgcacccc

SEQ ID NO: 314386 - RNA, 23 nt, Human
ccacgucgcccagcggcaucgug

SEQ ID NO: 314387 - RNA, 21 nt, Human
ccaggccccggcccugugcga

SEQ ID NO: 314388 - RNA, 20 nt, Human
cccacgccacgucgcccagc

SEQ ID NO: 314389 - RNA, 21 nt, Human
cccacgccacgucgcccagcg

SEQ ID NO: 314390 - RNA, 21 nt, Human
cccaugcaaaccccggagcca

SEQ ID NO: 314391 - RNA, 22 nt, Human
ccccaccgucccccugccccca

SEQ ID NO: 314392 - RNA, 23 nt, Human
ccccaccgucccccugcccccac

SEQ ID NO: 314393 - RNA, 21 nt, Human
cccccaccgucccccugcccc

SEQ ID NO: 314394 - RNA, 18 nt, Human
cccccacgccacgucgcc

SEQ ID NO: 314395 - RNA, 19 nt, Human
cccccacgccacgucgccc

SEQ ID NO: 314396 - RNA, 21 nt, Human
ccccccuccccuccuuucgga

SEQ ID NO: 314397 - RNA, 26 nt, Human
cccccugcccccacgccacgucgccc

SEQ ID NO: 314398 - RNA, 21 nt, Human
ccccgcacccccaaggucgcc

SEQ ID NO: 314399 - RNA, 23 nt, Human
ccccgcacccccaaggucgccca

SEQ ID NO: 314400 - RNA, 24 nt, Human
ccccgcacccccaaggucgcccag

SEQ ID NO: 314401 - RNA, 18 nt, Human
ccccgcccccuucccgcg

SEQ ID NO: 314402 - RNA, 20 nt, Human
ccccgcuucuucccccucuc

SEQ ID NO: 314403 - RNA, 21 nt, Human
ccccgcuucuucccccucuca

SEQ ID NO: 314404 - RNA, 23 nt, Human
ccccggagccagaggagaagggg

SEQ ID NO: 314405 - RNA, 21 nt, Human
ccccuucccgcggguaaagga

SEQ ID NO: 314406 - RNA, 24 nt, Human
cccgcagaugacccgggggaccgg

SEQ ID NO: 314407 - RNA, 19 nt, Human
cccgcccccuucccgcggg

SEQ ID NO: 314408 - RNA, 23 nt, Human
ccggcgaccggacgcggcggggc

SEQ ID NO: 314409 - RNA, 18 nt, Human
ccuggggcggggaggccg

SEQ ID NO: 314410 - RNA, 21 nt, Human
cgaggcgggcgcgcgcacucc

SEQ ID NO: 314411 - RNA, 21 nt, Human
cgcacccccaaggucgcccag

SEQ ID NO: 314412 - RNA, 21 nt, Human
cgccacgucgcccagcggcau

SEQ ID NO: 314413 - RNA, 25 nt, Human
cgccccgcacccccaaggucgccca

SEQ ID NO: 314414 - RNA, 18 nt, Human
cgccgggcagcgcgugga

SEQ ID NO: 314415 - RNA, 21 nt, Human
cgcgacugggcaggaaaaagg

SEQ ID NO: 314416 - RNA, 22 nt, Human
cucccaugcaaaccccggagcc

SEQ ID NO: 314417 - RNA, 18 nt, Human
cucccccgcccgcucucc

SEQ ID NO: 314418 - RNA, 19 nt, Human
cugcgcccccuacccccgg

SEQ ID NO: 314419 - RNA, 20 nt, Human
cugcgcccccuacccccggg

SEQ ID NO: 314420 - RNA, 19 nt, Human
cuuuacccgugaucacuga

SEQ ID NO: 314421 - RNA, 22 nt, Human
gacacgagacacgggggaggga

SEQ ID NO: 314422 - RNA, 24 nt, Human
gacgccgggcagcgcguggagcag

SEQ ID NO: 314423 - RNA, 18 nt, Human
gacuugggccccgcgacu

SEQ ID NO: 314424 - RNA, 21 nt, Human
gagcucccccgcccgcucucc

SEQ ID NO: 314425 - RNA, 19 nt, Human
gaguggcacagggggcgag

SEQ ID NO: 314426 - RNA, 21 nt, Human
gcagcgaguccccccuccccu

SEQ ID NO: 314427 - RNA, 23 nt, Human
gccacaguccgggcaggagaggg

SEQ ID NO: 314428 - RNA, 18 nt, Human
gccacgucgcccagcggc

SEQ ID NO: 314429 - RNA, 20 nt, Human
gccccgcacccccaaggucg

SEQ ID NO: 314430 - RNA, 18 nt, Human
gccccgcccccuucccgc

SEQ ID NO: 314431 - RNA, 18 nt, Human
gccgggcagcgcguggag

SEQ ID NO: 314432 - RNA, 22 nt, Human
ggagccagaggagaaggggaag

SEQ ID NO: 314433 - RNA, 20 nt, Human
ggauucucccaugcaaaccc

SEQ ID NO: 314434 - RNA, 20 nt, Human
ggccacagcacggggggcgg

SEQ ID NO: 314435 - RNA, 21 nt, Human
ggccccggcccugugcgaggc

SEQ ID NO: 314436 - RNA, 19 nt, Human
ggcggugaggccccgggga

SEQ ID NO: 314437 - RNA, 23 nt, Human
ggcucccccaccgucccccugcc

SEQ ID NO: 314438 - RNA, 25 nt, Human
gggaggccgaccgagagucgaagac

SEQ ID NO: 314439 - RNA, 25 nt, Human
gggcggagcugaguggcacaggggg

SEQ ID NO: 314440 - RNA, 25 nt, Human
gggcucccccaccgucccccugccc

SEQ ID NO: 314441 - RNA, 22 nt, Human
ggggaacccgcccgcagaugac

SEQ ID NO: 314442 - RNA, 18 nt, Human
gggggagggagaggggaa

SEQ ID NO: 314443 - RNA, 24 nt, Human
guccaggccccggcccugugcgag

SEQ ID NO: 314444 - RNA, 21 nt, Human
uaaauuacaaaguagagaaaa

SEQ ID NO: 314445 - RNA, 20 nt, Human
ucccaugcaaaccccggagc

SEQ ID NO: 314446 - RNA, 24 nt, Human
ucccgcuggucuguacagaugguc

SEQ ID NO: 314447 - RNA, 18 nt, Human
uccucaccuggaggccug

SEQ ID NO: 314448 - RNA, 22 nt, Human
uccuguggaagugcgggaggag

SEQ ID NO: 314449 - RNA, 19 nt, Human
ucuccccggcgaggccaca

SEQ ID NO: 314450 - RNA, 20 nt, Human
ucuuccuccccgcuucuucc

SEQ ID NO: 314451 - RNA, 19 nt, Human
ugacccgggggaccggcga

SEQ ID NO: 314452 - RNA, 24 nt, Human
ugacgccuggggcggggaggccga

SEQ ID NO: 314453 - RNA, 20 nt, Human
ugaguggcacagggggcgag

SEQ ID NO: 314454 - RNA, 20 nt, Human
uggaaagaggauucucccau

SEQ ID NO: 314455 - RNA, 22 nt, Human
ugggcaggaaaaaggggaggga

SEQ ID NO: 314456 - RNA, 20 nt, Human
ugggccccgcgacugggcag

SEQ ID NO: 314457 - RNA, 21 nt, Human
uggggcgggauuucuuccucc

SEQ ID NO: 314458 - RNA, 22 nt, Human
uguggaagugcgggaggaggcg

SEQ ID NO: 314459 - RNA, 23 nt, Human
ugugucauccacacguuuccugu

SEQ ID NO: 314460 - RNA, 26 nt, Human
uucucccaugcaaaccccggagccag

SEQ ID NO: 314461 - RNA, 19 nt, Human
aagcagagaaggggccagg

SEQ ID NO: 314462 - RNA, 19 nt, Human
agaaggggccaggccaccc

SEQ ID NO: 314463 - RNA, 24 nt, Human
agcgggagaggcugggaggggcug

SEQ ID NO: 314464 - RNA, 20 nt, Human
auaaagugcuaacuugcccc

SEQ ID NO: 314465 - RNA, 24 nt, Human
caggggcacuuugcuuagaagagg

SEQ ID NO: 314466 - RNA, 20 nt, Human
caucaggccguggagcuggu

SEQ ID NO: 314467 - RNA, 25 nt, Human
ccccaggcugucuaugggagacccu

SEQ ID NO: 314468 - RNA, 19 nt, Human
cuuugcuuagaagaggacu

SEQ ID NO: 314469 - RNA, 20 nt, Human
gaagaggacucuccuagcgg

SEQ ID NO: 314470 - RNA, 22 nt, Human
gccaggccaccccauucaggaa

SEQ ID NO: 314471 - RNA, 24 nt, Human
gggcaguccuggcggcagaacccg

SEQ ID NO: 314472 - RNA, 21 nt, Human
gggcucugggaagggggcagu

SEQ ID NO: 314473 - RNA, 19 nt, Human
gggcugcaucaggccgugg

SEQ ID NO: 314474 - RNA, 18 nt, Human
uacaguccguccaccacc

SEQ ID NO: 314475 - RNA, 21 nt, Human
uagaagaggacucuccuagcg

SEQ ID NO: 314476 - RNA, 23 nt, Human
uccugagcucuguuggguuccug

SEQ ID NO: 314477 - RNA, 19 nt, Human
ucuuuaagcagagaagggg

SEQ ID NO: 314478 - RNA, 20 nt, Human
ugagcucuguuggguuccug

SEQ ID NO: 314479 - RNA, 20 nt, Human
ugggaagggggcaguccugg

SEQ ID NO: 314480 - RNA, 21 nt, Human
ugggaagggggcaguccugga

SEQ ID NO: 314481 - RNA, 23 nt, Human
ugggaggggcugcaucaggccgu

SEQ ID NO: 314482 - RNA, 20 nt, Human
ugggauggaaucagugcauc

SEQ ID NO: 314483 - RNA, 19 nt, Human
uuccugggauggaaucagu

SEQ ID NO: 314484 - RNA, 21 nt, Human
aaggaaaacauggaacccaaa

SEQ ID NO: 314485 - RNA, 21 nt, Human
acugcgagcaaauggggugga

SEQ ID NO: 314486 - RNA, 18 nt, Human
agaaggaaugaucuggug

SEQ ID NO: 314487 - RNA, 21 nt, Human
aggcaugggagggaacaagga

SEQ ID NO: 314488 - RNA, 24 nt, Human
auggaacccaaagggaacugcagc

SEQ ID NO: 314489 - RNA, 25 nt, Human
cgagcaaaugggguggaggggugcu

SEQ ID NO: 314490 - RNA, 22 nt, Human
cugcgagcaaaugggguggagg

SEQ ID NO: 314491 - RNA, 19 nt, Human
gaacaaggaaaacauggaa

SEQ ID NO: 314492 - RNA, 23 nt, Human
gaacccaaagggaacugcagcga

SEQ ID NO: 314493 - RNA, 22 nt, Human
gagggaacaaggaaaacaugga

SEQ ID NO: 314494 - RNA, 23 nt, Human
gcuaauaguacacgguuuuccuc

SEQ ID NO: 314495 - RNA, 19 nt, Human
gggaacaaggaaaacaugg

SEQ ID NO: 314496 - RNA, 21 nt, Human
ggugguuaagauaaaacacaa

SEQ ID NO: 314497 - RNA, 22 nt, Human
uaacucugcaauccagcuaggc

SEQ ID NO: 314498 - RNA, 19 nt, Human
uaagauaaaacacaaguca

SEQ ID NO: 314499 - RNA, 19 nt, Human
ugggagggaacaaggaaaa

SEQ ID NO: 314500 - RNA, 26 nt, Human
ugggguggaggggugcucuccugagc

SEQ ID NO: 314501 - RNA, 26 nt, Human
aaaaaaaaaaagcaaauaauugaaag

SEQ ID NO: 314502 - RNA, 31 nt, Human
acacaacacacacacacacacacacacacag

SEQ ID NO: 314503 - RNA, 23 nt, Human
acacacacacacacacacacaca

SEQ ID NO: 314504 - RNA, 23 nt, Human
acacacacacacacacacacaca

SEQ ID NO: 314505 - RNA, 23 nt, Human
acacacacacacacacacacaca

SEQ ID NO: 314506 - RNA, 25 nt, Human
acacacacacacacacacacacagu

SEQ ID NO: 314507 - RNA, 25 nt, Human
acacacacacacacacacacacccc

SEQ ID NO: 314508 - RNA, 18 nt, Human
acacacaccccugccaaa

SEQ ID NO: 314509 - RNA, 25 nt, Human
agcaaauaauugaaagacaacacaa

SEQ ID NO: 314510 - RNA, 19 nt, Human
agcaccacuugaggaaggg

SEQ ID NO: 314511 - RNA, 20 nt, Human
cacacacacacacacacaca

SEQ ID NO: 314512 - RNA, 20 nt, Human
cacacacacacacacacaca

SEQ ID NO: 314513 - RNA, 20 nt, Human
cacacacacacacacacaca

SEQ ID NO: 314514 - RNA, 20 nt, Human
cacacacacacacacacaca

SEQ ID NO: 314515 - RNA, 20 nt, Human
cacacacacacacacacaca

SEQ ID NO: 314516 - RNA, 22 nt, Human
cacacacacacacacacacaca

SEQ ID NO: 314517 - RNA, 26 nt, Human
cacacacacacacacacacacacaca

SEQ ID NO: 314518 - RNA, 22 nt, Human
cacacacacacacacacacccu

SEQ ID NO: 314519 - RNA, 23 nt, Human
cacacaccccugccaaagcauau

SEQ ID NO: 314520 - RNA, 31 nt, Human
gacaacacaacacacacacacacacacacag

SEQ ID NO: 314521 - RNA, 19 nt, Human
gggauagaauacaaaaaga

SEQ ID NO: 314522 - RNA, 20 nt, Human
uaaguucaaagucccuaagc

SEQ ID NO: 314523 - RNA, 24 nt, Human
uagaauacaaaaagaaaguaaaaa

SEQ ID NO: 314524 - RNA, 23 nt, Human
uauccuuguuuucugccaguugu

SEQ ID NO: 314525 - RNA, 22 nt, Human
ucccuaagcaggugguuuacua

SEQ ID NO: 314526 - RNA, 22 nt, Human
ucugggacagcugacgggccuc

SEQ ID NO: 314527 - RNA, 19 nt, Human
ugaaagacaacacaacaca

SEQ ID NO: 314528 - RNA, 24 nt, Human
ugggauagaauacaaaaagaaagu

SEQ ID NO: 314529 - RNA, 21 nt, Human
uuugccaauucaaaguuuuuu

SEQ ID NO: 314530 - RNA, 26 nt, Human
uuuuuaguuuuaaaauagcaccacuu

SEQ ID NO: 314531 - RNA, 18 nt, Human
uuuuuuuuuuuuuuuuug

SEQ ID NO: 314532 - RNA, 22 nt, Human
uuuuuuuuuuuuuuuuugccaa

SEQ ID NO: 314533 - RNA, 23 nt, Human
uuuuuuuuuuuuuuuuugccaau

SEQ ID NO: 314534 - RNA, 18 nt, Human
aaaauuagcugggcgugg

SEQ ID NO: 314535 - RNA, 18 nt, Human
aaacaguaaggaacuaag

SEQ ID NO: 314536 - RNA, 23 nt, Human
aaagaaacaaacaaaaccacuuu

SEQ ID NO: 314537 - RNA, 20 nt, Human
aacuguaaacaguaaggaac

SEQ ID NO: 314538 - RNA, 19 nt, Human
aagacuggacaccauuauu

SEQ ID NO: 314539 - RNA, 24 nt, Human
aagcugaggcaggagaauugcuug

SEQ ID NO: 314540 - RNA, 24 nt, Human
aaggcgggguggaucacaagguca

SEQ ID NO: 314541 - RNA, 21 nt, Human
aauauggugaaaccccaucuc

SEQ ID NO: 314542 - RNA, 24 nt, Human
aauugcuugaacccgggaggcaga

SEQ ID NO: 314543 - RNA, 20 nt, Human
acacaauaagcaaaacugaa

SEQ ID NO: 314544 - RNA, 24 nt, Human
acagagcaagacuccaucucaaag

SEQ ID NO: 314545 - RNA, 24 nt, Human
accaauauggugaaaccccaucuc

SEQ ID NO: 314546 - RNA, 24 nt, Human
accccaucucuacuaaaaauacaa

SEQ ID NO: 314547 - RNA, 22 nt, Human
accccuaucaguacuccuaaac

SEQ ID NO: 314548 - RNA, 24 nt, Human
accgcacuccagccugggugacag

SEQ ID NO: 314549 - RNA, 26 nt, Human
accgcacuccagccugggugacagag

SEQ ID NO: 314550 - RNA, 19 nt, Human
accuaguggccgcccgggc

SEQ ID NO: 314551 - RNA, 23 nt, Human
acgugaccaauauggugaaaccc

SEQ ID NO: 314552 - RNA, 22 nt, Human
agaggaugcagugagccgagau

SEQ ID NO: 314553 - RNA, 24 nt, Human
agaggaugcagugagccgagauug

SEQ ID NO: 314554 - RNA, 24 nt, Human
agccugggugacagagcaagacuc

SEQ ID NO: 314555 - RNA, 23 nt, Human
agcugggcgugguggcacgugcc

SEQ ID NO: 314556 - RNA, 28 nt, Human
aggaguucaagaccaacgugacgugacc

SEQ ID NO: 314557 - RNA, 21 nt, Human
aggcagaggaugcagugagcc

SEQ ID NO: 314558 - RNA, 24 nt, Human
aggcagaggaugcagugagccgag

SEQ ID NO: 314559 - RNA, 24 nt, Human
aggcaggagaauugcuugaacccg

SEQ ID NO: 314560 - RNA, 22 nt, Human
aggccaaggcgggguggaucac

SEQ ID NO: 314561 - RNA, 20 nt, Human
aggcgggguggaucacaagg

SEQ ID NO: 314562 - RNA, 21 nt, Human
aggcgggguggaucacaaggu

SEQ ID NO: 314563 - RNA, 24 nt, Human
aucaacacacaauaagcaaaacug

SEQ ID NO: 314564 - RNA, 21 nt, Human
aucacaaggucaggaguucaa

SEQ ID NO: 314565 - RNA, 22 nt, Human
aucccagcacuuugggaggcca

SEQ ID NO: 314566 - RNA, 22 nt, Human
augcagugagccgagauugcgc

SEQ ID NO: 314567 - RNA, 20 nt, Human
auggugaaaccccaucucua

SEQ ID NO: 314568 - RNA, 24 nt, Human
auugcgccaccgcacuccagccug

SEQ ID NO: 314569 - RNA, 24 nt, Human
caauauggugaaaccccaucucua

SEQ ID NO: 314570 - RNA, 24 nt, Human
cacaccuguaaucccagcacuuug

SEQ ID NO: 314571 - RNA, 23 nt, Human
cacauaaccauuuuaaaaaacau

SEQ ID NO: 314572 - RNA, 24 nt, Human
caccgcacuccagccugggugaca

SEQ ID NO: 314573 - RNA, 19 nt, Human
caccuguaaucccagcacu

SEQ ID NO: 314574 - RNA, 24 nt, Human
caccuguaaucccagcacuuuggg

SEQ ID NO: 314575 - RNA, 22 nt, Human
cacuccagccugggugacagag

SEQ ID NO: 314576 - RNA, 23 nt, Human
cacuccagccugggugacagagc

SEQ ID NO: 314577 - RNA, 24 nt, Human
cagcacuuugggaggccaaggcgg

SEQ ID NO: 314578 - RNA, 20 nt, Human
cauaaccauuuuaaaaaaca

SEQ ID NO: 314579 - RNA, 26 nt, Human
caucucaaagaaacaaacaaaaccac

SEQ ID NO: 314580 - RNA, 23 nt, Human
cauuagggaucauauucauagac

SEQ ID NO: 314581 - RNA, 22 nt, Human
cauuuuaaaaaacauuuuacuu

SEQ ID NO: 314582 - RNA, 29 nt, Human
cauuuuaaaaaacauuuuacuuggccggu

SEQ ID NO: 314583 - RNA, 20 nt, Human
ccaccgcacuccagccuggg

SEQ ID NO: 314584 - RNA, 20 nt, Human
ccaccgcacuccagccuggg

SEQ ID NO: 314585 - RNA, 23 nt, Human
ccaccgcacuccagccuggguga

SEQ ID NO: 314586 - RNA, 24 nt, Human
ccaccgcacuccagccugggugac

SEQ ID NO: 314587 - RNA, 22 nt, Human
ccugggugacagagcaagacuc

SEQ ID NO: 314588 - RNA, 18 nt, Human
ccuguaaucccagcuacu

SEQ ID NO: 314589 - RNA, 21 nt, Human
ccuguaaucccagcuacuugg

SEQ ID NO: 314590 - RNA, 22 nt, Human
ccuguaaucccagcuacuuggg

SEQ ID NO: 314591 - RNA, 26 nt, Human
cgccaccgcacuccagccugggugac

SEQ ID NO: 314592 - RNA, 19 nt, Human
cgccggagaccggcagcga

SEQ ID NO: 314593 - RNA, 21 nt, Human
cgggaggcagaggaugcagug

SEQ ID NO: 314594 - RNA, 24 nt, Human
cgugccuguaaucccagcuacuug

SEQ ID NO: 314595 - RNA, 22 nt, Human
cucacaccuguaaucccagcac

SEQ ID NO: 314596 - RNA, 24 nt, Human
cucacaccuguaaucccagcacuu

SEQ ID NO: 314597 - RNA, 24 nt, Human
cuuggccgggcacgguggcucaca

SEQ ID NO: 314598 - RNA, 18 nt, Human
gaacccgggaggcagagg

SEQ ID NO: 314599 - RNA, 23 nt, Human
gagaauugcuugaacccgggagg

SEQ ID NO: 314600 - RNA, 23 nt, Human
gagauugcgccaccgcacuccag

SEQ ID NO: 314601 - RNA, 24 nt, Human
gaucacaaggucaggaguucaaga

SEQ ID NO: 314602 - RNA, 24 nt, Human
gcacuccagccugggugacagagc

SEQ ID NO: 314603 - RNA, 19 nt, Human
gccaccgcacuccagccug

SEQ ID NO: 314604 - RNA, 19 nt, Human
gcccgggccgcccaaacuc

SEQ ID NO: 314605 - RNA, 20 nt, Human
gccuguaaucccagcuacuu

SEQ ID NO: 314606 - RNA, 21 nt, Human
ggcacgugccuguaaucccag

SEQ ID NO: 314607 - RNA, 24 nt, Human
ggcgggguggaucacaaggucagg

SEQ ID NO: 314608 - RNA, 23 nt, Human
ggcgugguggcacgugccuguaa

SEQ ID NO: 314609 - RNA, 21 nt, Human
ggcucacaccuguaaucccag

SEQ ID NO: 314610 - RNA, 24 nt, Human
gggcacgguggcucacaccuguaa

SEQ ID NO: 314611 - RNA, 18 nt, Human
gggccgcccaaacuccag

SEQ ID NO: 314612 - RNA, 23 nt, Human
gguggaucacaaggucaggaguu

SEQ ID NO: 314613 - RNA, 24 nt, Human
gguggcacgugccuguaaucccag

SEQ ID NO: 314614 - RNA, 23 nt, Human
gguggcucacaccuguaauccca

SEQ ID NO: 314615 - RNA, 24 nt, Human
gguggcucacaccuguaaucccag

SEQ ID NO: 314616 - RNA, 19 nt, Human
gugaccaauauggugaaac

SEQ ID NO: 314617 - RNA, 23 nt, Human
guggaucacaaggucaggaguuc

SEQ ID NO: 314618 - RNA, 25 nt, Human
uaaggaacuaaggugucaaaagaaa

SEQ ID NO: 314619 - RNA, 24 nt, Human
uacaaguuuaaaaagacuggacac

SEQ ID NO: 314620 - RNA, 22 nt, Human
uagcugggcgugguggcacgug

SEQ ID NO: 314621 - RNA, 20 nt, Human
ucaacacacaauaagcaaaa

SEQ ID NO: 314622 - RNA, 21 nt, Human
ucacaaggucaggaguucaag

SEQ ID NO: 314623 - RNA, 24 nt, Human
ucacaaggucaggaguucaagacc

SEQ ID NO: 314624 - RNA, 24 nt, Human
uccagccugggugacagagcaaga

SEQ ID NO: 314625 - RNA, 21 nt, Human
uccaucucaaagaaacaaaca

SEQ ID NO: 314626 - RNA, 24 nt, Human
ucucaaagaaacaaacaaaaccac

SEQ ID NO: 314627 - RNA, 21 nt, Human
ucucuacuaaaaauacaaaaa

SEQ ID NO: 314628 - RNA, 19 nt, Human
ugaaaccccaucucuacua

SEQ ID NO: 314629 - RNA, 22 nt, Human
ugaccaauauggugaaacccca

SEQ ID NO: 314630 - RNA, 24 nt, Human
ugaccaauauggugaaaccccauc

SEQ ID NO: 314631 - RNA, 22 nt, Human
ugagccgagauugcgccaccgc

SEQ ID NO: 314632 - RNA, 24 nt, Human
ugaggcaggagaauugcuugaacc

SEQ ID NO: 314633 - RNA, 25 nt, Human
ugaggcaggagaauugcuugaaccc

SEQ ID NO: 314634 - RNA, 24 nt, Human
ugccuguaaucccagcuacuuggg

SEQ ID NO: 314635 - RNA, 22 nt, Human
uggaucacaaggucaggaguuc

SEQ ID NO: 314636 - RNA, 21 nt, Human
uggcacgugccuguaauccca

SEQ ID NO: 314637 - RNA, 21 nt, Human
uggcucacaccuguaauccca

SEQ ID NO: 314638 - RNA, 24 nt, Human
uggcucacaccuguaaucccagca

SEQ ID NO: 314639 - RNA, 25 nt, Human
ugggaggccaaggcgggguggauca

SEQ ID NO: 314640 - RNA, 24 nt, Human
ugguggcacgugccuguaauccca

SEQ ID NO: 314641 - RNA, 24 nt, Human
ugucaaaagaaacacauuagggau

SEQ ID NO: 314642 - RNA, 19 nt, Human
uuagcugggcgugguggca

SEQ ID NO: 314643 - RNA, 20 nt, Human
uuagcugggcgugguggcac

SEQ ID NO: 314644 - RNA, 24 nt, Human
uuagcugggcgugguggcacgugc

SEQ ID NO: 314645 - RNA, 18 nt, Human
uugcuugaacccgggagg

SEQ ID NO: 314646 - RNA, 24 nt, Human
uugcuugaacccgggaggcagagg

SEQ ID NO: 314647 - RNA, 23 nt, Human
uugggaagcugaggcaggagaau

SEQ ID NO: 314648 - RNA, 23 nt, Human
aaaaacgacagcagcaaaccaac

SEQ ID NO: 314649 - RNA, 28 nt, Human
aaaccaacaggcuucacaguaaccagga

SEQ ID NO: 314650 - RNA, 19 nt, Human
aacucaggucacaccacag

SEQ ID NO: 314651 - RNA, 18 nt, Human
aagacuuucacuuggaug

SEQ ID NO: 314652 - RNA, 18 nt, Human
aauccauguuccagaaau

SEQ ID NO: 314653 - RNA, 23 nt, Human
acccaucaccaucaccaugucca

SEQ ID NO: 314654 - RNA, 23 nt, Human
accuuggcugacagcccaacgcg

SEQ ID NO: 314655 - RNA, 21 nt, Human
acugcuccuacccccaugggc

SEQ ID NO: 314656 - RNA, 21 nt, Human
agcagcaaaccaacaggcuuc

SEQ ID NO: 314657 - RNA, 20 nt, Human
aucauguccacaaagaugcc

SEQ ID NO: 314658 - RNA, 20 nt, Human
caaaacugacugucccccuu

SEQ ID NO: 314659 - RNA, 18 nt, Human
caacugcuccuaccccca

SEQ ID NO: 314660 - RNA, 18 nt, Human
caaggggugggugacauc

SEQ ID NO: 314661 - RNA, 20 nt, Human
caccaugccagcacccuggc

SEQ ID NO: 314662 - RNA, 23 nt, Human
cacgggcggggagaacacagaac

SEQ ID NO: 314663 - RNA, 19 nt, Human
ccacaaagaugcccagaaa

SEQ ID NO: 314664 - RNA, 20 nt, Human
ccaucaccaucaccaugucc

SEQ ID NO: 314665 - RNA, 23 nt, Human
cggggagaacacagaacucaaac

SEQ ID NO: 314666 - RNA, 20 nt, Human
cuacccccaugggcccuccc

SEQ ID NO: 314667 - RNA, 20 nt, Human
cugacugucccccuugguca

SEQ ID NO: 314668 - RNA, 22 nt, Human
gaacacagaacucaaacugacg

SEQ ID NO: 314669 - RNA, 21 nt, Human
gacagcccaacgcggccaccu

SEQ ID NO: 314670 - RNA, 22 nt, Human
gaggucgugaggaagggugggu

SEQ ID NO: 314671 - RNA, 23 nt, Human
gcugacagcccaacgcggccacc

SEQ ID NO: 314672 - RNA, 24 nt, Human
gcugacagcccaacgcggccaccu

SEQ ID NO: 314673 - RNA, 19 nt, Human
ggaaaagacuuucacuugg

SEQ ID NO: 314674 - RNA, 18 nt, Human
ggcugggcaaucacaggc

SEQ ID NO: 314675 - RNA, 19 nt, Human
gggcgcgggucgggcggga

SEQ ID NO: 314676 - RNA, 24 nt, Human
gggugcauggacauuugcagcugc

SEQ ID NO: 314677 - RNA, 23 nt, Human
ggucaaggaaaagacuuucacuu

SEQ ID NO: 314678 - RNA, 20 nt, Human
uaacacacagaaaaaucaaa

SEQ ID NO: 314679 - RNA, 24 nt, Human
uaacacacagaaaaaucaaagccu

SEQ ID NO: 314680 - RNA, 19 nt, Human
uaacacaucaugaguagau

SEQ ID NO: 314681 - RNA, 18 nt, Human
uagcaacacaggaauucc

SEQ ID NO: 314682 - RNA, 21 nt, Human
ucacuuggauggcaacccauc

SEQ ID NO: 314683 - RNA, 18 nt, Human
ucccagguucaacugcuc

SEQ ID NO: 314684 - RNA, 18 nt, Human
ucccuagcagccuuccuc

SEQ ID NO: 314685 - RNA, 20 nt, Human
ucccuccggagcacaggagc

SEQ ID NO: 314686 - RNA, 23 nt, Human
ugcuccuacccccaugggcccuc

SEQ ID NO: 314687 - RNA, 24 nt, Human
ugggugcauggacauuugcagcug

SEQ ID NO: 314688 - RNA, 22 nt, Human
ugguggguccuggccgaggucu

SEQ ID NO: 314689 - RNA, 19 nt, Human
ugucuaggcacagcucaag

SEQ ID NO: 314690 - RNA, 20 nt, Human
ugugacaguggagugggcac

SEQ ID NO: 314691 - RNA, 20 nt, Human
uucacauuuaaggugaacac

SEQ ID NO: 314692 - RNA, 23 nt, Human
uucacauuuaaggugaacacaaa

SEQ ID NO: 314693 - RNA, 19 nt, Human
uuccucaggcacacuguga

SEQ ID NO: 314694 - RNA, 18 nt, Human
uugaauuucuuuaacaca

SEQ ID NO: 314695 - RNA, 24 nt, Human
uuuugcaaaacugacugucccccu

SEQ ID NO: 314696 - RNA, 20 nt, Human
uuuuuuuuuuuuuuuuccau

SEQ ID NO: 314697 - RNA, 24 nt, Human
uuuuuuuuuuuuuuuuuuccauag

SEQ ID NO: 314698 - RNA, 20 nt, Human
aaaaaaaacaaggacaacug

SEQ ID NO: 314699 - RNA, 23 nt, Human
aaaaaacaaggacaacugguggg

SEQ ID NO: 314700 - RNA, 24 nt, Human
aaaaacaaugaaaaggaaaacaac

SEQ ID NO: 314701 - RNA, 24 nt, Human
aaaagaccaaaaaaaaacaaggac

SEQ ID NO: 314702 - RNA, 22 nt, Human
aaaaggaaaacaacauaaagga

SEQ ID NO: 314703 - RNA, 24 nt, Human
aaaaggacaaacauaaaacaaucc

SEQ ID NO: 314704 - RNA, 18 nt, Human
aaacagaauggaaguaag

SEQ ID NO: 314705 - RNA, 24 nt, Human
aaacauaaaacaauccaaaaacaa

SEQ ID NO: 314706 - RNA, 22 nt, Human
aaagaccaaaaaaaaacaagga

SEQ ID NO: 314707 - RNA, 25 nt, Human
aaagaccaaaaaaaaacaaggacaa

SEQ ID NO: 314708 - RNA, 23 nt, Human
aaugaagaaaagaccaaaaaaaa

SEQ ID NO: 314709 - RNA, 22 nt, Human
accaaaaaaaaacaaggacaac

SEQ ID NO: 314710 - RNA, 25 nt, Human
accaaaaaaaaacaaggacaacuga

SEQ ID NO: 314711 - RNA, 20 nt, Human
acucaaugaaauccacauua

SEQ ID NO: 314712 - RNA, 23 nt, Human
agaaaagaccaaaaaaaaacaag

SEQ ID NO: 314713 - RNA, 26 nt, Human
aggaaaacaacauaaaggagauucau

SEQ ID NO: 314714 - RNA, 19 nt, Human
caaaaaaaaacaaggacaa

SEQ ID NO: 314715 - RNA, 19 nt, Human
caaaaaaaaacaaggacac

SEQ ID NO: 314716 - RNA, 25 nt, Human
caaacauaaaacaauccaaaaacaa

SEQ ID NO: 314717 - RNA, 18 nt, Human
caacugaucccugugcuc

SEQ ID NO: 314718 - RNA, 23 nt, Human
caacugaucccugugcuccugca

SEQ ID NO: 314719 - RNA, 23 nt, Human
cagauugcagauuaucaaaaaau

SEQ ID NO: 314720 - RNA, 21 nt, Human
cgaaacagaauggaaguaagu

SEQ ID NO: 314721 - RNA, 23 nt, Human
cgccgccagaaaaggcgcuaaag

SEQ ID NO: 314722 - RNA, 21 nt, Human
gaccaaaaaaaaacaaggaca

SEQ ID NO: 314723 - RNA, 26 nt, Human
uaagaaaaaaaaggacaaacauaaaa

SEQ ID NO: 314724 - RNA, 26 nt, Human
uagcaagucucucaaacuuaaaaucc

SEQ ID NO: 314725 - RNA, 18 nt, Human
ucaaaugaagaaaagacc

SEQ ID NO: 314726 - RNA, 24 nt, Human
uccaaaaacaaugaaaaggaaaac

SEQ ID NO: 314727 - RNA, 22 nt, Human
uccagauugcagauuaucaaaa

SEQ ID NO: 314728 - RNA, 23 nt, Human
ucccugugcuccugcaccgguag

SEQ ID NO: 314729 - RNA, 23 nt, Human
ucuucucuggguccgguccuuug

SEQ ID NO: 314730 - RNA, 22 nt, Human
ugaagaaaagaccaaaaaaaaa

SEQ ID NO: 314731 - RNA, 19 nt, Human
ugcagauuaucaaaaaauc

SEQ ID NO: 314732 - RNA, 21 nt, Human
uuaagaaaaaaaaggacaaac

SEQ ID NO: 314733 - RNA, 24 nt, Human
uucaaaugaagaaaagaccaaaaa

SEQ ID NO: 314734 - RNA, 18 nt, Human
uuuuuuuuuuuuuuuuug

SEQ ID NO: 314735 - RNA, 31 nt, Human
uuuuuuuuuuuuuuuuuuuuuuuuguuuuuu

SEQ ID NO: 314736 - RNA, 19 nt, Human
aagaacaccaccaagaaga

SEQ ID NO: 314737 - RNA, 21 nt, Human
aagaacaccaccaagaagaag

SEQ ID NO: 314738 - RNA, 20 nt, Human
aagaagaagggaaggccuga

SEQ ID NO: 314739 - RNA, 22 nt, Human
aggcagggaagcaaagacgggg

SEQ ID NO: 314740 - RNA, 21 nt, Human
aucucugacacuuccaugguc

SEQ ID NO: 314741 - RNA, 23 nt, Human
auggggcagcagcaggcagggaa

SEQ ID NO: 314742 - RNA, 23 nt, Human
cagauuaucuuacucaagaacac

SEQ ID NO: 314743 - RNA, 22 nt, Human
caguccagauuaucuuacucaa

SEQ ID NO: 314744 - RNA, 19 nt, Human
gcuccgacccggaagcaga

SEQ ID NO: 314745 - RNA, 24 nt, Human
ucuugaucaaauggggcagcagca

SEQ ID NO: 314746 - RNA, 25 nt, Human
ugaaucucugacacuuccauggucu

SEQ ID NO: 314747 - RNA, 21 nt, Human
aacaaauguaaaagacugaaa

SEQ ID NO: 314748 - RNA, 21 nt, Human
aagaagcagcauuaugguuca

SEQ ID NO: 314749 - RNA, 20 nt, Human
aagaagcugggcucaagaac

SEQ ID NO: 314750 - RNA, 21 nt, Human
aagagaaaagaagcauccuau

SEQ ID NO: 314751 - RNA, 20 nt, Human
aagugucagaaacagcacug

SEQ ID NO: 314752 - RNA, 24 nt, Human
agaacaaauguaaaagacugaaau

SEQ ID NO: 314753 - RNA, 25 nt, Human
agagaaaagaagcauccuauuaaaa

SEQ ID NO: 314754 - RNA, 21 nt, Human
agaugccaggccuccuaagcu

SEQ ID NO: 314755 - RNA, 20 nt, Human
agccggcggcggaaugcuug

SEQ ID NO: 314756 - RNA, 22 nt, Human
aucuagaagcugguucacuggg

SEQ ID NO: 314757 - RNA, 20 nt, Human
caaaaccacugagaaaugac

SEQ ID NO: 314758 - RNA, 23 nt, Human
caaaugcucuggcaaccuaggca

SEQ ID NO: 314759 - RNA, 23 nt, Human
caaauguaaaagacugaaauagg

SEQ ID NO: 314760 - RNA, 21 nt, Human
cauucuaugucaucuagaagc

SEQ ID NO: 314761 - RNA, 23 nt, Human
cccacaaaauccagaaagcggac

SEQ ID NO: 314762 - RNA, 19 nt, Human
ccugcuccuccccacaaaa

SEQ ID NO: 314763 - RNA, 20 nt, Human
ccuucuuagaaacuugauug

SEQ ID NO: 314764 - RNA, 20 nt, Human
cgagaagaagcugggcucag

SEQ ID NO: 314765 - RNA, 21 nt, Human
cgggaagcuggggugggagac

SEQ ID NO: 314766 - RNA, 21 nt, Human
cuccuaagcuucaugacuugc

SEQ ID NO: 314767 - RNA, 23 nt, Human
gacccgucgcugcugcacacuuc

SEQ ID NO: 314768 - RNA, 27 nt, Human
gagaaaagaagcauccuauuaaaaugu

SEQ ID NO: 314769 - RNA, 19 nt, Human
uaagcuucaugacuugcaa

SEQ ID NO: 314770 - RNA, 23 nt, Human
uaggccagaauauaaaucuccuu

SEQ ID NO: 314771 - RNA, 23 nt, Human
ucaagaacagaggaaaaugcaaa

SEQ ID NO: 314772 - RNA, 20 nt, Human
ucagagcagacaugcacaag

SEQ ID NO: 314773 - RNA, 23 nt, Human
ucauuuggcaaaaauucaaugug

SEQ ID NO: 314774 - RNA, 23 nt, Human
uccagaaaguuauuuuuauacau

SEQ ID NO: 314775 - RNA, 23 nt, Human
ucgauaccaggauuuggguggcc

SEQ ID NO: 314776 - RNA, 21 nt, Human
ucuccugcuccuccccacaaa

SEQ ID NO: 314777 - RNA, 23 nt, Human
ucuccuuucugagaguacuacuu

SEQ ID NO: 314778 - RNA, 23 nt, Human
ucugaagugucagaaacagcacu

SEQ ID NO: 314779 - RNA, 18 nt, Human
ugccgggaagcuggggug

SEQ ID NO: 314780 - RNA, 20 nt, Human
ugcucuggcaaccuaggcaa

SEQ ID NO: 314781 - RNA, 21 nt, Human
uggccaagacaaggaagagga

SEQ ID NO: 314782 - RNA, 22 nt, Human
ugggggaagagaaaagaagcau

SEQ ID NO: 314783 - RNA, 22 nt, Human
uguaaaagacugaaauagggcg

SEQ ID NO: 314784 - RNA, 21 nt, Human
ugucauucuaugucaucuaga

SEQ ID NO: 314785 - RNA, 19 nt, Human
uguggcuuugcgugggaug

SEQ ID NO: 314786 - RNA, 24 nt, Human
uguugauguucugguuuugagagg

SEQ ID NO: 314787 - RNA, 20 nt, Human
uuaaaagaacuugaguggcg

SEQ ID NO: 314788 - RNA, 21 nt, Human
uucauuuggcaaaaauucaau

SEQ ID NO: 314789 - RNA, 24 nt, Human
uucgauaccaggauuuggguggcc

SEQ ID NO: 314790 - RNA, 23 nt, Human
uucuaugucaucuagaagcuggu

SEQ ID NO: 314791 - RNA, 18 nt, Human
uuguggaaguuucuaugu

SEQ ID NO: 314792 - RNA, 21 nt, Human
aacaagcagacuccagccacc

SEQ ID NO: 314793 - RNA, 24 nt, Human
aacaagcagacuccagccaccagg

SEQ ID NO: 314794 - RNA, 23 nt, Human
accagggcuagggagaggacgac

SEQ ID NO: 314795 - RNA, 18 nt, Human
acguccacuccagcaccc

SEQ ID NO: 314796 - RNA, 25 nt, Human
agauaauaagcgagacuuguaaagc

SEQ ID NO: 314797 - RNA, 21 nt, Human
agauauuggcguggugaauaa

SEQ ID NO: 314798 - RNA, 21 nt, Human
agaugucaugccaggcagcag

SEQ ID NO: 314799 - RNA, 18 nt, Human
aggaguuuguugcuggga

SEQ ID NO: 314800 - RNA, 23 nt, Human
aggcagcagcccccacgggccca

SEQ ID NO: 314801 - RNA, 22 nt, Human
aguguacaggaaaagggaggaa

SEQ ID NO: 314802 - RNA, 22 nt, Human
caaaggauuuaaaugccagaac

SEQ ID NO: 314803 - RNA, 21 nt, Human
cagaguaacuacugaggaggc

SEQ ID NO: 314804 - RNA, 19 nt, Human
cagcaccgagggcuggaca

SEQ ID NO: 314805 - RNA, 23 nt, Human
caggcagcagcccccacgggccc

SEQ ID NO: 314806 - RNA, 22 nt, Human
ccacgggcccaggccuuugugg

SEQ ID NO: 314807 - RNA, 18 nt, Human
ccccacgggcccaggccu

SEQ ID NO: 314808 - RNA, 18 nt, Human
ccugcaccagggcuaggg

SEQ ID NO: 314809 - RNA, 18 nt, Human
cugaaacuaaggcuaaca

SEQ ID NO: 314810 - RNA, 20 nt, Human
cugaaacuaaggcuaacagc

SEQ ID NO: 314811 - RNA, 20 nt, Human
cugguggcugacaauuaacg

SEQ ID NO: 314812 - RNA, 18 nt, Human
cuuguccuucagugguuu

SEQ ID NO: 314813 - RNA, 19 nt, Human
gagaggacgacaccaagga

SEQ ID NO: 314814 - RNA, 19 nt, Human
gaguguacaggaaaaggga

SEQ ID NO: 314815 - RNA, 19 nt, Human
gcagcacaauccacuauca

SEQ ID NO: 314816 - RNA, 24 nt, Human
gccuuuguggggcagugucacugu

SEQ ID NO: 314817 - RNA, 22 nt, Human
ggaguguacaggaaaagggagg

SEQ ID NO: 314818 - RNA, 21 nt, Human
guggggcagugucacugucug

SEQ ID NO: 314819 - RNA, 22 nt, Human
uaaagcacugaaacuaaggcua

SEQ ID NO: 314820 - RNA, 18 nt, Human
uaacagcagcacaaucca

SEQ ID NO: 314821 - RNA, 20 nt, Human
uaagccagaaaucuggagag

SEQ ID NO: 314822 - RNA, 21 nt, Human
uacgucacucagggugaauga

SEQ ID NO: 314823 - RNA, 21 nt, Human
uaggugccgggacagucuggu

SEQ ID NO: 314824 - RNA, 21 nt, Human
uccagcaccgagggcuggaca

SEQ ID NO: 314825 - RNA, 24 nt, Human
ucggauggaaaguugguuuuaagc

SEQ ID NO: 314826 - RNA, 21 nt, Human
ugagauaauaagcgagacuug

SEQ ID NO: 314827 - RNA, 18 nt, Human
ugagcagaguaacuacug

SEQ ID NO: 314828 - RNA, 21 nt, Human
ugaggaguuuguugcugggag

SEQ ID NO: 314829 - RNA, 22 nt, Human
ugccagaacugugaaacauucu

SEQ ID NO: 314830 - RNA, 20 nt, Human
ugccaggcagcagcccccac

SEQ ID NO: 314831 - RNA, 23 nt, Human
ugggaguguacaggaaaagggag

SEQ ID NO: 314832 - RNA, 20 nt, Human
uggggcagugucacugucug

SEQ ID NO: 314833 - RNA, 19 nt, Human
ugguuuuaagccagaaauc

SEQ ID NO: 314834 - RNA, 18 nt, Human
ugucaugccaggcagcag

SEQ ID NO: 314835 - RNA, 21 nt, Human
ugugcaguuaucaugaggagu

SEQ ID NO: 314836 - RNA, 24 nt, Human
ugugugcaguuaucaugaggaguu

SEQ ID NO: 314837 - RNA, 23 nt, Human
uuaaaugccagaacugugaaaca

SEQ ID NO: 314838 - RNA, 20 nt, Human
uucaccuuuccuggcuugga

SEQ ID NO: 314839 - RNA, 21 nt, Human
uugggacgagaguugccuguc

SEQ ID NO: 314840 - RNA, 22 nt, Human
uuuaagccagaaaucuggagag

SEQ ID NO: 314841 - RNA, 19 nt, Human
uuucaugcuauaaauaaag

SEQ ID NO: 314842 - RNA, 22 nt, Human
uuuuaagccagaaaucuggaga

SEQ ID NO: 314843 - RNA, 23 nt, Human
aaacauuuagcccuauugucaca

SEQ ID NO: 314844 - RNA, 23 nt, Human
aaagcccucuuauauccuaaguu

SEQ ID NO: 314845 - RNA, 19 nt, Human
aaauagcaaggaaaacuuc

SEQ ID NO: 314846 - RNA, 25 nt, Human
aaauguugggaauuagcagcaccuc

SEQ ID NO: 314847 - RNA, 24 nt, Human
aauuaugaaaucagaaauaaaaaa

SEQ ID NO: 314848 - RNA, 22 nt, Human
agacacuuggcucuaagaaaca

SEQ ID NO: 314849 - RNA, 23 nt, Human
agcaaacacgagaagggaguaac

SEQ ID NO: 314850 - RNA, 18 nt, Human
caauuacuguguaucaga

SEQ ID NO: 314851 - RNA, 22 nt, Human
cacuaggcgcucgccggccaac

SEQ ID NO: 314852 - RNA, 24 nt, Human
caucuacaaaauccacauuuacaa

SEQ ID NO: 314853 - RNA, 21 nt, Human
ccccuuaaaaaaaguucaaca

SEQ ID NO: 314854 - RNA, 20 nt, Human
ccgccgaauccggcggcggg

SEQ ID NO: 314855 - RNA, 23 nt, Human
ccggucccacgcagcccgccgaa

SEQ ID NO: 314856 - RNA, 19 nt, Human
cgacgacgccgagaagggg

SEQ ID NO: 314857 - RNA, 22 nt, Human
cgccgagaagggggagggggcg

SEQ ID NO: 314858 - RNA, 24 nt, Human
cuggccgggaucccgccgguccca

SEQ ID NO: 314859 - RNA, 24 nt, Human
cuuaauaauuuacuuuaaaaaguu

SEQ ID NO: 314860 - RNA, 21 nt, Human
gccggagcgccggagcgagca

SEQ ID NO: 314861 - RNA, 24 nt, Human
uaagaaacauuaagugaaacacag

SEQ ID NO: 314862 - RNA, 26 nt, Human
uacaaaauccacauuuacaauacaag

SEQ ID NO: 314863 - RNA, 18 nt, Human
ugaaaaagaagggaauug

SEQ ID NO: 314864 - RNA, 20 nt, Human
ugaaacacaggucacuauga

SEQ ID NO: 314865 - RNA, 23 nt, Human
ugaaauagcaaggaaaacuucac

SEQ ID NO: 314866 - RNA, 24 nt, Human
ugaaauagcaaggaaaagggaggc

SEQ ID NO: 314867 - RNA, 20 nt, Human
ugaaaucagaaauaaaaaau

SEQ ID NO: 314868 - RNA, 21 nt, Human
ugucuggacuuguccgcgaga

SEQ ID NO: 314869 - RNA, 19 nt, Human
uuaaaagacacuuggcucu

SEQ ID NO: 314870 - RNA, 21 nt, Human
uuaagcaaacacgagaaggga

SEQ ID NO: 314871 - RNA, 22 nt, Human
uucacauauuuuaagcaaacac

SEQ ID NO: 314872 - RNA, 19 nt, Human
uuccaaaaagucaaacugu

SEQ ID NO: 314873 - RNA, 20 nt, Human
uuccaaaaagucaaacugua

SEQ ID NO: 314874 - RNA, 20 nt, Human
uugcacaguuuucaagacaa

SEQ ID NO: 314875 - RNA, 21 nt, Human
uuuggaaaaaccucauuuccc

SEQ ID NO: 314876 - RNA, 23 nt, Human
uuuuagauuguuuuaggcaaaca

SEQ ID NO: 314877 - RNA, 21 nt, Human
uuuuuuuuuuuuuuuuuucag

SEQ ID NO: 314878 - RNA, 18 nt, Human
aaaugagggagaaggaga

SEQ ID NO: 314879 - RNA, 24 nt, Human
acucccacccccagccuuuucggu

SEQ ID NO: 314880 - RNA, 24 nt, Human
auuuucaugaaugagaguugggga

SEQ ID NO: 314881 - RNA, 19 nt, Human
cacaauagguagggaugag

SEQ ID NO: 314882 - RNA, 20 nt, Human
cacccccagccuuuucgguc

SEQ ID NO: 314883 - RNA, 21 nt, Human
cacccccagccuuuucggucu

SEQ ID NO: 314884 - RNA, 21 nt, Human
cccacaauagguagggaugag

SEQ ID NO: 314885 - RNA, 20 nt, Human
cggaaacccacaauagguag

SEQ ID NO: 314886 - RNA, 21 nt, Human
gagagaaaaugagggagaagg

SEQ ID NO: 314887 - RNA, 22 nt, Human
ggcggcgggcaguacgccugag

SEQ ID NO: 314888 - RNA, 22 nt, Human
uccguccacucuguucuccccc

SEQ ID NO: 314889 - RNA, 22 nt, Human
ugagagaaaaugagggagaagg

SEQ ID NO: 314890 - RNA, 23 nt, Human
ugagagaaaaugagggagaagga

SEQ ID NO: 314891 - RNA, 23 nt, Human
uucaaauccgcuacucccacccc

SEQ ID NO: 314892 - RNA, 23 nt, Human
uuuucggucucuccuacucuccg

SEQ ID NO: 314893 - RNA, 19 nt, Human
aaaaaaaaaaaaaaaaaga

SEQ ID NO: 314894 - RNA, 23 nt, Human
aaaaaaaaaaaaaaaagaaagaa

SEQ ID NO: 314895 - RNA, 23 nt, Human
aaaaaaaagaaauaggaaaagaa

SEQ ID NO: 314896 - RNA, 22 nt, Human
aaaaaaagaaauaggaaaagaa

SEQ ID NO: 314897 - RNA, 23 nt, Human
aaaaagaaaaccaaugcagguga

SEQ ID NO: 314898 - RNA, 21 nt, Human
aaaaaggauuccuauuaacca

SEQ ID NO: 314899 - RNA, 25 nt, Human
aaaaaggauucucauguacugugga

SEQ ID NO: 314900 - RNA, 26 nt, Human
aaaacaaaacaagcucaaaauaauua

SEQ ID NO: 314901 - RNA, 19 nt, Human
aaaagaaaaagaaaaccaa

SEQ ID NO: 314902 - RNA, 23 nt, Human
aaaaugugcuuuaaaacaaaacg

SEQ ID NO: 314903 - RNA, 21 nt, Human
aaacaaaaacaaaacaagcuc

SEQ ID NO: 314904 - RNA, 23 nt, Human
aaacaaaaacaaaacaagcucaa

SEQ ID NO: 314905 - RNA, 24 nt, Human
aaacaaacaaaaacaaaacaagcu

SEQ ID NO: 314906 - RNA, 21 nt, Human
aaacaaccaagcaacacuaaa

SEQ ID NO: 314907 - RNA, 20 nt, Human
aaacaagagaggcccccucg

SEQ ID NO: 314908 - RNA, 24 nt, Human
aaacaagcucaaaauaauuaaaca

SEQ ID NO: 314909 - RNA, 23 nt, Human
aaagcucuucccauauuucacuu

SEQ ID NO: 314910 - RNA, 18 nt, Human
aaauaaacaagagaggcc

SEQ ID NO: 314911 - RNA, 24 nt, Human
aaauaaacaagagaggcccccucg

SEQ ID NO: 314912 - RNA, 23 nt, Human
aaaucagaauaaaaaucuuuagu

SEQ ID NO: 314913 - RNA, 20 nt, Human
aacaugauaaauuuccaucc

SEQ ID NO: 314914 - RNA, 23 nt, Human
aacauugcccuuuuucccugcca

SEQ ID NO: 314915 - RNA, 20 nt, Human
aagaaagaaaaaagaaaaaa

SEQ ID NO: 314916 - RNA, 20 nt, Human
aagaaagaaaaaagaaaaag

SEQ ID NO: 314917 - RNA, 21 nt, Human
aagaaagaaaaaagaaaaaga

SEQ ID NO: 314918 - RNA, 21 nt, Human
aagacgauauuaaggucaaaa

SEQ ID NO: 314919 - RNA, 22 nt, Human
aaggcuugucaaaaaaggauuc

SEQ ID NO: 314920 - RNA, 20 nt, Human
aagguguuaccaggaaguua

SEQ ID NO: 314921 - RNA, 21 nt, Human
acaaacaaaaacaaaacaagc

SEQ ID NO: 314922 - RNA, 28 nt, Human
acaacaacucaaaaaaaaaaaaaaaaaa

SEQ ID NO: 314923 - RNA, 23 nt, Human
acccaauacccauaguugacaaa

SEQ ID NO: 314924 - RNA, 20 nt, Human
acccacggaaaauaaauaaa

SEQ ID NO: 314925 - RNA, 20 nt, Human
acuacauuuaaaaugugcuu

SEQ ID NO: 314926 - RNA, 22 nt, Human
acuacauuuaaaaugugcuuua

SEQ ID NO: 314927 - RNA, 21 nt, Human
acuguaaggaaaaaaaaaauc

SEQ ID NO: 314928 - RNA, 20 nt, Human
agacagugucagcuuuccaa

SEQ ID NO: 314929 - RNA, 18 nt, Human
agacgauauuaaggucaa

SEQ ID NO: 314930 - RNA, 21 nt, Human
agagggaggaaaaagagacag

SEQ ID NO: 314931 - RNA, 19 nt, Human
aggaaaaaaaaaaucaguc

SEQ ID NO: 314932 - RNA, 20 nt, Human
aggaaaaagagacaguguca

SEQ ID NO: 314933 - RNA, 21 nt, Human
aggcugcggcgacggcucggc

SEQ ID NO: 314934 - RNA, 18 nt, Human
agggaaaauaauaguugg

SEQ ID NO: 314935 - RNA, 23 nt, Human
auuuuaaagaacuuuugcacugu

SEQ ID NO: 314936 - RNA, 24 nt, Human
caaaagccagacaaugggauacag

SEQ ID NO: 314937 - RNA, 20 nt, Human
caaacaaaaacaaaacaagc

SEQ ID NO: 314938 - RNA, 24 nt, Human
caacauacuuagucuugaccugga

SEQ ID NO: 314939 - RNA, 19 nt, Human
caaccaagcaacacuaaaa

SEQ ID NO: 314940 - RNA, 23 nt, Human
caaccaagcaacacuaaaaccac

SEQ ID NO: 314941 - RNA, 18 nt, Human
caagcaacacuaaaacca

SEQ ID NO: 314942 - RNA, 19 nt, Human
cacauccaauagugucaca

SEQ ID NO: 314943 - RNA, 20 nt, Human
ccaagguaccacauaaucac

SEQ ID NO: 314944 - RNA, 21 nt, Human
ccaauacccauaguugacaaa

SEQ ID NO: 314945 - RNA, 25 nt, Human
ccagcagcgggaacaagggcuucuc

SEQ ID NO: 314946 - RNA, 23 nt, Human
cccacugaccagcauucauuuaa

SEQ ID NO: 314947 - RNA, 19 nt, Human
cccccacccccuccccgcc

SEQ ID NO: 314948 - RNA, 19 nt, Human
ccccccacccccuccccgc

SEQ ID NO: 314949 - RNA, 19 nt, Human
cccccucgaacagggccgc

SEQ ID NO: 314950 - RNA, 25 nt, Human
cccgggcccuccccccacccccucc

SEQ ID NO: 314951 - RNA, 19 nt, Human
ccuccccccacccccuccc

SEQ ID NO: 314952 - RNA, 24 nt, Human
ccuccccccacccccuccccgccg

SEQ ID NO: 314953 - RNA, 20 nt, Human
ccuguaaguucucuccuucu

SEQ ID NO: 314954 - RNA, 24 nt, Human
cggaauuagaaaaaaagacauaug

SEQ ID NO: 314955 - RNA, 20 nt, Human
cgggcccuccccccaccccc

SEQ ID NO: 314956 - RNA, 22 nt, Human
cgggcccuccccccacccccuc

SEQ ID NO: 314957 - RNA, 23 nt, Human
cgggcccuccccccacccccucc

SEQ ID NO: 314958 - RNA, 18 nt, Human
cuaaaaacaaacaacaac

SEQ ID NO: 314959 - RNA, 22 nt, Human
cuaaaaacaaacaacaacucaa

SEQ ID NO: 314960 - RNA, 21 nt, Human
cuaaguagauaaacaagggaa

SEQ ID NO: 314961 - RNA, 19 nt, Human
cuacuauacuucacuacaa

SEQ ID NO: 314962 - RNA, 26 nt, Human
cucaauuuaacauuuucaaagacgau

SEQ ID NO: 314963 - RNA, 18 nt, Human
cuccccccacccccuccc

SEQ ID NO: 314964 - RNA, 20 nt, Human
cuccccccacccccuccccg

SEQ ID NO: 314965 - RNA, 22 nt, Human
cuccccccacccccuccccgcc

SEQ ID NO: 314966 - RNA, 24 nt, Human
cucuucccauauuucacuuuuaaa

SEQ ID NO: 314967 - RNA, 26 nt, Human
cugcggcgacggcucggcguucucuc

SEQ ID NO: 314968 - RNA, 23 nt, Human
cuuacacacuccaaucaggaagu

SEQ ID NO: 314969 - RNA, 25 nt, Human
cuuuaaaaaaaaaaaaggauuccua

SEQ ID NO: 314970 - RNA, 25 nt, Human
cuuuucccgggcccuccccccaccc

SEQ ID NO: 314971 - RNA, 25 nt, Human
gaaaagaaucauuucaauaugucaa

SEQ ID NO: 314972 - RNA, 20 nt, Human
gaucuaaaaacaaacaacaa

SEQ ID NO: 314973 - RNA, 23 nt, Human
gcaacacuaaaaccacauuacac

SEQ ID NO: 314974 - RNA, 21 nt, Human
gcacugugcugaaaaugaaau

SEQ ID NO: 314975 - RNA, 19 nt, Human
gcgcgcacacucggaggca

SEQ ID NO: 314976 - RNA, 21 nt, Human
ggcacagacucuccuucccag

SEQ ID NO: 314977 - RNA, 23 nt, Human
gggcauuauagauaugaugucca

SEQ ID NO: 314978 - RNA, 18 nt, Human
guauacaacauucacaug

SEQ ID NO: 314979 - RNA, 19 nt, Human
gugaaugucuguaaagcuc

SEQ ID NO: 314980 - RNA, 21 nt, Human
gugcgaaugaaaaccuaaagc

SEQ ID NO: 314981 - RNA, 22 nt, Human
uaaaacaaaacggaauuagaaa

SEQ ID NO: 314982 - RNA, 19 nt, Human
uaaaaccuuugugaccuaa

SEQ ID NO: 314983 - RNA, 20 nt, Human
uaaaaugugcuuuaaaacua

SEQ ID NO: 314984 - RNA, 27 nt, Human
uaaaauuccuuuuuaauguaaugaggc

SEQ ID NO: 314985 - RNA, 24 nt, Human
uaaacaaccaagcaacacuaaaac

SEQ ID NO: 314986 - RNA, 20 nt, Human
uaaacaaccaagcaacacuu

SEQ ID NO: 314987 - RNA, 21 nt, Human
uaaacagauaucuaaguagau

SEQ ID NO: 314988 - RNA, 18 nt, Human
uaaauaaacaagagaggc

SEQ ID NO: 314989 - RNA, 19 nt, Human
uaaauaaacaagagaggcc

SEQ ID NO: 314990 - RNA, 21 nt, Human
uaaauacauccuucguauaga

SEQ ID NO: 314991 - RNA, 22 nt, Human
uaaaucaccucagauaaaaccu

SEQ ID NO: 314992 - RNA, 23 nt, Human
uaacugggaugcuuuucaacuuu

SEQ ID NO: 314993 - RNA, 19 nt, Human
uaaguuaaaggugugacau

SEQ ID NO: 314994 - RNA, 24 nt, Human
uaaguucucuccuucuaaaaucuu

SEQ ID NO: 314995 - RNA, 22 nt, Human
uaauuaaacaaccaagcaacac

SEQ ID NO: 314996 - RNA, 22 nt, Human
uacaguaucauaugaccuuuga

SEQ ID NO: 314997 - RNA, 20 nt, Human
uaccacauaaucacauuacc

SEQ ID NO: 314998 - RNA, 21 nt, Human
uagagcaucaauaaguuaaaa

SEQ ID NO: 314999 - RNA, 26 nt, Human
uagugaaaacaaacaaaaacaaaaca

SEQ ID NO: 315000 - RNA, 24 nt, Human
uauagagggaggaaaaagagacag

SEQ ID NO: 315001 - RNA, 22 nt, Human
ucaaaaaaaaaaaaaaaaaaaa

SEQ ID NO: 315002 - RNA, 23 nt, Human
ucaaaaaaaaaaaaaaaaaaaaa

SEQ ID NO: 315003 - RNA, 21 nt, Human
ucacuggauuggacaaugugc

SEQ ID NO: 315004 - RNA, 20 nt, Human
ucagcuuuccaaggcuuguc

SEQ ID NO: 315005 - RNA, 21 nt, Human
ucccauauuucacuuuuaaaa

SEQ ID NO: 315006 - RNA, 19 nt, Human
ucccgggcccuccccccac

SEQ ID NO: 315007 - RNA, 22 nt, Human
ucccgggcccuccccccacccc

SEQ ID NO: 315008 - RNA, 23 nt, Human
ucucacuguaaggaaaaaaaaaa

SEQ ID NO: 315009 - RNA, 20 nt, Human
ucuugcaguaaguaauacaa

SEQ ID NO: 315010 - RNA, 24 nt, Human
ugaaaacaaacaaaaacaaaacaa

SEQ ID NO: 315011 - RNA, 25 nt, Human
ugaaaacaaacaaaaacaaaacaag

SEQ ID NO: 315012 - RNA, 22 nt, Human
ugaaaaccuaaagccaagguac

SEQ ID NO: 315013 - RNA, 23 nt, Human
ugaaaaccuaaagccaagguacc

SEQ ID NO: 315014 - RNA, 23 nt, Human
ugacaaugcucaauaaaagcuuu

SEQ ID NO: 315015 - RNA, 19 nt, Human
ugaucagguacagaaauua

SEQ ID NO: 315016 - RNA, 18 nt, Human
ugcacaaauccaaaucag

SEQ ID NO: 315017 - RNA, 20 nt, Human
ugcaguaaguaauacaaugu

SEQ ID NO: 315018 - RNA, 20 nt, Human
uggaucuaaaaacaaacaac

SEQ ID NO: 315019 - RNA, 22 nt, Human
uggaucuaaaaacaaacaacaa

SEQ ID NO: 315020 - RNA, 31 nt, Human
uguaaggaaaaaaaaaaucagucaggcuucc

SEQ ID NO: 315021 - RNA, 19 nt, Human
ugucacagucaaagaauca

SEQ ID NO: 315022 - RNA, 22 nt, Human
ugucacagucaaagaaucacaa

SEQ ID NO: 315023 - RNA, 20 nt, Human
uuaaaacaaaacggaauuag

SEQ ID NO: 315024 - RNA, 23 nt, Human
uuaagauccuuuacccgucuccu

SEQ ID NO: 315025 - RNA, 18 nt, Human
uucauguuaacuuuucua

SEQ ID NO: 315026 - RNA, 24 nt, Human
uuccgugcgaaugaaaaccuaaag

SEQ ID NO: 315027 - RNA, 20 nt, Human
uugaucagguacagaaauua

SEQ ID NO: 315028 - RNA, 20 nt, Human
uuucccgggcccucccccca

SEQ ID NO: 315029 - RNA, 18 nt, Human
aagaaaaaaauucucagg

SEQ ID NO: 315030 - RNA, 25 nt, Human
agaauaaagaauguaggccaaagaa

SEQ ID NO: 315031 - RNA, 21 nt, Human
aggccaguaagaggcagaucg

SEQ ID NO: 315032 - RNA, 24 nt, Human
caccacacgguauuguacacgguc

SEQ ID NO: 315033 - RNA, 21 nt, Human
cagaauaaagaauguaggcca

SEQ ID NO: 315034 - RNA, 25 nt, Human
cagaauaaagaauguaggccaaaga

SEQ ID NO: 315035 - RNA, 24 nt, Human
cauaaaauccauaaauucuguuga

SEQ ID NO: 315036 - RNA, 19 nt, Human
cauaguccccaagaaacag

SEQ ID NO: 315037 - RNA, 23 nt, Human
ccuguccacauaguccccaagaa

SEQ ID NO: 315038 - RNA, 19 nt, Human
cucaaaaagucgcagcaaa

SEQ ID NO: 315039 - RNA, 26 nt, Human
cugguggacaguaaguuaguuccuuu

SEQ ID NO: 315040 - RNA, 21 nt, Human
cuguccacauaguccccaaga

SEQ ID NO: 315041 - RNA, 23 nt, Human
cuuauaagccucaacuucaccgc

SEQ ID NO: 315042 - RNA, 19 nt, Human
gagacuuuaagcacagucc

SEQ ID NO: 315043 - RNA, 24 nt, Human
gcuggcacauucaugguucccucu

SEQ ID NO: 315044 - RNA, 24 nt, Human
gguggacaguaaguuaguuccuuu

SEQ ID NO: 315045 - RNA, 21 nt, Human
ggugggaaaccaccguacuca

SEQ ID NO: 315046 - RNA, 22 nt, Human
uaaagaauguaggccaaagaaa

SEQ ID NO: 315047 - RNA, 20 nt, Human
uacucaaaaagucgcagcaa

SEQ ID NO: 315048 - RNA, 25 nt, Human
uauuguacacggucaucuguugaaa

SEQ ID NO: 315049 - RNA, 24 nt, Human
uccaugacagcagaauaucuucuc

SEQ ID NO: 315050 - RNA, 20 nt, Human
ucccucugagaagaaaaaaa

SEQ ID NO: 315051 - RNA, 19 nt, Human
uccucugauuucauucucc

SEQ ID NO: 315052 - RNA, 19 nt, Human
ugacugcuuuccccugucc

SEQ ID NO: 315053 - RNA, 23 nt, Human
ugaguggugcuucaaguucuagu

SEQ ID NO: 315054 - RNA, 21 nt, Human
uggcacauucaugguucccuc

SEQ ID NO: 315055 - RNA, 20 nt, Human
ugggaaaccaccguacucaa

SEQ ID NO: 315056 - RNA, 24 nt, Human
uuaacuuauaagccucaacuucac

SEQ ID NO: 315057 - RNA, 18 nt, Human
uuaguuccuuuguuuuaa

SEQ ID NO: 315058 - RNA, 26 nt, Human
uuguaucuucuuuuacauucaucaua

SEQ ID NO: 315059 - RNA, 24 nt, Human
uuguccauggaugucaccacauau

SEQ ID NO: 315060 - RNA, 25 nt, Human
aaaacccaauuuaaguguucgcuac

SEQ ID NO: 315061 - RNA, 25 nt, Human
aauaacaggagaagggugggaagaa

SEQ ID NO: 315062 - RNA, 19 nt, Human
aaugcuggaggagagaggg

SEQ ID NO: 315063 - RNA, 18 nt, Human
acaggcaaggacuaagaa

SEQ ID NO: 315064 - RNA, 21 nt, Human
accaaucucaagccagcuuug

SEQ ID NO: 315065 - RNA, 23 nt, Human
agagagggaaggagggggcugga

SEQ ID NO: 315066 - RNA, 20 nt, Human
agcaggaggagaagggcugg

SEQ ID NO: 315067 - RNA, 22 nt, Human
agcugggacuguugaaaaccca

SEQ ID NO: 315068 - RNA, 18 nt, Human
aggacagggaggagagga

SEQ ID NO: 315069 - RNA, 20 nt, Human
aggacagggaggagaggagg

SEQ ID NO: 315070 - RNA, 20 nt, Human
aggacagggaggagaggagg

SEQ ID NO: 315071 - RNA, 22 nt, Human
aggacagggaggagaggaggaa

SEQ ID NO: 315072 - RNA, 22 nt, Human
aggacagggaggagaggaggaa

SEQ ID NO: 315073 - RNA, 22 nt, Human
aggcagaggagacagucggcuc

SEQ ID NO: 315074 - RNA, 23 nt, Human
agggaaggagggggcuggagaag

SEQ ID NO: 315075 - RNA, 21 nt, Human
agggaggagaggaggaagggg

SEQ ID NO: 315076 - RNA, 21 nt, Human
agggaggagaggaggaagggg

SEQ ID NO: 315077 - RNA, 24 nt, Human
agggugugagaaggguuagcagga

SEQ ID NO: 315078 - RNA, 20 nt, Human
aggguuagcaggaggagaag

SEQ ID NO: 315079 - RNA, 21 nt, Human
auccuccaccuucuuuauucc

SEQ ID NO: 315080 - RNA, 21 nt, Human
auccuccaccuucuuuauucc

SEQ ID NO: 315081 - RNA, 20 nt, Human
auuuauuuugugcaucugug

SEQ ID NO: 315082 - RNA, 18 nt, Human
caaaaggaccggaaaaug

SEQ ID NO: 315083 - RNA, 19 nt, Human
caagagaacugaacaucug

SEQ ID NO: 315084 - RNA, 18 nt, Human
caagauaacuagauccca

SEQ ID NO: 315085 - RNA, 22 nt, Human
cagaggagacagucggcucuaa

SEQ ID NO: 315086 - RNA, 20 nt, Human
cagagugguagccaggaucc

SEQ ID NO: 315087 - RNA, 24 nt, Human
caguaagggguagagaggggccaa

SEQ ID NO: 315088 - RNA, 26 nt, Human
ccaaucucaagccagcuuugucagaa

SEQ ID NO: 315089 - RNA, 18 nt, Human
cccucuuccuuccucucc

SEQ ID NO: 315090 - RNA, 20 nt, Human
ccggagaaaucaaagucuag

SEQ ID NO: 315091 - RNA, 18 nt, Human
ccuccucuuccucuuccc

SEQ ID NO: 315092 - RNA, 20 nt, Human
ccucgagagagaaggguggg

SEQ ID NO: 315093 - RNA, 18 nt, Human
ccucuugagggugugaga

SEQ ID NO: 315094 - RNA, 21 nt, Human
cucacaggcaaggacuaagaa

SEQ ID NO: 315095 - RNA, 21 nt, Human
cucaggacagggaggagagga

SEQ ID NO: 315096 - RNA, 21 nt, Human
cucaggacagggaggagagga

SEQ ID NO: 315097 - RNA, 23 nt, Human
cucaggacagggaggagaggagg

SEQ ID NO: 315098 - RNA, 23 nt, Human
cucaggacagggaggagaggagg

SEQ ID NO: 315099 - RNA, 19 nt, Human
cuccugggccuccgcuucu

SEQ ID NO: 315100 - RNA, 19 nt, Human
cuccugggccuccgcuucu

SEQ ID NO: 315101 - RNA, 21 nt, Human
cuccugggccuccgcuucucc

SEQ ID NO: 315102 - RNA, 21 nt, Human
cuccugggccuccgcuucucc

SEQ ID NO: 315103 - RNA, 25 nt, Human
cucuuccucuucccucuaucaggca

SEQ ID NO: 315104 - RNA, 24 nt, Human
cucuugagggugugagaaggguua

SEQ ID NO: 315105 - RNA, 23 nt, Human
cucuuugcucccucccucuuccu

SEQ ID NO: 315106 - RNA, 26 nt, Human
cugggccuccgcuucuccaccccugg

SEQ ID NO: 315107 - RNA, 26 nt, Human
cugggccuccgcuucuccaccccugg

SEQ ID NO: 315108 - RNA, 24 nt, Human
cuugagggugugagaaggguuagc

SEQ ID NO: 315109 - RNA, 20 nt, Human
cuuugcucccucccucuucc

SEQ ID NO: 315110 - RNA, 23 nt, Human
cuuugcucccucccucuuccuuc

SEQ ID NO: 315111 - RNA, 27 nt, Human
cuuugcucccucccucuuccuuccucu

SEQ ID NO: 315112 - RNA, 20 nt, Human
gaaaaacaaaaggcagagga

SEQ ID NO: 315113 - RNA, 24 nt, Human
gacacaggaaugcuggaggagaga

SEQ ID NO: 315114 - RNA, 21 nt, Human
gacccuggcagugaaagcugg

SEQ ID NO: 315115 - RNA, 19 nt, Human
gacuguugaaaacccaauu

SEQ ID NO: 315116 - RNA, 24 nt, Human
gagaacaaaaggaagacacuggga

SEQ ID NO: 315117 - RNA, 20 nt, Human
gaggagaagggcugggagcu

SEQ ID NO: 315118 - RNA, 21 nt, Human
gaggagaggaggaagggggau

SEQ ID NO: 315119 - RNA, 21 nt, Human
gaggagaggaggaagggggau

SEQ ID NO: 315120 - RNA, 20 nt, Human
gaucucuguucguccuccuc

SEQ ID NO: 315121 - RNA, 19 nt, Human
gcaggaggagaagggcugg

SEQ ID NO: 315122 - RNA, 21 nt, Human
gccuccgcuucuccaccccug

SEQ ID NO: 315123 - RNA, 21 nt, Human
gccuccgcuucuccaccccug

SEQ ID NO: 315124 - RNA, 22 nt, Human
ggaggcuggguucuggaauagc

SEQ ID NO: 315125 - RNA, 24 nt, Human
ggcagugaaagcugggacuguuga

SEQ ID NO: 315126 - RNA, 20 nt, Human
ggcagugagaacaaaaggaa

SEQ ID NO: 315127 - RNA, 20 nt, Human
ggcucuaagugaccaaucuc

SEQ ID NO: 315128 - RNA, 23 nt, Human
gggccuccgcuucuccaccccug

SEQ ID NO: 315129 - RNA, 20 nt, Human
gugagaaggguuagcaggag

SEQ ID NO: 315130 - RNA, 21 nt, Human
guuagggcgcaaauuccugga

SEQ ID NO: 315131 - RNA, 20 nt, Human
uaaauaacaggagaagggug

SEQ ID NO: 315132 - RNA, 22 nt, Human
uaagagaagcgguaucggauuc

SEQ ID NO: 315133 - RNA, 22 nt, Human
uaagagaagcgguaucggauuc

SEQ ID NO: 315134 - RNA, 22 nt, Human
uagaucccaggacaggcaguuu

SEQ ID NO: 315135 - RNA, 25 nt, Human
uaucucacaggcaaggacuaagaau

SEQ ID NO: 315136 - RNA, 21 nt, Human
ucagagugguagccaggaucc

SEQ ID NO: 315137 - RNA, 24 nt, Human
ucagagugguagccaggauccucc

SEQ ID NO: 315138 - RNA, 20 nt, Human
ucaggacagggaggagagga

SEQ ID NO: 315139 - RNA, 20 nt, Human
ucaggacagggaggagagga

SEQ ID NO: 315140 - RNA, 20 nt, Human
ucaggacagggaggagagga

SEQ ID NO: 315141 - RNA, 22 nt, Human
ucaggaucucuguucguccucc

SEQ ID NO: 315142 - RNA, 20 nt, Human
ucccucccucuuccuuccuc

SEQ ID NO: 315143 - RNA, 19 nt, Human
uccugggccuccgcuucuc

SEQ ID NO: 315144 - RNA, 19 nt, Human
uccugggccuccgcuucuc

SEQ ID NO: 315145 - RNA, 23 nt, Human
uccugggccuccgcuucucgggg

SEQ ID NO: 315146 - RNA, 23 nt, Human
uccugggccuccgcuucucgggg

SEQ ID NO: 315147 - RNA, 23 nt, Human
ucucccagagacccaggucccug

SEQ ID NO: 315148 - RNA, 20 nt, Human
ucugaagcugaaaaacaaaa

SEQ ID NO: 315149 - RNA, 22 nt, Human
ucugaagcugaaaaacaaaagg

SEQ ID NO: 315150 - RNA, 19 nt, Human
ucuugagggugugagaagg

SEQ ID NO: 315151 - RNA, 26 nt, Human
ugacugggacccuggcagugaaagcu

SEQ ID NO: 315152 - RNA, 18 nt, Human
ugagaacaaaaggaagac

SEQ ID NO: 315153 - RNA, 19 nt, Human
ugagaacaaaaggaagaca

SEQ ID NO: 315154 - RNA, 22 nt, Human
ugagaacaaaaggaagacaccg

SEQ ID NO: 315155 - RNA, 24 nt, Human
ugagaacaaaaggaagacacuggg

SEQ ID NO: 315156 - RNA, 19 nt, Human
ugagaaggguuagcaggag

SEQ ID NO: 315157 - RNA, 21 nt, Human
ugagaaggguuagcaggagga

SEQ ID NO: 315158 - RNA, 18 nt, Human
ugauuuuggguuauuuau

SEQ ID NO: 315159 - RNA, 28 nt, Human
ugcucccucccucuuccuuccucuccca

SEQ ID NO: 315160 - RNA, 21 nt, Human
uggaauagcagcaagucagaa

SEQ ID NO: 315161 - RNA, 19 nt, Human
uggcagugaaagcugggac

SEQ ID NO: 315162 - RNA, 20 nt, Human
uggcagugaaagcugggacu

SEQ ID NO: 315163 - RNA, 24 nt, Human
ugggaagaaaggauaugauuauuu

SEQ ID NO: 315164 - RNA, 21 nt, Human
ugggacccuggcagugaaagc

SEQ ID NO: 315165 - RNA, 24 nt, Human
ugggacuguugaaaacccaauuua

SEQ ID NO: 315166 - RNA, 24 nt, Human
ugggaggaaaaaugaggacugggg

SEQ ID NO: 315167 - RNA, 23 nt, Human
ugggccuccgcuucuccaccccu

SEQ ID NO: 315168 - RNA, 23 nt, Human
ugggccuccgcuucuccaccccu

SEQ ID NO: 315169 - RNA, 25 nt, Human
uuccuuccucucccagagacccagg

SEQ ID NO: 315170 - RNA, 18 nt, Human
uuggcagugagaacaaaa

SEQ ID NO: 315171 - RNA, 18 nt, Human
uuuuuuuuuuuuuuuuug

SEQ ID NO: 315172 - RNA, 24 nt, Human
uuuuuuuuuuuuuuuuugugauuu

SEQ ID NO: 315173 - RNA, 19 nt, Human
aaaaaaaaaaaggccacug

SEQ ID NO: 315174 - RNA, 23 nt, Human
aaaaaaaaucuucucagcagcug

SEQ ID NO: 315175 - RNA, 22 nt, Human
aaaaaaacaaaaaacaaaccaa

SEQ ID NO: 315176 - RNA, 20 nt, Human
aaaaaacaaaccaacaacaa

SEQ ID NO: 315177 - RNA, 18 nt, Human
aaaaaucuucucagcagc

SEQ ID NO: 315178 - RNA, 24 nt, Human
aaaacaaaccaacaacaacaaaaa

SEQ ID NO: 315179 - RNA, 25 nt, Human
aaacaaaaaacaaaccaacaacaac

SEQ ID NO: 315180 - RNA, 24 nt, Human
aaacaaaccaacaacaacaaaaac

SEQ ID NO: 315181 - RNA, 21 nt, Human
aaacaccccagaaaauuaaac

SEQ ID NO: 315182 - RNA, 23 nt, Human
aaacaccccagaaaauuaaacaa

SEQ ID NO: 315183 - RNA, 21 nt, Human
aaacauagaagacucugccac

SEQ ID NO: 315184 - RNA, 23 nt, Human
aacaacaaaaacaccccagaaaa

SEQ ID NO: 315185 - RNA, 23 nt, Human
aacaacaacaaaaacaccccaga

SEQ ID NO: 315186 - RNA, 24 nt, Human
aaccaacaacaacaaaaacacccc

SEQ ID NO: 315187 - RNA, 20 nt, Human
aaggaaaaaauacaaaccca

SEQ ID NO: 315188 - RNA, 21 nt, Human
aaguuuucucagucauuaaaa

SEQ ID NO: 315189 - RNA, 23 nt, Human
aauacaaucagcuacuauaagcu

SEQ ID NO: 315190 - RNA, 18 nt, Human
acaacaaaaacaccccag

SEQ ID NO: 315191 - RNA, 19 nt, Human
acaacaaaaacaccccaga

SEQ ID NO: 315192 - RNA, 20 nt, Human
acaacaacaaaaacacccca

SEQ ID NO: 315193 - RNA, 23 nt, Human
acaaguuuucucagucauuaaaa

SEQ ID NO: 315194 - RNA, 24 nt, Human
accccagaaaauuaaacaaaauga

SEQ ID NO: 315195 - RNA, 22 nt, Human
acuacaauaaaaaaaaagugac

SEQ ID NO: 315196 - RNA, 23 nt, Human
agaaggaaaaaauacaaacccaa

SEQ ID NO: 315197 - RNA, 21 nt, Human
agacauuugaaauaagaaaua

SEQ ID NO: 315198 - RNA, 24 nt, Human
auucuagauaagagggcauuuggc

SEQ ID NO: 315199 - RNA, 27 nt, Human
caaaaaacaaaccaacaacaacaaaaa

SEQ ID NO: 315200 - RNA, 25 nt, Human
caaaaacaccccagaaaauuaaaca

SEQ ID NO: 315201 - RNA, 22 nt, Human
caaaccaacaacaacaaaaaca

SEQ ID NO: 315202 - RNA, 23 nt, Human
caacaacaaaaacaccccagaaa

SEQ ID NO: 315203 - RNA, 19 nt, Human
caacaacaacaaaaacacc

SEQ ID NO: 315204 - RNA, 25 nt, Human
caacaacaacaaaaacaccccagaa

SEQ ID NO: 315205 - RNA, 18 nt, Human
caacuaaggcuuacuggu

SEQ ID NO: 315206 - RNA, 24 nt, Human
caauacaaucaauaauacaaucag

SEQ ID NO: 315207 - RNA, 25 nt, Human
caccccagaaaauuaaaagguccuc

SEQ ID NO: 315208 - RNA, 19 nt, Human
caguaccugcuaaaaugaa

SEQ ID NO: 315209 - RNA, 24 nt, Human
cauuugaaauaagaaauagucaag

SEQ ID NO: 315210 - RNA, 21 nt, Human
ccgaaaaugacagucuccaag

SEQ ID NO: 315211 - RNA, 21 nt, Human
ccgugaaaacauagaagacuc

SEQ ID NO: 315212 - RNA, 22 nt, Human
ccuuaaaaaaaaaaaggccacu

SEQ ID NO: 315213 - RNA, 19 nt, Human
gaaaaacucgaaacugugg

SEQ ID NO: 315214 - RNA, 27 nt, Human
gggcauuuggcaggauauccgaaaaug

SEQ ID NO: 315215 - RNA, 18 nt, Human
uaaaaaaaaaaaggccac

SEQ ID NO: 315216 - RNA, 23 nt, Human
uaaaaaaaaaaaggccacugaaa

SEQ ID NO: 315217 - RNA, 21 nt, Human
uaaaauggucugaacaugaug

SEQ ID NO: 315218 - RNA, 18 nt, Human
uaaaugcauauugcacaa

SEQ ID NO: 315219 - RNA, 20 nt, Human
uaacaugaaacaauggucuu

SEQ ID NO: 315220 - RNA, 23 nt, Human
uaagaaauaaaugcauauugcac

SEQ ID NO: 315221 - RNA, 22 nt, Human
uaagaaauagucaagcaugcca

SEQ ID NO: 315222 - RNA, 21 nt, Human
uaauacaugacaauaaucaca

SEQ ID NO: 315223 - RNA, 23 nt, Human
uacuuuggcuagcacaacaguuu

SEQ ID NO: 315224 - RNA, 23 nt, Human
uagaagacucugccacaugaaga

SEQ ID NO: 315225 - RNA, 22 nt, Human
uauacaauacaaucaauaauac

SEQ ID NO: 315226 - RNA, 25 nt, Human
ucaguaccugcuaaaaugaauguga

SEQ ID NO: 315227 - RNA, 20 nt, Human
ucagucauuaaaaaaaaauc

SEQ ID NO: 315228 - RNA, 22 nt, Human
uccaaggauucuucccagacuu

SEQ ID NO: 315229 - RNA, 18 nt, Human
uccaggugggagacaaca

SEQ ID NO: 315230 - RNA, 23 nt, Human
uccuuaaaaaaaaaaaggccacu

SEQ ID NO: 315231 - RNA, 20 nt, Human
ucugcaaaugauuucauagc

SEQ ID NO: 315232 - RNA, 21 nt, Human
ucuucugugagagcugaaagu

SEQ ID NO: 315233 - RNA, 23 nt, Human
ugaaacaaaaauucuagauaaga

SEQ ID NO: 315234 - RNA, 21 nt, Human
ugaggcauaucuggccuugaa

SEQ ID NO: 315235 - RNA, 23 nt, Human
ugaguacuaucaaaugaaaacug

SEQ ID NO: 315236 - RNA, 18 nt, Human
ugcauuagcagacauuug

SEQ ID NO: 315237 - RNA, 21 nt, Human
ugccagaaagauguaguauuu

SEQ ID NO: 315238 - RNA, 19 nt, Human
ugcuaaaaugaaugugaag

SEQ ID NO: 315239 - RNA, 19 nt, Human
uguaaugaaaaagccguga

SEQ ID NO: 315240 - RNA, 22 nt, Human
ugugaaauguaaagcaauuauc

SEQ ID NO: 315241 - RNA, 23 nt, Human
uuagaaggaaaaaauacaaaccc

SEQ ID NO: 315242 - RNA, 21 nt, Human
uuccagugacugccaauuaug

SEQ ID NO: 315243 - RNA, 21 nt, Human
uuccuuauaugcuggagcugu

SEQ ID NO: 315244 - RNA, 23 nt, Human
uuguaaagauagggcuccacaua

SEQ ID NO: 315245 - RNA, 19 nt, Human
uuuacaguaggaaacuuuu

SEQ ID NO: 315246 - RNA, 25 nt, Human
uuuagaaggaaaaaauacaaaccca

SEQ ID NO: 315247 - RNA, 25 nt, Human
aaaaagaaaauacuguaaguauuaa

SEQ ID NO: 315248 - RNA, 18 nt, Human
aaaaccaggaauggcaag

SEQ ID NO: 315249 - RNA, 19 nt, Human
aaaaccaggaauggcaagg

SEQ ID NO: 315250 - RNA, 21 nt, Human
aaaaccaggaauggcaaggaa

SEQ ID NO: 315251 - RNA, 18 nt, Human
aaaagaggggugggggca

SEQ ID NO: 315252 - RNA, 24 nt, Human
aaacaaaaaauucuggacuuggau

SEQ ID NO: 315253 - RNA, 22 nt, Human
aaaccagacauggcuacucaug

SEQ ID NO: 315254 - RNA, 22 nt, Human
aaacuuuagccccagaaucucu

SEQ ID NO: 315255 - RNA, 24 nt, Human
aaagacacaaaaugcuaccacuaa

SEQ ID NO: 315256 - RNA, 23 nt, Human
aaagccccugggccuucugccuu

SEQ ID NO: 315257 - RNA, 20 nt, Human
aaagucaguuccugagaggu

SEQ ID NO: 315258 - RNA, 20 nt, Human
aaagucaguuccugagaggu

SEQ ID NO: 315259 - RNA, 21 nt, Human
aacagcucaaauagguccuuu

SEQ ID NO: 315260 - RNA, 19 nt, Human
aacauggcaaaaccccauc

SEQ ID NO: 315261 - RNA, 21 nt, Human
aacauggcaaaaccccaucuc

SEQ ID NO: 315262 - RNA, 21 nt, Human
aacauggcaaaaccccaucuc

SEQ ID NO: 315263 - RNA, 22 nt, Human
aaccauuccagagggcaucuga

SEQ ID NO: 315264 - RNA, 22 nt, Human
aaccauuccagagggcaucuga

SEQ ID NO: 315265 - RNA, 18 nt, Human
aacugguguagagugagg

SEQ ID NO: 315266 - RNA, 22 nt, Human
aagaaaacaaaaaauucuggac

SEQ ID NO: 315267 - RNA, 25 nt, Human
aagcagaugaauuggggaacagcuc

SEQ ID NO: 315268 - RNA, 23 nt, Human
aagcaggucaagcuaccucagac

SEQ ID NO: 315269 - RNA, 24 nt, Human
aagcaggucaagcuaccucagaca

SEQ ID NO: 315270 - RNA, 21 nt, Human
aagccccugggccuucugccu

SEQ ID NO: 315271 - RNA, 18 nt, Human
aagcgggaaucuguuccg

SEQ ID NO: 315272 - RNA, 23 nt, Human
aagcugaggaaaggugguugagg

SEQ ID NO: 315273 - RNA, 22 nt, Human
aagcugccugcuuauuggguuu

SEQ ID NO: 315274 - RNA, 22 nt, Human
aaggaaaaccauaaagccaaag

SEQ ID NO: 315275 - RNA, 18 nt, Human
aaggaaagaccaucuuga

SEQ ID NO: 315276 - RNA, 18 nt, Human
aaggaagugaggcagaau

SEQ ID NO: 315277 - RNA, 21 nt, Human
aagugacagaccugagcccca

SEQ ID NO: 315278 - RNA, 19 nt, Human
aagugcugggauuacaggc

SEQ ID NO: 315279 - RNA, 21 nt, Human
aagugcugggauuacaggcau

SEQ ID NO: 315280 - RNA, 23 nt, Human
aagugcugggauuacaggcauga

SEQ ID NO: 315281 - RNA, 20 nt, Human
aaguggccucagauacuuga

SEQ ID NO: 315282 - RNA, 24 nt, Human
aaguguccuuccaccaaaacaucc

SEQ ID NO: 315283 - RNA, 24 nt, Human
aaguguccuuccaccaaaacaucc

SEQ ID NO: 315284 - RNA, 19 nt, Human
aaucuccccuccccaccuc

SEQ ID NO: 315285 - RNA, 21 nt, Human
aaucuggagccuagccuacuu

SEQ ID NO: 315286 - RNA, 23 nt, Human
aaugaaccacucuaaacacugaa

SEQ ID NO: 315287 - RNA, 23 nt, Human
aaugacuugcacacucaagugaa

SEQ ID NO: 315288 - RNA, 20 nt, Human
aaugcagucacugucaccuu

SEQ ID NO: 315289 - RNA, 23 nt, Human
aauggcccacuagagaaucuggg

SEQ ID NO: 315290 - RNA, 24 nt, Human
aauugcuuucuauccauuucucca

SEQ ID NO: 315291 - RNA, 20 nt, Human
acaccacugcacuccagccu

SEQ ID NO: 315292 - RNA, 24 nt, Human
acaccacugcacuccagccugggc

SEQ ID NO: 315293 - RNA, 20 nt, Human
acaccuaacaaaguacaugg

SEQ ID NO: 315294 - RNA, 18 nt, Human
acacucuaaaaauggggu

SEQ ID NO: 315295 - RNA, 20 nt, Human
acagaguuuuaccaggaaca

SEQ ID NO: 315296 - RNA, 21 nt, Human
acaggccaaaaauccagacac

SEQ ID NO: 315297 - RNA, 19 nt, Human
acaggcgccugccaccacg

SEQ ID NO: 315298 - RNA, 18 nt, Human
accaagggauaaaacucc

SEQ ID NO: 315299 - RNA, 22 nt, Human
accacugcacuccagccugggc

SEQ ID NO: 315300 - RNA, 19 nt, Human
acccugagauuugcauaac

SEQ ID NO: 315301 - RNA, 21 nt, Human
accuaacaaaguacauggcuu

SEQ ID NO: 315302 - RNA, 19 nt, Human
acgccuguaauccuaucgc

SEQ ID NO: 315303 - RNA, 22 nt, Human
acgccuguaauccuaucgcuuu

SEQ ID NO: 315304 - RNA, 23 nt, Human
acgccuguaauccuaucgcuuug

SEQ ID NO: 315305 - RNA, 18 nt, Human
acuccaugcccaccucaa

SEQ ID NO: 315306 - RNA, 18 nt, Human
acugcaagcuccgccucc

SEQ ID NO: 315307 - RNA, 18 nt, Human
acugcacuccagccuggg

SEQ ID NO: 315308 - RNA, 22 nt, Human
acugcacuccagccugggcgag

SEQ ID NO: 315309 - RNA, 24 nt, Human
acugcacuccagccugggcgagag

SEQ ID NO: 315310 - RNA, 24 nt, Human
acuggguuaauguaaaaagcugaa

SEQ ID NO: 315311 - RNA, 24 nt, Human
acuggguuaauguaaaaagcugaa

SEQ ID NO: 315312 - RNA, 21 nt, Human
agaaaggaaaggaauaaauga

SEQ ID NO: 315313 - RNA, 30 nt, Human
agaacccucuccuaccccgcagccugccuu

SEQ ID NO: 315314 - RNA, 22 nt, Human
agaagcccaauuuucaacaaac

SEQ ID NO: 315315 - RNA, 21 nt, Human
agagaggaaaacaaggucaag

SEQ ID NO: 315316 - RNA, 18 nt, Human
agaguagaauuucccuuu

SEQ ID NO: 315317 - RNA, 20 nt, Human
agcaacuuucccagaagccc

SEQ ID NO: 315318 - RNA, 24 nt, Human
agcagcuucagaccagccugggca

SEQ ID NO: 315319 - RNA, 20 nt, Human
agccagugguaggcacaacc

SEQ ID NO: 315320 - RNA, 21 nt, Human
agccagugguaggcacaaccc

SEQ ID NO: 315321 - RNA, 22 nt, Human
agccagugguaggcacaaccuu

SEQ ID NO: 315322 - RNA, 19 nt, Human
agcccagcagcuucagacc

SEQ ID NO: 315323 - RNA, 22 nt, Human
agccccugggccuucugccuuc

SEQ ID NO: 315324 - RNA, 19 nt, Human
agccuagccuacuuggaca

SEQ ID NO: 315325 - RNA, 24 nt, Human
agccugggcaacauggcaaaaccc

SEQ ID NO: 315326 - RNA, 18 nt, Human
agccugguguacucccca

SEQ ID NO: 315327 - RNA, 18 nt, Human
agccugguguacucccca

SEQ ID NO: 315328 - RNA, 22 nt, Human
agcgugcuuuccguaaagacuc

SEQ ID NO: 315329 - RNA, 20 nt, Human
agcugaggaaaggugguuga

SEQ ID NO: 315330 - RNA, 21 nt, Human
agcugccuggggugcucauga

SEQ ID NO: 315331 - RNA, 19 nt, Human
agcuuccuugcuuccugag

SEQ ID NO: 315332 - RNA, 19 nt, Human
agcuuuuauaccauugagu

SEQ ID NO: 315333 - RNA, 24 nt, Human
aggaaaaacucucucguuauuaga

SEQ ID NO: 315334 - RNA, 22 nt, Human
aggaccugcugcuucugacauu

SEQ ID NO: 315335 - RNA, 24 nt, Human
aggagaaauaacagaaaauaucac

SEQ ID NO: 315336 - RNA, 21 nt, Human
aggaggcucucuguaaccccu

SEQ ID NO: 315337 - RNA, 18 nt, Human
aggcuggagugcaguggc

SEQ ID NO: 315338 - RNA, 23 nt, Human
aggcuugugaaagccaagugcug

SEQ ID NO: 315339 - RNA, 20 nt, Human
agggagcaggcaguggugcu

SEQ ID NO: 315340 - RNA, 21 nt, Human
agggggcgguggugguggugg

SEQ ID NO: 315341 - RNA, 22 nt, Human
agggguuuggaagaacagggca

SEQ ID NO: 315342 - RNA, 22 nt, Human
agggguuuggaagaacagggca

SEQ ID NO: 315343 - RNA, 24 nt, Human
agguggagguugcagugagcugag

SEQ ID NO: 315344 - RNA, 18 nt, Human
agguggauugcuugagcc

SEQ ID NO: 315345 - RNA, 20 nt, Human
aguagagauuggguuucacc

SEQ ID NO: 315346 - RNA, 18 nt, Human
aguagcugggacuacagg

SEQ ID NO: 315347 - RNA, 20 nt, Human
agugcaguggcgugaucaag

SEQ ID NO: 315348 - RNA, 22 nt, Human
agugcaguggcgugaucaaggc

SEQ ID NO: 315349 - RNA, 23 nt, Human
agugcaguggcgugaucaaggcu

SEQ ID NO: 315350 - RNA, 24 nt, Human
agugcaguggcgugaucaaggcuc

SEQ ID NO: 315351 - RNA, 18 nt, Human
agugcugggauuacaggc

SEQ ID NO: 315352 - RNA, 24 nt, Human
agugugugcuuaaagugcggucag

SEQ ID NO: 315353 - RNA, 19 nt, Human
auaaagccaaagucugagu

SEQ ID NO: 315354 - RNA, 20 nt, Human
auaucacuggcaacccuaaa

SEQ ID NO: 315355 - RNA, 23 nt, Human
aucaaaucauuccaggugaaagc

SEQ ID NO: 315356 - RNA, 19 nt, Human
aucaauucaacauccugcu

SEQ ID NO: 315357 - RNA, 20 nt, Human
aucaauucaacauccugcug

SEQ ID NO: 315358 - RNA, 20 nt, Human
aucaauucaacauccugcug

SEQ ID NO: 315359 - RNA, 24 nt, Human
aucacaccacugcacuccagccug

SEQ ID NO: 315360 - RNA, 21 nt, Human
aucacagaauuuuaagccaaa

SEQ ID NO: 315361 - RNA, 21 nt, Human
aucaugcuucaauuaaaacug

SEQ ID NO: 315362 - RNA, 21 nt, Human
aucaugcuucaauuaaaacug

SEQ ID NO: 315363 - RNA, 23 nt, Human
aucccuugagccugggaggugga

SEQ ID NO: 315364 - RNA, 25 nt, Human
auccugcuguuucucuuggcacccc

SEQ ID NO: 315365 - RNA, 21 nt, Human
auccuuucugcuuucuuuuuc

SEQ ID NO: 315366 - RNA, 18 nt, Human
augcagcugcuggcugcu

SEQ ID NO: 315367 - RNA, 19 nt, Human
auggaaaaccaccucucua

SEQ ID NO: 315368 - RNA, 22 nt, Human
augggcugagcuguugccacca

SEQ ID NO: 315369 - RNA, 22 nt, Human
augguuggaaaugaaagacaga

SEQ ID NO: 315370 - RNA, 21 nt, Human
augugcaugugaacgcacaua

SEQ ID NO: 315371 - RNA, 19 nt, Human
auugcuaaaccuuuuuagg

SEQ ID NO: 315372 - RNA, 20 nt, Human
auuggguuucaccguguuag

SEQ ID NO: 315373 - RNA, 24 nt, Human
caaaagagagaucugaaaucucac

SEQ ID NO: 315374 - RNA, 20 nt, Human
caaaauaagcagaugaauug

SEQ ID NO: 315375 - RNA, 20 nt, Human
caaccccaaccccaccccag

SEQ ID NO: 315376 - RNA, 24 nt, Human
caaccccaaccccaccccauccca

SEQ ID NO: 315377 - RNA, 18 nt, Human
caaccccaacucucaaag

SEQ ID NO: 315378 - RNA, 18 nt, Human
caaggucaaggaagugag

SEQ ID NO: 315379 - RNA, 21 nt, Human
caaugcagucacugucacccc

SEQ ID NO: 315380 - RNA, 21 nt, Human
caaugcagucacugucacccc

SEQ ID NO: 315381 - RNA, 21 nt, Human
caaugcagucacugucaccuu

SEQ ID NO: 315382 - RNA, 21 nt, Human
cacaccacugcacuccagccu

SEQ ID NO: 315383 - RNA, 20 nt, Human
cacaccugcaguccuagcug

SEQ ID NO: 315384 - RNA, 21 nt, Human
cacaugguuuggggaagggaa

SEQ ID NO: 315385 - RNA, 18 nt, Human
caccaaaacauccauuuc

SEQ ID NO: 315386 - RNA, 21 nt, Human
caccaaaacauccauuucuuu

SEQ ID NO: 315387 - RNA, 21 nt, Human
caccaaaacauccauuucuuu

SEQ ID NO: 315388 - RNA, 25 nt, Human
caccacugcacuccagccugggcga

SEQ ID NO: 315389 - RNA, 24 nt, Human
caccagaggcuaccugaccaugcc

SEQ ID NO: 315390 - RNA, 20 nt, Human
caccagugagacagaacuca

SEQ ID NO: 315391 - RNA, 21 nt, Human
caccaugcagcugcuggcugc

SEQ ID NO: 315392 - RNA, 24 nt, Human
cacccaggcuggagugcaguggcg

SEQ ID NO: 315393 - RNA, 24 nt, Human
caccguguuagccaggauggucuc

SEQ ID NO: 315394 - RNA, 24 nt, Human
caccucggccuccugaagugcugg

SEQ ID NO: 315395 - RNA, 23 nt, Human
caccucucauuccuccuugcacu

SEQ ID NO: 315396 - RNA, 23 nt, Human
caccugcaguccuagcugcucgg

SEQ ID NO: 315397 - RNA, 24 nt, Human
caccugcaguccuagcugcucggg

SEQ ID NO: 315398 - RNA, 22 nt, Human
cacgccauucuccugccucagc

SEQ ID NO: 315399 - RNA, 22 nt, Human
cacuccagccugggcgagagag

SEQ ID NO: 315400 - RNA, 21 nt, Human
cacuccgacucucaacucugg

SEQ ID NO: 315401 - RNA, 20 nt, Human
cacugcacuccagccugggc

SEQ ID NO: 315402 - RNA, 20 nt, Human
cacugcacuccagccugggc

SEQ ID NO: 315403 - RNA, 22 nt, Human
cacugcacuccagccugggcga

SEQ ID NO: 315404 - RNA, 22 nt, Human
cacugcacuccagccugggcga

SEQ ID NO: 315405 - RNA, 27 nt, Human
cacugcacuccagccugggcgagagag

SEQ ID NO: 315406 - RNA, 25 nt, Human
cacuggguuaauguaaaaagcugaa

SEQ ID NO: 315407 - RNA, 18 nt, Human
cacuggguuguaagccaa

SEQ ID NO: 315408 - RNA, 19 nt, Human
cacuggguuguaagccaaa

SEQ ID NO: 315409 - RNA, 22 nt, Human
cagaacacaaaagaucaauagc

SEQ ID NO: 315410 - RNA, 24 nt, Human
cagaacauucauuaaugguauugu

SEQ ID NO: 315411 - RNA, 18 nt, Human
cagaacccucuccuaccc

SEQ ID NO: 315412 - RNA, 18 nt, Human
cagaaggcaagcgggaau

SEQ ID NO: 315413 - RNA, 18 nt, Human
cagaauaaugacuuccca

SEQ ID NO: 315414 - RNA, 18 nt, Human
cagagggaggaccaugga

SEQ ID NO: 315415 - RNA, 21 nt, Human
cagcaacuuucccagaagccc

SEQ ID NO: 315416 - RNA, 18 nt, Human
cagcagcucaaaguaaga

SEQ ID NO: 315417 - RNA, 21 nt, Human
cagcaguagguaccuguccaa

SEQ ID NO: 315418 - RNA, 19 nt, Human
cagccaccuccacuuccag

SEQ ID NO: 315419 - RNA, 20 nt, Human
cagccuccugaguagcuggg

SEQ ID NO: 315420 - RNA, 21 nt, Human
caggcgccugccaccacgccu

SEQ ID NO: 315421 - RNA, 23 nt, Human
caggcgccugccaccacgccugg

SEQ ID NO: 315422 - RNA, 18 nt, Human
cagggcaaagacaaggag

SEQ ID NO: 315423 - RNA, 18 nt, Human
cagggcauugaaagugca

SEQ ID NO: 315424 - RNA, 18 nt, Human
cagggcauugaaagugca

SEQ ID NO: 315425 - RNA, 19 nt, Human
caguagguaccuguccaag

SEQ ID NO: 315426 - RNA, 24 nt, Human
cagucaguaguuuacacacacuuu

SEQ ID NO: 315427 - RNA, 21 nt, Human
caguccaaccucauuuuacag

SEQ ID NO: 315428 - RNA, 20 nt, Human
cagugcuggcauaaacaaug

SEQ ID NO: 315429 - RNA, 19 nt, Human
caguggacugaaguuaauc

SEQ ID NO: 315430 - RNA, 22 nt, Human
cauacgggccuaaaagucaaac

SEQ ID NO: 315431 - RNA, 20 nt, Human
cauaugugucuuuccagccu

SEQ ID NO: 315432 - RNA, 20 nt, Human
caugacucucaucaaugggu

SEQ ID NO: 315433 - RNA, 22 nt, Human
cauggagagcuacaugucaugu

SEQ ID NO: 315434 - RNA, 23 nt, Human
cauucaauuacccucaauauuaa

SEQ ID NO: 315435 - RNA, 21 nt, Human
ccaaaaaggaugagaagucaa

SEQ ID NO: 315436 - RNA, 24 nt, Human
ccaaccccaccccaucccaggugu

SEQ ID NO: 315437 - RNA, 18 nt, Human
ccacaggcagacuucagc

SEQ ID NO: 315438 - RNA, 20 nt, Human
ccaccacgccuggcuaauuu

SEQ ID NO: 315439 - RNA, 19 nt, Human
ccacugcaccugguggaau

SEQ ID NO: 315440 - RNA, 24 nt, Human
ccacugcaccugguggaauuggga

SEQ ID NO: 315441 - RNA, 25 nt, Human
ccacugcaccugguggaauugggau

SEQ ID NO: 315442 - RNA, 20 nt, Human
ccacugcacuccagccuggg

SEQ ID NO: 315443 - RNA, 21 nt, Human
ccacugcacuccagccugggc

SEQ ID NO: 315444 - RNA, 21 nt, Human
ccacugcacuccagccugggc

SEQ ID NO: 315445 - RNA, 23 nt, Human
ccacugcacuccagccugggcga

SEQ ID NO: 315446 - RNA, 24 nt, Human
ccacugcacuccagccugggcgag

SEQ ID NO: 315447 - RNA, 25 nt, Human
ccacugcacuccagccugggcgaga

SEQ ID NO: 315448 - RNA, 23 nt, Human
ccagaaucucuggaauggccaaa

SEQ ID NO: 315449 - RNA, 19 nt, Human
ccagagcauucuccagaug

SEQ ID NO: 315450 - RNA, 23 nt, Human
ccaugauaauacgaagucucaag

SEQ ID NO: 315451 - RNA, 19 nt, Human
ccaugcagcugcuggcugc

SEQ ID NO: 315452 - RNA, 22 nt, Human
cccagaaugaaggauauaaaac

SEQ ID NO: 315453 - RNA, 24 nt, Human
cccagccagguggauugcuugagc

SEQ ID NO: 315454 - RNA, 21 nt, Human
cccaggcuggagugcaguggc

SEQ ID NO: 315455 - RNA, 20 nt, Human
cccaucgcagcacacagcca

SEQ ID NO: 315456 - RNA, 22 nt, Human
cccaucucuacaaaaaaauuca

SEQ ID NO: 315457 - RNA, 20 nt, Human
ccccaaccccaccccauccc

SEQ ID NO: 315458 - RNA, 21 nt, Human
ccccaaccccaccccauccca

SEQ ID NO: 315459 - RNA, 19 nt, Human
ccccaaccccaccccaucu

SEQ ID NO: 315460 - RNA, 24 nt, Human
ccccagaaucucuggaauggccaa

SEQ ID NO: 315461 - RNA, 23 nt, Human
ccccagggcugcuggcccucccc

SEQ ID NO: 315462 - RNA, 18 nt, Human
ccccugggccuucugccu

SEQ ID NO: 315463 - RNA, 21 nt, Human
ccccuuucccuggucuauuga

SEQ ID NO: 315464 - RNA, 20 nt, Human
cccucaaccccaacucucaa

SEQ ID NO: 315465 - RNA, 23 nt, Human
ccgccaucuuuacuccucccgcc

SEQ ID NO: 315466 - RNA, 19 nt, Human
ccgccuggaagcugaauaa

SEQ ID NO: 315467 - RNA, 19 nt, Human
ccgggacacuggguuguaa

SEQ ID NO: 315468 - RNA, 22 nt, Human
ccuccuugcacugacuucauuu

SEQ ID NO: 315469 - RNA, 21 nt, Human
ccucgaccggcugaauguccu

SEQ ID NO: 315470 - RNA, 22 nt, Human
ccucgcgccgccaucuuuacuc

SEQ ID NO: 315471 - RNA, 23 nt, Human
ccucugggucuugccacucuaaa

SEQ ID NO: 315472 - RNA, 23 nt, Human
ccugaagugcugggauuacaggc

SEQ ID NO: 315473 - RNA, 24 nt, Human
ccugaagugcugggauuacaggca

SEQ ID NO: 315474 - RNA, 23 nt, Human
ccugaguagcugggacuacaggc

SEQ ID NO: 315475 - RNA, 24 nt, Human
ccugaguagcugggacuacaggcg

SEQ ID NO: 315476 - RNA, 23 nt, Human
ccugccucagccuccugaguagc

SEQ ID NO: 315477 - RNA, 24 nt, Human
ccugccucagccuccugaguagcu

SEQ ID NO: 315478 - RNA, 25 nt, Human
ccugccuccuggugucuuuuuuccu

SEQ ID NO: 315479 - RNA, 23 nt, Human
ccugcuguuucucuuggcacccc

SEQ ID NO: 315480 - RNA, 23 nt, Human
ccugcuguuucucuuggcacccc

SEQ ID NO: 315481 - RNA, 21 nt, Human
ccugggagguggagguugcag

SEQ ID NO: 315482 - RNA, 24 nt, Human
ccugggcaacauggcaaaacccca

SEQ ID NO: 315483 - RNA, 22 nt, Human
ccuguaauccuaucgcuuuggg

SEQ ID NO: 315484 - RNA, 18 nt, Human
ccuugaguagaccuucgu

SEQ ID NO: 315485 - RNA, 23 nt, Human
ccuugcucuuugaaugggcugag

SEQ ID NO: 315486 - RNA, 18 nt, Human
ccuuucugccucuugaag

SEQ ID NO: 315487 - RNA, 19 nt, Human
cgccucccggguucacgcc

SEQ ID NO: 315488 - RNA, 21 nt, Human
cgccuuggagaaauggcuagg

SEQ ID NO: 315489 - RNA, 20 nt, Human
cggccuccugaagugcuggg

SEQ ID NO: 315490 - RNA, 25 nt, Human
cgugaucaaggcucacugcaagcuc

SEQ ID NO: 315491 - RNA, 25 nt, Human
cgugggauccacagaccauuaacuu

SEQ ID NO: 315492 - RNA, 20 nt, Human
cuaaacaaccccaaccccac

SEQ ID NO: 315493 - RNA, 22 nt, Human
cuaaacaaccccaaccccaccc

SEQ ID NO: 315494 - RNA, 20 nt, Human
cucaacaaucuccccucccc

SEQ ID NO: 315495 - RNA, 21 nt, Human
cucacagcccaguaggcugcu

SEQ ID NO: 315496 - RNA, 20 nt, Human
cucagaacccucuccuaccc

SEQ ID NO: 315497 - RNA, 21 nt, Human
cucagaaucagggacugaaaa

SEQ ID NO: 315498 - RNA, 23 nt, Human
cucagaaucagggacugaaaauc

SEQ ID NO: 315499 - RNA, 24 nt, Human
cucagccuccugaguagcugggac

SEQ ID NO: 315500 - RNA, 20 nt, Human
cucaugcuucucagggcucc

SEQ ID NO: 315501 - RNA, 21 nt, Human
cuccaguggaaccaguggcuc

SEQ ID NO: 315502 - RNA, 23 nt, Human
cucccagaaugaaggauauaaaa

SEQ ID NO: 315503 - RNA, 19 nt, Human
cuccccucaagcccuucag

SEQ ID NO: 315504 - RNA, 23 nt, Human
cuccccuccccaccucucauucc

SEQ ID NO: 315505 - RNA, 21 nt, Human
cucccggguucacgccauucu

SEQ ID NO: 315506 - RNA, 24 nt, Human
cuccucugacuguccuucucuaaa

SEQ ID NO: 315507 - RNA, 24 nt, Human
cuccugaagugcugggauuacagg

SEQ ID NO: 315508 - RNA, 22 nt, Human
cuccugaccucgugaucugucc

SEQ ID NO: 315509 - RNA, 22 nt, Human
cuccugccucagccuccugagu

SEQ ID NO: 315510 - RNA, 21 nt, Human
cucuucauccagacuccugcc

SEQ ID NO: 315511 - RNA, 21 nt, Human
cucuuggcaccccaaucagga

SEQ ID NO: 315512 - RNA, 21 nt, Human
cucuuggcaccccaaucagga

SEQ ID NO: 315513 - RNA, 24 nt, Human
cugaaaaucuauuuguccauagca

SEQ ID NO: 315514 - RNA, 23 nt, Human
cugaagugcugggauuacaggca

SEQ ID NO: 315515 - RNA, 24 nt, Human
cugaagugcugggauuacaggcau

SEQ ID NO: 315516 - RNA, 21 nt, Human
cugcaguccuagcugcucggg

SEQ ID NO: 315517 - RNA, 22 nt, Human
cugccaaaacuaccaacacuaa

SEQ ID NO: 315518 - RNA, 23 nt, Human
cugcccuuucacuccaauuacac

SEQ ID NO: 315519 - RNA, 22 nt, Human
cugcugagggcucaugcuucuc

SEQ ID NO: 315520 - RNA, 18 nt, Human
cuggaacugcugagggcu

SEQ ID NO: 315521 - RNA, 23 nt, Human
cugggcaacauggcaaaacccca

SEQ ID NO: 315522 - RNA, 18 nt, Human
cugucacccaggcuggag

SEQ ID NO: 315523 - RNA, 22 nt, Human
cuucagaccagccugggcaaca

SEQ ID NO: 315524 - RNA, 18 nt, Human
cuuccaucuucuuuguca

SEQ ID NO: 315525 - RNA, 24 nt, Human
cuucucccuaaacaaccccaaccc

SEQ ID NO: 315526 - RNA, 19 nt, Human
cuugcagcuuccacccugc

SEQ ID NO: 315527 - RNA, 25 nt, Human
cuuucuuuuuccuuuuugcaccuuu

SEQ ID NO: 315528 - RNA, 19 nt, Human
gaaaaaugguuggaaauga

SEQ ID NO: 315529 - RNA, 19 nt, Human
gaaaagaggggugggggca

SEQ ID NO: 315530 - RNA, 19 nt, Human
gaaaagaggggugggggca

SEQ ID NO: 315531 - RNA, 22 nt, Human
gaaaaucuauuuguccauagca

SEQ ID NO: 315532 - RNA, 23 nt, Human
gaaaggacaggcaaaggcacaga

SEQ ID NO: 315533 - RNA, 23 nt, Human
gaacugaacuuacaguacuccca

SEQ ID NO: 315534 - RNA, 18 nt, Human
gaacugcugagggcucau

SEQ ID NO: 315535 - RNA, 18 nt, Human
gaagcugaauaacuggca

SEQ ID NO: 315536 - RNA, 21 nt, Human
gaaggcaagcgggaaucuguu

SEQ ID NO: 315537 - RNA, 18 nt, Human
gaagggucaugugaagug

SEQ ID NO: 315538 - RNA, 21 nt, Human
gaauagugggccccgacgacu

SEQ ID NO: 315539 - RNA, 22 nt, Human
gaaucagggacugaaaaucuau

SEQ ID NO: 315540 - RNA, 24 nt, Human
gacagaaaccaggggaagcccaga

SEQ ID NO: 315541 - RNA, 22 nt, Human
gaccucgugaucuguccaccuc

SEQ ID NO: 315542 - RNA, 22 nt, Human
gaccucgugaucuguccaccuc

SEQ ID NO: 315543 - RNA, 24 nt, Human
gaccucgugaucuguccaccucgg

SEQ ID NO: 315544 - RNA, 18 nt, Human
gagcagcaggaaguugag

SEQ ID NO: 315545 - RNA, 18 nt, Human
gagcagcaggaaguugag

SEQ ID NO: 315546 - RNA, 19 nt, Human
gagcagcaggaaguugagg

SEQ ID NO: 315547 - RNA, 19 nt, Human
gagcagcaggaaguugagg

SEQ ID NO: 315548 - RNA, 21 nt, Human
gagcagcaggaaguugagggg

SEQ ID NO: 315549 - RNA, 21 nt, Human
gagcagcaggaaguugagggg

SEQ ID NO: 315550 - RNA, 19 nt, Human
gaggcugcaaacaggccaa

SEQ ID NO: 315551 - RNA, 22 nt, Human
gagguugcagugagcugagauc

SEQ ID NO: 315552 - RNA, 19 nt, Human
gaguacuaacaaacuaugg

SEQ ID NO: 315553 - RNA, 20 nt, Human
gaguagcugggacuacaggc

SEQ ID NO: 315554 - RNA, 26 nt, Human
gaguagcugggacuacaggcgccugc

SEQ ID NO: 315555 - RNA, 19 nt, Human
gaguuauccccaaauugcu

SEQ ID NO: 315556 - RNA, 18 nt, Human
gauaguagcagcuucucu

SEQ ID NO: 315557 - RNA, 24 nt, Human
gaucccuugagccugggaggugga

SEQ ID NO: 315558 - RNA, 18 nt, Human
gaugaaagggagaggagu

SEQ ID NO: 315559 - RNA, 18 nt, Human
gauuacaggcaugagcca

SEQ ID NO: 315560 - RNA, 22 nt, Human
gauuacaggcaugagccacugc

SEQ ID NO: 315561 - RNA, 23 nt, Human
gauuacaggcaugagccacugca

SEQ ID NO: 315562 - RNA, 25 nt, Human
gauugcugccuccucucagaacccu

SEQ ID NO: 315563 - RNA, 20 nt, Human
gcacuggauuuguauucuuu

SEQ ID NO: 315564 - RNA, 23 nt, Human
gcccagaagagaaguaaacacau

SEQ ID NO: 315565 - RNA, 22 nt, Human
gccccagaaucucuggaauggc

SEQ ID NO: 315566 - RNA, 22 nt, Human
gcccuggaaaaacaaacuuuag

SEQ ID NO: 315567 - RNA, 22 nt, Human
gccgccaucuuuacuccucccg

SEQ ID NO: 315568 - RNA, 25 nt, Human
gccucccggguucacgccauucucc

SEQ ID NO: 315569 - RNA, 22 nt, Human
gccucucucagagcgcuucagc

SEQ ID NO: 315570 - RNA, 23 nt, Human
gccuggcuaauuuuuuguauuuu

SEQ ID NO: 315571 - RNA, 21 nt, Human
gcgugguggguuugucuggcu

SEQ ID NO: 315572 - RNA, 22 nt, Human
gcucagcuggagccugagggau

SEQ ID NO: 315573 - RNA, 18 nt, Human
gcucugggcuagcaaaug

SEQ ID NO: 315574 - RNA, 25 nt, Human
gcucugucacccaggcuggagugca

SEQ ID NO: 315575 - RNA, 20 nt, Human
gcugagaucacaccacugca

SEQ ID NO: 315576 - RNA, 21 nt, Human
gcugagcagcaggaaguugag

SEQ ID NO: 315577 - RNA, 19 nt, Human
gcuggagugcaguggcgug

SEQ ID NO: 315578 - RNA, 21 nt, Human
gcugggcgugggcccuuacgc

SEQ ID NO: 315579 - RNA, 21 nt, Human
gcuuucuauccauuucuccau

SEQ ID NO: 315580 - RNA, 19 nt, Human
ggaacugcugagggcucau

SEQ ID NO: 315581 - RNA, 23 nt, Human
ggacagaaaccaggggaagccca

SEQ ID NO: 315582 - RNA, 22 nt, Human
ggaccaaauccaauguggacaa

SEQ ID NO: 315583 - RNA, 22 nt, Human
ggaccaaauccaauguggacaa

SEQ ID NO: 315584 - RNA, 19 nt, Human
ggacuggaaaagaggggug

SEQ ID NO: 315585 - RNA, 19 nt, Human
ggacuggaaaagaggggug

SEQ ID NO: 315586 - RNA, 20 nt, Human
ggagaggagugaaguguaug

SEQ ID NO: 315587 - RNA, 23 nt, Human
ggagaggcauggaaaccucaggg

SEQ ID NO: 315588 - RNA, 18 nt, Human
ggagcaggcaguggugcu

SEQ ID NO: 315589 - RNA, 26 nt, Human
ggagggcuuccgggacacuggguugu

SEQ ID NO: 315590 - RNA, 24 nt, Human
ggagguucuagggaacaucaaaug

SEQ ID NO: 315591 - RNA, 18 nt, Human
ggagguugcagugagcug

SEQ ID NO: 315592 - RNA, 22 nt, Human
ggagguugcagugagcugagau

SEQ ID NO: 315593 - RNA, 23 nt, Human
ggagguugcagugagcugagauc

SEQ ID NO: 315594 - RNA, 24 nt, Human
ggagguugcagugagcugagauca

SEQ ID NO: 315595 - RNA, 24 nt, Human
ggauggucucgaacuccugaccuc

SEQ ID NO: 315596 - RNA, 22 nt, Human
ggauuacaggcaugagccacug

SEQ ID NO: 315597 - RNA, 21 nt, Human
ggcaaggaacucuauugccag

SEQ ID NO: 315598 - RNA, 21 nt, Human
ggcauugaaagugcagagaaa

SEQ ID NO: 315599 - RNA, 21 nt, Human
ggcauugaaagugcagagaaa

SEQ ID NO: 315600 - RNA, 19 nt, Human
ggccacugaagaggccagc

SEQ ID NO: 315601 - RNA, 21 nt, Human
ggccuggaccgaaacacuggc

SEQ ID NO: 315602 - RNA, 23 nt, Human
ggcgugggcccuuacgccuguaa

SEQ ID NO: 315603 - RNA, 22 nt, Human
ggcuggagugcaguggcgugau

SEQ ID NO: 315604 - RNA, 25 nt, Human
gggaaaaacaaaagauaugauuuaa

SEQ ID NO: 315605 - RNA, 19 nt, Human
gggauagggguuuggaaga

SEQ ID NO: 315606 - RNA, 19 nt, Human
gggauagggguuuggaaga

SEQ ID NO: 315607 - RNA, 21 nt, Human
ggguuucaccguguuagccag

SEQ ID NO: 315608 - RNA, 18 nt, Human
gguaggcugggcgugggc

SEQ ID NO: 315609 - RNA, 19 nt, Human
gguggagguugcagugagc

SEQ ID NO: 315610 - RNA, 24 nt, Human
guacuuuugaaaggcacaaacaga

SEQ ID NO: 315611 - RNA, 24 nt, Human
gucacaugacuaaaaggagaaggg

SEQ ID NO: 315612 - RNA, 18 nt, Human
gucaugugaaguggcagg

SEQ ID NO: 315613 - RNA, 24 nt, Human
gucccugacagggucuacugcuuc

SEQ ID NO: 315614 - RNA, 20 nt, Human
gucccuuucuuuccucauaa

SEQ ID NO: 315615 - RNA, 18 nt, Human
gugaucaaggcucacugc

SEQ ID NO: 315616 - RNA, 19 nt, Human
gugcugggauuacaggcau

SEQ ID NO: 315617 - RNA, 20 nt, Human
guggagguugcagugagcug

SEQ ID NO: 315618 - RNA, 19 nt, Human
guggcagggaugcaacacc

SEQ ID NO: 315619 - RNA, 18 nt, Human
guggccucagauacuuga

SEQ ID NO: 315620 - RNA, 18 nt, Human
guuaaagaguugcagaua

SEQ ID NO: 315621 - RNA, 19 nt, Human
guugcagugagcugagauc

SEQ ID NO: 315622 - RNA, 22 nt, Human
guuucagagggaggaccaugga

SEQ ID NO: 315623 - RNA, 21 nt, Human
uaaaacaacuuguccaaaggc

SEQ ID NO: 315624 - RNA, 18 nt, Human
uaaaaccaggaauggcaa

SEQ ID NO: 315625 - RNA, 23 nt, Human
uaaacagcaugugguguuucaga

SEQ ID NO: 315626 - RNA, 21 nt, Human
uaaacuuggggugggaacuag

SEQ ID NO: 315627 - RNA, 20 nt, Human
uaaagcacccucggcuccaa

SEQ ID NO: 315628 - RNA, 20 nt, Human
uaacaaaguacauggcuuug

SEQ ID NO: 315629 - RNA, 23 nt, Human
uaacaaaguacauggcuuugaga

SEQ ID NO: 315630 - RNA, 20 nt, Human
uaacaaauuaaugaaaacag

SEQ ID NO: 315631 - RNA, 23 nt, Human
uaacaacaaccaguaaaacaaaa

SEQ ID NO: 315632 - RNA, 19 nt, Human
uaagaaugaauaaaucaca

SEQ ID NO: 315633 - RNA, 23 nt, Human
uaagaggcuccccaccaucagug

SEQ ID NO: 315634 - RNA, 20 nt, Human
uaagcagaugaauuggggaa

SEQ ID NO: 315635 - RNA, 19 nt, Human
uaaugguuuaauuuugcac

SEQ ID NO: 315636 - RNA, 24 nt, Human
uaauuuuuuguauuuuuaguagag

SEQ ID NO: 315637 - RNA, 23 nt, Human
uacaggcaucauauagaagugaa

SEQ ID NO: 315638 - RNA, 22 nt, Human
uacaggcaugagccacugcacc

SEQ ID NO: 315639 - RNA, 22 nt, Human
uacaggcgccugccaccacgcc

SEQ ID NO: 315640 - RNA, 23 nt, Human
uacucaaaacuauauaacaacaa

SEQ ID NO: 315641 - RNA, 19 nt, Human
uacugcuuccugagcagug

SEQ ID NO: 315642 - RNA, 21 nt, Human
uacuugacuuucgccauaugu

SEQ ID NO: 315643 - RNA, 23 nt, Human
uagaaggagaugcuggcguggug

SEQ ID NO: 315644 - RNA, 22 nt, Human
uagaaggccuauaauuaccauc

SEQ ID NO: 315645 - RNA, 24 nt, Human
uagccaggauggucucgaacuccu

SEQ ID NO: 315646 - RNA, 18 nt, Human
uaggaggcuugugaaagc

SEQ ID NO: 315647 - RNA, 21 nt, Human
uaguagagauuggguuucacc

SEQ ID NO: 315648 - RNA, 24 nt, Human
uaguagagauuggguuucaccgug

SEQ ID NO: 315649 - RNA, 26 nt, Human
uaguagagauuggguuucaccguguu

SEQ ID NO: 315650 - RNA, 23 nt, Human
uaguagaucuggacuacaaggag

SEQ ID NO: 315651 - RNA, 21 nt, Human
uaguggaggagggaagugagu

SEQ ID NO: 315652 - RNA, 21 nt, Human
uauaaaaggauagaaaggaaa

SEQ ID NO: 315653 - RNA, 21 nt, Human
uaucacuggcaacccuaaaau

SEQ ID NO: 315654 - RNA, 26 nt, Human
uaucgcuuugggaggcccagccaggu

SEQ ID NO: 315655 - RNA, 22 nt, Human
uaucucaagugccguuaaagag

SEQ ID NO: 315656 - RNA, 19 nt, Human
uaugaggaaugacuuaaag

SEQ ID NO: 315657 - RNA, 18 nt, Human
uauuuuuuuugagaugga

SEQ ID NO: 315658 - RNA, 22 nt, Human
uauuuuuuuugagauggagucu

SEQ ID NO: 315659 - RNA, 21 nt, Human
ucaaaaauuagcugggcaugg

SEQ ID NO: 315660 - RNA, 20 nt, Human
ucaacaaacagguggccacu

SEQ ID NO: 315661 - RNA, 19 nt, Human
ucaagcuacuucuggcccu

SEQ ID NO: 315662 - RNA, 21 nt, Human
ucaauagcugucccugacagg

SEQ ID NO: 315663 - RNA, 19 nt, Human
ucaauggaacuaaagauug

SEQ ID NO: 315664 - RNA, 23 nt, Human
ucacaccacugcacuccagccug

SEQ ID NO: 315665 - RNA, 23 nt, Human
ucacagcccaguaggcugcuauc

SEQ ID NO: 315666 - RNA, 24 nt, Human
ucacccaggcuggagugcaguggc

SEQ ID NO: 315667 - RNA, 24 nt, Human
ucaccguguuagccaggauggucu

SEQ ID NO: 315668 - RNA, 23 nt, Human
ucaccuuggaugcuaaccauucc

SEQ ID NO: 315669 - RNA, 23 nt, Human
ucaccuuggaugcuaaccauucc

SEQ ID NO: 315670 - RNA, 18 nt, Human
ucacugcaagcuccgccu

SEQ ID NO: 315671 - RNA, 19 nt, Human
ucacugcaagcuccgccuc

SEQ ID NO: 315672 - RNA, 24 nt, Human
ucacugcaagcuccgccucccggg

SEQ ID NO: 315673 - RNA, 18 nt, Human
ucacugucaccuuggaug

SEQ ID NO: 315674 - RNA, 18 nt, Human
ucacugucaccuuggaug

SEQ ID NO: 315675 - RNA, 21 nt, Human
ucagcccggagcagagggcgg

SEQ ID NO: 315676 - RNA, 23 nt, Human
ucagccuccugaguagcugggac

SEQ ID NO: 315677 - RNA, 19 nt, Human
ucagcuggagccugaggga

SEQ ID NO: 315678 - RNA, 21 nt, Human
ucagggcaaagacaaggagga

SEQ ID NO: 315679 - RNA, 24 nt, Human
ucaguaguuuacacacacuuucgu

SEQ ID NO: 315680 - RNA, 20 nt, Human
ucauuuuacagacagggagg

SEQ ID NO: 315681 - RNA, 25 nt, Human
uccaaacacagaguacuaacaaaga

SEQ ID NO: 315682 - RNA, 20 nt, Human
uccaagcagcacaagaaaaa

SEQ ID NO: 315683 - RNA, 23 nt, Human
ucccauuuuaagaaagcugagga

SEQ ID NO: 315684 - RNA, 20 nt, Human
uccccaccucucauuccucc

SEQ ID NO: 315685 - RNA, 22 nt, Human
uccccagaacacccagaucaac

SEQ ID NO: 315686 - RNA, 21 nt, Human
ucccggguucacgccauucuc

SEQ ID NO: 315687 - RNA, 24 nt, Human
ucccggguucacgccauucuccug

SEQ ID NO: 315688 - RNA, 20 nt, Human
ucccuaaacaaccccaaccc

SEQ ID NO: 315689 - RNA, 26 nt, Human
ucccuaaacaaccccaaccccacccc

SEQ ID NO: 315690 - RNA, 18 nt, Human
ucccugacagggucuacu

SEQ ID NO: 315691 - RNA, 19 nt, Human
ucccuugagccugggaggu

SEQ ID NO: 315692 - RNA, 24 nt, Human
ucccuugagccugggagguggagg

SEQ ID NO: 315693 - RNA, 21 nt, Human
uccuccaaacucucuuuaccu

SEQ ID NO: 315694 - RNA, 24 nt, Human
uccugaagugcugggauuacaggc

SEQ ID NO: 315695 - RNA, 24 nt, Human
uccugaguagcugggacuacaggc

SEQ ID NO: 315696 - RNA, 19 nt, Human
uccuucccaguacuugcag

SEQ ID NO: 315697 - RNA, 21 nt, Human
uccuugcacugacuucauuuc

SEQ ID NO: 315698 - RNA, 20 nt, Human
uccuuucugcuucuugaagg

SEQ ID NO: 315699 - RNA, 20 nt, Human
ucuaaccacuggaaauaauc

SEQ ID NO: 315700 - RNA, 19 nt, Human
ucuccagauggcucgaauu

SEQ ID NO: 315701 - RNA, 19 nt, Human
ucuccagauggcucgaauu

SEQ ID NO: 315702 - RNA, 21 nt, Human
ucuccuguucuguaauuggga

SEQ ID NO: 315703 - RNA, 19 nt, Human
ucucgaacuccugaccucg

SEQ ID NO: 315704 - RNA, 21 nt, Human
ucucuaaagcacccucggcuc

SEQ ID NO: 315705 - RNA, 18 nt, Human
ucucugaacucucagaau

SEQ ID NO: 315706 - RNA, 20 nt, Human
ucucugcccuuucacuccaa

SEQ ID NO: 315707 - RNA, 23 nt, Human
ucugagaggagacagugucuguc

SEQ ID NO: 315708 - RNA, 19 nt, Human
ucugaguuuucauuuguaa

SEQ ID NO: 315709 - RNA, 21 nt, Human
ucugcagcuauuuauucagcu

SEQ ID NO: 315710 - RNA, 18 nt, Human
ucugcucacuccaugccc

SEQ ID NO: 315711 - RNA, 20 nt, Human
ucugguugucggauuucagu

SEQ ID NO: 315712 - RNA, 24 nt, Human
ucugucacccaggcuggagugcag

SEQ ID NO: 315713 - RNA, 24 nt, Human
ucuguggcuaggagaggcugcaaa

SEQ ID NO: 315714 - RNA, 22 nt, Human
ucuguuagggugacaccuugag

SEQ ID NO: 315715 - RNA, 25 nt, Human
ucuguuagggugacaccuugaguag

SEQ ID NO: 315716 - RNA, 24 nt, Human
ucuguugcuggaacugcugagggc

SEQ ID NO: 315717 - RNA, 23 nt, Human
ucuugcucugucacccaggcugg

SEQ ID NO: 315718 - RNA, 24 nt, Human
ucuugcucugucacccaggcugga

SEQ ID NO: 315719 - RNA, 19 nt, Human
ucuugucacaaggaaaacu

SEQ ID NO: 315720 - RNA, 24 nt, Human
ucuuuccagccugcuuccacuucc

SEQ ID NO: 315721 - RNA, 21 nt, Human
ucuuugucacaauguugcaag

SEQ ID NO: 315722 - RNA, 21 nt, Human
ugaaagggagaggagugaagu

SEQ ID NO: 315723 - RNA, 25 nt, Human
ugaaauuaccuaggauaguuuacac

SEQ ID NO: 315724 - RNA, 21 nt, Human
ugaagagggugauagaaagaa

SEQ ID NO: 315725 - RNA, 21 nt, Human
ugaagagggugauagaaagaa

SEQ ID NO: 315726 - RNA, 21 nt, Human
ugaaggaaagaccaucuugaa

SEQ ID NO: 315727 - RNA, 20 nt, Human
ugaaguuaauccauacaacu

SEQ ID NO: 315728 - RNA, 25 nt, Human
ugaauguccuuucugccucuugaag

SEQ ID NO: 315729 - RNA, 25 nt, Human
ugaauguccuuucugcuucuugaag

SEQ ID NO: 315730 - RNA, 26 nt, Human
ugaauguccuuucugcuucuugaagg

SEQ ID NO: 315731 - RNA, 22 nt, Human
ugacacaauaauagaaagcugg

SEQ ID NO: 315732 - RNA, 18 nt, Human
ugacauuccaggcccagc

SEQ ID NO: 315733 - RNA, 21 nt, Human
ugacauuccaggcccagcacu

SEQ ID NO: 315734 - RNA, 24 nt, Human
ugaccaugcccaugggugaaagcu

SEQ ID NO: 315735 - RNA, 20 nt, Human
ugaccucugggucuugccuc

SEQ ID NO: 315736 - RNA, 23 nt, Human
ugacuguccuucucuaaacacug

SEQ ID NO: 315737 - RNA, 18 nt, Human
ugagaucacaccacugca

SEQ ID NO: 315738 - RNA, 24 nt, Human
ugagaucacaccacugcacuccag

SEQ ID NO: 315739 - RNA, 22 nt, Human
ugagauggagucuugcucuguc

SEQ ID NO: 315740 - RNA, 23 nt, Human
ugagcccagcagcuucagaccag

SEQ ID NO: 315741 - RNA, 18 nt, Human
ugagccugggagguggag

SEQ ID NO: 315742 - RNA, 24 nt, Human
ugagccugggagguggagguugca

SEQ ID NO: 315743 - RNA, 22 nt, Human
ugagccugguguacuccccaga

SEQ ID NO: 315744 - RNA, 22 nt, Human
ugagccugguguacuccccaga

SEQ ID NO: 315745 - RNA, 21 nt, Human
ugaggugagaggaucccuuga

SEQ ID NO: 315746 - RNA, 24 nt, Human
ugaggugagaggaucccuugagcc

SEQ ID NO: 315747 - RNA, 18 nt, Human
ugaugacucugaugaggg

SEQ ID NO: 315748 - RNA, 18 nt, Human
ugcaacaaauugcuuucu

SEQ ID NO: 315749 - RNA, 18 nt, Human
ugcagagaaaauguagag

SEQ ID NO: 315750 - RNA, 18 nt, Human
ugcagagaaaauguagag

SEQ ID NO: 315751 - RNA, 18 nt, Human
ugcagcugcuggcugcug

SEQ ID NO: 315752 - RNA, 19 nt, Human
ugcagcugcuggcugcugg

SEQ ID NO: 315753 - RNA, 22 nt, Human
ugcagggaaaucauugcccugg

SEQ ID NO: 315754 - RNA, 23 nt, Human
ugcaguuggaagacagggagguu

SEQ ID NO: 315755 - RNA, 18 nt, Human
ugccaaaacuaccaacac

SEQ ID NO: 315756 - RNA, 22 nt, Human
ugccaaaacuaccaacacuaaa

SEQ ID NO: 315757 - RNA, 18 nt, Human
ugccccagggcugcuggc

SEQ ID NO: 315758 - RNA, 19 nt, Human
ugcccucaaccccaacucu

SEQ ID NO: 315759 - RNA, 24 nt, Human
ugccucagccuccugaguagcugg

SEQ ID NO: 315760 - RNA, 19 nt, Human
ugccucuaguggagaaaca

SEQ ID NO: 315761 - RNA, 24 nt, Human
ugcucugucacccaggcuggagug

SEQ ID NO: 315762 - RNA, 22 nt, Human
ugcugaauccuuucugcuuucu

SEQ ID NO: 315763 - RNA, 20 nt, Human
ugcuggcugcuggccaagau

SEQ ID NO: 315764 - RNA, 19 nt, Human
ugcuuucuauccauuucuc

SEQ ID NO: 315765 - RNA, 26 nt, Human
uggaaaaggaucagcagcccuggaaa

SEQ ID NO: 315766 - RNA, 22 nt, Human
uggaaccaucuaauaagcacau

SEQ ID NO: 315767 - RNA, 19 nt, Human
uggaagaacagggcauuga

SEQ ID NO: 315768 - RNA, 19 nt, Human
uggaagaacagggcauuga

SEQ ID NO: 315769 - RNA, 23 nt, Human
uggaagcugaauaacuggcaaca

SEQ ID NO: 315770 - RNA, 19 nt, Human
uggaauagggggcgguggu

SEQ ID NO: 315771 - RNA, 20 nt, Human
uggaccaaauccaaugugga

SEQ ID NO: 315772 - RNA, 20 nt, Human
uggaccaaauccaaugugga

SEQ ID NO: 315773 - RNA, 20 nt, Human
uggacuuggauuuuugaggu

SEQ ID NO: 315774 - RNA, 20 nt, Human
uggagaaacagucaguaguu

SEQ ID NO: 315775 - RNA, 25 nt, Human
uggaggagggaagugaguuggagag

SEQ ID NO: 315776 - RNA, 21 nt, Human
uggaguaaagacacaaaaugc

SEQ ID NO: 315777 - RNA, 19 nt, Human
uggagucuugcucugucac

SEQ ID NO: 315778 - RNA, 19 nt, Human
uggagugcaguggcgugau

SEQ ID NO: 315779 - RNA, 21 nt, Human
uggagugcaguggcgugauca

SEQ ID NO: 315780 - RNA, 24 nt, Human
uggagugcaguggcgugaucaagg

SEQ ID NO: 315781 - RNA, 24 nt, Human
uggccaaagacaacugaggucagg

SEQ ID NO: 315782 - RNA, 19 nt, Human
uggccaagauucuguguuu

SEQ ID NO: 315783 - RNA, 18 nt, Human
uggcugagcugggcaccu

SEQ ID NO: 315784 - RNA, 21 nt, Human
ugggacuacaggcgccugcca

SEQ ID NO: 315785 - RNA, 22 nt, Human
ugggacuacaggcgccugccac

SEQ ID NO: 315786 - RNA, 24 nt, Human
ugggacuacaggcgccugccacca

SEQ ID NO: 315787 - RNA, 25 nt, Human
ugggagaggcauggaaaccucaggg

SEQ ID NO: 315788 - RNA, 24 nt, Human
ugggaggcccagccagguggauug

SEQ ID NO: 315789 - RNA, 18 nt, Human
ugggagguggagguugca

SEQ ID NO: 315790 - RNA, 29 nt, Human
ugggagguggagguugcagugacaacggu

SEQ ID NO: 315791 - RNA, 24 nt, Human
ugggagguggagguugcagugagc

SEQ ID NO: 315792 - RNA, 20 nt, Human
ugggauggggcuggggucau

SEQ ID NO: 315793 - RNA, 19 nt, Human
ugggauuacaggcaugagc

SEQ ID NO: 315794 - RNA, 21 nt, Human
ugggauuacaggcaugagcca

SEQ ID NO: 315795 - RNA, 22 nt, Human
ugggauuacaggcaugagccac

SEQ ID NO: 315796 - RNA, 22 nt, Human
ugggauuacaggcaugagccac

SEQ ID NO: 315797 - RNA, 24 nt, Human
ugggauuacaggcaugagccacug

SEQ ID NO: 315798 - RNA, 24 nt, Human
ugggauuacaggcaugagccacug

SEQ ID NO: 315799 - RNA, 22 nt, Human
ugggcaacauggcaaaacccca

SEQ ID NO: 315800 - RNA, 23 nt, Human
uggguuucaccguguuagccagg

SEQ ID NO: 315801 - RNA, 20 nt, Human
ugguaucagaaccuccuacu

SEQ ID NO: 315802 - RNA, 26 nt, Human
uggucuccuuggccaggcuauggagg

SEQ ID NO: 315803 - RNA, 19 nt, Human
uggugcacaccugcagucc

SEQ ID NO: 315804 - RNA, 23 nt, Human
ugguuuggggaagggaaaugggu

SEQ ID NO: 315805 - RNA, 18 nt, Human
uguaaccccuuucccugg

SEQ ID NO: 315806 - RNA, 22 nt, Human
uguaaggcagaguucaagacaa

SEQ ID NO: 315807 - RNA, 23 nt, Human
uguaaucaaguauaugccagacc

SEQ ID NO: 315808 - RNA, 22 nt, Human
ugucauaaaacuugggauaggg

SEQ ID NO: 315809 - RNA, 22 nt, Human
ugucauaaaacuugggauaggg

SEQ ID NO: 315810 - RNA, 18 nt, Human
ugucucaacucagcacac

SEQ ID NO: 315811 - RNA, 19 nt, Human
ugugcugggaagacacacu

SEQ ID NO: 315812 - RNA, 18 nt, Human
uguugauuuccucuccca

SEQ ID NO: 315813 - RNA, 20 nt, Human
uuagcugggcaugguggugc

SEQ ID NO: 315814 - RNA, 18 nt, Human
uuaguagagauuggguuu

SEQ ID NO: 315815 - RNA, 22 nt, Human
uuaguagagauuggguuucacc

SEQ ID NO: 315816 - RNA, 24 nt, Human
uuaguagagauuggguuucaccgu

SEQ ID NO: 315817 - RNA, 21 nt, Human
uucaacaaacagguggccacu

SEQ ID NO: 315818 - RNA, 19 nt, Human
uucacaaagcaagucuggc

SEQ ID NO: 315819 - RNA, 24 nt, Human
uucaccaugcagcugcuggcugcu

SEQ ID NO: 315820 - RNA, 21 nt, Human
uucagcuugagcugccugggg

SEQ ID NO: 315821 - RNA, 22 nt, Human
uucauuucucauuagaagcagg

SEQ ID NO: 315822 - RNA, 21 nt, Human
uuccaccaaaacauccauuuc

SEQ ID NO: 315823 - RNA, 21 nt, Human
uuccaccaaaacauccauuuc

SEQ ID NO: 315824 - RNA, 20 nt, Human
uucgugggauccacagacca

SEQ ID NO: 315825 - RNA, 24 nt, Human
uucucccuaaacaaccccaacccc

SEQ ID NO: 315826 - RNA, 19 nt, Human
uucugcucacuccaugccc

SEQ ID NO: 315827 - RNA, 22 nt, Human
uugaaaaauaacaaauuaauga

SEQ ID NO: 315828 - RNA, 23 nt, Human
uugaaaaauaacaaauuaaugaa

SEQ ID NO: 315829 - RNA, 19 nt, Human
uugaaaagcuugcaaauuu

SEQ ID NO: 315830 - RNA, 24 nt, Human
uugaagggggaagauaagugggag

SEQ ID NO: 315831 - RNA, 21 nt, Human
uugagauggagucuugcucug

SEQ ID NO: 315832 - RNA, 24 nt, Human
uugagccugggagguggagguugc

SEQ ID NO: 315833 - RNA, 19 nt, Human
uugcagugagcugagauca

SEQ ID NO: 315834 - RNA, 20 nt, Human
uugcagugagcugagaucac

SEQ ID NO: 315835 - RNA, 24 nt, Human
uugcucugucacccaggcuggagu

SEQ ID NO: 315836 - RNA, 19 nt, Human
uugcugaugacucugauga

SEQ ID NO: 315837 - RNA, 24 nt, Human
uugcuuccugaguggaaccaucua

SEQ ID NO: 315838 - RNA, 23 nt, Human
uugcuugagcccagcagcuucag

SEQ ID NO: 315839 - RNA, 18 nt, Human
uuggaaggcaaggacugg

SEQ ID NO: 315840 - RNA, 24 nt, Human
uuggguuucaccguguuagccagg

SEQ ID NO: 315841 - RNA, 19 nt, Human
uuucaccguguuagccagg

SEQ ID NO: 315842 - RNA, 22 nt, Human
uuucagagggaggaccauggag

SEQ ID NO: 315843 - RNA, 25 nt, Human
uuucucagcccucagaaaucaccuc

SEQ ID NO: 315844 - RNA, 20 nt, Human
uuugcugaugacucugauga

SEQ ID NO: 315845 - RNA, 18 nt, Human
uuugguuggaaggcaagg

SEQ ID NO: 315846 - RNA, 18 nt, Human
uuugguuggaaggcaagg

SEQ ID NO: 315847 - RNA, 24 nt, Human
uuuuuaguagagauuggguuucac

SEQ ID NO: 315848 - RNA, 21 nt, Human
uuuuuguauuuuuaguagaga

SEQ ID NO: 315849 - RNA, 18 nt, Human
uuuuuuguauuuuuagua

SEQ ID NO: 315850 - RNA, 26 nt, Human
aaaaaaccccaaaaguggaaaacuga

SEQ ID NO: 315851 - RNA, 19 nt, Human
aacaauaaaaaaccccaaa

SEQ ID NO: 315852 - RNA, 20 nt, Human
aacaauaaaaaaccccaaaa

SEQ ID NO: 315853 - RNA, 22 nt, Human
aauaacaauaaaaaaccccaaa

SEQ ID NO: 315854 - RNA, 23 nt, Human
aauaacaauaaaaaaccccaaaa

SEQ ID NO: 315855 - RNA, 23 nt, Human
cacgaggagcccugcucauggca

SEQ ID NO: 315856 - RNA, 23 nt, Human
ccaccgccuccgggacgcccgcc

SEQ ID NO: 315857 - RNA, 23 nt, Human
cgccaccgccuccgggacgcccg

SEQ ID NO: 315858 - RNA, 22 nt, Human
cucauggcaccaggccuggccg

SEQ ID NO: 315859 - RNA, 24 nt, Human
cucccugcgccaccgccuccggga

SEQ ID NO: 315860 - RNA, 19 nt, Human
cugcgccaccgccuccggg

SEQ ID NO: 315861 - RNA, 18 nt, Human
uaacaauaaaaaacccca

SEQ ID NO: 315862 - RNA, 20 nt, Human
ucgggccccucccugcgcca

SEQ ID NO: 315863 - RNA, 24 nt, Human
ucgggccccucccugcgccaccgc

SEQ ID NO: 315864 - RNA, 21 nt, Human
ugcucauggcaccaggccugg

SEQ ID NO: 315865 - RNA, 19 nt, Human
uggaaaacugagggggcag

SEQ ID NO: 315866 - RNA, 24 nt, Human
uuaauaacaauaaaaaaccccaaa

SEQ ID NO: 315867 - RNA, 24 nt, Human
uuuuuuuuuuuuuuuuugcaccaa

SEQ ID NO: 315868 - RNA, 27 nt, Human
uuuuuuuuuuuuuuuuuuuuuuugggg

SEQ ID NO: 315869 - RNA, 22 nt, Human
aaaaaaaaaaagaguauguggg

SEQ ID NO: 315870 - RNA, 25 nt, Human
aaaaaacaaaaacaaacaaaaaccc

SEQ ID NO: 315871 - RNA, 23 nt, Human
aaaaaacaaacaaaaaaaacccu

SEQ ID NO: 315872 - RNA, 20 nt, Human
aaaaaacagagcagacauug

SEQ ID NO: 315873 - RNA, 23 nt, Human
aaaaaacagagcagacauuggug

SEQ ID NO: 315874 - RNA, 24 nt, Human
aaaaaaucaaaauaauggccacag

SEQ ID NO: 315875 - RNA, 22 nt, Human
aaaaacaaaaacaaacaaaaac

SEQ ID NO: 315876 - RNA, 20 nt, Human
aaaaacaaacaaaaaccccc

SEQ ID NO: 315877 - RNA, 24 nt, Human
aaaaacauuaaaaaacaaaaacaa

SEQ ID NO: 315878 - RNA, 20 nt, Human
aaaacaaacaaaaaaaaccc

SEQ ID NO: 315879 - RNA, 21 nt, Human
aaaaccccccaaaaacaaaaa

SEQ ID NO: 315880 - RNA, 22 nt, Human
aaaaucagagggugcaugaaua

SEQ ID NO: 315881 - RNA, 25 nt, Human
aaacaaaaaacagagcagacauugg

SEQ ID NO: 315882 - RNA, 27 nt, Human
aaacaaaaacaaacaaaaaccccccaa

SEQ ID NO: 315883 - RNA, 24 nt, Human
aaacaaaaccaaagucauggggaa

SEQ ID NO: 315884 - RNA, 22 nt, Human
aaacaaacaaaaaaaacccuca

SEQ ID NO: 315885 - RNA, 23 nt, Human
aaacaaacaaaaaaaacccucag

SEQ ID NO: 315886 - RNA, 24 nt, Human
aaacaaacaaaaaaaacccucagu

SEQ ID NO: 315887 - RNA, 22 nt, Human
aaacaagaaaaccaaaaucaga

SEQ ID NO: 315888 - RNA, 23 nt, Human
aaacagacaaaucaaguugaagg

SEQ ID NO: 315889 - RNA, 23 nt, Human
aaacagacaagguaacaccaaau

SEQ ID NO: 315890 - RNA, 24 nt, Human
aaaccccccaaaaacaaaaaacag

SEQ ID NO: 315891 - RNA, 18 nt, Human
aaaucaucaucuacuuuc

SEQ ID NO: 315892 - RNA, 23 nt, Human
aaaugacagaagagugagagaaa

SEQ ID NO: 315893 - RNA, 23 nt, Human
aaccauaacuaaaccaagacaca

SEQ ID NO: 315894 - RNA, 24 nt, Human
aaccccccaaaaacaaaaaacaga

SEQ ID NO: 315895 - RNA, 19 nt, Human
aacccucaaaaaacaaaca

SEQ ID NO: 315896 - RNA, 22 nt, Human
aagaaaaccaaaaucagagggu

SEQ ID NO: 315897 - RNA, 21 nt, Human
aagacacacagggcuuuccug

SEQ ID NO: 315898 - RNA, 18 nt, Human
aagggaauggcgagauag

SEQ ID NO: 315899 - RNA, 23 nt, Human
aaguguuaaaauacuauucagcc

SEQ ID NO: 315900 - RNA, 21 nt, Human
aauauaugugcacgcacaugu

SEQ ID NO: 315901 - RNA, 18 nt, Human
aaugcaguuuuggacuga

SEQ ID NO: 315902 - RNA, 20 nt, Human
acaaaaaccccccaaaaaca

SEQ ID NO: 315903 - RNA, 21 nt, Human
acaaaaaccccccaaaaacaa

SEQ ID NO: 315904 - RNA, 20 nt, Human
acaaacaaaaaccccccaaa

SEQ ID NO: 315905 - RNA, 23 nt, Human
acagacuuaaucucuacaucccc

SEQ ID NO: 315906 - RNA, 21 nt, Human
acagucuuaaugauccuuuaa

SEQ ID NO: 315907 - RNA, 21 nt, Human
acauagcagcaaaugacagaa

SEQ ID NO: 315908 - RNA, 18 nt, Human
acugcacucacaguucag

SEQ ID NO: 315909 - RNA, 20 nt, Human
acugcacucacaguucagca

SEQ ID NO: 315910 - RNA, 20 nt, Human
agacagguauuuaaagggaa

SEQ ID NO: 315911 - RNA, 26 nt, Human
aggcagccgcagaucccgcucaggga

SEQ ID NO: 315912 - RNA, 25 nt, Human
aggcauuuucagucuaaucagucuc

SEQ ID NO: 315913 - RNA, 26 nt, Human
agguauagaaauucagcagcuaaacu

SEQ ID NO: 315914 - RNA, 20 nt, Human
agucacaggguuuacaucua

SEQ ID NO: 315915 - RNA, 21 nt, Human
augaaaacagacaagguaaca

SEQ ID NO: 315916 - RNA, 24 nt, Human
auguaucuauauauaaaauauaca

SEQ ID NO: 315917 - RNA, 19 nt, Human
augucaaauuuuagucauc

SEQ ID NO: 315918 - RNA, 25 nt, Human
caaaaacaaacaaaaaccccccaaa

SEQ ID NO: 315919 - RNA, 22 nt, Human
caaaaaccccccaaaaacaaag

SEQ ID NO: 315920 - RNA, 21 nt, Human
caaacaaaaaccccccaaaaa

SEQ ID NO: 315921 - RNA, 24 nt, Human
caaacaaaaaccccccaaaaacaa

SEQ ID NO: 315922 - RNA, 25 nt, Human
caaacaaaaaccccccaaaaacaaa

SEQ ID NO: 315923 - RNA, 21 nt, Human
caagaaaaccaaaaucagagg

SEQ ID NO: 315924 - RNA, 19 nt, Human
caagguaacaccaaauagu

SEQ ID NO: 315925 - RNA, 22 nt, Human
cacaacgaccccgacgccagag

SEQ ID NO: 315926 - RNA, 21 nt, Human
cacgacacaacgaccccgacg

SEQ ID NO: 315927 - RNA, 18 nt, Human
cacugcugcuacucaaac

SEQ ID NO: 315928 - RNA, 24 nt, Human
cagaaaaugcaacaguaacucuua

SEQ ID NO: 315929 - RNA, 22 nt, Human
cagaaacaagaaaaccaaaauc

SEQ ID NO: 315930 - RNA, 19 nt, Human
cagcagagacucgcaggca

SEQ ID NO: 315931 - RNA, 18 nt, Human
cagcagcuaaacuguauu

SEQ ID NO: 315932 - RNA, 26 nt, Human
cagccuaaaaccccacugagcaugcu

SEQ ID NO: 315933 - RNA, 21 nt, Human
ccaaaaacaaaaaacagagca

SEQ ID NO: 315934 - RNA, 19 nt, Human
cccaaaaacaaaaaacaga

SEQ ID NO: 315935 - RNA, 25 nt, Human
cccaaaaacaaaaaacagagcagac

SEQ ID NO: 315936 - RNA, 23 nt, Human
ccccaaagauauuguuuaacuuc

SEQ ID NO: 315937 - RNA, 21 nt, Human
cccccaaaaacaaaaaacaga

SEQ ID NO: 315938 - RNA, 18 nt, Human
ccccccaaaaacaaaaaa

SEQ ID NO: 315939 - RNA, 24 nt, Human
cccucaaaaaacaaacaaaaaaaa

SEQ ID NO: 315940 - RNA, 28 nt, Human
cccucaaaaaacaaacaaaaaaaacccu

SEQ ID NO: 315941 - RNA, 19 nt, Human
ccgcucagggcuaaagcgg

SEQ ID NO: 315942 - RNA, 21 nt, Human
ccuauagcacugcugcuacuc

SEQ ID NO: 315943 - RNA, 22 nt, Human
ccucaaaaaacaaacaaaaaaa

SEQ ID NO: 315944 - RNA, 25 nt, Human
ccuuggcuagaacugaaccgggguc

SEQ ID NO: 315945 - RNA, 20 nt, Human
cgacacaacgaccccgacgc

SEQ ID NO: 315946 - RNA, 18 nt, Human
cgcgcacccuuagccccu

SEQ ID NO: 315947 - RNA, 21 nt, Human
cuaaaaaccagaaaaugaguu

SEQ ID NO: 315948 - RNA, 22 nt, Human
cuaaaaccccacugagcaugcc

SEQ ID NO: 315949 - RNA, 25 nt, Human
cucaaaaaacaaacaaaaaaaaccc

SEQ ID NO: 315950 - RNA, 20 nt, Human
cuccuaauguggugacaguc

SEQ ID NO: 315951 - RNA, 27 nt, Human
cucucaugcaaagaaaacccucaaaaa

SEQ ID NO: 315952 - RNA, 23 nt, Human
cugaacauucagaucugucucuc

SEQ ID NO: 315953 - RNA, 21 nt, Human
cugcaugugacagccuaaaac

SEQ ID NO: 315954 - RNA, 19 nt, Human
cugcugccucggaaacggc

SEQ ID NO: 315955 - RNA, 19 nt, Human
cuuguaaacacaaagaaac

SEQ ID NO: 315956 - RNA, 23 nt, Human
gaaaaauguaaacaaaaccaaag

SEQ ID NO: 315957 - RNA, 19 nt, Human
gaaaacacaaaaagaauca

SEQ ID NO: 315958 - RNA, 24 nt, Human
gaaaacagacaagguaacaccaaa

SEQ ID NO: 315959 - RNA, 19 nt, Human
gaaaacccucaaaaaacaa

SEQ ID NO: 315960 - RNA, 23 nt, Human
gagaaaaaguucaguccuuuccu

SEQ ID NO: 315961 - RNA, 24 nt, Human
ggaaaaaauuccaccuaauucuua

SEQ ID NO: 315962 - RNA, 21 nt, Human
ggcacagcagagacucgcagg

SEQ ID NO: 315963 - RNA, 21 nt, Human
gggaaaaauguaaacaaaacc

SEQ ID NO: 315964 - RNA, 18 nt, Human
uaacuugaaucauaaugg

SEQ ID NO: 315965 - RNA, 22 nt, Human
uaagcacagaaagugauacuga

SEQ ID NO: 315966 - RNA, 21 nt, Human
uaagcuguucaauaaaagccu

SEQ ID NO: 315967 - RNA, 19 nt, Human
uaaugcaguuuuggacuga

SEQ ID NO: 315968 - RNA, 29 nt, Human
uaccaaaaacauuaaaaaacaaaaacaaa

SEQ ID NO: 315969 - RNA, 21 nt, Human
uagaaaacacaaaaagaauca

SEQ ID NO: 315970 - RNA, 21 nt, Human
uagaagauugugugcguaugu

SEQ ID NO: 315971 - RNA, 22 nt, Human
uaggaaagaaaagcaggagguu

SEQ ID NO: 315972 - RNA, 23 nt, Human
uaggucagaaaaugcaacaguaa

SEQ ID NO: 315973 - RNA, 23 nt, Human
uaucucauucaaaaaaucaaaau

SEQ ID NO: 315974 - RNA, 23 nt, Human
uaugugcacgcacauguacagac

SEQ ID NO: 315975 - RNA, 19 nt, Human
uauuuuuuuaaaaaacugc

SEQ ID NO: 315976 - RNA, 23 nt, Human
ucgcugcuuggcgugggguccgc

SEQ ID NO: 315977 - RNA, 23 nt, Human
ucuaaaaaccagaaaaugaguuu

SEQ ID NO: 315978 - RNA, 19 nt, Human
ucuacaaaaaaaaaaaaaa

SEQ ID NO: 315979 - RNA, 23 nt, Human
ugaaaacagacaagguaacacca

SEQ ID NO: 315980 - RNA, 27 nt, Human
ugaaaacagacaagguaacaccaaaua

SEQ ID NO: 315981 - RNA, 21 nt, Human
ugaaaauaaauuaguuccccc

SEQ ID NO: 315982 - RNA, 22 nt, Human
ugaacauucagaucugucucuc

SEQ ID NO: 315983 - RNA, 22 nt, Human
ugaaggaaaaaauuccaccuaa

SEQ ID NO: 315984 - RNA, 21 nt, Human
ugacagccuaaaaccccacug

SEQ ID NO: 315985 - RNA, 23 nt, Human
ugacagccuaaaaccccacugag

SEQ ID NO: 315986 - RNA, 21 nt, Human
uggaaaggaguaggaaagaaa

SEQ ID NO: 315987 - RNA, 18 nt, Human
uggggaaaaaagcuaguu

SEQ ID NO: 315988 - RNA, 23 nt, Human
uguaaacacaaagaaacucaaca

SEQ ID NO: 315989 - RNA, 23 nt, Human
uguagaaaacacaaaaagaauca

SEQ ID NO: 315990 - RNA, 27 nt, Human
uguagaaaacacaaaaagaaucaacug

SEQ ID NO: 315991 - RNA, 19 nt, Human
uugaaggaaaaaauuccac

SEQ ID NO: 315992 - RNA, 25 nt, Human
uugguacuuaagucaugaauuguga

SEQ ID NO: 315993 - RNA, 22 nt, Human
aaaaaagaaaacagcaagauga

SEQ ID NO: 315994 - RNA, 23 nt, Human
aaaaaagaaaacagcaagaugaa

SEQ ID NO: 315995 - RNA, 18 nt, Human
aaaaacacaaaauaaccu

SEQ ID NO: 315996 - RNA, 22 nt, Human
aaaacaaguauaauacaaaaca

SEQ ID NO: 315997 - RNA, 26 nt, Human
aaacagcaagaugaaaauaggcaagg

SEQ ID NO: 315998 - RNA, 20 nt, Human
aaaccaacuuaaaaacacaa

SEQ ID NO: 315999 - RNA, 19 nt, Human
aaagguuauuuagcuuuuc

SEQ ID NO: 316000 - RNA, 22 nt, Human
aagcauucuauaacaagaaccc

SEQ ID NO: 316001 - RNA, 18 nt, Human
aaggaagaagggaacuga

SEQ ID NO: 316002 - RNA, 23 nt, Human
aaggaagaagggaacugaaaaag

SEQ ID NO: 316003 - RNA, 24 nt, Human
aauaauagaagcaacauucuggga

SEQ ID NO: 316004 - RNA, 18 nt, Human
aauucugucacugcagag

SEQ ID NO: 316005 - RNA, 20 nt, Human
acaauaauagaagcaacauu

SEQ ID NO: 316006 - RNA, 24 nt, Human
accauuaacacagcuuuccaucac

SEQ ID NO: 316007 - RNA, 23 nt, Human
agaaauaauuuccccaggaaaga

SEQ ID NO: 316008 - RNA, 21 nt, Human
agaccccaacacuaaauucuc

SEQ ID NO: 316009 - RNA, 27 nt, Human
agaguggaccaucuuaugaggccaaaa

SEQ ID NO: 316010 - RNA, 18 nt, Human
agcaagaugaaaauaggc

SEQ ID NO: 316011 - RNA, 20 nt, Human
aggaagaagggaacugaaaa

SEQ ID NO: 316012 - RNA, 26 nt, Human
aggucucaaaagcucaaaucuaaacc

SEQ ID NO: 316013 - RNA, 19 nt, Human
aucagaccucccacuccuc

SEQ ID NO: 316014 - RNA, 20 nt, Human
auuuuuuuaaaaaaaagaaa

SEQ ID NO: 316015 - RNA, 19 nt, Human
caagcaucacaucaaaaaa

SEQ ID NO: 316016 - RNA, 22 nt, Human
cacaaaaacaaguauaauacaa

SEQ ID NO: 316017 - RNA, 24 nt, Human
cagagcccuuuguguauacuuuuc

SEQ ID NO: 316018 - RNA, 22 nt, Human
cagcaagaugaaaauaggcaag

SEQ ID NO: 316019 - RNA, 18 nt, Human
caggucucaaaagcucaa

SEQ ID NO: 316020 - RNA, 20 nt, Human
caugacaugaagucccuacg

SEQ ID NO: 316021 - RNA, 18 nt, Human
cauggcacaucacacaug

SEQ ID NO: 316022 - RNA, 19 nt, Human
cauucuuaaagguuauuua

SEQ ID NO: 316023 - RNA, 22 nt, Human
ccaacacuaaauucucaagugu

SEQ ID NO: 316024 - RNA, 22 nt, Human
cccaacaugaaagcuaguggau

SEQ ID NO: 316025 - RNA, 24 nt, Human
ccccaggaaagaauuguaaaaccc

SEQ ID NO: 316026 - RNA, 27 nt, Human
ccucccacuccucugacuugagcuuca

SEQ ID NO: 316027 - RNA, 25 nt, Human
cgucaagcaucacaucaaaaaagug

SEQ ID NO: 316028 - RNA, 19 nt, Human
cucaaugguugugcacaau

SEQ ID NO: 316029 - RNA, 18 nt, Human
cuguacagaccccaacac

SEQ ID NO: 316030 - RNA, 21 nt, Human
cuguacagaccccaacacuaa

SEQ ID NO: 316031 - RNA, 18 nt, Human
cuucuuucuccaauacca

SEQ ID NO: 316032 - RNA, 18 nt, Human
cuuuuuuuuuuuuuuuug

SEQ ID NO: 316033 - RNA, 24 nt, Human
gaaggaagaagggaacugaaaaag

SEQ ID NO: 316034 - RNA, 20 nt, Human
gauuugcuuaaacuuucccc

SEQ ID NO: 316035 - RNA, 24 nt, Human
ggaaagaauuguaaaaccaacuua

SEQ ID NO: 316036 - RNA, 18 nt, Human
ggcggacccuaaaagcca

SEQ ID NO: 316037 - RNA, 18 nt, Human
uacaguagaaaaguaugg

SEQ ID NO: 316038 - RNA, 18 nt, Human
uaccaagcauucuauaac

SEQ ID NO: 316039 - RNA, 22 nt, Human
uaggcagagaggcggcggaccc

SEQ ID NO: 316040 - RNA, 18 nt, Human
uaugacaagucaagacca

SEQ ID NO: 316041 - RNA, 24 nt, Human
uaugcacacacaaaaacaaguaua

SEQ ID NO: 316042 - RNA, 18 nt, Human
uauuuagcuuuucuccac

SEQ ID NO: 316043 - RNA, 24 nt, Human
ucaccaucagccauccuuccucaa

SEQ ID NO: 316044 - RNA, 25 nt, Human
ucagccauccuuccucaacuuuucc

SEQ ID NO: 316045 - RNA, 25 nt, Human
uccaccaacaaugaucagaccuccc

SEQ ID NO: 316046 - RNA, 22 nt, Human
uccauagccaggucucaaaagc

SEQ ID NO: 316047 - RNA, 18 nt, Human
uccaucaccaucagccau

SEQ ID NO: 316048 - RNA, 24 nt, Human
uccauuuuuuuaaaaaaaagaaaa

SEQ ID NO: 316049 - RNA, 18 nt, Human
uccuagugucgggccuca

SEQ ID NO: 316050 - RNA, 24 nt, Human
ucuaaaccuacugauggaguagca

SEQ ID NO: 316051 - RNA, 19 nt, Human
ucuauaacaagaacccaag

SEQ ID NO: 316052 - RNA, 24 nt, Human
ucuauaccaagcauucuauaacaa

SEQ ID NO: 316053 - RNA, 19 nt, Human
ucuaugugcaagguacugg

SEQ ID NO: 316054 - RNA, 21 nt, Human
ucuccaauaccacccacauuc

SEQ ID NO: 316055 - RNA, 18 nt, Human
ucuuuuuuuuuuuuuuuu

SEQ ID NO: 316056 - RNA, 20 nt, Human
ucuuuuuuuuuuuuuuuugu

SEQ ID NO: 316057 - RNA, 22 nt, Human
ugacaguuugaucacaaaguca

SEQ ID NO: 316058 - RNA, 22 nt, Human
ugagagggaaggaagaagggaa

SEQ ID NO: 316059 - RNA, 18 nt, Human
ugaggccaaaaacccaug

SEQ ID NO: 316060 - RNA, 18 nt, Human
ugaguuaccagaugacca

SEQ ID NO: 316061 - RNA, 26 nt, Human
ugauuuuuuauagaucacaucugaac

SEQ ID NO: 316062 - RNA, 23 nt, Human
ugcacacacaaaaacaaguauaa

SEQ ID NO: 316063 - RNA, 24 nt, Human
ugcagaaaaaugagucaccuucaa

SEQ ID NO: 316064 - RNA, 20 nt, Human
ugcauucucguaacaccucu

SEQ ID NO: 316065 - RNA, 19 nt, Human
ugcauugagaauccuagug

SEQ ID NO: 316066 - RNA, 22 nt, Human
uggauucuugcauugagaaucc

SEQ ID NO: 316067 - RNA, 23 nt, Human
uuaaaaaaaagaaaacagcaaga

SEQ ID NO: 316068 - RNA, 19 nt, Human
uuacuugauccuucaaagc

SEQ ID NO: 316069 - RNA, 19 nt, Human
uuccccuccagaaauaauu

SEQ ID NO: 316070 - RNA, 23 nt, Human
uugauucuccggagcuauaauuc

SEQ ID NO: 316071 - RNA, 19 nt, Human
uuguaucaaacacauuuau

SEQ ID NO: 316072 - RNA, 26 nt, Human
uuuaaaaaaaagaaaacagcaagaug

SEQ ID NO: 316073 - RNA, 22 nt, Human
uuuaugcacacacaaaaacaag

SEQ ID NO: 316074 - RNA, 18 nt, Human
aaauuguaagagugggga

SEQ ID NO: 316075 - RNA, 25 nt, Human
aaugacaggaggcgcagcuuaggug

SEQ ID NO: 316076 - RNA, 19 nt, Human
accccaccacccugcccca

SEQ ID NO: 316077 - RNA, 23 nt, Human
acccugccccaacucauuacaca

SEQ ID NO: 316078 - RNA, 19 nt, Human
accuaccccaccacccugc

SEQ ID NO: 316079 - RNA, 25 nt, Human
agacaagugacucagacguuucaag

SEQ ID NO: 316080 - RNA, 18 nt, Human
agcagggaaaugacagga

SEQ ID NO: 316081 - RNA, 22 nt, Human
caaccugcgggggaccucucgg

SEQ ID NO: 316082 - RNA, 19 nt, Human
cacaacucggccuucuggc

SEQ ID NO: 316083 - RNA, 24 nt, Human
cacaacucggccuucuggccaccu

SEQ ID NO: 316084 - RNA, 19 nt, Human
caccacccugccccaacuc

SEQ ID NO: 316085 - RNA, 26 nt, Human
caccugaggcuacuuuuuagacaagu

SEQ ID NO: 316086 - RNA, 23 nt, Human
ccaugcaccuaccccaccacccu

SEQ ID NO: 316087 - RNA, 21 nt, Human
cccaccacccugccccaacuc

SEQ ID NO: 316088 - RNA, 22 nt, Human
cccagagggcccacccucccau

SEQ ID NO: 316089 - RNA, 20 nt, Human
cccaugcaccuaccccacca

SEQ ID NO: 316090 - RNA, 18 nt, Human
ccccaccacccugcccca

SEQ ID NO: 316091 - RNA, 20 nt, Human
ccccagagggcccacccucc

SEQ ID NO: 316092 - RNA, 20 nt, Human
cccuacccuugguucgccac

SEQ ID NO: 316093 - RNA, 23 nt, Human
ccgccggccgucggaagaugagg

SEQ ID NO: 316094 - RNA, 24 nt, Human
ccuaccccaccacccugccccaac

SEQ ID NO: 316095 - RNA, 21 nt, Human
ccuagcaggaggacuugggcc

SEQ ID NO: 316096 - RNA, 25 nt, Human
cgacagcucccuccgugcucagaag

SEQ ID NO: 316097 - RNA, 19 nt, Human
cgaccccgcgacagcuccc

SEQ ID NO: 316098 - RNA, 18 nt, Human
cgggggaccucucggccc

SEQ ID NO: 316099 - RNA, 19 nt, Human
cuccccagagggcccaccc

SEQ ID NO: 316100 - RNA, 22 nt, Human
cuccccagagggcccacccucc

SEQ ID NO: 316101 - RNA, 25 nt, Human
gaguccuuguccagguccuccgcuu

SEQ ID NO: 316102 - RNA, 23 nt, Human
gcaaaacaagcugcuugggccuc

SEQ ID NO: 316103 - RNA, 21 nt, Human
ggaaaugacaggaggcgcagc

SEQ ID NO: 316104 - RNA, 23 nt, Human
ggggaccucucggcccggugcgc

SEQ ID NO: 316105 - RNA, 22 nt, Human
uaaagaaauuguaagagugggg

SEQ ID NO: 316106 - RNA, 24 nt, Human
uacagagacacauucaggacacau

SEQ ID NO: 316107 - RNA, 22 nt, Human
uaccccaccacccugccccaac

SEQ ID NO: 316108 - RNA, 22 nt, Human
uacccuugguucgccaccuugc

SEQ ID NO: 316109 - RNA, 18 nt, Human
ucccaugcaccuacccca

SEQ ID NO: 316110 - RNA, 24 nt, Human
ucccaugcaccuaccccaccaccc

SEQ ID NO: 316111 - RNA, 20 nt, Human
ucccuccgugcucagaagcc

SEQ ID NO: 316112 - RNA, 20 nt, Human
uccgcuaugggcuaaagguu

SEQ ID NO: 316113 - RNA, 18 nt, Human
uccugaggaggcauccgc

SEQ ID NO: 316114 - RNA, 18 nt, Human
uccugaggaggcauccgc

SEQ ID NO: 316115 - RNA, 21 nt, Human
ugacaggaggcgcagcuuagg

SEQ ID NO: 316116 - RNA, 19 nt, Human
ugcaccuaccccaccaccc

SEQ ID NO: 316117 - RNA, 19 nt, Human
ugguucgccaccuugcucc

SEQ ID NO: 316118 - RNA, 22 nt, Human
ugguucgccaccuugcuccucg

SEQ ID NO: 316119 - RNA, 21 nt, Human
uguggaggcuccagguggccg

SEQ ID NO: 316120 - RNA, 18 nt, Human
uugggccuccccagaggg

SEQ ID NO: 316121 - RNA, 21 nt, Human
auugccauuggguuugugacu

SEQ ID NO: 316122 - RNA, 19 nt, Human
cugaaaaugguguguggcg

SEQ ID NO: 316123 - RNA, 24 nt, Human
uagugacgaccucaggagcaacag

SEQ ID NO: 316124 - RNA, 20 nt, Human
ucagugccuuuauugccauu

SEQ ID NO: 316125 - RNA, 24 nt, Human
ugccuuuauugccauuggguuugu

SEQ ID NO: 316126 - RNA, 24 nt, Human
uugauauagugacgaccucaggag

SEQ ID NO: 316127 - RNA, 23 nt, Human
aaaaacagguaaauuucaaacaa

SEQ ID NO: 316128 - RNA, 23 nt, Human
aaaaauuccucuuagagacacca

SEQ ID NO: 316129 - RNA, 21 nt, Human
aaaaggccuauuacacaaaug

SEQ ID NO: 316130 - RNA, 18 nt, Human
aaacugacaucuaaaaau

SEQ ID NO: 316131 - RNA, 20 nt, Human
aaauaaguaauacuucuucu

SEQ ID NO: 316132 - RNA, 21 nt, Human
aacaggaaggacaaaagagaa

SEQ ID NO: 316133 - RNA, 21 nt, Human
aaccacugacccaaggaaaca

SEQ ID NO: 316134 - RNA, 18 nt, Human
aacucugucagguuuacu

SEQ ID NO: 316135 - RNA, 23 nt, Human
aagaaaaacagguaaauuucaaa

SEQ ID NO: 316136 - RNA, 21 nt, Human
aagccuucuuuuugaucaaac

SEQ ID NO: 316137 - RNA, 19 nt, Human
aagugccgcacgagggaug

SEQ ID NO: 316138 - RNA, 18 nt, Human
aaucccacccuucuccau

SEQ ID NO: 316139 - RNA, 24 nt, Human
aaucgaccaacugagggauccaca

SEQ ID NO: 316140 - RNA, 22 nt, Human
aaucuuuuccuuuuuaauuuga

SEQ ID NO: 316141 - RNA, 20 nt, Human
accacugacccaaggaaaca

SEQ ID NO: 316142 - RNA, 18 nt, Human
acccgugaguucuuccuc

SEQ ID NO: 316143 - RNA, 20 nt, Human
accugccaggaaggggccag

SEQ ID NO: 316144 - RNA, 22 nt, Human
acuguaaccucuacagcucugg

SEQ ID NO: 316145 - RNA, 20 nt, Human
agaaagaaaggagguagugg

SEQ ID NO: 316146 - RNA, 21 nt, Human
agaaaggagguaguggaaggc

SEQ ID NO: 316147 - RNA, 22 nt, Human
agacaagugcagcauggacccg

SEQ ID NO: 316148 - RNA, 22 nt, Human
agacaagugcagcauggacccg

SEQ ID NO: 316149 - RNA, 18 nt, Human
agagggaugcggggcuug

SEQ ID NO: 316150 - RNA, 18 nt, Human
aggacaaaagagaaaagc

SEQ ID NO: 316151 - RNA, 20 nt, Human
agggauccacauccucuggg

SEQ ID NO: 316152 - RNA, 18 nt, Human
agguaguggaaggccuag

SEQ ID NO: 316153 - RNA, 21 nt, Human
aguagaggacaguacucugga

SEQ ID NO: 316154 - RNA, 20 nt, Human
aucaauguuuccuaacuuug

SEQ ID NO: 316155 - RNA, 18 nt, Human
aucacccuuccaccccau

SEQ ID NO: 316156 - RNA, 23 nt, Human
aucccacccuucuccaugaccaa

SEQ ID NO: 316157 - RNA, 21 nt, Human
aucuugcgucucccccuccca

SEQ ID NO: 316158 - RNA, 22 nt, Human
augaaaaggccuauuacacaaa

SEQ ID NO: 316159 - RNA, 19 nt, Human
caaacugacaucuaaaaau

SEQ ID NO: 316160 - RNA, 18 nt, Human
caacaggaaggacaaaag

SEQ ID NO: 316161 - RNA, 22 nt, Human
caacaggaaggacaaaagagaa

SEQ ID NO: 316162 - RNA, 24 nt, Human
caaugguaaggguagaaauccgcu

SEQ ID NO: 316163 - RNA, 27 nt, Human
caccccauucccacccaaucccacccu

SEQ ID NO: 316164 - RNA, 23 nt, Human
cacccuuccaccccauucccacc

SEQ ID NO: 316165 - RNA, 20 nt, Human
cacccuucuccaugaccaaa

SEQ ID NO: 316166 - RNA, 21 nt, Human
cacgagggaugcagcaaccac

SEQ ID NO: 316167 - RNA, 21 nt, Human
cagcaaacaguuuuuccucaa

SEQ ID NO: 316168 - RNA, 24 nt, Human
cagcagaaaaguaaaaaaagagcc

SEQ ID NO: 316169 - RNA, 21 nt, Human
cagcgggaggcuagagccgga

SEQ ID NO: 316170 - RNA, 18 nt, Human
cagcucuggauucaaccu

SEQ ID NO: 316171 - RNA, 19 nt, Human
cagcuuaacugcagaauuc

SEQ ID NO: 316172 - RNA, 24 nt, Human
cagcuuaacugcagaauucuaagc

SEQ ID NO: 316173 - RNA, 25 nt, Human
cagcuuaacugcagaauucuaagcc

SEQ ID NO: 316174 - RNA, 22 nt, Human
caggaaggggccagaugcgaug

SEQ ID NO: 316175 - RNA, 20 nt, Human
caggagacauucugaaagac

SEQ ID NO: 316176 - RNA, 20 nt, Human
cagucuauugaaaaggauau

SEQ ID NO: 316177 - RNA, 20 nt, Human
caguuccugggccugggcuc

SEQ ID NO: 316178 - RNA, 26 nt, Human
caucuuuauuuguaauauaaugggga

SEQ ID NO: 316179 - RNA, 22 nt, Human
ccaaauaaguaauacuucuucu

SEQ ID NO: 316180 - RNA, 21 nt, Human
ccacccaaucccacccuucuc

SEQ ID NO: 316181 - RNA, 21 nt, Human
ccacccuucuccaugaccaaa

SEQ ID NO: 316182 - RNA, 18 nt, Human
ccacucuagcccuggccg

SEQ ID NO: 316183 - RNA, 20 nt, Human
ccagauggcaguggcaauca

SEQ ID NO: 316184 - RNA, 26 nt, Human
ccaucuugcgucucccccucccauuu

SEQ ID NO: 316185 - RNA, 18 nt, Human
cccaucacccuuccaccc

SEQ ID NO: 316186 - RNA, 20 nt, Human
cccaucacccuuccacccca

SEQ ID NO: 316187 - RNA, 21 nt, Human
cccauucccacccaaucccac

SEQ ID NO: 316188 - RNA, 22 nt, Human
ccccaaggcuggugaugcuacu

SEQ ID NO: 316189 - RNA, 18 nt, Human
cccccaaccccggguuuc

SEQ ID NO: 316190 - RNA, 20 nt, Human
cccccaaccccggguuucuu

SEQ ID NO: 316191 - RNA, 19 nt, Human
cccccaaggcuggugaugc

SEQ ID NO: 316192 - RNA, 23 nt, Human
cccggguuucuucaguuccuggg

SEQ ID NO: 316193 - RNA, 18 nt, Human
cccuaagcacgccgggaa

SEQ ID NO: 316194 - RNA, 21 nt, Human
ccgggccacucuagcccuggc

SEQ ID NO: 316195 - RNA, 20 nt, Human
ccgugaguucuuccucuucc

SEQ ID NO: 316196 - RNA, 18 nt, Human
ccucaaaaccacugaccc

SEQ ID NO: 316197 - RNA, 19 nt, Human
ccucaaugguaaggguaga

SEQ ID NO: 316198 - RNA, 22 nt, Human
ccucccauuuggcgcgcccuaa

SEQ ID NO: 316199 - RNA, 25 nt, Human
ccuccucaaugguaaggguagaaau

SEQ ID NO: 316200 - RNA, 23 nt, Human
ccuuccagcccaggcuagcuccc

SEQ ID NO: 316201 - RNA, 19 nt, Human
cgcacacauggaaaguuuu

SEQ ID NO: 316202 - RNA, 20 nt, Human
cgcccggcccggugcagcaa

SEQ ID NO: 316203 - RNA, 19 nt, Human
cggcccggugcagcaaaca

SEQ ID NO: 316204 - RNA, 20 nt, Human
cggcccggugcagcaaacag

SEQ ID NO: 316205 - RNA, 23 nt, Human
cgggacguacaggaaggggccag

SEQ ID NO: 316206 - RNA, 18 nt, Human
cgggaggcuagagccgga

SEQ ID NO: 316207 - RNA, 21 nt, Human
cguaaguucgggccaaggccu

SEQ ID NO: 316208 - RNA, 18 nt, Human
cuaguucauuagcucccc

SEQ ID NO: 316209 - RNA, 20 nt, Human
cuccccaucacccuuccacc

SEQ ID NO: 316210 - RNA, 22 nt, Human
cuccccaucacccuuccacccc

SEQ ID NO: 316211 - RNA, 24 nt, Human
cucccccucccauuuggcgcgccc

SEQ ID NO: 316212 - RNA, 28 nt, Human
cucgaagcgcuccggcgacuggcuaauc

SEQ ID NO: 316213 - RNA, 19 nt, Human
cucugaauaacaagagcuc

SEQ ID NO: 316214 - RNA, 19 nt, Human
cuguggcagacagacaagu

SEQ ID NO: 316215 - RNA, 22 nt, Human
cugugucuauggcaccagucac

SEQ ID NO: 316216 - RNA, 20 nt, Human
cuuccucuuccucuuugguc

SEQ ID NO: 316217 - RNA, 24 nt, Human
gaaaaacagguaaauuucaaacaa

SEQ ID NO: 316218 - RNA, 23 nt, Human
gaaaaguaaaaaaagagccgccc

SEQ ID NO: 316219 - RNA, 21 nt, Human
gagcccccaaccccggguuuc

SEQ ID NO: 316220 - RNA, 21 nt, Human
gaugcagcaaccacagaggga

SEQ ID NO: 316221 - RNA, 19 nt, Human
gcucgggacguacaggaag

SEQ ID NO: 316222 - RNA, 18 nt, Human
gcuugugagguuccaacc

SEQ ID NO: 316223 - RNA, 22 nt, Human
ggacccgagagcaagacuggug

SEQ ID NO: 316224 - RNA, 22 nt, Human
ggacccgagagcaagacuggug

SEQ ID NO: 316225 - RNA, 18 nt, Human
ggacuuggaaggauagug

SEQ ID NO: 316226 - RNA, 19 nt, Human
ggcccggugcagcaaacag

SEQ ID NO: 316227 - RNA, 23 nt, Human
gggccagaugcgaugcuccacgg

SEQ ID NO: 316228 - RNA, 19 nt, Human
gggccggggcuggcucgag

SEQ ID NO: 316229 - RNA, 24 nt, Human
ggguuucucccaaauaaguaauac

SEQ ID NO: 316230 - RNA, 24 nt, Human
ggguuucucccaaauaaguaauac

SEQ ID NO: 316231 - RNA, 23 nt, Human
gguaguggaaggccuaggaaaga

SEQ ID NO: 316232 - RNA, 20 nt, Human
guaaguucgggccaaggccu

SEQ ID NO: 316233 - RNA, 18 nt, Human
uaaaaaaagagccgcccu

SEQ ID NO: 316234 - RNA, 18 nt, Human
uaaaaagcuacacauaaa

SEQ ID NO: 316235 - RNA, 20 nt, Human
uaaaaagcuacacauaaagc

SEQ ID NO: 316236 - RNA, 20 nt, Human
uaaaaagcuacacauaaagc

SEQ ID NO: 316237 - RNA, 22 nt, Human
uaaagguuacagguaaaaagcu

SEQ ID NO: 316238 - RNA, 20 nt, Human
uaaccucuacagcucuggau

SEQ ID NO: 316239 - RNA, 20 nt, Human
uaagaaacuucagcaggagg

SEQ ID NO: 316240 - RNA, 22 nt, Human
uaagaagccuuucucuacaaug

SEQ ID NO: 316241 - RNA, 21 nt, Human
uaagugagcgccuuugagccc

SEQ ID NO: 316242 - RNA, 20 nt, Human
uacaugguuaggaugccagg

SEQ ID NO: 316243 - RNA, 20 nt, Human
uaccugccaggaaggggccg

SEQ ID NO: 316244 - RNA, 20 nt, Human
uacuguaaccucuacagcuc

SEQ ID NO: 316245 - RNA, 19 nt, Human
uagacaagugcagcaugga

SEQ ID NO: 316246 - RNA, 19 nt, Human
uagacaagugcagcaugga

SEQ ID NO: 316247 - RNA, 24 nt, Human
uagagacaccaguuacuuccaaac

SEQ ID NO: 316248 - RNA, 23 nt, Human
uagcuccccaucacccuuccacc

SEQ ID NO: 316249 - RNA, 20 nt, Human
uaggaugccaggagacauuc

SEQ ID NO: 316250 - RNA, 22 nt, Human
uaggaugccaggagacauucug

SEQ ID NO: 316251 - RNA, 21 nt, Human
uagugaauauaaauuaggcuc

SEQ ID NO: 316252 - RNA, 26 nt, Human
uauuucaaccccacccccaauuguca

SEQ ID NO: 316253 - RNA, 20 nt, Human
ucaaaggggcugccuaagug

SEQ ID NO: 316254 - RNA, 18 nt, Human
ucaaugguaaagucacac

SEQ ID NO: 316255 - RNA, 18 nt, Human
ucaaugguaaagucacac

SEQ ID NO: 316256 - RNA, 22 nt, Human
ucaaugguaaagucacacaaau

SEQ ID NO: 316257 - RNA, 22 nt, Human
ucaaugguaaagucacacaaau

SEQ ID NO: 316258 - RNA, 21 nt, Human
ucauauccuuugaaaacugcc

SEQ ID NO: 316259 - RNA, 27 nt, Human
uccaaacaaaucuuuuccuuuuuaauu

SEQ ID NO: 316260 - RNA, 22 nt, Human
uccaacaggaaggacaaaagag

SEQ ID NO: 316261 - RNA, 22 nt, Human
uccaccccauucccacccaauc

SEQ ID NO: 316262 - RNA, 20 nt, Human
uccagauuucccuccucaau

SEQ ID NO: 316263 - RNA, 18 nt, Human
ucccacccaaucccaccc

SEQ ID NO: 316264 - RNA, 23 nt, Human
ucccacccuucuccaugaccaaa

SEQ ID NO: 316265 - RNA, 22 nt, Human
ucuaaaaauuccucuuagagac

SEQ ID NO: 316266 - RNA, 18 nt, Human
ucuucaguuccugggccu

SEQ ID NO: 316267 - RNA, 21 nt, Human
ucuucaguuccugggccuggg

SEQ ID NO: 316268 - RNA, 22 nt, Human
ucuuuggucuuugaauguccag

SEQ ID NO: 316269 - RNA, 23 nt, Human
ugaaaaggauauaagaagccuuu

SEQ ID NO: 316270 - RNA, 23 nt, Human
ugaaaaggccuauuacacaaaug

SEQ ID NO: 316271 - RNA, 18 nt, Human
ugaauauaaauuaggcuc

SEQ ID NO: 316272 - RNA, 19 nt, Human
ugagagacaaauucacagc

SEQ ID NO: 316273 - RNA, 18 nt, Human
ugagaucuauggcaaccc

SEQ ID NO: 316274 - RNA, 24 nt, Human
ugagggauccacauccucuggguu

SEQ ID NO: 316275 - RNA, 21 nt, Human
ugaggggggaaagagccucca

SEQ ID NO: 316276 - RNA, 19 nt, Human
ugaucaaacugagaucuau

SEQ ID NO: 316277 - RNA, 20 nt, Human
ugaucaaacugagaucuaug

SEQ ID NO: 316278 - RNA, 26 nt, Human
ugccaggaaggggccagaugacccag

SEQ ID NO: 316279 - RNA, 23 nt, Human
ugccaggaaggggccagaugcga

SEQ ID NO: 316280 - RNA, 19 nt, Human
uggaaaguuuuucucccua

SEQ ID NO: 316281 - RNA, 20 nt, Human
uggaccucaaaaccacugac

SEQ ID NO: 316282 - RNA, 23 nt, Human
uggaccucaaaaccacugaccca

SEQ ID NO: 316283 - RNA, 18 nt, Human
uggcaaugucugaggcuu

SEQ ID NO: 316284 - RNA, 22 nt, Human
uggcaguggcaaucagugacug

SEQ ID NO: 316285 - RNA, 18 nt, Human
uggcucgagcgcgcucgg

SEQ ID NO: 316286 - RNA, 18 nt, Human
ugggcagucgaacagcgg

SEQ ID NO: 316287 - RNA, 20 nt, Human
ugguaaggguagaaauccgc

SEQ ID NO: 316288 - RNA, 21 nt, Human
uguccagauuucccuccucaa

SEQ ID NO: 316289 - RNA, 27 nt, Human
ugugggcaguguugaacucugucaggu

SEQ ID NO: 316290 - RNA, 24 nt, Human
uguuuguuagccaggucuagucuu

SEQ ID NO: 316291 - RNA, 22 nt, Human
uucaaccccacccccaauuguc

SEQ ID NO: 316292 - RNA, 18 nt, Human
uucauaauacacuuaaaa

SEQ ID NO: 316293 - RNA, 28 nt, Human
uuccaaacaaaucuuuuccuuuuuaauu

SEQ ID NO: 316294 - RNA, 24 nt, Human
uuccagauggcaguggcaaucagu

SEQ ID NO: 316295 - RNA, 19 nt, Human
uucccacccaaucccaccc

SEQ ID NO: 316296 - RNA, 19 nt, Human
uucuucaguuccugggccu

SEQ ID NO: 316297 - RNA, 22 nt, Human
uugaaaaggauauaagaagccu

SEQ ID NO: 316298 - RNA, 21 nt, Human
uugugggcaguguugaacucu

SEQ ID NO: 316299 - RNA, 18 nt, Human
uuuagcaaacauuuccag

SEQ ID NO: 316300 - RNA, 24 nt, Human
aaacaguucuguucaaaacaacuc

SEQ ID NO: 316301 - RNA, 24 nt, Human
aaagaacaacauggggcugagauu

SEQ ID NO: 316302 - RNA, 23 nt, Human
aagaacaauuucaaaacucacaa

SEQ ID NO: 316303 - RNA, 22 nt, Human
aagaacccacaaagugcacacc

SEQ ID NO: 316304 - RNA, 22 nt, Human
agcuaaauggaaguuaaauugu

SEQ ID NO: 316305 - RNA, 19 nt, Human
aggaagaacccacaaagug

SEQ ID NO: 316306 - RNA, 23 nt, Human
aucuuauuaucugcagucucuca

SEQ ID NO: 316307 - RNA, 22 nt, Human
caaaacaacucaccagguucug

SEQ ID NO: 316308 - RNA, 24 nt, Human
caaaacaacucaccagguucugaa

SEQ ID NO: 316309 - RNA, 24 nt, Human
caaggaguuaccagagagguuaug

SEQ ID NO: 316310 - RNA, 22 nt, Human
caaguagaagggaggccuuggu

SEQ ID NO: 316311 - RNA, 20 nt, Human
cacaaagugcacaccaacaa

SEQ ID NO: 316312 - RNA, 26 nt, Human
caggaagaacccacaaagugcacacc

SEQ ID NO: 316313 - RNA, 19 nt, Human
ccagagagguuauguagug

SEQ ID NO: 316314 - RNA, 20 nt, Human
ccccagccggcugccgcucc

SEQ ID NO: 316315 - RNA, 18 nt, Human
cccugaaaauaaaaagaa

SEQ ID NO: 316316 - RNA, 18 nt, Human
ccggcugccgcuccgcgc

SEQ ID NO: 316317 - RNA, 22 nt, Human
ccucccgcgccgccgcccgcac

SEQ ID NO: 316318 - RNA, 26 nt, Human
cuacaagucuacaaauucuaaaauuu

SEQ ID NO: 316319 - RNA, 22 nt, Human
cuacacgcacacgccgccgccg

SEQ ID NO: 316320 - RNA, 23 nt, Human
cuacagucaugcugaguaaagcu

SEQ ID NO: 316321 - RNA, 22 nt, Human
cuccuccgcucgcugaggcucc

SEQ ID NO: 316322 - RNA, 27 nt, Human
cucggccgucggcccugcgccgguucc

SEQ ID NO: 316323 - RNA, 23 nt, Human
cucuugugcagucacaucgucuu

SEQ ID NO: 316324 - RNA, 19 nt, Human
cugcagugcucuugugcag

SEQ ID NO: 316325 - RNA, 24 nt, Human
gaaaaaacaguucuguucaaaaca

SEQ ID NO: 316326 - RNA, 22 nt, Human
gaaaacaaguuuuuugaauguu

SEQ ID NO: 316327 - RNA, 19 nt, Human
gcagugcucuugugcaguc

SEQ ID NO: 316328 - RNA, 18 nt, Human
gccgccgccgguuccucg

SEQ ID NO: 316329 - RNA, 18 nt, Human
gcgccuccuccuccgcuc

SEQ ID NO: 316330 - RNA, 23 nt, Human
ggaaaaaacaguucuguucaaaa

SEQ ID NO: 316331 - RNA, 20 nt, Human
ggggcugagauuugaguagg

SEQ ID NO: 316332 - RNA, 19 nt, Human
gguaauuauuuuuaaaaau

SEQ ID NO: 316333 - RNA, 25 nt, Human
gguucauucuaaaguggucacggcu

SEQ ID NO: 316334 - RNA, 22 nt, Human
gucucucagagaaagcaaaagu

SEQ ID NO: 316335 - RNA, 19 nt, Human
guugcucuucccauuucca

SEQ ID NO: 316336 - RNA, 20 nt, Human
uaaaacacaacccaaagacu

SEQ ID NO: 316337 - RNA, 22 nt, Human
uaaaacacaacccaaagacuua

SEQ ID NO: 316338 - RNA, 25 nt, Human
uaaaacacaacccaaagacuuaaau

SEQ ID NO: 316339 - RNA, 21 nt, Human
uaaaguggucacggcuguuga

SEQ ID NO: 316340 - RNA, 22 nt, Human
uacaaauagcgcuaugccagaa

SEQ ID NO: 316341 - RNA, 22 nt, Human
uacaauuaagucuuacugaagc

SEQ ID NO: 316342 - RNA, 20 nt, Human
ucaaggaguuaccagagagg

SEQ ID NO: 316343 - RNA, 21 nt, Human
ucagagaaagcaaaaguaacu

SEQ ID NO: 316344 - RNA, 19 nt, Human
uccaaugauuguuugcugc

SEQ ID NO: 316345 - RNA, 24 nt, Human
uccaugugaaaacaaguuuuuuga

SEQ ID NO: 316346 - RNA, 23 nt, Human
ucuacagucaugcugaguaaagc

SEQ ID NO: 316347 - RNA, 18 nt, Human
ugaaaaacacugcagugc

SEQ ID NO: 316348 - RNA, 18 nt, Human
ugaggcuggcgcuggccc

SEQ ID NO: 316349 - RNA, 18 nt, Human
ugcagugcucuugugcag

SEQ ID NO: 316350 - RNA, 18 nt, Human
ugccagaaacugguuucu

SEQ ID NO: 316351 - RNA, 24 nt, Human
ugccgcuccgcgcuccucccgcgc

SEQ ID NO: 316352 - RNA, 23 nt, Human
uggcacaucuuuugguccaugug

SEQ ID NO: 316353 - RNA, 18 nt, Human
uuaaaacacaacccaaag

SEQ ID NO: 316354 - RNA, 18 nt, Human
uuaaaacacaacccaaag

SEQ ID NO: 316355 - RNA, 21 nt, Human
uuaaaacacaacccaaagacu

SEQ ID NO: 316356 - RNA, 20 nt, Human
uucauggcaauacuguacaa

SEQ ID NO: 316357 - RNA, 22 nt, Human
uuggaguuacuguugcucuucc

SEQ ID NO: 316358 - RNA, 21 nt, Human
uugguccaugugaaaacaagu

SEQ ID NO: 316359 - RNA, 19 nt, Human
uuuaacuuuuuuaauaaac

SEQ ID NO: 316360 - RNA, 20 nt, Human
uuuaacuuuuuuaauaaaca

SEQ ID NO: 316361 - RNA, 21 nt, Human
uuuaacuuuuuuaauaaacag

SEQ ID NO: 316362 - RNA, 22 nt, Human
aaaacuccaacucuauuaaucc

SEQ ID NO: 316363 - RNA, 25 nt, Human
aagacagaucccaauuuguuacaga

SEQ ID NO: 316364 - RNA, 23 nt, Human
aagcacugucaugacaaauauac

SEQ ID NO: 316365 - RNA, 22 nt, Human
auacauauauuuuaaaaagcca

SEQ ID NO: 316366 - RNA, 21 nt, Human
caaauaagcgcaaaaggagau

SEQ ID NO: 316367 - RNA, 22 nt, Human
gacaacauacucccaagaagaa

SEQ ID NO: 316368 - RNA, 21 nt, Human
ggcggccgggcuggggcucgg

SEQ ID NO: 316369 - RNA, 21 nt, Human
uaaaauuuccaaauaagcgca

SEQ ID NO: 316370 - RNA, 22 nt, Human
uaaaugaagggaaaucucuuua

SEQ ID NO: 316371 - RNA, 22 nt, Human
uauggcacauuugguccaugau

SEQ ID NO: 316372 - RNA, 24 nt, Human
uauuaauccaugccaguuaaacac

SEQ ID NO: 316373 - RNA, 21 nt, Human
uccaaauaagcgcaaaaggag

SEQ ID NO: 316374 - RNA, 18 nt, Human
ucccaagaagaaccuuuu

SEQ ID NO: 316375 - RNA, 24 nt, Human
ucccaagaagaaccuuuucuucag

SEQ ID NO: 316376 - RNA, 24 nt, Human
ugacaacauacucccaagaagaac

SEQ ID NO: 316377 - RNA, 20 nt, Human
ugucaugacaaauauacaga

SEQ ID NO: 316378 - RNA, 21 nt, Human
uuaugacaacauacucccaag

SEQ ID NO: 316379 - RNA, 25 nt, Human
uugugaauuuuucuuaaaaauaaaa

SEQ ID NO: 316380 - RNA, 24 nt, Human
aaaaaaaccaaugauggggaggac

SEQ ID NO: 316381 - RNA, 24 nt, Human
aaaaaaccaaugauggggaggacg

SEQ ID NO: 316382 - RNA, 18 nt, Human
aaugauggggaggacggg

SEQ ID NO: 316383 - RNA, 20 nt, Human
aaugauggggaggacgggag

SEQ ID NO: 316384 - RNA, 22 nt, Human
acaaaaaaaaaccaaugauggg

SEQ ID NO: 316385 - RNA, 18 nt, Human
agaaguaaaugggggagg

SEQ ID NO: 316386 - RNA, 25 nt, Human
agagggacuuguggggguuggaggg

SEQ ID NO: 316387 - RNA, 19 nt, Human
aggacgggagguggagaag

SEQ ID NO: 316388 - RNA, 23 nt, Human
aggcuggggagaggaggaaccgu

SEQ ID NO: 316389 - RNA, 19 nt, Human
caaaaaaaaaccaaugaug

SEQ ID NO: 316390 - RNA, 25 nt, Human
caaaaaaaaaccaaugauggggagg

SEQ ID NO: 316391 - RNA, 18 nt, Human
caucuucccaggcugggg

SEQ ID NO: 316392 - RNA, 19 nt, Human
cauuacagcagcaggaucc

SEQ ID NO: 316393 - RNA, 23 nt, Human
ccaaaggccccccagugucuccc

SEQ ID NO: 316394 - RNA, 19 nt, Human
cccauuacagcagcaggau

SEQ ID NO: 316395 - RNA, 20 nt, Human
ccccuuccucccaaggucac

SEQ ID NO: 316396 - RNA, 19 nt, Human
ccuguccaaccccgugcuc

SEQ ID NO: 316397 - RNA, 21 nt, Human
gacccgggaugcucacaucuc

SEQ ID NO: 316398 - RNA, 25 nt, Human
gacgggagguggagaaguaaauggg

SEQ ID NO: 316399 - RNA, 22 nt, Human
gagaggaggaaccgugcugggg

SEQ ID NO: 316400 - RNA, 19 nt, Human
gaggacgggagguggagaa

SEQ ID NO: 316401 - RNA, 18 nt, Human
gggggaaggggccugggg

SEQ ID NO: 316402 - RNA, 18 nt, Human
ucacuguccuguccaacc

SEQ ID NO: 316403 - RNA, 19 nt, Human
uccugucagacugcggcca

SEQ ID NO: 316404 - RNA, 24 nt, Human
ugaaaagggggaaaauaaaaggaa

SEQ ID NO: 316405 - RNA, 21 nt, Human
ugauggggaggacgggaggug

SEQ ID NO: 316406 - RNA, 23 nt, Human
ugcggccagcgcugccucgugcc

SEQ ID NO: 316407 - RNA, 24 nt, Human
ugcugggggaaggggccugggguc

SEQ ID NO: 316408 - RNA, 21 nt, Human
uggagaaguaaaugggggagg

SEQ ID NO: 316409 - RNA, 20 nt, Human
uggggagaggaggaaccgug

SEQ ID NO: 316410 - RNA, 23 nt, Human
uguggggguuggaggguggacac

SEQ ID NO: 316411 - RNA, 20 nt, Human
aggccuuuucccuccugcuc

SEQ ID NO: 316412 - RNA, 20 nt, Human
ccuuuucccuccugcuccuc

SEQ ID NO: 316413 - RNA, 20 nt, Human
ccuuuucccuccugcuccuc

SEQ ID NO: 316414 - RNA, 22 nt, Human
uaaaggccuuuucccuccugcu

SEQ ID NO: 316415 - RNA, 20 nt, Human
uugacuagaaauuugugaca

SEQ ID NO: 316416 - RNA, 21 nt, Human
uugacuagaaauuugugacaa

SEQ ID NO: 316417 - RNA, 18 nt, Human
aaaaaagagcauagcagg

SEQ ID NO: 316418 - RNA, 19 nt, Human
aaaaaagagcauagcaggg

SEQ ID NO: 316419 - RNA, 23 nt, Human
aaaaaagccaaggaacauguaag

SEQ ID NO: 316420 - RNA, 22 nt, Human
aaaaagcaagaguaacaaggca

SEQ ID NO: 316421 - RNA, 24 nt, Human
aaaaagccaaggaacauguaagua

SEQ ID NO: 316422 - RNA, 26 nt, Human
aaaagaacagaccagccuuucucagg

SEQ ID NO: 316423 - RNA, 22 nt, Human
aaaauggaaaauggaaaaaaaa

SEQ ID NO: 316424 - RNA, 19 nt, Human
aaacaagaagaauuugucu

SEQ ID NO: 316425 - RNA, 21 nt, Human
aaacaagaagaauuugucuaa

SEQ ID NO: 316426 - RNA, 22 nt, Human
aaacagaagugucccaaaccua

SEQ ID NO: 316427 - RNA, 24 nt, Human
aaagcaaauuacacuugaaaguca

SEQ ID NO: 316428 - RNA, 19 nt, Human
aaccaggaggaggggaggg

SEQ ID NO: 316429 - RNA, 20 nt, Human
aagagaaaaaagccaaggaa

SEQ ID NO: 316430 - RNA, 25 nt, Human
aagcaaauuacacuugaaagucagg

SEQ ID NO: 316431 - RNA, 24 nt, Human
aagcaucagaaguucaagucaacu

SEQ ID NO: 316432 - RNA, 21 nt, Human
aagcauucaaguucccuagcc

SEQ ID NO: 316433 - RNA, 24 nt, Human
aaguuauaaaucuggauccucaac

SEQ ID NO: 316434 - RNA, 21 nt, Human
acaaaaagcaagaguaacaag

SEQ ID NO: 316435 - RNA, 19 nt, Human
acacccaaaaagaacagac

SEQ ID NO: 316436 - RNA, 19 nt, Human
acauagaaccuucuggaaa

SEQ ID NO: 316437 - RNA, 24 nt, Human
agaaaaaaaauaaaaacccggcaa

SEQ ID NO: 316438 - RNA, 30 nt, Human
agaaaaaaaauaaaaacccggcaauggagg

SEQ ID NO: 316439 - RNA, 22 nt, Human
agaaacacccaaaaagaacaga

SEQ ID NO: 316440 - RNA, 21 nt, Human
agacaaguauccaugaucccu

SEQ ID NO: 316441 - RNA, 20 nt, Human
agacaccuaggaacaaaaca

SEQ ID NO: 316442 - RNA, 23 nt, Human
agagaaaaaaaauaaaaacccgg

SEQ ID NO: 316443 - RNA, 24 nt, Human
agagaagccuucuggucuguuuuu

SEQ ID NO: 316444 - RNA, 19 nt, Human
agauguagagauauuaacc

SEQ ID NO: 316445 - RNA, 18 nt, Human
agcuuucaauucuaaaca

SEQ ID NO: 316446 - RNA, 21 nt, Human
aggagaaacacccaaaaagaa

SEQ ID NO: 316447 - RNA, 22 nt, Human
aggaggaggggagggugcugcu

SEQ ID NO: 316448 - RNA, 19 nt, Human
auaaaucucuggcuuaaaa

SEQ ID NO: 316449 - RNA, 18 nt, Human
aucaagacagauguagag

SEQ ID NO: 316450 - RNA, 21 nt, Human
aucuggauccucaacugggga

SEQ ID NO: 316451 - RNA, 21 nt, Human
auggagcugucaccuccucca

SEQ ID NO: 316452 - RNA, 22 nt, Human
auggagcuuacaaaaaaagagc

SEQ ID NO: 316453 - RNA, 26 nt, Human
caacagguuccccuccuuggcagccg

SEQ ID NO: 316454 - RNA, 26 nt, Human
caagauacgccgugccccgagggguc

SEQ ID NO: 316455 - RNA, 18 nt, Human
caauggagcugucaccuc

SEQ ID NO: 316456 - RNA, 20 nt, Human
cacaaaacaagaagaauuug

SEQ ID NO: 316457 - RNA, 20 nt, Human
cacccaaaaagaacagacca

SEQ ID NO: 316458 - RNA, 23 nt, Human
cacccaaaaagaacagaccagcc

SEQ ID NO: 316459 - RNA, 19 nt, Human
caucagaaguucaagucaa

SEQ ID NO: 316460 - RNA, 19 nt, Human
caucucaaaccauuuaccc

SEQ ID NO: 316461 - RNA, 26 nt, Human
cauucugcauccucuucucagcuuca

SEQ ID NO: 316462 - RNA, 19 nt, Human
ccaagauacgccgugcccc

SEQ ID NO: 316463 - RNA, 19 nt, Human
ccacaguucauuucuguag

SEQ ID NO: 316464 - RNA, 26 nt, Human
ccagagaaaacugggcaauaaaagca

SEQ ID NO: 316465 - RNA, 19 nt, Human
ccagcuccaguucccagcg

SEQ ID NO: 316466 - RNA, 20 nt, Human
cccaaaaagaacagaccagc

SEQ ID NO: 316467 - RNA, 21 nt, Human
cccaaaaagaacagaccagcc

SEQ ID NO: 316468 - RNA, 22 nt, Human
cccaaaaagaacagaccagccu

SEQ ID NO: 316469 - RNA, 18 nt, Human
cccaacagguuccccucc

SEQ ID NO: 316470 - RNA, 19 nt, Human
cccccugggagagcgggca

SEQ ID NO: 316471 - RNA, 20 nt, Human
ccccgccuggcccugccaag

SEQ ID NO: 316472 - RNA, 24 nt, Human
ccgccuggcccugccaagcucacu

SEQ ID NO: 316473 - RNA, 19 nt, Human
ccgcuccaaaaugcaaaaa

SEQ ID NO: 316474 - RNA, 23 nt, Human
ccgcugccuccgggugccaagau

SEQ ID NO: 316475 - RNA, 26 nt, Human
ccggcaauggagcugucaccuccucc

SEQ ID NO: 316476 - RNA, 21 nt, Human
ccuaggaacaaaacacuggac

SEQ ID NO: 316477 - RNA, 18 nt, Human
ccuggcccugccaagcuc

SEQ ID NO: 316478 - RNA, 19 nt, Human
cgcccgcccgccccggagg

SEQ ID NO: 316479 - RNA, 21 nt, Human
cgcuccaaaaugcaaaaaaga

SEQ ID NO: 316480 - RNA, 23 nt, Human
cgcuccaaaaugcaaaaaagauc

SEQ ID NO: 316481 - RNA, 23 nt, Human
cggagagaaaaaaaauaaaaacc

SEQ ID NO: 316482 - RNA, 23 nt, Human
cggcaauggagcugucaccuccu

SEQ ID NO: 316483 - RNA, 22 nt, Human
cuaaacagaagugucccaaacc

SEQ ID NO: 316484 - RNA, 20 nt, Human
cucacuccagcuccaguucc

SEQ ID NO: 316485 - RNA, 19 nt, Human
cuccaaaaugcaaaaaaga

SEQ ID NO: 316486 - RNA, 23 nt, Human
cucccgcgcggugcgcucacucc

SEQ ID NO: 316487 - RNA, 20 nt, Human
cuccuuggcagccgcuccaa

SEQ ID NO: 316488 - RNA, 18 nt, Human
cugcacuaaaugggaguu

SEQ ID NO: 316489 - RNA, 24 nt, Human
cugcauccucuucucagcuucaug

SEQ ID NO: 316490 - RNA, 21 nt, Human
cuuaggagaaacacccaaaaa

SEQ ID NO: 316491 - RNA, 21 nt, Human
cuucuggaaauggcuuucuag

SEQ ID NO: 316492 - RNA, 18 nt, Human
gaaaaaaaaaugguggag

SEQ ID NO: 316493 - RNA, 19 nt, Human
gacuaguauucaguaugug

SEQ ID NO: 316494 - RNA, 19 nt, Human
gacugcaccaugguccgaa

SEQ ID NO: 316495 - RNA, 19 nt, Human
gagaggggggcaggggagc

SEQ ID NO: 316496 - RNA, 21 nt, Human
gagcugucaccuccuccacuc

SEQ ID NO: 316497 - RNA, 19 nt, Human
gcaaaaaagaucccuccuc

SEQ ID NO: 316498 - RNA, 20 nt, Human
gcagggacaggauucaggcu

SEQ ID NO: 316499 - RNA, 26 nt, Human
gcauuuagugccuuuccuagggggaa

SEQ ID NO: 316500 - RNA, 19 nt, Human
ggaaaaaaaaaugguggag

SEQ ID NO: 316501 - RNA, 23 nt, Human
ggagacggggaggcggagagaaa

SEQ ID NO: 316502 - RNA, 22 nt, Human
ggagcugucaccuccuccacuc

SEQ ID NO: 316503 - RNA, 19 nt, Human
ggcaauaaaagcaucagaa

SEQ ID NO: 316504 - RNA, 18 nt, Human
gggagcugggaauguugg

SEQ ID NO: 316505 - RNA, 24 nt, Human
gggcagccgcgacaaaauggugcc

SEQ ID NO: 316506 - RNA, 22 nt, Human
ggggagcugggaauguuggacu

SEQ ID NO: 316507 - RNA, 21 nt, Human
guaaguagaagauuauaugga

SEQ ID NO: 316508 - RNA, 18 nt, Human
uaaaaaaaacuuaucucu

SEQ ID NO: 316509 - RNA, 26 nt, Human
uaaauccuuugcaugcauuuagugcc

SEQ ID NO: 316510 - RNA, 20 nt, Human
uaaaucucuggcuuaaauga

SEQ ID NO: 316511 - RNA, 20 nt, Human
uaacaaggcagcagauggaa

SEQ ID NO: 316512 - RNA, 23 nt, Human
uaagagcacaaaaagcaagagua

SEQ ID NO: 316513 - RNA, 19 nt, Human
uaaguaauaacuugucccc

SEQ ID NO: 316514 - RNA, 19 nt, Human
uacaucuguaaacugaaag

SEQ ID NO: 316515 - RNA, 21 nt, Human
uacccugcacuaaaugggagu

SEQ ID NO: 316516 - RNA, 22 nt, Human
uacccugcacuaaaugggaguu

SEQ ID NO: 316517 - RNA, 25 nt, Human
uaggaacaaaacacuggacccacca

SEQ ID NO: 316518 - RNA, 21 nt, Human
uaggagaaaugagucaucaag

SEQ ID NO: 316519 - RNA, 20 nt, Human
ucaagacagauguagagaua

SEQ ID NO: 316520 - RNA, 21 nt, Human
ucagggacucagggguggugg

SEQ ID NO: 316521 - RNA, 23 nt, Human
uccaaagcaaauuacacuugaaa

SEQ ID NO: 316522 - RNA, 22 nt, Human
ucccuccucccccugggagagc

SEQ ID NO: 316523 - RNA, 19 nt, Human
uccuuggcagccgcuccaa

SEQ ID NO: 316524 - RNA, 25 nt, Human
ucuaauacaucuguaaacugaaaga

SEQ ID NO: 316525 - RNA, 23 nt, Human
ucuggucccgcccgcccgccccg

SEQ ID NO: 316526 - RNA, 24 nt, Human
ugcaaaaaagaucccuccuccccc

SEQ ID NO: 316527 - RNA, 18 nt, Human
ugcaguggcgagauggca

SEQ ID NO: 316528 - RNA, 24 nt, Human
ugcgaggcugcggcggcuccuccc

SEQ ID NO: 316529 - RNA, 18 nt, Human
uggaaauggcuuucuaga

SEQ ID NO: 316530 - RNA, 18 nt, Human
uggaauaaauaagcugga

SEQ ID NO: 316531 - RNA, 21 nt, Human
uggcagggacaggauucaggc

SEQ ID NO: 316532 - RNA, 21 nt, Human
ugggagagcgggcagccgcga

SEQ ID NO: 316533 - RNA, 23 nt, Human
ugggagagcgggcagccgcgaca

SEQ ID NO: 316534 - RNA, 18 nt, Human
uguaaacugaaagaaaau

SEQ ID NO: 316535 - RNA, 18 nt, Human
uguagagauauuaaccca

SEQ ID NO: 316536 - RNA, 19 nt, Human
uguuagcuggcagcuuuca

SEQ ID NO: 316537 - RNA, 19 nt, Human
uuagaacaccagauaauaa

SEQ ID NO: 316538 - RNA, 19 nt, Human
uucaaaggaaaauggaaaa

SEQ ID NO: 316539 - RNA, 22 nt, Human
uucaaguucccuagccaaauuc

SEQ ID NO: 316540 - RNA, 25 nt, Human
uucucagcuucaugcaauaaaucuc

SEQ ID NO: 316541 - RNA, 21 nt, Human
uucuggaaauggcuuucuaga

SEQ ID NO: 316542 - RNA, 18 nt, Human
uuucuggacuccacccau

SEQ ID NO: 316543 - RNA, 20 nt, Human
uuuuaauucuauuccaauca

SEQ ID NO: 316544 - RNA, 18 nt, Human
uuuuuuuuccuccuccaa

SEQ ID NO: 316545 - RNA, 22 nt, Human
aauuugauaguuuuaucguugg

SEQ ID NO: 316546 - RNA, 21 nt, Human
acacugccaccucugcagcug

SEQ ID NO: 316547 - RNA, 21 nt, Human
acacugccaccucugcagcug

SEQ ID NO: 316548 - RNA, 21 nt, Human
aggaaagcuggggcagggagg

SEQ ID NO: 316549 - RNA, 21 nt, Human
aggcucuugagauagucaaac

SEQ ID NO: 316550 - RNA, 22 nt, Human
augcccagggcuggccuuccug

SEQ ID NO: 316551 - RNA, 23 nt, Human
cacaauucuggccuaggaaagcu

SEQ ID NO: 316552 - RNA, 23 nt, Human
cacacugccaccucugcagcugu

SEQ ID NO: 316553 - RNA, 18 nt, Human
caccuguggccagcagcu

SEQ ID NO: 316554 - RNA, 21 nt, Human
cagacaauuacugccaaacac

SEQ ID NO: 316555 - RNA, 27 nt, Human
cagguuguauccuucgggccuuuuauc

SEQ ID NO: 316556 - RNA, 21 nt, Human
cccagggcuggccuuccugga

SEQ ID NO: 316557 - RNA, 23 nt, Human
cccggccgcccuugucaccuggu

SEQ ID NO: 316558 - RNA, 26 nt, Human
cgcuuccuuuccuuuuuauuuuuuua

SEQ ID NO: 316559 - RNA, 21 nt, Human
cugcagcuguccucaucagug

SEQ ID NO: 316560 - RNA, 22 nt, Human
cuuccuguguccacacacugcc

SEQ ID NO: 316561 - RNA, 19 nt, Human
gacccggccgcccuuguca

SEQ ID NO: 316562 - RNA, 21 nt, Human
gccaaacacaauucuggccua

SEQ ID NO: 316563 - RNA, 19 nt, Human
ggaaagcuggggcagggag

SEQ ID NO: 316564 - RNA, 18 nt, Human
uaucguugguggacagga

SEQ ID NO: 316565 - RNA, 23 nt, Human
ucaucagugcugugacuuucuuc

SEQ ID NO: 316566 - RNA, 21 nt, Human
ucugcagcuguccucaucagu

SEQ ID NO: 316567 - RNA, 23 nt, Human
ucuuccauaauuugauaguuuua

SEQ ID NO: 316568 - RNA, 19 nt, Human
ucuucuccucuaucuccag

SEQ ID NO: 316569 - RNA, 23 nt, Human
ugaggcuggguggcaggggccgg

SEQ ID NO: 316570 - RNA, 19 nt, Human
ugaugucagcucuggaguc

SEQ ID NO: 316571 - RNA, 22 nt, Human
uggagucuucaaugcccagggc

SEQ ID NO: 316572 - RNA, 19 nt, Human
uuccccuccuugcauugcg

SEQ ID NO: 316573 - RNA, 18 nt, Human
uugaucuuguugaucuuc

SEQ ID NO: 316574 - RNA, 24 nt, Human
uugcaugaggcuggguggcagggg

SEQ ID NO: 316575 - RNA, 23 nt, Human
uuugauaguuuuaucguuggugg

SEQ ID NO: 316576 - RNA, 24 nt, Human
uuuguggcggugaacgcuuccuuu

SEQ ID NO: 316577 - RNA, 23 nt, Human
aaacagaggcuuuaaucugaaca

SEQ ID NO: 316578 - RNA, 26 nt, Human
aaacagccucucaucaaacgggacga

SEQ ID NO: 316579 - RNA, 18 nt, Human
aaacaggagagaguggcc

SEQ ID NO: 316580 - RNA, 27 nt, Human
aaacccagcagagccaagggcuagaga

SEQ ID NO: 316581 - RNA, 24 nt, Human
aagagccagggggaggcuuggaca

SEQ ID NO: 316582 - RNA, 25 nt, Human
aagaggccagaaacaggagagagug

SEQ ID NO: 316583 - RNA, 27 nt, Human
aagccccucccugaguuucugccaucc

SEQ ID NO: 316584 - RNA, 20 nt, Human
aaggagccugggaggggcac

SEQ ID NO: 316585 - RNA, 21 nt, Human
aaggagccugggaggggcacc

SEQ ID NO: 316586 - RNA, 25 nt, Human
aaggggcugggagcccauaggggga

SEQ ID NO: 316587 - RNA, 21 nt, Human
acagcuaaggccucuccacca

SEQ ID NO: 316588 - RNA, 23 nt, Human
acagcuggacggugaccuccucc

SEQ ID NO: 316589 - RNA, 20 nt, Human
acaggggagagacagcugga

SEQ ID NO: 316590 - RNA, 21 nt, Human
acccagccucugcccagaccu

SEQ ID NO: 316591 - RNA, 21 nt, Human
accccacccaccccaccccag

SEQ ID NO: 316592 - RNA, 22 nt, Human
accccacccaccccaccccagc

SEQ ID NO: 316593 - RNA, 26 nt, Human
accccacccaccccaccccagcccac

SEQ ID NO: 316594 - RNA, 18 nt, Human
acccgaccccacccaccc

SEQ ID NO: 316595 - RNA, 20 nt, Human
acccuauaaaagcaauggac

SEQ ID NO: 316596 - RNA, 23 nt, Human
acugggcccauucugagugccaa

SEQ ID NO: 316597 - RNA, 20 nt, Human
acuguggccuggguggcucu

SEQ ID NO: 316598 - RNA, 26 nt, Human
agagaagcagggcccaggggcccagg

SEQ ID NO: 316599 - RNA, 18 nt, Human
agagccagggggaggcuu

SEQ ID NO: 316600 - RNA, 24 nt, Human
agagggaggggauggggaggggcc

SEQ ID NO: 316601 - RNA, 20 nt, Human
agcaauggaagcagcaggua

SEQ ID NO: 316602 - RNA, 22 nt, Human
agcaauggaagcagcagguauc

SEQ ID NO: 316603 - RNA, 21 nt, Human
agcaccuacccaaagggcagc

SEQ ID NO: 316604 - RNA, 20 nt, Human
agcagaaguggccgggccua

SEQ ID NO: 316605 - RNA, 18 nt, Human
aggaagggaaaagcaaug

SEQ ID NO: 316606 - RNA, 18 nt, Human
agggaggugggaggacaa

SEQ ID NO: 316607 - RNA, 19 nt, Human
agggaggugggaggacaag

SEQ ID NO: 316608 - RNA, 22 nt, Human
agggaggugggaggacaaggug

SEQ ID NO: 316609 - RNA, 22 nt, Human
aggggcugggagcccauagggg

SEQ ID NO: 316610 - RNA, 21 nt, Human
agggggaugggggagccagga

SEQ ID NO: 316611 - RNA, 20 nt, Human
aguggccgagugaccaggcc

SEQ ID NO: 316612 - RNA, 18 nt, Human
aucccaggcugagccccu

SEQ ID NO: 316613 - RNA, 18 nt, Human
aucucgccaccccacccc

SEQ ID NO: 316614 - RNA, 22 nt, Human
augcucugagcccccucaagcc

SEQ ID NO: 316615 - RNA, 24 nt, Human
caaaacagaggcuuuaaucugaac

SEQ ID NO: 316616 - RNA, 19 nt, Human
cacaggaacuguggccugg

SEQ ID NO: 316617 - RNA, 20 nt, Human
cacaggagggggcaguggaa

SEQ ID NO: 316618 - RNA, 18 nt, Human
cacccaccccaccccagc

SEQ ID NO: 316619 - RNA, 23 nt, Human
cacccaccccaccccagcccaca

SEQ ID NO: 316620 - RNA, 19 nt, Human
caccccaccccagcccaca

SEQ ID NO: 316621 - RNA, 20 nt, Human
caccccaucaucugggcccu

SEQ ID NO: 316622 - RNA, 20 nt, Human
cacccgaccccacccacccc

SEQ ID NO: 316623 - RNA, 20 nt, Human
cacccuauaaaagcaaugga

SEQ ID NO: 316624 - RNA, 19 nt, Human
cacugggcccauucugagu

SEQ ID NO: 316625 - RNA, 21 nt, Human
cagaacagccccugcucucaa

SEQ ID NO: 316626 - RNA, 21 nt, Human
cagacccucucuucuggccag

SEQ ID NO: 316627 - RNA, 22 nt, Human
cagcagcgcaaagguagcagaa

SEQ ID NO: 316628 - RNA, 24 nt, Human
cagccaggacagcuaaggccucuc

SEQ ID NO: 316629 - RNA, 23 nt, Human
cagccccugcucucaaaaccaga

SEQ ID NO: 316630 - RNA, 23 nt, Human
cagcccuaccauagauggccacc

SEQ ID NO: 316631 - RNA, 18 nt, Human
caggaacuguggccuggg

SEQ ID NO: 316632 - RNA, 22 nt, Human
caggaagggcugucuggcccug

SEQ ID NO: 316633 - RNA, 23 nt, Human
caggagcccagcaccuacccaaa

SEQ ID NO: 316634 - RNA, 27 nt, Human
cagggcccaggggcccagggugaggcu

SEQ ID NO: 316635 - RNA, 23 nt, Human
caguaaacagccucucaucaaac

SEQ ID NO: 316636 - RNA, 21 nt, Human
caucugggcccucccaggagc

SEQ ID NO: 316637 - RNA, 23 nt, Human
cauucugagugccaaagccuggg

SEQ ID NO: 316638 - RNA, 18 nt, Human
ccaccacccgaccccacc

SEQ ID NO: 316639 - RNA, 22 nt, Human
ccaccacccgaccccacccacc

SEQ ID NO: 316640 - RNA, 22 nt, Human
ccaccccaccccagcccacagc

SEQ ID NO: 316641 - RNA, 18 nt, Human
ccaccccaccccaguaaa

SEQ ID NO: 316642 - RNA, 20 nt, Human
ccacccgaccccacccaccc

SEQ ID NO: 316643 - RNA, 22 nt, Human
ccacugggcccauucugagugc

SEQ ID NO: 316644 - RNA, 20 nt, Human
ccagauacaaugggccccaa

SEQ ID NO: 316645 - RNA, 21 nt, Human
ccagccucugcccagaccauc

SEQ ID NO: 316646 - RNA, 19 nt, Human
ccaggacagcuaaggccuc

SEQ ID NO: 316647 - RNA, 18 nt, Human
ccaggagcccagcaccua

SEQ ID NO: 316648 - RNA, 22 nt, Human
ccagggugaggcucacagcagc

SEQ ID NO: 316649 - RNA, 18 nt, Human
cccaccccaccccagccc

SEQ ID NO: 316650 - RNA, 21 nt, Human
cccaccccaccccagcccaca

SEQ ID NO: 316651 - RNA, 21 nt, Human
cccaccccaguaaacagccuc

SEQ ID NO: 316652 - RNA, 23 nt, Human
cccagaccaucaccggaucccag

SEQ ID NO: 316653 - RNA, 22 nt, Human
cccagcaccuacccaaagggca

SEQ ID NO: 316654 - RNA, 27 nt, Human
ccccacccaccccaccccagcccacag

SEQ ID NO: 316655 - RNA, 19 nt, Human
ccccaccccagcccacagc

SEQ ID NO: 316656 - RNA, 23 nt, Human
ccccaccccagcccacagcuggc

SEQ ID NO: 316657 - RNA, 22 nt, Human
cccccucaagcccaucucgcca

SEQ ID NO: 316658 - RNA, 24 nt, Human
ccccucaagcccaucucgccaccc

SEQ ID NO: 316659 - RNA, 25 nt, Human
ccccugcucucaaaaccagacugga

SEQ ID NO: 316660 - RNA, 26 nt, Human
cccgaccccacccaccccaccccagc

SEQ ID NO: 316661 - RNA, 22 nt, Human
cccucccaggagcccagcaccu

SEQ ID NO: 316662 - RNA, 25 nt, Human
cccuuagaaaggcaucgacuccagg

SEQ ID NO: 316663 - RNA, 23 nt, Human
ccugcaaggagcagcuccaaccc

SEQ ID NO: 316664 - RNA, 24 nt, Human
ccuuaugcucugagcccccucaag

SEQ ID NO: 316665 - RNA, 24 nt, Human
cgggacgaacagagggaggggaug

SEQ ID NO: 316666 - RNA, 18 nt, Human
cucagaaaacuggcuaca

SEQ ID NO: 316667 - RNA, 23 nt, Human
cucgccaccccaccccaguaaac

SEQ ID NO: 316668 - RNA, 26 nt, Human
cucuccaccacccgaccccacccacc

SEQ ID NO: 316669 - RNA, 20 nt, Human
cucugagcccccucaagccc

SEQ ID NO: 316670 - RNA, 23 nt, Human
cuggcccugggagagagguggac

SEQ ID NO: 316671 - RNA, 19 nt, Human
cugucuggcccugggagag

SEQ ID NO: 316672 - RNA, 25 nt, Human
cugugcugugcuucucagugcuccc

SEQ ID NO: 316673 - RNA, 21 nt, Human
gaaaagcaauggaagcagccg

SEQ ID NO: 316674 - RNA, 21 nt, Human
gaaacccagcagagccaaggg

SEQ ID NO: 316675 - RNA, 23 nt, Human
gaagagccagggggaggcuugga

SEQ ID NO: 316676 - RNA, 19 nt, Human
gaaggcaggcacaggaacu

SEQ ID NO: 316677 - RNA, 25 nt, Human
gaccaggccccagacccucucuucu

SEQ ID NO: 316678 - RNA, 18 nt, Human
gacccagccucugcccag

SEQ ID NO: 316679 - RNA, 22 nt, Human
gacccagccucugcccagacca

SEQ ID NO: 316680 - RNA, 20 nt, Human
gaccccacccaccccacccc

SEQ ID NO: 316681 - RNA, 27 nt, Human
gaccccacccaccccaccccagcccac

SEQ ID NO: 316682 - RNA, 19 nt, Human
gagcccagcaccuacccaa

SEQ ID NO: 316683 - RNA, 19 nt, Human
gagcccagcaccuacccaa

SEQ ID NO: 316684 - RNA, 20 nt, Human
gagcccagcaccuacccaaa

SEQ ID NO: 316685 - RNA, 21 nt, Human
gagcccccucaagcccaucuc

SEQ ID NO: 316686 - RNA, 20 nt, Human
gagugaagggagaagaggcc

SEQ ID NO: 316687 - RNA, 20 nt, Human
gcacaggaacuguggccugg

SEQ ID NO: 316688 - RNA, 18 nt, Human
gcagaacagccccugcuc

SEQ ID NO: 316689 - RNA, 23 nt, Human
gcaguggagaagggcaggccugg

SEQ ID NO: 316690 - RNA, 22 nt, Human
gccccaagccccucccugaguu

SEQ ID NO: 316691 - RNA, 22 nt, Human
gcccucaaugggccugcccagc

SEQ ID NO: 316692 - RNA, 27 nt, Human
gcccugaagccuuaugcucugagcccc

SEQ ID NO: 316693 - RNA, 20 nt, Human
gccgggccuaagacugccaa

SEQ ID NO: 316694 - RNA, 21 nt, Human
gcuaaggccucuccaccaccc

SEQ ID NO: 316695 - RNA, 21 nt, Human
gcugggccucuucugagaaac

SEQ ID NO: 316696 - RNA, 19 nt, Human
ggaaacccagcagagccaa

SEQ ID NO: 316697 - RNA, 18 nt, Human
ggagcagcuccaacccuu

SEQ ID NO: 316698 - RNA, 27 nt, Human
ggauggggaggggccacugcuggggug

SEQ ID NO: 316699 - RNA, 21 nt, Human
gggagagacagcuggacggug

SEQ ID NO: 316700 - RNA, 18 nt, Human
gggaggggccacugcugg

SEQ ID NO: 316701 - RNA, 18 nt, Human
gggcaguggagaagggca

SEQ ID NO: 316702 - RNA, 21 nt, Human
gggcaguggagaagggcaggc

SEQ ID NO: 316703 - RNA, 23 nt, Human
gggggcagggugaaaaggagccu

SEQ ID NO: 316704 - RNA, 23 nt, Human
gggugaaaaggagccugggaggg

SEQ ID NO: 316705 - RNA, 19 nt, Human
gguggggaaggcaggcaca

SEQ ID NO: 316706 - RNA, 20 nt, Human
uaggagaaaccucggcggug

SEQ ID NO: 316707 - RNA, 23 nt, Human
ucaccggaucccaggcugagccc

SEQ ID NO: 316708 - RNA, 21 nt, Human
ucagcuuccagcccuaccaua

SEQ ID NO: 316709 - RNA, 19 nt, Human
uccaccacccgaccccacc

SEQ ID NO: 316710 - RNA, 21 nt, Human
uccaccacccgaccccaccca

SEQ ID NO: 316711 - RNA, 22 nt, Human
ucccugaguuucugccaucccc

SEQ ID NO: 316712 - RNA, 18 nt, Human
ucccugcggugcugcaga

SEQ ID NO: 316713 - RNA, 19 nt, Human
ucuggaaagacaugccuca

SEQ ID NO: 316714 - RNA, 20 nt, Human
ucugggcccacccaucaccc

SEQ ID NO: 316715 - RNA, 21 nt, Human
ugaagggagaagaggccagaa

SEQ ID NO: 316716 - RNA, 20 nt, Human
ugaaggguguguggacccag

SEQ ID NO: 316717 - RNA, 19 nt, Human
ugagggugcaaggggcugg

SEQ ID NO: 316718 - RNA, 24 nt, Human
ugagggugcaaggggcugggagcc

SEQ ID NO: 316719 - RNA, 25 nt, Human
ugaguuucugccauccccucccugg

SEQ ID NO: 316720 - RNA, 24 nt, Human
ugcaaaacagaggcuuuaaucuga

SEQ ID NO: 316721 - RNA, 23 nt, Human
ugcagaacagccccugcucucaa

SEQ ID NO: 316722 - RNA, 24 nt, Human
ugccaagaggaauccaggcucucc

SEQ ID NO: 316723 - RNA, 20 nt, Human
ugcugggguggggaaggcag

SEQ ID NO: 316724 - RNA, 18 nt, Human
uggaaagacaugccucac

SEQ ID NO: 316725 - RNA, 18 nt, Human
uggacgggagugaaggga

SEQ ID NO: 316726 - RNA, 21 nt, Human
uggccuggguggcucuucggc

SEQ ID NO: 316727 - RNA, 18 nt, Human
ugggacuccugacccagc

SEQ ID NO: 316728 - RNA, 20 nt, Human
ugggcccacccaucacccag

SEQ ID NO: 316729 - RNA, 21 nt, Human
ugggcuugggaggcugucucu

SEQ ID NO: 316730 - RNA, 23 nt, Human
ugggcuugggaggcugucucuua

SEQ ID NO: 316731 - RNA, 19 nt, Human
uggggacaggggagagaca

SEQ ID NO: 316732 - RNA, 20 nt, Human
uggggaggggccacugcugg

SEQ ID NO: 316733 - RNA, 21 nt, Human
uggggaggggccacugcugga

SEQ ID NO: 316734 - RNA, 22 nt, Human
uggggaggggccacugcugggg

SEQ ID NO: 316735 - RNA, 23 nt, Human
uggggaggggccacugcuggggu

SEQ ID NO: 316736 - RNA, 21 nt, Human
ugggggagccaggaagggcug

SEQ ID NO: 316737 - RNA, 20 nt, Human
uuaccucacccuauaaaagc

SEQ ID NO: 316738 - RNA, 19 nt, Human
uuucugccauccccucccu

SEQ ID NO: 316739 - RNA, 18 nt, Human
aaacuucagaagugacac

SEQ ID NO: 316740 - RNA, 18 nt, Human
aagaauucaagucauaau

SEQ ID NO: 316741 - RNA, 22 nt, Human
aagccuacugcaguuccuuuaa

SEQ ID NO: 316742 - RNA, 23 nt, Human
aagccuccaucccugggucagga

SEQ ID NO: 316743 - RNA, 18 nt, Human
acgccgccgagcuucucc

SEQ ID NO: 316744 - RNA, 21 nt, Human
agaggaggaaugaauugagag

SEQ ID NO: 316745 - RNA, 22 nt, Human
agaugugagaaauacuugacca

SEQ ID NO: 316746 - RNA, 25 nt, Human
aggaagggggauauucaugaggaac

SEQ ID NO: 316747 - RNA, 22 nt, Human
aggcgggggagaggcgcggggu

SEQ ID NO: 316748 - RNA, 26 nt, Human
auacuugaccaaguaaaaacauacaa

SEQ ID NO: 316749 - RNA, 19 nt, Human
augagguuuguuuuguaau

SEQ ID NO: 316750 - RNA, 19 nt, Human
augauacagcacagggcua

SEQ ID NO: 316751 - RNA, 24 nt, Human
caacacaaucaaagaagaauucaa

SEQ ID NO: 316752 - RNA, 21 nt, Human
caccacacugugggacucaaa

SEQ ID NO: 316753 - RNA, 18 nt, Human
cacugugggacucaaagc

SEQ ID NO: 316754 - RNA, 22 nt, Human
cagcccgcccugccuggagccu

SEQ ID NO: 316755 - RNA, 26 nt, Human
cagcgcagcccgcccugaccccuugg

SEQ ID NO: 316756 - RNA, 18 nt, Human
ccaucuguuaccacucug

SEQ ID NO: 316757 - RNA, 23 nt, Human
ccccacggcccuccggccccggg

SEQ ID NO: 316758 - RNA, 20 nt, Human
ccccgggccgcggcgagcuc

SEQ ID NO: 316759 - RNA, 18 nt, Human
ccccugcgccccggcccc

SEQ ID NO: 316760 - RNA, 19 nt, Human
cccggccccacggcccucc

SEQ ID NO: 316761 - RNA, 21 nt, Human
cccggccccacggcccuccgg

SEQ ID NO: 316762 - RNA, 22 nt, Human
cccggggcugccccguagcccc

SEQ ID NO: 316763 - RNA, 19 nt, Human
cccugccuggagccuccuc

SEQ ID NO: 316764 - RNA, 21 nt, Human
cccugcgccccggccccacgg

SEQ ID NO: 316765 - RNA, 23 nt, Human
ccgagcgcgccucucgucgcuuc

SEQ ID NO: 316766 - RNA, 19 nt, Human
ccgcggcccugacgcuugg

SEQ ID NO: 316767 - RNA, 21 nt, Human
ccgcugccagcgcagcccgcc

SEQ ID NO: 316768 - RNA, 21 nt, Human
ccggccggccagcaccucagc

SEQ ID NO: 316769 - RNA, 23 nt, Human
ccgggccgcggcgagcucccggg

SEQ ID NO: 316770 - RNA, 20 nt, Human
ccuaggauguaacuaagguu

SEQ ID NO: 316771 - RNA, 23 nt, Human
ccucacggccacaucucagcgcu

SEQ ID NO: 316772 - RNA, 22 nt, Human
ccucggagccacugccgcggug

SEQ ID NO: 316773 - RNA, 23 nt, Human
ccugcgccccggccccacggccg

SEQ ID NO: 316774 - RNA, 27 nt, Human
cgccccugcgccccggccccacggccc

SEQ ID NO: 316775 - RNA, 21 nt, Human
cgcgccccugcgccccggccc

SEQ ID NO: 316776 - RNA, 22 nt, Human
cgcggggugcucgcgccccugc

SEQ ID NO: 316777 - RNA, 23 nt, Human
cggagacggcaggaggaggcggg

SEQ ID NO: 316778 - RNA, 21 nt, Human
cggccgcugccagcgcagccc

SEQ ID NO: 316779 - RNA, 23 nt, Human
cgggacgccgccgagcuucuccu

SEQ ID NO: 316780 - RNA, 22 nt, Human
cucacggccacaucucagcgcu

SEQ ID NO: 316781 - RNA, 20 nt, Human
cucacucauaucauagauga

SEQ ID NO: 316782 - RNA, 18 nt, Human
cucaucgcccggggcugc

SEQ ID NO: 316783 - RNA, 20 nt, Human
cuccggcugcugcuugcaag

SEQ ID NO: 316784 - RNA, 22 nt, Human
cucucgucgcuucugcccccgu

SEQ ID NO: 316785 - RNA, 21 nt, Human
cuggagguuccugguccccgg

SEQ ID NO: 316786 - RNA, 19 nt, Human
gaagggcgggggcggaggg

SEQ ID NO: 316787 - RNA, 22 nt, Human
gaccaaguaaaaacauacaaga

SEQ ID NO: 316788 - RNA, 23 nt, Human
gagacggcaggaggaggcggggg

SEQ ID NO: 316789 - RNA, 20 nt, Human
gaggacuggaaaggcccugc

SEQ ID NO: 316790 - RNA, 21 nt, Human
gaggacuggaaaggcccugcc

SEQ ID NO: 316791 - RNA, 21 nt, Human
gagggaagggcgggggcggag

SEQ ID NO: 316792 - RNA, 23 nt, Human
gcccugccuggagccuccucuca

SEQ ID NO: 316793 - RNA, 22 nt, Human
gccucacggccacaucucagcg

SEQ ID NO: 316794 - RNA, 18 nt, Human
gcggggugcucgcgcccc

SEQ ID NO: 316795 - RNA, 18 nt, Human
ggagaggcgcggggugcu

SEQ ID NO: 316796 - RNA, 21 nt, Human
gggugcgggugccgagcgcgc

SEQ ID NO: 316797 - RNA, 20 nt, Human
uaagagauuggaaugguacu

SEQ ID NO: 316798 - RNA, 20 nt, Human
uauaaaagggaaaaauauac

SEQ ID NO: 316799 - RNA, 24 nt, Human
uccccgggccgcggcgagcucccg

SEQ ID NO: 316800 - RNA, 19 nt, Human
uccggcagaggugggaggc

SEQ ID NO: 316801 - RNA, 21 nt, Human
ucggcgcccgccaacgccuca

SEQ ID NO: 316802 - RNA, 23 nt, Human
ucuaugugcaacacaaucaaaga

SEQ ID NO: 316803 - RNA, 24 nt, Human
ugaaaagcacauuauaaaagggaa

SEQ ID NO: 316804 - RNA, 20 nt, Human
ugaaacuucagaagugacac

SEQ ID NO: 316805 - RNA, 19 nt, Human
ugagacaaagagaagggua

SEQ ID NO: 316806 - RNA, 22 nt, Human
ugagaggaagaggaggaaugaa

SEQ ID NO: 316807 - RNA, 24 nt, Human
ugagggagggguuagggcagguaa

SEQ ID NO: 316808 - RNA, 22 nt, Human
ugagguuuguuuuguaauuuuu

SEQ ID NO: 316809 - RNA, 20 nt, Human
ugccgcggugcccgcucuuc

SEQ ID NO: 316810 - RNA, 22 nt, Human
ugccuggagccuccucucaggg

SEQ ID NO: 316811 - RNA, 23 nt, Human
ugccuggagccuccucucagggc

SEQ ID NO: 316812 - RNA, 19 nt, Human
ugccuucagccuuugagag

SEQ ID NO: 316813 - RNA, 18 nt, Human
ugcucaaucccccaauga

SEQ ID NO: 316814 - RNA, 18 nt, Human
ugcugcucaaucccccaa

SEQ ID NO: 316815 - RNA, 19 nt, Human
ugcuuuaaaaagccuggag

SEQ ID NO: 316816 - RNA, 24 nt, Human
ugggacucaaagccuccaucccug

SEQ ID NO: 316817 - RNA, 19 nt, Human
ugggucaggagggacuagg

SEQ ID NO: 316818 - RNA, 21 nt, Human
ugggucaggagggacuaggug

SEQ ID NO: 316819 - RNA, 21 nt, Human
ugugaggacuggaaaggcccu

SEQ ID NO: 316820 - RNA, 23 nt, Human
uuaccacucccauaauuaucuca

SEQ ID NO: 316821 - RNA, 24 nt, Human
uuaguccauauauuuuuccauuua

SEQ ID NO: 316822 - RNA, 29 nt, Human
uucagaagugacacaauaaauccaaugaa

SEQ ID NO: 316823 - RNA, 21 nt, Human
aaggggacaaggaaguacaca

SEQ ID NO: 316824 - RNA, 30 nt, Human
aaggggacaaggaaguacacagcgagggaa

SEQ ID NO: 316825 - RNA, 22 nt, Human
accccaggacacugugaaucuc

SEQ ID NO: 316826 - RNA, 21 nt, Human
acccccagccacggaaagagg

SEQ ID NO: 316827 - RNA, 19 nt, Human
agacaggguagaaaggagg

SEQ ID NO: 316828 - RNA, 21 nt, Human
agagggacugacagcucuggg

SEQ ID NO: 316829 - RNA, 21 nt, Human
aggggacaaggaaguacacag

SEQ ID NO: 316830 - RNA, 22 nt, Human
cacaguccugggccccccccca

SEQ ID NO: 316831 - RNA, 21 nt, Human
cacccuggcuuucucgaaaac

SEQ ID NO: 316832 - RNA, 18 nt, Human
caggagaagggauagagg

SEQ ID NO: 316833 - RNA, 22 nt, Human
cauccuguccggccuuuggggg

SEQ ID NO: 316834 - RNA, 23 nt, Human
ccacccuggcuuucucgaaaacc

SEQ ID NO: 316835 - RNA, 20 nt, Human
ccacucuggcaaggccaggg

SEQ ID NO: 316836 - RNA, 20 nt, Human
ccagggccuccugcaacugc

SEQ ID NO: 316837 - RNA, 19 nt, Human
ccaugauuacugugaaccc

SEQ ID NO: 316838 - RNA, 22 nt, Human
cccacccuggcuuucucgaaaa

SEQ ID NO: 316839 - RNA, 19 nt, Human
ccccagggccuccugcaac

SEQ ID NO: 316840 - RNA, 25 nt, Human
cccccagggccuccugcaacugccc

SEQ ID NO: 316841 - RNA, 22 nt, Human
ccccccagggccuccugcaacu

SEQ ID NO: 316842 - RNA, 20 nt, Human
ccccggggguucucucuggg

SEQ ID NO: 316843 - RNA, 18 nt, Human
cggggguucucucugggc

SEQ ID NO: 316844 - RNA, 18 nt, Human
cucccccucccccugccc

SEQ ID NO: 316845 - RNA, 19 nt, Human
cucucugggccccuggaca

SEQ ID NO: 316846 - RNA, 22 nt, Human
cuguguagagggugagcugggc

SEQ ID NO: 316847 - RNA, 19 nt, Human
cuucuugccugugcccucc

SEQ ID NO: 316848 - RNA, 20 nt, Human
gaagaucccugauggcagcu

SEQ ID NO: 316849 - RNA, 23 nt, Human
gagaauaaauagaccauggaccc

SEQ ID NO: 316850 - RNA, 21 nt, Human
gcaggcgaggcgcugagugcc

SEQ ID NO: 316851 - RNA, 18 nt, Human
gcccaguccuggggggca

SEQ ID NO: 316852 - RNA, 19 nt, Human
ggacaaggaaguacacagc

SEQ ID NO: 316853 - RNA, 21 nt, Human
ggacaggagaagggauagagg

SEQ ID NO: 316854 - RNA, 25 nt, Human
ggagcagagggugggagcccgccug

SEQ ID NO: 316855 - RNA, 19 nt, Human
ggaggugcugggugagacu

SEQ ID NO: 316856 - RNA, 19 nt, Human
ggcagacaggguagaaagg

SEQ ID NO: 316857 - RNA, 18 nt, Human
ggcugggaguccucagaa

SEQ ID NO: 316858 - RNA, 26 nt, Human
gggacaaggaaguacacagcgaggga

SEQ ID NO: 316859 - RNA, 22 nt, Human
gggcaggggaagaucccugaug

SEQ ID NO: 316860 - RNA, 21 nt, Human
gggccuccugcaacugcccag

SEQ ID NO: 316861 - RNA, 22 nt, Human
gggccugggaggugcuggguga

SEQ ID NO: 316862 - RNA, 21 nt, Human
ggggggcagacaggguagaaa

SEQ ID NO: 316863 - RNA, 19 nt, Human
gggguucucucugggccug

SEQ ID NO: 316864 - RNA, 22 nt, Human
ggguucccacccuggcuuucuc

SEQ ID NO: 316865 - RNA, 22 nt, Human
guccugggcccccccccagggc

SEQ ID NO: 316866 - RNA, 22 nt, Human
gugaaagcugggcugggcuggg

SEQ ID NO: 316867 - RNA, 24 nt, Human
uacacagcgagggaagggaggagu

SEQ ID NO: 316868 - RNA, 19 nt, Human
uacccccagccacggaaag

SEQ ID NO: 316869 - RNA, 18 nt, Human
uagaaaggaggauggcuc

SEQ ID NO: 316870 - RNA, 21 nt, Human
uagacuucggucgccaacccc

SEQ ID NO: 316871 - RNA, 20 nt, Human
ucagaagccacucuggcaag

SEQ ID NO: 316872 - RNA, 20 nt, Human
ucccugauggcagcuuccug

SEQ ID NO: 316873 - RNA, 24 nt, Human
uccugggcccccccccagggccuc

SEQ ID NO: 316874 - RNA, 21 nt, Human
uccuguccggccuuugggggg

SEQ ID NO: 316875 - RNA, 21 nt, Human
ucucugggccugggaggugcu

SEQ ID NO: 316876 - RNA, 18 nt, Human
ugagacuggacagacuaa

SEQ ID NO: 316877 - RNA, 22 nt, Human
ugagugcccuugcccaaggcca

SEQ ID NO: 316878 - RNA, 21 nt, Human
ugauuacugugaacccccccu

SEQ ID NO: 316879 - RNA, 18 nt, Human
uggccaaggcaggggcag

SEQ ID NO: 316880 - RNA, 22 nt, Human
ugggcccccccccagggccucc

SEQ ID NO: 316881 - RNA, 20 nt, Human
ugggccugggaggugcuggg

SEQ ID NO: 316882 - RNA, 22 nt, Human
ugggccugggaggugcugggug

SEQ ID NO: 316883 - RNA, 24 nt, Human
uggguuuagcuuuuccccuucuga

SEQ ID NO: 316884 - RNA, 26 nt, Human
ugugcccucccccucccccugcccaa

SEQ ID NO: 316885 - RNA, 23 nt, Human
uucccacccuggcuuucucgaaa

SEQ ID NO: 316886 - RNA, 21 nt, Human
uuugcggggcaggggaagauc

SEQ ID NO: 316887 - RNA, 18 nt, Human
aaaaacaaacaaaagaac

SEQ ID NO: 316888 - RNA, 29 nt, Human
aaaaagagagucuucccagaaaccucucc

SEQ ID NO: 316889 - RNA, 23 nt, Human
aaaaagauguucuuacacacuga

SEQ ID NO: 316890 - RNA, 21 nt, Human
aaaacaaaagcucaguacaug

SEQ ID NO: 316891 - RNA, 19 nt, Human
aaaacaaagauacaaugua

SEQ ID NO: 316892 - RNA, 20 nt, Human
aaaccucucucacaaacaua

SEQ ID NO: 316893 - RNA, 21 nt, Human
aaagaaaaccuagacaaaaag

SEQ ID NO: 316894 - RNA, 20 nt, Human
aaagagccauuucacugaga

SEQ ID NO: 316895 - RNA, 22 nt, Human
aaagauccuaaguuccauuugg

SEQ ID NO: 316896 - RNA, 21 nt, Human
aaaggaagccauacuaaaggc

SEQ ID NO: 316897 - RNA, 21 nt, Human
aacaugaagaugaagggcagg

SEQ ID NO: 316898 - RNA, 21 nt, Human
aacccgcggcucugccagcgg

SEQ ID NO: 316899 - RNA, 24 nt, Human
aacuagggaaacuuuaggaggcca

SEQ ID NO: 316900 - RNA, 19 nt, Human
aagaaaccaggcggccgca

SEQ ID NO: 316901 - RNA, 22 nt, Human
aagaccgaugaaaacucagaca

SEQ ID NO: 316902 - RNA, 18 nt, Human
aagagccuuguugaaggg

SEQ ID NO: 316903 - RNA, 20 nt, Human
acacuaaaaagacacuugga

SEQ ID NO: 316904 - RNA, 25 nt, Human
accacaagaaguccccuccccccag

SEQ ID NO: 316905 - RNA, 18 nt, Human
acccugagagaaauaaag

SEQ ID NO: 316906 - RNA, 21 nt, Human
acccugagagaaauaaagaau

SEQ ID NO: 316907 - RNA, 21 nt, Human
acuggcgggcccggccccgac

SEQ ID NO: 316908 - RNA, 19 nt, Human
acuuggaaauauggcuuua

SEQ ID NO: 316909 - RNA, 18 nt, Human
agaaaauaccagcggcug

SEQ ID NO: 316910 - RNA, 24 nt, Human
agaaagaaaaccuagacaaaaaga

SEQ ID NO: 316911 - RNA, 18 nt, Human
agagaaggagacacggug

SEQ ID NO: 316912 - RNA, 24 nt, Human
agagcagaaagaaaaccuagacaa

SEQ ID NO: 316913 - RNA, 22 nt, Human
agauguucuuacacacugagcu

SEQ ID NO: 316914 - RNA, 24 nt, Human
agcagaaagaaaaccuagacaaaa

SEQ ID NO: 316915 - RNA, 21 nt, Human
aggaggccaaaauauuaagua

SEQ ID NO: 316916 - RNA, 18 nt, Human
aggcagcggcagugccgg

SEQ ID NO: 316917 - RNA, 24 nt, Human
agggcaaaaagagagucuucccag

SEQ ID NO: 316918 - RNA, 19 nt, Human
agguguugauaacgugagc

SEQ ID NO: 316919 - RNA, 19 nt, Human
agugaagagaccccuuaga

SEQ ID NO: 316920 - RNA, 21 nt, Human
augaaaaaacagauccuaaaa

SEQ ID NO: 316921 - RNA, 21 nt, Human
augaagggcagggugcuuucc

SEQ ID NO: 316922 - RNA, 22 nt, Human
caaaaagagagucuucccagaa

SEQ ID NO: 316923 - RNA, 18 nt, Human
caaagagccauuucacug

SEQ ID NO: 316924 - RNA, 18 nt, Human
caagaaguccccuccccc

SEQ ID NO: 316925 - RNA, 20 nt, Human
caagacacgaggacagaagc

SEQ ID NO: 316926 - RNA, 23 nt, Human
caagcaggauaaauaagucaaaa

SEQ ID NO: 316927 - RNA, 21 nt, Human
cacacuaaaaagacacuugga

SEQ ID NO: 316928 - RNA, 24 nt, Human
cagaaaccucucucacaaacauac

SEQ ID NO: 316929 - RNA, 19 nt, Human
cagacacuguauuuuccuu

SEQ ID NO: 316930 - RNA, 21 nt, Human
cagcaugugaagaccgauggu

SEQ ID NO: 316931 - RNA, 19 nt, Human
cagugccggccccgugcaa

SEQ ID NO: 316932 - RNA, 25 nt, Human
caucucacaaagcggacuuguccac

SEQ ID NO: 316933 - RNA, 20 nt, Human
ccacaagaaguccccucccc

SEQ ID NO: 316934 - RNA, 24 nt, Human
cccaggugauuuuccuccaagaca

SEQ ID NO: 316935 - RNA, 24 nt, Human
cgaaaucugcaaauaaaaauauua

SEQ ID NO: 316936 - RNA, 22 nt, Human
cgaggacaccgucgucaacccg

SEQ ID NO: 316937 - RNA, 23 nt, Human
cgcuggugccuccuccaagcucu

SEQ ID NO: 316938 - RNA, 22 nt, Human
cggaacgggguccaagaaagcu

SEQ ID NO: 316939 - RNA, 18 nt, Human
cgucauccucgcuggugc

SEQ ID NO: 316940 - RNA, 20 nt, Human
cuaaaauaagccacauuuug

SEQ ID NO: 316941 - RNA, 23 nt, Human
cucacaaacauacugaacaucca

SEQ ID NO: 316942 - RNA, 23 nt, Human
cugcaaauaaaaauauuaacaca

SEQ ID NO: 316943 - RNA, 21 nt, Human
cugcuggcguaacaaucacgu

SEQ ID NO: 316944 - RNA, 21 nt, Human
cuggugccuccuccaagcucu

SEQ ID NO: 316945 - RNA, 21 nt, Human
cuucaauaaagagcagaaaga

SEQ ID NO: 316946 - RNA, 26 nt, Human
gaacauccaaaaucaaggauauuuga

SEQ ID NO: 316947 - RNA, 19 nt, Human
gaagaugaagggcagggug

SEQ ID NO: 316948 - RNA, 22 nt, Human
gacuuggacuacgcuggggugg

SEQ ID NO: 316949 - RNA, 21 nt, Human
gcaaugcuguuguguuacuuu

SEQ ID NO: 316950 - RNA, 19 nt, Human
gccauacuaaaggccacac

SEQ ID NO: 316951 - RNA, 24 nt, Human
gcgggcucugggaagucaccauug

SEQ ID NO: 316952 - RNA, 22 nt, Human
ggagaacaugaagaugaagggc

SEQ ID NO: 316953 - RNA, 22 nt, Human
gucgucaacccgcggcucugcc

SEQ ID NO: 316954 - RNA, 21 nt, Human
gugaagaccgaugaaaacuca

SEQ ID NO: 316955 - RNA, 20 nt, Human
uaaaagauccuaaguuccau

SEQ ID NO: 316956 - RNA, 22 nt, Human
uaaaaggaagccauacuaaagg

SEQ ID NO: 316957 - RNA, 22 nt, Human
uaaaauggagagauacuuguca

SEQ ID NO: 316958 - RNA, 22 nt, Human
uaaagaauagacaaagcacuaa

SEQ ID NO: 316959 - RNA, 21 nt, Human
uaaagacggaaguucaaacaa

SEQ ID NO: 316960 - RNA, 22 nt, Human
uaaggcaagaaaccaggcggcc

SEQ ID NO: 316961 - RNA, 24 nt, Human
uaaguaauacucuugccaaagaaa

SEQ ID NO: 316962 - RNA, 24 nt, Human
uagacaaagcacuaaguuuaaaga

SEQ ID NO: 316963 - RNA, 23 nt, Human
uaguuuucauaaugguaaaaugg

SEQ ID NO: 316964 - RNA, 21 nt, Human
ucaaaauacauaagacgcugc

SEQ ID NO: 316965 - RNA, 20 nt, Human
ucaagacacuuaacauuaag

SEQ ID NO: 316966 - RNA, 26 nt, Human
uccaaaaucaaggauauuugagaauc

SEQ ID NO: 316967 - RNA, 22 nt, Human
ucuagacuucagcgggaaaggc

SEQ ID NO: 316968 - RNA, 22 nt, Human
ucucacuaucuuugaaaggaua

SEQ ID NO: 316969 - RNA, 22 nt, Human
ucucagaacagcacugcagccu

SEQ ID NO: 316970 - RNA, 19 nt, Human
ucugggaagucaccauugu

SEQ ID NO: 316971 - RNA, 20 nt, Human
ugaaaaaacagauccuaaaa

SEQ ID NO: 316972 - RNA, 21 nt, Human
ugaaaaacaaacaaaagaacu

SEQ ID NO: 316973 - RNA, 22 nt, Human
ugaaggcagcggcagugccggc

SEQ ID NO: 316974 - RNA, 20 nt, Human
ugaagggcaacaauguuuaa

SEQ ID NO: 316975 - RNA, 20 nt, Human
ugagaacucgaaagcaaaga

SEQ ID NO: 316976 - RNA, 19 nt, Human
ugccaaagaaaauuaguuu

SEQ ID NO: 316977 - RNA, 20 nt, Human
ugccaguggcuugaagugac

SEQ ID NO: 316978 - RNA, 20 nt, Human
ugcccaguacguugcgugag

SEQ ID NO: 316979 - RNA, 21 nt, Human
uggaguaccacagacuuggaa

SEQ ID NO: 316980 - RNA, 22 nt, Human
uggcguaacaaucacguggaaa

SEQ ID NO: 316981 - RNA, 23 nt, Human
ugggcaggagguaccagagcucc

SEQ ID NO: 316982 - RNA, 19 nt, Human
ugggguggcggcgacacug

SEQ ID NO: 316983 - RNA, 23 nt, Human
uguaacugauugguauggcacag

SEQ ID NO: 316984 - RNA, 21 nt, Human
ugucaacaucuagacuucagc

SEQ ID NO: 316985 - RNA, 18 nt, Human
uucaagcaggauaaauaa

SEQ ID NO: 316986 - RNA, 18 nt, Human
uucaugucacucaucaaa

SEQ ID NO: 316987 - RNA, 21 nt, Human
uugaagggcaacaauguuuaa

SEQ ID NO: 316988 - RNA, 18 nt, Human
uuggaaaacacugauguu

SEQ ID NO: 316989 - RNA, 19 nt, Human
uuuaaaacuccaauuucug

SEQ ID NO: 316990 - RNA, 23 nt, Human
uuuaaaauaaaucucuucuacag

SEQ ID NO: 316991 - RNA, 26 nt, Human
uuuaagauaaauuucagagcaaucuc

SEQ ID NO: 316992 - RNA, 21 nt, Human
aaccuggguccggccuuccuc

SEQ ID NO: 316993 - RNA, 20 nt, Human
aagcagucagccccagggug

SEQ ID NO: 316994 - RNA, 19 nt, Human
aagcccaacccaccuuagc

SEQ ID NO: 316995 - RNA, 23 nt, Human
acaaacaaggaaauaaauaggug

SEQ ID NO: 316996 - RNA, 18 nt, Human
accccagggcugcugcuc

SEQ ID NO: 316997 - RNA, 24 nt, Human
acccggcccgucuccugcggcccc

SEQ ID NO: 316998 - RNA, 25 nt, Human
acccuauguacacagccaaaagccg

SEQ ID NO: 316999 - RNA, 20 nt, Human
acugccugcgccccuggaac

SEQ ID NO: 317000 - RNA, 21 nt, Human
agaaaagcagucagccccagg

SEQ ID NO: 317001 - RNA, 25 nt, Human
agaaaagcagucagccccagggugg

SEQ ID NO: 317002 - RNA, 22 nt, Human
agagcagccucagguagcugug

SEQ ID NO: 317003 - RNA, 19 nt, Human
agcacccuauguacacagc

SEQ ID NO: 317004 - RNA, 19 nt, Human
agcagccucagguagcugu

SEQ ID NO: 317005 - RNA, 22 nt, Human
agcagguaggggacaggcaucc

SEQ ID NO: 317006 - RNA, 18 nt, Human
agccccuggccccuccaa

SEQ ID NO: 317007 - RNA, 21 nt, Human
aguauggagggccagggcagu

SEQ ID NO: 317008 - RNA, 30 nt, Human
agugcccacaucccccucccuugaguagcc

SEQ ID NO: 317009 - RNA, 22 nt, Human
augggguaagaagaaauaauac

SEQ ID NO: 317010 - RNA, 19 nt, Human
auucaucccuccccggccc

SEQ ID NO: 317011 - RNA, 26 nt, Human
caaaagccgcacugccugcgccccug

SEQ ID NO: 317012 - RNA, 21 nt, Human
caacagcacagaaaagcaguc

SEQ ID NO: 317013 - RNA, 23 nt, Human
cacacggcugggacuggggggcc

SEQ ID NO: 317014 - RNA, 22 nt, Human
cacagccaaaagccgcacugcc

SEQ ID NO: 317015 - RNA, 18 nt, Human
cacuaagcaucuuagugc

SEQ ID NO: 317016 - RNA, 24 nt, Human
cagcauagcacaaacaaggaaaua

SEQ ID NO: 317017 - RNA, 26 nt, Human
cagccaaaagccgcacugccugcgcc

SEQ ID NO: 317018 - RNA, 23 nt, Human
caucccccucccuugaguagcua

SEQ ID NO: 317019 - RNA, 22 nt, Human
ccaacagcacagaaaagcaguc

SEQ ID NO: 317020 - RNA, 24 nt, Human
ccagcacacggcugggacuggggg

SEQ ID NO: 317021 - RNA, 24 nt, Human
cccagggcugugugggcuguggcc

SEQ ID NO: 317022 - RNA, 23 nt, Human
ccccacuugguccaucugggccc

SEQ ID NO: 317023 - RNA, 20 nt, Human
cccccaagacagccaguagg

SEQ ID NO: 317024 - RNA, 21 nt, Human
cccggcccgucuccugcggcc

SEQ ID NO: 317025 - RNA, 19 nt, Human
cccgucuccugcggccccg

SEQ ID NO: 317026 - RNA, 23 nt, Human
ccgcacucggccgcucggcgucu

SEQ ID NO: 317027 - RNA, 22 nt, Human
ccuuccaugucugugaccccag

SEQ ID NO: 317028 - RNA, 22 nt, Human
cgcuccggcuccggcuuugcuc

SEQ ID NO: 317029 - RNA, 18 nt, Human
cggcugggacuggggggc

SEQ ID NO: 317030 - RNA, 21 nt, Human
cucggcccguccggacccggc

SEQ ID NO: 317031 - RNA, 20 nt, Human
cucugcaggggagagagagg

SEQ ID NO: 317032 - RNA, 26 nt, Human
cuucaagugcccacaucccccucccu

SEQ ID NO: 317033 - RNA, 23 nt, Human
cuuggggcaccgcucccugcuuc

SEQ ID NO: 317034 - RNA, 19 nt, Human
gaagagggaccauucugug

SEQ ID NO: 317035 - RNA, 21 nt, Human
gacccggcccgucuccugcgg

SEQ ID NO: 317036 - RNA, 22 nt, Human
gagggccagggcagugucccag

SEQ ID NO: 317037 - RNA, 22 nt, Human
gcucaccaaagacagggcacgg

SEQ ID NO: 317038 - RNA, 21 nt, Human
ggaaauaaauagguguuggca

SEQ ID NO: 317039 - RNA, 27 nt, Human
ggacccggcccgucuccuugggagccc

SEQ ID NO: 317040 - RNA, 24 nt, Human
gggaccaauggggcuugacauaac

SEQ ID NO: 317041 - RNA, 18 nt, Human
gggcacgggguagggugu

SEQ ID NO: 317042 - RNA, 24 nt, Human
ggggagaagagggaccauucugug

SEQ ID NO: 317043 - RNA, 19 nt, Human
gggguuggcuucccuucag

SEQ ID NO: 317044 - RNA, 23 nt, Human
uauguacacagccaaaagccgca

SEQ ID NO: 317045 - RNA, 21 nt, Human
ucccagggcugugugggcugu

SEQ ID NO: 317046 - RNA, 24 nt, Human
ucccccaagacagccaguagggag

SEQ ID NO: 317047 - RNA, 19 nt, Human
uccccggccccacuugguc

SEQ ID NO: 317048 - RNA, 24 nt, Human
uccugcggccccgcuccucgggag

SEQ ID NO: 317049 - RNA, 20 nt, Human
uccugcuguucccuacaugc

SEQ ID NO: 317050 - RNA, 22 nt, Human
uccuguguguacuucucagagc

SEQ ID NO: 317051 - RNA, 24 nt, Human
ucucagagcagccucagguagcug

SEQ ID NO: 317052 - RNA, 21 nt, Human
ugcuucaagugcccacauccc

SEQ ID NO: 317053 - RNA, 18 nt, Human
ugugaccccagggcugcu

SEQ ID NO: 317054 - RNA, 21 nt, Human
ugugugggcuguggcccugug

SEQ ID NO: 317055 - RNA, 23 nt, Human
uguuuauucaucccuccccggcc

SEQ ID NO: 317056 - RNA, 25 nt, Human
uuagugcucagccuguacuagccac

SEQ ID NO: 317057 - RNA, 18 nt, Human
uucagcuacucugggacc

SEQ ID NO: 317058 - RNA, 19 nt, Human
uuccucagccccuggcccc

SEQ ID NO: 317059 - RNA, 29 nt, Human
uucuccgccaucgugguguguucuugacu

SEQ ID NO: 317060 - RNA, 19 nt, Human
uuucuaguuuugggaacca

SEQ ID NO: 317061 - RNA, 22 nt, Human
uuuugggaaccaacagcacaga

SEQ ID NO: 317062 - RNA, 23 nt, Human
uuuuggggagaagagggaccauu

SEQ ID NO: 317063 - RNA, 25 nt, Human
agaggcuacauccucuuuugcugga

SEQ ID NO: 317064 - RNA, 22 nt, Human
agcguuccgguggcggcggcgg

SEQ ID NO: 317065 - RNA, 24 nt, Human
agcugcggggagccuggggcgacg

SEQ ID NO: 317066 - RNA, 18 nt, Human
agggaggaagacuggauc

SEQ ID NO: 317067 - RNA, 21 nt, Human
aguccuuauuuuguuuuuucc

SEQ ID NO: 317068 - RNA, 22 nt, Human
aucaccucuucucucuuaacuc

SEQ ID NO: 317069 - RNA, 18 nt, Human
auuacagucaaguuaucc

SEQ ID NO: 317070 - RNA, 20 nt, Human
auucaagacauugauuugga

SEQ ID NO: 317071 - RNA, 23 nt, Human
caacaacuccaaacaguccaagc

SEQ ID NO: 317072 - RNA, 20 nt, Human
caacucaggaagaugugcaa

SEQ ID NO: 317073 - RNA, 18 nt, Human
caauacagaaaacuguug

SEQ ID NO: 317074 - RNA, 25 nt, Human
cagcggcagcaagagaaggggacag

SEQ ID NO: 317075 - RNA, 25 nt, Human
caggaagaugugcaaaagaaaaaga

SEQ ID NO: 317076 - RNA, 25 nt, Human
caggacauuaggaauuuccagauuu

SEQ ID NO: 317077 - RNA, 19 nt, Human
cauagcaauuucaucaaca

SEQ ID NO: 317078 - RNA, 19 nt, Human
caugaauccgauauucccu

SEQ ID NO: 317079 - RNA, 19 nt, Human
caugaccccauuccacgug

SEQ ID NO: 317080 - RNA, 19 nt, Human
ccaucuucuacuacauaaa

SEQ ID NO: 317081 - RNA, 19 nt, Human
cccagaggcuacauccucu

SEQ ID NO: 317082 - RNA, 20 nt, Human
cccagaggcuacauccucuu

SEQ ID NO: 317083 - RNA, 24 nt, Human
ccccaguaaacaaaacuuuuauca

SEQ ID NO: 317084 - RNA, 23 nt, Human
ccccggacccggcggcggcggcg

SEQ ID NO: 317085 - RNA, 23 nt, Human
ccccuuucucucuccuauuguca

SEQ ID NO: 317086 - RNA, 21 nt, Human
ccggacccggcggcggcggcg

SEQ ID NO: 317087 - RNA, 18 nt, Human
ccuggggcgacggcuguc

SEQ ID NO: 317088 - RNA, 23 nt, Human
cgagaaucuacaaaaaacacugu

SEQ ID NO: 317089 - RNA, 24 nt, Human
cucagcguuccgguggcggcggcg

SEQ ID NO: 317090 - RNA, 23 nt, Human
cucaggaagaugugcaaaagaaa

SEQ ID NO: 317091 - RNA, 24 nt, Human
cuccaaacaguccaagcuguuugc

SEQ ID NO: 317092 - RNA, 21 nt, Human
cuguaauaaugaaacaaaggu

SEQ ID NO: 317093 - RNA, 24 nt, Human
gacguggggagggggggaagggag

SEQ ID NO: 317094 - RNA, 19 nt, Human
gagccgcaggagcuggagc

SEQ ID NO: 317095 - RNA, 20 nt, Human
gagguccgggcagcugcggg

SEQ ID NO: 317096 - RNA, 26 nt, Human
gagguggccgcagcgggggcgggcgg

SEQ ID NO: 317097 - RNA, 25 nt, Human
gccaccuuucgcuacccgcggugga

SEQ ID NO: 317098 - RNA, 24 nt, Human
gccccggacccggcggcggcggcg

SEQ ID NO: 317099 - RNA, 19 nt, Human
gccggacccgaaccucagc

SEQ ID NO: 317100 - RNA, 22 nt, Human
ggaaagauguucaccccaguaa

SEQ ID NO: 317101 - RNA, 20 nt, Human
ggaagggagggaggaagacu

SEQ ID NO: 317102 - RNA, 21 nt, Human
ggaccgggacgugcaggggga

SEQ ID NO: 317103 - RNA, 18 nt, Human
ggagggggggaagggagg

SEQ ID NO: 317104 - RNA, 20 nt, Human
ggagggggggaagggaggga

SEQ ID NO: 317105 - RNA, 23 nt, Human
ggagguccgggcagcugcgggga

SEQ ID NO: 317106 - RNA, 18 nt, Human
gggacagaauaaggagga

SEQ ID NO: 317107 - RNA, 20 nt, Human
gggagccuggggcgacggcu

SEQ ID NO: 317108 - RNA, 18 nt, Human
ggggaagggagggaggaa

SEQ ID NO: 317109 - RNA, 22 nt, Human
gggggaagggagggaggaagac

SEQ ID NO: 317110 - RNA, 23 nt, Human
gguaacaaauacaguaguuagga

SEQ ID NO: 317111 - RNA, 19 nt, Human
uaaaagagggugagaacaa

SEQ ID NO: 317112 - RNA, 21 nt, Human
uaaaagagggugagaacaaug

SEQ ID NO: 317113 - RNA, 21 nt, Human
uaaauaaggaacucccgauaa

SEQ ID NO: 317114 - RNA, 21 nt, Human
uaacaaauacaguaguuagga

SEQ ID NO: 317115 - RNA, 21 nt, Human
uaaggaaaugacagucuuuuu

SEQ ID NO: 317116 - RNA, 20 nt, Human
uacauauuaaaaaguaaggc

SEQ ID NO: 317117 - RNA, 20 nt, Human
uacuauguuuaucaccucuu

SEQ ID NO: 317118 - RNA, 21 nt, Human
uagugauaaauaaggaacucc

SEQ ID NO: 317119 - RNA, 24 nt, Human
uaguguuugucuuucuuauuucaa

SEQ ID NO: 317120 - RNA, 21 nt, Human
uccagauuuuuuucaguagca

SEQ ID NO: 317121 - RNA, 24 nt, Human
ucccaucaaaucggcaccgacccc

SEQ ID NO: 317122 - RNA, 21 nt, Human
ucccuacuauguuuaucaccu

SEQ ID NO: 317123 - RNA, 22 nt, Human
ucccuccgguuccgcggcggcg

SEQ ID NO: 317124 - RNA, 29 nt, Human
uccgguggcggcggcggccucacgauccu

SEQ ID NO: 317125 - RNA, 18 nt, Human
ugaagcuucuggggaaga

SEQ ID NO: 317126 - RNA, 24 nt, Human
ugagaaguccaucuacuguccaaa

SEQ ID NO: 317127 - RNA, 18 nt, Human
ugcagggggagguccggg

SEQ ID NO: 317128 - RNA, 23 nt, Human
ugcauaauaauguuuauccugaa

SEQ ID NO: 317129 - RNA, 18 nt, Human
ugccccggacccggcggc

SEQ ID NO: 317130 - RNA, 18 nt, Human
ugccccuuucucucuccu

SEQ ID NO: 317131 - RNA, 25 nt, Human
uggaaagauguucaccccaguaaac

SEQ ID NO: 317132 - RNA, 23 nt, Human
uggcgggcggcgccucagcucgu

SEQ ID NO: 317133 - RNA, 20 nt, Human
uggggagggggggaagggag

SEQ ID NO: 317134 - RNA, 22 nt, Human
uggggagggggggaagggaggg

SEQ ID NO: 317135 - RNA, 18 nt, Human
ugugcaaaagaaaaagau

SEQ ID NO: 317136 - RNA, 18 nt, Human
uuaaauuacagucaaguu

SEQ ID NO: 317137 - RNA, 22 nt, Human
uucaagacauugauuuggauuc

SEQ ID NO: 317138 - RNA, 24 nt, Human
uucacauuugaaaauuguaucaua

SEQ ID NO: 317139 - RNA, 23 nt, Human
uuguaucauacucucugcuagug

SEQ ID NO: 317140 - RNA, 18 nt, Human
uuucaugguuguauuguu

SEQ ID NO: 317141 - RNA, 21 nt, Human
uuugcaaaguucugagaaguc

SEQ ID NO: 317142 - RNA, 23 nt, Human
uuuuuuuuuuuaaaagaggguga

SEQ ID NO: 317143 - RNA, 22 nt, Human
uuuuuuuuuuuuaaaagagggu

SEQ ID NO: 317144 - RNA, 22 nt, Human
aaaagaaaggaauccaaaaaaa

SEQ ID NO: 317145 - RNA, 22 nt, Human
aaacaaccugauaacaaauuaa

SEQ ID NO: 317146 - RNA, 18 nt, Human
aaacaugcuaaccaucua

SEQ ID NO: 317147 - RNA, 24 nt, Human
aacaauguuacaaacaaacugaaa

SEQ ID NO: 317148 - RNA, 26 nt, Human
aacguucuuuuuuuucuuugggggcc

SEQ ID NO: 317149 - RNA, 23 nt, Human
aacugaauccaauuccuggcccc

SEQ ID NO: 317150 - RNA, 25 nt, Human
aagaagaagauaaguguuauaugga

SEQ ID NO: 317151 - RNA, 26 nt, Human
aagaagccuguggaaaucagccugug

SEQ ID NO: 317152 - RNA, 23 nt, Human
aagcauuuuagagaauauaaagu

SEQ ID NO: 317153 - RNA, 21 nt, Human
aagcgcauuacagucccauac

SEQ ID NO: 317154 - RNA, 19 nt, Human
aaucaccauccccaccaaa

SEQ ID NO: 317155 - RNA, 20 nt, Human
aauuccuggcccccagagcc

SEQ ID NO: 317156 - RNA, 20 nt, Human
acaucauuuuguuaaaaaug

SEQ ID NO: 317157 - RNA, 24 nt, Human
acgccucccgguucuucuuuuauu

SEQ ID NO: 317158 - RNA, 23 nt, Human
acucaguggaaggaugagaauuc

SEQ ID NO: 317159 - RNA, 24 nt, Human
agaaagaaaauaaacaccaugaag

SEQ ID NO: 317160 - RNA, 23 nt, Human
agaacagaacaaaauaacuaaac

SEQ ID NO: 317161 - RNA, 18 nt, Human
agacacucaacgccgccg

SEQ ID NO: 317162 - RNA, 21 nt, Human
agagaauauaaaguacgccag

SEQ ID NO: 317163 - RNA, 18 nt, Human
agccugugauguguggug

SEQ ID NO: 317164 - RNA, 21 nt, Human
agccuguggaaaucagccugu

SEQ ID NO: 317165 - RNA, 20 nt, Human
aggaaaacauguucauuccc

SEQ ID NO: 317166 - RNA, 24 nt, Human
aggaagccagaagauggcaucugc

SEQ ID NO: 317167 - RNA, 21 nt, Human
aguaggcaccaccccucagau

SEQ ID NO: 317168 - RNA, 24 nt, Human
auacaacugaaacaaccugauaac

SEQ ID NO: 317169 - RNA, 25 nt, Human
auacauuuccaguauaugucagacc

SEQ ID NO: 317170 - RNA, 18 nt, Human
auggaaagaagggcauuc

SEQ ID NO: 317171 - RNA, 24 nt, Human
caaaauuucaaaggcauuaagcau

SEQ ID NO: 317172 - RNA, 30 nt, Human
caacugaaacaaccugauaacaaauuaauu

SEQ ID NO: 317173 - RNA, 19 nt, Human
caauaaauaguccuuaguu

SEQ ID NO: 317174 - RNA, 18 nt, Human
caauguuacaaacaaacu

SEQ ID NO: 317175 - RNA, 22 nt, Human
cacacgagcacccaccccggca

SEQ ID NO: 317176 - RNA, 18 nt, Human
caccaccccucagaucac

SEQ ID NO: 317177 - RNA, 22 nt, Human
cagaacagaacaaaauaacuaa

SEQ ID NO: 317178 - RNA, 18 nt, Human
cagaaucaccauuucuuu

SEQ ID NO: 317179 - RNA, 22 nt, Human
cagaaugaaccaguuguaaccc

SEQ ID NO: 317180 - RNA, 20 nt, Human
cagcaagccacaaccaagac

SEQ ID NO: 317181 - RNA, 26 nt, Human
caguauacauacauuuccaguauaug

SEQ ID NO: 317182 - RNA, 24 nt, Human
caucuaaauauuuuccuugguugc

SEQ ID NO: 317183 - RNA, 22 nt, Human
ccaaaagagguguuuaaucacc

SEQ ID NO: 317184 - RNA, 23 nt, Human
cccaaaagagguguuuaaucacc

SEQ ID NO: 317185 - RNA, 22 nt, Human
cccauacaggccgauacagcca

SEQ ID NO: 317186 - RNA, 18 nt, Human
cccaucaugccccgcagc

SEQ ID NO: 317187 - RNA, 19 nt, Human
ccccaucaugccccgcagc

SEQ ID NO: 317188 - RNA, 18 nt, Human
cccccagagcaaauaagc

SEQ ID NO: 317189 - RNA, 30 nt, Human
ccccgcagcucaaaaaaaaaaaaaaaaaaa

SEQ ID NO: 317190 - RNA, 23 nt, Human
ccccucagaucacgaggccccua

SEQ ID NO: 317191 - RNA, 25 nt, Human
cccgguucuucuuuuauucuugggg

SEQ ID NO: 317192 - RNA, 23 nt, Human
cccuaaauauaaacggcaaaaaa

SEQ ID NO: 317193 - RNA, 22 nt, Human
cccuccuccgccgccgccgcua

SEQ ID NO: 317194 - RNA, 18 nt, Human
ccgccgccgccgccgccg

SEQ ID NO: 317195 - RNA, 18 nt, Human
ccgccgccgccgccgccg

SEQ ID NO: 317196 - RNA, 18 nt, Human
ccgccgccgccgccgccg

SEQ ID NO: 317197 - RNA, 18 nt, Human
ccgccgccgccgccgccg

SEQ ID NO: 317198 - RNA, 18 nt, Human
ccgccgccgccgccgccg

SEQ ID NO: 317199 - RNA, 24 nt, Human
ccgccgccgccgccgccgccgccg

SEQ ID NO: 317200 - RNA, 24 nt, Human
ccgccgccgccgccgccgccgccg

SEQ ID NO: 317201 - RNA, 24 nt, Human
ccgccgccgccgccgccgccgccg

SEQ ID NO: 317202 - RNA, 18 nt, Human
ccgccgccgccgccgcgc

SEQ ID NO: 317203 - RNA, 23 nt, Human
ccgccgccgccgccgcgcugcaa

SEQ ID NO: 317204 - RNA, 18 nt, Human
ccgccgccgccgcgcugc

SEQ ID NO: 317205 - RNA, 19 nt, Human
ccgccgcgcugcaaaccgc

SEQ ID NO: 317206 - RNA, 20 nt, Human
ccgccgcgcugcaaaccgcu

SEQ ID NO: 317207 - RNA, 23 nt, Human
ccgcgcugcaaaccgcucggcug

SEQ ID NO: 317208 - RNA, 19 nt, Human
ccgcugccgccagccccgc

SEQ ID NO: 317209 - RNA, 24 nt, Human
cgccgccgccgccgccgccgccgg

SEQ ID NO: 317210 - RNA, 20 nt, Human
cgccgccgccgccgccgcgc

SEQ ID NO: 317211 - RNA, 20 nt, Human
cgcugcucguccguccgacu

SEQ ID NO: 317212 - RNA, 26 nt, Human
cggagacccagcaccgcggaauggag

SEQ ID NO: 317213 - RNA, 19 nt, Human
cgggccagacacucaacgc

SEQ ID NO: 317214 - RNA, 22 nt, Human
cuccgccgcugccgccagcccc

SEQ ID NO: 317215 - RNA, 21 nt, Human
cuccgggcugcgcgugugugg

SEQ ID NO: 317216 - RNA, 19 nt, Human
cuccuccgccgccgccgcc

SEQ ID NO: 317217 - RNA, 24 nt, Human
cuccuccgccgccgccgccuucac

SEQ ID NO: 317218 - RNA, 22 nt, Human
cuccuccgccgcugccgccagc

SEQ ID NO: 317219 - RNA, 20 nt, Human
cucucucccucuuuuuuaau

SEQ ID NO: 317220 - RNA, 19 nt, Human
cuggcccccagagcaaaua

SEQ ID NO: 317221 - RNA, 20 nt, Human
gaagccuguggaaaucagcc

SEQ ID NO: 317222 - RNA, 22 nt, Human
gaccggcgggccagacacucaa

SEQ ID NO: 317223 - RNA, 23 nt, Human
gcacccaccccggcacggagacc

SEQ ID NO: 317224 - RNA, 21 nt, Human
gcaccuagaagacacauggug

SEQ ID NO: 317225 - RNA, 23 nt, Human
ggagaaauauccacaggaaaaaa

SEQ ID NO: 317226 - RNA, 22 nt, Human
ggagacccagcaccgcggaaug

SEQ ID NO: 317227 - RNA, 21 nt, Human
ggauagucuuugccagacugu

SEQ ID NO: 317228 - RNA, 23 nt, Human
gggcauccaauacaacugaaaca

SEQ ID NO: 317229 - RNA, 18 nt, Human
gugugguggugggccagc

SEQ ID NO: 317230 - RNA, 22 nt, Human
gugugguggugggccagcaccu

SEQ ID NO: 317231 - RNA, 23 nt, Human
guucauuccccuaacauugcagu

SEQ ID NO: 317232 - RNA, 21 nt, Human
uaaaaaacaugcauaggcaga

SEQ ID NO: 317233 - RNA, 19 nt, Human
uaaaagauauuccauugcc

SEQ ID NO: 317234 - RNA, 24 nt, Human
uaaaaggcauacccaaaagaggug

SEQ ID NO: 317235 - RNA, 23 nt, Human
uaacauugcaguauauacuagca

SEQ ID NO: 317236 - RNA, 24 nt, Human
uaaccaucuacaugugcauugaca

SEQ ID NO: 317237 - RNA, 22 nt, Human
uaaccuaucuagaaguccccaa

SEQ ID NO: 317238 - RNA, 21 nt, Human
uaagcgcauuacagucccaua

SEQ ID NO: 317239 - RNA, 19 nt, Human
uacaaagggaaaaaaguga

SEQ ID NO: 317240 - RNA, 18 nt, Human
uacaagugcaugcuuuga

SEQ ID NO: 317241 - RNA, 24 nt, Human
uacaugugcauugacaagcuuaug

SEQ ID NO: 317242 - RNA, 24 nt, Human
uaggaagaagccuguggaaaucag

SEQ ID NO: 317243 - RNA, 20 nt, Human
uauaaacggcaaaaaagaua

SEQ ID NO: 317244 - RNA, 22 nt, Human
ucaaaaaaaaaaaaaaaaaaaa

SEQ ID NO: 317245 - RNA, 23 nt, Human
ucaaaaaaaaaaaaaaaaaaaaa

SEQ ID NO: 317246 - RNA, 24 nt, Human
ucaacgccgccgccgccgccgccg

SEQ ID NO: 317247 - RNA, 22 nt, Human
ucagaaugaaccaguuguaacc

SEQ ID NO: 317248 - RNA, 19 nt, Human
ucaguggaaggaugagaau

SEQ ID NO: 317249 - RNA, 23 nt, Human
uccaacugcugauaugcagcaau

SEQ ID NO: 317250 - RNA, 20 nt, Human
ugaaaaaaguacauauuuug

SEQ ID NO: 317251 - RNA, 18 nt, Human
ugaugugugguggugggc

SEQ ID NO: 317252 - RNA, 19 nt, Human
ugccagacuguaucgagaa

SEQ ID NO: 317253 - RNA, 22 nt, Human
ugcgcguguguggugguuauuu

SEQ ID NO: 317254 - RNA, 21 nt, Human
ugcucguccguccgacugcac

SEQ ID NO: 317255 - RNA, 19 nt, Human
uggaaaucagccugugaug

SEQ ID NO: 317256 - RNA, 25 nt, Human
uggcacaugacagaacagaacaaaa

SEQ ID NO: 317257 - RNA, 18 nt, Human
ugggggaagggggauggg

SEQ ID NO: 317258 - RNA, 21 nt, Human
ugucagaagucaaauuacaaa

SEQ ID NO: 317259 - RNA, 19 nt, Human
uguccaguaacagaauaau

SEQ ID NO: 317260 - RNA, 25 nt, Human
uguggcacaugacagaacagaacaa

SEQ ID NO: 317261 - RNA, 23 nt, Human
ugugugguggugggccagcaccu

SEQ ID NO: 317262 - RNA, 21 nt, Human
uuaaaaaacaugcauaggcag

SEQ ID NO: 317263 - RNA, 19 nt, Human
uuagaguuucacauguaac

SEQ ID NO: 317264 - RNA, 21 nt, Human
uuagauaguagcugaagcgug

SEQ ID NO: 317265 - RNA, 23 nt, Human
uucacuauacuuaaaaaugcacc

SEQ ID NO: 317266 - RNA, 24 nt, Human
uucagcggacucaguggaaggaug

SEQ ID NO: 317267 - RNA, 20 nt, Human
uucuugggggaagggggaug

SEQ ID NO: 317268 - RNA, 23 nt, Human
uugccaugcauuuagaguuucac

SEQ ID NO: 317269 - RNA, 22 nt, Human
uuuaaaguugcugccuuuuccg

SEQ ID NO: 317270 - RNA, 20 nt, Human
uuuuauucuugggggaaggg

SEQ ID NO: 317271 - RNA, 21 nt, Human
uuuucugagcacgccucccgg

SEQ ID NO: 317272 - RNA, 18 nt, Human
uuuuuaggauggagaaau

SEQ ID NO: 317273 - RNA, 25 nt, Human
uuuuuagucaggauauuuucucugc

SEQ ID NO: 317274 - RNA, 18 nt, Human
aaaauaccaagacuaugu

SEQ ID NO: 317275 - RNA, 23 nt, Human
aaagaucugggcaaaaaagacuc

SEQ ID NO: 317276 - RNA, 24 nt, Human
aaauauuugcaaaaugaaaacaug

SEQ ID NO: 317277 - RNA, 18 nt, Human
aagcggcggcgccgccgg

SEQ ID NO: 317278 - RNA, 22 nt, Human
acauaaaaaugauagaaagcca

SEQ ID NO: 317279 - RNA, 25 nt, Human
acuauguuacagaauuagccacauu

SEQ ID NO: 317280 - RNA, 19 nt, Human
agacaggagaccauacagg

SEQ ID NO: 317281 - RNA, 19 nt, Human
aggauugcauuugaaauca

SEQ ID NO: 317282 - RNA, 20 nt, Human
agguguggaugcccuccacu

SEQ ID NO: 317283 - RNA, 22 nt, Human
auaaaauggagguguggaugcc

SEQ ID NO: 317284 - RNA, 19 nt, Human
augcccuccacuggaaauu

SEQ ID NO: 317285 - RNA, 21 nt, Human
auggaaaaagaaaaguccaca

SEQ ID NO: 317286 - RNA, 18 nt, Human
caaaaucuaauucuacug

SEQ ID NO: 317287 - RNA, 23 nt, Human
caaaguaaagggaaauaccaaac

SEQ ID NO: 317288 - RNA, 18 nt, Human
caccuuggcagcgaugac

SEQ ID NO: 317289 - RNA, 22 nt, Human
cagagccaagcggcggcgccgc

SEQ ID NO: 317290 - RNA, 24 nt, Human
ccagcuccucgggugaucugucca

SEQ ID NO: 317291 - RNA, 21 nt, Human
ccauuuggggcccgagaugug

SEQ ID NO: 317292 - RNA, 20 nt, Human
cccagggcccucaagccucc

SEQ ID NO: 317293 - RNA, 22 nt, Human
ccccaagccccuugcucacugc

SEQ ID NO: 317294 - RNA, 24 nt, Human
ccccuccagcuccucgggugaucu

SEQ ID NO: 317295 - RNA, 18 nt, Human
ccccuugcucacugcucu

SEQ ID NO: 317296 - RNA, 20 nt, Human
ccccuugcucacugcucucc

SEQ ID NO: 317297 - RNA, 21 nt, Human
cccuccacuggaaauugcccc

SEQ ID NO: 317298 - RNA, 19 nt, Human
ccuuugcauuaaaacauaa

SEQ ID NO: 317299 - RNA, 20 nt, Human
cucauaacaucuagguaacc

SEQ ID NO: 317300 - RNA, 20 nt, Human
cuucuuaaaucucuggggug

SEQ ID NO: 317301 - RNA, 25 nt, Human
gaaauugccccaagccccuugcuca

SEQ ID NO: 317302 - RNA, 20 nt, Human
gaccccuccagcuccucggg

SEQ ID NO: 317303 - RNA, 19 nt, Human
gccgggcgggguugggggc

SEQ ID NO: 317304 - RNA, 19 nt, Human
gcugggcccggggcucggc

SEQ ID NO: 317305 - RNA, 23 nt, Human
ggagguguggaugcccuccacug

SEQ ID NO: 317306 - RNA, 18 nt, Human
ggcccggggcucggcuag

SEQ ID NO: 317307 - RNA, 22 nt, Human
ggccgggcgggguugggggcgg

SEQ ID NO: 317308 - RNA, 21 nt, Human
ggcgggguugggggcgggggc

SEQ ID NO: 317309 - RNA, 19 nt, Human
ggggcccgagaugugagag

SEQ ID NO: 317310 - RNA, 18 nt, Human
gguugggggcgggggcgg

SEQ ID NO: 317311 - RNA, 24 nt, Human
guggcucucuaagcaacuugagua

SEQ ID NO: 317312 - RNA, 22 nt, Human
uaaaauuuccuuugcauuaaaa

SEQ ID NO: 317313 - RNA, 22 nt, Human
uaacuaucaaaagaaagguuuc

SEQ ID NO: 317314 - RNA, 23 nt, Human
uaaucaaaaacacuuccagaaca

SEQ ID NO: 317315 - RNA, 23 nt, Human
uaccaagacuauguuacagaauu

SEQ ID NO: 317316 - RNA, 21 nt, Human
uacgucaaguuuuacagacau

SEQ ID NO: 317317 - RNA, 21 nt, Human
uagaaagccagcagcaaauca

SEQ ID NO: 317318 - RNA, 18 nt, Human
uagaugguuccgcugccu

SEQ ID NO: 317319 - RNA, 23 nt, Human
uagggucucagaagcacaauggu

SEQ ID NO: 317320 - RNA, 22 nt, Human
uaucaaaagaaagguuucaaca

SEQ ID NO: 317321 - RNA, 20 nt, Human
uccacuggaaauugccccaa

SEQ ID NO: 317322 - RNA, 23 nt, Human
uccaggaagggggcuagggucuc

SEQ ID NO: 317323 - RNA, 22 nt, Human
ucccagggcccucaagccucca

SEQ ID NO: 317324 - RNA, 18 nt, Human
ucugggcaaaaaagacuc

SEQ ID NO: 317325 - RNA, 18 nt, Human
ugagagucccugggaagu

SEQ ID NO: 317326 - RNA, 18 nt, Human
ugauuuguaaacuuaaau

SEQ ID NO: 317327 - RNA, 21 nt, Human
ugccccaagccccuugcucac

SEQ ID NO: 317328 - RNA, 24 nt, Human
ugccccaagccccuugcucacugc

SEQ ID NO: 317329 - RNA, 19 nt, Human
uggaaaaagaaaaguccac

SEQ ID NO: 317330 - RNA, 25 nt, Human
uggcaaacaaaacaauagaugguuc

SEQ ID NO: 317331 - RNA, 20 nt, Human
ugggccgggcgggguugggg

SEQ ID NO: 317332 - RNA, 19 nt, Human
ugggguguaagucuuaaaa

SEQ ID NO: 317333 - RNA, 20 nt, Human
uggguuucucggcauuuugc

SEQ ID NO: 317334 - RNA, 21 nt, Human
uguacaucauaggucuauaua

SEQ ID NO: 317335 - RNA, 22 nt, Human
uguggaugcccuccacuggaaa

SEQ ID NO: 317336 - RNA, 24 nt, Human
uguggaugcccuccacuggaaauu

SEQ ID NO: 317337 - RNA, 18 nt, Human
uuuguguucaaguaagag

SEQ ID NO: 317338 - RNA, 20 nt, Human
acugacaggacgagggccca

SEQ ID NO: 317339 - RNA, 21 nt, Human
agaaaaaagggaaaaacaaaa

SEQ ID NO: 317340 - RNA, 19 nt, Human
agccagccgugcccggccc

SEQ ID NO: 317341 - RNA, 24 nt, Human
agguugaaguuguuuugaguugcu

SEQ ID NO: 317342 - RNA, 19 nt, Human
caccugagccacggcagga

SEQ ID NO: 317343 - RNA, 20 nt, Human
cagcgccggccuccgacgcc

SEQ ID NO: 317344 - RNA, 24 nt, Human
caggacgagggcccaccggccgcu

SEQ ID NO: 317345 - RNA, 18 nt, Human
cccgccggacgugcgccu

SEQ ID NO: 317346 - RNA, 22 nt, Human
ccgcggccgccgccuucuccuc

SEQ ID NO: 317347 - RNA, 18 nt, Human
cgaccgggacagccgcgg

SEQ ID NO: 317348 - RNA, 23 nt, Human
cgccuucuccucgggcagccuua

SEQ ID NO: 317349 - RNA, 22 nt, Human
cggggaacaccgcuucggcacc

SEQ ID NO: 317350 - RNA, 22 nt, Human
gagaaaaaagggaaaaacaaaa

SEQ ID NO: 317351 - RNA, 26 nt, Human
gagaaaaaagggaaaaacaaaacaga

SEQ ID NO: 317352 - RNA, 22 nt, Human
gccagccgugcccggccccggc

SEQ ID NO: 317353 - RNA, 21 nt, Human
gcccggccccggcuccucagc

SEQ ID NO: 317354 - RNA, 22 nt, Human
ggggaacaccgcuucggcaccg

SEQ ID NO: 317355 - RNA, 21 nt, Human
uagcacaagacuucacaaaug

SEQ ID NO: 317356 - RNA, 23 nt, Human
uccccucggccuccuccaggcuc

SEQ ID NO: 317357 - RNA, 22 nt, Human
uccgagcaccagaagggcgcgg

SEQ ID NO: 317358 - RNA, 23 nt, Human
uccuccaggcuccaggagcccgc

SEQ ID NO: 317359 - RNA, 24 nt, Human
uccucgggcagccuuagcugcccg

SEQ ID NO: 317360 - RNA, 22 nt, Human
ucucuugggaggcgccagcggc

SEQ ID NO: 317361 - RNA, 21 nt, Human
ugaauuauaaaugcaccucca

SEQ ID NO: 317362 - RNA, 19 nt, Human
ugcgccuacgccgcggccg

SEQ ID NO: 317363 - RNA, 24 nt, Human
ugcuaaggguggcgaccgggacag

SEQ ID NO: 317364 - RNA, 21 nt, Human
uguguugacaacaaucagauu

SEQ ID NO: 317365 - RNA, 19 nt, Human
uucuccucgggcagccuua

SEQ ID NO: 317366 - RNA, 18 nt, Human
uuuacagaauaaaugcag

SEQ ID NO: 317367 - RNA, 22 nt, Human
uuuuuuuuuuuuugagguuucc

SEQ ID NO: 317368 - RNA, 18 nt, Human
uuuuuuuuuuuuuuuuug

SEQ ID NO: 317369 - RNA, 21 nt, Human
uuuuuuuuuuuuuuuuugagg

SEQ ID NO: 317370 - RNA, 18 nt, Human
aaaaagccaaccccuucc

SEQ ID NO: 317371 - RNA, 18 nt, Human
aaaggaaaauagcuggcc

SEQ ID NO: 317372 - RNA, 22 nt, Human
aaaggaaaauagcuggccuaac

SEQ ID NO: 317373 - RNA, 19 nt, Human
aagaaaggagggggagagg

SEQ ID NO: 317374 - RNA, 22 nt, Human
aagaaaggagggggagaggggg

SEQ ID NO: 317375 - RNA, 24 nt, Human
aagaagaaaggagggggagagggg

SEQ ID NO: 317376 - RNA, 22 nt, Human
aaguauauuaaauuaaagccaa

SEQ ID NO: 317377 - RNA, 18 nt, Human
aaucaagaaaaaaaaacc

SEQ ID NO: 317378 - RNA, 22 nt, Human
aaucaagaaaaaaaaaccagua

SEQ ID NO: 317379 - RNA, 18 nt, Human
acuacauauauagaaagc

SEQ ID NO: 317380 - RNA, 22 nt, Human
acuuuaaagugcuacacugagu

SEQ ID NO: 317381 - RNA, 18 nt, Human
agaaaggagggggagagg

SEQ ID NO: 317382 - RNA, 20 nt, Human
agaaaggagggggagagggg

SEQ ID NO: 317383 - RNA, 20 nt, Human
agaagaaaggagggggagag

SEQ ID NO: 317384 - RNA, 19 nt, Human
agagggggcgaagacggcc

SEQ ID NO: 317385 - RNA, 18 nt, Human
agcagcggcgagaggcag

SEQ ID NO: 317386 - RNA, 19 nt, Human
agcuggccuaacacccggc

SEQ ID NO: 317387 - RNA, 24 nt, Human
aggaaaauagcuggccuaacaccc

SEQ ID NO: 317388 - RNA, 19 nt, Human
agggggaaauaaauuaagg

SEQ ID NO: 317389 - RNA, 25 nt, Human
auauaucuauauauaaauauuuaca

SEQ ID NO: 317390 - RNA, 19 nt, Human
augaagcagcuauaagccc

SEQ ID NO: 317391 - RNA, 20 nt, Human
augaagcagcuauaagcccu

SEQ ID NO: 317392 - RNA, 22 nt, Human
caagaaaaaaaaaccaguaugc

SEQ ID NO: 317393 - RNA, 20 nt, Human
cacagagagcauugcuggac

SEQ ID NO: 317394 - RNA, 19 nt, Human
cacuuaaaccacaaauaua

SEQ ID NO: 317395 - RNA, 23 nt, Human
cccgcgccggccgggcgauuggg

SEQ ID NO: 317396 - RNA, 18 nt, Human
ccgcggggcccgcgccgg

SEQ ID NO: 317397 - RNA, 19 nt, Human
ccucagacagcuucuggcc

SEQ ID NO: 317398 - RNA, 21 nt, Human
ccucagacagcuucuggccuu

SEQ ID NO: 317399 - RNA, 18 nt, Human
cgggggcugcagccucgc

SEQ ID NO: 317400 - RNA, 22 nt, Human
cuaacacccggcucaaauugua

SEQ ID NO: 317401 - RNA, 18 nt, Human
cucuuggcaguagcaaug

SEQ ID NO: 317402 - RNA, 21 nt, Human
cugcagccucgcgcucgcgcc

SEQ ID NO: 317403 - RNA, 23 nt, Human
gaaaauagcuggccuaacacccc

SEQ ID NO: 317404 - RNA, 21 nt, Human
gagaagaagaaaggaggggga

SEQ ID NO: 317405 - RNA, 24 nt, Human
gagaggcagagaagaagaaaggag

SEQ ID NO: 317406 - RNA, 19 nt, Human
gaggcaggagaggcagaga

SEQ ID NO: 317407 - RNA, 26 nt, Human
gagggggagagggggcgaagacggcc

SEQ ID NO: 317408 - RNA, 26 nt, Human
gccaaccccuucccuuucuccaccac

SEQ ID NO: 317409 - RNA, 19 nt, Human
gcggcggcccagcugcggc

SEQ ID NO: 317410 - RNA, 22 nt, Human
gcuacacugaguuauugagaga

SEQ ID NO: 317411 - RNA, 19 nt, Human
ggcggggagggggcgcgcg

SEQ ID NO: 317412 - RNA, 20 nt, Human
ggcggggagggggcgcgcgu

SEQ ID NO: 317413 - RNA, 25 nt, Human
gggcaaaucaagaaaaaaaaaccag

SEQ ID NO: 317414 - RNA, 23 nt, Human
gggcaggguagggggaaauaaau

SEQ ID NO: 317415 - RNA, 25 nt, Human
uaaagccaaccuacuacauauauag

SEQ ID NO: 317416 - RNA, 20 nt, Human
uaaauauuuacauauguaua

SEQ ID NO: 317417 - RNA, 23 nt, Human
uaacaaaugcuuugucaaucucu

SEQ ID NO: 317418 - RNA, 19 nt, Human
uacaaucaaucaugauugc

SEQ ID NO: 317419 - RNA, 19 nt, Human
uacuacauauauagaaagc

SEQ ID NO: 317420 - RNA, 19 nt, Human
uacuauaugaacacaagaa

SEQ ID NO: 317421 - RNA, 25 nt, Human
uagauacauacaugcauauuaaaua

SEQ ID NO: 317422 - RNA, 19 nt, Human
uauauaaauauuuacauau

SEQ ID NO: 317423 - RNA, 24 nt, Human
uauauaaauauuuacauauguaua

SEQ ID NO: 317424 - RNA, 25 nt, Human
uaugggcaaaucaagaaaaaaaaac

SEQ ID NO: 317425 - RNA, 23 nt, Human
ucaaaggagaaagcacaggaaaa

SEQ ID NO: 317426 - RNA, 18 nt, Human
ucagagccggagagcgcg

SEQ ID NO: 317427 - RNA, 24 nt, Human
ucagagccggagagcgcgggagga

SEQ ID NO: 317428 - RNA, 18 nt, Human
ucaguaagugauacauac

SEQ ID NO: 317429 - RNA, 22 nt, Human
ucgggggcugcagccucgcgcu

SEQ ID NO: 317430 - RNA, 24 nt, Human
ucuccucaagcagagguguauuaa

SEQ ID NO: 317431 - RNA, 22 nt, Human
ugagcagaucuucagagaugga

SEQ ID NO: 317432 - RNA, 18 nt, Human
ugccucagacagcuucug

SEQ ID NO: 317433 - RNA, 20 nt, Human
ugccucagacagcuucuggc

SEQ ID NO: 317434 - RNA, 28 nt, Human
ugcucuaucccucgugguaaagaaauuu

SEQ ID NO: 317435 - RNA, 20 nt, Human
uggcauaaauuuggauacaa

SEQ ID NO: 317436 - RNA, 20 nt, Human
uggcucgcaggaaacggcgg

SEQ ID NO: 317437 - RNA, 19 nt, Human
ugggggaggggaggcggcg

SEQ ID NO: 317438 - RNA, 25 nt, Human
uggguguuuagauacauacaugcag

SEQ ID NO: 317439 - RNA, 18 nt, Human
uuaaagccaaccuacuac

SEQ ID NO: 317440 - RNA, 25 nt, Human
uucagagccggagagcgcgggagga

SEQ ID NO: 317441 - RNA, 21 nt, Human
uucucacacuuaaaccacaaa

SEQ ID NO: 317442 - RNA, 18 nt, Human
uuggauacaauuuugcuc

SEQ ID NO: 317443 - RNA, 21 nt, Human
uuguuauaaaagaugaagaaa

SEQ ID NO: 317444 - RNA, 23 nt, Human
uuguuuuguuucugaaucaagua

SEQ ID NO: 317445 - RNA, 24 nt, Human
aaacaaacagaaaaaagaaggaaa

SEQ ID NO: 317446 - RNA, 19 nt, Human
aaagaaggaaaaaaagaaa

SEQ ID NO: 317447 - RNA, 18 nt, Human
aagaaggaaaaaaagaaa

SEQ ID NO: 317448 - RNA, 21 nt, Human
aagcacccucuugggggacag

SEQ ID NO: 317449 - RNA, 18 nt, Human
aaguggggagagaggagg

SEQ ID NO: 317450 - RNA, 20 nt, Human
agaaaaaagaaggaaaaaaa

SEQ ID NO: 317451 - RNA, 22 nt, Human
agagaggaggaggaacauggag

SEQ ID NO: 317452 - RNA, 23 nt, Human
agagaggaggaggaacauggagc

SEQ ID NO: 317453 - RNA, 18 nt, Human
agcacccucuugggggac

SEQ ID NO: 317454 - RNA, 19 nt, Human
agccaggacagcccccccc

SEQ ID NO: 317455 - RNA, 20 nt, Human
agccccccccacgcccagcc

SEQ ID NO: 317456 - RNA, 21 nt, Human
agggggcaggggccgggcggg

SEQ ID NO: 317457 - RNA, 20 nt, Human
auuuuuucauuuuuuuucuc

SEQ ID NO: 317458 - RNA, 25 nt, Human
cagcagagccaggacagcccccccc

SEQ ID NO: 317459 - RNA, 18 nt, Human
cccccacgcccagccucc

SEQ ID NO: 317460 - RNA, 20 nt, Human
cccccacgcccagccuccgu

SEQ ID NO: 317461 - RNA, 22 nt, Human
ccccccacgcccagccuccguc

SEQ ID NO: 317462 - RNA, 18 nt, Human
ccccccccacgcccagcc

SEQ ID NO: 317463 - RNA, 18 nt, Human
ccccccccacgcccagcc

SEQ ID NO: 317464 - RNA, 18 nt, Human
ccgccgcugcgacuccgg

SEQ ID NO: 317465 - RNA, 23 nt, Human
cuccgcaccgcacaggggucucc

SEQ ID NO: 317466 - RNA, 22 nt, Human
gaaggaaaaaaagaaaaaaaaa

SEQ ID NO: 317467 - RNA, 18 nt, Human
gaggaacauggagcuagg

SEQ ID NO: 317468 - RNA, 23 nt, Human
gccgccgcccccuccgcaccgca

SEQ ID NO: 317469 - RNA, 22 nt, Human
gggacagcagagccaggacagc

SEQ ID NO: 317470 - RNA, 18 nt, Human
gggggcaggggccgggcg

SEQ ID NO: 317471 - RNA, 19 nt, Human
ggguuggagggggcagggg

SEQ ID NO: 317472 - RNA, 21 nt, Human
uaucuaaaaacaaacagaaaa

SEQ ID NO: 317473 - RNA, 24 nt, Human
uaucuaaaaacaaacagaaaaaag

SEQ ID NO: 317474 - RNA, 24 nt, Human
ucuccaggccucuccagagaaguc

SEQ ID NO: 317475 - RNA, 21 nt, Human
ucuccgccgcugcgacuccgg

SEQ ID NO: 317476 - RNA, 19 nt, Human
ucuugggggacagcagagc

SEQ ID NO: 317477 - RNA, 18 nt, Human
uggggagagaggaggagg

SEQ ID NO: 317478 - RNA, 19 nt, Human
uggugcgagggccagaagg

SEQ ID NO: 317479 - RNA, 20 nt, Human
uggugcgagggccagaaggg

SEQ ID NO: 317480 - RNA, 19 nt, Human
uuuuuuucauuuuucuucu

SEQ ID NO: 317481 - RNA, 24 nt, Human
uuuuuuuuuuuuuuuuucauuuuu

SEQ ID NO: 317482 - RNA, 24 nt, Human
aaaaaaucagacacagacacucag

SEQ ID NO: 317483 - RNA, 21 nt, Human
aagcaggaaagacaccgagau

SEQ ID NO: 317484 - RNA, 18 nt, Human
acucagcaaccauucugu

SEQ ID NO: 317485 - RNA, 21 nt, Human
agacacagacacucagcaacc

SEQ ID NO: 317486 - RNA, 27 nt, Human
agacacucagcaaccauucuguaaaug

SEQ ID NO: 317487 - RNA, 20 nt, Human
aggagauguaaaaaccccuc

SEQ ID NO: 317488 - RNA, 22 nt, Human
augcucugccaauucaaguuuc

SEQ ID NO: 317489 - RNA, 21 nt, Human
auggaagcaggaaagacaccg

SEQ ID NO: 317490 - RNA, 20 nt, Human
cagacacagacacucagcaa

SEQ ID NO: 317491 - RNA, 23 nt, Human
cagcaauaugcugcgcuuaagag

SEQ ID NO: 317492 - RNA, 20 nt, Human
cagcaugaaaaaaucagaca

SEQ ID NO: 317493 - RNA, 19 nt, Human
ccgcccggggagccggggc

SEQ ID NO: 317494 - RNA, 19 nt, Human
cgaaugcccacugaaccuc

SEQ ID NO: 317495 - RNA, 22 nt, Human
cguggcgaaugcccacugaacc

SEQ ID NO: 317496 - RNA, 19 nt, Human
cuccuccgcggccgcccgg

SEQ ID NO: 317497 - RNA, 21 nt, Human
cugaaggucucuuucacaucu

SEQ ID NO: 317498 - RNA, 21 nt, Human
cuuuuuuuuuuuuuuuacagg

SEQ ID NO: 317499 - RNA, 21 nt, Human
gaacuugugccacaacaguuu

SEQ ID NO: 317500 - RNA, 24 nt, Human
gaagaaguugcaccucagagcuga

SEQ ID NO: 317501 - RNA, 20 nt, Human
gacagcuggccacagagccc

SEQ ID NO: 317502 - RNA, 20 nt, Human
gaguuuucuuuuuuuuuuuu

SEQ ID NO: 317503 - RNA, 24 nt, Human
gcacacgucacaaacgauucacac

SEQ ID NO: 317504 - RNA, 21 nt, Human
gccacagagcccagcaagucc

SEQ ID NO: 317505 - RNA, 21 nt, Human
ggcccgggcccuccucgaguu

SEQ ID NO: 317506 - RNA, 18 nt, Human
gggcacacgucugccuuc

SEQ ID NO: 317507 - RNA, 23 nt, Human
gggcugggcuggacagcuggcca

SEQ ID NO: 317508 - RNA, 22 nt, Human
uaaagacugcagcacucccaag

SEQ ID NO: 317509 - RNA, 18 nt, Human
uaaauguguacagcaaua

SEQ ID NO: 317510 - RNA, 18 nt, Human
uagaaaacaaucaaaagu

SEQ ID NO: 317511 - RNA, 26 nt, Human
uaggagauguaaaaacccccugaaag

SEQ ID NO: 317512 - RNA, 22 nt, Human
ucaucccuuccauaaggaaaau

SEQ ID NO: 317513 - RNA, 21 nt, Human
uccucgaguuuucuuuuuuuu

SEQ ID NO: 317514 - RNA, 24 nt, Human
ucgauuguuaaauaaaaccaggag

SEQ ID NO: 317515 - RNA, 22 nt, Human
ugacaauuauaauccucugaga

SEQ ID NO: 317516 - RNA, 21 nt, Human
ugcaccugcaaugaaguccgc

SEQ ID NO: 317517 - RNA, 19 nt, Human
ugcccacugaaccucggcu

SEQ ID NO: 317518 - RNA, 25 nt, Human
ugggagagaagaguuagggcugguc

SEQ ID NO: 317519 - RNA, 25 nt, Human
uguaaaaaccccuccuuucccauuu

SEQ ID NO: 317520 - RNA, 22 nt, Human
uguaggcaacuugcaccugcaa

SEQ ID NO: 317521 - RNA, 23 nt, Human
uucuuuuuuuuuuuuuuuacagg

SEQ ID NO: 317522 - RNA, 19 nt, Human
uuuuuuuuuuuuacagguc

SEQ ID NO: 317523 - RNA, 24 nt, Human
aaauacaaacuuuacaaaguaaaa

SEQ ID NO: 317524 - RNA, 20 nt, Human
aagcgaccccuacccuggca

SEQ ID NO: 317525 - RNA, 23 nt, Human
acagaaugcccaggcugugcccc

SEQ ID NO: 317526 - RNA, 21 nt, Human
accuccuuccucucuguccag

SEQ ID NO: 317527 - RNA, 19 nt, Human
acuuuacaaaguaaaaggg

SEQ ID NO: 317528 - RNA, 24 nt, Human
agccacucggccccaccccacccc

SEQ ID NO: 317529 - RNA, 21 nt, Human
aggggaggcgcaggcggggcc

SEQ ID NO: 317530 - RNA, 24 nt, Human
caccuccuuccucucuguccaggg

SEQ ID NO: 317531 - RNA, 25 nt, Human
caccuccuuccucucuguccaggga

SEQ ID NO: 317532 - RNA, 23 nt, Human
cagaaugcccaggcugugccccc

SEQ ID NO: 317533 - RNA, 20 nt, Human
cagccccugacucugccccu

SEQ ID NO: 317534 - RNA, 18 nt, Human
caggcggggccccccugc

SEQ ID NO: 317535 - RNA, 18 nt, Human
cagggcagccacucggcc

SEQ ID NO: 317536 - RNA, 21 nt, Human
cagggcagccacucggcccca

SEQ ID NO: 317537 - RNA, 22 nt, Human
ccaccuccuuccucucugucca

SEQ ID NO: 317538 - RNA, 18 nt, Human
cccaccccaccccgagga

SEQ ID NO: 317539 - RNA, 20 nt, Human
cccagccccagcugcuccac

SEQ ID NO: 317540 - RNA, 22 nt, Human
cccagccuagccccaccauggg

SEQ ID NO: 317541 - RNA, 18 nt, Human
cccaggcugugcccccag

SEQ ID NO: 317542 - RNA, 18 nt, Human
ccccaccccaccccgagg

SEQ ID NO: 317543 - RNA, 22 nt, Human
ccccaccccaccccgaggacgg

SEQ ID NO: 317544 - RNA, 25 nt, Human
ccccaccccgaggacggccuccccc

SEQ ID NO: 317545 - RNA, 26 nt, Human
ccccagccuagccccaccauggggcu

SEQ ID NO: 317546 - RNA, 19 nt, Human
cccccagccccagcugcuc

SEQ ID NO: 317547 - RNA, 18 nt, Human
ccuccuuccucucugucc

SEQ ID NO: 317548 - RNA, 23 nt, Human
ccucugcaaaccuaaaggggaau

SEQ ID NO: 317549 - RNA, 21 nt, Human
ccucuggccagccccugacuc

SEQ ID NO: 317550 - RNA, 23 nt, Human
ccugacucugccccuacccccuc

SEQ ID NO: 317551 - RNA, 21 nt, Human
ccugcugacccucucucuggg

SEQ ID NO: 317552 - RNA, 18 nt, Human
cgcaggcggggccccccu

SEQ ID NO: 317553 - RNA, 25 nt, Human
cgccagcggcacccggccgaacccu

SEQ ID NO: 317554 - RNA, 20 nt, Human
cggggccugcucugccccua

SEQ ID NO: 317555 - RNA, 18 nt, Human
cuacccccucugcaaacc

SEQ ID NO: 317556 - RNA, 23 nt, Human
cucuggccagccccugacucugc

SEQ ID NO: 317557 - RNA, 20 nt, Human
gcaaagcgaccccuacccug

SEQ ID NO: 317558 - RNA, 23 nt, Human
gcccccagccccagcugcuccac

SEQ ID NO: 317559 - RNA, 20 nt, Human
gcugcuccaccuccuuccuc

SEQ ID NO: 317560 - RNA, 18 nt, Human
ggcggggcccuauugcuu

SEQ ID NO: 317561 - RNA, 21 nt, Human
uaaaauagcuggggagggggg

SEQ ID NO: 317562 - RNA, 23 nt, Human
uacccccucugcaaaccuaaagg

SEQ ID NO: 317563 - RNA, 21 nt, Human
uauggcggggcccuauugcuu

SEQ ID NO: 317564 - RNA, 19 nt, Human
uccccacagaaugcccagg

SEQ ID NO: 317565 - RNA, 24 nt, Human
uccuauggcggggcccuauugcuu

SEQ ID NO: 317566 - RNA, 24 nt, Human
ucuggccagccccugacucugccc

SEQ ID NO: 317567 - RNA, 23 nt, Human
ugacccucucucugggggucuuc

SEQ ID NO: 317568 - RNA, 20 nt, Human
ugacucugccccuacccccu

SEQ ID NO: 317569 - RNA, 20 nt, Human
ugaggggggcagggcagcca

SEQ ID NO: 317570 - RNA, 21 nt, Human
ugcccccagccccagcugcuc

SEQ ID NO: 317571 - RNA, 23 nt, Human
ugcuccaccuccuuccucucugu

SEQ ID NO: 317572 - RNA, 19 nt, Human
uggggaggggggugagccc

SEQ ID NO: 317573 - RNA, 24 nt, Human
uggggaggggggugagccccagcc

SEQ ID NO: 317574 - RNA, 21 nt, Human
uggggcggggccugcucugcc

SEQ ID NO: 317575 - RNA, 19 nt, Human
uuggaggggcccugggaug

SEQ ID NO: 317576 - RNA, 18 nt, Human
uuuacaaaguaaaagggg

SEQ ID NO: 317577 - RNA, 21 nt, Human
aaaaaaggaaacacauccugu

SEQ ID NO: 317578 - RNA, 18 nt, Human
aagcaagagcuacaugca

SEQ ID NO: 317579 - RNA, 20 nt, Human
aagcaagagcuacaugcagc

SEQ ID NO: 317580 - RNA, 20 nt, Human
acagcggcggcggcggcugu

SEQ ID NO: 317581 - RNA, 20 nt, Human
acuaaaacaaaaggcugaau

SEQ ID NO: 317582 - RNA, 22 nt, Human
aggcagcauuucagcagcaaag

SEQ ID NO: 317583 - RNA, 23 nt, Human
augggucagcaggaugggcgaag

SEQ ID NO: 317584 - RNA, 21 nt, Human
auuuaaaaaaaaaaaaggcaa

SEQ ID NO: 317585 - RNA, 23 nt, Human
caaagugcucaauaaaaaguaua

SEQ ID NO: 317586 - RNA, 19 nt, Human
caagccgcggcaacagcgg

SEQ ID NO: 317587 - RNA, 18 nt, Human
cauuuggaguccaucgug

SEQ ID NO: 317588 - RNA, 29 nt, Human
cgcggcaacagcggcggcggcggcuuuuu

SEQ ID NO: 317589 - RNA, 25 nt, Human
cggcaacagcggcggcggcggcugu

SEQ ID NO: 317590 - RNA, 24 nt, Human
cuaaaacaaaaggcugaaugauac

SEQ ID NO: 317591 - RNA, 20 nt, Human
gcaagagcuacaugcagcag

SEQ ID NO: 317592 - RNA, 21 nt, Human
gcggcggcggcggcuguagca

SEQ ID NO: 317593 - RNA, 20 nt, Human
ggacagguauacauaacuuu

SEQ ID NO: 317594 - RNA, 21 nt, Human
guagcagcggcggcggcagcg

SEQ ID NO: 317595 - RNA, 19 nt, Human
uaagaauaacaagccgcgg

SEQ ID NO: 317596 - RNA, 21 nt, Human
uaccaaacuaaaacaaaaggc

SEQ ID NO: 317597 - RNA, 24 nt, Human
uagaaaaacuuugcuauagacacc

SEQ ID NO: 317598 - RNA, 20 nt, Human
ugggaugggggaaaauugau

SEQ ID NO: 317599 - RNA, 26 nt, Human
uuaccaaacuaaaacaaaaggcugaa

SEQ ID NO: 317600 - RNA, 19 nt, Human
uugaggcauuuggagucca

SEQ ID NO: 317601 - RNA, 18 nt, Human
uuuuuuuuuuuuuuuuug

SEQ ID NO: 317602 - RNA, 25 nt, Human
uuuuuuuuuuuuuuuuuuguccuuu

SEQ ID NO: 317603 - RNA, 27 nt, Human
uuuuuuuuuuuuuuuuuuguccuuuag

SEQ ID NO: 317604 - RNA, 21 nt, Human
aaaagcguuaaguuuucacag

SEQ ID NO: 317605 - RNA, 20 nt, Human
aaaauuauuuucacaucccc

SEQ ID NO: 317606 - RNA, 19 nt, Human
aacagaagauggcaaaggg

SEQ ID NO: 317607 - RNA, 22 nt, Human
aacagaguaaguugacucuagc

SEQ ID NO: 317608 - RNA, 22 nt, Human
aaccauaauggcuaaacuuagc

SEQ ID NO: 317609 - RNA, 22 nt, Human
aagcuuuuugagcaaacaaucc

SEQ ID NO: 317610 - RNA, 21 nt, Human
aaggcagccuuaagaaaugau

SEQ ID NO: 317611 - RNA, 19 nt, Human
aaguugacucuagcaucaa

SEQ ID NO: 317612 - RNA, 22 nt, Human
aaucaccagcaaaacaaagcau

SEQ ID NO: 317613 - RNA, 23 nt, Human
aauccucaucuuuuaguugaaga

SEQ ID NO: 317614 - RNA, 23 nt, Human
agaaagggcagguuggucgagaa

SEQ ID NO: 317615 - RNA, 21 nt, Human
agcuuuuugagcaaacaaucc

SEQ ID NO: 317616 - RNA, 22 nt, Human
aggggcucccugagcucuauug

SEQ ID NO: 317617 - RNA, 23 nt, Human
aguguguaguauuuuccaagcuu

SEQ ID NO: 317618 - RNA, 19 nt, Human
auauuaagaaagggcaggu

SEQ ID NO: 317619 - RNA, 21 nt, Human
ccaacuucuugcucuuaaucc

SEQ ID NO: 317620 - RNA, 21 nt, Human
cuaaacuuagcagcaccaaca

SEQ ID NO: 317621 - RNA, 21 nt, Human
cucacuuuucacuuucgcgcc

SEQ ID NO: 317622 - RNA, 23 nt, Human
cucaucauuucuccaaacugaca

SEQ ID NO: 317623 - RNA, 20 nt, Human
cucauggaacacaucagaaa

SEQ ID NO: 317624 - RNA, 18 nt, Human
cugguaaauguguuuugg

SEQ ID NO: 317625 - RNA, 21 nt, Human
cuucuugcucuuaauccucau

SEQ ID NO: 317626 - RNA, 19 nt, Human
gaauaaggcuuaagagaga

SEQ ID NO: 317627 - RNA, 21 nt, Human
gaauggaauaggaagaacuag

SEQ ID NO: 317628 - RNA, 21 nt, Human
gagacaaagugggugcugcag

SEQ ID NO: 317629 - RNA, 22 nt, Human
gagacaaagugggugcugcaga

SEQ ID NO: 317630 - RNA, 21 nt, Human
gaucugagcucaggcuugggc

SEQ ID NO: 317631 - RNA, 20 nt, Human
gcagguuggucgagaaugga

SEQ ID NO: 317632 - RNA, 18 nt, Human
gccugggcacaguucugg

SEQ ID NO: 317633 - RNA, 23 nt, Human
gcugccucacuuuucacuuucgc

SEQ ID NO: 317634 - RNA, 18 nt, Human
ggagacaaagugggugcu

SEQ ID NO: 317635 - RNA, 19 nt, Human
ggccugggcaccucuuugc

SEQ ID NO: 317636 - RNA, 19 nt, Human
ggcguagcucaucauuucu

SEQ ID NO: 317637 - RNA, 22 nt, Human
gguaacagaagauggcaaagga

SEQ ID NO: 317638 - RNA, 21 nt, Human
guggguugaucuccagaagga

SEQ ID NO: 317639 - RNA, 24 nt, Human
uaaaacaaucuccaugguaauuaa

SEQ ID NO: 317640 - RNA, 18 nt, Human
uaagaaaugaugcagaaa

SEQ ID NO: 317641 - RNA, 19 nt, Human
uaagaugauagcacagagg

SEQ ID NO: 317642 - RNA, 26 nt, Human
uagccaagcaagauuuuuccaagcac

SEQ ID NO: 317643 - RNA, 21 nt, Human
uaggaagaacuagcugccuca

SEQ ID NO: 317644 - RNA, 20 nt, Human
uaguguaggaaaugguagau

SEQ ID NO: 317645 - RNA, 20 nt, Human
uauggcaagacuuggaaaaa

SEQ ID NO: 317646 - RNA, 23 nt, Human
uaugguuccuccuauucucugcu

SEQ ID NO: 317647 - RNA, 19 nt, Human
uauuaagaaagggcagguu

SEQ ID NO: 317648 - RNA, 20 nt, Human
uauuaagaaagggcagguug

SEQ ID NO: 317649 - RNA, 23 nt, Human
uccaaacugacaugcuacagaaa

SEQ ID NO: 317650 - RNA, 24 nt, Human
uccaaacugacaugcuacagaaau

SEQ ID NO: 317651 - RNA, 21 nt, Human
ucccuaaguuauacaagaugu

SEQ ID NO: 317652 - RNA, 18 nt, Human
uccuuugggccugggcac

SEQ ID NO: 317653 - RNA, 22 nt, Human
ucucugcuaaagccagcaacag

SEQ ID NO: 317654 - RNA, 19 nt, Human
ucucuuaagcaacuuaauu

SEQ ID NO: 317655 - RNA, 20 nt, Human
ugaaggaaacugucucccau

SEQ ID NO: 317656 - RNA, 28 nt, Human
ugacaugcuacagaaaugucuuccaaaa

SEQ ID NO: 317657 - RNA, 20 nt, Human
ugagagaggaaggcagccuu

SEQ ID NO: 317658 - RNA, 18 nt, Human
ugcucaaauaguguagga

SEQ ID NO: 317659 - RNA, 18 nt, Human
uggcaaaggauaagauuc

SEQ ID NO: 317660 - RNA, 18 nt, Human
uggcuaaacuuagcagca

SEQ ID NO: 317661 - RNA, 25 nt, Human
uggcuaaacuuagcagcaccaacac

SEQ ID NO: 317662 - RNA, 22 nt, Human
ugggugcuacuucccuccuuuu

SEQ ID NO: 317663 - RNA, 21 nt, Human
uguacauuuccucucuuaagc

SEQ ID NO: 317664 - RNA, 21 nt, Human
ugucacaugaccgcgggcgcg

SEQ ID NO: 317665 - RNA, 20 nt, Human
uucacaucccccccaacuuu

SEQ ID NO: 317666 - RNA, 22 nt, Human
uuuacuguaacaggaauucuca

SEQ ID NO: 317667 - RNA, 24 nt, Human
uuuuccaagcuuuuugagcaaaca

SEQ ID NO: 317668 - RNA, 23 nt, Human
aaaaaaacugaaaauaaagagag

SEQ ID NO: 317669 - RNA, 21 nt, Human
aaaaagggaacauggggagga

SEQ ID NO: 317670 - RNA, 23 nt, Human
aaaagcagccacaaguuaaaaac

SEQ ID NO: 317671 - RNA, 19 nt, Human
aaacaggcggagcgaucca

SEQ ID NO: 317672 - RNA, 23 nt, Human
aaccccgucucuacuaaaaaugg

SEQ ID NO: 317673 - RNA, 23 nt, Human
aagaacacaggccucccccuuuc

SEQ ID NO: 317674 - RNA, 23 nt, Human
aagaaggccucuccaggcuucgu

SEQ ID NO: 317675 - RNA, 24 nt, Human
aaggagaccccuguggugggcagg

SEQ ID NO: 317676 - RNA, 21 nt, Human
acauucauccacguccacaug

SEQ ID NO: 317677 - RNA, 20 nt, Human
accgaggaguuccuggggac

SEQ ID NO: 317678 - RNA, 23 nt, Human
accucccgccucaccucccgcca

SEQ ID NO: 317679 - RNA, 19 nt, Human
acuuacaguuauguuuugc

SEQ ID NO: 317680 - RNA, 19 nt, Human
agaaaaaagggaacauggg

SEQ ID NO: 317681 - RNA, 22 nt, Human
agacccaggacaggaggggcaa

SEQ ID NO: 317682 - RNA, 21 nt, Human
agacucaggggcaggccaaga

SEQ ID NO: 317683 - RNA, 19 nt, Human
agagagagagagaucuggg

SEQ ID NO: 317684 - RNA, 23 nt, Human
agagcucaccccgggcccuaccc

SEQ ID NO: 317685 - RNA, 24 nt, Human
agaggaaggggguucugggaggcc

SEQ ID NO: 317686 - RNA, 24 nt, Human
agcaaaaaaacugaaaauaaagag

SEQ ID NO: 317687 - RNA, 26 nt, Human
agcagcaaaagcagccacaaguuaaa

SEQ ID NO: 317688 - RNA, 22 nt, Human
agcagcagcagcaaaagcagcc

SEQ ID NO: 317689 - RNA, 18 nt, Human
aggaggggcaauggaaua

SEQ ID NO: 317690 - RNA, 18 nt, Human
aggccaccacuuggucuc

SEQ ID NO: 317691 - RNA, 24 nt, Human
aggccaggcccuggggagccagga

SEQ ID NO: 317692 - RNA, 22 nt, Human
aggccucgcuccacccgcuguu

SEQ ID NO: 317693 - RNA, 18 nt, Human
aguaggccaggcccuggg

SEQ ID NO: 317694 - RNA, 20 nt, Human
agucuggaacccacgguggc

SEQ ID NO: 317695 - RNA, 21 nt, Human
aguggccuggaaggagacccc

SEQ ID NO: 317696 - RNA, 22 nt, Human
aguuauguuuugccuccuguga

SEQ ID NO: 317697 - RNA, 24 nt, Human
auaacaccuauucaaagguaguua

SEQ ID NO: 317698 - RNA, 22 nt, Human
augcaggugcgcccguccacgc

SEQ ID NO: 317699 - RNA, 21 nt, Human
auggaauauuccauugcgccc

SEQ ID NO: 317700 - RNA, 25 nt, Human
caaagccugacaucugcuuuccaag

SEQ ID NO: 317701 - RNA, 21 nt, Human
caagaggcuacugaggccccc

SEQ ID NO: 317702 - RNA, 23 nt, Human
caaguuaaaaacaugguuucuca

SEQ ID NO: 317703 - RNA, 21 nt, Human
cacagcucagccaccuguucu

SEQ ID NO: 317704 - RNA, 23 nt, Human
cacaggugagcgcccccgggugg

SEQ ID NO: 317705 - RNA, 20 nt, Human
cacccgaagucccgccucca

SEQ ID NO: 317706 - RNA, 22 nt, Human
caccuguucuggcugcagcucu

SEQ ID NO: 317707 - RNA, 18 nt, Human
cacugcuccagccgcucc

SEQ ID NO: 317708 - RNA, 18 nt, Human
cagagggugaugcugguc

SEQ ID NO: 317709 - RNA, 21 nt, Human
cagaugacagccucucacccc

SEQ ID NO: 317710 - RNA, 18 nt, Human
cagcaaaaaaacugaaaa

SEQ ID NO: 317711 - RNA, 18 nt, Human
cagcacggagcaaucccc

SEQ ID NO: 317712 - RNA, 19 nt, Human
cagcagcaaaagcagccac

SEQ ID NO: 317713 - RNA, 20 nt, Human
cagcagcaaaagcagccaca

SEQ ID NO: 317714 - RNA, 21 nt, Human
cagcagcaaaagcagccacaa

SEQ ID NO: 317715 - RNA, 21 nt, Human
cagcagcagcaaaagcagcca

SEQ ID NO: 317716 - RNA, 24 nt, Human
cagcagcagcaaaagcagccacaa

SEQ ID NO: 317717 - RNA, 21 nt, Human
cagccaccuguucuggcugca

SEQ ID NO: 317718 - RNA, 19 nt, Human
caggaggggcaauggaaua

SEQ ID NO: 317719 - RNA, 21 nt, Human
caggcccuggggagccaggag

SEQ ID NO: 317720 - RNA, 25 nt, Human
caggggacuuuagagaaaaaaggga

SEQ ID NO: 317721 - RNA, 19 nt, Human
cagugcuucccuccccagc

SEQ ID NO: 317722 - RNA, 23 nt, Human
ccacaaguuaaaaacaugguuuc

SEQ ID NO: 317723 - RNA, 19 nt, Human
ccacagauauuccccaaca

SEQ ID NO: 317724 - RNA, 18 nt, Human
ccacugcuccagccgcuc

SEQ ID NO: 317725 - RNA, 23 nt, Human
ccaggaucuuccuaaugcaucgc

SEQ ID NO: 317726 - RNA, 20 nt, Human
cccccagcagaaggcuccug

SEQ ID NO: 317727 - RNA, 18 nt, Human
cccccagccagaagacuc

SEQ ID NO: 317728 - RNA, 19 nt, Human
cccccagcgacccgaaagu

SEQ ID NO: 317729 - RNA, 21 nt, Human
cccccagcgacccgaaagucc

SEQ ID NO: 317730 - RNA, 19 nt, Human
ccccccgcucucccuccag

SEQ ID NO: 317731 - RNA, 23 nt, Human
cccccgcucucccuccagaugac

SEQ ID NO: 317732 - RNA, 21 nt, Human
ccccgggcccuacccccucug

SEQ ID NO: 317733 - RNA, 22 nt, Human
ccccgucucuacuaaaaauggg

SEQ ID NO: 317734 - RNA, 22 nt, Human
cccgaagucccgccuccaacuc

SEQ ID NO: 317735 - RNA, 21 nt, Human
cccgcaacacagacccaggac

SEQ ID NO: 317736 - RNA, 23 nt, Human
cccgcaacacagacccaggacag

SEQ ID NO: 317737 - RNA, 20 nt, Human
cccggccccacagcucagcc

SEQ ID NO: 317738 - RNA, 19 nt, Human
cccucuguugucaccucuc

SEQ ID NO: 317739 - RNA, 18 nt, Human
cccucuuaggaguuggga

SEQ ID NO: 317740 - RNA, 22 nt, Human
cccuggggagccaggaguccca

SEQ ID NO: 317741 - RNA, 23 nt, Human
cccuugaagagugcagacuccca

SEQ ID NO: 317742 - RNA, 20 nt, Human
ccgccucccgaacggccacg

SEQ ID NO: 317743 - RNA, 19 nt, Human
ccgcgcgagcguuccccgc

SEQ ID NO: 317744 - RNA, 22 nt, Human
ccgggcccuacccccucuguug

SEQ ID NO: 317745 - RNA, 25 nt, Human
ccucaagaggcuacugaggcccccc

SEQ ID NO: 317746 - RNA, 18 nt, Human
ccucccgccucaccuccc

SEQ ID NO: 317747 - RNA, 21 nt, Human
ccucuccaggcuucguugccc

SEQ ID NO: 317748 - RNA, 19 nt, Human
ccugaccggcccacugcuc

SEQ ID NO: 317749 - RNA, 19 nt, Human
ccuggcccaguuucuccug

SEQ ID NO: 317750 - RNA, 18 nt, Human
ccugugaagccccacccc

SEQ ID NO: 317751 - RNA, 22 nt, Human
ccugugaagccccacccccagc

SEQ ID NO: 317752 - RNA, 22 nt, Human
cgacccgaaaguccgauuuccc

SEQ ID NO: 317753 - RNA, 26 nt, Human
cgagcguuccccgcaacacagaccca

SEQ ID NO: 317754 - RNA, 21 nt, Human
cgcaacacagacccaggacag

SEQ ID NO: 317755 - RNA, 21 nt, Human
cgcacccgaagucccgccucc

SEQ ID NO: 317756 - RNA, 21 nt, Human
cgcagacgccuccguucaggc

SEQ ID NO: 317757 - RNA, 24 nt, Human
cgccacauaacgcgguacaugguc

SEQ ID NO: 317758 - RNA, 23 nt, Human
cgccgaggcccaggcuguugucc

SEQ ID NO: 317759 - RNA, 20 nt, Human
cgccucaccucccgccacau

SEQ ID NO: 317760 - RNA, 23 nt, Human
cggaugggagggggaagggcggg

SEQ ID NO: 317761 - RNA, 21 nt, Human
cgggaccaccagugucugcuu

SEQ ID NO: 317762 - RNA, 18 nt, Human
cgugagcagcagcccagg

SEQ ID NO: 317763 - RNA, 19 nt, Human
cgugagcagcagcccaggc

SEQ ID NO: 317764 - RNA, 20 nt, Human
cuacccccucuguugucacc

SEQ ID NO: 317765 - RNA, 19 nt, Human
cucccgccaacgcgcaccc

SEQ ID NO: 317766 - RNA, 21 nt, Human
cucccugacugcguccaugcc

SEQ ID NO: 317767 - RNA, 22 nt, Human
cuccugugaagccccaccccca

SEQ ID NO: 317768 - RNA, 21 nt, Human
cucucccuccagaugacagcc

SEQ ID NO: 317769 - RNA, 20 nt, Human
cugcagaugcgccucccagc

SEQ ID NO: 317770 - RNA, 21 nt, Human
cugcuuuccaaggccaccacu

SEQ ID NO: 317771 - RNA, 21 nt, Human
cuguggugggcaggggguggg

SEQ ID NO: 317772 - RNA, 20 nt, Human
cuucaagaacggaacugucc

SEQ ID NO: 317773 - RNA, 24 nt, Human
cuugaagagugcagacucccaccu

SEQ ID NO: 317774 - RNA, 21 nt, Human
gacccgaaaguccgauuuccc

SEQ ID NO: 317775 - RNA, 19 nt, Human
gacugggggauccccaaac

SEQ ID NO: 317776 - RNA, 20 nt, Human
gagcagcagcccaggccccu

SEQ ID NO: 317777 - RNA, 19 nt, Human
gaggccccccgcucucccu

SEQ ID NO: 317778 - RNA, 18 nt, Human
gaugggagggggaagggc

SEQ ID NO: 317779 - RNA, 24 nt, Human
gcaaaaaaacugaaaauaaagaga

SEQ ID NO: 317780 - RNA, 18 nt, Human
gcacaccaaagccugaca

SEQ ID NO: 317781 - RNA, 25 nt, Human
gcagcaaaagcagccacaaguuaaa

SEQ ID NO: 317782 - RNA, 18 nt, Human
gcagcagcaaaagcagcc

SEQ ID NO: 317783 - RNA, 20 nt, Human
gcagcagcaaaagcagccac

SEQ ID NO: 317784 - RNA, 26 nt, Human
gcagcagcagcaaaagcagccacaag

SEQ ID NO: 317785 - RNA, 25 nt, Human
gcaggggaaugacggaugggagggg

SEQ ID NO: 317786 - RNA, 20 nt, Human
gccacagauauuccccaaca

SEQ ID NO: 317787 - RNA, 18 nt, Human
gcccacugcuccagccgc

SEQ ID NO: 317788 - RNA, 22 nt, Human
gcgcacccgaagucccgccucc

SEQ ID NO: 317789 - RNA, 21 nt, Human
gcucagccaccuguucuggcu

SEQ ID NO: 317790 - RNA, 24 nt, Human
ggaauauuccauugcgcccuaggu

SEQ ID NO: 317791 - RNA, 18 nt, Human
ggacaggaggggcaaugg

SEQ ID NO: 317792 - RNA, 24 nt, Human
ggaccccuccaugcaggugcgccc

SEQ ID NO: 317793 - RNA, 18 nt, Human
ggagagaagcuaaaaaug

SEQ ID NO: 317794 - RNA, 18 nt, Human
ggaggagcagcagcagca

SEQ ID NO: 317795 - RNA, 20 nt, Human
ggaguugggagggcugaugu

SEQ ID NO: 317796 - RNA, 21 nt, Human
ggaugggagggggaagggcgg

SEQ ID NO: 317797 - RNA, 18 nt, Human
ggccaagaacacaggccu

SEQ ID NO: 317798 - RNA, 19 nt, Human
ggccucccccuuucuucag

SEQ ID NO: 317799 - RNA, 22 nt, Human
ggcgcacucgcacuggucaggc

SEQ ID NO: 317800 - RNA, 24 nt, Human
ggcuacugaggccccccgcucucc

SEQ ID NO: 317801 - RNA, 23 nt, Human
gggaacauggggaggagagaagc

SEQ ID NO: 317802 - RNA, 20 nt, Human
gggauccacccuuggccccc

SEQ ID NO: 317803 - RNA, 23 nt, Human
gggcaggggguggguucuccacc

SEQ ID NO: 317804 - RNA, 21 nt, Human
gggcaggggugcuguagaggc

SEQ ID NO: 317805 - RNA, 24 nt, Human
gggcaggggugcuguagaggcuuc

SEQ ID NO: 317806 - RNA, 19 nt, Human
gggggaagggugaggaaag

SEQ ID NO: 317807 - RNA, 20 nt, Human
gggguucugggaggccaagu

SEQ ID NO: 317808 - RNA, 21 nt, Human
ggucaugggggcagccgcagg

SEQ ID NO: 317809 - RNA, 24 nt, Human
ggucaugggggcagccgcagguga

SEQ ID NO: 317810 - RNA, 19 nt, Human
ggugaugcugguccuacau

SEQ ID NO: 317811 - RNA, 19 nt, Human
gucacaggcacaccaaagc

SEQ ID NO: 317812 - RNA, 24 nt, Human
guccugaguggccuggaaggagac

SEQ ID NO: 317813 - RNA, 21 nt, Human
guccuguaagugcugcagaug

SEQ ID NO: 317814 - RNA, 22 nt, Human
uaaaacaauggugcgagcagag

SEQ ID NO: 317815 - RNA, 19 nt, Human
uaaauacagggauaacacc

SEQ ID NO: 317816 - RNA, 24 nt, Human
uaacagcaaaaaaacugaaaauaa

SEQ ID NO: 317817 - RNA, 18 nt, Human
uacuaaaaccccgucucu

SEQ ID NO: 317818 - RNA, 21 nt, Human
uaucccaagucuggaacccac

SEQ ID NO: 317819 - RNA, 22 nt, Human
ucaucuuuuuccgccucccgaa

SEQ ID NO: 317820 - RNA, 22 nt, Human
uccaacacugaucauagggacu

SEQ ID NO: 317821 - RNA, 21 nt, Human
uccaaggccaccacuuggucu

SEQ ID NO: 317822 - RNA, 20 nt, Human
uccacaugacagugcuuccc

SEQ ID NO: 317823 - RNA, 24 nt, Human
uccaugccagaggaugagguggga

SEQ ID NO: 317824 - RNA, 19 nt, Human
ucccaagucuggaacccac

SEQ ID NO: 317825 - RNA, 18 nt, Human
ucccagaggauuaguggg

SEQ ID NO: 317826 - RNA, 23 nt, Human
uccccaaaccugagaugggccuc

SEQ ID NO: 317827 - RNA, 21 nt, Human
uccccgccuugauucucccca

SEQ ID NO: 317828 - RNA, 21 nt, Human
ucccgaacggccacgcugagu

SEQ ID NO: 317829 - RNA, 19 nt, Human
ucccgccucaccucccgcc

SEQ ID NO: 317830 - RNA, 19 nt, Human
ucgaugauugacgccgagg

SEQ ID NO: 317831 - RNA, 20 nt, Human
ucuacuaaaaccccgucucu

SEQ ID NO: 317832 - RNA, 21 nt, Human
ucuacuaaaaccccgucucua

SEQ ID NO: 317833 - RNA, 21 nt, Human
ucuccuccagcagcagcaccu

SEQ ID NO: 317834 - RNA, 22 nt, Human
ucucuggaccgaggaguuccug

SEQ ID NO: 317835 - RNA, 19 nt, Human
ucugcugaaccucccgccu

SEQ ID NO: 317836 - RNA, 18 nt, Human
ucuggaacccacgguggc

SEQ ID NO: 317837 - RNA, 21 nt, Human
ugacagugcuucccuccccag

SEQ ID NO: 317838 - RNA, 24 nt, Human
ugacggaugggagggggaagggcg

SEQ ID NO: 317839 - RNA, 23 nt, Human
ugacugcguccaugccagaggau

SEQ ID NO: 317840 - RNA, 24 nt, Human
ugaggugggagagauugaguaggc

SEQ ID NO: 317841 - RNA, 25 nt, Human
ugaggugggagagauugaguaggcc

SEQ ID NO: 317842 - RNA, 20 nt, Human
ugagguggucacaggcacac

SEQ ID NO: 317843 - RNA, 19 nt, Human
ugaugcugguccuacauuc

SEQ ID NO: 317844 - RNA, 27 nt, Human
ugcccuugucuccagagacgcagagag

SEQ ID NO: 317845 - RNA, 22 nt, Human
ugcgagcagagggugaugcugg

SEQ ID NO: 317846 - RNA, 21 nt, Human
ugcugcagaugcgccucccag

SEQ ID NO: 317847 - RNA, 18 nt, Human
ugcuggggaggaaacagg

SEQ ID NO: 317848 - RNA, 22 nt, Human
ugcugguccuacauucauccac

SEQ ID NO: 317849 - RNA, 19 nt, Human
ugcuguagaggcuucuuau

SEQ ID NO: 317850 - RNA, 21 nt, Human
ugcuguagaggcuucuuaucg

SEQ ID NO: 317851 - RNA, 18 nt, Human
ugcuuggagcagacuccc

SEQ ID NO: 317852 - RNA, 25 nt, Human
ugcuuggagcagacucccugacugc

SEQ ID NO: 317853 - RNA, 22 nt, Human
uggaacccacgguggcgggggg

SEQ ID NO: 317854 - RNA, 21 nt, Human
uggaaggagaccccuguggug

SEQ ID NO: 317855 - RNA, 20 nt, Human
uggaauauuccauugcgccc

SEQ ID NO: 317856 - RNA, 19 nt, Human
uggaauugucauucaugga

SEQ ID NO: 317857 - RNA, 25 nt, Human
uggagcgggaccaccagugucugcu

SEQ ID NO: 317858 - RNA, 20 nt, Human
uggaggagcagaggaagggg

SEQ ID NO: 317859 - RNA, 22 nt, Human
uggauaacagcaaaaaaacuga

SEQ ID NO: 317860 - RNA, 20 nt, Human
uggcacugguugggggcucu

SEQ ID NO: 317861 - RNA, 18 nt, Human
uggcagcacacugcaugg

SEQ ID NO: 317862 - RNA, 19 nt, Human
uggcagcacacugcauggg

SEQ ID NO: 317863 - RNA, 18 nt, Human
uggguguuggugguugca

SEQ ID NO: 317864 - RNA, 19 nt, Human
ugguugcauuuguuaagga

SEQ ID NO: 317865 - RNA, 22 nt, Human
ugguuucucacuucccaacuuc

SEQ ID NO: 317866 - RNA, 24 nt, Human
uguuuugccuccugugaagcccca

SEQ ID NO: 317867 - RNA, 24 nt, Human
uuaauuaucuggauaacagcaaaa

SEQ ID NO: 317868 - RNA, 18 nt, Human
uucaagaacggaacuguc

SEQ ID NO: 317869 - RNA, 19 nt, Human
uucaagaacggaacugucc

SEQ ID NO: 317870 - RNA, 23 nt, Human
uucaagaacggaacuguccccau

SEQ ID NO: 317871 - RNA, 18 nt, Human
uuccauugcgcccuaggu

SEQ ID NO: 317872 - RNA, 24 nt, Human
uuccccgccuugauucuccccacu

SEQ ID NO: 317873 - RNA, 21 nt, Human
uuccuggggaccccugaauau

SEQ ID NO: 317874 - RNA, 21 nt, Human
uucuggcugcagcucuucagg

SEQ ID NO: 317875 - RNA, 19 nt, Human
uuuuuuuuuuuuuugagga

SEQ ID NO: 317876 - RNA, 22 nt, Human
uuuuuuuuuuuuuuuuuugagg

SEQ ID NO: 317877 - RNA, 28 nt, Human
aggggagagcugggcuggccaggagccu

SEQ ID NO: 317878 - RNA, 23 nt, Human
gagcaagcuuuggccagagccaa

SEQ ID NO: 317879 - RNA, 24 nt, Human
gggcuggcgcugcucauggagucg

SEQ ID NO: 317880 - RNA, 21 nt, Human
ggugcagaggggagagcuggg

SEQ ID NO: 317881 - RNA, 20 nt, Human
gugcagaggggagagcuggg

SEQ ID NO: 317882 - RNA, 18 nt, Human
agcgacuuaggcuggccu

SEQ ID NO: 317883 - RNA, 19 nt, Human
aguaauaaucaaaaugguu

SEQ ID NO: 317884 - RNA, 26 nt, Human
aguaauaaucaaaaugguuuuuccuu

SEQ ID NO: 317885 - RNA, 23 nt, Human
auugcuucucuuuauuuucaaca

SEQ ID NO: 317886 - RNA, 27 nt, Human
caacuuccccuuuuuuuccucacugaa

SEQ ID NO: 317887 - RNA, 21 nt, Human
cacauuaacuccucaagucaa

SEQ ID NO: 317888 - RNA, 23 nt, Human
ccaacuuccccuuuuuuuccuca

SEQ ID NO: 317889 - RNA, 22 nt, Human
ccccaacuuccccuuuuuuucc

SEQ ID NO: 317890 - RNA, 21 nt, Human
cccuuuuuuuccucacugaac

SEQ ID NO: 317891 - RNA, 22 nt, Human
ccucacugaacauguuuuccuc

SEQ ID NO: 317892 - RNA, 20 nt, Human
ccucagagaguucaccacac

SEQ ID NO: 317893 - RNA, 23 nt, Human
ccucaggaccuccaacgcuugga

SEQ ID NO: 317894 - RNA, 21 nt, Human
ccuccaacgcuuggauuucua

SEQ ID NO: 317895 - RNA, 23 nt, Human
gcugcaggcccggcuucuggcug

SEQ ID NO: 317896 - RNA, 19 nt, Human
gucacgccugggaagcggg

SEQ ID NO: 317897 - RNA, 21 nt, Human
uaacuccuacauguacuuccc

SEQ ID NO: 317898 - RNA, 21 nt, Human
ucaacaucugccuauccccaa

SEQ ID NO: 317899 - RNA, 22 nt, Human
ucaacaucugccuauccccaac

SEQ ID NO: 317900 - RNA, 22 nt, Human
ucacugaacauguuuuccucac

SEQ ID NO: 317901 - RNA, 23 nt, Human
ucccaagccagaaucucccuuua

SEQ ID NO: 317902 - RNA, 21 nt, Human
uccuacauguacuucccaagc

SEQ ID NO: 317903 - RNA, 22 nt, Human
uccuacauguacuucccaagcc

SEQ ID NO: 317904 - RNA, 21 nt, Human
ucuauaagauguaucucccca

SEQ ID NO: 317905 - RNA, 23 nt, Human
ugggaagcggguggggugucccg

SEQ ID NO: 317906 - RNA, 23 nt, Human
ugucccggagcggugcugaggcg

SEQ ID NO: 317907 - RNA, 21 nt, Human
ugucugaaacuguggcugcuu

SEQ ID NO: 317908 - RNA, 24 nt, Human
uguggcugcuuuguugcuucaaga

SEQ ID NO: 317909 - RNA, 22 nt, Human
uuacaacagucuacacagggau

SEQ ID NO: 317910 - RNA, 24 nt, Human
uuuuugcuucacauugcuucucuu

SEQ ID NO: 317911 - RNA, 21 nt, Human
uuuuuuuuuuuuuuuuugcuu

SEQ ID NO: 317912 - RNA, 20 nt, Human
uuuuuuuuuuuuuuuuuugg

SEQ ID NO: 317913 - RNA, 21 nt, Human
aggaggcucuggagucacucc

SEQ ID NO: 317914 - RNA, 23 nt, Human
aucuucuuauucacuuccuguca

SEQ ID NO: 317915 - RNA, 21 nt, Human
cuuccugucauugaauccuag

SEQ ID NO: 317916 - RNA, 22 nt, Human
ggcucuggagucacucccaacu

SEQ ID NO: 317917 - RNA, 23 nt, Human
uuagagcuaugaugaccuuuuuc

SEQ ID NO: 317918 - RNA, 19 nt, Human
accaccuucuuccaauguc

SEQ ID NO: 317919 - RNA, 18 nt, Human
aggcucuggagucacucc

SEQ ID NO: 317920 - RNA, 23 nt, Human
aucacugucaucuucuuguucac

SEQ ID NO: 317921 - RNA, 24 nt, Human
caucuucuuguucacuuccuguca

SEQ ID NO: 317922 - RNA, 23 nt, Human
cauggcauuugaaucauuugaau

SEQ ID NO: 317923 - RNA, 21 nt, Human
gcucuggagucacucccaacu

SEQ ID NO: 317924 - RNA, 25 nt, Human
gucaucuucuuguucacuuccuguc

SEQ ID NO: 317925 - RNA, 23 nt, Human
aacacugucaucuucuuauucac

SEQ ID NO: 317926 - RNA, 18 nt, Human
aggcucuggagucacucc

SEQ ID NO: 317927 - RNA, 21 nt, Human
aucacauuauguuucaaggca

SEQ ID NO: 317928 - RNA, 23 nt, Human
aucuucuuauucacuuccuguca

SEQ ID NO: 317929 - RNA, 21 nt, Human
cuuccugucauugaauccuag

SEQ ID NO: 317930 - RNA, 22 nt, Human
ggcucuggagucacucccaacu

SEQ ID NO: 317931 - RNA, 25 nt, Human
gucaucuucuuauucacuuccuguc

SEQ ID NO: 317932 - RNA, 20 nt, Human
ucacauuauguuucaaggca

SEQ ID NO: 317933 - RNA, 19 nt, Human
ugaaacacugucaucuucu

SEQ ID NO: 317934 - RNA, 24 nt, Human
aaaacucccaccccagaacucaga

SEQ ID NO: 317935 - RNA, 24 nt, Human
aagcugggggccaggccagcuggg

SEQ ID NO: 317936 - RNA, 19 nt, Human
aaguccgccugcuccguac

SEQ ID NO: 317937 - RNA, 19 nt, Human
acaccugacagagagcaaa

SEQ ID NO: 317938 - RNA, 19 nt, Human
accccagaacucagagccc

SEQ ID NO: 317939 - RNA, 23 nt, Human
acucauggcuacggcugauuucc

SEQ ID NO: 317940 - RNA, 20 nt, Human
agaaaggagcugaauuuucu

SEQ ID NO: 317941 - RNA, 19 nt, Human
aguggugguggggaggguu

SEQ ID NO: 317942 - RNA, 20 nt, Human
aucacaccugacagagagca

SEQ ID NO: 317943 - RNA, 21 nt, Human
auccugggcuuagagcagcug

SEQ ID NO: 317944 - RNA, 30 nt, Human
cagcugggcuggcaggagauccugggagcc

SEQ ID NO: 317945 - RNA, 25 nt, Human
cagcuggggucccagaggugaagcu

SEQ ID NO: 317946 - RNA, 21 nt, Human
ccaggacagaaaggagcugaa

SEQ ID NO: 317947 - RNA, 20 nt, Human
cccaccccagaacucagagc

SEQ ID NO: 317948 - RNA, 18 nt, Human
cccggaggccuaguaggc

SEQ ID NO: 317949 - RNA, 20 nt, Human
ccugcuccguacucuagggc

SEQ ID NO: 317950 - RNA, 18 nt, Human
ccugggcuuagagcagcu

SEQ ID NO: 317951 - RNA, 20 nt, Human
ccuuggggaaagagauccug

SEQ ID NO: 317952 - RNA, 21 nt, Human
cugggcuggcaggagauccug

SEQ ID NO: 317953 - RNA, 22 nt, Human
cugggcuggcaggagauccugg

SEQ ID NO: 317954 - RNA, 18 nt, Human
cugggggccaggccagcu

SEQ ID NO: 317955 - RNA, 25 nt, Human
cugggggccaggccagcugggcugg

SEQ ID NO: 317956 - RNA, 20 nt, Human
cugguuuaaaaaaaaaaaaa

SEQ ID NO: 317957 - RNA, 18 nt, Human
gaacucagagccccuucg

SEQ ID NO: 317958 - RNA, 20 nt, Human
gcuggcaggagauccuggga

SEQ ID NO: 317959 - RNA, 19 nt, Human
gggaggguucaacauuuua

SEQ ID NO: 317960 - RNA, 20 nt, Human
gggccaggccagcugggcug

SEQ ID NO: 317961 - RNA, 20 nt, Human
gggcuggcaggagauccugg

SEQ ID NO: 317962 - RNA, 24 nt, Human
ggggaggguucaacauuuuaucac

SEQ ID NO: 317963 - RNA, 24 nt, Human
ggggucccagaggugaagcugggg

SEQ ID NO: 317964 - RNA, 18 nt, Human
uaacuuguuaagaaaaau

SEQ ID NO: 317965 - RNA, 20 nt, Human
uaagcuccuagucccgggca

SEQ ID NO: 317966 - RNA, 21 nt, Human
uaagcuccuagucccgggcaa

SEQ ID NO: 317967 - RNA, 21 nt, Human
ucacaccugacagagagcaaa

SEQ ID NO: 317968 - RNA, 19 nt, Human
ucccgcguuucgggcgccc

SEQ ID NO: 317969 - RNA, 23 nt, Human
ucccugguuuaaaaaaaaaaaaa

SEQ ID NO: 317970 - RNA, 20 nt, Human
ugggggccaggccagcuggg

SEQ ID NO: 317971 - RNA, 21 nt, Human
ugguuuaaaaaaaaaaaaagu

SEQ ID NO: 317972 - RNA, 21 nt, Human
uuuaaaaaaaaaaaaaguggu

SEQ ID NO: 317973 - RNA, 20 nt, Human
uuuuuuuuuuuuuugucaga

SEQ ID NO: 317974 - RNA, 18 nt, Human
uuuuuuuuuuuuuuuguc

SEQ ID NO: 317975 - RNA, 20 nt, Human
uuuuuuuuuuuuuuugucag

SEQ ID NO: 317976 - RNA, 18 nt, Human
uuuuuuuuuuuuuuuuug

SEQ ID NO: 317977 - RNA, 19 nt, Human
uuuuuuuuuuuuuuuuugu

SEQ ID NO: 317978 - RNA, 27 nt, Human
aaagacacuucaaccucaaaaccaaag

SEQ ID NO: 317979 - RNA, 19 nt, Human
aaagacagugagaacccag

SEQ ID NO: 317980 - RNA, 20 nt, Human
aaccaggaacucuacuccag

SEQ ID NO: 317981 - RNA, 19 nt, Human
aagaagaaauugaaaacaa

SEQ ID NO: 317982 - RNA, 20 nt, Human
aagaagaaauugaaaacaau

SEQ ID NO: 317983 - RNA, 22 nt, Human
aagaagaaauugaaaacaauca

SEQ ID NO: 317984 - RNA, 24 nt, Human
aagacacuucaaccucaaaaccag

SEQ ID NO: 317985 - RNA, 21 nt, Human
acuucaaccucaaaaccaaag

SEQ ID NO: 317986 - RNA, 24 nt, Human
agacacuucaaccucaaaaccaaa

SEQ ID NO: 317987 - RNA, 22 nt, Human
caaagaaaguaacucucccucu

SEQ ID NO: 317988 - RNA, 20 nt, Human
cacccucuauucuaucucaa

SEQ ID NO: 317989 - RNA, 22 nt, Human
cacccucuauucuaucucaacu

SEQ ID NO: 317990 - RNA, 24 nt, Human
ccagacauccuaccagcugcaauu

SEQ ID NO: 317991 - RNA, 23 nt, Human
cccucuauucuaucucaacuuug

SEQ ID NO: 317992 - RNA, 18 nt, Human
ccuagacguggugcaaag

SEQ ID NO: 317993 - RNA, 25 nt, Human
ccucuuaugaaaagcaaccaggaac

SEQ ID NO: 317994 - RNA, 21 nt, Human
cugcuugcagagauacaaaga

SEQ ID NO: 317995 - RNA, 25 nt, Human
gaaaguaacucucccucuuaugaaa

SEQ ID NO: 317996 - RNA, 19 nt, Human
gacguggugcaaagacagu

SEQ ID NO: 317997 - RNA, 24 nt, Human
gcugcaauuacaucauuuuuuauc

SEQ ID NO: 317998 - RNA, 18 nt, Human
ggugcaaagacagugaga

SEQ ID NO: 317999 - RNA, 23 nt, Human
uaaaagaagaaauugaaaacaau

SEQ ID NO: 318000 - RNA, 22 nt, Human
uacauguagaaaaucaaaguga

SEQ ID NO: 318001 - RNA, 18 nt, Human
uaucucaacuuuggcccc

SEQ ID NO: 318002 - RNA, 24 nt, Human
ucacccucuauucuaucucaacuu

SEQ ID NO: 318003 - RNA, 22 nt, Human
uccugggauugggcaccagaca

SEQ ID NO: 318004 - RNA, 20 nt, Human
ucuaucuucugcuuuuacuu

SEQ ID NO: 318005 - RNA, 18 nt, Human
ugaacauaaaagaagaaa

SEQ ID NO: 318006 - RNA, 20 nt, Human
ugaaugggaaugugguggug

SEQ ID NO: 318007 - RNA, 22 nt, Human
uggccccaucaaaucuaaugau

SEQ ID NO: 318008 - RNA, 18 nt, Human
ugugaacauaaaagaaga

SEQ ID NO: 318009 - RNA, 18 nt, Human
cacagugcuggaguuaca

SEQ ID NO: 318010 - RNA, 21 nt, Human
cccgggcgcgcgucccagcuc

SEQ ID NO: 318011 - RNA, 22 nt, Human
cuccucgcuucguccggccgcc

SEQ ID NO: 318012 - RNA, 22 nt, Human
gccaaucccugaaaccucacag

SEQ ID NO: 318013 - RNA, 25 nt, Human
ggacaggugcgcggucgcugcucuu

SEQ ID NO: 318014 - RNA, 21 nt, Human
gggcagccucggcggucccuc

SEQ ID NO: 318015 - RNA, 22 nt, Human
guccccuugguccccucugcca

SEQ ID NO: 318016 - RNA, 21 nt, Human
uccccucugccaaucccugaa

SEQ ID NO: 318017 - RNA, 18 nt, Human
ugaaaccucacagugcug

SEQ ID NO: 318018 - RNA, 24 nt, Human
ugcuggaguuacacuugggggcag

SEQ ID NO: 318019 - RNA, 27 nt, Human
uugggggcagccucggcggucccuccu

SEQ ID NO: 318020 - RNA, 20 nt, Human
acgcagggacaggguucucc

SEQ ID NO: 318021 - RNA, 22 nt, Human
acgcgggcacccggcaguggcc

SEQ ID NO: 318022 - RNA, 21 nt, Human
agcguccaccugcccacuggc

SEQ ID NO: 318023 - RNA, 23 nt, Human
aucauuugagugaucucucucuu

SEQ ID NO: 318024 - RNA, 19 nt, Human
augguggguggggaggaug

SEQ ID NO: 318025 - RNA, 19 nt, Human
caggguucuccggggcccc

SEQ ID NO: 318026 - RNA, 18 nt, Human
ccaccugcccacuggcug

SEQ ID NO: 318027 - RNA, 18 nt, Human
cccccggcugcccagccc

SEQ ID NO: 318028 - RNA, 21 nt, Human
ccugcccacuggcugauucug

SEQ ID NO: 318029 - RNA, 21 nt, Human
cggcaguggccaccagcuucu

SEQ ID NO: 318030 - RNA, 25 nt, Human
cggcaguggccaccagcuucugucg

SEQ ID NO: 318031 - RNA, 23 nt, Human
cggcucgcggaaucucucuccuc

SEQ ID NO: 318032 - RNA, 21 nt, Human
cuccuugaguccagaagcagc

SEQ ID NO: 318033 - RNA, 20 nt, Human
cucuccuccuccuugagucc

SEQ ID NO: 318034 - RNA, 19 nt, Human
gacaggguucuccggggcc

SEQ ID NO: 318035 - RNA, 19 nt, Human
gcagagcguccaccugccc

SEQ ID NO: 318036 - RNA, 19 nt, Human
gcucgcggaaucucucucc

SEQ ID NO: 318037 - RNA, 23 nt, Human
gcucgcggaaucucucuccuccu

SEQ ID NO: 318038 - RNA, 20 nt, Human
ggcccccggcugcccagccc

SEQ ID NO: 318039 - RNA, 25 nt, Human
gguggguggggaggaugcugaggag

SEQ ID NO: 318040 - RNA, 23 nt, Human
ucucucuccuccuccuugagucc

SEQ ID NO: 318041 - RNA, 18 nt, Human
ucugcgaggcagcuccgu

SEQ ID NO: 318042 - RNA, 23 nt, Human
ucuuuggacggccaccugcaugg

SEQ ID NO: 318043 - RNA, 19 nt, Human
ugcccacuggcugauucug

SEQ ID NO: 318044 - RNA, 24 nt, Human
ugcccucgcucuggccaccggccc

SEQ ID NO: 318045 - RNA, 19 nt, Human
ugcgaggcagcuccguugg

SEQ ID NO: 318046 - RNA, 21 nt, Human
ugguggguggggaggaugcug

SEQ ID NO: 318047 - RNA, 20 nt, Human
uuggacggccaccugcaugg

SEQ ID NO: 318048 - RNA, 25 nt, Human
aaaaaaaaucccuuuaucgugugac

SEQ ID NO: 318049 - RNA, 23 nt, Human
aaaaaaacgaaaacaacaaaaaa

SEQ ID NO: 318050 - RNA, 24 nt, Human
aaacaagggccaugcucagaucug

SEQ ID NO: 318051 - RNA, 24 nt, Human
aaacgcaacaccagaauaggcaua

SEQ ID NO: 318052 - RNA, 18 nt, Human
aaauaguaagagacaaca

SEQ ID NO: 318053 - RNA, 25 nt, Human
aaauaguaagagacaaccgguaccc

SEQ ID NO: 318054 - RNA, 21 nt, Human
aacaaaaaaaagaaauaccag

SEQ ID NO: 318055 - RNA, 25 nt, Human
aacaagugguaacagagcuucacaa

SEQ ID NO: 318056 - RNA, 28 nt, Human
aacacgugaacacacacgcacgcacaca

SEQ ID NO: 318057 - RNA, 20 nt, Human
aacccaagaaccucacugaa

SEQ ID NO: 318058 - RNA, 25 nt, Human
aaccccuuuuuguaugucaaauugu

SEQ ID NO: 318059 - RNA, 20 nt, Human
aacgaaaacaacaaaaaaaa

SEQ ID NO: 318060 - RNA, 25 nt, Human
aacgaaaacaacaaaaaaaagaaaa

SEQ ID NO: 318061 - RNA, 21 nt, Human
aacucaagaagcaaaaagcag

SEQ ID NO: 318062 - RNA, 18 nt, Human
aagaacacguccaagcac

SEQ ID NO: 318063 - RNA, 18 nt, Human
aagagccagaaacucaga

SEQ ID NO: 318064 - RNA, 21 nt, Human
aagcaaaaagcagggucaagg

SEQ ID NO: 318065 - RNA, 24 nt, Human
aagcaaaaagcagggucaaggagc

SEQ ID NO: 318066 - RNA, 21 nt, Human
aagcacaaacgggccaucaac

SEQ ID NO: 318067 - RNA, 20 nt, Human
aagcaggugagcugaccugc

SEQ ID NO: 318068 - RNA, 22 nt, Human
aaggccuuccuaaggcugaccc

SEQ ID NO: 318069 - RNA, 22 nt, Human
aaugggaaugauaguggaagga

SEQ ID NO: 318070 - RNA, 18 nt, Human
acaaaacccaagaaccuc

SEQ ID NO: 318071 - RNA, 24 nt, Human
acaaaacccaagaaccucacugaa

SEQ ID NO: 318072 - RNA, 25 nt, Human
acaaaacccaagaaccucacugaac

SEQ ID NO: 318073 - RNA, 19 nt, Human
acaaacgcaacaccagaau

SEQ ID NO: 318074 - RNA, 27 nt, Human
acaaauaguaagagacaaccgguaccc

SEQ ID NO: 318075 - RNA, 19 nt, Human
acaacgccaacaaaaaaag

SEQ ID NO: 318076 - RNA, 19 nt, Human
acacacacgcacgcacaca

SEQ ID NO: 318077 - RNA, 24 nt, Human
acacgcacgcacacaugcacgcgg

SEQ ID NO: 318078 - RNA, 33 nt, Human
acacgugaacacacacgcacgcacacaugcagu

SEQ ID NO: 318079 - RNA, 19 nt, Human
acacuucccagagcucacc

SEQ ID NO: 318080 - RNA, 21 nt, Human
acagugcccuucucuuuggga

SEQ ID NO: 318081 - RNA, 18 nt, Human
acaugcacucccuuucuc

SEQ ID NO: 318082 - RNA, 24 nt, Human
accacugaccaggaaaugccacuu

SEQ ID NO: 318083 - RNA, 21 nt, Human
accccaacaggaaggcugggc

SEQ ID NO: 318084 - RNA, 21 nt, Human
accccaaggccucaaccacac

SEQ ID NO: 318085 - RNA, 22 nt, Human
acccccaccauagccgaaaauc

SEQ ID NO: 318086 - RNA, 19 nt, Human
acugaccaggaaaugccac

SEQ ID NO: 318087 - RNA, 20 nt, Human
acugcagccgauugacugac

SEQ ID NO: 318088 - RNA, 19 nt, Human
agaacacguccaagcacaa

SEQ ID NO: 318089 - RNA, 23 nt, Human
agaagcucagacacuaaagaugu

SEQ ID NO: 318090 - RNA, 24 nt, Human
agaccacucacgcgcccgcacgag

SEQ ID NO: 318091 - RNA, 25 nt, Human
agacucaagagcaauggacugaugg

SEQ ID NO: 318092 - RNA, 19 nt, Human
agagcucccuccuuccgcu

SEQ ID NO: 318093 - RNA, 23 nt, Human
agagggaagguggggagagaggg

SEQ ID NO: 318094 - RNA, 21 nt, Human
agaguggagggaaggucaaaa

SEQ ID NO: 318095 - RNA, 20 nt, Human
agcacucuccaaaaagaagc

SEQ ID NO: 318096 - RNA, 20 nt, Human
aggagcucuugaaaaauugc

SEQ ID NO: 318097 - RNA, 24 nt, Human
aggcaaggaaggggguuuuccaug

SEQ ID NO: 318098 - RNA, 20 nt, Human
aggcacggaaggagguagag

SEQ ID NO: 318099 - RNA, 26 nt, Human
aggcauaaaaaagaguccauauccaa

SEQ ID NO: 318100 - RNA, 24 nt, Human
agguagaaaacauaguggccccuu

SEQ ID NO: 318101 - RNA, 19 nt, Human
agugaccuaccuaccccca

SEQ ID NO: 318102 - RNA, 24 nt, Human
agugcuacauugguuaaaaucaau

SEQ ID NO: 318103 - RNA, 24 nt, Human
aguuauaaaacuuuaaaaauggag

SEQ ID NO: 318104 - RNA, 20 nt, Human
aucccgaucaaaaagacuaa

SEQ ID NO: 318105 - RNA, 20 nt, Human
aucucuucuucuucccccug

SEQ ID NO: 318106 - RNA, 23 nt, Human
augaagggcgcaggagaucccuc

SEQ ID NO: 318107 - RNA, 22 nt, Human
augcaaaaaaggagugacccca

SEQ ID NO: 318108 - RNA, 21 nt, Human
caaaacccaagaaccucacug

SEQ ID NO: 318109 - RNA, 24 nt, Human
caaaacgccuaaggacucaauaca

SEQ ID NO: 318110 - RNA, 23 nt, Human
caaaagacaacucaagaagcaaa

SEQ ID NO: 318111 - RNA, 22 nt, Human
caaacgggccaucaacauggag

SEQ ID NO: 318112 - RNA, 21 nt, Human
caaaggcacaaaacccaagaa

SEQ ID NO: 318113 - RNA, 27 nt, Human
caaaggcacaaaacccaagaaccucac

SEQ ID NO: 318114 - RNA, 19 nt, Human
caaaguucaauacaggagc

SEQ ID NO: 318115 - RNA, 21 nt, Human
caacaaaaaaagugaaaugua

SEQ ID NO: 318116 - RNA, 21 nt, Human
caacaccagaauaggcauaaa

SEQ ID NO: 318117 - RNA, 24 nt, Human
caacauaaaguccccauaacagaa

SEQ ID NO: 318118 - RNA, 24 nt, Human
caacauggagauggagauucagau

SEQ ID NO: 318119 - RNA, 21 nt, Human
caagagccagaaacucagaca

SEQ ID NO: 318120 - RNA, 25 nt, Human
caagcucagcucacccguuucuccu

SEQ ID NO: 318121 - RNA, 20 nt, Human
caagugaccuaccuaccccc

SEQ ID NO: 318122 - RNA, 23 nt, Human
caagugaccuaccuacccccacc

SEQ ID NO: 318123 - RNA, 23 nt, Human
caagugguaacagagcuucacaa

SEQ ID NO: 318124 - RNA, 20 nt, Human
caauacauaacugggaaggc

SEQ ID NO: 318125 - RNA, 19 nt, Human
caauuuguuguuuuuaauc

SEQ ID NO: 318126 - RNA, 24 nt, Human
cacaaaacccaagaaccucacuga

SEQ ID NO: 318127 - RNA, 28 nt, Human
cacacgcacgcacacaugcacgcgcgca

SEQ ID NO: 318128 - RNA, 18 nt, Human
cacaugcaaaaaaggagu

SEQ ID NO: 318129 - RNA, 18 nt, Human
cacauggcagauacagag

SEQ ID NO: 318130 - RNA, 21 nt, Human
cacgcgcccgcacgagaacac

SEQ ID NO: 318131 - RNA, 19 nt, Human
cagagaaggguagacggug

SEQ ID NO: 318132 - RNA, 20 nt, Human
cagagcucaccaugggcugc

SEQ ID NO: 318133 - RNA, 22 nt, Human
cagcaauagcacaacaaaucuu

SEQ ID NO: 318134 - RNA, 19 nt, Human
cagcguggagucggccccc

SEQ ID NO: 318135 - RNA, 21 nt, Human
caggaaaggaaauugccaagc

SEQ ID NO: 318136 - RNA, 21 nt, Human
caggugcaccugaucugaggu

SEQ ID NO: 318137 - RNA, 20 nt, Human
caugcaaaaaaggagugacc

SEQ ID NO: 318138 - RNA, 18 nt, Human
cauuguauuaggagaaau

SEQ ID NO: 318139 - RNA, 21 nt, Human
ccaagcggaaaaauauccaca

SEQ ID NO: 318140 - RNA, 25 nt, Human
ccacacuucccagagcucaccaugg

SEQ ID NO: 318141 - RNA, 18 nt, Human
ccagagcucaccaugggc

SEQ ID NO: 318142 - RNA, 23 nt, Human
ccagucccaugacgaggagccag

SEQ ID NO: 318143 - RNA, 21 nt, Human
ccauacaccguccccauuccc

SEQ ID NO: 318144 - RNA, 24 nt, Human
ccaugugcuggggccgaggggcau

SEQ ID NO: 318145 - RNA, 18 nt, Human
ccccaaaggcacaaaacc

SEQ ID NO: 318146 - RNA, 21 nt, Human
ccccaaaggcacaaaacccaa

SEQ ID NO: 318147 - RNA, 25 nt, Human
ccccaaaggcacaaaacccaagaac

SEQ ID NO: 318148 - RNA, 21 nt, Human
cccccaccauagccgaaaauc

SEQ ID NO: 318149 - RNA, 22 nt, Human
cccccuggcaggauggccuccg

SEQ ID NO: 318150 - RNA, 25 nt, Human
ccccugggucaaaccaaagucccca

SEQ ID NO: 318151 - RNA, 27 nt, Human
ccccuuccugccgccccgggguucggg

SEQ ID NO: 318152 - RNA, 22 nt, Human
cccucguuugaagaccacucac

SEQ ID NO: 318153 - RNA, 23 nt, Human
cccuggcaggauggccuccgaaa

SEQ ID NO: 318154 - RNA, 19 nt, Human
ccuccccaagcaggugagc

SEQ ID NO: 318155 - RNA, 19 nt, Human
ccugaaaccuacaacaaac

SEQ ID NO: 318156 - RNA, 18 nt, Human
cgaaaucucuucuucuuc

SEQ ID NO: 318157 - RNA, 28 nt, Human
cgcacgcacacaugcacgcgcgcacaug

SEQ ID NO: 318158 - RNA, 25 nt, Human
cgcguugggcccccaccgaagcagc

SEQ ID NO: 318159 - RNA, 21 nt, Human
cgugccaaaaacaagggccau

SEQ ID NO: 318160 - RNA, 21 nt, Human
cguguagacauacaucuguac

SEQ ID NO: 318161 - RNA, 19 nt, Human
cuacauacauauuuacaga

SEQ ID NO: 318162 - RNA, 20 nt, Human
cuacugcuaaaacaggcaac

SEQ ID NO: 318163 - RNA, 22 nt, Human
cucaagaagcaaaaagcagggu

SEQ ID NO: 318164 - RNA, 22 nt, Human
cucaagagccagaaacucagac

SEQ ID NO: 318165 - RNA, 23 nt, Human
cucaagagccagaaacucagaca

SEQ ID NO: 318166 - RNA, 19 nt, Human
cuccuacuuucagauguac

SEQ ID NO: 318167 - RNA, 20 nt, Human
cuccucuaguuauuaagugu

SEQ ID NO: 318168 - RNA, 19 nt, Human
cucgcagccucacacaacu

SEQ ID NO: 318169 - RNA, 22 nt, Human
cugaaggccuuccuaaggcuga

SEQ ID NO: 318170 - RNA, 18 nt, Human
cugcaaagacucaagagc

SEQ ID NO: 318171 - RNA, 19 nt, Human
cuuauccuaaguugagcau

SEQ ID NO: 318172 - RNA, 24 nt, Human
cuugaaaagccuaaaguauccaaa

SEQ ID NO: 318173 - RNA, 25 nt, Human
cuuuauacaauauuucaacauaaag

SEQ ID NO: 318174 - RNA, 24 nt, Human
gaaaacaacaaaaaaaagaaauac

SEQ ID NO: 318175 - RNA, 22 nt, Human
gaaaagccuaaaguauccaaau

SEQ ID NO: 318176 - RNA, 21 nt, Human
gaagaacacguccaagcacaa

SEQ ID NO: 318177 - RNA, 23 nt, Human
gaaggccuuccuaaggcugaccc

SEQ ID NO: 318178 - RNA, 18 nt, Human
gaagguggggagagaggg

SEQ ID NO: 318179 - RNA, 25 nt, Human
gacaacucaagaagcaaaaagcagg

SEQ ID NO: 318180 - RNA, 20 nt, Human
gaccccugggucaaaccaaa

SEQ ID NO: 318181 - RNA, 23 nt, Human
gacucaauacauaacugggaagg

SEQ ID NO: 318182 - RNA, 24 nt, Human
gagaacaaaaaacaguaugaauaa

SEQ ID NO: 318183 - RNA, 20 nt, Human
gagguaccagucccaugacg

SEQ ID NO: 318184 - RNA, 22 nt, Human
gagucagcuucaacuggucuug

SEQ ID NO: 318185 - RNA, 20 nt, Human
gaguggagggaaggucaaaa

SEQ ID NO: 318186 - RNA, 23 nt, Human
gcacaaauucaccaaacaaauau

SEQ ID NO: 318187 - RNA, 23 nt, Human
gcacacaugcacgcgcgcacaug

SEQ ID NO: 318188 - RNA, 21 nt, Human
gcaggagaucccuccccucca

SEQ ID NO: 318189 - RNA, 20 nt, Human
gccaugcucagaucugaggu

SEQ ID NO: 318190 - RNA, 21 nt, Human
gcguugggcccccaccgaagc

SEQ ID NO: 318191 - RNA, 23 nt, Human
ggaaggagguagaaaacauagug

SEQ ID NO: 318192 - RNA, 23 nt, Human
ggacaagugaccuaccuaccccc

SEQ ID NO: 318193 - RNA, 21 nt, Human
ggagaaauaucuaagaaaaaa

SEQ ID NO: 318194 - RNA, 21 nt, Human
ggagucagccccguccccccc

SEQ ID NO: 318195 - RNA, 22 nt, Human
ggcacaaaacccaagaaccuca

SEQ ID NO: 318196 - RNA, 20 nt, Human
ggcccccaccgaagcagcag

SEQ ID NO: 318197 - RNA, 19 nt, Human
ggcugcaggugacuugcca

SEQ ID NO: 318198 - RNA, 19 nt, Human
gggaaacaggaaaacugug

SEQ ID NO: 318199 - RNA, 21 nt, Human
gggaacucggccuccuccuga

SEQ ID NO: 318200 - RNA, 19 nt, Human
gggaaugauaguggaagga

SEQ ID NO: 318201 - RNA, 19 nt, Human
gggcauguucaggcucggc

SEQ ID NO: 318202 - RNA, 18 nt, Human
gggcgcccagcaugcgcg

SEQ ID NO: 318203 - RNA, 18 nt, Human
ggggugguacugaagggg

SEQ ID NO: 318204 - RNA, 20 nt, Human
gguuaaaaucaauggacaac

SEQ ID NO: 318205 - RNA, 21 nt, Human
guagcccugaaaaaaaaaauc

SEQ ID NO: 318206 - RNA, 22 nt, Human
gugccaaaaacaagggccaugc

SEQ ID NO: 318207 - RNA, 23 nt, Human
guggaaggauuaaaguggcacaa

SEQ ID NO: 318208 - RNA, 18 nt, Human
guggagucggcccccuuc

SEQ ID NO: 318209 - RNA, 22 nt, Human
uaaaacaggcaacuugcuuugc

SEQ ID NO: 318210 - RNA, 21 nt, Human
uaaaagaaaggcaucaagagc

SEQ ID NO: 318211 - RNA, 22 nt, Human
uaaaguggcacaaauucaccaa

SEQ ID NO: 318212 - RNA, 26 nt, Human
uaacaacgccaacaaaaaaagugaaa

SEQ ID NO: 318213 - RNA, 24 nt, Human
uaacagcaaaguucaauacaggaa

SEQ ID NO: 318214 - RNA, 23 nt, Human
uaacuaacagcaaaguucaauac

SEQ ID NO: 318215 - RNA, 24 nt, Human
uaagccucgcagagugaggaacau

SEQ ID NO: 318216 - RNA, 22 nt, Human
uaagcugccggcaaucagcuga

SEQ ID NO: 318217 - RNA, 20 nt, Human
uaaguguuugcagcaauagc

SEQ ID NO: 318218 - RNA, 21 nt, Human
uaaguugagcaugcaauacuu

SEQ ID NO: 318219 - RNA, 22 nt, Human
uaauaguuauaaauuagugcca

SEQ ID NO: 318220 - RNA, 18 nt, Human
uaauggcaaaagacaacu

SEQ ID NO: 318221 - RNA, 23 nt, Human
uacaccguccccauucccugccc

SEQ ID NO: 318222 - RNA, 24 nt, Human
uaccuacccccaccauagccgaaa

SEQ ID NO: 318223 - RNA, 22 nt, Human
uagauccuuaucagaucccaua

SEQ ID NO: 318224 - RNA, 19 nt, Human
uagcacucuccaaaaagaa

SEQ ID NO: 318225 - RNA, 24 nt, Human
uagcacucuccaaaaagaagcaau

SEQ ID NO: 318226 - RNA, 23 nt, Human
uaguggaaggauuaaaguggcac

SEQ ID NO: 318227 - RNA, 23 nt, Human
uaguggccccuuccaccaaguuc

SEQ ID NO: 318228 - RNA, 21 nt, Human
uauagcaaagucccuaaaaaa

SEQ ID NO: 318229 - RNA, 23 nt, Human
uaucgugugacaaaccgugcuca

SEQ ID NO: 318230 - RNA, 19 nt, Human
ucaaaacgccuaaggacuc

SEQ ID NO: 318231 - RNA, 18 nt, Human
ucaaaccaaaguccccau

SEQ ID NO: 318232 - RNA, 20 nt, Human
ucaauacauaacugggaagg

SEQ ID NO: 318233 - RNA, 22 nt, Human
ucacauauaauacaauugaagc

SEQ ID NO: 318234 - RNA, 20 nt, Human
ucauauauuuaccuccccaa

SEQ ID NO: 318235 - RNA, 22 nt, Human
ucauauauuuaccuccccaagc

SEQ ID NO: 318236 - RNA, 19 nt, Human
ucauuagaauagucuuuuu

SEQ ID NO: 318237 - RNA, 23 nt, Human
uccaaaaagaagcaauaaaauaa

SEQ ID NO: 318238 - RNA, 19 nt, Human
uccaaacgccaagcucagc

SEQ ID NO: 318239 - RNA, 20 nt, Human
uccauacaccguccccauuc

SEQ ID NO: 318240 - RNA, 19 nt, Human
ucccaaaggacagcgugga

SEQ ID NO: 318241 - RNA, 20 nt, Human
ucccagagauguugccggga

SEQ ID NO: 318242 - RNA, 20 nt, Human
ucccauacugcagccgauug

SEQ ID NO: 318243 - RNA, 19 nt, Human
uccccaagcaggugagcug

SEQ ID NO: 318244 - RNA, 19 nt, Human
ucccuaaaaaauaagccuc

SEQ ID NO: 318245 - RNA, 18 nt, Human
ucccuccuuccgcucugg

SEQ ID NO: 318246 - RNA, 23 nt, Human
ucccuuucucucgcagccucaca

SEQ ID NO: 318247 - RNA, 21 nt, Human
ucccuuuggcuucacugauuc

SEQ ID NO: 318248 - RNA, 25 nt, Human
ucggccuccuccugaaggccuuccc

SEQ ID NO: 318249 - RNA, 18 nt, Human
ucuaacaagugguaacag

SEQ ID NO: 318250 - RNA, 21 nt, Human
ucucccaggugcaccugaucu

SEQ ID NO: 318251 - RNA, 23 nt, Human
ucugaaaacuccuacuuucagau

SEQ ID NO: 318252 - RNA, 23 nt, Human
ucuggaaaugccucaagagccag

SEQ ID NO: 318253 - RNA, 23 nt, Human
ucuguacaggccugggaugcgcc

SEQ ID NO: 318254 - RNA, 22 nt, Human
ugaaaccuacaacaaacuacug

SEQ ID NO: 318255 - RNA, 22 nt, Human
ugaaaggauuccaguuuaugaa

SEQ ID NO: 318256 - RNA, 24 nt, Human
ugaaaggauuccaguuuaugaaaa

SEQ ID NO: 318257 - RNA, 18 nt, Human
ugaaaggcacggaaggag

SEQ ID NO: 318258 - RNA, 21 nt, Human
ugaaaggcacggaaggaggua

SEQ ID NO: 318259 - RNA, 18 nt, Human
ugaccccugggucaaacc

SEQ ID NO: 318260 - RNA, 22 nt, Human
ugacugacucauuaaauaacac

SEQ ID NO: 318261 - RNA, 24 nt, Human
ugagaagcucagacacuaaagaug

SEQ ID NO: 318262 - RNA, 18 nt, Human
ugagugcauccaaaucug

SEQ ID NO: 318263 - RNA, 19 nt, Human
ugauuuaaaaaaacgaaaa

SEQ ID NO: 318264 - RNA, 24 nt, Human
ugccaagcggaaaaauauccacag

SEQ ID NO: 318265 - RNA, 20 nt, Human
ugccauguuauuucacaaca

SEQ ID NO: 318266 - RNA, 18 nt, Human
ugccccaaaggcacaaaa

SEQ ID NO: 318267 - RNA, 24 nt, Human
ugccccaaaggcacaaaacccaag

SEQ ID NO: 318268 - RNA, 19 nt, Human
ugccgggagagggaaggug

SEQ ID NO: 318269 - RNA, 18 nt, Human
ugcuguugauucccagag

SEQ ID NO: 318270 - RNA, 19 nt, Human
ugggaugcgccugugcacu

SEQ ID NO: 318271 - RNA, 24 nt, Human
ugguaugcaaauucauuuauacuu

SEQ ID NO: 318272 - RNA, 18 nt, Human
uguagacauacaucugua

SEQ ID NO: 318273 - RNA, 23 nt, Human
ugucccaagugggugccucagga

SEQ ID NO: 318274 - RNA, 21 nt, Human
ugucuggagucugccccaaag

SEQ ID NO: 318275 - RNA, 23 nt, Human
ugucuggagucugccccaaaggc

SEQ ID NO: 318276 - RNA, 18 nt, Human
ugugaaaggcacggaagg

SEQ ID NO: 318277 - RNA, 20 nt, Human
ugugcuuuuuaaucuuccca

SEQ ID NO: 318278 - RNA, 18 nt, Human
uguggcaaugaagggcgc

SEQ ID NO: 318279 - RNA, 24 nt, Human
uguugccgggagagggaagguggg

SEQ ID NO: 318280 - RNA, 19 nt, Human
uuaauacaucugacaagcc

SEQ ID NO: 318281 - RNA, 24 nt, Human
uuaucccaagagccauacuucuga

SEQ ID NO: 318282 - RNA, 22 nt, Human
uucaaaucaauccuuucucugc

SEQ ID NO: 318283 - RNA, 21 nt, Human
uucccagagauguugccggga

SEQ ID NO: 318284 - RNA, 21 nt, Human
uucucucgcagccucacacaa

SEQ ID NO: 318285 - RNA, 25 nt, Human
uucuguaaagauacacacaacaaag

SEQ ID NO: 318286 - RNA, 24 nt, Human
uugaaaagccuaaaguauccaaau

SEQ ID NO: 318287 - RNA, 19 nt, Human
uugauagcucacucuugaa

SEQ ID NO: 318288 - RNA, 24 nt, Human
uuuaauacaucugacaagccccaa

SEQ ID NO: 318289 - RNA, 21 nt, Human
aaaacaagaucuacccuaaac

SEQ ID NO: 318290 - RNA, 18 nt, Human
aaacaagaucuacccuaa

SEQ ID NO: 318291 - RNA, 23 nt, Human
aagcagcccagguguggugauuu

SEQ ID NO: 318292 - RNA, 22 nt, Human
aagccucagaaguuacacuucc

SEQ ID NO: 318293 - RNA, 20 nt, Human
aaguagcacacuuaugcugc

SEQ ID NO: 318294 - RNA, 24 nt, Human
agguguggugauuuacaccuguaa

SEQ ID NO: 318295 - RNA, 22 nt, Human
auaaagccucagaaguuacacu

SEQ ID NO: 318296 - RNA, 22 nt, Human
auggaagaaugugaaauaaauc

SEQ ID NO: 318297 - RNA, 22 nt, Human
caagaucuacccuaaacuucca

SEQ ID NO: 318298 - RNA, 20 nt, Human
caauguuuuaacacuuuuca

SEQ ID NO: 318299 - RNA, 19 nt, Human
caccagaguccucuacucc

SEQ ID NO: 318300 - RNA, 19 nt, Human
cacuaucagcaaucaggau

SEQ ID NO: 318301 - RNA, 22 nt, Human
cacuucccucccaguccaccac

SEQ ID NO: 318302 - RNA, 18 nt, Human
caggauggcuauggggca

SEQ ID NO: 318303 - RNA, 22 nt, Human
caggcaucucuccucuuguucu

SEQ ID NO: 318304 - RNA, 22 nt, Human
caggugacuugcucaggcuucc

SEQ ID NO: 318305 - RNA, 21 nt, Human
ccaccagaguccucuacucca

SEQ ID NO: 318306 - RNA, 24 nt, Human
ccagcaccugccgaaacuuuggag

SEQ ID NO: 318307 - RNA, 18 nt, Human
ccagcaggaaaauggaau

SEQ ID NO: 318308 - RNA, 24 nt, Human
ccagcaggcauuauuugggcucuu

SEQ ID NO: 318309 - RNA, 19 nt, Human
ccagcccagagguugugcc

SEQ ID NO: 318310 - RNA, 21 nt, Human
ccagcccagagguugugccuu

SEQ ID NO: 318311 - RNA, 18 nt, Human
ccccuuugucugaauggc

SEQ ID NO: 318312 - RNA, 18 nt, Human
cccuuccuucccuuccuc

SEQ ID NO: 318313 - RNA, 23 nt, Human
ccucagaaguuacacuucccucc

SEQ ID NO: 318314 - RNA, 23 nt, Human
ccucccaguccaccacuuaaaau

SEQ ID NO: 318315 - RNA, 22 nt, Human
ccuucuuuaccuuccaaaaauc

SEQ ID NO: 318316 - RNA, 21 nt, Human
cuccagcccagagguugugcc

SEQ ID NO: 318317 - RNA, 24 nt, Human
cuggauguuuacuggagacaggga

SEQ ID NO: 318318 - RNA, 18 nt, Human
cugggacccugaaaacag

SEQ ID NO: 318319 - RNA, 21 nt, Human
cuuaaaauaggacacaugcuc

SEQ ID NO: 318320 - RNA, 19 nt, Human
cuuaacuaagcugggaccc

SEQ ID NO: 318321 - RNA, 21 nt, Human
cuuuaaacuuacuagcugcca

SEQ ID NO: 318322 - RNA, 22 nt, Human
gagaaggagcgcucggguggug

SEQ ID NO: 318323 - RNA, 21 nt, Human
gagcauguuccaucaauccug

SEQ ID NO: 318324 - RNA, 23 nt, Human
gccuugagcaggagagcauguuc

SEQ ID NO: 318325 - RNA, 19 nt, Human
ggggccaauaucagagaag

SEQ ID NO: 318326 - RNA, 19 nt, Human
uaaaacacuaucagcaauc

SEQ ID NO: 318327 - RNA, 19 nt, Human
uaaaauaaagcagcccagg

SEQ ID NO: 318328 - RNA, 21 nt, Human
uaaaauaaagcagcccaggug

SEQ ID NO: 318329 - RNA, 22 nt, Human
uaaacuuacuagcugccaagua

SEQ ID NO: 318330 - RNA, 24 nt, Human
uaacuaagcugggacccugaaaac

SEQ ID NO: 318331 - RNA, 19 nt, Human
uaagguaaaugaaacauaa

SEQ ID NO: 318332 - RNA, 20 nt, Human
uaauggaagaaugugaaaua

SEQ ID NO: 318333 - RNA, 24 nt, Human
uacauucauuccauaaauacauua

SEQ ID NO: 318334 - RNA, 21 nt, Human
uacccuaaacuuccaaguggc

SEQ ID NO: 318335 - RNA, 23 nt, Human
uagaauguuaccaagucacagga

SEQ ID NO: 318336 - RNA, 19 nt, Human
uauaaaauaaagcagccca

SEQ ID NO: 318337 - RNA, 25 nt, Human
ucagcaaucaggauggcuauggggc

SEQ ID NO: 318338 - RNA, 23 nt, Human
ucagccuucuuuaccuuccaaaa

SEQ ID NO: 318339 - RNA, 19 nt, Human
ucaggagacaauccagcag

SEQ ID NO: 318340 - RNA, 22 nt, Human
ucccuuccuucccuuccucagg

SEQ ID NO: 318341 - RNA, 19 nt, Human
ucgggugguggggacaggc

SEQ ID NO: 318342 - RNA, 18 nt, Human
ucuaaaccuacaaagauc

SEQ ID NO: 318343 - RNA, 21 nt, Human
ugaauggcuggauguuuacug

SEQ ID NO: 318344 - RNA, 24 nt, Human
ugacuacugacugacugcugcuuu

SEQ ID NO: 318345 - RNA, 21 nt, Human
uggcuggauguuuacuggaga

SEQ ID NO: 318346 - RNA, 18 nt, Human
uguauuuuuccauuugca

SEQ ID NO: 318347 - RNA, 19 nt, Human
ugugccuugagcaggagag

SEQ ID NO: 318348 - RNA, 24 nt, Human
uguuaccaagucacaggaccagca

SEQ ID NO: 318349 - RNA, 19 nt, Human
uucccaccagaguccucua

SEQ ID NO: 318350 - RNA, 25 nt, Human
uuuuuuuuuuuuuuuuccgguauuu

SEQ ID NO: 318351 - RNA, 21 nt, Human
uuuuuuuuuuuuuuuuuccgg

SEQ ID NO: 318352 - RNA, 22 nt, Human
uuuuuuuuuuuuuuuuuccggu

SEQ ID NO: 318353 - RNA, 25 nt, Human
uuuuuuuuuuuuuuuuuuuuuccgg

SEQ ID NO: 318354 - RNA, 22 nt, Human
aaaauaaguaaaaugacuacau

SEQ ID NO: 318355 - RNA, 24 nt, Human
agccagaauuacaaaaacaaaaca

SEQ ID NO: 318356 - RNA, 23 nt, Human
auuacaaaaacaaaacauuuaga

SEQ ID NO: 318357 - RNA, 19 nt, Human
auuauaggcaagauucaag

SEQ ID NO: 318358 - RNA, 22 nt, Human
caggaccguugaucagaagcuu

SEQ ID NO: 318359 - RNA, 23 nt, Human
gccagaauuacaaaaacaaaaca

SEQ ID NO: 318360 - RNA, 21 nt, Human
uaaaaugacuacauaaacuca

SEQ ID NO: 318361 - RNA, 19 nt, Human
uaaccauguuuaaaagguc

SEQ ID NO: 318362 - RNA, 23 nt, Human
uacaaugaauacuucagcaaaga

SEQ ID NO: 318363 - RNA, 19 nt, Human
uagccagccaccaagaugu

SEQ ID NO: 318364 - RNA, 21 nt, Human
ugaauacuucagcaaagaaaa

SEQ ID NO: 318365 - RNA, 18 nt, Human
ugugguucuucucucagu

SEQ ID NO: 318366 - RNA, 21 nt, Human
ugugguucuucucucaguuga

SEQ ID NO: 318367 - RNA, 23 nt, Human
uucaaaaugcaaucccuggauuu

SEQ ID NO: 318368 - RNA, 21 nt, Human
uucaagaugaaaauuucagga

SEQ ID NO: 318369 - RNA, 27 nt, Human
aaccacaaguguuuauugcagaaaucu

SEQ ID NO: 318370 - RNA, 20 nt, Human
cacaaguguuuauugcagaa

SEQ ID NO: 318371 - RNA, 18 nt, Human
cagcacagggcugggcag

SEQ ID NO: 318372 - RNA, 19 nt, Human
cagggccccagcacagggc

SEQ ID NO: 318373 - RNA, 23 nt, Human
ccacuuccacuccgccuccuggc

SEQ ID NO: 318374 - RNA, 20 nt, Human
gauagggagggguggaggaa

SEQ ID NO: 318375 - RNA, 21 nt, Human
gggcugggcaggugagauagg

SEQ ID NO: 318376 - RNA, 24 nt, Human
uauugcagaaaucuggccaacauu

SEQ ID NO: 318377 - RNA, 19 nt, Human
uggccaacauuccaauugc

SEQ ID NO: 318378 - RNA, 18 nt, Human
uuuuccgcaaaccacaag

SEQ ID NO: 318379 - RNA, 19 nt, Human
agaagaaaggaggcaggga

SEQ ID NO: 318380 - RNA, 20 nt, Human
agaagaaaggaggcagggag

SEQ ID NO: 318381 - RNA, 23 nt, Human
agcaaagggaguccaggccucca

SEQ ID NO: 318382 - RNA, 22 nt, Human
aggcagaagaaaggaggcaggg

SEQ ID NO: 318383 - RNA, 19 nt, Human
aggcagggaguauggccug

SEQ ID NO: 318384 - RNA, 20 nt, Human
aggcagggaguauggccugg

SEQ ID NO: 318385 - RNA, 21 nt, Human
aggcagggaguauggccuggg

SEQ ID NO: 318386 - RNA, 26 nt, Human
agugcccauucaucuugucagaggca

SEQ ID NO: 318387 - RNA, 23 nt, Human
caaagggaguccaggccuccacu

SEQ ID NO: 318388 - RNA, 21 nt, Human
cacugcccgcaccgcggcacc

SEQ ID NO: 318389 - RNA, 19 nt, Human
cagaagaaaggaggcaggg

SEQ ID NO: 318390 - RNA, 19 nt, Human
caggccagucccuucccca

SEQ ID NO: 318391 - RNA, 22 nt, Human
caucugaacccccagauuacua

SEQ ID NO: 318392 - RNA, 18 nt, Human
caugugaagaggaacugg

SEQ ID NO: 318393 - RNA, 22 nt, Human
ccagcaaaugccaggggcuuca

SEQ ID NO: 318394 - RNA, 19 nt, Human
ccaggacaugccgcgccgg

SEQ ID NO: 318395 - RNA, 19 nt, Human
ccccagauuacuacccaag

SEQ ID NO: 318396 - RNA, 19 nt, Human
ccccagauuacuacccaag

SEQ ID NO: 318397 - RNA, 21 nt, Human
ccccgucgccgccgggagcac

SEQ ID NO: 318398 - RNA, 21 nt, Human
cccgcaccgcggcacccagga

SEQ ID NO: 318399 - RNA, 22 nt, Human
cccgcaccgcggcacccaggac

SEQ ID NO: 318400 - RNA, 26 nt, Human
ccucugguaggcagaagaaaggaggc

SEQ ID NO: 318401 - RNA, 27 nt, Human
cucugcucuagagauggcaguguccag

SEQ ID NO: 318402 - RNA, 28 nt, Human
cucugcucuagagauggcaguguccagg

SEQ ID NO: 318403 - RNA, 23 nt, Human
cugaacccccagauuacuaccca

SEQ ID NO: 318404 - RNA, 20 nt, Human
cuggauggauccacagauga

SEQ ID NO: 318405 - RNA, 18 nt, Human
gaaaggaggcagggagua

SEQ ID NO: 318406 - RNA, 27 nt, Human
gaugacgaaggcaagguuccugggaag

SEQ ID NO: 318407 - RNA, 21 nt, Human
gcagaagaaaggaggcaggga

SEQ ID NO: 318408 - RNA, 19 nt, Human
gccagucccuuccccagca

SEQ ID NO: 318409 - RNA, 21 nt, Human
ggaggcagggaguauggccuc

SEQ ID NO: 318410 - RNA, 22 nt, Human
ggcaagguuccugggaccugga

SEQ ID NO: 318411 - RNA, 25 nt, Human
guaggcagaagaaaggaggcaggga

SEQ ID NO: 318412 - RNA, 20 nt, Human
gugaagaggaacuggccaca

SEQ ID NO: 318413 - RNA, 19 nt, Human
uagagauggcaguguccag

SEQ ID NO: 318414 - RNA, 21 nt, Human
uaggcagaagaaaggaggcag

SEQ ID NO: 318415 - RNA, 20 nt, Human
ucacacagggccauagccaa

SEQ ID NO: 318416 - RNA, 19 nt, Human
ucaguucacucuuuccuuc

SEQ ID NO: 318417 - RNA, 23 nt, Human
ucaucuugucagaggcaaccuca

SEQ ID NO: 318418 - RNA, 23 nt, Human
ucaugugaagaggaacuggccac

SEQ ID NO: 318419 - RNA, 23 nt, Human
uccaggcuccugauucccaggaa

SEQ ID NO: 318420 - RNA, 22 nt, Human
ucccauuccucaagguaagggu

SEQ ID NO: 318421 - RNA, 24 nt, Human
uccccagcaaaugccaggggcuuc

SEQ ID NO: 318422 - RNA, 18 nt, Human
uccugauucccaggaagc

SEQ ID NO: 318423 - RNA, 24 nt, Human
ucuagauaaggacaagcucaacuc

SEQ ID NO: 318424 - RNA, 21 nt, Human
ugaacccccagauuacuaccc

SEQ ID NO: 318425 - RNA, 23 nt, Human
ugaacccccagauuacuacccaa

SEQ ID NO: 318426 - RNA, 25 nt, Human
ugaagaggaacuggccacaaggcug

SEQ ID NO: 318427 - RNA, 20 nt, Human
ugagcaaagggaguccaggc

SEQ ID NO: 318428 - RNA, 21 nt, Human
ugagcaaagggaguccaggcc

SEQ ID NO: 318429 - RNA, 22 nt, Human
ugaggggaggaggagaaacugu

SEQ ID NO: 318430 - RNA, 19 nt, Human
ugggcaucuucacauguuu

SEQ ID NO: 318431 - RNA, 21 nt, Human
ugguaggcagaagaaaggagg

SEQ ID NO: 318432 - RNA, 18 nt, Human
uucacuagaagggcaggc

SEQ ID NO: 318433 - RNA, 25 nt, Human
uuccugggaccuggagucacacagg

SEQ ID NO: 318434 - RNA, 24 nt, Human
uuuuuuuuuuuuuuuggggucuca

SEQ ID NO: 318435 - RNA, 22 nt, Human
uuuuuuuuuuuuuuuuuggggu

SEQ ID NO: 318436 - RNA, 23 nt, Human
uuuuuuuuuuuuuuuuuuugggg

SEQ ID NO: 318437 - RNA, 23 nt, Human
aaaccacagaaggccaggaguuu

SEQ ID NO: 318438 - RNA, 23 nt, Human
aaagaaggggagagagagaaaac

SEQ ID NO: 318439 - RNA, 19 nt, Human
aacuggguggaaccaaacu

SEQ ID NO: 318440 - RNA, 25 nt, Human
aagcugggagaaagaaggggagaga

SEQ ID NO: 318441 - RNA, 22 nt, Human
cagcagagagccagcuagaaga

SEQ ID NO: 318442 - RNA, 24 nt, Human
cagcuagaagaucugaucucccag

SEQ ID NO: 318443 - RNA, 22 nt, Human
cagcucugaguuuaguccuccu

SEQ ID NO: 318444 - RNA, 19 nt, Human
ccucccuucggcggagcug

SEQ ID NO: 318445 - RNA, 22 nt, Human
cucugaguuuaguccuccucuu

SEQ ID NO: 318446 - RNA, 21 nt, Human
gagggugggauaagggaggca

SEQ ID NO: 318447 - RNA, 26 nt, Human
gauaagggaggcaaagcugggagaaa

SEQ ID NO: 318448 - RNA, 20 nt, Human
gcagcagagagccagcuaga

SEQ ID NO: 318449 - RNA, 20 nt, Human
gcggucagagcagauccggu

SEQ ID NO: 318450 - RNA, 19 nt, Human
ggaaccaaacugaguccuu

SEQ ID NO: 318451 - RNA, 21 nt, Human
ggagagagagaaaacgaaugg

SEQ ID NO: 318452 - RNA, 25 nt, Human
ggcaaagcugggagaaagaagggga

SEQ ID NO: 318453 - RNA, 21 nt, Human
ggcggagcuguggcagcagag

SEQ ID NO: 318454 - RNA, 18 nt, Human
ggcugcagaagaauagau

SEQ ID NO: 318455 - RNA, 23 nt, Human
guccuccucuuccacccccuccc

SEQ ID NO: 318456 - RNA, 18 nt, Human
guuuaguccuccucuucc

SEQ ID NO: 318457 - RNA, 18 nt, Human
uaagggaggcaaagcugg

SEQ ID NO: 318458 - RNA, 21 nt, Human
uaguccuccucuuccaccccc

SEQ ID NO: 318459 - RNA, 19 nt, Human
ucccugccucgaggguggg

SEQ ID NO: 318460 - RNA, 20 nt, Human
uccucuuccacccccucccu

SEQ ID NO: 318461 - RNA, 18 nt, Human
ugcacugguugucuuuca

SEQ ID NO: 318462 - RNA, 26 nt, Human
ugccucuccucucagcucugaguuua

SEQ ID NO: 318463 - RNA, 19 nt, Human
ugcggucagagcagauccg

SEQ ID NO: 318464 - RNA, 23 nt, Human
ugggccccagccuucaagugcgg

SEQ ID NO: 318465 - RNA, 22 nt, Human
aaaaaaacaccaaaaaaccaca

SEQ ID NO: 318466 - RNA, 22 nt, Human
aaaaacaccaaaaaaccacaug

SEQ ID NO: 318467 - RNA, 23 nt, Human
aaaaaggagaagccuaaaaaaga

SEQ ID NO: 318468 - RNA, 19 nt, Human
aaaacuaacuuguugcaga

SEQ ID NO: 318469 - RNA, 23 nt, Human
aaccacaugugccuagacagggu

SEQ ID NO: 318470 - RNA, 23 nt, Human
aagaaacaccaaggccuugcuaa

SEQ ID NO: 318471 - RNA, 25 nt, Human
acaccaaggccuugcuaaaaaggag

SEQ ID NO: 318472 - RNA, 20 nt, Human
agaagucuucuccaugagaa

SEQ ID NO: 318473 - RNA, 18 nt, Human
agcaaucuaauauucaca

SEQ ID NO: 318474 - RNA, 22 nt, Human
aucccugucauucuuaaauaac

SEQ ID NO: 318475 - RNA, 22 nt, Human
caccaaaaaaccacaugugccu

SEQ ID NO: 318476 - RNA, 23 nt, Human
caccaaaaaaccacaugugccua

SEQ ID NO: 318477 - RNA, 25 nt, Human
caccaaggccuugcuaaaaaggaga

SEQ ID NO: 318478 - RNA, 21 nt, Human
caugcccuuaaaaaaaacacc

SEQ ID NO: 318479 - RNA, 22 nt, Human
ccaaaaaaccacaugugccuag

SEQ ID NO: 318480 - RNA, 19 nt, Human
ccacaugugccuagacagg

SEQ ID NO: 318481 - RNA, 20 nt, Human
ccacuucuggaguugccccu

SEQ ID NO: 318482 - RNA, 29 nt, Human
cccaacaugcccuuaaaaaaaacaccaag

SEQ ID NO: 318483 - RNA, 21 nt, Human
cccuuaaaaaaaacaccaaaa

SEQ ID NO: 318484 - RNA, 24 nt, Human
ccgacuaugauccuuaauucagca

SEQ ID NO: 318485 - RNA, 19 nt, Human
cucaauaugaagaaaccgg

SEQ ID NO: 318486 - RNA, 19 nt, Human
cucacagaaaacuccacuu

SEQ ID NO: 318487 - RNA, 24 nt, Human
gaauuccuuuuuuuuuuuuuuuuu

SEQ ID NO: 318488 - RNA, 20 nt, Human
gauccuuaauucagcaaucu

SEQ ID NO: 318489 - RNA, 25 nt, Human
ggaaaaagaaacaccaaggccuugc

SEQ ID NO: 318490 - RNA, 21 nt, Human
ggugucaacgugggaaagccc

SEQ ID NO: 318491 - RNA, 25 nt, Human
uaaaaaaaacaccaaaaaaccacau

SEQ ID NO: 318492 - RNA, 24 nt, Human
uaaaaaggagaagccuaaaaaaga

SEQ ID NO: 318493 - RNA, 18 nt, Human
uccuuuuuuuuuuuuuuu

SEQ ID NO: 318494 - RNA, 18 nt, Human
uccuuuuuuuuuuuuuuu

SEQ ID NO: 318495 - RNA, 18 nt, Human
ugcuaaaaaggagaagcc

SEQ ID NO: 318496 - RNA, 25 nt, Human
ugcuuuauucucacagaaaacucca

SEQ ID NO: 318497 - RNA, 23 nt, Human
uggaaaaagaaacaccaaggccu

SEQ ID NO: 318498 - RNA, 20 nt, Human
ugggaaagcccuugagguuu

SEQ ID NO: 318499 - RNA, 18 nt, Human
uguucaacuguagccugu

SEQ ID NO: 318500 - RNA, 18 nt, Human
uuuuuuuuuuuuuuuuug

SEQ ID NO: 318501 - RNA, 28 nt, Human
uuuuuuuuuuuuuuuuuuuuuuuggggg

SEQ ID NO: 318502 - RNA, 24 nt, Human
aaaaaaucccaaaauaaaccagag

SEQ ID NO: 318503 - RNA, 25 nt, Human
aaaauaaaccagagauuucaugcca

SEQ ID NO: 318504 - RNA, 20 nt, Human
aaaaucccaaaauaaaccag

SEQ ID NO: 318505 - RNA, 21 nt, Human
aacaaacuuugacaacaccaa

SEQ ID NO: 318506 - RNA, 23 nt, Human
acaacaaaaaaucccaaaauaaa

SEQ ID NO: 318507 - RNA, 26 nt, Human
acacaacuuuagaaaaaagggaacgc

SEQ ID NO: 318508 - RNA, 22 nt, Human
accuucuguugguccccuguua

SEQ ID NO: 318509 - RNA, 21 nt, Human
agaaaaaacaaacuuugacaa

SEQ ID NO: 318510 - RNA, 24 nt, Human
agccggguggccccauguggccuc

SEQ ID NO: 318511 - RNA, 22 nt, Human
aggagccgaaggccaggcaccu

SEQ ID NO: 318512 - RNA, 18 nt, Human
aggcagggaggacgcugg

SEQ ID NO: 318513 - RNA, 23 nt, Human
aggcagggaggacgcugggcagg

SEQ ID NO: 318514 - RNA, 24 nt, Human
aggcagggaggacgcugggcaggu

SEQ ID NO: 318515 - RNA, 21 nt, Human
aggcggagccaucccgaggga

SEQ ID NO: 318516 - RNA, 18 nt, Human
aggcgugauggaggcccc

SEQ ID NO: 318517 - RNA, 18 nt, Human
caaaucccagcuccagag

SEQ ID NO: 318518 - RNA, 23 nt, Human
caaaucccagcuccagaggccgc

SEQ ID NO: 318519 - RNA, 18 nt, Human
cacagcgaggguggccag

SEQ ID NO: 318520 - RNA, 23 nt, Human
caccagcugcucccaucagcucu

SEQ ID NO: 318521 - RNA, 19 nt, Human
caucacagcgaggguggcc

SEQ ID NO: 318522 - RNA, 23 nt, Human
caucacagcgaggguggccaggc

SEQ ID NO: 318523 - RNA, 20 nt, Human
caucccgagggagccgggug

SEQ ID NO: 318524 - RNA, 18 nt, Human
ccagcgcugccugcugug

SEQ ID NO: 318525 - RNA, 18 nt, Human
ccaggcuugucccggaag

SEQ ID NO: 318526 - RNA, 22 nt, Human
ccauauaaauaaagucagagca

SEQ ID NO: 318527 - RNA, 25 nt, Human
ccauguggccuccaugacguucccu

SEQ ID NO: 318528 - RNA, 24 nt, Human
ccuuggguucuggggacgcaggag

SEQ ID NO: 318529 - RNA, 20 nt, Human
cggaaggaggcagggaggac

SEQ ID NO: 318530 - RNA, 18 nt, Human
cggcccagggccaaucag

SEQ ID NO: 318531 - RNA, 18 nt, Human
cuccagaggccgcggccc

SEQ ID NO: 318532 - RNA, 21 nt, Human
gaagaaugggccggcccaggg

SEQ ID NO: 318533 - RNA, 18 nt, Human
gaaggaggcagggaggac

SEQ ID NO: 318534 - RNA, 21 nt, Human
gagccaucccgagggagccgg

SEQ ID NO: 318535 - RNA, 24 nt, Human
gccaaucagccagcucgucaucac

SEQ ID NO: 318536 - RNA, 22 nt, Human
gcggcugcggaagccuugggcc

SEQ ID NO: 318537 - RNA, 24 nt, Human
gggcggcugcggaagccuugggcc

SEQ ID NO: 318538 - RNA, 21 nt, Human
gguuagggugaaccuggaagc

SEQ ID NO: 318539 - RNA, 23 nt, Human
uaaucacacaacuuuagaaaaaa

SEQ ID NO: 318540 - RNA, 24 nt, Human
uaugggucuccagcaccccuccag

SEQ ID NO: 318541 - RNA, 20 nt, Human
uccaggggcggugaugucca

SEQ ID NO: 318542 - RNA, 18 nt, Human
ucccaaaauaaaccaggg

SEQ ID NO: 318543 - RNA, 18 nt, Human
ucccaaaucccagcucca

SEQ ID NO: 318544 - RNA, 21 nt, Human
ucccggaacgggcggcugcgg

SEQ ID NO: 318545 - RNA, 22 nt, Human
uccucccaaaucccagcuccag

SEQ ID NO: 318546 - RNA, 23 nt, Human
ucuuuuuuuuuuaguagaagcgg

SEQ ID NO: 318547 - RNA, 20 nt, Human
ugacaacaccaacaacaaaa

SEQ ID NO: 318548 - RNA, 21 nt, Human
ugacaacaccaacaacaaaaa

SEQ ID NO: 318549 - RNA, 23 nt, Human
ugacaacaccaacaacaaaaaau

SEQ ID NO: 318550 - RNA, 26 nt, Human
ugacaacaccaacaacaaaaaauccc

SEQ ID NO: 318551 - RNA, 20 nt, Human
ugaggaggaggagacacgug

SEQ ID NO: 318552 - RNA, 21 nt, Human
ugaggaggaggagacacgugu

SEQ ID NO: 318553 - RNA, 24 nt, Human
ugaggaggaggagacacguguggu

SEQ ID NO: 318554 - RNA, 28 nt, Human
ugcuguguccucccaaaucccagcucca

SEQ ID NO: 318555 - RNA, 19 nt, Human
uggcaggcgugugaagaau

SEQ ID NO: 318556 - RNA, 21 nt, Human
uggcaggcgugugaagaaugg

SEQ ID NO: 318557 - RNA, 21 nt, Human
uggccccauguggccuccaug

SEQ ID NO: 318558 - RNA, 20 nt, Human
uggccuccaugacguucccu

SEQ ID NO: 318559 - RNA, 25 nt, Human
ugggucuccagcaccccuccagcuu

SEQ ID NO: 318560 - RNA, 20 nt, Human
uugacaacaccaacaacaaa

SEQ ID NO: 318561 - RNA, 24 nt, Human
uuuuccaaguccaccaagcagguu

SEQ ID NO: 318562 - RNA, 26 nt, Human
uuuuccaaguccaccaagcagguuag

SEQ ID NO: 318563 - RNA, 23 nt, Human
aaauaugucaaauacccccacuc

SEQ ID NO: 318564 - RNA, 20 nt, Human
aagaacaauaagauagauaa

SEQ ID NO: 318565 - RNA, 24 nt, Human
aagaacaauaagauagauaacagc

SEQ ID NO: 318566 - RNA, 20 nt, Human
acacagauauccaggaaaaa

SEQ ID NO: 318567 - RNA, 21 nt, Human
agaaaaggggcauaucauuau

SEQ ID NO: 318568 - RNA, 21 nt, Human
augcuaacuacauugccuggu

SEQ ID NO: 318569 - RNA, 19 nt, Human
auuugggguguuauguaac

SEQ ID NO: 318570 - RNA, 19 nt, Human
cacaauccaagucagaguc

SEQ ID NO: 318571 - RNA, 19 nt, Human
cacuguguuucauuauuuu

SEQ ID NO: 318572 - RNA, 22 nt, Human
cacuguguuucauuauuuuucc

SEQ ID NO: 318573 - RNA, 18 nt, Human
cuguguuuuaauuuggga

SEQ ID NO: 318574 - RNA, 21 nt, Human
ggaugauaaaacuuaagcuuc

SEQ ID NO: 318575 - RNA, 21 nt, Human
guaaaauaugucaaauacccc

SEQ ID NO: 318576 - RNA, 18 nt, Human
guagacaaacacauccac

SEQ ID NO: 318577 - RNA, 24 nt, Human
uaaagcauaauccuuuaagaauuc

SEQ ID NO: 318578 - RNA, 20 nt, Human
uacccccacucuacaaauuc

SEQ ID NO: 318579 - RNA, 18 nt, Human
uagguaugaaauauuacc

SEQ ID NO: 318580 - RNA, 23 nt, Human
uaguacacuccacccuguaaaau

SEQ ID NO: 318581 - RNA, 18 nt, Human
uauccaggaaaaaaaggu

SEQ ID NO: 318582 - RNA, 21 nt, Human
ucacuguguuucauuauuuuu

SEQ ID NO: 318583 - RNA, 23 nt, Human
uccaagucagagucuuaauuuag

SEQ ID NO: 318584 - RNA, 23 nt, Human
ugaaaauacacagauauccagga

SEQ ID NO: 318585 - RNA, 27 nt, Human
uuaaagcauaauccuuuaagaauucau

SEQ ID NO: 318586 - RNA, 21 nt, Human
uugcuucucaagcuacuuuaa

SEQ ID NO: 318587 - RNA, 23 nt, Human
aaacaggauucccccaaugguga

SEQ ID NO: 318588 - RNA, 18 nt, Human
aagcagaggaggggaggc

SEQ ID NO: 318589 - RNA, 22 nt, Human
aauaaggaagacugccgaggaa

SEQ ID NO: 318590 - RNA, 21 nt, Human
acaccaggugccaggcaaagc

SEQ ID NO: 318591 - RNA, 22 nt, Human
acagagugaugauggucgaacg

SEQ ID NO: 318592 - RNA, 23 nt, Human
acucgugccaugucccaccggcc

SEQ ID NO: 318593 - RNA, 18 nt, Human
acugcuggcugggaccag

SEQ ID NO: 318594 - RNA, 20 nt, Human
agaaaaaucugaaacacaua

SEQ ID NO: 318595 - RNA, 21 nt, Human
agaaaaaucugaaacacauaa

SEQ ID NO: 318596 - RNA, 21 nt, Human
agacagagaugaagaugaagg

SEQ ID NO: 318597 - RNA, 18 nt, Human
agcaggccauuccagggg

SEQ ID NO: 318598 - RNA, 20 nt, Human
agcauuggcauggccaggaa

SEQ ID NO: 318599 - RNA, 21 nt, Human
agcugcccaggagagggcagc

SEQ ID NO: 318600 - RNA, 19 nt, Human
aggaggggaggcagcugcc

SEQ ID NO: 318601 - RNA, 18 nt, Human
agguggagggagggaugg

SEQ ID NO: 318602 - RNA, 22 nt, Human
caaagcgccgagagaaagcgua

SEQ ID NO: 318603 - RNA, 25 nt, Human
cacaccaggugccaggcaaagcgcc

SEQ ID NO: 318604 - RNA, 20 nt, Human
caccaggugccaggcaaagc

SEQ ID NO: 318605 - RNA, 18 nt, Human
cagaaggagcggaguucc

SEQ ID NO: 318606 - RNA, 19 nt, Human
cauuuuauugcagggaggu

SEQ ID NO: 318607 - RNA, 20 nt, Human
cauuuuauugcagggagguu

SEQ ID NO: 318608 - RNA, 23 nt, Human
ccacaccaggugccaggcaaagc

SEQ ID NO: 318609 - RNA, 22 nt, Human
ccagguacugcagacagagaug

SEQ ID NO: 318610 - RNA, 21 nt, Human
ccaggugccaggcaaagcgcc

SEQ ID NO: 318611 - RNA, 18 nt, Human
ccauucccagggcacagg

SEQ ID NO: 318612 - RNA, 23 nt, Human
cccaauggugagcauuggcaugg

SEQ ID NO: 318613 - RNA, 18 nt, Human
ccuuuguggugccauucc

SEQ ID NO: 318614 - RNA, 22 nt, Human
cuccgaacugagugaaggcaaa

SEQ ID NO: 318615 - RNA, 20 nt, Human
cugccccugggucucuuccu

SEQ ID NO: 318616 - RNA, 24 nt, Human
cugccgaggaagagucaaaugcuc

SEQ ID NO: 318617 - RNA, 20 nt, Human
cugcuucugcccugccccug

SEQ ID NO: 318618 - RNA, 19 nt, Human
gagcauuggcauggccagg

SEQ ID NO: 318619 - RNA, 27 nt, Human
gcaaagcgccgagagaaagcguagcuc

SEQ ID NO: 318620 - RNA, 18 nt, Human
gcaagcagaggaggggag

SEQ ID NO: 318621 - RNA, 21 nt, Human
gccaaauagguucccaaucug

SEQ ID NO: 318622 - RNA, 21 nt, Human
gccacaacuguaucacagaca

SEQ ID NO: 318623 - RNA, 18 nt, Human
gcccugaggcugaugccc

SEQ ID NO: 318624 - RNA, 26 nt, Human
gcguagcuccagaaggaggggaacgc

SEQ ID NO: 318625 - RNA, 23 nt, Human
ggaagagucaaaugcuccauugu

SEQ ID NO: 318626 - RNA, 20 nt, Human
ggagagggcagcucugaacu

SEQ ID NO: 318627 - RNA, 18 nt, Human
ggaguuccugcuucugcc

SEQ ID NO: 318628 - RNA, 21 nt, Human
ggcauuuguguaggugcugac

SEQ ID NO: 318629 - RNA, 23 nt, Human
ggguaugggaugugcccccgggg

SEQ ID NO: 318630 - RNA, 23 nt, Human
ggugguguagaaaaaucugaaac

SEQ ID NO: 318631 - RNA, 21 nt, Human
guagcucccuguuuucaugcu

SEQ ID NO: 318632 - RNA, 19 nt, Human
guucccaaucugcagguug

SEQ ID NO: 318633 - RNA, 24 nt, Human
guuccugcuucugcccugccccug

SEQ ID NO: 318634 - RNA, 21 nt, Human
uaaagaaugugguccucggau

SEQ ID NO: 318635 - RNA, 19 nt, Human
uaagccgguccaugagcag

SEQ ID NO: 318636 - RNA, 18 nt, Human
uaauaauaaggaagacug

SEQ ID NO: 318637 - RNA, 19 nt, Human
uccaugagcaggccauucc

SEQ ID NO: 318638 - RNA, 21 nt, Human
uccucggauguuaaaagaccc

SEQ ID NO: 318639 - RNA, 24 nt, Human
ucggauguuaaaagacccugucuu

SEQ ID NO: 318640 - RNA, 24 nt, Human
ugaugagaaacaggauucccccaa

SEQ ID NO: 318641 - RNA, 22 nt, Human
ugcauggggcaggugaugauuu

SEQ ID NO: 318642 - RNA, 30 nt, Human
ugccagguacugcagacagagaugaagauu

SEQ ID NO: 318643 - RNA, 21 nt, Human
ugcuccauuguacagagugau

SEQ ID NO: 318644 - RNA, 22 nt, Human
ugcuuccuucugguacuucugu

SEQ ID NO: 318645 - RNA, 19 nt, Human
uggccaaauagguucccaa

SEQ ID NO: 318646 - RNA, 21 nt, Human
uggccaggaagagcagcacgg

SEQ ID NO: 318647 - RNA, 20 nt, Human
uggugccauucccagggcac

SEQ ID NO: 318648 - RNA, 21 nt, Human
ugugguccucggauguuaaaa

SEQ ID NO: 318649 - RNA, 20 nt, Human
uuccuucugguacuucuguu

SEQ ID NO: 318650 - RNA, 22 nt, Human
uucuugcuuccuucugguacuu

SEQ ID NO: 318651 - RNA, 22 nt, Human
uuggaaaguauaaagaaugugg

SEQ ID NO: 318652 - RNA, 18 nt, Human
agcaggagagguuggggg

SEQ ID NO: 318653 - RNA, 18 nt, Human
caccacaucauuggcauc

SEQ ID NO: 318654 - RNA, 19 nt, Human
cgggagggagcugcuggca

SEQ ID NO: 318655 - RNA, 24 nt, Human
cgguaguucucccgccuggccucu

SEQ ID NO: 318656 - RNA, 23 nt, Human
cuccaccguccuucuuggggcug

SEQ ID NO: 318657 - RNA, 24 nt, Human
cucucucucucccauuuuuguuuu

SEQ ID NO: 318658 - RNA, 20 nt, Human
gccaagcaguccguacgccc

SEQ ID NO: 318659 - RNA, 19 nt, Human
ggacgggagggagcugcug

SEQ ID NO: 318660 - RNA, 21 nt, Human
gguaguucucccgccuggccu

SEQ ID NO: 318661 - RNA, 26 nt, Human
guuuaauaccucucucucucccauuu

SEQ ID NO: 318662 - RNA, 25 nt, Human
uagccaccacaucauuggcaucuua

SEQ ID NO: 318663 - RNA, 33 nt, Human
uaguauagccccuuccaagagucugagaccuuu

SEQ ID NO: 318664 - RNA, 19 nt, Human
uaguucucccgccuggccu

SEQ ID NO: 318665 - RNA, 23 nt, Human
uaugagcaggagagguuggggga

SEQ ID NO: 318666 - RNA, 21 nt, Human
uccguacgcccaccugcugcg

SEQ ID NO: 318667 - RNA, 23 nt, Human
uccguacgcccaccugcugcggu

SEQ ID NO: 318668 - RNA, 19 nt, Human
ugcgccaagcaguccguac

SEQ ID NO: 318669 - RNA, 19 nt, Human
ugcugcgguaguucucccg

SEQ ID NO: 318670 - RNA, 22 nt, Human
ugugugucuaguauagccccuu

SEQ ID NO: 318671 - RNA, 23 nt, Human
uguuuaauaccucucucucuccc

SEQ ID NO: 318672 - RNA, 18 nt, Human
uucuuggggcugucuuug

SEQ ID NO: 318673 - RNA, 18 nt, Human
uugggggacgggagggag

SEQ ID NO: 318674 - RNA, 23 nt, Human
uuuuuuuuuuuauccucuaaggg

SEQ ID NO: 318675 - RNA, 19 nt, Human
aaagagggauuaaucugcu

SEQ ID NO: 318676 - RNA, 23 nt, Human
aauggucuguaaacaauaacaac

SEQ ID NO: 318677 - RNA, 22 nt, Human
augcaaugggagggagaggagg

SEQ ID NO: 318678 - RNA, 24 nt, Human
augcaaugggagggagaggaggaa

SEQ ID NO: 318679 - RNA, 19 nt, Human
auuuauugauuucuuccuu

SEQ ID NO: 318680 - RNA, 19 nt, Human
uaagauuaucaaaucuguu

SEQ ID NO: 318681 - RNA, 21 nt, Human
uaccuuagauauauaauaaau

SEQ ID NO: 318682 - RNA, 20 nt, Human
ucuguaaacuucauguagac

SEQ ID NO: 318683 - RNA, 23 nt, Human
ugaauaagauuaucaaaucuguu

SEQ ID NO: 318684 - RNA, 23 nt, Human
uguaaaauuuuaauauuuccaug

SEQ ID NO: 318685 - RNA, 21 nt, Human
uuaaaagauauauucaauuug

SEQ ID NO: 318686 - RNA, 22 nt, Human
uuaauauuuccauguuuuccaa

SEQ ID NO: 318687 - RNA, 22 nt, Human
uucuuuuacaggugugagccau

SEQ ID NO: 318688 - RNA, 24 nt, Human
uuuauuuuuuuaauguuccaaagu

SEQ ID NO: 318689 - RNA, 19 nt, Human
uuuuuuuuuuuuaagccuc

SEQ ID NO: 318690 - RNA, 20 nt, Human
uuuuuuuuuuuuuuuuuaag

SEQ ID NO: 318691 - RNA, 23 nt, Human
aacacuguuaucuucuuauucac

SEQ ID NO: 318692 - RNA, 21 nt, Human
aggaggcucuggugucacucc

SEQ ID NO: 318693 - RNA, 23 nt, Human
aucuucuuauucacuuccuguca

SEQ ID NO: 318694 - RNA, 21 nt, Human
cuuccugucauugaauccugg

SEQ ID NO: 318695 - RNA, 19 nt, Human
ugaaacacuguuaucuucu

SEQ ID NO: 318696 - RNA, 23 nt, Human
aacacugucaucuucuuauucac

SEQ ID NO: 318697 - RNA, 23 nt, Human
acucccaacuuuucccccccccu

SEQ ID NO: 318698 - RNA, 21 nt, Human
agaaggcucuggugucacucc

SEQ ID NO: 318699 - RNA, 23 nt, Human
aggcucuggugucacucccaacu

SEQ ID NO: 318700 - RNA, 21 nt, Human
aucacauuauguuucaaggca

SEQ ID NO: 318701 - RNA, 24 nt, Human
caucuucuuauucacuuccuguca

SEQ ID NO: 318702 - RNA, 21 nt, Human
cuuccugucauugaauccuag

SEQ ID NO: 318703 - RNA, 19 nt, Human
cuugcagaaggcucuggug

SEQ ID NO: 318704 - RNA, 25 nt, Human
gucaucuucuuauucacuuccuguc

SEQ ID NO: 318705 - RNA, 21 nt, Human
ucccaacuuuucccccccccu

SEQ ID NO: 318706 - RNA, 19 nt, Human
ugaaacacugucaucuucu

SEQ ID NO: 318707 - RNA, 20 nt, Human
cagaagauauccacaauggu

SEQ ID NO: 318708 - RNA, 20 nt, Human
gaaggcagaagauauccaca

SEQ ID NO: 318709 - RNA, 21 nt, Human
uugaaggcagaagauauccac

SEQ ID NO: 318710 - RNA, 20 nt, Human
aaaaaaggccaggcacagug

SEQ ID NO: 318711 - RNA, 25 nt, Human
aaacaggaaacaggcuauugaggaa

SEQ ID NO: 318712 - RNA, 24 nt, Human
aaacucggaaaacacaaacggugg

SEQ ID NO: 318713 - RNA, 24 nt, Human
aaaggccaggcacaguggcucaca

SEQ ID NO: 318714 - RNA, 20 nt, Human
aacuacuugggaggcugagg

SEQ ID NO: 318715 - RNA, 21 nt, Human
aacuccuccucuuuccuucug

SEQ ID NO: 318716 - RNA, 18 nt, Human
acaaaaaaaaauugaaaa

SEQ ID NO: 318717 - RNA, 24 nt, Human
acgcugaggugugaggaucgcuug

SEQ ID NO: 318718 - RNA, 21 nt, Human
aggaucacuugagcugggaag

SEQ ID NO: 318719 - RNA, 24 nt, Human
aggcacaguggcucacaacuguaa

SEQ ID NO: 318720 - RNA, 24 nt, Human
aggcugagguaggaggaucacuug

SEQ ID NO: 318721 - RNA, 18 nt, Human
agguaggaggaucacuug

SEQ ID NO: 318722 - RNA, 23 nt, Human
agguaggaggaucacuugagcug

SEQ ID NO: 318723 - RNA, 24 nt, Human
aguggcucacaacuguaaucccag

SEQ ID NO: 318724 - RNA, 23 nt, Human
caaaggcaaaaucuuaaaaacag

SEQ ID NO: 318725 - RNA, 23 nt, Human
caacuguaaucccagcacucugg

SEQ ID NO: 318726 - RNA, 24 nt, Human
caacuguaaucccagcacucuggg

SEQ ID NO: 318727 - RNA, 26 nt, Human
caagaauacaaacucggaaaacacaa

SEQ ID NO: 318728 - RNA, 24 nt, Human
cacaacuguaaucccagcacucug

SEQ ID NO: 318729 - RNA, 25 nt, Human
cacaccuguguguccuaacuacuug

SEQ ID NO: 318730 - RNA, 24 nt, Human
cacugcacuaagccuuggugacag

SEQ ID NO: 318731 - RNA, 21 nt, Human
caggaaacaggcuauugagga

SEQ ID NO: 318732 - RNA, 21 nt, Human
cccaggagucugagaucugcc

SEQ ID NO: 318733 - RNA, 22 nt, Human
ccccccaccucuacaaaaaaaa

SEQ ID NO: 318734 - RNA, 20 nt, Human
cuccuaaaauaggacuuaaa

SEQ ID NO: 318735 - RNA, 18 nt, Human
cuccuccucuuuccuucu

SEQ ID NO: 318736 - RNA, 18 nt, Human
cugggaaggucaaggcug

SEQ ID NO: 318737 - RNA, 19 nt, Human
gaaaacacaaacgguggca

SEQ ID NO: 318738 - RNA, 23 nt, Human
gaugcagugaagagagaaguuaa

SEQ ID NO: 318739 - RNA, 18 nt, Human
gcagugaagagagaaguu

SEQ ID NO: 318740 - RNA, 23 nt, Human
ggaaaacacaaacgguggcagcc

SEQ ID NO: 318741 - RNA, 24 nt, Human
ggagaccccccaccucuacaaaaa

SEQ ID NO: 318742 - RNA, 19 nt, Human
uaaaaaaaaaaaaaggcca

SEQ ID NO: 318743 - RNA, 18 nt, Human
uaaaugacaucacucaag

SEQ ID NO: 318744 - RNA, 24 nt, Human
uaacaaaaaugguccagaaaagga

SEQ ID NO: 318745 - RNA, 19 nt, Human
uacaaagugauuaagaguu

SEQ ID NO: 318746 - RNA, 24 nt, Human
uacaaagugauuaagaguuaaaac

SEQ ID NO: 318747 - RNA, 18 nt, Human
uagaaacuccuccucuuu

SEQ ID NO: 318748 - RNA, 27 nt, Human
uauuaacaaaaaugguccagaaaagga

SEQ ID NO: 318749 - RNA, 18 nt, Human
ucaaagcaaaauauagug

SEQ ID NO: 318750 - RNA, 24 nt, Human
ucaaagcaaaauauagugaaaguc

SEQ ID NO: 318751 - RNA, 19 nt, Human
ucacugcacuaagccuugg

SEQ ID NO: 318752 - RNA, 23 nt, Human
ucccggguggcgggagaguucau

SEQ ID NO: 318753 - RNA, 21 nt, Human
uccuccucuuuccuucuguca

SEQ ID NO: 318754 - RNA, 21 nt, Human
ucgcuugagcccaggagucug

SEQ ID NO: 318755 - RNA, 23 nt, Human
ugagcccaggagucugagaucug

SEQ ID NO: 318756 - RNA, 24 nt, Human
ugagcugggaaggucaaggcugca

SEQ ID NO: 318757 - RNA, 20 nt, Human
ugagguaggaggaucacuug

SEQ ID NO: 318758 - RNA, 21 nt, Human
ugagguaggaggaucacuuga

SEQ ID NO: 318759 - RNA, 23 nt, Human
ugagguaggaggaucacuugagc

SEQ ID NO: 318760 - RNA, 24 nt, Human
ugaggugugaggaucgcuugagcc

SEQ ID NO: 318761 - RNA, 18 nt, Human
ugccugggcaacauaggg

SEQ ID NO: 318762 - RNA, 22 nt, Human
ugccugggcaacauagggagac

SEQ ID NO: 318763 - RNA, 22 nt, Human
uggcucacaacuguaaucccag

SEQ ID NO: 318764 - RNA, 24 nt, Human
uggcucacaacuguaaucccagca

SEQ ID NO: 318765 - RNA, 20 nt, Human
ugggaaggucaaggcugcaa

SEQ ID NO: 318766 - RNA, 19 nt, Human
ugggaggcugagguaggag

SEQ ID NO: 318767 - RNA, 19 nt, Human
ugggaggcugagguaggag

SEQ ID NO: 318768 - RNA, 24 nt, Human
ugggaggcugagguaggaggauca

SEQ ID NO: 318769 - RNA, 22 nt, Human
ugggaugcagugaagagagaag

SEQ ID NO: 318770 - RNA, 25 nt, Human
uugggaggcugagguaggaggauca

SEQ ID NO: 318771 - RNA, 18 nt, Human
uaacuugauuacaaaugg

SEQ ID NO: 318772 - RNA, 26 nt, Human
uaggcuuuuaacuauaaaucauguuc

SEQ ID NO: 318773 - RNA, 20 nt, Human
uggcugugacuuauuaugca

SEQ ID NO: 318774 - RNA, 18 nt, Human
aauagcauugugugcccc

SEQ ID NO: 318775 - RNA, 25 nt, Human
accacagucuucuguugaauacacu

SEQ ID NO: 318776 - RNA, 23 nt, Human
agaauauaacugauuuucauagu

SEQ ID NO: 318777 - RNA, 18 nt, Human
agcaaagcaaggaggugu

SEQ ID NO: 318778 - RNA, 23 nt, Human
auauuuuguuuucaguaauuuca

SEQ ID NO: 318779 - RNA, 25 nt, Human
caaagcaaggagguguugccaaacc

SEQ ID NO: 318780 - RNA, 22 nt, Human
cacccuuacauugagaugguuc

SEQ ID NO: 318781 - RNA, 18 nt, Human
caccgccugccgcuccgc

SEQ ID NO: 318782 - RNA, 19 nt, Human
cagaaagaaacuagagaca

SEQ ID NO: 318783 - RNA, 19 nt, Human
cagauauuuuguuuucagu

SEQ ID NO: 318784 - RNA, 23 nt, Human
ccucgcuccaccgccugccgcuc

SEQ ID NO: 318785 - RNA, 21 nt, Human
cuagccgccgccgccgccgcu

SEQ ID NO: 318786 - RNA, 19 nt, Human
cucgcuccaccgccugccg

SEQ ID NO: 318787 - RNA, 29 nt, Human
gccgcuccgcuagccgccgccgccgccgg

SEQ ID NO: 318788 - RNA, 18 nt, Human
gugccccuggaaauaauu

SEQ ID NO: 318789 - RNA, 18 nt, Human
uaaacacagcauaaagcc

SEQ ID NO: 318790 - RNA, 25 nt, Human
uacaccaaacagcaaagcaaggagg

SEQ ID NO: 318791 - RNA, 19 nt, Human
uagaaaaacuuggcuucug

SEQ ID NO: 318792 - RNA, 25 nt, Human
uagugcaauaacagaaagaaacuag

SEQ ID NO: 318793 - RNA, 22 nt, Human
uauugcaguggauauuauccaa

SEQ ID NO: 318794 - RNA, 18 nt, Human
ucgcuccaccgccugccg

SEQ ID NO: 318795 - RNA, 20 nt, Human
ucugaaaucuuggaggcagg

SEQ ID NO: 318796 - RNA, 23 nt, Human
ugaguuaguuacagcuguuuuua

SEQ ID NO: 318797 - RNA, 24 nt, Human
ugcaauaacagaaagaaacuagag

SEQ ID NO: 318798 - RNA, 26 nt, Human
ugcaauaacagaaagaaacuagagac

SEQ ID NO: 318799 - RNA, 18 nt, Human
uguuacaugaccacaguc

SEQ ID NO: 318800 - RNA, 19 nt, Human
uguuacaugaccacagucu

SEQ ID NO: 318801 - RNA, 25 nt, Human
uuacuacaccaaacagcaaagcaag

SEQ ID NO: 318802 - RNA, 23 nt, Human
uuggcuucugaaaucuuggaggc

SEQ ID NO: 318803 - RNA, 21 nt, Human
aaaaacacacagaugacugga

SEQ ID NO: 318804 - RNA, 23 nt, Human
aaacacacagaugacuggaaaug

SEQ ID NO: 318805 - RNA, 21 nt, Human
aaaugagcaauguacagucca

SEQ ID NO: 318806 - RNA, 19 nt, Human
aacacugucaccuauuaug

SEQ ID NO: 318807 - RNA, 21 nt, Human
acaaaaaaggguacccccaaa

SEQ ID NO: 318808 - RNA, 22 nt, Human
acaaaaaaggguacccccaaac

SEQ ID NO: 318809 - RNA, 19 nt, Human
acaauuguaaaaccucauc

SEQ ID NO: 318810 - RNA, 28 nt, Human
acacugucaccuauuaugacuggaauaa

SEQ ID NO: 318811 - RNA, 21 nt, Human
acaucuuccugacccagacuc

SEQ ID NO: 318812 - RNA, 21 nt, Human
acccugagcaagggacucccg

SEQ ID NO: 318813 - RNA, 26 nt, Human
acuggaauaaaaagcuggacaaccug

SEQ ID NO: 318814 - RNA, 19 nt, Human
agacucagaaggcugcugu

SEQ ID NO: 318815 - RNA, 18 nt, Human
agccucaugcaccgcggg

SEQ ID NO: 318816 - RNA, 19 nt, Human
aggcaagaccaacacugua

SEQ ID NO: 318817 - RNA, 19 nt, Human
aggggcagagguccugagc

SEQ ID NO: 318818 - RNA, 21 nt, Human
augaguccccgaggcucaaag

SEQ ID NO: 318819 - RNA, 20 nt, Human
caaguucuacauuccuuuca

SEQ ID NO: 318820 - RNA, 21 nt, Human
cacaaaaaaggguacccccaa

SEQ ID NO: 318821 - RNA, 23 nt, Human
cacaaaaaaggguacccccaaac

SEQ ID NO: 318822 - RNA, 24 nt, Human
cacagaccgaggcgcugcaggagc

SEQ ID NO: 318823 - RNA, 19 nt, Human
caccccucccucuuuucuu

SEQ ID NO: 318824 - RNA, 19 nt, Human
caccucccuggagccgaga

SEQ ID NO: 318825 - RNA, 21 nt, Human
caccucugcuuacaaaaagag

SEQ ID NO: 318826 - RNA, 27 nt, Human
cauuuuuggcuuaagaaaaaucgagaa

SEQ ID NO: 318827 - RNA, 23 nt, Human
ccaaaggacaucuuccugaccca

SEQ ID NO: 318828 - RNA, 19 nt, Human
ccccaaacucagguauacc

SEQ ID NO: 318829 - RNA, 21 nt, Human
cccggaaccgcgggucccaag

SEQ ID NO: 318830 - RNA, 24 nt, Human
ccucccucucccaccaggagcaaa

SEQ ID NO: 318831 - RNA, 18 nt, Human
ccucgggccgggagccgg

SEQ ID NO: 318832 - RNA, 19 nt, Human
ccugcccaggcaagccgcg

SEQ ID NO: 318833 - RNA, 18 nt, Human
cgacucccgggaaacuga

SEQ ID NO: 318834 - RNA, 23 nt, Human
cggaaggagucggagcaccagga

SEQ ID NO: 318835 - RNA, 18 nt, Human
cucacagcaaccugggcu

SEQ ID NO: 318836 - RNA, 22 nt, Human
cucagguauaccaaguaaauaa

SEQ ID NO: 318837 - RNA, 23 nt, Human
cucagucccuguuucccagaauu

SEQ ID NO: 318838 - RNA, 22 nt, Human
cucccggaaccgcgggucccaa

SEQ ID NO: 318839 - RNA, 21 nt, Human
cuuaagaaaaaucgagaaugu

SEQ ID NO: 318840 - RNA, 21 nt, Human
gaagauaaaccgacacuuucc

SEQ ID NO: 318841 - RNA, 18 nt, Human
gacaccucccuggagccg

SEQ ID NO: 318842 - RNA, 20 nt, Human
gacaggcaagaccaacacug

SEQ ID NO: 318843 - RNA, 22 nt, Human
gacuguaagaaacaauuguaaa

SEQ ID NO: 318844 - RNA, 23 nt, Human
gagcucacuccucccucucccac

SEQ ID NO: 318845 - RNA, 26 nt, Human
gagcuuccgcugacucacagcaaccu

SEQ ID NO: 318846 - RNA, 19 nt, Human
gaguccccgaggcucaaag

SEQ ID NO: 318847 - RNA, 22 nt, Human
gaucauccagcugaauggagaa

SEQ ID NO: 318848 - RNA, 23 nt, Human
ggcagagguccugagcaaggugc

SEQ ID NO: 318849 - RNA, 22 nt, Human
ggccucaacagggacaaguggc

SEQ ID NO: 318850 - RNA, 21 nt, Human
ggucccaaggagccugcggaa

SEQ ID NO: 318851 - RNA, 20 nt, Human
gucugcuuugguccaaagga

SEQ ID NO: 318852 - RNA, 23 nt, Human
uacccccaaacucagguauacca

SEQ ID NO: 318853 - RNA, 24 nt, Human
ucaugcaccgcggggccagggcug

SEQ ID NO: 318854 - RNA, 25 nt, Human
uccauagccaggccucaacagggac

SEQ ID NO: 318855 - RNA, 21 nt, Human
ucccaccaggagcaaagggca

SEQ ID NO: 318856 - RNA, 18 nt, Human
ucccuggagccgagagac

SEQ ID NO: 318857 - RNA, 25 nt, Human
uccucugccaccccucccucuuuuc

SEQ ID NO: 318858 - RNA, 22 nt, Human
uccugacccagacucagaaggc

SEQ ID NO: 318859 - RNA, 20 nt, Human
uccugggccaccauccgccc

SEQ ID NO: 318860 - RNA, 21 nt, Human
uccugggccaccauccgcccc

SEQ ID NO: 318861 - RNA, 26 nt, Human
ucggagcaccaggacaccacgccccc

SEQ ID NO: 318862 - RNA, 22 nt, Human
ugaaaagucacaaaaaagggua

SEQ ID NO: 318863 - RNA, 19 nt, Human
ugacaccucccuggagccg

SEQ ID NO: 318864 - RNA, 19 nt, Human
ugagcagaguucaugugac

SEQ ID NO: 318865 - RNA, 18 nt, Human
ugcagagccagccaccuc

SEQ ID NO: 318866 - RNA, 18 nt, Human
ugcaggaaagggacccug

SEQ ID NO: 318867 - RNA, 19 nt, Human
ugcaggaaagggacccuga

SEQ ID NO: 318868 - RNA, 18 nt, Human
ugcccaggcaagccgcgg

SEQ ID NO: 318869 - RNA, 23 nt, Human
ugcccaggcaagccgcggcaaga

SEQ ID NO: 318870 - RNA, 21 nt, Human
ugcggggacacagggaaggcg

SEQ ID NO: 318871 - RNA, 18 nt, Human
ugcuaggaggacugucac

SEQ ID NO: 318872 - RNA, 22 nt, Human
uggagccgagagacaaucuguu

SEQ ID NO: 318873 - RNA, 21 nt, Human
ugggggucugcggggacacag

SEQ ID NO: 318874 - RNA, 18 nt, Human
ugguggugugcugucucc

SEQ ID NO: 318875 - RNA, 22 nt, Human
uguaaaaccucaucuagaaauc

SEQ ID NO: 318876 - RNA, 24 nt, Human
uuauugcugagcagaguucaugug

SEQ ID NO: 318877 - RNA, 24 nt, Human
uugaaacuuguccaucaaggugac

SEQ ID NO: 318878 - RNA, 23 nt, Human
uugccgagcucucgcaaucgcgc

SEQ ID NO: 318879 - RNA, 22 nt, Human
uuucacgguuaacacugucacc

SEQ ID NO: 318880 - RNA, 21 nt, Human
uuugaaggacaggcaagacca

SEQ ID NO: 318881 - RNA, 24 nt, Human
uuugaaggacaggcaagaccaaca

SEQ ID NO: 318882 - RNA, 24 nt, Human
uuuuuuuuuuuuuuuuuuacaaag

SEQ ID NO: 318883 - RNA, 22 nt, Human
aaaaagaaaaaagaaaacccau

SEQ ID NO: 318884 - RNA, 22 nt, Human
aaaaagaaaacccaugggggca

SEQ ID NO: 318885 - RNA, 18 nt, Human
aaagcacaaaugagaaag

SEQ ID NO: 318886 - RNA, 20 nt, Human
aagaggaagggaaaaguggg

SEQ ID NO: 318887 - RNA, 22 nt, Human
aagcaacccacugaacauguca

SEQ ID NO: 318888 - RNA, 20 nt, Human
aagcccaagggugaagacag

SEQ ID NO: 318889 - RNA, 21 nt, Human
aagcgugagccccucuuucca

SEQ ID NO: 318890 - RNA, 19 nt, Human
accaaaaaaaagaaaaaag

SEQ ID NO: 318891 - RNA, 19 nt, Human
accccaggccugagaacuc

SEQ ID NO: 318892 - RNA, 19 nt, Human
agaaaaaagaaaaaagaaa

SEQ ID NO: 318893 - RNA, 21 nt, Human
agaaaaaagcacaaaugagaa

SEQ ID NO: 318894 - RNA, 21 nt, Human
agaaacucguuuaaaacaggc

SEQ ID NO: 318895 - RNA, 18 nt, Human
agacaggucuguugggga

SEQ ID NO: 318896 - RNA, 18 nt, Human
agagaaaaaagcacaaau

SEQ ID NO: 318897 - RNA, 23 nt, Human
agagaaaaaagcacaaaugagaa

SEQ ID NO: 318898 - RNA, 21 nt, Human
agaggaagggaaaagugggag

SEQ ID NO: 318899 - RNA, 21 nt, Human
agcaaguggggccugugguug

SEQ ID NO: 318900 - RNA, 23 nt, Human
agcacacuguucaagaggaaguc

SEQ ID NO: 318901 - RNA, 18 nt, Human
agcgccucccuuuccaaa

SEQ ID NO: 318902 - RNA, 24 nt, Human
aggaagggaaaagugggagagggg

SEQ ID NO: 318903 - RNA, 22 nt, Human
aggaauggggggacaugggagg

SEQ ID NO: 318904 - RNA, 20 nt, Human
agggagggaggcacuggugg

SEQ ID NO: 318905 - RNA, 21 nt, Human
aggggcuggggggcugugggg

SEQ ID NO: 318906 - RNA, 22 nt, Human
aggggcuggggggcugugggga

SEQ ID NO: 318907 - RNA, 20 nt, Human
caacccacugaacaugucac

SEQ ID NO: 318908 - RNA, 22 nt, Human
caacccucccacccccccgacc

SEQ ID NO: 318909 - RNA, 22 nt, Human
caagaccuggucugacuggagu

SEQ ID NO: 318910 - RNA, 19 nt, Human
caagaggaagucucguccu

SEQ ID NO: 318911 - RNA, 19 nt, Human
caagcaacccacugaacau

SEQ ID NO: 318912 - RNA, 28 nt, Human
caauccaacccucccacccccccgacca

SEQ ID NO: 318913 - RNA, 23 nt, Human
cacccggggccccaccccaggcc

SEQ ID NO: 318914 - RNA, 21 nt, Human
cacuaaaaaucucuccuuccc

SEQ ID NO: 318915 - RNA, 22 nt, Human
cacuaaaaaucucuccuuccca

SEQ ID NO: 318916 - RNA, 25 nt, Human
cacuaaaaaucucuccuucccaggc

SEQ ID NO: 318917 - RNA, 22 nt, Human
cagccccuccccagcagcucua

SEQ ID NO: 318918 - RNA, 20 nt, Human
cagcggcuccccacuuuucu

SEQ ID NO: 318919 - RNA, 21 nt, Human
cagcugguguuucugucccuc

SEQ ID NO: 318920 - RNA, 20 nt, Human
caggagggugaaggggauga

SEQ ID NO: 318921 - RNA, 24 nt, Human
cagguugaaucgcccccgcaccca

SEQ ID NO: 318922 - RNA, 18 nt, Human
ccaacccucccacccccc

SEQ ID NO: 318923 - RNA, 23 nt, Human
cccacccccccgaccaaaaaaaa

SEQ ID NO: 318924 - RNA, 22 nt, Human
cccaggcaggauuacuccgaaa

SEQ ID NO: 318925 - RNA, 18 nt, Human
ccccaccccaggccugag

SEQ ID NO: 318926 - RNA, 26 nt, Human
ccccaccccaggccugagaacuccuc

SEQ ID NO: 318927 - RNA, 26 nt, Human
ccccacucagcugagggaaggcugga

SEQ ID NO: 318928 - RNA, 18 nt, Human
cccccgcacccacccggg

SEQ ID NO: 318929 - RNA, 21 nt, Human
ccccggggaggggcccagggg

SEQ ID NO: 318930 - RNA, 19 nt, Human
ccccucugucuuuuugggg

SEQ ID NO: 318931 - RNA, 18 nt, Human
ccccucuuuccauacccu

SEQ ID NO: 318932 - RNA, 23 nt, Human
ccccucuuuccauacccuguccc

SEQ ID NO: 318933 - RNA, 23 nt, Human
cccgaccaaaaaaaagaaaaaag

SEQ ID NO: 318934 - RNA, 22 nt, Human
cccgcacccacccggggcccca

SEQ ID NO: 318935 - RNA, 19 nt, Human
cccggggccccaccccagg

SEQ ID NO: 318936 - RNA, 18 nt, Human
cccuccccagcagcucua

SEQ ID NO: 318937 - RNA, 26 nt, Human
ccgaccaaaaaaaagaaaaaagaaaa

SEQ ID NO: 318938 - RNA, 18 nt, Human
ccucccacccccccgacc

SEQ ID NO: 318939 - RNA, 18 nt, Human
ccucccacccccccgacc

SEQ ID NO: 318940 - RNA, 19 nt, Human
ccuccccacucagcugagg

SEQ ID NO: 318941 - RNA, 21 nt, Human
ccuuagcaaguggggccugug

SEQ ID NO: 318942 - RNA, 20 nt, Human
ccuugaaccccgggccgugg

SEQ ID NO: 318943 - RNA, 18 nt, Human
cgagagaaaaaagcacaa

SEQ ID NO: 318944 - RNA, 19 nt, Human
cuccccagcagcucuagcc

SEQ ID NO: 318945 - RNA, 18 nt, Human
cuccccagcggcucccca

SEQ ID NO: 318946 - RNA, 19 nt, Human
cuccccagcggcuccccac

SEQ ID NO: 318947 - RNA, 22 nt, Human
cucuagccuugaaccccgggcc

SEQ ID NO: 318948 - RNA, 24 nt, Human
cucuucuguucccuuuugcaggga

SEQ ID NO: 318949 - RNA, 21 nt, Human
cuggaggguggggugggggug

SEQ ID NO: 318950 - RNA, 21 nt, Human
cuggcuuucaaagcccaaggg

SEQ ID NO: 318951 - RNA, 19 nt, Human
cuggucugacuggaguuga

SEQ ID NO: 318952 - RNA, 28 nt, Human
cuuggccucuucuguucccuuuugcagg

SEQ ID NO: 318953 - RNA, 18 nt, Human
gaaggagggagggaggca

SEQ ID NO: 318954 - RNA, 26 nt, Human
gaggaaagacuugggcuuggggcucc

SEQ ID NO: 318955 - RNA, 23 nt, Human
gaguagaggaaggagggagggag

SEQ ID NO: 318956 - RNA, 20 nt, Human
gcagaagugggcugggaggg

SEQ ID NO: 318957 - RNA, 19 nt, Human
gcggaagcuggugggugag

SEQ ID NO: 318958 - RNA, 23 nt, Human
ggaauggggggacaugggagggg

SEQ ID NO: 318959 - RNA, 21 nt, Human
ggagaaguuaugagaggggga

SEQ ID NO: 318960 - RNA, 25 nt, Human
ggagagggggcaggagggugaaggg

SEQ ID NO: 318961 - RNA, 23 nt, Human
ggaguagaggaaggagggaggga

SEQ ID NO: 318962 - RNA, 18 nt, Human
ggaugagggggagcagcu

SEQ ID NO: 318963 - RNA, 20 nt, Human
ggaugagggggagcagcugg

SEQ ID NO: 318964 - RNA, 19 nt, Human
ggcugaggggcuggggggc

SEQ ID NO: 318965 - RNA, 24 nt, Human
ggcugaggggcuggggggcugugg

SEQ ID NO: 318966 - RNA, 26 nt, Human
ggcugggagggcugaggggcuggggg

SEQ ID NO: 318967 - RNA, 24 nt, Human
gggaaaagugggagagggggccgg

SEQ ID NO: 318968 - RNA, 21 nt, Human
gggaugggggugugggugggg

SEQ ID NO: 318969 - RNA, 24 nt, Human
gggcccaggggagauuagcagcgg

SEQ ID NO: 318970 - RNA, 20 nt, Human
gggcugaggggcuggggggc

SEQ ID NO: 318971 - RNA, 19 nt, Human
gggcugggagggcugaggg

SEQ ID NO: 318972 - RNA, 19 nt, Human
gggcuguggggaaagagga

SEQ ID NO: 318973 - RNA, 18 nt, Human
ggggcuggggggcugugg

SEQ ID NO: 318974 - RNA, 22 nt, Human
ggggcuguggggaaagaggaag

SEQ ID NO: 318975 - RNA, 22 nt, Human
gggggaaacgcugcugggagga

SEQ ID NO: 318976 - RNA, 20 nt, Human
ggggugggggugaaauuaga

SEQ ID NO: 318977 - RNA, 18 nt, Human
gggugggaugggggugug

SEQ ID NO: 318978 - RNA, 20 nt, Human
ggugaaggggaugaggggga

SEQ ID NO: 318979 - RNA, 19 nt, Human
ggugggauggggguguggg

SEQ ID NO: 318980 - RNA, 18 nt, Human
gucccucugauuaucugg

SEQ ID NO: 318981 - RNA, 30 nt, Human
gugggcugggagggcugaggggcugggggg

SEQ ID NO: 318982 - RNA, 19 nt, Human
gugguugggugggaugggg

SEQ ID NO: 318983 - RNA, 18 nt, Human
uaagcuggaggaggggcg

SEQ ID NO: 318984 - RNA, 23 nt, Human
uauugguaauaguuuucaaauau

SEQ ID NO: 318985 - RNA, 19 nt, Human
ucaauccaacccucccacc

SEQ ID NO: 318986 - RNA, 24 nt, Human
ucacuaaaaaucucuccuucccag

SEQ ID NO: 318987 - RNA, 18 nt, Human
ucccacccccccgaccaa

SEQ ID NO: 318988 - RNA, 22 nt, Human
ucccaggcaggauuacuccgaa

SEQ ID NO: 318989 - RNA, 21 nt, Human
uccccggggaggggcccaggg

SEQ ID NO: 318990 - RNA, 19 nt, Human
ucccucugauuaucugggc

SEQ ID NO: 318991 - RNA, 21 nt, Human
ucccucugauuaucugggcuu

SEQ ID NO: 318992 - RNA, 30 nt, Human
ucccuggauacaccagcaagaccuggucuu

SEQ ID NO: 318993 - RNA, 19 nt, Human
uccugggauggggagaagu

SEQ ID NO: 318994 - RNA, 23 nt, Human
ucugggcuuccugcucccccuaa

SEQ ID NO: 318995 - RNA, 21 nt, Human
ucuggggcccucuggcuguuc

SEQ ID NO: 318996 - RNA, 20 nt, Human
ugaaauuagaugcaaggaac

SEQ ID NO: 318997 - RNA, 19 nt, Human
ugaaucgcccccgcaccca

SEQ ID NO: 318998 - RNA, 21 nt, Human
ugagagggggaaauacgggga

SEQ ID NO: 318999 - RNA, 24 nt, Human
ugaggaauggggggacaugggagg

SEQ ID NO: 319000 - RNA, 18 nt, Human
ugaguaaaacaggcagcc

SEQ ID NO: 319001 - RNA, 23 nt, Human
ugauggacagcugacagcuaagc

SEQ ID NO: 319002 - RNA, 25 nt, Human
ugcaaggaacucuggggcccucugg

SEQ ID NO: 319003 - RNA, 19 nt, Human
uggaggaggggcgcccagg

SEQ ID NO: 319004 - RNA, 18 nt, Human
uggagggugggguggggg

SEQ ID NO: 319005 - RNA, 21 nt, Human
uggauuugaggaaugggggga

SEQ ID NO: 319006 - RNA, 18 nt, Human
uggcagagaggauucccc

SEQ ID NO: 319007 - RNA, 23 nt, Human
uggcagagaggauuccccgggga

SEQ ID NO: 319008 - RNA, 19 nt, Human
uggcuccccagcggcuccc

SEQ ID NO: 319009 - RNA, 22 nt, Human
uggcuguucaauccaacccucc

SEQ ID NO: 319010 - RNA, 18 nt, Human
ugggagggcugaggggcu

SEQ ID NO: 319011 - RNA, 24 nt, Human
ugggaggggugggaguagaggaag

SEQ ID NO: 319012 - RNA, 21 nt, Human
ugggauggggagaaguuauga

SEQ ID NO: 319013 - RNA, 19 nt, Human
ugggaugggggugugggug

SEQ ID NO: 319014 - RNA, 26 nt, Human
ugggaugggggugugggugggggcug

SEQ ID NO: 319015 - RNA, 21 nt, Human
ugggcugggagggcugagggg

SEQ ID NO: 319016 - RNA, 21 nt, Human
ugggcugggagggcugagggg

SEQ ID NO: 319017 - RNA, 22 nt, Human
ugggcugggagggcugaggggc

SEQ ID NO: 319018 - RNA, 22 nt, Human
uggggggacuuggccucuucug

SEQ ID NO: 319019 - RNA, 18 nt, Human
uggggguguggguggggg

SEQ ID NO: 319020 - RNA, 19 nt, Human
ugggguggcuccccagcgg

SEQ ID NO: 319021 - RNA, 21 nt, Human
ugggguggcuccccagcggcu

SEQ ID NO: 319022 - RNA, 21 nt, Human
uggggugggggugaaauuaga

SEQ ID NO: 319023 - RNA, 23 nt, Human
uugggcuuggggcucccccucug

SEQ ID NO: 319024 - RNA, 23 nt, Human
uugucuggcuuucaaagcccaag

SEQ ID NO: 319025 - RNA, 18 nt, Human
uuucugucccucugauua

SEQ ID NO: 319026 - RNA, 21 nt, Human
uuugcagggaugcccucccca

SEQ ID NO: 319027 - RNA, 23 nt, Human
aaaaaaauagcaaaacaaguggg

SEQ ID NO: 319028 - RNA, 21 nt, Human
aaacaaaacaaauguaaaccc

SEQ ID NO: 319029 - RNA, 18 nt, Human
aaacaaauguaaacccuc

SEQ ID NO: 319030 - RNA, 18 nt, Human
aaaugugcaaaagugcuu

SEQ ID NO: 319031 - RNA, 20 nt, Human
aacuucuuuuuaacgguuac

SEQ ID NO: 319032 - RNA, 23 nt, Human
aagaguuuuggcaaaaccaaguc

SEQ ID NO: 319033 - RNA, 19 nt, Human
aagcaaauagaaugauuau

SEQ ID NO: 319034 - RNA, 18 nt, Human
aaguggguuaagccaugg

SEQ ID NO: 319035 - RNA, 21 nt, Human
aauaacuacugaaagcaacac

SEQ ID NO: 319036 - RNA, 21 nt, Human
aaucagauggggaaaauuaaa

SEQ ID NO: 319037 - RNA, 25 nt, Human
acaaaacaaaacaaauguaaacccu

SEQ ID NO: 319038 - RNA, 19 nt, Human
acagguuuuuuuuaugucu

SEQ ID NO: 319039 - RNA, 24 nt, Human
accuaccugcaccgauaauaaagc

SEQ ID NO: 319040 - RNA, 24 nt, Human
accucuauauuguuuccaaaaauc

SEQ ID NO: 319041 - RNA, 25 nt, Human
agccauaacacugcccaucugaaac

SEQ ID NO: 319042 - RNA, 24 nt, Human
aggagaaagacaacccaaagagaa

SEQ ID NO: 319043 - RNA, 19 nt, Human
aggggucagggaagggaag

SEQ ID NO: 319044 - RNA, 18 nt, Human
auaagacagucuaucuuc

SEQ ID NO: 319045 - RNA, 22 nt, Human
augaugaggacuauuagagaaa

SEQ ID NO: 319046 - RNA, 20 nt, Human
auggauucucaacaaacacu

SEQ ID NO: 319047 - RNA, 23 nt, Human
caaaacaaaacaaauguaaaccc

SEQ ID NO: 319048 - RNA, 26 nt, Human
caaaacaaaacaaauguaaacccuca

SEQ ID NO: 319049 - RNA, 21 nt, Human
caaagguuucaccagggugug

SEQ ID NO: 319050 - RNA, 22 nt, Human
caaagguuucaccagggugugg

SEQ ID NO: 319051 - RNA, 20 nt, Human
cacacuacacaggcugguca

SEQ ID NO: 319052 - RNA, 20 nt, Human
cagccuuccaaauuucuggg

SEQ ID NO: 319053 - RNA, 24 nt, Human
ccaaaaaucaagccauuuuugacu

SEQ ID NO: 319054 - RNA, 20 nt, Human
ccaacaaaauaaaauggagc

SEQ ID NO: 319055 - RNA, 19 nt, Human
ccaagugagagaaucuggg

SEQ ID NO: 319056 - RNA, 18 nt, Human
ccagaauagugaauucca

SEQ ID NO: 319057 - RNA, 20 nt, Human
cccuucaaauaucacguagc

SEQ ID NO: 319058 - RNA, 23 nt, Human
ccuacagaaaugcugguaccaag

SEQ ID NO: 319059 - RNA, 20 nt, Human
cucacaaauauaguacacca

SEQ ID NO: 319060 - RNA, 23 nt, Human
cuugaaauuuccaccugacagca

SEQ ID NO: 319061 - RNA, 20 nt, Human
gacacguuugucacacuaca

SEQ ID NO: 319062 - RNA, 19 nt, Human
gaggaggauauaaaaggag

SEQ ID NO: 319063 - RNA, 22 nt, Human
gauauaaaaggagggaaaggga

SEQ ID NO: 319064 - RNA, 22 nt, Human
gcaacacuuauccuucccuuca

SEQ ID NO: 319065 - RNA, 19 nt, Human
gccagaauagugaauucca

SEQ ID NO: 319066 - RNA, 23 nt, Human
ggaaaauuaaaagcaaagaaaaa

SEQ ID NO: 319067 - RNA, 23 nt, Human
ggaagaaauggauguaggagagg

SEQ ID NO: 319068 - RNA, 22 nt, Human
ggagcacuguuuagagaaaacc

SEQ ID NO: 319069 - RNA, 21 nt, Human
ggagggaaagggaacuagaac

SEQ ID NO: 319070 - RNA, 24 nt, Human
ggcaagaaggggucagggaaggga

SEQ ID NO: 319071 - RNA, 21 nt, Human
gggucagggaagggaaggggg

SEQ ID NO: 319072 - RNA, 24 nt, Human
ggucagggaagggaaggggggcug

SEQ ID NO: 319073 - RNA, 21 nt, Human
guaggaaaaaaacuaaccucu

SEQ ID NO: 319074 - RNA, 23 nt, Human
gucagggaagggaaggggggcug

SEQ ID NO: 319075 - RNA, 26 nt, Human
uaaauugaucauuaaaaugaacccag

SEQ ID NO: 319076 - RNA, 23 nt, Human
uaacgguuacaaaacaaaacaaa

SEQ ID NO: 319077 - RNA, 20 nt, Human
uaauuuguauaaauuuccuu

SEQ ID NO: 319078 - RNA, 20 nt, Human
uaccucaaaauuaaaauaca

SEQ ID NO: 319079 - RNA, 19 nt, Human
uaccucuauauuguuucca

SEQ ID NO: 319080 - RNA, 22 nt, Human
uaccucuauauuguuuccaaaa

SEQ ID NO: 319081 - RNA, 24 nt, Human
uagcuggaaacaacuucuuuuuaa

SEQ ID NO: 319082 - RNA, 23 nt, Human
uaggaaaaaaacuaaccucucaa

SEQ ID NO: 319083 - RNA, 24 nt, Human
uaggaaaaaaacuaaccucucaaa

SEQ ID NO: 319084 - RNA, 21 nt, Human
ucaaaaauuaccaagaguuuu

SEQ ID NO: 319085 - RNA, 19 nt, Human
ucaacaaacacugaacuaa

SEQ ID NO: 319086 - RNA, 21 nt, Human
ucacacuacacaggcugguca

SEQ ID NO: 319087 - RNA, 18 nt, Human
ucacuuucauuaaucaug

SEQ ID NO: 319088 - RNA, 20 nt, Human
ucagacauucuguuuacuga

SEQ ID NO: 319089 - RNA, 21 nt, Human
ugcagaaacacuugauaaccg

SEQ ID NO: 319090 - RNA, 19 nt, Human
ugcuucaacaaggacgguc

SEQ ID NO: 319091 - RNA, 20 nt, Human
ugcuugaaauuuccaccuga

SEQ ID NO: 319092 - RNA, 21 nt, Human
uggcaaaaccaagucugagcu

SEQ ID NO: 319093 - RNA, 19 nt, Human
uggcacagacaaugcuugc

SEQ ID NO: 319094 - RNA, 22 nt, Human
ugguacagaugaaaagaagugg

SEQ ID NO: 319095 - RNA, 19 nt, Human
uguaggagaggagaaagac

SEQ ID NO: 319096 - RNA, 20 nt, Human
ugucacacuacacaggcugg

SEQ ID NO: 319097 - RNA, 22 nt, Human
ugucacacuacacaggcugguc

SEQ ID NO: 319098 - RNA, 18 nt, Human
uuccaagaaaguuagucu

SEQ ID NO: 319099 - RNA, 21 nt, Human
uucucaacaaacacugaacua

SEQ ID NO: 319100 - RNA, 22 nt, Human
uucuguuuacugagagaacaga

SEQ ID NO: 319101 - RNA, 22 nt, Human
uuuaaaauuugucacuuucauu

SEQ ID NO: 319102 - RNA, 21 nt, Human
uuucugggucuagcuguacug

SEQ ID NO: 319103 - RNA, 22 nt, Human
aaaaggaaagaaaacccacagg

SEQ ID NO: 319104 - RNA, 21 nt, Human
aaacaaaaaggaaagaaaacc

SEQ ID NO: 319105 - RNA, 23 nt, Human
aaacaaaaaggaaagaaaaccca

SEQ ID NO: 319106 - RNA, 22 nt, Human
aaacagcccacugaacauggca

SEQ ID NO: 319107 - RNA, 24 nt, Human
aaacagcccacugaacauggcacu

SEQ ID NO: 319108 - RNA, 23 nt, Human
aaaccucucuccuucccaggcag

SEQ ID NO: 319109 - RNA, 20 nt, Human
aacauggcacuaaaccucuc

SEQ ID NO: 319110 - RNA, 19 nt, Human
aagcacagagggaccagga

SEQ ID NO: 319111 - RNA, 21 nt, Human
aaguggugccuguucagggcu

SEQ ID NO: 319112 - RNA, 19 nt, Human
acaacagcaagaccuggcc

SEQ ID NO: 319113 - RNA, 24 nt, Human
accaaaaacaaaaaggaaagaaaa

SEQ ID NO: 319114 - RNA, 18 nt, Human
accaggaaggcauggggc

SEQ ID NO: 319115 - RNA, 19 nt, Human
acccugugggaggagaaag

SEQ ID NO: 319116 - RNA, 21 nt, Human
agaaacucguuuaaaacaggc

SEQ ID NO: 319117 - RNA, 21 nt, Human
agagagaagcacagagggacc

SEQ ID NO: 319118 - RNA, 22 nt, Human
aggaaggcauggggcggggggu

SEQ ID NO: 319119 - RNA, 20 nt, Human
aggcagaagggggcuggggc

SEQ ID NO: 319120 - RNA, 24 nt, Human
aggcagaagggggcuggggcaagg

SEQ ID NO: 319121 - RNA, 21 nt, Human
aguggugccuguucagggcug

SEQ ID NO: 319122 - RNA, 22 nt, Human
auccaacccucccaucccccaa

SEQ ID NO: 319123 - RNA, 22 nt, Human
caacccucccaucccccaaacc

SEQ ID NO: 319124 - RNA, 25 nt, Human
caauccaacccucccaucccccaaa

SEQ ID NO: 319125 - RNA, 20 nt, Human
caccaaaaacaaaaaggaag

SEQ ID NO: 319126 - RNA, 23 nt, Human
cacuaaaccucucuccuucccag

SEQ ID NO: 319127 - RNA, 18 nt, Human
cagaagggggcuggggca

SEQ ID NO: 319128 - RNA, 24 nt, Human
ccaaaccaccaaaaacaaaaagga

SEQ ID NO: 319129 - RNA, 18 nt, Human
ccaacccucccauccccc

SEQ ID NO: 319130 - RNA, 22 nt, Human
cccaggcaggauuacuccaaag

SEQ ID NO: 319131 - RNA, 18 nt, Human
cccaucccccaaaccacc

SEQ ID NO: 319132 - RNA, 21 nt, Human
cccccaaaccaccaaaaacaa

SEQ ID NO: 319133 - RNA, 24 nt, Human
cccccaaaccaccaaaaacaaaaa

SEQ ID NO: 319134 - RNA, 23 nt, Human
ccccucuuuccacaccguguccc

SEQ ID NO: 319135 - RNA, 19 nt, Human
cccuugauacaacagcaag

SEQ ID NO: 319136 - RNA, 23 nt, Human
ccucccaucccccaaaccaccaa

SEQ ID NO: 319137 - RNA, 26 nt, Human
cuaaaccucucuccuucccaggcagg

SEQ ID NO: 319138 - RNA, 22 nt, Human
gcacuaaaccucucuccuuccc

SEQ ID NO: 319139 - RNA, 22 nt, Human
ggaaagaaaacccacaggggca

SEQ ID NO: 319140 - RNA, 26 nt, Human
ggcggggggugagggagcagcuggug

SEQ ID NO: 319141 - RNA, 20 nt, Human
ggcuggggcaagggggaccc

SEQ ID NO: 319142 - RNA, 22 nt, Human
ggcuuccugcucccccaacccu

SEQ ID NO: 319143 - RNA, 22 nt, Human
gggcaagggggacccuguggga

SEQ ID NO: 319144 - RNA, 23 nt, Human
gggcuggggcaagggggacccug

SEQ ID NO: 319145 - RNA, 18 nt, Human
gggggcuggggcaagggg

SEQ ID NO: 319146 - RNA, 20 nt, Human
ggggugaggaugaaauuaga

SEQ ID NO: 319147 - RNA, 21 nt, Human
ucaauccaacccucccauccc

SEQ ID NO: 319148 - RNA, 24 nt, Human
uccaacccucccaucccccaaacc

SEQ ID NO: 319149 - RNA, 22 nt, Human
ucccaggcaggauuacuccaaa

SEQ ID NO: 319150 - RNA, 22 nt, Human
ucccccaaaccaccaaaaacaa

SEQ ID NO: 319151 - RNA, 27 nt, Human
ucccccaaaccaccaaaaacaaaaagg

SEQ ID NO: 319152 - RNA, 21 nt, Human
ucuggggcccucuggcuguuc

SEQ ID NO: 319153 - RNA, 20 nt, Human
ugaaauuagauacaaggaac

SEQ ID NO: 319154 - RNA, 19 nt, Human
ugagggagcagcugguguu

SEQ ID NO: 319155 - RNA, 22 nt, Human
ugagggagcagcugguguuucu

SEQ ID NO: 319156 - RNA, 22 nt, Human
uggcuguucaauccaacccucc

SEQ ID NO: 319157 - RNA, 18 nt, Human
ugguguuucuguuccucc

SEQ ID NO: 319158 - RNA, 24 nt, Human
uugagccccucuuuccacaccgug

SEQ ID NO: 319159 - RNA, 19 nt, Human
aagaggcgcccgggcccuc

SEQ ID NO: 319160 - RNA, 21 nt, Human
aagggcaggggacccugaaca

SEQ ID NO: 319161 - RNA, 18 nt, Human
acucagagcaugagcccc

SEQ ID NO: 319162 - RNA, 20 nt, Human
agaggacaggggcuagaacu

SEQ ID NO: 319163 - RNA, 21 nt, Human
agaucagaauuugucugagag

SEQ ID NO: 319164 - RNA, 21 nt, Human
auccauucucuuuccuccccc

SEQ ID NO: 319165 - RNA, 22 nt, Human
caccgcuccuggaggucaccac

SEQ ID NO: 319166 - RNA, 23 nt, Human
caucccaccgcuccuggagguca

SEQ ID NO: 319167 - RNA, 19 nt, Human
ccacagagcuuccagcagg

SEQ ID NO: 319168 - RNA, 22 nt, Human
cccacagagcuuccagcaggca

SEQ ID NO: 319169 - RNA, 22 nt, Human
cccauaccuucccuagcuccca

SEQ ID NO: 319170 - RNA, 23 nt, Human
ccuccccacucacauuaugggaa

SEQ ID NO: 319171 - RNA, 19 nt, Human
ccucccccauaccuucccu

SEQ ID NO: 319172 - RNA, 23 nt, Human
ccuggugcugcaugaccccuucc

SEQ ID NO: 319173 - RNA, 19 nt, Human
cgcccgggcccucaucauc

SEQ ID NO: 319174 - RNA, 19 nt, Human
cgcccgggcccucaucauc

SEQ ID NO: 319175 - RNA, 22 nt, Human
cuaaauggacuuggccuccucc

SEQ ID NO: 319176 - RNA, 19 nt, Human
cucccagauagaagggcag

SEQ ID NO: 319177 - RNA, 25 nt, Human
cuccuccauauagcacggaacagga

SEQ ID NO: 319178 - RNA, 22 nt, Human
cugcaugaccccuucccccagc

SEQ ID NO: 319179 - RNA, 24 nt, Human
gagcccccucaccaucuuuaaggg

SEQ ID NO: 319180 - RNA, 20 nt, Human
gcugaaaguuuuuucaagug

SEQ ID NO: 319181 - RNA, 18 nt, Human
gcugcaugaccccuuccc

SEQ ID NO: 319182 - RNA, 21 nt, Human
ggucaccaccuucuacucaga

SEQ ID NO: 319183 - RNA, 19 nt, Human
uaaauggacuuggccuccu

SEQ ID NO: 319184 - RNA, 18 nt, Human
uaagaggacaggggcuag

SEQ ID NO: 319185 - RNA, 19 nt, Human
uaguucacccagaaagggg

SEQ ID NO: 319186 - RNA, 21 nt, Human
ucaaguuucaucugauuccca

SEQ ID NO: 319187 - RNA, 21 nt, Human
ucccacagagcuuccagcagg

SEQ ID NO: 319188 - RNA, 20 nt, Human
ucccucaaguuucaucugau

SEQ ID NO: 319189 - RNA, 20 nt, Human
uccuggaggucaccaccuuc

SEQ ID NO: 319190 - RNA, 25 nt, Human
ugggaagaaaugucacuaaauggug

SEQ ID NO: 319191 - RNA, 18 nt, Human
ugucugagaggcacagag

SEQ ID NO: 319192 - RNA, 22 nt, Human
uuccagcaggcagugaguuggg

SEQ ID NO: 319193 - RNA, 24 nt, Human
aaaacgugacccagagacuuuguu

SEQ ID NO: 319194 - RNA, 19 nt, Human
aggcaaaacgugacccaga

SEQ ID NO: 319195 - RNA, 20 nt, Human
uaaccacuugcagccagugu

SEQ ID NO: 319196 - RNA, 24 nt, Human
ugaggcaaaacgugacccagagac

SEQ ID NO: 319197 - RNA, 19 nt, Human
uucaugaggcaaaacguga

SEQ ID NO: 319198 - RNA, 22 nt, Human
aaaaaaagacuaaaccaaagua

SEQ ID NO: 319199 - RNA, 18 nt, Human
aaaaaggaggaaaaaaag

SEQ ID NO: 319200 - RNA, 25 nt, Human
aaacacaaaguacagaucagaaacc

SEQ ID NO: 319201 - RNA, 18 nt, Human
aaacuuaaaaggcaggua

SEQ ID NO: 319202 - RNA, 21 nt, Human
aaagaaaaguuugccagagga

SEQ ID NO: 319203 - RNA, 25 nt, Human
aaagaaagaaaaguuugccagagga

SEQ ID NO: 319204 - RNA, 26 nt, Human
aaagaaauacagcauauauggccaca

SEQ ID NO: 319205 - RNA, 22 nt, Human
aaaguaaaaaacuucuuccaaa

SEQ ID NO: 319206 - RNA, 19 nt, Human
aacacugcacaaagagaag

SEQ ID NO: 319207 - RNA, 21 nt, Human
aacuucuuccaaaaucucaug

SEQ ID NO: 319208 - RNA, 23 nt, Human
aagaaagaaaaguuugccagagg

SEQ ID NO: 319209 - RNA, 23 nt, Human
aagacuaaaccaaaguaaaaaac

SEQ ID NO: 319210 - RNA, 22 nt, Human
aagcaacacagacacauuauac

SEQ ID NO: 319211 - RNA, 23 nt, Human
aagcaacacagacacauuauacc

SEQ ID NO: 319212 - RNA, 20 nt, Human
aagcauggauuggggagagg

SEQ ID NO: 319213 - RNA, 21 nt, Human
aaguuuuucaaaucuaugaaa

SEQ ID NO: 319214 - RNA, 20 nt, Human
acaaaguacagaucagaaac

SEQ ID NO: 319215 - RNA, 23 nt, Human
acacugaacuuuguccgccuggc

SEQ ID NO: 319216 - RNA, 20 nt, Human
accaaaguaaaaaacuucuu

SEQ ID NO: 319217 - RNA, 21 nt, Human
acccuaaaauguaaauaaaac

SEQ ID NO: 319218 - RNA, 18 nt, Human
acucacugcccaggguga

SEQ ID NO: 319219 - RNA, 19 nt, Human
agaaacccucauuuaauau

SEQ ID NO: 319220 - RNA, 20 nt, Human
agacacauuauacccuacca

SEQ ID NO: 319221 - RNA, 23 nt, Human
agauguaguuaaauacuaaccaa

SEQ ID NO: 319222 - RNA, 23 nt, Human
aggaaaaaaagacuaaaccaaag

SEQ ID NO: 319223 - RNA, 21 nt, Human
augaaaauaaaagugccuaca

SEQ ID NO: 319224 - RNA, 23 nt, Human
augaguuaguuucaaacuuaaaa

SEQ ID NO: 319225 - RNA, 23 nt, Human
caaauccaaucuccuggaaucag

SEQ ID NO: 319226 - RNA, 20 nt, Human
caagaauguagaccucaaau

SEQ ID NO: 319227 - RNA, 25 nt, Human
caagcuuuaagcuuguaagaacaua

SEQ ID NO: 319228 - RNA, 23 nt, Human
cacauuauacccuaccaucaacc

SEQ ID NO: 319229 - RNA, 22 nt, Human
caccaaaaagcauggcacucac

SEQ ID NO: 319230 - RNA, 26 nt, Human
caccagaaauucuagcugaauaaaaa

SEQ ID NO: 319231 - RNA, 24 nt, Human
cagcaaauccaaucuccuggaauc

SEQ ID NO: 319232 - RNA, 23 nt, Human
cagcaggauagccuuucagacca

SEQ ID NO: 319233 - RNA, 24 nt, Human
cagcaucugaucaauuauuuggca

SEQ ID NO: 319234 - RNA, 23 nt, Human
cagucacucccaaauauaacccu

SEQ ID NO: 319235 - RNA, 21 nt, Human
ccagugaaugucacggggaaa

SEQ ID NO: 319236 - RNA, 20 nt, Human
cgaggcugcgggugcgaggc

SEQ ID NO: 319237 - RNA, 18 nt, Human
cuaagauuuucuauaucc

SEQ ID NO: 319238 - RNA, 18 nt, Human
cuacauuacagaacugug

SEQ ID NO: 319239 - RNA, 21 nt, Human
cuaccaucaacccaccagaaa

SEQ ID NO: 319240 - RNA, 22 nt, Human
cucacugcccagggugaauacu

SEQ ID NO: 319241 - RNA, 21 nt, Human
cucuggggacgggcggcggcg

SEQ ID NO: 319242 - RNA, 22 nt, Human
cugaacuuuguccgccuggcau

SEQ ID NO: 319243 - RNA, 19 nt, Human
cuugcagucacucccaaau

SEQ ID NO: 319244 - RNA, 22 nt, Human
gaaaaaaaaaacugaaccaauc

SEQ ID NO: 319245 - RNA, 23 nt, Human
gaaaaaaaaaacugaaccaauca

SEQ ID NO: 319246 - RNA, 19 nt, Human
gaguuaguuucaaacuuaa

SEQ ID NO: 319247 - RNA, 21 nt, Human
gaguuaguuucaaacuuaaaa

SEQ ID NO: 319248 - RNA, 21 nt, Human
gaugccaguggccacuuggcg

SEQ ID NO: 319249 - RNA, 25 nt, Human
gcaacacagacacauuauacccuac

SEQ ID NO: 319250 - RNA, 19 nt, Human
gcgggcgcgaggcugcggg

SEQ ID NO: 319251 - RNA, 21 nt, Human
gcugcgggugcgaggcggcgg

SEQ ID NO: 319252 - RNA, 26 nt, Human
gcuuauaacuggacaauuaugucacu

SEQ ID NO: 319253 - RNA, 18 nt, Human
gggcggcggcgggcgcga

SEQ ID NO: 319254 - RNA, 24 nt, Human
uaaaaaauuuguaacaagguggcu

SEQ ID NO: 319255 - RNA, 25 nt, Human
uaaaaguuuuucaaaucuaugaaaa

SEQ ID NO: 319256 - RNA, 22 nt, Human
uaacaagauauaaauaaaccag

SEQ ID NO: 319257 - RNA, 21 nt, Human
uaaugcuccaaauugaaaaug

SEQ ID NO: 319258 - RNA, 19 nt, Human
uagauuauuuuggaaauuu

SEQ ID NO: 319259 - RNA, 18 nt, Human
uauccauuucccuaaucu

SEQ ID NO: 319260 - RNA, 25 nt, Human
uaugaaaaaaaucuaccaugaccaa

SEQ ID NO: 319261 - RNA, 18 nt, Human
uccaaaaucucaugcccc

SEQ ID NO: 319262 - RNA, 21 nt, Human
ucccucagcgcuuugcuccca

SEQ ID NO: 319263 - RNA, 19 nt, Human
ucccuuuagcagcaucacc

SEQ ID NO: 319264 - RNA, 23 nt, Human
ucuguuaggacauuugcuccauc

SEQ ID NO: 319265 - RNA, 22 nt, Human
ucuuacccacccuaaaauguaa

SEQ ID NO: 319266 - RNA, 22 nt, Human
ugaauaaaaaggaggaaaaaaa

SEQ ID NO: 319267 - RNA, 21 nt, Human
ugcacaaagagaagcaguaac

SEQ ID NO: 319268 - RNA, 24 nt, Human
ugcacaaagagaagcaguaacagc

SEQ ID NO: 319269 - RNA, 18 nt, Human
ugcacuguuacaucauua

SEQ ID NO: 319270 - RNA, 22 nt, Human
ugcacuguuacaucauuacucu

SEQ ID NO: 319271 - RNA, 23 nt, Human
ugcuagauaggaaagcaggacuu

SEQ ID NO: 319272 - RNA, 18 nt, Human
uggaaucaguuuaaugag

SEQ ID NO: 319273 - RNA, 21 nt, Human
uggugcaauaaaagcaacuuu

SEQ ID NO: 319274 - RNA, 19 nt, Human
uguaaauaaaaccucuucc

SEQ ID NO: 319275 - RNA, 18 nt, Human
uuaaaaaagaaaagaaag

SEQ ID NO: 319276 - RNA, 19 nt, Human
uuagcuuggcaaacaacaa

SEQ ID NO: 319277 - RNA, 19 nt, Human
uucaauaggugcuggaucu

SEQ ID NO: 319278 - RNA, 20 nt, Human
aaaugcccauaaccacagca

SEQ ID NO: 319279 - RNA, 19 nt, Human
aaugggccuucagaagcaa

SEQ ID NO: 319280 - RNA, 21 nt, Human
aggaaaggagcauguuuauac

SEQ ID NO: 319281 - RNA, 22 nt, Human
aggaaaggagcauguuuauacu

SEQ ID NO: 319282 - RNA, 23 nt, Human
aggcacuuaaauuguuggagaga

SEQ ID NO: 319283 - RNA, 22 nt, Human
caacccuacgcuaccacggccg

SEQ ID NO: 319284 - RNA, 22 nt, Human
cacuaagaaggcucuggggaag

SEQ ID NO: 319285 - RNA, 19 nt, Human
cccauaaccacagcaaugg

SEQ ID NO: 319286 - RNA, 19 nt, Human
cccuacgcuaccacggccg

SEQ ID NO: 319287 - RNA, 19 nt, Human
ccgcgcccgcgaggucucu

SEQ ID NO: 319288 - RNA, 19 nt, Human
cgcaacccuacgcuaccac

SEQ ID NO: 319289 - RNA, 21 nt, Human
gcccgcgaggucucuucgcgc

SEQ ID NO: 319290 - RNA, 23 nt, Human
gcgcaacccuacgcuaccacggc

SEQ ID NO: 319291 - RNA, 22 nt, Human
gucgcgccgcucuuuggccggc

SEQ ID NO: 319292 - RNA, 23 nt, Human
uaagaaggcucugggguguggca

SEQ ID NO: 319293 - RNA, 20 nt, Human
uccgggccgcgcaacccuac

SEQ ID NO: 319294 - RNA, 23 nt, Human
ugcguuuccgggccgcgcaaccc

SEQ ID NO: 319295 - RNA, 25 nt, Human
uggcagcaguggcggcaacggcagg

SEQ ID NO: 319296 - RNA, 20 nt, Human
uggccggcucugcguuuccu

SEQ ID NO: 319297 - RNA, 19 nt, Human
aaaaaaaccaaacaaaccc

SEQ ID NO: 319298 - RNA, 19 nt, Human
aaaaaaccaaacaaaccca

SEQ ID NO: 319299 - RNA, 20 nt, Human
aaaaagcagauauaugcuug

SEQ ID NO: 319300 - RNA, 22 nt, Human
aaaucacucauuuaaaagcaaa

SEQ ID NO: 319301 - RNA, 22 nt, Human
aaucacuuuuuaaaaaaacaaa

SEQ ID NO: 319302 - RNA, 23 nt, Human
aaugacuaaauugccuguccaua

SEQ ID NO: 319303 - RNA, 22 nt, Human
aauguaaaaaaaggaaaaaacc

SEQ ID NO: 319304 - RNA, 19 nt, Human
accuguuucccaaaaugaa

SEQ ID NO: 319305 - RNA, 21 nt, Human
acuacuguuuauugauacguu

SEQ ID NO: 319306 - RNA, 24 nt, Human
aggaaaaaaccugaaaucacagaa

SEQ ID NO: 319307 - RNA, 24 nt, Human
aggcagcacauaacuuaucaagcu

SEQ ID NO: 319308 - RNA, 22 nt, Human
agggaaaaaugcauuaaugauc

SEQ ID NO: 319309 - RNA, 24 nt, Human
auaaggaucccacauuauuuuugg

SEQ ID NO: 319310 - RNA, 19 nt, Human
caaaauagauaacuugaaa

SEQ ID NO: 319311 - RNA, 22 nt, Human
caaaauguacuuuauugcaaaa

SEQ ID NO: 319312 - RNA, 22 nt, Human
caagcuagaaaacuuuaaaaca

SEQ ID NO: 319313 - RNA, 22 nt, Human
cauauagccuaugauaacaucc

SEQ ID NO: 319314 - RNA, 22 nt, Human
cauaugauauuuuauaccauuu

SEQ ID NO: 319315 - RNA, 18 nt, Human
ccggccgccggcucccgg

SEQ ID NO: 319316 - RNA, 19 nt, Human
ccuggccgcccucgccccc

SEQ ID NO: 319317 - RNA, 22 nt, Human
cgcccccuccccggcacgccua

SEQ ID NO: 319318 - RNA, 22 nt, Human
cgccuagggccccgcggcugcc

SEQ ID NO: 319319 - RNA, 23 nt, Human
cgcuaccggcugcgagcgcggcg

SEQ ID NO: 319320 - RNA, 21 nt, Human
cggcaggcgccuggccgcccu

SEQ ID NO: 319321 - RNA, 19 nt, Human
cuaaaaauguggcugaagu

SEQ ID NO: 319322 - RNA, 20 nt, Human
cuaccggcugcgagcgcggc

SEQ ID NO: 319323 - RNA, 23 nt, Human
cucgcccccuccccggcacgccu

SEQ ID NO: 319324 - RNA, 22 nt, Human
gaacaaagaaauaaacuguggg

SEQ ID NO: 319325 - RNA, 21 nt, Human
gcacugggccccggcgccggc

SEQ ID NO: 319326 - RNA, 22 nt, Human
gccccgcggcugccgagcgacg

SEQ ID NO: 319327 - RNA, 19 nt, Human
gccuagaaaucauguaaga

SEQ ID NO: 319328 - RNA, 22 nt, Human
ggaaaaaaccugaaaucacaga

SEQ ID NO: 319329 - RNA, 23 nt, Human
ggcaucuacacaaacacauucuc

SEQ ID NO: 319330 - RNA, 19 nt, Human
ggccuagaaaucauguaag

SEQ ID NO: 319331 - RNA, 23 nt, Human
ggcgcacugggccccggcgccgg

SEQ ID NO: 319332 - RNA, 20 nt, Human
guaaaaaaaggaaaaaaccu

SEQ ID NO: 319333 - RNA, 25 nt, Human
guaaaacacauauagccuaugauaa

SEQ ID NO: 319334 - RNA, 22 nt, Human
uaaaaaaaggaaaaaaccugaa

SEQ ID NO: 319335 - RNA, 21 nt, Human
uaaaaccacuggaauauguau

SEQ ID NO: 319336 - RNA, 22 nt, Human
uaacagacauggcuuuuaaaau

SEQ ID NO: 319337 - RNA, 23 nt, Human
uaagaauacagaaugaugaacca

SEQ ID NO: 319338 - RNA, 25 nt, Human
uacaagaagguuuugcaaaaauguu

SEQ ID NO: 319339 - RNA, 24 nt, Human
uacaagugggaccauaaacauucu

SEQ ID NO: 319340 - RNA, 23 nt, Human
uacugacauuaugccaacaaagu

SEQ ID NO: 319341 - RNA, 22 nt, Human
uagaauacagagaauugcaaaa

SEQ ID NO: 319342 - RNA, 21 nt, Human
uaucaaugaacaaugaaaauc

SEQ ID NO: 319343 - RNA, 24 nt, Human
uaugcaggccuagugaagaacaaa

SEQ ID NO: 319344 - RNA, 23 nt, Human
ucaccaauaggccaaggcagcac

SEQ ID NO: 319345 - RNA, 23 nt, Human
ucagucugaauaaguaaaacaca

SEQ ID NO: 319346 - RNA, 24 nt, Human
ucuacauuaaagcaauggcaaggc

SEQ ID NO: 319347 - RNA, 21 nt, Human
ucuagacacugggucaugggg

SEQ ID NO: 319348 - RNA, 18 nt, Human
ucucuagacacuggguca

SEQ ID NO: 319349 - RNA, 21 nt, Human
ucucucaucuaaaacacuguu

SEQ ID NO: 319350 - RNA, 27 nt, Human
ucuggaguucuuuugugagugggaccg

SEQ ID NO: 319351 - RNA, 30 nt, Human
ucuggaguucuuuuguguuuuuucuuguuu

SEQ ID NO: 319352 - RNA, 23 nt, Human
ucuuauguggcagcauacugagc

SEQ ID NO: 319353 - RNA, 18 nt, Human
ugauauuuuauaccauuu

SEQ ID NO: 319354 - RNA, 21 nt, Human
ugaucucucaucuaaaacacu

SEQ ID NO: 319355 - RNA, 21 nt, Human
uuucuuguuuaacagacaugg

SEQ ID NO: 319356 - RNA, 25 nt, Human
uuuuuaugaacuacucuuuagaaag

SEQ ID NO: 319357 - RNA, 22 nt, Human
aauaacccuacaauuuucaggc

SEQ ID NO: 319358 - RNA, 19 nt, Human
agagagagacccugaacag

SEQ ID NO: 319359 - RNA, 28 nt, Human
cacugcggggagggcugggggcugggga

SEQ ID NO: 319360 - RNA, 21 nt, Human
cagacacaagccguggccuua

SEQ ID NO: 319361 - RNA, 21 nt, Human
cauauggaaucagacacaagc

SEQ ID NO: 319362 - RNA, 21 nt, Human
cccccccaaccaccucuugcu

SEQ ID NO: 319363 - RNA, 24 nt, Human
ccccccccaaccaccucuugcucc

SEQ ID NO: 319364 - RNA, 22 nt, Human
cccuacaauuuucaggccucca

SEQ ID NO: 319365 - RNA, 18 nt, Human
cugggggcuggggaggug

SEQ ID NO: 319366 - RNA, 18 nt, Human
gagguguuuguucucgcu

SEQ ID NO: 319367 - RNA, 25 nt, Human
guccccccccaaccaccucuugcuc

SEQ ID NO: 319368 - RNA, 19 nt, Human
uaacccuacaauuuucagg

SEQ ID NO: 319369 - RNA, 19 nt, Human
uaagagagagacccugaac

SEQ ID NO: 319370 - RNA, 21 nt, Human
ugcggggagggcugggggcug

SEQ ID NO: 319371 - RNA, 18 nt, Human
uggacuaauaacccuaca

SEQ ID NO: 319372 - RNA, 18 nt, Human
ugggggcuggggaggugu

SEQ ID NO: 319373 - RNA, 19 nt, Human
uucacuuccacugcgggga

SEQ ID NO: 319374 - RNA, 29 nt, Human
acagccgggucccggccaggcugguaccc

SEQ ID NO: 319375 - RNA, 21 nt, Human
agcaggcuccgggggcagugu

SEQ ID NO: 319376 - RNA, 21 nt, Human
aggacagaggagcagggaggc

SEQ ID NO: 319377 - RNA, 19 nt, Human
agguucgcugugcgaggac

SEQ ID NO: 319378 - RNA, 18 nt, Human
agugggcuggcuaacugc

SEQ ID NO: 319379 - RNA, 18 nt, Human
augacccuggugccuguc

SEQ ID NO: 319380 - RNA, 30 nt, Human
cacagccgggucccggccaggcugguaccc

SEQ ID NO: 319381 - RNA, 22 nt, Human
caggagcccagguucgcugugc

SEQ ID NO: 319382 - RNA, 22 nt, Human
caggagcccagguucgcugugc

SEQ ID NO: 319383 - RNA, 22 nt, Human
caggcccagaacccagcccucc

SEQ ID NO: 319384 - RNA, 30 nt, Human
cauugaccccaaccucagcuguccacggcc

SEQ ID NO: 319385 - RNA, 20 nt, Human
ccacaaggagcagggcucgg

SEQ ID NO: 319386 - RNA, 22 nt, Human
ccaggccagggcgauaggcuca

SEQ ID NO: 319387 - RNA, 18 nt, Human
cccacgcacccugccccc

SEQ ID NO: 319388 - RNA, 24 nt, Human
cccacgcacccugcccccggcacc

SEQ ID NO: 319389 - RNA, 26 nt, Human
cccacgcacccugcccccggcaccac

SEQ ID NO: 319390 - RNA, 27 nt, Human
cccacgcacccugcccccggcaccaca

SEQ ID NO: 319391 - RNA, 19 nt, Human
cccaggcuccguccuccca

SEQ ID NO: 319392 - RNA, 19 nt, Human
cccccggcaccacagccgc

SEQ ID NO: 319393 - RNA, 20 nt, Human
ccccgccccgcucccaggcu

SEQ ID NO: 319394 - RNA, 21 nt, Human
ccccgccccgcucccaggcuc

SEQ ID NO: 319395 - RNA, 21 nt, Human
cccuggggagcugccucuguc

SEQ ID NO: 319396 - RNA, 22 nt, Human
ccgccccacgggucuccaggcc

SEQ ID NO: 319397 - RNA, 23 nt, Human
ccgcucccaggcuccguccuccc

SEQ ID NO: 319398 - RNA, 19 nt, Human
ccggccaggcugguaccug

SEQ ID NO: 319399 - RNA, 21 nt, Human
cggcaccacagccgcggggca

SEQ ID NO: 319400 - RNA, 24 nt, Human
cgucgcccccuugcgcggcggccc

SEQ ID NO: 319401 - RNA, 23 nt, Human
cuugcgcggcggccccgccccgc

SEQ ID NO: 319402 - RNA, 20 nt, Human
cuuucuuuuccuuccugccc

SEQ ID NO: 319403 - RNA, 21 nt, Human
gaccaagcucucccucuggcc

SEQ ID NO: 319404 - RNA, 22 nt, Human
gagccgggaggggagggagggu

SEQ ID NO: 319405 - RNA, 19 nt, Human
gaggguggaggggccagug

SEQ ID NO: 319406 - RNA, 30 nt, Human
gcccaggaggcauugaccccaaccucagcc

SEQ ID NO: 319407 - RNA, 19 nt, Human
gccccacgggucuccaggc

SEQ ID NO: 319408 - RNA, 18 nt, Human
gccgggucccggccaggc

SEQ ID NO: 319409 - RNA, 19 nt, Human
gccgggucccggccaggcu

SEQ ID NO: 319410 - RNA, 23 nt, Human
ggacuccugccaccuccaagucc

SEQ ID NO: 319411 - RNA, 19 nt, Human
ggagcugccucugucgcuc

SEQ ID NO: 319412 - RNA, 20 nt, Human
ggaggggagggaggguggag

SEQ ID NO: 319413 - RNA, 22 nt, Human
ggaggggagggaggguggaggg

SEQ ID NO: 319414 - RNA, 19 nt, Human
gggaauagguacaaagggg

SEQ ID NO: 319415 - RNA, 20 nt, Human
ggggaauagguacaaagggg

SEQ ID NO: 319416 - RNA, 19 nt, Human
ggggagggaggguggaggg

SEQ ID NO: 319417 - RNA, 19 nt, Human
gucccaggccaugacccug

SEQ ID NO: 319418 - RNA, 22 nt, Human
gugugauggggacuggacgggc

SEQ ID NO: 319419 - RNA, 19 nt, Human
uaaggcagguccagagacc

SEQ ID NO: 319420 - RNA, 19 nt, Human
uccagagaccaagcucucc

SEQ ID NO: 319421 - RNA, 22 nt, Human
uccaggucccaggccaugaccc

SEQ ID NO: 319422 - RNA, 26 nt, Human
uccagguuuguguuuauucgauacag

SEQ ID NO: 319423 - RNA, 25 nt, Human
ucccacagccgggucccggccaggc

SEQ ID NO: 319424 - RNA, 21 nt, Human
ucccacgcacccugcccccgg

SEQ ID NO: 319425 - RNA, 22 nt, Human
ucccaggcuccguccucccacg

SEQ ID NO: 319426 - RNA, 22 nt, Human
ucccucuccuuccuaaggcagg

SEQ ID NO: 319427 - RNA, 23 nt, Human
ucccucuggccggggagccggga

SEQ ID NO: 319428 - RNA, 18 nt, Human
uccgccccacgggucucc

SEQ ID NO: 319429 - RNA, 18 nt, Human
uccugccaccuccaaguc

SEQ ID NO: 319430 - RNA, 21 nt, Human
uccugcccucccucuccuucc

SEQ ID NO: 319431 - RNA, 19 nt, Human
uccuuccugcccucccucu

SEQ ID NO: 319432 - RNA, 19 nt, Human
ucuccaggcccuggggagc

SEQ ID NO: 319433 - RNA, 20 nt, Human
ugagcgcccacaaggagcag

SEQ ID NO: 319434 - RNA, 21 nt, Human
ugccucugucgcucaccggaa

SEQ ID NO: 319435 - RNA, 21 nt, Human
uggccgagcugggggaacaga

SEQ ID NO: 319436 - RNA, 18 nt, Human
uggcuaacugcccagcuc

SEQ ID NO: 319437 - RNA, 20 nt, Human
ugggcuggcuaacugcccag

SEQ ID NO: 319438 - RNA, 21 nt, Human
uuggagugggcuggcuaacug

SEQ ID NO: 319439 - RNA, 19 nt, Human
uuggucccacagccggguc

SEQ ID NO: 319440 - RNA, 24 nt, Human
aaaaacauaaaaaugucaccacaa

SEQ ID NO: 319441 - RNA, 19 nt, Human
aagcaaauaaaguuugaaa

SEQ ID NO: 319442 - RNA, 22 nt, Human
aaguaucagaaacuacaacacu

SEQ ID NO: 319443 - RNA, 23 nt, Human
acaacaacagaaacaaaacccca

SEQ ID NO: 319444 - RNA, 23 nt, Human
acaacagaaacaaaaccccaaag

SEQ ID NO: 319445 - RNA, 26 nt, Human
acaacagaaacaaaaccccaaagcaa

SEQ ID NO: 319446 - RNA, 21 nt, Human
acauaaaguaucagaaacuac

SEQ ID NO: 319447 - RNA, 20 nt, Human
acauggaugcaacuuggcaa

SEQ ID NO: 319448 - RNA, 21 nt, Human
acuuggcaaugaaaaacauaa

SEQ ID NO: 319449 - RNA, 21 nt, Human
acuuugauaauguguuaauua

SEQ ID NO: 319450 - RNA, 19 nt, Human
agaaaaucaaacauggaug

SEQ ID NO: 319451 - RNA, 22 nt, Human
agaaaaucaaacauggaugcaa

SEQ ID NO: 319452 - RNA, 19 nt, Human
aggcccggaaguggaagag

SEQ ID NO: 319453 - RNA, 20 nt, Human
augaaggacggagaucuaca

SEQ ID NO: 319454 - RNA, 19 nt, Human
auuuggguucugaaacacu

SEQ ID NO: 319455 - RNA, 20 nt, Human
auuuggguucugaaacacug

SEQ ID NO: 319456 - RNA, 25 nt, Human
caacaacagaaacaaaaccccaaag

SEQ ID NO: 319457 - RNA, 25 nt, Human
caacaacagaaacaaaaccccaaag

SEQ ID NO: 319458 - RNA, 28 nt, Human
caacaacagaaacaaaaccccaaagcaa

SEQ ID NO: 319459 - RNA, 18 nt, Human
caacagaaacaaaacccc

SEQ ID NO: 319460 - RNA, 20 nt, Human
caccacaauagccguugagc

SEQ ID NO: 319461 - RNA, 20 nt, Human
cagaaacaaaaccccaaagc

SEQ ID NO: 319462 - RNA, 26 nt, Human
cagaaacaaaaccccaaagcaaauaa

SEQ ID NO: 319463 - RNA, 25 nt, Human
caggugaaauagagggauuccucuu

SEQ ID NO: 319464 - RNA, 20 nt, Human
cagugcagaaaaagagggaa

SEQ ID NO: 319465 - RNA, 23 nt, Human
cccaaagcaaauaaaguuugaaa

SEQ ID NO: 319466 - RNA, 22 nt, Human
ccccggggccgcgggaccgcgg

SEQ ID NO: 319467 - RNA, 23 nt, Human
cccgagaggugccggccccgggg

SEQ ID NO: 319468 - RNA, 21 nt, Human
ccggagcccgagaggugccgg

SEQ ID NO: 319469 - RNA, 26 nt, Human
cuaaaagcacauucuuggaauuuuag

SEQ ID NO: 319470 - RNA, 24 nt, Human
gaacaacaacagaaacaaaacccc

SEQ ID NO: 319471 - RNA, 25 nt, Human
gacagaaaugaaggacggagaucua

SEQ ID NO: 319472 - RNA, 23 nt, Human
gauaacauuuuauuuugagcaug

SEQ ID NO: 319473 - RNA, 20 nt, Human
gcuccaggcccggaagugga

SEQ ID NO: 319474 - RNA, 23 nt, Human
ggagcccgagaggugccggcccc

SEQ ID NO: 319475 - RNA, 21 nt, Human
ggccuugcuagagugacugug

SEQ ID NO: 319476 - RNA, 24 nt, Human
uaaaaaugucaccacaauagccgu

SEQ ID NO: 319477 - RNA, 19 nt, Human
uaaaagcacauucuuggaa

SEQ ID NO: 319478 - RNA, 20 nt, Human
uacaacacugagguagcacc

SEQ ID NO: 319479 - RNA, 23 nt, Human
uagucucaucagaaaaucaaaca

SEQ ID NO: 319480 - RNA, 19 nt, Human
ucaaggucuggugccucca

SEQ ID NO: 319481 - RNA, 21 nt, Human
ucaaguaguuuggggaugagg

SEQ ID NO: 319482 - RNA, 24 nt, Human
uccacagauuggaugguugggggu

SEQ ID NO: 319483 - RNA, 21 nt, Human
uccagaacaggugaaauagag

SEQ ID NO: 319484 - RNA, 25 nt, Human
ugaacaacaacagaaacaaaacccc

SEQ ID NO: 319485 - RNA, 25 nt, Human
ugagguagcacccaagcugguugcc

SEQ ID NO: 319486 - RNA, 18 nt, Human
uggcagugcagaaaaaga

SEQ ID NO: 319487 - RNA, 21 nt, Human
uggcagugcagaaaaagaggg

SEQ ID NO: 319488 - RNA, 23 nt, Human
ugggucuacuuagcugacaugcu

SEQ ID NO: 319489 - RNA, 22 nt, Human
uggguucugaaacacugucacu

SEQ ID NO: 319490 - RNA, 20 nt, Human
uggugccaaaugcccuuuuc

SEQ ID NO: 319491 - RNA, 18 nt, Human
ugguugcccuuugacccc

SEQ ID NO: 319492 - RNA, 20 nt, Human
uguguuaauuaugcagcugc

SEQ ID NO: 319493 - RNA, 18 nt, Human
uguucuuuucaaggucug

SEQ ID NO: 319494 - RNA, 26 nt, Human
uuagcugacaugcugcggaaaauaaa

SEQ ID NO: 319495 - RNA, 25 nt, Human
uucaaguaguuuggggaugagggug

SEQ ID NO: 319496 - RNA, 20 nt, Human
uugaacaacaacagaaacaa

SEQ ID NO: 319497 - RNA, 18 nt, Human
uugggggugaauauggca

SEQ ID NO: 319498 - RNA, 24 nt, Human
uuuggguucugaaacacugucacu

SEQ ID NO: 319499 - RNA, 20 nt, Human
aggggcaggcgccaaggguc

SEQ ID NO: 319500 - RNA, 25 nt, Human
ccguugcaggggcaggcgccaaggg

SEQ ID NO: 319501 - RNA, 18 nt, Human
aagggagaggagcuggag

SEQ ID NO: 319502 - RNA, 21 nt, Human
aagggagaggagcuggagacu

SEQ ID NO: 319503 - RNA, 22 nt, Human
agaaggccaggaacgcuuggga

SEQ ID NO: 319504 - RNA, 19 nt, Human
agaggagcuggagacucga

SEQ ID NO: 319505 - RNA, 19 nt, Human
agggaccaggauccugccu

SEQ ID NO: 319506 - RNA, 21 nt, Human
aggggguggugaaguuggggg

SEQ ID NO: 319507 - RNA, 21 nt, Human
caggauccugccuuucuuggg

SEQ ID NO: 319508 - RNA, 23 nt, Human
cagguggaagggagaggagcugg

SEQ ID NO: 319509 - RNA, 24 nt, Human
ccccagaaacguagcagggaccag

SEQ ID NO: 319510 - RNA, 23 nt, Human
ccccagaaacguagcagggaccc

SEQ ID NO: 319511 - RNA, 19 nt, Human
cccgggcgcgccggcuccg

SEQ ID NO: 319512 - RNA, 21 nt, Human
cccgggcgcgccggcuccgca

SEQ ID NO: 319513 - RNA, 20 nt, Human
ccuuucuugggggaaacagg

SEQ ID NO: 319514 - RNA, 23 nt, Human
cgcgccaggcagggagcggcacc

SEQ ID NO: 319515 - RNA, 22 nt, Human
cggcggaggggacguuggggac

SEQ ID NO: 319516 - RNA, 18 nt, Human
gaaguugggggugaagug

SEQ ID NO: 319517 - RNA, 19 nt, Human
gaccaggauccugccuuuc

SEQ ID NO: 319518 - RNA, 25 nt, Human
gaccaggauccugccuuucuugggg

SEQ ID NO: 319519 - RNA, 19 nt, Human
gcagagcuggaaugcuggg

SEQ ID NO: 319520 - RNA, 21 nt, Human
gcggagcgcgccaggcaggga

SEQ ID NO: 319521 - RNA, 26 nt, Human
gcuggaaugcuggggugcaggaucua

SEQ ID NO: 319522 - RNA, 25 nt, Human
ggaaacagguggaagggagaggagc

SEQ ID NO: 319523 - RNA, 18 nt, Human
ggaaugcuggggugcagg

SEQ ID NO: 319524 - RNA, 25 nt, Human
ggagaggggcaaggcaccuccaggu

SEQ ID NO: 319525 - RNA, 20 nt, Human
ggccaggaacgcuugggagg

SEQ ID NO: 319526 - RNA, 24 nt, Human
gggaaauuccgaggugggcaggag

SEQ ID NO: 319527 - RNA, 22 nt, Human
gggcagagcuggaaugcugggg

SEQ ID NO: 319528 - RNA, 20 nt, Human
gggcaggagaggggcaaggc

SEQ ID NO: 319529 - RNA, 23 nt, Human
ggggugcaggaucuagaauggga

SEQ ID NO: 319530 - RNA, 24 nt, Human
gguggaagggagaggagcuggaga

SEQ ID NO: 319531 - RNA, 19 nt, Human
guauggaguucagaaggcc

SEQ ID NO: 319532 - RNA, 19 nt, Human
uggaagggagaggagcugg

SEQ ID NO: 319533 - RNA, 21 nt, Human
uggaagggagaggagcuggag

SEQ ID NO: 319534 - RNA, 23 nt, Human
uggaaugcuggggugccgcggug

SEQ ID NO: 319535 - RNA, 23 nt, Human
uggaguucagaaggccaggaacg

SEQ ID NO: 319536 - RNA, 18 nt, Human
uggggugcaggaucuaga

SEQ ID NO: 319537 - RNA, 20 nt, Human
uggugaaguugggggugaag

SEQ ID NO: 319538 - RNA, 20 nt, Human
uugggggugaaguggggcug

SEQ ID NO: 319539 - RNA, 22 nt, Human
aagguucuuguucuaaggcuga

SEQ ID NO: 319540 - RNA, 18 nt, Human
agaguucuucacuugcuc

SEQ ID NO: 319541 - RNA, 18 nt, Human
aggagucgaggcagcccu

SEQ ID NO: 319542 - RNA, 20 nt, Human
cagaguucuucacuugcucc

SEQ ID NO: 319543 - RNA, 21 nt, Human
cccggccccggggggccugcu

SEQ ID NO: 319544 - RNA, 20 nt, Human
ccgcugccccggccccgggg

SEQ ID NO: 319545 - RNA, 20 nt, Human
ccggcgccgcugccccggcc

SEQ ID NO: 319546 - RNA, 19 nt, Human
cgugcccucucucucacuc

SEQ ID NO: 319547 - RNA, 22 nt, Human
cuaagcgccccucgacuggcca

SEQ ID NO: 319548 - RNA, 24 nt, Human
cucuauuccuuuggguucucgugc

SEQ ID NO: 319549 - RNA, 21 nt, Human
gcccucucucucacuccccau

SEQ ID NO: 319550 - RNA, 18 nt, Human
ggccccggggggccugcu

SEQ ID NO: 319551 - RNA, 22 nt, Human
gggccugcuucgcagcgggaga

SEQ ID NO: 319552 - RNA, 21 nt, Human
gucgaggcagcccuggggaaa

SEQ ID NO: 319553 - RNA, 25 nt, Human
uaagcgccccucgacuggccauucu

SEQ ID NO: 319554 - RNA, 19 nt, Human
uaguugauaucugaaaguu

SEQ ID NO: 319555 - RNA, 21 nt, Human
ucgaggcagcccuggggaaag

SEQ ID NO: 319556 - RNA, 19 nt, Human
ucucgugcccucucucuca

SEQ ID NO: 319557 - RNA, 19 nt, Human
ucucuauuccuuuggguuc

SEQ ID NO: 319558 - RNA, 22 nt, Human
ucugccuccuccguccgaauuc

SEQ ID NO: 319559 - RNA, 24 nt, Human
ucuuguucuaaggcugaugcuggg

SEQ ID NO: 319560 - RNA, 21 nt, Human
ugccccggccccggggggccu

SEQ ID NO: 319561 - RNA, 19 nt, Human
aaacagauguaauaauuga

SEQ ID NO: 319562 - RNA, 19 nt, Human
accuaccugcccaccucgc

SEQ ID NO: 319563 - RNA, 22 nt, Human
acugaaaaaccaguucaacuaa

SEQ ID NO: 319564 - RNA, 20 nt, Human
aggccgggggugcggggggc

SEQ ID NO: 319565 - RNA, 20 nt, Human
ccgcagcgccgacccaaggg

SEQ ID NO: 319566 - RNA, 23 nt, Human
ccggagaaccgcggccguccgcc

SEQ ID NO: 319567 - RNA, 25 nt, Human
ccguccgcccaccuaccugcccacc

SEQ ID NO: 319568 - RNA, 19 nt, Human
ccuaccugcccaccucgcc

SEQ ID NO: 319569 - RNA, 26 nt, Human
ccucacucccccgccucaacgcugga

SEQ ID NO: 319570 - RNA, 23 nt, Human
cucccccgccucaacgcuggagg

SEQ ID NO: 319571 - RNA, 19 nt, Human
cuccgccgccugcgcuugc

SEQ ID NO: 319572 - RNA, 22 nt, Human
gcuaguaguauuaauuuuuuuu

SEQ ID NO: 319573 - RNA, 21 nt, Human
uaaauggcaacaugaguagaa

SEQ ID NO: 319574 - RNA, 22 nt, Human
uaccugcccaccucgcccgcag

SEQ ID NO: 319575 - RNA, 23 nt, Human
uaguauuaauuuuuuuuucauag

SEQ ID NO: 319576 - RNA, 21 nt, Human
ucccucugggucggcaucucc

SEQ ID NO: 319577 - RNA, 18 nt, Human
ucgccggagcagccggaa

SEQ ID NO: 319578 - RNA, 20 nt, Human
ugcagcaaguuuauccaugc

SEQ ID NO: 319579 - RNA, 22 nt, Human
ugcagcaaguuuauccaugcau

SEQ ID NO: 319580 - RNA, 18 nt, Human
uggaggccgggggugcgg

SEQ ID NO: 319581 - RNA, 30 nt, Human
uuuuuuuuuuuaaacaaaaaagguaacuuu

SEQ ID NO: 319582 - RNA, 18 nt, Human
ccccggcgcgcggcccgc

SEQ ID NO: 319583 - RNA, 22 nt, Human
ccgcuccggccugcucggcucc

SEQ ID NO: 319584 - RNA, 18 nt, Human
ccuuuuuaaaaacuaaga

SEQ ID NO: 319585 - RNA, 19 nt, Human
cgcuccggccugcucggcu

SEQ ID NO: 319586 - RNA, 22 nt, Human
cgggcgcggcgcgacccucccc

SEQ ID NO: 319587 - RNA, 27 nt, Human
cucucgggcaggggcaggggcaggggc

SEQ ID NO: 319588 - RNA, 20 nt, Human
gaggagcgcgcgugcgcccc

SEQ ID NO: 319589 - RNA, 24 nt, Human
gccgcccgccagggguccccgcgc

SEQ ID NO: 319590 - RNA, 20 nt, Human
ggagggaggggcggccagag

SEQ ID NO: 319591 - RNA, 18 nt, Human
ggcaaaucccaaaggccu

SEQ ID NO: 319592 - RNA, 18 nt, Human
ggcaggggcaggggcagg

SEQ ID NO: 319593 - RNA, 24 nt, Human
ggcaggggcaggggcaggggaggg

SEQ ID NO: 319594 - RNA, 21 nt, Human
ggcgcggcgcgacccuccccg

SEQ ID NO: 319595 - RNA, 19 nt, Human
gggcaggggcaggggaggg

SEQ ID NO: 319596 - RNA, 21 nt, Human
gggcaggggcaggggcagggg

SEQ ID NO: 319597 - RNA, 21 nt, Human
gggcaggggcaggggcagggg

SEQ ID NO: 319598 - RNA, 22 nt, Human
gggcaggggcaggggcaggggc

SEQ ID NO: 319599 - RNA, 21 nt, Human
ggggagggggcgggcgcggcg

SEQ ID NO: 319600 - RNA, 22 nt, Human
aagaaaaacacugauuugcaaa

SEQ ID NO: 319601 - RNA, 20 nt, Human
acagaguauuauaagaaaga

SEQ ID NO: 319602 - RNA, 19 nt, Human
acucagauacaucaacagu

SEQ ID NO: 319603 - RNA, 23 nt, Human
agaaaaacacugauuugcaaagg

SEQ ID NO: 319604 - RNA, 25 nt, Human
agacggaaaauaaaaacuuuccgga

SEQ ID NO: 319605 - RNA, 23 nt, Human
aggaggaggaggagggcgaggag

SEQ ID NO: 319606 - RNA, 22 nt, Human
aggaggaggagggcgaggagaa

SEQ ID NO: 319607 - RNA, 21 nt, Human
aggcauuuaggcuuaagagca

SEQ ID NO: 319608 - RNA, 19 nt, Human
augggacacaccaaacaga

SEQ ID NO: 319609 - RNA, 21 nt, Human
cacaccaaacagaacuacuuc

SEQ ID NO: 319610 - RNA, 23 nt, Human
cacaccaaacagaacuacuucac

SEQ ID NO: 319611 - RNA, 21 nt, Human
cacagauacauucugucucuu

SEQ ID NO: 319612 - RNA, 19 nt, Human
cacagcuaggugcauuguc

SEQ ID NO: 319613 - RNA, 22 nt, Human
ccaggcaggcaaaggauucaaa

SEQ ID NO: 319614 - RNA, 19 nt, Human
cccacauggguuuuggagu

SEQ ID NO: 319615 - RNA, 24 nt, Human
cccuccucauucauuuuuuuccca

SEQ ID NO: 319616 - RNA, 18 nt, Human
cgaggaggaggaggaggg

SEQ ID NO: 319617 - RNA, 18 nt, Human
cuaaggcauuuaggcuua

SEQ ID NO: 319618 - RNA, 25 nt, Human
cuacccuccucauucauuuuuuucc

SEQ ID NO: 319619 - RNA, 19 nt, Human
gaggaggaggagagaagga

SEQ ID NO: 319620 - RNA, 19 nt, Human
gaggggagggcgaggagga

SEQ ID NO: 319621 - RNA, 19 nt, Human
gaucgggaggggagggcga

SEQ ID NO: 319622 - RNA, 18 nt, Human
gcaaaggauucaaaacua

SEQ ID NO: 319623 - RNA, 20 nt, Human
gcggcgcggcagcaggaaag

SEQ ID NO: 319624 - RNA, 20 nt, Human
gggcagcggagggcgggggc

SEQ ID NO: 319625 - RNA, 21 nt, Human
gggcgcagggccgggcagcgg

SEQ ID NO: 319626 - RNA, 18 nt, Human
ggggaugaggaucgggag

SEQ ID NO: 319627 - RNA, 22 nt, Human
ggugcauugucuugaguuuaaa

SEQ ID NO: 319628 - RNA, 23 nt, Human
guuucagggaacuuuuguuaaua

SEQ ID NO: 319629 - RNA, 23 nt, Human
uaaauauacugaggcacaccagu

SEQ ID NO: 319630 - RNA, 18 nt, Human
uaacaaguuucguguuuc

SEQ ID NO: 319631 - RNA, 25 nt, Human
uaagaaaaacacugauuugcaaagg

SEQ ID NO: 319632 - RNA, 19 nt, Human
uaagagcacuaggucuugc

SEQ ID NO: 319633 - RNA, 24 nt, Human
uacaacagaguauuauaagaaaga

SEQ ID NO: 319634 - RNA, 20 nt, Human
uacaaugacaacaccaaugg

SEQ ID NO: 319635 - RNA, 18 nt, Human
uaggucuugcacagcuag

SEQ ID NO: 319636 - RNA, 23 nt, Human
ucccacauggguuuuggaguugu

SEQ ID NO: 319637 - RNA, 19 nt, Human
ucccugggcugggggaggg

SEQ ID NO: 319638 - RNA, 20 nt, Human
ucccugggcugggggagggc

SEQ ID NO: 319639 - RNA, 21 nt, Human
ucccugggcugggggagggca

SEQ ID NO: 319640 - RNA, 23 nt, Human
uccucauucauuuuuuucccaca

SEQ ID NO: 319641 - RNA, 19 nt, Human
ugaaaaauacacaaaggug

SEQ ID NO: 319642 - RNA, 24 nt, Human
ugaggcacaccaggcaggcaaagg

SEQ ID NO: 319643 - RNA, 21 nt, Human
ugcaaaggcacaguggagaca

SEQ ID NO: 319644 - RNA, 19 nt, Human
ugggcugggggagggcaag

SEQ ID NO: 319645 - RNA, 20 nt, Human
uucacaauaacaaguuucgu

SEQ ID NO: 319646 - RNA, 23 nt, Human
uucauagaacacuggaaauaauc

SEQ ID NO: 319647 - RNA, 23 nt, Human
aaaaaaacaaacaaacaaacaua

SEQ ID NO: 319648 - RNA, 18 nt, Human
aaaacccuucaaugccuc

SEQ ID NO: 319649 - RNA, 22 nt, Human
aaaauaacagcaguaaagaaaa

SEQ ID NO: 319650 - RNA, 23 nt, Human
aaacaaacaaacaaacauauauu

SEQ ID NO: 319651 - RNA, 18 nt, Human
aacacaaccagguaaaac

SEQ ID NO: 319652 - RNA, 22 nt, Human
aacuucuuuauuuccucuguua

SEQ ID NO: 319653 - RNA, 20 nt, Human
aagcccaauaggcuagggga

SEQ ID NO: 319654 - RNA, 19 nt, Human
aauaacagcaguaaagaaa

SEQ ID NO: 319655 - RNA, 18 nt, Human
aauugacuuuaaaacacu

SEQ ID NO: 319656 - RNA, 21 nt, Human
acagcaguaaagaaaaugacc

SEQ ID NO: 319657 - RNA, 25 nt, Human
acagcaguaaagaaaaugaccgcac

SEQ ID NO: 319658 - RNA, 19 nt, Human
acaggagacuagcuucagg

SEQ ID NO: 319659 - RNA, 21 nt, Human
acaguagauugauugccuagu

SEQ ID NO: 319660 - RNA, 23 nt, Human
acugacccugcacuggcccuggc

SEQ ID NO: 319661 - RNA, 25 nt, Human
agaaaaaaggauacuguuugcuaua

SEQ ID NO: 319662 - RNA, 25 nt, Human
agaagaaaaaaaaaaagguuuacaa

SEQ ID NO: 319663 - RNA, 22 nt, Human
agacaggagacuagcuucaggg

SEQ ID NO: 319664 - RNA, 25 nt, Human
agaguagcagagcaacuccaaaaag

SEQ ID NO: 319665 - RNA, 22 nt, Human
aggauuuaacaucacugagcua

SEQ ID NO: 319666 - RNA, 19 nt, Human
auauauauauauauauaua

SEQ ID NO: 319667 - RNA, 21 nt, Human
auaucagucccaucaaaaagc

SEQ ID NO: 319668 - RNA, 21 nt, Human
auauuaaaaauguacugaaca

SEQ ID NO: 319669 - RNA, 21 nt, Human
auggcugcugugaggguaaac

SEQ ID NO: 319670 - RNA, 31 nt, Human
auuuauauuuuuuuauauauauauauauauu

SEQ ID NO: 319671 - RNA, 20 nt, Human
caaaaccaguuauugcuuag

SEQ ID NO: 319672 - RNA, 22 nt, Human
caaauguccucauuuucauucu

SEQ ID NO: 319673 - RNA, 21 nt, Human
caacaaauacaaagagugcaa

SEQ ID NO: 319674 - RNA, 21 nt, Human
caacacugugacaaagggaga

SEQ ID NO: 319675 - RNA, 23 nt, Human
caacucagcacuuagaccagcag

SEQ ID NO: 319676 - RNA, 24 nt, Human
cacauccccucaaacugcuuaaaa

SEQ ID NO: 319677 - RNA, 22 nt, Human
caccuucucaaauguccacacc

SEQ ID NO: 319678 - RNA, 23 nt, Human
cacuccuacacauccccucaaac

SEQ ID NO: 319679 - RNA, 24 nt, Human
cacuggcccuggcuaaaaagcaga

SEQ ID NO: 319680 - RNA, 21 nt, Human
cagaacauucuuuuuuuuuuu

SEQ ID NO: 319681 - RNA, 19 nt, Human
cagcaaaauaucaguccau

SEQ ID NO: 319682 - RNA, 20 nt, Human
cagcacugcagaugacaauc

SEQ ID NO: 319683 - RNA, 22 nt, Human
cagcagaguggagcuaugcaaa

SEQ ID NO: 319684 - RNA, 19 nt, Human
cagcaggauagaguugacg

SEQ ID NO: 319685 - RNA, 20 nt, Human
cagcaguacucuuccuuuug

SEQ ID NO: 319686 - RNA, 19 nt, Human
caggaaauacauauugaau

SEQ ID NO: 319687 - RNA, 19 nt, Human
cagugccuuuacaaaauuu

SEQ ID NO: 319688 - RNA, 18 nt, Human
caguuucccgccuguacc

SEQ ID NO: 319689 - RNA, 18 nt, Human
cauauuuagcagcagagu

SEQ ID NO: 319690 - RNA, 18 nt, Human
ccaggccaacauaacuaa

SEQ ID NO: 319691 - RNA, 22 nt, Human
cccagugugcuuuuucuaggca

SEQ ID NO: 319692 - RNA, 21 nt, Human
ccccucaaacugcuuaaaaua

SEQ ID NO: 319693 - RNA, 21 nt, Human
ccuacucauuaugaacuacag

SEQ ID NO: 319694 - RNA, 27 nt, Human
ccucaaacugcuuaaaauaauugacuu

SEQ ID NO: 319695 - RNA, 21 nt, Human
ccuuaaaaaaacaaacaaaca

SEQ ID NO: 319696 - RNA, 24 nt, Human
ccuuaaaaaaacaaacaaacaaac

SEQ ID NO: 319697 - RNA, 18 nt, Human
ccuugccucaguuuucuu

SEQ ID NO: 319698 - RNA, 18 nt, Human
cuagacaggagacuagcu

SEQ ID NO: 319699 - RNA, 19 nt, Human
cuccuacacauccccucaa

SEQ ID NO: 319700 - RNA, 26 nt, Human
cugacugaacccuagguaaagauaaa

SEQ ID NO: 319701 - RNA, 21 nt, Human
cugcagaugacaaucuacgaa

SEQ ID NO: 319702 - RNA, 23 nt, Human
gaacaugcauauuuagcagcaga

SEQ ID NO: 319703 - RNA, 21 nt, Human
gaacugccgacagaccugcca

SEQ ID NO: 319704 - RNA, 22 nt, Human
gaagucauccucuaucacaggg

SEQ ID NO: 319705 - RNA, 19 nt, Human
gacaaagggagaggcaaga

SEQ ID NO: 319706 - RNA, 19 nt, Human
gaccuaaaaaagaaaggua

SEQ ID NO: 319707 - RNA, 21 nt, Human
gaguccaagaccucagcaaaa

SEQ ID NO: 319708 - RNA, 21 nt, Human
gauacuuauacuagaaauagg

SEQ ID NO: 319709 - RNA, 23 nt, Human
gaugacaaucuacgaagaacaag

SEQ ID NO: 319710 - RNA, 18 nt, Human
gcagcacugcagaugaca

SEQ ID NO: 319711 - RNA, 21 nt, Human
ggagucuugauugaccuaaaa

SEQ ID NO: 319712 - RNA, 19 nt, Human
guaaaacagcccagugugc

SEQ ID NO: 319713 - RNA, 20 nt, Human
guaaagauaaauuguguaaa

SEQ ID NO: 319714 - RNA, 23 nt, Human
guucuuuuacuuuuguuagagug

SEQ ID NO: 319715 - RNA, 25 nt, Human
uaaaagaacuuagaacacaggagua

SEQ ID NO: 319716 - RNA, 18 nt, Human
uaaaauaacacaaccagg

SEQ ID NO: 319717 - RNA, 23 nt, Human
uaaaauaacagcaguaaagaaaa

SEQ ID NO: 319718 - RNA, 21 nt, Human
uaaagacaaaaaguuaugcag

SEQ ID NO: 319719 - RNA, 23 nt, Human
uaaagccgagaucugcaccugcu

SEQ ID NO: 319720 - RNA, 22 nt, Human
uaacaacaaauacaaagagugc

SEQ ID NO: 319721 - RNA, 18 nt, Human
uaacagcaguaaagaaag

SEQ ID NO: 319722 - RNA, 24 nt, Human
uaagaugaagcucauaaugacuua

SEQ ID NO: 319723 - RNA, 24 nt, Human
uacaaaauuuuuagaaaacuucuu

SEQ ID NO: 319724 - RNA, 19 nt, Human
uaccaagaggggaauguuu

SEQ ID NO: 319725 - RNA, 23 nt, Human
uaccaagaggggaauguuuccug

SEQ ID NO: 319726 - RNA, 19 nt, Human
uagaccagcaguacucuuc

SEQ ID NO: 319727 - RNA, 18 nt, Human
uagcagcagaguggagcu

SEQ ID NO: 319728 - RNA, 18 nt, Human
uauauauauauauauaua

SEQ ID NO: 319729 - RNA, 19 nt, Human
uauauauauauauauauau

SEQ ID NO: 319730 - RNA, 21 nt, Human
uauuaaaaauguacugaacag

SEQ ID NO: 319731 - RNA, 23 nt, Human
uauucaguacuuuuccuuugguu

SEQ ID NO: 319732 - RNA, 20 nt, Human
ucaaggaguugaaugcccca

SEQ ID NO: 319733 - RNA, 25 nt, Human
ucacgacaacacugugacaaaggag

SEQ ID NO: 319734 - RNA, 19 nt, Human
ucacugagcuauccucagc

SEQ ID NO: 319735 - RNA, 23 nt, Human
ucaguccauaaaaugaaaucccc

SEQ ID NO: 319736 - RNA, 23 nt, Human
uccacaccuuaaaucaccuucuc

SEQ ID NO: 319737 - RNA, 22 nt, Human
uccacuccuacacauccccuca

SEQ ID NO: 319738 - RNA, 19 nt, Human
ucccuaauuaucuuagaag

SEQ ID NO: 319739 - RNA, 24 nt, Human
ucccuaauuaucuuagaagcuguu

SEQ ID NO: 319740 - RNA, 21 nt, Human
uccuuaaaaaaacaaacaaac

SEQ ID NO: 319741 - RNA, 22 nt, Human
ucucaaauguccacaccuuaaa

SEQ ID NO: 319742 - RNA, 20 nt, Human
ucugaucuucacgacaacac

SEQ ID NO: 319743 - RNA, 22 nt, Human
ucuuuauuuccucuguuaagcc

SEQ ID NO: 319744 - RNA, 20 nt, Human
ugacugaacccuagguaaag

SEQ ID NO: 319745 - RNA, 21 nt, Human
ugauauaaacagacuuuggug

SEQ ID NO: 319746 - RNA, 19 nt, Human
uggaaaaguauggugauag

SEQ ID NO: 319747 - RNA, 18 nt, Human
uggagaagaaaaaaaaaa

SEQ ID NO: 319748 - RNA, 23 nt, Human
uggagcuaugcaaagacauacaa

SEQ ID NO: 319749 - RNA, 18 nt, Human
uggagucuugauugaccu

SEQ ID NO: 319750 - RNA, 23 nt, Human
uggauauaaccaaaaaaauauua

SEQ ID NO: 319751 - RNA, 24 nt, Human
uggcuaaaaagcagaaauuacuga

SEQ ID NO: 319752 - RNA, 24 nt, Human
uggucucaaauacuacuaacuguu

SEQ ID NO: 319753 - RNA, 22 nt, Human
uguaacaucauuugucccuaau

SEQ ID NO: 319754 - RNA, 20 nt, Human
ugucaaggugaaauccucuu

SEQ ID NO: 319755 - RNA, 23 nt, Human
ugucagucagaacaugcauauuu

SEQ ID NO: 319756 - RNA, 18 nt, Human
uguugauauaaacagacu

SEQ ID NO: 319757 - RNA, 21 nt, Human
uguuugaaauuuggcaguaag

SEQ ID NO: 319758 - RNA, 24 nt, Human
uuaaaacacuccagauaucugcaa

SEQ ID NO: 319759 - RNA, 27 nt, Human
uuaaaauaacagcaguaaagaaaauga

SEQ ID NO: 319760 - RNA, 22 nt, Human
uuaaauagcuggcugcuggagc

SEQ ID NO: 319761 - RNA, 18 nt, Human
uuacugacugaacccuag

SEQ ID NO: 319762 - RNA, 20 nt, Human
uuaggcauuuaacaacaaau

SEQ ID NO: 319763 - RNA, 20 nt, Human
uucacgacaacacugugaca

SEQ ID NO: 319764 - RNA, 21 nt, Human
uucacgacaacacugugacaa

SEQ ID NO: 319765 - RNA, 24 nt, Human
uuccuuugguuuacuaauuugaua

SEQ ID NO: 319766 - RNA, 23 nt, Human
uugaccuaaaaaagaaagguaaa

SEQ ID NO: 319767 - RNA, 19 nt, Human
uuggugaaacugggaaguc

SEQ ID NO: 319768 - RNA, 20 nt, Human
uuggugaaacugggaaguca

SEQ ID NO: 319769 - RNA, 21 nt, Human
uuuacuuuuguuagaguggag

SEQ ID NO: 319770 - RNA, 19 nt, Human
uuuauauauauauauauau

SEQ ID NO: 319771 - RNA, 20 nt, Human
uuucagucuguacuugucuc

SEQ ID NO: 319772 - RNA, 21 nt, Human
uuuuauauauauauauauauu

SEQ ID NO: 319773 - RNA, 19 nt, Human
uuuucauucuggggggaug

SEQ ID NO: 319774 - RNA, 20 nt, Human
aaaaaggaacccaagcagug

SEQ ID NO: 319775 - RNA, 24 nt, Human
aaaaccuauccagggcuggccccc

SEQ ID NO: 319776 - RNA, 21 nt, Human
aaccuauccagggcuggcccc

SEQ ID NO: 319777 - RNA, 21 nt, Human
acuucaggagcgucugugaga

SEQ ID NO: 319778 - RNA, 19 nt, Human
agaaggcaaauucuuuccu

SEQ ID NO: 319779 - RNA, 18 nt, Human
agacacacggcaucguca

SEQ ID NO: 319780 - RNA, 20 nt, Human
agugauuacuugucugcggc

SEQ ID NO: 319781 - RNA, 21 nt, Human
auccagggcuggcccccagca

SEQ ID NO: 319782 - RNA, 21 nt, Human
caggagacgagacacacggca

SEQ ID NO: 319783 - RNA, 20 nt, Human
ccaagcagugucucuugaac

SEQ ID NO: 319784 - RNA, 21 nt, Human
cccccagcauuuauacauccc

SEQ ID NO: 319785 - RNA, 23 nt, Human
uaaaaaccuauccagggcuggcc

SEQ ID NO: 319786 - RNA, 21 nt, Human
uaucaagucuugaaaccuuuc

SEQ ID NO: 319787 - RNA, 18 nt, Human
ucacaugggggcgaacgg

SEQ ID NO: 319788 - RNA, 19 nt, Human
ucagucuuuauuguugagu

SEQ ID NO: 319789 - RNA, 24 nt, Human
uccaagugcggagacccaucuuuc

SEQ ID NO: 319790 - RNA, 24 nt, Human
ugcuacagauaaagucacaugggg

SEQ ID NO: 319791 - RNA, 23 nt, Human
uggcgcccaggugaagagccaua

SEQ ID NO: 319792 - RNA, 19 nt, Human
uguuucuuucuuuuuccaa

SEQ ID NO: 319793 - RNA, 26 nt, Human
uuucugcuacagauaaaggacaucgg

SEQ ID NO: 319794 - RNA, 24 nt, Human
acgaagccccacaaagguccugcc

SEQ ID NO: 319795 - RNA, 18 nt, Human
agcaaaggucaguaucca

SEQ ID NO: 319796 - RNA, 28 nt, Human
aguauccaccgcaccccucuuguccagc

SEQ ID NO: 319797 - RNA, 20 nt, Human
caccgcaccccucuugucca

SEQ ID NO: 319798 - RNA, 22 nt, Human
caccgcaccccucuuguccagc

SEQ ID NO: 319799 - RNA, 19 nt, Human
cagccccgccugggcccca

SEQ ID NO: 319800 - RNA, 27 nt, Human
cccacaaagguccugccgccacagagg

SEQ ID NO: 319801 - RNA, 19 nt, Human
cccgaaacggguucugugg

SEQ ID NO: 319802 - RNA, 18 nt, Human
cccgccugggccccagag

SEQ ID NO: 319803 - RNA, 18 nt, Human
ccugggccccagagcagg

SEQ ID NO: 319804 - RNA, 22 nt, Human
cggagcaaaggucaguauccac

SEQ ID NO: 319805 - RNA, 23 nt, Human
cggagcaaaggucaguauccacc

SEQ ID NO: 319806 - RNA, 21 nt, Human
cucaccagacgcucugaggcc

SEQ ID NO: 319807 - RNA, 22 nt, Human
cucaccagacgcucugaggccc

SEQ ID NO: 319808 - RNA, 23 nt, Human
cuugagguucucugcgcccaucc

SEQ ID NO: 319809 - RNA, 19 nt, Human
gacagggcuggggguggug

SEQ ID NO: 319810 - RNA, 20 nt, Human
gacagggcuggggguggugg

SEQ ID NO: 319811 - RNA, 21 nt, Human
gcaggcccagaggggcgggug

SEQ ID NO: 319812 - RNA, 18 nt, Human
gcagggacagggcugggg

SEQ ID NO: 319813 - RNA, 19 nt, Human
gccacagaggagggcaaca

SEQ ID NO: 319814 - RNA, 23 nt, Human
gccggagcaaaggucaguaucca

SEQ ID NO: 319815 - RNA, 19 nt, Human
ggagggcaacagagccaca

SEQ ID NO: 319816 - RNA, 21 nt, Human
ggguggcagggacagggcugg

SEQ ID NO: 319817 - RNA, 20 nt, Human
gucaagucauucacuagucc

SEQ ID NO: 319818 - RNA, 20 nt, Human
uccccacuaggagggguggc

SEQ ID NO: 319819 - RNA, 19 nt, Human
ucuuuggaggcuguugggg

SEQ ID NO: 319820 - RNA, 22 nt, Human
ugaggucacaggucaagucauu

SEQ ID NO: 319821 - RNA, 19 nt, Human
ugcaggggcuggcuucaug

SEQ ID NO: 319822 - RNA, 19 nt, Human
uggcagggacagggcuggg

SEQ ID NO: 319823 - RNA, 22 nt, Human
uggcagggacagggcugggggu

SEQ ID NO: 319824 - RNA, 24 nt, Human
uggcagggacagggcugggggugg

SEQ ID NO: 319825 - RNA, 18 nt, Human
uggggccugggaaugugg

SEQ ID NO: 319826 - RNA, 22 nt, Human
uggggggcccagggagggcaag

SEQ ID NO: 319827 - RNA, 20 nt, Human
uuguauugaggucacagguc

SEQ ID NO: 319828 - RNA, 20 nt, Human
aaaaaaaacaaacaaauauc

SEQ ID NO: 319829 - RNA, 18 nt, Human
aaaggcuuugcuucagga

SEQ ID NO: 319830 - RNA, 20 nt, Human
acacugacauuuacagauga

SEQ ID NO: 319831 - RNA, 21 nt, Human
acucuuauacuacauugaagu

SEQ ID NO: 319832 - RNA, 19 nt, Human
acuuccaggaccaucuuua

SEQ ID NO: 319833 - RNA, 20 nt, Human
agaaaacauguaaagagcac

SEQ ID NO: 319834 - RNA, 22 nt, Human
agcuguaauagaucccacagcc

SEQ ID NO: 319835 - RNA, 21 nt, Human
aggcagaagcagguaagagaa

SEQ ID NO: 319836 - RNA, 26 nt, Human
agguuugcuggcagcugaccacaggg

SEQ ID NO: 319837 - RNA, 18 nt, Human
aguaugaaauugcagaau

SEQ ID NO: 319838 - RNA, 24 nt, Human
aucaauuuuuaaaaucugucagaa

SEQ ID NO: 319839 - RNA, 18 nt, Human
aucaugcauuauuuuuca

SEQ ID NO: 319840 - RNA, 23 nt, Human
caacugcuauuuuagguucaaac

SEQ ID NO: 319841 - RNA, 25 nt, Human
cacugcugggaaauaaaaucaugaa

SEQ ID NO: 319842 - RNA, 21 nt, Human
cagaaaaagcugucuucagca

SEQ ID NO: 319843 - RNA, 18 nt, Human
cagaagcagguaagagaa

SEQ ID NO: 319844 - RNA, 26 nt, Human
cagcaaggcagaagcagguaagagaa

SEQ ID NO: 319845 - RNA, 23 nt, Human
cagcuuauucacuaaaagguaau

SEQ ID NO: 319846 - RNA, 24 nt, Human
caggaccaccaugucaacugcuau

SEQ ID NO: 319847 - RNA, 22 nt, Human
caggccuaagacaagaagcuag

SEQ ID NO: 319848 - RNA, 25 nt, Human
caucuuuaagcacaauauuuuaaaa

SEQ ID NO: 319849 - RNA, 18 nt, Human
cccacuccacccuacccc

SEQ ID NO: 319850 - RNA, 24 nt, Human
cccacuccacccuaccccaagcau

SEQ ID NO: 319851 - RNA, 24 nt, Human
ccccacuccacccuaccccaagca

SEQ ID NO: 319852 - RNA, 21 nt, Human
ccuccgggcugccgggggcuc

SEQ ID NO: 319853 - RNA, 26 nt, Human
ccugccgcugcuccgcgucuugaggc

SEQ ID NO: 319854 - RNA, 25 nt, Human
cuccccacuccacccuaccccaagc

SEQ ID NO: 319855 - RNA, 25 nt, Human
cuccuccgggcugccgggggcuccc

SEQ ID NO: 319856 - RNA, 22 nt, Human
cuccuuccugccgcugcuccgc

SEQ ID NO: 319857 - RNA, 22 nt, Human
cucuagacugacuauguuguau

SEQ ID NO: 319858 - RNA, 20 nt, Human
gaauaaaguaaaucagcuug

SEQ ID NO: 319859 - RNA, 18 nt, Human
gacaugaacucugugacc

SEQ ID NO: 319860 - RNA, 20 nt, Human
gcugcuagucauuuacuucc

SEQ ID NO: 319861 - RNA, 22 nt, Human
guaaauauuaacaacuuugacu

SEQ ID NO: 319862 - RNA, 24 nt, Human
uaaaagggaauacuuuaagccuca

SEQ ID NO: 319863 - RNA, 19 nt, Human
uaaaaucugucagaaagaa

SEQ ID NO: 319864 - RNA, 24 nt, Human
uaauaauagucaacuggcaugcca

SEQ ID NO: 319865 - RNA, 18 nt, Human
uaauagucaacuggcaug

SEQ ID NO: 319866 - RNA, 21 nt, Human
uagugaaaaugcuugaguuuc

SEQ ID NO: 319867 - RNA, 18 nt, Human
uaucaaaaaaaacaaaca

SEQ ID NO: 319868 - RNA, 24 nt, Human
uaucaaaaaaaacaaacaaauauc

SEQ ID NO: 319869 - RNA, 21 nt, Human
uauuuauuuuuuggauggguu

SEQ ID NO: 319870 - RNA, 19 nt, Human
uauuuuuauaaaagggaau

SEQ ID NO: 319871 - RNA, 25 nt, Human
ucaaaaaaaacaaacaaauaucaug

SEQ ID NO: 319872 - RNA, 22 nt, Human
ucagaaaaagcugucuucagca

SEQ ID NO: 319873 - RNA, 21 nt, Human
ucagguuugcuggcagcugug

SEQ ID NO: 319874 - RNA, 19 nt, Human
uccccacuccacccuaccc

SEQ ID NO: 319875 - RNA, 26 nt, Human
ucccuccccacuccacccuaccccaa

SEQ ID NO: 319876 - RNA, 21 nt, Human
uccgggcugccgggggcuccu

SEQ ID NO: 319877 - RNA, 22 nt, Human
ucuccaugugaauaaaguaaau

SEQ ID NO: 319878 - RNA, 24 nt, Human
ucucugaccucaaauaaguaaugu

SEQ ID NO: 319879 - RNA, 18 nt, Human
ucuguuuuucauucuugu

SEQ ID NO: 319880 - RNA, 22 nt, Human
ugaaaugguuuugugaauugcu

SEQ ID NO: 319881 - RNA, 27 nt, Human
ugaagaaagggaauagcccaguuucug

SEQ ID NO: 319882 - RNA, 19 nt, Human
ugaauugcuuuuuuucccc

SEQ ID NO: 319883 - RNA, 22 nt, Human
ugccaauuuaucaaaaaaaaca

SEQ ID NO: 319884 - RNA, 19 nt, Human
ugcuucaggaccaccaugu

SEQ ID NO: 319885 - RNA, 21 nt, Human
ugcuugaguuucuggcuacac

SEQ ID NO: 319886 - RNA, 20 nt, Human
uggugaccccgagcacuaau

SEQ ID NO: 319887 - RNA, 19 nt, Human
uguuuuguucucugaccuc

SEQ ID NO: 319888 - RNA, 21 nt, Human
uguuuuuugguucaggccuaa

SEQ ID NO: 319889 - RNA, 20 nt, Human
uuaaucccuccccacuccac

SEQ ID NO: 319890 - RNA, 22 nt, Human
uuaaucccuccccacuccaccc

SEQ ID NO: 319891 - RNA, 21 nt, Human
uuagacaaguauauggacuca

SEQ ID NO: 319892 - RNA, 25 nt, Human
uuaguuagacaaguauauggacuca

SEQ ID NO: 319893 - RNA, 21 nt, Human
uucaggccuaagacaagaagc

SEQ ID NO: 319894 - RNA, 21 nt, Human
uuuauaauuaccuuugucucu

SEQ ID NO: 319895 - RNA, 24 nt, Human
uuucuacuucuuuuauuucuguuu

SEQ ID NO: 319896 - RNA, 23 nt, Human
uuuuauuuauuuuuuggaugggu

SEQ ID NO: 319897 - RNA, 23 nt, Human
uuuuuguuuguuuguuguuuuuu

SEQ ID NO: 319898 - RNA, 25 nt, Human
aaaaauuaacgaugauucuauacaa

SEQ ID NO: 319899 - RNA, 18 nt, Human
aaaagcaggugaaaguca

SEQ ID NO: 319900 - RNA, 20 nt, Human
aaucuugccucucccuggac

SEQ ID NO: 319901 - RNA, 23 nt, Human
accaccauuuuaagauaccacca

SEQ ID NO: 319902 - RNA, 19 nt, Human
acuacagugcaucaacauu

SEQ ID NO: 319903 - RNA, 24 nt, Human
agauuuucaaagagucagcagucu

SEQ ID NO: 319904 - RNA, 24 nt, Human
auaauacucugaaaagaaaauaau

SEQ ID NO: 319905 - RNA, 18 nt, Human
auccacaccauucuccuc

SEQ ID NO: 319906 - RNA, 18 nt, Human
caaucuugccucucccug

SEQ ID NO: 319907 - RNA, 20 nt, Human
cacugaucauaaaggagaga

SEQ ID NO: 319908 - RNA, 19 nt, Human
cagaaccauauccacacca

SEQ ID NO: 319909 - RNA, 20 nt, Human
cagcagucuuaccuacuaga

SEQ ID NO: 319910 - RNA, 26 nt, Human
caggaauuucuuuucccuaauggucu

SEQ ID NO: 319911 - RNA, 23 nt, Human
caguugagaaaagcaaauaaugu

SEQ ID NO: 319912 - RNA, 20 nt, Human
cauucuccucuucccauugu

SEQ ID NO: 319913 - RNA, 22 nt, Human
ccacaccauucuccucuuccca

SEQ ID NO: 319914 - RNA, 19 nt, Human
cccaauagaaaauaauuac

SEQ ID NO: 319915 - RNA, 20 nt, Human
cuagaauauauuuuccuuuc

SEQ ID NO: 319916 - RNA, 22 nt, Human
cucccuggacucaugucagagg

SEQ ID NO: 319917 - RNA, 24 nt, Human
cugaucauaaaggagagaaaauau

SEQ ID NO: 319918 - RNA, 18 nt, Human
gaaagucaggagguucug

SEQ ID NO: 319919 - RNA, 20 nt, Human
gauaugauuggaauggaaca

SEQ ID NO: 319920 - RNA, 24 nt, Human
gcaaaccaccauuuuaagauacca

SEQ ID NO: 319921 - RNA, 20 nt, Human
uaaaagcaggugaaagucag

SEQ ID NO: 319922 - RNA, 20 nt, Human
uaacaaggacuuucgaaaag

SEQ ID NO: 319923 - RNA, 23 nt, Human
uaagauaccaccaugcuuauaug

SEQ ID NO: 319924 - RNA, 18 nt, Human
uacugggaggcaaaagcc

SEQ ID NO: 319925 - RNA, 22 nt, Human
uagcaguugagaaaagcaaaua

SEQ ID NO: 319926 - RNA, 19 nt, Human
uagcaucauuuaaccacac

SEQ ID NO: 319927 - RNA, 18 nt, Human
uaucacagaauuuuucaa

SEQ ID NO: 319928 - RNA, 25 nt, Human
uaucacugaucauaaaggagagaaa

SEQ ID NO: 319929 - RNA, 20 nt, Human
ucaacauuugucaaugggau

SEQ ID NO: 319930 - RNA, 25 nt, Human
ucaccauuguuuuuccuucuauuug

SEQ ID NO: 319931 - RNA, 19 nt, Human
ucccuggacucaugucaga

SEQ ID NO: 319932 - RNA, 19 nt, Human
ucuaaguuccccaauagaa

SEQ ID NO: 319933 - RNA, 21 nt, Human
ucuucuguagaguacaggcag

SEQ ID NO: 319934 - RNA, 21 nt, Human
ugacuggauugauugauucag

SEQ ID NO: 319935 - RNA, 23 nt, Human
ugagaaaagcaaauaauguaaua

SEQ ID NO: 319936 - RNA, 23 nt, Human
ugagagcuggggagcucuccaaa

SEQ ID NO: 319937 - RNA, 23 nt, Human
ugcagaaaaaacugccacuuuaa

SEQ ID NO: 319938 - RNA, 20 nt, Human
uggaaaggaaaaugggguag

SEQ ID NO: 319939 - RNA, 19 nt, Human
uggaacaauagauugcaga

SEQ ID NO: 319940 - RNA, 22 nt, Human
uggaacaauagauugcagaaaa

SEQ ID NO: 319941 - RNA, 24 nt, Human
uggaauggaacaauagauugcaga

SEQ ID NO: 319942 - RNA, 19 nt, Human
uuaguaguacucaaacgag

SEQ ID NO: 319943 - RNA, 24 nt, Human
uuuucuaaguuccccaauagaaaa

SEQ ID NO: 319944 - RNA, 21 nt, Human
aaaaaaaaaaagaauaaagag

SEQ ID NO: 319945 - RNA, 24 nt, Human
aaaaagaauaaagagaugagccgg

SEQ ID NO: 319946 - RNA, 20 nt, Human
aaaaauaguaaaaaauuaaa

SEQ ID NO: 319947 - RNA, 21 nt, Human
aaagagaaaaaagaaggcuua

SEQ ID NO: 319948 - RNA, 20 nt, Human
aacauggugaaacccugucu

SEQ ID NO: 319949 - RNA, 20 nt, Human
aacauggugaaacccugucu

SEQ ID NO: 319950 - RNA, 21 nt, Human
aacauggugaaacccugucuu

SEQ ID NO: 319951 - RNA, 22 nt, Human
aacugcauaucagaagcaggau

SEQ ID NO: 319952 - RNA, 22 nt, Human
aagcgguagaaauuuaauaaau

SEQ ID NO: 319953 - RNA, 24 nt, Human
aauaaagagaugagccaggaaaaa

SEQ ID NO: 319954 - RNA, 24 nt, Human
aaucacuugaacccaagaggcaga

SEQ ID NO: 319955 - RNA, 19 nt, Human
acagagcgagacucugucu

SEQ ID NO: 319956 - RNA, 24 nt, Human
accucgaugccucgaugaagauug

SEQ ID NO: 319957 - RNA, 24 nt, Human
acuugaggucaggaguuugagacc

SEQ ID NO: 319958 - RNA, 23 nt, Human
agaaaaaagaaggcuuaaaaaaa

SEQ ID NO: 319959 - RNA, 20 nt, Human
agaaguugcagugagccaag

SEQ ID NO: 319960 - RNA, 22 nt, Human
agacugugucauugcacuccag

SEQ ID NO: 319961 - RNA, 22 nt, Human
agagaagcaaaccugagucaga

SEQ ID NO: 319962 - RNA, 24 nt, Human
agcacuuugggaggccgaggcagg

SEQ ID NO: 319963 - RNA, 19 nt, Human
agcagauuuuagauaauuu

SEQ ID NO: 319964 - RNA, 22 nt, Human
agccuggccaacauggugaaac

SEQ ID NO: 319965 - RNA, 24 nt, Human
agccuggccaacauggugaaaccc

SEQ ID NO: 319966 - RNA, 24 nt, Human
agccugggcaacagagcgagacuc

SEQ ID NO: 319967 - RNA, 20 nt, Human
aggaguuugagaccagccug

SEQ ID NO: 319968 - RNA, 24 nt, Human
aggcagaaguugcagugagccaag

SEQ ID NO: 319969 - RNA, 18 nt, Human
aggcaggagaaucacuug

SEQ ID NO: 319970 - RNA, 23 nt, Human
aggcaggagaaucacuugaaccc

SEQ ID NO: 319971 - RNA, 24 nt, Human
aggcaggagaaucacuugaaccca

SEQ ID NO: 319972 - RNA, 26 nt, Human
aggcagguggauuacuugaggucagg

SEQ ID NO: 319973 - RNA, 21 nt, Human
aggccgaggcagguggauuac

SEQ ID NO: 319974 - RNA, 24 nt, Human
aggcugaggcaggagaaucacuug

SEQ ID NO: 319975 - RNA, 22 nt, Human
aguuggguggguggcacaugcc

SEQ ID NO: 319976 - RNA, 24 nt, Human
augccuguaauccagcuacucagg

SEQ ID NO: 319977 - RNA, 24 nt, Human
auuacuugaggucaggaguuugag

SEQ ID NO: 319978 - RNA, 24 nt, Human
auugcacuccagccugggcaacag

SEQ ID NO: 319979 - RNA, 22 nt, Human
auuugcuccagaaacugguaaa

SEQ ID NO: 319980 - RNA, 23 nt, Human
caaaaugcacgcagauaaucacg

SEQ ID NO: 319981 - RNA, 21 nt, Human
caacauggugaaacccugucu

SEQ ID NO: 319982 - RNA, 24 nt, Human
cacuccagccugggcaacagagcg

SEQ ID NO: 319983 - RNA, 20 nt, Human
cacuuuuuuuuuuuuuuuaa

SEQ ID NO: 319984 - RNA, 23 nt, Human
cacuuuuuuuuuuuuuuuaauga

SEQ ID NO: 319985 - RNA, 24 nt, Human
cagcacuuugggaggccgaggcag

SEQ ID NO: 319986 - RNA, 24 nt, Human
cagcacuuugggaggccgaggcag

SEQ ID NO: 319987 - RNA, 24 nt, Human
cagcuacucaggaggcugaggcag

SEQ ID NO: 319988 - RNA, 24 nt, Human
caggaggcugaggcaggagaauca

SEQ ID NO: 319989 - RNA, 21 nt, Human
caggauacuuuuucagaaggg

SEQ ID NO: 319990 - RNA, 24 nt, Human
cagguggauuacuugaggucagga

SEQ ID NO: 319991 - RNA, 24 nt, Human
caucccuguaaucccagcacuuug

SEQ ID NO: 319992 - RNA, 18 nt, Human
cauugcacuccagccugg

SEQ ID NO: 319993 - RNA, 19 nt, Human
cauugcacuccagccuggg

SEQ ID NO: 319994 - RNA, 19 nt, Human
cauugcacuccagccuggg

SEQ ID NO: 319995 - RNA, 20 nt, Human
cauugcacuccagccugggc

SEQ ID NO: 319996 - RNA, 21 nt, Human
cauugcacuccagccugggca

SEQ ID NO: 319997 - RNA, 22 nt, Human
cauugcacuccagccugggcaa

SEQ ID NO: 319998 - RNA, 23 nt, Human
cauugcacuccagccugggcaac

SEQ ID NO: 319999 - RNA, 24 nt, Human
cauugcacuccagccugggcaaca

SEQ ID NO: 320000 - RNA, 22 nt, Human
ccuggccaacauggugaaaccc

SEQ ID NO: 320001 - RNA, 24 nt, Human
ccuggccaacauggugaaacccug

SEQ ID NO: 320002 - RNA, 22 nt, Human
ccugggcaacagagcgagacuc

SEQ ID NO: 320003 - RNA, 18 nt, Human
ccugguuggaagcuuugu

SEQ ID NO: 320004 - RNA, 22 nt, Human
ccuguaaucccagcacuuuggg

SEQ ID NO: 320005 - RNA, 24 nt, Human
cgaggcagguggauuacuugaggu

SEQ ID NO: 320006 - RNA, 26 nt, Human
cgaggcagguggauuacuugagguca

SEQ ID NO: 320007 - RNA, 24 nt, Human
cucaucccuguaaucccagcacuu

SEQ ID NO: 320008 - RNA, 24 nt, Human
cuggccaacauggugaaacccugu

SEQ ID NO: 320009 - RNA, 22 nt, Human
gaagcuuuguccaaaaugcacu

SEQ ID NO: 320010 - RNA, 19 nt, Human
gaaucacuugaacccaaga

SEQ ID NO: 320011 - RNA, 23 nt, Human
gagaccagccuggccaacauggu

SEQ ID NO: 320012 - RNA, 24 nt, Human
gaugaggcugggcgcgguggcuca

SEQ ID NO: 320013 - RNA, 19 nt, Human
gauggaagaacugcuaaag

SEQ ID NO: 320014 - RNA, 22 nt, Human
gauuacuugaggucaggaguuu

SEQ ID NO: 320015 - RNA, 24 nt, Human
gauuacuugaggucaggaguuuga

SEQ ID NO: 320016 - RNA, 23 nt, Human
gcaagucacaaaguaugagcaaa

SEQ ID NO: 320017 - RNA, 24 nt, Human
gcacuccagccugggcaacagagc

SEQ ID NO: 320018 - RNA, 22 nt, Human
gcaggagaaucacuugaaccca

SEQ ID NO: 320019 - RNA, 23 nt, Human
gccaacauggugaaacccugucu

SEQ ID NO: 320020 - RNA, 23 nt, Human
gccuguaauccagcuacucagga

SEQ ID NO: 320021 - RNA, 18 nt, Human
gcuugucgugccuguggu

SEQ ID NO: 320022 - RNA, 22 nt, Human
ggauuacuugaggucaggaguu

SEQ ID NO: 320023 - RNA, 23 nt, Human
ggcgcgguggcucaucccuguaa

SEQ ID NO: 320024 - RNA, 19 nt, Human
ggguggcacaugccuguaa

SEQ ID NO: 320025 - RNA, 19 nt, Human
ggucaggaguuugagacca

SEQ ID NO: 320026 - RNA, 23 nt, Human
gguggcacaugccuguaauccag

SEQ ID NO: 320027 - RNA, 23 nt, Human
gguggcucaucccuguaauccca

SEQ ID NO: 320028 - RNA, 24 nt, Human
gguggcucaucccuguaaucccag

SEQ ID NO: 320029 - RNA, 24 nt, Human
gucauugcacuccagccugggcaa

SEQ ID NO: 320030 - RNA, 23 nt, Human
guggagcugaaugccacugugac

SEQ ID NO: 320031 - RNA, 25 nt, Human
uaaaaaaaaaaaaaagaauaaagag

SEQ ID NO: 320032 - RNA, 19 nt, Human
uaaaagagaaaaaagaagg

SEQ ID NO: 320033 - RNA, 25 nt, Human
uagaacaaagagaugaggcugggcg

SEQ ID NO: 320034 - RNA, 21 nt, Human
uaguuggguggguggcacaug

SEQ ID NO: 320035 - RNA, 23 nt, Human
uauccugguuggaagcuuugucc

SEQ ID NO: 320036 - RNA, 21 nt, Human
ucacggaaguguggauguuga

SEQ ID NO: 320037 - RNA, 21 nt, Human
ucacuuuuuuuuuuuuuuuaa

SEQ ID NO: 320038 - RNA, 20 nt, Human
ucagauggaagaacugcuaa

SEQ ID NO: 320039 - RNA, 18 nt, Human
ucauugcacuccagccug

SEQ ID NO: 320040 - RNA, 20 nt, Human
ucauugcacuccagccuggg

SEQ ID NO: 320041 - RNA, 21 nt, Human
ucauugcacuccagccugggc

SEQ ID NO: 320042 - RNA, 24 nt, Human
ucauugcacuccagccugggcaac

SEQ ID NO: 320043 - RNA, 23 nt, Human
uccagccugggcaacagagcgag

SEQ ID NO: 320044 - RNA, 24 nt, Human
uccagccugggcaacagagcgaga

SEQ ID NO: 320045 - RNA, 22 nt, Human
ucccuguaaucccagcacuuug

SEQ ID NO: 320046 - RNA, 19 nt, Human
ucuauugauauucccuagc

SEQ ID NO: 320047 - RNA, 23 nt, Human
ucugucuuuaaaaaaaaaaaaaa

SEQ ID NO: 320048 - RNA, 24 nt, Human
ucugucuuuaaaaaaaaaaaaaag

SEQ ID NO: 320049 - RNA, 26 nt, Human
ucugucuuuaaaaaaaaaaaaaagaa

SEQ ID NO: 320050 - RNA, 22 nt, Human
ucuuuaaaaaaaaaaaaaagaa

SEQ ID NO: 320051 - RNA, 18 nt, Human
ugaagcaaaaagaagaaa

SEQ ID NO: 320052 - RNA, 19 nt, Human
ugaagcaaaaagaagaaaa

SEQ ID NO: 320053 - RNA, 21 nt, Human
ugaagcaaaaagaagaaaacc

SEQ ID NO: 320054 - RNA, 23 nt, Human
ugagaccagccuggccaacaugg

SEQ ID NO: 320055 - RNA, 20 nt, Human
ugaggcaggagaaucacuug

SEQ ID NO: 320056 - RNA, 24 nt, Human
ugaggcaggagaaucacuugaacc

SEQ ID NO: 320057 - RNA, 25 nt, Human
ugaggcaggagaaucacuugaaccc

SEQ ID NO: 320058 - RNA, 18 nt, Human
ugaggucaggaguuugag

SEQ ID NO: 320059 - RNA, 18 nt, Human
ugauugauucauuaauag

SEQ ID NO: 320060 - RNA, 22 nt, Human
ugcacuccagccugggcaacag

SEQ ID NO: 320061 - RNA, 22 nt, Human
ugcacuccagccugggcaacag

SEQ ID NO: 320062 - RNA, 23 nt, Human
ugccuguaauccagcuacucagg

SEQ ID NO: 320063 - RNA, 23 nt, Human
uggauuacuugaggucaggaguu

SEQ ID NO: 320064 - RNA, 24 nt, Human
uggauuacuugaggucaggaguuu

SEQ ID NO: 320065 - RNA, 20 nt, Human
uggcacaugccuguaaucca

SEQ ID NO: 320066 - RNA, 24 nt, Human
uggccaacauggugaaacccuguc

SEQ ID NO: 320067 - RNA, 18 nt, Human
uggcucaucccuguaauc

SEQ ID NO: 320068 - RNA, 21 nt, Human
uggcucaucccuguaauccca

SEQ ID NO: 320069 - RNA, 24 nt, Human
uggcucaucccuguaaucccagca

SEQ ID NO: 320070 - RNA, 22 nt, Human
ugggaggccgaggcagguggau

SEQ ID NO: 320071 - RNA, 24 nt, Human
ugucauugcacuccagccugggca

SEQ ID NO: 320072 - RNA, 25 nt, Human
ugugucauugcacuccagccugggc

SEQ ID NO: 320073 - RNA, 22 nt, Human
uuacaauuuacaaauccaggaa

SEQ ID NO: 320074 - RNA, 23 nt, Human
uuaguuggguggguggcacaugc

SEQ ID NO: 320075 - RNA, 22 nt, Human
uugcagugagccaagacugugu

SEQ ID NO: 320076 - RNA, 20 nt, Human
uugcuccagaaacugguaaa

SEQ ID NO: 320077 - RNA, 20 nt, Human
uuggccuaaaagcgguagaa

SEQ ID NO: 320078 - RNA, 23 nt, Human
uuggguggguggcacaugccugu

SEQ ID NO: 320079 - RNA, 19 nt, Human
acugauacaaaguugaagc

SEQ ID NO: 320080 - RNA, 24 nt, Human
agaaagacugucgcuagcauuuuu

SEQ ID NO: 320081 - RNA, 26 nt, Human
agccauuaaaaagagcuuaauaacaa

SEQ ID NO: 320082 - RNA, 24 nt, Human
caaaguaaauuagagauauguaaa

SEQ ID NO: 320083 - RNA, 24 nt, Human
caaauacacagcagaccaaucaug

SEQ ID NO: 320084 - RNA, 24 nt, Human
cagcagaccaaucauguucccuga

SEQ ID NO: 320085 - RNA, 19 nt, Human
ccccgggaggagcuccagc

SEQ ID NO: 320086 - RNA, 23 nt, Human
cccgggucgcugguccccgggag

SEQ ID NO: 320087 - RNA, 23 nt, Human
cccuuuauaaagcuuugugcaaa

SEQ ID NO: 320088 - RNA, 19 nt, Human
cucgcuccccgggucgcug

SEQ ID NO: 320089 - RNA, 20 nt, Human
gaaucccaucguaacaguuc

SEQ ID NO: 320090 - RNA, 19 nt, Human
gagaagggacggcucagcg

SEQ ID NO: 320091 - RNA, 19 nt, Human
ggcgagaagggacggcuca

SEQ ID NO: 320092 - RNA, 22 nt, Human
gugguacaaaguuuauaaauac

SEQ ID NO: 320093 - RNA, 20 nt, Human
uaaaaagagcuuaauaacaa

SEQ ID NO: 320094 - RNA, 18 nt, Human
uaaaaugagcagaauccc

SEQ ID NO: 320095 - RNA, 19 nt, Human
uaaaaugagcagaauccca

SEQ ID NO: 320096 - RNA, 24 nt, Human
uaacaagaacaggaugacagucaa

SEQ ID NO: 320097 - RNA, 21 nt, Human
uaagaaagacugucgcuagca

SEQ ID NO: 320098 - RNA, 22 nt, Human
uacaugaauucaaauacacagc

SEQ ID NO: 320099 - RNA, 18 nt, Human
uagaaacaagacauaaac

SEQ ID NO: 320100 - RNA, 25 nt, Human
uauguaaauaacagaauuaucaaca

SEQ ID NO: 320101 - RNA, 21 nt, Human
ucacaauggcuaacaagaaca

SEQ ID NO: 320102 - RNA, 19 nt, Human
ucagcggcuggaggaagag

SEQ ID NO: 320103 - RNA, 21 nt, Human
ucaguagcuuuuuaauaaaau

SEQ ID NO: 320104 - RNA, 23 nt, Human
ucccaucguaacaguucuuuguu

SEQ ID NO: 320105 - RNA, 21 nt, Human
uccccgggucgcugguccccg

SEQ ID NO: 320106 - RNA, 20 nt, Human
ucgcugguccccgggaggag

SEQ ID NO: 320107 - RNA, 25 nt, Human
uguaaaaugggugcuacacucucuc

SEQ ID NO: 320108 - RNA, 19 nt, Human
uuagugcugucccucaaga

SEQ ID NO: 320109 - RNA, 24 nt, Human
uuagugcugucccucaagacucua

SEQ ID NO: 320110 - RNA, 23 nt, Human
uuuuuaugugcuacugaaagauu

SEQ ID NO: 320111 - RNA, 19 nt, Human
aaaaaaaaaaaaaaaggcg

SEQ ID NO: 320112 - RNA, 19 nt, Human
aaaccuaagacaaacaugu

SEQ ID NO: 320113 - RNA, 23 nt, Human
aaaccucccuuuuuaucaccauc

SEQ ID NO: 320114 - RNA, 23 nt, Human
aaauaccacacuggaacaaaaaa

SEQ ID NO: 320115 - RNA, 18 nt, Human
aacauagugaaaccccau

SEQ ID NO: 320116 - RNA, 19 nt, Human
aacauagugaaaccccauc

SEQ ID NO: 320117 - RNA, 22 nt, Human
aacauagugaaaccccauccuc

SEQ ID NO: 320118 - RNA, 24 nt, Human
aaccugggugacagagagagacuc

SEQ ID NO: 320119 - RNA, 19 nt, Human
aagaauucuauuuagguuu

SEQ ID NO: 320120 - RNA, 18 nt, Human
aagaggaagaaacuuuaa

SEQ ID NO: 320121 - RNA, 22 nt, Human
aagugaagaucccauaagacuc

SEQ ID NO: 320122 - RNA, 24 nt, Human
aaucgcuugaacccaggaggggga

SEQ ID NO: 320123 - RNA, 18 nt, Human
aauuagccaggcauggug

SEQ ID NO: 320124 - RNA, 21 nt, Human
acaacuuaaauaguauccuuc

SEQ ID NO: 320125 - RNA, 24 nt, Human
acagagagagacuccaucucaaaa

SEQ ID NO: 320126 - RNA, 22 nt, Human
acagugaucucucucagauucu

SEQ ID NO: 320127 - RNA, 19 nt, Human
acccaguaaagugcaacuu

SEQ ID NO: 320128 - RNA, 21 nt, Human
acccauuaaguuuucgucauu

SEQ ID NO: 320129 - RNA, 23 nt, Human
accccacaucucugagaacccug

SEQ ID NO: 320130 - RNA, 23 nt, Human
accugggugacagagagagacuc

SEQ ID NO: 320131 - RNA, 25 nt, Human
acuaaaaagaaauucuaacaacuaa

SEQ ID NO: 320132 - RNA, 18 nt, Human
acugcacuccaaccuggg

SEQ ID NO: 320133 - RNA, 24 nt, Human
acugcacuccaaccugggugacag

SEQ ID NO: 320134 - RNA, 21 nt, Human
agaacccaagaggaagaaacu

SEQ ID NO: 320135 - RNA, 22 nt, Human
agacaaaccaaugccucucaga

SEQ ID NO: 320136 - RNA, 21 nt, Human
agacagaacuccuaauuaggu

SEQ ID NO: 320137 - RNA, 18 nt, Human
agccaguguuucauaugu

SEQ ID NO: 320138 - RNA, 24 nt, Human
agcuuauuaaagcauucugaacag

SEQ ID NO: 320139 - RNA, 24 nt, Human
aggagggcggaucacaagguuagg

SEQ ID NO: 320140 - RNA, 20 nt, Human
aggaguuugagaccagucug

SEQ ID NO: 320141 - RNA, 23 nt, Human
aggcaggagaaucgcuugaaccc

SEQ ID NO: 320142 - RNA, 24 nt, Human
aggcaggagaaucgcuugaaccca

SEQ ID NO: 320143 - RNA, 24 nt, Human
aggcaugguggcuggcgccuguag

SEQ ID NO: 320144 - RNA, 20 nt, Human
aggcugaggcaggagaaucg

SEQ ID NO: 320145 - RNA, 24 nt, Human
aggcugaggcaggagaaucgcuug

SEQ ID NO: 320146 - RNA, 22 nt, Human
agggggagguugcagcagugag

SEQ ID NO: 320147 - RNA, 27 nt, Human
agggggagguugcagcagugagccaag

SEQ ID NO: 320148 - RNA, 19 nt, Human
aguauccagcugcagauag

SEQ ID NO: 320149 - RNA, 19 nt, Human
agucuaaaguaaacucaaa

SEQ ID NO: 320150 - RNA, 22 nt, Human
agucuggccaacauagugaaac

SEQ ID NO: 320151 - RNA, 24 nt, Human
agucuggccaacauagugaaaccc

SEQ ID NO: 320152 - RNA, 20 nt, Human
auaaaacccaguaaagugca

SEQ ID NO: 320153 - RNA, 31 nt, Human
auagcagcaguuaaaaaaaaaaaaaaaaaaa

SEQ ID NO: 320154 - RNA, 22 nt, Human
auaugacagaacccaagaggaa

SEQ ID NO: 320155 - RNA, 20 nt, Human
auauguaagucucgaaaccu

SEQ ID NO: 320156 - RNA, 24 nt, Human
aucacaccacugcacuccaaccug

SEQ ID NO: 320157 - RNA, 24 nt, Human
auggagggucucaguucauccaca

SEQ ID NO: 320158 - RNA, 22 nt, Human
caaccugggugacagagagaga

SEQ ID NO: 320159 - RNA, 24 nt, Human
caacuugacagugaucucucucag

SEQ ID NO: 320160 - RNA, 24 nt, Human
cacaagguuaggaguuugagacca

SEQ ID NO: 320161 - RNA, 23 nt, Human
caccaaaacguuuccugcagcaa

SEQ ID NO: 320162 - RNA, 26 nt, Human
caccacugcacuccaaccugggugac

SEQ ID NO: 320163 - RNA, 23 nt, Human
cacugcacuccaaccugggugac

SEQ ID NO: 320164 - RNA, 24 nt, Human
cacugcacuccaaccugggugaca

SEQ ID NO: 320165 - RNA, 20 nt, Human
cagaagaauggauugaggug

SEQ ID NO: 320166 - RNA, 24 nt, Human
cagcuacucaggaggcugaggcag

SEQ ID NO: 320167 - RNA, 19 nt, Human
cagcugcagauagcagcag

SEQ ID NO: 320168 - RNA, 23 nt, Human
cagcugcuuugaauuauuacuga

SEQ ID NO: 320169 - RNA, 24 nt, Human
caugugagaaacaaggagacagcu

SEQ ID NO: 320170 - RNA, 22 nt, Human
cauuuaagaucuaaaaucaucu

SEQ ID NO: 320171 - RNA, 20 nt, Human
ccacacuggaacaaaaaaua

SEQ ID NO: 320172 - RNA, 20 nt, Human
ccacugcacuccaaccuggg

SEQ ID NO: 320173 - RNA, 24 nt, Human
ccacugcacuccaaccugggugac

SEQ ID NO: 320174 - RNA, 25 nt, Human
ccacugcacuccaaccugggugaca

SEQ ID NO: 320175 - RNA, 23 nt, Human
ccaucucaaaaaaaaaaaaaaaa

SEQ ID NO: 320176 - RNA, 21 nt, Human
cccaggagggggagguugcag

SEQ ID NO: 320177 - RNA, 20 nt, Human
ccccacaucucugagaaccc

SEQ ID NO: 320178 - RNA, 19 nt, Human
ccuaagacaaacaugugaa

SEQ ID NO: 320179 - RNA, 22 nt, Human
ccugccuucugugaaagguaaa

SEQ ID NO: 320180 - RNA, 19 nt, Human
ccuguagucccagcuacuc

SEQ ID NO: 320181 - RNA, 21 nt, Human
ccuguagucccagcuacucag

SEQ ID NO: 320182 - RNA, 24 nt, Human
cgccuguagucccagcuacucagg

SEQ ID NO: 320183 - RNA, 21 nt, Human
cggaucacaagguuaggaguu

SEQ ID NO: 320184 - RNA, 23 nt, Human
cuaagacaaacaugugaagugaa

SEQ ID NO: 320185 - RNA, 18 nt, Human
cucaaaaaaaaaaaaaaa

SEQ ID NO: 320186 - RNA, 19 nt, Human
cuccaucucaaaaaaaaaa

SEQ ID NO: 320187 - RNA, 19 nt, Human
cuccuaaaacuggauaaaa

SEQ ID NO: 320188 - RNA, 24 nt, Human
cuccuaaaacuggauaaaacccag

SEQ ID NO: 320189 - RNA, 20 nt, Human
cucuacuaaaaauacaaaaa

SEQ ID NO: 320190 - RNA, 23 nt, Human
cuggccaacauagugaaacccca

SEQ ID NO: 320191 - RNA, 19 nt, Human
cugucucacccaaaacaag

SEQ ID NO: 320192 - RNA, 20 nt, Human
cugugcaaaaaaaaaaaaaa

SEQ ID NO: 320193 - RNA, 25 nt, Human
cugugcaaaaaaaaaaaaaaguaca

SEQ ID NO: 320194 - RNA, 23 nt, Human
cuugaacccaggagggggagguu

SEQ ID NO: 320195 - RNA, 20 nt, Human
gaaaccccauccucuacuaa

SEQ ID NO: 320196 - RNA, 23 nt, Human
gagaaucgcuugaacccaggagg

SEQ ID NO: 320197 - RNA, 23 nt, Human
gauagcagcaguuaaaaaaaaaa

SEQ ID NO: 320198 - RNA, 22 nt, Human
gaucacaagguuaggaguuuga

SEQ ID NO: 320199 - RNA, 18 nt, Human
gcagcaaguuacccugcc

SEQ ID NO: 320200 - RNA, 22 nt, Human
gcaggagaaucgcuugaaccca

SEQ ID NO: 320201 - RNA, 22 nt, Human
gccaacauagugaaaccccauc

SEQ ID NO: 320202 - RNA, 20 nt, Human
gccaagaucacaccacugca

SEQ ID NO: 320203 - RNA, 18 nt, Human
gcucauguucuguauugg

SEQ ID NO: 320204 - RNA, 23 nt, Human
ggagguugcagcagugagccaag

SEQ ID NO: 320205 - RNA, 20 nt, Human
ggaucacaagguuaggaguu

SEQ ID NO: 320206 - RNA, 26 nt, Human
ggauuccccccaaacgagauucauau

SEQ ID NO: 320207 - RNA, 23 nt, Human
ggcggaucacaagguuaggaguu

SEQ ID NO: 320208 - RNA, 24 nt, Human
gguggcuggcgccuguagucccag

SEQ ID NO: 320209 - RNA, 26 nt, Human
guaaaacagcagcaguaucugcagaa

SEQ ID NO: 320210 - RNA, 21 nt, Human
uaaaaagagcuaaggacaacu

SEQ ID NO: 320211 - RNA, 21 nt, Human
uaaaaauacaaaaauuagcca

SEQ ID NO: 320212 - RNA, 21 nt, Human
uaaaaucaucuaagauacuau

SEQ ID NO: 320213 - RNA, 22 nt, Human
uaaaccuaagacaaacauguga

SEQ ID NO: 320214 - RNA, 27 nt, Human
uaagacaaacaugugaagugaagaucc

SEQ ID NO: 320215 - RNA, 26 nt, Human
uaaggagggcggaucacaagguuagg

SEQ ID NO: 320216 - RNA, 20 nt, Human
uacaaggauuccccccaaac

SEQ ID NO: 320217 - RNA, 21 nt, Human
uaccuggcaagcccauggggu

SEQ ID NO: 320218 - RNA, 20 nt, Human
uagaagaauacggaggaaaa

SEQ ID NO: 320219 - RNA, 23 nt, Human
uagcagcaguuaaaaaaaaaaaa

SEQ ID NO: 320220 - RNA, 19 nt, Human
uaguagacagaacuccuaa

SEQ ID NO: 320221 - RNA, 24 nt, Human
uauacaccaaaacguuuccugcag

SEQ ID NO: 320222 - RNA, 19 nt, Human
uauaugccuugcaaaagaa

SEQ ID NO: 320223 - RNA, 24 nt, Human
uaucaaauaccacacuggaacaaa

SEQ ID NO: 320224 - RNA, 25 nt, Human
uaugacagaacccaagaggaagaaa

SEQ ID NO: 320225 - RNA, 24 nt, Human
ucacaagguuaggaguuugagacc

SEQ ID NO: 320226 - RNA, 23 nt, Human
ucacaccacugcacuccaaccug

SEQ ID NO: 320227 - RNA, 19 nt, Human
uccagcugcagauagcagc

SEQ ID NO: 320228 - RNA, 23 nt, Human
uccaucucaaaaaaaaaaaaaaa

SEQ ID NO: 320229 - RNA, 20 nt, Human
uccuaaaacuggauaaaacc

SEQ ID NO: 320230 - RNA, 23 nt, Human
ucgucauuaccuggcaagcccau

SEQ ID NO: 320231 - RNA, 18 nt, Human
ucucaaaaaaaaaaaaaa

SEQ ID NO: 320232 - RNA, 22 nt, Human
ucucacccaaaacaaggcuuca

SEQ ID NO: 320233 - RNA, 18 nt, Human
ucucaguucauccacauu

SEQ ID NO: 320234 - RNA, 23 nt, Human
ucuggccaacauagugaaacccc

SEQ ID NO: 320235 - RNA, 23 nt, Human
ugaaaaaaccucccuuuuuauca

SEQ ID NO: 320236 - RNA, 21 nt, Human
ugaaaccccauccucuacuaa

SEQ ID NO: 320237 - RNA, 23 nt, Human
ugaaagguaaaccuaagacaaac

SEQ ID NO: 320238 - RNA, 21 nt, Human
ugacauugccuccccuccucc

SEQ ID NO: 320239 - RNA, 19 nt, Human
ugagaacccuguaaagcca

SEQ ID NO: 320240 - RNA, 18 nt, Human
ugagaccagucuggccaa

SEQ ID NO: 320241 - RNA, 24 nt, Human
ugagaccagucuggccaacauagu

SEQ ID NO: 320242 - RNA, 20 nt, Human
ugaggcaggagaaucgcuug

SEQ ID NO: 320243 - RNA, 24 nt, Human
ugaggcaggagaaucgcuugaacc

SEQ ID NO: 320244 - RNA, 25 nt, Human
ugaggcaggagaaucgcuugaaccc

SEQ ID NO: 320245 - RNA, 22 nt, Human
ugcaaaaaaaaaaaaaaguaca

SEQ ID NO: 320246 - RNA, 19 nt, Human
ugcaaaagaaugcaagaca

SEQ ID NO: 320247 - RNA, 25 nt, Human
ugccaaacucauuuaagaucuaaaa

SEQ ID NO: 320248 - RNA, 21 nt, Human
uggcuggcgccuguaguccca

SEQ ID NO: 320249 - RNA, 22 nt, Human
uggcuggcgccuguagucccag

SEQ ID NO: 320250 - RNA, 20 nt, Human
ugggggggcuaaggagggcg

SEQ ID NO: 320251 - RNA, 19 nt, Human
ugguggcuggcgccuguag

SEQ ID NO: 320252 - RNA, 24 nt, Human
ugguggcuggcgccuguaguccca

SEQ ID NO: 320253 - RNA, 23 nt, Human
ugugagaaacaaggagacagcug

SEQ ID NO: 320254 - RNA, 19 nt, Human
ugugcaaaaaaaaaaaaaa

SEQ ID NO: 320255 - RNA, 25 nt, Human
ugugcaaaaaaaaaaaaaaguacac

SEQ ID NO: 320256 - RNA, 20 nt, Human
ugugucaaguaaauuucacu

SEQ ID NO: 320257 - RNA, 23 nt, Human
ugugugcaguguucuaucugcaa

SEQ ID NO: 320258 - RNA, 18 nt, Human
uuagccaggcaugguggc

SEQ ID NO: 320259 - RNA, 25 nt, Human
uuagccaggcaugguggcuggcgcc

SEQ ID NO: 320260 - RNA, 20 nt, Human
uugggggggcuaaggagggc

SEQ ID NO: 320261 - RNA, 29 nt, Human
uuucuacagaaugaugagcugaccuuggu

SEQ ID NO: 320262 - RNA, 18 nt, Human
uuugggggggcuaaggag

SEQ ID NO: 320263 - RNA, 19 nt, Human
uuugggggggcuaaggagg

SEQ ID NO: 320264 - RNA, 20 nt, Human
aaaaaagaauucagcuguga

SEQ ID NO: 320265 - RNA, 30 nt, Human
aaaaauaggcacuccccucccugacccccc

SEQ ID NO: 320266 - RNA, 18 nt, Human
aaaacccaagccagugcu

SEQ ID NO: 320267 - RNA, 21 nt, Human
aaaacgagaggaacccgggca

SEQ ID NO: 320268 - RNA, 23 nt, Human
aaaaugaguuauguacaaagcca

SEQ ID NO: 320269 - RNA, 21 nt, Human
aaacagcuccaauagcaagga

SEQ ID NO: 320270 - RNA, 27 nt, Human
aaacuaaaggugaaauaaaagggaccc

SEQ ID NO: 320271 - RNA, 25 nt, Human
aaagaaacaaaacgcugaaugagaa

SEQ ID NO: 320272 - RNA, 26 nt, Human
aaagaagagguggagaagagggaccc

SEQ ID NO: 320273 - RNA, 25 nt, Human
aaagagaaaaggugcacccucuuca

SEQ ID NO: 320274 - RNA, 22 nt, Human
aaagccagaccccacacccuca

SEQ ID NO: 320275 - RNA, 24 nt, Human
aaagugcugggauugcaggcauga

SEQ ID NO: 320276 - RNA, 19 nt, Human
aacaguguuaagccauagu

SEQ ID NO: 320277 - RNA, 23 nt, Human
aaccuacuaauuauucucaccua

SEQ ID NO: 320278 - RNA, 29 nt, Human
aaccuacuucuucaaugcacucaccccug

SEQ ID NO: 320279 - RNA, 20 nt, Human
aaccugagcuacugaguuuu

SEQ ID NO: 320280 - RNA, 20 nt, Human
aagaagagguggagaagaaa

SEQ ID NO: 320281 - RNA, 25 nt, Human
aagcaauccucucgccccagccucc

SEQ ID NO: 320282 - RNA, 25 nt, Human
aagcaauccucucgccccagccucc

SEQ ID NO: 320283 - RNA, 25 nt, Human
aagcaaucuuucugcuucagcuucc

SEQ ID NO: 320284 - RNA, 22 nt, Human
aaggguuucaucauguuggcca

SEQ ID NO: 320285 - RNA, 24 nt, Human
aaggguuucaucauguuggccagg

SEQ ID NO: 320286 - RNA, 18 nt, Human
aagugagcccuacaacca

SEQ ID NO: 320287 - RNA, 19 nt, Human
aagugcugggauugcaggc

SEQ ID NO: 320288 - RNA, 21 nt, Human
aagugcugggauugcaggcau

SEQ ID NO: 320289 - RNA, 20 nt, Human
aaucugauuacauuucccuu

SEQ ID NO: 320290 - RNA, 23 nt, Human
aauggugugaucucagaucacug

SEQ ID NO: 320291 - RNA, 24 nt, Human
aauuucaacugugcucugaucuau

SEQ ID NO: 320292 - RNA, 21 nt, Human
acacacacacacacacacaca

SEQ ID NO: 320293 - RNA, 18 nt, Human
acacaccccaaaguaucc

SEQ ID NO: 320294 - RNA, 19 nt, Human
acaccccaaaguauccaaa

SEQ ID NO: 320295 - RNA, 21 nt, Human
acagaaauggcgaacaacaca

SEQ ID NO: 320296 - RNA, 19 nt, Human
acagacaggguucacuaug

SEQ ID NO: 320297 - RNA, 24 nt, Human
acccaggcuggagggcaauggugu

SEQ ID NO: 320298 - RNA, 21 nt, Human
accccauuucaaaucuguaca

SEQ ID NO: 320299 - RNA, 20 nt, Human
acuaacugggauuacaggca

SEQ ID NO: 320300 - RNA, 25 nt, Human
acuauguugcccaagcuggucucaa

SEQ ID NO: 320301 - RNA, 22 nt, Human
acuccccucccugaccccccau

SEQ ID NO: 320302 - RNA, 30 nt, Human
acucugucacccaggcuggagggcaauggg

SEQ ID NO: 320303 - RNA, 20 nt, Human
acugaugugugauaugugug

SEQ ID NO: 320304 - RNA, 19 nt, Human
acugcagccucaaccucuu

SEQ ID NO: 320305 - RNA, 19 nt, Human
acugcagccuccgccuccu

SEQ ID NO: 320306 - RNA, 19 nt, Human
agaaaaagaagagguggag

SEQ ID NO: 320307 - RNA, 23 nt, Human
agaaaaagaagagguggagaaga

SEQ ID NO: 320308 - RNA, 28 nt, Human
agaaaagaaacaaaacgcugaaugagaa

SEQ ID NO: 320309 - RNA, 22 nt, Human
agaacacucucacgccuggauu

SEQ ID NO: 320310 - RNA, 21 nt, Human
agaagacauuuugcuucuggg

SEQ ID NO: 320311 - RNA, 24 nt, Human
agaaggagacagaugaaggcaggg

SEQ ID NO: 320312 - RNA, 20 nt, Human
agacacacacacagacaggc

SEQ ID NO: 320313 - RNA, 21 nt, Human
agacaggcacacaccccaaag

SEQ ID NO: 320314 - RNA, 19 nt, Human
agagugcugggacuacagg

SEQ ID NO: 320315 - RNA, 20 nt, Human
agagugcugggacuacagga

SEQ ID NO: 320316 - RNA, 20 nt, Human
agcaauagccccgggaggga

SEQ ID NO: 320317 - RNA, 23 nt, Human
agcaauccucucgccccagccuc

SEQ ID NO: 320318 - RNA, 25 nt, Human
agcaauccucucgccccagccuccc

SEQ ID NO: 320319 - RNA, 23 nt, Human
agcuggucucaaacuccuggccu

SEQ ID NO: 320320 - RNA, 18 nt, Human
aggaaaaacgagaggaac

SEQ ID NO: 320321 - RNA, 23 nt, Human
aggaaaaacgagaggaacccggg

SEQ ID NO: 320322 - RNA, 21 nt, Human
aggagacagaugaaggcaggg

SEQ ID NO: 320323 - RNA, 22 nt, Human
aggcacacaccccaaaguaucc

SEQ ID NO: 320324 - RNA, 25 nt, Human
aggcacacaccccaaaguauccaaa

SEQ ID NO: 320325 - RNA, 19 nt, Human
aggcaugacacacucugcc

SEQ ID NO: 320326 - RNA, 22 nt, Human
agggagaaaucucuucccagga

SEQ ID NO: 320327 - RNA, 24 nt, Human
aggugaucugccugccuuggccuc

SEQ ID NO: 320328 - RNA, 24 nt, Human
agugcaguggcgcaaucuugguug

SEQ ID NO: 320329 - RNA, 19 nt, Human
agugcugucuugcacucug

SEQ ID NO: 320330 - RNA, 23 nt, Human
aguucuuuguuccaggcagauuc

SEQ ID NO: 320331 - RNA, 21 nt, Human
auaaaacccaagccagugcug

SEQ ID NO: 320332 - RNA, 20 nt, Human
auaaagucuaugagaaaaac

SEQ ID NO: 320333 - RNA, 25 nt, Human
aucauguuggccaggcuggucucaa

SEQ ID NO: 320334 - RNA, 19 nt, Human
aucccaaaccacucaacug

SEQ ID NO: 320335 - RNA, 21 nt, Human
aucuuauucccccaaacuaua

SEQ ID NO: 320336 - RNA, 21 nt, Human
augaagcgugcaaucuuaccc

SEQ ID NO: 320337 - RNA, 24 nt, Human
auggggucucgcuaugcugcccag

SEQ ID NO: 320338 - RNA, 22 nt, Human
auguugcccaagcuggucucaa

SEQ ID NO: 320339 - RNA, 23 nt, Human
auuaaaaauaggcacuccccucc

SEQ ID NO: 320340 - RNA, 21 nt, Human
auucuccugccucagccuccc

SEQ ID NO: 320341 - RNA, 21 nt, Human
auuuuuuuuuaaaauuggggg

SEQ ID NO: 320342 - RNA, 28 nt, Human
caaaaauaaaacccaagccagugcuguc

SEQ ID NO: 320343 - RNA, 18 nt, Human
caaaagcaaaaagccauu

SEQ ID NO: 320344 - RNA, 23 nt, Human
caaaccuagaaucaucaguauua

SEQ ID NO: 320345 - RNA, 27 nt, Human
caaagugcugggauugcaggcaugaca

SEQ ID NO: 320346 - RNA, 19 nt, Human
caaaucccaccugcuaaaa

SEQ ID NO: 320347 - RNA, 20 nt, Human
caacacacaacaauuuacag

SEQ ID NO: 320348 - RNA, 22 nt, Human
caacacacaacaauuuacagag

SEQ ID NO: 320349 - RNA, 24 nt, Human
caacacacaacaauuuacagagaa

SEQ ID NO: 320350 - RNA, 20 nt, Human
caagagaacacucucacgcc

SEQ ID NO: 320351 - RNA, 18 nt, Human
caagauuaaaaauaggca

SEQ ID NO: 320352 - RNA, 22 nt, Human
caagcaaucuuucugcuucagc

SEQ ID NO: 320353 - RNA, 27 nt, Human
caagcaaucuuucugcuucagcuuccc

SEQ ID NO: 320354 - RNA, 24 nt, Human
caaggguuucaucauguuggccag

SEQ ID NO: 320355 - RNA, 27 nt, Human
caagugauccucucaucucagccuccu

SEQ ID NO: 320356 - RNA, 18 nt, Human
caaugcacucaccccugc

SEQ ID NO: 320357 - RNA, 23 nt, Human
cacaaucagggcucacugcagcc

SEQ ID NO: 320358 - RNA, 22 nt, Human
cacacaacaauuuacagagaaa

SEQ ID NO: 320359 - RNA, 21 nt, Human
cacacacacacacaauuugug

SEQ ID NO: 320360 - RNA, 20 nt, Human
cacacacacacacacacaca

SEQ ID NO: 320361 - RNA, 21 nt, Human
cacacagacaggcacacaccc

SEQ ID NO: 320362 - RNA, 20 nt, Human
cacacagguacagagaaaac

SEQ ID NO: 320363 - RNA, 25 nt, Human
cacagcauccggcagcagucacagg

SEQ ID NO: 320364 - RNA, 19 nt, Human
cacaggcugaaaauagagu

SEQ ID NO: 320365 - RNA, 26 nt, Human
cacauggcaaggguauacuccacccu

SEQ ID NO: 320366 - RNA, 23 nt, Human
caccacaucuggcuaauuuuugu

SEQ ID NO: 320367 - RNA, 22 nt, Human
caccuggcuacagaguggagcc

SEQ ID NO: 320368 - RNA, 26 nt, Human
caccuucaccaagacacacacacaga

SEQ ID NO: 320369 - RNA, 23 nt, Human
cacggcugacggagacacagaga

SEQ ID NO: 320370 - RNA, 24 nt, Human
cacuauguugcccaagcuggucuc

SEQ ID NO: 320371 - RNA, 21 nt, Human
cacuccccucccugacccccc

SEQ ID NO: 320372 - RNA, 21 nt, Human
cacucugccagguaaacucuu

SEQ ID NO: 320373 - RNA, 22 nt, Human
cacucugucacccaggcuggag

SEQ ID NO: 320374 - RNA, 25 nt, Human
cacucugucacccaggcuggagggc

SEQ ID NO: 320375 - RNA, 24 nt, Human
cacuguggccuggaccuccucagg

SEQ ID NO: 320376 - RNA, 18 nt, Human
cagaaaagaaacaaaacg

SEQ ID NO: 320377 - RNA, 22 nt, Human
cagaaaagaaacaaaacgcuga

SEQ ID NO: 320378 - RNA, 19 nt, Human
cagacaggcacacacccca

SEQ ID NO: 320379 - RNA, 24 nt, Human
cagagugcugggacuacaggaaca

SEQ ID NO: 320380 - RNA, 21 nt, Human
cagcaaacaugagacuucaug

SEQ ID NO: 320381 - RNA, 23 nt, Human
cagccucaaccucuugagcucag

SEQ ID NO: 320382 - RNA, 20 nt, Human
cagccuccgccuccugaguu

SEQ ID NO: 320383 - RNA, 20 nt, Human
cagccuccugaguagcugag

SEQ ID NO: 320384 - RNA, 24 nt, Human
cagccucggagggcggcgcggcag

SEQ ID NO: 320385 - RNA, 19 nt, Human
cagcugugacagcugagca

SEQ ID NO: 320386 - RNA, 19 nt, Human
caggaacaagccacugcac

SEQ ID NO: 320387 - RNA, 20 nt, Human
cagggcaugagaaaaagaag

SEQ ID NO: 320388 - RNA, 22 nt, Human
cagggcaugagaaaaagaagag

SEQ ID NO: 320389 - RNA, 21 nt, Human
caggguucacuauguugccca

SEQ ID NO: 320390 - RNA, 22 nt, Human
cagguuuucugaauacaaugca

SEQ ID NO: 320391 - RNA, 20 nt, Human
caucaguauuauuacauaaa

SEQ ID NO: 320392 - RNA, 24 nt, Human
caucauguuggccaggcuggucuc

SEQ ID NO: 320393 - RNA, 21 nt, Human
caucucagagcacaaggacug

SEQ ID NO: 320394 - RNA, 21 nt, Human
caucucagagcacaaggacug

SEQ ID NO: 320395 - RNA, 24 nt, Human
caucucagccuccugaguagcuga

SEQ ID NO: 320396 - RNA, 21 nt, Human
caugaaucugcggaucuuccu

SEQ ID NO: 320397 - RNA, 23 nt, Human
caugacccacauuuagcaagaga

SEQ ID NO: 320398 - RNA, 18 nt, Human
cauguuggccaggcuggu

SEQ ID NO: 320399 - RNA, 21 nt, Human
cauguuggccaggcuggucuc

SEQ ID NO: 320400 - RNA, 24 nt, Human
cauguuggccaggcuggucucaaa

SEQ ID NO: 320401 - RNA, 24 nt, Human
ccaaagugcugggauugcaggcau

SEQ ID NO: 320402 - RNA, 25 nt, Human
ccaaaguguuacuuaggauuacagg

SEQ ID NO: 320403 - RNA, 28 nt, Human
ccaaaguguuacuuaggauuacaggugu

SEQ ID NO: 320404 - RNA, 20 nt, Human
ccaccacaucuggcuaauuu

SEQ ID NO: 320405 - RNA, 18 nt, Human
ccacugcaccuagccuag

SEQ ID NO: 320406 - RNA, 20 nt, Human
ccacugcaccuagccuagau

SEQ ID NO: 320407 - RNA, 26 nt, Human
ccagaccccacacccucaguuuaugc

SEQ ID NO: 320408 - RNA, 19 nt, Human
ccagagugcugggacuaca

SEQ ID NO: 320409 - RNA, 23 nt, Human
ccaguccacggagcggaaccacc

SEQ ID NO: 320410 - RNA, 18 nt, Human
ccagucucaaacucccag

SEQ ID NO: 320411 - RNA, 19 nt, Human
cccaagagaacacucucac

SEQ ID NO: 320412 - RNA, 18 nt, Human
cccaccuucaccaagaca

SEQ ID NO: 320413 - RNA, 20 nt, Human
cccaggcucaagcaaucuuu

SEQ ID NO: 320414 - RNA, 23 nt, Human
cccagggaagaacaucugggggu

SEQ ID NO: 320415 - RNA, 24 nt, Human
ccccucccugaccccccaugagaa

SEQ ID NO: 320416 - RNA, 22 nt, Human
ccccugccacagcugggcccug

SEQ ID NO: 320417 - RNA, 24 nt, Human
cccgacuaacugggauuacaggca

SEQ ID NO: 320418 - RNA, 18 nt, Human
cccucaguuuaugcugug

SEQ ID NO: 320419 - RNA, 22 nt, Human
cccuggcuggagugcaguggcg

SEQ ID NO: 320420 - RNA, 19 nt, Human
cccuucagaaaaacaaccu

SEQ ID NO: 320421 - RNA, 24 nt, Human
ccgacuaacugggauuacaggcau

SEQ ID NO: 320422 - RNA, 22 nt, Human
ccgcggcagcaucaacggaggc

SEQ ID NO: 320423 - RNA, 24 nt, Human
ccgggccaggccggagcgcucggg

SEQ ID NO: 320424 - RNA, 21 nt, Human
ccuccagcucgguggccgcgu

SEQ ID NO: 320425 - RNA, 19 nt, Human
ccucccaacccagguuccc

SEQ ID NO: 320426 - RNA, 24 nt, Human
ccucucaucucagccuccugagua

SEQ ID NO: 320427 - RNA, 19 nt, Human
ccucucgccccagccuccc

SEQ ID NO: 320428 - RNA, 18 nt, Human
ccucugggugcgcggcuc

SEQ ID NO: 320429 - RNA, 24 nt, Human
ccugaauagcugggacuacaggua

SEQ ID NO: 320430 - RNA, 21 nt, Human
ccugaccucaggugaucugcc

SEQ ID NO: 320431 - RNA, 23 nt, Human
ccugaccucaggugaucugccug

SEQ ID NO: 320432 - RNA, 24 nt, Human
ccugaguagcugagacuacaggca

SEQ ID NO: 320433 - RNA, 21 nt, Human
ccugcaauaaauucgcuccca

SEQ ID NO: 320434 - RNA, 22 nt, Human
ccugccuuggccucccaaagug

SEQ ID NO: 320435 - RNA, 24 nt, Human
ccugccuuggccucccaaagugcu

SEQ ID NO: 320436 - RNA, 18 nt, Human
ccuggccccagugccuuc

SEQ ID NO: 320437 - RNA, 23 nt, Human
ccuggccuuaagcaauccuccca

SEQ ID NO: 320438 - RNA, 20 nt, Human
ccugggcucaagcaauccuc

SEQ ID NO: 320439 - RNA, 24 nt, Human
ccuucaccaagacacacacacaga

SEQ ID NO: 320440 - RNA, 18 nt, Human
ccuucagaaaaacaaccu

SEQ ID NO: 320441 - RNA, 21 nt, Human
cgaacaacacaucccaaacca

SEQ ID NO: 320442 - RNA, 26 nt, Human
cgcccucgccucugggugcgcggcuc

SEQ ID NO: 320443 - RNA, 25 nt, Human
cgccuccugaguuccauauucuccu

SEQ ID NO: 320444 - RNA, 27 nt, Human
cgcuaugcugcccaggccagucucaaa

SEQ ID NO: 320445 - RNA, 26 nt, Human
cggcagccgcggcagcaucaacggag

SEQ ID NO: 320446 - RNA, 25 nt, Human
cggcccccggauaucuuauuccccc

SEQ ID NO: 320447 - RNA, 20 nt, Human
cggcucggcacggcugacgg

SEQ ID NO: 320448 - RNA, 23 nt, Human
cuaauuuuuguguuuuuaauaga

SEQ ID NO: 320449 - RNA, 21 nt, Human
cuacugaguugaccgucacgu

SEQ ID NO: 320450 - RNA, 18 nt, Human
cucaacaugaauauuuaa

SEQ ID NO: 320451 - RNA, 24 nt, Human
cucaagcaaucuuucugcuucagc

SEQ ID NO: 320452 - RNA, 24 nt, Human
cucacucugucacccaggcuggag

SEQ ID NO: 320453 - RNA, 20 nt, Human
cucaggcucaagugauccuc

SEQ ID NO: 320454 - RNA, 24 nt, Human
cucaucucagccuccugaguagcu

SEQ ID NO: 320455 - RNA, 25 nt, Human
cucccaggcucaagcaaucuuucug

SEQ ID NO: 320456 - RNA, 24 nt, Human
cuccugaauagcugggacuacagg

SEQ ID NO: 320457 - RNA, 26 nt, Human
cuccugaccucaggugaucugccugc

SEQ ID NO: 320458 - RNA, 19 nt, Human
cuccugaguuccauauucu

SEQ ID NO: 320459 - RNA, 23 nt, Human
cuccugggcucaagcaauccucu

SEQ ID NO: 320460 - RNA, 23 nt, Human
cucgggaagccggacuccccggg

SEQ ID NO: 320461 - RNA, 23 nt, Human
cucuacauuuugcacagugauug

SEQ ID NO: 320462 - RNA, 18 nt, Human
cucugcaugaaggucagc

SEQ ID NO: 320463 - RNA, 20 nt, Human
cucuguucacucagcagcug

SEQ ID NO: 320464 - RNA, 18 nt, Human
cugaguagcugagacuac

SEQ ID NO: 320465 - RNA, 22 nt, Human
cugcagccucaaccucuugagc

SEQ ID NO: 320466 - RNA, 23 nt, Human
cugcagccucaaccucuugagcu

SEQ ID NO: 320467 - RNA, 19 nt, Human
cuggagaaaucaaaggcug

SEQ ID NO: 320468 - RNA, 24 nt, Human
cuggagggcaauggugugaucuca

SEQ ID NO: 320469 - RNA, 22 nt, Human
cuggccuuaagcaauccuccca

SEQ ID NO: 320470 - RNA, 27 nt, Human
cuuccccaaauccuaggauuauaaaag

SEQ ID NO: 320471 - RNA, 31 nt, Human
cuucuauauauacacacacacacacacacag

SEQ ID NO: 320472 - RNA, 25 nt, Human
gaaaaaccaagacaacaccaaaaga

SEQ ID NO: 320473 - RNA, 26 nt, Human
gaaaagcuucaaaucccaccugcuaa

SEQ ID NO: 320474 - RNA, 19 nt, Human
gaaaaggugcacccucuuc

SEQ ID NO: 320475 - RNA, 21 nt, Human
gaaacaugacagagcaucccc

SEQ ID NO: 320476 - RNA, 26 nt, Human
gaaacugaauugaaaaauaaaaauaa

SEQ ID NO: 320477 - RNA, 18 nt, Human
gaacaggugagguuccuu

SEQ ID NO: 320478 - RNA, 23 nt, Human
gaccucaggugaucugccugccu

SEQ ID NO: 320479 - RNA, 23 nt, Human
gacuacaggaacaagccacugca

SEQ ID NO: 320480 - RNA, 24 nt, Human
gacuacaggcaugcuccaccaugc

SEQ ID NO: 320481 - RNA, 24 nt, Human
gacucugccacccacucacauccu

SEQ ID NO: 320482 - RNA, 25 nt, Human
gagaaaaaccaagacaacaccaaaa

SEQ ID NO: 320483 - RNA, 21 nt, Human
gagguggagaagaaagucuug

SEQ ID NO: 320484 - RNA, 24 nt, Human
gaguagcugagacuacaggcaugc

SEQ ID NO: 320485 - RNA, 18 nt, Human
gauuacaggcaugugcca

SEQ ID NO: 320486 - RNA, 21 nt, Human
gauuacaggugugagccuggc

SEQ ID NO: 320487 - RNA, 19 nt, Human
gcaacauacccuucagaug

SEQ ID NO: 320488 - RNA, 26 nt, Human
gcagggcaugagaaaaagaagaggug

SEQ ID NO: 320489 - RNA, 23 nt, Human
gccaaggggugcacaaaccugcc

SEQ ID NO: 320490 - RNA, 22 nt, Human
gcccaguuaacuuuuuuguauu

SEQ ID NO: 320491 - RNA, 24 nt, Human
gcccaguuaacuuuuuuguauuuu

SEQ ID NO: 320492 - RNA, 22 nt, Human
gccccgggagggagcagccgcu

SEQ ID NO: 320493 - RNA, 22 nt, Human
gccuuggccucccaaagugcug

SEQ ID NO: 320494 - RNA, 22 nt, Human
gcgaacaacacaucccaaacca

SEQ ID NO: 320495 - RNA, 18 nt, Human
gcucaagugauccucuca

SEQ ID NO: 320496 - RNA, 19 nt, Human
gcugacggagacacagaga

SEQ ID NO: 320497 - RNA, 28 nt, Human
gcuggagggcaauggugugaucucagau

SEQ ID NO: 320498 - RNA, 19 nt, Human
gcuggagugcaguggcgca

SEQ ID NO: 320499 - RNA, 23 nt, Human
gcuggucucaaacuccugaccuc

SEQ ID NO: 320500 - RNA, 25 nt, Human
ggacagaaaagaaacaaaacgcuga

SEQ ID NO: 320501 - RNA, 18 nt, Human
ggacuacagguaugcaca

SEQ ID NO: 320502 - RNA, 21 nt, Human
ggacuacagguaugcacaaug

SEQ ID NO: 320503 - RNA, 19 nt, Human
ggacuccccgggacgcagc

SEQ ID NO: 320504 - RNA, 18 nt, Human
ggagaaaucaaaggcugc

SEQ ID NO: 320505 - RNA, 20 nt, Human
ggagacagaugaaggcaggg

SEQ ID NO: 320506 - RNA, 19 nt, Human
ggauuacaggcaugugcca

SEQ ID NO: 320507 - RNA, 23 nt, Human
ggauuacaggugugagccuggcc

SEQ ID NO: 320508 - RNA, 22 nt, Human
ggcagcagucacaggggcccca

SEQ ID NO: 320509 - RNA, 19 nt, Human
ggcauuucaggcuuuccug

SEQ ID NO: 320510 - RNA, 22 nt, Human
ggcuggagggcaauggugugau

SEQ ID NO: 320511 - RNA, 24 nt, Human
ggcuggucucaaacuccugaccuc

SEQ ID NO: 320512 - RNA, 24 nt, Human
gggccaggccggagcgcucgggaa

SEQ ID NO: 320513 - RNA, 18 nt, Human
ggggacccaacuggcuuc

SEQ ID NO: 320514 - RNA, 22 nt, Human
gggucucgcuaugcugcccagg

SEQ ID NO: 320515 - RNA, 21 nt, Human
ggguuucaucauguuggccag

SEQ ID NO: 320516 - RNA, 22 nt, Human
ggguuucaucauguuggccagg

SEQ ID NO: 320517 - RNA, 23 nt, Human
gucauuguggauuccugcaauaa

SEQ ID NO: 320518 - RNA, 20 nt, Human
guccaaagaacuagagacca

SEQ ID NO: 320519 - RNA, 19 nt, Human
gucugugugaguguacccc

SEQ ID NO: 320520 - RNA, 23 nt, Human
gugauccucucaucucagccucc

SEQ ID NO: 320521 - RNA, 18 nt, Human
gugcagaaggagacagau

SEQ ID NO: 320522 - RNA, 22 nt, Human
gugcagccugaguugcaccugg

SEQ ID NO: 320523 - RNA, 24 nt, Human
gugcagccugaguugcaccuggcc

SEQ ID NO: 320524 - RNA, 22 nt, Human
gugcucaaguguuucauuuaug

SEQ ID NO: 320525 - RNA, 23 nt, Human
gugcugucuugcacucuguucac

SEQ ID NO: 320526 - RNA, 20 nt, Human
uaaaacccaagccagugcug

SEQ ID NO: 320527 - RNA, 21 nt, Human
uaaaaggagaaauuaggaaca

SEQ ID NO: 320528 - RNA, 22 nt, Human
uaaaauuacacauauggacuca

SEQ ID NO: 320529 - RNA, 18 nt, Human
uaaauaaugccaguucca

SEQ ID NO: 320530 - RNA, 20 nt, Human
uaacacauggcaaggguaua

SEQ ID NO: 320531 - RNA, 22 nt, Human
uaacgaaacaauuuucaaaacc

SEQ ID NO: 320532 - RNA, 21 nt, Human
uaacugggauuacaggcaugu

SEQ ID NO: 320533 - RNA, 27 nt, Human
uaagcaauccucccaacccagguuccc

SEQ ID NO: 320534 - RNA, 25 nt, Human
uaauaaaacagacaacauaaaauua

SEQ ID NO: 320535 - RNA, 25 nt, Human
uaauagagacaaggguuucaucaug

SEQ ID NO: 320536 - RNA, 22 nt, Human
uaauuuuuguguuuuuaauaga

SEQ ID NO: 320537 - RNA, 24 nt, Human
uaauuuuuguguuuuuaauagaga

SEQ ID NO: 320538 - RNA, 23 nt, Human
uacaacagcuccugaauagcugg

SEQ ID NO: 320539 - RNA, 20 nt, Human
uacacacacacacacacaca

SEQ ID NO: 320540 - RNA, 21 nt, Human
uacacauauggacucaugggu

SEQ ID NO: 320541 - RNA, 21 nt, Human
uacagacaggguucacuaugu

SEQ ID NO: 320542 - RNA, 24 nt, Human
uacagcccaccuucaccaagacac

SEQ ID NO: 320543 - RNA, 22 nt, Human
uacaggaacaagccacugcacc

SEQ ID NO: 320544 - RNA, 24 nt, Human
uacaggcaugcuccaccaugccca

SEQ ID NO: 320545 - RNA, 20 nt, Human
uacaggcaugugccaccaca

SEQ ID NO: 320546 - RNA, 23 nt, Human
uacagguaugcacaaugacaccc

SEQ ID NO: 320547 - RNA, 23 nt, Human
uacaucacugcacaauuugugca

SEQ ID NO: 320548 - RNA, 23 nt, Human
uacauuuugcacagugauuguuu

SEQ ID NO: 320549 - RNA, 19 nt, Human
uaccccuguugucaacaag

SEQ ID NO: 320550 - RNA, 19 nt, Human
uaccccuguugucaacaag

SEQ ID NO: 320551 - RNA, 20 nt, Human
uacucugggugcagaaggag

SEQ ID NO: 320552 - RNA, 19 nt, Human
uacugaguuuugagaagag

SEQ ID NO: 320553 - RNA, 22 nt, Human
uagaauguucaauaauauuauu

SEQ ID NO: 320554 - RNA, 24 nt, Human
uagaauguucaauaauauuauuac

SEQ ID NO: 320555 - RNA, 21 nt, Human
uagagacaaggguuucaucau

SEQ ID NO: 320556 - RNA, 22 nt, Human
uagagacaaggguuucaucaug

SEQ ID NO: 320557 - RNA, 23 nt, Human
uagagacaaggguuucaucaugu

SEQ ID NO: 320558 - RNA, 21 nt, Human
uagagaccauguaggucaaac

SEQ ID NO: 320559 - RNA, 18 nt, Human
uagagauggggucucgcu

SEQ ID NO: 320560 - RNA, 21 nt, Human
uagcagcaauagccccgggag

SEQ ID NO: 320561 - RNA, 19 nt, Human
uaggauuacaggugugagc

SEQ ID NO: 320562 - RNA, 20 nt, Human
uaggauuacaggugugagcc

SEQ ID NO: 320563 - RNA, 20 nt, Human
uaggauuacaggugugagcc

SEQ ID NO: 320564 - RNA, 22 nt, Human
uaggauuacaggugugagccug

SEQ ID NO: 320565 - RNA, 28 nt, Human
uaggauuacaggugugagccuggcccca

SEQ ID NO: 320566 - RNA, 27 nt, Human
uauacacacacacacacacacacaauu

SEQ ID NO: 320567 - RNA, 23 nt, Human
uauacacacagguacagagaaaa

SEQ ID NO: 320568 - RNA, 23 nt, Human
uauagagauggggucucgcuaug

SEQ ID NO: 320569 - RNA, 24 nt, Human
uauauacacacacacacacacaca

SEQ ID NO: 320570 - RNA, 23 nt, Human
uaucguaagaauuuuccucuaca

SEQ ID NO: 320571 - RNA, 20 nt, Human
uaucgugggcacgaugggag

SEQ ID NO: 320572 - RNA, 25 nt, Human
uaugaccccgccaugggcaguuucc

SEQ ID NO: 320573 - RNA, 24 nt, Human
uaugcugcccaggccagucucaaa

SEQ ID NO: 320574 - RNA, 23 nt, Human
uauguugcccaagcuggucucaa

SEQ ID NO: 320575 - RNA, 24 nt, Human
uauguugcccaagcuggucucaaa

SEQ ID NO: 320576 - RNA, 19 nt, Human
uauucuccugccucagccu

SEQ ID NO: 320577 - RNA, 21 nt, Human
uauugaacuccugggcucaag

SEQ ID NO: 320578 - RNA, 20 nt, Human
ucaaacacagaaauggcgaa

SEQ ID NO: 320579 - RNA, 19 nt, Human
ucaaacucccaggcucaag

SEQ ID NO: 320580 - RNA, 24 nt, Human
ucaaagcaaacaaauaaaaagguc

SEQ ID NO: 320581 - RNA, 20 nt, Human
ucaaugccuaugaaagcagg

SEQ ID NO: 320582 - RNA, 22 nt, Human
ucacuccuucgcccuggcugga

SEQ ID NO: 320583 - RNA, 19 nt, Human
ucacugcagccucaaccuc

SEQ ID NO: 320584 - RNA, 22 nt, Human
ucacugcagccucaaccucuug

SEQ ID NO: 320585 - RNA, 24 nt, Human
ucacuguauggcugucaugccauc

SEQ ID NO: 320586 - RNA, 22 nt, Human
ucauuguggauuccugcaauaa

SEQ ID NO: 320587 - RNA, 18 nt, Human
uccaaaaccuacuucuuc

SEQ ID NO: 320588 - RNA, 22 nt, Human
uccacauuucaccaucugaaca

SEQ ID NO: 320589 - RNA, 23 nt, Human
uccacauuucaccaucugaacau

SEQ ID NO: 320590 - RNA, 18 nt, Human
uccacggagcggaaccac

SEQ ID NO: 320591 - RNA, 18 nt, Human
uccaucagcaagagaaaa

SEQ ID NO: 320592 - RNA, 24 nt, Human
ucccaaagugcugggauugcaggc

SEQ ID NO: 320593 - RNA, 27 nt, Human
ucccaaaguguuacuuaggauuacagg

SEQ ID NO: 320594 - RNA, 30 nt, Human
ucccagacagguauugaacuccugggcuga

SEQ ID NO: 320595 - RNA, 20 nt, Human
ucccagagugcugggacuac

SEQ ID NO: 320596 - RNA, 18 nt, Human
ucccaggcucaagcaauc

SEQ ID NO: 320597 - RNA, 20 nt, Human
ucccaggcucaagcaaucuu

SEQ ID NO: 320598 - RNA, 24 nt, Human
ucccaggcucaagcaaucuuucug

SEQ ID NO: 320599 - RNA, 24 nt, Human
ucccgacuaacugggauuacaggc

SEQ ID NO: 320600 - RNA, 23 nt, Human
ucccggucucacgcccgccgcuu

SEQ ID NO: 320601 - RNA, 20 nt, Human
ucccugaccccccaugagaa

SEQ ID NO: 320602 - RNA, 18 nt, Human
ucccuugacauuuugccu

SEQ ID NO: 320603 - RNA, 25 nt, Human
uccucaggcucaagugauccucuca

SEQ ID NO: 320604 - RNA, 24 nt, Human
uccugaauagcugggacuacaggu

SEQ ID NO: 320605 - RNA, 24 nt, Human
uccugaguagcugagacuacaggc

SEQ ID NO: 320606 - RNA, 22 nt, Human
uccugaguuccauauucuccug

SEQ ID NO: 320607 - RNA, 26 nt, Human
uccugaguuccauauucuccugccuc

SEQ ID NO: 320608 - RNA, 18 nt, Human
uccugggcucaagcaauc

SEQ ID NO: 320609 - RNA, 21 nt, Human
uccugggcucaagcaauccuc

SEQ ID NO: 320610 - RNA, 24 nt, Human
ucgccccagccucccaaaguguua

SEQ ID NO: 320611 - RNA, 24 nt, Human
ucgcccuggcuggagugcaguggc

SEQ ID NO: 320612 - RNA, 21 nt, Human
ucgccucugggugcgcggcuc

SEQ ID NO: 320613 - RNA, 18 nt, Human
ucguccagccuggagugc

SEQ ID NO: 320614 - RNA, 22 nt, Human
ucuagcaugacccacauuuagc

SEQ ID NO: 320615 - RNA, 18 nt, Human
ucuaugagaaaaaccaag

SEQ ID NO: 320616 - RNA, 24 nt, Human
ucucacuccuucgcccuggcugga

SEQ ID NO: 320617 - RNA, 23 nt, Human
ucucacucugucacccaggcugg

SEQ ID NO: 320618 - RNA, 24 nt, Human
ucucacucugucacccaggcugga

SEQ ID NO: 320619 - RNA, 26 nt, Human
ucucacucugucacccaggcuggagg

SEQ ID NO: 320620 - RNA, 27 nt, Human
ucucacucugucacccaggcuggaggg

SEQ ID NO: 320621 - RNA, 24 nt, Human
ucucauuuguucuguauggcugga

SEQ ID NO: 320622 - RNA, 22 nt, Human
ucuccugccucagccucccgac

SEQ ID NO: 320623 - RNA, 26 nt, Human
ucucgcuaugcugcccaggccagucu

SEQ ID NO: 320624 - RNA, 27 nt, Human
ucucgcuaugcugcccaggccagucuc

SEQ ID NO: 320625 - RNA, 24 nt, Human
ucugcggaacagcuuuccagucca

SEQ ID NO: 320626 - RNA, 19 nt, Human
ucugcggaucuuccucgcg

SEQ ID NO: 320627 - RNA, 22 nt, Human
ucuguaggcgaacucuggccca

SEQ ID NO: 320628 - RNA, 18 nt, Human
ucugucacccaggcugga

SEQ ID NO: 320629 - RNA, 24 nt, Human
ucuugcucugucguccagccugga

SEQ ID NO: 320630 - RNA, 23 nt, Human
ucuuuuuuuuuauauagagaugg

SEQ ID NO: 320631 - RNA, 18 nt, Human
ugaaaauacagcccaccu

SEQ ID NO: 320632 - RNA, 25 nt, Human
ugaacuccugggcucaagcaauccu

SEQ ID NO: 320633 - RNA, 19 nt, Human
ugaaggaauuagaagaauu

SEQ ID NO: 320634 - RNA, 25 nt, Human
ugaauagcugggacuacagguaugc

SEQ ID NO: 320635 - RNA, 21 nt, Human
ugaaugagaaauucaguaaca

SEQ ID NO: 320636 - RNA, 21 nt, Human
ugaauguagacacccccggcc

SEQ ID NO: 320637 - RNA, 22 nt, Human
ugacacacucugccagguaaac

SEQ ID NO: 320638 - RNA, 18 nt, Human
ugaccucaggugaucugc

SEQ ID NO: 320639 - RNA, 20 nt, Human
ugaccucaggugaucugccu

SEQ ID NO: 320640 - RNA, 24 nt, Human
ugaccucaggugaucugccugccu

SEQ ID NO: 320641 - RNA, 19 nt, Human
ugacugcagccuccgccuc

SEQ ID NO: 320642 - RNA, 22 nt, Human
ugacugcagccuccgccuccug

SEQ ID NO: 320643 - RNA, 21 nt, Human
ugagaaaaaccaagacaacac

SEQ ID NO: 320644 - RNA, 25 nt, Human
ugagaaaaaccaagacaacaccaaa

SEQ ID NO: 320645 - RNA, 27 nt, Human
ugagaaaaaccaagacaacaccaaaag

SEQ ID NO: 320646 - RNA, 24 nt, Human
ugagacuacaggcaugcuccacca

SEQ ID NO: 320647 - RNA, 19 nt, Human
ugaguugaccgucacguga

SEQ ID NO: 320648 - RNA, 20 nt, Human
ugcacagcauccggcagcag

SEQ ID NO: 320649 - RNA, 19 nt, Human
ugcaccuggcuacagagug

SEQ ID NO: 320650 - RNA, 19 nt, Human
ugcaggaugaauuuuuuuu

SEQ ID NO: 320651 - RNA, 19 nt, Human
ugcaugcaacauacccuuc

SEQ ID NO: 320652 - RNA, 24 nt, Human
ugccucagccucccgacuaacugg

SEQ ID NO: 320653 - RNA, 18 nt, Human
ugccugccuuggccuccc

SEQ ID NO: 320654 - RNA, 22 nt, Human
ugcuagagggagaaaucucuuc

SEQ ID NO: 320655 - RNA, 19 nt, Human
ugcucaaguguuucauuua

SEQ ID NO: 320656 - RNA, 18 nt, Human
ugcuccaccaugcccagu

SEQ ID NO: 320657 - RNA, 24 nt, Human
ugcucugucguccagccuggagug

SEQ ID NO: 320658 - RNA, 22 nt, Human
uggaaaaacagcuccaauagca

SEQ ID NO: 320659 - RNA, 21 nt, Human
uggaaaagcuucaaaucccac

SEQ ID NO: 320660 - RNA, 19 nt, Human
uggaacagggucucacucu

SEQ ID NO: 320661 - RNA, 22 nt, Human
uggaacagggucucacucuguc

SEQ ID NO: 320662 - RNA, 19 nt, Human
uggagaagaaagucuugga

SEQ ID NO: 320663 - RNA, 23 nt, Human
uggagagggaguggggcugaacu

SEQ ID NO: 320664 - RNA, 19 nt, Human
uggagggcaauggugugau

SEQ ID NO: 320665 - RNA, 23 nt, Human
uggagugcacuggcacaaucagg

SEQ ID NO: 320666 - RNA, 23 nt, Human
uggagugcaguggcgcaaucuug

SEQ ID NO: 320667 - RNA, 24 nt, Human
uggagugcaguggcgcaaucuugg

SEQ ID NO: 320668 - RNA, 23 nt, Human
uggcacaaucagggcucacugca

SEQ ID NO: 320669 - RNA, 24 nt, Human
uggccaggcuggucucaaacuccu

SEQ ID NO: 320670 - RNA, 21 nt, Human
uggccuggaccuccucaggcu

SEQ ID NO: 320671 - RNA, 20 nt, Human
uggccuuaagcaauccuccc

SEQ ID NO: 320672 - RNA, 21 nt, Human
uggccuuaagcaauccuccca

SEQ ID NO: 320673 - RNA, 21 nt, Human
uggcgaacaacacaucccaaa

SEQ ID NO: 320674 - RNA, 23 nt, Human
uggcuacagaguggagccuugga

SEQ ID NO: 320675 - RNA, 23 nt, Human
uggcuggagugcaguggcgcaau

SEQ ID NO: 320676 - RNA, 19 nt, Human
uggcugggcggugcucacg

SEQ ID NO: 320677 - RNA, 22 nt, Human
ugggacuacaggaacaagccac

SEQ ID NO: 320678 - RNA, 22 nt, Human
ugggacuacaggaacaagccac

SEQ ID NO: 320679 - RNA, 24 nt, Human
ugggacuacaggaacaagccacug

SEQ ID NO: 320680 - RNA, 24 nt, Human
ugggacuacaggaacaagccacug

SEQ ID NO: 320681 - RNA, 18 nt, Human
ugggacuacagguaugca

SEQ ID NO: 320682 - RNA, 18 nt, Human
ugggauuacaggcaugug

SEQ ID NO: 320683 - RNA, 21 nt, Human
ugggauuacaggcaugugcca

SEQ ID NO: 320684 - RNA, 22 nt, Human
ugggauuacaggcaugugccac

SEQ ID NO: 320685 - RNA, 24 nt, Human
ugggauuacaggcaugugccacca

SEQ ID NO: 320686 - RNA, 19 nt, Human
ugggauugcaggcaugaca

SEQ ID NO: 320687 - RNA, 22 nt, Human
ugggauugcaggcaugacacac

SEQ ID NO: 320688 - RNA, 22 nt, Human
ugggauugcaggcaugacacac

SEQ ID NO: 320689 - RNA, 25 nt, Human
ugggauugcaggcaugacacacucu

SEQ ID NO: 320690 - RNA, 19 nt, Human
ugggggcaaggcagauggu

SEQ ID NO: 320691 - RNA, 24 nt, Human
uggggucucgcuaugcugcccagg

SEQ ID NO: 320692 - RNA, 22 nt, Human
ugggugcagaaggagacagaug

SEQ ID NO: 320693 - RNA, 21 nt, Human
uggugagugagaagcacaggc

SEQ ID NO: 320694 - RNA, 23 nt, Human
ugguuauaaucaaauaaguccag

SEQ ID NO: 320695 - RNA, 18 nt, Human
uguaaagaguuuauucug

SEQ ID NO: 320696 - RNA, 23 nt, Human
uguagagaugagguguuucccag

SEQ ID NO: 320697 - RNA, 23 nt, Human
uguauggcuggaggcugaucaug

SEQ ID NO: 320698 - RNA, 23 nt, Human
uuaaaaauaggcacuccccuccc

SEQ ID NO: 320699 - RNA, 25 nt, Human
uuaauagagacaaggguuucaucau

SEQ ID NO: 320700 - RNA, 28 nt, Human
uucaaaaccuuccuacaguguggaauuc

SEQ ID NO: 320701 - RNA, 19 nt, Human
uucaaaagcaaaaagccau

SEQ ID NO: 320702 - RNA, 20 nt, Human
uucaaaagcaaaaagccauu

SEQ ID NO: 320703 - RNA, 19 nt, Human
uucaccaagacacacacac

SEQ ID NO: 320704 - RNA, 23 nt, Human
uucccccaaacuauacaaugcau

SEQ ID NO: 320705 - RNA, 23 nt, Human
uugaagauuucuaaauccuucug

SEQ ID NO: 320706 - RNA, 23 nt, Human
uugacucugccacccacucacau

SEQ ID NO: 320707 - RNA, 22 nt, Human
uuggaauugcuucuaauuucuc

SEQ ID NO: 320708 - RNA, 23 nt, Human
uuggagucuuuaacaguguuaag

SEQ ID NO: 320709 - RNA, 18 nt, Human
uuggccucccaaagugcu

SEQ ID NO: 320710 - RNA, 23 nt, Human
uuggguuuuuuuuuuuuuuugga

SEQ ID NO: 320711 - RNA, 24 nt, Human
uuuaacauuuccauuuccuaaaga

SEQ ID NO: 320712 - RNA, 18 nt, Human
uuuaguauaccugcuacc

SEQ ID NO: 320713 - RNA, 24 nt, Human
uuucaucauguuggccaggcuggu

SEQ ID NO: 320714 - RNA, 24 nt, Human
uuuuauuuuuugagaugggagucu

SEQ ID NO: 320715 - RNA, 24 nt, Human
uuuuuaauagagacaaggguuuca

SEQ ID NO: 320716 - RNA, 20 nt, Human
uuuuuguguuuuuaauagag

SEQ ID NO: 320717 - RNA, 23 nt, Human
uuuuuguguuuuuaauagagaca

SEQ ID NO: 320718 - RNA, 19 nt, Human
uuuuuuguauuuuguagag

SEQ ID NO: 320719 - RNA, 21 nt, Human
uuuuuuguauuuuguagagau

SEQ ID NO: 320720 - RNA, 23 nt, Human
uuuuuuuuuuggaacagggucuc

SEQ ID NO: 320721 - RNA, 20 nt, Human
uuuuuuuuuuuggaacaggg

SEQ ID NO: 320722 - RNA, 23 nt, Human
uuuuuuuuuuuuggaacaggguc

SEQ ID NO: 320723 - RNA, 19 nt, Human
agcauggauucaaaagaga

SEQ ID NO: 320724 - RNA, 21 nt, Human
ccaagcauggauucaaaagag

SEQ ID NO: 320725 - RNA, 20 nt, Human
gagucaguuuuuauuuuuua

SEQ ID NO: 320726 - RNA, 18 nt, Human
uaaaagaagcuugcaaug

SEQ ID NO: 320727 - RNA, 21 nt, Human
uggaacggaucauuaaggacc

SEQ ID NO: 320728 - RNA, 22 nt, Human
aaagcccagcccagaaaaccgg

SEQ ID NO: 320729 - RNA, 23 nt, Human
aaagcccagcccagaaaaccggc

SEQ ID NO: 320730 - RNA, 21 nt, Human
aacagcaaaaaguaaaucuac

SEQ ID NO: 320731 - RNA, 23 nt, Human
aaggagcugggagcuuuaguagg

SEQ ID NO: 320732 - RNA, 20 nt, Human
acauaguuuuauaacuaaca

SEQ ID NO: 320733 - RNA, 21 nt, Human
agaaagaggcaagugguuaaa

SEQ ID NO: 320734 - RNA, 19 nt, Human
agaaagcccagcccagaaa

SEQ ID NO: 320735 - RNA, 18 nt, Human
agaggauauaccuauugg

SEQ ID NO: 320736 - RNA, 20 nt, Human
aggacaugaagcuccauugu

SEQ ID NO: 320737 - RNA, 19 nt, Human
auggagcaugaaaggagcu

SEQ ID NO: 320738 - RNA, 19 nt, Human
caguaagguauaggaacuu

SEQ ID NO: 320739 - RNA, 21 nt, Human
cauccucaguguucgccucca

SEQ ID NO: 320740 - RNA, 21 nt, Human
ccuccaugaauaggagaguuc

SEQ ID NO: 320741 - RNA, 19 nt, Human
ccugcacgaggacaugaag

SEQ ID NO: 320742 - RNA, 18 nt, Human
gaaagagggagaaggagu

SEQ ID NO: 320743 - RNA, 23 nt, Human
gcaauuuucauggcauuuuccua

SEQ ID NO: 320744 - RNA, 27 nt, Human
uaacagcaaaaaguaaaucuacaaauc

SEQ ID NO: 320745 - RNA, 19 nt, Human
uaacuaacagcaaaaagua

SEQ ID NO: 320746 - RNA, 23 nt, Human
uauaacuaacagcaaaaaguaaa

SEQ ID NO: 320747 - RNA, 20 nt, Human
uaucagaaguucacuucagg

SEQ ID NO: 320748 - RNA, 26 nt, Human
uaucagaaguucacuucaggguucau

SEQ ID NO: 320749 - RNA, 18 nt, Human
ucuuuugucaucuuucua

SEQ ID NO: 320750 - RNA, 24 nt, Human
ugaguaagcagaaagcccagccca

SEQ ID NO: 320751 - RNA, 23 nt, Human
ugaguacuuccugcacgaggaca

SEQ ID NO: 320752 - RNA, 22 nt, Human
ugcugcaggaaauguaucagaa

SEQ ID NO: 320753 - RNA, 19 nt, Human
uggaaagcuguuucgcgaa

SEQ ID NO: 320754 - RNA, 22 nt, Human
uggcauugucccucaagaauac

SEQ ID NO: 320755 - RNA, 21 nt, Human
ugguuaaaaauggagcaugaa

SEQ ID NO: 320756 - RNA, 19 nt, Human
uuaguuuugucagggagca

SEQ ID NO: 320757 - RNA, 24 nt, Human
uuucacguacucuguaguguuacc

SEQ ID NO: 320758 - RNA, 21 nt, Human
agccagccaaccugucagcag

SEQ ID NO: 320759 - RNA, 21 nt, Human
aggcaggaguuugguggaugu

SEQ ID NO: 320760 - RNA, 21 nt, Human
ccugucagcagguggaacucu

SEQ ID NO: 320761 - RNA, 23 nt, Human
ggcaagaggaucuugaagucugg

SEQ ID NO: 320762 - RNA, 18 nt, Human
ucagagcagggcaccacc

SEQ ID NO: 320763 - RNA, 23 nt, Human
ucagcagguggaacucugugggc

SEQ ID NO: 320764 - RNA, 21 nt, Human
uggaacucugugggcagcuga

SEQ ID NO: 320765 - RNA, 18 nt, Human
uggcaagaggaucuugaa

SEQ ID NO: 320766 - RNA, 20 nt, Human
uucaagauguggcaagagga

SEQ ID NO: 320767 - RNA, 19 nt, Human
uuccuuagcaggcuccuga

SEQ ID NO: 320768 - RNA, 21 nt, Human
uucucaggcaggaguuuggug

SEQ ID NO: 320769 - RNA, 20 nt, Human
uuggcugagccagccaaccu

SEQ ID NO: 320770 - RNA, 21 nt, Human
aagcuuuauugggcaggugac

SEQ ID NO: 320771 - RNA, 19 nt, Human
acuugguguuucgggcgac

SEQ ID NO: 320772 - RNA, 19 nt, Human
aggagggcggaggccugcc

SEQ ID NO: 320773 - RNA, 19 nt, Human
aggggaggagggcggaggc

SEQ ID NO: 320774 - RNA, 20 nt, Human
aggggaggagggcggaggcc

SEQ ID NO: 320775 - RNA, 18 nt, Human
cccuggaguaggggagga

SEQ ID NO: 320776 - RNA, 18 nt, Human
cucacucgguguuucuug

SEQ ID NO: 320777 - RNA, 22 nt, Human
cuccugggcugaggcugcagug

SEQ ID NO: 320778 - RNA, 20 nt, Human
cugaggcugcagugggcccc

SEQ ID NO: 320779 - RNA, 22 nt, Human
gagcauuugauguaggggaauu

SEQ ID NO: 320780 - RNA, 20 nt, Human
gagcauuugauguaggggag

SEQ ID NO: 320781 - RNA, 21 nt, Human
ggcugcagugggcccuggagu

SEQ ID NO: 320782 - RNA, 23 nt, Human
gggagaucugguggcuccugggc

SEQ ID NO: 320783 - RNA, 24 nt, Human
gggagaucugguggcuccugggcu

SEQ ID NO: 320784 - RNA, 23 nt, Human
gggcccuggaguaggggaggagg

SEQ ID NO: 320785 - RNA, 18 nt, Human
gguguugggagaucuggu

SEQ ID NO: 320786 - RNA, 28 nt, Human
guggcuccugggcugaggcugcaguggg

SEQ ID NO: 320787 - RNA, 19 nt, Human
uccugggcugaggcugcag

SEQ ID NO: 320788 - RNA, 18 nt, Human
ugcagugggcccuggagu

SEQ ID NO: 320789 - RNA, 18 nt, Human
ugggcaggugacuuugca

SEQ ID NO: 320790 - RNA, 19 nt, Human
ugggcuucucggcggcaac

SEQ ID NO: 320791 - RNA, 22 nt, Human
ugguguuucgggcgacuuuuuc

SEQ ID NO: 320792 - RNA, 18 nt, Human
uguugggagaucuggugg

SEQ ID NO: 320793 - RNA, 20 nt, Human
uucuuaauuuccagcugggg

SEQ ID NO: 320794 - RNA, 24 nt, Human
uugguguuucgggcgacuuuuucu

SEQ ID NO: 320795 - RNA, 23 nt, Human
uuucucuuaacuuccagcugggg

SEQ ID NO: 320796 - RNA, 23 nt, Human
uuuuucuuaauuuccagcugggg

SEQ ID NO: 320797 - RNA, 18 nt, Human
aaacaucaccccaguucu

SEQ ID NO: 320798 - RNA, 19 nt, Human
aaacuccuaagucuguccu

SEQ ID NO: 320799 - RNA, 19 nt, Human
aaagauggugaaaacagga

SEQ ID NO: 320800 - RNA, 20 nt, Human
aaagauuagaaagaugguga

SEQ ID NO: 320801 - RNA, 23 nt, Human
aaggagccagagguauccaggca

SEQ ID NO: 320802 - RNA, 23 nt, Human
aauacauaucugcuaggugacaa

SEQ ID NO: 320803 - RNA, 24 nt, Human
acaaaacaagaacaugcaaaguua

SEQ ID NO: 320804 - RNA, 23 nt, Human
acuguucugagauuuguuuuagc

SEQ ID NO: 320805 - RNA, 23 nt, Human
agccaauaauaacauugcagaaa

SEQ ID NO: 320806 - RNA, 23 nt, Human
agugcacauuguaagccuaagga

SEQ ID NO: 320807 - RNA, 24 nt, Human
aucauguggccuccuaacaaaccu

SEQ ID NO: 320808 - RNA, 24 nt, Human
augucaaaaucauucugguuucca

SEQ ID NO: 320809 - RNA, 19 nt, Human
auuuuauauacauauauau

SEQ ID NO: 320810 - RNA, 25 nt, Human
caagccaauaauaacauugcagaaa

SEQ ID NO: 320811 - RNA, 22 nt, Human
caagggcaccauucccaaacau

SEQ ID NO: 320812 - RNA, 24 nt, Human
caauuaugagacagaaauaaagaa

SEQ ID NO: 320813 - RNA, 20 nt, Human
cacaaagugcaagccaauaa

SEQ ID NO: 320814 - RNA, 24 nt, Human
caccaccacuaaaagggcugcagg

SEQ ID NO: 320815 - RNA, 21 nt, Human
cagcaucucaggucuacucua

SEQ ID NO: 320816 - RNA, 22 nt, Human
cagcgggcugagccugcauccc

SEQ ID NO: 320817 - RNA, 19 nt, Human
ccacgcaaaaggguuuccc

SEQ ID NO: 320818 - RNA, 21 nt, Human
ccagugcccaucagugccaag

SEQ ID NO: 320819 - RNA, 24 nt, Human
ccuccuaacaaaccuggcagaaau

SEQ ID NO: 320820 - RNA, 18 nt, Human
ccucggucgugaggagag

SEQ ID NO: 320821 - RNA, 18 nt, Human
cuccaagggcaccauucc

SEQ ID NO: 320822 - RNA, 19 nt, Human
cugcugaaggagccagagg

SEQ ID NO: 320823 - RNA, 22 nt, Human
gaaggagccagagguauccagg

SEQ ID NO: 320824 - RNA, 19 nt, Human
gauggugaaaacaggaaga

SEQ ID NO: 320825 - RNA, 18 nt, Human
gcacauuguaagccuaag

SEQ ID NO: 320826 - RNA, 20 nt, Human
gcagguggauaccgccuccc

SEQ ID NO: 320827 - RNA, 23 nt, Human
gccugcaucccaagagcuaagaa

SEQ ID NO: 320828 - RNA, 21 nt, Human
gcuaugaaaucucuacuaaga

SEQ ID NO: 320829 - RNA, 22 nt, Human
ggacaaaggagauuugccuuca

SEQ ID NO: 320830 - RNA, 22 nt, Human
uaacaaaacaagaacaugcaaa

SEQ ID NO: 320831 - RNA, 23 nt, Human
uaaggaccacgcaaaaggguuuc

SEQ ID NO: 320832 - RNA, 22 nt, Human
uaauuaacauuaacagaauuuc

SEQ ID NO: 320833 - RNA, 22 nt, Human
uacaugcauauuucaaagaccu

SEQ ID NO: 320834 - RNA, 22 nt, Human
uagaaaauauaaaguacaugca

SEQ ID NO: 320835 - RNA, 22 nt, Human
uagccagagguucaguguugug

SEQ ID NO: 320836 - RNA, 24 nt, Human
uauaaaguacaugcauauuucaaa

SEQ ID NO: 320837 - RNA, 23 nt, Human
uauaacaaaacaagaacaugcaa

SEQ ID NO: 320838 - RNA, 24 nt, Human
uaugucaaaaucauucugguuucc

SEQ ID NO: 320839 - RNA, 21 nt, Human
uauuuacucuuguugaacagc

SEQ ID NO: 320840 - RNA, 22 nt, Human
ucccaagagcuaagaaucucua

SEQ ID NO: 320841 - RNA, 24 nt, Human
uccuuuaaacaucuaaaaugggag

SEQ ID NO: 320842 - RNA, 24 nt, Human
ucuaaaaugggagguugccuccaa

SEQ ID NO: 320843 - RNA, 19 nt, Human
ucuagccagagguucagug

SEQ ID NO: 320844 - RNA, 23 nt, Human
ucucccuauucuuugauucaaaa

SEQ ID NO: 320845 - RNA, 21 nt, Human
ugaacagcugcuguguagccc

SEQ ID NO: 320846 - RNA, 22 nt, Human
ugaacagcugcuguguagccca

SEQ ID NO: 320847 - RNA, 21 nt, Human
ugaccuaauucugguuuuuga

SEQ ID NO: 320848 - RNA, 21 nt, Human
ugagauuuguuuuagccucaa

SEQ ID NO: 320849 - RNA, 23 nt, Human
ugagccugcaucccaagagcuaa

SEQ ID NO: 320850 - RNA, 21 nt, Human
ugcagaaaaguaauacauauc

SEQ ID NO: 320851 - RNA, 21 nt, Human
ugccaaggguauugauuagcc

SEQ ID NO: 320852 - RNA, 20 nt, Human
uggccuggcauuagcaacgg

SEQ ID NO: 320853 - RNA, 23 nt, Human
uguggccuccuaacaaaccuggc

SEQ ID NO: 320854 - RNA, 22 nt, Human
uucugguuuccagguaaaugga

SEQ ID NO: 320855 - RNA, 22 nt, Human
uucugguuuuugacaauuauga

SEQ ID NO: 320856 - RNA, 19 nt, Human
uuguaagccuaaggaccac

SEQ ID NO: 320857 - RNA, 19 nt, Human
uuguuuuagccucaaccug

SEQ ID NO: 320858 - RNA, 23 nt, Human
uuucaaagaccuguuaauggugu

SEQ ID NO: 320859 - RNA, 18 nt, Human
aaacagaguaucccccuc

SEQ ID NO: 320860 - RNA, 24 nt, Human
acagcccccccccccccccccccc

SEQ ID NO: 320861 - RNA, 24 nt, Human
acuggcaccuguaggggcgggucg

SEQ ID NO: 320862 - RNA, 20 nt, Human
agggggggggggcggggggg

SEQ ID NO: 320863 - RNA, 18 nt, Human
aucugcuccuccccaccc

SEQ ID NO: 320864 - RNA, 22 nt, Human
augucccuuuaaugucccaucc

SEQ ID NO: 320865 - RNA, 21 nt, Human
cauaaacagaguaucccccuc

SEQ ID NO: 320866 - RNA, 23 nt, Human
caugcaaaagcccagcccugcag

SEQ ID NO: 320867 - RNA, 20 nt, Human
ccaaaagagggauggaagga

SEQ ID NO: 320868 - RNA, 18 nt, Human
ccaugacagccccccccc

SEQ ID NO: 320869 - RNA, 24 nt, Human
cccauccauugccaugcaaaagcc

SEQ ID NO: 320870 - RNA, 20 nt, Human
ccccacagaguugcucuagg

SEQ ID NO: 320871 - RNA, 18 nt, Human
cccccccccccccccccc

SEQ ID NO: 320872 - RNA, 19 nt, Human
ccccccccccccccccccc

SEQ ID NO: 320873 - RNA, 19 nt, Human
ccccccccccccccccccc

SEQ ID NO: 320874 - RNA, 18 nt, Human
ccccucaacacacacagc

SEQ ID NO: 320875 - RNA, 22 nt, Human
cccucaacacacacagcuuuag

SEQ ID NO: 320876 - RNA, 24 nt, Human
ccugccgccaugacagcccccccc

SEQ ID NO: 320877 - RNA, 21 nt, Human
cguccugccgccaugacagcc

SEQ ID NO: 320878 - RNA, 20 nt, Human
cuccagaagagcccaaaaga

SEQ ID NO: 320879 - RNA, 19 nt, Human
cuccuccccaccccacaga

SEQ ID NO: 320880 - RNA, 23 nt, Human
cuuggaucugcuccuccccaccc

SEQ ID NO: 320881 - RNA, 19 nt, Human
gaucugcuccuccccaccc

SEQ ID NO: 320882 - RNA, 21 nt, Human
uaaacagaguaucccccucaa

SEQ ID NO: 320883 - RNA, 21 nt, Human
ucaguaaauguuacuucccuc

SEQ ID NO: 320884 - RNA, 18 nt, Human
ucccauccauugccaugc

SEQ ID NO: 320885 - RNA, 20 nt, Human
ugguuguguuuuuuauucuu

SEQ ID NO: 320886 - RNA, 21 nt, Human
uucccuccagaagagcccaaa

SEQ ID NO: 320887 - RNA, 25 nt, Human
uuguuacaugucccuuuaauguccc

SEQ ID NO: 320888 - RNA, 20 nt, Human
uuucgugguuguguuuuuua

SEQ ID NO: 320889 - RNA, 18 nt, Human
uuuuuuuuuuuuuuuucg

SEQ ID NO: 320890 - RNA, 21 nt, Human
uuuuuuuuuuuuuuuucgugg

SEQ ID NO: 320891 - RNA, 23 nt, Human
uuuuuuuuuuuuuuuucgugguu

SEQ ID NO: 320892 - RNA, 20 nt, Human
uuuuuuuuuuuuuuuuucgu

SEQ ID NO: 320893 - RNA, 20 nt, Human
aacgccucaggugauucugu

SEQ ID NO: 320894 - RNA, 22 nt, Human
accaaguacuuuguccaccucu

SEQ ID NO: 320895 - RNA, 26 nt, Human
acuuuguccaccucuccucuccaucu

SEQ ID NO: 320896 - RNA, 24 nt, Human
agccccuucugacggggcuggaga

SEQ ID NO: 320897 - RNA, 18 nt, Human
aggcuccggaccuggguu

SEQ ID NO: 320898 - RNA, 21 nt, Human
aggcuuccugccccaacucca

SEQ ID NO: 320899 - RNA, 25 nt, Human
caccucuccucuccaucuccccucc

SEQ ID NO: 320900 - RNA, 20 nt, Human
ccauaugacuuggauuuuac

SEQ ID NO: 320901 - RNA, 21 nt, Human
ccugaaguugaggcuccggac

SEQ ID NO: 320902 - RNA, 26 nt, Human
cuccucuccaucuccccucccucaaa

SEQ ID NO: 320903 - RNA, 21 nt, Human
cuuuguccaccucuccucucc

SEQ ID NO: 320904 - RNA, 18 nt, Human
gaugugggagaagaaagg

SEQ ID NO: 320905 - RNA, 20 nt, Human
ggccauaggcuuccugcccc

SEQ ID NO: 320906 - RNA, 20 nt, Human
gggcagaugugggagaagaa

SEQ ID NO: 320907 - RNA, 24 nt, Human
uaaauauaagaaauuuauuaauau

SEQ ID NO: 320908 - RNA, 20 nt, Human
uacuuuguccaccucuccuc

SEQ ID NO: 320909 - RNA, 21 nt, Human
uaggcuuccugccccaacucc

SEQ ID NO: 320910 - RNA, 23 nt, Human
uagguucuuagcaaaccaaguac

SEQ ID NO: 320911 - RNA, 19 nt, Human
ucacugccauaugacuugg

SEQ ID NO: 320912 - RNA, 23 nt, Human
ucagugggcagaugugggagaag

SEQ ID NO: 320913 - RNA, 18 nt, Human
ucccuugccagccuccau

SEQ ID NO: 320914 - RNA, 20 nt, Human
ucuccaucuccccucccuca

SEQ ID NO: 320915 - RNA, 20 nt, Human
ucugucuuuggaggaugggc

SEQ ID NO: 320916 - RNA, 21 nt, Human
ugccccaacuccauuaucugu

SEQ ID NO: 320917 - RNA, 19 nt, Human
uggcucgggccggcugcgg

SEQ ID NO: 320918 - RNA, 21 nt, Human
ugggcagaugugggagaagaa

SEQ ID NO: 320919 - RNA, 24 nt, Human
uuccacaaagauagauaaacauuc

SEQ ID NO: 320920 - RNA, 18 nt, Human
uuccuggcucgggccggc

SEQ ID NO: 320921 - RNA, 18 nt, Human
uuccuggcucgggccggc

SEQ ID NO: 320922 - RNA, 21 nt, Human
uuccuggcucgggccggcugc

SEQ ID NO: 320923 - RNA, 19 nt, Human
uucguguuacuucuuucua

SEQ ID NO: 320924 - RNA, 23 nt, Human
uuuuuuuauuuuuuuuuugccuu

SEQ ID NO: 320925 - RNA, 25 nt, Human
uuuuuuuuuuuuuuuuuuuauuuuu

SEQ ID NO: 320926 - RNA, 20 nt, Human
agccucugcuccugcucucc

SEQ ID NO: 320927 - RNA, 23 nt, Human
agugcccauacucugggcagggc

SEQ ID NO: 320928 - RNA, 19 nt, Human
aucagguucggcccacacc

SEQ ID NO: 320929 - RNA, 19 nt, Human
cacauucgaggagaguucc

SEQ ID NO: 320930 - RNA, 19 nt, Human
caccugagugcccauacuc

SEQ ID NO: 320931 - RNA, 21 nt, Human
cagcccggccacugcucccca

SEQ ID NO: 320932 - RNA, 22 nt, Human
cagcccggccacugcuccccaa

SEQ ID NO: 320933 - RNA, 24 nt, Human
cagguaucagguucggcccacacc

SEQ ID NO: 320934 - RNA, 19 nt, Human
caguggcugucccaggcag

SEQ ID NO: 320935 - RNA, 23 nt, Human
ccucaccuccagcagcucugcaa

SEQ ID NO: 320936 - RNA, 23 nt, Human
ccuccccagcccggccacugcuc

SEQ ID NO: 320937 - RNA, 18 nt, Human
ccugaccucaccuccagc

SEQ ID NO: 320938 - RNA, 18 nt, Human
cucgggcugugugggcug

SEQ ID NO: 320939 - RNA, 21 nt, Human
cugcuccccaaggggcucggg

SEQ ID NO: 320940 - RNA, 22 nt, Human
cuggcacuucagcugcauggug

SEQ ID NO: 320941 - RNA, 20 nt, Human
cugugugaggaugggguugg

SEQ ID NO: 320942 - RNA, 21 nt, Human
gaagguggacaauccucuagg

SEQ ID NO: 320943 - RNA, 24 nt, Human
gaagguggacaauccucuaggucc

SEQ ID NO: 320944 - RNA, 22 nt, Human
gacuucacaagcacccuggcac

SEQ ID NO: 320945 - RNA, 18 nt, Human
gaggugggggccuugggc

SEQ ID NO: 320946 - RNA, 23 nt, Human
gcugcagcuguggugauggccug

SEQ ID NO: 320947 - RNA, 20 nt, Human
gcugugugggcuggccuugg

SEQ ID NO: 320948 - RNA, 25 nt, Human
ggacaugggggucacagaggugggg

SEQ ID NO: 320949 - RNA, 20 nt, Human
ggucacagaggugggggccu

SEQ ID NO: 320950 - RNA, 20 nt, Human
gugauggccugggcgggggc

SEQ ID NO: 320951 - RNA, 18 nt, Human
gugugaggaugggguugg

SEQ ID NO: 320952 - RNA, 21 nt, Human
uagguccaaggacaugggggu

SEQ ID NO: 320953 - RNA, 20 nt, Human
uaucagguucggcccacacc

SEQ ID NO: 320954 - RNA, 20 nt, Human
uccagcagcucugcaagugu

SEQ ID NO: 320955 - RNA, 23 nt, Human
ugaagacagcaacagagugagac

SEQ ID NO: 320956 - RNA, 21 nt, Human
ugaccaggcaggccuccccag

SEQ ID NO: 320957 - RNA, 27 nt, Human
ugcagcuguggugauggccugggcggg

SEQ ID NO: 320958 - RNA, 22 nt, Human
ugcccauacucugggcagggcu

SEQ ID NO: 320959 - RNA, 23 nt, Human
uggcugcagcuguggugauggcc

SEQ ID NO: 320960 - RNA, 20 nt, Human
ugggaggcaccugaccucac

SEQ ID NO: 320961 - RNA, 22 nt, Human
uggggacccucugccggcaggg

SEQ ID NO: 320962 - RNA, 23 nt, Human
ugggggucacagaggugggggcc

SEQ ID NO: 320963 - RNA, 19 nt, Human
ugguuuauugaccaggcag

SEQ ID NO: 320964 - RNA, 18 nt, Human
ugugugaggaugggguug

SEQ ID NO: 320965 - RNA, 19 nt, Human
ugugugaggaugggguugg

SEQ ID NO: 320966 - RNA, 23 nt, Human
uuggcagaagguggacaauccuc

SEQ ID NO: 320967 - RNA, 20 nt, Human
uuuccaguggcugucccagg

SEQ ID NO: 320968 - RNA, 18 nt, Human
aacacugccugcuuagau

SEQ ID NO: 320969 - RNA, 22 nt, Human
aaggaguuguuuaaggaaacac

SEQ ID NO: 320970 - RNA, 19 nt, Human
aaggaugguggguauccug

SEQ ID NO: 320971 - RNA, 21 nt, Human
aauggaaaagcugugggaauu

SEQ ID NO: 320972 - RNA, 24 nt, Human
aauugccuucuaauaugucaauau

SEQ ID NO: 320973 - RNA, 20 nt, Human
acagaggacugcccuccuca

SEQ ID NO: 320974 - RNA, 21 nt, Human
acaggccacaagccacaggcu

SEQ ID NO: 320975 - RNA, 23 nt, Human
acucugagcaaugcacccaagag

SEQ ID NO: 320976 - RNA, 26 nt, Human
agaggggcagggcccaggaaagagag

SEQ ID NO: 320977 - RNA, 19 nt, Human
agagucuucagggggcuga

SEQ ID NO: 320978 - RNA, 19 nt, Human
agauuagauugaaccacca

SEQ ID NO: 320979 - RNA, 19 nt, Human
aggggcagggcccaggaaa

SEQ ID NO: 320980 - RNA, 19 nt, Human
agggggaauguccuuucug

SEQ ID NO: 320981 - RNA, 22 nt, Human
agggggaauguccuuucugcca

SEQ ID NO: 320982 - RNA, 20 nt, Human
aggucaccuggggaggggag

SEQ ID NO: 320983 - RNA, 21 nt, Human
aguuggugcuuuuauucuaaa

SEQ ID NO: 320984 - RNA, 23 nt, Human
augcacccaagagccugugccca

SEQ ID NO: 320985 - RNA, 22 nt, Human
cacagaccucacgugaagggcc

SEQ ID NO: 320986 - RNA, 23 nt, Human
cacugccugcuuagaugccucuc

SEQ ID NO: 320987 - RNA, 21 nt, Human
caggucaccuggggaggggag

SEQ ID NO: 320988 - RNA, 23 nt, Human
ccacagccucaagcugugacauc

SEQ ID NO: 320989 - RNA, 23 nt, Human
cccacaaauugguccucacagac

SEQ ID NO: 320990 - RNA, 27 nt, Human
ccugggacucugagcaaugcacccaag

SEQ ID NO: 320991 - RNA, 18 nt, Human
ccuuucagccccugcccu

SEQ ID NO: 320992 - RNA, 18 nt, Human
ccuuucugccauuuacca

SEQ ID NO: 320993 - RNA, 19 nt, Human
cucaagcugugacauccuc

SEQ ID NO: 320994 - RNA, 18 nt, Human
cugcccugcucccugucc

SEQ ID NO: 320995 - RNA, 19 nt, Human
cugcccugcucccuguccc

SEQ ID NO: 320996 - RNA, 21 nt, Human
cugcucccugucccuugcucc

SEQ ID NO: 320997 - RNA, 20 nt, Human
cugugugcauaugugcguag

SEQ ID NO: 320998 - RNA, 25 nt, Human
cuucagggggcugauuggccucccu

SEQ ID NO: 320999 - RNA, 18 nt, Human
gccaccuuucacaccaca

SEQ ID NO: 321000 - RNA, 19 nt, Human
gcccaggaaagagagcagg

SEQ ID NO: 321001 - RNA, 19 nt, Human
gcucccaccccaaucugga

SEQ ID NO: 321002 - RNA, 18 nt, Human
ggaaagagagcaggucac

SEQ ID NO: 321003 - RNA, 19 nt, Human
ggaagagccaaucuugagg

SEQ ID NO: 321004 - RNA, 18 nt, Human
ggaauugggggcuucagu

SEQ ID NO: 321005 - RNA, 23 nt, Human
ggcagaaauaaaaauccaggcug

SEQ ID NO: 321006 - RNA, 19 nt, Human
gggagaggggcagggccca

SEQ ID NO: 321007 - RNA, 19 nt, Human
gggagguaugucugccugu

SEQ ID NO: 321008 - RNA, 21 nt, Human
ggggaggggagggggaauguc

SEQ ID NO: 321009 - RNA, 20 nt, Human
uagaugccucucgcuucccc

SEQ ID NO: 321010 - RNA, 24 nt, Human
ucacaccacagccucaagcuguga

SEQ ID NO: 321011 - RNA, 20 nt, Human
ucagugccccuuucagcccc

SEQ ID NO: 321012 - RNA, 23 nt, Human
ucccugucccuugcucccacccc

SEQ ID NO: 321013 - RNA, 21 nt, Human
ucugagcaaugcacccaagag

SEQ ID NO: 321014 - RNA, 21 nt, Human
ucugccauuuaccaccucucu

SEQ ID NO: 321015 - RNA, 24 nt, Human
ugaacuacccacaaauugguccuc

SEQ ID NO: 321016 - RNA, 21 nt, Human
ugcccugcucccugucccuug

SEQ ID NO: 321017 - RNA, 24 nt, Human
ugcucccugucccuugcucccacc

SEQ ID NO: 321018 - RNA, 19 nt, Human
uggcagaaauaaaaaucca

SEQ ID NO: 321019 - RNA, 20 nt, Human
uggcagaaggucacagguca

SEQ ID NO: 321020 - RNA, 25 nt, Human
uggccaccuuucacaccacagccuc

SEQ ID NO: 321021 - RNA, 18 nt, Human
ugggaccagagucuucag

SEQ ID NO: 321022 - RNA, 19 nt, Human
ugggcucccuacaccugcc

SEQ ID NO: 321023 - RNA, 19 nt, Human
uggggagaggggcagggcc

SEQ ID NO: 321024 - RNA, 20 nt, Human
uggggagaggggcagggccc

SEQ ID NO: 321025 - RNA, 18 nt, Human
uggggaggggagggggaa

SEQ ID NO: 321026 - RNA, 18 nt, Human
uggguauccugagaccag

SEQ ID NO: 321027 - RNA, 22 nt, Human
uguagggacugggagagucaug

SEQ ID NO: 321028 - RNA, 24 nt, Human
ugucugccugugugcauaugugcg

SEQ ID NO: 321029 - RNA, 22 nt, Human
ugugacauccucaggccagccu

SEQ ID NO: 321030 - RNA, 18 nt, Human
uguggggagaggggcagg

SEQ ID NO: 321031 - RNA, 23 nt, Human
uguggggagaggggcagggccca

SEQ ID NO: 321032 - RNA, 21 nt, Human
uuaauggaaaagcugugggaa

SEQ ID NO: 321033 - RNA, 23 nt, Human
uuaauggaaaagcugugggaauu

SEQ ID NO: 321034 - RNA, 22 nt, Human
uucuaaagccagcagguuggug

SEQ ID NO: 321035 - RNA, 26 nt, Human
uuuauucuaaagccagcagguuggug

SEQ ID NO: 321036 - RNA, 20 nt, Human
uuugcauuuuaauggaaaag

SEQ ID NO: 321037 - RNA, 21 nt, Human
cuuauuuauuuucugccacug

SEQ ID NO: 321038 - RNA, 21 nt, Human
ucugaaggaaguuaucuucuu

SEQ ID NO: 321039 - RNA, 21 nt, Human
uuuucugccacugaauucuag

SEQ ID NO: 321040 - RNA, 22 nt, Human
aaaacaaaaauagacaggaagg

SEQ ID NO: 321041 - RNA, 19 nt, Human
aaagcacuacccagagacc

SEQ ID NO: 321042 - RNA, 24 nt, Human
aacacuugauacuagucugaugau

SEQ ID NO: 321043 - RNA, 19 nt, Human
aaucuagccaucacauuug

SEQ ID NO: 321044 - RNA, 27 nt, Human
accaaaaaucugugauccuuuccacuu

SEQ ID NO: 321045 - RNA, 22 nt, Human
accaguucuucauugcugauca

SEQ ID NO: 321046 - RNA, 22 nt, Human
agaaacuaccaaaaaucuguga

SEQ ID NO: 321047 - RNA, 23 nt, Human
aggaagggagggagucauccuug

SEQ ID NO: 321048 - RNA, 22 nt, Human
aguaaaaaacaaaaauagacag

SEQ ID NO: 321049 - RNA, 25 nt, Human
auggaccauggacuauaacgugauu

SEQ ID NO: 321050 - RNA, 22 nt, Human
auuuguuuaaaaaacucugugg

SEQ ID NO: 321051 - RNA, 25 nt, Human
cacuacccagagaccaauggugccg

SEQ ID NO: 321052 - RNA, 23 nt, Human
cagcaccaagaagucaaugguga

SEQ ID NO: 321053 - RNA, 22 nt, Human
cauccaaugggaacaaacaccc

SEQ ID NO: 321054 - RNA, 19 nt, Human
cccagaaacuaccaaaaau

SEQ ID NO: 321055 - RNA, 21 nt, Human
cgaacagcauuucucucucaa

SEQ ID NO: 321056 - RNA, 26 nt, Human
cucaagaucucucucucucuuuugaa

SEQ ID NO: 321057 - RNA, 22 nt, Human
cuggcguugcuccuggauuugg

SEQ ID NO: 321058 - RNA, 20 nt, Human
cuuguagacccagaaacuac

SEQ ID NO: 321059 - RNA, 24 nt, Human
cuuugauaaaguauaauagaugaa

SEQ ID NO: 321060 - RNA, 18 nt, Human
gaaaaucucugcgugaag

SEQ ID NO: 321061 - RNA, 23 nt, Human
gaacacuugauacuagucugaug

SEQ ID NO: 321062 - RNA, 20 nt, Human
gaagcaaaugaauauuuacc

SEQ ID NO: 321063 - RNA, 20 nt, Human
ggauuuggaaaguccuugua

SEQ ID NO: 321064 - RNA, 20 nt, Human
guagacccagaaacuaccaa

SEQ ID NO: 321065 - RNA, 24 nt, Human
uaaagcacuacccagagaccaaug

SEQ ID NO: 321066 - RNA, 25 nt, Human
uacgcagguuucucuaugauggcuu

SEQ ID NO: 321067 - RNA, 23 nt, Human
uagggaccaaacucaaagguuuc

SEQ ID NO: 321068 - RNA, 18 nt, Human
ucagaacugcaaucugca

SEQ ID NO: 321069 - RNA, 18 nt, Human
uccaugcuggacaccaga

SEQ ID NO: 321070 - RNA, 21 nt, Human
uccuaaugcaacagaaaacuc

SEQ ID NO: 321071 - RNA, 24 nt, Human
uccuuuuuauucaaaugaaucaga

SEQ ID NO: 321072 - RNA, 21 nt, Human
ucucaagaucucucucucucu

SEQ ID NO: 321073 - RNA, 20 nt, Human
ucucuaugauggcuuuugca

SEQ ID NO: 321074 - RNA, 23 nt, Human
ugaaacuccugaagcaaaugaau

SEQ ID NO: 321075 - RNA, 18 nt, Human
ugaauagugauggaccau

SEQ ID NO: 321076 - RNA, 23 nt, Human
ugaauagugauggaccauggacu

SEQ ID NO: 321077 - RNA, 20 nt, Human
ugauccuuuccacuuugagu

SEQ ID NO: 321078 - RNA, 21 nt, Human
ugauggcuuuugcaugccauu

SEQ ID NO: 321079 - RNA, 18 nt, Human
ugcaugccauuuccaagu

SEQ ID NO: 321080 - RNA, 21 nt, Human
ugccacuggcguugcuccugg

SEQ ID NO: 321081 - RNA, 19 nt, Human
ugccuuggugcccgccuga

SEQ ID NO: 321082 - RNA, 24 nt, Human
uggauuauuuucaacagcaccaag

SEQ ID NO: 321083 - RNA, 22 nt, Human
uggcaauauguuagaaucuagc

SEQ ID NO: 321084 - RNA, 23 nt, Human
ugguaacaaaagguauauacacc

SEQ ID NO: 321085 - RNA, 18 nt, Human
ugugguaacaaaagguau

SEQ ID NO: 321086 - RNA, 18 nt, Human
uguuaaacuguacaccgu

SEQ ID NO: 321087 - RNA, 18 nt, Human
uuaaaaaacucuguggua

SEQ ID NO: 321088 - RNA, 18 nt, Human
uuaaagcacuacccagag

SEQ ID NO: 321089 - RNA, 23 nt, Human
uuagggaccaaacucaaagguuu

SEQ ID NO: 321090 - RNA, 21 nt, Human
aaacaaccucacaacucuucu

SEQ ID NO: 321091 - RNA, 18 nt, Human
aaagagcauucauccaca

SEQ ID NO: 321092 - RNA, 18 nt, Human
aaccugguuuacaagugc

SEQ ID NO: 321093 - RNA, 22 nt, Human
aaucauauguccggaaaucaaa

SEQ ID NO: 321094 - RNA, 18 nt, Human
aauccuuucuucccauca

SEQ ID NO: 321095 - RNA, 21 nt, Human
aauugagcaauuccagaacca

SEQ ID NO: 321096 - RNA, 21 nt, Human
aauuuccuuuauuccagaagc

SEQ ID NO: 321097 - RNA, 21 nt, Human
acaagugcaaguaaaagaagc

SEQ ID NO: 321098 - RNA, 21 nt, Human
acuaggaggagacacgccagc

SEQ ID NO: 321099 - RNA, 24 nt, Human
acugcaaccuccauuuagggcccc

SEQ ID NO: 321100 - RNA, 26 nt, Human
acugcaaccuccauuuaggguccucc

SEQ ID NO: 321101 - RNA, 18 nt, Human
agacaccauauuccauag

SEQ ID NO: 321102 - RNA, 21 nt, Human
agacgggaagcacuaggagga

SEQ ID NO: 321103 - RNA, 19 nt, Human
agccuucggggcauucaca

SEQ ID NO: 321104 - RNA, 19 nt, Human
auagcaaguguaaccucca

SEQ ID NO: 321105 - RNA, 24 nt, Human
auuccagcuucguauacauccauc

SEQ ID NO: 321106 - RNA, 22 nt, Human
caauagcaaguguaaccuccag

SEQ ID NO: 321107 - RNA, 21 nt, Human
cacacugaaacaaccucacaa

SEQ ID NO: 321108 - RNA, 21 nt, Human
cagaaccaggauaguaggagc

SEQ ID NO: 321109 - RNA, 24 nt, Human
cagcgacccagcgagccucggcgg

SEQ ID NO: 321110 - RNA, 24 nt, Human
caucacaauagcaaguguaaccuc

SEQ ID NO: 321111 - RNA, 20 nt, Human
caucuagacgaggguuaauc

SEQ ID NO: 321112 - RNA, 24 nt, Human
cauucaaaaucuccugggauguuc

SEQ ID NO: 321113 - RNA, 20 nt, Human
ccacaucuuuacaaucuuuc

SEQ ID NO: 321114 - RNA, 18 nt, Human
ccacccaggacccucauu

SEQ ID NO: 321115 - RNA, 22 nt, Human
ccaucacagcuucuuuagcuau

SEQ ID NO: 321116 - RNA, 21 nt, Human
cccgcagcgcccacccaggac

SEQ ID NO: 321117 - RNA, 22 nt, Human
cccgcucccagcgcccagcccg

SEQ ID NO: 321118 - RNA, 20 nt, Human
ccgcucccagcgcccagccc

SEQ ID NO: 321119 - RNA, 21 nt, Human
cgacccagcgagccucggcgg

SEQ ID NO: 321120 - RNA, 22 nt, Human
cgccagcgacccagcgagccuc

SEQ ID NO: 321121 - RNA, 21 nt, Human
cgccgcggagcugcgagccug

SEQ ID NO: 321122 - RNA, 23 nt, Human
cgccgcggagcugcgagccugug

SEQ ID NO: 321123 - RNA, 18 nt, Human
cggcgccagcgacccagc

SEQ ID NO: 321124 - RNA, 23 nt, Human
cggcggaacagccgggggcggag

SEQ ID NO: 321125 - RNA, 21 nt, Human
cggcuuaaaaagggguccagg

SEQ ID NO: 321126 - RNA, 24 nt, Human
cggggcauucacauucaaaaucuc

SEQ ID NO: 321127 - RNA, 22 nt, Human
cugaaaaucugcugauuucugg

SEQ ID NO: 321128 - RNA, 23 nt, Human
cuuggcuucaaagagcauucauc

SEQ ID NO: 321129 - RNA, 22 nt, Human
gaaaaucugcugauuucuggca

SEQ ID NO: 321130 - RNA, 23 nt, Human
gaagcuuuucggagcugggggau

SEQ ID NO: 321131 - RNA, 18 nt, Human
gaagugcaaucaggagcc

SEQ ID NO: 321132 - RNA, 25 nt, Human
gaccggagcgcuaggcgccgcggag

SEQ ID NO: 321133 - RNA, 18 nt, Human
gagcaauuccagaaccag

SEQ ID NO: 321134 - RNA, 21 nt, Human
gagcacacauguucucagagc

SEQ ID NO: 321135 - RNA, 20 nt, Human
gagcugcgagccugugcgcc

SEQ ID NO: 321136 - RNA, 20 nt, Human
gaggcgccggcagggacggu

SEQ ID NO: 321137 - RNA, 23 nt, Human
gauaacaaggacauuuccaggaa

SEQ ID NO: 321138 - RNA, 21 nt, Human
gcggaacagccgggggcggag

SEQ ID NO: 321139 - RNA, 21 nt, Human
ggaacagccgggggcggagga

SEQ ID NO: 321140 - RNA, 22 nt, Human
ggccuaguaaacacugcugaga

SEQ ID NO: 321141 - RNA, 21 nt, Human
ggcgcgucgcggcggggaccg

SEQ ID NO: 321142 - RNA, 21 nt, Human
gguuuccagcaauccauuuuc

SEQ ID NO: 321143 - RNA, 23 nt, Human
guuuccagcaauccauuuuccgg

SEQ ID NO: 321144 - RNA, 22 nt, Human
uaaaaagggguccagguuuauu

SEQ ID NO: 321145 - RNA, 25 nt, Human
uaaaacaaccccugcaaaaggucac

SEQ ID NO: 321146 - RNA, 18 nt, Human
uaaaguaauucauacuuu

SEQ ID NO: 321147 - RNA, 23 nt, Human
uaggaggagacacgccagcagcg

SEQ ID NO: 321148 - RNA, 21 nt, Human
uaguaggagcccuucuccaca

SEQ ID NO: 321149 - RNA, 23 nt, Human
uauaaacaaaaguuugccucuga

SEQ ID NO: 321150 - RNA, 24 nt, Human
uauaaacaaaaguuugccucugag

SEQ ID NO: 321151 - RNA, 20 nt, Human
ucacacuuuucuccuugcca

SEQ ID NO: 321152 - RNA, 19 nt, Human
uccacagacaccauauucc

SEQ ID NO: 321153 - RNA, 21 nt, Human
uccacagacaccauauuccau

SEQ ID NO: 321154 - RNA, 23 nt, Human
uccacaguaaccaggcaaugcuu

SEQ ID NO: 321155 - RNA, 22 nt, Human
uccauuuauauuugagggaucu

SEQ ID NO: 321156 - RNA, 22 nt, Human
ugaaacaaccucacaacucuuc

SEQ ID NO: 321157 - RNA, 22 nt, Human
ugaaucauauguccggaaauca

SEQ ID NO: 321158 - RNA, 28 nt, Human
ugacugcaaccuccauuuaggguccucc

SEQ ID NO: 321159 - RNA, 20 nt, Human
ugauaacaaggacauuucca

SEQ ID NO: 321160 - RNA, 18 nt, Human
ugcacacagcugugccac

SEQ ID NO: 321161 - RNA, 20 nt, Human
ugcugaaaaucugcugauuu

SEQ ID NO: 321162 - RNA, 21 nt, Human
uggaauggcauugacacagcu

SEQ ID NO: 321163 - RNA, 24 nt, Human
uguaaccuccaggguaauugacac

SEQ ID NO: 321164 - RNA, 23 nt, Human
uguuggaggccuaguaaacacug

SEQ ID NO: 321165 - RNA, 21 nt, Human
uuucuugaauaauuuccuuua

SEQ ID NO: 321166 - RNA, 21 nt, Human
uuuucuccuugccaaccuggu

SEQ ID NO: 321167 - RNA, 21 nt, Human
aaaccaaacaaaauacuuaaa

SEQ ID NO: 321168 - RNA, 29 nt, Human
aaacuaaaggcagaaagaaaagggacccc

SEQ ID NO: 321169 - RNA, 24 nt, Human
aagaaaaugagagaaaccgguacc

SEQ ID NO: 321170 - RNA, 27 nt, Human
aagcaaacuaaaggcagaaagaaaaca

SEQ ID NO: 321171 - RNA, 23 nt, Human
aagcucgucagcugggcacagcu

SEQ ID NO: 321172 - RNA, 26 nt, Human
aaugagagaaacgugaugaggaggaa

SEQ ID NO: 321173 - RNA, 22 nt, Human
acauauccaugccucccauaca

SEQ ID NO: 321174 - RNA, 21 nt, Human
agaaagaaaacaaccaucccc

SEQ ID NO: 321175 - RNA, 20 nt, Human
aggcagaaagaaaacaacca

SEQ ID NO: 321176 - RNA, 19 nt, Human
caaaagcaaacuaaaggca

SEQ ID NO: 321177 - RNA, 27 nt, Human
caaaagcaaacuaaaggcagaaagaaa

SEQ ID NO: 321178 - RNA, 27 nt, Human
caaauucccuucauugcuaauagagac

SEQ ID NO: 321179 - RNA, 20 nt, Human
caguagaaacaagagacaca

SEQ ID NO: 321180 - RNA, 30 nt, Human
cauauccaugccucccauacacauauauag

SEQ ID NO: 321181 - RNA, 24 nt, Human
ccagcugauuucauaacauaucca

SEQ ID NO: 321182 - RNA, 18 nt, Human
cucccgcuuagaaacugu

SEQ ID NO: 321183 - RNA, 20 nt, Human
cuggaaaaggggccucgugc

SEQ ID NO: 321184 - RNA, 18 nt, Human
gaaaacaaaagaaaauga

SEQ ID NO: 321185 - RNA, 21 nt, Human
gcacagcucaagaaucccggg

SEQ ID NO: 321186 - RNA, 19 nt, Human
ggaaaacaaaagaaaauga

SEQ ID NO: 321187 - RNA, 21 nt, Human
ggcaaaagcaaacuaaaggca

SEQ ID NO: 321188 - RNA, 22 nt, Human
uacugauugaguucaaaccaaa

SEQ ID NO: 321189 - RNA, 20 nt, Human
uagacacauauaacuuggaa

SEQ ID NO: 321190 - RNA, 22 nt, Human
ucaaaaucuagacacauauaac

SEQ ID NO: 321191 - RNA, 21 nt, Human
ucaaguggaugcaucguuaaa

SEQ ID NO: 321192 - RNA, 21 nt, Human
ucauaacauauccaugccucc

SEQ ID NO: 321193 - RNA, 21 nt, Human
uccaugccucccauacacaua

SEQ ID NO: 321194 - RNA, 19 nt, Human
ucccgggaccucuuaggaa

SEQ ID NO: 321195 - RNA, 22 nt, Human
uccucagccaaccgccauuugc

SEQ ID NO: 321196 - RNA, 23 nt, Human
ugcaauggaaaacaaaagaaaau

SEQ ID NO: 321197 - RNA, 21 nt, Human
ugggaggagcggagcgcugag

SEQ ID NO: 321198 - RNA, 21 nt, Human
ugggcaaaagcaaacuaaagg

SEQ ID NO: 321199 - RNA, 21 nt, Human
uucuuagcaguagaaacaaga

SEQ ID NO: 321200 - RNA, 25 nt, Human
uuuuuuuuuuuuuuuuuuaauuugg

SEQ ID NO: 321201 - RNA, 20 nt, Human
aacccccuucuguugucuau

SEQ ID NO: 321202 - RNA, 19 nt, Human
aagcaagaaagaaaaauca

SEQ ID NO: 321203 - RNA, 20 nt, Human
aagcaagaaagaaaaaucag

SEQ ID NO: 321204 - RNA, 24 nt, Human
aagcuccaguuucccgcuccagcu

SEQ ID NO: 321205 - RNA, 21 nt, Human
caacaaaguucuuaaaaccaa

SEQ ID NO: 321206 - RNA, 20 nt, Human
caacugaaaaaaaggucauu

SEQ ID NO: 321207 - RNA, 23 nt, Human
cagaaguccacagccugcuuccc

SEQ ID NO: 321208 - RNA, 20 nt, Human
cagcuccucgaacccagccu

SEQ ID NO: 321209 - RNA, 23 nt, Human
cgaacccagccucacugggccgg

SEQ ID NO: 321210 - RNA, 27 nt, Human
cgcuccagcuccucgaacccagccuca

SEQ ID NO: 321211 - RNA, 26 nt, Human
cuggaaacuccaguuuucuucuuucc

SEQ ID NO: 321212 - RNA, 20 nt, Human
cuucuuuccucauuccuguu

SEQ ID NO: 321213 - RNA, 26 nt, Human
gaaagcaagaaagaaaaaucagcuug

SEQ ID NO: 321214 - RNA, 22 nt, Human
ggacuaauuaaaaugaaagcaa

SEQ ID NO: 321215 - RNA, 21 nt, Human
guagaacucagagacuggaaa

SEQ ID NO: 321216 - RNA, 21 nt, Human
guuuucuucuuuccucauucc

SEQ ID NO: 321217 - RNA, 20 nt, Human
uaugaaaugaaggccaacaa

SEQ ID NO: 321218 - RNA, 18 nt, Human
ucaagaguuacaucaggu

SEQ ID NO: 321219 - RNA, 23 nt, Human
uccacagccugcuucccuaaguu

SEQ ID NO: 321220 - RNA, 21 nt, Human
uccuguugguaauuccagaag

SEQ ID NO: 321221 - RNA, 27 nt, Human
ugaaauaauuaaguccauccucaaaug

SEQ ID NO: 321222 - RNA, 25 nt, Human
uuccucauuccuguugguaauucca

SEQ ID NO: 321223 - RNA, 20 nt, Human
uuucuuauuguuauuaacac

SEQ ID NO: 321224 - RNA, 19 nt, Human
aaaaaagacaaggcaugau

SEQ ID NO: 321225 - RNA, 22 nt, Human
aaaaagacaaggcaugaugaag

SEQ ID NO: 321226 - RNA, 27 nt, Human
aaaucuccuuucucaguuaaaaaagac

SEQ ID NO: 321227 - RNA, 22 nt, Human
caaaaaaucuccuuucucaguu

SEQ ID NO: 321228 - RNA, 21 nt, Human
cagcaauggggccaguggcag

SEQ ID NO: 321229 - RNA, 23 nt, Human
caggccggacucuuccaaggccu

SEQ ID NO: 321230 - RNA, 24 nt, Human
ccaguggcagggcagguucucccu

SEQ ID NO: 321231 - RNA, 20 nt, Human
ccgauccuagcccuucagaa

SEQ ID NO: 321232 - RNA, 21 nt, Human
ccuucagaaggacuggaccuc

SEQ ID NO: 321233 - RNA, 19 nt, Human
cgauccuagcccuucagaa

SEQ ID NO: 321234 - RNA, 20 nt, Human
cucuuccaaggccuccuccc

SEQ ID NO: 321235 - RNA, 22 nt, Human
cuucagugggaagccaccuugg

SEQ ID NO: 321236 - RNA, 22 nt, Human
gcccauacugggcggugaucuc

SEQ ID NO: 321237 - RNA, 23 nt, Human
ucagugggaagccaccuuggaca

SEQ ID NO: 321238 - RNA, 18 nt, Human
ucaguuaaaaaagacaag

SEQ ID NO: 321239 - RNA, 21 nt, Human
ucaguuaaaaaagacaaggca

SEQ ID NO: 321240 - RNA, 21 nt, Human
uggaccucugugucccuucag

SEQ ID NO: 321241 - RNA, 21 nt, Human
uggggccaguggcagggcagg

SEQ ID NO: 321242 - RNA, 18 nt, Human
ugucccuucagugggaag

SEQ ID NO: 321243 - RNA, 24 nt, Human
uucaaaaaaucuccuuucucaguu

SEQ ID NO: 321244 - RNA, 25 nt, Human
uuuuuuuuuuuuuuucuugacaaug

SEQ ID NO: 321245 - RNA, 26 nt, Human
uuuuuuuuuuuuuuuuuuucuugggg

SEQ ID NO: 321246 - RNA, 20 nt, Human
caggaaagggaugccuggua

SEQ ID NO: 321247 - RNA, 21 nt, Human
caggaaagggaugccugguac

SEQ ID NO: 321248 - RNA, 20 nt, Human
caggaguggucuuaggguuu

SEQ ID NO: 321249 - RNA, 18 nt, Human
ccagcgacugcuggccgg

SEQ ID NO: 321250 - RNA, 24 nt, Human
cucagacccuggcucacccacuuc

SEQ ID NO: 321251 - RNA, 25 nt, Human
cucuugacagcauuuuauuugguuc

SEQ ID NO: 321252 - RNA, 19 nt, Human
gcuggccggguagggcuug

SEQ ID NO: 321253 - RNA, 22 nt, Human
ggaguggucuuaggguuugggc

SEQ ID NO: 321254 - RNA, 18 nt, Human
gggcagggagaggccagc

SEQ ID NO: 321255 - RNA, 24 nt, Human
guagauuuguccugaggggggauc

SEQ ID NO: 321256 - RNA, 21 nt, Human
uaagccaggaaagggaugccu

SEQ ID NO: 321257 - RNA, 18 nt, Human
ugacagcauuuuauuugg

SEQ ID NO: 321258 - RNA, 18 nt, Human
ugaggggggaucauuggc

SEQ ID NO: 321259 - RNA, 21 nt, Human
ugucagggcagggagaggcca

SEQ ID NO: 321260 - RNA, 23 nt, Human
ugugaaacucagacccuggcuca

SEQ ID NO: 321261 - RNA, 19 nt, Human
aaacaagggugggguggau

SEQ ID NO: 321262 - RNA, 21 nt, Human
aaacacccucacacaacaucc

SEQ ID NO: 321263 - RNA, 23 nt, Human
aaacacccucacacaacauccuc

SEQ ID NO: 321264 - RNA, 20 nt, Human
aaaggagaauccaagcuaca

SEQ ID NO: 321265 - RNA, 21 nt, Human
aaccaccccccaccccccacc

SEQ ID NO: 321266 - RNA, 22 nt, Human
aagauagaugaagguaaagcca

SEQ ID NO: 321267 - RNA, 22 nt, Human
aagcagauggugauggaucagg

SEQ ID NO: 321268 - RNA, 19 nt, Human
aagccucagaaguuacucu

SEQ ID NO: 321269 - RNA, 22 nt, Human
aagcgaucacggcugcugcaga

SEQ ID NO: 321270 - RNA, 22 nt, Human
aaggaucaagauagaugaaggu

SEQ ID NO: 321271 - RNA, 19 nt, Human
acaaagaaaacccugaagc

SEQ ID NO: 321272 - RNA, 23 nt, Human
agauagaugaagguaaagccaaa

SEQ ID NO: 321273 - RNA, 23 nt, Human
agguacaaaggagaauccaagcu

SEQ ID NO: 321274 - RNA, 18 nt, Human
agguuugggguugcccag

SEQ ID NO: 321275 - RNA, 22 nt, Human
aucucaauccgucuuuccccag

SEQ ID NO: 321276 - RNA, 21 nt, Human
caaccaccccccaccccccac

SEQ ID NO: 321277 - RNA, 23 nt, Human
caaccaccccccaccccccaccc

SEQ ID NO: 321278 - RNA, 19 nt, Human
caaggggaaacaagggugg

SEQ ID NO: 321279 - RNA, 21 nt, Human
cacacagguacacacacuuua

SEQ ID NO: 321280 - RNA, 19 nt, Human
caccccccaccccccaccc

SEQ ID NO: 321281 - RNA, 18 nt, Human
cacuuuauuaguuuccuc

SEQ ID NO: 321282 - RNA, 21 nt, Human
cagaaugagauaaugcaggua

SEQ ID NO: 321283 - RNA, 22 nt, Human
cagcugagcuauaguuaaagcu

SEQ ID NO: 321284 - RNA, 23 nt, Human
caguaggcuaaggaagaucaagc

SEQ ID NO: 321285 - RNA, 23 nt, Human
ccaccccccacccaaugucugcu

SEQ ID NO: 321286 - RNA, 18 nt, Human
ccaccccccaccccccac

SEQ ID NO: 321287 - RNA, 19 nt, Human
cccaagaggauauuuggcc

SEQ ID NO: 321288 - RNA, 24 nt, Human
cccaccccccacccaaugucugcc

SEQ ID NO: 321289 - RNA, 23 nt, Human
ccccaccccccacccaaugucug

SEQ ID NO: 321290 - RNA, 21 nt, Human
cccccacccaaugucugcuca

SEQ ID NO: 321291 - RNA, 19 nt, Human
ccccccaccccccacccaa

SEQ ID NO: 321292 - RNA, 23 nt, Human
ccccccucaaccaccccccaccc

SEQ ID NO: 321293 - RNA, 27 nt, Human
cccucaaccaccccccaccccccaccc

SEQ ID NO: 321294 - RNA, 23 nt, Human
ccucaaccaccccccacccccca

SEQ ID NO: 321295 - RNA, 22 nt, Human
cuaaaaccuacugccucagugg

SEQ ID NO: 321296 - RNA, 21 nt, Human
cuauaguuaaagcugcaaggc

SEQ ID NO: 321297 - RNA, 21 nt, Human
cucaaccaccccccacccccc

SEQ ID NO: 321298 - RNA, 25 nt, Human
cuuccccagucacagucaaacaccc

SEQ ID NO: 321299 - RNA, 21 nt, Human
gaagcauguuugcuuuccaga

SEQ ID NO: 321300 - RNA, 22 nt, Human
gagaacuggucacacauggguu

SEQ ID NO: 321301 - RNA, 23 nt, Human
gauuuuauucucaaaaagccuca

SEQ ID NO: 321302 - RNA, 21 nt, Human
gcuacagcacaucaucuaaua

SEQ ID NO: 321303 - RNA, 20 nt, Human
ggacuagguuugggguugcc

SEQ ID NO: 321304 - RNA, 22 nt, Human
gguuugggguugcccagggcuc

SEQ ID NO: 321305 - RNA, 23 nt, Human
gucaaacacccucacacaacauc

SEQ ID NO: 321306 - RNA, 23 nt, Human
guucucaacaaagaaaacccuga

SEQ ID NO: 321307 - RNA, 18 nt, Human
uacaaaggagaauccaag

SEQ ID NO: 321308 - RNA, 20 nt, Human
uacaauguucauuugggccc

SEQ ID NO: 321309 - RNA, 19 nt, Human
uaccaaggggaaacaaggg

SEQ ID NO: 321310 - RNA, 19 nt, Human
uaccaaggggaaacaaggg

SEQ ID NO: 321311 - RNA, 24 nt, Human
uacccuaagcacuccacuaagcga

SEQ ID NO: 321312 - RNA, 21 nt, Human
uaccugaugugggauguagaa

SEQ ID NO: 321313 - RNA, 20 nt, Human
uagcaggaagcauguuugcu

SEQ ID NO: 321314 - RNA, 25 nt, Human
ucaaacacccucacacaacauccuc

SEQ ID NO: 321315 - RNA, 19 nt, Human
ucaaccaccccccaccccc

SEQ ID NO: 321316 - RNA, 23 nt, Human
ucaaccaccccccaccccccacc

SEQ ID NO: 321317 - RNA, 26 nt, Human
ucacacaacauccucaaaagucugaa

SEQ ID NO: 321318 - RNA, 24 nt, Human
ugagauaaugcagguaggaggucc

SEQ ID NO: 321319 - RNA, 24 nt, Human
ugcacugugcugccuccccccuca

SEQ ID NO: 321320 - RNA, 22 nt, Human
ugcagguaggaggucccagcag

SEQ ID NO: 321321 - RNA, 19 nt, Human
ugccucaguggcaguaggc

SEQ ID NO: 321322 - RNA, 24 nt, Human
ugccuccccccucaaccacccccc

SEQ ID NO: 321323 - RNA, 26 nt, Human
ugccuuuguugcuaguuguucucaac

SEQ ID NO: 321324 - RNA, 24 nt, Human
ugcugcagagaccggaaccgaagu

SEQ ID NO: 321325 - RNA, 20 nt, Human
uggccaacuacccuaagcac

SEQ ID NO: 321326 - RNA, 22 nt, Human
uuauucucaaaaagccucagaa

SEQ ID NO: 321327 - RNA, 20 nt, Human
uugggcccaagaggauauuu

SEQ ID NO: 321328 - RNA, 26 nt, Human
uuuuuuuuuuuuuuuuuucacacagg

SEQ ID NO: 321329 - RNA, 24 nt, Human
aaaaaaaaaaaggaaaauucaaaa

SEQ ID NO: 321330 - RNA, 20 nt, Human
aaaaaaaggaaaauucaaaa

SEQ ID NO: 321331 - RNA, 24 nt, Human
aaaaaaaggaaaauucaaaaucca

SEQ ID NO: 321332 - RNA, 21 nt, Human
aaaaauccagaaaacaaaaac

SEQ ID NO: 321333 - RNA, 26 nt, Human
aaaacaaaaacaagucagaagucaga

SEQ ID NO: 321334 - RNA, 22 nt, Human
aaacuagcucuauacauucuua

SEQ ID NO: 321335 - RNA, 21 nt, Human
aaacuggaaagaaaugaucuu

SEQ ID NO: 321336 - RNA, 22 nt, Human
aaagaccaaauaaccaccacca

SEQ ID NO: 321337 - RNA, 23 nt, Human
aaauaaccaccaccauuucccca

SEQ ID NO: 321338 - RNA, 18 nt, Human
aaaugugucaguguccau

SEQ ID NO: 321339 - RNA, 18 nt, Human
aaccaccaccauuucccc

SEQ ID NO: 321340 - RNA, 20 nt, Human
aaccaccaccauuuccccaa

SEQ ID NO: 321341 - RNA, 21 nt, Human
aagaacaaaggaagagaucac

SEQ ID NO: 321342 - RNA, 20 nt, Human
aaggucugaauuuccauugu

SEQ ID NO: 321343 - RNA, 19 nt, Human
aauacaaagguggggcuaa

SEQ ID NO: 321344 - RNA, 22 nt, Human
acaguaaccaagaugguuuauc

SEQ ID NO: 321345 - RNA, 23 nt, Human
accaaauaaccaccaccauuucc

SEQ ID NO: 321346 - RNA, 18 nt, Human
acgccaggagcagcaaga

SEQ ID NO: 321347 - RNA, 30 nt, Human
acuccgaggggcgcgcggcggcggaggagg

SEQ ID NO: 321348 - RNA, 22 nt, Human
agaaaacaaaaacaagucagaa

SEQ ID NO: 321349 - RNA, 23 nt, Human
aggagguggcggaggcaacagcg

SEQ ID NO: 321350 - RNA, 18 nt, Human
aggggcgcgcggcggcgg

SEQ ID NO: 321351 - RNA, 23 nt, Human
agucagaagucagaguaggcuug

SEQ ID NO: 321352 - RNA, 23 nt, Human
augacaaugcagguuccuauauc

SEQ ID NO: 321353 - RNA, 23 nt, Human
augcagguuccuauauccuuuuu

SEQ ID NO: 321354 - RNA, 23 nt, Human
caaauaaccaccaccauuucccc

SEQ ID NO: 321355 - RNA, 21 nt, Human
caaauuaagcacaguaaccaa

SEQ ID NO: 321356 - RNA, 22 nt, Human
caccaccauuuccccaaaaacu

SEQ ID NO: 321357 - RNA, 25 nt, Human
caccaccauuuccccaaaaacugga

SEQ ID NO: 321358 - RNA, 21 nt, Human
caggagcagcaagaaauguac

SEQ ID NO: 321359 - RNA, 21 nt, Human
cauuuccccaaaaacuggaaa

SEQ ID NO: 321360 - RNA, 18 nt, Human
ccauaggcauuaucagua

SEQ ID NO: 321361 - RNA, 22 nt, Human
ccccaaaaacuggaaagaaaug

SEQ ID NO: 321362 - RNA, 23 nt, Human
ccuacagcuaaaaauccagaaaa

SEQ ID NO: 321363 - RNA, 19 nt, Human
cgaaauauauaaacuauga

SEQ ID NO: 321364 - RNA, 24 nt, Human
cgaggggcgcgcggcggcggagga

SEQ ID NO: 321365 - RNA, 21 nt, Human
cuacagcuaaaaauccagaaa

SEQ ID NO: 321366 - RNA, 19 nt, Human
cuggacacuucccauucug

SEQ ID NO: 321367 - RNA, 18 nt, Human
cuugagcuuuagaagggg

SEQ ID NO: 321368 - RNA, 18 nt, Human
cuugcuggacacuuccca

SEQ ID NO: 321369 - RNA, 22 nt, Human
gaccaaauaaccaccaccauuu

SEQ ID NO: 321370 - RNA, 26 nt, Human
gaccaaauaaccaccaccauuucccc

SEQ ID NO: 321371 - RNA, 20 nt, Human
gagcagcaagaaauguacaa

SEQ ID NO: 321372 - RNA, 19 nt, Human
gcggcggcggaggaggugg

SEQ ID NO: 321373 - RNA, 22 nt, Human
ggagguggcggaggcaacagcg

SEQ ID NO: 321374 - RNA, 21 nt, Human
ggcgcgcggcggcggaggagg

SEQ ID NO: 321375 - RNA, 21 nt, Human
ggggcgcgcggcggcggagga

SEQ ID NO: 321376 - RNA, 20 nt, Human
guuggcuuuaggccuuggcc

SEQ ID NO: 321377 - RNA, 18 nt, Human
uaaacuaugacuuccaca

SEQ ID NO: 321378 - RNA, 19 nt, Human
uaaauuuuccaagguucac

SEQ ID NO: 321379 - RNA, 21 nt, Human
uaaccaccaccauuuccccaa

SEQ ID NO: 321380 - RNA, 24 nt, Human
uaaccaccaccauuuccccaaaaa

SEQ ID NO: 321381 - RNA, 21 nt, Human
uaaccaccaccauuuccccag

SEQ ID NO: 321382 - RNA, 24 nt, Human
uaagacaguucacuuaaagaccaa

SEQ ID NO: 321383 - RNA, 22 nt, Human
uaagcuaaauaaaauuuggucc

SEQ ID NO: 321384 - RNA, 21 nt, Human
uacccaaauguccauaggcau

SEQ ID NO: 321385 - RNA, 21 nt, Human
uaccuuuaagucaguuggcuu

SEQ ID NO: 321386 - RNA, 21 nt, Human
uagaaaccaucaguucuuaaa

SEQ ID NO: 321387 - RNA, 23 nt, Human
ucacuccaaaguaaaaggauaau

SEQ ID NO: 321388 - RNA, 27 nt, Human
ucaguauauauuuacacagaaggcuuu

SEQ ID NO: 321389 - RNA, 26 nt, Human
uccaaaaaaaaaaaaaaaaaaggaaa

SEQ ID NO: 321390 - RNA, 22 nt, Human
uccacgccaggagcagcaagaa

SEQ ID NO: 321391 - RNA, 19 nt, Human
uccagaaaacaaaaacaag

SEQ ID NO: 321392 - RNA, 19 nt, Human
uccagaaaacaaaaacaag

SEQ ID NO: 321393 - RNA, 18 nt, Human
ugaaagaacaaaggaaga

SEQ ID NO: 321394 - RNA, 21 nt, Human
ugagaucauuauuuuaaaacu

SEQ ID NO: 321395 - RNA, 23 nt, Human
ugaguuauccaaaaaaaaaaaaa

SEQ ID NO: 321396 - RNA, 28 nt, Human
ugaguuauccaaaaaaaaaaaaaaaaaa

SEQ ID NO: 321397 - RNA, 25 nt, Human
uggaaacaccaaauagucaaggucu

SEQ ID NO: 321398 - RNA, 21 nt, Human
uggaauuuuaggaugcagcau

SEQ ID NO: 321399 - RNA, 24 nt, Human
uggacaggaccaauguauuuggug

SEQ ID NO: 321400 - RNA, 18 nt, Human
uggcuaaguccagucgca

SEQ ID NO: 321401 - RNA, 22 nt, Human
uguacaaauuuugggauuaagc

SEQ ID NO: 321402 - RNA, 22 nt, Human
ugucuaauguauaccccccaaa

SEQ ID NO: 321403 - RNA, 18 nt, Human
uuaagcacaguaaccaag

SEQ ID NO: 321404 - RNA, 21 nt, Human
uuaaguuuccacgccaggagc

SEQ ID NO: 321405 - RNA, 18 nt, Human
uuggcuuuaggccuuggc

SEQ ID NO: 321406 - RNA, 22 nt, Human
aggagguccagggucgagaccc

SEQ ID NO: 321407 - RNA, 22 nt, Human
cccaucaauccgggcaaaagaa

SEQ ID NO: 321408 - RNA, 19 nt, Human
ccggcgggggaacggggag

SEQ ID NO: 321409 - RNA, 18 nt, Human
ccuggagcugaaacaacu

SEQ ID NO: 321410 - RNA, 26 nt, Human
ccuggagcugaaacaacuaaaugaac

SEQ ID NO: 321411 - RNA, 18 nt, Human
cgcucagcuucccuaacc

SEQ ID NO: 321412 - RNA, 23 nt, Human
gaacggggagagcuccgaggucc

SEQ ID NO: 321413 - RNA, 25 nt, Human
gcaaaagaagauaucuaacuccagg

SEQ ID NO: 321414 - RNA, 21 nt, Human
gcgcucagcuucccuaaccag

SEQ ID NO: 321415 - RNA, 18 nt, Human
ggagaggccaacuggaua

SEQ ID NO: 321416 - RNA, 21 nt, Human
uaccuccauuucccuggagcu

SEQ ID NO: 321417 - RNA, 20 nt, Human
uagaguuaagacuuuaugug

SEQ ID NO: 321418 - RNA, 18 nt, Human
ucaacaucaauaccucca

SEQ ID NO: 321419 - RNA, 23 nt, Human
ucaggagguccagggucgagacc

SEQ ID NO: 321420 - RNA, 24 nt, Human
ugaaagaaaaauacgauucucuau

SEQ ID NO: 321421 - RNA, 19 nt, Human
ugcuucauuuuucaauggc

SEQ ID NO: 321422 - RNA, 21 nt, Human
ugcuuuuuccauguuucccuc

SEQ ID NO: 321423 - RNA, 23 nt, Human
uggcuguaggcauagcaauuucu

SEQ ID NO: 321424 - RNA, 23 nt, Human
ugggagaggccaacuggauagua

SEQ ID NO: 321425 - RNA, 23 nt, Human
uucaacaucaauaccuccauuuc

SEQ ID NO: 321426 - RNA, 21 nt, Human
uucauuuuucaauggcuguag

SEQ ID NO: 321427 - RNA, 31 nt, Human
uucccuggagcugaaacaacuaaaugaacaa

SEQ ID NO: 321428 - RNA, 18 nt, Human
uuucuaaucugacauccu

SEQ ID NO: 321429 - RNA, 23 nt, Human
aaacacccaaaccgacauaaaaa

SEQ ID NO: 321430 - RNA, 18 nt, Human
aagagcucaauguuuuac

SEQ ID NO: 321431 - RNA, 22 nt, Human
aaugucauuuacuggacuugac

SEQ ID NO: 321432 - RNA, 19 nt, Human
acucacaaacacccaaacc

SEQ ID NO: 321433 - RNA, 22 nt, Human
acuggacuugacaguauaaucu

SEQ ID NO: 321434 - RNA, 21 nt, Human
agaaaaacacacaaacacaag

SEQ ID NO: 321435 - RNA, 23 nt, Human
agaaaaacacacaaacacaaguu

SEQ ID NO: 321436 - RNA, 18 nt, Human
agaaaggcggagcugaag

SEQ ID NO: 321437 - RNA, 23 nt, Human
agcaacuuuggaagaaggcuuug

SEQ ID NO: 321438 - RNA, 18 nt, Human
agcaagaaaggcggagcu

SEQ ID NO: 321439 - RNA, 20 nt, Human
agggaggaacaagcaugacg

SEQ ID NO: 321440 - RNA, 23 nt, Human
auuuuauuaacuuuuuaagcacu

SEQ ID NO: 321441 - RNA, 19 nt, Human
caacuaaaacgaggucuua

SEQ ID NO: 321442 - RNA, 21 nt, Human
caagaaaggcggagcugaaga

SEQ ID NO: 321443 - RNA, 21 nt, Human
caauugcagguaucauacaga

SEQ ID NO: 321444 - RNA, 22 nt, Human
cuccccaaacucacaaacaccc

SEQ ID NO: 321445 - RNA, 21 nt, Human
cuuugugagcuuacaaaucuu

SEQ ID NO: 321446 - RNA, 19 nt, Human
gaacaagcaugacgguucc

SEQ ID NO: 321447 - RNA, 18 nt, Human
gagcaagaaaggcggagc

SEQ ID NO: 321448 - RNA, 22 nt, Human
gguuacaggggagagggaggaa

SEQ ID NO: 321449 - RNA, 19 nt, Human
guuccugugaaauccaucc

SEQ ID NO: 321450 - RNA, 19 nt, Human
uaaaacgauugccaaaaca

SEQ ID NO: 321451 - RNA, 23 nt, Human
uaaacaguuacaacuaaaacgag

SEQ ID NO: 321452 - RNA, 23 nt, Human
uaagcacuuggcucaagcaacuu

SEQ ID NO: 321453 - RNA, 20 nt, Human
uaguugcagaaaauaaauac

SEQ ID NO: 321454 - RNA, 19 nt, Human
ucacaaacacccaaaccga

SEQ ID NO: 321455 - RNA, 20 nt, Human
ucagagcaagaaaggcggag

SEQ ID NO: 321456 - RNA, 21 nt, Human
ucccaccgagcagucacucuu

SEQ ID NO: 321457 - RNA, 22 nt, Human
uccccaaacucacaaacaccca

SEQ ID NO: 321458 - RNA, 21 nt, Human
ugacgguuccugugaaaucca

SEQ ID NO: 321459 - RNA, 28 nt, Human
ugccaaaacacaaaguuuuagaaaaacc

SEQ ID NO: 321460 - RNA, 19 nt, Human
uggcccucgggaguuuucc

SEQ ID NO: 321461 - RNA, 22 nt, Human
uuacaggggagagggaggaaca

SEQ ID NO: 321462 - RNA, 21 nt, Human
uuauaaaaauugcuccccaaa

SEQ ID NO: 321463 - RNA, 24 nt, Human
uuggcucaagcaacuuuggaagaa

SEQ ID NO: 321464 - RNA, 23 nt, Human
uuuauuuuaguuauaaaacgauu

SEQ ID NO: 321465 - RNA, 21 nt, Human
gacugaagagauacugggggc

SEQ ID NO: 321466 - RNA, 18 nt, Human
gguauagagacugaagag

SEQ ID NO: 321467 - RNA, 23 nt, Human
aauggcccaagcuggcaagaaaa

SEQ ID NO: 321468 - RNA, 20 nt, Human
acaaacacgaccagucccau

SEQ ID NO: 321469 - RNA, 20 nt, Human
agaagccagcgcucacccac

SEQ ID NO: 321470 - RNA, 18 nt, Human
agaagggcagagcuucug

SEQ ID NO: 321471 - RNA, 18 nt, Human
agcgcucacccacccggg

SEQ ID NO: 321472 - RNA, 26 nt, Human
aggaggagacaaaugcugacugucua

SEQ ID NO: 321473 - RNA, 19 nt, Human
caagcuggcaagaaaaagc

SEQ ID NO: 321474 - RNA, 18 nt, Human
cacacugcauacauagga

SEQ ID NO: 321475 - RNA, 21 nt, Human
cauuaguuggacuaagaugau

SEQ ID NO: 321476 - RNA, 20 nt, Human
cgacucuggcggcggcggcg

SEQ ID NO: 321477 - RNA, 22 nt, Human
cucaaacucagagucaucgugc

SEQ ID NO: 321478 - RNA, 19 nt, Human
cuccacugaacaaacaaaa

SEQ ID NO: 321479 - RNA, 21 nt, Human
gaaaagcacaaacacgaccag

SEQ ID NO: 321480 - RNA, 23 nt, Human
gaaaagcacaaacacgaccaguc

SEQ ID NO: 321481 - RNA, 20 nt, Human
gcggcggcggcgguggcggc

SEQ ID NO: 321482 - RNA, 21 nt, Human
gcggcggcgguggcggcggac

SEQ ID NO: 321483 - RNA, 22 nt, Human
gcggcgguggcggcggacaggg

SEQ ID NO: 321484 - RNA, 23 nt, Human
ggcgacucuggcggcggcggcgg

SEQ ID NO: 321485 - RNA, 33 nt, Human
ggcgacucuggcggcggcggcgguggcggcgac

SEQ ID NO: 321486 - RNA, 20 nt, Human
ggcggcggcggcgguggcgg

SEQ ID NO: 321487 - RNA, 23 nt, Human
ggcggcggcggcgguggcggcgg

SEQ ID NO: 321488 - RNA, 18 nt, Human
ggcggcggcgguggcggc

SEQ ID NO: 321489 - RNA, 24 nt, Human
guguaagaaguacuuuaauagcuc

SEQ ID NO: 321490 - RNA, 19 nt, Human
uaagcaagaauggcccaag

SEQ ID NO: 321491 - RNA, 20 nt, Human
ucaagaaggauucuguugga

SEQ ID NO: 321492 - RNA, 24 nt, Human
ucauccgucauccacgggagaguc

SEQ ID NO: 321493 - RNA, 23 nt, Human
ugaguguccuauuccagcagccc

SEQ ID NO: 321494 - RNA, 24 nt, Human
ugugcauugaccuuugggugcuga

SEQ ID NO: 321495 - RNA, 20 nt, Human
agacagggccugacauccgc

SEQ ID NO: 321496 - RNA, 21 nt, Human
agacagggccugacauccgcc

SEQ ID NO: 321497 - RNA, 18 nt, Human
agccgacugaggucccug

SEQ ID NO: 321498 - RNA, 24 nt, Human
ccacacucugauuaagccgacuga

SEQ ID NO: 321499 - RNA, 23 nt, Human
ccagacagggccugacauccgcc

SEQ ID NO: 321500 - RNA, 21 nt, Human
cccacagcgcucaguucuggc

SEQ ID NO: 321501 - RNA, 22 nt, Human
cccacagcgcucaguucuggcc

SEQ ID NO: 321502 - RNA, 23 nt, Human
cccggccauacuggcggcucaca

SEQ ID NO: 321503 - RNA, 20 nt, Human
cgcucaguucuggcccagac

SEQ ID NO: 321504 - RNA, 19 nt, Human
uaagccgacugaggucccu

SEQ ID NO: 321505 - RNA, 18 nt, Human
uagcuucuaugccacacu

SEQ ID NO: 321506 - RNA, 23 nt, Human
aaacaaaaacacagauugaagga

SEQ ID NO: 321507 - RNA, 25 nt, Human
aaacagaaggagauuagaaagacaa

SEQ ID NO: 321508 - RNA, 26 nt, Human
aaacagaaggagauuagaagggaccc

SEQ ID NO: 321509 - RNA, 27 nt, Human
aaacagagaaauagacagaagggaccc

SEQ ID NO: 321510 - RNA, 22 nt, Human
aaacuuacagcaaagccccuaa

SEQ ID NO: 321511 - RNA, 18 nt, Human
aaagacauacaaaaagcu

SEQ ID NO: 321512 - RNA, 20 nt, Human
aaagacauacaaaaagcuga

SEQ ID NO: 321513 - RNA, 22 nt, Human
aagaacagugcaaaucuauggc

SEQ ID NO: 321514 - RNA, 23 nt, Human
aagaagagcaucagagacagaaa

SEQ ID NO: 321515 - RNA, 23 nt, Human
aagagagagaggagagaaaaaga

SEQ ID NO: 321516 - RNA, 19 nt, Human
aagauaaacagagaaauag

SEQ ID NO: 321517 - RNA, 22 nt, Human
aaguaccagggagugauauuug

SEQ ID NO: 321518 - RNA, 21 nt, Human
aauaagagagauagagaagga

SEQ ID NO: 321519 - RNA, 25 nt, Human
agaaacaaaaacacagauugaagga

SEQ ID NO: 321520 - RNA, 21 nt, Human
agaaagacaaauagugacagg

SEQ ID NO: 321521 - RNA, 22 nt, Human
agaaaugaagauauucagagaa

SEQ ID NO: 321522 - RNA, 23 nt, Human
agaagaagagcaucagagacaga

SEQ ID NO: 321523 - RNA, 24 nt, Human
agaagaagagcaucagagacagaa

SEQ ID NO: 321524 - RNA, 21 nt, Human
agaaucaugaaucccuagagu

SEQ ID NO: 321525 - RNA, 19 nt, Human
agacagaaacacagagaua

SEQ ID NO: 321526 - RNA, 19 nt, Human
agacagaaauagagacaga

SEQ ID NO: 321527 - RNA, 23 nt, Human
agacagaaauagagacagagaca

SEQ ID NO: 321528 - RNA, 22 nt, Human
agacagaaauagagccucaggg

SEQ ID NO: 321529 - RNA, 22 nt, Human
agacagaaauagagccucaggg

SEQ ID NO: 321530 - RNA, 22 nt, Human
agagacacagaagaagagcauc

SEQ ID NO: 321531 - RNA, 25 nt, Human
agagacagagacagagugagaaaga

SEQ ID NO: 321532 - RNA, 23 nt, Human
agagacugagggaaagggguaca

SEQ ID NO: 321533 - RNA, 19 nt, Human
agagauagagaaggaaaag

SEQ ID NO: 321534 - RNA, 21 nt, Human
aggaagagaaauagagacaca

SEQ ID NO: 321535 - RNA, 21 nt, Human
aggagacacacagagaccaaa

SEQ ID NO: 321536 - RNA, 23 nt, Human
aggagcuggaguggcagaauuug

SEQ ID NO: 321537 - RNA, 21 nt, Human
agugaaggguguggaaggaag

SEQ ID NO: 321538 - RNA, 23 nt, Human
agugacaggaagagaaauagaga

SEQ ID NO: 321539 - RNA, 18 nt, Human
agugacaggggaaagaga

SEQ ID NO: 321540 - RNA, 20 nt, Human
agugacaggggaaagagaga

SEQ ID NO: 321541 - RNA, 24 nt, Human
agugacaggggaaagagagaggaa

SEQ ID NO: 321542 - RNA, 23 nt, Human
aguuucuucuuucaaaacaagcu

SEQ ID NO: 321543 - RNA, 22 nt, Human
caaaaacacagauugaaggaca

SEQ ID NO: 321544 - RNA, 21 nt, Human
caaagacauacaaaaagcuga

SEQ ID NO: 321545 - RNA, 22 nt, Human
caaagccccuaacccaggagcu

SEQ ID NO: 321546 - RNA, 19 nt, Human
cacagagaccaaaaaugag

SEQ ID NO: 321547 - RNA, 20 nt, Human
cagaaauagagacagagaca

SEQ ID NO: 321548 - RNA, 20 nt, Human
cagguuccugucacagcuaa

SEQ ID NO: 321549 - RNA, 19 nt, Human
caguggaaauagccauggc

SEQ ID NO: 321550 - RNA, 21 nt, Human
ccaggcccuggaagaaggaau

SEQ ID NO: 321551 - RNA, 23 nt, Human
ccuauccucccaggcccuggaag

SEQ ID NO: 321552 - RNA, 28 nt, Human
cgagggcaccagcauaaguuggagaccc

SEQ ID NO: 321553 - RNA, 21 nt, Human
gaaacaaaaacacagauugaa

SEQ ID NO: 321554 - RNA, 19 nt, Human
gaaagagagaggaagagac

SEQ ID NO: 321555 - RNA, 19 nt, Human
gaaauagccauggcagagc

SEQ ID NO: 321556 - RNA, 20 nt, Human
gaaggaaaagauuaagugac

SEQ ID NO: 321557 - RNA, 18 nt, Human
gacaaauagugacagggg

SEQ ID NO: 321558 - RNA, 26 nt, Human
gacacagaagaagagcaucagagaca

SEQ ID NO: 321559 - RNA, 18 nt, Human
gacaggaagagaaauaga

SEQ ID NO: 321560 - RNA, 22 nt, Human
gagacagagagauugaggacac

SEQ ID NO: 321561 - RNA, 22 nt, Human
gagacagagagauugaggacac

SEQ ID NO: 321562 - RNA, 22 nt, Human
gcagaggagagacagaaauaga

SEQ ID NO: 321563 - RNA, 22 nt, Human
gcagaggagagacagaaauaga

SEQ ID NO: 321564 - RNA, 19 nt, Human
gcaguggaaauagccaugg

SEQ ID NO: 321565 - RNA, 18 nt, Human
gccagaaacaaaaacaca

SEQ ID NO: 321566 - RNA, 22 nt, Human
ggagacagagagauugaggaca

SEQ ID NO: 321567 - RNA, 22 nt, Human
ggagacagagagauugaggaca

SEQ ID NO: 321568 - RNA, 19 nt, Human
gggaaagagagaggaagag

SEQ ID NO: 321569 - RNA, 25 nt, Human
ggguacagugagagaaaccgguacc

SEQ ID NO: 321570 - RNA, 24 nt, Human
ggugagugaaggguguggaaggaa

SEQ ID NO: 321571 - RNA, 20 nt, Human
uaaaguccagaaaaagaaac

SEQ ID NO: 321572 - RNA, 19 nt, Human
uacaaaaagcugagaagua

SEQ ID NO: 321573 - RNA, 24 nt, Human
uaccagggagugauauuugauugu

SEQ ID NO: 321574 - RNA, 26 nt, Human
uagaaagacaaauagugacaggggaa

SEQ ID NO: 321575 - RNA, 18 nt, Human
uagacagaaacacagaga

SEQ ID NO: 321576 - RNA, 18 nt, Human
uaggagacacacagagac

SEQ ID NO: 321577 - RNA, 20 nt, Human
uaggagacacacagagacca

SEQ ID NO: 321578 - RNA, 20 nt, Human
uauucagagaaacagaagga

SEQ ID NO: 321579 - RNA, 18 nt, Human
ucagagaaacagaaggag

SEQ ID NO: 321580 - RNA, 22 nt, Human
ucagugaacaaguauguccagg

SEQ ID NO: 321581 - RNA, 23 nt, Human
uccaccagaaucaugaaucccua

SEQ ID NO: 321582 - RNA, 19 nt, Human
uccagaaaaagaaacuuac

SEQ ID NO: 321583 - RNA, 24 nt, Human
ucccaggcccuggaagaaggaauc

SEQ ID NO: 321584 - RNA, 26 nt, Human
ucuuuaggaaagaacagugcaaaucu

SEQ ID NO: 321585 - RNA, 22 nt, Human
ugaagauauucagagaaacaga

SEQ ID NO: 321586 - RNA, 18 nt, Human
ugacaggaagagaaauag

SEQ ID NO: 321587 - RNA, 19 nt, Human
ugacaggaagagaaauaga

SEQ ID NO: 321588 - RNA, 19 nt, Human
ugacaggggaaagagagag

SEQ ID NO: 321589 - RNA, 25 nt, Human
ugacaggggaaagagagaggaagag

SEQ ID NO: 321590 - RNA, 21 nt, Human
ugagaaagaaagugacuagga

SEQ ID NO: 321591 - RNA, 22 nt, Human
ugaggacacagcagaggagaga

SEQ ID NO: 321592 - RNA, 23 nt, Human
ugaggacacagcagaggagagac

SEQ ID NO: 321593 - RNA, 24 nt, Human
ugcggaacaggugcugaauuccaa

SEQ ID NO: 321594 - RNA, 18 nt, Human
uggaaauagccauggcag

SEQ ID NO: 321595 - RNA, 18 nt, Human
uggaaauagccauggcag

SEQ ID NO: 321596 - RNA, 23 nt, Human
uggaagaaggaaucuccaccaga

SEQ ID NO: 321597 - RNA, 22 nt, Human
uggcagagcaagagagagagga

SEQ ID NO: 321598 - RNA, 24 nt, Human
ugggauuagcccuauccucccagg

SEQ ID NO: 321599 - RNA, 18 nt, Human
uuccugggaguuucuucu

SEQ ID NO: 321600 - RNA, 19 nt, Human
uugaaggacagaaagauaa

SEQ ID NO: 321601 - RNA, 23 nt, Human
uugaucuuuaggaaagaacagug

SEQ ID NO: 321602 - RNA, 25 nt, Human
uuggaagcuggaaguaccagggagu

SEQ ID NO: 321603 - RNA, 23 nt, Human
uuugaaccagaaucugaucagca

SEQ ID NO: 321604 - RNA, 21 nt, Human
gguauagagacugcagaggga

SEQ ID NO: 321605 - RNA, 23 nt, Human
aaaauuuuguuucccuggccccc

SEQ ID NO: 321606 - RNA, 23 nt, Human
agaaaagacagagaaacaauuga

SEQ ID NO: 321607 - RNA, 24 nt, Human
agcagcaaacuaaacuggaacuag

SEQ ID NO: 321608 - RNA, 21 nt, Human
agguaagaauaaaaaccuuug

SEQ ID NO: 321609 - RNA, 18 nt, Human
aguaaguaauaaaaauaa

SEQ ID NO: 321610 - RNA, 18 nt, Human
caaacuaaacuggaacua

SEQ ID NO: 321611 - RNA, 18 nt, Human
caggccugugacauaagc

SEQ ID NO: 321612 - RNA, 19 nt, Human
caucccuuuaaacaacagu

SEQ ID NO: 321613 - RNA, 22 nt, Human
cuuacaauaaauaguuucuauu

SEQ ID NO: 321614 - RNA, 20 nt, Human
uagaaaagacagagaaacaa

SEQ ID NO: 321615 - RNA, 19 nt, Human
ugacauagguaagaauaaa

SEQ ID NO: 321616 - RNA, 18 nt, Human
ugggaaaauacuaagguu

SEQ ID NO: 321617 - RNA, 23 nt, Human
ugguugggaaaauacuaagguua

SEQ ID NO: 321618 - RNA, 23 nt, Human
uucccuggcccccuagcauuuca

SEQ ID NO: 321619 - RNA, 19 nt, Human
uuuaaacaacaguaaguaa

SEQ ID NO: 321620 - RNA, 23 nt, Human
uuuuaaaguuauucuguauugcu

SEQ ID NO: 321621 - RNA, 18 nt, Human
aaaaagcacacccagaag

SEQ ID NO: 321622 - RNA, 24 nt, Human
aaacaggugggagccagggcucau

SEQ ID NO: 321623 - RNA, 20 nt, Human
aagauggggccccagccucc

SEQ ID NO: 321624 - RNA, 21 nt, Human
aagguggccccagcccagaac

SEQ ID NO: 321625 - RNA, 23 nt, Human
acccagaagaaugggcucaaaga

SEQ ID NO: 321626 - RNA, 19 nt, Human
accuaccugcccgccccuc

SEQ ID NO: 321627 - RNA, 18 nt, Human
accugcccgccccucccc

SEQ ID NO: 321628 - RNA, 19 nt, Human
agccagggcucauuuucau

SEQ ID NO: 321629 - RNA, 18 nt, Human
aggagucagggcucgggg

SEQ ID NO: 321630 - RNA, 20 nt, Human
aggcagggagcggccgcaac

SEQ ID NO: 321631 - RNA, 26 nt, Human
aggcagggagcggccgcaacgggaga

SEQ ID NO: 321632 - RNA, 21 nt, Human
agggagcggccgcaacgggag

SEQ ID NO: 321633 - RNA, 21 nt, Human
agggucccaggagcuccccag

SEQ ID NO: 321634 - RNA, 20 nt, Human
agguggccccagcccagaac

SEQ ID NO: 321635 - RNA, 20 nt, Human
auccaagcgccagcccaguu

SEQ ID NO: 321636 - RNA, 20 nt, Human
auccauccuggaaguagggc

SEQ ID NO: 321637 - RNA, 22 nt, Human
auggucccaaaaagcacaccca

SEQ ID NO: 321638 - RNA, 20 nt, Human
auuucugcccuguuacuccc

SEQ ID NO: 321639 - RNA, 26 nt, Human
caaaaagcacacccagaagaaugggc

SEQ ID NO: 321640 - RNA, 24 nt, Human
caaaggccaucagggaaggaccag

SEQ ID NO: 321641 - RNA, 24 nt, Human
caacgggagacgccuggaguaucc

SEQ ID NO: 321642 - RNA, 22 nt, Human
caagauuggggccuuuccuguc

SEQ ID NO: 321643 - RNA, 18 nt, Human
cacacccagaagaauggg

SEQ ID NO: 321644 - RNA, 20 nt, Human
cagaaacaggugggagccag

SEQ ID NO: 321645 - RNA, 19 nt, Human
cagaacacagggagagggc

SEQ ID NO: 321646 - RNA, 22 nt, Human
caggaguggcugcaccuaccug

SEQ ID NO: 321647 - RNA, 21 nt, Human
caggcccuggguccaaaggcc

SEQ ID NO: 321648 - RNA, 19 nt, Human
caucagggaaggaccaggc

SEQ ID NO: 321649 - RNA, 22 nt, Human
caucagggaaggaccaggcucc

SEQ ID NO: 321650 - RNA, 27 nt, Human
ccagugggcaagauuggggccuuuccu

SEQ ID NO: 321651 - RNA, 25 nt, Human
cccaaaaagcacacccagaagaaug

SEQ ID NO: 321652 - RNA, 18 nt, Human
cccagccucccgcagagu

SEQ ID NO: 321653 - RNA, 19 nt, Human
cccaggacaagggccccug

SEQ ID NO: 321654 - RNA, 18 nt, Human
ccccagauccaagcgcca

SEQ ID NO: 321655 - RNA, 21 nt, Human
ccccagccucccgcagagucc

SEQ ID NO: 321656 - RNA, 20 nt, Human
ccccuggggcagacuccagg

SEQ ID NO: 321657 - RNA, 18 nt, Human
cccgccccuccccuggcc

SEQ ID NO: 321658 - RNA, 19 nt, Human
cccgccccuccccuggccc

SEQ ID NO: 321659 - RNA, 22 nt, Human
ccuaccugcccgccccuccccu

SEQ ID NO: 321660 - RNA, 21 nt, Human
ccuccccuggccccgcccacu

SEQ ID NO: 321661 - RNA, 20 nt, Human
ccuggccccgcccacuggcc

SEQ ID NO: 321662 - RNA, 19 nt, Human
cucccaccccagauccaag

SEQ ID NO: 321663 - RNA, 20 nt, Human
cucccaccccagauccaagc

SEQ ID NO: 321664 - RNA, 21 nt, Human
cugcaccuaccugcccgcccc

SEQ ID NO: 321665 - RNA, 23 nt, Human
cugcaccuaccugcccgccccuc

SEQ ID NO: 321666 - RNA, 21 nt, Human
cuggccccgcccacuggcugg

SEQ ID NO: 321667 - RNA, 19 nt, Human
cuggcugggcuccgccagc

SEQ ID NO: 321668 - RNA, 25 nt, Human
cuuccagaaacaggugggagccagg

SEQ ID NO: 321669 - RNA, 18 nt, Human
gacaagggccccuggggc

SEQ ID NO: 321670 - RNA, 24 nt, Human
gagcaguguggacgagucaccagc

SEQ ID NO: 321671 - RNA, 18 nt, Human
gaguggcucaagucaggc

SEQ ID NO: 321672 - RNA, 23 nt, Human
gccagcccaguuccggugggggc

SEQ ID NO: 321673 - RNA, 24 nt, Human
gcccgccccuccccuggccccgcc

SEQ ID NO: 321674 - RNA, 18 nt, Human
gcccuggguccaaaggcc

SEQ ID NO: 321675 - RNA, 19 nt, Human
gcgcucagcggccaguggg

SEQ ID NO: 321676 - RNA, 24 nt, Human
ggcaagauuggggccuuuccuguc

SEQ ID NO: 321677 - RNA, 20 nt, Human
ggccagugggcaagauuggg

SEQ ID NO: 321678 - RNA, 20 nt, Human
ggcucaguccuccggagucc

SEQ ID NO: 321679 - RNA, 21 nt, Human
gggcagcaaguguccaaggcu

SEQ ID NO: 321680 - RNA, 21 nt, Human
gggcucgggggcgcucagcgg

SEQ ID NO: 321681 - RNA, 22 nt, Human
ggggcucaguccuccggagucc

SEQ ID NO: 321682 - RNA, 21 nt, Human
gugggugaggggccagaggcu

SEQ ID NO: 321683 - RNA, 22 nt, Human
uauccgaagcgagcagugugga

SEQ ID NO: 321684 - RNA, 23 nt, Human
ucaccagcaccgucuggccacgc

SEQ ID NO: 321685 - RNA, 22 nt, Human
uccaggagucagggcucggggg

SEQ ID NO: 321686 - RNA, 20 nt, Human
uccugacucucagugauggu

SEQ ID NO: 321687 - RNA, 19 nt, Human
uccuggaaguagggccagc

SEQ ID NO: 321688 - RNA, 24 nt, Human
ucgaagcugcacaaagguggcccc

SEQ ID NO: 321689 - RNA, 18 nt, Human
uggcugcaccuaccugcc

SEQ ID NO: 321690 - RNA, 21 nt, Human
uguggacgagucaccagcacc

SEQ ID NO: 321691 - RNA, 24 nt, Human
uuucugcccuguuacucccacccc

SEQ ID NO: 321692 - RNA, 21 nt, Human
ccucgaggguuuggagccagg

SEQ ID NO: 321693 - RNA, 18 nt, Human
cggggucccggccagcgc

SEQ ID NO: 321694 - RNA, 19 nt, Human
gagccaggcucgggguccc

SEQ ID NO: 321695 - RNA, 23 nt, Human
ugggguccagggugcacccacga

SEQ ID NO: 321696 - RNA, 18 nt, Human
aacaaugaguggcgcccc

SEQ ID NO: 321697 - RNA, 21 nt, Human
aagaaucgugggggaaaugga

SEQ ID NO: 321698 - RNA, 23 nt, Human
acaagcaccccaggaggggcuga

SEQ ID NO: 321699 - RNA, 20 nt, Human
agacacaugcagccacuccu

SEQ ID NO: 321700 - RNA, 24 nt, Human
agcagcggugaagaaucguggggg

SEQ ID NO: 321701 - RNA, 22 nt, Human
aggaggggcugaguggauggug

SEQ ID NO: 321702 - RNA, 27 nt, Human
aucauaacaaugaguggcgccccuggg

SEQ ID NO: 321703 - RNA, 18 nt, Human
cacacagagaagauccca

SEQ ID NO: 321704 - RNA, 18 nt, Human
cacacagcccugaaugcu

SEQ ID NO: 321705 - RNA, 20 nt, Human
cacacagcccugaaugcucc

SEQ ID NO: 321706 - RNA, 20 nt, Human
caccacagcgcuagggccag

SEQ ID NO: 321707 - RNA, 23 nt, Human
caccccccaagugagacacucca

SEQ ID NO: 321708 - RNA, 21 nt, Human
cagcagaacgcugcugcugcu

SEQ ID NO: 321709 - RNA, 26 nt, Human
ccacaagcaccccaggaggggcugag

SEQ ID NO: 321710 - RNA, 22 nt, Human
ccaccacagcgcuagggccagu

SEQ ID NO: 321711 - RNA, 24 nt, Human
ccagugcuagccccaccccccaag

SEQ ID NO: 321712 - RNA, 19 nt, Human
cccacagggcaaguccggc

SEQ ID NO: 321713 - RNA, 19 nt, Human
cccaccccccaagugagac

SEQ ID NO: 321714 - RNA, 21 nt, Human
cccaccccccaagugagacac

SEQ ID NO: 321715 - RNA, 18 nt, Human
cccugaaugcucauucug

SEQ ID NO: 321716 - RNA, 21 nt, Human
ccggucuccugggacaggggc

SEQ ID NO: 321717 - RNA, 19 nt, Human
ccuccaguguccccucucc

SEQ ID NO: 321718 - RNA, 22 nt, Human
ccuccaguguccccucucccac

SEQ ID NO: 321719 - RNA, 27 nt, Human
ccucccgcaggcugaggggcaggaggc

SEQ ID NO: 321720 - RNA, 21 nt, Human
cgccccuggggcaggucauuc

SEQ ID NO: 321721 - RNA, 23 nt, Human
cuggaauguugggccacacagcc

SEQ ID NO: 321722 - RNA, 24 nt, Human
gaacagguuccaaggggcugcaca

SEQ ID NO: 321723 - RNA, 18 nt, Human
gaauguacccaucauaac

SEQ ID NO: 321724 - RNA, 21 nt, Human
gagcagcggugaagaaucgug

SEQ ID NO: 321725 - RNA, 24 nt, Human
gaggagcagaaguggguauaggag

SEQ ID NO: 321726 - RNA, 22 nt, Human
gaggagggagggaguucagcag

SEQ ID NO: 321727 - RNA, 22 nt, Human
ggaagaugauucauggacagga

SEQ ID NO: 321728 - RNA, 22 nt, Human
ggcaggucauucggggggagcc

SEQ ID NO: 321729 - RNA, 24 nt, Human
gggacaggggcagcuugaggaaag

SEQ ID NO: 321730 - RNA, 25 nt, Human
gggacaggggcagcuugaggaggga

SEQ ID NO: 321731 - RNA, 19 nt, Human
gggagggaguucagcagaa

SEQ ID NO: 321732 - RNA, 24 nt, Human
ggugugguucaacaaggagcugga

SEQ ID NO: 321733 - RNA, 26 nt, Human
gugugguggugagcagcgacgacggc

SEQ ID NO: 321734 - RNA, 18 nt, Human
uacaagcacaagggacgg

SEQ ID NO: 321735 - RNA, 21 nt, Human
uaggaggccacaagcacccca

SEQ ID NO: 321736 - RNA, 21 nt, Human
uagguuacaagcacaagggac

SEQ ID NO: 321737 - RNA, 21 nt, Human
uccaggcccccagccuaccuc

SEQ ID NO: 321738 - RNA, 20 nt, Human
uccccaccacagcgcuaggg

SEQ ID NO: 321739 - RNA, 22 nt, Human
uccccaccacagcgcuagggcc

SEQ ID NO: 321740 - RNA, 24 nt, Human
uccccaccacagcgcuagggccag

SEQ ID NO: 321741 - RNA, 22 nt, Human
ucucccacagggcaaguccggc

SEQ ID NO: 321742 - RNA, 20 nt, Human
ucuccugggacaggggcagc

SEQ ID NO: 321743 - RNA, 20 nt, Human
uggggaagaugauucaugga

SEQ ID NO: 321744 - RNA, 21 nt, Human
ugguggugagcagcggugaag

SEQ ID NO: 321745 - RNA, 21 nt, Human
uggugugguucaacaaggagc

SEQ ID NO: 321746 - RNA, 18 nt, Human
ugugguggugagcagcgg

SEQ ID NO: 321747 - RNA, 18 nt, Human
uucauggacaggaugggg

SEQ ID NO: 321748 - RNA, 24 nt, Human
uucggggggagccacuugaacagg

SEQ ID NO: 321749 - RNA, 23 nt, Human
aacccuguagccugcugugcccu

SEQ ID NO: 321750 - RNA, 20 nt, Human
aacucagccaccccuggcac

SEQ ID NO: 321751 - RNA, 26 nt, Human
aagcaggcagccaucuaggaucucca

SEQ ID NO: 321752 - RNA, 22 nt, Human
aagccgcaccuccggcacagcc

SEQ ID NO: 321753 - RNA, 22 nt, Human
aagccgcaccuccggcacagcc

SEQ ID NO: 321754 - RNA, 22 nt, Human
aagccgcaccuccggcacagcc

SEQ ID NO: 321755 - RNA, 24 nt, Human
aagcggaacuugggugacuucucu

SEQ ID NO: 321756 - RNA, 19 nt, Human
acagaucgagggcaggcag

SEQ ID NO: 321757 - RNA, 22 nt, Human
accagcuucccugagaccucag

SEQ ID NO: 321758 - RNA, 22 nt, Human
acccucccaucccagccccagc

SEQ ID NO: 321759 - RNA, 21 nt, Human
accucggggaggugcacaucg

SEQ ID NO: 321760 - RNA, 20 nt, Human
accucuggaagccgcaccuc

SEQ ID NO: 321761 - RNA, 20 nt, Human
accucuggaagccgcaccuc

SEQ ID NO: 321762 - RNA, 20 nt, Human
accucuggaagccgcaccuc

SEQ ID NO: 321763 - RNA, 21 nt, Human
accuuggcuaccuuggccuca

SEQ ID NO: 321764 - RNA, 20 nt, Human
acgagcuccugcagccaccu

SEQ ID NO: 321765 - RNA, 20 nt, Human
acgcagccgaggcagcugga

SEQ ID NO: 321766 - RNA, 24 nt, Human
acuuuggcugaagcccacucgggg

SEQ ID NO: 321767 - RNA, 21 nt, Human
agaaaggaaggcaagaaggga

SEQ ID NO: 321768 - RNA, 19 nt, Human
agacacccucacccaccag

SEQ ID NO: 321769 - RNA, 20 nt, Human
agagaaacaacuuuguccag

SEQ ID NO: 321770 - RNA, 19 nt, Human
agaggaaggggcagagggu

SEQ ID NO: 321771 - RNA, 20 nt, Human
agaucgagggcaggcagcag

SEQ ID NO: 321772 - RNA, 19 nt, Human
agccccagcccuugcccuc

SEQ ID NO: 321773 - RNA, 24 nt, Human
agcccuggucagucacccaccucc

SEQ ID NO: 321774 - RNA, 25 nt, Human
agccuccaccuuggcuuuccugggg

SEQ ID NO: 321775 - RNA, 20 nt, Human
agccuggauccgaugguggg

SEQ ID NO: 321776 - RNA, 18 nt, Human
agcuggaggcgccggcgg

SEQ ID NO: 321777 - RNA, 18 nt, Human
agcuguaccucuggaagc

SEQ ID NO: 321778 - RNA, 22 nt, Human
agcuugguagcucgcccagccc

SEQ ID NO: 321779 - RNA, 21 nt, Human
aggcagagugagagaggggac

SEQ ID NO: 321780 - RNA, 22 nt, Human
aggcagggaagugugggcagag

SEQ ID NO: 321781 - RNA, 22 nt, Human
aggcccagggagagaaacaacu

SEQ ID NO: 321782 - RNA, 23 nt, Human
aucccagccccagcccuugccuu

SEQ ID NO: 321783 - RNA, 18 nt, Human
caacuucaggagcagcgg

SEQ ID NO: 321784 - RNA, 20 nt, Human
cacagcccccucugcccucc

SEQ ID NO: 321785 - RNA, 18 nt, Human
cacccgagccuuggggag

SEQ ID NO: 321786 - RNA, 22 nt, Human
caccucagggcccuccacccgc

SEQ ID NO: 321787 - RNA, 21 nt, Human
caccuccagcuccuugggccu

SEQ ID NO: 321788 - RNA, 20 nt, Human
caccugguauuggaccaggc

SEQ ID NO: 321789 - RNA, 20 nt, Human
caccuugaacuucugcuucc

SEQ ID NO: 321790 - RNA, 19 nt, Human
cacugcccucuuccuccuc

SEQ ID NO: 321791 - RNA, 25 nt, Human
cagacuuugggcagcugcaccucug

SEQ ID NO: 321792 - RNA, 22 nt, Human
cagcaggcggagccggggcucc

SEQ ID NO: 321793 - RNA, 23 nt, Human
cagccaccucagccuccaccuug

SEQ ID NO: 321794 - RNA, 20 nt, Human
cagcccccacccgagccuug

SEQ ID NO: 321795 - RNA, 20 nt, Human
cagcccccucagccucugcc

SEQ ID NO: 321796 - RNA, 18 nt, Human
cagccgggacaggacccu

SEQ ID NO: 321797 - RNA, 20 nt, Human
cagcuccaccugaggggcug

SEQ ID NO: 321798 - RNA, 19 nt, Human
cagcugcaccucuggaagc

SEQ ID NO: 321799 - RNA, 19 nt, Human
cagcuguaccucuggaagc

SEQ ID NO: 321800 - RNA, 19 nt, Human
caggccugccuccccagcc

SEQ ID NO: 321801 - RNA, 22 nt, Human
cagggcccuccacccgcucucc

SEQ ID NO: 321802 - RNA, 18 nt, Human
cagggugggcaccacuac

SEQ ID NO: 321803 - RNA, 21 nt, Human
cagugagggcaaggcaggcag

SEQ ID NO: 321804 - RNA, 23 nt, Human
cagugggaggcugggaguggaca

SEQ ID NO: 321805 - RNA, 19 nt, Human
cauggagcagcugccucug

SEQ ID NO: 321806 - RNA, 24 nt, Human
cauuuuagggaguuucaucucugg

SEQ ID NO: 321807 - RNA, 18 nt, Human
ccaagagggaaagcccaa

SEQ ID NO: 321808 - RNA, 19 nt, Human
ccacagucggugcugccac

SEQ ID NO: 321809 - RNA, 21 nt, Human
ccaccagcagcucaccaccug

SEQ ID NO: 321810 - RNA, 26 nt, Human
ccagcacucaggcuggaaucuggcuu

SEQ ID NO: 321811 - RNA, 21 nt, Human
ccaggcagagacagggucacc

SEQ ID NO: 321812 - RNA, 23 nt, Human
ccagugugggcaacuucagccuc

SEQ ID NO: 321813 - RNA, 20 nt, Human
cccaaaggugggcauucgaa

SEQ ID NO: 321814 - RNA, 22 nt, Human
ccccaaaucggggaaaacuaag

SEQ ID NO: 321815 - RNA, 19 nt, Human
ccccacgcugggcagccgc

SEQ ID NO: 321816 - RNA, 20 nt, Human
ccccagagccccaggcacca

SEQ ID NO: 321817 - RNA, 19 nt, Human
ccccaucugacuaggggcu

SEQ ID NO: 321818 - RNA, 23 nt, Human
cccccagagccccaggcaccauc

SEQ ID NO: 321819 - RNA, 20 nt, Human
cccccggauggcgagagcuc

SEQ ID NO: 321820 - RNA, 30 nt, Human
cccccuucccggggaagaguuuggggcagg

SEQ ID NO: 321821 - RNA, 21 nt, Human
ccccucagccucugccuuagc

SEQ ID NO: 321822 - RNA, 22 nt, Human
ccccugcugccaccucagggcc

SEQ ID NO: 321823 - RNA, 23 nt, Human
ccccuucccgggucucuaggcag

SEQ ID NO: 321824 - RNA, 19 nt, Human
cccuccaacucagccaccc

SEQ ID NO: 321825 - RNA, 19 nt, Human
cccuccaacucagccaccc

SEQ ID NO: 321826 - RNA, 20 nt, Human
cccucccaucccagccccag

SEQ ID NO: 321827 - RNA, 18 nt, Human
cccucuuccuccuccucc

SEQ ID NO: 321828 - RNA, 20 nt, Human
cccugaccccugcugccacc

SEQ ID NO: 321829 - RNA, 19 nt, Human
cccugggguaccugccucc

SEQ ID NO: 321830 - RNA, 20 nt, Human
ccgccucgcccgccugugcc

SEQ ID NO: 321831 - RNA, 18 nt, Human
ccgccucgccuggcuugc

SEQ ID NO: 321832 - RNA, 20 nt, Human
ccggccucucccucccccuc

SEQ ID NO: 321833 - RNA, 20 nt, Human
ccgggaggugcacaucgggc

SEQ ID NO: 321834 - RNA, 26 nt, Human
ccucagccucagcccccacccgagcc

SEQ ID NO: 321835 - RNA, 20 nt, Human
ccucagccuccaccuuggcu

SEQ ID NO: 321836 - RNA, 22 nt, Human
ccucagccuccaccuuggcuuu

SEQ ID NO: 321837 - RNA, 19 nt, Human
ccucaggugccucuccccg

SEQ ID NO: 321838 - RNA, 19 nt, Human
ccucccggcccucuuaggg

SEQ ID NO: 321839 - RNA, 21 nt, Human
ccucccugccagcccugguca

SEQ ID NO: 321840 - RNA, 22 nt, Human
ccucccuuccuccugggcgccc

SEQ ID NO: 321841 - RNA, 23 nt, Human
ccucccuuccuccugggcgccca

SEQ ID NO: 321842 - RNA, 23 nt, Human
ccuccggcacagccaucucuggc

SEQ ID NO: 321843 - RNA, 23 nt, Human
ccuccggcacagccaucucuggc

SEQ ID NO: 321844 - RNA, 23 nt, Human
ccuccggcacagccaucucuggc

SEQ ID NO: 321845 - RNA, 20 nt, Human
ccucugggaggugcacaucc

SEQ ID NO: 321846 - RNA, 20 nt, Human
ccucugggaggugcacaucg

SEQ ID NO: 321847 - RNA, 18 nt, Human
ccugcagccaccucagcc

SEQ ID NO: 321848 - RNA, 21 nt, Human
ccugccaccucuaccuugccu

SEQ ID NO: 321849 - RNA, 18 nt, Human
ccuggggggaggagcggc

SEQ ID NO: 321850 - RNA, 22 nt, Human
ccuguguccucuccccuuucug

SEQ ID NO: 321851 - RNA, 18 nt, Human
ccuugggccuccuggguc

SEQ ID NO: 321852 - RNA, 21 nt, Human
cgggagcugcacuuccgggag

SEQ ID NO: 321853 - RNA, 19 nt, Human
cggggcuccgagcccaagg

SEQ ID NO: 321854 - RNA, 22 nt, Human
cucacccaccagcagcucacca

SEQ ID NO: 321855 - RNA, 19 nt, Human
cucagcacccucgcccccc

SEQ ID NO: 321856 - RNA, 21 nt, Human
cucagccuuuucccccgggcu

SEQ ID NO: 321857 - RNA, 21 nt, Human
cucccaucccagccccagccc

SEQ ID NO: 321858 - RNA, 23 nt, Human
cuccccaaagccggucagcuccc

SEQ ID NO: 321859 - RNA, 18 nt, Human
cuccccagccccuuuggc

SEQ ID NO: 321860 - RNA, 20 nt, Human
cuccuccuccuccuccuccu

SEQ ID NO: 321861 - RNA, 19 nt, Human
cuccuugggccuccugggu

SEQ ID NO: 321862 - RNA, 24 nt, Human
cucguacacgcagccgaggcagcu

SEQ ID NO: 321863 - RNA, 19 nt, Human
cucuaucaucuccagccgc

SEQ ID NO: 321864 - RNA, 21 nt, Human
cucucugacgggggacuuggg

SEQ ID NO: 321865 - RNA, 18 nt, Human
cucuggaagggcugccuc

SEQ ID NO: 321866 - RNA, 26 nt, Human
cugagcccccuccauccuggccgggg

SEQ ID NO: 321867 - RNA, 20 nt, Human
cugagccgcugccugggugc

SEQ ID NO: 321868 - RNA, 19 nt, Human
cugagggcaggugggcauc

SEQ ID NO: 321869 - RNA, 22 nt, Human
cugcaccucggggagucgaacc

SEQ ID NO: 321870 - RNA, 19 nt, Human
cugcaccucuggaagccgc

SEQ ID NO: 321871 - RNA, 19 nt, Human
cugccaccucuaccuugcc

SEQ ID NO: 321872 - RNA, 20 nt, Human
cugccaccucuaccuugccu

SEQ ID NO: 321873 - RNA, 19 nt, Human
cugccagagagacaggagc

SEQ ID NO: 321874 - RNA, 21 nt, Human
cugcccucccuuccuccuggg

SEQ ID NO: 321875 - RNA, 18 nt, Human
cugccucagugucccggc

SEQ ID NO: 321876 - RNA, 20 nt, Human
cugccucugagccgcugccu

SEQ ID NO: 321877 - RNA, 21 nt, Human
cugccuguucugccuuggugg

SEQ ID NO: 321878 - RNA, 20 nt, Human
cugccuuagccaccuuuggc

SEQ ID NO: 321879 - RNA, 19 nt, Human
cuucucacccuccucggcc

SEQ ID NO: 321880 - RNA, 25 nt, Human
cuugcccauuuuagcggcugggacc

SEQ ID NO: 321881 - RNA, 22 nt, Human
cuuugggcagcugcaccucugg

SEQ ID NO: 321882 - RNA, 23 nt, Human
gaaccagcuucaguucugcaugg

SEQ ID NO: 321883 - RNA, 19 nt, Human
gaacuuggaagagggcuug

SEQ ID NO: 321884 - RNA, 19 nt, Human
gacccgaggccccuucccc

SEQ ID NO: 321885 - RNA, 21 nt, Human
gaccugggggacacccaccuc

SEQ ID NO: 321886 - RNA, 21 nt, Human
gagcccaaggguuggcaggug

SEQ ID NO: 321887 - RNA, 22 nt, Human
gagcccccuccauccuggccgg

SEQ ID NO: 321888 - RNA, 23 nt, Human
gagcccccuccauccuggccggg

SEQ ID NO: 321889 - RNA, 26 nt, Human
gagcuccugcagccaccucagccucc

SEQ ID NO: 321890 - RNA, 24 nt, Human
gaggcccagggagagaaacaacuu

SEQ ID NO: 321891 - RNA, 18 nt, Human
gagggcccugggcugggg

SEQ ID NO: 321892 - RNA, 18 nt, Human
gaguuuggggcagagagg

SEQ ID NO: 321893 - RNA, 23 nt, Human
gaucgagggcaggcagcaggccu

SEQ ID NO: 321894 - RNA, 24 nt, Human
gcacagccaccucugaccccuugg

SEQ ID NO: 321895 - RNA, 21 nt, Human
gcaccacuaccgacacagccc

SEQ ID NO: 321896 - RNA, 24 nt, Human
gcacuuccuccuaacaggagccca

SEQ ID NO: 321897 - RNA, 19 nt, Human
gcaucuugauggugggcag

SEQ ID NO: 321898 - RNA, 18 nt, Human
gcccaaaggaaggcaucu

SEQ ID NO: 321899 - RNA, 18 nt, Human
gcccagcggaggcauccu

SEQ ID NO: 321900 - RNA, 18 nt, Human
gcccugggcagcuucacc

SEQ ID NO: 321901 - RNA, 25 nt, Human
gcccuggucagucacccaccucccg

SEQ ID NO: 321902 - RNA, 23 nt, Human
gccgcggcccaaccagcuccacc

SEQ ID NO: 321903 - RNA, 23 nt, Human
gccucgcccgccugugccucucg

SEQ ID NO: 321904 - RNA, 20 nt, Human
gccucugaccccaaacuugg

SEQ ID NO: 321905 - RNA, 25 nt, Human
gccugccuccccagccccuuuggcc

SEQ ID NO: 321906 - RNA, 22 nt, Human
gccuuggggagcuucacuucag

SEQ ID NO: 321907 - RNA, 18 nt, Human
gcgggcaggggcagccgg

SEQ ID NO: 321908 - RNA, 18 nt, Human
gcuccaccucggggaucu

SEQ ID NO: 321909 - RNA, 20 nt, Human
gcuccuggcaggucuagcuc

SEQ ID NO: 321910 - RNA, 20 nt, Human
gcucgcccagcccccucagc

SEQ ID NO: 321911 - RNA, 22 nt, Human
gcucucccuugcccauuuuagc

SEQ ID NO: 321912 - RNA, 22 nt, Human
gcugcaccucggggaggugcac

SEQ ID NO: 321913 - RNA, 23 nt, Human
gcugccaccucagggcccuccac

SEQ ID NO: 321914 - RNA, 21 nt, Human
gcugccucagugucccggccu

SEQ ID NO: 321915 - RNA, 24 nt, Human
gcuugaccucaggagccuugggga

SEQ ID NO: 321916 - RNA, 18 nt, Human
ggagaacuuggaagaggg

SEQ ID NO: 321917 - RNA, 19 nt, Human
ggagcggcggcggccagcc

SEQ ID NO: 321918 - RNA, 22 nt, Human
ggcaccacuaccgacacagccc

SEQ ID NO: 321919 - RNA, 23 nt, Human
ggcagagaggaaggggcagaggg

SEQ ID NO: 321920 - RNA, 24 nt, Human
ggcagaggguggaauuagcuuggg

SEQ ID NO: 321921 - RNA, 22 nt, Human
ggcagagugggcagugagggca

SEQ ID NO: 321922 - RNA, 18 nt, Human
ggcagcucuaccucugga

SEQ ID NO: 321923 - RNA, 21 nt, Human
ggcaucuucagggccaccuca

SEQ ID NO: 321924 - RNA, 19 nt, Human
ggcuguggacaccuucagg

SEQ ID NO: 321925 - RNA, 19 nt, Human
gggaaacugaggcccaggg

SEQ ID NO: 321926 - RNA, 22 nt, Human
gggaagaguuuggggcagagag

SEQ ID NO: 321927 - RNA, 20 nt, Human
gggcagagaggaaggggccg

SEQ ID NO: 321928 - RNA, 21 nt, Human
gggcagaggguggaauuagcu

SEQ ID NO: 321929 - RNA, 21 nt, Human
gggcagccguaccuugagcuu

SEQ ID NO: 321930 - RNA, 19 nt, Human
gggcagcucuaccucugga

SEQ ID NO: 321931 - RNA, 20 nt, Human
ggggacccccagagccccag

SEQ ID NO: 321932 - RNA, 19 nt, Human
gggggaggagcggcggcgg

SEQ ID NO: 321933 - RNA, 18 nt, Human
gggggaugugcuggguca

SEQ ID NO: 321934 - RNA, 18 nt, Human
gggguacaggcacuccug

SEQ ID NO: 321935 - RNA, 19 nt, Human
ggugggucugucccccuuc

SEQ ID NO: 321936 - RNA, 19 nt, Human
uacaggcacuccugccaga

SEQ ID NO: 321937 - RNA, 21 nt, Human
uaccuugccugagggcaggug

SEQ ID NO: 321938 - RNA, 18 nt, Human
uacucugagccugcugcc

SEQ ID NO: 321939 - RNA, 23 nt, Human
uagggaguuucaucucugggacu

SEQ ID NO: 321940 - RNA, 18 nt, Human
ucacauggcuuggugggg

SEQ ID NO: 321941 - RNA, 19 nt, Human
ucaccauccaccucuggcu

SEQ ID NO: 321942 - RNA, 18 nt, Human
ucaccaugagugcccagg

SEQ ID NO: 321943 - RNA, 19 nt, Human
ucacccaccucccggcccu

SEQ ID NO: 321944 - RNA, 19 nt, Human
ucaggcaccuuuggaagcu

SEQ ID NO: 321945 - RNA, 18 nt, Human
uccaacucagccaccccu

SEQ ID NO: 321946 - RNA, 22 nt, Human
uccacccccacagucggugcug

SEQ ID NO: 321947 - RNA, 21 nt, Human
uccacccgcucucccuugccc

SEQ ID NO: 321948 - RNA, 21 nt, Human
uccacugaaggcagagugaga

SEQ ID NO: 321949 - RNA, 18 nt, Human
uccaggcugagcuguggg

SEQ ID NO: 321950 - RNA, 22 nt, Human
uccccacucccacuccgggccc

SEQ ID NO: 321951 - RNA, 20 nt, Human
uccgaggugggugagggccc

SEQ ID NO: 321952 - RNA, 21 nt, Human
uccgugggguucuugcugccu

SEQ ID NO: 321953 - RNA, 19 nt, Human
uccuuggcccgcaccaggc

SEQ ID NO: 321954 - RNA, 19 nt, Human
ucucaggcaccuuuggaag

SEQ ID NO: 321955 - RNA, 21 nt, Human
ucugcauggagcagcugccuc

SEQ ID NO: 321956 - RNA, 21 nt, Human
ucugcugagggggcagccuug

SEQ ID NO: 321957 - RNA, 18 nt, Human
ucugcugccucagugucc

SEQ ID NO: 321958 - RNA, 20 nt, Human
ugaaggcagagugagagagg

SEQ ID NO: 321959 - RNA, 19 nt, Human
ugaccccugcugccaccuc

SEQ ID NO: 321960 - RNA, 18 nt, Human
ugagagaggggacaccca

SEQ ID NO: 321961 - RNA, 19 nt, Human
ugaggcccagggagagaaa

SEQ ID NO: 321962 - RNA, 18 nt, Human
ugagggcaaggcaggcag

SEQ ID NO: 321963 - RNA, 19 nt, Human
ugagggcaaggcaggcagc

SEQ ID NO: 321964 - RNA, 23 nt, Human
ugcaccucuggaagccgcaccuc

SEQ ID NO: 321965 - RNA, 22 nt, Human
ugcagaaccagcuucaguucug

SEQ ID NO: 321966 - RNA, 19 nt, Human
ugccaccucuaccuugccu

SEQ ID NO: 321967 - RNA, 23 nt, Human
ugccagagagacaggagcaggcc

SEQ ID NO: 321968 - RNA, 18 nt, Human
ugcccagcggaggcaucc

SEQ ID NO: 321969 - RNA, 20 nt, Human
ugcccucccuuccuccuggg

SEQ ID NO: 321970 - RNA, 21 nt, Human
ugcccucuuccuccuccuccu

SEQ ID NO: 321971 - RNA, 19 nt, Human
ugccuugguggccuuuagc

SEQ ID NO: 321972 - RNA, 27 nt, Human
ugcugagggggcagccuugggggcuga

SEQ ID NO: 321973 - RNA, 22 nt, Human
uggcaagcggacccggacccuc

SEQ ID NO: 321974 - RNA, 24 nt, Human
uggcacagccaccucugacaccuc

SEQ ID NO: 321975 - RNA, 18 nt, Human
uggcaccuuugggaguuu

SEQ ID NO: 321976 - RNA, 18 nt, Human
uggcaccuuugggaguuu

SEQ ID NO: 321977 - RNA, 21 nt, Human
uggcaccuuugggaguuucau

SEQ ID NO: 321978 - RNA, 21 nt, Human
uggcaccuuugggaguuucau

SEQ ID NO: 321979 - RNA, 21 nt, Human
uggcaccuuugggaguuucau

SEQ ID NO: 321980 - RNA, 18 nt, Human
uggcccacgauggcgggg

SEQ ID NO: 321981 - RNA, 23 nt, Human
uggcccccagugugggcaacuuc

SEQ ID NO: 321982 - RNA, 18 nt, Human
uggccucagccucagccc

SEQ ID NO: 321983 - RNA, 18 nt, Human
uggcuguggacaccuuca

SEQ ID NO: 321984 - RNA, 23 nt, Human
uggcuguggacaccuucaggccu

SEQ ID NO: 321985 - RNA, 20 nt, Human
ugggaggcugggaguggaca

SEQ ID NO: 321986 - RNA, 22 nt, Human
ugggaggcugggaguggacagg

SEQ ID NO: 321987 - RNA, 22 nt, Human
ugggcagcucuaccucuggaag

SEQ ID NO: 321988 - RNA, 21 nt, Human
ugggcagcugcaccucuggga

SEQ ID NO: 321989 - RNA, 18 nt, Human
ugggcauggucaucuugg

SEQ ID NO: 321990 - RNA, 21 nt, Human
uggggagagcaaaccugggcc

SEQ ID NO: 321991 - RNA, 23 nt, Human
uggggaguuucaucucugagacu

SEQ ID NO: 321992 - RNA, 24 nt, Human
uggggcagagaggaaggggcagag

SEQ ID NO: 321993 - RNA, 23 nt, Human
uggggugacaauuucaacagagg

SEQ ID NO: 321994 - RNA, 20 nt, Human
uguccagggccacucagcag

SEQ ID NO: 321995 - RNA, 21 nt, Human
uuagggaguuucaucucuggg

SEQ ID NO: 321996 - RNA, 23 nt, Human
uucacccucccaucccagcccca

SEQ ID NO: 321997 - RNA, 24 nt, Human
uucagggccaccucaggugccucu

SEQ ID NO: 321998 - RNA, 20 nt, Human
uucccggggaagaguuuggg

SEQ ID NO: 321999 - RNA, 20 nt, Human
uuccuccuccuccuccuccu

SEQ ID NO: 322000 - RNA, 22 nt, Human
uuccugguccccacucccacuc

SEQ ID NO: 322001 - RNA, 23 nt, Human
uuccugguccccacucccacucc

SEQ ID NO: 322002 - RNA, 21 nt, Human
uucuagauccugauccgggau

SEQ ID NO: 322003 - RNA, 23 nt, Human
uucugcugcagaaccagcuucag

SEQ ID NO: 322004 - RNA, 22 nt, Human
uugccugucauuucaccaugaa

SEQ ID NO: 322005 - RNA, 23 nt, Human
uuucacagacuuugggcagcugc

SEQ ID NO: 322006 - RNA, 18 nt, Human
uuucggcagcugcaccuc

SEQ ID NO: 322007 - RNA, 18 nt, Human
uuucggcagcugcaccuc

SEQ ID NO: 322008 - RNA, 24 nt, Human
uuucugcugcagaaccagcuucag

SEQ ID NO: 322009 - RNA, 22 nt, Human
uuugggcagcucuaccucugga

SEQ ID NO: 322010 - RNA, 19 nt, Human
uuuggggcagagaggaagg

SEQ ID NO: 322011 - RNA, 20 nt, Human
uuuggggcagagaggaaggg

SEQ ID NO: 322012 - RNA, 24 nt, Human
agacaaaagcuuuuugguuuuaau

SEQ ID NO: 322013 - RNA, 21 nt, Human
agagcugggcccggcugcagg

SEQ ID NO: 322014 - RNA, 21 nt, Human
agcggccccgggggggccggc

SEQ ID NO: 322015 - RNA, 26 nt, Human
aggggccucaacagccucgugggcuc

SEQ ID NO: 322016 - RNA, 23 nt, Human
cacccagggaggcgucugggucc

SEQ ID NO: 322017 - RNA, 19 nt, Human
cccaaccccuccaaggguu

SEQ ID NO: 322018 - RNA, 19 nt, Human
cccgcgagcggccccgggg

SEQ ID NO: 322019 - RNA, 19 nt, Human
cuuccggcccaaccccucc

SEQ ID NO: 322020 - RNA, 19 nt, Human
gacagaagagcugggcccg

SEQ ID NO: 322021 - RNA, 19 nt, Human
ggagaaggucacuuccugg

SEQ ID NO: 322022 - RNA, 22 nt, Human
ucuauugcuguccacccaggga

SEQ ID NO: 322023 - RNA, 24 nt, Human
ucugguggccaaggacagaagagc

SEQ ID NO: 322024 - RNA, 23 nt, Human
ugcccccuuuucuauugcuguua

SEQ ID NO: 322025 - RNA, 19 nt, Human
uggguccuggugggacugg

SEQ ID NO: 322026 - RNA, 22 nt, Human
uuaauacacaaacuaaaugagg

SEQ ID NO: 322027 - RNA, 20 nt, Human
uuccugggcgucugcccccu

SEQ ID NO: 322028 - RNA, 25 nt, Human
uuccugggcgucugcccccuuuucu

SEQ ID NO: 322029 - RNA, 18 nt, Human
uuucuuaaagacaaaagc

SEQ ID NO: 322030 - RNA, 23 nt, Human
uuuuugguuuuaauacacaaacu

SEQ ID NO: 322031 - RNA, 24 nt, Human
aagcaugaaaaaaaguguuguugg

SEQ ID NO: 322032 - RNA, 18 nt, Human
aagccgcggccacucuug

SEQ ID NO: 322033 - RNA, 19 nt, Human
aaggucagaauuggaggcc

SEQ ID NO: 322034 - RNA, 24 nt, Human
accaggugacuuguagcaacggcc

SEQ ID NO: 322035 - RNA, 24 nt, Human
agaaacaagcccagaucaucugca

SEQ ID NO: 322036 - RNA, 19 nt, Human
auuuuauucaugucucucu

SEQ ID NO: 322037 - RNA, 26 nt, Human
cacuuuuguaaggucagaauuggagg

SEQ ID NO: 322038 - RNA, 19 nt, Human
cagugccccuccucaguuc

SEQ ID NO: 322039 - RNA, 21 nt, Human
cauccugggucucucagaagc

SEQ ID NO: 322040 - RNA, 20 nt, Human
ccagaaucucugccagaaac

SEQ ID NO: 322041 - RNA, 20 nt, Human
ccagggcugggaaguaaggc

SEQ ID NO: 322042 - RNA, 20 nt, Human
ccauguacucuccugggagg

SEQ ID NO: 322043 - RNA, 23 nt, Human
cccgaccccaggugucccaaagc

SEQ ID NO: 322044 - RNA, 21 nt, Human
ccucaugguggacccgacccc

SEQ ID NO: 322045 - RNA, 20 nt, Human
ccugggucucucagaagcuc

SEQ ID NO: 322046 - RNA, 24 nt, Human
cgccucuccuuucucuguaccaga

SEQ ID NO: 322047 - RNA, 19 nt, Human
cggccacucuugggcgggu

SEQ ID NO: 322048 - RNA, 23 nt, Human
cgugguuccacucagcgccucuc

SEQ ID NO: 322049 - RNA, 20 nt, Human
cucaaugccauguacucucc

SEQ ID NO: 322050 - RNA, 18 nt, Human
cuccccuggccucagccc

SEQ ID NO: 322051 - RNA, 18 nt, Human
cucuugaccucacugcau

SEQ ID NO: 322052 - RNA, 22 nt, Human
cucuugggauuguugaggccca

SEQ ID NO: 322053 - RNA, 24 nt, Human
cugcaucccuucauccugggucuc

SEQ ID NO: 322054 - RNA, 21 nt, Human
cugguguggugugcuccucuu

SEQ ID NO: 322055 - RNA, 23 nt, Human
gaagcucucucagacugaccuuu

SEQ ID NO: 322056 - RNA, 24 nt, Human
ggaaguaaggcccagggcagugcc

SEQ ID NO: 322057 - RNA, 18 nt, Human
ggccacucuugggcgggu

SEQ ID NO: 322058 - RNA, 19 nt, Human
gucuuuuccucacuuggcc

SEQ ID NO: 322059 - RNA, 18 nt, Human
ucaacuacuuuaguucuc

SEQ ID NO: 322060 - RNA, 23 nt, Human
ucacugcaucccuucauccuggg

SEQ ID NO: 322061 - RNA, 21 nt, Human
ucagaagcucucucagacuga

SEQ ID NO: 322062 - RNA, 19 nt, Human
ucagugaaagaagguuggg

SEQ ID NO: 322063 - RNA, 22 nt, Human
ucccuucauccugggucucuca

SEQ ID NO: 322064 - RNA, 21 nt, Human
uccugggucucucagaagcuc

SEQ ID NO: 322065 - RNA, 23 nt, Human
uccugggucucucagaagcucuc

SEQ ID NO: 322066 - RNA, 23 nt, Human
ucucaaugccauguacucuccug

SEQ ID NO: 322067 - RNA, 22 nt, Human
ucucugaguccuuagagguggg

SEQ ID NO: 322068 - RNA, 20 nt, Human
ucucuugggauuguugaggc

SEQ ID NO: 322069 - RNA, 25 nt, Human
ucuguaccagaaucucugccagaaa

SEQ ID NO: 322070 - RNA, 19 nt, Human
ugaaagaagguugggcucu

SEQ ID NO: 322071 - RNA, 22 nt, Human
ugaaagaagguugggcucuuga

SEQ ID NO: 322072 - RNA, 21 nt, Human
ugcaaaccacacuuugguagc

SEQ ID NO: 322073 - RNA, 18 nt, Human
ugccagaaacaagcccag

SEQ ID NO: 322074 - RNA, 24 nt, Human
ugccagaaacaagcccagaucauc

SEQ ID NO: 322075 - RNA, 21 nt, Human
ugccauguacucuccugggag

SEQ ID NO: 322076 - RNA, 21 nt, Human
uggaggccagggcugggaagu

SEQ ID NO: 322077 - RNA, 18 nt, Human
ugggaaguaaggcccagg

SEQ ID NO: 322078 - RNA, 24 nt, Human
ugggcucuugaccucacugcaucc

SEQ ID NO: 322079 - RNA, 18 nt, Human
ugggucucucagaagcuc

SEQ ID NO: 322080 - RNA, 22 nt, Human
uggugugcuccucuucgcguac

SEQ ID NO: 322081 - RNA, 24 nt, Human
uguuggagguugugaugucucccc

SEQ ID NO: 322082 - RNA, 24 nt, Human
uuggagguugugaugucuccccug

SEQ ID NO: 322083 - RNA, 22 nt, Human
uuguuggagguugugaugucuc

SEQ ID NO: 322084 - RNA, 26 nt, Human
aaaaacaaccaaccaaucaacuuucu

SEQ ID NO: 322085 - RNA, 18 nt, Human
aaaaagaggaaggcgaag

SEQ ID NO: 322086 - RNA, 26 nt, Human
aaaacaaccaaccaaucaacuuucuc

SEQ ID NO: 322087 - RNA, 18 nt, Human
aaaaguagcagcaaaggc

SEQ ID NO: 322088 - RNA, 25 nt, Human
aaacaaccaaccaaucaacuuucuc

SEQ ID NO: 322089 - RNA, 21 nt, Human
aaagaaugguaaaaaugaauc

SEQ ID NO: 322090 - RNA, 18 nt, Human
agacuggggaggggguac

SEQ ID NO: 322091 - RNA, 23 nt, Human
agaggaaggcgaagacuggggag

SEQ ID NO: 322092 - RNA, 19 nt, Human
agagggccccccuacccuc

SEQ ID NO: 322093 - RNA, 23 nt, Human
agccgcugaacccaggagacccc

SEQ ID NO: 322094 - RNA, 22 nt, Human
aggaaggcgaagacuggggagg

SEQ ID NO: 322095 - RNA, 23 nt, Human
aggaaggcgaagacuggggaggg

SEQ ID NO: 322096 - RNA, 22 nt, Human
aguagcagcaaaggcaaaauac

SEQ ID NO: 322097 - RNA, 25 nt, Human
agugucuacauauaucagugauaac

SEQ ID NO: 322098 - RNA, 22 nt, Human
auaaacauauauaaaguauguc

SEQ ID NO: 322099 - RNA, 19 nt, Human
aucugcaauaaacauguuc

SEQ ID NO: 322100 - RNA, 23 nt, Human
caaggaggaccgaacgcgugaac

SEQ ID NO: 322101 - RNA, 18 nt, Human
cagcaccuagagggcccc

SEQ ID NO: 322102 - RNA, 24 nt, Human
cagccgcugaacccaggagacccc

SEQ ID NO: 322103 - RNA, 18 nt, Human
caggagaccccacagaug

SEQ ID NO: 322104 - RNA, 18 nt, Human
ccaaggaggaccgaacgc

SEQ ID NO: 322105 - RNA, 20 nt, Human
ccgcugaacccaggagaccc

SEQ ID NO: 322106 - RNA, 23 nt, Human
cgccuggcacucuuaaaccacuc

SEQ ID NO: 322107 - RNA, 24 nt, Human
gaagacuggggaggggguacaacu

SEQ ID NO: 322108 - RNA, 20 nt, Human
gacauuaggucccaccagcu

SEQ ID NO: 322109 - RNA, 27 nt, Human
gcauaauugaaaaacaaccaaccaauc

SEQ ID NO: 322110 - RNA, 26 nt, Human
gcgaagacuggggaggggguacaacu

SEQ ID NO: 322111 - RNA, 19 nt, Human
ggcuggcguuccuggcccu

SEQ ID NO: 322112 - RNA, 19 nt, Human
ggggaaagacuuuucagca

SEQ ID NO: 322113 - RNA, 20 nt, Human
gugcggcggcgagggcggug

SEQ ID NO: 322114 - RNA, 23 nt, Human
uaaauguauagaaauauaaagua

SEQ ID NO: 322115 - RNA, 19 nt, Human
uacagaguuguggauguuu

SEQ ID NO: 322116 - RNA, 18 nt, Human
uagagggccccccuaccc

SEQ ID NO: 322117 - RNA, 18 nt, Human
uagcagcaaaggcaaaag

SEQ ID NO: 322118 - RNA, 23 nt, Human
uccccaaguuacuuuaaacuuug

SEQ ID NO: 322119 - RNA, 20 nt, Human
ugaaaaacaaccaaccaauc

SEQ ID NO: 322120 - RNA, 21 nt, Human
ugaaaaacaaccaaccaauca

SEQ ID NO: 322121 - RNA, 19 nt, Human
ugcggcggcgagggcggug

SEQ ID NO: 322122 - RNA, 24 nt, Human
ugcuguguguucccaugacuccag

SEQ ID NO: 322123 - RNA, 22 nt, Human
uggaaugcuauaaugcacaagg

SEQ ID NO: 322124 - RNA, 21 nt, Human
uggcacucuuaaaccacuccu

SEQ ID NO: 322125 - RNA, 21 nt, Human
uuaaaccacuccuccaauggu

SEQ ID NO: 322126 - RNA, 19 nt, Human
uugaaaaacaaccaaccaa

SEQ ID NO: 322127 - RNA, 24 nt, Human
uuguucuuucaaaaaagaagaauc

SEQ ID NO: 322128 - RNA, 21 nt, Human
uuuguuagaaaagcaacaaga

SEQ ID NO: 322129 - RNA, 21 nt, Human
uuuuaggacuuuaauguucuu

SEQ ID NO: 322130 - RNA, 24 nt, Human
uuuuuuuuuuuuuuuagauguuuu

SEQ ID NO: 322131 - RNA, 22 nt, Human
aaaaagccugauuauuccaggc

SEQ ID NO: 322132 - RNA, 22 nt, Human
aacaaggcaucaccaggaaaga

SEQ ID NO: 322133 - RNA, 20 nt, Human
aaccccaaacaaggcaucac

SEQ ID NO: 322134 - RNA, 23 nt, Human
aacccuuggccccacugaugucc

SEQ ID NO: 322135 - RNA, 23 nt, Human
aagaaacuguggcucaugccagc

SEQ ID NO: 322136 - RNA, 24 nt, Human
aagaccuccagugcaucaacaucc

SEQ ID NO: 322137 - RNA, 24 nt, Human
aagcacaugucagggcucagaaca

SEQ ID NO: 322138 - RNA, 19 nt, Human
aagccaccagcagcugcuu

SEQ ID NO: 322139 - RNA, 26 nt, Human
acagaaccccaaacaaggcaucacca

SEQ ID NO: 322140 - RNA, 23 nt, Human
accagcagcugcuuccaaaaucc

SEQ ID NO: 322141 - RNA, 19 nt, Human
acccaaacccacagaaccc

SEQ ID NO: 322142 - RNA, 23 nt, Human
acccaaacccacagaaccccaaa

SEQ ID NO: 322143 - RNA, 21 nt, Human
accccagcauccaauccacac

SEQ ID NO: 322144 - RNA, 21 nt, Human
acccccacaccccagcaucca

SEQ ID NO: 322145 - RNA, 23 nt, Human
agaaaugggggaggugggggagc

SEQ ID NO: 322146 - RNA, 20 nt, Human
agagagaaaaggggcacuga

SEQ ID NO: 322147 - RNA, 18 nt, Human
agcagagagaaaaggggc

SEQ ID NO: 322148 - RNA, 23 nt, Human
aggaaagacacgggaaagccaaa

SEQ ID NO: 322149 - RNA, 20 nt, Human
aggaggccaccucagaagcc

SEQ ID NO: 322150 - RNA, 21 nt, Human
caaacccacagaaccccaaac

SEQ ID NO: 322151 - RNA, 22 nt, Human
caaaucacaguugaaccaggga

SEQ ID NO: 322152 - RNA, 23 nt, Human
caacauccaucuagcagagagaa

SEQ ID NO: 322153 - RNA, 24 nt, Human
caacauccaucuagcagagagaaa

SEQ ID NO: 322154 - RNA, 21 nt, Human
caacccccacaccccagcauc

SEQ ID NO: 322155 - RNA, 22 nt, Human
caacccccacaccccagcaucc

SEQ ID NO: 322156 - RNA, 23 nt, Human
caacccccacaccccagcaucca

SEQ ID NO: 322157 - RNA, 21 nt, Human
caagaggguugauggccucca

SEQ ID NO: 322158 - RNA, 22 nt, Human
cacacaaguagaaaaaaaccaa

SEQ ID NO: 322159 - RNA, 23 nt, Human
cacagaaacuuuagugcaaaaca

SEQ ID NO: 322160 - RNA, 18 nt, Human
cacagaaccccaaacaag

SEQ ID NO: 322161 - RNA, 18 nt, Human
cacaugucagggcucaga

SEQ ID NO: 322162 - RNA, 23 nt, Human
caccagcagcugcuuccaaaauc

SEQ ID NO: 322163 - RNA, 18 nt, Human
cacccaaacccacagaac

SEQ ID NO: 322164 - RNA, 21 nt, Human
cagaaccccaaacaaggcauc

SEQ ID NO: 322165 - RNA, 22 nt, Human
cagaaccccaaacaaggcauca

SEQ ID NO: 322166 - RNA, 21 nt, Human
cagacacacaaguagaaaaaa

SEQ ID NO: 322167 - RNA, 18 nt, Human
cagagcucucuccuccuc

SEQ ID NO: 322168 - RNA, 19 nt, Human
cagccagggacauguaggc

SEQ ID NO: 322169 - RNA, 22 nt, Human
cagcuuccaacccccacacccc

SEQ ID NO: 322170 - RNA, 23 nt, Human
caggaaagacacgggaaagccaa

SEQ ID NO: 322171 - RNA, 22 nt, Human
caggcuaaaagaccuccagugc

SEQ ID NO: 322172 - RNA, 26 nt, Human
cagggacagagaacccuuggccccac

SEQ ID NO: 322173 - RNA, 23 nt, Human
cagugcaucaacauccaucuagc

SEQ ID NO: 322174 - RNA, 26 nt, Human
caucaccaggaaagacacgggaaagg

SEQ ID NO: 322175 - RNA, 22 nt, Human
cauuuaaaaagccugauuauuc

SEQ ID NO: 322176 - RNA, 23 nt, Human
ccaaacccacagaaccccaaaca

SEQ ID NO: 322177 - RNA, 24 nt, Human
ccacacccagcagacccuucggca

SEQ ID NO: 322178 - RNA, 21 nt, Human
ccacaccccagcauccaaucc

SEQ ID NO: 322179 - RNA, 21 nt, Human
ccacccaaacccacagaaccc

SEQ ID NO: 322180 - RNA, 23 nt, Human
ccagcauccaauccacacccagc

SEQ ID NO: 322181 - RNA, 24 nt, Human
cccaaacccacagaaccccaaaca

SEQ ID NO: 322182 - RNA, 22 nt, Human
cccaagugggccacagacagcu

SEQ ID NO: 322183 - RNA, 25 nt, Human
cccaagugggccacagacagcuucc

SEQ ID NO: 322184 - RNA, 22 nt, Human
cccacaccccagcauccaaucc

SEQ ID NO: 322185 - RNA, 23 nt, Human
cccacagaaccccaaacaaggca

SEQ ID NO: 322186 - RNA, 21 nt, Human
cccacccaaacccacagaacc

SEQ ID NO: 322187 - RNA, 20 nt, Human
cccagcauccaauccacacc

SEQ ID NO: 322188 - RNA, 20 nt, Human
ccccacaccccagcauccaa

SEQ ID NO: 322189 - RNA, 21 nt, Human
ccccacaccccagcauccaau

SEQ ID NO: 322190 - RNA, 21 nt, Human
ccccagcauccaauccacacc

SEQ ID NO: 322191 - RNA, 19 nt, Human
ccucagaagcccaggccca

SEQ ID NO: 322192 - RNA, 23 nt, Human
ccugaucagggcaggaggccacc

SEQ ID NO: 322193 - RNA, 21 nt, Human
cgagcaggcacagcgcggcca

SEQ ID NO: 322194 - RNA, 21 nt, Human
cuacaauaaaggacacagaaa

SEQ ID NO: 322195 - RNA, 23 nt, Human
cuaccaggaagccagaggccuag

SEQ ID NO: 322196 - RNA, 22 nt, Human
cucagaagcccaggcccaccag

SEQ ID NO: 322197 - RNA, 19 nt, Human
cugcuuccaaaaucccuau

SEQ ID NO: 322198 - RNA, 22 nt, Human
cugugcguucauucccccagac

SEQ ID NO: 322199 - RNA, 25 nt, Human
cuuccaacccccacaccccagcauc

SEQ ID NO: 322200 - RNA, 19 nt, Human
gaaaaaaaccaaugcugug

SEQ ID NO: 322201 - RNA, 19 nt, Human
gaacaaggccucaaccaag

SEQ ID NO: 322202 - RNA, 20 nt, Human
gacacacaaguagaaaaaaa

SEQ ID NO: 322203 - RNA, 18 nt, Human
gacccuucggcaugccgc

SEQ ID NO: 322204 - RNA, 21 nt, Human
gagaacccuuggccccacuga

SEQ ID NO: 322205 - RNA, 20 nt, Human
gagcaggcacagcgcggcca

SEQ ID NO: 322206 - RNA, 19 nt, Human
gagcaucuaugagacaagg

SEQ ID NO: 322207 - RNA, 21 nt, Human
gaucugugcguucauuccccc

SEQ ID NO: 322208 - RNA, 23 nt, Human
gcaaaacaaaaaucacgaagucc

SEQ ID NO: 322209 - RNA, 19 nt, Human
gcagcgccucaacagccag

SEQ ID NO: 322210 - RNA, 19 nt, Human
gcccaggcccaccagugcc

SEQ ID NO: 322211 - RNA, 20 nt, Human
ggggagggucccugaucagg

SEQ ID NO: 322212 - RNA, 23 nt, Human
ggggaggugggggagcccuauuu

SEQ ID NO: 322213 - RNA, 21 nt, Human
uagaaaaaaaccaaugcuggu

SEQ ID NO: 322214 - RNA, 22 nt, Human
uagaaaaaaaccaaugcugugg

SEQ ID NO: 322215 - RNA, 24 nt, Human
uaggggcucccuugcagacagcaa

SEQ ID NO: 322216 - RNA, 24 nt, Human
uccaauccacacccagcagacccu

SEQ ID NO: 322217 - RNA, 25 nt, Human
ucccuugcagacagcaaugcuacaa

SEQ ID NO: 322218 - RNA, 22 nt, Human
uccugcuggcuuugcuugcugu

SEQ ID NO: 322219 - RNA, 21 nt, Human
ucuccuggcaaccagaagugg

SEQ ID NO: 322220 - RNA, 21 nt, Human
ucuucccacccaaacccacag

SEQ ID NO: 322221 - RNA, 20 nt, Human
ugaaaaggucaaaaggagca

SEQ ID NO: 322222 - RNA, 25 nt, Human
ugaagcagcuaugucugccaggggc

SEQ ID NO: 322223 - RNA, 23 nt, Human
ugagacaagggaggggugcaggc

SEQ ID NO: 322224 - RNA, 20 nt, Human
ugcaaaacaaaaaucacgaa

SEQ ID NO: 322225 - RNA, 18 nt, Human
ugcagacagcaaugcuac

SEQ ID NO: 322226 - RNA, 18 nt, Human
ugccaagauggaauauuc

SEQ ID NO: 322227 - RNA, 22 nt, Human
ugccaagauggaauauuccucc

SEQ ID NO: 322228 - RNA, 21 nt, Human
ugccaggggcuaggggcuccc

SEQ ID NO: 322229 - RNA, 22 nt, Human
ugccaggggcuaggggcucccu

SEQ ID NO: 322230 - RNA, 21 nt, Human
ugccuuuguuuugcugcuuug

SEQ ID NO: 322231 - RNA, 19 nt, Human
uggcccucuucccacccaa

SEQ ID NO: 322232 - RNA, 20 nt, Human
ugggggaggugggggagccc

SEQ ID NO: 322233 - RNA, 20 nt, Human
ugucccaagccaccagcagc

SEQ ID NO: 322234 - RNA, 22 nt, Human
uucauguccugcuggcuuugcu

SEQ ID NO: 322235 - RNA, 18 nt, Human
aaaaaggcauauaaaagc

SEQ ID NO: 322236 - RNA, 19 nt, Human
aaacaguggcuuucuagaa

SEQ ID NO: 322237 - RNA, 18 nt, Human
acaguggcuuucuagaac

SEQ ID NO: 322238 - RNA, 18 nt, Human
acugccucccugccacgc

SEQ ID NO: 322239 - RNA, 18 nt, Human
agcagcagcuugcaccgc

SEQ ID NO: 322240 - RNA, 18 nt, Human
agcagcuugcaccgcagg

SEQ ID NO: 322241 - RNA, 18 nt, Human
agcagcuugcacugcagg

SEQ ID NO: 322242 - RNA, 21 nt, Human
aggcauauaaaagcuauaauc

SEQ ID NO: 322243 - RNA, 19 nt, Human
caccgcagggcgacugccu

SEQ ID NO: 322244 - RNA, 22 nt, Human
caccgcagggcgacugccuccc

SEQ ID NO: 322245 - RNA, 19 nt, Human
cacugcagggcgaccaccu

SEQ ID NO: 322246 - RNA, 21 nt, Human
cagcuugcaccgcagggcgac

SEQ ID NO: 322247 - RNA, 21 nt, Human
cagcuugcacugcagggcgac

SEQ ID NO: 322248 - RNA, 23 nt, Human
ccacgguacgcucuggagcagca

SEQ ID NO: 322249 - RNA, 23 nt, Human
ccacgguaugcucuggagcagca

SEQ ID NO: 322250 - RNA, 25 nt, Human
cccaggaccccagccacggcacgag

SEQ ID NO: 322251 - RNA, 21 nt, Human
ccgcagggcgacugccucccu

SEQ ID NO: 322252 - RNA, 24 nt, Human
ccugggccacgguaugcucuggag

SEQ ID NO: 322253 - RNA, 22 nt, Human
cgaccaccucccaggaccccag

SEQ ID NO: 322254 - RNA, 20 nt, Human
cggaggggccgcccgcggug

SEQ ID NO: 322255 - RNA, 21 nt, Human
cuaaaaauacuacuguuagaa

SEQ ID NO: 322256 - RNA, 19 nt, Human
cugcagggcgaccaccucc

SEQ ID NO: 322257 - RNA, 18 nt, Human
cugccucccugccacgcc

SEQ ID NO: 322258 - RNA, 18 nt, Human
cugccucccugccacgcc

SEQ ID NO: 322259 - RNA, 25 nt, Human
gacugccucccugccacgccuuccg

SEQ ID NO: 322260 - RNA, 19 nt, Human
gagcagcagcuugcaccgc

SEQ ID NO: 322261 - RNA, 19 nt, Human
gagcagcagcuugcacugc

SEQ ID NO: 322262 - RNA, 18 nt, Human
gcucuggagcagcagcuu

SEQ ID NO: 322263 - RNA, 19 nt, Human
uaaaacaguggcuuucuag

SEQ ID NO: 322264 - RNA, 21 nt, Human
uacgcucuggagcagcagcuu

SEQ ID NO: 322265 - RNA, 26 nt, Human
uagaacgguuaauacugccccgagug

SEQ ID NO: 322266 - RNA, 19 nt, Human
ucccaggaccccagccacg

SEQ ID NO: 322267 - RNA, 23 nt, Human
ucugcuguggagacagcggaagc

SEQ ID NO: 322268 - RNA, 24 nt, Human
ucugggccacgguacgcucuggag

SEQ ID NO: 322269 - RNA, 19 nt, Human
ucuuucugcugggguuggg

SEQ ID NO: 322270 - RNA, 19 nt, Human
uggcaugguacgaaugagg

SEQ ID NO: 322271 - RNA, 25 nt, Human
uguuuugcuauaaaacaguggcuuu

SEQ ID NO: 322272 - RNA, 20 nt, Human
uucugcugggguugggucuu

SEQ ID NO: 322273 - RNA, 23 nt, Human
aaccacagugcacgaaacucucc

SEQ ID NO: 322274 - RNA, 20 nt, Human
aagagccuugccagggagaa

SEQ ID NO: 322275 - RNA, 19 nt, Human
acucugagcccacugcagc

SEQ ID NO: 322276 - RNA, 19 nt, Human
acugcagcucccacccacc

SEQ ID NO: 322277 - RNA, 25 nt, Human
agaacagccacuuaugcccagaaaa

SEQ ID NO: 322278 - RNA, 18 nt, Human
agcacagggcuagcaggg

SEQ ID NO: 322279 - RNA, 23 nt, Human
agcucccacccacccuccugagc

SEQ ID NO: 322280 - RNA, 20 nt, Human
agcugaggaccagagagggg

SEQ ID NO: 322281 - RNA, 22 nt, Human
aggaagcugaggaccagagagg

SEQ ID NO: 322282 - RNA, 23 nt, Human
aggaagucaguccuggcccacgg

SEQ ID NO: 322283 - RNA, 23 nt, Human
aggaguuuuauucucucuuugga

SEQ ID NO: 322284 - RNA, 21 nt, Human
aggcagagagggccaagccca

SEQ ID NO: 322285 - RNA, 22 nt, Human
aggcagagcugggacugagcuc

SEQ ID NO: 322286 - RNA, 19 nt, Human
aggcgaccacauuuccugu

SEQ ID NO: 322287 - RNA, 24 nt, Human
agugcacuggggugggaggugggu

SEQ ID NO: 322288 - RNA, 27 nt, Human
augacucccagaacagccacuuaugcc

SEQ ID NO: 322289 - RNA, 20 nt, Human
auguggggguggguggggac

SEQ ID NO: 322290 - RNA, 24 nt, Human
caagcccaacccgaggacagggga

SEQ ID NO: 322291 - RNA, 22 nt, Human
cagagagcgccuucagagccga

SEQ ID NO: 322292 - RNA, 19 nt, Human
cagcaaugaugucuguggc

SEQ ID NO: 322293 - RNA, 19 nt, Human
cagcaaugaugucuguggc

SEQ ID NO: 322294 - RNA, 18 nt, Human
cagcauucuggggcuggu

SEQ ID NO: 322295 - RNA, 19 nt, Human
cagcauucuggggcugguu

SEQ ID NO: 322296 - RNA, 19 nt, Human
cagcgagucagaggcagag

SEQ ID NO: 322297 - RNA, 19 nt, Human
cagcucccacccacccucc

SEQ ID NO: 322298 - RNA, 20 nt, Human
cagcucgagguaacggggaa

SEQ ID NO: 322299 - RNA, 23 nt, Human
caggcuccuagggcagugcuccc

SEQ ID NO: 322300 - RNA, 22 nt, Human
cagugcuccuuccaccaccccu

SEQ ID NO: 322301 - RNA, 21 nt, Human
caguuuugcaagaacuagaga

SEQ ID NO: 322302 - RNA, 21 nt, Human
ccacccacccuccugagcucu

SEQ ID NO: 322303 - RNA, 23 nt, Human
ccacggccccuccuacguugagg

SEQ ID NO: 322304 - RNA, 21 nt, Human
ccagaaaauccaugaucccau

SEQ ID NO: 322305 - RNA, 28 nt, Human
ccagggagaagaaucacuuagggacccc

SEQ ID NO: 322306 - RNA, 22 nt, Human
cccacugcagcucccacccacc

SEQ ID NO: 322307 - RNA, 23 nt, Human
cccagaaaauccaugaucccauc

SEQ ID NO: 322308 - RNA, 24 nt, Human
ccccgcccagcccuguguggggag

SEQ ID NO: 322309 - RNA, 24 nt, Human
ccccuagcccagugcuccuuccac

SEQ ID NO: 322310 - RNA, 23 nt, Human
cccgggguucugucccggggucc

SEQ ID NO: 322311 - RNA, 24 nt, Human
ccgucauuuucuugagggucccac

SEQ ID NO: 322312 - RNA, 18 nt, Human
ccgugggucugagcugug

SEQ ID NO: 322313 - RNA, 21 nt, Human
ccugcagacgcccaacccaga

SEQ ID NO: 322314 - RNA, 21 nt, Human
ccugcagcugggugcccaggc

SEQ ID NO: 322315 - RNA, 22 nt, Human
ccugccaaggaauuucccucca

SEQ ID NO: 322316 - RNA, 21 nt, Human
ccuuccaccaccccuggcugc

SEQ ID NO: 322317 - RNA, 19 nt, Human
cgggcuggcccggcaagga

SEQ ID NO: 322318 - RNA, 22 nt, Human
cuccagagacaggagucucacc

SEQ ID NO: 322319 - RNA, 22 nt, Human
cucccacccacccuccugagcu

SEQ ID NO: 322320 - RNA, 26 nt, Human
cucccagaacagccacuuaugcccag

SEQ ID NO: 322321 - RNA, 23 nt, Human
cuccccagcaacguugaauccgg

SEQ ID NO: 322322 - RNA, 20 nt, Human
cuccuccaggccaggccucc

SEQ ID NO: 322323 - RNA, 20 nt, Human
cuccuuccaccaccccuggc

SEQ ID NO: 322324 - RNA, 20 nt, Human
cucuggcugcucuccucacc

SEQ ID NO: 322325 - RNA, 20 nt, Human
cucuuuggaaugacucccag

SEQ ID NO: 322326 - RNA, 21 nt, Human
cugccuccaggcggcccuccu

SEQ ID NO: 322327 - RNA, 21 nt, Human
cugcuguucgggcuggcccgg

SEQ ID NO: 322328 - RNA, 23 nt, Human
cuggagcacagggcuagcagggg

SEQ ID NO: 322329 - RNA, 19 nt, Human
cuggcaguggggcagaggc

SEQ ID NO: 322330 - RNA, 21 nt, Human
cuggcccacgggggucucgug

SEQ ID NO: 322331 - RNA, 22 nt, Human
cuggggcugguuuuccucuggc

SEQ ID NO: 322332 - RNA, 23 nt, Human
cuggggcugguuuuccucuggcu

SEQ ID NO: 322333 - RNA, 23 nt, Human
cuuagggaccccacggccccucc

SEQ ID NO: 322334 - RNA, 23 nt, Human
gaagaaucacuuagggaccccac

SEQ ID NO: 322335 - RNA, 18 nt, Human
gaagcuggagcacagggc

SEQ ID NO: 322336 - RNA, 19 nt, Human
gaagguggagucuauacug

SEQ ID NO: 322337 - RNA, 21 nt, Human
gaccccugaccccuagcccag

SEQ ID NO: 322338 - RNA, 19 nt, Human
gagacagagcuggcugccc

SEQ ID NO: 322339 - RNA, 24 nt, Human
gagcgccuucagagccgaggacac

SEQ ID NO: 322340 - RNA, 19 nt, Human
gcacuggggugggaggugg

SEQ ID NO: 322341 - RNA, 21 nt, Human
gcagagagcgccuucagagcc

SEQ ID NO: 322342 - RNA, 20 nt, Human
gcagcauucuggggcugguu

SEQ ID NO: 322343 - RNA, 24 nt, Human
gccuaguucacaggcugacaagaa

SEQ ID NO: 322344 - RNA, 22 nt, Human
gccucuggggaaaagaugaccc

SEQ ID NO: 322345 - RNA, 22 nt, Human
gcucccacccacccuccugagc

SEQ ID NO: 322346 - RNA, 18 nt, Human
gcugaggaccagagaggg

SEQ ID NO: 322347 - RNA, 19 nt, Human
gcuguucgggcuggcccgg

SEQ ID NO: 322348 - RNA, 18 nt, Human
gcuugccccgcccagccc

SEQ ID NO: 322349 - RNA, 21 nt, Human
ggaggugggucuccaggugcu

SEQ ID NO: 322350 - RNA, 21 nt, Human
ggcagagcugggacugagcuc

SEQ ID NO: 322351 - RNA, 24 nt, Human
gggaagggaguagacuaagggagu

SEQ ID NO: 322352 - RNA, 24 nt, Human
gggaaggguuggcagagauauccc

SEQ ID NO: 322353 - RNA, 24 nt, Human
gggcaggggccugcagcugggugc

SEQ ID NO: 322354 - RNA, 21 nt, Human
gggggugagaaguguuuccug

SEQ ID NO: 322355 - RNA, 19 nt, Human
ggggugagaaguguuuccu

SEQ ID NO: 322356 - RNA, 22 nt, Human
ggggugggaggugggucuccag

SEQ ID NO: 322357 - RNA, 18 nt, Human
ggguggguggggacgagg

SEQ ID NO: 322358 - RNA, 19 nt, Human
ggucucgugugcaggcuuu

SEQ ID NO: 322359 - RNA, 23 nt, Human
ggugggaggugggucuccaggug

SEQ ID NO: 322360 - RNA, 29 nt, Human
gugggaggugggucuccaggugcugcaac

SEQ ID NO: 322361 - RNA, 21 nt, Human
guuuuauucucucuuuggaau

SEQ ID NO: 322362 - RNA, 24 nt, Human
uaacaggcuccuuccugcuugccc

SEQ ID NO: 322363 - RNA, 19 nt, Human
ucagaggcagagcugggac

SEQ ID NO: 322364 - RNA, 18 nt, Human
uccaccugcuuccuugcc

SEQ ID NO: 322365 - RNA, 19 nt, Human
uccagagacaggagucuca

SEQ ID NO: 322366 - RNA, 22 nt, Human
ucccagaacagccacuuaugcc

SEQ ID NO: 322367 - RNA, 25 nt, Human
ucccagaacagccacuuaugcccuu

SEQ ID NO: 322368 - RNA, 21 nt, Human
uccccagcaacguugaauccg

SEQ ID NO: 322369 - RNA, 18 nt, Human
ucccgggguucugucccc

SEQ ID NO: 322370 - RNA, 18 nt, Human
ucccuggagacagagcug

SEQ ID NO: 322371 - RNA, 23 nt, Human
ucccuggagacagagcuggcugc

SEQ ID NO: 322372 - RNA, 23 nt, Human
uccuguagugcacguagggcagg

SEQ ID NO: 322373 - RNA, 26 nt, Human
uccuucauggaccaaugaggugacag

SEQ ID NO: 322374 - RNA, 20 nt, Human
ucuauacugcuuuucucucc

SEQ ID NO: 322375 - RNA, 24 nt, Human
ucuguggcccaaaagagugcacug

SEQ ID NO: 322376 - RNA, 19 nt, Human
ugaaaaggaagagccuugc

SEQ ID NO: 322377 - RNA, 23 nt, Human
ugacaagaaucugcggauguccu

SEQ ID NO: 322378 - RNA, 20 nt, Human
ugaccccuagcccagugcuc

SEQ ID NO: 322379 - RNA, 22 nt, Human
ugaccccuagcccagugcuccu

SEQ ID NO: 322380 - RNA, 20 nt, Human
ugaccccugaccccuagccc

SEQ ID NO: 322381 - RNA, 19 nt, Human
ugaggugacagaggcaggg

SEQ ID NO: 322382 - RNA, 18 nt, Human
ugauggaggaagcugagg

SEQ ID NO: 322383 - RNA, 21 nt, Human
ugccaaggaauuucccuccag

SEQ ID NO: 322384 - RNA, 23 nt, Human
ugccaaggaauuucccuccaggg

SEQ ID NO: 322385 - RNA, 24 nt, Human
ugcccagaaaauccaugaucccau

SEQ ID NO: 322386 - RNA, 23 nt, Human
ugcuugcagaccuccagagacag

SEQ ID NO: 322387 - RNA, 20 nt, Human
uggaagcuggagcacagggc

SEQ ID NO: 322388 - RNA, 25 nt, Human
uggaggaagcugaggaccagagagg

SEQ ID NO: 322389 - RNA, 18 nt, Human
uggcccaaaagagugcac

SEQ ID NO: 322390 - RNA, 19 nt, Human
uggcccaaaagagugcacu

SEQ ID NO: 322391 - RNA, 21 nt, Human
uggcucagccacugccuccag

SEQ ID NO: 322392 - RNA, 19 nt, Human
uggggcugguuuuccucug

SEQ ID NO: 322393 - RNA, 20 nt, Human
uggggguggguggggacgag

SEQ ID NO: 322394 - RNA, 20 nt, Human
uggggugggaggugggucuu

SEQ ID NO: 322395 - RNA, 21 nt, Human
ugggucugagcugugugugug

SEQ ID NO: 322396 - RNA, 21 nt, Human
ugucuguggcccaaaagagug

SEQ ID NO: 322397 - RNA, 19 nt, Human
uucacaggcugacaagaau

SEQ ID NO: 322398 - RNA, 21 nt, Human
uuccuguuccccugccaagga

SEQ ID NO: 322399 - RNA, 22 nt, Human
uucuuggcuucuuggauauagc

SEQ ID NO: 322400 - RNA, 21 nt, Human
uuuuuuuuuuuuuuggaucag

SEQ ID NO: 322401 - RNA, 18 nt, Human
uuuuuuuuuuuuuuuuug

SEQ ID NO: 322402 - RNA, 19 nt, Human
aaagaucacuccagcucgc

SEQ ID NO: 322403 - RNA, 21 nt, Human
acuggaaugagcaggaaccug

SEQ ID NO: 322404 - RNA, 22 nt, Human
acuggaaugagcaggaaccugg

SEQ ID NO: 322405 - RNA, 18 nt, Human
cacuauagaugugagaaa

SEQ ID NO: 322406 - RNA, 27 nt, Human
ccuaagauuuuauaacccagcaauuau

SEQ ID NO: 322407 - RNA, 22 nt, Human
ccuccgcaggagcuacugggca

SEQ ID NO: 322408 - RNA, 21 nt, Human
cgcaggagcuacugggcauaa

SEQ ID NO: 322409 - RNA, 21 nt, Human
cuccgcaggagcuacugggca

SEQ ID NO: 322410 - RNA, 23 nt, Human
cuuuguuuacaagccauuacagg

SEQ ID NO: 322411 - RNA, 20 nt, Human
gaaaggacaccacaauccgg

SEQ ID NO: 322412 - RNA, 20 nt, Human
gaaugagcaggaaccugcau

SEQ ID NO: 322413 - RNA, 21 nt, Human
uaacccagcaauuauccuaua

SEQ ID NO: 322414 - RNA, 19 nt, Human
uaagaagcauaaacuauaa

SEQ ID NO: 322415 - RNA, 23 nt, Human
uacuggaaugagcaggaaccugc

SEQ ID NO: 322416 - RNA, 23 nt, Human
uauagaugugagaaacagcugau

SEQ ID NO: 322417 - RNA, 20 nt, Human
uauccuauagaaaauagucc

SEQ ID NO: 322418 - RNA, 21 nt, Human
uauuuaguuuuccugucugcu

SEQ ID NO: 322419 - RNA, 22 nt, Human
ugaacaaauucaaaauugccua

SEQ ID NO: 322420 - RNA, 23 nt, Human
ugagcaggaaccugcaucuuugu

SEQ ID NO: 322421 - RNA, 24 nt, Human
ugagucuagagauauuugugaaau

SEQ ID NO: 322422 - RNA, 19 nt, Human
ugcuuagaaauuggcuguu

SEQ ID NO: 322423 - RNA, 23 nt, Human
ugucacuauagaugugagaaaca

SEQ ID NO: 322424 - RNA, 19 nt, Human
ugugaaauaagcuaauuug

SEQ ID NO: 322425 - RNA, 22 nt, Human
uuacuggaaugagcaggaaccu

SEQ ID NO: 322426 - RNA, 22 nt, Human
uucauacuugacuccaaaaagu

SEQ ID NO: 322427 - RNA, 22 nt, Human
uuggcuguuuagguugaaaaau

SEQ ID NO: 322428 - RNA, 18 nt, Human
uuuccaugguucucauga

SEQ ID NO: 322429 - RNA, 21 nt, Human
uuugcagcacccaucucagac

SEQ ID NO: 322430 - RNA, 18 nt, Human
uuuuuuuuuuuuuuuuug

SEQ ID NO: 322431 - RNA, 22 nt, Human
uuuuuuuuuuuuuuuuuuguuu

SEQ ID NO: 322432 - RNA, 19 nt, Human
aaaaaaaaagcaucaaaag

SEQ ID NO: 322433 - RNA, 21 nt, Human
aaagcggaagaugaccacaga

SEQ ID NO: 322434 - RNA, 20 nt, Human
aaagugcugggauugcaggc

SEQ ID NO: 322435 - RNA, 23 nt, Human
aaagugcugggauugcaggcgua

SEQ ID NO: 322436 - RNA, 24 nt, Human
aacuguguguucaagaaauuucaa

SEQ ID NO: 322437 - RNA, 24 nt, Human
aagcaucaaaaguucaggggcgcu

SEQ ID NO: 322438 - RNA, 21 nt, Human
aagcggaagaugaccacagag

SEQ ID NO: 322439 - RNA, 19 nt, Human
aagugcugggauugcaggc

SEQ ID NO: 322440 - RNA, 19 nt, Human
aagugcugggauugcaggc

SEQ ID NO: 322441 - RNA, 18 nt, Human
acaaaaaggggcucucag

SEQ ID NO: 322442 - RNA, 19 nt, Human
acaaaauugguuggggcag

SEQ ID NO: 322443 - RNA, 22 nt, Human
accccagagcccugccuugagc

SEQ ID NO: 322444 - RNA, 24 nt, Human
accccagagcccugccuugagccc

SEQ ID NO: 322445 - RNA, 23 nt, Human
accuugugauccgcccgccuggc

SEQ ID NO: 322446 - RNA, 19 nt, Human
acuccccacccuaaaccuc

SEQ ID NO: 322447 - RNA, 22 nt, Human
acucgcagcuaguuuuuguauu

SEQ ID NO: 322448 - RNA, 19 nt, Human
agaaacuugucuuucagga

SEQ ID NO: 322449 - RNA, 19 nt, Human
agacacaacaauaaagaga

SEQ ID NO: 322450 - RNA, 21 nt, Human
agagaaagaguaagcccuugg

SEQ ID NO: 322451 - RNA, 18 nt, Human
agagaggaguaaaggcca

SEQ ID NO: 322452 - RNA, 23 nt, Human
agagcccugccuugagcccaccc

SEQ ID NO: 322453 - RNA, 20 nt, Human
agcaacacggggugaggggg

SEQ ID NO: 322454 - RNA, 20 nt, Human
agcagaaacgagaaacggca

SEQ ID NO: 322455 - RNA, 22 nt, Human
agccagcaccucaucgauguca

SEQ ID NO: 322456 - RNA, 23 nt, Human
agccaggcccaagggcuggggug

SEQ ID NO: 322457 - RNA, 20 nt, Human
aggaaggaggggaaaccagc

SEQ ID NO: 322458 - RNA, 23 nt, Human
aggcacuccccacccuaaaccuc

SEQ ID NO: 322459 - RNA, 18 nt, Human
aggcccaagggcuggggu

SEQ ID NO: 322460 - RNA, 21 nt, Human
aggcccaagggcugggguggg

SEQ ID NO: 322461 - RNA, 18 nt, Human
aggccccagcccugcccu

SEQ ID NO: 322462 - RNA, 18 nt, Human
agggaauguuugacuuca

SEQ ID NO: 322463 - RNA, 19 nt, Human
aguagcugggacuacaggc

SEQ ID NO: 322464 - RNA, 19 nt, Human
aguagcugggacuacaggc

SEQ ID NO: 322465 - RNA, 19 nt, Human
aguucccggccucgaguag

SEQ ID NO: 322466 - RNA, 18 nt, Human
augggguuucacuacguu

SEQ ID NO: 322467 - RNA, 20 nt, Human
augggguuucacuacguugg

SEQ ID NO: 322468 - RNA, 24 nt, Human
auguaaacaugaagaaaacacuga

SEQ ID NO: 322469 - RNA, 24 nt, Human
caaagugcugggauugcaggcgua

SEQ ID NO: 322470 - RNA, 23 nt, Human
cacaaagcggaagaugaccacag

SEQ ID NO: 322471 - RNA, 23 nt, Human
cacacaaaaaaaaagcaucaaaa

SEQ ID NO: 322472 - RNA, 25 nt, Human
cacaucuucuuccccaccugccuca

SEQ ID NO: 322473 - RNA, 24 nt, Human
caccacucgcagcuaguuuuugua

SEQ ID NO: 322474 - RNA, 23 nt, Human
cacccagaucccagcuccgacuc

SEQ ID NO: 322475 - RNA, 22 nt, Human
caccccagagcccugccuugag

SEQ ID NO: 322476 - RNA, 18 nt, Human
cacuacguuggccaggau

SEQ ID NO: 322477 - RNA, 24 nt, Human
cacuacguuggccaggauggucuc

SEQ ID NO: 322478 - RNA, 21 nt, Human
cagagggggacugaugguguc

SEQ ID NO: 322479 - RNA, 20 nt, Human
cagcaagagaaagaguaagc

SEQ ID NO: 322480 - RNA, 21 nt, Human
cagcaggcacuccccacccua

SEQ ID NO: 322481 - RNA, 26 nt, Human
cagcaggcacuccccacccuaaaccu

SEQ ID NO: 322482 - RNA, 21 nt, Human
cagcagguccuccgaagagug

SEQ ID NO: 322483 - RNA, 19 nt, Human
cagccaccccagagcccug

SEQ ID NO: 322484 - RNA, 22 nt, Human
cagccagcaccucaucgauguc

SEQ ID NO: 322485 - RNA, 22 nt, Human
cagcccauuggggagagaggag

SEQ ID NO: 322486 - RNA, 18 nt, Human
cagcucagccccaaaucc

SEQ ID NO: 322487 - RNA, 19 nt, Human
caggacagagggggacuga

SEQ ID NO: 322488 - RNA, 21 nt, Human
caggacagagggggacugaug

SEQ ID NO: 322489 - RNA, 22 nt, Human
caggccccaggacagaggggga

SEQ ID NO: 322490 - RNA, 22 nt, Human
ccaaagugcugggauugcaggc

SEQ ID NO: 322491 - RNA, 24 nt, Human
ccaaagugcugggauugcaggcgu

SEQ ID NO: 322492 - RNA, 21 nt, Human
ccacagagcucugggccccgg

SEQ ID NO: 322493 - RNA, 24 nt, Human
ccacccagaucccagcuccgacuc

SEQ ID NO: 322494 - RNA, 20 nt, Human
ccacccuguacgaaaaagug

SEQ ID NO: 322495 - RNA, 22 nt, Human
ccacugaagcgggggaaagcca

SEQ ID NO: 322496 - RNA, 22 nt, Human
ccagagcccugccuugagccca

SEQ ID NO: 322497 - RNA, 24 nt, Human
ccagcaggcacuccccacccuaaa

SEQ ID NO: 322498 - RNA, 20 nt, Human
ccaggcccaagggcuggggu

SEQ ID NO: 322499 - RNA, 20 nt, Human
ccauauaugcuuccuagaca

SEQ ID NO: 322500 - RNA, 23 nt, Human
ccauuuggcucuagcgauucucu

SEQ ID NO: 322501 - RNA, 19 nt, Human
cccacagccaccccagagc

SEQ ID NO: 322502 - RNA, 25 nt, Human
cccacagccaccccagagcccugcc

SEQ ID NO: 322503 - RNA, 27 nt, Human
cccagagcccugccuugagcccacccc

SEQ ID NO: 322504 - RNA, 24 nt, Human
cccauguacaagguuccggcugcc

SEQ ID NO: 322505 - RNA, 18 nt, Human
ccccacagccaccccaga

SEQ ID NO: 322506 - RNA, 25 nt, Human
ccccagagcccugccuugagcccac

SEQ ID NO: 322507 - RNA, 20 nt, Human
cccccgcccacccuguacga

SEQ ID NO: 322508 - RNA, 18 nt, Human
cccccuggagcagguagc

SEQ ID NO: 322509 - RNA, 21 nt, Human
cccgcccacccuguacgaaaa

SEQ ID NO: 322510 - RNA, 27 nt, Human
cccgcccacccuguacgaaaaagugca

SEQ ID NO: 322511 - RNA, 20 nt, Human
cccgccuggccucccaaagu

SEQ ID NO: 322512 - RNA, 18 nt, Human
cccggggggaggaccagg

SEQ ID NO: 322513 - RNA, 20 nt, Human
cccucccgcccccgcccacc

SEQ ID NO: 322514 - RNA, 24 nt, Human
cccuucagaggccucaaacaccuc

SEQ ID NO: 322515 - RNA, 23 nt, Human
ccgccuggccucccaaagugcug

SEQ ID NO: 322516 - RNA, 19 nt, Human
ccucacacuggccuucucc

SEQ ID NO: 322517 - RNA, 19 nt, Human
ccucaggggcaccgugucc

SEQ ID NO: 322518 - RNA, 24 nt, Human
ccucgaguagcugggacuacaggc

SEQ ID NO: 322519 - RNA, 21 nt, Human
ccugaggcccaggccccagcc

SEQ ID NO: 322520 - RNA, 20 nt, Human
ccugccccggacaccgcguc

SEQ ID NO: 322521 - RNA, 19 nt, Human
ccugggguggggcuggcgg

SEQ ID NO: 322522 - RNA, 20 nt, Human
cgacucaagcccccuggagc

SEQ ID NO: 322523 - RNA, 23 nt, Human
cgacucaagcccccuggagcagg

SEQ ID NO: 322524 - RNA, 21 nt, Human
cgaggcugggaugagggccag

SEQ ID NO: 322525 - RNA, 21 nt, Human
cggcucccuggccgggccccu

SEQ ID NO: 322526 - RNA, 21 nt, Human
cggcugccagguagggccgag

SEQ ID NO: 322527 - RNA, 22 nt, Human
cuagacacaacaauaaagagaa

SEQ ID NO: 322528 - RNA, 18 nt, Human
cuaggcuccugaggccca

SEQ ID NO: 322529 - RNA, 21 nt, Human
cucacacuggccuucuccaca

SEQ ID NO: 322530 - RNA, 19 nt, Human
cucaggggcaccgugucca

SEQ ID NO: 322531 - RNA, 19 nt, Human
cucccgcucagccagcacc

SEQ ID NO: 322532 - RNA, 24 nt, Human
cucgaguagcugggacuacaggcg

SEQ ID NO: 322533 - RNA, 25 nt, Human
cucgucguccacaucuucuucccca

SEQ ID NO: 322534 - RNA, 24 nt, Human
cucuugaccuugugauccgcccgc

SEQ ID NO: 322535 - RNA, 22 nt, Human
cugcccugccccggacaccgcg

SEQ ID NO: 322536 - RNA, 19 nt, Human
cugcuccaaccuggggugg

SEQ ID NO: 322537 - RNA, 21 nt, Human
cuuccuagacaaaauugguug

SEQ ID NO: 322538 - RNA, 23 nt, Human
gaagaguguggccaggcgcucag

SEQ ID NO: 322539 - RNA, 21 nt, Human
gaccuugugauccgcccgccu

SEQ ID NO: 322540 - RNA, 23 nt, Human
gaccuugugauccgcccgccugg

SEQ ID NO: 322541 - RNA, 19 nt, Human
gagaaaccccacccagauc

SEQ ID NO: 322542 - RNA, 24 nt, Human
gagaugggguuucacuacguuggc

SEQ ID NO: 322543 - RNA, 22 nt, Human
gaguaagcccuuggggaggaag

SEQ ID NO: 322544 - RNA, 20 nt, Human
gaguagcugggacuacaggc

SEQ ID NO: 322545 - RNA, 24 nt, Human
gaguagcugggacuacaggcgugc

SEQ ID NO: 322546 - RNA, 23 nt, Human
gcagggccaugucauccuucagg

SEQ ID NO: 322547 - RNA, 22 nt, Human
gcagugccuggugggcccucag

SEQ ID NO: 322548 - RNA, 20 nt, Human
gccccuagccuaggcuccug

SEQ ID NO: 322549 - RNA, 21 nt, Human
gccccucccgcccccgcccac

SEQ ID NO: 322550 - RNA, 19 nt, Human
gcccuaggccgggaggccc

SEQ ID NO: 322551 - RNA, 22 nt, Human
gccucacacuggccuucuccac

SEQ ID NO: 322552 - RNA, 21 nt, Human
gcggcccauguacaagguucc

SEQ ID NO: 322553 - RNA, 20 nt, Human
gcucccuggccgggccccuu

SEQ ID NO: 322554 - RNA, 18 nt, Human
gcuggcggcccauguaca

SEQ ID NO: 322555 - RNA, 18 nt, Human
ggacgcccuuccuccacc

SEQ ID NO: 322556 - RNA, 19 nt, Human
ggacuacaggcgugcgcca

SEQ ID NO: 322557 - RNA, 19 nt, Human
ggagaugggggggccugcu

SEQ ID NO: 322558 - RNA, 22 nt, Human
ggagccaggcccaagggcuggg

SEQ ID NO: 322559 - RNA, 18 nt, Human
ggcccaagggcuggggug

SEQ ID NO: 322560 - RNA, 18 nt, Human
ggccgggccguggggcag

SEQ ID NO: 322561 - RNA, 21 nt, Human
ggcugacuuucgauggccgag

SEQ ID NO: 322562 - RNA, 22 nt, Human
gggcgcuagccccucccgcccc

SEQ ID NO: 322563 - RNA, 18 nt, Human
gggcuggggugggccugg

SEQ ID NO: 322564 - RNA, 18 nt, Human
gggcuggggugggccugg

SEQ ID NO: 322565 - RNA, 19 nt, Human
gggcuggggugggccuggg

SEQ ID NO: 322566 - RNA, 24 nt, Human
gggggggccugcucugggggcuua

SEQ ID NO: 322567 - RNA, 22 nt, Human
gggguuucacuacguuggccag

SEQ ID NO: 322568 - RNA, 22 nt, Human
ggguuucacuacguuggccagg

SEQ ID NO: 322569 - RNA, 23 nt, Human
ggugaggggggcccacgcagagg

SEQ ID NO: 322570 - RNA, 24 nt, Human
gucguccacaucuucuuccccacc

SEQ ID NO: 322571 - RNA, 20 nt, Human
gugauccgcccgccuggccu

SEQ ID NO: 322572 - RNA, 21 nt, Human
guggagaugggggggccugcu

SEQ ID NO: 322573 - RNA, 23 nt, Human
uaaaaccauauaugcuuccuaga

SEQ ID NO: 322574 - RNA, 19 nt, Human
uaauagagaugggguuuca

SEQ ID NO: 322575 - RNA, 24 nt, Human
uaauagagaugggguuucacuacg

SEQ ID NO: 322576 - RNA, 18 nt, Human
uacgaaaaagugcaaaac

SEQ ID NO: 322577 - RNA, 21 nt, Human
uagacacaacaauaaagagaa

SEQ ID NO: 322578 - RNA, 21 nt, Human
uagccccucccgcccccgccc

SEQ ID NO: 322579 - RNA, 18 nt, Human
uaggcuccugaggcccag

SEQ ID NO: 322580 - RNA, 24 nt, Human
uaguuuuuguauuuuuaauagaga

SEQ ID NO: 322581 - RNA, 20 nt, Human
ucaaacaccucgucguccac

SEQ ID NO: 322582 - RNA, 21 nt, Human
ucacugcauagacagcugugu

SEQ ID NO: 322583 - RNA, 27 nt, Human
ucagcagguccuccgaagaguguggcc

SEQ ID NO: 322584 - RNA, 21 nt, Human
ucaggggcgcuagccccuccc

SEQ ID NO: 322585 - RNA, 24 nt, Human
ucaguggccucacacuggccuucu

SEQ ID NO: 322586 - RNA, 19 nt, Human
uccaagccaggccccagga

SEQ ID NO: 322587 - RNA, 18 nt, Human
uccagagcaguuuuaauc

SEQ ID NO: 322588 - RNA, 20 nt, Human
uccagagcaguuuuaauccc

SEQ ID NO: 322589 - RNA, 23 nt, Human
uccagugucagcagguccuccga

SEQ ID NO: 322590 - RNA, 24 nt, Human
ucccaaagugcugggauugcaggc

SEQ ID NO: 322591 - RNA, 19 nt, Human
ucccacacaaaaaaaaagc

SEQ ID NO: 322592 - RNA, 21 nt, Human
uccgaagaguguggccaggcg

SEQ ID NO: 322593 - RNA, 18 nt, Human
uccuagacaaaauugguu

SEQ ID NO: 322594 - RNA, 22 nt, Human
uccucccgcucagccagcaccu

SEQ ID NO: 322595 - RNA, 18 nt, Human
ucuagcgauucucugggc

SEQ ID NO: 322596 - RNA, 19 nt, Human
ucucugggcaugagaggag

SEQ ID NO: 322597 - RNA, 22 nt, Human
ucugcauuaugggaauugagga

SEQ ID NO: 322598 - RNA, 18 nt, Human
ucugggcaugagaggaga

SEQ ID NO: 322599 - RNA, 22 nt, Human
ugaagaaagaggguugcuagag

SEQ ID NO: 322600 - RNA, 23 nt, Human
ugaagaaagaggguugcuagaga

SEQ ID NO: 322601 - RNA, 24 nt, Human
ugaagagggugcccagggugaggg

SEQ ID NO: 322602 - RNA, 19 nt, Human
ugagcuggggggguccaag

SEQ ID NO: 322603 - RNA, 23 nt, Human
ugagcuggggggguccaaggagc

SEQ ID NO: 322604 - RNA, 19 nt, Human
ugccagguagggccgagcc

SEQ ID NO: 322605 - RNA, 21 nt, Human
ugccagguagggccgagccuc

SEQ ID NO: 322606 - RNA, 21 nt, Human
ugccgaggcugggaugagggc

SEQ ID NO: 322607 - RNA, 20 nt, Human
ugccuugagcccaccccagg

SEQ ID NO: 322608 - RNA, 18 nt, Human
uggaagagauagauggca

SEQ ID NO: 322609 - RNA, 20 nt, Human
uggagccaggcccaagggcu

SEQ ID NO: 322610 - RNA, 22 nt, Human
uggagccaggcccaagggcugg

SEQ ID NO: 322611 - RNA, 19 nt, Human
uggaugcuuccagccguaa

SEQ ID NO: 322612 - RNA, 24 nt, Human
uggcauuguagauaaaagagaaca

SEQ ID NO: 322613 - RNA, 24 nt, Human
uggccaggauggucucgaucucuu

SEQ ID NO: 322614 - RNA, 22 nt, Human
uggccgggccccuucagaggcc

SEQ ID NO: 322615 - RNA, 18 nt, Human
ugggacuacaggcgugcg

SEQ ID NO: 322616 - RNA, 21 nt, Human
ugggacuacaggcgugcgcca

SEQ ID NO: 322617 - RNA, 22 nt, Human
ugggacuacaggcgugcgccac

SEQ ID NO: 322618 - RNA, 24 nt, Human
ugggacuacaggcgugcgccacca

SEQ ID NO: 322619 - RNA, 18 nt, Human
ugggaugagggccaggga

SEQ ID NO: 322620 - RNA, 18 nt, Human
ugggauugcaggcguaag

SEQ ID NO: 322621 - RNA, 19 nt, Human
ugggauugcaggcguaagc

SEQ ID NO: 322622 - RNA, 24 nt, Human
ugggauugcaggcguaagcaccau

SEQ ID NO: 322623 - RNA, 20 nt, Human
ugggccccgggugggggcug

SEQ ID NO: 322624 - RNA, 25 nt, Human
ugggccccgggugggggcugcccag

SEQ ID NO: 322625 - RNA, 18 nt, Human
ugggcccucagagcuggg

SEQ ID NO: 322626 - RNA, 21 nt, Human
ugggccugggaggagaaaccc

SEQ ID NO: 322627 - RNA, 22 nt, Human
uggggccuuggcauggacgccc

SEQ ID NO: 322628 - RNA, 25 nt, Human
uggggcuggcggcccauguacaagg

SEQ ID NO: 322629 - RNA, 24 nt, Human
ugggguuucacuacguuggccagg

SEQ ID NO: 322630 - RNA, 25 nt, Human
uggguaggcagugccuggugggccc

SEQ ID NO: 322631 - RNA, 25 nt, Human
uguaaacaugaagaaaacacugagu

SEQ ID NO: 322632 - RNA, 18 nt, Human
uguacaagguuccggcug

SEQ ID NO: 322633 - RNA, 24 nt, Human
ugucagcagguccuccgaagagug

SEQ ID NO: 322634 - RNA, 19 nt, Human
ugucagggugggggugguc

SEQ ID NO: 322635 - RNA, 20 nt, Human
ugucucggaguacuuggcug

SEQ ID NO: 322636 - RNA, 18 nt, Human
uuaauagagaugggguuu

SEQ ID NO: 322637 - RNA, 18 nt, Human
uuaaucccccuggaggcu

SEQ ID NO: 322638 - RNA, 21 nt, Human
uucagaggccucaaacaccuc

SEQ ID NO: 322639 - RNA, 24 nt, Human
uugcucaugcacaucugcauuaug

SEQ ID NO: 322640 - RNA, 19 nt, Human
uuggcauggacgcccuucc

SEQ ID NO: 322641 - RNA, 19 nt, Human
uuucacuacguuggccagg

SEQ ID NO: 322642 - RNA, 22 nt, Human
uuucacuacguuggccaggaug

SEQ ID NO: 322643 - RNA, 24 nt, Human
uuuuuaauagagaugggguuucac

SEQ ID NO: 322644 - RNA, 20 nt, Human
uuuuuguauuuuuaauagag

SEQ ID NO: 322645 - RNA, 21 nt, Human
uuuuuguauuuuuaauagaga

SEQ ID NO: 322646 - RNA, 23 nt, Human
uuuuuguauuuuuaauagagaug

SEQ ID NO: 322647 - RNA, 19 nt, Human
aagcagacccagcccaaga

SEQ ID NO: 322648 - RNA, 20 nt, Human
aagcagacccagcccaagac

SEQ ID NO: 322649 - RNA, 25 nt, Human
aagcagcagcaaacacaagagucac

SEQ ID NO: 322650 - RNA, 19 nt, Human
aaggaccgcaaaggcuguu

SEQ ID NO: 322651 - RNA, 19 nt, Human
aaggaccgcaaaggcuguu

SEQ ID NO: 322652 - RNA, 20 nt, Human
aaguuccuggacagcagcuc

SEQ ID NO: 322653 - RNA, 19 nt, Human
acacuguagaaaaugaaau

SEQ ID NO: 322654 - RNA, 21 nt, Human
acagcagcucgugacucaggu

SEQ ID NO: 322655 - RNA, 20 nt, Human
accacaacggugagaagaau

SEQ ID NO: 322656 - RNA, 20 nt, Human
acccaucccagccuccacuu

SEQ ID NO: 322657 - RNA, 18 nt, Human
acccuagaauaaugggac

SEQ ID NO: 322658 - RNA, 19 nt, Human
accuuuguccuccccagau

SEQ ID NO: 322659 - RNA, 21 nt, Human
acuccacuccaguucagacgg

SEQ ID NO: 322660 - RNA, 28 nt, Human
agaaaacaaagccucuugagguucuuuc

SEQ ID NO: 322661 - RNA, 21 nt, Human
agaaaacaagcccaaagguga

SEQ ID NO: 322662 - RNA, 23 nt, Human
agagggugcggacuucgcccaga

SEQ ID NO: 322663 - RNA, 26 nt, Human
agcuggcaaugcuuucuugaaaaugg

SEQ ID NO: 322664 - RNA, 22 nt, Human
aggaagacuuggaaggaagcug

SEQ ID NO: 322665 - RNA, 23 nt, Human
aggacagaggaggcaucuggggc

SEQ ID NO: 322666 - RNA, 25 nt, Human
aggggaaaacaagucucauuuaaaa

SEQ ID NO: 322667 - RNA, 19 nt, Human
aggugauggagauuggaag

SEQ ID NO: 322668 - RNA, 23 nt, Human
aggugauggagauuggaagagcu

SEQ ID NO: 322669 - RNA, 24 nt, Human
aguagaaaacaagcccaaagguga

SEQ ID NO: 322670 - RNA, 19 nt, Human
aguuccuggacagcagcuc

SEQ ID NO: 322671 - RNA, 21 nt, Human
auagugcaagguggucaggaa

SEQ ID NO: 322672 - RNA, 20 nt, Human
auucugcugcuggugccugc

SEQ ID NO: 322673 - RNA, 18 nt, Human
caaaguagaaaacaagcc

SEQ ID NO: 322674 - RNA, 20 nt, Human
caagcagacccagcccaaga

SEQ ID NO: 322675 - RNA, 21 nt, Human
caagcccaaaggugauggaga

SEQ ID NO: 322676 - RNA, 24 nt, Human
caaggcaccugcgcccugagacgu

SEQ ID NO: 322677 - RNA, 23 nt, Human
cacccggggcgugaggcgcggag

SEQ ID NO: 322678 - RNA, 24 nt, Human
caccucuccauuccccauucugcu

SEQ ID NO: 322679 - RNA, 22 nt, Human
caccuuuguccuccccagauuu

SEQ ID NO: 322680 - RNA, 18 nt, Human
cagaaugcucgucgcccc

SEQ ID NO: 322681 - RNA, 18 nt, Human
cagacccagcccaagacg

SEQ ID NO: 322682 - RNA, 24 nt, Human
cagacggcuacuaaucccggccca

SEQ ID NO: 322683 - RNA, 19 nt, Human
cagcaaaaaaucaaaggga

SEQ ID NO: 322684 - RNA, 23 nt, Human
caguaccuccugaaaaguucaga

SEQ ID NO: 322685 - RNA, 21 nt, Human
cauaaaaggcuguacaagaua

SEQ ID NO: 322686 - RNA, 24 nt, Human
ccauuuuacucuucuuuaauucua

SEQ ID NO: 322687 - RNA, 18 nt, Human
ccccgccgccccgcugcc

SEQ ID NO: 322688 - RNA, 21 nt, Human
ccccgcugccgccgcggcucg

SEQ ID NO: 322689 - RNA, 18 nt, Human
ccccugcccaccucucca

SEQ ID NO: 322690 - RNA, 22 nt, Human
ccccugcccaccucuccauucc

SEQ ID NO: 322691 - RNA, 19 nt, Human
cccggcccaaggcaccugc

SEQ ID NO: 322692 - RNA, 19 nt, Human
cccuagaauaagugggacc

SEQ ID NO: 322693 - RNA, 18 nt, Human
cccuagaauaaugggacc

SEQ ID NO: 322694 - RNA, 22 nt, Human
cccugcccaccucuccauuccc

SEQ ID NO: 322695 - RNA, 21 nt, Human
ccgccccgcugccgccgcggc

SEQ ID NO: 322696 - RNA, 20 nt, Human
ccgccgccccgcugccgccg

SEQ ID NO: 322697 - RNA, 19 nt, Human
ccgccgcggcucguagcuc

SEQ ID NO: 322698 - RNA, 18 nt, Human
ccgcugccgccgcggcuc

SEQ ID NO: 322699 - RNA, 19 nt, Human
ccgcugccgccgcggcucg

SEQ ID NO: 322700 - RNA, 25 nt, Human
ccuccacuauggauuaauaugccua

SEQ ID NO: 322701 - RNA, 24 nt, Human
ccugugaccacgcgucaagcugcu

SEQ ID NO: 322702 - RNA, 24 nt, Human
ccugugaccacgcgucaagcugcu

SEQ ID NO: 322703 - RNA, 22 nt, Human
cgccccuggacaaggacacacu

SEQ ID NO: 322704 - RNA, 23 nt, Human
cgcuuccucuuucuccuacucca

SEQ ID NO: 322705 - RNA, 21 nt, Human
cuacuccacuccaguucagac

SEQ ID NO: 322706 - RNA, 21 nt, Human
cucguagcucagguuccuucc

SEQ ID NO: 322707 - RNA, 21 nt, Human
cugcaaaaguccagccgggaa

SEQ ID NO: 322708 - RNA, 21 nt, Human
cuggccuugggaagaaauggc

SEQ ID NO: 322709 - RNA, 21 nt, Human
cuggccuugggaagaaauggc

SEQ ID NO: 322710 - RNA, 24 nt, Human
cuugaccucgucccucaaaucugg

SEQ ID NO: 322711 - RNA, 24 nt, Human
cuugaccucgucccucaaaucugg

SEQ ID NO: 322712 - RNA, 19 nt, Human
cuugacucaaagagagggg

SEQ ID NO: 322713 - RNA, 27 nt, Human
gaaaacaaagccucuugagguucuuuc

SEQ ID NO: 322714 - RNA, 23 nt, Human
gaaggaagcugcaaaaguccagc

SEQ ID NO: 322715 - RNA, 21 nt, Human
gacagaggaggcaucuggggc

SEQ ID NO: 322716 - RNA, 24 nt, Human
gcaaaguagaaaacaagcccaaag

SEQ ID NO: 322717 - RNA, 18 nt, Human
gcacaaaccaauuaauau

SEQ ID NO: 322718 - RNA, 21 nt, Human
gcagggcugacagcaccgauu

SEQ ID NO: 322719 - RNA, 23 nt, Human
gcccaaaggugauggagauugga

SEQ ID NO: 322720 - RNA, 21 nt, Human
gcugcuggugccugcucuucc

SEQ ID NO: 322721 - RNA, 18 nt, Human
gcuguagaaaaagacugc

SEQ ID NO: 322722 - RNA, 20 nt, Human
ggcacagcaacuuccgggcc

SEQ ID NO: 322723 - RNA, 23 nt, Human
ggggcacagcaacuuccgggccu

SEQ ID NO: 322724 - RNA, 22 nt, Human
ggugagaagaaucugagaggga

SEQ ID NO: 322725 - RNA, 23 nt, Human
gugaaaucguccugugaccacgc

SEQ ID NO: 322726 - RNA, 23 nt, Human
gugaaaucguccugugaccacgc

SEQ ID NO: 322727 - RNA, 20 nt, Human
guggucaggaagacuuggaa

SEQ ID NO: 322728 - RNA, 22 nt, Human
uaaaaaggaugagucugcagca

SEQ ID NO: 322729 - RNA, 24 nt, Human
uaaggcacaaaccaauuaauaugg

SEQ ID NO: 322730 - RNA, 21 nt, Human
uaaugagugucagugcuugag

SEQ ID NO: 322731 - RNA, 21 nt, Human
uaaugagugucagugcuugag

SEQ ID NO: 322732 - RNA, 22 nt, Human
uaccuccugaaaaguucagaau

SEQ ID NO: 322733 - RNA, 19 nt, Human
uacgcuuccccgccgcccc

SEQ ID NO: 322734 - RNA, 22 nt, Human
uacuccccuuuccucugggucu

SEQ ID NO: 322735 - RNA, 19 nt, Human
uacugaauuuggaaccuga

SEQ ID NO: 322736 - RNA, 19 nt, Human
uacugaauuuggaaccuga

SEQ ID NO: 322737 - RNA, 24 nt, Human
uauaggcaccuccuuccaaagucc

SEQ ID NO: 322738 - RNA, 20 nt, Human
ucagugcuugagaagaagaa

SEQ ID NO: 322739 - RNA, 20 nt, Human
ucagugcuugagaagaagaa

SEQ ID NO: 322740 - RNA, 25 nt, Human
uccaaaauuuacugaauuuggaacc

SEQ ID NO: 322741 - RNA, 26 nt, Human
uccaaaauuuacugaauuuggaaccu

SEQ ID NO: 322742 - RNA, 21 nt, Human
ucccagccuccacuauggauu

SEQ ID NO: 322743 - RNA, 22 nt, Human
ucgcccagaaugcucgucgccc

SEQ ID NO: 322744 - RNA, 19 nt, Human
ucgugacucagguguagag

SEQ ID NO: 322745 - RNA, 24 nt, Human
ucuacauauuugacuugacucaaa

SEQ ID NO: 322746 - RNA, 19 nt, Human
ucuauaggcaccuccuucc

SEQ ID NO: 322747 - RNA, 22 nt, Human
ucuauaggcaccuccuuccaaa

SEQ ID NO: 322748 - RNA, 21 nt, Human
ucucacccaucccagccucca

SEQ ID NO: 322749 - RNA, 18 nt, Human
ucuccuccaggccaagcu

SEQ ID NO: 322750 - RNA, 18 nt, Human
ucuccuccaggccaagcu

SEQ ID NO: 322751 - RNA, 22 nt, Human
ucugaauuauggaaaagucacc

SEQ ID NO: 322752 - RNA, 22 nt, Human
ucugagagggaagcagcagcaa

SEQ ID NO: 322753 - RNA, 28 nt, Human
ucuguggcaaaguagaaaaccggggucc

SEQ ID NO: 322754 - RNA, 24 nt, Human
ucuuucuuucauguguucuccucc

SEQ ID NO: 322755 - RNA, 24 nt, Human
ucuuucuuucauguguucuccucc

SEQ ID NO: 322756 - RNA, 23 nt, Human
ugaaaucucccaauccaaguuuu

SEQ ID NO: 322757 - RNA, 21 nt, Human
ugaauuauggaaaagucaccu

SEQ ID NO: 322758 - RNA, 21 nt, Human
ugacucaaagagaggggaaaa

SEQ ID NO: 322759 - RNA, 19 nt, Human
ugacucagguguagagcga

SEQ ID NO: 322760 - RNA, 20 nt, Human
ugagaagaaucugagaggga

SEQ ID NO: 322761 - RNA, 18 nt, Human
ugagagggaagcagcagc

SEQ ID NO: 322762 - RNA, 18 nt, Human
ugccucgagacagcccga

SEQ ID NO: 322763 - RNA, 21 nt, Human
ugcugcuggugccugcucuuc

SEQ ID NO: 322764 - RNA, 22 nt, Human
ugcuggugccugcucuuccuca

SEQ ID NO: 322765 - RNA, 20 nt, Human
uggaaaauccaaauuugacu

SEQ ID NO: 322766 - RNA, 20 nt, Human
uggaaaauccaaauuugacu

SEQ ID NO: 322767 - RNA, 20 nt, Human
uggaaaguuccuggacagca

SEQ ID NO: 322768 - RNA, 22 nt, Human
uggagcaacuguauagaaauac

SEQ ID NO: 322769 - RNA, 22 nt, Human
uggagcaacuguauagaaauac

SEQ ID NO: 322770 - RNA, 18 nt, Human
ugggaagaaauggcaauc

SEQ ID NO: 322771 - RNA, 18 nt, Human
ugggaagaaauggcaauc

SEQ ID NO: 322772 - RNA, 18 nt, Human
ugggaccaucugcuacca

SEQ ID NO: 322773 - RNA, 18 nt, Human
ugggaccaucugcuacca

SEQ ID NO: 322774 - RNA, 22 nt, Human
ugucagugcuugagaagaagaa

SEQ ID NO: 322775 - RNA, 22 nt, Human
ugucagugcuugagaagaagaa

SEQ ID NO: 322776 - RNA, 21 nt, Human
ugugugggagagaagaaugag

SEQ ID NO: 322777 - RNA, 21 nt, Human
ugugugggagagaagaaugag

SEQ ID NO: 322778 - RNA, 26 nt, Human
uuaauucuaccgcuuugggcauacau

SEQ ID NO: 322779 - RNA, 26 nt, Human
uuagguauacgcuuccccgccgcccc

SEQ ID NO: 322780 - RNA, 24 nt, Human
uuauuggguugauuuucaacgugu

SEQ ID NO: 322781 - RNA, 22 nt, Human
uucagaauucaguuaauacaga

SEQ ID NO: 322782 - RNA, 20 nt, Human
uucuauaggcaccuccuucc

SEQ ID NO: 322783 - RNA, 19 nt, Human
uucuccuacuccacuccag

SEQ ID NO: 322784 - RNA, 21 nt, Human
uucugcugcuggugccugcuc

SEQ ID NO: 322785 - RNA, 23 nt, Human
uugagaagaagaauugccaaagg

SEQ ID NO: 322786 - RNA, 23 nt, Human
uugagaagaagaauugccaaagg

SEQ ID NO: 322787 - RNA, 19 nt, Human
uugguccauaaaaggcugu

SEQ ID NO: 322788 - RNA, 23 nt, Human
uuuccaaaauuuacugaauuugg

SEQ ID NO: 322789 - RNA, 23 nt, Human
uuuccaaaauuuacugaauuugg

SEQ ID NO: 322790 - RNA, 23 nt, Human
uuucuauaggcaccuccuuccaa

SEQ ID NO: 322791 - RNA, 22 nt, Human
aagcaccacgaacacuuggggc

SEQ ID NO: 322792 - RNA, 18 nt, Human
agcucccucacaucacuc

SEQ ID NO: 322793 - RNA, 24 nt, Human
aggaaagaaaagucuuaaaaauau

SEQ ID NO: 322794 - RNA, 18 nt, Human
agggaacuggcuuuuccu

SEQ ID NO: 322795 - RNA, 18 nt, Human
auccaaugaaaauucccu

SEQ ID NO: 322796 - RNA, 21 nt, Human
augaaacagcuggcaccaaag

SEQ ID NO: 322797 - RNA, 20 nt, Human
augccugcuccgccgccgcu

SEQ ID NO: 322798 - RNA, 20 nt, Human
auuacuauuaagccacuucc

SEQ ID NO: 322799 - RNA, 21 nt, Human
auuacuauuaagccacuuccc

SEQ ID NO: 322800 - RNA, 22 nt, Human
caaagcauugggaacacuccuc

SEQ ID NO: 322801 - RNA, 23 nt, Human
caagaacaggacucaguuucuaa

SEQ ID NO: 322802 - RNA, 18 nt, Human
cacugcuggaaaugccug

SEQ ID NO: 322803 - RNA, 18 nt, Human
cagagaggucugaauccc

SEQ ID NO: 322804 - RNA, 24 nt, Human
caguucaucuggauaaaccugcug

SEQ ID NO: 322805 - RNA, 19 nt, Human
ccaaagagcugguucugcc

SEQ ID NO: 322806 - RNA, 21 nt, Human
cccaaagcgggagccaaaguc

SEQ ID NO: 322807 - RNA, 22 nt, Human
ccuccuccucaccaaguaaaca

SEQ ID NO: 322808 - RNA, 22 nt, Human
ccugcugugcuuccuguccgug

SEQ ID NO: 322809 - RNA, 22 nt, Human
cucaguucaucuggauaaaccu

SEQ ID NO: 322810 - RNA, 22 nt, Human
cuggcaccaaagagcugguucu

SEQ ID NO: 322811 - RNA, 18 nt, Human
cuggcuuucaaagagggc

SEQ ID NO: 322812 - RNA, 23 nt, Human
cuggugaugaaacagcuggcacc

SEQ ID NO: 322813 - RNA, 24 nt, Human
cuggugaugaaacagcuggcaccu

SEQ ID NO: 322814 - RNA, 23 nt, Human
cuugguuucuucuucucagcagg

SEQ ID NO: 322815 - RNA, 24 nt, Human
gccuccuccucaccaaguaaacac

SEQ ID NO: 322816 - RNA, 23 nt, Human
gcgcugguuuuuaacacgucacu

SEQ ID NO: 322817 - RNA, 22 nt, Human
gcucuguggccucaguuucuuc

SEQ ID NO: 322818 - RNA, 18 nt, Human
ggacuagcuucugucuca

SEQ ID NO: 322819 - RNA, 22 nt, Human
ggauaaaccugcugugcuuccu

SEQ ID NO: 322820 - RNA, 28 nt, Human
guaaaacuauacaacugcauccaaugaa

SEQ ID NO: 322821 - RNA, 23 nt, Human
uaaggaaagaaaagucuuaaaaa

SEQ ID NO: 322822 - RNA, 22 nt, Human
uccagccagagcacccaggugc

SEQ ID NO: 322823 - RNA, 19 nt, Human
ucccugcagcuugcagccu

SEQ ID NO: 322824 - RNA, 21 nt, Human
ucccuggcuuucaaagagggc

SEQ ID NO: 322825 - RNA, 23 nt, Human
uccugacgucugagaagucccac

SEQ ID NO: 322826 - RNA, 19 nt, Human
ucucagcccucaugccgga

SEQ ID NO: 322827 - RNA, 22 nt, Human
ucugaccuucucaguucaucug

SEQ ID NO: 322828 - RNA, 25 nt, Human
ucugaccuucucaguucaucuggau

SEQ ID NO: 322829 - RNA, 22 nt, Human
ugaaacagcuggcaccaaagag

SEQ ID NO: 322830 - RNA, 25 nt, Human
ugcauccaaugaaaauucccugcag

SEQ ID NO: 322831 - RNA, 18 nt, Human
ugccugcuccgccgccgc

SEQ ID NO: 322832 - RNA, 23 nt, Human
uggauaaaccugcugugcuuccu

SEQ ID NO: 322833 - RNA, 21 nt, Human
uggcaccaaagagcugguucu

SEQ ID NO: 322834 - RNA, 23 nt, Human
ugggcgaccuugggaaaagucac

SEQ ID NO: 322835 - RNA, 29 nt, Human
uguaaaacuauacaacugcauccaaugaa

SEQ ID NO: 322836 - RNA, 21 nt, Human
uuaacacgucacuuucuaugg

SEQ ID NO: 322837 - RNA, 27 nt, Human
uuagcucuguggccucaguuucuuccc

SEQ ID NO: 322838 - RNA, 19 nt, Human
uucccugcagcuugcagcc

SEQ ID NO: 322839 - RNA, 19 nt, Human
uuccuucagcuccaauagc

SEQ ID NO: 322840 - RNA, 21 nt, Human
uuccuucagcuccaauagcuu

SEQ ID NO: 322841 - RNA, 19 nt, Human
uucuauggucacacagcuc

SEQ ID NO: 322842 - RNA, 20 nt, Human
uucuauggucacacagcucc

SEQ ID NO: 322843 - RNA, 24 nt, Human
uucuucaucaguaaaauucagagg

SEQ ID NO: 322844 - RNA, 19 nt, Human
uucuucucagcaggcuaaa

SEQ ID NO: 322845 - RNA, 18 nt, Human
uuuuuuaaggaaagaaaa

SEQ ID NO: 322846 - RNA, 24 nt, Human
aaaucauaaaaacauuaucuucau

SEQ ID NO: 322847 - RNA, 24 nt, Human
aagaaucagcaaauuuucaaauaa

SEQ ID NO: 322848 - RNA, 21 nt, Human
aauacaauuguuuuccugacu

SEQ ID NO: 322849 - RNA, 26 nt, Human
augaaaucaauguucuuccugcuugg

SEQ ID NO: 322850 - RNA, 19 nt, Human
caaugauuucaaauguguc

SEQ ID NO: 322851 - RNA, 23 nt, Human
caauucucaugaauaguugccca

SEQ ID NO: 322852 - RNA, 19 nt, Human
caucaauguagaaaacaaa

SEQ ID NO: 322853 - RNA, 24 nt, Human
cauguaggcugucuucuaaaauuu

SEQ ID NO: 322854 - RNA, 21 nt, Human
ccucuucccagggcaggagcu

SEQ ID NO: 322855 - RNA, 18 nt, Human
ccugcuuggucuaggcug

SEQ ID NO: 322856 - RNA, 21 nt, Human
cugaaugccagauagacucca

SEQ ID NO: 322857 - RNA, 18 nt, Human
cugcuuguguguucuccu

SEQ ID NO: 322858 - RNA, 19 nt, Human
gcugucagcugugcugucc

SEQ ID NO: 322859 - RNA, 19 nt, Human
ggcagucagguagaaagca

SEQ ID NO: 322860 - RNA, 18 nt, Human
guagaaagcaaaaguaaa

SEQ ID NO: 322861 - RNA, 19 nt, Human
gucuucuaaaauuuucuuu

SEQ ID NO: 322862 - RNA, 22 nt, Human
gugcugagccucuucccagggc

SEQ ID NO: 322863 - RNA, 26 nt, Human
uaaagaaucagcaaauuuucaaauaa

SEQ ID NO: 322864 - RNA, 19 nt, Human
uacaaagaaagcagauugu

SEQ ID NO: 322865 - RNA, 25 nt, Human
ucuaaaauuuucuuuucucuaaguu

SEQ ID NO: 322866 - RNA, 23 nt, Human
ucucaugaauaguugcccaauuc

SEQ ID NO: 322867 - RNA, 24 nt, Human
ucuuccugcuuggucuaggcuggg

SEQ ID NO: 322868 - RNA, 20 nt, Human
ugaacugcuauaagcuguag

SEQ ID NO: 322869 - RNA, 24 nt, Human
ugagauuaaaucuucacaaaccuc

SEQ ID NO: 322870 - RNA, 19 nt, Human
ugcugagccucuucccagg

SEQ ID NO: 322871 - RNA, 18 nt, Human
ugcuuguguguucuccuc

SEQ ID NO: 322872 - RNA, 18 nt, Human
uggaguuucuucaaaugu

SEQ ID NO: 322873 - RNA, 22 nt, Human
uggaguuucuucaaaugugguc

SEQ ID NO: 322874 - RNA, 18 nt, Human
uguguguucuccucugug

SEQ ID NO: 322875 - RNA, 19 nt, Human
uucacaaaccucuugagaa

SEQ ID NO: 322876 - RNA, 23 nt, Human
uucaggaggagaauuugggauuu

SEQ ID NO: 322877 - RNA, 26 nt, Human
uucaggaggagaauuugggauuugcu

SEQ ID NO: 322878 - RNA, 18 nt, Human
uucauucuaucuauguuu

SEQ ID NO: 322879 - RNA, 25 nt, Human
uuuuuuuuuuuuuuuuuuuuuuagg

SEQ ID NO: 322880 - RNA, 23 nt, Human
aagaaaaaaauucauaaaucugg

SEQ ID NO: 322881 - RNA, 24 nt, Human
acuuuaccaauugcugaagaaaaa

SEQ ID NO: 322882 - RNA, 23 nt, Human
agaguccuuuucauagucuuuuc

SEQ ID NO: 322883 - RNA, 21 nt, Human
cagaagcuuccagagcacggc

SEQ ID NO: 322884 - RNA, 18 nt, Human
caugaagguaucagccug

SEQ ID NO: 322885 - RNA, 21 nt, Human
ccagaagcuuccagagcacgg

SEQ ID NO: 322886 - RNA, 18 nt, Human
cgugcauguucuccucug

SEQ ID NO: 322887 - RNA, 20 nt, Human
cugcgugcauguucuccucu

SEQ ID NO: 322888 - RNA, 22 nt, Human
cugugcuguccuuccuccugca

SEQ ID NO: 322889 - RNA, 24 nt, Human
gaaaaaaauucauaaaucuggagg

SEQ ID NO: 322890 - RNA, 18 nt, Human
ggaguucuuuucuucuuu

SEQ ID NO: 322891 - RNA, 21 nt, Human
gugcauguucuccucugugga

SEQ ID NO: 322892 - RNA, 24 nt, Human
uauuuaguccaaugaaauggaguu

SEQ ID NO: 322893 - RNA, 25 nt, Human
ugaagaaaaaaauucauaaaucugg

SEQ ID NO: 322894 - RNA, 21 nt, Human
ugcgugcauguucuccucugu

SEQ ID NO: 322895 - RNA, 23 nt, Human
ugcgugcauguucuccucugugg

SEQ ID NO: 322896 - RNA, 22 nt, Human
ugugcuguccuuccuccugcaa

SEQ ID NO: 322897 - RNA, 26 nt, Human
uucauagucuuuuccauaaaucuccu

SEQ ID NO: 322898 - RNA, 22 nt, Human
uuuuccauaaaucuccugccag

SEQ ID NO: 322899 - RNA, 18 nt, Human
uuuucuucuuugucuuga

SEQ ID NO: 322900 - RNA, 20 nt, Human
uuuuguuuacaaaaguauac

SEQ ID NO: 322901 - RNA, 21 nt, Human
aaaauguucauaaaucuggag

SEQ ID NO: 322902 - RNA, 18 nt, Human
caugaagguaucagccug

SEQ ID NO: 322903 - RNA, 22 nt, Human
cucaagaaaaaauguucauaaa

SEQ ID NO: 322904 - RNA, 21 nt, Human
cucagauagagagcaaaagga

SEQ ID NO: 322905 - RNA, 18 nt, Human
cugccuguguguucuccu

SEQ ID NO: 322906 - RNA, 22 nt, Human
cuuuccauaaaucuccugccag

SEQ ID NO: 322907 - RNA, 23 nt, Human
uauuuaguccaauaacauugagu

SEQ ID NO: 322908 - RNA, 18 nt, Human
uccugagcacggcuguca

SEQ ID NO: 322909 - RNA, 18 nt, Human
ucucugcugccugugugu

SEQ ID NO: 322910 - RNA, 25 nt, Human
ugaaacauuccaagaaucagcacau

SEQ ID NO: 322911 - RNA, 20 nt, Human
ugaaauacagaaaugacauc

SEQ ID NO: 322912 - RNA, 18 nt, Human
ugccuguguguucuccuc

SEQ ID NO: 322913 - RNA, 19 nt, Human
uggggcacucagauagaga

SEQ ID NO: 322914 - RNA, 18 nt, Human
uguguguucuccucugug

SEQ ID NO: 322915 - RNA, 18 nt, Human
uuuucuucuuugucuuga

SEQ ID NO: 322916 - RNA, 20 nt, Human
uuuuguuuacaaaaguauac

SEQ ID NO: 322917 - RNA, 24 nt, Human
aagaaaaaaagugcauaaaucugg

SEQ ID NO: 322918 - RNA, 24 nt, Human
acuuuaccaauugcugaagaaaaa

SEQ ID NO: 322919 - RNA, 23 nt, Human
agaguccuugucagagucuuuuc

SEQ ID NO: 322920 - RNA, 23 nt, Human
agagucuuuucauaaaucuccuu

SEQ ID NO: 322921 - RNA, 24 nt, Human
agcugagccuaggauccagaaacu

SEQ ID NO: 322922 - RNA, 24 nt, Human
aggaagaaugaaagcaacugucug

SEQ ID NO: 322923 - RNA, 18 nt, Human
agugguaugaucuugaag

SEQ ID NO: 322924 - RNA, 19 nt, Human
ccucuguggagcugagccu

SEQ ID NO: 322925 - RNA, 22 nt, Human
cuccugaauaguuucccaauuc

SEQ ID NO: 322926 - RNA, 24 nt, Human
cuccugaauaguuucccaauucug

SEQ ID NO: 322927 - RNA, 18 nt, Human
cugccugcguguucuccu

SEQ ID NO: 322928 - RNA, 23 nt, Human
uaccauaaacauaugaauacucc

SEQ ID NO: 322929 - RNA, 24 nt, Human
uauuuaguccaauaaaauuggguu

SEQ ID NO: 322930 - RNA, 24 nt, Human
ucagagucuuuucauaaaucuccu

SEQ ID NO: 322931 - RNA, 20 nt, Human
uccucuguggagcugagccu

SEQ ID NO: 322932 - RNA, 21 nt, Human
uccugaauaguuucccaauuc

SEQ ID NO: 322933 - RNA, 21 nt, Human
ucuccuugaacaaaaagcaau

SEQ ID NO: 322934 - RNA, 20 nt, Human
ugaaauacagaaaugacauc

SEQ ID NO: 322935 - RNA, 21 nt, Human
ugaacaaaaagcaauuuugga

SEQ ID NO: 322936 - RNA, 19 nt, Human
ugaaguaucagccuguuca

SEQ ID NO: 322937 - RNA, 18 nt, Human
ugccugcguguucuccuc

SEQ ID NO: 322938 - RNA, 20 nt, Human
uuuuguuuacaaaaguauac

SEQ ID NO: 322939 - RNA, 24 nt, Human
aaaccaucuucucugcaaacacac

SEQ ID NO: 322940 - RNA, 18 nt, Human
aggaaauggugagagcca

SEQ ID NO: 322941 - RNA, 26 nt, Human
auagaaaccaucuucucugcaaacac

SEQ ID NO: 322942 - RNA, 21 nt, Human
aucucuguguucauuucuauu

SEQ ID NO: 322943 - RNA, 22 nt, Human
caaggguuuucccaugaaauuu

SEQ ID NO: 322944 - RNA, 21 nt, Human
caccuccagcuuauagggcuu

SEQ ID NO: 322945 - RNA, 20 nt, Human
ccacacaaugugcauuuaaa

SEQ ID NO: 322946 - RNA, 18 nt, Human
cugcauuauccugccaag

SEQ ID NO: 322947 - RNA, 19 nt, Human
cugcauuauccugccaagu

SEQ ID NO: 322948 - RNA, 18 nt, Human
cugcuuguguguucuccu

SEQ ID NO: 322949 - RNA, 18 nt, Human
gaauuggaggaacuagua

SEQ ID NO: 322950 - RNA, 22 nt, Human
ggucuugcucuucgugauucca

SEQ ID NO: 322951 - RNA, 19 nt, Human
ggugaguucugaguggcuc

SEQ ID NO: 322952 - RNA, 22 nt, Human
guuuuacacuguaucucuuagg

SEQ ID NO: 322953 - RNA, 22 nt, Human
uacuacaugugaaauucuaaug

SEQ ID NO: 322954 - RNA, 20 nt, Human
uaggaaauggugagagccau

SEQ ID NO: 322955 - RNA, 22 nt, Human
uauagggcuucuggaacagagu

SEQ ID NO: 322956 - RNA, 23 nt, Human
ucaacuucuuauccugguuuaca

SEQ ID NO: 322957 - RNA, 20 nt, Human
uccaugggagaaaauggaau

SEQ ID NO: 322958 - RNA, 24 nt, Human
uccccugagauguuacguaaaagu

SEQ ID NO: 322959 - RNA, 23 nt, Human
ucuaaugacugcauuauccugcc

SEQ ID NO: 322960 - RNA, 24 nt, Human
ucuacuauaauuucagcuuuccua

SEQ ID NO: 322961 - RNA, 22 nt, Human
ucucuuaggaaauggugagagc

SEQ ID NO: 322962 - RNA, 23 nt, Human
ugagauguuacguaaaaguuuga

SEQ ID NO: 322963 - RNA, 20 nt, Human
ugcaagauggagagagccac

SEQ ID NO: 322964 - RNA, 19 nt, Human
ugccaagugaaagaggcag

SEQ ID NO: 322965 - RNA, 18 nt, Human
ugcuuguguguucuccuc

SEQ ID NO: 322966 - RNA, 20 nt, Human
ugggagcccuguaugcaaga

SEQ ID NO: 322967 - RNA, 19 nt, Human
ugggucuugcucuucguga

SEQ ID NO: 322968 - RNA, 21 nt, Human
uuggaaaaacuguccacagug

SEQ ID NO: 322969 - RNA, 24 nt, Human
aagaaaaaaaguucauaaaucugg

SEQ ID NO: 322970 - RNA, 24 nt, Human
aagaaaaagcaauuuuggacugua

SEQ ID NO: 322971 - RNA, 24 nt, Human
agaaucaaagcaacugucugccag

SEQ ID NO: 322972 - RNA, 23 nt, Human
agaguccuugucagagucuuuuc

SEQ ID NO: 322973 - RNA, 24 nt, Human
agagucuuuuccauaaaucuccuu

SEQ ID NO: 322974 - RNA, 24 nt, Human
agcugagccuaggauccagaaacu

SEQ ID NO: 322975 - RNA, 19 nt, Human
aggaagaaucaaagcaacu

SEQ ID NO: 322976 - RNA, 18 nt, Human
agugguaugaucuugaag

SEQ ID NO: 322977 - RNA, 18 nt, Human
caugaagguaucagccug

SEQ ID NO: 322978 - RNA, 22 nt, Human
ccaauaacauggaguuuuuuuc

SEQ ID NO: 322979 - RNA, 19 nt, Human
ccucuguggagcugagccu

SEQ ID NO: 322980 - RNA, 22 nt, Human
cucaagaaaaaaaguucauaaa

SEQ ID NO: 322981 - RNA, 20 nt, Human
cuccuugaagaaaaagcaau

SEQ ID NO: 322982 - RNA, 23 nt, Human
cucugcgccugcguguucuccuc

SEQ ID NO: 322983 - RNA, 21 nt, Human
gagcacggcuguaggcugugc

SEQ ID NO: 322984 - RNA, 19 nt, Human
gcuguaggcugugcugucc

SEQ ID NO: 322985 - RNA, 21 nt, Human
ggugauuguaaguaguuugag

SEQ ID NO: 322986 - RNA, 22 nt, Human
uaugaaaacauuaugcuuuuga

SEQ ID NO: 322987 - RNA, 24 nt, Human
uauuuaguccaauaacauggaguu

SEQ ID NO: 322988 - RNA, 25 nt, Human
ucagagucuuuuccauaaaucuccu

SEQ ID NO: 322989 - RNA, 20 nt, Human
uccucuguggagcugagccu

SEQ ID NO: 322990 - RNA, 19 nt, Human
uggggcacucagauagaga

SEQ ID NO: 322991 - RNA, 21 nt, Human
ugucuagaauuucaugaaggu

SEQ ID NO: 322992 - RNA, 23 nt, Human
uuuuccauaaaucuccuugaaga

SEQ ID NO: 322993 - RNA, 20 nt, Human
uuuuguuuacaaaaguauac

SEQ ID NO: 322994 - RNA, 18 nt, Human
uuuuuuuuuuuuuuuuug

SEQ ID NO: 322995 - RNA, 23 nt, Human
uuuuuuuuuuuuuuuuugaacuu

SEQ ID NO: 322996 - RNA, 23 nt, Human
cauguuuuaauccuagcacuuug

SEQ ID NO: 322997 - RNA, 18 nt, Human
cugucuguguguucuccc

SEQ ID NO: 322998 - RNA, 18 nt, Human
gugggucauguuuuaauc

SEQ ID NO: 322999 - RNA, 18 nt, Human
ucucugcugucugugugu

SEQ ID NO: 323000 - RNA, 18 nt, Human
ugucuguguguucucccc

SEQ ID NO: 323001 - RNA, 24 nt, Human
aaaccaucuucucugcaaacacac

SEQ ID NO: 323002 - RNA, 20 nt, Human
aacauuuuggugaguucuga

SEQ ID NO: 323003 - RNA, 18 nt, Human
aggaaauggugagagcca

SEQ ID NO: 323004 - RNA, 19 nt, Human
aggcaggcacaagcaagga

SEQ ID NO: 323005 - RNA, 26 nt, Human
auagaaaccaucuucucugcaaacac

SEQ ID NO: 323006 - RNA, 21 nt, Human
aucucuguguucauuucuauu

SEQ ID NO: 323007 - RNA, 23 nt, Human
cacauuuccuccugagauguuau

SEQ ID NO: 323008 - RNA, 19 nt, Human
caucuugggaaaaacuguc

SEQ ID NO: 323009 - RNA, 20 nt, Human
ccacacaaugugcauuuaaa

SEQ ID NO: 323010 - RNA, 18 nt, Human
ccuauacuacaugugaaa

SEQ ID NO: 323011 - RNA, 24 nt, Human
ccuccugagauguuauguaaaagu

SEQ ID NO: 323012 - RNA, 21 nt, Human
cuaagaggggugagagccuca

SEQ ID NO: 323013 - RNA, 18 nt, Human
cugcauuauccugccaag

SEQ ID NO: 323014 - RNA, 19 nt, Human
cugcauuauccugccaagu

SEQ ID NO: 323015 - RNA, 18 nt, Human
gaauuggaggaacuagua

SEQ ID NO: 323016 - RNA, 19 nt, Human
ggauuuucccaugaaauuu

SEQ ID NO: 323017 - RNA, 19 nt, Human
gggagaagauggaauugga

SEQ ID NO: 323018 - RNA, 22 nt, Human
ggucuugcucuuugagguucca

SEQ ID NO: 323019 - RNA, 19 nt, Human
ggugaguucugaguggcuc

SEQ ID NO: 323020 - RNA, 24 nt, Human
guuugagcagcuguuguuauggug

SEQ ID NO: 323021 - RNA, 23 nt, Human
uacaauguaucucuuaggaaaug

SEQ ID NO: 323022 - RNA, 22 nt, Human
uacuacaugugaaauucuaaug

SEQ ID NO: 323023 - RNA, 20 nt, Human
uaggaaauggugagagccau

SEQ ID NO: 323024 - RNA, 20 nt, Human
uagggcuucuggaacagagu

SEQ ID NO: 323025 - RNA, 23 nt, Human
ucuaaugacugcauuauccugcc

SEQ ID NO: 323026 - RNA, 24 nt, Human
ucuacuauaauuucagcuuuccua

SEQ ID NO: 323027 - RNA, 22 nt, Human
ucucuuaggaaauggugagagc

SEQ ID NO: 323028 - RNA, 21 nt, Human
ucugcucccugcguguucucc

SEQ ID NO: 323029 - RNA, 20 nt, Human
ugcaagauggagagagccac

SEQ ID NO: 323030 - RNA, 19 nt, Human
ugccaagugaaagaggcag

SEQ ID NO: 323031 - RNA, 21 nt, Human
ugggaaaaacuguccacagug

SEQ ID NO: 323032 - RNA, 21 nt, Human
ugggaaaaacuguccacagug

SEQ ID NO: 323033 - RNA, 22 nt, Human
ugggagaagauggaauuggagg

SEQ ID NO: 323034 - RNA, 20 nt, Human
ugggagcccuguaugcaaga

SEQ ID NO: 323035 - RNA, 26 nt, Human
ugggucuugcucuuugagguuccaug

SEQ ID NO: 323036 - RNA, 27 nt, Human
uguuuuauucugcuagaaucagucuua

SEQ ID NO: 323037 - RNA, 19 nt, Human
uucugaguggcucagacau

SEQ ID NO: 323038 - RNA, 26 nt, Human
uuuacaauguaucucuuaggaaaugg

SEQ ID NO: 323039 - RNA, 24 nt, Human
aagaaaaaaaguucauaaaucugg

SEQ ID NO: 323040 - RNA, 24 nt, Human
acuuuaccaauugcugaagaaaaa

SEQ ID NO: 323041 - RNA, 26 nt, Human
caaagaaucagcacauuuuccaauaa

SEQ ID NO: 323042 - RNA, 18 nt, Human
caugaagguaucagccug

SEQ ID NO: 323043 - RNA, 18 nt, Human
cugccuguguguucuccu

SEQ ID NO: 323044 - RNA, 19 nt, Human
gcugucagcugugcugucc

SEQ ID NO: 323045 - RNA, 24 nt, Human
uauuuaguccaauaacauugaguu

SEQ ID NO: 323046 - RNA, 20 nt, Human
ucagauagacagcaaaagca

SEQ ID NO: 323047 - RNA, 18 nt, Human
ucucugcugccugugugu

SEQ ID NO: 323048 - RNA, 23 nt, Human
ugaaaacauuauccuuuugauua

SEQ ID NO: 323049 - RNA, 20 nt, Human
ugaagaaaaaaaguucauaa

SEQ ID NO: 323050 - RNA, 20 nt, Human
ugaagguaucagccuguucu

SEQ ID NO: 323051 - RNA, 18 nt, Human
ugccuguguguucuccuc

SEQ ID NO: 323052 - RNA, 20 nt, Human
ugucugagcacggcugucag

SEQ ID NO: 323053 - RNA, 18 nt, Human
uguguguucuccucugug

SEQ ID NO: 323054 - RNA, 24 nt, Human
uugcugaagaaaaaaaguucauaa

SEQ ID NO: 323055 - RNA, 18 nt, Human
uuuucuucuuugucuuga

SEQ ID NO: 323056 - RNA, 23 nt, Human
uuuuucucagugucucaguuguu

SEQ ID NO: 323057 - RNA, 18 nt, Human
uuuuuuuuuuuuuuuuug

SEQ ID NO: 323058 - RNA, 19 nt, Human
acauagcauuccaccacuc

SEQ ID NO: 323059 - RNA, 23 nt, Human
caccuauguucuucauauaaaaa

SEQ ID NO: 323060 - RNA, 18 nt, Human
cagugagguugcuuggaa

SEQ ID NO: 323061 - RNA, 24 nt, Human
gaggugcugccgaaaguaucgcuc

SEQ ID NO: 323062 - RNA, 19 nt, Human
gguggcggcgcgggccugg

SEQ ID NO: 323063 - RNA, 24 nt, Human
guggugccuguauucuuacauauu

SEQ ID NO: 323064 - RNA, 21 nt, Human
uacagagaagucugcgggagu

SEQ ID NO: 323065 - RNA, 23 nt, Human
uagcauuccaccacucugcaacu

SEQ ID NO: 323066 - RNA, 22 nt, Human
ucaaaguauagauuauugucau

SEQ ID NO: 323067 - RNA, 21 nt, Human
uccaccacucugcaacuuuug

SEQ ID NO: 323068 - RNA, 26 nt, Human
uccaccacucugcaacuuuugguuca

SEQ ID NO: 323069 - RNA, 24 nt, Human
uccagcaaaacugagaaucaagga

SEQ ID NO: 323070 - RNA, 20 nt, Human
ucuacagagaagucugcggg

SEQ ID NO: 323071 - RNA, 22 nt, Human
ucuagaaaaugauuauacagac

SEQ ID NO: 323072 - RNA, 19 nt, Human
ucuggacugauuccuaaaa

SEQ ID NO: 323073 - RNA, 27 nt, Human
aaacaaaacauacuuuaaacauguuua

SEQ ID NO: 323074 - RNA, 27 nt, Human
auacuuuaaacauguuuaaguagauua

SEQ ID NO: 323075 - RNA, 23 nt, Human
cugcaaaacaaaacauacuuuaa

SEQ ID NO: 323076 - RNA, 21 nt, Human
ugcaaaaagucugcaaaacaa

SEQ ID NO: 323077 - RNA, 22 nt, Human
uuaaaaacagucgauuuaaacc

SEQ ID NO: 323078 - RNA, 21 nt, Human
uuuaaaccauguagaaauaag

SEQ ID NO: 323079 - RNA, 24 nt, Human
aguagaaauuuaaaauacaauaga

SEQ ID NO: 323080 - RNA, 22 nt, Human
aaggacauuauuagaacugaaa

SEQ ID NO: 323081 - RNA, 22 nt, Human
cauuuaaaaaaugcacauacaa

SEQ ID NO: 323082 - RNA, 22 nt, Human
ccagagaaguucugaggaucag

SEQ ID NO: 323083 - RNA, 20 nt, Human
ugcacauacaauggagauuu

SEQ ID NO: 323084 - RNA, 25 nt, Human
uuuaaaaaaugcacauacaauggag

SEQ ID NO: 323085 - RNA, 24 nt, Human
uuuuuuuuuuuuuuuuuuuauuuu

SEQ ID NO: 323086 - RNA, 19 nt, Human
aaacaaaaccauccaaggu

SEQ ID NO: 323087 - RNA, 20 nt, Human
aaaguacaaaaucaaccagg

SEQ ID NO: 323088 - RNA, 22 nt, Human
aacugauuggugauaagagcac

SEQ ID NO: 323089 - RNA, 19 nt, Human
acaaaaucaaccaggucug

SEQ ID NO: 323090 - RNA, 21 nt, Human
accauccaagguacaguucca

SEQ ID NO: 323091 - RNA, 20 nt, Human
caaaaccauccaagguacag

SEQ ID NO: 323092 - RNA, 19 nt, Human
caaaguacaaaaucaacca

SEQ ID NO: 323093 - RNA, 24 nt, Human
ccaagguacaguuccaaaguacaa

SEQ ID NO: 323094 - RNA, 19 nt, Human
ggugauaagagcacacaga

SEQ ID NO: 323095 - RNA, 21 nt, Human
uaaacaaaaccauccaaggua

SEQ ID NO: 323096 - RNA, 19 nt, Human
aggcagaggggauuagggg

SEQ ID NO: 323097 - RNA, 20 nt, Human
aggcagaggggauuaggggu

SEQ ID NO: 323098 - RNA, 20 nt, Human
cccuuguuccaagcucuaag

SEQ ID NO: 323099 - RNA, 21 nt, Human
gcaggcagaggggauuagggg

SEQ ID NO: 323100 - RNA, 20 nt, Human
ggcagaggggauuagggguc

SEQ ID NO: 323101 - RNA, 21 nt, Human
uguuccaagcucuaagccuca

SEQ ID NO: 323102 - RNA, 23 nt, Human
uucccccuuguuccaagcucuaa

SEQ ID NO: 323103 - RNA, 23 nt, Human
uuuguuuuuuuuuuuuuuaacug

SEQ ID NO: 323104 - RNA, 24 nt, Human
uuuuuuuuuuuuuuuuuuguuuuu

SEQ ID NO: 323105 - RNA, 23 nt, Human
uuuuuuuuuuuuuuuuuuuuggg

SEQ ID NO: 323106 - RNA, 25 nt, Human
aaaaaaauaaaggagcccaucaaaa

SEQ ID NO: 323107 - RNA, 19 nt, Human
aaaaagaucaucuucccuc

SEQ ID NO: 323108 - RNA, 24 nt, Human
aaagugcugggauuacaggcauga

SEQ ID NO: 323109 - RNA, 23 nt, Human
aagaaaagucagaccuggcaaaa

SEQ ID NO: 323110 - RNA, 22 nt, Human
aagcaggaagcagaugacugga

SEQ ID NO: 323111 - RNA, 24 nt, Human
aaguaguuggguuuacaggcgugu

SEQ ID NO: 323112 - RNA, 19 nt, Human
aagugcugggauuacaggc

SEQ ID NO: 323113 - RNA, 21 nt, Human
aagugcugggauuacaggcau

SEQ ID NO: 323114 - RNA, 26 nt, Human
aagugcugggauuacaggcaugagcc

SEQ ID NO: 323115 - RNA, 22 nt, Human
acagcacuccagccugggcuag

SEQ ID NO: 323116 - RNA, 24 nt, Human
acagcacuccagccugggcuagag

SEQ ID NO: 323117 - RNA, 20 nt, Human
acauggugagacccugucuc

SEQ ID NO: 323118 - RNA, 22 nt, Human
acauggugagacccugucucua

SEQ ID NO: 323119 - RNA, 24 nt, Human
accauguuggccaggcuggucuug

SEQ ID NO: 323120 - RNA, 24 nt, Human
accauguuggucaggauggucucg

SEQ ID NO: 323121 - RNA, 18 nt, Human
accuggaccagagggcuc

SEQ ID NO: 323122 - RNA, 22 nt, Human
acgccacagcacuccagccugg

SEQ ID NO: 323123 - RNA, 21 nt, Human
acgggguuucaccauguuggu

SEQ ID NO: 323124 - RNA, 23 nt, Human
acgggguuucaccauguugguca

SEQ ID NO: 323125 - RNA, 24 nt, Human
acgggguuucaccauguuggucag

SEQ ID NO: 323126 - RNA, 22 nt, Human
acuccagccugggcuagaguga

SEQ ID NO: 323127 - RNA, 24 nt, Human
acucuguugccaggcuggaguaca

SEQ ID NO: 323128 - RNA, 18 nt, Human
agacgggaggaucacuug

SEQ ID NO: 323129 - RNA, 24 nt, Human
agacgggaggaucacuugggcccg

SEQ ID NO: 323130 - RNA, 24 nt, Human
agcaggaagaaaagucagaccugg

SEQ ID NO: 323131 - RNA, 20 nt, Human
agccaccacacccagcucug

SEQ ID NO: 323132 - RNA, 24 nt, Human
agccaggcuggagugcaguggcau

SEQ ID NO: 323133 - RNA, 22 nt, Human
agcugaaguuuccuccaggaag

SEQ ID NO: 323134 - RNA, 21 nt, Human
aggaagggaagcaggaagcag

SEQ ID NO: 323135 - RNA, 24 nt, Human
aggcggagguugcagugagccaag

SEQ ID NO: 323136 - RNA, 24 nt, Human
aggcgugugccaccacgccuggcu

SEQ ID NO: 323137 - RNA, 24 nt, Human
aggcugagacgggaggaucacuug

SEQ ID NO: 323138 - RNA, 25 nt, Human
aggcuggagugcaguggcaugaucu

SEQ ID NO: 323139 - RNA, 20 nt, Human
aguacaguggcgcgaucuag

SEQ ID NO: 323140 - RNA, 22 nt, Human
aguagagaugggguuucaccau

SEQ ID NO: 323141 - RNA, 20 nt, Human
agugcaguggcaugaucucg

SEQ ID NO: 323142 - RNA, 23 nt, Human
agugcaguggcaugaucucggcu

SEQ ID NO: 323143 - RNA, 24 nt, Human
agugcaguggcaugaucucggcuc

SEQ ID NO: 323144 - RNA, 18 nt, Human
agugcugggauuacaggc

SEQ ID NO: 323145 - RNA, 24 nt, Human
aguggcaugaucucggcucacugc

SEQ ID NO: 323146 - RNA, 20 nt, Human
auauauuuuuuuaguagaga

SEQ ID NO: 323147 - RNA, 21 nt, Human
auauuuuuuuaguagagaugg

SEQ ID NO: 323148 - RNA, 18 nt, Human
augggguuucaccauguu

SEQ ID NO: 323149 - RNA, 22 nt, Human
augggguuucaccauguuggcc

SEQ ID NO: 323150 - RNA, 24 nt, Human
augggguuucaccauguuggccag

SEQ ID NO: 323151 - RNA, 24 nt, Human
auuacgccacagcacuccagccug

SEQ ID NO: 323152 - RNA, 20 nt, Human
caaaaaaaaguucccuggca

SEQ ID NO: 323153 - RNA, 24 nt, Human
caaaaagaaccacuacuuuagaga

SEQ ID NO: 323154 - RNA, 24 nt, Human
caaagugcugggauuacaggcaug

SEQ ID NO: 323155 - RNA, 22 nt, Human
caagcaauucuccugccucagc

SEQ ID NO: 323156 - RNA, 27 nt, Human
caagcaauucuccugccucagccuccc

SEQ ID NO: 323157 - RNA, 26 nt, Human
cacacccagcucuggaagaaauauuu

SEQ ID NO: 323158 - RNA, 22 nt, Human
cacagcacuccagccugggcua

SEQ ID NO: 323159 - RNA, 24 nt, Human
caccacgcccagcuaauuuuugua

SEQ ID NO: 323160 - RNA, 21 nt, Human
caccauguuggccaggcuggu

SEQ ID NO: 323161 - RNA, 22 nt, Human
caccauguuggccaggcugguc

SEQ ID NO: 323162 - RNA, 23 nt, Human
caccauguuggccaggcuggucu

SEQ ID NO: 323163 - RNA, 24 nt, Human
caccauguuggccaggcuggucuu

SEQ ID NO: 323164 - RNA, 18 nt, Human
caccauguuggucaggau

SEQ ID NO: 323165 - RNA, 24 nt, Human
caccauguuggucaggauggucuc

SEQ ID NO: 323166 - RNA, 20 nt, Human
cacuccagccugggcuagag

SEQ ID NO: 323167 - RNA, 20 nt, Human
cacuccagccugggcuagag

SEQ ID NO: 323168 - RNA, 22 nt, Human
cacuccagccugggcuagagug

SEQ ID NO: 323169 - RNA, 18 nt, Human
cacucuguugccaggcug

SEQ ID NO: 323170 - RNA, 23 nt, Human
cacugcaaccucccucucccggg

SEQ ID NO: 323171 - RNA, 21 nt, Human
cacugcaaccuccgccucccg

SEQ ID NO: 323172 - RNA, 23 nt, Human
cacugcaaccuccgccucccggg

SEQ ID NO: 323173 - RNA, 22 nt, Human
cagagacgggguuucaccaugu

SEQ ID NO: 323174 - RNA, 22 nt, Human
caguagcugggacuaggggugc

SEQ ID NO: 323175 - RNA, 22 nt, Human
cauguuacauuaagugcaugua

SEQ ID NO: 323176 - RNA, 24 nt, Human
cauguuggccaggcuggucuugaa

SEQ ID NO: 323177 - RNA, 23 nt, Human
ccaaagugcugggauuacaggca

SEQ ID NO: 323178 - RNA, 24 nt, Human
ccaaagugcugggauuacaggcau

SEQ ID NO: 323179 - RNA, 20 nt, Human
ccacagcacuccagccuggg

SEQ ID NO: 323180 - RNA, 21 nt, Human
ccacagcacuccagccugggc

SEQ ID NO: 323181 - RNA, 20 nt, Human
ccaccacgcccagcuaauuu

SEQ ID NO: 323182 - RNA, 24 nt, Human
cccaaagugcugggauuacaggca

SEQ ID NO: 323183 - RNA, 23 nt, Human
cccaaguaguuggguuuacaggc

SEQ ID NO: 323184 - RNA, 23 nt, Human
cccgggcucaagcaauucuccug

SEQ ID NO: 323185 - RNA, 24 nt, Human
ccgccucccggguucgaccgauuc

SEQ ID NO: 323186 - RNA, 24 nt, Human
ccucccggguucgaccgauucucc

SEQ ID NO: 323187 - RNA, 21 nt, Human
ccuguaaucccagcuacucag

SEQ ID NO: 323188 - RNA, 18 nt, Human
cgccucccggguucgacc

SEQ ID NO: 323189 - RNA, 24 nt, Human
cgccucggccucccaaagugcugg

SEQ ID NO: 323190 - RNA, 24 nt, Human
cgccuguaaucccagcuacucagg

SEQ ID NO: 323191 - RNA, 24 nt, Human
cgggaggcggagguugcagugagc

SEQ ID NO: 323192 - RNA, 24 nt, Human
cgggguuucaccauguuggucagg

SEQ ID NO: 323193 - RNA, 21 nt, Human
cgucucagccuccccaguagc

SEQ ID NO: 323194 - RNA, 25 nt, Human
cuagcugggcauugguggugugcgc

SEQ ID NO: 323195 - RNA, 24 nt, Human
cucaagcaauucuccugccucagc

SEQ ID NO: 323196 - RNA, 18 nt, Human
cucacucuguugccaggc

SEQ ID NO: 323197 - RNA, 23 nt, Human
cucacucuguugccaggcuggag

SEQ ID NO: 323198 - RNA, 23 nt, Human
cucacugcaaccucccucucccg

SEQ ID NO: 323199 - RNA, 24 nt, Human
cucacugcaaccucccucucccgg

SEQ ID NO: 323200 - RNA, 24 nt, Human
cucacugcaaccuccgccucccgg

SEQ ID NO: 323201 - RNA, 21 nt, Human
cucagccuccccaguagcugg

SEQ ID NO: 323202 - RNA, 24 nt, Human
cucagccuccccaguagcugggac

SEQ ID NO: 323203 - RNA, 25 nt, Human
cucccgggcucaagcaauucuccug

SEQ ID NO: 323204 - RNA, 23 nt, Human
cucuaugaaaaacacaaaaacua

SEQ ID NO: 323205 - RNA, 20 nt, Human
cucugucagccaggcuggag

SEQ ID NO: 323206 - RNA, 24 nt, Human
cucuugaccucgugauccgcccgc

SEQ ID NO: 323207 - RNA, 23 nt, Human
cugcaaccucccucucccgggcu

SEQ ID NO: 323208 - RNA, 24 nt, Human
cugcaaccucccucucccgggcuc

SEQ ID NO: 323209 - RNA, 23 nt, Human
cugcaaccuccgccucccggguu

SEQ ID NO: 323210 - RNA, 24 nt, Human
cugcaaccuccgccucccggguuc

SEQ ID NO: 323211 - RNA, 21 nt, Human
cugccucagccucccaaguag

SEQ ID NO: 323212 - RNA, 24 nt, Human
cuggagugcaguggcaugaucucg

SEQ ID NO: 323213 - RNA, 18 nt, Human
cugucagccaggcuggag

SEQ ID NO: 323214 - RNA, 22 nt, Human
gaaaaaaauaaaggagcccauc

SEQ ID NO: 323215 - RNA, 26 nt, Human
gaaaaaaauaaaggagcccaucaaaa

SEQ ID NO: 323216 - RNA, 19 nt, Human
gaagcaggaagcagaugac

SEQ ID NO: 323217 - RNA, 20 nt, Human
gacagagucuugcucuguca

SEQ ID NO: 323218 - RNA, 22 nt, Human
gaccucgugauccgcccgccuc

SEQ ID NO: 323219 - RNA, 22 nt, Human
gaccucgugauccgcccgccuc

SEQ ID NO: 323220 - RNA, 24 nt, Human
gaccucgugauccgcccgccucgg

SEQ ID NO: 323221 - RNA, 24 nt, Human
gacggagucucacucuguugccag

SEQ ID NO: 323222 - RNA, 23 nt, Human
gagacgggguuucaccauguugg

SEQ ID NO: 323223 - RNA, 24 nt, Human
gagacgggguuucaccauguuggu

SEQ ID NO: 323224 - RNA, 20 nt, Human
gagaugggguuucaccaugu

SEQ ID NO: 323225 - RNA, 24 nt, Human
gagaugggguuucaccauguuggc

SEQ ID NO: 323226 - RNA, 22 nt, Human
gagcaggaagaaaagucagacc

SEQ ID NO: 323227 - RNA, 18 nt, Human
gagguugcagugagccaa

SEQ ID NO: 323228 - RNA, 22 nt, Human
gagguugcagugagccaagauu

SEQ ID NO: 323229 - RNA, 18 nt, Human
gauuacaggcaugagcca

SEQ ID NO: 323230 - RNA, 21 nt, Human
gauuacaggcaugagccacca

SEQ ID NO: 323231 - RNA, 22 nt, Human
gauuacaggcaugagccaccac

SEQ ID NO: 323232 - RNA, 18 nt, Human
gauuauagggauggaaga

SEQ ID NO: 323233 - RNA, 22 nt, Human
gauucucccgucucagccuccc

SEQ ID NO: 323234 - RNA, 21 nt, Human
gcaaaaagaucaucuucccuc

SEQ ID NO: 323235 - RNA, 21 nt, Human
gcacuccagccugggcuagag

SEQ ID NO: 323236 - RNA, 22 nt, Human
gccacagcacuccagccugggc

SEQ ID NO: 323237 - RNA, 23 nt, Human
gccacagcacuccagccugggcu

SEQ ID NO: 323238 - RNA, 22 nt, Human
gcccagcuaauuuuuguauuuu

SEQ ID NO: 323239 - RNA, 21 nt, Human
gcuaguuggaaaggaagccaa

SEQ ID NO: 323240 - RNA, 23 nt, Human
gcucacugcaaccucccucuccc

SEQ ID NO: 323241 - RNA, 24 nt, Human
gcuggaguacaguggcgcgaucua

SEQ ID NO: 323242 - RNA, 20 nt, Human
ggagguugcagugagccaag

SEQ ID NO: 323243 - RNA, 24 nt, Human
ggagguugcagugagccaagauua

SEQ ID NO: 323244 - RNA, 19 nt, Human
ggauuacaggcaugagcca

SEQ ID NO: 323245 - RNA, 22 nt, Human
gggguuucaccauguuggccag

SEQ ID NO: 323246 - RNA, 23 nt, Human
gggguuucaccauguuggucagg

SEQ ID NO: 323247 - RNA, 18 nt, Human
ggguuucaccauguuggc

SEQ ID NO: 323248 - RNA, 22 nt, Human
ggguuucaccauguuggccagg

SEQ ID NO: 323249 - RNA, 20 nt, Human
ggugcgugccaccacgccca

SEQ ID NO: 323250 - RNA, 24 nt, Human
gguggugugcgccuguaaucccag

SEQ ID NO: 323251 - RNA, 23 nt, Human
guagagaugggguuucaccaugu

SEQ ID NO: 323252 - RNA, 19 nt, Human
gucagccaggcuggagugc

SEQ ID NO: 323253 - RNA, 24 nt, Human
gucucacucuguugccaggcugga

SEQ ID NO: 323254 - RNA, 24 nt, Human
gugauccgcccgccucggccuccc

SEQ ID NO: 323255 - RNA, 20 nt, Human
gugggagggaggacaugaug

SEQ ID NO: 323256 - RNA, 24 nt, Human
guggugugcgccuguaaucccagc

SEQ ID NO: 323257 - RNA, 24 nt, Human
uaauuuuuguauuuuuagcagaga

SEQ ID NO: 323258 - RNA, 24 nt, Human
uacaggcaugagccaccacaccca

SEQ ID NO: 323259 - RNA, 22 nt, Human
uacaggcgugugccaccacgcc

SEQ ID NO: 323260 - RNA, 18 nt, Human
uacauguuuuuguacugu

SEQ ID NO: 323261 - RNA, 22 nt, Human
uagaaaaaaauaaaggagccca

SEQ ID NO: 323262 - RNA, 22 nt, Human
uagagaugggguuucaccaugu

SEQ ID NO: 323263 - RNA, 23 nt, Human
uagagugagacccugucucuaaa

SEQ ID NO: 323264 - RNA, 24 nt, Human
uagcagagacgggguuucaccaug

SEQ ID NO: 323265 - RNA, 25 nt, Human
uagcagagacgggguuucaccaugu

SEQ ID NO: 323266 - RNA, 24 nt, Human
uaguagagaugggguuucaccaug

SEQ ID NO: 323267 - RNA, 26 nt, Human
uaguagagaugggguuucaccauguu

SEQ ID NO: 323268 - RNA, 18 nt, Human
uauauuuuuuuaguagag

SEQ ID NO: 323269 - RNA, 24 nt, Human
uaugaaaaacacaaaaacuagcug

SEQ ID NO: 323270 - RNA, 21 nt, Human
uauguauguauacuuuacaca

SEQ ID NO: 323271 - RNA, 23 nt, Human
ucaaaaaaaaguucccuggcaac

SEQ ID NO: 323272 - RNA, 24 nt, Human
ucaccauguuggucaggauggucu

SEQ ID NO: 323273 - RNA, 24 nt, Human
ucacugcaaccucccucucccggg

SEQ ID NO: 323274 - RNA, 23 nt, Human
ucacugcaaccuccgccucccgg

SEQ ID NO: 323275 - RNA, 24 nt, Human
ucacugcaaccuccgccucccggg

SEQ ID NO: 323276 - RNA, 25 nt, Human
ucacugcaaccuccgccucccgggu

SEQ ID NO: 323277 - RNA, 27 nt, Human
ucacugcaaccuccgccucccggguuc

SEQ ID NO: 323278 - RNA, 24 nt, Human
ucacuugggcccgggaggcggagg

SEQ ID NO: 323279 - RNA, 25 nt, Human
ucacuugggcccgggaggcggaggu

SEQ ID NO: 323280 - RNA, 23 nt, Human
ucagaccuggcaaaaagaucauc

SEQ ID NO: 323281 - RNA, 19 nt, Human
ucagccaggcuggagugca

SEQ ID NO: 323282 - RNA, 20 nt, Human
ucagccuccccaguagcugg

SEQ ID NO: 323283 - RNA, 21 nt, Human
uccagccugggcuagagugag

SEQ ID NO: 323284 - RNA, 22 nt, Human
uccagccugggcuagagugaga

SEQ ID NO: 323285 - RNA, 24 nt, Human
ucccaaagugcugggauuacaggc

SEQ ID NO: 323286 - RNA, 24 nt, Human
ucccaaguaguuggguuuacaggc

SEQ ID NO: 323287 - RNA, 21 nt, Human
ucccgggcucaagcaauucuc

SEQ ID NO: 323288 - RNA, 24 nt, Human
ucccgggcucaagcaauucuccug

SEQ ID NO: 323289 - RNA, 19 nt, Human
ucccggguucgaccgauuc

SEQ ID NO: 323290 - RNA, 21 nt, Human
ucccggguucgaccgauucuc

SEQ ID NO: 323291 - RNA, 18 nt, Human
ucccuggcaagugggagg

SEQ ID NO: 323292 - RNA, 18 nt, Human
ucggccucccaaagugcu

SEQ ID NO: 323293 - RNA, 21 nt, Human
ucucacucuguugccaggcug

SEQ ID NO: 323294 - RNA, 23 nt, Human
ucucacucuguugccaggcugga

SEQ ID NO: 323295 - RNA, 24 nt, Human
ucucccgggcucaagcaauucucc

SEQ ID NO: 323296 - RNA, 25 nt, Human
ucucccgucucagccuccccaguag

SEQ ID NO: 323297 - RNA, 19 nt, Human
ucuccugccucagccuccc

SEQ ID NO: 323298 - RNA, 18 nt, Human
ucucuaaauaaauaaaua

SEQ ID NO: 323299 - RNA, 19 nt, Human
ucugucagccaggcuggag

SEQ ID NO: 323300 - RNA, 24 nt, Human
ucugucagccaggcuggagugcag

SEQ ID NO: 323301 - RNA, 23 nt, Human
ucuugcucugucagccaggcugg

SEQ ID NO: 323302 - RNA, 24 nt, Human
ucuugcucugucagccaggcugga

SEQ ID NO: 323303 - RNA, 21 nt, Human
ugaaaaacacaaaaacuagcu

SEQ ID NO: 323304 - RNA, 20 nt, Human
ugaaugacauggugagaccc

SEQ ID NO: 323305 - RNA, 20 nt, Human
ugaaugacauggugagaccc

SEQ ID NO: 323306 - RNA, 24 nt, Human
ugaaugacauggugagacccuguc

SEQ ID NO: 323307 - RNA, 22 nt, Human
ugacauggugagacccugucuc

SEQ ID NO: 323308 - RNA, 24 nt, Human
ugacauggugagacccugucucua

SEQ ID NO: 323309 - RNA, 18 nt, Human
ugagacagagucuugcuc

SEQ ID NO: 323310 - RNA, 22 nt, Human
ugagacagagucuugcucuguc

SEQ ID NO: 323311 - RNA, 22 nt, Human
ugagacggagucucacucuguu

SEQ ID NO: 323312 - RNA, 22 nt, Human
ugagacgggaggaucacuuggg

SEQ ID NO: 323313 - RNA, 22 nt, Human
ugcaguggcaugaucucggcuc

SEQ ID NO: 323314 - RNA, 20 nt, Human
ugccaggcuggaguacagug

SEQ ID NO: 323315 - RNA, 23 nt, Human
ugccaggcuggaguacaguggcg

SEQ ID NO: 323316 - RNA, 24 nt, Human
ugccucagccucccaaguaguugg

SEQ ID NO: 323317 - RNA, 19 nt, Human
ugcgugccaccacgcccag

SEQ ID NO: 323318 - RNA, 21 nt, Human
ugcgugccaccacgcccagcu

SEQ ID NO: 323319 - RNA, 22 nt, Human
uggagggcggagcaggaagaaa

SEQ ID NO: 323320 - RNA, 19 nt, Human
uggaguacaguggcgcgau

SEQ ID NO: 323321 - RNA, 19 nt, Human
uggagugcaguggcaugau

SEQ ID NO: 323322 - RNA, 24 nt, Human
uggagugcaguggcaugaucucgg

SEQ ID NO: 323323 - RNA, 19 nt, Human
uggccaggcuggucuugaa

SEQ ID NO: 323324 - RNA, 18 nt, Human
ugggauuacaggcaugag

SEQ ID NO: 323325 - RNA, 19 nt, Human
ugggauuacaggcaugagc

SEQ ID NO: 323326 - RNA, 22 nt, Human
ugggauuacaggcaugagccac

SEQ ID NO: 323327 - RNA, 23 nt, Human
ugggauuacaggcaugagccacc

SEQ ID NO: 323328 - RNA, 24 nt, Human
ugggauuacaggcaugagccacca

SEQ ID NO: 323329 - RNA, 24 nt, Human
ugggauuacaggcaugagccacca

SEQ ID NO: 323330 - RNA, 19 nt, Human
ugggcccgggaggcggagg

SEQ ID NO: 323331 - RNA, 24 nt, Human
ugggcccgggaggcggagguugca

SEQ ID NO: 323332 - RNA, 23 nt, Human
ugggcuagagugagacccugucu

SEQ ID NO: 323333 - RNA, 24 nt, Human
ugggguuucaccauguuggccagg

SEQ ID NO: 323334 - RNA, 22 nt, Human
uggguuuacaggcgugugccac

SEQ ID NO: 323335 - RNA, 24 nt, Human
uggguuuacaggcgugugccacca

SEQ ID NO: 323336 - RNA, 24 nt, Human
uggucaggauggucucgcucucuu

SEQ ID NO: 323337 - RNA, 24 nt, Human
ugguggugugcgccuguaauccca

SEQ ID NO: 323338 - RNA, 21 nt, Human
uggugugcgccuguaauccca

SEQ ID NO: 323339 - RNA, 22 nt, Human
uggugugcgccuguaaucccag

SEQ ID NO: 323340 - RNA, 24 nt, Human
uggugugcgccuguaaucccagcu

SEQ ID NO: 323341 - RNA, 21 nt, Human
uguauuuuuagcagagacggg

SEQ ID NO: 323342 - RNA, 18 nt, Human
ugucuguauguauguaua

SEQ ID NO: 323343 - RNA, 18 nt, Human
ugugucuguauguaugua

SEQ ID NO: 323344 - RNA, 18 nt, Human
ugugucuguauguaugua

SEQ ID NO: 323345 - RNA, 26 nt, Human
uguuauauauuuuuuuaguagagaug

SEQ ID NO: 323346 - RNA, 24 nt, Human
uuagcagagacgggguuucaccau

SEQ ID NO: 323347 - RNA, 18 nt, Human
uuaguagagaugggguuu

SEQ ID NO: 323348 - RNA, 22 nt, Human
uuaguagagaugggguuucacc

SEQ ID NO: 323349 - RNA, 24 nt, Human
uuaguagagaugggguuucaccau

SEQ ID NO: 323350 - RNA, 20 nt, Human
uucuuuuuuuugagacggag

SEQ ID NO: 323351 - RNA, 24 nt, Human
uugaaugacauggugagacccugu

SEQ ID NO: 323352 - RNA, 20 nt, Human
uugcagugagccaagauuac

SEQ ID NO: 323353 - RNA, 22 nt, Human
uugggcccgggaggcggagguu

SEQ ID NO: 323354 - RNA, 24 nt, Human
uugggcccgggaggcggagguugc

SEQ ID NO: 323355 - RNA, 23 nt, Human
uuguauuuuuagcagagacgggg

SEQ ID NO: 323356 - RNA, 24 nt, Human
uuucaccauguuggccaggcuggu

SEQ ID NO: 323357 - RNA, 19 nt, Human
uuucaccauguuggucagg

SEQ ID NO: 323358 - RNA, 21 nt, Human
uuuuguauuuuuagcagagac

SEQ ID NO: 323359 - RNA, 24 nt, Human
uuuuuagcagagacgggguuucac

SEQ ID NO: 323360 - RNA, 24 nt, Human
uuuuuaguagagaugggguuucac

SEQ ID NO: 323361 - RNA, 20 nt, Human
uuuuuguauuuuuagcagag

SEQ ID NO: 323362 - RNA, 23 nt, Human
uuuuuuaguagagaugggguuuc

SEQ ID NO: 323363 - RNA, 20 nt, Human
uuuuuuuuuuugagacagag

SEQ ID NO: 323364 - RNA, 24 nt, Human
uuuuuuuuuuuugagacagagucu

SEQ ID NO: 323365 - RNA, 27 nt, Human
uuuuuuuuuuuuuuuuuuuuuuugggg

SEQ ID NO: 323366 - RNA, 21 nt, Human
aaaaaaaagugggcucuggga

SEQ ID NO: 323367 - RNA, 18 nt, Human
aaaagaaaaaaaaguggg

SEQ ID NO: 323368 - RNA, 21 nt, Human
auuucaaaaaaagaaaaaaaa

SEQ ID NO: 323369 - RNA, 24 nt, Human
ucaaaaaaagaaaaaaaagugggc

SEQ ID NO: 323370 - RNA, 24 nt, Human
caaaagaagagucuaucuuugaac

SEQ ID NO: 323371 - RNA, 20 nt, Human
uagggcaacuucaguucugg

SEQ ID NO: 323372 - RNA, 23 nt, Human
uuaaaaguagggcaacuucaguu

SEQ ID NO: 323373 - RNA, 23 nt, Human
uucaaaguuaaaaguagggcaac

SEQ ID NO: 323374 - RNA, 21 nt, Human
acaugagugucuuacugggcc

SEQ ID NO: 323375 - RNA, 21 nt, Human
caaugcucaccaccuuccaga

SEQ ID NO: 323376 - RNA, 19 nt, Human
cagaaccgcggccagccac

SEQ ID NO: 323377 - RNA, 23 nt, Human
ccagaaccgcggccagccaccca

SEQ ID NO: 323378 - RNA, 21 nt, Human
cuuacugggccucaaugcuca

SEQ ID NO: 323379 - RNA, 24 nt, Human
cuuccagaaccgcggccagccacc

SEQ ID NO: 323380 - RNA, 23 nt, Human
gcggccagccacccacugaugcc

SEQ ID NO: 323381 - RNA, 22 nt, Human
acuucaccggccuccucuggcu

SEQ ID NO: 323382 - RNA, 24 nt, Human
agaagaugcacuucaccggccucc

SEQ ID NO: 323383 - RNA, 22 nt, Human
agagaacacgcagaagaugcac

SEQ ID NO: 323384 - RNA, 25 nt, Human
ccaagaccucccagaggagaccuuu

SEQ ID NO: 323385 - RNA, 27 nt, Human
cccguacucucucuuuggcucaggcua

SEQ ID NO: 323386 - RNA, 20 nt, Human
ccucuggcugcugagcccgu

SEQ ID NO: 323387 - RNA, 21 nt, Human
cgcccagcacccagagaucug

SEQ ID NO: 323388 - RNA, 21 nt, Human
cggccaagaccucccagagga

SEQ ID NO: 323389 - RNA, 20 nt, Human
cguacucucucuuuggcuca

SEQ ID NO: 323390 - RNA, 24 nt, Human
cugagucggccaagaccucccaga

SEQ ID NO: 323391 - RNA, 23 nt, Human
gaagaugcacuucaccggccucc

SEQ ID NO: 323392 - RNA, 22 nt, Human
gaccugcccagcugccaccacc

SEQ ID NO: 323393 - RNA, 27 nt, Human
gccaagaccucccagaggagaccuuuu

SEQ ID NO: 323394 - RNA, 26 nt, Human
gggcacccagaaacuucccuggggga

SEQ ID NO: 323395 - RNA, 21 nt, Human
ucaccggccuccucuggcugc

SEQ ID NO: 323396 - RNA, 21 nt, Human
ucccugagucggccaagaccu

SEQ ID NO: 323397 - RNA, 19 nt, Human
uggcuuaggucccugaguc

SEQ ID NO: 323398 - RNA, 20 nt, Human
uuuucuuuauucuacuuagu

SEQ ID NO: 323399 - RNA, 25 nt, Human
aaagagaaggccaaaugccauuuga

SEQ ID NO: 323400 - RNA, 24 nt, Human
aaagugcugggauuauagguguga

SEQ ID NO: 323401 - RNA, 24 nt, Human
aaagugcugugauuacaggcguga

SEQ ID NO: 323402 - RNA, 21 nt, Human
aaauaagaaagagaagucugg

SEQ ID NO: 323403 - RNA, 25 nt, Human
aaaucauucaguacgugaucaccug

SEQ ID NO: 323404 - RNA, 20 nt, Human
aaccuccgccuccugggcuc

SEQ ID NO: 323405 - RNA, 18 nt, Human
aagugcugggauuauagg

SEQ ID NO: 323406 - RNA, 26 nt, Human
aagugcugggauuauaggugugagcc

SEQ ID NO: 323407 - RNA, 21 nt, Human
aaucuccagggaaacguucaa

SEQ ID NO: 323408 - RNA, 22 nt, Human
aaucucugcucaccgcaaccuc

SEQ ID NO: 323409 - RNA, 22 nt, Human
acagaguaucgcucuguuuccc

SEQ ID NO: 323410 - RNA, 22 nt, Human
accauauuggucaggcugaucu

SEQ ID NO: 323411 - RNA, 24 nt, Human
accauauuggucaggcugaucuug

SEQ ID NO: 323412 - RNA, 21 nt, Human
accgcaccuggccauaaacau

SEQ ID NO: 323413 - RNA, 18 nt, Human
acgggguuucuccauguu

SEQ ID NO: 323414 - RNA, 20 nt, Human
acgggguuucuccauguugg

SEQ ID NO: 323415 - RNA, 24 nt, Human
acgggguuucuccauguuggccag

SEQ ID NO: 323416 - RNA, 23 nt, Human
acuagucugaaacuccugaccuc

SEQ ID NO: 323417 - RNA, 23 nt, Human
acucauuucccaaugaccauacc

SEQ ID NO: 323418 - RNA, 25 nt, Human
acucugucguccagacuggagugca

SEQ ID NO: 323419 - RNA, 25 nt, Human
acuggagugcaguggcacaaucucu

SEQ ID NO: 323420 - RNA, 19 nt, Human
agaaaaccaucacagaaua

SEQ ID NO: 323421 - RNA, 20 nt, Human
agaaaaccaucacagaauac

SEQ ID NO: 323422 - RNA, 24 nt, Human
agaaacagaagugaguaggaggaa

SEQ ID NO: 323423 - RNA, 19 nt, Human
agaaagucauguaaaauuu

SEQ ID NO: 323424 - RNA, 23 nt, Human
agauacauacuuucauacuaaug

SEQ ID NO: 323425 - RNA, 22 nt, Human
agcacccaccuccccuaagcuc

SEQ ID NO: 323426 - RNA, 18 nt, Human
agcccaaaauuucagaau

SEQ ID NO: 323427 - RNA, 24 nt, Human
aggugauccgccugccuuggccuc

SEQ ID NO: 323428 - RNA, 19 nt, Human
aggugugagccaccgcacc

SEQ ID NO: 323429 - RNA, 20 nt, Human
aguaacaauaacaguugggc

SEQ ID NO: 323430 - RNA, 18 nt, Human
agucccuuuuguuuucuc

SEQ ID NO: 323431 - RNA, 24 nt, Human
agugauucuucugucucagccucc

SEQ ID NO: 323432 - RNA, 21 nt, Human
agugcaauggcgcaaucucug

SEQ ID NO: 323433 - RNA, 21 nt, Human
agugcaguggcacaaucucug

SEQ ID NO: 323434 - RNA, 24 nt, Human
aguguaguggccggaucucggcuc

SEQ ID NO: 323435 - RNA, 23 nt, Human
aucaccugucauguauagggcuc

SEQ ID NO: 323436 - RNA, 24 nt, Human
caaagugcugggauuauaggugug

SEQ ID NO: 323437 - RNA, 24 nt, Human
caaagugcugugauuacaggcgug

SEQ ID NO: 323438 - RNA, 23 nt, Human
caaccuccgccuccugggcucaa

SEQ ID NO: 323439 - RNA, 21 nt, Human
caagcaauucuccugccucag

SEQ ID NO: 323440 - RNA, 22 nt, Human
caagugauucuucugucucagc

SEQ ID NO: 323441 - RNA, 22 nt, Human
caccaagcccagcuaauuuuug

SEQ ID NO: 323442 - RNA, 23 nt, Human
caccauauuggucaggcugaucu

SEQ ID NO: 323443 - RNA, 24 nt, Human
caccauauuggucaggcugaucuu

SEQ ID NO: 323444 - RNA, 22 nt, Human
cacccaccuccccuaagcucca

SEQ ID NO: 323445 - RNA, 21 nt, Human
caccgcaaccuccgccuccug

SEQ ID NO: 323446 - RNA, 22 nt, Human
cacucugucguccagacuggag

SEQ ID NO: 323447 - RNA, 23 nt, Human
cacucugucguccagacuggagu

SEQ ID NO: 323448 - RNA, 21 nt, Human
cacugcaaacucuaccucccg

SEQ ID NO: 323449 - RNA, 21 nt, Human
cacugcaacccccgccucccg

SEQ ID NO: 323450 - RNA, 23 nt, Human
cacugcaacccccgccucccggg

SEQ ID NO: 323451 - RNA, 30 nt, Human
cagaucucuugaaaccguucagagaauuuu

SEQ ID NO: 323452 - RNA, 24 nt, Human
caggcgugagccaccgugccuggc

SEQ ID NO: 323453 - RNA, 24 nt, Human
caggcuuucaccauauuggucagg

SEQ ID NO: 323454 - RNA, 24 nt, Human
caguggagacaggcuuucaccaua

SEQ ID NO: 323455 - RNA, 18 nt, Human
cauagugcagcuaaaagc

SEQ ID NO: 323456 - RNA, 21 nt, Human
cauagugcagcuaaaagcaaa

SEQ ID NO: 323457 - RNA, 21 nt, Human
ccaaagugcugggauuauagg

SEQ ID NO: 323458 - RNA, 24 nt, Human
ccaaagugcugggauuauaggugu

SEQ ID NO: 323459 - RNA, 22 nt, Human
ccaaagugcugugauuacaggc

SEQ ID NO: 323460 - RNA, 24 nt, Human
ccaaagugcugugauuacaggcgu

SEQ ID NO: 323461 - RNA, 21 nt, Human
ccaagcccagcuaauuuuugc

SEQ ID NO: 323462 - RNA, 20 nt, Human
ccauguuggccagacuaguc

SEQ ID NO: 323463 - RNA, 23 nt, Human
cccgaguagcugggauuacaccu

SEQ ID NO: 323464 - RNA, 19 nt, Human
cccggguagcugagauuac

SEQ ID NO: 323465 - RNA, 23 nt, Human
cccggguucaagcaauucuccug

SEQ ID NO: 323466 - RNA, 21 nt, Human
cccugcaaggcaccgcucucc

SEQ ID NO: 323467 - RNA, 24 nt, Human
cccugcaaggcaccgcucuccucg

SEQ ID NO: 323468 - RNA, 18 nt, Human
ccgcaaccuccgccuccu

SEQ ID NO: 323469 - RNA, 23 nt, Human
ccgcaaccuccgccuccugggcu

SEQ ID NO: 323470 - RNA, 24 nt, Human
ccgcaaccuccgccuccugggcuc

SEQ ID NO: 323471 - RNA, 26 nt, Human
ccgccucccggguucaagcaauucuu

SEQ ID NO: 323472 - RNA, 24 nt, Human
ccgccuccugggcucaagugauuc

SEQ ID NO: 323473 - RNA, 18 nt, Human
ccgcucuccucgccgccu

SEQ ID NO: 323474 - RNA, 24 nt, Human
ccucccggguucaagcaauucucc

SEQ ID NO: 323475 - RNA, 22 nt, Human
ccuccgccuccugggcucaagu

SEQ ID NO: 323476 - RNA, 18 nt, Human
ccugaccucaggugaucc

SEQ ID NO: 323477 - RNA, 21 nt, Human
ccugaccucaggugauccgcc

SEQ ID NO: 323478 - RNA, 23 nt, Human
ccugaccucaggugauccgccug

SEQ ID NO: 323479 - RNA, 22 nt, Human
ccugccuuggccucccaaagug

SEQ ID NO: 323480 - RNA, 22 nt, Human
ccugggcucaagugauucuucu

SEQ ID NO: 323481 - RNA, 23 nt, Human
ccugggcucaagugauucuucug

SEQ ID NO: 323482 - RNA, 24 nt, Human
cgcucuguuucccaggcuggagug

SEQ ID NO: 323483 - RNA, 24 nt, Human
cgcuuugucgcccaggcuggagug

SEQ ID NO: 323484 - RNA, 19 nt, Human
cgggguuucuccauguugg

SEQ ID NO: 323485 - RNA, 20 nt, Human
cuaauuuuuuguauuuucag

SEQ ID NO: 323486 - RNA, 23 nt, Human
cucaagugauucuucugucucag

SEQ ID NO: 323487 - RNA, 24 nt, Human
cucacucugucguccagacuggag

SEQ ID NO: 323488 - RNA, 23 nt, Human
cucacugcaaacucuaccucccg

SEQ ID NO: 323489 - RNA, 24 nt, Human
cucacugcaacccccgccucccgg

SEQ ID NO: 323490 - RNA, 24 nt, Human
cucagccucccgaguagcugggau

SEQ ID NO: 323491 - RNA, 19 nt, Human
cuccucgccgccugccucg

SEQ ID NO: 323492 - RNA, 26 nt, Human
cuccugaccucaggugauccgccugc

SEQ ID NO: 323493 - RNA, 20 nt, Human
cuccugggcucaagugauuc

SEQ ID NO: 323494 - RNA, 21 nt, Human
cuccugggcucaagugauucu

SEQ ID NO: 323495 - RNA, 24 nt, Human
cucgcuuugucgcccaggcuggag

SEQ ID NO: 323496 - RNA, 23 nt, Human
cugcaacccccgccucccggguu

SEQ ID NO: 323497 - RNA, 24 nt, Human
cugcaacccccgccucccggguuc

SEQ ID NO: 323498 - RNA, 23 nt, Human
cugccucagucucgcgaguagcu

SEQ ID NO: 323499 - RNA, 23 nt, Human
cugccuuggccucccaaagugcu

SEQ ID NO: 323500 - RNA, 19 nt, Human
cuggcacuacaggugugca

SEQ ID NO: 323501 - RNA, 21 nt, Human
cugggauuauaggugugagcc

SEQ ID NO: 323502 - RNA, 23 nt, Human
cugucucagccucccgaguagcu

SEQ ID NO: 323503 - RNA, 18 nt, Human
cuguuucccaggcuggag

SEQ ID NO: 323504 - RNA, 24 nt, Human
cuuaaaagaucugcccaccuuggc

SEQ ID NO: 323505 - RNA, 19 nt, Human
cuugaaaccguucagagaa

SEQ ID NO: 323506 - RNA, 24 nt, Human
gaaacgggguuucuccauguuggc

SEQ ID NO: 323507 - RNA, 23 nt, Human
gaccucaggugauccgccugccu

SEQ ID NO: 323508 - RNA, 18 nt, Human
gagaagucuggggaaggu

SEQ ID NO: 323509 - RNA, 21 nt, Human
gagagaaggucuaaaugcuac

SEQ ID NO: 323510 - RNA, 25 nt, Human
gaguagcugggauuacaccucgugc

SEQ ID NO: 323511 - RNA, 21 nt, Human
gagucucgcuuugucgcccag

SEQ ID NO: 323512 - RNA, 24 nt, Human
gaucucuugaaaccguucagagaa

SEQ ID NO: 323513 - RNA, 18 nt, Human
gauuacaggcgugagcca

SEQ ID NO: 323514 - RNA, 20 nt, Human
gauuacaggcgugagccacc

SEQ ID NO: 323515 - RNA, 20 nt, Human
gauuacaggcgugagccacc

SEQ ID NO: 323516 - RNA, 20 nt, Human
gauuacaggcgugagccacc

SEQ ID NO: 323517 - RNA, 21 nt, Human
gauuacaggcgugagccaccg

SEQ ID NO: 323518 - RNA, 18 nt, Human
gauuacaggggugcgcca

SEQ ID NO: 323519 - RNA, 18 nt, Human
gauuauaggugugagcca

SEQ ID NO: 323520 - RNA, 22 nt, Human
gauuauaggugugagccaccgc

SEQ ID NO: 323521 - RNA, 23 nt, Human
gauuauaggugugagccaccgca

SEQ ID NO: 323522 - RNA, 22 nt, Human
gauuuuacaaugcuguauauga

SEQ ID NO: 323523 - RNA, 24 nt, Human
gcacccaccuccccuaagcuccau

SEQ ID NO: 323524 - RNA, 26 nt, Human
gcacuuugcuaggcgcuuucuuuaua

SEQ ID NO: 323525 - RNA, 22 nt, Human
gccaccgcaccuggccauaaac

SEQ ID NO: 323526 - RNA, 19 nt, Human
gcccaggcuggagugcaau

SEQ ID NO: 323527 - RNA, 20 nt, Human
gcccaggcuggagugcaaug

SEQ ID NO: 323528 - RNA, 22 nt, Human
gccuuggccucccaaagugcug

SEQ ID NO: 323529 - RNA, 20 nt, Human
gcuacugaaaaaguuuucag

SEQ ID NO: 323530 - RNA, 25 nt, Human
gcuggagugcaauggcgcaaucucu

SEQ ID NO: 323531 - RNA, 20 nt, Human
gcuuggccucccaaagugcu

SEQ ID NO: 323532 - RNA, 18 nt, Human
ggagagagagagaacuag

SEQ ID NO: 323533 - RNA, 18 nt, Human
ggcacgagggagagagag

SEQ ID NO: 323534 - RNA, 23 nt, Human
ggcugaucuugaacuccugaccu

SEQ ID NO: 323535 - RNA, 19 nt, Human
gggcucaagugauucuucu

SEQ ID NO: 323536 - RNA, 21 nt, Human
gucacugagauuagaaaacca

SEQ ID NO: 323537 - RNA, 23 nt, Human
gucccuuuuguuuucucuaggaa

SEQ ID NO: 323538 - RNA, 24 nt, Human
gugauucuucugucucagccuccc

SEQ ID NO: 323539 - RNA, 20 nt, Human
uaauucguagagcaacccuu

SEQ ID NO: 323540 - RNA, 22 nt, Human
uaauuuuugcauuuuuaguaga

SEQ ID NO: 323541 - RNA, 24 nt, Human
uaauuuuuuguauuuucaguggag

SEQ ID NO: 323542 - RNA, 25 nt, Human
uaauuuuuuguauuuucaguggaga

SEQ ID NO: 323543 - RNA, 22 nt, Human
uacaggcgugagccaccgugcc

SEQ ID NO: 323544 - RNA, 23 nt, Human
uacaggcgugagccaccgugccu

SEQ ID NO: 323545 - RNA, 24 nt, Human
uacaggggugcgccaccacaccca

SEQ ID NO: 323546 - RNA, 24 nt, Human
uaguagaaacgggguuucuccaug

SEQ ID NO: 323547 - RNA, 23 nt, Human
uauaggugugagccaccgcaccu

SEQ ID NO: 323548 - RNA, 24 nt, Human
uaucgcucuguuucccaggcugga

SEQ ID NO: 323549 - RNA, 24 nt, Human
ucaccgcaaccuccgccuccuggg

SEQ ID NO: 323550 - RNA, 25 nt, Human
ucaccgcaaccuccgccuccugggc

SEQ ID NO: 323551 - RNA, 27 nt, Human
ucaccgcaaccuccgccuccugggcuc

SEQ ID NO: 323552 - RNA, 21 nt, Human
ucacugagauuagaaaaccau

SEQ ID NO: 323553 - RNA, 21 nt, Human
ucacugcaaacucuaccuccc

SEQ ID NO: 323554 - RNA, 24 nt, Human
ucacugcaaacucuaccucccggg

SEQ ID NO: 323555 - RNA, 18 nt, Human
ucacugcaacccccgccu

SEQ ID NO: 323556 - RNA, 24 nt, Human
ucacugcaacccccgccucccggg

SEQ ID NO: 323557 - RNA, 26 nt, Human
ucacugcaacccccgccucccggguu

SEQ ID NO: 323558 - RNA, 20 nt, Human
ucagccucccgaguagcugg

SEQ ID NO: 323559 - RNA, 24 nt, Human
ucaguggagacaggcuuucaccau

SEQ ID NO: 323560 - RNA, 23 nt, Human
ucauacuaaugaaaaagggaggc

SEQ ID NO: 323561 - RNA, 23 nt, Human
ucccaaagugcugggauuauagg

SEQ ID NO: 323562 - RNA, 24 nt, Human
ucccaaagugcugugauuacaggc

SEQ ID NO: 323563 - RNA, 24 nt, Human
ucccaaugaccauaccagguuuug

SEQ ID NO: 323564 - RNA, 23 nt, Human
ucccaggcuggaguguaguggcc

SEQ ID NO: 323565 - RNA, 18 nt, Human
ucccgaguagcugggauu

SEQ ID NO: 323566 - RNA, 21 nt, Human
ucccggguucaagcaauucuc

SEQ ID NO: 323567 - RNA, 24 nt, Human
ucccggguucaagcaauucuccug

SEQ ID NO: 323568 - RNA, 19 nt, Human
ucccugagcacucauuucc

SEQ ID NO: 323569 - RNA, 21 nt, Human
uccugggcucaagugauucuu

SEQ ID NO: 323570 - RNA, 24 nt, Human
uccugggcucaagugauucuucug

SEQ ID NO: 323571 - RNA, 18 nt, Human
ucgcccaggcuggagugc

SEQ ID NO: 323572 - RNA, 24 nt, Human
ucgcgaguagcuggcacuacaggu

SEQ ID NO: 323573 - RNA, 22 nt, Human
ucgcucuguuucccaggcugga

SEQ ID NO: 323574 - RNA, 24 nt, Human
ucgcuuugucgcccaggcuggagu

SEQ ID NO: 323575 - RNA, 24 nt, Human
ucguccagacuggagugcaguggc

SEQ ID NO: 323576 - RNA, 22 nt, Human
ucucacucugucguccagacug

SEQ ID NO: 323577 - RNA, 24 nt, Human
ucucacucugucguccagacugga

SEQ ID NO: 323578 - RNA, 18 nt, Human
ucuccagggaaacguuca

SEQ ID NO: 323579 - RNA, 23 nt, Human
ucucgcuuugucgcccaggcugg

SEQ ID NO: 323580 - RNA, 24 nt, Human
ucucgcuuugucgcccaggcugga

SEQ ID NO: 323581 - RNA, 23 nt, Human
ucuguacauuuuaguuagauggu

SEQ ID NO: 323582 - RNA, 24 nt, Human
ucugucguccagacuggagugcag

SEQ ID NO: 323583 - RNA, 22 nt, Human
ucuguuucccaggcuggagugu

SEQ ID NO: 323584 - RNA, 24 nt, Human
ucuguuucccaggcuggaguguag

SEQ ID NO: 323585 - RNA, 20 nt, Human
ucuguuuuuuugagacagag

SEQ ID NO: 323586 - RNA, 23 nt, Human
ucuugaacuccugaccuuaaaag

SEQ ID NO: 323587 - RNA, 24 nt, Human
ugaagaauaggacagaucucuuga

SEQ ID NO: 323588 - RNA, 18 nt, Human
ugaccucaggugauccgc

SEQ ID NO: 323589 - RNA, 24 nt, Human
ugaccucaggugauccgccugccu

SEQ ID NO: 323590 - RNA, 19 nt, Human
ugagaagaaagucauguaa

SEQ ID NO: 323591 - RNA, 22 nt, Human
ugagacagaguaucgcucuguu

SEQ ID NO: 323592 - RNA, 25 nt, Human
ugagagaaggucuaaaugcuacuga

SEQ ID NO: 323593 - RNA, 19 nt, Human
ugagaggaugugaaagauu

SEQ ID NO: 323594 - RNA, 22 nt, Human
ugagauggagucucacucuguc

SEQ ID NO: 323595 - RNA, 22 nt, Human
ugagauuacaggggugcgccac

SEQ ID NO: 323596 - RNA, 24 nt, Human
ugagauuacaggggugcgccacca

SEQ ID NO: 323597 - RNA, 23 nt, Human
ugagauuagaaaaccaucacaga

SEQ ID NO: 323598 - RNA, 24 nt, Human
ugccucagucucgcgaguagcugg

SEQ ID NO: 323599 - RNA, 24 nt, Human
uggagucucgcuuugucgcccagg

SEQ ID NO: 323600 - RNA, 22 nt, Human
uggagugcaauggcgcaaucuc

SEQ ID NO: 323601 - RNA, 18 nt, Human
uggagugcaguggcacaa

SEQ ID NO: 323602 - RNA, 22 nt, Human
uggagugcaguggcacaaucuc

SEQ ID NO: 323603 - RNA, 24 nt, Human
uggaguguaguggccggaucucgg

SEQ ID NO: 323604 - RNA, 24 nt, Human
uggcacaaucucugcucacugcaa

SEQ ID NO: 323605 - RNA, 24 nt, Human
uggcacuacaggugugcaccacca

SEQ ID NO: 323606 - RNA, 24 nt, Human
uggccauaaacauuuaauuuaacc

SEQ ID NO: 323607 - RNA, 18 nt, Human
ugggauuauaggugugag

SEQ ID NO: 323608 - RNA, 19 nt, Human
ugggauuauaggugugagc

SEQ ID NO: 323609 - RNA, 21 nt, Human
ugggauuauaggugugagcca

SEQ ID NO: 323610 - RNA, 22 nt, Human
ugggauuauaggugugagccac

SEQ ID NO: 323611 - RNA, 23 nt, Human
ugggauuauaggugugagccacc

SEQ ID NO: 323612 - RNA, 24 nt, Human
ugggauuauaggugugagccaccg

SEQ ID NO: 323613 - RNA, 24 nt, Human
ugggcucaagugauucuucugucu

SEQ ID NO: 323614 - RNA, 24 nt, Human
uggucaggcugaucuugaacuccu

SEQ ID NO: 323615 - RNA, 19 nt, Human
ugucauguauagggcucuu

SEQ ID NO: 323616 - RNA, 20 nt, Human
ugucgcccaggcuggagugc

SEQ ID NO: 323617 - RNA, 24 nt, Human
ugucucagccucccgaguagcugg

SEQ ID NO: 323618 - RNA, 20 nt, Human
ugugaaagauugccaagagg

SEQ ID NO: 323619 - RNA, 18 nt, Human
ugugaugauuaguacuuu

SEQ ID NO: 323620 - RNA, 22 nt, Human
ugugauuacaggcgugagccac

SEQ ID NO: 323621 - RNA, 24 nt, Human
ugugauuacaggcgugagccaccg

SEQ ID NO: 323622 - RNA, 22 nt, Human
uguuuuuuuugagauggagucu

SEQ ID NO: 323623 - RNA, 24 nt, Human
uuaguagaaacgggguuucuccau

SEQ ID NO: 323624 - RNA, 21 nt, Human
uucaagcaauucuccugccuc

SEQ ID NO: 323625 - RNA, 27 nt, Human
uucaagcaauucuccugccucagucuc

SEQ ID NO: 323626 - RNA, 21 nt, Human
uucaguacgugaucaccuguc

SEQ ID NO: 323627 - RNA, 18 nt, Human
uuuaagauacauacuuuc

SEQ ID NO: 323628 - RNA, 21 nt, Human
uuuagucccuuuuguuuucuc

SEQ ID NO: 323629 - RNA, 21 nt, Human
uuucaccauauuggucaggcu

SEQ ID NO: 323630 - RNA, 24 nt, Human
uuucccaggcuggaguguaguggc

SEQ ID NO: 323631 - RNA, 21 nt, Human
uuucuccauguuggccagacu

SEQ ID NO: 323632 - RNA, 24 nt, Human
uuugucgcccaggcuggagugcaa

SEQ ID NO: 323633 - RNA, 19 nt, Human
uuuugagacagaguaucgc

SEQ ID NO: 323634 - RNA, 21 nt, Human
uuuuuguauuuucaguggaga

SEQ ID NO: 323635 - RNA, 24 nt, Human
uuuuuuauuuuugagauggagucu

SEQ ID NO: 323636 - RNA, 26 nt, Human
uuuuuuauuuuugagauggagucuca

SEQ ID NO: 323637 - RNA, 24 nt, Human
uuuuuuguauuuucaguggagaca

SEQ ID NO: 323638 - RNA, 21 nt, Human
uuuuuuuugagauggagucuc

SEQ ID NO: 323639 - RNA, 21 nt, Human
uuuuuuuuuuuugcggccuca

SEQ ID NO: 323640 - RNA, 18 nt, Human
uuuuuuuuuuuuuugcgg

SEQ ID NO: 323641 - RNA, 18 nt, Human
uuuuuuuuuuuuuuuuug

SEQ ID NO: 323642 - RNA, 23 nt, Human
uuuuuuuuuuuuuuuuuuugcgg

SEQ ID NO: 323643 - RNA, 20 nt, Human
aaagacacaggauguuuugc

SEQ ID NO: 323644 - RNA, 21 nt, Human
caacaggccacccaaugggca

SEQ ID NO: 323645 - RNA, 22 nt, Human
caacaggccacccaaugggcac

SEQ ID NO: 323646 - RNA, 23 nt, Human
caaccauuuuccugaugacagcc

SEQ ID NO: 323647 - RNA, 23 nt, Human
cacuuacacaucguacuccaaaa

SEQ ID NO: 323648 - RNA, 26 nt, Human
ccccaaccucaucccuuucagggauu

SEQ ID NO: 323649 - RNA, 20 nt, Human
cgcuuuauugggaagcagac

SEQ ID NO: 323650 - RNA, 23 nt, Human
cucccccaaccucaucccuuuca

SEQ ID NO: 323651 - RNA, 19 nt, Human
cugaugacagccaugguuc

SEQ ID NO: 323652 - RNA, 19 nt, Human
cugcugcacagugaccaac

SEQ ID NO: 323653 - RNA, 19 nt, Human
gcugccggaaguuccucca

SEQ ID NO: 323654 - RNA, 23 nt, Human
ucagugggaacagggauuccucu

SEQ ID NO: 323655 - RNA, 18 nt, Human
uccucugggcaacucccc

SEQ ID NO: 323656 - RNA, 21 nt, Human
uccucugggcaacucccccaa

SEQ ID NO: 323657 - RNA, 18 nt, Human
ucucccaaccauuuuccu

SEQ ID NO: 323658 - RNA, 19 nt, Human
ugccuuggccacuugagcu

SEQ ID NO: 323659 - RNA, 23 nt, Human
ugggaacagggauuccucugggc

SEQ ID NO: 323660 - RNA, 23 nt, Human
acacagcaccuucccuuuagagc

SEQ ID NO: 323661 - RNA, 19 nt, Human
cuccaaaagccuccgcucc

SEQ ID NO: 323662 - RNA, 21 nt, Human
ugauuacacagcaccuucccu

SEQ ID NO: 323663 - RNA, 18 nt, Human
aaagccuucucuugaccg

SEQ ID NO: 323664 - RNA, 26 nt, Human
accucuccccacaaaucccgacucuu

SEQ ID NO: 323665 - RNA, 22 nt, Human
aguggaaaaccucuccccacaa

SEQ ID NO: 323666 - RNA, 21 nt, Human
cagccgugagacuggggcugg

SEQ ID NO: 323667 - RNA, 24 nt, Human
ccuggaggagcgggcagaagaugg

SEQ ID NO: 323668 - RNA, 19 nt, Human
cgggagccgcaacgggaga

SEQ ID NO: 323669 - RNA, 22 nt, Human
cuccccacaaaucccgacucuu

SEQ ID NO: 323670 - RNA, 20 nt, Human
cuuaaagccuucucuugacc

SEQ ID NO: 323671 - RNA, 22 nt, Human
gggagauuaauaccgucuuucu

SEQ ID NO: 323672 - RNA, 19 nt, Human
ucagccgugagacuggggc

SEQ ID NO: 323673 - RNA, 22 nt, Human
ucccgacucuugaccggaccag

SEQ ID NO: 323674 - RNA, 21 nt, Human
uggcagggacccuaaaccauc

SEQ ID NO: 323675 - RNA, 18 nt, Human
uuccuggaggagcgggca

SEQ ID NO: 323676 - RNA, 20 nt, Human
uuuuuuggcagggacccuaa

SEQ ID NO: 323677 - RNA, 21 nt, Human
uuuuuuuuuuggcagggaccc

SEQ ID NO: 323678 - RNA, 21 nt, Human
uuuuuuuuuuuggcagggacc

SEQ ID NO: 323679 - RNA, 19 nt, Human
uuuuuuuuuuuuggcaggg

SEQ ID NO: 323680 - RNA, 25 nt, Human
uuuuuuuuuuuuuuuuuggcagggg

SEQ ID NO: 323681 - RNA, 22 nt, Human
uuuuuuuuuuuuuuuuuuuggc

SEQ ID NO: 323682 - RNA, 21 nt, Human
aaagggaaugagguuuuggga

SEQ ID NO: 323683 - RNA, 19 nt, Human
aagccccagccccugagug

SEQ ID NO: 323684 - RNA, 18 nt, Human
agagaagccccagccccu

SEQ ID NO: 323685 - RNA, 18 nt, Human
gaagaaaccaauccuggg

SEQ ID NO: 323686 - RNA, 22 nt, Human
gggaaugagguuuugggacaga

SEQ ID NO: 323687 - RNA, 21 nt, Human
ugggggugcgagagaagcccc

SEQ ID NO: 323688 - RNA, 18 nt, Human
uggguaaagaaaaaaggg

SEQ ID NO: 323689 - RNA, 22 nt, Human
uuuuuuuuuuuuuuggauucga

SEQ ID NO: 323690 - RNA, 18 nt, Human
uuuuuuuuuuuuuuuuug

SEQ ID NO: 323691 - RNA, 18 nt, Human
uuuuuuuuuuuuuuuuug

SEQ ID NO: 323692 - RNA, 19 nt, Human
cccacagagcuuuauugga

SEQ ID NO: 323693 - RNA, 20 nt, Human
gagcuuuauuggagagauac

SEQ ID NO: 323694 - RNA, 20 nt, Human
uacacacaaaggcuguccac

SEQ ID NO: 323695 - RNA, 18 nt, Human
aaaacaaaugauacaaaa

SEQ ID NO: 323696 - RNA, 23 nt, Human
aaacagauuuuauucaacuuuuu

SEQ ID NO: 323697 - RNA, 20 nt, Human
aacaaacauacaaauuucuu

SEQ ID NO: 323698 - RNA, 22 nt, Human
caacacuuucccuuuguaacuu

SEQ ID NO: 323699 - RNA, 24 nt, Human
caacaucugucaugcagccaucaa

SEQ ID NO: 323700 - RNA, 24 nt, Human
caauaaaugcaacuuuaacaaaca

SEQ ID NO: 323701 - RNA, 22 nt, Human
cagcaaauaugaaaagcuucaa

SEQ ID NO: 323702 - RNA, 26 nt, Human
caugcagccaucaaaaaucuuacagu

SEQ ID NO: 323703 - RNA, 22 nt, Human
cgcagcaaauaugaaaagcuuc

SEQ ID NO: 323704 - RNA, 21 nt, Human
uaacaaacauacaaauuucuu

SEQ ID NO: 323705 - RNA, 23 nt, Human
uaagaaaugcuuucuuauaccac

SEQ ID NO: 323706 - RNA, 18 nt, Human
uacaaaaugcucacgcag

SEQ ID NO: 323707 - RNA, 21 nt, Human
ucccuuuguaacuugcugcaa

SEQ ID NO: 323708 - RNA, 21 nt, Human
uuuguaacuugcugcaauaaa

SEQ ID NO: 323709 - RNA, 26 nt, Human
agcaggaggcgacaauucccccagaa

SEQ ID NO: 323710 - RNA, 18 nt, Human
cacccuuggcagcaggau

SEQ ID NO: 323711 - RNA, 26 nt, Human
cagcugcaguucagagccccuggugg

SEQ ID NO: 323712 - RNA, 23 nt, Human
gccugcugauaacaucagcugca

SEQ ID NO: 323713 - RNA, 18 nt, Human
guucagagccccuggugg

SEQ ID NO: 323714 - RNA, 22 nt, Human
uuuuuuuuuuuuuugaccuugg

SEQ ID NO: 323715 - RNA, 23 nt, Human
uuuuuuuuuuuuuuugaccuugg

SEQ ID NO: 323716 - RNA, 27 nt, Human
uuuuuuuuuuuuuuuuugaccuugggg

SEQ ID NO: 323717 - RNA, 27 nt, Human
uuuuuuuuuuuuuuuuuuuuuuugggg

SEQ ID NO: 323718 - RNA, 26 nt, Human
aaaagaaaaaaaaagauagugaagag

SEQ ID NO: 323719 - RNA, 20 nt, Human
aaagugcugggaauuauagg

SEQ ID NO: 323720 - RNA, 23 nt, Human
aacacuggaucuauuaugaccaa

SEQ ID NO: 323721 - RNA, 20 nt, Human
aaccucugccucccaggcuc

SEQ ID NO: 323722 - RNA, 19 nt, Human
aagaaaaaaacuuccaccc

SEQ ID NO: 323723 - RNA, 26 nt, Human
aagcgauucucgugccucagccuccu

SEQ ID NO: 323724 - RNA, 19 nt, Human
acacuggaucuauuaugac

SEQ ID NO: 323725 - RNA, 20 nt, Human
acaggguuuugccauauugg

SEQ ID NO: 323726 - RNA, 24 nt, Human
acaggguuuugccauauuggccag

SEQ ID NO: 323727 - RNA, 18 nt, Human
accaaaaagaaaaaaaaa

SEQ ID NO: 323728 - RNA, 22 nt, Human
agaaaaaaaaagauagugaaga

SEQ ID NO: 323729 - RNA, 25 nt, Human
agaaaaaaaaagauagugaagagaa

SEQ ID NO: 323730 - RNA, 26 nt, Human
agaaaaaaaaagauagugaagagaaa

SEQ ID NO: 323731 - RNA, 26 nt, Human
agaaauggaaaaaggaccaaaaagaa

SEQ ID NO: 323732 - RNA, 18 nt, Human
agacagagucuugcugug

SEQ ID NO: 323733 - RNA, 24 nt, Human
agcgauucucgugccucagccucc

SEQ ID NO: 323734 - RNA, 22 nt, Human
aguagagacaggguuuugccau

SEQ ID NO: 323735 - RNA, 18 nt, Human
aguagcugagauuauagg

SEQ ID NO: 323736 - RNA, 19 nt, Human
agugaagagaauccagaaa

SEQ ID NO: 323737 - RNA, 24 nt, Human
auauaacaguguugguaacaaagg

SEQ ID NO: 323738 - RNA, 23 nt, Human
auauuggccaggcuggucuugaa

SEQ ID NO: 323739 - RNA, 22 nt, Human
auggaaaaaggaccaaaaagaa

SEQ ID NO: 323740 - RNA, 31 nt, Human
caaaaagaaaaaaaaagauagugaagagaaa

SEQ ID NO: 323741 - RNA, 23 nt, Human
caaagugcugggaauuauaggug

SEQ ID NO: 323742 - RNA, 23 nt, Human
caaccucugccucccaggcucaa

SEQ ID NO: 323743 - RNA, 18 nt, Human
cacugcaaccucugccuc

SEQ ID NO: 323744 - RNA, 21 nt, Human
cacugcaaccucugccuccca

SEQ ID NO: 323745 - RNA, 24 nt, Human
cagagucuugcuguguugcccagg

SEQ ID NO: 323746 - RNA, 20 nt, Human
cagccuccugaguagcugag

SEQ ID NO: 323747 - RNA, 24 nt, Human
caggguuuugccauauuggccagg

SEQ ID NO: 323748 - RNA, 24 nt, Human
cauauuggccaggcuggucuugaa

SEQ ID NO: 323749 - RNA, 21 nt, Human
ccaaagugcugggaauuauag

SEQ ID NO: 323750 - RNA, 22 nt, Human
ccaaagugcugggaauuauagg

SEQ ID NO: 323751 - RNA, 25 nt, Human
ccaaagugcugggaauuauaggugu

SEQ ID NO: 323752 - RNA, 19 nt, Human
ccauauuggccaggcuggu

SEQ ID NO: 323753 - RNA, 21 nt, Human
ccauauuggccaggcuggucu

SEQ ID NO: 323754 - RNA, 20 nt, Human
cccaggcucaagcgauucuc

SEQ ID NO: 323755 - RNA, 20 nt, Human
cccaggcucaagcgauucuc

SEQ ID NO: 323756 - RNA, 22 nt, Human
cccaucuuggccucccaaagug

SEQ ID NO: 323757 - RNA, 22 nt, Human
ccugaguagcugagauuauagg

SEQ ID NO: 323758 - RNA, 23 nt, Human
ccugaguagcugagauuauaggu

SEQ ID NO: 323759 - RNA, 24 nt, Human
ccugaguagcugagauuauaggug

SEQ ID NO: 323760 - RNA, 24 nt, Human
cgcgcccagcccugaagcaggcuu

SEQ ID NO: 323761 - RNA, 24 nt, Human
cgugccucagccuccugaguagcu

SEQ ID NO: 323762 - RNA, 24 nt, Human
cucaagugauuugcccaucuuggc

SEQ ID NO: 323763 - RNA, 24 nt, Human
cucacugcaaccucugccucccag

SEQ ID NO: 323764 - RNA, 24 nt, Human
cucacugcaaccucugccucccag

SEQ ID NO: 323765 - RNA, 18 nt, Human
cuccuagacucaagugau

SEQ ID NO: 323766 - RNA, 23 nt, Human
cuccuaguuccacuuugcauuuc

SEQ ID NO: 323767 - RNA, 25 nt, Human
cucgugccucagccuccugaguagc

SEQ ID NO: 323768 - RNA, 21 nt, Human
cugaguagcugagauuauagg

SEQ ID NO: 323769 - RNA, 24 nt, Human
cugaguagcugagauuauaggugu

SEQ ID NO: 323770 - RNA, 24 nt, Human
cugauuuuauauuuuuaguagaga

SEQ ID NO: 323771 - RNA, 23 nt, Human
cugcaaccucugccucccaggcu

SEQ ID NO: 323772 - RNA, 24 nt, Human
cugcaaccucugccucccaggcuc

SEQ ID NO: 323773 - RNA, 22 nt, Human
cuugcuguguugcccaggcugg

SEQ ID NO: 323774 - RNA, 19 nt, Human
gacaggguuuugccauauu

SEQ ID NO: 323775 - RNA, 22 nt, Human
gacucaagugauuugcccaucu

SEQ ID NO: 323776 - RNA, 19 nt, Human
gaguagcugagauuauagg

SEQ ID NO: 323777 - RNA, 24 nt, Human
gauuauaggugugcgccaccaugc

SEQ ID NO: 323778 - RNA, 24 nt, Human
gauuuuauauuuuuaguagagaca

SEQ ID NO: 323779 - RNA, 23 nt, Human
gcgauucucgugccucagccucc

SEQ ID NO: 323780 - RNA, 20 nt, Human
ggaaaaaggaccaaaaagaa

SEQ ID NO: 323781 - RNA, 18 nt, Human
ggcuggucuugaacuccu

SEQ ID NO: 323782 - RNA, 23 nt, Human
gugcaguggcaagaucucagcuc

SEQ ID NO: 323783 - RNA, 22 nt, Human
gugccucagccuccugaguagc

SEQ ID NO: 323784 - RNA, 26 nt, Human
guuuuuauuuuauucauuuauuuuug

SEQ ID NO: 323785 - RNA, 20 nt, Human
uagagacaggguuuugccau

SEQ ID NO: 323786 - RNA, 21 nt, Human
uagccaccgcgcccagcccug

SEQ ID NO: 323787 - RNA, 25 nt, Human
uaggugugcgccaccaugccuggcu

SEQ ID NO: 323788 - RNA, 19 nt, Human
uaguagagacaggguuuug

SEQ ID NO: 323789 - RNA, 24 nt, Human
uaguagagacaggguuuugccaua

SEQ ID NO: 323790 - RNA, 20 nt, Human
uauuuuauucauuuauuuuu

SEQ ID NO: 323791 - RNA, 19 nt, Human
ucaaaugccuuaggagaag

SEQ ID NO: 323792 - RNA, 19 nt, Human
ucacugcaaccucugccuc

SEQ ID NO: 323793 - RNA, 24 nt, Human
ucacugcaaccucugccucccagg

SEQ ID NO: 323794 - RNA, 25 nt, Human
ucacugcaaccucugccucccaggc

SEQ ID NO: 323795 - RNA, 27 nt, Human
ucagcucacugcaaccucugccuccca

SEQ ID NO: 323796 - RNA, 24 nt, Human
ucccaaagugcugggaauuauagg

SEQ ID NO: 323797 - RNA, 21 nt, Human
ucccaggcucaagcgauucuc

SEQ ID NO: 323798 - RNA, 24 nt, Human
ucccaggcucaagcgauucucgug

SEQ ID NO: 323799 - RNA, 18 nt, Human
uccucuacaugagcucua

SEQ ID NO: 323800 - RNA, 24 nt, Human
uccugaguagcugagauuauaggu

SEQ ID NO: 323801 - RNA, 18 nt, Human
ucuugcuguguugcccag

SEQ ID NO: 323802 - RNA, 19 nt, Human
ucuugcuguguugcccagg

SEQ ID NO: 323803 - RNA, 23 nt, Human
ucuugcuguguugcccaggcugg

SEQ ID NO: 323804 - RNA, 24 nt, Human
ucuugcuguguugcccaggcuggu

SEQ ID NO: 323805 - RNA, 25 nt, Human
ucuugcuguguugcccaggcuggug

SEQ ID NO: 323806 - RNA, 20 nt, Human
ucuuggccucccaaagugcu

SEQ ID NO: 323807 - RNA, 22 nt, Human
ugaagagaauccagaaauaauu

SEQ ID NO: 323808 - RNA, 22 nt, Human
ugagacagagucuugcuguguu

SEQ ID NO: 323809 - RNA, 23 nt, Human
ugagacagagucuugcuguguug

SEQ ID NO: 323810 - RNA, 21 nt, Human
ugagauuauaggugugcgcca

SEQ ID NO: 323811 - RNA, 22 nt, Human
ugagauuauaggugugcgccac

SEQ ID NO: 323812 - RNA, 24 nt, Human
ugagauuauaggugugcgccacca

SEQ ID NO: 323813 - RNA, 25 nt, Human
ugagauuauaggugugcgccaccau

SEQ ID NO: 323814 - RNA, 19 nt, Human
ugagggaagaaaaaaacuu

SEQ ID NO: 323815 - RNA, 25 nt, Human
ugaguagcugagauuauuacuacag

SEQ ID NO: 323816 - RNA, 20 nt, Human
ugauaauucuuggggaaagg

SEQ ID NO: 323817 - RNA, 22 nt, Human
ugauaauucuuggggaaaggaa

SEQ ID NO: 323818 - RNA, 24 nt, Human
ugauuugcccaucuuggccuccca

SEQ ID NO: 323819 - RNA, 24 nt, Human
ugccauauuggccaggcuggucuu

SEQ ID NO: 323820 - RNA, 27 nt, Human
ugccauauuggccaggcuggucuugaa

SEQ ID NO: 323821 - RNA, 18 nt, Human
ugcccaggcuggugugca

SEQ ID NO: 323822 - RNA, 24 nt, Human
ugccucagccuccugaguagcuga

SEQ ID NO: 323823 - RNA, 21 nt, Human
ugccuuaggagaaguuuuggg

SEQ ID NO: 323824 - RNA, 21 nt, Human
ugcuguguugcccaggcuggu

SEQ ID NO: 323825 - RNA, 20 nt, Human
uggaaaaaggaccaaaaaga

SEQ ID NO: 323826 - RNA, 26 nt, Human
uggaaaaaggaccaaaaagaaaaaaa

SEQ ID NO: 323827 - RNA, 24 nt, Human
uggcaagaucucagcucacugcaa

SEQ ID NO: 323828 - RNA, 24 nt, Human
uggccaggcuggucuugaacuccu

SEQ ID NO: 323829 - RNA, 22 nt, Human
ugugcaguggcaagaucucagc

SEQ ID NO: 323830 - RNA, 23 nt, Human
ugugcaguggcaagaucucagcu

SEQ ID NO: 323831 - RNA, 24 nt, Human
uguguugcccaggcuggugugcag

SEQ ID NO: 323832 - RNA, 24 nt, Human
uuaguagagacaggguuuugccau

SEQ ID NO: 323833 - RNA, 22 nt, Human
uugagacagagucuugcugugu

SEQ ID NO: 323834 - RNA, 18 nt, Human
uugcccaggcuggugugc

SEQ ID NO: 323835 - RNA, 23 nt, Human
uuuauauuuuuaguagagacagg

SEQ ID NO: 323836 - RNA, 24 nt, Human
uuuauauuuuuaguagagacaggg

SEQ ID NO: 323837 - RNA, 19 nt, Human
uuuuauauuuuuaguagag

SEQ ID NO: 323838 - RNA, 20 nt, Human
uuuuauauuuuuaguagaga

SEQ ID NO: 323839 - RNA, 21 nt, Human
uuuuuaguagagacaggguuu

SEQ ID NO: 323840 - RNA, 24 nt, Human
uuuuuaguagagacaggguuuugc

SEQ ID NO: 323841 - RNA, 18 nt, Human
aaauaccagaaacagacc

SEQ ID NO: 323842 - RNA, 19 nt, Human
aagaacccucuagcagcac

SEQ ID NO: 323843 - RNA, 23 nt, Human
aauaccagaaacagaccccaaga

SEQ ID NO: 323844 - RNA, 19 nt, Human
agagauaaaugaaugaaga

SEQ ID NO: 323845 - RNA, 18 nt, Human
agcucuuguugggucagc

SEQ ID NO: 323846 - RNA, 21 nt, Human
caagagugaccggaggcagag

SEQ ID NO: 323847 - RNA, 26 nt, Human
cacguagcaccacagcaagagugacc

SEQ ID NO: 323848 - RNA, 24 nt, Human
cagcaagagugaccggaggcagag

SEQ ID NO: 323849 - RNA, 20 nt, Human
cauuuccccaacucacagga

SEQ ID NO: 323850 - RNA, 24 nt, Human
ccaaaauauuugguggcuucucuu

SEQ ID NO: 323851 - RNA, 20 nt, Human
ccccugaggaugccagagcu

SEQ ID NO: 323852 - RNA, 24 nt, Human
ccccugaggaugccagagcuaugg

SEQ ID NO: 323853 - RNA, 27 nt, Human
cgcaaacaccggcagcaguuggagacc

SEQ ID NO: 323854 - RNA, 20 nt, Human
gaacauaaugcaauucaugc

SEQ ID NO: 323855 - RNA, 20 nt, Human
gacuaucauuuccccaacuc

SEQ ID NO: 323856 - RNA, 23 nt, Human
gacuggcucccugccacacgccg

SEQ ID NO: 323857 - RNA, 22 nt, Human
uaagcaugucaagugaaaaaga

SEQ ID NO: 323858 - RNA, 23 nt, Human
uacaaaguaaaaaagcuauuuaa

SEQ ID NO: 323859 - RNA, 20 nt, Human
uagcagcacacugauuuagu

SEQ ID NO: 323860 - RNA, 23 nt, Human
ugaaaaagaacccucuagcagca

SEQ ID NO: 323861 - RNA, 25 nt, Human
ugaaaaagaacccucuagcagcaca

SEQ ID NO: 323862 - RNA, 18 nt, Human
ugaccggaggcagagagc

SEQ ID NO: 323863 - RNA, 20 nt, Human
ugaccggaggcagagagcuc

SEQ ID NO: 323864 - RNA, 20 nt, Human
ugaggaugccagagcuaugg

SEQ ID NO: 323865 - RNA, 20 nt, Human
ugaggaugccagagcuaugg

SEQ ID NO: 323866 - RNA, 19 nt, Human
uggcuucucuucauuuuuc

SEQ ID NO: 323867 - RNA, 21 nt, Human
uucaagaugaggaaaauucaa

SEQ ID NO: 323868 - RNA, 19 nt, Human
uuugagaucagucuccauu

SEQ ID NO: 323869 - RNA, 23 nt, Human
aaaacaaaaacaaaaacacacaa

SEQ ID NO: 323870 - RNA, 23 nt, Human
aaaacagaaagcggugugcaaga

SEQ ID NO: 323871 - RNA, 23 nt, Human
aaaaccagucccaaggaacacag

SEQ ID NO: 323872 - RNA, 22 nt, Human
aaacagcaaacauugguaaaca

SEQ ID NO: 323873 - RNA, 19 nt, Human
aaagaggccaagccuaagg

SEQ ID NO: 323874 - RNA, 19 nt, Human
aaaggagcuugcugcccuc

SEQ ID NO: 323875 - RNA, 21 nt, Human
aaaggagcuugcugcccucug

SEQ ID NO: 323876 - RNA, 22 nt, Human
aacaaaaacaaaaacacacaaa

SEQ ID NO: 323877 - RNA, 24 nt, Human
aaccuggucaacacagggagaccc

SEQ ID NO: 323878 - RNA, 22 nt, Human
aacuuucuaugaagcucuucug

SEQ ID NO: 323879 - RNA, 21 nt, Human
aagacaaguuggaaaucccua

SEQ ID NO: 323880 - RNA, 23 nt, Human
aagcauuuucaagaggucugauc

SEQ ID NO: 323881 - RNA, 22 nt, Human
aaguccagggcaagggaagaug

SEQ ID NO: 323882 - RNA, 18 nt, Human
acacugcacuccagccug

SEQ ID NO: 323883 - RNA, 20 nt, Human
acacugcacuccagccuggg

SEQ ID NO: 323884 - RNA, 21 nt, Human
acacugcacuccagccugggu

SEQ ID NO: 323885 - RNA, 24 nt, Human
acacugcacuccagccugggugac

SEQ ID NO: 323886 - RNA, 22 nt, Human
acccugucucuacaaaaaauaa

SEQ ID NO: 323887 - RNA, 19 nt, Human
acgccccagucgaccguaa

SEQ ID NO: 323888 - RNA, 18 nt, Human
acugcacuccagccuggg

SEQ ID NO: 323889 - RNA, 21 nt, Human
acugcacuccagccuggguga

SEQ ID NO: 323890 - RNA, 23 nt, Human
acugcacuccagccugggugaca

SEQ ID NO: 323891 - RNA, 18 nt, Human
agcaaaaccagucccaag

SEQ ID NO: 323892 - RNA, 21 nt, Human
agcaaggccucagugcaaaga

SEQ ID NO: 323893 - RNA, 19 nt, Human
agcccaggaguucgagacc

SEQ ID NO: 323894 - RNA, 24 nt, Human
agccugggugacaaagcaagaccu

SEQ ID NO: 323895 - RNA, 23 nt, Human
agcuaugcaugguggugcacgcc

SEQ ID NO: 323896 - RNA, 22 nt, Human
aggaguucgagaccaaccuggu

SEQ ID NO: 323897 - RNA, 18 nt, Human
aggcaggaggacugcuug

SEQ ID NO: 323898 - RNA, 24 nt, Human
aggcaggaggacugcuugagccca

SEQ ID NO: 323899 - RNA, 19 nt, Human
agggagagaagacaaguug

SEQ ID NO: 323900 - RNA, 21 nt, Human
aguccagggcaagggaagaug

SEQ ID NO: 323901 - RNA, 24 nt, Human
aguggcucacgccugugaucccag

SEQ ID NO: 323902 - RNA, 20 nt, Human
auagcgcugaucucagggca

SEQ ID NO: 323903 - RNA, 24 nt, Human
aucacgacacugcacuccagccug

SEQ ID NO: 323904 - RNA, 19 nt, Human
auccaaccacagcaaaacc

SEQ ID NO: 323905 - RNA, 22 nt, Human
auccacagcagcaaggccucag

SEQ ID NO: 323906 - RNA, 22 nt, Human
aucccagcacuuuaggaggcca

SEQ ID NO: 323907 - RNA, 24 nt, Human
augcaugguggugcacgccugugg

SEQ ID NO: 323908 - RNA, 18 nt, Human
auggcugucaggucaaau

SEQ ID NO: 323909 - RNA, 21 nt, Human
caaaguauuggcaggaauccc

SEQ ID NO: 323910 - RNA, 20 nt, Human
caacacagggagacccuguc

SEQ ID NO: 323911 - RNA, 22 nt, Human
caacacagggagacccugucuc

SEQ ID NO: 323912 - RNA, 24 nt, Human
caacacagggagacccugucucua

SEQ ID NO: 323913 - RNA, 23 nt, Human
caaccacagcaaaaccaguccca

SEQ ID NO: 323914 - RNA, 22 nt, Human
caagaacuggggaaaugaacac

SEQ ID NO: 323915 - RNA, 22 nt, Human
cacaguacugccaccacacaga

SEQ ID NO: 323916 - RNA, 23 nt, Human
cacgccugugaucccagcacuuu

SEQ ID NO: 323917 - RNA, 23 nt, Human
cacgccuguggucccagauacuu

SEQ ID NO: 323918 - RNA, 22 nt, Human
cacuccagccugggugacaaag

SEQ ID NO: 323919 - RNA, 23 nt, Human
cacuccagccugggugacaaagc

SEQ ID NO: 323920 - RNA, 19 nt, Human
cacugcacuccagccuggg

SEQ ID NO: 323921 - RNA, 19 nt, Human
cacugcacuccagccuggg

SEQ ID NO: 323922 - RNA, 19 nt, Human
cacugcacuccagccuggg

SEQ ID NO: 323923 - RNA, 20 nt, Human
cacugcacuccagccugggu

SEQ ID NO: 323924 - RNA, 22 nt, Human
cacugcacuccagccuggguga

SEQ ID NO: 323925 - RNA, 23 nt, Human
cacugcacuccagccugggugac

SEQ ID NO: 323926 - RNA, 24 nt, Human
cacugcacuccagccugggugaca

SEQ ID NO: 323927 - RNA, 25 nt, Human
cacugcacuccagccugggugacaa

SEQ ID NO: 323928 - RNA, 22 nt, Human
cagcaaaaccagucccaaggaa

SEQ ID NO: 323929 - RNA, 21 nt, Human
cagcacuguaaaacucuuuau

SEQ ID NO: 323930 - RNA, 21 nt, Human
cagcacuuuaggaggccaagg

SEQ ID NO: 323931 - RNA, 24 nt, Human
cagcacuuuaggaggccaaggcag

SEQ ID NO: 323932 - RNA, 24 nt, Human
cagcagcaaggccucagugcaaag

SEQ ID NO: 323933 - RNA, 24 nt, Human
cagcugcugaggaagcacaguacu

SEQ ID NO: 323934 - RNA, 19 nt, Human
cauagccaggagguucaau

SEQ ID NO: 323935 - RNA, 22 nt, Human
ccagaaaacaaaaacaaaaaca

SEQ ID NO: 323936 - RNA, 27 nt, Human
ccagaaaacaaaaacaaaaacacacaa

SEQ ID NO: 323937 - RNA, 24 nt, Human
ccaggaguucgagaccaaccuggu

SEQ ID NO: 323938 - RNA, 21 nt, Human
ccagggagauuacacuggugg

SEQ ID NO: 323939 - RNA, 25 nt, Human
ccaguaccugccagaauaacuuccg

SEQ ID NO: 323940 - RNA, 18 nt, Human
ccccgggccgcgacucca

SEQ ID NO: 323941 - RNA, 21 nt, Human
cccgggccgcgacuccagaga

SEQ ID NO: 323942 - RNA, 21 nt, Human
cccuguucuccaaagggagcu

SEQ ID NO: 323943 - RNA, 20 nt, Human
ccgcccacuugcccacaauc

SEQ ID NO: 323944 - RNA, 21 nt, Human
ccguaacuacggcuccgccca

SEQ ID NO: 323945 - RNA, 22 nt, Human
ccuccaggcuuucccuguucuc

SEQ ID NO: 323946 - RNA, 24 nt, Human
ccugggaagccuccaggcuuuccc

SEQ ID NO: 323947 - RNA, 22 nt, Human
ccuggucaacacagggagaccc

SEQ ID NO: 323948 - RNA, 22 nt, Human
ccuguggucccagauacuuggg

SEQ ID NO: 323949 - RNA, 19 nt, Human
cgagaccaaccuggucaac

SEQ ID NO: 323950 - RNA, 18 nt, Human
cgccugugaucccagcac

SEQ ID NO: 323951 - RNA, 22 nt, Human
cgccugugaucccagcacuuua

SEQ ID NO: 323952 - RNA, 23 nt, Human
cgcugggccaccugggaagccuc

SEQ ID NO: 323953 - RNA, 20 nt, Human
cggcugaggcagugcccaca

SEQ ID NO: 323954 - RNA, 22 nt, Human
cgugaaccccgggccgcgacuc

SEQ ID NO: 323955 - RNA, 25 nt, Human
cguggaauuagaacaugcaauuuaa

SEQ ID NO: 323956 - RNA, 22 nt, Human
cucacgccugugaucccagcac

SEQ ID NO: 323957 - RNA, 24 nt, Human
cucacgccugugaucccagcacuu

SEQ ID NO: 323958 - RNA, 20 nt, Human
cuccaaagggagcuacuaug

SEQ ID NO: 323959 - RNA, 22 nt, Human
cuccagaaaacaaaaacaaaaa

SEQ ID NO: 323960 - RNA, 18 nt, Human
cuccagagacccggcucc

SEQ ID NO: 323961 - RNA, 18 nt, Human
cucguuccuauccauacc

SEQ ID NO: 323962 - RNA, 21 nt, Human
cugcuugagcccaggaguucg

SEQ ID NO: 323963 - RNA, 23 nt, Human
cugcuugagcccaggaguucgag

SEQ ID NO: 323964 - RNA, 20 nt, Human
gaaaacaaaaacaaaaacac

SEQ ID NO: 323965 - RNA, 22 nt, Human
gagaaccuguggcuggaagcac

SEQ ID NO: 323966 - RNA, 25 nt, Human
gagaagacaaguuggaaaucccuag

SEQ ID NO: 323967 - RNA, 19 nt, Human
gagacaaaaaauaaaaggg

SEQ ID NO: 323968 - RNA, 19 nt, Human
gagagaagacaaguuggaa

SEQ ID NO: 323969 - RNA, 20 nt, Human
gagagaagacaaguuggaaa

SEQ ID NO: 323970 - RNA, 22 nt, Human
gaggaagcacaguacuuaacca

SEQ ID NO: 323971 - RNA, 24 nt, Human
gcaugguggugcacgccugugguc

SEQ ID NO: 323972 - RNA, 25 nt, Human
gccuaaguuuuuaagaaugccuuaa

SEQ ID NO: 323973 - RNA, 20 nt, Human
gcgcaguggcucacgccugu

SEQ ID NO: 323974 - RNA, 19 nt, Human
gcugggcgcaguggcucac

SEQ ID NO: 323975 - RNA, 21 nt, Human
ggcgcaguggcucacgccugu

SEQ ID NO: 323976 - RNA, 20 nt, Human
gggaauuccuauuuagggcc

SEQ ID NO: 323977 - RNA, 19 nt, Human
guggaauuagaacaugcaa

SEQ ID NO: 323978 - RNA, 23 nt, Human
guggugcacgccuguggucccag

SEQ ID NO: 323979 - RNA, 18 nt, Human
uaaaaagucaaacuagca

SEQ ID NO: 323980 - RNA, 21 nt, Human
uaaaagggaggaagaauaagc

SEQ ID NO: 323981 - RNA, 20 nt, Human
uaacuuccgcccacuugccc

SEQ ID NO: 323982 - RNA, 18 nt, Human
ucacaccaguaccugcca

SEQ ID NO: 323983 - RNA, 22 nt, Human
ucacgccugugaucccagcacu

SEQ ID NO: 323984 - RNA, 23 nt, Human
uccagaaaacaaaaacaaaaaca

SEQ ID NO: 323985 - RNA, 24 nt, Human
uccagaaaacaaaaacaaaaacac

SEQ ID NO: 323986 - RNA, 24 nt, Human
uccagccugggugacaaagcaaga

SEQ ID NO: 323987 - RNA, 20 nt, Human
ucccuagacccaaguccagg

SEQ ID NO: 323988 - RNA, 19 nt, Human
ucccugagaaccauuuuac

SEQ ID NO: 323989 - RNA, 21 nt, Human
uccguauccacagcagcaagg

SEQ ID NO: 323990 - RNA, 20 nt, Human
ucuccagaaaacaaaaacaa

SEQ ID NO: 323991 - RNA, 24 nt, Human
ucuccagaaaacaaaaacaaaaac

SEQ ID NO: 323992 - RNA, 21 nt, Human
ugaaaggagcuugcugcccuc

SEQ ID NO: 323993 - RNA, 18 nt, Human
ugaacacugauaccaugg

SEQ ID NO: 323994 - RNA, 23 nt, Human
ugaaccccgggccgcgacuccag

SEQ ID NO: 323995 - RNA, 20 nt, Human
ugacaaagcaagaccuuguc

SEQ ID NO: 323996 - RNA, 22 nt, Human
ugagaaccuguggcuggaagca

SEQ ID NO: 323997 - RNA, 23 nt, Human
ugagcccaggaguucgagaccaa

SEQ ID NO: 323998 - RNA, 20 nt, Human
ugagcuuugguuugggaggg

SEQ ID NO: 323999 - RNA, 21 nt, Human
ugaggcagugcccacagcguc

SEQ ID NO: 324000 - RNA, 20 nt, Human
uggaaaauacguggaauuag

SEQ ID NO: 324001 - RNA, 24 nt, Human
uggcucacgccugugaucccagca

SEQ ID NO: 324002 - RNA, 18 nt, Human
uggcuggaagcacacagc

SEQ ID NO: 324003 - RNA, 21 nt, Human
ugggccacaguacugccacca

SEQ ID NO: 324004 - RNA, 20 nt, Human
ugggcugggcgcaguggcuc

SEQ ID NO: 324005 - RNA, 18 nt, Human
uggugcacgccugugguc

SEQ ID NO: 324006 - RNA, 21 nt, Human
uggugcacgccugugguccca

SEQ ID NO: 324007 - RNA, 19 nt, Human
uggugggccacaguacugc

SEQ ID NO: 324008 - RNA, 24 nt, Human
ugguggugcacgccugugguccca

SEQ ID NO: 324009 - RNA, 25 nt, Human
ugucuccagaaaacaaaaacaaaaa

SEQ ID NO: 324010 - RNA, 22 nt, Human
ugugaaagaggccaagccuaag

SEQ ID NO: 324011 - RNA, 18 nt, Human
uguuuugcccaacuuucu

SEQ ID NO: 324012 - RNA, 20 nt, Human
uuagaacaugcaauuuaaac

SEQ ID NO: 324013 - RNA, 24 nt, Human
uuagcuaugcaugguggugcacgc

SEQ ID NO: 324014 - RNA, 20 nt, Human
uuggaaaucccuagacccaa

SEQ ID NO: 324015 - RNA, 21 nt, Human
uuuuuuuuuuuuuuuaacugg

SEQ ID NO: 324016 - RNA, 24 nt, Human
uuuuuuuuuuuuuuuuuaacuggg

SEQ ID NO: 324017 - RNA, 24 nt, Human
aguuuggggaaaaucuggaguccc

SEQ ID NO: 324018 - RNA, 18 nt, Human
cacagaaugggagagagg

SEQ ID NO: 324019 - RNA, 18 nt, Human
ccgcacaaggaguggagu

SEQ ID NO: 324020 - RNA, 21 nt, Human
ccugagaggcaaggugaggga

SEQ ID NO: 324021 - RNA, 22 nt, Human
gaaaaaucucaacagaagcaag

SEQ ID NO: 324022 - RNA, 18 nt, Human
ugcuguacucaucacaga

SEQ ID NO: 324023 - RNA, 23 nt, Human
cccgggcuuucgcuuucacuccc

SEQ ID NO: 324024 - RNA, 20 nt, Human
ccgggcuuucgcuuucacuc

SEQ ID NO: 324025 - RNA, 20 nt, Human
aggcgcuguggacuccaggg

SEQ ID NO: 324026 - RNA, 24 nt, Human
cccuugcuggcuuacucacugcuc

SEQ ID NO: 324027 - RNA, 23 nt, Human
cgaccgcccuugcuggcuuacuc

SEQ ID NO: 324028 - RNA, 18 nt, Human
cucgcucgcucccucccu

SEQ ID NO: 324029 - RNA, 20 nt, Human
cucgcucgcucccucccucu

SEQ ID NO: 324030 - RNA, 23 nt, Human
gcucccucccucugugccugucc

SEQ ID NO: 324031 - RNA, 23 nt, Human
gcuguggacuccagggagggggc

SEQ ID NO: 324032 - RNA, 20 nt, Human
uccagggagggggccggagg

SEQ ID NO: 324033 - RNA, 22 nt, Human
ugaccucgggacccgaccgccc

SEQ ID NO: 324034 - RNA, 19 nt, Human
aaacaaaccaaucuuugag

SEQ ID NO: 324035 - RNA, 18 nt, Human
acauuuccuccaaaucca

SEQ ID NO: 324036 - RNA, 23 nt, Human
acuacaguuaaaaacaaacaaac

SEQ ID NO: 324037 - RNA, 20 nt, Human
agcuaggaauauacauaaag

SEQ ID NO: 324038 - RNA, 18 nt, Human
auaccaaagggaaaaaaa

SEQ ID NO: 324039 - RNA, 21 nt, Human
auaccaaagggaaaaaaacca

SEQ ID NO: 324040 - RNA, 18 nt, Human
auaccauuuggcguuauc

SEQ ID NO: 324041 - RNA, 19 nt, Human
aucacauuuccuccaaauc

SEQ ID NO: 324042 - RNA, 22 nt, Human
aucacauuuccuccaaauccaa

SEQ ID NO: 324043 - RNA, 23 nt, Human
caaacaaaccaaucuuugaggaa

SEQ ID NO: 324044 - RNA, 20 nt, Human
caaagggaaaaaaaccaaua

SEQ ID NO: 324045 - RNA, 21 nt, Human
cagcucuacaaaaucagugau

SEQ ID NO: 324046 - RNA, 21 nt, Human
cauaaagaauucagauuacaa

SEQ ID NO: 324047 - RNA, 19 nt, Human
ccaaagggaaaaaaaccaa

SEQ ID NO: 324048 - RNA, 22 nt, Human
ccaaauccaaugaaagcauccc

SEQ ID NO: 324049 - RNA, 21 nt, Human
ccauuuggcguuauccuugac

SEQ ID NO: 324050 - RNA, 27 nt, Human
cuguaugacaauggauguuauucuucc

SEQ ID NO: 324051 - RNA, 26 nt, Human
uaaaaacaaacaaaccaaucuuugag

SEQ ID NO: 324052 - RNA, 18 nt, Human
uaauacuggaacuacagu

SEQ ID NO: 324053 - RNA, 23 nt, Human
uacuggaacuacaguuaaaaaca

SEQ ID NO: 324054 - RNA, 21 nt, Human
ucagugauauaccauuuggcg

SEQ ID NO: 324055 - RNA, 19 nt, Human
uccaggaaaucgauaguga

SEQ ID NO: 324056 - RNA, 19 nt, Human
uccuugacuuguugccuga

SEQ ID NO: 324057 - RNA, 23 nt, Human
ugacauaccaaagggaaaaaaac

SEQ ID NO: 324058 - RNA, 26 nt, Human
ugacauaccaaagggaaaaaaaccaa

SEQ ID NO: 324059 - RNA, 23 nt, Human
ugacucuccacucuuaaaacacu

SEQ ID NO: 324060 - RNA, 33 nt, Human
uguuauucuuccgguucucccagcagcucuaau

SEQ ID NO: 324061 - RNA, 24 nt, Human
uguuuggagcuguaugacaaugga

SEQ ID NO: 324062 - RNA, 18 nt, Human
uuaaaacacuuuguauga

SEQ ID NO: 324063 - RNA, 24 nt, Human
aaagugcugggauuacagguguga

SEQ ID NO: 324064 - RNA, 20 nt, Human
aaggggcucauuugaguucu

SEQ ID NO: 324065 - RNA, 18 nt, Human
aagugcugggauuacagg

SEQ ID NO: 324066 - RNA, 19 nt, Human
aagugcugggauuacaggu

SEQ ID NO: 324067 - RNA, 26 nt, Human
aagugcugggauuacaggugugagcc

SEQ ID NO: 324068 - RNA, 23 nt, Human
acaauguuggccaggauggucuc

SEQ ID NO: 324069 - RNA, 19 nt, Human
acuacaggcgugugccacc

SEQ ID NO: 324070 - RNA, 24 nt, Human
agcgauucuccugccucagccucc

SEQ ID NO: 324071 - RNA, 24 nt, Human
aggcgugugccaccaugcccggcu

SEQ ID NO: 324072 - RNA, 19 nt, Human
aguagcugggacuacaggc

SEQ ID NO: 324073 - RNA, 23 nt, Human
aguagcugggacuacaggcgugu

SEQ ID NO: 324074 - RNA, 20 nt, Human
agugcaauggugcaaucuag

SEQ ID NO: 324075 - RNA, 22 nt, Human
aucccuucuucccccagcucag

SEQ ID NO: 324076 - RNA, 24 nt, Human
aucucgcucuguugccaggcuaga

SEQ ID NO: 324077 - RNA, 24 nt, Human
augaucugcccaccucggccuccc

SEQ ID NO: 324078 - RNA, 24 nt, Human
augggguuuuacaauguuggccag

SEQ ID NO: 324079 - RNA, 25 nt, Human
auuuuuguauguuuuaguagagaug

SEQ ID NO: 324080 - RNA, 24 nt, Human
caaagugcugggauuacaggugug

SEQ ID NO: 324081 - RNA, 24 nt, Human
caaaucuaauggcccaccagugcc

SEQ ID NO: 324082 - RNA, 24 nt, Human
caacagccuggcucugccaucauc

SEQ ID NO: 324083 - RNA, 22 nt, Human
caagcgauucuccugccucagc

SEQ ID NO: 324084 - RNA, 24 nt, Human
caccaugcccggcuaauuuuugua

SEQ ID NO: 324085 - RNA, 24 nt, Human
caccucggccucccaaagugcugg

SEQ ID NO: 324086 - RNA, 18 nt, Human
cacugcaaccucugccuc

SEQ ID NO: 324087 - RNA, 21 nt, Human
cacugcaaccucugccuccca

SEQ ID NO: 324088 - RNA, 20 nt, Human
cagccuccugaguagcuggg

SEQ ID NO: 324089 - RNA, 28 nt, Human
caguagauaucccuucuucccccagcuc

SEQ ID NO: 324090 - RNA, 21 nt, Human
ccaaagugcugggauuacagg

SEQ ID NO: 324091 - RNA, 21 nt, Human
ccaaagugcugggauuacagg

SEQ ID NO: 324092 - RNA, 24 nt, Human
ccaaagugcugggauuacaggugu

SEQ ID NO: 324093 - RNA, 21 nt, Human
ccaacagccuggcucugccau

SEQ ID NO: 324094 - RNA, 19 nt, Human
ccagugcccacagaggugg

SEQ ID NO: 324095 - RNA, 19 nt, Human
cccacaggcggaugaaggg

SEQ ID NO: 324096 - RNA, 19 nt, Human
cccaccagugcccacagag

SEQ ID NO: 324097 - RNA, 18 nt, Human
cccagaccacaguagaua

SEQ ID NO: 324098 - RNA, 21 nt, Human
cccagcucaguccaugauguu

SEQ ID NO: 324099 - RNA, 20 nt, Human
cccagguucaagcgauucuc

SEQ ID NO: 324100 - RNA, 23 nt, Human
cccagguucaagcgauucuccug

SEQ ID NO: 324101 - RNA, 22 nt, Human
ccccaaggucugcaccuggccc

SEQ ID NO: 324102 - RNA, 24 nt, Human
ccucccagguucaagcgauucucc

SEQ ID NO: 324103 - RNA, 23 nt, Human
ccugaguagcugggacuacaggc

SEQ ID NO: 324104 - RNA, 24 nt, Human
ccugaguagcugggacuacaggcg

SEQ ID NO: 324105 - RNA, 20 nt, Human
ccugcccaggugagguagcc

SEQ ID NO: 324106 - RNA, 23 nt, Human
ccugccucagccuccugaguagc

SEQ ID NO: 324107 - RNA, 24 nt, Human
ccugccucagccuccugaguagcu

SEQ ID NO: 324108 - RNA, 21 nt, Human
cgcucuguugccaggcuagag

SEQ ID NO: 324109 - RNA, 24 nt, Human
cucagccuccugaguagcugggac

SEQ ID NO: 324110 - RNA, 23 nt, Human
cugcaaccucugccucccagguu

SEQ ID NO: 324111 - RNA, 24 nt, Human
cugcaaccucugccucccagguuc

SEQ ID NO: 324112 - RNA, 19 nt, Human
cugcgcccacucccccaaa

SEQ ID NO: 324113 - RNA, 23 nt, Human
cugcgcccacucccccaaagcuu

SEQ ID NO: 324114 - RNA, 20 nt, Human
gaaucucgcucuguugccag

SEQ ID NO: 324115 - RNA, 21 nt, Human
gacccaugaucugcccaccuc

SEQ ID NO: 324116 - RNA, 24 nt, Human
gacuacaggcgugugccaccaugc

SEQ ID NO: 324117 - RNA, 25 nt, Human
gaguagcugggacuacaggcgugug

SEQ ID NO: 324118 - RNA, 18 nt, Human
gauuacaggugugagcca

SEQ ID NO: 324119 - RNA, 22 nt, Human
gauuacaggugugagccacugc

SEQ ID NO: 324120 - RNA, 22 nt, Human
gauuacaggugugagccacugc

SEQ ID NO: 324121 - RNA, 22 nt, Human
gcaaccucugccucccagguuc

SEQ ID NO: 324122 - RNA, 22 nt, Human
gcccacagagguggugcccaga

SEQ ID NO: 324123 - RNA, 21 nt, Human
gcccacucccccaaagcuuua

SEQ ID NO: 324124 - RNA, 23 nt, Human
gcgauucuccugccucagccucc

SEQ ID NO: 324125 - RNA, 24 nt, Human
gcuagagugcaauggugcaaucua

SEQ ID NO: 324126 - RNA, 24 nt, Human
ggacuacaggcgugugccaccaug

SEQ ID NO: 324127 - RNA, 21 nt, Human
ggagaagacuucaggccugga

SEQ ID NO: 324128 - RNA, 18 nt, Human
gggguuuuacaauguugg

SEQ ID NO: 324129 - RNA, 22 nt, Human
gggguuuuacaauguuggccag

SEQ ID NO: 324130 - RNA, 22 nt, Human
ggguuuuacaauguuggccagg

SEQ ID NO: 324131 - RNA, 23 nt, Human
gugugagccacugcgcccacucc

SEQ ID NO: 324132 - RNA, 18 nt, Human
guucauggaggagaagac

SEQ ID NO: 324133 - RNA, 24 nt, Human
guuuuaguagagaugggguuuuac

SEQ ID NO: 324134 - RNA, 21 nt, Human
uaaagucuucccccaaggucu

SEQ ID NO: 324135 - RNA, 25 nt, Human
uaauuuuuguauguuuuaguagaga

SEQ ID NO: 324136 - RNA, 24 nt, Human
uacaauguuggccaggauggucuc

SEQ ID NO: 324137 - RNA, 19 nt, Human
uacaggugugagccacugc

SEQ ID NO: 324138 - RNA, 24 nt, Human
uacaggugugagccacugcgccca

SEQ ID NO: 324139 - RNA, 21 nt, Human
uaguagagaugggguuuuaca

SEQ ID NO: 324140 - RNA, 24 nt, Human
uaguagagaugggguuuuacaaug

SEQ ID NO: 324141 - RNA, 19 nt, Human
ucacugcaaccucugccuc

SEQ ID NO: 324142 - RNA, 23 nt, Human
ucacugcaaccucugccucccag

SEQ ID NO: 324143 - RNA, 24 nt, Human
ucacugcaaccucugccucccagg

SEQ ID NO: 324144 - RNA, 25 nt, Human
ucacugcaaccucugccucccaggu

SEQ ID NO: 324145 - RNA, 23 nt, Human
ucagccuccugaguagcugggac

SEQ ID NO: 324146 - RNA, 22 nt, Human
ucagucacaguuacuguaguau

SEQ ID NO: 324147 - RNA, 20 nt, Human
ucauggaggagaagacuuca

SEQ ID NO: 324148 - RNA, 23 nt, Human
ucccaaagugcugggauuacagg

SEQ ID NO: 324149 - RNA, 21 nt, Human
ucccagguucaagcgauucuc

SEQ ID NO: 324150 - RNA, 24 nt, Human
ucccagguucaagcgauucuccug

SEQ ID NO: 324151 - RNA, 20 nt, Human
ucccccagcucaguccauga

SEQ ID NO: 324152 - RNA, 24 nt, Human
uccugaguagcugggacuacaggc

SEQ ID NO: 324153 - RNA, 22 nt, Human
uccugguggugccuguagcagg

SEQ ID NO: 324154 - RNA, 18 nt, Human
ucggccucccaaagugcu

SEQ ID NO: 324155 - RNA, 24 nt, Human
ucuccugccucagccuccugagua

SEQ ID NO: 324156 - RNA, 20 nt, Human
ucucgcucuguugccaggcu

SEQ ID NO: 324157 - RNA, 22 nt, Human
ucucgcucuguugccaggcuag

SEQ ID NO: 324158 - RNA, 23 nt, Human
ucucgcucuguugccaggcuaga

SEQ ID NO: 324159 - RNA, 25 nt, Human
ucugcaccuggcccugacauuccuu

SEQ ID NO: 324160 - RNA, 18 nt, Human
ucugccaucaucccugcc

SEQ ID NO: 324161 - RNA, 23 nt, Human
ucuguugccaggcuagagugcaa

SEQ ID NO: 324162 - RNA, 22 nt, Human
ugagauggaaucucgcucuguu

SEQ ID NO: 324163 - RNA, 25 nt, Human
ugaguucuggauuuuccaacagccu

SEQ ID NO: 324164 - RNA, 24 nt, Human
ugaucugcccaccucggccuccca

SEQ ID NO: 324165 - RNA, 24 nt, Human
ugcccagaccacaguagauauccc

SEQ ID NO: 324166 - RNA, 18 nt, Human
ugccccaucggggagaac

SEQ ID NO: 324167 - RNA, 25 nt, Human
ugcccggcuaauuuuuguauguuuu

SEQ ID NO: 324168 - RNA, 24 nt, Human
ugccucagccuccugaguagcugg

SEQ ID NO: 324169 - RNA, 24 nt, Human
ugcugggauuacaggugugagcca

SEQ ID NO: 324170 - RNA, 18 nt, Human
uggaaucucgcucuguug

SEQ ID NO: 324171 - RNA, 23 nt, Human
uggaaugaucagcugguccuggu

SEQ ID NO: 324172 - RNA, 23 nt, Human
uggaggagaagacuucaggccug

SEQ ID NO: 324173 - RNA, 22 nt, Human
uggauuuuccaacagccuggcu

SEQ ID NO: 324174 - RNA, 24 nt, Human
uggccaggauggucucgaucucuu

SEQ ID NO: 324175 - RNA, 18 nt, Human
ugggacuacaggcgugug

SEQ ID NO: 324176 - RNA, 21 nt, Human
ugggacuacaggcgugugcca

SEQ ID NO: 324177 - RNA, 22 nt, Human
ugggacuacaggcgugugccac

SEQ ID NO: 324178 - RNA, 24 nt, Human
ugggacuacaggcgugugccacca

SEQ ID NO: 324179 - RNA, 25 nt, Human
ugggacuacaggcgugugccaccau

SEQ ID NO: 324180 - RNA, 18 nt, Human
ugggauuacaggugugag

SEQ ID NO: 324181 - RNA, 19 nt, Human
ugggauuacaggugugagc

SEQ ID NO: 324182 - RNA, 21 nt, Human
ugggauuacaggugugagcca

SEQ ID NO: 324183 - RNA, 22 nt, Human
ugggauuacaggugugagccac

SEQ ID NO: 324184 - RNA, 22 nt, Human
ugggauuacaggugugagccac

SEQ ID NO: 324185 - RNA, 24 nt, Human
ugggauuacaggugugagccacug

SEQ ID NO: 324186 - RNA, 24 nt, Human
ugggguuuuacaauguuggccagg

SEQ ID NO: 324187 - RNA, 18 nt, Human
ugguuuaaagucuucccc

SEQ ID NO: 324188 - RNA, 24 nt, Human
ugguuuaaagucuucccccaaggu

SEQ ID NO: 324189 - RNA, 18 nt, Human
uuaguagagaugggguuu

SEQ ID NO: 324190 - RNA, 21 nt, Human
uuaguagagaugggguuuuac

SEQ ID NO: 324191 - RNA, 24 nt, Human
uuaguagagaugggguuuuacaau

SEQ ID NO: 324192 - RNA, 21 nt, Human
uucaagcgauucuccugccuc

SEQ ID NO: 324193 - RNA, 23 nt, Human
uucaagcgauucuccugccucag

SEQ ID NO: 324194 - RNA, 24 nt, Human
uucaagcgauucuccugccucagc

SEQ ID NO: 324195 - RNA, 21 nt, Human
uuuuuguauguuuuaguagag

SEQ ID NO: 324196 - RNA, 25 nt, Human
uuuuuuuuuuuugagauggaaucuc

SEQ ID NO: 324197 - RNA, 22 nt, Human
uuuuuuuuuuuuuugagaugga

SEQ ID NO: 324198 - RNA, 23 nt, Human
aaaaaaccgcgccgccgccccuc

SEQ ID NO: 324199 - RNA, 20 nt, Human
aaaaaauaaaaucucugguc

SEQ ID NO: 324200 - RNA, 21 nt, Human
aaaaaccgcgccgccgccccu

SEQ ID NO: 324201 - RNA, 25 nt, Human
aaacugauuucucuuuaaaaaaaua

SEQ ID NO: 324202 - RNA, 19 nt, Human
aaaggggauccuaggagag

SEQ ID NO: 324203 - RNA, 19 nt, Human
aaccgcgccgccgccccuc

SEQ ID NO: 324204 - RNA, 21 nt, Human
aaccugccucuacagcgucca

SEQ ID NO: 324205 - RNA, 21 nt, Human
aauaccacaaggaaguuuaga

SEQ ID NO: 324206 - RNA, 21 nt, Human
acuggccaaccugccucuaca

SEQ ID NO: 324207 - RNA, 20 nt, Human
agaaagagcacagagaagac

SEQ ID NO: 324208 - RNA, 21 nt, Human
agaagggaaggcccugggggc

SEQ ID NO: 324209 - RNA, 26 nt, Human
agaagggaaggcccugggggcggggu

SEQ ID NO: 324210 - RNA, 24 nt, Human
agacuggccaaccugccucuacag

SEQ ID NO: 324211 - RNA, 20 nt, Human
agagcacagagaagacagga

SEQ ID NO: 324212 - RNA, 18 nt, Human
agagcccccgggacagga

SEQ ID NO: 324213 - RNA, 19 nt, Human
agcacagagaagacaggag

SEQ ID NO: 324214 - RNA, 20 nt, Human
agcaucagaggcaggcaaaa

SEQ ID NO: 324215 - RNA, 21 nt, Human
agcgcccgccuuccggguccc

SEQ ID NO: 324216 - RNA, 22 nt, Human
agcuggagcagcggggagcccg

SEQ ID NO: 324217 - RNA, 19 nt, Human
aggaagaaaaaacccugaa

SEQ ID NO: 324218 - RNA, 26 nt, Human
aggcaaaacacagaaaugaggggacc

SEQ ID NO: 324219 - RNA, 27 nt, Human
aggcaaaacacagaaaugaggggaccc

SEQ ID NO: 324220 - RNA, 23 nt, Human
aggcaaccggaggcgaugccaga

SEQ ID NO: 324221 - RNA, 24 nt, Human
aggcaaccggaggcgaugccagag

SEQ ID NO: 324222 - RNA, 20 nt, Human
aggcaggcaaaacacagaaa

SEQ ID NO: 324223 - RNA, 25 nt, Human
aggccccaccaaggcauggccccga

SEQ ID NO: 324224 - RNA, 22 nt, Human
aggcgccggaauagcaggaacc

SEQ ID NO: 324225 - RNA, 22 nt, Human
agggggcccggccgugggggcc

SEQ ID NO: 324226 - RNA, 19 nt, Human
auuuggucaacuggaaaua

SEQ ID NO: 324227 - RNA, 23 nt, Human
caacuggaaauauugcuaggcac

SEQ ID NO: 324228 - RNA, 24 nt, Human
cacagaaaugagacuuugguccaa

SEQ ID NO: 324229 - RNA, 20 nt, Human
caccccuuggguccccagga

SEQ ID NO: 324230 - RNA, 21 nt, Human
caccugcaggccccacgcccg

SEQ ID NO: 324231 - RNA, 21 nt, Human
cagcauacaagguaauaccac

SEQ ID NO: 324232 - RNA, 21 nt, Human
cagcggggagcccgccugggg

SEQ ID NO: 324233 - RNA, 21 nt, Human
caggaaggcagguuuuuuaag

SEQ ID NO: 324234 - RNA, 23 nt, Human
caggccccaccaaggcauggccc

SEQ ID NO: 324235 - RNA, 20 nt, Human
cagggcuagacaagggagga

SEQ ID NO: 324236 - RNA, 19 nt, Human
cauggccccgagggucugg

SEQ ID NO: 324237 - RNA, 20 nt, Human
cccacgcccgacacaggccc

SEQ ID NO: 324238 - RNA, 19 nt, Human
cccagcaucagaggcaggc

SEQ ID NO: 324239 - RNA, 21 nt, Human
ccccaccccuuggguccccag

SEQ ID NO: 324240 - RNA, 22 nt, Human
ccccacgcccgacacaggcccc

SEQ ID NO: 324241 - RNA, 23 nt, Human
cccccugccucucucugguguga

SEQ ID NO: 324242 - RNA, 24 nt, Human
ccccgagggucuggccccgggugu

SEQ ID NO: 324243 - RNA, 18 nt, Human
ccgccgcgccccagcugc

SEQ ID NO: 324244 - RNA, 26 nt, Human
ccgccgcgccccagcugcaugauccu

SEQ ID NO: 324245 - RNA, 21 nt, Human
ccugugccugacccacugggc

SEQ ID NO: 324246 - RNA, 22 nt, Human
cgccccagcugcaugauccugc

SEQ ID NO: 324247 - RNA, 19 nt, Human
cgccccuucccugaagcuc

SEQ ID NO: 324248 - RNA, 23 nt, Human
cgccccuucccugaagcucaggg

SEQ ID NO: 324249 - RNA, 22 nt, Human
cgccgccgccccucgggucuca

SEQ ID NO: 324250 - RNA, 20 nt, Human
cgccggaauagcaggaaccg

SEQ ID NO: 324251 - RNA, 21 nt, Human
cgccggaauagcaggaaccga

SEQ ID NO: 324252 - RNA, 18 nt, Human
cgccuuccgggucccagc

SEQ ID NO: 324253 - RNA, 19 nt, Human
cggaauagcaggaaccgac

SEQ ID NO: 324254 - RNA, 24 nt, Human
cggaauagcaggaaccgacccaac

SEQ ID NO: 324255 - RNA, 23 nt, Human
cgggacaggacgcgggggcggua

SEQ ID NO: 324256 - RNA, 22 nt, Human
cggggcgcccaccugcaggccc

SEQ ID NO: 324257 - RNA, 27 nt, Human
cguggucggggcgcccaccugcaggcc

SEQ ID NO: 324258 - RNA, 20 nt, Human
cucccgcugccacagucacc

SEQ ID NO: 324259 - RNA, 27 nt, Human
cucccgcugccacagucaccaagagcc

SEQ ID NO: 324260 - RNA, 24 nt, Human
cucucuggaaacuggguccugccu

SEQ ID NO: 324261 - RNA, 21 nt, Human
cucuggaaacuggguccugcc

SEQ ID NO: 324262 - RNA, 24 nt, Human
cuuggguccccaggacaccccggg

SEQ ID NO: 324263 - RNA, 24 nt, Human
gaaaaaacccugaaguuugagagc

SEQ ID NO: 324264 - RNA, 22 nt, Human
gaacacagggcuagacaaggga

SEQ ID NO: 324265 - RNA, 20 nt, Human
gacaagggaggaguuucuca

SEQ ID NO: 324266 - RNA, 22 nt, Human
gacccaacggcuccgaguuaua

SEQ ID NO: 324267 - RNA, 20 nt, Human
gagcaaguuuucuaggcgac

SEQ ID NO: 324268 - RNA, 22 nt, Human
gagcgcccgccuuccggguccc

SEQ ID NO: 324269 - RNA, 21 nt, Human
gauggaaguugucgccagggg

SEQ ID NO: 324270 - RNA, 19 nt, Human
gcagaagggaaggcccugg

SEQ ID NO: 324271 - RNA, 21 nt, Human
gccccagcugcaugauccugc

SEQ ID NO: 324272 - RNA, 19 nt, Human
gccgcggccgccgcgcccc

SEQ ID NO: 324273 - RNA, 24 nt, Human
gccggaauagcaggaaccgaccca

SEQ ID NO: 324274 - RNA, 22 nt, Human
gccugggggcagaagggaaggc

SEQ ID NO: 324275 - RNA, 24 nt, Human
gcgaugccagaggcggcgacacgc

SEQ ID NO: 324276 - RNA, 21 nt, Human
ggaauagcaggaaccgaccca

SEQ ID NO: 324277 - RNA, 23 nt, Human
ggaauagcaggaaccgacccaac

SEQ ID NO: 324278 - RNA, 22 nt, Human
ggcagaagggaaggcccugggg

SEQ ID NO: 324279 - RNA, 19 nt, Human
ggccaggcccccugccucu

SEQ ID NO: 324280 - RNA, 21 nt, Human
ggcugggguuggggugucgca

SEQ ID NO: 324281 - RNA, 22 nt, Human
gggacaggacgcgggggcggua

SEQ ID NO: 324282 - RNA, 18 nt, Human
gggagcccgccugggggc

SEQ ID NO: 324283 - RNA, 18 nt, Human
gggcagaagggaaggccc

SEQ ID NO: 324284 - RNA, 23 nt, Human
gggcagaagggaaggcccugggg

SEQ ID NO: 324285 - RNA, 19 nt, Human
gggcccggccgugggggcc

SEQ ID NO: 324286 - RNA, 21 nt, Human
gggcccggccgugggggccug

SEQ ID NO: 324287 - RNA, 18 nt, Human
gggggcggggugaaggga

SEQ ID NO: 324288 - RNA, 22 nt, Human
ggguggguguguggcugcagga

SEQ ID NO: 324289 - RNA, 21 nt, Human
gguggguguguggcugcagga

SEQ ID NO: 324290 - RNA, 19 nt, Human
guccacagcgaacacaggg

SEQ ID NO: 324291 - RNA, 26 nt, Human
guccacagcgaacacagggcuagaca

SEQ ID NO: 324292 - RNA, 25 nt, Human
guccccuguggcuccgcggucacaa

SEQ ID NO: 324293 - RNA, 23 nt, Human
guggcugcaggaaggcagguuuu

SEQ ID NO: 324294 - RNA, 26 nt, Human
guggucggggcgcccaccugcaggcc

SEQ ID NO: 324295 - RNA, 25 nt, Human
uaaggcaacggaaugugcguggggu

SEQ ID NO: 324296 - RNA, 21 nt, Human
uacacucauaccauuguauca

SEQ ID NO: 324297 - RNA, 21 nt, Human
uacagcguccacagcgaacac

SEQ ID NO: 324298 - RNA, 19 nt, Human
uagaaagagcacagagaag

SEQ ID NO: 324299 - RNA, 22 nt, Human
uagaaagagcacagagaagaca

SEQ ID NO: 324300 - RNA, 19 nt, Human
uagaauauuuggucaacug

SEQ ID NO: 324301 - RNA, 22 nt, Human
uagacaagggaggaguuucuca

SEQ ID NO: 324302 - RNA, 22 nt, Human
uaggagagcccccgggacagga

SEQ ID NO: 324303 - RNA, 20 nt, Human
uaggcacagacgucugcaac

SEQ ID NO: 324304 - RNA, 22 nt, Human
uccaaaauuugaaggaagaaaa

SEQ ID NO: 324305 - RNA, 27 nt, Human
uccaaaauuugaaggaagaaaaaaccc

SEQ ID NO: 324306 - RNA, 24 nt, Human
uccacagcgaacacagggcuagag

SEQ ID NO: 324307 - RNA, 24 nt, Human
uccccuguggcuccgcggucacaa

SEQ ID NO: 324308 - RNA, 19 nt, Human
ucccugaagcucaggggcu

SEQ ID NO: 324309 - RNA, 24 nt, Human
uccgcagcuggagcagcggggagc

SEQ ID NO: 324310 - RNA, 18 nt, Human
ucucuggaaugauggaag

SEQ ID NO: 324311 - RNA, 18 nt, Human
ucuugcuauaaaaaguua

SEQ ID NO: 324312 - RNA, 19 nt, Human
ugauggaaguugucgccag

SEQ ID NO: 324313 - RNA, 22 nt, Human
ugauggaaguugucgccagggg

SEQ ID NO: 324314 - RNA, 21 nt, Human
ugcaacugcaaaguauauaau

SEQ ID NO: 324315 - RNA, 21 nt, Human
ugcuaaggucacuucagcugu

SEQ ID NO: 324316 - RNA, 21 nt, Human
ugggggcagaagggaaggccc

SEQ ID NO: 324317 - RNA, 27 nt, Human
ugggggcagaagggaaggcccuggggg

SEQ ID NO: 324318 - RNA, 18 nt, Human
ugucgccagggggcccgg

SEQ ID NO: 324319 - RNA, 18 nt, Human
ugugacccccccaccccu

SEQ ID NO: 324320 - RNA, 19 nt, Human
ugugacccccccaccccuu

SEQ ID NO: 324321 - RNA, 21 nt, Human
uuagaauauuuggucaacugg

SEQ ID NO: 324322 - RNA, 21 nt, Human
uuagagggcugggguuggggu

SEQ ID NO: 324323 - RNA, 21 nt, Human
uuggguccccaggacaccccg

SEQ ID NO: 324324 - RNA, 22 nt, Human
uuuaaggcacaaggaagccaag

SEQ ID NO: 324325 - RNA, 22 nt, Human
uuucucuggaaugauggaaguu

SEQ ID NO: 324326 - RNA, 22 nt, Human
uuuuuuuuuuuuuuaaggcgga

SEQ ID NO: 324327 - RNA, 23 nt, Human
uuuuuuuuuuuuuuuuuuuaagg

SEQ ID NO: 324328 - RNA, 25 nt, Human
uuuuuuuuuuuuuuuuuuuuuaagg

SEQ ID NO: 324329 - RNA, 19 nt, Human
aaaugccccuguaacuggg

SEQ ID NO: 324330 - RNA, 22 nt, Human
agacacagccucacacagugug

SEQ ID NO: 324331 - RNA, 18 nt, Human
aggcaggacccagcugca

SEQ ID NO: 324332 - RNA, 18 nt, Human
ccacucggaaggaggcag

SEQ ID NO: 324333 - RNA, 24 nt, Human
ccagcugcagaccugaguugcggc

SEQ ID NO: 324334 - RNA, 19 nt, Human
ccccuuuuggauggcagag

SEQ ID NO: 324335 - RNA, 21 nt, Human
cugaguugcggcugggggagg

SEQ ID NO: 324336 - RNA, 18 nt, Human
cugcucccuaaaugcccc

SEQ ID NO: 324337 - RNA, 23 nt, Human
gaguugcggcugggggaggaggc

SEQ ID NO: 324338 - RNA, 19 nt, Human
gcagagacacagccucaca

SEQ ID NO: 324339 - RNA, 19 nt, Human
uaaaugccccuguaacugg

SEQ ID NO: 324340 - RNA, 18 nt, Human
ucugcucccuaaaugccc

SEQ ID NO: 324341 - RNA, 19 nt, Human
ugaguugcggcugggggag

SEQ ID NO: 324342 - RNA, 18 nt, Human
ugcggcugggggaggagg

SEQ ID NO: 324343 - RNA, 19 nt, Human
uggaucaccauucucaagg

SEQ ID NO: 324344 - RNA, 18 nt, Human
uggauggcagagacacag

SEQ ID NO: 324345 - RNA, 21 nt, Human
aagacgaauaauccuccgaac

SEQ ID NO: 324346 - RNA, 25 nt, Human
acagaacacaaaaggaaaaaauucc

SEQ ID NO: 324347 - RNA, 22 nt, Human
acuggacaacaagugucaaaac

SEQ ID NO: 324348 - RNA, 30 nt, Human
agaacacaaaaggaaaaaauuccuacguag

SEQ ID NO: 324349 - RNA, 23 nt, Human
agagagauggcagaagcugcugg

SEQ ID NO: 324350 - RNA, 23 nt, Human
agaggagagaacugagcgcaguc

SEQ ID NO: 324351 - RNA, 23 nt, Human
agaguccugccacaucaccgccc

SEQ ID NO: 324352 - RNA, 20 nt, Human
aggagagagauggcagaagg

SEQ ID NO: 324353 - RNA, 19 nt, Human
aggaggagagagauggcag

SEQ ID NO: 324354 - RNA, 21 nt, Human
aggaggagagagauggcagaa

SEQ ID NO: 324355 - RNA, 19 nt, Human
aggcgacucagacccccuc

SEQ ID NO: 324356 - RNA, 20 nt, Human
augacacagcuacacaaccu

SEQ ID NO: 324357 - RNA, 21 nt, Human
augacacagcuacacaaccuu

SEQ ID NO: 324358 - RNA, 19 nt, Human
auggcagaagcugcuggug

SEQ ID NO: 324359 - RNA, 19 nt, Human
auuauuuccuuucugagca

SEQ ID NO: 324360 - RNA, 23 nt, Human
caacaagugucaaaacccugugg

SEQ ID NO: 324361 - RNA, 22 nt, Human
cacagcggcucaacucucaaac

SEQ ID NO: 324362 - RNA, 18 nt, Human
caugacacagcuacacaa

SEQ ID NO: 324363 - RNA, 18 nt, Human
caugguguuuuaucccuc

SEQ ID NO: 324364 - RNA, 22 nt, Human
cauuagaaugguagcaaaaccu

SEQ ID NO: 324365 - RNA, 21 nt, Human
ccacaucaccgcccgccggcc

SEQ ID NO: 324366 - RNA, 23 nt, Human
cccccccgcuccaggagcgggag

SEQ ID NO: 324367 - RNA, 19 nt, Human
cccccgcuccaggagcggg

SEQ ID NO: 324368 - RNA, 27 nt, Human
cccggccucgccucacagcggcucaac

SEQ ID NO: 324369 - RNA, 22 nt, Human
ccgcccgagcccacggcuucca

SEQ ID NO: 324370 - RNA, 18 nt, Human
ccgcccgccggccugccc

SEQ ID NO: 324371 - RNA, 18 nt, Human
ccgccgccgccgccgccg

SEQ ID NO: 324372 - RNA, 18 nt, Human
ccgccgccgccgccgccg

SEQ ID NO: 324373 - RNA, 18 nt, Human
ccgccgccgccgccgcgc

SEQ ID NO: 324374 - RNA, 27 nt, Human
ccgccgccgccgccgcgccucagccgg

SEQ ID NO: 324375 - RNA, 18 nt, Human
ccgccgccgccgccgugu

SEQ ID NO: 324376 - RNA, 19 nt, Human
ccgccgcgccucagccggc

SEQ ID NO: 324377 - RNA, 19 nt, Human
ccgccgcgccucagccggc

SEQ ID NO: 324378 - RNA, 20 nt, Human
ccgccgcgccucagccggcu

SEQ ID NO: 324379 - RNA, 23 nt, Human
ccgccgcggccgccgccgccgcc

SEQ ID NO: 324380 - RNA, 24 nt, Human
ccgccgcggccgccgccgccgccg

SEQ ID NO: 324381 - RNA, 26 nt, Human
ccgccgcggccgccgccgccgccgcu

SEQ ID NO: 324382 - RNA, 18 nt, Human
ccgccgcugccgccgccg

SEQ ID NO: 324383 - RNA, 20 nt, Human
ccgccgcuucucccccccgc

SEQ ID NO: 324384 - RNA, 22 nt, Human
ccgccgcuucucccccccgcuc

SEQ ID NO: 324385 - RNA, 19 nt, Human
ccgccggccugcccgcccc

SEQ ID NO: 324386 - RNA, 23 nt, Human
ccgcgccucagccggcucccggc

SEQ ID NO: 324387 - RNA, 24 nt, Human
ccgcggccgccgccgccgccgcuu

SEQ ID NO: 324388 - RNA, 21 nt, Human
ccgcuuggcucuggaccgcag

SEQ ID NO: 324389 - RNA, 21 nt, Human
ccggccugcccgcccccuccg

SEQ ID NO: 324390 - RNA, 22 nt, Human
ccucagcagccagaggccuggc

SEQ ID NO: 324391 - RNA, 20 nt, Human
ccucgccugagcccggccuc

SEQ ID NO: 324392 - RNA, 28 nt, Human
ccucgcucugccgccgcuuggcucugga

SEQ ID NO: 324393 - RNA, 25 nt, Human
ccugagcccggccucgccucacagc

SEQ ID NO: 324394 - RNA, 22 nt, Human
cgagaaacgccgccgcugccgc

SEQ ID NO: 324395 - RNA, 22 nt, Human
cgaggggaggcgggaggcgagc

SEQ ID NO: 324396 - RNA, 20 nt, Human
cgcaaacaacaagcagugac

SEQ ID NO: 324397 - RNA, 18 nt, Human
cgccgccgccgccgcgcc

SEQ ID NO: 324398 - RNA, 20 nt, Human
cgccgccgcugccgccgccg

SEQ ID NO: 324399 - RNA, 24 nt, Human
cgccgcugccgccgccgcaggccg

SEQ ID NO: 324400 - RNA, 18 nt, Human
cgccucggaagaccgagg

SEQ ID NO: 324401 - RNA, 18 nt, Human
cgcugccgccgccgcagg

SEQ ID NO: 324402 - RNA, 21 nt, Human
cggcggcagcggaauggggag

SEQ ID NO: 324403 - RNA, 21 nt, Human
cucaacucucaaacuuccauc

SEQ ID NO: 324404 - RNA, 18 nt, Human
cuccgggccgcggccgcc

SEQ ID NO: 324405 - RNA, 19 nt, Human
cuccucagcagccagaggc

SEQ ID NO: 324406 - RNA, 23 nt, Human
cuccucagcagccagaggccugg

SEQ ID NO: 324407 - RNA, 24 nt, Human
cucuuagccaacugcaaacuuauc

SEQ ID NO: 324408 - RNA, 24 nt, Human
cugcccgcccccuccgccgccgcg

SEQ ID NO: 324409 - RNA, 18 nt, Human
cugcuucuccucagcagc

SEQ ID NO: 324410 - RNA, 20 nt, Human
cuggacaacaagugucaaaa

SEQ ID NO: 324411 - RNA, 21 nt, Human
cuguagcaugcuaaagaaagg

SEQ ID NO: 324412 - RNA, 22 nt, Human
cuguggcugaagaaaaaggagg

SEQ ID NO: 324413 - RNA, 18 nt, Human
gacucagacccccucccu

SEQ ID NO: 324414 - RNA, 21 nt, Human
gcaguagaaggggagagacca

SEQ ID NO: 324415 - RNA, 22 nt, Human
gcccgggucccuggaugugccg

SEQ ID NO: 324416 - RNA, 19 nt, Human
gccgccgccgccgccgccg

SEQ ID NO: 324417 - RNA, 19 nt, Human
gccgccgccgccgccgccg

SEQ ID NO: 324418 - RNA, 22 nt, Human
gccucgccucacagcggcucaa

SEQ ID NO: 324419 - RNA, 23 nt, Human
gcggcggcggcggacgacgacgc

SEQ ID NO: 324420 - RNA, 20 nt, Human
gcggcggcggcggacgggag

SEQ ID NO: 324421 - RNA, 24 nt, Human
gcgguagcugaugccccucgcucu

SEQ ID NO: 324422 - RNA, 19 nt, Human
gcuuccaccuucccuuuca

SEQ ID NO: 324423 - RNA, 20 nt, Human
ggacuuggcgguagcugaug

SEQ ID NO: 324424 - RNA, 26 nt, Human
ggaggagagagauggcagaagcugcu

SEQ ID NO: 324425 - RNA, 21 nt, Human
ggccgccgccgccgccgcuuc

SEQ ID NO: 324426 - RNA, 21 nt, Human
gggagguuuaaaaccggcccg

SEQ ID NO: 324427 - RNA, 23 nt, Human
ggggagagaccaacucuccggcg

SEQ ID NO: 324428 - RNA, 23 nt, Human
ggggaggcgggaggcgagcgaga

SEQ ID NO: 324429 - RNA, 20 nt, Human
ggggggugcggcggcggcgg

SEQ ID NO: 324430 - RNA, 21 nt, Human
ggugacagaacacaaaaggaa

SEQ ID NO: 324431 - RNA, 20 nt, Human
guagcaaaaccuuucggaaa

SEQ ID NO: 324432 - RNA, 20 nt, Human
guccagaguccagcauaaaa

SEQ ID NO: 324433 - RNA, 21 nt, Human
gugcggcggcggcggacggga

SEQ ID NO: 324434 - RNA, 20 nt, Human
guggcugaagaaaaaggagg

SEQ ID NO: 324435 - RNA, 20 nt, Human
guuagaaaagacgaagagga

SEQ ID NO: 324436 - RNA, 24 nt, Human
guugcuguguuucuuaccuaugac

SEQ ID NO: 324437 - RNA, 22 nt, Human
uaaagaguccugccacaucacc

SEQ ID NO: 324438 - RNA, 24 nt, Human
uaaauguccuuuugacacaaaaag

SEQ ID NO: 324439 - RNA, 20 nt, Human
uacacaucagucugucucca

SEQ ID NO: 324440 - RNA, 18 nt, Human
uagaaaagacgaagagga

SEQ ID NO: 324441 - RNA, 22 nt, Human
uagaaaagacgaagaggaggcg

SEQ ID NO: 324442 - RNA, 23 nt, Human
uauauacaugacacagcuacaca

SEQ ID NO: 324443 - RNA, 25 nt, Human
uauucaaguuuauuuucaugguguu

SEQ ID NO: 324444 - RNA, 19 nt, Human
ucaaaacccuguggaugua

SEQ ID NO: 324445 - RNA, 26 nt, Human
ucaacuggacaacaagugucaaaacc

SEQ ID NO: 324446 - RNA, 24 nt, Human
ucaccgcccgccggccugcccgcc

SEQ ID NO: 324447 - RNA, 23 nt, Human
ucagcagccagaggccuggcagc

SEQ ID NO: 324448 - RNA, 25 nt, Human
uccaccuucccuuucaggagaagcc

SEQ ID NO: 324449 - RNA, 21 nt, Human
uccaucauggcugcagcuucc

SEQ ID NO: 324450 - RNA, 21 nt, Human
uccccgagggcgcugcccccg

SEQ ID NO: 324451 - RNA, 23 nt, Human
uccccuccauugcccuaacccga

SEQ ID NO: 324452 - RNA, 27 nt, Human
ucccuggaugugccgccgccgccgccg

SEQ ID NO: 324453 - RNA, 24 nt, Human
uccggagcccgggccacggggggu

SEQ ID NO: 324454 - RNA, 21 nt, Human
uccugccgcagcgcauaaaga

SEQ ID NO: 324455 - RNA, 20 nt, Human
ucgcucugccgccgcuuggc

SEQ ID NO: 324456 - RNA, 19 nt, Human
ucucccccccgcuccagga

SEQ ID NO: 324457 - RNA, 19 nt, Human
ucuccggcguucccagccc

SEQ ID NO: 324458 - RNA, 21 nt, Human
ucucucaucucccucgccuga

SEQ ID NO: 324459 - RNA, 19 nt, Human
ugacacagcuacacaaccu

SEQ ID NO: 324460 - RNA, 19 nt, Human
ugacagaacacaaaaggaa

SEQ ID NO: 324461 - RNA, 20 nt, Human
ugacagaacacaaaaggaaa

SEQ ID NO: 324462 - RNA, 21 nt, Human
ugagaaaacauauuuaauaaa

SEQ ID NO: 324463 - RNA, 21 nt, Human
ugagaaaacauauuuaauaaa

SEQ ID NO: 324464 - RNA, 20 nt, Human
ugccauuaaaaaaaaaaagg

SEQ ID NO: 324465 - RNA, 19 nt, Human
ugcugguggcggggcuucu

SEQ ID NO: 324466 - RNA, 21 nt, Human
uggcagaagcugcugguggcg

SEQ ID NO: 324467 - RNA, 25 nt, Human
uggcagcggcggcagcggaaugggg

SEQ ID NO: 324468 - RNA, 22 nt, Human
ugguugcagcgacugggccugc

SEQ ID NO: 324469 - RNA, 21 nt, Human
uguuuuaucccucuugauaaa

SEQ ID NO: 324470 - RNA, 23 nt, Human
uuaagauguugcagaagguucau

SEQ ID NO: 324471 - RNA, 20 nt, Human
uucggaaaccucucuuagcc

SEQ ID NO: 324472 - RNA, 23 nt, Human
uuggugacagaacacaaaaggaa

SEQ ID NO: 324473 - RNA, 19 nt, Human
uuuacaauugagaaaacau

SEQ ID NO: 324474 - RNA, 18 nt, Human
aaagaggaacuggcagca

SEQ ID NO: 324475 - RNA, 23 nt, Human
aacauuagaucgcucaagaagga

SEQ ID NO: 324476 - RNA, 21 nt, Human
aacuucccuuguugcagaagc

SEQ ID NO: 324477 - RNA, 21 nt, Human
aauauacauaaggcaaacauu

SEQ ID NO: 324478 - RNA, 18 nt, Human
aggccaacuucccuggcc

SEQ ID NO: 324479 - RNA, 18 nt, Human
agggaauauacauaaggc

SEQ ID NO: 324480 - RNA, 19 nt, Human
auagauuagggagaaaaac

SEQ ID NO: 324481 - RNA, 21 nt, Human
caaaacagcaaaauguauggc

SEQ ID NO: 324482 - RNA, 26 nt, Human
caaacccuccuaguucucaucagaag

SEQ ID NO: 324483 - RNA, 18 nt, Human
caucagaaggaaaugauc

SEQ ID NO: 324484 - RNA, 25 nt, Human
cggaaagccaaagauaucaaaauca

SEQ ID NO: 324485 - RNA, 23 nt, Human
cucucucucuuucugucuuaaaa

SEQ ID NO: 324486 - RNA, 21 nt, Human
cucuguugaaaugccuggguc

SEQ ID NO: 324487 - RNA, 21 nt, Human
cuuugaucagcagaaauaucu

SEQ ID NO: 324488 - RNA, 19 nt, Human
gaacuuccggcaggccaac

SEQ ID NO: 324489 - RNA, 20 nt, Human
gcaaguuuuauacucaaggu

SEQ ID NO: 324490 - RNA, 21 nt, Human
gcucaauuaggcugaguaacu

SEQ ID NO: 324491 - RNA, 21 nt, Human
ggaaagccaaagauaucaaaa

SEQ ID NO: 324492 - RNA, 18 nt, Human
gguaaaggaaauaaaggg

SEQ ID NO: 324493 - RNA, 20 nt, Human
gguugacuacagguaacucg

SEQ ID NO: 324494 - RNA, 24 nt, Human
gguugacuacagguaacucgggua

SEQ ID NO: 324495 - RNA, 22 nt, Human
guacaacgcgcugccuucuccc

SEQ ID NO: 324496 - RNA, 19 nt, Human
uaaaaacagacucuucauc

SEQ ID NO: 324497 - RNA, 18 nt, Human
uaaaugaauugcaaugga

SEQ ID NO: 324498 - RNA, 18 nt, Human
uaacucccuagaggcaca

SEQ ID NO: 324499 - RNA, 27 nt, Human
uacaaacuuugcaaaacagcaaaaugu

SEQ ID NO: 324500 - RNA, 21 nt, Human
uacacagaaagcuugaucauc

SEQ ID NO: 324501 - RNA, 27 nt, Human
uaccaccaagagauguucuaaaaagag

SEQ ID NO: 324502 - RNA, 25 nt, Human
uaccggaaagccaaagauaucaaaa

SEQ ID NO: 324503 - RNA, 21 nt, Human
uagaaauagguacuucuguau

SEQ ID NO: 324504 - RNA, 21 nt, Human
uagauaccggaaagccaaaga

SEQ ID NO: 324505 - RNA, 24 nt, Human
uagaucgcucaagaaggaaauaau

SEQ ID NO: 324506 - RNA, 21 nt, Human
uagcaaagcucaacuucccaa

SEQ ID NO: 324507 - RNA, 24 nt, Human
uaguucucaucagaaggaaaugau

SEQ ID NO: 324508 - RNA, 26 nt, Human
uauaaaauuaaccuuucaaaauauuu

SEQ ID NO: 324509 - RNA, 18 nt, Human
uauacaaacuuugcaaaa

SEQ ID NO: 324510 - RNA, 18 nt, Human
uaucaaagaggaacuggc

SEQ ID NO: 324511 - RNA, 18 nt, Human
uaugauuaaaaacagacu

SEQ ID NO: 324512 - RNA, 23 nt, Human
uauuuuacagugccauauuauuc

SEQ ID NO: 324513 - RNA, 20 nt, Human
uccaaggaaaaacaaaaggu

SEQ ID NO: 324514 - RNA, 21 nt, Human
uccaaggaaaaacaaaaggua

SEQ ID NO: 324515 - RNA, 28 nt, Human
uccaaggaaaaacaaaagguaaaggaaa

SEQ ID NO: 324516 - RNA, 23 nt, Human
ucucaaaauuuaacuucccuugu

SEQ ID NO: 324517 - RNA, 22 nt, Human
ucuccuggcucauuccucuuug

SEQ ID NO: 324518 - RNA, 25 nt, Human
ugcaaaacagcaaaauguauggcaa

SEQ ID NO: 324519 - RNA, 22 nt, Human
uggcaaaaauagauaccggaaa

SEQ ID NO: 324520 - RNA, 23 nt, Human
ugguguuagcucuguugaaaugc

SEQ ID NO: 324521 - RNA, 21 nt, Human
uguauggcaaaaauagauacc

SEQ ID NO: 324522 - RNA, 26 nt, Human
ugugaaugcgguuucucuccucucuc

SEQ ID NO: 324523 - RNA, 22 nt, Human
ugugaauucauaagcaaccauc

SEQ ID NO: 324524 - RNA, 19 nt, Human
uguugaaaugccugggucu

SEQ ID NO: 324525 - RNA, 24 nt, Human
uuaaaaacagacucuucaucaaga

SEQ ID NO: 324526 - RNA, 19 nt, Human
uuaaagaacagcaggauaa

SEQ ID NO: 324527 - RNA, 23 nt, Human
uuguuuagaaauagguacuucug

SEQ ID NO: 324528 - RNA, 21 nt, Human
uuugugaaugcgguuucucuc

SEQ ID NO: 324529 - RNA, 18 nt, Human
uuuuuuuuuuuuuuuuug

SEQ ID NO: 324530 - RNA, 23 nt, Human
uuuuuuuuuuuuuuuuuggaauu

SEQ ID NO: 324531 - RNA, 31 nt, Human
uuuuuuuuuuuuuuuuuuuuuuuggaauuaa

SEQ ID NO: 324532 - RNA, 21 nt, Human
acagagcagagacauccagag

SEQ ID NO: 324533 - RNA, 21 nt, Human
ccagagcgugggggucaccug

SEQ ID NO: 324534 - RNA, 21 nt, Human
cuggccgggaucccagcuuca

SEQ ID NO: 324535 - RNA, 22 nt, Human
gaacagagcagagacauccaga

SEQ ID NO: 324536 - RNA, 24 nt, Human
gagccggggcaggggcucggggaa

SEQ ID NO: 324537 - RNA, 19 nt, Human
gcggggagccggggcaggg

SEQ ID NO: 324538 - RNA, 25 nt, Human
gggcaggggugcuuuggcggggagc

SEQ ID NO: 324539 - RNA, 19 nt, Human
gggcucggggaaggaacag

SEQ ID NO: 324540 - RNA, 22 nt, Human
ucaccuggcuggccgggauccc

SEQ ID NO: 324541 - RNA, 21 nt, Human
ucccagcuucagcccugggga

SEQ ID NO: 324542 - RNA, 23 nt, Human
uuuuuuuuuuuuuuuuuuaacug

SEQ ID NO: 324543 - RNA, 26 nt, Human
ccaaaggcucugcgccgcgcaccugg

SEQ ID NO: 324544 - RNA, 19 nt, Human
gggcccagcccaggguggg

SEQ ID NO: 324545 - RNA, 25 nt, Human
ucccaaaggcucugcgccgcgcacc

SEQ ID NO: 324546 - RNA, 18 nt, Human
ucguugggccucugguug

SEQ ID NO: 324547 - RNA, 19 nt, Human
ucugcgccgcgcaccuggg

SEQ ID NO: 324548 - RNA, 21 nt, Human
ugccugggauguggggucccc

SEQ ID NO: 324549 - RNA, 22 nt, Human
ugccugggauguggggucccca

SEQ ID NO: 324550 - RNA, 23 nt, Human
uggcuuagucguugggccucugg

SEQ ID NO: 324551 - RNA, 24 nt, Human
uggcuuagucguugggccucuggu

SEQ ID NO: 324552 - RNA, 19 nt, Human
aaaauaaauaaccugacaa

SEQ ID NO: 324553 - RNA, 19 nt, Human
aaacaaauuacaaaaccac

SEQ ID NO: 324554 - RNA, 23 nt, Human
aaacagugcaaauucacugaaau

SEQ ID NO: 324555 - RNA, 20 nt, Human
acaguaacuaugauuaaaca

SEQ ID NO: 324556 - RNA, 20 nt, Human
acaucuguagccuugaccac

SEQ ID NO: 324557 - RNA, 20 nt, Human
accauguuccccuaaauaaa

SEQ ID NO: 324558 - RNA, 19 nt, Human
acucagaggaaaaagggga

SEQ ID NO: 324559 - RNA, 18 nt, Human
agaaaguacagucacugu

SEQ ID NO: 324560 - RNA, 19 nt, Human
agaacuuuuaaacuacuga

SEQ ID NO: 324561 - RNA, 20 nt, Human
agagaugcgcccuccucucc

SEQ ID NO: 324562 - RNA, 18 nt, Human
agaguauuaaugagaauu

SEQ ID NO: 324563 - RNA, 20 nt, Human
agcaggcuugguugcuucca

SEQ ID NO: 324564 - RNA, 21 nt, Human
aggaaaaaggggagggaccga

SEQ ID NO: 324565 - RNA, 23 nt, Human
caaacaaauuacaaaaccacaua

SEQ ID NO: 324566 - RNA, 24 nt, Human
caaauuacaaaaccacauacuuug

SEQ ID NO: 324567 - RNA, 19 nt, Human
caacaggaaagcuuaaauc

SEQ ID NO: 324568 - RNA, 22 nt, Human
cagaggaaaaaggggagggacc

SEQ ID NO: 324569 - RNA, 24 nt, Human
cagcaggcuugguugcuuccacau

SEQ ID NO: 324570 - RNA, 25 nt, Human
cauuucuauuauuucuuguugagag

SEQ ID NO: 324571 - RNA, 19 nt, Human
ccacauacacaaacaucac

SEQ ID NO: 324572 - RNA, 23 nt, Human
ccagagcccccuucccgcaccca

SEQ ID NO: 324573 - RNA, 21 nt, Human
cccacauacacaaacaucaca

SEQ ID NO: 324574 - RNA, 19 nt, Human
cccgcacccagcgcgccga

SEQ ID NO: 324575 - RNA, 19 nt, Human
cccuccucucccggccuuu

SEQ ID NO: 324576 - RNA, 20 nt, Human
ccgcacccagcgcgccgacg

SEQ ID NO: 324577 - RNA, 22 nt, Human
ccuaaauaaaauauagacagau

SEQ ID NO: 324578 - RNA, 22 nt, Human
cgcccuccucucccggccuuua

SEQ ID NO: 324579 - RNA, 21 nt, Human
cuccaaaggccaaguaccaug

SEQ ID NO: 324580 - RNA, 23 nt, Human
cuccaaaggccaaguaccaugcu

SEQ ID NO: 324581 - RNA, 22 nt, Human
cucccacauacacaaacaucac

SEQ ID NO: 324582 - RNA, 28 nt, Human
cucucccggccuuuaccugggaggaagg

SEQ ID NO: 324583 - RNA, 22 nt, Human
cucucccggccuuuaccugggg

SEQ ID NO: 324584 - RNA, 21 nt, Human
cuuuuuauuagggcagcuuca

SEQ ID NO: 324585 - RNA, 20 nt, Human
gaccugcaguuccuggagga

SEQ ID NO: 324586 - RNA, 23 nt, Human
gcacaucuguagccuugaccaca

SEQ ID NO: 324587 - RNA, 21 nt, Human
ggaggaagagggucugagagc

SEQ ID NO: 324588 - RNA, 21 nt, Human
ggcagcuggaucuucaaugca

SEQ ID NO: 324589 - RNA, 20 nt, Human
ggccacguacauccuccccc

SEQ ID NO: 324590 - RNA, 22 nt, Human
gucaaaccauguuccccuaaau

SEQ ID NO: 324591 - RNA, 18 nt, Human
uaaaauaaauaaccugac

SEQ ID NO: 324592 - RNA, 24 nt, Human
uaaaauaaauaaccugacaacuug

SEQ ID NO: 324593 - RNA, 23 nt, Human
uaacgguaguagcaagauuaaaa

SEQ ID NO: 324594 - RNA, 20 nt, Human
uaagauaugacucacugcua

SEQ ID NO: 324595 - RNA, 18 nt, Human
uaccugggaggaagaggg

SEQ ID NO: 324596 - RNA, 21 nt, Human
ucagaggaaaaaggggaggga

SEQ ID NO: 324597 - RNA, 19 nt, Human
ucauuguucaaauaaaggg

SEQ ID NO: 324598 - RNA, 23 nt, Human
uccaguauaucugaagaaugaac

SEQ ID NO: 324599 - RNA, 20 nt, Human
ucccacauacacaaacauca

SEQ ID NO: 324600 - RNA, 23 nt, Human
ucccacauacacaaacaucacag

SEQ ID NO: 324601 - RNA, 20 nt, Human
ucccauauaagaugagucaa

SEQ ID NO: 324602 - RNA, 20 nt, Human
ucccgcacccagcgcgccga

SEQ ID NO: 324603 - RNA, 23 nt, Human
ugagagaaccauuccuaaagucu

SEQ ID NO: 324604 - RNA, 24 nt, Human
ugauguuaacccacugaguccacu

SEQ ID NO: 324605 - RNA, 23 nt, Human
uggccacguacauccucccccag

SEQ ID NO: 324606 - RNA, 24 nt, Human
uguaagaguaauacuguagugaug

SEQ ID NO: 324607 - RNA, 18 nt, Human
uguacacuauauguguau

SEQ ID NO: 324608 - RNA, 22 nt, Human
uucaaaaugaucuuccagaugc

SEQ ID NO: 324609 - RNA, 24 nt, Human
uucacugaaauauuuugaugcuga

SEQ ID NO: 324610 - RNA, 26 nt, Human
uucccauauaagaugagucaaaccau

SEQ ID NO: 324611 - RNA, 21 nt, Human
uuccuggaggaugaguaaaca

SEQ ID NO: 324612 - RNA, 19 nt, Human
uugaccacagcuuaaaugu

SEQ ID NO: 324613 - RNA, 21 nt, Human
uuuacacacuguuuucauuuc

SEQ ID NO: 324614 - RNA, 19 nt, Human
uuuaccugggaggaagagg

SEQ ID NO: 324615 - RNA, 24 nt, Human
aaacaggacauaacagcuucugga

SEQ ID NO: 324616 - RNA, 20 nt, Human
aauucacaaaacaauaggac

SEQ ID NO: 324617 - RNA, 23 nt, Human
acgcggcgcgggcggcggcggag

SEQ ID NO: 324618 - RNA, 23 nt, Human
acuggcccgggagggagccacgc

SEQ ID NO: 324619 - RNA, 25 nt, Human
agggagccacgccuuccucucuggg

SEQ ID NO: 324620 - RNA, 23 nt, Human
agguuuuaauuuccccaaaauuc

SEQ ID NO: 324621 - RNA, 18 nt, Human
agucauggagcuuccagu

SEQ ID NO: 324622 - RNA, 20 nt, Human
agucauggagcuuccaguga

SEQ ID NO: 324623 - RNA, 22 nt, Human
cagcgggagggggcagacgcgg

SEQ ID NO: 324624 - RNA, 22 nt, Human
ccgcagcgggagggggcagacg

SEQ ID NO: 324625 - RNA, 18 nt, Human
ccgcggcuggggcugggc

SEQ ID NO: 324626 - RNA, 21 nt, Human
cgggagggggcagacgcggcg

SEQ ID NO: 324627 - RNA, 19 nt, Human
cucucugggaaaccucugg

SEQ ID NO: 324628 - RNA, 18 nt, Human
gaaacaggacauaacagc

SEQ ID NO: 324629 - RNA, 22 nt, Human
gagccgcagcgggagggggcag

SEQ ID NO: 324630 - RNA, 18 nt, Human
gcggcggcggaggucggc

SEQ ID NO: 324631 - RNA, 19 nt, Human
gcggcggcggaggucggcg

SEQ ID NO: 324632 - RNA, 23 nt, Human
ggggcagacgcggcgcgggcggc

SEQ ID NO: 324633 - RNA, 21 nt, Human
guccagagagccgcagcggga

SEQ ID NO: 324634 - RNA, 22 nt, Human
uacaaaaacauguauggaaaca

SEQ ID NO: 324635 - RNA, 20 nt, Human
uacaaaaagagagucaugga

SEQ ID NO: 324636 - RNA, 25 nt, Human
uacaaaaagagagucauggagcuuc

SEQ ID NO: 324637 - RNA, 25 nt, Human
uaugcuuuauucaaauuauggaaua

SEQ ID NO: 324638 - RNA, 22 nt, Human
uccgcugcugggaccgcggccg

SEQ ID NO: 324639 - RNA, 24 nt, Human
uccgcugcugggaccgcggccgcg

SEQ ID NO: 324640 - RNA, 19 nt, Human
uccucucugggaaaccucu

SEQ ID NO: 324641 - RNA, 19 nt, Human
ugaggaggggauggcgucc

SEQ ID NO: 324642 - RNA, 20 nt, Human
uggcccgggagggagccacg

SEQ ID NO: 324643 - RNA, 19 nt, Human
uggcguccagagagccgca

SEQ ID NO: 324644 - RNA, 20 nt, Human
uggcuucgaggugaggaggg

SEQ ID NO: 324645 - RNA, 18 nt, Human
ugggggugggcuuggggg

SEQ ID NO: 324646 - RNA, 22 nt, Human
ugucaaaauaguucacagauac

SEQ ID NO: 324647 - RNA, 29 nt, Human
uucugugauuuuuuuuucuuuuacaaaaa

SEQ ID NO: 324648 - RNA, 21 nt, Human
aaacuugggaaacaagaggug

SEQ ID NO: 324649 - RNA, 23 nt, Human
agcguucaggugugaggcugugc

SEQ ID NO: 324650 - RNA, 22 nt, Human
agucccagcuuugcagugcccg

SEQ ID NO: 324651 - RNA, 27 nt, Human
caccuuguccugcucagucuggaauuu

SEQ ID NO: 324652 - RNA, 18 nt, Human
cagcagcgguggcagccu

SEQ ID NO: 324653 - RNA, 18 nt, Human
cagcgguggcagccucac

SEQ ID NO: 324654 - RNA, 23 nt, Human
cagugcccgccggucucgucugc

SEQ ID NO: 324655 - RNA, 18 nt, Human
ccuuggagugcaaggcug

SEQ ID NO: 324656 - RNA, 23 nt, Human
ccuuguccugcucagucuggaaa

SEQ ID NO: 324657 - RNA, 19 nt, Human
cgggaggacagcguucagg

SEQ ID NO: 324658 - RNA, 21 nt, Human
cuuacucgcuauuuuuuuucc

SEQ ID NO: 324659 - RNA, 20 nt, Human
gagcacagcuaaaugugacc

SEQ ID NO: 324660 - RNA, 20 nt, Human
gcagugcccgccggucucgu

SEQ ID NO: 324661 - RNA, 18 nt, Human
gcggcagcagcgguggca

SEQ ID NO: 324662 - RNA, 23 nt, Human
ggaggacagcguucaggugugag

SEQ ID NO: 324663 - RNA, 18 nt, Human
ggcagcagcgguggcagc

SEQ ID NO: 324664 - RNA, 19 nt, Human
ggcagcagcgguggcagcc

SEQ ID NO: 324665 - RNA, 20 nt, Human
gugcagcgggaugggucagu

SEQ ID NO: 324666 - RNA, 22 nt, Human
uagcccuucugagcacagcuaa

SEQ ID NO: 324667 - RNA, 23 nt, Human
ucaaagccggucucaguggcugu

SEQ ID NO: 324668 - RNA, 21 nt, Human
ugagcacagcuaaaugugaca

SEQ ID NO: 324669 - RNA, 18 nt, Human
ugcagcgggaugggucag

SEQ ID NO: 324670 - RNA, 19 nt, Human
ugcgcagccuuggagugca

SEQ ID NO: 324671 - RNA, 19 nt, Human
uggacaccgaggucagagu

SEQ ID NO: 324672 - RNA, 18 nt, Human
ugggucuguagcggcagc

SEQ ID NO: 324673 - RNA, 19 nt, Human
ugugacauguaugugucua

SEQ ID NO: 324674 - RNA, 18 nt, Human
uuuauaaggguccagaaa

SEQ ID NO: 324675 - RNA, 22 nt, Human
uuuuggacaccgaggucagagu

SEQ ID NO: 324676 - RNA, 20 nt, Human
aaagacauccaaagccaacg

SEQ ID NO: 324677 - RNA, 19 nt, Human
aaaguuccuuugaguggcu

SEQ ID NO: 324678 - RNA, 24 nt, Human
aacagagcaagacucugucuugga

SEQ ID NO: 324679 - RNA, 18 nt, Human
aacauggugaacccgucu

SEQ ID NO: 324680 - RNA, 19 nt, Human
aacauggugaacccgucuc

SEQ ID NO: 324681 - RNA, 24 nt, Human
aaucgcuugaacccgggaggcgga

SEQ ID NO: 324682 - RNA, 23 nt, Human
acacacacacacacacacacaca

SEQ ID NO: 324683 - RNA, 23 nt, Human
acacacacacacacacacacaca

SEQ ID NO: 324684 - RNA, 23 nt, Human
acacacacacacacacacacaca

SEQ ID NO: 324685 - RNA, 23 nt, Human
acacacacacacacacacacaca

SEQ ID NO: 324686 - RNA, 23 nt, Human
acacacacacacacacacacaca

SEQ ID NO: 324687 - RNA, 23 nt, Human
acacacacacacacacacacaca

SEQ ID NO: 324688 - RNA, 24 nt, Human
acacacacacacacacacacacag

SEQ ID NO: 324689 - RNA, 25 nt, Human
acacacacauacacauacacacaca

SEQ ID NO: 324690 - RNA, 28 nt, Human
acacacacgggcacacacacaggcccac

SEQ ID NO: 324691 - RNA, 28 nt, Human
acacauacacacacacgggcacacacac

SEQ ID NO: 324692 - RNA, 24 nt, Human
acagagcaagacucugucuuggaa

SEQ ID NO: 324693 - RNA, 25 nt, Human
acauacacacacacauacacauaca

SEQ ID NO: 324694 - RNA, 29 nt, Human
acauacacauacacacacacgggcacaca

SEQ ID NO: 324695 - RNA, 18 nt, Human
accccagccuugcuucca

SEQ ID NO: 324696 - RNA, 24 nt, Human
acuucacuccagcuugggcaacag

SEQ ID NO: 324697 - RNA, 25 nt, Human
acuucacuccagcuugggcaacaga

SEQ ID NO: 324698 - RNA, 24 nt, Human
acuuccauuuaaugacuaaaaauc

SEQ ID NO: 324699 - RNA, 31 nt, Human
agaaaacacacacacacacacacacacacag

SEQ ID NO: 324700 - RNA, 21 nt, Human
agacauccaaagccaacggca

SEQ ID NO: 324701 - RNA, 24 nt, Human
agcacuuugggaggccgaggccgg

SEQ ID NO: 324702 - RNA, 23 nt, Human
agcuggguauggugauacgcgcc

SEQ ID NO: 324703 - RNA, 24 nt, Human
agcuugggcaacagagcaagacuc

SEQ ID NO: 324704 - RNA, 20 nt, Human
aggaacccaagaccccagcc

SEQ ID NO: 324705 - RNA, 21 nt, Human
aggccgaggccgguggaucac

SEQ ID NO: 324706 - RNA, 26 nt, Human
aggccgguggaucacuugaggccagg

SEQ ID NO: 324707 - RNA, 19 nt, Human
aggcggaggcugcagugag

SEQ ID NO: 324708 - RNA, 24 nt, Human
aggcgggagaaucgcuugaacccg

SEQ ID NO: 324709 - RNA, 20 nt, Human
aggcugaggcgggagaaucg

SEQ ID NO: 324710 - RNA, 24 nt, Human
aggcugaggcgggagaaucgcuug

SEQ ID NO: 324711 - RNA, 22 nt, Human
aggcugcagugagccagauugu

SEQ ID NO: 324712 - RNA, 18 nt, Human
aggcugccaggaaaccag

SEQ ID NO: 324713 - RNA, 24 nt, Human
agugauucaugccugucaucccag

SEQ ID NO: 324714 - RNA, 21 nt, Human
aucacuugaggccaggaguuc

SEQ ID NO: 324715 - RNA, 24 nt, Human
auuguaccacuucacuccagcuug

SEQ ID NO: 324716 - RNA, 22 nt, Human
caaagcucccgguccuccaccc

SEQ ID NO: 324717 - RNA, 24 nt, Human
caagaccccagccuugcuuccaca

SEQ ID NO: 324718 - RNA, 20 nt, Human
cacacacacacacacacaca

SEQ ID NO: 324719 - RNA, 20 nt, Human
cacacacacacacacacaca

SEQ ID NO: 324720 - RNA, 20 nt, Human
cacacacacacacacacaca

SEQ ID NO: 324721 - RNA, 20 nt, Human
cacacacacacacacacaca

SEQ ID NO: 324722 - RNA, 20 nt, Human
cacacacacacacacacaca

SEQ ID NO: 324723 - RNA, 20 nt, Human
cacacacacacacacacaca

SEQ ID NO: 324724 - RNA, 20 nt, Human
cacacacacacacacacaca

SEQ ID NO: 324725 - RNA, 20 nt, Human
cacacacacacacacacaca

SEQ ID NO: 324726 - RNA, 20 nt, Human
cacacacacacacacacaca

SEQ ID NO: 324727 - RNA, 20 nt, Human
cacacacacacacacacaca

SEQ ID NO: 324728 - RNA, 20 nt, Human
cacacacacacacacacaca

SEQ ID NO: 324729 - RNA, 20 nt, Human
cacacacacacacacacaca

SEQ ID NO: 324730 - RNA, 22 nt, Human
cacacacacacacacacacaca

SEQ ID NO: 324731 - RNA, 22 nt, Human
cacacacacacacacacacaca

SEQ ID NO: 324732 - RNA, 22 nt, Human
cacacacacacacacacacaca

SEQ ID NO: 324733 - RNA, 22 nt, Human
cacacacacacacacacacaca

SEQ ID NO: 324734 - RNA, 22 nt, Human
cacacacacacacacacacaca

SEQ ID NO: 324735 - RNA, 26 nt, Human
cacacacacacacacacacacacaca

SEQ ID NO: 324736 - RNA, 26 nt, Human
cacacacacacacacacacacacaca

SEQ ID NO: 324737 - RNA, 26 nt, Human
cacacacacacacacacacacacaca

SEQ ID NO: 324738 - RNA, 26 nt, Human
cacacacacacacacacacacacaca

SEQ ID NO: 324739 - RNA, 26 nt, Human
cacacacacacacacacacacacaca

SEQ ID NO: 324740 - RNA, 26 nt, Human
cacacacacacacacacacacacaca

SEQ ID NO: 324741 - RNA, 26 nt, Human
cacacacacacacacacacacacaca

SEQ ID NO: 324742 - RNA, 26 nt, Human
cacacacacacacacacacacacaca

SEQ ID NO: 324743 - RNA, 26 nt, Human
cacacacacacacacacacacacacg

SEQ ID NO: 324744 - RNA, 22 nt, Human
cacacacacacacacacacacg

SEQ ID NO: 324745 - RNA, 22 nt, Human
cacacacacgggcacacacaca

SEQ ID NO: 324746 - RNA, 22 nt, Human
cacacaggcccacugugcccag

SEQ ID NO: 324747 - RNA, 26 nt, Human
cacauacacauacacacacacgggca

SEQ ID NO: 324748 - RNA, 24 nt, Human
cacccacugcccuuuggagggacu

SEQ ID NO: 324749 - RNA, 22 nt, Human
cacgggcacacacacaggccca

SEQ ID NO: 324750 - RNA, 24 nt, Human
cacuucacuccagcuugggcaaca

SEQ ID NO: 324751 - RNA, 19 nt, Human
cagaauuucuggggucagu

SEQ ID NO: 324752 - RNA, 19 nt, Human
cagcaaagacauccaaagc

SEQ ID NO: 324753 - RNA, 22 nt, Human
cagcacuuugggaggccgaggc

SEQ ID NO: 324754 - RNA, 25 nt, Human
cagcacuuugggaggccgaggccgg

SEQ ID NO: 324755 - RNA, 22 nt, Human
cagccacuucgugcaggaaucc

SEQ ID NO: 324756 - RNA, 24 nt, Human
cagcgggggcagaggagccagccc

SEQ ID NO: 324757 - RNA, 24 nt, Human
cagcuacucaggaggcugaggcgg

SEQ ID NO: 324758 - RNA, 22 nt, Human
cauacaggaacccaagacccca

SEQ ID NO: 324759 - RNA, 24 nt, Human
caugccugucaucccagcacuuug

SEQ ID NO: 324760 - RNA, 23 nt, Human
ccaaagcucccgguccuccaccc

SEQ ID NO: 324761 - RNA, 23 nt, Human
ccacuucacuccagcuugggcaa

SEQ ID NO: 324762 - RNA, 24 nt, Human
ccacuucacuccagcuugggcaac

SEQ ID NO: 324763 - RNA, 22 nt, Human
cccaaagcucccgguccuccac

SEQ ID NO: 324764 - RNA, 23 nt, Human
cccacacgcgcagcaggcugcca

SEQ ID NO: 324765 - RNA, 22 nt, Human
cccgucucuacuaaaaauacaa

SEQ ID NO: 324766 - RNA, 22 nt, Human
ccgggaggcggaggcugcagug

SEQ ID NO: 324767 - RNA, 20 nt, Human
ccucccacccacaccugagc

SEQ ID NO: 324768 - RNA, 23 nt, Human
ccucccacccacaccugagccag

SEQ ID NO: 324769 - RNA, 21 nt, Human
ccucuagauuggcugggccag

SEQ ID NO: 324770 - RNA, 21 nt, Human
ccugggcaacauggugaaccc

SEQ ID NO: 324771 - RNA, 22 nt, Human
ccugggcaacauggugaacccg

SEQ ID NO: 324772 - RNA, 21 nt, Human
ccuguaaucccagcuacucag

SEQ ID NO: 324773 - RNA, 22 nt, Human
ccuguaaucccagcuacucagg

SEQ ID NO: 324774 - RNA, 23 nt, Human
ccuguccuuggcucacccagccg

SEQ ID NO: 324775 - RNA, 26 nt, Human
cgaggccgguggaucacuugaggcca

SEQ ID NO: 324776 - RNA, 24 nt, Human
cgccuguaaucccagcuacucagg

SEQ ID NO: 324777 - RNA, 23 nt, Human
cgguggaucacuugaggccagga

SEQ ID NO: 324778 - RNA, 22 nt, Human
cuccagaugguggcugagcaca

SEQ ID NO: 324779 - RNA, 25 nt, Human
cucccacccacaccugagccagaga

SEQ ID NO: 324780 - RNA, 19 nt, Human
cugcagcaaagacauccaa

SEQ ID NO: 324781 - RNA, 21 nt, Human
cugcagugagccagauuguac

SEQ ID NO: 324782 - RNA, 21 nt, Human
cuuggcucacccagcuuccac

SEQ ID NO: 324783 - RNA, 28 nt, Human
gaaucuuaaauagagucucccuucucuc

SEQ ID NO: 324784 - RNA, 21 nt, Human
gacauccaaagccaacggcaa

SEQ ID NO: 324785 - RNA, 22 nt, Human
gaggcugcagugagccagauug

SEQ ID NO: 324786 - RNA, 24 nt, Human
gaguggcuggucacccaaagcucc

SEQ ID NO: 324787 - RNA, 18 nt, Human
gaucacuugaggccagga

SEQ ID NO: 324788 - RNA, 24 nt, Human
gaucacuugaggccaggaguucga

SEQ ID NO: 324789 - RNA, 19 nt, Human
gcaacagagcaagacucug

SEQ ID NO: 324790 - RNA, 24 nt, Human
gcccagagacccacacgcgcagca

SEQ ID NO: 324791 - RNA, 33 nt, Human
gcuaagaaacauacacacacacauacacauagu

SEQ ID NO: 324792 - RNA, 20 nt, Human
ggacucagggcccaccacaa

SEQ ID NO: 324793 - RNA, 21 nt, Human
ggaggcugcagugagccagau

SEQ ID NO: 324794 - RNA, 23 nt, Human
ggaggcugcagugagccagauug

SEQ ID NO: 324795 - RNA, 20 nt, Human
ggaucacuugaggccaggaa

SEQ ID NO: 324796 - RNA, 22 nt, Human
ggcagggguccccuggccuggc

SEQ ID NO: 324797 - RNA, 21 nt, Human
ggcccacugugcccagagacc

SEQ ID NO: 324798 - RNA, 18 nt, Human
ggcugagcuuccuguggg

SEQ ID NO: 324799 - RNA, 20 nt, Human
ggcugccaggaaaccaggag

SEQ ID NO: 324800 - RNA, 19 nt, Human
gggaggccgaggccggugg

SEQ ID NO: 324801 - RNA, 21 nt, Human
ggggucagucugaaaagucug

SEQ ID NO: 324802 - RNA, 24 nt, Human
ggguauggugauacgcgccuguaa

SEQ ID NO: 324803 - RNA, 24 nt, Human
ggugauacgcgccuguaaucccag

SEQ ID NO: 324804 - RNA, 23 nt, Human
guggaucacuugaggccaggagu

SEQ ID NO: 324805 - RNA, 20 nt, Human
guggcugagcacagugauuc

SEQ ID NO: 324806 - RNA, 21 nt, Human
uaagaaacauacacacacacc

SEQ ID NO: 324807 - RNA, 25 nt, Human
uacacacacacauacacauacacac

SEQ ID NO: 324808 - RNA, 24 nt, Human
uacacacacacgggcacacacaca

SEQ ID NO: 324809 - RNA, 31 nt, Human
uaggagaaaacacacacacacacacacacag

SEQ ID NO: 324810 - RNA, 21 nt, Human
ucacagggacucacaugggag

SEQ ID NO: 324811 - RNA, 23 nt, Human
ucacccagcuuccaccauacagg

SEQ ID NO: 324812 - RNA, 24 nt, Human
ucacuccagcuugggcaacagagc

SEQ ID NO: 324813 - RNA, 23 nt, Human
ucacuugaggccaggaguucgag

SEQ ID NO: 324814 - RNA, 22 nt, Human
ucaugccugucaucccagcacu

SEQ ID NO: 324815 - RNA, 23 nt, Human
ucaugccugucaucccagcacuu

SEQ ID NO: 324816 - RNA, 24 nt, Human
uccacagagaacuggcaggggucc

SEQ ID NO: 324817 - RNA, 24 nt, Human
uccagcuugggcaacagagcaaga

SEQ ID NO: 324818 - RNA, 21 nt, Human
ucccacccacaccugagccag

SEQ ID NO: 324819 - RNA, 22 nt, Human
ucccacccacaccugagccaga

SEQ ID NO: 324820 - RNA, 23 nt, Human
ucccgguccuccacccacugccc

SEQ ID NO: 324821 - RNA, 24 nt, Human
ucgcuugaacccgggaggcggagg

SEQ ID NO: 324822 - RNA, 22 nt, Human
ucucccuucucucuuuucacug

SEQ ID NO: 324823 - RNA, 23 nt, Human
ucucuacuaaaaauacaaaaauu

SEQ ID NO: 324824 - RNA, 19 nt, Human
ucuggggucagucugaaaa

SEQ ID NO: 324825 - RNA, 21 nt, Human
ucuuuucacuguuagggaggg

SEQ ID NO: 324826 - RNA, 21 nt, Human
ugaagauacugaagggaccag

SEQ ID NO: 324827 - RNA, 20 nt, Human
ugaagggaccagaaaguucc

SEQ ID NO: 324828 - RNA, 24 nt, Human
ugaggcgggagaaucgcuugaacc

SEQ ID NO: 324829 - RNA, 24 nt, Human
ugauucaugccugucaucccagca

SEQ ID NO: 324830 - RNA, 22 nt, Human
ugcagcaaagacauccaaagcc

SEQ ID NO: 324831 - RNA, 24 nt, Human
ugccugucaucccagcacuuuggg

SEQ ID NO: 324832 - RNA, 20 nt, Human
ugcucuguuacuuuagcuga

SEQ ID NO: 324833 - RNA, 20 nt, Human
uggaucacuugaggccagga

SEQ ID NO: 324834 - RNA, 24 nt, Human
uggaucacuugaggccaggaguuc

SEQ ID NO: 324835 - RNA, 27 nt, Human
uggaucacuugaggccaggaguucgag

SEQ ID NO: 324836 - RNA, 19 nt, Human
uggcagggguccccuggcc

SEQ ID NO: 324837 - RNA, 19 nt, Human
uggcagggguccccuggcc

SEQ ID NO: 324838 - RNA, 20 nt, Human
uggcagggguccccuggccu

SEQ ID NO: 324839 - RNA, 23 nt, Human
uggcagggguccccuggccugac

SEQ ID NO: 324840 - RNA, 23 nt, Human
uggcagggguccccuggccuggc

SEQ ID NO: 324841 - RNA, 22 nt, Human
uggccuggccaucacagggacu

SEQ ID NO: 324842 - RNA, 19 nt, Human
ugggaggagaaggcugagc

SEQ ID NO: 324843 - RNA, 24 nt, Human
ugggaggccgaggccgguggauca

SEQ ID NO: 324844 - RNA, 20 nt, Human
ugggcaacagagcaagacuc

SEQ ID NO: 324845 - RNA, 23 nt, Human
uggucacccaaagcucccggucc

SEQ ID NO: 324846 - RNA, 22 nt, Human
uguaccacuucacuccagcuug

SEQ ID NO: 324847 - RNA, 21 nt, Human
uguccuuggcucacccagcuu

SEQ ID NO: 324848 - RNA, 20 nt, Human
uuagcuggguauggugauac

SEQ ID NO: 324849 - RNA, 22 nt, Human
uuagcuggguauggugauacgc

SEQ ID NO: 324850 - RNA, 22 nt, Human
uuagggagggagagggagugau

SEQ ID NO: 324851 - RNA, 22 nt, Human
uugaggccaggaguucgagacc

SEQ ID NO: 324852 - RNA, 23 nt, Human
uuggcugggccagaauuucuggg

SEQ ID NO: 324853 - RNA, 25 nt, Human
uugggaggccgaggccgguggauca

SEQ ID NO: 324854 - RNA, 20 nt, Human
uuuuuuuuuuuggcagacac

SEQ ID NO: 324855 - RNA, 22 nt, Human
uuuuuuuuuuuuuuuuuggcag

SEQ ID NO: 324856 - RNA, 22 nt, Human
uuuuuuuuuuuuuuuuuuuggc

SEQ ID NO: 324857 - RNA, 28 nt, Human
uuuuuuuuuuuuuuuuuuuuuuuggggg

SEQ ID NO: 324858 - RNA, 23 nt, Human
aaaaaacacuuccaacaacaauc

SEQ ID NO: 324859 - RNA, 20 nt, Human
aaacauauacucagauaaca

SEQ ID NO: 324860 - RNA, 20 nt, Human
aaauaaaccaucugaaaguc

SEQ ID NO: 324861 - RNA, 24 nt, Human
aaauaaauucucugcugaaagcaa

SEQ ID NO: 324862 - RNA, 21 nt, Human
aagaucuccucaagucaguac

SEQ ID NO: 324863 - RNA, 24 nt, Human
aauaggccagaucaaaaaauaaga

SEQ ID NO: 324864 - RNA, 24 nt, Human
aauugcuuucagugugacucccau

SEQ ID NO: 324865 - RNA, 19 nt, Human
acagagcggugaucucaaa

SEQ ID NO: 324866 - RNA, 21 nt, Human
acaucaacacucuuaaguaac

SEQ ID NO: 324867 - RNA, 19 nt, Human
aggaaggauggagaauggu

SEQ ID NO: 324868 - RNA, 21 nt, Human
agguuguuauaacaaaccauc

SEQ ID NO: 324869 - RNA, 23 nt, Human
agucaucucccucucaaaacugu

SEQ ID NO: 324870 - RNA, 22 nt, Human
auaaagcaggacuaccuucccu

SEQ ID NO: 324871 - RNA, 23 nt, Human
augagaguuucuucuccaugccu

SEQ ID NO: 324872 - RNA, 22 nt, Human
augucuguguguauaugugugu

SEQ ID NO: 324873 - RNA, 22 nt, Human
caaaaacaaguugaaaauguac

SEQ ID NO: 324874 - RNA, 18 nt, Human
caaaauaggccagaucaa

SEQ ID NO: 324875 - RNA, 20 nt, Human
caaacaagcaaagaaaaagu

SEQ ID NO: 324876 - RNA, 18 nt, Human
cacaaugaggggcaaaau

SEQ ID NO: 324877 - RNA, 23 nt, Human
cacaucucucucacuccuuaaag

SEQ ID NO: 324878 - RNA, 28 nt, Human
cagaugauucacucaaagcccugaaagg

SEQ ID NO: 324879 - RNA, 18 nt, Human
cagggucaggcaaccugu

SEQ ID NO: 324880 - RNA, 23 nt, Human
caucaaugugcugagaaagagcc

SEQ ID NO: 324881 - RNA, 26 nt, Human
caucucccucucaaaacugugcagga

SEQ ID NO: 324882 - RNA, 20 nt, Human
cauuguacccagcaugauaa

SEQ ID NO: 324883 - RNA, 23 nt, Human
ccagccgggcucucugaggagca

SEQ ID NO: 324884 - RNA, 22 nt, Human
ccaucugaaagucuucugguua

SEQ ID NO: 324885 - RNA, 19 nt, Human
ccgccagccgggcucucug

SEQ ID NO: 324886 - RNA, 22 nt, Human
ccucaaggagaaggauccugga

SEQ ID NO: 324887 - RNA, 27 nt, Human
cugaaagucuucugguuacuucaccag

SEQ ID NO: 324888 - RNA, 18 nt, Human
gaaacacacuagcugcag

SEQ ID NO: 324889 - RNA, 20 nt, Human
gaagaaacacacuagcugca

SEQ ID NO: 324890 - RNA, 18 nt, Human
gagaaucugaaaucagcc

SEQ ID NO: 324891 - RNA, 28 nt, Human
gagcagaagacggagccgcucggugugc

SEQ ID NO: 324892 - RNA, 20 nt, Human
gauugcagggucaggcaacc

SEQ ID NO: 324893 - RNA, 20 nt, Human
gcaaauaaaccaucugaaaa

SEQ ID NO: 324894 - RNA, 20 nt, Human
uaaauaagacagauaagcuc

SEQ ID NO: 324895 - RNA, 21 nt, Human
uacacaaacaagcaaagaaaa

SEQ ID NO: 324896 - RNA, 30 nt, Human
uacacaucucucucacuccuuaaagccuuu

SEQ ID NO: 324897 - RNA, 23 nt, Human
uauaaagcaggacuaccuucccu

SEQ ID NO: 324898 - RNA, 24 nt, Human
uaugacaugaaaaaacacuuccaa

SEQ ID NO: 324899 - RNA, 24 nt, Human
uauguacacaucucucucacuccu

SEQ ID NO: 324900 - RNA, 21 nt, Human
uauugccaaacaugucuuaau

SEQ ID NO: 324901 - RNA, 22 nt, Human
uauuggaaaauuuggggagaga

SEQ ID NO: 324902 - RNA, 18 nt, Human
ucaugaccaugcaugugu

SEQ ID NO: 324903 - RNA, 22 nt, Human
ucccaggccgccagccgggcuc

SEQ ID NO: 324904 - RNA, 19 nt, Human
ucccucucaaaacugugca

SEQ ID NO: 324905 - RNA, 22 nt, Human
uccucaagucaguacacauggc

SEQ ID NO: 324906 - RNA, 23 nt, Human
uccuggagccccugaaugagagu

SEQ ID NO: 324907 - RNA, 18 nt, Human
ucuguguguauaugugug

SEQ ID NO: 324908 - RNA, 21 nt, Human
ucuucuccaugccucucccca

SEQ ID NO: 324909 - RNA, 22 nt, Human
ucuuggguuaacaucauuuuua

SEQ ID NO: 324910 - RNA, 19 nt, Human
ugaaagcaaauaaaccauc

SEQ ID NO: 324911 - RNA, 19 nt, Human
ugaauuacacaaacaagca

SEQ ID NO: 324912 - RNA, 20 nt, Human
ugagaaagagccuuuguuuc

SEQ ID NO: 324913 - RNA, 19 nt, Human
ugagaguuucuucuccaug

SEQ ID NO: 324914 - RNA, 19 nt, Human
ugaggggcaaaauaggcca

SEQ ID NO: 324915 - RNA, 18 nt, Human
ugaugucuguguguauau

SEQ ID NO: 324916 - RNA, 25 nt, Human
ugcacauggccauguugcaagaucu

SEQ ID NO: 324917 - RNA, 18 nt, Human
ugcauuauccaugguaga

SEQ ID NO: 324918 - RNA, 23 nt, Human
ugcuuggcaaauugccagucuuc

SEQ ID NO: 324919 - RNA, 19 nt, Human
uggaaauauucauagaagc

SEQ ID NO: 324920 - RNA, 19 nt, Human
uggagccccugaaugagag

SEQ ID NO: 324921 - RNA, 21 nt, Human
uggagccccugaaugagaguu

SEQ ID NO: 324922 - RNA, 23 nt, Human
uggagccccugaaugagaguuuc

SEQ ID NO: 324923 - RNA, 27 nt, Human
uggcaaaaacaaguugaaaauguacag

SEQ ID NO: 324924 - RNA, 23 nt, Human
uggcaaauaggccaaguagaggc

SEQ ID NO: 324925 - RNA, 21 nt, Human
uggcaauacagcaagaauucu

SEQ ID NO: 324926 - RNA, 21 nt, Human
uguaaagaagaaacacacuag

SEQ ID NO: 324927 - RNA, 24 nt, Human
ugucaugaccaugcauguguuaau

SEQ ID NO: 324928 - RNA, 22 nt, Human
ugucuguguguauaugugugua

SEQ ID NO: 324929 - RNA, 22 nt, Human
uguguguaaagaagaaacacac

SEQ ID NO: 324930 - RNA, 18 nt, Human
uguguguauaugugugua

SEQ ID NO: 324931 - RNA, 19 nt, Human
uguguguauauguguguaa

SEQ ID NO: 324932 - RNA, 26 nt, Human
uguuauaauaauccccaagugcuugg

SEQ ID NO: 324933 - RNA, 23 nt, Human
uuaauuuuuguucuagccccaca

SEQ ID NO: 324934 - RNA, 22 nt, Human
uuacacaaacaagcaaagaaaa

SEQ ID NO: 324935 - RNA, 18 nt, Human
uucaaaaccugaaucuga

SEQ ID NO: 324936 - RNA, 25 nt, Human
uuccaacaacaaucgaccuucauaa

SEQ ID NO: 324937 - RNA, 20 nt, Human
uucucugacacaaauaaugg

SEQ ID NO: 324938 - RNA, 21 nt, Human
uucuuuuguucucugacacaa

SEQ ID NO: 324939 - RNA, 22 nt, Human
uugcagggucaggcaaccuguc

SEQ ID NO: 324940 - RNA, 21 nt, Human
uuugaugucuacuucuugggu

SEQ ID NO: 324941 - RNA, 20 nt, Human
aaaaaaaaaaaaaaaagcag

SEQ ID NO: 324942 - RNA, 19 nt, Human
aaaaauacacauuccugga

SEQ ID NO: 324943 - RNA, 20 nt, Human
aaagcaaaacauaccacaaa

SEQ ID NO: 324944 - RNA, 22 nt, Human
aaagcagcagcagaagccuggg

SEQ ID NO: 324945 - RNA, 18 nt, Human
aaagggcacuggcuguua

SEQ ID NO: 324946 - RNA, 22 nt, Human
aagaacuccgcaugccaucacc

SEQ ID NO: 324947 - RNA, 24 nt, Human
aagagcacuugucgcagggguggg

SEQ ID NO: 324948 - RNA, 26 nt, Human
aagcaaaaaaaaaaaaaaaaaaagca

SEQ ID NO: 324949 - RNA, 19 nt, Human
aagccugggauguggaaga

SEQ ID NO: 324950 - RNA, 18 nt, Human
aaggaacuagguccuugg

SEQ ID NO: 324951 - RNA, 25 nt, Human
aauacaaaagaaauggaaaaggggc

SEQ ID NO: 324952 - RNA, 19 nt, Human
aaucauggcugcaggcagu

SEQ ID NO: 324953 - RNA, 21 nt, Human
acaaagcugcuccccaaagau

SEQ ID NO: 324954 - RNA, 21 nt, Human
acacacccggucagguccaaa

SEQ ID NO: 324955 - RNA, 24 nt, Human
acacacccggucagguccaaagcu

SEQ ID NO: 324956 - RNA, 21 nt, Human
acacauuccuggaaauuuaua

SEQ ID NO: 324957 - RNA, 18 nt, Human
acagagcuuuuaaagcag

SEQ ID NO: 324958 - RNA, 23 nt, Human
acaggccauucacauaacagcaa

SEQ ID NO: 324959 - RNA, 20 nt, Human
acauaccacaaaguauaccc

SEQ ID NO: 324960 - RNA, 23 nt, Human
acauggcauaucugugggucccc

SEQ ID NO: 324961 - RNA, 23 nt, Human
acauuuuuaaauuaaaauuuagc

SEQ ID NO: 324962 - RNA, 23 nt, Human
accaaugccuuugccccccacaa

SEQ ID NO: 324963 - RNA, 18 nt, Human
acccaaaucccaguuccc

SEQ ID NO: 324964 - RNA, 21 nt, Human
acccggucagguccaaagcua

SEQ ID NO: 324965 - RNA, 18 nt, Human
acuaacccccugcagugg

SEQ ID NO: 324966 - RNA, 26 nt, Human
acucaguccaugguuuuacacacacc

SEQ ID NO: 324967 - RNA, 20 nt, Human
agaaggaacuagguccuugg

SEQ ID NO: 324968 - RNA, 18 nt, Human
agagcccgggacacugag

SEQ ID NO: 324969 - RNA, 20 nt, Human
agaggaucuauaaaccagug

SEQ ID NO: 324970 - RNA, 20 nt, Human
agcagcagaagccugggaug

SEQ ID NO: 324971 - RNA, 22 nt, Human
agcagggggaaauggugagcca

SEQ ID NO: 324972 - RNA, 21 nt, Human
agcagucgggcaaagcacacc

SEQ ID NO: 324973 - RNA, 19 nt, Human
agggggaaauggugagcca

SEQ ID NO: 324974 - RNA, 18 nt, Human
agugcccaccacucgaac

SEQ ID NO: 324975 - RNA, 19 nt, Human
aguggagagccaaauugua

SEQ ID NO: 324976 - RNA, 23 nt, Human
aguggccucacaacuacuggagc

SEQ ID NO: 324977 - RNA, 20 nt, Human
aguggccuuggucugaaggc

SEQ ID NO: 324978 - RNA, 24 nt, Human
auacaaaagaaauggaaaaggggc

SEQ ID NO: 324979 - RNA, 24 nt, Human
aucaccccuuccucaccacaaccc

SEQ ID NO: 324980 - RNA, 18 nt, Human
auggggcaggugggugga

SEQ ID NO: 324981 - RNA, 20 nt, Human
auugcaauuagggcaugaga

SEQ ID NO: 324982 - RNA, 22 nt, Human
caaagagcugcacaugaauggc

SEQ ID NO: 324983 - RNA, 19 nt, Human
caaagcaagaagcaagggc

SEQ ID NO: 324984 - RNA, 22 nt, Human
caaagcacaccgcucuugacuc

SEQ ID NO: 324985 - RNA, 24 nt, Human
caaccccgcgaaacaaaagcuaua

SEQ ID NO: 324986 - RNA, 21 nt, Human
cacagaaaacaaauacaaaag

SEQ ID NO: 324987 - RNA, 18 nt, Human
caccacaaccccgcgaaa

SEQ ID NO: 324988 - RNA, 25 nt, Human
caccacgguggcaacuuccacggcc

SEQ ID NO: 324989 - RNA, 19 nt, Human
caccagugcugcugguagg

SEQ ID NO: 324990 - RNA, 23 nt, Human
caccaucgagugucugcugugac

SEQ ID NO: 324991 - RNA, 22 nt, Human
cacccaucacauuuaccaccau

SEQ ID NO: 324992 - RNA, 23 nt, Human
caccccuuccucaccacaacccc

SEQ ID NO: 324993 - RNA, 20 nt, Human
cacccggucagguccaaagc

SEQ ID NO: 324994 - RNA, 20 nt, Human
cacccuuucuuccuacuaag

SEQ ID NO: 324995 - RNA, 20 nt, Human
cagaagccugggauguggaa

SEQ ID NO: 324996 - RNA, 20 nt, Human
cagauggugagggugagggg

SEQ ID NO: 324997 - RNA, 19 nt, Human
cagcagcagaagccuggga

SEQ ID NO: 324998 - RNA, 22 nt, Human
caggaggggccuccucuaccaa

SEQ ID NO: 324999 - RNA, 27 nt, Human
caggcagucugcaaagcaagaagcaag

SEQ ID NO: 325000 - RNA, 24 nt, Human
cagucugcaaagcaagaagcaagg

SEQ ID NO: 325001 - RNA, 20 nt, Human
cagugcccaccacucgaacc

SEQ ID NO: 325002 - RNA, 23 nt, Human
cauaucugugggucccccugcaa

SEQ ID NO: 325003 - RNA, 22 nt, Human
caugcagaaaagagagagcgcc

SEQ ID NO: 325004 - RNA, 18 nt, Human
caugcagcuugggcagcc

SEQ ID NO: 325005 - RNA, 21 nt, Human
ccagcucagugcccaccacuc

SEQ ID NO: 325006 - RNA, 20 nt, Human
cccaggugcuugcaagcucc

SEQ ID NO: 325007 - RNA, 19 nt, Human
cccauggugacaaagagcu

SEQ ID NO: 325008 - RNA, 19 nt, Human
ccccaaagaugagaagcuu

SEQ ID NO: 325009 - RNA, 20 nt, Human
ccccuuccucaccacaaccc

SEQ ID NO: 325010 - RNA, 21 nt, Human
cccgcaggcucaggcucggcg

SEQ ID NO: 325011 - RNA, 23 nt, Human
cccgcgaaacaaaagcuauaaac

SEQ ID NO: 325012 - RNA, 21 nt, Human
cccggguggaaccugcccucg

SEQ ID NO: 325013 - RNA, 21 nt, Human
cccucugucacuccccucccg

SEQ ID NO: 325014 - RNA, 18 nt, Human
cccucuucugcuccuccu

SEQ ID NO: 325015 - RNA, 22 nt, Human
cccuucuuacugcccuggacag

SEQ ID NO: 325016 - RNA, 19 nt, Human
cccuucuuccucuguuguc

SEQ ID NO: 325017 - RNA, 19 nt, Human
cccuugguggggaaaacuc

SEQ ID NO: 325018 - RNA, 18 nt, Human
ccgcgcgcuggggcccac

SEQ ID NO: 325019 - RNA, 24 nt, Human
ccgugggaagaagagccgugugcu

SEQ ID NO: 325020 - RNA, 21 nt, Human
ccuacaagcugccucuucuga

SEQ ID NO: 325021 - RNA, 22 nt, Human
ccuccaacgcggaagcuggcuc

SEQ ID NO: 325022 - RNA, 21 nt, Human
ccucccacagcagcgccaggu

SEQ ID NO: 325023 - RNA, 22 nt, Human
ccucguccucuuccucuaguca

SEQ ID NO: 325024 - RNA, 18 nt, Human
ccucuagucacucaggcc

SEQ ID NO: 325025 - RNA, 23 nt, Human
ccucugucacuccccucccgggc

SEQ ID NO: 325026 - RNA, 22 nt, Human
ccugaacugcagcaucaguaug

SEQ ID NO: 325027 - RNA, 23 nt, Human
ccugcacuguguccucauaguuu

SEQ ID NO: 325028 - RNA, 21 nt, Human
ccugccaguugcccugcucgg

SEQ ID NO: 325029 - RNA, 20 nt, Human
ccugcucggcgauccacucg

SEQ ID NO: 325030 - RNA, 18 nt, Human
ccugggauuucucgcccc

SEQ ID NO: 325031 - RNA, 18 nt, Human
ccugugccaauaaaaucc

SEQ ID NO: 325032 - RNA, 20 nt, Human
ccuugcagcccuucuuacug

SEQ ID NO: 325033 - RNA, 21 nt, Human
cgaaacaaaagcuauaaacac

SEQ ID NO: 325034 - RNA, 18 nt, Human
cgaggcggaggcggcggu

SEQ ID NO: 325035 - RNA, 22 nt, Human
cgcgcgcuggggcccacgugca

SEQ ID NO: 325036 - RNA, 22 nt, Human
cgcgcuggggcccacgugcagg

SEQ ID NO: 325037 - RNA, 22 nt, Human
cgcucagcagcucucugaacac

SEQ ID NO: 325038 - RNA, 21 nt, Human
cggccuuuucuuggauuuccu

SEQ ID NO: 325039 - RNA, 24 nt, Human
cggcgggggccgcgcgcuggggcc

SEQ ID NO: 325040 - RNA, 18 nt, Human
cuaaaccccugaaaacag

SEQ ID NO: 325041 - RNA, 18 nt, Human
cucacagaaaacaaauac

SEQ ID NO: 325042 - RNA, 19 nt, Human
cuccacaaagcugcucccc

SEQ ID NO: 325043 - RNA, 24 nt, Human
cucccaggugcuugcaagcuccac

SEQ ID NO: 325044 - RNA, 25 nt, Human
cuccccuuccuugcagcccuucuua

SEQ ID NO: 325045 - RNA, 18 nt, Human
cucgccccuuccugccag

SEQ ID NO: 325046 - RNA, 22 nt, Human
cucugacccuccuggccccagc

SEQ ID NO: 325047 - RNA, 19 nt, Human
cugaaaaggucauagaaaa

SEQ ID NO: 325048 - RNA, 20 nt, Human
cugcaguugggaaaacacac

SEQ ID NO: 325049 - RNA, 20 nt, Human
cugugggggagcagggggaa

SEQ ID NO: 325050 - RNA, 18 nt, Human
cuuaaaaugaccugaagg

SEQ ID NO: 325051 - RNA, 22 nt, Human
cuugcaagcuccacaaagcugc

SEQ ID NO: 325052 - RNA, 21 nt, Human
gaaaacagggggugggguagg

SEQ ID NO: 325053 - RNA, 18 nt, Human
gaaccagggucgcugugg

SEQ ID NO: 325054 - RNA, 21 nt, Human
gagcagucgggcaaagcacac

SEQ ID NO: 325055 - RNA, 23 nt, Human
gagcccgggacacugagaggcgg

SEQ ID NO: 325056 - RNA, 21 nt, Human
gagccucagaaaacccuacug

SEQ ID NO: 325057 - RNA, 24 nt, Human
gaucaccacgguggcaacuuccac

SEQ ID NO: 325058 - RNA, 19 nt, Human
gaucucgccccucugcagc

SEQ ID NO: 325059 - RNA, 20 nt, Human
gaucucugucuacucuccua

SEQ ID NO: 325060 - RNA, 27 nt, Human
gcaaaacauaccacaaaguauaccccc

SEQ ID NO: 325061 - RNA, 24 nt, Human
gcacaacucauccggcccauggug

SEQ ID NO: 325062 - RNA, 28 nt, Human
gcagagaagcaaaaaaaaaaaaaaaaaa

SEQ ID NO: 325063 - RNA, 23 nt, Human
gcagcagcagaagccugggaugu

SEQ ID NO: 325064 - RNA, 22 nt, Human
gccaucaccccuuccucaccac

SEQ ID NO: 325065 - RNA, 24 nt, Human
gcccucgugggucagggcgaggac

SEQ ID NO: 325066 - RNA, 21 nt, Human
gcuccugguacagcugggcug

SEQ ID NO: 325067 - RNA, 19 nt, Human
gcuugggcagcccagugga

SEQ ID NO: 325068 - RNA, 21 nt, Human
ggaaaacucaaugggaaucug

SEQ ID NO: 325069 - RNA, 23 nt, Human
ggaaaaggggcagagaagcaaaa

SEQ ID NO: 325070 - RNA, 21 nt, Human
ggacauggggcaggugggugg

SEQ ID NO: 325071 - RNA, 21 nt, Human
ggaucucgccccucugcagcc

SEQ ID NO: 325072 - RNA, 19 nt, Human
ggcccgggccaaggaaagg

SEQ ID NO: 325073 - RNA, 19 nt, Human
gggcugggaaccccaccuc

SEQ ID NO: 325074 - RNA, 20 nt, Human
ggugagggggggaaagacac

SEQ ID NO: 325075 - RNA, 23 nt, Human
ggugggguagggucguaaaagcc

SEQ ID NO: 325076 - RNA, 19 nt, Human
guagcgcugcucguacccc

SEQ ID NO: 325077 - RNA, 22 nt, Human
guccaguuccuuuccuucagcc

SEQ ID NO: 325078 - RNA, 21 nt, Human
guccccauccuccccuuccuu

SEQ ID NO: 325079 - RNA, 20 nt, Human
guccccuugguggggaaaac

SEQ ID NO: 325080 - RNA, 19 nt, Human
gugcaccucccacagcagc

SEQ ID NO: 325081 - RNA, 21 nt, Human
gugcaugguccccuugguggg

SEQ ID NO: 325082 - RNA, 19 nt, Human
guggaggagaacuuaccca

SEQ ID NO: 325083 - RNA, 22 nt, Human
uaaaagccacaaauuagccuuc

SEQ ID NO: 325084 - RNA, 24 nt, Human
uaaaagccacaaauuagccuucgg

SEQ ID NO: 325085 - RNA, 22 nt, Human
uaaacacacacaagucagagga

SEQ ID NO: 325086 - RNA, 19 nt, Human
uaaaccccugaaaacaggg

SEQ ID NO: 325087 - RNA, 18 nt, Human
uaaagcagcagcagaagc

SEQ ID NO: 325088 - RNA, 20 nt, Human
uaaagcagcagcagaagccu

SEQ ID NO: 325089 - RNA, 23 nt, Human
uaagaagugcaauuccaccugug

SEQ ID NO: 325090 - RNA, 18 nt, Human
uacaaaagaaauggaaaa

SEQ ID NO: 325091 - RNA, 24 nt, Human
uacugggaugcuuccgaaaggcca

SEQ ID NO: 325092 - RNA, 27 nt, Human
uagcaguuaggauauguuaugacaugc

SEQ ID NO: 325093 - RNA, 23 nt, Human
uaguggccuuggucugaaggcug

SEQ ID NO: 325094 - RNA, 18 nt, Human
uaugaaaggaaaagguac

SEQ ID NO: 325095 - RNA, 23 nt, Human
ucacaccagugcugcugguagga

SEQ ID NO: 325096 - RNA, 20 nt, Human
ucaccacaaccccgcgaaac

SEQ ID NO: 325097 - RNA, 21 nt, Human
ucaccacauuaaaaauacaca

SEQ ID NO: 325098 - RNA, 25 nt, Human
ucaccccuuccucaccacaaccaaa

SEQ ID NO: 325099 - RNA, 20 nt, Human
ucacugaagauaaagaacuc

SEQ ID NO: 325100 - RNA, 21 nt, Human
ucagaaagugccgugggaaga

SEQ ID NO: 325101 - RNA, 19 nt, Human
ucagaacuugacaugcaga

SEQ ID NO: 325102 - RNA, 22 nt, Human
ucaggcucggcgggggccgcgc

SEQ ID NO: 325103 - RNA, 24 nt, Human
ucagugcccaccacucgaaccagg

SEQ ID NO: 325104 - RNA, 23 nt, Human
ucaguggagagccaaauuguaga

SEQ ID NO: 325105 - RNA, 20 nt, Human
ucauggcugcaggcagucug

SEQ ID NO: 325106 - RNA, 19 nt, Human
ucccaugaaacaucucaac

SEQ ID NO: 325107 - RNA, 23 nt, Human
uccccauccuccccuuccuugca

SEQ ID NO: 325108 - RNA, 21 nt, Human
ucccgcaggcucaggcucggc

SEQ ID NO: 325109 - RNA, 21 nt, Human
ucccucugucacuccccuccc

SEQ ID NO: 325110 - RNA, 21 nt, Human
ucccucuucugcuccuccugg

SEQ ID NO: 325111 - RNA, 22 nt, Human
uccuuguccccauccuccccuu

SEQ ID NO: 325112 - RNA, 22 nt, Human
ucgccccuuccugccagcccuc

SEQ ID NO: 325113 - RNA, 24 nt, Human
ucggccagcacuuuaaccugcacu

SEQ ID NO: 325114 - RNA, 23 nt, Human
ucucgccccucugcagccgcucc

SEQ ID NO: 325115 - RNA, 19 nt, Human
ucugcaaagcaagaagcaa

SEQ ID NO: 325116 - RNA, 18 nt, Human
ucugcugugacucagucc

SEQ ID NO: 325117 - RNA, 19 nt, Human
ucugcugugacucagucca

SEQ ID NO: 325118 - RNA, 21 nt, Human
ucugcugugacucaguccaug

SEQ ID NO: 325119 - RNA, 25 nt, Human
ucugugcuggggguugaacauuuca

SEQ ID NO: 325120 - RNA, 25 nt, Human
ugaaauaaaaaacaaauggugcauu

SEQ ID NO: 325121 - RNA, 21 nt, Human
ugaagucagucagucuugcaa

SEQ ID NO: 325122 - RNA, 21 nt, Human
ugacaaaaucauggcugcagg

SEQ ID NO: 325123 - RNA, 24 nt, Human
ugaccaaugccuuugccccccaca

SEQ ID NO: 325124 - RNA, 28 nt, Human
ugcagaaaagagagagcgccaagucccc

SEQ ID NO: 325125 - RNA, 20 nt, Human
ugcagcggcgaggcggaggc

SEQ ID NO: 325126 - RNA, 22 nt, Human
ugccaaaaaggcucagucuuug

SEQ ID NO: 325127 - RNA, 19 nt, Human
ugccacacuuaaaaagaaa

SEQ ID NO: 325128 - RNA, 20 nt, Human
ugcccugggauuucucgccc

SEQ ID NO: 325129 - RNA, 22 nt, Human
ugccuuaacaacuccagcccug

SEQ ID NO: 325130 - RNA, 21 nt, Human
uggcaucugugcuggggguug

SEQ ID NO: 325131 - RNA, 22 nt, Human
uggccgggccgcggugcaccuc

SEQ ID NO: 325132 - RNA, 19 nt, Human
uggcugcaggcagucugca

SEQ ID NO: 325133 - RNA, 20 nt, Human
ugggauguggaagaucucug

SEQ ID NO: 325134 - RNA, 19 nt, Human
ugggcacagcugcucgcag

SEQ ID NO: 325135 - RNA, 21 nt, Human
ugggguagggucguaaaagcc

SEQ ID NO: 325136 - RNA, 19 nt, Human
uuagccuucggcacagguc

SEQ ID NO: 325137 - RNA, 20 nt, Human
uuaggcucuuucuggggcua

SEQ ID NO: 325138 - RNA, 21 nt, Human
uuccagggcugccauuucagu

SEQ ID NO: 325139 - RNA, 27 nt, Human
uucccaccacaggcccgggccaaggaa

SEQ ID NO: 325140 - RNA, 21 nt, Human
uuccugccagcccucagguga

SEQ ID NO: 325141 - RNA, 20 nt, Human
uucuucauauucauucuuaa

SEQ ID NO: 325142 - RNA, 22 nt, Human
uugacucugcucuacaggccau

SEQ ID NO: 325143 - RNA, 21 nt, Human
uugcagcccuucuuacugccc

SEQ ID NO: 325144 - RNA, 19 nt, Human
uuuuccccuuuggaagaga

SEQ ID NO: 325145 - RNA, 20 nt, Human
aacagcagcugaucggcccc

SEQ ID NO: 325146 - RNA, 22 nt, Human
agccagcagcgacugcccugcc

SEQ ID NO: 325147 - RNA, 19 nt, Human
agggccauccccuggggac

SEQ ID NO: 325148 - RNA, 21 nt, Human
agguggaaugucucaggcccu

SEQ ID NO: 325149 - RNA, 23 nt, Human
cagagcagaccugacuguacaga

SEQ ID NO: 325150 - RNA, 21 nt, Human
ccaagccuggugggggaccag

SEQ ID NO: 325151 - RNA, 22 nt, Human
cccagaccagagcagaccugac

SEQ ID NO: 325152 - RNA, 21 nt, Human
ccccagaguuugggggccaag

SEQ ID NO: 325153 - RNA, 23 nt, Human
ccgaagacagggcagagaucaca

SEQ ID NO: 325154 - RNA, 24 nt, Human
ccgcagccaucagccaugucccug

SEQ ID NO: 325155 - RNA, 23 nt, Human
ccucacucucuucccagagccag

SEQ ID NO: 325156 - RNA, 25 nt, Human
ccucccguugccccuuugggaugcc

SEQ ID NO: 325157 - RNA, 23 nt, Human
cuuuuccaauaacugugguuuuu

SEQ ID NO: 325158 - RNA, 27 nt, Human
gagccagcacccagaccagagcagacc

SEQ ID NO: 325159 - RNA, 22 nt, Human
gagggccauccccuggggacca

SEQ ID NO: 325160 - RNA, 26 nt, Human
gaucacagggucagcuugaccggugg

SEQ ID NO: 325161 - RNA, 21 nt, Human
gcagcagccuccccuuccucc

SEQ ID NO: 325162 - RNA, 19 nt, Human
gccccagaguuugggggcc

SEQ ID NO: 325163 - RNA, 18 nt, Human
gcuggcucuuggaguggc

SEQ ID NO: 325164 - RNA, 22 nt, Human
gggaauccagggccagagcagg

SEQ ID NO: 325165 - RNA, 20 nt, Human
gggcagagaucacaggguca

SEQ ID NO: 325166 - RNA, 22 nt, Human
gggcagagaucacagggucagc

SEQ ID NO: 325167 - RNA, 18 nt, Human
guggaaugucucaggccc

SEQ ID NO: 325168 - RNA, 18 nt, Human
guggaaugucucaggccc

SEQ ID NO: 325169 - RNA, 19 nt, Human
guggaaugucucaggcccu

SEQ ID NO: 325170 - RNA, 21 nt, Human
uaaacguuuccucugucccuc

SEQ ID NO: 325171 - RNA, 22 nt, Human
uccagggccagagcaggucggc

SEQ ID NO: 325172 - RNA, 20 nt, Human
uccccuggggacuuggggug

SEQ ID NO: 325173 - RNA, 18 nt, Human
ucccucacucucuuccca

SEQ ID NO: 325174 - RNA, 23 nt, Human
uccgcagccaucagccauguccc

SEQ ID NO: 325175 - RNA, 24 nt, Human
ucuccagucuugcccaggcucucc

SEQ ID NO: 325176 - RNA, 22 nt, Human
ugcccugccgcaggagaaacag

SEQ ID NO: 325177 - RNA, 22 nt, Human
uggcuugguagagggggagggc

SEQ ID NO: 325178 - RNA, 23 nt, Human
ugggcucuccagucuugcccagg

SEQ ID NO: 325179 - RNA, 21 nt, Human
uguggagcagaaagggggcug

SEQ ID NO: 325180 - RNA, 20 nt, Human
uuccucugucccucacucuc

SEQ ID NO: 325181 - RNA, 18 nt, Human
uuuuguggagcagaaagg

SEQ ID NO: 325182 - RNA, 19 nt, Human
aaaaauccaaaaauuagcc

SEQ ID NO: 325183 - RNA, 18 nt, Human
aaaaucaguugggcgugg

SEQ ID NO: 325184 - RNA, 19 nt, Human
aaacaaaacacgucugcag

SEQ ID NO: 325185 - RNA, 19 nt, Human
aaagugcugggauuacagg

SEQ ID NO: 325186 - RNA, 21 nt, Human
aaagugcugggauuacaggca

SEQ ID NO: 325187 - RNA, 22 nt, Human
aaagugcugggauuacaggcaa

SEQ ID NO: 325188 - RNA, 22 nt, Human
aacaaaacacgucugcagacug

SEQ ID NO: 325189 - RNA, 20 nt, Human
aacauggggaaaccccgucu

SEQ ID NO: 325190 - RNA, 21 nt, Human
aacauggggaaaccccgucuc

SEQ ID NO: 325191 - RNA, 19 nt, Human
aagcaauucuggugccuca

SEQ ID NO: 325192 - RNA, 18 nt, Human
aagugcugggauuacagg

SEQ ID NO: 325193 - RNA, 19 nt, Human
aagugcugggauuacaggc

SEQ ID NO: 325194 - RNA, 22 nt, Human
aaguuuaggugccucuggcucu

SEQ ID NO: 325195 - RNA, 19 nt, Human
aauacggugaaaucccauc

SEQ ID NO: 325196 - RNA, 18 nt, Human
aauagcugggauuacagg

SEQ ID NO: 325197 - RNA, 21 nt, Human
aaucacgaggucaggaguucg

SEQ ID NO: 325198 - RNA, 22 nt, Human
aaucacgaggucaggaguucga

SEQ ID NO: 325199 - RNA, 24 nt, Human
aaucacgaggucaggaguucgaga

SEQ ID NO: 325200 - RNA, 23 nt, Human
accaauuagcugguccccaccac

SEQ ID NO: 325201 - RNA, 24 nt, Human
accccgucucuacuaaaaauacaa

SEQ ID NO: 325202 - RNA, 23 nt, Human
accucggccucccaaagugcugg

SEQ ID NO: 325203 - RNA, 18 nt, Human
acgggguuucgccauguu

SEQ ID NO: 325204 - RNA, 23 nt, Human
acgggguuucgccauguuggcca

SEQ ID NO: 325205 - RNA, 24 nt, Human
acgggguuucgccauguuggccag

SEQ ID NO: 325206 - RNA, 18 nt, Human
acggugaaaucccaucuc

SEQ ID NO: 325207 - RNA, 20 nt, Human
acggugaaaucccaucucua

SEQ ID NO: 325208 - RNA, 24 nt, Human
acugcacucuagccugggcagcag

SEQ ID NO: 325209 - RNA, 26 nt, Human
acugcacucuagccugggcagcagag

SEQ ID NO: 325210 - RNA, 20 nt, Human
acuggaucgugaucacaguu

SEQ ID NO: 325211 - RNA, 23 nt, Human
agagcuugcagugagccgagauc

SEQ ID NO: 325212 - RNA, 23 nt, Human
agcacuuugggaggcccaggcag

SEQ ID NO: 325213 - RNA, 24 nt, Human
agcacuuugggaggccgaggcggg

SEQ ID NO: 325214 - RNA, 23 nt, Human
agcagggaagugguaaugcuagc

SEQ ID NO: 325215 - RNA, 21 nt, Human
agcauggagcccccuucccca

SEQ ID NO: 325216 - RNA, 23 nt, Human
agccgggugugguggcgggugcc

SEQ ID NO: 325217 - RNA, 18 nt, Human
agccuccugaauagcugg

SEQ ID NO: 325218 - RNA, 24 nt, Human
agccugggcagcagagcgagacuc

SEQ ID NO: 325219 - RNA, 28 nt, Human
agcuauguggccccaggcaagucaccuc

SEQ ID NO: 325220 - RNA, 19 nt, Human
agcucucagccuuggccac

SEQ ID NO: 325221 - RNA, 19 nt, Human
agcugggaggcuggggcag

SEQ ID NO: 325222 - RNA, 18 nt, Human
aggaggcggcaguggggg

SEQ ID NO: 325223 - RNA, 20 nt, Human
aggaguugcucauccagcau

SEQ ID NO: 325224 - RNA, 24 nt, Human
aggcaaaucacgaggucaggaguu

SEQ ID NO: 325225 - RNA, 21 nt, Human
aggcagagcuugcagugagcc

SEQ ID NO: 325226 - RNA, 24 nt, Human
aggcagagcuugcagugagccgag

SEQ ID NO: 325227 - RNA, 18 nt, Human
aggcaggagaauggugug

SEQ ID NO: 325228 - RNA, 21 nt, Human
aggcaggagaauggugugaac

SEQ ID NO: 325229 - RNA, 22 nt, Human
aggcaggcaaaucacgagguca

SEQ ID NO: 325230 - RNA, 24 nt, Human
aggcaggcaaaucacgaggucagg

SEQ ID NO: 325231 - RNA, 24 nt, Human
aggcgggcagaucacgagcucagg

SEQ ID NO: 325232 - RNA, 19 nt, Human
aggcugaggcaggagaaug

SEQ ID NO: 325233 - RNA, 18 nt, Human
agggaagcagaucuucua

SEQ ID NO: 325234 - RNA, 22 nt, Human
agguagcuaacccacucaucuc

SEQ ID NO: 325235 - RNA, 24 nt, Human
agguggagguuguggugagcugag

SEQ ID NO: 325236 - RNA, 21 nt, Human
agugccguggcgcagucucag

SEQ ID NO: 325237 - RNA, 18 nt, Human
agugcugggauuacaggc

SEQ ID NO: 325238 - RNA, 23 nt, Human
aguugggcgugguggugugcgcc

SEQ ID NO: 325239 - RNA, 21 nt, Human
auaagcgugaaacuccgucuc

SEQ ID NO: 325240 - RNA, 24 nt, Human
aucacgccacugcacucuagccug

SEQ ID NO: 325241 - RNA, 24 nt, Human
aucgugccauugcacuccagccug

SEQ ID NO: 325242 - RNA, 19 nt, Human
augccuguaauccuagcac

SEQ ID NO: 325243 - RNA, 25 nt, Human
auggagcccccuuccccagcgaauu

SEQ ID NO: 325244 - RNA, 18 nt, Human
auguacccaaguuuaggu

SEQ ID NO: 325245 - RNA, 24 nt, Human
auugcacuccagccugggcaauaa

SEQ ID NO: 325246 - RNA, 25 nt, Human
auugcacuccagccugggcaauaag

SEQ ID NO: 325247 - RNA, 19 nt, Human
caaaggacauccugagugg

SEQ ID NO: 325248 - RNA, 24 nt, Human
caacauggggaaaccccgucucua

SEQ ID NO: 325249 - RNA, 23 nt, Human
caaccuccaccuccuggguucaa

SEQ ID NO: 325250 - RNA, 24 nt, Human
caagaccauccuggcuaauacggu

SEQ ID NO: 325251 - RNA, 22 nt, Human
caaggcauaacaaucacugcua

SEQ ID NO: 325252 - RNA, 20 nt, Human
cacacagaaagcugggaggc

SEQ ID NO: 325253 - RNA, 24 nt, Human
cacaccuguaaucccagcacuuug

SEQ ID NO: 325254 - RNA, 20 nt, Human
cacagcgucucucugggaau

SEQ ID NO: 325255 - RNA, 19 nt, Human
caccuguaaucccagcacu

SEQ ID NO: 325256 - RNA, 24 nt, Human
caccuguaaucccagcacuuuggg

SEQ ID NO: 325257 - RNA, 19 nt, Human
cacgucugcagacuggauc

SEQ ID NO: 325258 - RNA, 24 nt, Human
cacucaucucucccucuuuucuuu

SEQ ID NO: 325259 - RNA, 22 nt, Human
cacuccagccugggcaauaagc

SEQ ID NO: 325260 - RNA, 23 nt, Human
cacuccagccugggcaauaagcg

SEQ ID NO: 325261 - RNA, 21 nt, Human
cacugcaaccuccaccuccug

SEQ ID NO: 325262 - RNA, 23 nt, Human
cacugcaaccuccaccuccuggg

SEQ ID NO: 325263 - RNA, 18 nt, Human
cacugcacucuagccugg

SEQ ID NO: 325264 - RNA, 19 nt, Human
cacugcacucuagccuggg

SEQ ID NO: 325265 - RNA, 23 nt, Human
cacugcacucuagccugggcagc

SEQ ID NO: 325266 - RNA, 24 nt, Human
cacugcacucuagccugggcagca

SEQ ID NO: 325267 - RNA, 24 nt, Human
cagaaagcugggaggcuggggcag

SEQ ID NO: 325268 - RNA, 21 nt, Human
cagacaaagccugauuuugga

SEQ ID NO: 325269 - RNA, 24 nt, Human
cagagucuugcucugucgcccagg

SEQ ID NO: 325270 - RNA, 24 nt, Human
cagcacuuugggaggccgaggcgg

SEQ ID NO: 325271 - RNA, 24 nt, Human
cagccugaccaacauggggaaacc

SEQ ID NO: 325272 - RNA, 24 nt, Human
cagcuacucaggaggcugaggcag

SEQ ID NO: 325273 - RNA, 21 nt, Human
caggagguggagguuguggug

SEQ ID NO: 325274 - RNA, 24 nt, Human
caggagguggagguuguggugagc

SEQ ID NO: 325275 - RNA, 22 nt, Human
caggcaaaucacgaggucagga

SEQ ID NO: 325276 - RNA, 22 nt, Human
caggcaagucaccucaccucuc

SEQ ID NO: 325277 - RNA, 22 nt, Human
caggcugggcagaggcgagcac

SEQ ID NO: 325278 - RNA, 24 nt, Human
cagggaagcagaucuucuaaggga

SEQ ID NO: 325279 - RNA, 19 nt, Human
caguaaaucugccugcaga

SEQ ID NO: 325280 - RNA, 24 nt, Human
cauccagcauuugcuccugggaca

SEQ ID NO: 325281 - RNA, 20 nt, Human
caugccuguaauccuagcac

SEQ ID NO: 325282 - RNA, 24 nt, Human
caugccuguaauccuagcacuuug

SEQ ID NO: 325283 - RNA, 24 nt, Human
cauguuggccaggcuggucuugaa

SEQ ID NO: 325284 - RNA, 18 nt, Human
cauugcacuccagccugg

SEQ ID NO: 325285 - RNA, 19 nt, Human
cauugcacuccagccuggg

SEQ ID NO: 325286 - RNA, 21 nt, Human
cauugcacuccagccugggca

SEQ ID NO: 325287 - RNA, 24 nt, Human
cauugcacuccagccugggcaaua

SEQ ID NO: 325288 - RNA, 19 nt, Human
ccaaagugcugggauuaca

SEQ ID NO: 325289 - RNA, 23 nt, Human
ccaaagugcugggauuacaggca

SEQ ID NO: 325290 - RNA, 20 nt, Human
ccacaccagcauggagcccc

SEQ ID NO: 325291 - RNA, 20 nt, Human
ccacugcacucuagccuggg

SEQ ID NO: 325292 - RNA, 20 nt, Human
ccacugcacucuagccuggg

SEQ ID NO: 325293 - RNA, 21 nt, Human
ccacugcacucuagccugggc

SEQ ID NO: 325294 - RNA, 22 nt, Human
ccacugcacucuagccugggca

SEQ ID NO: 325295 - RNA, 22 nt, Human
ccacugcacucuagccugggca

SEQ ID NO: 325296 - RNA, 22 nt, Human
ccacugcacucuagccugggca

SEQ ID NO: 325297 - RNA, 23 nt, Human
ccacugcacucuagccugggcag

SEQ ID NO: 325298 - RNA, 24 nt, Human
ccacugcacucuagccugggcagc

SEQ ID NO: 325299 - RNA, 22 nt, Human
ccaggagguggagguuguggug

SEQ ID NO: 325300 - RNA, 18 nt, Human
ccaggcaagucaccucac

SEQ ID NO: 325301 - RNA, 19 nt, Human
ccauguuggccaggcuggu

SEQ ID NO: 325302 - RNA, 21 nt, Human
ccauguuggccaggcuggucu

SEQ ID NO: 325303 - RNA, 18 nt, Human
ccauugcacuccagccug

SEQ ID NO: 325304 - RNA, 20 nt, Human
ccauugcacuccagccuggg

SEQ ID NO: 325305 - RNA, 21 nt, Human
ccauugcacuccagccugggc

SEQ ID NO: 325306 - RNA, 23 nt, Human
ccauugcacuccagccugggcaa

SEQ ID NO: 325307 - RNA, 24 nt, Human
ccauugcacuccagccugggcaau

SEQ ID NO: 325308 - RNA, 23 nt, Human
cccaaagaacaggaguugcucau

SEQ ID NO: 325309 - RNA, 24 nt, Human
cccaaagugcugggauuacaggca

SEQ ID NO: 325310 - RNA, 18 nt, Human
cccaggagguggagguug

SEQ ID NO: 325311 - RNA, 22 nt, Human
cccagggaagcccccaaacccc

SEQ ID NO: 325312 - RNA, 21 nt, Human
cccaucucuacuaaaaaucca

SEQ ID NO: 325313 - RNA, 24 nt, Human
cccgaccucaagugauccgcccac

SEQ ID NO: 325314 - RNA, 21 nt, Human
cccuggagaaggucagggaga

SEQ ID NO: 325315 - RNA, 19 nt, Human
ccuccaccuccuggguuca

SEQ ID NO: 325316 - RNA, 22 nt, Human
ccuccuggguucaagcaauucu

SEQ ID NO: 325317 - RNA, 20 nt, Human
ccucuggcucugucagcucc

SEQ ID NO: 325318 - RNA, 21 nt, Human
ccugaagucgagaagaauugu

SEQ ID NO: 325319 - RNA, 23 nt, Human
ccugaauagcugggauuacaggc

SEQ ID NO: 325320 - RNA, 24 nt, Human
ccugaauagcugggauuacaggca

SEQ ID NO: 325321 - RNA, 23 nt, Human
ccugaccaacauggggaaacccc

SEQ ID NO: 325322 - RNA, 24 nt, Human
ccugaccaacauggggaaaccccg

SEQ ID NO: 325323 - RNA, 24 nt, Human
ccuggcuaauacggugaaauccca

SEQ ID NO: 325324 - RNA, 22 nt, Human
ccugggcagcagagcgagacuc

SEQ ID NO: 325325 - RNA, 18 nt, Human
ccuggggauauccugccu

SEQ ID NO: 325326 - RNA, 19 nt, Human
ccuggguucaagcaauucu

SEQ ID NO: 325327 - RNA, 21 nt, Human
ccuguaaucucagcuacuugg

SEQ ID NO: 325328 - RNA, 22 nt, Human
ccuguaaucucagcuacuuggg

SEQ ID NO: 325329 - RNA, 19 nt, Human
ccuguagucccagcuacuc

SEQ ID NO: 325330 - RNA, 21 nt, Human
ccuguagucccagcuacucag

SEQ ID NO: 325331 - RNA, 22 nt, Human
ccuguagucccagcuacucagg

SEQ ID NO: 325332 - RNA, 21 nt, Human
ccuuccauagcuauuucugcc

SEQ ID NO: 325333 - RNA, 18 nt, Human
cgaccucaagugauccgc

SEQ ID NO: 325334 - RNA, 24 nt, Human
cgaggcgggcagaucacgagcuca

SEQ ID NO: 325335 - RNA, 24 nt, Human
cgccauguuggccaggcuggucuu

SEQ ID NO: 325336 - RNA, 27 nt, Human
cgccauguuggccaggcuggucuugaa

SEQ ID NO: 325337 - RNA, 21 nt, Human
cgccuguaaucucagcuacuu

SEQ ID NO: 325338 - RNA, 23 nt, Human
cgccuguaaucucagcuacuugg

SEQ ID NO: 325339 - RNA, 24 nt, Human
cgccuguaaucucagcuacuuggg

SEQ ID NO: 325340 - RNA, 24 nt, Human
cggcagugggggucacccaggcgu

SEQ ID NO: 325341 - RNA, 22 nt, Human
cggcugccacucagcucuggcc

SEQ ID NO: 325342 - RNA, 24 nt, Human
cggcuugcuuccuucccuucccag

SEQ ID NO: 325343 - RNA, 22 nt, Human
cgggcagaucacgagcucagga

SEQ ID NO: 325344 - RNA, 24 nt, Human
cgggguuucgccauguuggccagg

SEQ ID NO: 325345 - RNA, 20 nt, Human
cuagcacuuugggaggccca

SEQ ID NO: 325346 - RNA, 23 nt, Human
cuagccucugggacauucagagg

SEQ ID NO: 325347 - RNA, 19 nt, Human
cuaguuuaaggauuauugg

SEQ ID NO: 325348 - RNA, 24 nt, Human
cucaagugauccgcccaccucggc

SEQ ID NO: 325349 - RNA, 22 nt, Human
cucacaccuguaaucccagcac

SEQ ID NO: 325350 - RNA, 24 nt, Human
cucacaccuguaaucccagcacuu

SEQ ID NO: 325351 - RNA, 24 nt, Human
cucaugccuguaauccuagcacuu

SEQ ID NO: 325352 - RNA, 19 nt, Human
cuccaucucaaaaaaaaaa

SEQ ID NO: 325353 - RNA, 19 nt, Human
cuccgucucaaaaaaaaaa

SEQ ID NO: 325354 - RNA, 24 nt, Human
cuccugaauagcugggauuacagg

SEQ ID NO: 325355 - RNA, 21 nt, Human
cuccuggguucaagcaauucu

SEQ ID NO: 325356 - RNA, 19 nt, Human
cucugucagcuccugaagu

SEQ ID NO: 325357 - RNA, 20 nt, Human
cugagcuuaaaaagaaagaa

SEQ ID NO: 325358 - RNA, 28 nt, Human
cugaggcccagggaagcccccaaacccc

SEQ ID NO: 325359 - RNA, 24 nt, Human
cugaguggccuuucuguggccagc

SEQ ID NO: 325360 - RNA, 18 nt, Human
cugcaaccuccaccuccu

SEQ ID NO: 325361 - RNA, 23 nt, Human
cugcaaccuccaccuccuggguu

SEQ ID NO: 325362 - RNA, 22 nt, Human
cugccuccugccaaucacagcg

SEQ ID NO: 325363 - RNA, 24 nt, Human
cugggcaauaagcgugaaacuccg

SEQ ID NO: 325364 - RNA, 22 nt, Human
cuggugccucagccuccugaau

SEQ ID NO: 325365 - RNA, 19 nt, Human
cugucccuggagaagguca

SEQ ID NO: 325366 - RNA, 19 nt, Human
cugucgcccaggcuggagu

SEQ ID NO: 325367 - RNA, 21 nt, Human
cuucuuuuuuggcuugaucag

SEQ ID NO: 325368 - RNA, 19 nt, Human
cuugcagugagccgagauc

SEQ ID NO: 325369 - RNA, 22 nt, Human
gaaaauagaaucuuuauuaaaa

SEQ ID NO: 325370 - RNA, 24 nt, Human
gaauagcugggauuacaggcacgc

SEQ ID NO: 325371 - RNA, 19 nt, Human
gacaguaaaucugccugca

SEQ ID NO: 325372 - RNA, 24 nt, Human
gaccucaagugauccgcccaccuc

SEQ ID NO: 325373 - RNA, 21 nt, Human
gagaaaagcagggaagugguu

SEQ ID NO: 325374 - RNA, 22 nt, Human
gagaccagccugaccaacaugg

SEQ ID NO: 325375 - RNA, 24 nt, Human
gagacgggguuucgccauguuggc

SEQ ID NO: 325376 - RNA, 20 nt, Human
gagaucacgccacugcacuc

SEQ ID NO: 325377 - RNA, 23 nt, Human
gagaucgugccauugcacuccag

SEQ ID NO: 325378 - RNA, 19 nt, Human
gagcaauggggcaaucugg

SEQ ID NO: 325379 - RNA, 18 nt, Human
gagcuugcagugagccga

SEQ ID NO: 325380 - RNA, 22 nt, Human
gaggcugaggcccagggaagcc

SEQ ID NO: 325381 - RNA, 19 nt, Human
gaggugagaguaacgaggu

SEQ ID NO: 325382 - RNA, 19 nt, Human
gauauccugccuccugcca

SEQ ID NO: 325383 - RNA, 22 nt, Human
gcaaccuccaccuccuggguuc

SEQ ID NO: 325384 - RNA, 22 nt, Human
gcagaagcauugcuuaaaccca

SEQ ID NO: 325385 - RNA, 24 nt, Human
gcagagcgagacuccaucucaaaa

SEQ ID NO: 325386 - RNA, 24 nt, Human
gccacugcacucuagccugggcag

SEQ ID NO: 325387 - RNA, 24 nt, Human
gccauguuggccaggcuggucuug

SEQ ID NO: 325388 - RNA, 22 nt, Human
gccauugcacuccagccugggc

SEQ ID NO: 325389 - RNA, 24 nt, Human
gccauugcacuccagccugggcaa

SEQ ID NO: 325390 - RNA, 26 nt, Human
gcccagcacaccaggguugcagccug

SEQ ID NO: 325391 - RNA, 20 nt, Human
gcccaggcuggagugccgug

SEQ ID NO: 325392 - RNA, 20 nt, Human
gccgagaucacgccacugca

SEQ ID NO: 325393 - RNA, 22 nt, Human
gccgggcaugguggcucaugcc

SEQ ID NO: 325394 - RNA, 21 nt, Human
gccguggcgcagucucaguuc

SEQ ID NO: 325395 - RNA, 24 nt, Human
gcuaauacggugaaaucccaucuc

SEQ ID NO: 325396 - RNA, 22 nt, Human
gcucaggagaucaagaccaucc

SEQ ID NO: 325397 - RNA, 27 nt, Human
gcucugucgcccaggcuggagugccgu

SEQ ID NO: 325398 - RNA, 20 nt, Human
gcuggggcaggcuggggcag

SEQ ID NO: 325399 - RNA, 23 nt, Human
gcuggucuugaacucccgaccuc

SEQ ID NO: 325400 - RNA, 23 nt, Human
ggaaaaaaaguucauuuuaaaaa

SEQ ID NO: 325401 - RNA, 18 nt, Human
ggaagugguaaugcuagc

SEQ ID NO: 325402 - RNA, 21 nt, Human
ggacugacugcugaaugacau

SEQ ID NO: 325403 - RNA, 22 nt, Human
ggagguuguggugagcugagau

SEQ ID NO: 325404 - RNA, 24 nt, Human
ggagguuguggugagcugagaucg

SEQ ID NO: 325405 - RNA, 21 nt, Human
ggcagaucacgagcucaggag

SEQ ID NO: 325406 - RNA, 19 nt, Human
ggcaggcugggcagaggcg

SEQ ID NO: 325407 - RNA, 18 nt, Human
ggcaggcuggggcaggcu

SEQ ID NO: 325408 - RNA, 23 nt, Human
ggcaugguggcucaugccuguaa

SEQ ID NO: 325409 - RNA, 23 nt, Human
ggccgggcaugguggcucaugcc

SEQ ID NO: 325410 - RNA, 23 nt, Human
ggcgcgguggcucacaccuguaa

SEQ ID NO: 325411 - RNA, 19 nt, Human
ggcgugaagauggguuucc

SEQ ID NO: 325412 - RNA, 23 nt, Human
ggcgugguggugugcgccuguaa

SEQ ID NO: 325413 - RNA, 18 nt, Human
ggcucaugccuguaaucc

SEQ ID NO: 325414 - RNA, 21 nt, Human
ggcugggcgcgguggcucaca

SEQ ID NO: 325415 - RNA, 21 nt, Human
ggcuggggcaggcuggggcag

SEQ ID NO: 325416 - RNA, 24 nt, Human
ggcuggucuugaacucccgaccuc

SEQ ID NO: 325417 - RNA, 21 nt, Human
gggaaaccccgucucuacuaa

SEQ ID NO: 325418 - RNA, 18 nt, Human
gggaaugugagcccagug

SEQ ID NO: 325419 - RNA, 23 nt, Human
gggcaaaggcaaauuuucaucac

SEQ ID NO: 325420 - RNA, 21 nt, Human
gggcagaggcgagcacgugga

SEQ ID NO: 325421 - RNA, 19 nt, Human
gggcagaucacgagcucag

SEQ ID NO: 325422 - RNA, 22 nt, Human
ggggcuggcggggcuggcgggg

SEQ ID NO: 325423 - RNA, 22 nt, Human
ggggcuggcggggcuggcgggg

SEQ ID NO: 325424 - RNA, 23 nt, Human
gggggccacuggugggaggagau

SEQ ID NO: 325425 - RNA, 23 nt, Human
gggguuucgccauguuggccagg

SEQ ID NO: 325426 - RNA, 24 nt, Human
gggucacccaggcgugaagauggg

SEQ ID NO: 325427 - RNA, 23 nt, Human
gguggcucacaccuguaauccca

SEQ ID NO: 325428 - RNA, 24 nt, Human
gguggcucacaccuguaaucccag

SEQ ID NO: 325429 - RNA, 24 nt, Human
gguggcucaugccuguaauccuag

SEQ ID NO: 325430 - RNA, 24 nt, Human
gguggugugcgccuguaaucucag

SEQ ID NO: 325431 - RNA, 23 nt, Human
guagagacgggguuucgccaugu

SEQ ID NO: 325432 - RNA, 23 nt, Human
gucagaacccuggugaagccgag

SEQ ID NO: 325433 - RNA, 24 nt, Human
gugauccgcccaccucggccuccc

SEQ ID NO: 325434 - RNA, 22 nt, Human
gugccucagccuccugaauagc

SEQ ID NO: 325435 - RNA, 20 nt, Human
guggagguuguggugagcug

SEQ ID NO: 325436 - RNA, 23 nt, Human
guggugugcgccuguaaucucag

SEQ ID NO: 325437 - RNA, 24 nt, Human
guggugugcgccuguaaucucagc

SEQ ID NO: 325438 - RNA, 22 nt, Human
uaauacggugaaaucccaucuc

SEQ ID NO: 325439 - RNA, 21 nt, Human
uaauccauagagcuuucaaug

SEQ ID NO: 325440 - RNA, 23 nt, Human
uaauuuuuuuauguuuaguagag

SEQ ID NO: 325441 - RNA, 24 nt, Human
uaauuuuuuuauguuuaguagaga

SEQ ID NO: 325442 - RNA, 22 nt, Human
uagagacgggguuucgccaugu

SEQ ID NO: 325443 - RNA, 21 nt, Human
uagcacuuugggaggcccagg

SEQ ID NO: 325444 - RNA, 21 nt, Human
uagcuaacccacucaucucuc

SEQ ID NO: 325445 - RNA, 23 nt, Human
uagcuuuucccuccccuggaccc

SEQ ID NO: 325446 - RNA, 24 nt, Human
uaguagagacgggguuucgccaug

SEQ ID NO: 325447 - RNA, 22 nt, Human
uauuaaaauagcaaggcauaac

SEQ ID NO: 325448 - RNA, 22 nt, Human
uauuucauucuugccacugagc

SEQ ID NO: 325449 - RNA, 23 nt, Human
ucaaaaaaaaaaaaaaaaaaaga

SEQ ID NO: 325450 - RNA, 24 nt, Human
ucacgagcucaggagaucaagacc

SEQ ID NO: 325451 - RNA, 18 nt, Human
ucacgaggucaggaguuc

SEQ ID NO: 325452 - RNA, 24 nt, Human
ucacgaggucaggaguucgagacc

SEQ ID NO: 325453 - RNA, 22 nt, Human
ucacgaggugagaguaacgagg

SEQ ID NO: 325454 - RNA, 23 nt, Human
ucacugcaaccuccaccuccugg

SEQ ID NO: 325455 - RNA, 23 nt, Human
ucacugcaaccuccaccuccugg

SEQ ID NO: 325456 - RNA, 24 nt, Human
ucacugcaaccuccaccuccuggg

SEQ ID NO: 325457 - RNA, 25 nt, Human
ucacugcaaccuccaccuccugggu

SEQ ID NO: 325458 - RNA, 27 nt, Human
ucacugcaaccuccaccuccuggguuc

SEQ ID NO: 325459 - RNA, 22 nt, Human
ucaguugggcgugguggugugc

SEQ ID NO: 325460 - RNA, 24 nt, Human
ucaguugggcgugguggugugcgc

SEQ ID NO: 325461 - RNA, 24 nt, Human
uccaaggaggugcgaccuuuaaag

SEQ ID NO: 325462 - RNA, 23 nt, Human
uccaucucaaaaaaaaaaaaaaa

SEQ ID NO: 325463 - RNA, 23 nt, Human
uccaucuggagaacaggcaggua

SEQ ID NO: 325464 - RNA, 24 nt, Human
ucccaaagugcugggauuacaggc

SEQ ID NO: 325465 - RNA, 18 nt, Human
ucccacuggaggcugcca

SEQ ID NO: 325466 - RNA, 19 nt, Human
ucccaucucuacuaaaaau

SEQ ID NO: 325467 - RNA, 18 nt, Human
ucccugugagugggggcc

SEQ ID NO: 325468 - RNA, 23 nt, Human
uccgucucaaaaaaaaaaaaaaa

SEQ ID NO: 325469 - RNA, 24 nt, Human
uccugaauagcugggauuacaggc

SEQ ID NO: 325470 - RNA, 23 nt, Human
uccugaguggccuuucuguggcc

SEQ ID NO: 325471 - RNA, 22 nt, Human
uccugggggugccuggaggcug

SEQ ID NO: 325472 - RNA, 19 nt, Human
uccuggguucaagcaauuc

SEQ ID NO: 325473 - RNA, 24 nt, Human
uccuggguucaagcaauucuggug

SEQ ID NO: 325474 - RNA, 22 nt, Human
ucgccauguuggccaggcuggu

SEQ ID NO: 325475 - RNA, 24 nt, Human
ucgccauguuggccaggcuggucu

SEQ ID NO: 325476 - RNA, 18 nt, Human
ucgcccaggcuggagugc

SEQ ID NO: 325477 - RNA, 18 nt, Human
ucggccucccaaagugcu

SEQ ID NO: 325478 - RNA, 23 nt, Human
ucuagaacagagaacuccacucc

SEQ ID NO: 325479 - RNA, 23 nt, Human
ucuagccugggcagcagagcgag

SEQ ID NO: 325480 - RNA, 24 nt, Human
ucuagccugggcagcagagcgaga

SEQ ID NO: 325481 - RNA, 18 nt, Human
ucucaaaaaaaaaaaaaa

SEQ ID NO: 325482 - RNA, 20 nt, Human
ucucagagccuguuucucca

SEQ ID NO: 325483 - RNA, 22 nt, Human
ucucccuccagcuaaagcuaga

SEQ ID NO: 325484 - RNA, 20 nt, Human
ucuccugcauuuucucaagu

SEQ ID NO: 325485 - RNA, 21 nt, Human
ucucuacuaaaaauacaaaaa

SEQ ID NO: 325486 - RNA, 21 nt, Human
ucucuacuaaaaauccaaaaa

SEQ ID NO: 325487 - RNA, 21 nt, Human
ucucuacuaaaaauccaaaaa

SEQ ID NO: 325488 - RNA, 23 nt, Human
ucugccugcagaguuccucgucg

SEQ ID NO: 325489 - RNA, 22 nt, Human
ucuggcucugucagcuccugaa

SEQ ID NO: 325490 - RNA, 19 nt, Human
ucugucagcuccugaaguc

SEQ ID NO: 325491 - RNA, 18 nt, Human
ucugucgcccaggcugga

SEQ ID NO: 325492 - RNA, 23 nt, Human
ucuugcucugucgcccaggcugg

SEQ ID NO: 325493 - RNA, 24 nt, Human
ucuugcucugucgcccaggcugga

SEQ ID NO: 325494 - RNA, 22 nt, Human
ucuuggcugggcgcgguggcuc

SEQ ID NO: 325495 - RNA, 23 nt, Human
ucuuugaaggcaggugagaaucu

SEQ ID NO: 325496 - RNA, 22 nt, Human
ugaaugaacucucccaaagaug

SEQ ID NO: 325497 - RNA, 21 nt, Human
ugaauugggagcagacaaagc

SEQ ID NO: 325498 - RNA, 20 nt, Human
ugacugugguuccaaggagg

SEQ ID NO: 325499 - RNA, 20 nt, Human
ugagaaagcccaucccaucc

SEQ ID NO: 325500 - RNA, 22 nt, Human
ugagcccaaagaacaggaguug

SEQ ID NO: 325501 - RNA, 22 nt, Human
ugagccgagaucacgccacugc

SEQ ID NO: 325502 - RNA, 24 nt, Human
ugaggcagaagcauugcuuaaacc

SEQ ID NO: 325503 - RNA, 25 nt, Human
ugaggcagaagcauugcuuaaaccc

SEQ ID NO: 325504 - RNA, 23 nt, Human
ugaggcaggagaauggugugaac

SEQ ID NO: 325505 - RNA, 22 nt, Human
ugaggcccagggaagcccccaa

SEQ ID NO: 325506 - RNA, 19 nt, Human
ugcacuccagccugggcaa

SEQ ID NO: 325507 - RNA, 20 nt, Human
ugcagccugcgcaagaccuu

SEQ ID NO: 325508 - RNA, 24 nt, Human
ugccauugcacuccagccugggca

SEQ ID NO: 325509 - RNA, 20 nt, Human
ugccccuguucugcaccggg

SEQ ID NO: 325510 - RNA, 18 nt, Human
ugccggcuugcuuccuuc

SEQ ID NO: 325511 - RNA, 22 nt, Human
ugccucagccuccugaauagcu

SEQ ID NO: 325512 - RNA, 26 nt, Human
ugccucagccuccugaauagcuggga

SEQ ID NO: 325513 - RNA, 20 nt, Human
ugccugcagaguuccucgug

SEQ ID NO: 325514 - RNA, 20 nt, Human
ugccuggaggcugaggccca

SEQ ID NO: 325515 - RNA, 23 nt, Human
ugccuggugggagcacaucuuuu

SEQ ID NO: 325516 - RNA, 23 nt, Human
ugccuguaauccuagcacuuugg

SEQ ID NO: 325517 - RNA, 23 nt, Human
ugccuguaauccuagcacuuugg

SEQ ID NO: 325518 - RNA, 24 nt, Human
ugccuguaauccuagcacuuuggg

SEQ ID NO: 325519 - RNA, 24 nt, Human
ugccuguagucccagcuacucagg

SEQ ID NO: 325520 - RNA, 24 nt, Human
ugcgccuguaaucucagcuacuug

SEQ ID NO: 325521 - RNA, 24 nt, Human
ugcucugucgcccaggcuggagug

SEQ ID NO: 325522 - RNA, 19 nt, Human
uggaaagaaaacuuugcag

SEQ ID NO: 325523 - RNA, 24 nt, Human
uggagugccguggcgcagucucag

SEQ ID NO: 325524 - RNA, 23 nt, Human
uggccaggcuggucuugaacucc

SEQ ID NO: 325525 - RNA, 24 nt, Human
uggcgggugccuguagucccagcu

SEQ ID NO: 325526 - RNA, 21 nt, Human
uggcucacaccuguaauccca

SEQ ID NO: 325527 - RNA, 24 nt, Human
uggcucacaccuguaaucccagca

SEQ ID NO: 325528 - RNA, 24 nt, Human
uggcucaugccuguaauccuagca

SEQ ID NO: 325529 - RNA, 21 nt, Human
ugggaagcugaggcagaagca

SEQ ID NO: 325530 - RNA, 22 nt, Human
ugggagaaaagcagggaagugg

SEQ ID NO: 325531 - RNA, 24 nt, Human
ugggaggcccaggcaggcaaauca

SEQ ID NO: 325532 - RNA, 19 nt, Human
ugggaggccgaggcgggca

SEQ ID NO: 325533 - RNA, 20 nt, Human
ugggaggccgaggcgggcag

SEQ ID NO: 325534 - RNA, 24 nt, Human
ugggaggccgaggcgggcagauca

SEQ ID NO: 325535 - RNA, 20 nt, Human
ugggaggcuggggcaggcug

SEQ ID NO: 325536 - RNA, 21 nt, Human
ugggaggcuggggcaggcugg

SEQ ID NO: 325537 - RNA, 22 nt, Human
ugggaggcuggggcaggcuggg

SEQ ID NO: 325538 - RNA, 18 nt, Human
ugggauuacaggcaagcc

SEQ ID NO: 325539 - RNA, 20 nt, Human
ugggauuacaggcacgcacc

SEQ ID NO: 325540 - RNA, 21 nt, Human
ugggauuacaggcacgcaccg

SEQ ID NO: 325541 - RNA, 24 nt, Human
ugggauuacaggcacgcaccgcca

SEQ ID NO: 325542 - RNA, 24 nt, Human
ugguggcgggugccuguaguccca

SEQ ID NO: 325543 - RNA, 22 nt, Human
ugguggcucaugccuguaaucc

SEQ ID NO: 325544 - RNA, 24 nt, Human
ugguggugugcgccuguaaucuca

SEQ ID NO: 325545 - RNA, 21 nt, Human
uggugugcgccuguaaucuca

SEQ ID NO: 325546 - RNA, 24 nt, Human
uggugugcgccuguaaucucagcu

SEQ ID NO: 325547 - RNA, 21 nt, Human
ugguuuaauagauuucagcau

SEQ ID NO: 325548 - RNA, 21 nt, Human
ugucugggcugugucuuccuu

SEQ ID NO: 325549 - RNA, 24 nt, Human
uguuuaguagagacgggguuucgc

SEQ ID NO: 325550 - RNA, 24 nt, Human
uuaaacccaggagguggagguugu

SEQ ID NO: 325551 - RNA, 21 nt, Human
uuaaucaucaaaaucaaugac

SEQ ID NO: 325552 - RNA, 24 nt, Human
uuagccgggugugguggcgggugc

SEQ ID NO: 325553 - RNA, 24 nt, Human
uuaggccgggcaugguggcucaug

SEQ ID NO: 325554 - RNA, 18 nt, Human
uuaguagagacgggguuu

SEQ ID NO: 325555 - RNA, 22 nt, Human
uuaguagagacgggguuucgcc

SEQ ID NO: 325556 - RNA, 24 nt, Human
uuaguagagacgggguuucgccau

SEQ ID NO: 325557 - RNA, 22 nt, Human
uuauugggggacugacugcuga

SEQ ID NO: 325558 - RNA, 25 nt, Human
uucaagagaagcuggacauuuugaa

SEQ ID NO: 325559 - RNA, 21 nt, Human
uucaguaucucagguaacagc

SEQ ID NO: 325560 - RNA, 18 nt, Human
uugaaugaacucucccaa

SEQ ID NO: 325561 - RNA, 18 nt, Human
uugcagugagccgagauc

SEQ ID NO: 325562 - RNA, 20 nt, Human
uugcagugagccgagaucac

SEQ ID NO: 325563 - RNA, 21 nt, Human
uugcagugagccgagaucacg

SEQ ID NO: 325564 - RNA, 24 nt, Human
uugcucauccagcauuugcuccug

SEQ ID NO: 325565 - RNA, 23 nt, Human
uugcuccugggacaguaaaucug

SEQ ID NO: 325566 - RNA, 24 nt, Human
uugcuuaaacccaggagguggagg

SEQ ID NO: 325567 - RNA, 25 nt, Human
uugggaggccgaggcgggcagauca

SEQ ID NO: 325568 - RNA, 22 nt, Human
uugguaaacaacaauauuaaaa

SEQ ID NO: 325569 - RNA, 21 nt, Human
uuuaguagagacgggguuucg

SEQ ID NO: 325570 - RNA, 21 nt, Human
uuuauuuuucauggucacuuu

SEQ ID NO: 325571 - RNA, 24 nt, Human
uuucgccauguuggccaggcuggu

SEQ ID NO: 325572 - RNA, 23 nt, Human
uuugggcaagaccugugaaaucu

SEQ ID NO: 325573 - RNA, 23 nt, Human
uuugguaaacaacaauauuaaaa

SEQ ID NO: 325574 - RNA, 23 nt, Human
uuuuuuuauguuuaguagagacg

SEQ ID NO: 325575 - RNA, 23 nt, Human
aaaauaccuucacagccacaccu

SEQ ID NO: 325576 - RNA, 18 nt, Human
aaagucccuccaggccau

SEQ ID NO: 325577 - RNA, 19 nt, Human
aaagucccuccaggccauu

SEQ ID NO: 325578 - RNA, 20 nt, Human
aaauaacugugugcuauagc

SEQ ID NO: 325579 - RNA, 24 nt, Human
aaauccacauucuagacagccaga

SEQ ID NO: 325580 - RNA, 20 nt, Human
aaauggaccaucuugucaga

SEQ ID NO: 325581 - RNA, 23 nt, Human
aacaaauggaccaucuugucaga

SEQ ID NO: 325582 - RNA, 19 nt, Human
aaccccucaucuuaccccu

SEQ ID NO: 325583 - RNA, 18 nt, Human
aaccucuagcacgcccag

SEQ ID NO: 325584 - RNA, 18 nt, Human
aagaaaggagaggauucu

SEQ ID NO: 325585 - RNA, 23 nt, Human
aagaaaggcuagccauguuccag

SEQ ID NO: 325586 - RNA, 24 nt, Human
aagacaggagacuuaaccccaagg

SEQ ID NO: 325587 - RNA, 21 nt, Human
aagcaaaagaggaauuccugg

SEQ ID NO: 325588 - RNA, 21 nt, Human
aagcaacagacacaaacucca

SEQ ID NO: 325589 - RNA, 21 nt, Human
aaucacaauauuccagauaau

SEQ ID NO: 325590 - RNA, 23 nt, Human
acaagcaacagacacaaacucca

SEQ ID NO: 325591 - RNA, 19 nt, Human
acaagcacaaagcucuccc

SEQ ID NO: 325592 - RNA, 22 nt, Human
acacugcccggagcuccagccc

SEQ ID NO: 325593 - RNA, 23 nt, Human
acaggcaagaucaggccuggaac

SEQ ID NO: 325594 - RNA, 21 nt, Human
accaauggcgugaauacagcc

SEQ ID NO: 325595 - RNA, 18 nt, Human
accagggucuuagugggg

SEQ ID NO: 325596 - RNA, 22 nt, Human
accccacuuccuugcccucuca

SEQ ID NO: 325597 - RNA, 24 nt, Human
accccacuuccuugcccucucagu

SEQ ID NO: 325598 - RNA, 25 nt, Human
accccacuuccuugcccucucagug

SEQ ID NO: 325599 - RNA, 20 nt, Human
acccccgcuccucccuccag

SEQ ID NO: 325600 - RNA, 23 nt, Human
agacaggagacuuaaccccaagg

SEQ ID NO: 325601 - RNA, 20 nt, Human
agaccagggucuuagugggg

SEQ ID NO: 325602 - RNA, 19 nt, Human
agcaggcuggaaacucagg

SEQ ID NO: 325603 - RNA, 21 nt, Human
agccagacaggcaagaucagg

SEQ ID NO: 325604 - RNA, 19 nt, Human
agcugccaucagcuccugg

SEQ ID NO: 325605 - RNA, 19 nt, Human
aggaauaccucuggaaccc

SEQ ID NO: 325606 - RNA, 22 nt, Human
aggaauuccuggaauaggccac

SEQ ID NO: 325607 - RNA, 18 nt, Human
aggagagggugucugauu

SEQ ID NO: 325608 - RNA, 20 nt, Human
agggagaaaggaaguaccag

SEQ ID NO: 325609 - RNA, 18 nt, Human
auaccuucacagccacac

SEQ ID NO: 325610 - RNA, 21 nt, Human
aucccauccuuccacccucaa

SEQ ID NO: 325611 - RNA, 20 nt, Human
caaaauaagaacccccuaac

SEQ ID NO: 325612 - RNA, 24 nt, Human
caaaauaagaacccccuaacuuuc

SEQ ID NO: 325613 - RNA, 22 nt, Human
caaaccaggaaucaagaggagc

SEQ ID NO: 325614 - RNA, 18 nt, Human
caaagcucuccccuccag

SEQ ID NO: 325615 - RNA, 20 nt, Human
caaauggaccaucuugucag

SEQ ID NO: 325616 - RNA, 23 nt, Human
caaccaauggcgugaauacagcc

SEQ ID NO: 325617 - RNA, 20 nt, Human
caaccccucaucuuaccccu

SEQ ID NO: 325618 - RNA, 27 nt, Human
caacugauuguagauguuaaucacauc

SEQ ID NO: 325619 - RNA, 22 nt, Human
caagaagaacaccccacuuccu

SEQ ID NO: 325620 - RNA, 21 nt, Human
caagaucaggccuggaacuga

SEQ ID NO: 325621 - RNA, 21 nt, Human
caagcacaaagcucuccccuc

SEQ ID NO: 325622 - RNA, 21 nt, Human
cacaccuguuacaggaacugg

SEQ ID NO: 325623 - RNA, 23 nt, Human
cacacugcccggagcuccagccc

SEQ ID NO: 325624 - RNA, 20 nt, Human
cacaggcccaccccuuggcc

SEQ ID NO: 325625 - RNA, 18 nt, Human
cacccuucccccggcucc

SEQ ID NO: 325626 - RNA, 22 nt, Human
caccuagauuacuguuugauua

SEQ ID NO: 325627 - RNA, 23 nt, Human
cacucuggaaugacaagcacaaa

SEQ ID NO: 325628 - RNA, 21 nt, Human
cacugcccggagcuccagccc

SEQ ID NO: 325629 - RNA, 20 nt, Human
cacugcuguguccccacacc

SEQ ID NO: 325630 - RNA, 19 nt, Human
cagagcagaggggguuaga

SEQ ID NO: 325631 - RNA, 24 nt, Human
caggaacuggcacauaguaaacac

SEQ ID NO: 325632 - RNA, 22 nt, Human
cagugaugggcccaaggauccc

SEQ ID NO: 325633 - RNA, 18 nt, Human
caucacauccaccaaauc

SEQ ID NO: 325634 - RNA, 22 nt, Human
caucacauccaccaaaucaaaa

SEQ ID NO: 325635 - RNA, 23 nt, Human
caucccauccuuccacccucaaa

SEQ ID NO: 325636 - RNA, 24 nt, Human
caucccauccuuccacccucaaag

SEQ ID NO: 325637 - RNA, 20 nt, Human
caucuuaccccucuguccuc

SEQ ID NO: 325638 - RNA, 23 nt, Human
ccaacacucaccaugccaaacca

SEQ ID NO: 325639 - RNA, 21 nt, Human
ccaccauucugucuuugaccc

SEQ ID NO: 325640 - RNA, 21 nt, Human
ccagauaaugggugagacuua

SEQ ID NO: 325641 - RNA, 20 nt, Human
ccagccaacuaaggagaaac

SEQ ID NO: 325642 - RNA, 18 nt, Human
ccagcccauccccucccc

SEQ ID NO: 325643 - RNA, 22 nt, Human
ccagcccauccccuccccaccc

SEQ ID NO: 325644 - RNA, 24 nt, Human
ccaucccauccuuccacccucaaa

SEQ ID NO: 325645 - RNA, 28 nt, Human
ccaucccauccuuccacccucaaagccc

SEQ ID NO: 325646 - RNA, 18 nt, Human
ccaugagucaagaccugg

SEQ ID NO: 325647 - RNA, 24 nt, Human
cccaacacucaccaugccaaacca

SEQ ID NO: 325648 - RNA, 19 nt, Human
cccaagaagaacaccccac

SEQ ID NO: 325649 - RNA, 22 nt, Human
cccaccccuuggccagaaugca

SEQ ID NO: 325650 - RNA, 18 nt, Human
cccauccuuccacccuca

SEQ ID NO: 325651 - RNA, 24 nt, Human
cccauccuuccacccucaaagccc

SEQ ID NO: 325652 - RNA, 19 nt, Human
ccccaacacucaccaugcc

SEQ ID NO: 325653 - RNA, 18 nt, Human
cccccgcuccucccucca

SEQ ID NO: 325654 - RNA, 20 nt, Human
cccccgcuccucccuccagc

SEQ ID NO: 325655 - RNA, 23 nt, Human
ccccggcuccacccccgcuccuc

SEQ ID NO: 325656 - RNA, 18 nt, Human
ccccuagccccagcugcc

SEQ ID NO: 325657 - RNA, 19 nt, Human
ccccuccccacccuucccc

SEQ ID NO: 325658 - RNA, 19 nt, Human
ccccucuguccucucucuc

SEQ ID NO: 325659 - RNA, 23 nt, Human
ccccucuguccucucucucugcu

SEQ ID NO: 325660 - RNA, 23 nt, Human
cccgcuccucccuccagcuguca

SEQ ID NO: 325661 - RNA, 24 nt, Human
cccuccccacccuucccccggcuc

SEQ ID NO: 325662 - RNA, 21 nt, Human
ccgcagggagaaaggaaguac

SEQ ID NO: 325663 - RNA, 22 nt, Human
ccuagccccagcugccaucagc

SEQ ID NO: 325664 - RNA, 22 nt, Human
ccucaaccccucaucuuacccc

SEQ ID NO: 325665 - RNA, 20 nt, Human
ccuccguucugccagcuucc

SEQ ID NO: 325666 - RNA, 19 nt, Human
ccucuggaacccaucccau

SEQ ID NO: 325667 - RNA, 19 nt, Human
ccugaaaagggcagugccu

SEQ ID NO: 325668 - RNA, 25 nt, Human
ccuggccucagcacucuggaaugac

SEQ ID NO: 325669 - RNA, 25 nt, Human
ccuucacagccacaccuagauuacu

SEQ ID NO: 325670 - RNA, 22 nt, Human
ccuuccacccucaaagcccuuc

SEQ ID NO: 325671 - RNA, 20 nt, Human
ccuuggccagaaugcacccc

SEQ ID NO: 325672 - RNA, 21 nt, Human
cgcuccucccuccagcuguca

SEQ ID NO: 325673 - RNA, 21 nt, Human
cggcuccacccccgcuccucc

SEQ ID NO: 325674 - RNA, 22 nt, Human
cuacaagaaaggcuagccaugu

SEQ ID NO: 325675 - RNA, 18 nt, Human
cuagccccagcugccauc

SEQ ID NO: 325676 - RNA, 23 nt, Human
cuccacccccgcuccucccucca

SEQ ID NO: 325677 - RNA, 22 nt, Human
cuccuccguucugccagcuucc

SEQ ID NO: 325678 - RNA, 19 nt, Human
cuccugguuggaccacggc

SEQ ID NO: 325679 - RNA, 20 nt, Human
cuccugguuggaccacggcu

SEQ ID NO: 325680 - RNA, 19 nt, Human
cucugcuuuagaggauggg

SEQ ID NO: 325681 - RNA, 20 nt, Human
cucuguaagggaggaaguug

SEQ ID NO: 325682 - RNA, 25 nt, Human
cugccagcuuccuguccuuccugcu

SEQ ID NO: 325683 - RNA, 20 nt, Human
cuggaauaggccaccggaug

SEQ ID NO: 325684 - RNA, 19 nt, Human
cugucugcccugagaucac

SEQ ID NO: 325685 - RNA, 26 nt, Human
cugugcgugcgccucgcacacugccc

SEQ ID NO: 325686 - RNA, 24 nt, Human
cuucacagccacaccuagauuacu

SEQ ID NO: 325687 - RNA, 18 nt, Human
cuuccacccucaaagccc

SEQ ID NO: 325688 - RNA, 22 nt, Human
cuucuuuuccaggaaacugcag

SEQ ID NO: 325689 - RNA, 19 nt, Human
cuugcccucucagugcagg

SEQ ID NO: 325690 - RNA, 23 nt, Human
cuuucaacuaaucaggugcagcu

SEQ ID NO: 325691 - RNA, 20 nt, Human
cuuuccaaaacacuugucug

SEQ ID NO: 325692 - RNA, 24 nt, Human
gaacaaauggaccaucuugucaga

SEQ ID NO: 325693 - RNA, 19 nt, Human
gaaugcaaaauaagaaccc

SEQ ID NO: 325694 - RNA, 24 nt, Human
gacaggcaagaucaggccuggaac

SEQ ID NO: 325695 - RNA, 21 nt, Human
gagaagggcagggauccaggc

SEQ ID NO: 325696 - RNA, 23 nt, Human
gaguagccugaauaucaggugga

SEQ ID NO: 325697 - RNA, 24 nt, Human
gauugauucacaggcccaccccuu

SEQ ID NO: 325698 - RNA, 18 nt, Human
gauuugggauacgagcca

SEQ ID NO: 325699 - RNA, 20 nt, Human
gcaaaagaggaauuccugga

SEQ ID NO: 325700 - RNA, 18 nt, Human
gcagaccaaaugagaacc

SEQ ID NO: 325701 - RNA, 27 nt, Human
gccucgcacacugcccggagcuccagc

SEQ ID NO: 325702 - RNA, 20 nt, Human
gccugcgugaggugugucac

SEQ ID NO: 325703 - RNA, 18 nt, Human
gcucacccaaauuauuua

SEQ ID NO: 325704 - RNA, 19 nt, Human
gcuccucccuccagcuguc

SEQ ID NO: 325705 - RNA, 23 nt, Human
gcugcaaccucuagcacgcccag

SEQ ID NO: 325706 - RNA, 21 nt, Human
gcuggaguggagggcugucug

SEQ ID NO: 325707 - RNA, 20 nt, Human
gcugucugcccugagaucac

SEQ ID NO: 325708 - RNA, 25 nt, Human
ggaacccaucccauccuuccacccu

SEQ ID NO: 325709 - RNA, 19 nt, Human
ggacacaagcucuucaugg

SEQ ID NO: 325710 - RNA, 20 nt, Human
ggaucaugaagaaccuuccc

SEQ ID NO: 325711 - RNA, 20 nt, Human
ggcuugauuacaagcaacag

SEQ ID NO: 325712 - RNA, 23 nt, Human
gggaaauagaaucugcaagaaag

SEQ ID NO: 325713 - RNA, 20 nt, Human
gggcccaaggaucccagcag

SEQ ID NO: 325714 - RNA, 18 nt, Human
ggggugcgggacgcagag

SEQ ID NO: 325715 - RNA, 18 nt, Human
gggucucuggucuugaga

SEQ ID NO: 325716 - RNA, 23 nt, Human
gugcagcucacccaaauuauuua

SEQ ID NO: 325717 - RNA, 22 nt, Human
gugcccccucuguuguaugcuc

SEQ ID NO: 325718 - RNA, 20 nt, Human
guuuccccuguuguuucugg

SEQ ID NO: 325719 - RNA, 19 nt, Human
uaaaaccaaccaucacauc

SEQ ID NO: 325720 - RNA, 24 nt, Human
uaaaaccaaccaucacauccacca

SEQ ID NO: 325721 - RNA, 24 nt, Human
uaaauaacugugugcuauagccca

SEQ ID NO: 325722 - RNA, 20 nt, Human
uaaggagagggugucugauu

SEQ ID NO: 325723 - RNA, 19 nt, Human
uacagcccaccuguucucu

SEQ ID NO: 325724 - RNA, 20 nt, Human
uacagugaugggcccaagga

SEQ ID NO: 325725 - RNA, 22 nt, Human
uacagugaugggcccaaggauc

SEQ ID NO: 325726 - RNA, 23 nt, Human
uagcaggcuggaaacucaggcag

SEQ ID NO: 325727 - RNA, 19 nt, Human
uaggaaaauacauauuugg

SEQ ID NO: 325728 - RNA, 20 nt, Human
uauaacagguaacuuuagaa

SEQ ID NO: 325729 - RNA, 18 nt, Human
uaugugcucuccuccccg

SEQ ID NO: 325730 - RNA, 19 nt, Human
uauuagcagaagaggggaa

SEQ ID NO: 325731 - RNA, 26 nt, Human
ucaauacuaagcaaagucuaccuaau

SEQ ID NO: 325732 - RNA, 18 nt, Human
ucacacuguuggugugag

SEQ ID NO: 325733 - RNA, 20 nt, Human
ucacucugaagaagcuuucu

SEQ ID NO: 325734 - RNA, 19 nt, Human
ucagaaagucaagauucug

SEQ ID NO: 325735 - RNA, 22 nt, Human
ucagaccagggucuuagugggg

SEQ ID NO: 325736 - RNA, 19 nt, Human
ucagcacucuggaaugaca

SEQ ID NO: 325737 - RNA, 19 nt, Human
uccaaaacacuugucugau

SEQ ID NO: 325738 - RNA, 22 nt, Human
uccacccccgcuccucccucca

SEQ ID NO: 325739 - RNA, 24 nt, Human
uccagcccauccccuccccacccu

SEQ ID NO: 325740 - RNA, 20 nt, Human
ucccauccuuccacccucaa

SEQ ID NO: 325741 - RNA, 21 nt, Human
uccccacccuucccccggcuc

SEQ ID NO: 325742 - RNA, 22 nt, Human
ucuacaaaauaccuucacagcc

SEQ ID NO: 325743 - RNA, 25 nt, Human
ucuacgucagagcaacugcaagagc

SEQ ID NO: 325744 - RNA, 18 nt, Human
ucucagagcuggagugga

SEQ ID NO: 325745 - RNA, 20 nt, Human
ucucagagcuggaguggagg

SEQ ID NO: 325746 - RNA, 22 nt, Human
ucucucucugcugccuacagaa

SEQ ID NO: 325747 - RNA, 21 nt, Human
ucugauugcccaggauugauu

SEQ ID NO: 325748 - RNA, 19 nt, Human
ucuggaucaucagccagga

SEQ ID NO: 325749 - RNA, 20 nt, Human
ucuguccucucucucugcuu

SEQ ID NO: 325750 - RNA, 22 nt, Human
ugaaaagggcagugccuggccc

SEQ ID NO: 325751 - RNA, 26 nt, Human
ugaaauuaauaagaaaggagaggauu

SEQ ID NO: 325752 - RNA, 20 nt, Human
ugaagaaccuucccucaacc

SEQ ID NO: 325753 - RNA, 22 nt, Human
ugaagggcuaacaaggaguuca

SEQ ID NO: 325754 - RNA, 23 nt, Human
ugaagggcuaacaaggaguucag

SEQ ID NO: 325755 - RNA, 19 nt, Human
ugaaugaguagccugaaua

SEQ ID NO: 325756 - RNA, 20 nt, Human
ugaaugaguagccugaauau

SEQ ID NO: 325757 - RNA, 23 nt, Human
ugaaugaguagccugaauaucag

SEQ ID NO: 325758 - RNA, 30 nt, Human
ugacaagcacaaagcucuccccuccagaaa

SEQ ID NO: 325759 - RNA, 19 nt, Human
ugacccugagccagacagg

SEQ ID NO: 325760 - RNA, 20 nt, Human
ugagaacaaaugagaauuaa

SEQ ID NO: 325761 - RNA, 21 nt, Human
ugagaagggcagggauccagg

SEQ ID NO: 325762 - RNA, 23 nt, Human
ugagagcgcaauaggggaggaca

SEQ ID NO: 325763 - RNA, 24 nt, Human
ugagagcgcaauaggggaggacag

SEQ ID NO: 325764 - RNA, 21 nt, Human
ugagccagacaggcaagauca

SEQ ID NO: 325765 - RNA, 20 nt, Human
ugaggcaaaguuucuucuuu

SEQ ID NO: 325766 - RNA, 22 nt, Human
ugagucaaaccaggaaucaaga

SEQ ID NO: 325767 - RNA, 22 nt, Human
ugcaagagcagggaaggauugc

SEQ ID NO: 325768 - RNA, 23 nt, Human
ugcaggcacagauucagggaaug

SEQ ID NO: 325769 - RNA, 19 nt, Human
ugcccccucuguuguaugc

SEQ ID NO: 325770 - RNA, 19 nt, Human
ugcccccucuguuguaugc

SEQ ID NO: 325771 - RNA, 21 nt, Human
ugccucugcuuuagaggaugg

SEQ ID NO: 325772 - RNA, 23 nt, Human
ugcucuccuccccgggugccccc

SEQ ID NO: 325773 - RNA, 18 nt, Human
uggaaacucaggcaggag

SEQ ID NO: 325774 - RNA, 26 nt, Human
uggaacccaucccauccuuccacccu

SEQ ID NO: 325775 - RNA, 21 nt, Human
uggaagaauaaacagaaucac

SEQ ID NO: 325776 - RNA, 19 nt, Human
uggaaggaaaagcuaaagu

SEQ ID NO: 325777 - RNA, 18 nt, Human
uggaauaggccaccggau

SEQ ID NO: 325778 - RNA, 22 nt, Human
uggaauaggccaccggauggaa

SEQ ID NO: 325779 - RNA, 18 nt, Human
uggaaugacaagcacaaa

SEQ ID NO: 325780 - RNA, 18 nt, Human
uggcacauaguaaacacu

SEQ ID NO: 325781 - RNA, 21 nt, Human
uggcagaccaaaugagaacca

SEQ ID NO: 325782 - RNA, 23 nt, Human
ugggaccaaaagagauauauaac

SEQ ID NO: 325783 - RNA, 20 nt, Human
uggggugcgggacgcagagu

SEQ ID NO: 325784 - RNA, 20 nt, Human
ugggugagacuuaaaguucu

SEQ ID NO: 325785 - RNA, 24 nt, Human
uguuugucugccacuggaguguga

SEQ ID NO: 325786 - RNA, 20 nt, Human
uuaaaguucuaaaugucaac

SEQ ID NO: 325787 - RNA, 22 nt, Human
uuaaauaacugugugcuauagc

SEQ ID NO: 325788 - RNA, 22 nt, Human
uucauggagacuuccagcaccc

SEQ ID NO: 325789 - RNA, 20 nt, Human
uucccccggcuccacccccg

SEQ ID NO: 325790 - RNA, 30 nt, Human
uucuaaaugucaaccccaacacucaccaau

SEQ ID NO: 325791 - RNA, 19 nt, Human
uucugccagcuuccugucc

SEQ ID NO: 325792 - RNA, 22 nt, Human
uucuuggugcauuuagccuguu

SEQ ID NO: 325793 - RNA, 27 nt, Human
uuuaagaccaucagcccuggccucagc

SEQ ID NO: 325794 - RNA, 18 nt, Human
uuuccaggaaacugcagu

SEQ ID NO: 325795 - RNA, 21 nt, Human
uuugacccugagccagacagg

SEQ ID NO: 325796 - RNA, 21 nt, Human
uuuuccaggaaacugcagugu

SEQ ID NO: 325797 - RNA, 18 nt, Human
aaaagaagaaaagaaaag

SEQ ID NO: 325798 - RNA, 19 nt, Human
aaaagaagaaaagaaaagg

SEQ ID NO: 325799 - RNA, 24 nt, Human
aaacagaauaaaaacuguuuucca

SEQ ID NO: 325800 - RNA, 21 nt, Human
aaacaucgacaguguaaaaac

SEQ ID NO: 325801 - RNA, 19 nt, Human
aaacauuuuaaaaggucag

SEQ ID NO: 325802 - RNA, 18 nt, Human
aaagaagaaaagaaaagg

SEQ ID NO: 325803 - RNA, 22 nt, Human
aaauauuaaaacccacagugcu

SEQ ID NO: 325804 - RNA, 23 nt, Human
aacagaaaaucugagaaaacaua

SEQ ID NO: 325805 - RNA, 20 nt, Human
aaccuuaaauaucucaauau

SEQ ID NO: 325806 - RNA, 19 nt, Human
aacuguacaacagaaaauc

SEQ ID NO: 325807 - RNA, 18 nt, Human
aagaaaauauaggcagag

SEQ ID NO: 325808 - RNA, 21 nt, Human
aagaagaaaagaaaaggaaca

SEQ ID NO: 325809 - RNA, 23 nt, Human
aagaagaaaagaaaaggaacagc

SEQ ID NO: 325810 - RNA, 24 nt, Human
aagcauccacagaucccucaaaac

SEQ ID NO: 325811 - RNA, 18 nt, Human
aagcauuuugaagaggua

SEQ ID NO: 325812 - RNA, 23 nt, Human
aagggccuuuuuuuuucucuuuu

SEQ ID NO: 325813 - RNA, 19 nt, Human
aauucuggaauaucucaac

SEQ ID NO: 325814 - RNA, 21 nt, Human
acauaggccuauccuaaggac

SEQ ID NO: 325815 - RNA, 20 nt, Human
acugugucucuuagcaaaau

SEQ ID NO: 325816 - RNA, 24 nt, Human
agaaaagaaaaggaacagcaugca

SEQ ID NO: 325817 - RNA, 18 nt, Human
agaaaucaaacaagcuuu

SEQ ID NO: 325818 - RNA, 18 nt, Human
agaaugggaacguaacuu

SEQ ID NO: 325819 - RNA, 23 nt, Human
agacauaaauaauaaucuucaau

SEQ ID NO: 325820 - RNA, 19 nt, Human
agacaugaaauuacuggua

SEQ ID NO: 325821 - RNA, 21 nt, Human
agcugagguuuaccugaaaac

SEQ ID NO: 325822 - RNA, 27 nt, Human
auaaaauucucugcuuuucacuuaaaa

SEQ ID NO: 325823 - RNA, 22 nt, Human
auuaaacuguacaacagaaaau

SEQ ID NO: 325824 - RNA, 24 nt, Human
auuucauuuucucccucuucccaa

SEQ ID NO: 325825 - RNA, 21 nt, Human
auuuucucccucuucccaaaa

SEQ ID NO: 325826 - RNA, 19 nt, Human
caaaacauuuuaaaagguc

SEQ ID NO: 325827 - RNA, 22 nt, Human
caaaaguacuuuaaaauuucaa

SEQ ID NO: 325828 - RNA, 21 nt, Human
caaguaaaaagacgucaaaac

SEQ ID NO: 325829 - RNA, 19 nt, Human
cacugauaccuguuuuugu

SEQ ID NO: 325830 - RNA, 22 nt, Human
cagaauaaaaacuguuuuccaa

SEQ ID NO: 325831 - RNA, 20 nt, Human
cagcaugcagguagccaggc

SEQ ID NO: 325832 - RNA, 23 nt, Human
cauaggccuauccuaaggacaaa

SEQ ID NO: 325833 - RNA, 24 nt, Human
ccccaaagaaaauauacugauugu

SEQ ID NO: 325834 - RNA, 18 nt, Human
ccuuuuuuuuucucuuuu

SEQ ID NO: 325835 - RNA, 20 nt, Human
cgaagcauccacagaucccu

SEQ ID NO: 325836 - RNA, 22 nt, Human
cggggguaggcuuugcugucug

SEQ ID NO: 325837 - RNA, 21 nt, Human
cucacugcaagucguaugaca

SEQ ID NO: 325838 - RNA, 22 nt, Human
cucacugcaagucguaugacaa

SEQ ID NO: 325839 - RNA, 18 nt, Human
cugauuuuaaaaaguaga

SEQ ID NO: 325840 - RNA, 22 nt, Human
cugauuuuaaaaaguagacaug

SEQ ID NO: 325841 - RNA, 21 nt, Human
cuggacgugcuccugacgcuc

SEQ ID NO: 325842 - RNA, 20 nt, Human
cuggcuguggagcugaagga

SEQ ID NO: 325843 - RNA, 19 nt, Human
cuuaaauaucucaauaugc

SEQ ID NO: 325844 - RNA, 21 nt, Human
cuuaaauaucucaauaugcca

SEQ ID NO: 325845 - RNA, 18 nt, Human
cuucaauaaauuaaguaa

SEQ ID NO: 325846 - RNA, 28 nt, Human
gaaaaaggaacaucacuuauaaaauauu

SEQ ID NO: 325847 - RNA, 19 nt, Human
gaacguaacuuuuuccagu

SEQ ID NO: 325848 - RNA, 21 nt, Human
gaacuacuuagauaucauuug

SEQ ID NO: 325849 - RNA, 21 nt, Human
gacaaugagauguggaaaaga

SEQ ID NO: 325850 - RNA, 22 nt, Human
gagcggcgggcagggcgcggcg

SEQ ID NO: 325851 - RNA, 24 nt, Human
gcauccaucuugguuacagauagc

SEQ ID NO: 325852 - RNA, 23 nt, Human
gcgucuggcuguggagcugaagg

SEQ ID NO: 325853 - RNA, 20 nt, Human
ggcgcggcgcggggguaggc

SEQ ID NO: 325854 - RNA, 19 nt, Human
ggcuguggagcugaaggag

SEQ ID NO: 325855 - RNA, 22 nt, Human
gggcagggcgcggcgcgggggu

SEQ ID NO: 325856 - RNA, 18 nt, Human
guggagcugaaggaggcg

SEQ ID NO: 325857 - RNA, 20 nt, Human
guugaaauucaaguaaaaag

SEQ ID NO: 325858 - RNA, 25 nt, Human
uaaaaaaaacagugaacaguguuuu

SEQ ID NO: 325859 - RNA, 20 nt, Human
uaaaaauauuaaaacccaca

SEQ ID NO: 325860 - RNA, 21 nt, Human
uaaaagaagaaaagaaaagga

SEQ ID NO: 325861 - RNA, 24 nt, Human
uaaacguaaaauuguaaagaagau

SEQ ID NO: 325862 - RNA, 20 nt, Human
uaaacuguacaacagaaaau

SEQ ID NO: 325863 - RNA, 24 nt, Human
uaaauaagaaagggcauuaauuag

SEQ ID NO: 325864 - RNA, 24 nt, Human
uaaauuugaacaauaauuugguuc

SEQ ID NO: 325865 - RNA, 22 nt, Human
uaacacugcaguggcuccacca

SEQ ID NO: 325866 - RNA, 21 nt, Human
uaacagcaacagcaaaaucuu

SEQ ID NO: 325867 - RNA, 19 nt, Human
uacacauuugucugaggca

SEQ ID NO: 325868 - RNA, 19 nt, Human
uagcuauaaauaaaauucu

SEQ ID NO: 325869 - RNA, 21 nt, Human
uaggcuuugcugucugagggc

SEQ ID NO: 325870 - RNA, 22 nt, Human
uauccuaaggacaaacauucaa

SEQ ID NO: 325871 - RNA, 22 nt, Human
uauuucauuuucucccucuucc

SEQ ID NO: 325872 - RNA, 21 nt, Human
ucagugacaaugagaugugga

SEQ ID NO: 325873 - RNA, 23 nt, Human
ucauuuucucccucuucccaaaa

SEQ ID NO: 325874 - RNA, 26 nt, Human
uccaaacuuaacagcaacagcaaaau

SEQ ID NO: 325875 - RNA, 20 nt, Human
ucccagguuuugucagcaga

SEQ ID NO: 325876 - RNA, 21 nt, Human
ucccucuucccaaaagaaaau

SEQ ID NO: 325877 - RNA, 21 nt, Human
uccuaaggacaaacauucaac

SEQ ID NO: 325878 - RNA, 26 nt, Human
uccugagcugagguuuaccugaaaac

SEQ ID NO: 325879 - RNA, 23 nt, Human
ucgcauacacaacccaaauuccc

SEQ ID NO: 325880 - RNA, 21 nt, Human
ugacauaacaaaaaaaaauca

SEQ ID NO: 325881 - RNA, 19 nt, Human
ugagacaauauucuuugug

SEQ ID NO: 325882 - RNA, 19 nt, Human
ugcauuggaaacaucgaca

SEQ ID NO: 325883 - RNA, 23 nt, Human
ugcuucaaaaguuuaaaccuaaa

SEQ ID NO: 325884 - RNA, 22 nt, Human
uggcugaacaaauuaacgaagc

SEQ ID NO: 325885 - RNA, 22 nt, Human
ugguuuuguuuuuaaauaagaa

SEQ ID NO: 325886 - RNA, 20 nt, Human
uguaaagaagauucuccuga

SEQ ID NO: 325887 - RNA, 18 nt, Human
uguggagcugaaggaggc

SEQ ID NO: 325888 - RNA, 19 nt, Human
uguggagcugaaggaggcg

SEQ ID NO: 325889 - RNA, 27 nt, Human
uuaacagcaacagcaaaaucuuuagag

SEQ ID NO: 325890 - RNA, 22 nt, Human
uuaaccuuaaacauucuaaacg

SEQ ID NO: 325891 - RNA, 24 nt, Human
uuaaccuuaaacauucuaaacgua

SEQ ID NO: 325892 - RNA, 23 nt, Human
uucaaaaguuuaaaccuaaauuu

SEQ ID NO: 325893 - RNA, 22 nt, Human
uucaaccuuaaauaucucaauu

SEQ ID NO: 325894 - RNA, 18 nt, Human
uugaaauucaaguaaaaa

SEQ ID NO: 325895 - RNA, 22 nt, Human
uugaacaauaauuugguuuucu

SEQ ID NO: 325896 - RNA, 22 nt, Human
uugcugagaacuacuuagauau

SEQ ID NO: 325897 - RNA, 18 nt, Human
uuuaaauccaagacagcu

SEQ ID NO: 325898 - RNA, 20 nt, Human
uuuacaggugauucuacccu

SEQ ID NO: 325899 - RNA, 20 nt, Human
uuuacauaauauucagagag

SEQ ID NO: 325900 - RNA, 24 nt, Human
uuugagauaacacugcaguggcuc

SEQ ID NO: 325901 - RNA, 22 nt, Human
aaaaagaauaaacaauagaaaa

SEQ ID NO: 325902 - RNA, 24 nt, Human
aaaugaauaaaaguggaaucagaa

SEQ ID NO: 325903 - RNA, 19 nt, Human
acacugucuagagcagaac

SEQ ID NO: 325904 - RNA, 18 nt, Human
acauacaaugucuuagaa

SEQ ID NO: 325905 - RNA, 23 nt, Human
cauuuuuguuuuacauuuuaagg

SEQ ID NO: 325906 - RNA, 21 nt, Human
cugucuagagcagaacucuga

SEQ ID NO: 325907 - RNA, 23 nt, Human
cuuaugaucauuacauuuuuguu

SEQ ID NO: 325908 - RNA, 22 nt, Human
gguagaagagagguuuaaaagu

SEQ ID NO: 325909 - RNA, 18 nt, Human
ucaaaugaauaaaagugg

SEQ ID NO: 325910 - RNA, 23 nt, Human
aaacaaaucagaggcgcuuccuc

SEQ ID NO: 325911 - RNA, 24 nt, Human
aaccgccuccuaaaagaagaaagu

SEQ ID NO: 325912 - RNA, 23 nt, Human
aagucagcuucuuugcgaaccgg

SEQ ID NO: 325913 - RNA, 19 nt, Human
agaaauacacuucuccagc

SEQ ID NO: 325914 - RNA, 24 nt, Human
agaaaugaaaaacacugaagaaag

SEQ ID NO: 325915 - RNA, 23 nt, Human
agauggucacuagcuucugaagc

SEQ ID NO: 325916 - RNA, 18 nt, Human
agcaaaaagggaaaaaag

SEQ ID NO: 325917 - RNA, 22 nt, Human
aggcagaagggaggcuccaaaa

SEQ ID NO: 325918 - RNA, 27 nt, Human
aggcagaagggaggcuccaaaacccag

SEQ ID NO: 325919 - RNA, 24 nt, Human
agggaaaaaagaaacaaaucagag

SEQ ID NO: 325920 - RNA, 21 nt, Human
auaauagcgaaaauaaaaugg

SEQ ID NO: 325921 - RNA, 24 nt, Human
caaaaagggaaaaaagaaacaaau

SEQ ID NO: 325922 - RNA, 19 nt, Human
caaaacccagcugagagca

SEQ ID NO: 325923 - RNA, 18 nt, Human
caaaugcuucuauauucu

SEQ ID NO: 325924 - RNA, 22 nt, Human
caaccggcuacuccaacugugc

SEQ ID NO: 325925 - RNA, 24 nt, Human
cacagccagaaagagcaaaaaggg

SEQ ID NO: 325926 - RNA, 25 nt, Human
ccaaaacccagcugagagcaccccg

SEQ ID NO: 325927 - RNA, 20 nt, Human
ccacacagccagaaagagca

SEQ ID NO: 325928 - RNA, 23 nt, Human
ccacacagccagaaagagcaaaa

SEQ ID NO: 325929 - RNA, 19 nt, Human
cuccuggguucguggaaca

SEQ ID NO: 325930 - RNA, 25 nt, Human
gaaacaaaucagaggcgcuuccucu

SEQ ID NO: 325931 - RNA, 22 nt, Human
gagcaaaaagggaaaaaagaaa

SEQ ID NO: 325932 - RNA, 23 nt, Human
gggaggcuccaaaacccagcuga

SEQ ID NO: 325933 - RNA, 22 nt, Human
ggugacgguggagaaagaggaa

SEQ ID NO: 325934 - RNA, 21 nt, Human
gguggagaaagaggaaugggc

SEQ ID NO: 325935 - RNA, 22 nt, Human
ggugugagaguaaggggaagaa

SEQ ID NO: 325936 - RNA, 19 nt, Human
guagagugguaaaggauug

SEQ ID NO: 325937 - RNA, 23 nt, Human
guaguguguuuacacgucuccca

SEQ ID NO: 325938 - RNA, 26 nt, Human
guggaacagggcuaaccgccuccuaa

SEQ ID NO: 325939 - RNA, 23 nt, Human
uaagaaaugaaaaacacugaaga

SEQ ID NO: 325940 - RNA, 21 nt, Human
uacccuagaaaaauuauuuca

SEQ ID NO: 325941 - RNA, 19 nt, Human
uaguguguuuacacgucuc

SEQ ID NO: 325942 - RNA, 20 nt, Human
uauucugaguuauucucugu

SEQ ID NO: 325943 - RNA, 22 nt, Human
ucaaugauaaguaguguguuuu

SEQ ID NO: 325944 - RNA, 24 nt, Human
uccaagccaaggcagaagggaggc

SEQ ID NO: 325945 - RNA, 25 nt, Human
uccucugaaauaauagcgaaaauaa

SEQ ID NO: 325946 - RNA, 21 nt, Human
ucuccagcaaauuaugaagau

SEQ ID NO: 325947 - RNA, 19 nt, Human
ugaaauaauagcgaaaaua

SEQ ID NO: 325948 - RNA, 22 nt, Human
ugaaauuauuugguagaguggu

SEQ ID NO: 325949 - RNA, 21 nt, Human
ugagaaaaaccuauauccuug

SEQ ID NO: 325950 - RNA, 20 nt, Human
ugagagcaccccgcugaggc

SEQ ID NO: 325951 - RNA, 22 nt, Human
ugagaguaaggggaagaaauac

SEQ ID NO: 325952 - RNA, 20 nt, Human
ugagcugguagaaaccagag

SEQ ID NO: 325953 - RNA, 19 nt, Human
uggaacagggcuaaccgcc

SEQ ID NO: 325954 - RNA, 23 nt, Human
ugggugacgguggagaaagagga

SEQ ID NO: 325955 - RNA, 25 nt, Human
ugguagagugguaaaggauugaugu

SEQ ID NO: 325956 - RNA, 26 nt, Human
uguccaagccaaggcagaagggaggc

SEQ ID NO: 325957 - RNA, 18 nt, Human
ugugugguagggggguac

SEQ ID NO: 325958 - RNA, 24 nt, Human
uguugggugacgguggagaaagag

SEQ ID NO: 325959 - RNA, 21 nt, Human
uuugguagagugguaaaggau

SEQ ID NO: 325960 - RNA, 23 nt, Human
uuuguccaagccaaggcagaagg

SEQ ID NO: 325961 - RNA, 23 nt, Human
cacccaucuuuugguccaucugu

SEQ ID NO: 325962 - RNA, 22 nt, Human
cauucaaccacccaucuuuugg

SEQ ID NO: 325963 - RNA, 22 nt, Human
cccuguuuuuccucuuggcccc

SEQ ID NO: 325964 - RNA, 21 nt, Human
cuuuugguccaucuguccauc

SEQ ID NO: 325965 - RNA, 25 nt, Human
cuuuugguccaucuguccauccacu

SEQ ID NO: 325966 - RNA, 26 nt, Human
ggaaaucauucaaccacccaucuuuu

SEQ ID NO: 325967 - RNA, 25 nt, Human
uccuuuuucuuuuuuuuuucuuuuu

SEQ ID NO: 325968 - RNA, 23 nt, Human
ucuuuuuuucccuguuuuuccuc

SEQ ID NO: 325969 - RNA, 20 nt, Human
uguuuuuccucuuggcccca

SEQ ID NO: 325970 - RNA, 18 nt, Human
uuuuucuuuuuuucccug

SEQ ID NO: 325971 - RNA, 22 nt, Human
uuuuucuuuuuuuuuucuuuuu

SEQ ID NO: 325972 - RNA, 24 nt, Human
uuuuuucuuuuuuucccuguuuuu

SEQ ID NO: 325973 - RNA, 25 nt, Human
uuuuuuucuuuuuuucccuguuuuu

SEQ ID NO: 325974 - RNA, 25 nt, Human
uuuuuuuuucuuuuuuucccuguuu

SEQ ID NO: 325975 - RNA, 25 nt, Human
aaaaguagcagaaaaaaaugaacaa

SEQ ID NO: 325976 - RNA, 24 nt, Human
aaacaagaaaaagauauagaugca

SEQ ID NO: 325977 - RNA, 25 nt, Human
aaacaagaaaaagauauagaugcag

SEQ ID NO: 325978 - RNA, 24 nt, Human
aacggcuguaggaagaagcaggga

SEQ ID NO: 325979 - RNA, 21 nt, Human
aacugaauuuucagccuuuga

SEQ ID NO: 325980 - RNA, 21 nt, Human
aacuuggcuggcccagagcaa

SEQ ID NO: 325981 - RNA, 18 nt, Human
aagaaaaagauauagaug

SEQ ID NO: 325982 - RNA, 20 nt, Human
aagaaaaagauauagaugca

SEQ ID NO: 325983 - RNA, 18 nt, Human
aagaaagagugaagaccu

SEQ ID NO: 325984 - RNA, 22 nt, Human
aagaagaaagagugaagaccug

SEQ ID NO: 325985 - RNA, 23 nt, Human
aagaagaaagagugaagaccuga

SEQ ID NO: 325986 - RNA, 18 nt, Human
aagcagggacccuccucc

SEQ ID NO: 325987 - RNA, 24 nt, Human
aggaaaaugauacacacuaaaaga

SEQ ID NO: 325988 - RNA, 19 nt, Human
caacuuggcuggcccagag

SEQ ID NO: 325989 - RNA, 24 nt, Human
caaguugccaacuuggcuggccca

SEQ ID NO: 325990 - RNA, 23 nt, Human
cacacaaccagccauuggaccag

SEQ ID NO: 325991 - RNA, 18 nt, Human
cagagcccgggagaagcu

SEQ ID NO: 325992 - RNA, 25 nt, Human
cagccaagcccucucacacaaccaa

SEQ ID NO: 325993 - RNA, 19 nt, Human
caggagccaauucauggag

SEQ ID NO: 325994 - RNA, 22 nt, Human
cagggacccuccuccagagccc

SEQ ID NO: 325995 - RNA, 22 nt, Human
caugacaugguuuacaaagaag

SEQ ID NO: 325996 - RNA, 19 nt, Human
ccacaugccauguacaaug

SEQ ID NO: 325997 - RNA, 20 nt, Human
ccagcccaugaaagucagcc

SEQ ID NO: 325998 - RNA, 19 nt, Human
cuccuccagagcccgggag

SEQ ID NO: 325999 - RNA, 20 nt, Human
gagaagcuuccaaguugcca

SEQ ID NO: 326000 - RNA, 21 nt, Human
gcagcugggguggucgggccc

SEQ ID NO: 326001 - RNA, 20 nt, Human
gcuguaggaagaagcaggga

SEQ ID NO: 326002 - RNA, 19 nt, Human
uaaaaggaaaaugauacac

SEQ ID NO: 326003 - RNA, 23 nt, Human
uaacagcucaaacaagaaaaaga

SEQ ID NO: 326004 - RNA, 23 nt, Human
uaacugaggaaaucuuuccacag

SEQ ID NO: 326005 - RNA, 22 nt, Human
uacauuaaaguaagaaauaaga

SEQ ID NO: 326006 - RNA, 23 nt, Human
uaugcacaggcaaaauaaaugca

SEQ ID NO: 326007 - RNA, 19 nt, Human
uccuuguucccaaaaacac

SEQ ID NO: 326008 - RNA, 22 nt, Human
ugaagaccugaggucuggcugg

SEQ ID NO: 326009 - RNA, 21 nt, Human
ugaaucuuuuuucuacccaaa

SEQ ID NO: 326010 - RNA, 21 nt, Human
ugagagaaagcuacagccaag

SEQ ID NO: 326011 - RNA, 21 nt, Human
uggcccagagcaaacuugugg

SEQ ID NO: 326012 - RNA, 23 nt, Human
uuccagcaaguacuuguucuuuc

SEQ ID NO: 326013 - RNA, 21 nt, Human
uuuacaaagaagaaagaguga

SEQ ID NO: 326014 - RNA, 26 nt, Human
aaaaaaacaaaacaaaaaaugaaccc

SEQ ID NO: 326015 - RNA, 23 nt, Human
aaaacaaaacaaaaaaugaaccc

SEQ ID NO: 326016 - RNA, 23 nt, Human
aaacaaaacaaaaaaugaaccca

SEQ ID NO: 326017 - RNA, 25 nt, Human
aaacaaaacaaaaaaugaacccaaa

SEQ ID NO: 326018 - RNA, 23 nt, Human
acaaaacaaaaaaugaacccaaa

SEQ ID NO: 326019 - RNA, 21 nt, Human
aggaauuaagaugucaccccu

SEQ ID NO: 326020 - RNA, 20 nt, Human
auuccggcucuccucuucca

SEQ ID NO: 326021 - RNA, 24 nt, Human
ccucgcugcugguggaaggcuaga

SEQ ID NO: 326022 - RNA, 22 nt, Human
gagugcuggcgacugaggacac

SEQ ID NO: 326023 - RNA, 22 nt, Human
gugaacauaaauuguucuucau

SEQ ID NO: 326024 - RNA, 23 nt, Human
uagcaagacgugcuccuagggga

SEQ ID NO: 326025 - RNA, 20 nt, Human
ucuuagaaaaacgccacauu

SEQ ID NO: 326026 - RNA, 24 nt, Human
uggucauucaaaaaaguuggagcu

SEQ ID NO: 326027 - RNA, 22 nt, Human
uuccucgcugcugguggaaggc

SEQ ID NO: 326028 - RNA, 24 nt, Human
uugaaaaaaacaaaacaaaaaaug

SEQ ID NO: 326029 - RNA, 20 nt, Human
aaguuaaaagaauguuuaug

SEQ ID NO: 326030 - RNA, 21 nt, Human
acaagucaaauagaaagaagu

SEQ ID NO: 326031 - RNA, 21 nt, Human
acccuguguccauagcccaga

SEQ ID NO: 326032 - RNA, 20 nt, Human
agaauggggguuggggagag

SEQ ID NO: 326033 - RNA, 22 nt, Human
agaccaaacucacauuaaauaa

SEQ ID NO: 326034 - RNA, 22 nt, Human
agagaaagaggggcaggaagag

SEQ ID NO: 326035 - RNA, 18 nt, Human
agagagcggauuuggccc

SEQ ID NO: 326036 - RNA, 21 nt, Human
agaggaggaguaagaaaagag

SEQ ID NO: 326037 - RNA, 18 nt, Human
agaggggcaggaagagag

SEQ ID NO: 326038 - RNA, 20 nt, Human
agaguccccucuguccagcu

SEQ ID NO: 326039 - RNA, 23 nt, Human
agcaagggaaaguaaaggaagaa

SEQ ID NO: 326040 - RNA, 22 nt, Human
agcuccuccccagcuucucugu

SEQ ID NO: 326041 - RNA, 24 nt, Human
aggaagagagcggauuuggcccaa

SEQ ID NO: 326042 - RNA, 26 nt, Human
aggcaggggcgaagacgcaggcaggu

SEQ ID NO: 326043 - RNA, 19 nt, Human
aggugacuccccuuggccu

SEQ ID NO: 326044 - RNA, 25 nt, Human
aguacagccagggguaggggugggg

SEQ ID NO: 326045 - RNA, 22 nt, Human
caaaacaaagcuccuccccagc

SEQ ID NO: 326046 - RNA, 22 nt, Human
caaagcuccuccccagcuucuc

SEQ ID NO: 326047 - RNA, 24 nt, Human
caaccacaagucaaauagaaagaa

SEQ ID NO: 326048 - RNA, 19 nt, Human
caagggacaucugagggcc

SEQ ID NO: 326049 - RNA, 19 nt, Human
cacagcauccugugccugg

SEQ ID NO: 326050 - RNA, 22 nt, Human
cacagcauccugugccuggacu

SEQ ID NO: 326051 - RNA, 19 nt, Human
caccaugugacaccucccc

SEQ ID NO: 326052 - RNA, 22 nt, Human
cagcagucccccucugagccau

SEQ ID NO: 326053 - RNA, 24 nt, Human
caggaagagagcggauuuggccca

SEQ ID NO: 326054 - RNA, 25 nt, Human
caggcaggggcgaagacgcaggcag

SEQ ID NO: 326055 - RNA, 19 nt, Human
caggcagguggccccaccc

SEQ ID NO: 326056 - RNA, 20 nt, Human
caggcccaucccucaucuca

SEQ ID NO: 326057 - RNA, 19 nt, Human
cagguccucccucaggagg

SEQ ID NO: 326058 - RNA, 23 nt, Human
caguccagaccaaacucacauua

SEQ ID NO: 326059 - RNA, 28 nt, Human
caucuuugucaccgucacccugugucca

SEQ ID NO: 326060 - RNA, 24 nt, Human
cauguccauauauaaagcuagggg

SEQ ID NO: 326061 - RNA, 22 nt, Human
ccagcuucucugugcaucaagg

SEQ ID NO: 326062 - RNA, 20 nt, Human
ccaggcuggcuuagggagca

SEQ ID NO: 326063 - RNA, 22 nt, Human
ccaugugacaccuccccacccc

SEQ ID NO: 326064 - RNA, 22 nt, Human
cccacaugaccaacagcaaggc

SEQ ID NO: 326065 - RNA, 22 nt, Human
ccccaaaacaaagcuccucccc

SEQ ID NO: 326066 - RNA, 24 nt, Human
ccccaaaacaaagcuccuccccag

SEQ ID NO: 326067 - RNA, 26 nt, Human
ccccaggagcccccugcauggaccag

SEQ ID NO: 326068 - RNA, 18 nt, Human
ccccagguccucccucag

SEQ ID NO: 326069 - RNA, 20 nt, Human
cccccaaaacaaagcuccuc

SEQ ID NO: 326070 - RNA, 24 nt, Human
cucacuggcugccugacccccaaa

SEQ ID NO: 326071 - RNA, 24 nt, Human
cuccagcgacuacuccucgggcac

SEQ ID NO: 326072 - RNA, 21 nt, Human
cucccaauuagcuuguuccug

SEQ ID NO: 326073 - RNA, 19 nt, Human
cugacccccaaaacaaagc

SEQ ID NO: 326074 - RNA, 21 nt, Human
cugucaguccagaccaaacuc

SEQ ID NO: 326075 - RNA, 22 nt, Human
cuuucaucugccgucuagcuug

SEQ ID NO: 326076 - RNA, 20 nt, Human
gaagaaagagaaagaggggc

SEQ ID NO: 326077 - RNA, 23 nt, Human
gaaggugacuccccuuggccuuc

SEQ ID NO: 326078 - RNA, 21 nt, Human
gacuacuccucgggcaccgcc

SEQ ID NO: 326079 - RNA, 22 nt, Human
gagaauggggguuggggagaga

SEQ ID NO: 326080 - RNA, 19 nt, Human
gagagaaagaggaggagua

SEQ ID NO: 326081 - RNA, 21 nt, Human
gagcaguacagccagggguag

SEQ ID NO: 326082 - RNA, 22 nt, Human
gagcggauuuggcccaaggucc

SEQ ID NO: 326083 - RNA, 20 nt, Human
gaggaggaguaagaaaagag

SEQ ID NO: 326084 - RNA, 22 nt, Human
gcaggcaggggcgaagacgcag

SEQ ID NO: 326085 - RNA, 20 nt, Human
gcccagaguccccucugucc

SEQ ID NO: 326086 - RNA, 24 nt, Human
ggagagaaagaggaggaguaagaa

SEQ ID NO: 326087 - RNA, 18 nt, Human
ggcaccgccaggugagcc

SEQ ID NO: 326088 - RNA, 19 nt, Human
ggccaggcagcagcagucc

SEQ ID NO: 326089 - RNA, 18 nt, Human
ggccuucucccuggaaga

SEQ ID NO: 326090 - RNA, 18 nt, Human
gggagcaguggccaggca

SEQ ID NO: 326091 - RNA, 20 nt, Human
ggggagagaaagaggaggag

SEQ ID NO: 326092 - RNA, 21 nt, Human
gggguagggguggggagaggg

SEQ ID NO: 326093 - RNA, 22 nt, Human
ggugcagaugagaauggggguu

SEQ ID NO: 326094 - RNA, 18 nt, Human
guagggguggggagaggg

SEQ ID NO: 326095 - RNA, 20 nt, Human
ucaaguguucacucugugcc

SEQ ID NO: 326096 - RNA, 24 nt, Human
ucaauauacacuguacaagaaugc

SEQ ID NO: 326097 - RNA, 21 nt, Human
ucaguccagaccaaacucaca

SEQ ID NO: 326098 - RNA, 25 nt, Human
uccauagcccagaguccccucuguc

SEQ ID NO: 326099 - RNA, 22 nt, Human
uccauauauaaagcuaggggca

SEQ ID NO: 326100 - RNA, 19 nt, Human
uccucgggcaccgccaggu

SEQ ID NO: 326101 - RNA, 18 nt, Human
ugacaccuccccaccccc

SEQ ID NO: 326102 - RNA, 21 nt, Human
ugacccccaaaacaaagcucc

SEQ ID NO: 326103 - RNA, 20 nt, Human
ugagaauggggguuggggag

SEQ ID NO: 326104 - RNA, 18 nt, Human
ugcaaaguggcaagggaa

SEQ ID NO: 326105 - RNA, 18 nt, Human
ugcaucaagggacaucug

SEQ ID NO: 326106 - RNA, 22 nt, Human
ugccauauaguuuaucaagugu

SEQ ID NO: 326107 - RNA, 22 nt, Human
ugccugacccccaaaacaaagc

SEQ ID NO: 326108 - RNA, 21 nt, Human
ugccuggacucccaauuagcu

SEQ ID NO: 326109 - RNA, 19 nt, Human
uggcaagggaaggugacuc

SEQ ID NO: 326110 - RNA, 20 nt, Human
uggcccaagguccuaucuug

SEQ ID NO: 326111 - RNA, 18 nt, Human
uggggagagaaagaggag

SEQ ID NO: 326112 - RNA, 18 nt, Human
ugguucccaaaucggccu

SEQ ID NO: 326113 - RNA, 18 nt, Human
uguacaagaaugccaggc

SEQ ID NO: 326114 - RNA, 21 nt, Human
ugucaccgucacccugugucc

SEQ ID NO: 326115 - RNA, 20 nt, Human
uuaaaagaauguuuaugcaa

SEQ ID NO: 326116 - RNA, 21 nt, Human
uucccaaaucggccugccaug

SEQ ID NO: 326117 - RNA, 18 nt, Human
uucucccuggaagaccca

SEQ ID NO: 326118 - RNA, 22 nt, Human
aaaacaaaaacaaaaacaaaaa

SEQ ID NO: 326119 - RNA, 27 nt, Human
aaaacaaaaacaaaaacaaaaaaacaa

SEQ ID NO: 326120 - RNA, 20 nt, Human
aaaacuccuucaucugccag

SEQ ID NO: 326121 - RNA, 22 nt, Human
aaaagugugggguaaggauggc

SEQ ID NO: 326122 - RNA, 22 nt, Human
aaacaaaaacaaaaaaacaaaa

SEQ ID NO: 326123 - RNA, 25 nt, Human
aaacaaaaacaaaaaaacaaaacaa

SEQ ID NO: 326124 - RNA, 22 nt, Human
aaacaaaacaaacaaaaaacga

SEQ ID NO: 326125 - RNA, 20 nt, Human
aaacuccuucaucugccagg

SEQ ID NO: 326126 - RNA, 23 nt, Human
aacaaacaaaaaacgacaacaau

SEQ ID NO: 326127 - RNA, 19 nt, Human
aagccuagcccuccccagg

SEQ ID NO: 326128 - RNA, 23 nt, Human
acaaaaaaacaaaacaaacaaaa

SEQ ID NO: 326129 - RNA, 24 nt, Human
acaaaaacaaaaaaacaaaacaaa

SEQ ID NO: 326130 - RNA, 28 nt, Human
acaaaaacaaaaaaacaaaacaaacaaa

SEQ ID NO: 326131 - RNA, 29 nt, Human
acaaaaacaaaaaaacaaaacaaacaaaa

SEQ ID NO: 326132 - RNA, 18 nt, Human
acaaaacaaacaaaaaac

SEQ ID NO: 326133 - RNA, 20 nt, Human
acaaaacaaacaaaaaacga

SEQ ID NO: 326134 - RNA, 22 nt, Human
acccuccucaucuccagggccc

SEQ ID NO: 326135 - RNA, 22 nt, Human
accucccaugcccacccacccc

SEQ ID NO: 326136 - RNA, 22 nt, Human
agaaggguggggaagacguggg

SEQ ID NO: 326137 - RNA, 19 nt, Human
agaggaagagguggcaggg

SEQ ID NO: 326138 - RNA, 19 nt, Human
agaggaggaaaggccaggc

SEQ ID NO: 326139 - RNA, 30 nt, Human
agcgaguguaaaaacaaaaacaaaaacaaa

SEQ ID NO: 326140 - RNA, 19 nt, Human
aggaagaggaggaaaggcc

SEQ ID NO: 326141 - RNA, 18 nt, Human
aggaugaggaaaggagag

SEQ ID NO: 326142 - RNA, 20 nt, Human
aggaugaggaaaggagagaa

SEQ ID NO: 326143 - RNA, 20 nt, Human
aggccagaaauugggguuac

SEQ ID NO: 326144 - RNA, 21 nt, Human
agucgcccaguuuggguccaa

SEQ ID NO: 326145 - RNA, 20 nt, Human
agugucaaaagcuccugaaa

SEQ ID NO: 326146 - RNA, 24 nt, Human
caaaaacaaaaaaacaaaacaaac

SEQ ID NO: 326147 - RNA, 23 nt, Human
caaaaagggcgguuuauauagug

SEQ ID NO: 326148 - RNA, 23 nt, Human
caccggagcgcgggcgccgcagc

SEQ ID NO: 326149 - RNA, 19 nt, Human
cagaguggggaggacucac

SEQ ID NO: 326150 - RNA, 21 nt, Human
cagcagcagccgcagccggag

SEQ ID NO: 326151 - RNA, 27 nt, Human
cagcucaucccaagccuagcccucccc

SEQ ID NO: 326152 - RNA, 21 nt, Human
ccacccaccccacgcugcaau

SEQ ID NO: 326153 - RNA, 23 nt, Human
ccaggcccugcucagaccucagc

SEQ ID NO: 326154 - RNA, 18 nt, Human
ccagggcccaccccuacc

SEQ ID NO: 326155 - RNA, 22 nt, Human
cccaagccuagcccuccccagg

SEQ ID NO: 326156 - RNA, 24 nt, Human
cccaccccuaccucccaugcccac

SEQ ID NO: 326157 - RNA, 19 nt, Human
cccaggcaaaguuggcaga

SEQ ID NO: 326158 - RNA, 21 nt, Human
ccccuaccucccaugcccacc

SEQ ID NO: 326159 - RNA, 27 nt, Human
ccccuaccucccaugcccacccacccc

SEQ ID NO: 326160 - RNA, 23 nt, Human
cccuaccucccaugcccacccac

SEQ ID NO: 326161 - RNA, 24 nt, Human
cccuaccucccaugcccacccacc

SEQ ID NO: 326162 - RNA, 22 nt, Human
ccgaccccgaggcgucccgagg

SEQ ID NO: 326163 - RNA, 20 nt, Human
ccgcagccggagcccgaccc

SEQ ID NO: 326164 - RNA, 26 nt, Human
ccgcagccggagcccgaccccgaggc

SEQ ID NO: 326165 - RNA, 22 nt, Human
ccucccaaaggaugagggugag

SEQ ID NO: 326166 - RNA, 20 nt, Human
ccucccaugcccacccaccc

SEQ ID NO: 326167 - RNA, 23 nt, Human
ccuccccaggcaaaguuggcaga

SEQ ID NO: 326168 - RNA, 21 nt, Human
ccucuauaauccuggucuaga

SEQ ID NO: 326169 - RNA, 29 nt, Human
ccugaaaacuccuucaucugccaggcacu

SEQ ID NO: 326170 - RNA, 22 nt, Human
ccuguugcacuagggcaggggc

SEQ ID NO: 326171 - RNA, 21 nt, Human
cgaccccgaggcgucccgagg

SEQ ID NO: 326172 - RNA, 22 nt, Human
cgccgcagcagcagccgcagcc

SEQ ID NO: 326173 - RNA, 23 nt, Human
cuccagggcccaccccuaccucc

SEQ ID NO: 326174 - RNA, 21 nt, Human
cucccaugcccacccacccca

SEQ ID NO: 326175 - RNA, 23 nt, Human
cuccccacaaacccagcucaucc

SEQ ID NO: 326176 - RNA, 25 nt, Human
cuccccacaaacccagcucauccca

SEQ ID NO: 326177 - RNA, 24 nt, Human
cugcaauuacauauaaaagccgcc

SEQ ID NO: 326178 - RNA, 25 nt, Human
gaaaaggagcugagggcgcacggcg

SEQ ID NO: 326179 - RNA, 19 nt, Human
gaggacucacuugcugugu

SEQ ID NO: 326180 - RNA, 21 nt, Human
gcagaguuggacccggucaag

SEQ ID NO: 326181 - RNA, 20 nt, Human
gcccagaguggggaggacuc

SEQ ID NO: 326182 - RNA, 18 nt, Human
gcccaggaggacagggau

SEQ ID NO: 326183 - RNA, 23 nt, Human
gcgccgcagcagcagccgcagcc

SEQ ID NO: 326184 - RNA, 20 nt, Human
gcucaaagcccuagucgccc

SEQ ID NO: 326185 - RNA, 24 nt, Human
ggagagaaggguggggaagacgug

SEQ ID NO: 326186 - RNA, 20 nt, Human
gggaaacugcccagcucaaa

SEQ ID NO: 326187 - RNA, 19 nt, Human
gggaagacgugggucuggg

SEQ ID NO: 326188 - RNA, 24 nt, Human
guggggaagacgugggucuggguc

SEQ ID NO: 326189 - RNA, 27 nt, Human
uaaggaacuccccacaaacccagcuca

SEQ ID NO: 326190 - RNA, 27 nt, Human
ucagaccucagcaaugccuguugcacu

SEQ ID NO: 326191 - RNA, 23 nt, Human
ucagugugcacaagcccagagug

SEQ ID NO: 326192 - RNA, 21 nt, Human
uccagggcccaccccuaccuc

SEQ ID NO: 326193 - RNA, 20 nt, Human
ucccaagccuagcccuccca

SEQ ID NO: 326194 - RNA, 19 nt, Human
uccccacaaacccagcuca

SEQ ID NO: 326195 - RNA, 23 nt, Human
uccucaucuccagggcccacccc

SEQ ID NO: 326196 - RNA, 19 nt, Human
ucgcccaguuuggguccaa

SEQ ID NO: 326197 - RNA, 21 nt, Human
ugaggaaaggagagaagggug

SEQ ID NO: 326198 - RNA, 18 nt, Human
ugaggaagaggaggaaag

SEQ ID NO: 326199 - RNA, 19 nt, Human
ugagggugaggaagaggag

SEQ ID NO: 326200 - RNA, 21 nt, Human
ugagggugaggaagaggagga

SEQ ID NO: 326201 - RNA, 26 nt, Human
ugcauacaaaaagggcgguuuauaua

SEQ ID NO: 326202 - RNA, 23 nt, Human
ugcccacccaccccacgcugcaa

SEQ ID NO: 326203 - RNA, 18 nt, Human
ugcccaggccauccugag

SEQ ID NO: 326204 - RNA, 18 nt, Human
ugggucagugugcacaag

SEQ ID NO: 326205 - RNA, 23 nt, Human
uuaggaugaggaaaggagagaag

SEQ ID NO: 326206 - RNA, 20 nt, Human
uuggcagaugaguggcagag

SEQ ID NO: 326207 - RNA, 25 nt, Human
aaaaagaaagcgagaguucagggac

SEQ ID NO: 326208 - RNA, 23 nt, Human
aaacaggccaaaaaaaauaaaca

SEQ ID NO: 326209 - RNA, 28 nt, Human
aaauacaaacaaauuuccuuuuuaaagu

SEQ ID NO: 326210 - RNA, 21 nt, Human
aacaggccaaaaaaaauaaac

SEQ ID NO: 326211 - RNA, 22 nt, Human
acaaauuuccuuuuuaaaguac

SEQ ID NO: 326212 - RNA, 22 nt, Human
acaccacaaguaaagucagaag

SEQ ID NO: 326213 - RNA, 21 nt, Human
accaucucauacaaaccaacu

SEQ ID NO: 326214 - RNA, 23 nt, Human
acccuaacaauauguacaaaaau

SEQ ID NO: 326215 - RNA, 26 nt, Human
agacaaaaaaggaaaaaaagggaccc

SEQ ID NO: 326216 - RNA, 19 nt, Human
aggaacaaugcaaagaugg

SEQ ID NO: 326217 - RNA, 24 nt, Human
aggccaaaaaaaauaaacagcaac

SEQ ID NO: 326218 - RNA, 21 nt, Human
aggcgcgcggcggaggcggcu

SEQ ID NO: 326219 - RNA, 22 nt, Human
auaaacagcaacuucauagaca

SEQ ID NO: 326220 - RNA, 24 nt, Human
caaaaaaaauaaacagcaacuuca

SEQ ID NO: 326221 - RNA, 23 nt, Human
caaaccaacuacuuauaguacag

SEQ ID NO: 326222 - RNA, 23 nt, Human
caagguuuuuuuucuccuuugag

SEQ ID NO: 326223 - RNA, 23 nt, Human
cauacaaaccaacuacuuauagu

SEQ ID NO: 326224 - RNA, 18 nt, Human
cucaugguuuggguuggg

SEQ ID NO: 326225 - RNA, 19 nt, Human
gaguccgcggcggcggagg

SEQ ID NO: 326226 - RNA, 21 nt, Human
gaugcaggggauuaaaaagaa

SEQ ID NO: 326227 - RNA, 18 nt, Human
gcgcgcggcggaggcggc

SEQ ID NO: 326228 - RNA, 20 nt, Human
gcggcggaggcggcugcggc

SEQ ID NO: 326229 - RNA, 18 nt, Human
gcggcggcggaggaggcg

SEQ ID NO: 326230 - RNA, 24 nt, Human
gcugguuuggucauccgagaucau

SEQ ID NO: 326231 - RNA, 24 nt, Human
ggucauccgagaucauuaaaaaug

SEQ ID NO: 326232 - RNA, 21 nt, Human
ggugggcgggcgggccucucu

SEQ ID NO: 326233 - RNA, 19 nt, Human
guaggacagagaacgcucc

SEQ ID NO: 326234 - RNA, 23 nt, Human
guaggacagagaacgcuccgaag

SEQ ID NO: 326235 - RNA, 21 nt, Human
uaaaaagaaagcgagaguuca

SEQ ID NO: 326236 - RNA, 26 nt, Human
uacaaacaaauuuccuuuuuaaagua

SEQ ID NO: 326237 - RNA, 26 nt, Human
uacauacacaaaaaaguuacuggaau

SEQ ID NO: 326238 - RNA, 24 nt, Human
uagacaaaaaaggaaaaaaaaaga

SEQ ID NO: 326239 - RNA, 26 nt, Human
uaggucacggcggccuuuuuuuuuuu

SEQ ID NO: 326240 - RNA, 18 nt, Human
ucacaccacaaguaaagu

SEQ ID NO: 326241 - RNA, 23 nt, Human
ucauagacaaaaaaggaaaaaaa

SEQ ID NO: 326242 - RNA, 20 nt, Human
ucucaugguuuggguugggu

SEQ ID NO: 326243 - RNA, 18 nt, Human
ugaauaggucacggcggc

SEQ ID NO: 326244 - RNA, 19 nt, Human
ugccggaguccgcggcggc

SEQ ID NO: 326245 - RNA, 19 nt, Human
ugccggaguccgcggcggc

SEQ ID NO: 326246 - RNA, 24 nt, Human
uggaaguuuugguucuuuuuuccu

SEQ ID NO: 326247 - RNA, 20 nt, Human
uggaaugcucggaauaagau

SEQ ID NO: 326248 - RNA, 24 nt, Human
uguaaauaaaaaauacaaacaaau

SEQ ID NO: 326249 - RNA, 27 nt, Human
uguaaauaaaaaauacaaacaaauuuc

SEQ ID NO: 326250 - RNA, 25 nt, Human
uuguuggacaacauuguuucacaca

SEQ ID NO: 326251 - RNA, 22 nt, Human
uuuagauucugagacgggaagu

SEQ ID NO: 326252 - RNA, 23 nt, Human
uuugguucuuuuuuccuccccug

SEQ ID NO: 326253 - RNA, 18 nt, Human
uuuuuuuuuuuuuuucug

SEQ ID NO: 326254 - RNA, 22 nt, Human
uuuuuuuuuuuuuuuuucuguu

SEQ ID NO: 326255 - RNA, 18 nt, Human
aaagaagaggguggcagc

SEQ ID NO: 326256 - RNA, 19 nt, Human
acacggcagcggcggccgc

SEQ ID NO: 326257 - RNA, 18 nt, Human
acccccaccuccagcccu

SEQ ID NO: 326258 - RNA, 19 nt, Human
agaagaggguggcagcucu

SEQ ID NO: 326259 - RNA, 23 nt, Human
agaagaggguggcagcucucggu

SEQ ID NO: 326260 - RNA, 23 nt, Human
agagagcaaagagagagaggagc

SEQ ID NO: 326261 - RNA, 22 nt, Human
agcuguggggcucggcaacccc

SEQ ID NO: 326262 - RNA, 19 nt, Human
aggcggcagaggcgcgcgg

SEQ ID NO: 326263 - RNA, 25 nt, Human
aggcggugccggcgcgcucggcgcg

SEQ ID NO: 326264 - RNA, 18 nt, Human
agggagaaagagagcaaa

SEQ ID NO: 326265 - RNA, 22 nt, Human
agggagccaggugaagaguggc

SEQ ID NO: 326266 - RNA, 19 nt, Human
agggaggggaggggggcag

SEQ ID NO: 326267 - RNA, 22 nt, Human
agggaggggaggggggcagcuc

SEQ ID NO: 326268 - RNA, 21 nt, Human
agggcccagagcagggagcca

SEQ ID NO: 326269 - RNA, 19 nt, Human
augacgcugggggaugcag

SEQ ID NO: 326270 - RNA, 20 nt, Human
caaaaagggaggggaggggg

SEQ ID NO: 326271 - RNA, 18 nt, Human
caaagagagagaggagca

SEQ ID NO: 326272 - RNA, 19 nt, Human
caaccccggccccaccccg

SEQ ID NO: 326273 - RNA, 23 nt, Human
caaccccggccccaccccggccu

SEQ ID NO: 326274 - RNA, 23 nt, Human
cacccccaccuccagcccagaga

SEQ ID NO: 326275 - RNA, 22 nt, Human
caccuccagcccagagaggccu

SEQ ID NO: 326276 - RNA, 21 nt, Human
cagggcccagagcagggagcc

SEQ ID NO: 326277 - RNA, 24 nt, Human
ccagagcagggagccaggugaaga

SEQ ID NO: 326278 - RNA, 20 nt, Human
cccaacccagccuguuggcc

SEQ ID NO: 326279 - RNA, 21 nt, Human
cccacccccaccuccagccca

SEQ ID NO: 326280 - RNA, 21 nt, Human
cccagagaggccucccaaccc

SEQ ID NO: 326281 - RNA, 18 nt, Human
cccccacccccaccucca

SEQ ID NO: 326282 - RNA, 22 nt, Human
cccccacccccaccuccagccc

SEQ ID NO: 326283 - RNA, 22 nt, Human
cccggggccgagacggagaggc

SEQ ID NO: 326284 - RNA, 19 nt, Human
cccuggacggcggagggug

SEQ ID NO: 326285 - RNA, 23 nt, Human
ccggagggcgggcggaagggcgg

SEQ ID NO: 326286 - RNA, 23 nt, Human
ccggggccggggccggggcuggc

SEQ ID NO: 326287 - RNA, 27 nt, Human
ccuccagcccagagaggccucccaacc

SEQ ID NO: 326288 - RNA, 26 nt, Human
ccucccaacccagccuguuggcaggc

SEQ ID NO: 326289 - RNA, 21 nt, Human
ccuggcgcgguggcggcggcg

SEQ ID NO: 326290 - RNA, 21 nt, Human
cgcgguggcggcggcggcggc

SEQ ID NO: 326291 - RNA, 18 nt, Human
gagaaagagagcaaagag

SEQ ID NO: 326292 - RNA, 18 nt, Human
gagaggcccuggacggcg

SEQ ID NO: 326293 - RNA, 21 nt, Human
gagggagaaagagagcaaaga

SEQ ID NO: 326294 - RNA, 22 nt, Human
gagggagaaagagagcaaagag

SEQ ID NO: 326295 - RNA, 19 nt, Human
gcaaagagagagaggagca

SEQ ID NO: 326296 - RNA, 21 nt, Human
gcccccacccccaccuccagc

SEQ ID NO: 326297 - RNA, 20 nt, Human
gccggaaccuggcgcggugg

SEQ ID NO: 326298 - RNA, 25 nt, Human
gcggcggcggcggcgacacggcagc

SEQ ID NO: 326299 - RNA, 20 nt, Human
gcgguggcggcggcggcggc

SEQ ID NO: 326300 - RNA, 20 nt, Human
gcuggggagaaagaagaggg

SEQ ID NO: 326301 - RNA, 19 nt, Human
gcugucugagaagagggga

SEQ ID NO: 326302 - RNA, 24 nt, Human
ggaaaugagaaggcuggggagaaa

SEQ ID NO: 326303 - RNA, 28 nt, Human
ggagaagaaugaggcugguaggggaggg

SEQ ID NO: 326304 - RNA, 23 nt, Human
ggagggagaaagagagcaaagag

SEQ ID NO: 326305 - RNA, 19 nt, Human
ggaggggaggggggcagcu

SEQ ID NO: 326306 - RNA, 19 nt, Human
ggaggggaggggggcagcu

SEQ ID NO: 326307 - RNA, 27 nt, Human
ggaggggaggggggcagcuguggggcu

SEQ ID NO: 326308 - RNA, 24 nt, Human
ggcaaccccggccccaccccggcc

SEQ ID NO: 326309 - RNA, 21 nt, Human
ggccggggccggggcuggcgg

SEQ ID NO: 326310 - RNA, 18 nt, Human
ggcgcgcgggguggggcg

SEQ ID NO: 326311 - RNA, 22 nt, Human
ggcgcgguggcggcggcggcgg

SEQ ID NO: 326312 - RNA, 18 nt, Human
ggcgggcggaagggcggu

SEQ ID NO: 326313 - RNA, 23 nt, Human
ggcggggaggcggggucccgggg

SEQ ID NO: 326314 - RNA, 18 nt, Human
gggaggggaggggggcag

SEQ ID NO: 326315 - RNA, 22 nt, Human
gggaggggaggggggcagcugu

SEQ ID NO: 326316 - RNA, 20 nt, Human
gggaggggggcagcuguggg

SEQ ID NO: 326317 - RNA, 20 nt, Human
gggaggggggcagcuguggg

SEQ ID NO: 326318 - RNA, 19 nt, Human
gggcagcuguggggcucgg

SEQ ID NO: 326319 - RNA, 20 nt, Human
gggccggggccggggcuggc

SEQ ID NO: 326320 - RNA, 25 nt, Human
gggccggggccggggcuggcgggga

SEQ ID NO: 326321 - RNA, 21 nt, Human
ggggaggggggcagcuguggg

SEQ ID NO: 326322 - RNA, 20 nt, Human
guggcggcggcggcggcgac

SEQ ID NO: 326323 - RNA, 18 nt, Human
uacaaaaagggaggggag

SEQ ID NO: 326324 - RNA, 22 nt, Human
ucaggagguggaacaauggcag

SEQ ID NO: 326325 - RNA, 22 nt, Human
ugacgcugggggaugcagaggu

SEQ ID NO: 326326 - RNA, 19 nt, Human
ugagggagauccagggauc

SEQ ID NO: 326327 - RNA, 23 nt, Human
ugagggagauccagggaucaggc

SEQ ID NO: 326328 - RNA, 23 nt, Human
ugaggguggagggcgcagugucu

SEQ ID NO: 326329 - RNA, 22 nt, Human
ugcccccacccccaccuccagc

SEQ ID NO: 326330 - RNA, 24 nt, Human
ugcccccacccccaccuccagccc

SEQ ID NO: 326331 - RNA, 23 nt, Human
uggaacaauggcagagugagggu

SEQ ID NO: 326332 - RNA, 19 nt, Human
uggcggcggcggcggcgac

SEQ ID NO: 326333 - RNA, 23 nt, Human
uggcggcggcggcggcgacacgg

SEQ ID NO: 326334 - RNA, 22 nt, Human
uggcuggacuuggcugccccca

SEQ ID NO: 326335 - RNA, 18 nt, Human
ugggagaggcuaccggag

SEQ ID NO: 326336 - RNA, 20 nt, Human
uggggcaggacaugacgcug

SEQ ID NO: 326337 - RNA, 18 nt, Human
uggggcgggggugggucu

SEQ ID NO: 326338 - RNA, 20 nt, Human
ugguaggggagggagaaaga

SEQ ID NO: 326339 - RNA, 23 nt, Human
uuaggugggagaggcuaccggag

SEQ ID NO: 326340 - RNA, 21 nt, Human
uuauacaaaaagggaggggag

SEQ ID NO: 326341 - RNA, 18 nt, Human
aaaaaaaaaaaaagucaa

SEQ ID NO: 326342 - RNA, 20 nt, Human
aacaagagaaguaguuuaca

SEQ ID NO: 326343 - RNA, 23 nt, Human
aagaaaacaaaugcuucugccaa

SEQ ID NO: 326344 - RNA, 21 nt, Human
auuauaagccccuacugguac

SEQ ID NO: 326345 - RNA, 23 nt, Human
cagaaaacaagauauuuucuuca

SEQ ID NO: 326346 - RNA, 27 nt, Human
cauagucauaacauuuaaauugcugcc

SEQ ID NO: 326347 - RNA, 21 nt, Human
caucaagaaaacaaaugcuuc

SEQ ID NO: 326348 - RNA, 24 nt, Human
cauuuaaaaaacgcuacuacaaaa

SEQ ID NO: 326349 - RNA, 25 nt, Human
ccccucucuccacuuuggauuuucc

SEQ ID NO: 326350 - RNA, 22 nt, Human
ccgccuucuggacggaugacuc

SEQ ID NO: 326351 - RNA, 24 nt, Human
ccgcugaguccagguacccggcuc

SEQ ID NO: 326352 - RNA, 19 nt, Human
ccgcugcugcucuccccgc

SEQ ID NO: 326353 - RNA, 23 nt, Human
cgagggagggagagcgcuuugca

SEQ ID NO: 326354 - RNA, 21 nt, Human
cgcugaguccagguacccggc

SEQ ID NO: 326355 - RNA, 23 nt, Human
cggaugacucacuggucucuuuc

SEQ ID NO: 326356 - RNA, 23 nt, Human
cgggccaggaggacgaaggcugg

SEQ ID NO: 326357 - RNA, 21 nt, Human
cugcucuggggcucucuuggc

SEQ ID NO: 326358 - RNA, 22 nt, Human
cugcugcucuccccgccuucug

SEQ ID NO: 326359 - RNA, 21 nt, Human
cugcuugggccgcugcugcuc

SEQ ID NO: 326360 - RNA, 20 nt, Human
cuuucuuccccucucuccac

SEQ ID NO: 326361 - RNA, 20 nt, Human
gaaaaauaauuucaucaaga

SEQ ID NO: 326362 - RNA, 18 nt, Human
gaacggaagggaaaugga

SEQ ID NO: 326363 - RNA, 22 nt, Human
gagaaugggagggaugagagga

SEQ ID NO: 326364 - RNA, 21 nt, Human
gauuuuuggacuggaaggcgg

SEQ ID NO: 326365 - RNA, 18 nt, Human
gccgcugcugcucucccc

SEQ ID NO: 326366 - RNA, 19 nt, Human
gcucuggggcucucuuggc

SEQ ID NO: 326367 - RNA, 24 nt, Human
ggaaaaaaaucuaggugaaaaaaa

SEQ ID NO: 326368 - RNA, 21 nt, Human
ggaaauggagaaugggaggga

SEQ ID NO: 326369 - RNA, 19 nt, Human
ggacaugcucugcuucccc

SEQ ID NO: 326370 - RNA, 21 nt, Human
ggacgaaggcugggcgaggga

SEQ ID NO: 326371 - RNA, 19 nt, Human
ggagggagagcgcuuugca

SEQ ID NO: 326372 - RNA, 25 nt, Human
gggaaaaaaaucuaggugaaaaaaa

SEQ ID NO: 326373 - RNA, 20 nt, Human
gggaacggaagggaaaugga

SEQ ID NO: 326374 - RNA, 21 nt, Human
uaggugaaaaaaauuaccuaa

SEQ ID NO: 326375 - RNA, 25 nt, Human
uaguauuuuuuuccucagauggaaa

SEQ ID NO: 326376 - RNA, 18 nt, Human
uauuggcagaaaacaaga

SEQ ID NO: 326377 - RNA, 21 nt, Human
ucaaaaaacuuaccucaauug

SEQ ID NO: 326378 - RNA, 20 nt, Human
ucagauggaaaaauaauuuc

SEQ ID NO: 326379 - RNA, 20 nt, Human
ucauuuaucauguacuauaa

SEQ ID NO: 326380 - RNA, 20 nt, Human
uccagguacccggcucgcug

SEQ ID NO: 326381 - RNA, 21 nt, Human
uccugcuugggccgcugcugc

SEQ ID NO: 326382 - RNA, 20 nt, Human
ucucuuucuuccccucucuc

SEQ ID NO: 326383 - RNA, 23 nt, Human
ucuuuaaaaaaaaaaaaagucaa

SEQ ID NO: 326384 - RNA, 21 nt, Human
ucuuuucuuuuuguuuuugcu

SEQ ID NO: 326385 - RNA, 23 nt, Human
ucuuuuuguuuuugcuuauugug

SEQ ID NO: 326386 - RNA, 19 nt, Human
ugaauacaaagccuacggu

SEQ ID NO: 326387 - RNA, 25 nt, Human
ugacucacuggucucuuucuucccc

SEQ ID NO: 326388 - RNA, 22 nt, Human
ugagaggagcgggccaggagga

SEQ ID NO: 326389 - RNA, 18 nt, Human
ugcccaaaaaauguaaaa

SEQ ID NO: 326390 - RNA, 22 nt, Human
ugccuuugacucaauuacgccc

SEQ ID NO: 326391 - RNA, 20 nt, Human
ugcucugcuuccccaccccc

SEQ ID NO: 326392 - RNA, 20 nt, Human
ugcucugcuuccccaccccc

SEQ ID NO: 326393 - RNA, 19 nt, Human
ugcuugggccgcugcugcu

SEQ ID NO: 326394 - RNA, 23 nt, Human
uggagaaugggagggaugagagg

SEQ ID NO: 326395 - RNA, 19 nt, Human
ugggaaaaaaaucuaggug

SEQ ID NO: 326396 - RNA, 19 nt, Human
ugggagggaugagaggagc

SEQ ID NO: 326397 - RNA, 20 nt, Human
ugggagggaugagaggagcg

SEQ ID NO: 326398 - RNA, 22 nt, Human
ugggcgagggagggagagcgcu

SEQ ID NO: 326399 - RNA, 22 nt, Human
uugcugacuacauuuuaaaaaa

SEQ ID NO: 326400 - RNA, 24 nt, Human
uugcugacuacauuuuaaaaaauc

SEQ ID NO: 326401 - RNA, 26 nt, Human
uuuaaaaaaucuauuggcagaaaaca

SEQ ID NO: 326402 - RNA, 21 nt, Human
uuuucuuuucuuuuuguuuuu

SEQ ID NO: 326403 - RNA, 19 nt, Human
aaaaaaaaaaagccaacua

SEQ ID NO: 326404 - RNA, 23 nt, Human
aaaaaaaaagccaacuauuucug

SEQ ID NO: 326405 - RNA, 22 nt, Human
aaaaaagccaacuauuucugag

SEQ ID NO: 326406 - RNA, 22 nt, Human
aaaaagacaggagauuucaaaa

SEQ ID NO: 326407 - RNA, 22 nt, Human
aaaaagacaggagauuucaaaa

SEQ ID NO: 326408 - RNA, 19 nt, Human
aaaaaugcuacuacaccgc

SEQ ID NO: 326409 - RNA, 22 nt, Human
aaaauaaaaacaaaacaaaagg

SEQ ID NO: 326410 - RNA, 23 nt, Human
aaaaugcugugcugagccuggcc

SEQ ID NO: 326411 - RNA, 19 nt, Human
aaacuccagcauaggaaau

SEQ ID NO: 326412 - RNA, 19 nt, Human
aaacuggcuucagcuagca

SEQ ID NO: 326413 - RNA, 23 nt, Human
aacagcgaugacuucgcgcagcc

SEQ ID NO: 326414 - RNA, 20 nt, Human
aacccagccaagaaucugca

SEQ ID NO: 326415 - RNA, 27 nt, Human
aacuacauacaaaacuuaagcagccuu

SEQ ID NO: 326416 - RNA, 22 nt, Human
aacugccuuccacaaaggagcu

SEQ ID NO: 326417 - RNA, 22 nt, Human
aagaaaaaaauugcuuuaagga

SEQ ID NO: 326418 - RNA, 25 nt, Human
aagauaagcaaaguauuuagaaucc

SEQ ID NO: 326419 - RNA, 21 nt, Human
aagcaaaguauuuagaaucca

SEQ ID NO: 326420 - RNA, 19 nt, Human
aagcaacacagucccuuca

SEQ ID NO: 326421 - RNA, 19 nt, Human
aagcauaauggaagagugu

SEQ ID NO: 326422 - RNA, 18 nt, Human
aagcauuucucaagucga

SEQ ID NO: 326423 - RNA, 23 nt, Human
aagcauuucucaagucgaaaaua

SEQ ID NO: 326424 - RNA, 21 nt, Human
acaaaaaaagggaaaaaaaaa

SEQ ID NO: 326425 - RNA, 23 nt, Human
acaauacacacacacacacacac

SEQ ID NO: 326426 - RNA, 31 nt, Human
acacaauacacacacacacacacacacacag

SEQ ID NO: 326427 - RNA, 31 nt, Human
acacacaauacacacacacacacacacacag

SEQ ID NO: 326428 - RNA, 31 nt, Human
acacacacaauacacacacacacacacacag

SEQ ID NO: 326429 - RNA, 28 nt, Human
acacacacacacacacaauacacacaca

SEQ ID NO: 326430 - RNA, 23 nt, Human
acacacacacacacacacacaca

SEQ ID NO: 326431 - RNA, 23 nt, Human
acacacacacacacacacacaca

SEQ ID NO: 326432 - RNA, 23 nt, Human
acacacacacacacacacacaca

SEQ ID NO: 326433 - RNA, 23 nt, Human
acacacacacacacacacacaca

SEQ ID NO: 326434 - RNA, 23 nt, Human
acacacacacacacacccccucc

SEQ ID NO: 326435 - RNA, 21 nt, Human
acacacacacccccucccccc

SEQ ID NO: 326436 - RNA, 18 nt, Human
acacccccuccccccaaa

SEQ ID NO: 326437 - RNA, 18 nt, Human
acacccggcccggcccgg

SEQ ID NO: 326438 - RNA, 18 nt, Human
acacuaaacccagccaag

SEQ ID NO: 326439 - RNA, 31 nt, Human
acacugcgcgugcacacacacacacacacag

SEQ ID NO: 326440 - RNA, 20 nt, Human
acaucuuuauugauggccug

SEQ ID NO: 326441 - RNA, 20 nt, Human
acauuaaaaagaccacuaaa

SEQ ID NO: 326442 - RNA, 21 nt, Human
accaacccucccccacaaaaa

SEQ ID NO: 326443 - RNA, 20 nt, Human
acuccaaaacuaggagcaaa

SEQ ID NO: 326444 - RNA, 21 nt, Human
acugauggacacugcgcgugc

SEQ ID NO: 326445 - RNA, 22 nt, Human
agagccccugauggugccccuc

SEQ ID NO: 326446 - RNA, 20 nt, Human
aggagaggaaggaaaaaaga

SEQ ID NO: 326447 - RNA, 20 nt, Human
aggcaguucacauagccggg

SEQ ID NO: 326448 - RNA, 18 nt, Human
auauaccaccaacccucc

SEQ ID NO: 326449 - RNA, 22 nt, Human
aucauuaggagagugguugagg

SEQ ID NO: 326450 - RNA, 22 nt, Human
aucauuaggagagugguugagg

SEQ ID NO: 326451 - RNA, 23 nt, Human
augcagccugaucauaacugccu

SEQ ID NO: 326452 - RNA, 20 nt, Human
auggacacugcgcgugcaca

SEQ ID NO: 326453 - RNA, 24 nt, Human
auuaaaaaaaaaaaaaagccaacu

SEQ ID NO: 326454 - RNA, 26 nt, Human
auuaaaaaaaaaaaaaagccaacuau

SEQ ID NO: 326455 - RNA, 20 nt, Human
caaaacaaaaggcucuuggc

SEQ ID NO: 326456 - RNA, 20 nt, Human
caaacuccaaaacuaggagc

SEQ ID NO: 326457 - RNA, 20 nt, Human
caaacuccaaaacuaggagc

SEQ ID NO: 326458 - RNA, 23 nt, Human
caacccucccccacaaaaaaagg

SEQ ID NO: 326459 - RNA, 21 nt, Human
caagaaucugcaaaaaugcua

SEQ ID NO: 326460 - RNA, 25 nt, Human
caaguccuaaaauaaaaauuuuaag

SEQ ID NO: 326461 - RNA, 18 nt, Human
caagucgaaaauauguga

SEQ ID NO: 326462 - RNA, 19 nt, Human
caauccuggcagaaauuca

SEQ ID NO: 326463 - RNA, 19 nt, Human
caauccuggcagaaauuca

SEQ ID NO: 326464 - RNA, 27 nt, Human
cacaaaaaaagggaaaaaaaaaauccc

SEQ ID NO: 326465 - RNA, 23 nt, Human
cacacacacaauacacacacaca

SEQ ID NO: 326466 - RNA, 18 nt, Human
cacacacacacacacaca

SEQ ID NO: 326467 - RNA, 20 nt, Human
cacacacacacacacacaca

SEQ ID NO: 326468 - RNA, 20 nt, Human
cacacacacacacacacaca

SEQ ID NO: 326469 - RNA, 20 nt, Human
cacacacacacacacacaca

SEQ ID NO: 326470 - RNA, 20 nt, Human
cacacacacacacacacaca

SEQ ID NO: 326471 - RNA, 20 nt, Human
cacacacacacacacacaca

SEQ ID NO: 326472 - RNA, 26 nt, Human
cacacacacacacacacacacacaca

SEQ ID NO: 326473 - RNA, 26 nt, Human
cacacacacacacacacacacacaca

SEQ ID NO: 326474 - RNA, 30 nt, Human
cacacacacacacacacacacacacacccu

SEQ ID NO: 326475 - RNA, 24 nt, Human
cacacacacacacacacacacacc

SEQ ID NO: 326476 - RNA, 21 nt, Human
cacacacccccuccccccaaa

SEQ ID NO: 326477 - RNA, 26 nt, Human
cacacacccccuccccccaaacaaca

SEQ ID NO: 326478 - RNA, 21 nt, Human
cacacccccuccccccaaaca

SEQ ID NO: 326479 - RNA, 25 nt, Human
cacacccccuccccccaaacaacaa

SEQ ID NO: 326480 - RNA, 22 nt, Human
caccaacccucccccacaaaaa

SEQ ID NO: 326481 - RNA, 22 nt, Human
cacccccuccccccaaacaaca

SEQ ID NO: 326482 - RNA, 22 nt, Human
cagaaaacauuaaaaagaccac

SEQ ID NO: 326483 - RNA, 23 nt, Human
cagcagaaaacauuaaaaagaag

SEQ ID NO: 326484 - RNA, 20 nt, Human
caggcaggcacugauacuga

SEQ ID NO: 326485 - RNA, 22 nt, Human
caucaguaaagacuaaaaacca

SEQ ID NO: 326486 - RNA, 21 nt, Human
ccaacccucccccacaaaaaa

SEQ ID NO: 326487 - RNA, 26 nt, Human
cccagccucggcgcgcgacacccggc

SEQ ID NO: 326488 - RNA, 23 nt, Human
cccccaaacaacaaaauucagag

SEQ ID NO: 326489 - RNA, 21 nt, Human
cccccacaaaaaaagggaaaa

SEQ ID NO: 326490 - RNA, 21 nt, Human
cccccacaaaaaaagggaaaa

SEQ ID NO: 326491 - RNA, 22 nt, Human
cccccuccccccaaacaacaaa

SEQ ID NO: 326492 - RNA, 21 nt, Human
cccggcccggcggcggcggcg

SEQ ID NO: 326493 - RNA, 22 nt, Human
ccgccacccccaccgcucucga

SEQ ID NO: 326494 - RNA, 18 nt, Human
ccgccgcugcccuguggc

SEQ ID NO: 326495 - RNA, 21 nt, Human
ccgccgcugccgcuccagccg

SEQ ID NO: 326496 - RNA, 25 nt, Human
ccgccgcugccgcuccagccgcucc

SEQ ID NO: 326497 - RNA, 20 nt, Human
ccgccgcugccuccgcugcc

SEQ ID NO: 326498 - RNA, 23 nt, Human
ccgccgcugccuccgcugccgcc

SEQ ID NO: 326499 - RNA, 25 nt, Human
ccgccgcugccuccgcugccgccgg

SEQ ID NO: 326500 - RNA, 27 nt, Human
ccgccgcugcgucuccugcugccgccg

SEQ ID NO: 326501 - RNA, 21 nt, Human
ccgcugccgcuccagccgcuc

SEQ ID NO: 326502 - RNA, 24 nt, Human
ccgcugccuccgcugccgccgcug

SEQ ID NO: 326503 - RNA, 22 nt, Human
ccgcugcgucuccugcugccgc

SEQ ID NO: 326504 - RNA, 19 nt, Human
ccggcccggcggcggcggc

SEQ ID NO: 326505 - RNA, 27 nt, Human
ccggcccggcggcggcggcggcggcga

SEQ ID NO: 326506 - RNA, 21 nt, Human
ccgucuugcugcugcugcugc

SEQ ID NO: 326507 - RNA, 23 nt, Human
ccuccccccaaacaacaaaauuc

SEQ ID NO: 326508 - RNA, 19 nt, Human
ccucgcgccgugcccggcc

SEQ ID NO: 326509 - RNA, 25 nt, Human
ccucuaaauggcacaaucaagucag

SEQ ID NO: 326510 - RNA, 25 nt, Human
ccucuaaauggcacaaucaagucag

SEQ ID NO: 326511 - RNA, 22 nt, Human
ccugcugccgccgcugccuccg

SEQ ID NO: 326512 - RNA, 22 nt, Human
cgaggaggcgccucucuccuca

SEQ ID NO: 326513 - RNA, 19 nt, Human
cgccgcugccuccgcugcc

SEQ ID NO: 326514 - RNA, 23 nt, Human
cgccgugcccggccgccgcugcc

SEQ ID NO: 326515 - RNA, 24 nt, Human
cgccgugcccggccgccgcugccg

SEQ ID NO: 326516 - RNA, 29 nt, Human
cgcgccgugcccggccgccgcugccgcuc

SEQ ID NO: 326517 - RNA, 27 nt, Human
cgcgugcacacacacacacacacaaua

SEQ ID NO: 326518 - RNA, 19 nt, Human
cggcccggcccggcggcgg

SEQ ID NO: 326519 - RNA, 22 nt, Human
cggcccggcggcggcggcggcg

SEQ ID NO: 326520 - RNA, 21 nt, Human
cggccgccgcugcgucuccug

SEQ ID NO: 326521 - RNA, 19 nt, Human
cggcgacgacuccccccca

SEQ ID NO: 326522 - RNA, 18 nt, Human
cggcggcggcggcggcgg

SEQ ID NO: 326523 - RNA, 19 nt, Human
cggcggcggcggcggcggc

SEQ ID NO: 326524 - RNA, 18 nt, Human
cggcgguagcgguggcgg

SEQ ID NO: 326525 - RNA, 19 nt, Human
cgguggcggcggcggcgac

SEQ ID NO: 326526 - RNA, 19 nt, Human
cuaaacccagccaagaauc

SEQ ID NO: 326527 - RNA, 23 nt, Human
cuaauguucugcugguuuuccuu

SEQ ID NO: 326528 - RNA, 22 nt, Human
cucagaaucgccauaaaugugc

SEQ ID NO: 326529 - RNA, 26 nt, Human
cuccaaaaaauccaacuacauacaaa

SEQ ID NO: 326530 - RNA, 23 nt, Human
cuccgcugccgccgcugcccugu

SEQ ID NO: 326531 - RNA, 18 nt, Human
cuccucagucaccucggc

SEQ ID NO: 326532 - RNA, 25 nt, Human
cucggcggcggcggcggcggcggua

SEQ ID NO: 326533 - RNA, 20 nt, Human
cucuuucucuuuucuuaaac

SEQ ID NO: 326534 - RNA, 21 nt, Human
cugcacagcaaauuccagcag

SEQ ID NO: 326535 - RNA, 19 nt, Human
cugccgccgcugccuccgc

SEQ ID NO: 326536 - RNA, 24 nt, Human
cugccuccgcugccgccgcugccc

SEQ ID NO: 326537 - RNA, 24 nt, Human
cugccuccgcugccgccgcugccc

SEQ ID NO: 326538 - RNA, 18 nt, Human
cugcuguuuuuuuggugu

SEQ ID NO: 326539 - RNA, 26 nt, Human
cuucaagauaagcaaaguauuuagaa

SEQ ID NO: 326540 - RNA, 22 nt, Human
gaaaaacagcuuuucuagauca

SEQ ID NO: 326541 - RNA, 20 nt, Human
gaaaacauuaaaaagaccac

SEQ ID NO: 326542 - RNA, 23 nt, Human
gaacacccuuucaucaguaaaga

SEQ ID NO: 326543 - RNA, 24 nt, Human
gaucgggggaaaagggagauguag

SEQ ID NO: 326544 - RNA, 22 nt, Human
gcagaaaaacagcuuuucuaga

SEQ ID NO: 326545 - RNA, 23 nt, Human
gccauuucuccacuaauuuauca

SEQ ID NO: 326546 - RNA, 20 nt, Human
gccgcugccgcuccagccgc

SEQ ID NO: 326547 - RNA, 22 nt, Human
gccuccgcugccgccgcugccc

SEQ ID NO: 326548 - RNA, 23 nt, Human
gccuccgcugccgccgcugcccu

SEQ ID NO: 326549 - RNA, 24 nt, Human
gcggcggcggcggcggcgguagcg

SEQ ID NO: 326550 - RNA, 26 nt, Human
gcgugcacacacacacacacacaaua

SEQ ID NO: 326551 - RNA, 22 nt, Human
gcuacuacaccgcuucacaagc

SEQ ID NO: 326552 - RNA, 19 nt, Human
gcugccagacugcacgcac

SEQ ID NO: 326553 - RNA, 23 nt, Human
ggaaaaauauaccaccaacccuc

SEQ ID NO: 326554 - RNA, 25 nt, Human
ggagaggaaggaaaaaagaggggaa

SEQ ID NO: 326555 - RNA, 19 nt, Human
ggagauguaggagaggaag

SEQ ID NO: 326556 - RNA, 18 nt, Human
ggcccggcccggcggcgg

SEQ ID NO: 326557 - RNA, 22 nt, Human
ggcccggcggcggcggcggcgg

SEQ ID NO: 326558 - RNA, 20 nt, Human
ggcggcggcggcggcggcgg

SEQ ID NO: 326559 - RNA, 22 nt, Human
ggcggcggcggcggcggcggua

SEQ ID NO: 326560 - RNA, 23 nt, Human
ggcgguagcgguggcggcggcgg

SEQ ID NO: 326561 - RNA, 19 nt, Human
gggaaagugaaaaaaaaaa

SEQ ID NO: 326562 - RNA, 20 nt, Human
gggagauguaggagaggaag

SEQ ID NO: 326563 - RNA, 26 nt, Human
guaggagaggaaggaaaaaagagggg

SEQ ID NO: 326564 - RNA, 19 nt, Human
guaggucacuuuccacuug

SEQ ID NO: 326565 - RNA, 19 nt, Human
guccggcgguggcgggagc

SEQ ID NO: 326566 - RNA, 23 nt, Human
guccgucuugcugcugcugcugc

SEQ ID NO: 326567 - RNA, 21 nt, Human
gucuccugcugccgccgcugc

SEQ ID NO: 326568 - RNA, 20 nt, Human
gugauggggaaagugaaaaa

SEQ ID NO: 326569 - RNA, 26 nt, Human
gugcacacacacacacacacaauaca

SEQ ID NO: 326570 - RNA, 18 nt, Human
guggcggcggcggcgacg

SEQ ID NO: 326571 - RNA, 24 nt, Human
guggcgucaccucgcgccgugccc

SEQ ID NO: 326572 - RNA, 21 nt, Human
guguaggucacuuuccacuug

SEQ ID NO: 326573 - RNA, 24 nt, Human
gugugauggggaaagugaaaaaaa

SEQ ID NO: 326574 - RNA, 24 nt, Human
uaaaaacaaaacaaaaggcucuug

SEQ ID NO: 326575 - RNA, 20 nt, Human
uaaaaggagggcuaauguuu

SEQ ID NO: 326576 - RNA, 23 nt, Human
uaaaaggagggcuaauguuucau

SEQ ID NO: 326577 - RNA, 21 nt, Human
uaaaauaaaaggagggcuaau

SEQ ID NO: 326578 - RNA, 21 nt, Human
uaaaugugcaacguauauucc

SEQ ID NO: 326579 - RNA, 24 nt, Human
uaagcaaaguauuuagaauccacu

SEQ ID NO: 326580 - RNA, 24 nt, Human
uaaggaaaaaaaauccaguuuuaa

SEQ ID NO: 326581 - RNA, 22 nt, Human
uacaaaacuuaagcagccuuua

SEQ ID NO: 326582 - RNA, 25 nt, Human
uacacacacacacacacacacacac

SEQ ID NO: 326583 - RNA, 26 nt, Human
uacagcaacaagggcuucuauuccau

SEQ ID NO: 326584 - RNA, 23 nt, Human
uaccaccaacccucccccacaaa

SEQ ID NO: 326585 - RNA, 22 nt, Human
uacuacaccgcuucacaagcaa

SEQ ID NO: 326586 - RNA, 18 nt, Human
uagcgguggcggcggcgg

SEQ ID NO: 326587 - RNA, 25 nt, Human
uagcugacgcuaacaaaaugggagg

SEQ ID NO: 326588 - RNA, 19 nt, Human
uagugcaagagccccugau

SEQ ID NO: 326589 - RNA, 23 nt, Human
uauaccaccaacccucccccaca

SEQ ID NO: 326590 - RNA, 20 nt, Human
uaucaaaauaaaaacaaaac

SEQ ID NO: 326591 - RNA, 27 nt, Human
uaucaaaauaaaaacaaaacaaaaggc

SEQ ID NO: 326592 - RNA, 22 nt, Human
uaugaagcuucucucuucaaga

SEQ ID NO: 326593 - RNA, 22 nt, Human
uauuaucaaucaguguuuucuc

SEQ ID NO: 326594 - RNA, 20 nt, Human
uauucagagcccuagaagca

SEQ ID NO: 326595 - RNA, 26 nt, Human
ucaaaacccaguggaaucaacaccau

SEQ ID NO: 326596 - RNA, 20 nt, Human
ucacauagccggucaacaug

SEQ ID NO: 326597 - RNA, 20 nt, Human
ucaccucggcggcggcggcg

SEQ ID NO: 326598 - RNA, 23 nt, Human
ucaguacacuaaacccagccaag

SEQ ID NO: 326599 - RNA, 25 nt, Human
uccaaaaaauccaacuacauacaaa

SEQ ID NO: 326600 - RNA, 23 nt, Human
uccaaauucaauuugggccucaa

SEQ ID NO: 326601 - RNA, 24 nt, Human
uccacuuguuuacuugaugcuuaa

SEQ ID NO: 326602 - RNA, 18 nt, Human
uccagauucacauuucca

SEQ ID NO: 326603 - RNA, 18 nt, Human
uccagauucacauuucca

SEQ ID NO: 326604 - RNA, 19 nt, Human
uccgcugccgccgcugccc

SEQ ID NO: 326605 - RNA, 22 nt, Human
uccgcugccgccgcugcccugu

SEQ ID NO: 326606 - RNA, 18 nt, Human
uccucagucaccucggcg

SEQ ID NO: 326607 - RNA, 24 nt, Human
uccugcugccgccgcugccuccgc

SEQ ID NO: 326608 - RNA, 23 nt, Human
ucuccugcugccgccgcugccuc

SEQ ID NO: 326609 - RNA, 23 nt, Human
ucugcacagcaaauuccagcagg

SEQ ID NO: 326610 - RNA, 19 nt, Human
ucugggauaaccacuuagc

SEQ ID NO: 326611 - RNA, 21 nt, Human
ucugggauaaccacuuagcuu

SEQ ID NO: 326612 - RNA, 23 nt, Human
ucuuaaacauuuuauucauuuua

SEQ ID NO: 326613 - RNA, 23 nt, Human
ucuuaaacauuuuauucauuuua

SEQ ID NO: 326614 - RNA, 21 nt, Human
ucuugcugcugcugcugcggc

SEQ ID NO: 326615 - RNA, 23 nt, Human
ucuugcugcugcugcugcggccg

SEQ ID NO: 326616 - RNA, 23 nt, Human
ugaaauguuucacagcagaaaac

SEQ ID NO: 326617 - RNA, 22 nt, Human
ugaagaaacuaacaugaacacc

SEQ ID NO: 326618 - RNA, 18 nt, Human
ugacacagguaauauucc

SEQ ID NO: 326619 - RNA, 18 nt, Human
ugacacagguaauauucc

SEQ ID NO: 326620 - RNA, 18 nt, Human
ugagaagagacuccucuu

SEQ ID NO: 326621 - RNA, 24 nt, Human
ugagacaaggucccggucuguucc

SEQ ID NO: 326622 - RNA, 19 nt, Human
ugagguaucaucaguguga

SEQ ID NO: 326623 - RNA, 21 nt, Human
ugaguacguaauauuuagagg

SEQ ID NO: 326624 - RNA, 18 nt, Human
ugaucauaacugccuucc

SEQ ID NO: 326625 - RNA, 26 nt, Human
ugcaauuaaaaaaaaaaaaaagccaa

SEQ ID NO: 326626 - RNA, 27 nt, Human
ugcaauuaaaaaaaaaaaaaagccaac

SEQ ID NO: 326627 - RNA, 20 nt, Human
ugcacacacacacacacaca

SEQ ID NO: 326628 - RNA, 20 nt, Human
ugcacgcacaucuacagcaa

SEQ ID NO: 326629 - RNA, 20 nt, Human
ugcccuguggcgucaccucg

SEQ ID NO: 326630 - RNA, 21 nt, Human
ugccuccgcugccgccgcugc

SEQ ID NO: 326631 - RNA, 21 nt, Human
ugcuccccaaacagaugguuu

SEQ ID NO: 326632 - RNA, 20 nt, Human
ugcugcugcugcugcggccg

SEQ ID NO: 326633 - RNA, 25 nt, Human
ugcuuuauacauccuucuccucaau

SEQ ID NO: 326634 - RNA, 24 nt, Human
uggaaauauucggacuccaaaaaa

SEQ ID NO: 326635 - RNA, 20 nt, Human
uggcacaaucaagucagccu

SEQ ID NO: 326636 - RNA, 20 nt, Human
uggcacaaucaagucagccu

SEQ ID NO: 326637 - RNA, 21 nt, Human
uggccuggaguccucccuuuu

SEQ ID NO: 326638 - RNA, 18 nt, Human
uggcgagcuggggacugg

SEQ ID NO: 326639 - RNA, 25 nt, Human
ugggaggcuuauggcucugcacagc

SEQ ID NO: 326640 - RNA, 21 nt, Human
ugggauaaccacuuagcuuca

SEQ ID NO: 326641 - RNA, 22 nt, Human
uggggaaagugaaaaaaaaaaa

SEQ ID NO: 326642 - RNA, 26 nt, Human
uggggaaagugaaaaaaaaaaaucaa

SEQ ID NO: 326643 - RNA, 22 nt, Human
ugugcugagccuggcagaaguc

SEQ ID NO: 326644 - RNA, 19 nt, Human
uguucugcugguuuuccuu

SEQ ID NO: 326645 - RNA, 19 nt, Human
uguucugcugguuuuccuu

SEQ ID NO: 326646 - RNA, 21 nt, Human
uguuguuuuuuguuuuuuuuu

SEQ ID NO: 326647 - RNA, 23 nt, Human
uuaaucucaaaaaaccuaguaau

SEQ ID NO: 326648 - RNA, 24 nt, Human
uuaaucucaaaaaaccuaguaaua

SEQ ID NO: 326649 - RNA, 24 nt, Human
uuacagcccggccgaucgcgccgc

SEQ ID NO: 326650 - RNA, 25 nt, Human
uuacuacauuuaggcacuagugaga

SEQ ID NO: 326651 - RNA, 21 nt, Human
uuagaagacaaguuucuggga

SEQ ID NO: 326652 - RNA, 22 nt, Human
uuaguuaaaaaucaaaacucca

SEQ ID NO: 326653 - RNA, 19 nt, Human
uuauuguucuuuaaaaggg

SEQ ID NO: 326654 - RNA, 23 nt, Human
uucacagcagaaaacauuaaaaa

SEQ ID NO: 326655 - RNA, 27 nt, Human
uucucuuucucuuuucuuaaacauuuu

SEQ ID NO: 326656 - RNA, 25 nt, Human
uugcacgaugucucucuucuacccu

SEQ ID NO: 326657 - RNA, 22 nt, Human
uuuacauuuccuucuacugaac

SEQ ID NO: 326658 - RNA, 18 nt, Human
uuuugaagaaacuaacau

SEQ ID NO: 326659 - RNA, 29 nt, Human
uuuuugguguuguuuuuuguuuuuuuuuu

SEQ ID NO: 326660 - RNA, 24 nt, Human
uuuuuuguuugcuuuuguuccaau

SEQ ID NO: 326661 - RNA, 27 nt, Human
uuuuuuuuuuuuuuuuuuuuuuugggg

SEQ ID NO: 326662 - RNA, 19 nt, Human
aaacaacaagcccagcuca

SEQ ID NO: 326663 - RNA, 21 nt, Human
aacaagcccagcucagaaugc

SEQ ID NO: 326664 - RNA, 22 nt, Human
aaccacagccauguaaugauca

SEQ ID NO: 326665 - RNA, 25 nt, Human
aacugcacccuauugcugagcgaca

SEQ ID NO: 326666 - RNA, 28 nt, Human
aagcacauauuuuucaucaggacacaag

SEQ ID NO: 326667 - RNA, 18 nt, Human
aagguggggggcgggggg

SEQ ID NO: 326668 - RNA, 22 nt, Human
aauccccgaccccugcagcuac

SEQ ID NO: 326669 - RNA, 19 nt, Human
acacacccaaacuacuaca

SEQ ID NO: 326670 - RNA, 23 nt, Human
acacacccaaacuacuacauaca

SEQ ID NO: 326671 - RNA, 22 nt, Human
acccugcuguaccaggacaggc

SEQ ID NO: 326672 - RNA, 23 nt, Human
accgccgcccuagccgcugcugc

SEQ ID NO: 326673 - RNA, 19 nt, Human
agcaagacccugcuguacc

SEQ ID NO: 326674 - RNA, 21 nt, Human
agcagagcagcucgcuaccuc

SEQ ID NO: 326675 - RNA, 20 nt, Human
aggacaggcugggccucacc

SEQ ID NO: 326676 - RNA, 20 nt, Human
aggagggagcccuggguggg

SEQ ID NO: 326677 - RNA, 20 nt, Human
aggagggagcccuggguggg

SEQ ID NO: 326678 - RNA, 27 nt, Human
aggcaaaaugugaaaaugcuggcaaga

SEQ ID NO: 326679 - RNA, 23 nt, Human
aggcugacaucaaaaaauuuuaa

SEQ ID NO: 326680 - RNA, 18 nt, Human
aggucaugcacaggcagg

SEQ ID NO: 326681 - RNA, 21 nt, Human
auucaaggggggggcuguugg

SEQ ID NO: 326682 - RNA, 21 nt, Human
caagaaaaugcuagugcacua

SEQ ID NO: 326683 - RNA, 18 nt, Human
caaggggggggcuguugg

SEQ ID NO: 326684 - RNA, 18 nt, Human
cacacgggggagcaguga

SEQ ID NO: 326685 - RNA, 20 nt, Human
caccauagcucugcagggug

SEQ ID NO: 326686 - RNA, 24 nt, Human
caccuaagccuuauccacaccuca

SEQ ID NO: 326687 - RNA, 24 nt, Human
cacguuacccacaauaucacuaaa

SEQ ID NO: 326688 - RNA, 22 nt, Human
cacucuccucaaaaaauggcuu

SEQ ID NO: 326689 - RNA, 19 nt, Human
cagaaccaacguccguccg

SEQ ID NO: 326690 - RNA, 23 nt, Human
cagaaugcuuacagccuggcacc

SEQ ID NO: 326691 - RNA, 21 nt, Human
cagagcagcucgcuaccucuc

SEQ ID NO: 326692 - RNA, 19 nt, Human
cagcugcucuccaaggaua

SEQ ID NO: 326693 - RNA, 26 nt, Human
caggugccucucuuccaaaucacggu

SEQ ID NO: 326694 - RNA, 22 nt, Human
ccaaagguggggggcggggggu

SEQ ID NO: 326695 - RNA, 19 nt, Human
cccuggguggggcgagccc

SEQ ID NO: 326696 - RNA, 19 nt, Human
ccgccgcccuagccgcugc

SEQ ID NO: 326697 - RNA, 19 nt, Human
ccgccgcccuagccgcugc

SEQ ID NO: 326698 - RNA, 23 nt, Human
ccgccgcccuagccgcugcugcu

SEQ ID NO: 326699 - RNA, 21 nt, Human
ccgcugcaauccccgaccccu

SEQ ID NO: 326700 - RNA, 18 nt, Human
ccucaccauagcucugca

SEQ ID NO: 326701 - RNA, 22 nt, Human
cgagccccaagacggguguagg

SEQ ID NO: 326702 - RNA, 20 nt, Human
cgcgcucuuagccccgaggc

SEQ ID NO: 326703 - RNA, 21 nt, Human
cggcaaggugaaccgggacag

SEQ ID NO: 326704 - RNA, 22 nt, Human
cggcagccggaacuacgcauca

SEQ ID NO: 326705 - RNA, 23 nt, Human
cgggacaaaguaaucucacauca

SEQ ID NO: 326706 - RNA, 22 nt, Human
cucacguuacccacaauaucac

SEQ ID NO: 326707 - RNA, 21 nt, Human
cugcgccuccuucucggccca

SEQ ID NO: 326708 - RNA, 21 nt, Human
cuguaccaggacaggcugggc

SEQ ID NO: 326709 - RNA, 23 nt, Human
gagaguagcucgggagcuacagc

SEQ ID NO: 326710 - RNA, 18 nt, Human
gaguggaggagggucagg

SEQ ID NO: 326711 - RNA, 19 nt, Human
gcccuggguggggcgagcc

SEQ ID NO: 326712 - RNA, 19 nt, Human
gcgccuccuucucggccca

SEQ ID NO: 326713 - RNA, 23 nt, Human
ggaaaacugcacccuauugcuga

SEQ ID NO: 326714 - RNA, 23 nt, Human
ggcaaaaaguaaaaggaugaggg

SEQ ID NO: 326715 - RNA, 22 nt, Human
ggcuguuggcgugccgcccgcc

SEQ ID NO: 326716 - RNA, 18 nt, Human
gggccagggcggcugcug

SEQ ID NO: 326717 - RNA, 23 nt, Human
ggguguaggccccuucccucugc

SEQ ID NO: 326718 - RNA, 23 nt, Human
gguggagguggaguggaggaggg

SEQ ID NO: 326719 - RNA, 19 nt, Human
gguggggcagacgcgccuc

SEQ ID NO: 326720 - RNA, 22 nt, Human
gguguaggccccuucccucugc

SEQ ID NO: 326721 - RNA, 23 nt, Human
guaccaggacaggcugggccuca

SEQ ID NO: 326722 - RNA, 21 nt, Human
gugccgcccgccugggaugcu

SEQ ID NO: 326723 - RNA, 19 nt, Human
guggauuugguacucaaag

SEQ ID NO: 326724 - RNA, 23 nt, Human
uaacauaauguguaacaaggugg

SEQ ID NO: 326725 - RNA, 19 nt, Human
uaagccuuauccacaccuc

SEQ ID NO: 326726 - RNA, 21 nt, Human
uaagcgggacaaaguaaucuc

SEQ ID NO: 326727 - RNA, 22 nt, Human
uacaggacuuaaaaacaacaag

SEQ ID NO: 326728 - RNA, 21 nt, Human
uaccaggacaggcugggccuc

SEQ ID NO: 326729 - RNA, 31 nt, Human
uauacacacccaaacuacuacauacauauag

SEQ ID NO: 326730 - RNA, 21 nt, Human
ucaggacacaagaagaccuua

SEQ ID NO: 326731 - RNA, 23 nt, Human
ucucacguuacccacaauaucac

SEQ ID NO: 326732 - RNA, 21 nt, Human
ucucucggcaaggugaaccgg

SEQ ID NO: 326733 - RNA, 25 nt, Human
ucuucaguucccuuugcaggaagag

SEQ ID NO: 326734 - RNA, 22 nt, Human
ugaaccgggacagagacggcgg

SEQ ID NO: 326735 - RNA, 20 nt, Human
ugagaacuagaucuagcaga

SEQ ID NO: 326736 - RNA, 23 nt, Human
ugaggguggggcagacgcgccuc

SEQ ID NO: 326737 - RNA, 21 nt, Human
ugcacuauggaugccuuuggg

SEQ ID NO: 326738 - RNA, 20 nt, Human
ugcuuacaaccguccuccuu

SEQ ID NO: 326739 - RNA, 18 nt, Human
uggagaguugcucccugc

SEQ ID NO: 326740 - RNA, 23 nt, Human
uggcaagagaguagcucgggagg

SEQ ID NO: 326741 - RNA, 19 nt, Human
uggcaccuaagccuuaucc

SEQ ID NO: 326742 - RNA, 18 nt, Human
uggggcgagccccaagac

SEQ ID NO: 326743 - RNA, 18 nt, Human
uguuaaaaagccacuuaa

SEQ ID NO: 326744 - RNA, 19 nt, Human
uguuuaaauaaauauggag

SEQ ID NO: 326745 - RNA, 22 nt, Human
uucaagcacauauuuuucauca

SEQ ID NO: 326746 - RNA, 19 nt, Human
uugacuuggaauggcggag

SEQ ID NO: 326747 - RNA, 19 nt, Human
uugguucaagaaaaugcua

SEQ ID NO: 326748 - RNA, 24 nt, Human
uuuaauacauuauugguucaagaa

SEQ ID NO: 326749 - RNA, 23 nt, Human
uuugaaaugcuacuauauauaca

SEQ ID NO: 326750 - RNA, 22 nt, Human
aauaaaaaagccuauuacuaga

SEQ ID NO: 326751 - RNA, 21 nt, Human
acagaccccccuccaggccug

SEQ ID NO: 326752 - RNA, 22 nt, Human
aggaaaaaaaaaauuaaacugg

SEQ ID NO: 326753 - RNA, 22 nt, Human
agguaaaagcaagcccugggcg

SEQ ID NO: 326754 - RNA, 22 nt, Human
auuacuagaauuugaaucccca

SEQ ID NO: 326755 - RNA, 23 nt, Human
auuacuagaauuugaauccccau

SEQ ID NO: 326756 - RNA, 20 nt, Human
caaagcauccuugcuuccuu

SEQ ID NO: 326757 - RNA, 24 nt, Human
cacagaccccccuccaggccuggg

SEQ ID NO: 326758 - RNA, 19 nt, Human
cagaccccccuccaggccu

SEQ ID NO: 326759 - RNA, 19 nt, Human
cagccggccgcgcacagac

SEQ ID NO: 326760 - RNA, 22 nt, Human
cauccuugcuuccuccuggaaa

SEQ ID NO: 326761 - RNA, 22 nt, Human
ccaaaaauagaagccaucaaaa

SEQ ID NO: 326762 - RNA, 22 nt, Human
ccaacaaugaggaaaaaaaaaa

SEQ ID NO: 326763 - RNA, 25 nt, Human
ccaauggcagugcuguagggucuuu

SEQ ID NO: 326764 - RNA, 25 nt, Human
ccacgcacaguguccaaagcauccu

SEQ ID NO: 326765 - RNA, 21 nt, Human
ccccaacaaugaggaaaaaaa

SEQ ID NO: 326766 - RNA, 18 nt, Human
ccccccuccaggccuggg

SEQ ID NO: 326767 - RNA, 20 nt, Human
cccccgugaugucaccgcuc

SEQ ID NO: 326768 - RNA, 22 nt, Human
cccgccgccacuuccugcuucc

SEQ ID NO: 326769 - RNA, 19 nt, Human
cccggcucgcuccuccucc

SEQ ID NO: 326770 - RNA, 20 nt, Human
cccggcucgcuccuccuccc

SEQ ID NO: 326771 - RNA, 20 nt, Human
cccggcucgcuccuccuccu

SEQ ID NO: 326772 - RNA, 22 nt, Human
cccuccggcuccgcgacggacc

SEQ ID NO: 326773 - RNA, 26 nt, Human
ccgcgcacagaccccccuccaggccu

SEQ ID NO: 326774 - RNA, 23 nt, Human
ccgcucgcgacgcccgccgccac

SEQ ID NO: 326775 - RNA, 20 nt, Human
ccgcucgggaccggacgcgg

SEQ ID NO: 326776 - RNA, 21 nt, Human
ccgcucgggaccggacgcggg

SEQ ID NO: 326777 - RNA, 27 nt, Human
ccgggaauggcagcgcgggggcuccuu

SEQ ID NO: 326778 - RNA, 18 nt, Human
ccuccgcccccgcccuuc

SEQ ID NO: 326779 - RNA, 20 nt, Human
ccuccgcccccgcccuucgc

SEQ ID NO: 326780 - RNA, 25 nt, Human
cgcgcacagaccccccuccaggccu

SEQ ID NO: 326781 - RNA, 22 nt, Human
cuaggaguggguagguaaaagc

SEQ ID NO: 326782 - RNA, 24 nt, Human
cuccgcgacggacccgcuccuugc

SEQ ID NO: 326783 - RNA, 23 nt, Human
cuuaauucucauuuggccaaaaa

SEQ ID NO: 326784 - RNA, 20 nt, Human
gaaaaaaaaaauuaaacugg

SEQ ID NO: 326785 - RNA, 23 nt, Human
gccaaaaauagaagccaucaaaa

SEQ ID NO: 326786 - RNA, 27 nt, Human
gcccuucgccgccgucgcccccgugau

SEQ ID NO: 326787 - RNA, 19 nt, Human
gcgcgggggcuccgcggag

SEQ ID NO: 326788 - RNA, 20 nt, Human
gcucggucacaucgggcugg

SEQ ID NO: 326789 - RNA, 25 nt, Human
ggacaggcuguggccuagaggggca

SEQ ID NO: 326790 - RNA, 19 nt, Human
gggaauggcagcgcggggg

SEQ ID NO: 326791 - RNA, 21 nt, Human
ggucaacuucugacagucuca

SEQ ID NO: 326792 - RNA, 24 nt, Human
ucagcggaggaccgagcgacggcc

SEQ ID NO: 326793 - RNA, 21 nt, Human
ucccgcccuccggcuccgcga

SEQ ID NO: 326794 - RNA, 19 nt, Human
uccuccgcccccgcccuuc

SEQ ID NO: 326795 - RNA, 23 nt, Human
ucuaggucguuguuacuuaauuu

SEQ ID NO: 326796 - RNA, 21 nt, Human
ucucaggcacuggcuuaauuc

SEQ ID NO: 326797 - RNA, 24 nt, Human
ucucauuuggccaaaaauagaagc

SEQ ID NO: 326798 - RNA, 19 nt, Human
ugaaguuuuggcagguuuu

SEQ ID NO: 326799 - RNA, 23 nt, Human
ugaggaaaugaguaauugggaag

SEQ ID NO: 326800 - RNA, 18 nt, Human
ugaguaauugggaagcag

SEQ ID NO: 326801 - RNA, 24 nt, Human
ugaguuaaaauacaguggucuuua

SEQ ID NO: 326802 - RNA, 24 nt, Human
ugcaaaauacagcgcacaauuuaa

SEQ ID NO: 326803 - RNA, 22 nt, Human
ugcagcugccccccggcccggc

SEQ ID NO: 326804 - RNA, 19 nt, Human
ugcuguuuuaacugagcau

SEQ ID NO: 326805 - RNA, 22 nt, Human
ugggaucaaaaugucccucaau

SEQ ID NO: 326806 - RNA, 24 nt, Human
ugggaucaaaaugucccucaaugc

SEQ ID NO: 326807 - RNA, 21 nt, Human
uuaacugcuuccucaauuuca

SEQ ID NO: 326808 - RNA, 21 nt, Human
uucaaacaaauucuauaaaau

SEQ ID NO: 326809 - RNA, 22 nt, Human
uugcaagccuuccaaauccaag

SEQ ID NO: 326810 - RNA, 19 nt, Human
uuguagagaugauuucuuc

SEQ ID NO: 326811 - RNA, 20 nt, Human
uuuuuuuuuuuuuuuuccag

SEQ ID NO: 326812 - RNA, 21 nt, Human
uuuuuuuuuuuuuuuuccagg

SEQ ID NO: 326813 - RNA, 22 nt, Human
aaacacacacaagcuaagagaa

SEQ ID NO: 326814 - RNA, 23 nt, Human
aaacagaaaaagaguaguccuua

SEQ ID NO: 326815 - RNA, 21 nt, Human
aaagaaacacacacaagcuaa

SEQ ID NO: 326816 - RNA, 26 nt, Human
acaaaauaaugcauacaugauaaaac

SEQ ID NO: 326817 - RNA, 24 nt, Human
agacuguauauaauauaaaaauaa

SEQ ID NO: 326818 - RNA, 20 nt, Human
aggaacaauuaggaugaaca

SEQ ID NO: 326819 - RNA, 23 nt, Human
caaauaauuuacaaauaaaguac

SEQ ID NO: 326820 - RNA, 25 nt, Human
cauacaugauaaaacagaaaaagag

SEQ ID NO: 326821 - RNA, 23 nt, Human
cuccagggcaaauaauuuacaaa

SEQ ID NO: 326822 - RNA, 23 nt, Human
cucccgcguccccccggcugcgg

SEQ ID NO: 326823 - RNA, 25 nt, Human
cuuaaacucaauauaucauaaaggu

SEQ ID NO: 326824 - RNA, 20 nt, Human
gaaaacaggaacaauuagga

SEQ ID NO: 326825 - RNA, 20 nt, Human
ggaugaacaauuagacugua

SEQ ID NO: 326826 - RNA, 21 nt, Human
guggcaccugaauuuuccagu

SEQ ID NO: 326827 - RNA, 21 nt, Human
uaaagaaacacacacaagcua

SEQ ID NO: 326828 - RNA, 20 nt, Human
uaaguguaguauaaggcagg

SEQ ID NO: 326829 - RNA, 23 nt, Human
uagacuguauauaauauaaaaau

SEQ ID NO: 326830 - RNA, 24 nt, Human
ucaaauauuaaagaaacacacaca

SEQ ID NO: 326831 - RNA, 21 nt, Human
ucaguggcaccugaauuuucc

SEQ ID NO: 326832 - RNA, 21 nt, Human
ucuacaagcagcguguaacag

SEQ ID NO: 326833 - RNA, 18 nt, Human
ugauaaaacagaaaaaga

SEQ ID NO: 326834 - RNA, 21 nt, Human
ugcccuguacauauacaaaau

SEQ ID NO: 326835 - RNA, 22 nt, Human
uguacauauacaaaauaaugca

SEQ ID NO: 326836 - RNA, 24 nt, Human
uuuucuaaaacuccagggcaaaua

SEQ ID NO: 326837 - RNA, 23 nt, Human
aaauauuggaaaacauuuuugcu

SEQ ID NO: 326838 - RNA, 23 nt, Human
aaauauuggaaaacauuuuugcu

SEQ ID NO: 326839 - RNA, 20 nt, Human
acaggaaauucuauauagua

SEQ ID NO: 326840 - RNA, 18 nt, Human
aggaaauucuauauagua

SEQ ID NO: 326841 - RNA, 22 nt, Human
aguaacaaacagauaacugaua

SEQ ID NO: 326842 - RNA, 23 nt, Human
aucaucaaaugcugccuuuaauc

SEQ ID NO: 326843 - RNA, 23 nt, Human
aucaucaaaugcugccuuuaauc

SEQ ID NO: 326844 - RNA, 18 nt, Human
caaaugcugccuuuaauc

SEQ ID NO: 326845 - RNA, 22 nt, Human
caagaagaauaccccucuaaga

SEQ ID NO: 326846 - RNA, 22 nt, Human
caagaagaauaccccucuaaga

SEQ ID NO: 326847 - RNA, 23 nt, Human
caguaacaaacagauaacugaua

SEQ ID NO: 326848 - RNA, 23 nt, Human
caguaacaaacagauaacugaua

SEQ ID NO: 326849 - RNA, 21 nt, Human
cauccagaggcucuuuucaug

SEQ ID NO: 326850 - RNA, 22 nt, Human
cgagaccggguccugcuacugg

SEQ ID NO: 326851 - RNA, 20 nt, Human
cuaugccaauauuacuguca

SEQ ID NO: 326852 - RNA, 20 nt, Human
cuaugccaauauuacuguca

SEQ ID NO: 326853 - RNA, 19 nt, Human
cugcucugugaucuuauuu

SEQ ID NO: 326854 - RNA, 23 nt, Human
cuggagguuaaggagagaaaugg

SEQ ID NO: 326855 - RNA, 18 nt, Human
uaaaguagcuguaaaaau

SEQ ID NO: 326856 - RNA, 18 nt, Human
uaaaguagcuguaaaaau

SEQ ID NO: 326857 - RNA, 23 nt, Human
uaaugauuacaaacagaugaugc

SEQ ID NO: 326858 - RNA, 23 nt, Human
uaaugauuacaaacagaugaugc

SEQ ID NO: 326859 - RNA, 19 nt, Human
uaguguuaaaauuuuguaa

SEQ ID NO: 326860 - RNA, 19 nt, Human
uaguguuaaaauuuuguaa

SEQ ID NO: 326861 - RNA, 24 nt, Human
uauaaacaagauuggugcauuaaa

SEQ ID NO: 326862 - RNA, 24 nt, Human
uauaaacaagauuggugcauuaaa

SEQ ID NO: 326863 - RNA, 23 nt, Human
uauuacaggaaauucuauauagu

SEQ ID NO: 326864 - RNA, 23 nt, Human
uauuacaggaaauucuauauagu

SEQ ID NO: 326865 - RNA, 19 nt, Human
ugaacuugcugcucuguga

SEQ ID NO: 326866 - RNA, 19 nt, Human
ugaacuugcugcucuguga

SEQ ID NO: 326867 - RNA, 25 nt, Human
ugauacaguaaacauuugcuacuuu

SEQ ID NO: 326868 - RNA, 25 nt, Human
ugauacaguaaacauuugcuacuuu

SEQ ID NO: 326869 - RNA, 25 nt, Human
uuacaaacagaugaugcaguaacaa

SEQ ID NO: 326870 - RNA, 25 nt, Human
uuacaaacagaugaugcaguaacaa

SEQ ID NO: 326871 - RNA, 24 nt, Human
uuuaagguguguuuuuauuuacaa

SEQ ID NO: 326872 - RNA, 24 nt, Human
uuuaagguguguuuuuauuuacaa

SEQ ID NO: 326873 - RNA, 22 nt, Human
agccuguuugcugccagccacc

SEQ ID NO: 326874 - RNA, 22 nt, Human
auggagcugggucccuccucca

SEQ ID NO: 326875 - RNA, 24 nt, Human
ccccugagauggccuuagcaguuu

SEQ ID NO: 326876 - RNA, 19 nt, Human
cccguggcgccccggaguc

SEQ ID NO: 326877 - RNA, 23 nt, Human
cggaaaggcuguccuucgcggcg

SEQ ID NO: 326878 - RNA, 21 nt, Human
gccccggagucccgcgcggaa

SEQ ID NO: 326879 - RNA, 19 nt, Human
ggaggugacucuccuccag

SEQ ID NO: 326880 - RNA, 21 nt, Human
gggagcagauguugucuggag

SEQ ID NO: 326881 - RNA, 22 nt, Human
guguccaugcccaguguggccc

SEQ ID NO: 326882 - RNA, 18 nt, Human
ucagagagccuguuugcu

SEQ ID NO: 326883 - RNA, 19 nt, Human
ugcccaguguggcccucug

SEQ ID NO: 326884 - RNA, 19 nt, Human
uggaagauagcugcuuaca

SEQ ID NO: 326885 - RNA, 19 nt, Human
uggagcugggucccuccuc

SEQ ID NO: 326886 - RNA, 22 nt, Human
uggagcugggucccuccuccag

SEQ ID NO: 326887 - RNA, 18 nt, Human
uggcccccguggcgcccc

SEQ ID NO: 326888 - RNA, 18 nt, Human
uggcgccccggagucccu

SEQ ID NO: 326889 - RNA, 23 nt, Human
uguggcccucuggaagauagcug

SEQ ID NO: 326890 - RNA, 20 nt, Human
aaaaaaaaaaauuagaccug

SEQ ID NO: 326891 - RNA, 25 nt, Human
aaaaaaaaaaauuagaccuguaguc

SEQ ID NO: 326892 - RNA, 22 nt, Human
aaagcccccacauuucccaccc

SEQ ID NO: 326893 - RNA, 22 nt, Human
aacauggcaaaaacucauuucu

SEQ ID NO: 326894 - RNA, 24 nt, Human
acccuagcuaccuccuccagccuc

SEQ ID NO: 326895 - RNA, 24 nt, Human
agagacguguccuccuuuuauuuc

SEQ ID NO: 326896 - RNA, 24 nt, Human
agcacuuugggaggcugaggcagg

SEQ ID NO: 326897 - RNA, 19 nt, Human
aggcaggaggauugcuuga

SEQ ID NO: 326898 - RNA, 21 nt, Human
aggcaggaggauugcuugagg

SEQ ID NO: 326899 - RNA, 24 nt, Human
aggcaggaggauugcuugagguug

SEQ ID NO: 326900 - RNA, 21 nt, Human
aggcugaggcaggaggauugc

SEQ ID NO: 326901 - RNA, 24 nt, Human
aggcugaggcaggaggauugcuug

SEQ ID NO: 326902 - RNA, 25 nt, Human
agucugggcaacauggcaaaaacuc

SEQ ID NO: 326903 - RNA, 18 nt, Human
aguguccauccacuucuc

SEQ ID NO: 326904 - RNA, 24 nt, Human
cacaccuguaaucucagcacuuug

SEQ ID NO: 326905 - RNA, 19 nt, Human
caccuguaaucucagcacu

SEQ ID NO: 326906 - RNA, 24 nt, Human
caccuguaaucucagcacuuuggg

SEQ ID NO: 326907 - RNA, 24 nt, Human
cagcacuuugggaggcugaggcag

SEQ ID NO: 326908 - RNA, 25 nt, Human
cagcacuuugggaggcugaggcagg

SEQ ID NO: 326909 - RNA, 18 nt, Human
cagcccaccugagggugg

SEQ ID NO: 326910 - RNA, 20 nt, Human
ccaccugagggugggguggg

SEQ ID NO: 326911 - RNA, 23 nt, Human
ccaccuguggacuguaucucuga

SEQ ID NO: 326912 - RNA, 19 nt, Human
ccaggcccacuguuuccau

SEQ ID NO: 326913 - RNA, 23 nt, Human
cccacccugagaaacuuuaacuu

SEQ ID NO: 326914 - RNA, 20 nt, Human
ccccugaguguccaagugag

SEQ ID NO: 326915 - RNA, 20 nt, Human
ccccuuccugaucuucuuuc

SEQ ID NO: 326916 - RNA, 20 nt, Human
cccugaguguccaagugagg

SEQ ID NO: 326917 - RNA, 19 nt, Human
ccuagauagguccugauuu

SEQ ID NO: 326918 - RNA, 19 nt, Human
ccucaccagccacuauacc

SEQ ID NO: 326919 - RNA, 24 nt, Human
ccuguagucccagcuacucggcag

SEQ ID NO: 326920 - RNA, 18 nt, Human
cggaagcucaucuguccc

SEQ ID NO: 326921 - RNA, 20 nt, Human
cggccccgcgcgcgcggcga

SEQ ID NO: 326922 - RNA, 21 nt, Human
cucaagccuugaaugcuacag

SEQ ID NO: 326923 - RNA, 22 nt, Human
cucacaccuguaaucucagcac

SEQ ID NO: 326924 - RNA, 24 nt, Human
cucacaccuguaaucucagcacuu

SEQ ID NO: 326925 - RNA, 22 nt, Human
cuccagccucaagccuugaaug

SEQ ID NO: 326926 - RNA, 19 nt, Human
cugcuuggcugugguuaug

SEQ ID NO: 326927 - RNA, 27 nt, Human
cuggucucucucucucuggcuggggau

SEQ ID NO: 326928 - RNA, 20 nt, Human
cuugagguugggaguucaag

SEQ ID NO: 326929 - RNA, 23 nt, Human
gaccuguagucccagcuacucgg

SEQ ID NO: 326930 - RNA, 18 nt, Human
gagggaggcucaggugcu

SEQ ID NO: 326931 - RNA, 24 nt, Human
gauugcuugagguugggaguucaa

SEQ ID NO: 326932 - RNA, 19 nt, Human
gcgcucagcagcaccgggg

SEQ ID NO: 326933 - RNA, 24 nt, Human
gcuugagguugggaguucaagacc

SEQ ID NO: 326934 - RNA, 25 nt, Human
ggagauguguacucauuugggggac

SEQ ID NO: 326935 - RNA, 19 nt, Human
ggaggauugcuugagguug

SEQ ID NO: 326936 - RNA, 24 nt, Human
ggaucuguuuauaucugucuaguu

SEQ ID NO: 326937 - RNA, 22 nt, Human
ggcccacuguuuccauucugcg

SEQ ID NO: 326938 - RNA, 21 nt, Human
ggcucacaccuguaaucucag

SEQ ID NO: 326939 - RNA, 19 nt, Human
gguccauccaucaagacau

SEQ ID NO: 326940 - RNA, 24 nt, Human
ggugaggagagcagucuccggaaa

SEQ ID NO: 326941 - RNA, 24 nt, Human
gguggcucacaccuguaaucucag

SEQ ID NO: 326942 - RNA, 24 nt, Human
gguuaggagucugucuggccagaa

SEQ ID NO: 326943 - RNA, 23 nt, Human
guggcucacaccuguaaucucag

SEQ ID NO: 326944 - RNA, 22 nt, Human
uacccuagcuaccuccuccagc

SEQ ID NO: 326945 - RNA, 24 nt, Human
uacccuagcuaccuccuccagccu

SEQ ID NO: 326946 - RNA, 21 nt, Human
uaggggguccaccuggcuguc

SEQ ID NO: 326947 - RNA, 23 nt, Human
uagguccugauuugcuggggguc

SEQ ID NO: 326948 - RNA, 21 nt, Human
ucagccagccagcccaccuga

SEQ ID NO: 326949 - RNA, 22 nt, Human
uccagcccggccccgcgcgcgc

SEQ ID NO: 326950 - RNA, 18 nt, Human
ucuaguaaucugacuaac

SEQ ID NO: 326951 - RNA, 19 nt, Human
ucucucucucucuggcugg

SEQ ID NO: 326952 - RNA, 18 nt, Human
ucuggccggcuggcuggg

SEQ ID NO: 326953 - RNA, 20 nt, Human
ucugucccuucuccccuuca

SEQ ID NO: 326954 - RNA, 27 nt, Human
ucugucugucugccuaucuggaggucu

SEQ ID NO: 326955 - RNA, 24 nt, Human
ucugucuuuugggggcucuguuug

SEQ ID NO: 326956 - RNA, 24 nt, Human
ugaggcaggaggauugcuugaggu

SEQ ID NO: 326957 - RNA, 24 nt, Human
ugaggcaggaggauugcuugaggu

SEQ ID NO: 326958 - RNA, 25 nt, Human
ugaggcaggaggauugcuugagguu

SEQ ID NO: 326959 - RNA, 18 nt, Human
ugaggguggggugggguc

SEQ ID NO: 326960 - RNA, 21 nt, Human
uggcucacaccuguaaucuca

SEQ ID NO: 326961 - RNA, 24 nt, Human
uggcucacaccuguaaucucagca

SEQ ID NO: 326962 - RNA, 20 nt, Human
ugggaggcugaggcaggagg

SEQ ID NO: 326963 - RNA, 22 nt, Human
ugggaggcugaggcaggaggau

SEQ ID NO: 326964 - RNA, 24 nt, Human
ugggccauuuaaaguguuucaaau

SEQ ID NO: 326965 - RNA, 28 nt, Human
ugguccccugaguguccaagugagggag

SEQ ID NO: 326966 - RNA, 24 nt, Human
ugguggcucacaccuguaaucuca

SEQ ID NO: 326967 - RNA, 20 nt, Human
uugggaggcugaggcaggag

SEQ ID NO: 326968 - RNA, 20 nt, Human
uuuccauucugcgcacggcg

SEQ ID NO: 326969 - RNA, 22 nt, Human
uuuuuuuuuuuugcacagagac

SEQ ID NO: 326970 - RNA, 23 nt, Human
uuuuuuuuuuuuuuuuugcacag

SEQ ID NO: 326971 - RNA, 27 nt, Human
uuuuuuuuuuuuuuuuuuuuuuugggg

SEQ ID NO: 326972 - RNA, 19 nt, Human
aaaauccagauagccucca

SEQ ID NO: 326973 - RNA, 22 nt, Human
aaaguaccuggagcgucggacg

SEQ ID NO: 326974 - RNA, 24 nt, Human
aauaaugggauuuacagaaaccaa

SEQ ID NO: 326975 - RNA, 21 nt, Human
aaugucuuuauuuuagacagc

SEQ ID NO: 326976 - RNA, 18 nt, Human
aauuucuuuacaaagucu

SEQ ID NO: 326977 - RNA, 19 nt, Human
acccugaaaugcuuaagaa

SEQ ID NO: 326978 - RNA, 23 nt, Human
acccugaaaugcuuaagaauaaa

SEQ ID NO: 326979 - RNA, 20 nt, Human
acugcaccguuuuugggaua

SEQ ID NO: 326980 - RNA, 19 nt, Human
aguaccuggagcgucggac

SEQ ID NO: 326981 - RNA, 18 nt, Human
auccagauagccuccaaa

SEQ ID NO: 326982 - RNA, 21 nt, Human
caacuguuuaccugacuaucc

SEQ ID NO: 326983 - RNA, 23 nt, Human
ccgcgccccgcccccacgccaag

SEQ ID NO: 326984 - RNA, 22 nt, Human
ccuaaaucauaaucuaccccaa

SEQ ID NO: 326985 - RNA, 22 nt, Human
cgccgcgccccgcccccacgcc

SEQ ID NO: 326986 - RNA, 20 nt, Human
cgcgcagacucggcgcccga

SEQ ID NO: 326987 - RNA, 23 nt, Human
cucauaucaaacuucuuuuuaga

SEQ ID NO: 326988 - RNA, 20 nt, Human
cuccaaaaacaaauccugug

SEQ ID NO: 326989 - RNA, 19 nt, Human
cugcgcgccgcgccccgcc

SEQ ID NO: 326990 - RNA, 18 nt, Human
cuggcgcgagcagagccu

SEQ ID NO: 326991 - RNA, 23 nt, Human
gaaccugcagucaagaguccuga

SEQ ID NO: 326992 - RNA, 26 nt, Human
gcaugcgcgcugcgcgccgcgccccc

SEQ ID NO: 326993 - RNA, 20 nt, Human
gcgcgccgcgccccgccccc

SEQ ID NO: 326994 - RNA, 23 nt, Human
gcugcuucuuacuuuugcuuccu

SEQ ID NO: 326995 - RNA, 19 nt, Human
ggaaaacuguaaaacauaa

SEQ ID NO: 326996 - RNA, 21 nt, Human
ggaaccugcagucaagagucc

SEQ ID NO: 326997 - RNA, 22 nt, Human
guuggucaggugaaauacugug

SEQ ID NO: 326998 - RNA, 21 nt, Human
uaaaacauaaaagaaaugcaa

SEQ ID NO: 326999 - RNA, 18 nt, Human
uaaaauccagauagccuc

SEQ ID NO: 327000 - RNA, 20 nt, Human
uaaaucauaaucuaccccaa

SEQ ID NO: 327001 - RNA, 24 nt, Human
uaacagauuuuucaaauugagcuc

SEQ ID NO: 327002 - RNA, 18 nt, Human
uaacguagauaaaaccac

SEQ ID NO: 327003 - RNA, 24 nt, Human
uaacuacaaaagauuaaauagaua

SEQ ID NO: 327004 - RNA, 28 nt, Human
uacaaaagauuaaauagauacuuauaaa

SEQ ID NO: 327005 - RNA, 21 nt, Human
uacuguguuugacauguauga

SEQ ID NO: 327006 - RNA, 25 nt, Human
uagaaagaaacugaaaaguguuuac

SEQ ID NO: 327007 - RNA, 22 nt, Human
uagccuccaaaaacaaauccuu

SEQ ID NO: 327008 - RNA, 23 nt, Human
uaguaaacugaaauuaugaauca

SEQ ID NO: 327009 - RNA, 18 nt, Human
uauugcuuauaucaagug

SEQ ID NO: 327010 - RNA, 22 nt, Human
ugacauguaugaauacaguugc

SEQ ID NO: 327011 - RNA, 21 nt, Human
uggcgcugcggcgcaugcgcg

SEQ ID NO: 327012 - RNA, 18 nt, Human
uguaaaacauaaaagaaa

SEQ ID NO: 327013 - RNA, 24 nt, Human
uuauuccaacuucuaacugcucau

SEQ ID NO: 327014 - RNA, 26 nt, Human
uuccaauaacguagauaaaaccacaa

SEQ ID NO: 327015 - RNA, 18 nt, Human
uuugggauaugaggcguu

SEQ ID NO: 327016 - RNA, 22 nt, Human
uuuuguuucuuuguuugcuuuu

SEQ ID NO: 327017 - RNA, 21 nt, Human
uuuuuaguaacagauuuuuca

SEQ ID NO: 327018 - RNA, 24 nt, Human
aaauaaauccauucuaaaaguguu

SEQ ID NO: 327019 - RNA, 22 nt, Human
aacuggcaaaaaugaaaaauaa

SEQ ID NO: 327020 - RNA, 25 nt, Human
aauacuggaagcuauuaugggaacc

SEQ ID NO: 327021 - RNA, 18 nt, Human
agguauacuccauuuagg

SEQ ID NO: 327022 - RNA, 18 nt, Human
auaaauccauucuaaaag

SEQ ID NO: 327023 - RNA, 18 nt, Human
auugucauuauuugcaca

SEQ ID NO: 327024 - RNA, 19 nt, Human
caacucaaugcaaaugaua

SEQ ID NO: 327025 - RNA, 23 nt, Human
caagagcaguuuguauugcaacc

SEQ ID NO: 327026 - RNA, 19 nt, Human
cagagcaagaaaaauaguc

SEQ ID NO: 327027 - RNA, 21 nt, Human
cuggcaaaaaugaaaaauaaa

SEQ ID NO: 327028 - RNA, 24 nt, Human
cuuuacaaaauuucuagucuggga

SEQ ID NO: 327029 - RNA, 23 nt, Human
ggcaaaaaugaaaaauaaaucca

SEQ ID NO: 327030 - RNA, 23 nt, Human
uaaaagacaauaaaaauaacugg

SEQ ID NO: 327031 - RNA, 22 nt, Human
uacauucaaauaauugucauua

SEQ ID NO: 327032 - RNA, 21 nt, Human
uacuggaagcuauuaugggaa

SEQ ID NO: 327033 - RNA, 18 nt, Human
uagcaguauucuaguagu

SEQ ID NO: 327034 - RNA, 20 nt, Human
ugaaaaauaaauccauucua

SEQ ID NO: 327035 - RNA, 20 nt, Human
ugaaaaugcaaaacuggcac

SEQ ID NO: 327036 - RNA, 21 nt, Human
ugaaaaugcaaaacuggcacu

SEQ ID NO: 327037 - RNA, 21 nt, Human
ugcagagcaagaaaaauaguc

SEQ ID NO: 327038 - RNA, 21 nt, Human
uggcauuuugcuuuucuuuua

SEQ ID NO: 327039 - RNA, 21 nt, Human
uuaacuagcaguauucuagua

SEQ ID NO: 327040 - RNA, 20 nt, Human
uuggcauuuugcuuuucuuu

SEQ ID NO: 327041 - RNA, 19 nt, Human
aaaggcagcagaaauggga

SEQ ID NO: 327042 - RNA, 23 nt, Human
aaggagcagaaccugacccagag

SEQ ID NO: 327043 - RNA, 24 nt, Human
aaggagcagaaccugacccagagc

SEQ ID NO: 327044 - RNA, 21 nt, Human
agaaccugacccagagccugc

SEQ ID NO: 327045 - RNA, 23 nt, Human
agcagaaccugacccagagccug

SEQ ID NO: 327046 - RNA, 22 nt, Human
cacgagcccagccccgccccuu

SEQ ID NO: 327047 - RNA, 22 nt, Human
caguacauuuccaccccacagg

SEQ ID NO: 327048 - RNA, 19 nt, Human
cauuuccaccccacagggg

SEQ ID NO: 327049 - RNA, 24 nt, Human
ccacaggggugcaggcugggccag

SEQ ID NO: 327050 - RNA, 22 nt, Human
cccagagccugcaguacauuuc

SEQ ID NO: 327051 - RNA, 19 nt, Human
ccccgccccuucgugccgg

SEQ ID NO: 327052 - RNA, 20 nt, Human
cccguagcugcugcagcugc

SEQ ID NO: 327053 - RNA, 19 nt, Human
cggccacccggccacuccc

SEQ ID NO: 327054 - RNA, 22 nt, Human
cugcugggugugggcagguggg

SEQ ID NO: 327055 - RNA, 22 nt, Human
gaagucacuggucacgggaggg

SEQ ID NO: 327056 - RNA, 18 nt, Human
gcaggcugggccaggcag

SEQ ID NO: 327057 - RNA, 20 nt, Human
gccacgagcccagccccgcc

SEQ ID NO: 327058 - RNA, 19 nt, Human
gggccaaaggcagcagaaa

SEQ ID NO: 327059 - RNA, 22 nt, Human
uaaaggagcagaaccugaccca

SEQ ID NO: 327060 - RNA, 23 nt, Human
uagcaaagagcugaaaaaugucg

SEQ ID NO: 327061 - RNA, 20 nt, Human
uagcugcugcagcugcuggc

SEQ ID NO: 327062 - RNA, 20 nt, Human
ucccauaaaggagcagaacc

SEQ ID NO: 327063 - RNA, 23 nt, Human
ugagaagcucugcuggguguggg

SEQ ID NO: 327064 - RNA, 21 nt, Human
ugagaugaugaugauguagug

SEQ ID NO: 327065 - RNA, 23 nt, Human
ugccggaagucacuggucacggg

SEQ ID NO: 327066 - RNA, 21 nt, Human
ugcugcagcugcuggcucagc

SEQ ID NO: 327067 - RNA, 23 nt, Human
ugugcccacugagaagcucugcu

SEQ ID NO: 327068 - RNA, 22 nt, Human
uucaauagcaaagagcugaaaa

SEQ ID NO: 327069 - RNA, 19 nt, Human
agcugugcacaguggccca

SEQ ID NO: 327070 - RNA, 21 nt, Human
agguucagguugugagucugu

SEQ ID NO: 327071 - RNA, 21 nt, Human
agguucagguugugagucugu

SEQ ID NO: 327072 - RNA, 26 nt, Human
augcagcucccagugccgggccgccu

SEQ ID NO: 327073 - RNA, 21 nt, Human
caccugaggacagcaccgcuc

SEQ ID NO: 327074 - RNA, 20 nt, Human
cagcuagucugggcaggcag

SEQ ID NO: 327075 - RNA, 23 nt, Human
cccaagccaggugaggaagaacc

SEQ ID NO: 327076 - RNA, 19 nt, Human
cccagugccgggccgccuc

SEQ ID NO: 327077 - RNA, 24 nt, Human
ccgcagggggcggggcugagccag

SEQ ID NO: 327078 - RNA, 21 nt, Human
ccucaccacccccgguggucc

SEQ ID NO: 327079 - RNA, 22 nt, Human
cgccucaccacccccggugguc

SEQ ID NO: 327080 - RNA, 25 nt, Human
cgccucaccacccccggugguccca

SEQ ID NO: 327081 - RNA, 21 nt, Human
cgcucaguaaucagccacuuc

SEQ ID NO: 327082 - RNA, 21 nt, Human
cuauauacagggucagggaga

SEQ ID NO: 327083 - RNA, 21 nt, Human
cuauauacagggucagggaga

SEQ ID NO: 327084 - RNA, 23 nt, Human
cugccuggggccuggcugggcua

SEQ ID NO: 327085 - RNA, 23 nt, Human
cugccuggggccuggcugggcua

SEQ ID NO: 327086 - RNA, 19 nt, Human
cugggcaggcagagagcuc

SEQ ID NO: 327087 - RNA, 23 nt, Human
gaaggguuggcccugccuggggc

SEQ ID NO: 327088 - RNA, 23 nt, Human
gaaggguuggcccugccuggggc

SEQ ID NO: 327089 - RNA, 19 nt, Human
gaggaagaaccgcucagua

SEQ ID NO: 327090 - RNA, 27 nt, Human
gaugcagcucccagugccgggccgccu

SEQ ID NO: 327091 - RNA, 24 nt, Human
gccucaccacccccggugguccca

SEQ ID NO: 327092 - RNA, 21 nt, Human
ggcggggcugagccagcggca

SEQ ID NO: 327093 - RNA, 21 nt, Human
gggcugagccagcggcacagc

SEQ ID NO: 327094 - RNA, 21 nt, Human
gggucagggagaggugggggg

SEQ ID NO: 327095 - RNA, 21 nt, Human
gggucagggagaggugggggg

SEQ ID NO: 327096 - RNA, 19 nt, Human
ggguuggcccugccugggg

SEQ ID NO: 327097 - RNA, 19 nt, Human
ggguuggcccugccugggg

SEQ ID NO: 327098 - RNA, 23 nt, Human
uaagccucagaugcagcucccag

SEQ ID NO: 327099 - RNA, 22 nt, Human
ucagggcugaggcauggccacc

SEQ ID NO: 327100 - RNA, 22 nt, Human
ucagggcugaggcauggccacc

SEQ ID NO: 327101 - RNA, 20 nt, Human
ucugggcaggcagagagcuc

SEQ ID NO: 327102 - RNA, 20 nt, Human
ugccuggggccuggcugggc

SEQ ID NO: 327103 - RNA, 20 nt, Human
ugccuggggccuggcugggc

SEQ ID NO: 327104 - RNA, 23 nt, Human
ugccuggggccuggcugggcuau

SEQ ID NO: 327105 - RNA, 23 nt, Human
ugccuggggccuggcugggcuau

SEQ ID NO: 327106 - RNA, 19 nt, Human
uggccaccugaggacagca

SEQ ID NO: 327107 - RNA, 19 nt, Human
uggccaccugaggacagca

SEQ ID NO: 327108 - RNA, 21 nt, Human
uggcccugccuggggccuggc

SEQ ID NO: 327109 - RNA, 21 nt, Human
uggcccugccuggggccuggc

SEQ ID NO: 327110 - RNA, 19 nt, Human
ugggggcuuccggagagga

SEQ ID NO: 327111 - RNA, 23 nt, Human
uguagggagggggaagccacggc

SEQ ID NO: 327112 - RNA, 20 nt, Human
uuuuuuuuuuuuuuuuucac

SEQ ID NO: 327113 - RNA, 22 nt, Human
uuuuuuuuuuuuuuuuucacag

SEQ ID NO: 327114 - RNA, 21 nt, Human
aacugcugcuguuccacuccc

SEQ ID NO: 327115 - RNA, 18 nt, Human
aagaauccagaaggagga

SEQ ID NO: 327116 - RNA, 18 nt, Human
aagagagaggggagagag

SEQ ID NO: 327117 - RNA, 19 nt, Human
aaggcagcugucaggggcg

SEQ ID NO: 327118 - RNA, 19 nt, Human
aaggcagcugucaggggcg

SEQ ID NO: 327119 - RNA, 22 nt, Human
aagguauaguggguccugcauu

SEQ ID NO: 327120 - RNA, 22 nt, Human
aagguauaguggguccugcauu

SEQ ID NO: 327121 - RNA, 21 nt, Human
accagaguacacagggcucug

SEQ ID NO: 327122 - RNA, 18 nt, Human
accuucauccccaucuca

SEQ ID NO: 327123 - RNA, 18 nt, Human
accuucauccccaucuca

SEQ ID NO: 327124 - RNA, 25 nt, Human
acucuuaugacacauggguggaggc

SEQ ID NO: 327125 - RNA, 24 nt, Human
acugcuuagccucccuaagaguag

SEQ ID NO: 327126 - RNA, 26 nt, Human
acugcuuagccucccuaagaguaguu

SEQ ID NO: 327127 - RNA, 20 nt, Human
agaaagcacgcagaagccau

SEQ ID NO: 327128 - RNA, 21 nt, Human
agaaggcaagggaggaaacag

SEQ ID NO: 327129 - RNA, 22 nt, Human
agaaggcaagggaggaaacaga

SEQ ID NO: 327130 - RNA, 22 nt, Human
agaaggcagucucgggguagag

SEQ ID NO: 327131 - RNA, 23 nt, Human
agacauuggagguuccccuuacu

SEQ ID NO: 327132 - RNA, 23 nt, Human
agacauuggagguuccccuuacu

SEQ ID NO: 327133 - RNA, 18 nt, Human
agaccuggaauccggccc

SEQ ID NO: 327134 - RNA, 18 nt, Human
agaccuggaauccggccc

SEQ ID NO: 327135 - RNA, 19 nt, Human
agagagaggggagagaggc

SEQ ID NO: 327136 - RNA, 20 nt, Human
agagccccccaccgagccuc

SEQ ID NO: 327137 - RNA, 20 nt, Human
agagccccccaccgagccuc

SEQ ID NO: 327138 - RNA, 21 nt, Human
agaggaagcagaggaguggcc

SEQ ID NO: 327139 - RNA, 21 nt, Human
agaggaagcagaggaguggcc

SEQ ID NO: 327140 - RNA, 22 nt, Human
agccaggcaggcgggcuccugg

SEQ ID NO: 327141 - RNA, 18 nt, Human
agccagucucagauucaa

SEQ ID NO: 327142 - RNA, 18 nt, Human
agccagucucagauucaa

SEQ ID NO: 327143 - RNA, 22 nt, Human
agccauggaagcaaaacagaga

SEQ ID NO: 327144 - RNA, 22 nt, Human
agccauggaagcaaaacagaga

SEQ ID NO: 327145 - RNA, 23 nt, Human
agcuaaccagugggccuuccccc

SEQ ID NO: 327146 - RNA, 18 nt, Human
agcugguaucaaggcagc

SEQ ID NO: 327147 - RNA, 20 nt, Human
agcugguaucaaggcagcug

SEQ ID NO: 327148 - RNA, 20 nt, Human
agcugguaucaaggcagcug

SEQ ID NO: 327149 - RNA, 23 nt, Human
aggaagcagaggaguggccagug

SEQ ID NO: 327150 - RNA, 23 nt, Human
aggaagcagaggaguggccagug

SEQ ID NO: 327151 - RNA, 18 nt, Human
aggaaggaguggcuggag

SEQ ID NO: 327152 - RNA, 18 nt, Human
aggaaggaguggcuggag

SEQ ID NO: 327153 - RNA, 19 nt, Human
aggaaggaguggcuggagu

SEQ ID NO: 327154 - RNA, 19 nt, Human
aggaaggaguggcuggagu

SEQ ID NO: 327155 - RNA, 21 nt, Human
aggcagcugucaggggcggcg

SEQ ID NO: 327156 - RNA, 21 nt, Human
aggcagcugucaggggcggcg

SEQ ID NO: 327157 - RNA, 19 nt, Human
aggccaagcagaagcauua

SEQ ID NO: 327158 - RNA, 19 nt, Human
aggccaagcagaagcauua

SEQ ID NO: 327159 - RNA, 22 nt, Human
aggcucacucagccaugagguc

SEQ ID NO: 327160 - RNA, 22 nt, Human
agggagggccuguggggcugug

SEQ ID NO: 327161 - RNA, 22 nt, Human
agggagggccuguggggcugug

SEQ ID NO: 327162 - RNA, 19 nt, Human
agggccuguggggcugugc

SEQ ID NO: 327163 - RNA, 19 nt, Human
agggccuguggggcugugc

SEQ ID NO: 327164 - RNA, 25 nt, Human
agggcucaggggagguggaggugug

SEQ ID NO: 327165 - RNA, 25 nt, Human
agggcucaggggagguggaggugug

SEQ ID NO: 327166 - RNA, 22 nt, Human
aggggaggcucacucagccaug

SEQ ID NO: 327167 - RNA, 21 nt, Human
aguaguccccacauguucccu

SEQ ID NO: 327168 - RNA, 20 nt, Human
aguggcuucuagaaacuucu

SEQ ID NO: 327169 - RNA, 23 nt, Human
auucaaggaggaggaauccugag

SEQ ID NO: 327170 - RNA, 23 nt, Human
auucaaggaggaggaauccugag

SEQ ID NO: 327171 - RNA, 20 nt, Human
caaaacagagacugcuuagc

SEQ ID NO: 327172 - RNA, 20 nt, Human
caaaacagagacugcuuagc

SEQ ID NO: 327173 - RNA, 20 nt, Human
caacugccaggccuggucac

SEQ ID NO: 327174 - RNA, 20 nt, Human
caacugccaggccuggucac

SEQ ID NO: 327175 - RNA, 23 nt, Human
caaguccauccccaaggcuguaa

SEQ ID NO: 327176 - RNA, 23 nt, Human
caaguccauccccaaggcuguaa

SEQ ID NO: 327177 - RNA, 21 nt, Human
cacuuuccccagacccaccuu

SEQ ID NO: 327178 - RNA, 21 nt, Human
cagcaggguccucuccuaacu

SEQ ID NO: 327179 - RNA, 19 nt, Human
cagcaguguuggagcuggu

SEQ ID NO: 327180 - RNA, 19 nt, Human
caggaaacugaagcucaca

SEQ ID NO: 327181 - RNA, 22 nt, Human
caggaucaggcacuugagagcc

SEQ ID NO: 327182 - RNA, 22 nt, Human
caggaucaggcacuugagagcc

SEQ ID NO: 327183 - RNA, 20 nt, Human
caggcacuugagagcccccc

SEQ ID NO: 327184 - RNA, 20 nt, Human
caggcacuugagagcccccc

SEQ ID NO: 327185 - RNA, 20 nt, Human
cagugggccuuccccugaac

SEQ ID NO: 327186 - RNA, 24 nt, Human
cauccagcccuuccgauguguggu

SEQ ID NO: 327187 - RNA, 22 nt, Human
cauggaagcaaaacagagacug

SEQ ID NO: 327188 - RNA, 22 nt, Human
cauggaagcaaaacagagacug

SEQ ID NO: 327189 - RNA, 19 nt, Human
ccaccuucccaggcuugag

SEQ ID NO: 327190 - RNA, 20 nt, Human
ccaggaaggaguggcuggag

SEQ ID NO: 327191 - RNA, 20 nt, Human
ccaggaaggaguggcuggag

SEQ ID NO: 327192 - RNA, 20 nt, Human
ccaggggaggcucacucagc

SEQ ID NO: 327193 - RNA, 21 nt, Human
ccauucuugcaucuggccugu

SEQ ID NO: 327194 - RNA, 21 nt, Human
ccauucuugcaucuggccugu

SEQ ID NO: 327195 - RNA, 21 nt, Human
cccaggggaggcucacucagc

SEQ ID NO: 327196 - RNA, 23 nt, Human
ccccagacccaccuucccaggcu

SEQ ID NO: 327197 - RNA, 20 nt, Human
ccccagcaggguccucuccu

SEQ ID NO: 327198 - RNA, 25 nt, Human
ccccaucucagaaugggcagccagu

SEQ ID NO: 327199 - RNA, 25 nt, Human
ccccaucucagaaugggcagccagu

SEQ ID NO: 327200 - RNA, 21 nt, Human
cccccagaucacucggcccac

SEQ ID NO: 327201 - RNA, 20 nt, Human
cccccagaucacucggcccc

SEQ ID NO: 327202 - RNA, 18 nt, Human
cccccaggcugccucuug

SEQ ID NO: 327203 - RNA, 19 nt, Human
ccccugaacagagaaugga

SEQ ID NO: 327204 - RNA, 22 nt, Human
ccccugaacagagaauggaggc

SEQ ID NO: 327205 - RNA, 27 nt, Human
ccccugaacagagaauggaggccucca

SEQ ID NO: 327206 - RNA, 23 nt, Human
cccuaagaguaguuggugggagu

SEQ ID NO: 327207 - RNA, 21 nt, Human
ccucauggcagcuaagcacuu

SEQ ID NO: 327208 - RNA, 21 nt, Human
ccucauggcagcuaagcacuu

SEQ ID NO: 327209 - RNA, 23 nt, Human
ccuccauaaggccaagcagaagc

SEQ ID NO: 327210 - RNA, 23 nt, Human
ccuccauaaggccaagcagaagc

SEQ ID NO: 327211 - RNA, 31 nt, Human
ccucucacagggcucaggggagguggagguu

SEQ ID NO: 327212 - RNA, 31 nt, Human; identical to SEQ ID NO: 327211

SEQ ID NO: 327213 - RNA, 28 nt, Human
cgggcuccuggaccccagcaggguccuu

SEQ ID NO: 327214 - RNA, 22 nt, Human
cuaagggaaggacaggaucuau

SEQ ID NO: 327215 - RNA, 22 nt, Human
cuccuaacugcugcuguuccac

SEQ ID NO: 327216 - RNA, 24 nt, Human
cucuuaugacacauggguggaggc

SEQ ID NO: 327217 - RNA, 24 nt, Human
cugaguaguccccacauguucccu

SEQ ID NO: 327218 - RNA, 24 nt, Human
cugaguaguccccacauguucccu

SEQ ID NO: 327219 - RNA, 18 nt, Human
cugcugaagcagcugugg

SEQ ID NO: 327220 - RNA, 19 nt, Human
cuugguuacuguucuggag

SEQ ID NO: 327221 - RNA, 22 nt, Human
gaaaauauguguucucuaggac

SEQ ID NO: 327222 - RNA, 21 nt, Human
gacacauggguggaggcaagg

SEQ ID NO: 327223 - RNA, 21 nt, Human
gacacauggguggaggcaagg

SEQ ID NO: 327224 - RNA, 23 nt, Human
gagacuuggagaucaggaccaga

SEQ ID NO: 327225 - RNA, 23 nt, Human
gagacuuggagaucaggaccaga

SEQ ID NO: 327226 - RNA, 18 nt, Human
gagcagguccaaguggga

SEQ ID NO: 327227 - RNA, 19 nt, Human
gagcccagggcaggaucag

SEQ ID NO: 327228 - RNA, 19 nt, Human
gagcccagggcaggaucag

SEQ ID NO: 327229 - RNA, 23 nt, Human
gagcugguaucaaggcagcuguc

SEQ ID NO: 327230 - RNA, 23 nt, Human
gagcugguaucaaggcagcuguc

SEQ ID NO: 327231 - RNA, 19 nt, Human
gaucaggcacuugagagcc

SEQ ID NO: 327232 - RNA, 19 nt, Human
gaucaggcacuugagagcc

SEQ ID NO: 327233 - RNA, 24 nt, Human
gcaaaacagagacugcuuagccuc

SEQ ID NO: 327234 - RNA, 24 nt, Human
gcaaaacagagacugcuuagccuc

SEQ ID NO: 327235 - RNA, 20 nt, Human
gccaggcaggcgggcuccug

SEQ ID NO: 327236 - RNA, 19 nt, Human
gccagggagggccuguggg

SEQ ID NO: 327237 - RNA, 19 nt, Human
gccagggagggccuguggg

SEQ ID NO: 327238 - RNA, 22 nt, Human
gcccacuuuccccagacccacc

SEQ ID NO: 327239 - RNA, 18 nt, Human
gcucugagcccagggcag

SEQ ID NO: 327240 - RNA, 18 nt, Human
gcugugcaguugcuuccc

SEQ ID NO: 327241 - RNA, 23 nt, Human
gcuguggcccccaggcugccucu

SEQ ID NO: 327242 - RNA, 21 nt, Human
ggaaacugaagcucacaaaga

SEQ ID NO: 327243 - RNA, 21 nt, Human
ggaaacugaagcucacaaaga

SEQ ID NO: 327244 - RNA, 18 nt, Human
ggacaccugggcuucuuu

SEQ ID NO: 327245 - RNA, 18 nt, Human
ggacaccugggcuucuuu

SEQ ID NO: 327246 - RNA, 20 nt, Human
ggacccagggcagaaggcag

SEQ ID NO: 327247 - RNA, 27 nt, Human
ggagcugguugggcagccaggcaggcg

SEQ ID NO: 327248 - RNA, 22 nt, Human
ggcagccaggcaggcgggcucc

SEQ ID NO: 327249 - RNA, 21 nt, Human
ggccagcaaccauggaggcag

SEQ ID NO: 327250 - RNA, 21 nt, Human
ggccagcaaccauggaggcag

SEQ ID NO: 327251 - RNA, 19 nt, Human
ggcgucuucuguuccccaa

SEQ ID NO: 327252 - RNA, 21 nt, Human
ggcucugagcccagggcagga

SEQ ID NO: 327253 - RNA, 26 nt, Human
gggagaaggcaagggaggaaacagaa

SEQ ID NO: 327254 - RNA, 19 nt, Human
gggagguggaggugugggc

SEQ ID NO: 327255 - RNA, 19 nt, Human
ggggagguggagguguggg

SEQ ID NO: 327256 - RNA, 19 nt, Human
ggggagguggagguguggg

SEQ ID NO: 327257 - RNA, 20 nt, Human
ggggagguggaggugugggc

SEQ ID NO: 327258 - RNA, 21 nt, Human
ggggcugugcaguugcuuccc

SEQ ID NO: 327259 - RNA, 21 nt, Human
ggggcugugcaguugcuuccc

SEQ ID NO: 327260 - RNA, 19 nt, Human
gguagagauuguggaugaa

SEQ ID NO: 327261 - RNA, 20 nt, Human
ggugcugggcccaggggagg

SEQ ID NO: 327262 - RNA, 21 nt, Human
gucgugccucucacagggcuc

SEQ ID NO: 327263 - RNA, 21 nt, Human
gucgugccucucacagggcuc

SEQ ID NO: 327264 - RNA, 23 nt, Human
gucugucuuugagggcugagaag

SEQ ID NO: 327265 - RNA, 19 nt, Human
uaaccagugggccuucccc

SEQ ID NO: 327266 - RNA, 21 nt, Human
uaaggccaagcagaagcauua

SEQ ID NO: 327267 - RNA, 19 nt, Human
uagaacaggaaacugaagc

SEQ ID NO: 327268 - RNA, 19 nt, Human
uagaacaggaaacugaagc

SEQ ID NO: 327269 - RNA, 21 nt, Human
uauagaacaggaaacugaagc

SEQ ID NO: 327270 - RNA, 21 nt, Human
uauagaacaggaaacugaagc

SEQ ID NO: 327271 - RNA, 18 nt, Human
uauuuucccacuugguua

SEQ ID NO: 327272 - RNA, 18 nt, Human
uauuuucccacuugguua

SEQ ID NO: 327273 - RNA, 20 nt, Human
ucaaggaggaggaauccuga

SEQ ID NO: 327274 - RNA, 20 nt, Human
ucacagggcucaggggaggu

SEQ ID NO: 327275 - RNA, 20 nt, Human
ucacagggcucaggggaggu

SEQ ID NO: 327276 - RNA, 19 nt, Human
ucacuggggcgucuucugu

SEQ ID NO: 327277 - RNA, 22 nt, Human
ucagguagacagugaggagucc

SEQ ID NO: 327278 - RNA, 22 nt, Human
ucagguagacagugaggagucc

SEQ ID NO: 327279 - RNA, 22 nt, Human
uccccagacccaccuucccagg

SEQ ID NO: 327280 - RNA, 24 nt, Human
uccccagacccaccuucccaggcu

SEQ ID NO: 327281 - RNA, 23 nt, Human
uccccugaacagagaauggaggc

SEQ ID NO: 327282 - RNA, 24 nt, Human
ucccuaagaguaguuggugggagu

SEQ ID NO: 327283 - RNA, 20 nt, Human
ucccucauggcagcuaagcu

SEQ ID NO: 327284 - RNA, 20 nt, Human
ucccucauggcagcuaagcu

SEQ ID NO: 327285 - RNA, 18 nt, Human
ucccucugggcuggcucu

SEQ ID NO: 327286 - RNA, 18 nt, Human
ucccucugggcuggcucu

SEQ ID NO: 327287 - RNA, 21 nt, Human
uccggccccuuguccuuacug

SEQ ID NO: 327288 - RNA, 21 nt, Human
uccggccccuuguccuuacug

SEQ ID NO: 327289 - RNA, 21 nt, Human
uccucuccuaacugcugcugu

SEQ ID NO: 327290 - RNA, 22 nt, Human
uccucuccuaacugcugcuguu

SEQ ID NO: 327291 - RNA, 23 nt, Human
uccuggaccccagcaggguccuc

SEQ ID NO: 327292 - RNA, 19 nt, Human
uccuuccccacaccaaccc

SEQ ID NO: 327293 - RNA, 21 nt, Human
ucucuagguguacucagcaaa

SEQ ID NO: 327294 - RNA, 21 nt, Human
ucucuagguguacucagcaaa

SEQ ID NO: 327295 - RNA, 23 nt, Human
ucucugagcuaaccagugggccu

SEQ ID NO: 327296 - RNA, 22 nt, Human
ucugucuuugagggcugagaag

SEQ ID NO: 327297 - RNA, 21 nt, Human
ucuuccagagauuucaacugc

SEQ ID NO: 327298 - RNA, 21 nt, Human
ucuuccagagauuucaacugc

SEQ ID NO: 327299 - RNA, 21 nt, Human
ucuuuugauuggggucaucca

SEQ ID NO: 327300 - RNA, 21 nt, Human
ucuuuugauuggggucaucca

SEQ ID NO: 327301 - RNA, 22 nt, Human
ugagagccccccaccgagccuc

SEQ ID NO: 327302 - RNA, 22 nt, Human
ugagagccccccaccgagccuc

SEQ ID NO: 327303 - RNA, 18 nt, Human
ugagaugggguugggggg

SEQ ID NO: 327304 - RNA, 18 nt, Human
ugagaugggguugggggg

SEQ ID NO: 327305 - RNA, 21 nt, Human
ugagguagaccugaggucccc

SEQ ID NO: 327306 - RNA, 21 nt, Human
ugagguagaccugaggucccc

SEQ ID NO: 327307 - RNA, 19 nt, Human
ugagguccccuggaaauug

SEQ ID NO: 327308 - RNA, 19 nt, Human
ugagguccccuggaaauug

SEQ ID NO: 327309 - RNA, 18 nt, Human
ugagguggggugcugggc

SEQ ID NO: 327310 - RNA, 24 nt, Human
ugagguggggugcugggcccaggg

SEQ ID NO: 327311 - RNA, 19 nt, Human
ugauuggggucauccagcc

SEQ ID NO: 327312 - RNA, 19 nt, Human
ugauuggggucauccagcc

SEQ ID NO: 327313 - RNA, 20 nt, Human
ugcauggaugguuaugaccc

SEQ ID NO: 327314 - RNA, 18 nt, Human
ugcucauucucucaggua

SEQ ID NO: 327315 - RNA, 22 nt, Human
uggagcuuguacccucugagcu

SEQ ID NO: 327316 - RNA, 22 nt, Human
uggagcuuguacccucugagcu

SEQ ID NO: 327317 - RNA, 22 nt, Human
uggaggugugggcaaguccauc

SEQ ID NO: 327318 - RNA, 22 nt, Human
uggaggugugggcaaguccauc

SEQ ID NO: 327319 - RNA, 23 nt, Human
uggaguggcuucuagaaacuucu

SEQ ID NO: 327320 - RNA, 20 nt, Human
uggaugguuaugacccugau

SEQ ID NO: 327321 - RNA, 20 nt, Human
uggaugguuaugacccugau

SEQ ID NO: 327322 - RNA, 20 nt, Human
uggcuggaguggcuucuaga

SEQ ID NO: 327323 - RNA, 20 nt, Human
uggcuggaguggcuucuaga

SEQ ID NO: 327324 - RNA, 21 nt, Human
uggcuggaguggcuucuagaa

SEQ ID NO: 327325 - RNA, 21 nt, Human
uggcuggaguggcuucuagaa

SEQ ID NO: 327326 - RNA, 24 nt, Human
uggcuggaguggcuucuagaaacu

SEQ ID NO: 327327 - RNA, 24 nt, Human
uggcuggaguggcuucuagaaacu

SEQ ID NO: 327328 - RNA, 18 nt, Human
ugggcaggaccucgggug

SEQ ID NO: 327329 - RNA, 18 nt, Human
ugggcaggaccucgggug

SEQ ID NO: 327330 - RNA, 22 nt, Human
ugggcuggcucugagcccaggg

SEQ ID NO: 327331 - RNA, 22 nt, Human
ugggcuggcucugagcccaggg

SEQ ID NO: 327332 - RNA, 23 nt, Human
uggggccaacagaggaagcagag

SEQ ID NO: 327333 - RNA, 24 nt, Human
uggggccaacagaggaagcagagg

SEQ ID NO: 327334 - RNA, 24 nt, Human
uggggccaacagaggaagcagagg

SEQ ID NO: 327335 - RNA, 20 nt, Human
uguaaggaaggagcagcucc

SEQ ID NO: 327336 - RNA, 20 nt, Human
uguaaggaaggagcagcucc

SEQ ID NO: 327337 - RNA, 26 nt, Human
uguacucagcaaaugcaagguauagu

SEQ ID NO: 327338 - RNA, 26 nt, Human
uguacucagcaaaugcaagguauagu

SEQ ID NO: 327339 - RNA, 21 nt, Human
ugucaggggcggcgugccugg

SEQ ID NO: 327340 - RNA, 21 nt, Human
ugucaggggcggcgugccugg

SEQ ID NO: 327341 - RNA, 18 nt, Human
ugugcaguugcuucccuc

SEQ ID NO: 327342 - RNA, 18 nt, Human
ugugcaguugcuucccuc

SEQ ID NO: 327343 - RNA, 21 nt, Human
uguggucagggagcagaguca

SEQ ID NO: 327344 - RNA, 21 nt, Human
uguggucagggagcagaguca

SEQ ID NO: 327345 - RNA, 23 nt, Human
uguucccucuuccagagauuuca

SEQ ID NO: 327346 - RNA, 23 nt, Human
uguucuuucuuuugauugggguc

SEQ ID NO: 327347 - RNA, 20 nt, Human
uuacugcugcugcuuccugu

SEQ ID NO: 327348 - RNA, 20 nt, Human
uuacugcugcugcuuccugu

SEQ ID NO: 327349 - RNA, 19 nt, Human
uuauuuucccacuugguua

SEQ ID NO: 327350 - RNA, 23 nt, Human
uucauccccaucucagaaugggc

SEQ ID NO: 327351 - RNA, 23 nt, Human
uucauccccaucucagaaugggc

SEQ ID NO: 327352 - RNA, 25 nt, Human
uuccccagacccaccuucccaggcu

SEQ ID NO: 327353 - RNA, 21 nt, Human
uugcuucccucugggcuggcu

SEQ ID NO: 327354 - RNA, 21 nt, Human
uugcuucccucugggcuggcu

SEQ ID NO: 327355 - RNA, 18 nt, Human
uugguuacuguucuggag

SEQ ID NO: 327356 - RNA, 25 nt, Human
uuguccuuacugcugcugcuuccug

SEQ ID NO: 327357 - RNA, 25 nt, Human
uuguccuuacugcugcugcuuccug

SEQ ID NO: 327358 - RNA, 22 nt, Human
uuuccacagagagcugguauca

SEQ ID NO: 327359 - RNA, 22 nt, Human
uuuccacagagagcugguauca

SEQ ID NO: 327360 - RNA, 23 nt, Human
uuucuuugucugucauaaaugcc

SEQ ID NO: 327361 - RNA, 23 nt, Human
uuucuuugucugucauaaaugcc

SEQ ID NO: 327362 - RNA, 24 nt, Human
acaaaacagaauauuacaaaauau

SEQ ID NO: 327363 - RNA, 18 nt, Human
acaccgugaacaccaggu

SEQ ID NO: 327364 - RNA, 24 nt, Human
acagugcauggugguacggggaca

SEQ ID NO: 327365 - RNA, 18 nt, Human
accaaagcacaauccagc

SEQ ID NO: 327366 - RNA, 21 nt, Human
accaaagcacaauccagccca

SEQ ID NO: 327367 - RNA, 25 nt, Human
acucugaagaguugccagugagaga

SEQ ID NO: 327368 - RNA, 26 nt, Human
aggcaucggcggcugucugcagagcu

SEQ ID NO: 327369 - RNA, 22 nt, Human
agguaauagaagccuauguacc

SEQ ID NO: 327370 - RNA, 20 nt, Human
agucuagcuucuuuuaaaaa

SEQ ID NO: 327371 - RNA, 23 nt, Human
agugauggcggcagcggccgggg

SEQ ID NO: 327372 - RNA, 18 nt, Human
agugguggggauggggga

SEQ ID NO: 327373 - RNA, 20 nt, Human
agugguggggaugggggagg

SEQ ID NO: 327374 - RNA, 23 nt, Human
auccucuguagccuuggcugcaa

SEQ ID NO: 327375 - RNA, 20 nt, Human
caaccacuuuccucgagagc

SEQ ID NO: 327376 - RNA, 19 nt, Human
cacaauccagcccaauuuc

SEQ ID NO: 327377 - RNA, 20 nt, Human
caccgugaacaccaggucag

SEQ ID NO: 327378 - RNA, 20 nt, Human
cagagcugcuacucgccccu

SEQ ID NO: 327379 - RNA, 21 nt, Human
cagagcugcuacucgccccuc

SEQ ID NO: 327380 - RNA, 19 nt, Human
cagcaacaccgugaacacc

SEQ ID NO: 327381 - RNA, 25 nt, Human
cagugcuaacacauuuacauauaaa

SEQ ID NO: 327382 - RNA, 24 nt, Human
ccccaauaaaacauuggaaaaagg

SEQ ID NO: 327383 - RNA, 21 nt, Human
ccccagcucgucuucuaggcg

SEQ ID NO: 327384 - RNA, 21 nt, Human
cccccagcucgucuucuaggc

SEQ ID NO: 327385 - RNA, 19 nt, Human
cccgcggcuccgagccccg

SEQ ID NO: 327386 - RNA, 24 nt, Human
ccgccgcccggcccgcggcuccga

SEQ ID NO: 327387 - RNA, 22 nt, Human
ccucagggccgccgcccggccc

SEQ ID NO: 327388 - RNA, 21 nt, Human
ccucuugucagggaugcggaa

SEQ ID NO: 327389 - RNA, 23 nt, Human
cgacagugauggcggcagcggcc

SEQ ID NO: 327390 - RNA, 19 nt, Human
cgccgcccggcccgcggcu

SEQ ID NO: 327391 - RNA, 27 nt, Human
cgcggcggcggcggcggccucgccucc

SEQ ID NO: 327392 - RNA, 24 nt, Human
cgcuggggacgaggacagcggcuc

SEQ ID NO: 327393 - RNA, 21 nt, Human
cugcaucauccauuaccacuc

SEQ ID NO: 327394 - RNA, 21 nt, Human
cugcaucauccauuaccacuc

SEQ ID NO: 327395 - RNA, 21 nt, Human
cugcaucauccauuaccacuc

SEQ ID NO: 327396 - RNA, 21 nt, Human
cuuagugccaguuugcuccuc

SEQ ID NO: 327397 - RNA, 25 nt, Human
cuuggccuuguagaaggcaucggcg

SEQ ID NO: 327398 - RNA, 22 nt, Human
cuuggcugcaaacucauucuug

SEQ ID NO: 327399 - RNA, 20 nt, Human
gaagcugcccaauuccuggu

SEQ ID NO: 327400 - RNA, 23 nt, Human
gagccccgcggcggcggcggcgg

SEQ ID NO: 327401 - RNA, 20 nt, Human
gagcugcuacucgccccuca

SEQ ID NO: 327402 - RNA, 20 nt, Human
gaggggcgacugggcgggcg

SEQ ID NO: 327403 - RNA, 21 nt, Human
gaggguggaguaggaacagca

SEQ ID NO: 327404 - RNA, 23 nt, Human
gcccgcggcuccgagccccgcgg

SEQ ID NO: 327405 - RNA, 27 nt, Human
gcgacagugauggcggcagcggccuuu

SEQ ID NO: 327406 - RNA, 20 nt, Human
gcggcggcggcggcggccuc

SEQ ID NO: 327407 - RNA, 22 nt, Human
ggacgaggacagcggcuccgcc

SEQ ID NO: 327408 - RNA, 18 nt, Human
ggagaagggguaccugcu

SEQ ID NO: 327409 - RNA, 18 nt, Human
ggcggcggcggcggccuc

SEQ ID NO: 327410 - RNA, 19 nt, Human
gggagggauauuuacagug

SEQ ID NO: 327411 - RNA, 20 nt, Human
gggcguugggcgggaccgcu

SEQ ID NO: 327412 - RNA, 20 nt, Human
ggggagggauauuuacagug

SEQ ID NO: 327413 - RNA, 22 nt, Human
ggggaugggggaggggaccagg

SEQ ID NO: 327414 - RNA, 20 nt, Human
gguaauagaagccuauguac

SEQ ID NO: 327415 - RNA, 20 nt, Human
gucagggaugcggaagucac

SEQ ID NO: 327416 - RNA, 21 nt, Human
gucuaggaacuggccccccag

SEQ ID NO: 327417 - RNA, 23 nt, Human
gucuaggaacuggccccccagcu

SEQ ID NO: 327418 - RNA, 24 nt, Human
gugauggcggcagcggccgggguc

SEQ ID NO: 327419 - RNA, 25 nt, Human
gugauggcggcagcggccggggucc

SEQ ID NO: 327420 - RNA, 19 nt, Human
gugguacggggacaaccac

SEQ ID NO: 327421 - RNA, 19 nt, Human
uaaaggcaauccuccuggu

SEQ ID NO: 327422 - RNA, 22 nt, Human
uaaaggcaauccuccuggucca

SEQ ID NO: 327423 - RNA, 20 nt, Human
uaccacucaguggaauucca

SEQ ID NO: 327424 - RNA, 20 nt, Human
uaccacucaguggaauucca

SEQ ID NO: 327425 - RNA, 20 nt, Human
uaccacucaguggaauucca

SEQ ID NO: 327426 - RNA, 20 nt, Human
uaccuggaauggauuuugug

SEQ ID NO: 327427 - RNA, 22 nt, Human
uaccuggaauggauuuuguguu

SEQ ID NO: 327428 - RNA, 26 nt, Human
uacucgccccucaauacgcucuucug

SEQ ID NO: 327429 - RNA, 23 nt, Human
uagcuggcucggauguggaagcu

SEQ ID NO: 327430 - RNA, 18 nt, Human
uccauggcgaggggaagc

SEQ ID NO: 327431 - RNA, 19 nt, Human
uccgaagggucaugaaaaa

SEQ ID NO: 327432 - RNA, 21 nt, Human
uccuggugauugucauccuga

SEQ ID NO: 327433 - RNA, 22 nt, Human
ucgggccgccacuagcccucag

SEQ ID NO: 327434 - RNA, 26 nt, Human
ucgggccgccacuagcccucagggcc

SEQ ID NO: 327435 - RNA, 22 nt, Human
ucuuuaggagaagggguaccug

SEQ ID NO: 327436 - RNA, 20 nt, Human
ugagagaaaucagcuugaaa

SEQ ID NO: 327437 - RNA, 20 nt, Human
uggaagcugcccaauuccug

SEQ ID NO: 327438 - RNA, 22 nt, Human
uggcaagcuucugaagaagucu

SEQ ID NO: 327439 - RNA, 23 nt, Human
uggcgaggggaagcggcugaggg

SEQ ID NO: 327440 - RNA, 19 nt, Human
ugggcugauuccgaagggu

SEQ ID NO: 327441 - RNA, 18 nt, Human
uggggacgaggacagcgg

SEQ ID NO: 327442 - RNA, 22 nt, Human
ugggggaggggaccagggagag

SEQ ID NO: 327443 - RNA, 18 nt, Human
ugggguauauuaacaaaa

SEQ ID NO: 327444 - RNA, 20 nt, Human
uguaccaauuucuaaaacag

SEQ ID NO: 327445 - RNA, 18 nt, Human
uuagugccaguuugcucc

SEQ ID NO: 327446 - RNA, 22 nt, Human
uugccagugagagaaaucagcu

SEQ ID NO: 327447 - RNA, 23 nt, Human
uugccagugagagaaaucagcuu

SEQ ID NO: 327448 - RNA, 21 nt, Human
uuguagaaggcaucggcggcu

SEQ ID NO: 327449 - RNA, 21 nt, Human
uuucgggccgccacuagcccu

SEQ ID NO: 327450 - RNA, 18 nt, Human
uuugcuccucuucaucuu

SEQ ID NO: 327451 - RNA, 20 nt, Human
uuuuuuuuuuucagggaguc

SEQ ID NO: 327452 - RNA, 19 nt, Human
aaagcuuaauauuaaacau

SEQ ID NO: 327453 - RNA, 19 nt, Human
aagaaacuacaaaauacaa

SEQ ID NO: 327454 - RNA, 23 nt, Human
caguaguuaagauccagaggaga

SEQ ID NO: 327455 - RNA, 22 nt, Human
uagcuggcaccucuguagggca

SEQ ID NO: 327456 - RNA, 24 nt, Human
uauguagaacaagucaugaacacu

SEQ ID NO: 327457 - RNA, 23 nt, Human
ugaaaaauacauauuuacagaag

SEQ ID NO: 327458 - RNA, 26 nt, Human
ugaaaaauacauauuuacagaagaaa

SEQ ID NO: 327459 - RNA, 21 nt, Human
uguagaacaagucaugaacac

SEQ ID NO: 327460 - RNA, 20 nt, Human
uuuacagaagaaacuacaaa

SEQ ID NO: 327461 - RNA, 23 nt, Human
aaaaacaaaggaaaagcaaaagc

SEQ ID NO: 327462 - RNA, 24 nt, Human
aaaaauaucucaauagucucaaag

SEQ ID NO: 327463 - RNA, 19 nt, Human
aaacacacacccauacaca

SEQ ID NO: 327464 - RNA, 21 nt, Human
aaacacacacccauacacaca

SEQ ID NO: 327465 - RNA, 20 nt, Human
aaauagcuauauuaaauuuc

SEQ ID NO: 327466 - RNA, 22 nt, Human
aacaaauauguuuguauucuuc

SEQ ID NO: 327467 - RNA, 24 nt, Human
aagaauucucucucuuucucuguc

SEQ ID NO: 327468 - RNA, 20 nt, Human
aaugaaaguuaugaauggga

SEQ ID NO: 327469 - RNA, 23 nt, Human
acacacauacauauacacacaua

SEQ ID NO: 327470 - RNA, 22 nt, Human
acacacauaccaccuuuaugua

SEQ ID NO: 327471 - RNA, 27 nt, Human
acacacccauacacacauacauauaca

SEQ ID NO: 327472 - RNA, 24 nt, Human
aguagaacaaggaggacaucuuga

SEQ ID NO: 327473 - RNA, 22 nt, Human
aguuaacacuucuaauauaaaa

SEQ ID NO: 327474 - RNA, 25 nt, Human
auaaaaacaaaggaaaagcaaaagc

SEQ ID NO: 327475 - RNA, 18 nt, Human
auacacacacauaccacc

SEQ ID NO: 327476 - RNA, 22 nt, Human
auacacacauacauauacacac

SEQ ID NO: 327477 - RNA, 25 nt, Human
augaaaaauuccauaaaaauagcua

SEQ ID NO: 327478 - RNA, 23 nt, Human
augauuaagacauuuauaaggac

SEQ ID NO: 327479 - RNA, 22 nt, Human
caaacacacacccauacacaca

SEQ ID NO: 327480 - RNA, 31 nt, Human
caaacacacacccauacacacauacauauag

SEQ ID NO: 327481 - RNA, 22 nt, Human
caagcuaaguuaacacuucuaa

SEQ ID NO: 327482 - RNA, 27 nt, Human
caaugaaaaauuccauaaaaauagcua

SEQ ID NO: 327483 - RNA, 30 nt, Human
cacacaaacacacacccauacacacauaca

SEQ ID NO: 327484 - RNA, 22 nt, Human
cacacacccauacacacauaca

SEQ ID NO: 327485 - RNA, 31 nt, Human
cacacacccauacacacauacauauacacag

SEQ ID NO: 327486 - RNA, 22 nt, Human
cacacauacauauacacacaua

SEQ ID NO: 327487 - RNA, 24 nt, Human
cacacauaccaccuuuauguacua

SEQ ID NO: 327488 - RNA, 18 nt, Human
cacaguaguaaaauauaa

SEQ ID NO: 327489 - RNA, 31 nt, Human
cacauacauauacacacauaacgauuacagu

SEQ ID NO: 327490 - RNA, 24 nt, Human
cacuguugucuuaucagacgagga

SEQ ID NO: 327491 - RNA, 24 nt, Human
cccauacacacauacauauacaca

SEQ ID NO: 327492 - RNA, 27 nt, Human
ccuuucuccacuguugucuuaucagac

SEQ ID NO: 327493 - RNA, 25 nt, Human
cucacacaaacacacacccauacac

SEQ ID NO: 327494 - RNA, 23 nt, Human
cugaaaaaagcaacauacucuua

SEQ ID NO: 327495 - RNA, 26 nt, Human
cuuccuacuucuacaaaaauagaaau

SEQ ID NO: 327496 - RNA, 20 nt, Human
gacaucuugaggucauuuca

SEQ ID NO: 327497 - RNA, 18 nt, Human
gcaaaauugaaaacccca

SEQ ID NO: 327498 - RNA, 28 nt, Human
gcauacacacacauaccaccuuuaugua

SEQ ID NO: 327499 - RNA, 20 nt, Human
gcguccuuucuccacuguug

SEQ ID NO: 327500 - RNA, 23 nt, Human
guagaacaaggaggacaucuuga

SEQ ID NO: 327501 - RNA, 22 nt, Human
gucaaguuugggaaaaguuacu

SEQ ID NO: 327502 - RNA, 20 nt, Human
uaaaaacagauccuucaagc

SEQ ID NO: 327503 - RNA, 22 nt, Human
uaaaagagaguagaaaccuguu

SEQ ID NO: 327504 - RNA, 22 nt, Human
uaaaauuaguaaaaauauaaau

SEQ ID NO: 327505 - RNA, 19 nt, Human
uaaaugcauuuuuuuauag

SEQ ID NO: 327506 - RNA, 21 nt, Human
uaaauuuuaaauauuguacag

SEQ ID NO: 327507 - RNA, 20 nt, Human
uaagaacaagugaaugucaa

SEQ ID NO: 327508 - RNA, 25 nt, Human
uaagauagauauauaugaguagaaa

SEQ ID NO: 327509 - RNA, 19 nt, Human
uaagcauacgucuguacaa

SEQ ID NO: 327510 - RNA, 24 nt, Human
uaagcucacuggaaauuuuuuaau

SEQ ID NO: 327511 - RNA, 22 nt, Human
uaauaauagaaaauuguaguua

SEQ ID NO: 327512 - RNA, 18 nt, Human
uaaugcauacugucaacc

SEQ ID NO: 327513 - RNA, 21 nt, Human
uacaaaaauagaaauaacagc

SEQ ID NO: 327514 - RNA, 24 nt, Human
uacaaugaauauuaauacauauug

SEQ ID NO: 327515 - RNA, 24 nt, Human
uacaaugaauauuaauacauauug

SEQ ID NO: 327516 - RNA, 25 nt, Human
uacacacacauaccaccuuuaugua

SEQ ID NO: 327517 - RNA, 19 nt, Human
uacauauacacacauaacg

SEQ ID NO: 327518 - RNA, 21 nt, Human
uaccacugaaaaaagcaacau

SEQ ID NO: 327519 - RNA, 24 nt, Human
uauaagauuucccaauguuaauuu

SEQ ID NO: 327520 - RNA, 23 nt, Human
uaucaagcaauaaauuuuaaaua

SEQ ID NO: 327521 - RNA, 19 nt, Human
uaucauauuuuucauauca

SEQ ID NO: 327522 - RNA, 19 nt, Human
uauuuaaguucaauuguac

SEQ ID NO: 327523 - RNA, 23 nt, Human
ucaaagguuuugcauaccacuga

SEQ ID NO: 327524 - RNA, 20 nt, Human
ucaaguuugggaaaaguuac

SEQ ID NO: 327525 - RNA, 18 nt, Human
ucaauagucucaaagguu

SEQ ID NO: 327526 - RNA, 18 nt, Human
ucauaaaaacaaaggaaa

SEQ ID NO: 327527 - RNA, 22 nt, Human
ucauaucaaugaaaaauuccau

SEQ ID NO: 327528 - RNA, 18 nt, Human
ucaugauuauaaaauuua

SEQ ID NO: 327529 - RNA, 18 nt, Human
ucauuucagaaauguaca

SEQ ID NO: 327530 - RNA, 24 nt, Human
uccuacuucuacaaaaauagaaau

SEQ ID NO: 327531 - RNA, 19 nt, Human
ucucaaagguuuugcauac

SEQ ID NO: 327532 - RNA, 19 nt, Human
ucucacacaaacacacacc

SEQ ID NO: 327533 - RNA, 21 nt, Human
ucucacacaaacacacaccca

SEQ ID NO: 327534 - RNA, 26 nt, Human
ucucacacaaacacacacccauacac

SEQ ID NO: 327535 - RNA, 22 nt, Human
ucucacacaaacacacacccuu

SEQ ID NO: 327536 - RNA, 21 nt, Human
ucucucacacaaacacacacc

SEQ ID NO: 327537 - RNA, 18 nt, Human
ucucugucucucacacaa

SEQ ID NO: 327538 - RNA, 25 nt, Human
ugaauuuauuugcagcaucucugug

SEQ ID NO: 327539 - RNA, 18 nt, Human
ugaguagaacaaggagga

SEQ ID NO: 327540 - RNA, 19 nt, Human
ugauaagcucacuggaaau

SEQ ID NO: 327541 - RNA, 18 nt, Human
ugcagcaucucuguguuu

SEQ ID NO: 327542 - RNA, 24 nt, Human
uguacaaaaccuaauuuguuguca

SEQ ID NO: 327543 - RNA, 22 nt, Human
uguaguagcauacacacacaua

SEQ ID NO: 327544 - RNA, 23 nt, Human
uuaaaauaagcauacgucuguac

SEQ ID NO: 327545 - RNA, 19 nt, Human
uucaagcuaaguuaacacu

SEQ ID NO: 327546 - RNA, 18 nt, Human
uucacuugaaagaauucu

SEQ ID NO: 327547 - RNA, 23 nt, Human
uucuacaaaaauagaaauaacag

SEQ ID NO: 327548 - RNA, 24 nt, Human
uucuccacuguugucuuaucagac

SEQ ID NO: 327549 - RNA, 19 nt, Human
uuuacuuaccuucuuaaug

SEQ ID NO: 327550 - RNA, 18 nt, Human
uuuguaguagcauacaca

SEQ ID NO: 327551 - RNA, 25 nt, Human
uuuguaguagcauacacacacauag

SEQ ID NO: 327552 - RNA, 25 nt, Human
uuuucauaucaaugaaaaauuccau

SEQ ID NO: 327553 - RNA, 18 nt, Human
uuuuuuuuuuuuuuuuug

SEQ ID NO: 327554 - RNA, 21 nt, Human
acaggcugaaggaguuuuauu

SEQ ID NO: 327555 - RNA, 20 nt, Human
aggaguuuuauuucaaaugg

SEQ ID NO: 327556 - RNA, 19 nt, Human
aggcauggucaugugggcu

SEQ ID NO: 327557 - RNA, 20 nt, Human
caucuugggaagcagaggcu

SEQ ID NO: 327558 - RNA, 18 nt, Human
cccuccgugccgggcacc

SEQ ID NO: 327559 - RNA, 21 nt, Human
cgggcacccaccuccagcucu

SEQ ID NO: 327560 - RNA, 23 nt, Human
cuccgugccgggcacccaccucc

SEQ ID NO: 327561 - RNA, 24 nt, Human
cugguaggggugacagucugaggc

SEQ ID NO: 327562 - RNA, 19 nt, Human
gaagcagaggcacggggag

SEQ ID NO: 327563 - RNA, 21 nt, Human
gaagcagaggcacggggagug

SEQ ID NO: 327564 - RNA, 20 nt, Human
ggaacugguaggggugacag

SEQ ID NO: 327565 - RNA, 22 nt, Human
ggucaugugggcugggggucca

SEQ ID NO: 327566 - RNA, 22 nt, Human
uccgcaggccccuccgugccgg

SEQ ID NO: 327567 - RNA, 21 nt, Human
ugggaacugguaggggugaca

SEQ ID NO: 327568 - RNA, 18 nt, Human
aaauucacuuuaucgaau

SEQ ID NO: 327569 - RNA, 20 nt, Human
aaauucacuuuaucgaaugg

SEQ ID NO: 327570 - RNA, 19 nt, Human
agaagagacuccauggaua

SEQ ID NO: 327571 - RNA, 22 nt, Human
caauacuaaaaaacuaaaucaa

SEQ ID NO: 327572 - RNA, 18 nt, Human
cacaguuagaaaugaagc

SEQ ID NO: 327573 - RNA, 20 nt, Human
cagaagagacuccauggaua

SEQ ID NO: 327574 - RNA, 26 nt, Human
cagcgagucuguccgaucugaaauuu

SEQ ID NO: 327575 - RNA, 22 nt, Human
cauucccuccccuuggccccua

SEQ ID NO: 327576 - RNA, 21 nt, Human
ccccuaaaauguuauuaugag

SEQ ID NO: 327577 - RNA, 20 nt, Human
ccggagccgcagcgagucug

SEQ ID NO: 327578 - RNA, 22 nt, Human
cgagcagcuuggaaucacugcc

SEQ ID NO: 327579 - RNA, 24 nt, Human
cgagucuguccgaucugggacuuu

SEQ ID NO: 327580 - RNA, 19 nt, Human
gcagcagcgugcgcgagca

SEQ ID NO: 327581 - RNA, 23 nt, Human
uaaaaaaaaguuuacacaguuag

SEQ ID NO: 327582 - RNA, 20 nt, Human
uaagaaggacuucucaagug

SEQ ID NO: 327583 - RNA, 20 nt, Human
uacacaguuagaaaugaagc

SEQ ID NO: 327584 - RNA, 19 nt, Human
uaucgaaugauacauuuug

SEQ ID NO: 327585 - RNA, 22 nt, Human
uaucgaaugauacauuuuguua

SEQ ID NO: 327586 - RNA, 19 nt, Human
uccccuuggccccuaaaau

SEQ ID NO: 327587 - RNA, 23 nt, Human
ugagcaguauggugggaaggggc

SEQ ID NO: 327588 - RNA, 19 nt, Human
ugcagcuuggcagcagcgu

SEQ ID NO: 327589 - RNA, 21 nt, Human
uggcagcagcgugcgcgagca

SEQ ID NO: 327590 - RNA, 23 nt, Human
uuguuuuguguguaauaguccca

SEQ ID NO: 327591 - RNA, 20 nt, Human
uuuaaacauucccuccccuu

SEQ ID NO: 327592 - RNA, 20 nt, Human
uuuguguguaauagucccac

SEQ ID NO: 327593 - RNA, 20 nt, Human
aggcccagccacccagccuc

SEQ ID NO: 327594 - RNA, 24 nt, Human
cauaacaaaauauauacaaagaaa

SEQ ID NO: 327595 - RNA, 21 nt, Human
ccgccgcccuccggggcgccc

SEQ ID NO: 327596 - RNA, 21 nt, Human
ccgccgccgccucggcuccag

SEQ ID NO: 327597 - RNA, 24 nt, Human
ccgccgccucggcuccagcuccgg

SEQ ID NO: 327598 - RNA, 22 nt, Human
ccggccgcgucccgccgccgcc

SEQ ID NO: 327599 - RNA, 21 nt, Human
ccuccggggcgcccggcuguc

SEQ ID NO: 327600 - RNA, 23 nt, Human
cgccugcccgccgcccuccgggg

SEQ ID NO: 327601 - RNA, 20 nt, Human
cggcuccugccgcccgcucg

SEQ ID NO: 327602 - RNA, 18 nt, Human
cucccaggcccagccacc

SEQ ID NO: 327603 - RNA, 21 nt, Human
cucccaggcccagccacccag

SEQ ID NO: 327604 - RNA, 23 nt, Human
cucccaggcccagccacccagcc

SEQ ID NO: 327605 - RNA, 18 nt, Human
gcagaaauauauauuuua

SEQ ID NO: 327606 - RNA, 25 nt, Human
gcauaacaaaauauauacaaagaaa

SEQ ID NO: 327607 - RNA, 26 nt, Human
gcauaacaaaauauauacaaagaaau

SEQ ID NO: 327608 - RNA, 24 nt, Human
gcccgccgcccuccggggcgcccg

SEQ ID NO: 327609 - RNA, 20 nt, Human
gccgccgccucggcuccagc

SEQ ID NO: 327610 - RNA, 26 nt, Human
gcucgcgccggcuccugccgcccgcu

SEQ ID NO: 327611 - RNA, 19 nt, Human
gucuucgccgggcgcgaag

SEQ ID NO: 327612 - RNA, 25 nt, Human
ucucccaggcccagccacccagccu

SEQ ID NO: 327613 - RNA, 25 nt, Human
ucucccgggcgccugcccgccgccc

SEQ ID NO: 327614 - RNA, 19 nt, Human
uggccucugugugucuccc

SEQ ID NO: 327615 - RNA, 20 nt, Human
uggucgcgcagaucgcgcug

SEQ ID NO: 327616 - RNA, 22 nt, Human
ugucucccaggcccagccaccc

SEQ ID NO: 327617 - RNA, 20 nt, Human
uuguccggccggccgcgucc

SEQ ID NO: 327618 - RNA, 23 nt, Human
aaaaaaaaaaaaaaaacaaaaca

SEQ ID NO: 327619 - RNA, 24 nt, Human
aaaaaaaaaaaaaaaacaaaacaa

SEQ ID NO: 327620 - RNA, 22 nt, Human
aaaaaaaaaaaacaaaacaaaa

SEQ ID NO: 327621 - RNA, 25 nt, Human
aaaaaaaaaaaacaaaacaaaauaa

SEQ ID NO: 327622 - RNA, 25 nt, Human
aaaaaaaacaaaacaaaauaaaccc

SEQ ID NO: 327623 - RNA, 21 nt, Human
aaaacaaaauaaaccccaacc

SEQ ID NO: 327624 - RNA, 18 nt, Human
aaaaggcuuuaaagggaa

SEQ ID NO: 327625 - RNA, 21 nt, Human
aaaaucaucuggccccugcuc

SEQ ID NO: 327626 - RNA, 24 nt, Human
aaaaucccucagucuaccccacuu

SEQ ID NO: 327627 - RNA, 19 nt, Human
aaacaaaauaaaccccaac

SEQ ID NO: 327628 - RNA, 23 nt, Human
aaacaaaauaaaccccaaccccu

SEQ ID NO: 327629 - RNA, 19 nt, Human
aaacaccacaccauacugc

SEQ ID NO: 327630 - RNA, 21 nt, Human
aaacaccacaccauacugcaa

SEQ ID NO: 327631 - RNA, 18 nt, Human
aaacagcugcaaaccagg

SEQ ID NO: 327632 - RNA, 21 nt, Human
aagggcugacucuuuuuuuuu

SEQ ID NO: 327633 - RNA, 18 nt, Human
aaguccaguagucuugcc

SEQ ID NO: 327634 - RNA, 25 nt, Human
acaaaaaaaaaaaaaaaacaaaaca

SEQ ID NO: 327635 - RNA, 26 nt, Human
acaaaaaaaaaaaaaaaacaaaacaa

SEQ ID NO: 327636 - RNA, 25 nt, Human
acaaaacaaaauaaaccccaacccc

SEQ ID NO: 327637 - RNA, 31 nt, Human
acaaaacuuaaaaaaacauugaguuuccccc

SEQ ID NO: 327638 - RNA, 22 nt, Human
accacaccauacugcaaugcug

SEQ ID NO: 327639 - RNA, 23 nt, Human
accacgucccucagcuaaaacag

SEQ ID NO: 327640 - RNA, 21 nt, Human
accccacagccuacaaacacc

SEQ ID NO: 327641 - RNA, 18 nt, Human
accgccacccgagcugga

SEQ ID NO: 327642 - RNA, 21 nt, Human
accugugcuauucaccuuggc

SEQ ID NO: 327643 - RNA, 19 nt, Human
acgcugugauccccguggg

SEQ ID NO: 327644 - RNA, 23 nt, Human
acucuuuuuuuuuuuuuuuuugg

SEQ ID NO: 327645 - RNA, 19 nt, Human
agaaaugcgggagcgcaac

SEQ ID NO: 327646 - RNA, 22 nt, Human
agcauccacaagguaaaaauga

SEQ ID NO: 327647 - RNA, 19 nt, Human
agccaggcucugugggccc

SEQ ID NO: 327648 - RNA, 21 nt, Human
agccuagcuagguuuggggac

SEQ ID NO: 327649 - RNA, 18 nt, Human
agcuaugcacccuucccc

SEQ ID NO: 327650 - RNA, 23 nt, Human
agcuaugcacccuuccccgcccc

SEQ ID NO: 327651 - RNA, 19 nt, Human
agggaggaaaaucaucugg

SEQ ID NO: 327652 - RNA, 18 nt, Human
agggauguucuaggcucu

SEQ ID NO: 327653 - RNA, 24 nt, Human
auacaaaaaaaaaaaaaaaacaaa

SEQ ID NO: 327654 - RNA, 21 nt, Human
auagaaaacagacuguguaca

SEQ ID NO: 327655 - RNA, 19 nt, Human
auggcucagaggagcuggg

SEQ ID NO: 327656 - RNA, 20 nt, Human
auggugaugaggaaugccuu

SEQ ID NO: 327657 - RNA, 22 nt, Human
caaaaaaaaaaaaaaaacaaaa

SEQ ID NO: 327658 - RNA, 22 nt, Human
caaaacaaaauaaaccccaacc

SEQ ID NO: 327659 - RNA, 25 nt, Human
caaaacuuaaaaaaacauugaguuu

SEQ ID NO: 327660 - RNA, 21 nt, Human
caaaauaaaccccaaccccua

SEQ ID NO: 327661 - RNA, 22 nt, Human
caaccccaccccaugagaagaa

SEQ ID NO: 327662 - RNA, 22 nt, Human
caagggcugacucuuuuuuuuu

SEQ ID NO: 327663 - RNA, 23 nt, Human
caaugcuggggaccaaagccagg

SEQ ID NO: 327664 - RNA, 19 nt, Human
cacagccagccacagccca

SEQ ID NO: 327665 - RNA, 18 nt, Human
caccacugucaauguggc

SEQ ID NO: 327666 - RNA, 21 nt, Human
caccauacugcaaugcugggg

SEQ ID NO: 327667 - RNA, 21 nt, Human
cacccgagcuggagccggagc

SEQ ID NO: 327668 - RNA, 19 nt, Human
caccuggucccgcucccgc

SEQ ID NO: 327669 - RNA, 18 nt, Human
cacgaggaaggcaauguu

SEQ ID NO: 327670 - RNA, 19 nt, Human
cacggccgagccuccgcuc

SEQ ID NO: 327671 - RNA, 21 nt, Human
cacuagcauccacaagguaaa

SEQ ID NO: 327672 - RNA, 24 nt, Human
cacuggccuggaccugaaaggcca

SEQ ID NO: 327673 - RNA, 24 nt, Human
cagaccccacagccuacaaacacc

SEQ ID NO: 327674 - RNA, 23 nt, Human
cagcaccaagggccgggcaccag

SEQ ID NO: 327675 - RNA, 24 nt, Human
cagccagcagcucccucgggaacc

SEQ ID NO: 327676 - RNA, 21 nt, Human
cagcccaggacaaucaaccga

SEQ ID NO: 327677 - RNA, 21 nt, Human
cagccuacaaacaccacacca

SEQ ID NO: 327678 - RNA, 24 nt, Human
cagcuaugcacccuuccccgcccc

SEQ ID NO: 327679 - RNA, 18 nt, Human
cagcugcaaaccagggag

SEQ ID NO: 327680 - RNA, 22 nt, Human
ccagaccccacagccuacaaac

SEQ ID NO: 327681 - RNA, 22 nt, Human
ccagggccuccacuccuuccgc

SEQ ID NO: 327682 - RNA, 23 nt, Human
ccagggccuccacuccuuccgcc

SEQ ID NO: 327683 - RNA, 21 nt, Human
ccccccgcaagccgcuagggc

SEQ ID NO: 327684 - RNA, 21 nt, Human
ccccgugggcugugcucugcc

SEQ ID NO: 327685 - RNA, 25 nt, Human
cccgagccggagccgaagcuggagc

SEQ ID NO: 327686 - RNA, 27 nt, Human
cccgccaccgccacccgagcuggagcc

SEQ ID NO: 327687 - RNA, 22 nt, Human
cccucagcuaaaacagcuaugc

SEQ ID NO: 327688 - RNA, 23 nt, Human
cccugaggugcaugggguguggc

SEQ ID NO: 327689 - RNA, 18 nt, Human
cccuggggcuggcucagg

SEQ ID NO: 327690 - RNA, 18 nt, Human
ccgaagcuggagccgccg

SEQ ID NO: 327691 - RNA, 20 nt, Human
ccgcaagccgcuagggccgc

SEQ ID NO: 327692 - RNA, 20 nt, Human
ccgccacccgagcuggagcc

SEQ ID NO: 327693 - RNA, 18 nt, Human
ccgccgccaccgcucccg

SEQ ID NO: 327694 - RNA, 19 nt, Human
ccgccgccaccgcucccgc

SEQ ID NO: 327695 - RNA, 21 nt, Human
ccgccgccaccgcucccgccg

SEQ ID NO: 327696 - RNA, 19 nt, Human
ccgccgccgccuccaccug

SEQ ID NO: 327697 - RNA, 25 nt, Human
ccgccgccgccuccaccuggucccg

SEQ ID NO: 327698 - RNA, 22 nt, Human
ccgccgccuccaccuggucccg

SEQ ID NO: 327699 - RNA, 26 nt, Human
ccgccucugccgccgccaccgcuccc

SEQ ID NO: 327700 - RNA, 21 nt, Human
ccgcucccgccaccgccaccc

SEQ ID NO: 327701 - RNA, 21 nt, Human
ccgggcaccagggccuccacu

SEQ ID NO: 327702 - RNA, 28 nt, Human
ccuacaaacaccacaccauacugcaaag

SEQ ID NO: 327703 - RNA, 19 nt, Human
ccuacaaacaccacaccuc

SEQ ID NO: 327704 - RNA, 21 nt, Human
ccucccggcccacggccgagc

SEQ ID NO: 327705 - RNA, 18 nt, Human
ccuccggagccccacggc

SEQ ID NO: 327706 - RNA, 21 nt, Human
ccucugccgccgccaccgcuc

SEQ ID NO: 327707 - RNA, 23 nt, Human
ccuuggccacacagccagacccc

SEQ ID NO: 327708 - RNA, 19 nt, Human
cgagcccgagccggagccg

SEQ ID NO: 327709 - RNA, 19 nt, Human
cgagccggagccgaagcug

SEQ ID NO: 327710 - RNA, 22 nt, Human
cgaggaaggcaauguucugucc

SEQ ID NO: 327711 - RNA, 21 nt, Human
cgccucugccgccgccaccgc

SEQ ID NO: 327712 - RNA, 20 nt, Human
cggagccggagcccgagccc

SEQ ID NO: 327713 - RNA, 21 nt, Human
cggagccggagccggagccgg

SEQ ID NO: 327714 - RNA, 21 nt, Human
cuaugcacccuuccccgcccc

SEQ ID NO: 327715 - RNA, 24 nt, Human
cuccucugccgccgccgccuccac

SEQ ID NO: 327716 - RNA, 25 nt, Human
cucucccagacacaucugugguucu

SEQ ID NO: 327717 - RNA, 24 nt, Human
cucugccgccgccaccgcucccgc

SEQ ID NO: 327718 - RNA, 21 nt, Human
cugccgccgccgccuccaccu

SEQ ID NO: 327719 - RNA, 22 nt, Human
cugccgccgccgccuccaccug

SEQ ID NO: 327720 - RNA, 20 nt, Human
cugcugggccauccacuugc

SEQ ID NO: 327721 - RNA, 18 nt, Human
cuggccccugcucugagg

SEQ ID NO: 327722 - RNA, 21 nt, Human
gaaaacagcugcaaaccaggg

SEQ ID NO: 327723 - RNA, 19 nt, Human
gacagaagggccacagugc

SEQ ID NO: 327724 - RNA, 26 nt, Human
gagaaaugcgggagcgcaacagagag

SEQ ID NO: 327725 - RNA, 20 nt, Human
gagccggagccgaagcugga

SEQ ID NO: 327726 - RNA, 20 nt, Human
gagccggagccggagcccga

SEQ ID NO: 327727 - RNA, 20 nt, Human
gagccggagccggagccgga

SEQ ID NO: 327728 - RNA, 20 nt, Human
gagccggagccggagccgga

SEQ ID NO: 327729 - RNA, 21 nt, Human
gaggaaggcaauguucugucc

SEQ ID NO: 327730 - RNA, 21 nt, Human
gauacggauucgcgaaaggaa

SEQ ID NO: 327731 - RNA, 22 nt, Human
gccagaccccacagccuacaag

SEQ ID NO: 327732 - RNA, 24 nt, Human
gcccacggccgagccuccgcucag

SEQ ID NO: 327733 - RNA, 22 nt, Human
gcccagaggaagaggcgcucuc

SEQ ID NO: 327734 - RNA, 24 nt, Human
gcccugaggugcaugggguguggc

SEQ ID NO: 327735 - RNA, 23 nt, Human
gcuaaaaucccucagucuacccc

SEQ ID NO: 327736 - RNA, 23 nt, Human
gcugugaauguuaaacacacacu

SEQ ID NO: 327737 - RNA, 19 nt, Human
ggcccaggucagccagcag

SEQ ID NO: 327738 - RNA, 25 nt, Human
ggcugacucuuuuuuuuuuuuuuuu

SEQ ID NO: 327739 - RNA, 23 nt, Human
gggaaaacaaaacuuaaaaaaac

SEQ ID NO: 327740 - RNA, 24 nt, Human
gggaaaacaaaacuuaaaaaaaca

SEQ ID NO: 327741 - RNA, 23 nt, Human
gggaccaaagccaggcucugugg

SEQ ID NO: 327742 - RNA, 20 nt, Human
gggcccaggucagccagcag

SEQ ID NO: 327743 - RNA, 20 nt, Human
ggggguggcggaggagaggg

SEQ ID NO: 327744 - RNA, 23 nt, Human
guccaguagucuugccacauugg

SEQ ID NO: 327745 - RNA, 20 nt, Human
gugcuauucaccuuggccac

SEQ ID NO: 327746 - RNA, 21 nt, Human
uaaaaaggaggcuuugcccca

SEQ ID NO: 327747 - RNA, 21 nt, Human
uaauaaggacugauuagagua

SEQ ID NO: 327748 - RNA, 22 nt, Human
uacaaacaccacaccauacugc

SEQ ID NO: 327749 - RNA, 19 nt, Human
uagaguaccauugauagaa

SEQ ID NO: 327750 - RNA, 21 nt, Human
uagauagcgcugcccagagga

SEQ ID NO: 327751 - RNA, 18 nt, Human
uagccuagcuagguuugg

SEQ ID NO: 327752 - RNA, 23 nt, Human
uagcugaaacaggaucucgucug

SEQ ID NO: 327753 - RNA, 18 nt, Human
uaggagggcuggacgaug

SEQ ID NO: 327754 - RNA, 20 nt, Human
uaugcaaugaugcuguaguu

SEQ ID NO: 327755 - RNA, 21 nt, Human
ucagcaagcugggauaauaag

SEQ ID NO: 327756 - RNA, 28 nt, Human
ucagcagaagucauacaaaaaaaaaaaa

SEQ ID NO: 327757 - RNA, 21 nt, Human
ucauacaaaaaaaaaaaaaaa

SEQ ID NO: 327758 - RNA, 26 nt, Human
ucauacaaaaaaaaaaaaaaaacaaa

SEQ ID NO: 327759 - RNA, 25 nt, Human
uccacagccagccacagcccaggac

SEQ ID NO: 327760 - RNA, 18 nt, Human
uccccccgcaagccgcua

SEQ ID NO: 327761 - RNA, 25 nt, Human
ucccgccaccgccacccgagcugga

SEQ ID NO: 327762 - RNA, 22 nt, Human
ucccggcccacggccgagccuc

SEQ ID NO: 327763 - RNA, 20 nt, Human
ucccucgggaaccccaggca

SEQ ID NO: 327764 - RNA, 22 nt, Human
ucccugcauuuagcugaaacag

SEQ ID NO: 327765 - RNA, 23 nt, Human
ucccuggggcuggcucaggggcc

SEQ ID NO: 327766 - RNA, 26 nt, Human
uccucugccgccgccgccuccaccug

SEQ ID NO: 327767 - RNA, 22 nt, Human
ucugccgccgccgccuccaccu

SEQ ID NO: 327768 - RNA, 19 nt, Human
ucugugggcccaggucagc

SEQ ID NO: 327769 - RNA, 25 nt, Human
ucuuggaguggaaaagagcgauuau

SEQ ID NO: 327770 - RNA, 22 nt, Human
ucuuuuuuuuuuuuuuuuuggg

SEQ ID NO: 327771 - RNA, 18 nt, Human
ugaaacgcugugaucccc

SEQ ID NO: 327772 - RNA, 23 nt, Human
ugaacucuacagcacuagcaucc

SEQ ID NO: 327773 - RNA, 24 nt, Human
ugaacucuacagcacuagcaucca

SEQ ID NO: 327774 - RNA, 19 nt, Human
ugaagcagaagccaagggc

SEQ ID NO: 327775 - RNA, 22 nt, Human
ugaagcgggcuccagguggguc

SEQ ID NO: 327776 - RNA, 19 nt, Human
ugacagcaucugcguagga

SEQ ID NO: 327777 - RNA, 21 nt, Human
ugacagcaucugcguaggagg

SEQ ID NO: 327778 - RNA, 23 nt, Human
ugacagcaucugcguaggagggc

SEQ ID NO: 327779 - RNA, 21 nt, Human
ugagaagaagcaugagaaaug

SEQ ID NO: 327780 - RNA, 23 nt, Human
ugaggugcaugggguguggcaca

SEQ ID NO: 327781 - RNA, 19 nt, Human
ugccuugccaggcucuccc

SEQ ID NO: 327782 - RNA, 19 nt, Human
ugcuauucaccuuggccac

SEQ ID NO: 327783 - RNA, 22 nt, Human
ugcuauucaccuuggccacaca

SEQ ID NO: 327784 - RNA, 21 nt, Human
uggaaaagagcgauuaucggg

SEQ ID NO: 327785 - RNA, 23 nt, Human
uggcacacacccuaaccugugcu

SEQ ID NO: 327786 - RNA, 19 nt, Human
uggcagccccagcucugca

SEQ ID NO: 327787 - RNA, 18 nt, Human
uggcccugaggugcaugg

SEQ ID NO: 327788 - RNA, 22 nt, Human
uggccuggaccugaaaggccag

SEQ ID NO: 327789 - RNA, 18 nt, Human
uggcucagaggagcuggg

SEQ ID NO: 327790 - RNA, 24 nt, Human
ugggauagacgaccagggaugagu

SEQ ID NO: 327791 - RNA, 28 nt, Human
uggggcuggcucaggggccauccagggc

SEQ ID NO: 327792 - RNA, 23 nt, Human
uuggcccugaggugcauggggug

SEQ ID NO: 327793 - RNA, 27 nt, Human
uuuaaagggaaaacaaaacuuaaaaaa

SEQ ID NO: 327794 - RNA, 25 nt, Human
uuuuauuuuugugguuuuuuguuuu

SEQ ID NO: 327795 - RNA, 26 nt, Human
uuuuuuuuuuuuggguuuuuuguuuu

SEQ ID NO: 327796 - RNA, 18 nt, Human
uuuuuuuuuuuuuugggu

SEQ ID NO: 327797 - RNA, 21 nt, Human
aaaauaaauaucaaaacuuuu

SEQ ID NO: 327798 - RNA, 22 nt, Human
aaacaaugcuauccacuccauu

SEQ ID NO: 327799 - RNA, 21 nt, Human
aaacuggccaugccuccauac

SEQ ID NO: 327800 - RNA, 19 nt, Human
aaaggagagagccgauccc

SEQ ID NO: 327801 - RNA, 21 nt, Human
aaaguacagcauugccugcua

SEQ ID NO: 327802 - RNA, 18 nt, Human
aaccagcauaaauggaac

SEQ ID NO: 327803 - RNA, 23 nt, Human
aacgcagagccacgcuggggacg

SEQ ID NO: 327804 - RNA, 23 nt, Human
aagaggaaagcagggagguaaac

SEQ ID NO: 327805 - RNA, 21 nt, Human
aagugaccgggaacgcagagc

SEQ ID NO: 327806 - RNA, 19 nt, Human
aagugcccuuucaggauuc

SEQ ID NO: 327807 - RNA, 20 nt, Human
aauagaaacggccggaggaa

SEQ ID NO: 327808 - RNA, 21 nt, Human
acggccggaggaaacggagga

SEQ ID NO: 327809 - RNA, 19 nt, Human
agacauaaaauggcaaaaa

SEQ ID NO: 327810 - RNA, 21 nt, Human
agcagccgaggauccccaacu

SEQ ID NO: 327811 - RNA, 18 nt, Human
agcggagagccccccaaa

SEQ ID NO: 327812 - RNA, 19 nt, Human
agcuccuuccagggccccg

SEQ ID NO: 327813 - RNA, 25 nt, Human
aggaaggaggcauguuugcgagagg

SEQ ID NO: 327814 - RNA, 26 nt, Human
aggaaggaggcauguuugcgagaggg

SEQ ID NO: 327815 - RNA, 22 nt, Human
aggagaggaggacugaagaaaa

SEQ ID NO: 327816 - RNA, 28 nt, Human
aggcagcuccuuccagggccccgggaag

SEQ ID NO: 327817 - RNA, 18 nt, Human
aggcaggcagcuccuucc

SEQ ID NO: 327818 - RNA, 21 nt, Human
aggcaggcagcuccuuccagg

SEQ ID NO: 327819 - RNA, 27 nt, Human
auaauaauaaaagcaauauucacuguc

SEQ ID NO: 327820 - RNA, 25 nt, Human
caaaaaaggccucaaaaaaguucuc

SEQ ID NO: 327821 - RNA, 20 nt, Human
caaaaaaguucucagucuuc

SEQ ID NO: 327822 - RNA, 21 nt, Human
cacuccauuaaaauacagaag

SEQ ID NO: 327823 - RNA, 20 nt, Human
cagacagggaccgcgggcgg

SEQ ID NO: 327824 - RNA, 23 nt, Human
cagcaauaauaauaauaaaagca

SEQ ID NO: 327825 - RNA, 23 nt, Human
cagcauaaauggaacuguuucag

SEQ ID NO: 327826 - RNA, 26 nt, Human
cagcccgagagccggcgggcggcggg

SEQ ID NO: 327827 - RNA, 18 nt, Human
caugacauuaacagaccu

SEQ ID NO: 327828 - RNA, 23 nt, Human
ccaaaauagaaacggccggagga

SEQ ID NO: 327829 - RNA, 22 nt, Human
ccacuccauuaaaauacagaag

SEQ ID NO: 327830 - RNA, 23 nt, Human
ccccccaaaauagaaacggccgg

SEQ ID NO: 327831 - RNA, 18 nt, Human
ccccgcgcucggcggccc

SEQ ID NO: 327832 - RNA, 23 nt, Human
ccgagcgccccccggaaaaucuc

SEQ ID NO: 327833 - RNA, 23 nt, Human
cgagcgccccccggaaaaucuca

SEQ ID NO: 327834 - RNA, 21 nt, Human
cgccccccggaaaaucucaaa

SEQ ID NO: 327835 - RNA, 21 nt, Human
cggcggcggggcugagcgcgg

SEQ ID NO: 327836 - RNA, 23 nt, Human
cgggcuucaggcaggcagcuccu

SEQ ID NO: 327837 - RNA, 22 nt, Human
cggggcugagcgcggcgcggcg

SEQ ID NO: 327838 - RNA, 22 nt, Human
cgucauggaaugucacaucagg

SEQ ID NO: 327839 - RNA, 18 nt, Human
cuccugaaaguuguggcu

SEQ ID NO: 327840 - RNA, 19 nt, Human
cuucagaaguuuacaaauu

SEQ ID NO: 327841 - RNA, 19 nt, Human
gagccccccaaaauagaaa

SEQ ID NO: 327842 - RNA, 21 nt, Human
gaggggagaggcagggggagc

SEQ ID NO: 327843 - RNA, 21 nt, Human
gccugcuaguagaaugcaacc

SEQ ID NO: 327844 - RNA, 23 nt, Human
gcggcgcuggaaacuggccaugc

SEQ ID NO: 327845 - RNA, 18 nt, Human
gcggcggcggggcugagc

SEQ ID NO: 327846 - RNA, 20 nt, Human
ggcggcggcgagcagccgag

SEQ ID NO: 327847 - RNA, 21 nt, Human
gggcggcggcggggcugagcg

SEQ ID NO: 327848 - RNA, 18 nt, Human
gggcuucaggcaggcagc

SEQ ID NO: 327849 - RNA, 23 nt, Human
ggggaaggggaggggagaggcag

SEQ ID NO: 327850 - RNA, 21 nt, Human
ggggaggggagaggcaggggg

SEQ ID NO: 327851 - RNA, 18 nt, Human
gucacaucaggguuugcu

SEQ ID NO: 327852 - RNA, 18 nt, Human
uaaaauacagaaggcaua

SEQ ID NO: 327853 - RNA, 25 nt, Human
uaacaaagaccuucacuguauugaa

SEQ ID NO: 327854 - RNA, 19 nt, Human
uaagacauaaaauggcaaa

SEQ ID NO: 327855 - RNA, 22 nt, Human
uaagacauaaaauggcaaaaaa

SEQ ID NO: 327856 - RNA, 21 nt, Human
uaagggaucucuuaaccagca

SEQ ID NO: 327857 - RNA, 24 nt, Human
uaauacagaguuauccuuuauuuu

SEQ ID NO: 327858 - RNA, 25 nt, Human
uacagcauugccugcuaguagaauu

SEQ ID NO: 327859 - RNA, 23 nt, Human
uaggauaccauuaagacauaaaa

SEQ ID NO: 327860 - RNA, 18 nt, Human
uccacuccauuaaaauac

SEQ ID NO: 327861 - RNA, 19 nt, Human
uccagggccccgggaagga

SEQ ID NO: 327862 - RNA, 22 nt, Human
ucgcccgcuccacgggcccccc

SEQ ID NO: 327863 - RNA, 18 nt, Human
ucggcagcgcagcacagc

SEQ ID NO: 327864 - RNA, 23 nt, Human
ucggcagcgcagcacagcccgag

SEQ ID NO: 327865 - RNA, 21 nt, Human
ucuggcaaaaaaggccucaaa

SEQ ID NO: 327866 - RNA, 23 nt, Human
ugaaaugaacagaggugcaaaug

SEQ ID NO: 327867 - RNA, 24 nt, Human
ugcaaaugcucaguaggauaccau

SEQ ID NO: 327868 - RNA, 20 nt, Human
ugccuaaaauaaaaaggaga

SEQ ID NO: 327869 - RNA, 19 nt, Human
uggaauccgggaagccgcc

SEQ ID NO: 327870 - RNA, 23 nt, Human
uggcaaaaaaggccucaaaaaag

SEQ ID NO: 327871 - RNA, 22 nt, Human
uggcuccggcgcaggcugggaa

SEQ ID NO: 327872 - RNA, 20 nt, Human
ugggaaagcuguaauacaga

SEQ ID NO: 327873 - RNA, 18 nt, Human
ugggaaggaacgaagagc

SEQ ID NO: 327874 - RNA, 24 nt, Human
ugggaaggaacgaagagcgcggcg

SEQ ID NO: 327875 - RNA, 20 nt, Human
uuccccggcucgcccgcucc

SEQ ID NO: 327876 - RNA, 20 nt, Human
uuccguuuaaaaaggagaga

SEQ ID NO: 327877 - RNA, 18 nt, Human
uuuacaaauuaagugccc

SEQ ID NO: 327878 - RNA, 21 nt, Human
uuuuuuuuuuuuuuuuacugg

SEQ ID NO: 327879 - RNA, 22 nt, Human
uuuuuuuuuuuuuuuuuacugg

SEQ ID NO: 327880 - RNA, 23 nt, Human
uuuuuuuuuuuuuuuuuacuggg

SEQ ID NO: 327881 - RNA, 25 nt, Human
aaccagaguuugggauaccagcccc

SEQ ID NO: 327882 - RNA, 18 nt, Human
accagcccccuccuccca

SEQ ID NO: 327883 - RNA, 20 nt, Human
acccaggagucugggagccc

SEQ ID NO: 327884 - RNA, 20 nt, Human
acucaucugaagcccaccag

SEQ ID NO: 327885 - RNA, 21 nt, Human
agccagaacuccagacccaaa

SEQ ID NO: 327886 - RNA, 23 nt, Human
agccuguuucuuucugcauccug

SEQ ID NO: 327887 - RNA, 24 nt, Human
aggaugccugggcugccgacccag

SEQ ID NO: 327888 - RNA, 21 nt, Human
cacagcacccaggagucuggg

SEQ ID NO: 327889 - RNA, 21 nt, Human
caccagaccacucucuccugg

SEQ ID NO: 327890 - RNA, 22 nt, Human
cacucucuccuggggaaaccag

SEQ ID NO: 327891 - RNA, 20 nt, Human
cagaauccaggccccagccu

SEQ ID NO: 327892 - RNA, 20 nt, Human
cagcacccaggagucuggga

SEQ ID NO: 327893 - RNA, 24 nt, Human
caggaauccagauccccagcuccc

SEQ ID NO: 327894 - RNA, 24 nt, Human
caucugaagcccaccagaccacuc

SEQ ID NO: 327895 - RNA, 23 nt, Human
ccaaauuccuuccugccucagaa

SEQ ID NO: 327896 - RNA, 24 nt, Human
cccagcccucugcucuuccaggaa

SEQ ID NO: 327897 - RNA, 20 nt, Human
ccccagcucccauaggacuc

SEQ ID NO: 327898 - RNA, 18 nt, Human
ccccuccucccacagcac

SEQ ID NO: 327899 - RNA, 19 nt, Human
ccucaaguagccagaacuc

SEQ ID NO: 327900 - RNA, 23 nt, Human
ccucccacagcacccaggaguug

SEQ ID NO: 327901 - RNA, 23 nt, Human
ccuuccugccucagaauccaggc

SEQ ID NO: 327902 - RNA, 18 nt, Human
ccuuccugccuuuggucc

SEQ ID NO: 327903 - RNA, 24 nt, Human
cgaccccagauuauagaagacuga

SEQ ID NO: 327904 - RNA, 24 nt, Human
cuccagacacugccggggacccag

SEQ ID NO: 327905 - RNA, 22 nt, Human
cugaaguaaaaucaaggcagga

SEQ ID NO: 327906 - RNA, 21 nt, Human
cuugaggaugccugggcugcc

SEQ ID NO: 327907 - RNA, 24 nt, Human
gaaccaggaauccagauccccagc

SEQ ID NO: 327908 - RNA, 18 nt, Human
gacccaggagucccaggc

SEQ ID NO: 327909 - RNA, 18 nt, Human
ggagcccagcccucugcu

SEQ ID NO: 327910 - RNA, 18 nt, Human
ggaugguggggugcagag

SEQ ID NO: 327911 - RNA, 18 nt, Human
ggcacagggacucccucc

SEQ ID NO: 327912 - RNA, 22 nt, Human
ucaaggcaggauccuuccugcc

SEQ ID NO: 327913 - RNA, 22 nt, Human
uccagagcuugaggaugccugg

SEQ ID NO: 327914 - RNA, 24 nt, Human
uccagagcuugaggaugccugggc

SEQ ID NO: 327915 - RNA, 19 nt, Human
uccuggaaagaccuaggga

SEQ ID NO: 327916 - RNA, 19 nt, Human
uccuuccugccuuuggucc

SEQ ID NO: 327917 - RNA, 20 nt, Human
ugccugggcugccgacccag

SEQ ID NO: 327918 - RNA, 18 nt, Human
ugcucuuccaggaaucug

SEQ ID NO: 327919 - RNA, 18 nt, Human
uggggugcagagagaccu

SEQ ID NO: 327920 - RNA, 19 nt, Human
uugggauaccagcccccuc

SEQ ID NO: 327921 - RNA, 23 nt, Human
uugggcacagggacucccuccga

SEQ ID NO: 327922 - RNA, 21 nt, Human
uugguccucaaguagccagaa

SEQ ID NO: 327923 - RNA, 22 nt, Human
aaaaaaagugaccucaucccau

SEQ ID NO: 327924 - RNA, 21 nt, Human
aacagaacaaagaauuaagau

SEQ ID NO: 327925 - RNA, 23 nt, Human
aagggggaaaaaaaaaaaaguga

SEQ ID NO: 327926 - RNA, 20 nt, Human
acacgccggagccuagcgcg

SEQ ID NO: 327927 - RNA, 22 nt, Human
accccucccugcgcaaucauca

SEQ ID NO: 327928 - RNA, 20 nt, Human
agacauggcagcggcggcgg

SEQ ID NO: 327929 - RNA, 21 nt, Human
agcccccgacagccccaauuu

SEQ ID NO: 327930 - RNA, 22 nt, Human
agcggcgcccacccccagcgcg

SEQ ID NO: 327931 - RNA, 26 nt, Human
aguacaaaaauauagaucucuacuga

SEQ ID NO: 327932 - RNA, 19 nt, Human
cacaaaacagaacaaagaa

SEQ ID NO: 327933 - RNA, 20 nt, Human
cacguaccccucccugcgca

SEQ ID NO: 327934 - RNA, 22 nt, Human
ccacccauccacagcccccgac

SEQ ID NO: 327935 - RNA, 23 nt, Human
cccacccccagcgcgcggcuacc

SEQ ID NO: 327936 - RNA, 21 nt, Human
ccccggagacauggcagcggc

SEQ ID NO: 327937 - RNA, 22 nt, Human
ccccugaucaaaugagaacaga

SEQ ID NO: 327938 - RNA, 19 nt, Human
cccgacagccccaauuugu

SEQ ID NO: 327939 - RNA, 23 nt, Human
cccugagcgcgcaggggcuucgc

SEQ ID NO: 327940 - RNA, 18 nt, Human
ccgccgugcgcccgagcc

SEQ ID NO: 327941 - RNA, 19 nt, Human
ccgccgugcgcccgagccc

SEQ ID NO: 327942 - RNA, 18 nt, Human
ccgcugccuccuccgcgc

SEQ ID NO: 327943 - RNA, 21 nt, Human
ccggagccuagcgcggcugcc

SEQ ID NO: 327944 - RNA, 20 nt, Human
ccgugcgcccgagcccgggc

SEQ ID NO: 327945 - RNA, 22 nt, Human
ccuccccugaucaaaugagaac

SEQ ID NO: 327946 - RNA, 20 nt, Human
ccuccugccgucuccuucgc

SEQ ID NO: 327947 - RNA, 18 nt, Human
ccugccgucuccuucgcc

SEQ ID NO: 327948 - RNA, 22 nt, Human
cgccccgggcuuccccggagac

SEQ ID NO: 327949 - RNA, 20 nt, Human
cgcccuggaacgugccccgg

SEQ ID NO: 327950 - RNA, 26 nt, Human
cggcggccgcggccacacgccggagc

SEQ ID NO: 327951 - RNA, 19 nt, Human
cggcucccgcgcucguccc

SEQ ID NO: 327952 - RNA, 21 nt, Human
cucaagggggaaaaaaaaaaa

SEQ ID NO: 327953 - RNA, 21 nt, Human
gaaaaaauggagcacaaauca

SEQ ID NO: 327954 - RNA, 22 nt, Human
gauuugcuccccacccauccac

SEQ ID NO: 327955 - RNA, 24 nt, Human
gcagcggcggcggcggccgcggcc

SEQ ID NO: 327956 - RNA, 20 nt, Human
gcccccgacagccccaauuu

SEQ ID NO: 327957 - RNA, 18 nt, Human
gccccgggcuuccccgga

SEQ ID NO: 327958 - RNA, 23 nt, Human
gcccuggaacgugccccggacgc

SEQ ID NO: 327959 - RNA, 18 nt, Human
ggcagcggcggcggcggc

SEQ ID NO: 327960 - RNA, 22 nt, Human
gggaagaaaaaauggagcacaa

SEQ ID NO: 327961 - RNA, 19 nt, Human
gggcaggggaagcggggcc

SEQ ID NO: 327962 - RNA, 26 nt, Human
gucccugagcgcgcaggggcuucgcg

SEQ ID NO: 327963 - RNA, 20 nt, Human
gucuuuuuaaaaaagaaauu

SEQ ID NO: 327964 - RNA, 22 nt, Human
uaaaaaagaaauuguuuuggaa

SEQ ID NO: 327965 - RNA, 24 nt, Human
uaaaaauagaccucugauacuuaa

SEQ ID NO: 327966 - RNA, 22 nt, Human
uaccccucccugcgcaaucauc

SEQ ID NO: 327967 - RNA, 18 nt, Human
uacugaggaagcaaaccu

SEQ ID NO: 327968 - RNA, 21 nt, Human
ucaagggggaaaaaaaaaaaa

SEQ ID NO: 327969 - RNA, 23 nt, Human
ucauagaucccuuuuccugguuu

SEQ ID NO: 327970 - RNA, 21 nt, Human
ucauaugcagcuucaugcccu

SEQ ID NO: 327971 - RNA, 22 nt, Human
uccaucggcuagauuccaagac

SEQ ID NO: 327972 - RNA, 19 nt, Human
uccccgcuccgcccgcccc

SEQ ID NO: 327973 - RNA, 22 nt, Human
ucccgcgcucgucccgcugccu

SEQ ID NO: 327974 - RNA, 19 nt, Human
ucccugagcgcgcaggggc

SEQ ID NO: 327975 - RNA, 23 nt, Human
ucccugagcgcgcaggggcuucg

SEQ ID NO: 327976 - RNA, 18 nt, Human
uccgcgcgucaugcggcu

SEQ ID NO: 327977 - RNA, 18 nt, Human
uggcagcggcggcggcgg

SEQ ID NO: 327978 - RNA, 21 nt, Human
uuuuccgcaauccucaagggg

SEQ ID NO: 327979 - RNA, 22 nt, Human
aaaaaaagaugauuguguggug

SEQ ID NO: 327980 - RNA, 21 nt, Human
aaaaagcuuucuucaggaaaa

SEQ ID NO: 327981 - RNA, 19 nt, Human
aaaauacuuuuaccucuca

SEQ ID NO: 327982 - RNA, 21 nt, Human
aaacaucaagagaaacauuuu

SEQ ID NO: 327983 - RNA, 23 nt, Human
aaagucucccaccccccacauua

SEQ ID NO: 327984 - RNA, 27 nt, Human
aagcuuucuucaggaaaaaaagaugau

SEQ ID NO: 327985 - RNA, 19 nt, Human
aaguguaacagguacaaca

SEQ ID NO: 327986 - RNA, 18 nt, Human
aauagauggacagguuuc

SEQ ID NO: 327987 - RNA, 20 nt, Human
acacuggaaugcuuuaguca

SEQ ID NO: 327988 - RNA, 21 nt, Human
acagccgcccgcccgcccuuu

SEQ ID NO: 327989 - RNA, 19 nt, Human
acagcuuuucuuuucuucu

SEQ ID NO: 327990 - RNA, 23 nt, Human
acccugaaagcauauauguugcc

SEQ ID NO: 327991 - RNA, 20 nt, Human
agucaauuacaaacugcaag

SEQ ID NO: 327992 - RNA, 19 nt, Human
aguuauauauauuuauaua

SEQ ID NO: 327993 - RNA, 22 nt, Human
caaacuaccucaggggcgaaag

SEQ ID NO: 327994 - RNA, 21 nt, Human
caaauguaaaagucucccacc

SEQ ID NO: 327995 - RNA, 19 nt, Human
cacaaguguaacagguaca

SEQ ID NO: 327996 - RNA, 18 nt, Human
cacaggcugaaaaacucc

SEQ ID NO: 327997 - RNA, 21 nt, Human
caccaaaccauuauuuaccua

SEQ ID NO: 327998 - RNA, 20 nt, Human
cagcaaggccuuuuaaugug

SEQ ID NO: 327999 - RNA, 18 nt, Human
caguccuuuuuauuaaga

SEQ ID NO: 328000 - RNA, 24 nt, Human
caucaaaaaaggaauguaaguaac

SEQ ID NO: 328001 - RNA, 21 nt, Human
cauguaaacaucaagagaaac

SEQ ID NO: 328002 - RNA, 24 nt, Human
cauguacacaagagaaucacuaua

SEQ ID NO: 328003 - RNA, 25 nt, Human
cauuuuaucacccugacaguuuaca

SEQ ID NO: 328004 - RNA, 24 nt, Human
cccccacauuaaaaucuuucugca

SEQ ID NO: 328005 - RNA, 20 nt, Human
cccgcccuuuuuccuucuuc

SEQ ID NO: 328006 - RNA, 18 nt, Human
cccuuuuuccuucuucgc

SEQ ID NO: 328007 - RNA, 26 nt, Human
ccggccgcggcggcagcucuccaugc

SEQ ID NO: 328008 - RNA, 21 nt, Human
cgacggaggagcgggccgggc

SEQ ID NO: 328009 - RNA, 19 nt, Human
cgccaaacuaccucagggg

SEQ ID NO: 328010 - RNA, 18 nt, Human
cuccauauagacauauuu

SEQ ID NO: 328011 - RNA, 20 nt, Human
gaccagugcugggccacagg

SEQ ID NO: 328012 - RNA, 20 nt, Human
gaggacggugagaggacagc

SEQ ID NO: 328013 - RNA, 21 nt, Human
gcacagcuuuucuuuucuucu

SEQ ID NO: 328014 - RNA, 19 nt, Human
gcccuuuuuccuucuucgc

SEQ ID NO: 328015 - RNA, 21 nt, Human
gccgcgaaauccacgacggag

SEQ ID NO: 328016 - RNA, 21 nt, Human
ggccucgcggggugaggacgg

SEQ ID NO: 328017 - RNA, 18 nt, Human
uaaaaacuaauucagucc

SEQ ID NO: 328018 - RNA, 19 nt, Human
uaaaaagaacuuuaaauga

SEQ ID NO: 328019 - RNA, 21 nt, Human
uaaaagacccaauugccaagg

SEQ ID NO: 328020 - RNA, 25 nt, Human
uaaaagucucccaccccccacauua

SEQ ID NO: 328021 - RNA, 26 nt, Human
uaagauacacaacuucauaaaaaaaa

SEQ ID NO: 328022 - RNA, 23 nt, Human
uaaguaaccaauaaauauaaugu

SEQ ID NO: 328023 - RNA, 22 nt, Human
uagaaagaggacacuggaaugc

SEQ ID NO: 328024 - RNA, 22 nt, Human
uagcuaaagaaaaagcuuucuu

SEQ ID NO: 328025 - RNA, 21 nt, Human
uauuaaaagacccaauugcca

SEQ ID NO: 328026 - RNA, 22 nt, Human
ucaagagaaacauuuuaucacc

SEQ ID NO: 328027 - RNA, 21 nt, Human
ucaagcagcuuugcaaagagc

SEQ ID NO: 328028 - RNA, 22 nt, Human
ucaauuacaaacugcaagcuga

SEQ ID NO: 328029 - RNA, 21 nt, Human
ucucccaccccccacauuaaa

SEQ ID NO: 328030 - RNA, 24 nt, Human
ugaaaaacuauacauauucagcaa

SEQ ID NO: 328031 - RNA, 19 nt, Human
ugaggacggugagaggaca

SEQ ID NO: 328032 - RNA, 20 nt, Human
ugagucuuuggcuuauguua

SEQ ID NO: 328033 - RNA, 23 nt, Human
ugagucuuuggcuuauguuauuu

SEQ ID NO: 328034 - RNA, 25 nt, Human
ugaugugaaguuacagcuuccacug

SEQ ID NO: 328035 - RNA, 21 nt, Human
ugccaagggauuuuacacaaa

SEQ ID NO: 328036 - RNA, 21 nt, Human
uggaugcacuuuaaagagucu

SEQ ID NO: 328037 - RNA, 19 nt, Human
uggcucaauagauggacag

SEQ ID NO: 328038 - RNA, 22 nt, Human
ugggagaaguuucaagcagcuu

SEQ ID NO: 328039 - RNA, 22 nt, Human
uguaaacaucaagagaaacauu

SEQ ID NO: 328040 - RNA, 22 nt, Human
uguaugaucaccaaaccauuau

SEQ ID NO: 328041 - RNA, 22 nt, Human
ugugaaguuacagcuacgugga

SEQ ID NO: 328042 - RNA, 18 nt, Human
uuaaaauuuaaaugaugc

SEQ ID NO: 328043 - RNA, 23 nt, Human
uuacaauugauuuuagcuaaaga

SEQ ID NO: 328044 - RNA, 23 nt, Human
uucacuuaagaaucccaugacaa

SEQ ID NO: 328045 - RNA, 23 nt, Human
aauuccuucauaagaauauaguu

SEQ ID NO: 328046 - RNA, 21 nt, Human
agcaaaauaagcauauugaga

SEQ ID NO: 328047 - RNA, 19 nt, Human
auuuaucuguuaguccugg

SEQ ID NO: 328048 - RNA, 25 nt, Human
caaaaacauacacucagcuguaaca

SEQ ID NO: 328049 - RNA, 23 nt, Human
caaaauaagcauauugagaaguc

SEQ ID NO: 328050 - RNA, 24 nt, Human
cauaagaauauaguugugcucuuc

SEQ ID NO: 328051 - RNA, 25 nt, Human
cauacaacauaucuuuguucauuac

SEQ ID NO: 328052 - RNA, 21 nt, Human
caucucuuuugcacaaauacc

SEQ ID NO: 328053 - RNA, 21 nt, Human
ccccaaagguacaaauuccuu

SEQ ID NO: 328054 - RNA, 21 nt, Human
gacagaaacgacgacucauac

SEQ ID NO: 328055 - RNA, 21 nt, Human
gaguccucccccaagcuuuuc

SEQ ID NO: 328056 - RNA, 20 nt, Human
gcauucuccacagaacaaaa

SEQ ID NO: 328057 - RNA, 23 nt, Human
gcauucuccacagaacaaaaaca

SEQ ID NO: 328058 - RNA, 23 nt, Human
uaaaaagagccaauuaugcaaag

SEQ ID NO: 328059 - RNA, 21 nt, Human
uauuaccauaaugccagauag

SEQ ID NO: 328060 - RNA, 19 nt, Human
ucagcuguaacaauaacga

SEQ ID NO: 328061 - RNA, 20 nt, Human
uccucccccaagcuuuuccc

SEQ ID NO: 328062 - RNA, 18 nt, Human
ucuccacagaacaaaaac

SEQ ID NO: 328063 - RNA, 21 nt, Human
ucuucaguuuaccagcugucu

SEQ ID NO: 328064 - RNA, 27 nt, Human
ugaauaaauaauuugaugaaaucaaaa

SEQ ID NO: 328065 - RNA, 26 nt, Human
ugcaaagcaaaauaagcauauugaga

SEQ ID NO: 328066 - RNA, 20 nt, Human
ugcaacauguuaaaguacaa

SEQ ID NO: 328067 - RNA, 20 nt, Human
uggaaacaauacaaaucuga

SEQ ID NO: 328068 - RNA, 18 nt, Human
ugggcucuuaaaaagagc

SEQ ID NO: 328069 - RNA, 28 nt, Human
uggguccgugaaucugauccugguccca

SEQ ID NO: 328070 - RNA, 18 nt, Human
uguaacaauaacgagggu

SEQ ID NO: 328071 - RNA, 20 nt, Human
uguguguguguuucugucag

SEQ ID NO: 328072 - RNA, 21 nt, Human
uuugugaacugaguccucccc

SEQ ID NO: 328073 - RNA, 20 nt, Human
acagaggcugggcugcccgc

SEQ ID NO: 328074 - RNA, 22 nt, Human
acaggcaaagagggacagaggc

SEQ ID NO: 328075 - RNA, 18 nt, Human
agaggcaggcccggggcu

SEQ ID NO: 328076 - RNA, 23 nt, Human
agaggcaggcccggggcugagaa

SEQ ID NO: 328077 - RNA, 21 nt, Human
agcgacgcuggcgggagccug

SEQ ID NO: 328078 - RNA, 20 nt, Human
aggcaggagaaggcucuggg

SEQ ID NO: 328079 - RNA, 21 nt, Human
aggcaggagaaggcucugggu

SEQ ID NO: 328080 - RNA, 21 nt, Human
aggcccggggcugagaagcag

SEQ ID NO: 328081 - RNA, 19 nt, Human
aggcucuggcaugcgaggc

SEQ ID NO: 328082 - RNA, 28 nt, Human
agggggagccggguguggccaggagccu

SEQ ID NO: 328083 - RNA, 19 nt, Human
caacacacuaacuuuauuc

SEQ ID NO: 328084 - RNA, 18 nt, Human
cagcgacgcuggcgggag

SEQ ID NO: 328085 - RNA, 19 nt, Human
caggagaaggcucugggua

SEQ ID NO: 328086 - RNA, 18 nt, Human
ccagaggggcugaggcgg

SEQ ID NO: 328087 - RNA, 22 nt, Human
cgagcuccgggcgcucgcuccc

SEQ ID NO: 328088 - RNA, 22 nt, Human
cgcccaagugugagucagaggc

SEQ ID NO: 328089 - RNA, 24 nt, Human
cggggcugagaagcagggggagcc

SEQ ID NO: 328090 - RNA, 22 nt, Human
cucuucuaggaagggcugagca

SEQ ID NO: 328091 - RNA, 20 nt, Human
cugcacagacaacacacuaa

SEQ ID NO: 328092 - RNA, 23 nt, Human
cugcagcacccccaugggaugcc

SEQ ID NO: 328093 - RNA, 29 nt, Human
cugccagaggggcugaggcggggcuugcc

SEQ ID NO: 328094 - RNA, 23 nt, Human
cugguacaaaaguaguuuuuucu

SEQ ID NO: 328095 - RNA, 18 nt, Human
gacagaggcugggcugcc

SEQ ID NO: 328096 - RNA, 20 nt, Human
gagaagcagggggagccggg

SEQ ID NO: 328097 - RNA, 18 nt, Human
gagagagguugagcagcg

SEQ ID NO: 328098 - RNA, 22 nt, Human
gagcuacaggagagccaggcca

SEQ ID NO: 328099 - RNA, 20 nt, Human
gaggccagggagggcagagc

SEQ ID NO: 328100 - RNA, 21 nt, Human
gaggccagggagggcagagcg

SEQ ID NO: 328101 - RNA, 18 nt, Human
gagguggcugguggggca

SEQ ID NO: 328102 - RNA, 21 nt, Human
gcucugggaugccccaggcuc

SEQ ID NO: 328103 - RNA, 21 nt, Human
gcugguggggcagugaggagg

SEQ ID NO: 328104 - RNA, 18 nt, Human
gggaacucccagaacccc

SEQ ID NO: 328105 - RNA, 22 nt, Human
gggaauguaggcaggagaaggc

SEQ ID NO: 328106 - RNA, 18 nt, Human
gggaugccccaggcucug

SEQ ID NO: 328107 - RNA, 18 nt, Human
gggaugcccugggcucug

SEQ ID NO: 328108 - RNA, 21 nt, Human
gggcagagcgcccaaguguga

SEQ ID NO: 328109 - RNA, 23 nt, Human
gggcaggcgugccccuucuggcu

SEQ ID NO: 328110 - RNA, 30 nt, Human
gggccggagccgcagcgacgcuggcgggaa

SEQ ID NO: 328111 - RNA, 18 nt, Human
gggcgugaggccagggag

SEQ ID NO: 328112 - RNA, 24 nt, Human
gggcugcccgccaaggggccccag

SEQ ID NO: 328113 - RNA, 18 nt, Human
ggguggugggaggaggcu

SEQ ID NO: 328114 - RNA, 23 nt, Human
gguggugggaggaggcugggcgu

SEQ ID NO: 328115 - RNA, 20 nt, Human
guccuuuccucuccuccugg

SEQ ID NO: 328116 - RNA, 21 nt, Human
uaggaagggcugagcaugccc

SEQ ID NO: 328117 - RNA, 20 nt, Human
uccauacuggagcauagggg

SEQ ID NO: 328118 - RNA, 23 nt, Human
ucccagaaccccaggagagcuac

SEQ ID NO: 328119 - RNA, 19 nt, Human
uccuccuggcugcagcacc

SEQ ID NO: 328120 - RNA, 21 nt, Human
ugagaagcagggggagccggg

SEQ ID NO: 328121 - RNA, 19 nt, Human
ugcccugggcucugggaug

SEQ ID NO: 328122 - RNA, 18 nt, Human
uggcugcagcacccccau

SEQ ID NO: 328123 - RNA, 27 nt, Human
uggcugguggggcagugaggagugggu

SEQ ID NO: 328124 - RNA, 24 nt, Human
uggcuuucccuuccugacucuucu

SEQ ID NO: 328125 - RNA, 19 nt, Human
ugggaggaggcugggcgug

SEQ ID NO: 328126 - RNA, 20 nt, Human
ugggaggguggugggaggag

SEQ ID NO: 328127 - RNA, 24 nt, Human
ugggaggguggugggaggaggcug

SEQ ID NO: 328128 - RNA, 25 nt, Human
ugggaggguggugggaggaggcugg

SEQ ID NO: 328129 - RNA, 22 nt, Human
ugggcgugaggccagggagggc

SEQ ID NO: 328130 - RNA, 19 nt, Human
ugggcugcccgccaagggg

SEQ ID NO: 328131 - RNA, 24 nt, Human
uggguacacagagaugcucacaca

SEQ ID NO: 328132 - RNA, 28 nt, Human
uggugggaggaggcugggcgugaggcca

SEQ ID NO: 328133 - RNA, 25 nt, Human
uggugggaggguggugggaggaggc

SEQ ID NO: 328134 - RNA, 21 nt, Human
ugugagucagaggcaggcccg

SEQ ID NO: 328135 - RNA, 23 nt, Human
ugugagucagaggcaggcccggg

SEQ ID NO: 328136 - RNA, 22 nt, Human
uuuuuugcagcugcacagacaa

SEQ ID NO: 328137 - RNA, 18 nt, Human
uuuuuuuuuuuuuuuuug

SEQ ID NO: 328138 - RNA, 21 nt, Human
uuuuuuuuuuuuuuuuugcag

SEQ ID NO: 328139 - RNA, 23 nt, Human
uuuuuuuuuuuuuuuuugcagcu

SEQ ID NO: 328140 - RNA, 21 nt, Human
aaaaaacucagcccaaccagc

SEQ ID NO: 328141 - RNA, 21 nt, Human
aaaaaacucagcccaaccagc

SEQ ID NO: 328142 - RNA, 19 nt, Human
aaaaaacucagcccaaccg

SEQ ID NO: 328143 - RNA, 18 nt, Human
aaaagauuacacaguuga

SEQ ID NO: 328144 - RNA, 18 nt, Human
aaaagauuacacaguuga

SEQ ID NO: 328145 - RNA, 19 nt, Human
aaacaaaaagaaaucucug

SEQ ID NO: 328146 - RNA, 19 nt, Human
aaacaaaaagaaaucucug

SEQ ID NO: 328147 - RNA, 20 nt, Human
aaacaaaaagaaaucucugu

SEQ ID NO: 328148 - RNA, 21 nt, Human
aaacucagcccaaccagcaaa

SEQ ID NO: 328149 - RNA, 21 nt, Human
aaacucagcccaaccagcaaa

SEQ ID NO: 328150 - RNA, 24 nt, Human
aaaguaacaggcuucacaaugcca

SEQ ID NO: 328151 - RNA, 24 nt, Human
aaaguaacaggcuucacaaugcca

SEQ ID NO: 328152 - RNA, 19 nt, Human
aaaugaaacugacaaccaa

SEQ ID NO: 328153 - RNA, 18 nt, Human
aacaaaacaaaaagaaau

SEQ ID NO: 328154 - RNA, 18 nt, Human
aacaaaacaaaaagaaau

SEQ ID NO: 328155 - RNA, 21 nt, Human
aacaaaacaaaaagaaaucuu

SEQ ID NO: 328156 - RNA, 24 nt, Human
aacagaacaaggaaugcaaagucu

SEQ ID NO: 328157 - RNA, 24 nt, Human
aacagaacaaggaaugcaaagucu

SEQ ID NO: 328158 - RNA, 22 nt, Human
aaccaaaagaauaacaaaacaa

SEQ ID NO: 328159 - RNA, 22 nt, Human
aaccaaaagaauaacaaaacaa

SEQ ID NO: 328160 - RNA, 21 nt, Human
aaccaucaagaacuagaacag

SEQ ID NO: 328161 - RNA, 21 nt, Human
aaccaucaagaacuagaacag

SEQ ID NO: 328162 - RNA, 22 nt, Human
aaccccucucuucccugaccaa

SEQ ID NO: 328163 - RNA, 22 nt, Human
aaccccucucuucccugaccaa

SEQ ID NO: 328164 - RNA, 21 nt, Human
aacuuguugacagaaaacuuc

SEQ ID NO: 328165 - RNA, 18 nt, Human
aagauuacuuacaccucc

SEQ ID NO: 328166 - RNA, 21 nt, Human
aagcuccuguuuguugccaac

SEQ ID NO: 328167 - RNA, 20 nt, Human
aaggugcauugaaacucaaa

SEQ ID NO: 328168 - RNA, 22 nt, Human
aauccuauccuucccacugguc

SEQ ID NO: 328169 - RNA, 20 nt, Human
acaaaaaaaaguagucaaau

SEQ ID NO: 328170 - RNA, 20 nt, Human
acaaaaaaaaguagucaaau

SEQ ID NO: 328171 - RNA, 23 nt, Human
acaguaagcagccuggugucaca

SEQ ID NO: 328172 - RNA, 19 nt, Human
acaguacuuguuucucccu

SEQ ID NO: 328173 - RNA, 21 nt, Human
accccucucuucccugaccaa

SEQ ID NO: 328174 - RNA, 21 nt, Human
accccucucuucccugaccaa

SEQ ID NO: 328175 - RNA, 26 nt, Human
acccugucauuggcuccucuuccccc

SEQ ID NO: 328176 - RNA, 20 nt, Human
acugaaaaacaaacacuuaa

SEQ ID NO: 328177 - RNA, 20 nt, Human
acugaaaaacaaacacuuaa

SEQ ID NO: 328178 - RNA, 20 nt, Human
acuguuguuuuugguuuuag

SEQ ID NO: 328179 - RNA, 24 nt, Human
agaaucacacacacacaaaaauua

SEQ ID NO: 328180 - RNA, 24 nt, Human
agaaucacacacacacaaaaauua

SEQ ID NO: 328181 - RNA, 24 nt, Human
agaauccauagagacauuugacaa

SEQ ID NO: 328182 - RNA, 24 nt, Human
agaauccauagagacauuugacaa

SEQ ID NO: 328183 - RNA, 18 nt, Human
agacauuugacaauauua

SEQ ID NO: 328184 - RNA, 18 nt, Human
agacauuugacaauauua

SEQ ID NO: 328185 - RNA, 20 nt, Human
aggaagaaaaccaucaagaa

SEQ ID NO: 328186 - RNA, 20 nt, Human
aggaagaaaaccaucaagaa

SEQ ID NO: 328187 - RNA, 20 nt, Human
aggcaguggcaggaagaagg

SEQ ID NO: 328188 - RNA, 23 nt, Human
agggaggaugggcgcacaucaug

SEQ ID NO: 328189 - RNA, 23 nt, Human
agggaggaugggcgcacaucaug

SEQ ID NO: 328190 - RNA, 20 nt, Human
agugaaagaguccaaaagga

SEQ ID NO: 328191 - RNA, 20 nt, Human
agugaaagaguccaaaagga

SEQ ID NO: 328192 - RNA, 20 nt, Human
agugauuuggguggagcugg

SEQ ID NO: 328193 - RNA, 23 nt, Human
aucagcuacucccucuuccaccc

SEQ ID NO: 328194 - RNA, 18 nt, Human
caaaagggccaaggaaga

SEQ ID NO: 328195 - RNA, 18 nt, Human
caaaagggccaaggaaga

SEQ ID NO: 328196 - RNA, 23 nt, Human
caaagaaaucagcuacucccucu

SEQ ID NO: 328197 - RNA, 21 nt, Human
caagugucuucaugaagcucu

SEQ ID NO: 328198 - RNA, 24 nt, Human
caccacugucaucucccuacccuu

SEQ ID NO: 328199 - RNA, 20 nt, Human
cacugguccauaugcuuccc

SEQ ID NO: 328200 - RNA, 22 nt, Human
cagcaacugguuccugaaguuu

SEQ ID NO: 328201 - RNA, 22 nt, Human
cagcccuuguaaucaauaaaau

SEQ ID NO: 328202 - RNA, 18 nt, Human
ccaaaagaauaacaaaac

SEQ ID NO: 328203 - RNA, 18 nt, Human
ccaaaagaauaacaaaac

SEQ ID NO: 328204 - RNA, 20 nt, Human
ccaaccagcaaagggccaac

SEQ ID NO: 328205 - RNA, 20 nt, Human
ccaaccagcaaagggccaac

SEQ ID NO: 328206 - RNA, 21 nt, Human
ccacauauuacaaagcagggc

SEQ ID NO: 328207 - RNA, 21 nt, Human
ccacauauuacaaagcagggc

SEQ ID NO: 328208 - RNA, 24 nt, Human
ccagcucaugucuuuuuguaaccc

SEQ ID NO: 328209 - RNA, 21 nt, Human
cccacagcaaagucacugaag

SEQ ID NO: 328210 - RNA, 22 nt, Human
cccacagcaaagucacugaagu

SEQ ID NO: 328211 - RNA, 23 nt, Human
cccagcaugcugcagucgaccuc

SEQ ID NO: 328212 - RNA, 23 nt, Human
cccagcaugcugcagucgaccuc

SEQ ID NO: 328213 - RNA, 23 nt, Human
cccaugugaggccaggagcuggg

SEQ ID NO: 328214 - RNA, 23 nt, Human
cccuacccugucauuggcuccuc

SEQ ID NO: 328215 - RNA, 21 nt, Human
cccugggcgccgagguugcuc

SEQ ID NO: 328216 - RNA, 20 nt, Human
cccuuuccuccucugcgccc

SEQ ID NO: 328217 - RNA, 22 nt, Human
ccggcggcggcucacaauggcc

SEQ ID NO: 328218 - RNA, 21 nt, Human
ccucagacccugggcgccgag

SEQ ID NO: 328219 - RNA, 20 nt, Human
ccugcgccugcucccuuucc

SEQ ID NO: 328220 - RNA, 22 nt, Human
ccugcgccugcucccuuuccuc

SEQ ID NO: 328221 - RNA, 19 nt, Human
ccugcucccuuuccuccuc

SEQ ID NO: 328222 - RNA, 24 nt, Human
ccugugaaugagacaaagaaagac

SEQ ID NO: 328223 - RNA, 22 nt, Human
ccuuccugcuccauugugcgcu

SEQ ID NO: 328224 - RNA, 18 nt, Human
ccuuuucccccuuccauu

SEQ ID NO: 328225 - RNA, 18 nt, Human
cguggagagcucuucucc

SEQ ID NO: 328226 - RNA, 22 nt, Human
cucucacuaugcucagucucac

SEQ ID NO: 328227 - RNA, 18 nt, Human
cucuccugugaaugagac

SEQ ID NO: 328228 - RNA, 29 nt, Human
cugaagucuggguuuuguucacugccgcu

SEQ ID NO: 328229 - RNA, 19 nt, Human
cugaaguuugguuuucuga

SEQ ID NO: 328230 - RNA, 20 nt, Human
cugaaguuugguuuucugac

SEQ ID NO: 328231 - RNA, 24 nt, Human
cugguccauaugcuucccagacuu

SEQ ID NO: 328232 - RNA, 18 nt, Human
cugguucugagcaaagac

SEQ ID NO: 328233 - RNA, 23 nt, Human
cuuaaaaauaaaaaacucagccc

SEQ ID NO: 328234 - RNA, 23 nt, Human
cuuaaaaauaaaaaacucagccc

SEQ ID NO: 328235 - RNA, 21 nt, Human
cuuugccuuuucccccuucca

SEQ ID NO: 328236 - RNA, 23 nt, Human
cuuuucccccuuccauuuuuuuu

SEQ ID NO: 328237 - RNA, 19 nt, Human
gaaaucagcuacucccucu

SEQ ID NO: 328238 - RNA, 19 nt, Human
gcaagggaggaugggcgca

SEQ ID NO: 328239 - RNA, 19 nt, Human
gcaagggaggaugggcgca

SEQ ID NO: 328240 - RNA, 21 nt, Human
gcaggucaacagaacaaggaa

SEQ ID NO: 328241 - RNA, 21 nt, Human
gcaggucaacagaacaaggaa

SEQ ID NO: 328242 - RNA, 19 nt, Human
gcaguggcaggaagaaggc

SEQ ID NO: 328243 - RNA, 22 nt, Human
gccacauauuacaaagcagggc

SEQ ID NO: 328244 - RNA, 18 nt, Human
gccugcucccuuuccucc

SEQ ID NO: 328245 - RNA, 20 nt, Human
gccuuuucccccuuccauuu

SEQ ID NO: 328246 - RNA, 21 nt, Human
gcuucugugagauaaauuauc

SEQ ID NO: 328247 - RNA, 21 nt, Human
gcuucugugagauaaauuauc

SEQ ID NO: 328248 - RNA, 19 nt, Human
ggacucgggggcacggcug

SEQ ID NO: 328249 - RNA, 21 nt, Human
ggacucgggggcacggcugcg

SEQ ID NO: 328250 - RNA, 31 nt, Human
ggcucacaauggcgaacuggggcugcagccc

SEQ ID NO: 328251 - RNA, 20 nt, Human
ggcugucauggcuaaagcug

SEQ ID NO: 328252 - RNA, 22 nt, Human
ggcugucauggcuaaagcuggu

SEQ ID NO: 328253 - RNA, 24 nt, Human
gggcugucauggcuaaagcuggug

SEQ ID NO: 328254 - RNA, 23 nt, Human
ggggcugucauggcuaaagcugg

SEQ ID NO: 328255 - RNA, 18 nt, Human
ggguugaucugugcaucu

SEQ ID NO: 328256 - RNA, 21 nt, Human
guaaagucaucaugaugugca

SEQ ID NO: 328257 - RNA, 18 nt, Human
guccaaaaggacacugua

SEQ ID NO: 328258 - RNA, 18 nt, Human
guccaaaaggacacugua

SEQ ID NO: 328259 - RNA, 21 nt, Human
gucuaggcaccacgauugcuc

SEQ ID NO: 328260 - RNA, 21 nt, Human
gucuaggcaccacgauugcuc

SEQ ID NO: 328261 - RNA, 22 nt, Human
gugaagcaucccccaauucaaa

SEQ ID NO: 328262 - RNA, 24 nt, Human
gugaagucagagucaauacaaaug

SEQ ID NO: 328263 - RNA, 21 nt, Human
guucaaagaguccaacuugac

SEQ ID NO: 328264 - RNA, 21 nt, Human
guucaaagaguccaacuugac

SEQ ID NO: 328265 - RNA, 21 nt, Human
uaaaaugaaacugacaaccaa

SEQ ID NO: 328266 - RNA, 21 nt, Human
uaaaaugaaacugacaaccaa

SEQ ID NO: 328267 - RNA, 23 nt, Human
uaacaaaacaaaaagaaaucucu

SEQ ID NO: 328268 - RNA, 23 nt, Human
uaacaaaacaaaaagaaaucucu

SEQ ID NO: 328269 - RNA, 18 nt, Human
uaagaaucacacacacac

SEQ ID NO: 328270 - RNA, 18 nt, Human
uaagaaucacacacacac

SEQ ID NO: 328271 - RNA, 18 nt, Human
uaagagcaccauaaagac

SEQ ID NO: 328272 - RNA, 25 nt, Human
uaagagcaccauaaagacuggagac

SEQ ID NO: 328273 - RNA, 24 nt, Human
uaagagcaccauaaagacuggagc

SEQ ID NO: 328274 - RNA, 22 nt, Human
uaagcaggugaagcauccccca

SEQ ID NO: 328275 - RNA, 25 nt, Human
uacaggacguugaauauguuacaag

SEQ ID NO: 328276 - RNA, 26 nt, Human
uacuuugccuuuucccccuuccauuu

SEQ ID NO: 328277 - RNA, 25 nt, Human
uagaaccccucucuucccugaccaa

SEQ ID NO: 328278 - RNA, 18 nt, Human
uagaaugaccauuucuuc

SEQ ID NO: 328279 - RNA, 18 nt, Human
uagaaugaccauuucuuc

SEQ ID NO: 328280 - RNA, 22 nt, Human
uagcggacucccccggcggcgg

SEQ ID NO: 328281 - RNA, 23 nt, Human
uagcggacucccccggcggcggc

SEQ ID NO: 328282 - RNA, 23 nt, Human
uauaaucugaugcuaacaaugcc

SEQ ID NO: 328283 - RNA, 23 nt, Human
uauaaucugaugcuaacaaugcc

SEQ ID NO: 328284 - RNA, 22 nt, Human
uauagucagacacucuacaguc

SEQ ID NO: 328285 - RNA, 22 nt, Human
ucagcccaaccagcaaagggcc

SEQ ID NO: 328286 - RNA, 22 nt, Human
ucagcccaaccagcaaagggcc

SEQ ID NO: 328287 - RNA, 19 nt, Human
ucauaaauucccagcucuu

SEQ ID NO: 328288 - RNA, 19 nt, Human
ucauaaauucccagcucuu

SEQ ID NO: 328289 - RNA, 19 nt, Human
ucaugcaccacugucaucu

SEQ ID NO: 328290 - RNA, 20 nt, Human
uccaaagaauaaaauguuac

SEQ ID NO: 328291 - RNA, 20 nt, Human
uccaaagaauaaaauguuac

SEQ ID NO: 328292 - RNA, 23 nt, Human
uccaacuugacacucuucugaac

SEQ ID NO: 328293 - RNA, 23 nt, Human
uccaacuugacacucuucugaac

SEQ ID NO: 328294 - RNA, 28 nt, Human
ucccaucaugcaccacugucaucucccu

SEQ ID NO: 328295 - RNA, 21 nt, Human
ucccccuuccauuuuuuuacu

SEQ ID NO: 328296 - RNA, 20 nt, Human
ucccggugcuucugugagau

SEQ ID NO: 328297 - RNA, 20 nt, Human
ucccggugcuucugugagau

SEQ ID NO: 328298 - RNA, 23 nt, Human
ucccugaccaaccuccccaaucc

SEQ ID NO: 328299 - RNA, 23 nt, Human
ucccugaccaaccuccccaaucc

SEQ ID NO: 328300 - RNA, 28 nt, Human
ucuaagacugaacacucguggagagcuc

SEQ ID NO: 328301 - RNA, 22 nt, Human
ucuacucuacuuugaagcugaa

SEQ ID NO: 328302 - RNA, 22 nt, Human
ucuacucuacuuugaagcugaa

SEQ ID NO: 328303 - RNA, 27 nt, Human
ucucccaucaugcaccacugucaucuc

SEQ ID NO: 328304 - RNA, 19 nt, Human
ucucguagucaaaacugga

SEQ ID NO: 328305 - RNA, 21 nt, Human
ucucguagucaaaacuggagu

SEQ ID NO: 328306 - RNA, 23 nt, Human
ucugaaccagaugugguuucuug

SEQ ID NO: 328307 - RNA, 23 nt, Human
ucugaaccagaugugguuucuug

SEQ ID NO: 328308 - RNA, 26 nt, Human
ucugugugcugccuccuuucuguggg

SEQ ID NO: 328309 - RNA, 23 nt, Human
ucuguugaauuugguccauuauu

SEQ ID NO: 328310 - RNA, 23 nt, Human
ucuguuuacugaacuaaaugggc

SEQ ID NO: 328311 - RNA, 20 nt, Human
ucuugagaaagaacuuggac

SEQ ID NO: 328312 - RNA, 20 nt, Human
ucuugagaaagaacuuggac

SEQ ID NO: 328313 - RNA, 21 nt, Human
ucuuucuuuauuuuuuauccu

SEQ ID NO: 328314 - RNA, 21 nt, Human
ugaaaaacaaacacuuaaaaa

SEQ ID NO: 328315 - RNA, 21 nt, Human
ugaaaaacaaacacuuaaaaa

SEQ ID NO: 328316 - RNA, 19 nt, Human
ugaaugucuuucccucucc

SEQ ID NO: 328317 - RNA, 18 nt, Human
ugaauuugguccauuauu

SEQ ID NO: 328318 - RNA, 25 nt, Human
ugacaauauuacaaaaaaaaguagu

SEQ ID NO: 328319 - RNA, 25 nt, Human
ugacaauauuacaaaaaaaaguagu

SEQ ID NO: 328320 - RNA, 20 nt, Human
ugacacuacaauuguaggca

SEQ ID NO: 328321 - RNA, 18 nt, Human
ugacagcauucaugucac

SEQ ID NO: 328322 - RNA, 18 nt, Human
ugacagcauucaugucac

SEQ ID NO: 328323 - RNA, 23 nt, Human
ugauaagaaucacacacacacaa

SEQ ID NO: 328324 - RNA, 23 nt, Human
ugauaagaaucacacacacacaa

SEQ ID NO: 328325 - RNA, 22 nt, Human
ugauauuacaggcacagaucca

SEQ ID NO: 328326 - RNA, 22 nt, Human
ugaucuguggguagaaccccuc

SEQ ID NO: 328327 - RNA, 22 nt, Human
ugaucuguggguagaaccccuc

SEQ ID NO: 328328 - RNA, 18 nt, Human
ugauuuggguggagcugg

SEQ ID NO: 328329 - RNA, 20 nt, Human
ugcacugaaaaacaaacacu

SEQ ID NO: 328330 - RNA, 20 nt, Human
ugcacugaaaaacaaacacu

SEQ ID NO: 328331 - RNA, 21 nt, Human
ugcuaauccuauccuucccac

SEQ ID NO: 328332 - RNA, 22 nt, Human
ugcugccuccuuucuguggguc

SEQ ID NO: 328333 - RNA, 22 nt, Human
uggcuaaagcuggugacacuac

SEQ ID NO: 328334 - RNA, 25 nt, Human
uggcuccucuucccccaguauaguc

SEQ ID NO: 328335 - RNA, 19 nt, Human
ugggaagaaacagcaacug

SEQ ID NO: 328336 - RNA, 21 nt, Human
ugggaagaaacagcaacuggu

SEQ ID NO: 328337 - RNA, 21 nt, Human
ugggaagaaacagcaacuggu

SEQ ID NO: 328338 - RNA, 24 nt, Human
uggguagagggaauggagguaaag

SEQ ID NO: 328339 - RNA, 18 nt, Human
uggguuuuguucacugcg

SEQ ID NO: 328340 - RNA, 18 nt, Human
ugguuuucugacuggagc

SEQ ID NO: 328341 - RNA, 27 nt, Human
ugucccagcaugcugcagucgaccuac

SEQ ID NO: 328342 - RNA, 18 nt, Human
ugugaggccaggagcugg

SEQ ID NO: 328343 - RNA, 23 nt, Human
uguugacagaaaacuucaaagaa

SEQ ID NO: 328344 - RNA, 20 nt, Human
uguuguuuuugguuuuagga

SEQ ID NO: 328345 - RNA, 25 nt, Human
uuaaaaauaaaaaacucagcccaac

SEQ ID NO: 328346 - RNA, 25 nt, Human
uuaaaaauaaaaaacucagcccaac

SEQ ID NO: 328347 - RNA, 24 nt, Human
uucauugccauaacuucauaaauu

SEQ ID NO: 328348 - RNA, 24 nt, Human
uucauugccauaacuucauaaauu

SEQ ID NO: 328349 - RNA, 25 nt, Human
uucccagacuuucaugauucuccca

SEQ ID NO: 328350 - RNA, 26 nt, Human
uuccuuccuggguuauggggcugguc

SEQ ID NO: 328351 - RNA, 26 nt, Human
uuccuuccuggguuauggggcugguc

SEQ ID NO: 328352 - RNA, 20 nt, Human
uuggaugguaguauccugau

SEQ ID NO: 328353 - RNA, 22 nt, Human
uuggguggagcugguucugagc

SEQ ID NO: 328354 - RNA, 18 nt, Human
uuucccccuuccauuuuu

SEQ ID NO: 328355 - RNA, 23 nt, Human
aaggaucauggggugaugggaug

SEQ ID NO: 328356 - RNA, 18 nt, Human
accauccccccacccccc

SEQ ID NO: 328357 - RNA, 24 nt, Human
accccccaccccggaaucugguuu

SEQ ID NO: 328358 - RNA, 19 nt, Human
agaggcauccggggccagu

SEQ ID NO: 328359 - RNA, 23 nt, Human
agcaggggaggguccugcagggg

SEQ ID NO: 328360 - RNA, 21 nt, Human
aggcgaguggggaaauccagg

SEQ ID NO: 328361 - RNA, 21 nt, Human
auggugcagaaacacagcugc

SEQ ID NO: 328362 - RNA, 25 nt, Human
caccccccaccccggaaucugguuu

SEQ ID NO: 328363 - RNA, 22 nt, Human
cacccuccucugguucugggga

SEQ ID NO: 328364 - RNA, 20 nt, Human
cauccccccaccccccaccc

SEQ ID NO: 328365 - RNA, 21 nt, Human
cauccccccaccccccacccc

SEQ ID NO: 328366 - RNA, 19 nt, Human
ccacccuccucugguucug

SEQ ID NO: 328367 - RNA, 19 nt, Human
ccagggaggucgcuggggc

SEQ ID NO: 328368 - RNA, 20 nt, Human
ccagggaggucgcuggggcg

SEQ ID NO: 328369 - RNA, 18 nt, Human
ccccaccccccaccccgg

SEQ ID NO: 328370 - RNA, 19 nt, Human
ccccaccccccaccccgga

SEQ ID NO: 328371 - RNA, 19 nt, Human
ccccccaccccccaccccg

SEQ ID NO: 328372 - RNA, 22 nt, Human
ccccccaccccccaccccggaa

SEQ ID NO: 328373 - RNA, 24 nt, Human
cccccgggucccccuaccaccgcu

SEQ ID NO: 328374 - RNA, 23 nt, Human
ccuccugcccugcccacuggggg

SEQ ID NO: 328375 - RNA, 20 nt, Human
cgaccuccgaucuccgcccu

SEQ ID NO: 328376 - RNA, 18 nt, Human
cgcugggggaggacgagg

SEQ ID NO: 328377 - RNA, 25 nt, Human
cggcggccgugccagggaggucgcu

SEQ ID NO: 328378 - RNA, 24 nt, Human
cucaccauccccccaccccccacc

SEQ ID NO: 328379 - RNA, 25 nt, Human
cucaccauccccccaccccccaccc

SEQ ID NO: 328380 - RNA, 23 nt, Human
cugcugccgcugccaccuccugc

SEQ ID NO: 328381 - RNA, 24 nt, Human
gagcaggggaggguccugcagggg

SEQ ID NO: 328382 - RNA, 22 nt, Human
gcagagcggggaggagcccccc

SEQ ID NO: 328383 - RNA, 24 nt, Human
gcccacuggggguccaggccucag

SEQ ID NO: 328384 - RNA, 18 nt, Human
gccggggccggugggggg

SEQ ID NO: 328385 - RNA, 18 nt, Human
gcggccggggccgguggg

SEQ ID NO: 328386 - RNA, 24 nt, Human
gcucaccauccccccaccccccac

SEQ ID NO: 328387 - RNA, 19 nt, Human
gcuguucaugggacaaugg

SEQ ID NO: 328388 - RNA, 24 nt, Human
ggcagagggagggucacauggagc

SEQ ID NO: 328389 - RNA, 18 nt, Human
ggcauccggggccagugg

SEQ ID NO: 328390 - RNA, 18 nt, Human
ggccaguggugucgggcc

SEQ ID NO: 328391 - RNA, 22 nt, Human
ggccggggccggugggggggcu

SEQ ID NO: 328392 - RNA, 22 nt, Human
gggcagaggcauccggggccag

SEQ ID NO: 328393 - RNA, 24 nt, Human
gggcggccggggccgguggggggg

SEQ ID NO: 328394 - RNA, 20 nt, Human
ggggccaguggugucgggcc

SEQ ID NO: 328395 - RNA, 21 nt, Human
ggugucgggccugggggggac

SEQ ID NO: 328396 - RNA, 20 nt, Human
gugccccacccuccucuggu

SEQ ID NO: 328397 - RNA, 24 nt, Human
guucuggggagcacuccuauuugc

SEQ ID NO: 328398 - RNA, 19 nt, Human
ucaccauccccccaccccc

SEQ ID NO: 328399 - RNA, 23 nt, Human
uccaggagaccuucauggaggag

SEQ ID NO: 328400 - RNA, 19 nt, Human
uccccccaccccccacccc

SEQ ID NO: 328401 - RNA, 26 nt, Human
uccccccaccccccaccccggaaucu

SEQ ID NO: 328402 - RNA, 23 nt, Human
ucccucacagagaggccucgagc

SEQ ID NO: 328403 - RNA, 21 nt, Human
ugcagaaacacagcugcugcc

SEQ ID NO: 328404 - RNA, 21 nt, Human
ugccagggaggucgcuggggc

SEQ ID NO: 328405 - RNA, 18 nt, Human
uggaggaggcagagggag

SEQ ID NO: 328406 - RNA, 23 nt, Human
uggaggaggcagagggagggucc

SEQ ID NO: 328407 - RNA, 21 nt, Human
uggccccccggucccucacag

SEQ ID NO: 328408 - RNA, 27 nt, Human
uggggcggccggggccggugggggggc

SEQ ID NO: 328409 - RNA, 18 nt, Human
uuugcucaccaucccccc

SEQ ID NO: 328410 - RNA, 19 nt, Human
uuugcucaccaucccccca

SEQ ID NO: 328411 - RNA, 21 nt, Human
aaaaaaauaccacaauuccau

SEQ ID NO: 328412 - RNA, 23 nt, Human
aaauacagcuaaaaauuugacac

SEQ ID NO: 328413 - RNA, 18 nt, Human
aaccugauaauugcuaca

SEQ ID NO: 328414 - RNA, 18 nt, Human
aacuugacucaguaguaa

SEQ ID NO: 328415 - RNA, 23 nt, Human
acaauuacacagaacuagaaaac

SEQ ID NO: 328416 - RNA, 19 nt, Human
acaugcugaaacaaaguua

SEQ ID NO: 328417 - RNA, 23 nt, Human
agaaaacugguagaguaagacca

SEQ ID NO: 328418 - RNA, 21 nt, Human
agcaaaccugauaauugcuac

SEQ ID NO: 328419 - RNA, 18 nt, Human
aguggagagggaggggga

SEQ ID NO: 328420 - RNA, 21 nt, Human
aguuuggaauuccuaaccucu

SEQ ID NO: 328421 - RNA, 18 nt, Human
auggagacacuagggcag

SEQ ID NO: 328422 - RNA, 21 nt, Human
auuccauucuuagaaauacug

SEQ ID NO: 328423 - RNA, 20 nt, Human
caaaaguuaaaauuacaugc

SEQ ID NO: 328424 - RNA, 21 nt, Human
cacagaacuagaaaacuugac

SEQ ID NO: 328425 - RNA, 18 nt, Human
cagaacuagaaaacuuga

SEQ ID NO: 328426 - RNA, 24 nt, Human
caguaguaaaauauaaaaauccua

SEQ ID NO: 328427 - RNA, 24 nt, Human
ccacaaaaguuaaaauuacaugcu

SEQ ID NO: 328428 - RNA, 21 nt, Human
cuacuguauuaaaaguuauau

SEQ ID NO: 328429 - RNA, 20 nt, Human
cuagcaaaccugauaauugc

SEQ ID NO: 328430 - RNA, 19 nt, Human
cucagaguggagagggagg

SEQ ID NO: 328431 - RNA, 23 nt, Human
gagcgaaggaaauguuuuuuuug

SEQ ID NO: 328432 - RNA, 19 nt, Human
gaguccccccaccccuuuc

SEQ ID NO: 328433 - RNA, 26 nt, Human
uaaacuaaacaauuacacagaacuag

SEQ ID NO: 328434 - RNA, 24 nt, Human
uaaguaaauuacaagucuugcaaa

SEQ ID NO: 328435 - RNA, 20 nt, Human
uacacagaacuagaaaacuu

SEQ ID NO: 328436 - RNA, 25 nt, Human
uacagaaaaaaauaccacaauucca

SEQ ID NO: 328437 - RNA, 20 nt, Human
uacagcuaaaaauuugacac

SEQ ID NO: 328438 - RNA, 22 nt, Human
uacgucauuaaacuaaacaauu

SEQ ID NO: 328439 - RNA, 19 nt, Human
uaggaagaggaaaacaaug

SEQ ID NO: 328440 - RNA, 23 nt, Human
ucaauacagaaaaaaauaccaca

SEQ ID NO: 328441 - RNA, 23 nt, Human
ucauauggaagaguguuuuauuu

SEQ ID NO: 328442 - RNA, 21 nt, Human
ucaugaaaguuacugucaggu

SEQ ID NO: 328443 - RNA, 22 nt, Human
ugaacuacgucauuaaacuaaa

SEQ ID NO: 328444 - RNA, 21 nt, Human
uguauagaucgaagugagauc

SEQ ID NO: 328445 - RNA, 19 nt, Human
uguuuuaauccuccagugu

SEQ ID NO: 328446 - RNA, 22 nt, Human
uuaaacuaaacaauuacacaga

SEQ ID NO: 328447 - RNA, 22 nt, Human
uucaaaaugaagguauuucuau

SEQ ID NO: 328448 - RNA, 23 nt, Human
uuugacacuaaaaacaaacuagg

SEQ ID NO: 328449 - RNA, 25 nt, Human
uuuucuguaguuuggaauuccuaac

SEQ ID NO: 328450 - RNA, 19 nt, Human
uuuuguuuguuuguuuuaa

SEQ ID NO: 328451 - RNA, 22 nt, Human
uuuuuuuuuuuuuuuuuaaugg

SEQ ID NO: 328452 - RNA, 20 nt, Human
aaauaaucccacaccaaaac

SEQ ID NO: 328453 - RNA, 24 nt, Human
agaaagaaacugggcuuugugcaa

SEQ ID NO: 328454 - RNA, 21 nt, Human
aucaaaaucuuuuucaaacac

SEQ ID NO: 328455 - RNA, 19 nt, Human
caaacacagaaagaaacug

SEQ ID NO: 328456 - RNA, 22 nt, Human
caccuccucccgccgcgcggcc

SEQ ID NO: 328457 - RNA, 24 nt, Human
ccgccgcgcggccggugccuccuc

SEQ ID NO: 328458 - RNA, 20 nt, Human
cucggccggcaccuccuccc

SEQ ID NO: 328459 - RNA, 25 nt, Human
gucacuugaauuuuauuucuuuaag

SEQ ID NO: 328460 - RNA, 24 nt, Human
uaaaugauuuucaggauguauauu

SEQ ID NO: 328461 - RNA, 20 nt, Human
uauuucuuuaagauucaccu

SEQ ID NO: 328462 - RNA, 19 nt, Human
ucaaauaaucccacaccaa

SEQ ID NO: 328463 - RNA, 24 nt, Human
ucccacaccaaaacauuuugugaa

SEQ ID NO: 328464 - RNA, 18 nt, Human
ucugcggugcucggccgg

SEQ ID NO: 328465 - RNA, 23 nt, Human
ugaccucuuaauauuccaagggg

SEQ ID NO: 328466 - RNA, 19 nt, Human
ugagguaauggagaaaaca

SEQ ID NO: 328467 - RNA, 22 nt, Human
ugagguaauggagaaaacaaaa

SEQ ID NO: 328468 - RNA, 26 nt, Human
uguguacguacaacaaucacguggug

SEQ ID NO: 328469 - RNA, 24 nt, Human
uugcuuucaaauaaucccacacca

SEQ ID NO: 328470 - RNA, 23 nt, Human
uuugugcaaugcuaaccccaaua

SEQ ID NO: 328471 - RNA, 24 nt, Human
aaauacacacaaacucugaagcac

SEQ ID NO: 328472 - RNA, 24 nt, Human
acacacaaacucugaagcacuaag

SEQ ID NO: 328473 - RNA, 19 nt, Human
acucugaagcacuaagaaa

SEQ ID NO: 328474 - RNA, 22 nt, Human
caaacucugaagcacuaagaaa

SEQ ID NO: 328475 - RNA, 24 nt, Human
cuguugaagaaugcuuuauuaaua

SEQ ID NO: 328476 - RNA, 22 nt, Human
uugcaggucuuaacagccgcau

SEQ ID NO: 328477 - RNA, 19 nt, Human
uuuuuuuuuuuuuuuuucu

SEQ ID NO: 328478 - RNA, 21 nt, Human
uuuuuuuuuuuuuuuuucugg

SEQ ID NO: 328479 - RNA, 22 nt, Human
uuuuuuuuuuuuuuuuucuguu

SEQ ID NO: 328480 - RNA, 20 nt, Human
aaaaaagcccaaaccccaaa

SEQ ID NO: 328481 - RNA, 21 nt, Human
aaaaaagcccaaaccccaaag

SEQ ID NO: 328482 - RNA, 21 nt, Human
aaaaagcccaaaccccaaaga

SEQ ID NO: 328483 - RNA, 22 nt, Human
aaaccguuuuauuggaaacugg

SEQ ID NO: 328484 - RNA, 18 nt, Human
aaacugguuaaaaauuaa

SEQ ID NO: 328485 - RNA, 23 nt, Human
aaagcagcucgccccgcucccuc

SEQ ID NO: 328486 - RNA, 18 nt, Human
aagcggauuuugcacgca

SEQ ID NO: 328487 - RNA, 21 nt, Human
aagcgucgggacugaugugcu

SEQ ID NO: 328488 - RNA, 23 nt, Human
aagcuuccaagggaaaaagauuc

SEQ ID NO: 328489 - RNA, 21 nt, Human
aagcuuuaugguuuccuugag

SEQ ID NO: 328490 - RNA, 21 nt, Human
aaggcuggcagguucacuggc

SEQ ID NO: 328491 - RNA, 21 nt, Human
aauggccaccccccagacagc

SEQ ID NO: 328492 - RNA, 22 nt, Human
acaagcggucuccgcccggaac

SEQ ID NO: 328493 - RNA, 21 nt, Human
acagauguacacagucaaaaa

SEQ ID NO: 328494 - RNA, 21 nt, Human
acugagcgcaagggcugacua

SEQ ID NO: 328495 - RNA, 20 nt, Human
acugaggaugccaacagggc

SEQ ID NO: 328496 - RNA, 21 nt, Human
agaaacgcaggguucugcccu

SEQ ID NO: 328497 - RNA, 21 nt, Human
agaaggucaccagucugcaag

SEQ ID NO: 328498 - RNA, 23 nt, Human
agagagaaacgcaggguucugcc

SEQ ID NO: 328499 - RNA, 20 nt, Human
agcagcucgccccgcucccu

SEQ ID NO: 328500 - RNA, 23 nt, Human
agcuuguuaguggacagagagaa

SEQ ID NO: 328501 - RNA, 20 nt, Human
aggcagcgagaggccugcag

SEQ ID NO: 328502 - RNA, 25 nt, Human
agugcgcagccucaaaaagcagcuc

SEQ ID NO: 328503 - RNA, 20 nt, Human
aucugccccgccccucgcca

SEQ ID NO: 328504 - RNA, 21 nt, Human
augaggcagaaggagcaccag

SEQ ID NO: 328505 - RNA, 23 nt, Human
augaggcagaaggagcaccagcg

SEQ ID NO: 328506 - RNA, 19 nt, Human
caaccgagcccuagcgcca

SEQ ID NO: 328507 - RNA, 26 nt, Human
caacgggcucgccucccggcgcggcu

SEQ ID NO: 328508 - RNA, 27 nt, Human
caacuccgacuccagcacaagcggucu

SEQ ID NO: 328509 - RNA, 19 nt, Human
caacuggugcugcugaggc

SEQ ID NO: 328510 - RNA, 20 nt, Human
caagacgagaggacuguccu

SEQ ID NO: 328511 - RNA, 23 nt, Human
caagaugcgcacacagacgcugu

SEQ ID NO: 328512 - RNA, 21 nt, Human
caccagcgccugcuggguggu

SEQ ID NO: 328513 - RNA, 21 nt, Human
cagacuguguacuggagcccc

SEQ ID NO: 328514 - RNA, 21 nt, Human
cagccugaagaacuggguaca

SEQ ID NO: 328515 - RNA, 19 nt, Human
cagggaauagaaggucacc

SEQ ID NO: 328516 - RNA, 22 nt, Human
ccaaaaagggccugaauuuuua

SEQ ID NO: 328517 - RNA, 20 nt, Human
ccaaagauuucuuauuucaa

SEQ ID NO: 328518 - RNA, 18 nt, Human
ccaccccccagacagccc

SEQ ID NO: 328519 - RNA, 19 nt, Human
ccaccccccagacagccca

SEQ ID NO: 328520 - RNA, 18 nt, Human
ccagacagcccaacaggc

SEQ ID NO: 328521 - RNA, 19 nt, Human
ccagagaagcccacucaga

SEQ ID NO: 328522 - RNA, 22 nt, Human
cccaaugcuauuuaauacaauu

SEQ ID NO: 328523 - RNA, 21 nt, Human
cccacaccgcuggcacacgag

SEQ ID NO: 328524 - RNA, 20 nt, Human
ccccagacagcccaacaggc

SEQ ID NO: 328525 - RNA, 18 nt, Human
cccccagacagcccaaca

SEQ ID NO: 328526 - RNA, 22 nt, Human
ccccguccuccccacaccgcug

SEQ ID NO: 328527 - RNA, 23 nt, Human
ccccgugucaucagcaaaagccg

SEQ ID NO: 328528 - RNA, 20 nt, Human
cccgccccucgccaacgggc

SEQ ID NO: 328529 - RNA, 21 nt, Human
cccggcugggcugggcugcgg

SEQ ID NO: 328530 - RNA, 19 nt, Human
cccguccccacgaucccua

SEQ ID NO: 328531 - RNA, 19 nt, Human
cccuaaauggccacccccc

SEQ ID NO: 328532 - RNA, 19 nt, Human
ccgcccggaacagccgcgg

SEQ ID NO: 328533 - RNA, 21 nt, Human
ccggaacagccgcggcgccgg

SEQ ID NO: 328534 - RNA, 20 nt, Human
ccggaaguggaccugcgagg

SEQ ID NO: 328535 - RNA, 22 nt, Human
cgaucccuaaauggccaccccc

SEQ ID NO: 328536 - RNA, 22 nt, Human
cggaacagccgcggcgccggaa

SEQ ID NO: 328537 - RNA, 22 nt, Human
cggcugggcugggcugcggagc

SEQ ID NO: 328538 - RNA, 22 nt, Human
cuacaaauacaaaugcccaaga

SEQ ID NO: 328539 - RNA, 18 nt, Human
cucagcugacucuggaca

SEQ ID NO: 328540 - RNA, 18 nt, Human
cucccggcugggcugggc

SEQ ID NO: 328541 - RNA, 18 nt, Human
cucccggcugggcugggc

SEQ ID NO: 328542 - RNA, 20 nt, Human
cucccggcugggcugggcug

SEQ ID NO: 328543 - RNA, 21 nt, Human
cucuccggccgccuguccugg

SEQ ID NO: 328544 - RNA, 24 nt, Human
cugccccguccuccccacaccgcu

SEQ ID NO: 328545 - RNA, 24 nt, Human
cuggccaaggucaggagaccgcaa

SEQ ID NO: 328546 - RNA, 20 nt, Human
cuguccuggaaggcuggcag

SEQ ID NO: 328547 - RNA, 21 nt, Human
cuguccuggaaggcuggcagg

SEQ ID NO: 328548 - RNA, 18 nt, Human
cuucaggggcagcucucc

SEQ ID NO: 328549 - RNA, 21 nt, Human
gaaacagagaugaacagggaa

SEQ ID NO: 328550 - RNA, 18 nt, Human
gaaggagcaccagcgccu

SEQ ID NO: 328551 - RNA, 19 nt, Human
gacucuggacacaccugcu

SEQ ID NO: 328552 - RNA, 20 nt, Human
gagaaugacagccacagcgc

SEQ ID NO: 328553 - RNA, 19 nt, Human
gaggacuguccuucagggg

SEQ ID NO: 328554 - RNA, 21 nt, Human
gcacgcacacuacugcauuca

SEQ ID NO: 328555 - RNA, 23 nt, Human
gcacgcacacuacugcauucaua

SEQ ID NO: 328556 - RNA, 21 nt, Human
gccaugcgagugcgcagccuc

SEQ ID NO: 328557 - RNA, 24 nt, Human
gccccguccuccccacaccgcugg

SEQ ID NO: 328558 - RNA, 18 nt, Human
gcccucagcugacucugg

SEQ ID NO: 328559 - RNA, 20 nt, Human
gccugaauuuuuauaugaag

SEQ ID NO: 328560 - RNA, 18 nt, Human
ggaccugcgagguggggc

SEQ ID NO: 328561 - RNA, 22 nt, Human
ggcagcacuuuucagugacuuc

SEQ ID NO: 328562 - RNA, 22 nt, Human
ggcccagagccgggccugugga

SEQ ID NO: 328563 - RNA, 19 nt, Human
ggcuggaagcuggacuggu

SEQ ID NO: 328564 - RNA, 25 nt, Human
uaaaaauuguccaaaaagggccuga

SEQ ID NO: 328565 - RNA, 27 nt, Human
uaaaauucaaggcaauccuccggccgg

SEQ ID NO: 328566 - RNA, 22 nt, Human
uaaaccguuuuauuggaaacug

SEQ ID NO: 328567 - RNA, 22 nt, Human
uaaaucuagaaacagagaugaa

SEQ ID NO: 328568 - RNA, 21 nt, Human
uacaaaugcccaagaggucag

SEQ ID NO: 328569 - RNA, 25 nt, Human
uacacagucaaaaaggcuuaucgag

SEQ ID NO: 328570 - RNA, 23 nt, Human
uacuggagccccgugucaucagc

SEQ ID NO: 328571 - RNA, 19 nt, Human
uagaaacagagaugaacag

SEQ ID NO: 328572 - RNA, 20 nt, Human
uauaaaaaagcccaaacccc

SEQ ID NO: 328573 - RNA, 23 nt, Human
uauaaaaaagcccaaaccccaaa

SEQ ID NO: 328574 - RNA, 21 nt, Human
ucacaaccgagcccuagcgcc

SEQ ID NO: 328575 - RNA, 24 nt, Human
ucacgcugaagacagucuucucag

SEQ ID NO: 328576 - RNA, 28 nt, Human
ucagugacuuccccgcacgcugcuuucc

SEQ ID NO: 328577 - RNA, 18 nt, Human
uccaaacuuccuuaggca

SEQ ID NO: 328578 - RNA, 22 nt, Human
uccccgcacgcugcuuucccug

SEQ ID NO: 328579 - RNA, 25 nt, Human
uccccgcacgcugcuuucccugcca

SEQ ID NO: 328580 - RNA, 27 nt, Human
uccccgcacgcugcuuucccugccacg

SEQ ID NO: 328581 - RNA, 22 nt, Human
ucccggcugggcugggcugcgg

SEQ ID NO: 328582 - RNA, 24 nt, Human
ucccggcugggcugggcugcggag

SEQ ID NO: 328583 - RNA, 26 nt, Human
ucccuaaauggccaccccccagacag

SEQ ID NO: 328584 - RNA, 19 nt, Human
uccugccccguccucccca

SEQ ID NO: 328585 - RNA, 19 nt, Human
ucgccaucugccccgcccc

SEQ ID NO: 328586 - RNA, 20 nt, Human
ucgccccgcucccucgccaa

SEQ ID NO: 328587 - RNA, 26 nt, Human
ucuugggguggaccccgucccaccag

SEQ ID NO: 328588 - RNA, 20 nt, Human
ugaaaauggaacgcauccuu

SEQ ID NO: 328589 - RNA, 19 nt, Human
ugaagugugaaaauggaac

SEQ ID NO: 328590 - RNA, 21 nt, Human
ugaauaaacaauacaaagucc

SEQ ID NO: 328591 - RNA, 19 nt, Human
ugacuaaaucuagaaacag

SEQ ID NO: 328592 - RNA, 20 nt, Human
ugcacgcacacuacugcauu

SEQ ID NO: 328593 - RNA, 23 nt, Human
ugcacgcacacuacugcauucau

SEQ ID NO: 328594 - RNA, 24 nt, Human
ugcacgcacacuacugcauucaua

SEQ ID NO: 328595 - RNA, 21 nt, Human
ugcaggcacugaggaugccag

SEQ ID NO: 328596 - RNA, 24 nt, Human
ugccugugaacuuuaguucacgcu

SEQ ID NO: 328597 - RNA, 19 nt, Human
ugcgagguggggccaugcg

SEQ ID NO: 328598 - RNA, 23 nt, Human
ugcgcacacagacgcuguccgug

SEQ ID NO: 328599 - RNA, 19 nt, Human
uggagcguuacaacuccga

SEQ ID NO: 328600 - RNA, 22 nt, Human
ugggcugggcugcggagcgugc

SEQ ID NO: 328601 - RNA, 27 nt, Human
ugggcugggcugcggagcgugcaccuc

SEQ ID NO: 328602 - RNA, 22 nt, Human
ugugaaaauggaacgcauccuu

SEQ ID NO: 328603 - RNA, 24 nt, Human
uuaguggacagagagaaacgcagg

SEQ ID NO: 328604 - RNA, 23 nt, Human
uucaggggcagcucuccggccgc

SEQ ID NO: 328605 - RNA, 24 nt, Human
uucaggggcagcucuccggccgcc

SEQ ID NO: 328606 - RNA, 24 nt, Human
uucagugacuuccccgcacgcugc

SEQ ID NO: 328607 - RNA, 21 nt, Human
uucuaguaaagauacaaauuu

SEQ ID NO: 328608 - RNA, 22 nt, Human
uugcgugugaagcuuguuaguc

SEQ ID NO: 328609 - RNA, 19 nt, Human
uuuacagaaacgugggcag

SEQ ID NO: 328610 - RNA, 19 nt, Human
uuuuaaaauucaaggcaau

SEQ ID NO: 328611 - RNA, 24 nt, Human
aacgugacauucgauuauaacaca

SEQ ID NO: 328612 - RNA, 22 nt, Human
aguauuuggccaguacaaauaa

SEQ ID NO: 328613 - RNA, 22 nt, Human
auaaagucuaguaacauuaucc

SEQ ID NO: 328614 - RNA, 18 nt, Human
caaagaaaaguaaaacaa

SEQ ID NO: 328615 - RNA, 19 nt, Human
caaaguucuuuccacagcu

SEQ ID NO: 328616 - RNA, 20 nt, Human
caauacaguccuuuuuaauu

SEQ ID NO: 328617 - RNA, 22 nt, Human
cauuuauaguuguuaagucacc

SEQ ID NO: 328618 - RNA, 22 nt, Human
ccaaaacaaaauuaaccaaaga

SEQ ID NO: 328619 - RNA, 24 nt, Human
ccucuguucaacaauacaguccuu

SEQ ID NO: 328620 - RNA, 27 nt, Human
cucaacucucucuuucauuagucucaa

SEQ ID NO: 328621 - RNA, 20 nt, Human
cugaaagcaccauggcauau

SEQ ID NO: 328622 - RNA, 19 nt, Human
cuggagagacgcaaaguuc

SEQ ID NO: 328623 - RNA, 21 nt, Human
gaaaaguaaaacaauuguccc

SEQ ID NO: 328624 - RNA, 20 nt, Human
gacauucgauuauaacacau

SEQ ID NO: 328625 - RNA, 23 nt, Human
gagagacgcaaaguucuuuccac

SEQ ID NO: 328626 - RNA, 18 nt, Human
gccaaaacaaaauuaacc

SEQ ID NO: 328627 - RNA, 19 nt, Human
gguacauaccaauaacaau

SEQ ID NO: 328628 - RNA, 23 nt, Human
guaaaauucaucucuggccaaaa

SEQ ID NO: 328629 - RNA, 19 nt, Human
gucucaacucucucuuuca

SEQ ID NO: 328630 - RNA, 21 nt, Human
gugaguuucuuucuuuggcuu

SEQ ID NO: 328631 - RNA, 23 nt, Human
uaacacauaaacuacauuuauag

SEQ ID NO: 328632 - RNA, 22 nt, Human
uaaccaaagaaaaguaaaacaa

SEQ ID NO: 328633 - RNA, 22 nt, Human
uauccucaaaagcuuuuuccaa

SEQ ID NO: 328634 - RNA, 20 nt, Human
uaugacuaucuucucaaaaa

SEQ ID NO: 328635 - RNA, 21 nt, Human
ucaacucucucuuucauuagu

SEQ ID NO: 328636 - RNA, 22 nt, Human
uccacagcuggcgggaggagac

SEQ ID NO: 328637 - RNA, 25 nt, Human
ucuggccaaaacaaaauuaaccaaa

SEQ ID NO: 328638 - RNA, 24 nt, Human
ugaaagcaccauggcauaaagucu

SEQ ID NO: 328639 - RNA, 21 nt, Human
uggcauguguuuuaaguguga

SEQ ID NO: 328640 - RNA, 22 nt, Human
uggccaaaacaaaauuaaccaa

SEQ ID NO: 328641 - RNA, 23 nt, Human
uggccaaaacaaaauuaaccaaa

SEQ ID NO: 328642 - RNA, 19 nt, Human
uggcgggaggagacucuca

SEQ ID NO: 328643 - RNA, 18 nt, Human
uguaauaagguacauacc

SEQ ID NO: 328644 - RNA, 22 nt, Human
uucuuuccacagcuggcgggag

SEQ ID NO: 328645 - RNA, 26 nt, Human
uuggccaguacaaauaaagauugguc

SEQ ID NO: 328646 - RNA, 27 nt, Human
aaacacuagugagaacucaaucuugaa

SEQ ID NO: 328647 - RNA, 23 nt, Human
aaucaaaaguauguucgacuacu

SEQ ID NO: 328648 - RNA, 18 nt, Human
acaaaauauguggccucc

SEQ ID NO: 328649 - RNA, 23 nt, Human
acaccaguaaaacagcagggcaa

SEQ ID NO: 328650 - RNA, 22 nt, Human
acacugaaugcacagggcuggc

SEQ ID NO: 328651 - RNA, 22 nt, Human
acuacaauucaaacuucucagg

SEQ ID NO: 328652 - RNA, 20 nt, Human
acucguggauuugauuccuu

SEQ ID NO: 328653 - RNA, 20 nt, Human
acucugaaaccuuuuucauu

SEQ ID NO: 328654 - RNA, 19 nt, Human
agaacauuucugguugcug

SEQ ID NO: 328655 - RNA, 23 nt, Human
agacaaaaugcaaaauacaguuc

SEQ ID NO: 328656 - RNA, 22 nt, Human
agaugacaaauaaaaccaagcu

SEQ ID NO: 328657 - RNA, 18 nt, Human
agcuauuugcaaaacuug

SEQ ID NO: 328658 - RNA, 24 nt, Human
auagaagcaagaccaaaagcagag

SEQ ID NO: 328659 - RNA, 19 nt, Human
auauauauauauauauaua

SEQ ID NO: 328660 - RNA, 19 nt, Human
auauauauauauauauaua

SEQ ID NO: 328661 - RNA, 19 nt, Human
auauauauauauauauaua

SEQ ID NO: 328662 - RNA, 19 nt, Human
auauauauauauauauaua

SEQ ID NO: 328663 - RNA, 19 nt, Human
auauauauauauauauaua

SEQ ID NO: 328664 - RNA, 22 nt, Human
aucaaaacaagaaaauacuaca

SEQ ID NO: 328665 - RNA, 19 nt, Human
auguggccucccauguaca

SEQ ID NO: 328666 - RNA, 18 nt, Human
caagaccaaaagcagagu

SEQ ID NO: 328667 - RNA, 22 nt, Human
caauucuauauucaaacaagga

SEQ ID NO: 328668 - RNA, 19 nt, Human
cacagggcuggcuaauucu

SEQ ID NO: 328669 - RNA, 20 nt, Human
caccaguaaaacagcagggc

SEQ ID NO: 328670 - RNA, 22 nt, Human
caccaguaaaacagcagggcaa

SEQ ID NO: 328671 - RNA, 22 nt, Human
cagccccccgaucuucucucuc

SEQ ID NO: 328672 - RNA, 24 nt, Human
ccauguacauugguuaccuaugua

SEQ ID NO: 328673 - RNA, 18 nt, Human
ccccuuaccuuucacccc

SEQ ID NO: 328674 - RNA, 22 nt, Human
ccucacgaacagccuucuucag

SEQ ID NO: 328675 - RNA, 20 nt, Human
ccuuuuccuuuuuuucuuuu

SEQ ID NO: 328676 - RNA, 22 nt, Human
cuagaacauuucugguugcugg

SEQ ID NO: 328677 - RNA, 22 nt, Human
cucccccuuaccuuucaccccc

SEQ ID NO: 328678 - RNA, 22 nt, Human
cucucgcucccccuuaccuuuc

SEQ ID NO: 328679 - RNA, 20 nt, Human
cucuggcgcucucgcucccc

SEQ ID NO: 328680 - RNA, 19 nt, Human
gaagauggauuucagcccc

SEQ ID NO: 328681 - RNA, 21 nt, Human
gagguggggaagagcuauuug

SEQ ID NO: 328682 - RNA, 20 nt, Human
gaguuggauuuuuuuuucuc

SEQ ID NO: 328683 - RNA, 20 nt, Human
gcaaccacuugcccgucuca

SEQ ID NO: 328684 - RNA, 21 nt, Human
gcgggaaugagggaacagcgg

SEQ ID NO: 328685 - RNA, 23 nt, Human
ggagcgguaggaugaagauggau

SEQ ID NO: 328686 - RNA, 18 nt, Human
ggaggagggaguaauccu

SEQ ID NO: 328687 - RNA, 28 nt, Human
uaaagaacauuuauuccuucaaaagaaa

SEQ ID NO: 328688 - RNA, 18 nt, Human
uacacuauauauuuauag

SEQ ID NO: 328689 - RNA, 22 nt, Human
uacagguauacaaauguacaau

SEQ ID NO: 328690 - RNA, 20 nt, Human
uacgaccauaaaaggugaga

SEQ ID NO: 328691 - RNA, 18 nt, Human
uauauauauauauauaua

SEQ ID NO: 328692 - RNA, 19 nt, Human
uauauauauauauauauau

SEQ ID NO: 328693 - RNA, 19 nt, Human
uauauauauauauauauau

SEQ ID NO: 328694 - RNA, 19 nt, Human
uauauauauauauauauau

SEQ ID NO: 328695 - RNA, 19 nt, Human
uauauauauauauauauau

SEQ ID NO: 328696 - RNA, 22 nt, Human
uauaugcaaagucuacaccaag

SEQ ID NO: 328697 - RNA, 18 nt, Human
uauguggccucccaugua

SEQ ID NO: 328698 - RNA, 18 nt, Human
ucacacccgcccagccuc

SEQ ID NO: 328699 - RNA, 20 nt, Human
uccacaugugaaauauagau

SEQ ID NO: 328700 - RNA, 22 nt, Human
ucucgcuauacuugagacuaga

SEQ ID NO: 328701 - RNA, 21 nt, Human
ucugguugcugguuggauuug

SEQ ID NO: 328702 - RNA, 21 nt, Human
ugaauaacauuuagaaagaau

SEQ ID NO: 328703 - RNA, 25 nt, Human
ugaaugcacagggcuggcuaauucu

SEQ ID NO: 328704 - RNA, 21 nt, Human
uguaaggaaagcucgggcaag

SEQ ID NO: 328705 - RNA, 21 nt, Human
uguacaccguguaguguuaca

SEQ ID NO: 328706 - RNA, 25 nt, Human
ugucacaaaaucaaaacauuacuuu

SEQ ID NO: 328707 - RNA, 19 nt, Human
ugugcuugcaaaaaaguuc

SEQ ID NO: 328708 - RNA, 25 nt, Human
uuacaaaggcuuuuccacucgugga

SEQ ID NO: 328709 - RNA, 20 nt, Human
uuacaaguagacaaaaugca

SEQ ID NO: 328710 - RNA, 23 nt, Human
uuaccaaaaaacguguuuauguu

SEQ ID NO: 328711 - RNA, 21 nt, Human
uucaaacuucucagguuuuuu

SEQ ID NO: 328712 - RNA, 21 nt, Human
uucaucuucuguacaaaaggg

SEQ ID NO: 328713 - RNA, 22 nt, Human
uucauuauauauauauauauau

SEQ ID NO: 328714 - RNA, 20 nt, Human
uuccuuuuuuggaggaggga

SEQ ID NO: 328715 - RNA, 27 nt, Human
uucucaugcuaaauaaucagauuuuac

SEQ ID NO: 328716 - RNA, 18 nt, Human
uugauuccuuuuuuggag

SEQ ID NO: 328717 - RNA, 22 nt, Human
uugcacguccuuuugacuguca

SEQ ID NO: 328718 - RNA, 21 nt, Human
uuguuuuuguuuguuuuuuac

SEQ ID NO: 328719 - RNA, 22 nt, Human
uuuaggauuaaaaaaacacuag

SEQ ID NO: 328720 - RNA, 22 nt, Human
uuuuuuucuuuuuuuuuuaaag

SEQ ID NO: 328721 - RNA, 22 nt, Human
uuuuuuuuuuuuuuuuuuucag

SEQ ID NO: 328722 - RNA, 19 nt, Human
aaaaagaucucuuccauau

SEQ ID NO: 328723 - RNA, 24 nt, Human
aaaaagcaaaauaaagcucaacac

SEQ ID NO: 328724 - RNA, 19 nt, Human
aaaagaaagcugguucaua

SEQ ID NO: 328725 - RNA, 19 nt, Human
aaaccacaucuacuguaaa

SEQ ID NO: 328726 - RNA, 24 nt, Human
aaacugguccagaaacaaucccua

SEQ ID NO: 328727 - RNA, 21 nt, Human
aaaguaaaauaacucaacacc

SEQ ID NO: 328728 - RNA, 19 nt, Human
aacaccaaacaugaaaaag

SEQ ID NO: 328729 - RNA, 20 nt, Human
aaccuuuagauuccauauug

SEQ ID NO: 328730 - RNA, 21 nt, Human
aacugguccagaaacaauccc

SEQ ID NO: 328731 - RNA, 19 nt, Human
aagagccaggacuuagaca

SEQ ID NO: 328732 - RNA, 20 nt, Human
aagagccaggacuuagacaa

SEQ ID NO: 328733 - RNA, 26 nt, Human
aagagccaggacuuagacagugggca

SEQ ID NO: 328734 - RNA, 20 nt, Human
aagcaaaaagagcuaucuga

SEQ ID NO: 328735 - RNA, 24 nt, Human
aaggagacacucaagaguaaagcc

SEQ ID NO: 328736 - RNA, 22 nt, Human
acaaacacaaggcguugcugca

SEQ ID NO: 328737 - RNA, 19 nt, Human
acaagaacagguacuuuug

SEQ ID NO: 328738 - RNA, 21 nt, Human
acaucauauacaggcauucug

SEQ ID NO: 328739 - RNA, 20 nt, Human
accaaggaaagcaucacuaa

SEQ ID NO: 328740 - RNA, 23 nt, Human
acuaaaaugcaaauguaucccag

SEQ ID NO: 328741 - RNA, 20 nt, Human
agaaagcaaaaagagcuauc

SEQ ID NO: 328742 - RNA, 21 nt, Human
agagaaaaacacaagaccagg

SEQ ID NO: 328743 - RNA, 19 nt, Human
aggaauucaacuguacaaa

SEQ ID NO: 328744 - RNA, 18 nt, Human
aggaccccaagaagaggg

SEQ ID NO: 328745 - RNA, 22 nt, Human
aggaccccaagaagaggguuua

SEQ ID NO: 328746 - RNA, 18 nt, Human
agguuucacgcaaaggaa

SEQ ID NO: 328747 - RNA, 21 nt, Human
auaaaaagaaagcugguucau

SEQ ID NO: 328748 - RNA, 24 nt, Human
auaauucaucccccaccccccaaa

SEQ ID NO: 328749 - RNA, 23 nt, Human
auacaguacucuucuguacaaag

SEQ ID NO: 328750 - RNA, 20 nt, Human
aucaaauucacuuuucagug

SEQ ID NO: 328751 - RNA, 22 nt, Human
caaaaggagacacucaagagua

SEQ ID NO: 328752 - RNA, 20 nt, Human
caaaauacaaauuuccacuc

SEQ ID NO: 328753 - RNA, 20 nt, Human
caacaugacagcuuugaucc

SEQ ID NO: 328754 - RNA, 18 nt, Human
caaggaaagcaucacuac

SEQ ID NO: 328755 - RNA, 21 nt, Human
caauaauaaaaagaaagcugg

SEQ ID NO: 328756 - RNA, 24 nt, Human
caaucccuaucaaaaggagacacu

SEQ ID NO: 328757 - RNA, 21 nt, Human
cacucaagaguaaagccuagg

SEQ ID NO: 328758 - RNA, 24 nt, Human
cacucuuucucauugcaaaccaaa

SEQ ID NO: 328759 - RNA, 25 nt, Human
caguacucuucuguacaaagaaaaa

SEQ ID NO: 328760 - RNA, 24 nt, Human
cauaugaaccaauaagagccagga

SEQ ID NO: 328761 - RNA, 18 nt, Human
caugcugaugacccagag

SEQ ID NO: 328762 - RNA, 21 nt, Human
ccaacaugacagcuuugaucc

SEQ ID NO: 328763 - RNA, 19 nt, Human
ccaacuuacuaaaagguaa

SEQ ID NO: 328764 - RNA, 20 nt, Human
cccaccccccaaauauacac

SEQ ID NO: 328765 - RNA, 25 nt, Human
cccaccccccaaauauacacaagaa

SEQ ID NO: 328766 - RNA, 23 nt, Human
ccccaagaagaggguuuaguuuc

SEQ ID NO: 328767 - RNA, 21 nt, Human
cccccaaauauacacaagaac

SEQ ID NO: 328768 - RNA, 23 nt, Human
ccugugccaacagagggcaagga

SEQ ID NO: 328769 - RNA, 18 nt, Human
cucaacacuuccucaaca

SEQ ID NO: 328770 - RNA, 20 nt, Human
cucuacuugucauuuucuaa

SEQ ID NO: 328771 - RNA, 22 nt, Human
cucuacuugucauuuucuaaaa

SEQ ID NO: 328772 - RNA, 22 nt, Human
cugccucuaugaaaaagcaaaa

SEQ ID NO: 328773 - RNA, 22 nt, Human
cugggacaugcugaugacccag

SEQ ID NO: 328774 - RNA, 21 nt, Human
cuugucauuuucuaaaauugc

SEQ ID NO: 328775 - RNA, 21 nt, Human
gaauacuguacuuuuuccuuu

SEQ ID NO: 328776 - RNA, 23 nt, Human
gaugaaaaaagcauuggccucca

SEQ ID NO: 328777 - RNA, 19 nt, Human
gcaaaaagagcuaucugaa

SEQ ID NO: 328778 - RNA, 25 nt, Human
gcaaaacaaaauacaaauuuccacu

SEQ ID NO: 328779 - RNA, 25 nt, Human
ggaauucaacuguacaaagacagga

SEQ ID NO: 328780 - RNA, 20 nt, Human
ggacuuagacaaacuggucc

SEQ ID NO: 328781 - RNA, 22 nt, Human
gguuguagaccuaccagacugu

SEQ ID NO: 328782 - RNA, 19 nt, Human
uaaaacaaaaugaucucac

SEQ ID NO: 328783 - RNA, 21 nt, Human
uaauucaucccccacccccca

SEQ ID NO: 328784 - RNA, 21 nt, Human
uaauuguauuaaaaccacauc

SEQ ID NO: 328785 - RNA, 20 nt, Human
uaauuuauaauucauccccc

SEQ ID NO: 328786 - RNA, 24 nt, Human
uacacacacaaugcauauauuuau

SEQ ID NO: 328787 - RNA, 21 nt, Human
uacagauuugcucuuacuugg

SEQ ID NO: 328788 - RNA, 22 nt, Human
uacuacacacacaaugcauaua

SEQ ID NO: 328789 - RNA, 20 nt, Human
uacugacuucaacaaaauac

SEQ ID NO: 328790 - RNA, 23 nt, Human
uagaaagcaaaaagagcuaucug

SEQ ID NO: 328791 - RNA, 24 nt, Human
uaguaaaaaaagaucucuuccaua

SEQ ID NO: 328792 - RNA, 19 nt, Human
uauacaacacuauauugcc

SEQ ID NO: 328793 - RNA, 19 nt, Human
uauacacauauggucacaa

SEQ ID NO: 328794 - RNA, 18 nt, Human
uaugucuuauguccagag

SEQ ID NO: 328795 - RNA, 25 nt, Human
uaugucuuauguccagaggaaaaaa

SEQ ID NO: 328796 - RNA, 22 nt, Human
uauuacuacacacacaaugcau

SEQ ID NO: 328797 - RNA, 21 nt, Human
uauucacacauuuuucauuuu

SEQ ID NO: 328798 - RNA, 23 nt, Human
ucacaugguuaaauuaucuucuu

SEQ ID NO: 328799 - RNA, 22 nt, Human
ucaguggccccuuuucaucucu

SEQ ID NO: 328800 - RNA, 18 nt, Human
ucaucccccaccccccaa

SEQ ID NO: 328801 - RNA, 22 nt, Human
ucugauaggucuccacucaggg

SEQ ID NO: 328802 - RNA, 20 nt, Human
ugaaaaagcaaaauaaagcu

SEQ ID NO: 328803 - RNA, 21 nt, Human
ugaaaaagcaaaauaaagcuc

SEQ ID NO: 328804 - RNA, 23 nt, Human
ugaaacaaacacaaggcguugcu

SEQ ID NO: 328805 - RNA, 26 nt, Human
ugaaacaaacacaaggcguugcugca

SEQ ID NO: 328806 - RNA, 21 nt, Human
ugaaaccaugggcugauacug

SEQ ID NO: 328807 - RNA, 21 nt, Human
ugaaaugugauuuucagauuu

SEQ ID NO: 328808 - RNA, 24 nt, Human
ugacuucaacaaaauacaaagcac

SEQ ID NO: 328809 - RNA, 21 nt, Human
ugauaaaaccuuuagauucca

SEQ ID NO: 328810 - RNA, 22 nt, Human
ugcaaauguaucccaaagagau

SEQ ID NO: 328811 - RNA, 22 nt, Human
ugcacaauacccugacuucaau

SEQ ID NO: 328812 - RNA, 19 nt, Human
uggauuuaauggucucacc

SEQ ID NO: 328813 - RNA, 27 nt, Human
uggggugggcacccaaaauggcagacu

SEQ ID NO: 328814 - RNA, 23 nt, Human
uguacaaagaaaaaagucacauc

SEQ ID NO: 328815 - RNA, 20 nt, Human
uucauaguugaguuguguuu

SEQ ID NO: 328816 - RNA, 22 nt, Human
uucaucccccaccccccaaaua

SEQ ID NO: 328817 - RNA, 19 nt, Human
uugauccugaaaccauggg

SEQ ID NO: 328818 - RNA, 22 nt, Human
uuuacaagguaaaaauuuacaa

SEQ ID NO: 328819 - RNA, 18 nt, Human
uuuacauuauacaacacu

SEQ ID NO: 328820 - RNA, 24 nt, Human
uuuucauuuucuaauuuauacaua

SEQ ID NO: 328821 - RNA, 28 nt, Human
aaaacagcaaaaauccauccugagaaaa

SEQ ID NO: 328822 - RNA, 25 nt, Human
accauccaggcggcuccaggacaca

SEQ ID NO: 328823 - RNA, 22 nt, Human
agcaccuggaugcccuccaccc

SEQ ID NO: 328824 - RNA, 20 nt, Human
agccaaaacagcaaaaaucc

SEQ ID NO: 328825 - RNA, 19 nt, Human
cagagcccgagccugacac

SEQ ID NO: 328826 - RNA, 20 nt, Human
cagcaccuggaugcccucca

SEQ ID NO: 328827 - RNA, 19 nt, Human
cagcccagggaaggaacag

SEQ ID NO: 328828 - RNA, 20 nt, Human
cagcuacagcagggucaucu

SEQ ID NO: 328829 - RNA, 20 nt, Human
caggacacaauggggcgcgg

SEQ ID NO: 328830 - RNA, 24 nt, Human
caggaccauccaaaucccacauga

SEQ ID NO: 328831 - RNA, 24 nt, Human
ccagccggcccugugccguucucc

SEQ ID NO: 328832 - RNA, 23 nt, Human
ccagcuacagcagggucaucuuu

SEQ ID NO: 328833 - RNA, 21 nt, Human
ccaggacacaauggggcgcgg

SEQ ID NO: 328834 - RNA, 18 nt, Human
cccacaugacaguagaaa

SEQ ID NO: 328835 - RNA, 26 nt, Human
cccacaugacaguagaaaucuugcuu

SEQ ID NO: 328836 - RNA, 21 nt, Human
cccagcaccuggaugcccucc

SEQ ID NO: 328837 - RNA, 21 nt, Human
ccccagagcccgagccugaca

SEQ ID NO: 328838 - RNA, 23 nt, Human
ccccgcuccguccacccucugga

SEQ ID NO: 328839 - RNA, 18 nt, Human
cccguggcgacacacuca

SEQ ID NO: 328840 - RNA, 18 nt, Human
cccugugccguucuccuc

SEQ ID NO: 328841 - RNA, 26 nt, Human
ccuccaccccgauagggcgaccaucc

SEQ ID NO: 328842 - RNA, 22 nt, Human
ccucuggagccugccagacacu

SEQ ID NO: 328843 - RNA, 19 nt, Human
ccugauggguguuagggcc

SEQ ID NO: 328844 - RNA, 19 nt, Human
ccugugcccagcaccugga

SEQ ID NO: 328845 - RNA, 21 nt, Human
cgaccauccaggcggcuccag

SEQ ID NO: 328846 - RNA, 23 nt, Human
cgguggagggugacagugucagg

SEQ ID NO: 328847 - RNA, 20 nt, Human
cucuaucucucuccucuuuu

SEQ ID NO: 328848 - RNA, 24 nt, Human
cugagagccaaaacagcaaaaauc

SEQ ID NO: 328849 - RNA, 22 nt, Human
cugcaggaacugcuccaacucc

SEQ ID NO: 328850 - RNA, 21 nt, Human
cuggaugcccuccaccccgau

SEQ ID NO: 328851 - RNA, 22 nt, Human
cuggaugcccuccaccccgaua

SEQ ID NO: 328852 - RNA, 23 nt, Human
cugugccguucuccucacccggg

SEQ ID NO: 328853 - RNA, 19 nt, Human
gagccuggccccguggcug

SEQ ID NO: 328854 - RNA, 18 nt, Human
gcgacacacucaagcacc

SEQ ID NO: 328855 - RNA, 25 nt, Human
gcuggaccgucacgucugagaugau

SEQ ID NO: 328856 - RNA, 22 nt, Human
ggaaggaacaggcuccugcagg

SEQ ID NO: 328857 - RNA, 19 nt, Human
gggcgcggguugcccgugg

SEQ ID NO: 328858 - RNA, 18 nt, Human
guccacccucuggagccu

SEQ ID NO: 328859 - RNA, 21 nt, Human
uaccaggcagaggcaaggggg

SEQ ID NO: 328860 - RNA, 22 nt, Human
ucagggcccagcuacagcaggg

SEQ ID NO: 328861 - RNA, 21 nt, Human
uccauccugagaaaacaaagu

SEQ ID NO: 328862 - RNA, 24 nt, Human
uccucuaucucucuccucuuuuuu

SEQ ID NO: 328863 - RNA, 20 nt, Human
ucgguggagggugacagugu

SEQ ID NO: 328864 - RNA, 21 nt, Human
ucuggugcacugucaggguga

SEQ ID NO: 328865 - RNA, 19 nt, Human
ucuuuuuuuuuuuuuuuaa

SEQ ID NO: 328866 - RNA, 24 nt, Human
ucuuuuuuuuuuuuuuuaaguuuu

SEQ ID NO: 328867 - RNA, 22 nt, Human
ugacaguagaaaucuugcuuuu

SEQ ID NO: 328868 - RNA, 19 nt, Human
ugagagccaaaacagcaaa

SEQ ID NO: 328869 - RNA, 19 nt, Human
ugagaugaugagguuuccu

SEQ ID NO: 328870 - RNA, 24 nt, Human
ugagguuuccugugcccagcaccu

SEQ ID NO: 328871 - RNA, 21 nt, Human
ugcccagcaccuggaugcccu

SEQ ID NO: 328872 - RNA, 19 nt, Human
uggagggugacagugucag

SEQ ID NO: 328873 - RNA, 23 nt, Human
uggggcgcggguugcccguggcg

SEQ ID NO: 328874 - RNA, 19 nt, Human
ugucagggcccagcuacag

SEQ ID NO: 328875 - RNA, 18 nt, Human
uguuagggccgggggguc

SEQ ID NO: 328876 - RNA, 22 nt, Human
uuaguucaguuccaagucaugu

SEQ ID NO: 328877 - RNA, 23 nt, Human
uuguaggccccagagcccgagcc

SEQ ID NO: 328878 - RNA, 26 nt, Human
augcauguguguguguguggggguuu

SEQ ID NO: 328879 - RNA, 18 nt, Human
ccgccgccgccugccgcu

SEQ ID NO: 328880 - RNA, 19 nt, Human
ccgccgccgccugccgcuc

SEQ ID NO: 328881 - RNA, 24 nt, Human
ccgccgccugccgcuccgcccgcc

SEQ ID NO: 328882 - RNA, 19 nt, Human
ccgcgccgccgccgccugc

SEQ ID NO: 328883 - RNA, 18 nt, Human
ccgcugccgcgccgccgc

SEQ ID NO: 328884 - RNA, 20 nt, Human
ccgcugccgcgccgccgccg

SEQ ID NO: 328885 - RNA, 22 nt, Human
ccugccgcuccgcccgccgccu

SEQ ID NO: 328886 - RNA, 18 nt, Human
cgccgccgccgccugccg

SEQ ID NO: 328887 - RNA, 20 nt, Human
cugccgcgccgccgccgccu

SEQ ID NO: 328888 - RNA, 18 nt, Human
gccgcuccgcccgccgcc

SEQ ID NO: 328889 - RNA, 25 nt, Human
guguguguguguaugcaugugugug

SEQ ID NO: 328890 - RNA, 24 nt, Human
uccgcugccgcgccgccgccgccu

SEQ ID NO: 328891 - RNA, 21 nt, Human
ucuguguguguggcugugugu

SEQ ID NO: 328892 - RNA, 19 nt, Human
uggcugugugugugugugu

SEQ ID NO: 328893 - RNA, 21 nt, Human
uguaugcaugugugugugugu

SEQ ID NO: 328894 - RNA, 19 nt, Human
uguguaugcaugugugugu

SEQ ID NO: 328895 - RNA, 21 nt, Human
uguguaugcaugugugugugu

SEQ ID NO: 328896 - RNA, 21 nt, Human
uguguaugcaugugugugugu

SEQ ID NO: 328897 - RNA, 24 nt, Human
uguguggcugugugugugugugua

SEQ ID NO: 328898 - RNA, 24 nt, Human
uguguguaugcaugugugugugug

SEQ ID NO: 328899 - RNA, 21 nt, Human
uguguguguaugcaugugugu

SEQ ID NO: 328900 - RNA, 21 nt, Human
uguguguguaugcaugugugu

SEQ ID NO: 328901 - RNA, 21 nt, Human
uguguguguaugcaugugugu

SEQ ID NO: 328902 - RNA, 19 nt, Human
uguguguguggcugugugu

SEQ ID NO: 328903 - RNA, 20 nt, Human
uguguguguggcugugugug

SEQ ID NO: 328904 - RNA, 23 nt, Human
uguguguguggcugugugugugu

SEQ ID NO: 328905 - RNA, 23 nt, Human
uguguguguggcugugugugugu

SEQ ID NO: 328906 - RNA, 25 nt, Human
uguguguguggcugugugugugugu

SEQ ID NO: 328907 - RNA, 22 nt, Human
uguguguguguaugcaugugug

SEQ ID NO: 328908 - RNA, 23 nt, Human
uguguguguguaugcaugugugu

SEQ ID NO: 328909 - RNA, 30 nt, Human
uguguguguguaugcaugugugugugugug

SEQ ID NO: 328910 - RNA, 21 nt, Human
uguguguguguguaugcaugu

SEQ ID NO: 328911 - RNA, 23 nt, Human
uguguguguguguaugcaugugu

SEQ ID NO: 328912 - RNA, 21 nt, Human
uguguguguguguguaugcau

SEQ ID NO: 328913 - RNA, 25 nt, Human
uguguguguguguguaugcaugugu

SEQ ID NO: 328914 - RNA, 18 nt, Human
agagagguggaagaccag

SEQ ID NO: 328915 - RNA, 22 nt, Human
caacucggguggggguggaggg

SEQ ID NO: 328916 - RNA, 21 nt, Human
gagccugcacugaaaggcugg

SEQ ID NO: 328917 - RNA, 20 nt, Human
gagggcuggagccugcacug

SEQ ID NO: 328918 - RNA, 19 nt, Human
ggguggggguggagggcug

SEQ ID NO: 328919 - RNA, 19 nt, Human
guggagggcuggagccugc

SEQ ID NO: 328920 - RNA, 20 nt, Human
guggagggcuggagccugca

SEQ ID NO: 328921 - RNA, 20 nt, Human
aaacaaaaaacucuggacac

SEQ ID NO: 328922 - RNA, 19 nt, Human
aacaaaaaacucuggacac

SEQ ID NO: 328923 - RNA, 23 nt, Human
aagaguucaagaccagccugggc

SEQ ID NO: 328924 - RNA, 19 nt, Human
acagacaaggagcuuacgu

SEQ ID NO: 328925 - RNA, 24 nt, Human
acagagccagacccugucucaaga

SEQ ID NO: 328926 - RNA, 20 nt, Human
accaaagcaaccaauguucc

SEQ ID NO: 328927 - RNA, 23 nt, Human
accacuguacucuagucugccaa

SEQ ID NO: 328928 - RNA, 23 nt, Human
accuguagucauagcuacucagg

SEQ ID NO: 328929 - RNA, 18 nt, Human
agaagucaaggcugcaau

SEQ ID NO: 328930 - RNA, 23 nt, Human
agccugggcaacacagggaaacc

SEQ ID NO: 328931 - RNA, 20 nt, Human
agcuacucaggaggcugagg

SEQ ID NO: 328932 - RNA, 24 nt, Human
agcuacucaggaggcugagguggg

SEQ ID NO: 328933 - RNA, 26 nt, Human
aggcagaaguaucacuuggagccaag

SEQ ID NO: 328934 - RNA, 24 nt, Human
aggcugaggugggaggaugacuug

SEQ ID NO: 328935 - RNA, 23 nt, Human
aucacuuggagccaagaguucaa

SEQ ID NO: 328936 - RNA, 25 nt, Human
aucccuucccccuuguguuggaaau

SEQ ID NO: 328937 - RNA, 24 nt, Human
aucucaccacuguacucuagucug

SEQ ID NO: 328938 - RNA, 22 nt, Human
caacugcagcgcugccuccccc

SEQ ID NO: 328939 - RNA, 25 nt, Human
caaggagcuuacgugccaccaaagc

SEQ ID NO: 328940 - RNA, 25 nt, Human
caaggcagaaguaucacuuggagcc

SEQ ID NO: 328941 - RNA, 21 nt, Human
cacacccuucuguguggucug

SEQ ID NO: 328942 - RNA, 24 nt, Human
cacacccuucuguguggucugcua

SEQ ID NO: 328943 - RNA, 19 nt, Human
cacugagcagcugggccuc

SEQ ID NO: 328944 - RNA, 21 nt, Human
cagacccugucucaagacaaa

SEQ ID NO: 328945 - RNA, 24 nt, Human
cagcacuuugggaggccaaggcag

SEQ ID NO: 328946 - RNA, 22 nt, Human
cagcucccggagcucagguccu

SEQ ID NO: 328947 - RNA, 19 nt, Human
caggugcugccuauauggc

SEQ ID NO: 328948 - RNA, 20 nt, Human
ccaaaauucucugguggccc

SEQ ID NO: 328949 - RNA, 18 nt, Human
ccacuguacucuagucug

SEQ ID NO: 328950 - RNA, 23 nt, Human
ccagcuccagucucucuccccuc

SEQ ID NO: 328951 - RNA, 20 nt, Human
cccacacuucucuguucccg

SEQ ID NO: 328952 - RNA, 19 nt, Human
ccccggggggccgcuccuc

SEQ ID NO: 328953 - RNA, 26 nt, Human
ccccggggggccgcuccuccagugcc

SEQ ID NO: 328954 - RNA, 24 nt, Human
ccccuaggcagcugcuugcggccu

SEQ ID NO: 328955 - RNA, 18 nt, Human
ccccugcaucccuucccc

SEQ ID NO: 328956 - RNA, 19 nt, Human
ccccugcaucccuuccccc

SEQ ID NO: 328957 - RNA, 23 nt, Human
ccccugccauccugcugguuccu

SEQ ID NO: 328958 - RNA, 18 nt, Human
cccggagcucagguccug

SEQ ID NO: 328959 - RNA, 22 nt, Human
ccugaauugcagccucugguga

SEQ ID NO: 328960 - RNA, 18 nt, Human
ccugagucuagugagucc

SEQ ID NO: 328961 - RNA, 21 nt, Human
ccugggcaacacagggaaacc

SEQ ID NO: 328962 - RNA, 21 nt, Human
cgggcccuuuauccucagcuc

SEQ ID NO: 328963 - RNA, 21 nt, Human
cuaguaguuuucucugcuccu

SEQ ID NO: 328964 - RNA, 21 nt, Human
cucaagacaaacaaaaaacuc

SEQ ID NO: 328965 - RNA, 18 nt, Human
cucaggaggcugaggugg

SEQ ID NO: 328966 - RNA, 20 nt, Human
cuccugggcauucaucucua

SEQ ID NO: 328967 - RNA, 20 nt, Human
cucgcucugccgcggucgcu

SEQ ID NO: 328968 - RNA, 20 nt, Human
cucuagucugccaacagagc

SEQ ID NO: 328969 - RNA, 18 nt, Human
cucuccccucucaguccc

SEQ ID NO: 328970 - RNA, 21 nt, Human
cucuuccccacacuucucugu

SEQ ID NO: 328971 - RNA, 19 nt, Human
cugcaucccuucccccuug

SEQ ID NO: 328972 - RNA, 19 nt, Human
cugccaacagagccagacc

SEQ ID NO: 328973 - RNA, 20 nt, Human
cugccucccccugcaucccu

SEQ ID NO: 328974 - RNA, 20 nt, Human
cuggaggcccacguccuugc

SEQ ID NO: 328975 - RNA, 19 nt, Human
cugucucaagacaaacaaa

SEQ ID NO: 328976 - RNA, 21 nt, Human
cuucuucaaguucacaucuag

SEQ ID NO: 328977 - RNA, 23 nt, Human
cuugcauguugucacauguugcu

SEQ ID NO: 328978 - RNA, 21 nt, Human
cuuggcccaaggucuucucuc

SEQ ID NO: 328979 - RNA, 18 nt, Human
cuugggccacucugggug

SEQ ID NO: 328980 - RNA, 24 nt, Human
gagcagcugggccuccugggucuu

SEQ ID NO: 328981 - RNA, 23 nt, Human
gagcugcuuaauucagcacuuug

SEQ ID NO: 328982 - RNA, 19 nt, Human
gaggcugaggugggaggau

SEQ ID NO: 328983 - RNA, 19 nt, Human
gagucuugggccacucugg

SEQ ID NO: 328984 - RNA, 18 nt, Human
gcaccugcccccgucguu

SEQ ID NO: 328985 - RNA, 24 nt, Human
gccaacagagccagacccugucuc

SEQ ID NO: 328986 - RNA, 21 nt, Human
gcccaaagaaagaucgggccc

SEQ ID NO: 328987 - RNA, 18 nt, Human
gccucccccugcaucccu

SEQ ID NO: 328988 - RNA, 21 nt, Human
gcugugcaccuccucccuuug

SEQ ID NO: 328989 - RNA, 21 nt, Human
gcuguuucuuguaaccacaga

SEQ ID NO: 328990 - RNA, 21 nt, Human
ggcaacacagggaaaccucga

SEQ ID NO: 328991 - RNA, 21 nt, Human
ggcaguacuucuugcauguug

SEQ ID NO: 328992 - RNA, 18 nt, Human
gggaaggggaauacccac

SEQ ID NO: 328993 - RNA, 21 nt, Human
gggagagggcagauggaagcc

SEQ ID NO: 328994 - RNA, 21 nt, Human
gggagggaggcuggucucuuu

SEQ ID NO: 328995 - RNA, 23 nt, Human
gggucaguggcuguuucuuguaa

SEQ ID NO: 328996 - RNA, 21 nt, Human
ggugcuggagacagacaagga

SEQ ID NO: 328997 - RNA, 23 nt, Human
guacucuagucugccaacagagc

SEQ ID NO: 328998 - RNA, 18 nt, Human
uaaucucuguccuuuuac

SEQ ID NO: 328999 - RNA, 24 nt, Human
uaauucagcacuuugggaggccaa

SEQ ID NO: 329000 - RNA, 24 nt, Human
uaccuguagucauagcuacucagg

SEQ ID NO: 329001 - RNA, 21 nt, Human
uagaagcucaaggccagaggc

SEQ ID NO: 329002 - RNA, 24 nt, Human
uagcuacucaggaggcugaggugg

SEQ ID NO: 329003 - RNA, 23 nt, Human
uauuuccugccagucccagcuug

SEQ ID NO: 329004 - RNA, 28 nt, Human
ucaagacaaacaaaaaacucuggacaca

SEQ ID NO: 329005 - RNA, 23 nt, Human
ucacuuggagccaagaguucaag

SEQ ID NO: 329006 - RNA, 23 nt, Human
uccccaacucuguggggucccac

SEQ ID NO: 329007 - RNA, 23 nt, Human
uccccggggggccgcuccuccag

SEQ ID NO: 329008 - RNA, 18 nt, Human
ucccggcucuuccaucuc

SEQ ID NO: 329009 - RNA, 19 nt, Human
ucccggcucuuccaucucu

SEQ ID NO: 329010 - RNA, 19 nt, Human
uccucagcuccugggcauu

SEQ ID NO: 329011 - RNA, 23 nt, Human
uccucagcuccugggcauucauc

SEQ ID NO: 329012 - RNA, 18 nt, Human
uccucgcuucccggcgcc

SEQ ID NO: 329013 - RNA, 19 nt, Human
uccugcugguuccuaucuc

SEQ ID NO: 329014 - RNA, 21 nt, Human
uccugggcauucaucucuaag

SEQ ID NO: 329015 - RNA, 21 nt, Human
ucucucuccccucucaguccc

SEQ ID NO: 329016 - RNA, 18 nt, Human
ucugguuggcaguauugg

SEQ ID NO: 329017 - RNA, 25 nt, Human
ucuuccccacacuucucuguucccg

SEQ ID NO: 329018 - RNA, 21 nt, Human
ugaccagggucaguggcuguu

SEQ ID NO: 329019 - RNA, 20 nt, Human
ugaggugggaggaugacuug

SEQ ID NO: 329020 - RNA, 22 nt, Human
ugaggugggaggaugacuuggc

SEQ ID NO: 329021 - RNA, 22 nt, Human
ugcaaugaacugugaucucacc

SEQ ID NO: 329022 - RNA, 20 nt, Human
ugcaccuccucccuuugcug

SEQ ID NO: 329023 - RNA, 21 nt, Human
ugcugugagaaucaggugcug

SEQ ID NO: 329024 - RNA, 21 nt, Human
uggagaccuaugaacuugcac

SEQ ID NO: 329025 - RNA, 20 nt, Human
uggcagaaaguggcugcagc

SEQ ID NO: 329026 - RNA, 19 nt, Human
uggcugcagaugcuggcag

SEQ ID NO: 329027 - RNA, 19 nt, Human
uggcugcagaugcuggcag

SEQ ID NO: 329028 - RNA, 18 nt, Human
uggcugcagcugacaacc

SEQ ID NO: 329029 - RNA, 21 nt, Human
uggcugcagcugacaaccuuc

SEQ ID NO: 329030 - RNA, 24 nt, Human
ugggaggccaaggcagaaguauca

SEQ ID NO: 329031 - RNA, 18 nt, Human
ugguuggcaguauuggca

SEQ ID NO: 329032 - RNA, 24 nt, Human
uguccugcuuauuuucucuugcag

SEQ ID NO: 329033 - RNA, 19 nt, Human
ugucucaagacaaacaaaa

SEQ ID NO: 329034 - RNA, 24 nt, Human
uucccggcgccagcucgcucugcc

SEQ ID NO: 329035 - RNA, 22 nt, Human
uugccagcuccagucucucucc

SEQ ID NO: 329036 - RNA, 22 nt, Human
uuggagccaagaguucaagacc

SEQ ID NO: 329037 - RNA, 20 nt, Human
uuggcaguacuucuugcaug

SEQ ID NO: 329038 - RNA, 19 nt, Human
uuggggucggguccaacuc

SEQ ID NO: 329039 - RNA, 18 nt, Human
uuugccccugccauccug

SEQ ID NO: 329040 - RNA, 22 nt, Human
uuuuuuuuuuuuuuuuuuuggg

SEQ ID NO: 329041 - RNA, 20 nt, Human
aaaccaagucucugggggcg

SEQ ID NO: 329042 - RNA, 22 nt, Human
aaccagucuggaacccuaggcc

SEQ ID NO: 329043 - RNA, 23 nt, Human
aaggcuggagccaaaaccaaguc

SEQ ID NO: 329044 - RNA, 20 nt, Human
accaagucucugggggcggg

SEQ ID NO: 329045 - RNA, 20 nt, Human
acucugugggggccgaucgg

SEQ ID NO: 329046 - RNA, 19 nt, Human
agacgaacaaguccaacca

SEQ ID NO: 329047 - RNA, 21 nt, Human
caccucccuccaagucccaag

SEQ ID NO: 329048 - RNA, 19 nt, Human
cccaugcagcccuagagac

SEQ ID NO: 329049 - RNA, 22 nt, Human
cccaugcagcccuagagacggg

SEQ ID NO: 329050 - RNA, 22 nt, Human
ccccgggcuccccaugcagccc

SEQ ID NO: 329051 - RNA, 18 nt, Human
cccgcugcgcucuagccu

SEQ ID NO: 329052 - RNA, 20 nt, Human
ccgcgggccacucugugggg

SEQ ID NO: 329053 - RNA, 22 nt, Human
ccgcugcgcucuagccucccug

SEQ ID NO: 329054 - RNA, 23 nt, Human
ccgcugcgcucuagccucccugu

SEQ ID NO: 329055 - RNA, 21 nt, Human
ccggcuccgggccgguucccg

SEQ ID NO: 329056 - RNA, 21 nt, Human
ccgggccgguucccgcugcgc

SEQ ID NO: 329057 - RNA, 23 nt, Human
ccuccaagucccaagaaaguggg

SEQ ID NO: 329058 - RNA, 22 nt, Human
ccucucuggauccccacuacuc

SEQ ID NO: 329059 - RNA, 23 nt, Human
cgcgggccacucugugggggccg

SEQ ID NO: 329060 - RNA, 23 nt, Human
cggcuccggcuccgggccgguuc

SEQ ID NO: 329061 - RNA, 19 nt, Human
cggcuccgggccgguuccc

SEQ ID NO: 329062 - RNA, 24 nt, Human
cuccccaugcagcccuagagacgg

SEQ ID NO: 329063 - RNA, 20 nt, Human
cuccccgggcuccccaugca

SEQ ID NO: 329064 - RNA, 18 nt, Human
cuggcucugucucugucu

SEQ ID NO: 329065 - RNA, 21 nt, Human
cugggggcggggguccucucu

SEQ ID NO: 329066 - RNA, 23 nt, Human
ggaggcaguguuccacuccagug

SEQ ID NO: 329067 - RNA, 20 nt, Human
ggagggccgggccuggcucu

SEQ ID NO: 329068 - RNA, 22 nt, Human
gggagaaguccagugugcuguu

SEQ ID NO: 329069 - RNA, 19 nt, Human
gggagggccgggccuggcu

SEQ ID NO: 329070 - RNA, 21 nt, Human
gggagggccgggccuggcucu

SEQ ID NO: 329071 - RNA, 21 nt, Human
gggcgggagggccgggccugg

SEQ ID NO: 329072 - RNA, 20 nt, Human
ggggccaggggaaggcugga

SEQ ID NO: 329073 - RNA, 22 nt, Human
uaacuccugagugucacggggc

SEQ ID NO: 329074 - RNA, 18 nt, Human
uccccacuacucagcucc

SEQ ID NO: 329075 - RNA, 25 nt, Human
ucucuggauccccacuacucagcuc

SEQ ID NO: 329076 - RNA, 21 nt, Human
ucugggggcggggguccucuc

SEQ ID NO: 329077 - RNA, 21 nt, Human
uggauccccacuacucagcuc

SEQ ID NO: 329078 - RNA, 18 nt, Human
ugggggccgaucggcugg

SEQ ID NO: 329079 - RNA, 21 nt, Human
uguggggcuccggcuccggcu

SEQ ID NO: 329080 - RNA, 24 nt, Human
uguuccaccucccuccaaguccca

SEQ ID NO: 329081 - RNA, 23 nt, Human
uuccaccucccuccaagucccaa

SEQ ID NO: 329082 - RNA, 24 nt, Human
uuuuuuuuuuuuuuuuuuuguuuu

SEQ ID NO: 329083 - RNA, 26 nt, Human
uuuuuuuuuuuuuuuuuuuuuugggg

SEQ ID NO: 329084 - RNA, 24 nt, Human
aaaagaucugcuuuggucaggccu

SEQ ID NO: 329085 - RNA, 21 nt, Human
aagcggucccauaacagcgag

SEQ ID NO: 329086 - RNA, 19 nt, Human
aaucaucucuucaucuucu

SEQ ID NO: 329087 - RNA, 24 nt, Human
agacaccaggccugauauucagca

SEQ ID NO: 329088 - RNA, 22 nt, Human
auaacagcgaguaaacagguac

SEQ ID NO: 329089 - RNA, 23 nt, Human
caauaaaaauguggcucgagaug

SEQ ID NO: 329090 - RNA, 20 nt, Human
cacauggccucagguaagcc

SEQ ID NO: 329091 - RNA, 19 nt, Human
caccauguaucccaaugcc

SEQ ID NO: 329092 - RNA, 20 nt, Human
caccuccacaaaaugcaggg

SEQ ID NO: 329093 - RNA, 21 nt, Human
cagguaagccacuuaccucuc

SEQ ID NO: 329094 - RNA, 19 nt, Human
caucagaugcuucaccagg

SEQ ID NO: 329095 - RNA, 20 nt, Human
cauguuccccaggggaacau

SEQ ID NO: 329096 - RNA, 23 nt, Human
cccacccaccuccacaaaaugca

SEQ ID NO: 329097 - RNA, 22 nt, Human
ccucagguaagccacuuaccuc

SEQ ID NO: 329098 - RNA, 20 nt, Human
ccugccguucugcucugcag

SEQ ID NO: 329099 - RNA, 24 nt, Human
cgagaugaacuaacauagggguug

SEQ ID NO: 329100 - RNA, 21 nt, Human
cgugcaucagaugcuucaccc

SEQ ID NO: 329101 - RNA, 21 nt, Human
cuccagggaguauggucagcu

SEQ ID NO: 329102 - RNA, 21 nt, Human
cuguauuuugggcugacucua

SEQ ID NO: 329103 - RNA, 21 nt, Human
gaacauucucccacccaccuc

SEQ ID NO: 329104 - RNA, 19 nt, Human
gcccagcaggcaggugccu

SEQ ID NO: 329105 - RNA, 19 nt, Human
ggaaaauguacagacccuu

SEQ ID NO: 329106 - RNA, 20 nt, Human
gggaacaccaagggagccac

SEQ ID NO: 329107 - RNA, 19 nt, Human
gggaccucuggcccugccg

SEQ ID NO: 329108 - RNA, 24 nt, Human
gggguugggugggggaaauaauga

SEQ ID NO: 329109 - RNA, 18 nt, Human
ggucuuacauuccauagg

SEQ ID NO: 329110 - RNA, 19 nt, Human
guaaaaggggaacaccaag

SEQ ID NO: 329111 - RNA, 18 nt, Human
gugggcccagcaggcagg

SEQ ID NO: 329112 - RNA, 21 nt, Human
uaacauagggguugggugggg

SEQ ID NO: 329113 - RNA, 20 nt, Human
uaaguaaacagagaucucaa

SEQ ID NO: 329114 - RNA, 23 nt, Human
uagaaaacagugggcccagcagg

SEQ ID NO: 329115 - RNA, 18 nt, Human
ucaagcccagcugagcgc

SEQ ID NO: 329116 - RNA, 21 nt, Human
ucaagcccagcugagcgccgg

SEQ ID NO: 329117 - RNA, 18 nt, Human
uccaagggaucagaaagu

SEQ ID NO: 329118 - RNA, 19 nt, Human
uccaagggaucagaaaguu

SEQ ID NO: 329119 - RNA, 25 nt, Human
ucccacccaccuccacaaaaugcag

SEQ ID NO: 329120 - RNA, 21 nt, Human
uccccaggggaacauucuccc

SEQ ID NO: 329121 - RNA, 22 nt, Human
uccccaggggaacauucuccca

SEQ ID NO: 329122 - RNA, 21 nt, Human
ucucccacccaccuccacaaa

SEQ ID NO: 329123 - RNA, 20 nt, Human
ucugcagucucauggaagaa

SEQ ID NO: 329124 - RNA, 19 nt, Human
ucugcucugcagucucaug

SEQ ID NO: 329125 - RNA, 19 nt, Human
ugaccagcucgugggaccu

SEQ ID NO: 329126 - RNA, 20 nt, Human
ugagucuagagacaccaggc

SEQ ID NO: 329127 - RNA, 22 nt, Human
uggcaacacaaagacuguauuu

SEQ ID NO: 329128 - RNA, 20 nt, Human
uggcaguaaaaggggaacac

SEQ ID NO: 329129 - RNA, 25 nt, Human
uggcaguaaaaggggaacaccaagg

SEQ ID NO: 329130 - RNA, 18 nt, Human
ugggugggggaaauaaug

SEQ ID NO: 329131 - RNA, 20 nt, Human
ugggugggggaaauaaugag

SEQ ID NO: 329132 - RNA, 19 nt, Human
uuagaaaacagugggccca

SEQ ID NO: 329133 - RNA, 18 nt, Human
uucaggccugacgcagag

SEQ ID NO: 329134 - RNA, 21 nt, Human
aggucuuagccggcacaaucc

SEQ ID NO: 329135 - RNA, 23 nt, Human
auccucacguuagaaaacuccau

SEQ ID NO: 329136 - RNA, 23 nt, Human
caaaguucaugugaauaccucuc

SEQ ID NO: 329137 - RNA, 18 nt, Human
cacaagggucccaucucc

SEQ ID NO: 329138 - RNA, 20 nt, Human
cacaggaaaagcaagucacu

SEQ ID NO: 329139 - RNA, 20 nt, Human
cacguuagaaaacuccaucu

SEQ ID NO: 329140 - RNA, 19 nt, Human
cauucaucaccguucacac

SEQ ID NO: 329141 - RNA, 19 nt, Human
ggaccccuccucuuugcug

SEQ ID NO: 329142 - RNA, 19 nt, Human
ggcacaauccaacgcugca

SEQ ID NO: 329143 - RNA, 24 nt, Human
ggcaggucuuagccggcacaaucc

SEQ ID NO: 329144 - RNA, 21 nt, Human
gucccaucucccuggcagguc

SEQ ID NO: 329145 - RNA, 22 nt, Human
guuaaaaauauaaauaagucuc

SEQ ID NO: 329146 - RNA, 24 nt, Human
uaagucucauacaaaguucaugug

SEQ ID NO: 329147 - RNA, 22 nt, Human
ucuggaccccuccucuuugcug

SEQ ID NO: 329148 - RNA, 24 nt, Human
uggggccaggugccagugcgugcc

SEQ ID NO: 329149 - RNA, 18 nt, Human
aaacugcauccccacaac

SEQ ID NO: 329150 - RNA, 22 nt, Human
aaguacaaugaagggagggccg

SEQ ID NO: 329151 - RNA, 23 nt, Human
aaugauaaaguacaaugaaggga

SEQ ID NO: 329152 - RNA, 21 nt, Human
accaccgcaccgcgcccaagc

SEQ ID NO: 329153 - RNA, 18 nt, Human
agccccgggcaagucacc

SEQ ID NO: 329154 - RNA, 27 nt, Human
augccaaacugcauccccacaacccca

SEQ ID NO: 329155 - RNA, 23 nt, Human
caccaccgcaccgcgcccaagca

SEQ ID NO: 329156 - RNA, 24 nt, Human
caccacguagacagcagacagggc

SEQ ID NO: 329157 - RNA, 19 nt, Human
caccgcaccgcgcccaagc

SEQ ID NO: 329158 - RNA, 24 nt, Human
caccgcaccucugugccucggucc

SEQ ID NO: 329159 - RNA, 19 nt, Human
caggcuaccuggagccccg

SEQ ID NO: 329160 - RNA, 22 nt, Human
caucagagaacaaaaccaaaag

SEQ ID NO: 329161 - RNA, 23 nt, Human
caucaggggugcggagccuggga

SEQ ID NO: 329162 - RNA, 21 nt, Human
cauccccacaacccaccacgu

SEQ ID NO: 329163 - RNA, 22 nt, Human
ccaaacugcauccccacaaccc

SEQ ID NO: 329164 - RNA, 23 nt, Human
ccaaacugcauccccacaaccca

SEQ ID NO: 329165 - RNA, 18 nt, Human
ccgccgccgccgccgcca

SEQ ID NO: 329166 - RNA, 18 nt, Human
ccgccgccgccgccgcca

SEQ ID NO: 329167 - RNA, 21 nt, Human
ccgccgccgccgccgccauga

SEQ ID NO: 329168 - RNA, 18 nt, Human
ccgccgccgccgccgccg

SEQ ID NO: 329169 - RNA, 18 nt, Human
ccgcgcccaagcagcugc

SEQ ID NO: 329170 - RNA, 18 nt, Human
ccugcaggcuaccuggag

SEQ ID NO: 329171 - RNA, 30 nt, Human
cgcccaagcagcugccgccgccgccgccgg

SEQ ID NO: 329172 - RNA, 20 nt, Human
cgccgccgccgccgccgcca

SEQ ID NO: 329173 - RNA, 22 nt, Human
cggagccugggaggcacgcgag

SEQ ID NO: 329174 - RNA, 18 nt, Human
cggccgaagcgggcucag

SEQ ID NO: 329175 - RNA, 19 nt, Human
cgucccggccgaagcgggc

SEQ ID NO: 329176 - RNA, 19 nt, Human
cuagauacugagacacauc

SEQ ID NO: 329177 - RNA, 18 nt, Human
gaaguugauuuuuaauga

SEQ ID NO: 329178 - RNA, 18 nt, Human
gaccuggcucagacauga

SEQ ID NO: 329179 - RNA, 19 nt, Human
gccugggaggcacgcgagg

SEQ ID NO: 329180 - RNA, 22 nt, Human
gcgcagcaucaggggugcggag

SEQ ID NO: 329181 - RNA, 21 nt, Human
gcucagacaugaaucaugugc

SEQ ID NO: 329182 - RNA, 23 nt, Human
gcugccgccgccgccgccgccgg

SEQ ID NO: 329183 - RNA, 21 nt, Human
ggggcuaagccuagcugucug

SEQ ID NO: 329184 - RNA, 20 nt, Human
ggggugcuguggugguggua

SEQ ID NO: 329185 - RNA, 25 nt, Human
uacaaugaagggagggcagaggggc

SEQ ID NO: 329186 - RNA, 20 nt, Human
ucagacaugaaucaugugcu

SEQ ID NO: 329187 - RNA, 20 nt, Human
ugauaaaguacaaugaaggg

SEQ ID NO: 329188 - RNA, 19 nt, Human
ugcauccccacaacccacc

SEQ ID NO: 329189 - RNA, 19 nt, Human
ugccaaacugcauccccac

SEQ ID NO: 329190 - RNA, 19 nt, Human
ugccucgguccucagcugc

SEQ ID NO: 329191 - RNA, 18 nt, Human
ugcggagccugggaggca

SEQ ID NO: 329192 - RNA, 22 nt, Human
aaaaaagccacgucagcuuaaa

SEQ ID NO: 329193 - RNA, 22 nt, Human
aaaacaaaaaaccugguccuuu

SEQ ID NO: 329194 - RNA, 23 nt, Human
aaaagaaaacugguaggacagaa

SEQ ID NO: 329195 - RNA, 25 nt, Human
aaacaaaaaaccugguccuuuacca

SEQ ID NO: 329196 - RNA, 23 nt, Human
aaacauaacaauauauuacuaac

SEQ ID NO: 329197 - RNA, 19 nt, Human
aaaggcucugccaggagaa

SEQ ID NO: 329198 - RNA, 19 nt, Human
aaauggccugugaaacaga

SEQ ID NO: 329199 - RNA, 24 nt, Human
aacauuuccuuccucaccaauacc

SEQ ID NO: 329200 - RNA, 19 nt, Human
aaccauuugaguucucagc

SEQ ID NO: 329201 - RNA, 21 nt, Human
aagaagcaggguaaccauuug

SEQ ID NO: 329202 - RNA, 24 nt, Human
aagcgacucauaaugcaugugaau

SEQ ID NO: 329203 - RNA, 22 nt, Human
aauagccugagaccuugagaac

SEQ ID NO: 329204 - RNA, 20 nt, Human
acagaaaaaaagccacguca

SEQ ID NO: 329205 - RNA, 26 nt, Human
acagaaaaaaagccacgucagcuuaa

SEQ ID NO: 329206 - RNA, 21 nt, Human
acggaagcugaggaagaucag

SEQ ID NO: 329207 - RNA, 24 nt, Human
acuccaccacaaguccuggaauaa

SEQ ID NO: 329208 - RNA, 22 nt, Human
acucugcaacuuacggaagcug

SEQ ID NO: 329209 - RNA, 23 nt, Human
agaaaaaaagccacgucagcuua

SEQ ID NO: 329210 - RNA, 18 nt, Human
agaaucuguaaaagaaaa

SEQ ID NO: 329211 - RNA, 21 nt, Human
agaccuguagccccagcccag

SEQ ID NO: 329212 - RNA, 21 nt, Human
agagaggaaaacguguugugu

SEQ ID NO: 329213 - RNA, 19 nt, Human
agagaggagguaaaaggga

SEQ ID NO: 329214 - RNA, 22 nt, Human
agagaggagguaaaagggagga

SEQ ID NO: 329215 - RNA, 23 nt, Human
agagaggagguaaaagggaggau

SEQ ID NO: 329216 - RNA, 21 nt, Human
agagucccaggucucugcccc

SEQ ID NO: 329217 - RNA, 22 nt, Human
agaugaggggaaauaggauggg

SEQ ID NO: 329218 - RNA, 24 nt, Human
agggacccaagcuauaccccuucc

SEQ ID NO: 329219 - RNA, 18 nt, Human
agggcagcgggcagacuu

SEQ ID NO: 329220 - RNA, 23 nt, Human
aggugcagacugaguuguggaag

SEQ ID NO: 329221 - RNA, 25 nt, Human
agugagaaucuguaaaagaaaacug

SEQ ID NO: 329222 - RNA, 18 nt, Human
caacugaggugcagacug

SEQ ID NO: 329223 - RNA, 22 nt, Human
caauaccauaaaacauguaagg

SEQ ID NO: 329224 - RNA, 20 nt, Human
cacuccucacucagaauauu

SEQ ID NO: 329225 - RNA, 23 nt, Human
cagaaaaagaccacacuccucac

SEQ ID NO: 329226 - RNA, 18 nt, Human
cagcaccuagagagagga

SEQ ID NO: 329227 - RNA, 21 nt, Human
cagcagaaaaggaaggcuaga

SEQ ID NO: 329228 - RNA, 21 nt, Human
cagcugagcugaccagaguac

SEQ ID NO: 329229 - RNA, 19 nt, Human
caugaagccacccauacaa

SEQ ID NO: 329230 - RNA, 25 nt, Human
caugaagccacccauacaaucacaa

SEQ ID NO: 329231 - RNA, 21 nt, Human
cauuguaggaagaagcagggu

SEQ ID NO: 329232 - RNA, 22 nt, Human
ccaauaccauaaaacauguaag

SEQ ID NO: 329233 - RNA, 21 nt, Human
ccacagaaaaaaagccacguc

SEQ ID NO: 329234 - RNA, 18 nt, Human
ccagauccaagagaggga

SEQ ID NO: 329235 - RNA, 24 nt, Human
ccagauccaagagagggaguagag

SEQ ID NO: 329236 - RNA, 18 nt, Human
ccccaaaacagugcuacu

SEQ ID NO: 329237 - RNA, 18 nt, Human
ccccuccuccccagaucc

SEQ ID NO: 329238 - RNA, 18 nt, Human
cccuccuccccagaucca

SEQ ID NO: 329239 - RNA, 20 nt, Human
cccuccuccccagauccaag

SEQ ID NO: 329240 - RNA, 21 nt, Human
ccucacucugcaacuuacgga

SEQ ID NO: 329241 - RNA, 19 nt, Human
ccugaaccaagggacagga

SEQ ID NO: 329242 - RNA, 18 nt, Human
ccugaggucaaccugcuc

SEQ ID NO: 329243 - RNA, 22 nt, Human
cgagggccccaaaacagugcua

SEQ ID NO: 329244 - RNA, 18 nt, Human
cuagagagacagaggaaa

SEQ ID NO: 329245 - RNA, 19 nt, Human
cugaagccccaugacuaua

SEQ ID NO: 329246 - RNA, 19 nt, Human
cugcagacuugugcugguc

SEQ ID NO: 329247 - RNA, 22 nt, Human
cugcucacauucaaucaaaauc

SEQ ID NO: 329248 - RNA, 21 nt, Human
cuggguucacccauaucacac

SEQ ID NO: 329249 - RNA, 19 nt, Human
gacuugugcuggucaguga

SEQ ID NO: 329250 - RNA, 18 nt, Human
gagaaaauagugacacug

SEQ ID NO: 329251 - RNA, 24 nt, Human
gagcauagugacagaccuguagcc

SEQ ID NO: 329252 - RNA, 20 nt, Human
gaggaaggucaggggcuggg

SEQ ID NO: 329253 - RNA, 22 nt, Human
gaggggaaauaggaugggcccu

SEQ ID NO: 329254 - RNA, 22 nt, Human
gaucagaaaaagaccacacucc

SEQ ID NO: 329255 - RNA, 22 nt, Human
gcagaaaccacaauggaguagg

SEQ ID NO: 329256 - RNA, 22 nt, Human
gcagcagaaaaggaaggcuaga

SEQ ID NO: 329257 - RNA, 23 nt, Human
gcuggguucacccauaucacaca

SEQ ID NO: 329258 - RNA, 24 nt, Human
ggaagcugaggaagaucagaaaaa

SEQ ID NO: 329259 - RNA, 18 nt, Human
ggcacaaagacccuggac

SEQ ID NO: 329260 - RNA, 19 nt, Human
ggcagcacacagugugaac

SEQ ID NO: 329261 - RNA, 19 nt, Human
gucaggggcuggguucacc

SEQ ID NO: 329262 - RNA, 18 nt, Human
gucucugccccuccuccc

SEQ ID NO: 329263 - RNA, 21 nt, Human
gugaaggacuggaaaacaaaa

SEQ ID NO: 329264 - RNA, 18 nt, Human
uaaaggugaacaucagug

SEQ ID NO: 329265 - RNA, 19 nt, Human
uaaaggugaacaucagugu

SEQ ID NO: 329266 - RNA, 21 nt, Human
uaauauaccucacucugcaac

SEQ ID NO: 329267 - RNA, 23 nt, Human
uaauauaccucacucugcaacuu

SEQ ID NO: 329268 - RNA, 21 nt, Human
uacagcuuaaaccuaagcuuu

SEQ ID NO: 329269 - RNA, 26 nt, Human
uaccauaacuccaccacaaguccugg

SEQ ID NO: 329270 - RNA, 21 nt, Human
uagaggaaggucaggggcugg

SEQ ID NO: 329271 - RNA, 21 nt, Human
uagcagaagugagaaucugua

SEQ ID NO: 329272 - RNA, 21 nt, Human
uagcauuucaauguugcugug

SEQ ID NO: 329273 - RNA, 20 nt, Human
uauacagcuuaaaccuaagc

SEQ ID NO: 329274 - RNA, 25 nt, Human
ucaaucaaaaucaaaauaaaaauga

SEQ ID NO: 329275 - RNA, 24 nt, Human
ucaggucccaaugguucugcugac

SEQ ID NO: 329276 - RNA, 23 nt, Human
ucagugaacaccuuuuuuuuuuu

SEQ ID NO: 329277 - RNA, 20 nt, Human
uccaagcuacuuuccugaac

SEQ ID NO: 329278 - RNA, 19 nt, Human
ucccaggucucugccccuc

SEQ ID NO: 329279 - RNA, 22 nt, Human
ucccaggucucugccccuccuc

SEQ ID NO: 329280 - RNA, 19 nt, Human
uccuggaauaauuccaaaa

SEQ ID NO: 329281 - RNA, 21 nt, Human
ucuauccuuguccaguuuuug

SEQ ID NO: 329282 - RNA, 18 nt, Human
ucucaaaggcucugccag

SEQ ID NO: 329283 - RNA, 19 nt, Human
ucucaaaggcucugccagg

SEQ ID NO: 329284 - RNA, 22 nt, Human
ucugccccuccuccccagaucc

SEQ ID NO: 329285 - RNA, 18 nt, Human
ugaaccaggacagccagc

SEQ ID NO: 329286 - RNA, 23 nt, Human
ugacacauucuugcugaagaaca

SEQ ID NO: 329287 - RNA, 20 nt, Human
ugagaaaggaaagaaagugc

SEQ ID NO: 329288 - RNA, 24 nt, Human
ugaggaagaucagaaaaagaccag

SEQ ID NO: 329289 - RNA, 18 nt, Human
ugaggggaaauaggaugg

SEQ ID NO: 329290 - RNA, 23 nt, Human
ugaggucaaccugcucacauuca

SEQ ID NO: 329291 - RNA, 24 nt, Human
ugaguuguggaagguggguguuga

SEQ ID NO: 329292 - RNA, 21 nt, Human
ugccuugggaacaaagauaaa

SEQ ID NO: 329293 - RNA, 24 nt, Human
ugccuugggaacaaagauaaagug

SEQ ID NO: 329294 - RNA, 19 nt, Human
ugcuagggucuucagagag

SEQ ID NO: 329295 - RNA, 18 nt, Human
uggaaaacaaaaaaccug

SEQ ID NO: 329296 - RNA, 26 nt, Human
uggaacccagcauuacaauauugguu

SEQ ID NO: 329297 - RNA, 19 nt, Human
uggccaguuugggugcugu

SEQ ID NO: 329298 - RNA, 24 nt, Human
ugucagaagcucaaagcgacucau

SEQ ID NO: 329299 - RNA, 18 nt, Human
uucaaggggugaaaaguu

SEQ ID NO: 329300 - RNA, 24 nt, Human
uucaaggggugaaaaguuuuaacc

SEQ ID NO: 329301 - RNA, 22 nt, Human
uuccaagcuacuuuccugaacc

SEQ ID NO: 329302 - RNA, 19 nt, Human
uucccaaauagccugagac

SEQ ID NO: 329303 - RNA, 19 nt, Human
uucucuggaagugaaacuc

SEQ ID NO: 329304 - RNA, 23 nt, Human
uucugccccauggggccuugcag

SEQ ID NO: 329305 - RNA, 19 nt, Human
uugccgggucggcagcaca

SEQ ID NO: 329306 - RNA, 19 nt, Human
uuuuuuccaucucuggcag

SEQ ID NO: 329307 - RNA, 19 nt, Human
aaaacauaauacauuaaca

SEQ ID NO: 329308 - RNA, 24 nt, Human
aaacacggugcauuuuuuuccuca

SEQ ID NO: 329309 - RNA, 19 nt, Human
agcggcgcugcggaaggca

SEQ ID NO: 329310 - RNA, 18 nt, Human
aggagccggaaguggcug

SEQ ID NO: 329311 - RNA, 23 nt, Human
agguuccagaccacuuaggaguc

SEQ ID NO: 329312 - RNA, 25 nt, Human
auccuugccucauacuugccagaag

SEQ ID NO: 329313 - RNA, 25 nt, Human
caaccuuguuuuaagaaguaguaaa

SEQ ID NO: 329314 - RNA, 21 nt, Human
cauacuugccagaagcucaga

SEQ ID NO: 329315 - RNA, 21 nt, Human
cccucaagacuggacagccua

SEQ ID NO: 329316 - RNA, 18 nt, Human
ccuguuccugcagcuccc

SEQ ID NO: 329317 - RNA, 24 nt, Human
cggaaguggcugaaaaaaaaaaga

SEQ ID NO: 329318 - RNA, 19 nt, Human
cugcagcucccucaagacu

SEQ ID NO: 329319 - RNA, 21 nt, Human
cuugccucauacuugccagaa

SEQ ID NO: 329320 - RNA, 21 nt, Human
gaagacaguggcuaggagcac

SEQ ID NO: 329321 - RNA, 18 nt, Human
gcgaaacgcccacgcucc

SEQ ID NO: 329322 - RNA, 21 nt, Human
ggaauuuuugcuccaaguucu

SEQ ID NO: 329323 - RNA, 24 nt, Human
ggcuaggagcacauuccuuauaaa

SEQ ID NO: 329324 - RNA, 18 nt, Human
uaaaugguauacuuagga

SEQ ID NO: 329325 - RNA, 19 nt, Human
uaagaaguaguaaaaugaa

SEQ ID NO: 329326 - RNA, 19 nt, Human
uagauuucagucaugccug

SEQ ID NO: 329327 - RNA, 24 nt, Human
ucugaaggucucuuuuuccuguuc

SEQ ID NO: 329328 - RNA, 21 nt, Human
ucuggaaagcuugucuuuucc

SEQ ID NO: 329329 - RNA, 19 nt, Human
ugccagaagcucagagaca

SEQ ID NO: 329330 - RNA, 24 nt, Human
ugccuggaaaggagaagacagugg

SEQ ID NO: 329331 - RNA, 21 nt, Human
ugcgcuuuagcggcgcugcgg

SEQ ID NO: 329332 - RNA, 23 nt, Human
ugggaauuuuugcuccaaguucu

SEQ ID NO: 329333 - RNA, 21 nt, Human
uuagauuucagucaugccugg

SEQ ID NO: 329334 - RNA, 23 nt, Human
uuccagaccacuuaggagucugc

SEQ ID NO: 329335 - RNA, 18 nt, Human
uuccuagccgaaucugga

SEQ ID NO: 329336 - RNA, 21 nt, Human
aaacagaacagauaaaguuca

SEQ ID NO: 329337 - RNA, 22 nt, Human
aaagagaccccaacagacccug

SEQ ID NO: 329338 - RNA, 24 nt, Human
aaagcaaucuacacaccagacacc

SEQ ID NO: 329339 - RNA, 23 nt, Human
aacauacuuccccuucuccuccc

SEQ ID NO: 329340 - RNA, 18 nt, Human
aaggggggcagagacagg

SEQ ID NO: 329341 - RNA, 23 nt, Human
acagagaaaaaauaaaaucaaaa

SEQ ID NO: 329342 - RNA, 22 nt, Human
acaggaagcagccccccaaaac

SEQ ID NO: 329343 - RNA, 20 nt, Human
acauacuuccccuucuccuc

SEQ ID NO: 329344 - RNA, 21 nt, Human
accccaacagacccugccugc

SEQ ID NO: 329345 - RNA, 20 nt, Human
acccccgggugaagucucua

SEQ ID NO: 329346 - RNA, 20 nt, Human
agaaacagaacagauaaagu

SEQ ID NO: 329347 - RNA, 19 nt, Human
agaagcaggggggcucaga

SEQ ID NO: 329348 - RNA, 22 nt, Human
agacaagcagggggaccccuca

SEQ ID NO: 329349 - RNA, 21 nt, Human
agacaggaagcagccccccaa

SEQ ID NO: 329350 - RNA, 27 nt, Human
agaccccaacagacccugccugcccuu

SEQ ID NO: 329351 - RNA, 21 nt, Human
agagaaguaaaacaucucagg

SEQ ID NO: 329352 - RNA, 18 nt, Human
agagagccccauagaagc

SEQ ID NO: 329353 - RNA, 21 nt, Human
agagguaaaucaacaagacca

SEQ ID NO: 329354 - RNA, 21 nt, Human
agcagaucuggggaagggaua

SEQ ID NO: 329355 - RNA, 21 nt, Human
aggagccugucccucugcccc

SEQ ID NO: 329356 - RNA, 26 nt, Human
aggagggaggagggggcccagaggcu

SEQ ID NO: 329357 - RNA, 19 nt, Human
aggauaaaaagagacccca

SEQ ID NO: 329358 - RNA, 20 nt, Human
aggcagaagagagagcccca

SEQ ID NO: 329359 - RNA, 23 nt, Human
aggcagaagagagagccccauag

SEQ ID NO: 329360 - RNA, 24 nt, Human
aggcaggggcagucgccaggccua

SEQ ID NO: 329361 - RNA, 18 nt, Human
agggaggagggggcccag

SEQ ID NO: 329362 - RNA, 22 nt, Human
agggaggagggggcccagaggc

SEQ ID NO: 329363 - RNA, 26 nt, Human
aggggcagucgccaggccucccaagg

SEQ ID NO: 329364 - RNA, 19 nt, Human
agggggagucacagagcug

SEQ ID NO: 329365 - RNA, 21 nt, Human
agguaaaucaacaagaccaaa

SEQ ID NO: 329366 - RNA, 22 nt, Human
agguauaaaaggggagugcggg

SEQ ID NO: 329367 - RNA, 27 nt, Human
auaaaguucagaauucuaggcccaaaa

SEQ ID NO: 329368 - RNA, 19 nt, Human
auaaucacagaacaaagac

SEQ ID NO: 329369 - RNA, 22 nt, Human
caaagcaaucuacacaccagac

SEQ ID NO: 329370 - RNA, 25 nt, Human
caaagcaaucuacacaccagacacc

SEQ ID NO: 329371 - RNA, 21 nt, Human
caacaagaccaaagagacguc

SEQ ID NO: 329372 - RNA, 23 nt, Human
cacagagcugcucccagcacacc

SEQ ID NO: 329373 - RNA, 21 nt, Human
caccaucagugaaggcccagu

SEQ ID NO: 329374 - RNA, 25 nt, Human
caccccacagacaaagcaaucuaca

SEQ ID NO: 329375 - RNA, 22 nt, Human
caccccaccccacagacaaagc

SEQ ID NO: 329376 - RNA, 24 nt, Human
cagacaggaagcagccccccaaaa

SEQ ID NO: 329377 - RNA, 19 nt, Human
cagacccugccugcccuuc

SEQ ID NO: 329378 - RNA, 23 nt, Human
cauauugcuuccccaccccaccc

SEQ ID NO: 329379 - RNA, 23 nt, Human
cauggccccuuugguucucugcc

SEQ ID NO: 329380 - RNA, 19 nt, Human
ccaaaaaggagggacccuc

SEQ ID NO: 329381 - RNA, 22 nt, Human
ccaaaacauacuuccccuucuc

SEQ ID NO: 329382 - RNA, 27 nt, Human
ccaaaacauacuuccccuucuccuccc

SEQ ID NO: 329383 - RNA, 22 nt, Human
ccauuagaccccgguggccccu

SEQ ID NO: 329384 - RNA, 21 nt, Human
cccaaaacauacuuccccuuc

SEQ ID NO: 329385 - RNA, 21 nt, Human
cccaaggccuggcuccucuuu

SEQ ID NO: 329386 - RNA, 22 nt, Human
cccaauaaucacagaacaaaga

SEQ ID NO: 329387 - RNA, 21 nt, Human
cccaccccacagacaaagcaa

SEQ ID NO: 329388 - RNA, 20 nt, Human
cccaccugugaaaggggagg

SEQ ID NO: 329389 - RNA, 18 nt, Human
cccagaaaccccaguccc

SEQ ID NO: 329390 - RNA, 20 nt, Human
ccccaacagacccugccugc

SEQ ID NO: 329391 - RNA, 18 nt, Human
ccccaauaaucacagaac

SEQ ID NO: 329392 - RNA, 19 nt, Human
ccccaauaaucacagaaca

SEQ ID NO: 329393 - RNA, 21 nt, Human
ccccacagacaaagcaaucua

SEQ ID NO: 329394 - RNA, 21 nt, Human
ccccaccccacagacaaagca

SEQ ID NO: 329395 - RNA, 18 nt, Human
ccccaccccaccccacag

SEQ ID NO: 329396 - RNA, 18 nt, Human
ccccaccccaccccacag

SEQ ID NO: 329397 - RNA, 19 nt, Human
ccccaccccaccccacaga

SEQ ID NO: 329398 - RNA, 19 nt, Human
ccccagaaaccccaguccc

SEQ ID NO: 329399 - RNA, 22 nt, Human
ccccagaaaccccagucccucu

SEQ ID NO: 329400 - RNA, 25 nt, Human
ccccagaggagccugucccucugcc

SEQ ID NO: 329401 - RNA, 21 nt, Human
ccccccaaaacauacuucccc

SEQ ID NO: 329402 - RNA, 21 nt, Human
ccccuucuccucccacagaaa

SEQ ID NO: 329403 - RNA, 23 nt, Human
cccgcaccagcggaggacaaggg

SEQ ID NO: 329404 - RNA, 19 nt, Human
cccuggggaggauggagag

SEQ ID NO: 329405 - RNA, 18 nt, Human
ccugagaaggcagaagag

SEQ ID NO: 329406 - RNA, 18 nt, Human
ccugccccccggcugcac

SEQ ID NO: 329407 - RNA, 21 nt, Human
ccugccugcccuucccugccc

SEQ ID NO: 329408 - RNA, 18 nt, Human
cgccggcucagggucgcg

SEQ ID NO: 329409 - RNA, 22 nt, Human
cgcuagcugcgucccggggcgc

SEQ ID NO: 329410 - RNA, 21 nt, Human
cgcucgucuaugccccgcaac

SEQ ID NO: 329411 - RNA, 19 nt, Human
cggcucagggucgcgcuag

SEQ ID NO: 329412 - RNA, 18 nt, Human
cuaggcccaaaagggugc

SEQ ID NO: 329413 - RNA, 22 nt, Human
cuuccccaccccaccccacaga

SEQ ID NO: 329414 - RNA, 21 nt, Human
gaaaugggaaaagccagcuug

SEQ ID NO: 329415 - RNA, 21 nt, Human
gaagagauggcuccagugugg

SEQ ID NO: 329416 - RNA, 27 nt, Human
gaaggggggcagagacaggggcagggc

SEQ ID NO: 329417 - RNA, 22 nt, Human
gacaauuaggucgggggaggaa

SEQ ID NO: 329418 - RNA, 23 nt, Human
gaccuuuggaggggcugggcuga

SEQ ID NO: 329419 - RNA, 22 nt, Human
gagcaagaggcuccugagggcu

SEQ ID NO: 329420 - RNA, 22 nt, Human
gaggauggagagugggcagccu

SEQ ID NO: 329421 - RNA, 19 nt, Human
gcagaagagagagccccau

SEQ ID NO: 329422 - RNA, 18 nt, Human
gcagguauaaaaggggag

SEQ ID NO: 329423 - RNA, 18 nt, Human
gccugcccuucccugccc

SEQ ID NO: 329424 - RNA, 18 nt, Human
gcuggggaaggggggcag

SEQ ID NO: 329425 - RNA, 26 nt, Human
ggaaaagccagcuuggaaguuuacag

SEQ ID NO: 329426 - RNA, 20 nt, Human
ggaauaaggauaaaaagaga

SEQ ID NO: 329427 - RNA, 19 nt, Human
ggacaaggguuccaguuuc

SEQ ID NO: 329428 - RNA, 22 nt, Human
ggacguacaugggcuggggugg

SEQ ID NO: 329429 - RNA, 23 nt, Human
ggagagcuacaggagggaggagg

SEQ ID NO: 329430 - RNA, 18 nt, Human
ggagccugucccucugcc

SEQ ID NO: 329431 - RNA, 18 nt, Human
ggcccagaggcucuggca

SEQ ID NO: 329432 - RNA, 21 nt, Human
gggaaggggggcagagacagg

SEQ ID NO: 329433 - RNA, 23 nt, Human
gggaaguaaagaagggguuucca

SEQ ID NO: 329434 - RNA, 19 nt, Human
gggaggauggagagugggc

SEQ ID NO: 329435 - RNA, 20 nt, Human
gggcccagaggcucuggcag

SEQ ID NO: 329436 - RNA, 22 nt, Human
gggcugaccuucccccaaaaag

SEQ ID NO: 329437 - RNA, 22 nt, Human
gggggcucagaagguucagggg

SEQ ID NO: 329438 - RNA, 21 nt, Human
ggggggcagagacaggggcag

SEQ ID NO: 329439 - RNA, 18 nt, Human
gggguggagcccccagcc

SEQ ID NO: 329440 - RNA, 27 nt, Human
ggugaugaagaagagauacaaaaggga

SEQ ID NO: 329441 - RNA, 20 nt, Human
guaaaucaacaagaccaaag

SEQ ID NO: 329442 - RNA, 23 nt, Human
uaaaacaguccugggagcuauga

SEQ ID NO: 329443 - RNA, 21 nt, Human
uaaaucaacaagaccaaagag

SEQ ID NO: 329444 - RNA, 22 nt, Human
uagaaaacauuauugcuggaga

SEQ ID NO: 329445 - RNA, 19 nt, Human
uagaagcaggggggcucag

SEQ ID NO: 329446 - RNA, 21 nt, Human
uagaagcaggggggcucagaa

SEQ ID NO: 329447 - RNA, 22 nt, Human
ucacagagcugcucccagcaca

SEQ ID NO: 329448 - RNA, 21 nt, Human
ucagaagguucagggguucac

SEQ ID NO: 329449 - RNA, 19 nt, Human
ucagaccuuuggaggggcu

SEQ ID NO: 329450 - RNA, 19 nt, Human
ucaguagaacaagagcagg

SEQ ID NO: 329451 - RNA, 23 nt, Human
uccaaauagcagcaguuuauaaa

SEQ ID NO: 329452 - RNA, 18 nt, Human
uccaggcacgccgucccg

SEQ ID NO: 329453 - RNA, 22 nt, Human
uccauggccccuuugguucucu

SEQ ID NO: 329454 - RNA, 18 nt, Human
ucccacagaaacagaaca

SEQ ID NO: 329455 - RNA, 19 nt, Human
ucccgcaccagcggaggac

SEQ ID NO: 329456 - RNA, 23 nt, Human
uccuugguaaagagcucuggggg

SEQ ID NO: 329457 - RNA, 22 nt, Human
ugaagugaaagagggggaguca

SEQ ID NO: 329458 - RNA, 26 nt, Human
ugaagugaaagagggggagucacaga

SEQ ID NO: 329459 - RNA, 23 nt, Human
ugaggaagagauggcuccagugu

SEQ ID NO: 329460 - RNA, 24 nt, Human
ugagggcuuacucagacaggaagc

SEQ ID NO: 329461 - RNA, 20 nt, Human
ugccccaaauccuaucaugc

SEQ ID NO: 329462 - RNA, 21 nt, Human
ugcuaagaaacaauaaaauac

SEQ ID NO: 329463 - RNA, 19 nt, Human
ugcuggcuggggaaggggg

SEQ ID NO: 329464 - RNA, 19 nt, Human
ugcuuccccaccccacccc

SEQ ID NO: 329465 - RNA, 25 nt, Human
ugcuuccccaccccaccccacagac

SEQ ID NO: 329466 - RNA, 23 nt, Human
uggaaguuuacagagaaaaaaua

SEQ ID NO: 329467 - RNA, 19 nt, Human
uggaccccagaaaccccag

SEQ ID NO: 329468 - RNA, 21 nt, Human
uggacugucaccauuagaccc

SEQ ID NO: 329469 - RNA, 23 nt, Human
uggagggagccggguguccccca

SEQ ID NO: 329470 - RNA, 22 nt, Human
uggccaggccaguucgugggga

SEQ ID NO: 329471 - RNA, 18 nt, Human
uggcuggggaaggggggc

SEQ ID NO: 329472 - RNA, 20 nt, Human
uggcuggggaaggggggcag

SEQ ID NO: 329473 - RNA, 24 nt, Human
uggcuggggaaggggggcagagac

SEQ ID NO: 329474 - RNA, 18 nt, Human
ugggaaaagccagcuugg

SEQ ID NO: 329475 - RNA, 19 nt, Human
ugggaaaagccagcuugga

SEQ ID NO: 329476 - RNA, 21 nt, Human
ugggaaaagccagcuuggaag

SEQ ID NO: 329477 - RNA, 21 nt, Human
ugggaaaagccagcuuggaag

SEQ ID NO: 329478 - RNA, 21 nt, Human
uggggaggauggagagugggc

SEQ ID NO: 329479 - RNA, 20 nt, Human
uggggaugcuggcuggggaa

SEQ ID NO: 329480 - RNA, 23 nt, Human
uggggugcuggccaggccaguuc

SEQ ID NO: 329481 - RNA, 20 nt, Human
ugugcuaagaaacaauaaaa

SEQ ID NO: 329482 - RNA, 25 nt, Human
uuccagacccccugagugccgaucc

SEQ ID NO: 329483 - RNA, 18 nt, Human
uugguucucugccuuugg

SEQ ID NO: 329484 - RNA, 18 nt, Human
uuuccaaauagcagcagu

SEQ ID NO: 329485 - RNA, 25 nt, Human
aaaaagcagcaccaagaaagggcau

SEQ ID NO: 329486 - RNA, 26 nt, Human
aaaaucucucugaucauuagcuacua

SEQ ID NO: 329487 - RNA, 24 nt, Human
aagaaugacagaaccaugagcacu

SEQ ID NO: 329488 - RNA, 21 nt, Human
aagcagcaccaagaaagggcc

SEQ ID NO: 329489 - RNA, 21 nt, Human
aauuucaggauggaauccugg

SEQ ID NO: 329490 - RNA, 22 nt, Human
acagcagaugaaccuccuacuu

SEQ ID NO: 329491 - RNA, 20 nt, Human
acagggcagcccgucccacu

SEQ ID NO: 329492 - RNA, 20 nt, Human
acuagaacacagacuaccca

SEQ ID NO: 329493 - RNA, 20 nt, Human
acucaccauacccccuuccc

SEQ ID NO: 329494 - RNA, 20 nt, Human
acuugcucuguccucccacc

SEQ ID NO: 329495 - RNA, 30 nt, Human
agacauuagaggcgcacagcagaugaaccu

SEQ ID NO: 329496 - RNA, 19 nt, Human
agcagaugaaccuccuacu

SEQ ID NO: 329497 - RNA, 21 nt, Human
aguuccauuuauucuucguac

SEQ ID NO: 329498 - RNA, 21 nt, Human
augagcacuccuaccaaaacu

SEQ ID NO: 329499 - RNA, 21 nt, Human
caaaacucagcucugcucagc

SEQ ID NO: 329500 - RNA, 18 nt, Human
caacuccuaacacauccc

SEQ ID NO: 329501 - RNA, 18 nt, Human
caagaaguacagcaaagg

SEQ ID NO: 329502 - RNA, 22 nt, Human
caagaaguacagcaaaggcuua

SEQ ID NO: 329503 - RNA, 25 nt, Human
caagaaugacagaaccaugagcacu

SEQ ID NO: 329504 - RNA, 23 nt, Human
caagcaaaccuuccuccuaugcc

SEQ ID NO: 329505 - RNA, 18 nt, Human
caaggaagcuggacuauc

SEQ ID NO: 329506 - RNA, 21 nt, Human
caauucaacccaacaggccaa

SEQ ID NO: 329507 - RNA, 23 nt, Human
cacaagcaaaccuuccuccuaug

SEQ ID NO: 329508 - RNA, 24 nt, Human
cagaaccaugagcacuccuaccaa

SEQ ID NO: 329509 - RNA, 24 nt, Human
cagcccgcccccuugguaggccca

SEQ ID NO: 329510 - RNA, 21 nt, Human
cagccucauuucacaagcaaa

SEQ ID NO: 329511 - RNA, 25 nt, Human
caggagagguccaagaaugacagaa

SEQ ID NO: 329512 - RNA, 20 nt, Human
caggauggaauccugggacc

SEQ ID NO: 329513 - RNA, 24 nt, Human
ccaccaacguuccugaauacagcc

SEQ ID NO: 329514 - RNA, 22 nt, Human
ccacccagccucauuucacaag

SEQ ID NO: 329515 - RNA, 27 nt, Human
ccagacacucuguagcaauuggcccuu

SEQ ID NO: 329516 - RNA, 25 nt, Human
ccccacgcguccgcccacgcguccg

SEQ ID NO: 329517 - RNA, 20 nt, Human
cccgcucccacccagccuca

SEQ ID NO: 329518 - RNA, 20 nt, Human
ccuaacacaucccauccaga

SEQ ID NO: 329519 - RNA, 23 nt, Human
ccuacguugaggcagcuccugaa

SEQ ID NO: 329520 - RNA, 19 nt, Human
ccuaugccacacacccaga

SEQ ID NO: 329521 - RNA, 23 nt, Human
ccuaugccacacacccagacacu

SEQ ID NO: 329522 - RNA, 23 nt, Human
ccuccuaugccacacacccagac

SEQ ID NO: 329523 - RNA, 22 nt, Human
cucacagggcagcccgucccac

SEQ ID NO: 329524 - RNA, 21 nt, Human
cucagagaugacacagcucau

SEQ ID NO: 329525 - RNA, 18 nt, Human
cugcucccucaucuuccu

SEQ ID NO: 329526 - RNA, 23 nt, Human
cuuaugguaacacugaaccuauu

SEQ ID NO: 329527 - RNA, 19 nt, Human
cuuauggucaucagcccgc

SEQ ID NO: 329528 - RNA, 21 nt, Human
gaaccuccuacuuacacugcc

SEQ ID NO: 329529 - RNA, 23 nt, Human
gagcgcccccacgcguccgccca

SEQ ID NO: 329530 - RNA, 24 nt, Human
gaucuagucccuccccgcucccac

SEQ ID NO: 329531 - RNA, 20 nt, Human
gcaccaagaaagggcaugau

SEQ ID NO: 329532 - RNA, 21 nt, Human
ggaaaggacagacauuacaga

SEQ ID NO: 329533 - RNA, 21 nt, Human
ggaugagggauugccgcacuc

SEQ ID NO: 329534 - RNA, 22 nt, Human
guugaggcagcuccugaaaggc

SEQ ID NO: 329535 - RNA, 22 nt, Human
uaaaaaaaaaaucucucugauc

SEQ ID NO: 329536 - RNA, 21 nt, Human
uacaaagaaaaauaaauuuca

SEQ ID NO: 329537 - RNA, 19 nt, Human
uaccaaaacucagcucugc

SEQ ID NO: 329538 - RNA, 21 nt, Human
uacccaaaaagcagcaccaag

SEQ ID NO: 329539 - RNA, 24 nt, Human
uacccaaaaagcagcaccaagaaa

SEQ ID NO: 329540 - RNA, 23 nt, Human
ucacaagcaaaccuuccuccuau

SEQ ID NO: 329541 - RNA, 25 nt, Human
ucagccaaaucaacaauucaaccca

SEQ ID NO: 329542 - RNA, 26 nt, Human
ucagccaaaucaacaauucaacccaa

SEQ ID NO: 329543 - RNA, 20 nt, Human
uccaagaaugacagaaccau

SEQ ID NO: 329544 - RNA, 20 nt, Human
uccuacuuacacugcccaag

SEQ ID NO: 329545 - RNA, 20 nt, Human
uccuccuaugccacacaccc

SEQ ID NO: 329546 - RNA, 23 nt, Human
ucuccccuagaaacauuucaaga

SEQ ID NO: 329547 - RNA, 22 nt, Human
ucuguagcuggauguacagccc

SEQ ID NO: 329548 - RNA, 28 nt, Human
ucuucguacaaauauuuuacaguuuuau

SEQ ID NO: 329549 - RNA, 25 nt, Human
ugaaccuccuacuuacacugcccaa

SEQ ID NO: 329550 - RNA, 19 nt, Human
ugccacacacccagacacu

SEQ ID NO: 329551 - RNA, 21 nt, Human
ugccacacacccagacacucu

SEQ ID NO: 329552 - RNA, 21 nt, Human
ugcucuguccucccaccaacg

SEQ ID NO: 329553 - RNA, 21 nt, Human
uggacacucacagggcagccc

SEQ ID NO: 329554 - RNA, 19 nt, Human
uggcaagauugcacuuucu

SEQ ID NO: 329555 - RNA, 24 nt, Human
ugguaggcccauuuggggagaggg

SEQ ID NO: 329556 - RNA, 23 nt, Human
uguagcuggauguacagcccuug

SEQ ID NO: 329557 - RNA, 19 nt, Human
uguaggaacuagaacacag

SEQ ID NO: 329558 - RNA, 19 nt, Human
uugcucuguccucccacca

SEQ ID NO: 329559 - RNA, 20 nt, Human
uugcucuguccucccaccaa

SEQ ID NO: 329560 - RNA, 19 nt, Human
uuucacaagcaaaccuucc

SEQ ID NO: 329561 - RNA, 23 nt, Human
aaagggccaggacagaacugaua

SEQ ID NO: 329562 - RNA, 19 nt, Human
aagagaaggugguggcagg

SEQ ID NO: 329563 - RNA, 20 nt, Human
acaguaaccacccucccaca

SEQ ID NO: 329564 - RNA, 18 nt, Human
agagaagagaagguggug

SEQ ID NO: 329565 - RNA, 23 nt, Human
agcagaaacuguggccaggucca

SEQ ID NO: 329566 - RNA, 22 nt, Human
agcuggccagcgccgaugaagc

SEQ ID NO: 329567 - RNA, 22 nt, Human
aggggccgggagggggcguggg

SEQ ID NO: 329568 - RNA, 18 nt, Human
agggggcgugggauccca

SEQ ID NO: 329569 - RNA, 21 nt, Human
aggugguggcaggaugguggg

SEQ ID NO: 329570 - RNA, 18 nt, Human
agucaggacacugggggc

SEQ ID NO: 329571 - RNA, 19 nt, Human
augaagcccacgcucaugc

SEQ ID NO: 329572 - RNA, 23 nt, Human
augaagcccacgcucaugcuguc

SEQ ID NO: 329573 - RNA, 25 nt, Human
caaggagcccuuuccccaaaugucc

SEQ ID NO: 329574 - RNA, 20 nt, Human
cacccacaguaaccacccuc

SEQ ID NO: 329575 - RNA, 22 nt, Human
caccccuguucugggcugggaa

SEQ ID NO: 329576 - RNA, 23 nt, Human
cagaugcccuccaagaugugggc

SEQ ID NO: 329577 - RNA, 25 nt, Human
cagcccaaggagcccuuuccccaaa

SEQ ID NO: 329578 - RNA, 18 nt, Human
cagcuucuucucaaugga

SEQ ID NO: 329579 - RNA, 18 nt, Human
ccaagaugugggcgggcc

SEQ ID NO: 329580 - RNA, 23 nt, Human
ccaggacagaacugauagcaccc

SEQ ID NO: 329581 - RNA, 18 nt, Human
ccaggaugaaggggauga

SEQ ID NO: 329582 - RNA, 19 nt, Human
cccaaggagcccuuucccc

SEQ ID NO: 329583 - RNA, 22 nt, Human
cccccaucuuccugagagcaga

SEQ ID NO: 329584 - RNA, 21 nt, Human
cccguccuccaccugggcgug

SEQ ID NO: 329585 - RNA, 21 nt, Human
ccuagugacaagagaagagaa

SEQ ID NO: 329586 - RNA, 19 nt, Human
ccuccaagaugugggcggg

SEQ ID NO: 329587 - RNA, 24 nt, Human
ccucccagggaggucaggagcagg

SEQ ID NO: 329588 - RNA, 18 nt, Human
ccucccguccuccaccug

SEQ ID NO: 329589 - RNA, 21 nt, Human
ccucccguccuccaccugggc

SEQ ID NO: 329590 - RNA, 22 nt, Human
ccucccguccuccaccugggcg

SEQ ID NO: 329591 - RNA, 24 nt, Human
ccuccucauguggcagacagaagu

SEQ ID NO: 329592 - RNA, 22 nt, Human
ccucuggcccuucucacacggg

SEQ ID NO: 329593 - RNA, 22 nt, Human
cgaaacgcugacagcuucuucu

SEQ ID NO: 329594 - RNA, 19 nt, Human
cuagugacaagagaagaga

SEQ ID NO: 329595 - RNA, 20 nt, Human
cucccugaauggagggcagg

SEQ ID NO: 329596 - RNA, 20 nt, Human
cucccuggcuaugucccugg

SEQ ID NO: 329597 - RNA, 19 nt, Human
cucuagaggaagguggucc

SEQ ID NO: 329598 - RNA, 21 nt, Human
cugacagcuucuucucaaugg

SEQ ID NO: 329599 - RNA, 30 nt, Human
cugagagcagaaacuguggccagguccauu

SEQ ID NO: 329600 - RNA, 20 nt, Human
cugauggugacgccggccgc

SEQ ID NO: 329601 - RNA, 21 nt, Human
cugcaccgucuccuuguugug

SEQ ID NO: 329602 - RNA, 21 nt, Human
cugcgcugaucagagccacag

SEQ ID NO: 329603 - RNA, 21 nt, Human
cuggccccugcgcugaucaga

SEQ ID NO: 329604 - RNA, 22 nt, Human
gaaacgcugacagcuucuucuc

SEQ ID NO: 329605 - RNA, 18 nt, Human
gaaacuguggccaggucc

SEQ ID NO: 329606 - RNA, 21 nt, Human
gaaggccuccacuauuccacc

SEQ ID NO: 329607 - RNA, 24 nt, Human
gaauggagggcagggaggggccgg

SEQ ID NO: 329608 - RNA, 20 nt, Human
gacaugguuugggagcagag

SEQ ID NO: 329609 - RNA, 18 nt, Human
gagguugagguuggggaa

SEQ ID NO: 329610 - RNA, 21 nt, Human
gaguaggagugggugaagacc

SEQ ID NO: 329611 - RNA, 20 nt, Human
gaucccaccucugcugagcc

SEQ ID NO: 329612 - RNA, 19 nt, Human
gcaggaggugguggccaca

SEQ ID NO: 329613 - RNA, 19 nt, Human
gcagggccucccuccucau

SEQ ID NO: 329614 - RNA, 22 nt, Human
gccagcgccgaugaagcccacg

SEQ ID NO: 329615 - RNA, 24 nt, Human
ggaagugauguggccccucccugg

SEQ ID NO: 329616 - RNA, 20 nt, Human
ggcagggaggggccgggagg

SEQ ID NO: 329617 - RNA, 21 nt, Human
gggaagcacuugcagaccaca

SEQ ID NO: 329618 - RNA, 19 nt, Human
gggaggggccgggaggggg

SEQ ID NO: 329619 - RNA, 23 nt, Human
gggcagggaggggccgggagggg

SEQ ID NO: 329620 - RNA, 20 nt, Human
gggcuguggcccuucacgcu

SEQ ID NO: 329621 - RNA, 24 nt, Human
guggcauacacgguggcccccucc

SEQ ID NO: 329622 - RNA, 20 nt, Human
gugguccugacaugguuugg

SEQ ID NO: 329623 - RNA, 25 nt, Human
ucaggagcaggaggugguggccaca

SEQ ID NO: 329624 - RNA, 20 nt, Human
ucaguugaaggccuccacua

SEQ ID NO: 329625 - RNA, 24 nt, Human
uccacccacaguaaccacccuccc

SEQ ID NO: 329626 - RNA, 19 nt, Human
uccaggaugaaggggauga

SEQ ID NO: 329627 - RNA, 19 nt, Human
ucccaccucugcugagccu

SEQ ID NO: 329628 - RNA, 22 nt, Human
uccccaaauguccaugggaucu

SEQ ID NO: 329629 - RNA, 24 nt, Human
uccccaaauguccaugggaucugc

SEQ ID NO: 329630 - RNA, 19 nt, Human
ucggcgccuauuucaucca

SEQ ID NO: 329631 - RNA, 20 nt, Human
ucuagaggaaggugguccug

SEQ ID NO: 329632 - RNA, 20 nt, Human
ucuuccugagagcagaaacu

SEQ ID NO: 329633 - RNA, 18 nt, Human
ucuugugggcagccaaga

SEQ ID NO: 329634 - RNA, 21 nt, Human
ugaaagccuuggccagggcaa

SEQ ID NO: 329635 - RNA, 18 nt, Human
uggccagggcaaaagcca

SEQ ID NO: 329636 - RNA, 18 nt, Human
uggccagggcaaaagcca

SEQ ID NO: 329637 - RNA, 19 nt, Human
ugggaucccaccucugcug

SEQ ID NO: 329638 - RNA, 19 nt, Human
ugggcugggaagcacuugc

SEQ ID NO: 329639 - RNA, 22 nt, Human
ugguggcaggaugguggucagg

SEQ ID NO: 329640 - RNA, 24 nt, Human
uguggcagacagaagucaggacac

SEQ ID NO: 329641 - RNA, 20 nt, Human
ugugucuguccucaaugucg

SEQ ID NO: 329642 - RNA, 21 nt, Human
uuacauugacauuuuaaucag

SEQ ID NO: 329643 - RNA, 23 nt, Human
uuccacccacaguaaccacccuc

SEQ ID NO: 329644 - RNA, 21 nt, Human
uuccagugggaagugaugugg

SEQ ID NO: 329645 - RNA, 22 nt, Human
aaaaaagggggaagaauccaaa

SEQ ID NO: 329646 - RNA, 18 nt, Human
aacgugaagaccuuuugg

SEQ ID NO: 329647 - RNA, 19 nt, Human
aacugggagacaagagcgg

SEQ ID NO: 329648 - RNA, 22 nt, Human
aagcagccauggguuuuccucg

SEQ ID NO: 329649 - RNA, 19 nt, Human
aagcugcaagcaucuggaa

SEQ ID NO: 329650 - RNA, 20 nt, Human
acaaguuuaacgugaagacc

SEQ ID NO: 329651 - RNA, 21 nt, Human
accuuuuggaaaauucccggg

SEQ ID NO: 329652 - RNA, 24 nt, Human
agaguugccccuuuucuaaaauuc

SEQ ID NO: 329653 - RNA, 22 nt, Human
caaaaggucaaucuucccagug

SEQ ID NO: 329654 - RNA, 22 nt, Human
caaauaaauacaaaaggucaau

SEQ ID NO: 329655 - RNA, 22 nt, Human
caacaggcagacccuaccaggg

SEQ ID NO: 329656 - RNA, 22 nt, Human
cacaaauaaauacaaaagguca

SEQ ID NO: 329657 - RNA, 24 nt, Human
caggaagcugcaagcaucuggaau

SEQ ID NO: 329658 - RNA, 20 nt, Human
cgauguggucacuaaccaag

SEQ ID NO: 329659 - RNA, 21 nt, Human
cuaguaccaacuaaaugcgaa

SEQ ID NO: 329660 - RNA, 24 nt, Human
cuuccucaccaccgccgccuucgc

SEQ ID NO: 329661 - RNA, 22 nt, Human
gacuuggcaaagucccuaucgg

SEQ ID NO: 329662 - RNA, 21 nt, Human
gccauggguuuuccucgccuu

SEQ ID NO: 329663 - RNA, 20 nt, Human
gcucaguggggaacauccug

SEQ ID NO: 329664 - RNA, 20 nt, Human
gugaagaccuuuuggaaaau

SEQ ID NO: 329665 - RNA, 19 nt, Human
uaaaugcgaagggggacug

SEQ ID NO: 329666 - RNA, 20 nt, Human
uaucuuccucaccaccgccg

SEQ ID NO: 329667 - RNA, 18 nt, Human
ucaaaaaagggggaagaa

SEQ ID NO: 329668 - RNA, 22 nt, Human
ucaaaaaagggggaagaaucca

SEQ ID NO: 329669 - RNA, 18 nt, Human
ucacgggggacacagcau

SEQ ID NO: 329670 - RNA, 21 nt, Human
uccaaaucuuuccuuuuugaa

SEQ ID NO: 329671 - RNA, 22 nt, Human
uccaaaucuuuccuuuuugaag

SEQ ID NO: 329672 - RNA, 20 nt, Human
ucccggguuuuccuggcucu

SEQ ID NO: 329673 - RNA, 26 nt, Human
uccugcugcagcuugggucgucgucg

SEQ ID NO: 329674 - RNA, 21 nt, Human
uccuggaugcaggaagcugca

SEQ ID NO: 329675 - RNA, 24 nt, Human
ucugaugagaaugcuaaaaagaag

SEQ ID NO: 329676 - RNA, 23 nt, Human
ugagaaugcuaaaaagaagaguu

SEQ ID NO: 329677 - RNA, 22 nt, Human
ugcuaaaaagaagaguugcccc

SEQ ID NO: 329678 - RNA, 22 nt, Human
ugcugcagcuuggguuccagcu

SEQ ID NO: 329679 - RNA, 27 nt, Human
uucaagcaucacugcuguagauauucc

SEQ ID NO: 329680 - RNA, 20 nt, Human
uucccggguuuuccuggcuc

SEQ ID NO: 329681 - RNA, 24 nt, Human
uuguuuuggaggaaaaggguagga

SEQ ID NO: 329682 - RNA, 23 nt, Human
uuuuuauggggaaaaugcaccuu

SEQ ID NO: 329683 - RNA, 21 nt, Human
aaaaagagccuccccgcagcc

SEQ ID NO: 329684 - RNA, 23 nt, Human
aaacaagaaaaggcuucagcuag

SEQ ID NO: 329685 - RNA, 21 nt, Human
aagaaaacaaaugcccgcugg

SEQ ID NO: 329686 - RNA, 22 nt, Human
aagaugugugcaaaguucuggg

SEQ ID NO: 329687 - RNA, 23 nt, Human
aagcugugucagccaacuucauc

SEQ ID NO: 329688 - RNA, 22 nt, Human
accaaggccucugagacagcag

SEQ ID NO: 329689 - RNA, 22 nt, Human
agacagcagacacaagcaccca

SEQ ID NO: 329690 - RNA, 21 nt, Human
agagauggaggaggaaagcgg

SEQ ID NO: 329691 - RNA, 21 nt, Human
agagccaggacagagggcagg

SEQ ID NO: 329692 - RNA, 30 nt, Human
agagccuccccgcagcccagauccagcauu

SEQ ID NO: 329693 - RNA, 19 nt, Human
agaggcucaacacuaaaga

SEQ ID NO: 329694 - RNA, 21 nt, Human
agagggcagggggcagggggc

SEQ ID NO: 329695 - RNA, 20 nt, Human
agaugugugcaaaguucugg

SEQ ID NO: 329696 - RNA, 19 nt, Human
agcacauuccuuccuuacc

SEQ ID NO: 329697 - RNA, 18 nt, Human
agccuguucccugcccuc

SEQ ID NO: 329698 - RNA, 19 nt, Human
agcgggagggcacagaccu

SEQ ID NO: 329699 - RNA, 21 nt, Human
aggaggugcaaagucagcaag

SEQ ID NO: 329700 - RNA, 23 nt, Human
aggcagguugccagccuugggga

SEQ ID NO: 329701 - RNA, 25 nt, Human
aggcuguagugcucuggugggcugu

SEQ ID NO: 329702 - RNA, 22 nt, Human
agggcacagaccugcccccugc

SEQ ID NO: 329703 - RNA, 23 nt, Human
agggggcagggggcugugaagga

SEQ ID NO: 329704 - RNA, 21 nt, Human
aggugcugaagcugcagggcu

SEQ ID NO: 329705 - RNA, 19 nt, Human
caacacuaaagacaucggc

SEQ ID NO: 329706 - RNA, 25 nt, Human
caagcacaaaagugaccaaguacaa

SEQ ID NO: 329707 - RNA, 19 nt, Human
caagcacccacacaaugcc

SEQ ID NO: 329708 - RNA, 20 nt, Human
caagcacccacacaaugccc

SEQ ID NO: 329709 - RNA, 25 nt, Human
caaugcccauuggauggcuacaaag

SEQ ID NO: 329710 - RNA, 21 nt, Human
cacaaauggguuccuccggga

SEQ ID NO: 329711 - RNA, 27 nt, Human
cacacaaugcccauuggauggcuacaa

SEQ ID NO: 329712 - RNA, 24 nt, Human
cacacgcgaacgccgggauggugc

SEQ ID NO: 329713 - RNA, 20 nt, Human
cacagcccagcacuugcccc

SEQ ID NO: 329714 - RNA, 19 nt, Human
caccaguggcuggcaaagu

SEQ ID NO: 329715 - RNA, 22 nt, Human
cacccccaccucccagugccag

SEQ ID NO: 329716 - RNA, 19 nt, Human
cacccugacccccauggcc

SEQ ID NO: 329717 - RNA, 21 nt, Human
caccgugcgcagauccuccug

SEQ ID NO: 329718 - RNA, 24 nt, Human
cagaaaaugggccuccucaagcac

SEQ ID NO: 329719 - RNA, 18 nt, Human
cagaccccagaauccaga

SEQ ID NO: 329720 - RNA, 20 nt, Human
cagaccccagaauccagagg

SEQ ID NO: 329721 - RNA, 20 nt, Human
cagcaagaaaacaaaugccc

SEQ ID NO: 329722 - RNA, 25 nt, Human
cagcaagaaaacaaaugcccgcugg

SEQ ID NO: 329723 - RNA, 24 nt, Human
caguggcuggcaaaguguuugggg

SEQ ID NO: 329724 - RNA, 22 nt, Human
ccaaccacagccacaaagguuu

SEQ ID NO: 329725 - RNA, 21 nt, Human
ccaccaguggcuggcaaagug

SEQ ID NO: 329726 - RNA, 19 nt, Human
ccacuggcccagaccccag

SEQ ID NO: 329727 - RNA, 25 nt, Human
ccagaggcucaacacuaaagacauc

SEQ ID NO: 329728 - RNA, 20 nt, Human
ccagccuuggggaggggcaa

SEQ ID NO: 329729 - RNA, 22 nt, Human
ccagugucccccucagucaucc

SEQ ID NO: 329730 - RNA, 22 nt, Human
cccagugccaggccugcugucc

SEQ ID NO: 329731 - RNA, 23 nt, Human
ccccagaauccagaggcucaaca

SEQ ID NO: 329732 - RNA, 23 nt, Human
ccccagaauccagaggcucaaca

SEQ ID NO: 329733 - RNA, 18 nt, Human
ccccauggccccuccugg

SEQ ID NO: 329734 - RNA, 19 nt, Human
ccccauggccccuccugga

SEQ ID NO: 329735 - RNA, 24 nt, Human
cccccugccaggcagaaaaugggc

SEQ ID NO: 329736 - RNA, 19 nt, Human
cccgcagcccagauccagc

SEQ ID NO: 329737 - RNA, 20 nt, Human
ccuccacagagccgcugccu

SEQ ID NO: 329738 - RNA, 18 nt, Human
ccuccucaagcacaaaag

SEQ ID NO: 329739 - RNA, 26 nt, Human
ccugacccccauggccccuccuggaa

SEQ ID NO: 329740 - RNA, 18 nt, Human
ccuuggggaggggcaagg

SEQ ID NO: 329741 - RNA, 24 nt, Human
cgggagggcacagaccugcccccu

SEQ ID NO: 329742 - RNA, 27 nt, Human
cucaaaaccacccugacccccauggcc

SEQ ID NO: 329743 - RNA, 19 nt, Human
cuccagugucccccucagu

SEQ ID NO: 329744 - RNA, 22 nt, Human
cuggcccuuguguguacaacag

SEQ ID NO: 329745 - RNA, 24 nt, Human
cuggcuuccuuuacaagaaacuag

SEQ ID NO: 329746 - RNA, 20 nt, Human
cuguagugcucuggugggcu

SEQ ID NO: 329747 - RNA, 22 nt, Human
gacagagggcagggggcagggg

SEQ ID NO: 329748 - RNA, 22 nt, Human
gaccaaggccucugagacagcc

SEQ ID NO: 329749 - RNA, 27 nt, Human
gaggcagguugccagccucccaagggg

SEQ ID NO: 329750 - RNA, 21 nt, Human
gagggcacagaccugcccccu

SEQ ID NO: 329751 - RNA, 21 nt, Human
gcacagugguggucagggugg

SEQ ID NO: 329752 - RNA, 23 nt, Human
gcagagcacaaauggguuccucc

SEQ ID NO: 329753 - RNA, 20 nt, Human
gcagagccaggacagagggc

SEQ ID NO: 329754 - RNA, 19 nt, Human
gccaaccacagccacaaag

SEQ ID NO: 329755 - RNA, 19 nt, Human
gccaggccugcuguccaag

SEQ ID NO: 329756 - RNA, 27 nt, Human
gcccagaccccagaauccagaggcucc

SEQ ID NO: 329757 - RNA, 21 nt, Human
ggacagagggcagggggcagg

SEQ ID NO: 329758 - RNA, 28 nt, Human
ggacagagggcagggggcagggggcugu

SEQ ID NO: 329759 - RNA, 18 nt, Human
ggaccaccaguggcuggc

SEQ ID NO: 329760 - RNA, 22 nt, Human
ggaccccugguccuuuuuccag

SEQ ID NO: 329761 - RNA, 21 nt, Human
ggaggaaaagagauggaggag

SEQ ID NO: 329762 - RNA, 18 nt, Human
ggcaaaguguuuggggaa

SEQ ID NO: 329763 - RNA, 19 nt, Human
ggcacagugguggucaggg

SEQ ID NO: 329764 - RNA, 20 nt, Human
ggcacagugguggucagggu

SEQ ID NO: 329765 - RNA, 22 nt, Human
ggcacuggaggccagggagaaa

SEQ ID NO: 329766 - RNA, 21 nt, Human
ggcaggaugacuggggcuaca

SEQ ID NO: 329767 - RNA, 18 nt, Human
ggccaggaggcagggcug

SEQ ID NO: 329768 - RNA, 19 nt, Human
ggccaggaggcagggcugg

SEQ ID NO: 329769 - RNA, 20 nt, Human
ggccaggaggcagggcuggg

SEQ ID NO: 329770 - RNA, 20 nt, Human
ggccagggagaaaaagagcc

SEQ ID NO: 329771 - RNA, 21 nt, Human
gggaaaaaaggaggugcaaag

SEQ ID NO: 329772 - RNA, 21 nt, Human
gggaggggcaaggcugugagg

SEQ ID NO: 329773 - RNA, 23 nt, Human
gggcacagugguggucagggugg

SEQ ID NO: 329774 - RNA, 21 nt, Human
gggcuacauggggcuuggccc

SEQ ID NO: 329775 - RNA, 24 nt, Human
ggggcugugaaggcgaugccuaga

SEQ ID NO: 329776 - RNA, 20 nt, Human
gguggggcaggugcugaagc

SEQ ID NO: 329777 - RNA, 21 nt, Human
guacaacaggaaaugcaccuc

SEQ ID NO: 329778 - RNA, 24 nt, Human
guugccagccuuggggaggggcaa

SEQ ID NO: 329779 - RNA, 21 nt, Human
uaauacauagcaagaugugug

SEQ ID NO: 329780 - RNA, 23 nt, Human
uaauacauagcaagaugugugca

SEQ ID NO: 329781 - RNA, 21 nt, Human
uacaacaggaaaugcaccuca

SEQ ID NO: 329782 - RNA, 21 nt, Human
ucaaaaccacccugaccccca

SEQ ID NO: 329783 - RNA, 21 nt, Human
ucaagcacaaaagugaccaag

SEQ ID NO: 329784 - RNA, 21 nt, Human
ucaguuuuuaucucacaaggc

SEQ ID NO: 329785 - RNA, 18 nt, Human
uccagugucccccucagu

SEQ ID NO: 329786 - RNA, 18 nt, Human
uccaugacccauauacca

SEQ ID NO: 329787 - RNA, 23 nt, Human
ucccagugccaggccugcugucc

SEQ ID NO: 329788 - RNA, 19 nt, Human
ucccggguuccaagcaccc

SEQ ID NO: 329789 - RNA, 21 nt, Human
ucccugcccucucucuugggc

SEQ ID NO: 329790 - RNA, 21 nt, Human
uccuccacagagccgcugccu

SEQ ID NO: 329791 - RNA, 22 nt, Human
uccugaccaaggccucugagac

SEQ ID NO: 329792 - RNA, 21 nt, Human
uccuuacccugcucucucaaa

SEQ ID NO: 329793 - RNA, 20 nt, Human
ucuagcacauuccuuccuua

SEQ ID NO: 329794 - RNA, 22 nt, Human
ucucucuugggcaaugggaggc

SEQ ID NO: 329795 - RNA, 21 nt, Human
ugaccaaggccucugagacag

SEQ ID NO: 329796 - RNA, 20 nt, Human
ugacccccauggccccuccu

SEQ ID NO: 329797 - RNA, 22 nt, Human
ugagacagcagacacaagcacc

SEQ ID NO: 329798 - RNA, 26 nt, Human
ugcaaaguucugggggagcccagcaa

SEQ ID NO: 329799 - RNA, 19 nt, Human
ugcagcugcucuggcgcgg

SEQ ID NO: 329800 - RNA, 20 nt, Human
ugccaggcagaaaaugggcc

SEQ ID NO: 329801 - RNA, 22 nt, Human
ugccaggcagaaaaugggccuc

SEQ ID NO: 329802 - RNA, 29 nt, Human
ugccaggcagaaaaugggccuccuucuuu

SEQ ID NO: 329803 - RNA, 22 nt, Human
ugccccacucaauaaaaggcug

SEQ ID NO: 329804 - RNA, 18 nt, Human
ugcccucucucuugggca

SEQ ID NO: 329805 - RNA, 23 nt, Human
ugcuagauuucucggcaauucca

SEQ ID NO: 329806 - RNA, 18 nt, Human
uggaggaggaaagcggcg

SEQ ID NO: 329807 - RNA, 21 nt, Human
uggccaggaggcagggcuggg

SEQ ID NO: 329808 - RNA, 19 nt, Human
uggcuggcaaaguguuugg

SEQ ID NO: 329809 - RNA, 20 nt, Human
uggcuuccuuuacaagaaac

SEQ ID NO: 329810 - RNA, 18 nt, Human
ugggaggcagguugccag

SEQ ID NO: 329811 - RNA, 18 nt, Human
uggggaggggcaaggcug

SEQ ID NO: 329812 - RNA, 21 nt, Human
uggggcuuggcccuucccugu

SEQ ID NO: 329813 - RNA, 21 nt, Human
uggguggggcaggugcugaag

SEQ ID NO: 329814 - RNA, 24 nt, Human
ugucagggcacgaccacagcccag

SEQ ID NO: 329815 - RNA, 19 nt, Human
uuccuuacccugcucucuc

SEQ ID NO: 329816 - RNA, 20 nt, Human
uuccuuccuuacccugcucu

SEQ ID NO: 329817 - RNA, 18 nt, Human
uuuuuuuuuuuuuuuuug

SEQ ID NO: 329818 - RNA, 22 nt, Human
uuuuuuuuuuuuuuuuugccaa

SEQ ID NO: 329819 - RNA, 21 nt, Human
caaguucaguaagaagcuaug

SEQ ID NO: 329820 - RNA, 21 nt, Human
gcggcgggcugcgcggcgggc

SEQ ID NO: 329821 - RNA, 25 nt, Human
ggggcggcgggcugcgcggcgggcu

SEQ ID NO: 329822 - RNA, 22 nt, Human
uauguuuucuagagacauugua

SEQ ID NO: 329823 - RNA, 18 nt, Human
aacuccaguaccccaccc

SEQ ID NO: 329824 - RNA, 18 nt, Human
aaggagcccugaagugac

SEQ ID NO: 329825 - RNA, 19 nt, Human
aaggagcccugaagugacc

SEQ ID NO: 329826 - RNA, 20 nt, Human
acagcccucacuccaccccc

SEQ ID NO: 329827 - RNA, 18 nt, Human
acauggucuucugucccu

SEQ ID NO: 329828 - RNA, 23 nt, Human
acuugggccgccaagacuggccu

SEQ ID NO: 329829 - RNA, 20 nt, Human
aggagaggggagggagaggu

SEQ ID NO: 329830 - RNA, 23 nt, Human
aggagcaggcagagugcuggauu

SEQ ID NO: 329831 - RNA, 19 nt, Human
agggaugcucagguuacug

SEQ ID NO: 329832 - RNA, 20 nt, Human
agggcaaggggaggagagga

SEQ ID NO: 329833 - RNA, 21 nt, Human
auuggggagcugucugucagu

SEQ ID NO: 329834 - RNA, 20 nt, Human
caaaaggaaccaggaccccc

SEQ ID NO: 329835 - RNA, 19 nt, Human
cacauggucuucugucccu

SEQ ID NO: 329836 - RNA, 24 nt, Human
cagcacgccccgccuccccugcaa

SEQ ID NO: 329837 - RNA, 19 nt, Human
cagggguggugugagggag

SEQ ID NO: 329838 - RNA, 22 nt, Human
caguaccccacccucugcauga

SEQ ID NO: 329839 - RNA, 22 nt, Human
ccaggccuugcacauggucuuc

SEQ ID NO: 329840 - RNA, 26 nt, Human
cccccugcaggcuguggugcaggagc

SEQ ID NO: 329841 - RNA, 27 nt, Human
cccccuguugcugucccucaaggagcc

SEQ ID NO: 329842 - RNA, 21 nt, Human
ccucacuccacccccaccgaa

SEQ ID NO: 329843 - RNA, 19 nt, Human
ccuccagccaaggagugga

SEQ ID NO: 329844 - RNA, 21 nt, Human
ccuccagccaaggaguggagc

SEQ ID NO: 329845 - RNA, 20 nt, Human
ccuccaggccuugcacaugg

SEQ ID NO: 329846 - RNA, 19 nt, Human
ccugaagugaccuuuugga

SEQ ID NO: 329847 - RNA, 23 nt, Human
ccugcagcacggggcccugggaa

SEQ ID NO: 329848 - RNA, 23 nt, Human
ccuggcuuguucacaggccugug

SEQ ID NO: 329849 - RNA, 20 nt, Human
cggaagaggugcaacuagca

SEQ ID NO: 329850 - RNA, 21 nt, Human
cucccccuguugcugucccuc

SEQ ID NO: 329851 - RNA, 18 nt, Human
cugacccacuuccuccag

SEQ ID NO: 329852 - RNA, 19 nt, Human
cugagcagcucuaggcucc

SEQ ID NO: 329853 - RNA, 20 nt, Human
gagggcaaggggaggagagg

SEQ ID NO: 329854 - RNA, 23 nt, Human
gaggugcuggggcuggcccaaga

SEQ ID NO: 329855 - RNA, 21 nt, Human
gcagcacgccccgccuccccu

SEQ ID NO: 329856 - RNA, 18 nt, Human
gcccucacuccaccccca

SEQ ID NO: 329857 - RNA, 22 nt, Human
ggacuggacugaugguagaggg

SEQ ID NO: 329858 - RNA, 21 nt, Human
ggaggagaggagaggggaggg

SEQ ID NO: 329859 - RNA, 23 nt, Human
ggaugucuuugagaaaggggccc

SEQ ID NO: 329860 - RNA, 20 nt, Human
ggcugcaggagggcgggccg

SEQ ID NO: 329861 - RNA, 21 nt, Human
gggagggucuuggccuggcag

SEQ ID NO: 329862 - RNA, 19 nt, Human
gguggugugagggagguug

SEQ ID NO: 329863 - RNA, 21 nt, Human
gugaggcagggccacagcccu

SEQ ID NO: 329864 - RNA, 18 nt, Human
guguuguggcaaaaggaa

SEQ ID NO: 329865 - RNA, 19 nt, Human
uagcagaggccacuggaug

SEQ ID NO: 329866 - RNA, 22 nt, Human
uccccugacggaagaggugcaa

SEQ ID NO: 329867 - RNA, 19 nt, Human
ucccuugucccugccuuuu

SEQ ID NO: 329868 - RNA, 20 nt, Human
ucugucaguggcugaaccag

SEQ ID NO: 329869 - RNA, 19 nt, Human
ucugucccuugucccugcc

SEQ ID NO: 329870 - RNA, 23 nt, Human
ucugucccuugucccugccuuuu

SEQ ID NO: 329871 - RNA, 21 nt, Human
ugaagugaccuuuuggagagg

SEQ ID NO: 329872 - RNA, 20 nt, Human
ugagaaaggggcccacgacc

SEQ ID NO: 329873 - RNA, 28 nt, Human
ugagcagcucuaggcucccccuguugcu

SEQ ID NO: 329874 - RNA, 22 nt, Human
ugaggcagggccacagcccuca

SEQ ID NO: 329875 - RNA, 24 nt, Human
ugaggcagggccacagcccucacu

SEQ ID NO: 329876 - RNA, 18 nt, Human
ugcaugaggugcuggggc

SEQ ID NO: 329877 - RNA, 20 nt, Human
uggcagcucagggagcuauu

SEQ ID NO: 329878 - RNA, 21 nt, Human
uggccuggcagcucagggagc

SEQ ID NO: 329879 - RNA, 21 nt, Human
uggccuggcuuguucacaggc

SEQ ID NO: 329880 - RNA, 23 nt, Human
uggcgggaggccgcuagccugca

SEQ ID NO: 329881 - RNA, 20 nt, Human
uggcucugggcagcacgccc

SEQ ID NO: 329882 - RNA, 20 nt, Human
uggcucugggcagcacgccc

SEQ ID NO: 329883 - RNA, 21 nt, Human
uggcucugggcagcacgcccc

SEQ ID NO: 329884 - RNA, 23 nt, Human
ugggagaaacugaggcauucccc

SEQ ID NO: 329885 - RNA, 21 nt, Human
ugggagggucuuggccuggca

SEQ ID NO: 329886 - RNA, 19 nt, Human
uggggcuggcccaagagag

SEQ ID NO: 329887 - RNA, 23 nt, Human
ugguuuggggucuggucuggagg

SEQ ID NO: 329888 - RNA, 23 nt, Human
uuguggcaaaaggaaccaggacc

SEQ ID NO: 329889 - RNA, 25 nt, Human
uuuggaggguuggauacaagaagga

SEQ ID NO: 329890 - RNA, 21 nt, Human
aaaaacacucccccaggggcc

SEQ ID NO: 329891 - RNA, 20 nt, Human
aaaaagacaaauaaagccca

SEQ ID NO: 329892 - RNA, 23 nt, Human
aaagacccccaccaccaccgcau

SEQ ID NO: 329893 - RNA, 19 nt, Human
aaagccaguggaaacaagg

SEQ ID NO: 329894 - RNA, 24 nt, Human
aaagccaguggaaacaaggaccaa

SEQ ID NO: 329895 - RNA, 21 nt, Human
aacaaacacaagaguugagca

SEQ ID NO: 329896 - RNA, 18 nt, Human
aacacaaaaacagcaaca

SEQ ID NO: 329897 - RNA, 22 nt, Human
aacaccccugcccuccggaucu

SEQ ID NO: 329898 - RNA, 21 nt, Human
aacagaacaacaaacacaaga

SEQ ID NO: 329899 - RNA, 20 nt, Human
aacuccaggcucuucuaccu

SEQ ID NO: 329900 - RNA, 19 nt, Human
aaggaccaagagccaaaca

SEQ ID NO: 329901 - RNA, 20 nt, Human
aaggaccaagagccaaacau

SEQ ID NO: 329902 - RNA, 23 nt, Human
aauccccauuuauucccuaaagc

SEQ ID NO: 329903 - RNA, 21 nt, Human
aauuccucuggccagaaaccu

SEQ ID NO: 329904 - RNA, 20 nt, Human
acaacacaaaaacagcaaca

SEQ ID NO: 329905 - RNA, 21 nt, Human
acagaacaacaaacacaagag

SEQ ID NO: 329906 - RNA, 19 nt, Human
acaguacaaaagaccccca

SEQ ID NO: 329907 - RNA, 22 nt, Human
acaucaaaaaaaucacccugga

SEQ ID NO: 329908 - RNA, 21 nt, Human
accaccaccgcauucugccau

SEQ ID NO: 329909 - RNA, 18 nt, Human
accacuaggucuuugcca

SEQ ID NO: 329910 - RNA, 22 nt, Human
accaucgcccagaagggguguc

SEQ ID NO: 329911 - RNA, 21 nt, Human
acuguuucugccccaugggga

SEQ ID NO: 329912 - RNA, 19 nt, Human
agaacaacaaacacaagag

SEQ ID NO: 329913 - RNA, 19 nt, Human
agagccaaacaucaaaaaa

SEQ ID NO: 329914 - RNA, 24 nt, Human
agcacgagagaggcugagaaagga

SEQ ID NO: 329915 - RNA, 20 nt, Human
agcagggucuucucuccuca

SEQ ID NO: 329916 - RNA, 23 nt, Human
agggagcagauccagcaaaaaca

SEQ ID NO: 329917 - RNA, 19 nt, Human
agggccacaccccaugccu

SEQ ID NO: 329918 - RNA, 20 nt, Human
agggguguuaggcacaggug

SEQ ID NO: 329919 - RNA, 19 nt, Human
aggguaccaccaaagucca

SEQ ID NO: 329920 - RNA, 21 nt, Human
aucaccaggcccaagaggaua

SEQ ID NO: 329921 - RNA, 25 nt, Human
aucuuccuccagccccuuuucucuu

SEQ ID NO: 329922 - RNA, 21 nt, Human
augaaagaauagcaaagagaa

SEQ ID NO: 329923 - RNA, 27 nt, Human
auggaaagccaguggaaacaaggacca

SEQ ID NO: 329924 - RNA, 25 nt, Human
auggcaaugaggaucccgccgcauc

SEQ ID NO: 329925 - RNA, 19 nt, Human
caaaaaaaucacccuggaa

SEQ ID NO: 329926 - RNA, 22 nt, Human
caaaaacacucccccaggggcc

SEQ ID NO: 329927 - RNA, 20 nt, Human
caacacaaaaacagcaacag

SEQ ID NO: 329928 - RNA, 21 nt, Human
caagaaacugccauaaccagg

SEQ ID NO: 329929 - RNA, 25 nt, Human
caagagccaaacaucaaaaaaauca

SEQ ID NO: 329930 - RNA, 19 nt, Human
caagccaggaaggcagggg

SEQ ID NO: 329931 - RNA, 22 nt, Human
caauuccucuggccagaaaccu

SEQ ID NO: 329932 - RNA, 19 nt, Human
caccaccaccgcauucugc

SEQ ID NO: 329933 - RNA, 20 nt, Human
cacccuggaagagcagggag

SEQ ID NO: 329934 - RNA, 25 nt, Human
cacuuuguuccaaaaaguaguggag

SEQ ID NO: 329935 - RNA, 19 nt, Human
cagaaggggugucaggggc

SEQ ID NO: 329936 - RNA, 18 nt, Human
cagcaaaaacacuccccc

SEQ ID NO: 329937 - RNA, 23 nt, Human
cagcaucucucaccuacugucuu

SEQ ID NO: 329938 - RNA, 18 nt, Human
cagccacacuccugggcc

SEQ ID NO: 329939 - RNA, 23 nt, Human
cagccacacuccugggccuccag

SEQ ID NO: 329940 - RNA, 28 nt, Human
cagcccaggcccccgagcugcagcaacc

SEQ ID NO: 329941 - RNA, 23 nt, Human
cagccccuuuucucuugcagcca

SEQ ID NO: 329942 - RNA, 21 nt, Human
cagcggcgggggauggaggcc

SEQ ID NO: 329943 - RNA, 24 nt, Human
caggagccacuguuucugccccau

SEQ ID NO: 329944 - RNA, 28 nt, Human
caugccugccuuccccaccccauggagg

SEQ ID NO: 329945 - RNA, 26 nt, Human
ccaaacaucaaaaaaaucacccugga

SEQ ID NO: 329946 - RNA, 25 nt, Human
ccaagagccaaacaucaaaaaaauc

SEQ ID NO: 329947 - RNA, 23 nt, Human
ccacaccccaugccugccuuccc

SEQ ID NO: 329948 - RNA, 22 nt, Human
ccacacuccugggccuccagaa

SEQ ID NO: 329949 - RNA, 25 nt, Human
ccacaggcugugacagggccucacu

SEQ ID NO: 329950 - RNA, 20 nt, Human
ccacuaggucuuugccacug

SEQ ID NO: 329951 - RNA, 22 nt, Human
ccacuguaucuugagcuggggg

SEQ ID NO: 329952 - RNA, 21 nt, Human
ccagaaggggugucaggggca

SEQ ID NO: 329953 - RNA, 19 nt, Human
ccaggaaggcaggggaaua

SEQ ID NO: 329954 - RNA, 22 nt, Human
cccaccaccaccgcauucugcc

SEQ ID NO: 329955 - RNA, 20 nt, Human
cccagaggcugcucuccucc

SEQ ID NO: 329956 - RNA, 24 nt, Human
cccaggagccacuguuucugcccc

SEQ ID NO: 329957 - RNA, 23 nt, Human
ccccaaaucaccaagaaacugcc

SEQ ID NO: 329958 - RNA, 23 nt, Human
ccccuacccacaggcugugacag

SEQ ID NO: 329959 - RNA, 21 nt, Human
ccuaaagcugucucccagagc

SEQ ID NO: 329960 - RNA, 23 nt, Human
ccuaacuucuccgagggccacac

SEQ ID NO: 329961 - RNA, 22 nt, Human
ccucaucaggccccaggcccau

SEQ ID NO: 329962 - RNA, 29 nt, Human
ccuccagccccuuuucucuuggggccgcc

SEQ ID NO: 329963 - RNA, 18 nt, Human
ccugcccaccucaauucc

SEQ ID NO: 329964 - RNA, 22 nt, Human
ccuuugaguaccauggcaauga

SEQ ID NO: 329965 - RNA, 21 nt, Human
cgagagggagcagauccagca

SEQ ID NO: 329966 - RNA, 21 nt, Human
cgagggccacaccccaugccu

SEQ ID NO: 329967 - RNA, 20 nt, Human
cggggugggggugggggguu

SEQ ID NO: 329968 - RNA, 22 nt, Human
cucaaagguugucagcuccacc

SEQ ID NO: 329969 - RNA, 24 nt, Human
cucccagagcccauaaaagggcua

SEQ ID NO: 329970 - RNA, 19 nt, Human
cucuccucccagccucaaa

SEQ ID NO: 329971 - RNA, 22 nt, Human
cugcaccaucgcccagaagggg

SEQ ID NO: 329972 - RNA, 19 nt, Human
cuucugccugcccaccuca

SEQ ID NO: 329973 - RNA, 20 nt, Human
gaaaaggagaacgagcagcg

SEQ ID NO: 329974 - RNA, 19 nt, Human
gaaagaauagcaaagagaa

SEQ ID NO: 329975 - RNA, 20 nt, Human
gagcagcggggugggggugg

SEQ ID NO: 329976 - RNA, 24 nt, Human
gaggaagcaaaggaguggguagaa

SEQ ID NO: 329977 - RNA, 21 nt, Human
gaggcugagaaaggaccagug

SEQ ID NO: 329978 - RNA, 27 nt, Human
gaguugagcagcggggugggggugggg

SEQ ID NO: 329979 - RNA, 18 nt, Human
gcaaagagaagcaacaaa

SEQ ID NO: 329980 - RNA, 19 nt, Human
gcagccacacuccugggcc

SEQ ID NO: 329981 - RNA, 22 nt, Human
gcagcggggugggggugggggg

SEQ ID NO: 329982 - RNA, 20 nt, Human
gccacacuccugggccucca

SEQ ID NO: 329983 - RNA, 23 nt, Human
gcccaagaggauaugaaagaaua

SEQ ID NO: 329984 - RNA, 22 nt, Human
gcucccaggagccacuguuucu

SEQ ID NO: 329985 - RNA, 19 nt, Human
gcugcaccaucgcccagaa

SEQ ID NO: 329986 - RNA, 19 nt, Human
ggaaaauccccauuuauuc

SEQ ID NO: 329987 - RNA, 22 nt, Human
ggaaagccaguggaaacaagga

SEQ ID NO: 329988 - RNA, 24 nt, Human
ggaaggaguuggguaagucuugga

SEQ ID NO: 329989 - RNA, 22 nt, Human
ggaaugugugcaugaacagaaa

SEQ ID NO: 329990 - RNA, 25 nt, Human
ggaccaagagccaaacaucaaaaaa

SEQ ID NO: 329991 - RNA, 19 nt, Human
ggaggaaaugagguauagg

SEQ ID NO: 329992 - RNA, 23 nt, Human
ggaucccgccgcauccccuaccc

SEQ ID NO: 329993 - RNA, 23 nt, Human
ggaucuuccuccagccccuuuuc

SEQ ID NO: 329994 - RNA, 21 nt, Human
gggcauccaucaucagcagag

SEQ ID NO: 329995 - RNA, 19 nt, Human
gggcugcaccaucgcccag

SEQ ID NO: 329996 - RNA, 18 nt, Human
gggcugggggaggagggu

SEQ ID NO: 329997 - RNA, 18 nt, Human
ggggauggaaagccagug

SEQ ID NO: 329998 - RNA, 20 nt, Human
gggggauggaggcgcccuug

SEQ ID NO: 329999 - RNA, 20 nt, Human
ggggguaggggaccacuagg

SEQ ID NO: 330000 - RNA, 19 nt, Human
ggggugggggugggggguu

SEQ ID NO: 330001 - RNA, 18 nt, Human
ggguaccaccaaagucca

SEQ ID NO: 330002 - RNA, 24 nt, Human
gggucuucucuccucaugccagga

SEQ ID NO: 330003 - RNA, 18 nt, Human
gguaccaccaaaguccag

SEQ ID NO: 330004 - RNA, 22 nt, Human
guacaaaagacccccaccacca

SEQ ID NO: 330005 - RNA, 19 nt, Human
gugggggguugccaucuac

SEQ ID NO: 330006 - RNA, 24 nt, Human
guugagcagcgggguggggguggg

SEQ ID NO: 330007 - RNA, 25 nt, Human
guugagcagcggggugggggugggg

SEQ ID NO: 330008 - RNA, 20 nt, Human
uaaaaaauaaaaaaagacaa

SEQ ID NO: 330009 - RNA, 20 nt, Human
uaacacuugacuccaaaaac

SEQ ID NO: 330010 - RNA, 22 nt, Human
uaacuucuccgagggccacacc

SEQ ID NO: 330011 - RNA, 22 nt, Human
uacccacaggcugugacagggc

SEQ ID NO: 330012 - RNA, 18 nt, Human
uagcaaagagaagcaaca

SEQ ID NO: 330013 - RNA, 21 nt, Human
uagcaaagagaagcaacaaac

SEQ ID NO: 330014 - RNA, 20 nt, Human
uagcggcagcggcgggggau

SEQ ID NO: 330015 - RNA, 24 nt, Human
uagcggcagcggcgggggauggag

SEQ ID NO: 330016 - RNA, 20 nt, Human
uagugugagggacacuggga

SEQ ID NO: 330017 - RNA, 22 nt, Human
uagugugagggacacugggaac

SEQ ID NO: 330018 - RNA, 22 nt, Human
uaucuugagcugggggacuccu

SEQ ID NO: 330019 - RNA, 24 nt, Human
ucaccaagaaacugccauaaccag

SEQ ID NO: 330020 - RNA, 18 nt, Human
ucaggggcagcccaggcc

SEQ ID NO: 330021 - RNA, 18 nt, Human
ucauggaggaaaugaggu

SEQ ID NO: 330022 - RNA, 19 nt, Human
uccaaaaacuaaggcugga

SEQ ID NO: 330023 - RNA, 23 nt, Human
ucccaggagccacuguuucugcc

SEQ ID NO: 330024 - RNA, 21 nt, Human
uccuggaucucuguagaucuc

SEQ ID NO: 330025 - RNA, 22 nt, Human
uccugggccuccagaaauagcc

SEQ ID NO: 330026 - RNA, 23 nt, Human
ucuccgagggccacaccccaugc

SEQ ID NO: 330027 - RNA, 21 nt, Human
ucucugagggggaaggaguug

SEQ ID NO: 330028 - RNA, 24 nt, Human
ucuuccuccagccccuuuucucuu

SEQ ID NO: 330029 - RNA, 21 nt, Human
ucuugcagccacacuccuggg

SEQ ID NO: 330030 - RNA, 22 nt, Human
ugaagccccaaaucaccaagaa

SEQ ID NO: 330031 - RNA, 19 nt, Human
ugagagagcgagagggagc

SEQ ID NO: 330032 - RNA, 22 nt, Human
ugagcagcgggguggggguggg

SEQ ID NO: 330033 - RNA, 18 nt, Human
ugagggggaaggaguugg

SEQ ID NO: 330034 - RNA, 21 nt, Human
ugagguauagggcucugcgcc

SEQ ID NO: 330035 - RNA, 20 nt, Human
ugcaccaucgcccagaaggg

SEQ ID NO: 330036 - RNA, 18 nt, Human
ugcagccacacuccuggg

SEQ ID NO: 330037 - RNA, 19 nt, Human
ugccauaaccaggaacucu

SEQ ID NO: 330038 - RNA, 18 nt, Human
ugccaucacuuuguucca

SEQ ID NO: 330039 - RNA, 18 nt, Human
ugcccuccggaucuuccu

SEQ ID NO: 330040 - RNA, 19 nt, Human
ugcccuccggaucuuccuc

SEQ ID NO: 330041 - RNA, 24 nt, Human
uggcaagaccccaauuccucuggc

SEQ ID NO: 330042 - RNA, 21 nt, Human
uggcaggcagugcuuaaaaaa

SEQ ID NO: 330043 - RNA, 23 nt, Human
ugggggaggaggguaccaccaaa

SEQ ID NO: 330044 - RNA, 21 nt, Human
uggguagaaaaaggggaaaau

SEQ ID NO: 330045 - RNA, 19 nt, Human
ugguaugaagaagauacgu

SEQ ID NO: 330046 - RNA, 20 nt, Human
uugaagccccaaaucaccaa

SEQ ID NO: 330047 - RNA, 21 nt, Human
uugacuccaaaaacuaaggcu

SEQ ID NO: 330048 - RNA, 21 nt, Human
agugucuauuuuauagagaca

SEQ ID NO: 330049 - RNA, 25 nt, Human
ccagaaguacauauuuauucagcaa

SEQ ID NO: 330050 - RNA, 19 nt, Human
uuugaccagaaguacauau

SEQ ID NO: 330051 - RNA, 21 nt, Human
gaauuugggguggcgagggua

SEQ ID NO: 330052 - RNA, 19 nt, Human
uagccacacccuccaggag

SEQ ID NO: 330053 - RNA, 24 nt, Human
uagcuguucuuuauugacauggaa

SEQ ID NO: 330054 - RNA, 19 nt, Human
uggaauuugggguggcgag

SEQ ID NO: 330055 - RNA, 20 nt, Human
aaaaauaacucagccuuuaa

SEQ ID NO: 330056 - RNA, 20 nt, Human
aagaagacagacaacaagug

SEQ ID NO: 330057 - RNA, 20 nt, Human
acacaggaaaaggauaccag

SEQ ID NO: 330058 - RNA, 19 nt, Human
acagggguuacagaaaaca

SEQ ID NO: 330059 - RNA, 18 nt, Human
accuaggccagaccacag

SEQ ID NO: 330060 - RNA, 18 nt, Human
agcuccgaaucgaacccu

SEQ ID NO: 330061 - RNA, 22 nt, Human
aggccagaccacaggcacaggg

SEQ ID NO: 330062 - RNA, 19 nt, Human
caaaaauaacucagccuuu

SEQ ID NO: 330063 - RNA, 21 nt, Human
caacaagugcauuuauuagga

SEQ ID NO: 330064 - RNA, 18 nt, Human
caaccacacaggaaaagg

SEQ ID NO: 330065 - RNA, 24 nt, Human
caaggacagaugaacagucacaaa

SEQ ID NO: 330066 - RNA, 23 nt, Human
caauaccaacaaaucaacaaagu

SEQ ID NO: 330067 - RNA, 19 nt, Human
cacaaaaggaguuaaggca

SEQ ID NO: 330068 - RNA, 26 nt, Human
cacacaggaaaaggauaccagggacu

SEQ ID NO: 330069 - RNA, 20 nt, Human
cagaccacaggcacaggggc

SEQ ID NO: 330070 - RNA, 25 nt, Human
cagaccacaggcacaggggcaacca

SEQ ID NO: 330071 - RNA, 22 nt, Human
cagccuuuaaaauguccccaau

SEQ ID NO: 330072 - RNA, 21 nt, Human
caggauuuaaauccacccccu

SEQ ID NO: 330073 - RNA, 29 nt, Human
ccaauaccaacaaaucaacaaaguaguca

SEQ ID NO: 330074 - RNA, 18 nt, Human
ccacaaaaggaguuaagg

SEQ ID NO: 330075 - RNA, 19 nt, Human
ccagcccggcucccgcagc

SEQ ID NO: 330076 - RNA, 22 nt, Human
ccccaauaccaacaaaucaaca

SEQ ID NO: 330077 - RNA, 20 nt, Human
ccccucauaggcacugagau

SEQ ID NO: 330078 - RNA, 21 nt, Human
cuuauaccacaaaaggaguua

SEQ ID NO: 330079 - RNA, 24 nt, Human
gauaccagggacagaguccaugua

SEQ ID NO: 330080 - RNA, 30 nt, Human
ggcacaggggcaaccacacaggaaaaggaa

SEQ ID NO: 330081 - RNA, 20 nt, Human
uaaaauguccccaauaccaa

SEQ ID NO: 330082 - RNA, 23 nt, Human
uaaaauguccccaauaccaacaa

SEQ ID NO: 330083 - RNA, 19 nt, Human
uacagaaaacacaaggcug

SEQ ID NO: 330084 - RNA, 23 nt, Human
uaccacaaaaggaguuaaggcag

SEQ ID NO: 330085 - RNA, 20 nt, Human
uaccacaaacagggguuaca

SEQ ID NO: 330086 - RNA, 22 nt, Human
uagugacuuuucuggcaggccc

SEQ ID NO: 330087 - RNA, 24 nt, Human
uauuacacuugucccuaggagagc

SEQ ID NO: 330088 - RNA, 25 nt, Human
uauuaggaacaacauucugaauaac

SEQ ID NO: 330089 - RNA, 20 nt, Human
ucccuaggagagcaaaugca

SEQ ID NO: 330090 - RNA, 20 nt, Human
ucgcauugucuuacuucaca

SEQ ID NO: 330091 - RNA, 21 nt, Human
ucuaguauacucaucucugac

SEQ ID NO: 330092 - RNA, 23 nt, Human
ucuuacuucacauaaauguauua

SEQ ID NO: 330093 - RNA, 18 nt, Human
ugccagcccggcucccgc

SEQ ID NO: 330094 - RNA, 22 nt, Human
ugcuguauauaagaugugauuu

SEQ ID NO: 330095 - RNA, 20 nt, Human
uucacauaaauguauuacac

SEQ ID NO: 330096 - RNA, 24 nt, Human
uuuaaaauguccccaauaccaaca

SEQ ID NO: 330097 - RNA, 27 nt, Human
aaaaauuaaugagcaauuuaggacaca

SEQ ID NO: 330098 - RNA, 20 nt, Human
aaagaaaucugaccgccuuc

SEQ ID NO: 330099 - RNA, 21 nt, Human
aagacacauaagaauaggaug

SEQ ID NO: 330100 - RNA, 24 nt, Human
cacacagcauuugucugaaaucag

SEQ ID NO: 330101 - RNA, 20 nt, Human
cacauaagaauaggaugauc

SEQ ID NO: 330102 - RNA, 20 nt, Human
cggugccucuuuuucaaucu

SEQ ID NO: 330103 - RNA, 18 nt, Human
cgugaugaugauccuugg

SEQ ID NO: 330104 - RNA, 24 nt, Human
guauuacauguaauagauuuccac

SEQ ID NO: 330105 - RNA, 21 nt, Human
uacauguaauagauuuccaca

SEQ ID NO: 330106 - RNA, 21 nt, Human
uccaaccgcuauuuaaguacu

SEQ ID NO: 330107 - RNA, 20 nt, Human
ugaccgccuucaaacuacau

SEQ ID NO: 330108 - RNA, 19 nt, Human
ugccuugacuuuugaauuc

SEQ ID NO: 330109 - RNA, 22 nt, Human
uuauuuugccauuuucuuuaca

SEQ ID NO: 330110 - RNA, 21 nt, Human
uuuuuuagcauuuaauucuga

SEQ ID NO: 330111 - RNA, 19 nt, Human
aaaaagugccccccucucu

SEQ ID NO: 330112 - RNA, 18 nt, Human
aaaacacaaaagugacac

SEQ ID NO: 330113 - RNA, 26 nt, Human
aaacaaaauuuacucaacuacauaaa

SEQ ID NO: 330114 - RNA, 21 nt, Human
aaacaauaacugaggaaucca

SEQ ID NO: 330115 - RNA, 22 nt, Human
aaagugccccccucucuaauca

SEQ ID NO: 330116 - RNA, 23 nt, Human
aaauuuacucaacuacauaaacc

SEQ ID NO: 330117 - RNA, 19 nt, Human
aacaauaacugaggaaucc

SEQ ID NO: 330118 - RNA, 20 nt, Human
aacacaaaagugacacaaga

SEQ ID NO: 330119 - RNA, 20 nt, Human
aacagaggcacccgagaugg

SEQ ID NO: 330120 - RNA, 18 nt, Human
aacccgagcgccgagcuu

SEQ ID NO: 330121 - RNA, 23 nt, Human
aacccgagcgccgagcuucaacc

SEQ ID NO: 330122 - RNA, 26 nt, Human
aagaaaaccaaaaugacuggugggca

SEQ ID NO: 330123 - RNA, 21 nt, Human
aagcugcucuguggcaaaaug

SEQ ID NO: 330124 - RNA, 25 nt, Human
aauaauaaaauggcuauagaagaaa

SEQ ID NO: 330125 - RNA, 25 nt, Human
acacaacuuccaggaaacugcagag

SEQ ID NO: 330126 - RNA, 18 nt, Human
acauacugaaaccaaaga

SEQ ID NO: 330127 - RNA, 27 nt, Human
agaauucuccagaaaaagugccccccc

SEQ ID NO: 330128 - RNA, 21 nt, Human
agacaaaauuugacacuacca

SEQ ID NO: 330129 - RNA, 23 nt, Human
aggcagcacuguuuaacuuaugg

SEQ ID NO: 330130 - RNA, 25 nt, Human
agugguaucugugggaccagggggc

SEQ ID NO: 330131 - RNA, 19 nt, Human
auacuaaaagaauacaugc

SEQ ID NO: 330132 - RNA, 21 nt, Human
auccacgagaaagcaaaacua

SEQ ID NO: 330133 - RNA, 19 nt, Human
caaauuacagagcaugcau

SEQ ID NO: 330134 - RNA, 23 nt, Human
cacaagaauuacaaauauauuua

SEQ ID NO: 330135 - RNA, 22 nt, Human
cacacaucaugagcaccgcaag

SEQ ID NO: 330136 - RNA, 19 nt, Human
cacccgagauggaauacca

SEQ ID NO: 330137 - RNA, 24 nt, Human
cagaauaauggaaaauuuucaagc

SEQ ID NO: 330138 - RNA, 21 nt, Human
cagagcaugcauaaaauacaa

SEQ ID NO: 330139 - RNA, 21 nt, Human
cagcagugguaucugugggac

SEQ ID NO: 330140 - RNA, 22 nt, Human
caugagcaccgcaagagacaaa

SEQ ID NO: 330141 - RNA, 23 nt, Human
caugagcaccgcaagagacaaaa

SEQ ID NO: 330142 - RNA, 21 nt, Human
ccccacacaucaugagcaccg

SEQ ID NO: 330143 - RNA, 23 nt, Human
ccccacacaucaugagcaccgca

SEQ ID NO: 330144 - RNA, 19 nt, Human
cgagaaagcaaaacuaaau

SEQ ID NO: 330145 - RNA, 22 nt, Human
cuaagagaauucuccagaaaaa

SEQ ID NO: 330146 - RNA, 22 nt, Human
cuauagaagaaaaccaaaauga

SEQ ID NO: 330147 - RNA, 22 nt, Human
cugcaaaacucaaauauuagca

SEQ ID NO: 330148 - RNA, 19 nt, Human
gaaaaaaagcugcagucau

SEQ ID NO: 330149 - RNA, 18 nt, Human
gaaaaccaaaaugacuga

SEQ ID NO: 330150 - RNA, 18 nt, Human
gaagccauagcaugaaaa

SEQ ID NO: 330151 - RNA, 19 nt, Human
gacaaaauuugacacuacc

SEQ ID NO: 330152 - RNA, 21 nt, Human
gagcaccgcaagagacaaaag

SEQ ID NO: 330153 - RNA, 22 nt, Human
gagcaccgcaagagacaaaaga

SEQ ID NO: 330154 - RNA, 18 nt, Human
gagcagcagugguaucug

SEQ ID NO: 330155 - RNA, 22 nt, Human
gagcagcagugguaucuguggg

SEQ ID NO: 330156 - RNA, 21 nt, Human
gcggccgaggagcgaaagggc

SEQ ID NO: 330157 - RNA, 22 nt, Human
gcuucauugauuucaacaaugu

SEQ ID NO: 330158 - RNA, 20 nt, Human
ggaaacugcagaguaagugc

SEQ ID NO: 330159 - RNA, 23 nt, Human
gggagcagcagugguaucugugg

SEQ ID NO: 330160 - RNA, 19 nt, Human
guagcaauuuacaaauaga

SEQ ID NO: 330161 - RNA, 21 nt, Human
gugaauauaauccaaaucaau

SEQ ID NO: 330162 - RNA, 23 nt, Human
uaaaacacaaaagugacacaaga

SEQ ID NO: 330163 - RNA, 23 nt, Human
uaaaaucaaaagacuuaggacau

SEQ ID NO: 330164 - RNA, 21 nt, Human
uaaaauggcuauagaagaaaa

SEQ ID NO: 330165 - RNA, 18 nt, Human
uaaaucucagaccuggga

SEQ ID NO: 330166 - RNA, 19 nt, Human
uaacugaggaauccaaaca

SEQ ID NO: 330167 - RNA, 20 nt, Human
uaacugaggaauccaaacau

SEQ ID NO: 330168 - RNA, 18 nt, Human
uaagcaagcccacacaua

SEQ ID NO: 330169 - RNA, 24 nt, Human
uaaguaugaaguaauaaaacacaa

SEQ ID NO: 330170 - RNA, 21 nt, Human
uacaaaaauuaaaaaacaaaa

SEQ ID NO: 330171 - RNA, 24 nt, Human
uacaaaaauuaaaaaacaaaauuu

SEQ ID NO: 330172 - RNA, 21 nt, Human
uagaagaaaaccaaaaugacu

SEQ ID NO: 330173 - RNA, 23 nt, Human
uagaagaaaaccaaaaugacuga

SEQ ID NO: 330174 - RNA, 24 nt, Human
uagcaauuuacaaauagauaauau

SEQ ID NO: 330175 - RNA, 23 nt, Human
uauuauagaucauuuaaaucuuu

SEQ ID NO: 330176 - RNA, 22 nt, Human
ucaaaagacuuaggacauggaa

SEQ ID NO: 330177 - RNA, 21 nt, Human
uccagaaaaagugccccccuc

SEQ ID NO: 330178 - RNA, 21 nt, Human
ucuaagacaaaauuugacacu

SEQ ID NO: 330179 - RNA, 23 nt, Human
ucuauaauauacugcaaaacuca

SEQ ID NO: 330180 - RNA, 22 nt, Human
ucuuaguuugauuugaucaaga

SEQ ID NO: 330181 - RNA, 29 nt, Human
ugaaaaguaaacaauaacugaggaaaacg

SEQ ID NO: 330182 - RNA, 22 nt, Human
ugacacuaccagcauuaaacca

SEQ ID NO: 330183 - RNA, 18 nt, Human
ugacugacuacagcaaug

SEQ ID NO: 330184 - RNA, 22 nt, Human
ugagcagaaauuaaccucucac

SEQ ID NO: 330185 - RNA, 18 nt, Human
ugccuuuaagugguacca

SEQ ID NO: 330186 - RNA, 23 nt, Human
uggacuauacacagccuucuagg

SEQ ID NO: 330187 - RNA, 19 nt, Human
ugugggaccagggggcguc

SEQ ID NO: 330188 - RNA, 21 nt, Human
uuaaacuaaggcuagugaagc

SEQ ID NO: 330189 - RNA, 23 nt, Human
uucagacauacugaaaccaaaga

SEQ ID NO: 330190 - RNA, 20 nt, Human
uugccugagcaauaaaaugc

SEQ ID NO: 330191 - RNA, 22 nt, Human
uugcuucauugauuucaacaau

SEQ ID NO: 330192 - RNA, 18 nt, Human
uugggcugccugaucauu

SEQ ID NO: 330193 - RNA, 23 nt, Human
uuggggauuucccaccauccuga

SEQ ID NO: 330194 - RNA, 20 nt, Human
uuuacuaagagaauucucca

SEQ ID NO: 330195 - RNA, 18 nt, Human
aaaccugaucuaguaaca

SEQ ID NO: 330196 - RNA, 23 nt, Human
aagaaagaccaugacaagugaca

SEQ ID NO: 330197 - RNA, 21 nt, Human
aguguagugccgagcuagccu

SEQ ID NO: 330198 - RNA, 19 nt, Human
aucucucuccuuccuuucc

SEQ ID NO: 330199 - RNA, 22 nt, Human
auucauuccucucccuucuccc

SEQ ID NO: 330200 - RNA, 25 nt, Human
auucauuccucucccuucucccuuc

SEQ ID NO: 330201 - RNA, 19 nt, Human
cccaggccaggaagaaguu

SEQ ID NO: 330202 - RNA, 20 nt, Human
cccucucuuccuaccuccuu

SEQ ID NO: 330203 - RNA, 18 nt, Human
cccuucucccuuccucuc

SEQ ID NO: 330204 - RNA, 20 nt, Human
cccuuuucuccuuuuucucc

SEQ ID NO: 330205 - RNA, 18 nt, Human
ccucccucucuuccuacc

SEQ ID NO: 330206 - RNA, 21 nt, Human
ccucccucucuuccuaccucc

SEQ ID NO: 330207 - RNA, 23 nt, Human
ccuccuugccuucuuucacuucc

SEQ ID NO: 330208 - RNA, 19 nt, Human
ccucucccuucucccuucc

SEQ ID NO: 330209 - RNA, 18 nt, Human
ccucucucuuccuuuuuu

SEQ ID NO: 330210 - RNA, 23 nt, Human
ccucugccguugucucccucagg

SEQ ID NO: 330211 - RNA, 18 nt, Human
ccuuccuuuccuccuccc

SEQ ID NO: 330212 - RNA, 22 nt, Human
ccuugccuucuuucacuuccuc

SEQ ID NO: 330213 - RNA, 22 nt, Human
cggcacggagcccaggccagga

SEQ ID NO: 330214 - RNA, 23 nt, Human
cggcacggagcccaggccaggaa

SEQ ID NO: 330215 - RNA, 20 nt, Human
cggguaccaugguuuuuuuu

SEQ ID NO: 330216 - RNA, 21 nt, Human
cuaugugacccuccaagcccc

SEQ ID NO: 330217 - RNA, 24 nt, Human
cuaugugacccuccaagccccucu

SEQ ID NO: 330218 - RNA, 22 nt, Human
cucccucugccguugucucccu

SEQ ID NO: 330219 - RNA, 20 nt, Human
cuccucccucucuuccuacc

SEQ ID NO: 330220 - RNA, 21 nt, Human
cucucuuccuuuuuuuccuuu

SEQ ID NO: 330221 - RNA, 20 nt, Human
cucugccguugucucccuca

SEQ ID NO: 330222 - RNA, 20 nt, Human
cucuuccuuuuuuuccuuuu

SEQ ID NO: 330223 - RNA, 19 nt, Human
cugcucacucccucugccg

SEQ ID NO: 330224 - RNA, 22 nt, Human
cuucucccuuccucucucuucc

SEQ ID NO: 330225 - RNA, 21 nt, Human
gacccuccaagccccucugcu

SEQ ID NO: 330226 - RNA, 19 nt, Human
gagcccaggccaggaagaa

SEQ ID NO: 330227 - RNA, 22 nt, Human
gcccaggccaggaagaaguuuu

SEQ ID NO: 330228 - RNA, 20 nt, Human
gguggggagcgcccggcacu

SEQ ID NO: 330229 - RNA, 20 nt, Human
gguggggaggcaagaaaggg

SEQ ID NO: 330230 - RNA, 21 nt, Human
gguuggcaaacagagcggcac

SEQ ID NO: 330231 - RNA, 22 nt, Human
uaaaucaguguauuuacauuua

SEQ ID NO: 330232 - RNA, 19 nt, Human
uaccaagaaagaccaugac

SEQ ID NO: 330233 - RNA, 20 nt, Human
uaccaagaaagaccaugaca

SEQ ID NO: 330234 - RNA, 25 nt, Human
uaccaugguuuuuuuuuuuuuuugu

SEQ ID NO: 330235 - RNA, 18 nt, Human
ucaauucauuccucuccc

SEQ ID NO: 330236 - RNA, 22 nt, Human
uccccugcucacucccucugcc

SEQ ID NO: 330237 - RNA, 18 nt, Human
ucccucucuuccuaccuc

SEQ ID NO: 330238 - RNA, 21 nt, Human
ucccucugccguugucucccu

SEQ ID NO: 330239 - RNA, 21 nt, Human
uccgggguggggaggcaagaa

SEQ ID NO: 330240 - RNA, 20 nt, Human
uccuuccuuuccuccucccu

SEQ ID NO: 330241 - RNA, 23 nt, Human
uccuugccuucuuucacuuccuc

SEQ ID NO: 330242 - RNA, 31 nt, Human
ucucccuuccucucucuuccuuuuuuucccc

SEQ ID NO: 330243 - RNA, 23 nt, Human
ucuccuuuuucuccucauucucu

SEQ ID NO: 330244 - RNA, 20 nt, Human
ugacccuccaagccccucug

SEQ ID NO: 330245 - RNA, 20 nt, Human
ugaggcaucucucuccuucc

SEQ ID NO: 330246 - RNA, 21 nt, Human
uggggaggcaagaaagggucc

SEQ ID NO: 330247 - RNA, 21 nt, Human
uguagugccgagcuagccuuu

SEQ ID NO: 330248 - RNA, 22 nt, Human
uuaauaccaagaaagaccauga

SEQ ID NO: 330249 - RNA, 24 nt, Human
uuccucucccuucucccuuccccc

SEQ ID NO: 330250 - RNA, 20 nt, Human
uucuccuuuuucuccucauu

SEQ ID NO: 330251 - RNA, 21 nt, Human
uuuuuuuuuuuuuuugugcaa

SEQ ID NO: 330252 - RNA, 23 nt, Human
aaaacaauuaugugcaaacugca

SEQ ID NO: 330253 - RNA, 22 nt, Human
aaaacacuaagcuugcaacaaa

SEQ ID NO: 330254 - RNA, 18 nt, Human
aaaaccuucaaccacaug

SEQ ID NO: 330255 - RNA, 21 nt, Human
aaaaugcugcacagucaugaa

SEQ ID NO: 330256 - RNA, 22 nt, Human
aacacaugaaugaaaaaaaucu

SEQ ID NO: 330257 - RNA, 18 nt, Human
aagauuuucauugugaca

SEQ ID NO: 330258 - RNA, 24 nt, Human
aagcaaaaagaauagcaaaagcag

SEQ ID NO: 330259 - RNA, 28 nt, Human
aaugauaggaguauuuaagcaaaaagaa

SEQ ID NO: 330260 - RNA, 19 nt, Human
acaaaacaacaaaaugaaa

SEQ ID NO: 330261 - RNA, 20 nt, Human
acaaaacaacaaaaugaaaa

SEQ ID NO: 330262 - RNA, 23 nt, Human
acaaaacacuaagcuugcaacaa

SEQ ID NO: 330263 - RNA, 21 nt, Human
acaaaaccuccacuacaaaac

SEQ ID NO: 330264 - RNA, 20 nt, Human
acacaagcuacaguuaaggu

SEQ ID NO: 330265 - RNA, 22 nt, Human
acacuaagcuugcaacaaaaca

SEQ ID NO: 330266 - RNA, 19 nt, Human
acagagaacaaacugccca

SEQ ID NO: 330267 - RNA, 22 nt, Human
acauaaaaaaacuguagacugc

SEQ ID NO: 330268 - RNA, 20 nt, Human
acauaacuaaaaaugcugca

SEQ ID NO: 330269 - RNA, 21 nt, Human
accaaguaauucagaaaauga

SEQ ID NO: 330270 - RNA, 18 nt, Human
accacauguaauguagac

SEQ ID NO: 330271 - RNA, 20 nt, Human
agaauguauaaaaccuucaa

SEQ ID NO: 330272 - RNA, 23 nt, Human
agagaucaguguaaauuaaauaa

SEQ ID NO: 330273 - RNA, 22 nt, Human
auaaaaccuucaaccacaugua

SEQ ID NO: 330274 - RNA, 21 nt, Human
auaacacaugaaugaaaaaaa

SEQ ID NO: 330275 - RNA, 24 nt, Human
auacuggaaucuuacugaggggua

SEQ ID NO: 330276 - RNA, 18 nt, Human
aucaagacaacaauccaa

SEQ ID NO: 330277 - RNA, 19 nt, Human
augauaccucuauucuucc

SEQ ID NO: 330278 - RNA, 22 nt, Human
auucaaauuuagaccaaaucaa

SEQ ID NO: 330279 - RNA, 27 nt, Human
caacaaaacaacaaaaugaaagccaca

SEQ ID NO: 330280 - RNA, 25 nt, Human
caacugagcuaaucauugaaguaaa

SEQ ID NO: 330281 - RNA, 21 nt, Human
cacacuauucauguccuccug

SEQ ID NO: 330282 - RNA, 23 nt, Human
cacacuauucauguccuccugaa

SEQ ID NO: 330283 - RNA, 23 nt, Human
cauaaauacacaaaucucaaguu

SEQ ID NO: 330284 - RNA, 22 nt, Human
caugaaguaaauuaacaaacau

SEQ ID NO: 330285 - RNA, 21 nt, Human
cauguccuccugaaaccaaaa

SEQ ID NO: 330286 - RNA, 19 nt, Human
ccuccacuacaaaacacua

SEQ ID NO: 330287 - RNA, 22 nt, Human
cucaaggagcaaaaaacaacag

SEQ ID NO: 330288 - RNA, 18 nt, Human
gaauagcaaaagcagacu

SEQ ID NO: 330289 - RNA, 21 nt, Human
gagaacaaacugcccagaaau

SEQ ID NO: 330290 - RNA, 21 nt, Human
gcaacaaaacaacaaaaugaa

SEQ ID NO: 330291 - RNA, 23 nt, Human
gcaagagauggaauuucccagag

SEQ ID NO: 330292 - RNA, 19 nt, Human
gccaaacaccacauaacua

SEQ ID NO: 330293 - RNA, 18 nt, Human
ggaaauguauauacuucc

SEQ ID NO: 330294 - RNA, 22 nt, Human
guaaccaaccuuaaaggacaaa

SEQ ID NO: 330295 - RNA, 20 nt, Human
gucaaucucaguacuacuag

SEQ ID NO: 330296 - RNA, 20 nt, Human
guggucacucacaaaaaugc

SEQ ID NO: 330297 - RNA, 23 nt, Human
uaaaaaaacuguagacugcaaac

SEQ ID NO: 330298 - RNA, 25 nt, Human
uaaaaaagaaucucaaacaucccag

SEQ ID NO: 330299 - RNA, 21 nt, Human
uaaaauagcagagaucagugu

SEQ ID NO: 330300 - RNA, 21 nt, Human
uaaaauagcaguuaaagaguu

SEQ ID NO: 330301 - RNA, 19 nt, Human
uaaaucaaguagaauguga

SEQ ID NO: 330302 - RNA, 24 nt, Human
uaacaugaacaaaucacaaguaca

SEQ ID NO: 330303 - RNA, 25 nt, Human
uacaaaacacuaagcuugcaacaaa

SEQ ID NO: 330304 - RNA, 19 nt, Human
uacaauauacaauagcaag

SEQ ID NO: 330305 - RNA, 21 nt, Human
uacaauauacaauagcaagag

SEQ ID NO: 330306 - RNA, 26 nt, Human
uacaauauacaauagcaagaggugag

SEQ ID NO: 330307 - RNA, 18 nt, Human
uaccaaguaauucagaaa

SEQ ID NO: 330308 - RNA, 21 nt, Human
uagaaaaagguuacaauauaa

SEQ ID NO: 330309 - RNA, 21 nt, Human
uagaaugugagguuuuuauau

SEQ ID NO: 330310 - RNA, 22 nt, Human
uagcaagaggugagaaaacuga

SEQ ID NO: 330311 - RNA, 26 nt, Human
uagcucaaggagcaaaaaacaacagg

SEQ ID NO: 330312 - RNA, 24 nt, Human
uaguaaccaaccuuaaaggacaaa

SEQ ID NO: 330313 - RNA, 23 nt, Human
uauagaauguauaaaaccuucaa

SEQ ID NO: 330314 - RNA, 23 nt, Human
uauaguaaccaaccuuaaaggac

SEQ ID NO: 330315 - RNA, 19 nt, Human
uauucaucaacauuacaca

SEQ ID NO: 330316 - RNA, 18 nt, Human
ucacacaucagaaucugg

SEQ ID NO: 330317 - RNA, 20 nt, Human
ucagaaagaacccaacauga

SEQ ID NO: 330318 - RNA, 25 nt, Human
ucauguccuccugaaaccaaaaugg

SEQ ID NO: 330319 - RNA, 23 nt, Human
uccuccugaaaccaaaauggggg

SEQ ID NO: 330320 - RNA, 19 nt, Human
uccugaaagaaaauuugcc

SEQ ID NO: 330321 - RNA, 20 nt, Human
ugaaaagaauuaacaaaacc

SEQ ID NO: 330322 - RNA, 19 nt, Human
ugagaaaacugaauacugu

SEQ ID NO: 330323 - RNA, 24 nt, Human
ugauauaaaacaauuaugugcaaa

SEQ ID NO: 330324 - RNA, 22 nt, Human
ugcaacaaaacaacaaaaugaa

SEQ ID NO: 330325 - RNA, 25 nt, Human
ugcaacaaaacaacaaaaugaaagc

SEQ ID NO: 330326 - RNA, 21 nt, Human
ugcugcacagucaugaaucca

SEQ ID NO: 330327 - RNA, 19 nt, Human
uggccugggcuacauucug

SEQ ID NO: 330328 - RNA, 19 nt, Human
uguauaaaaccuucaacca

SEQ ID NO: 330329 - RNA, 21 nt, Human
uguuucauuuacaaaaccucc

SEQ ID NO: 330330 - RNA, 21 nt, Human
uucaagaacuagaaaaagguu

SEQ ID NO: 330331 - RNA, 22 nt, Human
uucaagaacuagaaaaagguua

SEQ ID NO: 330332 - RNA, 23 nt, Human
uucauuuuuguuauauucaagua

SEQ ID NO: 330333 - RNA, 20 nt, Human
uugcaacaaaacaacaaaau

SEQ ID NO: 330334 - RNA, 22 nt, Human
uuuacaaaaccuccacuacaaa

SEQ ID NO: 330335 - RNA, 24 nt, Human
uuuuuuuuuuuuaacuauuacuca

SEQ ID NO: 330336 - RNA, 26 nt, Human
aaaaaaccuauucauuuuuggcuuca

SEQ ID NO: 330337 - RNA, 21 nt, Human
aaaccaaacaaaacccccuag

SEQ ID NO: 330338 - RNA, 19 nt, Human
aaauacuggaugcugcucu

SEQ ID NO: 330339 - RNA, 22 nt, Human
aaccaaacaaaacccccuagga

SEQ ID NO: 330340 - RNA, 19 nt, Human
aacccccuaggaucuugaa

SEQ ID NO: 330341 - RNA, 20 nt, Human
aacccuccuccaacaccaag

SEQ ID NO: 330342 - RNA, 21 nt, Human
aagaaucuguuguagugcagc

SEQ ID NO: 330343 - RNA, 18 nt, Human
aagggaauaaaaaaaaag

SEQ ID NO: 330344 - RNA, 20 nt, Human
acacaaagguuuaaaacagu

SEQ ID NO: 330345 - RNA, 19 nt, Human
acccucggccccucccugc

SEQ ID NO: 330346 - RNA, 18 nt, Human
acggcccagagggcggcc

SEQ ID NO: 330347 - RNA, 21 nt, Human
acucccucaccuccccacccu

SEQ ID NO: 330348 - RNA, 23 nt, Human
agacagugcgacgcaaggccagg

SEQ ID NO: 330349 - RNA, 19 nt, Human
agagcaaacgucuuccccu

SEQ ID NO: 330350 - RNA, 20 nt, Human
aggaaagcaacaaggauuac

SEQ ID NO: 330351 - RNA, 18 nt, Human
aggaaauagggaagccuu

SEQ ID NO: 330352 - RNA, 21 nt, Human
agggaauaaaaaaaaagucag

SEQ ID NO: 330353 - RNA, 20 nt, Human
aggucuagaauaccuuaguu

SEQ ID NO: 330354 - RNA, 23 nt, Human
auaaaauaguugaaucugacuga

SEQ ID NO: 330355 - RNA, 21 nt, Human
auugcaaauucauugcuguga

SEQ ID NO: 330356 - RNA, 20 nt, Human
caaaacaauacuuaucacca

SEQ ID NO: 330357 - RNA, 27 nt, Human
caaauuacaauauucugcagccacaaa

SEQ ID NO: 330358 - RNA, 21 nt, Human
caaggaagaacuagcaaauca

SEQ ID NO: 330359 - RNA, 18 nt, Human
cacacaaauggcuguguu

SEQ ID NO: 330360 - RNA, 21 nt, Human
cacccaguauucauguuuuaa

SEQ ID NO: 330361 - RNA, 19 nt, Human
cacucccucaccuccccac

SEQ ID NO: 330362 - RNA, 22 nt, Human
cacucccucaccuccccacccu

SEQ ID NO: 330363 - RNA, 18 nt, Human
cacugcagcugccgccgc

SEQ ID NO: 330364 - RNA, 24 nt, Human
caugccaauauaaacaucaaaaca

SEQ ID NO: 330365 - RNA, 21 nt, Human
cauugugcacacacaaauggc

SEQ ID NO: 330366 - RNA, 21 nt, Human
ccaacaccaaguuaagcaacu

SEQ ID NO: 330367 - RNA, 18 nt, Human
ccacucccucaccucccc

SEQ ID NO: 330368 - RNA, 18 nt, Human
ccagcagccauaucccaa

SEQ ID NO: 330369 - RNA, 18 nt, Human
cccacucccucaccuccc

SEQ ID NO: 330370 - RNA, 24 nt, Human
ccccuaggaucuugaagguccuau

SEQ ID NO: 330371 - RNA, 19 nt, Human
ccccuccccucugacucgc

SEQ ID NO: 330372 - RNA, 18 nt, Human
ccgcaccgccuggcaugc

SEQ ID NO: 330373 - RNA, 20 nt, Human
ccgccccauuccccacuccc

SEQ ID NO: 330374 - RNA, 21 nt, Human
ccgcccuugcugccgcagccg

SEQ ID NO: 330375 - RNA, 22 nt, Human
ccgccgccaccgccgcccuugc

SEQ ID NO: 330376 - RNA, 22 nt, Human
ccgccuggcaugccgggaaagg

SEQ ID NO: 330377 - RNA, 25 nt, Human
ccucggccccucccugcuccccucc

SEQ ID NO: 330378 - RNA, 24 nt, Human
cgggagagcaaacgucuuccccua

SEQ ID NO: 330379 - RNA, 22 nt, Human
cuaaaccugacaucuaaacaug

SEQ ID NO: 330380 - RNA, 22 nt, Human
cuagaauaccuuaguuugcauu

SEQ ID NO: 330381 - RNA, 18 nt, Human
cuccccacccucggcccc

SEQ ID NO: 330382 - RNA, 24 nt, Human
cucccugcuccccuccccucugac

SEQ ID NO: 330383 - RNA, 21 nt, Human
cucggccccucccugcucccc

SEQ ID NO: 330384 - RNA, 24 nt, Human
cugccgccgccgccaccgccgccc

SEQ ID NO: 330385 - RNA, 23 nt, Human
gcauugugcacacacaaauggcu

SEQ ID NO: 330386 - RNA, 22 nt, Human
gcccacaacaaaauguguugcc

SEQ ID NO: 330387 - RNA, 21 nt, Human
gccccauuccccacucccuca

SEQ ID NO: 330388 - RNA, 19 nt, Human
gccgccgccgccaccgccg

SEQ ID NO: 330389 - RNA, 22 nt, Human
gccgccgccgccaccgccgccc

SEQ ID NO: 330390 - RNA, 23 nt, Human
gccgccgccgccaccgccgcccu

SEQ ID NO: 330391 - RNA, 21 nt, Human
gccuuuacacggcccagaggg

SEQ ID NO: 330392 - RNA, 18 nt, Human
ggaaaauugaauauucug

SEQ ID NO: 330393 - RNA, 21 nt, Human
ggccccucccugcuccccucc

SEQ ID NO: 330394 - RNA, 24 nt, Human
ggcuacgcgagcugaggacagaca

SEQ ID NO: 330395 - RNA, 21 nt, Human
gggcauauuaucuagaaagca

SEQ ID NO: 330396 - RNA, 19 nt, Human
uaaaaaccaaacaaaaccc

SEQ ID NO: 330397 - RNA, 21 nt, Human
uaaaaaccaaacaaaaccccc

SEQ ID NO: 330398 - RNA, 21 nt, Human
uaaacccuccuccaacaccaa

SEQ ID NO: 330399 - RNA, 27 nt, Human
uaacucuacaaggaagaacuagcaaau

SEQ ID NO: 330400 - RNA, 19 nt, Human
uacauucuaaacuuguuuu

SEQ ID NO: 330401 - RNA, 19 nt, Human
uacgcgagcugaggacaga

SEQ ID NO: 330402 - RNA, 18 nt, Human
uagaacacaaucagcagc

SEQ ID NO: 330403 - RNA, 23 nt, Human
uagaacacaaucagcagccgccg

SEQ ID NO: 330404 - RNA, 19 nt, Human
uauaaaccagcacacaaag

SEQ ID NO: 330405 - RNA, 18 nt, Human
uauaacaucucacuaaac

SEQ ID NO: 330406 - RNA, 25 nt, Human
uauugugaaauuuucauagauggaa

SEQ ID NO: 330407 - RNA, 21 nt, Human
ucaaaacaauacuuaucacca

SEQ ID NO: 330408 - RNA, 18 nt, Human
ucacugcagcugccgccg

SEQ ID NO: 330409 - RNA, 20 nt, Human
ucacugcagcugccgccgcc

SEQ ID NO: 330410 - RNA, 21 nt, Human
ucacugcagcugccgccgccg

SEQ ID NO: 330411 - RNA, 18 nt, Human
ucagucaccuuaaaaugc

SEQ ID NO: 330412 - RNA, 19 nt, Human
ucauugcugugagaaaagg

SEQ ID NO: 330413 - RNA, 21 nt, Human
uccccuagaacacaaucagca

SEQ ID NO: 330414 - RNA, 18 nt, Human
ucccucaccuccccaccc

SEQ ID NO: 330415 - RNA, 18 nt, Human
ucccugcuccccuccccu

SEQ ID NO: 330416 - RNA, 24 nt, Human
uccgcgccacggguaaucgaaaga

SEQ ID NO: 330417 - RNA, 24 nt, Human
uccucacaauuaaaaaccaaacaa

SEQ ID NO: 330418 - RNA, 23 nt, Human
ugaaccacugaaguugguuaaau

SEQ ID NO: 330419 - RNA, 19 nt, Human
ugagauaggcuguuccggg

SEQ ID NO: 330420 - RNA, 20 nt, Human
ugcgugaagaauguuuuggc

SEQ ID NO: 330421 - RNA, 21 nt, Human
uggagacgguaagaaucuguu

SEQ ID NO: 330422 - RNA, 18 nt, Human
uggaugcugcucuaagau

SEQ ID NO: 330423 - RNA, 19 nt, Human
ugguaucaggaaagcaaca

SEQ ID NO: 330424 - RNA, 22 nt, Human
ugugcacacacaaauggcugug

SEQ ID NO: 330425 - RNA, 18 nt, Human
uguuuuggcugcuauuuc

SEQ ID NO: 330426 - RNA, 22 nt, Human
uuaagcaacuguggaggauaaa

SEQ ID NO: 330427 - RNA, 24 nt, Human
uuauaugcagaguaugaagaaacu

SEQ ID NO: 330428 - RNA, 21 nt, Human
uuccgggagagcaaacgucuu

SEQ ID NO: 330429 - RNA, 18 nt, Human
uucuaaacuuguuuuaca

SEQ ID NO: 330430 - RNA, 19 nt, Human
uucugaaaaugaaguuagc

SEQ ID NO: 330431 - RNA, 20 nt, Human
uugaccauuuacaaucucug

SEQ ID NO: 330432 - RNA, 23 nt, Human
uugccuguuuagugaaaaauaaa

SEQ ID NO: 330433 - RNA, 24 nt, Human
uuggcuuguguuuagcuuaaauuu

SEQ ID NO: 330434 - RNA, 25 nt, Human
uuugccaauuaggaaaggugcugcu

SEQ ID NO: 330435 - RNA, 19 nt, Human
aaaauaccauacaaagaug

SEQ ID NO: 330436 - RNA, 22 nt, Human
aaaaugacuucaugacauuuuc

SEQ ID NO: 330437 - RNA, 22 nt, Human
aaacaaaagauaaaacacaaaa

SEQ ID NO: 330438 - RNA, 21 nt, Human
aaacacaaaaggaguacauaa

SEQ ID NO: 330439 - RNA, 21 nt, Human
aaaccagguauauugaaagga

SEQ ID NO: 330440 - RNA, 20 nt, Human
aacauaccaugacagcugga

SEQ ID NO: 330441 - RNA, 25 nt, Human
aaccaggaagaaagcuuucgucuaa

SEQ ID NO: 330442 - RNA, 27 nt, Human
acaaauaaugaaaaaugacuucaugac

SEQ ID NO: 330443 - RNA, 21 nt, Human
acagggcaauaauuuuuucca

SEQ ID NO: 330444 - RNA, 20 nt, Human
acauuguuuaguacaaauaa

SEQ ID NO: 330445 - RNA, 20 nt, Human
acccuucaguauuauuuugu

SEQ ID NO: 330446 - RNA, 22 nt, Human
acuauacauucugaaaaagcac

SEQ ID NO: 330447 - RNA, 19 nt, Human
acugucccaagugacaaaa

SEQ ID NO: 330448 - RNA, 21 nt, Human
acuuaacaaggacacacccag

SEQ ID NO: 330449 - RNA, 18 nt, Human
agaaaagccuacaugacc

SEQ ID NO: 330450 - RNA, 21 nt, Human
agaaaagccuacaugacccaa

SEQ ID NO: 330451 - RNA, 19 nt, Human
aggcauuucauuuauguuu

SEQ ID NO: 330452 - RNA, 22 nt, Human
agguuauagaaauguugaagug

SEQ ID NO: 330453 - RNA, 25 nt, Human
auaaaacauuguuuaguacaaauaa

SEQ ID NO: 330454 - RNA, 21 nt, Human
auggaaaaacaaaagauaaaa

SEQ ID NO: 330455 - RNA, 22 nt, Human
caaaagauaaaacacaaaagga

SEQ ID NO: 330456 - RNA, 25 nt, Human
caaaagauaaaacacaaaaggagua

SEQ ID NO: 330457 - RNA, 24 nt, Human
caaaagguguuagaugcaucacca

SEQ ID NO: 330458 - RNA, 23 nt, Human
caagauuuaaggguuuacccuuc

SEQ ID NO: 330459 - RNA, 20 nt, Human
caaggacacacccaggaaau

SEQ ID NO: 330460 - RNA, 27 nt, Human
caaugcuguaaaaaccagguauauuga

SEQ ID NO: 330461 - RNA, 22 nt, Human
cagaaaagccuacaugacccaa

SEQ ID NO: 330462 - RNA, 20 nt, Human
cagcagcagcuccgccgggg

SEQ ID NO: 330463 - RNA, 18 nt, Human
cauucccuuuuacaaacc

SEQ ID NO: 330464 - RNA, 23 nt, Human
ccacacuucacaggaccuccuga

SEQ ID NO: 330465 - RNA, 19 nt, Human
ccagauucaauacuauuuc

SEQ ID NO: 330466 - RNA, 22 nt, Human
cuauacaaacaagguuauagaa

SEQ ID NO: 330467 - RNA, 19 nt, Human
cuucagcuuacuccaguac

SEQ ID NO: 330468 - RNA, 22 nt, Human
gagugauaaucaguuuuaacag

SEQ ID NO: 330469 - RNA, 22 nt, Human
gaguggcucagcagcagcuccg

SEQ ID NO: 330470 - RNA, 19 nt, Human
gaugaaaacugcuuacugc

SEQ ID NO: 330471 - RNA, 18 nt, Human
gccaaaacccugugguuu

SEQ ID NO: 330472 - RNA, 25 nt, Human
ggcaaagagaacauuuacuuuugau

SEQ ID NO: 330473 - RNA, 21 nt, Human
gggggugguggggcgcgggag

SEQ ID NO: 330474 - RNA, 19 nt, Human
gggugguggggcgcgggag

SEQ ID NO: 330475 - RNA, 22 nt, Human
ggugguggggcgcgggagucuc

SEQ ID NO: 330476 - RNA, 19 nt, Human
guaaaaaccagguauauug

SEQ ID NO: 330477 - RNA, 20 nt, Human
guaaagcacuauaaaaauua

SEQ ID NO: 330478 - RNA, 21 nt, Human
uaaaauggcaaagagaacaac

SEQ ID NO: 330479 - RNA, 19 nt, Human
uaacaaggacacacccagg

SEQ ID NO: 330480 - RNA, 20 nt, Human
uacaaagauguguaaacaaa

SEQ ID NO: 330481 - RNA, 24 nt, Human
uacauucugaaaaagcacugcaga

SEQ ID NO: 330482 - RNA, 25 nt, Human
uaccagacaucugcaugcacacccc

SEQ ID NO: 330483 - RNA, 24 nt, Human
uaccaugacagcuggauggguuuc

SEQ ID NO: 330484 - RNA, 20 nt, Human
uagaaugucauuuucuuaaa

SEQ ID NO: 330485 - RNA, 18 nt, Human
uaucaaaaagaucugcaa

SEQ ID NO: 330486 - RNA, 25 nt, Human
ucaguauuauuuugugaaaguauuc

SEQ ID NO: 330487 - RNA, 19 nt, Human
ucagugagcagcaaaaggu

SEQ ID NO: 330488 - RNA, 19 nt, Human
uccacaguauuaaaaucug

SEQ ID NO: 330489 - RNA, 19 nt, Human
ugaaaaagcacugcagagc

SEQ ID NO: 330490 - RNA, 18 nt, Human
ugagaaaggcuauacaaa

SEQ ID NO: 330491 - RNA, 22 nt, Human
ugagaaaggcuauacaaacaag

SEQ ID NO: 330492 - RNA, 21 nt, Human
ugcaauaaggcucaccuggga

SEQ ID NO: 330493 - RNA, 21 nt, Human
ugggugacuauaucaaaaaga

SEQ ID NO: 330494 - RNA, 19 nt, Human
uguaacaauauauuuaggc

SEQ ID NO: 330495 - RNA, 24 nt, Human
uugaucacuuaacaaggacacacc

SEQ ID NO: 330496 - RNA, 18 nt, Human
uuuaaacccaagcucauu

SEQ ID NO: 330497 - RNA, 20 nt, Human
uuucauuuauguuuuuccaa

SEQ ID NO: 330498 - RNA, 20 nt, Human
uuuuuaaacccaagcucauu

SEQ ID NO: 330499 - RNA, 20 nt, Human
uuuuuuuuuuuuuuacuuuu

SEQ ID NO: 330500 - RNA, 25 nt, Human
aaaaggccaaguugagugcaaggug

SEQ ID NO: 330501 - RNA, 18 nt, Human
acugaaaacaaaggcuug

SEQ ID NO: 330502 - RNA, 19 nt, Human
acugggcaacaaagucaga

SEQ ID NO: 330503 - RNA, 25 nt, Human
acuuuauucacuaggacugaaaaca

SEQ ID NO: 330504 - RNA, 20 nt, Human
agaagggccuggagacccuc

SEQ ID NO: 330505 - RNA, 18 nt, Human
agccagagccuccuagag

SEQ ID NO: 330506 - RNA, 20 nt, Human
aggcagcgggggugcuggcc

SEQ ID NO: 330507 - RNA, 19 nt, Human
aggccacaggcauccucca

SEQ ID NO: 330508 - RNA, 20 nt, Human
agucccggagcgcgccgguc

SEQ ID NO: 330509 - RNA, 20 nt, Human
cacagaccucaccuguggcc

SEQ ID NO: 330510 - RNA, 19 nt, Human
caccuggacgugcccagga

SEQ ID NO: 330511 - RNA, 20 nt, Human
caccuguggccaggccgggc

SEQ ID NO: 330512 - RNA, 21 nt, Human
cagcagagcaccguggcaaag

SEQ ID NO: 330513 - RNA, 20 nt, Human
cagcgggggugcuggccccu

SEQ ID NO: 330514 - RNA, 22 nt, Human
caggacacacagaugcacgaug

SEQ ID NO: 330515 - RNA, 19 nt, Human
caggcauccuccaagguca

SEQ ID NO: 330516 - RNA, 21 nt, Human
caggcguccucccuuagcugc

SEQ ID NO: 330517 - RNA, 19 nt, Human
ccacgggcucucagaagcc

SEQ ID NO: 330518 - RNA, 18 nt, Human
ccacugggcaacaaaguc

SEQ ID NO: 330519 - RNA, 18 nt, Human
ccaggacacacagaugca

SEQ ID NO: 330520 - RNA, 19 nt, Human
ccaggacacacagaugcac

SEQ ID NO: 330521 - RNA, 24 nt, Human
cccucaccuggacgugcccaggag

SEQ ID NO: 330522 - RNA, 23 nt, Human
cccucuguccagccuucuaggga

SEQ ID NO: 330523 - RNA, 20 nt, Human
ccgcuccccgucccgugcag

SEQ ID NO: 330524 - RNA, 26 nt, Human
ccucaccuggacgugcccaggagggg

SEQ ID NO: 330525 - RNA, 18 nt, Human
ccugagcaugugcggcug

SEQ ID NO: 330526 - RNA, 22 nt, Human
cggagcgcgccggucgggcccc

SEQ ID NO: 330527 - RNA, 21 nt, Human
cgggagcaggcagcucccagg

SEQ ID NO: 330528 - RNA, 19 nt, Human
cguggaggcagcgggggug

SEQ ID NO: 330529 - RNA, 25 nt, Human
cuggagacccucuguccagccuucu

SEQ ID NO: 330530 - RNA, 22 nt, Human
cuucugucccaggcgugggcag

SEQ ID NO: 330531 - RNA, 24 nt, Human
gcagcguggaggcagcgggggugc

SEQ ID NO: 330532 - RNA, 21 nt, Human
gcagugaagccuucuguccca

SEQ ID NO: 330533 - RNA, 18 nt, Human
ggaggaagggacaaggcu

SEQ ID NO: 330534 - RNA, 20 nt, Human
ggaggaggaagggacaaggc

SEQ ID NO: 330535 - RNA, 18 nt, Human
ggaggcagcgggggugcu

SEQ ID NO: 330536 - RNA, 21 nt, Human
ggcagcagagcaccguggcaa

SEQ ID NO: 330537 - RNA, 23 nt, Human
gggaggaggaagggacaaggcuu

SEQ ID NO: 330538 - RNA, 18 nt, Human
gggcagcguggaggcagc

SEQ ID NO: 330539 - RNA, 26 nt, Human
gggccgggagcaggcagcucccagga

SEQ ID NO: 330540 - RNA, 25 nt, Human
uaggacugaaaacaaaggcuugugc

SEQ ID NO: 330541 - RNA, 22 nt, Human
uccuccaaggucagugaggaag

SEQ ID NO: 330542 - RNA, 20 nt, Human
ucugucccaggcgugggcag

SEQ ID NO: 330543 - RNA, 23 nt, Human
ugaaaacaaaggcuugugcaauc

SEQ ID NO: 330544 - RNA, 19 nt, Human
ugaaaacagacacucgggc

SEQ ID NO: 330545 - RNA, 18 nt, Human
ugaagccuucugucccag

SEQ ID NO: 330546 - RNA, 21 nt, Human
ugaccuggggcuccugaaaac

SEQ ID NO: 330547 - RNA, 24 nt, Human
ugcaaggcccguugggcggcgcgu

SEQ ID NO: 330548 - RNA, 24 nt, Human
ugccagccccagcccucccucacc

SEQ ID NO: 330549 - RNA, 20 nt, Human
ugcccaggagggggcagcag

SEQ ID NO: 330550 - RNA, 25 nt, Human
ugccugagcaugugcggcugaagac

SEQ ID NO: 330551 - RNA, 22 nt, Human
ugggaggaggaagggacaaggc

SEQ ID NO: 330552 - RNA, 20 nt, Human
ugugcguggugccagcccca

SEQ ID NO: 330553 - RNA, 23 nt, Human
uguuguuucugguguuuucugug

SEQ ID NO: 330554 - RNA, 22 nt, Human
uguuucugguguuuucugugau

SEQ ID NO: 330555 - RNA, 24 nt, Human
uguuucugguguuuucugugauuu

SEQ ID NO: 330556 - RNA, 21 nt, Human
uuaggcacugugcguggugcc

SEQ ID NO: 330557 - RNA, 24 nt, Human
uuugagccagagccuccuagaggg

SEQ ID NO: 330558 - RNA, 21 nt, Human
uuuuuuuuuuuuuuuuccaga

SEQ ID NO: 330559 - RNA, 22 nt, Human
uuuuuuuuuuuuuuuuuuccag

SEQ ID NO: 330560 - RNA, 19 nt, Human
aaacauuugccaccauaaa

SEQ ID NO: 330561 - RNA, 22 nt, Human
aaacauuugccaccauaaaaua

SEQ ID NO: 330562 - RNA, 21 nt, Human
aaauaucaacaauacagagcc

SEQ ID NO: 330563 - RNA, 24 nt, Human
aacaucuaucuuccaccaaauagc

SEQ ID NO: 330564 - RNA, 22 nt, Human
aagagaaauguuaaagucagaa

SEQ ID NO: 330565 - RNA, 23 nt, Human
aagcaaaacaaguugcaaauauu

SEQ ID NO: 330566 - RNA, 19 nt, Human
aaggcacuuuuggcucuga

SEQ ID NO: 330567 - RNA, 21 nt, Human
aaucuuaaagaaauauuuaca

SEQ ID NO: 330568 - RNA, 18 nt, Human
aauguuaagacaaagaga

SEQ ID NO: 330569 - RNA, 20 nt, Human
acaguacccucauucauucu

SEQ ID NO: 330570 - RNA, 23 nt, Human
accaaacauuugccaccauaaaa

SEQ ID NO: 330571 - RNA, 21 nt, Human
accccaauccccuucccacca

SEQ ID NO: 330572 - RNA, 22 nt, Human
accccaauccccuucccaccaa

SEQ ID NO: 330573 - RNA, 25 nt, Human
aguacaaaugugacugcuucaauau

SEQ ID NO: 330574 - RNA, 21 nt, Human
auaaacaacuuccaugaaaca

SEQ ID NO: 330575 - RNA, 22 nt, Human
augauuuucuaaaacguuagag

SEQ ID NO: 330576 - RNA, 23 nt, Human
auucagagcaaugggaauauagc

SEQ ID NO: 330577 - RNA, 19 nt, Human
caacaauugacaacuucca

SEQ ID NO: 330578 - RNA, 21 nt, Human
caaguacaguaaaugcucaug

SEQ ID NO: 330579 - RNA, 27 nt, Human
cacauaggccaaguauaaauguacaau

SEQ ID NO: 330580 - RNA, 19 nt, Human
caccaauaaaaaagucacc

SEQ ID NO: 330581 - RNA, 23 nt, Human
caccccaauccccuucccaccaa

SEQ ID NO: 330582 - RNA, 26 nt, Human
caccccaauccccuucccaccaauaa

SEQ ID NO: 330583 - RNA, 22 nt, Human
cacuuuuggcucugaaauauuu

SEQ ID NO: 330584 - RNA, 21 nt, Human
cagcacauaggccaaguauaa

SEQ ID NO: 330585 - RNA, 22 nt, Human
cagccugccccaccccaauccc

SEQ ID NO: 330586 - RNA, 19 nt, Human
ccaccaauggaaaagcaaa

SEQ ID NO: 330587 - RNA, 19 nt, Human
cccaccccaauccccuucc

SEQ ID NO: 330588 - RNA, 19 nt, Human
ccccaauccccuucccacc

SEQ ID NO: 330589 - RNA, 19 nt, Human
ccuauauagccauuaagau

SEQ ID NO: 330590 - RNA, 21 nt, Human
ccugcugguaaagacagagau

SEQ ID NO: 330591 - RNA, 21 nt, Human
cuaccaaacauuugccaccau

SEQ ID NO: 330592 - RNA, 23 nt, Human
gaaaaagaaacuaaauauuuacu

SEQ ID NO: 330593 - RNA, 21 nt, Human
gagucuuuggaaaagcaguuc

SEQ ID NO: 330594 - RNA, 23 nt, Human
gcaaauaucaacaauacagagcc

SEQ ID NO: 330595 - RNA, 18 nt, Human
gguacaaguacaguuuag

SEQ ID NO: 330596 - RNA, 22 nt, Human
uaaaaucuaguucccugacccu

SEQ ID NO: 330597 - RNA, 24 nt, Human
uaaagaaauauuuacaaagcugca

SEQ ID NO: 330598 - RNA, 22 nt, Human
uaaaugaucuuggcaagaccca

SEQ ID NO: 330599 - RNA, 26 nt, Human
uaagacaaagagaaauguuaaaguca

SEQ ID NO: 330600 - RNA, 23 nt, Human
uaauaaauacacucuucugugac

SEQ ID NO: 330601 - RNA, 25 nt, Human
uaccuuugaauuuuauaaacaacuu

SEQ ID NO: 330602 - RNA, 18 nt, Human
uagaaugucaccuauggc

SEQ ID NO: 330603 - RNA, 22 nt, Human
uagauauagccaugauuugucc

SEQ ID NO: 330604 - RNA, 24 nt, Human
uagucguaaagucugggcuucuag

SEQ ID NO: 330605 - RNA, 23 nt, Human
uauaaauaugaagaaaaagaaac

SEQ ID NO: 330606 - RNA, 24 nt, Human
uauaacugcauguaagaucuuaaa

SEQ ID NO: 330607 - RNA, 25 nt, Human
uaugaagaaaaagaaacuaaauauu

SEQ ID NO: 330608 - RNA, 24 nt, Human
ucacugugccauguaucaaucaua

SEQ ID NO: 330609 - RNA, 23 nt, Human
ucauauuacauuaagccagccug

SEQ ID NO: 330610 - RNA, 18 nt, Human
ucauucauucuacauaau

SEQ ID NO: 330611 - RNA, 21 nt, Human
uccaaucacauguccucuuca

SEQ ID NO: 330612 - RNA, 23 nt, Human
uccaccaaauagcaaacaggcau

SEQ ID NO: 330613 - RNA, 19 nt, Human
uccaccaauggaaaagcaa

SEQ ID NO: 330614 - RNA, 19 nt, Human
ucuaccaaacauuugccac

SEQ ID NO: 330615 - RNA, 22 nt, Human
ucuaccaaacauuugccaccau

SEQ ID NO: 330616 - RNA, 19 nt, Human
ucugaaauauuucuccuaa

SEQ ID NO: 330617 - RNA, 18 nt, Human
ugaagaacucaguaguuc

SEQ ID NO: 330618 - RNA, 23 nt, Human
ugaaucuuaaagaaauauuuaca

SEQ ID NO: 330619 - RNA, 22 nt, Human
ugacugcuucaauaugaacauc

SEQ ID NO: 330620 - RNA, 20 nt, Human
ugagaagcaauuuguacaca

SEQ ID NO: 330621 - RNA, 19 nt, Human
ugcugguaaagacagagau

SEQ ID NO: 330622 - RNA, 22 nt, Human
uggaaaagcaaaacaaguugca

SEQ ID NO: 330623 - RNA, 20 nt, Human
uggcaaugcagcggaauaaa

SEQ ID NO: 330624 - RNA, 19 nt, Human
uggugagaagcaauuugua

SEQ ID NO: 330625 - RNA, 21 nt, Human
uuacaguucuaccaaacauuu

SEQ ID NO: 330626 - RNA, 18 nt, Human
acaucugguaugaacacc

SEQ ID NO: 330627 - RNA, 22 nt, Human
acccccagagugggaagaagag

SEQ ID NO: 330628 - RNA, 22 nt, Human
caccaugacuucuguaagccaa

SEQ ID NO: 330629 - RNA, 21 nt, Human
caccauucaggauggcuaccc

SEQ ID NO: 330630 - RNA, 22 nt, Human
ccacagggcuggauuucucagc

SEQ ID NO: 330631 - RNA, 18 nt, Human
ccccuccccggcuuuucc

SEQ ID NO: 330632 - RNA, 21 nt, Human
cucagcugucugguaaaccag

SEQ ID NO: 330633 - RNA, 20 nt, Human
cucauggaaggugggaagcu

SEQ ID NO: 330634 - RNA, 18 nt, Human
cuggauuucucagcuguc

SEQ ID NO: 330635 - RNA, 23 nt, Human
cuggcucccuuucugaauuucug

SEQ ID NO: 330636 - RNA, 21 nt, Human
cuugaagccuuugcuuggccc

SEQ ID NO: 330637 - RNA, 19 nt, Human
gcccuggggcucagagccc

SEQ ID NO: 330638 - RNA, 19 nt, Human
ggcacuucacugccccagg

SEQ ID NO: 330639 - RNA, 19 nt, Human
ggggugggggcagcguggg

SEQ ID NO: 330640 - RNA, 18 nt, Human
gggugggggcagcguggg

SEQ ID NO: 330641 - RNA, 20 nt, Human
uaagacaccaguucccacag

SEQ ID NO: 330642 - RNA, 22 nt, Human
uaagacaccaguucccacaggg

SEQ ID NO: 330643 - RNA, 21 nt, Human
uaagccaacggggcuuccucc

SEQ ID NO: 330644 - RNA, 18 nt, Human
uaauugccaccauucagg

SEQ ID NO: 330645 - RNA, 21 nt, Human
uagaaacccccagagugggaa

SEQ ID NO: 330646 - RNA, 25 nt, Human
ucagcggggucgggccaugggggcg

SEQ ID NO: 330647 - RNA, 18 nt, Human
ugccccaggguggcuggc

SEQ ID NO: 330648 - RNA, 20 nt, Human
ugcccuggggcucagagccu

SEQ ID NO: 330649 - RNA, 19 nt, Human
uggaaggugggaagcuaua

SEQ ID NO: 330650 - RNA, 23 nt, Human
ugggggcagcguggguccugagc

SEQ ID NO: 330651 - RNA, 27 nt, Human
uguuuugguuuauuaucuuaguguuuu

SEQ ID NO: 330652 - RNA, 22 nt, Human
uugaagccuuugcuuggcccuu

SEQ ID NO: 330653 - RNA, 19 nt, Human
uuuuucagguaguguuuug

SEQ ID NO: 330654 - RNA, 30 nt, Human
aaaaaaacaaaagcaacaugcucugcagag

SEQ ID NO: 330655 - RNA, 21 nt, Human
aaacaaaagcaacaugcucug

SEQ ID NO: 330656 - RNA, 21 nt, Human
acaagaaaaccagggccccca

SEQ ID NO: 330657 - RNA, 23 nt, Human
accaccgaagcccuaaagaagag

SEQ ID NO: 330658 - RNA, 22 nt, Human
acugaugugcaggagggauccc

SEQ ID NO: 330659 - RNA, 22 nt, Human
agaaaaccagggcccccagaug

SEQ ID NO: 330660 - RNA, 19 nt, Human
agaguucccacaugcaccc

SEQ ID NO: 330661 - RNA, 18 nt, Human
agcugagagaacagcaca

SEQ ID NO: 330662 - RNA, 22 nt, Human
cacaugcacccacugaugugca

SEQ ID NO: 330663 - RNA, 21 nt, Human
caccccaggcauaaacagaaa

SEQ ID NO: 330664 - RNA, 21 nt, Human
cacgcaagggaaggucugcga

SEQ ID NO: 330665 - RNA, 21 nt, Human
cagaucuccccagcaucucau

SEQ ID NO: 330666 - RNA, 22 nt, Human
cagaugauuaccaccgaagccc

SEQ ID NO: 330667 - RNA, 22 nt, Human
caggagucagaaggucagagag

SEQ ID NO: 330668 - RNA, 22 nt, Human
caguacauuuccccccggacuc

SEQ ID NO: 330669 - RNA, 18 nt, Human
ccccagaugauuaccacc

SEQ ID NO: 330670 - RNA, 23 nt, Human
ccccagaugauuaccaccgaagc

SEQ ID NO: 330671 - RNA, 24 nt, Human
ccccagaugauuaccaccgaagcc

SEQ ID NO: 330672 - RNA, 20 nt, Human
cccuuggccugccaugcuuu

SEQ ID NO: 330673 - RNA, 18 nt, Human
ccuaaagaagaguuccca

SEQ ID NO: 330674 - RNA, 23 nt, Human
ccuacaguacauuuccccccgga

SEQ ID NO: 330675 - RNA, 23 nt, Human
ccuugcuccaacuccagacugga

SEQ ID NO: 330676 - RNA, 18 nt, Human
cuaaagaagaguucccac

SEQ ID NO: 330677 - RNA, 19 nt, Human
cucauggcccaucagggca

SEQ ID NO: 330678 - RNA, 24 nt, Human
cuccaacuccagacuggaaaaggg

SEQ ID NO: 330679 - RNA, 21 nt, Human
cuccccagcaucucauggccg

SEQ ID NO: 330680 - RNA, 27 nt, Human
cuccuugcuccaacuccagacuggaaa

SEQ ID NO: 330681 - RNA, 23 nt, Human
cugccaugcuuuguaagcucagg

SEQ ID NO: 330682 - RNA, 18 nt, Human
cuguuggucauggguaaa

SEQ ID NO: 330683 - RNA, 22 nt, Human
cuuguauauauuauuaaaacaa

SEQ ID NO: 330684 - RNA, 23 nt, Human
gaacagcacaaccggcuccagug

SEQ ID NO: 330685 - RNA, 20 nt, Human
gccaugcuuuguaagcucag

SEQ ID NO: 330686 - RNA, 20 nt, Human
gcccuaaagaagaguuccca

SEQ ID NO: 330687 - RNA, 23 nt, Human
ggagugccuagugcaauuuucuc

SEQ ID NO: 330688 - RNA, 20 nt, Human
gggcuggagucagucccugc

SEQ ID NO: 330689 - RNA, 20 nt, Human
guucccacaugcacccacug

SEQ ID NO: 330690 - RNA, 22 nt, Human
guuggucauggguaaagguuuc

SEQ ID NO: 330691 - RNA, 25 nt, Human
uaagcucaggagcccacaggaguca

SEQ ID NO: 330692 - RNA, 22 nt, Human
uacaucccaaaguucuugaaag

SEQ ID NO: 330693 - RNA, 22 nt, Human
uagugcaauuuucuccuugcuc

SEQ ID NO: 330694 - RNA, 20 nt, Human
ucaauuuucucucguccuca

SEQ ID NO: 330695 - RNA, 22 nt, Human
ucaggggcacugugauuugaug

SEQ ID NO: 330696 - RNA, 23 nt, Human
ucaggggcacugugauuugaugg

SEQ ID NO: 330697 - RNA, 21 nt, Human
ucauggacuucccccauuuuu

SEQ ID NO: 330698 - RNA, 18 nt, Human
uccaagggcuggagucag

SEQ ID NO: 330699 - RNA, 19 nt, Human
uccaagggcuggagucagu

SEQ ID NO: 330700 - RNA, 21 nt, Human
uccagacuggaaaagggugaa

SEQ ID NO: 330701 - RNA, 23 nt, Human
uccagacuggaaaagggugaaac

SEQ ID NO: 330702 - RNA, 22 nt, Human
uccccagcaucucauggcccau

SEQ ID NO: 330703 - RNA, 24 nt, Human
uccccccggacucuguuuaggaau

SEQ ID NO: 330704 - RNA, 24 nt, Human
ucuccccaccccaggcauaaacag

SEQ ID NO: 330705 - RNA, 21 nt, Human
ugaaagugccuguggacaaga

SEQ ID NO: 330706 - RNA, 18 nt, Human
ugagagaacagcacaacc

SEQ ID NO: 330707 - RNA, 20 nt, Human
ugauucauggacuuccccca

SEQ ID NO: 330708 - RNA, 23 nt, Human
ugauuugauggguguguacagcu

SEQ ID NO: 330709 - RNA, 21 nt, Human
uggagucagucccugcccugg

SEQ ID NO: 330710 - RNA, 18 nt, Human
ugguagacaagaaaacca

SEQ ID NO: 330711 - RNA, 28 nt, Human
ugugcgaaugagucacgcacgcagugug

SEQ ID NO: 330712 - RNA, 24 nt, Human
uguggucgaggcccuuggccugcc

SEQ ID NO: 330713 - RNA, 21 nt, Human
uguuggucauggguaaagguu

SEQ ID NO: 330714 - RNA, 21 nt, Human
uuacuguuggucauggguaaa

SEQ ID NO: 330715 - RNA, 23 nt, Human
uucaaaaucuccauggggucguc

SEQ ID NO: 330716 - RNA, 18 nt, Human
uuccuuuucuucuccgug

SEQ ID NO: 330717 - RNA, 21 nt, Human
uucuccuugcuccaacuccag

SEQ ID NO: 330718 - RNA, 22 nt, Human
uuuacuugcuuuuuaaaaaaac

SEQ ID NO: 330719 - RNA, 20 nt, Human
uuuccccccggacucuguuu

SEQ ID NO: 330720 - RNA, 18 nt, Human
uuugauggguguguacag

SEQ ID NO: 330721 - RNA, 21 nt, Human
uuuugcugauucauggacuuc

SEQ ID NO: 330722 - RNA, 22 nt, Human
uuuuuuuuuuuuuuuugcugau

SEQ ID NO: 330723 - RNA, 20 nt, Human
uuuuuuuuuuuuuuuuugcu

SEQ ID NO: 330724 - RNA, 23 nt, Human
uuuuuuuuuuuuuuuuuugcuga

SEQ ID NO: 330725 - RNA, 20 nt, Human
uuuuuuuuuuuuuuuuuugg

SEQ ID NO: 330726 - RNA, 23 nt, Human
aaagugaggugccaggccaccga

SEQ ID NO: 330727 - RNA, 23 nt, Human
aaauccuuuucagguacauuucc

SEQ ID NO: 330728 - RNA, 20 nt, Human
caaagccagugugcucacuc

SEQ ID NO: 330729 - RNA, 22 nt, Human
caaagugaggugccaggccacc

SEQ ID NO: 330730 - RNA, 22 nt, Human
cgcagccaggcagugccggggc

SEQ ID NO: 330731 - RNA, 19 nt, Human
cuccggggccguccgaggg

SEQ ID NO: 330732 - RNA, 18 nt, Human
cugcaggccuuccaggau

SEQ ID NO: 330733 - RNA, 21 nt, Human
gccaggccaccgagcguaggg

SEQ ID NO: 330734 - RNA, 20 nt, Human
ggccauuuugugguggugug

SEQ ID NO: 330735 - RNA, 22 nt, Human
ucccaggguuuucuaaaauccu

SEQ ID NO: 330736 - RNA, 19 nt, Human
uccugccccgcccccugca

SEQ ID NO: 330737 - RNA, 21 nt, Human
ugaggugccaggccaccgagc

SEQ ID NO: 330738 - RNA, 25 nt, Human
ugccccgcccccugcaggccuucca

SEQ ID NO: 330739 - RNA, 25 nt, Human
ugccggggcucagcagcauccuccg

SEQ ID NO: 330740 - RNA, 31 nt, Human
ugguggguuucccaggguuuucuaaaauccu

SEQ ID NO: 330741 - RNA, 22 nt, Human
ugguggugugguggguuuccca

SEQ ID NO: 330742 - RNA, 21 nt, Human
uuccugccccgcccccugcag

SEQ ID NO: 330743 - RNA, 22 nt, Human
uuuccugccccgcccccugcag

SEQ ID NO: 330744 - RNA, 18 nt, Human
acaaagagaacguccacg

SEQ ID NO: 330745 - RNA, 20 nt, Human
acacccuccuccugaggcuu

SEQ ID NO: 330746 - RNA, 19 nt, Human
accgaaccggggccccaac

SEQ ID NO: 330747 - RNA, 20 nt, Human
accgcgcugcuccagccgcc

SEQ ID NO: 330748 - RNA, 21 nt, Human
aggaggagagagggaggagag

SEQ ID NO: 330749 - RNA, 22 nt, Human
augcaggcacagaaaaaaggga

SEQ ID NO: 330750 - RNA, 19 nt, Human
cacacaaagagaacgucca

SEQ ID NO: 330751 - RNA, 20 nt, Human
caccaacacaaagccaggga

SEQ ID NO: 330752 - RNA, 19 nt, Human
cagccgccgccgcgccucg

SEQ ID NO: 330753 - RNA, 21 nt, Human
cagcucggaggcaccaacaca

SEQ ID NO: 330754 - RNA, 22 nt, Human
ccccaaccccccuugagggcuc

SEQ ID NO: 330755 - RNA, 26 nt, Human
ccccaaccccccuugagggcuccucu

SEQ ID NO: 330756 - RNA, 19 nt, Human
cccccggaccgaaccgggg

SEQ ID NO: 330757 - RNA, 22 nt, Human
ccccggaccgaaccggggcccc

SEQ ID NO: 330758 - RNA, 22 nt, Human
ccgaaccggggccccaaccccc

SEQ ID NO: 330759 - RNA, 21 nt, Human
ccgccgccgcgccucggccca

SEQ ID NO: 330760 - RNA, 24 nt, Human
ccgccgcgccucggcccacacccu

SEQ ID NO: 330761 - RNA, 23 nt, Human
ccuccuccagcgcacccuccuug

SEQ ID NO: 330762 - RNA, 21 nt, Human
cgagccccgagccuucugccu

SEQ ID NO: 330763 - RNA, 19 nt, Human
cgcacccuccuugcagcuc

SEQ ID NO: 330764 - RNA, 21 nt, Human
cgcucgaggcgagcgagcucu

SEQ ID NO: 330765 - RNA, 20 nt, Human
cgcugcuccagccgccgccg

SEQ ID NO: 330766 - RNA, 19 nt, Human
cggaggcaccaacacaaag

SEQ ID NO: 330767 - RNA, 22 nt, Human
cggaggcaccaacacaaagcca

SEQ ID NO: 330768 - RNA, 19 nt, Human
gaaccggggccccaacccc

SEQ ID NO: 330769 - RNA, 25 nt, Human
gcacagaaaaaagggaaagaaaaaa

SEQ ID NO: 330770 - RNA, 20 nt, Human
gccccccuccuccuccucca

SEQ ID NO: 330771 - RNA, 18 nt, Human
gccccgagccuucugccu

SEQ ID NO: 330772 - RNA, 21 nt, Human
gcgugugugugugcgcgcgug

SEQ ID NO: 330773 - RNA, 23 nt, Human
gcgugugugugugcgcgcgugug

SEQ ID NO: 330774 - RNA, 18 nt, Human
ggaccgaaccggggcccc

SEQ ID NO: 330775 - RNA, 23 nt, Human
ggaccggaugcucuggcgaagga

SEQ ID NO: 330776 - RNA, 19 nt, Human
ggagaggaggagagaggga

SEQ ID NO: 330777 - RNA, 27 nt, Human
ggcacagaaaaaagggaaagaaaaaac

SEQ ID NO: 330778 - RNA, 24 nt, Human
ggggugccucucacuccgggcccc

SEQ ID NO: 330779 - RNA, 24 nt, Human
gugugugugcgcgcguguguguga

SEQ ID NO: 330780 - RNA, 21 nt, Human
uaccgcgcugcuccagccgcc

SEQ ID NO: 330781 - RNA, 23 nt, Human
uaugcaggcacagaaaaaaggga

SEQ ID NO: 330782 - RNA, 24 nt, Human
uaugcaggcacagaaaaaagggaa

SEQ ID NO: 330783 - RNA, 18 nt, Human
ucacuccgggccccccuc

SEQ ID NO: 330784 - RNA, 21 nt, Human
uccgggccccccuccuccucc

SEQ ID NO: 330785 - RNA, 19 nt, Human
uccuccagcgcacccuccu

SEQ ID NO: 330786 - RNA, 18 nt, Human
ugcaggcacagaaaaaag

SEQ ID NO: 330787 - RNA, 18 nt, Human
ugccugugugcgcccucg

SEQ ID NO: 330788 - RNA, 25 nt, Human
ugcgugcgccggcaccgugugcgcg

SEQ ID NO: 330789 - RNA, 18 nt, Human
ugugcgcgcgcgcgcgug

SEQ ID NO: 330790 - RNA, 18 nt, Human
ugugcgcgcgugugugug

SEQ ID NO: 330791 - RNA, 21 nt, Human
ugugugcgcgcgugugugugu

SEQ ID NO: 330792 - RNA, 22 nt, Human
ugugugcgcgcgugugugugug

SEQ ID NO: 330793 - RNA, 21 nt, Human
uguguguccgcccgugugugc

SEQ ID NO: 330794 - RNA, 20 nt, Human
ugugugugcgcgcgugugug

SEQ ID NO: 330795 - RNA, 21 nt, Human
ugugugugcgcgcgugugugu

SEQ ID NO: 330796 - RNA, 21 nt, Human
uguguguguccgcccgugugu

SEQ ID NO: 330797 - RNA, 25 nt, Human
ugugugugugcgcgcgugugugugu

SEQ ID NO: 330798 - RNA, 28 nt, Human
uguguguguguccgcccgugugugcgug

SEQ ID NO: 330799 - RNA, 22 nt, Human
uuaucuuguauuuauaucguuu

SEQ ID NO: 330800 - RNA, 22 nt, Human
aaaacaacaaacaagccaucaa

SEQ ID NO: 330801 - RNA, 22 nt, Human
aaacaacaaacaagccaucaac

SEQ ID NO: 330802 - RNA, 18 nt, Human
aaaggccugagugguugu

SEQ ID NO: 330803 - RNA, 19 nt, Human
aacauggagaaaccccauc

SEQ ID NO: 330804 - RNA, 20 nt, Human
aacauggagaaaccccaucu

SEQ ID NO: 330805 - RNA, 21 nt, Human
aacauggagaaaccccaucuc

SEQ ID NO: 330806 - RNA, 19 nt, Human
aacauggugaaaccucucu

SEQ ID NO: 330807 - RNA, 20 nt, Human
aacauggugaaaccucucuc

SEQ ID NO: 330808 - RNA, 19 nt, Human
aaccuggucuuccuaaugg

SEQ ID NO: 330809 - RNA, 20 nt, Human
aacuacaagaauggccacug

SEQ ID NO: 330810 - RNA, 25 nt, Human
aagagcuaaaagcuggacacaagcc

SEQ ID NO: 330811 - RNA, 19 nt, Human
aagcuuaugcccagcaaac

SEQ ID NO: 330812 - RNA, 18 nt, Human
aagcuugcagugagccaa

SEQ ID NO: 330813 - RNA, 18 nt, Human
aauuagccaggcauggug

SEQ ID NO: 330814 - RNA, 19 nt, Human
acaacagaaaacucccagg

SEQ ID NO: 330815 - RNA, 19 nt, Human
acaagccaucaacacuggc

SEQ ID NO: 330816 - RNA, 19 nt, Human
acaagggugaaacuccauc

SEQ ID NO: 330817 - RNA, 20 nt, Human
acaagggugaaacuccaucu

SEQ ID NO: 330818 - RNA, 23 nt, Human
acaccacacccacccccgcaaac

SEQ ID NO: 330819 - RNA, 26 nt, Human
acagagguggggguguacgugaggca

SEQ ID NO: 330820 - RNA, 21 nt, Human
accacacccacccccgcaaac

SEQ ID NO: 330821 - RNA, 23 nt, Human
accacagugccugcacuggcccg

SEQ ID NO: 330822 - RNA, 24 nt, Human
accccaucucuacuaaaaauacaa

SEQ ID NO: 330823 - RNA, 25 nt, Human
acuccagccugggcaacaaggguga

SEQ ID NO: 330824 - RNA, 20 nt, Human
acugugcccuggagcugagc

SEQ ID NO: 330825 - RNA, 24 nt, Human
acuuugggaggccgaggugggcag

SEQ ID NO: 330826 - RNA, 21 nt, Human
agaaccauaaguccugcugac

SEQ ID NO: 330827 - RNA, 21 nt, Human
agagguggggguguacgugag

SEQ ID NO: 330828 - RNA, 18 nt, Human
agagguugcacugagccg

SEQ ID NO: 330829 - RNA, 23 nt, Human
agagguugcacugagccgagauu

SEQ ID NO: 330830 - RNA, 24 nt, Human
agcacuuugggaggccgaggcggg

SEQ ID NO: 330831 - RNA, 24 nt, Human
agcacuuugggaggccgagguggg

SEQ ID NO: 330832 - RNA, 23 nt, Human
agccaggcaugguggugcaugcc

SEQ ID NO: 330833 - RNA, 22 nt, Human
agccaggugacaggagccuggg

SEQ ID NO: 330834 - RNA, 22 nt, Human
agccggauggcccgcggcuggg

SEQ ID NO: 330835 - RNA, 25 nt, Human
agccugggcaacaagggugaaacuc

SEQ ID NO: 330836 - RNA, 19 nt, Human
agccugggugacagagacu

SEQ ID NO: 330837 - RNA, 21 nt, Human
aggagcucacucuggugaaaa

SEQ ID NO: 330838 - RNA, 22 nt, Human
aggaggcgguguuggagacagg

SEQ ID NO: 330839 - RNA, 19 nt, Human
aggcaaaggcgcagagucc

SEQ ID NO: 330840 - RNA, 21 nt, Human
aggcagagguugcacugagcc

SEQ ID NO: 330841 - RNA, 24 nt, Human
aggcagagguugcacugagccgag

SEQ ID NO: 330842 - RNA, 22 nt, Human
aggcaggagaaucgcuucaacc

SEQ ID NO: 330843 - RNA, 24 nt, Human
aggcaggagaaucgcuucaaccug

SEQ ID NO: 330844 - RNA, 25 nt, Human
aggcaggagaaucgcuucaaccugg

SEQ ID NO: 330845 - RNA, 24 nt, Human
aggcaggagaauggcaugaacccg

SEQ ID NO: 330846 - RNA, 22 nt, Human
aggcaguauguccagaaggagc

SEQ ID NO: 330847 - RNA, 24 nt, Human
aggcaugguggugcaugccuguaa

SEQ ID NO: 330848 - RNA, 23 nt, Human
aggccgaggcgggcagaucacga

SEQ ID NO: 330849 - RNA, 21 nt, Human
aggccgaggugggcaggucac

SEQ ID NO: 330850 - RNA, 23 nt, Human
aggcgggcagaucacgaggucag

SEQ ID NO: 330851 - RNA, 24 nt, Human
aggcgggcagaucacgaggucaga

SEQ ID NO: 330852 - RNA, 20 nt, Human
aggcugaggcaggagaaucg

SEQ ID NO: 330853 - RNA, 20 nt, Human
aggcugaggcaggagaaucg

SEQ ID NO: 330854 - RNA, 19 nt, Human
aggcugaggcaggagaaug

SEQ ID NO: 330855 - RNA, 24 nt, Human
aggcugcauuuaguggaccaggcu

SEQ ID NO: 330856 - RNA, 28 nt, Human
aggcuggggaauguguggggggagcacc

SEQ ID NO: 330857 - RNA, 21 nt, Human
agggagaggccuuggcgccag

SEQ ID NO: 330858 - RNA, 18 nt, Human
agggauggagaggcagca

SEQ ID NO: 330859 - RNA, 24 nt, Human
aggggaagcuugcagugagccaag

SEQ ID NO: 330860 - RNA, 25 nt, Human
aggggcgcagcuaaugugguggggg

SEQ ID NO: 330861 - RNA, 25 nt, Human
aggugccagagauagcccuucagcc

SEQ ID NO: 330862 - RNA, 24 nt, Human
aucgugccauugcacuccagccug

SEQ ID NO: 330863 - RNA, 21 nt, Human
aucucaaaaaaaaaaaaaaag

SEQ ID NO: 330864 - RNA, 20 nt, Human
augacccugcaaauggacug

SEQ ID NO: 330865 - RNA, 24 nt, Human
auuacgccauugcacuccagccug

SEQ ID NO: 330866 - RNA, 24 nt, Human
auugcacuccagccugggcaacaa

SEQ ID NO: 330867 - RNA, 25 nt, Human
auugcacuccagccugggcaacaag

SEQ ID NO: 330868 - RNA, 21 nt, Human
auugcacuccagccuggguga

SEQ ID NO: 330869 - RNA, 24 nt, Human
auugcacuccagccugggugacag

SEQ ID NO: 330870 - RNA, 19 nt, Human
auuuuguccauuguccucc

SEQ ID NO: 330871 - RNA, 24 nt, Human
caagaauggccacugcagcaccau

SEQ ID NO: 330872 - RNA, 24 nt, Human
caagaucgugccauugcacuccag

SEQ ID NO: 330873 - RNA, 19 nt, Human
caccacagugccugcacug

SEQ ID NO: 330874 - RNA, 24 nt, Human
caccacagugccugcacuggcccg

SEQ ID NO: 330875 - RNA, 24 nt, Human
cacccuuguaaucccagcacuuug

SEQ ID NO: 330876 - RNA, 21 nt, Human
cacggaccaggagggcaggac

SEQ ID NO: 330877 - RNA, 18 nt, Human
cacuaaacauacaacccc

SEQ ID NO: 330878 - RNA, 21 nt, Human
cacuaaacauacaaccccuuu

SEQ ID NO: 330879 - RNA, 20 nt, Human
cacuccagccugggcaacaa

SEQ ID NO: 330880 - RNA, 23 nt, Human
cacuccagccugggcaacaaggg

SEQ ID NO: 330881 - RNA, 25 nt, Human
cacuccagccugggcaacaagggug

SEQ ID NO: 330882 - RNA, 18 nt, Human
cacuccagccugggugac

SEQ ID NO: 330883 - RNA, 22 nt, Human
cacuccagccugggugacagag

SEQ ID NO: 330884 - RNA, 22 nt, Human
cacugugacggauccuggggac

SEQ ID NO: 330885 - RNA, 18 nt, Human
cagaaggagcucacucug

SEQ ID NO: 330886 - RNA, 22 nt, Human
cagagcuugggcuccagucucc

SEQ ID NO: 330887 - RNA, 24 nt, Human
cagcacuuugggaggccgaggcgg

SEQ ID NO: 330888 - RNA, 22 nt, Human
cagcacuuugggaggccgaggu

SEQ ID NO: 330889 - RNA, 24 nt, Human
cagcacuuugggaggccgaggugg

SEQ ID NO: 330890 - RNA, 19 nt, Human
cagcaugagugccagagga

SEQ ID NO: 330891 - RNA, 24 nt, Human
cagccugaccaacauggagaaacc

SEQ ID NO: 330892 - RNA, 24 nt, Human
cagcuacucgggaggcugaggcag

SEQ ID NO: 330893 - RNA, 24 nt, Human
cagcuacuugggaggcugaggcag

SEQ ID NO: 330894 - RNA, 20 nt, Human
caggagucugagagcagccu

SEQ ID NO: 330895 - RNA, 24 nt, Human
caggccuguaaucccagcacuuug

SEQ ID NO: 330896 - RNA, 22 nt, Human
cagggcagcugcagugugccag

SEQ ID NO: 330897 - RNA, 24 nt, Human
caggucaccugagaucaggagucu

SEQ ID NO: 330898 - RNA, 20 nt, Human
caggucuaagagacauuuug

SEQ ID NO: 330899 - RNA, 20 nt, Human
caggugcugacuuugacaag

SEQ ID NO: 330900 - RNA, 20 nt, Human
caucagggagaggccuuggc

SEQ ID NO: 330901 - RNA, 19 nt, Human
caugaaaacugggcgcugc

SEQ ID NO: 330902 - RNA, 24 nt, Human
caugccuguaaucccagcuacuug

SEQ ID NO: 330903 - RNA, 21 nt, Human
cauggacaccauuacaaaggu

SEQ ID NO: 330904 - RNA, 18 nt, Human
cauugcacuccagccugg

SEQ ID NO: 330905 - RNA, 19 nt, Human
cauugcacuccagccuggg

SEQ ID NO: 330906 - RNA, 19 nt, Human
cauugcacuccagccuggg

SEQ ID NO: 330907 - RNA, 21 nt, Human
cauugcacuccagccugggca

SEQ ID NO: 330908 - RNA, 24 nt, Human
cauugcacuccagccugggcaaca

SEQ ID NO: 330909 - RNA, 21 nt, Human
cauugcacuccagccugggug

SEQ ID NO: 330910 - RNA, 22 nt, Human
cauugcacuccagccuggguga

SEQ ID NO: 330911 - RNA, 24 nt, Human
cauugcacuccagccugggugaca

SEQ ID NO: 330912 - RNA, 24 nt, Human
cauugcacuccagccugggugaca

SEQ ID NO: 330913 - RNA, 24 nt, Human
ccacagucacggaaauuccugucc

SEQ ID NO: 330914 - RNA, 20 nt, Human
ccauccacaugaaaacuggg

SEQ ID NO: 330915 - RNA, 20 nt, Human
ccauugcacuccagccuggg

SEQ ID NO: 330916 - RNA, 20 nt, Human
ccauugcacuccagccuggg

SEQ ID NO: 330917 - RNA, 21 nt, Human
ccauugcacuccagccugggc

SEQ ID NO: 330918 - RNA, 23 nt, Human
ccauugcacuccagccugggcaa

SEQ ID NO: 330919 - RNA, 24 nt, Human
ccauugcacuccagccugggcaac

SEQ ID NO: 330920 - RNA, 21 nt, Human
ccauugcacuccagccugggu

SEQ ID NO: 330921 - RNA, 21 nt, Human
ccauugcacuccagccugggu

SEQ ID NO: 330922 - RNA, 22 nt, Human
ccauugcacuccagccugggug

SEQ ID NO: 330923 - RNA, 24 nt, Human
ccauugcacuccagccugggugac

SEQ ID NO: 330924 - RNA, 20 nt, Human
cccgccgcccaaaagaaaac

SEQ ID NO: 330925 - RNA, 21 nt, Human
cccuggagcugagcccggugg

SEQ ID NO: 330926 - RNA, 24 nt, Human
cccuuguaaucccagcacuuuggg

SEQ ID NO: 330927 - RNA, 23 nt, Human
ccuaggacagcugugcagucugc

SEQ ID NO: 330928 - RNA, 24 nt, Human
ccugaccaacauggagaaacccca

SEQ ID NO: 330929 - RNA, 23 nt, Human
ccugagaucaggagucugagagc

SEQ ID NO: 330930 - RNA, 19 nt, Human
ccugcacuggcccgguggu

SEQ ID NO: 330931 - RNA, 18 nt, Human
ccuggcuaacauggugaa

SEQ ID NO: 330932 - RNA, 21 nt, Human
ccuggcuaacauggugaaacc

SEQ ID NO: 330933 - RNA, 21 nt, Human
ccuggcuaacauggugaaacc

SEQ ID NO: 330934 - RNA, 23 nt, Human
ccuggcuaacauggugaaaccuc

SEQ ID NO: 330935 - RNA, 25 nt, Human
ccugggaggcagagguugcacugag

SEQ ID NO: 330936 - RNA, 24 nt, Human
ccuggucuuccuaauggaccccaa

SEQ ID NO: 330937 - RNA, 22 nt, Human
ccuguaaucccagcacuuuggg

SEQ ID NO: 330938 - RNA, 21 nt, Human
ccuguaaucccagcuacuugg

SEQ ID NO: 330939 - RNA, 19 nt, Human
ccuguagucccagcuacuc

SEQ ID NO: 330940 - RNA, 21 nt, Human
ccuguagucccagcuacucgg

SEQ ID NO: 330941 - RNA, 22 nt, Human
ccuguagucccagcuacucggg

SEQ ID NO: 330942 - RNA, 27 nt, Human
ccuucagccagaacaggucuaagagac

SEQ ID NO: 330943 - RNA, 18 nt, Human
ccuuccacgcaggcucca

SEQ ID NO: 330944 - RNA, 18 nt, Human
ccuuguaaucccagcacu

SEQ ID NO: 330945 - RNA, 24 nt, Human
cgagaccauccuggcuaacauggu

SEQ ID NO: 330946 - RNA, 24 nt, Human
cgagauuacgccauugcacuccag

SEQ ID NO: 330947 - RNA, 27 nt, Human
cgaggcgggcagaucacgaggucagau

SEQ ID NO: 330948 - RNA, 19 nt, Human
cgaggugggcaggucaccu

SEQ ID NO: 330949 - RNA, 24 nt, Human
cgccauugcacuccagccugggca

SEQ ID NO: 330950 - RNA, 23 nt, Human
cggaggccuuccacgcaggcucc

SEQ ID NO: 330951 - RNA, 23 nt, Human
cuagugcccaaccugcaacggac

SEQ ID NO: 330952 - RNA, 23 nt, Human
cuauaacuacaagaauggccacu

SEQ ID NO: 330953 - RNA, 24 nt, Human
cucacccuuguaaucccagcacuu

SEQ ID NO: 330954 - RNA, 24 nt, Human
cucaggccuguaaucccagcacuu

SEQ ID NO: 330955 - RNA, 21 nt, Human
cuccaucccgccgcccaaaag

SEQ ID NO: 330956 - RNA, 19 nt, Human
cuccaucucaaaaaaaaaa

SEQ ID NO: 330957 - RNA, 19 nt, Human
cucccagggggaauggcag

SEQ ID NO: 330958 - RNA, 25 nt, Human
cucuguccaucuguguguccuucca

SEQ ID NO: 330959 - RNA, 19 nt, Human
cugaagcucugagacccag

SEQ ID NO: 330960 - RNA, 20 nt, Human
gaacccggaaggggaagcuu

SEQ ID NO: 330961 - RNA, 18 nt, Human
gacgcaggaguuugcagu

SEQ ID NO: 330962 - RNA, 23 nt, Human
gacgcgguggcucaggccuguaa

SEQ ID NO: 330963 - RNA, 18 nt, Human
gagaggcagcagugggca

SEQ ID NO: 330964 - RNA, 21 nt, Human
gagaggcagcagugggcacag

SEQ ID NO: 330965 - RNA, 21 nt, Human
gagcugagcccgguggguggg

SEQ ID NO: 330966 - RNA, 25 nt, Human
gaggugggcaggucaccugagauca

SEQ ID NO: 330967 - RNA, 24 nt, Human
gaucgcugggaaagagugcagggu

SEQ ID NO: 330968 - RNA, 20 nt, Human
gauggcccgcggcuggggag

SEQ ID NO: 330969 - RNA, 20 nt, Human
gcagagcuugggcuccaguc

SEQ ID NO: 330970 - RNA, 22 nt, Human
gcagcugcagugugccaggccc

SEQ ID NO: 330971 - RNA, 19 nt, Human
gccauugcacuccagccug

SEQ ID NO: 330972 - RNA, 22 nt, Human
gccauugcacuccagccugggc

SEQ ID NO: 330973 - RNA, 24 nt, Human
gccauugcacuccagccugggcaa

SEQ ID NO: 330974 - RNA, 24 nt, Human
gccauugcacuccagccuggguga

SEQ ID NO: 330975 - RNA, 19 nt, Human
gcccgaaggggcaagggaa

SEQ ID NO: 330976 - RNA, 18 nt, Human
gcccgaccacaggcugca

SEQ ID NO: 330977 - RNA, 23 nt, Human
gcccgguggguggguggagggac

SEQ ID NO: 330978 - RNA, 21 nt, Human
gccucuccuucaggugcugac

SEQ ID NO: 330979 - RNA, 18 nt, Human
gccuggggcuguggggcu

SEQ ID NO: 330980 - RNA, 20 nt, Human
gccuguaaucccagcuacuu

SEQ ID NO: 330981 - RNA, 23 nt, Human
gcuaacauggugaaaccucucuc

SEQ ID NO: 330982 - RNA, 21 nt, Human
ggagccuggggcuguggggcc

SEQ ID NO: 330983 - RNA, 18 nt, Human
ggaggccggacgcggugg

SEQ ID NO: 330984 - RNA, 21 nt, Human
ggaggccuuccacgcaggcuc

SEQ ID NO: 330985 - RNA, 24 nt, Human
ggcagaaggacagugaggccugaa

SEQ ID NO: 330986 - RNA, 23 nt, Human
ggcaugguggcucacccuuguaa

SEQ ID NO: 330987 - RNA, 23 nt, Human
ggccuguaaucccagcacuuugg

SEQ ID NO: 330988 - RNA, 19 nt, Human
gggaagcuugcagugagcc

SEQ ID NO: 330989 - RNA, 21 nt, Human
gggaaugaauagaaaaagaug

SEQ ID NO: 330990 - RNA, 19 nt, Human
gggcagaucacgaggucag

SEQ ID NO: 330991 - RNA, 24 nt, Human
ggggaauggcagguggccucuccu

SEQ ID NO: 330992 - RNA, 21 nt, Human
ggggcaagggaagggagcugu

SEQ ID NO: 330993 - RNA, 23 nt, Human
ggggcgcagcuaauguggugggg

SEQ ID NO: 330994 - RNA, 24 nt, Human
gguggcucacccuuguaaucccag

SEQ ID NO: 330995 - RNA, 23 nt, Human
gguggcucaggccuguaauccca

SEQ ID NO: 330996 - RNA, 24 nt, Human
gguggcucaggccuguaaucccag

SEQ ID NO: 330997 - RNA, 24 nt, Human
gguggugcaugccuguaaucccag

SEQ ID NO: 330998 - RNA, 22 nt, Human
gguugacugcugaugugggcca

SEQ ID NO: 330999 - RNA, 20 nt, Human
guccauuguccuccagaggu

SEQ ID NO: 331000 - RNA, 18 nt, Human
gugacagagacuccaucc

SEQ ID NO: 331001 - RNA, 23 nt, Human
guggcucaggccuguaaucccag

SEQ ID NO: 331002 - RNA, 19 nt, Human
gugguuguucugcacaucc

SEQ ID NO: 331003 - RNA, 23 nt, Human
guucacacuaaacauacaacccc

SEQ ID NO: 331004 - RNA, 21 nt, Human
guugcacugagccgagauuac

SEQ ID NO: 331005 - RNA, 20 nt, Human
uaaaaauacaaaauuagcca

SEQ ID NO: 331006 - RNA, 22 nt, Human
uaaaaauacaaaauuagccagg

SEQ ID NO: 331007 - RNA, 23 nt, Human
uaaaaauacaaaauuagccaggc

SEQ ID NO: 331008 - RNA, 23 nt, Human
uaaaaauauaaaaaauuagccug

SEQ ID NO: 331009 - RNA, 23 nt, Human
uaacagcuggacaccacacccac

SEQ ID NO: 331010 - RNA, 21 nt, Human
uaacauggugaaaccucucuc

SEQ ID NO: 331011 - RNA, 23 nt, Human
uaacauggugaaaccucucucua

SEQ ID NO: 331012 - RNA, 21 nt, Human
uaagagguguauaggccaaug

SEQ ID NO: 331013 - RNA, 21 nt, Human
uagccaggugacaggagccug

SEQ ID NO: 331014 - RNA, 22 nt, Human
uaggccaaugagagagggaugg

SEQ ID NO: 331015 - RNA, 18 nt, Human
uaugcccagcaaaccugg

SEQ ID NO: 331016 - RNA, 21 nt, Human
uauuuuauaugcuuuguacug

SEQ ID NO: 331017 - RNA, 19 nt, Human
ucaaaaaaaaaaaaaaagu

SEQ ID NO: 331018 - RNA, 22 nt, Human
ucaccugagaucaggagucuga

SEQ ID NO: 331019 - RNA, 24 nt, Human
ucacgaggucagaucaucgagacc

SEQ ID NO: 331020 - RNA, 18 nt, Human
ucagccagaacaggucua

SEQ ID NO: 331021 - RNA, 19 nt, Human
uccagccugggugacagag

SEQ ID NO: 331022 - RNA, 20 nt, Human
uccagccugggugacagaga

SEQ ID NO: 331023 - RNA, 19 nt, Human
uccaucccgccgcccaaaa

SEQ ID NO: 331024 - RNA, 23 nt, Human
uccaucucaaaaaaaaaaaaaaa

SEQ ID NO: 331025 - RNA, 22 nt, Human
ucccaggcagccaguggggccu

SEQ ID NO: 331026 - RNA, 23 nt, Human
ucccaggcagccaguggggccuu

SEQ ID NO: 331027 - RNA, 18 nt, Human
ucccagggggaauggcag

SEQ ID NO: 331028 - RNA, 18 nt, Human
ucccgccgcccaaaagaa

SEQ ID NO: 331029 - RNA, 19 nt, Human
ucccuaggaaggcaggcug

SEQ ID NO: 331030 - RNA, 23 nt, Human
ucccuaggaaggcaggcugccag

SEQ ID NO: 331031 - RNA, 23 nt, Human
ucgugccauugcacuccagccug

SEQ ID NO: 331032 - RNA, 20 nt, Human
ucucuacuaaaaauacaaaa

SEQ ID NO: 331033 - RNA, 22 nt, Human
ucucuacuaaaaauauaaaaaa

SEQ ID NO: 331034 - RNA, 18 nt, Human
ucugaaguccucuaaagg

SEQ ID NO: 331035 - RNA, 21 nt, Human
ugacaggagccuggggcugug

SEQ ID NO: 331036 - RNA, 18 nt, Human
ugagacccagaaccauaa

SEQ ID NO: 331037 - RNA, 18 nt, Human
ugagagagggauggagag

SEQ ID NO: 331038 - RNA, 24 nt, Human
ugagagcagccugaccaacaugga

SEQ ID NO: 331039 - RNA, 22 nt, Human
ugagccaagaucgugccauugc

SEQ ID NO: 331040 - RNA, 22 nt, Human
ugagccgagauuacgccauugc

SEQ ID NO: 331041 - RNA, 20 nt, Human
ugaggacgauuuaaucaagg

SEQ ID NO: 331042 - RNA, 24 nt, Human
ugaggcaggagaaucgcuucaacc

SEQ ID NO: 331043 - RNA, 23 nt, Human
ugaggcaggagaauggcaugaac

SEQ ID NO: 331044 - RNA, 24 nt, Human
ugaggcaggagaauggcaugaacc

SEQ ID NO: 331045 - RNA, 25 nt, Human
ugaggcaggagaauggcaugaaccc

SEQ ID NO: 331046 - RNA, 19 nt, Human
ugaguacgcaaagcuauaa

SEQ ID NO: 331047 - RNA, 19 nt, Human
ugcacuccagccugggcaa

SEQ ID NO: 331048 - RNA, 24 nt, Human
ugcacuccagccugggugacagag

SEQ ID NO: 331049 - RNA, 22 nt, Human
ugccaggcaguauguccagaag

SEQ ID NO: 331050 - RNA, 20 nt, Human
ugccuggaacacugugacgg

SEQ ID NO: 331051 - RNA, 19 nt, Human
ugccuggagucugggcggg

SEQ ID NO: 331052 - RNA, 20 nt, Human
ugccuggagucugggcgggg

SEQ ID NO: 331053 - RNA, 23 nt, Human
ugccuguaaucccagcuacuugg

SEQ ID NO: 331054 - RNA, 24 nt, Human
ugccuguaaucccagcuacuuggg

SEQ ID NO: 331055 - RNA, 24 nt, Human
ugccuguagucccagcuacucggg

SEQ ID NO: 331056 - RNA, 20 nt, Human
ugcuacaggaaggaggcucc

SEQ ID NO: 331057 - RNA, 21 nt, Human
ugcuggagacacuucaggggc

SEQ ID NO: 331058 - RNA, 18 nt, Human
uggacaccacacccaccc

SEQ ID NO: 331059 - RNA, 25 nt, Human
uggacaccacacccacccccgcaaa

SEQ ID NO: 331060 - RNA, 19 nt, Human
uggcaagagcuaaaagcug

SEQ ID NO: 331061 - RNA, 21 nt, Human
uggcucacccuuguaauccca

SEQ ID NO: 331062 - RNA, 22 nt, Human
uggcucacccuuguaaucccag

SEQ ID NO: 331063 - RNA, 24 nt, Human
uggcucacccuuguaaucccagca

SEQ ID NO: 331064 - RNA, 24 nt, Human
uggcucaggccuguaaucccagca

SEQ ID NO: 331065 - RNA, 20 nt, Human
ugggaggcagagguugcacu

SEQ ID NO: 331066 - RNA, 19 nt, Human
ugggaggccgaggcgggca

SEQ ID NO: 331067 - RNA, 20 nt, Human
ugggaggccgaggcgggcag

SEQ ID NO: 331068 - RNA, 24 nt, Human
ugggaggccgaggcgggcagauca

SEQ ID NO: 331069 - RNA, 20 nt, Human
ugggaggccgaggugggcag

SEQ ID NO: 331070 - RNA, 20 nt, Human
ugggaggccgaggugggcag

SEQ ID NO: 331071 - RNA, 24 nt, Human
ugggaggccgaggugggcagguca

SEQ ID NO: 331072 - RNA, 26 nt, Human
ugggaggccgaggugggcaggucacc

SEQ ID NO: 331073 - RNA, 19 nt, Human
ugggaggcugaggcaggag

SEQ ID NO: 331074 - RNA, 23 nt, Human
ugggaggcugaggcaggagaauc

SEQ ID NO: 331075 - RNA, 24 nt, Human
ugggcaggucaccugagaucagga

SEQ ID NO: 331076 - RNA, 24 nt, Human
uggucacacgugccuguaguccca

SEQ ID NO: 331077 - RNA, 21 nt, Human
uggugcaugccuguaauccca

SEQ ID NO: 331078 - RNA, 24 nt, Human
ugguggcucacccuuguaauccca

SEQ ID NO: 331079 - RNA, 24 nt, Human
ugguggugcaugccuguaauccca

SEQ ID NO: 331080 - RNA, 21 nt, Human
uguacgugaggcaguacagcu

SEQ ID NO: 331081 - RNA, 20 nt, Human
uguccauuguccuccagagg

SEQ ID NO: 331082 - RNA, 23 nt, Human
uguccauuguccuccagaggugc

SEQ ID NO: 331083 - RNA, 23 nt, Human
uguggaugagcauacugggcaga

SEQ ID NO: 331084 - RNA, 20 nt, Human
uguucugcacauccuggccc

SEQ ID NO: 331085 - RNA, 19 nt, Human
uuacaaagguccuaagagg

SEQ ID NO: 331086 - RNA, 23 nt, Human
uuacgccauugcacuccagccug

SEQ ID NO: 331087 - RNA, 25 nt, Human
uucaagggcugcagagugaguuacc

SEQ ID NO: 331088 - RNA, 26 nt, Human
uucaccuuguauuuuauaugcuuugu

SEQ ID NO: 331089 - RNA, 20 nt, Human
uugcacugagccgagauuac

SEQ ID NO: 331090 - RNA, 22 nt, Human
uugcagugagccaagaucgugc

SEQ ID NO: 331091 - RNA, 25 nt, Human
uugggaggccgaggcgggcagauca

SEQ ID NO: 331092 - RNA, 24 nt, Human
uugggaggcugaggcaggagaauc

SEQ ID NO: 331093 - RNA, 24 nt, Human
uuuguucacacuaaacauacaacc

SEQ ID NO: 331094 - RNA, 20 nt, Human
aaagagcuaacucagaggca

SEQ ID NO: 331095 - RNA, 21 nt, Human
aaagagcuaacucagaggcaa

SEQ ID NO: 331096 - RNA, 23 nt, Human
aaauauauauaauauauauuaca

SEQ ID NO: 331097 - RNA, 18 nt, Human
aagacaccagggcaaggu

SEQ ID NO: 331098 - RNA, 26 nt, Human
aagccaguccuuaacuugacagcuag

SEQ ID NO: 331099 - RNA, 20 nt, Human
aaugguaaaaauagaggcac

SEQ ID NO: 331100 - RNA, 19 nt, Human
agaggcauagaucuuuggc

SEQ ID NO: 331101 - RNA, 21 nt, Human
aggcacauauggaggcauguc

SEQ ID NO: 331102 - RNA, 18 nt, Human
augauggugaggaaagca

SEQ ID NO: 331103 - RNA, 24 nt, Human
cagugccgacuguggcccugcagg

SEQ ID NO: 331104 - RNA, 19 nt, Human
ccaaaaugguaaaaauaga

SEQ ID NO: 331105 - RNA, 24 nt, Human
ccaaaaugguaaaaauagaggcac

SEQ ID NO: 331106 - RNA, 21 nt, Human
ccagacaccagcaaaggugcc

SEQ ID NO: 331107 - RNA, 19 nt, Human
ccccacagcuugagucaga

SEQ ID NO: 331108 - RNA, 23 nt, Human
cccuuuuauuuuaagacuugagg

SEQ ID NO: 331109 - RNA, 18 nt, Human
cgacuguggcccugcagg

SEQ ID NO: 331110 - RNA, 23 nt, Human
cugauuaaaagaagcaaauaaca

SEQ ID NO: 331111 - RNA, 24 nt, Human
cugcaggauuuuggucagcuacau

SEQ ID NO: 331112 - RNA, 21 nt, Human
gaaaaaacagaggcauagagg

SEQ ID NO: 331113 - RNA, 24 nt, Human
gaaagcauagaaagaacauuugcu

SEQ ID NO: 331114 - RNA, 21 nt, Human
gaaagcuaacagaaaggcaca

SEQ ID NO: 331115 - RNA, 21 nt, Human
gagaauggaggucaucuuggg

SEQ ID NO: 331116 - RNA, 18 nt, Human
gccgagaauggaggucau

SEQ ID NO: 331117 - RNA, 23 nt, Human
gcuaacagaaaggcacauaugga

SEQ ID NO: 331118 - RNA, 18 nt, Human
gggcaaggugaaagccag

SEQ ID NO: 331119 - RNA, 22 nt, Human
ggugaggaaagcauagaaagaa

SEQ ID NO: 331120 - RNA, 19 nt, Human
uaauaggccugucaggcca

SEQ ID NO: 331121 - RNA, 20 nt, Human
uagaucuuuggcuugccaca

SEQ ID NO: 331122 - RNA, 21 nt, Human
uaggacaaggacaauauagcu

SEQ ID NO: 331123 - RNA, 24 nt, Human
uauauuacauguauagcauguaua

SEQ ID NO: 331124 - RNA, 18 nt, Human
ucagaggcaacucuuagg

SEQ ID NO: 331125 - RNA, 23 nt, Human
ucucucauugaaaaaacagaggc

SEQ ID NO: 331126 - RNA, 22 nt, Human
ugacagaaguuuguaacagacu

SEQ ID NO: 331127 - RNA, 24 nt, Human
ugauggugaggaaagcauagaaag

SEQ ID NO: 331128 - RNA, 23 nt, Human
ugccugaccagggaagcgcagcc

SEQ ID NO: 331129 - RNA, 23 nt, Human
uggaaaaagacaccagggcaagg

SEQ ID NO: 331130 - RNA, 19 nt, Human
ugguaaaaauagaggcaca

SEQ ID NO: 331131 - RNA, 19 nt, Human
uguauagcauguauagagg

SEQ ID NO: 331132 - RNA, 18 nt, Human
uuuggucagcuacaugac

SEQ ID NO: 331133 - RNA, 18 nt, Human
aaacccccaacagcggcc

SEQ ID NO: 331134 - RNA, 19 nt, Human
acagcacacccccccacca

SEQ ID NO: 331135 - RNA, 20 nt, Human
acaggaggggcagggcuugg

SEQ ID NO: 331136 - RNA, 23 nt, Human
acccacagcacacccccccacca

SEQ ID NO: 331137 - RNA, 21 nt, Human
acccccaacagcggccucggc

SEQ ID NO: 331138 - RNA, 20 nt, Human
aggaggggcagggcuugggg

SEQ ID NO: 331139 - RNA, 20 nt, Human
aggcgggggggggguucagg

SEQ ID NO: 331140 - RNA, 18 nt, Human
agggaagaggggaaaggg

SEQ ID NO: 331141 - RNA, 24 nt, Human
aggggucuugugcccguggcuggu

SEQ ID NO: 331142 - RNA, 26 nt, Human
auuuuaaaaaaaggcggggggggggg

SEQ ID NO: 331143 - RNA, 24 nt, Human
caauaaauaaauaaauagcuacaa

SEQ ID NO: 331144 - RNA, 20 nt, Human
caccaaaagagaaaacgggg

SEQ ID NO: 331145 - RNA, 22 nt, Human
cagcagcggcucaggccccugc

SEQ ID NO: 331146 - RNA, 18 nt, Human
caugaggucagaacaggu

SEQ ID NO: 331147 - RNA, 23 nt, Human
ccauugcccgaucagccugcuuu

SEQ ID NO: 331148 - RNA, 19 nt, Human
cccacagcacaccccccca

SEQ ID NO: 331149 - RNA, 21 nt, Human
cccacagcacacccccccacc

SEQ ID NO: 331150 - RNA, 23 nt, Human
cccacagcacacccccccaccaa

SEQ ID NO: 331151 - RNA, 27 nt, Human
cccaugguccacacagggaaaccccca

SEQ ID NO: 331152 - RNA, 19 nt, Human
ccccaccaaaagagaaaac

SEQ ID NO: 331153 - RNA, 22 nt, Human
ccccggugcguugauguggggc

SEQ ID NO: 331154 - RNA, 21 nt, Human
cccggguaguugggggaaggu

SEQ ID NO: 331155 - RNA, 21 nt, Human
ccuagcggcggugacuuuuuu

SEQ ID NO: 331156 - RNA, 21 nt, Human
ccucccauugcccgaucagcc

SEQ ID NO: 331157 - RNA, 20 nt, Human
cggcggcagcagcggcucag

SEQ ID NO: 331158 - RNA, 23 nt, Human
cggcggugacuuuuuugggggcc

SEQ ID NO: 331159 - RNA, 18 nt, Human
cgggggggggguucagga

SEQ ID NO: 331160 - RNA, 21 nt, Human
cugcgcggcggcggcggcagc

SEQ ID NO: 331161 - RNA, 20 nt, Human
gagacaccacagcugagugg

SEQ ID NO: 331162 - RNA, 20 nt, Human
gagcggugaguucacggggc

SEQ ID NO: 331163 - RNA, 18 nt, Human
gcacacccccccaccaaa

SEQ ID NO: 331164 - RNA, 21 nt, Human
gcaggccuggccaccucccau

SEQ ID NO: 331165 - RNA, 18 nt, Human
gccuggcaggccagacuc

SEQ ID NO: 331166 - RNA, 20 nt, Human
gcggcagcagcggcucaggc

SEQ ID NO: 331167 - RNA, 19 nt, Human
gcguugauguggggcugcg

SEQ ID NO: 331168 - RNA, 20 nt, Human
ggaaagggagugggauggcu

SEQ ID NO: 331169 - RNA, 19 nt, Human
ggaagguggggaagacagg

SEQ ID NO: 331170 - RNA, 22 nt, Human
ggcuuggggcgggcaggggagc

SEQ ID NO: 331171 - RNA, 18 nt, Human
gggagaggagccuggcag

SEQ ID NO: 331172 - RNA, 21 nt, Human
gggcggggggggggggggucc

SEQ ID NO: 331173 - RNA, 21 nt, Human
ggggcugcgcggcggcggcgg

SEQ ID NO: 331174 - RNA, 24 nt, Human
gggggggggggggucccagggugg

SEQ ID NO: 331175 - RNA, 24 nt, Human
gggggggggggucccaggguggug

SEQ ID NO: 331176 - RNA, 24 nt, Human
gugacuuuuuuggcgguggcggug

SEQ ID NO: 331177 - RNA, 29 nt, Human
guggggcugcgcggcggcggcggcagcaa

SEQ ID NO: 331178 - RNA, 23 nt, Human
uaaauaaauagcuacaauaauaa

SEQ ID NO: 331179 - RNA, 22 nt, Human
uacaauaauaaauaagggugac

SEQ ID NO: 331180 - RNA, 23 nt, Human
uagggugucaucuggccccucuu

SEQ ID NO: 331181 - RNA, 19 nt, Human
ucaggccccugcaguccuc

SEQ ID NO: 331182 - RNA, 19 nt, Human
ucuggugggcggggggggg

SEQ ID NO: 331183 - RNA, 22 nt, Human
ugaauacccacagcacaccccc

SEQ ID NO: 331184 - RNA, 23 nt, Human
ugacaggaccccggugcguugau

SEQ ID NO: 331185 - RNA, 21 nt, Human
ugacuuuuuuggcgguggcgg

SEQ ID NO: 331186 - RNA, 19 nt, Human
uggcaggccuggccaccuc

SEQ ID NO: 331187 - RNA, 19 nt, Human
ugggcgggggggggggggg

SEQ ID NO: 331188 - RNA, 19 nt, Human
uggggcugcgcggcggcgg

SEQ ID NO: 331189 - RNA, 20 nt, Human
uggggcugcgcggcggcggc

SEQ ID NO: 331190 - RNA, 24 nt, Human
uggugaauacccacagcacacccc

SEQ ID NO: 331191 - RNA, 20 nt, Human
ugucaugacaucuccuaagg

SEQ ID NO: 331192 - RNA, 24 nt, Human
uuuagggugucaucuggccccucu

SEQ ID NO: 331193 - RNA, 20 nt, Human
uuuuuuuuuuuugauggucc

SEQ ID NO: 331194 - RNA, 22 nt, Human
uuuuuuuuuuuuuuuuugaugg

SEQ ID NO: 331195 - RNA, 27 nt, Human
uuuuuuuuuuuuuuuuuuuuuuugggg

SEQ ID NO: 331196 - RNA, 20 nt, Human
aaacagagucuucuuuugua

SEQ ID NO: 331197 - RNA, 24 nt, Human
aaagugcugggauuacaggcguga

SEQ ID NO: 331198 - RNA, 19 nt, Human
aagugcugggauuacaggc

SEQ ID NO: 331199 - RNA, 19 nt, Human
aagugcugggauuacaggc

SEQ ID NO: 331200 - RNA, 26 nt, Human
aagugcugggauuacaggcgugagcc

SEQ ID NO: 331201 - RNA, 22 nt, Human
aauggaggaacucucauuuuaa

SEQ ID NO: 331202 - RNA, 25 nt, Human
acccgccucggccucccaaagugcu

SEQ ID NO: 331203 - RNA, 18 nt, Human
acgggguuucaccuuguu

SEQ ID NO: 331204 - RNA, 20 nt, Human
acgggguuucaccuuguuag

SEQ ID NO: 331205 - RNA, 19 nt, Human
acuccgagugcgggacgac

SEQ ID NO: 331206 - RNA, 20 nt, Human
acugcccaggcccugugggc

SEQ ID NO: 331207 - RNA, 18 nt, Human
agcuaugcaggcgagccu

SEQ ID NO: 331208 - RNA, 22 nt, Human
agcucuuccugucgccacagca

SEQ ID NO: 331209 - RNA, 23 nt, Human
aggcagaaaagagacuguucucu

SEQ ID NO: 331210 - RNA, 24 nt, Human
agggagagugggcugagagcggac

SEQ ID NO: 331211 - RNA, 23 nt, Human
agggagcccgauaggaaacaagc

SEQ ID NO: 331212 - RNA, 21 nt, Human
agggggccggggcggggcgcu

SEQ ID NO: 331213 - RNA, 18 nt, Human
agugcugggauuacaggc

SEQ ID NO: 331214 - RNA, 24 nt, Human
augauccacccgccucggccuccc

SEQ ID NO: 331215 - RNA, 24 nt, Human
caaagugcugggauuacaggcgug

SEQ ID NO: 331216 - RNA, 19 nt, Human
caauccuuuucucuuaagu

SEQ ID NO: 331217 - RNA, 23 nt, Human
cacccgccucggccucccaaagu

SEQ ID NO: 331218 - RNA, 24 nt, Human
caccuuguuagccaggauggucuc

SEQ ID NO: 331219 - RNA, 24 nt, Human
cagcaacucaucuugcucugagug

SEQ ID NO: 331220 - RNA, 20 nt, Human
caguguguaacagggagagu

SEQ ID NO: 331221 - RNA, 20 nt, Human
ccaaagugcugggauuacag

SEQ ID NO: 331222 - RNA, 22 nt, Human
ccaaagugcugggauuacaggc

SEQ ID NO: 331223 - RNA, 22 nt, Human
ccaaagugcugggauuacaggc

SEQ ID NO: 331224 - RNA, 24 nt, Human
ccaaagugcugggauuacaggcgu

SEQ ID NO: 331225 - RNA, 18 nt, Human
cccggacggucggcggga

SEQ ID NO: 331226 - RNA, 20 nt, Human
ccugaccucaugauccaccc

SEQ ID NO: 331227 - RNA, 20 nt, Human
cgcaauuggcaugccccuga

SEQ ID NO: 331228 - RNA, 22 nt, Human
cgccacagcaacugcccaggcc

SEQ ID NO: 331229 - RNA, 24 nt, Human
cgccucggccucccaaagugcugg

SEQ ID NO: 331230 - RNA, 18 nt, Human
cgggagggcgcggagggg

SEQ ID NO: 331231 - RNA, 24 nt, Human
cuccugaccucaugauccacccgc

SEQ ID NO: 331232 - RNA, 20 nt, Human
cugaagaaugugugcguguc

SEQ ID NO: 331233 - RNA, 18 nt, Human
cugggaccaucugcagag

SEQ ID NO: 331234 - RNA, 18 nt, Human
gaaugugugcgugucaaa

SEQ ID NO: 331235 - RNA, 18 nt, Human
gaccaucugcagagaacc

SEQ ID NO: 331236 - RNA, 22 nt, Human
gaccucaugauccacccgccuc

SEQ ID NO: 331237 - RNA, 20 nt, Human
gagaagcagacugggugugg

SEQ ID NO: 331238 - RNA, 20 nt, Human
gagacgggguuucaccuugu

SEQ ID NO: 331239 - RNA, 18 nt, Human
gauuacaggcgugagcca

SEQ ID NO: 331240 - RNA, 22 nt, Human
gauuacaggcgugagccaccgc

SEQ ID NO: 331241 - RNA, 22 nt, Human
gauuacaggcgugagccaccgc

SEQ ID NO: 331242 - RNA, 20 nt, Human
gcggagggggccggggcggg

SEQ ID NO: 331243 - RNA, 19 nt, Human
gcgucgggagggcgcggag

SEQ ID NO: 331244 - RNA, 19 nt, Human
ggagggggccggggcgggg

SEQ ID NO: 331245 - RNA, 25 nt, Human
ggaggucaggaaggugggccuugcc

SEQ ID NO: 331246 - RNA, 20 nt, Human
ggcgcggagggggccggggc

SEQ ID NO: 331247 - RNA, 18 nt, Human
gggcaggcaaagaauagc

SEQ ID NO: 331248 - RNA, 24 nt, Human
gggccggggcggggcgcugcggga

SEQ ID NO: 331249 - RNA, 22 nt, Human
ggguuucaccuuguuagccagg

SEQ ID NO: 331250 - RNA, 24 nt, Human
gguaacaggcgcagggcuuugaga

SEQ ID NO: 331251 - RNA, 20 nt, Human
ggucucgaucuccugaccuc

SEQ ID NO: 331252 - RNA, 24 nt, Human
gugaauccccuucguaaaacagag

SEQ ID NO: 331253 - RNA, 23 nt, Human
uacaggcgugagccaccgcgccc

SEQ ID NO: 331254 - RNA, 18 nt, Human
uagcagcaacucaucuug

SEQ ID NO: 331255 - RNA, 24 nt, Human
uaguagagacgggguuucaccuug

SEQ ID NO: 331256 - RNA, 26 nt, Human
uaguagagacgggguuucaccuuguu

SEQ ID NO: 331257 - RNA, 27 nt, Human
uagugaauccccuucguaaaacagagu

SEQ ID NO: 331258 - RNA, 24 nt, Human
ucaccuuguuagccaggauggucu

SEQ ID NO: 331259 - RNA, 24 nt, Human
ucccaaagugcugggauuacaggc

SEQ ID NO: 331260 - RNA, 18 nt, Human
ucgcucccggacggucgg

SEQ ID NO: 331261 - RNA, 18 nt, Human
ucggccucccaaagugcu

SEQ ID NO: 331262 - RNA, 20 nt, Human
ucugacucagccuuugcucc

SEQ ID NO: 331263 - RNA, 23 nt, Human
ugaccucaugauccacccgccuc

SEQ ID NO: 331264 - RNA, 23 nt, Human
ugacuuguagugagagaaagccc

SEQ ID NO: 331265 - RNA, 23 nt, Human
ugagagaaagccccgcagggagc

SEQ ID NO: 331266 - RNA, 21 nt, Human
ugaggggaggucaggaaggug

SEQ ID NO: 331267 - RNA, 18 nt, Human
ugcgggauggucuggucc

SEQ ID NO: 331268 - RNA, 24 nt, Human
ugcugggauuacaggcgugagcca

SEQ ID NO: 331269 - RNA, 23 nt, Human
ugcuuugagaaguugucuuuaac

SEQ ID NO: 331270 - RNA, 18 nt, Human
ugggauuacaggcgugag

SEQ ID NO: 331271 - RNA, 19 nt, Human
ugggauuacaggcgugagc

SEQ ID NO: 331272 - RNA, 21 nt, Human
ugggauuacaggcgugagcca

SEQ ID NO: 331273 - RNA, 22 nt, Human
ugggauuacaggcgugagccac

SEQ ID NO: 331274 - RNA, 23 nt, Human
ugggauuacaggcgugagccacc

SEQ ID NO: 331275 - RNA, 24 nt, Human
ugggauuacaggcgugagccaccg

SEQ ID NO: 331276 - RNA, 21 nt, Human
ugugcuuugagaaguugucuu

SEQ ID NO: 331277 - RNA, 22 nt, Human
ugugcuuugagaaguugucuuu

SEQ ID NO: 331278 - RNA, 22 nt, Human
uguguaacagggagaagcagac

SEQ ID NO: 331279 - RNA, 25 nt, Human
uguguaacagggagagugggcugag

SEQ ID NO: 331280 - RNA, 22 nt, Human
uuagagagucugagcucucuga

SEQ ID NO: 331281 - RNA, 24 nt, Human
uuagcucuuccugucgccacagca

SEQ ID NO: 331282 - RNA, 24 nt, Human
uuaguagagacgggguuucaccuu

SEQ ID NO: 331283 - RNA, 25 nt, Human
uuaguagagacgggguuucaccuug

SEQ ID NO: 331284 - RNA, 18 nt, Human
uuuaaaggcagaaaagag

SEQ ID NO: 331285 - RNA, 24 nt, Human
uuuucucuuaaguguguuucugac

SEQ ID NO: 331286 - RNA, 24 nt, Human
uuuuuaguagagacgggguuucac

SEQ ID NO: 331287 - RNA, 23 nt, Human
uuuuuuaguagagacgggguuuc

SEQ ID NO: 331288 - RNA, 24 nt, Human
uuuuuuuuuuuuuuaguagagacg

SEQ ID NO: 331289 - RNA, 30 nt, Human
uuuuuuuuuuuuuuuuaguagagacggggg

SEQ ID NO: 331290 - RNA, 22 nt, Human
aaacaaaagaugugaaaaacag

SEQ ID NO: 331291 - RNA, 23 nt, Human
aaacaaaagaugugaaaaacagg

SEQ ID NO: 331292 - RNA, 28 nt, Human
aaaccgaaagugaaaggaaaagggaccc

SEQ ID NO: 331293 - RNA, 19 nt, Human
aaaguucacggaaaaacuc

SEQ ID NO: 331294 - RNA, 18 nt, Human
aaauaagaaaacacacug

SEQ ID NO: 331295 - RNA, 23 nt, Human
aacaugaugagaaaagcacaccu

SEQ ID NO: 331296 - RNA, 24 nt, Human
aaccaacaugaugagaaaagcaca

SEQ ID NO: 331297 - RNA, 22 nt, Human
acacuggcuaucaaugccagag

SEQ ID NO: 331298 - RNA, 18 nt, Human
acaguauaaaguucacgg

SEQ ID NO: 331299 - RNA, 20 nt, Human
acuggauuuaguagguuucc

SEQ ID NO: 331300 - RNA, 24 nt, Human
agaaaaagauggugguaaaaaaaa

SEQ ID NO: 331301 - RNA, 20 nt, Human
caccggcugcacucgcccgc

SEQ ID NO: 331302 - RNA, 22 nt, Human
cagaacaccccaaauucucuuu

SEQ ID NO: 331303 - RNA, 22 nt, Human
cagccaaaaacagagcagguac

SEQ ID NO: 331304 - RNA, 23 nt, Human
ccaaaugccacuguaugaacacc

SEQ ID NO: 331305 - RNA, 22 nt, Human
ccagcaaacuggaaguggauga

SEQ ID NO: 331306 - RNA, 24 nt, Human
ccaugcuguggagccgcacugggc

SEQ ID NO: 331307 - RNA, 21 nt, Human
ccccauaaagaucuacuucca

SEQ ID NO: 331308 - RNA, 19 nt, Human
cgccgggucaccggcugca

SEQ ID NO: 331309 - RNA, 21 nt, Human
cggccccagcuuacauggucu

SEQ ID NO: 331310 - RNA, 19 nt, Human
cggcgcgucucggugggga

SEQ ID NO: 331311 - RNA, 23 nt, Human
cgguggggaagggccuggggcgg

SEQ ID NO: 331312 - RNA, 19 nt, Human
cuccgcgcaggcgcagggc

SEQ ID NO: 331313 - RNA, 24 nt, Human
cuccgcgcaggcgcagggcccucc

SEQ ID NO: 331314 - RNA, 21 nt, Human
cugaauuccagaaaaagcaca

SEQ ID NO: 331315 - RNA, 22 nt, Human
gcaaccgccggucucccagcgg

SEQ ID NO: 331316 - RNA, 19 nt, Human
gcacaccucacaauugaca

SEQ ID NO: 331317 - RNA, 22 nt, Human
gcagaacaccccaaauucucuu

SEQ ID NO: 331318 - RNA, 24 nt, Human
gcccaguagguuuggguaaaggua

SEQ ID NO: 331319 - RNA, 22 nt, Human
gccggacuccagcuccgcgcag

SEQ ID NO: 331320 - RNA, 22 nt, Human
gcgcaggcgcagggcccuccac

SEQ ID NO: 331321 - RNA, 23 nt, Human
gcgcagggcccuccacccuccgu

SEQ ID NO: 331322 - RNA, 18 nt, Human
ggaccggaggagggaggg

SEQ ID NO: 331323 - RNA, 18 nt, Human
ggaugagcggccccagcu

SEQ ID NO: 331324 - RNA, 21 nt, Human
ggccccagcuuacauggucua

SEQ ID NO: 331325 - RNA, 19 nt, Human
ggccuggggcgggggaccg

SEQ ID NO: 331326 - RNA, 18 nt, Human
ggcuacaggacauacagu

SEQ ID NO: 331327 - RNA, 21 nt, Human
gggaagggccuggggcggggg

SEQ ID NO: 331328 - RNA, 19 nt, Human
gugaaaggaaaaauaugaa

SEQ ID NO: 331329 - RNA, 20 nt, Human
guggaugagcggccccagcu

SEQ ID NO: 331330 - RNA, 25 nt, Human
uaaaaugaacaggaaacaaaagaug

SEQ ID NO: 331331 - RNA, 22 nt, Human
uaaagaucuacuuccauacaga

SEQ ID NO: 331332 - RNA, 22 nt, Human
uacuccagauauacuuccugaa

SEQ ID NO: 331333 - RNA, 18 nt, Human
uagaaaaagaugguggua

SEQ ID NO: 331334 - RNA, 25 nt, Human
uagaaaaagauggugguaaaaaaaa

SEQ ID NO: 331335 - RNA, 19 nt, Human
uaugauuugcugugccacu

SEQ ID NO: 331336 - RNA, 21 nt, Human
ucauacaucagauuccaugcu

SEQ ID NO: 331337 - RNA, 27 nt, Human
uccaacgauugugucccaaaugccacu

SEQ ID NO: 331338 - RNA, 22 nt, Human
uccagaaaaagcacaguacaau

SEQ ID NO: 331339 - RNA, 22 nt, Human
ucccaaaugccacuguaugaac

SEQ ID NO: 331340 - RNA, 23 nt, Human
uccccacggcaaccgccggucuc

SEQ ID NO: 331341 - RNA, 21 nt, Human
ucgccgggucaccggcugcac

SEQ ID NO: 331342 - RNA, 23 nt, Human
ucucacagccaaaaacagagcag

SEQ ID NO: 331343 - RNA, 20 nt, Human
ucucuuuuccccauaaagau

SEQ ID NO: 331344 - RNA, 21 nt, Human
ugaaaaacaggcagugaugcc

SEQ ID NO: 331345 - RNA, 19 nt, Human
ugagaaaagcacaccucac

SEQ ID NO: 331346 - RNA, 24 nt, Human
ugccacauucuaucauaucauaca

SEQ ID NO: 331347 - RNA, 21 nt, Human
uggaaguggaugagcggcccc

SEQ ID NO: 331348 - RNA, 25 nt, Human
uggaucacguaaacaccaguuaaaa

SEQ ID NO: 331349 - RNA, 25 nt, Human
uguagaauguaguaaacggaguuaa

SEQ ID NO: 331350 - RNA, 21 nt, Human
ugugcaauauaaccaacauga

SEQ ID NO: 331351 - RNA, 24 nt, Human
uguuuuaaaccgaaagugaaagga

SEQ ID NO: 331352 - RNA, 25 nt, Human
uugcugugccacuuugacuggcuug

SEQ ID NO: 331353 - RNA, 22 nt, Human
uuuuuuuuuuuuuuuugagugg

SEQ ID NO: 331354 - RNA, 21 nt, Human
uuuuuuuuuuuuuuuuuuugg

SEQ ID NO: 331355 - RNA, 20 nt, Human
aaaaaaaaaaaccagacugg

SEQ ID NO: 331356 - RNA, 27 nt, Human
aaaaaaccagacuggguagugggcacc

SEQ ID NO: 331357 - RNA, 22 nt, Human
aaaaccuguguaauggccagcg

SEQ ID NO: 331358 - RNA, 23 nt, Human
aaaagcccccuccccaccccaaa

SEQ ID NO: 331359 - RNA, 23 nt, Human
aaacaaguguccacauaguucuc

SEQ ID NO: 331360 - RNA, 19 nt, Human
aaaggaacacugaccauua

SEQ ID NO: 331361 - RNA, 25 nt, Human
aaagggaacaaaagcccccucccca

SEQ ID NO: 331362 - RNA, 23 nt, Human
aaauuauucccccuaaccuucca

SEQ ID NO: 331363 - RNA, 18 nt, Human
aauacagguaccaggaga

SEQ ID NO: 331364 - RNA, 23 nt, Human
agaaaugaacauuugccugaaua

SEQ ID NO: 331365 - RNA, 23 nt, Human
caaagaauguuuuugaaaagccc

SEQ ID NO: 331366 - RNA, 22 nt, Human
caagccgagcugcggggccgaa

SEQ ID NO: 331367 - RNA, 24 nt, Human
caccccaaacaacaaaaccugugu

SEQ ID NO: 331368 - RNA, 18 nt, Human
cagcaaggcccaggcgug

SEQ ID NO: 331369 - RNA, 23 nt, Human
cauggaggaacaacugaagcccc

SEQ ID NO: 331370 - RNA, 23 nt, Human
cauuuaaaaaaaaaaaccagacu

SEQ ID NO: 331371 - RNA, 21 nt, Human
ccaaugaaacaaguguccaca

SEQ ID NO: 331372 - RNA, 23 nt, Human
ccagacuggguauaauuaagaua

SEQ ID NO: 331373 - RNA, 24 nt, Human
cccccuaaccuuccaaugaaacaa

SEQ ID NO: 331374 - RNA, 18 nt, Human
cccccuccccaccccaaa

SEQ ID NO: 331375 - RNA, 19 nt, Human
cccccuccccaccccaaac

SEQ ID NO: 331376 - RNA, 24 nt, Human
cccuccccaccccaaacaacaaaa

SEQ ID NO: 331377 - RNA, 19 nt, Human
ccgcagcaagccgagcugc

SEQ ID NO: 331378 - RNA, 26 nt, Human
ccuccccaccccaaacaacaaaaccu

SEQ ID NO: 331379 - RNA, 18 nt, Human
ccugagaccgcagcaagc

SEQ ID NO: 331380 - RNA, 22 nt, Human
ccugagaccgcagcaagccgag

SEQ ID NO: 331381 - RNA, 20 nt, Human
ccugucaaagggggagagag

SEQ ID NO: 331382 - RNA, 20 nt, Human
cucaauauaaaacuaaacac

SEQ ID NO: 331383 - RNA, 19 nt, Human
cuuaaaauaauucuguauu

SEQ ID NO: 331384 - RNA, 21 nt, Human
cuuccuggcagcaaggcccag

SEQ ID NO: 331385 - RNA, 20 nt, Human
gaaucuccuucuaaacaaag

SEQ ID NO: 331386 - RNA, 24 nt, Human
gagaaauuauucccccuaaccuuc

SEQ ID NO: 331387 - RNA, 20 nt, Human
gccauggaggaacaacugaa

SEQ ID NO: 331388 - RNA, 22 nt, Human
gggggagagagaaauaauuagc

SEQ ID NO: 331389 - RNA, 18 nt, Human
uaaaaaaaaaaaccagac

SEQ ID NO: 331390 - RNA, 23 nt, Human
uaaaauaauucuguauuagaaac

SEQ ID NO: 331391 - RNA, 26 nt, Human
uaaaauaauucuguauuagaaacuug

SEQ ID NO: 331392 - RNA, 23 nt, Human
uaauacucuuccccaccccugac

SEQ ID NO: 331393 - RNA, 26 nt, Human
uaccccauuuaaaaaaaaaaaccagu

SEQ ID NO: 331394 - RNA, 22 nt, Human
uagaaucuccuucuaaacaaag

SEQ ID NO: 331395 - RNA, 21 nt, Human
uauggagacuacaaugcagua

SEQ ID NO: 331396 - RNA, 20 nt, Human
uaugguucuagccauggagg

SEQ ID NO: 331397 - RNA, 28 nt, Human
uauuaugucaaaagggaacaaaagcccc

SEQ ID NO: 331398 - RNA, 26 nt, Human
ucagacucuucaaugaacuuccagaa

SEQ ID NO: 331399 - RNA, 21 nt, Human
uccuggcagcaaggcccaggc

SEQ ID NO: 331400 - RNA, 19 nt, Human
ucuuccccaccccugaccu

SEQ ID NO: 331401 - RNA, 19 nt, Human
ucuucuuuccggagguaaa

SEQ ID NO: 331402 - RNA, 21 nt, Human
ugaaaagcccaaauuaguaag

SEQ ID NO: 331403 - RNA, 19 nt, Human
ugaaaggaacacugaccau

SEQ ID NO: 331404 - RNA, 23 nt, Human
ugacacaugguagcuuucauaua

SEQ ID NO: 331405 - RNA, 23 nt, Human
ugagcaccucaauauaaaacuaa

SEQ ID NO: 331406 - RNA, 18 nt, Human
uggcuaagcaucauaaau

SEQ ID NO: 331407 - RNA, 19 nt, Human
ugggauuauuuucuugugg

SEQ ID NO: 331408 - RNA, 20 nt, Human
uggguauaauuaagauacca

SEQ ID NO: 331409 - RNA, 18 nt, Human
ugguuuauuucauuuuug

SEQ ID NO: 331410 - RNA, 23 nt, Human
ugucaaaagggaacaaaagcccc

SEQ ID NO: 331411 - RNA, 22 nt, Human
uguguaauggccagcggugauu

SEQ ID NO: 331412 - RNA, 23 nt, Human
uuagaaucuccuucuaaacaaag

SEQ ID NO: 331413 - RNA, 21 nt, Human
uucacaggugacuacuguacc

SEQ ID NO: 331414 - RNA, 23 nt, Human
uucauauaaugaaaauaccuaaa

SEQ ID NO: 331415 - RNA, 18 nt, Human
uucucaaaauuccuaaaa

SEQ ID NO: 331416 - RNA, 20 nt, Human
uuuaaaaaaaaaaaccagac

SEQ ID NO: 331417 - RNA, 23 nt, Human
uuugauuuuuaccccauuuaaaa

SEQ ID NO: 331418 - RNA, 24 nt, Human
uuuuuuugcuuuuuauaccacuuu

SEQ ID NO: 331419 - RNA, 24 nt, Human
uuuuuuuuuuuuuuuugcuuuuua

SEQ ID NO: 331420 - RNA, 18 nt, Human
uuuuuuuuuuuuuuuuug

SEQ ID NO: 331421 - RNA, 24 nt, Human
uuuuuuuuuuuuuuuuuugcuuuu

SEQ ID NO: 331422 - RNA, 20 nt, Human
aaaccuccuucucaguuccu

SEQ ID NO: 331423 - RNA, 22 nt, Human
aaccaaauaaaaacaaaaagga

SEQ ID NO: 331424 - RNA, 23 nt, Human
aagcagaaggggaagggacagga

SEQ ID NO: 331425 - RNA, 24 nt, Human
aagcagaaggggaagggacaggag

SEQ ID NO: 331426 - RNA, 27 nt, Human
acccggcaccuccugcuuggugucccu

SEQ ID NO: 331427 - RNA, 20 nt, Human
accuaggaacacccuccaca

SEQ ID NO: 331428 - RNA, 25 nt, Human
accuccaccuccgcccaguuagcuu

SEQ ID NO: 331429 - RNA, 19 nt, Human
agaaggggaagggacagga

SEQ ID NO: 331430 - RNA, 19 nt, Human
agccccagaguagggggua

SEQ ID NO: 331431 - RNA, 26 nt, Human
agcugccugguguuuguugcugaagc

SEQ ID NO: 331432 - RNA, 19 nt, Human
agcugucaggaggcagccc

SEQ ID NO: 331433 - RNA, 19 nt, Human
aggaacacuagggaggagg

SEQ ID NO: 331434 - RNA, 18 nt, Human
aggagaaaagaggcucaa

SEQ ID NO: 331435 - RNA, 21 nt, Human
aggcaaccagugaaaauucuu

SEQ ID NO: 331436 - RNA, 21 nt, Human
aucucccccaggcccuuaaug

SEQ ID NO: 331437 - RNA, 25 nt, Human
aucuugccuccccauucucaccucu

SEQ ID NO: 331438 - RNA, 20 nt, Human
caagccccagaguagggggu

SEQ ID NO: 331439 - RNA, 19 nt, Human
cacccuccacaaggccaaa

SEQ ID NO: 331440 - RNA, 22 nt, Human
cagacuacagcagagccaaaga

SEQ ID NO: 331441 - RNA, 27 nt, Human
cagcugccugguguuuguugcugaagc

SEQ ID NO: 331442 - RNA, 22 nt, Human
ccacaguugacccugcaccucc

SEQ ID NO: 331443 - RNA, 25 nt, Human
cccacgauuaggggaaaccgggguc

SEQ ID NO: 331444 - RNA, 28 nt, Human
cccccaagccccagaguaggggguaggg

SEQ ID NO: 331445 - RNA, 18 nt, Human
cccccaggcccuuaaugu

SEQ ID NO: 331446 - RNA, 19 nt, Human
cccuccugcucgagcuuua

SEQ ID NO: 331447 - RNA, 19 nt, Human
ccuccuucucaguuccugg

SEQ ID NO: 331448 - RNA, 24 nt, Human
cuaccuaggaacacccuccacaag

SEQ ID NO: 331449 - RNA, 20 nt, Human
cucaccucuaccuaggaaca

SEQ ID NO: 331450 - RNA, 20 nt, Human
cuccuccaaucagacuacag

SEQ ID NO: 331451 - RNA, 19 nt, Human
cugaaaaaaucggggagga

SEQ ID NO: 331452 - RNA, 22 nt, Human
cugagaucuugccuccccauuc

SEQ ID NO: 331453 - RNA, 18 nt, Human
cugcaccuccaccuccgc

SEQ ID NO: 331454 - RNA, 26 nt, Human
cuggaaaccuccuucucaguuccugg

SEQ ID NO: 331455 - RNA, 18 nt, Human
gaacacccuccacaaggg

SEQ ID NO: 331456 - RNA, 20 nt, Human
gaagaaaguuuguuuuggaa

SEQ ID NO: 331457 - RNA, 22 nt, Human
gagaaacuccaaccaaauaaaa

SEQ ID NO: 331458 - RNA, 20 nt, Human
gaggaacacuagggaggagg

SEQ ID NO: 331459 - RNA, 18 nt, Human
gaggcagcccuuggagcc

SEQ ID NO: 331460 - RNA, 22 nt, Human
gaucuugccuccccauucucac

SEQ ID NO: 331461 - RNA, 20 nt, Human
ggaagacucugggguccaac

SEQ ID NO: 331462 - RNA, 22 nt, Human
ggcccuuaauguaaaugaacug

SEQ ID NO: 331463 - RNA, 19 nt, Human
gggagaggagaaaagaggc

SEQ ID NO: 331464 - RNA, 22 nt, Human
guaaaugaacuggaaaccuccu

SEQ ID NO: 331465 - RNA, 23 nt, Human
uaaaugaacuggaaaccuccuuc

SEQ ID NO: 331466 - RNA, 18 nt, Human
uaagaggcugcgugaggg

SEQ ID NO: 331467 - RNA, 20 nt, Human
uaaguccuggggggaguuga

SEQ ID NO: 331468 - RNA, 21 nt, Human
uaccuaggaacacccuccaca

SEQ ID NO: 331469 - RNA, 22 nt, Human
uaccuaggaacacccuccacaa

SEQ ID NO: 331470 - RNA, 23 nt, Human
uaggaacacccuccacaaggcca

SEQ ID NO: 331471 - RNA, 24 nt, Human
uaggaacacccuccacaaggccaa

SEQ ID NO: 331472 - RNA, 25 nt, Human
ucagacuacagcagagccaaagacg

SEQ ID NO: 331473 - RNA, 24 nt, Human
uccaaccaaauaaaaacaaaaagg

SEQ ID NO: 331474 - RNA, 21 nt, Human
uccacaaggccaaaucaugga

SEQ ID NO: 331475 - RNA, 22 nt, Human
ucccugagaucuugccucccca

SEQ ID NO: 331476 - RNA, 19 nt, Human
ucgagggguagggauggcg

SEQ ID NO: 331477 - RNA, 21 nt, Human
ugcaccuccaccuccgcccag

SEQ ID NO: 331478 - RNA, 18 nt, Human
uggaagguaaguccuggg

SEQ ID NO: 331479 - RNA, 20 nt, Human
uggagccagggcuagugugc

SEQ ID NO: 331480 - RNA, 19 nt, Human
uggggagaggagaaaagag

SEQ ID NO: 331481 - RNA, 21 nt, Human
uggggcugaggccaucuaaag

SEQ ID NO: 331482 - RNA, 23 nt, Human
uguauaaaucagaggauggguac

SEQ ID NO: 331483 - RNA, 21 nt, Human
uuccuggguucaccacaaaca

SEQ ID NO: 331484 - RNA, 22 nt, Human
uucuuagcucuugugcuagcuc

SEQ ID NO: 331485 - RNA, 21 nt, Human
aaaccaaagaccacuccgaac

SEQ ID NO: 331486 - RNA, 21 nt, Human
aaccaaagaccacuccgaaca

SEQ ID NO: 331487 - RNA, 21 nt, Human
aagaggcacuuaguggggagg

SEQ ID NO: 331488 - RNA, 23 nt, Human
aagccccuucccaaggucugccc

SEQ ID NO: 331489 - RNA, 25 nt, Human
aauacaaaauacagaaaaaguuggu

SEQ ID NO: 331490 - RNA, 22 nt, Human
accccacuguccccauauacaa

SEQ ID NO: 331491 - RNA, 22 nt, Human
accccucccccugcccccccag

SEQ ID NO: 331492 - RNA, 26 nt, Human
accuccaaggcggcuccggggcggcg

SEQ ID NO: 331493 - RNA, 24 nt, Human
acugaccccacuguccccauauac

SEQ ID NO: 331494 - RNA, 20 nt, Human
agagguuggggugaccgagg

SEQ ID NO: 331495 - RNA, 21 nt, Human
agccagagguuggggugaccg

SEQ ID NO: 331496 - RNA, 24 nt, Human
agccagagguuggggugaccgagg

SEQ ID NO: 331497 - RNA, 24 nt, Human
agcggggagggggcugcagccuga

SEQ ID NO: 331498 - RNA, 24 nt, Human
agcugcacugaccccacugucccc

SEQ ID NO: 331499 - RNA, 19 nt, Human
aggauguggaugcucuugc

SEQ ID NO: 331500 - RNA, 20 nt, Human
agguuggggugaccgagggu

SEQ ID NO: 331501 - RNA, 18 nt, Human
aguagaaaggggaggaag

SEQ ID NO: 331502 - RNA, 23 nt, Human
caauaaugcugugauaaugcugu

SEQ ID NO: 331503 - RNA, 19 nt, Human
cacucccccccuuacccac

SEQ ID NO: 331504 - RNA, 21 nt, Human
cacucccccccuuacccaccc

SEQ ID NO: 331505 - RNA, 20 nt, Human
caggcggaggaggcgggggc

SEQ ID NO: 331506 - RNA, 24 nt, Human
cagggcucagagccagagguuggg

SEQ ID NO: 331507 - RNA, 25 nt, Human
cagggcucagagccagagguugggg

SEQ ID NO: 331508 - RNA, 18 nt, Human
cagucgggucauucaggc

SEQ ID NO: 331509 - RNA, 20 nt, Human
caugguggaccccucccccu

SEQ ID NO: 331510 - RNA, 19 nt, Human
cccacccccaaauacucau

SEQ ID NO: 331511 - RNA, 21 nt, Human
cccaccgcccaaaccaaagac

SEQ ID NO: 331512 - RNA, 25 nt, Human
cccaccgcccaaaccaaagaccacu

SEQ ID NO: 331513 - RNA, 26 nt, Human
ccccacuguccccauauacaaggguu

SEQ ID NO: 331514 - RNA, 20 nt, Human
ccccagugguggcccgaguc

SEQ ID NO: 331515 - RNA, 19 nt, Human
cccccccuuacccacccac

SEQ ID NO: 331516 - RNA, 20 nt, Human
cccccccuuacccacccacc

SEQ ID NO: 331517 - RNA, 24 nt, Human
cccccccuuacccacccaccccca

SEQ ID NO: 331518 - RNA, 20 nt, Human
ccccccuuacccacccaccc

SEQ ID NO: 331519 - RNA, 23 nt, Human
ccccuuacccacccacccccaaa

SEQ ID NO: 331520 - RNA, 19 nt, Human
cccucccacucccccccuu

SEQ ID NO: 331521 - RNA, 18 nt, Human
ccguccagcuguaguggu

SEQ ID NO: 331522 - RNA, 21 nt, Human
ccuaagccccuucccaagguc

SEQ ID NO: 331523 - RNA, 21 nt, Human
ccucccacucccccccuuacc

SEQ ID NO: 331524 - RNA, 22 nt, Human
ccuuccuaagccccuucccaag

SEQ ID NO: 331525 - RNA, 19 nt, Human
cgcccaaaccaaagaccac

SEQ ID NO: 331526 - RNA, 21 nt, Human
cgcccaaaccaaagaccacuc

SEQ ID NO: 331527 - RNA, 19 nt, Human
cggggagggggcugcagcc

SEQ ID NO: 331528 - RNA, 20 nt, Human
cggggagggggcugcagccu

SEQ ID NO: 331529 - RNA, 18 nt, Human
cgugcggguggggacugg

SEQ ID NO: 331530 - RNA, 21 nt, Human
cuaagccccuucccaaggucu

SEQ ID NO: 331531 - RNA, 22 nt, Human
cugaccccacuguccccauaua

SEQ ID NO: 331532 - RNA, 18 nt, Human
cugugguuucccagcagg

SEQ ID NO: 331533 - RNA, 22 nt, Human
cuuacccacccacccccaaaua

SEQ ID NO: 331534 - RNA, 19 nt, Human
gcccaaaccaaagaccacu

SEQ ID NO: 331535 - RNA, 25 nt, Human
gcccaaaccaaagaccacuccgaac

SEQ ID NO: 331536 - RNA, 21 nt, Human
gccccaccgcccaaaccaaag

SEQ ID NO: 331537 - RNA, 22 nt, Human
gccccaccgcccaaaccaaaga

SEQ ID NO: 331538 - RNA, 20 nt, Human
gcccccccagugguggcccg

SEQ ID NO: 331539 - RNA, 20 nt, Human
ggcggaggaggcgggggcag

SEQ ID NO: 331540 - RNA, 18 nt, Human
gggagcggggagggggcu

SEQ ID NO: 331541 - RNA, 18 nt, Human
ggggagggggaccuccaa

SEQ ID NO: 331542 - RNA, 21 nt, Human
ggucagaacagggcucagagc

SEQ ID NO: 331543 - RNA, 24 nt, Human
gguggaccccucccccugcccccc

SEQ ID NO: 331544 - RNA, 21 nt, Human
guccccucccacucccccccu

SEQ ID NO: 331545 - RNA, 25 nt, Human
guuccguccccucccacuccccccc

SEQ ID NO: 331546 - RNA, 22 nt, Human
uaaaaaagugacuuaagacuua

SEQ ID NO: 331547 - RNA, 22 nt, Human
uacaaggguuggggggcaagag

SEQ ID NO: 331548 - RNA, 20 nt, Human
uacaauacaaaauacagaaa

SEQ ID NO: 331549 - RNA, 27 nt, Human
uacugauugguuacauguugaagaaaa

SEQ ID NO: 331550 - RNA, 24 nt, Human
uaugaucaaaauuauauggagaaa

SEQ ID NO: 331551 - RNA, 19 nt, Human
ucccacucccccccuuacc

SEQ ID NO: 331552 - RNA, 18 nt, Human
uccguccccucccacucc

SEQ ID NO: 331553 - RNA, 19 nt, Human
uccuaagccccuucccaag

SEQ ID NO: 331554 - RNA, 23 nt, Human
ucugccccaccgcccaaaccaaa

SEQ ID NO: 331555 - RNA, 20 nt, Human
ugacucacuccggccuauga

SEQ ID NO: 331556 - RNA, 18 nt, Human
ugcagccugaugagagcc

SEQ ID NO: 331557 - RNA, 22 nt, Human
ugccccaccgcccaaaccaaag

SEQ ID NO: 331558 - RNA, 24 nt, Human
ugccccaccgcccaaaccaaagac

SEQ ID NO: 331559 - RNA, 29 nt, Human
ugccccaccgcccaaaccaaagaccacuc

SEQ ID NO: 331560 - RNA, 22 nt, Human
uggaccccucccccugcccccc

SEQ ID NO: 331561 - RNA, 22 nt, Human
uggcccgagucguuaagugcga

SEQ ID NO: 331562 - RNA, 21 nt, Human
ugggaagagcagaagaucaua

SEQ ID NO: 331563 - RNA, 22 nt, Human
ugggagagcaguagaaagggga

SEQ ID NO: 331564 - RNA, 22 nt, Human
ugggagcggggagggggcugca

SEQ ID NO: 331565 - RNA, 22 nt, Human
uggggggcaagagcauguggcu

SEQ ID NO: 331566 - RNA, 20 nt, Human
uuacccacccacccccaaau

SEQ ID NO: 331567 - RNA, 21 nt, Human
uugguuccguccccucccacu

SEQ ID NO: 331568 - RNA, 23 nt, Human
aaaaaagaaaaaaauguuaagaa

SEQ ID NO: 331569 - RNA, 21 nt, Human
aaaaagaaaacccaagcaaaa

SEQ ID NO: 331570 - RNA, 24 nt, Human
aaaaaugcuaaaaaauaaggcaua

SEQ ID NO: 331571 - RNA, 22 nt, Human
aaaacuuuuacagugccuugcc

SEQ ID NO: 331572 - RNA, 22 nt, Human
aaagaaaacccaagcaaaaucu

SEQ ID NO: 331573 - RNA, 20 nt, Human
aacauuaaaaaagaaaaaaa

SEQ ID NO: 331574 - RNA, 22 nt, Human
aagugggaaguggaggaggaag

SEQ ID NO: 331575 - RNA, 24 nt, Human
aauaagugggaaguggaggaggaa

SEQ ID NO: 331576 - RNA, 19 nt, Human
acagugccuugccugcaca

SEQ ID NO: 331577 - RNA, 22 nt, Human
acaucugaagauugaaaguugu

SEQ ID NO: 331578 - RNA, 22 nt, Human
accuuaaaaaaugcuaaaaaau

SEQ ID NO: 331579 - RNA, 20 nt, Human
acuuuuguugugcuugugaa

SEQ ID NO: 331580 - RNA, 22 nt, Human
agaauuaaauacuaaaaaccug

SEQ ID NO: 331581 - RNA, 23 nt, Human
agaggaaagagaggggacuaagg

SEQ ID NO: 331582 - RNA, 24 nt, Human
agccauuuguuuuagucagaaaua

SEQ ID NO: 331583 - RNA, 22 nt, Human
agccuagagaccucccggaccg

SEQ ID NO: 331584 - RNA, 21 nt, Human
agcucuaaauagauucaacga

SEQ ID NO: 331585 - RNA, 22 nt, Human
aggaagaggaaagagaggggac

SEQ ID NO: 331586 - RNA, 22 nt, Human
aggaagucgggggaggcuaggu

SEQ ID NO: 331587 - RNA, 26 nt, Human
aggcaaagaaauaaauaucaccaaag

SEQ ID NO: 331588 - RNA, 22 nt, Human
auuccaaugggcuugguagaac

SEQ ID NO: 331589 - RNA, 18 nt, Human
caaaaccagccugaaaga

SEQ ID NO: 331590 - RNA, 22 nt, Human
caaaaccagccugaaagaccca

SEQ ID NO: 331591 - RNA, 23 nt, Human
caaaccaaaaccagccugaaaga

SEQ ID NO: 331592 - RNA, 22 nt, Human
caaauguccugagcaaaguuuu

SEQ ID NO: 331593 - RNA, 21 nt, Human
caaccuuaaaaaaugcuaaaa

SEQ ID NO: 331594 - RNA, 20 nt, Human
cacagcugccgccgccccuc

SEQ ID NO: 331595 - RNA, 18 nt, Human
cacuuuacaacuccaucc

SEQ ID NO: 331596 - RNA, 20 nt, Human
cacuuuacaacuccauccca

SEQ ID NO: 331597 - RNA, 19 nt, Human
cagccgccgccgccucccg

SEQ ID NO: 331598 - RNA, 20 nt, Human
cagccgccgccgccucccgg

SEQ ID NO: 331599 - RNA, 22 nt, Human
cagccuagagaccucccggacc

SEQ ID NO: 331600 - RNA, 18 nt, Human
cagccugaaagacccaac

SEQ ID NO: 331601 - RNA, 23 nt, Human
caggagccagggguguccucugg

SEQ ID NO: 331602 - RNA, 22 nt, Human
ccaaccuuaaaaaaugcuaaaa

SEQ ID NO: 331603 - RNA, 22 nt, Human
ccaauauucacacugcagucaa

SEQ ID NO: 331604 - RNA, 21 nt, Human
ccacagacuggcagccgccgc

SEQ ID NO: 331605 - RNA, 18 nt, Human
ccacagcugccgccgccc

SEQ ID NO: 331606 - RNA, 21 nt, Human
cccaaccuuaaaaaaugcuaa

SEQ ID NO: 331607 - RNA, 25 nt, Human
cccaagcaaaaucuauugcuuaaag

SEQ ID NO: 331608 - RNA, 26 nt, Human
cccgcggcugggaagggaaggagggc

SEQ ID NO: 331609 - RNA, 18 nt, Human
ccgccgccgccucccggc

SEQ ID NO: 331610 - RNA, 26 nt, Human
ccucccggaccgaugcugcuccagcc

SEQ ID NO: 331611 - RNA, 24 nt, Human
cgagcggaagggcgggcaccgagc

SEQ ID NO: 331612 - RNA, 20 nt, Human
cgcacucggcucccagaccu

SEQ ID NO: 331613 - RNA, 19 nt, Human
cggcagaguagccuagcac

SEQ ID NO: 331614 - RNA, 23 nt, Human
cgugaagaauuaaauacuaaaaa

SEQ ID NO: 331615 - RNA, 20 nt, Human
cuaauagaucaucuccacga

SEQ ID NO: 331616 - RNA, 19 nt, Human
cuagagaccucccggaccg

SEQ ID NO: 331617 - RNA, 22 nt, Human
cucaaauguccugagcaaaguu

SEQ ID NO: 331618 - RNA, 24 nt, Human
cuccacagacuggcagccgccgcc

SEQ ID NO: 331619 - RNA, 21 nt, Human
cucccagagucuaauaaagca

SEQ ID NO: 331620 - RNA, 20 nt, Human
cucucucggccccugcaagg

SEQ ID NO: 331621 - RNA, 19 nt, Human
cugccgccgccccucgugc

SEQ ID NO: 331622 - RNA, 21 nt, Human
cuuccacagcugccgccgccc

SEQ ID NO: 331623 - RNA, 24 nt, Human
cuucccaaagcuagggccguuccc

SEQ ID NO: 331624 - RNA, 24 nt, Human
cuugguccguagccuacagcaagu

SEQ ID NO: 331625 - RNA, 21 nt, Human
cuugguuaauuuucucuccca

SEQ ID NO: 331626 - RNA, 23 nt, Human
gaaauacauauugccauggugaa

SEQ ID NO: 331627 - RNA, 21 nt, Human
gaagagaagcugaggguggcg

SEQ ID NO: 331628 - RNA, 20 nt, Human
gagggcggugucggcaggag

SEQ ID NO: 331629 - RNA, 19 nt, Human
gcaaaaucuauugcuuaaa

SEQ ID NO: 331630 - RNA, 18 nt, Human
gccagcugacgaaaaagg

SEQ ID NO: 331631 - RNA, 22 nt, Human
gccggaaccgcagacguaucug

SEQ ID NO: 331632 - RNA, 19 nt, Human
gcuuacacagcaaucucac

SEQ ID NO: 331633 - RNA, 20 nt, Human
ggaagggaaggagggcggug

SEQ ID NO: 331634 - RNA, 21 nt, Human
ggaaguggaggaggaagagga

SEQ ID NO: 331635 - RNA, 20 nt, Human
ggaauggggguaagugagag

SEQ ID NO: 331636 - RNA, 21 nt, Human
ggaauggggguaagugagagg

SEQ ID NO: 331637 - RNA, 22 nt, Human
ggagagauaaaguaggcuguga

SEQ ID NO: 331638 - RNA, 24 nt, Human
ggaggaggaagaggaaagagaggg

SEQ ID NO: 331639 - RNA, 20 nt, Human
ggcagccgccgccgccuccc

SEQ ID NO: 331640 - RNA, 23 nt, Human
gggaaggagggcggugucggcag

SEQ ID NO: 331641 - RNA, 19 nt, Human
gggaagggaaggagggcgg

SEQ ID NO: 331642 - RNA, 22 nt, Human
gggaaguggaggaggaagagga

SEQ ID NO: 331643 - RNA, 19 nt, Human
gggaauggggguaagugag

SEQ ID NO: 331644 - RNA, 22 nt, Human
gguucuuuuguugguaagcuuu

SEQ ID NO: 331645 - RNA, 25 nt, Human
gugaagcucuaaauagauucaacga

SEQ ID NO: 331646 - RNA, 18 nt, Human
gugacaauaagugggaag

SEQ ID NO: 331647 - RNA, 19 nt, Human
uaaaagcacuuuacaacuc

SEQ ID NO: 331648 - RNA, 25 nt, Human
uacacagcaaucucacaauaacuag

SEQ ID NO: 331649 - RNA, 22 nt, Human
uaccugaucugccucuaggggc

SEQ ID NO: 331650 - RNA, 18 nt, Human
uacuauguaugcuuuacc

SEQ ID NO: 331651 - RNA, 20 nt, Human
uagacaucauuauuucuacu

SEQ ID NO: 331652 - RNA, 26 nt, Human
uagagaccucccggaccgaugcuggu

SEQ ID NO: 331653 - RNA, 27 nt, Human
uagagaccucccggaccgaugcugguu

SEQ ID NO: 331654 - RNA, 26 nt, Human
uagcuuaaauauaaaacuaaaucacc

SEQ ID NO: 331655 - RNA, 19 nt, Human
uaguaaagauuaaaagggc

SEQ ID NO: 331656 - RNA, 20 nt, Human
ucaaugaaagaguaaggggg

SEQ ID NO: 331657 - RNA, 25 nt, Human
ucacacugcagucaaugaaagagua

SEQ ID NO: 331658 - RNA, 21 nt, Human
ucaccaaagaaaaaagauuaa

SEQ ID NO: 331659 - RNA, 26 nt, Human
ucauuuugaagaugcaccaggagccu

SEQ ID NO: 331660 - RNA, 19 nt, Human
uccaaugaggggaugagga

SEQ ID NO: 331661 - RNA, 18 nt, Human
uccacagacuggcagccg

SEQ ID NO: 331662 - RNA, 21 nt, Human
uccagccagcugacgaaaaag

SEQ ID NO: 331663 - RNA, 19 nt, Human
ucccagagucuaauaaagc

SEQ ID NO: 331664 - RNA, 18 nt, Human
ucuccuuucccucuacua

SEQ ID NO: 331665 - RNA, 18 nt, Human
ucucuuguuuguuuugag

SEQ ID NO: 331666 - RNA, 19 nt, Human
ucugaagauugaaaguugu

SEQ ID NO: 331667 - RNA, 23 nt, Human
ugaaagagccauuuguuuuaguc

SEQ ID NO: 331668 - RNA, 21 nt, Human
ugaacauagcgcucguuaacc

SEQ ID NO: 331669 - RNA, 21 nt, Human
ugaagacacugacuuuuguug

SEQ ID NO: 331670 - RNA, 24 nt, Human
ugaauauuacaaggugacaauaag

SEQ ID NO: 331671 - RNA, 19 nt, Human
ugagaaaagcaaggagaga

SEQ ID NO: 331672 - RNA, 23 nt, Human
ugagaaaagcaaggagagauaaa

SEQ ID NO: 331673 - RNA, 23 nt, Human
ugcaaacaauguauuuacaaaug

SEQ ID NO: 331674 - RNA, 20 nt, Human
ugcugcuuugccaucucuug

SEQ ID NO: 331675 - RNA, 19 nt, Human
ugggaagggaaggagggcg

SEQ ID NO: 331676 - RNA, 20 nt, Human
ugggaaguggaggaggaaga

SEQ ID NO: 331677 - RNA, 20 nt, Human
uggggaagagaagcugaggg

SEQ ID NO: 331678 - RNA, 19 nt, Human
ugguuaauuuucucuccca

SEQ ID NO: 331679 - RNA, 18 nt, Human
ugugaaagagccauuugu

SEQ ID NO: 331680 - RNA, 27 nt, Human
ugugaagcuaauagaucaucuccacga

SEQ ID NO: 331681 - RNA, 24 nt, Human
uguguuaaguaaugcuuacaacaa

SEQ ID NO: 331682 - RNA, 22 nt, Human
uuaaauacuaaaaaccuguucu

SEQ ID NO: 331683 - RNA, 20 nt, Human
uuauacuguguuaaguaaug

SEQ ID NO: 331684 - RNA, 23 nt, Human
uuccacagcugccgccgccccuc

SEQ ID NO: 331685 - RNA, 26 nt, Human
uugaccucaaagaagaccguaauuua

SEQ ID NO: 331686 - RNA, 27 nt, Human
uugaccucaaagaagaccguaauuuau

SEQ ID NO: 331687 - RNA, 20 nt, Human
uuuguugugcuugugaagcu

SEQ ID NO: 331688 - RNA, 23 nt, Human
uuuuaagggaaauacauauugcc

SEQ ID NO: 331689 - RNA, 20 nt, Human
uuuuuuuuuuuuuuuugcca

SEQ ID NO: 331690 - RNA, 24 nt, Human
uuuuuuuuuuuuuuuuuuuuuggg

SEQ ID NO: 331691 - RNA, 22 nt, Human
aaaaaaaaacaacaacaugaga

SEQ ID NO: 331692 - RNA, 24 nt, Human
aaaaagcuagugucugaguauugc

SEQ ID NO: 331693 - RNA, 24 nt, Human
aauacaaaagugagaaaaaagcua

SEQ ID NO: 331694 - RNA, 19 nt, Human
acaaaagugagaaaaaagc

SEQ ID NO: 331695 - RNA, 22 nt, Human
acaaaagugagaaaaaagcuag

SEQ ID NO: 331696 - RNA, 23 nt, Human
agagaccuauuucuucaggagag

SEQ ID NO: 331697 - RNA, 27 nt, Human
caugacugcucuucucuuuccccacag

SEQ ID NO: 331698 - RNA, 20 nt, Human
ccucagggccaugacugcuc

SEQ ID NO: 331699 - RNA, 19 nt, Human
cucagggccaugacugcuc

SEQ ID NO: 331700 - RNA, 22 nt, Human
gacugcucuucucuuuccccac

SEQ ID NO: 331701 - RNA, 19 nt, Human
ugguaaagcauaaaagaga

SEQ ID NO: 331702 - RNA, 18 nt, Human
ugugaacaauaauaucuu

SEQ ID NO: 331703 - RNA, 21 nt, Human
ugugugcauagaaaucauaua

SEQ ID NO: 331704 - RNA, 19 nt, Human
aaacggaggacagaagcga

SEQ ID NO: 331705 - RNA, 21 nt, Human
aagaccaauaaaaaaaaucag

SEQ ID NO: 331706 - RNA, 25 nt, Human
aagaccaauaaaaaaaaucagauaa

SEQ ID NO: 331707 - RNA, 21 nt, Human
aagccgccaacuccgccgcug

SEQ ID NO: 331708 - RNA, 19 nt, Human
aaggagggaggggaaaggg

SEQ ID NO: 331709 - RNA, 18 nt, Human
aauguguugggggcaguc

SEQ ID NO: 331710 - RNA, 19 nt, Human
acaagaccaauaaaaaaaa

SEQ ID NO: 331711 - RNA, 21 nt, Human
acaagaccaauaaaaaaaauc

SEQ ID NO: 331712 - RNA, 18 nt, Human
acgcggccgcugcgcugg

SEQ ID NO: 331713 - RNA, 22 nt, Human
agaaagucagcuccuauugugg

SEQ ID NO: 331714 - RNA, 25 nt, Human
agaagguccaaguucugguuccagg

SEQ ID NO: 331715 - RNA, 21 nt, Human
agaccaauaaaaaaaaucaga

SEQ ID NO: 331716 - RNA, 26 nt, Human
aggaggagacuaaacggaggacagaa

SEQ ID NO: 331717 - RNA, 24 nt, Human
agggaggggaaaggggggguaaaa

SEQ ID NO: 331718 - RNA, 19 nt, Human
aggggggguaaaaagacca

SEQ ID NO: 331719 - RNA, 26 nt, Human
auuacauaauaaauggauacuguaaa

SEQ ID NO: 331720 - RNA, 23 nt, Human
auuaguuaaaaguaacaagcauu

SEQ ID NO: 331721 - RNA, 18 nt, Human
cagaacgcagcagucugc

SEQ ID NO: 331722 - RNA, 29 nt, Human
cagcaacacuuucuuccuagaggucaucc

SEQ ID NO: 331723 - RNA, 20 nt, Human
cccgccgaggaggagacuaa

SEQ ID NO: 331724 - RNA, 20 nt, Human
ccgcugccgccgccucaggc

SEQ ID NO: 331725 - RNA, 18 nt, Human
cgacuccagaaucuccca

SEQ ID NO: 331726 - RNA, 18 nt, Human
cgcugcgcugggggcucc

SEQ ID NO: 331727 - RNA, 25 nt, Human
cucccgagcucuccaagccgccaac

SEQ ID NO: 331728 - RNA, 24 nt, Human
cuucaaggagggaggggaaagggg

SEQ ID NO: 331729 - RNA, 20 nt, Human
gacagaagcgagaaggucca

SEQ ID NO: 331730 - RNA, 23 nt, Human
gcagcagucugcaccucuguaga

SEQ ID NO: 331731 - RNA, 21 nt, Human
gcgcugggggcuccgggccgg

SEQ ID NO: 331732 - RNA, 22 nt, Human
ggaaaggggggguaaaaagacc

SEQ ID NO: 331733 - RNA, 24 nt, Human
ggaacucucccgagcucuccaagc

SEQ ID NO: 331734 - RNA, 25 nt, Human
ggagggaggggaaaggggggguaaa

SEQ ID NO: 331735 - RNA, 18 nt, Human
ggccgcugcgcugggggc

SEQ ID NO: 331736 - RNA, 20 nt, Human
gggaaaggggggguaaaaag

SEQ ID NO: 331737 - RNA, 18 nt, Human
gggaacucucccgagcuc

SEQ ID NO: 331738 - RNA, 21 nt, Human
gggcauggggcaccagccuuc

SEQ ID NO: 331739 - RNA, 19 nt, Human
guaaaaagaccacaagacc

SEQ ID NO: 331740 - RNA, 18 nt, Human
guuccagggaacucuccc

SEQ ID NO: 331741 - RNA, 23 nt, Human
uaaauggauacuguaaaaagauc

SEQ ID NO: 331742 - RNA, 25 nt, Human
uaagauucuuuucuaagaagcauua

SEQ ID NO: 331743 - RNA, 22 nt, Human
uacaaaacucagccugaucaga

SEQ ID NO: 331744 - RNA, 24 nt, Human
uaccagaacgcagcagucugcacc

SEQ ID NO: 331745 - RNA, 18 nt, Human
ucagaaagucagcuccua

SEQ ID NO: 331746 - RNA, 19 nt, Human
ucccaggaugauaaccuuc

SEQ ID NO: 331747 - RNA, 18 nt, Human
ucuccaagccgccaacuc

SEQ ID NO: 331748 - RNA, 19 nt, Human
ucucccaggaugauaaccu

SEQ ID NO: 331749 - RNA, 23 nt, Human
ucucccgagcucuccaagccgcc

SEQ ID NO: 331750 - RNA, 19 nt, Human
ucuucccgacuccagaauc

SEQ ID NO: 331751 - RNA, 23 nt, Human
uggggcaccagccuucccaaggg

SEQ ID NO: 331752 - RNA, 19 nt, Human
uggucagaaagucagcucc

SEQ ID NO: 331753 - RNA, 23 nt, Human
uggucagaaagucagcuccuauu

SEQ ID NO: 331754 - RNA, 20 nt, Human
uguagaaggccacaccgaga

SEQ ID NO: 331755 - RNA, 23 nt, Human
uucagcaacacuuucuuccuaga

SEQ ID NO: 331756 - RNA, 25 nt, Human
aaaaagcccugcccaauuuaguacc

SEQ ID NO: 331757 - RNA, 24 nt, Human
aaagugcugggauuacagguguga

SEQ ID NO: 331758 - RNA, 20 nt, Human
aaccucugccucccagucuc

SEQ ID NO: 331759 - RNA, 22 nt, Human
aagacaucaacccagaaaccug

SEQ ID NO: 331760 - RNA, 18 nt, Human
aagacaucaacccagaac

SEQ ID NO: 331761 - RNA, 25 nt, Human
aagcgauucucccaccucagucucc

SEQ ID NO: 331762 - RNA, 19 nt, Human
aaguagcugggauuacagg

SEQ ID NO: 331763 - RNA, 21 nt, Human
aaguaggugagaauuaugauc

SEQ ID NO: 331764 - RNA, 18 nt, Human
aagugcugggauuacagg

SEQ ID NO: 331765 - RNA, 18 nt, Human
aagugcugggauuacagg

SEQ ID NO: 331766 - RNA, 19 nt, Human
aagugcugggauuacaggc

SEQ ID NO: 331767 - RNA, 21 nt, Human
aagugcugggauuacaggcau

SEQ ID NO: 331768 - RNA, 22 nt, Human
aagugcugggauuacaggcaug

SEQ ID NO: 331769 - RNA, 23 nt, Human
aagugcugggauuacaggcauga

SEQ ID NO: 331770 - RNA, 26 nt, Human
aagugcugggauuacaggcaugagcc

SEQ ID NO: 331771 - RNA, 19 nt, Human
aagugcugggauuacaggu

SEQ ID NO: 331772 - RNA, 26 nt, Human
aagugcugggauuacaggugugagcc

SEQ ID NO: 331773 - RNA, 19 nt, Human
aaucagauguuuacauucc

SEQ ID NO: 331774 - RNA, 24 nt, Human
aauggugugaucucagcucacugc

SEQ ID NO: 331775 - RNA, 18 nt, Human
acaguagucaggagacaa

SEQ ID NO: 331776 - RNA, 24 nt, Human
acccaggcugaagugcgguggcau

SEQ ID NO: 331777 - RNA, 18 nt, Human
acgggguuucaguauguu

SEQ ID NO: 331778 - RNA, 20 nt, Human
acgggguuucaguauguugg

SEQ ID NO: 331779 - RNA, 23 nt, Human
acgggguuucaguauguuggcca

SEQ ID NO: 331780 - RNA, 24 nt, Human
acgggguuucaguauguuggccag

SEQ ID NO: 331781 - RNA, 19 nt, Human
acgggguuuugccaugcug

SEQ ID NO: 331782 - RNA, 24 nt, Human
acgggguuuugccaugcugaccag

SEQ ID NO: 331783 - RNA, 24 nt, Human
acucccagguucaagugauucucc

SEQ ID NO: 331784 - RNA, 20 nt, Human
agacagaaagaaucugaaac

SEQ ID NO: 331785 - RNA, 19 nt, Human
agacggaguccuucucugu

SEQ ID NO: 331786 - RNA, 24 nt, Human
agaguuuaguaagaauaucgauaa

SEQ ID NO: 331787 - RNA, 22 nt, Human
agcucuuuguggaagaaaaugc

SEQ ID NO: 331788 - RNA, 23 nt, Human
aggagcagaccuauuucgaagca

SEQ ID NO: 331789 - RNA, 21 nt, Human
aggcaugagccaccaugcccg

SEQ ID NO: 331790 - RNA, 24 nt, Human
aggcgauccaccugccucagccuc

SEQ ID NO: 331791 - RNA, 24 nt, Human
aggcugaagcgcaauggugugauc

SEQ ID NO: 331792 - RNA, 19 nt, Human
agggcugaugagaagaucu

SEQ ID NO: 331793 - RNA, 21 nt, Human
agguucaagugauucuccugc

SEQ ID NO: 331794 - RNA, 22 nt, Human
agguucaagugauucuccugcc

SEQ ID NO: 331795 - RNA, 19 nt, Human
aguagagacgggguuucag

SEQ ID NO: 331796 - RNA, 23 nt, Human
aguagcugggauuacagacacgu

SEQ ID NO: 331797 - RNA, 24 nt, Human
agugcgguggcaugaucucgguuc

SEQ ID NO: 331798 - RNA, 18 nt, Human
agugcugggauuacaggc

SEQ ID NO: 331799 - RNA, 21 nt, Human
aucagauguuuacauuccaag

SEQ ID NO: 331800 - RNA, 19 nt, Human
auccgccugccuuggccuc

SEQ ID NO: 331801 - RNA, 18 nt, Human
aucuacuuuccuacccca

SEQ ID NO: 331802 - RNA, 18 nt, Human
aucucauuuuccucucaa

SEQ ID NO: 331803 - RNA, 18 nt, Human
aucuugaacuccugaccu

SEQ ID NO: 331804 - RNA, 21 nt, Human
augcacauggguuccaggugu

SEQ ID NO: 331805 - RNA, 19 nt, Human
auguuggccagguugaucu

SEQ ID NO: 331806 - RNA, 19 nt, Human
auuugaucucauuuuccuc

SEQ ID NO: 331807 - RNA, 19 nt, Human
caaaaauccacagaugccc

SEQ ID NO: 331808 - RNA, 24 nt, Human
caaagugcugggauuacaggugug

SEQ ID NO: 331809 - RNA, 21 nt, Human
caaccucuaacucccagguuc

SEQ ID NO: 331810 - RNA, 27 nt, Human
caagcgauucucccaccucagucucca

SEQ ID NO: 331811 - RNA, 22 nt, Human
caagugauucuccugccucagc

SEQ ID NO: 331812 - RNA, 27 nt, Human
caagugauucuccugccucagccuccc

SEQ ID NO: 331813 - RNA, 22 nt, Human
caauuuaguacuuaaauuaccu

SEQ ID NO: 331814 - RNA, 23 nt, Human
cacccaggcugaagugcgguggc

SEQ ID NO: 331815 - RNA, 24 nt, Human
caccucagucuccagaguagcugg

SEQ ID NO: 331816 - RNA, 23 nt, Human
caccugccucagccucccaaagu

SEQ ID NO: 331817 - RNA, 21 nt, Human
cacgccuggcuaauuuuugua

SEQ ID NO: 331818 - RNA, 23 nt, Human
cacgccuggcucaggacccaaaa

SEQ ID NO: 331819 - RNA, 21 nt, Human
cacugcaaccucuaacuccca

SEQ ID NO: 331820 - RNA, 18 nt, Human
cacugcaaccucugccuc

SEQ ID NO: 331821 - RNA, 21 nt, Human
cacugcaaccucugccuccca

SEQ ID NO: 331822 - RNA, 22 nt, Human
cagaaucagauguuuacauucc

SEQ ID NO: 331823 - RNA, 24 nt, Human
cagaguagcugggauuacagacac

SEQ ID NO: 331824 - RNA, 21 nt, Human
caggcgauccaccugccucag

SEQ ID NO: 331825 - RNA, 19 nt, Human
caggugcccgccaccacgc

SEQ ID NO: 331826 - RNA, 21 nt, Human
caggugcccgccaccacgccc

SEQ ID NO: 331827 - RNA, 24 nt, Human
caguauguuggccagguugaucuu

SEQ ID NO: 331828 - RNA, 23 nt, Human
caucacagccagcugaugucacu
